United States Patent 11,369,692 (MATERIALS AND METHODS FOR TREATMENT OF DUCHENNE MUSCULAR DYSTROPHY) - sequence listing, part 23

SEQ ID NO: 753869 - DNA, 22 bp, Artificial Sequence
  chemically synthesized
agattttattaataaatgtgtc

SEQ ID NO: 753870 - DNA, 22 bp, Artificial Sequence
  chemically synthesized
tattgtatgacacatttattaa

SEQ ID NO: 753871 - DNA, 22 bp, Artificial Sequence
  chemically synthesized
tatgacacatttattaataaaa

SEQ ID NO: 753872 - DNA, 22 bp, Artificial Sequence
  chemically synthesized
aatggtgaacaccgctaagatt

SEQ ID NO: 753873 - DNA, 22 bp, Artificial Sequence
  chemically synthesized
gaatggtgaacaccgctaagat

SEQ ID NO: 753874 - DNA, 22 bp, Artificial Sequence
  chemically synthesized
tgaatggtgaacaccgctaaga

SEQ ID NO: 753875 - DNA, 22 bp, Artificial Sequence
  chemically synthesized
ttgaatggtgaacaccgctaag

SEQ ID NO: 753876 - DNA, 22 bp, Artificial Sequence
  chemically synthesized
attaataaaatcttagcggtgt

SEQ ID NO: 753877 - DNA, 22 bp, Artificial Sequence
  chemically synthesized
ttaataaaatcttagcggtgtt

SEQ ID NO: 753878 - DNA, 22 bp, Artificial Sequence
  chemically synthesized
ttttgaatggtgaacaccgcta

SEQ ID NO: 753879 - DNA, 22 bp, Artificial Sequence
  chemically synthesized
ataaaatcttagcggtgttcac

SEQ ID NO: 753880 - DNA, 22 bp, Artificial Sequence
  chemically synthesized
aggattcttttgaatggtgaac

SEQ ID NO: 753881 - DNA, 22 bp, Artificial Sequence
  chemically synthesized
agcggtgttcaccattcaaaag

SEQ ID NO: 753882 - DNA, 22 bp, Artificial Sequence
  chemically synthesized
gcggtgttcaccattcaaaaga

SEQ ID NO: 753883 - DNA, 22 bp, Artificial Sequence
  chemically synthesized
caaagtatcagactcaggattc

SEQ ID NO: 753884 - DNA, 22 bp, Artificial Sequence
  chemically synthesized
accattcaaaagaatcctgagt

SEQ ID NO: 753885 - DNA, 22 bp, Artificial Sequence
  chemically synthesized
gcaaagtatcagactcaggatt

SEQ ID NO: 753886 - DNA, 22 bp, Artificial Sequence
  chemically synthesized
tgcaaagtatcagactcaggat

SEQ ID NO: 753887 - DNA, 22 bp, Artificial Sequence
  chemically synthesized
aaaagaatcctgagtctgatac

SEQ ID NO: 753888 - DNA, 22 bp, Artificial Sequence
  chemically synthesized
tggatgatgaatcattttgcaa

SEQ ID NO: 753889 - DNA, 22 bp, Artificial Sequence
  chemically synthesized
agtctgatactttgcaaaatga

SEQ ID NO: 753890 - DNA, 22 bp, Artificial Sequence
  chemically synthesized
atactttgcaaaatgattcatc

SEQ ID NO: 753891 - DNA, 22 bp, Artificial Sequence
  chemically synthesized
taaatagctgtggatgatgaat

SEQ ID NO: 753892 - DNA, 22 bp, Artificial Sequence
  chemically synthesized
tgcaaaatgattcatcatccac

SEQ ID NO: 753893 - DNA, 22 bp, Artificial Sequence
  chemically synthesized
gcaaaatgattcatcatccaca

SEQ ID NO: 753894 - DNA, 22 bp, Artificial Sequence
  chemically synthesized
caaaatgattcatcatccacag

SEQ ID NO: 753895 - DNA, 22 bp, Artificial Sequence
  chemically synthesized
aattgtaaatagctgtggatga

SEQ ID NO: 753896 - DNA, 22 bp, Artificial Sequence
  chemically synthesized
ttgaattgtaaatagctgtgga

SEQ ID NO: 753897 - DNA, 22 bp, Artificial Sequence
  chemically synthesized
tattgaattgtaaatagctgtg

SEQ ID NO: 753898 - DNA, 22 bp, Artificial Sequence
  chemically synthesized
tctattgaattgtaaatagctg

SEQ ID NO: 753899 - DNA, 22 bp, Artificial Sequence
  chemically synthesized
ctctattgaattgtaaatagct

SEQ ID NO: 753900 - DNA, 22 bp, Artificial Sequence
  chemically synthesized
tctctattgaattgtaaatagc

SEQ ID NO: 753901 - DNA, 22 bp, Artificial Sequence
  chemically synthesized
atcatccacagctatttacaat

SEQ ID NO: 753902 - DNA, 22 bp, Artificial Sequence
  chemically synthesized
cctttctctattgaattgtaaa

SEQ ID NO: 753903 - DNA, 22 bp, Artificial Sequence
  chemically synthesized
ccctttctctattgaattgtaa

SEQ ID NO: 753904 - DNA, 22 bp, Artificial Sequence
  chemically synthesized
aaacgccttccctttctctatt

SEQ ID NO: 753905 - DNA, 22 bp, Artificial Sequence
  chemically synthesized
tttacaattcaatagagaaagg

SEQ ID NO: 753906 - DNA, 22 bp, Artificial Sequence
  chemically synthesized
gttcaaacgccttccctttctc

SEQ ID NO: 753907 - DNA, 22 bp, Artificial Sequence
  chemically synthesized
acaattcaatagagaaagggaa

SEQ ID NO: 753908 - DNA, 22 bp, Artificial Sequence
  chemically synthesized
ggttcaaacgccttccctttct

SEQ ID NO: 753909 - DNA, 22 bp, Artificial Sequence
  chemically synthesized
caattcaatagagaaagggaag

SEQ ID NO: 753910 - DNA, 22 bp, Artificial Sequence
  chemically synthesized
tggttcaaacgccttccctttc

SEQ ID NO: 753911 - DNA, 22 bp, Artificial Sequence
  chemically synthesized
aatagagaaagggaaggcgttt

SEQ ID NO: 753912 - DNA, 22 bp, Artificial Sequence
  chemically synthesized
cagtattttggttcaaacgcct

SEQ ID NO: 753913 - DNA, 22 bp, Artificial Sequence
  chemically synthesized
cagaactccagtattttggttc

SEQ ID NO: 753914 - DNA, 22 bp, Artificial Sequence
  chemically synthesized
acagaactccagtattttggtt

SEQ ID NO: 753915 - DNA, 22 bp, Artificial Sequence
  chemically synthesized
cttacagaactccagtattttg

SEQ ID NO: 753916 - DNA, 22 bp, Artificial Sequence
  chemically synthesized
tacttacagaactccagtattt

SEQ ID NO: 753917 - DNA, 22 bp, Artificial Sequence
  chemically synthesized
gaaccaaaatactggagttctg

SEQ ID NO: 753918 - DNA, 22 bp, Artificial Sequence
  chemically synthesized
atattctacttacagaactcca

SEQ ID NO: 753919 - DNA, 22 bp, Artificial Sequence
  chemically synthesized
aaccaaaatactggagttctgt

SEQ ID NO: 753920 - DNA, 22 bp, Artificial Sequence
  chemically synthesized
aatcctaatattctacttacag

SEQ ID NO: 753921 - DNA, 22 bp, Artificial Sequence
  chemically synthesized
gagttctgtaagtagaatatta

SEQ ID NO: 753922 - DNA, 22 bp, Artificial Sequence
  chemically synthesized
taggctgaatcctaatattcta

SEQ ID NO: 753923 - DNA, 22 bp, Artificial Sequence
  chemically synthesized
tctgtaggctgaatcctaatat

SEQ ID NO: 753924 - DNA, 22 bp, Artificial Sequence
  chemically synthesized
tgtaagtagaatattaggattc

SEQ ID NO: 753925 - DNA, 22 bp, Artificial Sequence
  chemically synthesized
taagtagaatattaggattcag

SEQ ID NO: 753926 - DNA, 22 bp, Artificial Sequence
  chemically synthesized
cctatctgtaggctgaatccta

SEQ ID NO: 753927 - DNA, 22 bp, Artificial Sequence
  chemically synthesized
ccctatctgtaggctgaatcct

SEQ ID NO: 753928 - DNA, 22 bp, Artificial Sequence
  chemically synthesized
agaaagtacttccctatctgta

SEQ ID NO: 753929 - DNA, 22 bp, Artificial Sequence
  chemically synthesized
ggattcagcctacagataggga

SEQ ID NO: 753930 - DNA, 22 bp, Artificial Sequence
  chemically synthesized
ttcagaaagtacttccctatct

SEQ ID NO: 753931 - DNA, 22 bp, Artificial Sequence
  chemically synthesized
agcctacagatagggaagtact

SEQ ID NO: 753932 - DNA, 22 bp, Artificial Sequence
  chemically synthesized
cagatagggaagtactttctga

SEQ ID NO: 753933 - DNA, 22 bp, Artificial Sequence
  chemically synthesized
gggtacagaaatatcccattat

SEQ ID NO: 753934 - DNA, 22 bp, Artificial Sequence
  chemically synthesized
agggtacagaaatatcccatta

SEQ ID NO: 753935 - DNA, 22 bp, Artificial Sequence
  chemically synthesized
tagggtacagaaatatcccatt

SEQ ID NO: 753936 - DNA, 22 bp, Artificial Sequence
  chemically synthesized
tctgaataatgggatatttctg

SEQ ID NO: 753937 - DNA, 22 bp, Artificial Sequence
  chemically synthesized
ctgaataatgggatatttctgt

SEQ ID NO: 753938 - DNA, 22 bp, Artificial Sequence
  chemically synthesized
tgaataatgggatatttctgta

SEQ ID NO: 753939 - DNA, 22 bp, Artificial Sequence
  chemically synthesized
aataatgggatatttctgtacc

SEQ ID NO: 753940 - DNA, 22 bp, Artificial Sequence
  chemically synthesized
gcatgattttagggtacagaaa

SEQ ID NO: 753941 - DNA, 22 bp, Artificial Sequence
  chemically synthesized
acgtatctagcatgattttagg

SEQ ID NO: 753942 - DNA, 22 bp, Artificial Sequence
  chemically synthesized
ctgtaccctaaaatcatgctag

SEQ ID NO: 753943 - DNA, 22 bp, Artificial Sequence
  chemically synthesized
tgtaccctaaaatcatgctaga

SEQ ID NO: 753944 - DNA, 22 bp, Artificial Sequence
  chemically synthesized
taccctaaaatcatgctagata

SEQ ID NO: 753945 - DNA, 22 bp, Artificial Sequence
  chemically synthesized
aaatcatgctagatacgtgagt

SEQ ID NO: 753946 - DNA, 22 bp, Artificial Sequence
  chemically synthesized
tatgtaagcagagtaaataact

SEQ ID NO: 753947 - DNA, 22 bp, Artificial Sequence
  chemically synthesized
atatgtaagcagagtaaataac

SEQ ID NO: 753948 - DNA, 22 bp, Artificial Sequence
  chemically synthesized
tatatgtaagcagagtaaataa

SEQ ID NO: 753949 - DNA, 22 bp, Artificial Sequence
  chemically synthesized
gatacgtgagttatttactctg

SEQ ID NO: 753950 - DNA, 22 bp, Artificial Sequence
  chemically synthesized
tttactctgcttacatataaag

SEQ ID NO: 753951 - DNA, 22 bp, Artificial Sequence
  chemically synthesized
actctgcttacatataaagctg

SEQ ID NO: 753952 - DNA, 22 bp, Artificial Sequence
  chemically synthesized
ctctgcttacatataaagctga

SEQ ID NO: 753953 - DNA, 22 bp, Artificial Sequence
  chemically synthesized
tgcttacatataaagctgattc

SEQ ID NO: 753954 - DNA, 22 bp, Artificial Sequence
  chemically synthesized
cttacatataaagctgattctc

SEQ ID NO: 753955 - DNA, 22 bp, Artificial Sequence
  chemically synthesized
aagtgaaatatcaggagaatca

SEQ ID NO: 753956 - DNA, 22 bp, Artificial Sequence
  chemically synthesized
acatataaagctgattctcctg

SEQ ID NO: 753957 - DNA, 22 bp, Artificial Sequence
  chemically synthesized
caagtgaaatatcaggagaatc

SEQ ID NO: 753958 - DNA, 22 bp, Artificial Sequence
  chemically synthesized
catataaagctgattctcctga

SEQ ID NO: 753959 - DNA, 22 bp, Artificial Sequence
  chemically synthesized
attctcctgatatttcacttga

SEQ ID NO: 753960 - DNA, 22 bp, Artificial Sequence
  chemically synthesized
tcctgatatttcacttgaaatc

SEQ ID NO: 753961 - DNA, 22 bp, Artificial Sequence
  chemically synthesized
ctgatatttcacttgaaatctc

SEQ ID NO: 753962 - DNA, 22 bp, Artificial Sequence
  chemically synthesized
atatttcacttgaaatctccat

SEQ ID NO: 753963 - DNA, 22 bp, Artificial Sequence
  chemically synthesized
cacttgaaatctccatgtttgt

SEQ ID NO: 753964 - DNA, 22 bp, Artificial Sequence
  chemically synthesized
acttgaaatctccatgtttgtg

SEQ ID NO: 753965 - DNA, 22 bp, Artificial Sequence
  chemically synthesized
gaaatctccatgtttgtgtgtg

SEQ ID NO: 753966 - DNA, 22 bp, Artificial Sequence
  chemically synthesized
aaatctccatgtttgtgtgtgt

SEQ ID NO: 753967 - DNA, 22 bp, Artificial Sequence
  chemically synthesized
catgtttgtgtgtgtgtgtgtg

SEQ ID NO: 753968 - DNA, 22 bp, Artificial Sequence
  chemically synthesized
gtgtgtgtgtgtgtgtgtgtgt

SEQ ID NO: 753969 - DNA, 22 bp, Artificial Sequence
  chemically synthesized
tgtgtgtgtgtgtgtgtgtgtg

SEQ ID NO: 753970 - DNA, 22 bp, Artificial Sequence
  chemically synthesized
aacacacacacacacacacaca

SEQ ID NO: 753971 - DNA, 22 bp, Artificial Sequence
  chemically synthesized
tatgaaaaaaaacacaagaata

SEQ ID NO: 753972 - DNA, 22 bp, Artificial Sequence
  chemically synthesized
agttgttgtattcttgtgtttt

SEQ ID NO: 753973 - DNA, 22 bp, Artificial Sequence
  chemically synthesized
attgtatgaaaaaaaacacaag

SEQ ID NO: 753974 - DNA, 22 bp, Artificial Sequence
  chemically synthesized
aattgtatgaaaaaaaacacaa

SEQ ID NO: 753975 - DNA, 22 bp, Artificial Sequence
  chemically synthesized
ttgtattcttgtgttttttttc

SEQ ID NO: 753976 - DNA, 22 bp, Artificial Sequence
  chemically synthesized
tattcttgtgttttttttcata

SEQ ID NO: 753977 - DNA, 22 bp, Artificial Sequence
  chemically synthesized
ggaaacttaattgtatgaaaaa

SEQ ID NO: 753978 - DNA, 22 bp, Artificial Sequence
  chemically synthesized
gggaaacttaattgtatgaaaa

SEQ ID NO: 753979 - DNA, 22 bp, Artificial Sequence
  chemically synthesized
ttgtgttttttttcatacaatt

SEQ ID NO: 753980 - DNA, 22 bp, Artificial Sequence
  chemically synthesized
gtgttttttttcatacaattaa

SEQ ID NO: 753981 - DNA, 22 bp, Artificial Sequence
  chemically synthesized
aatttgggaaacttaattgtat

SEQ ID NO: 753982 - DNA, 22 bp, Artificial Sequence
  chemically synthesized
tgttttttttcatacaattaag

SEQ ID NO: 753983 - DNA, 22 bp, Artificial Sequence
  chemically synthesized
gaatttgggaaacttaattgta

SEQ ID NO: 753984 - DNA, 22 bp, Artificial Sequence
  chemically synthesized
cttgaatttgggaaacttaatt

SEQ ID NO: 753985 - DNA, 22 bp, Artificial Sequence
  chemically synthesized
acttgaatttgggaaacttaat

SEQ ID NO: 753986 - DNA, 22 bp, Artificial Sequence
  chemically synthesized
tttttcatacaattaagtttcc

SEQ ID NO: 753987 - DNA, 22 bp, Artificial Sequence
  chemically synthesized
ttttcatacaattaagtttccc

SEQ ID NO: 753988 - DNA, 22 bp, Artificial Sequence
  chemically synthesized
tttcatacaattaagtttccca

SEQ ID NO: 753989 - DNA, 22 bp, Artificial Sequence
  chemically synthesized
ttcatacaattaagtttcccaa

SEQ ID NO: 753990 - DNA, 22 bp, Artificial Sequence
  chemically synthesized
tcatacaattaagtttcccaaa

SEQ ID NO: 753991 - DNA, 22 bp, Artificial Sequence
  chemically synthesized
catacaattaagtttcccaaat

SEQ ID NO: 753992 - DNA, 22 bp, Artificial Sequence
  chemically synthesized
atacaattaagtttcccaaatt

SEQ ID NO: 753993 - DNA, 22 bp, Artificial Sequence
  chemically synthesized
agtttcccaaattcaagtaaat

SEQ ID NO: 753994 - DNA, 22 bp, Artificial Sequence
  chemically synthesized
ggcaaaatgataatttacttga

SEQ ID NO: 753995 - DNA, 22 bp, Artificial Sequence
  chemically synthesized
cccaaattcaagtaaattatca

SEQ ID NO: 753996 - DNA, 22 bp, Artificial Sequence
  chemically synthesized
ccaaattcaagtaaattatcat

SEQ ID NO: 753997 - DNA, 22 bp, Artificial Sequence
  chemically synthesized
aagtaaattatcattttgccta

SEQ ID NO: 753998 - DNA, 22 bp, Artificial Sequence
  chemically synthesized
aggtccaaacagagaaactagg

SEQ ID NO: 753999 - DNA, 22 bp, Artificial Sequence
  chemically synthesized
caggtccaaacagagaaactag

SEQ ID NO: 754000 - DNA, 22 bp, Artificial Sequence
  chemically synthesized
tcattttgcctagtttctctgt

SEQ ID NO: 754001 - DNA, 22 bp, Artificial Sequence
  chemically synthesized
ccttcaggtccaaacagagaaa

SEQ ID NO: 754002 - DNA, 22 bp, Artificial Sequence
  chemically synthesized
cctcccttcaggtccaaacaga

SEQ ID NO: 754003 - DNA, 22 bp, Artificial Sequence
  chemically synthesized
tgcctagtttctctgtttggac

SEQ ID NO: 754004 - DNA, 22 bp, Artificial Sequence
  chemically synthesized
gcctagtttctctgtttggacc

SEQ ID NO: 754005 - DNA, 22 bp, Artificial Sequence
  chemically synthesized
cctagtttctctgtttggacct

SEQ ID NO: 754006 - DNA, 22 bp, Artificial Sequence
  chemically synthesized
attgcctcccttcaggtccaaa

SEQ ID NO: 754007 - DNA, 22 bp, Artificial Sequence
  chemically synthesized
gtttctctgtttggacctgaag

SEQ ID NO: 754008 - DNA, 22 bp, Artificial Sequence
  chemically synthesized
ctctgtttggacctgaagggag

SEQ ID NO: 754009 - DNA, 22 bp, Artificial Sequence
  chemically synthesized
tctgtttggacctgaagggagg

SEQ ID NO: 754010 - DNA, 22 bp, Artificial Sequence
  chemically synthesized
tgtttggacctgaagggaggca

SEQ ID NO: 754011 - DNA, 22 bp, Artificial Sequence
  chemically synthesized
tttggacctgaagggaggcaat

SEQ ID NO: 754012 - DNA, 22 bp, Artificial Sequence
  chemically synthesized
ggacctgaagggaggcaattaa

SEQ ID NO: 754013 - DNA, 22 bp, Artificial Sequence
  chemically synthesized
gtaatgtcagtattaattgcct

SEQ ID NO: 754014 - DNA, 22 bp, Artificial Sequence
  chemically synthesized
gacctgaagggaggcaattaat

SEQ ID NO: 754015 - DNA, 22 bp, Artificial Sequence
  chemically synthesized
taattagtaatgtcagtattaa

SEQ ID NO: 754016 - DNA, 22 bp, Artificial Sequence
  chemically synthesized
aagggaggcaattaatactgac

SEQ ID NO: 754017 - DNA, 22 bp, Artificial Sequence
  chemically synthesized
ataattagtaatgtcagtatta

SEQ ID NO: 754018 - DNA, 22 bp, Artificial Sequence
  chemically synthesized
tataattagtaatgtcagtatt

SEQ ID NO: 754019 - DNA, 22 bp, Artificial Sequence
  chemically synthesized
ttataattagtaatgtcagtat

SEQ ID NO: 754020 - DNA, 22 bp, Artificial Sequence
  chemically synthesized
tttttataattagtaatgtcag

SEQ ID NO: 754021 - DNA, 22 bp, Artificial Sequence
  chemically synthesized
ttatttttataattagtaatgt

SEQ ID NO: 754022 - DNA, 22 bp, Artificial Sequence
  chemically synthesized
atactgacattactaattataa

SEQ ID NO: 754023 - DNA, 22 bp, Artificial Sequence
  chemically synthesized
acattactaattataaaaataa

SEQ ID NO: 754024 - DNA, 22 bp, Artificial Sequence
  chemically synthesized
aatagagggagccattattatt

SEQ ID NO: 754025 - DNA, 22 bp, Artificial Sequence
  chemically synthesized
ctaattataaaaataataatgg

SEQ ID NO: 754026 - DNA, 22 bp, Artificial Sequence
  chemically synthesized
attataaaaataataatggctc

SEQ ID NO: 754027 - DNA, 22 bp, Artificial Sequence
  chemically synthesized
taaaaataataatggctccctc

SEQ ID NO: 754028 - DNA, 22 bp, Artificial Sequence
  chemically synthesized
acacatggtagttcaatagagg

SEQ ID NO: 754029 - DNA, 22 bp, Artificial Sequence
  chemically synthesized
cctctattgaactaccatgtgt

SEQ ID NO: 754030 - DNA, 22 bp, Artificial Sequence
  chemically synthesized
aggtacaaccactgacacatgg

SEQ ID NO: 754031 - DNA, 22 bp, Artificial Sequence
  chemically synthesized
caggtacaaccactgacacatg

SEQ ID NO: 754032 - DNA, 22 bp, Artificial Sequence
  chemically synthesized
tattgaactaccatgtgtcagt

SEQ ID NO: 754033 - DNA, 22 bp, Artificial Sequence
  chemically synthesized
ttgaactaccatgtgtcagtgg

SEQ ID NO: 754034 - DNA, 22 bp, Artificial Sequence
  chemically synthesized
aactaccatgtgtcagtggttg

SEQ ID NO: 754035 - DNA, 22 bp, Artificial Sequence
  chemically synthesized
cagtttcaggtacaaccactga

SEQ ID NO: 754036 - DNA, 22 bp, Artificial Sequence
  chemically synthesized
ccagtttcaggtacaaccactg

SEQ ID NO: 754037 - DNA, 22 bp, Artificial Sequence
  chemically synthesized
ccatgtgtcagtggttgtacct

SEQ ID NO: 754038 - DNA, 22 bp, Artificial Sequence
  chemically synthesized
tatttccagtttcaggtacaac

SEQ ID NO: 754039 - DNA, 22 bp, Artificial Sequence
  chemically synthesized
gtatttccagtttcaggtacaa

SEQ ID NO: 754040 - DNA, 22 bp, Artificial Sequence
  chemically synthesized
tgtatttccagtttcaggtaca

SEQ ID NO: 754041 - DNA, 22 bp, Artificial Sequence
  chemically synthesized
aactttgtatttccagtttcag

SEQ ID NO: 754042 - DNA, 22 bp, Artificial Sequence
  chemically synthesized
cattcaactttgtatttccagt

SEQ ID NO: 754043 - DNA, 22 bp, Artificial Sequence
  chemically synthesized
gcattcaactttgtatttccag

SEQ ID NO: 754044 - DNA, 22 bp, Artificial Sequence
  chemically synthesized
tgcattcaactttgtatttcca

SEQ ID NO: 754045 - DNA, 22 bp, Artificial Sequence
  chemically synthesized
tacctgaaactggaaatacaaa

SEQ ID NO: 754046 - DNA, 22 bp, Artificial Sequence
  chemically synthesized
ttttgcattcaactttgtattt

SEQ ID NO: 754047 - DNA, 22 bp, Artificial Sequence
  chemically synthesized
aaactggaaatacaaagttgaa

SEQ ID NO: 754048 - DNA, 22 bp, Artificial Sequence
  chemically synthesized
gaaatacaaagttgaatgcaaa

SEQ ID NO: 754049 - DNA, 22 bp, Artificial Sequence
  chemically synthesized
aatagaaagggctgttttgcat

SEQ ID NO: 754050 - DNA, 22 bp, Artificial Sequence
  chemically synthesized
ctaaatagaaagggctgttttg

SEQ ID NO: 754051 - DNA, 22 bp, Artificial Sequence
  chemically synthesized
aatattcctaaatagaaagggc

SEQ ID NO: 754052 - DNA, 22 bp, Artificial Sequence
  chemically synthesized
aatgcaaaacagccctttctat

SEQ ID NO: 754053 - DNA, 22 bp, Artificial Sequence
  chemically synthesized
tatgttaaatattcctaaatag

SEQ ID NO: 754054 - DNA, 22 bp, Artificial Sequence
  chemically synthesized
ttatatgttaaatattcctaaa

SEQ ID NO: 754055 - DNA, 22 bp, Artificial Sequence
  chemically synthesized
tattatatgttaaatattccta

SEQ ID NO: 754056 - DNA, 22 bp, Artificial Sequence
  chemically synthesized
ctattatatgttaaatattcct

SEQ ID NO: 754057 - DNA, 22 bp, Artificial Sequence
  chemically synthesized
ttctattatatgttaaatattc

SEQ ID NO: 754058 - DNA, 22 bp, Artificial Sequence
  chemically synthesized
tctatttaggaatatttaacat

SEQ ID NO: 754059 - DNA, 22 bp, Artificial Sequence
  chemically synthesized
ctatttaggaatatttaacata

SEQ ID NO: 754060 - DNA, 22 bp, Artificial Sequence
  chemically synthesized
actcttctattatatgttaaat

SEQ ID NO: 754061 - DNA, 22 bp, Artificial Sequence
  chemically synthesized
tatttaggaatatttaacatat

SEQ ID NO: 754062 - DNA, 22 bp, Artificial Sequence
  chemically synthesized
tttaggaatatttaacatataa

SEQ ID NO: 754063 - DNA, 22 bp, Artificial Sequence
  chemically synthesized
aggaatatttaacatataatag

SEQ ID NO: 754064 - DNA, 22 bp, Artificial Sequence
  chemically synthesized
ggaatatttaacatataataga

SEQ ID NO: 754065 - DNA, 22 bp, Artificial Sequence
  chemically synthesized
cgtgtctgactcttctattata

SEQ ID NO: 754066 - DNA, 22 bp, Artificial Sequence
  chemically synthesized
acgtgtctgactcttctattat

SEQ ID NO: 754067 - DNA, 22 bp, Artificial Sequence
  chemically synthesized
tttacgtgtctgactcttctat

SEQ ID NO: 754068 - DNA, 22 bp, Artificial Sequence
  chemically synthesized
aacatataatagaagagtcaga

SEQ ID NO: 754069 - DNA, 22 bp, Artificial Sequence
  chemically synthesized
acatataatagaagagtcagac

SEQ ID NO: 754070 - DNA, 22 bp, Artificial Sequence
  chemically synthesized
aaattatttacgtgtctgactc

SEQ ID NO: 754071 - DNA, 22 bp, Artificial Sequence
  chemically synthesized
tattgaaattatttacgtgtct

SEQ ID NO: 754072 - DNA, 22 bp, Artificial Sequence
  chemically synthesized
cattgtattgaaattatttacg

SEQ ID NO: 754073 - DNA, 22 bp, Artificial Sequence
  chemically synthesized
tctacattgtattgaaattatt

SEQ ID NO: 754074 - DNA, 22 bp, Artificial Sequence
  chemically synthesized
tagcactgtctacattgtattg

SEQ ID NO: 754075 - DNA, 22 bp, Artificial Sequence
  chemically synthesized
cgcaagtctatagcactgtcta

SEQ ID NO: 754076 - DNA, 22 bp, Artificial Sequence
  chemically synthesized
caatacaatgtagacagtgcta

SEQ ID NO: 754077 - DNA, 22 bp, Artificial Sequence
  chemically synthesized
aatacaatgtagacagtgctat

SEQ ID NO: 754078 - DNA, 22 bp, Artificial Sequence
  chemically synthesized
cccatattgcgcaagtctatag

SEQ ID NO: 754079 - DNA, 22 bp, Artificial Sequence
  chemically synthesized
ccccatattgcgcaagtctata

SEQ ID NO: 754080 - DNA, 22 bp, Artificial Sequence
  chemically synthesized
ttccccatattgcgcaagtcta

SEQ ID NO: 754081 - DNA, 22 bp, Artificial Sequence
  chemically synthesized
cttccccatattgcgcaagtct

SEQ ID NO: 754082 - DNA, 22 bp, Artificial Sequence
  chemically synthesized
tcttccccatattgcgcaagtc

SEQ ID NO: 754083 - DNA, 22 bp, Artificial Sequence
  chemically synthesized
ccgattttcttccccatattgc

SEQ ID NO: 754084 - DNA, 22 bp, Artificial Sequence
  chemically synthesized
cccgattttcttccccatattg

SEQ ID NO: 754085 - DNA, 22 bp, Artificial Sequence
  chemically synthesized
tcccgattttcttccccatatt

SEQ ID NO: 754086 - DNA, 22 bp, Artificial Sequence
  chemically synthesized
tagacttgcgcaatatggggaa

SEQ ID NO: 754087 - DNA, 22 bp, Artificial Sequence
  chemically synthesized
ttcccgattttcttccccatat

SEQ ID NO: 754088 - DNA, 22 bp, Artificial Sequence
  chemically synthesized
gcgcaatatggggaagaaaatc

SEQ ID NO: 754089 - DNA, 22 bp, Artificial Sequence
  chemically synthesized
gaagcttttcccgattttcttc

SEQ ID NO: 754090 - DNA, 22 bp, Artificial Sequence
  chemically synthesized
cgcaatatggggaagaaaatcg

SEQ ID NO: 754091 - DNA, 22 bp, Artificial Sequence
  chemically synthesized
ctggaagcttttcccgattttc

SEQ ID NO: 754092 - DNA, 22 bp, Artificial Sequence
  chemically synthesized
tcctggaagcttttcccgattt

SEQ ID NO: 754093 - DNA, 22 bp, Artificial Sequence
  chemically synthesized
ctcctggaagcttttcccgatt

SEQ ID NO: 754094 - DNA, 22 bp, Artificial Sequence
  chemically synthesized
gcttctcctggaagcttttccc

SEQ ID NO: 754095 - DNA, 22 bp, Artificial Sequence
  chemically synthesized
ctagcttctcctggaagctttt

SEQ ID NO: 754096 - DNA, 22 bp, Artificial Sequence
  chemically synthesized
tgtgattactagcttctcctgg

SEQ ID NO: 754097 - DNA, 22 bp, Artificial Sequence
  chemically synthesized
tatgtgattactagcttctcct

SEQ ID NO: 754098 - DNA, 22 bp, Artificial Sequence
  chemically synthesized
aattctatgtgattactagctt

SEQ ID NO: 754099 - DNA, 22 bp, Artificial Sequence
  chemically synthesized
gaattctatgtgattactagct

SEQ ID NO: 754100 - DNA, 22 bp, Artificial Sequence
  chemically synthesized
tgaattctatgtgattactagc

SEQ ID NO: 754101 - DNA, 22 bp, Artificial Sequence
  chemically synthesized
ttgaattctatgtgattactag

SEQ ID NO: 754102 - DNA, 22 bp, Artificial Sequence
  chemically synthesized
ccaggagaagctagtaatcaca

SEQ ID NO: 754103 - DNA, 22 bp, Artificial Sequence
  chemically synthesized
caggagaagctagtaatcacat

SEQ ID NO: 754104 - DNA, 22 bp, Artificial Sequence
  chemically synthesized
atgcttttgaattctatgtgat

SEQ ID NO: 754105 - DNA, 22 bp, Artificial Sequence
  chemically synthesized
gtaatcacatagaattcaaaag

SEQ ID NO: 754106 - DNA, 22 bp, Artificial Sequence
  chemically synthesized
aataagtcatgttcatgctttt

SEQ ID NO: 754107 - DNA, 22 bp, Artificial Sequence
  chemically synthesized
gaataagtcatgttcatgcttt

SEQ ID NO: 754108 - DNA, 22 bp, Artificial Sequence
  chemically synthesized
cttgaataagtcatgttcatgc

SEQ ID NO: 754109 - DNA, 22 bp, Artificial Sequence
  chemically synthesized
ccttgaataagtcatgttcatg

SEQ ID NO: 754110 - DNA, 22 bp, Artificial Sequence
  chemically synthesized
ttccttgaataagtcatgttca

SEQ ID NO: 754111 - DNA, 22 bp, Artificial Sequence
  chemically synthesized
aaaagcatgaacatgacttatt

SEQ ID NO: 754112 - DNA, 22 bp, Artificial Sequence
  chemically synthesized
gcatactcttccttgaataagt

SEQ ID NO: 754113 - DNA, 22 bp, Artificial Sequence
  chemically synthesized
tagcatactcttccttgaataa

SEQ ID NO: 754114 - DNA, 22 bp, Artificial Sequence
  chemically synthesized
tctagcatactcttccttgaat

SEQ ID NO: 754115 - DNA, 22 bp, Artificial Sequence
  chemically synthesized
gaatgttctctagcatactctt

SEQ ID NO: 754116 - DNA, 22 bp, Artificial Sequence
  chemically synthesized
ggaatgttctctagcatactct

SEQ ID NO: 754117 - DNA, 22 bp, Artificial Sequence
  chemically synthesized
ttggaatgttctctagcatact

SEQ ID NO: 754118 - DNA, 22 bp, Artificial Sequence
  chemically synthesized
attcaaggaagagtatgctaga

SEQ ID NO: 754119 - DNA, 22 bp, Artificial Sequence
  chemically synthesized
cttggaatgttctctagcatac

SEQ ID NO: 754120 - DNA, 22 bp, Artificial Sequence
  chemically synthesized
ttcaaggaagagtatgctagag

SEQ ID NO: 754121 - DNA, 22 bp, Artificial Sequence
  chemically synthesized
ttcttggaatgttctctagcat

SEQ ID NO: 754122 - DNA, 22 bp, Artificial Sequence
  chemically synthesized
aaggaagagtatgctagagaac

SEQ ID NO: 754123 - DNA, 22 bp, Artificial Sequence
  chemically synthesized
ctcttcttggaatgttctctag

SEQ ID NO: 754124 - DNA, 22 bp, Artificial Sequence
  chemically synthesized
cctcttcttggaatgttctcta

SEQ ID NO: 754125 - DNA, 22 bp, Artificial Sequence
  chemically synthesized
tcctcttcttggaatgttctct

SEQ ID NO: 754126 - DNA, 22 bp, Artificial Sequence
  chemically synthesized
cattttcctcttcttggaatgt

SEQ ID NO: 754127 - DNA, 22 bp, Artificial Sequence
  chemically synthesized
gcattttcctcttcttggaatg

SEQ ID NO: 754128 - DNA, 22 bp, Artificial Sequence
  chemically synthesized
cacttgcattttcctcttcttg

SEQ ID NO: 754129 - DNA, 22 bp, Artificial Sequence
  chemically synthesized
gagaacattccaagaagaggaa

SEQ ID NO: 754130 - DNA, 22 bp, Artificial Sequence
  chemically synthesized
tgcacttgcattttcctcttct

SEQ ID NO: 754131 - DNA, 22 bp, Artificial Sequence
  chemically synthesized
tgactctgcacttgcattttcc

SEQ ID NO: 754132 - DNA, 22 bp, Artificial Sequence
  chemically synthesized
caagaagaggaaaatgcaagtg

SEQ ID NO: 754133 - DNA, 22 bp, Artificial Sequence
  chemically synthesized
tgtcctatgactctgcacttgc

SEQ ID NO: 754134 - DNA, 22 bp, Artificial Sequence
  chemically synthesized
cactatgtcctatgactctgca

SEQ ID NO: 754135 - DNA, 22 bp, Artificial Sequence
  chemically synthesized
cgatacataccatactgcacta

SEQ ID NO: 754136 - DNA, 22 bp, Artificial Sequence
  chemically synthesized
agattccgatacataccatact

SEQ ID NO: 754137 - DNA, 22 bp, Artificial Sequence
  chemically synthesized
gagattccgatacataccatac

SEQ ID NO: 754138 - DNA, 22 bp, Artificial Sequence
  chemically synthesized
cttgagattccgatacatacca

SEQ ID NO: 754139 - DNA, 22 bp, Artificial Sequence
  chemically synthesized
gcctgcttgagattccgataca

SEQ ID NO: 754140 - DNA, 22 bp, Artificial Sequence
  chemically synthesized
gaaacactggcctgcttgagat

SEQ ID NO: 754141 - DNA, 22 bp, Artificial Sequence
  chemically synthesized
tagaaacactggcctgcttgag

SEQ ID NO: 754142 - DNA, 22 bp, Artificial Sequence
  chemically synthesized
tgctctagaaacactggcctgc

SEQ ID NO: 754143 - DNA, 22 bp, Artificial Sequence
  chemically synthesized
atgctctagaaacactggcctg

SEQ ID NO: 754144 - DNA, 22 bp, Artificial Sequence
  chemically synthesized
tatgctctagaaacactggcct

SEQ ID NO: 754145 - DNA, 22 bp, Artificial Sequence
  chemically synthesized
tttatgctctagaaacactggc

SEQ ID NO: 754146 - DNA, 22 bp, Artificial Sequence
  chemically synthesized
ttctttatgctctagaaacact

SEQ ID NO: 754147 - DNA, 22 bp, Artificial Sequence
  chemically synthesized
gttctttatgctctagaaacac

SEQ ID NO: 754148 - DNA, 22 bp, Artificial Sequence
  chemically synthesized
aagcaggccagtgtttctagag

SEQ ID NO: 754149 - DNA, 22 bp, Artificial Sequence
  chemically synthesized
cttgttctttatgctctagaaa

SEQ ID NO: 754150 - DNA, 22 bp, Artificial Sequence
  chemically synthesized
tccttgttctttatgctctaga

SEQ ID NO: 754151 - DNA, 22 bp, Artificial Sequence
  chemically synthesized
gacatgccctctccttgttctt

SEQ ID NO: 754152 - DNA, 22 bp, Artificial Sequence
  chemically synthesized
ggacatgccctctccttgttct

SEQ ID NO: 754153 - DNA, 22 bp, Artificial Sequence
  chemically synthesized
ctagagcataaagaacaaggag

SEQ ID NO: 754154 - DNA, 22 bp, Artificial Sequence
  chemically synthesized
tggacatgccctctccttgttc

SEQ ID NO: 754155 - DNA, 22 bp, Artificial Sequence
  chemically synthesized
tagagcataaagaacaaggaga

SEQ ID NO: 754156 - DNA, 22 bp, Artificial Sequence
  chemically synthesized
gagcataaagaacaaggagagg

SEQ ID NO: 754157 - DNA, 22 bp, Artificial Sequence
  chemically synthesized
atctttggacatgccctctcct

SEQ ID NO: 754158 - DNA, 22 bp, Artificial Sequence
  chemically synthesized
catctttggacatgccctctcc

SEQ ID NO: 754159 - DNA, 22 bp, Artificial Sequence
  chemically synthesized
tcatctttggacatgccctctc

SEQ ID NO: 754160 - DNA, 22 bp, Artificial Sequence
  chemically synthesized
ttcatctttggacatgccctct

SEQ ID NO: 754161 - DNA, 22 bp, Artificial Sequence
  chemically synthesized
tttcatctttggacatgccctc

SEQ ID NO: 754162 - DNA, 22 bp, Artificial Sequence
  chemically synthesized
cagatagcaatagtgtcttttt

SEQ ID NO: 754163 - DNA, 22 bp, Artificial Sequence
  chemically synthesized
ccagatagcaatagtgtctttt

SEQ ID NO: 754164 - DNA, 22 bp, Artificial Sequence
  chemically synthesized
atgtatttccagatagcaatag

SEQ ID NO: 754165 - DNA, 22 bp, Artificial Sequence
  chemically synthesized
aaaatctaatgtatttccagat

SEQ ID NO: 754166 - DNA, 22 bp, Artificial Sequence
  chemically synthesized
aaaaatctaatgtatttccaga

SEQ ID NO: 754167 - DNA, 22 bp, Artificial Sequence
  chemically synthesized
gtttaaaaatctaatgtatttc

SEQ ID NO: 754168 - DNA, 22 bp, Artificial Sequence
  chemically synthesized
ttgctatctggaaatacattag

SEQ ID NO: 754169 - DNA, 22 bp, Artificial Sequence
  chemically synthesized
tggtttaaaaatctaatgtatt

SEQ ID NO: 754170 - DNA, 22 bp, Artificial Sequence
  chemically synthesized
ctatctggaaatacattagatt

SEQ ID NO: 754171 - DNA, 22 bp, Artificial Sequence
  chemically synthesized
tctggaaatacattagattttt

SEQ ID NO: 754172 - DNA, 22 bp, Artificial Sequence
  chemically synthesized
aaattctggtttaaaaatctaa

SEQ ID NO: 754173 - DNA, 22 bp, Artificial Sequence
  chemically synthesized
caaattctggtttaaaaatcta

SEQ ID NO: 754174 - DNA, 22 bp, Artificial Sequence
  chemically synthesized
gaaatacattagatttttaaac

SEQ ID NO: 754175 - DNA, 22 bp, Artificial Sequence
  chemically synthesized
gatttttaaaccagaatttgaa

SEQ ID NO: 754176 - DNA, 22 bp, Artificial Sequence
  chemically synthesized
ttaaaccagaatttgaagctct

SEQ ID NO: 754177 - DNA, 22 bp, Artificial Sequence
  chemically synthesized
taaaccagaatttgaagctctg

SEQ ID NO: 754178 - DNA, 22 bp, Artificial Sequence
  chemically synthesized
aaaccagaatttgaagctctgc

SEQ ID NO: 754179 - DNA, 22 bp, Artificial Sequence
  chemically synthesized
aaccagaatttgaagctctgcc

SEQ ID NO: 754180 - DNA, 22 bp, Artificial Sequence
  chemically synthesized
gaagctctgcctctctatgatc

SEQ ID NO: 754181 - DNA, 22 bp, Artificial Sequence
  chemically synthesized
aagctctgcctctctatgatca

SEQ ID NO: 754182 - DNA, 22 bp, Artificial Sequence
  chemically synthesized
gtggaccatatgtgatcataga

SEQ ID NO: 754183 - DNA, 22 bp, Artificial Sequence
  chemically synthesized
agtggaccatatgtgatcatag

SEQ ID NO: 754184 - DNA, 22 bp, Artificial Sequence
  chemically synthesized
ttagtggaccatatgtgatcat

SEQ ID NO: 754185 - DNA, 22 bp, Artificial Sequence
  chemically synthesized
tgcctctctatgatcacatatg

SEQ ID NO: 754186 - DNA, 22 bp, Artificial Sequence
  chemically synthesized
cctctctatgatcacatatggt

SEQ ID NO: 754187 - DNA, 22 bp, Artificial Sequence
  chemically synthesized
agcctcttagtggaccatatgt

SEQ ID NO: 754188 - DNA, 22 bp, Artificial Sequence
  chemically synthesized
tctatgatcacatatggtccac

SEQ ID NO: 754189 - DNA, 22 bp, Artificial Sequence
  chemically synthesized
tatgatcacatatggtccacta

SEQ ID NO: 754190 - DNA, 22 bp, Artificial Sequence
  chemically synthesized
tgatcacatatggtccactaag

SEQ ID NO: 754191 - DNA, 22 bp, Artificial Sequence
  chemically synthesized
aaggcaacacctaagcctctta

SEQ ID NO: 754192 - DNA, 22 bp, Artificial Sequence
  chemically synthesized
caaggcaacacctaagcctctt

SEQ ID NO: 754193 - DNA, 22 bp, Artificial Sequence
  chemically synthesized
ccttcaaggcaacacctaagcc

SEQ ID NO: 754194 - DNA, 22 bp, Artificial Sequence
  chemically synthesized
attaccttcaaggcaacaccta

SEQ ID NO: 754195 - DNA, 22 bp, Artificial Sequence
  chemically synthesized
ctgattaccttcaaggcaacac

SEQ ID NO: 754196 - DNA, 22 bp, Artificial Sequence
  chemically synthesized
agaggcttaggtgttgccttga

SEQ ID NO: 754197 - DNA, 22 bp, Artificial Sequence
  chemically synthesized
aaaggttcctgattaccttcaa

SEQ ID NO: 754198 - DNA, 22 bp, Artificial Sequence
  chemically synthesized
aggtgttgccttgaaggtaatc

SEQ ID NO: 754199 - DNA, 22 bp, Artificial Sequence
  chemically synthesized
ggtgttgccttgaaggtaatca

SEQ ID NO: 754200 - DNA, 22 bp, Artificial Sequence
  chemically synthesized
aaaccgttcaaaggttcctgat

SEQ ID NO: 754201 - DNA, 22 bp, Artificial Sequence
  chemically synthesized
ccttgaaggtaatcaggaacct

SEQ ID NO: 754202 - DNA, 22 bp, Artificial Sequence
  chemically synthesized
gttaaaaccgttcaaaggttcc

SEQ ID NO: 754203 - DNA, 22 bp, Artificial Sequence
  chemically synthesized
gaaggtaatcaggaacctttga

SEQ ID NO: 754204 - DNA, 22 bp, Artificial Sequence
  chemically synthesized
ggttaaaaccgttcaaaggttc

SEQ ID NO: 754205 - DNA, 22 bp, Artificial Sequence
  chemically synthesized
aaggtaatcaggaacctttgaa

SEQ ID NO: 754206 - DNA, 22 bp, Artificial Sequence
  chemically synthesized
ccttggttaaaaccgttcaaag

SEQ ID NO: 754207 - DNA, 22 bp, Artificial Sequence
  chemically synthesized
tgccactcccttggttaaaacc

SEQ ID NO: 754208 - DNA, 22 bp, Artificial Sequence
  chemically synthesized
ctgtgccactcccttggttaaa

SEQ ID NO: 754209 - DNA, 22 bp, Artificial Sequence
  chemically synthesized
tgaacggttttaaccaagggag

SEQ ID NO: 754210 - DNA, 22 bp, Artificial Sequence
  chemically synthesized
gaacggttttaaccaagggagt

SEQ ID NO: 754211 - DNA, 22 bp, Artificial Sequence
  chemically synthesized
aacggttttaaccaagggagtg

SEQ ID NO: 754212 - DNA, 22 bp, Artificial Sequence
  chemically synthesized
taaccaagggagtggcacagga

SEQ ID NO: 754213 - DNA, 22 bp, Artificial Sequence
  chemically synthesized
aagcacacatattcctgtgcca

SEQ ID NO: 754214 - DNA, 22 bp, Artificial Sequence
  chemically synthesized
aaccaagggagtggcacaggaa

SEQ ID NO: 754215 - DNA, 22 bp, Artificial Sequence
  chemically synthesized
gaagcacacatattcctgtgcc

SEQ ID NO: 754216 - DNA, 22 bp, Artificial Sequence
  chemically synthesized
accaagggagtggcacaggaat

SEQ ID NO: 754217 - DNA, 22 bp, Artificial Sequence
  chemically synthesized
tttgaagcacacatattcctgt

SEQ ID NO: 754218 - DNA, 22 bp, Artificial Sequence
  chemically synthesized
tatcaggaagatctatttgaag

SEQ ID NO: 754219 - DNA, 22 bp, Artificial Sequence
  chemically synthesized
atatcaggaagatctatttgaa

SEQ ID NO: 754220 - DNA, 22 bp, Artificial Sequence
  chemically synthesized
tatttatatcaggaagatctat

SEQ ID NO: 754221 - DNA, 22 bp, Artificial Sequence
  chemically synthesized
tgtatttatatcaggaagatct

SEQ ID NO: 754222 - DNA, 22 bp, Artificial Sequence
  chemically synthesized
caaatagatcttcctgatataa

SEQ ID NO: 754223 - DNA, 22 bp, Artificial Sequence
  chemically synthesized
aaatagatcttcctgatataaa

SEQ ID NO: 754224 - DNA, 22 bp, Artificial Sequence
  chemically synthesized
aaatacatactctgtatttata

SEQ ID NO: 754225 - DNA, 22 bp, Artificial Sequence
  chemically synthesized
tcaaatacatactctgtattta

SEQ ID NO: 754226 - DNA, 22 bp, Artificial Sequence
  chemically synthesized
ctcaaatacatactctgtattt

SEQ ID NO: 754227 - DNA, 22 bp, Artificial Sequence
  chemically synthesized
ttctcaaatacatactctgtat

SEQ ID NO: 754228 - DNA, 22 bp, Artificial Sequence
  chemically synthesized
cctgatataaatacagagtatg

SEQ ID NO: 754229 - DNA, 22 bp, Artificial Sequence
  chemically synthesized
ctgatataaatacagagtatgt

SEQ ID NO: 754230 - DNA, 22 bp, Artificial Sequence
  chemically synthesized
ttcttctcaaatacatactctg

SEQ ID NO: 754231 - DNA, 22 bp, Artificial Sequence
  chemically synthesized
tgttcttctcaaatacatactc

SEQ ID NO: 754232 - DNA, 22 bp, Artificial Sequence
  chemically synthesized
atataaatacagagtatgtatt

SEQ ID NO: 754233 - DNA, 22 bp, Artificial Sequence
  chemically synthesized
ctgttcttctcaaatacatact

SEQ ID NO: 754234 - DNA, 22 bp, Artificial Sequence
  chemically synthesized
catttctgttcttctcaaatac

SEQ ID NO: 754235 - DNA, 22 bp, Artificial Sequence
  chemically synthesized
attccatttctgttcttctcaa

SEQ ID NO: 754236 - DNA, 22 bp, Artificial Sequence
  chemically synthesized
tgattccatttctgttcttctc

SEQ ID NO: 754237 - DNA, 22 bp, Artificial Sequence
  chemically synthesized
tctgattccatttctgttcttc

SEQ ID NO: 754238 - DNA, 22 bp, Artificial Sequence
  chemically synthesized
tctctctgattccatttctgtt

SEQ ID NO: 754239 - DNA, 22 bp, Artificial Sequence
  chemically synthesized
attatctctctgattccatttc

SEQ ID NO: 754240 - DNA, 22 bp, Artificial Sequence
  chemically synthesized
gagaagaacagaaatggaatca

SEQ ID NO: 754241 - DNA, 22 bp, Artificial Sequence
  chemically synthesized
agaagaacagaaatggaatcag

SEQ ID NO: 754242 - DNA, 22 bp, Artificial Sequence
  chemically synthesized
cctcattatctctctgattcca

SEQ ID NO: 754243 - DNA, 22 bp, Artificial Sequence
  chemically synthesized
caattgcctcattatctctctg

SEQ ID NO: 754244 - DNA, 22 bp, Artificial Sequence
  chemically synthesized
acaattgcctcattatctctct

SEQ ID NO: 754245 - DNA, 22 bp, Artificial Sequence
  chemically synthesized
ttacaattgcctcattatctct

SEQ ID NO: 754246 - DNA, 22 bp, Artificial Sequence
  chemically synthesized
aattcttacaattgcctcatta

SEQ ID NO: 754247 - DNA, 22 bp, Artificial Sequence
  chemically synthesized
cactgaattcttacaattgcct

SEQ ID NO: 754248 - DNA, 22 bp, Artificial Sequence
  chemically synthesized
gcactgaattcttacaattgcc

SEQ ID NO: 754249 - DNA, 22 bp, Artificial Sequence
  chemically synthesized
ataatcttgcactgaattctta

SEQ ID NO: 754250 - DNA, 22 bp, Artificial Sequence
  chemically synthesized
taagaattcagtgcaagattat

SEQ ID NO: 754251 - DNA, 22 bp, Artificial Sequence
  chemically synthesized
agtcaaatcctcataatcttgc

SEQ ID NO: 754252 - DNA, 22 bp, Artificial Sequence
  chemically synthesized
ccctgagtcaaatcctcataat

SEQ ID NO: 754253 - DNA, 22 bp, Artificial Sequence
  chemically synthesized
agtgcaagattatgaggatttg

SEQ ID NO: 754254 - DNA, 22 bp, Artificial Sequence
  chemically synthesized
gtaccattgccctgagtcaaat

SEQ ID NO: 754255 - DNA, 22 bp, Artificial Sequence
  chemically synthesized
ctggtaccattgccctgagtca

SEQ ID NO: 754256 - DNA, 22 bp, Artificial Sequence
  chemically synthesized
cctggtaccattgccctgagtc

SEQ ID NO: 754257 - DNA, 22 bp, Artificial Sequence
  chemically synthesized
tcctggtaccattgccctgagt

SEQ ID NO: 754258 - DNA, 22 bp, Artificial Sequence
  chemically synthesized
ttcctggtaccattgccctgag

SEQ ID NO: 754259 - DNA, 22 bp, Artificial Sequence
  chemically synthesized
tgaggatttgactcagggcaat

SEQ ID NO: 754260 - DNA, 22 bp, Artificial Sequence
  chemically synthesized
tcatttttcctggtaccattgc

SEQ ID NO: 754261 - DNA, 22 bp, Artificial Sequence
  chemically synthesized
gactcagggcaatggtaccagg

SEQ ID NO: 754262 - DNA, 22 bp, Artificial Sequence
  chemically synthesized
actcagggcaatggtaccagga

SEQ ID NO: 754263 - DNA, 22 bp, Artificial Sequence
  chemically synthesized
tccctgtcatttttcctggtac

SEQ ID NO: 754264 - DNA, 22 bp, Artificial Sequence
  chemically synthesized
agggcaatggtaccaggaaaaa

SEQ ID NO: 754265 - DNA, 22 bp, Artificial Sequence
  chemically synthesized
tcctatccctgtcatttttcct

SEQ ID NO: 754266 - DNA, 22 bp, Artificial Sequence
  chemically synthesized
cctatcctatccctgtcatttt

SEQ ID NO: 754267 - DNA, 22 bp, Artificial Sequence
  chemically synthesized
ccctatcctatccctgtcattt

SEQ ID NO: 754268 - DNA, 22 bp, Artificial Sequence
  chemically synthesized
gacatttccctatcctatccct

SEQ ID NO: 754269 - DNA, 22 bp, Artificial Sequence
  chemically synthesized
agacatttccctatcctatccc

SEQ ID NO: 754270 - DNA, 22 bp, Artificial Sequence
  chemically synthesized
tagacatttccctatcctatcc

SEQ ID NO: 754271 - DNA, 22 bp, Artificial Sequence
  chemically synthesized
ttagacatttccctatcctatc

SEQ ID NO: 754272 - DNA, 22 bp, Artificial Sequence
  chemically synthesized
agatttttagacatttccctat

SEQ ID NO: 754273 - DNA, 22 bp, Artificial Sequence
  chemically synthesized
cagatttttagacatttcccta

SEQ ID NO: 754274 - DNA, 22 bp, Artificial Sequence
  chemically synthesized
acacttcagatttttagacatt

SEQ ID NO: 754275 - DNA, 22 bp, Artificial Sequence
  chemically synthesized
cacacttcagatttttagacat

SEQ ID NO: 754276 - DNA, 22 bp, Artificial Sequence
  chemically synthesized
tcacacttcagatttttagaca

SEQ ID NO: 754277 - DNA, 22 bp, Artificial Sequence
  chemically synthesized
agtcaccaaattttcacacttc

SEQ ID NO: 754278 - DNA, 22 bp, Artificial Sequence
  chemically synthesized
ttcagtcaccaaattttcacac

SEQ ID NO: 754279 - DNA, 22 bp, Artificial Sequence
  chemically synthesized
aaaatctgaagtgtgaaaattt

SEQ ID NO: 754280 - DNA, 22 bp, Artificial Sequence
  chemically synthesized
cagcatctattcagtcaccaaa

SEQ ID NO: 754281 - DNA, 22 bp, Artificial Sequence
  chemically synthesized
aagtgtgaaaatttggtgactg

SEQ ID NO: 754282 - DNA, 22 bp, Artificial Sequence
  chemically synthesized
tccagcatctattcagtcacca

SEQ ID NO: 754283 - DNA, 22 bp, Artificial Sequence
  chemically synthesized
tctccagcatctattcagtcac

SEQ ID NO: 754284 - DNA, 22 bp, Artificial Sequence
  chemically synthesized
ctctccagcatctattcagtca

SEQ ID NO: 754285 - DNA, 22 bp, Artificial Sequence
  chemically synthesized
ttctctccagcatctattcagt

SEQ ID NO: 754286 - DNA, 22 bp, Artificial Sequence
  chemically synthesized
tcttctctccagcatctattca

SEQ ID NO: 754287 - DNA, 22 bp, Artificial Sequence
  chemically synthesized
tctcttctctccagcatctatt

SEQ ID NO: 754288 - DNA, 22 bp, Artificial Sequence
  chemically synthesized
ctctcttctctccagcatctat

SEQ ID NO: 754289 - DNA, 22 bp, Artificial Sequence
  chemically synthesized
tctctcttctctccagcatcta

SEQ ID NO: 754290 - DNA, 22 bp, Artificial Sequence
  chemically synthesized
ttctctcttctctccagcatct

SEQ ID NO: 754291 - DNA, 22 bp, Artificial Sequence
  chemically synthesized
ggtgactgaatagatgctggag

SEQ ID NO: 754292 - DNA, 22 bp, Artificial Sequence
  chemically synthesized
tttctctcttctctccagcatc

SEQ ID NO: 754293 - DNA, 22 bp, Artificial Sequence
  chemically synthesized
gtgactgaatagatgctggaga

SEQ ID NO: 754294 - DNA, 22 bp, Artificial Sequence
  chemically synthesized
tttttctctcttctctccagca

SEQ ID NO: 754295 - DNA, 22 bp, Artificial Sequence
  chemically synthesized
ctttttctctcttctctccagc

SEQ ID NO: 754296 - DNA, 22 bp, Artificial Sequence
  chemically synthesized
tttctttttctctcttctctcc

SEQ ID NO: 754297 - DNA, 22 bp, Artificial Sequence
  chemically synthesized
gtttctttttctctcttctctc

SEQ ID NO: 754298 - DNA, 22 bp, Artificial Sequence
  chemically synthesized
aatagatgctggagagaagaga

SEQ ID NO: 754299 - DNA, 22 bp, Artificial Sequence
  chemically synthesized
ttgtttctttttctctcttctc

SEQ ID NO: 754300 - DNA, 22 bp, Artificial Sequence
  chemically synthesized
gagagaagagagaaaaagaaac

SEQ ID NO: 754301 - DNA, 22 bp, Artificial Sequence
  chemically synthesized
agtgtcattcttgtttcttttt

SEQ ID NO: 754302 - DNA, 22 bp, Artificial Sequence
  chemically synthesized
gacactaagtgtcattcttgtt

SEQ ID NO: 754303 - DNA, 22 bp, Artificial Sequence
  chemically synthesized
aacctagacactaagtgtcatt

SEQ ID NO: 754304 - DNA, 22 bp, Artificial Sequence
  chemically synthesized
ctcaacctagacactaagtgtc

SEQ ID NO: 754305 - DNA, 22 bp, Artificial Sequence
  chemically synthesized
atctactcaacctagacactaa

SEQ ID NO: 754306 - DNA, 22 bp, Artificial Sequence
  chemically synthesized
ctcatctactcaacctagacac

SEQ ID NO: 754307 - DNA, 22 bp, Artificial Sequence
  chemically synthesized
gctcatctactcaacctagaca

SEQ ID NO: 754308 - DNA, 22 bp, Artificial Sequence
  chemically synthesized
agtgtctaggttgagtagatga

SEQ ID NO: 754309 - DNA, 22 bp, Artificial Sequence
  chemically synthesized
gtgtctaggttgagtagatgag

SEQ ID NO: 754310 - DNA, 22 bp, Artificial Sequence
  chemically synthesized
cacccagcgtttgctcatctac

SEQ ID NO: 754311 - DNA, 22 bp, Artificial Sequence
  chemically synthesized
aattgcacccagcgtttgctca

SEQ ID NO: 754312 - DNA, 22 bp, Artificial Sequence
  chemically synthesized
ggttgagtagatgagcaaacgc

SEQ ID NO: 754313 - DNA, 22 bp, Artificial Sequence
  chemically synthesized
gttgaattgcacccagcgtttg

SEQ ID NO: 754314 - DNA, 22 bp, Artificial Sequence
  chemically synthesized
agttgaattgcacccagcgttt

SEQ ID NO: 754315 - DNA, 22 bp, Artificial Sequence
  chemically synthesized
agtagatgagcaaacgctgggt

SEQ ID NO: 754316 - DNA, 22 bp, Artificial Sequence
  chemically synthesized
atacttagttgaattgcaccca

SEQ ID NO: 754317 - DNA, 22 bp, Artificial Sequence
  chemically synthesized
ctcatacttagttgaattgcac

SEQ ID NO: 754318 - DNA, 22 bp, Artificial Sequence
  chemically synthesized
cctcatacttagttgaattgca

SEQ ID NO: 754319 - DNA, 22 bp, Artificial Sequence
  chemically synthesized
tttcctcatacttagttgaatt

SEQ ID NO: 754320 - DNA, 22 bp, Artificial Sequence
  chemically synthesized
atttcctcatacttagttgaat

SEQ ID NO: 754321 - DNA, 22 bp, Artificial Sequence
  chemically synthesized
ggtgcaattcaactaagtatga

SEQ ID NO: 754322 - DNA, 22 bp, Artificial Sequence
  chemically synthesized
aactaagtatgaggaaataaac

SEQ ID NO: 754323 - DNA, 22 bp, Artificial Sequence
  chemically synthesized
agacatccaggaaagtttattt

SEQ ID NO: 754324 - DNA, 22 bp, Artificial Sequence
  chemically synthesized
agtatgaggaaataaactttcc

SEQ ID NO: 754325 - DNA, 22 bp, Artificial Sequence
  chemically synthesized
taggtgaactgagacatccagg

SEQ ID NO: 754326 - DNA, 22 bp, Artificial Sequence
  chemically synthesized
tgtaggtgaactgagacatcca

SEQ ID NO: 754327 - DNA, 22 bp, Artificial Sequence
  chemically synthesized
ctgtaggtgaactgagacatcc

SEQ ID NO: 754328 - DNA, 22 bp, Artificial Sequence
  chemically synthesized
tctgtaggtgaactgagacatc

SEQ ID NO: 754329 - DNA, 22 bp, Artificial Sequence
  chemically synthesized
gagctttctgtaggtgaactga

SEQ ID NO: 754330 - DNA, 22 bp, Artificial Sequence
  chemically synthesized
tcctggatgtctcagttcacct

SEQ ID NO: 754331 - DNA, 22 bp, Artificial Sequence
  chemically synthesized
cctggatgtctcagttcaccta

SEQ ID NO: 754332 - DNA, 22 bp, Artificial Sequence
  chemically synthesized
ctggatgtctcagttcacctac

SEQ ID NO: 754333 - DNA, 22 bp, Artificial Sequence
  chemically synthesized
gatgtctcagttcacctacaga

SEQ ID NO: 754334 - DNA, 22 bp, Artificial Sequence
  chemically synthesized
aggaggctagagctttctgtag

SEQ ID NO: 754335 - DNA, 22 bp, Artificial Sequence
  chemically synthesized
tcaggaggctagagctttctgt

SEQ ID NO: 754336 - DNA, 22 bp, Artificial Sequence
  chemically synthesized
ctcaggaggctagagctttctg

SEQ ID NO: 754337 - DNA, 22 bp, Artificial Sequence
  chemically synthesized
agttcacctacagaaagctcta

SEQ ID NO: 754338 - DNA, 22 bp, Artificial Sequence
  chemically synthesized
acctacagaaagctctagcctc

SEQ ID NO: 754339 - DNA, 22 bp, Artificial Sequence
  chemically synthesized
cagaaagctctagcctcctgag

SEQ ID NO: 754340 - DNA, 22 bp, Artificial Sequence
  chemically synthesized
catggtgtgggaagtttctcag

SEQ ID NO: 754341 - DNA, 22 bp, Artificial Sequence
  chemically synthesized
tagcctcctgagaaacttccca

SEQ ID NO: 754342 - DNA, 22 bp, Artificial Sequence
  chemically synthesized
atctccatggtgtgggaagttt

SEQ ID NO: 754343 - DNA, 22 bp, Artificial Sequence
  chemically synthesized
gcctcctgagaaacttcccaca

SEQ ID NO: 754344 - DNA, 22 bp, Artificial Sequence
  chemically synthesized
ctgagaaacttcccacaccatg

SEQ ID NO: 754345 - DNA, 22 bp, Artificial Sequence
  chemically synthesized
cagatctaatctccatggtgtg

SEQ ID NO: 754346 - DNA, 22 bp, Artificial Sequence
  chemically synthesized
agaaacttcccacaccatggag

SEQ ID NO: 754347 - DNA, 22 bp, Artificial Sequence
  chemically synthesized
ctacagatctaatctccatggt

SEQ ID NO: 754348 - DNA, 22 bp, Artificial Sequence
  chemically synthesized
cccacaccatggagattagatc

SEQ ID NO: 754349 - DNA, 22 bp, Artificial Sequence
  chemically synthesized
ccacaccatggagattagatct

SEQ ID NO: 754350 - DNA, 22 bp, Artificial Sequence
  chemically synthesized
gacaaattgctacagatctaat

SEQ ID NO: 754351 - DNA, 22 bp, Artificial Sequence
  chemically synthesized
gatctgtagcaatttgtctagt

SEQ ID NO: 754352 - DNA, 22 bp, Artificial Sequence
  chemically synthesized
gatcagagaaatgaactagaca

SEQ ID NO: 754353 - DNA, 22 bp, Artificial Sequence
  chemically synthesized
ggatcagagaaatgaactagac

SEQ ID NO: 754354 - DNA, 22 bp, Artificial Sequence
  chemically synthesized
ttggatcagagaaatgaactag

SEQ ID NO: 754355 - DNA, 22 bp, Artificial Sequence
  chemically synthesized
tagcaatttgtctagttcattt

SEQ ID NO: 754356 - DNA, 22 bp, Artificial Sequence
  chemically synthesized
accctcttggatcagagaaatg

SEQ ID NO: 754357 - DNA, 22 bp, Artificial Sequence
  chemically synthesized
gaccctcttggatcagagaaat

SEQ ID NO: 754358 - DNA, 22 bp, Artificial Sequence
  chemically synthesized
gtctagttcatttctctgatcc

SEQ ID NO: 754359 - DNA, 22 bp, Artificial Sequence
  chemically synthesized
tctagttcatttctctgatcca

SEQ ID NO: 754360 - DNA, 22 bp, Artificial Sequence
  chemically synthesized
gttcatttctctgatccaagag

SEQ ID NO: 754361 - DNA, 22 bp, Artificial Sequence
  chemically synthesized
taaccgtttgaccctcttggat

SEQ ID NO: 754362 - DNA, 22 bp, Artificial Sequence
  chemically synthesized
atttctctgatccaagagggtc

SEQ ID NO: 754363 - DNA, 22 bp, Artificial Sequence
  chemically synthesized
agctataaccgtttgaccctct

SEQ ID NO: 754364 - DNA, 22 bp, Artificial Sequence
  chemically synthesized
ctctgatccaagagggtcaaac

SEQ ID NO: 754365 - DNA, 22 bp, Artificial Sequence
  chemically synthesized
tctgatccaagagggtcaaacg

SEQ ID NO: 754366 - DNA, 22 bp, Artificial Sequence
  chemically synthesized
tgatccaagagggtcaaacggt

SEQ ID NO: 754367 - DNA, 22 bp, Artificial Sequence
  chemically synthesized
ccctgagctataaccgtttgac

SEQ ID NO: 754368 - DNA, 22 bp, Artificial Sequence
  chemically synthesized
atccaagagggtcaaacggtta

SEQ ID NO: 754369 - DNA, 22 bp, Artificial Sequence
  chemically synthesized
ggaacctaccctgagctataac

SEQ ID NO: 754370 - DNA, 22 bp, Artificial Sequence
  chemically synthesized
aggaacctaccctgagctataa

SEQ ID NO: 754371 - DNA, 22 bp, Artificial Sequence
  chemically synthesized
agcttaggaacctaccctgagc

SEQ ID NO: 754372 - DNA, 22 bp, Artificial Sequence
  chemically synthesized
tagctcagggtaggttcctaag

SEQ ID NO: 754373 - DNA, 22 bp, Artificial Sequence
  chemically synthesized
acaacatagagttcagcttagg

SEQ ID NO: 754374 - DNA, 22 bp, Artificial Sequence
  chemically synthesized
agggtaggttcctaagctgaac

SEQ ID NO: 754375 - DNA, 22 bp, Artificial Sequence
  chemically synthesized
taacaacatagagttcagctta

SEQ ID NO: 754376 - DNA, 22 bp, Artificial Sequence
  chemically synthesized
ctaacaacatagagttcagctt

SEQ ID NO: 754377 - DNA, 22 bp, Artificial Sequence
  chemically synthesized
tctaacaacatagagttcagct

SEQ ID NO: 754378 - DNA, 22 bp, Artificial Sequence
  chemically synthesized
cagtctttctaacaacatagag

SEQ ID NO: 754379 - DNA, 22 bp, Artificial Sequence
  chemically synthesized
ctaagctgaactctatgttgtt

SEQ ID NO: 754380 - DNA, 22 bp, Artificial Sequence
  chemically synthesized
agctgaactctatgttgttaga

SEQ ID NO: 754381 - DNA, 22 bp, Artificial Sequence
  chemically synthesized
aactctatgttgttagaaagac

SEQ ID NO: 754382 - DNA, 22 bp, Artificial Sequence
  chemically synthesized
tatgttgttagaaagactggag

SEQ ID NO: 754383 - DNA, 22 bp, Artificial Sequence
  chemically synthesized
gaaagatacccactccagtctt

SEQ ID NO: 754384 - DNA, 22 bp, Artificial Sequence
  chemically synthesized
tgttgttagaaagactggagtg

SEQ ID NO: 754385 - DNA, 22 bp, Artificial Sequence
  chemically synthesized
ttagaaagactggagtgggtat

SEQ ID NO: 754386 - DNA, 22 bp, Artificial Sequence
  chemically synthesized
gaaagactggagtgggtatctt

SEQ ID NO: 754387 - DNA, 22 bp, Artificial Sequence
  chemically synthesized
aaatgtaaatacctagaaagat

SEQ ID NO: 754388 - DNA, 22 bp, Artificial Sequence
  chemically synthesized
gaaatgtaaatacctagaaaga

SEQ ID NO: 754389 - DNA, 22 bp, Artificial Sequence
  chemically synthesized
tgaaatgtaaatacctagaaag

SEQ ID NO: 754390 - DNA, 22 bp, Artificial Sequence
  chemically synthesized
ttgaaatgtaaatacctagaaa

SEQ ID NO: 754391 - DNA, 22 bp, Artificial Sequence
  chemically synthesized
gagtgggtatctttctaggtat

SEQ ID NO: 754392 - DNA, 22 bp, Artificial Sequence
  chemically synthesized
tttgaaatgtaaatacctagaa

SEQ ID NO: 754393 - DNA, 22 bp, Artificial Sequence
  chemically synthesized
atattttttgaaatgtaaatac

SEQ ID NO: 754394 - DNA, 22 bp, Artificial Sequence
  chemically synthesized
catattttttgaaatgtaaata

SEQ ID NO: 754395 - DNA, 22 bp, Artificial Sequence
  chemically synthesized
tctaggtatttacatttcaaaa

SEQ ID NO: 754396 - DNA, 22 bp, Artificial Sequence
  chemically synthesized
ctaggtatttacatttcaaaaa

SEQ ID NO: 754397 - DNA, 22 bp, Artificial Sequence
  chemically synthesized
taggtatttacatttcaaaaaa

SEQ ID NO: 754398 - DNA, 22 bp, Artificial Sequence
  chemically synthesized
ggtatttacatttcaaaaaata

SEQ ID NO: 754399 - DNA, 22 bp, Artificial Sequence
  chemically synthesized
caaggtatgggcttcatatttt

SEQ ID NO: 754400 - DNA, 22 bp, Artificial Sequence
  chemically synthesized
acatttcaaaaaatatgaagcc

SEQ ID NO: 754401 - DNA, 22 bp, Artificial Sequence
  chemically synthesized
catttcaaaaaatatgaagccc

SEQ ID NO: 754402 - DNA, 22 bp, Artificial Sequence
  chemically synthesized
caaaaaatatgaagcccatacc

SEQ ID NO: 754403 - DNA, 22 bp, Artificial Sequence
  chemically synthesized
aaaaaatatgaagcccatacct

SEQ ID NO: 754404 - DNA, 22 bp, Artificial Sequence
  chemically synthesized
gaaatgtctccaaggtatgggc

SEQ ID NO: 754405 - DNA, 22 bp, Artificial Sequence
  chemically synthesized
caatctggaaatgtctccaagg

SEQ ID NO: 754406 - DNA, 22 bp, Artificial Sequence
  chemically synthesized
acaatctggaaatgtctccaag

SEQ ID NO: 754407 - DNA, 22 bp, Artificial Sequence
  chemically synthesized
tacaatctggaaatgtctccaa

SEQ ID NO: 754408 - DNA, 22 bp, Artificial Sequence
  chemically synthesized
atgttttacaatctggaaatgt

SEQ ID NO: 754409 - DNA, 22 bp, Artificial Sequence
  chemically synthesized
ggagacatttccagattgtaaa

SEQ ID NO: 754410 - DNA, 22 bp, Artificial Sequence
  chemically synthesized
tgtgtctcatgttttacaatct

SEQ ID NO: 754411 - DNA, 22 bp, Artificial Sequence
  chemically synthesized
gagacatttccagattgtaaaa

SEQ ID NO: 754412 - DNA, 22 bp, Artificial Sequence
  chemically synthesized
gccctgtgtgtctcatgtttta

SEQ ID NO: 754413 - DNA, 22 bp, Artificial Sequence
  chemically synthesized
ccagattgtaaaacatgagaca

SEQ ID NO: 754414 - DNA, 22 bp, Artificial Sequence
  chemically synthesized
cagattgtaaaacatgagacac

SEQ ID NO: 754415 - DNA, 22 bp, Artificial Sequence
  chemically synthesized
taaaacatgagacacacagggc

SEQ ID NO: 754416 - DNA, 22 bp, Artificial Sequence
  chemically synthesized
cagaaaccagctagccctgtgt

SEQ ID NO: 754417 - DNA, 22 bp, Artificial Sequence
  chemically synthesized
tgcagaaaccagctagccctgt

SEQ ID NO: 754418 - DNA, 22 bp, Artificial Sequence
  chemically synthesized
ctgcagaaaccagctagccctg

SEQ ID NO: 754419 - DNA, 22 bp, Artificial Sequence
  chemically synthesized
cagcttctgcagaaaccagcta

SEQ ID NO: 754420 - DNA, 22 bp, Artificial Sequence
  chemically synthesized
attccagcttctgcagaaacca

SEQ ID NO: 754421 - DNA, 22 bp, Artificial Sequence
  chemically synthesized
agtcctaattccagcttctgca

SEQ ID NO: 754422 - DNA, 22 bp, Artificial Sequence
  chemically synthesized
gctggtttctgcagaagctgga

SEQ ID NO: 754423 - DNA, 22 bp, Artificial Sequence
  chemically synthesized
gtttctgcagaagctggaatta

SEQ ID NO: 754424 - DNA, 22 bp, Artificial Sequence
  chemically synthesized
ctgcagaagctggaattaggac

SEQ ID NO: 754425 - DNA, 22 bp, Artificial Sequence
  chemically synthesized
tgcagaagctggaattaggact

SEQ ID NO: 754426 - DNA, 22 bp, Artificial Sequence
  chemically synthesized
cagaagctggaattaggactca

SEQ ID NO: 754427 - DNA, 22 bp, Artificial Sequence
  chemically synthesized
tggaaacataacaggcctgagt

SEQ ID NO: 754428 - DNA, 22 bp, Artificial Sequence
  chemically synthesized
tgtggaaacataacaggcctga

SEQ ID NO: 754429 - DNA, 22 bp, Artificial Sequence
  chemically synthesized
gaattaggactcaggcctgtta

SEQ ID NO: 754430 - DNA, 22 bp, Artificial Sequence
  chemically synthesized
tctgtggaaacataacaggcct

SEQ ID NO: 754431 - DNA, 22 bp, Artificial Sequence
  chemically synthesized
ggactcaggcctgttatgtttc

SEQ ID NO: 754432 - DNA, 22 bp, Artificial Sequence
  chemically synthesized
aaaggttctctgtggaaacata

SEQ ID NO: 754433 - DNA, 22 bp, Artificial Sequence
  chemically synthesized
tgaaaggttctctgtggaaaca

SEQ ID NO: 754434 - DNA, 22 bp, Artificial Sequence
  chemically synthesized
aggcctgttatgtttccacaga

SEQ ID NO: 754435 - DNA, 22 bp, Artificial Sequence
  chemically synthesized
attctgaaaggttctctgtgga

SEQ ID NO: 754436 - DNA, 22 bp, Artificial Sequence
  chemically synthesized
tcattctgaaaggttctctgtg

SEQ ID NO: 754437 - DNA, 22 bp, Artificial Sequence
  chemically synthesized
ttatgtttccacagagaacctt

SEQ ID NO: 754438 - DNA, 22 bp, Artificial Sequence
  chemically synthesized
tgtttccacagagaacctttca

SEQ ID NO: 754439 - DNA, 22 bp, Artificial Sequence
  chemically synthesized
tccatctctcattctgaaaggt

SEQ ID NO: 754440 - DNA, 22 bp, Artificial Sequence
  chemically synthesized
ccacagagaacctttcagaatg

SEQ ID NO: 754441 - DNA, 22 bp, Artificial Sequence
  chemically synthesized
ctatccatctctcattctgaaa

SEQ ID NO: 754442 - DNA, 22 bp, Artificial Sequence
  chemically synthesized
cacagagaacctttcagaatga

SEQ ID NO: 754443 - DNA, 22 bp, Artificial Sequence
  chemically synthesized
tcagaatgagagatggatagca

SEQ ID NO: 754444 - DNA, 22 bp, Artificial Sequence
  chemically synthesized
cagaatgagagatggatagcag

SEQ ID NO: 754445 - DNA, 22 bp, Artificial Sequence
  chemically synthesized
agaatgagagatggatagcagc

SEQ ID NO: 754446 - DNA, 22 bp, Artificial Sequence
  chemically synthesized
taaaggagaaggaggctgctat

SEQ ID NO: 754447 - DNA, 22 bp, Artificial Sequence
  chemically synthesized
ataaaggagaaggaggctgcta

SEQ ID NO: 754448 - DNA, 22 bp, Artificial Sequence
  chemically synthesized
cttataaaggagaaggaggctg

SEQ ID NO: 754449 - DNA, 22 bp, Artificial Sequence
  chemically synthesized
tgcttataaaggagaaggaggc

SEQ ID NO: 754450 - DNA, 22 bp, Artificial Sequence
  chemically synthesized
ctgcttataaaggagaaggagg

SEQ ID NO: 754451 - DNA, 22 bp, Artificial Sequence
  chemically synthesized
tctgcttataaaggagaaggag

SEQ ID NO: 754452 - DNA, 22 bp, Artificial Sequence
  chemically synthesized
ttctgcttataaaggagaagga

SEQ ID NO: 754453 - DNA, 22 bp, Artificial Sequence
  chemically synthesized
tttctgcttataaaggagaagg

SEQ ID NO: 754454 - DNA, 22 bp, Artificial Sequence
  chemically synthesized
cttctcctttataagcagaaaa

SEQ ID NO: 754455 - DNA, 22 bp, Artificial Sequence
  chemically synthesized
ggaaaaatcattttttctgctt

SEQ ID NO: 754456 - DNA, 22 bp, Artificial Sequence
  chemically synthesized
ctcctttataagcagaaaaaat

SEQ ID NO: 754457 - DNA, 22 bp, Artificial Sequence
  chemically synthesized
tcctttataagcagaaaaaatg

SEQ ID NO: 754458 - DNA, 22 bp, Artificial Sequence
  chemically synthesized
ctttataagcagaaaaaatgat

SEQ ID NO: 754459 - DNA, 22 bp, Artificial Sequence
  chemically synthesized
tataagcagaaaaaatgatttt

SEQ ID NO: 754460 - DNA, 22 bp, Artificial Sequence
  chemically synthesized
ataagcagaaaaaatgattttt

SEQ ID NO: 754461 - DNA, 22 bp, Artificial Sequence
  chemically synthesized
taagcagaaaaaatgatttttc

SEQ ID NO: 754462 - DNA, 22 bp, Artificial Sequence
  chemically synthesized
cataagtgggagactaggaaaa

SEQ ID NO: 754463 - DNA, 22 bp, Artificial Sequence
  chemically synthesized
ggtactccataagtgggagact

SEQ ID NO: 754464 - DNA, 22 bp, Artificial Sequence
  chemically synthesized
ttcctagtctcccacttatgga

SEQ ID NO: 754465 - DNA, 22 bp, Artificial Sequence
  chemically synthesized
tcctagtctcccacttatggag

SEQ ID NO: 754466 - DNA, 22 bp, Artificial Sequence
  chemically synthesized
agtggctgggtactccataagt

SEQ ID NO: 754467 - DNA, 22 bp, Artificial Sequence
  chemically synthesized
cctagtctcccacttatggagt

SEQ ID NO: 754468 - DNA, 22 bp, Artificial Sequence
  chemically synthesized
gagtggctgggtactccataag

SEQ ID NO: 754469 - DNA, 22 bp, Artificial Sequence
  chemically synthesized
ctagtctcccacttatggagta

SEQ ID NO: 754470 - DNA, 22 bp, Artificial Sequence
  chemically synthesized
cttgagtggctgggtactccat

SEQ ID NO: 754471 - DNA, 22 bp, Artificial Sequence
  chemically synthesized
gtctcccacttatggagtaccc

SEQ ID NO: 754472 - DNA, 22 bp, Artificial Sequence
  chemically synthesized
ctacttgagtggctgggtactc

SEQ ID NO: 754473 - DNA, 22 bp, Artificial Sequence
  chemically synthesized
cctacttgagtggctgggtact

SEQ ID NO: 754474 - DNA, 22 bp, Artificial Sequence
  chemically synthesized
tcctacttgagtggctgggtac

SEQ ID NO: 754475 - DNA, 22 bp, Artificial Sequence
  chemically synthesized
ccacttatggagtacccagcca

SEQ ID NO: 754476 - DNA, 22 bp, Artificial Sequence
  chemically synthesized
atggagtacccagccactcaag

SEQ ID NO: 754477 - DNA, 22 bp, Artificial Sequence
  chemically synthesized
tggagtacccagccactcaagt

SEQ ID NO: 754478 - DNA, 22 bp, Artificial Sequence
  chemically synthesized
atgaaacattttcctacttgag

SEQ ID NO: 754479 - DNA, 22 bp, Artificial Sequence
  chemically synthesized
aagtaggaaaatgtttcatcag

SEQ ID NO: 754480 - DNA, 22 bp, Artificial Sequence
  chemically synthesized
gggcaacatgatgaacgctgat

SEQ ID NO: 754481 - DNA, 22 bp, Artificial Sequence
  chemically synthesized
cccctagggcaacatgatgaac

SEQ ID NO: 754482 - DNA, 22 bp, Artificial Sequence
  chemically synthesized
acccctagggcaacatgatgaa

SEQ ID NO: 754483 - DNA, 22 bp, Artificial Sequence
  chemically synthesized
catcagcgttcatcatgttgcc

SEQ ID NO: 754484 - DNA, 22 bp, Artificial Sequence
  chemically synthesized
atcagcgttcatcatgttgccc

SEQ ID NO: 754485 - DNA, 22 bp, Artificial Sequence
  chemically synthesized
cccaaagacttacccctagggc

SEQ ID NO: 754486 - DNA, 22 bp, Artificial Sequence
  chemically synthesized
gcccaaagacttacccctaggg

SEQ ID NO: 754487 - DNA, 22 bp, Artificial Sequence
  chemically synthesized
tgcccaaagacttacccctagg

SEQ ID NO: 754488 - DNA, 22 bp, Artificial Sequence
  chemically synthesized
atcatgttgccctaggggtaag

SEQ ID NO: 754489 - DNA, 22 bp, Artificial Sequence
  chemically synthesized
ctttgcccaaagacttacccct

SEQ ID NO: 754490 - DNA, 22 bp, Artificial Sequence
  chemically synthesized
cctttgcccaaagacttacccc

SEQ ID NO: 754491 - DNA, 22 bp, Artificial Sequence
  chemically synthesized
ccctaggggtaagtctttgggc

SEQ ID NO: 754492 - DNA, 22 bp, Artificial Sequence
  chemically synthesized
tgcccttcctttgcccaaagac

SEQ ID NO: 754493 - DNA, 22 bp, Artificial Sequence
  chemically synthesized
ctgtgcccttcctttgcccaaa

SEQ ID NO: 754494 - DNA, 22 bp, Artificial Sequence
  chemically synthesized
ggggtaagtctttgggcaaagg

SEQ ID NO: 754495 - DNA, 22 bp, Artificial Sequence
  chemically synthesized
ttgctgtgcccttcctttgccc

SEQ ID NO: 754496 - DNA, 22 bp, Artificial Sequence
  chemically synthesized
tgggcaaaggaagggcacagca

SEQ ID NO: 754497 - DNA, 22 bp, Artificial Sequence
  chemically synthesized
gggcaaaggaagggcacagcaa

SEQ ID NO: 754498 - DNA, 22 bp, Artificial Sequence
  chemically synthesized
cagtaaatattgttgctgtgcc

SEQ ID NO: 754499 - DNA, 22 bp, Artificial Sequence
  chemically synthesized
ggcaaaggaagggcacagcaac

SEQ ID NO: 754500 - DNA, 22 bp, Artificial Sequence
  chemically synthesized
acagtaaatattgttgctgtgc

SEQ ID NO: 754501 - DNA, 22 bp, Artificial Sequence
  chemically synthesized
ccttacagtaaatattgttgct

SEQ ID NO: 754502 - DNA, 22 bp, Artificial Sequence
  chemically synthesized
attaccttacagtaaatattgt

SEQ ID NO: 754503 - DNA, 22 bp, Artificial Sequence
  chemically synthesized
aattaccttacagtaaatattg

SEQ ID NO: 754504 - DNA, 22 bp, Artificial Sequence
  chemically synthesized
atttaattaccttacagtaaat

SEQ ID NO: 754505 - DNA, 22 bp, Artificial Sequence
  chemically synthesized
catttaattaccttacagtaaa

SEQ ID NO: 754506 - DNA, 22 bp, Artificial Sequence
  chemically synthesized
actgtaaggtaattaaatgaaa

SEQ ID NO: 754507 - DNA, 22 bp, Artificial Sequence
  chemically synthesized
ctgtaaggtaattaaatgaaat

SEQ ID NO: 754508 - DNA, 22 bp, Artificial Sequence
  chemically synthesized
aatcagaggcagatttcattta

SEQ ID NO: 754509 - DNA, 22 bp, Artificial Sequence
  chemically synthesized
tgaatcagaggcagatttcatt

SEQ ID NO: 754510 - DNA, 22 bp, Artificial Sequence
  chemically synthesized
taaggtaattaaatgaaatctg

SEQ ID NO: 754511 - DNA, 22 bp, Artificial Sequence
  chemically synthesized
aatgaaatctgcctctgattca

SEQ ID NO: 754512 - DNA, 22 bp, Artificial Sequence
  chemically synthesized
aatgagcatgaggggttctgaa

SEQ ID NO: 754513 - DNA, 22 bp, Artificial Sequence
  chemically synthesized
cctctgattcagaacccctcat

SEQ ID NO: 754514 - DNA, 22 bp, Artificial Sequence
  chemically synthesized
tcctgaatgagcatgaggggtt

SEQ ID NO: 754515 - DNA, 22 bp, Artificial Sequence
  chemically synthesized
atcctgaatgagcatgaggggt

SEQ ID NO: 754516 - DNA, 22 bp, Artificial Sequence
  chemically synthesized
tatcctgaatgagcatgagggg

SEQ ID NO: 754517 - DNA, 22 bp, Artificial Sequence
  chemically synthesized
tgattcagaacccctcatgctc

SEQ ID NO: 754518 - DNA, 22 bp, Artificial Sequence
  chemically synthesized
attcagaacccctcatgctcat

SEQ ID NO: 754519 - DNA, 22 bp, Artificial Sequence
  chemically synthesized
agaacccctcatgctcattcag

SEQ ID NO: 754520 - DNA, 22 bp, Artificial Sequence
  chemically synthesized
aataattttatcctgaatgagc

SEQ ID NO: 754521 - DNA, 22 bp, Artificial Sequence
  chemically synthesized
caataattttatcctgaatgag

SEQ ID NO: 754522 - DNA, 22 bp, Artificial Sequence
  chemically synthesized
ttcaataattttatcctgaatg

SEQ ID NO: 754523 - DNA, 22 bp, Artificial Sequence
  chemically synthesized
ctcttcaataattttatcctga

SEQ ID NO: 754524 - DNA, 22 bp, Artificial Sequence
  chemically synthesized
atgctcattcaggataaaatta

SEQ ID NO: 754525 - DNA, 22 bp, Artificial Sequence
  chemically synthesized
atattactcttcaataatttta

SEQ ID NO: 754526 - DNA, 22 bp, Artificial Sequence
  chemically synthesized
aatattactcttcaataatttt

SEQ ID NO: 754527 - DNA, 22 bp, Artificial Sequence
  chemically synthesized
taatattactcttcaataattt

SEQ ID NO: 754528 - DNA, 22 bp, Artificial Sequence
  chemically synthesized
ttaatattactcttcaataatt

SEQ ID NO: 754529 - DNA, 22 bp, Artificial Sequence
  chemically synthesized
attcaggataaaattattgaag

SEQ ID NO: 754530 - DNA, 22 bp, Artificial Sequence
  chemically synthesized
aggataaaattattgaagagta

SEQ ID NO: 754531 - DNA, 22 bp, Artificial Sequence
  chemically synthesized
catttttaatattactcttcaa

SEQ ID NO: 754532 - DNA, 22 bp, Artificial Sequence
  chemically synthesized
ttgaagagtaatattaaaaatg

SEQ ID NO: 754533 - DNA, 22 bp, Artificial Sequence
  chemically synthesized
aagagtaatattaaaaatgcaa

SEQ ID NO: 754534 - DNA, 22 bp, Artificial Sequence
  chemically synthesized
aaaatgcaacatgatggtgtgt

SEQ ID NO: 754535 - DNA, 22 bp, Artificial Sequence
  chemically synthesized
tcccccatgcacagaacacccc

SEQ ID NO: 754536 - DNA, 22 bp, Artificial Sequence
  chemically synthesized
tgtcccccatgcacagaacacc

SEQ ID NO: 754537 - DNA, 22 bp, Artificial Sequence
  chemically synthesized
ctctgtcccccatgcacagaac

SEQ ID NO: 754538 - DNA, 22 bp, Artificial Sequence
  chemically synthesized
actctgtcccccatgcacagaa

SEQ ID NO: 754539 - DNA, 22 bp, Artificial Sequence
  chemically synthesized
tgtgcatgggggacagagtaag

SEQ ID NO: 754540 - DNA, 22 bp, Artificial Sequence
  chemically synthesized
tgcatgggggacagagtaaggg

SEQ ID NO: 754541 - DNA, 22 bp, Artificial Sequence
  chemically synthesized
agcatatcacagtcccttactc

SEQ ID NO: 754542 - DNA, 22 bp, Artificial Sequence
  chemically synthesized
caagctgagcatatcacagtcc

SEQ ID NO: 754543 - DNA, 22 bp, Artificial Sequence
  chemically synthesized
ccaagctgagcatatcacagtc

SEQ ID NO: 754544 - DNA, 22 bp, Artificial Sequence
  chemically synthesized
tccaagctgagcatatcacagt

SEQ ID NO: 754545 - DNA, 22 bp, Artificial Sequence
  chemically synthesized
gctttccaagctgagcatatca

SEQ ID NO: 754546 - DNA, 22 bp, Artificial Sequence
  chemically synthesized
tgatatgctcagcttggaaagc

SEQ ID NO: 754547 - DNA, 22 bp, Artificial Sequence
  chemically synthesized
tggaaggaatgttagctttcca

SEQ ID NO: 754548 - DNA, 22 bp, Artificial Sequence
  chemically synthesized
gtggaaggaatgttagctttcc

SEQ ID NO: 754549 - DNA, 22 bp, Artificial Sequence
  chemically synthesized
cttgtggaaggaatgttagctt

SEQ ID NO: 754550 - DNA, 22 bp, Artificial Sequence
  chemically synthesized
ccttgtggaaggaatgttagct

SEQ ID NO: 754551 - DNA, 22 bp, Artificial Sequence
  chemically synthesized
agcttggaaagctaacattcct

SEQ ID NO: 754552 - DNA, 22 bp, Artificial Sequence
  chemically synthesized
tttccttgtggaaggaatgtta

SEQ ID NO: 754553 - DNA, 22 bp, Artificial Sequence
  chemically synthesized
ttatttccttgtggaaggaatg

SEQ ID NO: 754554 - DNA, 22 bp, Artificial Sequence
  chemically synthesized
attatttccttgtggaaggaat

SEQ ID NO: 754555 - DNA, 22 bp, Artificial Sequence
  chemically synthesized
ggaaagctaacattccttccac

SEQ ID NO: 754556 - DNA, 22 bp, Artificial Sequence
  chemically synthesized
gaaagctaacattccttccaca

SEQ ID NO: 754557 - DNA, 22 bp, Artificial Sequence
  chemically synthesized
agaatttattatttccttgtgg

SEQ ID NO: 754558 - DNA, 22 bp, Artificial Sequence
  chemically synthesized
acattccttccacaaggaaata

SEQ ID NO: 754559 - DNA, 22 bp, Artificial Sequence
  chemically synthesized
aaacctcagaatttattatttc

SEQ ID NO: 754560 - DNA, 22 bp, Artificial Sequence
  chemically synthesized
cttccacaaggaaataataaat

SEQ ID NO: 754561 - DNA, 22 bp, Artificial Sequence
  chemically synthesized
ctcaaacctcagaatttattat

SEQ ID NO: 754562 - DNA, 22 bp, Artificial Sequence
  chemically synthesized
ccacaaggaaataataaattct

SEQ ID NO: 754563 - DNA, 22 bp, Artificial Sequence
  chemically synthesized
tcctcaaacctcagaatttatt

SEQ ID NO: 754564 - DNA, 22 bp, Artificial Sequence
  chemically synthesized
cacaaggaaataataaattctg

SEQ ID NO: 754565 - DNA, 22 bp, Artificial Sequence
  chemically synthesized
ctcctcaaacctcagaatttat

SEQ ID NO: 754566 - DNA, 22 bp, Artificial Sequence
  chemically synthesized
tctcctcaaacctcagaattta

SEQ ID NO: 754567 - DNA, 22 bp, Artificial Sequence
  chemically synthesized
ttctcctcaaacctcagaattt

SEQ ID NO: 754568 - DNA, 22 bp, Artificial Sequence
  chemically synthesized
tttctcctcaaacctcagaatt

SEQ ID NO: 754569 - DNA, 22 bp, Artificial Sequence
  chemically synthesized
ttttctcctcaaacctcagaat

SEQ ID NO: 754570 - DNA, 22 bp, Artificial Sequence
  chemically synthesized
tttttctcctcaaacctcagaa

SEQ ID NO: 754571 - DNA, 22 bp, Artificial Sequence
  chemically synthesized
agtattttttttctcctcaaac

SEQ ID NO: 754572 - DNA, 22 bp, Artificial Sequence
  chemically synthesized
ctaagtattttttttctcctca

SEQ ID NO: 754573 - DNA, 22 bp, Artificial Sequence
  chemically synthesized
tgaggtttgaggagaaaaaaaa

SEQ ID NO: 754574 - DNA, 22 bp, Artificial Sequence
  chemically synthesized
aggtttgaggagaaaaaaaata

SEQ ID NO: 754575 - DNA, 22 bp, Artificial Sequence
  chemically synthesized
gaggagaaaaaaaatacttagg

SEQ ID NO: 754576 - DNA, 22 bp, Artificial Sequence
  chemically synthesized
aggagaaaaaaaatacttagga

SEQ ID NO: 754577 - DNA, 22 bp, Artificial Sequence
  chemically synthesized
aatgagaaaataactcctaagt

SEQ ID NO: 754578 - DNA, 22 bp, Artificial Sequence
  chemically synthesized
gctgaatgagaaaataactcct

SEQ ID NO: 754579 - DNA, 22 bp, Artificial Sequence
  chemically synthesized
aacgtatattagctgaatgaga

SEQ ID NO: 754580 - DNA, 22 bp, Artificial Sequence
  chemically synthesized
aggagttattttctcattcagc

SEQ ID NO: 754581 - DNA, 22 bp, Artificial Sequence
  chemically synthesized
ggagttattttctcattcagct

SEQ ID NO: 754582 - DNA, 22 bp, Artificial Sequence
  chemically synthesized
ttttctcattcagctaatatac

SEQ ID NO: 754583 - DNA, 22 bp, Artificial Sequence
  chemically synthesized
tctcattcagctaatatacgtt

SEQ ID NO: 754584 - DNA, 22 bp, Artificial Sequence
  chemically synthesized
ctcattcagctaatatacgttg

SEQ ID NO: 754585 - DNA, 22 bp, Artificial Sequence
  chemically synthesized
tcattcagctaatatacgttga

SEQ ID NO: 754586 - DNA, 22 bp, Artificial Sequence
  chemically synthesized
atatgtaggcactcaacgtata

SEQ ID NO: 754587 - DNA, 22 bp, Artificial Sequence
  chemically synthesized
gatatgtaggcactcaacgtat

SEQ ID NO: 754588 - DNA, 22 bp, Artificial Sequence
  chemically synthesized
attcagctaatatacgttgagt

SEQ ID NO: 754589 - DNA, 22 bp, Artificial Sequence
  chemically synthesized
tgatatgtaggcactcaacgta

SEQ ID NO: 754590 - DNA, 22 bp, Artificial Sequence
  chemically synthesized
agctaatatacgttgagtgcct

SEQ ID NO: 754591 - DNA, 22 bp, Artificial Sequence
  chemically synthesized
aactttgatatgtaggcactca

SEQ ID NO: 754592 - DNA, 22 bp, Artificial Sequence
  chemically synthesized
atatacgttgagtgcctacata

SEQ ID NO: 754593 - DNA, 22 bp, Artificial Sequence
  chemically synthesized
cccattaaactttgatatgtag

SEQ ID NO: 754594 - DNA, 22 bp, Artificial Sequence
  chemically synthesized
gcccattaaactttgatatgta

SEQ ID NO: 754595 - DNA, 22 bp, Artificial Sequence
  chemically synthesized
tttgcccattaaactttgatat

SEQ ID NO: 754596 - DNA, 22 bp, Artificial Sequence
  chemically synthesized
tgtttgcccattaaactttgat

SEQ ID NO: 754597 - DNA, 22 bp, Artificial Sequence
  chemically synthesized
agtgcctacatatcaaagttta

SEQ ID NO: 754598 - DNA, 22 bp, Artificial Sequence
  chemically synthesized
ctctgtttgcccattaaacttt

SEQ ID NO: 754599 - DNA, 22 bp, Artificial Sequence
  chemically synthesized
ttcctctgtttgcccattaaac

SEQ ID NO: 754600 - DNA, 22 bp, Artificial Sequence
  chemically synthesized
catatcaaagtttaatgggcaa

SEQ ID NO: 754601 - DNA, 22 bp, Artificial Sequence
  chemically synthesized
aagagatcctgttcctctgttt

SEQ ID NO: 754602 - DNA, 22 bp, Artificial Sequence
  chemically synthesized
tcaagagatcctgttcctctgt

SEQ ID NO: 754603 - DNA, 22 bp, Artificial Sequence
  chemically synthesized
aatgggcaaacagaggaacagg

SEQ ID NO: 754604 - DNA, 22 bp, Artificial Sequence
  chemically synthesized
atgggcaaacagaggaacagga

SEQ ID NO: 754605 - DNA, 22 bp, Artificial Sequence
  chemically synthesized
tctctcaagagatcctgttcct

SEQ ID NO: 754606 - DNA, 22 bp, Artificial Sequence
  chemically synthesized
tatctctcaagagatcctgttc

SEQ ID NO: 754607 - DNA, 22 bp, Artificial Sequence
  chemically synthesized
ctatctctcaagagatcctgtt

SEQ ID NO: 754608 - DNA, 22 bp, Artificial Sequence
  chemically synthesized
tctatctctcaagagatcctgt

SEQ ID NO: 754609 - DNA, 22 bp, Artificial Sequence
  chemically synthesized
ttctatctctcaagagatcctg

SEQ ID NO: 754610 - DNA, 22 bp, Artificial Sequence
  chemically synthesized
cttttctatctctcaagagatc

SEQ ID NO: 754611 - DNA, 22 bp, Artificial Sequence
  chemically synthesized
ttccttttctatctctcaagag

SEQ ID NO: 754612 - DNA, 22 bp, Artificial Sequence
  chemically synthesized
gttccttttctatctctcaaga

SEQ ID NO: 754613 - DNA, 22 bp, Artificial Sequence
  chemically synthesized
tttgttccttttctatctctca

SEQ ID NO: 754614 - DNA, 22 bp, Artificial Sequence
  chemically synthesized
cacctatttgttccttttctat

SEQ ID NO: 754615 - DNA, 22 bp, Artificial Sequence
  chemically synthesized
tccacctatttgttccttttct

SEQ ID NO: 754616 - DNA, 22 bp, Artificial Sequence
  chemically synthesized
ttgagagatagaaaaggaacaa

SEQ ID NO: 754617 - DNA, 22 bp, Artificial Sequence
  chemically synthesized
gagagatagaaaaggaacaaat

SEQ ID NO: 754618 - DNA, 22 bp, Artificial Sequence
  chemically synthesized
atctctccacctatttgttcct

SEQ ID NO: 754619 - DNA, 22 bp, Artificial Sequence
  chemically synthesized
agagatagaaaaggaacaaata

SEQ ID NO: 754620 - DNA, 22 bp, Artificial Sequence
  chemically synthesized
ccctaatctctccacctatttg

SEQ ID NO: 754621 - DNA, 22 bp, Artificial Sequence
  chemically synthesized
cccctaatctctccacctattt

SEQ ID NO: 754622 - DNA, 22 bp, Artificial Sequence
  chemically synthesized
atttcccctaatctctccacct

SEQ ID NO: 754623 - DNA, 22 bp, Artificial Sequence
  chemically synthesized
ctcatttcccctaatctctcca

SEQ ID NO: 754624 - DNA, 22 bp, Artificial Sequence
  chemically synthesized
cactcctcatttcccctaatct

SEQ ID NO: 754625 - DNA, 22 bp, Artificial Sequence
  chemically synthesized
tacactcctcatttcccctaat

SEQ ID NO: 754626 - DNA, 22 bp, Artificial Sequence
  chemically synthesized
ctacactcctcatttcccctaa

SEQ ID NO: 754627 - DNA, 22 bp, Artificial Sequence
  chemically synthesized
aaatttctacactcctcatttc

SEQ ID NO: 754628 - DNA, 22 bp, Artificial Sequence
  chemically synthesized
gaaatttctacactcctcattt

SEQ ID NO: 754629 - DNA, 22 bp, Artificial Sequence
  chemically synthesized
cttgaaatttctacactcctca

SEQ ID NO: 754630 - DNA, 22 bp, Artificial Sequence
  chemically synthesized
tccttgaaatttctacactcct

SEQ ID NO: 754631 - DNA, 22 bp, Artificial Sequence
  chemically synthesized
tctccttgaaatttctacactc

SEQ ID NO: 754632 - DNA, 22 bp, Artificial Sequence
  chemically synthesized
ggggaaatgaggagtgtagaaa

SEQ ID NO: 754633 - DNA, 22 bp, Artificial Sequence
  chemically synthesized
actctctccttgaaatttctac

SEQ ID NO: 754634 - DNA, 22 bp, Artificial Sequence
  chemically synthesized
tcactctctccttgaaatttct

SEQ ID NO: 754635 - DNA, 22 bp, Artificial Sequence
  chemically synthesized
aaaattctcactctctccttga

SEQ ID NO: 754636 - DNA, 22 bp, Artificial Sequence
  chemically synthesized
tcaaaattctcactctctcctt

SEQ ID NO: 754637 - DNA, 22 bp, Artificial Sequence
  chemically synthesized
ctctcaaaattctcactctctc

SEQ ID NO: 754638 - DNA, 22 bp, Artificial Sequence
  chemically synthesized
cctctcaaaattctcactctct

SEQ ID NO: 754639 - DNA, 22 bp, Artificial Sequence
  chemically synthesized
ttcctctcaaaattctcactct

SEQ ID NO: 754640 - DNA, 22 bp, Artificial Sequence
  chemically synthesized
caaggagagagtgagaattttg

SEQ ID NO: 754641 - DNA, 22 bp, Artificial Sequence
  chemically synthesized
aaggagagagtgagaattttga

SEQ ID NO: 754642 - DNA, 22 bp, Artificial Sequence
  chemically synthesized
gtcaccctcttcctctcaaaat

SEQ ID NO: 754643 - DNA, 22 bp, Artificial Sequence
  chemically synthesized
ggtcaccctcttcctctcaaaa

SEQ ID NO: 754644 - DNA, 22 bp, Artificial Sequence
  chemically synthesized
acttggtcaccctcttcctctc

SEQ ID NO: 754645 - DNA, 22 bp, Artificial Sequence
  chemically synthesized
gactcacttggtcaccctcttc

SEQ ID NO: 754646 - DNA, 22 bp, Artificial Sequence
  chemically synthesized
attggactcacttggtcaccct

SEQ ID NO: 754647 - DNA, 22 bp, Artificial Sequence
  chemically synthesized
cattggactcacttggtcaccc

SEQ ID NO: 754648 - DNA, 22 bp, Artificial Sequence
  chemically synthesized
tgagaggaagagggtgaccaag

SEQ ID NO: 754649 - DNA, 22 bp, Artificial Sequence
  chemically synthesized
gagaggaagagggtgaccaagt

SEQ ID NO: 754650 - DNA, 22 bp, Artificial Sequence
  chemically synthesized
agaggaagagggtgaccaagtg

SEQ ID NO: 754651 - DNA, 22 bp, Artificial Sequence
  chemically synthesized
tgtttcattggactcacttggt

SEQ ID NO: 754652 - DNA, 22 bp, Artificial Sequence
  chemically synthesized
tgtgtttcattggactcacttg

SEQ ID NO: 754653 - DNA, 22 bp, Artificial Sequence
  chemically synthesized
ctgtgtttcattggactcactt

SEQ ID NO: 754654 - DNA, 22 bp, Artificial Sequence
  chemically synthesized
cttctgtgtttcattggactca

SEQ ID NO: 754655 - DNA, 22 bp, Artificial Sequence
  chemically synthesized
acttctgtgtttcattggactc

SEQ ID NO: 754656 - DNA, 22 bp, Artificial Sequence
  chemically synthesized
tacttctgtgtttcattggact

SEQ ID NO: 754657 - DNA, 22 bp, Artificial Sequence
  chemically synthesized
ctttacttctgtgtttcattgg

SEQ ID NO: 754658 - DNA, 22 bp, Artificial Sequence
  chemically synthesized
actttacttctgtgtttcattg

SEQ ID NO: 754659 - DNA, 22 bp, Artificial Sequence
  chemically synthesized
atcttactttacttctgtgttt

SEQ ID NO: 754660 - DNA, 22 bp, Artificial Sequence
  chemically synthesized
caatgctgatcttactttactt

SEQ ID NO: 754661 - DNA, 22 bp, Artificial Sequence
  chemically synthesized
tgcaatgctgatcttactttac

SEQ ID NO: 754662 - DNA, 22 bp, Artificial Sequence
  chemically synthesized
gtgaacactctgcaatgctgat

SEQ ID NO: 754663 - DNA, 22 bp, Artificial Sequence
  chemically synthesized
agcacatctagtgaacactctg

SEQ ID NO: 754664 - DNA, 22 bp, Artificial Sequence
  chemically synthesized
tcagcacatctagtgaacactc

SEQ ID NO: 754665 - DNA, 22 bp, Artificial Sequence
  chemically synthesized
ctctcagcacatctagtgaaca

SEQ ID NO: 754666 - DNA, 22 bp, Artificial Sequence
  chemically synthesized
aaattgctctcagcacatctag

SEQ ID NO: 754667 - DNA, 22 bp, Artificial Sequence
  chemically synthesized
cagagtgttcactagatgtgct

SEQ ID NO: 754668 - DNA, 22 bp, Artificial Sequence
  chemically synthesized
cactgaaattgctctcagcaca

SEQ ID NO: 754669 - DNA, 22 bp, Artificial Sequence
  chemically synthesized
ccctccactgaaattgctctca

SEQ ID NO: 754670 - DNA, 22 bp, Artificial Sequence
  chemically synthesized
actagatgtgctgagagcaatt

SEQ ID NO: 754671 - DNA, 22 bp, Artificial Sequence
  chemically synthesized
tgccctccactgaaattgctct

SEQ ID NO: 754672 - DNA, 22 bp, Artificial Sequence
  chemically synthesized
ctgccctccactgaaattgctc

SEQ ID NO: 754673 - DNA, 22 bp, Artificial Sequence
  chemically synthesized
gatgtgctgagagcaatttcag

SEQ ID NO: 754674 - DNA, 22 bp, Artificial Sequence
  chemically synthesized
aggcttctgccctccactgaaa

SEQ ID NO: 754675 - DNA, 22 bp, Artificial Sequence
  chemically synthesized
tgaggcttctgccctccactga

SEQ ID NO: 754676 - DNA, 22 bp, Artificial Sequence
  chemically synthesized
ctgaggcttctgccctccactg

SEQ ID NO: 754677 - DNA, 22 bp, Artificial Sequence
  chemically synthesized
agagcaatttcagtggagggca

SEQ ID NO: 754678 - DNA, 22 bp, Artificial Sequence
  chemically synthesized
cttctgaggcttctgccctcca

SEQ ID NO: 754679 - DNA, 22 bp, Artificial Sequence
  chemically synthesized
tgcctacttctgaggcttctgc

SEQ ID NO: 754680 - DNA, 22 bp, Artificial Sequence
  chemically synthesized
cagtggagggcagaagcctcag

SEQ ID NO: 754681 - DNA, 22 bp, Artificial Sequence
  chemically synthesized
agtggagggcagaagcctcaga

SEQ ID NO: 754682 - DNA, 22 bp, Artificial Sequence
  chemically synthesized
agctatgcctacttctgaggct

SEQ ID NO: 754683 - DNA, 22 bp, Artificial Sequence
  chemically synthesized
ctcagctatgcctacttctgag

SEQ ID NO: 754684 - DNA, 22 bp, Artificial Sequence
  chemically synthesized
actcctcagctatgcctacttc

SEQ ID NO: 754685 - DNA, 22 bp, Artificial Sequence
  chemically synthesized
cactcactcctcagctatgcct

SEQ ID NO: 754686 - DNA, 22 bp, Artificial Sequence
  chemically synthesized
ccactcactcctcagctatgcc

SEQ ID NO: 754687 - DNA, 22 bp, Artificial Sequence
  chemically synthesized
ttccactcactcctcagctatg

SEQ ID NO: 754688 - DNA, 22 bp, Artificial Sequence
  chemically synthesized
cttccactcactcctcagctat

SEQ ID NO: 754689 - DNA, 22 bp, Artificial Sequence
  chemically synthesized
agaagtaggcatagctgaggag

SEQ ID NO: 754690 - DNA, 22 bp, Artificial Sequence
  chemically synthesized
cttcttccactcactcctcagc

SEQ ID NO: 754691 - DNA, 22 bp, Artificial Sequence
  chemically synthesized
ctccttcttccactcactcctc

SEQ ID NO: 754692 - DNA, 22 bp, Artificial Sequence
  chemically synthesized
aaatacctactccttcttccac

SEQ ID NO: 754693 - DNA, 22 bp, Artificial Sequence
  chemically synthesized
gaaatacctactccttcttcca

SEQ ID NO: 754694 - DNA, 22 bp, Artificial Sequence
  chemically synthesized
aggagtgagtggaagaaggagt

SEQ ID NO: 754695 - DNA, 22 bp, Artificial Sequence
  chemically synthesized
acttgaaatacctactccttct

SEQ ID NO: 754696 - DNA, 22 bp, Artificial Sequence
  chemically synthesized
cacttgaaatacctactccttc

SEQ ID NO: 754697 - DNA, 22 bp, Artificial Sequence
  chemically synthesized
tcacttgaaatacctactcctt

SEQ ID NO: 754698 - DNA, 22 bp, Artificial Sequence
  chemically synthesized
attttcacttgaaatacctact

SEQ ID NO: 754699 - DNA, 22 bp, Artificial Sequence
  chemically synthesized
gattttcacttgaaatacctac

SEQ ID NO: 754700 - DNA, 22 bp, Artificial Sequence
  chemically synthesized
aacatttgattttcacttgaaa

SEQ ID NO: 754701 - DNA, 22 bp, Artificial Sequence
  chemically synthesized
caagtgaaaatcaaatgttcaa

SEQ ID NO: 754702 - DNA, 22 bp, Artificial Sequence
  chemically synthesized
agaaaaagaaaattgaacattt

SEQ ID NO: 754703 - DNA, 22 bp, Artificial Sequence
  chemically synthesized
aagtgaaaatcaaatgttcaat

SEQ ID NO: 754704 - DNA, 22 bp, Artificial Sequence
  chemically synthesized
tcagaaaaagaaaattgaacat

SEQ ID NO: 754705 - DNA, 22 bp, Artificial Sequence
  chemically synthesized
ctcagaaaaagaaaattgaaca

SEQ ID NO: 754706 - DNA, 22 bp, Artificial Sequence
  chemically synthesized
cttctcagaaaaagaaaattga

SEQ ID NO: 754707 - DNA, 22 bp, Artificial Sequence
  chemically synthesized
ccttctcagaaaaagaaaattg

SEQ ID NO: 754708 - DNA, 22 bp, Artificial Sequence
  chemically synthesized
tccttctcagaaaaagaaaatt

SEQ ID NO: 754709 - DNA, 22 bp, Artificial Sequence
  chemically synthesized
ttccttctcagaaaaagaaaat

SEQ ID NO: 754710 - DNA, 22 bp, Artificial Sequence
  chemically synthesized
ttttccttctcagaaaaagaaa

SEQ ID NO: 754711 - DNA, 22 bp, Artificial Sequence
  chemically synthesized
ctcttttccttctcagaaaaag

SEQ ID NO: 754712 - DNA, 22 bp, Artificial Sequence
  chemically synthesized
cctcttttccttctcagaaaaa

SEQ ID NO: 754713 - DNA, 22 bp, Artificial Sequence
  chemically synthesized
aattttctttttctgagaagga

SEQ ID NO: 754714 - DNA, 22 bp, Artificial Sequence
  chemically synthesized
tcgtgtcttcctcttttccttc

SEQ ID NO: 754715 - DNA, 22 bp, Artificial Sequence
  chemically synthesized
tctttttctgagaaggaaaaga

SEQ ID NO: 754716 - DNA, 22 bp, Artificial Sequence
  chemically synthesized
ctttttctgagaaggaaaagag

SEQ ID NO: 754717 - DNA, 22 bp, Artificial Sequence
  chemically synthesized
tttttctgagaaggaaaagagg

SEQ ID NO: 754718 - DNA, 22 bp, Artificial Sequence
  chemically synthesized
ctgtcgtgtcttcctcttttcc

SEQ ID NO: 754719 - DNA, 22 bp, Artificial Sequence
  chemically synthesized
tttctgagaaggaaaagaggaa

SEQ ID NO: 754720 - DNA, 22 bp, Artificial Sequence
  chemically synthesized
ttctgagaaggaaaagaggaag

SEQ ID NO: 754721 - DNA, 22 bp, Artificial Sequence
  chemically synthesized
tctgagaaggaaaagaggaaga

SEQ ID NO: 754722 - DNA, 22 bp, Artificial Sequence
  chemically synthesized
ctgagaaggaaaagaggaagac

SEQ ID NO: 754723 - DNA, 22 bp, Artificial Sequence
  chemically synthesized
tcctcctgtcgtgtcttcctct

SEQ ID NO: 754724 - DNA, 22 bp, Artificial Sequence
  chemically synthesized
tgagaaggaaaagaggaagaca

SEQ ID NO: 754725 - DNA, 22 bp, Artificial Sequence
  chemically synthesized
tgtcctcctgtcgtgtcttcct

SEQ ID NO: 754726 - DNA, 22 bp, Artificial Sequence
  chemically synthesized
agaaggaaaagaggaagacacg

SEQ ID NO: 754727 - DNA, 22 bp, Artificial Sequence
  chemically synthesized
tctgtcctcctgtcgtgtcttc

SEQ ID NO: 754728 - DNA, 22 bp, Artificial Sequence
  chemically synthesized
tcctctctgtcctcctgtcgtg

SEQ ID NO: 754729 - DNA, 22 bp, Artificial Sequence
  chemically synthesized
ttatcctctctgtcctcctgtc

SEQ ID NO: 754730 - DNA, 22 bp, Artificial Sequence
  chemically synthesized
gttatcctctctgtcctcctgt

SEQ ID NO: 754731 - DNA, 22 bp, Artificial Sequence
  chemically synthesized
tcttgttatcctctctgtcctc

SEQ ID NO: 754732 - DNA, 22 bp, Artificial Sequence
  chemically synthesized
gtcttgttatcctctctgtcct

SEQ ID NO: 754733 - DNA, 22 bp, Artificial Sequence
  chemically synthesized
tgtcttgttatcctctctgtcc

SEQ ID NO: 754734 - DNA, 22 bp, Artificial Sequence
  chemically synthesized
tccctttgtcttgttatcctct

SEQ ID NO: 754735 - DNA, 22 bp, Artificial Sequence
  chemically synthesized
atccctttgtcttgttatcctc

SEQ ID NO: 754736 - DNA, 22 bp, Artificial Sequence
  chemically synthesized
ttatccctttgtcttgttatcc

SEQ ID NO: 754737 - DNA, 22 bp, Artificial Sequence
  chemically synthesized
cttatccctttgtcttgttatc

SEQ ID NO: 754738 - DNA, 22 bp, Artificial Sequence
  chemically synthesized
aaaagaacttcttatccctttg

SEQ ID NO: 754739 - DNA, 22 bp, Artificial Sequence
  chemically synthesized
tgctaaaaagaacttcttatcc

SEQ ID NO: 754740 - DNA, 22 bp, Artificial Sequence
  chemically synthesized
ctatgctaaaaagaacttctta

SEQ ID NO: 754741 - DNA, 22 bp, Artificial Sequence
  chemically synthesized
aaatcattcctatgctaaaaag

SEQ ID NO: 754742 - DNA, 22 bp, Artificial Sequence
  chemically synthesized
ggttcaaatcattcctatgcta

SEQ ID NO: 754743 - DNA, 22 bp, Artificial Sequence
  chemically synthesized
taggttcaaatcattcctatgc

SEQ ID NO: 754744 - DNA, 22 bp, Artificial Sequence
  chemically synthesized
actctaggttcaaatcattcct

SEQ ID NO: 754745 - DNA, 22 bp, Artificial Sequence
  chemically synthesized
cactctaggttcaaatcattcc

SEQ ID NO: 754746 - DNA, 22 bp, Artificial Sequence
  chemically synthesized
tttttagcataggaatgatttg

SEQ ID NO: 754747 - DNA, 22 bp, Artificial Sequence
  chemically synthesized
tcactctaggttcaaatcattc

SEQ ID NO: 754748 - DNA, 22 bp, Artificial Sequence
  chemically synthesized
tttagcataggaatgatttgaa

SEQ ID NO: 754749 - DNA, 22 bp, Artificial Sequence
  chemically synthesized
ttagcataggaatgatttgaac

SEQ ID NO: 754750 - DNA, 22 bp, Artificial Sequence
  chemically synthesized
tagcataggaatgatttgaacc

SEQ ID NO: 754751 - DNA, 22 bp, Artificial Sequence
  chemically synthesized
agcataggaatgatttgaacct

SEQ ID NO: 754752 - DNA, 22 bp, Artificial Sequence
  chemically synthesized
gcataggaatgatttgaaccta

SEQ ID NO: 754753 - DNA, 22 bp, Artificial Sequence
  chemically synthesized
cgtctttcactctaggttcaaa

SEQ ID NO: 754754 - DNA, 22 bp, Artificial Sequence
  chemically synthesized
ccgtctttcactctaggttcaa

SEQ ID NO: 754755 - DNA, 22 bp, Artificial Sequence
  chemically synthesized
gcttccgtctttcactctaggt

SEQ ID NO: 754756 - DNA, 22 bp, Artificial Sequence
  chemically synthesized
ctagcttccgtctttcactcta

SEQ ID NO: 754757 - DNA, 22 bp, Artificial Sequence
  chemically synthesized
ctgctagcttccgtctttcact

SEQ ID NO: 754758 - DNA, 22 bp, Artificial Sequence
  chemically synthesized
gaacctagagtgaaagacggaa

SEQ ID NO: 754759 - DNA, 22 bp, Artificial Sequence
  chemically synthesized
aacctagagtgaaagacggaag

SEQ ID NO: 754760 - DNA, 22 bp, Artificial Sequence
  chemically synthesized
ccctactgctagcttccgtctt

SEQ ID NO: 754761 - DNA, 22 bp, Artificial Sequence
  chemically synthesized
gttaccctactgctagcttccg

SEQ ID NO: 754762 - DNA, 22 bp, Artificial Sequence
  chemically synthesized
gagtgaaagacggaagctagca

SEQ ID NO: 754763 - DNA, 22 bp, Artificial Sequence
  chemically synthesized
gacaaaccaagatggttggtta

SEQ ID NO: 754764 - DNA, 22 bp, Artificial Sequence
  chemically synthesized
gcagtagggtaaccaaccatct

SEQ ID NO: 754765 - DNA, 22 bp, Artificial Sequence
  chemically synthesized
aatgctggacaaaccaagatgg

SEQ ID NO: 754766 - DNA, 22 bp, Artificial Sequence
  chemically synthesized
aaaaactcaatgctggacaaac

SEQ ID NO: 754767 - DNA, 22 bp, Artificial Sequence
  chemically synthesized
atcctgaaaaactcaatgctgg

SEQ ID NO: 754768 - DNA, 22 bp, Artificial Sequence
  chemically synthesized
tcatcctgaaaaactcaatgct

SEQ ID NO: 754769 - DNA, 22 bp, Artificial Sequence
  chemically synthesized
ggtttgtccagcattgagtttt

SEQ ID NO: 754770 - DNA, 22 bp, Artificial Sequence
  chemically synthesized
gtttgtccagcattgagttttt

SEQ ID NO: 754771 - DNA, 22 bp, Artificial Sequence
  chemically synthesized
gtccagcattgagtttttcagg

SEQ ID NO: 754772 - DNA, 22 bp, Artificial Sequence
  chemically synthesized
tccagcattgagtttttcagga

SEQ ID NO: 754773 - DNA, 22 bp, Artificial Sequence
  chemically synthesized
acatcgaaagtctctcatcctg

SEQ ID NO: 754774 - DNA, 22 bp, Artificial Sequence
  chemically synthesized
aacatcgaaagtctctcatcct

SEQ ID NO: 754775 - DNA, 22 bp, Artificial Sequence
  chemically synthesized
taacatcgaaagtctctcatcc

SEQ ID NO: 754776 - DNA, 22 bp, Artificial Sequence
  chemically synthesized
agtttttcaggatgagagactt

SEQ ID NO: 754777 - DNA, 22 bp, Artificial Sequence
  chemically synthesized
gttttaacatcgaaagtctctc

SEQ ID NO: 754778 - DNA, 22 bp, Artificial Sequence
  chemically synthesized
tggttttaacatcgaaagtctc

SEQ ID NO: 754779 - DNA, 22 bp, Artificial Sequence
  chemically synthesized
ttcaggatgagagactttcgat

SEQ ID NO: 754780 - DNA, 22 bp, Artificial Sequence
  chemically synthesized
tcaggatgagagactttcgatg

SEQ ID NO: 754781 - DNA, 22 bp, Artificial Sequence
  chemically synthesized
ttctggttttaacatcgaaagt

SEQ ID NO: 754782 - DNA, 22 bp, Artificial Sequence
  chemically synthesized
caggatgagagactttcgatgt

SEQ ID NO: 754783 - DNA, 22 bp, Artificial Sequence
  chemically synthesized
aggatgagagactttcgatgtt

SEQ ID NO: 754784 - DNA, 22 bp, Artificial Sequence
  chemically synthesized
aaactattctggttttaacatc

SEQ ID NO: 754785 - DNA, 22 bp, Artificial Sequence
  chemically synthesized
ctgaaactattctggttttaac

SEQ ID NO: 754786 - DNA, 22 bp, Artificial Sequence
  chemically synthesized
cctgaaactattctggttttaa

SEQ ID NO: 754787 - DNA, 22 bp, Artificial Sequence
  chemically synthesized
tcctgaaactattctggtttta

SEQ ID NO: 754788 - DNA, 22 bp, Artificial Sequence
  chemically synthesized
tcgatgttaaaaccagaatagt

SEQ ID NO: 754789 - DNA, 22 bp, Artificial Sequence
  chemically synthesized
cgatgttaaaaccagaatagtt

SEQ ID NO: 754790 - DNA, 22 bp, Artificial Sequence
  chemically synthesized
gatgttaaaaccagaatagttt

SEQ ID NO: 754791 - DNA, 22 bp, Artificial Sequence
  chemically synthesized
tccaattttcctgaaactattc

SEQ ID NO: 754792 - DNA, 22 bp, Artificial Sequence
  chemically synthesized
aaaccagaatagtttcaggaaa

SEQ ID NO: 754793 - DNA, 22 bp, Artificial Sequence
  chemically synthesized
agactgtccaattttcctgaaa

SEQ ID NO: 754794 - DNA, 22 bp, Artificial Sequence
  chemically synthesized
ctgagactgtccaattttcctg

SEQ ID NO: 754795 - DNA, 22 bp, Artificial Sequence
  chemically synthesized
cctgagactgtccaattttcct

SEQ ID NO: 754796 - DNA, 22 bp, Artificial Sequence
  chemically synthesized
tcctgagactgtccaattttcc

SEQ ID NO: 754797 - DNA, 22 bp, Artificial Sequence
  chemically synthesized
gttttcctgagactgtccaatt

SEQ ID NO: 754798 - DNA, 22 bp, Artificial Sequence
  chemically synthesized
ctcgttttcctgagactgtcca

SEQ ID NO: 754799 - DNA, 22 bp, Artificial Sequence
  chemically synthesized
cctcgttttcctgagactgtcc

SEQ ID NO: 754800 - DNA, 22 bp, Artificial Sequence
  chemically synthesized
tcctcgttttcctgagactgtc

SEQ ID NO: 754801 - DNA, 22 bp, Artificial Sequence
  chemically synthesized
caggaaaattggacagtctcag

SEQ ID NO: 754802 - DNA, 22 bp, Artificial Sequence
  chemically synthesized
aggaaaattggacagtctcagg

SEQ ID NO: 754803 - DNA, 22 bp, Artificial Sequence
  chemically synthesized
gacagtctcaggaaaacgagga

SEQ ID NO: 754804 - DNA, 22 bp, Artificial Sequence
  chemically synthesized
gggtgaccaactttcctcgttt

SEQ ID NO: 754805 - DNA, 22 bp, Artificial Sequence
  chemically synthesized
aggaaaacgaggaaagttggtc

SEQ ID NO: 754806 - DNA, 22 bp, Artificial Sequence
  chemically synthesized
tcaaggtcgtaacatatatcta

SEQ ID NO: 754807 - DNA, 22 bp, Artificial Sequence
  chemically synthesized
tgtcaaggtcgtaacatatatc

SEQ ID NO: 754808 - DNA, 22 bp, Artificial Sequence
  chemically synthesized
ctgtcaaggtcgtaacatatat

SEQ ID NO: 754809 - DNA, 22 bp, Artificial Sequence
  chemically synthesized
gtcaccctagatatatgttacg

SEQ ID NO: 754810 - DNA, 22 bp, Artificial Sequence
  chemically synthesized
caccttctgtcaaggtcgtaac

SEQ ID NO: 754811 - DNA, 22 bp, Artificial Sequence
  chemically synthesized
tctccaccttctgtcaaggtcg

SEQ ID NO: 754812 - DNA, 22 bp, Artificial Sequence
  chemically synthesized
gatatatgttacgaccttgaca

SEQ ID NO: 754813 - DNA, 22 bp, Artificial Sequence
  chemically synthesized
caacaattatctccaccttctg

SEQ ID NO: 754814 - DNA, 22 bp, Artificial Sequence
  chemically synthesized
cgaccttgacagaaggtggaga

SEQ ID NO: 754815 - DNA, 22 bp, Artificial Sequence
  chemically synthesized
ttccaacaattatctccacctt

SEQ ID NO: 754816 - DNA, 22 bp, Artificial Sequence
  chemically synthesized
gttccaacaattatctccacct

SEQ ID NO: 754817 - DNA, 22 bp, Artificial Sequence
  chemically synthesized
gacagaaggtggagataattgt

SEQ ID NO: 754818 - DNA, 22 bp, Artificial Sequence
  chemically synthesized
acagaaggtggagataattgtt

SEQ ID NO: 754819 - DNA, 22 bp, Artificial Sequence
  chemically synthesized
cagaccttgttccaacaattat

SEQ ID NO: 754820 - DNA, 22 bp, Artificial Sequence
  chemically synthesized
acagaccttgttccaacaatta

SEQ ID NO: 754821 - DNA, 22 bp, Artificial Sequence
  chemically synthesized
tacagaccttgttccaacaatt

SEQ ID NO: 754822 - DNA, 22 bp, Artificial Sequence
  chemically synthesized
ttttacagaccttgttccaaca

SEQ ID NO: 754823 - DNA, 22 bp, Artificial Sequence
  chemically synthesized
attttacagaccttgttccaac

SEQ ID NO: 754824 - DNA, 22 bp, Artificial Sequence
  chemically synthesized
cttattttacagaccttgttcc

SEQ ID NO: 754825 - DNA, 22 bp, Artificial Sequence
  chemically synthesized
ccttattttacagaccttgttc

SEQ ID NO: 754826 - DNA, 22 bp, Artificial Sequence
  chemically synthesized
ttggaacaaggtctgtaaaata

SEQ ID NO: 754827 - DNA, 22 bp, Artificial Sequence
  chemically synthesized
gaacaaggtctgtaaaataagg

SEQ ID NO: 754828 - DNA, 22 bp, Artificial Sequence
  chemically synthesized
taaaataaggaaatggatcttt

SEQ ID NO: 754829 - DNA, 22 bp, Artificial Sequence
  chemically synthesized
aaaaaaaaaaaaaaaaaaaaaa

SEQ ID NO: 754830 - DNA, 22 bp, Artificial Sequence
  chemically synthesized
catctcaaaaaaaaaaaaaaaa

SEQ ID NO: 754831 - DNA, 22 bp, Artificial Sequence
  chemically synthesized
tttttttttttttttttttttt

SEQ ID NO: 754832 - DNA, 22 bp, Artificial Sequence
  chemically synthesized
tttttttttttttttttttttg

SEQ ID NO: 754833 - DNA, 22 bp, Artificial Sequence
  chemically synthesized
ttttttttttttttttttttga

SEQ ID NO: 754834 - DNA, 22 bp, Artificial Sequence
  chemically synthesized
tttttttttttttttttttgag

SEQ ID NO: 754835 - DNA, 22 bp, Artificial Sequence
  chemically synthesized
ttttttttttttttttttgaga

SEQ ID NO: 754836 - DNA, 22 bp, Artificial Sequence
  chemically synthesized
tttttttttttttttttgagat

SEQ ID NO: 754837 - DNA, 22 bp, Artificial Sequence
  chemically synthesized
ttttttttttttttttgagatg

SEQ ID NO: 754838 - DNA, 22 bp, Artificial Sequence
  chemically synthesized
tttttttttttttttgagatgg

SEQ ID NO: 754839 - DNA, 22 bp, Artificial Sequence
  chemically synthesized
ttttttttttttttgagatgga

SEQ ID NO: 754840 - DNA, 22 bp, Artificial Sequence
  chemically synthesized
tttttttttttttgagatggag

SEQ ID NO: 754841 - DNA, 22 bp, Artificial Sequence
  chemically synthesized
ttttttttttttgagatggagt

SEQ ID NO: 754842 - DNA, 22 bp, Artificial Sequence
  chemically synthesized
tttttttttttgagatggagtc

SEQ ID NO: 754843 - DNA, 22 bp, Artificial Sequence
  chemically synthesized
ttttttttttgagatggagtct

SEQ ID NO: 754844 - DNA, 22 bp, Artificial Sequence
  chemically synthesized
ggcgacagagcgagactccatc

SEQ ID NO: 754845 - DNA, 22 bp, Artificial Sequence
  chemically synthesized
tttttttttgagatggagtctc

SEQ ID NO: 754846 - DNA, 22 bp, Artificial Sequence
  chemically synthesized
ttttttttgagatggagtctcg

SEQ ID NO: 754847 - DNA, 22 bp, Artificial Sequence
  chemically synthesized
tttttttgagatggagtctcgc

SEQ ID NO: 754848 - DNA, 22 bp, Artificial Sequence
  chemically synthesized
ttttttgagatggagtctcgct

SEQ ID NO: 754849 - DNA, 22 bp, Artificial Sequence
  chemically synthesized
tttttgagatggagtctcgctc

SEQ ID NO: 754850 - DNA, 22 bp, Artificial Sequence
  chemically synthesized
ttttgagatggagtctcgctct

SEQ ID NO: 754851 - DNA, 22 bp, Artificial Sequence
  chemically synthesized
tttgagatggagtctcgctctg

SEQ ID NO: 754852 - DNA, 22 bp, Artificial Sequence
  chemically synthesized
cagcctgggcgacagagcgaga

SEQ ID NO: 754853 - DNA, 22 bp, Artificial Sequence
  chemically synthesized
ttgagatggagtctcgctctgt

SEQ ID NO: 754854 - DNA, 22 bp, Artificial Sequence
  chemically synthesized
tgagatggagtctcgctctgtc

SEQ ID NO: 754855 - DNA, 22 bp, Artificial Sequence
  chemically synthesized
gagatggagtctcgctctgtcg

SEQ ID NO: 754856 - DNA, 22 bp, Artificial Sequence
  chemically synthesized
agatggagtctcgctctgtcgc

SEQ ID NO: 754857 - DNA, 22 bp, Artificial Sequence
  chemically synthesized
cactccagcctgggcgacagag

SEQ ID NO: 754858 - DNA, 22 bp, Artificial Sequence
  chemically synthesized
cgccactgcactccagcctggg

SEQ ID NO: 754859 - DNA, 22 bp, Artificial Sequence
  chemically synthesized
gctctgtcgcccaggctggagt

SEQ ID NO: 754860 - DNA, 22 bp, Artificial Sequence
  chemically synthesized
tgtcgcccaggctggagtgcag

SEQ ID NO: 754861 - DNA, 22 bp, Artificial Sequence
  chemically synthesized
tcgcccaggctggagtgcagtg

SEQ ID NO: 754862 - DNA, 22 bp, Artificial Sequence
  chemically synthesized
cagtgagccgagattgcgccac

SEQ ID NO: 754863 - DNA, 22 bp, Artificial Sequence
  chemically synthesized
gcagtgagccgagattgcgcca

SEQ ID NO: 754864 - DNA, 22 bp, Artificial Sequence
  chemically synthesized
gagtgcagtggcgcaatctcgg

SEQ ID NO: 754865 - DNA, 22 bp, Artificial Sequence
  chemically synthesized
ggaggtggagcttgcagtgagc

SEQ ID NO: 754866 - DNA, 22 bp, Artificial Sequence
  chemically synthesized
ggctcactgcaagctccacctc

SEQ ID NO: 754867 - DNA, 22 bp, Artificial Sequence
  chemically synthesized
actgcaagctccacctcccagg

SEQ ID NO: 754868 - DNA, 22 bp, Artificial Sequence
  chemically synthesized
caagctccacctcccaggttca

SEQ ID NO: 754869 - DNA, 22 bp, Artificial Sequence
  chemically synthesized
aggcaggagaatggcatgaacc

SEQ ID NO: 754870 - DNA, 22 bp, Artificial Sequence
  chemically synthesized
cacctcccaggttcatgccatt

SEQ ID NO: 754871 - DNA, 22 bp, Artificial Sequence
  chemically synthesized
ccaggttcatgccattctcctg

SEQ ID NO: 754872 - DNA, 22 bp, Artificial Sequence
  chemically synthesized
gggaggctgaggcaggagaatg

SEQ ID NO: 754873 - DNA, 22 bp, Artificial Sequence
  chemically synthesized
ctcgggaggctgaggcaggaga

SEQ ID NO: 754874 - DNA, 22 bp, Artificial Sequence
  chemically synthesized
atgccattctcctgcctcagcc

SEQ ID NO: 754875 - DNA, 22 bp, Artificial Sequence
  chemically synthesized
tagtcccagctactcgggaggc

SEQ ID NO: 754876 - DNA, 22 bp, Artificial Sequence
  chemically synthesized
tcctgcctcagcctcccgagta

SEQ ID NO: 754877 - DNA, 22 bp, Artificial Sequence
  chemically synthesized
ctgcctcagcctcccgagtagc

SEQ ID NO: 754878 - DNA, 22 bp, Artificial Sequence
  chemically synthesized
cctcagcctcccgagtagctgg

SEQ ID NO: 754879 - DNA, 22 bp, Artificial Sequence
  chemically synthesized
agcctcccgagtagctgggact

SEQ ID NO: 754880 - DNA, 22 bp, Artificial Sequence
  chemically synthesized
ccgagtagctgggactacaggc

SEQ ID NO: 754881 - DNA, 22 bp, Artificial Sequence
  chemically synthesized
ggcgtggtggcgggcgcctgta

SEQ ID NO: 754882 - DNA, 22 bp, Artificial Sequence
  chemically synthesized
gctgggcgtggtggcgggcgcc

SEQ ID NO: 754883 - DNA, 22 bp, Artificial Sequence
  chemically synthesized
ggactacaggcgcccgccacca

SEQ ID NO: 754884 - DNA, 22 bp, Artificial Sequence
  chemically synthesized
caggcgcccgccaccacgccca

SEQ ID NO: 754885 - DNA, 22 bp, Artificial Sequence
  chemically synthesized
aaaatacaaaaaattagctggg

SEQ ID NO: 754886 - DNA, 22 bp, Artificial Sequence
  chemically synthesized
ctaaaaatacaaaaaattagct

SEQ ID NO: 754887 - DNA, 22 bp, Artificial Sequence
  chemically synthesized
tactaaaaatacaaaaaattag

SEQ ID NO: 754888 - DNA, 22 bp, Artificial Sequence
  chemically synthesized
attttttgtatttttagtagag

SEQ ID NO: 754889 - DNA, 22 bp, Artificial Sequence
  chemically synthesized
tttgtatttttagtagagacgg

SEQ ID NO: 754890 - DNA, 22 bp, Artificial Sequence
  chemically synthesized
ttgtatttttagtagagacggg

SEQ ID NO: 754891 - DNA, 22 bp, Artificial Sequence
  chemically synthesized
acacggtgaaaccccgtctcta

SEQ ID NO: 754892 - DNA, 22 bp, Artificial Sequence
  chemically synthesized
tgtatttttagtagagacgggg

SEQ ID NO: 754893 - DNA, 22 bp, Artificial Sequence
  chemically synthesized
gtatttttagtagagacggggt

SEQ ID NO: 754894 - DNA, 22 bp, Artificial Sequence
  chemically synthesized
tatttttagtagagacggggtt

SEQ ID NO: 754895 - DNA, 22 bp, Artificial Sequence
  chemically synthesized
gctaacacggtgaaaccccgtc

SEQ ID NO: 754896 - DNA, 22 bp, Artificial Sequence
  chemically synthesized
ttagtagagacggggtttcacc

SEQ ID NO: 754897 - DNA, 22 bp, Artificial Sequence
  chemically synthesized
tagtagagacggggtttcaccg

SEQ ID NO: 754898 - DNA, 22 bp, Artificial Sequence
  chemically synthesized
agtagagacggggtttcaccgt

SEQ ID NO: 754899 - DNA, 22 bp, Artificial Sequence
  chemically synthesized
gtagagacggggtttcaccgtg

SEQ ID NO: 754900 - DNA, 22 bp, Artificial Sequence
  chemically synthesized
ggagatggagaccatcctggct

SEQ ID NO: 754901 - DNA, 22 bp, Artificial Sequence
  chemically synthesized
caccgtgttagccaggatggtc

SEQ ID NO: 754902 - DNA, 22 bp, Artificial Sequence
  chemically synthesized
accgtgttagccaggatggtct

SEQ ID NO: 754903 - DNA, 22 bp, Artificial Sequence
  chemically synthesized
gccaggatggtctccatctccc

SEQ ID NO: 754904 - DNA, 22 bp, Artificial Sequence
  chemically synthesized
catctcccaacctcgtgatctg

SEQ ID NO: 754905 - DNA, 22 bp, Artificial Sequence
  chemically synthesized
ggaggccaaggcgggcagatca

SEQ ID NO: 754906 - DNA, 22 bp, Artificial Sequence
  chemically synthesized
gggaggccaaggcgggcagatc

SEQ ID NO: 754907 - DNA, 22 bp, Artificial Sequence
  chemically synthesized
tgggaggccaaggcgggcagat

SEQ ID NO: 754908 - DNA, 22 bp, Artificial Sequence
  chemically synthesized
ccaacctcgtgatctgcccgcc

SEQ ID NO: 754909 - DNA, 22 bp, Artificial Sequence
  chemically synthesized
gtgatctgcccgccttggcctc

SEQ ID NO: 754910 - DNA, 22 bp, Artificial Sequence
  chemically synthesized
taatcccagcactttgggaggc

SEQ ID NO: 754911 - DNA, 22 bp, Artificial Sequence
  chemically synthesized
cccgccttggcctcccaaagtg

SEQ ID NO: 754912 - DNA, 22 bp, Artificial Sequence
  chemically synthesized
acgcctgtaatcccagcacttt

SEQ ID NO: 754913 - DNA, 22 bp, Artificial Sequence
  chemically synthesized
ggcctcccaaagtgctgggatt

SEQ ID NO: 754914 - DNA, 22 bp, Artificial Sequence
  chemically synthesized
gcctcccaaagtgctgggatta

SEQ ID NO: 754915 - DNA, 22 bp, Artificial Sequence
  chemically synthesized
ccaaagtgctgggattacaggc

SEQ ID NO: 754916 - DNA, 22 bp, Artificial Sequence
  chemically synthesized
cggccgggcgtggtggctcacg

SEQ ID NO: 754917 - DNA, 22 bp, Artificial Sequence
  chemically synthesized
ccggccgggcgtggtggctcac

SEQ ID NO: 754918 - DNA, 22 bp, Artificial Sequence
  chemically synthesized
ggattacaggcgtgagccacca

SEQ ID NO: 754919 - DNA, 22 bp, Artificial Sequence
  chemically synthesized
caggcgtgagccaccacgcccg

SEQ ID NO: 754920 - DNA, 22 bp, Artificial Sequence
  chemically synthesized
agatccatttccggccgggcgt

SEQ ID NO: 754921 - DNA, 22 bp, Artificial Sequence
  chemically synthesized
aagatccatttccggccgggcg

SEQ ID NO: 754922 - DNA, 22 bp, Artificial Sequence
  chemically synthesized
taagatccatttccggccgggc

SEQ ID NO: 754923 - DNA, 22 bp, Artificial Sequence
  chemically synthesized
atgagacctttaagatccattt

SEQ ID NO: 754924 - DNA, 22 bp, Artificial Sequence
  chemically synthesized
gatgagacctttaagatccatt

SEQ ID NO: 754925 - DNA, 22 bp, Artificial Sequence
  chemically synthesized
agtttgatgagacctttaagat

SEQ ID NO: 754926 - DNA, 22 bp, Artificial Sequence
  chemically synthesized
aagtttgatgagacctttaaga

SEQ ID NO: 754927 - DNA, 22 bp, Artificial Sequence
  chemically synthesized
taagtttgatgagacctttaag

SEQ ID NO: 754928 - DNA, 22 bp, Artificial Sequence
  chemically synthesized
ttaagtttgatgagacctttaa

SEQ ID NO: 754929 - DNA, 22 bp, Artificial Sequence
  chemically synthesized
agtttttaagtttgatgagacc

SEQ ID NO: 754930 - DNA, 22 bp, Artificial Sequence
  chemically synthesized
aagtttttaagtttgatgagac

SEQ ID NO: 754931 - DNA, 22 bp, Artificial Sequence
  chemically synthesized
gtgccttaagtttttaagtttg

SEQ ID NO: 754932 - DNA, 22 bp, Artificial Sequence
  chemically synthesized
aaaggtctcatcaaacttaaaa

SEQ ID NO: 754933 - DNA, 22 bp, Artificial Sequence
  chemically synthesized
agtgccttaagtttttaagttt

SEQ ID NO: 754934 - DNA, 22 bp, Artificial Sequence
  chemically synthesized
aaggtctcatcaaacttaaaaa

SEQ ID NO: 754935 - DNA, 22 bp, Artificial Sequence
  chemically synthesized
tagtgccttaagtttttaagtt

SEQ ID NO: 754936 - DNA, 22 bp, Artificial Sequence
  chemically synthesized
ttagtgccttaagtttttaagt

SEQ ID NO: 754937 - DNA, 22 bp, Artificial Sequence
  chemically synthesized
agtttttagtgccttaagtttt

SEQ ID NO: 754938 - DNA, 22 bp, Artificial Sequence
  chemically synthesized
aagtttttagtgccttaagttt

SEQ ID NO: 754939 - DNA, 22 bp, Artificial Sequence
  chemically synthesized
atcaaacttaaaaacttaaggc

SEQ ID NO: 754940 - DNA, 22 bp, Artificial Sequence
  chemically synthesized
taagtttttagtgccttaagtt

SEQ ID NO: 754941 - DNA, 22 bp, Artificial Sequence
  chemically synthesized
ttaagtttttagtgccttaagt

SEQ ID NO: 754942 - DNA, 22 bp, Artificial Sequence
  chemically synthesized
tttaagtttttagtgccttaag

SEQ ID NO: 754943 - DNA, 22 bp, Artificial Sequence
  chemically synthesized
gactttttaagtttttagtgcc

SEQ ID NO: 754944 - DNA, 22 bp, Artificial Sequence
  chemically synthesized
ggactttttaagtttttagtgc

SEQ ID NO: 754945 - DNA, 22 bp, Artificial Sequence
  chemically synthesized
aaaaacttaaggcactaaaaac

SEQ ID NO: 754946 - DNA, 22 bp, Artificial Sequence
  chemically synthesized
aaaacttaaggcactaaaaact

SEQ ID NO: 754947 - DNA, 22 bp, Artificial Sequence
  chemically synthesized
aaggcactaaaaacttaaaaag

SEQ ID NO: 754948 - DNA, 22 bp, Artificial Sequence
  chemically synthesized
aggcactaaaaacttaaaaagt

SEQ ID NO: 754949 - DNA, 22 bp, Artificial Sequence
  chemically synthesized
aaaacttaaaaagtccaaggca

SEQ ID NO: 754950 - DNA, 22 bp, Artificial Sequence
  chemically synthesized
tatcatcaaatagtgccttgga

SEQ ID NO: 754951 - DNA, 22 bp, Artificial Sequence
  chemically synthesized
aaaaagtccaaggcactatttg

SEQ ID NO: 754952 - DNA, 22 bp, Artificial Sequence
  chemically synthesized
aaaagtccaaggcactatttga

SEQ ID NO: 754953 - DNA, 22 bp, Artificial Sequence
  chemically synthesized
acaatggaattatatcatcaaa

SEQ ID NO: 754954 - DNA, 22 bp, Artificial Sequence
  chemically synthesized
aacaatggaattatatcatcaa

SEQ ID NO: 754955 - DNA, 22 bp, Artificial Sequence
  chemically synthesized
taacaatggaattatatcatca

SEQ ID NO: 754956 - DNA, 22 bp, Artificial Sequence
  chemically synthesized
tccagttttaacaatggaatta

SEQ ID NO: 754957 - DNA, 22 bp, Artificial Sequence
  chemically synthesized
tttgatgatataattccattgt

SEQ ID NO: 754958 - DNA, 22 bp, Artificial Sequence
  chemically synthesized
ctgtccagttttaacaatggaa

SEQ ID NO: 754959 - DNA, 22 bp, Artificial Sequence
  chemically synthesized
actgtccagttttaacaatgga

SEQ ID NO: 754960 - DNA, 22 bp, Artificial Sequence
  chemically synthesized
gatgatataattccattgttaa

SEQ ID NO: 754961 - DNA, 22 bp, Artificial Sequence
  chemically synthesized
atgatataattccattgttaaa

SEQ ID NO: 754962 - DNA, 22 bp, Artificial Sequence
  chemically synthesized
tttactgtccagttttaacaat

SEQ ID NO: 754963 - DNA, 22 bp, Artificial Sequence
  chemically synthesized
aattatttactgtccagtttta

SEQ ID NO: 754964 - DNA, 22 bp, Artificial Sequence
  chemically synthesized
gaattatttactgtccagtttt

SEQ ID NO: 754965 - DNA, 22 bp, Artificial Sequence
  chemically synthesized
tgaattatttactgtccagttt

SEQ ID NO: 754966 - DNA, 22 bp, Artificial Sequence
  chemically synthesized
cattgttaaaactggacagtaa

SEQ ID NO: 754967 - DNA, 22 bp, Artificial Sequence
  chemically synthesized
gctttgaattatttactgtcca

SEQ ID NO: 754968 - DNA, 22 bp, Artificial Sequence
  chemically synthesized
agctttgaattatttactgtcc

SEQ ID NO: 754969 - DNA, 22 bp, Artificial Sequence
  chemically synthesized
cttagctttgaattatttactg

SEQ ID NO: 754970 - DNA, 22 bp, Artificial Sequence
  chemically synthesized
ttaaaactggacagtaaataat

SEQ ID NO: 754971 - DNA, 22 bp, Artificial Sequence
  chemically synthesized
aaactggacagtaaataattca

SEQ ID NO: 754972 - DNA, 22 bp, Artificial Sequence
  chemically synthesized
gacagtaaataattcaaagcta

SEQ ID NO: 754973 - DNA, 22 bp, Artificial Sequence
  chemically synthesized
acaatggatgctccttagcttt

SEQ ID NO: 754974 - DNA, 22 bp, Artificial Sequence
  chemically synthesized
tcacaatggatgctccttagct

SEQ ID NO: 754975 - DNA, 22 bp, Artificial Sequence
  chemically synthesized
aaagctaaggagcatccattgt

SEQ ID NO: 754976 - DNA, 22 bp, Artificial Sequence
  chemically synthesized
aggagcatccattgtgagagac

SEQ ID NO: 754977 - DNA, 22 bp, Artificial Sequence
  chemically synthesized
gatgggcaaacacgtggtctct

SEQ ID NO: 754978 - DNA, 22 bp, Artificial Sequence
  chemically synthesized
tgagagaccacgtgtttgccca

SEQ ID NO: 754979 - DNA, 22 bp, Artificial Sequence
  chemically synthesized
gcaacaactcgatgggcaaaca

SEQ ID NO: 754980 - DNA, 22 bp, Artificial Sequence
  chemically synthesized
ggcaacaactcgatgggcaaac

SEQ ID NO: 754981 - DNA, 22 bp, Artificial Sequence
  chemically synthesized
agtccttggcaacaactcgatg

SEQ ID NO: 754982 - DNA, 22 bp, Artificial Sequence
  chemically synthesized
gcccatcgagttgttgccaagg

SEQ ID NO: 754983 - DNA, 22 bp, Artificial Sequence
  chemically synthesized
cccatcgagttgttgccaagga

SEQ ID NO: 754984 - DNA, 22 bp, Artificial Sequence
  chemically synthesized
tggtggatctaagtccttggca

SEQ ID NO: 754985 - DNA, 22 bp, Artificial Sequence
  chemically synthesized
tgcagctgtggtggatctaagt

SEQ ID NO: 754986 - DNA, 22 bp, Artificial Sequence
  chemically synthesized
ttgccaaggacttagatccacc

SEQ ID NO: 754987 - DNA, 22 bp, Artificial Sequence
  chemically synthesized
ccaaggacttagatccaccaca

SEQ ID NO: 754988 - DNA, 22 bp, Artificial Sequence
  chemically synthesized
agaaatgaactgtgcagctgtg

SEQ ID NO: 754989 - DNA, 22 bp, Artificial Sequence
  chemically synthesized
aagaaatgaactgtgcagctgt

SEQ ID NO: 754990 - DNA, 22 bp, Artificial Sequence
  chemically synthesized
agatccaccacagctgcacagt

SEQ ID NO: 754991 - DNA, 22 bp, Artificial Sequence
  chemically synthesized
gatccaccacagctgcacagtt

SEQ ID NO: 754992 - DNA, 22 bp, Artificial Sequence
  chemically synthesized
atatttaagaaatgaactgtgc

SEQ ID NO: 754993 - DNA, 22 bp, Artificial Sequence
  chemically synthesized
aatgactcatatttaagaaatg

SEQ ID NO: 754994 - DNA, 22 bp, Artificial Sequence
  chemically synthesized
caatgactcatatttaagaaat

SEQ ID NO: 754995 - DNA, 22 bp, Artificial Sequence
  chemically synthesized
cacagttcatttcttaaatatg

SEQ ID NO: 754996 - DNA, 22 bp, Artificial Sequence
  chemically synthesized
atcttcaatgactcatatttaa

SEQ ID NO: 754997 - DNA, 22 bp, Artificial Sequence
  chemically synthesized
aatcttcaatgactcatattta

SEQ ID NO: 754998 - DNA, 22 bp, Artificial Sequence
  chemically synthesized
taatcttcaatgactcatattt

SEQ ID NO: 754999 - DNA, 22 bp, Artificial Sequence
  chemically synthesized
attttaatcttcaatgactcat

SEQ ID NO: 755000 - DNA, 22 bp, Artificial Sequence
  chemically synthesized
atttcttaaatatgagtcattg

SEQ ID NO: 755001 - DNA, 22 bp, Artificial Sequence
  chemically synthesized
cttaaatatgagtcattgaaga

SEQ ID NO: 755002 - DNA, 22 bp, Artificial Sequence
  chemically synthesized
gcctcattttaatcttcaatga

SEQ ID NO: 755003 - DNA, 22 bp, Artificial Sequence
  chemically synthesized
ttaaatatgagtcattgaagat

SEQ ID NO: 755004 - DNA, 22 bp, Artificial Sequence
  chemically synthesized
ggcctcattttaatcttcaatg

SEQ ID NO: 755005 - DNA, 22 bp, Artificial Sequence
  chemically synthesized
tggcctcattttaatcttcaat

SEQ ID NO: 755006 - DNA, 22 bp, Artificial Sequence
  chemically synthesized
aaatatgagtcattgaagatta

SEQ ID NO: 755007 - DNA, 22 bp, Artificial Sequence
  chemically synthesized
aatatgagtcattgaagattaa

SEQ ID NO: 755008 - DNA, 22 bp, Artificial Sequence
  chemically synthesized
tttggcctcattttaatcttca

SEQ ID NO: 755009 - DNA, 22 bp, Artificial Sequence
  chemically synthesized
ctttggcctcattttaatcttc

SEQ ID NO: 755010 - DNA, 22 bp, Artificial Sequence
  chemically synthesized
tctttggcctcattttaatctt

SEQ ID NO: 755011 - DNA, 22 bp, Artificial Sequence
  chemically synthesized
ttctttggcctcattttaatct

SEQ ID NO: 755012 - DNA, 22 bp, Artificial Sequence
  chemically synthesized
tcttttctttggcctcatttta

SEQ ID NO: 755013 - DNA, 22 bp, Artificial Sequence
  chemically synthesized
gtcttttctttggcctcatttt

SEQ ID NO: 755014 - DNA, 22 bp, Artificial Sequence
  chemically synthesized
tgtcttttctttggcctcattt

SEQ ID NO: 755015 - DNA, 22 bp, Artificial Sequence
  chemically synthesized
tttgtcttttctttggcctcat

SEQ ID NO: 755016 - DNA, 22 bp, Artificial Sequence
  chemically synthesized
ctttgtcttttctttggcctca

SEQ ID NO: 755017 - DNA, 22 bp, Artificial Sequence
  chemically synthesized
tctttgtcttttctttggcctc

SEQ ID NO: 755018 - DNA, 22 bp, Artificial Sequence
  chemically synthesized
aagattaaaatgaggccaaaga

SEQ ID NO: 755019 - DNA, 22 bp, Artificial Sequence
  chemically synthesized
aaatgaggccaaagaaaagaca

SEQ ID NO: 755020 - DNA, 22 bp, Artificial Sequence
  chemically synthesized
taataacagaactttctttgtc

SEQ ID NO: 755021 - DNA, 22 bp, Artificial Sequence
  chemically synthesized
gtaataacagaactttctttgt

SEQ ID NO: 755022 - DNA, 22 bp, Artificial Sequence
  chemically synthesized
tgtaataacagaactttctttg

SEQ ID NO: 755023 - DNA, 22 bp, Artificial Sequence
  chemically synthesized
tgtctttgtaataacagaactt

SEQ ID NO: 755024 - DNA, 22 bp, Artificial Sequence
  chemically synthesized
atgtctttgtaataacagaact

SEQ ID NO: 755025 - DNA, 22 bp, Artificial Sequence
  chemically synthesized
tgttattacaaagacataagca

SEQ ID NO: 755026 - DNA, 22 bp, Artificial Sequence
  chemically synthesized
ttattacaaagacataagcacc

SEQ ID NO: 755027 - DNA, 22 bp, Artificial Sequence
  chemically synthesized
ttacaaagacataagcaccatt

SEQ ID NO: 755028 - DNA, 22 bp, Artificial Sequence
  chemically synthesized
caaagacataagcaccattatt

SEQ ID NO: 755029 - DNA, 22 bp, Artificial Sequence
  chemically synthesized
aggcaacaatgtgaaaataatg

SEQ ID NO: 755030 - DNA, 22 bp, Artificial Sequence
  chemically synthesized
caggcaacaatgtgaaaataat

SEQ ID NO: 755031 - DNA, 22 bp, Artificial Sequence
  chemically synthesized
atttcaggcaacaatgtgaaaa

SEQ ID NO: 755032 - DNA, 22 bp, Artificial Sequence
  chemically synthesized
aatttcaggcaacaatgtgaaa

SEQ ID NO: 755033 - DNA, 22 bp, Artificial Sequence
  chemically synthesized
ttaatttcaggcaacaatgtga

SEQ ID NO: 755034 - DNA, 22 bp, Artificial Sequence
  chemically synthesized
cttaatttcaggcaacaatgtg

SEQ ID NO: 755035 - DNA, 22 bp, Artificial Sequence
  chemically synthesized
tcttaatttcaggcaacaatgt

SEQ ID NO: 755036 - DNA, 22 bp, Artificial Sequence
  chemically synthesized
ttcttaatttcaggcaacaatg

SEQ ID NO: 755037 - DNA, 22 bp, Artificial Sequence
  chemically synthesized
ttttcttaatttcaggcaacaa

SEQ ID NO: 755038 - DNA, 22 bp, Artificial Sequence
  chemically synthesized
cttttcttaatttcaggcaaca

SEQ ID NO: 755039 - DNA, 22 bp, Artificial Sequence
  chemically synthesized
tcttttcttaatttcaggcaac

SEQ ID NO: 755040 - DNA, 22 bp, Artificial Sequence
  chemically synthesized
ttttcacattgttgcctgaaat

SEQ ID NO: 755041 - DNA, 22 bp, Artificial Sequence
  chemically synthesized
tcacattgttgcctgaaattaa

SEQ ID NO: 755042 - DNA, 22 bp, Artificial Sequence
  chemically synthesized
cacattgttgcctgaaattaag

SEQ ID NO: 755043 - DNA, 22 bp, Artificial Sequence
  chemically synthesized
acattgttgcctgaaattaaga

SEQ ID NO: 755044 - DNA, 22 bp, Artificial Sequence
  chemically synthesized
catccactttcttttcttaatt

SEQ ID NO: 755045 - DNA, 22 bp, Artificial Sequence
  chemically synthesized
ccatccactttcttttcttaat

SEQ ID NO: 755046 - DNA, 22 bp, Artificial Sequence
  chemically synthesized
ttccatccactttcttttctta

SEQ ID NO: 755047 - DNA, 22 bp, Artificial Sequence
  chemically synthesized
ttgcctgaaattaagaaaagaa

SEQ ID NO: 755048 - DNA, 22 bp, Artificial Sequence
  chemically synthesized
tcttccatccactttcttttct

SEQ ID NO: 755049 - DNA, 22 bp, Artificial Sequence
  chemically synthesized
cctgaaattaagaaaagaaagt

SEQ ID NO: 755050 - DNA, 22 bp, Artificial Sequence
  chemically synthesized
aaattaagaaaagaaagtggat

SEQ ID NO: 755051 - DNA, 22 bp, Artificial Sequence
  chemically synthesized
accctctcttccatccactttc

SEQ ID NO: 755052 - DNA, 22 bp, Artificial Sequence
  chemically synthesized
aaccctctcttccatccacttt

SEQ ID NO: 755053 - DNA, 22 bp, Artificial Sequence
  chemically synthesized
agaaaagaaagtggatggaaga

SEQ ID NO: 755054 - DNA, 22 bp, Artificial Sequence
  chemically synthesized
aagatacaatcacttaaccctc

SEQ ID NO: 755055 - DNA, 22 bp, Artificial Sequence
  chemically synthesized
taaagatacaatcacttaaccc

SEQ ID NO: 755056 - DNA, 22 bp, Artificial Sequence
  chemically synthesized
aaattctaaagatacaatcact

SEQ ID NO: 755057 - DNA, 22 bp, Artificial Sequence
  chemically synthesized
gaaattctaaagatacaatcac

SEQ ID NO: 755058 - DNA, 22 bp, Artificial Sequence
  chemically synthesized
tgaaattctaaagatacaatca

SEQ ID NO: 755059 - DNA, 22 bp, Artificial Sequence
  chemically synthesized
ttgaaattctaaagatacaatc

SEQ ID NO: 755060 - DNA, 22 bp, Artificial Sequence
  chemically synthesized
aatcttttgaaattctaaagat

SEQ ID NO: 755061 - DNA, 22 bp, Artificial Sequence
  chemically synthesized
agtgattgtatctttagaattt

SEQ ID NO: 755062 - DNA, 22 bp, Artificial Sequence
  chemically synthesized
atctgaatcttttgaaattcta

SEQ ID NO: 755063 - DNA, 22 bp, Artificial Sequence
  chemically synthesized
aatctgaatcttttgaaattct

SEQ ID NO: 755064 - DNA, 22 bp, Artificial Sequence
  chemically synthesized
tatctttagaatttcaaaagat

SEQ ID NO: 755065 - DNA, 22 bp, Artificial Sequence
  chemically synthesized
tatttaatctgaatcttttgaa

SEQ ID NO: 755066 - DNA, 22 bp, Artificial Sequence
  chemically synthesized
gtatttaatctgaatcttttga

SEQ ID NO: 755067 - DNA, 22 bp, Artificial Sequence
  chemically synthesized
tgtatttaatctgaatcttttg

SEQ ID NO: 755068 - DNA, 22 bp, Artificial Sequence
  chemically synthesized
ttgtatttaatctgaatctttt

SEQ ID NO: 755069 - DNA, 22 bp, Artificial Sequence
  chemically synthesized
tagaatttcaaaagattcagat

SEQ ID NO: 755070 - DNA, 22 bp, Artificial Sequence
  chemically synthesized
agaatttcaaaagattcagatt

SEQ ID NO: 755071 - DNA, 22 bp, Artificial Sequence
  chemically synthesized
gaatttcaaaagattcagatta

SEQ ID NO: 755072 - DNA, 22 bp, Artificial Sequence
  chemically synthesized
tccttttgtatttaatctgaat

SEQ ID NO: 755073 - DNA, 22 bp, Artificial Sequence
  chemically synthesized
atccttttgtatttaatctgaa

SEQ ID NO: 755074 - DNA, 22 bp, Artificial Sequence
  chemically synthesized
tatccttttgtatttaatctga

SEQ ID NO: 755075 - DNA, 22 bp, Artificial Sequence
  chemically synthesized
caaaagattcagattaaataca

SEQ ID NO: 755076 - DNA, 22 bp, Artificial Sequence
  chemically synthesized
aaaagattcagattaaatacaa

SEQ ID NO: 755077 - DNA, 22 bp, Artificial Sequence
  chemically synthesized
tgggagttttatccttttgtat

SEQ ID NO: 755078 - DNA, 22 bp, Artificial Sequence
  chemically synthesized
gtgggagttttatccttttgta

SEQ ID NO: 755079 - DNA, 22 bp, Artificial Sequence
  chemically synthesized
tgtgggagttttatccttttgt

SEQ ID NO: 755080 - DNA, 22 bp, Artificial Sequence
  chemically synthesized
ttgtgggagttttatccttttg

SEQ ID NO: 755081 - DNA, 22 bp, Artificial Sequence
  chemically synthesized
tttgtgggagttttatcctttt

SEQ ID NO: 755082 - DNA, 22 bp, Artificial Sequence
  chemically synthesized
agattaaatacaaaaggataaa

SEQ ID NO: 755083 - DNA, 22 bp, Artificial Sequence
  chemically synthesized
tttttgtgggagttttatcctt

SEQ ID NO: 755084 - DNA, 22 bp, Artificial Sequence
  chemically synthesized
tctttttgtgggagttttatcc

SEQ ID NO: 755085 - DNA, 22 bp, Artificial Sequence
  chemically synthesized
tctctttttgtgggagttttat

SEQ ID NO: 755086 - DNA, 22 bp, Artificial Sequence
  chemically synthesized
aatacaaaaggataaaactccc

SEQ ID NO: 755087 - DNA, 22 bp, Artificial Sequence
  chemically synthesized
ctctctttttgtgggagtttta

SEQ ID NO: 755088 - DNA, 22 bp, Artificial Sequence
  chemically synthesized
tttctctctttttgtgggagtt

SEQ ID NO: 755089 - DNA, 22 bp, Artificial Sequence
  chemically synthesized
aaccaactatttctctcttttt

SEQ ID NO: 755090 - DNA, 22 bp, Artificial Sequence
  chemically synthesized
gaaccaactatttctctctttt

SEQ ID NO: 755091 - DNA, 22 bp, Artificial Sequence
  chemically synthesized
cttgaaccaactatttctctct

SEQ ID NO: 755092 - DNA, 22 bp, Artificial Sequence
  chemically synthesized
ccacaaaaagagagaaatagtt

SEQ ID NO: 755093 - DNA, 22 bp, Artificial Sequence
  chemically synthesized
acctccttgaaccaactatttc

SEQ ID NO: 755094 - DNA, 22 bp, Artificial Sequence
  chemically synthesized
tgacctccttgaaccaactatt

SEQ ID NO: 755095 - DNA, 22 bp, Artificial Sequence
  chemically synthesized
acctctgacctccttgaaccaa

SEQ ID NO: 755096 - DNA, 22 bp, Artificial Sequence
  chemically synthesized
aacctctgacctccttgaacca

SEQ ID NO: 755097 - DNA, 22 bp, Artificial Sequence
  chemically synthesized
taacctctgacctccttgaacc

SEQ ID NO: 755098 - DNA, 22 bp, Artificial Sequence
  chemically synthesized
tttaacctctgacctccttgaa

SEQ ID NO: 755099 - DNA, 22 bp, Artificial Sequence
  chemically synthesized
ctttaacctctgacctccttga

SEQ ID NO: 755100 - DNA, 22 bp, Artificial Sequence
  chemically synthesized
tctttaacctctgacctccttg

SEQ ID NO: 755101 - DNA, 22 bp, Artificial Sequence
  chemically synthesized
ccattttctttaacctctgacc

SEQ ID NO: 755102 - DNA, 22 bp, Artificial Sequence
  chemically synthesized
gttcaaggaggtcagaggttaa

SEQ ID NO: 755103 - DNA, 22 bp, Artificial Sequence
  chemically synthesized
ttgccattttctttaacctctg

SEQ ID NO: 755104 - DNA, 22 bp, Artificial Sequence
  chemically synthesized
aaggaggtcagaggttaaagaa

SEQ ID NO: 755105 - DNA, 22 bp, Artificial Sequence
  chemically synthesized
ccacatgataagaattattgcc

SEQ ID NO: 755106 - DNA, 22 bp, Artificial Sequence
  chemically synthesized
cccacatgataagaattattgc

SEQ ID NO: 755107 - DNA, 22 bp, Artificial Sequence
  chemically synthesized
tcccacatgataagaattattg

SEQ ID NO: 755108 - DNA, 22 bp, Artificial Sequence
  chemically synthesized
ttcccacatgataagaattatt

SEQ ID NO: 755109 - DNA, 22 bp, Artificial Sequence
  chemically synthesized
aagaaaatggcaataattctta

SEQ ID NO: 755110 - DNA, 22 bp, Artificial Sequence
  chemically synthesized
tagtttttcccacatgataaga

SEQ ID NO: 755111 - DNA, 22 bp, Artificial Sequence
  chemically synthesized
atagtttttcccacatgataag

SEQ ID NO: 755112 - DNA, 22 bp, Artificial Sequence
  chemically synthesized
tttatagtttttcccacatgat

SEQ ID NO: 755113 - DNA, 22 bp, Artificial Sequence
  chemically synthesized
ttatttatagtttttcccacat

SEQ ID NO: 755114 - DNA, 22 bp, Artificial Sequence
  chemically synthesized
ttatcatgtgggaaaaactata

SEQ ID NO: 755115 - DNA, 22 bp, Artificial Sequence
  chemically synthesized
catattgttatttatagttttt

SEQ ID NO: 755116 - DNA, 22 bp, Artificial Sequence
  chemically synthesized
atcatgtgggaaaaactataaa

SEQ ID NO: 755117 - DNA, 22 bp, Artificial Sequence
  chemically synthesized
tcatgtgggaaaaactataaat

SEQ ID NO: 755118 - DNA, 22 bp, Artificial Sequence
  chemically synthesized
aaattacatattgttatttata

SEQ ID NO: 755119 - DNA, 22 bp, Artificial Sequence
  chemically synthesized
aaaattacatattgttatttat

SEQ ID NO: 755120 - DNA, 22 bp, Artificial Sequence
  chemically synthesized
taaataacaatatgtaatttta

SEQ ID NO: 755121 - DNA, 22 bp, Artificial Sequence
  chemically synthesized
catataaccatgtttaaaatta

SEQ ID NO: 755122 - DNA, 22 bp, Artificial Sequence
  chemically synthesized
acatataaccatgtttaaaatt

SEQ ID NO: 755123 - DNA, 22 bp, Artificial Sequence
  chemically synthesized
aagaggatcttacatataacca

SEQ ID NO: 755124 - DNA, 22 bp, Artificial Sequence
  chemically synthesized
aattaaagaggatcttacatat

SEQ ID NO: 755125 - DNA, 22 bp, Artificial Sequence
  chemically synthesized
taaacatggttatatgtaagat

SEQ ID NO: 755126 - DNA, 22 bp, Artificial Sequence
  chemically synthesized
aaacatggttatatgtaagatc

SEQ ID NO: 755127 - DNA, 22 bp, Artificial Sequence
  chemically synthesized
aacatggttatatgtaagatcc

SEQ ID NO: 755128 - DNA, 22 bp, Artificial Sequence
  chemically synthesized
agtgactaaattaaagaggatc

SEQ ID NO: 755129 - DNA, 22 bp, Artificial Sequence
  chemically synthesized
ttaagtgactaaattaaagagg

SEQ ID NO: 755130 - DNA, 22 bp, Artificial Sequence
  chemically synthesized
gttaagtgactaaattaaagag

SEQ ID NO: 755131 - DNA, 22 bp, Artificial Sequence
  chemically synthesized
tatgtaagatcctctttaattt

SEQ ID NO: 755132 - DNA, 22 bp, Artificial Sequence
  chemically synthesized
aagtttgttaagtgactaaatt

SEQ ID NO: 755133 - DNA, 22 bp, Artificial Sequence
  chemically synthesized
gaagtttgttaagtgactaaat

SEQ ID NO: 755134 - DNA, 22 bp, Artificial Sequence
  chemically synthesized
cttgaagtttgttaagtgacta

SEQ ID NO: 755135 - DNA, 22 bp, Artificial Sequence
  chemically synthesized
tttaatttagtcacttaacaaa

SEQ ID NO: 755136 - DNA, 22 bp, Artificial Sequence
  chemically synthesized
taatttagtcacttaacaaact

SEQ ID NO: 755137 - DNA, 22 bp, Artificial Sequence
  chemically synthesized
aatttagtcacttaacaaactt

SEQ ID NO: 755138 - DNA, 22 bp, Artificial Sequence
  chemically synthesized
atttagtcacttaacaaacttc

SEQ ID NO: 755139 - DNA, 22 bp, Artificial Sequence
  chemically synthesized
agtcacttaacaaacttcaagc

SEQ ID NO: 755140 - DNA, 22 bp, Artificial Sequence
  chemically synthesized
gtcacttaacaaacttcaagca

SEQ ID NO: 755141 - DNA, 22 bp, Artificial Sequence
  chemically synthesized
atacatagtagttgcttgaagt

SEQ ID NO: 755142 - DNA, 22 bp, Artificial Sequence
  chemically synthesized
aacaaacttcaagcaactacta

SEQ ID NO: 755143 - DNA, 22 bp, Artificial Sequence
  chemically synthesized
acaaacttcaagcaactactat

SEQ ID NO: 755144 - DNA, 22 bp, Artificial Sequence
  chemically synthesized
gaacagtgtctgatacatagta

SEQ ID NO: 755145 - DNA, 22 bp, Artificial Sequence
  chemically synthesized
caagcaactactatgtatcaga

SEQ ID NO: 755146 - DNA, 22 bp, Artificial Sequence
  chemically synthesized
cctagaacagtgtctgatacat

SEQ ID NO: 755147 - DNA, 22 bp, Artificial Sequence
  chemically synthesized
aagcaactactatgtatcagac

SEQ ID NO: 755148 - DNA, 22 bp, Artificial Sequence
  chemically synthesized
attgcctagaacagtgtctgat

SEQ ID NO: 755149 - DNA, 22 bp, Artificial Sequence
  chemically synthesized
ctatgtatcagacactgttcta

SEQ ID NO: 755150 - DNA, 22 bp, Artificial Sequence
  chemically synthesized
tgtatcagacactgttctaggc

SEQ ID NO: 755151 - DNA, 22 bp, Artificial Sequence
  chemically synthesized
caaagaccacagatgttcattg

SEQ ID NO: 755152 - DNA, 22 bp, Artificial Sequence
  chemically synthesized
ttctaggcaatgaacatctgtg

SEQ ID NO: 755153 - DNA, 22 bp, Artificial Sequence
  chemically synthesized
catgctacaaagaccacagatg

SEQ ID NO: 755154 - DNA, 22 bp, Artificial Sequence
  chemically synthesized
taggcaatgaacatctgtggtc

SEQ ID NO: 755155 - DNA, 22 bp, Artificial Sequence
  chemically synthesized
ggcaatgaacatctgtggtctt

SEQ ID NO: 755156 - DNA, 22 bp, Artificial Sequence
  chemically synthesized
agctccatgctacaaagaccac

SEQ ID NO: 755157 - DNA, 22 bp, Artificial Sequence
  chemically synthesized
aagctccatgctacaaagacca

SEQ ID NO: 755158 - DNA, 22 bp, Artificial Sequence
  chemically synthesized
taagctccatgctacaaagacc

SEQ ID NO: 755159 - DNA, 22 bp, Artificial Sequence
  chemically synthesized
ttttaagctccatgctacaaag

SEQ ID NO: 755160 - DNA, 22 bp, Artificial Sequence
  chemically synthesized
gttttaagctccatgctacaaa

SEQ ID NO: 755161 - DNA, 22 bp, Artificial Sequence
  chemically synthesized
tggtctttgtagcatggagctt

SEQ ID NO: 755162 - DNA, 22 bp, Artificial Sequence
  chemically synthesized
cataaagccatttgttttaagc

SEQ ID NO: 755163 - DNA, 22 bp, Artificial Sequence
  chemically synthesized
tgtagcatggagcttaaaacaa

SEQ ID NO: 755164 - DNA, 22 bp, Artificial Sequence
  chemically synthesized
gtagcatggagcttaaaacaaa

SEQ ID NO: 755165 - DNA, 22 bp, Artificial Sequence
  chemically synthesized
tagcatggagcttaaaacaaat

SEQ ID NO: 755166 - DNA, 22 bp, Artificial Sequence
  chemically synthesized
ctacataaagccatttgtttta

SEQ ID NO: 755167 - DNA, 22 bp, Artificial Sequence
  chemically synthesized
actacataaagccatttgtttt

SEQ ID NO: 755168 - DNA, 22 bp, Artificial Sequence
  chemically synthesized
tactacataaagccatttgttt

SEQ ID NO: 755169 - DNA, 22 bp, Artificial Sequence
  chemically synthesized
ttactacataaagccatttgtt

SEQ ID NO: 755170 - DNA, 22 bp, Artificial Sequence
  chemically synthesized
tttactacataaagccatttgt

SEQ ID NO: 755171 - DNA, 22 bp, Artificial Sequence
  chemically synthesized
ttttactacataaagccatttg

SEQ ID NO: 755172 - DNA, 22 bp, Artificial Sequence
  chemically synthesized
tttttactacataaagccattt

SEQ ID NO: 755173 - DNA, 22 bp, Artificial Sequence
  chemically synthesized
ttttttactacataaagccatt

SEQ ID NO: 755174 - DNA, 22 bp, Artificial Sequence
  chemically synthesized
tttttttactacataaagccat

SEQ ID NO: 755175 - DNA, 22 bp, Artificial Sequence
  chemically synthesized
ctttttttttactacataaagc

SEQ ID NO: 755176 - DNA, 22 bp, Artificial Sequence
  chemically synthesized
aaaacaaatggctttatgtagt

SEQ ID NO: 755177 - DNA, 22 bp, Artificial Sequence
  chemically synthesized
aaacaaatggctttatgtagta

SEQ ID NO: 755178 - DNA, 22 bp, Artificial Sequence
  chemically synthesized
cattgctttttttttactacat

SEQ ID NO: 755179 - DNA, 22 bp, Artificial Sequence
  chemically synthesized
tacattgctttttttttactac

SEQ ID NO: 755180 - DNA, 22 bp, Artificial Sequence
  chemically synthesized
tatgtagtaaaaaaaaagcaat

SEQ ID NO: 755181 - DNA, 22 bp, Artificial Sequence
  chemically synthesized
atgtagtaaaaaaaaagcaatg

SEQ ID NO: 755182 - DNA, 22 bp, Artificial Sequence
  chemically synthesized
atgcagattctacattgctttt

SEQ ID NO: 755183 - DNA, 22 bp, Artificial Sequence
  chemically synthesized
tgtagtaaaaaaaaagcaatgt

SEQ ID NO: 755184 - DNA, 22 bp, Artificial Sequence
  chemically synthesized
aatgcagattctacattgcttt

SEQ ID NO: 755185 - DNA, 22 bp, Artificial Sequence
  chemically synthesized
taatgcagattctacattgctt

SEQ ID NO: 755186 - DNA, 22 bp, Artificial Sequence
  chemically synthesized
ttttaatgcagattctacattg

SEQ ID NO: 755187 - DNA, 22 bp, Artificial Sequence
  chemically synthesized
cattattttaatgcagattcta

SEQ ID NO: 755188 - DNA, 22 bp, Artificial Sequence
  chemically synthesized
ccattattttaatgcagattct

SEQ ID NO: 755189 - DNA, 22 bp, Artificial Sequence
  chemically synthesized
tccattattttaatgcagattc

SEQ ID NO: 755190 - DNA, 22 bp, Artificial Sequence
  chemically synthesized
gctttccattattttaatgcag

SEQ ID NO: 755191 - DNA, 22 bp, Artificial Sequence
  chemically synthesized
aaaaattggctttccattattt

SEQ ID NO: 755192 - DNA, 22 bp, Artificial Sequence
  chemically synthesized
cattaaaataatggaaagccaa

SEQ ID NO: 755193 - DNA, 22 bp, Artificial Sequence
  chemically synthesized
gatactgaaaaattggctttcc

SEQ ID NO: 755194 - DNA, 22 bp, Artificial Sequence
  chemically synthesized
ttagatactgaaaaattggctt

SEQ ID NO: 755195 - DNA, 22 bp, Artificial Sequence
  chemically synthesized
aaataatggaaagccaattttt

SEQ ID NO: 755196 - DNA, 22 bp, Artificial Sequence
  chemically synthesized
tggtgagttattagatactgaa

SEQ ID NO: 755197 - DNA, 22 bp, Artificial Sequence
  chemically synthesized
atggtgagttattagatactga

SEQ ID NO: 755198 - DNA, 22 bp, Artificial Sequence
  chemically synthesized
ttcagtatctaataactcacca

SEQ ID NO: 755199 - DNA, 22 bp, Artificial Sequence
  chemically synthesized
tcagtatctaataactcaccat

SEQ ID NO: 755200 - DNA, 22 bp, Artificial Sequence
  chemically synthesized
cagtatctaataactcaccata

SEQ ID NO: 755201 - DNA, 22 bp, Artificial Sequence
  chemically synthesized
caacatgcagtttatggtgagt

SEQ ID NO: 755202 - DNA, 22 bp, Artificial Sequence
  chemically synthesized
agtatctaataactcaccataa

SEQ ID NO: 755203 - DNA, 22 bp, Artificial Sequence
  chemically synthesized
tactacaacatgcagtttatgg

SEQ ID NO: 755204 - DNA, 22 bp, Artificial Sequence
  chemically synthesized
ataactcaccataaactgcatg

SEQ ID NO: 755205 - DNA, 22 bp, Artificial Sequence
  chemically synthesized
accataaactgcatgttgtagt

SEQ ID NO: 755206 - DNA, 22 bp, Artificial Sequence
  chemically synthesized
aaatgcaataaattatactaca

SEQ ID NO: 755207 - DNA, 22 bp, Artificial Sequence
  chemically synthesized
aaaatgcaataaattatactac

SEQ ID NO: 755208 - DNA, 22 bp, Artificial Sequence
  chemically synthesized
taaaatgcaataaattatacta

SEQ ID NO: 755209 - DNA, 22 bp, Artificial Sequence
  chemically synthesized
ttaaaatgcaataaattatact

SEQ ID NO: 755210 - DNA, 22 bp, Artificial Sequence
  chemically synthesized
ttttaaaatgcaataaattata

SEQ ID NO: 755211 - DNA, 22 bp, Artificial Sequence
  chemically synthesized
cttttaaaatgcaataaattat

SEQ ID NO: 755212 - DNA, 22 bp, Artificial Sequence
  chemically synthesized
catgttgtagtataatttattg

SEQ ID NO: 755213 - DNA, 22 bp, Artificial Sequence
  chemically synthesized
tcttttaaaatgcaataaatta

SEQ ID NO: 755214 - DNA, 22 bp, Artificial Sequence
  chemically synthesized
tttcttttaaaatgcaataaat

SEQ ID NO: 755215 - DNA, 22 bp, Artificial Sequence
  chemically synthesized
ctttcttttaaaatgcaataaa

SEQ ID NO: 755216 - DNA, 22 bp, Artificial Sequence
  chemically synthesized
tctttcttttaaaatgcaataa

SEQ ID NO: 755217 - DNA, 22 bp, Artificial Sequence
  chemically synthesized
ttctttcttttaaaatgcaata

SEQ ID NO: 755218 - DNA, 22 bp, Artificial Sequence
  chemically synthesized
tagtataatttattgcatttta

SEQ ID NO: 755219 - DNA, 22 bp, Artificial Sequence
  chemically synthesized
atttttctttcttttaaaatgc

SEQ ID NO: 755220 - DNA, 22 bp, Artificial Sequence
  chemically synthesized
catttttctttcttttaaaatg

SEQ ID NO: 755221 - DNA, 22 bp, Artificial Sequence
  chemically synthesized
attgcattttaaaagaaagaaa

SEQ ID NO: 755222 - DNA, 22 bp, Artificial Sequence
  chemically synthesized
ttgcattttaaaagaaagaaaa

SEQ ID NO: 755223 - DNA, 22 bp, Artificial Sequence
  chemically synthesized
cattttaaaagaaagaaaaatg

SEQ ID NO: 755224 - DNA, 22 bp, Artificial Sequence
  chemically synthesized
aaaaaaagtcttcatttttctt

SEQ ID NO: 755225 - DNA, 22 bp, Artificial Sequence
  chemically synthesized
aaaaaaaagtcttcatttttct

SEQ ID NO: 755226 - DNA, 22 bp, Artificial Sequence
  chemically synthesized
taaaaaaaagtcttcatttttc

SEQ ID NO: 755227 - DNA, 22 bp, Artificial Sequence
  chemically synthesized
ttaaaaaaaagtcttcattttt

SEQ ID NO: 755228 - DNA, 22 bp, Artificial Sequence
  chemically synthesized
tttaaaaaaaagtcttcatttt

SEQ ID NO: 755229 - DNA, 22 bp, Artificial Sequence
  chemically synthesized
taaaagaaagaaaaatgaagac

SEQ ID NO: 755230 - DNA, 22 bp, Artificial Sequence
  chemically synthesized
ttttaaaaaaaagtcttcattt

SEQ ID NO: 755231 - DNA, 22 bp, Artificial Sequence
  chemically synthesized
aaaagaaagaaaaatgaagact

SEQ ID NO: 755232 - DNA, 22 bp, Artificial Sequence
  chemically synthesized
tttttaaaaaaaagtcttcatt

SEQ ID NO: 755233 - DNA, 22 bp, Artificial Sequence
  chemically synthesized
aaagaaagaaaaatgaagactt

SEQ ID NO: 755234 - DNA, 22 bp, Artificial Sequence
  chemically synthesized
tctttttttaaaaaaaagtctt

SEQ ID NO: 755235 - DNA, 22 bp, Artificial Sequence
  chemically synthesized
gtctttttttaaaaaaaagtct

SEQ ID NO: 755236 - DNA, 22 bp, Artificial Sequence
  chemically synthesized
tttgtctttttttaaaaaaaag

SEQ ID NO: 755237 - DNA, 22 bp, Artificial Sequence
  chemically synthesized
gtttgtctttttttaaaaaaaa

SEQ ID NO: 755238 - DNA, 22 bp, Artificial Sequence
  chemically synthesized
ttgtttgtctttttttaaaaaa

SEQ ID NO: 755239 - DNA, 22 bp, Artificial Sequence
  chemically synthesized
aatattcttgtttgtctttttt

SEQ ID NO: 755240 - DNA, 22 bp, Artificial Sequence
  chemically synthesized
ttttttaaaaaaagacaaacaa

SEQ ID NO: 755241 - DNA, 22 bp, Artificial Sequence
  chemically synthesized
tttttaaaaaaagacaaacaag

SEQ ID NO: 755242 - DNA, 22 bp, Artificial Sequence
  chemically synthesized
acattaaatattcttgtttgtc

SEQ ID NO: 755243 - DNA, 22 bp, Artificial Sequence
  chemically synthesized
ttttaaaaaaagacaaacaaga

SEQ ID NO: 755244 - DNA, 22 bp, Artificial Sequence
  chemically synthesized
gacattaaatattcttgtttgt

SEQ ID NO: 755245 - DNA, 22 bp, Artificial Sequence
  chemically synthesized
tttaaaaaaagacaaacaagaa

SEQ ID NO: 755246 - DNA, 22 bp, Artificial Sequence
  chemically synthesized
ttaaaaaaagacaaacaagaat

SEQ ID NO: 755247 - DNA, 22 bp, Artificial Sequence
  chemically synthesized
ttgacattaaatattcttgttt

SEQ ID NO: 755248 - DNA, 22 bp, Artificial Sequence
  chemically synthesized
taaaaaaagacaaacaagaata

SEQ ID NO: 755249 - DNA, 22 bp, Artificial Sequence
  chemically synthesized
aaaaaaagacaaacaagaatat

SEQ ID NO: 755250 - DNA, 22 bp, Artificial Sequence
  chemically synthesized
aaaaaagacaaacaagaatatt

SEQ ID NO: 755251 - DNA, 22 bp, Artificial Sequence
  chemically synthesized
tcaaaatcaaggctcttgacat

SEQ ID NO: 755252 - DNA, 22 bp, Artificial Sequence
  chemically synthesized
atcaaaatcaaggctcttgaca

SEQ ID NO: 755253 - DNA, 22 bp, Artificial Sequence
  chemically synthesized
aatgtcaagagccttgattttg

SEQ ID NO: 755254 - DNA, 22 bp, Artificial Sequence
  chemically synthesized
atgtcaagagccttgattttga

SEQ ID NO: 755255 - DNA, 22 bp, Artificial Sequence
  chemically synthesized
ggagacaagacacttatcaaaa

SEQ ID NO: 755256 - DNA, 22 bp, Artificial Sequence
  chemically synthesized
gggagacaagacacttatcaaa

SEQ ID NO: 755257 - DNA, 22 bp, Artificial Sequence
  chemically synthesized
tgggagacaagacacttatcaa

SEQ ID NO: 755258 - DNA, 22 bp, Artificial Sequence
  chemically synthesized
ttgggagacaagacacttatca

SEQ ID NO: 755259 - DNA, 22 bp, Artificial Sequence
  chemically synthesized
tttgggagacaagacacttatc

SEQ ID NO: 755260 - DNA, 22 bp, Artificial Sequence
  chemically synthesized
gattttgataagtgtcttgtct

SEQ ID NO: 755261 - DNA, 22 bp, Artificial Sequence
  chemically synthesized
attttgataagtgtcttgtctc

SEQ ID NO: 755262 - DNA, 22 bp, Artificial Sequence
  chemically synthesized
tgataagtgtcttgtctcccaa

SEQ ID NO: 755263 - DNA, 22 bp, Artificial Sequence
  chemically synthesized
aaacaggcctttttgggagaca

SEQ ID NO: 755264 - DNA, 22 bp, Artificial Sequence
  chemically synthesized
gataagtgtcttgtctcccaaa

SEQ ID NO: 755265 - DNA, 22 bp, Artificial Sequence
  chemically synthesized
caaacaggcctttttgggagac

SEQ ID NO: 755266 - DNA, 22 bp, Artificial Sequence
  chemically synthesized
ataagtgtcttgtctcccaaaa

SEQ ID NO: 755267 - DNA, 22 bp, Artificial Sequence
  chemically synthesized
tcaaacaggcctttttgggaga

SEQ ID NO: 755268 - DNA, 22 bp, Artificial Sequence
  chemically synthesized
tttcaaacaggcctttttggga

SEQ ID NO: 755269 - DNA, 22 bp, Artificial Sequence
  chemically synthesized
aaacctctttcaaacaggcctt

SEQ ID NO: 755270 - DNA, 22 bp, Artificial Sequence
  chemically synthesized
gtctcccaaaaaggcctgtttg

SEQ ID NO: 755271 - DNA, 22 bp, Artificial Sequence
  chemically synthesized
tcaaacctctttcaaacaggcc

SEQ ID NO: 755272 - DNA, 22 bp, Artificial Sequence
  chemically synthesized
tctcccaaaaaggcctgtttga

SEQ ID NO: 755273 - DNA, 22 bp, Artificial Sequence
  chemically synthesized
ctcaaacctctttcaaacaggc

SEQ ID NO: 755274 - DNA, 22 bp, Artificial Sequence
  chemically synthesized
tctcaaacctctttcaaacagg

SEQ ID NO: 755275 - DNA, 22 bp, Artificial Sequence
  chemically synthesized
ccaaaaaggcctgtttgaaaga

SEQ ID NO: 755276 - DNA, 22 bp, Artificial Sequence
  chemically synthesized
tttgaaagaggtttgagaaaat

SEQ ID NO: 755277 - DNA, 22 bp, Artificial Sequence
  chemically synthesized
gaaagaggtttgagaaaatata

SEQ ID NO: 755278 - DNA, 22 bp, Artificial Sequence
  chemically synthesized
aaagaggtttgagaaaatatat

SEQ ID NO: 755279 - DNA, 22 bp, Artificial Sequence
  chemically synthesized
gagaaaatatatactcatatat

SEQ ID NO: 755280 - DNA, 22 bp, Artificial Sequence
  chemically synthesized
agaaaatatatactcatatata

SEQ ID NO: 755281 - DNA, 22 bp, Artificial Sequence
  chemically synthesized
tatgacaaaatcagtatatatg

SEQ ID NO: 755282 - DNA, 22 bp, Artificial Sequence
  chemically synthesized
atatgacaaaatcagtatatat

SEQ ID NO: 755283 - DNA, 22 bp, Artificial Sequence
  chemically synthesized
accaaaatttatatgacaaaat

SEQ ID NO: 755284 - DNA, 22 bp, Artificial Sequence
  chemically synthesized
atatatactgattttgtcatat

SEQ ID NO: 755285 - DNA, 22 bp, Artificial Sequence
  chemically synthesized
aaatattaaccaaaatttatat

SEQ ID NO: 755286 - DNA, 22 bp, Artificial Sequence
  chemically synthesized
aaaatattaaccaaaatttata

SEQ ID NO: 755287 - DNA, 22 bp, Artificial Sequence
  chemically synthesized
attttgtcatataaattttggt

SEQ ID NO: 755288 - DNA, 22 bp, Artificial Sequence
  chemically synthesized
gtttaaaatattaaccaaaatt

SEQ ID NO: 755289 - DNA, 22 bp, Artificial Sequence
  chemically synthesized
tggtttaaaatattaaccaaaa

SEQ ID NO: 755290 - DNA, 22 bp, Artificial Sequence
  chemically synthesized
tgtcatataaattttggttaat

SEQ ID NO: 755291 - DNA, 22 bp, Artificial Sequence
  chemically synthesized
gtcatataaattttggttaata

SEQ ID NO: 755292 - DNA, 22 bp, Artificial Sequence
  chemically synthesized
tctggtttaaaatattaaccaa

SEQ ID NO: 755293 - DNA, 22 bp, Artificial Sequence
  chemically synthesized
tcatataaattttggttaatat

SEQ ID NO: 755294 - DNA, 22 bp, Artificial Sequence
  chemically synthesized
ctctggtttaaaatattaacca

SEQ ID NO: 755295 - DNA, 22 bp, Artificial Sequence
  chemically synthesized
acttctctggtttaaaatatta

SEQ ID NO: 755296 - DNA, 22 bp, Artificial Sequence
  chemically synthesized
tggttaatattttaaaccagag

SEQ ID NO: 755297 - DNA, 22 bp, Artificial Sequence
  chemically synthesized
ggttaatattttaaaccagaga

SEQ ID NO: 755298 - DNA, 22 bp, Artificial Sequence
  chemically synthesized
gttaatattttaaaccagagaa

SEQ ID NO: 755299 - DNA, 22 bp, Artificial Sequence
  chemically synthesized
atattttaaaccagagaagtca

SEQ ID NO: 755300 - DNA, 22 bp, Artificial Sequence
  chemically synthesized
tcatcacataaaggaactgact

SEQ ID NO: 755301 - DNA, 22 bp, Artificial Sequence
  chemically synthesized
taaaccagagaagtcagttcct

SEQ ID NO: 755302 - DNA, 22 bp, Artificial Sequence
  chemically synthesized
aaaccagagaagtcagttcctt

SEQ ID NO: 755303 - DNA, 22 bp, Artificial Sequence
  chemically synthesized
tatcatcacataaaggaactga

SEQ ID NO: 755304 - DNA, 22 bp, Artificial Sequence
  chemically synthesized
aaccagagaagtcagttccttt

SEQ ID NO: 755305 - DNA, 22 bp, Artificial Sequence
  chemically synthesized
ctatcatcacataaaggaactg

SEQ ID NO: 755306 - DNA, 22 bp, Artificial Sequence
  chemically synthesized
tctatcatcacataaaggaact

SEQ ID NO: 755307 - DNA, 22 bp, Artificial Sequence
  chemically synthesized
ttctatcatcacataaaggaac

SEQ ID NO: 755308 - DNA, 22 bp, Artificial Sequence
  chemically synthesized
ataccttttctatcatcacata

SEQ ID NO: 755309 - DNA, 22 bp, Artificial Sequence
  chemically synthesized
tatctgataccttttctatcat

SEQ ID NO: 755310 - DNA, 22 bp, Artificial Sequence
  chemically synthesized
ctttatgtgatgatagaaaagg

SEQ ID NO: 755311 - DNA, 22 bp, Artificial Sequence
  chemically synthesized
tatgtgatgatagaaaaggtat

SEQ ID NO: 755312 - DNA, 22 bp, Artificial Sequence
  chemically synthesized
atgtgatgatagaaaaggtatc

SEQ ID NO: 755313 - DNA, 22 bp, Artificial Sequence
  chemically synthesized
tgtgatgatagaaaaggtatca

SEQ ID NO: 755314 - DNA, 22 bp, Artificial Sequence
  chemically synthesized
tatgtacatgggagaaaatatc

SEQ ID NO: 755315 - DNA, 22 bp, Artificial Sequence
  chemically synthesized
tgtatgtacatgggagaaaata

SEQ ID NO: 755316 - DNA, 22 bp, Artificial Sequence
  chemically synthesized
taaatacgtattctgtatgtac

SEQ ID NO: 755317 - DNA, 22 bp, Artificial Sequence
  chemically synthesized
tctcccatgtacatacagaata

SEQ ID NO: 755318 - DNA, 22 bp, Artificial Sequence
  chemically synthesized
ctcccatgtacatacagaatac

SEQ ID NO: 755319 - DNA, 22 bp, Artificial Sequence
  chemically synthesized
tcccatgtacatacagaatacg

SEQ ID NO: 755320 - DNA, 22 bp, Artificial Sequence
  chemically synthesized
aatattgtaaatacgtattctg

SEQ ID NO: 755321 - DNA, 22 bp, Artificial Sequence
  chemically synthesized
ccatgtacatacagaatacgta

SEQ ID NO: 755322 - DNA, 22 bp, Artificial Sequence
  chemically synthesized
acatctgaatattgtaaatacg

SEQ ID NO: 755323 - DNA, 22 bp, Artificial Sequence
  chemically synthesized
aatgctaacatctgaatattgt

SEQ ID NO: 755324 - DNA, 22 bp, Artificial Sequence
  chemically synthesized
acatctgaatgctaacatctga

SEQ ID NO: 755325 - DNA, 22 bp, Artificial Sequence
  chemically synthesized
aacatctgaatgctaacatctg

SEQ ID NO: 755326 - DNA, 22 bp, Artificial Sequence
  chemically synthesized
acaatattcagatgttagcatt

SEQ ID NO: 755327 - DNA, 22 bp, Artificial Sequence
  chemically synthesized
tcttaacatctgaatgctaaca

SEQ ID NO: 755328 - DNA, 22 bp, Artificial Sequence
  chemically synthesized
caatattcagatgttagcattc

SEQ ID NO: 755329 - DNA, 22 bp, Artificial Sequence
  chemically synthesized
agatgttagcattcagatgtta

SEQ ID NO: 755330 - DNA, 22 bp, Artificial Sequence
  chemically synthesized
aggaagtaattatcttaacatc

SEQ ID NO: 755331 - DNA, 22 bp, Artificial Sequence
  chemically synthesized
gcattcagatgttaagataatt

SEQ ID NO: 755332 - DNA, 22 bp, Artificial Sequence
  chemically synthesized
aagggattcaggaagtaattat

SEQ ID NO: 755333 - DNA, 22 bp, Artificial Sequence
  chemically synthesized
agatgttaagataattacttcc

SEQ ID NO: 755334 - DNA, 22 bp, Artificial Sequence
  chemically synthesized
ttcaagggattcaggaagtaat

SEQ ID NO: 755335 - DNA, 22 bp, Artificial Sequence
  chemically synthesized
tctgttcaagggattcaggaag

SEQ ID NO: 755336 - DNA, 22 bp, Artificial Sequence
  chemically synthesized
atctgttcaagggattcaggaa

SEQ ID NO: 755337 - DNA, 22 bp, Artificial Sequence
  chemically synthesized
tatctgttcaagggattcagga

SEQ ID NO: 755338 - DNA, 22 bp, Artificial Sequence
  chemically synthesized
agataattacttcctgaatccc

SEQ ID NO: 755339 - DNA, 22 bp, Artificial Sequence
  chemically synthesized
cttcctgaatcccttgaacaga

SEQ ID NO: 755340 - DNA, 22 bp, Artificial Sequence
  chemically synthesized
cctgaatcccttgaacagataa

SEQ ID NO: 755341 - DNA, 22 bp, Artificial Sequence
  chemically synthesized
acaaagataattttatctgttc

SEQ ID NO: 755342 - DNA, 22 bp, Artificial Sequence
  chemically synthesized
ctgaatcccttgaacagataaa

SEQ ID NO: 755343 - DNA, 22 bp, Artificial Sequence
  chemically synthesized
aacaaagataattttatctgtt

SEQ ID NO: 755344 - DNA, 22 bp, Artificial Sequence
  chemically synthesized
taacaaagataattttatctgt

SEQ ID NO: 755345 - DNA, 22 bp, Artificial Sequence
  chemically synthesized
aatcccttgaacagataaaatt

SEQ ID NO: 755346 - DNA, 22 bp, Artificial Sequence
  chemically synthesized
gaacagataaaattatctttgt

SEQ ID NO: 755347 - DNA, 22 bp, Artificial Sequence
  chemically synthesized
aacagataaaattatctttgtt

SEQ ID NO: 755348 - DNA, 22 bp, Artificial Sequence
  chemically synthesized
tctttgttaaaacacatcctct

SEQ ID NO: 755349 - DNA, 22 bp, Artificial Sequence
  chemically synthesized
tgttaaaacacatcctcttccc

SEQ ID NO: 755350 - DNA, 22 bp, Artificial Sequence
  chemically synthesized
gttaaaacacatcctcttcccc

SEQ ID NO: 755351 - DNA, 22 bp, Artificial Sequence
  chemically synthesized
ttaaaacacatcctcttcccca

SEQ ID NO: 755352 - DNA, 22 bp, Artificial Sequence
  chemically synthesized
aaacacatcctcttccccatac

SEQ ID NO: 755353 - DNA, 22 bp, Artificial Sequence
  chemically synthesized
gaaaggtgaaaagaaaggtatg

SEQ ID NO: 755354 - DNA, 22 bp, Artificial Sequence
  chemically synthesized
ggaaaggtgaaaagaaaggtat

SEQ ID NO: 755355 - DNA, 22 bp, Artificial Sequence
  chemically synthesized
tcttggaaaggtgaaaagaaag

SEQ ID NO: 755356 - DNA, 22 bp, Artificial Sequence
  chemically synthesized
ttccccatacctttcttttcac

SEQ ID NO: 755357 - DNA, 22 bp, Artificial Sequence
  chemically synthesized
ccccatacctttcttttcacct

SEQ ID NO: 755358 - DNA, 22 bp, Artificial Sequence
  chemically synthesized
gctgtcttggaaaggtgaaaag

SEQ ID NO: 755359 - DNA, 22 bp, Artificial Sequence
  chemically synthesized
cccatacctttcttttcacctt

SEQ ID NO: 755360 - DNA, 22 bp, Artificial Sequence
  chemically synthesized
ggtctggctgtcttggaaaggt

SEQ ID NO: 755361 - DNA, 22 bp, Artificial Sequence
  chemically synthesized
gggtctggctgtcttggaaagg

SEQ ID NO: 755362 - DNA, 22 bp, Artificial Sequence
  chemically synthesized
tcttttcacctttccaagacag

SEQ ID NO: 755363 - DNA, 22 bp, Artificial Sequence
  chemically synthesized
cttttcacctttccaagacagc

SEQ ID NO: 755364 - DNA, 22 bp, Artificial Sequence
  chemically synthesized
ttttcacctttccaagacagcc

SEQ ID NO: 755365 - DNA, 22 bp, Artificial Sequence
  chemically synthesized
gacccttgggtctggctgtctt

SEQ ID NO: 755366 - DNA, 22 bp, Artificial Sequence
  chemically synthesized
ttcacctttccaagacagccag

SEQ ID NO: 755367 - DNA, 22 bp, Artificial Sequence
  chemically synthesized
ggacccttgggtctggctgtct

SEQ ID NO: 755368 - DNA, 22 bp, Artificial Sequence
  chemically synthesized
tcacctttccaagacagccaga

SEQ ID NO: 755369 - DNA, 22 bp, Artificial Sequence
  chemically synthesized
tggacccttgggtctggctgtc

SEQ ID NO: 755370 - DNA, 22 bp, Artificial Sequence
  chemically synthesized
cacctttccaagacagccagac

SEQ ID NO: 755371 - DNA, 22 bp, Artificial Sequence
  chemically synthesized
acctttccaagacagccagacc

SEQ ID NO: 755372 - DNA, 22 bp, Artificial Sequence
  chemically synthesized
ttttggacccttgggtctggct

SEQ ID NO: 755373 - DNA, 22 bp, Artificial Sequence
  chemically synthesized
tccaagacagccagacccaagg

SEQ ID NO: 755374 - DNA, 22 bp, Artificial Sequence
  chemically synthesized
ccaagacagccagacccaaggg

SEQ ID NO: 755375 - DNA, 22 bp, Artificial Sequence
  chemically synthesized
caagacagccagacccaagggt

SEQ ID NO: 755376 - DNA, 22 bp, Artificial Sequence
  chemically synthesized
atatcactattttggacccttg

SEQ ID NO: 755377 - DNA, 22 bp, Artificial Sequence
  chemically synthesized
tcatatcactattttggaccct

SEQ ID NO: 755378 - DNA, 22 bp, Artificial Sequence
  chemically synthesized
tctcatatcactattttggacc

SEQ ID NO: 755379 - DNA, 22 bp, Artificial Sequence
  chemically synthesized
attctctcatatcactattttg

SEQ ID NO: 755380 - DNA, 22 bp, Artificial Sequence
  chemically synthesized
taattctctcatatcactattt

SEQ ID NO: 755381 - DNA, 22 bp, Artificial Sequence
  chemically synthesized
ctaattctctcatatcactatt

SEQ ID NO: 755382 - DNA, 22 bp, Artificial Sequence
  chemically synthesized
cttctaattctctcatatcact

SEQ ID NO: 755383 - DNA, 22 bp, Artificial Sequence
  chemically synthesized
gtattgcttctaattctctcat

SEQ ID NO: 755384 - DNA, 22 bp, Artificial Sequence
  chemically synthesized
agtattgcttctaattctctca

SEQ ID NO: 755385 - DNA, 22 bp, Artificial Sequence
  chemically synthesized
tagtattgcttctaattctctc

SEQ ID NO: 755386 - DNA, 22 bp, Artificial Sequence
  chemically synthesized
cgtctttagtattgcttctaat

SEQ ID NO: 755387 - DNA, 22 bp, Artificial Sequence
  chemically synthesized
tacgtctttagtattgcttcta

SEQ ID NO: 755388 - DNA, 22 bp, Artificial Sequence
  chemically synthesized
atagaggtgctctacgtcttta

SEQ ID NO: 755389 - DNA, 22 bp, Artificial Sequence
  chemically synthesized
catagaggtgctctacgtcttt

SEQ ID NO: 755390 - DNA, 22 bp, Artificial Sequence
  chemically synthesized
gaagcaatactaaagacgtaga

SEQ ID NO: 755391 - DNA, 22 bp, Artificial Sequence
  chemically synthesized
tcatagaggtgctctacgtctt

SEQ ID NO: 755392 - DNA, 22 bp, Artificial Sequence
  chemically synthesized
ttttcatagaggtgctctacgt

SEQ ID NO: 755393 - DNA, 22 bp, Artificial Sequence
  chemically synthesized
attttcatagaggtgctctacg

SEQ ID NO: 755394 - DNA, 22 bp, Artificial Sequence
  chemically synthesized
tattttcatagaggtgctctac

SEQ ID NO: 755395 - DNA, 22 bp, Artificial Sequence
  chemically synthesized
aagacgtagagcacctctatga

SEQ ID NO: 755396 - DNA, 22 bp, Artificial Sequence
  chemically synthesized
catattttattttcatagaggt

SEQ ID NO: 755397 - DNA, 22 bp, Artificial Sequence
  chemically synthesized
aattgcatattttattttcata

SEQ ID NO: 755398 - DNA, 22 bp, Artificial Sequence
  chemically synthesized
taaattgcatattttattttca

SEQ ID NO: 755399 - DNA, 22 bp, Artificial Sequence
  chemically synthesized
ctaaattgcatattttattttc

SEQ ID NO: 755400 - DNA, 22 bp, Artificial Sequence
  chemically synthesized
tctaaattgcatattttatttt

SEQ ID NO: 755401 - DNA, 22 bp, Artificial Sequence
  chemically synthesized
acattttctaaattgcatattt

SEQ ID NO: 755402 - DNA, 22 bp, Artificial Sequence
  chemically synthesized
tatgaaaataaaatatgcaatt

SEQ ID NO: 755403 - DNA, 22 bp, Artificial Sequence
  chemically synthesized
ctaacattttctaaattgcata

SEQ ID NO: 755404 - DNA, 22 bp, Artificial Sequence
  chemically synthesized
tgaaaataaaatatgcaattta

SEQ ID NO: 755405 - DNA, 22 bp, Artificial Sequence
  chemically synthesized
tgtagtattcctaacattttct

SEQ ID NO: 755406 - DNA, 22 bp, Artificial Sequence
  chemically synthesized
agaaaatgttaggaatactaca

SEQ ID NO: 755407 - DNA, 22 bp, Artificial Sequence
  chemically synthesized
gaaaatgttaggaatactacac

SEQ ID NO: 755408 - DNA, 22 bp, Artificial Sequence
  chemically synthesized
aaggacaaacatctgtgtagta

SEQ ID NO: 755409 - DNA, 22 bp, Artificial Sequence
  chemically synthesized
ggaatactacacagatgtttgt

SEQ ID NO: 755410 - DNA, 22 bp, Artificial Sequence
  chemically synthesized
agaagctcaaggacaaacatct

SEQ ID NO: 755411 - DNA, 22 bp, Artificial Sequence
  chemically synthesized
aagaagctcaaggacaaacatc

SEQ ID NO: 755412 - DNA, 22 bp, Artificial Sequence
  chemically synthesized
cacagatgtttgtccttgagct

SEQ ID NO: 755413 - DNA, 22 bp, Artificial Sequence
  chemically synthesized
tgaaccttaagaagctcaagga

SEQ ID NO: 755414 - DNA, 22 bp, Artificial Sequence
  chemically synthesized
gtgaaccttaagaagctcaagg

SEQ ID NO: 755415 - DNA, 22 bp, Artificial Sequence
  chemically synthesized
tgtgaaccttaagaagctcaag

SEQ ID NO: 755416 - DNA, 22 bp, Artificial Sequence
  chemically synthesized
ttttgtgaaccttaagaagctc

SEQ ID NO: 755417 - DNA, 22 bp, Artificial Sequence
  chemically synthesized
attttgtgaaccttaagaagct

SEQ ID NO: 755418 - DNA, 22 bp, Artificial Sequence
  chemically synthesized
gtccttgagcttcttaaggttc

SEQ ID NO: 755419 - DNA, 22 bp, Artificial Sequence
  chemically synthesized
tccttgagcttcttaaggttca

SEQ ID NO: 755420 - DNA, 22 bp, Artificial Sequence
  chemically synthesized
atataagtttattttgtgaacc

SEQ ID NO: 755421 - DNA, 22 bp, Artificial Sequence
  chemically synthesized
gagcttcttaaggttcacaaaa

SEQ ID NO: 755422 - DNA, 22 bp, Artificial Sequence
  chemically synthesized
catataagtttattttgtgaac

SEQ ID NO: 755423 - DNA, 22 bp, Artificial Sequence
  chemically synthesized
agcttcttaaggttcacaaaat

SEQ ID NO: 755424 - DNA, 22 bp, Artificial Sequence
  chemically synthesized
cttaaggttcacaaaataaact

SEQ ID NO: 755425 - DNA, 22 bp, Artificial Sequence
  chemically synthesized
ttaaggttcacaaaataaactt

SEQ ID NO: 755426 - DNA, 22 bp, Artificial Sequence
  chemically synthesized
aaggttcacaaaataaacttat

SEQ ID NO: 755427 - DNA, 22 bp, Artificial Sequence
  chemically synthesized
aggttcacaaaataaacttata

SEQ ID NO: 755428 - DNA, 22 bp, Artificial Sequence
  chemically synthesized
acaaaataaacttatatgaagt

SEQ ID NO: 755429 - DNA, 22 bp, Artificial Sequence
  chemically synthesized
taatagtgtagtagcatacttc

SEQ ID NO: 755430 - DNA, 22 bp, Artificial Sequence
  chemically synthesized
ctataatagtgtagtagcatac

SEQ ID NO: 755431 - DNA, 22 bp, Artificial Sequence
  chemically synthesized
atatgaagtatgctactacact

SEQ ID NO: 755432 - DNA, 22 bp, Artificial Sequence
  chemically synthesized
tatgaagtatgctactacacta

SEQ ID NO: 755433 - DNA, 22 bp, Artificial Sequence
  chemically synthesized
tcattgctataatagtgtagta

SEQ ID NO: 755434 - DNA, 22 bp, Artificial Sequence
  chemically synthesized
agattatcattgctataatagt

SEQ ID NO: 755435 - DNA, 22 bp, Artificial Sequence
  chemically synthesized
gagattatcattgctataatag

SEQ ID NO: 755436 - DNA, 22 bp, Artificial Sequence
  chemically synthesized
tcttgagattatcattgctata

SEQ ID NO: 755437 - DNA, 22 bp, Artificial Sequence
  chemically synthesized
atcttgagattatcattgctat

SEQ ID NO: 755438 - DNA, 22 bp, Artificial Sequence
  chemically synthesized
ctacactattatagcaatgata

SEQ ID NO: 755439 - DNA, 22 bp, Artificial Sequence
  chemically synthesized
cactattatagcaatgataatc

SEQ ID NO: 755440 - DNA, 22 bp, Artificial Sequence
  chemically synthesized
ttatagcaatgataatctcaag

SEQ ID NO: 755441 - DNA, 22 bp, Artificial Sequence
  chemically synthesized
tagcaatgataatctcaagata

SEQ ID NO: 755442 - DNA, 22 bp, Artificial Sequence
  chemically synthesized
ataataaatagatttatcttga

SEQ ID NO: 755443 - DNA, 22 bp, Artificial Sequence
  chemically synthesized
cataataaatagatttatcttg

SEQ ID NO: 755444 - DNA, 22 bp, Artificial Sequence
  chemically synthesized
aaccttcataataaatagattt

SEQ ID NO: 755445 - DNA, 22 bp, Artificial Sequence
  chemically synthesized
aagataaatctatttattatga

SEQ ID NO: 755446 - DNA, 22 bp, Artificial Sequence
  chemically synthesized
ccagataattcaaccttcataa

SEQ ID NO: 755447 - DNA, 22 bp, Artificial Sequence
  chemically synthesized
tttattatgaaggttgaattat

SEQ ID NO: 755448 - DNA, 22 bp, Artificial Sequence
  chemically synthesized
attatgaaggttgaattatctg

SEQ ID NO: 755449 - DNA, 22 bp, Artificial Sequence
  chemically synthesized
agtgcaatctaccagataattc

SEQ ID NO: 755450 - DNA, 22 bp, Artificial Sequence
  chemically synthesized
ttatgaaggttgaattatctgg

SEQ ID NO: 755451 - DNA, 22 bp, Artificial Sequence
  chemically synthesized
aagtgcaatctaccagataatt

SEQ ID NO: 755452 - DNA, 22 bp, Artificial Sequence
  chemically synthesized
taagtgcaatctaccagataat

SEQ ID NO: 755453 - DNA, 22 bp, Artificial Sequence
  chemically synthesized
tgaaggttgaattatctggtag

SEQ ID NO: 755454 - DNA, 22 bp, Artificial Sequence
  chemically synthesized
tggtgttttaagtgcaatctac

SEQ ID NO: 755455 - DNA, 22 bp, Artificial Sequence
  chemically synthesized
aattatctggtagattgcactt

SEQ ID NO: 755456 - DNA, 22 bp, Artificial Sequence
  chemically synthesized
tctggtagattgcacttaaaac

SEQ ID NO: 755457 - DNA, 22 bp, Artificial Sequence
  chemically synthesized
gccagtacctatggtgttttaa

SEQ ID NO: 755458 - DNA, 22 bp, Artificial Sequence
  chemically synthesized
gtagattgcacttaaaacacca

SEQ ID NO: 755459 - DNA, 22 bp, Artificial Sequence
  chemically synthesized
cacttaaaacaccataggtact

SEQ ID NO: 755460 - DNA, 22 bp, Artificial Sequence
  chemically synthesized
aaaacaccataggtactggcca

SEQ ID NO: 755461 - DNA, 22 bp, Artificial Sequence
  chemically synthesized
aaacaccataggtactggccaa

SEQ ID NO: 755462 - DNA, 22 bp, Artificial Sequence
  chemically synthesized
gtgagtcaacaatcagtcaccc

SEQ ID NO: 755463 - DNA, 22 bp, Artificial Sequence
  chemically synthesized
gccaaccgggtgactgattgtt

SEQ ID NO: 755464 - DNA, 22 bp, Artificial Sequence
  chemically synthesized
aatgaacaaattagtgagtcaa

SEQ ID NO: 755465 - DNA, 22 bp, Artificial Sequence
  chemically synthesized
gaatgaacaaattagtgagtca

SEQ ID NO: 755466 - DNA, 22 bp, Artificial Sequence
  chemically synthesized
tgaatgaacaaattagtgagtc

SEQ ID NO: 755467 - DNA, 22 bp, Artificial Sequence
  chemically synthesized
ttgaatgaacaaattagtgagt

SEQ ID NO: 755468 - DNA, 22 bp, Artificial Sequence
  chemically synthesized
tttgaatgaacaaattagtgag

SEQ ID NO: 755469 - DNA, 22 bp, Artificial Sequence
  chemically synthesized
attgttgactcactaatttgtt

SEQ ID NO: 755470 - DNA, 22 bp, Artificial Sequence
  chemically synthesized
ttgactcactaatttgttcatt

SEQ ID NO: 755471 - DNA, 22 bp, Artificial Sequence
  chemically synthesized
actcactaatttgttcattcaa

SEQ ID NO: 755472 - DNA, 22 bp, Artificial Sequence
  chemically synthesized
aaaataaatattttttgaatga

SEQ ID NO: 755473 - DNA, 22 bp, Artificial Sequence
  chemically synthesized
actaatttgttcattcaaaaaa

SEQ ID NO: 755474 - DNA, 22 bp, Artificial Sequence
  chemically synthesized
atttgttcattcaaaaaatatt

SEQ ID NO: 755475 - DNA, 22 bp, Artificial Sequence
  chemically synthesized
ataggttcaaaataaatatttt

SEQ ID NO: 755476 - DNA, 22 bp, Artificial Sequence
  chemically synthesized
gttcattcaaaaaatatttatt

SEQ ID NO: 755477 - DNA, 22 bp, Artificial Sequence
  chemically synthesized
ttcattcaaaaaatatttattt

SEQ ID NO: 755478 - DNA, 22 bp, Artificial Sequence
  chemically synthesized
attcaaaaaatatttattttga

SEQ ID NO: 755479 - DNA, 22 bp, Artificial Sequence
  chemically synthesized
tacctaataggttcaaaataaa

SEQ ID NO: 755480 - DNA, 22 bp, Artificial Sequence
  chemically synthesized
gtacctaataggttcaaaataa

SEQ ID NO: 755481 - DNA, 22 bp, Artificial Sequence
  chemically synthesized
tgtacctaataggttcaaaata

SEQ ID NO: 755482 - DNA, 22 bp, Artificial Sequence
  chemically synthesized
aaaaaatatttattttgaacct

SEQ ID NO: 755483 - DNA, 22 bp, Artificial Sequence
  chemically synthesized
actttgtacctaataggttcaa

SEQ ID NO: 755484 - DNA, 22 bp, Artificial Sequence
  chemically synthesized
ctaactttgtacctaataggtt

SEQ ID NO: 755485 - DNA, 22 bp, Artificial Sequence
  chemically synthesized
cctaactttgtacctaataggt

SEQ ID NO: 755486 - DNA, 22 bp, Artificial Sequence
  chemically synthesized
tcctaactttgtacctaatagg

SEQ ID NO: 755487 - DNA, 22 bp, Artificial Sequence
  chemically synthesized
attttgaacctattaggtacaa

SEQ ID NO: 755488 - DNA, 22 bp, Artificial Sequence
  chemically synthesized
ttttgaacctattaggtacaaa

SEQ ID NO: 755489 - DNA, 22 bp, Artificial Sequence
  chemically synthesized
tatctttcctaactttgtacct

SEQ ID NO: 755490 - DNA, 22 bp, Artificial Sequence
  chemically synthesized
tgaacctattaggtacaaagtt

SEQ ID NO: 755491 - DNA, 22 bp, Artificial Sequence
  chemically synthesized
tatatctttcctaactttgtac

SEQ ID NO: 755492 - DNA, 22 bp, Artificial Sequence
  chemically synthesized
gaacctattaggtacaaagtta

SEQ ID NO: 755493 - DNA, 22 bp, Artificial Sequence
  chemically synthesized
aacctattaggtacaaagttag

SEQ ID NO: 755494 - DNA, 22 bp, Artificial Sequence
  chemically synthesized
agtctctatatctttcctaact

SEQ ID NO: 755495 - DNA, 22 bp, Artificial Sequence
  chemically synthesized
ttaggtacaaagttaggaaaga

SEQ ID NO: 755496 - DNA, 22 bp, Artificial Sequence
  chemically synthesized
ggtacaaagttaggaaagatat

SEQ ID NO: 755497 - DNA, 22 bp, Artificial Sequence
  chemically synthesized
atgacaaagattaagtctctat

SEQ ID NO: 755498 - DNA, 22 bp, Artificial Sequence
  chemically synthesized
aatgacaaagattaagtctcta

SEQ ID NO: 755499 - DNA, 22 bp, Artificial Sequence
  chemically synthesized
ggaaagatatagagacttaatc

SEQ ID NO: 755500 - DNA, 22 bp, Artificial Sequence
  chemically synthesized
cttaatgacaaagattaagtct

SEQ ID NO: 755501 - DNA, 22 bp, Artificial Sequence
  chemically synthesized
gctccttaatgacaaagattaa

SEQ ID NO: 755502 - DNA, 22 bp, Artificial Sequence
  chemically synthesized
ttggctccttaatgacaaagat

SEQ ID NO: 755503 - DNA, 22 bp, Artificial Sequence
  chemically synthesized
aaccaaactattggctccttaa

SEQ ID NO: 755504 - DNA, 22 bp, Artificial Sequence
  chemically synthesized
aatctttgtcattaaggagcca

SEQ ID NO: 755505 - DNA, 22 bp, Artificial Sequence
  chemically synthesized
atctttgtcattaaggagccaa

SEQ ID NO: 755506 - DNA, 22 bp, Artificial Sequence
  chemically synthesized
ctcaaccaaactattggctcct

SEQ ID NO: 755507 - DNA, 22 bp, Artificial Sequence
  chemically synthesized
tgtcattaaggagccaatagtt

SEQ ID NO: 755508 - DNA, 22 bp, Artificial Sequence
  chemically synthesized
gtcattaaggagccaatagttt

SEQ ID NO: 755509 - DNA, 22 bp, Artificial Sequence
  chemically synthesized
tcattaaggagccaatagtttg

SEQ ID NO: 755510 - DNA, 22 bp, Artificial Sequence
  chemically synthesized
aggagccaatagtttggttgag

SEQ ID NO: 755511 - DNA, 22 bp, Artificial Sequence
  chemically synthesized
ggttgagtaggtatatttgtgg

SEQ ID NO: 755512 - DNA, 22 bp, Artificial Sequence
  chemically synthesized
gttgagtaggtatatttgtggt

SEQ ID NO: 755513 - DNA, 22 bp, Artificial Sequence
  chemically synthesized
agtaggtatatttgtggtgtat

SEQ ID NO: 755514 - DNA, 22 bp, Artificial Sequence
  chemically synthesized
ataatataaaagtatacaccac

SEQ ID NO: 755515 - DNA, 22 bp, Artificial Sequence
  chemically synthesized
gtggtgtatacttttatattat

SEQ ID NO: 755516 - DNA, 22 bp, Artificial Sequence
  chemically synthesized
tggtgtatacttttatattatg

SEQ ID NO: 755517 - DNA, 22 bp, Artificial Sequence
  chemically synthesized
catggatgaaacattcataata

SEQ ID NO: 755518 - DNA, 22 bp, Artificial Sequence
  chemically synthesized
gcatggatgaaacattcataat

SEQ ID NO: 755519 - DNA, 22 bp, Artificial Sequence
  chemically synthesized
aatttgcatggatgaaacattc

SEQ ID NO: 755520 - DNA, 22 bp, Artificial Sequence
  chemically synthesized
ttatattatgaatgtttcatcc

SEQ ID NO: 755521 - DNA, 22 bp, Artificial Sequence
  chemically synthesized
tatattatgaatgtttcatcca

SEQ ID NO: 755522 - DNA, 22 bp, Artificial Sequence
  chemically synthesized
atattatgaatgtttcatccat

SEQ ID NO: 755523 - DNA, 22 bp, Artificial Sequence
  chemically synthesized
tattatgaatgtttcatccatg

SEQ ID NO: 755524 - DNA, 22 bp, Artificial Sequence
  chemically synthesized
tatctcaatttgcatggatgaa

SEQ ID NO: 755525 - DNA, 22 bp, Artificial Sequence
  chemically synthesized
tctgtatctcaatttgcatgga

SEQ ID NO: 755526 - DNA, 22 bp, Artificial Sequence
  chemically synthesized
tgaatgtttcatccatgcaaat

SEQ ID NO: 755527 - DNA, 22 bp, Artificial Sequence
  chemically synthesized
atctgtatctcaatttgcatgg

SEQ ID NO: 755528 - DNA, 22 bp, Artificial Sequence
  chemically synthesized
acttatctgtatctcaatttgc

SEQ ID NO: 755529 - DNA, 22 bp, Artificial Sequence
  chemically synthesized
catccatgcaaattgagataca

SEQ ID NO: 755530 - DNA, 22 bp, Artificial Sequence
  chemically synthesized
atccatgcaaattgagatacag

SEQ ID NO: 755531 - DNA, 22 bp, Artificial Sequence
  chemically synthesized
ggtaaaccctaacttatctgta

SEQ ID NO: 755532 - DNA, 22 bp, Artificial Sequence
  chemically synthesized
aggtaaaccctaacttatctgt

SEQ ID NO: 755533 - DNA, 22 bp, Artificial Sequence
  chemically synthesized
agatacagataagttagggttt

SEQ ID NO: 755534 - DNA, 22 bp, Artificial Sequence
  chemically synthesized
atggccttaggtaaaccctaac

SEQ ID NO: 755535 - DNA, 22 bp, Artificial Sequence
  chemically synthesized
actgatggccttaggtaaaccc

SEQ ID NO: 755536 - DNA, 22 bp, Artificial Sequence
  chemically synthesized
gggtttacctaaggccatcagt

SEQ ID NO: 755537 - DNA, 22 bp, Artificial Sequence
  chemically synthesized
aaagtgtgtaattaactgatgg

SEQ ID NO: 755538 - DNA, 22 bp, Artificial Sequence
  chemically synthesized
acctaaggccatcagttaatta

SEQ ID NO: 755539 - DNA, 22 bp, Artificial Sequence
  chemically synthesized
cctaaggccatcagttaattac

SEQ ID NO: 755540 - DNA, 22 bp, Artificial Sequence
  chemically synthesized
gattcaaagtgtgtaattaact

SEQ ID NO: 755541 - DNA, 22 bp, Artificial Sequence
  chemically synthesized
agattcaaagtgtgtaattaac

SEQ ID NO: 755542 - DNA, 22 bp, Artificial Sequence
  chemically synthesized
aggccatcagttaattacacac

SEQ ID NO: 755543 - DNA, 22 bp, Artificial Sequence
  chemically synthesized
caagatttagattcaaagtgtg

SEQ ID NO: 755544 - DNA, 22 bp, Artificial Sequence
  chemically synthesized
gaattgcaagatttagattcaa

SEQ ID NO: 755545 - DNA, 22 bp, Artificial Sequence
  chemically synthesized
agaattgcaagatttagattca

SEQ ID NO: 755546 - DNA, 22 bp, Artificial Sequence
  chemically synthesized
attacacactttgaatctaaat

SEQ ID NO: 755547 - DNA, 22 bp, Artificial Sequence
  chemically synthesized
tagaattgcaagatttagattc

SEQ ID NO: 755548 - DNA, 22 bp, Artificial Sequence
  chemically synthesized
cacactttgaatctaaatcttg

SEQ ID NO: 755549 - DNA, 22 bp, Artificial Sequence
  chemically synthesized
actttagaattgcaagatttag

SEQ ID NO: 755550 - DNA, 22 bp, Artificial Sequence
  chemically synthesized
cactttagaattgcaagattta

SEQ ID NO: 755551 - DNA, 22 bp, Artificial Sequence
  chemically synthesized
agcttcactttagaattgcaag

SEQ ID NO: 755552 - DNA, 22 bp, Artificial Sequence
  chemically synthesized
tgaatctaaatcttgcaattct

SEQ ID NO: 755553 - DNA, 22 bp, Artificial Sequence
  chemically synthesized
cagcttcactttagaattgcaa

SEQ ID NO: 755554 - DNA, 22 bp, Artificial Sequence
  chemically synthesized
gaatctaaatcttgcaattcta

SEQ ID NO: 755555 - DNA, 22 bp, Artificial Sequence
  chemically synthesized
tcagcttcactttagaattgca

SEQ ID NO: 755556 - DNA, 22 bp, Artificial Sequence
  chemically synthesized
aatctaaatcttgcaattctaa

SEQ ID NO: 755557 - DNA, 22 bp, Artificial Sequence
  chemically synthesized
actttcagcttcactttagaat

SEQ ID NO: 755558 - DNA, 22 bp, Artificial Sequence
  chemically synthesized
aatcttgcaattctaaagtgaa

SEQ ID NO: 755559 - DNA, 22 bp, Artificial Sequence
  chemically synthesized
tcactcactttcagcttcactt

SEQ ID NO: 755560 - DNA, 22 bp, Artificial Sequence
  chemically synthesized
gcaattctaaagtgaagctgaa

SEQ ID NO: 755561 - DNA, 22 bp, Artificial Sequence
  chemically synthesized
ttatcactcactttcagcttca

SEQ ID NO: 755562 - DNA, 22 bp, Artificial Sequence
  chemically synthesized
caattctaaagtgaagctgaaa

SEQ ID NO: 755563 - DNA, 22 bp, Artificial Sequence
  chemically synthesized
gttatcactcactttcagcttc

SEQ ID NO: 755564 - DNA, 22 bp, Artificial Sequence
  chemically synthesized
tgttatcactcactttcagctt

SEQ ID NO: 755565 - DNA, 22 bp, Artificial Sequence
  chemically synthesized
taaagtgaagctgaaagtgagt

SEQ ID NO: 755566 - DNA, 22 bp, Artificial Sequence
  chemically synthesized
tgttttgttatcactcactttc

SEQ ID NO: 755567 - DNA, 22 bp, Artificial Sequence
  chemically synthesized
atgttttgttatcactcacttt

SEQ ID NO: 755568 - DNA, 22 bp, Artificial Sequence
  chemically synthesized
aagtgaagctgaaagtgagtga

SEQ ID NO: 755569 - DNA, 22 bp, Artificial Sequence
  chemically synthesized
tatgttttgttatcactcactt

SEQ ID NO: 755570 - DNA, 22 bp, Artificial Sequence
  chemically synthesized
aaagtgagtgataacaaaacat

SEQ ID NO: 755571 - DNA, 22 bp, Artificial Sequence
  chemically synthesized
agtcagggagattttatgtttt

SEQ ID NO: 755572 - DNA, 22 bp, Artificial Sequence
  chemically synthesized
taagtcagggagattttatgtt

SEQ ID NO: 755573 - DNA, 22 bp, Artificial Sequence
  chemically synthesized
ttctaagtcagggagattttat

SEQ ID NO: 755574 - DNA, 22 bp, Artificial Sequence
  chemically synthesized
caaattattctaagtcagggag

SEQ ID NO: 755575 - DNA, 22 bp, Artificial Sequence
  chemically synthesized
ccaaattattctaagtcaggga

SEQ ID NO: 755576 - DNA, 22 bp, Artificial Sequence
  chemically synthesized
tgtggcttccaaattattctaa

SEQ ID NO: 755577 - DNA, 22 bp, Artificial Sequence
  chemically synthesized
atgtggcttccaaattattcta

SEQ ID NO: 755578 - DNA, 22 bp, Artificial Sequence
  chemically synthesized
cctgacttagaataatttggaa

SEQ ID NO: 755579 - DNA, 22 bp, Artificial Sequence
  chemically synthesized
cacttatgtggcttccaaatta

SEQ ID NO: 755580 - DNA, 22 bp, Artificial Sequence
  chemically synthesized
ccacttatgtggcttccaaatt

SEQ ID NO: 755581 - DNA, 22 bp, Artificial Sequence
  chemically synthesized
tccacttatgtggcttccaaat

SEQ ID NO: 755582 - DNA, 22 bp, Artificial Sequence
  chemically synthesized
acttagaataatttggaagcca

SEQ ID NO: 755583 - DNA, 22 bp, Artificial Sequence
  chemically synthesized
agaataatttggaagccacata

SEQ ID NO: 755584 - DNA, 22 bp, Artificial Sequence
  chemically synthesized
ggattttccacttatgtggctt

SEQ ID NO: 755585 - DNA, 22 bp, Artificial Sequence
  chemically synthesized
gaataatttggaagccacataa

SEQ ID NO: 755586 - DNA, 22 bp, Artificial Sequence
  chemically synthesized
ggaagccacataagtggaaaat

SEQ ID NO: 755587 - DNA, 22 bp, Artificial Sequence
  chemically synthesized
gaagccacataagtggaaaatc

SEQ ID NO: 755588 - DNA, 22 bp, Artificial Sequence
  chemically synthesized
catggccattaggattttccac

SEQ ID NO: 755589 - DNA, 22 bp, Artificial Sequence
  chemically synthesized
ccatggccattaggattttcca

SEQ ID NO: 755590 - DNA, 22 bp, Artificial Sequence
  chemically synthesized
ttccatggccattaggattttc

SEQ ID NO: 755591 - DNA, 22 bp, Artificial Sequence
  chemically synthesized
cttccatggccattaggatttt

SEQ ID NO: 755592 - DNA, 22 bp, Artificial Sequence
  chemically synthesized
atttcttccatggccattagga

SEQ ID NO: 755593 - DNA, 22 bp, Artificial Sequence
  chemically synthesized
tgatttcttccatggccattag

SEQ ID NO: 755594 - DNA, 22 bp, Artificial Sequence
  chemically synthesized
ctgatttcttccatggccatta

SEQ ID NO: 755595 - DNA, 22 bp, Artificial Sequence
  chemically synthesized
agtttctgatttcttccatggc

SEQ ID NO: 755596 - DNA, 22 bp, Artificial Sequence
  chemically synthesized
aagtttctgatttcttccatgg

SEQ ID NO: 755597 - DNA, 22 bp, Artificial Sequence
  chemically synthesized
taagtttctgatttcttccatg

SEQ ID NO: 755598 - DNA, 22 bp, Artificial Sequence
  chemically synthesized
ttaagtttctgatttcttccat

SEQ ID NO: 755599 - DNA, 22 bp, Artificial Sequence
  chemically synthesized
tttaagtttctgatttcttcca

SEQ ID NO: 755600 - DNA, 22 bp, Artificial Sequence
  chemically synthesized
atggccatggaagaaatcagaa

SEQ ID NO: 755601 - DNA, 22 bp, Artificial Sequence
  chemically synthesized
aggaattttttaagtttctgat

SEQ ID NO: 755602 - DNA, 22 bp, Artificial Sequence
  chemically synthesized
caggaattttttaagtttctga

SEQ ID NO: 755603 - DNA, 22 bp, Artificial Sequence
  chemically synthesized
tcaggaattttttaagtttctg

SEQ ID NO: 755604 - DNA, 22 bp, Artificial Sequence
  chemically synthesized
ctttcaggaattttttaagttt

SEQ ID NO: 755605 - DNA, 22 bp, Artificial Sequence
  chemically synthesized
ttactttcaggaattttttaag

SEQ ID NO: 755606 - DNA, 22 bp, Artificial Sequence
  chemically synthesized
tattactttcaggaatttttta

SEQ ID NO: 755607 - DNA, 22 bp, Artificial Sequence
  chemically synthesized
tctattactttcaggaattttt

SEQ ID NO: 755608 - DNA, 22 bp, Artificial Sequence
  chemically synthesized
ctctattactttcaggaatttt

SEQ ID NO: 755609 - DNA, 22 bp, Artificial Sequence
  chemically synthesized
ttctctattactttcaggaatt

SEQ ID NO: 755610 - DNA, 22 bp, Artificial Sequence
  chemically synthesized
gttcttctctattactttcagg

SEQ ID NO: 755611 - DNA, 22 bp, Artificial Sequence
  chemically synthesized
ggttcttctctattactttcag

SEQ ID NO: 755612 - DNA, 22 bp, Artificial Sequence
  chemically synthesized
aaaaaattcctgaaagtaatag

SEQ ID NO: 755613 - DNA, 22 bp, Artificial Sequence
  chemically synthesized
aaaaattcctgaaagtaataga

SEQ ID NO: 755614 - DNA, 22 bp, Artificial Sequence
  chemically synthesized
ctgaaagtaatagagaagaacc

SEQ ID NO: 755615 - DNA, 22 bp, Artificial Sequence
  chemically synthesized
aaagtaatagagaagaaccaag

SEQ ID NO: 755616 - DNA, 22 bp, Artificial Sequence
  chemically synthesized
ttgattattattatttttattt

SEQ ID NO: 755617 - DNA, 22 bp, Artificial Sequence
  chemically synthesized
attattattatttttatttatt

SEQ ID NO: 755618 - DNA, 22 bp, Artificial Sequence
  chemically synthesized
aaaaataaataaataaataaat

SEQ ID NO: 755619 - DNA, 22 bp, Artificial Sequence
  chemically synthesized
ttattatttttatttatttatt

SEQ ID NO: 755620 - DNA, 22 bp, Artificial Sequence
  chemically synthesized
ttatttttatttatttatttat

SEQ ID NO: 755621 - DNA, 22 bp, Artificial Sequence
  chemically synthesized
cgtctcaaaaataaataaataa

SEQ ID NO: 755622 - DNA, 22 bp, Artificial Sequence
  chemically synthesized
tttttatttatttatttattta

SEQ ID NO: 755623 - DNA, 22 bp, Artificial Sequence
  chemically synthesized
ttatttatttatttatttattt

SEQ ID NO: 755624 - DNA, 22 bp, Artificial Sequence
  chemically synthesized
tatttatttatttatttatttt

SEQ ID NO: 755625 - DNA, 22 bp, Artificial Sequence
  chemically synthesized
atttatttatttatttattttt

SEQ ID NO: 755626 - DNA, 22 bp, Artificial Sequence
  chemically synthesized
tttatttatttatttatttttg

SEQ ID NO: 755627 - DNA, 22 bp, Artificial Sequence
  chemically synthesized
atttatttatttatttttgaga

SEQ ID NO: 755628 - DNA, 22 bp, Artificial Sequence
  chemically synthesized
tttatttatttatttttgagac

SEQ ID NO: 755629 - DNA, 22 bp, Artificial Sequence
  chemically synthesized
atttatttatttttgagacgga

SEQ ID NO: 755630 - DNA, 22 bp, Artificial Sequence
  chemically synthesized
tttatttatttttgagacggag

SEQ ID NO: 755631 - DNA, 22 bp, Artificial Sequence
  chemically synthesized
atttatttttgagacggagtct

SEQ ID NO: 755632 - DNA, 22 bp, Artificial Sequence
  chemically synthesized
ggtgacagagcgagactccgtc

SEQ ID NO: 755633 - DNA, 22 bp, Artificial Sequence
  chemically synthesized
tttatttttgagacggagtctc

SEQ ID NO: 755634 - DNA, 22 bp, Artificial Sequence
  chemically synthesized
atttttgagacggagtctcgct

SEQ ID NO: 755635 - DNA, 22 bp, Artificial Sequence
  chemically synthesized
tttttgagacggagtctcgctc

SEQ ID NO: 755636 - DNA, 22 bp, Artificial Sequence
  chemically synthesized
cagactgggtgacagagcgaga

SEQ ID NO: 755637 - DNA, 22 bp, Artificial Sequence
  chemically synthesized
ttgagacggagtctcgctctgt

SEQ ID NO: 755638 - DNA, 22 bp, Artificial Sequence
  chemically synthesized
tgagacggagtctcgctctgtc

SEQ ID NO: 755639 - DNA, 22 bp, Artificial Sequence
  chemically synthesized
gagacggagtctcgctctgtca

SEQ ID NO: 755640 - DNA, 22 bp, Artificial Sequence
  chemically synthesized
agacggagtctcgctctgtcac

SEQ ID NO: 755641 - DNA, 22 bp, Artificial Sequence
  chemically synthesized
cactccagactgggtgacagag

SEQ ID NO: 755642 - DNA, 22 bp, Artificial Sequence
  chemically synthesized
gctctgtcacccagtctggagt

SEQ ID NO: 755643 - DNA, 22 bp, Artificial Sequence
  chemically synthesized
tgtcacccagtctggagtgcag

SEQ ID NO: 755644 - DNA, 22 bp, Artificial Sequence
  chemically synthesized
tcacccagtctggagtgcagtg

SEQ ID NO: 755645 - DNA, 22 bp, Artificial Sequence
  chemically synthesized
cagtaagccgagatcgtgccac

SEQ ID NO: 755646 - DNA, 22 bp, Artificial Sequence
  chemically synthesized
gagtgcagtggcacgatctcgg

SEQ ID NO: 755647 - DNA, 22 bp, Artificial Sequence
  chemically synthesized
aacccaggaggcagaggttgca

SEQ ID NO: 755648 - DNA, 22 bp, Artificial Sequence
  chemically synthesized
gaacccaggaggcagaggttgc

SEQ ID NO: 755649 - DNA, 22 bp, Artificial Sequence
  chemically synthesized
ggcttactgcaacctctgcctc

SEQ ID NO: 755650 - DNA, 22 bp, Artificial Sequence
  chemically synthesized
actgcaacctctgcctcctggg

SEQ ID NO: 755651 - DNA, 22 bp, Artificial Sequence
  chemically synthesized
ctgcaacctctgcctcctgggt

SEQ ID NO: 755652 - DNA, 22 bp, Artificial Sequence
  chemically synthesized
caacctctgcctcctgggttca

SEQ ID NO: 755653 - DNA, 22 bp, Artificial Sequence
  chemically synthesized
aggcaggagaatcacttgaacc

SEQ ID NO: 755654 - DNA, 22 bp, Artificial Sequence
  chemically synthesized
tgcctcctgggttcaagtgatt

SEQ ID NO: 755655 - DNA, 22 bp, Artificial Sequence
  chemically synthesized
cctcctgggttcaagtgattct

SEQ ID NO: 755656 - DNA, 22 bp, Artificial Sequence
  chemically synthesized
ctgggttcaagtgattctcctg

SEQ ID NO: 755657 - DNA, 22 bp, Artificial Sequence
  chemically synthesized
aggaggctgaggcaggagaatc

SEQ ID NO: 755658 - DNA, 22 bp, Artificial Sequence
  chemically synthesized
ggttcaagtgattctcctgcct

SEQ ID NO: 755659 - DNA, 22 bp, Artificial Sequence
  chemically synthesized
ctcaggaggctgaggcaggaga

SEQ ID NO: 755660 - DNA, 22 bp, Artificial Sequence
  chemically synthesized
aagtgattctcctgcctcagcc

SEQ ID NO: 755661 - DNA, 22 bp, Artificial Sequence
  chemically synthesized
tagtcccatctactcaggaggc

SEQ ID NO: 755662 - DNA, 22 bp, Artificial Sequence
  chemically synthesized
tcctgcctcagcctcctgagta

SEQ ID NO: 755663 - DNA, 22 bp, Artificial Sequence
  chemically synthesized
ctgcctcagcctcctgagtaga

SEQ ID NO: 755664 - DNA, 22 bp, Artificial Sequence
  chemically synthesized
cctcagcctcctgagtagatgg

SEQ ID NO: 755665 - DNA, 22 bp, Artificial Sequence
  chemically synthesized
agcctcctgagtagatgggact

SEQ ID NO: 755666 - DNA, 22 bp, Artificial Sequence
  chemically synthesized
ctgagtagatgggactacaggc

SEQ ID NO: 755667 - DNA, 22 bp, Artificial Sequence
  chemically synthesized
agtagatgggactacaggcacg

SEQ ID NO: 755668 - DNA, 22 bp, Artificial Sequence
  chemically synthesized
gcagggtgtggtggcgcgtgcc

SEQ ID NO: 755669 - DNA, 22 bp, Artificial Sequence
  chemically synthesized
caggcacgcgccaccacaccct

SEQ ID NO: 755670 - DNA, 22 bp, Artificial Sequence
  chemically synthesized
aaaatacaaaaaattagcaggg

SEQ ID NO: 755671 - DNA, 22 bp, Artificial Sequence
  chemically synthesized
ctaaaaatacaaaaaattagca

SEQ ID NO: 755672 - DNA, 22 bp, Artificial Sequence
  chemically synthesized
tactaaaaatacaaaaaattag

SEQ ID NO: 755673 - DNA, 22 bp, Artificial Sequence
  chemically synthesized
ctaattttttgtatttttagta

SEQ ID NO: 755674 - DNA, 22 bp, Artificial Sequence
  chemically synthesized
attttttgtatttttagtagag

SEQ ID NO: 755675 - DNA, 22 bp, Artificial Sequence
  chemically synthesized
tttgtatttttagtagagacgg

SEQ ID NO: 755676 - DNA, 22 bp, Artificial Sequence
  chemically synthesized
ttgtatttttagtagagacggg

SEQ ID NO: 755677 - DNA, 22 bp, Artificial Sequence
  chemically synthesized
tgtatttttagtagagacgggg

SEQ ID NO: 755678 - DNA, 22 bp, Artificial Sequence
  chemically synthesized
gtatttttagtagagacggggt

SEQ ID NO: 755679 - DNA, 22 bp, Artificial Sequence
  chemically synthesized
tatttttagtagagacggggtt

SEQ ID NO: 755680 - DNA, 22 bp, Artificial Sequence
  chemically synthesized
cccaacatagtgaaaccccgtc

SEQ ID NO: 755681 - DNA, 22 bp, Artificial Sequence
  chemically synthesized
gcccaacatagtgaaaccccgt

SEQ ID NO: 755682 - DNA, 22 bp, Artificial Sequence
  chemically synthesized
ttagtagagacggggtttcact

SEQ ID NO: 755683 - DNA, 22 bp, Artificial Sequence
  chemically synthesized
tagtagagacggggtttcacta

SEQ ID NO: 755684 - DNA, 22 bp, Artificial Sequence
  chemically synthesized
agtagagacggggtttcactat

SEQ ID NO: 755685 - DNA, 22 bp, Artificial Sequence
  chemically synthesized
gtagagacggggtttcactatg

SEQ ID NO: 755686 - DNA, 22 bp, Artificial Sequence
  chemically synthesized
agaccagcttgcccaacatagt

SEQ ID NO: 755687 - DNA, 22 bp, Artificial Sequence
  chemically synthesized
gagaccagcttgcccaacatag

SEQ ID NO: 755688 - DNA, 22 bp, Artificial Sequence
  chemically synthesized
cactatgttgggcaagctggtc

SEQ ID NO: 755689 - DNA, 22 bp, Artificial Sequence
  chemically synthesized
actatgttgggcaagctggtct

SEQ ID NO: 755690 - DNA, 22 bp, Artificial Sequence
  chemically synthesized
aggtcaggagtttgagaccagc

SEQ ID NO: 755691 - DNA, 22 bp, Artificial Sequence
  chemically synthesized
tgttgggcaagctggtctcaaa

SEQ ID NO: 755692 - DNA, 22 bp, Artificial Sequence
  chemically synthesized
ggcaagctggtctcaaactcct

SEQ ID NO: 755693 - DNA, 22 bp, Artificial Sequence
  chemically synthesized
gtctcaaactcctgacctcagg

SEQ ID NO: 755694 - DNA, 22 bp, Artificial Sequence
  chemically synthesized
aaactcctgacctcaggtgatc

SEQ ID NO: 755695 - DNA, 22 bp, Artificial Sequence
  chemically synthesized
cgaggccgaggcaaacggatca

SEQ ID NO: 755696 - DNA, 22 bp, Artificial Sequence
  chemically synthesized
ctgacctcaggtgatccgtttg

SEQ ID NO: 755697 - DNA, 22 bp, Artificial Sequence
  chemically synthesized
gcgaggccgaggcaaacggatc

SEQ ID NO: 755698 - DNA, 22 bp, Artificial Sequence
  chemically synthesized
tgcgaggccgaggcaaacggat

SEQ ID NO: 755699 - DNA, 22 bp, Artificial Sequence
  chemically synthesized
acctcaggtgatccgtttgcct

SEQ ID NO: 755700 - DNA, 22 bp, Artificial Sequence
  chemically synthesized
aggtgatccgtttgcctcggcc

SEQ ID NO: 755701 - DNA, 22 bp, Artificial Sequence
  chemically synthesized
taatcccagcactttgcgaggc

SEQ ID NO: 755702 - DNA, 22 bp, Artificial Sequence
  chemically synthesized
gtaatcccagcactttgcgagg

SEQ ID NO: 755703 - DNA, 22 bp, Artificial Sequence
  chemically synthesized
gcctcggcctcgcaaagtgctg

SEQ ID NO: 755704 - DNA, 22 bp, Artificial Sequence
  chemically synthesized
cctcggcctcgcaaagtgctgg

SEQ ID NO: 755705 - DNA, 22 bp, Artificial Sequence
  chemically synthesized
acacttgtaatcccagcacttt

SEQ ID NO: 755706 - DNA, 22 bp, Artificial Sequence
  chemically synthesized
ggcctcgcaaagtgctgggatt

SEQ ID NO: 755707 - DNA, 22 bp, Artificial Sequence
  chemically synthesized
gcaaagtgctgggattacaagt

SEQ ID NO: 755708 - DNA, 22 bp, Artificial Sequence
  chemically synthesized
ggattacaagtgtgagccacca

SEQ ID NO: 755709 - DNA, 22 bp, Artificial Sequence
  chemically synthesized
caagtgtgagccaccacacctg

SEQ ID NO: 755710 - DNA, 22 bp, Artificial Sequence
  chemically synthesized
gccactgattatttttttctgt

SEQ ID NO: 755711 - DNA, 22 bp, Artificial Sequence
  chemically synthesized
attatttttttctgtccctctt

SEQ ID NO: 755712 - DNA, 22 bp, Artificial Sequence
  chemically synthesized
tttttttctgtccctcttgctt

SEQ ID NO: 755713 - DNA, 22 bp, Artificial Sequence
  chemically synthesized
taatataagcaggaagcaagag

SEQ ID NO: 755714 - DNA, 22 bp, Artificial Sequence
  chemically synthesized
ataatataagcaggaagcaaga

SEQ ID NO: 755715 - DNA, 22 bp, Artificial Sequence
  chemically synthesized
ttttctgtccctcttgcttcct

SEQ ID NO: 755716 - DNA, 22 bp, Artificial Sequence
  chemically synthesized
tataatataagcaggaagcaag

SEQ ID NO: 755717 - DNA, 22 bp, Artificial Sequence
  chemically synthesized
tttctgtccctcttgcttcctg

SEQ ID NO: 755718 - DNA, 22 bp, Artificial Sequence
  chemically synthesized
ttataatataagcaggaagcaa

SEQ ID NO: 755719 - DNA, 22 bp, Artificial Sequence
  chemically synthesized
ttctgtccctcttgcttcctgc

SEQ ID NO: 755720 - DNA, 22 bp, Artificial Sequence
  chemically synthesized
tctgtccctcttgcttcctgct

SEQ ID NO: 755721 - DNA, 22 bp, Artificial Sequence
  chemically synthesized
ctgtccctcttgcttcctgctt

SEQ ID NO: 755722 - DNA, 22 bp, Artificial Sequence
  chemically synthesized
tgtccctcttgcttcctgctta

SEQ ID NO: 755723 - DNA, 22 bp, Artificial Sequence
  chemically synthesized
tccctcttgcttcctgcttata

SEQ ID NO: 755724 - DNA, 22 bp, Artificial Sequence
  chemically synthesized
gatatttttataatataagcag

SEQ ID NO: 755725 - DNA, 22 bp, Artificial Sequence
  chemically synthesized
agatatttttataatataagca

SEQ ID NO: 755726 - DNA, 22 bp, Artificial Sequence
  chemically synthesized
tttagatatttttataatataa

SEQ ID NO: 755727 - DNA, 22 bp, Artificial Sequence
  chemically synthesized
ttgcttcctgcttatattataa

SEQ ID NO: 755728 - DNA, 22 bp, Artificial Sequence
  chemically synthesized
gcttcctgcttatattataaaa

SEQ ID NO: 755729 - DNA, 22 bp, Artificial Sequence
  chemically synthesized
cttcctgcttatattataaaaa

SEQ ID NO: 755730 - DNA, 22 bp, Artificial Sequence
  chemically synthesized
cctgcttatattataaaaatat

SEQ ID NO: 755731 - DNA, 22 bp, Artificial Sequence
  chemically synthesized
ctgcttatattataaaaatatc

SEQ ID NO: 755732 - DNA, 22 bp, Artificial Sequence
  chemically synthesized
tggcattatttagatattttta

SEQ ID NO: 755733 - DNA, 22 bp, Artificial Sequence
  chemically synthesized
atggcattatttagatattttt

SEQ ID NO: 755734 - DNA, 22 bp, Artificial Sequence
  chemically synthesized
cttatattataaaaatatctaa

SEQ ID NO: 755735 - DNA, 22 bp, Artificial Sequence
  chemically synthesized
tttatggcattatttagatatt

SEQ ID NO: 755736 - DNA, 22 bp, Artificial Sequence
  chemically synthesized
atattataaaaatatctaaata

SEQ ID NO: 755737 - DNA, 22 bp, Artificial Sequence
  chemically synthesized
tatttatggcattatttagata

SEQ ID NO: 755738 - DNA, 22 bp, Artificial Sequence
  chemically synthesized
tattataaaaatatctaaataa

SEQ ID NO: 755739 - DNA, 22 bp, Artificial Sequence
  chemically synthesized
ctatttatggcattatttagat

SEQ ID NO: 755740 - DNA, 22 bp, Artificial Sequence
  chemically synthesized
cttctatttatggcattattta

SEQ ID NO: 755741 - DNA, 22 bp, Artificial Sequence
  chemically synthesized
taaaaatatctaaataatgcca

SEQ ID NO: 755742 - DNA, 22 bp, Artificial Sequence
  chemically synthesized
agctacttctatttatggcatt

SEQ ID NO: 755743 - DNA, 22 bp, Artificial Sequence
  chemically synthesized
tgagctacttctatttatggca

SEQ ID NO: 755744 - DNA, 22 bp, Artificial Sequence
  chemically synthesized
aataatgccataaatagaagta

SEQ ID NO: 755745 - DNA, 22 bp, Artificial Sequence
  chemically synthesized
catacgtggttctgagctactt

SEQ ID NO: 755746 - DNA, 22 bp, Artificial Sequence
  chemically synthesized
atcccctccatacgtggttctg

SEQ ID NO: 755747 - DNA, 22 bp, Artificial Sequence
  chemically synthesized
catcccctccatacgtggttct

SEQ ID NO: 755748 - DNA, 22 bp, Artificial Sequence
  chemically synthesized
tcatcccctccatacgtggttc

SEQ ID NO: 755749 - DNA, 22 bp, Artificial Sequence
  chemically synthesized
acctttcatcccctccatacgt

SEQ ID NO: 755750 - DNA, 22 bp, Artificial Sequence
  chemically synthesized
agaaccacgtatggaggggatg

SEQ ID NO: 755751 - DNA, 22 bp, Artificial Sequence
  chemically synthesized
atgaagcaaatcaatatctcac

SEQ ID NO: 755752 - DNA, 22 bp, Artificial Sequence
  chemically synthesized
tcatgaagcaaatcaatatctc

SEQ ID NO: 755753 - DNA, 22 bp, Artificial Sequence
  chemically synthesized
ctctcatgaagcaaatcaatat

SEQ ID NO: 755754 - DNA, 22 bp, Artificial Sequence
  chemically synthesized
ttcctctcatgaagcaaatcaa

SEQ ID NO: 755755 - DNA, 22 bp, Artificial Sequence
  chemically synthesized
gttcctctcatgaagcaaatca

SEQ ID NO: 755756 - DNA, 22 bp, Artificial Sequence
  chemically synthesized
ttgttcctctcatgaagcaaat

SEQ ID NO: 755757 - DNA, 22 bp, Artificial Sequence
  chemically synthesized
ctcttgttcctctcatgaagca

SEQ ID NO: 755758 - DNA, 22 bp, Artificial Sequence
  chemically synthesized
tcctcttgttcctctcatgaag

SEQ ID NO: 755759 - DNA, 22 bp, Artificial Sequence
  chemically synthesized
atttgcttcatgagaggaacaa

SEQ ID NO: 755760 - DNA, 22 bp, Artificial Sequence
  chemically synthesized
gcttcatgagaggaacaagagg

SEQ ID NO: 755761 - DNA, 22 bp, Artificial Sequence
  chemically synthesized
cttcatgagaggaacaagagga

SEQ ID NO: 755762 - DNA, 22 bp, Artificial Sequence
  chemically synthesized
tgcccagagttctcctcttgtt

SEQ ID NO: 755763 - DNA, 22 bp, Artificial Sequence
  chemically synthesized
catgagaggaacaagaggagaa

SEQ ID NO: 755764 - DNA, 22 bp, Artificial Sequence
  chemically synthesized
atgagaggaacaagaggagaac

SEQ ID NO: 755765 - DNA, 22 bp, Artificial Sequence
  chemically synthesized
cctatgcccagagttctcctct

SEQ ID NO: 755766 - DNA, 22 bp, Artificial Sequence
  chemically synthesized
tcatgtcattacctatgcccag

SEQ ID NO: 755767 - DNA, 22 bp, Artificial Sequence
  chemically synthesized
cctgtcatgtcattacctatgc

SEQ ID NO: 755768 - DNA, 22 bp, Artificial Sequence
  chemically synthesized
tccctgtcatgtcattacctat

SEQ ID NO: 755769 - DNA, 22 bp, Artificial Sequence
  chemically synthesized
ctccctgtcatgtcattaccta

SEQ ID NO: 755770 - DNA, 22 bp, Artificial Sequence
  chemically synthesized
tctccctgtcatgtcattacct

SEQ ID NO: 755771 - DNA, 22 bp, Artificial Sequence
  chemically synthesized
ttctccctgtcatgtcattacc

SEQ ID NO: 755772 - DNA, 22 bp, Artificial Sequence
  chemically synthesized
tgggcataggtaatgacatgac

SEQ ID NO: 755773 - DNA, 22 bp, Artificial Sequence
  chemically synthesized
ggcataggtaatgacatgacag

SEQ ID NO: 755774 - DNA, 22 bp, Artificial Sequence
  chemically synthesized
tccccaggagaaagcaagatag

SEQ ID NO: 755775 - DNA, 22 bp, Artificial Sequence
  chemically synthesized
aatccactgtccccaggagaaa

SEQ ID NO: 755776 - DNA, 22 bp, Artificial Sequence
  chemically synthesized
tcttgctttctcctggggacag

SEQ ID NO: 755777 - DNA, 22 bp, Artificial Sequence
  chemically synthesized
gctttctcctggggacagtgga

SEQ ID NO: 755778 - DNA, 22 bp, Artificial Sequence
  chemically synthesized
ctttctcctggggacagtggat

SEQ ID NO: 755779 - DNA, 22 bp, Artificial Sequence
  chemically synthesized
tctcctggggacagtggattta

SEQ ID NO: 755780 - DNA, 22 bp, Artificial Sequence
  chemically synthesized
ctcctggggacagtggatttag

SEQ ID NO: 755781 - DNA, 22 bp, Artificial Sequence
  chemically synthesized
tcctggggacagtggatttagg

SEQ ID NO: 755782 - DNA, 22 bp, Artificial Sequence
  chemically synthesized
ctggggacagtggatttaggat

SEQ ID NO: 755783 - DNA, 22 bp, Artificial Sequence
  chemically synthesized
gggacagtggatttaggatcat

SEQ ID NO: 755784 - DNA, 22 bp, Artificial Sequence
  chemically synthesized
acatccatagtaatatgatcct

SEQ ID NO: 755785 - DNA, 22 bp, Artificial Sequence
  chemically synthesized
ctcacatccatagtaatatgat

SEQ ID NO: 755786 - DNA, 22 bp, Artificial Sequence
  chemically synthesized
actcacatccatagtaatatga

SEQ ID NO: 755787 - DNA, 22 bp, Artificial Sequence
  chemically synthesized
tactcacatccatagtaatatg

SEQ ID NO: 755788 - DNA, 22 bp, Artificial Sequence
  chemically synthesized
ttactcacatccatagtaatat

SEQ ID NO: 755789 - DNA, 22 bp, Artificial Sequence
  chemically synthesized
aggatcatattactatggatgt

SEQ ID NO: 755790 - DNA, 22 bp, Artificial Sequence
  chemically synthesized
ggatcatattactatggatgtg

SEQ ID NO: 755791 - DNA, 22 bp, Artificial Sequence
  chemically synthesized
aaaagcacgggcttttactcac

SEQ ID NO: 755792 - DNA, 22 bp, Artificial Sequence
  chemically synthesized
gaaaagcacgggcttttactca

SEQ ID NO: 755793 - DNA, 22 bp, Artificial Sequence
  chemically synthesized
tgaaaagcacgggcttttactc

SEQ ID NO: 755794 - DNA, 22 bp, Artificial Sequence
  chemically synthesized
ctatggatgtgagtaaaagccc

SEQ ID NO: 755795 - DNA, 22 bp, Artificial Sequence
  chemically synthesized
tggatgtgagtaaaagcccgtg

SEQ ID NO: 755796 - DNA, 22 bp, Artificial Sequence
  chemically synthesized
tgttttgaaaagcacgggcttt

SEQ ID NO: 755797 - DNA, 22 bp, Artificial Sequence
  chemically synthesized
aaagacatctgtgttttgaaaa

SEQ ID NO: 755798 - DNA, 22 bp, Artificial Sequence
  chemically synthesized
tacatgattgaaagacatctgt

SEQ ID NO: 755799 - DNA, 22 bp, Artificial Sequence
  chemically synthesized
ttcaaaacacagatgtctttca

SEQ ID NO: 755800 - DNA, 22 bp, Artificial Sequence
  chemically synthesized
tcaaaacacagatgtctttcaa

SEQ ID NO: 755801 - DNA, 22 bp, Artificial Sequence
  chemically synthesized
caaaacacagatgtctttcaat

SEQ ID NO: 755802 - DNA, 22 bp, Artificial Sequence
  chemically synthesized
aaaacacagatgtctttcaatc

SEQ ID NO: 755803 - DNA, 22 bp, Artificial Sequence
  chemically synthesized
agcgccaggcaagctgtacatg

SEQ ID NO: 755804 - DNA, 22 bp, Artificial Sequence
  chemically synthesized
tcaatcatgtacagcttgcctg

SEQ ID NO: 755805 - DNA, 22 bp, Artificial Sequence
  chemically synthesized
caatcatgtacagcttgcctgg

SEQ ID NO: 755806 - DNA, 22 bp, Artificial Sequence
  chemically synthesized
aatcatgtacagcttgcctggc

SEQ ID NO: 755807 - DNA, 22 bp, Artificial Sequence
  chemically synthesized
aatatgaatacaggtaaaattc

SEQ ID NO: 755808 - DNA, 22 bp, Artificial Sequence
  chemically synthesized
caatatgaatacaggtaaaatt

SEQ ID NO: 755809 - DNA, 22 bp, Artificial Sequence
  chemically synthesized
gcctggcgctgaattttacctg

SEQ ID NO: 755810 - DNA, 22 bp, Artificial Sequence
  chemically synthesized
cctggcgctgaattttacctgt

SEQ ID NO: 755811 - DNA, 22 bp, Artificial Sequence
  chemically synthesized
gcgctgaattttacctgtattc

SEQ ID NO: 755812 - DNA, 22 bp, Artificial Sequence
  chemically synthesized
ccatttcaatatgaatacaggt

SEQ ID NO: 755813 - DNA, 22 bp, Artificial Sequence
  chemically synthesized
accatttcaatatgaatacagg

SEQ ID NO: 755814 - DNA, 22 bp, Artificial Sequence
  chemically synthesized
aattttacctgtattcatattg

SEQ ID NO: 755815 - DNA, 22 bp, Artificial Sequence
  chemically synthesized
tacctgtattcatattgaaatg

SEQ ID NO: 755816 - DNA, 22 bp, Artificial Sequence
  chemically synthesized
acctgtattcatattgaaatgg

SEQ ID NO: 755817 - DNA, 22 bp, Artificial Sequence
  chemically synthesized
cctgtattcatattgaaatggt

SEQ ID NO: 755818 - DNA, 22 bp, Artificial Sequence
  chemically synthesized
aaaaacacaaatttaccatttc

SEQ ID NO: 755819 - DNA, 22 bp, Artificial Sequence
  chemically synthesized
tattcatattgaaatggtaaat

SEQ ID NO: 755820 - DNA, 22 bp, Artificial Sequence
  chemically synthesized
tgaaaaacacaaatttaccatt

SEQ ID NO: 755821 - DNA, 22 bp, Artificial Sequence
  chemically synthesized
ttctgaaaaacacaaatttacc

SEQ ID NO: 755822 - DNA, 22 bp, Artificial Sequence
  chemically synthesized
attctgaaaaacacaaatttac

SEQ ID NO: 755823 - DNA, 22 bp, Artificial Sequence
  chemically synthesized
atattgaaatggtaaatttgtg

SEQ ID NO: 755824 - DNA, 22 bp, Artificial Sequence
  chemically synthesized
tattctgaaaaacacaaattta

SEQ ID NO: 755825 - DNA, 22 bp, Artificial Sequence
  chemically synthesized
aaatggtaaatttgtgtttttc

SEQ ID NO: 755826 - DNA, 22 bp, Artificial Sequence
  chemically synthesized
catcagattttattctgaaaaa

SEQ ID NO: 755827 - DNA, 22 bp, Artificial Sequence
  chemically synthesized
gtcattccatcagattttattc

SEQ ID NO: 755828 - DNA, 22 bp, Artificial Sequence
  chemically synthesized
gtgtttttcagaataaaatctg

SEQ ID NO: 755829 - DNA, 22 bp, Artificial Sequence
  chemically synthesized
tagtcattccatcagattttat

SEQ ID NO: 755830 - DNA, 22 bp, Artificial Sequence
  chemically synthesized
tgtttttcagaataaaatctga

SEQ ID NO: 755831 - DNA, 22 bp, Artificial Sequence
  chemically synthesized
ctagtcattccatcagatttta

SEQ ID NO: 755832 - DNA, 22 bp, Artificial Sequence
  chemically synthesized
ttcagaataaaatctgatggaa

SEQ ID NO: 755833 - DNA, 22 bp, Artificial Sequence
  chemically synthesized
tcagaataaaatctgatggaat

SEQ ID NO: 755834 - DNA, 22 bp, Artificial Sequence
  chemically synthesized
cagaataaaatctgatggaatg

SEQ ID NO: 755835 - DNA, 22 bp, Artificial Sequence
  chemically synthesized
agaataaaatctgatggaatga

SEQ ID NO: 755836 - DNA, 22 bp, Artificial Sequence
  chemically synthesized
caaatatgggtagtatttctag

SEQ ID NO: 755837 - DNA, 22 bp, Artificial Sequence
  chemically synthesized
acaaatatgggtagtatttcta

SEQ ID NO: 755838 - DNA, 22 bp, Artificial Sequence
  chemically synthesized
atggaatgactagaaatactac

SEQ ID NO: 755839 - DNA, 22 bp, Artificial Sequence
  chemically synthesized
cttacaaatatgggtagtattt

SEQ ID NO: 755840 - DNA, 22 bp, Artificial Sequence
  chemically synthesized
tgcttacaaatatgggtagtat

SEQ ID NO: 755841 - DNA, 22 bp, Artificial Sequence
  chemically synthesized
ggaagttctgcttacaaatatg

SEQ ID NO: 755842 - DNA, 22 bp, Artificial Sequence
  chemically synthesized
gaaatactacccatatttgtaa

SEQ ID NO: 755843 - DNA, 22 bp, Artificial Sequence
  chemically synthesized
taggaagttctgcttacaaata

SEQ ID NO: 755844 - DNA, 22 bp, Artificial Sequence
  chemically synthesized
cccatatttgtaagcagaactt

SEQ ID NO: 755845 - DNA, 22 bp, Artificial Sequence
  chemically synthesized
ccaggatgattctaggaagttc

SEQ ID NO: 755846 - DNA, 22 bp, Artificial Sequence
  chemically synthesized
cctcccaggatgattctaggaa

SEQ ID NO: 755847 - DNA, 22 bp, Artificial Sequence
  chemically synthesized
gtaagcagaacttcctagaatc

SEQ ID NO: 755848 - DNA, 22 bp, Artificial Sequence
  chemically synthesized
taagcagaacttcctagaatca

SEQ ID NO: 755849 - DNA, 22 bp, Artificial Sequence
  chemically synthesized
agcctgcctcccaggatgattc

SEQ ID NO: 755850 - DNA, 22 bp, Artificial Sequence
  chemically synthesized
cagcctgcctcccaggatgatt

SEQ ID NO: 755851 - DNA, 22 bp, Artificial Sequence
  chemically synthesized
cctagaatcatcctgggaggca

SEQ ID NO: 755852 - DNA, 22 bp, Artificial Sequence
  chemically synthesized
accacttcagcctgcctcccag

SEQ ID NO: 755853 - DNA, 22 bp, Artificial Sequence
  chemically synthesized
ctagaatcatcctgggaggcag

SEQ ID NO: 755854 - DNA, 22 bp, Artificial Sequence
  chemically synthesized
caccacttcagcctgcctccca

SEQ ID NO: 755855 - DNA, 22 bp, Artificial Sequence
  chemically synthesized
tcaccacttcagcctgcctccc

SEQ ID NO: 755856 - DNA, 22 bp, Artificial Sequence
  chemically synthesized
ttcaccacttcagcctgcctcc

SEQ ID NO: 755857 - DNA, 22 bp, Artificial Sequence
  chemically synthesized
gaatcatcctgggaggcaggct

SEQ ID NO: 755858 - DNA, 22 bp, Artificial Sequence
  chemically synthesized
ttttcaccacttcagcctgcct

SEQ ID NO: 755859 - DNA, 22 bp, Artificial Sequence
  chemically synthesized
ggaggcaggctgaagtggtgaa

SEQ ID NO: 755860 - DNA, 22 bp, Artificial Sequence
  chemically synthesized
agaacagtgctcttttcaccac

SEQ ID NO: 755861 - DNA, 22 bp, Artificial Sequence
  chemically synthesized
ccactcagaacagtgctctttt

SEQ ID NO: 755862 - DNA, 22 bp, Artificial Sequence
  chemically synthesized
tgccactcagaacagtgctctt

SEQ ID NO: 755863 - DNA, 22 bp, Artificial Sequence
  chemically synthesized
ctgccactcagaacagtgctct

SEQ ID NO: 755864 - DNA, 22 bp, Artificial Sequence
  chemically synthesized
aagtggtgaaaagagcactgtt

SEQ ID NO: 755865 - DNA, 22 bp, Artificial Sequence
  chemically synthesized
aagcccaaggcttctgccactc

SEQ ID NO: 755866 - DNA, 22 bp, Artificial Sequence
  chemically synthesized
gaagcccaaggcttctgccact

SEQ ID NO: 755867 - DNA, 22 bp, Artificial Sequence
  chemically synthesized
ttctgagtggcagaagccttgg

SEQ ID NO: 755868 - DNA, 22 bp, Artificial Sequence
  chemically synthesized
tgagtggcagaagccttgggct

SEQ ID NO: 755869 - DNA, 22 bp, Artificial Sequence
  chemically synthesized
agtggcagaagccttgggcttc

SEQ ID NO: 755870 - DNA, 22 bp, Artificial Sequence
  chemically synthesized
gcccagcccaggcttgaagccc

SEQ ID NO: 755871 - DNA, 22 bp, Artificial Sequence
  chemically synthesized
tggcccagcccaggcttgaagc

SEQ ID NO: 755872 - DNA, 22 bp, Artificial Sequence
  chemically synthesized
gggcttcaagcctgggctgggc

SEQ ID NO: 755873 - DNA, 22 bp, Artificial Sequence
  chemically synthesized
ggcttcaagcctgggctgggcc

SEQ ID NO: 755874 - DNA, 22 bp, Artificial Sequence
  chemically synthesized
cagccaggttctggcccagccc

SEQ ID NO: 755875 - DNA, 22 bp, Artificial Sequence
  chemically synthesized
caagcctgggctgggccagaac

SEQ ID NO: 755876 - DNA, 22 bp, Artificial Sequence
  chemically synthesized
aagcctgggctgggccagaacc

SEQ ID NO: 755877 - DNA, 22 bp, Artificial Sequence
  chemically synthesized
gatcactgcagccaggttctgg

SEQ ID NO: 755878 - DNA, 22 bp, Artificial Sequence
  chemically synthesized
tggatcactgcagccaggttct

SEQ ID NO: 755879 - DNA, 22 bp, Artificial Sequence
  chemically synthesized
ctggatcactgcagccaggttc

SEQ ID NO: 755880 - DNA, 22 bp, Artificial Sequence
  chemically synthesized
tctggatcactgcagccaggtt

SEQ ID NO: 755881 - DNA, 22 bp, Artificial Sequence
  chemically synthesized
ggctgggccagaacctggctgc

SEQ ID NO: 755882 - DNA, 22 bp, Artificial Sequence
  chemically synthesized
ttctggatcactgcagccaggt

SEQ ID NO: 755883 - DNA, 22 bp, Artificial Sequence
  chemically synthesized
ggccagaacctggctgcagtga

SEQ ID NO: 755884 - DNA, 22 bp, Artificial Sequence
  chemically synthesized
tcaccttttctggatcactgca

SEQ ID NO: 755885 - DNA, 22 bp, Artificial Sequence
  chemically synthesized
atcaccttttctggatcactgc

SEQ ID NO: 755886 - DNA, 22 bp, Artificial Sequence
  chemically synthesized
gctgcagtgatccagaaaaggt

SEQ ID NO: 755887 - DNA, 22 bp, Artificial Sequence
  chemically synthesized
cagtgatccagaaaaggtgata

SEQ ID NO: 755888 - DNA, 22 bp, Artificial Sequence
  chemically synthesized
caaatgaggacacagaggagca

SEQ ID NO: 755889 - DNA, 22 bp, Artificial Sequence
  chemically synthesized
acaaatgaggacacagaggagc

SEQ ID NO: 755890 - DNA, 22 bp, Artificial Sequence
  chemically synthesized
tacaaatgaggacacagaggag

SEQ ID NO: 755891 - DNA, 22 bp, Artificial Sequence
  chemically synthesized
ttcctgctcctctgtgtcctca

SEQ ID NO: 755892 - DNA, 22 bp, Artificial Sequence
  chemically synthesized
cctgctcctctgtgtcctcatt

SEQ ID NO: 755893 - DNA, 22 bp, Artificial Sequence
  chemically synthesized
ctgctcctctgtgtcctcattt

SEQ ID NO: 755894 - DNA, 22 bp, Artificial Sequence
  chemically synthesized
ctcctctgtgtcctcatttgta

SEQ ID NO: 755895 - DNA, 22 bp, Artificial Sequence
  chemically synthesized
ctctgtgtcctcatttgtaaaa

SEQ ID NO: 755896 - DNA, 22 bp, Artificial Sequence
  chemically synthesized
gcaaatgcccacattttacaaa

SEQ ID NO: 755897 - DNA, 22 bp, Artificial Sequence
  chemically synthesized
agcaaatgcccacattttacaa

SEQ ID NO: 755898 - DNA, 22 bp, Artificial Sequence
  chemically synthesized
tgtgtcctcatttgtaaaatgt

SEQ ID NO: 755899 - DNA, 22 bp, Artificial Sequence
  chemically synthesized
tagcaaatgcccacattttaca

SEQ ID NO: 755900 - DNA, 22 bp, Artificial Sequence
  chemically synthesized
tgtcctcatttgtaaaatgtgg

SEQ ID NO: 755901 - DNA, 22 bp, Artificial Sequence
  chemically synthesized
atttgtaaaatgtgggcatttg

SEQ ID NO: 755902 - DNA, 22 bp, Artificial Sequence
  chemically synthesized
gataaggttttagcaaatgccc

SEQ ID NO: 755903 - DNA, 22 bp, Artificial Sequence
  chemically synthesized
agataaggttttagcaaatgcc

SEQ ID NO: 755904 - DNA, 22 bp, Artificial Sequence
  chemically synthesized
gtaaaatgtgggcatttgctaa

SEQ ID NO: 755905 - DNA, 22 bp, Artificial Sequence
  chemically synthesized
taaaatgtgggcatttgctaaa

SEQ ID NO: 755906 - DNA, 22 bp, Artificial Sequence
  chemically synthesized
gaacttagataaggttttagca

SEQ ID NO: 755907 - DNA, 22 bp, Artificial Sequence
  chemically synthesized
gatgttagaacttagataaggt

SEQ ID NO: 755908 - DNA, 22 bp, Artificial Sequence
  chemically synthesized
gctaaaaccttatctaagttct

SEQ ID NO: 755909 - DNA, 22 bp, Artificial Sequence
  chemically synthesized
ctaaaaccttatctaagttcta

SEQ ID NO: 755910 - DNA, 22 bp, Artificial Sequence
  chemically synthesized
aaaccttatctaagttctaaca

SEQ ID NO: 755911 - DNA, 22 bp, Artificial Sequence
  chemically synthesized
tagtatatgagaactggatgtt

SEQ ID NO: 755912 - DNA, 22 bp, Artificial Sequence
  chemically synthesized
atctaagttctaacatccagtt

SEQ ID NO: 755913 - DNA, 22 bp, Artificial Sequence
  chemically synthesized
tctaagttctaacatccagttc

SEQ ID NO: 755914 - DNA, 22 bp, Artificial Sequence
  chemically synthesized
attatagtatatgagaactgga

SEQ ID NO: 755915 - DNA, 22 bp, Artificial Sequence
  chemically synthesized
agttctaacatccagttctcat

SEQ ID NO: 755916 - DNA, 22 bp, Artificial Sequence
  chemically synthesized
taacatccagttctcatatact

SEQ ID NO: 755917 - DNA, 22 bp, Artificial Sequence
  chemically synthesized
acaaattgattatagtatatga

SEQ ID NO: 755918 - DNA, 22 bp, Artificial Sequence
  chemically synthesized
acatccagttctcatatactat

SEQ ID NO: 755919 - DNA, 22 bp, Artificial Sequence
  chemically synthesized
aacaaattgattatagtatatg

SEQ ID NO: 755920 - DNA, 22 bp, Artificial Sequence
  chemically synthesized
atgatcttaacaaattgattat

SEQ ID NO: 755921 - DNA, 22 bp, Artificial Sequence
  chemically synthesized
tcatatactataatcaatttgt

SEQ ID NO: 755922 - DNA, 22 bp, Artificial Sequence
  chemically synthesized
atatactataatcaatttgtta

SEQ ID NO: 755923 - DNA, 22 bp, Artificial Sequence
  chemically synthesized
tggccgattaatgatcttaaca

SEQ ID NO: 755924 - DNA, 22 bp, Artificial Sequence
  chemically synthesized
taatcaatttgttaagatcatt

SEQ ID NO: 755925 - DNA, 22 bp, Artificial Sequence
  chemically synthesized
gttaagatcattaatcggccac

SEQ ID NO: 755926 - DNA, 22 bp, Artificial Sequence
  chemically synthesized
ttaagatcattaatcggccaca

SEQ ID NO: 755927 - DNA, 22 bp, Artificial Sequence
  chemically synthesized
agatcattaatcggccacaggc

SEQ ID NO: 755928 - DNA, 22 bp, Artificial Sequence
  chemically synthesized
ccaccatagagcaggcctgtgg

SEQ ID NO: 755929 - DNA, 22 bp, Artificial Sequence
  chemically synthesized
aaactgccaccatagagcaggc

SEQ ID NO: 755930 - DNA, 22 bp, Artificial Sequence
  chemically synthesized
atcggccacaggcctgctctat

SEQ ID NO: 755931 - DNA, 22 bp, Artificial Sequence
  chemically synthesized
tcaaactgccaccatagagcag

SEQ ID NO: 755932 - DNA, 22 bp, Artificial Sequence
  chemically synthesized
gcagagactctcaaactgccac

SEQ ID NO: 755933 - DNA, 22 bp, Artificial Sequence
  chemically synthesized
agcagagactctcaaactgcca

SEQ ID NO: 755934 - DNA, 22 bp, Artificial Sequence
  chemically synthesized
ctctatggtggcagtttgagag

SEQ ID NO: 755935 - DNA, 22 bp, Artificial Sequence
  chemically synthesized
tatggtggcagtttgagagtct

SEQ ID NO: 755936 - DNA, 22 bp, Artificial Sequence
  chemically synthesized
tggtggcagtttgagagtctct

SEQ ID NO: 755937 - DNA, 22 bp, Artificial Sequence
  chemically synthesized
gagagtctctgctaagcatcgt

SEQ ID NO: 755938 - DNA, 22 bp, Artificial Sequence
  chemically synthesized
agagtctctgctaagcatcgtt

SEQ ID NO: 755939 - DNA, 22 bp, Artificial Sequence
  chemically synthesized
agcatcgataataacgatgctt

SEQ ID NO: 755940 - DNA, 22 bp, Artificial Sequence
  chemically synthesized
aagcatcgataataacgatgct

SEQ ID NO: 755941 - DNA, 22 bp, Artificial Sequence
  chemically synthesized
taagcatcgataataacgatgc

SEQ ID NO: 755942 - DNA, 22 bp, Artificial Sequence
  chemically synthesized
ttaagcatcgataataacgatg

SEQ ID NO: 755943 - DNA, 22 bp, Artificial Sequence
  chemically synthesized
tgctaagcatcgttattatcga

SEQ ID NO: 755944 - DNA, 22 bp, Artificial Sequence
  chemically synthesized
tggtttttaagcatcgataata

SEQ ID NO: 755945 - DNA, 22 bp, Artificial Sequence
  chemically synthesized
ctaagcatcgttattatcgatg

SEQ ID NO: 755946 - DNA, 22 bp, Artificial Sequence
  chemically synthesized
agcatcgttattatcgatgctt

SEQ ID NO: 755947 - DNA, 22 bp, Artificial Sequence
  chemically synthesized
tggctatggtttttaagcatcg

SEQ ID NO: 755948 - DNA, 22 bp, Artificial Sequence
  chemically synthesized
ttatcgatgcttaaaaaccata

SEQ ID NO: 755949 - DNA, 22 bp, Artificial Sequence
  chemically synthesized
tcgatgcttaaaaaccatagcc

SEQ ID NO: 755950 - DNA, 22 bp, Artificial Sequence
  chemically synthesized
tatgccaagctatggctatggt

SEQ ID NO: 755951 - DNA, 22 bp, Artificial Sequence
  chemically synthesized
ctatatgccaagctatggctat

SEQ ID NO: 755952 - DNA, 22 bp, Artificial Sequence
  chemically synthesized
actatatgccaagctatggcta

SEQ ID NO: 755953 - DNA, 22 bp, Artificial Sequence
  chemically synthesized
aaaaaccatagccatagcttgg

SEQ ID NO: 755954 - DNA, 22 bp, Artificial Sequence
  chemically synthesized
aaaaccatagccatagcttggc

SEQ ID NO: 755955 - DNA, 22 bp, Artificial Sequence
  chemically synthesized
agcatttactatatgccaagct

SEQ ID NO: 755956 - DNA, 22 bp, Artificial Sequence
  chemically synthesized
ctgagcatttactatatgccaa

SEQ ID NO: 755957 - DNA, 22 bp, Artificial Sequence
  chemically synthesized
actgagcatttactatatgcca

SEQ ID NO: 755958 - DNA, 22 bp, Artificial Sequence
  chemically synthesized
ggcatatagtaaatgctcagta

SEQ ID NO: 755959 - DNA, 22 bp, Artificial Sequence
  chemically synthesized
gtcaacaatgtttactgagcat

SEQ ID NO: 755960 - DNA, 22 bp, Artificial Sequence
  chemically synthesized
gcatatagtaaatgctcagtaa

SEQ ID NO: 755961 - DNA, 22 bp, Artificial Sequence
  chemically synthesized
agtcaacaatgtttactgagca

SEQ ID NO: 755962 - DNA, 22 bp, Artificial Sequence
  chemically synthesized
tatcttagtcaacaatgtttac

SEQ ID NO: 755963 - DNA, 22 bp, Artificial Sequence
  chemically synthesized
tgtatcttagtcaacaatgttt

SEQ ID NO: 755964 - DNA, 22 bp, Artificial Sequence
  chemically synthesized
ggtgttctgtatcttagtcaac

SEQ ID NO: 755965 - DNA, 22 bp, Artificial Sequence
  chemically synthesized
agtaaacattgttgactaagat

SEQ ID NO: 755966 - DNA, 22 bp, Artificial Sequence
  chemically synthesized
actgggtgttctgtatcttagt

SEQ ID NO: 755967 - DNA, 22 bp, Artificial Sequence
  chemically synthesized
taactgggtgttctgtatctta

SEQ ID NO: 755968 - DNA, 22 bp, Artificial Sequence
  chemically synthesized
gtgttctaactgggtgttctgt

SEQ ID NO: 755969 - DNA, 22 bp, Artificial Sequence
  chemically synthesized
ttgactaagatacagaacaccc

SEQ ID NO: 755970 - DNA, 22 bp, Artificial Sequence
  chemically synthesized
tagtgttctaactgggtgttct

SEQ ID NO: 755971 - DNA, 22 bp, Artificial Sequence
  chemically synthesized
actaagatacagaacacccagt

SEQ ID NO: 755972 - DNA, 22 bp, Artificial Sequence
  chemically synthesized
agatacagaacacccagttaga

SEQ ID NO: 755973 - DNA, 22 bp, Artificial Sequence
  chemically synthesized
atataacacactctagtgttct

SEQ ID NO: 755974 - DNA, 22 bp, Artificial Sequence
  chemically synthesized
catataacacactctagtgttc

SEQ ID NO: 755975 - DNA, 22 bp, Artificial Sequence
  chemically synthesized
gccttcatataacacactctag

SEQ ID NO: 755976 - DNA, 22 bp, Artificial Sequence
  chemically synthesized
ggccttcatataacacactcta

SEQ ID NO: 755977 - DNA, 22 bp, Artificial Sequence
  chemically synthesized
gaacactagagtgtgttatatg

SEQ ID NO: 755978 - DNA, 22 bp, Artificial Sequence
  chemically synthesized
aatcaacttggccttcatataa

SEQ ID NO: 755979 - DNA, 22 bp, Artificial Sequence
  chemically synthesized
gagtgtgttatatgaaggccaa

SEQ ID NO: 755980 - DNA, 22 bp, Artificial Sequence
  chemically synthesized
catctaaatcaacttggccttc

SEQ ID NO: 755981 - DNA, 22 bp, Artificial Sequence
  chemically synthesized
gcatctaaatcaacttggcctt

SEQ ID NO: 755982 - DNA, 22 bp, Artificial Sequence
  chemically synthesized
tgcatctaaatcaacttggcct

SEQ ID NO: 755983 - DNA, 22 bp, Artificial Sequence
  chemically synthesized
ttttgcatctaaatcaacttgg

SEQ ID NO: 755984 - DNA, 22 bp, Artificial Sequence
  chemically synthesized
tatgaaggccaagttgatttag

SEQ ID NO: 755985 - DNA, 22 bp, Artificial Sequence
  chemically synthesized
caagcctgttttgcatctaaat

SEQ ID NO: 755986 - DNA, 22 bp, Artificial Sequence
  chemically synthesized
ccctgcaagcctgttttgcatc

SEQ ID NO: 755987 - DNA, 22 bp, Artificial Sequence
  chemically synthesized
cccctgcaagcctgttttgcat

SEQ ID NO: 755988 - DNA, 22 bp, Artificial Sequence
  chemically synthesized
tcccctgcaagcctgttttgca

SEQ ID NO: 755989 - DNA, 22 bp, Artificial Sequence
  chemically synthesized
atttagatgcaaaacaggcttg

SEQ ID NO: 755990 - DNA, 22 bp, Artificial Sequence
  chemically synthesized
agatgcaaaacaggcttgcagg

SEQ ID NO: 755991 - DNA, 22 bp, Artificial Sequence
  chemically synthesized
gatgcaaaacaggcttgcaggg

SEQ ID NO: 755992 - DNA, 22 bp, Artificial Sequence
  chemically synthesized
atgagtccaggctttcccctgc

SEQ ID NO: 755993 - DNA, 22 bp, Artificial Sequence
  chemically synthesized
tgattcatgagtccaggctttc

SEQ ID NO: 755994 - DNA, 22 bp, Artificial Sequence
  chemically synthesized
atgattcatgagtccaggcttt

SEQ ID NO: 755995 - DNA, 22 bp, Artificial Sequence
  chemically synthesized
acttatgattcatgagtccagg

SEQ ID NO: 755996 - DNA, 22 bp, Artificial Sequence
  chemically synthesized
gcaggggaaagcctggactcat

SEQ ID NO: 755997 - DNA, 22 bp, Artificial Sequence
  chemically synthesized
cacttatgattcatgagtccag

SEQ ID NO: 755998 - DNA, 22 bp, Artificial Sequence
  chemically synthesized
caggggaaagcctggactcatg

SEQ ID NO: 755999 - DNA, 22 bp, Artificial Sequence
  chemically synthesized
tcacttatgattcatgagtcca

SEQ ID NO: 756000 - DNA, 22 bp, Artificial Sequence
  chemically synthesized
ttcacttatgattcatgagtcc

SEQ ID NO: 756001 - DNA, 22 bp, Artificial Sequence
  chemically synthesized
tttcacttatgattcatgagtc

SEQ ID NO: 756002 - DNA, 22 bp, Artificial Sequence
  chemically synthesized
attttttcacttatgattcatg

SEQ ID NO: 756003 - DNA, 22 bp, Artificial Sequence
  chemically synthesized
gactcatgaatcataagtgaaa

SEQ ID NO: 756004 - DNA, 22 bp, Artificial Sequence
  chemically synthesized
cagcattaattttttcacttat

SEQ ID NO: 756005 - DNA, 22 bp, Artificial Sequence
  chemically synthesized
acagcattaattttttcactta

SEQ ID NO: 756006 - DNA, 22 bp, Artificial Sequence
  chemically synthesized
atgaatcataagtgaaaaaatt

SEQ ID NO: 756007 - DNA, 22 bp, Artificial Sequence
  chemically synthesized
ccaatttacagcattaattttt

SEQ ID NO: 756008 - DNA, 22 bp, Artificial Sequence
  chemically synthesized
cccaatttacagcattaatttt

SEQ ID NO: 756009 - DNA, 22 bp, Artificial Sequence
  chemically synthesized
tcccaatttacagcattaattt

SEQ ID NO: 756010 - DNA, 22 bp, Artificial Sequence
  chemically synthesized
ttcccaatttacagcattaatt

SEQ ID NO: 756011 - DNA, 22 bp, Artificial Sequence
  chemically synthesized
tccatttttcccaatttacagc

SEQ ID NO: 756012 - DNA, 22 bp, Artificial Sequence
  chemically synthesized
atgctgtaaattgggaaaaatg

SEQ ID NO: 756013 - DNA, 22 bp, Artificial Sequence
  chemically synthesized
gaataagatctgtccatttttc

SEQ ID NO: 756014 - DNA, 22 bp, Artificial Sequence
  chemically synthesized
taaattgggaaaaatggacaga

SEQ ID NO: 756015 - DNA, 22 bp, Artificial Sequence
  chemically synthesized
ggaaaaatggacagatcttatt

SEQ ID NO: 756016 - DNA, 22 bp, Artificial Sequence
  chemically synthesized
gaacatgagtagacctagaata

SEQ ID NO: 756017 - DNA, 22 bp, Artificial Sequence
  chemically synthesized
gatctggaacatgagtagacct

SEQ ID NO: 756018 - DNA, 22 bp, Artificial Sequence
  chemically synthesized
ggatctggaacatgagtagacc

SEQ ID NO: 756019 - DNA, 22 bp, Artificial Sequence
  chemically synthesized
tggatctggaacatgagtagac

SEQ ID NO: 756020 - DNA, 22 bp, Artificial Sequence
  chemically synthesized
attctaggtctactcatgttcc

SEQ ID NO: 756021 - DNA, 22 bp, Artificial Sequence
  chemically synthesized
agctttggatctggaacatgag

SEQ ID NO: 756022 - DNA, 22 bp, Artificial Sequence
  chemically synthesized
ttctaggtctactcatgttcca

SEQ ID NO: 756023 - DNA, 22 bp, Artificial Sequence
  chemically synthesized
taggtctactcatgttccagat

SEQ ID NO: 756024 - DNA, 22 bp, Artificial Sequence
  chemically synthesized
ggtctactcatgttccagatcc

SEQ ID NO: 756025 - DNA, 22 bp, Artificial Sequence
  chemically synthesized
ctcatgttccagatccaaagct

SEQ ID NO: 756026 - DNA, 22 bp, Artificial Sequence
  chemically synthesized
agcagtgacactcagctttgga

SEQ ID NO: 756027 - DNA, 22 bp, Artificial Sequence
  chemically synthesized
atgttccagatccaaagctgag

SEQ ID NO: 756028 - DNA, 22 bp, Artificial Sequence
  chemically synthesized
cagatccaaagctgagtgtcac

SEQ ID NO: 756029 - DNA, 22 bp, Artificial Sequence
  chemically synthesized
cacccagtaactcagcagtgac

SEQ ID NO: 756030 - DNA, 22 bp, Artificial Sequence
  chemically synthesized
agtgtcactgctgagttactgg

SEQ ID NO: 756031 - DNA, 22 bp, Artificial Sequence
  chemically synthesized
aggaaattccacccagtaactc

SEQ ID NO: 756032 - DNA, 22 bp, Artificial Sequence
  chemically synthesized
gaggaaattccacccagtaact

SEQ ID NO: 756033 - DNA, 22 bp, Artificial Sequence
  chemically synthesized
ttgaggaaattccacccagtaa

SEQ ID NO: 756034 - DNA, 22 bp, Artificial Sequence
  chemically synthesized
cttgaggaaattccacccagta

SEQ ID NO: 756035 - DNA, 22 bp, Artificial Sequence
  chemically synthesized
ctgagttactgggtggaatttc

SEQ ID NO: 756036 - DNA, 22 bp, Artificial Sequence
  chemically synthesized
agttactgggtggaatttcctc

SEQ ID NO: 756037 - DNA, 22 bp, Artificial Sequence
  chemically synthesized
atgggaccacttcttgaggaaa

SEQ ID NO: 756038 - DNA, 22 bp, Artificial Sequence
  chemically synthesized
ctgggtggaatttcctcaagaa

SEQ ID NO: 756039 - DNA, 22 bp, Artificial Sequence
  chemically synthesized
ggtggaatttcctcaagaagtg

SEQ ID NO: 756040 - DNA, 22 bp, Artificial Sequence
  chemically synthesized
cctcaagaagtggtcccattag

SEQ ID NO: 756041 - DNA, 22 bp, Artificial Sequence
  chemically synthesized
aagaaggcaatgctaatgggac

SEQ ID NO: 756042 - DNA, 22 bp, Artificial Sequence
  chemically synthesized
ctcaagaagtggtcccattagc

SEQ ID NO: 756043 - DNA, 22 bp, Artificial Sequence
  chemically synthesized
aagaagtggtcccattagcatt

SEQ ID NO: 756044 - DNA, 22 bp, Artificial Sequence
  chemically synthesized
ggttgaagaaggcaatgctaat

SEQ ID NO: 756045 - DNA, 22 bp, Artificial Sequence
  chemically synthesized
agaaatcactaggttgaagaag

SEQ ID NO: 756046 - DNA, 22 bp, Artificial Sequence
  chemically synthesized
aagaaatcactaggttgaagaa

SEQ ID NO: 756047 - DNA, 22 bp, Artificial Sequence
  chemically synthesized
taagaaatcactaggttgaaga

SEQ ID NO: 756048 - DNA, 22 bp, Artificial Sequence
  chemically synthesized
gcattgccttcttcaacctagt

SEQ ID NO: 756049 - DNA, 22 bp, Artificial Sequence
  chemically synthesized
ctttaagaaatcactaggttga

SEQ ID NO: 756050 - DNA, 22 bp, Artificial Sequence
  chemically synthesized
ccttcttcaacctagtgatttc

SEQ ID NO: 756051 - DNA, 22 bp, Artificial Sequence
  chemically synthesized
cttcaacctagtgatttcttaa

SEQ ID NO: 756052 - DNA, 22 bp, Artificial Sequence
  chemically synthesized
ttcaacctagtgatttcttaaa

SEQ ID NO: 756053 - DNA, 22 bp, Artificial Sequence
  chemically synthesized
caacctagtgatttcttaaagg

SEQ ID NO: 756054 - DNA, 22 bp, Artificial Sequence
  chemically synthesized
aacctagtgatttcttaaagga

SEQ ID NO: 756055 - DNA, 22 bp, Artificial Sequence
  chemically synthesized
gacatgaaaatctcctttaaga

SEQ ID NO: 756056 - DNA, 22 bp, Artificial Sequence
  chemically synthesized
ggacatgaaaatctcctttaag

SEQ ID NO: 756057 - DNA, 22 bp, Artificial Sequence
  chemically synthesized
gtgatttcttaaaggagatttt

SEQ ID NO: 756058 - DNA, 22 bp, Artificial Sequence
  chemically synthesized
agtgtttggacatgaaaatctc

SEQ ID NO: 756059 - DNA, 22 bp, Artificial Sequence
  chemically synthesized
tgagtgtttggacatgaaaatc

SEQ ID NO: 756060 - DNA, 22 bp, Artificial Sequence
  chemically synthesized
ctgagtgtttggacatgaaaat

SEQ ID NO: 756061 - DNA, 22 bp, Artificial Sequence
  chemically synthesized
cttaaaggagattttcatgtcc

SEQ ID NO: 756062 - DNA, 22 bp, Artificial Sequence
  chemically synthesized
ttaaaggagattttcatgtcca

SEQ ID NO: 756063 - DNA, 22 bp, Artificial Sequence
  chemically synthesized
aaaggagattttcatgtccaaa

SEQ ID NO: 756064 - DNA, 22 bp, Artificial Sequence
  chemically synthesized
aaggagattttcatgtccaaac

SEQ ID NO: 756065 - DNA, 22 bp, Artificial Sequence
  chemically synthesized
aaaccatggaacttctgagtgt

SEQ ID NO: 756066 - DNA, 22 bp, Artificial Sequence
  chemically synthesized
tcatgtccaaacactcagaagt

SEQ ID NO: 756067 - DNA, 22 bp, Artificial Sequence
  chemically synthesized
catgtccaaacactcagaagtt

SEQ ID NO: 756068 - DNA, 22 bp, Artificial Sequence
  chemically synthesized
atgtccaaacactcagaagttc

SEQ ID NO: 756069 - DNA, 22 bp, Artificial Sequence
  chemically synthesized
agaagttccatggtttgaactg

SEQ ID NO: 756070 - DNA, 22 bp, Artificial Sequence
  chemically synthesized
cagaaaaagccccaagcagcag

SEQ ID NO: 756071 - DNA, 22 bp, Artificial Sequence
  chemically synthesized
catggtttgaactgctgcttgg

SEQ ID NO: 756072 - DNA, 22 bp, Artificial Sequence
  chemically synthesized
cagactacagaaaaagccccaa

SEQ ID NO: 756073 - DNA, 22 bp, Artificial Sequence
  chemically synthesized
gaactgctgcttggggcttttt

SEQ ID NO: 756074 - DNA, 22 bp, Artificial Sequence
  chemically synthesized
aactgctgcttggggctttttc

SEQ ID NO: 756075 - DNA, 22 bp, Artificial Sequence
  chemically synthesized
atcctgcagactacagaaaaag

SEQ ID NO: 756076 - DNA, 22 bp, Artificial Sequence
  chemically synthesized
ctgcttggggctttttctgtag

SEQ ID NO: 756077 - DNA, 22 bp, Artificial Sequence
  chemically synthesized
cctaatcctgcagactacagaa

SEQ ID NO: 756078 - DNA, 22 bp, Artificial Sequence
  chemically synthesized
cttggggctttttctgtagtct

SEQ ID NO: 756079 - DNA, 22 bp, Artificial Sequence
  chemically synthesized
ctacctaatcctgcagactaca

SEQ ID NO: 756080 - DNA, 22 bp, Artificial Sequence
  chemically synthesized
ggggctttttctgtagtctgca

SEQ ID NO: 756081 - DNA, 22 bp, Artificial Sequence
  chemically synthesized
gggctttttctgtagtctgcag

SEQ ID NO: 756082 - DNA, 22 bp, Artificial Sequence
  chemically synthesized
atctcctacctaatcctgcaga

SEQ ID NO: 756083 - DNA, 22 bp, Artificial Sequence
  chemically synthesized
tcatctcctacctaatcctgca

SEQ ID NO: 756084 - DNA, 22 bp, Artificial Sequence
  chemically synthesized
tttctgtagtctgcaggattag

SEQ ID NO: 756085 - DNA, 22 bp, Artificial Sequence
  chemically synthesized
ttctgtagtctgcaggattagg

SEQ ID NO: 756086 - DNA, 22 bp, Artificial Sequence
  chemically synthesized
tctgtagtctgcaggattaggt

SEQ ID NO: 756087 - DNA, 22 bp, Artificial Sequence
  chemically synthesized
ctgtagtctgcaggattaggta

SEQ ID NO: 756088 - DNA, 22 bp, Artificial Sequence
  chemically synthesized
tgtagtctgcaggattaggtag

SEQ ID NO: 756089 - DNA, 22 bp, Artificial Sequence
  chemically synthesized
tagtctgcaggattaggtagga

SEQ ID NO: 756090 - DNA, 22 bp, Artificial Sequence
  chemically synthesized
gtgtcctctcatctcctaccta

SEQ ID NO: 756091 - DNA, 22 bp, Artificial Sequence
  chemically synthesized
tctagtgtcctctcatctccta

SEQ ID NO: 756092 - DNA, 22 bp, Artificial Sequence
  chemically synthesized
caggattaggtaggagatgaga

SEQ ID NO: 756093 - DNA, 22 bp, Artificial Sequence
  chemically synthesized
agagcctgtctagtgtcctctc

SEQ ID NO: 756094 - DNA, 22 bp, Artificial Sequence
  chemically synthesized
cagagcctgtctagtgtcctct

SEQ ID NO: 756095 - DNA, 22 bp, Artificial Sequence
  chemically synthesized
ggtaggagatgagaggacacta

SEQ ID NO: 756096 - DNA, 22 bp, Artificial Sequence
  chemically synthesized
catttcagagcctgtctagtgt

SEQ ID NO: 756097 - DNA, 22 bp, Artificial Sequence
  chemically synthesized
gatcatcctacatttcagagcc

SEQ ID NO: 756098 - DNA, 22 bp, Artificial Sequence
  chemically synthesized
ttggatcatcctacatttcaga

SEQ ID NO: 756099 - DNA, 22 bp, Artificial Sequence
  chemically synthesized
gacaggctctgaaatgtaggat

SEQ ID NO: 756100 - DNA, 22 bp, Artificial Sequence
  chemically synthesized
tgaaatgtaggatgatccaaca

SEQ ID NO: 756101 - DNA, 22 bp, Artificial Sequence
  chemically synthesized
aatgaacagaactgttggatca

SEQ ID NO: 756102 - DNA, 22 bp, Artificial Sequence
  chemically synthesized
aaatgtaggatgatccaacagt

SEQ ID NO: 756103 - DNA, 22 bp, Artificial Sequence
  chemically synthesized
ttgaatgaacagaactgttgga

SEQ ID NO: 756104 - DNA, 22 bp, Artificial Sequence
  chemically synthesized
gttgaatgaacagaactgttgg

SEQ ID NO: 756105 - DNA, 22 bp, Artificial Sequence
  chemically synthesized
ggtatccatttgttgaatgaac

SEQ ID NO: 756106 - DNA, 22 bp, Artificial Sequence
  chemically synthesized
ctcggtatccatttgttgaatg

SEQ ID NO: 756107 - DNA, 22 bp, Artificial Sequence
  chemically synthesized
tgcctgctcggtatccatttgt

SEQ ID NO: 756108 - DNA, 22 bp, Artificial Sequence
  chemically synthesized
tgttcattcaacaaatggatac

SEQ ID NO: 756109 - DNA, 22 bp, Artificial Sequence
  chemically synthesized
tatgcctgctcggtatccattt

SEQ ID NO: 756110 - DNA, 22 bp, Artificial Sequence
  chemically synthesized
ttcattcaacaaatggataccg

SEQ ID NO: 756111 - DNA, 22 bp, Artificial Sequence
  chemically synthesized
ttctatgcctgctcggtatcca

SEQ ID NO: 756112 - DNA, 22 bp, Artificial Sequence
  chemically synthesized
gttctatgcctgctcggtatcc

SEQ ID NO: 756113 - DNA, 22 bp, Artificial Sequence
  chemically synthesized
attcaacaaatggataccgagc

SEQ ID NO: 756114 - DNA, 22 bp, Artificial Sequence
  chemically synthesized
aacaaatggataccgagcaggc

SEQ ID NO: 756115 - DNA, 22 bp, Artificial Sequence
  chemically synthesized
acatcttgttctatgcctgctc

SEQ ID NO: 756116 - DNA, 22 bp, Artificial Sequence
  chemically synthesized
ttaacatcttgttctatgcctg

SEQ ID NO: 756117 - DNA, 22 bp, Artificial Sequence
  chemically synthesized
cagatatgactgttaacatctt

SEQ ID NO: 756118 - DNA, 22 bp, Artificial Sequence
  chemically synthesized
gtaaatacagatcaagttacag

SEQ ID NO: 756119 - DNA, 22 bp, Artificial Sequence
  chemically synthesized
acagtcatatctgtaacttgat

SEQ ID NO: 756120 - DNA, 22 bp, Artificial Sequence
  chemically synthesized
taacttgatctgtatttactag

SEQ ID NO: 756121 - DNA, 22 bp, Artificial Sequence
  chemically synthesized
gatctgtatttactagttttgc

SEQ ID NO: 756122 - DNA, 22 bp, Artificial Sequence
  chemically synthesized
atctgtatttactagttttgcc

SEQ ID NO: 756123 - DNA, 22 bp, Artificial Sequence
  chemically synthesized
tatttactagttttgccatcct

SEQ ID NO: 756124 - DNA, 22 bp, Artificial Sequence
  chemically synthesized
actagttttgccatcctacgtc

SEQ ID NO: 756125 - DNA, 22 bp, Artificial Sequence
  chemically synthesized
ctagttttgccatcctacgtca

SEQ ID NO: 756126 - DNA, 22 bp, Artificial Sequence
  chemically synthesized
gttttgccatcctacgtcatca

SEQ ID NO: 756127 - DNA, 22 bp, Artificial Sequence
  chemically synthesized
tgccatcctacgtcatcattct

SEQ ID NO: 756128 - DNA, 22 bp, Artificial Sequence
  chemically synthesized
gccatcctacgtcatcattctt

SEQ ID NO: 756129 - DNA, 22 bp, Artificial Sequence
  chemically synthesized
ccatcctacgtcatcattcttg

SEQ ID NO: 756130 - DNA, 22 bp, Artificial Sequence
  chemically synthesized
cgtcatcattcttgttcctgtg

SEQ ID NO: 756131 - DNA, 22 bp, Artificial Sequence
  chemically synthesized
ttgttcctgtgttatttctacc

SEQ ID NO: 756132 - DNA, 22 bp, Artificial Sequence
  chemically synthesized
gttcctgtgttatttctacctt

SEQ ID NO: 756133 - DNA, 22 bp, Artificial Sequence
  chemically synthesized
ttcctgtgttatttctacctta

SEQ ID NO: 756134 - DNA, 22 bp, Artificial Sequence
  chemically synthesized
ctgtgttatttctaccttattt

SEQ ID NO: 756135 - DNA, 22 bp, Artificial Sequence
  chemically synthesized
tgttatttctaccttatttttt

SEQ ID NO: 756136 - DNA, 22 bp, Artificial Sequence
  chemically synthesized
tttctaccttattttttatgtc

SEQ ID NO: 756137 - DNA, 22 bp, Artificial Sequence
  chemically synthesized
ctaccttattttttatgtctcc

SEQ ID NO: 756138 - DNA, 22 bp, Artificial Sequence
  chemically synthesized
taccttattttttatgtctcct

SEQ ID NO: 756139 - DNA, 22 bp, Artificial Sequence
  chemically synthesized
ccttattttttatgtctcctgt

SEQ ID NO: 756140 - DNA, 22 bp, Artificial Sequence
  chemically synthesized
attttttatgtctcctgtattg

SEQ ID NO: 756141 - DNA, 22 bp, Artificial Sequence
  chemically synthesized
ttttttatgtctcctgtattgt

SEQ ID NO: 756142 - DNA, 22 bp, Artificial Sequence
  chemically synthesized
tcagacatagaaacaatacagg

SEQ ID NO: 756143 - DNA, 22 bp, Artificial Sequence
  chemically synthesized
gtcagacatagaaacaatacag

SEQ ID NO: 756144 - DNA, 22 bp, Artificial Sequence
  chemically synthesized
tttatgtctcctgtattgtttc

SEQ ID NO: 756145 - DNA, 22 bp, Artificial Sequence
  chemically synthesized
ttgtcagacatagaaacaatac

SEQ ID NO: 756146 - DNA, 22 bp, Artificial Sequence
  chemically synthesized
ttatgtctcctgtattgtttct

SEQ ID NO: 756147 - DNA, 22 bp, Artificial Sequence
  chemically synthesized
cttgtcagacatagaaacaata

SEQ ID NO: 756148 - DNA, 22 bp, Artificial Sequence
  chemically synthesized
tatgtctcctgtattgtttcta

SEQ ID NO: 756149 - DNA, 22 bp, Artificial Sequence
  chemically synthesized
tcttgtcagacatagaaacaat

SEQ ID NO: 756150 - DNA, 22 bp, Artificial Sequence
  chemically synthesized
atgtctcctgtattgtttctat

SEQ ID NO: 756151 - DNA, 22 bp, Artificial Sequence
  chemically synthesized
tgtctcctgtattgtttctatg

SEQ ID NO: 756152 - DNA, 22 bp, Artificial Sequence
  chemically synthesized
ctgtattgtttctatgtctgac

SEQ ID NO: 756153 - DNA, 22 bp, Artificial Sequence
  chemically synthesized
agcaactttcttgtcagacata

SEQ ID NO: 756154 - DNA, 22 bp, Artificial Sequence
  chemically synthesized
tattgtttctatgtctgacaag

SEQ ID NO: 756155 - DNA, 22 bp, Artificial Sequence
  chemically synthesized
tttctatgtctgacaagaaagt

SEQ ID NO: 756156 - DNA, 22 bp, Artificial Sequence
  chemically synthesized
ctatgtctgacaagaaagttgc

SEQ ID NO: 756157 - DNA, 22 bp, Artificial Sequence
  chemically synthesized
tatgtctgacaagaaagttgct

SEQ ID NO: 756158 - DNA, 22 bp, Artificial Sequence
  chemically synthesized
tgtctgacaagaaagttgctga

SEQ ID NO: 756159 - DNA, 22 bp, Artificial Sequence
  chemically synthesized
gtgacagaatatattcagcaac

SEQ ID NO: 756160 - DNA, 22 bp, Artificial Sequence
  chemically synthesized
ggtgacagaatatattcagcaa

SEQ ID NO: 756161 - DNA, 22 bp, Artificial Sequence
  chemically synthesized
tggtgacagaatatattcagca

SEQ ID NO: 756162 - DNA, 22 bp, Artificial Sequence
  chemically synthesized
ttggtgacagaatatattcagc

SEQ ID NO: 756163 - DNA, 22 bp, Artificial Sequence
  chemically synthesized
acaagaaagttgctgaatatat

SEQ ID NO: 756164 - DNA, 22 bp, Artificial Sequence
  chemically synthesized
ctgaatatattctgtcaccaaa

SEQ ID NO: 756165 - DNA, 22 bp, Artificial Sequence
  chemically synthesized
aatatattctgtcaccaaaagg

SEQ ID NO: 756166 - DNA, 22 bp, Artificial Sequence
  chemically synthesized
aataaagaaggtccttttggtg

SEQ ID NO: 756167 - DNA, 22 bp, Artificial Sequence
  chemically synthesized
aaataaagaaggtccttttggt

SEQ ID NO: 756168 - DNA, 22 bp, Artificial Sequence
  chemically synthesized
taaataaagaaggtccttttgg

SEQ ID NO: 756169 - DNA, 22 bp, Artificial Sequence
  chemically synthesized
tttaaataaagaaggtcctttt

SEQ ID NO: 756170 - DNA, 22 bp, Artificial Sequence
  chemically synthesized
tgtcaccaaaaggaccttcttt

SEQ ID NO: 756171 - DNA, 22 bp, Artificial Sequence
  chemically synthesized
tcaccaaaaggaccttctttat

SEQ ID NO: 756172 - DNA, 22 bp, Artificial Sequence
  chemically synthesized
aataaatatggtggctctttaa

SEQ ID NO: 756173 - DNA, 22 bp, Artificial Sequence
  chemically synthesized
ctttatttaaagagccaccata

SEQ ID NO: 756174 - DNA, 22 bp, Artificial Sequence
  chemically synthesized
agactcaataaatatggtggct

SEQ ID NO: 756175 - DNA, 22 bp, Artificial Sequence
  chemically synthesized
tttatttaaagagccaccatat

SEQ ID NO: 756176 - DNA, 22 bp, Artificial Sequence
  chemically synthesized
gagactcaataaatatggtggc

SEQ ID NO: 756177 - DNA, 22 bp, Artificial Sequence
  chemically synthesized
tatttaaagagccaccatattt

SEQ ID NO: 756178 - DNA, 22 bp, Artificial Sequence
  chemically synthesized
atttaaagagccaccatattta

SEQ ID NO: 756179 - DNA, 22 bp, Artificial Sequence
  chemically synthesized
tttaaagagccaccatatttat

SEQ ID NO: 756180 - DNA, 22 bp, Artificial Sequence
  chemically synthesized
aaagagccaccatatttattga

SEQ ID NO: 756181 - DNA, 22 bp, Artificial Sequence
  chemically synthesized
tgtgtttgagactcaataaata

SEQ ID NO: 756182 - DNA, 22 bp, Artificial Sequence
  chemically synthesized
aagagccaccatatttattgag

SEQ ID NO: 756183 - DNA, 22 bp, Artificial Sequence
  chemically synthesized
atgtgtttgagactcaataaat

SEQ ID NO: 756184 - DNA, 22 bp, Artificial Sequence
  chemically synthesized
ttatgtgtttgagactcaataa

SEQ ID NO: 756185 - DNA, 22 bp, Artificial Sequence
  chemically synthesized
gtaaaatattcttatgtgtttg

SEQ ID NO: 756186 - DNA, 22 bp, Artificial Sequence
  chemically synthesized
ggtaaaatattcttatgtgttt

SEQ ID NO: 756187 - DNA, 22 bp, Artificial Sequence
  chemically synthesized
attgagtctcaaacacataaga

SEQ ID NO: 756188 - DNA, 22 bp, Artificial Sequence
  chemically synthesized
ttgagtctcaaacacataagaa

SEQ ID NO: 756189 - DNA, 22 bp, Artificial Sequence
  chemically synthesized
agtctcaaacacataagaatat

SEQ ID NO: 756190 - DNA, 22 bp, Artificial Sequence
  chemically synthesized
aaacacataagaatattttacc

SEQ ID NO: 756191 - DNA, 22 bp, Artificial Sequence
  chemically synthesized
tcccgaagtgagcatttggtaa

SEQ ID NO: 756192 - DNA, 22 bp, Artificial Sequence
  chemically synthesized
gtcccgaagtgagcatttggta

SEQ ID NO: 756193 - DNA, 22 bp, Artificial Sequence
  chemically synthesized
cttgtcccgaagtgagcatttg

SEQ ID NO: 756194 - DNA, 22 bp, Artificial Sequence
  chemically synthesized
agcattgcttgtcccgaagtga

SEQ ID NO: 756195 - DNA, 22 bp, Artificial Sequence
  chemically synthesized
taccaaatgctcacttcgggac

SEQ ID NO: 756196 - DNA, 22 bp, Artificial Sequence
  chemically synthesized
accaaatgctcacttcgggaca

SEQ ID NO: 756197 - DNA, 22 bp, Artificial Sequence
  chemically synthesized
ccaaatgctcacttcgggacaa

SEQ ID NO: 756198 - DNA, 22 bp, Artificial Sequence
  chemically synthesized
actgagcattgcttgtcccgaa

SEQ ID NO: 756199 - DNA, 22 bp, Artificial Sequence
  chemically synthesized
agttaactgagcattgcttgtc

SEQ ID NO: 756200 - DNA, 22 bp, Artificial Sequence
  chemically synthesized
aagttaactgagcattgcttgt

SEQ ID NO: 756201 - DNA, 22 bp, Artificial Sequence
  chemically synthesized
taagttaactgagcattgcttg

SEQ ID NO: 756202 - DNA, 22 bp, Artificial Sequence
  chemically synthesized
ttaagttaactgagcattgctt

SEQ ID NO: 756203 - DNA, 22 bp, Artificial Sequence
  chemically synthesized
acttcgggacaagcaatgctca

SEQ ID NO: 756204 - DNA, 22 bp, Artificial Sequence
  chemically synthesized
gcttttaagttaactgagcatt

SEQ ID NO: 756205 - DNA, 22 bp, Artificial Sequence
  chemically synthesized
cgggacaagcaatgctcagtta

SEQ ID NO: 756206 - DNA, 22 bp, Artificial Sequence
  chemically synthesized
gggacaagcaatgctcagttaa

SEQ ID NO: 756207 - DNA, 22 bp, Artificial Sequence
  chemically synthesized
caagacctcgcttttaagttaa

SEQ ID NO: 756208 - DNA, 22 bp, Artificial Sequence
  chemically synthesized
ccaagacctcgcttttaagtta

SEQ ID NO: 756209 - DNA, 22 bp, Artificial Sequence
  chemically synthesized
tccaagacctcgcttttaagtt

SEQ ID NO: 756210 - DNA, 22 bp, Artificial Sequence
  chemically synthesized
ttccaagacctcgcttttaagt

SEQ ID NO: 756211 - DNA, 22 bp, Artificial Sequence
  chemically synthesized
cccttttccaagacctcgcttt

SEQ ID NO: 756212 - DNA, 22 bp, Artificial Sequence
  chemically synthesized
gcccttttccaagacctcgctt

SEQ ID NO: 756213 - DNA, 22 bp, Artificial Sequence
  chemically synthesized
agttaacttaaaagcgaggtct

SEQ ID NO: 756214 - DNA, 22 bp, Artificial Sequence
  chemically synthesized
cttgcccttttccaagacctcg

SEQ ID NO: 756215 - DNA, 22 bp, Artificial Sequence
  chemically synthesized
acttaaaagcgaggtcttggaa

SEQ ID NO: 756216 - DNA, 22 bp, Artificial Sequence
  chemically synthesized
gattgcttgcccttttccaaga

SEQ ID NO: 756217 - DNA, 22 bp, Artificial Sequence
  chemically synthesized
aaaagcgaggtcttggaaaagg

SEQ ID NO: 756218 - DNA, 22 bp, Artificial Sequence
  chemically synthesized
aaagcgaggtcttggaaaaggg

SEQ ID NO: 756219 - DNA, 22 bp, Artificial Sequence
  chemically synthesized
ccatgtacatcctggattgctt

SEQ ID NO: 756220 - DNA, 22 bp, Artificial Sequence
  chemically synthesized
ggaaaagggcaagcaatccagg

SEQ ID NO: 756221 - DNA, 22 bp, Artificial Sequence
  chemically synthesized
gaaaagggcaagcaatccagga

SEQ ID NO: 756222 - DNA, 22 bp, Artificial Sequence
  chemically synthesized
ccaccctgccatgtacatcctg

SEQ ID NO: 756223 - DNA, 22 bp, Artificial Sequence
  chemically synthesized
gccaccctgccatgtacatcct

SEQ ID NO: 756224 - DNA, 22 bp, Artificial Sequence
  chemically synthesized
ttgccaccctgccatgtacatc

SEQ ID NO: 756225 - DNA, 22 bp, Artificial Sequence
  chemically synthesized
ggggcaatattcttgccaccct

SEQ ID NO: 756226 - DNA, 22 bp, Artificial Sequence
  chemically synthesized
ctgggggcaatattcttgccac

SEQ ID NO: 756227 - DNA, 22 bp, Artificial Sequence
  chemically synthesized
gattactgggggcaatattctt

SEQ ID NO: 756228 - DNA, 22 bp, Artificial Sequence
  chemically synthesized
agattactgggggcaatattct

SEQ ID NO: 756229 - DNA, 22 bp, Artificial Sequence
  chemically synthesized
tagattactgggggcaatattc

SEQ ID NO: 756230 - DNA, 22 bp, Artificial Sequence
  chemically synthesized
ctttagattactgggggcaata

SEQ ID NO: 756231 - DNA, 22 bp, Artificial Sequence
  chemically synthesized
gctttagattactgggggcaat

SEQ ID NO: 756232 - DNA, 22 bp, Artificial Sequence
  chemically synthesized
tgaatttgctttagattactgg

SEQ ID NO: 756233 - DNA, 22 bp, Artificial Sequence
  chemically synthesized
cccccagtaatctaaagcaaat

SEQ ID NO: 756234 - DNA, 22 bp, Artificial Sequence
  chemically synthesized
catgaacccctatgaatttgct

SEQ ID NO: 756235 - DNA, 22 bp, Artificial Sequence
  chemically synthesized
ccatgaacccctatgaatttgc

SEQ ID NO: 756236 - DNA, 22 bp, Artificial Sequence
  chemically synthesized
ttccatgaacccctatgaattt

SEQ ID NO: 756237 - DNA, 22 bp, Artificial Sequence
  chemically synthesized
cttccatgaacccctatgaatt

SEQ ID NO: 756238 - DNA, 22 bp, Artificial Sequence
  chemically synthesized
tcttccatgaacccctatgaat

SEQ ID NO: 756239 - DNA, 22 bp, Artificial Sequence
  chemically synthesized
ttcttccatgaacccctatgaa

SEQ ID NO: 756240 - DNA, 22 bp, Artificial Sequence
  chemically synthesized
tttcttccatgaacccctatga

SEQ ID NO: 756241 - DNA, 22 bp, Artificial Sequence
  chemically synthesized
ttttcttccatgaacccctatg

SEQ ID NO: 756242 - DNA, 22 bp, Artificial Sequence
  chemically synthesized
aagcaaattcataggggttcat

SEQ ID NO: 756243 - DNA, 22 bp, Artificial Sequence
  chemically synthesized
aaatttttttcttccatgaacc

SEQ ID NO: 756244 - DNA, 22 bp, Artificial Sequence
  chemically synthesized
caaatttttttcttccatgaac

SEQ ID NO: 756245 - DNA, 22 bp, Artificial Sequence
  chemically synthesized
ttcaaatttttttcttccatga

SEQ ID NO: 756246 - DNA, 22 bp, Artificial Sequence
  chemically synthesized
cttcaaatttttttcttccatg

SEQ ID NO: 756247 - DNA, 22 bp, Artificial Sequence
  chemically synthesized
tcttcaaatttttttcttccat

SEQ ID NO: 756248 - DNA, 22 bp, Artificial Sequence
  chemically synthesized
ataggggttcatggaagaaaaa

SEQ ID NO: 756249 - DNA, 22 bp, Artificial Sequence
  chemically synthesized
tttcttcaaatttttttcttcc

SEQ ID NO: 756250 - DNA, 22 bp, Artificial Sequence
  chemically synthesized
cctctttcttcaaatttttttc

SEQ ID NO: 756251 - DNA, 22 bp, Artificial Sequence
  chemically synthesized
cattgcctctttcttcaaattt

SEQ ID NO: 756252 - DNA, 22 bp, Artificial Sequence
  chemically synthesized
atggaagaaaaaaatttgaaga

SEQ ID NO: 756253 - DNA, 22 bp, Artificial Sequence
  chemically synthesized
ctccattgcctctttcttcaaa

SEQ ID NO: 756254 - DNA, 22 bp, Artificial Sequence
  chemically synthesized
gctccattgcctctttcttcaa

SEQ ID NO: 756255 - DNA, 22 bp, Artificial Sequence
  chemically synthesized
tttgctccattgcctctttctt

SEQ ID NO: 756256 - DNA, 22 bp, Artificial Sequence
  chemically synthesized
ttgtttgctccattgcctcttt

SEQ ID NO: 756257 - DNA, 22 bp, Artificial Sequence
  chemically synthesized
tgttgtttgctccattgcctct

SEQ ID NO: 756258 - DNA, 22 bp, Artificial Sequence
  chemically synthesized
ctgttgtttgctccattgcctc

SEQ ID NO: 756259 - DNA, 22 bp, Artificial Sequence
  chemically synthesized
tctgttgtttgctccattgcct

SEQ ID NO: 756260 - DNA, 22 bp, Artificial Sequence
  chemically synthesized
tttctgttgtttgctccattgc

SEQ ID NO: 756261 - DNA, 22 bp, Artificial Sequence
  chemically synthesized
gaagaaagaggcaatggagcaa

SEQ ID NO: 756262 - DNA, 22 bp, Artificial Sequence
  chemically synthesized
tctttctgttgtttgctccatt

SEQ ID NO: 756263 - DNA, 22 bp, Artificial Sequence
  chemically synthesized
aagaaagaggcaatggagcaaa

SEQ ID NO: 756264 - DNA, 22 bp, Artificial Sequence
  chemically synthesized
agggaaacctctctttctgttg

SEQ ID NO: 756265 - DNA, 22 bp, Artificial Sequence
  chemically synthesized
ttaagggaaacctctctttctg

SEQ ID NO: 756266 - DNA, 22 bp, Artificial Sequence
  chemically synthesized
aaatgactattaagggaaacct

SEQ ID NO: 756267 - DNA, 22 bp, Artificial Sequence
  chemically synthesized
tctcaaatgactattaagggaa

SEQ ID NO: 756268 - DNA, 22 bp, Artificial Sequence
  chemically synthesized
gctgtctcaaatgactattaag

SEQ ID NO: 756269 - DNA, 22 bp, Artificial Sequence
  chemically synthesized
taatactagctgtctcaaatga

SEQ ID NO: 756270 - DNA, 22 bp, Artificial Sequence
  chemically synthesized
cccttaatagtcatttgagaca

SEQ ID NO: 756271 - DNA, 22 bp, Artificial Sequence
  chemically synthesized
tgtaatactagctgtctcaaat

SEQ ID NO: 756272 - DNA, 22 bp, Artificial Sequence
  chemically synthesized
ccttaatagtcatttgagacag

SEQ ID NO: 756273 - DNA, 22 bp, Artificial Sequence
  chemically synthesized
ctgtaatactagctgtctcaaa

SEQ ID NO: 756274 - DNA, 22 bp, Artificial Sequence
  chemically synthesized
aatagtcatttgagacagctag

SEQ ID NO: 756275 - DNA, 22 bp, Artificial Sequence
  chemically synthesized
atagtcatttgagacagctagt

SEQ ID NO: 756276 - DNA, 22 bp, Artificial Sequence
  chemically synthesized
ataacttctgtaatactagctg

SEQ ID NO: 756277 - DNA, 22 bp, Artificial Sequence
  chemically synthesized
gagacagctagtattacagaag

SEQ ID NO: 756278 - DNA, 22 bp, Artificial Sequence
  chemically synthesized
agacagctagtattacagaagt

SEQ ID NO: 756279 - DNA, 22 bp, Artificial Sequence
  chemically synthesized
gtattacagaagttatgaacat

SEQ ID NO: 756280 - DNA, 22 bp, Artificial Sequence
  chemically synthesized
tagcccagatacccatgttcat

SEQ ID NO: 756281 - DNA, 22 bp, Artificial Sequence
  chemically synthesized
atagcccagatacccatgttca

SEQ ID NO: 756282 - DNA, 22 bp, Artificial Sequence
  chemically synthesized
tatagcccagatacccatgttc

SEQ ID NO: 756283 - DNA, 22 bp, Artificial Sequence
  chemically synthesized
cagaagttatgaacatgggtat

SEQ ID NO: 756284 - DNA, 22 bp, Artificial Sequence
  chemically synthesized
tttatagcccagatacccatgt

SEQ ID NO: 756285 - DNA, 22 bp, Artificial Sequence
  chemically synthesized
ctttatagcccagatacccatg

SEQ ID NO: 756286 - DNA, 22 bp, Artificial Sequence
  chemically synthesized
tctttatagcccagatacccat

SEQ ID NO: 756287 - DNA, 22 bp, Artificial Sequence
  chemically synthesized
ttctttatagcccagataccca

SEQ ID NO: 756288 - DNA, 22 bp, Artificial Sequence
  chemically synthesized
tgaacatgggtatctgggctat

SEQ ID NO: 756289 - DNA, 22 bp, Artificial Sequence
  chemically synthesized
tggccttttctttatagcccag

SEQ ID NO: 756290 - DNA, 22 bp, Artificial Sequence
  chemically synthesized
ggctataaagaaaaggccataa

SEQ ID NO: 756291 - DNA, 22 bp, Artificial Sequence
  chemically synthesized
aataagaaaagatgattatggc

SEQ ID NO: 756292 - DNA, 22 bp, Artificial Sequence
  chemically synthesized
taaagaaaaggccataatcatc

SEQ ID NO: 756293 - DNA, 22 bp, Artificial Sequence
  chemically synthesized
tctcaataagaaaagatgatta

SEQ ID NO: 756294 - DNA, 22 bp, Artificial Sequence
  chemically synthesized
atctcaataagaaaagatgatt

SEQ ID NO: 756295 - DNA, 22 bp, Artificial Sequence
  chemically synthesized
ttatctcaataagaaaagatga

SEQ ID NO: 756296 - DNA, 22 bp, Artificial Sequence
  chemically synthesized
agtgttcttatctcaataagaa

SEQ ID NO: 756297 - DNA, 22 bp, Artificial Sequence
  chemically synthesized
atattaagtgttcttatctcaa

SEQ ID NO: 756298 - DNA, 22 bp, Artificial Sequence
  chemically synthesized
ttcttattgagataagaacact

SEQ ID NO: 756299 - DNA, 22 bp, Artificial Sequence
  chemically synthesized
tcttattgagataagaacactt

SEQ ID NO: 756300 - DNA, 22 bp, Artificial Sequence
  chemically synthesized
cttattgagataagaacactta

SEQ ID NO: 756301 - DNA, 22 bp, Artificial Sequence
  chemically synthesized
ttattgagataagaacacttaa

SEQ ID NO: 756302 - DNA, 22 bp, Artificial Sequence
  chemically synthesized
attgagataagaacacttaata

SEQ ID NO: 756303 - DNA, 22 bp, Artificial Sequence
  chemically synthesized
ttgagataagaacacttaatat

SEQ ID NO: 756304 - DNA, 22 bp, Artificial Sequence
  chemically synthesized
acagggtaaagttcatattaag

SEQ ID NO: 756305 - DNA, 22 bp, Artificial Sequence
  chemically synthesized
agataagaacacttaatatgaa

SEQ ID NO: 756306 - DNA, 22 bp, Artificial Sequence
  chemically synthesized
aatatgaactttaccctgttaa

SEQ ID NO: 756307 - DNA, 22 bp, Artificial Sequence
  chemically synthesized
atatgaactttaccctgttaac

SEQ ID NO: 756308 - DNA, 22 bp, Artificial Sequence
  chemically synthesized
aaaaaaaaaaaaaaatgtgtta

SEQ ID NO: 756309 - DNA, 22 bp, Artificial Sequence
  chemically synthesized
taccctgttaacacattttttt

SEQ ID NO: 756310 - DNA, 22 bp, Artificial Sequence
  chemically synthesized
accctgttaacacatttttttt

SEQ ID NO: 756311 - DNA, 22 bp, Artificial Sequence
  chemically synthesized
ccctgttaacacattttttttt

SEQ ID NO: 756312 - DNA, 22 bp, Artificial Sequence
  chemically synthesized
cgtctcaaaaaaaaaaaaaaat

SEQ ID NO: 756313 - DNA, 22 bp, Artificial Sequence
  chemically synthesized
ttaacacatttttttttttttt

SEQ ID NO: 756314 - DNA, 22 bp, Artificial Sequence
  chemically synthesized
acacatttttttttttttttga

SEQ ID NO: 756315 - DNA, 22 bp, Artificial Sequence
  chemically synthesized
ttttttttttttgagacggagt

SEQ ID NO: 756316 - DNA, 22 bp, Artificial Sequence
  chemically synthesized
tttttttttttgagacggagtc

SEQ ID NO: 756317 - DNA, 22 bp, Artificial Sequence
  chemically synthesized
ttttttttttgagacggagtct

SEQ ID NO: 756318 - DNA, 22 bp, Artificial Sequence
  chemically synthesized
agtgacagagcgagactccgtc

SEQ ID NO: 756319 - DNA, 22 bp, Artificial Sequence
  chemically synthesized
tttttttttgagacggagtctc

SEQ ID NO: 756320 - DNA, 22 bp, Artificial Sequence
  chemically synthesized
ttttttttgagacggagtctcg

SEQ ID NO: 756321 - DNA, 22 bp, Artificial Sequence
  chemically synthesized
tttttttgagacggagtctcgc

SEQ ID NO: 756322 - DNA, 22 bp, Artificial Sequence
  chemically synthesized
ttttttgagacggagtctcgct

SEQ ID NO: 756323 - DNA, 22 bp, Artificial Sequence
  chemically synthesized
tttttgagacggagtctcgctc

SEQ ID NO: 756324 - DNA, 22 bp, Artificial Sequence
  chemically synthesized
ttttgagacggagtctcgctct

SEQ ID NO: 756325 - DNA, 22 bp, Artificial Sequence
  chemically synthesized
tttgagacggagtctcgctctg

SEQ ID NO: 756326 - DNA, 22 bp, Artificial Sequence
  chemically synthesized
cagcctgagtgacagagcgaga

SEQ ID NO: 756327 - DNA, 22 bp, Artificial Sequence
  chemically synthesized
ttgagacggagtctcgctctgt

SEQ ID NO: 756328 - DNA, 22 bp, Artificial Sequence
  chemically synthesized
tgagacggagtctcgctctgtc

SEQ ID NO: 756329 - DNA, 22 bp, Artificial Sequence
  chemically synthesized
gagacggagtctcgctctgtca

SEQ ID NO: 756330 - DNA, 22 bp, Artificial Sequence
  chemically synthesized
agacggagtctcgctctgtcac

SEQ ID NO: 756331 - DNA, 22 bp, Artificial Sequence
  chemically synthesized
cactccagcctgagtgacagag

SEQ ID NO: 756332 - DNA, 22 bp, Artificial Sequence
  chemically synthesized
gctctgtcactcaggctggagt

SEQ ID NO: 756333 - DNA, 22 bp, Artificial Sequence
  chemically synthesized
tgtcactcaggctggagtgcag

SEQ ID NO: 756334 - DNA, 22 bp, Artificial Sequence
  chemically synthesized
tcactcaggctggagtgcagtg

SEQ ID NO: 756335 - DNA, 22 bp, Artificial Sequence
  chemically synthesized
aggctggagtgcagtggtgcgc

SEQ ID NO: 756336 - DNA, 22 bp, Artificial Sequence
  chemically synthesized
cagtgagccgagatcgcgcacc

SEQ ID NO: 756337 - DNA, 22 bp, Artificial Sequence
  chemically synthesized
gcagtgagccgagatcgcgcac

SEQ ID NO: 756338 - DNA, 22 bp, Artificial Sequence
  chemically synthesized
gagtgcagtggtgcgcgatctc

SEQ ID NO: 756339 - DNA, 22 bp, Artificial Sequence
  chemically synthesized
ggagacggagcttgcagtgagc

SEQ ID NO: 756340 - DNA, 22 bp, Artificial Sequence
  chemically synthesized
ggctcactgcaagctccgtctc

SEQ ID NO: 756341 - DNA, 22 bp, Artificial Sequence
  chemically synthesized
actgcaagctccgtctcccagg

SEQ ID NO: 756342 - DNA, 22 bp, Artificial Sequence
  chemically synthesized
caagctccgtctcccaggttca

SEQ ID NO: 756343 - DNA, 22 bp, Artificial Sequence
  chemically synthesized
aggcaggagaatggcgtgaacc

SEQ ID NO: 756344 - DNA, 22 bp, Artificial Sequence
  chemically synthesized
cgtctcccaggttcacgccatt

SEQ ID NO: 756345 - DNA, 22 bp, Artificial Sequence
  chemically synthesized
ccaggttcacgccattctcctg

SEQ ID NO: 756346 - DNA, 22 bp, Artificial Sequence
  chemically synthesized
gggaggctgaggcaggagaatg

SEQ ID NO: 756347 - DNA, 22 bp, Artificial Sequence
  chemically synthesized
ctcgggaggctgaggcaggaga

SEQ ID NO: 756348 - DNA, 22 bp, Artificial Sequence
  chemically synthesized
acgccattctcctgcctcagcc

SEQ ID NO: 756349 - DNA, 22 bp, Artificial Sequence
  chemically synthesized
tagtcccagctactcgggaggc

SEQ ID NO: 756350 - DNA, 22 bp, Artificial Sequence
  chemically synthesized
tcctgcctcagcctcccgagta

SEQ ID NO: 756351 - DNA, 22 bp, Artificial Sequence
  chemically synthesized
ctgcctcagcctcccgagtagc

SEQ ID NO: 756352 - DNA, 22 bp, Artificial Sequence
  chemically synthesized
cctcagcctcccgagtagctgg

SEQ ID NO: 756353 - DNA, 22 bp, Artificial Sequence
  chemically synthesized
agcctcccgagtagctgggact

SEQ ID NO: 756354 - DNA, 22 bp, Artificial Sequence
  chemically synthesized
ccgagtagctgggactacaggt

SEQ ID NO: 756355 - DNA, 22 bp, Artificial Sequence
  chemically synthesized
gccgggcatggtagcaggcacc

SEQ ID NO: 756356 - DNA, 22 bp, Artificial Sequence
  chemically synthesized
ggactacaggtgcctgctacca

SEQ ID NO: 756357 - DNA, 22 bp, Artificial Sequence
  chemically synthesized
caggtgcctgctaccatgcccg

SEQ ID NO: 756358 - DNA, 22 bp, Artificial Sequence
  chemically synthesized
ctaccatgcccggctaattttt

SEQ ID NO: 756359 - DNA, 22 bp, Artificial Sequence
  chemically synthesized
ccatgcccggctaattttttct

SEQ ID NO: 756360 - DNA, 22 bp, Artificial Sequence
  chemically synthesized
aaaatacaaaaaaagaaaaaat

SEQ ID NO: 756361 - DNA, 22 bp, Artificial Sequence
  chemically synthesized
ctaaaaatacaaaaaaagaaaa

SEQ ID NO: 756362 - DNA, 22 bp, Artificial Sequence
  chemically synthesized
tactaaaaatacaaaaaaagaa

SEQ ID NO: 756363 - DNA, 22 bp, Artificial Sequence
  chemically synthesized
attttttctttttttgtatttt

SEQ ID NO: 756364 - DNA, 22 bp, Artificial Sequence
  chemically synthesized
tttctttttttgtatttttagt

SEQ ID NO: 756365 - DNA, 22 bp, Artificial Sequence
  chemically synthesized
ttctttttttgtatttttagta

SEQ ID NO: 756366 - DNA, 22 bp, Artificial Sequence
  chemically synthesized
tctttttttgtatttttagtag

SEQ ID NO: 756367 - DNA, 22 bp, Artificial Sequence
  chemically synthesized
ctttttttgtatttttagtaga

SEQ ID NO: 756368 - DNA, 22 bp, Artificial Sequence
  chemically synthesized
tttttttgtatttttagtagag

SEQ ID NO: 756369 - DNA, 22 bp, Artificial Sequence
  chemically synthesized
tttttgtatttttagtagagat

SEQ ID NO: 756370 - DNA, 22 bp, Artificial Sequence
  chemically synthesized
ttttgtatttttagtagagatg

SEQ ID NO: 756371 - DNA, 22 bp, Artificial Sequence
  chemically synthesized
tttgtatttttagtagagatgg

SEQ ID NO: 756372 - DNA, 22 bp, Artificial Sequence
  chemically synthesized
ttgtatttttagtagagatggg

SEQ ID NO: 756373 - DNA, 22 bp, Artificial Sequence
  chemically synthesized
acacggtgaaaccccatctcta

SEQ ID NO: 756374 - DNA, 22 bp, Artificial Sequence
  chemically synthesized
tgtatttttagtagagatgggg

SEQ ID NO: 756375 - DNA, 22 bp, Artificial Sequence
  chemically synthesized
gtatttttagtagagatggggt

SEQ ID NO: 756376 - DNA, 22 bp, Artificial Sequence
  chemically synthesized
tatttttagtagagatggggtt

SEQ ID NO: 756377 - DNA, 22 bp, Artificial Sequence
  chemically synthesized
gctaacacggtgaaaccccatc

SEQ ID NO: 756378 - DNA, 22 bp, Artificial Sequence
  chemically synthesized
ttagtagagatggggtttcacc

SEQ ID NO: 756379 - DNA, 22 bp, Artificial Sequence
  chemically synthesized
tagtagagatggggtttcaccg

SEQ ID NO: 756380 - DNA, 22 bp, Artificial Sequence
  chemically synthesized
agtagagatggggtttcaccgt

SEQ ID NO: 756381 - DNA, 22 bp, Artificial Sequence
  chemically synthesized
gtagagatggggtttcaccgtg

SEQ ID NO: 756382 - DNA, 22 bp, Artificial Sequence
  chemically synthesized
caccgtgttagccaggatggtc

SEQ ID NO: 756383 - DNA, 22 bp, Artificial Sequence
  chemically synthesized
accgtgttagccaggatggtct

SEQ ID NO: 756384 - DNA, 22 bp, Artificial Sequence
  chemically synthesized
accgaggtccggagatcaagac

SEQ ID NO: 756385 - DNA, 22 bp, Artificial Sequence
  chemically synthesized
gccaggatggtcttgatctccg

SEQ ID NO: 756386 - DNA, 22 bp, Artificial Sequence
  chemically synthesized
aaaatgtgttaaccgaggtccg

SEQ ID NO: 756387 - DNA, 22 bp, Artificial Sequence
  chemically synthesized
aaaaatgtgttaaccgaggtcc

SEQ ID NO: 756388 - DNA, 22 bp, Artificial Sequence
  chemically synthesized
gatctccggacctcggttaaca

SEQ ID NO: 756389 - DNA, 22 bp, Artificial Sequence
  chemically synthesized
atctccggacctcggttaacac

SEQ ID NO: 756390 - DNA, 22 bp, Artificial Sequence
  chemically synthesized
tgcacttaaaaatgtgttaacc

SEQ ID NO: 756391 - DNA, 22 bp, Artificial Sequence
  chemically synthesized
gtgcacttaaaaatgtgttaac

SEQ ID NO: 756392 - DNA, 22 bp, Artificial Sequence
  chemically synthesized
cggacctcggttaacacatttt

SEQ ID NO: 756393 - DNA, 22 bp, Artificial Sequence
  chemically synthesized
ggttaacacatttttaagtgca

SEQ ID NO: 756394 - DNA, 22 bp, Artificial Sequence
  chemically synthesized
acaataccgatttgtgcactta

SEQ ID NO: 756395 - DNA, 22 bp, Artificial Sequence
  chemically synthesized
acacatttttaagtgcacaaat

SEQ ID NO: 756396 - DNA, 22 bp, Artificial Sequence
  chemically synthesized
tagttaacaataccgatttgtg

SEQ ID NO: 756397 - DNA, 22 bp, Artificial Sequence
  chemically synthesized
ttaagtgcacaaatcggtattg

SEQ ID NO: 756398 - DNA, 22 bp, Artificial Sequence
  chemically synthesized
taagtgcacaaatcggtattgt

SEQ ID NO: 756399 - DNA, 22 bp, Artificial Sequence
  chemically synthesized
tgcctatagttaacaataccga

SEQ ID NO: 756400 - DNA, 22 bp, Artificial Sequence
  chemically synthesized
aagtgcacaaatcggtattgtt

SEQ ID NO: 756401 - DNA, 22 bp, Artificial Sequence
  chemically synthesized
agtgcacaaatcggtattgtta

SEQ ID NO: 756402 - DNA, 22 bp, Artificial Sequence
  chemically synthesized
cataacattgtgcctatagtta

SEQ ID NO: 756403 - DNA, 22 bp, Artificial Sequence
  chemically synthesized
ctgcataacattgtgcctatag

SEQ ID NO: 756404 - DNA, 22 bp, Artificial Sequence
  chemically synthesized
ttaactataggcacaatgttat

SEQ ID NO: 756405 - DNA, 22 bp, Artificial Sequence
  chemically synthesized
gaggtctgctgcataacattgt

SEQ ID NO: 756406 - DNA, 22 bp, Artificial Sequence
  chemically synthesized
tagaggtctgctgcataacatt

SEQ ID NO: 756407 - DNA, 22 bp, Artificial Sequence
  chemically synthesized
actataggcacaatgttatgca

SEQ ID NO: 756408 - DNA, 22 bp, Artificial Sequence
  chemically synthesized
taggcacaatgttatgcagcag

SEQ ID NO: 756409 - DNA, 22 bp, Artificial Sequence
  chemically synthesized
tgcaagatgaaaaagttctaga

SEQ ID NO: 756410 - DNA, 22 bp, Artificial Sequence
  chemically synthesized
tgcagcagacctctagaacttt

SEQ ID NO: 756411 - DNA, 22 bp, Artificial Sequence
  chemically synthesized
agttatgcaagatgaaaaagtt

SEQ ID NO: 756412 - DNA, 22 bp, Artificial Sequence
  chemically synthesized
cagttatgcaagatgaaaaagt

SEQ ID NO: 756413 - DNA, 22 bp, Artificial Sequence
  chemically synthesized
tagaactttttcatcttgcata

SEQ ID NO: 756414 - DNA, 22 bp, Artificial Sequence
  chemically synthesized
gaactttttcatcttgcataac

SEQ ID NO: 756415 - DNA, 22 bp, Artificial Sequence
  chemically synthesized
tttcatcttgcataactgaaac

SEQ ID NO: 756416 - DNA, 22 bp, Artificial Sequence
  chemically synthesized
aatggatataaagtttcagtta

SEQ ID NO: 756417 - DNA, 22 bp, Artificial Sequence
  chemically synthesized
ttcatcttgcataactgaaact

SEQ ID NO: 756418 - DNA, 22 bp, Artificial Sequence
  chemically synthesized
tcatcttgcataactgaaactt

SEQ ID NO: 756419 - DNA, 22 bp, Artificial Sequence
  chemically synthesized
catcttgcataactgaaacttt

SEQ ID NO: 756420 - DNA, 22 bp, Artificial Sequence
  chemically synthesized
ctcaatggatataaagtttcag

SEQ ID NO: 756421 - DNA, 22 bp, Artificial Sequence
  chemically synthesized
atcttgcataactgaaacttta

SEQ ID NO: 756422 - DNA, 22 bp, Artificial Sequence
  chemically synthesized
ttgctcaatggatataaagttt

SEQ ID NO: 756423 - DNA, 22 bp, Artificial Sequence
  chemically synthesized
gcataactgaaactttatatcc

SEQ ID NO: 756424 - DNA, 22 bp, Artificial Sequence
  chemically synthesized
cataactgaaactttatatcca

SEQ ID NO: 756425 - DNA, 22 bp, Artificial Sequence
  chemically synthesized
aaactttatatccattgagcaa

SEQ ID NO: 756426 - DNA, 22 bp, Artificial Sequence
  chemically synthesized
taagggcgagttgttgctcaat

SEQ ID NO: 756427 - DNA, 22 bp, Artificial Sequence
  chemically synthesized
tatatccattgagcaacaactc

SEQ ID NO: 756428 - DNA, 22 bp, Artificial Sequence
  chemically synthesized
atatccattgagcaacaactcg

SEQ ID NO: 756429 - DNA, 22 bp, Artificial Sequence
  chemically synthesized
tatccattgagcaacaactcgc

SEQ ID NO: 756430 - DNA, 22 bp, Artificial Sequence
  chemically synthesized
ccatacattgtaagggcgagtt

SEQ ID NO: 756431 - DNA, 22 bp, Artificial Sequence
  chemically synthesized
agcaacaactcgcccttacaat

SEQ ID NO: 756432 - DNA, 22 bp, Artificial Sequence
  chemically synthesized
gcccttacaatgtatggcaacc

SEQ ID NO: 756433 - DNA, 22 bp, Artificial Sequence
  chemically synthesized
acaatgtatggcaaccattttt

SEQ ID NO: 756434 - DNA, 22 bp, Artificial Sequence
  chemically synthesized
caatgtatggcaaccatttttc

SEQ ID NO: 756435 - DNA, 22 bp, Artificial Sequence
  chemically synthesized
atagaagcagagagtagaaaaa

SEQ ID NO: 756436 - DNA, 22 bp, Artificial Sequence
  chemically synthesized
gtcaaactcatagaagcagaga

SEQ ID NO: 756437 - DNA, 22 bp, Artificial Sequence
  chemically synthesized
agtcaaactcatagaagcagag

SEQ ID NO: 756438 - DNA, 22 bp, Artificial Sequence
  chemically synthesized
tttagtcaaactcatagaagca

SEQ ID NO: 756439 - DNA, 22 bp, Artificial Sequence
  chemically synthesized
ttctactctctgcttctatgag

SEQ ID NO: 756440 - DNA, 22 bp, Artificial Sequence
  chemically synthesized
tctactctctgcttctatgagt

SEQ ID NO: 756441 - DNA, 22 bp, Artificial Sequence
  chemically synthesized
ctactctctgcttctatgagtt

SEQ ID NO: 756442 - DNA, 22 bp, Artificial Sequence
  chemically synthesized
tactctctgcttctatgagttt

SEQ ID NO: 756443 - DNA, 22 bp, Artificial Sequence
  chemically synthesized
ctctctgcttctatgagtttga

SEQ ID NO: 756444 - DNA, 22 bp, Artificial Sequence
  chemically synthesized
gatgattatttagtcaaactca

SEQ ID NO: 756445 - DNA, 22 bp, Artificial Sequence
  chemically synthesized
agatgattatttagtcaaactc

SEQ ID NO: 756446 - DNA, 22 bp, Artificial Sequence
  chemically synthesized
tctgcttctatgagtttgacta

SEQ ID NO: 756447 - DNA, 22 bp, Artificial Sequence
  chemically synthesized
tgcttctatgagtttgactaaa

SEQ ID NO: 756448 - DNA, 22 bp, Artificial Sequence
  chemically synthesized
tttagatgattatttagtcaaa

SEQ ID NO: 756449 - DNA, 22 bp, Artificial Sequence
  chemically synthesized
atttagatgattatttagtcaa

SEQ ID NO: 756450 - DNA, 22 bp, Artificial Sequence
  chemically synthesized
cttctatgagtttgactaaata

SEQ ID NO: 756451 - DNA, 22 bp, Artificial Sequence
  chemically synthesized
ctatgagtttgactaaataatc

SEQ ID NO: 756452 - DNA, 22 bp, Artificial Sequence
  chemically synthesized
tatgagtttgactaaataatca

SEQ ID NO: 756453 - DNA, 22 bp, Artificial Sequence
  chemically synthesized
tgagtttgactaaataatcatc

SEQ ID NO: 756454 - DNA, 22 bp, Artificial Sequence
  chemically synthesized
tcatcttatttagatgattatt

SEQ ID NO: 756455 - DNA, 22 bp, Artificial Sequence
  chemically synthesized
gtcatcttatttagatgattat

SEQ ID NO: 756456 - DNA, 22 bp, Artificial Sequence
  chemically synthesized
tgtcatcttatttagatgatta

SEQ ID NO: 756457 - DNA, 22 bp, Artificial Sequence
  chemically synthesized
ttgtcatcttatttagatgatt

SEQ ID NO: 756458 - DNA, 22 bp, Artificial Sequence
  chemically synthesized
tttgtcatcttatttagatgat

SEQ ID NO: 756459 - DNA, 22 bp, Artificial Sequence
  chemically synthesized
gactaaataatcatctaaataa

SEQ ID NO: 756460 - DNA, 22 bp, Artificial Sequence
  chemically synthesized
actaaataatcatctaaataag

SEQ ID NO: 756461 - DNA, 22 bp, Artificial Sequence
  chemically synthesized
aataatcatctaaataagatga

SEQ ID NO: 756462 - DNA, 22 bp, Artificial Sequence
  chemically synthesized
aataagatgacaaaaagctccg

SEQ ID NO: 756463 - DNA, 22 bp, Artificial Sequence
  chemically synthesized
agaagtggagtgaaaataaggc

SEQ ID NO: 756464 - DNA, 22 bp, Artificial Sequence
  chemically synthesized
ttcagaagtggagtgaaaataa

SEQ ID NO: 756465 - DNA, 22 bp, Artificial Sequence
  chemically synthesized
attcagaagtggagtgaaaata

SEQ ID NO: 756466 - DNA, 22 bp, Artificial Sequence
  chemically synthesized
tattcagaagtggagtgaaaat

SEQ ID NO: 756467 - DNA, 22 bp, Artificial Sequence
  chemically synthesized
ttattcagaagtggagtgaaaa

SEQ ID NO: 756468 - DNA, 22 bp, Artificial Sequence
  chemically synthesized
acttttattcagaagtggagtg

SEQ ID NO: 756469 - DNA, 22 bp, Artificial Sequence
  chemically synthesized
cgccttattttcactccacttc

SEQ ID NO: 756470 - DNA, 22 bp, Artificial Sequence
  chemically synthesized
cacttttattcagaagtggagt

SEQ ID NO: 756471 - DNA, 22 bp, Artificial Sequence
  chemically synthesized
tcttcacttttattcagaagtg

SEQ ID NO: 756472 - DNA, 22 bp, Artificial Sequence
  chemically synthesized
atcttcacttttattcagaagt

SEQ ID NO: 756473 - DNA, 22 bp, Artificial Sequence
  chemically synthesized
attttcactccacttctgaata

SEQ ID NO: 756474 - DNA, 22 bp, Artificial Sequence
  chemically synthesized
ttttcactccacttctgaataa

SEQ ID NO: 756475 - DNA, 22 bp, Artificial Sequence
  chemically synthesized
tcactccacttctgaataaaag

SEQ ID NO: 756476 - DNA, 22 bp, Artificial Sequence
  chemically synthesized
cactccacttctgaataaaagt

SEQ ID NO: 756477 - DNA, 22 bp, Artificial Sequence
  chemically synthesized
actccacttctgaataaaagtg

SEQ ID NO: 756478 - DNA, 22 bp, Artificial Sequence
  chemically synthesized
aatcccttatcttcacttttat

SEQ ID NO: 756479 - DNA, 22 bp, Artificial Sequence
  chemically synthesized
caatcccttatcttcactttta

SEQ ID NO: 756480 - DNA, 22 bp, Artificial Sequence
  chemically synthesized
cacttctgaataaaagtgaaga

SEQ ID NO: 756481 - DNA, 22 bp, Artificial Sequence
  chemically synthesized
atacttcaatcccttatcttca

SEQ ID NO: 756482 - DNA, 22 bp, Artificial Sequence
  chemically synthesized
ctgaataaaagtgaagataagg

SEQ ID NO: 756483 - DNA, 22 bp, Artificial Sequence
  chemically synthesized
tgaataaaagtgaagataaggg

SEQ ID NO: 756484 - DNA, 22 bp, Artificial Sequence
  chemically synthesized
aataaaagtgaagataagggat

SEQ ID NO: 756485 - DNA, 22 bp, Artificial Sequence
  chemically synthesized
aaacaatgaatggatgtatctg

SEQ ID NO: 756486 - DNA, 22 bp, Artificial Sequence
  chemically synthesized
tctgaaacaatgaatggatgta

SEQ ID NO: 756487 - DNA, 22 bp, Artificial Sequence
  chemically synthesized
aagtatcagatacatccattca

SEQ ID NO: 756488 - DNA, 22 bp, Artificial Sequence
  chemically synthesized
actatctgaaacaatgaatgga

SEQ ID NO: 756489 - DNA, 22 bp, Artificial Sequence
  chemically synthesized
ttgactatctgaaacaatgaat

SEQ ID NO: 756490 - DNA, 22 bp, Artificial Sequence
  chemically synthesized
atgttgttgactatctgaaaca

SEQ ID NO: 756491 - DNA, 22 bp, Artificial Sequence
  chemically synthesized
ttcatgttgttgactatctgaa

SEQ ID NO: 756492 - DNA, 22 bp, Artificial Sequence
  chemically synthesized
ttgttcatgttgttgactatct

SEQ ID NO: 756493 - DNA, 22 bp, Artificial Sequence
  chemically synthesized
attgtttcagatagtcaacaac

SEQ ID NO: 756494 - DNA, 22 bp, Artificial Sequence
  chemically synthesized
atattgttgttcatgttgttga

SEQ ID NO: 756495 - DNA, 22 bp, Artificial Sequence
  chemically synthesized
tttcagatagtcaacaacatga

SEQ ID NO: 756496 - DNA, 22 bp, Artificial Sequence
  chemically synthesized
cagatagtcaacaacatgaaca

SEQ ID NO: 756497 - DNA, 22 bp, Artificial Sequence
  chemically synthesized
agatagtcaacaacatgaacaa

SEQ ID NO: 756498 - DNA, 22 bp, Artificial Sequence
  chemically synthesized
taaattaatattgttgttcatg

SEQ ID NO: 756499 - DNA, 22 bp, Artificial Sequence
  chemically synthesized
ataaattaatattgttgttcat

SEQ ID NO: 756500 - DNA, 22 bp, Artificial Sequence
  chemically synthesized
atttataaattaatattgttgt

SEQ ID NO: 756501 - DNA, 22 bp, Artificial Sequence
  chemically synthesized
aatctcatttataaattaatat

SEQ ID NO: 756502 - DNA, 22 bp, Artificial Sequence
  chemically synthesized
ttcaatctcatttataaattaa

SEQ ID NO: 756503 - DNA, 22 bp, Artificial Sequence
  chemically synthesized
attcaatctcatttataaatta

SEQ ID NO: 756504 - DNA, 22 bp, Artificial Sequence
  chemically synthesized
catcaaatttattcaatctcat

SEQ ID NO: 756505 - DNA, 22 bp, Artificial Sequence
  chemically synthesized
acatcaaatttattcaatctca

SEQ ID NO: 756506 - DNA, 22 bp, Artificial Sequence
  chemically synthesized
tacatcaaatttattcaatctc

SEQ ID NO: 756507 - DNA, 22 bp, Artificial Sequence
  chemically synthesized
atttataaatgagattgaataa

SEQ ID NO: 756508 - DNA, 22 bp, Artificial Sequence
  chemically synthesized
aattttacatcaaatttattca

SEQ ID NO: 756509 - DNA, 22 bp, Artificial Sequence
  chemically synthesized
ataaatgagattgaataaattt

SEQ ID NO: 756510 - DNA, 22 bp, Artificial Sequence
  chemically synthesized
caattttacatcaaatttattc

SEQ ID NO: 756511 - DNA, 22 bp, Artificial Sequence
  chemically synthesized
taaatgagattgaataaatttg

SEQ ID NO: 756512 - DNA, 22 bp, Artificial Sequence
  chemically synthesized
tcaattttacatcaaatttatt

SEQ ID NO: 756513 - DNA, 22 bp, Artificial Sequence
  chemically synthesized
ttcaattttacatcaaatttat

SEQ ID NO: 756514 - DNA, 22 bp, Artificial Sequence
  chemically synthesized
cttttcaattttacatcaaatt

SEQ ID NO: 756515 - DNA, 22 bp, Artificial Sequence
  chemically synthesized
acttttcaattttacatcaaat

SEQ ID NO: 756516 - DNA, 22 bp, Artificial Sequence
  chemically synthesized
atttacttttcaattttacatc

SEQ ID NO: 756517 - DNA, 22 bp, Artificial Sequence
  chemically synthesized
aataaatttgatgtaaaattga

SEQ ID NO: 756518 - DNA, 22 bp, Artificial Sequence
  chemically synthesized
aaatatgttcatttacttttca

SEQ ID NO: 756519 - DNA, 22 bp, Artificial Sequence
  chemically synthesized
gatgtaaaattgaaaagtaaat

SEQ ID NO: 756520 - DNA, 22 bp, Artificial Sequence
  chemically synthesized
atgtaaaattgaaaagtaaatg

SEQ ID NO: 756521 - DNA, 22 bp, Artificial Sequence
  chemically synthesized
aggcctgaaatatgttcattta

SEQ ID NO: 756522 - DNA, 22 bp, Artificial Sequence
  chemically synthesized
caggcctgaaatatgttcattt

SEQ ID NO: 756523 - DNA, 22 bp, Artificial Sequence
  chemically synthesized
aaaagtaaatgaacatatttca

SEQ ID NO: 756524 - DNA, 22 bp, Artificial Sequence
  chemically synthesized
aaaaaaaaacataatttcaggc

SEQ ID NO: 756525 - DNA, 22 bp, Artificial Sequence
  chemically synthesized
aaaaaaaaaacataatttcagg

SEQ ID NO: 756526 - DNA, 22 bp, Artificial Sequence
  chemically synthesized
taaaaaaaaaacataatttcag

SEQ ID NO: 756527 - DNA, 22 bp, Artificial Sequence
  chemically synthesized
ttaaaaaaaaaacataatttca

SEQ ID NO: 756528 - DNA, 22 bp, Artificial Sequence
  chemically synthesized
gatttttaaaaaaaaaacataa

SEQ ID NO: 756529 - DNA, 22 bp, Artificial Sequence
  chemically synthesized
caggcctgaaattatgtttttt

SEQ ID NO: 756530 - DNA, 22 bp, Artificial Sequence
  chemically synthesized
aggcctgaaattatgttttttt

SEQ ID NO: 756531 - DNA, 22 bp, Artificial Sequence
  chemically synthesized
taattagatttttaaaaaaaaa

SEQ ID NO: 756532 - DNA, 22 bp, Artificial Sequence
  chemically synthesized
aaattatgttttttttttaaaa

SEQ ID NO: 756533 - DNA, 22 bp, Artificial Sequence
  chemically synthesized
actataattagatttttaaaaa

SEQ ID NO: 756534 - DNA, 22 bp, Artificial Sequence
  chemically synthesized
attgactataattagattttta

SEQ ID NO: 756535 - DNA, 22 bp, Artificial Sequence
  chemically synthesized
tgttttttttttaaaaatctaa

SEQ ID NO: 756536 - DNA, 22 bp, Artificial Sequence
  chemically synthesized
cattgactataattagattttt

SEQ ID NO: 756537 - DNA, 22 bp, Artificial Sequence
  chemically synthesized
tcattgactataattagatttt

SEQ ID NO: 756538 - DNA, 22 bp, Artificial Sequence
  chemically synthesized
ttcattgactataattagattt

SEQ ID NO: 756539 - DNA, 22 bp, Artificial Sequence
  chemically synthesized
tttcattgactataattagatt

SEQ ID NO: 756540 - DNA, 22 bp, Artificial Sequence
  chemically synthesized
tttttttaaaaatctaattata

SEQ ID NO: 756541 - DNA, 22 bp, Artificial Sequence
  chemically synthesized
ttttttaaaaatctaattatag

SEQ ID NO: 756542 - DNA, 22 bp, Artificial Sequence
  chemically synthesized
tttttaaaaatctaattatagt

SEQ ID NO: 756543 - DNA, 22 bp, Artificial Sequence
  chemically synthesized
ttttaaaaatctaattatagtc

SEQ ID NO: 756544 - DNA, 22 bp, Artificial Sequence
  chemically synthesized
tttaaaaatctaattatagtca

SEQ ID NO: 756545 - DNA, 22 bp, Artificial Sequence
  chemically synthesized
ttaaaaatctaattatagtcaa

SEQ ID NO: 756546 - DNA, 22 bp, Artificial Sequence
  chemically synthesized
taaaaatctaattatagtcaat

SEQ ID NO: 756547 - DNA, 22 bp, Artificial Sequence
  chemically synthesized
aaaaatctaattatagtcaatg

SEQ ID NO: 756548 - DNA, 22 bp, Artificial Sequence
  chemically synthesized
aaaatctaattatagtcaatga

SEQ ID NO: 756549 - DNA, 22 bp, Artificial Sequence
  chemically synthesized
aaaaatgttttttcattgacta

SEQ ID NO: 756550 - DNA, 22 bp, Artificial Sequence
  chemically synthesized
tacactcaaaaatgttttttca

SEQ ID NO: 756551 - DNA, 22 bp, Artificial Sequence
  chemically synthesized
attatagtcaatgaaaaaacat

SEQ ID NO: 756552 - DNA, 22 bp, Artificial Sequence
  chemically synthesized
atacactcaaaaatgttttttc

SEQ ID NO: 756553 - DNA, 22 bp, Artificial Sequence
  chemically synthesized
tagtcaatgaaaaaacattttt

SEQ ID NO: 756554 - DNA, 22 bp, Artificial Sequence
  chemically synthesized
cccttatacactcaaaaatgtt

SEQ ID NO: 756555 - DNA, 22 bp, Artificial Sequence
  chemically synthesized
ccccttatacactcaaaaatgt

SEQ ID NO: 756556 - DNA, 22 bp, Artificial Sequence
  chemically synthesized
tccccttatacactcaaaaatg

SEQ ID NO: 756557 - DNA, 22 bp, Artificial Sequence
  chemically synthesized
aacacattttccccttatacac

SEQ ID NO: 756558 - DNA, 22 bp, Artificial Sequence
  chemically synthesized
ttaaacacattttccccttata

SEQ ID NO: 756559 - DNA, 22 bp, Artificial Sequence
  chemically synthesized
gttaaacacattttccccttat

SEQ ID NO: 756560 - DNA, 22 bp, Artificial Sequence
  chemically synthesized
ttgagtgtataaggggaaaatg

SEQ ID NO: 756561 - DNA, 22 bp, Artificial Sequence
  chemically synthesized
tgagtgtataaggggaaaatgt

SEQ ID NO: 756562 - DNA, 22 bp, Artificial Sequence
  chemically synthesized
gagtgtataaggggaaaatgtg

SEQ ID NO: 756563 - DNA, 22 bp, Artificial Sequence
  chemically synthesized
agtgtataaggggaaaatgtgt

SEQ ID NO: 756564 - DNA, 22 bp, Artificial Sequence
  chemically synthesized
aacacagagtttgttaaacaca

SEQ ID NO: 756565 - DNA, 22 bp, Artificial Sequence
  chemically synthesized
cagaaaaataaatctcaacaca

SEQ ID NO: 756566 - DNA, 22 bp, Artificial Sequence
  chemically synthesized
ccagaaaaataaatctcaacac

SEQ ID NO: 756567 - DNA, 22 bp, Artificial Sequence
  chemically synthesized
aacaaactctgtgttgagattt

SEQ ID NO: 756568 - DNA, 22 bp, Artificial Sequence
  chemically synthesized
acaaactctgtgttgagattta

SEQ ID NO: 756569 - DNA, 22 bp, Artificial Sequence
  chemically synthesized
aaagacttccagaaaaataaat

SEQ ID NO: 756570 - DNA, 22 bp, Artificial Sequence
  chemically synthesized
caaagacttccagaaaaataaa

SEQ ID NO: 756571 - DNA, 22 bp, Artificial Sequence
  chemically synthesized
tcaaagacttccagaaaaataa

SEQ ID NO: 756572 - DNA, 22 bp, Artificial Sequence
  chemically synthesized
tgtgttgagatttatttttctg

SEQ ID NO: 756573 - DNA, 22 bp, Artificial Sequence
  chemically synthesized
tgttgagatttatttttctgga

SEQ ID NO: 756574 - DNA, 22 bp, Artificial Sequence
  chemically synthesized
ttttcaaagacttccagaaaaa

SEQ ID NO: 756575 - DNA, 22 bp, Artificial Sequence
  chemically synthesized
gttttcaaagacttccagaaaa

SEQ ID NO: 756576 - DNA, 22 bp, Artificial Sequence
  chemically synthesized
tgttttcaaagacttccagaaa

SEQ ID NO: 756577 - DNA, 22 bp, Artificial Sequence
  chemically synthesized
agatttatttttctggaagtct

SEQ ID NO: 756578 - DNA, 22 bp, Artificial Sequence
  chemically synthesized
atttttctggaagtctttgaaa

SEQ ID NO: 756579 - DNA, 22 bp, Artificial Sequence
  chemically synthesized
tttttctggaagtctttgaaaa

SEQ ID NO: 756580 - DNA, 22 bp, Artificial Sequence
  chemically synthesized
ttctggaagtctttgaaaacaa

SEQ ID NO: 756581 - DNA, 22 bp, Artificial Sequence
  chemically synthesized
tctggaagtctttgaaaacaaa

SEQ ID NO: 756582 - DNA, 22 bp, Artificial Sequence
  chemically synthesized
ctggaagtctttgaaaacaaag

SEQ ID NO: 756583 - DNA, 22 bp, Artificial Sequence
  chemically synthesized
agagaatacaatctttgttttc

SEQ ID NO: 756584 - DNA, 22 bp, Artificial Sequence
  chemically synthesized
tggaagtctttgaaaacaaaga

SEQ ID NO: 756585 - DNA, 22 bp, Artificial Sequence
  chemically synthesized
gaagtctttgaaaacaaagatt

SEQ ID NO: 756586 - DNA, 22 bp, Artificial Sequence
  chemically synthesized
atctcagagaatacaatctttg

SEQ ID NO: 756587 - DNA, 22 bp, Artificial Sequence
  chemically synthesized
gatctcagagaatacaatcttt

SEQ ID NO: 756588 - DNA, 22 bp, Artificial Sequence
  chemically synthesized
tgaaaacaaagattgtattctc

SEQ ID NO: 756589 - DNA, 22 bp, Artificial Sequence
  chemically synthesized
gaaaacaaagattgtattctct

SEQ ID NO: 756590 - DNA, 22 bp, Artificial Sequence
  chemically synthesized
aaaacaaagattgtattctctg

SEQ ID NO: 756591 - DNA, 22 bp, Artificial Sequence
  chemically synthesized
gcccgtgcccttgatctcagag

SEQ ID NO: 756592 - DNA, 22 bp, Artificial Sequence
  chemically synthesized
tagcccgtgcccttgatctcag

SEQ ID NO: 756593 - DNA, 22 bp, Artificial Sequence
  chemically synthesized
ttctagcccgtgcccttgatct

SEQ ID NO: 756594 - DNA, 22 bp, Artificial Sequence
  chemically synthesized
tattctctgagatcaagggcac

SEQ ID NO: 756595 - DNA, 22 bp, Artificial Sequence
  chemically synthesized
gactattctagcccgtgccctt

SEQ ID NO: 756596 - DNA, 22 bp, Artificial Sequence
  chemically synthesized
tctgagatcaagggcacgggct

SEQ ID NO: 756597 - DNA, 22 bp, Artificial Sequence
  chemically synthesized
tgagatcaagggcacgggctag

SEQ ID NO: 756598 - DNA, 22 bp, Artificial Sequence
  chemically synthesized
agatcaagggcacgggctagaa

SEQ ID NO: 756599 - DNA, 22 bp, Artificial Sequence
  chemically synthesized
caagcaggctggactattctag

SEQ ID NO: 756600 - DNA, 22 bp, Artificial Sequence
  chemically synthesized
gaatagtccagcctgcttgcag

SEQ ID NO: 756601 - DNA, 22 bp, Artificial Sequence
  chemically synthesized
catagtatcacagacctgcaag

SEQ ID NO: 756602 - DNA, 22 bp, Artificial Sequence
  chemically synthesized
ctccatagtatcacagacctgc

SEQ ID NO: 756603 - DNA, 22 bp, Artificial Sequence
  chemically synthesized
ttcctccatagtatcacagacc

SEQ ID NO: 756604 - DNA, 22 bp, Artificial Sequence
  chemically synthesized
cttgcaggtctgtgatactatg

SEQ ID NO: 756605 - DNA, 22 bp, Artificial Sequence
  chemically synthesized
gcaggtctgtgatactatggag

SEQ ID NO: 756606 - DNA, 22 bp, Artificial Sequence
  chemically synthesized
caggtctgtgatactatggagg

SEQ ID NO: 756607 - DNA, 22 bp, Artificial Sequence
  chemically synthesized
tgtgcgcagtaaactattcctc

SEQ ID NO: 756608 - DNA, 22 bp, Artificial Sequence
  chemically synthesized
tgatactatggaggaatagttt

SEQ ID NO: 756609 - DNA, 22 bp, Artificial Sequence
  chemically synthesized
aagatgctgtgtgcgcagtaaa

SEQ ID NO: 756610 - DNA, 22 bp, Artificial Sequence
  chemically synthesized
tggaggaatagtttactgcgca

SEQ ID NO: 756611 - DNA, 22 bp, Artificial Sequence
  chemically synthesized
ttcaagatgctgtgtgcgcagt

SEQ ID NO: 756612 - DNA, 22 bp, Artificial Sequence
  chemically synthesized
actgcgcacacagcatcttgaa

SEQ ID NO: 756613 - DNA, 22 bp, Artificial Sequence
  chemically synthesized
ctgcgcacacagcatcttgaac

SEQ ID NO: 756614 - DNA, 22 bp, Artificial Sequence
  chemically synthesized
agagtcaaacagctgttcaaga

SEQ ID NO: 756615 - DNA, 22 bp, Artificial Sequence
  chemically synthesized
cgcacacagcatcttgaacagc

SEQ ID NO: 756616 - DNA, 22 bp, Artificial Sequence
  chemically synthesized
gaattaagagtcaaacagctgt

SEQ ID NO: 756617 - DNA, 22 bp, Artificial Sequence
  chemically synthesized
agaattaagagtcaaacagctg

SEQ ID NO: 756618 - DNA, 22 bp, Artificial Sequence
  chemically synthesized
gaacagctgtttgactcttaat

SEQ ID NO: 756619 - DNA, 22 bp, Artificial Sequence
  chemically synthesized
aacagctgtttgactcttaatt

SEQ ID NO: 756620 - DNA, 22 bp, Artificial Sequence
  chemically synthesized
gaagcagcccagccttagaatt

SEQ ID NO: 756621 - DNA, 22 bp, Artificial Sequence
  chemically synthesized
tttgactcttaattctaaggct

SEQ ID NO: 756622 - DNA, 22 bp, Artificial Sequence
  chemically synthesized
ttggaagcagcccagccttaga

SEQ ID NO: 756623 - DNA, 22 bp, Artificial Sequence
  chemically synthesized
gactcttaattctaaggctggg

SEQ ID NO: 756624 - DNA, 22 bp, Artificial Sequence
  chemically synthesized
actcttaattctaaggctgggc

SEQ ID NO: 756625 - DNA, 22 bp, Artificial Sequence
  chemically synthesized
ttaattctaaggctgggctgct

SEQ ID NO: 756626 - DNA, 22 bp, Artificial Sequence
  chemically synthesized
aattctaaggctgggctgcttc

SEQ ID NO: 756627 - DNA, 22 bp, Artificial Sequence
  chemically synthesized
attctaaggctgggctgcttcc

SEQ ID NO: 756628 - DNA, 22 bp, Artificial Sequence
  chemically synthesized
cccagtgattgttggaagcagc

SEQ ID NO: 756629 - DNA, 22 bp, Artificial Sequence
  chemically synthesized
ccccagtgattgttggaagcag

SEQ ID NO: 756630 - DNA, 22 bp, Artificial Sequence
  chemically synthesized
taaggctgggctgcttccaaca

SEQ ID NO: 756631 - DNA, 22 bp, Artificial Sequence
  chemically synthesized
aggctgggctgcttccaacaat

SEQ ID NO: 756632 - DNA, 22 bp, Artificial Sequence
  chemically synthesized
ggctgcttccaacaatcactgg

SEQ ID NO: 756633 - DNA, 22 bp, Artificial Sequence
  chemically synthesized
cttccaacaatcactggggaag

SEQ ID NO: 756634 - DNA, 22 bp, Artificial Sequence
  chemically synthesized
tcagtaggaagtaacttcccca

SEQ ID NO: 756635 - DNA, 22 bp, Artificial Sequence
  chemically synthesized
ccaacaatcactggggaagtta

SEQ ID NO: 756636 - DNA, 22 bp, Artificial Sequence
  chemically synthesized
caacaatcactggggaagttac

SEQ ID NO: 756637 - DNA, 22 bp, Artificial Sequence
  chemically synthesized
ttgtcagtaggaagtaacttcc

SEQ ID NO: 756638 - DNA, 22 bp, Artificial Sequence
  chemically synthesized
acaacattattgtcagtaggaa

SEQ ID NO: 756639 - DNA, 22 bp, Artificial Sequence
  chemically synthesized
aacaacattattgtcagtagga

SEQ ID NO: 756640 - DNA, 22 bp, Artificial Sequence
  chemically synthesized
gggaagttacttcctactgaca

SEQ ID NO: 756641 - DNA, 22 bp, Artificial Sequence
  chemically synthesized
agaacttaacaacattattgtc

SEQ ID NO: 756642 - DNA, 22 bp, Artificial Sequence
  chemically synthesized
cttcctactgacaataatgttg

SEQ ID NO: 756643 - DNA, 22 bp, Artificial Sequence
  chemically synthesized
cctactgacaataatgttgtta

SEQ ID NO: 756644 - DNA, 22 bp, Artificial Sequence
  chemically synthesized
ctactgacaataatgttgttaa

SEQ ID NO: 756645 - DNA, 22 bp, Artificial Sequence
  chemically synthesized
ctgacaataatgttgttaagtt

SEQ ID NO: 756646 - DNA, 22 bp, Artificial Sequence
  chemically synthesized
aaggtcagctcagaacttaaca

SEQ ID NO: 756647 - DNA, 22 bp, Artificial Sequence
  chemically synthesized
acaataatgttgttaagttctg

SEQ ID NO: 756648 - DNA, 22 bp, Artificial Sequence
  chemically synthesized
tcaaggtcagctcagaacttaa

SEQ ID NO: 756649 - DNA, 22 bp, Artificial Sequence
  chemically synthesized
ttaagttctgagctgaccttga

SEQ ID NO: 756650 - DNA, 22 bp, Artificial Sequence
  chemically synthesized
accagtgatctctcaaggtcag

SEQ ID NO: 756651 - DNA, 22 bp, Artificial Sequence
  chemically synthesized
caccagtgatctctcaaggtca

SEQ ID NO: 756652 - DNA, 22 bp, Artificial Sequence
  chemically synthesized
tcaccagtgatctctcaaggtc

SEQ ID NO: 756653 - DNA, 22 bp, Artificial Sequence
  chemically synthesized
agttctgagctgaccttgagag

SEQ ID NO: 756654 - DNA, 22 bp, Artificial Sequence
  chemically synthesized
agttttcaccagtgatctctca

SEQ ID NO: 756655 - DNA, 22 bp, Artificial Sequence
  chemically synthesized
tgagctgaccttgagagatcac

SEQ ID NO: 756656 - DNA, 22 bp, Artificial Sequence
  chemically synthesized
agctgaccttgagagatcactg

SEQ ID NO: 756657 - DNA, 22 bp, Artificial Sequence
  chemically synthesized
gattgagttttcaccagtgatc

SEQ ID NO: 756658 - DNA, 22 bp, Artificial Sequence
  chemically synthesized
accttgagagatcactggtgaa

SEQ ID NO: 756659 - DNA, 22 bp, Artificial Sequence
  chemically synthesized
gagagatcactggtgaaaactc

SEQ ID NO: 756660 - DNA, 22 bp, Artificial Sequence
  chemically synthesized
agagatcactggtgaaaactca

SEQ ID NO: 756661 - DNA, 22 bp, Artificial Sequence
  chemically synthesized
aatggccacgggaactagattg

SEQ ID NO: 756662 - DNA, 22 bp, Artificial Sequence
  chemically synthesized
gtgaaaactcaatctagttccc

SEQ ID NO: 756663 - DNA, 22 bp, Artificial Sequence
  chemically synthesized
cctaaatggccacgggaactag

SEQ ID NO: 756664 - DNA, 22 bp, Artificial Sequence
  chemically synthesized
attccctaaatggccacgggaa

SEQ ID NO: 756665 - DNA, 22 bp, Artificial Sequence
  chemically synthesized
aatctagttcccgtggccattt

SEQ ID NO: 756666 - DNA, 22 bp, Artificial Sequence
  chemically synthesized
agacctaattccctaaatggcc

SEQ ID NO: 756667 - DNA, 22 bp, Artificial Sequence
  chemically synthesized
gttcccgtggccatttagggaa

SEQ ID NO: 756668 - DNA, 22 bp, Artificial Sequence
  chemically synthesized
ccgtggccatttagggaattag

SEQ ID NO: 756669 - DNA, 22 bp, Artificial Sequence
  chemically synthesized
atgacctaagacctaattccct

SEQ ID NO: 756670 - DNA, 22 bp, Artificial Sequence
  chemically synthesized
aatgacctaagacctaattccc

SEQ ID NO: 756671 - DNA, 22 bp, Artificial Sequence
  chemically synthesized
ggcttaatgacctaagacctaa

SEQ ID NO: 756672 - DNA, 22 bp, Artificial Sequence
  chemically synthesized
aggcttaatgacctaagaccta

SEQ ID NO: 756673 - DNA, 22 bp, Artificial Sequence
  chemically synthesized
agggaattaggtcttaggtcat

SEQ ID NO: 756674 - DNA, 22 bp, Artificial Sequence
  chemically synthesized
gggaattaggtcttaggtcatt

SEQ ID NO: 756675 - DNA, 22 bp, Artificial Sequence
  chemically synthesized
aagtttaggcttaatgacctaa

SEQ ID NO: 756676 - DNA, 22 bp, Artificial Sequence
  chemically synthesized
aaagtttaggcttaatgaccta

SEQ ID NO: 756677 - DNA, 22 bp, Artificial Sequence
  chemically synthesized
ggtcttaggtcattaagcctaa

SEQ ID NO: 756678 - DNA, 22 bp, Artificial Sequence
  chemically synthesized
caaatcttaaagtttaggctta

SEQ ID NO: 756679 - DNA, 22 bp, Artificial Sequence
  chemically synthesized
ccaaatcttaaagtttaggctt

SEQ ID NO: 756680 - DNA, 22 bp, Artificial Sequence
  chemically synthesized
aggtcattaagcctaaacttta

SEQ ID NO: 756681 - DNA, 22 bp, Artificial Sequence
  chemically synthesized
ggtcattaagcctaaactttaa

SEQ ID NO: 756682 - DNA, 22 bp, Artificial Sequence
  chemically synthesized
agaagtaatttccaaatcttaa

SEQ ID NO: 756683 - DNA, 22 bp, Artificial Sequence
  chemically synthesized
cagaagtaatttccaaatctta

SEQ ID NO: 756684 - DNA, 22 bp, Artificial Sequence
  chemically synthesized
agcctaaactttaagatttgga

SEQ ID NO: 756685 - DNA, 22 bp, Artificial Sequence
  chemically synthesized
acatttcagaagtaatttccaa

SEQ ID NO: 756686 - DNA, 22 bp, Artificial Sequence
  chemically synthesized
aactttaagatttggaaattac

SEQ ID NO: 756687 - DNA, 22 bp, Artificial Sequence
  chemically synthesized
ctaacatttcagaagtaatttc

SEQ ID NO: 756688 - DNA, 22 bp, Artificial Sequence
  chemically synthesized
tactaacatttcagaagtaatt

SEQ ID NO: 756689 - DNA, 22 bp, Artificial Sequence
  chemically synthesized
taagatttggaaattacttctg

SEQ ID NO: 756690 - DNA, 22 bp, Artificial Sequence
  chemically synthesized
ctactaacatttcagaagtaat

SEQ ID NO: 756691 - DNA, 22 bp, Artificial Sequence
  chemically synthesized
aagatttggaaattacttctga

SEQ ID NO: 756692 - DNA, 22 bp, Artificial Sequence
  chemically synthesized
agatttggaaattacttctgaa

SEQ ID NO: 756693 - DNA, 22 bp, Artificial Sequence
  chemically synthesized
atttctactaacatttcagaag

SEQ ID NO: 756694 - DNA, 22 bp, Artificial Sequence
  chemically synthesized
ggaaattacttctgaaatgtta

SEQ ID NO: 756695 - DNA, 22 bp, Artificial Sequence
  chemically synthesized
gaaattacttctgaaatgttag

SEQ ID NO: 756696 - DNA, 22 bp, Artificial Sequence
  chemically synthesized
ataatccattcatttctactaa

SEQ ID NO: 756697 - DNA, 22 bp, Artificial Sequence
  chemically synthesized
cttctgaaatgttagtagaaat

SEQ ID NO: 756698 - DNA, 22 bp, Artificial Sequence
  chemically synthesized
taataatccattcatttctact

SEQ ID NO: 756699 - DNA, 22 bp, Artificial Sequence
  chemically synthesized
ctaataatccattcatttctac

SEQ ID NO: 756700 - DNA, 22 bp, Artificial Sequence
  chemically synthesized
ctgaaatgttagtagaaatgaa

SEQ ID NO: 756701 - DNA, 22 bp, Artificial Sequence
  chemically synthesized
tctaataatccattcatttcta

SEQ ID NO: 756702 - DNA, 22 bp, Artificial Sequence
  chemically synthesized
tgaaatgttagtagaaatgaat

SEQ ID NO: 756703 - DNA, 22 bp, Artificial Sequence
  chemically synthesized
aaatgttagtagaaatgaatgg

SEQ ID NO: 756704 - DNA, 22 bp, Artificial Sequence
  chemically synthesized
gtagaaatgaatggattattag

SEQ ID NO: 756705 - DNA, 22 bp, Artificial Sequence
  chemically synthesized
tcacagggttttctaataatcc

SEQ ID NO: 756706 - DNA, 22 bp, Artificial Sequence
  chemically synthesized
gtcacagggttttctaataatc

SEQ ID NO: 756707 - DNA, 22 bp, Artificial Sequence
  chemically synthesized
atttgtcacagggttttctaat

SEQ ID NO: 756708 - DNA, 22 bp, Artificial Sequence
  chemically synthesized
ttagaaaaccctgtgacaaatt

SEQ ID NO: 756709 - DNA, 22 bp, Artificial Sequence
  chemically synthesized
gaaaaccctgtgacaaattaat

SEQ ID NO: 756710 - DNA, 22 bp, Artificial Sequence
  chemically synthesized
agaacatacacaaattaatttg

SEQ ID NO: 756711 - DNA, 22 bp, Artificial Sequence
  chemically synthesized
gagaacatacacaaattaattt

SEQ ID NO: 756712 - DNA, 22 bp, Artificial Sequence
  chemically synthesized
tgacaaattaatttgtgtatgt

SEQ ID NO: 756713 - DNA, 22 bp, Artificial Sequence
  chemically synthesized
agtatcttgagaacatacacaa

SEQ ID NO: 756714 - DNA, 22 bp, Artificial Sequence
  chemically synthesized
gctcagtatcttgagaacatac

SEQ ID NO: 756715 - DNA, 22 bp, Artificial Sequence
  chemically synthesized
ggctcagtatcttgagaacata

SEQ ID NO: 756716 - DNA, 22 bp, Artificial Sequence
  chemically synthesized
tggctcagtatcttgagaacat

SEQ ID NO: 756717 - DNA, 22 bp, Artificial Sequence
  chemically synthesized
atttgtgtatgttctcaagata

SEQ ID NO: 756718 - DNA, 22 bp, Artificial Sequence
  chemically synthesized
aaattttggctcagtatcttga

SEQ ID NO: 756719 - DNA, 22 bp, Artificial Sequence
  chemically synthesized
gtgtatgttctcaagatactga

SEQ ID NO: 756720 - DNA, 22 bp, Artificial Sequence
  chemically synthesized
tgtatgttctcaagatactgag

SEQ ID NO: 756721 - DNA, 22 bp, Artificial Sequence
  chemically synthesized
acaatctcaaattttggctcag

SEQ ID NO: 756722 - DNA, 22 bp, Artificial Sequence
  chemically synthesized
gacaatctcaaattttggctca

SEQ ID NO: 756723 - DNA, 22 bp, Artificial Sequence
  chemically synthesized
tcaagatactgagccaaaattt

SEQ ID NO: 756724 - DNA, 22 bp, Artificial Sequence
  chemically synthesized
aagatactgagccaaaatttga

SEQ ID NO: 756725 - DNA, 22 bp, Artificial Sequence
  chemically synthesized
tacttgacaatctcaaattttg

SEQ ID NO: 756726 - DNA, 22 bp, Artificial Sequence
  chemically synthesized
atacttgacaatctcaaatttt

SEQ ID NO: 756727 - DNA, 22 bp, Artificial Sequence
  chemically synthesized
ccacttatacttgacaatctca

SEQ ID NO: 756728 - DNA, 22 bp, Artificial Sequence
  chemically synthesized
accacttatacttgacaatctc

SEQ ID NO: 756729 - DNA, 22 bp, Artificial Sequence
  chemically synthesized
agccaaaatttgagattgtcaa

SEQ ID NO: 756730 - DNA, 22 bp, Artificial Sequence
  chemically synthesized
tttaccacttatacttgacaat

SEQ ID NO: 756731 - DNA, 22 bp, Artificial Sequence
  chemically synthesized
agatattatttaccacttatac

SEQ ID NO: 756732 - DNA, 22 bp, Artificial Sequence
  chemically synthesized
gagattgtcaagtataagtggt

SEQ ID NO: 756733 - DNA, 22 bp, Artificial Sequence
  chemically synthesized
agattgtcaagtataagtggta

SEQ ID NO: 756734 - DNA, 22 bp, Artificial Sequence
  chemically synthesized
tcaagtataagtggtaaataat

SEQ ID NO: 756735 - DNA, 22 bp, Artificial Sequence
  chemically synthesized
atagacagacacaaagggtatg

SEQ ID NO: 756736 - DNA, 22 bp, Artificial Sequence
  chemically synthesized
tgttgatagacagacacaaagg

SEQ ID NO: 756737 - DNA, 22 bp, Artificial Sequence
  chemically synthesized
aatcataccctttgtgtctgtc

SEQ ID NO: 756738 - DNA, 22 bp, Artificial Sequence
  chemically synthesized
gattatgttgatagacagacac

SEQ ID NO: 756739 - DNA, 22 bp, Artificial Sequence
  chemically synthesized
ggattatgttgatagacagaca

SEQ ID NO: 756740 - DNA, 22 bp, Artificial Sequence
  chemically synthesized
tggattatgttgatagacagac

SEQ ID NO: 756741 - DNA, 22 bp, Artificial Sequence
  chemically synthesized
ttggattatgttgatagacaga

SEQ ID NO: 756742 - DNA, 22 bp, Artificial Sequence
  chemically synthesized
catttttggattatgttgatag

SEQ ID NO: 756743 - DNA, 22 bp, Artificial Sequence
  chemically synthesized
tgtgtctgtctatcaacataat

SEQ ID NO: 756744 - DNA, 22 bp, Artificial Sequence
  chemically synthesized
gtgtctgtctatcaacataatc

SEQ ID NO: 756745 - DNA, 22 bp, Artificial Sequence
  chemically synthesized
tgtctgtctatcaacataatcc

SEQ ID NO: 756746 - DNA, 22 bp, Artificial Sequence
  chemically synthesized
tctatcaacataatccaaaaat

SEQ ID NO: 756747 - DNA, 22 bp, Artificial Sequence
  chemically synthesized
tcaacataatccaaaaatggaa

SEQ ID NO: 756748 - DNA, 22 bp, Artificial Sequence
  chemically synthesized
gaatgaaccagggttccatttt

SEQ ID NO: 756749 - DNA, 22 bp, Artificial Sequence
  chemically synthesized
agaatgaaccagggttccattt

SEQ ID NO: 756750 - DNA, 22 bp, Artificial Sequence
  chemically synthesized
agtgtatgtgcttagaatgaac

SEQ ID NO: 756751 - DNA, 22 bp, Artificial Sequence
  chemically synthesized
gagtgtatgtgcttagaatgaa

SEQ ID NO: 756752 - DNA, 22 bp, Artificial Sequence
  chemically synthesized
gttcattctaagcacatacact

SEQ ID NO: 756753 - DNA, 22 bp, Artificial Sequence
  chemically synthesized
attctaagcacatacactcaaa

SEQ ID NO: 756754 - DNA, 22 bp, Artificial Sequence
  chemically synthesized
ggaatgatcacgtttgagtgta

SEQ ID NO: 756755 - DNA, 22 bp, Artificial Sequence
  chemically synthesized
gggaatgatcacgtttgagtgt

SEQ ID NO: 756756 - DNA, 22 bp, Artificial Sequence
  chemically synthesized
taagcacatacactcaaacgtg

SEQ ID NO: 756757 - DNA, 22 bp, Artificial Sequence
  chemically synthesized
agcacatacactcaaacgtgat

SEQ ID NO: 756758 - DNA, 22 bp, Artificial Sequence
  chemically synthesized
agaaagacttgggaatgatcac

SEQ ID NO: 756759 - DNA, 22 bp, Artificial Sequence
  chemically synthesized
ccatctgagaaagacttgggaa

SEQ ID NO: 756760 - DNA, 22 bp, Artificial Sequence
  chemically synthesized
aaacgtgatcattcccaagtct

SEQ ID NO: 756761 - DNA, 22 bp, Artificial Sequence
  chemically synthesized
ccaagtctttctcagatggcaa

SEQ ID NO: 756762 - DNA, 22 bp, Artificial Sequence
  chemically synthesized
aacaaataaaataatgatgttg

SEQ ID NO: 756763 - DNA, 22 bp, Artificial Sequence
  chemically synthesized
gaacaaataaaataatgatgtt

SEQ ID NO: 756764 - DNA, 22 bp, Artificial Sequence
  chemically synthesized
tctcagatggcaacatcattat

SEQ ID NO: 756765 - DNA, 22 bp, Artificial Sequence
  chemically synthesized
ctcagatggcaacatcattatt

SEQ ID NO: 756766 - DNA, 22 bp, Artificial Sequence
  chemically synthesized
tcagatggcaacatcattattt

SEQ ID NO: 756767 - DNA, 22 bp, Artificial Sequence
  chemically synthesized
agatggcaacatcattatttta

SEQ ID NO: 756768 - DNA, 22 bp, Artificial Sequence
  chemically synthesized
aggtcaatggcttgaacaaata

SEQ ID NO: 756769 - DNA, 22 bp, Artificial Sequence
  chemically synthesized
tgaggtcaatggcttgaacaaa

SEQ ID NO: 756770 - DNA, 22 bp, Artificial Sequence
  chemically synthesized
ttttatttgttcaagccattga

SEQ ID NO: 756771 - DNA, 22 bp, Artificial Sequence
  chemically synthesized
tatttgttcaagccattgacct

SEQ ID NO: 756772 - DNA, 22 bp, Artificial Sequence
  chemically synthesized
atttgttcaagccattgacctc

SEQ ID NO: 756773 - DNA, 22 bp, Artificial Sequence
  chemically synthesized
tttgttcaagccattgacctca

SEQ ID NO: 756774 - DNA, 22 bp, Artificial Sequence
  chemically synthesized
gttcaagccattgacctcagaa

SEQ ID NO: 756775 - DNA, 22 bp, Artificial Sequence
  chemically synthesized
ttcaagccattgacctcagaat

SEQ ID NO: 756776 - DNA, 22 bp, Artificial Sequence
  chemically synthesized
aagccattgacctcagaatttt

SEQ ID NO: 756777 - DNA, 22 bp, Artificial Sequence
  chemically synthesized
acctcagaattttccttgactc

SEQ ID NO: 756778 - DNA, 22 bp, Artificial Sequence
  chemically synthesized
agaggaagcaaagagtcaagga

SEQ ID NO: 756779 - DNA, 22 bp, Artificial Sequence
  chemically synthesized
gagaggaagcaaagagtcaagg

SEQ ID NO: 756780 - DNA, 22 bp, Artificial Sequence
  chemically synthesized
agaattttccttgactctttgc

SEQ ID NO: 756781 - DNA, 22 bp, Artificial Sequence
  chemically synthesized
tccttgactctttgcttcctct

SEQ ID NO: 756782 - DNA, 22 bp, Artificial Sequence
  chemically synthesized
ccttgactctttgcttcctctc

SEQ ID NO: 756783 - DNA, 22 bp, Artificial Sequence
  chemically synthesized
cttgactctttgcttcctctca

SEQ ID NO: 756784 - DNA, 22 bp, Artificial Sequence
  chemically synthesized
gactctttgcttcctctcaaac

SEQ ID NO: 756785 - DNA, 22 bp, Artificial Sequence
  chemically synthesized
actctttgcttcctctcaaact

SEQ ID NO: 756786 - DNA, 22 bp, Artificial Sequence
  chemically synthesized
tttgcttcctctcaaactccac

SEQ ID NO: 756787 - DNA, 22 bp, Artificial Sequence
  chemically synthesized
agatagatagaatgtggagttt

SEQ ID NO: 756788 - DNA, 22 bp, Artificial Sequence
  chemically synthesized
tgcttcctctcaaactccacat

SEQ ID NO: 756789 - DNA, 22 bp, Artificial Sequence
  chemically synthesized
aagatagatagaatgtggagtt

SEQ ID NO: 756790 - DNA, 22 bp, Artificial Sequence
  chemically synthesized
gcttcctctcaaactccacatt

SEQ ID NO: 756791 - DNA, 22 bp, Artificial Sequence
  chemically synthesized
cttcctctcaaactccacattc

SEQ ID NO: 756792 - DNA, 22 bp, Artificial Sequence
  chemically synthesized
cctctcaaactccacattctat

SEQ ID NO: 756793 - DNA, 22 bp, Artificial Sequence
  chemically synthesized
ctctcaaactccacattctatc

SEQ ID NO: 756794 - DNA, 22 bp, Artificial Sequence
  chemically synthesized
tcaaactccacattctatctat

SEQ ID NO: 756795 - DNA, 22 bp, Artificial Sequence
  chemically synthesized
atagaacttaagatagatagaa

SEQ ID NO: 756796 - DNA, 22 bp, Artificial Sequence
  chemically synthesized
aaactccacattctatctatct

SEQ ID NO: 756797 - DNA, 22 bp, Artificial Sequence
  chemically synthesized
cacattctatctatcttaagtt

SEQ ID NO: 756798 - DNA, 22 bp, Artificial Sequence
  chemically synthesized
gagggtagaattgatagaactt

SEQ ID NO: 756799 - DNA, 22 bp, Artificial Sequence
  chemically synthesized
ggagggtagaattgatagaact

SEQ ID NO: 756800 - DNA, 22 bp, Artificial Sequence
  chemically synthesized
tatctatcttaagttctatcaa

SEQ ID NO: 756801 - DNA, 22 bp, Artificial Sequence
  chemically synthesized
tctatcttaagttctatcaatt

SEQ ID NO: 756802 - DNA, 22 bp, Artificial Sequence
  chemically synthesized
tcttaagttctatcaattctac

SEQ ID NO: 756803 - DNA, 22 bp, Artificial Sequence
  chemically synthesized
aagttctatcaattctaccctc

SEQ ID NO: 756804 - DNA, 22 bp, Artificial Sequence
  chemically synthesized
agttctatcaattctaccctcc

SEQ ID NO: 756805 - DNA, 22 bp, Artificial Sequence
  chemically synthesized
atcgaagatatatttggagggt

SEQ ID NO: 756806 - DNA, 22 bp, Artificial Sequence
  chemically synthesized
gatcgaagatatatttggaggg

SEQ ID NO: 756807 - DNA, 22 bp, Artificial Sequence
  chemically synthesized
tatcaattctaccctccaaata

SEQ ID NO: 756808 - DNA, 22 bp, Artificial Sequence
  chemically synthesized
tcaattctaccctccaaatata

SEQ ID NO: 756809 - DNA, 22 bp, Artificial Sequence
  chemically synthesized
tttgatcgaagatatatttgga

SEQ ID NO: 756810 - DNA, 22 bp, Artificial Sequence
  chemically synthesized
taccctccaaatatatcttcga

SEQ ID NO: 756811 - DNA, 22 bp, Artificial Sequence
  chemically synthesized
ccctccaaatatatcttcgatc

SEQ ID NO: 756812 - DNA, 22 bp, Artificial Sequence
  chemically synthesized
caaatatatcttcgatcaaata

SEQ ID NO: 756813 - DNA, 22 bp, Artificial Sequence
  chemically synthesized
cgatcaaataattattcaccat

SEQ ID NO: 756814 - DNA, 22 bp, Artificial Sequence
  chemically synthesized
gatcaaataattattcaccata

SEQ ID NO: 756815 - DNA, 22 bp, Artificial Sequence
  chemically synthesized
gagtggaaatgataggtatggt

SEQ ID NO: 756816 - DNA, 22 bp, Artificial Sequence
  chemically synthesized
gactagagtggaaatgataggt

SEQ ID NO: 756817 - DNA, 22 bp, Artificial Sequence
  chemically synthesized
ggactagagtggaaatgatagg

SEQ ID NO: 756818 - DNA, 22 bp, Artificial Sequence
  chemically synthesized
ttcaccatacctatcatttcca

SEQ ID NO: 756819 - DNA, 22 bp, Artificial Sequence
  chemically synthesized
cttggactagagtggaaatgat

SEQ ID NO: 756820 - DNA, 22 bp, Artificial Sequence
  chemically synthesized
accatacctatcatttccactc

SEQ ID NO: 756821 - DNA, 22 bp, Artificial Sequence
  chemically synthesized
tcatttccactctagtccaagt

SEQ ID NO: 756822 - DNA, 22 bp, Artificial Sequence
  chemically synthesized
agaaggaaatgattacttggac

SEQ ID NO: 756823 - DNA, 22 bp, Artificial Sequence
  chemically synthesized
ccactctagtccaagtaatcat

SEQ ID NO: 756824 - DNA, 22 bp, Artificial Sequence
  chemically synthesized
cactctagtccaagtaatcatt

SEQ ID NO: 756825 - DNA, 22 bp, Artificial Sequence
  chemically synthesized
tagtccaagtaatcatttcctt

SEQ ID NO: 756826 - DNA, 22 bp, Artificial Sequence
  chemically synthesized
gtccaagtaatcatttccttct

SEQ ID NO: 756827 - DNA, 22 bp, Artificial Sequence
  chemically synthesized
ccttctgagatgactccaccac

SEQ ID NO: 756828 - DNA, 22 bp, Artificial Sequence
  chemically synthesized
cttctgagatgactccaccacc

SEQ ID NO: 756829 - DNA, 22 bp, Artificial Sequence
  chemically synthesized
ctgagatgactccaccaccctc

SEQ ID NO: 756830 - DNA, 22 bp, Artificial Sequence
  chemically synthesized
tgagatgactccaccaccctcc

SEQ ID NO: 756831 - DNA, 22 bp, Artificial Sequence
  chemically synthesized
aagacacagaaaaggagggtgg

SEQ ID NO: 756832 - DNA, 22 bp, Artificial Sequence
  chemically synthesized
agatgactccaccaccctcctt

SEQ ID NO: 756833 - DNA, 22 bp, Artificial Sequence
  chemically synthesized
caccaccctccttttctgtgtc

SEQ ID NO: 756834 - DNA, 22 bp, Artificial Sequence
  chemically synthesized
taaaaagagcgaaactgaagac

SEQ ID NO: 756835 - DNA, 22 bp, Artificial Sequence
  chemically synthesized
cttttctgtgtcttcagtttcg

SEQ ID NO: 756836 - DNA, 22 bp, Artificial Sequence
  chemically synthesized
actataaaaagagcgaaactga

SEQ ID NO: 756837 - DNA, 22 bp, Artificial Sequence
  chemically synthesized
ttctgtgtcttcagtttcgctc

SEQ ID NO: 756838 - DNA, 22 bp, Artificial Sequence
  chemically synthesized
tctgtgtcttcagtttcgctct

SEQ ID NO: 756839 - DNA, 22 bp, Artificial Sequence
  chemically synthesized
ctgtgtcttcagtttcgctctt

SEQ ID NO: 756840 - DNA, 22 bp, Artificial Sequence
  chemically synthesized
tgtgtcttcagtttcgctcttt

SEQ ID NO: 756841 - DNA, 22 bp, Artificial Sequence
  chemically synthesized
tgtcttcagtttcgctcttttt

SEQ ID NO: 756842 - DNA, 22 bp, Artificial Sequence
  chemically synthesized
tggagaattgactataaaaaga

SEQ ID NO: 756843 - DNA, 22 bp, Artificial Sequence
  chemically synthesized
cagtttcgctctttttatagtc

SEQ ID NO: 756844 - DNA, 22 bp, Artificial Sequence
  chemically synthesized
ctatggagaattgactataaaa

SEQ ID NO: 756845 - DNA, 22 bp, Artificial Sequence
  chemically synthesized
agtttcgctctttttatagtca

SEQ ID NO: 756846 - DNA, 22 bp, Artificial Sequence
  chemically synthesized
ctgctatggagaattgactata

SEQ ID NO: 756847 - DNA, 22 bp, Artificial Sequence
  chemically synthesized
gctgctatggagaattgactat

SEQ ID NO: 756848 - DNA, 22 bp, Artificial Sequence
  chemically synthesized
cgctctttttatagtcaattct

SEQ ID NO: 756849 - DNA, 22 bp, Artificial Sequence
  chemically synthesized
ttgctgctatggagaattgact

SEQ ID NO: 756850 - DNA, 22 bp, Artificial Sequence
  chemically synthesized
gctctttttatagtcaattctc

SEQ ID NO: 756851 - DNA, 22 bp, Artificial Sequence
  chemically synthesized
actcttgctgctatggagaatt

SEQ ID NO: 756852 - DNA, 22 bp, Artificial Sequence
  chemically synthesized
tttttatagtcaattctccata

SEQ ID NO: 756853 - DNA, 22 bp, Artificial Sequence
  chemically synthesized
tttatagtcaattctccatagc

SEQ ID NO: 756854 - DNA, 22 bp, Artificial Sequence
  chemically synthesized
ttatagtcaattctccatagca

SEQ ID NO: 756855 - DNA, 22 bp, Artificial Sequence
  chemically synthesized
tatagtcaattctccatagcag

SEQ ID NO: 756856 - DNA, 22 bp, Artificial Sequence
  chemically synthesized
atagtcaattctccatagcagc

SEQ ID NO: 756857 - DNA, 22 bp, Artificial Sequence
  chemically synthesized
tagtcaattctccatagcagca

SEQ ID NO: 756858 - DNA, 22 bp, Artificial Sequence
  chemically synthesized
gaagttgactcttgctgctatg

SEQ ID NO: 756859 - DNA, 22 bp, Artificial Sequence
  chemically synthesized
agaagttgactcttgctgctat

SEQ ID NO: 756860 - DNA, 22 bp, Artificial Sequence
  chemically synthesized
tgtgtttagaagttgactcttg

SEQ ID NO: 756861 - DNA, 22 bp, Artificial Sequence
  chemically synthesized
atgtgtttagaagttgactctt

SEQ ID NO: 756862 - DNA, 22 bp, Artificial Sequence
  chemically synthesized
tccatagcagcaagagtcaact

SEQ ID NO: 756863 - DNA, 22 bp, Artificial Sequence
  chemically synthesized
catagcagcaagagtcaacttc

SEQ ID NO: 756864 - DNA, 22 bp, Artificial Sequence
  chemically synthesized
atttatgtgtttagaagttgac

SEQ ID NO: 756865 - DNA, 22 bp, Artificial Sequence
  chemically synthesized
ctaaacacataaatcagatcac

SEQ ID NO: 756866 - DNA, 22 bp, Artificial Sequence
  chemically synthesized
agcagggatgatgtgatctgat

SEQ ID NO: 756867 - DNA, 22 bp, Artificial Sequence
  chemically synthesized
taaacacataaatcagatcaca

SEQ ID NO: 756868 - DNA, 22 bp, Artificial Sequence
  chemically synthesized
tcagcagggatgatgtgatctg

SEQ ID NO: 756869 - DNA, 22 bp, Artificial Sequence
  chemically synthesized
aacacataaatcagatcacatc

SEQ ID NO: 756870 - DNA, 22 bp, Artificial Sequence
  chemically synthesized
gaaggctctcagcagggatgat

SEQ ID NO: 756871 - DNA, 22 bp, Artificial Sequence
  chemically synthesized
gaagtaaggaaacatcactgga

SEQ ID NO: 756872 - DNA, 22 bp, Artificial Sequence
  chemically synthesized
ctgagagccttccagtgatgtt

SEQ ID NO: 756873 - DNA, 22 bp, Artificial Sequence
  chemically synthesized
agagccttccagtgatgtttcc

SEQ ID NO: 756874 - DNA, 22 bp, Artificial Sequence
  chemically synthesized
ccagtgatgtttccttacttcc

SEQ ID NO: 756875 - DNA, 22 bp, Artificial Sequence
  chemically synthesized
cagtgatgtttccttacttcca

SEQ ID NO: 756876 - DNA, 22 bp, Artificial Sequence
  chemically synthesized
tgagtaaagagacatcactgga

SEQ ID NO: 756877 - DNA, 22 bp, Artificial Sequence
  chemically synthesized
tgtgagtaaagagacatcactg

SEQ ID NO: 756878 - DNA, 22 bp, Artificial Sequence
  chemically synthesized
ccttacttccagtgatgtctct

SEQ ID NO: 756879 - DNA, 22 bp, Artificial Sequence
  chemically synthesized
ttctgtgagtaaagagacatca

SEQ ID NO: 756880 - DNA, 22 bp, Artificial Sequence
  chemically synthesized
cttacttccagtgatgtctctt

SEQ ID NO: 756881 - DNA, 22 bp, Artificial Sequence
  chemically synthesized
attctgtgagtaaagagacatc

SEQ ID NO: 756882 - DNA, 22 bp, Artificial Sequence
  chemically synthesized
tattctgtgagtaaagagacat

SEQ ID NO: 756883 - DNA, 22 bp, Artificial Sequence
  chemically synthesized
acttccagtgatgtctctttac

SEQ ID NO: 756884 - DNA, 22 bp, Artificial Sequence
  chemically synthesized
cttccagtgatgtctctttact

SEQ ID NO: 756885 - DNA, 22 bp, Artificial Sequence
  chemically synthesized
ccagtgatgtctctttactcac

SEQ ID NO: 756886 - DNA, 22 bp, Artificial Sequence
  chemically synthesized
cagtgatgtctctttactcaca

SEQ ID NO: 756887 - DNA, 22 bp, Artificial Sequence
  chemically synthesized
gaggtggattttattctgtgag

SEQ ID NO: 756888 - DNA, 22 bp, Artificial Sequence
  chemically synthesized
ggaggtggattttattctgtga

SEQ ID NO: 756889 - DNA, 22 bp, Artificial Sequence
  chemically synthesized
tttactcacagaataaaatcca

SEQ ID NO: 756890 - DNA, 22 bp, Artificial Sequence
  chemically synthesized
tactcacagaataaaatccacc

SEQ ID NO: 756891 - DNA, 22 bp, Artificial Sequence
  chemically synthesized
actcacagaataaaatccacct

SEQ ID NO: 756892 - DNA, 22 bp, Artificial Sequence
  chemically synthesized
ctcacagaataaaatccacctc

SEQ ID NO: 756893 - DNA, 22 bp, Artificial Sequence
  chemically synthesized
caggccatagtttggaggtgga

SEQ ID NO: 756894 - DNA, 22 bp, Artificial Sequence
  chemically synthesized
acagaataaaatccacctccaa

SEQ ID NO: 756895 - DNA, 22 bp, Artificial Sequence
  chemically synthesized
gcaggccatagtttggaggtgg

SEQ ID NO: 756896 - DNA, 22 bp, Artificial Sequence
  chemically synthesized
caaactatggcctgcaagacca

SEQ ID NO: 756897 - DNA, 22 bp, Artificial Sequence
  chemically synthesized
tggcctgcaagaccattcatta

SEQ ID NO: 756898 - DNA, 22 bp, Artificial Sequence
  chemically synthesized
caagaccattcattatctggcc

SEQ ID NO: 756899 - DNA, 22 bp, Artificial Sequence
  chemically synthesized
gaaagagggaaaggccagataa

SEQ ID NO: 756900 - DNA, 22 bp, Artificial Sequence
  chemically synthesized
tagaaagagggaaaggccagat

SEQ ID NO: 756901 - DNA, 22 bp, Artificial Sequence
  chemically synthesized
attatctggcctttccctcttt

SEQ ID NO: 756902 - DNA, 22 bp, Artificial Sequence
  chemically synthesized
tctggcctttccctctttctag

SEQ ID NO: 756903 - DNA, 22 bp, Artificial Sequence
  chemically synthesized
gcctttccctctttctagaacc

SEQ ID NO: 756904 - DNA, 22 bp, Artificial Sequence
  chemically synthesized
tccctctttctagaacctatca

SEQ ID NO: 756905 - DNA, 22 bp, Artificial Sequence
  chemically synthesized
ccctctttctagaacctatcac

SEQ ID NO: 756906 - DNA, 22 bp, Artificial Sequence
  chemically synthesized
cctctttctagaacctatcact

SEQ ID NO: 756907 - DNA, 22 bp, Artificial Sequence
  chemically synthesized
tttctagaacctatcactgtct

SEQ ID NO: 756908 - DNA, 22 bp, Artificial Sequence
  chemically synthesized
tctagaacctatcactgtctac

SEQ ID NO: 756909 - DNA, 22 bp, Artificial Sequence
  chemically synthesized
ctagaacctatcactgtctact

SEQ ID NO: 756910 - DNA, 22 bp, Artificial Sequence
  chemically synthesized
tagaacctatcactgtctactg

SEQ ID NO: 756911 - DNA, 22 bp, Artificial Sequence
  chemically synthesized
gaacctatcactgtctactgat

SEQ ID NO: 756912 - DNA, 22 bp, Artificial Sequence
  chemically synthesized
aagggaaataagatcagtagac

SEQ ID NO: 756913 - DNA, 22 bp, Artificial Sequence
  chemically synthesized
tcactgtctactgatcttattt

SEQ ID NO: 756914 - DNA, 22 bp, Artificial Sequence
  chemically synthesized
tgtatctcaagggaaataagat

SEQ ID NO: 756915 - DNA, 22 bp, Artificial Sequence
  chemically synthesized
tctactgatcttatttcccttg

SEQ ID NO: 756916 - DNA, 22 bp, Artificial Sequence
  chemically synthesized
ctgatcttatttcccttgagat

SEQ ID NO: 756917 - DNA, 22 bp, Artificial Sequence
  chemically synthesized
atcttatttcccttgagataca

SEQ ID NO: 756918 - DNA, 22 bp, Artificial Sequence
  chemically synthesized
atttcccttgagatacacagct

SEQ ID NO: 756919 - DNA, 22 bp, Artificial Sequence
  chemically synthesized
tttcccttgagatacacagctc

SEQ ID NO: 756920 - DNA, 22 bp, Artificial Sequence
  chemically synthesized
cccttgagatacacagctcatc

SEQ ID NO: 756921 - DNA, 22 bp, Artificial Sequence
  chemically synthesized
tagaaatagcaagatgagctgt

SEQ ID NO: 756922 - DNA, 22 bp, Artificial Sequence
  chemically synthesized
ccttgagatacacagctcatct

SEQ ID NO: 756923 - DNA, 22 bp, Artificial Sequence
  chemically synthesized
gagatacacagctcatcttgct

SEQ ID NO: 756924 - DNA, 22 bp, Artificial Sequence
  chemically synthesized
agatacacagctcatcttgcta

SEQ ID NO: 756925 - DNA, 22 bp, Artificial Sequence
  chemically synthesized
agtgttgtagaaatagcaagat

SEQ ID NO: 756926 - DNA, 22 bp, Artificial Sequence
  chemically synthesized
gagtgttgtagaaatagcaaga

SEQ ID NO: 756927 - DNA, 22 bp, Artificial Sequence
  chemically synthesized
tgagtgttgtagaaatagcaag

SEQ ID NO: 756928 - DNA, 22 bp, Artificial Sequence
  chemically synthesized
atcttgctatttctacaacact

SEQ ID NO: 756929 - DNA, 22 bp, Artificial Sequence
  chemically synthesized
gctatttctacaacactcaaaa

SEQ ID NO: 756930 - DNA, 22 bp, Artificial Sequence
  chemically synthesized
ctatttctacaacactcaaaac

SEQ ID NO: 756931 - DNA, 22 bp, Artificial Sequence
  chemically synthesized
tttctacaacactcaaaacctg

SEQ ID NO: 756932 - DNA, 22 bp, Artificial Sequence
  chemically synthesized
ctacaacactcaaaacctgttc

SEQ ID NO: 756933 - DNA, 22 bp, Artificial Sequence
  chemically synthesized
tacaacactcaaaacctgttct

SEQ ID NO: 756934 - DNA, 22 bp, Artificial Sequence
  chemically synthesized
caacactcaaaacctgttctta

SEQ ID NO: 756935 - DNA, 22 bp, Artificial Sequence
  chemically synthesized
aaaagcccaatggtaagaacag

SEQ ID NO: 756936 - DNA, 22 bp, Artificial Sequence
  chemically synthesized
aaaacctgttcttaccattggg

SEQ ID NO: 756937 - DNA, 22 bp, Artificial Sequence
  chemically synthesized
ttcttaccattgggcttttgaa

SEQ ID NO: 756938 - DNA, 22 bp, Artificial Sequence
  chemically synthesized
ttaccattgggcttttgaattt

SEQ ID NO: 756939 - DNA, 22 bp, Artificial Sequence
  chemically synthesized
accattgggcttttgaatttgg

SEQ ID NO: 756940 - DNA, 22 bp, Artificial Sequence
  chemically synthesized
ccattgggcttttgaatttggt

SEQ ID NO: 756941 - DNA, 22 bp, Artificial Sequence
  chemically synthesized
ggcagaagaagcaccaaattca

SEQ ID NO: 756942 - DNA, 22 bp, Artificial Sequence
  chemically synthesized
taggcagaagaagcaccaaatt

SEQ ID NO: 756943 - DNA, 22 bp, Artificial Sequence
  chemically synthesized
ggcttttgaatttggtgcttct

SEQ ID NO: 756944 - DNA, 22 bp, Artificial Sequence
  chemically synthesized
ttgaatttggtgcttcttctgc

SEQ ID NO: 756945 - DNA, 22 bp, Artificial Sequence
  chemically synthesized
tgaatttggtgcttcttctgcc

SEQ ID NO: 756946 - DNA, 22 bp, Artificial Sequence
  chemically synthesized
gaatttggtgcttcttctgcct

SEQ ID NO: 756947 - DNA, 22 bp, Artificial Sequence
  chemically synthesized
aatttggtgcttcttctgccta

SEQ ID NO: 756948 - DNA, 22 bp, Artificial Sequence
  chemically synthesized
aatgaagaggattctaggcaga

SEQ ID NO: 756949 - DNA, 22 bp, Artificial Sequence
  chemically synthesized
gaatgaagaggattctaggcag

SEQ ID NO: 756950 - DNA, 22 bp, Artificial Sequence
  chemically synthesized
ggtgcttcttctgcctagaatc

SEQ ID NO: 756951 - DNA, 22 bp, Artificial Sequence
  chemically synthesized
gtgcttcttctgcctagaatcc

SEQ ID NO: 756952 - DNA, 22 bp, Artificial Sequence
  chemically synthesized
cttctgcctagaatcctcttca

SEQ ID NO: 756953 - DNA, 22 bp, Artificial Sequence
  chemically synthesized
ttctgcctagaatcctcttcat

SEQ ID NO: 756954 - DNA, 22 bp, Artificial Sequence
  chemically synthesized
ctgcctagaatcctcttcattc

SEQ ID NO: 756955 - DNA, 22 bp, Artificial Sequence
  chemically synthesized
tgcctagaatcctcttcattca

SEQ ID NO: 756956 - DNA, 22 bp, Artificial Sequence
  chemically synthesized
cctagaatcctcttcattcaag

SEQ ID NO: 756957 - DNA, 22 bp, Artificial Sequence
  chemically synthesized
gaatcctcttcattcaaggttt

SEQ ID NO: 756958 - DNA, 22 bp, Artificial Sequence
  chemically synthesized
ttcattcaaggtttttgcatgg

SEQ ID NO: 756959 - DNA, 22 bp, Artificial Sequence
  chemically synthesized
cattcaaggtttttgcatggtt

SEQ ID NO: 756960 - DNA, 22 bp, Artificial Sequence
  chemically synthesized
tgtgagtgagtaaaccatgcaa

SEQ ID NO: 756961 - DNA, 22 bp, Artificial Sequence
  chemically synthesized
attcaaggtttttgcatggttt

SEQ ID NO: 756962 - DNA, 22 bp, Artificial Sequence
  chemically synthesized
aaggtttttgcatggtttactc

SEQ ID NO: 756963 - DNA, 22 bp, Artificial Sequence
  chemically synthesized
ttgcatggtttactcactcaca

SEQ ID NO: 756964 - DNA, 22 bp, Artificial Sequence
  chemically synthesized
tgcatggtttactcactcacac

SEQ ID NO: 756965 - DNA, 22 bp, Artificial Sequence
  chemically synthesized
gcatggtttactcactcacaca

SEQ ID NO: 756966 - DNA, 22 bp, Artificial Sequence
  chemically synthesized
catggtttactcactcacacag

SEQ ID NO: 756967 - DNA, 22 bp, Artificial Sequence
  chemically synthesized
actcactcacacaggttttgtt

SEQ ID NO: 756968 - DNA, 22 bp, Artificial Sequence
  chemically synthesized
ctcactcacacaggttttgttt

SEQ ID NO: 756969 - DNA, 22 bp, Artificial Sequence
  chemically synthesized
aaaaaaacaaacaaacaaaacc

SEQ ID NO: 756970 - DNA, 22 bp, Artificial Sequence
  chemically synthesized
actcacacaggttttgtttgtt

SEQ ID NO: 756971 - DNA, 22 bp, Artificial Sequence
  chemically synthesized
tctcaaaaaaacaaacaaacaa

SEQ ID NO: 756972 - DNA, 22 bp, Artificial Sequence
  chemically synthesized
acacaggttttgtttgtttgtt

SEQ ID NO: 756973 - DNA, 22 bp, Artificial Sequence
  chemically synthesized
tgtttgtttgtttttttgagac

SEQ ID NO: 756974 - DNA, 22 bp, Artificial Sequence
  chemically synthesized
gtttgtttgtttttttgagaca

SEQ ID NO: 756975 - DNA, 22 bp, Artificial Sequence
  chemically synthesized
tttgtttgtttttttgagacag

SEQ ID NO: 756976 - DNA, 22 bp, Artificial Sequence
  chemically synthesized
gtttgtttttttgagacagggt

SEQ ID NO: 756977 - DNA, 22 bp, Artificial Sequence
  chemically synthesized
tttgtttttttgagacagggtc

SEQ ID NO: 756978 - DNA, 22 bp, Artificial Sequence
  chemically synthesized
ggtggcagagtgagaccctgtc

SEQ ID NO: 756979 - DNA, 22 bp, Artificial Sequence
  chemically synthesized
gtttttttgagacagggtctca

SEQ ID NO: 756980 - DNA, 22 bp, Artificial Sequence
  chemically synthesized
tttttttgagacagggtctcac

SEQ ID NO: 756981 - DNA, 22 bp, Artificial Sequence
  chemically synthesized
gcctgggtggcagagtgagacc

SEQ ID NO: 756982 - DNA, 22 bp, Artificial Sequence
  chemically synthesized
ttttgagacagggtctcactct

SEQ ID NO: 756983 - DNA, 22 bp, Artificial Sequence
  chemically synthesized
tttgagacagggtctcactctg

SEQ ID NO: 756984 - DNA, 22 bp, Artificial Sequence
  chemically synthesized
tagcctgggtggcagagtgaga

SEQ ID NO: 756985 - DNA, 22 bp, Artificial Sequence
  chemically synthesized
ttgagacagggtctcactctgc

SEQ ID NO: 756986 - DNA, 22 bp, Artificial Sequence
  chemically synthesized
tgagacagggtctcactctgcc

SEQ ID NO: 756987 - DNA, 22 bp, Artificial Sequence
  chemically synthesized
gagacagggtctcactctgcca

SEQ ID NO: 756988 - DNA, 22 bp, Artificial Sequence
  chemically synthesized
agacagggtctcactctgccac

SEQ ID NO: 756989 - DNA, 22 bp, Artificial Sequence
  chemically synthesized
cactctagcctgggtggcagag

SEQ ID NO: 756990 - DNA, 22 bp, Artificial Sequence
  chemically synthesized
tgccactgcactctagcctggg

SEQ ID NO: 756991 - DNA, 22 bp, Artificial Sequence
  chemically synthesized
actctgccacccaggctagagt

SEQ ID NO: 756992 - DNA, 22 bp, Artificial Sequence
  chemically synthesized
tgccacccaggctagagtgcag

SEQ ID NO: 756993 - DNA, 22 bp, Artificial Sequence
  chemically synthesized
ccacccaggctagagtgcagtg

SEQ ID NO: 756994 - DNA, 22 bp, Artificial Sequence
  chemically synthesized
aagtgaaccaagattgtgccac

SEQ ID NO: 756995 - DNA, 22 bp, Artificial Sequence
  chemically synthesized
gagtgcagtggcacaatcttgg

SEQ ID NO: 756996 - DNA, 22 bp, Artificial Sequence
  chemically synthesized
ggaggcggaggttgaagtgaac

SEQ ID NO: 756997 - DNA, 22 bp, Artificial Sequence
  chemically synthesized
gggaggcggaggttgaagtgaa

SEQ ID NO: 756998 - DNA, 22 bp, Artificial Sequence
  chemically synthesized
aacttgggaggcggaggttgaa

SEQ ID NO: 756999 - DNA, 22 bp, Artificial Sequence
  chemically synthesized
gaacttgggaggcggaggttga

SEQ ID NO: 757000 - DNA, 22 bp, Artificial Sequence
  chemically synthesized
ggttcacttcaacctccgcctc

SEQ ID NO: 757001 - DNA, 22 bp, Artificial Sequence
  chemically synthesized
gttcacttcaacctccgcctcc

SEQ ID NO: 757002 - DNA, 22 bp, Artificial Sequence
  chemically synthesized
acttcaacctccgcctcccaag

SEQ ID NO: 757003 - DNA, 22 bp, Artificial Sequence
  chemically synthesized
caacctccgcctcccaagttca

SEQ ID NO: 757004 - DNA, 22 bp, Artificial Sequence
  chemically synthesized
aacctccgcctcccaagttcaa

SEQ ID NO: 757005 - DNA, 22 bp, Artificial Sequence
  chemically synthesized
aggtaccagaatcgcttgaact

SEQ ID NO: 757006 - DNA, 22 bp, Artificial Sequence
  chemically synthesized
cgcctcccaagttcaagcgatt

SEQ ID NO: 757007 - DNA, 22 bp, Artificial Sequence
  chemically synthesized
ccaagttcaagcgattctggta

SEQ ID NO: 757008 - DNA, 22 bp, Artificial Sequence
  chemically synthesized
cccaggaggctgaggtaccaga

SEQ ID NO: 757009 - DNA, 22 bp, Artificial Sequence
  chemically synthesized
aagcgattctggtacctcagcc

SEQ ID NO: 757010 - DNA, 22 bp, Artificial Sequence
  chemically synthesized
tagtcccagctacccaggaggc

SEQ ID NO: 757011 - DNA, 22 bp, Artificial Sequence
  chemically synthesized
tggtacctcagcctcctgggta

SEQ ID NO: 757012 - DNA, 22 bp, Artificial Sequence
  chemically synthesized
gtacctcagcctcctgggtagc

SEQ ID NO: 757013 - DNA, 22 bp, Artificial Sequence
  chemically synthesized
agcctcctgggtagctgggact

SEQ ID NO: 757014 - DNA, 22 bp, Artificial Sequence
  chemically synthesized
ctgggtagctgggactacaggc

SEQ ID NO: 757015 - DNA, 22 bp, Artificial Sequence
  chemically synthesized
ggtagctgggactacaggcacg

SEQ ID NO: 757016 - DNA, 22 bp, Artificial Sequence
  chemically synthesized
ggcgtggtgacacgtgcctgta

SEQ ID NO: 757017 - DNA, 22 bp, Artificial Sequence
  chemically synthesized
gctgggcgtggtgacacgtgcc

SEQ ID NO: 757018 - DNA, 22 bp, Artificial Sequence
  chemically synthesized
ggactacaggcacgtgtcacca

SEQ ID NO: 757019 - DNA, 22 bp, Artificial Sequence
  chemically synthesized
caggcacgtgtcaccacgccca

SEQ ID NO: 757020 - DNA, 22 bp, Artificial Sequence
  chemically synthesized
ccaaaaactagctgggcgtggt

SEQ ID NO: 757021 - DNA, 22 bp, Artificial Sequence
  chemically synthesized
taccaaaaactagctgggcgtg

SEQ ID NO: 757022 - DNA, 22 bp, Artificial Sequence
  chemically synthesized
ctaccaaaaactagctgggcgt

SEQ ID NO: 757023 - DNA, 22 bp, Artificial Sequence
  chemically synthesized
cgtttctaccaaaaactagctg

SEQ ID NO: 757024 - DNA, 22 bp, Artificial Sequence
  chemically synthesized
gtttttggtagaaacgtagttt

SEQ ID NO: 757025 - DNA, 22 bp, Artificial Sequence
  chemically synthesized
gccaacatagtgaaactacgtt

SEQ ID NO: 757026 - DNA, 22 bp, Artificial Sequence
  chemically synthesized
ttggtagaaacgtagtttcact

SEQ ID NO: 757027 - DNA, 22 bp, Artificial Sequence
  chemically synthesized
tggtagaaacgtagtttcacta

SEQ ID NO: 757028 - DNA, 22 bp, Artificial Sequence
  chemically synthesized
ggtagaaacgtagtttcactat

SEQ ID NO: 757029 - DNA, 22 bp, Artificial Sequence
  chemically synthesized
gtagaaacgtagtttcactatg

SEQ ID NO: 757030 - DNA, 22 bp, Artificial Sequence
  chemically synthesized
gaaaccagcctggccaacatag

SEQ ID NO: 757031 - DNA, 22 bp, Artificial Sequence
  chemically synthesized
cactatgttggccaggctggtt

SEQ ID NO: 757032 - DNA, 22 bp, Artificial Sequence
  chemically synthesized
actatgttggccaggctggttt

SEQ ID NO: 757033 - DNA, 22 bp, Artificial Sequence
  chemically synthesized
gacgtcaagagttcgaaaccag

SEQ ID NO: 757034 - DNA, 22 bp, Artificial Sequence
  chemically synthesized
tgttggccaggctggtttcgaa

SEQ ID NO: 757035 - DNA, 22 bp, Artificial Sequence
  chemically synthesized
gccaggctggtttcgaactctt

SEQ ID NO: 757036 - DNA, 22 bp, Artificial Sequence
  chemically synthesized
gtttcgaactcttgacgtccag

SEQ ID NO: 757037 - DNA, 22 bp, Artificial Sequence
  chemically synthesized
aaacaggcagatccctggacgt

SEQ ID NO: 757038 - DNA, 22 bp, Artificial Sequence
  chemically synthesized
cgaactcttgacgtccagggat

SEQ ID NO: 757039 - DNA, 22 bp, Artificial Sequence
  chemically synthesized
gaactcttgacgtccagggatc

SEQ ID NO: 757040 - DNA, 22 bp, Artificial Sequence
  chemically synthesized
ggtggctgaaacaggcagatcc

SEQ ID NO: 757041 - DNA, 22 bp, Artificial Sequence
  chemically synthesized
ttgacgtccagggatctgcctg

SEQ ID NO: 757042 - DNA, 22 bp, Artificial Sequence
  chemically synthesized
gggtggctgaaacaggcagatc

SEQ ID NO: 757043 - DNA, 22 bp, Artificial Sequence
  chemically synthesized
tgggtggctgaaacaggcagat

SEQ ID NO: 757044 - DNA, 22 bp, Artificial Sequence
  chemically synthesized
gacgtccagggatctgcctgtt

SEQ ID NO: 757045 - DNA, 22 bp, Artificial Sequence
  chemically synthesized
acgtccagggatctgcctgttt

SEQ ID NO: 757046 - DNA, 22 bp, Artificial Sequence
  chemically synthesized
taatcccagcactttgggtggc

SEQ ID NO: 757047 - DNA, 22 bp, Artificial Sequence
  chemically synthesized
cctgtttcagccacccaaagtg

SEQ ID NO: 757048 - DNA, 22 bp, Artificial Sequence
  chemically synthesized
tttcagccacccaaagtgctgg

SEQ ID NO: 757049 - DNA, 22 bp, Artificial Sequence
  chemically synthesized
atgcctgtaatcccagcacttt

SEQ ID NO: 757050 - DNA, 22 bp, Artificial Sequence
  chemically synthesized
cagccacccaaagtgctgggat

SEQ ID NO: 757051 - DNA, 22 bp, Artificial Sequence
  chemically synthesized
agccacccaaagtgctgggatt

SEQ ID NO: 757052 - DNA, 22 bp, Artificial Sequence
  chemically synthesized
ggattacaggcatgagccactg

SEQ ID NO: 757053 - DNA, 22 bp, Artificial Sequence
  chemically synthesized
tgtgaggccgggtgcagtggct

SEQ ID NO: 757054 - DNA, 22 bp, Artificial Sequence
  chemically synthesized
gtgtgaggccgggtgcagtggc

SEQ ID NO: 757055 - DNA, 22 bp, Artificial Sequence
  chemically synthesized
caggcatgagccactgcacccg

SEQ ID NO: 757056 - DNA, 22 bp, Artificial Sequence
  chemically synthesized
gggtaaagacttgtgtgaggcc

SEQ ID NO: 757057 - DNA, 22 bp, Artificial Sequence
  chemically synthesized
ggggtaaagacttgtgtgaggc

SEQ ID NO: 757058 - DNA, 22 bp, Artificial Sequence
  chemically synthesized
tggggtaaagacttgtgtgagg

SEQ ID NO: 757059 - DNA, 22 bp, Artificial Sequence
  chemically synthesized
ttttggggtaaagacttgtgtg

SEQ ID NO: 757060 - DNA, 22 bp, Artificial Sequence
  chemically synthesized
cacccggcctcacacaagtctt

SEQ ID NO: 757061 - DNA, 22 bp, Artificial Sequence
  chemically synthesized
acacaagtctttaccccaaaat

SEQ ID NO: 757062 - DNA, 22 bp, Artificial Sequence
  chemically synthesized
tgtgaggaggttattttggggt

SEQ ID NO: 757063 - DNA, 22 bp, Artificial Sequence
  chemically synthesized
gcctatgtgaggaggttatttt

SEQ ID NO: 757064 - DNA, 22 bp, Artificial Sequence
  chemically synthesized
taccccaaaataacctcctcac

SEQ ID NO: 757065 - DNA, 22 bp, Artificial Sequence
  chemically synthesized
accccaaaataacctcctcaca

SEQ ID NO: 757066 - DNA, 22 bp, Artificial Sequence
  chemically synthesized
ccccaaaataacctcctcacat

SEQ ID NO: 757067 - DNA, 22 bp, Artificial Sequence
  chemically synthesized
aggagtactggcctatgtgagg

SEQ ID NO: 757068 - DNA, 22 bp, Artificial Sequence
  chemically synthesized
ctcacataggccagtactcctc

SEQ ID NO: 757069 - DNA, 22 bp, Artificial Sequence
  chemically synthesized
acataggccagtactcctcaat

SEQ ID NO: 757070 - DNA, 22 bp, Artificial Sequence
  chemically synthesized
ctcaatctttctctattcatgc

SEQ ID NO: 757071 - DNA, 22 bp, Artificial Sequence
  chemically synthesized
aatctttctctattcatgcttt

SEQ ID NO: 757072 - DNA, 22 bp, Artificial Sequence
  chemically synthesized
tgaagagaaaataaacaaagca

SEQ ID NO: 757073 - DNA, 22 bp, Artificial Sequence
  chemically synthesized
tctctattcatgctttgtttat

SEQ ID NO: 757074 - DNA, 22 bp, Artificial Sequence
  chemically synthesized
ctctattcatgctttgtttatt

SEQ ID NO: 757075 - DNA, 22 bp, Artificial Sequence
  chemically synthesized
tctattcatgctttgtttattt

SEQ ID NO: 757076 - DNA, 22 bp, Artificial Sequence
  chemically synthesized
tattcatgctttgtttattttc

SEQ ID NO: 757077 - DNA, 22 bp, Artificial Sequence
  chemically synthesized
ttcatgctttgtttattttctc

SEQ ID NO: 757078 - DNA, 22 bp, Artificial Sequence
  chemically synthesized
atgctttgtttattttctcttc

SEQ ID NO: 757079 - DNA, 22 bp, Artificial Sequence
  chemically synthesized
ggtagtaagtgctatgaagaga

SEQ ID NO: 757080 - DNA, 22 bp, Artificial Sequence
  chemically synthesized
tgtttattttctcttcatagca

SEQ ID NO: 757081 - DNA, 22 bp, Artificial Sequence
  chemically synthesized
gtttattttctcttcatagcac

SEQ ID NO: 757082 - DNA, 22 bp, Artificial Sequence
  chemically synthesized
tttattttctcttcatagcact

SEQ ID NO: 757083 - DNA, 22 bp, Artificial Sequence
  chemically synthesized
tgttgggtagtaagtgctatga

SEQ ID NO: 757084 - DNA, 22 bp, Artificial Sequence
  chemically synthesized
attttctcttcatagcacttac

SEQ ID NO: 757085 - DNA, 22 bp, Artificial Sequence
  chemically synthesized
ttttctcttcatagcacttact

SEQ ID NO: 757086 - DNA, 22 bp, Artificial Sequence
  chemically synthesized
tctcttcatagcacttactacc

SEQ ID NO: 757087 - DNA, 22 bp, Artificial Sequence
  chemically synthesized
ctcttcatagcacttactaccc

SEQ ID NO: 757088 - DNA, 22 bp, Artificial Sequence
  chemically synthesized
tcttcatagcacttactaccca

SEQ ID NO: 757089 - DNA, 22 bp, Artificial Sequence
  chemically synthesized
ttcatagcacttactacccaac

SEQ ID NO: 757090 - DNA, 22 bp, Artificial Sequence
  chemically synthesized
catagcacttactacccaacat

SEQ ID NO: 757091 - DNA, 22 bp, Artificial Sequence
  chemically synthesized
atatatgaaattatgttgggta

SEQ ID NO: 757092 - DNA, 22 bp, Artificial Sequence
  chemically synthesized
atagcacttactacccaacata

SEQ ID NO: 757093 - DNA, 22 bp, Artificial Sequence
  chemically synthesized
actacccaacataatttcatat

SEQ ID NO: 757094 - DNA, 22 bp, Artificial Sequence
  chemically synthesized
ctacccaacataatttcatata

SEQ ID NO: 757095 - DNA, 22 bp, Artificial Sequence
  chemically synthesized
cccaacataatttcatatatta

SEQ ID NO: 757096 - DNA, 22 bp, Artificial Sequence
  chemically synthesized
catatattaatttatgggttta

SEQ ID NO: 757097 - DNA, 22 bp, Artificial Sequence
  chemically synthesized
atatattaatttatgggtttac

SEQ ID NO: 757098 - DNA, 22 bp, Artificial Sequence
  chemically synthesized
gtgacagaaatacatagtaaac

SEQ ID NO: 757099 - DNA, 22 bp, Artificial Sequence
  chemically synthesized
agtgacagaaatacatagtaaa

SEQ ID NO: 757100 - DNA, 22 bp, Artificial Sequence
  chemically synthesized
tagtgacagaaatacatagtaa

SEQ ID NO: 757101 - DNA, 22 bp, Artificial Sequence
  chemically synthesized
atttatgggtttactatgtatt

SEQ ID NO: 757102 - DNA, 22 bp, Artificial Sequence
  chemically synthesized
gattttagtgacagaaatacat

SEQ ID NO: 757103 - DNA, 22 bp, Artificial Sequence
  chemically synthesized
atgggtttactatgtatttctg

SEQ ID NO: 757104 - DNA, 22 bp, Artificial Sequence
  chemically synthesized
agattttagtgacagaaataca

SEQ ID NO: 757105 - DNA, 22 bp, Artificial Sequence
  chemically synthesized
tgggtttactatgtatttctgt

SEQ ID NO: 757106 - DNA, 22 bp, Artificial Sequence
  chemically synthesized
actatgtatttctgtcactaaa

SEQ ID NO: 757107 - DNA, 22 bp, Artificial Sequence
  chemically synthesized
ctatgtatttctgtcactaaaa

SEQ ID NO: 757108 - DNA, 22 bp, Artificial Sequence
  chemically synthesized
tggatgtttagattttagtgac

SEQ ID NO: 757109 - DNA, 22 bp, Artificial Sequence
  chemically synthesized
tgtatttctgtcactaaaatct

SEQ ID NO: 757110 - DNA, 22 bp, Artificial Sequence
  chemically synthesized
cccctatggatgtttagatttt

SEQ ID NO: 757111 - DNA, 22 bp, Artificial Sequence
  chemically synthesized
tgcccctatggatgtttagatt

SEQ ID NO: 757112 - DNA, 22 bp, Artificial Sequence
  chemically synthesized
ctgtcactaaaatctaaacatc

SEQ ID NO: 757113 - DNA, 22 bp, Artificial Sequence
  chemically synthesized
tgtcactaaaatctaaacatcc

SEQ ID NO: 757114 - DNA, 22 bp, Artificial Sequence
  chemically synthesized
tcactaaaatctaaacatccat

SEQ ID NO: 757115 - DNA, 22 bp, Artificial Sequence
  chemically synthesized
aaatctaaacatccataggggc

SEQ ID NO: 757116 - DNA, 22 bp, Artificial Sequence
  chemically synthesized
aacatccataggggcagagact

SEQ ID NO: 757117 - DNA, 22 bp, Artificial Sequence
  chemically synthesized
gggaacaaaatgagtctctgcc

SEQ ID NO: 757118 - DNA, 22 bp, Artificial Sequence
  chemically synthesized
agcatatgttagggaacaaaat

SEQ ID NO: 757119 - DNA, 22 bp, Artificial Sequence
  chemically synthesized
tgttaagcatatgttagggaac

SEQ ID NO: 757120 - DNA, 22 bp, Artificial Sequence
  chemically synthesized
tatgttaagcatatgttaggga

SEQ ID NO: 757121 - DNA, 22 bp, Artificial Sequence
  chemically synthesized
ctctatgttaagcatatgttag

SEQ ID NO: 757122 - DNA, 22 bp, Artificial Sequence
  chemically synthesized
attttgttccctaacatatgct

SEQ ID NO: 757123 - DNA, 22 bp, Artificial Sequence
  chemically synthesized
tgttccctaacatatgcttaac

SEQ ID NO: 757124 - DNA, 22 bp, Artificial Sequence
  chemically synthesized
gttccctaacatatgcttaaca

SEQ ID NO: 757125 - DNA, 22 bp, Artificial Sequence
  chemically synthesized
ttccctaacatatgcttaacat

SEQ ID NO: 757126 - DNA, 22 bp, Artificial Sequence
  chemically synthesized
cctaacatatgcttaacataga

SEQ ID NO: 757127 - DNA, 22 bp, Artificial Sequence
  chemically synthesized
tgaagagcctactctatgttaa

SEQ ID NO: 757128 - DNA, 22 bp, Artificial Sequence
  chemically synthesized
atgaagagcctactctatgtta

SEQ ID NO: 757129 - DNA, 22 bp, Artificial Sequence
  chemically synthesized
tatgaagagcctactctatgtt

SEQ ID NO: 757130 - DNA, 22 bp, Artificial Sequence
  chemically synthesized
ttatgaagagcctactctatgt

SEQ ID NO: 757131 - DNA, 22 bp, Artificial Sequence
  chemically synthesized
acatatgcttaacatagagtag

SEQ ID NO: 757132 - DNA, 22 bp, Artificial Sequence
  chemically synthesized
tttatgaagagcctactctatg

SEQ ID NO: 757133 - DNA, 22 bp, Artificial Sequence
  chemically synthesized
ttttatgaagagcctactctat

SEQ ID NO: 757134 - DNA, 22 bp, Artificial Sequence
  chemically synthesized
tttttatgaagagcctactcta

SEQ ID NO: 757135 - DNA, 22 bp, Artificial Sequence
  chemically synthesized
aacatagagtaggctcttcata

SEQ ID NO: 757136 - DNA, 22 bp, Artificial Sequence
  chemically synthesized
aagaactttttttatgaagagc

SEQ ID NO: 757137 - DNA, 22 bp, Artificial Sequence
  chemically synthesized
acatagagtaggctcttcataa

SEQ ID NO: 757138 - DNA, 22 bp, Artificial Sequence
  chemically synthesized
caagaactttttttatgaagag

SEQ ID NO: 757139 - DNA, 22 bp, Artificial Sequence
  chemically synthesized
tcaagaactttttttatgaaga

SEQ ID NO: 757140 - DNA, 22 bp, Artificial Sequence
  chemically synthesized
tttcaagaactttttttatgaa

SEQ ID NO: 757141 - DNA, 22 bp, Artificial Sequence
  chemically synthesized
gttctttcaagaacttttttta

SEQ ID NO: 757142 - DNA, 22 bp, Artificial Sequence
  chemically synthesized
ttggttctttcaagaacttttt

SEQ ID NO: 757143 - DNA, 22 bp, Artificial Sequence
  chemically synthesized
attggttctttcaagaactttt

SEQ ID NO: 757144 - DNA, 22 bp, Artificial Sequence
  chemically synthesized
ttcataaaaaaagttcttgaaa

SEQ ID NO: 757145 - DNA, 22 bp, Artificial Sequence
  chemically synthesized
cataaaaaaagttcttgaaaga

SEQ ID NO: 757146 - DNA, 22 bp, Artificial Sequence
  chemically synthesized
gaatttattggttctttcaaga

SEQ ID NO: 757147 - DNA, 22 bp, Artificial Sequence
  chemically synthesized
ataaaaaaagttcttgaaagaa

SEQ ID NO: 757148 - DNA, 22 bp, Artificial Sequence
  chemically synthesized
ctagaatttattggttctttca

SEQ ID NO: 757149 - DNA, 22 bp, Artificial Sequence
  chemically synthesized
agattcctagaatttattggtt

SEQ ID NO: 757150 - DNA, 22 bp, Artificial Sequence
  chemically synthesized
ttgaaagaaccaataaattcta

SEQ ID NO: 757151 - DNA, 22 bp, Artificial Sequence
  chemically synthesized
gaaagaaccaataaattctagg

SEQ ID NO: 757152 - DNA, 22 bp, Artificial Sequence
  chemically synthesized
aaagaaccaataaattctagga

SEQ ID NO: 757153 - DNA, 22 bp, Artificial Sequence
  chemically synthesized
taccataactcagattcctaga

SEQ ID NO: 757154 - DNA, 22 bp, Artificial Sequence
  chemically synthesized
ggaaaaattataccataactca

SEQ ID NO: 757155 - DNA, 22 bp, Artificial Sequence
  chemically synthesized
aggaaaaattataccataactc

SEQ ID NO: 757156 - DNA, 22 bp, Artificial Sequence
  chemically synthesized
taggaaaaattataccataact

SEQ ID NO: 757157 - DNA, 22 bp, Artificial Sequence
  chemically synthesized
taggaatctgagttatggtata

SEQ ID NO: 757158 - DNA, 22 bp, Artificial Sequence
  chemically synthesized
ttttaggaaaaattataccata

SEQ ID NO: 757159 - DNA, 22 bp, Artificial Sequence
  chemically synthesized
ggaatctgagttatggtataat

SEQ ID NO: 757160 - DNA, 22 bp, Artificial Sequence
  chemically synthesized
agttatggtataatttttccta

SEQ ID NO: 757161 - DNA, 22 bp, Artificial Sequence
  chemically synthesized
tggtataatttttcctaaaata

SEQ ID NO: 757162 - DNA, 22 bp, Artificial Sequence
  chemically synthesized
tcccccaaaaacattattttag

SEQ ID NO: 757163 - DNA, 22 bp, Artificial Sequence
  chemically synthesized
gtcccccaaaaacattatttta

SEQ ID NO: 757164 - DNA, 22 bp, Artificial Sequence
  chemically synthesized
tgtcccccaaaaacattatttt

SEQ ID NO: 757165 - DNA, 22 bp, Artificial Sequence
  chemically synthesized
ttgtcccccaaaaacattattt

SEQ ID NO: 757166 - DNA, 22 bp, Artificial Sequence
  chemically synthesized
cttttgtcccccaaaaacatta

SEQ ID NO: 757167 - DNA, 22 bp, Artificial Sequence
  chemically synthesized
ccttttgtcccccaaaaacatt

SEQ ID NO: 757168 - DNA, 22 bp, Artificial Sequence
  chemically synthesized
ttcctaaaataatgtttttggg

SEQ ID NO: 757169 - DNA, 22 bp, Artificial Sequence
  chemically synthesized
ttccttttgtcccccaaaaaca

SEQ ID NO: 757170 - DNA, 22 bp, Artificial Sequence
  chemically synthesized
tcctaaaataatgtttttgggg

SEQ ID NO: 757171 - DNA, 22 bp, Artificial Sequence
  chemically synthesized
cctaaaataatgtttttggggg

SEQ ID NO: 757172 - DNA, 22 bp, Artificial Sequence
  chemically synthesized
ctaaaataatgtttttggggga

SEQ ID NO: 757173 - DNA, 22 bp, Artificial Sequence
  chemically synthesized
tgctcttccttttgtcccccaa

SEQ ID NO: 757174 - DNA, 22 bp, Artificial Sequence
  chemically synthesized
aaataatgtttttgggggacaa

SEQ ID NO: 757175 - DNA, 22 bp, Artificial Sequence
  chemically synthesized
tgtgctcttccttttgtccccc

SEQ ID NO: 757176 - DNA, 22 bp, Artificial Sequence
  chemically synthesized
ctgtgctcttccttttgtcccc

SEQ ID NO: 757177 - DNA, 22 bp, Artificial Sequence
  chemically synthesized
tctgtgctcttccttttgtccc

SEQ ID NO: 757178 - DNA, 22 bp, Artificial Sequence
  chemically synthesized
ttctgtgctcttccttttgtcc

SEQ ID NO: 757179 - DNA, 22 bp, Artificial Sequence
  chemically synthesized
tttctgtgctcttccttttgtc

SEQ ID NO: 757180 - DNA, 22 bp, Artificial Sequence
  chemically synthesized
ttttctgtgctcttccttttgt

SEQ ID NO: 757181 - DNA, 22 bp, Artificial Sequence
  chemically synthesized
atttttttctgtgctcttcctt

SEQ ID NO: 757182 - DNA, 22 bp, Artificial Sequence
  chemically synthesized
ttgggggacaaaaggaagagca

SEQ ID NO: 757183 - DNA, 22 bp, Artificial Sequence
  chemically synthesized
gatttttttctgtgctcttcct

SEQ ID NO: 757184 - DNA, 22 bp, Artificial Sequence
  chemically synthesized
tgggggacaaaaggaagagcac

SEQ ID NO: 757185 - DNA, 22 bp, Artificial Sequence
  chemically synthesized
gggggacaaaaggaagagcaca

SEQ ID NO: 757186 - DNA, 22 bp, Artificial Sequence
  chemically synthesized
ggggacaaaaggaagagcacag

SEQ ID NO: 757187 - DNA, 22 bp, Artificial Sequence
  chemically synthesized
caaatgatccccttgatttttt

SEQ ID NO: 757188 - DNA, 22 bp, Artificial Sequence
  chemically synthesized
attacaaatgatccccttgatt

SEQ ID NO: 757189 - DNA, 22 bp, Artificial Sequence
  chemically synthesized
aattacaaatgatccccttgat

SEQ ID NO: 757190 - DNA, 22 bp, Artificial Sequence
  chemically synthesized
atttaattacaaatgatcccct

SEQ ID NO: 757191 - DNA, 22 bp, Artificial Sequence
  chemically synthesized
ttcatttaattacaaatgatcc

SEQ ID NO: 757192 - DNA, 22 bp, Artificial Sequence
  chemically synthesized
cacacattattcatttaattac

SEQ ID NO: 757193 - DNA, 22 bp, Artificial Sequence
  chemically synthesized
acacacattattcatttaatta

SEQ ID NO: 757194 - DNA, 22 bp, Artificial Sequence
  chemically synthesized
tacacacattattcatttaatt

SEQ ID NO: 757195 - DNA, 22 bp, Artificial Sequence
  chemically synthesized
ttacacacattattcatttaat

SEQ ID NO: 757196 - DNA, 22 bp, Artificial Sequence
  chemically synthesized
gtaattaaatgaataatgtgtg

SEQ ID NO: 757197 - DNA, 22 bp, Artificial Sequence
  chemically synthesized
taattaaatgaataatgtgtgt

SEQ ID NO: 757198 - DNA, 22 bp, Artificial Sequence
  chemically synthesized
acaaagcacttttacacacatt

SEQ ID NO: 757199 - DNA, 22 bp, Artificial Sequence
  chemically synthesized
gacaaagcacttttacacacat

SEQ ID NO: 757200 - DNA, 22 bp, Artificial Sequence
  chemically synthesized
aatgaataatgtgtgtaaaagt

SEQ ID NO: 757201 - DNA, 22 bp, Artificial Sequence
  chemically synthesized
ccttgacaaagcacttttacac

SEQ ID NO: 757202 - DNA, 22 bp, Artificial Sequence
  chemically synthesized
gccttgacaaagcacttttaca

SEQ ID NO: 757203 - DNA, 22 bp, Artificial Sequence
  chemically synthesized
tgccttgacaaagcacttttac

SEQ ID NO: 757204 - DNA, 22 bp, Artificial Sequence
  chemically synthesized
catagtgttttgccttgacaaa

SEQ ID NO: 757205 - DNA, 22 bp, Artificial Sequence
  chemically synthesized
aaacagtatctgcatagtgttt

SEQ ID NO: 757206 - DNA, 22 bp, Artificial Sequence
  chemically synthesized
aaaacagtatctgcatagtgtt

SEQ ID NO: 757207 - DNA, 22 bp, Artificial Sequence
  chemically synthesized
tgtcaaggcaaaacactatgca

SEQ ID NO: 757208 - DNA, 22 bp, Artificial Sequence
  chemically synthesized
taaaacagtatctgcatagtgt

SEQ ID NO: 757209 - DNA, 22 bp, Artificial Sequence
  chemically synthesized
gtcaaggcaaaacactatgcag

SEQ ID NO: 757210 - DNA, 22 bp, Artificial Sequence
  chemically synthesized
tcaaggcaaaacactatgcaga

SEQ ID NO: 757211 - DNA, 22 bp, Artificial Sequence
  chemically synthesized
tttaaaacagtatctgcatagt

SEQ ID NO: 757212 - DNA, 22 bp, Artificial Sequence
  chemically synthesized
acaaatactctttaaaacagta

SEQ ID NO: 757213 - DNA, 22 bp, Artificial Sequence
  chemically synthesized
tgcagatactgttttaaagagt

SEQ ID NO: 757214 - DNA, 22 bp, Artificial Sequence
  chemically synthesized
atgtcctgacaaatactcttta

SEQ ID NO: 757215 - DNA, 22 bp, Artificial Sequence
  chemically synthesized
gatgtcctgacaaatactcttt

SEQ ID NO: 757216 - DNA, 22 bp, Artificial Sequence
  chemically synthesized
tgatgtcctgacaaatactctt

SEQ ID NO: 757217 - DNA, 22 bp, Artificial Sequence
  chemically synthesized
ttttaaagagtatttgtcagga

SEQ ID NO: 757218 - DNA, 22 bp, Artificial Sequence
  chemically synthesized
taaagagtatttgtcaggacat

SEQ ID NO: 757219 - DNA, 22 bp, Artificial Sequence
  chemically synthesized
aaagagtatttgtcaggacatc

SEQ ID NO: 757220 - DNA, 22 bp, Artificial Sequence
  chemically synthesized
tcaaaatattttgatgtcctga

SEQ ID NO: 757221 - DNA, 22 bp, Artificial Sequence
  chemically synthesized
aagagtatttgtcaggacatca

SEQ ID NO: 757222 - DNA, 22 bp, Artificial Sequence
  chemically synthesized
gtcaaaatattttgatgtcctg

SEQ ID NO: 757223 - DNA, 22 bp, Artificial Sequence
  chemically synthesized
tgtcaaaatattttgatgtcct

SEQ ID NO: 757224 - DNA, 22 bp, Artificial Sequence
  chemically synthesized
actttgtcaaaatattttgatg

SEQ ID NO: 757225 - DNA, 22 bp, Artificial Sequence
  chemically synthesized
tcactttgtcaaaatattttga

SEQ ID NO: 757226 - DNA, 22 bp, Artificial Sequence
  chemically synthesized
tctcactttgtcaaaatatttt

SEQ ID NO: 757227 - DNA, 22 bp, Artificial Sequence
  chemically synthesized
gtcaggacatcaaaatattttg

SEQ ID NO: 757228 - DNA, 22 bp, Artificial Sequence
  chemically synthesized
tcaggacatcaaaatattttga

SEQ ID NO: 757229 - DNA, 22 bp, Artificial Sequence
  chemically synthesized
tctctcactttgtcaaaatatt

SEQ ID NO: 757230 - DNA, 22 bp, Artificial Sequence
  chemically synthesized
ctctctcactttgtcaaaatat

SEQ ID NO: 757231 - DNA, 22 bp, Artificial Sequence
  chemically synthesized
ccagtcttctctctcactttgt

SEQ ID NO: 757232 - DNA, 22 bp, Artificial Sequence
  chemically synthesized
taccagtcttctctctcacttt

SEQ ID NO: 757233 - DNA, 22 bp, Artificial Sequence
  chemically synthesized
tctaccagtcttctctctcact

SEQ ID NO: 757234 - DNA, 22 bp, Artificial Sequence
  chemically synthesized
ctctaccagtcttctctctcac

SEQ ID NO: 757235 - DNA, 22 bp, Artificial Sequence
  chemically synthesized
acttctctaccagtcttctctc

SEQ ID NO: 757236 - DNA, 22 bp, Artificial Sequence
  chemically synthesized
tgacaaagtgagagagaagact

SEQ ID NO: 757237 - DNA, 22 bp, Artificial Sequence
  chemically synthesized
gacaaagtgagagagaagactg

SEQ ID NO: 757238 - DNA, 22 bp, Artificial Sequence
  chemically synthesized
acaaagtgagagagaagactgg

SEQ ID NO: 757239 - DNA, 22 bp, Artificial Sequence
  chemically synthesized
caaactgacttctctaccagtc

SEQ ID NO: 757240 - DNA, 22 bp, Artificial Sequence
  chemically synthesized
acaaactgacttctctaccagt

SEQ ID NO: 757241 - DNA, 22 bp, Artificial Sequence
  chemically synthesized
gtagagaagtcagtttgtaaat

SEQ ID NO: 757242 - DNA, 22 bp, Artificial Sequence
  chemically synthesized
taacaagatgagatgtgaataa

SEQ ID NO: 757243 - DNA, 22 bp, Artificial Sequence
  chemically synthesized
gtaaattattcacatctcatct

SEQ ID NO: 757244 - DNA, 22 bp, Artificial Sequence
  chemically synthesized
atgactgtaacaagatgagatg

SEQ ID NO: 757245 - DNA, 22 bp, Artificial Sequence
  chemically synthesized
taaattattcacatctcatctt

SEQ ID NO: 757246 - DNA, 22 bp, Artificial Sequence
  chemically synthesized
aatgactgtaacaagatgagat

SEQ ID NO: 757247 - DNA, 22 bp, Artificial Sequence
  chemically synthesized
taatgactgtaacaagatgaga

SEQ ID NO: 757248 - DNA, 22 bp, Artificial Sequence
  chemically synthesized
ctttaatgactgtaacaagatg

SEQ ID NO: 757249 - DNA, 22 bp, Artificial Sequence
  chemically synthesized
gctttaatgactgtaacaagat

SEQ ID NO: 757250 - DNA, 22 bp, Artificial Sequence
  chemically synthesized
tgctttaatgactgtaacaaga

SEQ ID NO: 757251 - DNA, 22 bp, Artificial Sequence
  chemically synthesized
ttcacatctcatcttgttacag

SEQ ID NO: 757252 - DNA, 22 bp, Artificial Sequence
  chemically synthesized
ctttgctttaatgactgtaaca

SEQ ID NO: 757253 - DNA, 22 bp, Artificial Sequence
  chemically synthesized
acatctcatcttgttacagtca

SEQ ID NO: 757254 - DNA, 22 bp, Artificial Sequence
  chemically synthesized
ctgctttgctttaatgactgta

SEQ ID NO: 757255 - DNA, 22 bp, Artificial Sequence
  chemically synthesized
atcttgttacagtcattaaagc

SEQ ID NO: 757256 - DNA, 22 bp, Artificial Sequence
  chemically synthesized
ggaattgctgctttgctttaat

SEQ ID NO: 757257 - DNA, 22 bp, Artificial Sequence
  chemically synthesized
gttacagtcattaaagcaaagc

SEQ ID NO: 757258 - DNA, 22 bp, Artificial Sequence
  chemically synthesized
ttacagtcattaaagcaaagca

SEQ ID NO: 757259 - DNA, 22 bp, Artificial Sequence
  chemically synthesized
cagtcattaaagcaaagcagca

SEQ ID NO: 757260 - DNA, 22 bp, Artificial Sequence
  chemically synthesized
agtcatctaggaattgctgctt

SEQ ID NO: 757261 - DNA, 22 bp, Artificial Sequence
  chemically synthesized
aagcaaagcagcaattcctaga

SEQ ID NO: 757262 - DNA, 22 bp, Artificial Sequence
  chemically synthesized
aagaactgagtcatctaggaat

SEQ ID NO: 757263 - DNA, 22 bp, Artificial Sequence
  chemically synthesized
tcatcaaaactgaagaactgag

SEQ ID NO: 757264 - DNA, 22 bp, Artificial Sequence
  chemically synthesized
atcatcaaaactgaagaactga

SEQ ID NO: 757265 - DNA, 22 bp, Artificial Sequence
  chemically synthesized
tatcatcaaaactgaagaactg

SEQ ID NO: 757266 - DNA, 22 bp, Artificial Sequence
  chemically synthesized
ctagatgactcagttcttcagt

SEQ ID NO: 757267 - DNA, 22 bp, Artificial Sequence
  chemically synthesized
gctttatcatcaaaactgaaga

SEQ ID NO: 757268 - DNA, 22 bp, Artificial Sequence
  chemically synthesized
gatgactcagttcttcagtttt

SEQ ID NO: 757269 - DNA, 22 bp, Artificial Sequence
  chemically synthesized
aaaactagctttatcatcaaaa

SEQ ID NO: 757270 - DNA, 22 bp, Artificial Sequence
  chemically synthesized
agttcttcagttttgatgataa

SEQ ID NO: 757271 - DNA, 22 bp, Artificial Sequence
  chemically synthesized
tgaaaactagctttatcatcaa

SEQ ID NO: 757272 - DNA, 22 bp, Artificial Sequence
  chemically synthesized
ctgaaaactagctttatcatca

SEQ ID NO: 757273 - DNA, 22 bp, Artificial Sequence
  chemically synthesized
ttcagttttgatgataaagcta

SEQ ID NO: 757274 - DNA, 22 bp, Artificial Sequence
  chemically synthesized
cagttttgatgataaagctagt

SEQ ID NO: 757275 - DNA, 22 bp, Artificial Sequence
  chemically synthesized
agtcttctgaaaactagcttta

SEQ ID NO: 757276 - DNA, 22 bp, Artificial Sequence
  chemically synthesized
agttttgatgataaagctagtt

SEQ ID NO: 757277 - DNA, 22 bp, Artificial Sequence
  chemically synthesized
tgatgataaagctagttttcag

SEQ ID NO: 757278 - DNA, 22 bp, Artificial Sequence
  chemically synthesized
agtctaagtcttctgaaaacta

SEQ ID NO: 757279 - DNA, 22 bp, Artificial Sequence
  chemically synthesized
gatgataaagctagttttcaga

SEQ ID NO: 757280 - DNA, 22 bp, Artificial Sequence
  chemically synthesized
atgataaagctagttttcagaa

SEQ ID NO: 757281 - DNA, 22 bp, Artificial Sequence
  chemically synthesized
aaaactaagtctaagtcttctg

SEQ ID NO: 757282 - DNA, 22 bp, Artificial Sequence
  chemically synthesized
tgaaaactaagtctaagtcttc

SEQ ID NO: 757283 - DNA, 22 bp, Artificial Sequence
  chemically synthesized
ctgaaaactaagtctaagtctt

SEQ ID NO: 757284 - DNA, 22 bp, Artificial Sequence
  chemically synthesized
gttttcagaagacttagactta

SEQ ID NO: 757285 - DNA, 22 bp, Artificial Sequence
  chemically synthesized
agtcttctgaaaactaagtcta

SEQ ID NO: 757286 - DNA, 22 bp, Artificial Sequence
  chemically synthesized
gagtcttctgaaaactaagtct

SEQ ID NO: 757287 - DNA, 22 bp, Artificial Sequence
  chemically synthesized
tcagaagacttagacttagttt

SEQ ID NO: 757288 - DNA, 22 bp, Artificial Sequence
  chemically synthesized
cagaagacttagacttagtttt

SEQ ID NO: 757289 - DNA, 22 bp, Artificial Sequence
  chemically synthesized
agaagacttagacttagttttc

SEQ ID NO: 757290 - DNA, 22 bp, Artificial Sequence
  chemically synthesized
ggcatttgagtcttctgaaaac

SEQ ID NO: 757291 - DNA, 22 bp, Artificial Sequence
  chemically synthesized
taggcatttgagtcttctgaaa

SEQ ID NO: 757292 - DNA, 22 bp, Artificial Sequence
  chemically synthesized
ctaggcatttgagtcttctgaa

SEQ ID NO: 757293 - DNA, 22 bp, Artificial Sequence
  chemically synthesized
agacttagttttcagaagactc

SEQ ID NO: 757294 - DNA, 22 bp, Artificial Sequence
  chemically synthesized
gacttagttttcagaagactca

SEQ ID NO: 757295 - DNA, 22 bp, Artificial Sequence
  chemically synthesized
catttctaggcatttgagtctt

SEQ ID NO: 757296 - DNA, 22 bp, Artificial Sequence
  chemically synthesized
agttttcagaagactcaaatgc

SEQ ID NO: 757297 - DNA, 22 bp, Artificial Sequence
  chemically synthesized
gttttcagaagactcaaatgcc

SEQ ID NO: 757298 - DNA, 22 bp, Artificial Sequence
  chemically synthesized
gaactgcatttctaggcatttg

SEQ ID NO: 757299 - DNA, 22 bp, Artificial Sequence
  chemically synthesized
agaactgcatttctaggcattt

SEQ ID NO: 757300 - DNA, 22 bp, Artificial Sequence
  chemically synthesized
tcagaagactcaaatgcctaga

SEQ ID NO: 757301 - DNA, 22 bp, Artificial Sequence
  chemically synthesized
tagaactgcatttctaggcatt

SEQ ID NO: 757302 - DNA, 22 bp, Artificial Sequence
  chemically synthesized
cagaagactcaaatgcctagaa

SEQ ID NO: 757303 - DNA, 22 bp, Artificial Sequence
  chemically synthesized
ttagaactgcatttctaggcat

SEQ ID NO: 757304 - DNA, 22 bp, Artificial Sequence
  chemically synthesized
agaagactcaaatgcctagaaa

SEQ ID NO: 757305 - DNA, 22 bp, Artificial Sequence
  chemically synthesized
tttttagaactgcatttctagg

SEQ ID NO: 757306 - DNA, 22 bp, Artificial Sequence
  chemically synthesized
aaatgcctagaaatgcagttct

SEQ ID NO: 757307 - DNA, 22 bp, Artificial Sequence
  chemically synthesized
aaaattatttttagaactgcat

SEQ ID NO: 757308 - DNA, 22 bp, Artificial Sequence
  chemically synthesized
aaaaattatttttagaactgca

SEQ ID NO: 757309 - DNA, 22 bp, Artificial Sequence
  chemically synthesized
gaaatgcagttctaaaaataat

SEQ ID NO: 757310 - DNA, 22 bp, Artificial Sequence
  chemically synthesized
aatagaaatgacttaaaaatta

SEQ ID NO: 757311 - DNA, 22 bp, Artificial Sequence
  chemically synthesized
taaaaataatttttaagtcatt

SEQ ID NO: 757312 - DNA, 22 bp, Artificial Sequence
  chemically synthesized
aaaataatttttaagtcatttc

SEQ ID NO: 757313 - DNA, 22 bp, Artificial Sequence
  chemically synthesized
gggatgctgaatagaaatgact

SEQ ID NO: 757314 - DNA, 22 bp, Artificial Sequence
  chemically synthesized
agggatgctgaatagaaatgac

SEQ ID NO: 757315 - DNA, 22 bp, Artificial Sequence
  chemically synthesized
ttaagtcatttctattcagcat

SEQ ID NO: 757316 - DNA, 22 bp, Artificial Sequence
  chemically synthesized
taagtcatttctattcagcatc

SEQ ID NO: 757317 - DNA, 22 bp, Artificial Sequence
  chemically synthesized
aagtcatttctattcagcatcc

SEQ ID NO: 757318 - DNA, 22 bp, Artificial Sequence
  chemically synthesized
agtcatttctattcagcatccc

SEQ ID NO: 757319 - DNA, 22 bp, Artificial Sequence
  chemically synthesized
tgcagtcatatttagggatgct

SEQ ID NO: 757320 - DNA, 22 bp, Artificial Sequence
  chemically synthesized
ctattcagcatccctaaatatg

SEQ ID NO: 757321 - DNA, 22 bp, Artificial Sequence
  chemically synthesized
tattcagcatccctaaatatga

SEQ ID NO: 757322 - DNA, 22 bp, Artificial Sequence
  chemically synthesized
atatcctatgcagtcatattta

SEQ ID NO: 757323 - DNA, 22 bp, Artificial Sequence
  chemically synthesized
ttcagcatccctaaatatgact

SEQ ID NO: 757324 - DNA, 22 bp, Artificial Sequence
  chemically synthesized
gatatcctatgcagtcatattt

SEQ ID NO: 757325 - DNA, 22 bp, Artificial Sequence
  chemically synthesized
agcatccctaaatatgactgca

SEQ ID NO: 757326 - DNA, 22 bp, Artificial Sequence
  chemically synthesized
tataagtttgatatcctatgca

SEQ ID NO: 757327 - DNA, 22 bp, Artificial Sequence
  chemically synthesized
gtataagtttgatatcctatgc

SEQ ID NO: 757328 - DNA, 22 bp, Artificial Sequence
  chemically synthesized
tgtataagtttgatatcctatg

SEQ ID NO: 757329 - DNA, 22 bp, Artificial Sequence
  chemically synthesized
ttgtataagtttgatatcctat

SEQ ID NO: 757330 - DNA, 22 bp, Artificial Sequence
  chemically synthesized
aatatgactgcataggatatca

SEQ ID NO: 757331 - DNA, 22 bp, Artificial Sequence
  chemically synthesized
atcatttttgtataagtttgat

SEQ ID NO: 757332 - DNA, 22 bp, Artificial Sequence
  chemically synthesized
catcatttttgtataagtttga

SEQ ID NO: 757333 - DNA, 22 bp, Artificial Sequence
  chemically synthesized
ttcatcatttttgtataagttt

SEQ ID NO: 757334 - DNA, 22 bp, Artificial Sequence
  chemically synthesized
cataggatatcaaacttataca

SEQ ID NO: 757335 - DNA, 22 bp, Artificial Sequence
  chemically synthesized
ttcttcatcatttttgtataag

SEQ ID NO: 757336 - DNA, 22 bp, Artificial Sequence
  chemically synthesized
atctattcttcatcatttttgt

SEQ ID NO: 757337 - DNA, 22 bp, Artificial Sequence
  chemically synthesized
gatctattcttcatcatttttg

SEQ ID NO: 757338 - DNA, 22 bp, Artificial Sequence
  chemically synthesized
tgatctattcttcatcattttt

SEQ ID NO: 757339 - DNA, 22 bp, Artificial Sequence
  chemically synthesized
ttgatctattcttcatcatttt

SEQ ID NO: 757340 - DNA, 22 bp, Artificial Sequence
  chemically synthesized
tttgatctattcttcatcattt

SEQ ID NO: 757341 - DNA, 22 bp, Artificial Sequence
  chemically synthesized
atacaaaaatgatgaagaatag

SEQ ID NO: 757342 - DNA, 22 bp, Artificial Sequence
  chemically synthesized
tacaaaaatgatgaagaataga

SEQ ID NO: 757343 - DNA, 22 bp, Artificial Sequence
  chemically synthesized
gaggaaatagacgtctttttga

SEQ ID NO: 757344 - DNA, 22 bp, Artificial Sequence
  chemically synthesized
gccgcgttggaggaaatagacg

SEQ ID NO: 757345 - DNA, 22 bp, Artificial Sequence
  chemically synthesized
agccgcgttggaggaaatagac

SEQ ID NO: 757346 - DNA, 22 bp, Artificial Sequence
  chemically synthesized
tagccgcgttggaggaaataga

SEQ ID NO: 757347 - DNA, 22 bp, Artificial Sequence
  chemically synthesized
ttagccgcgttggaggaaatag

SEQ ID NO: 757348 - DNA, 22 bp, Artificial Sequence
  chemically synthesized
tttagccgcgttggaggaaata

SEQ ID NO: 757349 - DNA, 22 bp, Artificial Sequence
  chemically synthesized
aggtgtctttttagccgcgttg

SEQ ID NO: 757350 - DNA, 22 bp, Artificial Sequence
  chemically synthesized
taaggtgtctttttagccgcgt

SEQ ID NO: 757351 - DNA, 22 bp, Artificial Sequence
  chemically synthesized
tttcctccaacgcggctaaaaa

SEQ ID NO: 757352 - DNA, 22 bp, Artificial Sequence
  chemically synthesized
ctctaaggtgtctttttagccg

SEQ ID NO: 757353 - DNA, 22 bp, Artificial Sequence
  chemically synthesized
cctccaacgcggctaaaaagac

SEQ ID NO: 757354 - DNA, 22 bp, Artificial Sequence
  chemically synthesized
ctccaacgcggctaaaaagaca

SEQ ID NO: 757355 - DNA, 22 bp, Artificial Sequence
  chemically synthesized
tatctactctaaggtgtctttt

SEQ ID NO: 757356 - DNA, 22 bp, Artificial Sequence
  chemically synthesized
caacgcggctaaaaagacacct

SEQ ID NO: 757357 - DNA, 22 bp, Artificial Sequence
  chemically synthesized
gttatatctactctaaggtgtc

SEQ ID NO: 757358 - DNA, 22 bp, Artificial Sequence
  chemically synthesized
ttagttatatctactctaaggt

SEQ ID NO: 757359 - DNA, 22 bp, Artificial Sequence
  chemically synthesized
actgttagttatatctactcta

SEQ ID NO: 757360 - DNA, 22 bp, Artificial Sequence
  chemically synthesized
aaaagacaccttagagtagata

SEQ ID NO: 757361 - DNA, 22 bp, Artificial Sequence
  chemically synthesized
gactgttagttatatctactct

SEQ ID NO: 757362 - DNA, 22 bp, Artificial Sequence
  chemically synthesized
aaccacttgactgttagttata

SEQ ID NO: 757363 - DNA, 22 bp, Artificial Sequence
  chemically synthesized
taaaccacttgactgttagtta

SEQ ID NO: 757364 - DNA, 22 bp, Artificial Sequence
  chemically synthesized
ctaaaccacttgactgttagtt

SEQ ID NO: 757365 - DNA, 22 bp, Artificial Sequence
  chemically synthesized
agagtagatataactaacagtc

SEQ ID NO: 757366 - DNA, 22 bp, Artificial Sequence
  chemically synthesized
gagtagatataactaacagtca

SEQ ID NO: 757367 - DNA, 22 bp, Artificial Sequence
  chemically synthesized
gagtttctaaaccacttgactg

SEQ ID NO: 757368 - DNA, 22 bp, Artificial Sequence
  chemically synthesized
agagtttctaaaccacttgact

SEQ ID NO: 757369 - DNA, 22 bp, Artificial Sequence
  chemically synthesized
ttagagtttctaaaccacttga

SEQ ID NO: 757370 - DNA, 22 bp, Artificial Sequence
  chemically synthesized
gcctcttagagtttctaaacca

SEQ ID NO: 757371 - DNA, 22 bp, Artificial Sequence
  chemically synthesized
acagtcaagtggtttagaaact

SEQ ID NO: 757372 - DNA, 22 bp, Artificial Sequence
  chemically synthesized
aatgacctggcctcttagagtt

SEQ ID NO: 757373 - DNA, 22 bp, Artificial Sequence
  chemically synthesized
acattcaatgacctggcctctt

SEQ ID NO: 757374 - DNA, 22 bp, Artificial Sequence
  chemically synthesized
taacattcaatgacctggcctc

SEQ ID NO: 757375 - DNA, 22 bp, Artificial Sequence
  chemically synthesized
agaaactctaagaggccaggtc

SEQ ID NO: 757376 - DNA, 22 bp, Artificial Sequence
  chemically synthesized
gaaactctaagaggccaggtca

SEQ ID NO: 757377 - DNA, 22 bp, Artificial Sequence
  chemically synthesized
attctaacattcaatgacctgg

SEQ ID NO: 757378 - DNA, 22 bp, Artificial Sequence
  chemically synthesized
taagaggccaggtcattgaatg

SEQ ID NO: 757379 - DNA, 22 bp, Artificial Sequence
  chemically synthesized
agaggccaggtcattgaatgtt

SEQ ID NO: 757380 - DNA, 22 bp, Artificial Sequence
  chemically synthesized
aatgttagaatgaatcactctg

SEQ ID NO: 757381 - DNA, 22 bp, Artificial Sequence
  chemically synthesized
gaatgaatcactctggccgggc

SEQ ID NO: 757382 - DNA, 22 bp, Artificial Sequence
  chemically synthesized
caggcgtgagccaccgcgcccg

SEQ ID NO: 757383 - DNA, 22 bp, Artificial Sequence
  chemically synthesized
ggattacaggcgtgagccaccg

SEQ ID NO: 757384 - DNA, 22 bp, Artificial Sequence
  chemically synthesized
tggccgggcgcggtggctcacg

SEQ ID NO: 757385 - DNA, 22 bp, Artificial Sequence
  chemically synthesized
gccgggcgcggtggctcacgcc

SEQ ID NO: 757386 - DNA, 22 bp, Artificial Sequence
  chemically synthesized
ccaaagtgctgggattacaggc

SEQ ID NO: 757387 - DNA, 22 bp, Artificial Sequence
  chemically synthesized
agcctcccaaagtgctgggatt

SEQ ID NO: 757388 - DNA, 22 bp, Artificial Sequence
  chemically synthesized
acgcctgtaatcccagcacttt

SEQ ID NO: 757389 - DNA, 22 bp, Artificial Sequence
  chemically synthesized
taatcccagcactttgggaggc

SEQ ID NO: 757390 - DNA, 22 bp, Artificial Sequence
  chemically synthesized
gtgatccacccgcctcagcctc

SEQ ID NO: 757391 - DNA, 22 bp, Artificial Sequence
  chemically synthesized
acctcgtgatccacccgcctca

SEQ ID NO: 757392 - DNA, 22 bp, Artificial Sequence
  chemically synthesized
ctgacctcgtgatccacccgcc

SEQ ID NO: 757393 - DNA, 22 bp, Artificial Sequence
  chemically synthesized
tgggaggctgaggcgggtggat

SEQ ID NO: 757394 - DNA, 22 bp, Artificial Sequence
  chemically synthesized
gggaggctgaggcgggtggatc

SEQ ID NO: 757395 - DNA, 22 bp, Artificial Sequence
  chemically synthesized
ggaggctgaggcgggtggatca

SEQ ID NO: 757396 - DNA, 22 bp, Artificial Sequence
  chemically synthesized
gatctcctgacctcgtgatcca

SEQ ID NO: 757397 - DNA, 22 bp, Artificial Sequence
  chemically synthesized
aggcgggtggatcacgaggtca

SEQ ID NO: 757398 - DNA, 22 bp, Artificial Sequence
  chemically synthesized
gccaggatggtctcgatctcct

SEQ ID NO: 757399 - DNA, 22 bp, Artificial Sequence
  chemically synthesized
accgtgttagccaggatggtct

SEQ ID NO: 757400 - DNA, 22 bp, Artificial Sequence
  chemically synthesized
caccgtgttagccaggatggtc

SEQ ID NO: 757401 - DNA, 22 bp, Artificial Sequence
  chemically synthesized
gtagagacggggtttcaccgtg

SEQ ID NO: 757402 - DNA, 22 bp, Artificial Sequence
  chemically synthesized
agtagagacggggtttcaccgt

SEQ ID NO: 757403 - DNA, 22 bp, Artificial Sequence
  chemically synthesized
tagtagagacggggtttcaccg

SEQ ID NO: 757404 - DNA, 22 bp, Artificial Sequence
  chemically synthesized
ttagtagagacggggtttcacc

SEQ ID NO: 757405 - DNA, 22 bp, Artificial Sequence
  chemically synthesized
gctaacacggtgaaaccccgtc

SEQ ID NO: 757406 - DNA, 22 bp, Artificial Sequence
  chemically synthesized
tatttttagtagagacggggtt

SEQ ID NO: 757407 - DNA, 22 bp, Artificial Sequence
  chemically synthesized
gtatttttagtagagacggggt

SEQ ID NO: 757408 - DNA, 22 bp, Artificial Sequence
  chemically synthesized
tgtatttttagtagagacgggg

SEQ ID NO: 757409 - DNA, 22 bp, Artificial Sequence
  chemically synthesized
acacggtgaaaccccgtctcta

SEQ ID NO: 757410 - DNA, 22 bp, Artificial Sequence
  chemically synthesized
atgttttgtatttttagtagag

SEQ ID NO: 757411 - DNA, 22 bp, Artificial Sequence
  chemically synthesized
gctaatgttttgtatttttagt

SEQ ID NO: 757412 - DNA, 22 bp, Artificial Sequence
  chemically synthesized
tactaaaaatacaaaacattag

SEQ ID NO: 757413 - DNA, 22 bp, Artificial Sequence
  chemically synthesized
ctaaaaatacaaaacattagcc

SEQ ID NO: 757414 - DNA, 22 bp, Artificial Sequence
  chemically synthesized
aaaatacaaaacattagccagg

SEQ ID NO: 757415 - DNA, 22 bp, Artificial Sequence
  chemically synthesized
caggcacccaccaccacacctg

SEQ ID NO: 757416 - DNA, 22 bp, Artificial Sequence
  chemically synthesized
ggactacaggcacccaccacca

SEQ ID NO: 757417 - DNA, 22 bp, Artificial Sequence
  chemically synthesized
gccaggtgtggtggtgggtgcc

SEQ ID NO: 757418 - DNA, 22 bp, Artificial Sequence
  chemically synthesized
agctgggactacaggcacccac

SEQ ID NO: 757419 - DNA, 22 bp, Artificial Sequence
  chemically synthesized
cctcagctgggactacaggcac

SEQ ID NO: 757420 - DNA, 22 bp, Artificial Sequence
  chemically synthesized
ctgcctcagctgggactacagg

SEQ ID NO: 757421 - DNA, 22 bp, Artificial Sequence
  chemically synthesized
tcctgcctcagctgggactaca

SEQ ID NO: 757422 - DNA, 22 bp, Artificial Sequence
  chemically synthesized
ctcctgcctcagctgggactac

SEQ ID NO: 757423 - DNA, 22 bp, Artificial Sequence
  chemically synthesized
cttctcctgcctcagctgggac

SEQ ID NO: 757424 - DNA, 22 bp, Artificial Sequence
  chemically synthesized
tccttctcctgcctcagctggg

SEQ ID NO: 757425 - DNA, 22 bp, Artificial Sequence
  chemically synthesized
tagtcccagctgaggcaggaga

SEQ ID NO: 757426 - DNA, 22 bp, Artificial Sequence
  chemically synthesized
acgccattctccttctcctgcc

SEQ ID NO: 757427 - DNA, 22 bp, Artificial Sequence
  chemically synthesized
ggttcacgccattctccttctc

SEQ ID NO: 757428 - DNA, 22 bp, Artificial Sequence
  chemically synthesized
ctgggttcacgccattctcctt

SEQ ID NO: 757429 - DNA, 22 bp, Artificial Sequence
  chemically synthesized
aggcaggagaaggagaatggcg

SEQ ID NO: 757430 - DNA, 22 bp, Artificial Sequence
  chemically synthesized
cacctcctgggttcacgccatt

SEQ ID NO: 757431 - DNA, 22 bp, Artificial Sequence
  chemically synthesized
accgcaagctccacctcctggg

SEQ ID NO: 757432 - DNA, 22 bp, Artificial Sequence
  chemically synthesized
ggctcaccgcaagctccacctc

SEQ ID NO: 757433 - DNA, 22 bp, Artificial Sequence
  chemically synthesized
gagtgcagcggtgcgatctcgg

SEQ ID NO: 757434 - DNA, 22 bp, Artificial Sequence
  chemically synthesized
gcggtgagccgagatcgcaccg

SEQ ID NO: 757435 - DNA, 22 bp, Artificial Sequence
  chemically synthesized
cggtgagccgagatcgcaccgc

SEQ ID NO: 757436 - DNA, 22 bp, Artificial Sequence
  chemically synthesized
cagcccaggctggagtgcagcg

SEQ ID NO: 757437 - DNA, 22 bp, Artificial Sequence
  chemically synthesized
gcctgcagcccaggctggagtg

SEQ ID NO: 757438 - DNA, 22 bp, Artificial Sequence
  chemically synthesized
cactccagcctgggctgcaggc

SEQ ID NO: 757439 - DNA, 22 bp, Artificial Sequence
  chemically synthesized
agatggagtctcgcctgcagcc

SEQ ID NO: 757440 - DNA, 22 bp, Artificial Sequence
  chemically synthesized
gagatggagtctcgcctgcagc

SEQ ID NO: 757441 - DNA, 22 bp, Artificial Sequence
  chemically synthesized
tgagatggagtctcgcctgcag

SEQ ID NO: 757442 - DNA, 22 bp, Artificial Sequence
  chemically synthesized
ttgagatggagtctcgcctgca

SEQ ID NO: 757443 - DNA, 22 bp, Artificial Sequence
  chemically synthesized
tttgagatggagtctcgcctgc

SEQ ID NO: 757444 - DNA, 22 bp, Artificial Sequence
  chemically synthesized
cagcctgggctgcaggcgagac

SEQ ID NO: 757445 - DNA, 22 bp, Artificial Sequence
  chemically synthesized
ttttgagatggagtctcgcctg

SEQ ID NO: 757446 - DNA, 22 bp, Artificial Sequence
  chemically synthesized
tttttgagatggagtctcgcct

SEQ ID NO: 757447 - DNA, 22 bp, Artificial Sequence
  chemically synthesized
ttttttgagatggagtctcgcc

SEQ ID NO: 757448 - DNA, 22 bp, Artificial Sequence
  chemically synthesized
atttttttttgagatggagtct

SEQ ID NO: 757449 - DNA, 22 bp, Artificial Sequence
  chemically synthesized
ggctgcaggcgagactccatct

SEQ ID NO: 757450 - DNA, 22 bp, Artificial Sequence
  chemically synthesized
aatttttttttgagatggagtc

SEQ ID NO: 757451 - DNA, 22 bp, Artificial Sequence
  chemically synthesized
taatttttttttgagatggagt

SEQ ID NO: 757452 - DNA, 22 bp, Artificial Sequence
  chemically synthesized
tttaatttttttttgagatgga

SEQ ID NO: 757453 - DNA, 22 bp, Artificial Sequence
  chemically synthesized
ctttaatttttttttgagatgg

SEQ ID NO: 757454 - DNA, 22 bp, Artificial Sequence
  chemically synthesized
caggcgagactccatctcaaaa

SEQ ID NO: 757455 - DNA, 22 bp, Artificial Sequence
  chemically synthesized
tctttaatttttttttgagatg

SEQ ID NO: 757456 - DNA, 22 bp, Artificial Sequence
  chemically synthesized
ttctttaatttttttttgagat

SEQ ID NO: 757457 - DNA, 22 bp, Artificial Sequence
  chemically synthesized
tttctttaatttttttttgaga

SEQ ID NO: 757458 - DNA, 22 bp, Artificial Sequence
  chemically synthesized
ttttttctttaatttttttttg

SEQ ID NO: 757459 - DNA, 22 bp, Artificial Sequence
  chemically synthesized
attttttctttaattttttttt

SEQ ID NO: 757460 - DNA, 22 bp, Artificial Sequence
  chemically synthesized
tttattttttctttaatttttt

SEQ ID NO: 757461 - DNA, 22 bp, Artificial Sequence
  chemically synthesized
atttattttttctttaattttt

SEQ ID NO: 757462 - DNA, 22 bp, Artificial Sequence
  chemically synthesized
tatttattttttctttaatttt

SEQ ID NO: 757463 - DNA, 22 bp, Artificial Sequence
  chemically synthesized
catctcaaaaaaaaattaaaga

SEQ ID NO: 757464 - DNA, 22 bp, Artificial Sequence
  chemically synthesized
ttatttattttttctttaattt

SEQ ID NO: 757465 - DNA, 22 bp, Artificial Sequence
  chemically synthesized
tttatttattttttctttaatt

SEQ ID NO: 757466 - DNA, 22 bp, Artificial Sequence
  chemically synthesized
tttttatttattttttctttaa

SEQ ID NO: 757467 - DNA, 22 bp, Artificial Sequence
  chemically synthesized
ctttttatttattttttcttta

SEQ ID NO: 757468 - DNA, 22 bp, Artificial Sequence
  chemically synthesized
tctttttatttattttttcttt

SEQ ID NO: 757469 - DNA, 22 bp, Artificial Sequence
  chemically synthesized
aaaaaaaaattaaagaaaaaat

SEQ ID NO: 757470 - DNA, 22 bp, Artificial Sequence
  chemically synthesized
ttctttttatttattttttctt

SEQ ID NO: 757471 - DNA, 22 bp, Artificial Sequence
  chemically synthesized
ttttctttttatttattttttc

SEQ ID NO: 757472 - DNA, 22 bp, Artificial Sequence
  chemically synthesized
cttttctttttatttatttttt

SEQ ID NO: 757473 - DNA, 22 bp, Artificial Sequence
  chemically synthesized
tcttttctttttatttattttt

SEQ ID NO: 757474 - DNA, 22 bp, Artificial Sequence
  chemically synthesized
ttcttttctttttatttatttt

SEQ ID NO: 757475 - DNA, 22 bp, Artificial Sequence
  chemically synthesized
tttcttttctttttatttattt

SEQ ID NO: 757476 - DNA, 22 bp, Artificial Sequence
  chemically synthesized
ttttcttttctttttatttatt

SEQ ID NO: 757477 - DNA, 22 bp, Artificial Sequence
  chemically synthesized
ttttttcttttctttttattta

SEQ ID NO: 757478 - DNA, 22 bp, Artificial Sequence
  chemically synthesized
aagaaaaaataaataaaaagaa

SEQ ID NO: 757479 - DNA, 22 bp, Artificial Sequence
  chemically synthesized
attcttttttcttttcttttta

SEQ ID NO: 757480 - DNA, 22 bp, Artificial Sequence
  chemically synthesized
cgatagagtgattcattctttt

SEQ ID NO: 757481 - DNA, 22 bp, Artificial Sequence
  chemically synthesized
aaaaacaaccaaaagttgcgat

SEQ ID NO: 757482 - DNA, 22 bp, Artificial Sequence
  chemically synthesized
tgaaaaacaaccaaaagttgcg

SEQ ID NO: 757483 - DNA, 22 bp, Artificial Sequence
  chemically synthesized
tcacctctgaaaaacaaccaaa

SEQ ID NO: 757484 - DNA, 22 bp, Artificial Sequence
  chemically synthesized
tatcgcaacttttggttgtttt

SEQ ID NO: 757485 - DNA, 22 bp, Artificial Sequence
  chemically synthesized
tcgcaacttttggttgtttttc

SEQ ID NO: 757486 - DNA, 22 bp, Artificial Sequence
  chemically synthesized
cctatcacctctgaaaaacaac

SEQ ID NO: 757487 - DNA, 22 bp, Artificial Sequence
  chemically synthesized
ttccctatcacctctgaaaaac

SEQ ID NO: 757488 - DNA, 22 bp, Artificial Sequence
  chemically synthesized
ttggttgtttttcagaggtgat

SEQ ID NO: 757489 - DNA, 22 bp, Artificial Sequence
  chemically synthesized
tggttgtttttcagaggtgata

SEQ ID NO: 757490 - DNA, 22 bp, Artificial Sequence
  chemically synthesized
ggttgtttttcagaggtgatag

SEQ ID NO: 757491 - DNA, 22 bp, Artificial Sequence
  chemically synthesized
gttgtttttcagaggtgatagg

SEQ ID NO: 757492 - DNA, 22 bp, Artificial Sequence
  chemically synthesized
tttttcagaggtgatagggaac

SEQ ID NO: 757493 - DNA, 22 bp, Artificial Sequence
  chemically synthesized
agaaaaatgcgttgttccctat

SEQ ID NO: 757494 - DNA, 22 bp, Artificial Sequence
  chemically synthesized
ttcagaggtgatagggaacaac

SEQ ID NO: 757495 - DNA, 22 bp, Artificial Sequence
  chemically synthesized
tcagaggtgatagggaacaacg

SEQ ID NO: 757496 - DNA, 22 bp, Artificial Sequence
  chemically synthesized
cagaggtgatagggaacaacgc

SEQ ID NO: 757497 - DNA, 22 bp, Artificial Sequence
  chemically synthesized
agaggtgatagggaacaacgca

SEQ ID NO: 757498 - DNA, 22 bp, Artificial Sequence
  chemically synthesized
tgttaagaaaaatgcgttgttc

SEQ ID NO: 757499 - DNA, 22 bp, Artificial Sequence
  chemically synthesized
tgtgttaagaaaaatgcgttgt

SEQ ID NO: 757500 - DNA, 22 bp, Artificial Sequence
  chemically synthesized
agtcagctctgtgttaagaaaa

SEQ ID NO: 757501 - DNA, 22 bp, Artificial Sequence
  chemically synthesized
aagtcagctctgtgttaagaaa

SEQ ID NO: 757502 - DNA, 22 bp, Artificial Sequence
  chemically synthesized
agatttaagtcagctctgtgtt

SEQ ID NO: 757503 - DNA, 22 bp, Artificial Sequence
  chemically synthesized
ttcttaacacagagctgactta

SEQ ID NO: 757504 - DNA, 22 bp, Artificial Sequence
  chemically synthesized
tcttaacacagagctgacttaa

SEQ ID NO: 757505 - DNA, 22 bp, Artificial Sequence
  chemically synthesized
cttaacacagagctgacttaaa

SEQ ID NO: 757506 - DNA, 22 bp, Artificial Sequence
  chemically synthesized
tgaatgttaagatttaagtcag

SEQ ID NO: 757507 - DNA, 22 bp, Artificial Sequence
  chemically synthesized
ttaacacagagctgacttaaat

SEQ ID NO: 757508 - DNA, 22 bp, Artificial Sequence
  chemically synthesized
gtgaatgttaagatttaagtca

SEQ ID NO: 757509 - DNA, 22 bp, Artificial Sequence
  chemically synthesized
aacacagagctgacttaaatct

SEQ ID NO: 757510 - DNA, 22 bp, Artificial Sequence
  chemically synthesized
acacagagctgacttaaatctt

SEQ ID NO: 757511 - DNA, 22 bp, Artificial Sequence
  chemically synthesized
gatgtcatttgtgaatgttaag

SEQ ID NO: 757512 - DNA, 22 bp, Artificial Sequence
  chemically synthesized
ggatgtcatttgtgaatgttaa

SEQ ID NO: 757513 - DNA, 22 bp, Artificial Sequence
  chemically synthesized
tggatgtcatttgtgaatgtta

SEQ ID NO: 757514 - DNA, 22 bp, Artificial Sequence
  chemically synthesized
acttaaatcttaacattcacaa

SEQ ID NO: 757515 - DNA, 22 bp, Artificial Sequence
  chemically synthesized
aaatcttaacattcacaaatga

SEQ ID NO: 757516 - DNA, 22 bp, Artificial Sequence
  chemically synthesized
aatcttaacattcacaaatgac

SEQ ID NO: 757517 - DNA, 22 bp, Artificial Sequence
  chemically synthesized
aacattcacaaatgacatccaa

SEQ ID NO: 757518 - DNA, 22 bp, Artificial Sequence
  chemically synthesized
acattcacaaatgacatccaaa

SEQ ID NO: 757519 - DNA, 22 bp, Artificial Sequence
  chemically synthesized
cagaaagagaaaatatctttgg

SEQ ID NO: 757520 - DNA, 22 bp, Artificial Sequence
  chemically synthesized
acaaatgacatccaaagatatt

SEQ ID NO: 757521 - DNA, 22 bp, Artificial Sequence
  chemically synthesized
acagaaagagaaaatatctttg

SEQ ID NO: 757522 - DNA, 22 bp, Artificial Sequence
  chemically synthesized
tacagaaagagaaaatatcttt

SEQ ID NO: 757523 - DNA, 22 bp, Artificial Sequence
  chemically synthesized
ttacagaaagagaaaatatctt

SEQ ID NO: 757524 - DNA, 22 bp, Artificial Sequence
  chemically synthesized
tttacagaaagagaaaatatct

SEQ ID NO: 757525 - DNA, 22 bp, Artificial Sequence
  chemically synthesized
tttttacagaaagagaaaatat

SEQ ID NO: 757526 - DNA, 22 bp, Artificial Sequence
  chemically synthesized
ctttttacagaaagagaaaata

SEQ ID NO: 757527 - DNA, 22 bp, Artificial Sequence
  chemically synthesized
tctttttacagaaagagaaaat

SEQ ID NO: 757528 - DNA, 22 bp, Artificial Sequence
  chemically synthesized
tgttttctttttacagaaagag

SEQ ID NO: 757529 - DNA, 22 bp, Artificial Sequence
  chemically synthesized
tgtgttttctttttacagaaag

SEQ ID NO: 757530 - DNA, 22 bp, Artificial Sequence
  chemically synthesized
ctgtgttttctttttacagaaa

SEQ ID NO: 757531 - DNA, 22 bp, Artificial Sequence
  chemically synthesized
tctgtgttttctttttacagaa

SEQ ID NO: 757532 - DNA, 22 bp, Artificial Sequence
  chemically synthesized
tctctttctgtaaaaagaaaac

SEQ ID NO: 757533 - DNA, 22 bp, Artificial Sequence
  chemically synthesized
ctctttctgtaaaaagaaaaca

SEQ ID NO: 757534 - DNA, 22 bp, Artificial Sequence
  chemically synthesized
acgagttttctgtgttttcttt

SEQ ID NO: 757535 - DNA, 22 bp, Artificial Sequence
  chemically synthesized
tctttctgtaaaaagaaaacac

SEQ ID NO: 757536 - DNA, 22 bp, Artificial Sequence
  chemically synthesized
gacgagttttctgtgttttctt

SEQ ID NO: 757537 - DNA, 22 bp, Artificial Sequence
  chemically synthesized
tttctgtaaaaagaaaacacag

SEQ ID NO: 757538 - DNA, 22 bp, Artificial Sequence
  chemically synthesized
tctgtaaaaagaaaacacagaa

SEQ ID NO: 757539 - DNA, 22 bp, Artificial Sequence
  chemically synthesized
gcttgacgagttttctgtgttt

SEQ ID NO: 757540 - DNA, 22 bp, Artificial Sequence
  chemically synthesized
ctgtaaaaagaaaacacagaaa

SEQ ID NO: 757541 - DNA, 22 bp, Artificial Sequence
  chemically synthesized
tgtaaaaagaaaacacagaaaa

SEQ ID NO: 757542 - DNA, 22 bp, Artificial Sequence
  chemically synthesized
taaaaagaaaacacagaaaact

SEQ ID NO: 757543 - DNA, 22 bp, Artificial Sequence
  chemically synthesized
gtatgtatgttagcttgacgag

SEQ ID NO: 757544 - DNA, 22 bp, Artificial Sequence
  chemically synthesized
agtatgtatgttagcttgacga

SEQ ID NO: 757545 - DNA, 22 bp, Artificial Sequence
  chemically synthesized
tagtatgtatgttagcttgacg

SEQ ID NO: 757546 - DNA, 22 bp, Artificial Sequence
  chemically synthesized
gtcaagctaacatacatactaa

SEQ ID NO: 757547 - DNA, 22 bp, Artificial Sequence
  chemically synthesized
cgtgggatacattttagtatgt

SEQ ID NO: 757548 - DNA, 22 bp, Artificial Sequence
  chemically synthesized
acgtgggatacattttagtatg

SEQ ID NO: 757549 - DNA, 22 bp, Artificial Sequence
  chemically synthesized
cttacgtgggatacattttagt

SEQ ID NO: 757550 - DNA, 22 bp, Artificial Sequence
  chemically synthesized
acatacatactaaaatgtatcc

SEQ ID NO: 757551 - DNA, 22 bp, Artificial Sequence
  chemically synthesized
gcctgcttacgtgggatacatt

SEQ ID NO: 757552 - DNA, 22 bp, Artificial Sequence
  chemically synthesized
tcagtgctggcctgcttacgtg

SEQ ID NO: 757553 - DNA, 22 bp, Artificial Sequence
  chemically synthesized
aaatgtatcccacgtaagcagg

SEQ ID NO: 757554 - DNA, 22 bp, Artificial Sequence
  chemically synthesized
ttatcagtgctggcctgcttac

SEQ ID NO: 757555 - DNA, 22 bp, Artificial Sequence
  chemically synthesized
tgttatcagtgctggcctgctt

SEQ ID NO: 757556 - DNA, 22 bp, Artificial Sequence
  chemically synthesized
attctgttatcagtgctggcct

SEQ ID NO: 757557 - DNA, 22 bp, Artificial Sequence
  chemically synthesized
ggctcattctgttatcagtgct

SEQ ID NO: 757558 - DNA, 22 bp, Artificial Sequence
  chemically synthesized
aggctcattctgttatcagtgc

SEQ ID NO: 757559 - DNA, 22 bp, Artificial Sequence
  chemically synthesized
tttaggctcattctgttatcag

SEQ ID NO: 757560 - DNA, 22 bp, Artificial Sequence
  chemically synthesized
atttaggctcattctgttatca

SEQ ID NO: 757561 - DNA, 22 bp, Artificial Sequence
  chemically synthesized
tacatttatttaggctcattct

SEQ ID NO: 757562 - DNA, 22 bp, Artificial Sequence
  chemically synthesized
ataacagaatgagcctaaataa

SEQ ID NO: 757563 - DNA, 22 bp, Artificial Sequence
  chemically synthesized
tagattatacatttatttaggc

SEQ ID NO: 757564 - DNA, 22 bp, Artificial Sequence
  chemically synthesized
aaatcatgttgtagattataca

SEQ ID NO: 757565 - DNA, 22 bp, Artificial Sequence
  chemically synthesized
tcctgaaatcatgttgtagatt

SEQ ID NO: 757566 - DNA, 22 bp, Artificial Sequence
  chemically synthesized
aataaatgtataatctacaaca

SEQ ID NO: 757567 - DNA, 22 bp, Artificial Sequence
  chemically synthesized
aataaaattatcctgaaatcat

SEQ ID NO: 757568 - DNA, 22 bp, Artificial Sequence
  chemically synthesized
caacatgatttcaggataattt

SEQ ID NO: 757569 - DNA, 22 bp, Artificial Sequence
  chemically synthesized
agaaattcaataaaattatcct

SEQ ID NO: 757570 - DNA, 22 bp, Artificial Sequence
  chemically synthesized
caggataattttattgaatttc

SEQ ID NO: 757571 - DNA, 22 bp, Artificial Sequence
  chemically synthesized
aggataattttattgaatttct

SEQ ID NO: 757572 - DNA, 22 bp, Artificial Sequence
  chemically synthesized
tattgaatttctcagcctgtct

SEQ ID NO: 757573 - DNA, 22 bp, Artificial Sequence
  chemically synthesized
attgaatttctcagcctgtctc

SEQ ID NO: 757574 - DNA, 22 bp, Artificial Sequence
  chemically synthesized
ttgaatttctcagcctgtctct

SEQ ID NO: 757575 - DNA, 22 bp, Artificial Sequence
  chemically synthesized
aatttctcagcctgtctctcac

SEQ ID NO: 757576 - DNA, 22 bp, Artificial Sequence
  chemically synthesized
agaagtcaccacaaagtgagag

SEQ ID NO: 757577 - DNA, 22 bp, Artificial Sequence
  chemically synthesized
cagaagtcaccacaaagtgaga

SEQ ID NO: 757578 - DNA, 22 bp, Artificial Sequence
  chemically synthesized
ctcagcctgtctctcactttgt

SEQ ID NO: 757579 - DNA, 22 bp, Artificial Sequence
  chemically synthesized
tcagcctgtctctcactttgtg

SEQ ID NO: 757580 - DNA, 22 bp, Artificial Sequence
  chemically synthesized
ttcagaagtcaccacaaagtga

SEQ ID NO: 757581 - DNA, 22 bp, Artificial Sequence
  chemically synthesized
cttcagaagtcaccacaaagtg

SEQ ID NO: 757582 - DNA, 22 bp, Artificial Sequence
  chemically synthesized
agcctgtctctcactttgtggt

SEQ ID NO: 757583 - DNA, 22 bp, Artificial Sequence
  chemically synthesized
gatttcttcagaagtcaccaca

SEQ ID NO: 757584 - DNA, 22 bp, Artificial Sequence
  chemically synthesized
tctctcactttgtggtgacttc

SEQ ID NO: 757585 - DNA, 22 bp, Artificial Sequence
  chemically synthesized
tcactttgtggtgacttctgaa

SEQ ID NO: 757586 - DNA, 22 bp, Artificial Sequence
  chemically synthesized
actttgtggtgacttctgaaga

SEQ ID NO: 757587 - DNA, 22 bp, Artificial Sequence
  chemically synthesized
tgcatgttcgatttcttcagaa

SEQ ID NO: 757588 - DNA, 22 bp, Artificial Sequence
  chemically synthesized
tgtggtgacttctgaagaaatc

SEQ ID NO: 757589 - DNA, 22 bp, Artificial Sequence
  chemically synthesized
gtggtgacttctgaagaaatcg

SEQ ID NO: 757590 - DNA, 22 bp, Artificial Sequence
  chemically synthesized
tggtgacttctgaagaaatcga

SEQ ID NO: 757591 - DNA, 22 bp, Artificial Sequence
  chemically synthesized
ctgaagaaatcgaacatgcata

SEQ ID NO: 757592 - DNA, 22 bp, Artificial Sequence
  chemically synthesized
tgaagaaatcgaacatgcataa

SEQ ID NO: 757593 - DNA, 22 bp, Artificial Sequence
  chemically synthesized
tcaggtcatatattatgcatgt

SEQ ID NO: 757594 - DNA, 22 bp, Artificial Sequence
  chemically synthesized
gtcaggtcatatattatgcatg

SEQ ID NO: 757595 - DNA, 22 bp, Artificial Sequence
  chemically synthesized
aagaaatcgaacatgcataata

SEQ ID NO: 757596 - DNA, 22 bp, Artificial Sequence
  chemically synthesized
atttgtcaggtcatatattatg

SEQ ID NO: 757597 - DNA, 22 bp, Artificial Sequence
  chemically synthesized
ttcatttgtcaggtcatatatt

SEQ ID NO: 757598 - DNA, 22 bp, Artificial Sequence
  chemically synthesized
gttcatttgtcaggtcatatat

SEQ ID NO: 757599 - DNA, 22 bp, Artificial Sequence
  chemically synthesized
cttgttcatttgtcaggtcata

SEQ ID NO: 757600 - DNA, 22 bp, Artificial Sequence
  chemically synthesized
acttgttcatttgtcaggtcat

SEQ ID NO: 757601 - DNA, 22 bp, Artificial Sequence
  chemically synthesized
aataaagtagtttacttgttca

SEQ ID NO: 757602 - DNA, 22 bp, Artificial Sequence
  chemically synthesized
gaataaagtagtttacttgttc

SEQ ID NO: 757603 - DNA, 22 bp, Artificial Sequence
  chemically synthesized
acaaatgaacaagtaaactact

SEQ ID NO: 757604 - DNA, 22 bp, Artificial Sequence
  chemically synthesized
acaaatgaaaaggcttgaataa

SEQ ID NO: 757605 - DNA, 22 bp, Artificial Sequence
  chemically synthesized
ttgacaaatgaaaaggcttgaa

SEQ ID NO: 757606 - DNA, 22 bp, Artificial Sequence
  chemically synthesized
ctttattcaagccttttcattt

SEQ ID NO: 757607 - DNA, 22 bp, Artificial Sequence
  chemically synthesized
gatgctgttgacaaatgaaaag

SEQ ID NO: 757608 - DNA, 22 bp, Artificial Sequence
  chemically synthesized
ggatgctgttgacaaatgaaaa

SEQ ID NO: 757609 - DNA, 22 bp, Artificial Sequence
  chemically synthesized
tattcaagccttttcatttgtc

SEQ ID NO: 757610 - DNA, 22 bp, Artificial Sequence
  chemically synthesized
attcaagccttttcatttgtca

SEQ ID NO: 757611 - DNA, 22 bp, Artificial Sequence
  chemically synthesized
cttggatgctgttgacaaatga

SEQ ID NO: 757612 - DNA, 22 bp, Artificial Sequence
  chemically synthesized
ttcaagccttttcatttgtcaa

SEQ ID NO: 757613 - DNA, 22 bp, Artificial Sequence
  chemically synthesized
ttgcttggatgctgttgacaaa

SEQ ID NO: 757614 - DNA, 22 bp, Artificial Sequence
  chemically synthesized
aagccttttcatttgtcaacag

SEQ ID NO: 757615 - DNA, 22 bp, Artificial Sequence
  chemically synthesized
ttcatttgtcaacagcatccaa

SEQ ID NO: 757616 - DNA, 22 bp, Artificial Sequence
  chemically synthesized
tcatttgtcaacagcatccaag

SEQ ID NO: 757617 - DNA, 22 bp, Artificial Sequence
  chemically synthesized
catttgtcaacagcatccaagc

SEQ ID NO: 757618 - DNA, 22 bp, Artificial Sequence
  chemically synthesized
atttgtcaacagcatccaagca

SEQ ID NO: 757619 - DNA, 22 bp, Artificial Sequence
  chemically synthesized
gtcaacagcatccaagcaataa

SEQ ID NO: 757620 - DNA, 22 bp, Artificial Sequence
  chemically synthesized
tcaacagcatccaagcaataat

SEQ ID NO: 757621 - DNA, 22 bp, Artificial Sequence
  chemically synthesized
aaagagtggacagaaagccatt

SEQ ID NO: 757622 - DNA, 22 bp, Artificial Sequence
  chemically synthesized
ttaaaagagtggacagaaagcc

SEQ ID NO: 757623 - DNA, 22 bp, Artificial Sequence
  chemically synthesized
tctgtccactcttttaataatg

SEQ ID NO: 757624 - DNA, 22 bp, Artificial Sequence
  chemically synthesized
ctgtccactcttttaataatgt

SEQ ID NO: 757625 - DNA, 22 bp, Artificial Sequence
  chemically synthesized
tgtccactcttttaataatgta

SEQ ID NO: 757626 - DNA, 22 bp, Artificial Sequence
  chemically synthesized
tccactcttttaataatgtatg

SEQ ID NO: 757627 - DNA, 22 bp, Artificial Sequence
  chemically synthesized
gatggaagtaatcaatacatac

SEQ ID NO: 757628 - DNA, 22 bp, Artificial Sequence
  chemically synthesized
agatggaagtaatcaatacata

SEQ ID NO: 757629 - DNA, 22 bp, Artificial Sequence
  chemically synthesized
ttttaataatgtatgtattgat

SEQ ID NO: 757630 - DNA, 22 bp, Artificial Sequence
  chemically synthesized
ttaataatgtatgtattgatta

SEQ ID NO: 757631 - DNA, 22 bp, Artificial Sequence
  chemically synthesized
taataatgtatgtattgattac

SEQ ID NO: 757632 - DNA, 22 bp, Artificial Sequence
  chemically synthesized
aataatgtatgtattgattact

SEQ ID NO: 757633 - DNA, 22 bp, Artificial Sequence
  chemically synthesized
ataatgtatgtattgattactt

SEQ ID NO: 757634 - DNA, 22 bp, Artificial Sequence
  chemically synthesized
agatttagatggaagtaatcaa

SEQ ID NO: 757635 - DNA, 22 bp, Artificial Sequence
  chemically synthesized
gttaagatttagatggaagtaa

SEQ ID NO: 757636 - DNA, 22 bp, Artificial Sequence
  chemically synthesized
tggttaagatttagatggaagt

SEQ ID NO: 757637 - DNA, 22 bp, Artificial Sequence
  chemically synthesized
ctggttaagatttagatggaag

SEQ ID NO: 757638 - DNA, 22 bp, Artificial Sequence
  chemically synthesized
tctggttaagatttagatggaa

SEQ ID NO: 757639 - DNA, 22 bp, Artificial Sequence
  chemically synthesized
attacttccatctaaatcttaa

SEQ ID NO: 757640 - DNA, 22 bp, Artificial Sequence
  chemically synthesized
ccgagattttctggttaagatt

SEQ ID NO: 757641 - DNA, 22 bp, Artificial Sequence
  chemically synthesized
cccgagattttctggttaagat

SEQ ID NO: 757642 - DNA, 22 bp, Artificial Sequence
  chemically synthesized
cttccatctaaatcttaaccag

SEQ ID NO: 757643 - DNA, 22 bp, Artificial Sequence
  chemically synthesized
ccatctaaatcttaaccagaaa

SEQ ID NO: 757644 - DNA, 22 bp, Artificial Sequence
  chemically synthesized
catctaaatcttaaccagaaaa

SEQ ID NO: 757645 - DNA, 22 bp, Artificial Sequence
  chemically synthesized
aaagcttcccgagattttctgg

SEQ ID NO: 757646 - DNA, 22 bp, Artificial Sequence
  chemically synthesized
caaagcttcccgagattttctg

SEQ ID NO: 757647 - DNA, 22 bp, Artificial Sequence
  chemically synthesized
aatcttaaccagaaaatctcgg

SEQ ID NO: 757648 - DNA, 22 bp, Artificial Sequence
  chemically synthesized
aaccagaaaatctcgggaagct

SEQ ID NO: 757649 - DNA, 22 bp, Artificial Sequence
  chemically synthesized
accagaaaatctcgggaagctt

SEQ ID NO: 757650 - DNA, 22 bp, Artificial Sequence
  chemically synthesized
aggataccttcaaagcttcccg

SEQ ID NO: 757651 - DNA, 22 bp, Artificial Sequence
  chemically synthesized
gagatcattaaggataccttca

SEQ ID NO: 757652 - DNA, 22 bp, Artificial Sequence
  chemically synthesized
gggaagctttgaaggtatcctt

SEQ ID NO: 757653 - DNA, 22 bp, Artificial Sequence
  chemically synthesized
cctagagatcattaaggatacc

SEQ ID NO: 757654 - DNA, 22 bp, Artificial Sequence
  chemically synthesized
ccctagagatcattaaggatac

SEQ ID NO: 757655 - DNA, 22 bp, Artificial Sequence
  chemically synthesized
tgaaggtatccttaatgatctc

SEQ ID NO: 757656 - DNA, 22 bp, Artificial Sequence
  chemically synthesized
gaaggtatccttaatgatctct

SEQ ID NO: 757657 - DNA, 22 bp, Artificial Sequence
  chemically synthesized
aaggtatccttaatgatctcta

SEQ ID NO: 757658 - DNA, 22 bp, Artificial Sequence
  chemically synthesized
taatcccttccctagagatcat

SEQ ID NO: 757659 - DNA, 22 bp, Artificial Sequence
  chemically synthesized
tataatcccttccctagagatc

SEQ ID NO: 757660 - DNA, 22 bp, Artificial Sequence
  chemically synthesized
aatgatctctagggaagggatt

SEQ ID NO: 757661 - DNA, 22 bp, Artificial Sequence
  chemically synthesized
atgatctctagggaagggatta

SEQ ID NO: 757662 - DNA, 22 bp, Artificial Sequence
  chemically synthesized
aaaaaatctctataatcccttc

SEQ ID NO: 757663 - DNA, 22 bp, Artificial Sequence
  chemically synthesized
aattaaaaaaatctctataatc

SEQ ID NO: 757664 - DNA, 22 bp, Artificial Sequence
  chemically synthesized
caattaaaaaaatctctataat

SEQ ID NO: 757665 - DNA, 22 bp, Artificial Sequence
  chemically synthesized
tcaattaaaaaaatctctataa

SEQ ID NO: 757666 - DNA, 22 bp, Artificial Sequence
  chemically synthesized
tagggaagggattatagagatt

SEQ ID NO: 757667 - DNA, 22 bp, Artificial Sequence
  chemically synthesized
gggaagggattatagagatttt

SEQ ID NO: 757668 - DNA, 22 bp, Artificial Sequence
  chemically synthesized
atctttcaattaaaaaaatctc

SEQ ID NO: 757669 - DNA, 22 bp, Artificial Sequence
  chemically synthesized
catctttcaattaaaaaaatct

SEQ ID NO: 757670 - DNA, 22 bp, Artificial Sequence
  chemically synthesized
tcatctttcaattaaaaaaatc

SEQ ID NO: 757671 - DNA, 22 bp, Artificial Sequence
  chemically synthesized
ggttttcatctttcaattaaaa

SEQ ID NO: 757672 - DNA, 22 bp, Artificial Sequence
  chemically synthesized
tagagatttttttaattgaaag

SEQ ID NO: 757673 - DNA, 22 bp, Artificial Sequence
  chemically synthesized
tcactaggttttcatctttcaa

SEQ ID NO: 757674 - DNA, 22 bp, Artificial Sequence
  chemically synthesized
gtcactaggttttcatctttca

SEQ ID NO: 757675 - DNA, 22 bp, Artificial Sequence
  chemically synthesized
tttgtcactaggttttcatctt

SEQ ID NO: 757676 - DNA, 22 bp, Artificial Sequence
  chemically synthesized
ttttaattgaaagatgaaaacc

SEQ ID NO: 757677 - DNA, 22 bp, Artificial Sequence
  chemically synthesized
tttaattgaaagatgaaaacct

SEQ ID NO: 757678 - DNA, 22 bp, Artificial Sequence
  chemically synthesized
ttaattgaaagatgaaaaccta

SEQ ID NO: 757679 - DNA, 22 bp, Artificial Sequence
  chemically synthesized
taattgaaagatgaaaacctag

SEQ ID NO: 757680 - DNA, 22 bp, Artificial Sequence
  chemically synthesized
aattgaaagatgaaaacctagt

SEQ ID NO: 757681 - DNA, 22 bp, Artificial Sequence
  chemically synthesized
attgaaagatgaaaacctagtg

SEQ ID NO: 757682 - DNA, 22 bp, Artificial Sequence
  chemically synthesized
atgaaattgtttgtcactaggt

SEQ ID NO: 757683 - DNA, 22 bp, Artificial Sequence
  chemically synthesized
aaagatgaaaacctagtgacaa

SEQ ID NO: 757684 - DNA, 22 bp, Artificial Sequence
  chemically synthesized
ctaatgaaattgtttgtcacta

SEQ ID NO: 757685 - DNA, 22 bp, Artificial Sequence
  chemically synthesized
actaatgaaattgtttgtcact

SEQ ID NO: 757686 - DNA, 22 bp, Artificial Sequence
  chemically synthesized
tactaatgaaattgtttgtcac

SEQ ID NO: 757687 - DNA, 22 bp, Artificial Sequence
  chemically synthesized
ttactaatgaaattgtttgtca

SEQ ID NO: 757688 - DNA, 22 bp, Artificial Sequence
  chemically synthesized
tttactaatgaaattgtttgtc

SEQ ID NO: 757689 - DNA, 22 bp, Artificial Sequence
  chemically synthesized
cctttttactaatgaaattgtt

SEQ ID NO: 757690 - DNA, 22 bp, Artificial Sequence
  chemically synthesized
gcctttttactaatgaaattgt

SEQ ID NO: 757691 - DNA, 22 bp, Artificial Sequence
  chemically synthesized
tttgcctttttactaatgaaat

SEQ ID NO: 757692 - DNA, 22 bp, Artificial Sequence
  chemically synthesized
gtttgcctttttactaatgaaa

SEQ ID NO: 757693 - DNA, 22 bp, Artificial Sequence
  chemically synthesized
gtgacaaacaatttcattagta

SEQ ID NO: 757694 - DNA, 22 bp, Artificial Sequence
  chemically synthesized
tgtttgcctttttactaatgaa

SEQ ID NO: 757695 - DNA, 22 bp, Artificial Sequence
  chemically synthesized
ttgtttgcctttttactaatga

SEQ ID NO: 757696 - DNA, 22 bp, Artificial Sequence
  chemically synthesized
tttgtttgcctttttactaatg

SEQ ID NO: 757697 - DNA, 22 bp, Artificial Sequence
  chemically synthesized
cattagtaaaaaggcaaacaaa

SEQ ID NO: 757698 - DNA, 22 bp, Artificial Sequence
  chemically synthesized
attagtaaaaaggcaaacaaaa

SEQ ID NO: 757699 - DNA, 22 bp, Artificial Sequence
  chemically synthesized
gtaaaaaggcaaacaaaaagtc

SEQ ID NO: 757700 - DNA, 22 bp, Artificial Sequence
  chemically synthesized
taacaacagtgtaggtaatgac

SEQ ID NO: 757701 - DNA, 22 bp, Artificial Sequence
  chemically synthesized
attgtaacaacagtgtaggtaa

SEQ ID NO: 757702 - DNA, 22 bp, Artificial Sequence
  chemically synthesized
gattgtaacaacagtgtaggta

SEQ ID NO: 757703 - DNA, 22 bp, Artificial Sequence
  chemically synthesized
gatcttgattgtaacaacagtg

SEQ ID NO: 757704 - DNA, 22 bp, Artificial Sequence
  chemically synthesized
cctacactgttgttacaatcaa

SEQ ID NO: 757705 - DNA, 22 bp, Artificial Sequence
  chemically synthesized
cactgttgttacaatcaagatc

SEQ ID NO: 757706 - DNA, 22 bp, Artificial Sequence
  chemically synthesized
ttgttacaatcaagatctaatc

SEQ ID NO: 757707 - DNA, 22 bp, Artificial Sequence
  chemically synthesized
ttacaatcaagatctaatctcc

SEQ ID NO: 757708 - DNA, 22 bp, Artificial Sequence
  chemically synthesized
ccccaaatccaaatggagatta

SEQ ID NO: 757709 - DNA, 22 bp, Artificial Sequence
  chemically synthesized
caatcaagatctaatctccatt

SEQ ID NO: 757710 - DNA, 22 bp, Artificial Sequence
  chemically synthesized
ctaccccaaatccaaatggaga

SEQ ID NO: 757711 - DNA, 22 bp, Artificial Sequence
  chemically synthesized
ctcctaccccaaatccaaatgg

SEQ ID NO: 757712 - DNA, 22 bp, Artificial Sequence
  chemically synthesized
cctcctaccccaaatccaaatg

SEQ ID NO: 757713 - DNA, 22 bp, Artificial Sequence
  chemically synthesized
ccttcctcctaccccaaatcca

SEQ ID NO: 757714 - DNA, 22 bp, Artificial Sequence
  chemically synthesized
atctccatttggatttggggta

SEQ ID NO: 757715 - DNA, 22 bp, Artificial Sequence
  chemically synthesized
aactcccttcctcctaccccaa

SEQ ID NO: 757716 - DNA, 22 bp, Artificial Sequence
  chemically synthesized
catttggatttggggtaggagg

SEQ ID NO: 757717 - DNA, 22 bp, Artificial Sequence
  chemically synthesized
ttcaactcccttcctcctaccc

SEQ ID NO: 757718 - DNA, 22 bp, Artificial Sequence
  chemically synthesized
attcaactcccttcctcctacc

SEQ ID NO: 757719 - DNA, 22 bp, Artificial Sequence
  chemically synthesized
ggatttggggtaggaggaaggg

SEQ ID NO: 757720 - DNA, 22 bp, Artificial Sequence
  chemically synthesized
gatttggggtaggaggaaggga

SEQ ID NO: 757721 - DNA, 22 bp, Artificial Sequence
  chemically synthesized
ggggtaggaggaagggagttga

SEQ ID NO: 757722 - DNA, 22 bp, Artificial Sequence
  chemically synthesized
gggtaggaggaagggagttgaa

SEQ ID NO: 757723 - DNA, 22 bp, Artificial Sequence
  chemically synthesized
caataaaacatcagcttattca

SEQ ID NO: 757724 - DNA, 22 bp, Artificial Sequence
  chemically synthesized
aggagaactgcaataaaacatc

SEQ ID NO: 757725 - DNA, 22 bp, Artificial Sequence
  chemically synthesized
taaggagaactgcaataaaaca

SEQ ID NO: 757726 - DNA, 22 bp, Artificial Sequence
  chemically synthesized
ctaaggagaactgcaataaaac

SEQ ID NO: 757727 - DNA, 22 bp, Artificial Sequence
  chemically synthesized
aataagctgatgttttattgca

SEQ ID NO: 757728 - DNA, 22 bp, Artificial Sequence
  chemically synthesized
atgttttattgcagttctcctt

SEQ ID NO: 757729 - DNA, 22 bp, Artificial Sequence
  chemically synthesized
tattgcagttctccttagaaat

SEQ ID NO: 757730 - DNA, 22 bp, Artificial Sequence
  chemically synthesized
attgcagttctccttagaaatt

SEQ ID NO: 757731 - DNA, 22 bp, Artificial Sequence
  chemically synthesized
ttgcagttctccttagaaattc

SEQ ID NO: 757732 - DNA, 22 bp, Artificial Sequence
  chemically synthesized
cagttctccttagaaattcccc

SEQ ID NO: 757733 - DNA, 22 bp, Artificial Sequence
  chemically synthesized
aaggagcaaatcatagtgggga

SEQ ID NO: 757734 - DNA, 22 bp, Artificial Sequence
  chemically synthesized
tccttagaaattccccactatg

SEQ ID NO: 757735 - DNA, 22 bp, Artificial Sequence
  chemically synthesized
aaaggagcaaatcatagtgggg

SEQ ID NO: 757736 - DNA, 22 bp, Artificial Sequence
  chemically synthesized
taaaggagcaaatcatagtggg

SEQ ID NO: 757737 - DNA, 22 bp, Artificial Sequence
  chemically synthesized
cttagaaattccccactatgat

SEQ ID NO: 757738 - DNA, 22 bp, Artificial Sequence
  chemically synthesized
agaaattccccactatgatttg

SEQ ID NO: 757739 - DNA, 22 bp, Artificial Sequence
  chemically synthesized
gaaattccccactatgatttgc

SEQ ID NO: 757740 - DNA, 22 bp, Artificial Sequence
  chemically synthesized
gagagagttttaaaggagcaaa

SEQ ID NO: 757741 - DNA, 22 bp, Artificial Sequence
  chemically synthesized
cccactatgatttgctccttta

SEQ ID NO: 757742 - DNA, 22 bp, Artificial Sequence
  chemically synthesized
acctagagagagttttaaagga

SEQ ID NO: 757743 - DNA, 22 bp, Artificial Sequence
  chemically synthesized
tgatttgctcctttaaaactct

SEQ ID NO: 757744 - DNA, 22 bp, Artificial Sequence
  chemically synthesized
tgattaacctagagagagtttt

SEQ ID NO: 757745 - DNA, 22 bp, Artificial Sequence
  chemically synthesized
tgtgattaacctagagagagtt

SEQ ID NO: 757746 - DNA, 22 bp, Artificial Sequence
  chemically synthesized
ctgtgattaacctagagagagt

SEQ ID NO: 757747 - DNA, 22 bp, Artificial Sequence
  chemically synthesized
gctcctttaaaactctctctag

SEQ ID NO: 757748 - DNA, 22 bp, Artificial Sequence
  chemically synthesized
ctcctttaaaactctctctagg

SEQ ID NO: 757749 - DNA, 22 bp, Artificial Sequence
  chemically synthesized
cttctgtgattaacctagagag

SEQ ID NO: 757750 - DNA, 22 bp, Artificial Sequence
  chemically synthesized
ctttaaaactctctctaggtta

SEQ ID NO: 757751 - DNA, 22 bp, Artificial Sequence
  chemically synthesized
tctacttctgtgattaacctag

SEQ ID NO: 757752 - DNA, 22 bp, Artificial Sequence
  chemically synthesized
taaaactctctctaggttaatc

SEQ ID NO: 757753 - DNA, 22 bp, Artificial Sequence
  chemically synthesized
gtctacttctgtgattaaccta

SEQ ID NO: 757754 - DNA, 22 bp, Artificial Sequence
  chemically synthesized
aaaactctctctaggttaatca

SEQ ID NO: 757755 - DNA, 22 bp, Artificial Sequence
  chemically synthesized
aaactctctctaggttaatcac

SEQ ID NO: 757756 - DNA, 22 bp, Artificial Sequence
  chemically synthesized
cttgtctacttctgtgattaac

SEQ ID NO: 757757 - DNA, 22 bp, Artificial Sequence
  chemically synthesized
ttacttgtctacttctgtgatt

SEQ ID NO: 757758 - DNA, 22 bp, Artificial Sequence
  chemically synthesized
attacttgtctacttctgtgat

SEQ ID NO: 757759 - DNA, 22 bp, Artificial Sequence
  chemically synthesized
tctctaggttaatcacagaagt

SEQ ID NO: 757760 - DNA, 22 bp, Artificial Sequence
  chemically synthesized
tctaggttaatcacagaagtag

SEQ ID NO: 757761 - DNA, 22 bp, Artificial Sequence
  chemically synthesized
taggttaatcacagaagtagac

SEQ ID NO: 757762 - DNA, 22 bp, Artificial Sequence
  chemically synthesized
ggttaatcacagaagtagacaa

SEQ ID NO: 757763 - DNA, 22 bp, Artificial Sequence
  chemically synthesized
aagtgatatttattacttgtct

SEQ ID NO: 757764 - DNA, 22 bp, Artificial Sequence
  chemically synthesized
atcacagaagtagacaagtaat

SEQ ID NO: 757765 - DNA, 22 bp, Artificial Sequence
  chemically synthesized
agcagtcactaaagtgatattt

SEQ ID NO: 757766 - DNA, 22 bp, Artificial Sequence
  chemically synthesized
gagcagtcactaaagtgatatt

SEQ ID NO: 757767 - DNA, 22 bp, Artificial Sequence
  chemically synthesized
cttgagcagtcactaaagtgat

SEQ ID NO: 757768 - DNA, 22 bp, Artificial Sequence
  chemically synthesized
acttgagcagtcactaaagtga

SEQ ID NO: 757769 - DNA, 22 bp, Artificial Sequence
  chemically synthesized
tacttgagcagtcactaaagtg

SEQ ID NO: 757770 - DNA, 22 bp, Artificial Sequence
  chemically synthesized
ttttacttgagcagtcactaaa

SEQ ID NO: 757771 - DNA, 22 bp, Artificial Sequence
  chemically synthesized
gttttacttgagcagtcactaa

SEQ ID NO: 757772 - DNA, 22 bp, Artificial Sequence
  chemically synthesized
tgttttacttgagcagtcacta

SEQ ID NO: 757773 - DNA, 22 bp, Artificial Sequence
  chemically synthesized
ctttgttttacttgagcagtca

SEQ ID NO: 757774 - DNA, 22 bp, Artificial Sequence
  chemically synthesized
cctttgttttacttgagcagtc

SEQ ID NO: 757775 - DNA, 22 bp, Artificial Sequence
  chemically synthesized
acttcctttgttttacttgagc

SEQ ID NO: 757776 - DNA, 22 bp, Artificial Sequence
  chemically synthesized
tagtgactgctcaagtaaaaca

SEQ ID NO: 757777 - DNA, 22 bp, Artificial Sequence
  chemically synthesized
agtgactgctcaagtaaaacaa

SEQ ID NO: 757778 - DNA, 22 bp, Artificial Sequence
  chemically synthesized
gtgactgctcaagtaaaacaaa

SEQ ID NO: 757779 - DNA, 22 bp, Artificial Sequence
  chemically synthesized
aaaactgacttcctttgtttta

SEQ ID NO: 757780 - DNA, 22 bp, Artificial Sequence
  chemically synthesized
aaaaactgacttcctttgtttt

SEQ ID NO: 757781 - DNA, 22 bp, Artificial Sequence
  chemically synthesized
taaaaactgacttcctttgttt

SEQ ID NO: 757782 - DNA, 22 bp, Artificial Sequence
  chemically synthesized
ctcaagtaaaacaaaggaagtc

SEQ ID NO: 757783 - DNA, 22 bp, Artificial Sequence
  chemically synthesized
aagtaaaacaaaggaagtcagt

SEQ ID NO: 757784 - DNA, 22 bp, Artificial Sequence
  chemically synthesized
gtccagatatattttaaaaact

SEQ ID NO: 757785 - DNA, 22 bp, Artificial Sequence
  chemically synthesized
tggtccagatatattttaaaaa

SEQ ID NO: 757786 - DNA, 22 bp, Artificial Sequence
  chemically synthesized
ttctggtccagatatattttaa

SEQ ID NO: 757787 - DNA, 22 bp, Artificial Sequence
  chemically synthesized
gtgggtgttattctggtccaga

SEQ ID NO: 757788 - DNA, 22 bp, Artificial Sequence
  chemically synthesized
ttaaaatatatctggaccagaa

SEQ ID NO: 757789 - DNA, 22 bp, Artificial Sequence
  chemically synthesized
taaaatatatctggaccagaat

SEQ ID NO: 757790 - DNA, 22 bp, Artificial Sequence
  chemically synthesized
aaaatatatctggaccagaata

SEQ ID NO: 757791 - DNA, 22 bp, Artificial Sequence
  chemically synthesized
aaatatatctggaccagaataa

SEQ ID NO: 757792 - DNA, 22 bp, Artificial Sequence
  chemically synthesized
aattagtgggtgttattctggt

SEQ ID NO: 757793 - DNA, 22 bp, Artificial Sequence
  chemically synthesized
caattagtgggtgttattctgg

SEQ ID NO: 757794 - DNA, 22 bp, Artificial Sequence
  chemically synthesized
tcaattagtgggtgttattctg

SEQ ID NO: 757795 - DNA, 22 bp, Artificial Sequence
  chemically synthesized
gttttcaattagtgggtgttat

SEQ ID NO: 757796 - DNA, 22 bp, Artificial Sequence
  chemically synthesized
actcgttttcaattagtgggtg

SEQ ID NO: 757797 - DNA, 22 bp, Artificial Sequence
  chemically synthesized
gaccagaataacacccactaat

SEQ ID NO: 757798 - DNA, 22 bp, Artificial Sequence
  chemically synthesized
gactgactcgttttcaattagt

SEQ ID NO: 757799 - DNA, 22 bp, Artificial Sequence
  chemically synthesized
actagactgactcgttttcaat

SEQ ID NO: 757800 - DNA, 22 bp, Artificial Sequence
  chemically synthesized
cctcactagactgactcgtttt

SEQ ID NO: 757801 - DNA, 22 bp, Artificial Sequence
  chemically synthesized
gcctcactagactgactcgttt

SEQ ID NO: 757802 - DNA, 22 bp, Artificial Sequence
  chemically synthesized
cttgcctcactagactgactcg

SEQ ID NO: 757803 - DNA, 22 bp, Artificial Sequence
  chemically synthesized
attgaaaacgagtcagtctagt

SEQ ID NO: 757804 - DNA, 22 bp, Artificial Sequence
  chemically synthesized
attacttgcctcactagactga

SEQ ID NO: 757805 - DNA, 22 bp, Artificial Sequence
  chemically synthesized
ctcattacttgcctcactagac

SEQ ID NO: 757806 - DNA, 22 bp, Artificial Sequence
  chemically synthesized
aaaacgagtcagtctagtgagg

SEQ ID NO: 757807 - DNA, 22 bp, Artificial Sequence
  chemically synthesized
cagttcctcattacttgcctca

SEQ ID NO: 757808 - DNA, 22 bp, Artificial Sequence
  chemically synthesized
acagttcctcattacttgcctc

SEQ ID NO: 757809 - DNA, 22 bp, Artificial Sequence
  chemically synthesized
tacagttcctcattacttgcct

SEQ ID NO: 757810 - DNA, 22 bp, Artificial Sequence
  chemically synthesized
ttacagttcctcattacttgcc

SEQ ID NO: 757811 - DNA, 22 bp, Artificial Sequence
  chemically synthesized
gcttttacagttcctcattact

SEQ ID NO: 757812 - DNA, 22 bp, Artificial Sequence
  chemically synthesized
gtgaggcaagtaatgaggaact

SEQ ID NO: 757813 - DNA, 22 bp, Artificial Sequence
  chemically synthesized
tcctggcttttacagttcctca

SEQ ID NO: 757814 - DNA, 22 bp, Artificial Sequence
  chemically synthesized
aatacattatcctggcttttac

SEQ ID NO: 757815 - DNA, 22 bp, Artificial Sequence
  chemically synthesized
gaatacattatcctggctttta

SEQ ID NO: 757816 - DNA, 22 bp, Artificial Sequence
  chemically synthesized
tgaatacattatcctggctttt

SEQ ID NO: 757817 - DNA, 22 bp, Artificial Sequence
  chemically synthesized
ttgaatacattatcctggcttt

SEQ ID NO: 757818 - DNA, 22 bp, Artificial Sequence
  chemically synthesized
tgtcttttgaatacattatcct

SEQ ID NO: 757819 - DNA, 22 bp, Artificial Sequence
  chemically synthesized
atgtcttttgaatacattatcc

SEQ ID NO: 757820 - DNA, 22 bp, Artificial Sequence
  chemically synthesized
tatgtcttttgaatacattatc

SEQ ID NO: 757821 - DNA, 22 bp, Artificial Sequence
  chemically synthesized
ttatgtcttttgaatacattat

SEQ ID NO: 757822 - DNA, 22 bp, Artificial Sequence
  chemically synthesized
taaaagccaggataatgtattc

SEQ ID NO: 757823 - DNA, 22 bp, Artificial Sequence
  chemically synthesized
accaatttttatgtcttttgaa

SEQ ID NO: 757824 - DNA, 22 bp, Artificial Sequence
  chemically synthesized
gcaaatataaactgaccaattt

SEQ ID NO: 757825 - DNA, 22 bp, Artificial Sequence
  chemically synthesized
aaaagacataaaaattggtcag

SEQ ID NO: 757826 - DNA, 22 bp, Artificial Sequence
  chemically synthesized
agcaaatataaactgaccaatt

SEQ ID NO: 757827 - DNA, 22 bp, Artificial Sequence
  chemically synthesized
aaatatgccttagcaaatataa

SEQ ID NO: 757828 - DNA, 22 bp, Artificial Sequence
  chemically synthesized
gtcagtttatatttgctaaggc

SEQ ID NO: 757829 - DNA, 22 bp, Artificial Sequence
  chemically synthesized
aagctcaaatatgccttagcaa

SEQ ID NO: 757830 - DNA, 22 bp, Artificial Sequence
  chemically synthesized
atatttgctaaggcatatttga

SEQ ID NO: 757831 - DNA, 22 bp, Artificial Sequence
  chemically synthesized
tatttgctaaggcatatttgag

SEQ ID NO: 757832 - DNA, 22 bp, Artificial Sequence
  chemically synthesized
taaataattaaagctcaaatat

SEQ ID NO: 757833 - DNA, 22 bp, Artificial Sequence
  chemically synthesized
gctaaggcatatttgagcttta

SEQ ID NO: 757834 - DNA, 22 bp, Artificial Sequence
  chemically synthesized
ctaaggcatatttgagctttaa

SEQ ID NO: 757835 - DNA, 22 bp, Artificial Sequence
  chemically synthesized
aggcatatttgagctttaatta

SEQ ID NO: 757836 - DNA, 22 bp, Artificial Sequence
  chemically synthesized
gagctttaattatttataacac

SEQ ID NO: 757837 - DNA, 22 bp, Artificial Sequence
  chemically synthesized
agctttaattatttataacact

SEQ ID NO: 757838 - DNA, 22 bp, Artificial Sequence
  chemically synthesized
cagatgcggtgaagtgttataa

SEQ ID NO: 757839 - DNA, 22 bp, Artificial Sequence
  chemically synthesized
taattatttataacacttcacc

SEQ ID NO: 757840 - DNA, 22 bp, Artificial Sequence
  chemically synthesized
aattatttataacacttcaccg

SEQ ID NO: 757841 - DNA, 22 bp, Artificial Sequence
  chemically synthesized
attatttataacacttcaccgc

SEQ ID NO: 757842 - DNA, 22 bp, Artificial Sequence
  chemically synthesized
tttataacacttcaccgcatct

SEQ ID NO: 757843 - DNA, 22 bp, Artificial Sequence
  chemically synthesized
ataacacttcaccgcatctgga

SEQ ID NO: 757844 - DNA, 22 bp, Artificial Sequence
  chemically synthesized
ataaaataatgctccagatgcg

SEQ ID NO: 757845 - DNA, 22 bp, Artificial Sequence
  chemically synthesized
taacacttcaccgcatctggag

SEQ ID NO: 757846 - DNA, 22 bp, Artificial Sequence
  chemically synthesized
attaataaaataatgctccaga

SEQ ID NO: 757847 - DNA, 22 bp, Artificial Sequence
  chemically synthesized
caccgcatctggagcattattt

SEQ ID NO: 757848 - DNA, 22 bp, Artificial Sequence
  chemically synthesized
accgcatctggagcattatttt

SEQ ID NO: 757849 - DNA, 22 bp, Artificial Sequence
  chemically synthesized
aagactaattaataaaataatg

SEQ ID NO: 757850 - DNA, 22 bp, Artificial Sequence
  chemically synthesized
tcaagactaattaataaaataa

SEQ ID NO: 757851 - DNA, 22 bp, Artificial Sequence
  chemically synthesized
gagcattattttattaattagt

SEQ ID NO: 757852 - DNA, 22 bp, Artificial Sequence
  chemically synthesized
aatggctctcaagactaattaa

SEQ ID NO: 757853 - DNA, 22 bp, Artificial Sequence
  chemically synthesized
caactgaatggctctcaagact

SEQ ID NO: 757854 - DNA, 22 bp, Artificial Sequence
  chemically synthesized
ttttattaattagtcttgagag

SEQ ID NO: 757855 - DNA, 22 bp, Artificial Sequence
  chemically synthesized
tattaattagtcttgagagcca

SEQ ID NO: 757856 - DNA, 22 bp, Artificial Sequence
  chemically synthesized
attaattagtcttgagagccat

SEQ ID NO: 757857 - DNA, 22 bp, Artificial Sequence
  chemically synthesized
ttaattagtcttgagagccatt

SEQ ID NO: 757858 - DNA, 22 bp, Artificial Sequence
  chemically synthesized
attagtcttgagagccattcag

SEQ ID NO: 757859 - DNA, 22 bp, Artificial Sequence
  chemically synthesized
gtcttgagagccattcagttgc

SEQ ID NO: 757860 - DNA, 22 bp, Artificial Sequence
  chemically synthesized
ggcagcataacaactgcaactg

SEQ ID NO: 757861 - DNA, 22 bp, Artificial Sequence
  chemically synthesized
gagagccattcagttgcagttg

SEQ ID NO: 757862 - DNA, 22 bp, Artificial Sequence
  chemically synthesized
agagccattcagttgcagttgt

SEQ ID NO: 757863 - DNA, 22 bp, Artificial Sequence
  chemically synthesized
agttgcagttgttatgctgccc

SEQ ID NO: 757864 - DNA, 22 bp, Artificial Sequence
  chemically synthesized
cccaaaccagctgggcagcata

SEQ ID NO: 757865 - DNA, 22 bp, Artificial Sequence
  chemically synthesized
cagttgttatgctgcccagctg

SEQ ID NO: 757866 - DNA, 22 bp, Artificial Sequence
  chemically synthesized
tgctccccaaaccagctgggca

SEQ ID NO: 757867 - DNA, 22 bp, Artificial Sequence
  chemically synthesized
ttatgctgcccagctggtttgg

SEQ ID NO: 757868 - DNA, 22 bp, Artificial Sequence
  chemically synthesized
tgctgcccagctggtttgggga

SEQ ID NO: 757869 - DNA, 22 bp, Artificial Sequence
  chemically synthesized
cccagctggtttggggagcaca

SEQ ID NO: 757870 - DNA, 22 bp, Artificial Sequence
  chemically synthesized
acacccatgggagtagatctgt

SEQ ID NO: 757871 - DNA, 22 bp, Artificial Sequence
  chemically synthesized
gtttggggagcacagatctact

SEQ ID NO: 757872 - DNA, 22 bp, Artificial Sequence
  chemically synthesized
cacacccatgggagtagatctg

SEQ ID NO: 757873 - DNA, 22 bp, Artificial Sequence
  chemically synthesized
tcacacccatgggagtagatct

SEQ ID NO: 757874 - DNA, 22 bp, Artificial Sequence
  chemically synthesized
ggggagcacagatctactccca

SEQ ID NO: 757875 - DNA, 22 bp, Artificial Sequence
  chemically synthesized
gggagcacagatctactcccat

SEQ ID NO: 757876 - DNA, 22 bp, Artificial Sequence
  chemically synthesized
aaagcaattttcacacccatgg

SEQ ID NO: 757877 - DNA, 22 bp, Artificial Sequence
  chemically synthesized
ctcaaagcaattttcacaccca

SEQ ID NO: 757878 - DNA, 22 bp, Artificial Sequence
  chemically synthesized
actcctcaaagcaattttcaca

SEQ ID NO: 757879 - DNA, 22 bp, Artificial Sequence
  chemically synthesized
ctcccatgggtgtgaaaattgc

SEQ ID NO: 757880 - DNA, 22 bp, Artificial Sequence
  chemically synthesized
ccatgggtgtgaaaattgcttt

SEQ ID NO: 757881 - DNA, 22 bp, Artificial Sequence
  chemically synthesized
gggaccatagtctcactcctca

SEQ ID NO: 757882 - DNA, 22 bp, Artificial Sequence
  chemically synthesized
ggggaccatagtctcactcctc

SEQ ID NO: 757883 - DNA, 22 bp, Artificial Sequence
  chemically synthesized
ctttgaggagtgagactatggt

SEQ ID NO: 757884 - DNA, 22 bp, Artificial Sequence
  chemically synthesized
tgaggagtgagactatggtccc

SEQ ID NO: 757885 - DNA, 22 bp, Artificial Sequence
  chemically synthesized
gaggagtgagactatggtcccc

SEQ ID NO: 757886 - DNA, 22 bp, Artificial Sequence
  chemically synthesized
aggagtgagactatggtcccca

SEQ ID NO: 757887 - DNA, 22 bp, Artificial Sequence
  chemically synthesized
cacagacatatttggggaccat

SEQ ID NO: 757888 - DNA, 22 bp, Artificial Sequence
  chemically synthesized
caagatactccacagacatatt

SEQ ID NO: 757889 - DNA, 22 bp, Artificial Sequence
  chemically synthesized
tggtccccaaatatgtctgtgg

SEQ ID NO: 757890 - DNA, 22 bp, Artificial Sequence
  chemically synthesized
taggtaaaattccaagatactc

SEQ ID NO: 757891 - DNA, 22 bp, Artificial Sequence
  chemically synthesized
tgtaggtaaaattccaagatac

SEQ ID NO: 757892 - DNA, 22 bp, Artificial Sequence
  chemically synthesized
ctgtaggtaaaattccaagata

SEQ ID NO: 757893 - DNA, 22 bp, Artificial Sequence
  chemically synthesized
ttctgtaggtaaaattccaaga

SEQ ID NO: 757894 - DNA, 22 bp, Artificial Sequence
  chemically synthesized
tggagtatcttggaattttacc

SEQ ID NO: 757895 - DNA, 22 bp, Artificial Sequence
  chemically synthesized
ggaattttacctacagaagaac

SEQ ID NO: 757896 - DNA, 22 bp, Artificial Sequence
  chemically synthesized
gaattttacctacagaagaacc

SEQ ID NO: 757897 - DNA, 22 bp, Artificial Sequence
  chemically synthesized
tcatggagagatatatggttct

SEQ ID NO: 757898 - DNA, 22 bp, Artificial Sequence
  chemically synthesized
tacctacagaagaaccatatat

SEQ ID NO: 757899 - DNA, 22 bp, Artificial Sequence
  chemically synthesized
acctacagaagaaccatatatc

SEQ ID NO: 757900 - DNA, 22 bp, Artificial Sequence
  chemically synthesized
ctgtcatggagagatatatggt

SEQ ID NO: 757901 - DNA, 22 bp, Artificial Sequence
  chemically synthesized
cctacagaagaaccatatatct

SEQ ID NO: 757902 - DNA, 22 bp, Artificial Sequence
  chemically synthesized
cagaagaaccatatatctctcc

SEQ ID NO: 757903 - DNA, 22 bp, Artificial Sequence
  chemically synthesized
tccatgacagcaattgatattg

SEQ ID NO: 757904 - DNA, 22 bp, Artificial Sequence
  chemically synthesized
catgacagcaattgatattgac

SEQ ID NO: 757905 - DNA, 22 bp, Artificial Sequence
  chemically synthesized
tagagaaaatatacagtcaata

SEQ ID NO: 757906 - DNA, 22 bp, Artificial Sequence
  chemically synthesized
gtagagaaaatatacagtcaat

SEQ ID NO: 757907 - DNA, 22 bp, Artificial Sequence
  chemically synthesized
ttgtagagaaaatatacagtca

SEQ ID NO: 757908 - DNA, 22 bp, Artificial Sequence
  chemically synthesized
cttgtagagaaaatatacagtc

SEQ ID NO: 757909 - DNA, 22 bp, Artificial Sequence
  chemically synthesized
tcttgtagagaaaatatacagt

SEQ ID NO: 757910 - DNA, 22 bp, Artificial Sequence
  chemically synthesized
ttcttgtagagaaaatatacag

SEQ ID NO: 757911 - DNA, 22 bp, Artificial Sequence
  chemically synthesized
ttttcttgtagagaaaatatac

SEQ ID NO: 757912 - DNA, 22 bp, Artificial Sequence
  chemically synthesized
atattgactgtatattttctct

SEQ ID NO: 757913 - DNA, 22 bp, Artificial Sequence
  chemically synthesized
tactcttttcttgtagagaaaa

SEQ ID NO: 757914 - DNA, 22 bp, Artificial Sequence
  chemically synthesized
gtactcttttcttgtagagaaa

SEQ ID NO: 757915 - DNA, 22 bp, Artificial Sequence
  chemically synthesized
actgtatattttctctacaaga

SEQ ID NO: 757916 - DNA, 22 bp, Artificial Sequence
  chemically synthesized
tatattttctctacaagaaaag

SEQ ID NO: 757917 - DNA, 22 bp, Artificial Sequence
  chemically synthesized
catatcttgtactcttttcttg

SEQ ID NO: 757918 - DNA, 22 bp, Artificial Sequence
  chemically synthesized
tctctacaagaaaagagtacaa

SEQ ID NO: 757919 - DNA, 22 bp, Artificial Sequence
  chemically synthesized
ctctacaagaaaagagtacaag

SEQ ID NO: 757920 - DNA, 22 bp, Artificial Sequence
  chemically synthesized
tctacaagaaaagagtacaaga

SEQ ID NO: 757921 - DNA, 22 bp, Artificial Sequence
  chemically synthesized
tacaagaaaagagtacaagata

SEQ ID NO: 757922 - DNA, 22 bp, Artificial Sequence
  chemically synthesized
caagaaaagagtacaagatatg

SEQ ID NO: 757923 - DNA, 22 bp, Artificial Sequence
  chemically synthesized
tagcaaaatattacatatcttg

SEQ ID NO: 757924 - DNA, 22 bp, Artificial Sequence
  chemically synthesized
gtagcaaaatattacatatctt

SEQ ID NO: 757925 - DNA, 22 bp, Artificial Sequence
  chemically synthesized
tgtagcaaaatattacatatct

SEQ ID NO: 757926 - DNA, 22 bp, Artificial Sequence
  chemically synthesized
gtgataatattttgtagcaaaa

SEQ ID NO: 757927 - DNA, 22 bp, Artificial Sequence
  chemically synthesized
agattagtgataatattttgta

SEQ ID NO: 757928 - DNA, 22 bp, Artificial Sequence
  chemically synthesized
cagattagtgataatattttgt

SEQ ID NO: 757929 - DNA, 22 bp, Artificial Sequence
  chemically synthesized
tgctacaaaatattatcactaa

SEQ ID NO: 757930 - DNA, 22 bp, Artificial Sequence
  chemically synthesized
gctacaaaatattatcactaat

SEQ ID NO: 757931 - DNA, 22 bp, Artificial Sequence
  chemically synthesized
ctacaaaatattatcactaatc

SEQ ID NO: 757932 - DNA, 22 bp, Artificial Sequence
  chemically synthesized
tataccatttcagattagtgat

SEQ ID NO: 757933 - DNA, 22 bp, Artificial Sequence
  chemically synthesized
gtataccatttcagattagtga

SEQ ID NO: 757934 - DNA, 22 bp, Artificial Sequence
  chemically synthesized
tgtataccatttcagattagtg

SEQ ID NO: 757935 - DNA, 22 bp, Artificial Sequence
  chemically synthesized
caaaatattatcactaatctga

SEQ ID NO: 757936 - DNA, 22 bp, Artificial Sequence
  chemically synthesized
tttgtataccatttcagattag

SEQ ID NO: 757937 - DNA, 22 bp, Artificial Sequence
  chemically synthesized
ctttgtataccatttcagatta

SEQ ID NO: 757938 - DNA, 22 bp, Artificial Sequence
  chemically synthesized
tctttgtataccatttcagatt

SEQ ID NO: 757939 - DNA, 22 bp, Artificial Sequence
  chemically synthesized
ttctttgtataccatttcagat

SEQ ID NO: 757940 - DNA, 22 bp, Artificial Sequence
  chemically synthesized
tgtttttctttgtataccattt

SEQ ID NO: 757941 - DNA, 22 bp, Artificial Sequence
  chemically synthesized
tcactaatctgaaatggtatac

SEQ ID NO: 757942 - DNA, 22 bp, Artificial Sequence
  chemically synthesized
gtgtttttctttgtataccatt

SEQ ID NO: 757943 - DNA, 22 bp, Artificial Sequence
  chemically synthesized
atctgaaatggtatacaaagaa

SEQ ID NO: 757944 - DNA, 22 bp, Artificial Sequence
  chemically synthesized
aaatggtatacaaagaaaaaca

SEQ ID NO: 757945 - DNA, 22 bp, Artificial Sequence
  chemically synthesized
caaaacaggtaatttgtgtttt

SEQ ID NO: 757946 - DNA, 22 bp, Artificial Sequence
  chemically synthesized
acaaaacaggtaatttgtgttt

SEQ ID NO: 757947 - DNA, 22 bp, Artificial Sequence
  chemically synthesized
taaatcaggatgtttacaaaac

SEQ ID NO: 757948 - DNA, 22 bp, Artificial Sequence
  chemically synthesized
tataaatcaggatgtttacaaa

SEQ ID NO: 757949 - DNA, 22 bp, Artificial Sequence
  chemically synthesized
ctataaatcaggatgtttacaa

SEQ ID NO: 757950 - DNA, 22 bp, Artificial Sequence
  chemically synthesized
tctataaatcaggatgtttaca

SEQ ID NO: 757951 - DNA, 22 bp, Artificial Sequence
  chemically synthesized
attttctataaatcaggatgtt

SEQ ID NO: 757952 - DNA, 22 bp, Artificial Sequence
  chemically synthesized
cctgttttgtaaacatcctgat

SEQ ID NO: 757953 - DNA, 22 bp, Artificial Sequence
  chemically synthesized
cattttctataaatcaggatgt

SEQ ID NO: 757954 - DNA, 22 bp, Artificial Sequence
  chemically synthesized
tcattttctataaatcaggatg

SEQ ID NO: 757955 - DNA, 22 bp, Artificial Sequence
  chemically synthesized
ttttgtaaacatcctgatttat

SEQ ID NO: 757956 - DNA, 22 bp, Artificial Sequence
  chemically synthesized
actttcattttctataaatcag

SEQ ID NO: 757957 - DNA, 22 bp, Artificial Sequence
  chemically synthesized
cactttcattttctataaatca

SEQ ID NO: 757958 - DNA, 22 bp, Artificial Sequence
  chemically synthesized
tgtaaacatcctgatttataga

SEQ ID NO: 757959 - DNA, 22 bp, Artificial Sequence
  chemically synthesized
tcactttcattttctataaatc

SEQ ID NO: 757960 - DNA, 22 bp, Artificial Sequence
  chemically synthesized
gtaaacatcctgatttatagaa

SEQ ID NO: 757961 - DNA, 22 bp, Artificial Sequence
  chemically synthesized
taaacatcctgatttatagaaa

SEQ ID NO: 757962 - DNA, 22 bp, Artificial Sequence
  chemically synthesized
attttcactttcattttctata

SEQ ID NO: 757963 - DNA, 22 bp, Artificial Sequence
  chemically synthesized
ttcattttcactttcattttct

SEQ ID NO: 757964 - DNA, 22 bp, Artificial Sequence
  chemically synthesized
atttatagaaaatgaaagtgaa

SEQ ID NO: 757965 - DNA, 22 bp, Artificial Sequence
  chemically synthesized
atagaaaatgaaagtgaaaatg

SEQ ID NO: 757966 - DNA, 22 bp, Artificial Sequence
  chemically synthesized
tagaaaatgaaagtgaaaatga

SEQ ID NO: 757967 - DNA, 22 bp, Artificial Sequence
  chemically synthesized
aaatcaaatgttgttcattttc

SEQ ID NO: 757968 - DNA, 22 bp, Artificial Sequence
  chemically synthesized
aaactaaaatcaaatgttgttc

SEQ ID NO: 757969 - DNA, 22 bp, Artificial Sequence
  chemically synthesized
aaatgtcaatagttgaaactaa

SEQ ID NO: 757970 - DNA, 22 bp, Artificial Sequence
  chemically synthesized
gattttagtttcaactattgac

SEQ ID NO: 757971 - DNA, 22 bp, Artificial Sequence
  chemically synthesized
attttagtttcaactattgaca

SEQ ID NO: 757972 - DNA, 22 bp, Artificial Sequence
  chemically synthesized
tagtttcaactattgacatttt

SEQ ID NO: 757973 - DNA, 22 bp, Artificial Sequence
  chemically synthesized
agtttcaactattgacatttta

SEQ ID NO: 757974 - DNA, 22 bp, Artificial Sequence
  chemically synthesized
gtttcaactattgacattttaa

SEQ ID NO: 757975 - DNA, 22 bp, Artificial Sequence
  chemically synthesized
caactattgacattttaatggg

SEQ ID NO: 757976 - DNA, 22 bp, Artificial Sequence
  chemically synthesized
aactattgacattttaatggga

SEQ ID NO: 757977 - DNA, 22 bp, Artificial Sequence
  chemically synthesized
tggggatacaaatcccattaaa

SEQ ID NO: 757978 - DNA, 22 bp, Artificial Sequence
  chemically synthesized
atggggatacaaatcccattaa

SEQ ID NO: 757979 - DNA, 22 bp, Artificial Sequence
  chemically synthesized
tatggggatacaaatcccatta

SEQ ID NO: 757980 - DNA, 22 bp, Artificial Sequence
  chemically synthesized
ttatggggatacaaatcccatt

SEQ ID NO: 757981 - DNA, 22 bp, Artificial Sequence
  chemically synthesized
tttatggggatacaaatcccat

SEQ ID NO: 757982 - DNA, 22 bp, Artificial Sequence
  chemically synthesized
ttgacattttaatgggatttgt

SEQ ID NO: 757983 - DNA, 22 bp, Artificial Sequence
  chemically synthesized
acattttaatgggatttgtatc

SEQ ID NO: 757984 - DNA, 22 bp, Artificial Sequence
  chemically synthesized
atgctttttatggggatacaaa

SEQ ID NO: 757985 - DNA, 22 bp, Artificial Sequence
  chemically synthesized
ctgatgctttttatggggatac

SEQ ID NO: 757986 - DNA, 22 bp, Artificial Sequence
  chemically synthesized
taatgggatttgtatccccata

SEQ ID NO: 757987 - DNA, 22 bp, Artificial Sequence
  chemically synthesized
gctgatgctttttatggggata

SEQ ID NO: 757988 - DNA, 22 bp, Artificial Sequence
  chemically synthesized
aatgggatttgtatccccataa

SEQ ID NO: 757989 - DNA, 22 bp, Artificial Sequence
  chemically synthesized
tgctgatgctttttatggggat

SEQ ID NO: 757990 - DNA, 22 bp, Artificial Sequence
  chemically synthesized
atgggatttgtatccccataaa

SEQ ID NO: 757991 - DNA, 22 bp, Artificial Sequence
  chemically synthesized
atatcctttgctgatgcttttt

SEQ ID NO: 757992 - DNA, 22 bp, Artificial Sequence
  chemically synthesized
gtatccccataaaaagcatcag

SEQ ID NO: 757993 - DNA, 22 bp, Artificial Sequence
  chemically synthesized
tatccccataaaaagcatcagc

SEQ ID NO: 757994 - DNA, 22 bp, Artificial Sequence
  chemically synthesized
ttaatatcctttgctgatgctt

SEQ ID NO: 757995 - DNA, 22 bp, Artificial Sequence
  chemically synthesized
aattattaatatcctttgctga

SEQ ID NO: 757996 - DNA, 22 bp, Artificial Sequence
  chemically synthesized
taaattattaatatcctttgct

SEQ ID NO: 757997 - DNA, 22 bp, Artificial Sequence
  chemically synthesized
ttctaaattattaatatccttt

SEQ ID NO: 757998 - DNA, 22 bp, Artificial Sequence
  chemically synthesized
tattctaaattattaatatcct

SEQ ID NO: 757999 - DNA, 22 bp, Artificial Sequence
  chemically synthesized
tctattctaaattattaatatc

SEQ ID NO: 758000 - DNA, 22 bp, Artificial Sequence
  chemically synthesized
ctctctattctaaattattaat

SEQ ID NO: 758001 - DNA, 22 bp, Artificial Sequence
  chemically synthesized
actctctattctaaattattaa

SEQ ID NO: 758002 - DNA, 22 bp, Artificial Sequence
  chemically synthesized
cttactctctattctaaattat

SEQ ID NO: 758003 - DNA, 22 bp, Artificial Sequence
  chemically synthesized
ataatttagaatagagagtaag

SEQ ID NO: 758004 - DNA, 22 bp, Artificial Sequence
  chemically synthesized
aaaagtcatctgcttactctct

SEQ ID NO: 758005 - DNA, 22 bp, Artificial Sequence
  chemically synthesized
aaaaagtcatctgcttactctc

SEQ ID NO: 758006 - DNA, 22 bp, Artificial Sequence
  chemically synthesized
taaaaagtcatctgcttactct

SEQ ID NO: 758007 - DNA, 22 bp, Artificial Sequence
  chemically synthesized
ttaaaaagtcatctgcttactc

SEQ ID NO: 758008 - DNA, 22 bp, Artificial Sequence
  chemically synthesized
tttaaaaagtcatctgcttact

SEQ ID NO: 758009 - DNA, 22 bp, Artificial Sequence
  chemically synthesized
ttttaaaaagtcatctgcttac

SEQ ID NO: 758010 - DNA, 22 bp, Artificial Sequence
  chemically synthesized
agaatagagagtaagcagatga

SEQ ID NO: 758011 - DNA, 22 bp, Artificial Sequence
  chemically synthesized
gaatagagagtaagcagatgac

SEQ ID NO: 758012 - DNA, 22 bp, Artificial Sequence
  chemically synthesized
gagtgccacttttttaaaaagt

SEQ ID NO: 758013 - DNA, 22 bp, Artificial Sequence
  chemically synthesized
agagtgccacttttttaaaaag

SEQ ID NO: 758014 - DNA, 22 bp, Artificial Sequence
  chemically synthesized
cgcaagtatttagagtgccact

SEQ ID NO: 758015 - DNA, 22 bp, Artificial Sequence
  chemically synthesized
ttccgcaagtatttagagtgcc

SEQ ID NO: 758016 - DNA, 22 bp, Artificial Sequence
  chemically synthesized
tttaaaaaagtggcactctaaa

SEQ ID NO: 758017 - DNA, 22 bp, Artificial Sequence
  chemically synthesized
attccgcaagtatttagagtgc

SEQ ID NO: 758018 - DNA, 22 bp, Artificial Sequence
  chemically synthesized
ttaaaaaagtggcactctaaat

SEQ ID NO: 758019 - DNA, 22 bp, Artificial Sequence
  chemically synthesized
taaaaaagtggcactctaaata

SEQ ID NO: 758020 - DNA, 22 bp, Artificial Sequence
  chemically synthesized
aaaaaagtggcactctaaatac

SEQ ID NO: 758021 - DNA, 22 bp, Artificial Sequence
  chemically synthesized
aaaaagtggcactctaaatact

SEQ ID NO: 758022 - DNA, 22 bp, Artificial Sequence
  chemically synthesized
taaacttattccgcaagtattt

SEQ ID NO: 758023 - DNA, 22 bp, Artificial Sequence
  chemically synthesized
taattgtaaacttattccgcaa

SEQ ID NO: 758024 - DNA, 22 bp, Artificial Sequence
  chemically synthesized
taaatacttgcggaataagttt

SEQ ID NO: 758025 - DNA, 22 bp, Artificial Sequence
  chemically synthesized
aatacttgcggaataagtttac

SEQ ID NO: 758026 - DNA, 22 bp, Artificial Sequence
  chemically synthesized
gcggaataagtttacaattaca

SEQ ID NO: 758027 - DNA, 22 bp, Artificial Sequence
  chemically synthesized
cggaataagtttacaattacag

SEQ ID NO: 758028 - DNA, 22 bp, Artificial Sequence
  chemically synthesized
gtatcaagatgggtcactgtaa

SEQ ID NO: 758029 - DNA, 22 bp, Artificial Sequence
  chemically synthesized
ggtatcaagatgggtcactgta

SEQ ID NO: 758030 - DNA, 22 bp, Artificial Sequence
  chemically synthesized
acaattacagtgacccatcttg

SEQ ID NO: 758031 - DNA, 22 bp, Artificial Sequence
  chemically synthesized
caattacagtgacccatcttga

SEQ ID NO: 758032 - DNA, 22 bp, Artificial Sequence
  chemically synthesized
tatagaatccttggtatcaaga

SEQ ID NO: 758033 - DNA, 22 bp, Artificial Sequence
  chemically synthesized
gtatagaatccttggtatcaag

SEQ ID NO: 758034 - DNA, 22 bp, Artificial Sequence
  chemically synthesized
cagtgacccatcttgataccaa

SEQ ID NO: 758035 - DNA, 22 bp, Artificial Sequence
  chemically synthesized
tttgtatagaatccttggtatc

SEQ ID NO: 758036 - DNA, 22 bp, Artificial Sequence
  chemically synthesized
ttgtttgtatagaatccttggt

SEQ ID NO: 758037 - DNA, 22 bp, Artificial Sequence
  chemically synthesized
attgttgtttgtatagaatcct

SEQ ID NO: 758038 - DNA, 22 bp, Artificial Sequence
  chemically synthesized
aattgttgtttgtatagaatcc

SEQ ID NO: 758039 - DNA, 22 bp, Artificial Sequence
  chemically synthesized
gataccaaggattctatacaaa

SEQ ID NO: 758040 - DNA, 22 bp, Artificial Sequence
  chemically synthesized
atttaattgttgtttgtataga

SEQ ID NO: 758041 - DNA, 22 bp, Artificial Sequence
  chemically synthesized
ataccaaggattctatacaaac

SEQ ID NO: 758042 - DNA, 22 bp, Artificial Sequence
  chemically synthesized
gatttaattgttgtttgtatag

SEQ ID NO: 758043 - DNA, 22 bp, Artificial Sequence
  chemically synthesized
ttgatttaattgttgtttgtat

SEQ ID NO: 758044 - DNA, 22 bp, Artificial Sequence
  chemically synthesized
cttgatttaattgttgtttgta

SEQ ID NO: 758045 - DNA, 22 bp, Artificial Sequence
  chemically synthesized
tgggtttcttgatttaattgtt

SEQ ID NO: 758046 - DNA, 22 bp, Artificial Sequence
  chemically synthesized
atgggtttcttgatttaattgt

SEQ ID NO: 758047 - DNA, 22 bp, Artificial Sequence
  chemically synthesized
tatgggtttcttgatttaattg

SEQ ID NO: 758048 - DNA, 22 bp, Artificial Sequence
  chemically synthesized
tatacaaacaacaattaaatca

SEQ ID NO: 758049 - DNA, 22 bp, Artificial Sequence
  chemically synthesized
tttatgggtttcttgatttaat

SEQ ID NO: 758050 - DNA, 22 bp, Artificial Sequence
  chemically synthesized
tacaaacaacaattaaatcaag

SEQ ID NO: 758051 - DNA, 22 bp, Artificial Sequence
  chemically synthesized
ctctttatgggtttcttgattt

SEQ ID NO: 758052 - DNA, 22 bp, Artificial Sequence
  chemically synthesized
tattgctctttatgggtttctt

SEQ ID NO: 758053 - DNA, 22 bp, Artificial Sequence
  chemically synthesized
tacattgtattgctctttatgg

SEQ ID NO: 758054 - DNA, 22 bp, Artificial Sequence
  chemically synthesized
aatcaagaaacccataaagagc

SEQ ID NO: 758055 - DNA, 22 bp, Artificial Sequence
  chemically synthesized
cagaattgtacattgtattgct

SEQ ID NO: 758056 - DNA, 22 bp, Artificial Sequence
  chemically synthesized
ccagaattgtacattgtattgc

SEQ ID NO: 758057 - DNA, 22 bp, Artificial Sequence
  chemically synthesized
ccatgtttccagaattgtacat

SEQ ID NO: 758058 - DNA, 22 bp, Artificial Sequence
  chemically synthesized
gccatgtttccagaattgtaca

SEQ ID NO: 758059 - DNA, 22 bp, Artificial Sequence
  chemically synthesized
tgccatgtttccagaattgtac

SEQ ID NO: 758060 - DNA, 22 bp, Artificial Sequence
  chemically synthesized
ctttgccatgtttccagaattg

SEQ ID NO: 758061 - DNA, 22 bp, Artificial Sequence
  chemically synthesized
actttgccatgtttccagaatt

SEQ ID NO: 758062 - DNA, 22 bp, Artificial Sequence
  chemically synthesized
tactttgccatgtttccagaat

SEQ ID NO: 758063 - DNA, 22 bp, Artificial Sequence
  chemically synthesized
ttttactttgccatgtttccag

SEQ ID NO: 758064 - DNA, 22 bp, Artificial Sequence
  chemically synthesized
gttttactttgccatgtttcca

SEQ ID NO: 758065 - DNA, 22 bp, Artificial Sequence
  chemically synthesized
tgttttactttgccatgtttcc

SEQ ID NO: 758066 - DNA, 22 bp, Artificial Sequence
  chemically synthesized
ttgttttactttgccatgtttc

SEQ ID NO: 758067 - DNA, 22 bp, Artificial Sequence
  chemically synthesized
tggacttttgttttactttgcc

SEQ ID NO: 758068 - DNA, 22 bp, Artificial Sequence
  chemically synthesized
gtggacttttgttttactttgc

SEQ ID NO: 758069 - DNA, 22 bp, Artificial Sequence
  chemically synthesized
tggaaacatggcaaagtaaaac

SEQ ID NO: 758070 - DNA, 22 bp, Artificial Sequence
  chemically synthesized
gaaacatggcaaagtaaaacaa

SEQ ID NO: 758071 - DNA, 22 bp, Artificial Sequence
  chemically synthesized
tatttgtggacttttgttttac

SEQ ID NO: 758072 - DNA, 22 bp, Artificial Sequence
  chemically synthesized
atatttgtggacttttgtttta

SEQ ID NO: 758073 - DNA, 22 bp, Artificial Sequence
  chemically synthesized
acagatcttatatttgtggact

SEQ ID NO: 758074 - DNA, 22 bp, Artificial Sequence
  chemically synthesized
atagttgacagatcttatattt

SEQ ID NO: 758075 - DNA, 22 bp, Artificial Sequence
  chemically synthesized
catcaagatctaatagttgaca

SEQ ID NO: 758076 - DNA, 22 bp, Artificial Sequence
  chemically synthesized
tcaactattagatcttgatgga

SEQ ID NO: 758077 - DNA, 22 bp, Artificial Sequence
  chemically synthesized
ttagatcttgatggaattttgt

SEQ ID NO: 758078 - DNA, 22 bp, Artificial Sequence
  chemically synthesized
gatcttgatggaattttgtact

SEQ ID NO: 758079 - DNA, 22 bp, Artificial Sequence
  chemically synthesized
gatggaattttgtactgattct

SEQ ID NO: 758080 - DNA, 22 bp, Artificial Sequence
  chemically synthesized
atggaattttgtactgattctg

SEQ ID NO: 758081 - DNA, 22 bp, Artificial Sequence
  chemically synthesized
gaaaaagagaaaaagaacagaa

SEQ ID NO: 758082 - DNA, 22 bp, Artificial Sequence
  chemically synthesized
tgtactgattctgttctttttc

SEQ ID NO: 758083 - DNA, 22 bp, Artificial Sequence
  chemically synthesized
gtactgattctgttctttttct

SEQ ID NO: 758084 - DNA, 22 bp, Artificial Sequence
  chemically synthesized
agttagaaaaagagaaaaagaa

SEQ ID NO: 758085 - DNA, 22 bp, Artificial Sequence
  chemically synthesized
tactgattctgttctttttctc

SEQ ID NO: 758086 - DNA, 22 bp, Artificial Sequence
  chemically synthesized
aactcagttagaaaaagagaaa

SEQ ID NO: 758087 - DNA, 22 bp, Artificial Sequence
  chemically synthesized
attctgttctttttctcttttt

SEQ ID NO: 758088 - DNA, 22 bp, Artificial Sequence
  chemically synthesized
ctgaactcagttagaaaaagag

SEQ ID NO: 758089 - DNA, 22 bp, Artificial Sequence
  chemically synthesized
tgttctttttctctttttctaa

SEQ ID NO: 758090 - DNA, 22 bp, Artificial Sequence
  chemically synthesized
ttctttttctctttttctaact

SEQ ID NO: 758091 - DNA, 22 bp, Artificial Sequence
  chemically synthesized
tttttctctttttctaactgag

SEQ ID NO: 758092 - DNA, 22 bp, Artificial Sequence
  chemically synthesized
tttctctttttctaactgagtt

SEQ ID NO: 758093 - DNA, 22 bp, Artificial Sequence
  chemically synthesized
ttctctttttctaactgagttc

SEQ ID NO: 758094 - DNA, 22 bp, Artificial Sequence
  chemically synthesized
tctctttttctaactgagttca

SEQ ID NO: 758095 - DNA, 22 bp, Artificial Sequence
  chemically synthesized
ctctttttctaactgagttcag

SEQ ID NO: 758096 - DNA, 22 bp, Artificial Sequence
  chemically synthesized
tctttttctaactgagttcagg

SEQ ID NO: 758097 - DNA, 22 bp, Artificial Sequence
  chemically synthesized
cgtatcagatctcctgaactca

SEQ ID NO: 758098 - DNA, 22 bp, Artificial Sequence
  chemically synthesized
tttttctaactgagttcaggag

SEQ ID NO: 758099 - DNA, 22 bp, Artificial Sequence
  chemically synthesized
tttctaactgagttcaggagat

SEQ ID NO: 758100 - DNA, 22 bp, Artificial Sequence
  chemically synthesized
ttctaactgagttcaggagatc

SEQ ID NO: 758101 - DNA, 22 bp, Artificial Sequence
  chemically synthesized
tctaactgagttcaggagatct

SEQ ID NO: 758102 - DNA, 22 bp, Artificial Sequence
  chemically synthesized
gatctgcgtatcagatctcctg

SEQ ID NO: 758103 - DNA, 22 bp, Artificial Sequence
  chemically synthesized
ctaactgagttcaggagatctg

SEQ ID NO: 758104 - DNA, 22 bp, Artificial Sequence
  chemically synthesized
taactgagttcaggagatctga

SEQ ID NO: 758105 - DNA, 22 bp, Artificial Sequence
  chemically synthesized
actgagttcaggagatctgata

SEQ ID NO: 758106 - DNA, 22 bp, Artificial Sequence
  chemically synthesized
aaactggatctgcgtatcagat

SEQ ID NO: 758107 - DNA, 22 bp, Artificial Sequence
  chemically synthesized
gaaactggatctgcgtatcaga

SEQ ID NO: 758108 - DNA, 22 bp, Artificial Sequence
  chemically synthesized
agttcaggagatctgatacgca

SEQ ID NO: 758109 - DNA, 22 bp, Artificial Sequence
  chemically synthesized
aggagatctgatacgcagatcc

SEQ ID NO: 758110 - DNA, 22 bp, Artificial Sequence
  chemically synthesized
atacgcagatccagtttcaagg

SEQ ID NO: 758111 - DNA, 22 bp, Artificial Sequence
  chemically synthesized
tgggcaaaagaacaatggaaaa

SEQ ID NO: 758112 - DNA, 22 bp, Artificial Sequence
  chemically synthesized
caaggattttccattgttcttt

SEQ ID NO: 758113 - DNA, 22 bp, Artificial Sequence
  chemically synthesized
aaggattttccattgttctttt

SEQ ID NO: 758114 - DNA, 22 bp, Artificial Sequence
  chemically synthesized
aagcctatgggcaaaagaacaa

SEQ ID NO: 758115 - DNA, 22 bp, Artificial Sequence
  chemically synthesized
gaagcctatgggcaaaagaaca

SEQ ID NO: 758116 - DNA, 22 bp, Artificial Sequence
  chemically synthesized
ttgaagcctatgggcaaaagaa

SEQ ID NO: 758117 - DNA, 22 bp, Artificial Sequence
  chemically synthesized
tccattgttcttttgcccatag

SEQ ID NO: 758118 - DNA, 22 bp, Artificial Sequence
  chemically synthesized
ccattgttcttttgcccatagg

SEQ ID NO: 758119 - DNA, 22 bp, Artificial Sequence
  chemically synthesized
cattgttcttttgcccataggc

SEQ ID NO: 758120 - DNA, 22 bp, Artificial Sequence
  chemically synthesized
gtgatgctcttgaagcctatgg

SEQ ID NO: 758121 - DNA, 22 bp, Artificial Sequence
  chemically synthesized
ttcttttgcccataggcttcaa

SEQ ID NO: 758122 - DNA, 22 bp, Artificial Sequence
  chemically synthesized
gttagtgatgctcttgaagcct

SEQ ID NO: 758123 - DNA, 22 bp, Artificial Sequence
  chemically synthesized
ttttgcccataggcttcaagag

SEQ ID NO: 758124 - DNA, 22 bp, Artificial Sequence
  chemically synthesized
ttgcccataggcttcaagagca

SEQ ID NO: 758125 - DNA, 22 bp, Artificial Sequence
  chemically synthesized
tctagttagtgatgctcttgaa

SEQ ID NO: 758126 - DNA, 22 bp, Artificial Sequence
  chemically synthesized
tgcccataggcttcaagagcat

SEQ ID NO: 758127 - DNA, 22 bp, Artificial Sequence
  chemically synthesized
gcccataggcttcaagagcatc

SEQ ID NO: 758128 - DNA, 22 bp, Artificial Sequence
  chemically synthesized
cccataggcttcaagagcatca

SEQ ID NO: 758129 - DNA, 22 bp, Artificial Sequence
  chemically synthesized
atatatggactgtctagttagt

SEQ ID NO: 758130 - DNA, 22 bp, Artificial Sequence
  chemically synthesized
catatatggactgtctagttag

SEQ ID NO: 758131 - DNA, 22 bp, Artificial Sequence
  chemically synthesized
caagagcatcactaactagaca

SEQ ID NO: 758132 - DNA, 22 bp, Artificial Sequence
  chemically synthesized
tcatatatggactgtctagtta

SEQ ID NO: 758133 - DNA, 22 bp, Artificial Sequence
  chemically synthesized
aagagcatcactaactagacag

SEQ ID NO: 758134 - DNA, 22 bp, Artificial Sequence
  chemically synthesized
actagacagtccatatatgaaa

SEQ ID NO: 758135 - DNA, 22 bp, Artificial Sequence
  chemically synthesized
gacagtccatatatgaaagggc

SEQ ID NO: 758136 - DNA, 22 bp, Artificial Sequence
  chemically synthesized
tcacatgtatgtggtagccctt

SEQ ID NO: 758137 - DNA, 22 bp, Artificial Sequence
  chemically synthesized
gtcacatgtatgtggtagccct

SEQ ID NO: 758138 - DNA, 22 bp, Artificial Sequence
  chemically synthesized
tgtcacatgtatgtggtagccc

SEQ ID NO: 758139 - DNA, 22 bp, Artificial Sequence
  chemically synthesized
aaagttttgtcacatgtatgtg

SEQ ID NO: 758140 - DNA, 22 bp, Artificial Sequence
  chemically synthesized
actcaaagttttgtcacatgta

SEQ ID NO: 758141 - DNA, 22 bp, Artificial Sequence
  chemically synthesized
gactcaaagttttgtcacatgt

SEQ ID NO: 758142 - DNA, 22 bp, Artificial Sequence
  chemically synthesized
tttgactcaaagttttgtcaca

SEQ ID NO: 758143 - DNA, 22 bp, Artificial Sequence
  chemically synthesized
ccacatacatgtgacaaaactt

SEQ ID NO: 758144 - DNA, 22 bp, Artificial Sequence
  chemically synthesized
gtagcctgtttgactcaaagtt

SEQ ID NO: 758145 - DNA, 22 bp, Artificial Sequence
  chemically synthesized
agtagcctgtttgactcaaagt

SEQ ID NO: 758146 - DNA, 22 bp, Artificial Sequence
  chemically synthesized
atgagagaacagtttagtagcc

SEQ ID NO: 758147 - DNA, 22 bp, Artificial Sequence
  chemically synthesized
tgagtcaaacaggctactaaac

SEQ ID NO: 758148 - DNA, 22 bp, Artificial Sequence
  chemically synthesized
gagtcaaacaggctactaaact

SEQ ID NO: 758149 - DNA, 22 bp, Artificial Sequence
  chemically synthesized
agtcaaacaggctactaaactg

SEQ ID NO: 758150 - DNA, 22 bp, Artificial Sequence
  chemically synthesized
agtgctgatgagagaacagttt

SEQ ID NO: 758151 - DNA, 22 bp, Artificial Sequence
  chemically synthesized
ctgagtgctgatgagagaacag

SEQ ID NO: 758152 - DNA, 22 bp, Artificial Sequence
  chemically synthesized
ctaaactgttctctcatcagca

SEQ ID NO: 758153 - DNA, 22 bp, Artificial Sequence
  chemically synthesized
aactgttctctcatcagcactc

SEQ ID NO: 758154 - DNA, 22 bp, Artificial Sequence
  chemically synthesized
ttctctcatcagcactcaggag

SEQ ID NO: 758155 - DNA, 22 bp, Artificial Sequence
  chemically synthesized
aaacaacatcatcgctcctgag

SEQ ID NO: 758156 - DNA, 22 bp, Artificial Sequence
  chemically synthesized
tctcatcagcactcaggagcga

SEQ ID NO: 758157 - DNA, 22 bp, Artificial Sequence
  chemically synthesized
tcatcagcactcaggagcgatg

SEQ ID NO: 758158 - DNA, 22 bp, Artificial Sequence
  chemically synthesized
ctcaaacaacatcatcgctcct

SEQ ID NO: 758159 - DNA, 22 bp, Artificial Sequence
  chemically synthesized
cctcaaacaacatcatcgctcc

SEQ ID NO: 758160 - DNA, 22 bp, Artificial Sequence
  chemically synthesized
atcagcactcaggagcgatgat

SEQ ID NO: 758161 - DNA, 22 bp, Artificial Sequence
  chemically synthesized
cttcctcaaacaacatcatcgc

SEQ ID NO: 758162 - DNA, 22 bp, Artificial Sequence
  chemically synthesized
tccttcctcaaacaacatcatc

SEQ ID NO: 758163 - DNA, 22 bp, Artificial Sequence
  chemically synthesized
aggagcgatgatgttgtttgag

SEQ ID NO: 758164 - DNA, 22 bp, Artificial Sequence
  chemically synthesized
acacaaaacactctccttcctc

SEQ ID NO: 758165 - DNA, 22 bp, Artificial Sequence
  chemically synthesized
gacacaaaacactctccttcct

SEQ ID NO: 758166 - DNA, 22 bp, Artificial Sequence
  chemically synthesized
ttgacacaaaacactctccttc

SEQ ID NO: 758167 - DNA, 22 bp, Artificial Sequence
  chemically synthesized
tttgaggaaggagagtgttttg

SEQ ID NO: 758168 - DNA, 22 bp, Artificial Sequence
  chemically synthesized
gaggaaggagagtgttttgtgt

SEQ ID NO: 758169 - DNA, 22 bp, Artificial Sequence
  chemically synthesized
aggaaggagagtgttttgtgtc

SEQ ID NO: 758170 - DNA, 22 bp, Artificial Sequence
  chemically synthesized
agaaaaattcttgacacaaaac

SEQ ID NO: 758171 - DNA, 22 bp, Artificial Sequence
  chemically synthesized
aagaaaaattcttgacacaaaa

SEQ ID NO: 758172 - DNA, 22 bp, Artificial Sequence
  chemically synthesized
taagaaaaattcttgacacaaa

SEQ ID NO: 758173 - DNA, 22 bp, Artificial Sequence
  chemically synthesized
gtatctttaagaaaaattcttg

SEQ ID NO: 758174 - DNA, 22 bp, Artificial Sequence
  chemically synthesized
ggtatctttaagaaaaattctt

SEQ ID NO: 758175 - DNA, 22 bp, Artificial Sequence
  chemically synthesized
ttggtatctttaagaaaaattc

SEQ ID NO: 758176 - DNA, 22 bp, Artificial Sequence
  chemically synthesized
tcttggtatctttaagaaaaat

SEQ ID NO: 758177 - DNA, 22 bp, Artificial Sequence
  chemically synthesized
ctcttggtatctttaagaaaaa

SEQ ID NO: 758178 - DNA, 22 bp, Artificial Sequence
  chemically synthesized
tgtgtcaagaatttttcttaaa

SEQ ID NO: 758179 - DNA, 22 bp, Artificial Sequence
  chemically synthesized
gtgtcaagaatttttcttaaag

SEQ ID NO: 758180 - DNA, 22 bp, Artificial Sequence
  chemically synthesized
tgtcaagaatttttcttaaaga

SEQ ID NO: 758181 - DNA, 22 bp, Artificial Sequence
  chemically synthesized
aagcttctcttggtatctttaa

SEQ ID NO: 758182 - DNA, 22 bp, Artificial Sequence
  chemically synthesized
caagcttctcttggtatcttta

SEQ ID NO: 758183 - DNA, 22 bp, Artificial Sequence
  chemically synthesized
tcaagcttctcttggtatcttt

SEQ ID NO: 758184 - DNA, 22 bp, Artificial Sequence
  chemically synthesized
ttcaagcttctcttggtatctt

SEQ ID NO: 758185 - DNA, 22 bp, Artificial Sequence
  chemically synthesized
tttcaagcttctcttggtatct

SEQ ID NO: 758186 - DNA, 22 bp, Artificial Sequence
  chemically synthesized
ttcttaaagataccaagagaag

SEQ ID NO: 758187 - DNA, 22 bp, Artificial Sequence
  chemically synthesized
tcttaaagataccaagagaagc

SEQ ID NO: 758188 - DNA, 22 bp, Artificial Sequence
  chemically synthesized
cttaaagataccaagagaagct

SEQ ID NO: 758189 - DNA, 22 bp, Artificial Sequence
  chemically synthesized
ttaaagataccaagagaagctt

SEQ ID NO: 758190 - DNA, 22 bp, Artificial Sequence
  chemically synthesized
aaagataccaagagaagcttga

SEQ ID NO: 758191 - DNA, 22 bp, Artificial Sequence
  chemically synthesized
aagataccaagagaagcttgaa

SEQ ID NO: 758192 - DNA, 22 bp, Artificial Sequence
  chemically synthesized
gcgcaatgctttttcaagcttc

SEQ ID NO: 758193 - DNA, 22 bp, Artificial Sequence
  chemically synthesized
ggcgcaatgctttttcaagctt

SEQ ID NO: 758194 - DNA, 22 bp, Artificial Sequence
  chemically synthesized
tagtttggcgcaatgctttttc

SEQ ID NO: 758195 - DNA, 22 bp, Artificial Sequence
  chemically synthesized
gtagtttggcgcaatgcttttt

SEQ ID NO: 758196 - DNA, 22 bp, Artificial Sequence
  chemically synthesized
cttgtagtttggcgcaatgctt

SEQ ID NO: 758197 - DNA, 22 bp, Artificial Sequence
  chemically synthesized
acttgtagtttggcgcaatgct

SEQ ID NO: 758198 - DNA, 22 bp, Artificial Sequence
  chemically synthesized
tacttgtagtttggcgcaatgc

SEQ ID NO: 758199 - DNA, 22 bp, Artificial Sequence
  chemically synthesized
ttacttgtagtttggcgcaatg

SEQ ID NO: 758200 - DNA, 22 bp, Artificial Sequence
  chemically synthesized
gaaaaagcattgcgccaaacta

SEQ ID NO: 758201 - DNA, 22 bp, Artificial Sequence
  chemically synthesized
aaaaagcattgcgccaaactac

SEQ ID NO: 758202 - DNA, 22 bp, Artificial Sequence
  chemically synthesized
cgccaaactacaagtaaaagct

SEQ ID NO: 758203 - DNA, 22 bp, Artificial Sequence
  chemically synthesized
aataaacatacgacatacagct

SEQ ID NO: 758204 - DNA, 22 bp, Artificial Sequence
  chemically synthesized
caataaacatacgacatacagc

SEQ ID NO: 758205 - DNA, 22 bp, Artificial Sequence
  chemically synthesized
caagtaaaagctgtatgtcgta

SEQ ID NO: 758206 - DNA, 22 bp, Artificial Sequence
  chemically synthesized
tgaatggtgcttcaataaacat

SEQ ID NO: 758207 - DNA, 22 bp, Artificial Sequence
  chemically synthesized
ttgtgaatggtgcttcaataaa

SEQ ID NO: 758208 - DNA, 22 bp, Artificial Sequence
  chemically synthesized
tatgtcgtatgtttattgaagc

SEQ ID NO: 758209 - DNA, 22 bp, Artificial Sequence
  chemically synthesized
ctattgtgaatggtgcttcaat

SEQ ID NO: 758210 - DNA, 22 bp, Artificial Sequence
  chemically synthesized
gctattgtgaatggtgcttcaa

SEQ ID NO: 758211 - DNA, 22 bp, Artificial Sequence
  chemically synthesized
tgctattgtgaatggtgcttca

SEQ ID NO: 758212 - DNA, 22 bp, Artificial Sequence
  chemically synthesized
cacgcctttgctattgtgaatg

SEQ ID NO: 758213 - DNA, 22 bp, Artificial Sequence
  chemically synthesized
attgaagcaccattcacaatag

SEQ ID NO: 758214 - DNA, 22 bp, Artificial Sequence
  chemically synthesized
ttgaagcaccattcacaatagc

SEQ ID NO: 758215 - DNA, 22 bp, Artificial Sequence
  chemically synthesized
gttccacgcctttgctattgtg

SEQ ID NO: 758216 - DNA, 22 bp, Artificial Sequence
  chemically synthesized
aagcaccattcacaatagcaaa

SEQ ID NO: 758217 - DNA, 22 bp, Artificial Sequence
  chemically synthesized
ggttggttccacgcctttgcta

SEQ ID NO: 758218 - DNA, 22 bp, Artificial Sequence
  chemically synthesized
gggttggttccacgcctttgct

SEQ ID NO: 758219 - DNA, 22 bp, Artificial Sequence
  chemically synthesized
acaatagcaaaggcgtggaacc

SEQ ID NO: 758220 - DNA, 22 bp, Artificial Sequence
  chemically synthesized
atgggcatttgggttggttcca

SEQ ID NO: 758221 - DNA, 22 bp, Artificial Sequence
  chemically synthesized
atccagtatatcattgatgggc

SEQ ID NO: 758222 - DNA, 22 bp, Artificial Sequence
  chemically synthesized
aatccagtatatcattgatggg

SEQ ID NO: 758223 - DNA, 22 bp, Artificial Sequence
  chemically synthesized
ttaatccagtatatcattgatg

SEQ ID NO: 758224 - DNA, 22 bp, Artificial Sequence
  chemically synthesized
cttaatccagtatatcattgat

SEQ ID NO: 758225 - DNA, 22 bp, Artificial Sequence
  chemically synthesized
tcttaatccagtatatcattga

SEQ ID NO: 758226 - DNA, 22 bp, Artificial Sequence
  chemically synthesized
catggtgtacatgtgccacatt

SEQ ID NO: 758227 - DNA, 22 bp, Artificial Sequence
  chemically synthesized
gattaagaaaatgtggcacatg

SEQ ID NO: 758228 - DNA, 22 bp, Artificial Sequence
  chemically synthesized
agaaaatgtggcacatgtacac

SEQ ID NO: 758229 - DNA, 22 bp, Artificial Sequence
  chemically synthesized
acagtattccatggtgtacatg

SEQ ID NO: 758230 - DNA, 22 bp, Artificial Sequence
  chemically synthesized
cacagtattccatggtgtacat

SEQ ID NO: 758231 - DNA, 22 bp, Artificial Sequence
  chemically synthesized
tggcttcacagtattccatggt

SEQ ID NO: 758232 - DNA, 22 bp, Artificial Sequence
  chemically synthesized
atggcttcacagtattccatgg

SEQ ID NO: 758233 - DNA, 22 bp, Artificial Sequence
  chemically synthesized
tatggcttcacagtattccatg

SEQ ID NO: 758234 - DNA, 22 bp, Artificial Sequence
  chemically synthesized
ttatggcttcacagtattccat

SEQ ID NO: 758235 - DNA, 22 bp, Artificial Sequence
  chemically synthesized
tttatggcttcacagtattcca

SEQ ID NO: 758236 - DNA, 22 bp, Artificial Sequence
  chemically synthesized
ttttatggcttcacagtattcc

SEQ ID NO: 758237 - DNA, 22 bp, Artificial Sequence
  chemically synthesized
atccttttttatggcttcacag

SEQ ID NO: 758238 - DNA, 22 bp, Artificial Sequence
  chemically synthesized
tgaagccataaaaaaggatgag

SEQ ID NO: 758239 - DNA, 22 bp, Artificial Sequence
  chemically synthesized
caaaggacatgatctcatcctt

SEQ ID NO: 758240 - DNA, 22 bp, Artificial Sequence
  chemically synthesized
atccatgtccctgcaaaggaca

SEQ ID NO: 758241 - DNA, 22 bp, Artificial Sequence
  chemically synthesized
catccatgtccctgcaaaggac

SEQ ID NO: 758242 - DNA, 22 bp, Artificial Sequence
  chemically synthesized
cagcttcatccatgtccctgca

SEQ ID NO: 758243 - DNA, 22 bp, Artificial Sequence
  chemically synthesized
ccagcttcatccatgtccctgc

SEQ ID NO: 758244 - DNA, 22 bp, Artificial Sequence
  chemically synthesized
tgcagggacatggatgaagctg

SEQ ID NO: 758245 - DNA, 22 bp, Artificial Sequence
  chemically synthesized
gcagggacatggatgaagctgg

SEQ ID NO: 758246 - DNA, 22 bp, Artificial Sequence
  chemically synthesized
cagggacatggatgaagctgga

SEQ ID NO: 758247 - DNA, 22 bp, Artificial Sequence
  chemically synthesized
agaatgatggtttccagcttca

SEQ ID NO: 758248 - DNA, 22 bp, Artificial Sequence
  chemically synthesized
ctgagaatgatggtttccagct

SEQ ID NO: 758249 - DNA, 22 bp, Artificial Sequence
  chemically synthesized
gctgagaatgatggtttccagc

SEQ ID NO: 758250 - DNA, 22 bp, Artificial Sequence
  chemically synthesized
gtttgctgagaatgatggtttc

SEQ ID NO: 758251 - DNA, 22 bp, Artificial Sequence
  chemically synthesized
ttagtttgctgagaatgatggt

SEQ ID NO: 758252 - DNA, 22 bp, Artificial Sequence
  chemically synthesized
tgttagtttgctgagaatgatg

SEQ ID NO: 758253 - DNA, 22 bp, Artificial Sequence
  chemically synthesized
ctctgttagtttgctgagaatg

SEQ ID NO: 758254 - DNA, 22 bp, Artificial Sequence
  chemically synthesized
gaaaccatcattctcagcaaac

SEQ ID NO: 758255 - DNA, 22 bp, Artificial Sequence
  chemically synthesized
ggttcctctgttagtttgctga

SEQ ID NO: 758256 - DNA, 22 bp, Artificial Sequence
  chemically synthesized
cggttcctctgttagtttgctg

SEQ ID NO: 758257 - DNA, 22 bp, Artificial Sequence
  chemically synthesized
tcggttcctctgttagtttgct

SEQ ID NO: 758258 - DNA, 22 bp, Artificial Sequence
  chemically synthesized
gttttcggttcctctgttagtt

SEQ ID NO: 758259 - DNA, 22 bp, Artificial Sequence
  chemically synthesized
ggttttcggttcctctgttagt

SEQ ID NO: 758260 - DNA, 22 bp, Artificial Sequence
  chemically synthesized
tcagcaaactaacagaggaacc

SEQ ID NO: 758261 - DNA, 22 bp, Artificial Sequence
  chemically synthesized
agcaaactaacagaggaaccga

SEQ ID NO: 758262 - DNA, 22 bp, Artificial Sequence
  chemically synthesized
acagaggaaccgaaaaccaaac

SEQ ID NO: 758263 - DNA, 22 bp, Artificial Sequence
  chemically synthesized
tgagtgagaccatgcagtgttt

SEQ ID NO: 758264 - DNA, 22 bp, Artificial Sequence
  chemically synthesized
atgagtgagaccatgcagtgtt

SEQ ID NO: 758265 - DNA, 22 bp, Artificial Sequence
  chemically synthesized
ccacttatgagtgagaccatgc

SEQ ID NO: 758266 - DNA, 22 bp, Artificial Sequence
  chemically synthesized
tctcccacttatgagtgagacc

SEQ ID NO: 758267 - DNA, 22 bp, Artificial Sequence
  chemically synthesized
atctcccacttatgagtgagac

SEQ ID NO: 758268 - DNA, 22 bp, Artificial Sequence
  chemically synthesized
tttatctcccacttatgagtga

SEQ ID NO: 758269 - DNA, 22 bp, Artificial Sequence
  chemically synthesized
attgtttatctcccacttatga

SEQ ID NO: 758270 - DNA, 22 bp, Artificial Sequence
  chemically synthesized
catggtctcactcataagtggg

SEQ ID NO: 758271 - DNA, 22 bp, Artificial Sequence
  chemically synthesized
cattgtttatctcccacttatg

SEQ ID NO: 758272 - DNA, 22 bp, Artificial Sequence
  chemically synthesized
tcattgtttatctcccacttat

SEQ ID NO: 758273 - DNA, 22 bp, Artificial Sequence
  chemically synthesized
actcataagtgggagataaaca

SEQ ID NO: 758274 - DNA, 22 bp, Artificial Sequence
  chemically synthesized
ataagtgggagataaacaatga

SEQ ID NO: 758275 - DNA, 22 bp, Artificial Sequence
  chemically synthesized
tgtccatatgttttcattgttt

SEQ ID NO: 758276 - DNA, 22 bp, Artificial Sequence
  chemically synthesized
cctgtgtccatatgttttcatt

SEQ ID NO: 758277 - DNA, 22 bp, Artificial Sequence
  chemically synthesized
ccctccctgtgtccatatgttt

SEQ ID NO: 758278 - DNA, 22 bp, Artificial Sequence
  chemically synthesized
acaggccccagtgtgtgatgtt

SEQ ID NO: 758279 - DNA, 22 bp, Artificial Sequence
  chemically synthesized
gccccccaccccctgacaggcc

SEQ ID NO: 758280 - DNA, 22 bp, Artificial Sequence
  chemically synthesized
ccctagccccccaccccctgac

SEQ ID NO: 758281 - DNA, 22 bp, Artificial Sequence
  chemically synthesized
gggcctgtcagggggtgggggg

SEQ ID NO: 758282 - DNA, 22 bp, Artificial Sequence
  chemically synthesized
tccctcccctagccccccaccc

SEQ ID NO: 758283 - DNA, 22 bp, Artificial Sequence
  chemically synthesized
atgctatccctcccctagcccc

SEQ ID NO: 758284 - DNA, 22 bp, Artificial Sequence
  chemically synthesized
tcagggggtggggggctagggg

SEQ ID NO: 758285 - DNA, 22 bp, Artificial Sequence
  chemically synthesized
ctaatgctatccctcccctagc

SEQ ID NO: 758286 - DNA, 22 bp, Artificial Sequence
  chemically synthesized
tcctaatgctatccctccccta

SEQ ID NO: 758287 - DNA, 22 bp, Artificial Sequence
  chemically synthesized
ctcctaatgctatccctcccct

SEQ ID NO: 758288 - DNA, 22 bp, Artificial Sequence
  chemically synthesized
ggtatttctcctaatgctatcc

SEQ ID NO: 758289 - DNA, 22 bp, Artificial Sequence
  chemically synthesized
cattaggtatttctcctaatgc

SEQ ID NO: 758290 - DNA, 22 bp, Artificial Sequence
  chemically synthesized
ggggagggatagcattaggaga

SEQ ID NO: 758291 - DNA, 22 bp, Artificial Sequence
  chemically synthesized
ggagaaatacctaatgtagatg

SEQ ID NO: 758292 - DNA, 22 bp, Artificial Sequence
  chemically synthesized
ccacacccatcaacccgtcatc

SEQ ID NO: 758293 - DNA, 22 bp, Artificial Sequence
  chemically synthesized
gccacacccatcaacccgtcat

SEQ ID NO: 758294 - DNA, 22 bp, Artificial Sequence
  chemically synthesized
atgtagatgacgggttgatggg

SEQ ID NO: 758295 - DNA, 22 bp, Artificial Sequence
  chemically synthesized
atgggtgtggcaaaccaccatg

SEQ ID NO: 758296 - DNA, 22 bp, Artificial Sequence
  chemically synthesized
cataggtatacatgtgccatgg

SEQ ID NO: 758297 - DNA, 22 bp, Artificial Sequence
  chemically synthesized
ttacataggtatacatgtgcca

SEQ ID NO: 758298 - DNA, 22 bp, Artificial Sequence
  chemically synthesized
gttacataggtatacatgtgcc

SEQ ID NO: 758299 - DNA, 22 bp, Artificial Sequence
  chemically synthesized
ggatacatgtgcagaaagtgca

SEQ ID NO: 758300 - DNA, 22 bp, Artificial Sequence
  chemically synthesized
tgtaacaaacctgcactttctg

SEQ ID NO: 758301 - DNA, 22 bp, Artificial Sequence
  chemically synthesized
tgggatacatgtgcagaaagtg

SEQ ID NO: 758302 - DNA, 22 bp, Artificial Sequence
  chemically synthesized
cattctgggatacatgtgcaga

SEQ ID NO: 758303 - DNA, 22 bp, Artificial Sequence
  chemically synthesized
acattctgggatacatgtgcag

SEQ ID NO: 758304 - DNA, 22 bp, Artificial Sequence
  chemically synthesized
tacattctgggatacatgtgca

SEQ ID NO: 758305 - DNA, 22 bp, Artificial Sequence
  chemically synthesized
cactttctgcacatgtatccca

SEQ ID NO: 758306 - DNA, 22 bp, Artificial Sequence
  chemically synthesized
tactttacattctgggatacat

SEQ ID NO: 758307 - DNA, 22 bp, Artificial Sequence
  chemically synthesized
ttatactttacattctgggata

SEQ ID NO: 758308 - DNA, 22 bp, Artificial Sequence
  chemically synthesized
tctgcacatgtatcccagaatg

SEQ ID NO: 758309 - DNA, 22 bp, Artificial Sequence
  chemically synthesized
ctgcacatgtatcccagaatgt

SEQ ID NO: 758310 - DNA, 22 bp, Artificial Sequence
  chemically synthesized
ttattatactttacattctggg

SEQ ID NO: 758311 - DNA, 22 bp, Artificial Sequence
  chemically synthesized
tgcacatgtatcccagaatgta

SEQ ID NO: 758312 - DNA, 22 bp, Artificial Sequence
  chemically synthesized
attattatactttacattctgg

SEQ ID NO: 758313 - DNA, 22 bp, Artificial Sequence
  chemically synthesized
tattattatactttacattctg

SEQ ID NO: 758314 - DNA, 22 bp, Artificial Sequence
  chemically synthesized
cacatgtatcccagaatgtaaa

SEQ ID NO: 758315 - DNA, 22 bp, Artificial Sequence
  chemically synthesized
ttattattatactttacattct

SEQ ID NO: 758316 - DNA, 22 bp, Artificial Sequence
  chemically synthesized
tttattattatactttacattc

SEQ ID NO: 758317 - DNA, 22 bp, Artificial Sequence
  chemically synthesized
ttttattattatactttacatt

SEQ ID NO: 758318 - DNA, 22 bp, Artificial Sequence
  chemically synthesized
tttttattattatactttacat

SEQ ID NO: 758319 - DNA, 22 bp, Artificial Sequence
  chemically synthesized
ttttttattattatactttaca

SEQ ID NO: 758320 - DNA, 22 bp, Artificial Sequence
  chemically synthesized
atgcacaggtttttttttatta

SEQ ID NO: 758321 - DNA, 22 bp, Artificial Sequence
  chemically synthesized
gatgcacaggtttttttttatt

SEQ ID NO: 758322 - DNA, 22 bp, Artificial Sequence
  chemically synthesized
tgatgcacaggtttttttttat

SEQ ID NO: 758323 - DNA, 22 bp, Artificial Sequence
  chemically synthesized
ctttgatgcacaggtttttttt

SEQ ID NO: 758324 - DNA, 22 bp, Artificial Sequence
  chemically synthesized
taaagtgtgtagagctactttg

SEQ ID NO: 758325 - DNA, 22 bp, Artificial Sequence
  chemically synthesized
gtaaagtgtgtagagctacttt

SEQ ID NO: 758326 - DNA, 22 bp, Artificial Sequence
  chemically synthesized
tgtaaagtgtgtagagctactt

SEQ ID NO: 758327 - DNA, 22 bp, Artificial Sequence
  chemically synthesized
ttgtaaagtgtgtagagctact

SEQ ID NO: 758328 - DNA, 22 bp, Artificial Sequence
  chemically synthesized
tttgtaaagtgtgtagagctac

SEQ ID NO: 758329 - DNA, 22 bp, Artificial Sequence
  chemically synthesized
tgcatcaaagtagctctacaca

SEQ ID NO: 758330 - DNA, 22 bp, Artificial Sequence
  chemically synthesized
agcatctttttgtaaagtgtgt

SEQ ID NO: 758331 - DNA, 22 bp, Artificial Sequence
  chemically synthesized
attaagcatctttttgtaaagt

SEQ ID NO: 758332 - DNA, 22 bp, Artificial Sequence
  chemically synthesized
taattaagcatctttttgtaaa

SEQ ID NO: 758333 - DNA, 22 bp, Artificial Sequence
  chemically synthesized
ctaattaagcatctttttgtaa

SEQ ID NO: 758334 - DNA, 22 bp, Artificial Sequence
  chemically synthesized
tttctaattaagcatctttttg

SEQ ID NO: 758335 - DNA, 22 bp, Artificial Sequence
  chemically synthesized
tacacactttacaaaaagatgc

SEQ ID NO: 758336 - DNA, 22 bp, Artificial Sequence
  chemically synthesized
atttctaattaagcatcttttt

SEQ ID NO: 758337 - DNA, 22 bp, Artificial Sequence
  chemically synthesized
cacactttacaaaaagatgctt

SEQ ID NO: 758338 - DNA, 22 bp, Artificial Sequence
  chemically synthesized
tttatttctaattaagcatctt

SEQ ID NO: 758339 - DNA, 22 bp, Artificial Sequence
  chemically synthesized
tgtttatttctaattaagcatc

SEQ ID NO: 758340 - DNA, 22 bp, Artificial Sequence
  chemically synthesized
ctgtttatttctaattaagcat

SEQ ID NO: 758341 - DNA, 22 bp, Artificial Sequence
  chemically synthesized
tctgtttatttctaattaagca

SEQ ID NO: 758342 - DNA, 22 bp, Artificial Sequence
  chemically synthesized
tacaaaaagatgcttaattaga

SEQ ID NO: 758343 - DNA, 22 bp, Artificial Sequence
  chemically synthesized
acaaaaagatgcttaattagaa

SEQ ID NO: 758344 - DNA, 22 bp, Artificial Sequence
  chemically synthesized
caaaaagatgcttaattagaaa

SEQ ID NO: 758345 - DNA, 22 bp, Artificial Sequence
  chemically synthesized
caggagttttctgtttatttct

SEQ ID NO: 758346 - DNA, 22 bp, Artificial Sequence
  chemically synthesized
acaggagttttctgtttatttc

SEQ ID NO: 758347 - DNA, 22 bp, Artificial Sequence
  chemically synthesized
tttacaggagttttctgtttat

SEQ ID NO: 758348 - DNA, 22 bp, Artificial Sequence
  chemically synthesized
atttacaggagttttctgttta

SEQ ID NO: 758349 - DNA, 22 bp, Artificial Sequence
  chemically synthesized
ttatttacaggagttttctgtt

SEQ ID NO: 758350 - DNA, 22 bp, Artificial Sequence
  chemically synthesized
aattagaaataaacagaaaact

SEQ ID NO: 758351 - DNA, 22 bp, Artificial Sequence
  chemically synthesized
cttatttacaggagttttctgt

SEQ ID NO: 758352 - DNA, 22 bp, Artificial Sequence
  chemically synthesized
attagaaataaacagaaaactc

SEQ ID NO: 758353 - DNA, 22 bp, Artificial Sequence
  chemically synthesized
ccttcttatttacaggagtttt

SEQ ID NO: 758354 - DNA, 22 bp, Artificial Sequence
  chemically synthesized
gaaataaacagaaaactcctgt

SEQ ID NO: 758355 - DNA, 22 bp, Artificial Sequence
  chemically synthesized
ctgtaaataagaagggaatacc

SEQ ID NO: 758356 - DNA, 22 bp, Artificial Sequence
  chemically synthesized
taaataagaagggaataccact

SEQ ID NO: 758357 - DNA, 22 bp, Artificial Sequence
  chemically synthesized
agaccaagagcagggaaagaaa

SEQ ID NO: 758358 - DNA, 22 bp, Artificial Sequence
  chemically synthesized
ttgagaccaagagcagggaaag

SEQ ID NO: 758359 - DNA, 22 bp, Artificial Sequence
  chemically synthesized
tattctttctttccctgctctt

SEQ ID NO: 758360 - DNA, 22 bp, Artificial Sequence
  chemically synthesized
ttctttctttccctgctcttgg

SEQ ID NO: 758361 - DNA, 22 bp, Artificial Sequence
  chemically synthesized
tttctttccctgctcttggtct

SEQ ID NO: 758362 - DNA, 22 bp, Artificial Sequence
  chemically synthesized
tctttccctgctcttggtctca

SEQ ID NO: 758363 - DNA, 22 bp, Artificial Sequence
  chemically synthesized
ctttccctgctcttggtctcaa

SEQ ID NO: 758364 - DNA, 22 bp, Artificial Sequence
  chemically synthesized
tttccctgctcttggtctcaat

SEQ ID NO: 758365 - DNA, 22 bp, Artificial Sequence
  chemically synthesized
tccctgctcttggtctcaatag

SEQ ID NO: 758366 - DNA, 22 bp, Artificial Sequence
  chemically synthesized
gataaaggaaggctattgagac

SEQ ID NO: 758367 - DNA, 22 bp, Artificial Sequence
  chemically synthesized
ccctgctcttggtctcaatagc

SEQ ID NO: 758368 - DNA, 22 bp, Artificial Sequence
  chemically synthesized
cctgctcttggtctcaatagcc

SEQ ID NO: 758369 - DNA, 22 bp, Artificial Sequence
  chemically synthesized
gttagataaaggaaggctattg

SEQ ID NO: 758370 - DNA, 22 bp, Artificial Sequence
  chemically synthesized
ctcttggtctcaatagccttcc

SEQ ID NO: 758371 - DNA, 22 bp, Artificial Sequence
  chemically synthesized
ttggtctcaatagccttccttt

SEQ ID NO: 758372 - DNA, 22 bp, Artificial Sequence
  chemically synthesized
ggtctcaatagccttcctttat

SEQ ID NO: 758373 - DNA, 22 bp, Artificial Sequence
  chemically synthesized
gtctcaatagccttcctttatc

SEQ ID NO: 758374 - DNA, 22 bp, Artificial Sequence
  chemically synthesized
aatagccttcctttatctaacc

SEQ ID NO: 758375 - DNA, 22 bp, Artificial Sequence
  chemically synthesized
gtatacagtagacactggttag

SEQ ID NO: 758376 - DNA, 22 bp, Artificial Sequence
  chemically synthesized
cctttatctaaccagtgtctac

SEQ ID NO: 758377 - DNA, 22 bp, Artificial Sequence
  chemically synthesized
ctttatctaaccagtgtctact

SEQ ID NO: 758378 - DNA, 22 bp, Artificial Sequence
  chemically synthesized
tatctaaccagtgtctactgta

SEQ ID NO: 758379 - DNA, 22 bp, Artificial Sequence
  chemically synthesized
atctaaccagtgtctactgtat

SEQ ID NO: 758380 - DNA, 22 bp, Artificial Sequence
  chemically synthesized
tctaaccagtgtctactgtata

SEQ ID NO: 758381 - DNA, 22 bp, Artificial Sequence
  chemically synthesized
caaagtgcctagtatacagtag

SEQ ID NO: 758382 - DNA, 22 bp, Artificial Sequence
  chemically synthesized
accagtgtctactgtatactag

SEQ ID NO: 758383 - DNA, 22 bp, Artificial Sequence
  chemically synthesized
agcacattccaaagtgcctagt

SEQ ID NO: 758384 - DNA, 22 bp, Artificial Sequence
  chemically synthesized
ctcagcacattccaaagtgcct

SEQ ID NO: 758385 - DNA, 22 bp, Artificial Sequence
  chemically synthesized
tactcagcacattccaaagtgc

SEQ ID NO: 758386 - DNA, 22 bp, Artificial Sequence
  chemically synthesized
ctgtatactaggcactttggaa

SEQ ID NO: 758387 - DNA, 22 bp, Artificial Sequence
  chemically synthesized
ctactcagcacattccaaagtg

SEQ ID NO: 758388 - DNA, 22 bp, Artificial Sequence
  chemically synthesized
tctactcagcacattccaaagt

SEQ ID NO: 758389 - DNA, 22 bp, Artificial Sequence
  chemically synthesized
ttctactcagcacattccaaag

SEQ ID NO: 758390 - DNA, 22 bp, Artificial Sequence
  chemically synthesized
tatactaggcactttggaatgt

SEQ ID NO: 758391 - DNA, 22 bp, Artificial Sequence
  chemically synthesized
tcatttttctactcagcacatt

SEQ ID NO: 758392 - DNA, 22 bp, Artificial Sequence
  chemically synthesized
ggcactttggaatgtgctgagt

SEQ ID NO: 758393 - DNA, 22 bp, Artificial Sequence
  chemically synthesized
tggaatgtgctgagtagaaaaa

SEQ ID NO: 758394 - DNA, 22 bp, Artificial Sequence
  chemically synthesized
ggaatgtgctgagtagaaaaat

SEQ ID NO: 758395 - DNA, 22 bp, Artificial Sequence
  chemically synthesized
gaatgtgctgagtagaaaaatg

SEQ ID NO: 758396 - DNA, 22 bp, Artificial Sequence
  chemically synthesized
ggagggggaaagctgtcatttt

SEQ ID NO: 758397 - DNA, 22 bp, Artificial Sequence
  chemically synthesized
gggagggggaaagctgtcattt

SEQ ID NO: 758398 - DNA, 22 bp, Artificial Sequence
  chemically synthesized
tgggagggggaaagctgtcatt

SEQ ID NO: 758399 - DNA, 22 bp, Artificial Sequence
  chemically synthesized
ttgggagggggaaagctgtcat

SEQ ID NO: 758400 - DNA, 22 bp, Artificial Sequence
  chemically synthesized
agtagaaaaatgacagctttcc

SEQ ID NO: 758401 - DNA, 22 bp, Artificial Sequence
  chemically synthesized
aagaagatttttgggaggggga

SEQ ID NO: 758402 - DNA, 22 bp, Artificial Sequence
  chemically synthesized
caagaagatttttgggaggggg

SEQ ID NO: 758403 - DNA, 22 bp, Artificial Sequence
  chemically synthesized
tccccctcccaaaaatcttctt

SEQ ID NO: 758404 - DNA, 22 bp, Artificial Sequence
  chemically synthesized
ccccctcccaaaaatcttcttg

SEQ ID NO: 758405 - DNA, 22 bp, Artificial Sequence
  chemically synthesized
aaccatgtccttcaagaagatt

SEQ ID NO: 758406 - DNA, 22 bp, Artificial Sequence
  chemically synthesized
cccctcccaaaaatcttcttga

SEQ ID NO: 758407 - DNA, 22 bp, Artificial Sequence
  chemically synthesized
ctaaaccatgtccttcaagaag

SEQ ID NO: 758408 - DNA, 22 bp, Artificial Sequence
  chemically synthesized
gctaaaccatgtccttcaagaa

SEQ ID NO: 758409 - DNA, 22 bp, Artificial Sequence
  chemically synthesized
ttgctaaaccatgtccttcaag

SEQ ID NO: 758410 - DNA, 22 bp, Artificial Sequence
  chemically synthesized
ccaaaaatcttcttgaaggaca

SEQ ID NO: 758411 - DNA, 22 bp, Artificial Sequence
  chemically synthesized
ctcttgctaaaccatgtccttc

SEQ ID NO: 758412 - DNA, 22 bp, Artificial Sequence
  chemically synthesized
cttgaaggacatggtttagcaa

SEQ ID NO: 758413 - DNA, 22 bp, Artificial Sequence
  chemically synthesized
ttgaaggacatggtttagcaag

SEQ ID NO: 758414 - DNA, 22 bp, Artificial Sequence
  chemically synthesized
gaaggacatggtttagcaagag

SEQ ID NO: 758415 - DNA, 22 bp, Artificial Sequence
  chemically synthesized
aaggacatggtttagcaagagt

SEQ ID NO: 758416 - DNA, 22 bp, Artificial Sequence
  chemically synthesized
ataaatatcgactactcttgct

SEQ ID NO: 758417 - DNA, 22 bp, Artificial Sequence
  chemically synthesized
gataaatatcgactactcttgc

SEQ ID NO: 758418 - DNA, 22 bp, Artificial Sequence
  chemically synthesized
tttgataaatatcgactactct

SEQ ID NO: 758419 - DNA, 22 bp, Artificial Sequence
  chemically synthesized
ctatttgataaatatcgactac

SEQ ID NO: 758420 - DNA, 22 bp, Artificial Sequence
  chemically synthesized
agcaagagtagtcgatatttat

SEQ ID NO: 758421 - DNA, 22 bp, Artificial Sequence
  chemically synthesized
gcaagagtagtcgatatttatc

SEQ ID NO: 758422 - DNA, 22 bp, Artificial Sequence
  chemically synthesized
tcatcacgtacatgtgttacta

SEQ ID NO: 758423 - DNA, 22 bp, Artificial Sequence
  chemically synthesized
gtcatcacgtacatgtgttact

SEQ ID NO: 758424 - DNA, 22 bp, Artificial Sequence
  chemically synthesized
tttgtcatcacgtacatgtgtt

SEQ ID NO: 758425 - DNA, 22 bp, Artificial Sequence
  chemically synthesized
atcaaatagtaacacatgtacg

SEQ ID NO: 758426 - DNA, 22 bp, Artificial Sequence
  chemically synthesized
tcaaatagtaacacatgtacgt

SEQ ID NO: 758427 - DNA, 22 bp, Artificial Sequence
  chemically synthesized
taacatagcgttgtttgtcatc

SEQ ID NO: 758428 - DNA, 22 bp, Artificial Sequence
  chemically synthesized
tataacatagcgttgtttgtca

SEQ ID NO: 758429 - DNA, 22 bp, Artificial Sequence
  chemically synthesized
ctataacatagcgttgtttgtc

SEQ ID NO: 758430 - DNA, 22 bp, Artificial Sequence
  chemically synthesized
tctataacatagcgttgtttgt

SEQ ID NO: 758431 - DNA, 22 bp, Artificial Sequence
  chemically synthesized
ttctataacatagcgttgtttg

SEQ ID NO: 758432 - DNA, 22 bp, Artificial Sequence
  chemically synthesized
cttttctataacatagcgttgt

SEQ ID NO: 758433 - DNA, 22 bp, Artificial Sequence
  chemically synthesized
tctacttttctataacatagcg

SEQ ID NO: 758434 - DNA, 22 bp, Artificial Sequence
  chemically synthesized
aaattgtctacttttctataac

SEQ ID NO: 758435 - DNA, 22 bp, Artificial Sequence
  chemically synthesized
taaaattgtctacttttctata

SEQ ID NO: 758436 - DNA, 22 bp, Artificial Sequence
  chemically synthesized
ctaaaattgtctacttttctat

SEQ ID NO: 758437 - DNA, 22 bp, Artificial Sequence
  chemically synthesized
cacacttctaaaattgtctact

SEQ ID NO: 758438 - DNA, 22 bp, Artificial Sequence
  chemically synthesized
tgttatagaaaagtagacaatt

SEQ ID NO: 758439 - DNA, 22 bp, Artificial Sequence
  chemically synthesized
acacacttctaaaattgtctac

SEQ ID NO: 758440 - DNA, 22 bp, Artificial Sequence
  chemically synthesized
tacacacttctaaaattgtcta

SEQ ID NO: 758441 - DNA, 22 bp, Artificial Sequence
  chemically synthesized
tttacacacttctaaaattgtc

SEQ ID NO: 758442 - DNA, 22 bp, Artificial Sequence
  chemically synthesized
ctttacacacttctaaaattgt

SEQ ID NO: 758443 - DNA, 22 bp, Artificial Sequence
  chemically synthesized
tagaaaagtagacaattttaga

SEQ ID NO: 758444 - DNA, 22 bp, Artificial Sequence
  chemically synthesized
tctttacacacttctaaaattg

SEQ ID NO: 758445 - DNA, 22 bp, Artificial Sequence
  chemically synthesized
accagatctttctttacacact

SEQ ID NO: 758446 - DNA, 22 bp, Artificial Sequence
  chemically synthesized
gaccagatctttctttacacac

SEQ ID NO: 758447 - DNA, 22 bp, Artificial Sequence
  chemically synthesized
catttgaccagatctttcttta

SEQ ID NO: 758448 - DNA, 22 bp, Artificial Sequence
  chemically synthesized
tagaagtgtgtaaagaaagatc

SEQ ID NO: 758449 - DNA, 22 bp, Artificial Sequence
  chemically synthesized
agaagtgtgtaaagaaagatct

SEQ ID NO: 758450 - DNA, 22 bp, Artificial Sequence
  chemically synthesized
gaagtgtgtaaagaaagatctg

SEQ ID NO: 758451 - DNA, 22 bp, Artificial Sequence
  chemically synthesized
tctacatttgaccagatctttc

SEQ ID NO: 758452 - DNA, 22 bp, Artificial Sequence
  chemically synthesized
ttgtctacatttgaccagatct

SEQ ID NO: 758453 - DNA, 22 bp, Artificial Sequence
  chemically synthesized
cctgttgtctacatttgaccag

SEQ ID NO: 758454 - DNA, 22 bp, Artificial Sequence
  chemically synthesized
ccctgttgtctacatttgacca

SEQ ID NO: 758455 - DNA, 22 bp, Artificial Sequence
  chemically synthesized
tccctgttgtctacatttgacc

SEQ ID NO: 758456 - DNA, 22 bp, Artificial Sequence
  chemically synthesized
ttccctgttgtctacatttgac

SEQ ID NO: 758457 - DNA, 22 bp, Artificial Sequence
  chemically synthesized
tgcaaacttttccctgttgtct

SEQ ID NO: 758458 - DNA, 22 bp, Artificial Sequence
  chemically synthesized
gtcaaatgtagacaacagggaa

SEQ ID NO: 758459 - DNA, 22 bp, Artificial Sequence
  chemically synthesized
ggacattgtgcaaacttttccc

SEQ ID NO: 758460 - DNA, 22 bp, Artificial Sequence
  chemically synthesized
gctcggacattgtgcaaacttt

SEQ ID NO: 758461 - DNA, 22 bp, Artificial Sequence
  chemically synthesized
ggctcggacattgtgcaaactt

SEQ ID NO: 758462 - DNA, 22 bp, Artificial Sequence
  chemically synthesized
catcttggctcggacattgtgc

SEQ ID NO: 758463 - DNA, 22 bp, Artificial Sequence
  chemically synthesized
acatcttggctcggacattgtg

SEQ ID NO: 758464 - DNA, 22 bp, Artificial Sequence
  chemically synthesized
tacatcttggctcggacattgt

SEQ ID NO: 758465 - DNA, 22 bp, Artificial Sequence
  chemically synthesized
ataatcctttacatcttggctc

SEQ ID NO: 758466 - DNA, 22 bp, Artificial Sequence
  chemically synthesized
gcacaatgtccgagccaagatg

SEQ ID NO: 758467 - DNA, 22 bp, Artificial Sequence
  chemically synthesized
cacaatgtccgagccaagatgt

SEQ ID NO: 758468 - DNA, 22 bp, Artificial Sequence
  chemically synthesized
tcatctaataatcctttacatc

SEQ ID NO: 758469 - DNA, 22 bp, Artificial Sequence
  chemically synthesized
gttatcatctaataatccttta

SEQ ID NO: 758470 - DNA, 22 bp, Artificial Sequence
  chemically synthesized
ataatatcctggttatcatcta

SEQ ID NO: 758471 - DNA, 22 bp, Artificial Sequence
  chemically synthesized
ttagatgataaccaggatatta

SEQ ID NO: 758472 - DNA, 22 bp, Artificial Sequence
  chemically synthesized
tacccacccactcataatatcc

SEQ ID NO: 758473 - DNA, 22 bp, Artificial Sequence
  chemically synthesized
gatgataaccaggatattatga

SEQ ID NO: 758474 - DNA, 22 bp, Artificial Sequence
  chemically synthesized
cctatacccacccactcataat

SEQ ID NO: 758475 - DNA, 22 bp, Artificial Sequence
  chemically synthesized
acctatacccacccactcataa

SEQ ID NO: 758476 - DNA, 22 bp, Artificial Sequence
  chemically synthesized
tacctatacccacccactcata

SEQ ID NO: 758477 - DNA, 22 bp, Artificial Sequence
  chemically synthesized
ttacctatacccacccactcat

SEQ ID NO: 758478 - DNA, 22 bp, Artificial Sequence
  chemically synthesized
aaacccttttacctatacccac

SEQ ID NO: 758479 - DNA, 22 bp, Artificial Sequence
  chemically synthesized
tctcaaacccttttacctatac

SEQ ID NO: 758480 - DNA, 22 bp, Artificial Sequence
  chemically synthesized
tgagtgggtgggtataggtaaa

SEQ ID NO: 758481 - DNA, 22 bp, Artificial Sequence
  chemically synthesized
tgtctcaaacccttttacctat

SEQ ID NO: 758482 - DNA, 22 bp, Artificial Sequence
  chemically synthesized
gtcctctgtctcaaaccctttt

SEQ ID NO: 758483 - DNA, 22 bp, Artificial Sequence
  chemically synthesized
aatatgttggtcctctgtctca

SEQ ID NO: 758484 - DNA, 22 bp, Artificial Sequence
  chemically synthesized
aaatatgttggtcctctgtctc

SEQ ID NO: 758485 - DNA, 22 bp, Artificial Sequence
  chemically synthesized
taaatatgttggtcctctgtct

SEQ ID NO: 758486 - DNA, 22 bp, Artificial Sequence
  chemically synthesized
tgtggggctttaaatatgttgg

SEQ ID NO: 758487 - DNA, 22 bp, Artificial Sequence
  chemically synthesized
gagacagaggaccaacatattt

SEQ ID NO: 758488 - DNA, 22 bp, Artificial Sequence
  chemically synthesized
atgtggggctttaaatatgttg

SEQ ID NO: 758489 - DNA, 22 bp, Artificial Sequence
  chemically synthesized
agacagaggaccaacatattta

SEQ ID NO: 758490 - DNA, 22 bp, Artificial Sequence
  chemically synthesized
ttatgtggggctttaaatatgt

SEQ ID NO: 758491 - DNA, 22 bp, Artificial Sequence
  chemically synthesized
cgtgtccctcttatgtggggct

SEQ ID NO: 758492 - DNA, 22 bp, Artificial Sequence
  chemically synthesized
tgcgtgtccctcttatgtgggg

SEQ ID NO: 758493 - DNA, 22 bp, Artificial Sequence
  chemically synthesized
caattctgcgtgtccctcttat

SEQ ID NO: 758494 - DNA, 22 bp, Artificial Sequence
  chemically synthesized
ccaattctgcgtgtccctctta

SEQ ID NO: 758495 - DNA, 22 bp, Artificial Sequence
  chemically synthesized
aaagccccacataagagggaca

SEQ ID NO: 758496 - DNA, 22 bp, Artificial Sequence
  chemically synthesized
tccaattctgcgtgtccctctt

SEQ ID NO: 758497 - DNA, 22 bp, Artificial Sequence
  chemically synthesized
aagccccacataagagggacac

SEQ ID NO: 758498 - DNA, 22 bp, Artificial Sequence
  chemically synthesized
ttccaattctgcgtgtccctct

SEQ ID NO: 758499 - DNA, 22 bp, Artificial Sequence
  chemically synthesized
tttccaattctgcgtgtccctc

SEQ ID NO: 758500 - DNA, 22 bp, Artificial Sequence
  chemically synthesized
ctttttccaattctgcgtgtcc

SEQ ID NO: 758501 - DNA, 22 bp, Artificial Sequence
  chemically synthesized
actttttccaattctgcgtgtc

SEQ ID NO: 758502 - DNA, 22 bp, Artificial Sequence
  chemically synthesized
catttactttttccaattctgc

SEQ ID NO: 758503 - DNA, 22 bp, Artificial Sequence
  chemically synthesized
cctccatttactttttccaatt

SEQ ID NO: 758504 - DNA, 22 bp, Artificial Sequence
  chemically synthesized
gatgccagccatactgcctcca

SEQ ID NO: 758505 - DNA, 22 bp, Artificial Sequence
  chemically synthesized
gaaaaagtaaatggaggcagta

SEQ ID NO: 758506 - DNA, 22 bp, Artificial Sequence
  chemically synthesized
ggatgccagccatactgcctcc

SEQ ID NO: 758507 - DNA, 22 bp, Artificial Sequence
  chemically synthesized
tttggatgccagccatactgcc

SEQ ID NO: 758508 - DNA, 22 bp, Artificial Sequence
  chemically synthesized
ctgtttggatgccagccatact

SEQ ID NO: 758509 - DNA, 22 bp, Artificial Sequence
  chemically synthesized
gctgtttggatgccagccatac

SEQ ID NO: 758510 - DNA, 22 bp, Artificial Sequence
  chemically synthesized
ccttgctgtttggatgccagcc

SEQ ID NO: 758511 - DNA, 22 bp, Artificial Sequence
  chemically synthesized
cccttgctgtttggatgccagc

SEQ ID NO: 758512 - DNA, 22 bp, Artificial Sequence
  chemically synthesized
ttcccttgctgtttggatgcca

SEQ ID NO: 758513 - DNA, 22 bp, Artificial Sequence
  chemically synthesized
gatgctcttcccttgctgtttg

SEQ ID NO: 758514 - DNA, 22 bp, Artificial Sequence
  chemically synthesized
ctagatgctcttcccttgctgt

SEQ ID NO: 758515 - DNA, 22 bp, Artificial Sequence
  chemically synthesized
cctagatgctcttcccttgctg

SEQ ID NO: 758516 - DNA, 22 bp, Artificial Sequence
  chemically synthesized
tcctagatgctcttcccttgct

SEQ ID NO: 758517 - DNA, 22 bp, Artificial Sequence
  chemically synthesized
gcatccaaacagcaagggaaga

SEQ ID NO: 758518 - DNA, 22 bp, Artificial Sequence
  chemically synthesized
tttcctagatgctcttcccttg

SEQ ID NO: 758519 - DNA, 22 bp, Artificial Sequence
  chemically synthesized
ctctttcctagatgctcttccc

SEQ ID NO: 758520 - DNA, 22 bp, Artificial Sequence
  chemically synthesized
agcctcctctttcctagatgct

SEQ ID NO: 758521 - DNA, 22 bp, Artificial Sequence
  chemically synthesized
gcctcagcctcctctttcctag

SEQ ID NO: 758522 - DNA, 22 bp, Artificial Sequence
  chemically synthesized
tctggcctcagcctcctctttc

SEQ ID NO: 758523 - DNA, 22 bp, Artificial Sequence
  chemically synthesized
gtctggcctcagcctcctcttt

SEQ ID NO: 758524 - DNA, 22 bp, Artificial Sequence
  chemically synthesized
gcttgtctggcctcagcctcct

SEQ ID NO: 758525 - DNA, 22 bp, Artificial Sequence
  chemically synthesized
tctggcttgtctggcctcagcc

SEQ ID NO: 758526 - DNA, 22 bp, Artificial Sequence
  chemically synthesized
ggaaagaggaggctgaggccag

SEQ ID NO: 758527 - DNA, 22 bp, Artificial Sequence
  chemically synthesized
aggccagacaagccagatagtg

SEQ ID NO: 758528 - DNA, 22 bp, Artificial Sequence
  chemically synthesized
aacaagggtgacaaggcactat

SEQ ID NO: 758529 - DNA, 22 bp, Artificial Sequence
  chemically synthesized
gaaaaagaccaaaatcctcaac

SEQ ID NO: 758530 - DNA, 22 bp, Artificial Sequence
  chemically synthesized
ggaaaaagaccaaaatcctcaa

SEQ ID NO: 758531 - DNA, 22 bp, Artificial Sequence
  chemically synthesized
gtcacccttgttgaggattttg

SEQ ID NO: 758532 - DNA, 22 bp, Artificial Sequence
  chemically synthesized
ttggaaaaagaccaaaatcctc

SEQ ID NO: 758533 - DNA, 22 bp, Artificial Sequence
  chemically synthesized
tcacccttgttgaggattttgg

SEQ ID NO: 758534 - DNA, 22 bp, Artificial Sequence
  chemically synthesized
agtgctcttggaaaaagaccaa

SEQ ID NO: 758535 - DNA, 22 bp, Artificial Sequence
  chemically synthesized
gttgaggattttggtctttttc

SEQ ID NO: 758536 - DNA, 22 bp, Artificial Sequence
  chemically synthesized
tcagtgctcttggaaaaagacc

SEQ ID NO: 758537 - DNA, 22 bp, Artificial Sequence
  chemically synthesized
ttgaggattttggtctttttcc

SEQ ID NO: 758538 - DNA, 22 bp, Artificial Sequence
  chemically synthesized
ctcagtgctcttggaaaaagac

SEQ ID NO: 758539 - DNA, 22 bp, Artificial Sequence
  chemically synthesized
aggattttggtctttttccaag

SEQ ID NO: 758540 - DNA, 22 bp, Artificial Sequence
  chemically synthesized
tggtctttttccaagagcactg

SEQ ID NO: 758541 - DNA, 22 bp, Artificial Sequence
  chemically synthesized
tagtagtcttctcagtgctctt

SEQ ID NO: 758542 - DNA, 22 bp, Artificial Sequence
  chemically synthesized
ggtctttttccaagagcactga

SEQ ID NO: 758543 - DNA, 22 bp, Artificial Sequence
  chemically synthesized
gtctttttccaagagcactgag

SEQ ID NO: 758544 - DNA, 22 bp, Artificial Sequence
  chemically synthesized
acactatagtagtcttctcagt

SEQ ID NO: 758545 - DNA, 22 bp, Artificial Sequence
  chemically synthesized
tttccaagagcactgagaagac

SEQ ID NO: 758546 - DNA, 22 bp, Artificial Sequence
  chemically synthesized
aacactatagtagtcttctcag

SEQ ID NO: 758547 - DNA, 22 bp, Artificial Sequence
  chemically synthesized
ttccaagagcactgagaagact

SEQ ID NO: 758548 - DNA, 22 bp, Artificial Sequence
  chemically synthesized
tccaagagcactgagaagacta

SEQ ID NO: 758549 - DNA, 22 bp, Artificial Sequence
  chemically synthesized
ccaagagcactgagaagactac

SEQ ID NO: 758550 - DNA, 22 bp, Artificial Sequence
  chemically synthesized
caagagcactgagaagactact

SEQ ID NO: 758551 - DNA, 22 bp, Artificial Sequence
  chemically synthesized
tcttaacactatagtagtcttc

SEQ ID NO: 758552 - DNA, 22 bp, Artificial Sequence
  chemically synthesized
atcttaacactatagtagtctt

SEQ ID NO: 758553 - DNA, 22 bp, Artificial Sequence
  chemically synthesized
agaagactactatagtgttaag

SEQ ID NO: 758554 - DNA, 22 bp, Artificial Sequence
  chemically synthesized
tatcagtccttatcttaacact

SEQ ID NO: 758555 - DNA, 22 bp, Artificial Sequence
  chemically synthesized
ctatagtgttaagataaggact

SEQ ID NO: 758556 - DNA, 22 bp, Artificial Sequence
  chemically synthesized
tagtgttaagataaggactgat

SEQ ID NO: 758557 - DNA, 22 bp, Artificial Sequence
  chemically synthesized
agataaggactgatataattgg

SEQ ID NO: 758558 - DNA, 22 bp, Artificial Sequence
  chemically synthesized
tgtaaaaaacataaatccaatt

SEQ ID NO: 758559 - DNA, 22 bp, Artificial Sequence
  chemically synthesized
atataattggatttatgttttt

SEQ ID NO: 758560 - DNA, 22 bp, Artificial Sequence
  chemically synthesized
agtcagaataatctgtgtaaaa

SEQ ID NO: 758561 - DNA, 22 bp, Artificial Sequence
  chemically synthesized
cagtcagaataatctgtgtaaa

SEQ ID NO: 758562 - DNA, 22 bp, Artificial Sequence
  chemically synthesized
gatttatgttttttacacagat

SEQ ID NO: 758563 - DNA, 22 bp, Artificial Sequence
  chemically synthesized
catttcagtcagaataatctgt

SEQ ID NO: 758564 - DNA, 22 bp, Artificial Sequence
  chemically synthesized
atgttttttacacagattattc

SEQ ID NO: 758565 - DNA, 22 bp, Artificial Sequence
  chemically synthesized
tgttttttacacagattattct

SEQ ID NO: 758566 - DNA, 22 bp, Artificial Sequence
  chemically synthesized
tacatttcagtcagaataatct

SEQ ID NO: 758567 - DNA, 22 bp, Artificial Sequence
  chemically synthesized
tttacacagattattctgactg

SEQ ID NO: 758568 - DNA, 22 bp, Artificial Sequence
  chemically synthesized
ttacacagattattctgactga

SEQ ID NO: 758569 - DNA, 22 bp, Artificial Sequence
  chemically synthesized
tacacagattattctgactgaa

SEQ ID NO: 758570 - DNA, 22 bp, Artificial Sequence
  chemically synthesized
acacagattattctgactgaaa

SEQ ID NO: 758571 - DNA, 22 bp, Artificial Sequence
  chemically synthesized
cacagattattctgactgaaat

SEQ ID NO: 758572 - DNA, 22 bp, Artificial Sequence
  chemically synthesized
caatgcaatctctacatttcag

SEQ ID NO: 758573 - DNA, 22 bp, Artificial Sequence
  chemically synthesized
ttctgactgaaatgtagagatt

SEQ ID NO: 758574 - DNA, 22 bp, Artificial Sequence
  chemically synthesized
ccaccctacaatgcaatctcta

SEQ ID NO: 758575 - DNA, 22 bp, Artificial Sequence
  chemically synthesized
tgactgaaatgtagagattgca

SEQ ID NO: 758576 - DNA, 22 bp, Artificial Sequence
  chemically synthesized
gccaccctacaatgcaatctct

SEQ ID NO: 758577 - DNA, 22 bp, Artificial Sequence
  chemically synthesized
actgaaatgtagagattgcatt

SEQ ID NO: 758578 - DNA, 22 bp, Artificial Sequence
  chemically synthesized
ttgccaccctacaatgcaatct

SEQ ID NO: 758579 - DNA, 22 bp, Artificial Sequence
  chemically synthesized
ctcttgccaccctacaatgcaa

SEQ ID NO: 758580 - DNA, 22 bp, Artificial Sequence
  chemically synthesized
aaatgtagagattgcattgtag

SEQ ID NO: 758581 - DNA, 22 bp, Artificial Sequence
  chemically synthesized
catctactcttgccaccctaca

SEQ ID NO: 758582 - DNA, 22 bp, Artificial Sequence
  chemically synthesized
tgcatctactcttgccacccta

SEQ ID NO: 758583 - DNA, 22 bp, Artificial Sequence
  chemically synthesized
ctgcatctactcttgccaccct

SEQ ID NO: 758584 - DNA, 22 bp, Artificial Sequence
  chemically synthesized
tctgcatctactcttgccaccc

SEQ ID NO: 758585 - DNA, 22 bp, Artificial Sequence
  chemically synthesized
cattgtagggtggcaagagtag

SEQ ID NO: 758586 - DNA, 22 bp, Artificial Sequence
  chemically synthesized
acctttctgcatctactcttgc

SEQ ID NO: 758587 - DNA, 22 bp, Artificial Sequence
  chemically synthesized
ctaacctttctgcatctactct

SEQ ID NO: 758588 - DNA, 22 bp, Artificial Sequence
  chemically synthesized
tagggtggcaagagtagatgca

SEQ ID NO: 758589 - DNA, 22 bp, Artificial Sequence
  chemically synthesized
tcctaacctttctgcatctact

SEQ ID NO: 758590 - DNA, 22 bp, Artificial Sequence
  chemically synthesized
ctcctaacctttctgcatctac

SEQ ID NO: 758591 - DNA, 22 bp, Artificial Sequence
  chemically synthesized
tagaagaccatttctcctaacc

SEQ ID NO: 758592 - DNA, 22 bp, Artificial Sequence
  chemically synthesized
tcatcataattatagaagacca

SEQ ID NO: 758593 - DNA, 22 bp, Artificial Sequence
  chemically synthesized
ttatcatcataattatagaaga

SEQ ID NO: 758594 - DNA, 22 bp, Artificial Sequence
  chemically synthesized
ggagaaatggtcttctataatt

SEQ ID NO: 758595 - DNA, 22 bp, Artificial Sequence
  chemically synthesized
ttgttatcatcataattataga

SEQ ID NO: 758596 - DNA, 22 bp, Artificial Sequence
  chemically synthesized
ctattgttatcatcataattat

SEQ ID NO: 758597 - DNA, 22 bp, Artificial Sequence
  chemically synthesized
tctactattgttatcatcataa

SEQ ID NO: 758598 - DNA, 22 bp, Artificial Sequence
  chemically synthesized
actgtctactattgttatcatc

SEQ ID NO: 758599 - DNA, 22 bp, Artificial Sequence
  chemically synthesized
gactgtctactattgttatcat

SEQ ID NO: 758600 - DNA, 22 bp, Artificial Sequence
  chemically synthesized
ctataattatgatgataacaat

SEQ ID NO: 758601 - DNA, 22 bp, Artificial Sequence
  chemically synthesized
tgactgtctactattgttatca

SEQ ID NO: 758602 - DNA, 22 bp, Artificial Sequence
  chemically synthesized
tataattatgatgataacaata

SEQ ID NO: 758603 - DNA, 22 bp, Artificial Sequence
  chemically synthesized
ttgactgtctactattgttatc

SEQ ID NO: 758604 - DNA, 22 bp, Artificial Sequence
  chemically synthesized
taattatgatgataacaatagt

SEQ ID NO: 758605 - DNA, 22 bp, Artificial Sequence
  chemically synthesized
tttttgactgtctactattgtt

SEQ ID NO: 758606 - DNA, 22 bp, Artificial Sequence
  chemically synthesized
tgatgataacaatagtagacag

SEQ ID NO: 758607 - DNA, 22 bp, Artificial Sequence
  chemically synthesized
aaaattgtttttgactgtctac

SEQ ID NO: 758608 - DNA, 22 bp, Artificial Sequence
  chemically synthesized
caaaattgtttttgactgtcta

SEQ ID NO: 758609 - DNA, 22 bp, Artificial Sequence
  chemically synthesized
ccttcaaaattgtttttgactg

SEQ ID NO: 758610 - DNA, 22 bp, Artificial Sequence
  chemically synthesized
accttcaaaattgtttttgact

SEQ ID NO: 758611 - DNA, 22 bp, Artificial Sequence
  chemically synthesized
gccaatttaccttcaaaattgt

SEQ ID NO: 758612 - DNA, 22 bp, Artificial Sequence
  chemically synthesized
tgaaggtaaattggccaggtgc

SEQ ID NO: 758613 - DNA, 22 bp, Artificial Sequence
  chemically synthesized
gaaggtaaattggccaggtgcg

SEQ ID NO: 758614 - DNA, 22 bp, Artificial Sequence
  chemically synthesized
aaggtaaattggccaggtgcgg

SEQ ID NO: 758615 - DNA, 22 bp, Artificial Sequence
  chemically synthesized
caggcgtgagccaccgcacctg

SEQ ID NO: 758616 - DNA, 22 bp, Artificial Sequence
  chemically synthesized
ggattacaggcgtgagccaccg

SEQ ID NO: 758617 - DNA, 22 bp, Artificial Sequence
  chemically synthesized
gccaggtgcggtggctcacgcc

SEQ ID NO: 758618 - DNA, 22 bp, Artificial Sequence
  chemically synthesized
ccaaagtgctgggattacaggc

SEQ ID NO: 758619 - DNA, 22 bp, Artificial Sequence
  chemically synthesized
gcctcccaaagtgctgggatta

SEQ ID NO: 758620 - DNA, 22 bp, Artificial Sequence
  chemically synthesized
ggcctcccaaagtgctgggatt

SEQ ID NO: 758621 - DNA, 22 bp, Artificial Sequence
  chemically synthesized
acgcctgtaatcccagcacttt

SEQ ID NO: 758622 - DNA, 22 bp, Artificial Sequence
  chemically synthesized
tcttggcctcccaaagtgctgg

SEQ ID NO: 758623 - DNA, 22 bp, Artificial Sequence
  chemically synthesized
cctgtcttggcctcccaaagtg

SEQ ID NO: 758624 - DNA, 22 bp, Artificial Sequence
  chemically synthesized
taatcccagcactttgggaggc

SEQ ID NO: 758625 - DNA, 22 bp, Artificial Sequence
  chemically synthesized
gtgatctgcctgtcttggcctc

SEQ ID NO: 758626 - DNA, 22 bp, Artificial Sequence
  chemically synthesized
acctcgtgatctgcctgtcttg

SEQ ID NO: 758627 - DNA, 22 bp, Artificial Sequence
  chemically synthesized
gacctcgtgatctgcctgtctt

SEQ ID NO: 758628 - DNA, 22 bp, Artificial Sequence
  chemically synthesized
ttgacctcgtgatctgcctgtc

SEQ ID NO: 758629 - DNA, 22 bp, Artificial Sequence
  chemically synthesized
tgggaggccaagacaggcagat

SEQ ID NO: 758630 - DNA, 22 bp, Artificial Sequence
  chemically synthesized
gggaggccaagacaggcagatc

SEQ ID NO: 758631 - DNA, 22 bp, Artificial Sequence
  chemically synthesized
ggaggccaagacaggcagatca

SEQ ID NO: 758632 - DNA, 22 bp, Artificial Sequence
  chemically synthesized
gatctcttgacctcgtgatctg

SEQ ID NO: 758633 - DNA, 22 bp, Artificial Sequence
  chemically synthesized
gccagatggtctcgatctcttg

SEQ ID NO: 758634 - DNA, 22 bp, Artificial Sequence
  chemically synthesized
accgtgttggccagatggtctc

SEQ ID NO: 758635 - DNA, 22 bp, Artificial Sequence
  chemically synthesized
caccgtgttggccagatggtct

SEQ ID NO: 758636 - DNA, 22 bp, Artificial Sequence
  chemically synthesized
gtagagacagggtttcaccgtg

SEQ ID NO: 758637 - DNA, 22 bp, Artificial Sequence
  chemically synthesized
agtagagacagggtttcaccgt

SEQ ID NO: 758638 - DNA, 22 bp, Artificial Sequence
  chemically synthesized
tagtagagacagggtttcaccg

SEQ ID NO: 758639 - DNA, 22 bp, Artificial Sequence
  chemically synthesized
ttagtagagacagggtttcacc

SEQ ID NO: 758640 - DNA, 22 bp, Artificial Sequence
  chemically synthesized
gccaacacggtgaaaccctgtc

SEQ ID NO: 758641 - DNA, 22 bp, Artificial Sequence
  chemically synthesized
tatttttagtagagacagggtt

SEQ ID NO: 758642 - DNA, 22 bp, Artificial Sequence
  chemically synthesized
gtatttttagtagagacagggt

SEQ ID NO: 758643 - DNA, 22 bp, Artificial Sequence
  chemically synthesized
atgtttgtatttttagtagaga

SEQ ID NO: 758644 - DNA, 22 bp, Artificial Sequence
  chemically synthesized
tctctactaaaaatacaaacat

SEQ ID NO: 758645 - DNA, 22 bp, Artificial Sequence
  chemically synthesized
tactaaaaatacaaacattagg

SEQ ID NO: 758646 - DNA, 22 bp, Artificial Sequence
  chemically synthesized
ctaaaaatacaaacattaggtg

SEQ ID NO: 758647 - DNA, 22 bp, Artificial Sequence
  chemically synthesized
aaaatacaaacattaggtgggc

SEQ ID NO: 758648 - DNA, 22 bp, Artificial Sequence
  chemically synthesized
caggcacgcgccaccatgccca

SEQ ID NO: 758649 - DNA, 22 bp, Artificial Sequence
  chemically synthesized
ggactacaggcacgcgccacca

SEQ ID NO: 758650 - DNA, 22 bp, Artificial Sequence
  chemically synthesized
ggtgggcatggtggcgcgtgcc

SEQ ID NO: 758651 - DNA, 22 bp, Artificial Sequence
  chemically synthesized
ccgagtagctgggactacaggc

SEQ ID NO: 758652 - DNA, 22 bp, Artificial Sequence
  chemically synthesized
agcctcccgagtagctgggact

SEQ ID NO: 758653 - DNA, 22 bp, Artificial Sequence
  chemically synthesized
ccgcctcagcctcccgagtagc

SEQ ID NO: 758654 - DNA, 22 bp, Artificial Sequence
  chemically synthesized
tcccgcctcagcctcccgagta

SEQ ID NO: 758655 - DNA, 22 bp, Artificial Sequence
  chemically synthesized
tagtcccagctactcgggaggc

SEQ ID NO: 758656 - DNA, 22 bp, Artificial Sequence
  chemically synthesized
aagcaattctcccgcctcagcc

SEQ ID NO: 758657 - DNA, 22 bp, Artificial Sequence
  chemically synthesized
gttcaagcaattctcccgcctc

SEQ ID NO: 758658 - DNA, 22 bp, Artificial Sequence
  chemically synthesized
ctcgggaggctgaggcgggaga

SEQ ID NO: 758659 - DNA, 22 bp, Artificial Sequence
  chemically synthesized
ctggttcaagcaattctcccgc

SEQ ID NO: 758660 - DNA, 22 bp, Artificial Sequence
  chemically synthesized
gggaggctgaggcgggagaatt

SEQ ID NO: 758661 - DNA, 22 bp, Artificial Sequence
  chemically synthesized
cgcctcctggttcaagcaattc

SEQ ID NO: 758662 - DNA, 22 bp, Artificial Sequence
  chemically synthesized
aggcgggagaattgcttgaacc

SEQ ID NO: 758663 - DNA, 22 bp, Artificial Sequence
  chemically synthesized
caacctccgcctcctggttcaa

SEQ ID NO: 758664 - DNA, 22 bp, Artificial Sequence
  chemically synthesized
actgcaacctccgcctcctggt

SEQ ID NO: 758665 - DNA, 22 bp, Artificial Sequence
  chemically synthesized
gctcactgcaacctccgcctcc

SEQ ID NO: 758666 - DNA, 22 bp, Artificial Sequence
  chemically synthesized
ggctcactgcaacctccgcctc

SEQ ID NO: 758667 - DNA, 22 bp, Artificial Sequence
  chemically synthesized
cttgaaccaggaggcggaggtt

SEQ ID NO: 758668 - DNA, 22 bp, Artificial Sequence
  chemically synthesized
gaaccaggaggcggaggttgca

SEQ ID NO: 758669 - DNA, 22 bp, Artificial Sequence
  chemically synthesized
aaccaggaggcggaggttgcag

SEQ ID NO: 758670 - DNA, 22 bp, Artificial Sequence
  chemically synthesized
caatggcacaatcttggctcac

SEQ ID NO: 758671 - DNA, 22 bp, Artificial Sequence
  chemically synthesized
gagttgcaatggcacaatcttg

SEQ ID NO: 758672 - DNA, 22 bp, Artificial Sequence
  chemically synthesized
cagtgagccaagattgtgccat

SEQ ID NO: 758673 - DNA, 22 bp, Artificial Sequence
  chemically synthesized
tcaccaggctggagttgcaatg

SEQ ID NO: 758674 - DNA, 22 bp, Artificial Sequence
  chemically synthesized
tgtcaccaggctggagttgcaa

SEQ ID NO: 758675 - DNA, 22 bp, Artificial Sequence
  chemically synthesized
ctctgtcaccaggctggagttg

SEQ ID NO: 758676 - DNA, 22 bp, Artificial Sequence
  chemically synthesized
gctctgtcaccaggctggagtt

SEQ ID NO: 758677 - DNA, 22 bp, Artificial Sequence
  chemically synthesized
tgccattgcaactccagcctgg

SEQ ID NO: 758678 - DNA, 22 bp, Artificial Sequence
  chemically synthesized
ggtcttgctctgtcaccaggct

SEQ ID NO: 758679 - DNA, 22 bp, Artificial Sequence
  chemically synthesized
caactccagcctggtgacagag

SEQ ID NO: 758680 - DNA, 22 bp, Artificial Sequence
  chemically synthesized
agactgggtcttgctctgtcac

SEQ ID NO: 758681 - DNA, 22 bp, Artificial Sequence
  chemically synthesized
gagactgggtcttgctctgtca

SEQ ID NO: 758682 - DNA, 22 bp, Artificial Sequence
  chemically synthesized
tgagactgggtcttgctctgtc

SEQ ID NO: 758683 - DNA, 22 bp, Artificial Sequence
  chemically synthesized
ttgagactgggtcttgctctgt

SEQ ID NO: 758684 - DNA, 22 bp, Artificial Sequence
  chemically synthesized
tttgagactgggtcttgctctg

SEQ ID NO: 758685 - DNA, 22 bp, Artificial Sequence
  chemically synthesized
cagcctggtgacagagcaagac

SEQ ID NO: 758686 - DNA, 22 bp, Artificial Sequence
  chemically synthesized
ttttgagactgggtcttgctct

SEQ ID NO: 758687 - DNA, 22 bp, Artificial Sequence
  chemically synthesized
tttttgagactgggtcttgctc

SEQ ID NO: 758688 - DNA, 22 bp, Artificial Sequence
  chemically synthesized
ttttttgagactgggtcttgct

SEQ ID NO: 758689 - DNA, 22 bp, Artificial Sequence
  chemically synthesized
tttttttgagactgggtcttgc

SEQ ID NO: 758690 - DNA, 22 bp, Artificial Sequence
  chemically synthesized
ttttttttgagactgggtcttg

SEQ ID NO: 758691 - DNA, 22 bp, Artificial Sequence
  chemically synthesized
tttttttttgagactgggtctt

SEQ ID NO: 758692 - DNA, 22 bp, Artificial Sequence
  chemically synthesized
ttttttttttgagactgggtct

SEQ ID NO: 758693 - DNA, 22 bp, Artificial Sequence
  chemically synthesized
gtgacagagcaagacccagtct

SEQ ID NO: 758694 - DNA, 22 bp, Artificial Sequence
  chemically synthesized
tttttttttttgagactgggtc

SEQ ID NO: 758695 - DNA, 22 bp, Artificial Sequence
  chemically synthesized
ttttttttttttgagactgggt

SEQ ID NO: 758696 - DNA, 22 bp, Artificial Sequence
  chemically synthesized
tttttttttttttgagactggg

SEQ ID NO: 758697 - DNA, 22 bp, Artificial Sequence
  chemically synthesized
ttttttttttttttgagactgg

SEQ ID NO: 758698 - DNA, 22 bp, Artificial Sequence
  chemically synthesized
tttttttttttttttgagactg

SEQ ID NO: 758699 - DNA, 22 bp, Artificial Sequence
  chemically synthesized
ttttttttttttttttgagact

SEQ ID NO: 758700 - DNA, 22 bp, Artificial Sequence
  chemically synthesized
tttttttttttttttttgagac

SEQ ID NO: 758701 - DNA, 22 bp, Artificial Sequence
  chemically synthesized
ttttttttttttttttttgaga

SEQ ID NO: 758702 - DNA, 22 bp, Artificial Sequence
  chemically synthesized
ggtcaatttttttttttttttt

SEQ ID NO: 758703 - DNA, 22 bp, Artificial Sequence
  chemically synthesized
aaaaaaaaaaaaaaaaaaaaat

SEQ ID NO: 758704 - DNA, 22 bp, Artificial Sequence
  chemically synthesized
ccaagacatcactgggtcaatt

SEQ ID NO: 758705 - DNA, 22 bp, Artificial Sequence
  chemically synthesized
cactaccaagacatcactgggt

SEQ ID NO: 758706 - DNA, 22 bp, Artificial Sequence
  chemically synthesized
ccactaccaagacatcactggg

SEQ ID NO: 758707 - DNA, 22 bp, Artificial Sequence
  chemically synthesized
agccttccactaccaagacatc

SEQ ID NO: 758708 - DNA, 22 bp, Artificial Sequence
  chemically synthesized
cagccttccactaccaagacat

SEQ ID NO: 758709 - DNA, 22 bp, Artificial Sequence
  chemically synthesized
acccagtgatgtcttggtagtg

SEQ ID NO: 758710 - DNA, 22 bp, Artificial Sequence
  chemically synthesized
cggatgaccagccttcagcctt

SEQ ID NO: 758711 - DNA, 22 bp, Artificial Sequence
  chemically synthesized
ccggatgaccagccttcagcct

SEQ ID NO: 758712 - DNA, 22 bp, Artificial Sequence
  chemically synthesized
tccggatgaccagccttcagcc

SEQ ID NO: 758713 - DNA, 22 bp, Artificial Sequence
  chemically synthesized
ttccggatgaccagccttcagc

SEQ ID NO: 758714 - DNA, 22 bp, Artificial Sequence
  chemically synthesized
ggtagtggaaggctgaaggctg

SEQ ID NO: 758715 - DNA, 22 bp, Artificial Sequence
  chemically synthesized
gtagtggaaggctgaaggctgg

SEQ ID NO: 758716 - DNA, 22 bp, Artificial Sequence
  chemically synthesized
gtacagtaccttttccggatga

SEQ ID NO: 758717 - DNA, 22 bp, Artificial Sequence
  chemically synthesized
aaggctggtcatccggaaaagg

SEQ ID NO: 758718 - DNA, 22 bp, Artificial Sequence
  chemically synthesized
tctggtacagtaccttttccgg

SEQ ID NO: 758719 - DNA, 22 bp, Artificial Sequence
  chemically synthesized
gtcatccggaaaaggtactgta

SEQ ID NO: 758720 - DNA, 22 bp, Artificial Sequence
  chemically synthesized
ataccagacaacaatgtagttg

SEQ ID NO: 758721 - DNA, 22 bp, Artificial Sequence
  chemically synthesized
tcataccagacaacaatgtagt

SEQ ID NO: 758722 - DNA, 22 bp, Artificial Sequence
  chemically synthesized
ctcataccagacaacaatgtag

SEQ ID NO: 758723 - DNA, 22 bp, Artificial Sequence
  chemically synthesized
tctcataccagacaacaatgta

SEQ ID NO: 758724 - DNA, 22 bp, Artificial Sequence
  chemically synthesized
taccagacaactacattgttgt

SEQ ID NO: 758725 - DNA, 22 bp, Artificial Sequence
  chemically synthesized
aatattttctcataccagacaa

SEQ ID NO: 758726 - DNA, 22 bp, Artificial Sequence
  chemically synthesized
actaaatattttctcataccag

SEQ ID NO: 758727 - DNA, 22 bp, Artificial Sequence
  chemically synthesized
taactaaatattttctcatacc

SEQ ID NO: 758728 - DNA, 22 bp, Artificial Sequence
  chemically synthesized
cattgttgtctggtatgagaaa

SEQ ID NO: 758729 - DNA, 22 bp, Artificial Sequence
  chemically synthesized
ttgtctggtatgagaaaatatt

SEQ ID NO: 758730 - DNA, 22 bp, Artificial Sequence
  chemically synthesized
cgagactctaactaaatatttt

SEQ ID NO: 758731 - DNA, 22 bp, Artificial Sequence
  chemically synthesized
tctggtatgagaaaatatttag

SEQ ID NO: 758732 - DNA, 22 bp, Artificial Sequence
  chemically synthesized
gtatgagaaaatatttagttag

SEQ ID NO: 758733 - DNA, 22 bp, Artificial Sequence
  chemically synthesized
aatattccgagactctaactaa

SEQ ID NO: 758734 - DNA, 22 bp, Artificial Sequence
  chemically synthesized
gctaaatattccgagactctaa

SEQ ID NO: 758735 - DNA, 22 bp, Artificial Sequence
  chemically synthesized
tagctaaatattccgagactct

SEQ ID NO: 758736 - DNA, 22 bp, Artificial Sequence
  chemically synthesized
agttagagtctcggaatattta

SEQ ID NO: 758737 - DNA, 22 bp, Artificial Sequence
  chemically synthesized
caaaactctagctaaatattcc

SEQ ID NO: 758738 - DNA, 22 bp, Artificial Sequence
  chemically synthesized
gttagagtctcggaatatttag

SEQ ID NO: 758739 - DNA, 22 bp, Artificial Sequence
  chemically synthesized
gagtctcggaatatttagctag

SEQ ID NO: 758740 - DNA, 22 bp, Artificial Sequence
  chemically synthesized
caaaactccaaaactctagcta

SEQ ID NO: 758741 - DNA, 22 bp, Artificial Sequence
  chemically synthesized
ggaatatttagctagagttttg

SEQ ID NO: 758742 - DNA, 22 bp, Artificial Sequence
  chemically synthesized
caatctacaaaactccaaaact

SEQ ID NO: 758743 - DNA, 22 bp, Artificial Sequence
  chemically synthesized
ctgcaatctacaaaactccaaa

SEQ ID NO: 758744 - DNA, 22 bp, Artificial Sequence
  chemically synthesized
agctagagttttggagttttgt

SEQ ID NO: 758745 - DNA, 22 bp, Artificial Sequence
  chemically synthesized
ttgctgcaatctacaaaactcc

SEQ ID NO: 758746 - DNA, 22 bp, Artificial Sequence
  chemically synthesized
gctagagttttggagttttgta

SEQ ID NO: 758747 - DNA, 22 bp, Artificial Sequence
  chemically synthesized
gttgctgcaatctacaaaactc

SEQ ID NO: 758748 - DNA, 22 bp, Artificial Sequence
  chemically synthesized
tgttgctgcaatctacaaaact

SEQ ID NO: 758749 - DNA, 22 bp, Artificial Sequence
  chemically synthesized
ttgttgctgcaatctacaaaac

SEQ ID NO: 758750 - DNA, 22 bp, Artificial Sequence
  chemically synthesized
tttgttgctgcaatctacaaaa

SEQ ID NO: 758751 - DNA, 22 bp, Artificial Sequence
  chemically synthesized
gagttttggagttttgtagatt

SEQ ID NO: 758752 - DNA, 22 bp, Artificial Sequence
  chemically synthesized
tctttttgttgctgcaatctac

SEQ ID NO: 758753 - DNA, 22 bp, Artificial Sequence
  chemically synthesized
atctttttgttgctgcaatcta

SEQ ID NO: 758754 - DNA, 22 bp, Artificial Sequence
  chemically synthesized
tatctttttgttgctgcaatct

SEQ ID NO: 758755 - DNA, 22 bp, Artificial Sequence
  chemically synthesized
tggagttttgtagattgcagca

SEQ ID NO: 758756 - DNA, 22 bp, Artificial Sequence
  chemically synthesized
ggagttttgtagattgcagcaa

SEQ ID NO: 758757 - DNA, 22 bp, Artificial Sequence
  chemically synthesized
tttatctttttgttgctgcaat

SEQ ID NO: 758758 - DNA, 22 bp, Artificial Sequence
  chemically synthesized
gagttttgtagattgcagcaac

SEQ ID NO: 758759 - DNA, 22 bp, Artificial Sequence
  chemically synthesized
ctttatctttttgttgctgcaa

SEQ ID NO: 758760 - DNA, 22 bp, Artificial Sequence
  chemically synthesized
cttctttatctttttgttgctg

SEQ ID NO: 758761 - DNA, 22 bp, Artificial Sequence
  chemically synthesized
gcttctttatctttttgttgct

SEQ ID NO: 758762 - DNA, 22 bp, Artificial Sequence
  chemically synthesized
tgcttctttatctttttgttgc

SEQ ID NO: 758763 - DNA, 22 bp, Artificial Sequence
  chemically synthesized
tgtagattgcagcaacaaaaag

SEQ ID NO: 758764 - DNA, 22 bp, Artificial Sequence
  chemically synthesized
gtagattgcagcaacaaaaaga

SEQ ID NO: 758765 - DNA, 22 bp, Artificial Sequence
  chemically synthesized
tagattgcagcaacaaaaagat

SEQ ID NO: 758766 - DNA, 22 bp, Artificial Sequence
  chemically synthesized
aaaccctttgcttctttatctt

SEQ ID NO: 758767 - DNA, 22 bp, Artificial Sequence
  chemically synthesized
cagcaacaaaaagataaagaag

SEQ ID NO: 758768 - DNA, 22 bp, Artificial Sequence
  chemically synthesized
aaaagtctgaaaccctttgctt

SEQ ID NO: 758769 - DNA, 22 bp, Artificial Sequence
  chemically synthesized
caaaagtctgaaaccctttgct

SEQ ID NO: 758770 - DNA, 22 bp, Artificial Sequence
  chemically synthesized
tcaaaagtctgaaaccctttgc

SEQ ID NO: 758771 - DNA, 22 bp, Artificial Sequence
  chemically synthesized
ttttcaaaagtctgaaaccctt

SEQ ID NO: 758772 - DNA, 22 bp, Artificial Sequence
  chemically synthesized
gttttcaaaagtctgaaaccct

SEQ ID NO: 758773 - DNA, 22 bp, Artificial Sequence
  chemically synthesized
ataacttgttttcaaaagtctg

SEQ ID NO: 758774 - DNA, 22 bp, Artificial Sequence
  chemically synthesized
aataacttgttttcaaaagtct

SEQ ID NO: 758775 - DNA, 22 bp, Artificial Sequence
  chemically synthesized
taataacttgttttcaaaagtc

SEQ ID NO: 758776 - DNA, 22 bp, Artificial Sequence
  chemically synthesized
aattttaataacttgttttcaa

SEQ ID NO: 758777 - DNA, 22 bp, Artificial Sequence
  chemically synthesized
cagacttttgaaaacaagttat

SEQ ID NO: 758778 - DNA, 22 bp, Artificial Sequence
  chemically synthesized
agacttttgaaaacaagttatt

SEQ ID NO: 758779 - DNA, 22 bp, Artificial Sequence
  chemically synthesized
aatcatctaaattttaataact

SEQ ID NO: 758780 - DNA, 22 bp, Artificial Sequence
  chemically synthesized
ttgaaaacaagttattaaaatt

SEQ ID NO: 758781 - DNA, 22 bp, Artificial Sequence
  chemically synthesized
tgaaaacaagttattaaaattt

SEQ ID NO: 758782 - DNA, 22 bp, Artificial Sequence
  chemically synthesized
gaaaacaagttattaaaattta

SEQ ID NO: 758783 - DNA, 22 bp, Artificial Sequence
  chemically synthesized
gattcaatcatctaaattttaa

SEQ ID NO: 758784 - DNA, 22 bp, Artificial Sequence
  chemically synthesized
aaaacaagttattaaaatttag

SEQ ID NO: 758785 - DNA, 22 bp, Artificial Sequence
  chemically synthesized
agattcaatcatctaaatttta

SEQ ID NO: 758786 - DNA, 22 bp, Artificial Sequence
  chemically synthesized
ttaaaatttagatgattgaatc

SEQ ID NO: 758787 - DNA, 22 bp, Artificial Sequence
  chemically synthesized
caaatacaacttagattcaatc

SEQ ID NO: 758788 - DNA, 22 bp, Artificial Sequence
  chemically synthesized
ccaaatacaacttagattcaat

SEQ ID NO: 758789 - DNA, 22 bp, Artificial Sequence
  chemically synthesized
aaatttagatgattgaatctaa

SEQ ID NO: 758790 - DNA, 22 bp, Artificial Sequence
  chemically synthesized
cttccaaatacaacttagattc

SEQ ID NO: 758791 - DNA, 22 bp, Artificial Sequence
  chemically synthesized
agatgattgaatctaagttgta

SEQ ID NO: 758792 - DNA, 22 bp, Artificial Sequence
  chemically synthesized
cctccttccaaatacaacttag

SEQ ID NO: 758793 - DNA, 22 bp, Artificial Sequence
  chemically synthesized
gatgattgaatctaagttgtat

SEQ ID NO: 758794 - DNA, 22 bp, Artificial Sequence
  chemically synthesized
acctccttccaaatacaactta

SEQ ID NO: 758795 - DNA, 22 bp, Artificial Sequence
  chemically synthesized
catatttacctccttccaaata

SEQ ID NO: 758796 - DNA, 22 bp, Artificial Sequence
  chemically synthesized
aatctaagttgtatttggaagg

SEQ ID NO: 758797 - DNA, 22 bp, Artificial Sequence
  chemically synthesized
ccatatttacctccttccaaat

SEQ ID NO: 758798 - DNA, 22 bp, Artificial Sequence
  chemically synthesized
cccttccatatttacctccttc

SEQ ID NO: 758799 - DNA, 22 bp, Artificial Sequence
  chemically synthesized
agttgtatttggaaggaggtaa

SEQ ID NO: 758800 - DNA, 22 bp, Artificial Sequence
  chemically synthesized
tgcccttccatatttacctcct

SEQ ID NO: 758801 - DNA, 22 bp, Artificial Sequence
  chemically synthesized
ctctgcccttccatatttacct

SEQ ID NO: 758802 - DNA, 22 bp, Artificial Sequence
  chemically synthesized
tatttggaaggaggtaaatatg

SEQ ID NO: 758803 - DNA, 22 bp, Artificial Sequence
  chemically synthesized
gttcctctgcccttccatattt

SEQ ID NO: 758804 - DNA, 22 bp, Artificial Sequence
  chemically synthesized
ggaaggaggtaaatatggaagg

SEQ ID NO: 758805 - DNA, 22 bp, Artificial Sequence
  chemically synthesized
gaaggaggtaaatatggaaggg

SEQ ID NO: 758806 - DNA, 22 bp, Artificial Sequence
  chemically synthesized
tacattagttcctctgcccttc

SEQ ID NO: 758807 - DNA, 22 bp, Artificial Sequence
  chemically synthesized
atacattagttcctctgccctt

SEQ ID NO: 758808 - DNA, 22 bp, Artificial Sequence
  chemically synthesized
tatacattagttcctctgccct

SEQ ID NO: 758809 - DNA, 22 bp, Artificial Sequence
  chemically synthesized
tgttttatacattagttcctct

SEQ ID NO: 758810 - DNA, 22 bp, Artificial Sequence
  chemically synthesized
tgtgttttatacattagttcct

SEQ ID NO: 758811 - DNA, 22 bp, Artificial Sequence
  chemically synthesized
ctctgtgttttatacattagtt

SEQ ID NO: 758812 - DNA, 22 bp, Artificial Sequence
  chemically synthesized
attactctgtgttttatacatt

SEQ ID NO: 758813 - DNA, 22 bp, Artificial Sequence
  chemically synthesized
cagcccattgattactctgtgt

SEQ ID NO: 758814 - DNA, 22 bp, Artificial Sequence
  chemically synthesized
ccagcccattgattactctgtg

SEQ ID NO: 758815 - DNA, 22 bp, Artificial Sequence
  chemically synthesized
atgtataaaacacagagtaatc

SEQ ID NO: 758816 - DNA, 22 bp, Artificial Sequence
  chemically synthesized
acaggacttccagcccattgat

SEQ ID NO: 758817 - DNA, 22 bp, Artificial Sequence
  chemically synthesized
cacaggacttccagcccattga

SEQ ID NO: 758818 - DNA, 22 bp, Artificial Sequence
  chemically synthesized
gtgaatttcacaggacttccag

SEQ ID NO: 758819 - DNA, 22 bp, Artificial Sequence
  chemically synthesized
cgtgaatttcacaggacttcca

SEQ ID NO: 758820 - DNA, 22 bp, Artificial Sequence
  chemically synthesized
tcgtgaatttcacaggacttcc

SEQ ID NO: 758821 - DNA, 22 bp, Artificial Sequence
  chemically synthesized
acctttcgtgaatttcacagga

SEQ ID NO: 758822 - DNA, 22 bp, Artificial Sequence
  chemically synthesized
ttaacctttcgtgaatttcaca

SEQ ID NO: 758823 - DNA, 22 bp, Artificial Sequence
  chemically synthesized
cctgttaacctttcgtgaattt

SEQ ID NO: 758824 - DNA, 22 bp, Artificial Sequence
  chemically synthesized
gaagtcctgtgaaattcacgaa

SEQ ID NO: 758825 - DNA, 22 bp, Artificial Sequence
  chemically synthesized
agatagctacctgttaaccttt

SEQ ID NO: 758826 - DNA, 22 bp, Artificial Sequence
  chemically synthesized
tgaaattcacgaaaggttaaca

SEQ ID NO: 758827 - DNA, 22 bp, Artificial Sequence
  chemically synthesized
ctcagatagctacctgttaacc

SEQ ID NO: 758828 - DNA, 22 bp, Artificial Sequence
  chemically synthesized
gctcagatagctacctgttaac

SEQ ID NO: 758829 - DNA, 22 bp, Artificial Sequence
  chemically synthesized
acgaaaggttaacaggtagcta

SEQ ID NO: 758830 - DNA, 22 bp, Artificial Sequence
  chemically synthesized
gtgtgcttgctcagatagctac

SEQ ID NO: 758831 - DNA, 22 bp, Artificial Sequence
  chemically synthesized
gttagtgtgcttgctcagatag

SEQ ID NO: 758832 - DNA, 22 bp, Artificial Sequence
  chemically synthesized
ggttagtgtgcttgctcagata

SEQ ID NO: 758833 - DNA, 22 bp, Artificial Sequence
  chemically synthesized
acaggtagctatctgagcaagc

SEQ ID NO: 758834 - DNA, 22 bp, Artificial Sequence
  chemically synthesized
tctgagcaagcacactaaccaa

SEQ ID NO: 758835 - DNA, 22 bp, Artificial Sequence
  chemically synthesized
atccgtccccacttggttagtg

SEQ ID NO: 758836 - DNA, 22 bp, Artificial Sequence
  chemically synthesized
agcaagcacactaaccaagtgg

SEQ ID NO: 758837 - DNA, 22 bp, Artificial Sequence
  chemically synthesized
accagaatgaagttaatccgtc

SEQ ID NO: 758838 - DNA, 22 bp, Artificial Sequence
  chemically synthesized
accaagtggggacggattaact

SEQ ID NO: 758839 - DNA, 22 bp, Artificial Sequence
  chemically synthesized
tgagtgatactcaccagaatga

SEQ ID NO: 758840 - DNA, 22 bp, Artificial Sequence
  chemically synthesized
gagttatgagtgatactcacca

SEQ ID NO: 758841 - DNA, 22 bp, Artificial Sequence
  chemically synthesized
acttcattctggtgagtatcac

SEQ ID NO: 758842 - DNA, 22 bp, Artificial Sequence
  chemically synthesized
cattctggtgagtatcactcat

SEQ ID NO: 758843 - DNA, 22 bp, Artificial Sequence
  chemically synthesized
attctggtgagtatcactcata

SEQ ID NO: 758844 - DNA, 22 bp, Artificial Sequence
  chemically synthesized
tggtgagtatcactcataactc

SEQ ID NO: 758845 - DNA, 22 bp, Artificial Sequence
  chemically synthesized
gtgagtatcactcataactcta

SEQ ID NO: 758846 - DNA, 22 bp, Artificial Sequence
  chemically synthesized
gggagatggtgatgctagagtt

SEQ ID NO: 758847 - DNA, 22 bp, Artificial Sequence
  chemically synthesized
ggggagatggtgatgctagagt

SEQ ID NO: 758848 - DNA, 22 bp, Artificial Sequence
  chemically synthesized
ataactctagcatcaccatctc

SEQ ID NO: 758849 - DNA, 22 bp, Artificial Sequence
  chemically synthesized
tagcatcaccatctccccaagt

SEQ ID NO: 758850 - DNA, 22 bp, Artificial Sequence
  chemically synthesized
gcatcaccatctccccaagtca

SEQ ID NO: 758851 - DNA, 22 bp, Artificial Sequence
  chemically synthesized
atgacaaagaacatgacttggg

SEQ ID NO: 758852 - DNA, 22 bp, Artificial Sequence
  chemically synthesized
aggaatctcatgacaaagaaca

SEQ ID NO: 758853 - DNA, 22 bp, Artificial Sequence
  chemically synthesized
cccaagtcatgttctttgtcat

SEQ ID NO: 758854 - DNA, 22 bp, Artificial Sequence
  chemically synthesized
ctcaggaatctcatgacaaaga

SEQ ID NO: 758855 - DNA, 22 bp, Artificial Sequence
  chemically synthesized
actcaggaatctcatgacaaag

SEQ ID NO: 758856 - DNA, 22 bp, Artificial Sequence
  chemically synthesized
acgcagtccttactcaggaatc

SEQ ID NO: 758857 - DNA, 22 bp, Artificial Sequence
  chemically synthesized
aacgcagtccttactcaggaat

SEQ ID NO: 758858 - DNA, 22 bp, Artificial Sequence
  chemically synthesized
tttgtcatgagattcctgagta

SEQ ID NO: 758859 - DNA, 22 bp, Artificial Sequence
  chemically synthesized
tgtcatgagattcctgagtaag

SEQ ID NO: 758860 - DNA, 22 bp, Artificial Sequence
  chemically synthesized
gtcatgagattcctgagtaagg

SEQ ID NO: 758861 - DNA, 22 bp, Artificial Sequence
  chemically synthesized
tcatgagattcctgagtaagga

SEQ ID NO: 758862 - DNA, 22 bp, Artificial Sequence
  chemically synthesized
tacttaacgcagtccttactca

SEQ ID NO: 758863 - DNA, 22 bp, Artificial Sequence
  chemically synthesized
ctgagtaaggactgcgttaagt

SEQ ID NO: 758864 - DNA, 22 bp, Artificial Sequence
  chemically synthesized
agtaaggactgcgttaagtaca

SEQ ID NO: 758865 - DNA, 22 bp, Artificial Sequence
  chemically synthesized
agagtggtaaaatgtctgtact

SEQ ID NO: 758866 - DNA, 22 bp, Artificial Sequence
  chemically synthesized
ttaagagtggtaaaatgtctgt

SEQ ID NO: 758867 - DNA, 22 bp, Artificial Sequence
  chemically synthesized
gttaagagtggtaaaatgtctg

SEQ ID NO: 758868 - DNA, 22 bp, Artificial Sequence
  chemically synthesized
cgttaagtacagacattttacc

SEQ ID NO: 758869 - DNA, 22 bp, Artificial Sequence
  chemically synthesized
cttgttaagagtggtaaaatgt

SEQ ID NO: 758870 - DNA, 22 bp, Artificial Sequence
  chemically synthesized
gttgcttgttaagagtggtaaa

SEQ ID NO: 758871 - DNA, 22 bp, Artificial Sequence
  chemically synthesized
agtacagacattttaccactct

SEQ ID NO: 758872 - DNA, 22 bp, Artificial Sequence
  chemically synthesized
ggttgcttgttaagagtggtaa

SEQ ID NO: 758873 - DNA, 22 bp, Artificial Sequence
  chemically synthesized
tggttgcttgttaagagtggta

SEQ ID NO: 758874 - DNA, 22 bp, Artificial Sequence
  chemically synthesized
gttttggttgcttgttaagagt

SEQ ID NO: 758875 - DNA, 22 bp, Artificial Sequence
  chemically synthesized
ttagttttggttgcttgttaag

SEQ ID NO: 758876 - DNA, 22 bp, Artificial Sequence
  chemically synthesized
gttattagttttggttgcttgt

SEQ ID NO: 758877 - DNA, 22 bp, Artificial Sequence
  chemically synthesized
taccactcttaacaagcaacca

SEQ ID NO: 758878 - DNA, 22 bp, Artificial Sequence
  chemically synthesized
accactcttaacaagcaaccaa

SEQ ID NO: 758879 - DNA, 22 bp, Artificial Sequence
  chemically synthesized
ccactcttaacaagcaaccaaa

SEQ ID NO: 758880 - DNA, 22 bp, Artificial Sequence
  chemically synthesized
ctggttattagttttggttgct

SEQ ID NO: 758881 - DNA, 22 bp, Artificial Sequence
  chemically synthesized
ttcctggttattagttttggtt

SEQ ID NO: 758882 - DNA, 22 bp, Artificial Sequence
  chemically synthesized
ttaacaagcaaccaaaactaat

SEQ ID NO: 758883 - DNA, 22 bp, Artificial Sequence
  chemically synthesized
actattcctggttattagtttt

SEQ ID NO: 758884 - DNA, 22 bp, Artificial Sequence
  chemically synthesized
aacaagcaaccaaaactaataa

SEQ ID NO: 758885 - DNA, 22 bp, Artificial Sequence
  chemically synthesized
cactattcctggttattagttt

SEQ ID NO: 758886 - DNA, 22 bp, Artificial Sequence
  chemically synthesized
acaagcaaccaaaactaataac

SEQ ID NO: 758887 - DNA, 22 bp, Artificial Sequence
  chemically synthesized
cttcactattcctggttattag

SEQ ID NO: 758888 - DNA, 22 bp, Artificial Sequence
  chemically synthesized
taaatactgcttcactattcct

SEQ ID NO: 758889 - DNA, 22 bp, Artificial Sequence
  chemically synthesized
ttataaatactgcttcactatt

SEQ ID NO: 758890 - DNA, 22 bp, Artificial Sequence
  chemically synthesized
gttataaatactgcttcactat

SEQ ID NO: 758891 - DNA, 22 bp, Artificial Sequence
  chemically synthesized
tgttataaatactgcttcacta

SEQ ID NO: 758892 - DNA, 22 bp, Artificial Sequence
  chemically synthesized
ataaccaggaatagtgaagcag

SEQ ID NO: 758893 - DNA, 22 bp, Artificial Sequence
  chemically synthesized
cagccagtattttgttataaat

SEQ ID NO: 758894 - DNA, 22 bp, Artificial Sequence
  chemically synthesized
ccagccagtattttgttataaa

SEQ ID NO: 758895 - DNA, 22 bp, Artificial Sequence
  chemically synthesized
ttccagccagtattttgttata

SEQ ID NO: 758896 - DNA, 22 bp, Artificial Sequence
  chemically synthesized
cttccagccagtattttgttat

SEQ ID NO: 758897 - DNA, 22 bp, Artificial Sequence
  chemically synthesized
tggtttcttccagccagtattt

SEQ ID NO: 758898 - DNA, 22 bp, Artificial Sequence
  chemically synthesized
ctgtggtttcttccagccagta

SEQ ID NO: 758899 - DNA, 22 bp, Artificial Sequence
  chemically synthesized
ataacaaaatactggctggaag

SEQ ID NO: 758900 - DNA, 22 bp, Artificial Sequence
  chemically synthesized
taacaaaatactggctggaaga

SEQ ID NO: 758901 - DNA, 22 bp, Artificial Sequence
  chemically synthesized
gtccaaataattgctgtggttt

SEQ ID NO: 758902 - DNA, 22 bp, Artificial Sequence
  chemically synthesized
gctggaagaaaccacagcaatt

SEQ ID NO: 758903 - DNA, 22 bp, Artificial Sequence
  chemically synthesized
gaagaaaccacagcaattattt

SEQ ID NO: 758904 - DNA, 22 bp, Artificial Sequence
  chemically synthesized
taatatgaggaaattggtccaa

SEQ ID NO: 758905 - DNA, 22 bp, Artificial Sequence
  chemically synthesized
aactgtaatatgaggaaattgg

SEQ ID NO: 758906 - DNA, 22 bp, Artificial Sequence
  chemically synthesized
caactgtaatatgaggaaattg

SEQ ID NO: 758907 - DNA, 22 bp, Artificial Sequence
  chemically synthesized
ttcaactgtaatatgaggaaat

SEQ ID NO: 758908 - DNA, 22 bp, Artificial Sequence
  chemically synthesized
tttggaccaatttcctcatatt

SEQ ID NO: 758909 - DNA, 22 bp, Artificial Sequence
  chemically synthesized
ttcttcaactgtaatatgagga

SEQ ID NO: 758910 - DNA, 22 bp, Artificial Sequence
  chemically synthesized
gttcttcaactgtaatatgagg

SEQ ID NO: 758911 - DNA, 22 bp, Artificial Sequence
  chemically synthesized
tgttcttcaactgtaatatgag

SEQ ID NO: 758912 - DNA, 22 bp, Artificial Sequence
  chemically synthesized
ggaccaatttcctcatattaca

SEQ ID NO: 758913 - DNA, 22 bp, Artificial Sequence
  chemically synthesized
gaccaatttcctcatattacag

SEQ ID NO: 758914 - DNA, 22 bp, Artificial Sequence
  chemically synthesized
ttttgttcttcaactgtaatat

SEQ ID NO: 758915 - DNA, 22 bp, Artificial Sequence
  chemically synthesized
ctattttgttcttcaactgtaa

SEQ ID NO: 758916 - DNA, 22 bp, Artificial Sequence
  chemically synthesized
attgctattttgttcttcaact

SEQ ID NO: 758917 - DNA, 22 bp, Artificial Sequence
  chemically synthesized
cctcatattacagttgaagaac

SEQ ID NO: 758918 - DNA, 22 bp, Artificial Sequence
  chemically synthesized
ctcatattacagttgaagaaca

SEQ ID NO: 758919 - DNA, 22 bp, Artificial Sequence
  chemically synthesized
tgattgctattttgttcttcaa

SEQ ID NO: 758920 - DNA, 22 bp, Artificial Sequence
  chemically synthesized
atattacagttgaagaacaaaa

SEQ ID NO: 758921 - DNA, 22 bp, Artificial Sequence
  chemically synthesized
cagttgaagaacaaaatagcaa

SEQ ID NO: 758922 - DNA, 22 bp, Artificial Sequence
  chemically synthesized
ataagatggattctgattgcta

SEQ ID NO: 758923 - DNA, 22 bp, Artificial Sequence
  chemically synthesized
cataagatggattctgattgct

SEQ ID NO: 758924 - DNA, 22 bp, Artificial Sequence
  chemically synthesized
aagaacaaaatagcaatcagaa

SEQ ID NO: 758925 - DNA, 22 bp, Artificial Sequence
  chemically synthesized
ttcataagatggattctgattg

SEQ ID NO: 758926 - DNA, 22 bp, Artificial Sequence
  chemically synthesized
cttcataagatggattctgatt

SEQ ID NO: 758927 - DNA, 22 bp, Artificial Sequence
  chemically synthesized
gtcatatttcttcataagatgg

SEQ ID NO: 758928 - DNA, 22 bp, Artificial Sequence
  chemically synthesized
tagtcatatttcttcataagat

SEQ ID NO: 758929 - DNA, 22 bp, Artificial Sequence
  chemically synthesized
agattctagtcatatttcttca

SEQ ID NO: 758930 - DNA, 22 bp, Artificial Sequence
  chemically synthesized
atgaagaaatatgactagaatc

SEQ ID NO: 758931 - DNA, 22 bp, Artificial Sequence
  chemically synthesized
tgaagaaatatgactagaatct

SEQ ID NO: 758932 - DNA, 22 bp, Artificial Sequence
  chemically synthesized
ggagtcaggagactgagattct

SEQ ID NO: 758933 - DNA, 22 bp, Artificial Sequence
  chemically synthesized
gaatctcagtctcctgactcct

SEQ ID NO: 758934 - DNA, 22 bp, Artificial Sequence
  chemically synthesized
gacatgtgcactaggagtcagg

SEQ ID NO: 758935 - DNA, 22 bp, Artificial Sequence
  chemically synthesized
agtctcctgactcctagtgcac

SEQ ID NO: 758936 - DNA, 22 bp, Artificial Sequence
  chemically synthesized
ctgactcctagtgcacatgtcc

SEQ ID NO: 758937 - DNA, 22 bp, Artificial Sequence
  chemically synthesized
actcctagtgcacatgtccagt

SEQ ID NO: 758938 - DNA, 22 bp, Artificial Sequence
  chemically synthesized
ctagtgcacatgtccagtgatt

SEQ ID NO: 758939 - DNA, 22 bp, Artificial Sequence
  chemically synthesized
gtgcacatgtccagtgattcat

SEQ ID NO: 758940 - DNA, 22 bp, Artificial Sequence
  chemically synthesized
cagaaaccaaagaaaatgaatc

SEQ ID NO: 758941 - DNA, 22 bp, Artificial Sequence
  chemically synthesized
gttccagaaaccaaagaaaatg

SEQ ID NO: 758942 - DNA, 22 bp, Artificial Sequence
  chemically synthesized
tgctagttccagaaaccaaaga

SEQ ID NO: 758943 - DNA, 22 bp, Artificial Sequence
  chemically synthesized
atgctagttccagaaaccaaag

SEQ ID NO: 758944 - DNA, 22 bp, Artificial Sequence
  chemically synthesized
tatgctagttccagaaaccaaa

SEQ ID NO: 758945 - DNA, 22 bp, Artificial Sequence
  chemically synthesized
attttctttggtttctggaact

SEQ ID NO: 758946 - DNA, 22 bp, Artificial Sequence
  chemically synthesized
tctttggtttctggaactagca

SEQ ID NO: 758947 - DNA, 22 bp, Artificial Sequence
  chemically synthesized
ctttggtttctggaactagcat

SEQ ID NO: 758948 - DNA, 22 bp, Artificial Sequence
  chemically synthesized
tttggtttctggaactagcata

SEQ ID NO: 758949 - DNA, 22 bp, Artificial Sequence
  chemically synthesized
tggtttctggaactagcataaa

SEQ ID NO: 758950 - DNA, 22 bp, Artificial Sequence
  chemically synthesized
caaaagatgaattttatgctag

SEQ ID NO: 758951 - DNA, 22 bp, Artificial Sequence
  chemically synthesized
ggtttctggaactagcataaaa

SEQ ID NO: 758952 - DNA, 22 bp, Artificial Sequence
  chemically synthesized
gtttctggaactagcataaaat

SEQ ID NO: 758953 - DNA, 22 bp, Artificial Sequence
  chemically synthesized
tacaaaagatgaattttatgct

SEQ ID NO: 758954 - DNA, 22 bp, Artificial Sequence
  chemically synthesized
ctacaaaagatgaattttatgc

SEQ ID NO: 758955 - DNA, 22 bp, Artificial Sequence
  chemically synthesized
ctggaactagcataaaattcat

SEQ ID NO: 758956 - DNA, 22 bp, Artificial Sequence
  chemically synthesized
tggaactagcataaaattcatc

SEQ ID NO: 758957 - DNA, 22 bp, Artificial Sequence
  chemically synthesized
gaactagcataaaattcatctt

SEQ ID NO: 758958 - DNA, 22 bp, Artificial Sequence
  chemically synthesized
gcataaaattcatcttttgtag

SEQ ID NO: 758959 - DNA, 22 bp, Artificial Sequence
  chemically synthesized
atcttttgtagaaattctgtct

SEQ ID NO: 758960 - DNA, 22 bp, Artificial Sequence
  chemically synthesized
ttgtagaaattctgtctcattt

SEQ ID NO: 758961 - DNA, 22 bp, Artificial Sequence
  chemically synthesized
tgcgatatagtgaaatgagaca

SEQ ID NO: 758962 - DNA, 22 bp, Artificial Sequence
  chemically synthesized
tgtagaaattctgtctcatttc

SEQ ID NO: 758963 - DNA, 22 bp, Artificial Sequence
  chemically synthesized
gtagaaattctgtctcatttca

SEQ ID NO: 758964 - DNA, 22 bp, Artificial Sequence
  chemically synthesized
tagaaattctgtctcatttcac

SEQ ID NO: 758965 - DNA, 22 bp, Artificial Sequence
  chemically synthesized
tgtctcatttcactatatcgca

SEQ ID NO: 758966 - DNA, 22 bp, Artificial Sequence
  chemically synthesized
aaaaatgcattatgcgatatag

SEQ ID NO: 758967 - DNA, 22 bp, Artificial Sequence
  chemically synthesized
aaaaaatgcattatgcgatata

SEQ ID NO: 758968 - DNA, 22 bp, Artificial Sequence
  chemically synthesized
tctcatttcactatatcgcata

SEQ ID NO: 758969 - DNA, 22 bp, Artificial Sequence
  chemically synthesized
taaaaaatgcattatgcgatat

SEQ ID NO: 758970 - DNA, 22 bp, Artificial Sequence
  chemically synthesized
ttaaaaaatgcattatgcgata

SEQ ID NO: 758971 - DNA, 22 bp, Artificial Sequence
  chemically synthesized
tttaaaaaatgcattatgcgat

SEQ ID NO: 758972 - DNA, 22 bp, Artificial Sequence
  chemically synthesized
ttttaaaaaatgcattatgcga

SEQ ID NO: 758973 - DNA, 22 bp, Artificial Sequence
  chemically synthesized
atttcactatatcgcataatgc

SEQ ID NO: 758974 - DNA, 22 bp, Artificial Sequence
  chemically synthesized
cactatatcgcataatgcattt

SEQ ID NO: 758975 - DNA, 22 bp, Artificial Sequence
  chemically synthesized
actatatcgcataatgcatttt

SEQ ID NO: 758976 - DNA, 22 bp, Artificial Sequence
  chemically synthesized
tatcgcataatgcattttttaa

SEQ ID NO: 758977 - DNA, 22 bp, Artificial Sequence
  chemically synthesized
agaaggatgggccttttttaaa

SEQ ID NO: 758978 - DNA, 22 bp, Artificial Sequence
  chemically synthesized
attgagaaggatgggccttttt

SEQ ID NO: 758979 - DNA, 22 bp, Artificial Sequence
  chemically synthesized
tttaaaaaaggcccatccttct

SEQ ID NO: 758980 - DNA, 22 bp, Artificial Sequence
  chemically synthesized
ttaaaaaaggcccatccttctc

SEQ ID NO: 758981 - DNA, 22 bp, Artificial Sequence
  chemically synthesized
taaaaaaggcccatccttctca

SEQ ID NO: 758982 - DNA, 22 bp, Artificial Sequence
  chemically synthesized
aaaaaaggcccatccttctcaa

SEQ ID NO: 758983 - DNA, 22 bp, Artificial Sequence
  chemically synthesized
aaaaaggcccatccttctcaat

SEQ ID NO: 758984 - DNA, 22 bp, Artificial Sequence
  chemically synthesized
gtgtacatatagaaaagcactc

SEQ ID NO: 758985 - DNA, 22 bp, Artificial Sequence
  chemically synthesized
tggtgtacatatagaaaagcac

SEQ ID NO: 758986 - DNA, 22 bp, Artificial Sequence
  chemically synthesized
ctcaatgagtgcttttctatat

SEQ ID NO: 758987 - DNA, 22 bp, Artificial Sequence
  chemically synthesized
tcaatgagtgcttttctatatg

SEQ ID NO: 758988 - DNA, 22 bp, Artificial Sequence
  chemically synthesized
aatgagtgcttttctatatgta

SEQ ID NO: 758989 - DNA, 22 bp, Artificial Sequence
  chemically synthesized
ttctatatgtacaccagagtgt

SEQ ID NO: 758990 - DNA, 22 bp, Artificial Sequence
  chemically synthesized
tctatatgtacaccagagtgtt

SEQ ID NO: 758991 - DNA, 22 bp, Artificial Sequence
  chemically synthesized
ctatatgtacaccagagtgttt

SEQ ID NO: 758992 - DNA, 22 bp, Artificial Sequence
  chemically synthesized
aataaacagccaaaacactctg

SEQ ID NO: 758993 - DNA, 22 bp, Artificial Sequence
  chemically synthesized
tatatgtacaccagagtgtttt

SEQ ID NO: 758994 - DNA, 22 bp, Artificial Sequence
  chemically synthesized
gaataaacagccaaaacactct

SEQ ID NO: 758995 - DNA, 22 bp, Artificial Sequence
  chemically synthesized
tgaataaacagccaaaacactc

SEQ ID NO: 758996 - DNA, 22 bp, Artificial Sequence
  chemically synthesized
tatgtacaccagagtgttttgg

SEQ ID NO: 758997 - DNA, 22 bp, Artificial Sequence
  chemically synthesized
actttgaataaacagccaaaac

SEQ ID NO: 758998 - DNA, 22 bp, Artificial Sequence
  chemically synthesized
tgactttgaataaacagccaaa

SEQ ID NO: 758999 - DNA, 22 bp, Artificial Sequence
  chemically synthesized
aatgttctgactttgaataaac

SEQ ID NO: 759000 - DNA, 22 bp, Artificial Sequence
  chemically synthesized
aaatgttctgactttgaataaa

SEQ ID NO: 759001 - DNA, 22 bp, Artificial Sequence
  chemically synthesized
taaatgttctgactttgaataa

SEQ ID NO: 759002 - DNA, 22 bp, Artificial Sequence
  chemically synthesized
tggctgtttattcaaagtcaga

SEQ ID NO: 759003 - DNA, 22 bp, Artificial Sequence
  chemically synthesized
ggctgtttattcaaagtcagaa

SEQ ID NO: 759004 - DNA, 22 bp, Artificial Sequence
  chemically synthesized
gctgtttattcaaagtcagaac

SEQ ID NO: 759005 - DNA, 22 bp, Artificial Sequence
  chemically synthesized
tgtgttttaaatgttctgactt

SEQ ID NO: 759006 - DNA, 22 bp, Artificial Sequence
  chemically synthesized
tttattcaaagtcagaacattt

SEQ ID NO: 759007 - DNA, 22 bp, Artificial Sequence
  chemically synthesized
attcaaagtcagaacatttaaa

SEQ ID NO: 759008 - DNA, 22 bp, Artificial Sequence
  chemically synthesized
ttcaaagtcagaacatttaaaa

SEQ ID NO: 759009 - DNA, 22 bp, Artificial Sequence
  chemically synthesized
aaagtcagaacatttaaaacac

SEQ ID NO: 759010 - DNA, 22 bp, Artificial Sequence
  chemically synthesized
aaaacacatagcaccattacat

SEQ ID NO: 759011 - DNA, 22 bp, Artificial Sequence
  chemically synthesized
tggtagggtgaaatgtaatggt

SEQ ID NO: 759012 - DNA, 22 bp, Artificial Sequence
  chemically synthesized
aaacacatagcaccattacatt

SEQ ID NO: 759013 - DNA, 22 bp, Artificial Sequence
  chemically synthesized
gtggtagggtgaaatgtaatgg

SEQ ID NO: 759014 - DNA, 22 bp, Artificial Sequence
  chemically synthesized
tgtggtagggtgaaatgtaatg

SEQ ID NO: 759015 - DNA, 22 bp, Artificial Sequence
  chemically synthesized
ttgtggtagggtgaaatgtaat

SEQ ID NO: 759016 - DNA, 22 bp, Artificial Sequence
  chemically synthesized
gcttttgtggtagggtgaaatg

SEQ ID NO: 759017 - DNA, 22 bp, Artificial Sequence
  chemically synthesized
aattagcttttgtggtagggtg

SEQ ID NO: 759018 - DNA, 22 bp, Artificial Sequence
  chemically synthesized
catttcaccctaccacaaaagc

SEQ ID NO: 759019 - DNA, 22 bp, Artificial Sequence
  chemically synthesized
aatattaaattagcttttgtgg

SEQ ID NO: 759020 - DNA, 22 bp, Artificial Sequence
  chemically synthesized
tgaatattaaattagcttttgt

SEQ ID NO: 759021 - DNA, 22 bp, Artificial Sequence
  chemically synthesized
ctgaatattaaattagcttttg

SEQ ID NO: 759022 - DNA, 22 bp, Artificial Sequence
  chemically synthesized
caccctaccacaaaagctaatt

SEQ ID NO: 759023 - DNA, 22 bp, Artificial Sequence
  chemically synthesized
accctaccacaaaagctaattt

SEQ ID NO: 759024 - DNA, 22 bp, Artificial Sequence
  chemically synthesized
atatatttctgaatattaaatt

SEQ ID NO: 759025 - DNA, 22 bp, Artificial Sequence
  chemically synthesized
ccacaaaagctaatttaatatt

SEQ ID NO: 759026 - DNA, 22 bp, Artificial Sequence
  chemically synthesized
catatatttctgaatattaaat

SEQ ID NO: 759027 - DNA, 22 bp, Artificial Sequence
  chemically synthesized
ccttcatatatttctgaatatt

SEQ ID NO: 759028 - DNA, 22 bp, Artificial Sequence
  chemically synthesized
gccttcatatatttctgaatat

SEQ ID NO: 759029 - DNA, 22 bp, Artificial Sequence
  chemically synthesized
atttaatattcagaaatatatg

SEQ ID NO: 759030 - DNA, 22 bp, Artificial Sequence
  chemically synthesized
gccatttgccttcatatatttc

SEQ ID NO: 759031 - DNA, 22 bp, Artificial Sequence
  chemically synthesized
agccatttgccttcatatattt

SEQ ID NO: 759032 - DNA, 22 bp, Artificial Sequence
  chemically synthesized
tagccatttgccttcatatatt

SEQ ID NO: 759033 - DNA, 22 bp, Artificial Sequence
  chemically synthesized
aatattcagaaatatatgaagg

SEQ ID NO: 759034 - DNA, 22 bp, Artificial Sequence
  chemically synthesized
atattcagaaatatatgaaggc

SEQ ID NO: 759035 - DNA, 22 bp, Artificial Sequence
  chemically synthesized
ctttagccatttgccttcatat

SEQ ID NO: 759036 - DNA, 22 bp, Artificial Sequence
  chemically synthesized
tcctttagccatttgccttcat

SEQ ID NO: 759037 - DNA, 22 bp, Artificial Sequence
  chemically synthesized
ctcctttagccatttgccttca

SEQ ID NO: 759038 - DNA, 22 bp, Artificial Sequence
  chemically synthesized
agaaatatatgaaggcaaatgg

SEQ ID NO: 759039 - DNA, 22 bp, Artificial Sequence
  chemically synthesized
ccagtttctcctttagccattt

SEQ ID NO: 759040 - DNA, 22 bp, Artificial Sequence
  chemically synthesized
aaggagaaactggcagtttccc

SEQ ID NO: 759041 - DNA, 22 bp, Artificial Sequence
  chemically synthesized
caaaaaaaaaaaaaaatgccag

SEQ ID NO: 759042 - DNA, 22 bp, Artificial Sequence
  chemically synthesized
gcaaaaaaaaaaaaaaatgcca

SEQ ID NO: 759043 - DNA, 22 bp, Artificial Sequence
  chemically synthesized
tgcaaaaaaaaaaaaaaatgcc

SEQ ID NO: 759044 - DNA, 22 bp, Artificial Sequence
  chemically synthesized
gcagtttccctggcattttttt

SEQ ID NO: 759045 - DNA, 22 bp, Artificial Sequence
  chemically synthesized
ccctggcatttttttttttttt

SEQ ID NO: 759046 - DNA, 22 bp, Artificial Sequence
  chemically synthesized
cctggcattttttttttttttt

SEQ ID NO: 759047 - DNA, 22 bp, Artificial Sequence
  chemically synthesized
gcatttttttttttttttgcaa

SEQ ID NO: 759048 - DNA, 22 bp, Artificial Sequence
  chemically synthesized
ttttttttttttgcaaagatcc

SEQ ID NO: 759049 - DNA, 22 bp, Artificial Sequence
  chemically synthesized
tttttttttttgcaaagatccc

SEQ ID NO: 759050 - DNA, 22 bp, Artificial Sequence
  chemically synthesized
ttttttttttgcaaagatccct

SEQ ID NO: 759051 - DNA, 22 bp, Artificial Sequence
  chemically synthesized
tttttttttgcaaagatccctg

SEQ ID NO: 759052 - DNA, 22 bp, Artificial Sequence
  chemically synthesized
ttttttttgcaaagatccctgg

SEQ ID NO: 759053 - DNA, 22 bp, Artificial Sequence
  chemically synthesized
tttttttgcaaagatccctggg

SEQ ID NO: 759054 - DNA, 22 bp, Artificial Sequence
  chemically synthesized
ttttttgcaaagatccctgggt

SEQ ID NO: 759055 - DNA, 22 bp, Artificial Sequence
  chemically synthesized
tttttgcaaagatccctgggtc

SEQ ID NO: 759056 - DNA, 22 bp, Artificial Sequence
  chemically synthesized
ttttgcaaagatccctgggtct

SEQ ID NO: 759057 - DNA, 22 bp, Artificial Sequence
  chemically synthesized
tttgcaaagatccctgggtctt

SEQ ID NO: 759058 - DNA, 22 bp, Artificial Sequence
  chemically synthesized
ttgcaaagatccctgggtcttc

SEQ ID NO: 759059 - DNA, 22 bp, Artificial Sequence
  chemically synthesized
tgcaaagatccctgggtcttct

SEQ ID NO: 759060 - DNA, 22 bp, Artificial Sequence
  chemically synthesized
gcaaagatccctgggtcttctt

SEQ ID NO: 759061 - DNA, 22 bp, Artificial Sequence
  chemically synthesized
caaagatccctgggtcttcttt

SEQ ID NO: 759062 - DNA, 22 bp, Artificial Sequence
  chemically synthesized
taaaaagggaagagaacatgaa

SEQ ID NO: 759063 - DNA, 22 bp, Artificial Sequence
  chemically synthesized
ggtcttctttcatgttctcttc

SEQ ID NO: 759064 - DNA, 22 bp, Artificial Sequence
  chemically synthesized
ctttcatgttctcttccctttt

SEQ ID NO: 759065 - DNA, 22 bp, Artificial Sequence
  chemically synthesized
tttcatgttctcttcccttttt

SEQ ID NO: 759066 - DNA, 22 bp, Artificial Sequence
  chemically synthesized
tcatgttctcttccctttttat

SEQ ID NO: 759067 - DNA, 22 bp, Artificial Sequence
  chemically synthesized
catgttctcttccctttttata

SEQ ID NO: 759068 - DNA, 22 bp, Artificial Sequence
  chemically synthesized
atgttctcttccctttttataa

SEQ ID NO: 759069 - DNA, 22 bp, Artificial Sequence
  chemically synthesized
tcttccctttttataatttcct

SEQ ID NO: 759070 - DNA, 22 bp, Artificial Sequence
  chemically synthesized
gagaagaggatataggaaatta

SEQ ID NO: 759071 - DNA, 22 bp, Artificial Sequence
  chemically synthesized
ttccctttttataatttcctat

SEQ ID NO: 759072 - DNA, 22 bp, Artificial Sequence
  chemically synthesized
tggagaagaggatataggaaat

SEQ ID NO: 759073 - DNA, 22 bp, Artificial Sequence
  chemically synthesized
ccctttttataatttcctatat

SEQ ID NO: 759074 - DNA, 22 bp, Artificial Sequence
  chemically synthesized
cctttttataatttcctatatc

SEQ ID NO: 759075 - DNA, 22 bp, Artificial Sequence
  chemically synthesized
ttctggagaagaggatatagga

SEQ ID NO: 759076 - DNA, 22 bp, Artificial Sequence
  chemically synthesized
tttataatttcctatatcctct

SEQ ID NO: 759077 - DNA, 22 bp, Artificial Sequence
  chemically synthesized
ttataatttcctatatcctctt

SEQ ID NO: 759078 - DNA, 22 bp, Artificial Sequence
  chemically synthesized
tataatttcctatatcctcttc

SEQ ID NO: 759079 - DNA, 22 bp, Artificial Sequence
  chemically synthesized
tattattctggagaagaggata

SEQ ID NO: 759080 - DNA, 22 bp, Artificial Sequence
  chemically synthesized
ataatttcctatatcctcttct

SEQ ID NO: 759081 - DNA, 22 bp, Artificial Sequence
  chemically synthesized
atattattctggagaagaggat

SEQ ID NO: 759082 - DNA, 22 bp, Artificial Sequence
  chemically synthesized
taatttcctatatcctcttctc

SEQ ID NO: 759083 - DNA, 22 bp, Artificial Sequence
  chemically synthesized
cctatatcctcttctccagaat

SEQ ID NO: 759084 - DNA, 22 bp, Artificial Sequence
  chemically synthesized
ctatatcctcttctccagaata

SEQ ID NO: 759085 - DNA, 22 bp, Artificial Sequence
  chemically synthesized
tatcctcttctccagaataata

SEQ ID NO: 759086 - DNA, 22 bp, Artificial Sequence
  chemically synthesized
ttctccagaataatataaaccc

SEQ ID NO: 759087 - DNA, 22 bp, Artificial Sequence
  chemically synthesized
aggaaaggtcaagggtttatat

SEQ ID NO: 759088 - DNA, 22 bp, Artificial Sequence
  chemically synthesized
gaggaaaggtcaagggtttata

SEQ ID NO: 759089 - DNA, 22 bp, Artificial Sequence
  chemically synthesized
ctccagaataatataaaccctt

SEQ ID NO: 759090 - DNA, 22 bp, Artificial Sequence
  chemically synthesized
tccagaataatataaacccttg

SEQ ID NO: 759091 - DNA, 22 bp, Artificial Sequence
  chemically synthesized
cagaataatataaacccttgac

SEQ ID NO: 759092 - DNA, 22 bp, Artificial Sequence
  chemically synthesized
gacctttcctcaagatgccacc

SEQ ID NO: 759093 - DNA, 22 bp, Artificial Sequence
  chemically synthesized
acctttcctcaagatgccacct

SEQ ID NO: 759094 - DNA, 22 bp, Artificial Sequence
  chemically synthesized
tggagatacagccaaaggtggc

SEQ ID NO: 759095 - DNA, 22 bp, Artificial Sequence
  chemically synthesized
tcctcaagatgccacctttggc

SEQ ID NO: 759096 - DNA, 22 bp, Artificial Sequence
  chemically synthesized
tgtggagatacagccaaaggtg

SEQ ID NO: 759097 - DNA, 22 bp, Artificial Sequence
  chemically synthesized
cctcaagatgccacctttggct

SEQ ID NO: 759098 - DNA, 22 bp, Artificial Sequence
  chemically synthesized
ctcaagatgccacctttggctg

SEQ ID NO: 759099 - DNA, 22 bp, Artificial Sequence
  chemically synthesized
aagatgccacctttggctgtat

SEQ ID NO: 759100 - DNA, 22 bp, Artificial Sequence
  chemically synthesized
tggctgtatctccacagagatc

SEQ ID NO: 759101 - DNA, 22 bp, Artificial Sequence
  chemically synthesized
ggctgtatctccacagagatct

SEQ ID NO: 759102 - DNA, 22 bp, Artificial Sequence
  chemically synthesized
gctgtatctccacagagatctt

SEQ ID NO: 759103 - DNA, 22 bp, Artificial Sequence
  chemically synthesized
agcatgtaaaggaaagatctct

SEQ ID NO: 759104 - DNA, 22 bp, Artificial Sequence
  chemically synthesized
tatctccacagagatctttcct

SEQ ID NO: 759105 - DNA, 22 bp, Artificial Sequence
  chemically synthesized
tatgttgagcatgtaaaggaaa

SEQ ID NO: 759106 - DNA, 22 bp, Artificial Sequence
  chemically synthesized
gtatgttgagcatgtaaaggaa

SEQ ID NO: 759107 - DNA, 22 bp, Artificial Sequence
  chemically synthesized
cacagagatctttcctttacat

SEQ ID NO: 759108 - DNA, 22 bp, Artificial Sequence
  chemically synthesized
tgtatgttgagcatgtaaagga

SEQ ID NO: 759109 - DNA, 22 bp, Artificial Sequence
  chemically synthesized
ttgtatgttgagcatgtaaagg

SEQ ID NO: 759110 - DNA, 22 bp, Artificial Sequence
  chemically synthesized
tcctttacatgctcaacataca

SEQ ID NO: 759111 - DNA, 22 bp, Artificial Sequence
  chemically synthesized
cctttacatgctcaacatacaa

SEQ ID NO: 759112 - DNA, 22 bp, Artificial Sequence
  chemically synthesized
ctttacatgctcaacatacaaa

SEQ ID NO: 759113 - DNA, 22 bp, Artificial Sequence
  chemically synthesized
tacatgctcaacatacaaaagt

SEQ ID NO: 759114 - DNA, 22 bp, Artificial Sequence
  chemically synthesized
acatgctcaacatacaaaagtg

SEQ ID NO: 759115 - DNA, 22 bp, Artificial Sequence
  chemically synthesized
ataaaatggtaccacttttgta

SEQ ID NO: 759116 - DNA, 22 bp, Artificial Sequence
  chemically synthesized
catgctcaacatacaaaagtgg

SEQ ID NO: 759117 - DNA, 22 bp, Artificial Sequence
  chemically synthesized
gataaaatggtaccacttttgt

SEQ ID NO: 759118 - DNA, 22 bp, Artificial Sequence
  chemically synthesized
aacatacaaaagtggtaccatt

SEQ ID NO: 759119 - DNA, 22 bp, Artificial Sequence
  chemically synthesized
ccaaataataaaaacttgataa

SEQ ID NO: 759120 - DNA, 22 bp, Artificial Sequence
  chemically synthesized
ctaccaaataataaaaacttga

SEQ ID NO: 759121 - DNA, 22 bp, Artificial Sequence
  chemically synthesized
tatcaagtttttattatttggt

SEQ ID NO: 759122 - DNA, 22 bp, Artificial Sequence
  chemically synthesized
atcaagtttttattatttggta

SEQ ID NO: 759123 - DNA, 22 bp, Artificial Sequence
  chemically synthesized
tcaagtttttattatttggtag

SEQ ID NO: 759124 - DNA, 22 bp, Artificial Sequence
  chemically synthesized
ttattatttggtagtaatttgt

SEQ ID NO: 759125 - DNA, 22 bp, Artificial Sequence
  chemically synthesized
tattatttggtagtaatttgtt

SEQ ID NO: 759126 - DNA, 22 bp, Artificial Sequence
  chemically synthesized
attatttggtagtaatttgttt

SEQ ID NO: 759127 - DNA, 22 bp, Artificial Sequence
  chemically synthesized
ttatttggtagtaatttgtttg

SEQ ID NO: 759128 - DNA, 22 bp, Artificial Sequence
  chemically synthesized
tttggtagtaatttgtttggtt

SEQ ID NO: 759129 - DNA, 22 bp, Artificial Sequence
  chemically synthesized
ggtagtaatttgtttggtttgc

SEQ ID NO: 759130 - DNA, 22 bp, Artificial Sequence
  chemically synthesized
gtagtaatttgtttggtttgct

SEQ ID NO: 759131 - DNA, 22 bp, Artificial Sequence
  chemically synthesized
gtttggtttgctattcatttct

SEQ ID NO: 759132 - DNA, 22 bp, Artificial Sequence
  chemically synthesized
tttggtttgctattcatttctg

SEQ ID NO: 759133 - DNA, 22 bp, Artificial Sequence
  chemically synthesized
ggtttgctattcatttctgttc

SEQ ID NO: 759134 - DNA, 22 bp, Artificial Sequence
  chemically synthesized
gtttgctattcatttctgttct

SEQ ID NO: 759135 - DNA, 22 bp, Artificial Sequence
  chemically synthesized
gctattcatttctgttcttgta

SEQ ID NO: 759136 - DNA, 22 bp, Artificial Sequence
  chemically synthesized
ctattcatttctgttcttgtat

SEQ ID NO: 759137 - DNA, 22 bp, Artificial Sequence
  chemically synthesized
ttcatttctgttcttgtatctt

SEQ ID NO: 759138 - DNA, 22 bp, Artificial Sequence
  chemically synthesized
gaaatgagaataaaagatacaa

SEQ ID NO: 759139 - DNA, 22 bp, Artificial Sequence
  chemically synthesized
ggaaatgagaataaaagataca

SEQ ID NO: 759140 - DNA, 22 bp, Artificial Sequence
  chemically synthesized
atttctgttcttgtatctttta

SEQ ID NO: 759141 - DNA, 22 bp, Artificial Sequence
  chemically synthesized
tggaaatgagaataaaagatac

SEQ ID NO: 759142 - DNA, 22 bp, Artificial Sequence
  chemically synthesized
ctgttcttgtatcttttattct

SEQ ID NO: 759143 - DNA, 22 bp, Artificial Sequence
  chemically synthesized
tgttcttgtatcttttattctc

SEQ ID NO: 759144 - DNA, 22 bp, Artificial Sequence
  chemically synthesized
ttcttgtatcttttattctcat

SEQ ID NO: 759145 - DNA, 22 bp, Artificial Sequence
  chemically synthesized
ttgtatcttttattctcatttc

SEQ ID NO: 759146 - DNA, 22 bp, Artificial Sequence
  chemically synthesized
ataagtgttttggaaatgagaa

SEQ ID NO: 759147 - DNA, 22 bp, Artificial Sequence
  chemically synthesized
gtatcttttattctcatttcca

SEQ ID NO: 759148 - DNA, 22 bp, Artificial Sequence
  chemically synthesized
tatcttttattctcatttccaa

SEQ ID NO: 759149 - DNA, 22 bp, Artificial Sequence
  chemically synthesized
ttattctcatttccaaaacact

SEQ ID NO: 759150 - DNA, 22 bp, Artificial Sequence
  chemically synthesized
tattctcatttccaaaacactt

SEQ ID NO: 759151 - DNA, 22 bp, Artificial Sequence
  chemically synthesized
attctcatttccaaaacactta

SEQ ID NO: 759152 - DNA, 22 bp, Artificial Sequence
  chemically synthesized
ttctcatttccaaaacacttat

SEQ ID NO: 759153 - DNA, 22 bp, Artificial Sequence
  chemically synthesized
tcatttccaaaacacttatcag

SEQ ID NO: 759154 - DNA, 22 bp, Artificial Sequence
  chemically synthesized
atttccaaaacacttatcagta

SEQ ID NO: 759155 - DNA, 22 bp, Artificial Sequence
  chemically synthesized
gtgtagagtggatactgataag

SEQ ID NO: 759156 - DNA, 22 bp, Artificial Sequence
  chemically synthesized
ccaaaacacttatcagtatcca

SEQ ID NO: 759157 - DNA, 22 bp, Artificial Sequence
  chemically synthesized
caaaacacttatcagtatccac

SEQ ID NO: 759158 - DNA, 22 bp, Artificial Sequence
  chemically synthesized
gtaaagtgtctggtgtagagtg

SEQ ID NO: 759159 - DNA, 22 bp, Artificial Sequence
  chemically synthesized
atcagtatccactctacaccag

SEQ ID NO: 759160 - DNA, 22 bp, Artificial Sequence
  chemically synthesized
tcagtatccactctacaccaga

SEQ ID NO: 759161 - DNA, 22 bp, Artificial Sequence
  chemically synthesized
gagtctagtaaagtgtctggtg

SEQ ID NO: 759162 - DNA, 22 bp, Artificial Sequence
  chemically synthesized
tacaccagacactttactagac

SEQ ID NO: 759163 - DNA, 22 bp, Artificial Sequence
  chemically synthesized
caagaccctagagtctagtaaa

SEQ ID NO: 759164 - DNA, 22 bp, Artificial Sequence
  chemically synthesized
caccagacactttactagactc

SEQ ID NO: 759165 - DNA, 22 bp, Artificial Sequence
  chemically synthesized
acctccaagaccctagagtcta

SEQ ID NO: 759166 - DNA, 22 bp, Artificial Sequence
  chemically synthesized
ttcacctccaagaccctagagt

SEQ ID NO: 759167 - DNA, 22 bp, Artificial Sequence
  chemically synthesized
gttcacctccaagaccctagag

SEQ ID NO: 759168 - DNA, 22 bp, Artificial Sequence
  chemically synthesized
tcttgttcacctccaagaccct

SEQ ID NO: 759169 - DNA, 22 bp, Artificial Sequence
  chemically synthesized
tactagactctagggtcttgga

SEQ ID NO: 759170 - DNA, 22 bp, Artificial Sequence
  chemically synthesized
gtcttgttcacctccaagaccc

SEQ ID NO: 759171 - DNA, 22 bp, Artificial Sequence
  chemically synthesized
actagactctagggtcttggag

SEQ ID NO: 759172 - DNA, 22 bp, Artificial Sequence
  chemically synthesized
tgtcttgttcacctccaagacc

SEQ ID NO: 759173 - DNA, 22 bp, Artificial Sequence
  chemically synthesized
ctagactctagggtcttggagg

SEQ ID NO: 759174 - DNA, 22 bp, Artificial Sequence
  chemically synthesized
gactctagggtcttggaggtga

SEQ ID NO: 759175 - DNA, 22 bp, Artificial Sequence
  chemically synthesized
tagggtcttggaggtgaacaag

SEQ ID NO: 759176 - DNA, 22 bp, Artificial Sequence
  chemically synthesized
gggtcttggaggtgaacaagac

SEQ ID NO: 759177 - DNA, 22 bp, Artificial Sequence
  chemically synthesized
ggaggtgaacaagacaaaatct

SEQ ID NO: 759178 - DNA, 22 bp, Artificial Sequence
  chemically synthesized
gaggtgaacaagacaaaatctc

SEQ ID NO: 759179 - DNA, 22 bp, Artificial Sequence
  chemically synthesized
agtgaaaaaggcagagattttg

SEQ ID NO: 759180 - DNA, 22 bp, Artificial Sequence
  chemically synthesized
tgagtgaaaaaggcagagattt

SEQ ID NO: 759181 - DNA, 22 bp, Artificial Sequence
  chemically synthesized
agctctgagtgaaaaaggcaga

SEQ ID NO: 759182 - DNA, 22 bp, Artificial Sequence
  chemically synthesized
ctaagctctgagtgaaaaaggc

SEQ ID NO: 759183 - DNA, 22 bp, Artificial Sequence
  chemically synthesized
tactaagctctgagtgaaaaag

SEQ ID NO: 759184 - DNA, 22 bp, Artificial Sequence
  chemically synthesized
tctactaagctctgagtgaaaa

SEQ ID NO: 759185 - DNA, 22 bp, Artificial Sequence
  chemically synthesized
ctctactaagctctgagtgaaa

SEQ ID NO: 759186 - DNA, 22 bp, Artificial Sequence
  chemically synthesized
tcttctctactaagctctgagt

SEQ ID NO: 759187 - DNA, 22 bp, Artificial Sequence
  chemically synthesized
tgcctttttcactcagagctta

SEQ ID NO: 759188 - DNA, 22 bp, Artificial Sequence
  chemically synthesized
tatcttctctactaagctctga

SEQ ID NO: 759189 - DNA, 22 bp, Artificial Sequence
  chemically synthesized
ctatcttctctactaagctctg

SEQ ID NO: 759190 - DNA, 22 bp, Artificial Sequence
  chemically synthesized
cctttttcactcagagcttagt

SEQ ID NO: 759191 - DNA, 22 bp, Artificial Sequence
  chemically synthesized
tttcactcagagcttagtagag

SEQ ID NO: 759192 - DNA, 22 bp, Artificial Sequence
  chemically synthesized
catttctatcttctctactaag

SEQ ID NO: 759193 - DNA, 22 bp, Artificial Sequence
  chemically synthesized
ttcactcagagcttagtagaga

SEQ ID NO: 759194 - DNA, 22 bp, Artificial Sequence
  chemically synthesized
acatttctatcttctctactaa

SEQ ID NO: 759195 - DNA, 22 bp, Artificial Sequence
  chemically synthesized
tcactcagagcttagtagagaa

SEQ ID NO: 759196 - DNA, 22 bp, Artificial Sequence
  chemically synthesized
cactcagagcttagtagagaag

SEQ ID NO: 759197 - DNA, 22 bp, Artificial Sequence
  chemically synthesized
actcagagcttagtagagaaga

SEQ ID NO: 759198 - DNA, 22 bp, Artificial Sequence
  chemically synthesized
tttacatttctatcttctctac

SEQ ID NO: 759199 - DNA, 22 bp, Artificial Sequence
  chemically synthesized
atttacatttctatcttctcta

SEQ ID NO: 759200 - DNA, 22 bp, Artificial Sequence
  chemically synthesized
tatttacatttctatcttctct

SEQ ID NO: 759201 - DNA, 22 bp, Artificial Sequence
  chemically synthesized
ttatttacatttctatcttctc

SEQ ID NO: 759202 - DNA, 22 bp, Artificial Sequence
  chemically synthesized
agagcttagtagagaagataga

SEQ ID NO: 759203 - DNA, 22 bp, Artificial Sequence
  chemically synthesized
tttttatttacatttctatctt

SEQ ID NO: 759204 - DNA, 22 bp, Artificial Sequence
  chemically synthesized
atttttatttacatttctatct

SEQ ID NO: 759205 - DNA, 22 bp, Artificial Sequence
  chemically synthesized
tatttttatttacatttctatc

SEQ ID NO: 759206 - DNA, 22 bp, Artificial Sequence
  chemically synthesized
agtagagaagatagaaatgtaa

SEQ ID NO: 759207 - DNA, 22 bp, Artificial Sequence
  chemically synthesized
ttttatttttatttacatttct

SEQ ID NO: 759208 - DNA, 22 bp, Artificial Sequence
  chemically synthesized
gtagagaagatagaaatgtaaa

SEQ ID NO: 759209 - DNA, 22 bp, Artificial Sequence
  chemically synthesized
gttttatttttatttacatttc

SEQ ID NO: 759210 - DNA, 22 bp, Artificial Sequence
  chemically synthesized
tttgttttatttttatttacat

SEQ ID NO: 759211 - DNA, 22 bp, Artificial Sequence
  chemically synthesized
gtttgttttatttttatttaca

SEQ ID NO: 759212 - DNA, 22 bp, Artificial Sequence
  chemically synthesized
tttgtttgttttatttttattt

SEQ ID NO: 759213 - DNA, 22 bp, Artificial Sequence
  chemically synthesized
gtttgtttgttttatttttatt

SEQ ID NO: 759214 - DNA, 22 bp, Artificial Sequence
  chemically synthesized
tgtttgtttgttttatttttat

SEQ ID NO: 759215 - DNA, 22 bp, Artificial Sequence
  chemically synthesized
tttgtttgtttgttttattttt

SEQ ID NO: 759216 - DNA, 22 bp, Artificial Sequence
  chemically synthesized
ctttgtttgtttgttttatttt

SEQ ID NO: 759217 - DNA, 22 bp, Artificial Sequence
  chemically synthesized
tttctttgtttgtttgttttat

SEQ ID NO: 759218 - DNA, 22 bp, Artificial Sequence
  chemically synthesized
caacgatgaccaattatttctt

SEQ ID NO: 759219 - DNA, 22 bp, Artificial Sequence
  chemically synthesized
gcatcctccaacgatgaccaat

SEQ ID NO: 759220 - DNA, 22 bp, Artificial Sequence
  chemically synthesized
actagcatcctccaacgatgac

SEQ ID NO: 759221 - DNA, 22 bp, Artificial Sequence
  chemically synthesized
ttcactagcatcctccaacgat

SEQ ID NO: 759222 - DNA, 22 bp, Artificial Sequence
  chemically synthesized
gttcactagcatcctccaacga

SEQ ID NO: 759223 - DNA, 22 bp, Artificial Sequence
  chemically synthesized
gtcatcgttggaggatgctagt

SEQ ID NO: 759224 - DNA, 22 bp, Artificial Sequence
  chemically synthesized
taataacaacttgttcactagc

SEQ ID NO: 759225 - DNA, 22 bp, Artificial Sequence
  chemically synthesized
ataataacaacttgttcactag

SEQ ID NO: 759226 - DNA, 22 bp, Artificial Sequence
  chemically synthesized
tataataacaacttgttcacta

SEQ ID NO: 759227 - DNA, 22 bp, Artificial Sequence
  chemically synthesized
ttataataacaacttgttcact

SEQ ID NO: 759228 - DNA, 22 bp, Artificial Sequence
  chemically synthesized
gaggatgctagtgaacaagttg

SEQ ID NO: 759229 - DNA, 22 bp, Artificial Sequence
  chemically synthesized
ccaatttttataataacaactt

SEQ ID NO: 759230 - DNA, 22 bp, Artificial Sequence
  chemically synthesized
accaatttttataataacaact

SEQ ID NO: 759231 - DNA, 22 bp, Artificial Sequence
  chemically synthesized
taccaatttttataataacaac

SEQ ID NO: 759232 - DNA, 22 bp, Artificial Sequence
  chemically synthesized
gtgaacaagttgttattataaa

SEQ ID NO: 759233 - DNA, 22 bp, Artificial Sequence
  chemically synthesized
aattttaccaatttttataata

SEQ ID NO: 759234 - DNA, 22 bp, Artificial Sequence
  chemically synthesized
caattttaccaatttttataat

SEQ ID NO: 759235 - DNA, 22 bp, Artificial Sequence
  chemically synthesized
ttattataaaaattggtaaaat

SEQ ID NO: 759236 - DNA, 22 bp, Artificial Sequence
  chemically synthesized
ttataaaaattggtaaaattga

SEQ ID NO: 759237 - DNA, 22 bp, Artificial Sequence
  chemically synthesized
taaaaattggtaaaattgaaac

SEQ ID NO: 759238 - DNA, 22 bp, Artificial Sequence
  chemically synthesized
ataccgaacaagcaaaatacgt

SEQ ID NO: 759239 - DNA, 22 bp, Artificial Sequence
  chemically synthesized
gtaaaattgaaacgtattttgc

SEQ ID NO: 759240 - DNA, 22 bp, Artificial Sequence
  chemically synthesized
cataccgaacaagcaaaatacg

SEQ ID NO: 759241 - DNA, 22 bp, Artificial Sequence
  chemically synthesized
tcataccgaacaagcaaaatac

SEQ ID NO: 759242 - DNA, 22 bp, Artificial Sequence
  chemically synthesized
aaacgtattttgcttgttcggt

SEQ ID NO: 759243 - DNA, 22 bp, Artificial Sequence
  chemically synthesized
agtatacctttcataccgaaca

SEQ ID NO: 759244 - DNA, 22 bp, Artificial Sequence
  chemically synthesized
gtactcagtatacctttcatac

SEQ ID NO: 759245 - DNA, 22 bp, Artificial Sequence
  chemically synthesized
ggtactcagtatacctttcata

SEQ ID NO: 759246 - DNA, 22 bp, Artificial Sequence
  chemically synthesized
tgcttgttcggtatgaaaggta

SEQ ID NO: 759247 - DNA, 22 bp, Artificial Sequence
  chemically synthesized
tggtactcagtatacctttcat

SEQ ID NO: 759248 - DNA, 22 bp, Artificial Sequence
  chemically synthesized
gcttgttcggtatgaaaggtat

SEQ ID NO: 759249 - DNA, 22 bp, Artificial Sequence
  chemically synthesized
cttgttcggtatgaaaggtata

SEQ ID NO: 759250 - DNA, 22 bp, Artificial Sequence
  chemically synthesized
ttttggtactcagtataccttt

SEQ ID NO: 759251 - DNA, 22 bp, Artificial Sequence
  chemically synthesized
gttcggtatgaaaggtatactg

SEQ ID NO: 759252 - DNA, 22 bp, Artificial Sequence
  chemically synthesized
ttcggtatgaaaggtatactga

SEQ ID NO: 759253 - DNA, 22 bp, Artificial Sequence
  chemically synthesized
ctattttggtactcagtatacc

SEQ ID NO: 759254 - DNA, 22 bp, Artificial Sequence
  chemically synthesized
ggtatgaaaggtatactgagta

SEQ ID NO: 759255 - DNA, 22 bp, Artificial Sequence
  chemically synthesized
tctcctattttggtactcagta

SEQ ID NO: 759256 - DNA, 22 bp, Artificial Sequence
  chemically synthesized
gtctcctattttggtactcagt

SEQ ID NO: 759257 - DNA, 22 bp, Artificial Sequence
  chemically synthesized
cacttgtctcctattttggtac

SEQ ID NO: 759258 - DNA, 22 bp, Artificial Sequence
  chemically synthesized
gcacttgtctcctattttggta

SEQ ID NO: 759259 - DNA, 22 bp, Artificial Sequence
  chemically synthesized
tgcacttgtctcctattttggt

SEQ ID NO: 759260 - DNA, 22 bp, Artificial Sequence
  chemically synthesized
agtaccaaaataggagacaagt

SEQ ID NO: 759261 - DNA, 22 bp, Artificial Sequence
  chemically synthesized
tgaaaaaaatgttttgcacttg

SEQ ID NO: 759262 - DNA, 22 bp, Artificial Sequence
  chemically synthesized
gggtaggtctatgaaaaaaatg

SEQ ID NO: 759263 - DNA, 22 bp, Artificial Sequence
  chemically synthesized
actggggtaggtctatgaaaaa

SEQ ID NO: 759264 - DNA, 22 bp, Artificial Sequence
  chemically synthesized
ttcactggggtaggtctatgaa

SEQ ID NO: 759265 - DNA, 22 bp, Artificial Sequence
  chemically synthesized
attcactggggtaggtctatga

SEQ ID NO: 759266 - DNA, 22 bp, Artificial Sequence
  chemically synthesized
atttattcactggggtaggtct

SEQ ID NO: 759267 - DNA, 22 bp, Artificial Sequence
  chemically synthesized
catttattcactggggtaggtc

SEQ ID NO: 759268 - DNA, 22 bp, Artificial Sequence
  chemically synthesized
ttcatttattcactggggtagg

SEQ ID NO: 759269 - DNA, 22 bp, Artificial Sequence
  chemically synthesized
cttcatttattcactggggtag

SEQ ID NO: 759270 - DNA, 22 bp, Artificial Sequence
  chemically synthesized
ttttcatagacctaccccagtg

SEQ ID NO: 759271 - DNA, 22 bp, Artificial Sequence
  chemically synthesized
tttcatagacctaccccagtga

SEQ ID NO: 759272 - DNA, 22 bp, Artificial Sequence
  chemically synthesized
ttcatagacctaccccagtgaa

SEQ ID NO: 759273 - DNA, 22 bp, Artificial Sequence
  chemically synthesized
cttcttcatttattcactgggg

SEQ ID NO: 759274 - DNA, 22 bp, Artificial Sequence
  chemically synthesized
tcatagacctaccccagtgaat

SEQ ID NO: 759275 - DNA, 22 bp, Artificial Sequence
  chemically synthesized
catagacctaccccagtgaata

SEQ ID NO: 759276 - DNA, 22 bp, Artificial Sequence
  chemically synthesized
atagacctaccccagtgaataa

SEQ ID NO: 759277 - DNA, 22 bp, Artificial Sequence
  chemically synthesized
ccattccttcttcatttattca

SEQ ID NO: 759278 - DNA, 22 bp, Artificial Sequence
  chemically synthesized
taccattccttcttcatttatt

SEQ ID NO: 759279 - DNA, 22 bp, Artificial Sequence
  chemically synthesized
ccccagtgaataaatgaagaag

SEQ ID NO: 759280 - DNA, 22 bp, Artificial Sequence
  chemically synthesized
tctctaccattccttcttcatt

SEQ ID NO: 759281 - DNA, 22 bp, Artificial Sequence
  chemically synthesized
cctatctctaccattccttctt

SEQ ID NO: 759282 - DNA, 22 bp, Artificial Sequence
  chemically synthesized
cagtgtgataattgcctatctc

SEQ ID NO: 759283 - DNA, 22 bp, Artificial Sequence
  chemically synthesized
ggggttgcagtgtgataattgc

SEQ ID NO: 759284 - DNA, 22 bp, Artificial Sequence
  chemically synthesized
acgatcagtggctaggggttgc

SEQ ID NO: 759285 - DNA, 22 bp, Artificial Sequence
  chemically synthesized
ttcacgatcagtggctaggggt

SEQ ID NO: 759286 - DNA, 22 bp, Artificial Sequence
  chemically synthesized
tcacactgcaacccctagccac

SEQ ID NO: 759287 - DNA, 22 bp, Artificial Sequence
  chemically synthesized
atagctgttcacgatcagtggc

SEQ ID NO: 759288 - DNA, 22 bp, Artificial Sequence
  chemically synthesized
aatagctgttcacgatcagtgg

SEQ ID NO: 759289 - DNA, 22 bp, Artificial Sequence
  chemically synthesized
caacccctagccactgatcgtg

SEQ ID NO: 759290 - DNA, 22 bp, Artificial Sequence
  chemically synthesized
tgtgatgtttaatagctgttca

SEQ ID NO: 759291 - DNA, 22 bp, Artificial Sequence
  chemically synthesized
gccactgatcgtgaacagctat

SEQ ID NO: 759292 - DNA, 22 bp, Artificial Sequence
  chemically synthesized
gtgtgatgtttaatagctgttc

SEQ ID NO: 759293 - DNA, 22 bp, Artificial Sequence
  chemically synthesized
tgtgtgatgtttaatagctgtt

SEQ ID NO: 759294 - DNA, 22 bp, Artificial Sequence
  chemically synthesized
ttgtgtgatgtttaatagctgt

SEQ ID NO: 759295 - DNA, 22 bp, Artificial Sequence
  chemically synthesized
tttgtgtgatgtttaatagctg

SEQ ID NO: 759296 - DNA, 22 bp, Artificial Sequence
  chemically synthesized
tttttgtgtgatgtttaatagc

SEQ ID NO: 759297 - DNA, 22 bp, Artificial Sequence
  chemically synthesized
atcgtgaacagctattaaacat

SEQ ID NO: 759298 - DNA, 22 bp, Artificial Sequence
  chemically synthesized
tctttttgtgtgatgtttaata

SEQ ID NO: 759299 - DNA, 22 bp, Artificial Sequence
  chemically synthesized
ctctttttgtgtgatgtttaat

SEQ ID NO: 759300 - DNA, 22 bp, Artificial Sequence
  chemically synthesized
tctctttttgtgtgatgtttaa

SEQ ID NO: 759301 - DNA, 22 bp, Artificial Sequence
  chemically synthesized
ttttctctttttgtgtgatgtt

SEQ ID NO: 759302 - DNA, 22 bp, Artificial Sequence
  chemically synthesized
gttttctctttttgtgtgatgt

SEQ ID NO: 759303 - DNA, 22 bp, Artificial Sequence
  chemically synthesized
ttaaacatcacacaaaaagaga

SEQ ID NO: 759304 - DNA, 22 bp, Artificial Sequence
  chemically synthesized
aacatcacacaaaaagagaaaa

SEQ ID NO: 759305 - DNA, 22 bp, Artificial Sequence
  chemically synthesized
catcatcaggaggtggtatata

SEQ ID NO: 759306 - DNA, 22 bp, Artificial Sequence
  chemically synthesized
ccatcatcaggaggtggtatat

SEQ ID NO: 759307 - DNA, 22 bp, Artificial Sequence
  chemically synthesized
ttccatcatcaggaggtggtat

SEQ ID NO: 759308 - DNA, 22 bp, Artificial Sequence
  chemically synthesized
gtgtattcttccatcatcagga

SEQ ID NO: 759309 - DNA, 22 bp, Artificial Sequence
  chemically synthesized
tataccacctcctgatgatgga

SEQ ID NO: 759310 - DNA, 22 bp, Artificial Sequence
  chemically synthesized
acaggtgttcgtgtattcttcc

SEQ ID NO: 759311 - DNA, 22 bp, Artificial Sequence
  chemically synthesized
cacaggtgttcgtgtattcttc

SEQ ID NO: 759312 - DNA, 22 bp, Artificial Sequence
  chemically synthesized
ctgatgatggaagaatacacga

SEQ ID NO: 759313 - DNA, 22 bp, Artificial Sequence
  chemically synthesized
cttcacaggtgttcgtgtattc

SEQ ID NO: 759314 - DNA, 22 bp, Artificial Sequence
  chemically synthesized
atgatggaagaatacacgaaca

SEQ ID NO: 759315 - DNA, 22 bp, Artificial Sequence
  chemically synthesized
gcaagactgcttcacaggtgtt

SEQ ID NO: 759316 - DNA, 22 bp, Artificial Sequence
  chemically synthesized
ggcaagactgcttcacaggtgt

SEQ ID NO: 759317 - DNA, 22 bp, Artificial Sequence
  chemically synthesized
tggcaagactgcttcacaggtg

SEQ ID NO: 759318 - DNA, 22 bp, Artificial Sequence
  chemically synthesized
ttggcaagactgcttcacaggt

SEQ ID NO: 759319 - DNA, 22 bp, Artificial Sequence
  chemically synthesized
tttggcaagactgcttcacagg

SEQ ID NO: 759320 - DNA, 22 bp, Artificial Sequence
  chemically synthesized
ttttggcaagactgcttcacag

SEQ ID NO: 759321 - DNA, 22 bp, Artificial Sequence
  chemically synthesized
tttttggcaagactgcttcaca

SEQ ID NO: 759322 - DNA, 22 bp, Artificial Sequence
  chemically synthesized
gctttttttggcaagactgctt

SEQ ID NO: 759323 - DNA, 22 bp, Artificial Sequence
  chemically synthesized
ggctttttttggcaagactgct

SEQ ID NO: 759324 - DNA, 22 bp, Artificial Sequence
  chemically synthesized
ggtttggctttttttggcaaga

SEQ ID NO: 759325 - DNA, 22 bp, Artificial Sequence
  chemically synthesized
gggtttggctttttttggcaag

SEQ ID NO: 759326 - DNA, 22 bp, Artificial Sequence
  chemically synthesized
tgaagcagtcttgccaaaaaaa

SEQ ID NO: 759327 - DNA, 22 bp, Artificial Sequence
  chemically synthesized
tatttgggtttggctttttttg

SEQ ID NO: 759328 - DNA, 22 bp, Artificial Sequence
  chemically synthesized
attgtatttgggtttggctttt

SEQ ID NO: 759329 - DNA, 22 bp, Artificial Sequence
  chemically synthesized
gattgtatttgggtttggcttt

SEQ ID NO: 759330 - DNA, 22 bp, Artificial Sequence
  chemically synthesized
gccaaaaaaagccaaacccaaa

SEQ ID NO: 759331 - DNA, 22 bp, Artificial Sequence
  chemically synthesized
ccaaaaaaagccaaacccaaat

SEQ ID NO: 759332 - DNA, 22 bp, Artificial Sequence
  chemically synthesized
tagtttgattgtatttgggttt

SEQ ID NO: 759333 - DNA, 22 bp, Artificial Sequence
  chemically synthesized
tatagtttgattgtatttgggt

SEQ ID NO: 759334 - DNA, 22 bp, Artificial Sequence
  chemically synthesized
aacagtgcagttctatagtttg

SEQ ID NO: 759335 - DNA, 22 bp, Artificial Sequence
  chemically synthesized
ccgattgaacagtgcagttcta

SEQ ID NO: 759336 - DNA, 22 bp, Artificial Sequence
  chemically synthesized
ccagtagctaccgattgaacag

SEQ ID NO: 759337 - DNA, 22 bp, Artificial Sequence
  chemically synthesized
tagaactgcactgttcaatcgg

SEQ ID NO: 759338 - DNA, 22 bp, Artificial Sequence
  chemically synthesized
cactgttcaatcggtagctact

SEQ ID NO: 759339 - DNA, 22 bp, Artificial Sequence
  chemically synthesized
ttcaatcggtagctactggcaa

SEQ ID NO: 759340 - DNA, 22 bp, Artificial Sequence
  chemically synthesized
agtagccagatgttgccagtag

SEQ ID NO: 759341 - DNA, 22 bp, Artificial Sequence
  chemically synthesized
aatcggtagctactggcaacat

SEQ ID NO: 759342 - DNA, 22 bp, Artificial Sequence
  chemically synthesized
caagtactcagtagccagatgt

SEQ ID NO: 759343 - DNA, 22 bp, Artificial Sequence
  chemically synthesized
cattccaagtactcagtagcca

SEQ ID NO: 759344 - DNA, 22 bp, Artificial Sequence
  chemically synthesized
ctggcaacatctggctactgag

SEQ ID NO: 759345 - DNA, 22 bp, Artificial Sequence
  chemically synthesized
gcaacatctggctactgagtac

SEQ ID NO: 759346 - DNA, 22 bp, Artificial Sequence
  chemically synthesized
attacattccaagtactcagta

SEQ ID NO: 759347 - DNA, 22 bp, Artificial Sequence
  chemically synthesized
aggctcattacattccaagtac

SEQ ID NO: 759348 - DNA, 22 bp, Artificial Sequence
  chemically synthesized
gctactgagtacttggaatgta

SEQ ID NO: 759349 - DNA, 22 bp, Artificial Sequence
  chemically synthesized
aattcaggctcattacattcca

SEQ ID NO: 759350 - DNA, 22 bp, Artificial Sequence
  chemically synthesized
ctgagtacttggaatgtaatga

SEQ ID NO: 759351 - DNA, 22 bp, Artificial Sequence
  chemically synthesized
agtacttggaatgtaatgagcc

SEQ ID NO: 759352 - DNA, 22 bp, Artificial Sequence
  chemically synthesized
cagcacatctcaattcaggctc

SEQ ID NO: 759353 - DNA, 22 bp, Artificial Sequence
  chemically synthesized
acagcacatctcaattcaggct

SEQ ID NO: 759354 - DNA, 22 bp, Artificial Sequence
  chemically synthesized
ggaatgtaatgagcctgaattg

SEQ ID NO: 759355 - DNA, 22 bp, Artificial Sequence
  chemically synthesized
gaatgtaatgagcctgaattga

SEQ ID NO: 759356 - DNA, 22 bp, Artificial Sequence
  chemically synthesized
aattgagatgtgctgtaaatgt

SEQ ID NO: 759357 - DNA, 22 bp, Artificial Sequence
  chemically synthesized
agatgtgctgtaaatgtacatt

SEQ ID NO: 759358 - DNA, 22 bp, Artificial Sequence
  chemically synthesized
aacatgcaatcaatagaaaaaa

SEQ ID NO: 759359 - DNA, 22 bp, Artificial Sequence
  chemically synthesized
caacatgcaatcaatagaaaaa

SEQ ID NO: 759360 - DNA, 22 bp, Artificial Sequence
  chemically synthesized
taaatgtacattttttctattg

SEQ ID NO: 759361 - DNA, 22 bp, Artificial Sequence
  chemically synthesized
tcatttcaacatgcaatcaata

SEQ ID NO: 759362 - DNA, 22 bp, Artificial Sequence
  chemically synthesized
ttgtcatttcaacatgcaatca

SEQ ID NO: 759363 - DNA, 22 bp, Artificial Sequence
  chemically synthesized
attgtcatttcaacatgcaatc

SEQ ID NO: 759364 - DNA, 22 bp, Artificial Sequence
  chemically synthesized
ttattgtcatttcaacatgcaa

SEQ ID NO: 759365 - DNA, 22 bp, Artificial Sequence
  chemically synthesized
tttctattgattgcatgttgaa

SEQ ID NO: 759366 - DNA, 22 bp, Artificial Sequence
  chemically synthesized
ttctattgattgcatgttgaaa

SEQ ID NO: 759367 - DNA, 22 bp, Artificial Sequence
  chemically synthesized
tctattgattgcatgttgaaat

SEQ ID NO: 759368 - DNA, 22 bp, Artificial Sequence
  chemically synthesized
ctattgattgcatgttgaaatg

SEQ ID NO: 759369 - DNA, 22 bp, Artificial Sequence
  chemically synthesized
tattgattgcatgttgaaatga

SEQ ID NO: 759370 - DNA, 22 bp, Artificial Sequence
  chemically synthesized
ttgattgcatgttgaaatgaca

SEQ ID NO: 759371 - DNA, 22 bp, Artificial Sequence
  chemically synthesized
attgcatgttgaaatgacaata

SEQ ID NO: 759372 - DNA, 22 bp, Artificial Sequence
  chemically synthesized
tagtacaattcttattgtcatt

SEQ ID NO: 759373 - DNA, 22 bp, Artificial Sequence
  chemically synthesized
catgttgaaatgacaataagaa

SEQ ID NO: 759374 - DNA, 22 bp, Artificial Sequence
  chemically synthesized
aaatgacaataagaattgtact

SEQ ID NO: 759375 - DNA, 22 bp, Artificial Sequence
  chemically synthesized
tatgtcatgcaactgtagtaca

SEQ ID NO: 759376 - DNA, 22 bp, Artificial Sequence
  chemically synthesized
atcattatatgtcatgcaactg

SEQ ID NO: 759377 - DNA, 22 bp, Artificial Sequence
  chemically synthesized
catcattatatgtcatgcaact

SEQ ID NO: 759378 - DNA, 22 bp, Artificial Sequence
  chemically synthesized
tcatcattatatgtcatgcaac

SEQ ID NO: 759379 - DNA, 22 bp, Artificial Sequence
  chemically synthesized
ttcatcattatatgtcatgcaa

SEQ ID NO: 759380 - DNA, 22 bp, Artificial Sequence
  chemically synthesized
ttttcatcattatatgtcatgc

SEQ ID NO: 759381 - DNA, 22 bp, Artificial Sequence
  chemically synthesized
cttttcatcattatatgtcatg

SEQ ID NO: 759382 - DNA, 22 bp, Artificial Sequence
  chemically synthesized
tactacagttgcatgacatata

SEQ ID NO: 759383 - DNA, 22 bp, Artificial Sequence
  chemically synthesized
tttcttttcatcattatatgtc

SEQ ID NO: 759384 - DNA, 22 bp, Artificial Sequence
  chemically synthesized
cagttgcatgacatataatgat

SEQ ID NO: 759385 - DNA, 22 bp, Artificial Sequence
  chemically synthesized
accctgtttcttttcatcatta

SEQ ID NO: 759386 - DNA, 22 bp, Artificial Sequence
  chemically synthesized
caccctgtttcttttcatcatt

SEQ ID NO: 759387 - DNA, 22 bp, Artificial Sequence
  chemically synthesized
tcaccctgtttcttttcatcat

SEQ ID NO: 759388 - DNA, 22 bp, Artificial Sequence
  chemically synthesized
catgacatataatgatgaaaag

SEQ ID NO: 759389 - DNA, 22 bp, Artificial Sequence
  chemically synthesized
tatctttcaccctgtttctttt

SEQ ID NO: 759390 - DNA, 22 bp, Artificial Sequence
  chemically synthesized
cctgtatctttcaccctgtttc

SEQ ID NO: 759391 - DNA, 22 bp, Artificial Sequence
  chemically synthesized
ccctgtatctttcaccctgttt

SEQ ID NO: 759392 - DNA, 22 bp, Artificial Sequence
  chemically synthesized
aaatagaatagtttccctgtat

SEQ ID NO: 759393 - DNA, 22 bp, Artificial Sequence
  chemically synthesized
taaaatagaatagtttccctgt

SEQ ID NO: 759394 - DNA, 22 bp, Artificial Sequence
  chemically synthesized
ctaaaatagaatagtttccctg

SEQ ID NO: 759395 - DNA, 22 bp, Artificial Sequence
  chemically synthesized
acagtaagtttctaaaatagaa

SEQ ID NO: 759396 - DNA, 22 bp, Artificial Sequence
  chemically synthesized
cagattcacagtaagtttctaa

SEQ ID NO: 759397 - DNA, 22 bp, Artificial Sequence
  chemically synthesized
ttctattttagaaacttactgt

SEQ ID NO: 759398 - DNA, 22 bp, Artificial Sequence
  chemically synthesized
tattttagaaacttactgtgaa

SEQ ID NO: 759399 - DNA, 22 bp, Artificial Sequence
  chemically synthesized
ttttagaaacttactgtgaatc

SEQ ID NO: 759400 - DNA, 22 bp, Artificial Sequence
  chemically synthesized
gaagtaattacagattcacagt

SEQ ID NO: 759401 - DNA, 22 bp, Artificial Sequence
  chemically synthesized
ggaagtaattacagattcacag

SEQ ID NO: 759402 - DNA, 22 bp, Artificial Sequence
  chemically synthesized
tagaaacttactgtgaatctgt

SEQ ID NO: 759403 - DNA, 22 bp, Artificial Sequence
  chemically synthesized
agaaacttactgtgaatctgta

SEQ ID NO: 759404 - DNA, 22 bp, Artificial Sequence
  chemically synthesized
tttggaagtaattacagattca

SEQ ID NO: 759405 - DNA, 22 bp, Artificial Sequence
  chemically synthesized
gaaacttactgtgaatctgtaa

SEQ ID NO: 759406 - DNA, 22 bp, Artificial Sequence
  chemically synthesized
gtttggaagtaattacagattc

SEQ ID NO: 759407 - DNA, 22 bp, Artificial Sequence
  chemically synthesized
tgtttggaagtaattacagatt

SEQ ID NO: 759408 - DNA, 22 bp, Artificial Sequence
  chemically synthesized
ttgtttggaagtaattacagat

SEQ ID NO: 759409 - DNA, 22 bp, Artificial Sequence
  chemically synthesized
tttgtttggaagtaattacaga

SEQ ID NO: 759410 - DNA, 22 bp, Artificial Sequence
  chemically synthesized
ctttttgtttggaagtaattac

SEQ ID NO: 759411 - DNA, 22 bp, Artificial Sequence
  chemically synthesized
actgtgaatctgtaattacttc

SEQ ID NO: 759412 - DNA, 22 bp, Artificial Sequence
  chemically synthesized
ctgtgaatctgtaattacttcc

SEQ ID NO: 759413 - DNA, 22 bp, Artificial Sequence
  chemically synthesized
ttactttttgtttggaagtaat

SEQ ID NO: 759414 - DNA, 22 bp, Artificial Sequence
  chemically synthesized
attactttttgtttggaagtaa

SEQ ID NO: 759415 - DNA, 22 bp, Artificial Sequence
  chemically synthesized
tgaatctgtaattacttccaaa

SEQ ID NO: 759416 - DNA, 22 bp, Artificial Sequence
  chemically synthesized
tattactttttgtttggaagta

SEQ ID NO: 759417 - DNA, 22 bp, Artificial Sequence
  chemically synthesized
ttattactttttgtttggaagt

SEQ ID NO: 759418 - DNA, 22 bp, Artificial Sequence
  chemically synthesized
tttattactttttgtttggaag

SEQ ID NO: 759419 - DNA, 22 bp, Artificial Sequence
  chemically synthesized
gtctttttattactttttgttt

SEQ ID NO: 759420 - DNA, 22 bp, Artificial Sequence
  chemically synthesized
taattacttccaaacaaaaagt

SEQ ID NO: 759421 - DNA, 22 bp, Artificial Sequence
  chemically synthesized
gttggtctttttattacttttt

SEQ ID NO: 759422 - DNA, 22 bp, Artificial Sequence
  chemically synthesized
cttccaaacaaaaagtaataaa

SEQ ID NO: 759423 - DNA, 22 bp, Artificial Sequence
  chemically synthesized
gttagttggtctttttattact

SEQ ID NO: 759424 - DNA, 22 bp, Artificial Sequence
  chemically synthesized
ggttagttggtctttttattac

SEQ ID NO: 759425 - DNA, 22 bp, Artificial Sequence
  chemically synthesized
ccaaacaaaaagtaataaaaag

SEQ ID NO: 759426 - DNA, 22 bp, Artificial Sequence
  chemically synthesized
tggttagttggtctttttatta

SEQ ID NO: 759427 - DNA, 22 bp, Artificial Sequence
  chemically synthesized
caaacaaaaagtaataaaaaga

SEQ ID NO: 759428 - DNA, 22 bp, Artificial Sequence
  chemically synthesized
ctttggttagttggtcttttta

SEQ ID NO: 759429 - DNA, 22 bp, Artificial Sequence
  chemically synthesized
actttggttagttggtcttttt

SEQ ID NO: 759430 - DNA, 22 bp, Artificial Sequence
  chemically synthesized
aaatcagacccacaccttactt

SEQ ID NO: 759431 - DNA, 22 bp, Artificial Sequence
  chemically synthesized
accaaagtaaggtgtgggtctg

SEQ ID NO: 759432 - DNA, 22 bp, Artificial Sequence
  chemically synthesized
aataaaaattgaaatcagaccc

SEQ ID NO: 759433 - DNA, 22 bp, Artificial Sequence
  chemically synthesized
aaataaaaattgaaatcagacc

SEQ ID NO: 759434 - DNA, 22 bp, Artificial Sequence
  chemically synthesized
gtttaaataaaaattgaaatca

SEQ ID NO: 759435 - DNA, 22 bp, Artificial Sequence
  chemically synthesized
ggtttaaataaaaattgaaatc

SEQ ID NO: 759436 - DNA, 22 bp, Artificial Sequence
  chemically synthesized
tggtttaaataaaaattgaaat

SEQ ID NO: 759437 - DNA, 22 bp, Artificial Sequence
  chemically synthesized
gttttggtttaaataaaaattg

SEQ ID NO: 759438 - DNA, 22 bp, Artificial Sequence
  chemically synthesized
tggttttggtttaaataaaaat

SEQ ID NO: 759439 - DNA, 22 bp, Artificial Sequence
  chemically synthesized
ctggttttggtttaaataaaaa

SEQ ID NO: 759440 - DNA, 22 bp, Artificial Sequence
  chemically synthesized
tctggttttggtttaaataaaa

SEQ ID NO: 759441 - DNA, 22 bp, Artificial Sequence
  chemically synthesized
ttctggttttggtttaaataaa

SEQ ID NO: 759442 - DNA, 22 bp, Artificial Sequence
  chemically synthesized
tttctggttttggtttaaataa

SEQ ID NO: 759443 - DNA, 22 bp, Artificial Sequence
  chemically synthesized
atttcaatttttatttaaacca

SEQ ID NO: 759444 - DNA, 22 bp, Artificial Sequence
  chemically synthesized
aactttttctggttttggttta

SEQ ID NO: 759445 - DNA, 22 bp, Artificial Sequence
  chemically synthesized
caatttttatttaaaccaaaac

SEQ ID NO: 759446 - DNA, 22 bp, Artificial Sequence
  chemically synthesized
aaactttttctggttttggttt

SEQ ID NO: 759447 - DNA, 22 bp, Artificial Sequence
  chemically synthesized
aatttttatttaaaccaaaacc

SEQ ID NO: 759448 - DNA, 22 bp, Artificial Sequence
  chemically synthesized
taaactttttctggttttggtt

SEQ ID NO: 759449 - DNA, 22 bp, Artificial Sequence
  chemically synthesized
ttaaactttttctggttttggt

SEQ ID NO: 759450 - DNA, 22 bp, Artificial Sequence
  chemically synthesized
tttaaactttttctggttttgg

SEQ ID NO: 759451 - DNA, 22 bp, Artificial Sequence
  chemically synthesized
ttatttaaaccaaaaccagaaa

SEQ ID NO: 759452 - DNA, 22 bp, Artificial Sequence
  chemically synthesized
tatttaaaccaaaaccagaaaa

SEQ ID NO: 759453 - DNA, 22 bp, Artificial Sequence
  chemically synthesized
atttaaaccaaaaccagaaaaa

SEQ ID NO: 759454 - DNA, 22 bp, Artificial Sequence
  chemically synthesized
tttaaaccaaaaccagaaaaag

SEQ ID NO: 759455 - DNA, 22 bp, Artificial Sequence
  chemically synthesized
tgcattttttaaactttttctg

SEQ ID NO: 759456 - DNA, 22 bp, Artificial Sequence
  chemically synthesized
aaaccaaaaccagaaaaagttt

SEQ ID NO: 759457 - DNA, 22 bp, Artificial Sequence
  chemically synthesized
aaccaaaaccagaaaaagttta

SEQ ID NO: 759458 - DNA, 22 bp, Artificial Sequence
  chemically synthesized
atacatattatgcattttttaa

SEQ ID NO: 759459 - DNA, 22 bp, Artificial Sequence
  chemically synthesized
tcatacatattatgcatttttt

SEQ ID NO: 759460 - DNA, 22 bp, Artificial Sequence
  chemically synthesized
ctcatacatattatgcattttt

SEQ ID NO: 759461 - DNA, 22 bp, Artificial Sequence
  chemically synthesized
tctcatacatattatgcatttt

SEQ ID NO: 759462 - DNA, 22 bp, Artificial Sequence
  chemically synthesized
ttctcatacatattatgcattt

SEQ ID NO: 759463 - DNA, 22 bp, Artificial Sequence
  chemically synthesized
catttttctcatacatattatg

SEQ ID NO: 759464 - DNA, 22 bp, Artificial Sequence
  chemically synthesized
ccatttttctcatacatattat

SEQ ID NO: 759465 - DNA, 22 bp, Artificial Sequence
  chemically synthesized
aaaaaatgcataatatgtatga

SEQ ID NO: 759466 - DNA, 22 bp, Artificial Sequence
  chemically synthesized
aaaaatgcataatatgtatgag

SEQ ID NO: 759467 - DNA, 22 bp, Artificial Sequence
  chemically synthesized
aaatttccatttttctcataca

SEQ ID NO: 759468 - DNA, 22 bp, Artificial Sequence
  chemically synthesized
atcatatcaaatatccagtcca

SEQ ID NO: 759469 - DNA, 22 bp, Artificial Sequence
  chemically synthesized
catcatatcaaatatccagtcc

SEQ ID NO: 759470 - DNA, 22 bp, Artificial Sequence
  chemically synthesized
gaatatggactggatatttgat

SEQ ID NO: 759471 - DNA, 22 bp, Artificial Sequence
  chemically synthesized
aatatggactggatatttgata

SEQ ID NO: 759472 - DNA, 22 bp, Artificial Sequence
  chemically synthesized
aaatatcaataatttcatcata

SEQ ID NO: 759473 - DNA, 22 bp, Artificial Sequence
  chemically synthesized
gaaatatcaataatttcatcat

SEQ ID NO: 759474 - DNA, 22 bp, Artificial Sequence
  chemically synthesized
tgaaatatcaataatttcatca

SEQ ID NO: 759475 - DNA, 22 bp, Artificial Sequence
  chemically synthesized
gatatttgatatgatgaaatta

SEQ ID NO: 759476 - DNA, 22 bp, Artificial Sequence
  chemically synthesized
ttgaaatatcaataatttcatc

SEQ ID NO: 759477 - DNA, 22 bp, Artificial Sequence
  chemically synthesized
gatatgatgaaattattgatat

SEQ ID NO: 759478 - DNA, 22 bp, Artificial Sequence
  chemically synthesized
atatgatgaaattattgatatt

SEQ ID NO: 759479 - DNA, 22 bp, Artificial Sequence
  chemically synthesized
taatgcttttgaaatatcaata

SEQ ID NO: 759480 - DNA, 22 bp, Artificial Sequence
  chemically synthesized
ctataatgcttttgaaatatca

SEQ ID NO: 759481 - DNA, 22 bp, Artificial Sequence
  chemically synthesized
ctactataatgcttttgaaata

SEQ ID NO: 759482 - DNA, 22 bp, Artificial Sequence
  chemically synthesized
gctactataatgcttttgaaat

SEQ ID NO: 759483 - DNA, 22 bp, Artificial Sequence
  chemically synthesized
ttgatatttcaaaagcattata

SEQ ID NO: 759484 - DNA, 22 bp, Artificial Sequence
  chemically synthesized
atatttcaaaagcattatagta

SEQ ID NO: 759485 - DNA, 22 bp, Artificial Sequence
  chemically synthesized
aggtaatcaccttgctactata

SEQ ID NO: 759486 - DNA, 22 bp, Artificial Sequence
  chemically synthesized
aaggtaatcaccttgctactat

SEQ ID NO: 759487 - DNA, 22 bp, Artificial Sequence
  chemically synthesized
taaggtaatcaccttgctacta

SEQ ID NO: 759488 - DNA, 22 bp, Artificial Sequence
  chemically synthesized
caaaagcattatagtagcaagg

SEQ ID NO: 759489 - DNA, 22 bp, Artificial Sequence
  chemically synthesized
ttaaggtaatcaccttgctact

SEQ ID NO: 759490 - DNA, 22 bp, Artificial Sequence
  chemically synthesized
aaaagcattatagtagcaaggt

SEQ ID NO: 759491 - DNA, 22 bp, Artificial Sequence
  chemically synthesized
ttttaaggtaatcaccttgcta

SEQ ID NO: 759492 - DNA, 22 bp, Artificial Sequence
  chemically synthesized
actcttttaaggtaatcacctt

SEQ ID NO: 759493 - DNA, 22 bp, Artificial Sequence
  chemically synthesized
tagtagcaaggtgattacctta

SEQ ID NO: 759494 - DNA, 22 bp, Artificial Sequence
  chemically synthesized
aaagataggattcactctttta

SEQ ID NO: 759495 - DNA, 22 bp, Artificial Sequence
  chemically synthesized
ccttaaaagagtgaatcctatc

SEQ ID NO: 759496 - DNA, 22 bp, Artificial Sequence
  chemically synthesized
aaaaggttaaaagataggattc

SEQ ID NO: 759497 - DNA, 22 bp, Artificial Sequence
  chemically synthesized
caaaaggttaaaagataggatt

SEQ ID NO: 759498 - DNA, 22 bp, Artificial Sequence
  chemically synthesized
aaaagagtgaatcctatctttt

SEQ ID NO: 759499 - DNA, 22 bp, Artificial Sequence
  chemically synthesized
aaagagtgaatcctatctttta

SEQ ID NO: 759500 - DNA, 22 bp, Artificial Sequence
  chemically synthesized
atatttcaaaaggttaaaagat

SEQ ID NO: 759501 - DNA, 22 bp, Artificial Sequence
  chemically synthesized
ttaatatttcaaaaggttaaaa

SEQ ID NO: 759502 - DNA, 22 bp, Artificial Sequence
  chemically synthesized
ttgttaatatttcaaaaggtta

SEQ ID NO: 759503 - DNA, 22 bp, Artificial Sequence
  chemically synthesized
attgttaatatttcaaaaggtt

SEQ ID NO: 759504 - DNA, 22 bp, Artificial Sequence
  chemically synthesized
tattgttaatatttcaaaaggt

SEQ ID NO: 759505 - DNA, 22 bp, Artificial Sequence
  chemically synthesized
ttttattgttaatatttcaaaa

SEQ ID NO: 759506 - DNA, 22 bp, Artificial Sequence
  chemically synthesized
tcttttaaccttttgaaatatt

SEQ ID NO: 759507 - DNA, 22 bp, Artificial Sequence
  chemically synthesized
ttaaccttttgaaatattaaca

SEQ ID NO: 759508 - DNA, 22 bp, Artificial Sequence
  chemically synthesized
taaccttttgaaatattaacaa

SEQ ID NO: 759509 - DNA, 22 bp, Artificial Sequence
  chemically synthesized
aaccttttgaaatattaacaat

SEQ ID NO: 759510 - DNA, 22 bp, Artificial Sequence
  chemically synthesized
accttttgaaatattaacaata

SEQ ID NO: 759511 - DNA, 22 bp, Artificial Sequence
  chemically synthesized
ttgaaatattaacaataaaata

SEQ ID NO: 759512 - DNA, 22 bp, Artificial Sequence
  chemically synthesized
tgaaatattaacaataaaataa

SEQ ID NO: 759513 - DNA, 22 bp, Artificial Sequence
  chemically synthesized
gaaatattaacaataaaataac

SEQ ID NO: 759514 - DNA, 22 bp, Artificial Sequence
  chemically synthesized
aaatattaacaataaaataaca

SEQ ID NO: 759515 - DNA, 22 bp, Artificial Sequence
  chemically synthesized
aaacaaatatcaggcgtgtgtt

SEQ ID NO: 759516 - DNA, 22 bp, Artificial Sequence
  chemically synthesized
aaaacaaatatcaggcgtgtgt

SEQ ID NO: 759517 - DNA, 22 bp, Artificial Sequence
  chemically synthesized
acaataaaataacacacgcctg

SEQ ID NO: 759518 - DNA, 22 bp, Artificial Sequence
  chemically synthesized
taaaacaaatatcaggcgtgtg

SEQ ID NO: 759519 - DNA, 22 bp, Artificial Sequence
  chemically synthesized
ttttaaaacaaatatcaggcgt

SEQ ID NO: 759520 - DNA, 22 bp, Artificial Sequence
  chemically synthesized
ccagattgttttaaaacaaata

SEQ ID NO: 759521 - DNA, 22 bp, Artificial Sequence
  chemically synthesized
cccagattgttttaaaacaaat

SEQ ID NO: 759522 - DNA, 22 bp, Artificial Sequence
  chemically synthesized
ttcccagattgttttaaaacaa

SEQ ID NO: 759523 - DNA, 22 bp, Artificial Sequence
  chemically synthesized
tagctcttcccagattgtttta

SEQ ID NO: 759524 - DNA, 22 bp, Artificial Sequence
  chemically synthesized
atatttgttttaaaacaatctg

SEQ ID NO: 759525 - DNA, 22 bp, Artificial Sequence
  chemically synthesized
tatagctcttcccagattgttt

SEQ ID NO: 759526 - DNA, 22 bp, Artificial Sequence
  chemically synthesized
ttctatagctcttcccagattg

SEQ ID NO: 759527 - DNA, 22 bp, Artificial Sequence
  chemically synthesized
attctatagctcttcccagatt

SEQ ID NO: 759528 - DNA, 22 bp, Artificial Sequence
  chemically synthesized
gttttaaaacaatctgggaaga

SEQ ID NO: 759529 - DNA, 22 bp, Artificial Sequence
  chemically synthesized
ttttaaaacaatctgggaagag

SEQ ID NO: 759530 - DNA, 22 bp, Artificial Sequence
  chemically synthesized
tttattctatagctcttcccag

SEQ ID NO: 759531 - DNA, 22 bp, Artificial Sequence
  chemically synthesized
atttattctatagctcttccca

SEQ ID NO: 759532 - DNA, 22 bp, Artificial Sequence
  chemically synthesized
taaaacaatctgggaagagcta

SEQ ID NO: 759533 - DNA, 22 bp, Artificial Sequence
  chemically synthesized
aaaacaatctgggaagagctat

SEQ ID NO: 759534 - DNA, 22 bp, Artificial Sequence
  chemically synthesized
aaacaatctgggaagagctata

SEQ ID NO: 759535 - DNA, 22 bp, Artificial Sequence
  chemically synthesized
ggaagagctatagaataaataa

SEQ ID NO: 759536 - DNA, 22 bp, Artificial Sequence
  chemically synthesized
tcaaatcacgtcagatcttatt

SEQ ID NO: 759537 - DNA, 22 bp, Artificial Sequence
  chemically synthesized
tagaataaataagatctgacgt

SEQ ID NO: 759538 - DNA, 22 bp, Artificial Sequence
  chemically synthesized
atcaagacatcaacaattatca

SEQ ID NO: 759539 - DNA, 22 bp, Artificial Sequence
  chemically synthesized
acgtgatttgataattgttgat

SEQ ID NO: 759540 - DNA, 22 bp, Artificial Sequence
  chemically synthesized
gtactcatcaagacatcaacaa

SEQ ID NO: 759541 - DNA, 22 bp, Artificial Sequence
  chemically synthesized
gataattgttgatgtcttgatg

SEQ ID NO: 759542 - DNA, 22 bp, Artificial Sequence
  chemically synthesized
ataattgttgatgtcttgatga

SEQ ID NO: 759543 - DNA, 22 bp, Artificial Sequence
  chemically synthesized
taataaaactcgtactcatcaa

SEQ ID NO: 759544 - DNA, 22 bp, Artificial Sequence
  chemically synthesized
ttgatgtcttgatgagtacgag

SEQ ID NO: 759545 - DNA, 22 bp, Artificial Sequence
  chemically synthesized
atgtcttgatgagtacgagttt

SEQ ID NO: 759546 - DNA, 22 bp, Artificial Sequence
  chemically synthesized
gatgagtacgagttttattata

SEQ ID NO: 759547 - DNA, 22 bp, Artificial Sequence
  chemically synthesized
atgagtacgagttttattatag

SEQ ID NO: 759548 - DNA, 22 bp, Artificial Sequence
  chemically synthesized
aacatatacaaaagtagacaga

SEQ ID NO: 759549 - DNA, 22 bp, Artificial Sequence
  chemically synthesized
tattatagcattctgtctactt

SEQ ID NO: 759550 - DNA, 22 bp, Artificial Sequence
  chemically synthesized
attatagcattctgtctacttt

SEQ ID NO: 759551 - DNA, 22 bp, Artificial Sequence
  chemically synthesized
ttatagcattctgtctactttt

SEQ ID NO: 759552 - DNA, 22 bp, Artificial Sequence
  chemically synthesized
tagcattctgtctacttttgta

SEQ ID NO: 759553 - DNA, 22 bp, Artificial Sequence
  chemically synthesized
tgtctacttttgtatatgttca

SEQ ID NO: 759554 - DNA, 22 bp, Artificial Sequence
  chemically synthesized
tctacttttgtatatgttcaat

SEQ ID NO: 759555 - DNA, 22 bp, Artificial Sequence
  chemically synthesized
atgatgaaaaatattgaacata

SEQ ID NO: 759556 - DNA, 22 bp, Artificial Sequence
  chemically synthesized
catgatgaaaaatattgaacat

SEQ ID NO: 759557 - DNA, 22 bp, Artificial Sequence
  chemically synthesized
tcatgatgaaaaatattgaaca

SEQ ID NO: 759558 - DNA, 22 bp, Artificial Sequence
  chemically synthesized
ttcatgatgaaaaatattgaac

SEQ ID NO: 759559 - DNA, 22 bp, Artificial Sequence
  chemically synthesized
cttttgtatatgttcaatattt

SEQ ID NO: 759560 - DNA, 22 bp, Artificial Sequence
  chemically synthesized
ttgtatatgttcaatatttttc

SEQ ID NO: 759561 - DNA, 22 bp, Artificial Sequence
  chemically synthesized
tgtatatgttcaatatttttca

SEQ ID NO: 759562 - DNA, 22 bp, Artificial Sequence
  chemically synthesized
gtatatgttcaatatttttcat

SEQ ID NO: 759563 - DNA, 22 bp, Artificial Sequence
  chemically synthesized
tatatgttcaatatttttcatc

SEQ ID NO: 759564 - DNA, 22 bp, Artificial Sequence
  chemically synthesized
tataaaaaaaagcttttcatga

SEQ ID NO: 759565 - DNA, 22 bp, Artificial Sequence
  chemically synthesized
aatatttttcatcatgaaaagc

SEQ ID NO: 759566 - DNA, 22 bp, Artificial Sequence
  chemically synthesized
gctatataaaaaaaagcttttc

SEQ ID NO: 759567 - DNA, 22 bp, Artificial Sequence
  chemically synthesized
ggctatataaaaaaaagctttt

SEQ ID NO: 759568 - DNA, 22 bp, Artificial Sequence
  chemically synthesized
tggctatataaaaaaaagcttt

SEQ ID NO: 759569 - DNA, 22 bp, Artificial Sequence
  chemically synthesized
ttggctatataaaaaaaagctt

SEQ ID NO: 759570 - DNA, 22 bp, Artificial Sequence
  chemically synthesized
ttcatcatgaaaagcttttttt

SEQ ID NO: 759571 - DNA, 22 bp, Artificial Sequence
  chemically synthesized
tcatcatgaaaagctttttttt

SEQ ID NO: 759572 - DNA, 22 bp, Artificial Sequence
  chemically synthesized
ttttggctatataaaaaaaagc

SEQ ID NO: 759573 - DNA, 22 bp, Artificial Sequence
  chemically synthesized
catcatgaaaagctttttttta

SEQ ID NO: 759574 - DNA, 22 bp, Artificial Sequence
  chemically synthesized
atcatgaaaagcttttttttat

SEQ ID NO: 759575 - DNA, 22 bp, Artificial Sequence
  chemically synthesized
ttttttatatagccaaaagaga

SEQ ID NO: 759576 - DNA, 22 bp, Artificial Sequence
  chemically synthesized
agaaatcgtccatctcttttgg

SEQ ID NO: 759577 - DNA, 22 bp, Artificial Sequence
  chemically synthesized
tttttatatagccaaaagagat

SEQ ID NO: 759578 - DNA, 22 bp, Artificial Sequence
  chemically synthesized
aagaaatcgtccatctcttttg

SEQ ID NO: 759579 - DNA, 22 bp, Artificial Sequence
  chemically synthesized
ttttatatagccaaaagagatg

SEQ ID NO: 759580 - DNA, 22 bp, Artificial Sequence
  chemically synthesized
taagaaatcgtccatctctttt

SEQ ID NO: 759581 - DNA, 22 bp, Artificial Sequence
  chemically synthesized
tttatatagccaaaagagatgg

SEQ ID NO: 759582 - DNA, 22 bp, Artificial Sequence
  chemically synthesized
ttatatagccaaaagagatgga

SEQ ID NO: 759583 - DNA, 22 bp, Artificial Sequence
  chemically synthesized
tatatagccaaaagagatggac

SEQ ID NO: 759584 - DNA, 22 bp, Artificial Sequence
  chemically synthesized
atatagccaaaagagatggacg

SEQ ID NO: 759585 - DNA, 22 bp, Artificial Sequence
  chemically synthesized
tatagccaaaagagatggacga

SEQ ID NO: 759586 - DNA, 22 bp, Artificial Sequence
  chemically synthesized
ataataccctttaagaaatcgt

SEQ ID NO: 759587 - DNA, 22 bp, Artificial Sequence
  chemically synthesized
tgttaataataccctttaagaa

SEQ ID NO: 759588 - DNA, 22 bp, Artificial Sequence
  chemically synthesized
gtgttaataataccctttaaga

SEQ ID NO: 759589 - DNA, 22 bp, Artificial Sequence
  chemically synthesized
cttaaagggtattattaacaca

SEQ ID NO: 759590 - DNA, 22 bp, Artificial Sequence
  chemically synthesized
ttaaagggtattattaacacaa

SEQ ID NO: 759591 - DNA, 22 bp, Artificial Sequence
  chemically synthesized
aaagggtattattaacacaaat

SEQ ID NO: 759592 - DNA, 22 bp, Artificial Sequence
  chemically synthesized
aagggtattattaacacaaatg

SEQ ID NO: 759593 - DNA, 22 bp, Artificial Sequence
  chemically synthesized
taaatgtcaaacacatttgtgt

SEQ ID NO: 759594 - DNA, 22 bp, Artificial Sequence
  chemically synthesized
cactgtaaatgtcaaacacatt

SEQ ID NO: 759595 - DNA, 22 bp, Artificial Sequence
  chemically synthesized
ttaacacaaatgtgtttgacat

SEQ ID NO: 759596 - DNA, 22 bp, Artificial Sequence
  chemically synthesized
acacaaatgtgtttgacattta

SEQ ID NO: 759597 - DNA, 22 bp, Artificial Sequence
  chemically synthesized
agccattacactgtaaatgtca

SEQ ID NO: 759598 - DNA, 22 bp, Artificial Sequence
  chemically synthesized
taaataatctaagccattacac

SEQ ID NO: 759599 - DNA, 22 bp, Artificial Sequence
  chemically synthesized
gacatttacagtgtaatggctt

SEQ ID NO: 759600 - DNA, 22 bp, Artificial Sequence
  chemically synthesized
acatttacagtgtaatggctta

SEQ ID NO: 759601 - DNA, 22 bp, Artificial Sequence
  chemically synthesized
acagtgtaatggcttagattat

SEQ ID NO: 759602 - DNA, 22 bp, Artificial Sequence
  chemically synthesized
cagtgtaatggcttagattatt

SEQ ID NO: 759603 - DNA, 22 bp, Artificial Sequence
  chemically synthesized
acccaagggtcaattataaata

SEQ ID NO: 759604 - DNA, 22 bp, Artificial Sequence
  chemically synthesized
tcacccaagggtcaattataaa

SEQ ID NO: 759605 - DNA, 22 bp, Artificial Sequence
  chemically synthesized
ctcacccaagggtcaattataa

SEQ ID NO: 759606 - DNA, 22 bp, Artificial Sequence
  chemically synthesized
ttctcacccaagggtcaattat

SEQ ID NO: 759607 - DNA, 22 bp, Artificial Sequence
  chemically synthesized
agattatttataattgaccctt

SEQ ID NO: 759608 - DNA, 22 bp, Artificial Sequence
  chemically synthesized
ctcttctcacccaagggtcaat

SEQ ID NO: 759609 - DNA, 22 bp, Artificial Sequence
  chemically synthesized
gattatttataattgacccttg

SEQ ID NO: 759610 - DNA, 22 bp, Artificial Sequence
  chemically synthesized
actcttctcacccaagggtcaa

SEQ ID NO: 759611 - DNA, 22 bp, Artificial Sequence
  chemically synthesized
tactcttctcacccaagggtca

SEQ ID NO: 759612 - DNA, 22 bp, Artificial Sequence
  chemically synthesized
ttactcttctcacccaagggtc

SEQ ID NO: 759613 - DNA, 22 bp, Artificial Sequence
  chemically synthesized
tttactcttctcacccaagggt

SEQ ID NO: 759614 - DNA, 22 bp, Artificial Sequence
  chemically synthesized
ttttactcttctcacccaaggg

SEQ ID NO: 759615 - DNA, 22 bp, Artificial Sequence
  chemically synthesized
tttataattgacccttgggtga

SEQ ID NO: 759616 - DNA, 22 bp, Artificial Sequence
  chemically synthesized
ataattgacccttgggtgagaa

SEQ ID NO: 759617 - DNA, 22 bp, Artificial Sequence
  chemically synthesized
taattgacccttgggtgagaag

SEQ ID NO: 759618 - DNA, 22 bp, Artificial Sequence
  chemically synthesized
acccttgggtgagaagagtaaa

SEQ ID NO: 759619 - DNA, 22 bp, Artificial Sequence
  chemically synthesized
aatagaaatcttttttactctt

SEQ ID NO: 759620 - DNA, 22 bp, Artificial Sequence
  chemically synthesized
gggtgagaagagtaaaaaagat

SEQ ID NO: 759621 - DNA, 22 bp, Artificial Sequence
  chemically synthesized
agttgaatagaaatctttttta

SEQ ID NO: 759622 - DNA, 22 bp, Artificial Sequence
  chemically synthesized
ggtgagaagagtaaaaaagatt

SEQ ID NO: 759623 - DNA, 22 bp, Artificial Sequence
  chemically synthesized
aaattaagttgaatagaaatct

SEQ ID NO: 759624 - DNA, 22 bp, Artificial Sequence
  chemically synthesized
gaaattaagttgaatagaaatc

SEQ ID NO: 759625 - DNA, 22 bp, Artificial Sequence
  chemically synthesized
tttgaaattaagttgaatagaa

SEQ ID NO: 759626 - DNA, 22 bp, Artificial Sequence
  chemically synthesized
gtttgaaattaagttgaataga

SEQ ID NO: 759627 - DNA, 22 bp, Artificial Sequence
  chemically synthesized
tgtttgaaattaagttgaatag

SEQ ID NO: 759628 - DNA, 22 bp, Artificial Sequence
  chemically synthesized
attttgtttgaaattaagttga

SEQ ID NO: 759629 - DNA, 22 bp, Artificial Sequence
  chemically synthesized
aaattaattttgtttgaaatta

SEQ ID NO: 759630 - DNA, 22 bp, Artificial Sequence
  chemically synthesized
aaaattaattttgtttgaaatt

SEQ ID NO: 759631 - DNA, 22 bp, Artificial Sequence
  chemically synthesized
ctattcaacttaatttcaaaca

SEQ ID NO: 759632 - DNA, 22 bp, Artificial Sequence
  chemically synthesized
taaaattaattttgtttgaaat

SEQ ID NO: 759633 - DNA, 22 bp, Artificial Sequence
  chemically synthesized
tattcaacttaatttcaaacaa

SEQ ID NO: 759634 - DNA, 22 bp, Artificial Sequence
  chemically synthesized
ttcaacttaatttcaaacaaaa

SEQ ID NO: 759635 - DNA, 22 bp, Artificial Sequence
  chemically synthesized
ttttaaaattaattttgtttga

SEQ ID NO: 759636 - DNA, 22 bp, Artificial Sequence
  chemically synthesized
aacttaatttcaaacaaaatta

SEQ ID NO: 759637 - DNA, 22 bp, Artificial Sequence
  chemically synthesized
aatttcaaacaaaattaatttt

SEQ ID NO: 759638 - DNA, 22 bp, Artificial Sequence
  chemically synthesized
atttcaaacaaaattaatttta

SEQ ID NO: 759639 - DNA, 22 bp, Artificial Sequence
  chemically synthesized
caaacaaaattaattttaaaat

SEQ ID NO: 759640 - DNA, 22 bp, Artificial Sequence
  chemically synthesized
aaacaaaattaattttaaaata

SEQ ID NO: 759641 - DNA, 22 bp, Artificial Sequence
  chemically synthesized
agcacatagtaatccagtgact

SEQ ID NO: 759642 - DNA, 22 bp, Artificial Sequence
  chemically synthesized
attttaaaatagtcactggatt

SEQ ID NO: 759643 - DNA, 22 bp, Artificial Sequence
  chemically synthesized
taaaatagtcactggattacta

SEQ ID NO: 759644 - DNA, 22 bp, Artificial Sequence
  chemically synthesized
aaaatagtcactggattactat

SEQ ID NO: 759645 - DNA, 22 bp, Artificial Sequence
  chemically synthesized
aaatagtcactggattactatg

SEQ ID NO: 759646 - DNA, 22 bp, Artificial Sequence
  chemically synthesized
cacatgttaagcacatagtaat

SEQ ID NO: 759647 - DNA, 22 bp, Artificial Sequence
  chemically synthesized
gcacatgttaagcacatagtaa

SEQ ID NO: 759648 - DNA, 22 bp, Artificial Sequence
  chemically synthesized
gtgccttgcacatgttaagcac

SEQ ID NO: 759649 - DNA, 22 bp, Artificial Sequence
  chemically synthesized
gattactatgtgcttaacatgt

SEQ ID NO: 759650 - DNA, 22 bp, Artificial Sequence
  chemically synthesized
agcctcgtgccttgcacatgtt

SEQ ID NO: 759651 - DNA, 22 bp, Artificial Sequence
  chemically synthesized
aagcctcgtgccttgcacatgt

SEQ ID NO: 759652 - DNA, 22 bp, Artificial Sequence
  chemically synthesized
ctatgtgcttaacatgtgcaag

SEQ ID NO: 759653 - DNA, 22 bp, Artificial Sequence
  chemically synthesized
taagcctcgtgccttgcacatg

SEQ ID NO: 759654 - DNA, 22 bp, Artificial Sequence
  chemically synthesized
ttaagcctcgtgccttgcacat

SEQ ID NO: 759655 - DNA, 22 bp, Artificial Sequence
  chemically synthesized
tgtgcttaacatgtgcaaggca

SEQ ID NO: 759656 - DNA, 22 bp, Artificial Sequence
  chemically synthesized
aacatgtgcaaggcacgaggct

SEQ ID NO: 759657 - DNA, 22 bp, Artificial Sequence
  chemically synthesized
acatgtgcaaggcacgaggctt

SEQ ID NO: 759658 - DNA, 22 bp, Artificial Sequence
  chemically synthesized
aaaaatgtcctaccctatgtac

SEQ ID NO: 759659 - DNA, 22 bp, Artificial Sequence
  chemically synthesized
aaaatgtcctaccctatgtaca

SEQ ID NO: 759660 - DNA, 22 bp, Artificial Sequence
  chemically synthesized
agaagcagaacgatgtacatag

SEQ ID NO: 759661 - DNA, 22 bp, Artificial Sequence
  chemically synthesized
cagcagttcagaagcagaacga

SEQ ID NO: 759662 - DNA, 22 bp, Artificial Sequence
  chemically synthesized
ccctatgtacatcgttctgctt

SEQ ID NO: 759663 - DNA, 22 bp, Artificial Sequence
  chemically synthesized
ccagcagttcagaagcagaacg

SEQ ID NO: 759664 - DNA, 22 bp, Artificial Sequence
  chemically synthesized
tccagcagttcagaagcagaac

SEQ ID NO: 759665 - DNA, 22 bp, Artificial Sequence
  chemically synthesized
tgtacatcgttctgcttctgaa

SEQ ID NO: 759666 - DNA, 22 bp, Artificial Sequence
  chemically synthesized
gaggcgactttccagcagttca

SEQ ID NO: 759667 - DNA, 22 bp, Artificial Sequence
  chemically synthesized
ttggaggcgactttccagcagt

SEQ ID NO: 759668 - DNA, 22 bp, Artificial Sequence
  chemically synthesized
tgcttctgaactgctggaaagt

SEQ ID NO: 759669 - DNA, 22 bp, Artificial Sequence
  chemically synthesized
cttctgaactgctggaaagtcg

SEQ ID NO: 759670 - DNA, 22 bp, Artificial Sequence
  chemically synthesized
ctgaactgctggaaagtcgcct

SEQ ID NO: 759671 - DNA, 22 bp, Artificial Sequence
  chemically synthesized
tgaactgctggaaagtcgcctc

SEQ ID NO: 759672 - DNA, 22 bp, Artificial Sequence
  chemically synthesized
aactgctggaaagtcgcctcca

SEQ ID NO: 759673 - DNA, 22 bp, Artificial Sequence
  chemically synthesized
ctggaaagtcgcctccaatagg

SEQ ID NO: 759674 - DNA, 22 bp, Artificial Sequence
  chemically synthesized
agccggcaggcacctattggag

SEQ ID NO: 759675 - DNA, 22 bp, Artificial Sequence
  chemically synthesized
gaaagtcgcctccaataggtgc

SEQ ID NO: 759676 - DNA, 22 bp, Artificial Sequence
  chemically synthesized
caataggtgcctgccggcttaa

SEQ ID NO: 759677 - DNA, 22 bp, Artificial Sequence
  chemically synthesized
aaagatgatgaattaagccggc

SEQ ID NO: 759678 - DNA, 22 bp, Artificial Sequence
  chemically synthesized
cagctgaaagatgatgaattaa

SEQ ID NO: 759679 - DNA, 22 bp, Artificial Sequence
  chemically synthesized
ccggcttaattcatcatctttc

SEQ ID NO: 759680 - DNA, 22 bp, Artificial Sequence
  chemically synthesized
gtgtggctacagctgaaagatg

SEQ ID NO: 759681 - DNA, 22 bp, Artificial Sequence
  chemically synthesized
tggtgtggctacagctgaaaga

SEQ ID NO: 759682 - DNA, 22 bp, Artificial Sequence
  chemically synthesized
ctggtgtggctacagctgaaag

SEQ ID NO: 759683 - DNA, 22 bp, Artificial Sequence
  chemically synthesized
aattcatcatctttcagctgta

SEQ ID NO: 759684 - DNA, 22 bp, Artificial Sequence
  chemically synthesized
attcatcatctttcagctgtag

SEQ ID NO: 759685 - DNA, 22 bp, Artificial Sequence
  chemically synthesized
atcatctttcagctgtagccac

SEQ ID NO: 759686 - DNA, 22 bp, Artificial Sequence
  chemically synthesized
caggaacttctggtgtggctac

SEQ ID NO: 759687 - DNA, 22 bp, Artificial Sequence
  chemically synthesized
tgcaggaacttctggtgtggct

SEQ ID NO: 759688 - DNA, 22 bp, Artificial Sequence
  chemically synthesized
tctgcaggaacttctggtgtgg

SEQ ID NO: 759689 - DNA, 22 bp, Artificial Sequence
  chemically synthesized
ctctgcaggaacttctggtgtg

SEQ ID NO: 759690 - DNA, 22 bp, Artificial Sequence
  chemically synthesized
tcagctgtagccacaccagaag

SEQ ID NO: 759691 - DNA, 22 bp, Artificial Sequence
  chemically synthesized
tctctgcaggaacttctggtgt

SEQ ID NO: 759692 - DNA, 22 bp, Artificial Sequence
  chemically synthesized
cagctgtagccacaccagaagt

SEQ ID NO: 759693 - DNA, 22 bp, Artificial Sequence
  chemically synthesized
agctgtagccacaccagaagtt

SEQ ID NO: 759694 - DNA, 22 bp, Artificial Sequence
  chemically synthesized
cacctttctctgcaggaacttc

SEQ ID NO: 759695 - DNA, 22 bp, Artificial Sequence
  chemically synthesized
tagccacaccagaagttcctgc

SEQ ID NO: 759696 - DNA, 22 bp, Artificial Sequence
  chemically synthesized
accagtggaagcgtctgcacct

SEQ ID NO: 759697 - DNA, 22 bp, Artificial Sequence
  chemically synthesized
ctgcagagaaaggtgcagacgc

SEQ ID NO: 759698 - DNA, 22 bp, Artificial Sequence
  chemically synthesized
tgaccagtggaagcgtctgcac

SEQ ID NO: 759699 - DNA, 22 bp, Artificial Sequence
  chemically synthesized
cagagaaaggtgcagacgcttc

SEQ ID NO: 759700 - DNA, 22 bp, Artificial Sequence
  chemically synthesized
gaagccagttctgaccagtgga

SEQ ID NO: 759701 - DNA, 22 bp, Artificial Sequence
  chemically synthesized
ggaagccagttctgaccagtgg

SEQ ID NO: 759702 - DNA, 22 bp, Artificial Sequence
  chemically synthesized
aggtcccatttggaagccagtt

SEQ ID NO: 759703 - DNA, 22 bp, Artificial Sequence
  chemically synthesized
ccactggtcagaactggcttcc

SEQ ID NO: 759704 - DNA, 22 bp, Artificial Sequence
  chemically synthesized
caggtcccatttggaagccagt

SEQ ID NO: 759705 - DNA, 22 bp, Artificial Sequence
  chemically synthesized
cactggtcagaactggcttcca

SEQ ID NO: 759706 - DNA, 22 bp, Artificial Sequence
  chemically synthesized
tcaggtcccatttggaagccag

SEQ ID NO: 759707 - DNA, 22 bp, Artificial Sequence
  chemically synthesized
ttcaggtcccatttggaagcca

SEQ ID NO: 759708 - DNA, 22 bp, Artificial Sequence
  chemically synthesized
tttcaggtcccatttggaagcc

SEQ ID NO: 759709 - DNA, 22 bp, Artificial Sequence
  chemically synthesized
tttttcaggtcccatttggaag

SEQ ID NO: 759710 - DNA, 22 bp, Artificial Sequence
  chemically synthesized
gtcagaactggcttccaaatgg

SEQ ID NO: 759711 - DNA, 22 bp, Artificial Sequence
  chemically synthesized
ttctttttcaggtcccatttgg

SEQ ID NO: 759712 - DNA, 22 bp, Artificial Sequence
  chemically synthesized
ctgttctttttcaggtcccatt

SEQ ID NO: 759713 - DNA, 22 bp, Artificial Sequence
  chemically synthesized
gcttccaaatgggacctgaaaa

SEQ ID NO: 759714 - DNA, 22 bp, Artificial Sequence
  chemically synthesized
ccaaatgggacctgaaaaagaa

SEQ ID NO: 759715 - DNA, 22 bp, Artificial Sequence
  chemically synthesized
caaatgggacctgaaaaagaac

SEQ ID NO: 759716 - DNA, 22 bp, Artificial Sequence
  chemically synthesized
acatggtacgctgctgttcttt

SEQ ID NO: 759717 - DNA, 22 bp, Artificial Sequence
  chemically synthesized
tgacatggtacgctgctgttct

SEQ ID NO: 759718 - DNA, 22 bp, Artificial Sequence
  chemically synthesized
gatattctgacatggtacgctg

SEQ ID NO: 759719 - DNA, 22 bp, Artificial Sequence
  chemically synthesized
aaaaagaacagcagcgtaccat

SEQ ID NO: 759720 - DNA, 22 bp, Artificial Sequence
  chemically synthesized
tagatattctgacatggtacgc

SEQ ID NO: 759721 - DNA, 22 bp, Artificial Sequence
  chemically synthesized
ctagatattctgacatggtacg

SEQ ID NO: 759722 - DNA, 22 bp, Artificial Sequence
  chemically synthesized
cacttctagatattctgacatg

SEQ ID NO: 759723 - DNA, 22 bp, Artificial Sequence
  chemically synthesized
gaatcatcaattacacttctag

SEQ ID NO: 759724 - DNA, 22 bp, Artificial Sequence
  chemically synthesized
ttagaatcatcaattacacttc

SEQ ID NO: 759725 - DNA, 22 bp, Artificial Sequence
  chemically synthesized
aatggaattgttagaatcatca

SEQ ID NO: 759726 - DNA, 22 bp, Artificial Sequence
  chemically synthesized
caatggaattgttagaatcatc

SEQ ID NO: 759727 - DNA, 22 bp, Artificial Sequence
  chemically synthesized
gaagtgtaattgatgattctaa

SEQ ID NO: 759728 - DNA, 22 bp, Artificial Sequence
  chemically synthesized
tcaatggaattgttagaatcat

SEQ ID NO: 759729 - DNA, 22 bp, Artificial Sequence
  chemically synthesized
ttcaatggaattgttagaatca

SEQ ID NO: 759730 - DNA, 22 bp, Artificial Sequence
  chemically synthesized
tttcaatggaattgttagaatc

SEQ ID NO: 759731 - DNA, 22 bp, Artificial Sequence
  chemically synthesized
tactttttcaatggaattgtta

SEQ ID NO: 759732 - DNA, 22 bp, Artificial Sequence
  chemically synthesized
ttgtactttttcaatggaattg

SEQ ID NO: 759733 - DNA, 22 bp, Artificial Sequence
  chemically synthesized
attgtactttttcaatggaatt

SEQ ID NO: 759734 - DNA, 22 bp, Artificial Sequence
  chemically synthesized
atgattctaacaattccattga

SEQ ID NO: 759735 - DNA, 22 bp, Artificial Sequence
  chemically synthesized
taacaattccattgaaaaagta

SEQ ID NO: 759736 - DNA, 22 bp, Artificial Sequence
  chemically synthesized
acaattccattgaaaaagtaca

SEQ ID NO: 759737 - DNA, 22 bp, Artificial Sequence
  chemically synthesized
acaataggtttattgtactttt

SEQ ID NO: 759738 - DNA, 22 bp, Artificial Sequence
  chemically synthesized
cattgaaaaagtacaataaacc

SEQ ID NO: 759739 - DNA, 22 bp, Artificial Sequence
  chemically synthesized
tagttcacaataggtttattgt

SEQ ID NO: 759740 - DNA, 22 bp, Artificial Sequence
  chemically synthesized
gtagttcacaataggtttattg

SEQ ID NO: 759741 - DNA, 22 bp, Artificial Sequence
  chemically synthesized
tgtagttcacaataggtttatt

SEQ ID NO: 759742 - DNA, 22 bp, Artificial Sequence
  chemically synthesized
aaaaagtacaataaacctattg

SEQ ID NO: 759743 - DNA, 22 bp, Artificial Sequence
  chemically synthesized
ctttgtagttcacaataggttt

SEQ ID NO: 759744 - DNA, 22 bp, Artificial Sequence
  chemically synthesized
aagactgctttgtagttcacaa

SEQ ID NO: 759745 - DNA, 22 bp, Artificial Sequence
  chemically synthesized
ttcaagactgctttgtagttca

SEQ ID NO: 759746 - DNA, 22 bp, Artificial Sequence
  chemically synthesized
attcaagactgctttgtagttc

SEQ ID NO: 759747 - DNA, 22 bp, Artificial Sequence
  chemically synthesized
tattcaagactgctttgtagtt

SEQ ID NO: 759748 - DNA, 22 bp, Artificial Sequence
  chemically synthesized
ttattcaagactgctttgtagt

SEQ ID NO: 759749 - DNA, 22 bp, Artificial Sequence
  chemically synthesized
ttgtgaactacaaagcagtctt

SEQ ID NO: 759750 - DNA, 22 bp, Artificial Sequence
  chemically synthesized
tgaactacaaagcagtcttgaa

SEQ ID NO: 759751 - DNA, 22 bp, Artificial Sequence
  chemically synthesized
caaagcagtcttgaataaaaat

SEQ ID NO: 759752 - DNA, 22 bp, Artificial Sequence
  chemically synthesized
aaaagtaagtagccagattttt

SEQ ID NO: 759753 - DNA, 22 bp, Artificial Sequence
  chemically synthesized
tcaaaagtaagtagccagattt

SEQ ID NO: 759754 - DNA, 22 bp, Artificial Sequence
  chemically synthesized
gaataaaaatctggctacttac

SEQ ID NO: 759755 - DNA, 22 bp, Artificial Sequence
  chemically synthesized
tggctctcaaaagtaagtagcc

SEQ ID NO: 759756 - DNA, 22 bp, Artificial Sequence
  chemically synthesized
aataaaaatctggctacttact

SEQ ID NO: 759757 - DNA, 22 bp, Artificial Sequence
  chemically synthesized
gtggctctcaaaagtaagtagc

SEQ ID NO: 759758 - DNA, 22 bp, Artificial Sequence
  chemically synthesized
tgtggctctcaaaagtaagtag

SEQ ID NO: 759759 - DNA, 22 bp, Artificial Sequence
  chemically synthesized
ttttgtggctctcaaaagtaag

SEQ ID NO: 759760 - DNA, 22 bp, Artificial Sequence
  chemically synthesized
tgttttgtggctctcaaaagta

SEQ ID NO: 759761 - DNA, 22 bp, Artificial Sequence
  chemically synthesized
tcctctgttttgtggctctcaa

SEQ ID NO: 759762 - DNA, 22 bp, Artificial Sequence
  chemically synthesized
gctacttacttttgagagccac

SEQ ID NO: 759763 - DNA, 22 bp, Artificial Sequence
  chemically synthesized
cttacttttgagagccacaaaa

SEQ ID NO: 759764 - DNA, 22 bp, Artificial Sequence
  chemically synthesized
acttttgagagccacaaaacag

SEQ ID NO: 759765 - DNA, 22 bp, Artificial Sequence
  chemically synthesized
cttttgagagccacaaaacaga

SEQ ID NO: 759766 - DNA, 22 bp, Artificial Sequence
  chemically synthesized
ccatcaaactatcctctgtttt

SEQ ID NO: 759767 - DNA, 22 bp, Artificial Sequence
  chemically synthesized
ttgagagccacaaaacagagga

SEQ ID NO: 759768 - DNA, 22 bp, Artificial Sequence
  chemically synthesized
tgagagccacaaaacagaggat

SEQ ID NO: 759769 - DNA, 22 bp, Artificial Sequence
  chemically synthesized
gagagccacaaaacagaggata

SEQ ID NO: 759770 - DNA, 22 bp, Artificial Sequence
  chemically synthesized
agagccacaaaacagaggatag

SEQ ID NO: 759771 - DNA, 22 bp, Artificial Sequence
  chemically synthesized
aaaattgccatcaaactatcct

SEQ ID NO: 759772 - DNA, 22 bp, Artificial Sequence
  chemically synthesized
tcaaaattgccatcaaactatc

SEQ ID NO: 759773 - DNA, 22 bp, Artificial Sequence
  chemically synthesized
ctcaaaattgccatcaaactat

SEQ ID NO: 759774 - DNA, 22 bp, Artificial Sequence
  chemically synthesized
tctcaaaattgccatcaaacta

SEQ ID NO: 759775 - DNA, 22 bp, Artificial Sequence
  chemically synthesized
ttctcaaaattgccatcaaact

SEQ ID NO: 759776 - DNA, 22 bp, Artificial Sequence
  chemically synthesized
ccttttctcaaaattgccatca

SEQ ID NO: 759777 - DNA, 22 bp, Artificial Sequence
  chemically synthesized
aacactgccttttctcaaaatt

SEQ ID NO: 759778 - DNA, 22 bp, Artificial Sequence
  chemically synthesized
gatggcaattttgagaaaaggc

SEQ ID NO: 759779 - DNA, 22 bp, Artificial Sequence
  chemically synthesized
atggcaattttgagaaaaggca

SEQ ID NO: 759780 - DNA, 22 bp, Artificial Sequence
  chemically synthesized
tgagaaaaggcagtgtttagcc

SEQ ID NO: 759781 - DNA, 22 bp, Artificial Sequence
  chemically synthesized
gagaaaaggcagtgtttagcca

SEQ ID NO: 759782 - DNA, 22 bp, Artificial Sequence
  chemically synthesized
agaaaaggcagtgtttagccat

SEQ ID NO: 759783 - DNA, 22 bp, Artificial Sequence
  chemically synthesized
catgtggaaataaacatatggc

SEQ ID NO: 759784 - DNA, 22 bp, Artificial Sequence
  chemically synthesized
tgcatgtggaaataaacatatg

SEQ ID NO: 759785 - DNA, 22 bp, Artificial Sequence
  chemically synthesized
agcattctgcatgtggaaataa

SEQ ID NO: 759786 - DNA, 22 bp, Artificial Sequence
  chemically synthesized
agccatatgtttatttccacat

SEQ ID NO: 759787 - DNA, 22 bp, Artificial Sequence
  chemically synthesized
gccatatgtttatttccacatg

SEQ ID NO: 759788 - DNA, 22 bp, Artificial Sequence
  chemically synthesized
atttccacatgcagaatgctga

SEQ ID NO: 759789 - DNA, 22 bp, Artificial Sequence
  chemically synthesized
atgccaaaagtctcagcattct

SEQ ID NO: 759790 - DNA, 22 bp, Artificial Sequence
  chemically synthesized
tttccacatgcagaatgctgag

SEQ ID NO: 759791 - DNA, 22 bp, Artificial Sequence
  chemically synthesized
catgccaaaagtctcagcattc

SEQ ID NO: 759792 - DNA, 22 bp, Artificial Sequence
  chemically synthesized
ccacatgcagaatgctgagact

SEQ ID NO: 759793 - DNA, 22 bp, Artificial Sequence
  chemically synthesized
cacatgcagaatgctgagactt

SEQ ID NO: 759794 - DNA, 22 bp, Artificial Sequence
  chemically synthesized
cagtgtgtatttcatgccaaaa

SEQ ID NO: 759795 - DNA, 22 bp, Artificial Sequence
  chemically synthesized
agacttttggcatgaaatacac

SEQ ID NO: 759796 - DNA, 22 bp, Artificial Sequence
  chemically synthesized
ttggcatgaaatacacactgga

SEQ ID NO: 759797 - DNA, 22 bp, Artificial Sequence
  chemically synthesized
tggcatgaaatacacactggaa

SEQ ID NO: 759798 - DNA, 22 bp, Artificial Sequence
  chemically synthesized
ggcatgaaatacacactggaat

SEQ ID NO: 759799 - DNA, 22 bp, Artificial Sequence
  chemically synthesized
gcatgaaatacacactggaatc

SEQ ID NO: 759800 - DNA, 22 bp, Artificial Sequence
  chemically synthesized
caacagtatggaaaagcaatag

SEQ ID NO: 759801 - DNA, 22 bp, Artificial Sequence
  chemically synthesized
actacaacagtatggaaaagca

SEQ ID NO: 759802 - DNA, 22 bp, Artificial Sequence
  chemically synthesized
ttgactacaacagtatggaaaa

SEQ ID NO: 759803 - DNA, 22 bp, Artificial Sequence
  chemically synthesized
gaatctattgcttttccatact

SEQ ID NO: 759804 - DNA, 22 bp, Artificial Sequence
  chemically synthesized
agaattgttgactacaacagta

SEQ ID NO: 759805 - DNA, 22 bp, Artificial Sequence
  chemically synthesized
ttgcttttccatactgttgtag

SEQ ID NO: 759806 - DNA, 22 bp, Artificial Sequence
  chemically synthesized
cttttccatactgttgtagtca

SEQ ID NO: 759807 - DNA, 22 bp, Artificial Sequence
  chemically synthesized
ttccatactgttgtagtcaaca

SEQ ID NO: 759808 - DNA, 22 bp, Artificial Sequence
  chemically synthesized
tccatactgttgtagtcaacaa

SEQ ID NO: 759809 - DNA, 22 bp, Artificial Sequence
  chemically synthesized
ccatactgttgtagtcaacaat

SEQ ID NO: 759810 - DNA, 22 bp, Artificial Sequence
  chemically synthesized
catactgttgtagtcaacaatt

SEQ ID NO: 759811 - DNA, 22 bp, Artificial Sequence
  chemically synthesized
ccagaaatattaagaattgttg

SEQ ID NO: 759812 - DNA, 22 bp, Artificial Sequence
  chemically synthesized
taccagaaatattaagaattgt

SEQ ID NO: 759813 - DNA, 22 bp, Artificial Sequence
  chemically synthesized
ctaccagaaatattaagaattg

SEQ ID NO: 759814 - DNA, 22 bp, Artificial Sequence
  chemically synthesized
tctaccagaaatattaagaatt

SEQ ID NO: 759815 - DNA, 22 bp, Artificial Sequence
  chemically synthesized
ttgtagtcaacaattcttaata

SEQ ID NO: 759816 - DNA, 22 bp, Artificial Sequence
  chemically synthesized
ttctaccagaaatattaagaat

SEQ ID NO: 759817 - DNA, 22 bp, Artificial Sequence
  chemically synthesized
tttctaccagaaatattaagaa

SEQ ID NO: 759818 - DNA, 22 bp, Artificial Sequence
  chemically synthesized
tagtcaacaattcttaatattt

SEQ ID NO: 759819 - DNA, 22 bp, Artificial Sequence
  chemically synthesized
catccaattttttctaccagaa

SEQ ID NO: 759820 - DNA, 22 bp, Artificial Sequence
  chemically synthesized
ttaatatttctggtagaaaaaa

SEQ ID NO: 759821 - DNA, 22 bp, Artificial Sequence
  chemically synthesized
aatatttctggtagaaaaaatt

SEQ ID NO: 759822 - DNA, 22 bp, Artificial Sequence
  chemically synthesized
gtcactgcatccaattttttct

SEQ ID NO: 759823 - DNA, 22 bp, Artificial Sequence
  chemically synthesized
atatttctggtagaaaaaattg

SEQ ID NO: 759824 - DNA, 22 bp, Artificial Sequence
  chemically synthesized
attagtcactgcatccaatttt

SEQ ID NO: 759825 - DNA, 22 bp, Artificial Sequence
  chemically synthesized
cattagtcactgcatccaattt

SEQ ID NO: 759826 - DNA, 22 bp, Artificial Sequence
  chemically synthesized
tcattagtcactgcatccaatt

SEQ ID NO: 759827 - DNA, 22 bp, Artificial Sequence
  chemically synthesized
ctggtagaaaaaattggatgca

SEQ ID NO: 759828 - DNA, 22 bp, Artificial Sequence
  chemically synthesized
ttcattagtcactgcatccaat

SEQ ID NO: 759829 - DNA, 22 bp, Artificial Sequence
  chemically synthesized
tggtagaaaaaattggatgcag

SEQ ID NO: 759830 - DNA, 22 bp, Artificial Sequence
  chemically synthesized
gtagaaaaaattggatgcagtg

SEQ ID NO: 759831 - DNA, 22 bp, Artificial Sequence
  chemically synthesized
gatgcagtgactaatgaaaaac

SEQ ID NO: 759832 - DNA, 22 bp, Artificial Sequence
  chemically synthesized
gcatgagtcacatgaaaacgaa

SEQ ID NO: 759833 - DNA, 22 bp, Artificial Sequence
  chemically synthesized
atgaaaaacacttcgttttcat

SEQ ID NO: 759834 - DNA, 22 bp, Artificial Sequence
  chemically synthesized
cagtactagcatgagtcacatg

SEQ ID NO: 759835 - DNA, 22 bp, Artificial Sequence
  chemically synthesized
cgttttcatgtgactcatgcta

SEQ ID NO: 759836 - DNA, 22 bp, Artificial Sequence
  chemically synthesized
gttttcatgtgactcatgctag

SEQ ID NO: 759837 - DNA, 22 bp, Artificial Sequence
  chemically synthesized
tcatgtgactcatgctagtact

SEQ ID NO: 759838 - DNA, 22 bp, Artificial Sequence
  chemically synthesized
catgtgactcatgctagtactg

SEQ ID NO: 759839 - DNA, 22 bp, Artificial Sequence
  chemically synthesized
atgtgactcatgctagtactgg

SEQ ID NO: 759840 - DNA, 22 bp, Artificial Sequence
  chemically synthesized
aaggcaaaaagaattccagtac

SEQ ID NO: 759841 - DNA, 22 bp, Artificial Sequence
  chemically synthesized
tcaaggcaaaaagaattccagt

SEQ ID NO: 759842 - DNA, 22 bp, Artificial Sequence
  chemically synthesized
ctcaaggcaaaaagaattccag

SEQ ID NO: 759843 - DNA, 22 bp, Artificial Sequence
  chemically synthesized
atgctagtactggaattctttt

SEQ ID NO: 759844 - DNA, 22 bp, Artificial Sequence
  chemically synthesized
catttctcaaggcaaaaagaat

SEQ ID NO: 759845 - DNA, 22 bp, Artificial Sequence
  chemically synthesized
ccatttctcaaggcaaaaagaa

SEQ ID NO: 759846 - DNA, 22 bp, Artificial Sequence
  chemically synthesized
tccatttctcaaggcaaaaaga

SEQ ID NO: 759847 - DNA, 22 bp, Artificial Sequence
  chemically synthesized
gtactggaattctttttgcctt

SEQ ID NO: 759848 - DNA, 22 bp, Artificial Sequence
  chemically synthesized
gaattctttttgccttgagaaa

SEQ ID NO: 759849 - DNA, 22 bp, Artificial Sequence
  chemically synthesized
tttttgccttgagaaatggaaa

SEQ ID NO: 759850 - DNA, 22 bp, Artificial Sequence
  chemically synthesized
tttgccttgagaaatggaaagg

SEQ ID NO: 759851 - DNA, 22 bp, Artificial Sequence
  chemically synthesized
ttgccttgagaaatggaaaggt

SEQ ID NO: 759852 - DNA, 22 bp, Artificial Sequence
  chemically synthesized
tgccttgagaaatggaaaggtc

SEQ ID NO: 759853 - DNA, 22 bp, Artificial Sequence
  chemically synthesized
gccttgagaaatggaaaggtct

SEQ ID NO: 759854 - DNA, 22 bp, Artificial Sequence
  chemically synthesized
ccttgagaaatggaaaggtctc

SEQ ID NO: 759855 - DNA, 22 bp, Artificial Sequence
  chemically synthesized
gagaaatggaaaggtctctccc

SEQ ID NO: 759856 - DNA, 22 bp, Artificial Sequence
  chemically synthesized
agaaatggaaaggtctctcccc

SEQ ID NO: 759857 - DNA, 22 bp, Artificial Sequence
  chemically synthesized
gggtgtagaaatggaaaagtca

SEQ ID NO: 759858 - DNA, 22 bp, Artificial Sequence
  chemically synthesized
tccccacattttgacttttcca

SEQ ID NO: 759859 - DNA, 22 bp, Artificial Sequence
  chemically synthesized
cccacattttgacttttccatt

SEQ ID NO: 759860 - DNA, 22 bp, Artificial Sequence
  chemically synthesized
cctagggtgtagaaatggaaaa

SEQ ID NO: 759861 - DNA, 22 bp, Artificial Sequence
  chemically synthesized
tgacttttccatttctacaccc

SEQ ID NO: 759862 - DNA, 22 bp, Artificial Sequence
  chemically synthesized
gacttttccatttctacaccct

SEQ ID NO: 759863 - DNA, 22 bp, Artificial Sequence
  chemically synthesized
acttttccatttctacacccta

SEQ ID NO: 759864 - DNA, 22 bp, Artificial Sequence
  chemically synthesized
ttccatttctacaccctaggca

SEQ ID NO: 759865 - DNA, 22 bp, Artificial Sequence
  chemically synthesized
aatggaaaaggctgcctagggt

SEQ ID NO: 759866 - DNA, 22 bp, Artificial Sequence
  chemically synthesized
tccatttctacaccctaggcag

SEQ ID NO: 759867 - DNA, 22 bp, Artificial Sequence
  chemically synthesized
ccatttctacaccctaggcagc

SEQ ID NO: 759868 - DNA, 22 bp, Artificial Sequence
  chemically synthesized
catttctacaccctaggcagcc

SEQ ID NO: 759869 - DNA, 22 bp, Artificial Sequence
  chemically synthesized
ctacaccctaggcagccttttc

SEQ ID NO: 759870 - DNA, 22 bp, Artificial Sequence
  chemically synthesized
tacaccctaggcagccttttcc

SEQ ID NO: 759871 - DNA, 22 bp, Artificial Sequence
  chemically synthesized
caccctaggcagccttttccat

SEQ ID NO: 759872 - DNA, 22 bp, Artificial Sequence
  chemically synthesized
ggcagccttttccattgagttc

SEQ ID NO: 759873 - DNA, 22 bp, Artificial Sequence
  chemically synthesized
ttccattgagttcttccatctg

SEQ ID NO: 759874 - DNA, 22 bp, Artificial Sequence
  chemically synthesized
tccattgagttcttccatctgg

SEQ ID NO: 759875 - DNA, 22 bp, Artificial Sequence
  chemically synthesized
ccattgagttcttccatctggc

SEQ ID NO: 759876 - DNA, 22 bp, Artificial Sequence
  chemically synthesized
cattgagttcttccatctggcg

SEQ ID NO: 759877 - DNA, 22 bp, Artificial Sequence
  chemically synthesized
agttcttccatctggcgtctgt

SEQ ID NO: 759878 - DNA, 22 bp, Artificial Sequence
  chemically synthesized
ttccatctggcgtctgttcctt

SEQ ID NO: 759879 - DNA, 22 bp, Artificial Sequence
  chemically synthesized
ccatctggcgtctgttcctttc

SEQ ID NO: 759880 - DNA, 22 bp, Artificial Sequence
  chemically synthesized
ggaagaggagcagaaaggaaca

SEQ ID NO: 759881 - DNA, 22 bp, Artificial Sequence
  chemically synthesized
catctggcgtctgttcctttct

SEQ ID NO: 759882 - DNA, 22 bp, Artificial Sequence
  chemically synthesized
gggaagaggagcagaaaggaac

SEQ ID NO: 759883 - DNA, 22 bp, Artificial Sequence
  chemically synthesized
gcgtctgttcctttctgctcct

SEQ ID NO: 759884 - DNA, 22 bp, Artificial Sequence
  chemically synthesized
ttcctttctgctcctcttccca

SEQ ID NO: 759885 - DNA, 22 bp, Artificial Sequence
  chemically synthesized
ctttctgctcctcttcccaaat

SEQ ID NO: 759886 - DNA, 22 bp, Artificial Sequence
  chemically synthesized
tctgctcctcttcccaaatgcg

SEQ ID NO: 759887 - DNA, 22 bp, Artificial Sequence
  chemically synthesized
ctgctcctcttcccaaatgcgt

SEQ ID NO: 759888 - DNA, 22 bp, Artificial Sequence
  chemically synthesized
tgctcctcttcccaaatgcgtc

SEQ ID NO: 759889 - DNA, 22 bp, Artificial Sequence
  chemically synthesized
ctcctcttcccaaatgcgtctc

SEQ ID NO: 759890 - DNA, 22 bp, Artificial Sequence
  chemically synthesized
ctcttcccaaatgcgtctcctt

SEQ ID NO: 759891 - DNA, 22 bp, Artificial Sequence
  chemically synthesized
ttcccaaatgcgtctcctttcc

SEQ ID NO: 759892 - DNA, 22 bp, Artificial Sequence
  chemically synthesized
cccaaatgcgtctcctttcccc

SEQ ID NO: 759893 - DNA, 22 bp, Artificial Sequence
  chemically synthesized
ccaaatgcgtctcctttccccc

SEQ ID NO: 759894 - DNA, 22 bp, Artificial Sequence
  chemically synthesized
ctttccccctacccttctttat

SEQ ID NO: 759895 - DNA, 22 bp, Artificial Sequence
  chemically synthesized
tccccctacccttctttatttg

SEQ ID NO: 759896 - DNA, 22 bp, Artificial Sequence
  chemically synthesized
ccccctacccttctttatttgt

SEQ ID NO: 759897 - DNA, 22 bp, Artificial Sequence
  chemically synthesized
cccctacccttctttatttgtg

SEQ ID NO: 759898 - DNA, 22 bp, Artificial Sequence
  chemically synthesized
cccttctttatttgtgtgcacc

SEQ ID NO: 759899 - DNA, 22 bp, Artificial Sequence
  chemically synthesized
gtgaagacaaatcccaggtgca

SEQ ID NO: 759900 - DNA, 22 bp, Artificial Sequence
  chemically synthesized
ctttatttgtgtgcacctggga

SEQ ID NO: 759901 - DNA, 22 bp, Artificial Sequence
  chemically synthesized
ggtgaagacaaatcccaggtgc

SEQ ID NO: 759902 - DNA, 22 bp, Artificial Sequence
  chemically synthesized
tttatttgtgtgcacctgggat

SEQ ID NO: 759903 - DNA, 22 bp, Artificial Sequence
  chemically synthesized
tatttgtgtgcacctgggattt

SEQ ID NO: 759904 - DNA, 22 bp, Artificial Sequence
  chemically synthesized
atttgtgtgcacctgggatttg

SEQ ID NO: 759905 - DNA, 22 bp, Artificial Sequence
  chemically synthesized
tttgtgtgcacctgggatttgt

SEQ ID NO: 759906 - DNA, 22 bp, Artificial Sequence
  chemically synthesized
aaacttggtgaagacaaatccc

SEQ ID NO: 759907 - DNA, 22 bp, Artificial Sequence
  chemically synthesized
gtgtgcacctgggatttgtctt

SEQ ID NO: 759908 - DNA, 22 bp, Artificial Sequence
  chemically synthesized
tgtgcacctgggatttgtcttc

SEQ ID NO: 759909 - DNA, 22 bp, Artificial Sequence
  chemically synthesized
ggatttgtcttcaccaagtttc

SEQ ID NO: 759910 - DNA, 22 bp, Artificial Sequence
  chemically synthesized
gtcttcaccaagtttcaacatt

SEQ ID NO: 759911 - DNA, 22 bp, Artificial Sequence
  chemically synthesized
tcttcaccaagtttcaacattt

SEQ ID NO: 759912 - DNA, 22 bp, Artificial Sequence
  chemically synthesized
caccaagtttcaacattttctg

SEQ ID NO: 759913 - DNA, 22 bp, Artificial Sequence
  chemically synthesized
accaagtttcaacattttctgc

SEQ ID NO: 759914 - DNA, 22 bp, Artificial Sequence
  chemically synthesized
cacaaaggaaacaaagcagaaa

SEQ ID NO: 759915 - DNA, 22 bp, Artificial Sequence
  chemically synthesized
acacaaaggaaacaaagcagaa

SEQ ID NO: 759916 - DNA, 22 bp, Artificial Sequence
  chemically synthesized
tacacaaaggaaacaaagcaga

SEQ ID NO: 759917 - DNA, 22 bp, Artificial Sequence
  chemically synthesized
ttacacaaaggaaacaaagcag

SEQ ID NO: 759918 - DNA, 22 bp, Artificial Sequence
  chemically synthesized
tttacacaaaggaaacaaagca

SEQ ID NO: 759919 - DNA, 22 bp, Artificial Sequence
  chemically synthesized
caacattttctgctttgtttcc

SEQ ID NO: 759920 - DNA, 22 bp, Artificial Sequence
  chemically synthesized
aacattttctgctttgtttcct

SEQ ID NO: 759921 - DNA, 22 bp, Artificial Sequence
  chemically synthesized
gtactttttacacaaaggaaac

SEQ ID NO: 759922 - DNA, 22 bp, Artificial Sequence
  chemically synthesized
agtactttttacacaaaggaaa

SEQ ID NO: 759923 - DNA, 22 bp, Artificial Sequence
  chemically synthesized
tctgctttgtttcctttgtgta

SEQ ID NO: 759924 - DNA, 22 bp, Artificial Sequence
  chemically synthesized
ctgctttgtttcctttgtgtaa

SEQ ID NO: 759925 - DNA, 22 bp, Artificial Sequence
  chemically synthesized
tcttagtactttttacacaaag

SEQ ID NO: 759926 - DNA, 22 bp, Artificial Sequence
  chemically synthesized
tgctttgtttcctttgtgtaaa

SEQ ID NO: 759927 - DNA, 22 bp, Artificial Sequence
  chemically synthesized
ctttgtttcctttgtgtaaaaa

SEQ ID NO: 759928 - DNA, 22 bp, Artificial Sequence
  chemically synthesized
ttgtcttagtactttttacaca

SEQ ID NO: 759929 - DNA, 22 bp, Artificial Sequence
  chemically synthesized
tgtttcctttgtgtaaaaagta

SEQ ID NO: 759930 - DNA, 22 bp, Artificial Sequence
  chemically synthesized
gtttcctttgtgtaaaaagtac

SEQ ID NO: 759931 - DNA, 22 bp, Artificial Sequence
  chemically synthesized
tttcctttgtgtaaaaagtact

SEQ ID NO: 759932 - DNA, 22 bp, Artificial Sequence
  chemically synthesized
cctttgtgtaaaaagtactaag

SEQ ID NO: 759933 - DNA, 22 bp, Artificial Sequence
  chemically synthesized
ctttgtgtaaaaagtactaaga

SEQ ID NO: 759934 - DNA, 22 bp, Artificial Sequence
  chemically synthesized
catgtgagttgttgtcttagta

SEQ ID NO: 759935 - DNA, 22 bp, Artificial Sequence
  chemically synthesized
tgtgtaaaaagtactaagacaa

SEQ ID NO: 759936 - DNA, 22 bp, Artificial Sequence
  chemically synthesized
ccatgtgagttgttgtcttagt

SEQ ID NO: 759937 - DNA, 22 bp, Artificial Sequence
  chemically synthesized
gtgtaaaaagtactaagacaac

SEQ ID NO: 759938 - DNA, 22 bp, Artificial Sequence
  chemically synthesized
tgtaaaaagtactaagacaaca

SEQ ID NO: 759939 - DNA, 22 bp, Artificial Sequence
  chemically synthesized
ttccatgtgagttgttgtctta

SEQ ID NO: 759940 - DNA, 22 bp, Artificial Sequence
  chemically synthesized
ctcttccatgtgagttgttgtc

SEQ ID NO: 759941 - DNA, 22 bp, Artificial Sequence
  chemically synthesized
actcttccatgtgagttgttgt

SEQ ID NO: 759942 - DNA, 22 bp, Artificial Sequence
  chemically synthesized
tactcttccatgtgagttgttg

SEQ ID NO: 759943 - DNA, 22 bp, Artificial Sequence
  chemically synthesized
attttactcttccatgtgagtt

SEQ ID NO: 759944 - DNA, 22 bp, Artificial Sequence
  chemically synthesized
agacaacaactcacatggaaga

SEQ ID NO: 759945 - DNA, 22 bp, Artificial Sequence
  chemically synthesized
agataaatgtctgattttactc

SEQ ID NO: 759946 - DNA, 22 bp, Artificial Sequence
  chemically synthesized
cagataaatgtctgattttact

SEQ ID NO: 759947 - DNA, 22 bp, Artificial Sequence
  chemically synthesized
tcagataaatgtctgattttac

SEQ ID NO: 759948 - DNA, 22 bp, Artificial Sequence
  chemically synthesized
acatggaagagtaaaatcagac

SEQ ID NO: 759949 - DNA, 22 bp, Artificial Sequence
  chemically synthesized
gggggaagctttcagataaatg

SEQ ID NO: 759950 - DNA, 22 bp, Artificial Sequence
  chemically synthesized
atgttcgggggaagctttcaga

SEQ ID NO: 759951 - DNA, 22 bp, Artificial Sequence
  chemically synthesized
ttcatgttcgggggaagctttc

SEQ ID NO: 759952 - DNA, 22 bp, Artificial Sequence
  chemically synthesized
aattattcatgttcgggggaag

SEQ ID NO: 759953 - DNA, 22 bp, Artificial Sequence
  chemically synthesized
atctgaaagcttcccccgaaca

SEQ ID NO: 759954 - DNA, 22 bp, Artificial Sequence
  chemically synthesized
tctgaaagcttcccccgaacat

SEQ ID NO: 759955 - DNA, 22 bp, Artificial Sequence
  chemically synthesized
cctaaattattcatgttcgggg

SEQ ID NO: 759956 - DNA, 22 bp, Artificial Sequence
  chemically synthesized
ctgcctaaattattcatgttcg

SEQ ID NO: 759957 - DNA, 22 bp, Artificial Sequence
  chemically synthesized
aaagcttcccccgaacatgaat

SEQ ID NO: 759958 - DNA, 22 bp, Artificial Sequence
  chemically synthesized
agtctcctgcctaaattattca

SEQ ID NO: 759959 - DNA, 22 bp, Artificial Sequence
  chemically synthesized
cccccgaacatgaataatttag

SEQ ID NO: 759960 - DNA, 22 bp, Artificial Sequence
  chemically synthesized
ccccgaacatgaataatttagg

SEQ ID NO: 759961 - DNA, 22 bp, Artificial Sequence
  chemically synthesized
acggtaaagcactcagtctcct

SEQ ID NO: 759962 - DNA, 22 bp, Artificial Sequence
  chemically synthesized
aggcaggagactgagtgcttta

SEQ ID NO: 759963 - DNA, 22 bp, Artificial Sequence
  chemically synthesized
ggcaggagactgagtgctttac

SEQ ID NO: 759964 - DNA, 22 bp, Artificial Sequence
  chemically synthesized
aatacagttgacggtaaagcac

SEQ ID NO: 759965 - DNA, 22 bp, Artificial Sequence
  chemically synthesized
taaatacagttgacggtaaagc

SEQ ID NO: 759966 - DNA, 22 bp, Artificial Sequence
  chemically synthesized
acgtgttctaaatacagttgac

SEQ ID NO: 759967 - DNA, 22 bp, Artificial Sequence
  chemically synthesized
agtgctttaccgtcaactgtat

SEQ ID NO: 759968 - DNA, 22 bp, Artificial Sequence
  chemically synthesized
aggattaacgtgttctaaatac

SEQ ID NO: 759969 - DNA, 22 bp, Artificial Sequence
  chemically synthesized
taccgtcaactgtatttagaac

SEQ ID NO: 759970 - DNA, 22 bp, Artificial Sequence
  chemically synthesized
accgtcaactgtatttagaaca

SEQ ID NO: 759971 - DNA, 22 bp, Artificial Sequence
  chemically synthesized
taaggattaacgtgttctaaat

SEQ ID NO: 759972 - DNA, 22 bp, Artificial Sequence
  chemically synthesized
ccgtcaactgtatttagaacac

SEQ ID NO: 759973 - DNA, 22 bp, Artificial Sequence
  chemically synthesized
ctaaggattaacgtgttctaaa

SEQ ID NO: 759974 - DNA, 22 bp, Artificial Sequence
  chemically synthesized
aatggcttctaaggattaacgt

SEQ ID NO: 759975 - DNA, 22 bp, Artificial Sequence
  chemically synthesized
aaatggcttctaaggattaacg

SEQ ID NO: 759976 - DNA, 22 bp, Artificial Sequence
  chemically synthesized
tatttagaacacgttaatcctt

SEQ ID NO: 759977 - DNA, 22 bp, Artificial Sequence
  chemically synthesized
ttaaatggcttctaaggattaa

SEQ ID NO: 759978 - DNA, 22 bp, Artificial Sequence
  chemically synthesized
agaacacgttaatccttagaag

SEQ ID NO: 759979 - DNA, 22 bp, Artificial Sequence
  chemically synthesized
gaacacgttaatccttagaagc

SEQ ID NO: 759980 - DNA, 22 bp, Artificial Sequence
  chemically synthesized
tgtattcttaaatggcttctaa

SEQ ID NO: 759981 - DNA, 22 bp, Artificial Sequence
  chemically synthesized
gtgtattcttaaatggcttcta

SEQ ID NO: 759982 - DNA, 22 bp, Artificial Sequence
  chemically synthesized
atttgtgtattcttaaatggct

SEQ ID NO: 759983 - DNA, 22 bp, Artificial Sequence
  chemically synthesized
atccttagaagccatttaagaa

SEQ ID NO: 759984 - DNA, 22 bp, Artificial Sequence
  chemically synthesized
agaagccatttaagaatacaca

SEQ ID NO: 759985 - DNA, 22 bp, Artificial Sequence
  chemically synthesized
gaagccatttaagaatacacaa

SEQ ID NO: 759986 - DNA, 22 bp, Artificial Sequence
  chemically synthesized
tagcacagatcattcatttgtg

SEQ ID NO: 759987 - DNA, 22 bp, Artificial Sequence
  chemically synthesized
atagcacagatcattcatttgt

SEQ ID NO: 759988 - DNA, 22 bp, Artificial Sequence
  chemically synthesized
tatagcacagatcattcatttg

SEQ ID NO: 759989 - DNA, 22 bp, Artificial Sequence
  chemically synthesized
aagaatacacaaatgaatgatc

SEQ ID NO: 759990 - DNA, 22 bp, Artificial Sequence
  chemically synthesized
agaatacacaaatgaatgatct

SEQ ID NO: 759991 - DNA, 22 bp, Artificial Sequence
  chemically synthesized
aagtgaaatgtggattttatag

SEQ ID NO: 759992 - DNA, 22 bp, Artificial Sequence
  chemically synthesized
caagtgaaatgtggattttata

SEQ ID NO: 759993 - DNA, 22 bp, Artificial Sequence
  chemically synthesized
atcttcaagtgaaatgtggatt

SEQ ID NO: 759994 - DNA, 22 bp, Artificial Sequence
  chemically synthesized
tcatcttcaagtgaaatgtgga

SEQ ID NO: 759995 - DNA, 22 bp, Artificial Sequence
  chemically synthesized
ctcatcttcaagtgaaatgtgg

SEQ ID NO: 759996 - DNA, 22 bp, Artificial Sequence
  chemically synthesized
tgctataaaatccacatttcac

SEQ ID NO: 759997 - DNA, 22 bp, Artificial Sequence
  chemically synthesized
gcttctcatcttcaagtgaaat

SEQ ID NO: 759998 - DNA, 22 bp, Artificial Sequence
  chemically synthesized
agcttctcatcttcaagtgaaa

SEQ ID NO: 759999 - DNA, 22 bp, Artificial Sequence
  chemically synthesized
taaaatccacatttcacttgaa

SEQ ID NO: 760000 - DNA, 22 bp, Artificial Sequence
  chemically synthesized
atttagcttctcatcttcaagt

SEQ ID NO: 760001 - DNA, 22 bp, Artificial Sequence
  chemically synthesized
ttaatttagcttctcatcttca

SEQ ID NO: 760002 - DNA, 22 bp, Artificial Sequence
  chemically synthesized
attaatttagcttctcatcttc

SEQ ID NO: 760003 - DNA, 22 bp, Artificial Sequence
  chemically synthesized
tattaatttagcttctcatctt

SEQ ID NO: 760004 - DNA, 22 bp, Artificial Sequence
  chemically synthesized
ttttattaatttagcttctcat

SEQ ID NO: 760005 - DNA, 22 bp, Artificial Sequence
  chemically synthesized
attttattaatttagcttctca

SEQ ID NO: 760006 - DNA, 22 bp, Artificial Sequence
  chemically synthesized
cacttgaagatgagaagctaaa

SEQ ID NO: 760007 - DNA, 22 bp, Artificial Sequence
  chemically synthesized
acttgaagatgagaagctaaat

SEQ ID NO: 760008 - DNA, 22 bp, Artificial Sequence
  chemically synthesized
gaagatgagaagctaaattaat

SEQ ID NO: 760009 - DNA, 22 bp, Artificial Sequence
  chemically synthesized
aagatgagaagctaaattaata

SEQ ID NO: 760010 - DNA, 22 bp, Artificial Sequence
  chemically synthesized
gatgatgatttattttattaat

SEQ ID NO: 760011 - DNA, 22 bp, Artificial Sequence
  chemically synthesized
tggatgatgatttattttatta

SEQ ID NO: 760012 - DNA, 22 bp, Artificial Sequence
  chemically synthesized
ctggatgatgatttattttatt

SEQ ID NO: 760013 - DNA, 22 bp, Artificial Sequence
  chemically synthesized
tctggatgatgatttattttat

SEQ ID NO: 760014 - DNA, 22 bp, Artificial Sequence
  chemically synthesized
ttttctggatgatgatttattt

SEQ ID NO: 760015 - DNA, 22 bp, Artificial Sequence
  chemically synthesized
gttttctggatgatgatttatt

SEQ ID NO: 760016 - DNA, 22 bp, Artificial Sequence
  chemically synthesized
tgttttctggatgatgatttat

SEQ ID NO: 760017 - DNA, 22 bp, Artificial Sequence
  chemically synthesized
aattaataaaataaatcatcat

SEQ ID NO: 760018 - DNA, 22 bp, Artificial Sequence
  chemically synthesized
tttgttttctggatgatgattt

SEQ ID NO: 760019 - DNA, 22 bp, Artificial Sequence
  chemically synthesized
ctctttgttttctggatgatga

SEQ ID NO: 760020 - DNA, 22 bp, Artificial Sequence
  chemically synthesized
cctctttgttttctggatgatg

SEQ ID NO: 760021 - DNA, 22 bp, Artificial Sequence
  chemically synthesized
ataaaataaatcatcatccaga

SEQ ID NO: 760022 - DNA, 22 bp, Artificial Sequence
  chemically synthesized
cgtttcctctttgttttctgga

SEQ ID NO: 760023 - DNA, 22 bp, Artificial Sequence
  chemically synthesized
acactgcgtttcctctttgttt

SEQ ID NO: 760024 - DNA, 22 bp, Artificial Sequence
  chemically synthesized
ctaacactgcgtttcctctttg

SEQ ID NO: 760025 - DNA, 22 bp, Artificial Sequence
  chemically synthesized
gctaacactgcgtttcctcttt

SEQ ID NO: 760026 - DNA, 22 bp, Artificial Sequence
  chemically synthesized
tgctaacactgcgtttcctctt

SEQ ID NO: 760027 - DNA, 22 bp, Artificial Sequence
  chemically synthesized
aagataaagctttgctaacact

SEQ ID NO: 760028 - DNA, 22 bp, Artificial Sequence
  chemically synthesized
cctgaagataaagctttgctaa

SEQ ID NO: 760029 - DNA, 22 bp, Artificial Sequence
  chemically synthesized
acctgaagataaagctttgcta

SEQ ID NO: 760030 - DNA, 22 bp, Artificial Sequence
  chemically synthesized
atttacctgaagataaagcttt

SEQ ID NO: 760031 - DNA, 22 bp, Artificial Sequence
  chemically synthesized
taatttacctgaagataaagct

SEQ ID NO: 760032 - DNA, 22 bp, Artificial Sequence
  chemically synthesized
ctaatttacctgaagataaagc

SEQ ID NO: 760033 - DNA, 22 bp, Artificial Sequence
  chemically synthesized
gcaaagctttatcttcaggtaa

SEQ ID NO: 760034 - DNA, 22 bp, Artificial Sequence
  chemically synthesized
agcataatttctaatttacctg

SEQ ID NO: 760035 - DNA, 22 bp, Artificial Sequence
  chemically synthesized
tatcttcaggtaaattagaaat

SEQ ID NO: 760036 - DNA, 22 bp, Artificial Sequence
  chemically synthesized
atcttcaggtaaattagaaatt

SEQ ID NO: 760037 - DNA, 22 bp, Artificial Sequence
  chemically synthesized
tcttcaggtaaattagaaatta

SEQ ID NO: 760038 - DNA, 22 bp, Artificial Sequence
  chemically synthesized
agtgattgagcataatttctaa

SEQ ID NO: 760039 - DNA, 22 bp, Artificial Sequence
  chemically synthesized
caggtaaattagaaattatgct

SEQ ID NO: 760040 - DNA, 22 bp, Artificial Sequence
  chemically synthesized
aggtaaattagaaattatgctc

SEQ ID NO: 760041 - DNA, 22 bp, Artificial Sequence
  chemically synthesized
ataatagctgagtgattgagca

SEQ ID NO: 760042 - DNA, 22 bp, Artificial Sequence
  chemically synthesized
ctgataatagctgagtgattga

SEQ ID NO: 760043 - DNA, 22 bp, Artificial Sequence
  chemically synthesized
gaaattatgctcaatcactcag

SEQ ID NO: 760044 - DNA, 22 bp, Artificial Sequence
  chemically synthesized
gtaattgctgataatagctgag

SEQ ID NO: 760045 - DNA, 22 bp, Artificial Sequence
  chemically synthesized
tgctcaatcactcagctattat

SEQ ID NO: 760046 - DNA, 22 bp, Artificial Sequence
  chemically synthesized
attagtaattgctgataatagc

SEQ ID NO: 760047 - DNA, 22 bp, Artificial Sequence
  chemically synthesized
aatcactcagctattatcagca

SEQ ID NO: 760048 - DNA, 22 bp, Artificial Sequence
  chemically synthesized
tgaattaattagtaattgctga

SEQ ID NO: 760049 - DNA, 22 bp, Artificial Sequence
  chemically synthesized
ttatgaattaattagtaattgc

SEQ ID NO: 760050 - DNA, 22 bp, Artificial Sequence
  chemically synthesized
agctattatcagcaattactaa

SEQ ID NO: 760051 - DNA, 22 bp, Artificial Sequence
  chemically synthesized
ttatcagcaattactaattaat

SEQ ID NO: 760052 - DNA, 22 bp, Artificial Sequence
  chemically synthesized
tcagcaattactaattaattca

SEQ ID NO: 760053 - DNA, 22 bp, Artificial Sequence
  chemically synthesized
taggtagcgttattatgaatta

SEQ ID NO: 760054 - DNA, 22 bp, Artificial Sequence
  chemically synthesized
tgttataggtagcgttattatg

SEQ ID NO: 760055 - DNA, 22 bp, Artificial Sequence
  chemically synthesized
atgttataggtagcgttattat

SEQ ID NO: 760056 - DNA, 22 bp, Artificial Sequence
  chemically synthesized
ctaattaattcataataacgct

SEQ ID NO: 760057 - DNA, 22 bp, Artificial Sequence
  chemically synthesized
attaattcataataacgctacc

SEQ ID NO: 760058 - DNA, 22 bp, Artificial Sequence
  chemically synthesized
tatttatgttataggtagcgtt

SEQ ID NO: 760059 - DNA, 22 bp, Artificial Sequence
  chemically synthesized
attcataataacgctacctata

SEQ ID NO: 760060 - DNA, 22 bp, Artificial Sequence
  chemically synthesized
ttatatttatgttataggtagc

SEQ ID NO: 760061 - DNA, 22 bp, Artificial Sequence
  chemically synthesized
attatatttatgttataggtag

SEQ ID NO: 760062 - DNA, 22 bp, Artificial Sequence
  chemically synthesized
tattatatttatgttataggta

SEQ ID NO: 760063 - DNA, 22 bp, Artificial Sequence
  chemically synthesized
ataataacgctacctataacat

SEQ ID NO: 760064 - DNA, 22 bp, Artificial Sequence
  chemically synthesized
aagtctttattatatttatgtt

SEQ ID NO: 760065 - DNA, 22 bp, Artificial Sequence
  chemically synthesized
cctataacataaatataataaa

SEQ ID NO: 760066 - DNA, 22 bp, Artificial Sequence
  chemically synthesized
cagcgttaaagtctttattata

SEQ ID NO: 760067 - DNA, 22 bp, Artificial Sequence
  chemically synthesized
gcagcgttaaagtctttattat

SEQ ID NO: 760068 - DNA, 22 bp, Artificial Sequence
  chemically synthesized
tgcagcgttaaagtctttatta

SEQ ID NO: 760069 - DNA, 22 bp, Artificial Sequence
  chemically synthesized
taacataaatataataaagact

SEQ ID NO: 760070 - DNA, 22 bp, Artificial Sequence
  chemically synthesized
aatctttgcagcgttaaagtct

SEQ ID NO: 760071 - DNA, 22 bp, Artificial Sequence
  chemically synthesized
caatctttgcagcgttaaagtc

SEQ ID NO: 760072 - DNA, 22 bp, Artificial Sequence
  chemically synthesized
catttcaatctttgcagcgtta

SEQ ID NO: 760073 - DNA, 22 bp, Artificial Sequence
  chemically synthesized
acatttcaatctttgcagcgtt

SEQ ID NO: 760074 - DNA, 22 bp, Artificial Sequence
  chemically synthesized
tacatttcaatctttgcagcgt

SEQ ID NO: 760075 - DNA, 22 bp, Artificial Sequence
  chemically synthesized
ctttacatttcaatctttgcag

SEQ ID NO: 760076 - DNA, 22 bp, Artificial Sequence
  chemically synthesized
gctttacatttcaatctttgca

SEQ ID NO: 760077 - DNA, 22 bp, Artificial Sequence
  chemically synthesized
tgctttacatttcaatctttgc

SEQ ID NO: 760078 - DNA, 22 bp, Artificial Sequence
  chemically synthesized
ctttgctttacatttcaatctt

SEQ ID NO: 760079 - DNA, 22 bp, Artificial Sequence
  chemically synthesized
taacgctgcaaagattgaaatg

SEQ ID NO: 760080 - DNA, 22 bp, Artificial Sequence
  chemically synthesized
aacgctgcaaagattgaaatgt

SEQ ID NO: 760081 - DNA, 22 bp, Artificial Sequence
  chemically synthesized
acgctgcaaagattgaaatgta

SEQ ID NO: 760082 - DNA, 22 bp, Artificial Sequence
  chemically synthesized
gttgctttgctttacatttcaa

SEQ ID NO: 760083 - DNA, 22 bp, Artificial Sequence
  chemically synthesized
caaagattgaaatgtaaagcaa

SEQ ID NO: 760084 - DNA, 22 bp, Artificial Sequence
  chemically synthesized
cacctggttgctttgctttaca

SEQ ID NO: 760085 - DNA, 22 bp, Artificial Sequence
  chemically synthesized
ctccacctggttgctttgcttt

SEQ ID NO: 760086 - DNA, 22 bp, Artificial Sequence
  chemically synthesized
aaatgtaaagcaaagcaaccag

SEQ ID NO: 760087 - DNA, 22 bp, Artificial Sequence
  chemically synthesized
agggaaatgttgctccacctgg

SEQ ID NO: 760088 - DNA, 22 bp, Artificial Sequence
  chemically synthesized
ccaaatggctaagggaaatgtt

SEQ ID NO: 760089 - DNA, 22 bp, Artificial Sequence
  chemically synthesized
agttaccaaatggctaagggaa

SEQ ID NO: 760090 - DNA, 22 bp, Artificial Sequence
  chemically synthesized
taatgtcaagctaagttaccaa

SEQ ID NO: 760091 - DNA, 22 bp, Artificial Sequence
  chemically synthesized
cccttagccatttggtaactta

SEQ ID NO: 760092 - DNA, 22 bp, Artificial Sequence
  chemically synthesized
gtaatgtcaagctaagttacca

SEQ ID NO: 760093 - DNA, 22 bp, Artificial Sequence
  chemically synthesized
ccttagccatttggtaacttag

SEQ ID NO: 760094 - DNA, 22 bp, Artificial Sequence
  chemically synthesized
agccatttggtaacttagcttg

SEQ ID NO: 760095 - DNA, 22 bp, Artificial Sequence
  chemically synthesized
tatttgtaatgtcaagctaagt

SEQ ID NO: 760096 - DNA, 22 bp, Artificial Sequence
  chemically synthesized
gccatttggtaacttagcttga

SEQ ID NO: 760097 - DNA, 22 bp, Artificial Sequence
  chemically synthesized
ggtaacttagcttgacattaca

SEQ ID NO: 760098 - DNA, 22 bp, Artificial Sequence
  chemically synthesized
gtaacttagcttgacattacaa

SEQ ID NO: 760099 - DNA, 22 bp, Artificial Sequence
  chemically synthesized
agcttgacattacaaatacaat

SEQ ID NO: 760100 - DNA, 22 bp, Artificial Sequence
  chemically synthesized
gcttgacattacaaatacaatt

SEQ ID NO: 760101 - DNA, 22 bp, Artificial Sequence
  chemically synthesized
aggccaaaaggagaattgtatt

SEQ ID NO: 760102 - DNA, 22 bp, Artificial Sequence
  chemically synthesized
gacattacaaatacaattctcc

SEQ ID NO: 760103 - DNA, 22 bp, Artificial Sequence
  chemically synthesized
acattacaaatacaattctcct

SEQ ID NO: 760104 - DNA, 22 bp, Artificial Sequence
  chemically synthesized
actaaggccaaaaggagaattg

SEQ ID NO: 760105 - DNA, 22 bp, Artificial Sequence
  chemically synthesized
gactaaggccaaaaggagaatt

SEQ ID NO: 760106 - DNA, 22 bp, Artificial Sequence
  chemically synthesized
tttgactaaggccaaaaggaga

SEQ ID NO: 760107 - DNA, 22 bp, Artificial Sequence
  chemically synthesized
caaatacaattctccttttggc

SEQ ID NO: 760108 - DNA, 22 bp, Artificial Sequence
  chemically synthesized
tgtttgactaaggccaaaagga

SEQ ID NO: 760109 - DNA, 22 bp, Artificial Sequence
  chemically synthesized
gtgattctgtttgactaaggcc

SEQ ID NO: 760110 - DNA, 22 bp, Artificial Sequence
  chemically synthesized
ggtgattctgtttgactaaggc

SEQ ID NO: 760111 - DNA, 22 bp, Artificial Sequence
  chemically synthesized
tggtgattctgtttgactaagg

SEQ ID NO: 760112 - DNA, 22 bp, Artificial Sequence
  chemically synthesized
tttggtgattctgtttgactaa

SEQ ID NO: 760113 - DNA, 22 bp, Artificial Sequence
  chemically synthesized
tccttttggccttagtcaaaca

SEQ ID NO: 760114 - DNA, 22 bp, Artificial Sequence
  chemically synthesized
cttttggccttagtcaaacaga

SEQ ID NO: 760115 - DNA, 22 bp, Artificial Sequence
  chemically synthesized
ttggccttagtcaaacagaatc

SEQ ID NO: 760116 - DNA, 22 bp, Artificial Sequence
  chemically synthesized
tggccttagtcaaacagaatca

SEQ ID NO: 760117 - DNA, 22 bp, Artificial Sequence
  chemically synthesized
ggccttagtcaaacagaatcac

SEQ ID NO: 760118 - DNA, 22 bp, Artificial Sequence
  chemically synthesized
gccttagtcaaacagaatcacc

SEQ ID NO: 760119 - DNA, 22 bp, Artificial Sequence
  chemically synthesized
agtcaaacagaatcaccaaaga

SEQ ID NO: 760120 - DNA, 22 bp, Artificial Sequence
  chemically synthesized
gtcaaacagaatcaccaaagaa

SEQ ID NO: 760121 - DNA, 22 bp, Artificial Sequence
  chemically synthesized
agtagataagtattctttggtg

SEQ ID NO: 760122 - DNA, 22 bp, Artificial Sequence
  chemically synthesized
cagtagataagtattctttggt

SEQ ID NO: 760123 - DNA, 22 bp, Artificial Sequence
  chemically synthesized
atttcagtagataagtattctt

SEQ ID NO: 760124 - DNA, 22 bp, Artificial Sequence
  chemically synthesized
aatttcagtagataagtattct

SEQ ID NO: 760125 - DNA, 22 bp, Artificial Sequence
  chemically synthesized
gaacaatttaatttcagtagat

SEQ ID NO: 760126 - DNA, 22 bp, Artificial Sequence
  chemically synthesized
ggaacaatttaatttcagtaga

SEQ ID NO: 760127 - DNA, 22 bp, Artificial Sequence
  chemically synthesized
agaaagtttggaacaatttaat

SEQ ID NO: 760128 - DNA, 22 bp, Artificial Sequence
  chemically synthesized
cagaaagtttggaacaatttaa

SEQ ID NO: 760129 - DNA, 22 bp, Artificial Sequence
  chemically synthesized
atctactgaaattaaattgttc

SEQ ID NO: 760130 - DNA, 22 bp, Artificial Sequence
  chemically synthesized
tctactgaaattaaattgttcc

SEQ ID NO: 760131 - DNA, 22 bp, Artificial Sequence
  chemically synthesized
tccttcagaaagtttggaacaa

SEQ ID NO: 760132 - DNA, 22 bp, Artificial Sequence
  chemically synthesized
ctgaaattaaattgttccaaac

SEQ ID NO: 760133 - DNA, 22 bp, Artificial Sequence
  chemically synthesized
aaattaaattgttccaaacttt

SEQ ID NO: 760134 - DNA, 22 bp, Artificial Sequence
  chemically synthesized
tcaaattatccttcagaaagtt

SEQ ID NO: 760135 - DNA, 22 bp, Artificial Sequence
  chemically synthesized
aattgttccaaactttctgaag

SEQ ID NO: 760136 - DNA, 22 bp, Artificial Sequence
  chemically synthesized
ttccaaactttctgaaggataa

SEQ ID NO: 760137 - DNA, 22 bp, Artificial Sequence
  chemically synthesized
tgtattgtcaaattatccttca

SEQ ID NO: 760138 - DNA, 22 bp, Artificial Sequence
  chemically synthesized
atgtattgtcaaattatccttc

SEQ ID NO: 760139 - DNA, 22 bp, Artificial Sequence
  chemically synthesized
tatgtattgtcaaattatcctt

SEQ ID NO: 760140 - DNA, 22 bp, Artificial Sequence
  chemically synthesized
caaactttctgaaggataattt

SEQ ID NO: 760141 - DNA, 22 bp, Artificial Sequence
  chemically synthesized
ttatgtattgtcaaattatcct

SEQ ID NO: 760142 - DNA, 22 bp, Artificial Sequence
  chemically synthesized
tctgaaggataatttgacaata

SEQ ID NO: 760143 - DNA, 22 bp, Artificial Sequence
  chemically synthesized
aagacttttatgtattgtcaaa

SEQ ID NO: 760144 - DNA, 22 bp, Artificial Sequence
  chemically synthesized
ctgaaggataatttgacaatac

SEQ ID NO: 760145 - DNA, 22 bp, Artificial Sequence
  chemically synthesized
aaagacttttatgtattgtcaa

SEQ ID NO: 760146 - DNA, 22 bp, Artificial Sequence
  chemically synthesized
tgaaggataatttgacaataca

SEQ ID NO: 760147 - DNA, 22 bp, Artificial Sequence
  chemically synthesized
taaagacttttatgtattgtca

SEQ ID NO: 760148 - DNA, 22 bp, Artificial Sequence
  chemically synthesized
aaggataatttgacaatacata

SEQ ID NO: 760149 - DNA, 22 bp, Artificial Sequence
  chemically synthesized
cacattttaaagacttttatgt

SEQ ID NO: 760150 - DNA, 22 bp, Artificial Sequence
  chemically synthesized
gcacattttaaagacttttatg

SEQ ID NO: 760151 - DNA, 22 bp, Artificial Sequence
  chemically synthesized
tgcacattttaaagacttttat

SEQ ID NO: 760152 - DNA, 22 bp, Artificial Sequence
  chemically synthesized
gacaatacataaaagtctttaa

SEQ ID NO: 760153 - DNA, 22 bp, Artificial Sequence
  chemically synthesized
tctttgcacattttaaagactt

SEQ ID NO: 760154 - DNA, 22 bp, Artificial Sequence
  chemically synthesized
acaatacataaaagtctttaaa

SEQ ID NO: 760155 - DNA, 22 bp, Artificial Sequence
  chemically synthesized
tgggtcattgtctttgcacatt

SEQ ID NO: 760156 - DNA, 22 bp, Artificial Sequence
  chemically synthesized
agcctgtgggtcattgtctttg

SEQ ID NO: 760157 - DNA, 22 bp, Artificial Sequence
  chemically synthesized
aagcctgtgggtcattgtcttt

SEQ ID NO: 760158 - DNA, 22 bp, Artificial Sequence
  chemically synthesized
taaaatgtgcaaagacaatgac

SEQ ID NO: 760159 - DNA, 22 bp, Artificial Sequence
  chemically synthesized
aaaatgtgcaaagacaatgacc

SEQ ID NO: 760160 - DNA, 22 bp, Artificial Sequence
  chemically synthesized
aaatgtgcaaagacaatgaccc

SEQ ID NO: 760161 - DNA, 22 bp, Artificial Sequence
  chemically synthesized
aatttaagcctgtgggtcattg

SEQ ID NO: 760162 - DNA, 22 bp, Artificial Sequence
  chemically synthesized
gaatttaagcctgtgggtcatt

SEQ ID NO: 760163 - DNA, 22 bp, Artificial Sequence
  chemically synthesized
cttgaatttaagcctgtgggtc

SEQ ID NO: 760164 - DNA, 22 bp, Artificial Sequence
  chemically synthesized
ccttgaatttaagcctgtgggt

SEQ ID NO: 760165 - DNA, 22 bp, Artificial Sequence
  chemically synthesized
gtataatttccttgaatttaag

SEQ ID NO: 760166 - DNA, 22 bp, Artificial Sequence
  chemically synthesized
ttagtataatttccttgaattt

SEQ ID NO: 760167 - DNA, 22 bp, Artificial Sequence
  chemically synthesized
gttagtataatttccttgaatt

SEQ ID NO: 760168 - DNA, 22 bp, Artificial Sequence
  chemically synthesized
tgttagtataatttccttgaat

SEQ ID NO: 760169 - DNA, 22 bp, Artificial Sequence
  chemically synthesized
tttgttagtataatttccttga

SEQ ID NO: 760170 - DNA, 22 bp, Artificial Sequence
  chemically synthesized
ctttgttagtataatttccttg

SEQ ID NO: 760171 - DNA, 22 bp, Artificial Sequence
  chemically synthesized
caatttctttgttagtataatt

SEQ ID NO: 760172 - DNA, 22 bp, Artificial Sequence
  chemically synthesized
aaattcaaggaaattatactaa

SEQ ID NO: 760173 - DNA, 22 bp, Artificial Sequence
  chemically synthesized
ccaatttctttgttagtataat

SEQ ID NO: 760174 - DNA, 22 bp, Artificial Sequence
  chemically synthesized
aattcaaggaaattatactaac

SEQ ID NO: 760175 - DNA, 22 bp, Artificial Sequence
  chemically synthesized
tccaatttctttgttagtataa

SEQ ID NO: 760176 - DNA, 22 bp, Artificial Sequence
  chemically synthesized
ttccaatttctttgttagtata

SEQ ID NO: 760177 - DNA, 22 bp, Artificial Sequence
  chemically synthesized
tttccaatttctttgttagtat

SEQ ID NO: 760178 - DNA, 22 bp, Artificial Sequence
  chemically synthesized
aaggaaattatactaacaaaga

SEQ ID NO: 760179 - DNA, 22 bp, Artificial Sequence
  chemically synthesized
tatctttttccaatttctttgt

SEQ ID NO: 760180 - DNA, 22 bp, Artificial Sequence
  chemically synthesized
gtatctttttccaatttctttg

SEQ ID NO: 760181 - DNA, 22 bp, Artificial Sequence
  chemically synthesized
tgtatctttttccaatttcttt

SEQ ID NO: 760182 - DNA, 22 bp, Artificial Sequence
  chemically synthesized
tactaacaaagaaattggaaaa

SEQ ID NO: 760183 - DNA, 22 bp, Artificial Sequence
  chemically synthesized
tatctttgtatctttttccaat

SEQ ID NO: 760184 - DNA, 22 bp, Artificial Sequence
  chemically synthesized
acaaagaaattggaaaaagata

SEQ ID NO: 760185 - DNA, 22 bp, Artificial Sequence
  chemically synthesized
cacctatatctttgtatctttt

SEQ ID NO: 760186 - DNA, 22 bp, Artificial Sequence
  chemically synthesized
ccacctatatctttgtatcttt

SEQ ID NO: 760187 - DNA, 22 bp, Artificial Sequence
  chemically synthesized
tccacctatatctttgtatctt

SEQ ID NO: 760188 - DNA, 22 bp, Artificial Sequence
  chemically synthesized
ttccacctatatctttgtatct

SEQ ID NO: 760189 - DNA, 22 bp, Artificial Sequence
  chemically synthesized
gaaaaagatacaaagatatagg

SEQ ID NO: 760190 - DNA, 22 bp, Artificial Sequence
  chemically synthesized
tatataacatttttccacctat

SEQ ID NO: 760191 - DNA, 22 bp, Artificial Sequence
  chemically synthesized
tcaatcataaatgatgctatat

SEQ ID NO: 760192 - DNA, 22 bp, Artificial Sequence
  chemically synthesized
atcaatcataaatgatgctata

SEQ ID NO: 760193 - DNA, 22 bp, Artificial Sequence
  chemically synthesized
tatcaatcataaatgatgctat

SEQ ID NO: 760194 - DNA, 22 bp, Artificial Sequence
  chemically synthesized
ttttatcaatcataaatgatgc

SEQ ID NO: 760195 - DNA, 22 bp, Artificial Sequence
  chemically synthesized
gttttatcaatcataaatgatg

SEQ ID NO: 760196 - DNA, 22 bp, Artificial Sequence
  chemically synthesized
tgttttatcaatcataaatgat

SEQ ID NO: 760197 - DNA, 22 bp, Artificial Sequence
  chemically synthesized
ttttgttttatcaatcataaat

SEQ ID NO: 760198 - DNA, 22 bp, Artificial Sequence
  chemically synthesized
tatatagcatcatttatgattg

SEQ ID NO: 760199 - DNA, 22 bp, Artificial Sequence
  chemically synthesized
tgttttgttttatcaatcataa

SEQ ID NO: 760200 - DNA, 22 bp, Artificial Sequence
  chemically synthesized
ctgttttgttttatcaatcata

SEQ ID NO: 760201 - DNA, 22 bp, Artificial Sequence
  chemically synthesized
tttctgttttgttttatcaatc

SEQ ID NO: 760202 - DNA, 22 bp, Artificial Sequence
  chemically synthesized
agttgtttctgttttgttttat

SEQ ID NO: 760203 - DNA, 22 bp, Artificial Sequence
  chemically synthesized
aagttgtttctgttttgtttta

SEQ ID NO: 760204 - DNA, 22 bp, Artificial Sequence
  chemically synthesized
atgattgataaaacaaaacaga

SEQ ID NO: 760205 - DNA, 22 bp, Artificial Sequence
  chemically synthesized
tgattgataaaacaaaacagaa

SEQ ID NO: 760206 - DNA, 22 bp, Artificial Sequence
  chemically synthesized
aatatttaagttgtttctgttt

SEQ ID NO: 760207 - DNA, 22 bp, Artificial Sequence
  chemically synthesized
ataaaacaaaacagaaacaact

SEQ ID NO: 760208 - DNA, 22 bp, Artificial Sequence
  chemically synthesized
atattgaatatttaagttgttt

SEQ ID NO: 760209 - DNA, 22 bp, Artificial Sequence
  chemically synthesized
cctcatattgaatatttaagtt

SEQ ID NO: 760210 - DNA, 22 bp, Artificial Sequence
  chemically synthesized
aagcaattccctcatattgaat

SEQ ID NO: 760211 - DNA, 22 bp, Artificial Sequence
  chemically synthesized
tcaagcaattccctcatattga

SEQ ID NO: 760212 - DNA, 22 bp, Artificial Sequence
  chemically synthesized
ctcaagcaattccctcatattg

SEQ ID NO: 760213 - DNA, 22 bp, Artificial Sequence
  chemically synthesized
aaatattcaatatgagggaatt

SEQ ID NO: 760214 - DNA, 22 bp, Artificial Sequence
  chemically synthesized
catttctcaagcaattccctca

SEQ ID NO: 760215 - DNA, 22 bp, Artificial Sequence
  chemically synthesized
aatattcaatatgagggaattg

SEQ ID NO: 760216 - DNA, 22 bp, Artificial Sequence
  chemically synthesized
gcatttctcaagcaattccctc

SEQ ID NO: 760217 - DNA, 22 bp, Artificial Sequence
  chemically synthesized
tgcatttctcaagcaattccct

SEQ ID NO: 760218 - DNA, 22 bp, Artificial Sequence
  chemically synthesized
aatatgagggaattgcttgaga

SEQ ID NO: 760219 - DNA, 22 bp, Artificial Sequence
  chemically synthesized
gggttttgcatttctcaagcaa

SEQ ID NO: 760220 - DNA, 22 bp, Artificial Sequence
  chemically synthesized
cttgagaaatgcaaaaccccaa

SEQ ID NO: 760221 - DNA, 22 bp, Artificial Sequence
  chemically synthesized
gagaaatgcaaaaccccaacct

SEQ ID NO: 760222 - DNA, 22 bp, Artificial Sequence
  chemically synthesized
aaaacaatcagtaggttggggt

SEQ ID NO: 760223 - DNA, 22 bp, Artificial Sequence
  chemically synthesized
agaaatgcaaaaccccaaccta

SEQ ID NO: 760224 - DNA, 22 bp, Artificial Sequence
  chemically synthesized
gaaaacaatcagtaggttgggg

SEQ ID NO: 760225 - DNA, 22 bp, Artificial Sequence
  chemically synthesized
catttgaaaacaatcagtaggt

SEQ ID NO: 760226 - DNA, 22 bp, Artificial Sequence
  chemically synthesized
attacatttgaaaacaatcagt

SEQ ID NO: 760227 - DNA, 22 bp, Artificial Sequence
  chemically synthesized
cattacatttgaaaacaatcag

SEQ ID NO: 760228 - DNA, 22 bp, Artificial Sequence
  chemically synthesized
ctgattgttttcaaatgtaatg

SEQ ID NO: 760229 - DNA, 22 bp, Artificial Sequence
  chemically synthesized
attgttttcaaatgtaatgaaa

SEQ ID NO: 760230 - DNA, 22 bp, Artificial Sequence
  chemically synthesized
aagcatatacaagtttcattac

SEQ ID NO: 760231 - DNA, 22 bp, Artificial Sequence
  chemically synthesized
aaagcatatacaagtttcatta

SEQ ID NO: 760232 - DNA, 22 bp, Artificial Sequence
  chemically synthesized
ttttcaaatgtaatgaaacttg

SEQ ID NO: 760233 - DNA, 22 bp, Artificial Sequence
  chemically synthesized
tcaaatgtaatgaaacttgtat

SEQ ID NO: 760234 - DNA, 22 bp, Artificial Sequence
  chemically synthesized
aatttaaagcatatacaagttt

SEQ ID NO: 760235 - DNA, 22 bp, Artificial Sequence
  chemically synthesized
caaatgtaatgaaacttgtata

SEQ ID NO: 760236 - DNA, 22 bp, Artificial Sequence
  chemically synthesized
aaatgtaatgaaacttgtatat

SEQ ID NO: 760237 - DNA, 22 bp, Artificial Sequence
  chemically synthesized
taaatttaaagcatatacaagt

SEQ ID NO: 760238 - DNA, 22 bp, Artificial Sequence
  chemically synthesized
ctaaatttaaagcatatacaag

SEQ ID NO: 760239 - DNA, 22 bp, Artificial Sequence
  chemically synthesized
atttctaaatttaaagcatata

SEQ ID NO: 760240 - DNA, 22 bp, Artificial Sequence
  chemically synthesized
attaatttctaaatttaaagca

SEQ ID NO: 760241 - DNA, 22 bp, Artificial Sequence
  chemically synthesized
cattaatttctaaatttaaagc

SEQ ID NO: 760242 - DNA, 22 bp, Artificial Sequence
  chemically synthesized
gtatatgctttaaatttagaaa

SEQ ID NO: 760243 - DNA, 22 bp, Artificial Sequence
  chemically synthesized
tatatgctttaaatttagaaat

SEQ ID NO: 760244 - DNA, 22 bp, Artificial Sequence
  chemically synthesized
atatataaatttcattaatttc

SEQ ID NO: 760245 - DNA, 22 bp, Artificial Sequence
  chemically synthesized
taaatttagaaattaatgaaat

SEQ ID NO: 760246 - DNA, 22 bp, Artificial Sequence
  chemically synthesized
aaatttagaaattaatgaaatt

SEQ ID NO: 760247 - DNA, 22 bp, Artificial Sequence
  chemically synthesized
aattcatatataaatttcatta

SEQ ID NO: 760248 - DNA, 22 bp, Artificial Sequence
  chemically synthesized
aatttagaaattaatgaaattt

SEQ ID NO: 760249 - DNA, 22 bp, Artificial Sequence
  chemically synthesized
attaaattcatatataaatttc

SEQ ID NO: 760250 - DNA, 22 bp, Artificial Sequence
  chemically synthesized
aattaaattcatatataaattt

SEQ ID NO: 760251 - DNA, 22 bp, Artificial Sequence
  chemically synthesized
agaaattaatgaaatttatata

SEQ ID NO: 760252 - DNA, 22 bp, Artificial Sequence
  chemically synthesized
gaaattaatgaaatttatatat

SEQ ID NO: 760253 - DNA, 22 bp, Artificial Sequence
  chemically synthesized
tttaattaaattcatatataaa

SEQ ID NO: 760254 - DNA, 22 bp, Artificial Sequence
  chemically synthesized
atgaaatttatatatgaattta

SEQ ID NO: 760255 - DNA, 22 bp, Artificial Sequence
  chemically synthesized
agagctatttaattaaattcat

SEQ ID NO: 760256 - DNA, 22 bp, Artificial Sequence
  chemically synthesized
aattaagagctatttaattaaa

SEQ ID NO: 760257 - DNA, 22 bp, Artificial Sequence
  chemically synthesized
aaattaagagctatttaattaa

SEQ ID NO: 760258 - DNA, 22 bp, Artificial Sequence
  chemically synthesized
taaattaagagctatttaatta

SEQ ID NO: 760259 - DNA, 22 bp, Artificial Sequence
  chemically synthesized
atatatgaatttaattaaatag

SEQ ID NO: 760260 - DNA, 22 bp, Artificial Sequence
  chemically synthesized
ttaaattaagagctatttaatt

SEQ ID NO: 760261 - DNA, 22 bp, Artificial Sequence
  chemically synthesized
tatatgaatttaattaaatagc

SEQ ID NO: 760262 - DNA, 22 bp, Artificial Sequence
  chemically synthesized
ccttttaaattaagagctattt

SEQ ID NO: 760263 - DNA, 22 bp, Artificial Sequence
  chemically synthesized
aattaaatagctcttaatttaa

SEQ ID NO: 760264 - DNA, 22 bp, Artificial Sequence
  chemically synthesized
attaaatagctcttaatttaaa

SEQ ID NO: 760265 - DNA, 22 bp, Artificial Sequence
  chemically synthesized
aatagctcttaatttaaaaggg

SEQ ID NO: 760266 - DNA, 22 bp, Artificial Sequence
  chemically synthesized
tatatgtaataattccctttta

SEQ ID NO: 760267 - DNA, 22 bp, Artificial Sequence
  chemically synthesized
ttaatttaaaagggaattatta

SEQ ID NO: 760268 - DNA, 22 bp, Artificial Sequence
  chemically synthesized
aatttaaaagggaattattaca

SEQ ID NO: 760269 - DNA, 22 bp, Artificial Sequence
  chemically synthesized
atttaaaagggaattattacat

SEQ ID NO: 760270 - DNA, 22 bp, Artificial Sequence
  chemically synthesized
aaaagggaattattacatatat

SEQ ID NO: 760271 - DNA, 22 bp, Artificial Sequence
  chemically synthesized
aaagggaattattacatatata

SEQ ID NO: 760272 - DNA, 22 bp, Artificial Sequence
  chemically synthesized
tatgaatgcaccattatatatg

SEQ ID NO: 760273 - DNA, 22 bp, Artificial Sequence
  chemically synthesized
ctgtatgaatgcaccattatat

SEQ ID NO: 760274 - DNA, 22 bp, Artificial Sequence
  chemically synthesized
actgtatgaatgcaccattata

SEQ ID NO: 760275 - DNA, 22 bp, Artificial Sequence
  chemically synthesized
tactgtatgaatgcaccattat

SEQ ID NO: 760276 - DNA, 22 bp, Artificial Sequence
  chemically synthesized
ttacatatataatggtgcattc

SEQ ID NO: 760277 - DNA, 22 bp, Artificial Sequence
  chemically synthesized
catatataatggtgcattcata

SEQ ID NO: 760278 - DNA, 22 bp, Artificial Sequence
  chemically synthesized
caaaggattttactgtatgaat

SEQ ID NO: 760279 - DNA, 22 bp, Artificial Sequence
  chemically synthesized
gcaaaggattttactgtatgaa

SEQ ID NO: 760280 - DNA, 22 bp, Artificial Sequence
  chemically synthesized
aaccttgcaaaggattttactg

SEQ ID NO: 760281 - DNA, 22 bp, Artificial Sequence
  chemically synthesized
atacagtaaaatcctttgcaag

SEQ ID NO: 760282 - DNA, 22 bp, Artificial Sequence
  chemically synthesized
tgtcatcatattgaaccttgca

SEQ ID NO: 760283 - DNA, 22 bp, Artificial Sequence
  chemically synthesized
gctatgtcatcatattgaacct

SEQ ID NO: 760284 - DNA, 22 bp, Artificial Sequence
  chemically synthesized
ggctatgtcatcatattgaacc

SEQ ID NO: 760285 - DNA, 22 bp, Artificial Sequence
  chemically synthesized
tgcaaggttcaatatgatgaca

SEQ ID NO: 760286 - DNA, 22 bp, Artificial Sequence
  chemically synthesized
gcaaggttcaatatgatgacat

SEQ ID NO: 760287 - DNA, 22 bp, Artificial Sequence
  chemically synthesized
caaggttcaatatgatgacata

SEQ ID NO: 760288 - DNA, 22 bp, Artificial Sequence
  chemically synthesized
aatatgatgacatagccaaata

SEQ ID NO: 760289 - DNA, 22 bp, Artificial Sequence
  chemically synthesized
catatccataaatatttggcta

SEQ ID NO: 760290 - DNA, 22 bp, Artificial Sequence
  chemically synthesized
ccatatccataaatatttggct

SEQ ID NO: 760291 - DNA, 22 bp, Artificial Sequence
  chemically synthesized
tccatatccataaatatttggc

SEQ ID NO: 760292 - DNA, 22 bp, Artificial Sequence
  chemically synthesized
ttccatatccataaatatttgg

SEQ ID NO: 760293 - DNA, 22 bp, Artificial Sequence
  chemically synthesized
ggatgatgaccttttccatatc

SEQ ID NO: 760294 - DNA, 22 bp, Artificial Sequence
  chemically synthesized
gtaactgggatgatgacctttt

SEQ ID NO: 760295 - DNA, 22 bp, Artificial Sequence
  chemically synthesized
agtaactgggatgatgaccttt

SEQ ID NO: 760296 - DNA, 22 bp, Artificial Sequence
  chemically synthesized
atggatatggaaaaggtcatca

SEQ ID NO: 760297 - DNA, 22 bp, Artificial Sequence
  chemically synthesized
tggatatggaaaaggtcatcat

SEQ ID NO: 760298 - DNA, 22 bp, Artificial Sequence
  chemically synthesized
atttagtaactgggatgatgac

SEQ ID NO: 760299 - DNA, 22 bp, Artificial Sequence
  chemically synthesized
tcatttagtaactgggatgatg

SEQ ID NO: 760300 - DNA, 22 bp, Artificial Sequence
  chemically synthesized
ctcatttagtaactgggatgat

SEQ ID NO: 760301 - DNA, 22 bp, Artificial Sequence
  chemically synthesized
tctcatttagtaactgggatga

SEQ ID NO: 760302 - DNA, 22 bp, Artificial Sequence
  chemically synthesized
ttttctcatttagtaactggga

SEQ ID NO: 760303 - DNA, 22 bp, Artificial Sequence
  chemically synthesized
taacctgttttctcatttagta

SEQ ID NO: 760304 - DNA, 22 bp, Artificial Sequence
  chemically synthesized
gtaacctgttttctcatttagt

SEQ ID NO: 760305 - DNA, 22 bp, Artificial Sequence
  chemically synthesized
tgtaacctgttttctcatttag

SEQ ID NO: 760306 - DNA, 22 bp, Artificial Sequence
  chemically synthesized
ttttgtaacctgttttctcatt

SEQ ID NO: 760307 - DNA, 22 bp, Artificial Sequence
  chemically synthesized
gttttgtaacctgttttctcat

SEQ ID NO: 760308 - DNA, 22 bp, Artificial Sequence
  chemically synthesized
ctaaatgagaaaacaggttaca

SEQ ID NO: 760309 - DNA, 22 bp, Artificial Sequence
  chemically synthesized
aatgagaaaacaggttacaaaa

SEQ ID NO: 760310 - DNA, 22 bp, Artificial Sequence
  chemically synthesized
aaaaaatgtatttgttttgtaa

SEQ ID NO: 760311 - DNA, 22 bp, Artificial Sequence
  chemically synthesized
gaaaaattcaaaaaatgtattt

SEQ ID NO: 760312 - DNA, 22 bp, Artificial Sequence
  chemically synthesized
agaaaaattcaaaaaatgtatt

SEQ ID NO: 760313 - DNA, 22 bp, Artificial Sequence
  chemically synthesized
tagaaaaattcaaaaaatgtat

SEQ ID NO: 760314 - DNA, 22 bp, Artificial Sequence
  chemically synthesized
caaaacaaatacattttttgaa

SEQ ID NO: 760315 - DNA, 22 bp, Artificial Sequence
  chemically synthesized
tttgaatttttctaaaacattt

SEQ ID NO: 760316 - DNA, 22 bp, Artificial Sequence
  chemically synthesized
ttgaatttttctaaaacatttg

SEQ ID NO: 760317 - DNA, 22 bp, Artificial Sequence
  chemically synthesized
tgaatttttctaaaacatttgt

SEQ ID NO: 760318 - DNA, 22 bp, Artificial Sequence
  chemically synthesized
gaatttttctaaaacatttgtg

SEQ ID NO: 760319 - DNA, 22 bp, Artificial Sequence
  chemically synthesized
aatttttctaaaacatttgtgt

SEQ ID NO: 760320 - DNA, 22 bp, Artificial Sequence
  chemically synthesized
ttctaaaacatttgtgtatgtg

SEQ ID NO: 760321 - DNA, 22 bp, Artificial Sequence
  chemically synthesized
tctaaaacatttgtgtatgtgt

SEQ ID NO: 760322 - DNA, 22 bp, Artificial Sequence
  chemically synthesized
ctaaaacatttgtgtatgtgta

SEQ ID NO: 760323 - DNA, 22 bp, Artificial Sequence
  chemically synthesized
taaaacatttgtgtatgtgtat

SEQ ID NO: 760324 - DNA, 22 bp, Artificial Sequence
  chemically synthesized
aaacatttgtgtatgtgtatgt

SEQ ID NO: 760325 - DNA, 22 bp, Artificial Sequence
  chemically synthesized
gtgtatgtgtatgtatttgtat

SEQ ID NO: 760326 - DNA, 22 bp, Artificial Sequence
  chemically synthesized
tgtatgtgtatgtatttgtatg

SEQ ID NO: 760327 - DNA, 22 bp, Artificial Sequence
  chemically synthesized
gtcaagcatgtgcatacaaata

SEQ ID NO: 760328 - DNA, 22 bp, Artificial Sequence
  chemically synthesized
ctagtcaagcatgtgcatacaa

SEQ ID NO: 760329 - DNA, 22 bp, Artificial Sequence
  chemically synthesized
cctagtcaagcatgtgcataca

SEQ ID NO: 760330 - DNA, 22 bp, Artificial Sequence
  chemically synthesized
tcctagtcaagcatgtgcatac

SEQ ID NO: 760331 - DNA, 22 bp, Artificial Sequence
  chemically synthesized
ttcctagtcaagcatgtgcata

SEQ ID NO: 760332 - DNA, 22 bp, Artificial Sequence
  chemically synthesized
tttcctagtcaagcatgtgcat

SEQ ID NO: 760333 - DNA, 22 bp, Artificial Sequence
  chemically synthesized
caaaattttttcctagtcaagc

SEQ ID NO: 760334 - DNA, 22 bp, Artificial Sequence
  chemically synthesized
gtatgcacatgcttgactagga

SEQ ID NO: 760335 - DNA, 22 bp, Artificial Sequence
  chemically synthesized
tatgcacatgcttgactaggaa

SEQ ID NO: 760336 - DNA, 22 bp, Artificial Sequence
  chemically synthesized
tcattacaaaattttttcctag

SEQ ID NO: 760337 - DNA, 22 bp, Artificial Sequence
  chemically synthesized
gttgtcattacaaaattttttc

SEQ ID NO: 760338 - DNA, 22 bp, Artificial Sequence
  chemically synthesized
gactaggaaaaaattttgtaat

SEQ ID NO: 760339 - DNA, 22 bp, Artificial Sequence
  chemically synthesized
actaggaaaaaattttgtaatg

SEQ ID NO: 760340 - DNA, 22 bp, Artificial Sequence
  chemically synthesized
ggaaaaaattttgtaatgacaa

SEQ ID NO: 760341 - DNA, 22 bp, Artificial Sequence
  chemically synthesized
agggataacctggttgtcatta

SEQ ID NO: 760342 - DNA, 22 bp, Artificial Sequence
  chemically synthesized
tgagggataacctggttgtcat

SEQ ID NO: 760343 - DNA, 22 bp, Artificial Sequence
  chemically synthesized
cctctgagggataacctggttg

SEQ ID NO: 760344 - DNA, 22 bp, Artificial Sequence
  chemically synthesized
tgtaatgacaaccaggttatcc

SEQ ID NO: 760345 - DNA, 22 bp, Artificial Sequence
  chemically synthesized
gtaatgacaaccaggttatccc

SEQ ID NO: 760346 - DNA, 22 bp, Artificial Sequence
  chemically synthesized
taatgacaaccaggttatccct

SEQ ID NO: 760347 - DNA, 22 bp, Artificial Sequence
  chemically synthesized
taaatctacctctgagggataa

SEQ ID NO: 760348 - DNA, 22 bp, Artificial Sequence
  chemically synthesized
tccctcagaggtagatttacag

SEQ ID NO: 760349 - DNA, 22 bp, Artificial Sequence
  chemically synthesized
agaaataaatcacctgtaaatc

SEQ ID NO: 760350 - DNA, 22 bp, Artificial Sequence
  chemically synthesized
agaggtagatttacaggtgatt

SEQ ID NO: 760351 - DNA, 22 bp, Artificial Sequence
  chemically synthesized
acaggtgatttatttcttaatc

SEQ ID NO: 760352 - DNA, 22 bp, Artificial Sequence
  chemically synthesized
gaaaagtagaaagattaagaaa

SEQ ID NO: 760353 - DNA, 22 bp, Artificial Sequence
  chemically synthesized
caggtgatttatttcttaatct

SEQ ID NO: 760354 - DNA, 22 bp, Artificial Sequence
  chemically synthesized
ggaaaagtagaaagattaagaa

SEQ ID NO: 760355 - DNA, 22 bp, Artificial Sequence
  chemically synthesized
acaatttggaaaagtagaaaga

SEQ ID NO: 760356 - DNA, 22 bp, Artificial Sequence
  chemically synthesized
gacaatttggaaaagtagaaag

SEQ ID NO: 760357 - DNA, 22 bp, Artificial Sequence
  chemically synthesized
atttcttaatctttctactttt

SEQ ID NO: 760358 - DNA, 22 bp, Artificial Sequence
  chemically synthesized
tttcttaatctttctacttttc

SEQ ID NO: 760359 - DNA, 22 bp, Artificial Sequence
  chemically synthesized
cttaatctttctacttttccaa

SEQ ID NO: 760360 - DNA, 22 bp, Artificial Sequence
  chemically synthesized
ttaatctttctacttttccaaa

SEQ ID NO: 760361 - DNA, 22 bp, Artificial Sequence
  chemically synthesized
aatctttctacttttccaaatt

SEQ ID NO: 760362 - DNA, 22 bp, Artificial Sequence
  chemically synthesized
atctttctacttttccaaattg

SEQ ID NO: 760363 - DNA, 22 bp, Artificial Sequence
  chemically synthesized
tctacttttccaaattgtcaag

SEQ ID NO: 760364 - DNA, 22 bp, Artificial Sequence
  chemically synthesized
tagaaagaaaatcttgacaatt

SEQ ID NO: 760365 - DNA, 22 bp, Artificial Sequence
  chemically synthesized
ctacttttccaaattgtcaaga

SEQ ID NO: 760366 - DNA, 22 bp, Artificial Sequence
  chemically synthesized
tacttttccaaattgtcaagat

SEQ ID NO: 760367 - DNA, 22 bp, Artificial Sequence
  chemically synthesized
cttttccaaattgtcaagattt

SEQ ID NO: 760368 - DNA, 22 bp, Artificial Sequence
  chemically synthesized
caattatagaaagaaaatcttg

SEQ ID NO: 760369 - DNA, 22 bp, Artificial Sequence
  chemically synthesized
ttccaaattgtcaagattttct

SEQ ID NO: 760370 - DNA, 22 bp, Artificial Sequence
  chemically synthesized
tccaaattgtcaagattttctt

SEQ ID NO: 760371 - DNA, 22 bp, Artificial Sequence
  chemically synthesized
ccaaattgtcaagattttcttt

SEQ ID NO: 760372 - DNA, 22 bp, Artificial Sequence
  chemically synthesized
caaattgtcaagattttctttc

SEQ ID NO: 760373 - DNA, 22 bp, Artificial Sequence
  chemically synthesized
tactgcaattatagaaagaaaa

SEQ ID NO: 760374 - DNA, 22 bp, Artificial Sequence
  chemically synthesized
atactgcaattatagaaagaaa

SEQ ID NO: 760375 - DNA, 22 bp, Artificial Sequence
  chemically synthesized
tttatactgcaattatagaaag

SEQ ID NO: 760376 - DNA, 22 bp, Artificial Sequence
  chemically synthesized
tcaagattttctttctataatt

SEQ ID NO: 760377 - DNA, 22 bp, Artificial Sequence
  chemically synthesized
gacatattgtttatactgcaat

SEQ ID NO: 760378 - DNA, 22 bp, Artificial Sequence
  chemically synthesized
tctttctataattgcagtataa

SEQ ID NO: 760379 - DNA, 22 bp, Artificial Sequence
  chemically synthesized
ctttctataattgcagtataaa

SEQ ID NO: 760380 - DNA, 22 bp, Artificial Sequence
  chemically synthesized
ctggacatattgtttatactgc

SEQ ID NO: 760381 - DNA, 22 bp, Artificial Sequence
  chemically synthesized
tttctataattgcagtataaac

SEQ ID NO: 760382 - DNA, 22 bp, Artificial Sequence
  chemically synthesized
cctggacatattgtttatactg

SEQ ID NO: 760383 - DNA, 22 bp, Artificial Sequence
  chemically synthesized
tcctggacatattgtttatact

SEQ ID NO: 760384 - DNA, 22 bp, Artificial Sequence
  chemically synthesized
tctataattgcagtataaacaa

SEQ ID NO: 760385 - DNA, 22 bp, Artificial Sequence
  chemically synthesized
ttcctggacatattgtttatac

SEQ ID NO: 760386 - DNA, 22 bp, Artificial Sequence
  chemically synthesized
ctataattgcagtataaacaat

SEQ ID NO: 760387 - DNA, 22 bp, Artificial Sequence
  chemically synthesized
tataattgcagtataaacaata

SEQ ID NO: 760388 - DNA, 22 bp, Artificial Sequence
  chemically synthesized
taattgcagtataaacaatatg

SEQ ID NO: 760389 - DNA, 22 bp, Artificial Sequence
  chemically synthesized
atttttcctggacatattgttt

SEQ ID NO: 760390 - DNA, 22 bp, Artificial Sequence
  chemically synthesized
catttttcctggacatattgtt

SEQ ID NO: 760391 - DNA, 22 bp, Artificial Sequence
  chemically synthesized
cagtataaacaatatgtccagg

SEQ ID NO: 760392 - DNA, 22 bp, Artificial Sequence
  chemically synthesized
atggaaatgccttcatttttcc

SEQ ID NO: 760393 - DNA, 22 bp, Artificial Sequence
  chemically synthesized
gatggaaatgccttcatttttc

SEQ ID NO: 760394 - DNA, 22 bp, Artificial Sequence
  chemically synthesized
tttgatggaaatgccttcattt

SEQ ID NO: 760395 - DNA, 22 bp, Artificial Sequence
  chemically synthesized
atttgatggaaatgccttcatt

SEQ ID NO: 760396 - DNA, 22 bp, Artificial Sequence
  chemically synthesized
tcttatttgatggaaatgcctt

SEQ ID NO: 760397 - DNA, 22 bp, Artificial Sequence
  chemically synthesized
atcttatttgatggaaatgcct

SEQ ID NO: 760398 - DNA, 22 bp, Artificial Sequence
  chemically synthesized
atttatcttatttgatggaaat

SEQ ID NO: 760399 - DNA, 22 bp, Artificial Sequence
  chemically synthesized
aatttatcttatttgatggaaa

SEQ ID NO: 760400 - DNA, 22 bp, Artificial Sequence
  chemically synthesized
gaacaatttaatttatcttatt

SEQ ID NO: 760401 - DNA, 22 bp, Artificial Sequence
  chemically synthesized
ccatcaaataagataaattaaa

SEQ ID NO: 760402 - DNA, 22 bp, Artificial Sequence
  chemically synthesized
catcaaataagataaattaaat

SEQ ID NO: 760403 - DNA, 22 bp, Artificial Sequence
  chemically synthesized
gagtctggaacaatttaattta

SEQ ID NO: 760404 - DNA, 22 bp, Artificial Sequence
  chemically synthesized
agagtctggaacaatttaattt

SEQ ID NO: 760405 - DNA, 22 bp, Artificial Sequence
  chemically synthesized
ggaaataatacccttagagtct

SEQ ID NO: 760406 - DNA, 22 bp, Artificial Sequence
  chemically synthesized
gggaaataatacccttagagtc

SEQ ID NO: 760407 - DNA, 22 bp, Artificial Sequence
  chemically synthesized
aattgttccagactctaagggt

SEQ ID NO: 760408 - DNA, 22 bp, Artificial Sequence
  chemically synthesized
ttgggaaataatacccttagag

SEQ ID NO: 760409 - DNA, 22 bp, Artificial Sequence
  chemically synthesized
ttccagactctaagggtattat

SEQ ID NO: 760410 - DNA, 22 bp, Artificial Sequence
  chemically synthesized
agttcttgggaaataataccct

SEQ ID NO: 760411 - DNA, 22 bp, Artificial Sequence
  chemically synthesized
cagactctaagggtattatttc

SEQ ID NO: 760412 - DNA, 22 bp, Artificial Sequence
  chemically synthesized
acgattcagttcttgggaaata

SEQ ID NO: 760413 - DNA, 22 bp, Artificial Sequence
  chemically synthesized
cacgattcagttcttgggaaat

SEQ ID NO: 760414 - DNA, 22 bp, Artificial Sequence
  chemically synthesized
taagggtattatttcccaagaa

SEQ ID NO: 760415 - DNA, 22 bp, Artificial Sequence
  chemically synthesized
agggtattatttcccaagaact

SEQ ID NO: 760416 - DNA, 22 bp, Artificial Sequence
  chemically synthesized
tggtatttcacgattcagttct

SEQ ID NO: 760417 - DNA, 22 bp, Artificial Sequence
  chemically synthesized
atggtatttcacgattcagttc

SEQ ID NO: 760418 - DNA, 22 bp, Artificial Sequence
  chemically synthesized
tttcccaagaactgaatcgtga

SEQ ID NO: 760419 - DNA, 22 bp, Artificial Sequence
  chemically synthesized
cccaagaactgaatcgtgaaat

SEQ ID NO: 760420 - DNA, 22 bp, Artificial Sequence
  chemically synthesized
ccaagaactgaatcgtgaaata

SEQ ID NO: 760421 - DNA, 22 bp, Artificial Sequence
  chemically synthesized
atgacatttatggtatttcacg

SEQ ID NO: 760422 - DNA, 22 bp, Artificial Sequence
  chemically synthesized
aattcatgacatttatggtatt

SEQ ID NO: 760423 - DNA, 22 bp, Artificial Sequence
  chemically synthesized
aatcgtgaaataccataaatgt

SEQ ID NO: 760424 - DNA, 22 bp, Artificial Sequence
  chemically synthesized
tattcaattcatgacatttatg

SEQ ID NO: 760425 - DNA, 22 bp, Artificial Sequence
  chemically synthesized
ttatattcaattcatgacattt

SEQ ID NO: 760426 - DNA, 22 bp, Artificial Sequence
  chemically synthesized
catgcactattatattcaattc

SEQ ID NO: 760427 - DNA, 22 bp, Artificial Sequence
  chemically synthesized
tatgcaatctgcatgcactatt

SEQ ID NO: 760428 - DNA, 22 bp, Artificial Sequence
  chemically synthesized
attgtatgcaatctgcatgcac

SEQ ID NO: 760429 - DNA, 22 bp, Artificial Sequence
  chemically synthesized
taattgtatgcaatctgcatgc

SEQ ID NO: 760430 - DNA, 22 bp, Artificial Sequence
  chemically synthesized
aatataatagtgcatgcagatt

SEQ ID NO: 760431 - DNA, 22 bp, Artificial Sequence
  chemically synthesized
acctctaattgtatgcaatctg

SEQ ID NO: 760432 - DNA, 22 bp, Artificial Sequence
  chemically synthesized
catacaattagaggtcagttct

SEQ ID NO: 760433 - DNA, 22 bp, Artificial Sequence
  chemically synthesized
gaggtcagttcttttatgtttc

SEQ ID NO: 760434 - DNA, 22 bp, Artificial Sequence
  chemically synthesized
aaaggatggtacagaaacataa

SEQ ID NO: 760435 - DNA, 22 bp, Artificial Sequence
  chemically synthesized
ttttatgtttctgtaccatcct

SEQ ID NO: 760436 - DNA, 22 bp, Artificial Sequence
  chemically synthesized
ttatgtttctgtaccatccttt

SEQ ID NO: 760437 - DNA, 22 bp, Artificial Sequence
  chemically synthesized
tatgtttctgtaccatcctttc

SEQ ID NO: 760438 - DNA, 22 bp, Artificial Sequence
  chemically synthesized
atgtttctgtaccatcctttca

SEQ ID NO: 760439 - DNA, 22 bp, Artificial Sequence
  chemically synthesized
tgtttctgtaccatcctttcag

SEQ ID NO: 760440 - DNA, 22 bp, Artificial Sequence
  chemically synthesized
ctgtaccatcctttcagttacc

SEQ ID NO: 760441 - DNA, 22 bp, Artificial Sequence
  chemically synthesized
tcatggaaaagtggtaactgaa

SEQ ID NO: 760442 - DNA, 22 bp, Artificial Sequence
  chemically synthesized
tgtaccatcctttcagttacca

SEQ ID NO: 760443 - DNA, 22 bp, Artificial Sequence
  chemically synthesized
atcatggaaaagtggtaactga

SEQ ID NO: 760444 - DNA, 22 bp, Artificial Sequence
  chemically synthesized
taccatcctttcagttaccact

SEQ ID NO: 760445 - DNA, 22 bp, Artificial Sequence
  chemically synthesized
ggcttatcatggaaaagtggta

SEQ ID NO: 760446 - DNA, 22 bp, Artificial Sequence
  chemically synthesized
aggcttatcatggaaaagtggt

SEQ ID NO: 760447 - DNA, 22 bp, Artificial Sequence
  chemically synthesized
tcagttaccacttttccatgat

SEQ ID NO: 760448 - DNA, 22 bp, Artificial Sequence
  chemically synthesized
tcgcttaggcttatcatggaaa

SEQ ID NO: 760449 - DNA, 22 bp, Artificial Sequence
  chemically synthesized
cagttaccacttttccatgata

SEQ ID NO: 760450 - DNA, 22 bp, Artificial Sequence
  chemically synthesized
agttaccacttttccatgataa

SEQ ID NO: 760451 - DNA, 22 bp, Artificial Sequence
  chemically synthesized
ccacttttccatgataagccta

SEQ ID NO: 760452 - DNA, 22 bp, Artificial Sequence
  chemically synthesized
catggggaattgtcgcttaggc

SEQ ID NO: 760453 - DNA, 22 bp, Artificial Sequence
  chemically synthesized
ttccatgataagcctaagcgac

SEQ ID NO: 760454 - DNA, 22 bp, Artificial Sequence
  chemically synthesized
gcatggggaattgtcgcttagg

SEQ ID NO: 760455 - DNA, 22 bp, Artificial Sequence
  chemically synthesized
tccatgataagcctaagcgaca

SEQ ID NO: 760456 - DNA, 22 bp, Artificial Sequence
  chemically synthesized
ccatgataagcctaagcgacaa

SEQ ID NO: 760457 - DNA, 22 bp, Artificial Sequence
  chemically synthesized
catgataagcctaagcgacaat

SEQ ID NO: 760458 - DNA, 22 bp, Artificial Sequence
  chemically synthesized
aaatcttgcatggggaattgtc

SEQ ID NO: 760459 - DNA, 22 bp, Artificial Sequence
  chemically synthesized
aacagctaaaatcttgcatggg

SEQ ID NO: 760460 - DNA, 22 bp, Artificial Sequence
  chemically synthesized
agcgacaattccccatgcaaga

SEQ ID NO: 760461 - DNA, 22 bp, Artificial Sequence
  chemically synthesized
ttaaacagctaaaatcttgcat

SEQ ID NO: 760462 - DNA, 22 bp, Artificial Sequence
  chemically synthesized
catgctattaaacagctaaaat

SEQ ID NO: 760463 - DNA, 22 bp, Artificial Sequence
  chemically synthesized
cccatgcaagattttagctgtt

SEQ ID NO: 760464 - DNA, 22 bp, Artificial Sequence
  chemically synthesized
cacattacatgctattaaacag

SEQ ID NO: 760465 - DNA, 22 bp, Artificial Sequence
  chemically synthesized
accattacacattacatgctat

SEQ ID NO: 760466 - DNA, 22 bp, Artificial Sequence
  chemically synthesized
aaccattacacattacatgcta

SEQ ID NO: 760467 - DNA, 22 bp, Artificial Sequence
  chemically synthesized
tagctgtttaatagcatgtaat

SEQ ID NO: 760468 - DNA, 22 bp, Artificial Sequence
  chemically synthesized
agctgtttaatagcatgtaatg

SEQ ID NO: 760469 - DNA, 22 bp, Artificial Sequence
  chemically synthesized
gctgtttaatagcatgtaatgt

SEQ ID NO: 760470 - DNA, 22 bp, Artificial Sequence
  chemically synthesized
gtttaaccattacacattacat

SEQ ID NO: 760471 - DNA, 22 bp, Artificial Sequence
  chemically synthesized
tttaatagcatgtaatgtgtaa

SEQ ID NO: 760472 - DNA, 22 bp, Artificial Sequence
  chemically synthesized
aatagcatgtaatgtgtaatgg

SEQ ID NO: 760473 - DNA, 22 bp, Artificial Sequence
  chemically synthesized
atagcatgtaatgtgtaatggt

SEQ ID NO: 760474 - DNA, 22 bp, Artificial Sequence
  chemically synthesized
cagacaccccaaggaattcgtt

SEQ ID NO: 760475 - DNA, 22 bp, Artificial Sequence
  chemically synthesized
tgaattccagacaccccaagga

SEQ ID NO: 760476 - DNA, 22 bp, Artificial Sequence
  chemically synthesized
aacgaattccttggggtgtctg

SEQ ID NO: 760477 - DNA, 22 bp, Artificial Sequence
  chemically synthesized
cttggggtgtctggaattcaca

SEQ ID NO: 760478 - DNA, 22 bp, Artificial Sequence
  chemically synthesized
aaagggaccaagctgtgaattc

SEQ ID NO: 760479 - DNA, 22 bp, Artificial Sequence
  chemically synthesized
ggggtgtctggaattcacagct

SEQ ID NO: 760480 - DNA, 22 bp, Artificial Sequence
  chemically synthesized
tcaaagggaccaagctgtgaat

SEQ ID NO: 760481 - DNA, 22 bp, Artificial Sequence
  chemically synthesized
gggtgtctggaattcacagctt

SEQ ID NO: 760482 - DNA, 22 bp, Artificial Sequence
  chemically synthesized
actctcaaagggaccaagctgt

SEQ ID NO: 760483 - DNA, 22 bp, Artificial Sequence
  chemically synthesized
cactctcaaagggaccaagctg

SEQ ID NO: 760484 - DNA, 22 bp, Artificial Sequence
  chemically synthesized
tcactctcaaagggaccaagct

SEQ ID NO: 760485 - DNA, 22 bp, Artificial Sequence
  chemically synthesized
ttcactctcaaagggaccaagc

SEQ ID NO: 760486 - DNA, 22 bp, Artificial Sequence
  chemically synthesized
ttttcactctcaaagggaccaa

SEQ ID NO: 760487 - DNA, 22 bp, Artificial Sequence
  chemically synthesized
gaattcacagcttggtcccttt

SEQ ID NO: 760488 - DNA, 22 bp, Artificial Sequence
  chemically synthesized
acagcttggtccctttgagagt

SEQ ID NO: 760489 - DNA, 22 bp, Artificial Sequence
  chemically synthesized
acagcctcttttcactctcaaa

SEQ ID NO: 760490 - DNA, 22 bp, Artificial Sequence
  chemically synthesized
gacagcctcttttcactctcaa

SEQ ID NO: 760491 - DNA, 22 bp, Artificial Sequence
  chemically synthesized
cttgacagcctcttttcactct

SEQ ID NO: 760492 - DNA, 22 bp, Artificial Sequence
  chemically synthesized
ggtccctttgagagtgaaaaga

SEQ ID NO: 760493 - DNA, 22 bp, Artificial Sequence
  chemically synthesized
gtccctttgagagtgaaaagag

SEQ ID NO: 760494 - DNA, 22 bp, Artificial Sequence
  chemically synthesized
tgagagtgaaaagaggctgtca

SEQ ID NO: 760495 - DNA, 22 bp, Artificial Sequence
  chemically synthesized
gagagtgaaaagaggctgtcaa

SEQ ID NO: 760496 - DNA, 22 bp, Artificial Sequence
  chemically synthesized
aatatgtcctgcttgacagcct

SEQ ID NO: 760497 - DNA, 22 bp, Artificial Sequence
  chemically synthesized
agagtgaaaagaggctgtcaag

SEQ ID NO: 760498 - DNA, 22 bp, Artificial Sequence
  chemically synthesized
caatatgtcctgcttgacagcc

SEQ ID NO: 760499 - DNA, 22 bp, Artificial Sequence
  chemically synthesized
tcaatatgtcctgcttgacagc

SEQ ID NO: 760500 - DNA, 22 bp, Artificial Sequence
  chemically synthesized
ttcaatatgtcctgcttgacag

SEQ ID NO: 760501 - DNA, 22 bp, Artificial Sequence
  chemically synthesized
cttttcaatatgtcctgcttga

SEQ ID NO: 760502 - DNA, 22 bp, Artificial Sequence
  chemically synthesized
cacctacttttcaatatgtcct

SEQ ID NO: 760503 - DNA, 22 bp, Artificial Sequence
  chemically synthesized
tccacctacttttcaatatgtc

SEQ ID NO: 760504 - DNA, 22 bp, Artificial Sequence
  chemically synthesized
tctccacctacttttcaatatg

SEQ ID NO: 760505 - DNA, 22 bp, Artificial Sequence
  chemically synthesized
tcaagcaggacatattgaaaag

SEQ ID NO: 760506 - DNA, 22 bp, Artificial Sequence
  chemically synthesized
cctctctccacctacttttcaa

SEQ ID NO: 760507 - DNA, 22 bp, Artificial Sequence
  chemically synthesized
agccctacctctctccacctac

SEQ ID NO: 760508 - DNA, 22 bp, Artificial Sequence
  chemically synthesized
aaaagtaggtggagagaggtag

SEQ ID NO: 760509 - DNA, 22 bp, Artificial Sequence
  chemically synthesized
catgtctgagccctacctctct

SEQ ID NO: 760510 - DNA, 22 bp, Artificial Sequence
  chemically synthesized
ccatgtctgagccctacctctc

SEQ ID NO: 760511 - DNA, 22 bp, Artificial Sequence
  chemically synthesized
tccatgtctgagccctacctct

SEQ ID NO: 760512 - DNA, 22 bp, Artificial Sequence
  chemically synthesized
ttccatgtctgagccctacctc

SEQ ID NO: 760513 - DNA, 22 bp, Artificial Sequence
  chemically synthesized
cttttccatgtctgagccctac

SEQ ID NO: 760514 - DNA, 22 bp, Artificial Sequence
  chemically synthesized
ctgcttttccatgtctgagccc

SEQ ID NO: 760515 - DNA, 22 bp, Artificial Sequence
  chemically synthesized
gctgcttttccatgtctgagcc

SEQ ID NO: 760516 - DNA, 22 bp, Artificial Sequence
  chemically synthesized
ccatttgctgcttttccatgtc

SEQ ID NO: 760517 - DNA, 22 bp, Artificial Sequence
  chemically synthesized
taccatttgctgcttttccatg

SEQ ID NO: 760518 - DNA, 22 bp, Artificial Sequence
  chemically synthesized
ctaccatttgctgcttttccat

SEQ ID NO: 760519 - DNA, 22 bp, Artificial Sequence
  chemically synthesized
tctaccatttgctgcttttcca

SEQ ID NO: 760520 - DNA, 22 bp, Artificial Sequence
  chemically synthesized
ttctaccatttgctgcttttcc

SEQ ID NO: 760521 - DNA, 22 bp, Artificial Sequence
  chemically synthesized
agacatggaaaagcagcaaatg

SEQ ID NO: 760522 - DNA, 22 bp, Artificial Sequence
  chemically synthesized
atcagtgtcttttctaccattt

SEQ ID NO: 760523 - DNA, 22 bp, Artificial Sequence
  chemically synthesized
aatcagtgtcttttctaccatt

SEQ ID NO: 760524 - DNA, 22 bp, Artificial Sequence
  chemically synthesized
tttaatcagtgtcttttctacc

SEQ ID NO: 760525 - DNA, 22 bp, Artificial Sequence
  chemically synthesized
atttaatcagtgtcttttctac

SEQ ID NO: 760526 - DNA, 22 bp, Artificial Sequence
  chemically synthesized
ggggcagtcaataaatatttat

SEQ ID NO: 760527 - DNA, 22 bp, Artificial Sequence
  chemically synthesized
aggggcagtcaataaatattta

SEQ ID NO: 760528 - DNA, 22 bp, Artificial Sequence
  chemically synthesized
attaaataaatatttattgact

SEQ ID NO: 760529 - DNA, 22 bp, Artificial Sequence
  chemically synthesized
gagacttaggggcagtcaataa

SEQ ID NO: 760530 - DNA, 22 bp, Artificial Sequence
  chemically synthesized
aataaatatttattgactgccc

SEQ ID NO: 760531 - DNA, 22 bp, Artificial Sequence
  chemically synthesized
attgactgcccctaagtctcta

SEQ ID NO: 760532 - DNA, 22 bp, Artificial Sequence
  chemically synthesized
cccaatgtatcctagagactta

SEQ ID NO: 760533 - DNA, 22 bp, Artificial Sequence
  chemically synthesized
ttgactgcccctaagtctctag

SEQ ID NO: 760534 - DNA, 22 bp, Artificial Sequence
  chemically synthesized
ctccccaatgtatcctagagac

SEQ ID NO: 760535 - DNA, 22 bp, Artificial Sequence
  chemically synthesized
actgcccctaagtctctaggat

SEQ ID NO: 760536 - DNA, 22 bp, Artificial Sequence
  chemically synthesized
cctactccccaatgtatcctag

SEQ ID NO: 760537 - DNA, 22 bp, Artificial Sequence
  chemically synthesized
cccctaagtctctaggatacat

SEQ ID NO: 760538 - DNA, 22 bp, Artificial Sequence
  chemically synthesized
tccctactccccaatgtatcct

SEQ ID NO: 760539 - DNA, 22 bp, Artificial Sequence
  chemically synthesized
tctccctactccccaatgtatc

SEQ ID NO: 760540 - DNA, 22 bp, Artificial Sequence
  chemically synthesized
agtctctaggatacattgggga

SEQ ID NO: 760541 - DNA, 22 bp, Artificial Sequence
  chemically synthesized
ctctctccctactccccaatgt

SEQ ID NO: 760542 - DNA, 22 bp, Artificial Sequence
  chemically synthesized
cctctctccctactccccaatg

SEQ ID NO: 760543 - DNA, 22 bp, Artificial Sequence
  chemically synthesized
ccttcctctctccctactcccc

SEQ ID NO: 760544 - DNA, 22 bp, Artificial Sequence
  chemically synthesized
taggatacattggggagtaggg

SEQ ID NO: 760545 - DNA, 22 bp, Artificial Sequence
  chemically synthesized
cccttcctctctccctactccc

SEQ ID NO: 760546 - DNA, 22 bp, Artificial Sequence
  chemically synthesized
ggatacattggggagtagggag

SEQ ID NO: 760547 - DNA, 22 bp, Artificial Sequence
  chemically synthesized
ttcccttcctctctccctactc

SEQ ID NO: 760548 - DNA, 22 bp, Artificial Sequence
  chemically synthesized
tcttcccttcctctctccctac

SEQ ID NO: 760549 - DNA, 22 bp, Artificial Sequence
  chemically synthesized
tctcttcccttcctctctccct

SEQ ID NO: 760550 - DNA, 22 bp, Artificial Sequence
  chemically synthesized
tattctctcttcccttcctctc

SEQ ID NO: 760551 - DNA, 22 bp, Artificial Sequence
  chemically synthesized
gggagtagggagagaggaaggg

SEQ ID NO: 760552 - DNA, 22 bp, Artificial Sequence
  chemically synthesized
gtcatcgttatattctctcttc

SEQ ID NO: 760553 - DNA, 22 bp, Artificial Sequence
  chemically synthesized
ccaggcagacagaggccaaaca

SEQ ID NO: 760554 - DNA, 22 bp, Artificial Sequence
  chemically synthesized
taccaggcagacagaggccaaa

SEQ ID NO: 760555 - DNA, 22 bp, Artificial Sequence
  chemically synthesized
ctctaccaggcagacagaggcc

SEQ ID NO: 760556 - DNA, 22 bp, Artificial Sequence
  chemically synthesized
cctctaccaggcagacagaggc

SEQ ID NO: 760557 - DNA, 22 bp, Artificial Sequence
  chemically synthesized
tttcctctaccaggcagacaga

SEQ ID NO: 760558 - DNA, 22 bp, Artificial Sequence
  chemically synthesized
gtttcctctaccaggcagacag

SEQ ID NO: 760559 - DNA, 22 bp, Artificial Sequence
  chemically synthesized
atgtttggcctctgtctgcctg

SEQ ID NO: 760560 - DNA, 22 bp, Artificial Sequence
  chemically synthesized
tgtttcctctaccaggcagaca

SEQ ID NO: 760561 - DNA, 22 bp, Artificial Sequence
  chemically synthesized
ggcctctgtctgcctggtagag

SEQ ID NO: 760562 - DNA, 22 bp, Artificial Sequence
  chemically synthesized
gcctctgtctgcctggtagagg

SEQ ID NO: 760563 - DNA, 22 bp, Artificial Sequence
  chemically synthesized
tgtctgcctggtagaggaaaca

SEQ ID NO: 760564 - DNA, 22 bp, Artificial Sequence
  chemically synthesized
tctgcctggtagaggaaacaaa

SEQ ID NO: 760565 - DNA, 22 bp, Artificial Sequence
  chemically synthesized
ccacaaggatattttgtttcct

SEQ ID NO: 760566 - DNA, 22 bp, Artificial Sequence
  chemically synthesized
tgccacaaggatattttgtttc

SEQ ID NO: 760567 - DNA, 22 bp, Artificial Sequence
  chemically synthesized
cctggtagaggaaacaaaatat

SEQ ID NO: 760568 - DNA, 22 bp, Artificial Sequence
  chemically synthesized
tctgccacaaggatattttgtt

SEQ ID NO: 760569 - DNA, 22 bp, Artificial Sequence
  chemically synthesized
gtagaggaaacaaaatatcctt

SEQ ID NO: 760570 - DNA, 22 bp, Artificial Sequence
  chemically synthesized
gacctctctgccacaaggatat

SEQ ID NO: 760571 - DNA, 22 bp, Artificial Sequence
  chemically synthesized
tagacctctctgccacaaggat

SEQ ID NO: 760572 - DNA, 22 bp, Artificial Sequence
  chemically synthesized
ctctagacctctctgccacaag

SEQ ID NO: 760573 - DNA, 22 bp, Artificial Sequence
  chemically synthesized
tatcctcctctagacctctctg

SEQ ID NO: 760574 - DNA, 22 bp, Artificial Sequence
  chemically synthesized
actatatcctcctctagacctc

SEQ ID NO: 760575 - DNA, 22 bp, Artificial Sequence
  chemically synthesized
cactatatcctcctctagacct

SEQ ID NO: 760576 - DNA, 22 bp, Artificial Sequence
  chemically synthesized
gtggcagagaggtctagaggag

SEQ ID NO: 760577 - DNA, 22 bp, Artificial Sequence
  chemically synthesized
tggcagagaggtctagaggagg

SEQ ID NO: 760578 - DNA, 22 bp, Artificial Sequence
  chemically synthesized
cccttcactatatcctcctcta

SEQ ID NO: 760579 - DNA, 22 bp, Artificial Sequence
  chemically synthesized
gaggaggatatagtgaagggca

SEQ ID NO: 760580 - DNA, 22 bp, Artificial Sequence
  chemically synthesized
acataggcagcctgcccttcac

SEQ ID NO: 760581 - DNA, 22 bp, Artificial Sequence
  chemically synthesized
aacataggcagcctgcccttca

SEQ ID NO: 760582 - DNA, 22 bp, Artificial Sequence
  chemically synthesized
aggtcttaacataggcagcctg

SEQ ID NO: 760583 - DNA, 22 bp, Artificial Sequence
  chemically synthesized
gaggtcttaacataggcagcct

SEQ ID NO: 760584 - DNA, 22 bp, Artificial Sequence
  chemically synthesized
cctatgttaagacctcaagctg

SEQ ID NO: 760585 - DNA, 22 bp, Artificial Sequence
  chemically synthesized
cataaacaaagccgcagcttga

SEQ ID NO: 760586 - DNA, 22 bp, Artificial Sequence
  chemically synthesized
acataaacaaagccgcagcttg

SEQ ID NO: 760587 - DNA, 22 bp, Artificial Sequence
  chemically synthesized
tgttaagacctcaagctgcggc

SEQ ID NO: 760588 - DNA, 22 bp, Artificial Sequence
  chemically synthesized
cttacataaacaaagccgcagc

SEQ ID NO: 760589 - DNA, 22 bp, Artificial Sequence
  chemically synthesized
ccttacataaacaaagccgcag

SEQ ID NO: 760590 - DNA, 22 bp, Artificial Sequence
  chemically synthesized
agacctcaagctgcggctttgt

SEQ ID NO: 760591 - DNA, 22 bp, Artificial Sequence
  chemically synthesized
gcacttccttacataaacaaag

SEQ ID NO: 760592 - DNA, 22 bp, Artificial Sequence
  chemically synthesized
agcacttccttacataaacaaa

SEQ ID NO: 760593 - DNA, 22 bp, Artificial Sequence
  chemically synthesized
tagcacttccttacataaacaa

SEQ ID NO: 760594 - DNA, 22 bp, Artificial Sequence
  chemically synthesized
aagctgcggctttgtttatgta

SEQ ID NO: 760595 - DNA, 22 bp, Artificial Sequence
  chemically synthesized
gaattttagcacttccttacat

SEQ ID NO: 760596 - DNA, 22 bp, Artificial Sequence
  chemically synthesized
cggctttgtttatgtaaggaag

SEQ ID NO: 760597 - DNA, 22 bp, Artificial Sequence
  chemically synthesized
gaactggaattttagcacttcc

SEQ ID NO: 760598 - DNA, 22 bp, Artificial Sequence
  chemically synthesized
tgtttatgtaaggaagtgctaa

SEQ ID NO: 760599 - DNA, 22 bp, Artificial Sequence
  chemically synthesized
gtttatgtaaggaagtgctaaa

SEQ ID NO: 760600 - DNA, 22 bp, Artificial Sequence
  chemically synthesized
tttatgtaaggaagtgctaaaa

SEQ ID NO: 760601 - DNA, 22 bp, Artificial Sequence
  chemically synthesized
acctagaactggaattttagca

SEQ ID NO: 760602 - DNA, 22 bp, Artificial Sequence
  chemically synthesized
atgtaaggaagtgctaaaattc

SEQ ID NO: 760603 - DNA, 22 bp, Artificial Sequence
  chemically synthesized
aacctagaactggaattttagc

SEQ ID NO: 760604 - DNA, 22 bp, Artificial Sequence
  chemically synthesized
tgtaaggaagtgctaaaattcc

SEQ ID NO: 760605 - DNA, 22 bp, Artificial Sequence
  chemically synthesized
aaattccagttctaggttaaat

SEQ ID NO: 760606 - DNA, 22 bp, Artificial Sequence
  chemically synthesized
ataatgagtcagcaccatttaa

SEQ ID NO: 760607 - DNA, 22 bp, Artificial Sequence
  chemically synthesized
cagttctaggttaaatggtgct

SEQ ID NO: 760608 - DNA, 22 bp, Artificial Sequence
  chemically synthesized
taggttaaatggtgctgactca

SEQ ID NO: 760609 - DNA, 22 bp, Artificial Sequence
  chemically synthesized
acccactaataatgagtcagca

SEQ ID NO: 760610 - DNA, 22 bp, Artificial Sequence
  chemically synthesized
ggttaaatggtgctgactcatt

SEQ ID NO: 760611 - DNA, 22 bp, Artificial Sequence
  chemically synthesized
attgacccactaataatgagtc

SEQ ID NO: 760612 - DNA, 22 bp, Artificial Sequence
  chemically synthesized
aatggtgctgactcattattag

SEQ ID NO: 760613 - DNA, 22 bp, Artificial Sequence
  chemically synthesized
aaggggttcattgacccactaa

SEQ ID NO: 760614 - DNA, 22 bp, Artificial Sequence
  chemically synthesized
actcattattagtgggtcaatg

SEQ ID NO: 760615 - DNA, 22 bp, Artificial Sequence
  chemically synthesized
attattagtgggtcaatgaacc

SEQ ID NO: 760616 - DNA, 22 bp, Artificial Sequence
  chemically synthesized
ggggacctaaaggggttcattg

SEQ ID NO: 760617 - DNA, 22 bp, Artificial Sequence
  chemically synthesized
aggggacctaaaggggttcatt

SEQ ID NO: 760618 - DNA, 22 bp, Artificial Sequence
  chemically synthesized
ttagtgggtcaatgaacccctt

SEQ ID NO: 760619 - DNA, 22 bp, Artificial Sequence
  chemically synthesized
ttaggggacctaaaggggttca

SEQ ID NO: 760620 - DNA, 22 bp, Artificial Sequence
  chemically synthesized
tcttaggggacctaaaggggtt

SEQ ID NO: 760621 - DNA, 22 bp, Artificial Sequence
  chemically synthesized
gtgggtcaatgaacccctttag

SEQ ID NO: 760622 - DNA, 22 bp, Artificial Sequence
  chemically synthesized
tctcttaggggacctaaagggg

SEQ ID NO: 760623 - DNA, 22 bp, Artificial Sequence
  chemically synthesized
ctctctcttaggggacctaaag

SEQ ID NO: 760624 - DNA, 22 bp, Artificial Sequence
  chemically synthesized
gctctctcttaggggacctaaa

SEQ ID NO: 760625 - DNA, 22 bp, Artificial Sequence
  chemically synthesized
tgctctctcttaggggacctaa

SEQ ID NO: 760626 - DNA, 22 bp, Artificial Sequence
  chemically synthesized
ttttgctctctcttaggggacc

SEQ ID NO: 760627 - DNA, 22 bp, Artificial Sequence
  chemically synthesized
agttattttgctctctcttagg

SEQ ID NO: 760628 - DNA, 22 bp, Artificial Sequence
  chemically synthesized
taggtcccctaagagagagcaa

SEQ ID NO: 760629 - DNA, 22 bp, Artificial Sequence
  chemically synthesized
aggtcccctaagagagagcaaa

SEQ ID NO: 760630 - DNA, 22 bp, Artificial Sequence
  chemically synthesized
ggtctcagttattttgctctct

SEQ ID NO: 760631 - DNA, 22 bp, Artificial Sequence
  chemically synthesized
ggtcccctaagagagagcaaaa

SEQ ID NO: 760632 - DNA, 22 bp, Artificial Sequence
  chemically synthesized
cctaggtctcagttattttgct

SEQ ID NO: 760633 - DNA, 22 bp, Artificial Sequence
  chemically synthesized
aattccctaggtctcagttatt

SEQ ID NO: 760634 - DNA, 22 bp, Artificial Sequence
  chemically synthesized
agagagagcaaaataactgaga

SEQ ID NO: 760635 - DNA, 22 bp, Artificial Sequence
  chemically synthesized
agacctagggaattcagttctt

SEQ ID NO: 760636 - DNA, 22 bp, Artificial Sequence
  chemically synthesized
gggaattcagttcttttttttt

SEQ ID NO: 760637 - DNA, 22 bp, Artificial Sequence
  chemically synthesized
accaaaaaaaaaaaaaaaaaag

SEQ ID NO: 760638 - DNA, 22 bp, Artificial Sequence
  chemically synthesized
tctcaccaaaaaaaaaaaaaaa

SEQ ID NO: 760639 - DNA, 22 bp, Artificial Sequence
  chemically synthesized
tgtctcaccaaaaaaaaaaaaa

SEQ ID NO: 760640 - DNA, 22 bp, Artificial Sequence
  chemically synthesized
agttcttttttttttttttttt

SEQ ID NO: 760641 - DNA, 22 bp, Artificial Sequence
  chemically synthesized
ttttttttttttttttttggtg

SEQ ID NO: 760642 - DNA, 22 bp, Artificial Sequence
  chemically synthesized
ttttttttttttttttggtgag

SEQ ID NO: 760643 - DNA, 22 bp, Artificial Sequence
  chemically synthesized
tttttttttttttttggtgaga

SEQ ID NO: 760644 - DNA, 22 bp, Artificial Sequence
  chemically synthesized
ttttttttttttttggtgagac

SEQ ID NO: 760645 - DNA, 22 bp, Artificial Sequence
  chemically synthesized
tttttttttttttggtgagaca

SEQ ID NO: 760646 - DNA, 22 bp, Artificial Sequence
  chemically synthesized
ttttttttttttggtgagacag

SEQ ID NO: 760647 - DNA, 22 bp, Artificial Sequence
  chemically synthesized
tttttttttttggtgagacaga

SEQ ID NO: 760648 - DNA, 22 bp, Artificial Sequence
  chemically synthesized
ttttttttttggtgagacagag

SEQ ID NO: 760649 - DNA, 22 bp, Artificial Sequence
  chemically synthesized
tttttttttggtgagacagagt

SEQ ID NO: 760650 - DNA, 22 bp, Artificial Sequence
  chemically synthesized
ttttttttggtgagacagagtc

SEQ ID NO: 760651 - DNA, 22 bp, Artificial Sequence
  chemically synthesized
tttttttggtgagacagagtct

SEQ ID NO: 760652 - DNA, 22 bp, Artificial Sequence
  chemically synthesized
ggtgatagatcaagactctgtc

SEQ ID NO: 760653 - DNA, 22 bp, Artificial Sequence
  chemically synthesized
ttttttggtgagacagagtctt

SEQ ID NO: 760654 - DNA, 22 bp, Artificial Sequence
  chemically synthesized
tttttggtgagacagagtcttg

SEQ ID NO: 760655 - DNA, 22 bp, Artificial Sequence
  chemically synthesized
ttttggtgagacagagtcttga

SEQ ID NO: 760656 - DNA, 22 bp, Artificial Sequence
  chemically synthesized
tttggtgagacagagtcttgat

SEQ ID NO: 760657 - DNA, 22 bp, Artificial Sequence
  chemically synthesized
ttggtgagacagagtcttgatc

SEQ ID NO: 760658 - DNA, 22 bp, Artificial Sequence
  chemically synthesized
tggtgagacagagtcttgatct

SEQ ID NO: 760659 - DNA, 22 bp, Artificial Sequence
  chemically synthesized
ggtgagacagagtcttgatcta

SEQ ID NO: 760660 - DNA, 22 bp, Artificial Sequence
  chemically synthesized
cagcctgggtgatagatcaaga

SEQ ID NO: 760661 - DNA, 22 bp, Artificial Sequence
  chemically synthesized
gtgagacagagtcttgatctat

SEQ ID NO: 760662 - DNA, 22 bp, Artificial Sequence
  chemically synthesized
cactccagcctgggtgatagat

SEQ ID NO: 760663 - DNA, 22 bp, Artificial Sequence
  chemically synthesized
gatctatcacccaggctggagt

SEQ ID NO: 760664 - DNA, 22 bp, Artificial Sequence
  chemically synthesized
atctatcacccaggctggagtg

SEQ ID NO: 760665 - DNA, 22 bp, Artificial Sequence
  chemically synthesized
tcacccaggctggagtgcaatg

SEQ ID NO: 760666 - DNA, 22 bp, Artificial Sequence
  chemically synthesized
gagtgcaatggcacgatcttgg

SEQ ID NO: 760667 - DNA, 22 bp, Artificial Sequence
  chemically synthesized
aacccgggaggtggaggtgcag

SEQ ID NO: 760668 - DNA, 22 bp, Artificial Sequence
  chemically synthesized
gaacccgggaggtggaggtgca

SEQ ID NO: 760669 - DNA, 22 bp, Artificial Sequence
  chemically synthesized
cttgaacccgggaggtggaggt

SEQ ID NO: 760670 - DNA, 22 bp, Artificial Sequence
  chemically synthesized
ggctcactgcacctccacctcc

SEQ ID NO: 760671 - DNA, 22 bp, Artificial Sequence
  chemically synthesized
gctcactgcacctccacctccc

SEQ ID NO: 760672 - DNA, 22 bp, Artificial Sequence
  chemically synthesized
actgcacctccacctcccgggt

SEQ ID NO: 760673 - DNA, 22 bp, Artificial Sequence
  chemically synthesized
cacctccacctcccgggttcaa

SEQ ID NO: 760674 - DNA, 22 bp, Artificial Sequence
  chemically synthesized
atgcaggagaattgcttgaacc

SEQ ID NO: 760675 - DNA, 22 bp, Artificial Sequence
  chemically synthesized
cacctcccgggttcaagcaatt

SEQ ID NO: 760676 - DNA, 22 bp, Artificial Sequence
  chemically synthesized
ggaggctgatgcaggagaattg

SEQ ID NO: 760677 - DNA, 22 bp, Artificial Sequence
  chemically synthesized
ccgggttcaagcaattctcctg

SEQ ID NO: 760678 - DNA, 22 bp, Artificial Sequence
  chemically synthesized
gggaggctgatgcaggagaatt

SEQ ID NO: 760679 - DNA, 22 bp, Artificial Sequence
  chemically synthesized
aagcaattctcctgcatcagcc

SEQ ID NO: 760680 - DNA, 22 bp, Artificial Sequence
  chemically synthesized
taatcccagccacttgggaggc

SEQ ID NO: 760681 - DNA, 22 bp, Artificial Sequence
  chemically synthesized
tcctgcatcagcctcccaagtg

SEQ ID NO: 760682 - DNA, 22 bp, Artificial Sequence
  chemically synthesized
ctgcatcagcctcccaagtggc

SEQ ID NO: 760683 - DNA, 22 bp, Artificial Sequence
  chemically synthesized
catcagcctcccaagtggctgg

SEQ ID NO: 760684 - DNA, 22 bp, Artificial Sequence
  chemically synthesized
ccaagtggctgggattacaggc

SEQ ID NO: 760685 - DNA, 22 bp, Artificial Sequence
  chemically synthesized
ggtgtggtggtgggcgcctgta

SEQ ID NO: 760686 - DNA, 22 bp, Artificial Sequence
  chemically synthesized
gctgggtgtggtggtgggcgcc

SEQ ID NO: 760687 - DNA, 22 bp, Artificial Sequence
  chemically synthesized
ggattacaggcgcccaccacca

SEQ ID NO: 760688 - DNA, 22 bp, Artificial Sequence
  chemically synthesized
caggcgcccaccaccacaccca

SEQ ID NO: 760689 - DNA, 22 bp, Artificial Sequence
  chemically synthesized
aaaataccaaaaattagctggg

SEQ ID NO: 760690 - DNA, 22 bp, Artificial Sequence
  chemically synthesized
ctaaaaataccaaaaattagct

SEQ ID NO: 760691 - DNA, 22 bp, Artificial Sequence
  chemically synthesized
tactaaaaataccaaaaattag

SEQ ID NO: 760692 - DNA, 22 bp, Artificial Sequence
  chemically synthesized
atttttggtatttttagtagag

SEQ ID NO: 760693 - DNA, 22 bp, Artificial Sequence
  chemically synthesized
ttggtatttttagtagagatgg

SEQ ID NO: 760694 - DNA, 22 bp, Artificial Sequence
  chemically synthesized
tggtatttttagtagagatggg

SEQ ID NO: 760695 - DNA, 22 bp, Artificial Sequence
  chemically synthesized
ggtatttttagtagagatgggg

SEQ ID NO: 760696 - DNA, 22 bp, Artificial Sequence
  chemically synthesized
gtatttttagtagagatggggt

SEQ ID NO: 760697 - DNA, 22 bp, Artificial Sequence
  chemically synthesized
gccagcatggcgaaaccccatc

SEQ ID NO: 760698 - DNA, 22 bp, Artificial Sequence
  chemically synthesized
ttagtagagatggggtttcgcc

SEQ ID NO: 760699 - DNA, 22 bp, Artificial Sequence
  chemically synthesized
tagtagagatggggtttcgcca

SEQ ID NO: 760700 - DNA, 22 bp, Artificial Sequence
  chemically synthesized
agtagagatggggtttcgccat

SEQ ID NO: 760701 - DNA, 22 bp, Artificial Sequence
  chemically synthesized
gtagagatggggtttcgccatg

SEQ ID NO: 760702 - DNA, 22 bp, Artificial Sequence
  chemically synthesized
aagaccagcctggccagcatgg

SEQ ID NO: 760703 - DNA, 22 bp, Artificial Sequence
  chemically synthesized
cgccatgctggccaggctggtc

SEQ ID NO: 760704 - DNA, 22 bp, Artificial Sequence
  chemically synthesized
gccatgctggccaggctggtct

SEQ ID NO: 760705 - DNA, 22 bp, Artificial Sequence
  chemically synthesized
aggtcaagagttcaagaccagc

SEQ ID NO: 760706 - DNA, 22 bp, Artificial Sequence
  chemically synthesized
gccaggctggtcttgaactctt

SEQ ID NO: 760707 - DNA, 22 bp, Artificial Sequence
  chemically synthesized
gtcttgaactcttgacctcagg

SEQ ID NO: 760708 - DNA, 22 bp, Artificial Sequence
  chemically synthesized
aggcaggtggatcacctgaggt

SEQ ID NO: 760709 - DNA, 22 bp, Artificial Sequence
  chemically synthesized
gaactcttgacctcaggtgatc

SEQ ID NO: 760710 - DNA, 22 bp, Artificial Sequence
  chemically synthesized
aactcttgacctcaggtgatcc

SEQ ID NO: 760711 - DNA, 22 bp, Artificial Sequence
  chemically synthesized
ggaggctgaggcaggtggatca

SEQ ID NO: 760712 - DNA, 22 bp, Artificial Sequence
  chemically synthesized
ttgacctcaggtgatccacctg

SEQ ID NO: 760713 - DNA, 22 bp, Artificial Sequence
  chemically synthesized
gggaggctgaggcaggtggatc

SEQ ID NO: 760714 - DNA, 22 bp, Artificial Sequence
  chemically synthesized
tgggaggctgaggcaggtggat

SEQ ID NO: 760715 - DNA, 22 bp, Artificial Sequence
  chemically synthesized
gacctcaggtgatccacctgcc

SEQ ID NO: 760716 - DNA, 22 bp, Artificial Sequence
  chemically synthesized
acctcaggtgatccacctgcct

SEQ ID NO: 760717 - DNA, 22 bp, Artificial Sequence
  chemically synthesized
aggtgatccacctgcctcagcc

SEQ ID NO: 760718 - DNA, 22 bp, Artificial Sequence
  chemically synthesized
ccaacactttgggaggctgagg

SEQ ID NO: 760719 - DNA, 22 bp, Artificial Sequence
  chemically synthesized
ctcccaacactttgggaggctg

SEQ ID NO: 760720 - DNA, 22 bp, Artificial Sequence
  chemically synthesized
tactcccaacactttgggaggc

SEQ ID NO: 760721 - DNA, 22 bp, Artificial Sequence
  chemically synthesized
cgcctctactcccaacactttg

SEQ ID NO: 760722 - DNA, 22 bp, Artificial Sequence
  chemically synthesized
cctcagcctcccaaagtgttgg

SEQ ID NO: 760723 - DNA, 22 bp, Artificial Sequence
  chemically synthesized
acgcctctactcccaacacttt

SEQ ID NO: 760724 - DNA, 22 bp, Artificial Sequence
  chemically synthesized
agcctcccaaagtgttgggagt

SEQ ID NO: 760725 - DNA, 22 bp, Artificial Sequence
  chemically synthesized
ccaaagtgttgggagtagaggc

SEQ ID NO: 760726 - DNA, 22 bp, Artificial Sequence
  chemically synthesized
ggtgtggtagcttacgcctcta

SEQ ID NO: 760727 - DNA, 22 bp, Artificial Sequence
  chemically synthesized
ccggctgggtgtggtagcttac

SEQ ID NO: 760728 - DNA, 22 bp, Artificial Sequence
  chemically synthesized
ggagtagaggcgtaagctacca

SEQ ID NO: 760729 - DNA, 22 bp, Artificial Sequence
  chemically synthesized
aattcccggctgggtgtggtag

SEQ ID NO: 760730 - DNA, 22 bp, Artificial Sequence
  chemically synthesized
gaactgaattcccggctgggtg

SEQ ID NO: 760731 - DNA, 22 bp, Artificial Sequence
  chemically synthesized
agaactgaattcccggctgggt

SEQ ID NO: 760732 - DNA, 22 bp, Artificial Sequence
  chemically synthesized
tagaactgaattcccggctggg

SEQ ID NO: 760733 - DNA, 22 bp, Artificial Sequence
  chemically synthesized
ccacacccagccgggaattcag

SEQ ID NO: 760734 - DNA, 22 bp, Artificial Sequence
  chemically synthesized
gatcctttagaactgaattccc

SEQ ID NO: 760735 - DNA, 22 bp, Artificial Sequence
  chemically synthesized
agatcctttagaactgaattcc

SEQ ID NO: 760736 - DNA, 22 bp, Artificial Sequence
  chemically synthesized
ttagatcctttagaactgaatt

SEQ ID NO: 760737 - DNA, 22 bp, Artificial Sequence
  chemically synthesized
tcttagatcctttagaactgaa

SEQ ID NO: 760738 - DNA, 22 bp, Artificial Sequence
  chemically synthesized
ctcttagatcctttagaactga

SEQ ID NO: 760739 - DNA, 22 bp, Artificial Sequence
  chemically synthesized
agtttctcttagatcctttaga

SEQ ID NO: 760740 - DNA, 22 bp, Artificial Sequence
  chemically synthesized
ttaagtttctcttagatccttt

SEQ ID NO: 760741 - DNA, 22 bp, Artificial Sequence
  chemically synthesized
agttctaaaggatctaagagaa

SEQ ID NO: 760742 - DNA, 22 bp, Artificial Sequence
  chemically synthesized
atgctattaagtttctcttaga

SEQ ID NO: 760743 - DNA, 22 bp, Artificial Sequence
  chemically synthesized
catgctattaagtttctcttag

SEQ ID NO: 760744 - DNA, 22 bp, Artificial Sequence
  chemically synthesized
tttcatgctattaagtttctct

SEQ ID NO: 760745 - DNA, 22 bp, Artificial Sequence
  chemically synthesized
taaaggatctaagagaaactta

SEQ ID NO: 760746 - DNA, 22 bp, Artificial Sequence
  chemically synthesized
aaggatctaagagaaacttaat

SEQ ID NO: 760747 - DNA, 22 bp, Artificial Sequence
  chemically synthesized
cctatttcatgctattaagttt

SEQ ID NO: 760748 - DNA, 22 bp, Artificial Sequence
  chemically synthesized
ccctatttcatgctattaagtt

SEQ ID NO: 760749 - DNA, 22 bp, Artificial Sequence
  chemically synthesized
agagaaacttaatagcatgaaa

SEQ ID NO: 760750 - DNA, 22 bp, Artificial Sequence
  chemically synthesized
acaacttccctatttcatgcta

SEQ ID NO: 760751 - DNA, 22 bp, Artificial Sequence
  chemically synthesized
taacaacttccctatttcatgc

SEQ ID NO: 760752 - DNA, 22 bp, Artificial Sequence
  chemically synthesized
ctaacaacttccctatttcatg

SEQ ID NO: 760753 - DNA, 22 bp, Artificial Sequence
  chemically synthesized
gcttctaacaacttccctattt

SEQ ID NO: 760754 - DNA, 22 bp, Artificial Sequence
  chemically synthesized
aatagcatgaaatagggaagtt

SEQ ID NO: 760755 - DNA, 22 bp, Artificial Sequence
  chemically synthesized
atagcatgaaatagggaagttg

SEQ ID NO: 760756 - DNA, 22 bp, Artificial Sequence
  chemically synthesized
tccctggcttctaacaacttcc

SEQ ID NO: 760757 - DNA, 22 bp, Artificial Sequence
  chemically synthesized
tgtccctggcttctaacaactt

SEQ ID NO: 760758 - DNA, 22 bp, Artificial Sequence
  chemically synthesized
tcctctgtccctggcttctaac

SEQ ID NO: 760759 - DNA, 22 bp, Artificial Sequence
  chemically synthesized
actgtcctctgtccctggcttc

SEQ ID NO: 760760 - DNA, 22 bp, Artificial Sequence
  chemically synthesized
gactgtcctctgtccctggctt

SEQ ID NO: 760761 - DNA, 22 bp, Artificial Sequence
  chemically synthesized
ttgactgtcctctgtccctggc

SEQ ID NO: 760762 - DNA, 22 bp, Artificial Sequence
  chemically synthesized
tcttgactgtcctctgtccctg

SEQ ID NO: 760763 - DNA, 22 bp, Artificial Sequence
  chemically synthesized
ttagaagccagggacagaggac

SEQ ID NO: 760764 - DNA, 22 bp, Artificial Sequence
  chemically synthesized
gctctcttgactgtcctctgtc

SEQ ID NO: 760765 - DNA, 22 bp, Artificial Sequence
  chemically synthesized
gaagccagggacagaggacagt

SEQ ID NO: 760766 - DNA, 22 bp, Artificial Sequence
  chemically synthesized
tattagctctcttgactgtcct

SEQ ID NO: 760767 - DNA, 22 bp, Artificial Sequence
  chemically synthesized
ctgtattagctctcttgactgt

SEQ ID NO: 760768 - DNA, 22 bp, Artificial Sequence
  chemically synthesized
ctgctgtattagctctcttgac

SEQ ID NO: 760769 - DNA, 22 bp, Artificial Sequence
  chemically synthesized
tgctgctgtattagctctcttg

SEQ ID NO: 760770 - DNA, 22 bp, Artificial Sequence
  chemically synthesized
ctgctgctgtattagctctctt

SEQ ID NO: 760771 - DNA, 22 bp, Artificial Sequence
  chemically synthesized
caggtccgtcttctgctgctgt

SEQ ID NO: 760772 - DNA, 22 bp, Artificial Sequence
  chemically synthesized
aggttccaggtccgtcttctgc

SEQ ID NO: 760773 - DNA, 22 bp, Artificial Sequence
  chemically synthesized
gaggttccaggtccgtcttctg

SEQ ID NO: 760774 - DNA, 22 bp, Artificial Sequence
  chemically synthesized
tgaggttccaggtccgtcttct

SEQ ID NO: 760775 - DNA, 22 bp, Artificial Sequence
  chemically synthesized
ttgaggttccaggtccgtcttc

SEQ ID NO: 760776 - DNA, 22 bp, Artificial Sequence
  chemically synthesized
atacagcagcagaagacggacc

SEQ ID NO: 760777 - DNA, 22 bp, Artificial Sequence
  chemically synthesized
gtcttttgaggttccaggtccg

SEQ ID NO: 760778 - DNA, 22 bp, Artificial Sequence
  chemically synthesized
cgtcttttgaggttccaggtcc

SEQ ID NO: 760779 - DNA, 22 bp, Artificial Sequence
  chemically synthesized
tcgtcttttgaggttccaggtc

SEQ ID NO: 760780 - DNA, 22 bp, Artificial Sequence
  chemically synthesized
ttcgtcttttgaggttccaggt

SEQ ID NO: 760781 - DNA, 22 bp, Artificial Sequence
  chemically synthesized
gaacctcaaaagacgaaaagct

SEQ ID NO: 760782 - DNA, 22 bp, Artificial Sequence
  chemically synthesized
cccagatatgtgagagcttttc

SEQ ID NO: 760783 - DNA, 22 bp, Artificial Sequence
  chemically synthesized
acccagatatgtgagagctttt

SEQ ID NO: 760784 - DNA, 22 bp, Artificial Sequence
  chemically synthesized
aaaagacgaaaagctctcacat

SEQ ID NO: 760785 - DNA, 22 bp, Artificial Sequence
  chemically synthesized
aaggaagtccccttacccagat

SEQ ID NO: 760786 - DNA, 22 bp, Artificial Sequence
  chemically synthesized
tcacatatctgggtaaggggac

SEQ ID NO: 760787 - DNA, 22 bp, Artificial Sequence
  chemically synthesized
acatatctgggtaaggggactt

SEQ ID NO: 760788 - DNA, 22 bp, Artificial Sequence
  chemically synthesized
gaaaaaaattaaaggaagtccc

SEQ ID NO: 760789 - DNA, 22 bp, Artificial Sequence
  chemically synthesized
agaaaaaaattaaaggaagtcc

SEQ ID NO: 760790 - DNA, 22 bp, Artificial Sequence
  chemically synthesized
ggtaaggggacttcctttaatt

SEQ ID NO: 760791 - DNA, 22 bp, Artificial Sequence
  chemically synthesized
cacagcttagaaaaaaattaaa

SEQ ID NO: 760792 - DNA, 22 bp, Artificial Sequence
  chemically synthesized
actccacagcttagaaaaaaat

SEQ ID NO: 760793 - DNA, 22 bp, Artificial Sequence
  chemically synthesized
tctaactccacagcttagaaaa

SEQ ID NO: 760794 - DNA, 22 bp, Artificial Sequence
  chemically synthesized
atctaactccacagcttagaaa

SEQ ID NO: 760795 - DNA, 22 bp, Artificial Sequence
  chemically synthesized
cctttaatttttttctaagctg

SEQ ID NO: 760796 - DNA, 22 bp, Artificial Sequence
  chemically synthesized
tatctaactccacagcttagaa

SEQ ID NO: 760797 - DNA, 22 bp, Artificial Sequence
  chemically synthesized
ctttaatttttttctaagctgt

SEQ ID NO: 760798 - DNA, 22 bp, Artificial Sequence
  chemically synthesized
taatttttttctaagctgtgga

SEQ ID NO: 760799 - DNA, 22 bp, Artificial Sequence
  chemically synthesized
aatttttttctaagctgtggag

SEQ ID NO: 760800 - DNA, 22 bp, Artificial Sequence
  chemically synthesized
atttttttctaagctgtggagt

SEQ ID NO: 760801 - DNA, 22 bp, Artificial Sequence
  chemically synthesized
aaattttatctaactccacagc

SEQ ID NO: 760802 - DNA, 22 bp, Artificial Sequence
  chemically synthesized
tgaaattttatctaactccaca

SEQ ID NO: 760803 - DNA, 22 bp, Artificial Sequence
  chemically synthesized
ttttctaagctgtggagttaga

SEQ ID NO: 760804 - DNA, 22 bp, Artificial Sequence
  chemically synthesized
tttctaagctgtggagttagat

SEQ ID NO: 760805 - DNA, 22 bp, Artificial Sequence
  chemically synthesized
ttctaagctgtggagttagata

SEQ ID NO: 760806 - DNA, 22 bp, Artificial Sequence
  chemically synthesized
tctaagctgtggagttagataa

SEQ ID NO: 760807 - DNA, 22 bp, Artificial Sequence
  chemically synthesized
ctaagctgtggagttagataaa

SEQ ID NO: 760808 - DNA, 22 bp, Artificial Sequence
  chemically synthesized
taagctgtggagttagataaaa

SEQ ID NO: 760809 - DNA, 22 bp, Artificial Sequence
  chemically synthesized
agctgtggagttagataaaatt

SEQ ID NO: 760810 - DNA, 22 bp, Artificial Sequence
  chemically synthesized
tggagttagataaaatttcaga

SEQ ID NO: 760811 - DNA, 22 bp, Artificial Sequence
  chemically synthesized
ggatgatcaaacattctgaaat

SEQ ID NO: 760812 - DNA, 22 bp, Artificial Sequence
  chemically synthesized
gataaaatttcagaatgtttga

SEQ ID NO: 760813 - DNA, 22 bp, Artificial Sequence
  chemically synthesized
atatgtagttaggatgatcaaa

SEQ ID NO: 760814 - DNA, 22 bp, Artificial Sequence
  chemically synthesized
gatatgtagttaggatgatcaa

SEQ ID NO: 760815 - DNA, 22 bp, Artificial Sequence
  chemically synthesized
cagaatgtttgatcatcctaac

SEQ ID NO: 760816 - DNA, 22 bp, Artificial Sequence
  chemically synthesized
agaatgtttgatcatcctaact

SEQ ID NO: 760817 - DNA, 22 bp, Artificial Sequence
  chemically synthesized
gatcatcctaactacatatcaa

SEQ ID NO: 760818 - DNA, 22 bp, Artificial Sequence
  chemically synthesized
atcatcctaactacatatcaaa

SEQ ID NO: 760819 - DNA, 22 bp, Artificial Sequence
  chemically synthesized
actacatatcaaattgcttcat

SEQ ID NO: 760820 - DNA, 22 bp, Artificial Sequence
  chemically synthesized
ggagaggaaaaaaatgaagcaa

SEQ ID NO: 760821 - DNA, 22 bp, Artificial Sequence
  chemically synthesized
aggagaggaaaaaaatgaagca

SEQ ID NO: 760822 - DNA, 22 bp, Artificial Sequence
  chemically synthesized
taggagaggaaaaaaatgaagc

SEQ ID NO: 760823 - DNA, 22 bp, Artificial Sequence
  chemically synthesized
catatcaaattgcttcattttt

SEQ ID NO: 760824 - DNA, 22 bp, Artificial Sequence
  chemically synthesized
agctttaggagaggaaaaaaat

SEQ ID NO: 760825 - DNA, 22 bp, Artificial Sequence
  chemically synthesized
gagctttaggagaggaaaaaaa

SEQ ID NO: 760826 - DNA, 22 bp, Artificial Sequence
  chemically synthesized
ttgagctttaggagaggaaaaa

SEQ ID NO: 760827 - DNA, 22 bp, Artificial Sequence
  chemically synthesized
actcttgagctttaggagagga

SEQ ID NO: 760828 - DNA, 22 bp, Artificial Sequence
  chemically synthesized
cttcatttttttcctctcctaa

SEQ ID NO: 760829 - DNA, 22 bp, Artificial Sequence
  chemically synthesized
cactcttgagctttaggagagg

SEQ ID NO: 760830 - DNA, 22 bp, Artificial Sequence
  chemically synthesized
tcactcttgagctttaggagag

SEQ ID NO: 760831 - DNA, 22 bp, Artificial Sequence
  chemically synthesized
catttttttcctctcctaaagc

SEQ ID NO: 760832 - DNA, 22 bp, Artificial Sequence
  chemically synthesized
atttttttcctctcctaaagct

SEQ ID NO: 760833 - DNA, 22 bp, Artificial Sequence
  chemically synthesized
ctttcactcttgagctttagga

SEQ ID NO: 760834 - DNA, 22 bp, Artificial Sequence
  chemically synthesized
cctttcactcttgagctttagg

SEQ ID NO: 760835 - DNA, 22 bp, Artificial Sequence
  chemically synthesized
tcctttcactcttgagctttag

SEQ ID NO: 760836 - DNA, 22 bp, Artificial Sequence
  chemically synthesized
ttcctttcactcttgagcttta

SEQ ID NO: 760837 - DNA, 22 bp, Artificial Sequence
  chemically synthesized
ttttcctctcctaaagctcaag

SEQ ID NO: 760838 - DNA, 22 bp, Artificial Sequence
  chemically synthesized
tttcctctcctaaagctcaaga

SEQ ID NO: 760839 - DNA, 22 bp, Artificial Sequence
  chemically synthesized
ttcctctcctaaagctcaagag

SEQ ID NO: 760840 - DNA, 22 bp, Artificial Sequence
  chemically synthesized
tcctctcctaaagctcaagagt

SEQ ID NO: 760841 - DNA, 22 bp, Artificial Sequence
  chemically synthesized
cctctcctaaagctcaagagtg

SEQ ID NO: 760842 - DNA, 22 bp, Artificial Sequence
  chemically synthesized
ctctcctaaagctcaagagtga

SEQ ID NO: 760843 - DNA, 22 bp, Artificial Sequence
  chemically synthesized
tcacatttttcctttcactctt

SEQ ID NO: 760844 - DNA, 22 bp, Artificial Sequence
  chemically synthesized
tcctaaagctcaagagtgaaag

SEQ ID NO: 760845 - DNA, 22 bp, Artificial Sequence
  chemically synthesized
ctaaagctcaagagtgaaagga

SEQ ID NO: 760846 - DNA, 22 bp, Artificial Sequence
  chemically synthesized
ctatcacatttttcctttcact

SEQ ID NO: 760847 - DNA, 22 bp, Artificial Sequence
  chemically synthesized
aagctcaagagtgaaaggaaaa

SEQ ID NO: 760848 - DNA, 22 bp, Artificial Sequence
  chemically synthesized
tcctcctatcacatttttcctt

SEQ ID NO: 760849 - DNA, 22 bp, Artificial Sequence
  chemically synthesized
gtcctcctatcacatttttcct

SEQ ID NO: 760850 - DNA, 22 bp, Artificial Sequence
  chemically synthesized
tgtcctcctatcacatttttcc

SEQ ID NO: 760851 - DNA, 22 bp, Artificial Sequence
  chemically synthesized
ttgtcctcctatcacatttttc

SEQ ID NO: 760852 - DNA, 22 bp, Artificial Sequence
  chemically synthesized
aagagtgaaaggaaaaatgtga

SEQ ID NO: 760853 - DNA, 22 bp, Artificial Sequence
  chemically synthesized
agtttttgtcctcctatcacat

SEQ ID NO: 760854 - DNA, 22 bp, Artificial Sequence
  chemically synthesized
cagtttttgtcctcctatcaca

SEQ ID NO: 760855 - DNA, 22 bp, Artificial Sequence
  chemically synthesized
gcttcagtttttgtcctcctat

SEQ ID NO: 760856 - DNA, 22 bp, Artificial Sequence
  chemically synthesized
cgcttcagtttttgtcctccta

SEQ ID NO: 760857 - DNA, 22 bp, Artificial Sequence
  chemically synthesized
tcgcttcagtttttgtcctcct

SEQ ID NO: 760858 - DNA, 22 bp, Artificial Sequence
  chemically synthesized
ttcgcttcagtttttgtcctcc

SEQ ID NO: 760859 - DNA, 22 bp, Artificial Sequence
  chemically synthesized
taagtttttcgcttcagttttt

SEQ ID NO: 760860 - DNA, 22 bp, Artificial Sequence
  chemically synthesized
gtaagtttttcgcttcagtttt

SEQ ID NO: 760861 - DNA, 22 bp, Artificial Sequence
  chemically synthesized
tgtaagtttttcgcttcagttt

SEQ ID NO: 760862 - DNA, 22 bp, Artificial Sequence
  chemically synthesized
tcctttgtaagtttttcgcttc

SEQ ID NO: 760863 - DNA, 22 bp, Artificial Sequence
  chemically synthesized
tgtcctttgtaagtttttcgct

SEQ ID NO: 760864 - DNA, 22 bp, Artificial Sequence
  chemically synthesized
tctgtcctttgtaagtttttcg

SEQ ID NO: 760865 - DNA, 22 bp, Artificial Sequence
  chemically synthesized
agtgttctctgtcctttgtaag

SEQ ID NO: 760866 - DNA, 22 bp, Artificial Sequence
  chemically synthesized
aagcgaaaaacttacaaaggac

SEQ ID NO: 760867 - DNA, 22 bp, Artificial Sequence
  chemically synthesized
ctcagtgttctctgtcctttgt

SEQ ID NO: 760868 - DNA, 22 bp, Artificial Sequence
  chemically synthesized
actcagtgttctctgtcctttg

SEQ ID NO: 760869 - DNA, 22 bp, Artificial Sequence
  chemically synthesized
ttactcagtgttctctgtcctt

SEQ ID NO: 760870 - DNA, 22 bp, Artificial Sequence
  chemically synthesized
agttcttactcagtgttctctg

SEQ ID NO: 760871 - DNA, 22 bp, Artificial Sequence
  chemically synthesized
cagttcttactcagtgttctct

SEQ ID NO: 760872 - DNA, 22 bp, Artificial Sequence
  chemically synthesized
ttcagttcttactcagtgttct

SEQ ID NO: 760873 - DNA, 22 bp, Artificial Sequence
  chemically synthesized
acaaaggacagagaacactgag

SEQ ID NO: 760874 - DNA, 22 bp, Artificial Sequence
  chemically synthesized
caaaggacagagaacactgagt

SEQ ID NO: 760875 - DNA, 22 bp, Artificial Sequence
  chemically synthesized
acctcttcagttcttactcagt

SEQ ID NO: 760876 - DNA, 22 bp, Artificial Sequence
  chemically synthesized
cacctcttcagttcttactcag

SEQ ID NO: 760877 - DNA, 22 bp, Artificial Sequence
  chemically synthesized
tcacctcttcagttcttactca

SEQ ID NO: 760878 - DNA, 22 bp, Artificial Sequence
  chemically synthesized
cctttcacctcttcagttctta

SEQ ID NO: 760879 - DNA, 22 bp, Artificial Sequence
  chemically synthesized
gctgcctttcacctcttcagtt

SEQ ID NO: 760880 - DNA, 22 bp, Artificial Sequence
  chemically synthesized
tggctgcctttcacctcttcag

SEQ ID NO: 760881 - DNA, 22 bp, Artificial Sequence
  chemically synthesized
tctggctgcctttcacctcttc

SEQ ID NO: 760882 - DNA, 22 bp, Artificial Sequence
  chemically synthesized
agtaagaactgaagaggtgaaa

SEQ ID NO: 760883 - DNA, 22 bp, Artificial Sequence
  chemically synthesized
attctctggctgcctttcacct

SEQ ID NO: 760884 - DNA, 22 bp, Artificial Sequence
  chemically synthesized
attcattctctggctgcctttc

SEQ ID NO: 760885 - DNA, 22 bp, Artificial Sequence
  chemically synthesized
aattcattctctggctgccttt

SEQ ID NO: 760886 - DNA, 22 bp, Artificial Sequence
  chemically synthesized
taattcattctctggctgcctt

SEQ ID NO: 760887 - DNA, 22 bp, Artificial Sequence
  chemically synthesized
aagaggtgaaaggcagccagag

SEQ ID NO: 760888 - DNA, 22 bp, Artificial Sequence
  chemically synthesized
ttttaattcattctctggctgc

SEQ ID NO: 760889 - DNA, 22 bp, Artificial Sequence
  chemically synthesized
tatatgctgttttaattcattc

SEQ ID NO: 760890 - DNA, 22 bp, Artificial Sequence
  chemically synthesized
gtatatgctgttttaattcatt

SEQ ID NO: 760891 - DNA, 22 bp, Artificial Sequence
  chemically synthesized
aatacatttgtatatgctgttt

SEQ ID NO: 760892 - DNA, 22 bp, Artificial Sequence
  chemically synthesized
ggttgaatacatttgtatatgc

SEQ ID NO: 760893 - DNA, 22 bp, Artificial Sequence
  chemically synthesized
aggttgaatacatttgtatatg

SEQ ID NO: 760894 - DNA, 22 bp, Artificial Sequence
  chemically synthesized
taggttgaatacatttgtatat

SEQ ID NO: 760895 - DNA, 22 bp, Artificial Sequence
  chemically synthesized
aaacagcatatacaaatgtatt

SEQ ID NO: 760896 - DNA, 22 bp, Artificial Sequence
  chemically synthesized
agacccagagctttaggttgaa

SEQ ID NO: 760897 - DNA, 22 bp, Artificial Sequence
  chemically synthesized
gagacccagagctttaggttga

SEQ ID NO: 760898 - DNA, 22 bp, Artificial Sequence
  chemically synthesized
tagtttgagacccagagcttta

SEQ ID NO: 760899 - DNA, 22 bp, Artificial Sequence
  chemically synthesized
aacctaaagctctgggtctcaa

SEQ ID NO: 760900 - DNA, 22 bp, Artificial Sequence
  chemically synthesized
tacacactatagtttgagaccc

SEQ ID NO: 760901 - DNA, 22 bp, Artificial Sequence
  chemically synthesized
atacacactatagtttgagacc

SEQ ID NO: 760902 - DNA, 22 bp, Artificial Sequence
  chemically synthesized
ttatacacactatagtttgaga

SEQ ID NO: 760903 - DNA, 22 bp, Artificial Sequence
  chemically synthesized
cttatacacactatagtttgag

SEQ ID NO: 760904 - DNA, 22 bp, Artificial Sequence
  chemically synthesized
aagctctgggtctcaaactata

SEQ ID NO: 760905 - DNA, 22 bp, Artificial Sequence
  chemically synthesized
tgggtctcaaactatagtgtgt

SEQ ID NO: 760906 - DNA, 22 bp, Artificial Sequence
  chemically synthesized
aaatgtttcttatacacactat

SEQ ID NO: 760907 - DNA, 22 bp, Artificial Sequence
  chemically synthesized
ggtctcaaactatagtgtgtat

SEQ ID NO: 760908 - DNA, 22 bp, Artificial Sequence
  chemically synthesized
ctcaaatgtttcttatacacac

SEQ ID NO: 760909 - DNA, 22 bp, Artificial Sequence
  chemically synthesized
aaactatagtgtgtataagaaa

SEQ ID NO: 760910 - DNA, 22 bp, Artificial Sequence
  chemically synthesized
aacaagctactcaaatgtttct

SEQ ID NO: 760911 - DNA, 22 bp, Artificial Sequence
  chemically synthesized
tagtgtgtataagaaacatttg

SEQ ID NO: 760912 - DNA, 22 bp, Artificial Sequence
  chemically synthesized
aaacaagctactcaaatgtttc

SEQ ID NO: 760913 - DNA, 22 bp, Artificial Sequence
  chemically synthesized
taaacaagctactcaaatgttt

SEQ ID NO: 760914 - DNA, 22 bp, Artificial Sequence
  chemically synthesized
aattttaaacaagctactcaaa

SEQ ID NO: 760915 - DNA, 22 bp, Artificial Sequence
  chemically synthesized
gcaatctcaattttaaacaagc

SEQ ID NO: 760916 - DNA, 22 bp, Artificial Sequence
  chemically synthesized
gagtagcttgtttaaaattgag

SEQ ID NO: 760917 - DNA, 22 bp, Artificial Sequence
  chemically synthesized
agtagcttgtttaaaattgaga

SEQ ID NO: 760918 - DNA, 22 bp, Artificial Sequence
  chemically synthesized
gaggtggcacctagcaatctca

SEQ ID NO: 760919 - DNA, 22 bp, Artificial Sequence
  chemically synthesized
gtttaaaattgagattgctagg

SEQ ID NO: 760920 - DNA, 22 bp, Artificial Sequence
  chemically synthesized
tttaaaattgagattgctaggt

SEQ ID NO: 760921 - DNA, 22 bp, Artificial Sequence
  chemically synthesized
aaaattgagattgctaggtgcc

SEQ ID NO: 760922 - DNA, 22 bp, Artificial Sequence
  chemically synthesized
aaattgagattgctaggtgcca

SEQ ID NO: 760923 - DNA, 22 bp, Artificial Sequence
  chemically synthesized
tagaaagtctggaggtggcacc

SEQ ID NO: 760924 - DNA, 22 bp, Artificial Sequence
  chemically synthesized
agattgctaggtgccacctcca

SEQ ID NO: 760925 - DNA, 22 bp, Artificial Sequence
  chemically synthesized
ctaggtgccacctccagacttt

SEQ ID NO: 760926 - DNA, 22 bp, Artificial Sequence
  chemically synthesized
atagaattatagaaagtctgga

SEQ ID NO: 760927 - DNA, 22 bp, Artificial Sequence
  chemically synthesized
ggtgccacctccagactttcta

SEQ ID NO: 760928 - DNA, 22 bp, Artificial Sequence
  chemically synthesized
ttgatagaattatagaaagtct

SEQ ID NO: 760929 - DNA, 22 bp, Artificial Sequence
  chemically synthesized
cagactttctataattctatca

SEQ ID NO: 760930 - DNA, 22 bp, Artificial Sequence
  chemically synthesized
aaagcagagattgttgatagaa

SEQ ID NO: 760931 - DNA, 22 bp, Artificial Sequence
  chemically synthesized
ttgaaagcagagattgttgata

SEQ ID NO: 760932 - DNA, 22 bp, Artificial Sequence
  chemically synthesized
gttgaaagcagagattgttgat

SEQ ID NO: 760933 - DNA, 22 bp, Artificial Sequence
  chemically synthesized
tctataattctatcaacaatct

SEQ ID NO: 760934 - DNA, 22 bp, Artificial Sequence
  chemically synthesized
ctataattctatcaacaatctc

SEQ ID NO: 760935 - DNA, 22 bp, Artificial Sequence
  chemically synthesized
ttgttgaaagcagagattgttg

SEQ ID NO: 760936 - DNA, 22 bp, Artificial Sequence
  chemically synthesized
tataattctatcaacaatctct

SEQ ID NO: 760937 - DNA, 22 bp, Artificial Sequence
  chemically synthesized
taattctatcaacaatctctgc

SEQ ID NO: 760938 - DNA, 22 bp, Artificial Sequence
  chemically synthesized
tatcaacaatctctgctttcaa

SEQ ID NO: 760939 - DNA, 22 bp, Artificial Sequence
  chemically synthesized
tgaaggttcttgttgaaagcag

SEQ ID NO: 760940 - DNA, 22 bp, Artificial Sequence
  chemically synthesized
tcaacaatctctgctttcaaca

SEQ ID NO: 760941 - DNA, 22 bp, Artificial Sequence
  chemically synthesized
tggaattgtgaaggttcttgtt

SEQ ID NO: 760942 - DNA, 22 bp, Artificial Sequence
  chemically synthesized
cctgtggaattgtgaaggttct

SEQ ID NO: 760943 - DNA, 22 bp, Artificial Sequence
  chemically synthesized
tgctttcaacaagaaccttcac

SEQ ID NO: 760944 - DNA, 22 bp, Artificial Sequence
  chemically synthesized
acctgtggaattgtgaaggttc

SEQ ID NO: 760945 - DNA, 22 bp, Artificial Sequence
  chemically synthesized
ctttcaacaagaaccttcacaa

SEQ ID NO: 760946 - DNA, 22 bp, Artificial Sequence
  chemically synthesized
tcaacaagaaccttcacaattc

SEQ ID NO: 760947 - DNA, 22 bp, Artificial Sequence
  chemically synthesized
caacaagaaccttcacaattcc

SEQ ID NO: 760948 - DNA, 22 bp, Artificial Sequence
  chemically synthesized
gagcttacctgtggaattgtga

SEQ ID NO: 760949 - DNA, 22 bp, Artificial Sequence
  chemically synthesized
aacaagaaccttcacaattcca

SEQ ID NO: 760950 - DNA, 22 bp, Artificial Sequence
  chemically synthesized
tggagcttacctgtggaattgt

SEQ ID NO: 760951 - DNA, 22 bp, Artificial Sequence
  chemically synthesized
cacaattccacaggtaagctcc

SEQ ID NO: 760952 - DNA, 22 bp, Artificial Sequence
  chemically synthesized
acaattccacaggtaagctcca

SEQ ID NO: 760953 - DNA, 22 bp, Artificial Sequence
  chemically synthesized
tcaaagaatggttctggagctt

SEQ ID NO: 760954 - DNA, 22 bp, Artificial Sequence
  chemically synthesized
atcaaagaatggttctggagct

SEQ ID NO: 760955 - DNA, 22 bp, Artificial Sequence
  chemically synthesized
tatcaaagaatggttctggagc

SEQ ID NO: 760956 - DNA, 22 bp, Artificial Sequence
  chemically synthesized
cacaggtaagctccagaaccat

SEQ ID NO: 760957 - DNA, 22 bp, Artificial Sequence
  chemically synthesized
ataaatgctttatcaaagaatg

SEQ ID NO: 760958 - DNA, 22 bp, Artificial Sequence
  chemically synthesized
aataaatgctttatcaaagaat

SEQ ID NO: 760959 - DNA, 22 bp, Artificial Sequence
  chemically synthesized
taataaatgctttatcaaagaa

SEQ ID NO: 760960 - DNA, 22 bp, Artificial Sequence
  chemically synthesized
cagaaccattctttgataaagc

SEQ ID NO: 760961 - DNA, 22 bp, Artificial Sequence
  chemically synthesized
tttgataaagcatttattaaag

SEQ ID NO: 760962 - DNA, 22 bp, Artificial Sequence
  chemically synthesized
tgataaagcatttattaaagca

SEQ ID NO: 760963 - DNA, 22 bp, Artificial Sequence
  chemically synthesized
gataaagcatttattaaagcat

SEQ ID NO: 760964 - DNA, 22 bp, Artificial Sequence
  chemically synthesized
ataaagcatttattaaagcatt

SEQ ID NO: 760965 - DNA, 22 bp, Artificial Sequence
  chemically synthesized
gggcatatcagaaatgctttaa

SEQ ID NO: 760966 - DNA, 22 bp, Artificial Sequence
  chemically synthesized
ggggcatatcagaaatgcttta

SEQ ID NO: 760967 - DNA, 22 bp, Artificial Sequence
  chemically synthesized
attaaagcatttctgatatgcc

SEQ ID NO: 760968 - DNA, 22 bp, Artificial Sequence
  chemically synthesized
ttaaagcatttctgatatgccc

SEQ ID NO: 760969 - DNA, 22 bp, Artificial Sequence
  chemically synthesized
aagcatttctgatatgccccaa

SEQ ID NO: 760970 - DNA, 22 bp, Artificial Sequence
  chemically synthesized
ctgatatgccccaaacattact

SEQ ID NO: 760971 - DNA, 22 bp, Artificial Sequence
  chemically synthesized
tggagaccaagaagtaatgttt

SEQ ID NO: 760972 - DNA, 22 bp, Artificial Sequence
  chemically synthesized
tgatatgccccaaacattactt

SEQ ID NO: 760973 - DNA, 22 bp, Artificial Sequence
  chemically synthesized
atatgccccaaacattacttct

SEQ ID NO: 760974 - DNA, 22 bp, Artificial Sequence
  chemically synthesized
ccctgtggagaccaagaagtaa

SEQ ID NO: 760975 - DNA, 22 bp, Artificial Sequence
  chemically synthesized
gccctgtggagaccaagaagta

SEQ ID NO: 760976 - DNA, 22 bp, Artificial Sequence
  chemically synthesized
tgccctgtggagaccaagaagt

SEQ ID NO: 760977 - DNA, 22 bp, Artificial Sequence
  chemically synthesized
cttcttggtctccacagggcaa

SEQ ID NO: 760978 - DNA, 22 bp, Artificial Sequence
  chemically synthesized
acaaatgccacctttgccctgt

SEQ ID NO: 760979 - DNA, 22 bp, Artificial Sequence
  chemically synthesized
cttggtctccacagggcaaagg

SEQ ID NO: 760980 - DNA, 22 bp, Artificial Sequence
  chemically synthesized
ttggtctccacagggcaaaggt

SEQ ID NO: 760981 - DNA, 22 bp, Artificial Sequence
  chemically synthesized
ggtctccacagggcaaaggtgg

SEQ ID NO: 760982 - DNA, 22 bp, Artificial Sequence
  chemically synthesized
gtctccacagggcaaaggtggc

SEQ ID NO: 760983 - DNA, 22 bp, Artificial Sequence
  chemically synthesized
cacagggcaaaggtggcatttg

SEQ ID NO: 760984 - DNA, 22 bp, Artificial Sequence
  chemically synthesized
aaaatcaagtcactgacaaatg

SEQ ID NO: 760985 - DNA, 22 bp, Artificial Sequence
  chemically synthesized
caaaatcaagtcactgacaaat

SEQ ID NO: 760986 - DNA, 22 bp, Artificial Sequence
  chemically synthesized
gatcttcaaaatcaagtcactg

SEQ ID NO: 760987 - DNA, 22 bp, Artificial Sequence
  chemically synthesized
agatcttcaaaatcaagtcact

SEQ ID NO: 760988 - DNA, 22 bp, Artificial Sequence
  chemically synthesized
catttagatcttcaaaatcaag

SEQ ID NO: 760989 - DNA, 22 bp, Artificial Sequence
  chemically synthesized
acatttagatcttcaaaatcaa

SEQ ID NO: 760990 - DNA, 22 bp, Artificial Sequence
  chemically synthesized
gtcagtgacttgattttgaaga

SEQ ID NO: 760991 - DNA, 22 bp, Artificial Sequence
  chemically synthesized
cttacatttagatcttcaaaat

SEQ ID NO: 760992 - DNA, 22 bp, Artificial Sequence
  chemically synthesized
tcagtgacttgattttgaagat

SEQ ID NO: 760993 - DNA, 22 bp, Artificial Sequence
  chemically synthesized
acaatgttccttacatttagat

SEQ ID NO: 760994 - DNA, 22 bp, Artificial Sequence
  chemically synthesized
gattttgaagatctaaatgtaa

SEQ ID NO: 760995 - DNA, 22 bp, Artificial Sequence
  chemically synthesized
attttgaagatctaaatgtaag

SEQ ID NO: 760996 - DNA, 22 bp, Artificial Sequence
  chemically synthesized
agctcacaatgttccttacatt

SEQ ID NO: 760997 - DNA, 22 bp, Artificial Sequence
  chemically synthesized
gagctcacaatgttccttacat

SEQ ID NO: 760998 - DNA, 22 bp, Artificial Sequence
  chemically synthesized
tgaagatctaaatgtaaggaac

SEQ ID NO: 760999 - DNA, 22 bp, Artificial Sequence
  chemically synthesized
tgagctcacaatgttccttaca

SEQ ID NO: 761000 - DNA, 22 bp, Artificial Sequence
  chemically synthesized
gaagatctaaatgtaaggaaca

SEQ ID NO: 761001 - DNA, 22 bp, Artificial Sequence
  chemically synthesized
aagatctaaatgtaaggaacat

SEQ ID NO: 761002 - DNA, 22 bp, Artificial Sequence
  chemically synthesized
aatgtaaggaacattgtgagct

SEQ ID NO: 761003 - DNA, 22 bp, Artificial Sequence
  chemically synthesized
acatggtcaaagaaaatgtttt

SEQ ID NO: 761004 - DNA, 22 bp, Artificial Sequence
  chemically synthesized
aacatggtcaaagaaaatgttt

SEQ ID NO: 761005 - DNA, 22 bp, Artificial Sequence
  chemically synthesized
tgagctcaaaacattttctttg

SEQ ID NO: 761006 - DNA, 22 bp, Artificial Sequence
  chemically synthesized
acgggcttaacatggtcaaaga

SEQ ID NO: 761007 - DNA, 22 bp, Artificial Sequence
  chemically synthesized
cacgggcttaacatggtcaaag

SEQ ID NO: 761008 - DNA, 22 bp, Artificial Sequence
  chemically synthesized
aaaacattttctttgaccatgt

SEQ ID NO: 761009 - DNA, 22 bp, Artificial Sequence
  chemically synthesized
aaaacatttcacgggcttaaca

SEQ ID NO: 761010 - DNA, 22 bp, Artificial Sequence
  chemically synthesized
gaaaacatttcacgggcttaac

SEQ ID NO: 761011 - DNA, 22 bp, Artificial Sequence
  chemically synthesized
tctttgaccatgttaagcccgt

SEQ ID NO: 761012 - DNA, 22 bp, Artificial Sequence
  chemically synthesized
ctttgaccatgttaagcccgtg

SEQ ID NO: 761013 - DNA, 22 bp, Artificial Sequence
  chemically synthesized
tttgaccatgttaagcccgtga

SEQ ID NO: 761014 - DNA, 22 bp, Artificial Sequence
  chemically synthesized
tgaccatgttaagcccgtgaaa

SEQ ID NO: 761015 - DNA, 22 bp, Artificial Sequence
  chemically synthesized
gaccatgttaagcccgtgaaat

SEQ ID NO: 761016 - DNA, 22 bp, Artificial Sequence
  chemically synthesized
accatgttaagcccgtgaaatg

SEQ ID NO: 761017 - DNA, 22 bp, Artificial Sequence
  chemically synthesized
gaaatgtgacttgaaaacattt

SEQ ID NO: 761018 - DNA, 22 bp, Artificial Sequence
  chemically synthesized
agcccgtgaaatgttttcaagt

SEQ ID NO: 761019 - DNA, 22 bp, Artificial Sequence
  chemically synthesized
cgataaatgtattagaaatgtg

SEQ ID NO: 761020 - DNA, 22 bp, Artificial Sequence
  chemically synthesized
ccgataaatgtattagaaatgt

SEQ ID NO: 761021 - DNA, 22 bp, Artificial Sequence
  chemically synthesized
cttccgataaatgtattagaaa

SEQ ID NO: 761022 - DNA, 22 bp, Artificial Sequence
  chemically synthesized
tcaagtcacatttctaatacat

SEQ ID NO: 761023 - DNA, 22 bp, Artificial Sequence
  chemically synthesized
caagtcacatttctaatacatt

SEQ ID NO: 761024 - DNA, 22 bp, Artificial Sequence
  chemically synthesized
aagtcacatttctaatacattt

SEQ ID NO: 761025 - DNA, 22 bp, Artificial Sequence
  chemically synthesized
ctaatacatttatcggaagcag

SEQ ID NO: 761026 - DNA, 22 bp, Artificial Sequence
  chemically synthesized
taatacatttatcggaagcagt

SEQ ID NO: 761027 - DNA, 22 bp, Artificial Sequence
  chemically synthesized
atacatttatcggaagcagttg

SEQ ID NO: 761028 - DNA, 22 bp, Artificial Sequence
  chemically synthesized
atgaaaataaaaatagggcaac

SEQ ID NO: 761029 - DNA, 22 bp, Artificial Sequence
  chemically synthesized
atcggaagcagttgccctattt

SEQ ID NO: 761030 - DNA, 22 bp, Artificial Sequence
  chemically synthesized
tcggaagcagttgccctatttt

SEQ ID NO: 761031 - DNA, 22 bp, Artificial Sequence
  chemically synthesized
gtatatacactcatgaaaataa

SEQ ID NO: 761032 - DNA, 22 bp, Artificial Sequence
  chemically synthesized
ccctatttttattttcatgagt

SEQ ID NO: 761033 - DNA, 22 bp, Artificial Sequence
  chemically synthesized
tttttattttcatgagtgtata

SEQ ID NO: 761034 - DNA, 22 bp, Artificial Sequence
  chemically synthesized
aaaatatctggtatatacactc

SEQ ID NO: 761035 - DNA, 22 bp, Artificial Sequence
  chemically synthesized
caaaatatctggtatatacact

SEQ ID NO: 761036 - DNA, 22 bp, Artificial Sequence
  chemically synthesized
ttattttcatgagtgtatatac

SEQ ID NO: 761037 - DNA, 22 bp, Artificial Sequence
  chemically synthesized
tattttcatgagtgtatatacc

SEQ ID NO: 761038 - DNA, 22 bp, Artificial Sequence
  chemically synthesized
attttcatgagtgtatatacca

SEQ ID NO: 761039 - DNA, 22 bp, Artificial Sequence
  chemically synthesized
ttttcatgagtgtatataccag

SEQ ID NO: 761040 - DNA, 22 bp, Artificial Sequence
  chemically synthesized
tcatgagtgtatataccagata

SEQ ID NO: 761041 - DNA, 22 bp, Artificial Sequence
  chemically synthesized
atcatttcaaaatatctggtat

SEQ ID NO: 761042 - DNA, 22 bp, Artificial Sequence
  chemically synthesized
catgagtgtatataccagatat

SEQ ID NO: 761043 - DNA, 22 bp, Artificial Sequence
  chemically synthesized
atgagtgtatataccagatatt

SEQ ID NO: 761044 - DNA, 22 bp, Artificial Sequence
  chemically synthesized
cacatgcaaacataggttaatc

SEQ ID NO: 761045 - DNA, 22 bp, Artificial Sequence
  chemically synthesized
tgaaatgattaacctatgtttg

SEQ ID NO: 761046 - DNA, 22 bp, Artificial Sequence
  chemically synthesized
gaaatgattaacctatgtttgc

SEQ ID NO: 761047 - DNA, 22 bp, Artificial Sequence
  chemically synthesized
aaatgattaacctatgtttgca

SEQ ID NO: 761048 - DNA, 22 bp, Artificial Sequence
  chemically synthesized
aggaggagatattccacatgca

SEQ ID NO: 761049 - DNA, 22 bp, Artificial Sequence
  chemically synthesized
caggaggagatattccacatgc

SEQ ID NO: 761050 - DNA, 22 bp, Artificial Sequence
  chemically synthesized
tcaggaggagatattccacatg

SEQ ID NO: 761051 - DNA, 22 bp, Artificial Sequence
  chemically synthesized
acctatgtttgcatgtggaata

SEQ ID NO: 761052 - DNA, 22 bp, Artificial Sequence
  chemically synthesized
tgtttgcatgtggaatatctcc

SEQ ID NO: 761053 - DNA, 22 bp, Artificial Sequence
  chemically synthesized
gcatgtggaatatctcctcctg

SEQ ID NO: 761054 - DNA, 22 bp, Artificial Sequence
  chemically synthesized
catgtggaatatctcctcctga

SEQ ID NO: 761055 - DNA, 22 bp, Artificial Sequence
  chemically synthesized
caaatacaaagaaacattttca

SEQ ID NO: 761056 - DNA, 22 bp, Artificial Sequence
  chemically synthesized
ctcctgaaaatgtttctttgta

SEQ ID NO: 761057 - DNA, 22 bp, Artificial Sequence
  chemically synthesized
ctgaaaatgtttctttgtattt

SEQ ID NO: 761058 - DNA, 22 bp, Artificial Sequence
  chemically synthesized
aaaatgtttctttgtatttgta

SEQ ID NO: 761059 - DNA, 22 bp, Artificial Sequence
  chemically synthesized
ctttgtatttgtaatgactttt

SEQ ID NO: 761060 - DNA, 22 bp, Artificial Sequence
  chemically synthesized
tttgtatttgtaatgacttttt

SEQ ID NO: 761061 - DNA, 22 bp, Artificial Sequence
  chemically synthesized
tgtatttgtaatgacttttttt

SEQ ID NO: 761062 - DNA, 22 bp, Artificial Sequence
  chemically synthesized
gtatttgtaatgactttttttt

SEQ ID NO: 761063 - DNA, 22 bp, Artificial Sequence
  chemically synthesized
tatttgtaatgacttttttttc

SEQ ID NO: 761064 - DNA, 22 bp, Artificial Sequence
  chemically synthesized
tgtatgatataaccagaaaaaa

SEQ ID NO: 761065 - DNA, 22 bp, Artificial Sequence
  chemically synthesized
gtaatgacttttttttctggtt

SEQ ID NO: 761066 - DNA, 22 bp, Artificial Sequence
  chemically synthesized
taatgacttttttttctggtta

SEQ ID NO: 761067 - DNA, 22 bp, Artificial Sequence
  chemically synthesized
ttttttctggttatatcataca

SEQ ID NO: 761068 - DNA, 22 bp, Artificial Sequence
  chemically synthesized
tttttctggttatatcatacat

SEQ ID NO: 761069 - DNA, 22 bp, Artificial Sequence
  chemically synthesized
ttttctggttatatcatacata

SEQ ID NO: 761070 - DNA, 22 bp, Artificial Sequence
  chemically synthesized
tttctggttatatcatacatag

SEQ ID NO: 761071 - DNA, 22 bp, Artificial Sequence
  chemically synthesized
ttctggttatatcatacatagg

SEQ ID NO: 761072 - DNA, 22 bp, Artificial Sequence
  chemically synthesized
caaccccaacagcctatgtatg

SEQ ID NO: 761073 - DNA, 22 bp, Artificial Sequence
  chemically synthesized
tctggttatatcatacataggc

SEQ ID NO: 761074 - DNA, 22 bp, Artificial Sequence
  chemically synthesized
ccaaccccaacagcctatgtat

SEQ ID NO: 761075 - DNA, 22 bp, Artificial Sequence
  chemically synthesized
ctggttatatcatacataggct

SEQ ID NO: 761076 - DNA, 22 bp, Artificial Sequence
  chemically synthesized
tggttatatcatacataggctg

SEQ ID NO: 761077 - DNA, 22 bp, Artificial Sequence
  chemically synthesized
cttccaaccccaacagcctatg

SEQ ID NO: 761078 - DNA, 22 bp, Artificial Sequence
  chemically synthesized
gttatatcatacataggctgtt

SEQ ID NO: 761079 - DNA, 22 bp, Artificial Sequence
  chemically synthesized
tatcatacataggctgttgggg

SEQ ID NO: 761080 - DNA, 22 bp, Artificial Sequence
  chemically synthesized
aggttccttccaaccccaacag

SEQ ID NO: 761081 - DNA, 22 bp, Artificial Sequence
  chemically synthesized
tcaggttccttccaaccccaac

SEQ ID NO: 761082 - DNA, 22 bp, Artificial Sequence
  chemically synthesized
taatctctcaggttccttccaa

SEQ ID NO: 761083 - DNA, 22 bp, Artificial Sequence
  chemically synthesized
aactataatctctcaggttcct

SEQ ID NO: 761084 - DNA, 22 bp, Artificial Sequence
  chemically synthesized
ttggggttggaaggaacctgag

SEQ ID NO: 761085 - DNA, 22 bp, Artificial Sequence
  chemically synthesized
gggttggaaggaacctgagaga

SEQ ID NO: 761086 - DNA, 22 bp, Artificial Sequence
  chemically synthesized
gaaggaacctgagagattatag

SEQ ID NO: 761087 - DNA, 22 bp, Artificial Sequence
  chemically synthesized
agagattatagttcaaccttct

SEQ ID NO: 761088 - DNA, 22 bp, Artificial Sequence
  chemically synthesized
catatgcaaaacaagaaggttg

SEQ ID NO: 761089 - DNA, 22 bp, Artificial Sequence
  chemically synthesized
tacatatgcaaaacaagaaggt

SEQ ID NO: 761090 - DNA, 22 bp, Artificial Sequence
  chemically synthesized
ctacatatgcaaaacaagaagg

SEQ ID NO: 761091 - DNA, 22 bp, Artificial Sequence
  chemically synthesized
tagttcaaccttcttgttttgc

SEQ ID NO: 761092 - DNA, 22 bp, Artificial Sequence
  chemically synthesized
atttctacatatgcaaaacaag

SEQ ID NO: 761093 - DNA, 22 bp, Artificial Sequence
  chemically synthesized
gatttctacatatgcaaaacaa

SEQ ID NO: 761094 - DNA, 22 bp, Artificial Sequence
  chemically synthesized
aaccttcttgttttgcatatgt

SEQ ID NO: 761095 - DNA, 22 bp, Artificial Sequence
  chemically synthesized
caatcttgatttctacatatgc

SEQ ID NO: 761096 - DNA, 22 bp, Artificial Sequence
  chemically synthesized
gcaatcttgatttctacatatg

SEQ ID NO: 761097 - DNA, 22 bp, Artificial Sequence
  chemically synthesized
tgcaatcttgatttctacatat

SEQ ID NO: 761098 - DNA, 22 bp, Artificial Sequence
  chemically synthesized
cttgttttgcatatgtagaaat

SEQ ID NO: 761099 - DNA, 22 bp, Artificial Sequence
  chemically synthesized
ttgttttgcatatgtagaaatc

SEQ ID NO: 761100 - DNA, 22 bp, Artificial Sequence
  chemically synthesized
gttttgcatatgtagaaatcaa

SEQ ID NO: 761101 - DNA, 22 bp, Artificial Sequence
  chemically synthesized
ttttgcatatgtagaaatcaag

SEQ ID NO: 761102 - DNA, 22 bp, Artificial Sequence
  chemically synthesized
tacctttgcaatcttgatttct

SEQ ID NO: 761103 - DNA, 22 bp, Artificial Sequence
  chemically synthesized
atacctttgcaatcttgatttc

SEQ ID NO: 761104 - DNA, 22 bp, Artificial Sequence
  chemically synthesized
tatacctttgcaatcttgattt

SEQ ID NO: 761105 - DNA, 22 bp, Artificial Sequence
  chemically synthesized
tgcatatgtagaaatcaagatt

SEQ ID NO: 761106 - DNA, 22 bp, Artificial Sequence
  chemically synthesized
gcatatgtagaaatcaagattg

SEQ ID NO: 761107 - DNA, 22 bp, Artificial Sequence
  chemically synthesized
catatgtagaaatcaagattgc

SEQ ID NO: 761108 - DNA, 22 bp, Artificial Sequence
  chemically synthesized
ttttatacctttgcaatcttga

SEQ ID NO: 761109 - DNA, 22 bp, Artificial Sequence
  chemically synthesized
agcagctgttttatacctttgc

SEQ ID NO: 761110 - DNA, 22 bp, Artificial Sequence
  chemically synthesized
cagcagctgttttatacctttg

SEQ ID NO: 761111 - DNA, 22 bp, Artificial Sequence
  chemically synthesized
tcagcagctgttttataccttt

SEQ ID NO: 761112 - DNA, 22 bp, Artificial Sequence
  chemically synthesized
ttcagcagctgttttatacctt

SEQ ID NO: 761113 - DNA, 22 bp, Artificial Sequence
  chemically synthesized
tgtttttcagcagctgttttat

SEQ ID NO: 761114 - DNA, 22 bp, Artificial Sequence
  chemically synthesized
caaaggtataaaacagctgctg

SEQ ID NO: 761115 - DNA, 22 bp, Artificial Sequence
  chemically synthesized
aagttatgtttttcagcagctg

SEQ ID NO: 761116 - DNA, 22 bp, Artificial Sequence
  chemically synthesized
aataggacagctcaagttatgt

SEQ ID NO: 761117 - DNA, 22 bp, Artificial Sequence
  chemically synthesized
ctgaaaaacataacttgagctg

SEQ ID NO: 761118 - DNA, 22 bp, Artificial Sequence
  chemically synthesized
aaaaacataacttgagctgtcc

SEQ ID NO: 761119 - DNA, 22 bp, Artificial Sequence
  chemically synthesized
ccatatctaaataggacagctc

SEQ ID NO: 761120 - DNA, 22 bp, Artificial Sequence
  chemically synthesized
cccatatctaaataggacagct

SEQ ID NO: 761121 - DNA, 22 bp, Artificial Sequence
  chemically synthesized
tttcccatatctaaataggaca

SEQ ID NO: 761122 - DNA, 22 bp, Artificial Sequence
  chemically synthesized
tatttcccatatctaaatagga

SEQ ID NO: 761123 - DNA, 22 bp, Artificial Sequence
  chemically synthesized
ctatttcccatatctaaatagg

SEQ ID NO: 761124 - DNA, 22 bp, Artificial Sequence
  chemically synthesized
gagctgtcctatttagatatgg

SEQ ID NO: 761125 - DNA, 22 bp, Artificial Sequence
  chemically synthesized
agctgtcctatttagatatggg

SEQ ID NO: 761126 - DNA, 22 bp, Artificial Sequence
  chemically synthesized
taatttctatttcccatatcta

SEQ ID NO: 761127 - DNA, 22 bp, Artificial Sequence
  chemically synthesized
gtaatttctatttcccatatct

SEQ ID NO: 761128 - DNA, 22 bp, Artificial Sequence
  chemically synthesized
tcctatttagatatgggaaata

SEQ ID NO: 761129 - DNA, 22 bp, Artificial Sequence
  chemically synthesized
tttagatatgggaaatagaaat

SEQ ID NO: 761130 - DNA, 22 bp, Artificial Sequence
  chemically synthesized
acaaaggtttgtaatttctatt

SEQ ID NO: 761131 - DNA, 22 bp, Artificial Sequence
  chemically synthesized
agatatgggaaatagaaattac

SEQ ID NO: 761132 - DNA, 22 bp, Artificial Sequence
  chemically synthesized
gatatgggaaatagaaattaca

SEQ ID NO: 761133 - DNA, 22 bp, Artificial Sequence
  chemically synthesized
atctaacaaaggtttgtaattt

SEQ ID NO: 761134 - DNA, 22 bp, Artificial Sequence
  chemically synthesized
tcatctaacaaaggtttgtaat

SEQ ID NO: 761135 - DNA, 22 bp, Artificial Sequence
  chemically synthesized
ctcatctaacaaaggtttgtaa

SEQ ID NO: 761136 - DNA, 22 bp, Artificial Sequence
  chemically synthesized
tctcatctaacaaaggtttgta

SEQ ID NO: 761137 - DNA, 22 bp, Artificial Sequence
  chemically synthesized
aggattttctcatctaacaaag

SEQ ID NO: 761138 - DNA, 22 bp, Artificial Sequence
  chemically synthesized
aaggattttctcatctaacaaa

SEQ ID NO: 761139 - DNA, 22 bp, Artificial Sequence
  chemically synthesized
caaacctttgttagatgagaaa

SEQ ID NO: 761140 - DNA, 22 bp, Artificial Sequence
  chemically synthesized
aggtttaaggattttctcatct

SEQ ID NO: 761141 - DNA, 22 bp, Artificial Sequence
  chemically synthesized
tgttagatgagaaaatccttaa

SEQ ID NO: 761142 - DNA, 22 bp, Artificial Sequence
  chemically synthesized
gttagatgagaaaatccttaaa

SEQ ID NO: 761143 - DNA, 22 bp, Artificial Sequence
  chemically synthesized
aaaccactaaggtttaaggatt

SEQ ID NO: 761144 - DNA, 22 bp, Artificial Sequence
  chemically synthesized
ttagatgagaaaatccttaaac

SEQ ID NO: 761145 - DNA, 22 bp, Artificial Sequence
  chemically synthesized
gatgagaaaatccttaaacctt

SEQ ID NO: 761146 - DNA, 22 bp, Artificial Sequence
  chemically synthesized
gttaaaaccactaaggtttaag

SEQ ID NO: 761147 - DNA, 22 bp, Artificial Sequence
  chemically synthesized
ggttaaaaccactaaggtttaa

SEQ ID NO: 761148 - DNA, 22 bp, Artificial Sequence
  chemically synthesized
aaaccttagtggttttaaccaa

SEQ ID NO: 761149 - DNA, 22 bp, Artificial Sequence
  chemically synthesized
aaccttagtggttttaaccaaa

SEQ ID NO: 761150 - DNA, 22 bp, Artificial Sequence
  chemically synthesized
agagatcaaaaacatttggtta

SEQ ID NO: 761151 - DNA, 22 bp, Artificial Sequence
  chemically synthesized
ttcagagatcaaaaacatttgg

SEQ ID NO: 761152 - DNA, 22 bp, Artificial Sequence
  chemically synthesized
agtggttttaaccaaatgtttt

SEQ ID NO: 761153 - DNA, 22 bp, Artificial Sequence
  chemically synthesized
gttcagagatcaaaaacatttg

SEQ ID NO: 761154 - DNA, 22 bp, Artificial Sequence
  chemically synthesized
gtggttttaaccaaatgttttt

SEQ ID NO: 761155 - DNA, 22 bp, Artificial Sequence
  chemically synthesized
tgttcagagatcaaaaacattt

SEQ ID NO: 761156 - DNA, 22 bp, Artificial Sequence
  chemically synthesized
ttgttcagagatcaaaaacatt

SEQ ID NO: 761157 - DNA, 22 bp, Artificial Sequence
  chemically synthesized
tttgttcagagatcaaaaacat

SEQ ID NO: 761158 - DNA, 22 bp, Artificial Sequence
  chemically synthesized
taaccaaatgtttttgatctct

SEQ ID NO: 761159 - DNA, 22 bp, Artificial Sequence
  chemically synthesized
aaccaaatgtttttgatctctg

SEQ ID NO: 761160 - DNA, 22 bp, Artificial Sequence
  chemically synthesized
accaaatgtttttgatctctga

SEQ ID NO: 761161 - DNA, 22 bp, Artificial Sequence
  chemically synthesized
acagcaacaagcctttttgttc

SEQ ID NO: 761162 - DNA, 22 bp, Artificial Sequence
  chemically synthesized
aacagcaacaagcctttttgtt

SEQ ID NO: 761163 - DNA, 22 bp, Artificial Sequence
  chemically synthesized
ttgatctctgaacaaaaaggct

SEQ ID NO: 761164 - DNA, 22 bp, Artificial Sequence
  chemically synthesized
tgatctctgaacaaaaaggctt

SEQ ID NO: 761165 - DNA, 22 bp, Artificial Sequence
  chemically synthesized
gatctctgaacaaaaaggcttg

SEQ ID NO: 761166 - DNA, 22 bp, Artificial Sequence
  chemically synthesized
atttaacagcaacaagcctttt

SEQ ID NO: 761167 - DNA, 22 bp, Artificial Sequence
  chemically synthesized
atctctgaacaaaaaggcttgt

SEQ ID NO: 761168 - DNA, 22 bp, Artificial Sequence
  chemically synthesized
aatttaacagcaacaagccttt

SEQ ID NO: 761169 - DNA, 22 bp, Artificial Sequence
  chemically synthesized
atttaatttaacagcaacaagc

SEQ ID NO: 761170 - DNA, 22 bp, Artificial Sequence
  chemically synthesized
tgaacaaaaaggcttgttgctg

SEQ ID NO: 761171 - DNA, 22 bp, Artificial Sequence
  chemically synthesized
aatttaatttaacagcaacaag

SEQ ID NO: 761172 - DNA, 22 bp, Artificial Sequence
  chemically synthesized
aacaaaaaggcttgttgctgtt

SEQ ID NO: 761173 - DNA, 22 bp, Artificial Sequence
  chemically synthesized
ggcccaatttaatttaatttaa

SEQ ID NO: 761174 - DNA, 22 bp, Artificial Sequence
  chemically synthesized
aggcccaatttaatttaattta

SEQ ID NO: 761175 - DNA, 22 bp, Artificial Sequence
  chemically synthesized
taggcccaatttaatttaattt

SEQ ID NO: 761176 - DNA, 22 bp, Artificial Sequence
  chemically synthesized
gttgctgttaaattaaattaaa

SEQ ID NO: 761177 - DNA, 22 bp, Artificial Sequence
  chemically synthesized
ttgctgttaaattaaattaaat

SEQ ID NO: 761178 - DNA, 22 bp, Artificial Sequence
  chemically synthesized
ctgttaaattaaattaaattgg

SEQ ID NO: 761179 - DNA, 22 bp, Artificial Sequence
  chemically synthesized
ttaaattaaattaaattgggcc

SEQ ID NO: 761180 - DNA, 22 bp, Artificial Sequence
  chemically synthesized
aattaaattaaattgggcctaa

SEQ ID NO: 761181 - DNA, 22 bp, Artificial Sequence
  chemically synthesized
tgtacagagtcagctttaggcc

SEQ ID NO: 761182 - DNA, 22 bp, Artificial Sequence
  chemically synthesized
aattaaattgggcctaaagctg

SEQ ID NO: 761183 - DNA, 22 bp, Artificial Sequence
  chemically synthesized
ctatgtacagagtcagctttag

SEQ ID NO: 761184 - DNA, 22 bp, Artificial Sequence
  chemically synthesized
gctatgtacagagtcagcttta

SEQ ID NO: 761185 - DNA, 22 bp, Artificial Sequence
  chemically synthesized
aattgggcctaaagctgactct

SEQ ID NO: 761186 - DNA, 22 bp, Artificial Sequence
  chemically synthesized
cagtttgctatgtacagagtca

SEQ ID NO: 761187 - DNA, 22 bp, Artificial Sequence
  chemically synthesized
ggcctaaagctgactctgtaca

SEQ ID NO: 761188 - DNA, 22 bp, Artificial Sequence
  chemically synthesized
ggttgcagtttgctatgtacag

SEQ ID NO: 761189 - DNA, 22 bp, Artificial Sequence
  chemically synthesized
aagctgactctgtacatagcaa

SEQ ID NO: 761190 - DNA, 22 bp, Artificial Sequence
  chemically synthesized
actctgtacatagcaaactgca

SEQ ID NO: 761191 - DNA, 22 bp, Artificial Sequence
  chemically synthesized
catgccaagctgggttgcagtt

SEQ ID NO: 761192 - DNA, 22 bp, Artificial Sequence
  chemically synthesized
tgtacatagcaaactgcaaccc

SEQ ID NO: 761193 - DNA, 22 bp, Artificial Sequence
  chemically synthesized
acatgccaagctgggttgcagt

SEQ ID NO: 761194 - DNA, 22 bp, Artificial Sequence
  chemically synthesized
tacatagcaaactgcaacccag

SEQ ID NO: 761195 - DNA, 22 bp, Artificial Sequence
  chemically synthesized
cttacatgccaagctgggttgc

SEQ ID NO: 761196 - DNA, 22 bp, Artificial Sequence
  chemically synthesized
catattgcttacatgccaagct

SEQ ID NO: 761197 - DNA, 22 bp, Artificial Sequence
  chemically synthesized
agttgcatattgcttacatgcc

SEQ ID NO: 761198 - DNA, 22 bp, Artificial Sequence
  chemically synthesized
caacccagcttggcatgtaagc

SEQ ID NO: 761199 - DNA, 22 bp, Artificial Sequence
  chemically synthesized
aagttgcatattgcttacatgc

SEQ ID NO: 761200 - DNA, 22 bp, Artificial Sequence
  chemically synthesized
ttaagttgcatattgcttacat

SEQ ID NO: 761201 - DNA, 22 bp, Artificial Sequence
  chemically synthesized
ggcatgtaagcaatatgcaact

SEQ ID NO: 761202 - DNA, 22 bp, Artificial Sequence
  chemically synthesized
gcatgtaagcaatatgcaactt

SEQ ID NO: 761203 - DNA, 22 bp, Artificial Sequence
  chemically synthesized
caagaatgtactcttaagttgc

SEQ ID NO: 761204 - DNA, 22 bp, Artificial Sequence
  chemically synthesized
ttacaagaatgtactcttaagt

SEQ ID NO: 761205 - DNA, 22 bp, Artificial Sequence
  chemically synthesized
gttacaagaatgtactcttaag

SEQ ID NO: 761206 - DNA, 22 bp, Artificial Sequence
  chemically synthesized
tttgttacaagaatgtactctt

SEQ ID NO: 761207 - DNA, 22 bp, Artificial Sequence
  chemically synthesized
agctatttgttacaagaatgta

SEQ ID NO: 761208 - DNA, 22 bp, Artificial Sequence
  chemically synthesized
aggctcagctatttgttacaag

SEQ ID NO: 761209 - DNA, 22 bp, Artificial Sequence
  chemically synthesized
aagagtacattcttgtaacaaa

SEQ ID NO: 761210 - DNA, 22 bp, Artificial Sequence
  chemically synthesized
agagtacattcttgtaacaaat

SEQ ID NO: 761211 - DNA, 22 bp, Artificial Sequence
  chemically synthesized
gctgaggctcagctatttgtta

SEQ ID NO: 761212 - DNA, 22 bp, Artificial Sequence
  chemically synthesized
ggattggctgaggctcagctat

SEQ ID NO: 761213 - DNA, 22 bp, Artificial Sequence
  chemically synthesized
ttgtaacaaatagctgagcctc

SEQ ID NO: 761214 - DNA, 22 bp, Artificial Sequence
  chemically synthesized
ctgggattggctgaggctcagc

SEQ ID NO: 761215 - DNA, 22 bp, Artificial Sequence
  chemically synthesized
gtaacaaatagctgagcctcag

SEQ ID NO: 761216 - DNA, 22 bp, Artificial Sequence
  chemically synthesized
taacaaatagctgagcctcagc

SEQ ID NO: 761217 - DNA, 22 bp, Artificial Sequence
  chemically synthesized
actgctgggattggctgaggct

SEQ ID NO: 761218 - DNA, 22 bp, Artificial Sequence
  chemically synthesized
gactgctgggattggctgaggc

SEQ ID NO: 761219 - DNA, 22 bp, Artificial Sequence
  chemically synthesized
aaacttgactgctgggattggc

SEQ ID NO: 761220 - DNA, 22 bp, Artificial Sequence
  chemically synthesized
gctgaaacttgactgctgggat

SEQ ID NO: 761221 - DNA, 22 bp, Artificial Sequence
  chemically synthesized
agcctcagccaatcccagcagt

SEQ ID NO: 761222 - DNA, 22 bp, Artificial Sequence
  chemically synthesized
tgattagctgaaacttgactgc

SEQ ID NO: 761223 - DNA, 22 bp, Artificial Sequence
  chemically synthesized
agccaatcccagcagtcaagtt

SEQ ID NO: 761224 - DNA, 22 bp, Artificial Sequence
  chemically synthesized
cagcctgtgattagctgaaact

SEQ ID NO: 761225 - DNA, 22 bp, Artificial Sequence
  chemically synthesized
acagcctgtgattagctgaaac

SEQ ID NO: 761226 - DNA, 22 bp, Artificial Sequence
  chemically synthesized
atcagtttacagcctgtgatta

SEQ ID NO: 761227 - DNA, 22 bp, Artificial Sequence
  chemically synthesized
cagctaatcacaggctgtaaac

SEQ ID NO: 761228 - DNA, 22 bp, Artificial Sequence
  chemically synthesized
agctaatcacaggctgtaaact

SEQ ID NO: 761229 - DNA, 22 bp, Artificial Sequence
  chemically synthesized
atcacaggctgtaaactgatca

SEQ ID NO: 761230 - DNA, 22 bp, Artificial Sequence
  chemically synthesized
tatggacatgagctgatcagtt

SEQ ID NO: 761231 - DNA, 22 bp, Artificial Sequence
  chemically synthesized
atatggacatgagctgatcagt

SEQ ID NO: 761232 - DNA, 22 bp, Artificial Sequence
  chemically synthesized
ccttatatggacatgagctgat

SEQ ID NO: 761233 - DNA, 22 bp, Artificial Sequence
  chemically synthesized
gccttatatggacatgagctga

SEQ ID NO: 761234 - DNA, 22 bp, Artificial Sequence
  chemically synthesized
taaactgatcagctcatgtcca

SEQ ID NO: 761235 - DNA, 22 bp, Artificial Sequence
  chemically synthesized
atcagctcatgtccatataagg

SEQ ID NO: 761236 - DNA, 22 bp, Artificial Sequence
  chemically synthesized
atgtccatataaggcaaatgcc

SEQ ID NO: 761237 - DNA, 22 bp, Artificial Sequence
  chemically synthesized
ggcatagtgtaaataggcattt

SEQ ID NO: 761238 - DNA, 22 bp, Artificial Sequence
  chemically synthesized
gggcatagtgtaaataggcatt

SEQ ID NO: 761239 - DNA, 22 bp, Artificial Sequence
  chemically synthesized
cttgggcatagtgtaaataggc

SEQ ID NO: 761240 - DNA, 22 bp, Artificial Sequence
  chemically synthesized
acttgggcatagtgtaaatagg

SEQ ID NO: 761241 - DNA, 22 bp, Artificial Sequence
  chemically synthesized
ccttacttgggcatagtgtaaa

SEQ ID NO: 761242 - DNA, 22 bp, Artificial Sequence
  chemically synthesized
gccttacttgggcatagtgtaa

SEQ ID NO: 761243 - DNA, 22 bp, Artificial Sequence
  chemically synthesized
gaatttgccttacttgggcata

SEQ ID NO: 761244 - DNA, 22 bp, Artificial Sequence
  chemically synthesized
agaatttgccttacttgggcat

SEQ ID NO: 761245 - DNA, 22 bp, Artificial Sequence
  chemically synthesized
tttacactatgcccaagtaagg

SEQ ID NO: 761246 - DNA, 22 bp, Artificial Sequence
  chemically synthesized
cagcttagaatttgccttactt

SEQ ID NO: 761247 - DNA, 22 bp, Artificial Sequence
  chemically synthesized
acactatgcccaagtaaggcaa

SEQ ID NO: 761248 - DNA, 22 bp, Artificial Sequence
  chemically synthesized
cactatgcccaagtaaggcaaa

SEQ ID NO: 761249 - DNA, 22 bp, Artificial Sequence
  chemically synthesized
gttacagcttagaatttgcctt

SEQ ID NO: 761250 - DNA, 22 bp, Artificial Sequence
  chemically synthesized
tgcccaagtaaggcaaattcta

SEQ ID NO: 761251 - DNA, 22 bp, Artificial Sequence
  chemically synthesized
actggttacagcttagaatttg

SEQ ID NO: 761252 - DNA, 22 bp, Artificial Sequence
  chemically synthesized
gactggttacagcttagaattt

SEQ ID NO: 761253 - DNA, 22 bp, Artificial Sequence
  chemically synthesized
taagctgtaaccagtcaagctg

SEQ ID NO: 761254 - DNA, 22 bp, Artificial Sequence
  chemically synthesized
agctgtaaccagtcaagctgtt

SEQ ID NO: 761255 - DNA, 22 bp, Artificial Sequence
  chemically synthesized
taaccagtcaagctgtttctgt

SEQ ID NO: 761256 - DNA, 22 bp, Artificial Sequence
  chemically synthesized
tagatagaaaaaggaagtgaca

SEQ ID NO: 761257 - DNA, 22 bp, Artificial Sequence
  chemically synthesized
atagatagaaaaaggaagtgac

SEQ ID NO: 761258 - DNA, 22 bp, Artificial Sequence
  chemically synthesized
tttctgtatgtcacttcctttt

SEQ ID NO: 761259 - DNA, 22 bp, Artificial Sequence
  chemically synthesized
ctgtatgtcacttcctttttct

SEQ ID NO: 761260 - DNA, 22 bp, Artificial Sequence
  chemically synthesized
tgtatgtcacttcctttttcta

SEQ ID NO: 761261 - DNA, 22 bp, Artificial Sequence
  chemically synthesized
tatgtcacttcctttttctatc

SEQ ID NO: 761262 - DNA, 22 bp, Artificial Sequence
  chemically synthesized
cctttttctatctataaatact

SEQ ID NO: 761263 - DNA, 22 bp, Artificial Sequence
  chemically synthesized
ctttttctatctataaatactg

SEQ ID NO: 761264 - DNA, 22 bp, Artificial Sequence
  chemically synthesized
tttctatctataaatactgcct

SEQ ID NO: 761265 - DNA, 22 bp, Artificial Sequence
  chemically synthesized
ttctatctataaatactgcctg

SEQ ID NO: 761266 - DNA, 22 bp, Artificial Sequence
  chemically synthesized
tctatctataaatactgcctgc

SEQ ID NO: 761267 - DNA, 22 bp, Artificial Sequence
  chemically synthesized
ctatctataaatactgcctgcc

SEQ ID NO: 761268 - DNA, 22 bp, Artificial Sequence
  chemically synthesized
tatctataaatactgcctgccc

SEQ ID NO: 761269 - DNA, 22 bp, Artificial Sequence
  chemically synthesized
cacccagcaaggtgggcaggca

SEQ ID NO: 761270 - DNA, 22 bp, Artificial Sequence
  chemically synthesized
tctataaatactgcctgcccac

SEQ ID NO: 761271 - DNA, 22 bp, Artificial Sequence
  chemically synthesized
taaatactgcctgcccaccttg

SEQ ID NO: 761272 - DNA, 22 bp, Artificial Sequence
  chemically synthesized
agaaagctccacccagcaaggt

SEQ ID NO: 761273 - DNA, 22 bp, Artificial Sequence
  chemically synthesized
cctgcccaccttgctgggtgga

SEQ ID NO: 761274 - DNA, 22 bp, Artificial Sequence
  chemically synthesized
gaagttcagaaagctccaccca

SEQ ID NO: 761275 - DNA, 22 bp, Artificial Sequence
  chemically synthesized
cccaccttgctgggtggagctt

SEQ ID NO: 761276 - DNA, 22 bp, Artificial Sequence
  chemically synthesized
agaattagaagttcagaaagct

SEQ ID NO: 761277 - DNA, 22 bp, Artificial Sequence
  chemically synthesized
gctgggtggagctttctgaact

SEQ ID NO: 761278 - DNA, 22 bp, Artificial Sequence
  chemically synthesized
ctgggtggagctttctgaactt

SEQ ID NO: 761279 - DNA, 22 bp, Artificial Sequence
  chemically synthesized
ggtggagctttctgaacttcta

SEQ ID NO: 761280 - DNA, 22 bp, Artificial Sequence
  chemically synthesized
tctgaacttctaattctgagta

SEQ ID NO: 761281 - DNA, 22 bp, Artificial Sequence
  chemically synthesized
ctgaacttctaattctgagtac

SEQ ID NO: 761282 - DNA, 22 bp, Artificial Sequence
  chemically synthesized
atgaatcagacagtactcagaa

SEQ ID NO: 761283 - DNA, 22 bp, Artificial Sequence
  chemically synthesized
tgaacttctaattctgagtact

SEQ ID NO: 761284 - DNA, 22 bp, Artificial Sequence
  chemically synthesized
aacttctaattctgagtactgt

SEQ ID NO: 761285 - DNA, 22 bp, Artificial Sequence
  chemically synthesized
ctaattctgagtactgtctgat

SEQ ID NO: 761286 - DNA, 22 bp, Artificial Sequence
  chemically synthesized
taattctgagtactgtctgatt

SEQ ID NO: 761287 - DNA, 22 bp, Artificial Sequence
  chemically synthesized
attctgagtactgtctgattca

SEQ ID NO: 761288 - DNA, 22 bp, Artificial Sequence
  chemically synthesized
tgagtactgtctgattcatgaa

SEQ ID NO: 761289 - DNA, 22 bp, Artificial Sequence
  chemically synthesized
agcaaaaaacaattcatgaatc

SEQ ID NO: 761290 - DNA, 22 bp, Artificial Sequence
  chemically synthesized
gagcaaaaaacaattcatgaat

SEQ ID NO: 761291 - DNA, 22 bp, Artificial Sequence
  chemically synthesized
agtactgtctgattcatgaatt

SEQ ID NO: 761292 - DNA, 22 bp, Artificial Sequence
  chemically synthesized
tttgagcaaaaaacaattcatg

SEQ ID NO: 761293 - DNA, 22 bp, Artificial Sequence
  chemically synthesized
atttgagcaaaaaacaattcat

SEQ ID NO: 761294 - DNA, 22 bp, Artificial Sequence
  chemically synthesized
tctgattcatgaattgtttttt

SEQ ID NO: 761295 - DNA, 22 bp, Artificial Sequence
  chemically synthesized
attcatgaattgttttttgctc

SEQ ID NO: 761296 - DNA, 22 bp, Artificial Sequence
  chemically synthesized
cagagtttatttgagcaaaaaa

SEQ ID NO: 761297 - DNA, 22 bp, Artificial Sequence
  chemically synthesized
gcagagtttatttgagcaaaaa

SEQ ID NO: 761298 - DNA, 22 bp, Artificial Sequence
  chemically synthesized
tgcagagtttatttgagcaaaa

SEQ ID NO: 761299 - DNA, 22 bp, Artificial Sequence
  chemically synthesized
atgaattgttttttgctcaaat

SEQ ID NO: 761300 - DNA, 22 bp, Artificial Sequence
  chemically synthesized
cgttttgcagagtttatttgag

SEQ ID NO: 761301 - DNA, 22 bp, Artificial Sequence
  chemically synthesized
ttttttgctcaaataaactctg

SEQ ID NO: 761302 - DNA, 22 bp, Artificial Sequence
  chemically synthesized
tttgctcaaataaactctgcaa

SEQ ID NO: 761303 - DNA, 22 bp, Artificial Sequence
  chemically synthesized
ttgctcaaataaactctgcaaa

SEQ ID NO: 761304 - DNA, 22 bp, Artificial Sequence
  chemically synthesized
gacaaattccgttttgcagagt

SEQ ID NO: 761305 - DNA, 22 bp, Artificial Sequence
  chemically synthesized
tgctcaaataaactctgcaaaa

SEQ ID NO: 761306 - DNA, 22 bp, Artificial Sequence
  chemically synthesized
agacaaattccgttttgcagag

SEQ ID NO: 761307 - DNA, 22 bp, Artificial Sequence
  chemically synthesized
gctcaaataaactctgcaaaac

SEQ ID NO: 761308 - DNA, 22 bp, Artificial Sequence
  chemically synthesized
tagacaaattccgttttgcaga

SEQ ID NO: 761309 - DNA, 22 bp, Artificial Sequence
  chemically synthesized
ctcaaataaactctgcaaaacg

SEQ ID NO: 761310 - DNA, 22 bp, Artificial Sequence
  chemically synthesized
aaataaactctgcaaaacggaa

SEQ ID NO: 761311 - DNA, 22 bp, Artificial Sequence
  chemically synthesized
aaagacaaactttagacaaatt

SEQ ID NO: 761312 - DNA, 22 bp, Artificial Sequence
  chemically synthesized
tgcaaaacggaatttgtctaaa

SEQ ID NO: 761313 - DNA, 22 bp, Artificial Sequence
  chemically synthesized
caaaacggaatttgtctaaagt

SEQ ID NO: 761314 - DNA, 22 bp, Artificial Sequence
  chemically synthesized
gcaatgttaaaagacaaacttt

SEQ ID NO: 761315 - DNA, 22 bp, Artificial Sequence
  chemically synthesized
acaattagcaatgttaaaagac

SEQ ID NO: 761316 - DNA, 22 bp, Artificial Sequence
  chemically synthesized
gtctaaagtttgtcttttaaca

SEQ ID NO: 761317 - DNA, 22 bp, Artificial Sequence
  chemically synthesized
gacaattagcaatgttaaaaga

SEQ ID NO: 761318 - DNA, 22 bp, Artificial Sequence
  chemically synthesized
tctaaagtttgtcttttaacat

SEQ ID NO: 761319 - DNA, 22 bp, Artificial Sequence
  chemically synthesized
aagtttgtcttttaacattgct

SEQ ID NO: 761320 - DNA, 22 bp, Artificial Sequence
  chemically synthesized
gtcttttaacattgctaattgt

SEQ ID NO: 761321 - DNA, 22 bp, Artificial Sequence
  chemically synthesized
tcttttaacattgctaattgtc

SEQ ID NO: 761322 - DNA, 22 bp, Artificial Sequence
  chemically synthesized
ttaacattgctaattgtcaaat

SEQ ID NO: 761323 - DNA, 22 bp, Artificial Sequence
  chemically synthesized
taacattgctaattgtcaaata

SEQ ID NO: 761324 - DNA, 22 bp, Artificial Sequence
  chemically synthesized
aacattgctaattgtcaaatat

SEQ ID NO: 761325 - DNA, 22 bp, Artificial Sequence
  chemically synthesized
acattgctaattgtcaaatata

SEQ ID NO: 761326 - DNA, 22 bp, Artificial Sequence
  chemically synthesized
ctaattgtcaaatatattctgc

SEQ ID NO: 761327 - DNA, 22 bp, Artificial Sequence
  chemically synthesized
attgtcaaatatattctgctta

SEQ ID NO: 761328 - DNA, 22 bp, Artificial Sequence
  chemically synthesized
agtgggtaggagtaagcagaat

SEQ ID NO: 761329 - DNA, 22 bp, Artificial Sequence
  chemically synthesized
tcaaatatattctgcttactcc

SEQ ID NO: 761330 - DNA, 22 bp, Artificial Sequence
  chemically synthesized
cgttgagtgggtaggagtaagc

SEQ ID NO: 761331 - DNA, 22 bp, Artificial Sequence
  chemically synthesized
ccgttgagtgggtaggagtaag

SEQ ID NO: 761332 - DNA, 22 bp, Artificial Sequence
  chemically synthesized
tccgttgagtgggtaggagtaa

SEQ ID NO: 761333 - DNA, 22 bp, Artificial Sequence
  chemically synthesized
ttttccgttgagtgggtaggag

SEQ ID NO: 761334 - DNA, 22 bp, Artificial Sequence
  chemically synthesized
attttccgttgagtgggtagga

SEQ ID NO: 761335 - DNA, 22 bp, Artificial Sequence
  chemically synthesized
tattttccgttgagtgggtagg

SEQ ID NO: 761336 - DNA, 22 bp, Artificial Sequence
  chemically synthesized
ttattttccgttgagtgggtag

SEQ ID NO: 761337 - DNA, 22 bp, Artificial Sequence
  chemically synthesized
ttttattttccgttgagtgggt

SEQ ID NO: 761338 - DNA, 22 bp, Artificial Sequence
  chemically synthesized
tgcttactcctacccactcaac

SEQ ID NO: 761339 - DNA, 22 bp, Artificial Sequence
  chemically synthesized
cttactcctacccactcaacgg

SEQ ID NO: 761340 - DNA, 22 bp, Artificial Sequence
  chemically synthesized
actcctacccactcaacggaaa

SEQ ID NO: 761341 - DNA, 22 bp, Artificial Sequence
  chemically synthesized
ctcctacccactcaacggaaaa

SEQ ID NO: 761342 - DNA, 22 bp, Artificial Sequence
  chemically synthesized
aaccacctcttttattttccgt

SEQ ID NO: 761343 - DNA, 22 bp, Artificial Sequence
  chemically synthesized
ctacccactcaacggaaaataa

SEQ ID NO: 761344 - DNA, 22 bp, Artificial Sequence
  chemically synthesized
gaaccacctcttttattttccg

SEQ ID NO: 761345 - DNA, 22 bp, Artificial Sequence
  chemically synthesized
tgaaccacctcttttattttcc

SEQ ID NO: 761346 - DNA, 22 bp, Artificial Sequence
  chemically synthesized
cccactcaacggaaaataaaag

SEQ ID NO: 761347 - DNA, 22 bp, Artificial Sequence
  chemically synthesized
aacggaaaataaaagaggtggt

SEQ ID NO: 761348 - DNA, 22 bp, Artificial Sequence
  chemically synthesized
agcatgcccctttgaaccacct

SEQ ID NO: 761349 - DNA, 22 bp, Artificial Sequence
  chemically synthesized
atagacatagatagaagctaag

SEQ ID NO: 761350 - DNA, 22 bp, Artificial Sequence
  chemically synthesized
aaaggggcatgcttagcttcta

SEQ ID NO: 761351 - DNA, 22 bp, Artificial Sequence
  chemically synthesized
ataaagattaatagacatagat

SEQ ID NO: 761352 - DNA, 22 bp, Artificial Sequence
  chemically synthesized
actaataaagattaatagacat

SEQ ID NO: 761353 - DNA, 22 bp, Artificial Sequence
  chemically synthesized
agcttctatctatgtctattaa

SEQ ID NO: 761354 - DNA, 22 bp, Artificial Sequence
  chemically synthesized
cactaataaagattaatagaca

SEQ ID NO: 761355 - DNA, 22 bp, Artificial Sequence
  chemically synthesized
gcttctatctatgtctattaat

SEQ ID NO: 761356 - DNA, 22 bp, Artificial Sequence
  chemically synthesized
tcttcactaataaagattaata

SEQ ID NO: 761357 - DNA, 22 bp, Artificial Sequence
  chemically synthesized
ctatctatgtctattaatcttt

SEQ ID NO: 761358 - DNA, 22 bp, Artificial Sequence
  chemically synthesized
gtcttcactaataaagattaat

SEQ ID NO: 761359 - DNA, 22 bp, Artificial Sequence
  chemically synthesized
tatctatgtctattaatcttta

SEQ ID NO: 761360 - DNA, 22 bp, Artificial Sequence
  chemically synthesized
ttgtcttcactaataaagatta

SEQ ID NO: 761361 - DNA, 22 bp, Artificial Sequence
  chemically synthesized
tctatgtctattaatctttatt

SEQ ID NO: 761362 - DNA, 22 bp, Artificial Sequence
  chemically synthesized
tgtctattaatctttattagtg

SEQ ID NO: 761363 - DNA, 22 bp, Artificial Sequence
  chemically synthesized
agctcttgtcttcactaataaa

SEQ ID NO: 761364 - DNA, 22 bp, Artificial Sequence
  chemically synthesized
ttaatctttattagtgaagaca

SEQ ID NO: 761365 - DNA, 22 bp, Artificial Sequence
  chemically synthesized
atctttattagtgaagacaaga

SEQ ID NO: 761366 - DNA, 22 bp, Artificial Sequence
  chemically synthesized
tattagtgaagacaagagctta

SEQ ID NO: 761367 - DNA, 22 bp, Artificial Sequence
  chemically synthesized
attagtgaagacaagagcttag

SEQ ID NO: 761368 - DNA, 22 bp, Artificial Sequence
  chemically synthesized
ttagtgaagacaagagcttagg

SEQ ID NO: 761369 - DNA, 22 bp, Artificial Sequence
  chemically synthesized
aacggtagtaacccctaagctc

SEQ ID NO: 761370 - DNA, 22 bp, Artificial Sequence
  chemically synthesized
gtgaagacaagagcttaggggt

SEQ ID NO: 761371 - DNA, 22 bp, Artificial Sequence
  chemically synthesized
ttaaacggtagtaacccctaag

SEQ ID NO: 761372 - DNA, 22 bp, Artificial Sequence
  chemically synthesized
gttaaacggtagtaacccctaa

SEQ ID NO: 761373 - DNA, 22 bp, Artificial Sequence
  chemically synthesized
ccttgttaaacggtagtaaccc

SEQ ID NO: 761374 - DNA, 22 bp, Artificial Sequence
  chemically synthesized
gccttgttaaacggtagtaacc

SEQ ID NO: 761375 - DNA, 22 bp, Artificial Sequence
  chemically synthesized
gcacttgccttgttaaacggta

SEQ ID NO: 761376 - DNA, 22 bp, Artificial Sequence
  chemically synthesized
aggggttactaccgtttaacaa

SEQ ID NO: 761377 - DNA, 22 bp, Artificial Sequence
  chemically synthesized
ggggttactaccgtttaacaag

SEQ ID NO: 761378 - DNA, 22 bp, Artificial Sequence
  chemically synthesized
gagattagcacttgccttgtta

SEQ ID NO: 761379 - DNA, 22 bp, Artificial Sequence
  chemically synthesized
agagattagcacttgccttgtt

SEQ ID NO: 761380 - DNA, 22 bp, Artificial Sequence
  chemically synthesized
tagagattagcacttgccttgt

SEQ ID NO: 761381 - DNA, 22 bp, Artificial Sequence
  chemically synthesized
ttagagattagcacttgccttg

SEQ ID NO: 761382 - DNA, 22 bp, Artificial Sequence
  chemically synthesized
ctaccgtttaacaaggcaagtg

SEQ ID NO: 761383 - DNA, 22 bp, Artificial Sequence
  chemically synthesized
tttagagattagcacttgcctt

SEQ ID NO: 761384 - DNA, 22 bp, Artificial Sequence
  chemically synthesized
ccgtttaacaaggcaagtgcta

SEQ ID NO: 761385 - DNA, 22 bp, Artificial Sequence
  chemically synthesized
tcagctttttagagattagcac

SEQ ID NO: 761386 - DNA, 22 bp, Artificial Sequence
  chemically synthesized
aacaaggcaagtgctaatctct

SEQ ID NO: 761387 - DNA, 22 bp, Artificial Sequence
  chemically synthesized
acaaggcaagtgctaatctcta

SEQ ID NO: 761388 - DNA, 22 bp, Artificial Sequence
  chemically synthesized
tggaaattatcagctttttaga

SEQ ID NO: 761389 - DNA, 22 bp, Artificial Sequence
  chemically synthesized
caaattgtggaaattatcagct

SEQ ID NO: 761390 - DNA, 22 bp, Artificial Sequence
  chemically synthesized
acaaattgtggaaattatcagc

SEQ ID NO: 761391 - DNA, 22 bp, Artificial Sequence
  chemically synthesized
atctctaaaaagctgataattt

SEQ ID NO: 761392 - DNA, 22 bp, Artificial Sequence
  chemically synthesized
taaaaagctgataatttccaca

SEQ ID NO: 761393 - DNA, 22 bp, Artificial Sequence
  chemically synthesized
aaccttacaaattgtggaaatt

SEQ ID NO: 761394 - DNA, 22 bp, Artificial Sequence
  chemically synthesized
aaaagctgataatttccacaat

SEQ ID NO: 761395 - DNA, 22 bp, Artificial Sequence
  chemically synthesized
cctaaaccttacaaattgtgga

SEQ ID NO: 761396 - DNA, 22 bp, Artificial Sequence
  chemically synthesized
acctaaaccttacaaattgtgg

SEQ ID NO: 761397 - DNA, 22 bp, Artificial Sequence
  chemically synthesized
tacctaaaccttacaaattgtg

SEQ ID NO: 761398 - DNA, 22 bp, Artificial Sequence
  chemically synthesized
ataatttccacaatttgtaagg

SEQ ID NO: 761399 - DNA, 22 bp, Artificial Sequence
  chemically synthesized
cgttttacctaaaccttacaaa

SEQ ID NO: 761400 - DNA, 22 bp, Artificial Sequence
  chemically synthesized
tgcgttttacctaaaccttaca

SEQ ID NO: 761401 - DNA, 22 bp, Artificial Sequence
  chemically synthesized
ccacaatttgtaaggtttaggt

SEQ ID NO: 761402 - DNA, 22 bp, Artificial Sequence
  chemically synthesized
cacaatttgtaaggtttaggta

SEQ ID NO: 761403 - DNA, 22 bp, Artificial Sequence
  chemically synthesized
aaggctctgcgttttacctaaa

SEQ ID NO: 761404 - DNA, 22 bp, Artificial Sequence
  chemically synthesized
gtaaggtttaggtaaaacgcag

SEQ ID NO: 761405 - DNA, 22 bp, Artificial Sequence
  chemically synthesized
taaggtttaggtaaaacgcaga

SEQ ID NO: 761406 - DNA, 22 bp, Artificial Sequence
  chemically synthesized
cagcacatctaaaggctctgcg

SEQ ID NO: 761407 - DNA, 22 bp, Artificial Sequence
  chemically synthesized
aggtaaaacgcagagcctttag

SEQ ID NO: 761408 - DNA, 22 bp, Artificial Sequence
  chemically synthesized
ggtaaaacgcagagcctttaga

SEQ ID NO: 761409 - DNA, 22 bp, Artificial Sequence
  chemically synthesized
aagaccaagcaatatactccag

SEQ ID NO: 761410 - DNA, 22 bp, Artificial Sequence
  chemically synthesized
aaagaccaagcaatatactcca

SEQ ID NO: 761411 - DNA, 22 bp, Artificial Sequence
  chemically synthesized
tagatgtgctggagtatattgc

SEQ ID NO: 761412 - DNA, 22 bp, Artificial Sequence
  chemically synthesized
cttaaagaccaagcaatatact

SEQ ID NO: 761413 - DNA, 22 bp, Artificial Sequence
  chemically synthesized
agatgtgctggagtatattgct

SEQ ID NO: 761414 - DNA, 22 bp, Artificial Sequence
  chemically synthesized
gatgtgctggagtatattgctt

SEQ ID NO: 761415 - DNA, 22 bp, Artificial Sequence
  chemically synthesized
aggagttccttaaagaccaagc

SEQ ID NO: 761416 - DNA, 22 bp, Artificial Sequence
  chemically synthesized
gagtatattgcttggtctttaa

SEQ ID NO: 761417 - DNA, 22 bp, Artificial Sequence
  chemically synthesized
acactgaggagttccttaaaga

SEQ ID NO: 761418 - DNA, 22 bp, Artificial Sequence
  chemically synthesized
cttggtctttaaggaactcctc

SEQ ID NO: 761419 - DNA, 22 bp, Artificial Sequence
  chemically synthesized
gtgtcctgacactgaggagttc

SEQ ID NO: 761420 - DNA, 22 bp, Artificial Sequence
  chemically synthesized
agtgtcctgacactgaggagtt

SEQ ID NO: 761421 - DNA, 22 bp, Artificial Sequence
  chemically synthesized
ggtctttaaggaactcctcagt

SEQ ID NO: 761422 - DNA, 22 bp, Artificial Sequence
  chemically synthesized
gtctttaaggaactcctcagtg

SEQ ID NO: 761423 - DNA, 22 bp, Artificial Sequence
  chemically synthesized
ttagtgtcctgacactgaggag

SEQ ID NO: 761424 - DNA, 22 bp, Artificial Sequence
  chemically synthesized
taaggaactcctcagtgtcagg

SEQ ID NO: 761425 - DNA, 22 bp, Artificial Sequence
  chemically synthesized
aaggaactcctcagtgtcagga

SEQ ID NO: 761426 - DNA, 22 bp, Artificial Sequence
  chemically synthesized
taattcttagtgtcctgacact

SEQ ID NO: 761427 - DNA, 22 bp, Artificial Sequence
  chemically synthesized
aggaactcctcagtgtcaggac

SEQ ID NO: 761428 - DNA, 22 bp, Artificial Sequence
  chemically synthesized
ctcagtgtcaggacactaagaa

SEQ ID NO: 761429 - DNA, 22 bp, Artificial Sequence
  chemically synthesized
tcagcccctataattcttagtg

SEQ ID NO: 761430 - DNA, 22 bp, Artificial Sequence
  chemically synthesized
atcagcccctataattcttagt

SEQ ID NO: 761431 - DNA, 22 bp, Artificial Sequence
  chemically synthesized
agtgtcaggacactaagaatta

SEQ ID NO: 761432 - DNA, 22 bp, Artificial Sequence
  chemically synthesized
tatcagcccctataattcttag

SEQ ID NO: 761433 - DNA, 22 bp, Artificial Sequence
  chemically synthesized
agaattataggggctgataaag

SEQ ID NO: 761434 - DNA, 22 bp, Artificial Sequence
  chemically synthesized
gagaaataacaatcactttatc

SEQ ID NO: 761435 - DNA, 22 bp, Artificial Sequence
  chemically synthesized
taggggctgataaagtgattgt

SEQ ID NO: 761436 - DNA, 22 bp, Artificial Sequence
  chemically synthesized
tgtctagagaaataacaatcac

SEQ ID NO: 761437 - DNA, 22 bp, Artificial Sequence
  chemically synthesized
ataaagtgattgttatttctct

SEQ ID NO: 761438 - DNA, 22 bp, Artificial Sequence
  chemically synthesized
aaatatctgtgtctagagaaat

SEQ ID NO: 761439 - DNA, 22 bp, Artificial Sequence
  chemically synthesized
ttatttctctagacacagatat

SEQ ID NO: 761440 - DNA, 22 bp, Artificial Sequence
  chemically synthesized
tttctctagacacagatatttc

SEQ ID NO: 761441 - DNA, 22 bp, Artificial Sequence
  chemically synthesized
accaaatcacagttgaaatatc

SEQ ID NO: 761442 - DNA, 22 bp, Artificial Sequence
  chemically synthesized
ctctagacacagatatttcaac

SEQ ID NO: 761443 - DNA, 22 bp, Artificial Sequence
  chemically synthesized
tctagacacagatatttcaact

SEQ ID NO: 761444 - DNA, 22 bp, Artificial Sequence
  chemically synthesized
tagacacagatatttcaactgt

SEQ ID NO: 761445 - DNA, 22 bp, Artificial Sequence
  chemically synthesized
gacacagatatttcaactgtga

SEQ ID NO: 761446 - DNA, 22 bp, Artificial Sequence
  chemically synthesized
ggcattaaccaaatcacagttg

SEQ ID NO: 761447 - DNA, 22 bp, Artificial Sequence
  chemically synthesized
aaactaggcattaaccaaatca

SEQ ID NO: 761448 - DNA, 22 bp, Artificial Sequence
  chemically synthesized
caaactaggcattaaccaaatc

SEQ ID NO: 761449 - DNA, 22 bp, Artificial Sequence
  chemically synthesized
caactgtgatttggttaatgcc

SEQ ID NO: 761450 - DNA, 22 bp, Artificial Sequence
  chemically synthesized
aactgtgatttggttaatgcct

SEQ ID NO: 761451 - DNA, 22 bp, Artificial Sequence
  chemically synthesized
aggatttcaaactaggcattaa

SEQ ID NO: 761452 - DNA, 22 bp, Artificial Sequence
  chemically synthesized
ttaaggatttcaaactaggcat

SEQ ID NO: 761453 - DNA, 22 bp, Artificial Sequence
  chemically synthesized
tgatttggttaatgcctagttt

SEQ ID NO: 761454 - DNA, 22 bp, Artificial Sequence
  chemically synthesized
attaaggatttcaaactaggca

SEQ ID NO: 761455 - DNA, 22 bp, Artificial Sequence
  chemically synthesized
tattaaggatttcaaactaggc

SEQ ID NO: 761456 - DNA, 22 bp, Artificial Sequence
  chemically synthesized
ggttaatgcctagtttgaaatc

SEQ ID NO: 761457 - DNA, 22 bp, Artificial Sequence
  chemically synthesized
gttaatgcctagtttgaaatcc

SEQ ID NO: 761458 - DNA, 22 bp, Artificial Sequence
  chemically synthesized
atgcctagtttgaaatccttaa

SEQ ID NO: 761459 - DNA, 22 bp, Artificial Sequence
  chemically synthesized
agagtaaagttttattaaggat

SEQ ID NO: 761460 - DNA, 22 bp, Artificial Sequence
  chemically synthesized
cagagtaaagttttattaagga

SEQ ID NO: 761461 - DNA, 22 bp, Artificial Sequence
  chemically synthesized
tcagagtaaagttttattaagg

SEQ ID NO: 761462 - DNA, 22 bp, Artificial Sequence
  chemically synthesized
gtttgaaatccttaataaaact

SEQ ID NO: 761463 - DNA, 22 bp, Artificial Sequence
  chemically synthesized
gaaatccttaataaaactttac

SEQ ID NO: 761464 - DNA, 22 bp, Artificial Sequence
  chemically synthesized
aaatccttaataaaactttact

SEQ ID NO: 761465 - DNA, 22 bp, Artificial Sequence
  chemically synthesized
agaatgcatgcctttcagagta

SEQ ID NO: 761466 - DNA, 22 bp, Artificial Sequence
  chemically synthesized
aagaatgcatgcctttcagagt

SEQ ID NO: 761467 - DNA, 22 bp, Artificial Sequence
  chemically synthesized
aataaaactttactctgaaagg

SEQ ID NO: 761468 - DNA, 22 bp, Artificial Sequence
  chemically synthesized
taagaatgcatgcctttcagag

SEQ ID NO: 761469 - DNA, 22 bp, Artificial Sequence
  chemically synthesized
ataaaactttactctgaaaggc

SEQ ID NO: 761470 - DNA, 22 bp, Artificial Sequence
  chemically synthesized
actttaagaatgcatgcctttc

SEQ ID NO: 761471 - DNA, 22 bp, Artificial Sequence
  chemically synthesized
cactttaagaatgcatgccttt

SEQ ID NO: 761472 - DNA, 22 bp, Artificial Sequence
  chemically synthesized
tactctgaaaggcatgcattct

SEQ ID NO: 761473 - DNA, 22 bp, Artificial Sequence
  chemically synthesized
actctgaaaggcatgcattctt

SEQ ID NO: 761474 - DNA, 22 bp, Artificial Sequence
  chemically synthesized
ctctgaaaggcatgcattctta

SEQ ID NO: 761475 - DNA, 22 bp, Artificial Sequence
  chemically synthesized
tgaaaggcatgcattcttaaag

SEQ ID NO: 761476 - DNA, 22 bp, Artificial Sequence
  chemically synthesized
aaaggcatgcattcttaaagtg

SEQ ID NO: 761477 - DNA, 22 bp, Artificial Sequence
  chemically synthesized
aatataacacatttcactttaa

SEQ ID NO: 761478 - DNA, 22 bp, Artificial Sequence
  chemically synthesized
ttaaagtgaaatgtgttatatt

SEQ ID NO: 761479 - DNA, 22 bp, Artificial Sequence
  chemically synthesized
aaagtgaaatgtgttatattga

SEQ ID NO: 761480 - DNA, 22 bp, Artificial Sequence
  chemically synthesized
aagtgaaatgtgttatattgaa

SEQ ID NO: 761481 - DNA, 22 bp, Artificial Sequence
  chemically synthesized
taaaggaagtcaaagtgaaaaa

SEQ ID NO: 761482 - DNA, 22 bp, Artificial Sequence
  chemically synthesized
tattgaattcatttttcacttt

SEQ ID NO: 761483 - DNA, 22 bp, Artificial Sequence
  chemically synthesized
ataaaggaagtcaaagtgaaaa

SEQ ID NO: 761484 - DNA, 22 bp, Artificial Sequence
  chemically synthesized
tataaaggaagtcaaagtgaaa

SEQ ID NO: 761485 - DNA, 22 bp, Artificial Sequence
  chemically synthesized
aattcatttttcactttgactt

SEQ ID NO: 761486 - DNA, 22 bp, Artificial Sequence
  chemically synthesized
gttttataaaggaagtcaaagt

SEQ ID NO: 761487 - DNA, 22 bp, Artificial Sequence
  chemically synthesized
atttttcactttgacttccttt

SEQ ID NO: 761488 - DNA, 22 bp, Artificial Sequence
  chemically synthesized
ttcactttgacttcctttataa

SEQ ID NO: 761489 - DNA, 22 bp, Artificial Sequence
  chemically synthesized
tcactttgacttcctttataaa

SEQ ID NO: 761490 - DNA, 22 bp, Artificial Sequence
  chemically synthesized
cactttgacttcctttataaaa

SEQ ID NO: 761491 - DNA, 22 bp, Artificial Sequence
  chemically synthesized
actttgacttcctttataaaac

SEQ ID NO: 761492 - DNA, 22 bp, Artificial Sequence
  chemically synthesized
tgacttcctttataaaactaat

SEQ ID NO: 761493 - DNA, 22 bp, Artificial Sequence
  chemically synthesized
tagggatatatcattagtttta

SEQ ID NO: 761494 - DNA, 22 bp, Artificial Sequence
  chemically synthesized
gacttcctttataaaactaatg

SEQ ID NO: 761495 - DNA, 22 bp, Artificial Sequence
  chemically synthesized
atagggatatatcattagtttt

SEQ ID NO: 761496 - DNA, 22 bp, Artificial Sequence
  chemically synthesized
acttcctttataaaactaatga

SEQ ID NO: 761497 - DNA, 22 bp, Artificial Sequence
  chemically synthesized
cctttataaaactaatgatata

SEQ ID NO: 761498 - DNA, 22 bp, Artificial Sequence
  chemically synthesized
ctttataaaactaatgatatat

SEQ ID NO: 761499 - DNA, 22 bp, Artificial Sequence
  chemically synthesized
aagatttatagggatatatcat

SEQ ID NO: 761500 - DNA, 22 bp, Artificial Sequence
  chemically synthesized
tataaaactaatgatatatccc

SEQ ID NO: 761501 - DNA, 22 bp, Artificial Sequence
  chemically synthesized
ataaaactaatgatatatccct

SEQ ID NO: 761502 - DNA, 22 bp, Artificial Sequence
  chemically synthesized
taaaactaatgatatatcccta

SEQ ID NO: 761503 - DNA, 22 bp, Artificial Sequence
  chemically synthesized
atgatatatccctataaatctt

SEQ ID NO: 761504 - DNA, 22 bp, Artificial Sequence
  chemically synthesized
catgagggtactaaagatttat

SEQ ID NO: 761505 - DNA, 22 bp, Artificial Sequence
  chemically synthesized
ttacatgagggtactaaagatt

SEQ ID NO: 761506 - DNA, 22 bp, Artificial Sequence
  chemically synthesized
attacatgagggtactaaagat

SEQ ID NO: 761507 - DNA, 22 bp, Artificial Sequence
  chemically synthesized
tattacatgagggtactaaaga

SEQ ID NO: 761508 - DNA, 22 bp, Artificial Sequence
  chemically synthesized
ttttattacatgagggtactaa

SEQ ID NO: 761509 - DNA, 22 bp, Artificial Sequence
  chemically synthesized
taaatctttagtaccctcatgt

SEQ ID NO: 761510 - DNA, 22 bp, Artificial Sequence
  chemically synthesized
agtgctattttattacatgagg

SEQ ID NO: 761511 - DNA, 22 bp, Artificial Sequence
  chemically synthesized
aagtgctattttattacatgag

SEQ ID NO: 761512 - DNA, 22 bp, Artificial Sequence
  chemically synthesized
tagtaccctcatgtaataaaat

SEQ ID NO: 761513 - DNA, 22 bp, Artificial Sequence
  chemically synthesized
agtaccctcatgtaataaaata

SEQ ID NO: 761514 - DNA, 22 bp, Artificial Sequence
  chemically synthesized
gtaccctcatgtaataaaatag

SEQ ID NO: 761515 - DNA, 22 bp, Artificial Sequence
  chemically synthesized
catgtttaagtgctattttatt

SEQ ID NO: 761516 - DNA, 22 bp, Artificial Sequence
  chemically synthesized
tgcatgtttaagtgctatttta

SEQ ID NO: 761517 - DNA, 22 bp, Artificial Sequence
  chemically synthesized
ctgcatgtttaagtgctatttt

SEQ ID NO: 761518 - DNA, 22 bp, Artificial Sequence
  chemically synthesized
tctgcatgtttaagtgctattt

SEQ ID NO: 761519 - DNA, 22 bp, Artificial Sequence
  chemically synthesized
tttctgcatgtttaagtgctat

SEQ ID NO: 761520 - DNA, 22 bp, Artificial Sequence
  chemically synthesized
ctttctgcatgtttaagtgcta

SEQ ID NO: 761521 - DNA, 22 bp, Artificial Sequence
  chemically synthesized
atgtaataaaatagcacttaaa

SEQ ID NO: 761522 - DNA, 22 bp, Artificial Sequence
  chemically synthesized
tctttctgcatgtttaagtgct

SEQ ID NO: 761523 - DNA, 22 bp, Artificial Sequence
  chemically synthesized
ttctttctgcatgtttaagtgc

SEQ ID NO: 761524 - DNA, 22 bp, Artificial Sequence
  chemically synthesized
ccttttctttctgcatgtttaa

SEQ ID NO: 761525 - DNA, 22 bp, Artificial Sequence
  chemically synthesized
ctcccttttctttctgcatgtt

SEQ ID NO: 761526 - DNA, 22 bp, Artificial Sequence
  chemically synthesized
cattcctcccttttctttctgc

SEQ ID NO: 761527 - DNA, 22 bp, Artificial Sequence
  chemically synthesized
tgcattcctcccttttctttct

SEQ ID NO: 761528 - DNA, 22 bp, Artificial Sequence
  chemically synthesized
ctgcattcctcccttttctttc

SEQ ID NO: 761529 - DNA, 22 bp, Artificial Sequence
  chemically synthesized
aaacatgcagaaagaaaaggga

SEQ ID NO: 761530 - DNA, 22 bp, Artificial Sequence
  chemically synthesized
tttctgcattcctcccttttct

SEQ ID NO: 761531 - DNA, 22 bp, Artificial Sequence
  chemically synthesized
aacatgcagaaagaaaagggag

SEQ ID NO: 761532 - DNA, 22 bp, Artificial Sequence
  chemically synthesized
ttatttctgcattcctcccttt

SEQ ID NO: 761533 - DNA, 22 bp, Artificial Sequence
  chemically synthesized
attatttctgcattcctccctt

SEQ ID NO: 761534 - DNA, 22 bp, Artificial Sequence
  chemically synthesized
tattatttctgcattcctccct

SEQ ID NO: 761535 - DNA, 22 bp, Artificial Sequence
  chemically synthesized
tttattatttctgcattcctcc

SEQ ID NO: 761536 - DNA, 22 bp, Artificial Sequence
  chemically synthesized
tggttctttattatttctgcat

SEQ ID NO: 761537 - DNA, 22 bp, Artificial Sequence
  chemically synthesized
tggcagtattgtggttctttat

SEQ ID NO: 761538 - DNA, 22 bp, Artificial Sequence
  chemically synthesized
atggcagtattgtggttcttta

SEQ ID NO: 761539 - DNA, 22 bp, Artificial Sequence
  chemically synthesized
tatggcagtattgtggttcttt

SEQ ID NO: 761540 - DNA, 22 bp, Artificial Sequence
  chemically synthesized
ttatggcagtattgtggttctt

SEQ ID NO: 761541 - DNA, 22 bp, Artificial Sequence
  chemically synthesized
tttttatggcagtattgtggtt

SEQ ID NO: 761542 - DNA, 22 bp, Artificial Sequence
  chemically synthesized
tgtctgtttttatggcagtatt

SEQ ID NO: 761543 - DNA, 22 bp, Artificial Sequence
  chemically synthesized
gtgtctgtttttatggcagtat

SEQ ID NO: 761544 - DNA, 22 bp, Artificial Sequence
  chemically synthesized
tgtgtctgtttttatggcagta

SEQ ID NO: 761545 - DNA, 22 bp, Artificial Sequence
  chemically synthesized
catgggtctttgtgtctgtttt

SEQ ID NO: 761546 - DNA, 22 bp, Artificial Sequence
  chemically synthesized
ccatgggtctttgtgtctgttt

SEQ ID NO: 761547 - DNA, 22 bp, Artificial Sequence
  chemically synthesized
tccatgggtctttgtgtctgtt

SEQ ID NO: 761548 - DNA, 22 bp, Artificial Sequence
  chemically synthesized
ttccatgggtctttgtgtctgt

SEQ ID NO: 761549 - DNA, 22 bp, Artificial Sequence
  chemically synthesized
ccataaaaacagacacaaagac

SEQ ID NO: 761550 - DNA, 22 bp, Artificial Sequence
  chemically synthesized
gtcttttccatgggtctttgtg

SEQ ID NO: 761551 - DNA, 22 bp, Artificial Sequence
  chemically synthesized
tagtcttttccatgggtctttg

SEQ ID NO: 761552 - DNA, 22 bp, Artificial Sequence
  chemically synthesized
tctagtcttttccatgggtctt

SEQ ID NO: 761553 - DNA, 22 bp, Artificial Sequence
  chemically synthesized
ggttctctagtcttttccatgg

SEQ ID NO: 761554 - DNA, 22 bp, Artificial Sequence
  chemically synthesized
gggttctctagtcttttccatg

SEQ ID NO: 761555 - DNA, 22 bp, Artificial Sequence
  chemically synthesized
tgggttctctagtcttttccat

SEQ ID NO: 761556 - DNA, 22 bp, Artificial Sequence
  chemically synthesized
ttgggttctctagtcttttcca

SEQ ID NO: 761557 - DNA, 22 bp, Artificial Sequence
  chemically synthesized
gtttttgggttctctagtcttt

SEQ ID NO: 761558 - DNA, 22 bp, Artificial Sequence
  chemically synthesized
taggtgtgtggattcgtttttg

SEQ ID NO: 761559 - DNA, 22 bp, Artificial Sequence
  chemically synthesized
actgtaggtgtgtggattcgtt

SEQ ID NO: 761560 - DNA, 22 bp, Artificial Sequence
  chemically synthesized
gagaacccaaaaacgaatccac

SEQ ID NO: 761561 - DNA, 22 bp, Artificial Sequence
  chemically synthesized
tcaaaaatgagttaactgtagg

SEQ ID NO: 761562 - DNA, 22 bp, Artificial Sequence
  chemically synthesized
gtcaaaaatgagttaactgtag

SEQ ID NO: 761563 - DNA, 22 bp, Artificial Sequence
  chemically synthesized
tgtcaaaaatgagttaactgta

SEQ ID NO: 761564 - DNA, 22 bp, Artificial Sequence
  chemically synthesized
gcacctttgtcaaaaatgagtt

SEQ ID NO: 761565 - DNA, 22 bp, Artificial Sequence
  chemically synthesized
ggcacctttgtcaaaaatgagt

SEQ ID NO: 761566 - DNA, 22 bp, Artificial Sequence
  chemically synthesized
ttggcacctttgtcaaaaatga

SEQ ID NO: 761567 - DNA, 22 bp, Artificial Sequence
  chemically synthesized
cagttaactcatttttgacaaa

SEQ ID NO: 761568 - DNA, 22 bp, Artificial Sequence
  chemically synthesized
tatgttcttggcacctttgtca

SEQ ID NO: 761569 - DNA, 22 bp, Artificial Sequence
  chemically synthesized
actcatttttgacaaaggtgcc

SEQ ID NO: 761570 - DNA, 22 bp, Artificial Sequence
  chemically synthesized
atttttgacaaaggtgccaaga

SEQ ID NO: 761571 - DNA, 22 bp, Artificial Sequence
  chemically synthesized
cccactgtatgttcttggcacc

SEQ ID NO: 761572 - DNA, 22 bp, Artificial Sequence
  chemically synthesized
ccccactgtatgttcttggcac

SEQ ID NO: 761573 - DNA, 22 bp, Artificial Sequence
  chemically synthesized
tccccactgtatgttcttggca

SEQ ID NO: 761574 - DNA, 22 bp, Artificial Sequence
  chemically synthesized
ttccccactgtatgttcttggc

SEQ ID NO: 761575 - DNA, 22 bp, Artificial Sequence
  chemically synthesized
ttgacaaaggtgccaagaacat

SEQ ID NO: 761576 - DNA, 22 bp, Artificial Sequence
  chemically synthesized
tgacaaaggtgccaagaacata

SEQ ID NO: 761577 - DNA, 22 bp, Artificial Sequence
  chemically synthesized
gacaaaggtgccaagaacatac

SEQ ID NO: 761578 - DNA, 22 bp, Artificial Sequence
  chemically synthesized
acaaaggtgccaagaacataca

SEQ ID NO: 761579 - DNA, 22 bp, Artificial Sequence
  chemically synthesized
tcttttccccactgtatgttct

SEQ ID NO: 761580 - DNA, 22 bp, Artificial Sequence
  chemically synthesized
aagagactgtcttttccccact

SEQ ID NO: 761581 - DNA, 22 bp, Artificial Sequence
  chemically synthesized
ttgaagagactgtcttttcccc

SEQ ID NO: 761582 - DNA, 22 bp, Artificial Sequence
  chemically synthesized
gttgaagagactgtcttttccc

SEQ ID NO: 761583 - DNA, 22 bp, Artificial Sequence
  chemically synthesized
cgcaccatttgttgaagagact

SEQ ID NO: 761584 - DNA, 22 bp, Artificial Sequence
  chemically synthesized
ccgcaccatttgttgaagagac

SEQ ID NO: 761585 - DNA, 22 bp, Artificial Sequence
  chemically synthesized
tccgcaccatttgttgaagaga

SEQ ID NO: 761586 - DNA, 22 bp, Artificial Sequence
  chemically synthesized
ttccgcaccatttgttgaagag

SEQ ID NO: 761587 - DNA, 22 bp, Artificial Sequence
  chemically synthesized
ttcaacaaatggtgcggaaaaa

SEQ ID NO: 761588 - DNA, 22 bp, Artificial Sequence
  chemically synthesized
caacaaatggtgcggaaaaact

SEQ ID NO: 761589 - DNA, 22 bp, Artificial Sequence
  chemically synthesized
aacaaatggtgcggaaaaactg

SEQ ID NO: 761590 - DNA, 22 bp, Artificial Sequence
  chemically synthesized
catatggatatccagtttttcc

SEQ ID NO: 761591 - DNA, 22 bp, Artificial Sequence
  chemically synthesized
tgcatatggatatccagttttt

SEQ ID NO: 761592 - DNA, 22 bp, Artificial Sequence
  chemically synthesized
attctgcatatggatatccagt

SEQ ID NO: 761593 - DNA, 22 bp, Artificial Sequence
  chemically synthesized
gattcattctgcatatggatat

SEQ ID NO: 761594 - DNA, 22 bp, Artificial Sequence
  chemically synthesized
gatatccatatgcagaatgaat

SEQ ID NO: 761595 - DNA, 22 bp, Artificial Sequence
  chemically synthesized
tatatggtgagagataggggtc

SEQ ID NO: 761596 - DNA, 22 bp, Artificial Sequence
  chemically synthesized
gtatatggtgagagataggggt

SEQ ID NO: 761597 - DNA, 22 bp, Artificial Sequence
  chemically synthesized
tgtatatggtgagagatagggg

SEQ ID NO: 761598 - DNA, 22 bp, Artificial Sequence
  chemically synthesized
ttgtatatggtgagagataggg

SEQ ID NO: 761599 - DNA, 22 bp, Artificial Sequence
  chemically synthesized
atttttgtatatggtgagagat

SEQ ID NO: 761600 - DNA, 22 bp, Artificial Sequence
  chemically synthesized
gatttttgtatatggtgagaga

SEQ ID NO: 761601 - DNA, 22 bp, Artificial Sequence
  chemically synthesized
gacccctatctctcaccatata

SEQ ID NO: 761602 - DNA, 22 bp, Artificial Sequence
  chemically synthesized
atttgatttttgtatatggtga

SEQ ID NO: 761603 - DNA, 22 bp, Artificial Sequence
  chemically synthesized
gatttgatttttgtatatggtg

SEQ ID NO: 761604 - DNA, 22 bp, Artificial Sequence
  chemically synthesized
tgatttgatttttgtatatggt

SEQ ID NO: 761605 - DNA, 22 bp, Artificial Sequence
  chemically synthesized
ctttgatttgatttttgtatat

SEQ ID NO: 761606 - DNA, 22 bp, Artificial Sequence
  chemically synthesized
tctctcaccatatacaaaaatc

SEQ ID NO: 761607 - DNA, 22 bp, Artificial Sequence
  chemically synthesized
atctactttgatttgatttttg

SEQ ID NO: 761608 - DNA, 22 bp, Artificial Sequence
  chemically synthesized
aatctactttgatttgattttt

SEQ ID NO: 761609 - DNA, 22 bp, Artificial Sequence
  chemically synthesized
tcaccatatacaaaaatcaaat

SEQ ID NO: 761610 - DNA, 22 bp, Artificial Sequence
  chemically synthesized
taatctactttgatttgatttt

SEQ ID NO: 761611 - DNA, 22 bp, Artificial Sequence
  chemically synthesized
accatatacaaaaatcaaatca

SEQ ID NO: 761612 - DNA, 22 bp, Artificial Sequence
  chemically synthesized
agtctttaatctactttgattt

SEQ ID NO: 761613 - DNA, 22 bp, Artificial Sequence
  chemically synthesized
aagtctttaatctactttgatt

SEQ ID NO: 761614 - DNA, 22 bp, Artificial Sequence
  chemically synthesized
catttaagtctttaatctactt

SEQ ID NO: 761615 - DNA, 22 bp, Artificial Sequence
  chemically synthesized
acatttaagtctttaatctact

SEQ ID NO: 761616 - DNA, 22 bp, Artificial Sequence
  chemically synthesized
aggtcttacatttaagtcttta

SEQ ID NO: 761617 - DNA, 22 bp, Artificial Sequence
  chemically synthesized
gaggtcttacatttaagtcttt

SEQ ID NO: 761618 - DNA, 22 bp, Artificial Sequence
  chemically synthesized
atggtttgaggtcttacattta

SEQ ID NO: 761619 - DNA, 22 bp, Artificial Sequence
  chemically synthesized
catggtttgaggtcttacattt

SEQ ID NO: 761620 - DNA, 22 bp, Artificial Sequence
  chemically synthesized
aagacttaaatgtaagacctca

SEQ ID NO: 761621 - DNA, 22 bp, Artificial Sequence
  chemically synthesized
tagtagtttcatggtttgaggt

SEQ ID NO: 761622 - DNA, 22 bp, Artificial Sequence
  chemically synthesized
gtagtagtttcatggtttgagg

SEQ ID NO: 761623 - DNA, 22 bp, Artificial Sequence
  chemically synthesized
aaatgtaagacctcaaaccatg

SEQ ID NO: 761624 - DNA, 22 bp, Artificial Sequence
  chemically synthesized
ttgtagtagtttcatggtttga

SEQ ID NO: 761625 - DNA, 22 bp, Artificial Sequence
  chemically synthesized
aatgtaagacctcaaaccatga

SEQ ID NO: 761626 - DNA, 22 bp, Artificial Sequence
  chemically synthesized
tcttgtagtagtttcatggttt

SEQ ID NO: 761627 - DNA, 22 bp, Artificial Sequence
  chemically synthesized
agtgttctcttgtagtagtttc

SEQ ID NO: 761628 - DNA, 22 bp, Artificial Sequence
  chemically synthesized
tcagtgttctcttgtagtagtt

SEQ ID NO: 761629 - DNA, 22 bp, Artificial Sequence
  chemically synthesized
ctcagtgttctcttgtagtagt

SEQ ID NO: 761630 - DNA, 22 bp, Artificial Sequence
  chemically synthesized
tctcagtgttctcttgtagtag

SEQ ID NO: 761631 - DNA, 22 bp, Artificial Sequence
  chemically synthesized
aaaccatgaaactactacaaga

SEQ ID NO: 761632 - DNA, 22 bp, Artificial Sequence
  chemically synthesized
ttctcagtgttctcttgtagta

SEQ ID NO: 761633 - DNA, 22 bp, Artificial Sequence
  chemically synthesized
gagatttttctcagtgttctct

SEQ ID NO: 761634 - DNA, 22 bp, Artificial Sequence
  chemically synthesized
ctacaagagaacactgagaaaa

SEQ ID NO: 761635 - DNA, 22 bp, Artificial Sequence
  chemically synthesized
caagagaacactgagaaaaatc

SEQ ID NO: 761636 - DNA, 22 bp, Artificial Sequence
  chemically synthesized
atgacaccctggagatttttct

SEQ ID NO: 761637 - DNA, 22 bp, Artificial Sequence
  chemically synthesized
ttgatgacaccctggagatttt

SEQ ID NO: 761638 - DNA, 22 bp, Artificial Sequence
  chemically synthesized
atctgttgatgacaccctggag

SEQ ID NO: 761639 - DNA, 22 bp, Artificial Sequence
  chemically synthesized
ttcatctgttgatgacaccctg

SEQ ID NO: 761640 - DNA, 22 bp, Artificial Sequence
  chemically synthesized
agaaaaatctccagggtgtcat

SEQ ID NO: 761641 - DNA, 22 bp, Artificial Sequence
  chemically synthesized
aaattattcatctgttgatgac

SEQ ID NO: 761642 - DNA, 22 bp, Artificial Sequence
  chemically synthesized
cagggtgtcatcaacagatgaa

SEQ ID NO: 761643 - DNA, 22 bp, Artificial Sequence
  chemically synthesized
aagtacaaattcaaattattca

SEQ ID NO: 761644 - DNA, 22 bp, Artificial Sequence
  chemically synthesized
tgaagtacaaattcaaattatt

SEQ ID NO: 761645 - DNA, 22 bp, Artificial Sequence
  chemically synthesized
ctgaagtacaaattcaaattat

SEQ ID NO: 761646 - DNA, 22 bp, Artificial Sequence
  chemically synthesized
tttctgaagtacaaattcaaat

SEQ ID NO: 761647 - DNA, 22 bp, Artificial Sequence
  chemically synthesized
gtttctgaagtacaaattcaaa

SEQ ID NO: 761648 - DNA, 22 bp, Artificial Sequence
  chemically synthesized
tgtttctgaagtacaaattcaa

SEQ ID NO: 761649 - DNA, 22 bp, Artificial Sequence
  chemically synthesized
ttgtttctgaagtacaaattca

SEQ ID NO: 761650 - DNA, 22 bp, Artificial Sequence
  chemically synthesized
tttgtttctgaagtacaaattc

SEQ ID NO: 761651 - DNA, 22 bp, Artificial Sequence
  chemically synthesized
ttttgtttctgaagtacaaatt

SEQ ID NO: 761652 - DNA, 22 bp, Artificial Sequence
  chemically synthesized
tttttgtttctgaagtacaaat

SEQ ID NO: 761653 - DNA, 22 bp, Artificial Sequence
  chemically synthesized
attttttttgtttctgaagtac

SEQ ID NO: 761654 - DNA, 22 bp, Artificial Sequence
  chemically synthesized
aattttttttgtttctgaagta

SEQ ID NO: 761655 - DNA, 22 bp, Artificial Sequence
  chemically synthesized
taattttttttgtttctgaagt

SEQ ID NO: 761656 - DNA, 22 bp, Artificial Sequence
  chemically synthesized
tttaattttttttgtttctgaa

SEQ ID NO: 761657 - DNA, 22 bp, Artificial Sequence
  chemically synthesized
gaatttgtacttcagaaacaaa

SEQ ID NO: 761658 - DNA, 22 bp, Artificial Sequence
  chemically synthesized
aatttgtacttcagaaacaaaa

SEQ ID NO: 761659 - DNA, 22 bp, Artificial Sequence
  chemically synthesized
tggttctttaattttttttgtt

SEQ ID NO: 761660 - DNA, 22 bp, Artificial Sequence
  chemically synthesized
gtacttcagaaacaaaaaaaat

SEQ ID NO: 761661 - DNA, 22 bp, Artificial Sequence
  chemically synthesized
tgtggttctttaattttttttg

SEQ ID NO: 761662 - DNA, 22 bp, Artificial Sequence
  chemically synthesized
tacttcagaaacaaaaaaaatt

SEQ ID NO: 761663 - DNA, 22 bp, Artificial Sequence
  chemically synthesized
attctgtggttctttaattttt

SEQ ID NO: 761664 - DNA, 22 bp, Artificial Sequence
  chemically synthesized
aattctgtggttctttaatttt

SEQ ID NO: 761665 - DNA, 22 bp, Artificial Sequence
  chemically synthesized
cagaaacaaaaaaaattaaaga

SEQ ID NO: 761666 - DNA, 22 bp, Artificial Sequence
  chemically synthesized
taattctgtggttctttaattt

SEQ ID NO: 761667 - DNA, 22 bp, Artificial Sequence
  chemically synthesized
agaaacaaaaaaaattaaagaa

SEQ ID NO: 761668 - DNA, 22 bp, Artificial Sequence
  chemically synthesized
ccattttaattctgtggttctt

SEQ ID NO: 761669 - DNA, 22 bp, Artificial Sequence
  chemically synthesized
aagaaccacagaattaaaatgg

SEQ ID NO: 761670 - DNA, 22 bp, Artificial Sequence
  chemically synthesized
aagagatagctcccattttaat

SEQ ID NO: 761671 - DNA, 22 bp, Artificial Sequence
  chemically synthesized
aaagagatagctcccattttaa

SEQ ID NO: 761672 - DNA, 22 bp, Artificial Sequence
  chemically synthesized
tttaaagagatagctcccattt

SEQ ID NO: 761673 - DNA, 22 bp, Artificial Sequence
  chemically synthesized
tatttaaagagatagctcccat

SEQ ID NO: 761674 - DNA, 22 bp, Artificial Sequence
  chemically synthesized
tctatttaaagagatagctccc

SEQ ID NO: 761675 - DNA, 22 bp, Artificial Sequence
  chemically synthesized
tctctatttaaagagatagctc

SEQ ID NO: 761676 - DNA, 22 bp, Artificial Sequence
  chemically synthesized
aaatgggagctatctctttaaa

SEQ ID NO: 761677 - DNA, 22 bp, Artificial Sequence
  chemically synthesized
ggattctctctatttaaagaga

SEQ ID NO: 761678 - DNA, 22 bp, Artificial Sequence
  chemically synthesized
gggattctctctatttaaagag

SEQ ID NO: 761679 - DNA, 22 bp, Artificial Sequence
  chemically synthesized
tgggattctctctatttaaaga

SEQ ID NO: 761680 - DNA, 22 bp, Artificial Sequence
  chemically synthesized
tttgggattctctctatttaaa

SEQ ID NO: 761681 - DNA, 22 bp, Artificial Sequence
  chemically synthesized
tctttgggattctctctattta

SEQ ID NO: 761682 - DNA, 22 bp, Artificial Sequence
  chemically synthesized
ctctttgggattctctctattt

SEQ ID NO: 761683 - DNA, 22 bp, Artificial Sequence
  chemically synthesized
acttctctttgggattctctct

SEQ ID NO: 761684 - DNA, 22 bp, Artificial Sequence
  chemically synthesized
tctctttaaatagagagaatcc

SEQ ID NO: 761685 - DNA, 22 bp, Artificial Sequence
  chemically synthesized
tttaaatagagagaatcccaaa

SEQ ID NO: 761686 - DNA, 22 bp, Artificial Sequence
  chemically synthesized
taaatagagagaatcccaaaga

SEQ ID NO: 761687 - DNA, 22 bp, Artificial Sequence
  chemically synthesized
aaatagagagaatcccaaagag

SEQ ID NO: 761688 - DNA, 22 bp, Artificial Sequence
  chemically synthesized
aatagagagaatcccaaagaga

SEQ ID NO: 761689 - DNA, 22 bp, Artificial Sequence
  chemically synthesized
gaaaaaaaaaatgttgacttct

SEQ ID NO: 761690 - DNA, 22 bp, Artificial Sequence
  chemically synthesized
tctagaaaaaaaaaatgttgac

SEQ ID NO: 761691 - DNA, 22 bp, Artificial Sequence
  chemically synthesized
aagacctgtctagaaaaaaaaa

SEQ ID NO: 761692 - DNA, 22 bp, Artificial Sequence
  chemically synthesized
gagttcaagacctgtctagaaa

SEQ ID NO: 761693 - DNA, 22 bp, Artificial Sequence
  chemically synthesized
gatgttggagttcaagacctgt

SEQ ID NO: 761694 - DNA, 22 bp, Artificial Sequence
  chemically synthesized
tttttttctagacaggtcttga

SEQ ID NO: 761695 - DNA, 22 bp, Artificial Sequence
  chemically synthesized
ggatgttggagttcaagacctg

SEQ ID NO: 761696 - DNA, 22 bp, Artificial Sequence
  chemically synthesized
ttttttctagacaggtcttgaa

SEQ ID NO: 761697 - DNA, 22 bp, Artificial Sequence
  chemically synthesized
tttttctagacaggtcttgaac

SEQ ID NO: 761698 - DNA, 22 bp, Artificial Sequence
  chemically synthesized
ttttctagacaggtcttgaact

SEQ ID NO: 761699 - DNA, 22 bp, Artificial Sequence
  chemically synthesized
tttctagacaggtcttgaactc

SEQ ID NO: 761700 - DNA, 22 bp, Artificial Sequence
  chemically synthesized
ttctagacaggtcttgaactcc

SEQ ID NO: 761701 - DNA, 22 bp, Artificial Sequence
  chemically synthesized
tgtttggatgttggagttcaag

SEQ ID NO: 761702 - DNA, 22 bp, Artificial Sequence
  chemically synthesized
tctagacaggtcttgaactcca

SEQ ID NO: 761703 - DNA, 22 bp, Artificial Sequence
  chemically synthesized
ctagacaggtcttgaactccaa

SEQ ID NO: 761704 - DNA, 22 bp, Artificial Sequence
  chemically synthesized
tagacaggtcttgaactccaac

SEQ ID NO: 761705 - DNA, 22 bp, Artificial Sequence
  chemically synthesized
attatgtttggatgttggagtt

SEQ ID NO: 761706 - DNA, 22 bp, Artificial Sequence
  chemically synthesized
gacaggtcttgaactccaacat

SEQ ID NO: 761707 - DNA, 22 bp, Artificial Sequence
  chemically synthesized
gaatgttaattatgtttggatg

SEQ ID NO: 761708 - DNA, 22 bp, Artificial Sequence
  chemically synthesized
agaatgttaattatgtttggat

SEQ ID NO: 761709 - DNA, 22 bp, Artificial Sequence
  chemically synthesized
tagaatgttaattatgtttgga

SEQ ID NO: 761710 - DNA, 22 bp, Artificial Sequence
  chemically synthesized
gaactccaacatccaaacataa

SEQ ID NO: 761711 - DNA, 22 bp, Artificial Sequence
  chemically synthesized
ttagaatgttaattatgtttgg

SEQ ID NO: 761712 - DNA, 22 bp, Artificial Sequence
  chemically synthesized
aactccaacatccaaacataat

SEQ ID NO: 761713 - DNA, 22 bp, Artificial Sequence
  chemically synthesized
ttttagaatgttaattatgttt

SEQ ID NO: 761714 - DNA, 22 bp, Artificial Sequence
  chemically synthesized
tcttttagaatgttaattatgt

SEQ ID NO: 761715 - DNA, 22 bp, Artificial Sequence
  chemically synthesized
caacatccaaacataattaaca

SEQ ID NO: 761716 - DNA, 22 bp, Artificial Sequence
  chemically synthesized
tctcttttagaatgttaattat

SEQ ID NO: 761717 - DNA, 22 bp, Artificial Sequence
  chemically synthesized
tctctcttttagaatgttaatt

SEQ ID NO: 761718 - DNA, 22 bp, Artificial Sequence
  chemically synthesized
ctctctcttttagaatgttaat

SEQ ID NO: 761719 - DNA, 22 bp, Artificial Sequence
  chemically synthesized
tctctctcttttagaatgttaa

SEQ ID NO: 761720 - DNA, 22 bp, Artificial Sequence
  chemically synthesized
tttctctctcttttagaatgtt

SEQ ID NO: 761721 - DNA, 22 bp, Artificial Sequence
  chemically synthesized
ctttctctctcttttagaatgt

SEQ ID NO: 761722 - DNA, 22 bp, Artificial Sequence
  chemically synthesized
accttctttctctctcttttag

SEQ ID NO: 761723 - DNA, 22 bp, Artificial Sequence
  chemically synthesized
tgaccttctttctctctctttt

SEQ ID NO: 761724 - DNA, 22 bp, Artificial Sequence
  chemically synthesized
acattctaaaagagagagaaag

SEQ ID NO: 761725 - DNA, 22 bp, Artificial Sequence
  chemically synthesized
aatatctctgaccttctttctc

SEQ ID NO: 761726 - DNA, 22 bp, Artificial Sequence
  chemically synthesized
taaaagagagagaaagaaggtc

SEQ ID NO: 761727 - DNA, 22 bp, Artificial Sequence
  chemically synthesized
aaagagagagaaagaaggtcag

SEQ ID NO: 761728 - DNA, 22 bp, Artificial Sequence
  chemically synthesized
gacattgaatatctctgacctt

SEQ ID NO: 761729 - DNA, 22 bp, Artificial Sequence
  chemically synthesized
ggacattgaatatctctgacct

SEQ ID NO: 761730 - DNA, 22 bp, Artificial Sequence
  chemically synthesized
caacttggacattgaatatctc

SEQ ID NO: 761731 - DNA, 22 bp, Artificial Sequence
  chemically synthesized
agagaaaactgcaacttggaca

SEQ ID NO: 761732 - DNA, 22 bp, Artificial Sequence
  chemically synthesized
gagagaaaactgcaacttggac

SEQ ID NO: 761733 - DNA, 22 bp, Artificial Sequence
  chemically synthesized
tgagagaaaactgcaacttgga

SEQ ID NO: 761734 - DNA, 22 bp, Artificial Sequence
  chemically synthesized
cctttgagagaaaactgcaact

SEQ ID NO: 761735 - DNA, 22 bp, Artificial Sequence
  chemically synthesized
aatgtccaagttgcagttttct

SEQ ID NO: 761736 - DNA, 22 bp, Artificial Sequence
  chemically synthesized
cagttttctctcaaaggtagac

SEQ ID NO: 761737 - DNA, 22 bp, Artificial Sequence
  chemically synthesized
tctctcaaaggtagaccccacc

SEQ ID NO: 761738 - DNA, 22 bp, Artificial Sequence
  chemically synthesized
ctctcaaaggtagaccccacct

SEQ ID NO: 761739 - DNA, 22 bp, Artificial Sequence
  chemically synthesized
tctcaaaggtagaccccacctc

SEQ ID NO: 761740 - DNA, 22 bp, Artificial Sequence
  chemically synthesized
tcaaaggtagaccccacctctt

SEQ ID NO: 761741 - DNA, 22 bp, Artificial Sequence
  chemically synthesized
aaaggtagaccccacctctttt

SEQ ID NO: 761742 - DNA, 22 bp, Artificial Sequence
  chemically synthesized
tataatggagaacaaaagaagg

SEQ ID NO: 761743 - DNA, 22 bp, Artificial Sequence
  chemically synthesized
gtataatggagaacaaaagaag

SEQ ID NO: 761744 - DNA, 22 bp, Artificial Sequence
  chemically synthesized
tgtataatggagaacaaaagaa

SEQ ID NO: 761745 - DNA, 22 bp, Artificial Sequence
  chemically synthesized
tttttgcccttcttttgttctc

SEQ ID NO: 761746 - DNA, 22 bp, Artificial Sequence
  chemically synthesized
tttgcccttcttttgttctcca

SEQ ID NO: 761747 - DNA, 22 bp, Artificial Sequence
  chemically synthesized
ttgcccttcttttgttctccat

SEQ ID NO: 761748 - DNA, 22 bp, Artificial Sequence
  chemically synthesized
tgcccttcttttgttctccatt

SEQ ID NO: 761749 - DNA, 22 bp, Artificial Sequence
  chemically synthesized
gtgtctttgtataatggagaac

SEQ ID NO: 761750 - DNA, 22 bp, Artificial Sequence
  chemically synthesized
gcccttcttttgttctccatta

SEQ ID NO: 761751 - DNA, 22 bp, Artificial Sequence
  chemically synthesized
cccttcttttgttctccattat

SEQ ID NO: 761752 - DNA, 22 bp, Artificial Sequence
  chemically synthesized
cttttgttctccattatacaaa

SEQ ID NO: 761753 - DNA, 22 bp, Artificial Sequence
  chemically synthesized
ttttgttctccattatacaaag

SEQ ID NO: 761754 - DNA, 22 bp, Artificial Sequence
  chemically synthesized
gaatagttagtgtctttgtata

SEQ ID NO: 761755 - DNA, 22 bp, Artificial Sequence
  chemically synthesized
ttgttctccattatacaaagac

SEQ ID NO: 761756 - DNA, 22 bp, Artificial Sequence
  chemically synthesized
tgttctccattatacaaagaca

SEQ ID NO: 761757 - DNA, 22 bp, Artificial Sequence
  chemically synthesized
gttctccattatacaaagacac

SEQ ID NO: 761758 - DNA, 22 bp, Artificial Sequence
  chemically synthesized
ttctccattatacaaagacact

SEQ ID NO: 761759 - DNA, 22 bp, Artificial Sequence
  chemically synthesized
tccattatacaaagacactaac

SEQ ID NO: 761760 - DNA, 22 bp, Artificial Sequence
  chemically synthesized
gaggttagaatagttagtgtct

SEQ ID NO: 761761 - DNA, 22 bp, Artificial Sequence
  chemically synthesized
cattatacaaagacactaacta

SEQ ID NO: 761762 - DNA, 22 bp, Artificial Sequence
  chemically synthesized
ttagaggttagaatagttagtg

SEQ ID NO: 761763 - DNA, 22 bp, Artificial Sequence
  chemically synthesized
ctattagaggttagaatagtta

SEQ ID NO: 761764 - DNA, 22 bp, Artificial Sequence
  chemically synthesized
tacaaagacactaactattcta

SEQ ID NO: 761765 - DNA, 22 bp, Artificial Sequence
  chemically synthesized
gctattagaggttagaatagtt

SEQ ID NO: 761766 - DNA, 22 bp, Artificial Sequence
  chemically synthesized
gggagtgcttgctattagaggt

SEQ ID NO: 761767 - DNA, 22 bp, Artificial Sequence
  chemically synthesized
actattctaacctctaatagca

SEQ ID NO: 761768 - DNA, 22 bp, Artificial Sequence
  chemically synthesized
ttggggagtgcttgctattaga

SEQ ID NO: 761769 - DNA, 22 bp, Artificial Sequence
  chemically synthesized
ttctaacctctaatagcaagca

SEQ ID NO: 761770 - DNA, 22 bp, Artificial Sequence
  chemically synthesized
taacctctaatagcaagcactc

SEQ ID NO: 761771 - DNA, 22 bp, Artificial Sequence
  chemically synthesized
acctctaatagcaagcactccc

SEQ ID NO: 761772 - DNA, 22 bp, Artificial Sequence
  chemically synthesized
taatagcaagcactccccaata

SEQ ID NO: 761773 - DNA, 22 bp, Artificial Sequence
  chemically synthesized
atagcaagcactccccaataga

SEQ ID NO: 761774 - DNA, 22 bp, Artificial Sequence
  chemically synthesized
tagaagccataaatctattggg

SEQ ID NO: 761775 - DNA, 22 bp, Artificial Sequence
  chemically synthesized
tatagtctgtagaagccataaa

SEQ ID NO: 761776 - DNA, 22 bp, Artificial Sequence
  chemically synthesized
cccaatagatttatggcttcta

SEQ ID NO: 761777 - DNA, 22 bp, Artificial Sequence
  chemically synthesized
acattatatagtctgtagaagc

SEQ ID NO: 761778 - DNA, 22 bp, Artificial Sequence
  chemically synthesized
atggcttctacagactatataa

SEQ ID NO: 761779 - DNA, 22 bp, Artificial Sequence
  chemically synthesized
tggcttctacagactatataat

SEQ ID NO: 761780 - DNA, 22 bp, Artificial Sequence
  chemically synthesized
ctacagactatataatgtcagt

SEQ ID NO: 761781 - DNA, 22 bp, Artificial Sequence
  chemically synthesized
agaggcaaggacactgacatta

SEQ ID NO: 761782 - DNA, 22 bp, Artificial Sequence
  chemically synthesized
tacagactatataatgtcagtg

SEQ ID NO: 761783 - DNA, 22 bp, Artificial Sequence
  chemically synthesized
cagactatataatgtcagtgtc

SEQ ID NO: 761784 - DNA, 22 bp, Artificial Sequence
  chemically synthesized
tgaacattaagaggcaaggaca

SEQ ID NO: 761785 - DNA, 22 bp, Artificial Sequence
  chemically synthesized
tataatgtcagtgtccttgcct

SEQ ID NO: 761786 - DNA, 22 bp, Artificial Sequence
  chemically synthesized
tacaattgtgaacattaagagg

SEQ ID NO: 761787 - DNA, 22 bp, Artificial Sequence
  chemically synthesized
atacaattgtgaacattaagag

SEQ ID NO: 761788 - DNA, 22 bp, Artificial Sequence
  chemically synthesized
acatttatacaattgtgaacat

SEQ ID NO: 761789 - DNA, 22 bp, Artificial Sequence
  chemically synthesized
gcctcttaatgttcacaattgt

SEQ ID NO: 761790 - DNA, 22 bp, Artificial Sequence
  chemically synthesized
cctcttaatgttcacaattgta

SEQ ID NO: 761791 - DNA, 22 bp, Artificial Sequence
  chemically synthesized
ttaatgttcacaattgtataaa

SEQ ID NO: 761792 - DNA, 22 bp, Artificial Sequence
  chemically synthesized
aatgttcacaattgtataaatg

SEQ ID NO: 761793 - DNA, 22 bp, Artificial Sequence
  chemically synthesized
atgttcacaattgtataaatgt

SEQ ID NO: 761794 - DNA, 22 bp, Artificial Sequence
  chemically synthesized
tataaaatgttcacatttatac

SEQ ID NO: 761795 - DNA, 22 bp, Artificial Sequence
  chemically synthesized
acaattgtataaatgtgaacat

SEQ ID NO: 761796 - DNA, 22 bp, Artificial Sequence
  chemically synthesized
taaatgttatataaaatgttca

SEQ ID NO: 761797 - DNA, 22 bp, Artificial Sequence
  chemically synthesized
gtaaatgttatataaaatgttc

SEQ ID NO: 761798 - DNA, 22 bp, Artificial Sequence
  chemically synthesized
tataaatgtgaacattttatat

SEQ ID NO: 761799 - DNA, 22 bp, Artificial Sequence
  chemically synthesized
gcagaaaaatttgtaaatgtta

SEQ ID NO: 761800 - DNA, 22 bp, Artificial Sequence
  chemically synthesized
ggcagaaaaatttgtaaatgtt

SEQ ID NO: 761801 - DNA, 22 bp, Artificial Sequence
  chemically synthesized
tatttggcagaaaaatttgtaa

SEQ ID NO: 761802 - DNA, 22 bp, Artificial Sequence
  chemically synthesized
atatttggcagaaaaatttgta

SEQ ID NO: 761803 - DNA, 22 bp, Artificial Sequence
  chemically synthesized
tatataacatttacaaattttt

SEQ ID NO: 761804 - DNA, 22 bp, Artificial Sequence
  chemically synthesized
tatatttggcagaaaaatttgt

SEQ ID NO: 761805 - DNA, 22 bp, Artificial Sequence
  chemically synthesized
atataacatttacaaatttttc

SEQ ID NO: 761806 - DNA, 22 bp, Artificial Sequence
  chemically synthesized
ttatatttggcagaaaaatttg

SEQ ID NO: 761807 - DNA, 22 bp, Artificial Sequence
  chemically synthesized
tataacatttacaaatttttct

SEQ ID NO: 761808 - DNA, 22 bp, Artificial Sequence
  chemically synthesized
tgtgagatttttatatttggca

SEQ ID NO: 761809 - DNA, 22 bp, Artificial Sequence
  chemically synthesized
acaaatttttctgccaaatata

SEQ ID NO: 761810 - DNA, 22 bp, Artificial Sequence
  chemically synthesized
caaatttttctgccaaatataa

SEQ ID NO: 761811 - DNA, 22 bp, Artificial Sequence
  chemically synthesized
cattatgtgagatttttatatt

SEQ ID NO: 761812 - DNA, 22 bp, Artificial Sequence
  chemically synthesized
acattatgtgagatttttatat

SEQ ID NO: 761813 - DNA, 22 bp, Artificial Sequence
  chemically synthesized
ttctgccaaatataaaaatctc

SEQ ID NO: 761814 - DNA, 22 bp, Artificial Sequence
  chemically synthesized
tctgccaaatataaaaatctca

SEQ ID NO: 761815 - DNA, 22 bp, Artificial Sequence
  chemically synthesized
ctgccaaatataaaaatctcac

SEQ ID NO: 761816 - DNA, 22 bp, Artificial Sequence
  chemically synthesized
tgccaaatataaaaatctcaca

SEQ ID NO: 761817 - DNA, 22 bp, Artificial Sequence
  chemically synthesized
ccaaatataaaaatctcacata

SEQ ID NO: 761818 - DNA, 22 bp, Artificial Sequence
  chemically synthesized
agcagaatttacattatgtgag

SEQ ID NO: 761819 - DNA, 22 bp, Artificial Sequence
  chemically synthesized
cagcagaatttacattatgtga

SEQ ID NO: 761820 - DNA, 22 bp, Artificial Sequence
  chemically synthesized
tcaacataatttcagcagaatt

SEQ ID NO: 761821 - DNA, 22 bp, Artificial Sequence
  chemically synthesized
acataatgtaaattctgctgaa

SEQ ID NO: 761822 - DNA, 22 bp, Artificial Sequence
  chemically synthesized
tgctgaaattatgttgataaca

SEQ ID NO: 761823 - DNA, 22 bp, Artificial Sequence
  chemically synthesized
ctgaaattatgttgataacata

SEQ ID NO: 761824 - DNA, 22 bp, Artificial Sequence
  chemically synthesized
tgaaaatcacataatatgttat

SEQ ID NO: 761825 - DNA, 22 bp, Artificial Sequence
  chemically synthesized
aaattatgttgataacatatta

SEQ ID NO: 761826 - DNA, 22 bp, Artificial Sequence
  chemically synthesized
actatgaaaatcacataatatg

SEQ ID NO: 761827 - DNA, 22 bp, Artificial Sequence
  chemically synthesized
tgttgataacatattatgtgat

SEQ ID NO: 761828 - DNA, 22 bp, Artificial Sequence
  chemically synthesized
ttaactatgaaaatcacataat

SEQ ID NO: 761829 - DNA, 22 bp, Artificial Sequence
  chemically synthesized
ataacatattatgtgattttca

SEQ ID NO: 761830 - DNA, 22 bp, Artificial Sequence
  chemically synthesized
tatatactattaactatgaaaa

SEQ ID NO: 761831 - DNA, 22 bp, Artificial Sequence
  chemically synthesized
tgtgattttcatagttaatagt

SEQ ID NO: 761832 - DNA, 22 bp, Artificial Sequence
  chemically synthesized
cagatcattgtatatactatta

SEQ ID NO: 761833 - DNA, 22 bp, Artificial Sequence
  chemically synthesized
ccagatcattgtatatactatt

SEQ ID NO: 761834 - DNA, 22 bp, Artificial Sequence
  chemically synthesized
tccagatcattgtatatactat

SEQ ID NO: 761835 - DNA, 22 bp, Artificial Sequence
  chemically synthesized
ttccagatcattgtatatacta

SEQ ID NO: 761836 - DNA, 22 bp, Artificial Sequence
  chemically synthesized
tcatagttaatagtatatacaa

SEQ ID NO: 761837 - DNA, 22 bp, Artificial Sequence
  chemically synthesized
catagttaatagtatatacaat

SEQ ID NO: 761838 - DNA, 22 bp, Artificial Sequence
  chemically synthesized
tttttccagatcattgtatata

SEQ ID NO: 761839 - DNA, 22 bp, Artificial Sequence
  chemically synthesized
atagttaatagtatatacaatg

SEQ ID NO: 761840 - DNA, 22 bp, Artificial Sequence
  chemically synthesized
gattatttttccagatcattgt

SEQ ID NO: 761841 - DNA, 22 bp, Artificial Sequence
  chemically synthesized
atagtatatacaatgatctgga

SEQ ID NO: 761842 - DNA, 22 bp, Artificial Sequence
  chemically synthesized
ctagattatttttccagatcat

SEQ ID NO: 761843 - DNA, 22 bp, Artificial Sequence
  chemically synthesized
ctactagattatttttccagat

SEQ ID NO: 761844 - DNA, 22 bp, Artificial Sequence
  chemically synthesized
gtctactactagattatttttc

SEQ ID NO: 761845 - DNA, 22 bp, Artificial Sequence
  chemically synthesized
agtctactactagattattttt

SEQ ID NO: 761846 - DNA, 22 bp, Artificial Sequence
  chemically synthesized
aatttagtctactactagatta

SEQ ID NO: 761847 - DNA, 22 bp, Artificial Sequence
  chemically synthesized
caatttagtctactactagatt

SEQ ID NO: 761848 - DNA, 22 bp, Artificial Sequence
  chemically synthesized
gaaaaataatctagtagtagac

SEQ ID NO: 761849 - DNA, 22 bp, Artificial Sequence
  chemically synthesized
gtagtagactaaattgaaatct

SEQ ID NO: 761850 - DNA, 22 bp, Artificial Sequence
  chemically synthesized
cataagaaatatatatgaagat

SEQ ID NO: 761851 - DNA, 22 bp, Artificial Sequence
  chemically synthesized
acataagaaatatatatgaaga

SEQ ID NO: 761852 - DNA, 22 bp, Artificial Sequence
  chemically synthesized
tacataagaaatatatatgaag

SEQ ID NO: 761853 - DNA, 22 bp, Artificial Sequence
  chemically synthesized
aattgaaatcttcatatatatt

SEQ ID NO: 761854 - DNA, 22 bp, Artificial Sequence
  chemically synthesized
ttttacataagaaatatatatg

SEQ ID NO: 761855 - DNA, 22 bp, Artificial Sequence
  chemically synthesized
aaatcttcatatatatttctta

SEQ ID NO: 761856 - DNA, 22 bp, Artificial Sequence
  chemically synthesized
catatatatttcttatgtaaaa

SEQ ID NO: 761857 - DNA, 22 bp, Artificial Sequence
  chemically synthesized
atatatatttcttatgtaaaac

SEQ ID NO: 761858 - DNA, 22 bp, Artificial Sequence
  chemically synthesized
agaagtggtcaagtcaattgtt

SEQ ID NO: 761859 - DNA, 22 bp, Artificial Sequence
  chemically synthesized
gagaagtggtcaagtcaattgt

SEQ ID NO: 761860 - DNA, 22 bp, Artificial Sequence
  chemically synthesized
cttatgtaaaacaattgacttg

SEQ ID NO: 761861 - DNA, 22 bp, Artificial Sequence
  chemically synthesized
ttatgtaaaacaattgacttga

SEQ ID NO: 761862 - DNA, 22 bp, Artificial Sequence
  chemically synthesized
atgtaaaacaattgacttgacc

SEQ ID NO: 761863 - DNA, 22 bp, Artificial Sequence
  chemically synthesized
tgtaaaacaattgacttgacca

SEQ ID NO: 761864 - DNA, 22 bp, Artificial Sequence
  chemically synthesized
ataacttgagaagtggtcaagt

SEQ ID NO: 761865 - DNA, 22 bp, Artificial Sequence
  chemically synthesized
gaatattaataacttgagaagt

SEQ ID NO: 761866 - DNA, 22 bp, Artificial Sequence
  chemically synthesized
agaatattaataacttgagaag

SEQ ID NO: 761867 - DNA, 22 bp, Artificial Sequence
  chemically synthesized
tagaatattaataacttgagaa

SEQ ID NO: 761868 - DNA, 22 bp, Artificial Sequence
  chemically synthesized
acttgaccacttctcaagttat

SEQ ID NO: 761869 - DNA, 22 bp, Artificial Sequence
  chemically synthesized
attttagaatattaataacttg

SEQ ID NO: 761870 - DNA, 22 bp, Artificial Sequence
  chemically synthesized
aattttagaatattaataactt

SEQ ID NO: 761871 - DNA, 22 bp, Artificial Sequence
  chemically synthesized
gaccacttctcaagttattaat

SEQ ID NO: 761872 - DNA, 22 bp, Artificial Sequence
  chemically synthesized
taattttagaatattaataact

SEQ ID NO: 761873 - DNA, 22 bp, Artificial Sequence
  chemically synthesized
accacttctcaagttattaata

SEQ ID NO: 761874 - DNA, 22 bp, Artificial Sequence
  chemically synthesized
ttaattttagaatattaataac

SEQ ID NO: 761875 - DNA, 22 bp, Artificial Sequence
  chemically synthesized
catttttaattttagaatatta

SEQ ID NO: 761876 - DNA, 22 bp, Artificial Sequence
  chemically synthesized
gcatttttaattttagaatatt

SEQ ID NO: 761877 - DNA, 22 bp, Artificial Sequence
  chemically synthesized
ctcaagttattaatattctaaa

SEQ ID NO: 761878 - DNA, 22 bp, Artificial Sequence
  chemically synthesized
tcaagttattaatattctaaaa

SEQ ID NO: 761879 - DNA, 22 bp, Artificial Sequence
  chemically synthesized
aagttattaatattctaaaatt

SEQ ID NO: 761880 - DNA, 22 bp, Artificial Sequence
  chemically synthesized
ttaatattctaaaattaaaaat

SEQ ID NO: 761881 - DNA, 22 bp, Artificial Sequence
  chemically synthesized
atattctaaaattaaaaatgca

SEQ ID NO: 761882 - DNA, 22 bp, Artificial Sequence
  chemically synthesized
catatccacaatccttgcattt

SEQ ID NO: 761883 - DNA, 22 bp, Artificial Sequence
  chemically synthesized
taaaattaaaaatgcaaggatt

SEQ ID NO: 761884 - DNA, 22 bp, Artificial Sequence
  chemically synthesized
aaattaaaaatgcaaggattgt

SEQ ID NO: 761885 - DNA, 22 bp, Artificial Sequence
  chemically synthesized
aaattccatatccacaatcctt

SEQ ID NO: 761886 - DNA, 22 bp, Artificial Sequence
  chemically synthesized
taaaattccatatccacaatcc

SEQ ID NO: 761887 - DNA, 22 bp, Artificial Sequence
  chemically synthesized
aaaatgcaaggattgtggatat

SEQ ID NO: 761888 - DNA, 22 bp, Artificial Sequence
  chemically synthesized
attctaaaattccatatccaca

SEQ ID NO: 761889 - DNA, 22 bp, Artificial Sequence
  chemically synthesized
cattctaaaattccatatccac

SEQ ID NO: 761890 - DNA, 22 bp, Artificial Sequence
  chemically synthesized
tcattctaaaattccatatcca

SEQ ID NO: 761891 - DNA, 22 bp, Artificial Sequence
  chemically synthesized
ttcattctaaaattccatatcc

SEQ ID NO: 761892 - DNA, 22 bp, Artificial Sequence
  chemically synthesized
tggatatggaattttagaatga

SEQ ID NO: 761893 - DNA, 22 bp, Artificial Sequence
  chemically synthesized
gtcaaagaaagtgtttttcatt

SEQ ID NO: 761894 - DNA, 22 bp, Artificial Sequence
  chemically synthesized
tagaatgaaaaacactttcttt

SEQ ID NO: 761895 - DNA, 22 bp, Artificial Sequence
  chemically synthesized
agaatgaaaaacactttctttg

SEQ ID NO: 761896 - DNA, 22 bp, Artificial Sequence
  chemically synthesized
gaatgaaaaacactttctttga

SEQ ID NO: 761897 - DNA, 22 bp, Artificial Sequence
  chemically synthesized
agatggtaattagtcaaagaaa

SEQ ID NO: 761898 - DNA, 22 bp, Artificial Sequence
  chemically synthesized
tccaatattaagatggtaatta

SEQ ID NO: 761899 - DNA, 22 bp, Artificial Sequence
  chemically synthesized
tctttgactaattaccatctta

SEQ ID NO: 761900 - DNA, 22 bp, Artificial Sequence
  chemically synthesized
ctttgactaattaccatcttaa

SEQ ID NO: 761901 - DNA, 22 bp, Artificial Sequence
  chemically synthesized
tttgactaattaccatcttaat

SEQ ID NO: 761902 - DNA, 22 bp, Artificial Sequence
  chemically synthesized
tgactaattaccatcttaatat

SEQ ID NO: 761903 - DNA, 22 bp, Artificial Sequence
  chemically synthesized
gactaattaccatcttaatatt

SEQ ID NO: 761904 - DNA, 22 bp, Artificial Sequence
  chemically synthesized
atgacgttatccaatattaaga

SEQ ID NO: 761905 - DNA, 22 bp, Artificial Sequence
  chemically synthesized
actaattaccatcttaatattg

SEQ ID NO: 761906 - DNA, 22 bp, Artificial Sequence
  chemically synthesized
ctgatgacgttatccaatatta

SEQ ID NO: 761907 - DNA, 22 bp, Artificial Sequence
  chemically synthesized
attaccatcttaatattggata

SEQ ID NO: 761908 - DNA, 22 bp, Artificial Sequence
  chemically synthesized
ccatcttaatattggataacgt

SEQ ID NO: 761909 - DNA, 22 bp, Artificial Sequence
  chemically synthesized
aatattggataacgtcatcagt

SEQ ID NO: 761910 - DNA, 22 bp, Artificial Sequence
  chemically synthesized
atattggataacgtcatcagta

SEQ ID NO: 761911 - DNA, 22 bp, Artificial Sequence
  chemically synthesized
gataacgtcatcagtaactgtg

SEQ ID NO: 761912 - DNA, 22 bp, Artificial Sequence
  chemically synthesized
aatgtacacacacatgcataca

SEQ ID NO: 761913 - DNA, 22 bp, Artificial Sequence
  chemically synthesized
aaatgtacacacacatgcatac

SEQ ID NO: 761914 - DNA, 22 bp, Artificial Sequence
  chemically synthesized
cttaaatgtacacacacatgca

SEQ ID NO: 761915 - DNA, 22 bp, Artificial Sequence
  chemically synthesized
acttaaatgtacacacacatgc

SEQ ID NO: 761916 - DNA, 22 bp, Artificial Sequence
  chemically synthesized
tgtgtgtatgcatgtgtgtgta

SEQ ID NO: 761917 - DNA, 22 bp, Artificial Sequence
  chemically synthesized
tttacttaaatgtacacacaca

SEQ ID NO: 761918 - DNA, 22 bp, Artificial Sequence
  chemically synthesized
agtgggagaaaaagagaaaatt

SEQ ID NO: 761919 - DNA, 22 bp, Artificial Sequence
  chemically synthesized
aagtgggagaaaaagagaaaat

SEQ ID NO: 761920 - DNA, 22 bp, Artificial Sequence
  chemically synthesized
taagtgggagaaaaagagaaaa

SEQ ID NO: 761921 - DNA, 22 bp, Artificial Sequence
  chemically synthesized
aagtaaataattttctcttttt

SEQ ID NO: 761922 - DNA, 22 bp, Artificial Sequence
  chemically synthesized
agtaaataattttctctttttc

SEQ ID NO: 761923 - DNA, 22 bp, Artificial Sequence
  chemically synthesized
ctttaagtgggagaaaaagaga

SEQ ID NO: 761924 - DNA, 22 bp, Artificial Sequence
  chemically synthesized
actgctttaagtgggagaaaaa

SEQ ID NO: 761925 - DNA, 22 bp, Artificial Sequence
  chemically synthesized
tctctttttctcccacttaaag

SEQ ID NO: 761926 - DNA, 22 bp, Artificial Sequence
  chemically synthesized
ctctttttctcccacttaaagc

SEQ ID NO: 761927 - DNA, 22 bp, Artificial Sequence
  chemically synthesized
tctttttctcccacttaaagca

SEQ ID NO: 761928 - DNA, 22 bp, Artificial Sequence
  chemically synthesized
tttttctcccacttaaagcagt

SEQ ID NO: 761929 - DNA, 22 bp, Artificial Sequence
  chemically synthesized
tttctcccacttaaagcagtta

SEQ ID NO: 761930 - DNA, 22 bp, Artificial Sequence
  chemically synthesized
ttctcccacttaaagcagttaa

SEQ ID NO: 761931 - DNA, 22 bp, Artificial Sequence
  chemically synthesized
tctcccacttaaagcagttaat

SEQ ID NO: 761932 - DNA, 22 bp, Artificial Sequence
  chemically synthesized
ctcccacttaaagcagttaatg

SEQ ID NO: 761933 - DNA, 22 bp, Artificial Sequence
  chemically synthesized
tcccacttaaagcagttaatgt

SEQ ID NO: 761934 - DNA, 22 bp, Artificial Sequence
  chemically synthesized
ccacttaaagcagttaatgttt

SEQ ID NO: 761935 - DNA, 22 bp, Artificial Sequence
  chemically synthesized
catcaaacaaaacgaaaacatt

SEQ ID NO: 761936 - DNA, 22 bp, Artificial Sequence
  chemically synthesized
aaagcagttaatgttttcgttt

SEQ ID NO: 761937 - DNA, 22 bp, Artificial Sequence
  chemically synthesized
aagcagttaatgttttcgtttt

SEQ ID NO: 761938 - DNA, 22 bp, Artificial Sequence
  chemically synthesized
agttccatcaaacaaaacgaaa

SEQ ID NO: 761939 - DNA, 22 bp, Artificial Sequence
  chemically synthesized
aagttccatcaaacaaaacgaa

SEQ ID NO: 761940 - DNA, 22 bp, Artificial Sequence
  chemically synthesized
atgttttcgttttgtttgatgg

SEQ ID NO: 761941 - DNA, 22 bp, Artificial Sequence
  chemically synthesized
tcgttttgtttgatggaactta

SEQ ID NO: 761942 - DNA, 22 bp, Artificial Sequence
  chemically synthesized
cgttttgtttgatggaacttaa

SEQ ID NO: 761943 - DNA, 22 bp, Artificial Sequence
  chemically synthesized
gttttgtttgatggaacttaaa

SEQ ID NO: 761944 - DNA, 22 bp, Artificial Sequence
  chemically synthesized
tgtttgatggaacttaaattat

SEQ ID NO: 761945 - DNA, 22 bp, Artificial Sequence
  chemically synthesized
gtttgatggaacttaaattatc

SEQ ID NO: 761946 - DNA, 22 bp, Artificial Sequence
  chemically synthesized
tttgatggaacttaaattatca

SEQ ID NO: 761947 - DNA, 22 bp, Artificial Sequence
  chemically synthesized
gatggaacttaaattatcactg

SEQ ID NO: 761948 - DNA, 22 bp, Artificial Sequence
  chemically synthesized
atggaacttaaattatcactga

SEQ ID NO: 761949 - DNA, 22 bp, Artificial Sequence
  chemically synthesized
aaattatcactgactacttact

SEQ ID NO: 761950 - DNA, 22 bp, Artificial Sequence
  chemically synthesized
aattatcactgactacttactt

SEQ ID NO: 761951 - DNA, 22 bp, Artificial Sequence
  chemically synthesized
tcactgactacttacttttctt

SEQ ID NO: 761952 - DNA, 22 bp, Artificial Sequence
  chemically synthesized
gccaagaggtataaggaagaaa

SEQ ID NO: 761953 - DNA, 22 bp, Artificial Sequence
  chemically synthesized
actacttacttttcttccttat

SEQ ID NO: 761954 - DNA, 22 bp, Artificial Sequence
  chemically synthesized
cttacttttcttccttatacct

SEQ ID NO: 761955 - DNA, 22 bp, Artificial Sequence
  chemically synthesized
acttttcttccttatacctctt

SEQ ID NO: 761956 - DNA, 22 bp, Artificial Sequence
  chemically synthesized
cttttcttccttatacctcttg

SEQ ID NO: 761957 - DNA, 22 bp, Artificial Sequence
  chemically synthesized
catcacatgttggccaagaggt

SEQ ID NO: 761958 - DNA, 22 bp, Artificial Sequence
  chemically synthesized
ttcttccttatacctcttggcc

SEQ ID NO: 761959 - DNA, 22 bp, Artificial Sequence
  chemically synthesized
tcttccttatacctcttggcca

SEQ ID NO: 761960 - DNA, 22 bp, Artificial Sequence
  chemically synthesized
cttccttatacctcttggccaa

SEQ ID NO: 761961 - DNA, 22 bp, Artificial Sequence
  chemically synthesized
ttacatcacatgttggccaaga

SEQ ID NO: 761962 - DNA, 22 bp, Artificial Sequence
  chemically synthesized
ttccttatacctcttggccaac

SEQ ID NO: 761963 - DNA, 22 bp, Artificial Sequence
  chemically synthesized
ccttatacctcttggccaacat

SEQ ID NO: 761964 - DNA, 22 bp, Artificial Sequence
  chemically synthesized
cttatacctcttggccaacatg

SEQ ID NO: 761965 - DNA, 22 bp, Artificial Sequence
  chemically synthesized
atacctcttggccaacatgtga

SEQ ID NO: 761966 - DNA, 22 bp, Artificial Sequence
  chemically synthesized
tacctcttggccaacatgtgat

SEQ ID NO: 761967 - DNA, 22 bp, Artificial Sequence
  chemically synthesized
cacatgcattattacatcacat

SEQ ID NO: 761968 - DNA, 22 bp, Artificial Sequence
  chemically synthesized
ttggccaacatgtgatgtaata

SEQ ID NO: 761969 - DNA, 22 bp, Artificial Sequence
  chemically synthesized
ggccaacatgtgatgtaataat

SEQ ID NO: 761970 - DNA, 22 bp, Artificial Sequence
  chemically synthesized
gccaacatgtgatgtaataatg

SEQ ID NO: 761971 - DNA, 22 bp, Artificial Sequence
  chemically synthesized
tcattccacatgcattattaca

SEQ ID NO: 761972 - DNA, 22 bp, Artificial Sequence
  chemically synthesized
aagaaaagtatatgctatcatt

SEQ ID NO: 761973 - DNA, 22 bp, Artificial Sequence
  chemically synthesized
attcaagaaaagtatatgctat

SEQ ID NO: 761974 - DNA, 22 bp, Artificial Sequence
  chemically synthesized
aattcaagaaaagtatatgcta

SEQ ID NO: 761975 - DNA, 22 bp, Artificial Sequence
  chemically synthesized
ataatttaattcaagaaaagta

SEQ ID NO: 761976 - DNA, 22 bp, Artificial Sequence
  chemically synthesized
tctcataatttaattcaagaaa

SEQ ID NO: 761977 - DNA, 22 bp, Artificial Sequence
  chemically synthesized
tataatcctatctcataattta

SEQ ID NO: 761978 - DNA, 22 bp, Artificial Sequence
  chemically synthesized
ttcttgaattaaattatgagat

SEQ ID NO: 761979 - DNA, 22 bp, Artificial Sequence
  chemically synthesized
tcttgaattaaattatgagata

SEQ ID NO: 761980 - DNA, 22 bp, Artificial Sequence
  chemically synthesized
cttgaattaaattatgagatag

SEQ ID NO: 761981 - DNA, 22 bp, Artificial Sequence
  chemically synthesized
ttgaattaaattatgagatagg

SEQ ID NO: 761982 - DNA, 22 bp, Artificial Sequence
  chemically synthesized
aaattgtataatcctatctcat

SEQ ID NO: 761983 - DNA, 22 bp, Artificial Sequence
  chemically synthesized
gaattaaattatgagataggat

SEQ ID NO: 761984 - DNA, 22 bp, Artificial Sequence
  chemically synthesized
aattaaattatgagataggatt

SEQ ID NO: 761985 - DNA, 22 bp, Artificial Sequence
  chemically synthesized
attgaaattgtataatcctatc

SEQ ID NO: 761986 - DNA, 22 bp, Artificial Sequence
  chemically synthesized
aattgaaattgtataatcctat

SEQ ID NO: 761987 - DNA, 22 bp, Artificial Sequence
  chemically synthesized
aattatgagataggattataca

SEQ ID NO: 761988 - DNA, 22 bp, Artificial Sequence
  chemically synthesized
tgagataggattatacaatttc

SEQ ID NO: 761989 - DNA, 22 bp, Artificial Sequence
  chemically synthesized
agagaaaagaaatttaattgaa

SEQ ID NO: 761990 - DNA, 22 bp, Artificial Sequence
  chemically synthesized
gagagaaaagaaatttaattga

SEQ ID NO: 761991 - DNA, 22 bp, Artificial Sequence
  chemically synthesized
tgagagaaaagaaatttaattg

SEQ ID NO: 761992 - DNA, 22 bp, Artificial Sequence
  chemically synthesized
tacaatttcaattaaatttctt

SEQ ID NO: 761993 - DNA, 22 bp, Artificial Sequence
  chemically synthesized
agatgtctttgagagaaaagaa

SEQ ID NO: 761994 - DNA, 22 bp, Artificial Sequence
  chemically synthesized
caattaaatttcttttctctca

SEQ ID NO: 761995 - DNA, 22 bp, Artificial Sequence
  chemically synthesized
aattaaatttcttttctctcaa

SEQ ID NO: 761996 - DNA, 22 bp, Artificial Sequence
  chemically synthesized
aatttcttttctctcaaagaca

SEQ ID NO: 761997 - DNA, 22 bp, Artificial Sequence
  chemically synthesized
tataaagtaattaagatgtctt

SEQ ID NO: 761998 - DNA, 22 bp, Artificial Sequence
  chemically synthesized
cttttctctcaaagacatctta

SEQ ID NO: 761999 - DNA, 22 bp, Artificial Sequence
  chemically synthesized
ttttctctcaaagacatcttaa

SEQ ID NO: 762000 - DNA, 22 bp, Artificial Sequence
  chemically synthesized
ttctctcaaagacatcttaatt

SEQ ID NO: 762001 - DNA, 22 bp, Artificial Sequence
  chemically synthesized
tctctcaaagacatcttaatta

SEQ ID NO: 762002 - DNA, 22 bp, Artificial Sequence
  chemically synthesized
ctctcaaagacatcttaattac

SEQ ID NO: 762003 - DNA, 22 bp, Artificial Sequence
  chemically synthesized
tctcaaagacatcttaattact

SEQ ID NO: 762004 - DNA, 22 bp, Artificial Sequence
  chemically synthesized
tcaaagacatcttaattacttt

SEQ ID NO: 762005 - DNA, 22 bp, Artificial Sequence
  chemically synthesized
aaaggcattatataaagtaatt

SEQ ID NO: 762006 - DNA, 22 bp, Artificial Sequence
  chemically synthesized
aaagacatcttaattactttat

SEQ ID NO: 762007 - DNA, 22 bp, Artificial Sequence
  chemically synthesized
aaaaggcattatataaagtaat

SEQ ID NO: 762008 - DNA, 22 bp, Artificial Sequence
  chemically synthesized
atttaaaaggcattatataaag

SEQ ID NO: 762009 - DNA, 22 bp, Artificial Sequence
  chemically synthesized
attgatttaaaaggcattatat

SEQ ID NO: 762010 - DNA, 22 bp, Artificial Sequence
  chemically synthesized
aattactttatataatgccttt

SEQ ID NO: 762011 - DNA, 22 bp, Artificial Sequence
  chemically synthesized
attactttatataatgcctttt

SEQ ID NO: 762012 - DNA, 22 bp, Artificial Sequence
  chemically synthesized
ctttatataatgccttttaaat

SEQ ID NO: 762013 - DNA, 22 bp, Artificial Sequence
  chemically synthesized
tatataatgccttttaaatcaa

SEQ ID NO: 762014 - DNA, 22 bp, Artificial Sequence
  chemically synthesized
aaatagaactgattgatttaaa

SEQ ID NO: 762015 - DNA, 22 bp, Artificial Sequence
  chemically synthesized
atataatgccttttaaatcaat

SEQ ID NO: 762016 - DNA, 22 bp, Artificial Sequence
  chemically synthesized
tataatgccttttaaatcaatc

SEQ ID NO: 762017 - DNA, 22 bp, Artificial Sequence
  chemically synthesized
attaaaatagaactgattgatt

SEQ ID NO: 762018 - DNA, 22 bp, Artificial Sequence
  chemically synthesized
aattaaaatagaactgattgat

SEQ ID NO: 762019 - DNA, 22 bp, Artificial Sequence
  chemically synthesized
ttaattaaaatagaactgattg

SEQ ID NO: 762020 - DNA, 22 bp, Artificial Sequence
  chemically synthesized
cttaattaaaatagaactgatt

SEQ ID NO: 762021 - DNA, 22 bp, Artificial Sequence
  chemically synthesized
tcttaattaaaatagaactgat

SEQ ID NO: 762022 - DNA, 22 bp, Artificial Sequence
  chemically synthesized
ttaaatcaatcagttctatttt

SEQ ID NO: 762023 - DNA, 22 bp, Artificial Sequence
  chemically synthesized
gttttcttaattaaaatagaac

SEQ ID NO: 762024 - DNA, 22 bp, Artificial Sequence
  chemically synthesized
taaatcaatcagttctatttta

SEQ ID NO: 762025 - DNA, 22 bp, Artificial Sequence
  chemically synthesized
ggttttcttaattaaaatagaa

SEQ ID NO: 762026 - DNA, 22 bp, Artificial Sequence
  chemically synthesized
aaatcaatcagttctattttaa

SEQ ID NO: 762027 - DNA, 22 bp, Artificial Sequence
  chemically synthesized
aatcaatcagttctattttaat

SEQ ID NO: 762028 - DNA, 22 bp, Artificial Sequence
  chemically synthesized
ccttggttttcttaattaaaat

SEQ ID NO: 762029 - DNA, 22 bp, Artificial Sequence
  chemically synthesized
taccttggttttcttaattaaa

SEQ ID NO: 762030 - DNA, 22 bp, Artificial Sequence
  chemically synthesized
ctaccttggttttcttaattaa

SEQ ID NO: 762031 - DNA, 22 bp, Artificial Sequence
  chemically synthesized
tctaccttggttttcttaatta

SEQ ID NO: 762032 - DNA, 22 bp, Artificial Sequence
  chemically synthesized
ttctaccttggttttcttaatt

SEQ ID NO: 762033 - DNA, 22 bp, Artificial Sequence
  chemically synthesized
atttttctaccttggttttctt

SEQ ID NO: 762034 - DNA, 22 bp, Artificial Sequence
  chemically synthesized
aatttttctaccttggttttct

SEQ ID NO: 762035 - DNA, 22 bp, Artificial Sequence
  chemically synthesized
tattttaattaagaaaaccaag

SEQ ID NO: 762036 - DNA, 22 bp, Artificial Sequence
  chemically synthesized
ttttaattaagaaaaccaaggt

SEQ ID NO: 762037 - DNA, 22 bp, Artificial Sequence
  chemically synthesized
tttaatttttctaccttggttt

SEQ ID NO: 762038 - DNA, 22 bp, Artificial Sequence
  chemically synthesized
taattaagaaaaccaaggtaga

SEQ ID NO: 762039 - DNA, 22 bp, Artificial Sequence
  chemically synthesized
aattaagaaaaccaaggtagaa

SEQ ID NO: 762040 - DNA, 22 bp, Artificial Sequence
  chemically synthesized
attaagaaaaccaaggtagaaa

SEQ ID NO: 762041 - DNA, 22 bp, Artificial Sequence
  chemically synthesized
gaaaattgtttaatttttctac

SEQ ID NO: 762042 - DNA, 22 bp, Artificial Sequence
  chemically synthesized
agaaaaccaaggtagaaaaatt

SEQ ID NO: 762043 - DNA, 22 bp, Artificial Sequence
  chemically synthesized
tgaacctggaaaattgtttaat

SEQ ID NO: 762044 - DNA, 22 bp, Artificial Sequence
  chemically synthesized
atgaacctggaaaattgtttaa

SEQ ID NO: 762045 - DNA, 22 bp, Artificial Sequence
  chemically synthesized
tatgaacctggaaaattgttta

SEQ ID NO: 762046 - DNA, 22 bp, Artificial Sequence
  chemically synthesized
caatcacactttatgaacctgg

SEQ ID NO: 762047 - DNA, 22 bp, Artificial Sequence
  chemically synthesized
tgcaatcacactttatgaacct

SEQ ID NO: 762048 - DNA, 22 bp, Artificial Sequence
  chemically synthesized
aacaattttccaggttcataaa

SEQ ID NO: 762049 - DNA, 22 bp, Artificial Sequence
  chemically synthesized
gttctgcaatcacactttatga

SEQ ID NO: 762050 - DNA, 22 bp, Artificial Sequence
  chemically synthesized
agttctgcaatcacactttatg

SEQ ID NO: 762051 - DNA, 22 bp, Artificial Sequence
  chemically synthesized
tagttctgcaatcacactttat

SEQ ID NO: 762052 - DNA, 22 bp, Artificial Sequence
  chemically synthesized
ttagttctgcaatcacacttta

SEQ ID NO: 762053 - DNA, 22 bp, Artificial Sequence
  chemically synthesized
tccaggttcataaagtgtgatt

SEQ ID NO: 762054 - DNA, 22 bp, Artificial Sequence
  chemically synthesized
ttttagttctgcaatcacactt

SEQ ID NO: 762055 - DNA, 22 bp, Artificial Sequence
  chemically synthesized
ccaggttcataaagtgtgattg

SEQ ID NO: 762056 - DNA, 22 bp, Artificial Sequence
  chemically synthesized
caggttcataaagtgtgattgc

SEQ ID NO: 762057 - DNA, 22 bp, Artificial Sequence
  chemically synthesized
ttcttttagttctgcaatcaca

SEQ ID NO: 762058 - DNA, 22 bp, Artificial Sequence
  chemically synthesized
attcttttagttctgcaatcac

SEQ ID NO: 762059 - DNA, 22 bp, Artificial Sequence
  chemically synthesized
tattcttttagttctgcaatca

SEQ ID NO: 762060 - DNA, 22 bp, Artificial Sequence
  chemically synthesized
ataaagtgtgattgcagaacta

SEQ ID NO: 762061 - DNA, 22 bp, Artificial Sequence
  chemically synthesized
caatcgtacaattttattcttt

SEQ ID NO: 762062 - DNA, 22 bp, Artificial Sequence
  chemically synthesized
gcaatcgtacaattttattctt

SEQ ID NO: 762063 - DNA, 22 bp, Artificial Sequence
  chemically synthesized
ttgcaatcgtacaattttattc

SEQ ID NO: 762064 - DNA, 22 bp, Artificial Sequence
  chemically synthesized
cagaactaaaagaataaaattg

SEQ ID NO: 762065 - DNA, 22 bp, Artificial Sequence
  chemically synthesized
tcttgcaatcgtacaattttat

SEQ ID NO: 762066 - DNA, 22 bp, Artificial Sequence
  chemically synthesized
cagttctcttgcaatcgtacaa

SEQ ID NO: 762067 - DNA, 22 bp, Artificial Sequence
  chemically synthesized
aaagaataaaattgtacgattg

SEQ ID NO: 762068 - DNA, 22 bp, Artificial Sequence
  chemically synthesized
ccagttctcttgcaatcgtaca

SEQ ID NO: 762069 - DNA, 22 bp, Artificial Sequence
  chemically synthesized
ttccagttctcttgcaatcgta

SEQ ID NO: 762070 - DNA, 22 bp, Artificial Sequence
  chemically synthesized
tacgattgcaagagaactggaa

SEQ ID NO: 762071 - DNA, 22 bp, Artificial Sequence
  chemically synthesized
caagagaactggaagagactgt

SEQ ID NO: 762072 - DNA, 22 bp, Artificial Sequence
  chemically synthesized
accagaaatatggacagtctct

SEQ ID NO: 762073 - DNA, 22 bp, Artificial Sequence
  chemically synthesized
gaccagaaatatggacagtctc

SEQ ID NO: 762074 - DNA, 22 bp, Artificial Sequence
  chemically synthesized
gaagagactgtccatatttctg

SEQ ID NO: 762075 - DNA, 22 bp, Artificial Sequence
  chemically synthesized
aaatgaagagtttgaccagaaa

SEQ ID NO: 762076 - DNA, 22 bp, Artificial Sequence
  chemically synthesized
actgaaatgaagagtttgacca

SEQ ID NO: 762077 - DNA, 22 bp, Artificial Sequence
  chemically synthesized
cactgaaatgaagagtttgacc

SEQ ID NO: 762078 - DNA, 22 bp, Artificial Sequence
  chemically synthesized
tccatatttctggtcaaactct

SEQ ID NO: 762079 - DNA, 22 bp, Artificial Sequence
  chemically synthesized
cttcactgaaatgaagagtttg

SEQ ID NO: 762080 - DNA, 22 bp, Artificial Sequence
  chemically synthesized
tccttcactgaaatgaagagtt

SEQ ID NO: 762081 - DNA, 22 bp, Artificial Sequence
  chemically synthesized
ctccttcactgaaatgaagagt

SEQ ID NO: 762082 - DNA, 22 bp, Artificial Sequence
  chemically synthesized
tctccttcactgaaatgaagag

SEQ ID NO: 762083 - DNA, 22 bp, Artificial Sequence
  chemically synthesized
ctggtcaaactcttcatttcag

SEQ ID NO: 762084 - DNA, 22 bp, Artificial Sequence
  chemically synthesized
tggtcaaactcttcatttcagt

SEQ ID NO: 762085 - DNA, 22 bp, Artificial Sequence
  chemically synthesized
aattttctccttcactgaaatg

SEQ ID NO: 762086 - DNA, 22 bp, Artificial Sequence
  chemically synthesized
gtcaaactcttcatttcagtga

SEQ ID NO: 762087 - DNA, 22 bp, Artificial Sequence
  chemically synthesized
caattttctccttcactgaaat

SEQ ID NO: 762088 - DNA, 22 bp, Artificial Sequence
  chemically synthesized
agacttcaattttctccttcac

SEQ ID NO: 762089 - DNA, 22 bp, Artificial Sequence
  chemically synthesized
cagacttcaattttctccttca

SEQ ID NO: 762090 - DNA, 22 bp, Artificial Sequence
  chemically synthesized
ttcatttcagtgaaggagaaaa

SEQ ID NO: 762091 - DNA, 22 bp, Artificial Sequence
  chemically synthesized
cttcagacttcaattttctcct

SEQ ID NO: 762092 - DNA, 22 bp, Artificial Sequence
  chemically synthesized
catttcagtgaaggagaaaatt

SEQ ID NO: 762093 - DNA, 22 bp, Artificial Sequence
  chemically synthesized
atttcagtgaaggagaaaattg

SEQ ID NO: 762094 - DNA, 22 bp, Artificial Sequence
  chemically synthesized
actgcttcagacttcaattttc

SEQ ID NO: 762095 - DNA, 22 bp, Artificial Sequence
  chemically synthesized
aactgcttcagacttcaatttt

SEQ ID NO: 762096 - DNA, 22 bp, Artificial Sequence
  chemically synthesized
cagtgaaggagaaaattgaagt

SEQ ID NO: 762097 - DNA, 22 bp, Artificial Sequence
  chemically synthesized
agtgaaggagaaaattgaagtc

SEQ ID NO: 762098 - DNA, 22 bp, Artificial Sequence
  chemically synthesized
atcaagtcacttaactgcttca

SEQ ID NO: 762099 - DNA, 22 bp, Artificial Sequence
  chemically synthesized
gatcaagtcacttaactgcttc

SEQ ID NO: 762100 - DNA, 22 bp, Artificial Sequence
  chemically synthesized
aagtctgaagcagttaagtgac

SEQ ID NO: 762101 - DNA, 22 bp, Artificial Sequence
  chemically synthesized
gcatataatcttgatcaagtca

SEQ ID NO: 762102 - DNA, 22 bp, Artificial Sequence
  chemically synthesized
aagcagttaagtgacttgatca

SEQ ID NO: 762103 - DNA, 22 bp, Artificial Sequence
  chemically synthesized
agcatataatcttgatcaagtc

SEQ ID NO: 762104 - DNA, 22 bp, Artificial Sequence
  chemically synthesized
tcttagcatataatcttgatca

SEQ ID NO: 762105 - DNA, 22 bp, Artificial Sequence
  chemically synthesized
actgtcttagcatataatcttg

SEQ ID NO: 762106 - DNA, 22 bp, Artificial Sequence
  chemically synthesized
agtgacttgatcaagattatat

SEQ ID NO: 762107 - DNA, 22 bp, Artificial Sequence
  chemically synthesized
tcactaactgtcttagcatata

SEQ ID NO: 762108 - DNA, 22 bp, Artificial Sequence
  chemically synthesized
tgtcactaactgtcttagcata

SEQ ID NO: 762109 - DNA, 22 bp, Artificial Sequence
  chemically synthesized
gatcaagattatatgctaagac

SEQ ID NO: 762110 - DNA, 22 bp, Artificial Sequence
  chemically synthesized
atcaagattatatgctaagaca

SEQ ID NO: 762111 - DNA, 22 bp, Artificial Sequence
  chemically synthesized
ttctgtcactaactgtcttagc

SEQ ID NO: 762112 - DNA, 22 bp, Artificial Sequence
  chemically synthesized
tattctgtcactaactgtctta

SEQ ID NO: 762113 - DNA, 22 bp, Artificial Sequence
  chemically synthesized
ttctattctgtcactaactgtc

SEQ ID NO: 762114 - DNA, 22 bp, Artificial Sequence
  chemically synthesized
tgttctattctgtcactaactg

SEQ ID NO: 762115 - DNA, 22 bp, Artificial Sequence
  chemically synthesized
ctgttctattctgtcactaact

SEQ ID NO: 762116 - DNA, 22 bp, Artificial Sequence
  chemically synthesized
tatgctaagacagttagtgaca

SEQ ID NO: 762117 - DNA, 22 bp, Artificial Sequence
  chemically synthesized
ccttctgttctattctgtcact

SEQ ID NO: 762118 - DNA, 22 bp, Artificial Sequence
  chemically synthesized
cccttctgttctattctgtcac

SEQ ID NO: 762119 - DNA, 22 bp, Artificial Sequence
  chemically synthesized
agacagttagtgacagaataga

SEQ ID NO: 762120 - DNA, 22 bp, Artificial Sequence
  chemically synthesized
gtgacagaatagaacagaaggg

SEQ ID NO: 762121 - DNA, 22 bp, Artificial Sequence
  chemically synthesized
ggcaacccagtttcccttctgt

SEQ ID NO: 762122 - DNA, 22 bp, Artificial Sequence
  chemically synthesized
ggttgcccagctgctggcccat

SEQ ID NO: 762123 - DNA, 22 bp, Artificial Sequence
  chemically synthesized
cccagctgctggcccatgtctt

SEQ ID NO: 762124 - DNA, 22 bp, Artificial Sequence
  chemically synthesized
ctggcccatgtctttctactct

SEQ ID NO: 762125 - DNA, 22 bp, Artificial Sequence
  chemically synthesized
gcccatgtctttctactctacc

SEQ ID NO: 762126 - DNA, 22 bp, Artificial Sequence
  chemically synthesized
gaaatatgtgagtatggtagag

SEQ ID NO: 762127 - DNA, 22 bp, Artificial Sequence
  chemically synthesized
aaactcgaaatatgtgagtatg

SEQ ID NO: 762128 - DNA, 22 bp, Artificial Sequence
  chemically synthesized
caaactcgaaatatgtgagtat

SEQ ID NO: 762129 - DNA, 22 bp, Artificial Sequence
  chemically synthesized
tctactctaccatactcacata

SEQ ID NO: 762130 - DNA, 22 bp, Artificial Sequence
  chemically synthesized
ctactctaccatactcacatat

SEQ ID NO: 762131 - DNA, 22 bp, Artificial Sequence
  chemically synthesized
tactctaccatactcacatatt

SEQ ID NO: 762132 - DNA, 22 bp, Artificial Sequence
  chemically synthesized
ctctaccatactcacatatttc

SEQ ID NO: 762133 - DNA, 22 bp, Artificial Sequence
  chemically synthesized
taccatactcacatatttcgag

SEQ ID NO: 762134 - DNA, 22 bp, Artificial Sequence
  chemically synthesized
ccatactcacatatttcgagtt

SEQ ID NO: 762135 - DNA, 22 bp, Artificial Sequence
  chemically synthesized
tatgaatacaaaaatttcaaac

SEQ ID NO: 762136 - DNA, 22 bp, Artificial Sequence
  chemically synthesized
acatatttcgagtttgaaattt

SEQ ID NO: 762137 - DNA, 22 bp, Artificial Sequence
  chemically synthesized
atatgaatacaaaaatttcaaa

SEQ ID NO: 762138 - DNA, 22 bp, Artificial Sequence
  chemically synthesized
acttatatgaatacaaaaattt

SEQ ID NO: 762139 - DNA, 22 bp, Artificial Sequence
  chemically synthesized
cgagtttgaaatttttgtattc

SEQ ID NO: 762140 - DNA, 22 bp, Artificial Sequence
  chemically synthesized
gagtttgaaatttttgtattca

SEQ ID NO: 762141 - DNA, 22 bp, Artificial Sequence
  chemically synthesized
cagctaacttatatgaatacaa

SEQ ID NO: 762142 - DNA, 22 bp, Artificial Sequence
  chemically synthesized
cctccagctaacttatatgaat

SEQ ID NO: 762143 - DNA, 22 bp, Artificial Sequence
  chemically synthesized
gaaatttttgtattcatataag

SEQ ID NO: 762144 - DNA, 22 bp, Artificial Sequence
  chemically synthesized
aaatttttgtattcatataagt

SEQ ID NO: 762145 - DNA, 22 bp, Artificial Sequence
  chemically synthesized
ctgcctccagctaacttatatg

SEQ ID NO: 762146 - DNA, 22 bp, Artificial Sequence
  chemically synthesized
actgcctccagctaacttatat

SEQ ID NO: 762147 - DNA, 22 bp, Artificial Sequence
  chemically synthesized
ttgtattcatataagttagctg

SEQ ID NO: 762148 - DNA, 22 bp, Artificial Sequence
  chemically synthesized
tgtattcatataagttagctgg

SEQ ID NO: 762149 - DNA, 22 bp, Artificial Sequence
  chemically synthesized
tgcttactgcctccagctaact

SEQ ID NO: 762150 - DNA, 22 bp, Artificial Sequence
  chemically synthesized
gtattcatataagttagctgga

SEQ ID NO: 762151 - DNA, 22 bp, Artificial Sequence
  chemically synthesized
tattcatataagttagctggag

SEQ ID NO: 762152 - DNA, 22 bp, Artificial Sequence
  chemically synthesized
atataagttagctggaggcagt

SEQ ID NO: 762153 - DNA, 22 bp, Artificial Sequence
  chemically synthesized
tagggctatgcttactgcctcc

SEQ ID NO: 762154 - DNA, 22 bp, Artificial Sequence
  chemically synthesized
atagggctatgcttactgcctc

SEQ ID NO: 762155 - DNA, 22 bp, Artificial Sequence
  chemically synthesized
tatagggctatgcttactgcct

SEQ ID NO: 762156 - DNA, 22 bp, Artificial Sequence
  chemically synthesized
ctttatagggctatgcttactg

SEQ ID NO: 762157 - DNA, 22 bp, Artificial Sequence
  chemically synthesized
gctggaggcagtaagcatagcc

SEQ ID NO: 762158 - DNA, 22 bp, Artificial Sequence
  chemically synthesized
gaggcagtaagcatagccctat

SEQ ID NO: 762159 - DNA, 22 bp, Artificial Sequence
  chemically synthesized
aagagttgctttatagggctat

SEQ ID NO: 762160 - DNA, 22 bp, Artificial Sequence
  chemically synthesized
aagtgttcaagagttgctttat

SEQ ID NO: 762161 - DNA, 22 bp, Artificial Sequence
  chemically synthesized
caagtgttcaagagttgcttta

SEQ ID NO: 762162 - DNA, 22 bp, Artificial Sequence
  chemically synthesized
ttcaagtgttcaagagttgctt

SEQ ID NO: 762163 - DNA, 22 bp, Artificial Sequence
  chemically synthesized
cttcaagtgttcaagagttgct

SEQ ID NO: 762164 - DNA, 22 bp, Artificial Sequence
  chemically synthesized
taaagcaactcttgaacacttg

SEQ ID NO: 762165 - DNA, 22 bp, Artificial Sequence
  chemically synthesized
ataacatgtttcttcaagtgtt

SEQ ID NO: 762166 - DNA, 22 bp, Artificial Sequence
  chemically synthesized
gataacatgtttcttcaagtgt

SEQ ID NO: 762167 - DNA, 22 bp, Artificial Sequence
  chemically synthesized
cacttgataacatgtttcttca

SEQ ID NO: 762168 - DNA, 22 bp, Artificial Sequence
  chemically synthesized
acacttgataacatgtttcttc

SEQ ID NO: 762169 - DNA, 22 bp, Artificial Sequence
  chemically synthesized
ttgaacacttgaagaaacatgt

SEQ ID NO: 762170 - DNA, 22 bp, Artificial Sequence
  chemically synthesized
gaacacttgaagaaacatgtta

SEQ ID NO: 762171 - DNA, 22 bp, Artificial Sequence
  chemically synthesized
atttacacttgataacatgttt

SEQ ID NO: 762172 - DNA, 22 bp, Artificial Sequence
  chemically synthesized
aacacttgaagaaacatgttat

SEQ ID NO: 762173 - DNA, 22 bp, Artificial Sequence
  chemically synthesized
taatttacacttgataacatgt

SEQ ID NO: 762174 - DNA, 22 bp, Artificial Sequence
  chemically synthesized
ttctaatttacacttgataaca

SEQ ID NO: 762175 - DNA, 22 bp, Artificial Sequence
  chemically synthesized
gaagaaacatgttatcaagtgt

SEQ ID NO: 762176 - DNA, 22 bp, Artificial Sequence
  chemically synthesized
aagaaacatgttatcaagtgta

SEQ ID NO: 762177 - DNA, 22 bp, Artificial Sequence
  chemically synthesized
ccaatactattctaatttacac

SEQ ID NO: 762178 - DNA, 22 bp, Artificial Sequence
  chemically synthesized
cccaatactattctaatttaca

SEQ ID NO: 762179 - DNA, 22 bp, Artificial Sequence
  chemically synthesized
ggtcttcccaatactattctaa

SEQ ID NO: 762180 - DNA, 22 bp, Artificial Sequence
  chemically synthesized
tcaagtgtaaattagaatagta

SEQ ID NO: 762181 - DNA, 22 bp, Artificial Sequence
  chemically synthesized
actaggtcttcccaatactatt

SEQ ID NO: 762182 - DNA, 22 bp, Artificial Sequence
  chemically synthesized
ctcactaggtcttcccaatact

SEQ ID NO: 762183 - DNA, 22 bp, Artificial Sequence
  chemically synthesized
cctcactaggtcttcccaatac

SEQ ID NO: 762184 - DNA, 22 bp, Artificial Sequence
  chemically synthesized
tttcctcactaggtcttcccaa

SEQ ID NO: 762185 - DNA, 22 bp, Artificial Sequence
  chemically synthesized
gaatagtattgggaagacctag

SEQ ID NO: 762186 - DNA, 22 bp, Artificial Sequence
  chemically synthesized
gctgtttcctcactaggtcttc

SEQ ID NO: 762187 - DNA, 22 bp, Artificial Sequence
  chemically synthesized
tggctgtttcctcactaggtct

SEQ ID NO: 762188 - DNA, 22 bp, Artificial Sequence
  chemically synthesized
ctggctgtttcctcactaggtc

SEQ ID NO: 762189 - DNA, 22 bp, Artificial Sequence
  chemically synthesized
tctggctgtttcctcactaggt

SEQ ID NO: 762190 - DNA, 22 bp, Artificial Sequence
  chemically synthesized
ttctggctgtttcctcactagg

SEQ ID NO: 762191 - DNA, 22 bp, Artificial Sequence
  chemically synthesized
ttttctggctgtttcctcacta

SEQ ID NO: 762192 - DNA, 22 bp, Artificial Sequence
  chemically synthesized
cttttctggctgtttcctcact

SEQ ID NO: 762193 - DNA, 22 bp, Artificial Sequence
  chemically synthesized
tcttttctggctgtttcctcac

SEQ ID NO: 762194 - DNA, 22 bp, Artificial Sequence
  chemically synthesized
ttcttttctggctgtttcctca

SEQ ID NO: 762195 - DNA, 22 bp, Artificial Sequence
  chemically synthesized
ggaagacctagtgaggaaacag

SEQ ID NO: 762196 - DNA, 22 bp, Artificial Sequence
  chemically synthesized
gtgaggaaacagccagaaaaga

SEQ ID NO: 762197 - DNA, 22 bp, Artificial Sequence
  chemically synthesized
cataacaaatcttttcttttct

SEQ ID NO: 762198 - DNA, 22 bp, Artificial Sequence
  chemically synthesized
atattccataacaaatcttttc

SEQ ID NO: 762199 - DNA, 22 bp, Artificial Sequence
  chemically synthesized
attcatattccataacaaatct

SEQ ID NO: 762200 - DNA, 22 bp, Artificial Sequence
  chemically synthesized
gattcatattccataacaaatc

SEQ ID NO: 762201 - DNA, 22 bp, Artificial Sequence
  chemically synthesized
tgattcatattccataacaaat

SEQ ID NO: 762202 - DNA, 22 bp, Artificial Sequence
  chemically synthesized
caaattttgattcatattccat

SEQ ID NO: 762203 - DNA, 22 bp, Artificial Sequence
  chemically synthesized
tccaaattttgattcatattcc

SEQ ID NO: 762204 - DNA, 22 bp, Artificial Sequence
  chemically synthesized
ttctccaaattttgattcatat

SEQ ID NO: 762205 - DNA, 22 bp, Artificial Sequence
  chemically synthesized
attctccaaattttgattcata

SEQ ID NO: 762206 - DNA, 22 bp, Artificial Sequence
  chemically synthesized
ttattctccaaattttgattca

SEQ ID NO: 762207 - DNA, 22 bp, Artificial Sequence
  chemically synthesized
gttatggaatatgaatcaaaat

SEQ ID NO: 762208 - DNA, 22 bp, Artificial Sequence
  chemically synthesized
ttatggaatatgaatcaaaatt

SEQ ID NO: 762209 - DNA, 22 bp, Artificial Sequence
  chemically synthesized
ctcttattctccaaattttgat

SEQ ID NO: 762210 - DNA, 22 bp, Artificial Sequence
  chemically synthesized
cctcttattctccaaattttga

SEQ ID NO: 762211 - DNA, 22 bp, Artificial Sequence
  chemically synthesized
tggaatatgaatcaaaatttgg

SEQ ID NO: 762212 - DNA, 22 bp, Artificial Sequence
  chemically synthesized
tcctcttattctccaaattttg

SEQ ID NO: 762213 - DNA, 22 bp, Artificial Sequence
  chemically synthesized
tttcctcttattctccaaattt

SEQ ID NO: 762214 - DNA, 22 bp, Artificial Sequence
  chemically synthesized
tctttcctcttattctccaaat

SEQ ID NO: 762215 - DNA, 22 bp, Artificial Sequence
  chemically synthesized
caacattctctttcctcttatt

SEQ ID NO: 762216 - DNA, 22 bp, Artificial Sequence
  chemically synthesized
gcaacattctctttcctcttat

SEQ ID NO: 762217 - DNA, 22 bp, Artificial Sequence
  chemically synthesized
acacttgcaacattctctttcc

SEQ ID NO: 762218 - DNA, 22 bp, Artificial Sequence
  chemically synthesized
ggagaataagaggaaagagaat

SEQ ID NO: 762219 - DNA, 22 bp, Artificial Sequence
  chemically synthesized
gagaataagaggaaagagaatg

SEQ ID NO: 762220 - DNA, 22 bp, Artificial Sequence
  chemically synthesized
tcacacttgcaacattctcttt

SEQ ID NO: 762221 - DNA, 22 bp, Artificial Sequence
  chemically synthesized
gttctcacacttgcaacattct

SEQ ID NO: 762222 - DNA, 22 bp, Artificial Sequence
  chemically synthesized
ctggttctcacacttgcaacat

SEQ ID NO: 762223 - DNA, 22 bp, Artificial Sequence
  chemically synthesized
gctggttctcacacttgcaaca

SEQ ID NO: 762224 - DNA, 22 bp, Artificial Sequence
  chemically synthesized
caagtgtgagaaccagcaaggg

SEQ ID NO: 762225 - DNA, 22 bp, Artificial Sequence
  chemically synthesized
ccatatgagtatgtacccttgc

SEQ ID NO: 762226 - DNA, 22 bp, Artificial Sequence
  chemically synthesized
tcccatatgagtatgtaccctt

SEQ ID NO: 762227 - DNA, 22 bp, Artificial Sequence
  chemically synthesized
actctcccatatgagtatgtac

SEQ ID NO: 762228 - DNA, 22 bp, Artificial Sequence
  chemically synthesized
ctcactctcccatatgagtatg

SEQ ID NO: 762229 - DNA, 22 bp, Artificial Sequence
  chemically synthesized
cctcactctcccatatgagtat

SEQ ID NO: 762230 - DNA, 22 bp, Artificial Sequence
  chemically synthesized
caacaatttcctcactctccca

SEQ ID NO: 762231 - DNA, 22 bp, Artificial Sequence
  chemically synthesized
tccaacaatttcctcactctcc

SEQ ID NO: 762232 - DNA, 22 bp, Artificial Sequence
  chemically synthesized
ctctccaacaatttcctcactc

SEQ ID NO: 762233 - DNA, 22 bp, Artificial Sequence
  chemically synthesized
ctactctccaacaatttcctca

SEQ ID NO: 762234 - DNA, 22 bp, Artificial Sequence
  chemically synthesized
atatgggagagtgaggaaattg

SEQ ID NO: 762235 - DNA, 22 bp, Artificial Sequence
  chemically synthesized
accccattcctactctccaaca

SEQ ID NO: 762236 - DNA, 22 bp, Artificial Sequence
  chemically synthesized
taaccccattcctactctccaa

SEQ ID NO: 762237 - DNA, 22 bp, Artificial Sequence
  chemically synthesized
ctaaccccattcctactctcca

SEQ ID NO: 762238 - DNA, 22 bp, Artificial Sequence
  chemically synthesized
tctaaccccattcctactctcc

SEQ ID NO: 762239 - DNA, 22 bp, Artificial Sequence
  chemically synthesized
ttttctaaccccattcctactc

SEQ ID NO: 762240 - DNA, 22 bp, Artificial Sequence
  chemically synthesized
tattttctaaccccattcctac

SEQ ID NO: 762241 - DNA, 22 bp, Artificial Sequence
  chemically synthesized
ttggagagtaggaatggggtta

SEQ ID NO: 762242 - DNA, 22 bp, Artificial Sequence
  chemically synthesized
gagagtaggaatggggttagaa

SEQ ID NO: 762243 - DNA, 22 bp, Artificial Sequence
  chemically synthesized
agccaagagaatcaataaattc

SEQ ID NO: 762244 - DNA, 22 bp, Artificial Sequence
  chemically synthesized
tgagccaagagaatcaataaat

SEQ ID NO: 762245 - DNA, 22 bp, Artificial Sequence
  chemically synthesized
tctgagccaagagaatcaataa

SEQ ID NO: 762246 - DNA, 22 bp, Artificial Sequence
  chemically synthesized
gaaaatagaatttattgattct

SEQ ID NO: 762247 - DNA, 22 bp, Artificial Sequence
  chemically synthesized
attgattctcttggctcagaga

SEQ ID NO: 762248 - DNA, 22 bp, Artificial Sequence
  chemically synthesized
cccaacatagattctctgagcc

SEQ ID NO: 762249 - DNA, 22 bp, Artificial Sequence
  chemically synthesized
ttgattctcttggctcagagaa

SEQ ID NO: 762250 - DNA, 22 bp, Artificial Sequence
  chemically synthesized
ctccccaacatagattctctga

SEQ ID NO: 762251 - DNA, 22 bp, Artificial Sequence
  chemically synthesized
attctcttggctcagagaatct

SEQ ID NO: 762252 - DNA, 22 bp, Artificial Sequence
  chemically synthesized
ttactccccaacatagattctc

SEQ ID NO: 762253 - DNA, 22 bp, Artificial Sequence
  chemically synthesized
tcttggctcagagaatctatgt

SEQ ID NO: 762254 - DNA, 22 bp, Artificial Sequence
  chemically synthesized
tgttactccccaacatagattc

SEQ ID NO: 762255 - DNA, 22 bp, Artificial Sequence
  chemically synthesized
ttggctcagagaatctatgttg

SEQ ID NO: 762256 - DNA, 22 bp, Artificial Sequence
  chemically synthesized
ggctcagagaatctatgttggg

SEQ ID NO: 762257 - DNA, 22 bp, Artificial Sequence
  chemically synthesized
gctcagagaatctatgttgggg

SEQ ID NO: 762258 - DNA, 22 bp, Artificial Sequence
  chemically synthesized
agagaatctatgttggggagta

SEQ ID NO: 762259 - DNA, 22 bp, Artificial Sequence
  chemically synthesized
accaagcatcattctgttactc

SEQ ID NO: 762260 - DNA, 22 bp, Artificial Sequence
  chemically synthesized
tcaccaagcatcattctgttac

SEQ ID NO: 762261 - DNA, 22 bp, Artificial Sequence
  chemically synthesized
ctcaccaagcatcattctgtta

SEQ ID NO: 762262 - DNA, 22 bp, Artificial Sequence
  chemically synthesized
tctcaccaagcatcattctgtt

SEQ ID NO: 762263 - DNA, 22 bp, Artificial Sequence
  chemically synthesized
tgttggggagtaacagaatgat

SEQ ID NO: 762264 - DNA, 22 bp, Artificial Sequence
  chemically synthesized
ctttctcaccaagcatcattct

SEQ ID NO: 762265 - DNA, 22 bp, Artificial Sequence
  chemically synthesized
gggagtaacagaatgatgcttg

SEQ ID NO: 762266 - DNA, 22 bp, Artificial Sequence
  chemically synthesized
cagttcctttctcaccaagcat

SEQ ID NO: 762267 - DNA, 22 bp, Artificial Sequence
  chemically synthesized
cctccagttcctttctcaccaa

SEQ ID NO: 762268 - DNA, 22 bp, Artificial Sequence
  chemically synthesized
tgcctccagttcctttctcacc

SEQ ID NO: 762269 - DNA, 22 bp, Artificial Sequence
  chemically synthesized
ctgcctccagttcctttctcac

SEQ ID NO: 762270 - DNA, 22 bp, Artificial Sequence
  chemically synthesized
tctgcctccagttcctttctca

SEQ ID NO: 762271 - DNA, 22 bp, Artificial Sequence
  chemically synthesized
ttctgcctccagttcctttctc

SEQ ID NO: 762272 - DNA, 22 bp, Artificial Sequence
  chemically synthesized
tttctgcctccagttcctttct

SEQ ID NO: 762273 - DNA, 22 bp, Artificial Sequence
  chemically synthesized
tttttctgcctccagttccttt

SEQ ID NO: 762274 - DNA, 22 bp, Artificial Sequence
  chemically synthesized
ctttttctgcctccagttcctt

SEQ ID NO: 762275 - DNA, 22 bp, Artificial Sequence
  chemically synthesized
tctttttctgcctccagttcct

SEQ ID NO: 762276 - DNA, 22 bp, Artificial Sequence
  chemically synthesized
ttctttttctgcctccagttcc

SEQ ID NO: 762277 - DNA, 22 bp, Artificial Sequence
  chemically synthesized
ttttctttttctgcctccagtt

SEQ ID NO: 762278 - DNA, 22 bp, Artificial Sequence
  chemically synthesized
ggtgagaaaggaactggaggca

SEQ ID NO: 762279 - DNA, 22 bp, Artificial Sequence
  chemically synthesized
gtgagaaaggaactggaggcag

SEQ ID NO: 762280 - DNA, 22 bp, Artificial Sequence
  chemically synthesized
tcttttctttttctgcctccag

SEQ ID NO: 762281 - DNA, 22 bp, Artificial Sequence
  chemically synthesized
ctcttttctttttctgcctcca

SEQ ID NO: 762282 - DNA, 22 bp, Artificial Sequence
  chemically synthesized
ccttctcttttctttttctgcc

SEQ ID NO: 762283 - DNA, 22 bp, Artificial Sequence
  chemically synthesized
cccttctcttttctttttctgc

SEQ ID NO: 762284 - DNA, 22 bp, Artificial Sequence
  chemically synthesized
cttcccttctcttttctttttc

SEQ ID NO: 762285 - DNA, 22 bp, Artificial Sequence
  chemically synthesized
actccttcccttctcttttctt

SEQ ID NO: 762286 - DNA, 22 bp, Artificial Sequence
  chemically synthesized
gaggcagaaaaagaaaagagaa

SEQ ID NO: 762287 - DNA, 22 bp, Artificial Sequence
  chemically synthesized
ctaactccttcccttctctttt

SEQ ID NO: 762288 - DNA, 22 bp, Artificial Sequence
  chemically synthesized
gctaactccttcccttctcttt

SEQ ID NO: 762289 - DNA, 22 bp, Artificial Sequence
  chemically synthesized
ataagtccttgctaactccttc

SEQ ID NO: 762290 - DNA, 22 bp, Artificial Sequence
  chemically synthesized
tgcctaataagtccttgctaac

SEQ ID NO: 762291 - DNA, 22 bp, Artificial Sequence
  chemically synthesized
ccaactgtgcctaataagtcct

SEQ ID NO: 762292 - DNA, 22 bp, Artificial Sequence
  chemically synthesized
tgccaactgtgcctaataagtc

SEQ ID NO: 762293 - DNA, 22 bp, Artificial Sequence
  chemically synthesized
tctgccaactgtgcctaataag

SEQ ID NO: 762294 - DNA, 22 bp, Artificial Sequence
  chemically synthesized
tctctgccaactgtgcctaata

SEQ ID NO: 762295 - DNA, 22 bp, Artificial Sequence
  chemically synthesized
tctctctgccaactgtgcctaa

SEQ ID NO: 762296 - DNA, 22 bp, Artificial Sequence
  chemically synthesized
gcaaggacttattaggcacagt

SEQ ID NO: 762297 - DNA, 22 bp, Artificial Sequence
  chemically synthesized
ctctctctgccaactgtgccta

SEQ ID NO: 762298 - DNA, 22 bp, Artificial Sequence
  chemically synthesized
attaggcacagttggcagagag

SEQ ID NO: 762299 - DNA, 22 bp, Artificial Sequence
  chemically synthesized
gtagaaccttctctctctgcca

SEQ ID NO: 762300 - DNA, 22 bp, Artificial Sequence
  chemically synthesized
ttaggcacagttggcagagaga

SEQ ID NO: 762301 - DNA, 22 bp, Artificial Sequence
  chemically synthesized
ggcacagttggcagagagagaa

SEQ ID NO: 762302 - DNA, 22 bp, Artificial Sequence
  chemically synthesized
gaatctagtagaaccttctctc

SEQ ID NO: 762303 - DNA, 22 bp, Artificial Sequence
  chemically synthesized
gcagagagagaaggttctacta

SEQ ID NO: 762304 - DNA, 22 bp, Artificial Sequence
  chemically synthesized
atcattagaatctagtagaacc

SEQ ID NO: 762305 - DNA, 22 bp, Artificial Sequence
  chemically synthesized
aatcattagaatctagtagaac

SEQ ID NO: 762306 - DNA, 22 bp, Artificial Sequence
  chemically synthesized
tatttaatcattagaatctagt

SEQ ID NO: 762307 - DNA, 22 bp, Artificial Sequence
  chemically synthesized
atgaagttatatttaatcatta

SEQ ID NO: 762308 - DNA, 22 bp, Artificial Sequence
  chemically synthesized
tactagattctaatgattaaat

SEQ ID NO: 762309 - DNA, 22 bp, Artificial Sequence
  chemically synthesized
taatgaagttatatttaatcat

SEQ ID NO: 762310 - DNA, 22 bp, Artificial Sequence
  chemically synthesized
ctagattctaatgattaaatat

SEQ ID NO: 762311 - DNA, 22 bp, Artificial Sequence
  chemically synthesized
ctctaatgaagttatatttaat

SEQ ID NO: 762312 - DNA, 22 bp, Artificial Sequence
  chemically synthesized
gattctaatgattaaatataac

SEQ ID NO: 762313 - DNA, 22 bp, Artificial Sequence
  chemically synthesized
taatgattaaatataacttcat

SEQ ID NO: 762314 - DNA, 22 bp, Artificial Sequence
  chemically synthesized
atgattaaatataacttcatta

SEQ ID NO: 762315 - DNA, 22 bp, Artificial Sequence
  chemically synthesized
aatataacttcattagagcagt

SEQ ID NO: 762316 - DNA, 22 bp, Artificial Sequence
  chemically synthesized
cattagagcagtgatttttttt

SEQ ID NO: 762317 - DNA, 22 bp, Artificial Sequence
  chemically synthesized
attagagcagtgattttttttg

SEQ ID NO: 762318 - DNA, 22 bp, Artificial Sequence
  chemically synthesized
gagcagtgattttttttggtat

SEQ ID NO: 762319 - DNA, 22 bp, Artificial Sequence
  chemically synthesized
tttttggtatgttttattcatg

SEQ ID NO: 762320 - DNA, 22 bp, Artificial Sequence
  chemically synthesized
ttttggtatgttttattcatgg

SEQ ID NO: 762321 - DNA, 22 bp, Artificial Sequence
  chemically synthesized
tttggtatgttttattcatggt

SEQ ID NO: 762322 - DNA, 22 bp, Artificial Sequence
  chemically synthesized
ttggtatgttttattcatggtt

SEQ ID NO: 762323 - DNA, 22 bp, Artificial Sequence
  chemically synthesized
tggtatgttttattcatggttg

SEQ ID NO: 762324 - DNA, 22 bp, Artificial Sequence
  chemically synthesized
ggtatgttttattcatggttgc

SEQ ID NO: 762325 - DNA, 22 bp, Artificial Sequence
  chemically synthesized
ggcacggaggatgcaaccatga

SEQ ID NO: 762326 - DNA, 22 bp, Artificial Sequence
  chemically synthesized
gtatgttttattcatggttgca

SEQ ID NO: 762327 - DNA, 22 bp, Artificial Sequence
  chemically synthesized
tgggcacggaggatgcaaccat

SEQ ID NO: 762328 - DNA, 22 bp, Artificial Sequence
  chemically synthesized
ctgggcacggaggatgcaacca

SEQ ID NO: 762329 - DNA, 22 bp, Artificial Sequence
  chemically synthesized
ttctgggcacggaggatgcaac

SEQ ID NO: 762330 - DNA, 22 bp, Artificial Sequence
  chemically synthesized
tattcatggttgcatcctccgt

SEQ ID NO: 762331 - DNA, 22 bp, Artificial Sequence
  chemically synthesized
attcatggttgcatcctccgtg

SEQ ID NO: 762332 - DNA, 22 bp, Artificial Sequence
  chemically synthesized
ttcatggttgcatcctccgtgc

SEQ ID NO: 762333 - DNA, 22 bp, Artificial Sequence
  chemically synthesized
ggcactcttctgggcacggagg

SEQ ID NO: 762334 - DNA, 22 bp, Artificial Sequence
  chemically synthesized
atggttgcatcctccgtgccca

SEQ ID NO: 762335 - DNA, 22 bp, Artificial Sequence
  chemically synthesized
tgtactaggcactcttctgggc

SEQ ID NO: 762336 - DNA, 22 bp, Artificial Sequence
  chemically synthesized
catcctccgtgcccagaagagt

SEQ ID NO: 762337 - DNA, 22 bp, Artificial Sequence
  chemically synthesized
ctatgtactaggcactcttctg

SEQ ID NO: 762338 - DNA, 22 bp, Artificial Sequence
  chemically synthesized
cgtgcccagaagagtgcctagt

SEQ ID NO: 762339 - DNA, 22 bp, Artificial Sequence
  chemically synthesized
atgaatgcctactatgtactag

SEQ ID NO: 762340 - DNA, 22 bp, Artificial Sequence
  chemically synthesized
aatgaatgcctactatgtacta

SEQ ID NO: 762341 - DNA, 22 bp, Artificial Sequence
  chemically synthesized
aacaaatatttaatgaatgcct

SEQ ID NO: 762342 - DNA, 22 bp, Artificial Sequence
  chemically synthesized
gtacatagtaggcattcattaa

SEQ ID NO: 762343 - DNA, 22 bp, Artificial Sequence
  chemically synthesized
attcaacaaatatttaatgaat

SEQ ID NO: 762344 - DNA, 22 bp, Artificial Sequence
  chemically synthesized
ttcattcaacaaatatttaatg

SEQ ID NO: 762345 - DNA, 22 bp, Artificial Sequence
  chemically synthesized
gttcattcaacaaatatttaat

SEQ ID NO: 762346 - DNA, 22 bp, Artificial Sequence
  chemically synthesized
tttgttcattcaacaaatattt

SEQ ID NO: 762347 - DNA, 22 bp, Artificial Sequence
  chemically synthesized
atttgttcattcaacaaatatt

SEQ ID NO: 762348 - DNA, 22 bp, Artificial Sequence
  chemically synthesized
atttatttgttcattcaacaaa

SEQ ID NO: 762349 - DNA, 22 bp, Artificial Sequence
  chemically synthesized
attaaatatttgttgaatgaac

SEQ ID NO: 762350 - DNA, 22 bp, Artificial Sequence
  chemically synthesized
attcatttatttgttcattcaa

SEQ ID NO: 762351 - DNA, 22 bp, Artificial Sequence
  chemically synthesized
aatatttgttgaatgaacaaat

SEQ ID NO: 762352 - DNA, 22 bp, Artificial Sequence
  chemically synthesized
cctcattcatttatttgttcat

SEQ ID NO: 762353 - DNA, 22 bp, Artificial Sequence
  chemically synthesized
gttgaatgaacaaataaatgaa

SEQ ID NO: 762354 - DNA, 22 bp, Artificial Sequence
  chemically synthesized
ttgaatgaacaaataaatgaat

SEQ ID NO: 762355 - DNA, 22 bp, Artificial Sequence
  chemically synthesized
catatctccctcattcatttat

SEQ ID NO: 762356 - DNA, 22 bp, Artificial Sequence
  chemically synthesized
aatgaacaaataaatgaatgag

SEQ ID NO: 762357 - DNA, 22 bp, Artificial Sequence
  chemically synthesized
taggtctccatatctccctcat

SEQ ID NO: 762358 - DNA, 22 bp, Artificial Sequence
  chemically synthesized
gtaggtctccatatctccctca

SEQ ID NO: 762359 - DNA, 22 bp, Artificial Sequence
  chemically synthesized
aatcttgtaggtctccatatct

SEQ ID NO: 762360 - DNA, 22 bp, Artificial Sequence
  chemically synthesized
caatcttgtaggtctccatatc

SEQ ID NO: 762361 - DNA, 22 bp, Artificial Sequence
  chemically synthesized
aaagcttcaatcttgtaggtct

SEQ ID NO: 762362 - DNA, 22 bp, Artificial Sequence
  chemically synthesized
ttcaaagcttcaatcttgtagg

SEQ ID NO: 762363 - DNA, 22 bp, Artificial Sequence
  chemically synthesized
gttcaaagcttcaatcttgtag

SEQ ID NO: 762364 - DNA, 22 bp, Artificial Sequence
  chemically synthesized
tgttcaaagcttcaatcttgta

SEQ ID NO: 762365 - DNA, 22 bp, Artificial Sequence
  chemically synthesized
ttgttcaaagcttcaatcttgt

SEQ ID NO: 762366 - DNA, 22 bp, Artificial Sequence
  chemically synthesized
ttttgttcaaagcttcaatctt

SEQ ID NO: 762367 - DNA, 22 bp, Artificial Sequence
  chemically synthesized
ctcttttgttcaaagcttcaat

SEQ ID NO: 762368 - DNA, 22 bp, Artificial Sequence
  chemically synthesized
caagattgaagctttgaacaaa

SEQ ID NO: 762369 - DNA, 22 bp, Artificial Sequence
  chemically synthesized
tatcatattactcttttgttca

SEQ ID NO: 762370 - DNA, 22 bp, Artificial Sequence
  chemically synthesized
atatcatattactcttttgttc

SEQ ID NO: 762371 - DNA, 22 bp, Artificial Sequence
  chemically synthesized
tttatatcatattactcttttg

SEQ ID NO: 762372 - DNA, 22 bp, Artificial Sequence
  chemically synthesized
aagctttgaacaaaagagtaat

SEQ ID NO: 762373 - DNA, 22 bp, Artificial Sequence
  chemically synthesized
gacgctgtttatatcatattac

SEQ ID NO: 762374 - DNA, 22 bp, Artificial Sequence
  chemically synthesized
tgaacaaaagagtaatatgata

SEQ ID NO: 762375 - DNA, 22 bp, Artificial Sequence
  chemically synthesized
ggacgctgtttatatcatatta

SEQ ID NO: 762376 - DNA, 22 bp, Artificial Sequence
  chemically synthesized
gaacaaaagagtaatatgatat

SEQ ID NO: 762377 - DNA, 22 bp, Artificial Sequence
  chemically synthesized
aacaaaagagtaatatgatata

SEQ ID NO: 762378 - DNA, 22 bp, Artificial Sequence
  chemically synthesized
ccttggacgctgtttatatcat

SEQ ID NO: 762379 - DNA, 22 bp, Artificial Sequence
  chemically synthesized
taccttggacgctgtttatatc

SEQ ID NO: 762380 - DNA, 22 bp, Artificial Sequence
  chemically synthesized
caagaatactctaccttggacg

SEQ ID NO: 762381 - DNA, 22 bp, Artificial Sequence
  chemically synthesized
gcaagaatactctaccttggac

SEQ ID NO: 762382 - DNA, 22 bp, Artificial Sequence
  chemically synthesized
atacatttgcaagaatactcta

SEQ ID NO: 762383 - DNA, 22 bp, Artificial Sequence
  chemically synthesized
tgccatattgatacatttgcaa

SEQ ID NO: 762384 - DNA, 22 bp, Artificial Sequence
  chemically synthesized
ttgcaaatgtatcaatatggca

SEQ ID NO: 762385 - DNA, 22 bp, Artificial Sequence
  chemically synthesized
agtcatcatgttatgccatatt

SEQ ID NO: 762386 - DNA, 22 bp, Artificial Sequence
  chemically synthesized
gcaaatgtatcaatatggcata

SEQ ID NO: 762387 - DNA, 22 bp, Artificial Sequence
  chemically synthesized
aagtcatcatgttatgccatat

SEQ ID NO: 762388 - DNA, 22 bp, Artificial Sequence
  chemically synthesized
caaatgtatcaatatggcataa

SEQ ID NO: 762389 - DNA, 22 bp, Artificial Sequence
  chemically synthesized
tttaagtcatcatgttatgcca

SEQ ID NO: 762390 - DNA, 22 bp, Artificial Sequence
  chemically synthesized
atttaagtcatcatgttatgcc

SEQ ID NO: 762391 - DNA, 22 bp, Artificial Sequence
  chemically synthesized
ttatttaagtcatcatgttatg

SEQ ID NO: 762392 - DNA, 22 bp, Artificial Sequence
  chemically synthesized
agattcttatttaagtcatcat

SEQ ID NO: 762393 - DNA, 22 bp, Artificial Sequence
  chemically synthesized
tgattaagattcttatttaagt

SEQ ID NO: 762394 - DNA, 22 bp, Artificial Sequence
  chemically synthesized
ctgtgattaagattcttattta

SEQ ID NO: 762395 - DNA, 22 bp, Artificial Sequence
  chemically synthesized
cctgtgattaagattcttattt

SEQ ID NO: 762396 - DNA, 22 bp, Artificial Sequence
  chemically synthesized
ttcctgtgattaagattcttat

SEQ ID NO: 762397 - DNA, 22 bp, Artificial Sequence
  chemically synthesized
tcttcctgtgattaagattctt

SEQ ID NO: 762398 - DNA, 22 bp, Artificial Sequence
  chemically synthesized
ctcttcctgtgattaagattct

SEQ ID NO: 762399 - DNA, 22 bp, Artificial Sequence
  chemically synthesized
tctcttcctgtgattaagattc

SEQ ID NO: 762400 - DNA, 22 bp, Artificial Sequence
  chemically synthesized
ttctcttcctgtgattaagatt

SEQ ID NO: 762401 - DNA, 22 bp, Artificial Sequence
  chemically synthesized
aaataagaatcttaatcacagg

SEQ ID NO: 762402 - DNA, 22 bp, Artificial Sequence
  chemically synthesized
aataagaatcttaatcacagga

SEQ ID NO: 762403 - DNA, 22 bp, Artificial Sequence
  chemically synthesized
ccatacatcttttctcttcctg

SEQ ID NO: 762404 - DNA, 22 bp, Artificial Sequence
  chemically synthesized
tgccatacatcttttctcttcc

SEQ ID NO: 762405 - DNA, 22 bp, Artificial Sequence
  chemically synthesized
ctgccatacatcttttctcttc

SEQ ID NO: 762406 - DNA, 22 bp, Artificial Sequence
  chemically synthesized
ttctgccatacatcttttctct

SEQ ID NO: 762407 - DNA, 22 bp, Artificial Sequence
  chemically synthesized
cttctgccatacatcttttctc

SEQ ID NO: 762408 - DNA, 22 bp, Artificial Sequence
  chemically synthesized
aatcacaggaagagaaaagatg

SEQ ID NO: 762409 - DNA, 22 bp, Artificial Sequence
  chemically synthesized
tcttctgccatacatcttttct

SEQ ID NO: 762410 - DNA, 22 bp, Artificial Sequence
  chemically synthesized
atcacaggaagagaaaagatgt

SEQ ID NO: 762411 - DNA, 22 bp, Artificial Sequence
  chemically synthesized
ttcttctgccatacatcttttc

SEQ ID NO: 762412 - DNA, 22 bp, Artificial Sequence
  chemically synthesized
tttttcttctgccatacatctt

SEQ ID NO: 762413 - DNA, 22 bp, Artificial Sequence
  chemically synthesized
atttttcttctgccatacatct

SEQ ID NO: 762414 - DNA, 22 bp, Artificial Sequence
  chemically synthesized
catttatttttcttctgccata

SEQ ID NO: 762415 - DNA, 22 bp, Artificial Sequence
  chemically synthesized
ccatttatttttcttctgccat

SEQ ID NO: 762416 - DNA, 22 bp, Artificial Sequence
  chemically synthesized
cttccatttatttttcttctgc

SEQ ID NO: 762417 - DNA, 22 bp, Artificial Sequence
  chemically synthesized
ccttccatttatttttcttctg

SEQ ID NO: 762418 - DNA, 22 bp, Artificial Sequence
  chemically synthesized
tccttccatttatttttcttct

SEQ ID NO: 762419 - DNA, 22 bp, Artificial Sequence
  chemically synthesized
tatcgttttccttccatttatt

SEQ ID NO: 762420 - DNA, 22 bp, Artificial Sequence
  chemically synthesized
caaatacaagtccatattgtat

SEQ ID NO: 762421 - DNA, 22 bp, Artificial Sequence
  chemically synthesized
ccaaatacaagtccatattgta

SEQ ID NO: 762422 - DNA, 22 bp, Artificial Sequence
  chemically synthesized
tgcttccaaatacaagtccata

SEQ ID NO: 762423 - DNA, 22 bp, Artificial Sequence
  chemically synthesized
gtgcttccaaatacaagtccat

SEQ ID NO: 762424 - DNA, 22 bp, Artificial Sequence
  chemically synthesized
ataagagatatccttgtgcttc

SEQ ID NO: 762425 - DNA, 22 bp, Artificial Sequence
  chemically synthesized
gctcataagagatatccttgtg

SEQ ID NO: 762426 - DNA, 22 bp, Artificial Sequence
  chemically synthesized
gtatttggaagcacaaggatat

SEQ ID NO: 762427 - DNA, 22 bp, Artificial Sequence
  chemically synthesized
tatttggaagcacaaggatatc

SEQ ID NO: 762428 - DNA, 22 bp, Artificial Sequence
  chemically synthesized
cattggctcataagagatatcc

SEQ ID NO: 762429 - DNA, 22 bp, Artificial Sequence
  chemically synthesized
ggaagcacaaggatatctctta

SEQ ID NO: 762430 - DNA, 22 bp, Artificial Sequence
  chemically synthesized
gaagcacaaggatatctcttat

SEQ ID NO: 762431 - DNA, 22 bp, Artificial Sequence
  chemically synthesized
tattccattggctcataagaga

SEQ ID NO: 762432 - DNA, 22 bp, Artificial Sequence
  chemically synthesized
gtattccattggctcataagag

SEQ ID NO: 762433 - DNA, 22 bp, Artificial Sequence
  chemically synthesized
tgtattccattggctcataaga

SEQ ID NO: 762434 - DNA, 22 bp, Artificial Sequence
  chemically synthesized
cctttgtattccattggctcat

SEQ ID NO: 762435 - DNA, 22 bp, Artificial Sequence
  chemically synthesized
ccctttgtattccattggctca

SEQ ID NO: 762436 - DNA, 22 bp, Artificial Sequence
  chemically synthesized
gaagtttccctttgtattccat

SEQ ID NO: 762437 - DNA, 22 bp, Artificial Sequence
  chemically synthesized
cgaagtttccctttgtattcca

SEQ ID NO: 762438 - DNA, 22 bp, Artificial Sequence
  chemically synthesized
ttatgagccaatggaatacaaa

SEQ ID NO: 762439 - DNA, 22 bp, Artificial Sequence
  chemically synthesized
atgagccaatggaatacaaagg

SEQ ID NO: 762440 - DNA, 22 bp, Artificial Sequence
  chemically synthesized
tgagccaatggaatacaaaggg

SEQ ID NO: 762441 - DNA, 22 bp, Artificial Sequence
  chemically synthesized
aatccaaatgatttcgaagttt

SEQ ID NO: 762442 - DNA, 22 bp, Artificial Sequence
  chemically synthesized
aaatccaaatgatttcgaagtt

SEQ ID NO: 762443 - DNA, 22 bp, Artificial Sequence
  chemically synthesized
aatttaaatccaaatgatttcg

SEQ ID NO: 762444 - DNA, 22 bp, Artificial Sequence
  chemically synthesized
cgaaatcatttggatttaaatt

SEQ ID NO: 762445 - DNA, 22 bp, Artificial Sequence
  chemically synthesized
gaaatcatttggatttaaattc

SEQ ID NO: 762446 - DNA, 22 bp, Artificial Sequence
  chemically synthesized
aagaaacaaaattgaatttaaa

SEQ ID NO: 762447 - DNA, 22 bp, Artificial Sequence
  chemically synthesized
aaagaaacaaaattgaatttaa

SEQ ID NO: 762448 - DNA, 22 bp, Artificial Sequence
  chemically synthesized
taaagaaacaaaattgaattta

SEQ ID NO: 762449 - DNA, 22 bp, Artificial Sequence
  chemically synthesized
ttaaagaaacaaaattgaattt

SEQ ID NO: 762450 - DNA, 22 bp, Artificial Sequence
  chemically synthesized
ggatttaaattcaattttgttt

SEQ ID NO: 762451 - DNA, 22 bp, Artificial Sequence
  chemically synthesized
gatttaaattcaattttgtttc

SEQ ID NO: 762452 - DNA, 22 bp, Artificial Sequence
  chemically synthesized
aaattcaattttgtttctttaa

SEQ ID NO: 762453 - DNA, 22 bp, Artificial Sequence
  chemically synthesized
atgtgtccatttttaaagaaac

SEQ ID NO: 762454 - DNA, 22 bp, Artificial Sequence
  chemically synthesized
aattcaattttgtttctttaaa

SEQ ID NO: 762455 - DNA, 22 bp, Artificial Sequence
  chemically synthesized
aattttgtttctttaaaaatgg

SEQ ID NO: 762456 - DNA, 22 bp, Artificial Sequence
  chemically synthesized
tgtttctttaaaaatggacaca

SEQ ID NO: 762457 - DNA, 22 bp, Artificial Sequence
  chemically synthesized
gtttctttaaaaatggacacat

SEQ ID NO: 762458 - DNA, 22 bp, Artificial Sequence
  chemically synthesized
tttctttaaaaatggacacatt

SEQ ID NO: 762459 - DNA, 22 bp, Artificial Sequence
  chemically synthesized
ctttaaaaatggacacattaat

SEQ ID NO: 762460 - DNA, 22 bp, Artificial Sequence
  chemically synthesized
tttaaaaatggacacattaatg

SEQ ID NO: 762461 - DNA, 22 bp, Artificial Sequence
  chemically synthesized
aaaaaaataaaaccattaatgt

SEQ ID NO: 762462 - DNA, 22 bp, Artificial Sequence
  chemically synthesized
taaaaatggacacattaatggt

SEQ ID NO: 762463 - DNA, 22 bp, Artificial Sequence
  chemically synthesized
caaaaaaataaaaccattaatg

SEQ ID NO: 762464 - DNA, 22 bp, Artificial Sequence
  chemically synthesized
aaaaatggacacattaatggtt

SEQ ID NO: 762465 - DNA, 22 bp, Artificial Sequence
  chemically synthesized
aaaatggacacattaatggttt

SEQ ID NO: 762466 - DNA, 22 bp, Artificial Sequence
  chemically synthesized
tatttcaaaaaaataaaaccat

SEQ ID NO: 762467 - DNA, 22 bp, Artificial Sequence
  chemically synthesized
atatttcaaaaaaataaaacca

SEQ ID NO: 762468 - DNA, 22 bp, Artificial Sequence
  chemically synthesized
ttatatttcaaaaaaataaaac

SEQ ID NO: 762469 - DNA, 22 bp, Artificial Sequence
  chemically synthesized
ctcttatatttcaaaaaaataa

SEQ ID NO: 762470 - DNA, 22 bp, Artificial Sequence
  chemically synthesized
atggttttatttttttgaaata

SEQ ID NO: 762471 - DNA, 22 bp, Artificial Sequence
  chemically synthesized
aaactgctcttatatttcaaaa

SEQ ID NO: 762472 - DNA, 22 bp, Artificial Sequence
  chemically synthesized
tgaaactgctcttatatttcaa

SEQ ID NO: 762473 - DNA, 22 bp, Artificial Sequence
  chemically synthesized
tatttttttgaaatataagagc

SEQ ID NO: 762474 - DNA, 22 bp, Artificial Sequence
  chemically synthesized
atttttttgaaatataagagca

SEQ ID NO: 762475 - DNA, 22 bp, Artificial Sequence
  chemically synthesized
tttttttgaaatataagagcag

SEQ ID NO: 762476 - DNA, 22 bp, Artificial Sequence
  chemically synthesized
ttttgaaatataagagcagttt

SEQ ID NO: 762477 - DNA, 22 bp, Artificial Sequence
  chemically synthesized
tttgaaatataagagcagtttc

SEQ ID NO: 762478 - DNA, 22 bp, Artificial Sequence
  chemically synthesized
gtgagcgattctgaaactgctc

SEQ ID NO: 762479 - DNA, 22 bp, Artificial Sequence
  chemically synthesized
ttgaaatataagagcagtttca

SEQ ID NO: 762480 - DNA, 22 bp, Artificial Sequence
  chemically synthesized
ggtgagcgattctgaaactgct

SEQ ID NO: 762481 - DNA, 22 bp, Artificial Sequence
  chemically synthesized
tgaaatataagagcagtttcag

SEQ ID NO: 762482 - DNA, 22 bp, Artificial Sequence
  chemically synthesized
gaaatataagagcagtttcaga

SEQ ID NO: 762483 - DNA, 22 bp, Artificial Sequence
  chemically synthesized
aaatataagagcagtttcagaa

SEQ ID NO: 762484 - DNA, 22 bp, Artificial Sequence
  chemically synthesized
tttggtgagcgattctgaaact

SEQ ID NO: 762485 - DNA, 22 bp, Artificial Sequence
  chemically synthesized
gcccattgtttggtgagcgatt

SEQ ID NO: 762486 - DNA, 22 bp, Artificial Sequence
  chemically synthesized
cagttggcccattgtttggtga

SEQ ID NO: 762487 - DNA, 22 bp, Artificial Sequence
  chemically synthesized
cagaatcgctcaccaaacaatg

SEQ ID NO: 762488 - DNA, 22 bp, Artificial Sequence
  chemically synthesized
agaatcgctcaccaaacaatgg

SEQ ID NO: 762489 - DNA, 22 bp, Artificial Sequence
  chemically synthesized
taaaaaattacagttggcccat

SEQ ID NO: 762490 - DNA, 22 bp, Artificial Sequence
  chemically synthesized
accaaacaatgggccaactgta

SEQ ID NO: 762491 - DNA, 22 bp, Artificial Sequence
  chemically synthesized
taacatattataaaaaattaca

SEQ ID NO: 762492 - DNA, 22 bp, Artificial Sequence
  chemically synthesized
cccaagttataacatattataa

SEQ ID NO: 762493 - DNA, 22 bp, Artificial Sequence
  chemically synthesized
gcccaagttataacatattata

SEQ ID NO: 762494 - DNA, 22 bp, Artificial Sequence
  chemically synthesized
taattttttataatatgttata

SEQ ID NO: 762495 - DNA, 22 bp, Artificial Sequence
  chemically synthesized
tgtttgcccaagttataacata

SEQ ID NO: 762496 - DNA, 22 bp, Artificial Sequence
  chemically synthesized
tttataatatgttataacttgg

SEQ ID NO: 762497 - DNA, 22 bp, Artificial Sequence
  chemically synthesized
ttataatatgttataacttggg

SEQ ID NO: 762498 - DNA, 22 bp, Artificial Sequence
  chemically synthesized
tataatatgttataacttgggc

SEQ ID NO: 762499 - DNA, 22 bp, Artificial Sequence
  chemically synthesized
ataatatgttataacttgggca

SEQ ID NO: 762500 - DNA, 22 bp, Artificial Sequence
  chemically synthesized
taatatgttataacttgggcaa

SEQ ID NO: 762501 - DNA, 22 bp, Artificial Sequence
  chemically synthesized
gaaaaataggcctgtgtttgcc

SEQ ID NO: 762502 - DNA, 22 bp, Artificial Sequence
  chemically synthesized
taacttgggcaaacacaggcct

SEQ ID NO: 762503 - DNA, 22 bp, Artificial Sequence
  chemically synthesized
gggcaaacacaggcctattttt

SEQ ID NO: 762504 - DNA, 22 bp, Artificial Sequence
  chemically synthesized
ggcaaacacaggcctatttttc

SEQ ID NO: 762505 - DNA, 22 bp, Artificial Sequence
  chemically synthesized
aatgatatactggaaaaatagg

SEQ ID NO: 762506 - DNA, 22 bp, Artificial Sequence
  chemically synthesized
caatgatatactggaaaaatag

SEQ ID NO: 762507 - DNA, 22 bp, Artificial Sequence
  chemically synthesized
aaaaatagtttcaatgatatac

SEQ ID NO: 762508 - DNA, 22 bp, Artificial Sequence
  chemically synthesized
tttttccagtatatcattgaaa

SEQ ID NO: 762509 - DNA, 22 bp, Artificial Sequence
  chemically synthesized
ttccagtatatcattgaaacta

SEQ ID NO: 762510 - DNA, 22 bp, Artificial Sequence
  chemically synthesized
tccagtatatcattgaaactat

SEQ ID NO: 762511 - DNA, 22 bp, Artificial Sequence
  chemically synthesized
ccagtatatcattgaaactatt

SEQ ID NO: 762512 - DNA, 22 bp, Artificial Sequence
  chemically synthesized
ccacaattaaaaaatagtttca

SEQ ID NO: 762513 - DNA, 22 bp, Artificial Sequence
  chemically synthesized
cagtatatcattgaaactattt

SEQ ID NO: 762514 - DNA, 22 bp, Artificial Sequence
  chemically synthesized
aaatgaaaagttgccacaatta

SEQ ID NO: 762515 - DNA, 22 bp, Artificial Sequence
  chemically synthesized
aaactattttttaattgtggca

SEQ ID NO: 762516 - DNA, 22 bp, Artificial Sequence
  chemically synthesized
aaaatgaaaagttgccacaatt

SEQ ID NO: 762517 - DNA, 22 bp, Artificial Sequence
  chemically synthesized
taaaatgaaaagttgccacaat

SEQ ID NO: 762518 - DNA, 22 bp, Artificial Sequence
  chemically synthesized
ttttaaaatgaaaagttgccac

SEQ ID NO: 762519 - DNA, 22 bp, Artificial Sequence
  chemically synthesized
ttttttaattgtggcaactttt

SEQ ID NO: 762520 - DNA, 22 bp, Artificial Sequence
  chemically synthesized
tttaattgtggcaacttttcat

SEQ ID NO: 762521 - DNA, 22 bp, Artificial Sequence
  chemically synthesized
ttaattgtggcaacttttcatt

SEQ ID NO: 762522 - DNA, 22 bp, Artificial Sequence
  chemically synthesized
taattgtggcaacttttcattt

SEQ ID NO: 762523 - DNA, 22 bp, Artificial Sequence
  chemically synthesized
aattgtggcaacttttcatttt

SEQ ID NO: 762524 - DNA, 22 bp, Artificial Sequence
  chemically synthesized
attgtggcaacttttcatttta

SEQ ID NO: 762525 - DNA, 22 bp, Artificial Sequence
  chemically synthesized
catgggggttattttaaaatga

SEQ ID NO: 762526 - DNA, 22 bp, Artificial Sequence
  chemically synthesized
ccatgggggttattttaaaatg

SEQ ID NO: 762527 - DNA, 22 bp, Artificial Sequence
  chemically synthesized
tggcaacttttcattttaaaat

SEQ ID NO: 762528 - DNA, 22 bp, Artificial Sequence
  chemically synthesized
ttccatgggggttattttaaaa

SEQ ID NO: 762529 - DNA, 22 bp, Artificial Sequence
  chemically synthesized
cttccatgggggttattttaaa

SEQ ID NO: 762530 - DNA, 22 bp, Artificial Sequence
  chemically synthesized
tcacttcttccatgggggttat

SEQ ID NO: 762531 - DNA, 22 bp, Artificial Sequence
  chemically synthesized
ttcattttaaaataacccccat

SEQ ID NO: 762532 - DNA, 22 bp, Artificial Sequence
  chemically synthesized
gtcacttcttccatgggggtta

SEQ ID NO: 762533 - DNA, 22 bp, Artificial Sequence
  chemically synthesized
tcattttaaaataacccccatg

SEQ ID NO: 762534 - DNA, 22 bp, Artificial Sequence
  chemically synthesized
cattttaaaataacccccatgg

SEQ ID NO: 762535 - DNA, 22 bp, Artificial Sequence
  chemically synthesized
attttaaaataacccccatgga

SEQ ID NO: 762536 - DNA, 22 bp, Artificial Sequence
  chemically synthesized
taaaataacccccatggaagaa

SEQ ID NO: 762537 - DNA, 22 bp, Artificial Sequence
  chemically synthesized
aaaataacccccatggaagaag

SEQ ID NO: 762538 - DNA, 22 bp, Artificial Sequence
  chemically synthesized
tgaatcttgtcacttcttccat

SEQ ID NO: 762539 - DNA, 22 bp, Artificial Sequence
  chemically synthesized
aaataacccccatggaagaagt

SEQ ID NO: 762540 - DNA, 22 bp, Artificial Sequence
  chemically synthesized
cattatgaatcttgtcacttct

SEQ ID NO: 762541 - DNA, 22 bp, Artificial Sequence
  chemically synthesized
ataaacctgcattatgaatctt

SEQ ID NO: 762542 - DNA, 22 bp, Artificial Sequence
  chemically synthesized
gtggcactgataaacctgcatt

SEQ ID NO: 762543 - DNA, 22 bp, Artificial Sequence
  chemically synthesized
ataatgcaggtttatcagtgcc

SEQ ID NO: 762544 - DNA, 22 bp, Artificial Sequence
  chemically synthesized
gatatagaaccattagtggcac

SEQ ID NO: 762545 - DNA, 22 bp, Artificial Sequence
  chemically synthesized
atcagtgccactaatggttcta

SEQ ID NO: 762546 - DNA, 22 bp, Artificial Sequence
  chemically synthesized
tcagtgccactaatggttctat

SEQ ID NO: 762547 - DNA, 22 bp, Artificial Sequence
  chemically synthesized
gaagagttagatatagaaccat

SEQ ID NO: 762548 - DNA, 22 bp, Artificial Sequence
  chemically synthesized
atggttctatatctaactcttc

SEQ ID NO: 762549 - DNA, 22 bp, Artificial Sequence
  chemically synthesized
tatatctaactcttccagtgtt

SEQ ID NO: 762550 - DNA, 22 bp, Artificial Sequence
  chemically synthesized
tatctaactcttccagtgttat

SEQ ID NO: 762551 - DNA, 22 bp, Artificial Sequence
  chemically synthesized
tgaaatagaatagaataacact

SEQ ID NO: 762552 - DNA, 22 bp, Artificial Sequence
  chemically synthesized
actcttccagtgttattctatt

SEQ ID NO: 762553 - DNA, 22 bp, Artificial Sequence
  chemically synthesized
ttccagtgttattctattctat

SEQ ID NO: 762554 - DNA, 22 bp, Artificial Sequence
  chemically synthesized
ccagtgttattctattctattt

SEQ ID NO: 762555 - DNA, 22 bp, Artificial Sequence
  chemically synthesized
gggatgattatgaaatagaata

SEQ ID NO: 762556 - DNA, 22 bp, Artificial Sequence
  chemically synthesized
cagtgttattctattctatttc

SEQ ID NO: 762557 - DNA, 22 bp, Artificial Sequence
  chemically synthesized
ttctattctatttcataatcat

SEQ ID NO: 762558 - DNA, 22 bp, Artificial Sequence
  chemically synthesized
tattctatttcataatcatccc

SEQ ID NO: 762559 - DNA, 22 bp, Artificial Sequence
  chemically synthesized
ttctatttcataatcatcccta

SEQ ID NO: 762560 - DNA, 22 bp, Artificial Sequence
  chemically synthesized
tatttcataatcatccctaatt

SEQ ID NO: 762561 - DNA, 22 bp, Artificial Sequence
  chemically synthesized
tttcataatcatccctaattac

SEQ ID NO: 762562 - DNA, 22 bp, Artificial Sequence
  chemically synthesized
cataatcatccctaattactgc

SEQ ID NO: 762563 - DNA, 22 bp, Artificial Sequence
  chemically synthesized
ataatcatccctaattactgcc

SEQ ID NO: 762564 - DNA, 22 bp, Artificial Sequence
  chemically synthesized
agagaagtacagtataggcagt

SEQ ID NO: 762565 - DNA, 22 bp, Artificial Sequence
  chemically synthesized
aattgagagaagtacagtatag

SEQ ID NO: 762566 - DNA, 22 bp, Artificial Sequence
  chemically synthesized
attactgcctatactgtacttc

SEQ ID NO: 762567 - DNA, 22 bp, Artificial Sequence
  chemically synthesized
ctgcctatactgtacttctctc

SEQ ID NO: 762568 - DNA, 22 bp, Artificial Sequence
  chemically synthesized
cctatactgtacttctctcaat

SEQ ID NO: 762569 - DNA, 22 bp, Artificial Sequence
  chemically synthesized
tactgtacttctctcaattgaa

SEQ ID NO: 762570 - DNA, 22 bp, Artificial Sequence
  chemically synthesized
cagcaaatggcagggttcaatt

SEQ ID NO: 762571 - DNA, 22 bp, Artificial Sequence
  chemically synthesized
tacttctctcaattgaaccctg

SEQ ID NO: 762572 - DNA, 22 bp, Artificial Sequence
  chemically synthesized
ctctcaattgaaccctgccatt

SEQ ID NO: 762573 - DNA, 22 bp, Artificial Sequence
  chemically synthesized
tctcaattgaaccctgccattt

SEQ ID NO: 762574 - DNA, 22 bp, Artificial Sequence
  chemically synthesized
atcaatctacagcaaatggcag

SEQ ID NO: 762575 - DNA, 22 bp, Artificial Sequence
  chemically synthesized
tcaattgaaccctgccatttgc

SEQ ID NO: 762576 - DNA, 22 bp, Artificial Sequence
  chemically synthesized
aattgaaccctgccatttgctg

SEQ ID NO: 762577 - DNA, 22 bp, Artificial Sequence
  chemically synthesized
aaccctgccatttgctgtagat

SEQ ID NO: 762578 - DNA, 22 bp, Artificial Sequence
  chemically synthesized
gggtattgatcaatctacagca

SEQ ID NO: 762579 - DNA, 22 bp, Artificial Sequence
  chemically synthesized
aaattagggtattgatcaatct

SEQ ID NO: 762580 - DNA, 22 bp, Artificial Sequence
  chemically synthesized
ccatttgctgtagattgatcaa

SEQ ID NO: 762581 - DNA, 22 bp, Artificial Sequence
  chemically synthesized
attgaaattagggtattgatca

SEQ ID NO: 762582 - DNA, 22 bp, Artificial Sequence
  chemically synthesized
gattgaaattagggtattgatc

SEQ ID NO: 762583 - DNA, 22 bp, Artificial Sequence
  chemically synthesized
gctgtagattgatcaataccct

SEQ ID NO: 762584 - DNA, 22 bp, Artificial Sequence
  chemically synthesized
ctgtagattgatcaatacccta

SEQ ID NO: 762585 - DNA, 22 bp, Artificial Sequence
  chemically synthesized
tagattgatcaataccctaatt

SEQ ID NO: 762586 - DNA, 22 bp, Artificial Sequence
  chemically synthesized
acacttgattgaaattagggta

SEQ ID NO: 762587 - DNA, 22 bp, Artificial Sequence
  chemically synthesized
ctgacacttgattgaaattagg

SEQ ID NO: 762588 - DNA, 22 bp, Artificial Sequence
  chemically synthesized
cctgacacttgattgaaattag

SEQ ID NO: 762589 - DNA, 22 bp, Artificial Sequence
  chemically synthesized
atcaataccctaatttcaatca

SEQ ID NO: 762590 - DNA, 22 bp, Artificial Sequence
  chemically synthesized
tttcctgacacttgattgaaat

SEQ ID NO: 762591 - DNA, 22 bp, Artificial Sequence
  chemically synthesized
atttcctgacacttgattgaaa

SEQ ID NO: 762592 - DNA, 22 bp, Artificial Sequence
  chemically synthesized
gcttatttcctgacacttgatt

SEQ ID NO: 762593 - DNA, 22 bp, Artificial Sequence
  chemically synthesized
agcttatttcctgacacttgat

SEQ ID NO: 762594 - DNA, 22 bp, Artificial Sequence
  chemically synthesized
atttcaatcaagtgtcaggaaa

SEQ ID NO: 762595 - DNA, 22 bp, Artificial Sequence
  chemically synthesized
caatcaagtgtcaggaaataag

SEQ ID NO: 762596 - DNA, 22 bp, Artificial Sequence
  chemically synthesized
aatcaagtgtcaggaaataagc

SEQ ID NO: 762597 - DNA, 22 bp, Artificial Sequence
  chemically synthesized
cacatcaaagcaatttagctta

SEQ ID NO: 762598 - DNA, 22 bp, Artificial Sequence
  chemically synthesized
tccacatcaaagcaatttagct

SEQ ID NO: 762599 - DNA, 22 bp, Artificial Sequence
  chemically synthesized
aattgctttgatgtggagaatt

SEQ ID NO: 762600 - DNA, 22 bp, Artificial Sequence
  chemically synthesized
ctttgatgtggagaattacttc

SEQ ID NO: 762601 - DNA, 22 bp, Artificial Sequence
  chemically synthesized
ataaaaagcaaagaagtaattc

SEQ ID NO: 762602 - DNA, 22 bp, Artificial Sequence
  chemically synthesized
tgatgtggagaattacttcttt

SEQ ID NO: 762603 - DNA, 22 bp, Artificial Sequence
  chemically synthesized
gatgtggagaattacttctttg

SEQ ID NO: 762604 - DNA, 22 bp, Artificial Sequence
  chemically synthesized
atgtggagaattacttctttgc

SEQ ID NO: 762605 - DNA, 22 bp, Artificial Sequence
  chemically synthesized
taagcactcataaaaagcaaag

SEQ ID NO: 762606 - DNA, 22 bp, Artificial Sequence
  chemically synthesized
cttctttgctttttatgagtgc

SEQ ID NO: 762607 - DNA, 22 bp, Artificial Sequence
  chemically synthesized
ctttgctttttatgagtgctta

SEQ ID NO: 762608 - DNA, 22 bp, Artificial Sequence
  chemically synthesized
tttgctttttatgagtgcttat

SEQ ID NO: 762609 - DNA, 22 bp, Artificial Sequence
  chemically synthesized
tgctttttatgagtgcttataa

SEQ ID NO: 762610 - DNA, 22 bp, Artificial Sequence
  chemically synthesized
gctttttatgagtgcttataac

SEQ ID NO: 762611 - DNA, 22 bp, Artificial Sequence
  chemically synthesized
ctttttatgagtgcttataaca

SEQ ID NO: 762612 - DNA, 22 bp, Artificial Sequence
  chemically synthesized
tttatgagtgcttataacatat

SEQ ID NO: 762613 - DNA, 22 bp, Artificial Sequence
  chemically synthesized
ttatgagtgcttataacatatc

SEQ ID NO: 762614 - DNA, 22 bp, Artificial Sequence
  chemically synthesized
tatgagtgcttataacatatcc

SEQ ID NO: 762615 - DNA, 22 bp, Artificial Sequence
  chemically synthesized
tgtaataatacaggatatgtta

SEQ ID NO: 762616 - DNA, 22 bp, Artificial Sequence
  chemically synthesized
atgagtgcttataacatatcct

SEQ ID NO: 762617 - DNA, 22 bp, Artificial Sequence
  chemically synthesized
tgagtgcttataacatatcctg

SEQ ID NO: 762618 - DNA, 22 bp, Artificial Sequence
  chemically synthesized
tataggcctatgtaataataca

SEQ ID NO: 762619 - DNA, 22 bp, Artificial Sequence
  chemically synthesized
ataacatatcctgtattattac

SEQ ID NO: 762620 - DNA, 22 bp, Artificial Sequence
  chemically synthesized
atataggcctatgtaataatac

SEQ ID NO: 762621 - DNA, 22 bp, Artificial Sequence
  chemically synthesized
taacatatcctgtattattaca

SEQ ID NO: 762622 - DNA, 22 bp, Artificial Sequence
  chemically synthesized
tatataggcctatgtaataata

SEQ ID NO: 762623 - DNA, 22 bp, Artificial Sequence
  chemically synthesized
ttatataggcctatgtaataat

SEQ ID NO: 762624 - DNA, 22 bp, Artificial Sequence
  chemically synthesized
gcttttatataggcctatgtaa

SEQ ID NO: 762625 - DNA, 22 bp, Artificial Sequence
  chemically synthesized
ggcttttatataggcctatgta

SEQ ID NO: 762626 - DNA, 22 bp, Artificial Sequence
  chemically synthesized
tggcttttatataggcctatgt

SEQ ID NO: 762627 - DNA, 22 bp, Artificial Sequence
  chemically synthesized
tattattacataggcctatata

SEQ ID NO: 762628 - DNA, 22 bp, Artificial Sequence
  chemically synthesized
ttacataggcctatataaaagc

SEQ ID NO: 762629 - DNA, 22 bp, Artificial Sequence
  chemically synthesized
cataggcctatataaaagccaa

SEQ ID NO: 762630 - DNA, 22 bp, Artificial Sequence
  chemically synthesized
agatcaatggttttggctttta

SEQ ID NO: 762631 - DNA, 22 bp, Artificial Sequence
  chemically synthesized
aatattcagatcaatggttttg

SEQ ID NO: 762632 - DNA, 22 bp, Artificial Sequence
  chemically synthesized
aaatattcagatcaatggtttt

SEQ ID NO: 762633 - DNA, 22 bp, Artificial Sequence
  chemically synthesized
tataaaagccaaaaccattgat

SEQ ID NO: 762634 - DNA, 22 bp, Artificial Sequence
  chemically synthesized
gaatttaaatattcagatcaat

SEQ ID NO: 762635 - DNA, 22 bp, Artificial Sequence
  chemically synthesized
tagaatttaaatattcagatca

SEQ ID NO: 762636 - DNA, 22 bp, Artificial Sequence
  chemically synthesized
ccaattctagaatttaaatatt

SEQ ID NO: 762637 - DNA, 22 bp, Artificial Sequence
  chemically synthesized
atctgaatatttaaattctaga

SEQ ID NO: 762638 - DNA, 22 bp, Artificial Sequence
  chemically synthesized
aggtgctgccaattctagaatt

SEQ ID NO: 762639 - DNA, 22 bp, Artificial Sequence
  chemically synthesized
aatatttaaattctagaattgg

SEQ ID NO: 762640 - DNA, 22 bp, Artificial Sequence
  chemically synthesized
tctaaggtgctgccaattctag

SEQ ID NO: 762641 - DNA, 22 bp, Artificial Sequence
  chemically synthesized
atctaaggtgctgccaattcta

SEQ ID NO: 762642 - DNA, 22 bp, Artificial Sequence
  chemically synthesized
gcttatctaaggtgctgccaat

SEQ ID NO: 762643 - DNA, 22 bp, Artificial Sequence
  chemically synthesized
aaattctagaattggcagcacc

SEQ ID NO: 762644 - DNA, 22 bp, Artificial Sequence
  chemically synthesized
aattctagaattggcagcacct

SEQ ID NO: 762645 - DNA, 22 bp, Artificial Sequence
  chemically synthesized
tagaattggcagcaccttagat

SEQ ID NO: 762646 - DNA, 22 bp, Artificial Sequence
  chemically synthesized
gaattggcagcaccttagataa

SEQ ID NO: 762647 - DNA, 22 bp, Artificial Sequence
  chemically synthesized
gcagcaccttagataagctaac

SEQ ID NO: 762648 - DNA, 22 bp, Artificial Sequence
  chemically synthesized
atcaggtagaaaacagttagct

SEQ ID NO: 762649 - DNA, 22 bp, Artificial Sequence
  chemically synthesized
tcattaatcaggtagaaaacag

SEQ ID NO: 762650 - DNA, 22 bp, Artificial Sequence
  chemically synthesized
agataagctaactgttttctac

SEQ ID NO: 762651 - DNA, 22 bp, Artificial Sequence
  chemically synthesized
gataagctaactgttttctacc

SEQ ID NO: 762652 - DNA, 22 bp, Artificial Sequence
  chemically synthesized
ctgtcattaatcaggtagaaaa

SEQ ID NO: 762653 - DNA, 22 bp, Artificial Sequence
  chemically synthesized
gctgtcattaatcaggtagaaa

SEQ ID NO: 762654 - DNA, 22 bp, Artificial Sequence
  chemically synthesized
ttgctgtcattaatcaggtaga

SEQ ID NO: 762655 - DNA, 22 bp, Artificial Sequence
  chemically synthesized
attcttgctgtcattaatcagg

SEQ ID NO: 762656 - DNA, 22 bp, Artificial Sequence
  chemically synthesized
actgttttctacctgattaatg

SEQ ID NO: 762657 - DNA, 22 bp, Artificial Sequence
  chemically synthesized
gattcttgctgtcattaatcag

SEQ ID NO: 762658 - DNA, 22 bp, Artificial Sequence
  chemically synthesized
ttttctacctgattaatgacag

SEQ ID NO: 762659 - DNA, 22 bp, Artificial Sequence
  chemically synthesized
tctacctgattaatgacagcaa

SEQ ID NO: 762660 - DNA, 22 bp, Artificial Sequence
  chemically synthesized
ctacctgattaatgacagcaag

SEQ ID NO: 762661 - DNA, 22 bp, Artificial Sequence
  chemically synthesized
tacctgattaatgacagcaaga

SEQ ID NO: 762662 - DNA, 22 bp, Artificial Sequence
  chemically synthesized
ccgcagtttgattcttgctgtc

SEQ ID NO: 762663 - DNA, 22 bp, Artificial Sequence
  chemically synthesized
cctgattaatgacagcaagaat

SEQ ID NO: 762664 - DNA, 22 bp, Artificial Sequence
  chemically synthesized
attaatgacagcaagaatcaaa

SEQ ID NO: 762665 - DNA, 22 bp, Artificial Sequence
  chemically synthesized
atgacagcaagaatcaaactgc

SEQ ID NO: 762666 - DNA, 22 bp, Artificial Sequence
  chemically synthesized
ccatgtcagctaccgcagtttg

SEQ ID NO: 762667 - DNA, 22 bp, Artificial Sequence
  chemically synthesized
cccatgtcagctaccgcagttt

SEQ ID NO: 762668 - DNA, 22 bp, Artificial Sequence
  chemically synthesized
agcagtttcccatgtcagctac

SEQ ID NO: 762669 - DNA, 22 bp, Artificial Sequence
  chemically synthesized
tcagcagtttcccatgtcagct

SEQ ID NO: 762670 - DNA, 22 bp, Artificial Sequence
  chemically synthesized
attctcagcagtttcccatgtc

SEQ ID NO: 762671 - DNA, 22 bp, Artificial Sequence
  chemically synthesized
cattctcagcagtttcccatgt

SEQ ID NO: 762672 - DNA, 22 bp, Artificial Sequence
  chemically synthesized
ttcattctcagcagtttcccat

SEQ ID NO: 762673 - DNA, 22 bp, Artificial Sequence
  chemically synthesized
cggtagctgacatgggaaactg

SEQ ID NO: 762674 - DNA, 22 bp, Artificial Sequence
  chemically synthesized
acatgggaaactgctgagaatg

SEQ ID NO: 762675 - DNA, 22 bp, Artificial Sequence
  chemically synthesized
ctgagaatgaagagtccatatt

SEQ ID NO: 762676 - DNA, 22 bp, Artificial Sequence
  chemically synthesized
agaatgaagagtccatattttg

SEQ ID NO: 762677 - DNA, 22 bp, Artificial Sequence
  chemically synthesized
aaagtggcaaatagcatgtcag

SEQ ID NO: 762678 - DNA, 22 bp, Artificial Sequence
  chemically synthesized
tggctgacatgctatttgccac

SEQ ID NO: 762679 - DNA, 22 bp, Artificial Sequence
  chemically synthesized
ggctgacatgctatttgccact

SEQ ID NO: 762680 - DNA, 22 bp, Artificial Sequence
  chemically synthesized
gctgacatgctatttgccactt

SEQ ID NO: 762681 - DNA, 22 bp, Artificial Sequence
  chemically synthesized
acatgctatttgccactttcaa

SEQ ID NO: 762682 - DNA, 22 bp, Artificial Sequence
  chemically synthesized
ataaaataaaaggagaattgaa

SEQ ID NO: 762683 - DNA, 22 bp, Artificial Sequence
  chemically synthesized
gataaaataaaaggagaattga

SEQ ID NO: 762684 - DNA, 22 bp, Artificial Sequence
  chemically synthesized
tttgccactttcaattctcctt

SEQ ID NO: 762685 - DNA, 22 bp, Artificial Sequence
  chemically synthesized
gccactttcaattctcctttta

SEQ ID NO: 762686 - DNA, 22 bp, Artificial Sequence
  chemically synthesized
ccactttcaattctccttttat

SEQ ID NO: 762687 - DNA, 22 bp, Artificial Sequence
  chemically synthesized
atgtgaacttgataaaataaaa

SEQ ID NO: 762688 - DNA, 22 bp, Artificial Sequence
  chemically synthesized
tcaattctccttttattttatc

SEQ ID NO: 762689 - DNA, 22 bp, Artificial Sequence
  chemically synthesized
caattctccttttattttatca

SEQ ID NO: 762690 - DNA, 22 bp, Artificial Sequence
  chemically synthesized
aattctccttttattttatcaa

SEQ ID NO: 762691 - DNA, 22 bp, Artificial Sequence
  chemically synthesized
cctcatgtgaacttgataaaat

SEQ ID NO: 762692 - DNA, 22 bp, Artificial Sequence
  chemically synthesized
tgcctcatgtgaacttgataaa

SEQ ID NO: 762693 - DNA, 22 bp, Artificial Sequence
  chemically synthesized
tctgcctcatgtgaacttgata

SEQ ID NO: 762694 - DNA, 22 bp, Artificial Sequence
  chemically synthesized
tccttttattttatcaagttca

SEQ ID NO: 762695 - DNA, 22 bp, Artificial Sequence
  chemically synthesized
ctctgcctcatgtgaacttgat

SEQ ID NO: 762696 - DNA, 22 bp, Artificial Sequence
  chemically synthesized
tctctgcctcatgtgaacttga

SEQ ID NO: 762697 - DNA, 22 bp, Artificial Sequence
  chemically synthesized
cttttattttatcaagttcaca

SEQ ID NO: 762698 - DNA, 22 bp, Artificial Sequence
  chemically synthesized
ttctctgcctcatgtgaacttg

SEQ ID NO: 762699 - DNA, 22 bp, Artificial Sequence
  chemically synthesized
ttattttatcaagttcacatga

SEQ ID NO: 762700 - DNA, 22 bp, Artificial Sequence
  chemically synthesized
tattttatcaagttcacatgag

SEQ ID NO: 762701 - DNA, 22 bp, Artificial Sequence
  chemically synthesized
attttatcaagttcacatgagg

SEQ ID NO: 762702 - DNA, 22 bp, Artificial Sequence
  chemically synthesized
ttttatcaagttcacatgaggc

SEQ ID NO: 762703 - DNA, 22 bp, Artificial Sequence
  chemically synthesized
gtgccttttctctgcctcatgt

SEQ ID NO: 762704 - DNA, 22 bp, Artificial Sequence
  chemically synthesized
agtgccttttctctgcctcatg

SEQ ID NO: 762705 - DNA, 22 bp, Artificial Sequence
  chemically synthesized
tatcaagttcacatgaggcaga

SEQ ID NO: 762706 - DNA, 22 bp, Artificial Sequence
  chemically synthesized
atcaagttcacatgaggcagag

SEQ ID NO: 762707 - DNA, 22 bp, Artificial Sequence
  chemically synthesized
tcaagttcacatgaggcagaga

SEQ ID NO: 762708 - DNA, 22 bp, Artificial Sequence
  chemically synthesized
acatgaggcagagaaaaggcac

SEQ ID NO: 762709 - DNA, 22 bp, Artificial Sequence
  chemically synthesized
cgagtatcacttagtgcctttt

SEQ ID NO: 762710 - DNA, 22 bp, Artificial Sequence
  chemically synthesized
ttccgagtatcacttagtgcct

SEQ ID NO: 762711 - DNA, 22 bp, Artificial Sequence
  chemically synthesized
taattgttccgagtatcactta

SEQ ID NO: 762712 - DNA, 22 bp, Artificial Sequence
  chemically synthesized
agtgatactcggaacaattata

SEQ ID NO: 762713 - DNA, 22 bp, Artificial Sequence
  chemically synthesized
ggaacaattatagcatctttct

SEQ ID NO: 762714 - DNA, 22 bp, Artificial Sequence
  chemically synthesized
cacaaaagaaaaagaaagatgc

SEQ ID NO: 762715 - DNA, 22 bp, Artificial Sequence
  chemically synthesized
tgcacaaaagaaaaagaaagat

SEQ ID NO: 762716 - DNA, 22 bp, Artificial Sequence
  chemically synthesized
ctgcacaaaagaaaaagaaaga

SEQ ID NO: 762717 - DNA, 22 bp, Artificial Sequence
  chemically synthesized
tctgcacaaaagaaaaagaaag

SEQ ID NO: 762718 - DNA, 22 bp, Artificial Sequence
  chemically synthesized
ttctgcacaaaagaaaaagaaa

SEQ ID NO: 762719 - DNA, 22 bp, Artificial Sequence
  chemically synthesized
ttttctgcacaaaagaaaaaga

SEQ ID NO: 762720 - DNA, 22 bp, Artificial Sequence
  chemically synthesized
tagcatctttctttttcttttg

SEQ ID NO: 762721 - DNA, 22 bp, Artificial Sequence
  chemically synthesized
ttcttttctgcacaaaagaaaa

SEQ ID NO: 762722 - DNA, 22 bp, Artificial Sequence
  chemically synthesized
agttattcttttctgcacaaaa

SEQ ID NO: 762723 - DNA, 22 bp, Artificial Sequence
  chemically synthesized
tctttttcttttgtgcagaaaa

SEQ ID NO: 762724 - DNA, 22 bp, Artificial Sequence
  chemically synthesized
ctttttcttttgtgcagaaaag

SEQ ID NO: 762725 - DNA, 22 bp, Artificial Sequence
  chemically synthesized
tttttcttttgtgcagaaaaga

SEQ ID NO: 762726 - DNA, 22 bp, Artificial Sequence
  chemically synthesized
tttcttttgtgcagaaaagaat

SEQ ID NO: 762727 - DNA, 22 bp, Artificial Sequence
  chemically synthesized
ttcttttgtgcagaaaagaata

SEQ ID NO: 762728 - DNA, 22 bp, Artificial Sequence
  chemically synthesized
tcttttgtgcagaaaagaataa

SEQ ID NO: 762729 - DNA, 22 bp, Artificial Sequence
  chemically synthesized
cttttgtgcagaaaagaataac

SEQ ID NO: 762730 - DNA, 22 bp, Artificial Sequence
  chemically synthesized
ttttgtgcagaaaagaataact

SEQ ID NO: 762731 - DNA, 22 bp, Artificial Sequence
  chemically synthesized
gcaggtcaagttaagttattct

SEQ ID NO: 762732 - DNA, 22 bp, Artificial Sequence
  chemically synthesized
ttgtgcagaaaagaataactta

SEQ ID NO: 762733 - DNA, 22 bp, Artificial Sequence
  chemically synthesized
tgtgcagaaaagaataacttaa

SEQ ID NO: 762734 - DNA, 22 bp, Artificial Sequence
  chemically synthesized
gtgcagaaaagaataacttaac

SEQ ID NO: 762735 - DNA, 22 bp, Artificial Sequence
  chemically synthesized
tgcagaaaagaataacttaact

SEQ ID NO: 762736 - DNA, 22 bp, Artificial Sequence
  chemically synthesized
aacttgacctgccaatattttt

SEQ ID NO: 762737 - DNA, 22 bp, Artificial Sequence
  chemically synthesized
acttgacctgccaatatttttt

SEQ ID NO: 762738 - DNA, 22 bp, Artificial Sequence
  chemically synthesized
gacctgccaatattttttccat

SEQ ID NO: 762739 - DNA, 22 bp, Artificial Sequence
  chemically synthesized
acctgccaatattttttccatc

SEQ ID NO: 762740 - DNA, 22 bp, Artificial Sequence
  chemically synthesized
ccaatattttttccatctcaca

SEQ ID NO: 762741 - DNA, 22 bp, Artificial Sequence
  chemically synthesized
aaaaagaatgaaaatgtgagat

SEQ ID NO: 762742 - DNA, 22 bp, Artificial Sequence
  chemically synthesized
tttccatctcacattttcattc

SEQ ID NO: 762743 - DNA, 22 bp, Artificial Sequence
  chemically synthesized
gtcattaaaaaagaatgaaaat

SEQ ID NO: 762744 - DNA, 22 bp, Artificial Sequence
  chemically synthesized
ttccatctcacattttcattct

SEQ ID NO: 762745 - DNA, 22 bp, Artificial Sequence
  chemically synthesized
cgtcattaaaaaagaatgaaaa

SEQ ID NO: 762746 - DNA, 22 bp, Artificial Sequence
  chemically synthesized
tccatctcacattttcattctt

SEQ ID NO: 762747 - DNA, 22 bp, Artificial Sequence
  chemically synthesized
ccatctcacattttcattcttt

SEQ ID NO: 762748 - DNA, 22 bp, Artificial Sequence
  chemically synthesized
catctcacattttcattctttt

SEQ ID NO: 762749 - DNA, 22 bp, Artificial Sequence
  chemically synthesized
ataaccttcgtcattaaaaaag

SEQ ID NO: 762750 - DNA, 22 bp, Artificial Sequence
  chemically synthesized
acattttcattcttttttaatg

SEQ ID NO: 762751 - DNA, 22 bp, Artificial Sequence
  chemically synthesized
gataaccttcgtcattaaaaaa

SEQ ID NO: 762752 - DNA, 22 bp, Artificial Sequence
  chemically synthesized
tgataaccttcgtcattaaaaa

SEQ ID NO: 762753 - DNA, 22 bp, Artificial Sequence
  chemically synthesized
tcattcttttttaatgacgaag

SEQ ID NO: 762754 - DNA, 22 bp, Artificial Sequence
  chemically synthesized
cattcttttttaatgacgaagg

SEQ ID NO: 762755 - DNA, 22 bp, Artificial Sequence
  chemically synthesized
attcttttttaatgacgaaggt

SEQ ID NO: 762756 - DNA, 22 bp, Artificial Sequence
  chemically synthesized
ttttttaatgacgaaggttatc

SEQ ID NO: 762757 - DNA, 22 bp, Artificial Sequence
  chemically synthesized
ttttaatgacgaaggttatcaa

SEQ ID NO: 762758 - DNA, 22 bp, Artificial Sequence
  chemically synthesized
tttaatgacgaaggttatcaaa

SEQ ID NO: 762759 - DNA, 22 bp, Artificial Sequence
  chemically synthesized
ttaatgacgaaggttatcaaag

SEQ ID NO: 762760 - DNA, 22 bp, Artificial Sequence
  chemically synthesized
taatgacgaaggttatcaaagt

SEQ ID NO: 762761 - DNA, 22 bp, Artificial Sequence
  chemically synthesized
aatgacgaaggttatcaaagtg

SEQ ID NO: 762762 - DNA, 22 bp, Artificial Sequence
  chemically synthesized
atgacgaaggttatcaaagtgg

SEQ ID NO: 762763 - DNA, 22 bp, Artificial Sequence
  chemically synthesized
tcaaagtggcctacgtcatcac

SEQ ID NO: 762764 - DNA, 22 bp, Artificial Sequence
  chemically synthesized
agagaggtcagtatgtgtgatg

SEQ ID NO: 762765 - DNA, 22 bp, Artificial Sequence
  chemically synthesized
aagagaggtcagtatgtgtgat

SEQ ID NO: 762766 - DNA, 22 bp, Artificial Sequence
  chemically synthesized
ttaagagaggtcagtatgtgtg

SEQ ID NO: 762767 - DNA, 22 bp, Artificial Sequence
  chemically synthesized
aactcttaagagaggtcagtat

SEQ ID NO: 762768 - DNA, 22 bp, Artificial Sequence
  chemically synthesized
cgtcatcacacatactgacctc

SEQ ID NO: 762769 - DNA, 22 bp, Artificial Sequence
  chemically synthesized
aaactcttaagagaggtcagta

SEQ ID NO: 762770 - DNA, 22 bp, Artificial Sequence
  chemically synthesized
cagcttaaactcttaagagagg

SEQ ID NO: 762771 - DNA, 22 bp, Artificial Sequence
  chemically synthesized
tacagcttaaactcttaagaga

SEQ ID NO: 762772 - DNA, 22 bp, Artificial Sequence
  chemically synthesized
ctacagcttaaactcttaagag

SEQ ID NO: 762773 - DNA, 22 bp, Artificial Sequence
  chemically synthesized
tctacagcttaaactcttaaga

SEQ ID NO: 762774 - DNA, 22 bp, Artificial Sequence
  chemically synthesized
gctttctacagcttaaactctt

SEQ ID NO: 762775 - DNA, 22 bp, Artificial Sequence
  chemically synthesized
acctctcttaagagtttaagct

SEQ ID NO: 762776 - DNA, 22 bp, Artificial Sequence
  chemically synthesized
ttagctttctacagcttaaact

SEQ ID NO: 762777 - DNA, 22 bp, Artificial Sequence
  chemically synthesized
tattagctttctacagcttaaa

SEQ ID NO: 762778 - DNA, 22 bp, Artificial Sequence
  chemically synthesized
tcttaagagtttaagctgtaga

SEQ ID NO: 762779 - DNA, 22 bp, Artificial Sequence
  chemically synthesized
ttaagagtttaagctgtagaaa

SEQ ID NO: 762780 - DNA, 22 bp, Artificial Sequence
  chemically synthesized
aagagtttaagctgtagaaagc

SEQ ID NO: 762781 - DNA, 22 bp, Artificial Sequence
  chemically synthesized
agagtttaagctgtagaaagct

SEQ ID NO: 762782 - DNA, 22 bp, Artificial Sequence
  chemically synthesized
aagctgtagaaagctaatagag

SEQ ID NO: 762783 - DNA, 22 bp, Artificial Sequence
  chemically synthesized
agctgtagaaagctaatagagc

SEQ ID NO: 762784 - DNA, 22 bp, Artificial Sequence
  chemically synthesized
aaagatagggaggctctattag

SEQ ID NO: 762785 - DNA, 22 bp, Artificial Sequence
  chemically synthesized
caaagatagggaggctctatta

SEQ ID NO: 762786 - DNA, 22 bp, Artificial Sequence
  chemically synthesized
tcaaagatagggaggctctatt

SEQ ID NO: 762787 - DNA, 22 bp, Artificial Sequence
  chemically synthesized
tagaaagctaatagagcctccc

SEQ ID NO: 762788 - DNA, 22 bp, Artificial Sequence
  chemically synthesized
atagagcctccctatctttgaa

SEQ ID NO: 762789 - DNA, 22 bp, Artificial Sequence
  chemically synthesized
cctatctttgaaaatgctattg

SEQ ID NO: 762790 - DNA, 22 bp, Artificial Sequence
  chemically synthesized
ggagcaacaatggcaatagcat

SEQ ID NO: 762791 - DNA, 22 bp, Artificial Sequence
  chemically synthesized
tctttgaaaatgctattgccat

SEQ ID NO: 762792 - DNA, 22 bp, Artificial Sequence
  chemically synthesized
tgaaaatgctattgccattgtt

SEQ ID NO: 762793 - DNA, 22 bp, Artificial Sequence
  chemically synthesized
gaaaatgctattgccattgttg

SEQ ID NO: 762794 - DNA, 22 bp, Artificial Sequence
  chemically synthesized
aaaatgctattgccattgttgc

SEQ ID NO: 762795 - DNA, 22 bp, Artificial Sequence
  chemically synthesized
gtggtggtacactgggagcaac

SEQ ID NO: 762796 - DNA, 22 bp, Artificial Sequence
  chemically synthesized
ggtggtggtacactgggagcaa

SEQ ID NO: 762797 - DNA, 22 bp, Artificial Sequence
  chemically synthesized
ttgccattgttgctcccagtgt

SEQ ID NO: 762798 - DNA, 22 bp, Artificial Sequence
  chemically synthesized
ccattgttgctcccagtgtacc

SEQ ID NO: 762799 - DNA, 22 bp, Artificial Sequence
  chemically synthesized
tgtcaacttggtggtggtacac

SEQ ID NO: 762800 - DNA, 22 bp, Artificial Sequence
  chemically synthesized
gtgtcaacttggtggtggtaca

SEQ ID NO: 762801 - DNA, 22 bp, Artificial Sequence
  chemically synthesized
tgtgtcaacttggtggtggtac

SEQ ID NO: 762802 - DNA, 22 bp, Artificial Sequence
  chemically synthesized
ttgctcccagtgtaccaccacc

SEQ ID NO: 762803 - DNA, 22 bp, Artificial Sequence
  chemically synthesized
ctcccagtgtaccaccaccaag

SEQ ID NO: 762804 - DNA, 22 bp, Artificial Sequence
  chemically synthesized
ccagtgtaccaccaccaagttg

SEQ ID NO: 762805 - DNA, 22 bp, Artificial Sequence
  chemically synthesized
tatatgaattttgtgtcaactt

SEQ ID NO: 762806 - DNA, 22 bp, Artificial Sequence
  chemically synthesized
gtatatgaattttgtgtcaact

SEQ ID NO: 762807 - DNA, 22 bp, Artificial Sequence
  chemically synthesized
tgtatatgaattttgtgtcaac

SEQ ID NO: 762808 - DNA, 22 bp, Artificial Sequence
  chemically synthesized
ttttgtatatgaattttgtgtc

SEQ ID NO: 762809 - DNA, 22 bp, Artificial Sequence
  chemically synthesized
cctattttgtatatgaattttg

SEQ ID NO: 762810 - DNA, 22 bp, Artificial Sequence
  chemically synthesized
tctccctattttgtatatgaat

SEQ ID NO: 762811 - DNA, 22 bp, Artificial Sequence
  chemically synthesized
atctccctattttgtatatgaa

SEQ ID NO: 762812 - DNA, 22 bp, Artificial Sequence
  chemically synthesized
cttatctccctattttgtatat

SEQ ID NO: 762813 - DNA, 22 bp, Artificial Sequence
  chemically synthesized
acacaaaattcatatacaaaat

SEQ ID NO: 762814 - DNA, 22 bp, Artificial Sequence
  chemically synthesized
ttccttatctccctattttgta

SEQ ID NO: 762815 - DNA, 22 bp, Artificial Sequence
  chemically synthesized
atatacaaaatagggagataag

SEQ ID NO: 762816 - DNA, 22 bp, Artificial Sequence
  chemically synthesized
ccagacattgttccttatctcc

SEQ ID NO: 762817 - DNA, 22 bp, Artificial Sequence
  chemically synthesized
cccagacattgttccttatctc

SEQ ID NO: 762818 - DNA, 22 bp, Artificial Sequence
  chemically synthesized
gcttcccagacattgttcctta

SEQ ID NO: 762819 - DNA, 22 bp, Artificial Sequence
  chemically synthesized
caccctggcttcccagacattg

SEQ ID NO: 762820 - DNA, 22 bp, Artificial Sequence
  chemically synthesized
gcaccctggcttcccagacatt

SEQ ID NO: 762821 - DNA, 22 bp, Artificial Sequence
  chemically synthesized
acaagtttgcaccctggcttcc

SEQ ID NO: 762822 - DNA, 22 bp, Artificial Sequence
  chemically synthesized
cacaagtttgcaccctggcttc

SEQ ID NO: 762823 - DNA, 22 bp, Artificial Sequence
  chemically synthesized
tcacaagtttgcaccctggctt

SEQ ID NO: 762824 - DNA, 22 bp, Artificial Sequence
  chemically synthesized
ttcacaagtttgcaccctggct

SEQ ID NO: 762825 - DNA, 22 bp, Artificial Sequence
  chemically synthesized
tttttcacaagtttgcaccctg

SEQ ID NO: 762826 - DNA, 22 bp, Artificial Sequence
  chemically synthesized
gtttttcacaagtttgcaccct

SEQ ID NO: 762827 - DNA, 22 bp, Artificial Sequence
  chemically synthesized
tgtttttcacaagtttgcaccc

SEQ ID NO: 762828 - DNA, 22 bp, Artificial Sequence
  chemically synthesized
ttttgtttttcacaagtttgca

SEQ ID NO: 762829 - DNA, 22 bp, Artificial Sequence
  chemically synthesized
ggaagccagggtgcaaacttgt

SEQ ID NO: 762830 - DNA, 22 bp, Artificial Sequence
  chemically synthesized
gttttgtttttcacaagtttgc

SEQ ID NO: 762831 - DNA, 22 bp, Artificial Sequence
  chemically synthesized
tgttttgtttttcacaagtttg

SEQ ID NO: 762832 - DNA, 22 bp, Artificial Sequence
  chemically synthesized
ttttgttttgtttttcacaagt

SEQ ID NO: 762833 - DNA, 22 bp, Artificial Sequence
  chemically synthesized
gttttgttttgtttttcacaag

SEQ ID NO: 762834 - DNA, 22 bp, Artificial Sequence
  chemically synthesized
tgttttgttttgtttttcacaa

SEQ ID NO: 762835 - DNA, 22 bp, Artificial Sequence
  chemically synthesized
tgtataaggttttgttttgttt

SEQ ID NO: 762836 - DNA, 22 bp, Artificial Sequence
  chemically synthesized
atgtataaggttttgttttgtt

SEQ ID NO: 762837 - DNA, 22 bp, Artificial Sequence
  chemically synthesized
gtgaaaaacaaaacaaaacaaa

SEQ ID NO: 762838 - DNA, 22 bp, Artificial Sequence
  chemically synthesized
tatgtataaggttttgttttgt

SEQ ID NO: 762839 - DNA, 22 bp, Artificial Sequence
  chemically synthesized
tgaaaaacaaaacaaaacaaaa

SEQ ID NO: 762840 - DNA, 22 bp, Artificial Sequence
  chemically synthesized
ttatgtataaggttttgttttg

SEQ ID NO: 762841 - DNA, 22 bp, Artificial Sequence
  chemically synthesized
tttttatgtataaggttttgtt

SEQ ID NO: 762842 - DNA, 22 bp, Artificial Sequence
  chemically synthesized
atttttatgtataaggttttgt

SEQ ID NO: 762843 - DNA, 22 bp, Artificial Sequence
  chemically synthesized
ggagtagaacaggtttattttt

SEQ ID NO: 762844 - DNA, 22 bp, Artificial Sequence
  chemically synthesized
ctaggagtagaacaggtttatt

SEQ ID NO: 762845 - DNA, 22 bp, Artificial Sequence
  chemically synthesized
atacataaaaataaacctgttc

SEQ ID NO: 762846 - DNA, 22 bp, Artificial Sequence
  chemically synthesized
tacataaaaataaacctgttct

SEQ ID NO: 762847 - DNA, 22 bp, Artificial Sequence
  chemically synthesized
tgagaagtagattgctaggagt

SEQ ID NO: 762848 - DNA, 22 bp, Artificial Sequence
  chemically synthesized
atgagaagtagattgctaggag

SEQ ID NO: 762849 - DNA, 22 bp, Artificial Sequence
  chemically synthesized
tatgagaagtagattgctagga

SEQ ID NO: 762850 - DNA, 22 bp, Artificial Sequence
  chemically synthesized
ttatgagaagtagattgctagg

SEQ ID NO: 762851 - DNA, 22 bp, Artificial Sequence
  chemically synthesized
tttttatgagaagtagattgct

SEQ ID NO: 762852 - DNA, 22 bp, Artificial Sequence
  chemically synthesized
gtttttatgagaagtagattgc

SEQ ID NO: 762853 - DNA, 22 bp, Artificial Sequence
  chemically synthesized
ttctactcctagcaatctactt

SEQ ID NO: 762854 - DNA, 22 bp, Artificial Sequence
  chemically synthesized
tactcctagcaatctacttctc

SEQ ID NO: 762855 - DNA, 22 bp, Artificial Sequence
  chemically synthesized
ctcctagcaatctacttctcat

SEQ ID NO: 762856 - DNA, 22 bp, Artificial Sequence
  chemically synthesized
ctagcaatctacttctcataaa

SEQ ID NO: 762857 - DNA, 22 bp, Artificial Sequence
  chemically synthesized
gcaatctacttctcataaaaac

SEQ ID NO: 762858 - DNA, 22 bp, Artificial Sequence
  chemically synthesized
ggagtagaaaaggatttgtttt

SEQ ID NO: 762859 - DNA, 22 bp, Artificial Sequence
  chemically synthesized
taggagtagaaaaggatttgtt

SEQ ID NO: 762860 - DNA, 22 bp, Artificial Sequence
  chemically synthesized
cttctcataaaaacaaatcctt

SEQ ID NO: 762861 - DNA, 22 bp, Artificial Sequence
  chemically synthesized
ctaggagtagaaaaggatttgt

SEQ ID NO: 762862 - DNA, 22 bp, Artificial Sequence
  chemically synthesized
tctaggagtagaaaaggatttg

SEQ ID NO: 762863 - DNA, 22 bp, Artificial Sequence
  chemically synthesized
ttctaggagtagaaaaggattt

SEQ ID NO: 762864 - DNA, 22 bp, Artificial Sequence
  chemically synthesized
ctcataaaaacaaatccttttc

SEQ ID NO: 762865 - DNA, 22 bp, Artificial Sequence
  chemically synthesized
tttctaggagtagaaaaggatt

SEQ ID NO: 762866 - DNA, 22 bp, Artificial Sequence
  chemically synthesized
tcataaaaacaaatccttttct

SEQ ID NO: 762867 - DNA, 22 bp, Artificial Sequence
  chemically synthesized
ataaaaacaaatccttttctac

SEQ ID NO: 762868 - DNA, 22 bp, Artificial Sequence
  chemically synthesized
ttctactcctagaaaaaatcta

SEQ ID NO: 762869 - DNA, 22 bp, Artificial Sequence
  chemically synthesized
tctactcctagaaaaaatctac

SEQ ID NO: 762870 - DNA, 22 bp, Artificial Sequence
  chemically synthesized
ctactcctagaaaaaatctact

SEQ ID NO: 762871 - DNA, 22 bp, Artificial Sequence
  chemically synthesized
tactcctagaaaaaatctactc

SEQ ID NO: 762872 - DNA, 22 bp, Artificial Sequence
  chemically synthesized
ctcctagaaaaaatctactctc

SEQ ID NO: 762873 - DNA, 22 bp, Artificial Sequence
  chemically synthesized
aaaggatgaaatagagagtaga

SEQ ID NO: 762874 - DNA, 22 bp, Artificial Sequence
  chemically synthesized
ctagaaaaaatctactctctat

SEQ ID NO: 762875 - DNA, 22 bp, Artificial Sequence
  chemically synthesized
attgaaaggatgaaatagagag

SEQ ID NO: 762876 - DNA, 22 bp, Artificial Sequence
  chemically synthesized
gaaaaaatctactctctatttc

SEQ ID NO: 762877 - DNA, 22 bp, Artificial Sequence
  chemically synthesized
ctctctatttcatcctttcaat

SEQ ID NO: 762878 - DNA, 22 bp, Artificial Sequence
  chemically synthesized
tctatttcatcctttcaattag

SEQ ID NO: 762879 - DNA, 22 bp, Artificial Sequence
  chemically synthesized
tatttcatcctttcaattagta

SEQ ID NO: 762880 - DNA, 22 bp, Artificial Sequence
  chemically synthesized
caaagaaatgcatactaattga

SEQ ID NO: 762881 - DNA, 22 bp, Artificial Sequence
  chemically synthesized
tttcatcctttcaattagtatg

SEQ ID NO: 762882 - DNA, 22 bp, Artificial Sequence
  chemically synthesized
tacaaagaaatgcatactaatt

SEQ ID NO: 762883 - DNA, 22 bp, Artificial Sequence
  chemically synthesized
ctacaaagaaatgcatactaat

SEQ ID NO: 762884 - DNA, 22 bp, Artificial Sequence
  chemically synthesized
catcctttcaattagtatgcat

SEQ ID NO: 762885 - DNA, 22 bp, Artificial Sequence
  chemically synthesized
atcctttcaattagtatgcatt

SEQ ID NO: 762886 - DNA, 22 bp, Artificial Sequence
  chemically synthesized
tcaattagtatgcatttctttg

SEQ ID NO: 762887 - DNA, 22 bp, Artificial Sequence
  chemically synthesized
caattagtatgcatttctttgt

SEQ ID NO: 762888 - DNA, 22 bp, Artificial Sequence
  chemically synthesized
aattagtatgcatttctttgta

SEQ ID NO: 762889 - DNA, 22 bp, Artificial Sequence
  chemically synthesized
gtatgcatttctttgtagaagt

SEQ ID NO: 762890 - DNA, 22 bp, Artificial Sequence
  chemically synthesized
ctttgtagaagtttccttcttt

SEQ ID NO: 762891 - DNA, 22 bp, Artificial Sequence
  chemically synthesized
tttgtagaagtttccttctttc

SEQ ID NO: 762892 - DNA, 22 bp, Artificial Sequence
  chemically synthesized
tgtagaagtttccttctttctt

SEQ ID NO: 762893 - DNA, 22 bp, Artificial Sequence
  chemically synthesized
gtagaagtttccttctttcttt

SEQ ID NO: 762894 - DNA, 22 bp, Artificial Sequence
  chemically synthesized
tagaagtttccttctttcttta

SEQ ID NO: 762895 - DNA, 22 bp, Artificial Sequence
  chemically synthesized
ccttctttctttatatgctacg

SEQ ID NO: 762896 - DNA, 22 bp, Artificial Sequence
  chemically synthesized
cttctttctttatatgctacgg

SEQ ID NO: 762897 - DNA, 22 bp, Artificial Sequence
  chemically synthesized
accaccatatgataccgtagca

SEQ ID NO: 762898 - DNA, 22 bp, Artificial Sequence
  chemically synthesized
ctttctttatatgctacggtat

SEQ ID NO: 762899 - DNA, 22 bp, Artificial Sequence
  chemically synthesized
aaccaccatatgataccgtagc

SEQ ID NO: 762900 - DNA, 22 bp, Artificial Sequence
  chemically synthesized
tttctttatatgctacggtatc

SEQ ID NO: 762901 - DNA, 22 bp, Artificial Sequence
  chemically synthesized
taaccaccatatgataccgtag

SEQ ID NO: 762902 - DNA, 22 bp, Artificial Sequence
  chemically synthesized
ttaaccaccatatgataccgta

SEQ ID NO: 762903 - DNA, 22 bp, Artificial Sequence
  chemically synthesized
tctttatatgctacggtatcat

SEQ ID NO: 762904 - DNA, 22 bp, Artificial Sequence
  chemically synthesized
ctttatatgctacggtatcata

SEQ ID NO: 762905 - DNA, 22 bp, Artificial Sequence
  chemically synthesized
tttatatgctacggtatcatat

SEQ ID NO: 762906 - DNA, 22 bp, Artificial Sequence
  chemically synthesized
tatatgctacggtatcatatgg

SEQ ID NO: 762907 - DNA, 22 bp, Artificial Sequence
  chemically synthesized
aacttttaaccaccatatgata

SEQ ID NO: 762908 - DNA, 22 bp, Artificial Sequence
  chemically synthesized
atatgctacggtatcatatggt

SEQ ID NO: 762909 - DNA, 22 bp, Artificial Sequence
  chemically synthesized
tatgctacggtatcatatggtg

SEQ ID NO: 762910 - DNA, 22 bp, Artificial Sequence
  chemically synthesized
agagtctgaacttttaaccacc

SEQ ID NO: 762911 - DNA, 22 bp, Artificial Sequence
  chemically synthesized
cggtatcatatggtggttaaaa

SEQ ID NO: 762912 - DNA, 22 bp, Artificial Sequence
  chemically synthesized
cagagtctgaacttttaaccac

SEQ ID NO: 762913 - DNA, 22 bp, Artificial Sequence
  chemically synthesized
acttcagagtctgaacttttaa

SEQ ID NO: 762914 - DNA, 22 bp, Artificial Sequence
  chemically synthesized
aaagttcagactctgaagtcag

SEQ ID NO: 762915 - DNA, 22 bp, Artificial Sequence
  chemically synthesized
agactctgaagtcagactccct

SEQ ID NO: 762916 - DNA, 22 bp, Artificial Sequence
  chemically synthesized
tgaagtcagactccctgatttc

SEQ ID NO: 762917 - DNA, 22 bp, Artificial Sequence
  chemically synthesized
aagtcagactccctgatttctt

SEQ ID NO: 762918 - DNA, 22 bp, Artificial Sequence
  chemically synthesized
cctgatttctttttcttttact

SEQ ID NO: 762919 - DNA, 22 bp, Artificial Sequence
  chemically synthesized
atttctttttcttttacttttt

SEQ ID NO: 762920 - DNA, 22 bp, Artificial Sequence
  chemically synthesized
aaaagaaaaaagaaaaaagtaa

SEQ ID NO: 762921 - DNA, 22 bp, Artificial Sequence
  chemically synthesized
ctttttcttttacttttttctt

SEQ ID NO: 762922 - DNA, 22 bp, Artificial Sequence
  chemically synthesized
tttttcttttacttttttcttt

SEQ ID NO: 762923 - DNA, 22 bp, Artificial Sequence
  chemically synthesized
tctcaaaagaaaaaagaaaaaa

SEQ ID NO: 762924 - DNA, 22 bp, Artificial Sequence
  chemically synthesized
tttcttttacttttttcttttt

SEQ ID NO: 762925 - DNA, 22 bp, Artificial Sequence
  chemically synthesized
tgtctcaaaagaaaaaagaaaa

SEQ ID NO: 762926 - DNA, 22 bp, Artificial Sequence
  chemically synthesized
ttcttttacttttttctttttt

SEQ ID NO: 762927 - DNA, 22 bp, Artificial Sequence
  chemically synthesized
tcttttacttttttcttttttc

SEQ ID NO: 762928 - DNA, 22 bp, Artificial Sequence
  chemically synthesized
cttttacttttttcttttttct

SEQ ID NO: 762929 - DNA, 22 bp, Artificial Sequence
  chemically synthesized
ttttacttttttcttttttctt

SEQ ID NO: 762930 - DNA, 22 bp, Artificial Sequence
  chemically synthesized
ttacttttttcttttttctttt

SEQ ID NO: 762931 - DNA, 22 bp, Artificial Sequence
  chemically synthesized
tacttttttcttttttcttttg

SEQ ID NO: 762932 - DNA, 22 bp, Artificial Sequence
  chemically synthesized
acttttttcttttttcttttga

SEQ ID NO: 762933 - DNA, 22 bp, Artificial Sequence
  chemically synthesized
cttttttcttttttcttttgag

SEQ ID NO: 762934 - DNA, 22 bp, Artificial Sequence
  chemically synthesized
ttttcttttttcttttgagaca

SEQ ID NO: 762935 - DNA, 22 bp, Artificial Sequence
  chemically synthesized
tttcttttttcttttgagacag

SEQ ID NO: 762936 - DNA, 22 bp, Artificial Sequence
  chemically synthesized
ttcttttttcttttgagacaga

SEQ ID NO: 762937 - DNA, 22 bp, Artificial Sequence
  chemically synthesized
tcttttttcttttgagacagag

SEQ ID NO: 762938 - DNA, 22 bp, Artificial Sequence
  chemically synthesized
cttttttcttttgagacagagt

SEQ ID NO: 762939 - DNA, 22 bp, Artificial Sequence
  chemically synthesized
ttttttcttttgagacagagtc

SEQ ID NO: 762940 - DNA, 22 bp, Artificial Sequence
  chemically synthesized
ggggacagagtgagactctgtc

SEQ ID NO: 762941 - DNA, 22 bp, Artificial Sequence
  chemically synthesized
ttttcttttgagacagagtctc

SEQ ID NO: 762942 - DNA, 22 bp, Artificial Sequence
  chemically synthesized
tttcttttgagacagagtctca

SEQ ID NO: 762943 - DNA, 22 bp, Artificial Sequence
  chemically synthesized
ttcttttgagacagagtctcac

SEQ ID NO: 762944 - DNA, 22 bp, Artificial Sequence
  chemically synthesized
tcttttgagacagagtctcact

SEQ ID NO: 762945 - DNA, 22 bp, Artificial Sequence
  chemically synthesized
cttttgagacagagtctcactc

SEQ ID NO: 762946 - DNA, 22 bp, Artificial Sequence
  chemically synthesized
ttttgagacagagtctcactct

SEQ ID NO: 762947 - DNA, 22 bp, Artificial Sequence
  chemically synthesized
cagcctaggggacagagtgaga

SEQ ID NO: 762948 - DNA, 22 bp, Artificial Sequence
  chemically synthesized
ttgagacagagtctcactctgt

SEQ ID NO: 762949 - DNA, 22 bp, Artificial Sequence
  chemically synthesized
tgagacagagtctcactctgtc

SEQ ID NO: 762950 - DNA, 22 bp, Artificial Sequence
  chemically synthesized
gagacagagtctcactctgtcc

SEQ ID NO: 762951 - DNA, 22 bp, Artificial Sequence
  chemically synthesized
agacagagtctcactctgtccc

SEQ ID NO: 762952 - DNA, 22 bp, Artificial Sequence
  chemically synthesized
actccagcctaggggacagagt

SEQ ID NO: 762953 - DNA, 22 bp, Artificial Sequence
  chemically synthesized
cactccagcctaggggacagag

SEQ ID NO: 762954 - DNA, 22 bp, Artificial Sequence
  chemically synthesized
actctgtcccctaggctggagt

SEQ ID NO: 762955 - DNA, 22 bp, Artificial Sequence
  chemically synthesized
tgtcccctaggctggagtgaag

SEQ ID NO: 762956 - DNA, 22 bp, Artificial Sequence
  chemically synthesized
tcccctaggctggagtgaagtg

SEQ ID NO: 762957 - DNA, 22 bp, Artificial Sequence
  chemically synthesized
ggctggagtgaagtggtgcgat

SEQ ID NO: 762958 - DNA, 22 bp, Artificial Sequence
  chemically synthesized
cagtgagccgagatcgcaccac

SEQ ID NO: 762959 - DNA, 22 bp, Artificial Sequence
  chemically synthesized
gagtgaagtggtgcgatctcgg

SEQ ID NO: 762960 - DNA, 22 bp, Artificial Sequence
  chemically synthesized
aacccgggaggtggaggttgca

SEQ ID NO: 762961 - DNA, 22 bp, Artificial Sequence
  chemically synthesized
gaacccgggaggtggaggttgc

SEQ ID NO: 762962 - DNA, 22 bp, Artificial Sequence
  chemically synthesized
ggctcactgcaacctccacctc

SEQ ID NO: 762963 - DNA, 22 bp, Artificial Sequence
  chemically synthesized
actgcaacctccacctcccggg

SEQ ID NO: 762964 - DNA, 22 bp, Artificial Sequence
  chemically synthesized
caacctccacctcccgggttca

SEQ ID NO: 762965 - DNA, 22 bp, Artificial Sequence
  chemically synthesized
aggcaggagaatcgcttgaacc

SEQ ID NO: 762966 - DNA, 22 bp, Artificial Sequence
  chemically synthesized
cacctcccgggttcaagcgatt

SEQ ID NO: 762967 - DNA, 22 bp, Artificial Sequence
  chemically synthesized
ccgggttcaagcgattctcctg

SEQ ID NO: 762968 - DNA, 22 bp, Artificial Sequence
  chemically synthesized
aggaggctgaggcaggagaatc

SEQ ID NO: 762969 - DNA, 22 bp, Artificial Sequence
  chemically synthesized
ctcaggaggctgaggcaggaga

SEQ ID NO: 762970 - DNA, 22 bp, Artificial Sequence
  chemically synthesized
aagcgattctcctgcctcagcc

SEQ ID NO: 762971 - DNA, 22 bp, Artificial Sequence
  chemically synthesized
tagtcccagctactcaggaggc

SEQ ID NO: 762972 - DNA, 22 bp, Artificial Sequence
  chemically synthesized
tcctgcctcagcctcctgagta

SEQ ID NO: 762973 - DNA, 22 bp, Artificial Sequence
  chemically synthesized
ctgcctcagcctcctgagtagc

SEQ ID NO: 762974 - DNA, 22 bp, Artificial Sequence
  chemically synthesized
cctcagcctcctgagtagctgg

SEQ ID NO: 762975 - DNA, 22 bp, Artificial Sequence
  chemically synthesized
agcctcctgagtagctgggact

SEQ ID NO: 762976 - DNA, 22 bp, Artificial Sequence
  chemically synthesized
ctgagtagctgggactacaggc

SEQ ID NO: 762977 - DNA, 22 bp, Artificial Sequence
  chemically synthesized
agtagctgggactacaggcgcg

SEQ ID NO: 762978 - DNA, 22 bp, Artificial Sequence
  chemically synthesized
ggcatggtggcacgcgcctgta

SEQ ID NO: 762979 - DNA, 22 bp, Artificial Sequence
  chemically synthesized
gctgggcatggtggcacgcgcc

SEQ ID NO: 762980 - DNA, 22 bp, Artificial Sequence
  chemically synthesized
ggactacaggcgcgtgccacca

SEQ ID NO: 762981 - DNA, 22 bp, Artificial Sequence
  chemically synthesized
caggcgcgtgccaccatgccca

SEQ ID NO: 762982 - DNA, 22 bp, Artificial Sequence
  chemically synthesized
ccaaaaatacaaaaattagctg

SEQ ID NO: 762983 - DNA, 22 bp, Artificial Sequence
  chemically synthesized
taccaaaaatacaaaaattagc

SEQ ID NO: 762984 - DNA, 22 bp, Artificial Sequence
  chemically synthesized
atttttgtatttttggtagaga

SEQ ID NO: 762985 - DNA, 22 bp, Artificial Sequence
  chemically synthesized
ttgtatttttggtagagacggg

SEQ ID NO: 762986 - DNA, 22 bp, Artificial Sequence
  chemically synthesized
tgtatttttggtagagacggga

SEQ ID NO: 762987 - DNA, 22 bp, Artificial Sequence
  chemically synthesized
gtatttttggtagagacgggat

SEQ ID NO: 762988 - DNA, 22 bp, Artificial Sequence
  chemically synthesized
tatttttggtagagacgggatt

SEQ ID NO: 762989 - DNA, 22 bp, Artificial Sequence
  chemically synthesized
gccaacatggtgaaatcccgtc

SEQ ID NO: 762990 - DNA, 22 bp, Artificial Sequence
  chemically synthesized
ttggtagagacgggatttcacc

SEQ ID NO: 762991 - DNA, 22 bp, Artificial Sequence
  chemically synthesized
tggtagagacgggatttcacca

SEQ ID NO: 762992 - DNA, 22 bp, Artificial Sequence
  chemically synthesized
ggtagagacgggatttcaccat

SEQ ID NO: 762993 - DNA, 22 bp, Artificial Sequence
  chemically synthesized
gtagagacgggatttcaccatg

SEQ ID NO: 762994 - DNA, 22 bp, Artificial Sequence
  chemically synthesized
caccatgttggccaggatggtc

SEQ ID NO: 762995 - DNA, 22 bp, Artificial Sequence
  chemically synthesized
accatgttggccaggatggtct

SEQ ID NO: 762996 - DNA, 22 bp, Artificial Sequence
  chemically synthesized
gccaggatggtctcgatctctt

SEQ ID NO: 762997 - DNA, 22 bp, Artificial Sequence
  chemically synthesized
gatctcttgacctcgtgatcca

SEQ ID NO: 762998 - DNA, 22 bp, Artificial Sequence
  chemically synthesized
ggaggccgaggcaggtggatca

SEQ ID NO: 762999 - DNA, 22 bp, Artificial Sequence
  chemically synthesized
gggaggccgaggcaggtggatc

SEQ ID NO: 763000 - DNA, 22 bp, Artificial Sequence
  chemically synthesized
tgggaggccgaggcaggtggat

SEQ ID NO: 763001 - DNA, 22 bp, Artificial Sequence
  chemically synthesized
ttgacctcgtgatccacctgcc

SEQ ID NO: 763002 - DNA, 22 bp, Artificial Sequence
  chemically synthesized
gacctcgtgatccacctgcctc

SEQ ID NO: 763003 - DNA, 22 bp, Artificial Sequence
  chemically synthesized
acctcgtgatccacctgcctcg

SEQ ID NO: 763004 - DNA, 22 bp, Artificial Sequence
  chemically synthesized
gtgatccacctgcctcggcctc

SEQ ID NO: 763005 - DNA, 22 bp, Artificial Sequence
  chemically synthesized
taatcccagcactttgggaggc

SEQ ID NO: 763006 - DNA, 22 bp, Artificial Sequence
  chemically synthesized
cctcggcctcccaaagtgctgg

SEQ ID NO: 763007 - DNA, 22 bp, Artificial Sequence
  chemically synthesized
acgcctgtaatcccagcacttt

SEQ ID NO: 763008 - DNA, 22 bp, Artificial Sequence
  chemically synthesized
ggcctcccaaagtgctgggatt

SEQ ID NO: 763009 - DNA, 22 bp, Artificial Sequence
  chemically synthesized
ccaaagtgctgggattacaggc

SEQ ID NO: 763010 - DNA, 22 bp, Artificial Sequence
  chemically synthesized
ggattacaggcgtgagccacta

SEQ ID NO: 763011 - DNA, 22 bp, Artificial Sequence
  chemically synthesized
ggtgggccaggcgtagtggctc

SEQ ID NO: 763012 - DNA, 22 bp, Artificial Sequence
  chemically synthesized
caggcgtgagccactacgcctg

SEQ ID NO: 763013 - DNA, 22 bp, Artificial Sequence
  chemically synthesized
cgcctggcccacccagactccc

SEQ ID NO: 763014 - DNA, 22 bp, Artificial Sequence
  chemically synthesized
gcccacccagactccctgtttt

SEQ ID NO: 763015 - DNA, 22 bp, Artificial Sequence
  chemically synthesized
gcaagtggaagatacaagatga

SEQ ID NO: 763016 - DNA, 22 bp, Artificial Sequence
  chemically synthesized
agcaagtggaagatacaagatg

SEQ ID NO: 763017 - DNA, 22 bp, Artificial Sequence
  chemically synthesized
cctgttttcatcttgtatcttc

SEQ ID NO: 763018 - DNA, 22 bp, Artificial Sequence
  chemically synthesized
ttttcatcttgtatcttccact

SEQ ID NO: 763019 - DNA, 22 bp, Artificial Sequence
  chemically synthesized
gggtcacttagcaagtggaaga

SEQ ID NO: 763020 - DNA, 22 bp, Artificial Sequence
  chemically synthesized
agggtcacttagcaagtggaag

SEQ ID NO: 763021 - DNA, 22 bp, Artificial Sequence
  chemically synthesized
tcatcttgtatcttccacttgc

SEQ ID NO: 763022 - DNA, 22 bp, Artificial Sequence
  chemically synthesized
catcttgtatcttccacttgct

SEQ ID NO: 763023 - DNA, 22 bp, Artificial Sequence
  chemically synthesized
atcttgtatcttccacttgcta

SEQ ID NO: 763024 - DNA, 22 bp, Artificial Sequence
  chemically synthesized
cttagggtcacttagcaagtgg

SEQ ID NO: 763025 - DNA, 22 bp, Artificial Sequence
  chemically synthesized
ccttagggtcacttagcaagtg

SEQ ID NO: 763026 - DNA, 22 bp, Artificial Sequence
  chemically synthesized
gtatcttccacttgctaagtga

SEQ ID NO: 763027 - DNA, 22 bp, Artificial Sequence
  chemically synthesized
tatcttccacttgctaagtgac

SEQ ID NO: 763028 - DNA, 22 bp, Artificial Sequence
  chemically synthesized
aataatttccttagggtcactt

SEQ ID NO: 763029 - DNA, 22 bp, Artificial Sequence
  chemically synthesized
ccacttgctaagtgaccctaag

SEQ ID NO: 763030 - DNA, 22 bp, Artificial Sequence
  chemically synthesized
cacttgctaagtgaccctaagg

SEQ ID NO: 763031 - DNA, 22 bp, Artificial Sequence
  chemically synthesized
gctaagtgaccctaaggaaatt

SEQ ID NO: 763032 - DNA, 22 bp, Artificial Sequence
  chemically synthesized
ctaagtgaccctaaggaaatta

SEQ ID NO: 763033 - DNA, 22 bp, Artificial Sequence
  chemically synthesized
agtgaccctaaggaaattattt

SEQ ID NO: 763034 - DNA, 22 bp, Artificial Sequence
  chemically synthesized
aggaaattatttagcctctctg

SEQ ID NO: 763035 - DNA, 22 bp, Artificial Sequence
  chemically synthesized
aagaaagtgaggcacagagagg

SEQ ID NO: 763036 - DNA, 22 bp, Artificial Sequence
  chemically synthesized
gaagaaagtgaggcacagagag

SEQ ID NO: 763037 - DNA, 22 bp, Artificial Sequence
  chemically synthesized
catttgaagaaagtgaggcaca

SEQ ID NO: 763038 - DNA, 22 bp, Artificial Sequence
  chemically synthesized
tttagcctctctgtgcctcact

SEQ ID NO: 763039 - DNA, 22 bp, Artificial Sequence
  chemically synthesized
acatttgaagaaagtgaggcac

SEQ ID NO: 763040 - DNA, 22 bp, Artificial Sequence
  chemically synthesized
tacatttgaagaaagtgaggca

SEQ ID NO: 763041 - DNA, 22 bp, Artificial Sequence
  chemically synthesized
ttacatttgaagaaagtgaggc

SEQ ID NO: 763042 - DNA, 22 bp, Artificial Sequence
  chemically synthesized
agcctctctgtgcctcactttc

SEQ ID NO: 763043 - DNA, 22 bp, Artificial Sequence
  chemically synthesized
tttacatttgaagaaagtgagg

SEQ ID NO: 763044 - DNA, 22 bp, Artificial Sequence
  chemically synthesized
gcctctctgtgcctcactttct

SEQ ID NO: 763045 - DNA, 22 bp, Artificial Sequence
  chemically synthesized
tttttacatttgaagaaagtga

SEQ ID NO: 763046 - DNA, 22 bp, Artificial Sequence
  chemically synthesized
tctgtgcctcactttcttcaaa

SEQ ID NO: 763047 - DNA, 22 bp, Artificial Sequence
  chemically synthesized
aattctttttacatttgaagaa

SEQ ID NO: 763048 - DNA, 22 bp, Artificial Sequence
  chemically synthesized
tgtgcctcactttcttcaaatg

SEQ ID NO: 763049 - DNA, 22 bp, Artificial Sequence
  chemically synthesized
tgcctcactttcttcaaatgta

SEQ ID NO: 763050 - DNA, 22 bp, Artificial Sequence
  chemically synthesized
ttgaattctttttacatttgaa

SEQ ID NO: 763051 - DNA, 22 bp, Artificial Sequence
  chemically synthesized
ttattgaattctttttacattt

SEQ ID NO: 763052 - DNA, 22 bp, Artificial Sequence
  chemically synthesized
attattgaattctttttacatt

SEQ ID NO: 763053 - DNA, 22 bp, Artificial Sequence
  chemically synthesized
tattattgaattctttttacat

SEQ ID NO: 763054 - DNA, 22 bp, Artificial Sequence
  chemically synthesized
actttcttcaaatgtaaaaaga

SEQ ID NO: 763055 - DNA, 22 bp, Artificial Sequence
  chemically synthesized
tcttcaaatgtaaaaagaattc

SEQ ID NO: 763056 - DNA, 22 bp, Artificial Sequence
  chemically synthesized
cttcaaatgtaaaaagaattca

SEQ ID NO: 763057 - DNA, 22 bp, Artificial Sequence
  chemically synthesized
ttcaaatgtaaaaagaattcaa

SEQ ID NO: 763058 - DNA, 22 bp, Artificial Sequence
  chemically synthesized
caaatgtaaaaagaattcaata

SEQ ID NO: 763059 - DNA, 22 bp, Artificial Sequence
  chemically synthesized
aaatgtaaaaagaattcaataa

SEQ ID NO: 763060 - DNA, 22 bp, Artificial Sequence
  chemically synthesized
agaggtagattttattattgaa

SEQ ID NO: 763061 - DNA, 22 bp, Artificial Sequence
  chemically synthesized
agcaaccctaagaggtagattt

SEQ ID NO: 763062 - DNA, 22 bp, Artificial Sequence
  chemically synthesized
tcagcaaccctaagaggtagat

SEQ ID NO: 763063 - DNA, 22 bp, Artificial Sequence
  chemically synthesized
aataataaaatctacctcttag

SEQ ID NO: 763064 - DNA, 22 bp, Artificial Sequence
  chemically synthesized
atgctctcagcaaccctaagag

SEQ ID NO: 763065 - DNA, 22 bp, Artificial Sequence
  chemically synthesized
aatgctctcagcaaccctaaga

SEQ ID NO: 763066 - DNA, 22 bp, Artificial Sequence
  chemically synthesized
accggtttaatgctctcagcaa

SEQ ID NO: 763067 - DNA, 22 bp, Artificial Sequence
  chemically synthesized
cctcttagggttgctgagagca

SEQ ID NO: 763068 - DNA, 22 bp, Artificial Sequence
  chemically synthesized
attgaccggtttaatgctctca

SEQ ID NO: 763069 - DNA, 22 bp, Artificial Sequence
  chemically synthesized
ttagggttgctgagagcattaa

SEQ ID NO: 763070 - DNA, 22 bp, Artificial Sequence
  chemically synthesized
agggttgctgagagcattaaac

SEQ ID NO: 763071 - DNA, 22 bp, Artificial Sequence
  chemically synthesized
gggttgctgagagcattaaacc

SEQ ID NO: 763072 - DNA, 22 bp, Artificial Sequence
  chemically synthesized
cattcattgaccggtttaatgc

SEQ ID NO: 763073 - DNA, 22 bp, Artificial Sequence
  chemically synthesized
ccattcattgaccggtttaatg

SEQ ID NO: 763074 - DNA, 22 bp, Artificial Sequence
  chemically synthesized
tccattcattgaccggtttaat

SEQ ID NO: 763075 - DNA, 22 bp, Artificial Sequence
  chemically synthesized
ctgagagcattaaaccggtcaa

SEQ ID NO: 763076 - DNA, 22 bp, Artificial Sequence
  chemically synthesized
agagcattaaaccggtcaatga

SEQ ID NO: 763077 - DNA, 22 bp, Artificial Sequence
  chemically synthesized
aaccggtcaatgaatggaaagt

SEQ ID NO: 763078 - DNA, 22 bp, Artificial Sequence
  chemically synthesized
cataccacgcaatgccataagc

SEQ ID NO: 763079 - DNA, 22 bp, Artificial Sequence
  chemically synthesized
catgatgtacctacataccacg

SEQ ID NO: 763080 - DNA, 22 bp, Artificial Sequence
  chemically synthesized
acatgatgtacctacataccac

SEQ ID NO: 763081 - DNA, 22 bp, Artificial Sequence
  chemically synthesized
atggcattgcgtggtatgtagg

SEQ ID NO: 763082 - DNA, 22 bp, Artificial Sequence
  chemically synthesized
tggcattgcgtggtatgtaggt

SEQ ID NO: 763083 - DNA, 22 bp, Artificial Sequence
  chemically synthesized
atatttacatgatgtacctaca

SEQ ID NO: 763084 - DNA, 22 bp, Artificial Sequence
  chemically synthesized
cgtggtatgtaggtacatcatg

SEQ ID NO: 763085 - DNA, 22 bp, Artificial Sequence
  chemically synthesized
catcaagtatgaaataatgata

SEQ ID NO: 763086 - DNA, 22 bp, Artificial Sequence
  chemically synthesized
gttgctatcattatttcatact

SEQ ID NO: 763087 - DNA, 22 bp, Artificial Sequence
  chemically synthesized
taaatgtctgcatcaagtatga

SEQ ID NO: 763088 - DNA, 22 bp, Artificial Sequence
  chemically synthesized
ctatcattatttcatacttgat

SEQ ID NO: 763089 - DNA, 22 bp, Artificial Sequence
  chemically synthesized
ttgtaaatgtctgcatcaagta

SEQ ID NO: 763090 - DNA, 22 bp, Artificial Sequence
  chemically synthesized
tcattatttcatacttgatgca

SEQ ID NO: 763091 - DNA, 22 bp, Artificial Sequence
  chemically synthesized
tttcatacttgatgcagacatt

SEQ ID NO: 763092 - DNA, 22 bp, Artificial Sequence
  chemically synthesized
catacttgatgcagacatttac

SEQ ID NO: 763093 - DNA, 22 bp, Artificial Sequence
  chemically synthesized
agaagcactattgtaaatgtct

SEQ ID NO: 763094 - DNA, 22 bp, Artificial Sequence
  chemically synthesized
atacttgatgcagacatttaca

SEQ ID NO: 763095 - DNA, 22 bp, Artificial Sequence
  chemically synthesized
gatgcagacatttacaatagtg

SEQ ID NO: 763096 - DNA, 22 bp, Artificial Sequence
  chemically synthesized
gtaattcagaagcactattgta

SEQ ID NO: 763097 - DNA, 22 bp, Artificial Sequence
  chemically synthesized
atgcagacatttacaatagtgc

SEQ ID NO: 763098 - DNA, 22 bp, Artificial Sequence
  chemically synthesized
agtaattcagaagcactattgt

SEQ ID NO: 763099 - DNA, 22 bp, Artificial Sequence
  chemically synthesized
tagtaattcagaagcactattg

SEQ ID NO: 763100 - DNA, 22 bp, Artificial Sequence
  chemically synthesized
ttagtaattcagaagcactatt

SEQ ID NO: 763101 - DNA, 22 bp, Artificial Sequence
  chemically synthesized
catttttagtaattcagaagca

SEQ ID NO: 763102 - DNA, 22 bp, Artificial Sequence
  chemically synthesized
acaatagtgcttctgaattact

SEQ ID NO: 763103 - DNA, 22 bp, Artificial Sequence
  chemically synthesized
caatagtgcttctgaattacta

SEQ ID NO: 763104 - DNA, 22 bp, Artificial Sequence
  chemically synthesized
taaggaggaaaatctgcatttt

SEQ ID NO: 763105 - DNA, 22 bp, Artificial Sequence
  chemically synthesized
ctgaattactaaaaatgcagat

SEQ ID NO: 763106 - DNA, 22 bp, Artificial Sequence
  chemically synthesized
tgaattactaaaaatgcagatt

SEQ ID NO: 763107 - DNA, 22 bp, Artificial Sequence
  chemically synthesized
tataaggaggaaaatctgcatt

SEQ ID NO: 763108 - DNA, 22 bp, Artificial Sequence
  chemically synthesized
ctataaggaggaaaatctgcat

SEQ ID NO: 763109 - DNA, 22 bp, Artificial Sequence
  chemically synthesized
aattactaaaaatgcagatttt

SEQ ID NO: 763110 - DNA, 22 bp, Artificial Sequence
  chemically synthesized
ctaaaaatgcagattttcctcc

SEQ ID NO: 763111 - DNA, 22 bp, Artificial Sequence
  chemically synthesized
aaaatgcagattttcctcctta

SEQ ID NO: 763112 - DNA, 22 bp, Artificial Sequence
  chemically synthesized
acatatatacttctataaggag

SEQ ID NO: 763113 - DNA, 22 bp, Artificial Sequence
  chemically synthesized
aacatatatacttctataagga

SEQ ID NO: 763114 - DNA, 22 bp, Artificial Sequence
  chemically synthesized
taacatatatacttctataagg

SEQ ID NO: 763115 - DNA, 22 bp, Artificial Sequence
  chemically synthesized
tcctccttatagaagtatatat

SEQ ID NO: 763116 - DNA, 22 bp, Artificial Sequence
  chemically synthesized
cctccttatagaagtatatatg

SEQ ID NO: 763117 - DNA, 22 bp, Artificial Sequence
  chemically synthesized
ctccttatagaagtatatatgt

SEQ ID NO: 763118 - DNA, 22 bp, Artificial Sequence
  chemically synthesized
tccaaaattttaacatatatac

SEQ ID NO: 763119 - DNA, 22 bp, Artificial Sequence
  chemically synthesized
gtccaaaattttaacatatata

SEQ ID NO: 763120 - DNA, 22 bp, Artificial Sequence
  chemically synthesized
cttatagaagtatatatgttaa

SEQ ID NO: 763121 - DNA, 22 bp, Artificial Sequence
  chemically synthesized
acttgtccaaaattttaacata

SEQ ID NO: 763122 - DNA, 22 bp, Artificial Sequence
  chemically synthesized
atagaagtatatatgttaaaat

SEQ ID NO: 763123 - DNA, 22 bp, Artificial Sequence
  chemically synthesized
tagaagtatatatgttaaaatt

SEQ ID NO: 763124 - DNA, 22 bp, Artificial Sequence
  chemically synthesized
taacttgtccaaaattttaaca

SEQ ID NO: 763125 - DNA, 22 bp, Artificial Sequence
  chemically synthesized
ctaacttgtccaaaattttaac

SEQ ID NO: 763126 - DNA, 22 bp, Artificial Sequence
  chemically synthesized
ttctaacttgtccaaaatttta

SEQ ID NO: 763127 - DNA, 22 bp, Artificial Sequence
  chemically synthesized
tagttcttctaacttgtccaaa

SEQ ID NO: 763128 - DNA, 22 bp, Artificial Sequence
  chemically synthesized
atagttcttctaacttgtccaa

SEQ ID NO: 763129 - DNA, 22 bp, Artificial Sequence
  chemically synthesized
tatagttcttctaacttgtcca

SEQ ID NO: 763130 - DNA, 22 bp, Artificial Sequence
  chemically synthesized
tttatagttcttctaacttgtc

SEQ ID NO: 763131 - DNA, 22 bp, Artificial Sequence
  chemically synthesized
ctttatagttcttctaacttgt

SEQ ID NO: 763132 - DNA, 22 bp, Artificial Sequence
  chemically synthesized
ttctttatagttcttctaactt

SEQ ID NO: 763133 - DNA, 22 bp, Artificial Sequence
  chemically synthesized
aaattttggacaagttagaaga

SEQ ID NO: 763134 - DNA, 22 bp, Artificial Sequence
  chemically synthesized
cttctttatagttcttctaact

SEQ ID NO: 763135 - DNA, 22 bp, Artificial Sequence
  chemically synthesized
tcttctttatagttcttctaac

SEQ ID NO: 763136 - DNA, 22 bp, Artificial Sequence
  chemically synthesized
ttcttctttatagttcttctaa

SEQ ID NO: 763137 - DNA, 22 bp, Artificial Sequence
  chemically synthesized
tttcttctttatagttcttcta

SEQ ID NO: 763138 - DNA, 22 bp, Artificial Sequence
  chemically synthesized
ttttcttctttatagttcttct

SEQ ID NO: 763139 - DNA, 22 bp, Artificial Sequence
  chemically synthesized
tttttcttctttatagttcttc

SEQ ID NO: 763140 - DNA, 22 bp, Artificial Sequence
  chemically synthesized
tggacaagttagaagaactata

SEQ ID NO: 763141 - DNA, 22 bp, Artificial Sequence
  chemically synthesized
ggacaagttagaagaactataa

SEQ ID NO: 763142 - DNA, 22 bp, Artificial Sequence
  chemically synthesized
gacaagttagaagaactataaa

SEQ ID NO: 763143 - DNA, 22 bp, Artificial Sequence
  chemically synthesized
gaagaactataaagaagaaaaa

SEQ ID NO: 763144 - DNA, 22 bp, Artificial Sequence
  chemically synthesized
cagaagggagattttttttctt

SEQ ID NO: 763145 - DNA, 22 bp, Artificial Sequence
  chemically synthesized
taaagaagaaaaaaaatctccc

SEQ ID NO: 763146 - DNA, 22 bp, Artificial Sequence
  chemically synthesized
ggtagaaagattacagaaggga

SEQ ID NO: 763147 - DNA, 22 bp, Artificial Sequence
  chemically synthesized
taggtagaaagattacagaagg

SEQ ID NO: 763148 - DNA, 22 bp, Artificial Sequence
  chemically synthesized
cctctaggtagaaagattacag

SEQ ID NO: 763149 - DNA, 22 bp, Artificial Sequence
  chemically synthesized
ctacctctaggtagaaagatta

SEQ ID NO: 763150 - DNA, 22 bp, Artificial Sequence
  chemically synthesized
ccttctgtaatctttctaccta

SEQ ID NO: 763151 - DNA, 22 bp, Artificial Sequence
  chemically synthesized
ctgtaatctttctacctagagg

SEQ ID NO: 763152 - DNA, 22 bp, Artificial Sequence
  chemically synthesized
tgtaatctttctacctagaggt

SEQ ID NO: 763153 - DNA, 22 bp, Artificial Sequence
  chemically synthesized
taatctttctacctagaggtag

SEQ ID NO: 763154 - DNA, 22 bp, Artificial Sequence
  chemically synthesized
aatgacgggagtagttactacc

SEQ ID NO: 763155 - DNA, 22 bp, Artificial Sequence
  chemically synthesized
tctacctagaggtagtaactac

SEQ ID NO: 763156 - DNA, 22 bp, Artificial Sequence
  chemically synthesized
ctacctagaggtagtaactact

SEQ ID NO: 763157 - DNA, 22 bp, Artificial Sequence
  chemically synthesized
tacctagaggtagtaactactc

SEQ ID NO: 763158 - DNA, 22 bp, Artificial Sequence
  chemically synthesized
cctagaggtagtaactactccc

SEQ ID NO: 763159 - DNA, 22 bp, Artificial Sequence
  chemically synthesized
gaggtagtaactactcccgtca

SEQ ID NO: 763160 - DNA, 22 bp, Artificial Sequence
  chemically synthesized
tgggagtatacactaaatgacg

SEQ ID NO: 763161 - DNA, 22 bp, Artificial Sequence
  chemically synthesized
ctcccgtcatttagtgtatact

SEQ ID NO: 763162 - DNA, 22 bp, Artificial Sequence
  chemically synthesized
ataatagttatgggagtataca

SEQ ID NO: 763163 - DNA, 22 bp, Artificial Sequence
  chemically synthesized
ccgtcatttagtgtatactccc

SEQ ID NO: 763164 - DNA, 22 bp, Artificial Sequence
  chemically synthesized
aataatagttatgggagtatac

SEQ ID NO: 763165 - DNA, 22 bp, Artificial Sequence
  chemically synthesized
agtgtatactcccataactatt

SEQ ID NO: 763166 - DNA, 22 bp, Artificial Sequence
  chemically synthesized
gtgtatactcccataactatta

SEQ ID NO: 763167 - DNA, 22 bp, Artificial Sequence
  chemically synthesized
ccataactattattaagtccat

SEQ ID NO: 763168 - DNA, 22 bp, Artificial Sequence
  chemically synthesized
ttattaagtccatttggtcatc

SEQ ID NO: 763169 - DNA, 22 bp, Artificial Sequence
  chemically synthesized
ttaagtccatttggtcatcttc

SEQ ID NO: 763170 - DNA, 22 bp, Artificial Sequence
  chemically synthesized
agtccatttggtcatcttctac

SEQ ID NO: 763171 - DNA, 22 bp, Artificial Sequence
  chemically synthesized
ggtcatcttctacctcccttca

SEQ ID NO: 763172 - DNA, 22 bp, Artificial Sequence
  chemically synthesized
gtcatcttctacctcccttcat

SEQ ID NO: 763173 - DNA, 22 bp, Artificial Sequence
  chemically synthesized
gagaaaaagtgataatgaaggg

SEQ ID NO: 763174 - DNA, 22 bp, Artificial Sequence
  chemically synthesized
ctacctcccttcattatcactt

SEQ ID NO: 763175 - DNA, 22 bp, Artificial Sequence
  chemically synthesized
tgtctagagaaaaagtgataat

SEQ ID NO: 763176 - DNA, 22 bp, Artificial Sequence
  chemically synthesized
tacctcccttcattatcacttt

SEQ ID NO: 763177 - DNA, 22 bp, Artificial Sequence
  chemically synthesized
tgtgtctagagaaaaagtgata

SEQ ID NO: 763178 - DNA, 22 bp, Artificial Sequence
  chemically synthesized
cctcccttcattatcacttttt

SEQ ID NO: 763179 - DNA, 22 bp, Artificial Sequence
  chemically synthesized
ctgtgtctagagaaaaagtgat

SEQ ID NO: 763180 - DNA, 22 bp, Artificial Sequence
  chemically synthesized
ttctgtgtctagagaaaaagtg

SEQ ID NO: 763181 - DNA, 22 bp, Artificial Sequence
  chemically synthesized
cttctgtgtctagagaaaaagt

SEQ ID NO: 763182 - DNA, 22 bp, Artificial Sequence
  chemically synthesized
ccttcattatcactttttctct

SEQ ID NO: 763183 - DNA, 22 bp, Artificial Sequence
  chemically synthesized
tcttctgtgtctagagaaaaag

SEQ ID NO: 763184 - DNA, 22 bp, Artificial Sequence
  chemically synthesized
cattatcactttttctctagac

SEQ ID NO: 763185 - DNA, 22 bp, Artificial Sequence
  chemically synthesized
attatcactttttctctagaca

SEQ ID NO: 763186 - DNA, 22 bp, Artificial Sequence
  chemically synthesized
tgctttcttctgtgtctagaga

SEQ ID NO: 763187 - DNA, 22 bp, Artificial Sequence
  chemically synthesized
gtgctttcttctgtgtctagag

SEQ ID NO: 763188 - DNA, 22 bp, Artificial Sequence
  chemically synthesized
tgtgctttcttctgtgtctaga

SEQ ID NO: 763189 - DNA, 22 bp, Artificial Sequence
  chemically synthesized
tcactttttctctagacacaga

SEQ ID NO: 763190 - DNA, 22 bp, Artificial Sequence
  chemically synthesized
tttctctagacacagaagaaag

SEQ ID NO: 763191 - DNA, 22 bp, Artificial Sequence
  chemically synthesized
ttctctagacacagaagaaagc

SEQ ID NO: 763192 - DNA, 22 bp, Artificial Sequence
  chemically synthesized
aaaatattttgtgctttcttct

SEQ ID NO: 763193 - DNA, 22 bp, Artificial Sequence
  chemically synthesized
tctctagacacagaagaaagca

SEQ ID NO: 763194 - DNA, 22 bp, Artificial Sequence
  chemically synthesized
ctctagacacagaagaaagcac

SEQ ID NO: 763195 - DNA, 22 bp, Artificial Sequence
  chemically synthesized
tctagacacagaagaaagcaca

SEQ ID NO: 763196 - DNA, 22 bp, Artificial Sequence
  chemically synthesized
ttaaaaatattttgtgctttct

SEQ ID NO: 763197 - DNA, 22 bp, Artificial Sequence
  chemically synthesized
attaaaaatattttgtgctttc

SEQ ID NO: 763198 - DNA, 22 bp, Artificial Sequence
  chemically synthesized
tagacacagaagaaagcacaaa

SEQ ID NO: 763199 - DNA, 22 bp, Artificial Sequence
  chemically synthesized
tattaaaaatattttgtgcttt

SEQ ID NO: 763200 - DNA, 22 bp, Artificial Sequence
  chemically synthesized
gacacagaagaaagcacaaaat

SEQ ID NO: 763201 - DNA, 22 bp, Artificial Sequence
  chemically synthesized
tttattaaaaatattttgtgct

SEQ ID NO: 763202 - DNA, 22 bp, Artificial Sequence
  chemically synthesized
tctttattaaaaatattttgtg

SEQ ID NO: 763203 - DNA, 22 bp, Artificial Sequence
  chemically synthesized
ctctttattaaaaatattttgt

SEQ ID NO: 763204 - DNA, 22 bp, Artificial Sequence
  chemically synthesized
atttctctttattaaaaatatt

SEQ ID NO: 763205 - DNA, 22 bp, Artificial Sequence
  chemically synthesized
attcatttctctttattaaaaa

SEQ ID NO: 763206 - DNA, 22 bp, Artificial Sequence
  chemically synthesized
aattcatttctctttattaaaa

SEQ ID NO: 763207 - DNA, 22 bp, Artificial Sequence
  chemically synthesized
ttaattcatttctctttattaa

SEQ ID NO: 763208 - DNA, 22 bp, Artificial Sequence
  chemically synthesized
cttaattcatttctctttatta

SEQ ID NO: 763209 - DNA, 22 bp, Artificial Sequence
  chemically synthesized
tcttaattcatttctctttatt

SEQ ID NO: 763210 - DNA, 22 bp, Artificial Sequence
  chemically synthesized
cctttcttaattcatttctctt

SEQ ID NO: 763211 - DNA, 22 bp, Artificial Sequence
  chemically synthesized
ttaataaagagaaatgaattaa

SEQ ID NO: 763212 - DNA, 22 bp, Artificial Sequence
  chemically synthesized
taataaagagaaatgaattaag

SEQ ID NO: 763213 - DNA, 22 bp, Artificial Sequence
  chemically synthesized
aataaagagaaatgaattaaga

SEQ ID NO: 763214 - DNA, 22 bp, Artificial Sequence
  chemically synthesized
agcagttgcctttcttaattca

SEQ ID NO: 763215 - DNA, 22 bp, Artificial Sequence
  chemically synthesized
ataaagagaaatgaattaagaa

SEQ ID NO: 763216 - DNA, 22 bp, Artificial Sequence
  chemically synthesized
taagcagttgcctttcttaatt

SEQ ID NO: 763217 - DNA, 22 bp, Artificial Sequence
  chemically synthesized
ctaagcagttgcctttcttaat

SEQ ID NO: 763218 - DNA, 22 bp, Artificial Sequence
  chemically synthesized
tctaagcagttgcctttcttaa

SEQ ID NO: 763219 - DNA, 22 bp, Artificial Sequence
  chemically synthesized
ctttctaagcagttgcctttct

SEQ ID NO: 763220 - DNA, 22 bp, Artificial Sequence
  chemically synthesized
ctgctttctaagcagttgcctt

SEQ ID NO: 763221 - DNA, 22 bp, Artificial Sequence
  chemically synthesized
cctgctttctaagcagttgcct

SEQ ID NO: 763222 - DNA, 22 bp, Artificial Sequence
  chemically synthesized
agaaaggcaactgcttagaaag

SEQ ID NO: 763223 - DNA, 22 bp, Artificial Sequence
  chemically synthesized
cttagaaagcaggaagcctggc

SEQ ID NO: 763224 - DNA, 22 bp, Artificial Sequence
  chemically synthesized
agaaagcaggaagcctggcttt

SEQ ID NO: 763225 - DNA, 22 bp, Artificial Sequence
  chemically synthesized
gaaagcaggaagcctggctttc

SEQ ID NO: 763226 - DNA, 22 bp, Artificial Sequence
  chemically synthesized
gcaagggcggggaatgaaagcc

SEQ ID NO: 763227 - DNA, 22 bp, Artificial Sequence
  chemically synthesized
aatgatctagcaagggcgggga

SEQ ID NO: 763228 - DNA, 22 bp, Artificial Sequence
  chemically synthesized
aaatgatctagcaagggcgggg

SEQ ID NO: 763229 - DNA, 22 bp, Artificial Sequence
  chemically synthesized
gctttcattccccgcccttgct

SEQ ID NO: 763230 - DNA, 22 bp, Artificial Sequence
  chemically synthesized
taacttaaatgatctagcaagg

SEQ ID NO: 763231 - DNA, 22 bp, Artificial Sequence
  chemically synthesized
tcattccccgcccttgctagat

SEQ ID NO: 763232 - DNA, 22 bp, Artificial Sequence
  chemically synthesized
cattccccgcccttgctagatc

SEQ ID NO: 763233 - DNA, 22 bp, Artificial Sequence
  chemically synthesized
attccccgcccttgctagatca

SEQ ID NO: 763234 - DNA, 22 bp, Artificial Sequence
  chemically synthesized
cccgcccttgctagatcattta

SEQ ID NO: 763235 - DNA, 22 bp, Artificial Sequence
  chemically synthesized
gctagatcatttaagttacaat

SEQ ID NO: 763236 - DNA, 22 bp, Artificial Sequence
  chemically synthesized
ctagatcatttaagttacaatg

SEQ ID NO: 763237 - DNA, 22 bp, Artificial Sequence
  chemically synthesized
gatcatttaagttacaatgggc

SEQ ID NO: 763238 - DNA, 22 bp, Artificial Sequence
  chemically synthesized
aagttacaatgggcgttttact

SEQ ID NO: 763239 - DNA, 22 bp, Artificial Sequence
  chemically synthesized
agttacaatgggcgttttactt

SEQ ID NO: 763240 - DNA, 22 bp, Artificial Sequence
  chemically synthesized
caatgggcgttttacttactat

SEQ ID NO: 763241 - DNA, 22 bp, Artificial Sequence
  chemically synthesized
cgtggaggaacaaaaggataga

SEQ ID NO: 763242 - DNA, 22 bp, Artificial Sequence
  chemically synthesized
tacttactatctctatcctttt

SEQ ID NO: 763243 - DNA, 22 bp, Artificial Sequence
  chemically synthesized
acttactatctctatccttttg

SEQ ID NO: 763244 - DNA, 22 bp, Artificial Sequence
  chemically synthesized
cttactatctctatccttttgt

SEQ ID NO: 763245 - DNA, 22 bp, Artificial Sequence
  chemically synthesized
actatctctatccttttgttcc

SEQ ID NO: 763246 - DNA, 22 bp, Artificial Sequence
  chemically synthesized
ctatctctatccttttgttcct

SEQ ID NO: 763247 - DNA, 22 bp, Artificial Sequence
  chemically synthesized
caatagttccgtggaggaacaa

SEQ ID NO: 763248 - DNA, 22 bp, Artificial Sequence
  chemically synthesized
tctctatccttttgttcctcca

SEQ ID NO: 763249 - DNA, 22 bp, Artificial Sequence
  chemically synthesized
gcaatagttccgtggaggaaca

SEQ ID NO: 763250 - DNA, 22 bp, Artificial Sequence
  chemically synthesized
tgcaatagttccgtggaggaac

SEQ ID NO: 763251 - DNA, 22 bp, Artificial Sequence
  chemically synthesized
tatccttttgttcctccacgga

SEQ ID NO: 763252 - DNA, 22 bp, Artificial Sequence
  chemically synthesized
tccttttgttcctccacggaac

SEQ ID NO: 763253 - DNA, 22 bp, Artificial Sequence
  chemically synthesized
taccagttttgcaatagttccg

SEQ ID NO: 763254 - DNA, 22 bp, Artificial Sequence
  chemically synthesized
ttgttcctccacggaactattg

SEQ ID NO: 763255 - DNA, 22 bp, Artificial Sequence
  chemically synthesized
tgttcctccacggaactattgc

SEQ ID NO: 763256 - DNA, 22 bp, Artificial Sequence
  chemically synthesized
gttcctccacggaactattgca

SEQ ID NO: 763257 - DNA, 22 bp, Artificial Sequence
  chemically synthesized
ttataccagttttgcaatagtt

SEQ ID NO: 763258 - DNA, 22 bp, Artificial Sequence
  chemically synthesized
ttcctccacggaactattgcaa

SEQ ID NO: 763259 - DNA, 22 bp, Artificial Sequence
  chemically synthesized
gttataccagttttgcaatagt

SEQ ID NO: 763260 - DNA, 22 bp, Artificial Sequence
  chemically synthesized
ttgttataccagttttgcaata

SEQ ID NO: 763261 - DNA, 22 bp, Artificial Sequence
  chemically synthesized
ctccacggaactattgcaaaac

SEQ ID NO: 763262 - DNA, 22 bp, Artificial Sequence
  chemically synthesized
cacggaactattgcaaaactgg

SEQ ID NO: 763263 - DNA, 22 bp, Artificial Sequence
  chemically synthesized
ttgcaaaactggtataacaaga

SEQ ID NO: 763264 - DNA, 22 bp, Artificial Sequence
  chemically synthesized
caaaactggtataacaagaact

SEQ ID NO: 763265 - DNA, 22 bp, Artificial Sequence
  chemically synthesized
taaaaagggcagagggaagttc

SEQ ID NO: 763266 - DNA, 22 bp, Artificial Sequence
  chemically synthesized
gtaaaaagggcagagggaagtt

SEQ ID NO: 763267 - DNA, 22 bp, Artificial Sequence
  chemically synthesized
tgtaaaaagggcagagggaagt

SEQ ID NO: 763268 - DNA, 22 bp, Artificial Sequence
  chemically synthesized
gtataacaagaacttccctctg

SEQ ID NO: 763269 - DNA, 22 bp, Artificial Sequence
  chemically synthesized
ccctctgccctttttacaaaga

SEQ ID NO: 763270 - DNA, 22 bp, Artificial Sequence
  chemically synthesized
cctctgccctttttacaaagat

SEQ ID NO: 763271 - DNA, 22 bp, Artificial Sequence
  chemically synthesized
tgccctttttacaaagatgcta

SEQ ID NO: 763272 - DNA, 22 bp, Artificial Sequence
  chemically synthesized
atggatgcatcatagcatcttt

SEQ ID NO: 763273 - DNA, 22 bp, Artificial Sequence
  chemically synthesized
ccctttttacaaagatgctatg

SEQ ID NO: 763274 - DNA, 22 bp, Artificial Sequence
  chemically synthesized
gttaatggatgcatcatagcat

SEQ ID NO: 763275 - DNA, 22 bp, Artificial Sequence
  chemically synthesized
tttacaaagatgctatgatgca

SEQ ID NO: 763276 - DNA, 22 bp, Artificial Sequence
  chemically synthesized
ttacaaagatgctatgatgcat

SEQ ID NO: 763277 - DNA, 22 bp, Artificial Sequence
  chemically synthesized
tacaaagatgctatgatgcatc

SEQ ID NO: 763278 - DNA, 22 bp, Artificial Sequence
  chemically synthesized
acaaagatgctatgatgcatcc

SEQ ID NO: 763279 - DNA, 22 bp, Artificial Sequence
  chemically synthesized
caaagatgctatgatgcatcca

SEQ ID NO: 763280 - DNA, 22 bp, Artificial Sequence
  chemically synthesized
gagaagttagttaatggatgca

SEQ ID NO: 763281 - DNA, 22 bp, Artificial Sequence
  chemically synthesized
ggagaagttagttaatggatgc

SEQ ID NO: 763282 - DNA, 22 bp, Artificial Sequence
  chemically synthesized
tggagaagttagttaatggatg

SEQ ID NO: 763283 - DNA, 22 bp, Artificial Sequence
  chemically synthesized
tttggagaagttagttaatgga

SEQ ID NO: 763284 - DNA, 22 bp, Artificial Sequence
  chemically synthesized
ctttggagaagttagttaatgg

SEQ ID NO: 763285 - DNA, 22 bp, Artificial Sequence
  chemically synthesized
tctttggagaagttagttaatg

SEQ ID NO: 763286 - DNA, 22 bp, Artificial Sequence
  chemically synthesized
tgatgcatccattaactaactt

SEQ ID NO: 763287 - DNA, 22 bp, Artificial Sequence
  chemically synthesized
tgtgccagctttctttggagaa

SEQ ID NO: 763288 - DNA, 22 bp, Artificial Sequence
  chemically synthesized
tatgtgccagctttctttggag

SEQ ID NO: 763289 - DNA, 22 bp, Artificial Sequence
  chemically synthesized
ctatgtgccagctttctttgga

SEQ ID NO: 763290 - DNA, 22 bp, Artificial Sequence
  chemically synthesized
actaacttctccaaagaaagct

SEQ ID NO: 763291 - DNA, 22 bp, Artificial Sequence
  chemically synthesized
acttctccaaagaaagctggca

SEQ ID NO: 763292 - DNA, 22 bp, Artificial Sequence
  chemically synthesized
cccccttctatgtgccagcttt

SEQ ID NO: 763293 - DNA, 22 bp, Artificial Sequence
  chemically synthesized
gcccccttctatgtgccagctt

SEQ ID NO: 763294 - DNA, 22 bp, Artificial Sequence
  chemically synthesized
tgcccccttctatgtgccagct

SEQ ID NO: 763295 - DNA, 22 bp, Artificial Sequence
  chemically synthesized
ctccaaagaaagctggcacata

SEQ ID NO: 763296 - DNA, 22 bp, Artificial Sequence
  chemically synthesized
tccaaagaaagctggcacatag

SEQ ID NO: 763297 - DNA, 22 bp, Artificial Sequence
  chemically synthesized
caaagaaagctggcacatagaa

SEQ ID NO: 763298 - DNA, 22 bp, Artificial Sequence
  chemically synthesized
tattttgcccccttctatgtgc

SEQ ID NO: 763299 - DNA, 22 bp, Artificial Sequence
  chemically synthesized
atattttgcccccttctatgtg

SEQ ID NO: 763300 - DNA, 22 bp, Artificial Sequence
  chemically synthesized
tatattttgcccccttctatgt

SEQ ID NO: 763301 - DNA, 22 bp, Artificial Sequence
  chemically synthesized
acatactttatattttgccccc

SEQ ID NO: 763302 - DNA, 22 bp, Artificial Sequence
  chemically synthesized
gcacatagaagggggcaaaata

SEQ ID NO: 763303 - DNA, 22 bp, Artificial Sequence
  chemically synthesized
tagtatactcacatactttata

SEQ ID NO: 763304 - DNA, 22 bp, Artificial Sequence
  chemically synthesized
gttgtagtatactcacatactt

SEQ ID NO: 763305 - DNA, 22 bp, Artificial Sequence
  chemically synthesized
agttgtagtatactcacatact

SEQ ID NO: 763306 - DNA, 22 bp, Artificial Sequence
  chemically synthesized
tagttgtagtatactcacatac

SEQ ID NO: 763307 - DNA, 22 bp, Artificial Sequence
  chemically synthesized
ttagttgtagtatactcacata

SEQ ID NO: 763308 - DNA, 22 bp, Artificial Sequence
  chemically synthesized
agcttttagttgtagtatactc

SEQ ID NO: 763309 - DNA, 22 bp, Artificial Sequence
  chemically synthesized
taaactaagcttttagttgtag

SEQ ID NO: 763310 - DNA, 22 bp, Artificial Sequence
  chemically synthesized
tgtaaactaagcttttagttgt

SEQ ID NO: 763311 - DNA, 22 bp, Artificial Sequence
  chemically synthesized
aaacacatcctctgtaaactaa

SEQ ID NO: 763312 - DNA, 22 bp, Artificial Sequence
  chemically synthesized
caactaaaagcttagtttacag

SEQ ID NO: 763313 - DNA, 22 bp, Artificial Sequence
  chemically synthesized
ttaaaacacatcctctgtaaac

SEQ ID NO: 763314 - DNA, 22 bp, Artificial Sequence
  chemically synthesized
gttaaaacacatcctctgtaaa

SEQ ID NO: 763315 - DNA, 22 bp, Artificial Sequence
  chemically synthesized
tgttaaaacacatcctctgtaa

SEQ ID NO: 763316 - DNA, 22 bp, Artificial Sequence
  chemically synthesized
aaagcttagtttacagaggatg

SEQ ID NO: 763317 - DNA, 22 bp, Artificial Sequence
  chemically synthesized
agattttgttaaaacacatcct

SEQ ID NO: 763318 - DNA, 22 bp, Artificial Sequence
  chemically synthesized
tcagattttgttaaaacacatc

SEQ ID NO: 763319 - DNA, 22 bp, Artificial Sequence
  chemically synthesized
agtttacagaggatgtgtttta

SEQ ID NO: 763320 - DNA, 22 bp, Artificial Sequence
  chemically synthesized
gtttacagaggatgtgttttaa

SEQ ID NO: 763321 - DNA, 22 bp, Artificial Sequence
  chemically synthesized
ctctcagattttgttaaaacac

SEQ ID NO: 763322 - DNA, 22 bp, Artificial Sequence
  chemically synthesized
cctctcagattttgttaaaaca

SEQ ID NO: 763323 - DNA, 22 bp, Artificial Sequence
  chemically synthesized
acagaggatgtgttttaacaaa

SEQ ID NO: 763324 - DNA, 22 bp, Artificial Sequence
  chemically synthesized
cagaggatgtgttttaacaaaa

SEQ ID NO: 763325 - DNA, 22 bp, Artificial Sequence
  chemically synthesized
cttcctctcagattttgttaaa

SEQ ID NO: 763326 - DNA, 22 bp, Artificial Sequence
  chemically synthesized
gcttcctctcagattttgttaa

SEQ ID NO: 763327 - DNA, 22 bp, Artificial Sequence
  chemically synthesized
tgcttcctctcagattttgtta

SEQ ID NO: 763328 - DNA, 22 bp, Artificial Sequence
  chemically synthesized
ttgcttcctctcagattttgtt

SEQ ID NO: 763329 - DNA, 22 bp, Artificial Sequence
  chemically synthesized
tcttttgcttcctctcagattt

SEQ ID NO: 763330 - DNA, 22 bp, Artificial Sequence
  chemically synthesized
ctgtcttttgcttcctctcaga

SEQ ID NO: 763331 - DNA, 22 bp, Artificial Sequence
  chemically synthesized
cctgtcttttgcttcctctcag

SEQ ID NO: 763332 - DNA, 22 bp, Artificial Sequence
  chemically synthesized
taacaaaatctgagaggaagca

SEQ ID NO: 763333 - DNA, 22 bp, Artificial Sequence
  chemically synthesized
aacaaaatctgagaggaagcaa

SEQ ID NO: 763334 - DNA, 22 bp, Artificial Sequence
  chemically synthesized
acaaaatctgagaggaagcaaa

SEQ ID NO: 763335 - DNA, 22 bp, Artificial Sequence
  chemically synthesized
tagcaacttcctgtcttttgct

SEQ ID NO: 763336 - DNA, 22 bp, Artificial Sequence
  chemically synthesized
agaggaagcaaaagacaggaag

SEQ ID NO: 763337 - DNA, 22 bp, Artificial Sequence
  chemically synthesized
aagagagactatagcaacttcc

SEQ ID NO: 763338 - DNA, 22 bp, Artificial Sequence
  chemically synthesized
cagttaaagagagactatagca

SEQ ID NO: 763339 - DNA, 22 bp, Artificial Sequence
  chemically synthesized
ctacagttaaagagagactata

SEQ ID NO: 763340 - DNA, 22 bp, Artificial Sequence
  chemically synthesized
ctatagtctctctttaactgta

SEQ ID NO: 763341 - DNA, 22 bp, Artificial Sequence
  chemically synthesized
gaggagatagctcctacagtta

SEQ ID NO: 763342 - DNA, 22 bp, Artificial Sequence
  chemically synthesized
tagtctctctttaactgtagga

SEQ ID NO: 763343 - DNA, 22 bp, Artificial Sequence
  chemically synthesized
agaggagatagctcctacagtt

SEQ ID NO: 763344 - DNA, 22 bp, Artificial Sequence
  chemically synthesized
tctttaactgtaggagctatct

SEQ ID NO: 763345 - DNA, 22 bp, Artificial Sequence
  chemically synthesized
acagtttagaggagatagctcc

SEQ ID NO: 763346 - DNA, 22 bp, Artificial Sequence
  chemically synthesized
tttaactgtaggagctatctcc

SEQ ID NO: 763347 - DNA, 22 bp, Artificial Sequence
  chemically synthesized
taactgtaggagctatctcctc

SEQ ID NO: 763348 - DNA, 22 bp, Artificial Sequence
  chemically synthesized
aactgtaggagctatctcctct

SEQ ID NO: 763349 - DNA, 22 bp, Artificial Sequence
  chemically synthesized
actgtaggagctatctcctcta

SEQ ID NO: 763350 - DNA, 22 bp, Artificial Sequence
  chemically synthesized
taattaacagtttagaggagat

SEQ ID NO: 763351 - DNA, 22 bp, Artificial Sequence
  chemically synthesized
taggagctatctcctctaaact

SEQ ID NO: 763352 - DNA, 22 bp, Artificial Sequence
  chemically synthesized
taacacattataattaacagtt

SEQ ID NO: 763353 - DNA, 22 bp, Artificial Sequence
  chemically synthesized
tctcctctaaactgttaattat

SEQ ID NO: 763354 - DNA, 22 bp, Artificial Sequence
  chemically synthesized
ctctaaactgttaattataatg

SEQ ID NO: 763355 - DNA, 22 bp, Artificial Sequence
  chemically synthesized
taaactgttaattataatgtgt

SEQ ID NO: 763356 - DNA, 22 bp, Artificial Sequence
  chemically synthesized
aactgttaattataatgtgtta

SEQ ID NO: 763357 - DNA, 22 bp, Artificial Sequence
  chemically synthesized
tataatataaaacctgtaacac

SEQ ID NO: 763358 - DNA, 22 bp, Artificial Sequence
  chemically synthesized
ttaattataatgtgttacaggt

SEQ ID NO: 763359 - DNA, 22 bp, Artificial Sequence
  chemically synthesized
attataatgtgttacaggtttt

SEQ ID NO: 763360 - DNA, 22 bp, Artificial Sequence
  chemically synthesized
caattatataatataaaacctg

SEQ ID NO: 763361 - DNA, 22 bp, Artificial Sequence
  chemically synthesized
taatgtgttacaggttttatat

SEQ ID NO: 763362 - DNA, 22 bp, Artificial Sequence
  chemically synthesized
taacacattacaattatataat

SEQ ID NO: 763363 - DNA, 22 bp, Artificial Sequence
  chemically synthesized
ataacacattacaattatataa

SEQ ID NO: 763364 - DNA, 22 bp, Artificial Sequence
  chemically synthesized
caggttttatattatataattg

SEQ ID NO: 763365 - DNA, 22 bp, Artificial Sequence
  chemically synthesized
tataacacattacaattatata

SEQ ID NO: 763366 - DNA, 22 bp, Artificial Sequence
  chemically synthesized
tatattatataattgtaatgtg

SEQ ID NO: 763367 - DNA, 22 bp, Artificial Sequence
  chemically synthesized
atattatataattgtaatgtgt

SEQ ID NO: 763368 - DNA, 22 bp, Artificial Sequence
  chemically synthesized
aaaccctttataacacattaca

SEQ ID NO: 763369 - DNA, 22 bp, Artificial Sequence
  chemically synthesized
tattatataattgtaatgtgtt

SEQ ID NO: 763370 - DNA, 22 bp, Artificial Sequence
  chemically synthesized
aaaaccctttataacacattac

SEQ ID NO: 763371 - DNA, 22 bp, Artificial Sequence
  chemically synthesized
taaaaccctttataacacatta

SEQ ID NO: 763372 - DNA, 22 bp, Artificial Sequence
  chemically synthesized
tataattgtaatgtgttataaa

SEQ ID NO: 763373 - DNA, 22 bp, Artificial Sequence
  chemically synthesized
taatgtgttataaagggtttta

SEQ ID NO: 763374 - DNA, 22 bp, Artificial Sequence
  chemically synthesized
taaagggttttaaagactgtcc

SEQ ID NO: 763375 - DNA, 22 bp, Artificial Sequence
  chemically synthesized
aatgcataccagaggacagtct

SEQ ID NO: 763376 - DNA, 22 bp, Artificial Sequence
  chemically synthesized
gtctaaatgcataccagaggac

SEQ ID NO: 763377 - DNA, 22 bp, Artificial Sequence
  chemically synthesized
taaagactgtcctctggtatgc

SEQ ID NO: 763378 - DNA, 22 bp, Artificial Sequence
  chemically synthesized
aaagactgtcctctggtatgca

SEQ ID NO: 763379 - DNA, 22 bp, Artificial Sequence
  chemically synthesized
aagactgtcctctggtatgcat

SEQ ID NO: 763380 - DNA, 22 bp, Artificial Sequence
  chemically synthesized
gcattagtctaaatgcatacca

SEQ ID NO: 763381 - DNA, 22 bp, Artificial Sequence
  chemically synthesized
ggcattagtctaaatgcatacc

SEQ ID NO: 763382 - DNA, 22 bp, Artificial Sequence
  chemically synthesized
tggcattagtctaaatgcatac

SEQ ID NO: 763383 - DNA, 22 bp, Artificial Sequence
  chemically synthesized
ttggcattagtctaaatgcata

SEQ ID NO: 763384 - DNA, 22 bp, Artificial Sequence
  chemically synthesized
tttttggcattagtctaaatgc

SEQ ID NO: 763385 - DNA, 22 bp, Artificial Sequence
  chemically synthesized
tcctctggtatgcatttagact

SEQ ID NO: 763386 - DNA, 22 bp, Artificial Sequence
  chemically synthesized
tggtatgcatttagactaatgc

SEQ ID NO: 763387 - DNA, 22 bp, Artificial Sequence
  chemically synthesized
gtatgcatttagactaatgcca

SEQ ID NO: 763388 - DNA, 22 bp, Artificial Sequence
  chemically synthesized
tggaattatttttggcattagt

SEQ ID NO: 763389 - DNA, 22 bp, Artificial Sequence
  chemically synthesized
agactaatgccaaaaataattc

SEQ ID NO: 763390 - DNA, 22 bp, Artificial Sequence
  chemically synthesized
gactaatgccaaaaataattcc

SEQ ID NO: 763391 - DNA, 22 bp, Artificial Sequence
  chemically synthesized
acggatatgtattatggaatta

SEQ ID NO: 763392 - DNA, 22 bp, Artificial Sequence
  chemically synthesized
atgccaaaaataattccataat

SEQ ID NO: 763393 - DNA, 22 bp, Artificial Sequence
  chemically synthesized
cataatacatatccgttaattt

SEQ ID NO: 763394 - DNA, 22 bp, Artificial Sequence
  chemically synthesized
tacaaaaagtgataaaaaatta

SEQ ID NO: 763395 - DNA, 22 bp, Artificial Sequence
  chemically synthesized
attttttatcactttttgtata

SEQ ID NO: 763396 - DNA, 22 bp, Artificial Sequence
  chemically synthesized
gcatatcacagggttatacaaa

SEQ ID NO: 763397 - DNA, 22 bp, Artificial Sequence
  chemically synthesized
ggcatatcacagggttatacaa

SEQ ID NO: 763398 - DNA, 22 bp, Artificial Sequence
  chemically synthesized
tttatcactttttgtataaccc

SEQ ID NO: 763399 - DNA, 22 bp, Artificial Sequence
  chemically synthesized
ttatcactttttgtataaccct

SEQ ID NO: 763400 - DNA, 22 bp, Artificial Sequence
  chemically synthesized
ttggcatatcacagggttatac

SEQ ID NO: 763401 - DNA, 22 bp, Artificial Sequence
  chemically synthesized
tatcactttttgtataaccctg

SEQ ID NO: 763402 - DNA, 22 bp, Artificial Sequence
  chemically synthesized
atcactttttgtataaccctgt

SEQ ID NO: 763403 - DNA, 22 bp, Artificial Sequence
  chemically synthesized
tcttggcatatcacagggttat

SEQ ID NO: 763404 - DNA, 22 bp, Artificial Sequence
  chemically synthesized
tcactttttgtataaccctgtg

SEQ ID NO: 763405 - DNA, 22 bp, Artificial Sequence
  chemically synthesized
tctcttggcatatcacagggtt

SEQ ID NO: 763406 - DNA, 22 bp, Artificial Sequence
  chemically synthesized
ctctcttggcatatcacagggt

SEQ ID NO: 763407 - DNA, 22 bp, Artificial Sequence
  chemically synthesized
tttgtataaccctgtgatatgc

SEQ ID NO: 763408 - DNA, 22 bp, Artificial Sequence
  chemically synthesized
ttgtataaccctgtgatatgcc

SEQ ID NO: 763409 - DNA, 22 bp, Artificial Sequence
  chemically synthesized
tgtataaccctgtgatatgcca

SEQ ID NO: 763410 - DNA, 22 bp, Artificial Sequence
  chemically synthesized
gtataaccctgtgatatgccaa

SEQ ID NO: 763411 - DNA, 22 bp, Artificial Sequence
  chemically synthesized
tataaccctgtgatatgccaag

SEQ ID NO: 763412 - DNA, 22 bp, Artificial Sequence
  chemically synthesized
ataaatttctctcttggcatat

SEQ ID NO: 763413 - DNA, 22 bp, Artificial Sequence
  chemically synthesized
cataaatttctctcttggcata

SEQ ID NO: 763414 - DNA, 22 bp, Artificial Sequence
  chemically synthesized
gtttcataaatttctctcttgg

SEQ ID NO: 763415 - DNA, 22 bp, Artificial Sequence
  chemically synthesized
tagtttcataaatttctctctt

SEQ ID NO: 763416 - DNA, 22 bp, Artificial Sequence
  chemically synthesized
tgatatgccaagagagaaattt

SEQ ID NO: 763417 - DNA, 22 bp, Artificial Sequence
  chemically synthesized
ttctagtttcataaatttctct

SEQ ID NO: 763418 - DNA, 22 bp, Artificial Sequence
  chemically synthesized
aatgaggagtgcagctattcta

SEQ ID NO: 763419 - DNA, 22 bp, Artificial Sequence
  chemically synthesized
aaatgaggagtgcagctattct

SEQ ID NO: 763420 - DNA, 22 bp, Artificial Sequence
  chemically synthesized
atgaaactagaatagctgcact

SEQ ID NO: 763421 - DNA, 22 bp, Artificial Sequence
  chemically synthesized
tgaaactagaatagctgcactc

SEQ ID NO: 763422 - DNA, 22 bp, Artificial Sequence
  chemically synthesized
gaatagctgcactcctcattta

SEQ ID NO: 763423 - DNA, 22 bp, Artificial Sequence
  chemically synthesized
agacatcagagtgaatttaaat

SEQ ID NO: 763424 - DNA, 22 bp, Artificial Sequence
  chemically synthesized
cactcctcatttaaattcactc

SEQ ID NO: 763425 - DNA, 22 bp, Artificial Sequence
  chemically synthesized
ctcatttaaattcactctgatg

SEQ ID NO: 763426 - DNA, 22 bp, Artificial Sequence
  chemically synthesized
atttaaattcactctgatgtct

SEQ ID NO: 763427 - DNA, 22 bp, Artificial Sequence
  chemically synthesized
aaattcactctgatgtcttaat

SEQ ID NO: 763428 - DNA, 22 bp, Artificial Sequence
  chemically synthesized
aattcactctgatgtcttaata

SEQ ID NO: 763429 - DNA, 22 bp, Artificial Sequence
  chemically synthesized
actctgatgtcttaatatgcat

SEQ ID NO: 763430 - DNA, 22 bp, Artificial Sequence
  chemically synthesized
taaacataggagacatgcatat

SEQ ID NO: 763431 - DNA, 22 bp, Artificial Sequence
  chemically synthesized
ataaacataggagacatgcata

SEQ ID NO: 763432 - DNA, 22 bp, Artificial Sequence
  chemically synthesized
tgatgtcttaatatgcatgtct

SEQ ID NO: 763433 - DNA, 22 bp, Artificial Sequence
  chemically synthesized
tataaacataggagacatgcat

SEQ ID NO: 763434 - DNA, 22 bp, Artificial Sequence
  chemically synthesized
atgtcttaatatgcatgtctcc

SEQ ID NO: 763435 - DNA, 22 bp, Artificial Sequence
  chemically synthesized
aatatgcatgtctcctatgttt

SEQ ID NO: 763436 - DNA, 22 bp, Artificial Sequence
  chemically synthesized
atatgcatgtctcctatgttta

SEQ ID NO: 763437 - DNA, 22 bp, Artificial Sequence
  chemically synthesized
aagtggtaatgttttataaaca

SEQ ID NO: 763438 - DNA, 22 bp, Artificial Sequence
  chemically synthesized
gattaaagtggtaatgttttat

SEQ ID NO: 763439 - DNA, 22 bp, Artificial Sequence
  chemically synthesized
ctatgtttataaaacattacca

SEQ ID NO: 763440 - DNA, 22 bp, Artificial Sequence
  chemically synthesized
agattagattaaagtggtaatg

SEQ ID NO: 763441 - DNA, 22 bp, Artificial Sequence
  chemically synthesized
tgtttataaaacattaccactt

SEQ ID NO: 763442 - DNA, 22 bp, Artificial Sequence
  chemically synthesized
ataaaacattaccactttaatc

SEQ ID NO: 763443 - DNA, 22 bp, Artificial Sequence
  chemically synthesized
taaaacattaccactttaatct

SEQ ID NO: 763444 - DNA, 22 bp, Artificial Sequence
  chemically synthesized
aggattcagattagattaaagt

SEQ ID NO: 763445 - DNA, 22 bp, Artificial Sequence
  chemically synthesized
gaggattcagattagattaaag

SEQ ID NO: 763446 - DNA, 22 bp, Artificial Sequence
  chemically synthesized
ccactttaatctaatctgaatc

SEQ ID NO: 763447 - DNA, 22 bp, Artificial Sequence
  chemically synthesized
taatctaatctgaatcctcaag

SEQ ID NO: 763448 - DNA, 22 bp, Artificial Sequence
  chemically synthesized
aatctaatctgaatcctcaagt

SEQ ID NO: 763449 - DNA, 22 bp, Artificial Sequence
  chemically synthesized
atctaatctgaatcctcaagta

SEQ ID NO: 763450 - DNA, 22 bp, Artificial Sequence
  chemically synthesized
gtatggagatgatacttgagga

SEQ ID NO: 763451 - DNA, 22 bp, Artificial Sequence
  chemically synthesized
ggtatggagatgatacttgagg

SEQ ID NO: 763452 - DNA, 22 bp, Artificial Sequence
  chemically synthesized
cttggtatggagatgatacttg

SEQ ID NO: 763453 - DNA, 22 bp, Artificial Sequence
  chemically synthesized
atctgaatcctcaagtatcatc

SEQ ID NO: 763454 - DNA, 22 bp, Artificial Sequence
  chemically synthesized
gcttggtatggagatgatactt

SEQ ID NO: 763455 - DNA, 22 bp, Artificial Sequence
  chemically synthesized
tttgcttggtatggagatgata

SEQ ID NO: 763456 - DNA, 22 bp, Artificial Sequence
  chemically synthesized
atttgcttggtatggagatgat

SEQ ID NO: 763457 - DNA, 22 bp, Artificial Sequence
  chemically synthesized
aatcctcaagtatcatctccat

SEQ ID NO: 763458 - DNA, 22 bp, Artificial Sequence
  chemically synthesized
aagtatcatctccataccaagc

SEQ ID NO: 763459 - DNA, 22 bp, Artificial Sequence
  chemically synthesized
aataaatgaatcatttatttgc

SEQ ID NO: 763460 - DNA, 22 bp, Artificial Sequence
  chemically synthesized
gaataaatgaatcatttatttg

SEQ ID NO: 763461 - DNA, 22 bp, Artificial Sequence
  chemically synthesized
tgaataaatgaatcatttattt

SEQ ID NO: 763462 - DNA, 22 bp, Artificial Sequence
  chemically synthesized
cataccaagcaaataaatgatt

SEQ ID NO: 763463 - DNA, 22 bp, Artificial Sequence
  chemically synthesized
tattttgaataaatgaatcatt

SEQ ID NO: 763464 - DNA, 22 bp, Artificial Sequence
  chemically synthesized
actgtattttgaataaatgaat

SEQ ID NO: 763465 - DNA, 22 bp, Artificial Sequence
  chemically synthesized
agaatgattcactgtattttga

SEQ ID NO: 763466 - DNA, 22 bp, Artificial Sequence
  chemically synthesized
cagaatgattcactgtattttg

SEQ ID NO: 763467 - DNA, 22 bp, Artificial Sequence
  chemically synthesized
atttattcaaaatacagtgaat

SEQ ID NO: 763468 - DNA, 22 bp, Artificial Sequence
  chemically synthesized
attcaaaatacagtgaatcatt

SEQ ID NO: 763469 - DNA, 22 bp, Artificial Sequence
  chemically synthesized
ttcaaaatacagtgaatcattc

SEQ ID NO: 763470 - DNA, 22 bp, Artificial Sequence
  chemically synthesized
aaaatacagtgaatcattctga

SEQ ID NO: 763471 - DNA, 22 bp, Artificial Sequence
  chemically synthesized
cgtaaatcatccaatttcagaa

SEQ ID NO: 763472 - DNA, 22 bp, Artificial Sequence
  chemically synthesized
acatgtctacgtaaatcatcca

SEQ ID NO: 763473 - DNA, 22 bp, Artificial Sequence
  chemically synthesized
tgaaattggatgatttacgtag

SEQ ID NO: 763474 - DNA, 22 bp, Artificial Sequence
  chemically synthesized
gtatctcacatgtctacgtaaa

SEQ ID NO: 763475 - DNA, 22 bp, Artificial Sequence
  chemically synthesized
aaattggatgatttacgtagac

SEQ ID NO: 763476 - DNA, 22 bp, Artificial Sequence
  chemically synthesized
gatgatttacgtagacatgtga

SEQ ID NO: 763477 - DNA, 22 bp, Artificial Sequence
  chemically synthesized
gcacaagtaactggtatctcac

SEQ ID NO: 763478 - DNA, 22 bp, Artificial Sequence
  chemically synthesized
agcacaagtaactggtatctca

SEQ ID NO: 763479 - DNA, 22 bp, Artificial Sequence
  chemically synthesized
acgtagacatgtgagataccag

SEQ ID NO: 763480 - DNA, 22 bp, Artificial Sequence
  chemically synthesized
cgtagacatgtgagataccagt

SEQ ID NO: 763481 - DNA, 22 bp, Artificial Sequence
  chemically synthesized
tcttagcacaagtaactggtat

SEQ ID NO: 763482 - DNA, 22 bp, Artificial Sequence
  chemically synthesized
attgtcttagcacaagtaactg

SEQ ID NO: 763483 - DNA, 22 bp, Artificial Sequence
  chemically synthesized
ctcattgtcttagcacaagtaa

SEQ ID NO: 763484 - DNA, 22 bp, Artificial Sequence
  chemically synthesized
cctcattgtcttagcacaagta

SEQ ID NO: 763485 - DNA, 22 bp, Artificial Sequence
  chemically synthesized
tcctcattgtcttagcacaagt

SEQ ID NO: 763486 - DNA, 22 bp, Artificial Sequence
  chemically synthesized
cttgtgctaagacaatgaggaa

SEQ ID NO: 763487 - DNA, 22 bp, Artificial Sequence
  chemically synthesized
aaatggccaaattttcctcatt

SEQ ID NO: 763488 - DNA, 22 bp, Artificial Sequence
  chemically synthesized
gtgctaagacaatgaggaaaat

SEQ ID NO: 763489 - DNA, 22 bp, Artificial Sequence
  chemically synthesized
tgctaagacaatgaggaaaatt

SEQ ID NO: 763490 - DNA, 22 bp, Artificial Sequence
  chemically synthesized
agacaatgaggaaaatttggcc

SEQ ID NO: 763491 - DNA, 22 bp, Artificial Sequence
  chemically synthesized
ggccattttaattcatttgtgg

SEQ ID NO: 763492 - DNA, 22 bp, Artificial Sequence
  chemically synthesized
gccattttaattcatttgtggc

SEQ ID NO: 763493 - DNA, 22 bp, Artificial Sequence
  chemically synthesized
taattcatttgtggcctttttg

SEQ ID NO: 763494 - DNA, 22 bp, Artificial Sequence
  chemically synthesized
aattcatttgtggcctttttgc

SEQ ID NO: 763495 - DNA, 22 bp, Artificial Sequence
  chemically synthesized
attcatttgtggcctttttgct

SEQ ID NO: 763496 - DNA, 22 bp, Artificial Sequence
  chemically synthesized
atttgtggcctttttgctccac

SEQ ID NO: 763497 - DNA, 22 bp, Artificial Sequence
  chemically synthesized
ggtaggaaaagatgtggagcaa

SEQ ID NO: 763498 - DNA, 22 bp, Artificial Sequence
  chemically synthesized
gtggcctttttgctccacatct

SEQ ID NO: 763499 - DNA, 22 bp, Artificial Sequence
  chemically synthesized
tggcctttttgctccacatctt

SEQ ID NO: 763500 - DNA, 22 bp, Artificial Sequence
  chemically synthesized
aacattaggtaggaaaagatgt

SEQ ID NO: 763501 - DNA, 22 bp, Artificial Sequence
  chemically synthesized
tcaacattaggtaggaaaagat

SEQ ID NO: 763502 - DNA, 22 bp, Artificial Sequence
  chemically synthesized
tttgctccacatcttttcctac

SEQ ID NO: 763503 - DNA, 22 bp, Artificial Sequence
  chemically synthesized
ttgctccacatcttttcctacc

SEQ ID NO: 763504 - DNA, 22 bp, Artificial Sequence
  chemically synthesized
tgctccacatcttttcctacct

SEQ ID NO: 763505 - DNA, 22 bp, Artificial Sequence
  chemically synthesized
gctccacatcttttcctaccta

SEQ ID NO: 763506 - DNA, 22 bp, Artificial Sequence
  chemically synthesized
ctccacatcttttcctacctaa

SEQ ID NO: 763507 - DNA, 22 bp, Artificial Sequence
  chemically synthesized
cacatcttttcctacctaatgt

SEQ ID NO: 763508 - DNA, 22 bp, Artificial Sequence
  chemically synthesized
ggaaaaagtctctcaacattag

SEQ ID NO: 763509 - DNA, 22 bp, Artificial Sequence
  chemically synthesized
cggaaaaagtctctcaacatta

SEQ ID NO: 763510 - DNA, 22 bp, Artificial Sequence
  chemically synthesized
ttcctacctaatgttgagagac

SEQ ID NO: 763511 - DNA, 22 bp, Artificial Sequence
  chemically synthesized
tcctacctaatgttgagagact

SEQ ID NO: 763512 - DNA, 22 bp, Artificial Sequence
  chemically synthesized
cctacctaatgttgagagactt

SEQ ID NO: 763513 - DNA, 22 bp, Artificial Sequence
  chemically synthesized
ctacctaatgttgagagacttt

SEQ ID NO: 763514 - DNA, 22 bp, Artificial Sequence
  chemically synthesized
cctaatgttgagagactttttc

SEQ ID NO: 763515 - DNA, 22 bp, Artificial Sequence
  chemically synthesized
atgttgagagactttttccgaa

SEQ ID NO: 763516 - DNA, 22 bp, Artificial Sequence
  chemically synthesized
aagtggagtgaacttcggaaaa

SEQ ID NO: 763517 - DNA, 22 bp, Artificial Sequence
  chemically synthesized
caagtggagtgaacttcggaaa

SEQ ID NO: 763518 - DNA, 22 bp, Artificial Sequence
  chemically synthesized
agagactttttccgaagttcac

SEQ ID NO: 763519 - DNA, 22 bp, Artificial Sequence
  chemically synthesized
tttccgaagttcactccacttg

SEQ ID NO: 763520 - DNA, 22 bp, Artificial Sequence
  chemically synthesized
ttccgaagttcactccacttga

SEQ ID NO: 763521 - DNA, 22 bp, Artificial Sequence
  chemically synthesized
tccgaagttcactccacttgaa

SEQ ID NO: 763522 - DNA, 22 bp, Artificial Sequence
  chemically synthesized
gataacatgaacttcaagtgga

SEQ ID NO: 763523 - DNA, 22 bp, Artificial Sequence
  chemically synthesized
ccgaagttcactccacttgaag

SEQ ID NO: 763524 - DNA, 22 bp, Artificial Sequence
  chemically synthesized
ggataacatgaacttcaagtgg

SEQ ID NO: 763525 - DNA, 22 bp, Artificial Sequence
  chemically synthesized
cgaagttcactccacttgaagt

SEQ ID NO: 763526 - DNA, 22 bp, Artificial Sequence
  chemically synthesized
actccacttgaagttcatgtta

SEQ ID NO: 763527 - DNA, 22 bp, Artificial Sequence
  chemically synthesized
caaagacgtttggataacatga

SEQ ID NO: 763528 - DNA, 22 bp, Artificial Sequence
  chemically synthesized
cacttgaagttcatgttatcca

SEQ ID NO: 763529 - DNA, 22 bp, Artificial Sequence
  chemically synthesized
ttacaaagacgtttggataaca

SEQ ID NO: 763530 - DNA, 22 bp, Artificial Sequence
  chemically synthesized
gaagttcatgttatccaaacgt

SEQ ID NO: 763531 - DNA, 22 bp, Artificial Sequence
  chemically synthesized
aagttcatgttatccaaacgtc

SEQ ID NO: 763532 - DNA, 22 bp, Artificial Sequence
  chemically synthesized
atgttatccaaacgtctttgta

SEQ ID NO: 763533 - DNA, 22 bp, Artificial Sequence
  chemically synthesized
cgatgatgcagtcctgttacaa

SEQ ID NO: 763534 - DNA, 22 bp, Artificial Sequence
  chemically synthesized
tccaaacgtctttgtaacagga

SEQ ID NO: 763535 - DNA, 22 bp, Artificial Sequence
  chemically synthesized
gaaggttccgatgatgcagtcc

SEQ ID NO: 763536 - DNA, 22 bp, Artificial Sequence
  chemically synthesized
tgtaacaggactgcatcatcgg

SEQ ID NO: 763537 - DNA, 22 bp, Artificial Sequence
  chemically synthesized
gtaacaggactgcatcatcgga

SEQ ID NO: 763538 - DNA, 22 bp, Artificial Sequence
  chemically synthesized
taacaggactgcatcatcggaa

SEQ ID NO: 763539 - DNA, 22 bp, Artificial Sequence
  chemically synthesized
agatccctggaaggttccgatg

SEQ ID NO: 763540 - DNA, 22 bp, Artificial Sequence
  chemically synthesized
catcatcggaaccttccaggga

SEQ ID NO: 763541 - DNA, 22 bp, Artificial Sequence
  chemically synthesized
ccagggatctcaggattttttg

SEQ ID NO: 763542 - DNA, 22 bp, Artificial Sequence
  chemically synthesized
gatgaaaacagccaaaaaatcc

SEQ ID NO: 763543 - DNA, 22 bp, Artificial Sequence
  chemically synthesized
cagggatctcaggattttttgg

SEQ ID NO: 763544 - DNA, 22 bp, Artificial Sequence
  chemically synthesized
tcacaacctggatgaaaacagc

SEQ ID NO: 763545 - DNA, 22 bp, Artificial Sequence
  chemically synthesized
aggattttttggctgttttcat

SEQ ID NO: 763546 - DNA, 22 bp, Artificial Sequence
  chemically synthesized
atcacaacctggatgaaaacag

SEQ ID NO: 763547 - DNA, 22 bp, Artificial Sequence
  chemically synthesized
tttggctgttttcatccaggtt

SEQ ID NO: 763548 - DNA, 22 bp, Artificial Sequence
  chemically synthesized
ttggctgttttcatccaggttg

SEQ ID NO: 763549 - DNA, 22 bp, Artificial Sequence
  chemically synthesized
tggctgttttcatccaggttgt

SEQ ID NO: 763550 - DNA, 22 bp, Artificial Sequence
  chemically synthesized
ggctgttttcatccaggttgtg

SEQ ID NO: 763551 - DNA, 22 bp, Artificial Sequence
  chemically synthesized
gctgttttcatccaggttgtga

SEQ ID NO: 763552 - DNA, 22 bp, Artificial Sequence
  chemically synthesized
acacagatgtttatcacaacct

SEQ ID NO: 763553 - DNA, 22 bp, Artificial Sequence
  chemically synthesized
ttttcatccaggttgtgataaa

SEQ ID NO: 763554 - DNA, 22 bp, Artificial Sequence
  chemically synthesized
tcatccaggttgtgataaacat

SEQ ID NO: 763555 - DNA, 22 bp, Artificial Sequence
  chemically synthesized
aagctcacacagatgtttatca

SEQ ID NO: 763556 - DNA, 22 bp, Artificial Sequence
  chemically synthesized
catccaggttgtgataaacatc

SEQ ID NO: 763557 - DNA, 22 bp, Artificial Sequence
  chemically synthesized
atccaggttgtgataaacatct

SEQ ID NO: 763558 - DNA, 22 bp, Artificial Sequence
  chemically synthesized
tgataaacatctgtgtgagctt

SEQ ID NO: 763559 - DNA, 22 bp, Artificial Sequence
  chemically synthesized
caaggtgaaattgaagctcaca

SEQ ID NO: 763560 - DNA, 22 bp, Artificial Sequence
  chemically synthesized
taggacctccaaggtgaaattg

SEQ ID NO: 763561 - DNA, 22 bp, Artificial Sequence
  chemically synthesized
tgtgagcttcaatttcaccttg

SEQ ID NO: 763562 - DNA, 22 bp, Artificial Sequence
  chemically synthesized
tcctgtaggacctccaaggtga

SEQ ID NO: 763563 - DNA, 22 bp, Artificial Sequence
  chemically synthesized
ctgtcctgtaggacctccaagg

SEQ ID NO: 763564 - DNA, 22 bp, Artificial Sequence
  chemically synthesized
ctgctgtcctgtaggacctcca

SEQ ID NO: 763565 - DNA, 22 bp, Artificial Sequence
  chemically synthesized
caatttcaccttggaggtccta

SEQ ID NO: 763566 - DNA, 22 bp, Artificial Sequence
  chemically synthesized
cctgctgtcctgtaggacctcc

SEQ ID NO: 763567 - DNA, 22 bp, Artificial Sequence
  chemically synthesized
aatttcaccttggaggtcctac

SEQ ID NO: 763568 - DNA, 22 bp, Artificial Sequence
  chemically synthesized
ttcctgctgtcctgtaggacct

SEQ ID NO: 763569 - DNA, 22 bp, Artificial Sequence
  chemically synthesized
cttcctgctgtcctgtaggacc

SEQ ID NO: 763570 - DNA, 22 bp, Artificial Sequence
  chemically synthesized
ttcttcctgctgtcctgtagga

SEQ ID NO: 763571 - DNA, 22 bp, Artificial Sequence
  chemically synthesized
caccttggaggtcctacaggac

SEQ ID NO: 763572 - DNA, 22 bp, Artificial Sequence
  chemically synthesized
accttggaggtcctacaggaca

SEQ ID NO: 763573 - DNA, 22 bp, Artificial Sequence
  chemically synthesized
ggaggtcctacaggacagcagg

SEQ ID NO: 763574 - DNA, 22 bp, Artificial Sequence
  chemically synthesized
gaggtcctacaggacagcagga

SEQ ID NO: 763575 - DNA, 22 bp, Artificial Sequence
  chemically synthesized
cacatattcttcttcctgctgt

SEQ ID NO: 763576 - DNA, 22 bp, Artificial Sequence
  chemically synthesized
tgcacatattcttcttcctgct

SEQ ID NO: 763577 - DNA, 22 bp, Artificial Sequence
  chemically synthesized
caggacagcaggaagaagaata

SEQ ID NO: 763578 - DNA, 22 bp, Artificial Sequence
  chemically synthesized
gtaattctgcacatattcttct

SEQ ID NO: 763579 - DNA, 22 bp, Artificial Sequence
  chemically synthesized
ggtaattctgcacatattcttc

SEQ ID NO: 763580 - DNA, 22 bp, Artificial Sequence
  chemically synthesized
tttggtaattctgcacatattc

SEQ ID NO: 763581 - DNA, 22 bp, Artificial Sequence
  chemically synthesized
gtttggtaattctgcacatatt

SEQ ID NO: 763582 - DNA, 22 bp, Artificial Sequence
  chemically synthesized
tgtttggtaattctgcacatat

SEQ ID NO: 763583 - DNA, 22 bp, Artificial Sequence
  chemically synthesized
ttgtttggtaattctgcacata

SEQ ID NO: 763584 - DNA, 22 bp, Artificial Sequence
  chemically synthesized
ttttgtttggtaattctgcaca

SEQ ID NO: 763585 - DNA, 22 bp, Artificial Sequence
  chemically synthesized
cttttgtttggtaattctgcac

SEQ ID NO: 763586 - DNA, 22 bp, Artificial Sequence
  chemically synthesized
tttcttttgtttggtaattctg

SEQ ID NO: 763587 - DNA, 22 bp, Artificial Sequence
  chemically synthesized
gtttcttttgtttggtaattct

SEQ ID NO: 763588 - DNA, 22 bp, Artificial Sequence
  chemically synthesized
atcgcttgtttcttttgtttgg

SEQ ID NO: 763589 - DNA, 22 bp, Artificial Sequence
  chemically synthesized
acattcatcgcttgtttctttt

SEQ ID NO: 763590 - DNA, 22 bp, Artificial Sequence
  chemically synthesized
ccaaacaaaagaaacaagcgat

SEQ ID NO: 763591 - DNA, 22 bp, Artificial Sequence
  chemically synthesized
caaattcacattcatcgcttgt

SEQ ID NO: 763592 - DNA, 22 bp, Artificial Sequence
  chemically synthesized
tccaaattcacattcatcgctt

SEQ ID NO: 763593 - DNA, 22 bp, Artificial Sequence
  chemically synthesized
caattctccaaattcacattca

SEQ ID NO: 763594 - DNA, 22 bp, Artificial Sequence
  chemically synthesized
gcaattctccaaattcacattc

SEQ ID NO: 763595 - DNA, 22 bp, Artificial Sequence
  chemically synthesized
tgcaattctccaaattcacatt

SEQ ID NO: 763596 - DNA, 22 bp, Artificial Sequence
  chemically synthesized
tattttgcaattctccaaattc

SEQ ID NO: 763597 - DNA, 22 bp, Artificial Sequence
  chemically synthesized
atattttgcaattctccaaatt

SEQ ID NO: 763598 - DNA, 22 bp, Artificial Sequence
  chemically synthesized
tttatattttgcaattctccaa

SEQ ID NO: 763599 - DNA, 22 bp, Artificial Sequence
  chemically synthesized
ataattatttatattttgcaat

SEQ ID NO: 763600 - DNA, 22 bp, Artificial Sequence
  chemically synthesized
aactaataattatttatatttt

SEQ ID NO: 763601 - DNA, 22 bp, Artificial Sequence
  chemically synthesized
gaactaataattatttatattt

SEQ ID NO: 763602 - DNA, 22 bp, Artificial Sequence
  chemically synthesized
ggagaattgcaaaatataaata

SEQ ID NO: 763603 - DNA, 22 bp, Artificial Sequence
  chemically synthesized
tgaactaataattatttatatt

SEQ ID NO: 763604 - DNA, 22 bp, Artificial Sequence
  chemically synthesized
gagaattgcaaaatataaataa

SEQ ID NO: 763605 - DNA, 22 bp, Artificial Sequence
  chemically synthesized
ttgaactaataattatttatat

SEQ ID NO: 763606 - DNA, 22 bp, Artificial Sequence
  chemically synthesized
caaaatataaataattattagt

SEQ ID NO: 763607 - DNA, 22 bp, Artificial Sequence
  chemically synthesized
aaatgtcttttgaactaataat

SEQ ID NO: 763608 - DNA, 22 bp, Artificial Sequence
  chemically synthesized
attgaaatgtcttttgaactaa

SEQ ID NO: 763609 - DNA, 22 bp, Artificial Sequence
  chemically synthesized
gcctgattgaaatgtcttttga

SEQ ID NO: 763610 - DNA, 22 bp, Artificial Sequence
  chemically synthesized
agcctgattgaaatgtcttttg

SEQ ID NO: 763611 - DNA, 22 bp, Artificial Sequence
  chemically synthesized
gtttagcctgattgaaatgtct

SEQ ID NO: 763612 - DNA, 22 bp, Artificial Sequence
  chemically synthesized
ttagttcaaaagacatttcaat

SEQ ID NO: 763613 - DNA, 22 bp, Artificial Sequence
  chemically synthesized
ttagtttagcctgattgaaatg

SEQ ID NO: 763614 - DNA, 22 bp, Artificial Sequence
  chemically synthesized
gttagtttagcctgattgaaat

SEQ ID NO: 763615 - DNA, 22 bp, Artificial Sequence
  chemically synthesized
gttcaaaagacatttcaatcag

SEQ ID NO: 763616 - DNA, 22 bp, Artificial Sequence
  chemically synthesized
ttgttagtttagcctgattgaa

SEQ ID NO: 763617 - DNA, 22 bp, Artificial Sequence
  chemically synthesized
cttgttagtttagcctgattga

SEQ ID NO: 763618 - DNA, 22 bp, Artificial Sequence
  chemically synthesized
aaaagacatttcaatcaggcta

SEQ ID NO: 763619 - DNA, 22 bp, Artificial Sequence
  chemically synthesized
agatgtatcttcttgttagttt

SEQ ID NO: 763620 - DNA, 22 bp, Artificial Sequence
  chemically synthesized
gagatgtatcttcttgttagtt

SEQ ID NO: 763621 - DNA, 22 bp, Artificial Sequence
  chemically synthesized
caatcaggctaaactaacaaga

SEQ ID NO: 763622 - DNA, 22 bp, Artificial Sequence
  chemically synthesized
aatcaggctaaactaacaagaa

SEQ ID NO: 763623 - DNA, 22 bp, Artificial Sequence
  chemically synthesized
aactaacaagaagatacatctc

SEQ ID NO: 763624 - DNA, 22 bp, Artificial Sequence
  chemically synthesized
acaagaagatacatctcaaatc

SEQ ID NO: 763625 - DNA, 22 bp, Artificial Sequence
  chemically synthesized
aaatcccttttcttggcgtatt

SEQ ID NO: 763626 - DNA, 22 bp, Artificial Sequence
  chemically synthesized
cataataacaggagaaggcaat

SEQ ID NO: 763627 - DNA, 22 bp, Artificial Sequence
  chemically synthesized
ttcttggcgtattgccttctcc

SEQ ID NO: 763628 - DNA, 22 bp, Artificial Sequence
  chemically synthesized
tcttggcgtattgccttctcct

SEQ ID NO: 763629 - DNA, 22 bp, Artificial Sequence
  chemically synthesized
cttggcgtattgccttctcctg

SEQ ID NO: 763630 - DNA, 22 bp, Artificial Sequence
  chemically synthesized
ttggcgtattgccttctcctgt

SEQ ID NO: 763631 - DNA, 22 bp, Artificial Sequence
  chemically synthesized
aatctacataataacaggagaa

SEQ ID NO: 763632 - DNA, 22 bp, Artificial Sequence
  chemically synthesized
ggcgtattgccttctcctgtta

SEQ ID NO: 763633 - DNA, 22 bp, Artificial Sequence
  chemically synthesized
aaatctacataataacaggaga

SEQ ID NO: 763634 - DNA, 22 bp, Artificial Sequence
  chemically synthesized
gcgtattgccttctcctgttat

SEQ ID NO: 763635 - DNA, 22 bp, Artificial Sequence
  chemically synthesized
taaatctacataataacaggag

SEQ ID NO: 763636 - DNA, 22 bp, Artificial Sequence
  chemically synthesized
ccttctcctgttattatgtaga

SEQ ID NO: 763637 - DNA, 22 bp, Artificial Sequence
  chemically synthesized
ctcctgttattatgtagattta

SEQ ID NO: 763638 - DNA, 22 bp, Artificial Sequence
  chemically synthesized
tcctgttattatgtagatttaa

SEQ ID NO: 763639 - DNA, 22 bp, Artificial Sequence
  chemically synthesized
ctgttattatgtagatttaaaa

SEQ ID NO: 763640 - DNA, 22 bp, Artificial Sequence
  chemically synthesized
ataagatgcccattttaaatct

SEQ ID NO: 763641 - DNA, 22 bp, Artificial Sequence
  chemically synthesized
ttattatgtagatttaaaatgg

SEQ ID NO: 763642 - DNA, 22 bp, Artificial Sequence
  chemically synthesized
ttatgtagatttaaaatgggca

SEQ ID NO: 763643 - DNA, 22 bp, Artificial Sequence
  chemically synthesized
caactaataagatgcccatttt

SEQ ID NO: 763644 - DNA, 22 bp, Artificial Sequence
  chemically synthesized
tgtagatttaaaatgggcatct

SEQ ID NO: 763645 - DNA, 22 bp, Artificial Sequence
  chemically synthesized
ttacaactaataagatgcccat

SEQ ID NO: 763646 - DNA, 22 bp, Artificial Sequence
  chemically synthesized
aaaatgggcatcttattagttg

SEQ ID NO: 763647 - DNA, 22 bp, Artificial Sequence
  chemically synthesized
aaatgggcatcttattagttgt

SEQ ID NO: 763648 - DNA, 22 bp, Artificial Sequence
  chemically synthesized
ataatggcaaggaataaatcta

SEQ ID NO: 763649 - DNA, 22 bp, Artificial Sequence
  chemically synthesized
attagttgtaatagatttattc

SEQ ID NO: 763650 - DNA, 22 bp, Artificial Sequence
  chemically synthesized
ttagttgtaatagatttattcc

SEQ ID NO: 763651 - DNA, 22 bp, Artificial Sequence
  chemically synthesized
gttgtaatagatttattccttg

SEQ ID NO: 763652 - DNA, 22 bp, Artificial Sequence
  chemically synthesized
caactcataatggcaaggaata

SEQ ID NO: 763653 - DNA, 22 bp, Artificial Sequence
  chemically synthesized
ccaactcataatggcaaggaat

SEQ ID NO: 763654 - DNA, 22 bp, Artificial Sequence
  chemically synthesized
tccaactcataatggcaaggaa

SEQ ID NO: 763655 - DNA, 22 bp, Artificial Sequence
  chemically synthesized
taatagatttattccttgccat

SEQ ID NO: 763656 - DNA, 22 bp, Artificial Sequence
  chemically synthesized
ctttccaactcataatggcaag

SEQ ID NO: 763657 - DNA, 22 bp, Artificial Sequence
  chemically synthesized
attccttgccattatgagttgg

SEQ ID NO: 763658 - DNA, 22 bp, Artificial Sequence
  chemically synthesized
ttccttgccattatgagttgga

SEQ ID NO: 763659 - DNA, 22 bp, Artificial Sequence
  chemically synthesized
taaatacattactttccaactc

SEQ ID NO: 763660 - DNA, 22 bp, Artificial Sequence
  chemically synthesized
cttgccattatgagttggaaag

SEQ ID NO: 763661 - DNA, 22 bp, Artificial Sequence
  chemically synthesized
gccattatgagttggaaagtaa

SEQ ID NO: 763662 - DNA, 22 bp, Artificial Sequence
  chemically synthesized
ccattatgagttggaaagtaat

SEQ ID NO: 763663 - DNA, 22 bp, Artificial Sequence
  chemically synthesized
taaagttataaatacattactt

SEQ ID NO: 763664 - DNA, 22 bp, Artificial Sequence
  chemically synthesized
ataaagttataaatacattact

SEQ ID NO: 763665 - DNA, 22 bp, Artificial Sequence
  chemically synthesized
tataaagttataaatacattac

SEQ ID NO: 763666 - DNA, 22 bp, Artificial Sequence
  chemically synthesized
tgagttggaaagtaatgtattt

SEQ ID NO: 763667 - DNA, 22 bp, Artificial Sequence
  chemically synthesized
tgaactttataaagttataaat

SEQ ID NO: 763668 - DNA, 22 bp, Artificial Sequence
  chemically synthesized
gaaagtaatgtatttataactt

SEQ ID NO: 763669 - DNA, 22 bp, Artificial Sequence
  chemically synthesized
gtgaactttataaagttataaa

SEQ ID NO: 763670 - DNA, 22 bp, Artificial Sequence
  chemically synthesized
gaagatataacttgtgaacttt

SEQ ID NO: 763671 - DNA, 22 bp, Artificial Sequence
  chemically synthesized
ataactttataaagttcacaag

SEQ ID NO: 763672 - DNA, 22 bp, Artificial Sequence
  chemically synthesized
taactttataaagttcacaagt

SEQ ID NO: 763673 - DNA, 22 bp, Artificial Sequence
  chemically synthesized
tataaagttcacaagttatatc

SEQ ID NO: 763674 - DNA, 22 bp, Artificial Sequence
  chemically synthesized
ataaagttcacaagttatatct

SEQ ID NO: 763675 - DNA, 22 bp, Artificial Sequence
  chemically synthesized
taaagttcacaagttatatctt

SEQ ID NO: 763676 - DNA, 22 bp, Artificial Sequence
  chemically synthesized
tccatagactagaagatataac

SEQ ID NO: 763677 - DNA, 22 bp, Artificial Sequence
  chemically synthesized
gtccatagactagaagatataa

SEQ ID NO: 763678 - DNA, 22 bp, Artificial Sequence
  chemically synthesized
tgtccatagactagaagatata

SEQ ID NO: 763679 - DNA, 22 bp, Artificial Sequence
  chemically synthesized
acaagttatatcttctagtcta

SEQ ID NO: 763680 - DNA, 22 bp, Artificial Sequence
  chemically synthesized
tatcttctagtctatggacaaa

SEQ ID NO: 763681 - DNA, 22 bp, Artificial Sequence
  chemically synthesized
cataaaataatacattttgtcc

SEQ ID NO: 763682 - DNA, 22 bp, Artificial Sequence
  chemically synthesized
ccataaaataatacattttgtc

SEQ ID NO: 763683 - DNA, 22 bp, Artificial Sequence
  chemically synthesized
ctagtctatggacaaaatgtat

SEQ ID NO: 763684 - DNA, 22 bp, Artificial Sequence
  chemically synthesized
tagtctatggacaaaatgtatt

SEQ ID NO: 763685 - DNA, 22 bp, Artificial Sequence
  chemically synthesized
gtctatggacaaaatgtattat

SEQ ID NO: 763686 - DNA, 22 bp, Artificial Sequence
  chemically synthesized
tcacttccataaaataatacat

SEQ ID NO: 763687 - DNA, 22 bp, Artificial Sequence
  chemically synthesized
tggacaaaatgtattattttat

SEQ ID NO: 763688 - DNA, 22 bp, Artificial Sequence
  chemically synthesized
cctatcacttccataaaataat

SEQ ID NO: 763689 - DNA, 22 bp, Artificial Sequence
  chemically synthesized
ttgcctatcacttccataaaat

SEQ ID NO: 763690 - DNA, 22 bp, Artificial Sequence
  chemically synthesized
attgcctatcacttccataaaa

SEQ ID NO: 763691 - DNA, 22 bp, Artificial Sequence
  chemically synthesized
tattgcctatcacttccataaa

SEQ ID NO: 763692 - DNA, 22 bp, Artificial Sequence
  chemically synthesized
ttttatggaagtgataggcaat

SEQ ID NO: 763693 - DNA, 22 bp, Artificial Sequence
  chemically synthesized
tcatagaattttattgcctatc

SEQ ID NO: 763694 - DNA, 22 bp, Artificial Sequence
  chemically synthesized
atcatagaattttattgcctat

SEQ ID NO: 763695 - DNA, 22 bp, Artificial Sequence
  chemically synthesized
tatcatagaattttattgccta

SEQ ID NO: 763696 - DNA, 22 bp, Artificial Sequence
  chemically synthesized
tatggaagtgataggcaataaa

SEQ ID NO: 763697 - DNA, 22 bp, Artificial Sequence
  chemically synthesized
atggaagtgataggcaataaaa

SEQ ID NO: 763698 - DNA, 22 bp, Artificial Sequence
  chemically synthesized
tggaagtgataggcaataaaat

SEQ ID NO: 763699 - DNA, 22 bp, Artificial Sequence
  chemically synthesized
gggtacactttatcatagaatt

SEQ ID NO: 763700 - DNA, 22 bp, Artificial Sequence
  chemically synthesized
gcactggggtacactttatcat

SEQ ID NO: 763701 - DNA, 22 bp, Artificial Sequence
  chemically synthesized
ttggcactggggtacactttat

SEQ ID NO: 763702 - DNA, 22 bp, Artificial Sequence
  chemically synthesized
tatgataaagtgtaccccagtg

SEQ ID NO: 763703 - DNA, 22 bp, Artificial Sequence
  chemically synthesized
tgataaagtgtaccccagtgcc

SEQ ID NO: 763704 - DNA, 22 bp, Artificial Sequence
  chemically synthesized
atccatatagtaatgaaattat

SEQ ID NO: 763705 - DNA, 22 bp, Artificial Sequence
  chemically synthesized
gatccatatagtaatgaaatta

SEQ ID NO: 763706 - DNA, 22 bp, Artificial Sequence
  chemically synthesized
cattactatatggatcaagtca

SEQ ID NO: 763707 - DNA, 22 bp, Artificial Sequence
  chemically synthesized
attactatatggatcaagtcat

SEQ ID NO: 763708 - DNA, 22 bp, Artificial Sequence
  chemically synthesized
cgtaaatagaaaatatgacttg

SEQ ID NO: 763709 - DNA, 22 bp, Artificial Sequence
  chemically synthesized
ctatatggatcaagtcatattt

SEQ ID NO: 763710 - DNA, 22 bp, Artificial Sequence
  chemically synthesized
ctacgtaaatagaaaatatgac

SEQ ID NO: 763711 - DNA, 22 bp, Artificial Sequence
  chemically synthesized
tatggatcaagtcatattttct

SEQ ID NO: 763712 - DNA, 22 bp, Artificial Sequence
  chemically synthesized
cagattactacgtaaatagaaa

SEQ ID NO: 763713 - DNA, 22 bp, Artificial Sequence
  chemically synthesized
tacagattactacgtaaataga

SEQ ID NO: 763714 - DNA, 22 bp, Artificial Sequence
  chemically synthesized
actctacagattactacgtaaa

SEQ ID NO: 763715 - DNA, 22 bp, Artificial Sequence
  chemically synthesized
tctatttacgtagtaatctgta

SEQ ID NO: 763716 - DNA, 22 bp, Artificial Sequence
  chemically synthesized
ctatttacgtagtaatctgtag

SEQ ID NO: 763717 - DNA, 22 bp, Artificial Sequence
  chemically synthesized
tatttacgtagtaatctgtaga

SEQ ID NO: 763718 - DNA, 22 bp, Artificial Sequence
  chemically synthesized
tttacgtagtaatctgtagagt

SEQ ID NO: 763719 - DNA, 22 bp, Artificial Sequence
  chemically synthesized
tggtcagagttaactctacaga

SEQ ID NO: 763720 - DNA, 22 bp, Artificial Sequence
  chemically synthesized
atggtcagagttaactctacag

SEQ ID NO: 763721 - DNA, 22 bp, Artificial Sequence
  chemically synthesized
tatggtcagagttaactctaca

SEQ ID NO: 763722 - DNA, 22 bp, Artificial Sequence
  chemically synthesized
acgtagtaatctgtagagttaa

SEQ ID NO: 763723 - DNA, 22 bp, Artificial Sequence
  chemically synthesized
ttatggtcagagttaactctac

SEQ ID NO: 763724 - DNA, 22 bp, Artificial Sequence
  chemically synthesized
cgtagtaatctgtagagttaac

SEQ ID NO: 763725 - DNA, 22 bp, Artificial Sequence
  chemically synthesized
cacgcttttatggtcagagtta

SEQ ID NO: 763726 - DNA, 22 bp, Artificial Sequence
  chemically synthesized
tccacgcttttatggtcagagt

SEQ ID NO: 763727 - DNA, 22 bp, Artificial Sequence
  chemically synthesized
tagagttaactctgaccataaa

SEQ ID NO: 763728 - DNA, 22 bp, Artificial Sequence
  chemically synthesized
gtctctccacgcttttatggtc

SEQ ID NO: 763729 - DNA, 22 bp, Artificial Sequence
  chemically synthesized
ttagtctctccacgcttttatg

SEQ ID NO: 763730 - DNA, 22 bp, Artificial Sequence
  chemically synthesized
attagtctctccacgcttttat

SEQ ID NO: 763731 - DNA, 22 bp, Artificial Sequence
  chemically synthesized
actctgaccataaaagcgtgga

SEQ ID NO: 763732 - DNA, 22 bp, Artificial Sequence
  chemically synthesized
tttattagtctctccacgcttt

SEQ ID NO: 763733 - DNA, 22 bp, Artificial Sequence
  chemically synthesized
gtttattagtctctccacgctt

SEQ ID NO: 763734 - DNA, 22 bp, Artificial Sequence
  chemically synthesized
tgaccataaaagcgtggagaga

SEQ ID NO: 763735 - DNA, 22 bp, Artificial Sequence
  chemically synthesized
accataaaagcgtggagagact

SEQ ID NO: 763736 - DNA, 22 bp, Artificial Sequence
  chemically synthesized
tgggccaagtgcaatcttgttt

SEQ ID NO: 763737 - DNA, 22 bp, Artificial Sequence
  chemically synthesized
gtgctgtgggccaagtgcaatc

SEQ ID NO: 763738 - DNA, 22 bp, Artificial Sequence
  chemically synthesized
ataaacaagattgcacttggcc

SEQ ID NO: 763739 - DNA, 22 bp, Artificial Sequence
  chemically synthesized
ccaggaatgtgctggtgctgtg

SEQ ID NO: 763740 - DNA, 22 bp, Artificial Sequence
  chemically synthesized
cacttggcccacagcaccagca

SEQ ID NO: 763741 - DNA, 22 bp, Artificial Sequence
  chemically synthesized
ggcccacagcaccagcacattc

SEQ ID NO: 763742 - DNA, 22 bp, Artificial Sequence
  chemically synthesized
gcccacagcaccagcacattcc

SEQ ID NO: 763743 - DNA, 22 bp, Artificial Sequence
  chemically synthesized
ccatgacagactcccaggaatg

SEQ ID NO: 763744 - DNA, 22 bp, Artificial Sequence
  chemically synthesized
tcccatgacagactcccaggaa

SEQ ID NO: 763745 - DNA, 22 bp, Artificial Sequence
  chemically synthesized
tctcccatgacagactcccagg

SEQ ID NO: 763746 - DNA, 22 bp, Artificial Sequence
  chemically synthesized
ctctcccatgacagactcccag

SEQ ID NO: 763747 - DNA, 22 bp, Artificial Sequence
  chemically synthesized
tctctcccatgacagactccca

SEQ ID NO: 763748 - DNA, 22 bp, Artificial Sequence
  chemically synthesized
ctgggagtctgtcatgggagag

SEQ ID NO: 763749 - DNA, 22 bp, Artificial Sequence
  chemically synthesized
tcaagaagattttctctcccat

SEQ ID NO: 763750 - DNA, 22 bp, Artificial Sequence
  chemically synthesized
ggagtctgtcatgggagagaaa

SEQ ID NO: 763751 - DNA, 22 bp, Artificial Sequence
  chemically synthesized
tgttgtcaagaagattttctct

SEQ ID NO: 763752 - DNA, 22 bp, Artificial Sequence
  chemically synthesized
gtgttgtcaagaagattttctc

SEQ ID NO: 763753 - DNA, 22 bp, Artificial Sequence
  chemically synthesized
tcatgggagagaaaatcttctt

SEQ ID NO: 763754 - DNA, 22 bp, Artificial Sequence
  chemically synthesized
atttgtgttgtcaagaagattt

SEQ ID NO: 763755 - DNA, 22 bp, Artificial Sequence
  chemically synthesized
aatttgtgttgtcaagaagatt

SEQ ID NO: 763756 - DNA, 22 bp, Artificial Sequence
  chemically synthesized
cttgacaacacaaattaagttc

SEQ ID NO: 763757 - DNA, 22 bp, Artificial Sequence
  chemically synthesized
taataccaaggtgaacttaatt

SEQ ID NO: 763758 - DNA, 22 bp, Artificial Sequence
  chemically synthesized
ttgacaacacaaattaagttca

SEQ ID NO: 763759 - DNA, 22 bp, Artificial Sequence
  chemically synthesized
gacaacacaaattaagttcacc

SEQ ID NO: 763760 - DNA, 22 bp, Artificial Sequence
  chemically synthesized
acaacacaaattaagttcacct

SEQ ID NO: 763761 - DNA, 22 bp, Artificial Sequence
  chemically synthesized
tatgtatgatgctataatacca

SEQ ID NO: 763762 - DNA, 22 bp, Artificial Sequence
  chemically synthesized
agttcaccttggtattatagca

SEQ ID NO: 763763 - DNA, 22 bp, Artificial Sequence
  chemically synthesized
tactatatgtatgatgctataa

SEQ ID NO: 763764 - DNA, 22 bp, Artificial Sequence
  chemically synthesized
accttggtattatagcatcata

SEQ ID NO: 763765 - DNA, 22 bp, Artificial Sequence
  chemically synthesized
ggtattatagcatcatacatat

SEQ ID NO: 763766 - DNA, 22 bp, Artificial Sequence
  chemically synthesized
gtattatagcatcatacatata

SEQ ID NO: 763767 - DNA, 22 bp, Artificial Sequence
  chemically synthesized
tagcatcatacatatagtacag

SEQ ID NO: 763768 - DNA, 22 bp, Artificial Sequence
  chemically synthesized
ataaatgtatgatgctgtacta

SEQ ID NO: 763769 - DNA, 22 bp, Artificial Sequence
  chemically synthesized
aatgggaaatcaaaactaataa

SEQ ID NO: 763770 - DNA, 22 bp, Artificial Sequence
  chemically synthesized
aaaatgtgtattaaatgggaaa

SEQ ID NO: 763771 - DNA, 22 bp, Artificial Sequence
  chemically synthesized
attagttttgatttcccattta

SEQ ID NO: 763772 - DNA, 22 bp, Artificial Sequence
  chemically synthesized
ttagttttgatttcccatttaa

SEQ ID NO: 763773 - DNA, 22 bp, Artificial Sequence
  chemically synthesized
gttttgatttcccatttaatac

SEQ ID NO: 763774 - DNA, 22 bp, Artificial Sequence
  chemically synthesized
tgatttcccatttaatacacat

SEQ ID NO: 763775 - DNA, 22 bp, Artificial Sequence
  chemically synthesized
tcaagcctaaaaatgtgtatta

SEQ ID NO: 763776 - DNA, 22 bp, Artificial Sequence
  chemically synthesized
gatttcccatttaatacacatt

SEQ ID NO: 763777 - DNA, 22 bp, Artificial Sequence
  chemically synthesized
atttcccatttaatacacattt

SEQ ID NO: 763778 - DNA, 22 bp, Artificial Sequence
  chemically synthesized
cccatttaatacacatttttag

SEQ ID NO: 763779 - DNA, 22 bp, Artificial Sequence
  chemically synthesized
cacctgtcaagcctaaaaatgt

SEQ ID NO: 763780 - DNA, 22 bp, Artificial Sequence
  chemically synthesized
ccatttaatacacatttttagg

SEQ ID NO: 763781 - DNA, 22 bp, Artificial Sequence
  chemically synthesized
ccacctgtcaagcctaaaaatg

SEQ ID NO: 763782 - DNA, 22 bp, Artificial Sequence
  chemically synthesized
tccacctgtcaagcctaaaaat

SEQ ID NO: 763783 - DNA, 22 bp, Artificial Sequence
  chemically synthesized
aatacacatttttaggcttgac

SEQ ID NO: 763784 - DNA, 22 bp, Artificial Sequence
  chemically synthesized
atacacatttttaggcttgaca

SEQ ID NO: 763785 - DNA, 22 bp, Artificial Sequence
  chemically synthesized
tgtactttccacctgtcaagcc

SEQ ID NO: 763786 - DNA, 22 bp, Artificial Sequence
  chemically synthesized
ttaggcttgacaggtggaaagt

SEQ ID NO: 763787 - DNA, 22 bp, Artificial Sequence
  chemically synthesized
taggcttgacaggtggaaagta

SEQ ID NO: 763788 - DNA, 22 bp, Artificial Sequence
  chemically synthesized
aggcttgacaggtggaaagtac

SEQ ID NO: 763789 - DNA, 22 bp, Artificial Sequence
  chemically synthesized
ccaaggtcctatgtactttcca

SEQ ID NO: 763790 - DNA, 22 bp, Artificial Sequence
  chemically synthesized
ggcttgacaggtggaaagtaca

SEQ ID NO: 763791 - DNA, 22 bp, Artificial Sequence
  chemically synthesized
accaaggtcctatgtactttcc

SEQ ID NO: 763792 - DNA, 22 bp, Artificial Sequence
  chemically synthesized
ttaccaaggtcctatgtacttt

SEQ ID NO: 763793 - DNA, 22 bp, Artificial Sequence
  chemically synthesized
gacaggtggaaagtacatagga

SEQ ID NO: 763794 - DNA, 22 bp, Artificial Sequence
  chemically synthesized
acaggtggaaagtacataggac

SEQ ID NO: 763795 - DNA, 22 bp, Artificial Sequence
  chemically synthesized
tcataactcttaccaaggtcct

SEQ ID NO: 763796 - DNA, 22 bp, Artificial Sequence
  chemically synthesized
atcataactcttaccaaggtcc

SEQ ID NO: 763797 - DNA, 22 bp, Artificial Sequence
  chemically synthesized
ttatcataactcttaccaaggt

SEQ ID NO: 763798 - DNA, 22 bp, Artificial Sequence
  chemically synthesized
aatgcataacctcttatcataa

SEQ ID NO: 763799 - DNA, 22 bp, Artificial Sequence
  chemically synthesized
ggtaagagttatgataagaggt

SEQ ID NO: 763800 - DNA, 22 bp, Artificial Sequence
  chemically synthesized
gtaagagttatgataagaggtt

SEQ ID NO: 763801 - DNA, 22 bp, Artificial Sequence
  chemically synthesized
tgataagaggttatgcattcaa

SEQ ID NO: 763802 - DNA, 22 bp, Artificial Sequence
  chemically synthesized
tgtgtatacaagtgaagttgaa

SEQ ID NO: 763803 - DNA, 22 bp, Artificial Sequence
  chemically synthesized
atctgtgtgtatacaagtgaag

SEQ ID NO: 763804 - DNA, 22 bp, Artificial Sequence
  chemically synthesized
gatctgtgtgtatacaagtgaa

SEQ ID NO: 763805 - DNA, 22 bp, Artificial Sequence
  chemically synthesized
tgcattcaacttcacttgtata

SEQ ID NO: 763806 - DNA, 22 bp, Artificial Sequence
  chemically synthesized
ttgatctgtgtgtatacaagtg

SEQ ID NO: 763807 - DNA, 22 bp, Artificial Sequence
  chemically synthesized
cttgatctgtgtgtatacaagt

SEQ ID NO: 763808 - DNA, 22 bp, Artificial Sequence
  chemically synthesized
tcttgatctgtgtgtatacaag

SEQ ID NO: 763809 - DNA, 22 bp, Artificial Sequence
  chemically synthesized
aacttcacttgtatacacacag

SEQ ID NO: 763810 - DNA, 22 bp, Artificial Sequence
  chemically synthesized
taataattttcttgatctgtgt

SEQ ID NO: 763811 - DNA, 22 bp, Artificial Sequence
  chemically synthesized
cacttgtatacacacagatcaa

SEQ ID NO: 763812 - DNA, 22 bp, Artificial Sequence
  chemically synthesized
acttgtatacacacagatcaag

SEQ ID NO: 763813 - DNA, 22 bp, Artificial Sequence
  chemically synthesized
ctataataattttcttgatctg

SEQ ID NO: 763814 - DNA, 22 bp, Artificial Sequence
  chemically synthesized
tactataataattttcttgatc

SEQ ID NO: 763815 - DNA, 22 bp, Artificial Sequence
  chemically synthesized
gtatacacacagatcaagaaaa

SEQ ID NO: 763816 - DNA, 22 bp, Artificial Sequence
  chemically synthesized
ctactataataattttcttgat

SEQ ID NO: 763817 - DNA, 22 bp, Artificial Sequence
  chemically synthesized
tatacacacagatcaagaaaat

SEQ ID NO: 763818 - DNA, 22 bp, Artificial Sequence
  chemically synthesized
ttctactataataattttcttg

SEQ ID NO: 763819 - DNA, 22 bp, Artificial Sequence
  chemically synthesized
ttatagtagaagaatctgacct

SEQ ID NO: 763820 - DNA, 22 bp, Artificial Sequence
  chemically synthesized
tagtagaagaatctgaccttta

SEQ ID NO: 763821 - DNA, 22 bp, Artificial Sequence
  chemically synthesized
cacaggaagacataccatgtaa

SEQ ID NO: 763822 - DNA, 22 bp, Artificial Sequence
  chemically synthesized
acctttacatggtatgtcttcc

SEQ ID NO: 763823 - DNA, 22 bp, Artificial Sequence
  chemically synthesized
aaaatgttacacaggaagacat

SEQ ID NO: 763824 - DNA, 22 bp, Artificial Sequence
  chemically synthesized
tacatggtatgtcttcctgtgt

SEQ ID NO: 763825 - DNA, 22 bp, Artificial Sequence
  chemically synthesized
acatggtatgtcttcctgtgta

SEQ ID NO: 763826 - DNA, 22 bp, Artificial Sequence
  chemically synthesized
catggtatgtcttcctgtgtaa

SEQ ID NO: 763827 - DNA, 22 bp, Artificial Sequence
  chemically synthesized
aagctgaaaatgttacacagga

SEQ ID NO: 763828 - DNA, 22 bp, Artificial Sequence
  chemically synthesized
cctgtgtaacattttcagcttg

SEQ ID NO: 763829 - DNA, 22 bp, Artificial Sequence
  chemically synthesized
tagtgcccggttcaagctgaaa

SEQ ID NO: 763830 - DNA, 22 bp, Artificial Sequence
  chemically synthesized
ctgtgtaacattttcagcttga

SEQ ID NO: 763831 - DNA, 22 bp, Artificial Sequence
  chemically synthesized
tgtaacattttcagcttgaacc

SEQ ID NO: 763832 - DNA, 22 bp, Artificial Sequence
  chemically synthesized
tcagcttgaaccgggcactaca

SEQ ID NO: 763833 - DNA, 22 bp, Artificial Sequence
  chemically synthesized
cagcttgaaccgggcactacag

SEQ ID NO: 763834 - DNA, 22 bp, Artificial Sequence
  chemically synthesized
agcttgaaccgggcactacagc

SEQ ID NO: 763835 - DNA, 22 bp, Artificial Sequence
  chemically synthesized
tgcaacaggatcagtgctgtag

SEQ ID NO: 763836 - DNA, 22 bp, Artificial Sequence
  chemically synthesized
gaaccgggcactacagcactga

SEQ ID NO: 763837 - DNA, 22 bp, Artificial Sequence
  chemically synthesized
aaccgggcactacagcactgat

SEQ ID NO: 763838 - DNA, 22 bp, Artificial Sequence
  chemically synthesized
ctatgcaacaggatcagtgctg

SEQ ID NO: 763839 - DNA, 22 bp, Artificial Sequence
  chemically synthesized
aggattgctatgcaacaggatc

SEQ ID NO: 763840 - DNA, 22 bp, Artificial Sequence
  chemically synthesized
tcaggattgctatgcaacagga

SEQ ID NO: 763841 - DNA, 22 bp, Artificial Sequence
  chemically synthesized
ctcaggattgctatgcaacagg

SEQ ID NO: 763842 - DNA, 22 bp, Artificial Sequence
  chemically synthesized
tctcaggattgctatgcaacag

SEQ ID NO: 763843 - DNA, 22 bp, Artificial Sequence
  chemically synthesized
cagcactgatcctgttgcatag

SEQ ID NO: 763844 - DNA, 22 bp, Artificial Sequence
  chemically synthesized
ggttttctcaggattgctatgc

SEQ ID NO: 763845 - DNA, 22 bp, Artificial Sequence
  chemically synthesized
tgggttttctcaggattgctat

SEQ ID NO: 763846 - DNA, 22 bp, Artificial Sequence
  chemically synthesized
ctgggttttctcaggattgcta

SEQ ID NO: 763847 - DNA, 22 bp, Artificial Sequence
  chemically synthesized
atcctgttgcatagcaatcctg

SEQ ID NO: 763848 - DNA, 22 bp, Artificial Sequence
  chemically synthesized
agtttctgggttttctcaggat

SEQ ID NO: 763849 - DNA, 22 bp, Artificial Sequence
  chemically synthesized
cagtttctgggttttctcagga

SEQ ID NO: 763850 - DNA, 22 bp, Artificial Sequence
  chemically synthesized
ttgcatagcaatcctgagaaaa

SEQ ID NO: 763851 - DNA, 22 bp, Artificial Sequence
  chemically synthesized
tcagtttctgggttttctcagg

SEQ ID NO: 763852 - DNA, 22 bp, Artificial Sequence
  chemically synthesized
tttcagtttctgggttttctca

SEQ ID NO: 763853 - DNA, 22 bp, Artificial Sequence
  chemically synthesized
catagcaatcctgagaaaaccc

SEQ ID NO: 763854 - DNA, 22 bp, Artificial Sequence
  chemically synthesized
aagcagggctctttcagtttct

SEQ ID NO: 763855 - DNA, 22 bp, Artificial Sequence
  chemically synthesized
aaagcagggctctttcagtttc

SEQ ID NO: 763856 - DNA, 22 bp, Artificial Sequence
  chemically synthesized
taaagcagggctctttcagttt

SEQ ID NO: 763857 - DNA, 22 bp, Artificial Sequence
  chemically synthesized
agaaaacccagaaactgaaaga

SEQ ID NO: 763858 - DNA, 22 bp, Artificial Sequence
  chemically synthesized
gcattttaaagcagggctcttt

SEQ ID NO: 763859 - DNA, 22 bp, Artificial Sequence
  chemically synthesized
aaagagccctgctttaaaatgc

SEQ ID NO: 763860 - DNA, 22 bp, Artificial Sequence
  chemically synthesized
ctttaaaatgccaactttgctt

SEQ ID NO: 763861 - DNA, 22 bp, Artificial Sequence
  chemically synthesized
tcaacagaatgtaagcaaagtt

SEQ ID NO: 763862 - DNA, 22 bp, Artificial Sequence
  chemically synthesized
tgtcaacagaatgtaagcaaag

SEQ ID NO: 763863 - DNA, 22 bp, Artificial Sequence
  chemically synthesized
taaaatgccaactttgcttaca

SEQ ID NO: 763864 - DNA, 22 bp, Artificial Sequence
  chemically synthesized
aaaatgccaactttgcttacat

SEQ ID NO: 763865 - DNA, 22 bp, Artificial Sequence
  chemically synthesized
aaatgccaactttgcttacatt

SEQ ID NO: 763866 - DNA, 22 bp, Artificial Sequence
  chemically synthesized
attctgtcaacagaatgtaagc

SEQ ID NO: 763867 - DNA, 22 bp, Artificial Sequence
  chemically synthesized
caaaattcattctgtcaacaga

SEQ ID NO: 763868 - DNA, 22 bp, Artificial Sequence
  chemically synthesized
tgcttacattctgttgacagaa

SEQ ID NO: 763869 - DNA, 22 bp, Artificial Sequence
  chemically synthesized
gcttacattctgttgacagaat

SEQ ID NO: 763870 - DNA, 22 bp, Artificial Sequence
  chemically synthesized
cttacattctgttgacagaatg

SEQ ID NO: 763871 - DNA, 22 bp, Artificial Sequence
  chemically synthesized
tgctccaaaattcattctgtca

SEQ ID NO: 763872 - DNA, 22 bp, Artificial Sequence
  chemically synthesized
acattctgttgacagaatgaat

SEQ ID NO: 763873 - DNA, 22 bp, Artificial Sequence
  chemically synthesized
cattctgttgacagaatgaatt

SEQ ID NO: 763874 - DNA, 22 bp, Artificial Sequence
  chemically synthesized
tgttgacagaatgaattttgga

SEQ ID NO: 763875 - DNA, 22 bp, Artificial Sequence
  chemically synthesized
gtgaggcctgtgctccaaaatt

SEQ ID NO: 763876 - DNA, 22 bp, Artificial Sequence
  chemically synthesized
ttgacagaatgaattttggagc

SEQ ID NO: 763877 - DNA, 22 bp, Artificial Sequence
  chemically synthesized
acagaatgaattttggagcaca

SEQ ID NO: 763878 - DNA, 22 bp, Artificial Sequence
  chemically synthesized
actggtgaggcctgtgctccaa

SEQ ID NO: 763879 - DNA, 22 bp, Artificial Sequence
  chemically synthesized
ttgactggtgaggcctgtgctc

SEQ ID NO: 763880 - DNA, 22 bp, Artificial Sequence
  chemically synthesized
ttattgactggtgaggcctgtg

SEQ ID NO: 763881 - DNA, 22 bp, Artificial Sequence
  chemically synthesized
ttattattgactggtgaggcct

SEQ ID NO: 763882 - DNA, 22 bp, Artificial Sequence
  chemically synthesized
attattattgactggtgaggcc

SEQ ID NO: 763883 - DNA, 22 bp, Artificial Sequence
  chemically synthesized
tggagcacaggcctcaccagtc

SEQ ID NO: 763884 - DNA, 22 bp, Artificial Sequence
  chemically synthesized
ggagcacaggcctcaccagtca

SEQ ID NO: 763885 - DNA, 22 bp, Artificial Sequence
  chemically synthesized
gagcacaggcctcaccagtcaa

SEQ ID NO: 763886 - DNA, 22 bp, Artificial Sequence
  chemically synthesized
accagtcaataataataaacgg

SEQ ID NO: 763887 - DNA, 22 bp, Artificial Sequence
  chemically synthesized
gtgcggagtacaaagtggccgt

SEQ ID NO: 763888 - DNA, 22 bp, Artificial Sequence
  chemically synthesized
agtgcggagtacaaagtggccg

SEQ ID NO: 763889 - DNA, 22 bp, Artificial Sequence
  chemically synthesized
tttagtgcggagtacaaagtgg

SEQ ID NO: 763890 - DNA, 22 bp, Artificial Sequence
  chemically synthesized
ctgtttagtgcggagtacaaag

SEQ ID NO: 763891 - DNA, 22 bp, Artificial Sequence
  chemically synthesized
gctactgtttagtgcggagtac

SEQ ID NO: 763892 - DNA, 22 bp, Artificial Sequence
  chemically synthesized
tgtactccgcactaaacagtag

SEQ ID NO: 763893 - DNA, 22 bp, Artificial Sequence
  chemically synthesized
gtactccgcactaaacagtagc

SEQ ID NO: 763894 - DNA, 22 bp, Artificial Sequence
  chemically synthesized
tactccgcactaaacagtagcc

SEQ ID NO: 763895 - DNA, 22 bp, Artificial Sequence
  chemically synthesized
ccacatccacacgcctggctac

SEQ ID NO: 763896 - DNA, 22 bp, Artificial Sequence
  chemically synthesized
cgcactaaacagtagccaggcg

SEQ ID NO: 763897 - DNA, 22 bp, Artificial Sequence
  chemically synthesized
ctcccacatccacacgcctggc

SEQ ID NO: 763898 - DNA, 22 bp, Artificial Sequence
  chemically synthesized
aacagtagccaggcgtgtggat

SEQ ID NO: 763899 - DNA, 22 bp, Artificial Sequence
  chemically synthesized
aggttcctcccacatccacacg

SEQ ID NO: 763900 - DNA, 22 bp, Artificial Sequence
  chemically synthesized
gaggttcctcccacatccacac

SEQ ID NO: 763901 - DNA, 22 bp, Artificial Sequence
  chemically synthesized
tgaggttcctcccacatccaca

SEQ ID NO: 763902 - DNA, 22 bp, Artificial Sequence
  chemically synthesized
tttgaggttcctcccacatcca

SEQ ID NO: 763903 - DNA, 22 bp, Artificial Sequence
  chemically synthesized
tctttgaggttcctcccacatc

SEQ ID NO: 763904 - DNA, 22 bp, Artificial Sequence
  chemically synthesized
ctctctttgaggttcctcccac

SEQ ID NO: 763905 - DNA, 22 bp, Artificial Sequence
  chemically synthesized
caggcctcctctctttgaggtt

SEQ ID NO: 763906 - DNA, 22 bp, Artificial Sequence
  chemically synthesized
catattccaggcctcctctctt

SEQ ID NO: 763907 - DNA, 22 bp, Artificial Sequence
  chemically synthesized
tcagttgcatattccaggcctc

SEQ ID NO: 763908 - DNA, 22 bp, Artificial Sequence
  chemically synthesized
aaagagaggaggcctggaatat

SEQ ID NO: 763909 - DNA, 22 bp, Artificial Sequence
  chemically synthesized
atataaactgtcagttgcatat

SEQ ID NO: 763910 - DNA, 22 bp, Artificial Sequence
  chemically synthesized
aatataaactgtcagttgcata

SEQ ID NO: 763911 - DNA, 22 bp, Artificial Sequence
  chemically synthesized
tttaatataaactgtcagttgc

SEQ ID NO: 763912 - DNA, 22 bp, Artificial Sequence
  chemically synthesized
gctgtttaatataaactgtcag

SEQ ID NO: 763913 - DNA, 22 bp, Artificial Sequence
  chemically synthesized
gaatatgcaactgacagtttat

SEQ ID NO: 763914 - DNA, 22 bp, Artificial Sequence
  chemically synthesized
acagtttatattaaacagccaa

SEQ ID NO: 763915 - DNA, 22 bp, Artificial Sequence
  chemically synthesized
atattaaacagccaacttttct

SEQ ID NO: 763916 - DNA, 22 bp, Artificial Sequence
  chemically synthesized
tattaaacagccaacttttctt

SEQ ID NO: 763917 - DNA, 22 bp, Artificial Sequence
  chemically synthesized
taatggcagaatgataagaaaa

SEQ ID NO: 763918 - DNA, 22 bp, Artificial Sequence
  chemically synthesized
gtaatggcagaatgataagaaa

SEQ ID NO: 763919 - DNA, 22 bp, Artificial Sequence
  chemically synthesized
aacagccaacttttcttatcat

SEQ ID NO: 763920 - DNA, 22 bp, Artificial Sequence
  chemically synthesized
gcttgtaatggcagaatgataa

SEQ ID NO: 763921 - DNA, 22 bp, Artificial Sequence
  chemically synthesized
tggcttgtaatggcagaatgat

SEQ ID NO: 763922 - DNA, 22 bp, Artificial Sequence
  chemically synthesized
ttcttatcattctgccattaca

SEQ ID NO: 763923 - DNA, 22 bp, Artificial Sequence
  chemically synthesized
tcttatcattctgccattacaa

SEQ ID NO: 763924 - DNA, 22 bp, Artificial Sequence
  chemically synthesized
cttatcattctgccattacaag

SEQ ID NO: 763925 - DNA, 22 bp, Artificial Sequence
  chemically synthesized
taatgtctctggcttgtaatgg

SEQ ID NO: 763926 - DNA, 22 bp, Artificial Sequence
  chemically synthesized
ttatcattctgccattacaagc

SEQ ID NO: 763927 - DNA, 22 bp, Artificial Sequence
  chemically synthesized
ataatgtctctggcttgtaatg

SEQ ID NO: 763928 - DNA, 22 bp, Artificial Sequence
  chemically synthesized
atcattctgccattacaagcca

SEQ ID NO: 763929 - DNA, 22 bp, Artificial Sequence
  chemically synthesized
tcattctgccattacaagccag

SEQ ID NO: 763930 - DNA, 22 bp, Artificial Sequence
  chemically synthesized
tgccattacaagccagagacat

SEQ ID NO: 763931 - DNA, 22 bp, Artificial Sequence
  chemically synthesized
ccattacaagccagagacatta

SEQ ID NO: 763932 - DNA, 22 bp, Artificial Sequence
  chemically synthesized
caagccagagacattataaatt

SEQ ID NO: 763933 - DNA, 22 bp, Artificial Sequence
  chemically synthesized
taaattcattttatatatgtgt

SEQ ID NO: 763934 - DNA, 22 bp, Artificial Sequence
  chemically synthesized
ggaacaaggaaggaaacacata

SEQ ID NO: 763935 - DNA, 22 bp, Artificial Sequence
  chemically synthesized
ctgggaacaaggaaggaaacac

SEQ ID NO: 763936 - DNA, 22 bp, Artificial Sequence
  chemically synthesized
attttatatatgtgtttccttc

SEQ ID NO: 763937 - DNA, 22 bp, Artificial Sequence
  chemically synthesized
tgctgggaacaaggaaggaaac

SEQ ID NO: 763938 - DNA, 22 bp, Artificial Sequence
  chemically synthesized
tatatatgtgtttccttccttg

SEQ ID NO: 763939 - DNA, 22 bp, Artificial Sequence
  chemically synthesized
ttctgctgggaacaaggaagga

SEQ ID NO: 763940 - DNA, 22 bp, Artificial Sequence
  chemically synthesized
atatatgtgtttccttccttgt

SEQ ID NO: 763941 - DNA, 22 bp, Artificial Sequence
  chemically synthesized
tatatgtgtttccttccttgtt

SEQ ID NO: 763942 - DNA, 22 bp, Artificial Sequence
  chemically synthesized
actattctgctgggaacaagga

SEQ ID NO: 763943 - DNA, 22 bp, Artificial Sequence
  chemically synthesized
gactattctgctgggaacaagg

SEQ ID NO: 763944 - DNA, 22 bp, Artificial Sequence
  chemically synthesized
tgactattctgctgggaacaag

SEQ ID NO: 763945 - DNA, 22 bp, Artificial Sequence
  chemically synthesized
gctttgactattctgctgggaa

SEQ ID NO: 763946 - DNA, 22 bp, Artificial Sequence
  chemically synthesized
ggctttgactattctgctggga

SEQ ID NO: 763947 - DNA, 22 bp, Artificial Sequence
  chemically synthesized
ccttccttgttcccagcagaat

SEQ ID NO: 763948 - DNA, 22 bp, Artificial Sequence
  chemically synthesized
cttccttgttcccagcagaata

SEQ ID NO: 763949 - DNA, 22 bp, Artificial Sequence
  chemically synthesized
ccttggctttgactattctgct

SEQ ID NO: 763950 - DNA, 22 bp, Artificial Sequence
  chemically synthesized
ccttgttcccagcagaatagtc

SEQ ID NO: 763951 - DNA, 22 bp, Artificial Sequence
  chemically synthesized
cttgttcccagcagaatagtca

SEQ ID NO: 763952 - DNA, 22 bp, Artificial Sequence
  chemically synthesized
gttcccagcagaatagtcaaag

SEQ ID NO: 763953 - DNA, 22 bp, Artificial Sequence
  chemically synthesized
ttcccagcagaatagtcaaagc

SEQ ID NO: 763954 - DNA, 22 bp, Artificial Sequence
  chemically synthesized
ccagcagaatagtcaaagccaa

SEQ ID NO: 763955 - DNA, 22 bp, Artificial Sequence
  chemically synthesized
aggaatgttcccttggctttga

SEQ ID NO: 763956 - DNA, 22 bp, Artificial Sequence
  chemically synthesized
tgaggaatgttcccttggcttt

SEQ ID NO: 763957 - DNA, 22 bp, Artificial Sequence
  chemically synthesized
tctgaggaatgttcccttggct

SEQ ID NO: 763958 - DNA, 22 bp, Artificial Sequence
  chemically synthesized
gtacccggcagctctctgagga

SEQ ID NO: 763959 - DNA, 22 bp, Artificial Sequence
  chemically synthesized
ctcagagagctgccgggtacca

SEQ ID NO: 763960 - DNA, 22 bp, Artificial Sequence
  chemically synthesized
agagagctgccgggtaccagca

SEQ ID NO: 763961 - DNA, 22 bp, Artificial Sequence
  chemically synthesized
tgtaggcagaaaggaatgctgg

SEQ ID NO: 763962 - DNA, 22 bp, Artificial Sequence
  chemically synthesized
attgtgtaggcagaaaggaatg

SEQ ID NO: 763963 - DNA, 22 bp, Artificial Sequence
  chemically synthesized
ccgggtaccagcattcctttct

SEQ ID NO: 763964 - DNA, 22 bp, Artificial Sequence
  chemically synthesized
cattcattgtgtaggcagaaag

SEQ ID NO: 763965 - DNA, 22 bp, Artificial Sequence
  chemically synthesized
ctttctgcctacacaatgaatg

SEQ ID NO: 763966 - DNA, 22 bp, Artificial Sequence
  chemically synthesized
tctgcctacacaatgaatggag

SEQ ID NO: 763967 - DNA, 22 bp, Artificial Sequence
  chemically synthesized
ctgcctacacaatgaatggagg

SEQ ID NO: 763968 - DNA, 22 bp, Artificial Sequence
  chemically synthesized
tgcctacacaatgaatggaggc

SEQ ID NO: 763969 - DNA, 22 bp, Artificial Sequence
  chemically synthesized
cctacacaatgaatggaggctt

SEQ ID NO: 763970 - DNA, 22 bp, Artificial Sequence
  chemically synthesized
cacaatgaatggaggctttgta

SEQ ID NO: 763971 - DNA, 22 bp, Artificial Sequence
  chemically synthesized
agagcaagtcagataatataca

SEQ ID NO: 763972 - DNA, 22 bp, Artificial Sequence
  chemically synthesized
taagagcaagtcagataatata

SEQ ID NO: 763973 - DNA, 22 bp, Artificial Sequence
  chemically synthesized
tgtatattatctgacttgctct

SEQ ID NO: 763974 - DNA, 22 bp, Artificial Sequence
  chemically synthesized
gtatattatctgacttgctctt

SEQ ID NO: 763975 - DNA, 22 bp, Artificial Sequence
  chemically synthesized
tatattatctgacttgctctta

SEQ ID NO: 763976 - DNA, 22 bp, Artificial Sequence
  chemically synthesized
tctgacttgctcttagagattt

SEQ ID NO: 763977 - DNA, 22 bp, Artificial Sequence
  chemically synthesized
aacagaagcatacaaatctcta

SEQ ID NO: 763978 - DNA, 22 bp, Artificial Sequence
  chemically synthesized
acttgctcttagagatttgtat

SEQ ID NO: 763979 - DNA, 22 bp, Artificial Sequence
  chemically synthesized
ttgaacagaagcatacaaatct

SEQ ID NO: 763980 - DNA, 22 bp, Artificial Sequence
  chemically synthesized
gttgaacagaagcatacaaatc

SEQ ID NO: 763981 - DNA, 22 bp, Artificial Sequence
  chemically synthesized
gctcttagagatttgtatgctt

SEQ ID NO: 763982 - DNA, 22 bp, Artificial Sequence
  chemically synthesized
ctcttagagatttgtatgcttc

SEQ ID NO: 763983 - DNA, 22 bp, Artificial Sequence
  chemically synthesized
aacttgttgaacagaagcatac

SEQ ID NO: 763984 - DNA, 22 bp, Artificial Sequence
  chemically synthesized
aaacttgttgaacagaagcata

SEQ ID NO: 763985 - DNA, 22 bp, Artificial Sequence
  chemically synthesized
ttagagatttgtatgcttctgt

SEQ ID NO: 763986 - DNA, 22 bp, Artificial Sequence
  chemically synthesized
taaacttgttgaacagaagcat

SEQ ID NO: 763987 - DNA, 22 bp, Artificial Sequence
  chemically synthesized
ttaaacttgttgaacagaagca

SEQ ID NO: 763988 - DNA, 22 bp, Artificial Sequence
  chemically synthesized
agagatttgtatgcttctgttc

SEQ ID NO: 763989 - DNA, 22 bp, Artificial Sequence
  chemically synthesized
gagatttgtatgcttctgttca

SEQ ID NO: 763990 - DNA, 22 bp, Artificial Sequence
  chemically synthesized
gtatgcttctgttcaacaagtt

SEQ ID NO: 763991 - DNA, 22 bp, Artificial Sequence
  chemically synthesized
tatgcttctgttcaacaagttt

SEQ ID NO: 763992 - DNA, 22 bp, Artificial Sequence
  chemically synthesized
agaatgaatttttaaacttgtt

SEQ ID NO: 763993 - DNA, 22 bp, Artificial Sequence
  chemically synthesized
cagaatgaatttttaaacttgt

SEQ ID NO: 763994 - DNA, 22 bp, Artificial Sequence
  chemically synthesized
ctgttcaacaagtttaaaaatt

SEQ ID NO: 763995 - DNA, 22 bp, Artificial Sequence
  chemically synthesized
tgttcaacaagtttaaaaattc

SEQ ID NO: 763996 - DNA, 22 bp, Artificial Sequence
  chemically synthesized
gagcttcagaatgaatttttaa

SEQ ID NO: 763997 - DNA, 22 bp, Artificial Sequence
  chemically synthesized
ggagcttcagaatgaattttta

SEQ ID NO: 763998 - DNA, 22 bp, Artificial Sequence
  chemically synthesized
ttcaacaagtttaaaaattcat

SEQ ID NO: 763999 - DNA, 22 bp, Artificial Sequence
  chemically synthesized
tttggagcttcagaatgaattt

SEQ ID NO: 764000 - DNA, 22 bp, Artificial Sequence
  chemically synthesized
aacaagtttaaaaattcattct

SEQ ID NO: 764001 - DNA, 22 bp, Artificial Sequence
  chemically synthesized
aaaaattcattctgaagctcca

SEQ ID NO: 764002 - DNA, 22 bp, Artificial Sequence
  chemically synthesized
aaaattcattctgaagctccaa

SEQ ID NO: 764003 - DNA, 22 bp, Artificial Sequence
  chemically synthesized
attctgaagctccaaacaattg

SEQ ID NO: 764004 - DNA, 22 bp, Artificial Sequence
  chemically synthesized
cacagatcaatccaattgtttg

SEQ ID NO: 764005 - DNA, 22 bp, Artificial Sequence
  chemically synthesized
tgaagctccaaacaattggatt

SEQ ID NO: 764006 - DNA, 22 bp, Artificial Sequence
  chemically synthesized
gttacacagatcaatccaattg

SEQ ID NO: 764007 - DNA, 22 bp, Artificial Sequence
  chemically synthesized
aagctccaaacaattggattga

SEQ ID NO: 764008 - DNA, 22 bp, Artificial Sequence
  chemically synthesized
tagttacacagatcaatccaat

SEQ ID NO: 764009 - DNA, 22 bp, Artificial Sequence
  chemically synthesized
ctagttacacagatcaatccaa

SEQ ID NO: 764010 - DNA, 22 bp, Artificial Sequence
  chemically synthesized
tctagttacacagatcaatcca

SEQ ID NO: 764011 - DNA, 22 bp, Artificial Sequence
  chemically synthesized
ttctagttacacagatcaatcc

SEQ ID NO: 764012 - DNA, 22 bp, Artificial Sequence
  chemically synthesized
caaacaattggattgatctgtg

SEQ ID NO: 764013 - DNA, 22 bp, Artificial Sequence
  chemically synthesized
gattgatctgtgtaactagaaa

SEQ ID NO: 764014 - DNA, 22 bp, Artificial Sequence
  chemically synthesized
atctgtgtaactagaaaagttt

SEQ ID NO: 764015 - DNA, 22 bp, Artificial Sequence
  chemically synthesized
tgtaactagaaaagtttttttt

SEQ ID NO: 764016 - DNA, 22 bp, Artificial Sequence
  chemically synthesized
agagagagagagaaaaaaaaaa

SEQ ID NO: 764017 - DNA, 22 bp, Artificial Sequence
  chemically synthesized
gagagagagagagaaaaaaaaa

SEQ ID NO: 764018 - DNA, 22 bp, Artificial Sequence
  chemically synthesized
gaaaagttttttttttctctct

SEQ ID NO: 764019 - DNA, 22 bp, Artificial Sequence
  chemically synthesized
aatttgagagagagagagaaaa

SEQ ID NO: 764020 - DNA, 22 bp, Artificial Sequence
  chemically synthesized
attcaatttgagagagagagag

SEQ ID NO: 764021 - DNA, 22 bp, Artificial Sequence
  chemically synthesized
aattcaatttgagagagagaga

SEQ ID NO: 764022 - DNA, 22 bp, Artificial Sequence
  chemically synthesized
tttttttctctctctctctcaa

SEQ ID NO: 764023 - DNA, 22 bp, Artificial Sequence
  chemically synthesized
ttttttctctctctctctcaaa

SEQ ID NO: 764024 - DNA, 22 bp, Artificial Sequence
  chemically synthesized
tttttctctctctctctcaaat

SEQ ID NO: 764025 - DNA, 22 bp, Artificial Sequence
  chemically synthesized
ttttctctctctctctcaaatt

SEQ ID NO: 764026 - DNA, 22 bp, Artificial Sequence
  chemically synthesized
tttctctctctctctcaaattg

SEQ ID NO: 764027 - DNA, 22 bp, Artificial Sequence
  chemically synthesized
ttctctctctctctcaaattga

SEQ ID NO: 764028 - DNA, 22 bp, Artificial Sequence
  chemically synthesized
tctctctctctctcaaattgaa

SEQ ID NO: 764029 - DNA, 22 bp, Artificial Sequence
  chemically synthesized
ctctctctctctcaaattgaat

SEQ ID NO: 764030 - DNA, 22 bp, Artificial Sequence
  chemically synthesized
tctctctctctcaaattgaatt

SEQ ID NO: 764031 - DNA, 22 bp, Artificial Sequence
  chemically synthesized
gcagagtaatttaattcaattt

SEQ ID NO: 764032 - DNA, 22 bp, Artificial Sequence
  chemically synthesized
agcagagtaatttaattcaatt

SEQ ID NO: 764033 - DNA, 22 bp, Artificial Sequence
  chemically synthesized
tctctctctcaaattgaattaa

SEQ ID NO: 764034 - DNA, 22 bp, Artificial Sequence
  chemically synthesized
tagcagagtaatttaattcaat

SEQ ID NO: 764035 - DNA, 22 bp, Artificial Sequence
  chemically synthesized
tctctctcaaattgaattaaat

SEQ ID NO: 764036 - DNA, 22 bp, Artificial Sequence
  chemically synthesized
ctttagcagagtaatttaattc

SEQ ID NO: 764037 - DNA, 22 bp, Artificial Sequence
  chemically synthesized
tctctcaaattgaattaaatta

SEQ ID NO: 764038 - DNA, 22 bp, Artificial Sequence
  chemically synthesized
actttagcagagtaatttaatt

SEQ ID NO: 764039 - DNA, 22 bp, Artificial Sequence
  chemically synthesized
tctcaaattgaattaaattact

SEQ ID NO: 764040 - DNA, 22 bp, Artificial Sequence
  chemically synthesized
tcaaattgaattaaattactct

SEQ ID NO: 764041 - DNA, 22 bp, Artificial Sequence
  chemically synthesized
ccttactttagcagagtaattt

SEQ ID NO: 764042 - DNA, 22 bp, Artificial Sequence
  chemically synthesized
aaattgaattaaattactctgc

SEQ ID NO: 764043 - DNA, 22 bp, Artificial Sequence
  chemically synthesized
tcccttactttagcagagtaat

SEQ ID NO: 764044 - DNA, 22 bp, Artificial Sequence
  chemically synthesized
ctcccttactttagcagagtaa

SEQ ID NO: 764045 - DNA, 22 bp, Artificial Sequence
  chemically synthesized
tctcccttactttagcagagta

SEQ ID NO: 764046 - DNA, 22 bp, Artificial Sequence
  chemically synthesized
ttctcccttactttagcagagt

SEQ ID NO: 764047 - DNA, 22 bp, Artificial Sequence
  chemically synthesized
tttctcccttactttagcagag

SEQ ID NO: 764048 - DNA, 22 bp, Artificial Sequence
  chemically synthesized
aattaaattactctgctaaagt

SEQ ID NO: 764049 - DNA, 22 bp, Artificial Sequence
  chemically synthesized
ccactttttctcccttacttta

SEQ ID NO: 764050 - DNA, 22 bp, Artificial Sequence
  chemically synthesized
aattactctgctaaagtaaggg

SEQ ID NO: 764051 - DNA, 22 bp, Artificial Sequence
  chemically synthesized
tgccactttttctcccttactt

SEQ ID NO: 764052 - DNA, 22 bp, Artificial Sequence
  chemically synthesized
ctgccactttttctcccttact

SEQ ID NO: 764053 - DNA, 22 bp, Artificial Sequence
  chemically synthesized
ctctgctaaagtaagggagaaa

SEQ ID NO: 764054 - DNA, 22 bp, Artificial Sequence
  chemically synthesized
tttctgccactttttctccctt

SEQ ID NO: 764055 - DNA, 22 bp, Artificial Sequence
  chemically synthesized
tgctaaagtaagggagaaaaag

SEQ ID NO: 764056 - DNA, 22 bp, Artificial Sequence
  chemically synthesized
ctaaagtaagggagaaaaagtg

SEQ ID NO: 764057 - DNA, 22 bp, Artificial Sequence
  chemically synthesized
aagtaagggagaaaaagtggca

SEQ ID NO: 764058 - DNA, 22 bp, Artificial Sequence
  chemically synthesized
acatgttatttctgccactttt

SEQ ID NO: 764059 - DNA, 22 bp, Artificial Sequence
  chemically synthesized
taacatgttatttctgccactt

SEQ ID NO: 764060 - DNA, 22 bp, Artificial Sequence
  chemically synthesized
ctaacatgttatttctgccact

SEQ ID NO: 764061 - DNA, 22 bp, Artificial Sequence
  chemically synthesized
agaatttctaacatgttatttc

SEQ ID NO: 764062 - DNA, 22 bp, Artificial Sequence
  chemically synthesized
cagaatttctaacatgttattt

SEQ ID NO: 764063 - DNA, 22 bp, Artificial Sequence
  chemically synthesized
ttcagaatttctaacatgttat

SEQ ID NO: 764064 - DNA, 22 bp, Artificial Sequence
  chemically synthesized
agccagttcttcagaatttcta

SEQ ID NO: 764065 - DNA, 22 bp, Artificial Sequence
  chemically synthesized
gagccagttcttcagaatttct

SEQ ID NO: 764066 - DNA, 22 bp, Artificial Sequence
  chemically synthesized
aaaacttgagccagttcttcag

SEQ ID NO: 764067 - DNA, 22 bp, Artificial Sequence
  chemically synthesized
gaaattctgaagaactggctca

SEQ ID NO: 764068 - DNA, 22 bp, Artificial Sequence
  chemically synthesized
tggctgaaaacttgagccagtt

SEQ ID NO: 764069 - DNA, 22 bp, Artificial Sequence
  chemically synthesized
tgaagaactggctcaagttttc

SEQ ID NO: 764070 - DNA, 22 bp, Artificial Sequence
  chemically synthesized
agaggctgtggctgaaaacttg

SEQ ID NO: 764071 - DNA, 22 bp, Artificial Sequence
  chemically synthesized
aagaactggctcaagttttcag

SEQ ID NO: 764072 - DNA, 22 bp, Artificial Sequence
  chemically synthesized
aagaggctgtggctgaaaactt

SEQ ID NO: 764073 - DNA, 22 bp, Artificial Sequence
  chemically synthesized
catcttaagaggctgtggctga

SEQ ID NO: 764074 - DNA, 22 bp, Artificial Sequence
  chemically synthesized
gctcaagttttcagccacagcc

SEQ ID NO: 764075 - DNA, 22 bp, Artificial Sequence
  chemically synthesized
tgcatcttaagaggctgtggct

SEQ ID NO: 764076 - DNA, 22 bp, Artificial Sequence
  chemically synthesized
aagttttcagccacagcctctt

SEQ ID NO: 764077 - DNA, 22 bp, Artificial Sequence
  chemically synthesized
agaattctgcatcttaagaggc

SEQ ID NO: 764078 - DNA, 22 bp, Artificial Sequence
  chemically synthesized
tcagccacagcctcttaagatg

SEQ ID NO: 764079 - DNA, 22 bp, Artificial Sequence
  chemically synthesized
cagccacagcctcttaagatgc

SEQ ID NO: 764080 - DNA, 22 bp, Artificial Sequence
  chemically synthesized
agccacagcctcttaagatgca

SEQ ID NO: 764081 - DNA, 22 bp, Artificial Sequence
  chemically synthesized
aacattcagaattctgcatctt

SEQ ID NO: 764082 - DNA, 22 bp, Artificial Sequence
  chemically synthesized
ttcaacattcagaattctgcat

SEQ ID NO: 764083 - DNA, 22 bp, Artificial Sequence
  chemically synthesized
gttcaacattcagaattctgca

SEQ ID NO: 764084 - DNA, 22 bp, Artificial Sequence
  chemically synthesized
cttgttcaacattcagaattct

SEQ ID NO: 764085 - DNA, 22 bp, Artificial Sequence
  chemically synthesized
acttgttcaacattcagaattc

SEQ ID NO: 764086 - DNA, 22 bp, Artificial Sequence
  chemically synthesized
ttaagatgcagaattctgaatg

SEQ ID NO: 764087 - DNA, 22 bp, Artificial Sequence
  chemically synthesized
aagatgcagaattctgaatgtt

SEQ ID NO: 764088 - DNA, 22 bp, Artificial Sequence
  chemically synthesized
ccttacttgttcaacattcaga

SEQ ID NO: 764089 - DNA, 22 bp, Artificial Sequence
  chemically synthesized
agatgcagaattctgaatgttg

SEQ ID NO: 764090 - DNA, 22 bp, Artificial Sequence
  chemically synthesized
tctaccttacttgttcaacatt

SEQ ID NO: 764091 - DNA, 22 bp, Artificial Sequence
  chemically synthesized
tctgtctaccttacttgttcaa

SEQ ID NO: 764092 - DNA, 22 bp, Artificial Sequence
  chemically synthesized
attgtctgtctaccttacttgt

SEQ ID NO: 764093 - DNA, 22 bp, Artificial Sequence
  chemically synthesized
tgaatgttgaacaagtaaggta

SEQ ID NO: 764094 - DNA, 22 bp, Artificial Sequence
  chemically synthesized
aatgttgaacaagtaaggtaga

SEQ ID NO: 764095 - DNA, 22 bp, Artificial Sequence
  chemically synthesized
aacaagtaaggtagacagacaa

SEQ ID NO: 764096 - DNA, 22 bp, Artificial Sequence
  chemically synthesized
ccaaaaatagtgacaatagaca

SEQ ID NO: 764097 - DNA, 22 bp, Artificial Sequence
  chemically synthesized
gctgccaaaaatagtgacaata

SEQ ID NO: 764098 - DNA, 22 bp, Artificial Sequence
  chemically synthesized
agctgccaaaaatagtgacaat

SEQ ID NO: 764099 - DNA, 22 bp, Artificial Sequence
  chemically synthesized
tagctgccaaaaatagtgacaa

SEQ ID NO: 764100 - DNA, 22 bp, Artificial Sequence
  chemically synthesized
ttgtcactatttttggcagcta

SEQ ID NO: 764101 - DNA, 22 bp, Artificial Sequence
  chemically synthesized
tcactatttttggcagctaaag

SEQ ID NO: 764102 - DNA, 22 bp, Artificial Sequence
  chemically synthesized
gagtccatcagtgatgctttag

SEQ ID NO: 764103 - DNA, 22 bp, Artificial Sequence
  chemically synthesized
agagtccatcagtgatgcttta

SEQ ID NO: 764104 - DNA, 22 bp, Artificial Sequence
  chemically synthesized
tttttggcagctaaagcatcac

SEQ ID NO: 764105 - DNA, 22 bp, Artificial Sequence
  chemically synthesized
tagagtccatcagtgatgcttt

SEQ ID NO: 764106 - DNA, 22 bp, Artificial Sequence
  chemically synthesized
tttagagtccatcagtgatgct

SEQ ID NO: 764107 - DNA, 22 bp, Artificial Sequence
  chemically synthesized
ttggcagctaaagcatcactga

SEQ ID NO: 764108 - DNA, 22 bp, Artificial Sequence
  chemically synthesized
tggcagctaaagcatcactgat

SEQ ID NO: 764109 - DNA, 22 bp, Artificial Sequence
  chemically synthesized
tctttagagtccatcagtgatg

SEQ ID NO: 764110 - DNA, 22 bp, Artificial Sequence
  chemically synthesized
ggcagctaaagcatcactgatg

SEQ ID NO: 764111 - DNA, 22 bp, Artificial Sequence
  chemically synthesized
gcagctaaagcatcactgatgg

SEQ ID NO: 764112 - DNA, 22 bp, Artificial Sequence
  chemically synthesized
aagcatcactgatggactctaa

SEQ ID NO: 764113 - DNA, 22 bp, Artificial Sequence
  chemically synthesized
atggactctaaagagagttgtg

SEQ ID NO: 764114 - DNA, 22 bp, Artificial Sequence
  chemically synthesized
ccagtcaaagagaatgggacac

SEQ ID NO: 764115 - DNA, 22 bp, Artificial Sequence
  chemically synthesized
taaagagagttgtgtcccattc

SEQ ID NO: 764116 - DNA, 22 bp, Artificial Sequence
  chemically synthesized
aagagagttgtgtcccattctc

SEQ ID NO: 764117 - DNA, 22 bp, Artificial Sequence
  chemically synthesized
tctcccagtcaaagagaatggg

SEQ ID NO: 764118 - DNA, 22 bp, Artificial Sequence
  chemically synthesized
cctgtctcccagtcaaagagaa

SEQ ID NO: 764119 - DNA, 22 bp, Artificial Sequence
  chemically synthesized
tgtcccattctctttgactggg

SEQ ID NO: 764120 - DNA, 22 bp, Artificial Sequence
  chemically synthesized
ccctgcctgtctcccagtcaaa

SEQ ID NO: 764121 - DNA, 22 bp, Artificial Sequence
  chemically synthesized
tccatattcccctgcctgtctc

SEQ ID NO: 764122 - DNA, 22 bp, Artificial Sequence
  chemically synthesized
tctttgactgggagacaggcag

SEQ ID NO: 764123 - DNA, 22 bp, Artificial Sequence
  chemically synthesized
tatccatattcccctgcctgtc

SEQ ID NO: 764124 - DNA, 22 bp, Artificial Sequence
  chemically synthesized
tttgactgggagacaggcaggg

SEQ ID NO: 764125 - DNA, 22 bp, Artificial Sequence
  chemically synthesized
tgactgggagacaggcagggga

SEQ ID NO: 764126 - DNA, 22 bp, Artificial Sequence
  chemically synthesized
gactgggagacaggcaggggaa

SEQ ID NO: 764127 - DNA, 22 bp, Artificial Sequence
  chemically synthesized
actgggagacaggcaggggaat

SEQ ID NO: 764128 - DNA, 22 bp, Artificial Sequence
  chemically synthesized
ggagacaggcaggggaatatgg

SEQ ID NO: 764129 - DNA, 22 bp, Artificial Sequence
  chemically synthesized
atgtgattctatccatattccc

SEQ ID NO: 764130 - DNA, 22 bp, Artificial Sequence
  chemically synthesized
tgatgtgattctatccatattc

SEQ ID NO: 764131 - DNA, 22 bp, Artificial Sequence
  chemically synthesized
ctgatgtgattctatccatatt

SEQ ID NO: 764132 - DNA, 22 bp, Artificial Sequence
  chemically synthesized
aacttctgatgtgattctatcc

SEQ ID NO: 764133 - DNA, 22 bp, Artificial Sequence
  chemically synthesized
caacttctgatgtgattctatc

SEQ ID NO: 764134 - DNA, 22 bp, Artificial Sequence
  chemically synthesized
tcaacttctgatgtgattctat

SEQ ID NO: 764135 - DNA, 22 bp, Artificial Sequence
  chemically synthesized
tttcaacttctgatgtgattct

SEQ ID NO: 764136 - DNA, 22 bp, Artificial Sequence
  chemically synthesized
ctttcaacttctgatgtgattc

SEQ ID NO: 764137 - DNA, 22 bp, Artificial Sequence
  chemically synthesized
ccttctttcaacttctgatgtg

SEQ ID NO: 764138 - DNA, 22 bp, Artificial Sequence
  chemically synthesized
cccttctttcaacttctgatgt

SEQ ID NO: 764139 - DNA, 22 bp, Artificial Sequence
  chemically synthesized
agtatttcccttctttcaactt

SEQ ID NO: 764140 - DNA, 22 bp, Artificial Sequence
  chemically synthesized
cagtatttcccttctttcaact

SEQ ID NO: 764141 - DNA, 22 bp, Artificial Sequence
  chemically synthesized
tcagtatttcccttctttcaac

SEQ ID NO: 764142 - DNA, 22 bp, Artificial Sequence
  chemically synthesized
agaaatactttcagtatttccc

SEQ ID NO: 764143 - DNA, 22 bp, Artificial Sequence
  chemically synthesized
ctcagaaatactttcagtattt

SEQ ID NO: 764144 - DNA, 22 bp, Artificial Sequence
  chemically synthesized
aaagaagggaaatactgaaagt

SEQ ID NO: 764145 - DNA, 22 bp, Artificial Sequence
  chemically synthesized
agagatactactcagaaatact

SEQ ID NO: 764146 - DNA, 22 bp, Artificial Sequence
  chemically synthesized
ctcagagatactactcagaaat

SEQ ID NO: 764147 - DNA, 22 bp, Artificial Sequence
  chemically synthesized
tactactcagagatactactca

SEQ ID NO: 764148 - DNA, 22 bp, Artificial Sequence
  chemically synthesized
gtactactcagagatactactc

SEQ ID NO: 764149 - DNA, 22 bp, Artificial Sequence
  chemically synthesized
aaagtatttctgagtagtatct

SEQ ID NO: 764150 - DNA, 22 bp, Artificial Sequence
  chemically synthesized
gtttgtactactcagagatact

SEQ ID NO: 764151 - DNA, 22 bp, Artificial Sequence
  chemically synthesized
ctgagtagtatctctgagtagt

SEQ ID NO: 764152 - DNA, 22 bp, Artificial Sequence
  chemically synthesized
tgagtagtatctctgagtagta

SEQ ID NO: 764153 - DNA, 22 bp, Artificial Sequence
  chemically synthesized
agtagtatctctgagtagtaca

SEQ ID NO: 764154 - DNA, 22 bp, Artificial Sequence
  chemically synthesized
cagtacaaacctggtttgtact

SEQ ID NO: 764155 - DNA, 22 bp, Artificial Sequence
  chemically synthesized
ccagtacaaacctggtttgtac

SEQ ID NO: 764156 - DNA, 22 bp, Artificial Sequence
  chemically synthesized
tgagtagtacaaaccaggtttg

SEQ ID NO: 764157 - DNA, 22 bp, Artificial Sequence
  chemically synthesized
tatccttccagtacaaacctgg

SEQ ID NO: 764158 - DNA, 22 bp, Artificial Sequence
  chemically synthesized
agtagtacaaaccaggtttgta

SEQ ID NO: 764159 - DNA, 22 bp, Artificial Sequence
  chemically synthesized
aaaatcaggctatatccttcca

SEQ ID NO: 764160 - DNA, 22 bp, Artificial Sequence
  chemically synthesized
caaaatcaggctatatccttcc

SEQ ID NO: 764161 - DNA, 22 bp, Artificial Sequence
  chemically synthesized
tcaaaatcaggctatatccttc

SEQ ID NO: 764162 - DNA, 22 bp, Artificial Sequence
  chemically synthesized
ctttcaaaatcaggctatatcc

SEQ ID NO: 764163 - DNA, 22 bp, Artificial Sequence
  chemically synthesized
gtactggaaggatatagcctga

SEQ ID NO: 764164 - DNA, 22 bp, Artificial Sequence
  chemically synthesized
tactggaaggatatagcctgat

SEQ ID NO: 764165 - DNA, 22 bp, Artificial Sequence
  chemically synthesized
gaaggatatagcctgattttga

SEQ ID NO: 764166 - DNA, 22 bp, Artificial Sequence
  chemically synthesized
ccatataaactactttcaaaat

SEQ ID NO: 764167 - DNA, 22 bp, Artificial Sequence
  chemically synthesized
taccatataaactactttcaaa

SEQ ID NO: 764168 - DNA, 22 bp, Artificial Sequence
  chemically synthesized
ctaccatataaactactttcaa

SEQ ID NO: 764169 - DNA, 22 bp, Artificial Sequence
  chemically synthesized
accttctaccatataaactact

SEQ ID NO: 764170 - DNA, 22 bp, Artificial Sequence
  chemically synthesized
attttgaaagtagtttatatgg

SEQ ID NO: 764171 - DNA, 22 bp, Artificial Sequence
  chemically synthesized
tgaaagtagtttatatggtaga

SEQ ID NO: 764172 - DNA, 22 bp, Artificial Sequence
  chemically synthesized
gaaagtagtttatatggtagaa

SEQ ID NO: 764173 - DNA, 22 bp, Artificial Sequence
  chemically synthesized
aaagtagtttatatggtagaag

SEQ ID NO: 764174 - DNA, 22 bp, Artificial Sequence
  chemically synthesized
caagaatcccaatactaacctt

SEQ ID NO: 764175 - DNA, 22 bp, Artificial Sequence
  chemically synthesized
tgcaagaatcccaatactaacc

SEQ ID NO: 764176 - DNA, 22 bp, Artificial Sequence
  chemically synthesized
atatggtagaaggttagtattg

SEQ ID NO: 764177 - DNA, 22 bp, Artificial Sequence
  chemically synthesized
tatggtagaaggttagtattgg

SEQ ID NO: 764178 - DNA, 22 bp, Artificial Sequence
  chemically synthesized
gttctgcaagaatcccaatact

SEQ ID NO: 764179 - DNA, 22 bp, Artificial Sequence
  chemically synthesized
cgttctgcaagaatcccaatac

SEQ ID NO: 764180 - DNA, 22 bp, Artificial Sequence
  chemically synthesized
accaaacttcgttctgcaagaa

SEQ ID NO: 764181 - DNA, 22 bp, Artificial Sequence
  chemically synthesized
gaccaaacttcgttctgcaaga

SEQ ID NO: 764182 - DNA, 22 bp, Artificial Sequence
  chemically synthesized
gtattgggattcttgcagaacg

SEQ ID NO: 764183 - DNA, 22 bp, Artificial Sequence
  chemically synthesized
tatatttgaccaaacttcgttc

SEQ ID NO: 764184 - DNA, 22 bp, Artificial Sequence
  chemically synthesized
ggattcttgcagaacgaagttt

SEQ ID NO: 764185 - DNA, 22 bp, Artificial Sequence
  chemically synthesized
ttgcagaacgaagtttggtcaa

SEQ ID NO: 764186 - DNA, 22 bp, Artificial Sequence
  chemically synthesized
gcagaacgaagtttggtcaaat

SEQ ID NO: 764187 - DNA, 22 bp, Artificial Sequence
  chemically synthesized
cagaacgaagtttggtcaaata

SEQ ID NO: 764188 - DNA, 22 bp, Artificial Sequence
  chemically synthesized
ggtcaaatatatagccatttta

SEQ ID NO: 764189 - DNA, 22 bp, Artificial Sequence
  chemically synthesized
gtcaaatatatagccattttat

SEQ ID NO: 764190 - DNA, 22 bp, Artificial Sequence
  chemically synthesized
tatgtttttctttcttttttcc

SEQ ID NO: 764191 - DNA, 22 bp, Artificial Sequence
  chemically synthesized
atgtttttctttcttttttcct

SEQ ID NO: 764192 - DNA, 22 bp, Artificial Sequence
  chemically synthesized
cacgtaggcaaaaggaaaaaag

SEQ ID NO: 764193 - DNA, 22 bp, Artificial Sequence
  chemically synthesized
tgtttttctttcttttttcctt

SEQ ID NO: 764194 - DNA, 22 bp, Artificial Sequence
  chemically synthesized
ttccacgtaggcaaaaggaaaa

SEQ ID NO: 764195 - DNA, 22 bp, Artificial Sequence
  chemically synthesized
ttctttcttttttccttttgcc

SEQ ID NO: 764196 - DNA, 22 bp, Artificial Sequence
  chemically synthesized
tctttcttttttccttttgcct

SEQ ID NO: 764197 - DNA, 22 bp, Artificial Sequence
  chemically synthesized
ctttcttttttccttttgccta

SEQ ID NO: 764198 - DNA, 22 bp, Artificial Sequence
  chemically synthesized
tttcttttttccttttgcctac

SEQ ID NO: 764199 - DNA, 22 bp, Artificial Sequence
  chemically synthesized
tcttttttccttttgcctacgt

SEQ ID NO: 764200 - DNA, 22 bp, Artificial Sequence
  chemically synthesized
cttttttccttttgcctacgtg

SEQ ID NO: 764201 - DNA, 22 bp, Artificial Sequence
  chemically synthesized
ttttttccttttgcctacgtgg

SEQ ID NO: 764202 - DNA, 22 bp, Artificial Sequence
  chemically synthesized
ttttccttttgcctacgtggaa

SEQ ID NO: 764203 - DNA, 22 bp, Artificial Sequence
  chemically synthesized
tttccttttgcctacgtggaat

SEQ ID NO: 764204 - DNA, 22 bp, Artificial Sequence
  chemically synthesized
ggcaggcatgttattccacgta

SEQ ID NO: 764205 - DNA, 22 bp, Artificial Sequence
  chemically synthesized
ttccttttgcctacgtggaata

SEQ ID NO: 764206 - DNA, 22 bp, Artificial Sequence
  chemically synthesized
tccttttgcctacgtggaataa

SEQ ID NO: 764207 - DNA, 22 bp, Artificial Sequence
  chemically synthesized
ccttttgcctacgtggaataac

SEQ ID NO: 764208 - DNA, 22 bp, Artificial Sequence
  chemically synthesized
cttttgcctacgtggaataaca

SEQ ID NO: 764209 - DNA, 22 bp, Artificial Sequence
  chemically synthesized
ttgcctacgtggaataacatgc

SEQ ID NO: 764210 - DNA, 22 bp, Artificial Sequence
  chemically synthesized
tgcctacgtggaataacatgcc

SEQ ID NO: 764211 - DNA, 22 bp, Artificial Sequence
  chemically synthesized
gcctacgtggaataacatgcct

SEQ ID NO: 764212 - DNA, 22 bp, Artificial Sequence
  chemically synthesized
cctacgtggaataacatgcctg

SEQ ID NO: 764213 - DNA, 22 bp, Artificial Sequence
  chemically synthesized
cgtggaataacatgcctgccta

SEQ ID NO: 764214 - DNA, 22 bp, Artificial Sequence
  chemically synthesized
aagaagtgcaaattaggcaggc

SEQ ID NO: 764215 - DNA, 22 bp, Artificial Sequence
  chemically synthesized
ctgaagaagtgcaaattaggca

SEQ ID NO: 764216 - DNA, 22 bp, Artificial Sequence
  chemically synthesized
gctgaagaagtgcaaattaggc

SEQ ID NO: 764217 - DNA, 22 bp, Artificial Sequence
  chemically synthesized
tgctgaagaagtgcaaattagg

SEQ ID NO: 764218 - DNA, 22 bp, Artificial Sequence
  chemically synthesized
ttgctgaagaagtgcaaattag

SEQ ID NO: 764219 - DNA, 22 bp, Artificial Sequence
  chemically synthesized
ttttgctgaagaagtgcaaatt

SEQ ID NO: 764220 - DNA, 22 bp, Artificial Sequence
  chemically synthesized
tcttttgctgaagaagtgcaaa

SEQ ID NO: 764221 - DNA, 22 bp, Artificial Sequence
  chemically synthesized
ctcttttgctgaagaagtgcaa

SEQ ID NO: 764222 - DNA, 22 bp, Artificial Sequence
  chemically synthesized
tctcttttgctgaagaagtgca

SEQ ID NO: 764223 - DNA, 22 bp, Artificial Sequence
  chemically synthesized
ttctcttttgctgaagaagtgc

SEQ ID NO: 764224 - DNA, 22 bp, Artificial Sequence
  chemically synthesized
cctaatttgcacttcttcagca

SEQ ID NO: 764225 - DNA, 22 bp, Artificial Sequence
  chemically synthesized
acttttctcttttgctgaagaa

SEQ ID NO: 764226 - DNA, 22 bp, Artificial Sequence
  chemically synthesized
atttgcacttcttcagcaaaag

SEQ ID NO: 764227 - DNA, 22 bp, Artificial Sequence
  chemically synthesized
actcacttttctcttttgctga

SEQ ID NO: 764228 - DNA, 22 bp, Artificial Sequence
  chemically synthesized
gcacttcttcagcaaaagagaa

SEQ ID NO: 764229 - DNA, 22 bp, Artificial Sequence
  chemically synthesized
cacttcttcagcaaaagagaaa

SEQ ID NO: 764230 - DNA, 22 bp, Artificial Sequence
  chemically synthesized
gataaattaactcacttttctc

SEQ ID NO: 764231 - DNA, 22 bp, Artificial Sequence
  chemically synthesized
cttcagcaaaagagaaaagtga

SEQ ID NO: 764232 - DNA, 22 bp, Artificial Sequence
  chemically synthesized
agataaattaactcacttttct

SEQ ID NO: 764233 - DNA, 22 bp, Artificial Sequence
  chemically synthesized
ttcagcaaaagagaaaagtgag

SEQ ID NO: 764234 - DNA, 22 bp, Artificial Sequence
  chemically synthesized
cagcaaaagagaaaagtgagtt

SEQ ID NO: 764235 - DNA, 22 bp, Artificial Sequence
  chemically synthesized
agcaaaagagaaaagtgagtta

SEQ ID NO: 764236 - DNA, 22 bp, Artificial Sequence
  chemically synthesized
aagtacttagataaattaactc

SEQ ID NO: 764237 - DNA, 22 bp, Artificial Sequence
  chemically synthesized
ctgaagtacttagataaattaa

SEQ ID NO: 764238 - DNA, 22 bp, Artificial Sequence
  chemically synthesized
tcctgaagtacttagataaatt

SEQ ID NO: 764239 - DNA, 22 bp, Artificial Sequence
  chemically synthesized
ctcctgaagtacttagataaat

SEQ ID NO: 764240 - DNA, 22 bp, Artificial Sequence
  chemically synthesized
tctcctgaagtacttagataaa

SEQ ID NO: 764241 - DNA, 22 bp, Artificial Sequence
  chemically synthesized
ttctcctgaagtacttagataa

SEQ ID NO: 764242 - DNA, 22 bp, Artificial Sequence
  chemically synthesized
tttctcctgaagtacttagata

SEQ ID NO: 764243 - DNA, 22 bp, Artificial Sequence
  chemically synthesized
gctttttctcctgaagtactta

SEQ ID NO: 764244 - DNA, 22 bp, Artificial Sequence
  chemically synthesized
gttggctttttctcctgaagta

SEQ ID NO: 764245 - DNA, 22 bp, Artificial Sequence
  chemically synthesized
atttatctaagtacttcaggag

SEQ ID NO: 764246 - DNA, 22 bp, Artificial Sequence
  chemically synthesized
atctaagtacttcaggagaaaa

SEQ ID NO: 764247 - DNA, 22 bp, Artificial Sequence
  chemically synthesized
tctaagtacttcaggagaaaaa

SEQ ID NO: 764248 - DNA, 22 bp, Artificial Sequence
  chemically synthesized
gatctggttggctttttctcct

SEQ ID NO: 764249 - DNA, 22 bp, Artificial Sequence
  chemically synthesized
agatctggttggctttttctcc

SEQ ID NO: 764250 - DNA, 22 bp, Artificial Sequence
  chemically synthesized
agtacttcaggagaaaaagcca

SEQ ID NO: 764251 - DNA, 22 bp, Artificial Sequence
  chemically synthesized
gaacttagatctggttggcttt

SEQ ID NO: 764252 - DNA, 22 bp, Artificial Sequence
  chemically synthesized
caggagaaaaagccaaccagat

SEQ ID NO: 764253 - DNA, 22 bp, Artificial Sequence
  chemically synthesized
tctggaacttagatctggttgg

SEQ ID NO: 764254 - DNA, 22 bp, Artificial Sequence
  chemically synthesized
aggagaaaaagccaaccagatc

SEQ ID NO: 764255 - DNA, 22 bp, Artificial Sequence
  chemically synthesized
agttccagataattccttcact

SEQ ID NO: 764256 - DNA, 22 bp, Artificial Sequence
  chemically synthesized
cagataattccttcacttgtct

SEQ ID NO: 764257 - DNA, 22 bp, Artificial Sequence
  chemically synthesized
cttcacttgtcttttactttac

SEQ ID NO: 764258 - DNA, 22 bp, Artificial Sequence
  chemically synthesized
cacttgtcttttactttacttc

SEQ ID NO: 764259 - DNA, 22 bp, Artificial Sequence
  chemically synthesized
acttgtcttttactttacttct

SEQ ID NO: 764260 - DNA, 22 bp, Artificial Sequence
  chemically synthesized
gtcttttactttacttcttctg

SEQ ID NO: 764261 - DNA, 22 bp, Artificial Sequence
  chemically synthesized
tcttttactttacttcttctgt

SEQ ID NO: 764262 - DNA, 22 bp, Artificial Sequence
  chemically synthesized
tacaaatcaagtacaacagaag

SEQ ID NO: 764263 - DNA, 22 bp, Artificial Sequence
  chemically synthesized
ttactttacttcttctgttgta

SEQ ID NO: 764264 - DNA, 22 bp, Artificial Sequence
  chemically synthesized
tactttacttcttctgttgtac

SEQ ID NO: 764265 - DNA, 22 bp, Artificial Sequence
  chemically synthesized
actttacttcttctgttgtact

SEQ ID NO: 764266 - DNA, 22 bp, Artificial Sequence
  chemically synthesized
ctttacttcttctgttgtactt

SEQ ID NO: 764267 - DNA, 22 bp, Artificial Sequence
  chemically synthesized
tacttcttctgttgtacttgat

SEQ ID NO: 764268 - DNA, 22 bp, Artificial Sequence
  chemically synthesized
acttcttctgttgtacttgatt

SEQ ID NO: 764269 - DNA, 22 bp, Artificial Sequence
  chemically synthesized
cttcttctgttgtacttgattt

SEQ ID NO: 764270 - DNA, 22 bp, Artificial Sequence
  chemically synthesized
cttctgttgtacttgatttgta

SEQ ID NO: 764271 - DNA, 22 bp, Artificial Sequence
  chemically synthesized
ttctgttgtacttgatttgtac

SEQ ID NO: 764272 - DNA, 22 bp, Artificial Sequence
  chemically synthesized
ctgttgtacttgatttgtacag

SEQ ID NO: 764273 - DNA, 22 bp, Artificial Sequence
  chemically synthesized
tgttgtacttgatttgtacagt

SEQ ID NO: 764274 - DNA, 22 bp, Artificial Sequence
  chemically synthesized
ttgtacttgatttgtacagtac

SEQ ID NO: 764275 - DNA, 22 bp, Artificial Sequence
  chemically synthesized
tacttgatttgtacagtacttt

SEQ ID NO: 764276 - DNA, 22 bp, Artificial Sequence
  chemically synthesized
gatttgtacagtactttccttt

SEQ ID NO: 764277 - DNA, 22 bp, Artificial Sequence
  chemically synthesized
agtgcatacacaaaaggaaagt

SEQ ID NO: 764278 - DNA, 22 bp, Artificial Sequence
  chemically synthesized
atttgtacagtactttcctttt

SEQ ID NO: 764279 - DNA, 22 bp, Artificial Sequence
  chemically synthesized
gtacagtactttccttttgtgt

SEQ ID NO: 764280 - DNA, 22 bp, Artificial Sequence
  chemically synthesized
tacagtactttccttttgtgta

SEQ ID NO: 764281 - DNA, 22 bp, Artificial Sequence
  chemically synthesized
atcccctaagtgcatacacaaa

SEQ ID NO: 764282 - DNA, 22 bp, Artificial Sequence
  chemically synthesized
aatcccctaagtgcatacacaa

SEQ ID NO: 764283 - DNA, 22 bp, Artificial Sequence
  chemically synthesized
taatcccctaagtgcatacaca

SEQ ID NO: 764284 - DNA, 22 bp, Artificial Sequence
  chemically synthesized
tctttaatcccctaagtgcata

SEQ ID NO: 764285 - DNA, 22 bp, Artificial Sequence
  chemically synthesized
gtctttaatcccctaagtgcat

SEQ ID NO: 764286 - DNA, 22 bp, Artificial Sequence
  chemically synthesized
tccttttgtgtatgcacttagg

SEQ ID NO: 764287 - DNA, 22 bp, Artificial Sequence
  chemically synthesized
ccttttgtgtatgcacttaggg

SEQ ID NO: 764288 - DNA, 22 bp, Artificial Sequence
  chemically synthesized
cttttgtgtatgcacttagggg

SEQ ID NO: 764289 - DNA, 22 bp, Artificial Sequence
  chemically synthesized
ttgtgtatgcacttaggggatt

SEQ ID NO: 764290 - DNA, 22 bp, Artificial Sequence
  chemically synthesized
tgtgtatgcacttaggggatta

SEQ ID NO: 764291 - DNA, 22 bp, Artificial Sequence
  chemically synthesized
aaagtttgtctttaatccccta

SEQ ID NO: 764292 - DNA, 22 bp, Artificial Sequence
  chemically synthesized
gtgtatgcacttaggggattaa

SEQ ID NO: 764293 - DNA, 22 bp, Artificial Sequence
  chemically synthesized
tgtatgcacttaggggattaaa

SEQ ID NO: 764294 - DNA, 22 bp, Artificial Sequence
  chemically synthesized
aacaactaaaagtttgtcttta

SEQ ID NO: 764295 - DNA, 22 bp, Artificial Sequence
  chemically synthesized
gaacaactaaaagtttgtcttt

SEQ ID NO: 764296 - DNA, 22 bp, Artificial Sequence
  chemically synthesized
cttgaacaactaaaagtttgtc

SEQ ID NO: 764297 - DNA, 22 bp, Artificial Sequence
  chemically synthesized
aggggattaaagacaaactttt

SEQ ID NO: 764298 - DNA, 22 bp, Artificial Sequence
  chemically synthesized
acttgaacaactaaaagtttgt

SEQ ID NO: 764299 - DNA, 22 bp, Artificial Sequence
  chemically synthesized
ggggattaaagacaaactttta

SEQ ID NO: 764300 - DNA, 22 bp, Artificial Sequence
  chemically synthesized
tacttgaacaactaaaagtttg

SEQ ID NO: 764301 - DNA, 22 bp, Artificial Sequence
  chemically synthesized
ttacttgaacaactaaaagttt

SEQ ID NO: 764302 - DNA, 22 bp, Artificial Sequence
  chemically synthesized
aagacaaacttttagttgttca

SEQ ID NO: 764303 - DNA, 22 bp, Artificial Sequence
  chemically synthesized
gtgagaatacttttacttgaac

SEQ ID NO: 764304 - DNA, 22 bp, Artificial Sequence
  chemically synthesized
ctagtgagaatacttttacttg

SEQ ID NO: 764305 - DNA, 22 bp, Artificial Sequence
  chemically synthesized
ttagttgttcaagtaaaagtat

SEQ ID NO: 764306 - DNA, 22 bp, Artificial Sequence
  chemically synthesized
tagttgttcaagtaaaagtatt

SEQ ID NO: 764307 - DNA, 22 bp, Artificial Sequence
  chemically synthesized
agttgttcaagtaaaagtattc

SEQ ID NO: 764308 - DNA, 22 bp, Artificial Sequence
  chemically synthesized
gttgttcaagtaaaagtattct

SEQ ID NO: 764309 - DNA, 22 bp, Artificial Sequence
  chemically synthesized
atgctactagtgagaatacttt

SEQ ID NO: 764310 - DNA, 22 bp, Artificial Sequence
  chemically synthesized
ttcaagtaaaagtattctcact

SEQ ID NO: 764311 - DNA, 22 bp, Artificial Sequence
  chemically synthesized
aagtaaaagtattctcactagt

SEQ ID NO: 764312 - DNA, 22 bp, Artificial Sequence
  chemically synthesized
tcactagtagcatcagttttct

SEQ ID NO: 764313 - DNA, 22 bp, Artificial Sequence
  chemically synthesized
atgtagtaaacatagaaaactg

SEQ ID NO: 764314 - DNA, 22 bp, Artificial Sequence
  chemically synthesized
actagtagcatcagttttctat

SEQ ID NO: 764315 - DNA, 22 bp, Artificial Sequence
  chemically synthesized
gtagcatcagttttctatgttt

SEQ ID NO: 764316 - DNA, 22 bp, Artificial Sequence
  chemically synthesized
tatgtatgttaatgtagtaaac

SEQ ID NO: 764317 - DNA, 22 bp, Artificial Sequence
  chemically synthesized
atatgtatgttaatgtagtaaa

SEQ ID NO: 764318 - DNA, 22 bp, Artificial Sequence
  chemically synthesized
tatatgtatgttaatgtagtaa

SEQ ID NO: 764319 - DNA, 22 bp, Artificial Sequence
  chemically synthesized
tctatgtttactacattaacat

SEQ ID NO: 764320 - DNA, 22 bp, Artificial Sequence
  chemically synthesized
tcctttatatgtatgttaatgt

SEQ ID NO: 764321 - DNA, 22 bp, Artificial Sequence
  chemically synthesized
ctatgtttactacattaacata

SEQ ID NO: 764322 - DNA, 22 bp, Artificial Sequence
  chemically synthesized
tatgtttactacattaacatac

SEQ ID NO: 764323 - DNA, 22 bp, Artificial Sequence
  chemically synthesized
tgtttactacattaacatacat

SEQ ID NO: 764324 - DNA, 22 bp, Artificial Sequence
  chemically synthesized
actacattaacatacatataaa

SEQ ID NO: 764325 - DNA, 22 bp, Artificial Sequence
  chemically synthesized
ctacattaacatacatataaag

SEQ ID NO: 764326 - DNA, 22 bp, Artificial Sequence
  chemically synthesized
aaatgtactatcctttatatgt

SEQ ID NO: 764327 - DNA, 22 bp, Artificial Sequence
  chemically synthesized
caaatgtactatcctttatatg

SEQ ID NO: 764328 - DNA, 22 bp, Artificial Sequence
  chemically synthesized
cattaacatacatataaaggat

SEQ ID NO: 764329 - DNA, 22 bp, Artificial Sequence
  chemically synthesized
acatacatataaaggatagtac

SEQ ID NO: 764330 - DNA, 22 bp, Artificial Sequence
  chemically synthesized
tcaatgtaggatataaatttca

SEQ ID NO: 764331 - DNA, 22 bp, Artificial Sequence
  chemically synthesized
ctatcaatgtaggatataaatt

SEQ ID NO: 764332 - DNA, 22 bp, Artificial Sequence
  chemically synthesized
tgctatcaatgtaggatataaa

SEQ ID NO: 764333 - DNA, 22 bp, Artificial Sequence
  chemically synthesized
ggtctctgctatcaatgtagga

SEQ ID NO: 764334 - DNA, 22 bp, Artificial Sequence
  chemically synthesized
gaaatttatatcctacattgat

SEQ ID NO: 764335 - DNA, 22 bp, Artificial Sequence
  chemically synthesized
aaatttatatcctacattgata

SEQ ID NO: 764336 - DNA, 22 bp, Artificial Sequence
  chemically synthesized
agcctgggtctctgctatcaat

SEQ ID NO: 764337 - DNA, 22 bp, Artificial Sequence
  chemically synthesized
atatcctacattgatagcagag

SEQ ID NO: 764338 - DNA, 22 bp, Artificial Sequence
  chemically synthesized
tatcctacattgatagcagaga

SEQ ID NO: 764339 - DNA, 22 bp, Artificial Sequence
  chemically synthesized
gtgattgagcctgggtctctgc

SEQ ID NO: 764340 - DNA, 22 bp, Artificial Sequence
  chemically synthesized
cattgatagcagagacccaggc

SEQ ID NO: 764341 - DNA, 22 bp, Artificial Sequence
  chemically synthesized
aggagctcgtgattgagcctgg

SEQ ID NO: 764342 - DNA, 22 bp, Artificial Sequence
  chemically synthesized
atagcagagacccaggctcaat

SEQ ID NO: 764343 - DNA, 22 bp, Artificial Sequence
  chemically synthesized
aaggagctcgtgattgagcctg

SEQ ID NO: 764344 - DNA, 22 bp, Artificial Sequence
  chemically synthesized
atggtatacataaccttaagga

SEQ ID NO: 764345 - DNA, 22 bp, Artificial Sequence
  chemically synthesized
catggtatacataaccttaagg

SEQ ID NO: 764346 - DNA, 22 bp, Artificial Sequence
  chemically synthesized
aatcacgagctccttaaggtta

SEQ ID NO: 764347 - DNA, 22 bp, Artificial Sequence
  chemically synthesized
gtgacttcatggtatacataac

SEQ ID NO: 764348 - DNA, 22 bp, Artificial Sequence
  chemically synthesized
cttaaggttatgtataccatga

SEQ ID NO: 764349 - DNA, 22 bp, Artificial Sequence
  chemically synthesized
aaggttatgtataccatgaagt

SEQ ID NO: 764350 - DNA, 22 bp, Artificial Sequence
  chemically synthesized
aggttatgtataccatgaagtc

SEQ ID NO: 764351 - DNA, 22 bp, Artificial Sequence
  chemically synthesized
tgtataccatgaagtcaccaac

SEQ ID NO: 764352 - DNA, 22 bp, Artificial Sequence
  chemically synthesized
agaagacaaagaaagtgttggt

SEQ ID NO: 764353 - DNA, 22 bp, Artificial Sequence
  chemically synthesized
gagaagacaaagaaagtgttgg

SEQ ID NO: 764354 - DNA, 22 bp, Artificial Sequence
  chemically synthesized
tgcttgagaagacaaagaaagt

SEQ ID NO: 764355 - DNA, 22 bp, Artificial Sequence
  chemically synthesized
atgcttgagaagacaaagaaag

SEQ ID NO: 764356 - DNA, 22 bp, Artificial Sequence
  chemically synthesized
tttatgcttgagaagacaaaga

SEQ ID NO: 764357 - DNA, 22 bp, Artificial Sequence
  chemically synthesized
tctttgtcttctcaagcataaa

SEQ ID NO: 764358 - DNA, 22 bp, Artificial Sequence
  chemically synthesized
ctttgtcttctcaagcataaat

SEQ ID NO: 764359 - DNA, 22 bp, Artificial Sequence
  chemically synthesized
tttgtcttctcaagcataaata

SEQ ID NO: 764360 - DNA, 22 bp, Artificial Sequence
  chemically synthesized
tgtcttctcaagcataaatagg

SEQ ID NO: 764361 - DNA, 22 bp, Artificial Sequence
  chemically synthesized
atgaatcaacatcctatttatg

SEQ ID NO: 764362 - DNA, 22 bp, Artificial Sequence
  chemically synthesized
gtcttctcaagcataaatagga

SEQ ID NO: 764363 - DNA, 22 bp, Artificial Sequence
  chemically synthesized
tcttctcaagcataaataggat

SEQ ID NO: 764364 - DNA, 22 bp, Artificial Sequence
  chemically synthesized
ctcaagcataaataggatgttg

SEQ ID NO: 764365 - DNA, 22 bp, Artificial Sequence
  chemically synthesized
tcaagcataaataggatgttga

SEQ ID NO: 764366 - DNA, 22 bp, Artificial Sequence
  chemically synthesized
aagcataaataggatgttgatt

SEQ ID NO: 764367 - DNA, 22 bp, Artificial Sequence
  chemically synthesized
attcatgaatttgctacttttc

SEQ ID NO: 764368 - DNA, 22 bp, Artificial Sequence
  chemically synthesized
atgaatttgctacttttcatct

SEQ ID NO: 764369 - DNA, 22 bp, Artificial Sequence
  chemically synthesized
gctacttttcatctttgccata

SEQ ID NO: 764370 - DNA, 22 bp, Artificial Sequence
  chemically synthesized
ctacttttcatctttgccatat

SEQ ID NO: 764371 - DNA, 22 bp, Artificial Sequence
  chemically synthesized
cttttcatctttgccatatata

SEQ ID NO: 764372 - DNA, 22 bp, Artificial Sequence
  chemically synthesized
tatgcagtataatatatatggc

SEQ ID NO: 764373 - DNA, 22 bp, Artificial Sequence
  chemically synthesized
atatgcagtataatatatatgg

SEQ ID NO: 764374 - DNA, 22 bp, Artificial Sequence
  chemically synthesized
ttcatctttgccatatatatta

SEQ ID NO: 764375 - DNA, 22 bp, Artificial Sequence
  chemically synthesized
tcatctttgccatatatattat

SEQ ID NO: 764376 - DNA, 22 bp, Artificial Sequence
  chemically synthesized
catctttgccatatatattata

SEQ ID NO: 764377 - DNA, 22 bp, Artificial Sequence
  chemically synthesized
atctttgccatatatattatac

SEQ ID NO: 764378 - DNA, 22 bp, Artificial Sequence
  chemically synthesized
tgccatatatattatactgcat

SEQ ID NO: 764379 - DNA, 22 bp, Artificial Sequence
  chemically synthesized
gccatatatattatactgcata

SEQ ID NO: 764380 - DNA, 22 bp, Artificial Sequence
  chemically synthesized
ccatatatattatactgcatat

SEQ ID NO: 764381 - DNA, 22 bp, Artificial Sequence
  chemically synthesized
ataatacaacaaagatgtttat

SEQ ID NO: 764382 - DNA, 22 bp, Artificial Sequence
  chemically synthesized
ttgataatacaacaaagatgtt

SEQ ID NO: 764383 - DNA, 22 bp, Artificial Sequence
  chemically synthesized
tactgcatataaacatctttgt

SEQ ID NO: 764384 - DNA, 22 bp, Artificial Sequence
  chemically synthesized
gttgataatacaacaaagatgt

SEQ ID NO: 764385 - DNA, 22 bp, Artificial Sequence
  chemically synthesized
tttgttgataatacaacaaaga

SEQ ID NO: 764386 - DNA, 22 bp, Artificial Sequence
  chemically synthesized
atttgttgataatacaacaaag

SEQ ID NO: 764387 - DNA, 22 bp, Artificial Sequence
  chemically synthesized
catataaacatctttgttgtat

SEQ ID NO: 764388 - DNA, 22 bp, Artificial Sequence
  chemically synthesized
atttatttgttgataatacaac

SEQ ID NO: 764389 - DNA, 22 bp, Artificial Sequence
  chemically synthesized
tattcatttatttgttgataat

SEQ ID NO: 764390 - DNA, 22 bp, Artificial Sequence
  chemically synthesized
atattcatttatttgttgataa

SEQ ID NO: 764391 - DNA, 22 bp, Artificial Sequence
  chemically synthesized
tatattcatttatttgttgata

SEQ ID NO: 764392 - DNA, 22 bp, Artificial Sequence
  chemically synthesized
tgttgtattatcaacaaataaa

SEQ ID NO: 764393 - DNA, 22 bp, Artificial Sequence
  chemically synthesized
gttgtattatcaacaaataaat

SEQ ID NO: 764394 - DNA, 22 bp, Artificial Sequence
  chemically synthesized
ttgtattatcaacaaataaatg

SEQ ID NO: 764395 - DNA, 22 bp, Artificial Sequence
  chemically synthesized
tcaattttatattcatttattt

SEQ ID NO: 764396 - DNA, 22 bp, Artificial Sequence
  chemically synthesized
atcaattttatattcatttatt

SEQ ID NO: 764397 - DNA, 22 bp, Artificial Sequence
  chemically synthesized
tattatcaacaaataaatgaat

SEQ ID NO: 764398 - DNA, 22 bp, Artificial Sequence
  chemically synthesized
tttatcaattttatattcattt

SEQ ID NO: 764399 - DNA, 22 bp, Artificial Sequence
  chemically synthesized
gtttatcaattttatattcatt

SEQ ID NO: 764400 - DNA, 22 bp, Artificial Sequence
  chemically synthesized
tcaacaaataaatgaatataaa

SEQ ID NO: 764401 - DNA, 22 bp, Artificial Sequence
  chemically synthesized
aataaatgcttgtttatcaatt

SEQ ID NO: 764402 - DNA, 22 bp, Artificial Sequence
  chemically synthesized
ataaacaagcatttattgagga

SEQ ID NO: 764403 - DNA, 22 bp, Artificial Sequence
  chemically synthesized
gacaataaatcagtcctcaata

SEQ ID NO: 764404 - DNA, 22 bp, Artificial Sequence
  chemically synthesized
aaactagacaataaatcagtcc

SEQ ID NO: 764405 - DNA, 22 bp, Artificial Sequence
  chemically synthesized
attgaggactgatttattgtct

SEQ ID NO: 764406 - DNA, 22 bp, Artificial Sequence
  chemically synthesized
ttgaggactgatttattgtcta

SEQ ID NO: 764407 - DNA, 22 bp, Artificial Sequence
  chemically synthesized
aggactgatttattgtctagtt

SEQ ID NO: 764408 - DNA, 22 bp, Artificial Sequence
  chemically synthesized
ccaaagtgctaaaactagacaa

SEQ ID NO: 764409 - DNA, 22 bp, Artificial Sequence
  chemically synthesized
cccaaagtgctaaaactagaca

SEQ ID NO: 764410 - DNA, 22 bp, Artificial Sequence
  chemically synthesized
catttcccaaagtgctaaaact

SEQ ID NO: 764411 - DNA, 22 bp, Artificial Sequence
  chemically synthesized
atttattgtctagttttagcac

SEQ ID NO: 764412 - DNA, 22 bp, Artificial Sequence
  chemically synthesized
acatttcccaaagtgctaaaac

SEQ ID NO: 764413 - DNA, 22 bp, Artificial Sequence
  chemically synthesized
ttacatttcccaaagtgctaaa

SEQ ID NO: 764414 - DNA, 22 bp, Artificial Sequence
  chemically synthesized
attgtctagttttagcactttg

SEQ ID NO: 764415 - DNA, 22 bp, Artificial Sequence
  chemically synthesized
ttgtctagttttagcactttgg

SEQ ID NO: 764416 - DNA, 22 bp, Artificial Sequence
  chemically synthesized
ctcttacatttcccaaagtgct

SEQ ID NO: 764417 - DNA, 22 bp, Artificial Sequence
  chemically synthesized
tctagttttagcactttgggaa

SEQ ID NO: 764418 - DNA, 22 bp, Artificial Sequence
  chemically synthesized
tactcctcttacatttcccaaa

SEQ ID NO: 764419 - DNA, 22 bp, Artificial Sequence
  chemically synthesized
gtactcctcttacatttcccaa

SEQ ID NO: 764420 - DNA, 22 bp, Artificial Sequence
  chemically synthesized
gttttagcactttgggaaatgt

SEQ ID NO: 764421 - DNA, 22 bp, Artificial Sequence
  chemically synthesized
tagcactttgggaaatgtaaga

SEQ ID NO: 764422 - DNA, 22 bp, Artificial Sequence
  chemically synthesized
agcactttgggaaatgtaagag

SEQ ID NO: 764423 - DNA, 22 bp, Artificial Sequence
  chemically synthesized
tcatttgtactcctcttacatt

SEQ ID NO: 764424 - DNA, 22 bp, Artificial Sequence
  chemically synthesized
gcactttgggaaatgtaagagg

SEQ ID NO: 764425 - DNA, 22 bp, Artificial Sequence
  chemically synthesized
tgggaaatgtaagaggagtaca

SEQ ID NO: 764426 - DNA, 22 bp, Artificial Sequence
  chemically synthesized
gggaaatgtaagaggagtacaa

SEQ ID NO: 764427 - DNA, 22 bp, Artificial Sequence
  chemically synthesized
ggaaatgtaagaggagtacaaa

SEQ ID NO: 764428 - DNA, 22 bp, Artificial Sequence
  chemically synthesized
aagacagaactatcatttgtac

SEQ ID NO: 764429 - DNA, 22 bp, Artificial Sequence
  chemically synthesized
ggaaaattaaagacagaactat

SEQ ID NO: 764430 - DNA, 22 bp, Artificial Sequence
  chemically synthesized
aggaaaattaaagacagaacta

SEQ ID NO: 764431 - DNA, 22 bp, Artificial Sequence
  chemically synthesized
taggaaaattaaagacagaact

SEQ ID NO: 764432 - DNA, 22 bp, Artificial Sequence
  chemically synthesized
ggttttaggaaaattaaagaca

SEQ ID NO: 764433 - DNA, 22 bp, Artificial Sequence
  chemically synthesized
tgtctttaattttcctaaaacc

SEQ ID NO: 764434 - DNA, 22 bp, Artificial Sequence
  chemically synthesized
tctttaattttcctaaaaccta

SEQ ID NO: 764435 - DNA, 22 bp, Artificial Sequence
  chemically synthesized
aacaaaaatgcacactaggttt

SEQ ID NO: 764436 - DNA, 22 bp, Artificial Sequence
  chemically synthesized
taattttcctaaaacctagtgt

SEQ ID NO: 764437 - DNA, 22 bp, Artificial Sequence
  chemically synthesized
aattttcctaaaacctagtgtg

SEQ ID NO: 764438 - DNA, 22 bp, Artificial Sequence
  chemically synthesized
attttcctaaaacctagtgtgc

SEQ ID NO: 764439 - DNA, 22 bp, Artificial Sequence
  chemically synthesized
tcctaaaacctagtgtgcattt

SEQ ID NO: 764440 - DNA, 22 bp, Artificial Sequence
  chemically synthesized
cctaaaacctagtgtgcatttt

SEQ ID NO: 764441 - DNA, 22 bp, Artificial Sequence
  chemically synthesized
ctaaaacctagtgtgcattttt

SEQ ID NO: 764442 - DNA, 22 bp, Artificial Sequence
  chemically synthesized
aaacctagtgtgcatttttgtt

SEQ ID NO: 764443 - DNA, 22 bp, Artificial Sequence
  chemically synthesized
gtaatataaacgaattaaacaa

SEQ ID NO: 764444 - DNA, 22 bp, Artificial Sequence
  chemically synthesized
gtgtgcatttttgtttaattcg

SEQ ID NO: 764445 - DNA, 22 bp, Artificial Sequence
  chemically synthesized
gttggtaatataaacgaattaa

SEQ ID NO: 764446 - DNA, 22 bp, Artificial Sequence
  chemically synthesized
agttggtaatataaacgaatta

SEQ ID NO: 764447 - DNA, 22 bp, Artificial Sequence
  chemically synthesized
ttgtttaattcgtttatattac

SEQ ID NO: 764448 - DNA, 22 bp, Artificial Sequence
  chemically synthesized
tgtttaattcgtttatattacc

SEQ ID NO: 764449 - DNA, 22 bp, Artificial Sequence
  chemically synthesized
gtttaattcgtttatattacca

SEQ ID NO: 764450 - DNA, 22 bp, Artificial Sequence
  chemically synthesized
tttaattcgtttatattaccaa

SEQ ID NO: 764451 - DNA, 22 bp, Artificial Sequence
  chemically synthesized
ccgtcaatatttagttggtaat

SEQ ID NO: 764452 - DNA, 22 bp, Artificial Sequence
  chemically synthesized
aattcgtttatattaccaacta

SEQ ID NO: 764453 - DNA, 22 bp, Artificial Sequence
  chemically synthesized
attcgtttatattaccaactaa

SEQ ID NO: 764454 - DNA, 22 bp, Artificial Sequence
  chemically synthesized
gtttatattaccaactaaatat

SEQ ID NO: 764455 - DNA, 22 bp, Artificial Sequence
  chemically synthesized
atattaccaactaaatattgac

SEQ ID NO: 764456 - DNA, 22 bp, Artificial Sequence
  chemically synthesized
gcaggaattgccgtcaatattt

SEQ ID NO: 764457 - DNA, 22 bp, Artificial Sequence
  chemically synthesized
tattaccaactaaatattgacg

SEQ ID NO: 764458 - DNA, 22 bp, Artificial Sequence
  chemically synthesized
ggcaggaattgccgtcaatatt

SEQ ID NO: 764459 - DNA, 22 bp, Artificial Sequence
  chemically synthesized
ccaactaaatattgacggcaat

SEQ ID NO: 764460 - DNA, 22 bp, Artificial Sequence
  chemically synthesized
tgaagacttggcaggaattgcc

SEQ ID NO: 764461 - DNA, 22 bp, Artificial Sequence
  chemically synthesized
aatattgacggcaattcctgcc

SEQ ID NO: 764462 - DNA, 22 bp, Artificial Sequence
  chemically synthesized
acggcaattcctgccaagtctt

SEQ ID NO: 764463 - DNA, 22 bp, Artificial Sequence
  chemically synthesized
tcccagtatctatgaagacttg

SEQ ID NO: 764464 - DNA, 22 bp, Artificial Sequence
  chemically synthesized
atcccagtatctatgaagactt

SEQ ID NO: 764465 - DNA, 22 bp, Artificial Sequence
  chemically synthesized
tatcccagtatctatgaagact

SEQ ID NO: 764466 - DNA, 22 bp, Artificial Sequence
  chemically synthesized
ctgccaagtcttcatagatact

SEQ ID NO: 764467 - DNA, 22 bp, Artificial Sequence
  chemically synthesized
ccaagtcttcatagatactggg

SEQ ID NO: 764468 - DNA, 22 bp, Artificial Sequence
  chemically synthesized
aaggaaggagtctttatcccag

SEQ ID NO: 764469 - DNA, 22 bp, Artificial Sequence
  chemically synthesized
taaaggaaggagtctttatccc

SEQ ID NO: 764470 - DNA, 22 bp, Artificial Sequence
  chemically synthesized
ctaaaggaaggagtctttatcc

SEQ ID NO: 764471 - DNA, 22 bp, Artificial Sequence
  chemically synthesized
catagatactgggataaagact

SEQ ID NO: 764472 - DNA, 22 bp, Artificial Sequence
  chemically synthesized
atagatactgggataaagactc

SEQ ID NO: 764473 - DNA, 22 bp, Artificial Sequence
  chemically synthesized
catttctaaaggaaggagtctt

SEQ ID NO: 764474 - DNA, 22 bp, Artificial Sequence
  chemically synthesized
tgcatttctaaaggaaggagtc

SEQ ID NO: 764475 - DNA, 22 bp, Artificial Sequence
  chemically synthesized
ctgcatttctaaaggaaggagt

SEQ ID NO: 764476 - DNA, 22 bp, Artificial Sequence
  chemically synthesized
ggataaagactccttcctttag

SEQ ID NO: 764477 - DNA, 22 bp, Artificial Sequence
  chemically synthesized
gccatttctgcatttctaaagg

SEQ ID NO: 764478 - DNA, 22 bp, Artificial Sequence
  chemically synthesized
agccatttctgcatttctaaag

SEQ ID NO: 764479 - DNA, 22 bp, Artificial Sequence
  chemically synthesized
tagccatttctgcatttctaaa

SEQ ID NO: 764480 - DNA, 22 bp, Artificial Sequence
  chemically synthesized
cttcctttagaaatgcagaaat

SEQ ID NO: 764481 - DNA, 22 bp, Artificial Sequence
  chemically synthesized
agataactttagccatttctgc

SEQ ID NO: 764482 - DNA, 22 bp, Artificial Sequence
  chemically synthesized
cctttagaaatgcagaaatggc

SEQ ID NO: 764483 - DNA, 22 bp, Artificial Sequence
  chemically synthesized
ctttagaaatgcagaaatggct

SEQ ID NO: 764484 - DNA, 22 bp, Artificial Sequence
  chemically synthesized
tagaaatgcagaaatggctaaa

SEQ ID NO: 764485 - DNA, 22 bp, Artificial Sequence
  chemically synthesized
agaaatgcagaaatggctaaag

SEQ ID NO: 764486 - DNA, 22 bp, Artificial Sequence
  chemically synthesized
gaaatgcagaaatggctaaagt

SEQ ID NO: 764487 - DNA, 22 bp, Artificial Sequence
  chemically synthesized
ccaatgctaagataactttagc

SEQ ID NO: 764488 - DNA, 22 bp, Artificial Sequence
  chemically synthesized
gccaatgctaagataactttag

SEQ ID NO: 764489 - DNA, 22 bp, Artificial Sequence
  chemically synthesized
ttgccaatgctaagataacttt

SEQ ID NO: 764490 - DNA, 22 bp, Artificial Sequence
  chemically synthesized
cttgccaatgctaagataactt

SEQ ID NO: 764491 - DNA, 22 bp, Artificial Sequence
  chemically synthesized
tcttcttgccaatgctaagata

SEQ ID NO: 764492 - DNA, 22 bp, Artificial Sequence
  chemically synthesized
atcttcttgccaatgctaagat

SEQ ID NO: 764493 - DNA, 22 bp, Artificial Sequence
  chemically synthesized
aagttatcttagcattggcaag

SEQ ID NO: 764494 - DNA, 22 bp, Artificial Sequence
  chemically synthesized
acagaagacttatcttcttgcc

SEQ ID NO: 764495 - DNA, 22 bp, Artificial Sequence
  chemically synthesized
tcttagcattggcaagaagata

SEQ ID NO: 764496 - DNA, 22 bp, Artificial Sequence
  chemically synthesized
agcattggcaagaagataagtc

SEQ ID NO: 764497 - DNA, 22 bp, Artificial Sequence
  chemically synthesized
gcattggcaagaagataagtct

SEQ ID NO: 764498 - DNA, 22 bp, Artificial Sequence
  chemically synthesized
gcaagaagataagtcttctgtc

SEQ ID NO: 764499 - DNA, 22 bp, Artificial Sequence
  chemically synthesized
gaaaagcagtactgacagaaga

SEQ ID NO: 764500 - DNA, 22 bp, Artificial Sequence
  chemically synthesized
ctgtcagtactgcttttctagg

SEQ ID NO: 764501 - DNA, 22 bp, Artificial Sequence
  chemically synthesized
tgtcagtactgcttttctaggt

SEQ ID NO: 764502 - DNA, 22 bp, Artificial Sequence
  chemically synthesized
tatcaccatcatgacctagaaa

SEQ ID NO: 764503 - DNA, 22 bp, Artificial Sequence
  chemically synthesized
tcagtactgcttttctaggtca

SEQ ID NO: 764504 - DNA, 22 bp, Artificial Sequence
  chemically synthesized
tgtatcaccatcatgacctaga

SEQ ID NO: 764505 - DNA, 22 bp, Artificial Sequence
  chemically synthesized
cagctctgtatcaccatcatga

SEQ ID NO: 764506 - DNA, 22 bp, Artificial Sequence
  chemically synthesized
acagctctgtatcaccatcatg

SEQ ID NO: 764507 - DNA, 22 bp, Artificial Sequence
  chemically synthesized
cttttctaggtcatgatggtga

SEQ ID NO: 764508 - DNA, 22 bp, Artificial Sequence
  chemically synthesized
ttctaggtcatgatggtgatac

SEQ ID NO: 764509 - DNA, 22 bp, Artificial Sequence
  chemically synthesized
tctaggtcatgatggtgataca

SEQ ID NO: 764510 - DNA, 22 bp, Artificial Sequence
  chemically synthesized
ctaggtcatgatggtgatacag

SEQ ID NO: 764511 - DNA, 22 bp, Artificial Sequence
  chemically synthesized
taggtcatgatggtgatacaga

SEQ ID NO: 764512 - DNA, 22 bp, Artificial Sequence
  chemically synthesized
ggtcatgatggtgatacagagc

SEQ ID NO: 764513 - DNA, 22 bp, Artificial Sequence
  chemically synthesized
tacacgtgtcatttacagctct

SEQ ID NO: 764514 - DNA, 22 bp, Artificial Sequence
  chemically synthesized
ctgtacacgtgtcatttacagc

SEQ ID NO: 764515 - DNA, 22 bp, Artificial Sequence
  chemically synthesized
actgtacacgtgtcatttacag

SEQ ID NO: 764516 - DNA, 22 bp, Artificial Sequence
  chemically synthesized
tactgtacacgtgtcatttaca

SEQ ID NO: 764517 - DNA, 22 bp, Artificial Sequence
  chemically synthesized
taaagccctttactgtacacgt

SEQ ID NO: 764518 - DNA, 22 bp, Artificial Sequence
  chemically synthesized
taaatgacacgtgtacagtaaa

SEQ ID NO: 764519 - DNA, 22 bp, Artificial Sequence
  chemically synthesized
taacctgtaaagccctttactg

SEQ ID NO: 764520 - DNA, 22 bp, Artificial Sequence
  chemically synthesized
gtaacctgtaaagccctttact

SEQ ID NO: 764521 - DNA, 22 bp, Artificial Sequence
  chemically synthesized
tgtaacctgtaaagccctttac

SEQ ID NO: 764522 - DNA, 22 bp, Artificial Sequence
  chemically synthesized
tacgtgctttgtaacctgtaaa

SEQ ID NO: 764523 - DNA, 22 bp, Artificial Sequence
  chemically synthesized
gtacgtgctttgtaacctgtaa

SEQ ID NO: 764524 - DNA, 22 bp, Artificial Sequence
  chemically synthesized
tacaggttacaaagcacgtaca

SEQ ID NO: 764525 - DNA, 22 bp, Artificial Sequence
  chemically synthesized
aggtggtacatttgtacgtgct

SEQ ID NO: 764526 - DNA, 22 bp, Artificial Sequence
  chemically synthesized
acaggttacaaagcacgtacaa

SEQ ID NO: 764527 - DNA, 22 bp, Artificial Sequence
  chemically synthesized
caggttacaaagcacgtacaaa

SEQ ID NO: 764528 - DNA, 22 bp, Artificial Sequence
  chemically synthesized
caaagcacgtacaaatgtacca

SEQ ID NO: 764529 - DNA, 22 bp, Artificial Sequence
  chemically synthesized
acagagccagggggaggaataa

SEQ ID NO: 764530 - DNA, 22 bp, Artificial Sequence
  chemically synthesized
cacagagccagggggaggaata

SEQ ID NO: 764531 - DNA, 22 bp, Artificial Sequence
  chemically synthesized
agttattcctccccctggctct

SEQ ID NO: 764532 - DNA, 22 bp, Artificial Sequence
  chemically synthesized
gttattcctccccctggctctg

SEQ ID NO: 764533 - DNA, 22 bp, Artificial Sequence
  chemically synthesized
ttcctccccctggctctgtgaa

SEQ ID NO: 764534 - DNA, 22 bp, Artificial Sequence
  chemically synthesized
ctccccctggctctgtgaagta

SEQ ID NO: 764535 - DNA, 22 bp, Artificial Sequence
  chemically synthesized
cccctggctctgtgaagtacat

SEQ ID NO: 764536 - DNA, 22 bp, Artificial Sequence
  chemically synthesized
caaaacagaaaatgtgatgtac

SEQ ID NO: 764537 - DNA, 22 bp, Artificial Sequence
  chemically synthesized
gctctgtgaagtacatcacatt

SEQ ID NO: 764538 - DNA, 22 bp, Artificial Sequence
  chemically synthesized
atctgcaaaacagaaaatgtga

SEQ ID NO: 764539 - DNA, 22 bp, Artificial Sequence
  chemically synthesized
tgtgaagtacatcacattttct

SEQ ID NO: 764540 - DNA, 22 bp, Artificial Sequence
  chemically synthesized
tcatctgcaaaacagaaaatgt

SEQ ID NO: 764541 - DNA, 22 bp, Artificial Sequence
  chemically synthesized
tgaagtacatcacattttctgt

SEQ ID NO: 764542 - DNA, 22 bp, Artificial Sequence
  chemically synthesized
agtgctctcatctgcaaaacag

SEQ ID NO: 764543 - DNA, 22 bp, Artificial Sequence
  chemically synthesized
tctgttttgcagatgagagcac

SEQ ID NO: 764544 - DNA, 22 bp, Artificial Sequence
  chemically synthesized
ctgttttgcagatgagagcact

SEQ ID NO: 764545 - DNA, 22 bp, Artificial Sequence
  chemically synthesized
tgttttgcagatgagagcactg

SEQ ID NO: 764546 - DNA, 22 bp, Artificial Sequence
  chemically synthesized
aacatccgagtctcagtgctct

SEQ ID NO: 764547 - DNA, 22 bp, Artificial Sequence
  chemically synthesized
ttttgcagatgagagcactgag

SEQ ID NO: 764548 - DNA, 22 bp, Artificial Sequence
  chemically synthesized
tgcagatgagagcactgagact

SEQ ID NO: 764549 - DNA, 22 bp, Artificial Sequence
  chemically synthesized
gcagatgagagcactgagactc

SEQ ID NO: 764550 - DNA, 22 bp, Artificial Sequence
  chemically synthesized
cagatgagagcactgagactcg

SEQ ID NO: 764551 - DNA, 22 bp, Artificial Sequence
  chemically synthesized
ggcaagtcagttaaacatccga

SEQ ID NO: 764552 - DNA, 22 bp, Artificial Sequence
  chemically synthesized
aggcaagtcagttaaacatccg

SEQ ID NO: 764553 - DNA, 22 bp, Artificial Sequence
  chemically synthesized
taggcaagtcagttaaacatcc

SEQ ID NO: 764554 - DNA, 22 bp, Artificial Sequence
  chemically synthesized
ttaggcaagtcagttaaacatc

SEQ ID NO: 764555 - DNA, 22 bp, Artificial Sequence
  chemically synthesized
agactcggatgtttaactgact

SEQ ID NO: 764556 - DNA, 22 bp, Artificial Sequence
  chemically synthesized
tatggcttttaggcaagtcagt

SEQ ID NO: 764557 - DNA, 22 bp, Artificial Sequence
  chemically synthesized
ggatgtttaactgacttgccta

SEQ ID NO: 764558 - DNA, 22 bp, Artificial Sequence
  chemically synthesized
tcagctatatggcttttaggca

SEQ ID NO: 764559 - DNA, 22 bp, Artificial Sequence
  chemically synthesized
atcagctatatggcttttaggc

SEQ ID NO: 764560 - DNA, 22 bp, Artificial Sequence
  chemically synthesized
aactgacttgcctaaaagccat

SEQ ID NO: 764561 - DNA, 22 bp, Artificial Sequence
  chemically synthesized
actgacttgcctaaaagccata

SEQ ID NO: 764562 - DNA, 22 bp, Artificial Sequence
  chemically synthesized
acacttatcagctatatggctt

SEQ ID NO: 764563 - DNA, 22 bp, Artificial Sequence
  chemically synthesized
acttgcctaaaagccatatagc

SEQ ID NO: 764564 - DNA, 22 bp, Artificial Sequence
  chemically synthesized
taacacttatcagctatatggc

SEQ ID NO: 764565 - DNA, 22 bp, Artificial Sequence
  chemically synthesized
gcctaaaagccatatagctgat

SEQ ID NO: 764566 - DNA, 22 bp, Artificial Sequence
  chemically synthesized
cctaaaagccatatagctgata

SEQ ID NO: 764567 - DNA, 22 bp, Artificial Sequence
  chemically synthesized
ccagttctaacacttatcagct

SEQ ID NO: 764568 - DNA, 22 bp, Artificial Sequence
  chemically synthesized
cccagttctaacacttatcagc

SEQ ID NO: 764569 - DNA, 22 bp, Artificial Sequence
  chemically synthesized
aaagccatatagctgataagtg

SEQ ID NO: 764570 - DNA, 22 bp, Artificial Sequence
  chemically synthesized
gatccatttcccagttctaaca

SEQ ID NO: 764571 - DNA, 22 bp, Artificial Sequence
  chemically synthesized
ataagtgttagaactgggaaat

SEQ ID NO: 764572 - DNA, 22 bp, Artificial Sequence
  chemically synthesized
gaatcaagagaattggatccat

SEQ ID NO: 764573 - DNA, 22 bp, Artificial Sequence
  chemically synthesized
gaactgggaaatggatccaatt

SEQ ID NO: 764574 - DNA, 22 bp, Artificial Sequence
  chemically synthesized
tagaatcaagagaattggatcc

SEQ ID NO: 764575 - DNA, 22 bp, Artificial Sequence
  chemically synthesized
ctagaatcaagagaattggatc

SEQ ID NO: 764576 - DNA, 22 bp, Artificial Sequence
  chemically synthesized
ggaaatggatccaattctcttg

SEQ ID NO: 764577 - DNA, 22 bp, Artificial Sequence
  chemically synthesized
gtggaggcagcccaagatcttc

SEQ ID NO: 764578 - DNA, 22 bp, Artificial Sequence
  chemically synthesized
tcttgattctagaagatcttgg

SEQ ID NO: 764579 - DNA, 22 bp, Artificial Sequence
  chemically synthesized
ttgattctagaagatcttgggc

SEQ ID NO: 764580 - DNA, 22 bp, Artificial Sequence
  chemically synthesized
gattctagaagatcttgggctg

SEQ ID NO: 764581 - DNA, 22 bp, Artificial Sequence
  chemically synthesized
attctagaagatcttgggctgc

SEQ ID NO: 764582 - DNA, 22 bp, Artificial Sequence
  chemically synthesized
tagaagatcttgggctgcctcc

SEQ ID NO: 764583 - DNA, 22 bp, Artificial Sequence
  chemically synthesized
gaagatcttgggctgcctccac

SEQ ID NO: 764584 - DNA, 22 bp, Artificial Sequence
  chemically synthesized
gcaagtgggttggtggaggcag

SEQ ID NO: 764585 - DNA, 22 bp, Artificial Sequence
  chemically synthesized
tggcaagtgggttggtggaggc

SEQ ID NO: 764586 - DNA, 22 bp, Artificial Sequence
  chemically synthesized
ctggcaagtgggttggtggagg

SEQ ID NO: 764587 - DNA, 22 bp, Artificial Sequence
  chemically synthesized
gggctgcctccaccaacccact

SEQ ID NO: 764588 - DNA, 22 bp, Artificial Sequence
  chemically synthesized
ggctgcctccaccaacccactt

SEQ ID NO: 764589 - DNA, 22 bp, Artificial Sequence
  chemically synthesized
cctccaccaacccacttgccag

SEQ ID NO: 764590 - DNA, 22 bp, Artificial Sequence
  chemically synthesized
tatccaatgcttctggcaagtg

SEQ ID NO: 764591 - DNA, 22 bp, Artificial Sequence
  chemically synthesized
caccaacccacttgccagaagc

SEQ ID NO: 764592 - DNA, 22 bp, Artificial Sequence
  chemically synthesized
tgtattatatccaatgcttctg

SEQ ID NO: 764593 - DNA, 22 bp, Artificial Sequence
  chemically synthesized
ctgtgtattatatccaatgctt

SEQ ID NO: 764594 - DNA, 22 bp, Artificial Sequence
  chemically synthesized
gccagaagcattggatataata

SEQ ID NO: 764595 - DNA, 22 bp, Artificial Sequence
  chemically synthesized
ccagaagcattggatataatac

SEQ ID NO: 764596 - DNA, 22 bp, Artificial Sequence
  chemically synthesized
agtgactactgtgtattatatc

SEQ ID NO: 764597 - DNA, 22 bp, Artificial Sequence
  chemically synthesized
aggttcagtgactactgtgtat

SEQ ID NO: 764598 - DNA, 22 bp, Artificial Sequence
  chemically synthesized
gttcaggttcagtgactactgt

SEQ ID NO: 764599 - DNA, 22 bp, Artificial Sequence
  chemically synthesized
cgttcaggttcagtgactactg

SEQ ID NO: 764600 - DNA, 22 bp, Artificial Sequence
  chemically synthesized
gatataatacacagtagtcact

SEQ ID NO: 764601 - DNA, 22 bp, Artificial Sequence
  chemically synthesized
caagtagtatcttcgttcaggt

SEQ ID NO: 764602 - DNA, 22 bp, Artificial Sequence
  chemically synthesized
gcaagtagtatcttcgttcagg

SEQ ID NO: 764603 - DNA, 22 bp, Artificial Sequence
  chemically synthesized
ttgcaagtagtatcttcgttca

SEQ ID NO: 764604 - DNA, 22 bp, Artificial Sequence
  chemically synthesized
ctcttgcaagtagtatcttcgt

SEQ ID NO: 764605 - DNA, 22 bp, Artificial Sequence
  chemically synthesized
cctcttgcaagtagtatcttcg

SEQ ID NO: 764606 - DNA, 22 bp, Artificial Sequence
  chemically synthesized
tttcctcttgcaagtagtatct

SEQ ID NO: 764607 - DNA, 22 bp, Artificial Sequence
  chemically synthesized
aacctgaacgaagatactactt

SEQ ID NO: 764608 - DNA, 22 bp, Artificial Sequence
  chemically synthesized
atttcctcttgcaagtagtatc

SEQ ID NO: 764609 - DNA, 22 bp, Artificial Sequence
  chemically synthesized
aacgaagatactacttgcaaga

SEQ ID NO: 764610 - DNA, 22 bp, Artificial Sequence
  chemically synthesized
aacagtcacttatttcctcttg

SEQ ID NO: 764611 - DNA, 22 bp, Artificial Sequence
  chemically synthesized
cctcaacagtcacttatttcct

SEQ ID NO: 764612 - DNA, 22 bp, Artificial Sequence
  chemically synthesized
ccctcaacagtcacttatttcc

SEQ ID NO: 764613 - DNA, 22 bp, Artificial Sequence
  chemically synthesized
tccctcaacagtcacttatttc

SEQ ID NO: 764614 - DNA, 22 bp, Artificial Sequence
  chemically synthesized
ttccctcaacagtcacttattt

SEQ ID NO: 764615 - DNA, 22 bp, Artificial Sequence
  chemically synthesized
cttgcaagaggaaataagtgac

SEQ ID NO: 764616 - DNA, 22 bp, Artificial Sequence
  chemically synthesized
gcaagaggaaataagtgactgt

SEQ ID NO: 764617 - DNA, 22 bp, Artificial Sequence
  chemically synthesized
caagaggaaataagtgactgtt

SEQ ID NO: 764618 - DNA, 22 bp, Artificial Sequence
  chemically synthesized
agggtgcttttccctcaacagt

SEQ ID NO: 764619 - DNA, 22 bp, Artificial Sequence
  chemically synthesized
cagggtgcttttccctcaacag

SEQ ID NO: 764620 - DNA, 22 bp, Artificial Sequence
  chemically synthesized
tcagggtgcttttccctcaaca

SEQ ID NO: 764621 - DNA, 22 bp, Artificial Sequence
  chemically synthesized
tctttcagggtgcttttccctc

SEQ ID NO: 764622 - DNA, 22 bp, Artificial Sequence
  chemically synthesized
ttgagggaaaagcaccctgaaa

SEQ ID NO: 764623 - DNA, 22 bp, Artificial Sequence
  chemically synthesized
aagaatgctgtctttcagggtg

SEQ ID NO: 764624 - DNA, 22 bp, Artificial Sequence
  chemically synthesized
agggaaaagcaccctgaaagac

SEQ ID NO: 764625 - DNA, 22 bp, Artificial Sequence
  chemically synthesized
tcaaactcaagaatgctgtctt

SEQ ID NO: 764626 - DNA, 22 bp, Artificial Sequence
  chemically synthesized
atcaaactcaagaatgctgtct

SEQ ID NO: 764627 - DNA, 22 bp, Artificial Sequence
  chemically synthesized
tatcaaactcaagaatgctgtc

SEQ ID NO: 764628 - DNA, 22 bp, Artificial Sequence
  chemically synthesized
aaagacagcattcttgagtttg

SEQ ID NO: 764629 - DNA, 22 bp, Artificial Sequence
  chemically synthesized
ttgagtttgataaaatgtttac

SEQ ID NO: 764630 - DNA, 22 bp, Artificial Sequence
  chemically synthesized
gagtttgataaaatgtttaccc

SEQ ID NO: 764631 - DNA, 22 bp, Artificial Sequence
  chemically synthesized
agtttgataaaatgtttaccca

SEQ ID NO: 764632 - DNA, 22 bp, Artificial Sequence
  chemically synthesized
gataaaatgtttacccacgtgg

SEQ ID NO: 764633 - DNA, 22 bp, Artificial Sequence
  chemically synthesized
ataaaatgtttacccacgtgga

SEQ ID NO: 764634 - DNA, 22 bp, Artificial Sequence
  chemically synthesized
agaacaaatcaatccacgtggg

SEQ ID NO: 764635 - DNA, 22 bp, Artificial Sequence
  chemically synthesized
attcagaacaaatcaatccacg

SEQ ID NO: 764636 - DNA, 22 bp, Artificial Sequence
  chemically synthesized
cattcagaacaaatcaatccac

SEQ ID NO: 764637 - DNA, 22 bp, Artificial Sequence
  chemically synthesized
tcattcagaacaaatcaatcca

SEQ ID NO: 764638 - DNA, 22 bp, Artificial Sequence
  chemically synthesized
ttcattcagaacaaatcaatcc

SEQ ID NO: 764639 - DNA, 22 bp, Artificial Sequence
  chemically synthesized
acccacgtggattgatttgttc

SEQ ID NO: 764640 - DNA, 22 bp, Artificial Sequence
  chemically synthesized
cccacgtggattgatttgttct

SEQ ID NO: 764641 - DNA, 22 bp, Artificial Sequence
  chemically synthesized
aatttttcattcagaacaaatc

SEQ ID NO: 764642 - DNA, 22 bp, Artificial Sequence
  chemically synthesized
atttgttctgaatgaaaaattg

SEQ ID NO: 764643 - DNA, 22 bp, Artificial Sequence
  chemically synthesized
gttctgaatgaaaaattgaatt

SEQ ID NO: 764644 - DNA, 22 bp, Artificial Sequence
  chemically synthesized
ttctgaatgaaaaattgaattc

SEQ ID NO: 764645 - DNA, 22 bp, Artificial Sequence
  chemically synthesized
tgaatgaaaaattgaattctga

SEQ ID NO: 764646 - DNA, 22 bp, Artificial Sequence
  chemically synthesized
aatgaaaaattgaattctgact

SEQ ID NO: 764647 - DNA, 22 bp, Artificial Sequence
  chemically synthesized
aaaaaaaaaaaaaaaaaaagag

SEQ ID NO: 764648 - DNA, 22 bp, Artificial Sequence
  chemically synthesized
aattctgactgctctttttttt

SEQ ID NO: 764649 - DNA, 22 bp, Artificial Sequence
  chemically synthesized
tctcaaaaaaaaaaaaaaaaaa

SEQ ID NO: 764650 - DNA, 22 bp, Artificial Sequence
  chemically synthesized
tgactgctcttttttttttttt

SEQ ID NO: 764651 - DNA, 22 bp, Artificial Sequence
  chemically synthesized
tgtctcaaaaaaaaaaaaaaaa

SEQ ID NO: 764652 - DNA, 22 bp, Artificial Sequence
  chemically synthesized
actgctcttttttttttttttt

SEQ ID NO: 764653 - DNA, 22 bp, Artificial Sequence
  chemically synthesized
ctcttttttttttttttttttt

SEQ ID NO: 764654 - DNA, 22 bp, Artificial Sequence
  chemically synthesized
tttttttttttttttttttgag

SEQ ID NO: 764655 - DNA, 22 bp, Artificial Sequence
  chemically synthesized
tttttttttttttttttgagac

SEQ ID NO: 764656 - DNA, 22 bp, Artificial Sequence
  chemically synthesized
ttttttttttttttttgagaca

SEQ ID NO: 764657 - DNA, 22 bp, Artificial Sequence
  chemically synthesized
tttttttttttttttgagacag

SEQ ID NO: 764658 - DNA, 22 bp, Artificial Sequence
  chemically synthesized
ttttttttttttttgagacaga

SEQ ID NO: 764659 - DNA, 22 bp, Artificial Sequence
  chemically synthesized
tttttttttttttgagacagag

SEQ ID NO: 764660 - DNA, 22 bp, Artificial Sequence
  chemically synthesized
ttttttttttttgagacagagt

SEQ ID NO: 764661 - DNA, 22 bp, Artificial Sequence
  chemically synthesized
tttttttttttgagacagagtc

SEQ ID NO: 764662 - DNA, 22 bp, Artificial Sequence
  chemically synthesized
ttttttttttgagacagagtct

SEQ ID NO: 764663 - DNA, 22 bp, Artificial Sequence
  chemically synthesized
ggtgacagagcgagactctgtc

SEQ ID NO: 764664 - DNA, 22 bp, Artificial Sequence
  chemically synthesized
tttttttttgagacagagtctc

SEQ ID NO: 764665 - DNA, 22 bp, Artificial Sequence
  chemically synthesized
ttttttttgagacagagtctcg

SEQ ID NO: 764666 - DNA, 22 bp, Artificial Sequence
  chemically synthesized
tttttttgagacagagtctcgc

SEQ ID NO: 764667 - DNA, 22 bp, Artificial Sequence
  chemically synthesized
ttttttgagacagagtctcgct

SEQ ID NO: 764668 - DNA, 22 bp, Artificial Sequence
  chemically synthesized
tttttgagacagagtctcgctc

SEQ ID NO: 764669 - DNA, 22 bp, Artificial Sequence
  chemically synthesized
ttttgagacagagtctcgctct

SEQ ID NO: 764670 - DNA, 22 bp, Artificial Sequence
  chemically synthesized
tttgagacagagtctcgctctg

SEQ ID NO: 764671 - DNA, 22 bp, Artificial Sequence
  chemically synthesized
cagcctgggtgacagagcgaga

SEQ ID NO: 764672 - DNA, 22 bp, Artificial Sequence
  chemically synthesized
ttgagacagagtctcgctctgt

SEQ ID NO: 764673 - DNA, 22 bp, Artificial Sequence
  chemically synthesized
tgagacagagtctcgctctgtc

SEQ ID NO: 764674 - DNA, 22 bp, Artificial Sequence
  chemically synthesized
gagacagagtctcgctctgtca

SEQ ID NO: 764675 - DNA, 22 bp, Artificial Sequence
  chemically synthesized
agacagagtctcgctctgtcac

SEQ ID NO: 764676 - DNA, 22 bp, Artificial Sequence
  chemically synthesized
tgctccagcctgggtgacagag

SEQ ID NO: 764677 - DNA, 22 bp, Artificial Sequence
  chemically synthesized
gctctgtcacccaggctggagc

SEQ ID NO: 764678 - DNA, 22 bp, Artificial Sequence
  chemically synthesized
tgtcacccaggctggagcacag

SEQ ID NO: 764679 - DNA, 22 bp, Artificial Sequence
  chemically synthesized
tcacccaggctggagcacagtg

SEQ ID NO: 764680 - DNA, 22 bp, Artificial Sequence
  chemically synthesized
cagtgagccaagatcgcgccac

SEQ ID NO: 764681 - DNA, 22 bp, Artificial Sequence
  chemically synthesized
gcagtgagccaagatcgcgcca

SEQ ID NO: 764682 - DNA, 22 bp, Artificial Sequence
  chemically synthesized
gagcacagtggcgcgatcttgg

SEQ ID NO: 764683 - DNA, 22 bp, Artificial Sequence
  chemically synthesized
ggaggcggagcttgcagtgagc

SEQ ID NO: 764684 - DNA, 22 bp, Artificial Sequence
  chemically synthesized
ggctcactgcaagctccgcctc

SEQ ID NO: 764685 - DNA, 22 bp, Artificial Sequence
  chemically synthesized
gctcactgcaagctccgcctcc

SEQ ID NO: 764686 - DNA, 22 bp, Artificial Sequence
  chemically synthesized
actgcaagctccgcctcccagg

SEQ ID NO: 764687 - DNA, 22 bp, Artificial Sequence
  chemically synthesized
caagctccgcctcccaggttca

SEQ ID NO: 764688 - DNA, 22 bp, Artificial Sequence
  chemically synthesized
aggcaggagaatggcgtgaacc

SEQ ID NO: 764689 - DNA, 22 bp, Artificial Sequence
  chemically synthesized
cgcctcccaggttcacgccatt

SEQ ID NO: 764690 - DNA, 22 bp, Artificial Sequence
  chemically synthesized
ggaggctgaggcaggagaatgg

SEQ ID NO: 764691 - DNA, 22 bp, Artificial Sequence
  chemically synthesized
ccaggttcacgccattctcctg

SEQ ID NO: 764692 - DNA, 22 bp, Artificial Sequence
  chemically synthesized
gggaggctgaggcaggagaatg

SEQ ID NO: 764693 - DNA, 22 bp, Artificial Sequence
  chemically synthesized
cttgggaggctgaggcaggaga

SEQ ID NO: 764694 - DNA, 22 bp, Artificial Sequence
  chemically synthesized
acgccattctcctgcctcagcc

SEQ ID NO: 764695 - DNA, 22 bp, Artificial Sequence
  chemically synthesized
tagtcccagctacttgggaggc

SEQ ID NO: 764696 - DNA, 22 bp, Artificial Sequence
  chemically synthesized
tcctgcctcagcctcccaagta

SEQ ID NO: 764697 - DNA, 22 bp, Artificial Sequence
  chemically synthesized
ctgcctcagcctcccaagtagc

SEQ ID NO: 764698 - DNA, 22 bp, Artificial Sequence
  chemically synthesized
cctcagcctcccaagtagctgg

SEQ ID NO: 764699 - DNA, 22 bp, Artificial Sequence
  chemically synthesized
agcctcccaagtagctgggact

SEQ ID NO: 764700 - DNA, 22 bp, Artificial Sequence
  chemically synthesized
ccaagtagctgggactataggc

SEQ ID NO: 764701 - DNA, 22 bp, Artificial Sequence
  chemically synthesized
gccaggcgtggtggcgggcgcc

SEQ ID NO: 764702 - DNA, 22 bp, Artificial Sequence
  chemically synthesized
ggactataggcgcccgccacca

SEQ ID NO: 764703 - DNA, 22 bp, Artificial Sequence
  chemically synthesized
taggcgcccgccaccacgcctg

SEQ ID NO: 764704 - DNA, 22 bp, Artificial Sequence
  chemically synthesized
aaaatacaaaaaaaattagcca

SEQ ID NO: 764705 - DNA, 22 bp, Artificial Sequence
  chemically synthesized
ctaaaaatacaaaaaaaattag

SEQ ID NO: 764706 - DNA, 22 bp, Artificial Sequence
  chemically synthesized
tactaaaaatacaaaaaaaatt

SEQ ID NO: 764707 - DNA, 22 bp, Artificial Sequence
  chemically synthesized
ctactaaaaatacaaaaaaaat

SEQ ID NO: 764708 - DNA, 22 bp, Artificial Sequence
  chemically synthesized
tttctactaaaaatacaaaaaa

SEQ ID NO: 764709 - DNA, 22 bp, Artificial Sequence
  chemically synthesized
gctaattttttttgtattttta

SEQ ID NO: 764710 - DNA, 22 bp, Artificial Sequence
  chemically synthesized
attttttttgtatttttagtag

SEQ ID NO: 764711 - DNA, 22 bp, Artificial Sequence
  chemically synthesized
tttttgtatttttagtagaaac

SEQ ID NO: 764712 - DNA, 22 bp, Artificial Sequence
  chemically synthesized
ttttgtatttttagtagaaaca

SEQ ID NO: 764713 - DNA, 22 bp, Artificial Sequence
  chemically synthesized
tttgtatttttagtagaaacag

SEQ ID NO: 764714 - DNA, 22 bp, Artificial Sequence
  chemically synthesized
ttgtatttttagtagaaacagg

SEQ ID NO: 764715 - DNA, 22 bp, Artificial Sequence
  chemically synthesized
acatggtgaaaccctgtttcta

SEQ ID NO: 764716 - DNA, 22 bp, Artificial Sequence
  chemically synthesized
tgtatttttagtagaaacaggg

SEQ ID NO: 764717 - DNA, 22 bp, Artificial Sequence
  chemically synthesized
gtatttttagtagaaacagggt

SEQ ID NO: 764718 - DNA, 22 bp, Artificial Sequence
  chemically synthesized
tatttttagtagaaacagggtt

SEQ ID NO: 764719 - DNA, 22 bp, Artificial Sequence
  chemically synthesized
gctaacatggtgaaaccctgtt

SEQ ID NO: 764720 - DNA, 22 bp, Artificial Sequence
  chemically synthesized
ttagtagaaacagggtttcacc

SEQ ID NO: 764721 - DNA, 22 bp, Artificial Sequence
  chemically synthesized
tagtagaaacagggtttcacca

SEQ ID NO: 764722 - DNA, 22 bp, Artificial Sequence
  chemically synthesized
agtagaaacagggtttcaccat

SEQ ID NO: 764723 - DNA, 22 bp, Artificial Sequence
  chemically synthesized
gtagaaacagggtttcaccatg

SEQ ID NO: 764724 - DNA, 22 bp, Artificial Sequence
  chemically synthesized
caccatgttagccaggatggtc

SEQ ID NO: 764725 - DNA, 22 bp, Artificial Sequence
  chemically synthesized
accatgttagccaggatggtct

SEQ ID NO: 764726 - DNA, 22 bp, Artificial Sequence
  chemically synthesized
gccaggatggtctcgatctcct

SEQ ID NO: 764727 - DNA, 22 bp, Artificial Sequence
  chemically synthesized
gatctcctgacctcgtgatccg

SEQ ID NO: 764728 - DNA, 22 bp, Artificial Sequence
  chemically synthesized
ggaggccaaggtgggcggatca

SEQ ID NO: 764729 - DNA, 22 bp, Artificial Sequence
  chemically synthesized
gggaggccaaggtgggcggatc

SEQ ID NO: 764730 - DNA, 22 bp, Artificial Sequence
  chemically synthesized
tgggaggccaaggtgggcggat

SEQ ID NO: 764731 - DNA, 22 bp, Artificial Sequence
  chemically synthesized
ctgacctcgtgatccgcccacc

SEQ ID NO: 764732 - DNA, 22 bp, Artificial Sequence
  chemically synthesized
acctcgtgatccgcccaccttg

SEQ ID NO: 764733 - DNA, 22 bp, Artificial Sequence
  chemically synthesized
gtgatccgcccaccttggcctc

SEQ ID NO: 764734 - DNA, 22 bp, Artificial Sequence
  chemically synthesized
taatccaagcactttgggaggc

SEQ ID NO: 764735 - DNA, 22 bp, Artificial Sequence
  chemically synthesized
acgcctgtaatccaagcacttt

SEQ ID NO: 764736 - DNA, 22 bp, Artificial Sequence
  chemically synthesized
ggcctcccaaagtgcttggatt

SEQ ID NO: 764737 - DNA, 22 bp, Artificial Sequence
  chemically synthesized
gcctcccaaagtgcttggatta

SEQ ID NO: 764738 - DNA, 22 bp, Artificial Sequence
  chemically synthesized
ccaaagtgcttggattacaggc

SEQ ID NO: 764739 - DNA, 22 bp, Artificial Sequence
  chemically synthesized
ggattacaggcgtgagccacca

SEQ ID NO: 764740 - DNA, 22 bp, Artificial Sequence
  chemically synthesized
gattacaggcgtgagccaccac

SEQ ID NO: 764741 - DNA, 22 bp, Artificial Sequence
  chemically synthesized
caggcgtgagccaccacacctg

SEQ ID NO: 764742 - DNA, 22 bp, Artificial Sequence
  chemically synthesized
aatgagaagtgaaaagagcaat

SEQ ID NO: 764743 - DNA, 22 bp, Artificial Sequence
  chemically synthesized
gccctgattgctcttttcactt

SEQ ID NO: 764744 - DNA, 22 bp, Artificial Sequence
  chemically synthesized
attgctcttttcacttctcatt

SEQ ID NO: 764745 - DNA, 22 bp, Artificial Sequence
  chemically synthesized
ctcttttcacttctcatttagc

SEQ ID NO: 764746 - DNA, 22 bp, Artificial Sequence
  chemically synthesized
ttttcacttctcatttagcatt

SEQ ID NO: 764747 - DNA, 22 bp, Artificial Sequence
  chemically synthesized
ttcacttctcatttagcattgg

SEQ ID NO: 764748 - DNA, 22 bp, Artificial Sequence
  chemically synthesized
tcacttctcatttagcattggg

SEQ ID NO: 764749 - DNA, 22 bp, Artificial Sequence
  chemically synthesized
cacttctcatttagcattgggc

SEQ ID NO: 764750 - DNA, 22 bp, Artificial Sequence
  chemically synthesized
acttctcatttagcattgggca

SEQ ID NO: 764751 - DNA, 22 bp, Artificial Sequence
  chemically synthesized
acaggtggtccaggatgcccaa

SEQ ID NO: 764752 - DNA, 22 bp, Artificial Sequence
  chemically synthesized
ctcatttagcattgggcatcct

SEQ ID NO: 764753 - DNA, 22 bp, Artificial Sequence
  chemically synthesized
tcatttagcattgggcatcctg

SEQ ID NO: 764754 - DNA, 22 bp, Artificial Sequence
  chemically synthesized
ctcacaggtggtccaggatgcc

SEQ ID NO: 764755 - DNA, 22 bp, Artificial Sequence
  chemically synthesized
atttagcattgggcatcctgga

SEQ ID NO: 764756 - DNA, 22 bp, Artificial Sequence
  chemically synthesized
gctcacaggtggtccaggatgc

SEQ ID NO: 764757 - DNA, 22 bp, Artificial Sequence
  chemically synthesized
tgctcacaggtggtccaggatg

SEQ ID NO: 764758 - DNA, 22 bp, Artificial Sequence
  chemically synthesized
ttgctcacaggtggtccaggat

SEQ ID NO: 764759 - DNA, 22 bp, Artificial Sequence
  chemically synthesized
tttgctcacaggtggtccagga

SEQ ID NO: 764760 - DNA, 22 bp, Artificial Sequence
  chemically synthesized
agcattgggcatcctggaccac

SEQ ID NO: 764761 - DNA, 22 bp, Artificial Sequence
  chemically synthesized
gcattgggcatcctggaccacc

SEQ ID NO: 764762 - DNA, 22 bp, Artificial Sequence
  chemically synthesized
ggcatcctggaccacctgtgag

SEQ ID NO: 764763 - DNA, 22 bp, Artificial Sequence
  chemically synthesized
agtgtgaacattttttgctcac

SEQ ID NO: 764764 - DNA, 22 bp, Artificial Sequence
  chemically synthesized
cagtgtgaacattttttgctca

SEQ ID NO: 764765 - DNA, 22 bp, Artificial Sequence
  chemically synthesized
tcagtgtgaacattttttgctc

SEQ ID NO: 764766 - DNA, 22 bp, Artificial Sequence
  chemically synthesized
ttcagtgtgaacattttttgct

SEQ ID NO: 764767 - DNA, 22 bp, Artificial Sequence
  chemically synthesized
gaccacctgtgagcaaaaaatg

SEQ ID NO: 764768 - DNA, 22 bp, Artificial Sequence
  chemically synthesized
tgagcaaaaaatgttcacactg

SEQ ID NO: 764769 - DNA, 22 bp, Artificial Sequence
  chemically synthesized
cagaaaggagaccttttcagtg

SEQ ID NO: 764770 - DNA, 22 bp, Artificial Sequence
  chemically synthesized
gcagaaaggagaccttttcagt

SEQ ID NO: 764771 - DNA, 22 bp, Artificial Sequence
  chemically synthesized
acactgaaaaggtctcctttct

SEQ ID NO: 764772 - DNA, 22 bp, Artificial Sequence
  chemically synthesized
gcaacagggaaatttgcagaaa

SEQ ID NO: 764773 - DNA, 22 bp, Artificial Sequence
  chemically synthesized
aaaaggtctcctttctgcaaat

SEQ ID NO: 764774 - DNA, 22 bp, Artificial Sequence
  chemically synthesized
tggcaacagggaaatttgcaga

SEQ ID NO: 764775 - DNA, 22 bp, Artificial Sequence
  chemically synthesized
ttctggcaacagggaaatttgc

SEQ ID NO: 764776 - DNA, 22 bp, Artificial Sequence
  chemically synthesized
tgttctggcaacagggaaattt

SEQ ID NO: 764777 - DNA, 22 bp, Artificial Sequence
  chemically synthesized
ctgttctggcaacagggaaatt

SEQ ID NO: 764778 - DNA, 22 bp, Artificial Sequence
  chemically synthesized
ctttctgcaaatttccctgttg

SEQ ID NO: 764779 - DNA, 22 bp, Artificial Sequence
  chemically synthesized
tctgcaaatttccctgttgcca

SEQ ID NO: 764780 - DNA, 22 bp, Artificial Sequence
  chemically synthesized
ctgcaaatttccctgttgccag

SEQ ID NO: 764781 - DNA, 22 bp, Artificial Sequence
  chemically synthesized
tgcaaatttccctgttgccaga

SEQ ID NO: 764782 - DNA, 22 bp, Artificial Sequence
  chemically synthesized
caaatttccctgttgccagaac

SEQ ID NO: 764783 - DNA, 22 bp, Artificial Sequence
  chemically synthesized
atggcagaatttctgttctggc

SEQ ID NO: 764784 - DNA, 22 bp, Artificial Sequence
  chemically synthesized
ctgatggcagaatttctgttct

SEQ ID NO: 764785 - DNA, 22 bp, Artificial Sequence
  chemically synthesized
ccctgttgccagaacagaaatt

SEQ ID NO: 764786 - DNA, 22 bp, Artificial Sequence
  chemically synthesized
cctgttgccagaacagaaattc

SEQ ID NO: 764787 - DNA, 22 bp, Artificial Sequence
  chemically synthesized
ttgccagaacagaaattctgcc

SEQ ID NO: 764788 - DNA, 22 bp, Artificial Sequence
  chemically synthesized
ccagaacagaaattctgccatc

SEQ ID NO: 764789 - DNA, 22 bp, Artificial Sequence
  chemically synthesized
tagacaaagagatgaattactg

SEQ ID NO: 764790 - DNA, 22 bp, Artificial Sequence
  chemically synthesized
gtagacaaagagatgaattact

SEQ ID NO: 764791 - DNA, 22 bp, Artificial Sequence
  chemically synthesized
ttgtagacaaagagatgaatta

SEQ ID NO: 764792 - DNA, 22 bp, Artificial Sequence
  chemically synthesized
tgccatcagtaattcatctctt

SEQ ID NO: 764793 - DNA, 22 bp, Artificial Sequence
  chemically synthesized
ccatcagtaattcatctctttg

SEQ ID NO: 764794 - DNA, 22 bp, Artificial Sequence
  chemically synthesized
atctctttgtctacaagagcca

SEQ ID NO: 764795 - DNA, 22 bp, Artificial Sequence
  chemically synthesized
atagtagtccacatggctcttg

SEQ ID NO: 764796 - DNA, 22 bp, Artificial Sequence
  chemically synthesized
tttgtctacaagagccatgtgg

SEQ ID NO: 764797 - DNA, 22 bp, Artificial Sequence
  chemically synthesized
tgtctacaagagccatgtggac

SEQ ID NO: 764798 - DNA, 22 bp, Artificial Sequence
  chemically synthesized
gtctacaagagccatgtggact

SEQ ID NO: 764799 - DNA, 22 bp, Artificial Sequence
  chemically synthesized
tctacaagagccatgtggacta

SEQ ID NO: 764800 - DNA, 22 bp, Artificial Sequence
  chemically synthesized
gtatggttcatagtagtccaca

SEQ ID NO: 764801 - DNA, 22 bp, Artificial Sequence
  chemically synthesized
ggtatggttcatagtagtccac

SEQ ID NO: 764802 - DNA, 22 bp, Artificial Sequence
  chemically synthesized
caagagccatgtggactactat

SEQ ID NO: 764803 - DNA, 22 bp, Artificial Sequence
  chemically synthesized
ttggtatggttcatagtagtcc

SEQ ID NO: 764804 - DNA, 22 bp, Artificial Sequence
  chemically synthesized
cttggtatggttcatagtagtc

SEQ ID NO: 764805 - DNA, 22 bp, Artificial Sequence
  chemically synthesized
atgtgtcaagtcatttcttggt

SEQ ID NO: 764806 - DNA, 22 bp, Artificial Sequence
  chemically synthesized
ctatgaaccataccaagaaatg

SEQ ID NO: 764807 - DNA, 22 bp, Artificial Sequence
  chemically synthesized
tgaaccataccaagaaatgact

SEQ ID NO: 764808 - DNA, 22 bp, Artificial Sequence
  chemically synthesized
tgctgatgtgtcaagtcatttc

SEQ ID NO: 764809 - DNA, 22 bp, Artificial Sequence
  chemically synthesized
atgctgatgtgtcaagtcattt

SEQ ID NO: 764810 - DNA, 22 bp, Artificial Sequence
  chemically synthesized
tgtttatgctgatgtgtcaagt

SEQ ID NO: 764811 - DNA, 22 bp, Artificial Sequence
  chemically synthesized
gacacatcagcataaacatagt

SEQ ID NO: 764812 - DNA, 22 bp, Artificial Sequence
  chemically synthesized
acacatcagcataaacatagtt

SEQ ID NO: 764813 - DNA, 22 bp, Artificial Sequence
  chemically synthesized
ccatcccaaaggaacatggatg

SEQ ID NO: 764814 - DNA, 22 bp, Artificial Sequence
  chemically synthesized
ccagcctgccatcccaaaggaa

SEQ ID NO: 764815 - DNA, 22 bp, Artificial Sequence
  chemically synthesized
ctaccagcctgccatcccaaag

SEQ ID NO: 764816 - DNA, 22 bp, Artificial Sequence
  chemically synthesized
cctaccagcctgccatcccaaa

SEQ ID NO: 764817 - DNA, 22 bp, Artificial Sequence
  chemically synthesized
atccatgttcctttgggatggc

SEQ ID NO: 764818 - DNA, 22 bp, Artificial Sequence
  chemically synthesized
aaagatttcctaccagcctgcc

SEQ ID NO: 764819 - DNA, 22 bp, Artificial Sequence
  chemically synthesized
gaaagatttcctaccagcctgc

SEQ ID NO: 764820 - DNA, 22 bp, Artificial Sequence
  chemically synthesized
ctttgggatggcaggctggtag

SEQ ID NO: 764821 - DNA, 22 bp, Artificial Sequence
  chemically synthesized
tgggatggcaggctggtaggaa

SEQ ID NO: 764822 - DNA, 22 bp, Artificial Sequence
  chemically synthesized
gggatggcaggctggtaggaaa

SEQ ID NO: 764823 - DNA, 22 bp, Artificial Sequence
  chemically synthesized
tagcttgaaagatttcctacca

SEQ ID NO: 764824 - DNA, 22 bp, Artificial Sequence
  chemically synthesized
ggatggcaggctggtaggaaat

SEQ ID NO: 764825 - DNA, 22 bp, Artificial Sequence
  chemically synthesized
agtcctgtagcttgaaagattt

SEQ ID NO: 764826 - DNA, 22 bp, Artificial Sequence
  chemically synthesized
tctgagtcctgtagcttgaaag

SEQ ID NO: 764827 - DNA, 22 bp, Artificial Sequence
  chemically synthesized
gtaggaaatctttcaagctaca

SEQ ID NO: 764828 - DNA, 22 bp, Artificial Sequence
  chemically synthesized
gggcaacctatctgagtcctgt

SEQ ID NO: 764829 - DNA, 22 bp, Artificial Sequence
  chemically synthesized
agggcaacctatctgagtcctg

SEQ ID NO: 764830 - DNA, 22 bp, Artificial Sequence
  chemically synthesized
tagggcaacctatctgagtcct

SEQ ID NO: 764831 - DNA, 22 bp, Artificial Sequence
  chemically synthesized
ttagggcaacctatctgagtcc

SEQ ID NO: 764832 - DNA, 22 bp, Artificial Sequence
  chemically synthesized
tcaagctacaggactcagatag

SEQ ID NO: 764833 - DNA, 22 bp, Artificial Sequence
  chemically synthesized
caagctacaggactcagatagg

SEQ ID NO: 764834 - DNA, 22 bp, Artificial Sequence
  chemically synthesized
cttttagggcaacctatctgag

SEQ ID NO: 764835 - DNA, 22 bp, Artificial Sequence
  chemically synthesized
aagctacaggactcagataggt

SEQ ID NO: 764836 - DNA, 22 bp, Artificial Sequence
  chemically synthesized
ccttttagggcaacctatctga

SEQ ID NO: 764837 - DNA, 22 bp, Artificial Sequence
  chemically synthesized
ccttccttttagggcaacctat

SEQ ID NO: 764838 - DNA, 22 bp, Artificial Sequence
  chemically synthesized
accttccttttagggcaaccta

SEQ ID NO: 764839 - DNA, 22 bp, Artificial Sequence
  chemically synthesized
caggactcagataggttgccct

SEQ ID NO: 764840 - DNA, 22 bp, Artificial Sequence
  chemically synthesized
agataggttgccctaaaaggaa

SEQ ID NO: 764841 - DNA, 22 bp, Artificial Sequence
  chemically synthesized
ccaatacttaccttccttttag

SEQ ID NO: 764842 - DNA, 22 bp, Artificial Sequence
  chemically synthesized
cccaatacttaccttcctttta

SEQ ID NO: 764843 - DNA, 22 bp, Artificial Sequence
  chemically synthesized
tcccaatacttaccttcctttt

SEQ ID NO: 764844 - DNA, 22 bp, Artificial Sequence
  chemically synthesized
tttcccaatacttaccttcctt

SEQ ID NO: 764845 - DNA, 22 bp, Artificial Sequence
  chemically synthesized
ggttctttcccaatacttacct

SEQ ID NO: 764846 - DNA, 22 bp, Artificial Sequence
  chemically synthesized
ccctaaaaggaaggtaagtatt

SEQ ID NO: 764847 - DNA, 22 bp, Artificial Sequence
  chemically synthesized
gggttctttcccaatacttacc

SEQ ID NO: 764848 - DNA, 22 bp, Artificial Sequence
  chemically synthesized
aaaggaaggtaagtattgggaa

SEQ ID NO: 764849 - DNA, 22 bp, Artificial Sequence
  chemically synthesized
aaagagagccttgggttctttc

SEQ ID NO: 764850 - DNA, 22 bp, Artificial Sequence
  chemically synthesized
gaaagagagccttgggttcttt

SEQ ID NO: 764851 - DNA, 22 bp, Artificial Sequence
  chemically synthesized
tgaaagagagccttgggttctt

SEQ ID NO: 764852 - DNA, 22 bp, Artificial Sequence
  chemically synthesized
ttgaaagagagccttgggttct

SEQ ID NO: 764853 - DNA, 22 bp, Artificial Sequence
  chemically synthesized
ggaaagaacccaaggctctctt

SEQ ID NO: 764854 - DNA, 22 bp, Artificial Sequence
  chemically synthesized
cagcatgccagcttttgaaaga

SEQ ID NO: 764855 - DNA, 22 bp, Artificial Sequence
  chemically synthesized
cactacagcatgccagcttttg

SEQ ID NO: 764856 - DNA, 22 bp, Artificial Sequence
  chemically synthesized
tctttcaaaagctggcatgctg

SEQ ID NO: 764857 - DNA, 22 bp, Artificial Sequence
  chemically synthesized
tttcaaaagctggcatgctgta

SEQ ID NO: 764858 - DNA, 22 bp, Artificial Sequence
  chemically synthesized
aaaaatctccactacagcatgc

SEQ ID NO: 764859 - DNA, 22 bp, Artificial Sequence
  chemically synthesized
tcaaaagctggcatgctgtagt

SEQ ID NO: 764860 - DNA, 22 bp, Artificial Sequence
  chemically synthesized
caaaagctggcatgctgtagtg

SEQ ID NO: 764861 - DNA, 22 bp, Artificial Sequence
  chemically synthesized
aaaagctggcatgctgtagtgg

SEQ ID NO: 764862 - DNA, 22 bp, Artificial Sequence
  chemically synthesized
atactgaaaaatctccactaca

SEQ ID NO: 764863 - DNA, 22 bp, Artificial Sequence
  chemically synthesized
ttgatactgaaaaatctccact

SEQ ID NO: 764864 - DNA, 22 bp, Artificial Sequence
  chemically synthesized
attgatactgaaaaatctccac

SEQ ID NO: 764865 - DNA, 22 bp, Artificial Sequence
  chemically synthesized
gcatgctgtagtggagattttt

SEQ ID NO: 764866 - DNA, 22 bp, Artificial Sequence
  chemically synthesized
ccttattgatactgaaaaatct

SEQ ID NO: 764867 - DNA, 22 bp, Artificial Sequence
  chemically synthesized
tagtggagatttttcagtatca

SEQ ID NO: 764868 - DNA, 22 bp, Artificial Sequence
  chemically synthesized
atgctgccttattgatactgaa

SEQ ID NO: 764869 - DNA, 22 bp, Artificial Sequence
  chemically synthesized
tgactcatgctgccttattgat

SEQ ID NO: 764870 - DNA, 22 bp, Artificial Sequence
  chemically synthesized
ttcagtatcaataaggcagcat

SEQ ID NO: 764871 - DNA, 22 bp, Artificial Sequence
  chemically synthesized
tcagtatcaataaggcagcatg

SEQ ID NO: 764872 - DNA, 22 bp, Artificial Sequence
  chemically synthesized
cagtatcaataaggcagcatga

SEQ ID NO: 764873 - DNA, 22 bp, Artificial Sequence
  chemically synthesized
ccaatctatgactcatgctgcc

SEQ ID NO: 764874 - DNA, 22 bp, Artificial Sequence
  chemically synthesized
agtatcaataaggcagcatgag

SEQ ID NO: 764875 - DNA, 22 bp, Artificial Sequence
  chemically synthesized
cattcccaatctatgactcatg

SEQ ID NO: 764876 - DNA, 22 bp, Artificial Sequence
  chemically synthesized
ccctgcattcccaatctatgac

SEQ ID NO: 764877 - DNA, 22 bp, Artificial Sequence
  chemically synthesized
cagcctgccctgcattcccaat

SEQ ID NO: 764878 - DNA, 22 bp, Artificial Sequence
  chemically synthesized
gcagcctgccctgcattcccaa

SEQ ID NO: 764879 - DNA, 22 bp, Artificial Sequence
  chemically synthesized
cttgcagcctgccctgcattcc

SEQ ID NO: 764880 - DNA, 22 bp, Artificial Sequence
  chemically synthesized
ggaatgcagggcaggctgcaag

SEQ ID NO: 764881 - DNA, 22 bp, Artificial Sequence
  chemically synthesized
tgtataatgtatattccttgca

SEQ ID NO: 764882 - DNA, 22 bp, Artificial Sequence
  chemically synthesized
tattatgtataatgtatattcc

SEQ ID NO: 764883 - DNA, 22 bp, Artificial Sequence
  chemically synthesized
tattatattatgtataatgtat

SEQ ID NO: 764884 - DNA, 22 bp, Artificial Sequence
  chemically synthesized
caaggaatatacattatacata

SEQ ID NO: 764885 - DNA, 22 bp, Artificial Sequence
  chemically synthesized
tattatattatattatgtataa

SEQ ID NO: 764886 - DNA, 22 bp, Artificial Sequence
  chemically synthesized
tattatattatattatattatg

SEQ ID NO: 764887 - DNA, 22 bp, Artificial Sequence
  chemically synthesized
tgttatattatattatattata

SEQ ID NO: 764888 - DNA, 22 bp, Artificial Sequence
  chemically synthesized
tacataatataatataatataa

SEQ ID NO: 764889 - DNA, 22 bp, Artificial Sequence
  chemically synthesized
tgttatgttatattatattata

SEQ ID NO: 764890 - DNA, 22 bp, Artificial Sequence
  chemically synthesized
tattatgttatgttatattata

SEQ ID NO: 764891 - DNA, 22 bp, Artificial Sequence
  chemically synthesized
tggtagtattatattatgttat

SEQ ID NO: 764892 - DNA, 22 bp, Artificial Sequence
  chemically synthesized
gacaaatatcattatggtagta

SEQ ID NO: 764893 - DNA, 22 bp, Artificial Sequence
  chemically synthesized
agacaaatatcattatggtagt

SEQ ID NO: 764894 - DNA, 22 bp, Artificial Sequence
  chemically synthesized
ccataatgatatttgtctaaac

SEQ ID NO: 764895 - DNA, 22 bp, Artificial Sequence
  chemically synthesized
gtctaaactcatcattttttat

SEQ ID NO: 764896 - DNA, 22 bp, Artificial Sequence
  chemically synthesized
tctaaactcatcattttttatt

SEQ ID NO: 764897 - DNA, 22 bp, Artificial Sequence
  chemically synthesized
aactcatcattttttatttatt

SEQ ID NO: 764898 - DNA, 22 bp, Artificial Sequence
  chemically synthesized
atcattttttatttatttattt

SEQ ID NO: 764899 - DNA, 22 bp, Artificial Sequence
  chemically synthesized
tttatttatttatttatttatt

SEQ ID NO: 764900 - DNA, 22 bp, Artificial Sequence
  chemically synthesized
ttatttatttatttatttattt

SEQ ID NO: 764901 - DNA, 22 bp, Artificial Sequence
  chemically synthesized
tatttatttatttatttattta

SEQ ID NO: 764902 - DNA, 22 bp, Artificial Sequence
  chemically synthesized
atttatttatttatttatttat

SEQ ID NO: 764903 - DNA, 22 bp, Artificial Sequence
  chemically synthesized
tttatttatttatttatttatt

SEQ ID NO: 764904 - DNA, 22 bp, Artificial Sequence
  chemically synthesized
atttatttatttatttattatt

SEQ ID NO: 764905 - DNA, 22 bp, Artificial Sequence
  chemically synthesized
aagtataataataataataaat

SEQ ID NO: 764906 - DNA, 22 bp, Artificial Sequence
  chemically synthesized
tttatttatttatttattatta

SEQ ID NO: 764907 - DNA, 22 bp, Artificial Sequence
  chemically synthesized
aaagtataataataataataaa

SEQ ID NO: 764908 - DNA, 22 bp, Artificial Sequence
  chemically synthesized
atttatttatttattattatta

SEQ ID NO: 764909 - DNA, 22 bp, Artificial Sequence
  chemically synthesized
tttatttatttattattattat

SEQ ID NO: 764910 - DNA, 22 bp, Artificial Sequence
  chemically synthesized
aaatttaaagtataataataat

SEQ ID NO: 764911 - DNA, 22 bp, Artificial Sequence
  chemically synthesized
atttatttattattattattat

SEQ ID NO: 764912 - DNA, 22 bp, Artificial Sequence
  chemically synthesized
tttatttattattattattata

SEQ ID NO: 764913 - DNA, 22 bp, Artificial Sequence
  chemically synthesized
atttattattattattatactt

SEQ ID NO: 764914 - DNA, 22 bp, Artificial Sequence
  chemically synthesized
tttattattattattatacttt

SEQ ID NO: 764915 - DNA, 22 bp, Artificial Sequence
  chemically synthesized
attattattattatactttaaa

SEQ ID NO: 764916 - DNA, 22 bp, Artificial Sequence
  chemically synthesized
ttattattattatactttaaat

SEQ ID NO: 764917 - DNA, 22 bp, Artificial Sequence
  chemically synthesized
ttattattatactttaaatttt

SEQ ID NO: 764918 - DNA, 22 bp, Artificial Sequence
  chemically synthesized
tgcacatgtaccctaaaattta

SEQ ID NO: 764919 - DNA, 22 bp, Artificial Sequence
  chemically synthesized
ttattatactttaaattttagg

SEQ ID NO: 764920 - DNA, 22 bp, Artificial Sequence
  chemically synthesized
ttatactttaaattttagggta

SEQ ID NO: 764921 - DNA, 22 bp, Artificial Sequence
  chemically synthesized
tactttaaattttagggtacat

SEQ ID NO: 764922 - DNA, 22 bp, Artificial Sequence
  chemically synthesized
cacgttgtgcacatgtacccta

SEQ ID NO: 764923 - DNA, 22 bp, Artificial Sequence
  chemically synthesized
taaattttagggtacatgtgca

SEQ ID NO: 764924 - DNA, 22 bp, Artificial Sequence
  chemically synthesized
acctgcacgttgtgcacatgta

SEQ ID NO: 764925 - DNA, 22 bp, Artificial Sequence
  chemically synthesized
aaattttagggtacatgtgcac

SEQ ID NO: 764926 - DNA, 22 bp, Artificial Sequence
  chemically synthesized
aattttagggtacatgtgcaca

SEQ ID NO: 764927 - DNA, 22 bp, Artificial Sequence
  chemically synthesized
tagggtacatgtgcacaacgtg

SEQ ID NO: 764928 - DNA, 22 bp, Artificial Sequence
  chemically synthesized
agggtacatgtgcacaacgtgc

SEQ ID NO: 764929 - DNA, 22 bp, Artificial Sequence
  chemically synthesized
gggtacatgtgcacaacgtgca

SEQ ID NO: 764930 - DNA, 22 bp, Artificial Sequence
  chemically synthesized
gttacatatgtatacatgtgcc

SEQ ID NO: 764931 - DNA, 22 bp, Artificial Sequence
  chemically synthesized
catatgtatacatgtgccatgc

SEQ ID NO: 764932 - DNA, 22 bp, Artificial Sequence
  chemically synthesized
gtgggtgcagcgcaccagcatg

SEQ ID NO: 764933 - DNA, 22 bp, Artificial Sequence
  chemically synthesized
gatgatgagttagtgggtgcag

SEQ ID NO: 764934 - DNA, 22 bp, Artificial Sequence
  chemically synthesized
atgctagatgatgagttagtgg

SEQ ID NO: 764935 - DNA, 22 bp, Artificial Sequence
  chemically synthesized
gtgcgctgcacccactaactca

SEQ ID NO: 764936 - DNA, 22 bp, Artificial Sequence
  chemically synthesized
cacccactaactcatcatctag

SEQ ID NO: 764937 - DNA, 22 bp, Artificial Sequence
  chemically synthesized
ggagatatacctaatgctagat

SEQ ID NO: 764938 - DNA, 22 bp, Artificial Sequence
  chemically synthesized
actcatcatctagcattaggta

SEQ ID NO: 764939 - DNA, 22 bp, Artificial Sequence
  chemically synthesized
atcatctagcattaggtatatc

SEQ ID NO: 764940 - DNA, 22 bp, Artificial Sequence
  chemically synthesized
gcattaggtatatctcccaatg

SEQ ID NO: 764941 - DNA, 22 bp, Artificial Sequence
  chemically synthesized
ggtatatctcccaatgctatcc

SEQ ID NO: 764942 - DNA, 22 bp, Artificial Sequence
  chemically synthesized
tggggtggggggaggggggagg

SEQ ID NO: 764943 - DNA, 22 bp, Artificial Sequence
  chemically synthesized
ccaatgctatccctcccccctc

SEQ ID NO: 764944 - DNA, 22 bp, Artificial Sequence
  chemically synthesized
ttgtggggtggggggagggggg

SEQ ID NO: 764945 - DNA, 22 bp, Artificial Sequence
  chemically synthesized
tccctcccccctccccccaccc

SEQ ID NO: 764946 - DNA, 22 bp, Artificial Sequence
  chemically synthesized
gggactgttgtggggtgggggg

SEQ ID NO: 764947 - DNA, 22 bp, Artificial Sequence
  chemically synthesized
tggggactgttgtggggtgggg

SEQ ID NO: 764948 - DNA, 22 bp, Artificial Sequence
  chemically synthesized
ccccctccccccaccccacaac

SEQ ID NO: 764949 - DNA, 22 bp, Artificial Sequence
  chemically synthesized
cccccaccccacaacagtcccc

SEQ ID NO: 764950 - DNA, 22 bp, Artificial Sequence
  chemically synthesized
aacaatgagaacacatggacac

SEQ ID NO: 764951 - DNA, 22 bp, Artificial Sequence
  chemically synthesized
cccttcctgtgtccatgtgttc

SEQ ID NO: 764952 - DNA, 22 bp, Artificial Sequence
  chemically synthesized
cctgtgtccatgtgttctcatt

SEQ ID NO: 764953 - DNA, 22 bp, Artificial Sequence
  chemically synthesized
ctgtgtccatgtgttctcattg

SEQ ID NO: 764954 - DNA, 22 bp, Artificial Sequence
  chemically synthesized
tgtccatgtgttctcattgttc

SEQ ID NO: 764955 - DNA, 22 bp, Artificial Sequence
  chemically synthesized
ataggtgggaattgaacaatga

SEQ ID NO: 764956 - DNA, 22 bp, Artificial Sequence
  chemically synthesized
actcataggtgggaattgaaca

SEQ ID NO: 764957 - DNA, 22 bp, Artificial Sequence
  chemically synthesized
tcactcataggtgggaattgaa

SEQ ID NO: 764958 - DNA, 22 bp, Artificial Sequence
  chemically synthesized
tcattgttcaattcccacctat

SEQ ID NO: 764959 - DNA, 22 bp, Artificial Sequence
  chemically synthesized
attgttcaattcccacctatga

SEQ ID NO: 764960 - DNA, 22 bp, Artificial Sequence
  chemically synthesized
ttcaattcccacctatgagtga

SEQ ID NO: 764961 - DNA, 22 bp, Artificial Sequence
  chemically synthesized
aattcccacctatgagtgagaa

SEQ ID NO: 764962 - DNA, 22 bp, Artificial Sequence
  chemically synthesized
ccacctatgagtgagaatatgc

SEQ ID NO: 764963 - DNA, 22 bp, Artificial Sequence
  chemically synthesized
tgagtgagaatatgcggtgttt

SEQ ID NO: 764964 - DNA, 22 bp, Artificial Sequence
  chemically synthesized
tcacaagaacagaacaccaaac

SEQ ID NO: 764965 - DNA, 22 bp, Artificial Sequence
  chemically synthesized
agtaaactatcacaagaacaga

SEQ ID NO: 764966 - DNA, 22 bp, Artificial Sequence
  chemically synthesized
tcagtaaactatcacaagaaca

SEQ ID NO: 764967 - DNA, 22 bp, Artificial Sequence
  chemically synthesized
ttctcagtaaactatcacaaga

SEQ ID NO: 764968 - DNA, 22 bp, Artificial Sequence
  chemically synthesized
ggtgttctgttcttgtgatagt

SEQ ID NO: 764969 - DNA, 22 bp, Artificial Sequence
  chemically synthesized
gtgttctgttcttgtgatagtt

SEQ ID NO: 764970 - DNA, 22 bp, Artificial Sequence
  chemically synthesized
tgttcttgtgatagtttactga

SEQ ID NO: 764971 - DNA, 22 bp, Artificial Sequence
  chemically synthesized
gaaatcattattctcagtaaac

SEQ ID NO: 764972 - DNA, 22 bp, Artificial Sequence
  chemically synthesized
ttcttgtgatagtttactgaga

SEQ ID NO: 764973 - DNA, 22 bp, Artificial Sequence
  chemically synthesized
ttgtgatagtttactgagaata

SEQ ID NO: 764974 - DNA, 22 bp, Artificial Sequence
  chemically synthesized
gtgatagtttactgagaataat

SEQ ID NO: 764975 - DNA, 22 bp, Artificial Sequence
  chemically synthesized
tgatagtttactgagaataatg

SEQ ID NO: 764976 - DNA, 22 bp, Artificial Sequence
  chemically synthesized
actgagaataatgatttccaat

SEQ ID NO: 764977 - DNA, 22 bp, Artificial Sequence
  chemically synthesized
ctgagaataatgatttccaatt

SEQ ID NO: 764978 - DNA, 22 bp, Artificial Sequence
  chemically synthesized
agaataatgatttccaatttca

SEQ ID NO: 764979 - DNA, 22 bp, Artificial Sequence
  chemically synthesized
tagggacatggatgaaattgga

SEQ ID NO: 764980 - DNA, 22 bp, Artificial Sequence
  chemically synthesized
gtagggacatggatgaaattgg

SEQ ID NO: 764981 - DNA, 22 bp, Artificial Sequence
  chemically synthesized
tgtagggacatggatgaaattg

SEQ ID NO: 764982 - DNA, 22 bp, Artificial Sequence
  chemically synthesized
acatcctttgtagggacatgga

SEQ ID NO: 764983 - DNA, 22 bp, Artificial Sequence
  chemically synthesized
ccaatttcatccatgtccctac

SEQ ID NO: 764984 - DNA, 22 bp, Artificial Sequence
  chemically synthesized
caatttcatccatgtccctaca

SEQ ID NO: 764985 - DNA, 22 bp, Artificial Sequence
  chemically synthesized
catccatgtccctacaaaggat

SEQ ID NO: 764986 - DNA, 22 bp, Artificial Sequence
  chemically synthesized
atccatgtccctacaaaggatg

SEQ ID NO: 764987 - DNA, 22 bp, Artificial Sequence
  chemically synthesized
caaaggatgtgaactcatcctt

SEQ ID NO: 764988 - DNA, 22 bp, Artificial Sequence
  chemically synthesized
tgcagccataaaaaaaggatga

SEQ ID NO: 764989 - DNA, 22 bp, Artificial Sequence
  chemically synthesized
atcctttttttatggctgcata

SEQ ID NO: 764990 - DNA, 22 bp, Artificial Sequence
  chemically synthesized
tttttatggctgcatagtattc

SEQ ID NO: 764991 - DNA, 22 bp, Artificial Sequence
  chemically synthesized
ttttatggctgcatagtattcc

SEQ ID NO: 764992 - DNA, 22 bp, Artificial Sequence
  chemically synthesized
tttatggctgcatagtattcca

SEQ ID NO: 764993 - DNA, 22 bp, Artificial Sequence
  chemically synthesized
ttatggctgcatagtattccat

SEQ ID NO: 764994 - DNA, 22 bp, Artificial Sequence
  chemically synthesized
tatggctgcatagtattccatg

SEQ ID NO: 764995 - DNA, 22 bp, Artificial Sequence
  chemically synthesized
atggctgcatagtattccatgg

SEQ ID NO: 764996 - DNA, 22 bp, Artificial Sequence
  chemically synthesized
tggctgcatagtattccatggt

SEQ ID NO: 764997 - DNA, 22 bp, Artificial Sequence
  chemically synthesized
catagtattccatggtgtatat

SEQ ID NO: 764998 - DNA, 22 bp, Artificial Sequence
  chemically synthesized
agaaaatgtggcacatatacac

SEQ ID NO: 764999 - DNA, 22 bp, Artificial Sequence
  chemically synthesized
gattaagaaaatgtggcacata

SEQ ID NO: 765000 - DNA, 22 bp, Artificial Sequence
  chemically synthesized
catggtgtatatgtgccacatt

SEQ ID NO: 765001 - DNA, 22 bp, Artificial Sequence
  chemically synthesized
tcttaatccagtctatcactgt

SEQ ID NO: 765002 - DNA, 22 bp, Artificial Sequence
  chemically synthesized
cttaatccagtctatcactgtt

SEQ ID NO: 765003 - DNA, 22 bp, Artificial Sequence
  chemically synthesized
ttaatccagtctatcactgttg

SEQ ID NO: 765004 - DNA, 22 bp, Artificial Sequence
  chemically synthesized
aatccagtctatcactgttgga

SEQ ID NO: 765005 - DNA, 22 bp, Artificial Sequence
  chemically synthesized
atccagtctatcactgttggac

SEQ ID NO: 765006 - DNA, 22 bp, Artificial Sequence
  chemically synthesized
gaaccaacccaaatgtccaaca

SEQ ID NO: 765007 - DNA, 22 bp, Artificial Sequence
  chemically synthesized
ggaaccaacccaaatgtccaac

SEQ ID NO: 765008 - DNA, 22 bp, Artificial Sequence
  chemically synthesized
tcactgttggacatttgggttg

SEQ ID NO: 765009 - DNA, 22 bp, Artificial Sequence
  chemically synthesized
ttggacatttgggttggttcca

SEQ ID NO: 765010 - DNA, 22 bp, Artificial Sequence
  chemically synthesized
gacatttgggttggttccaagt

SEQ ID NO: 765011 - DNA, 22 bp, Artificial Sequence
  chemically synthesized
acaatagcaaagacttggaacc

SEQ ID NO: 765012 - DNA, 22 bp, Artificial Sequence
  chemically synthesized
ttcacaatagcaaagacttgga

SEQ ID NO: 765013 - DNA, 22 bp, Artificial Sequence
  chemically synthesized
gggttggttccaagtctttgct

SEQ ID NO: 765014 - DNA, 22 bp, Artificial Sequence
  chemically synthesized
ggttggttccaagtctttgcta

SEQ ID NO: 765015 - DNA, 22 bp, Artificial Sequence
  chemically synthesized
cggcactattcacaatagcaaa

SEQ ID NO: 765016 - DNA, 22 bp, Artificial Sequence
  chemically synthesized
gttccaagtctttgctattgtg

SEQ ID NO: 765017 - DNA, 22 bp, Artificial Sequence
  chemically synthesized
ttgcggcactattcacaatagc

SEQ ID NO: 765018 - DNA, 22 bp, Artificial Sequence
  chemically synthesized
attgcggcactattcacaatag

SEQ ID NO: 765019 - DNA, 22 bp, Artificial Sequence
  chemically synthesized
caagtctttgctattgtgaata

SEQ ID NO: 765020 - DNA, 22 bp, Artificial Sequence
  chemically synthesized
tgctattgtgaatagtgccgca

SEQ ID NO: 765021 - DNA, 22 bp, Artificial Sequence
  chemically synthesized
gctattgtgaatagtgccgcaa

SEQ ID NO: 765022 - DNA, 22 bp, Artificial Sequence
  chemically synthesized
ctattgtgaatagtgccgcaat

SEQ ID NO: 765023 - DNA, 22 bp, Artificial Sequence
  chemically synthesized
ttgtgaatagtgccgcaataaa

SEQ ID NO: 765024 - DNA, 22 bp, Artificial Sequence
  chemically synthesized
tgaatagtgccgcaataaacat

SEQ ID NO: 765025 - DNA, 22 bp, Artificial Sequence
  chemically synthesized
taaagacacatgcacacgtatg

SEQ ID NO: 765026 - DNA, 22 bp, Artificial Sequence
  chemically synthesized
ctataaagacacatgcacacgt

SEQ ID NO: 765027 - DNA, 22 bp, Artificial Sequence
  chemically synthesized
taaatcatgctgctataaagac

SEQ ID NO: 765028 - DNA, 22 bp, Artificial Sequence
  chemically synthesized
tatagcagcatgatttatagtc

SEQ ID NO: 765029 - DNA, 22 bp, Artificial Sequence
  chemically synthesized
atagcagcatgatttatagtcc

SEQ ID NO: 765030 - DNA, 22 bp, Artificial Sequence
  chemically synthesized
tagcagcatgatttatagtcct

SEQ ID NO: 765031 - DNA, 22 bp, Artificial Sequence
  chemically synthesized
ggtatatacccaaaggactata

SEQ ID NO: 765032 - DNA, 22 bp, Artificial Sequence
  chemically synthesized
ctgggtatatacccaaaggact

SEQ ID NO: 765033 - DNA, 22 bp, Artificial Sequence
  chemically synthesized
atagtcctttgggtatataccc

SEQ ID NO: 765034 - DNA, 22 bp, Artificial Sequence
  chemically synthesized
tagtcctttgggtatataccca

SEQ ID NO: 765035 - DNA, 22 bp, Artificial Sequence
  chemically synthesized
acccagccatcccattactggg

SEQ ID NO: 765036 - DNA, 22 bp, Artificial Sequence
  chemically synthesized
gacccagccatcccattactgg

SEQ ID NO: 765037 - DNA, 22 bp, Artificial Sequence
  chemically synthesized
tgggtatatacccagtaatggg

SEQ ID NO: 765038 - DNA, 22 bp, Artificial Sequence
  chemically synthesized
gggtatatacccagtaatggga

SEQ ID NO: 765039 - DNA, 22 bp, Artificial Sequence
  chemically synthesized
ggtatatacccagtaatgggat

SEQ ID NO: 765040 - DNA, 22 bp, Artificial Sequence
  chemically synthesized
gaaataccatttgacccagcca

SEQ ID NO: 765041 - DNA, 22 bp, Artificial Sequence
  chemically synthesized
gaactagaaataccatttgacc

SEQ ID NO: 765042 - DNA, 22 bp, Artificial Sequence
  chemically synthesized
agggatctagaactagaaatac

SEQ ID NO: 765043 - DNA, 22 bp, Artificial Sequence
  chemically synthesized
ggtcaaatggtatttctagttc

SEQ ID NO: 765044 - DNA, 22 bp, Artificial Sequence
  chemically synthesized
ctcagggatctagaactagaaa

SEQ ID NO: 765045 - DNA, 22 bp, Artificial Sequence
  chemically synthesized
ctagttctagatccctgaggaa

SEQ ID NO: 765046 - DNA, 22 bp, Artificial Sequence
  chemically synthesized
tagttctagatccctgaggaat

SEQ ID NO: 765047 - DNA, 22 bp, Artificial Sequence
  chemically synthesized
gttctagatccctgaggaatcg

SEQ ID NO: 765048 - DNA, 22 bp, Artificial Sequence
  chemically synthesized
tggaagtcagtgtggcgattcc

SEQ ID NO: 765049 - DNA, 22 bp, Artificial Sequence
  chemically synthesized
tagatccctgaggaatcgccac

SEQ ID NO: 765050 - DNA, 22 bp, Artificial Sequence
  chemically synthesized
gatccctgaggaatcgccacac

SEQ ID NO: 765051 - DNA, 22 bp, Artificial Sequence
  chemically synthesized
aaccattgtggaagtcagtgtg

SEQ ID NO: 765052 - DNA, 22 bp, Artificial Sequence
  chemically synthesized
aggaatcgccacactgacttcc

SEQ ID NO: 765053 - DNA, 22 bp, Artificial Sequence
  chemically synthesized
gttcaaccattgtggaagtcag

SEQ ID NO: 765054 - DNA, 22 bp, Artificial Sequence
  chemically synthesized
taaactagttcaaccattgtgg

SEQ ID NO: 765055 - DNA, 22 bp, Artificial Sequence
  chemically synthesized
acttccacaatggttgaactag

SEQ ID NO: 765056 - DNA, 22 bp, Artificial Sequence
  chemically synthesized
gtgggactgtaaactagttcaa

SEQ ID NO: 765057 - DNA, 22 bp, Artificial Sequence
  chemically synthesized
ccacaatggttgaactagttta

SEQ ID NO: 765058 - DNA, 22 bp, Artificial Sequence
  chemically synthesized
ttggtgggactgtaaactagtt

SEQ ID NO: 765059 - DNA, 22 bp, Artificial Sequence
  chemically synthesized
cacaatggttgaactagtttac

SEQ ID NO: 765060 - DNA, 22 bp, Artificial Sequence
  chemically synthesized
cactgttggtgggactgtaaac

SEQ ID NO: 765061 - DNA, 22 bp, Artificial Sequence
  chemically synthesized
tacactgttggtgggactgtaa

SEQ ID NO: 765062 - DNA, 22 bp, Artificial Sequence
  chemically synthesized
ctacactgttggtgggactgta

SEQ ID NO: 765063 - DNA, 22 bp, Artificial Sequence
  chemically synthesized
aactagtttacagtcccaccaa

SEQ ID NO: 765064 - DNA, 22 bp, Artificial Sequence
  chemically synthesized
gtttacagtcccaccaacagtg

SEQ ID NO: 765065 - DNA, 22 bp, Artificial Sequence
  chemically synthesized
acagtcccaccaacagtgtaga

SEQ ID NO: 765066 - DNA, 22 bp, Artificial Sequence
  chemically synthesized
cagtcccaccaacagtgtagaa

SEQ ID NO: 765067 - DNA, 22 bp, Artificial Sequence
  chemically synthesized
gagaggatgtggagaaatagga

SEQ ID NO: 765068 - DNA, 22 bp, Artificial Sequence
  chemically synthesized
ctatttctccacatcctctcca

SEQ ID NO: 765069 - DNA, 22 bp, Artificial Sequence
  chemically synthesized
tttctccacatcctctccagca

SEQ ID NO: 765070 - DNA, 22 bp, Artificial Sequence
  chemically synthesized
ctccacatcctctccagcacct

SEQ ID NO: 765071 - DNA, 22 bp, Artificial Sequence
  chemically synthesized
tccacatcctctccagcacctg

SEQ ID NO: 765072 - DNA, 22 bp, Artificial Sequence
  chemically synthesized
cacatcctctccagcacctgtt

SEQ ID NO: 765073 - DNA, 22 bp, Artificial Sequence
  chemically synthesized
aaagtcaggaaacaacaggtgc

SEQ ID NO: 765074 - DNA, 22 bp, Artificial Sequence
  chemically synthesized
aaaagtcaggaaacaacaggtg

SEQ ID NO: 765075 - DNA, 22 bp, Artificial Sequence
  chemically synthesized
tccagcacctgttgtttcctga

SEQ ID NO: 765076 - DNA, 22 bp, Artificial Sequence
  chemically synthesized
cagcacctgttgtttcctgact

SEQ ID NO: 765077 - DNA, 22 bp, Artificial Sequence
  chemically synthesized
gaatggcaatcatttaaaagtc

SEQ ID NO: 765078 - DNA, 22 bp, Artificial Sequence
  chemically synthesized
ttgtttcctgacttttaaatga

SEQ ID NO: 765079 - DNA, 22 bp, Artificial Sequence
  chemically synthesized
tttcctgacttttaaatgattg

SEQ ID NO: 765080 - DNA, 22 bp, Artificial Sequence
  chemically synthesized
cctgacttttaaatgattgcca

SEQ ID NO: 765081 - DNA, 22 bp, Artificial Sequence
  chemically synthesized
ctgacttttaaatgattgccat

SEQ ID NO: 765082 - DNA, 22 bp, Artificial Sequence
  chemically synthesized
acaccagttagaatggcaatca

SEQ ID NO: 765083 - DNA, 22 bp, Artificial Sequence
  chemically synthesized
acttttaaatgattgccattct

SEQ ID NO: 765084 - DNA, 22 bp, Artificial Sequence
  chemically synthesized
ttaaatgattgccattctaact

SEQ ID NO: 765085 - DNA, 22 bp, Artificial Sequence
  chemically synthesized
taaatgattgccattctaactg

SEQ ID NO: 765086 - DNA, 22 bp, Artificial Sequence
  chemically synthesized
aaatgattgccattctaactgg

SEQ ID NO: 765087 - DNA, 22 bp, Artificial Sequence
  chemically synthesized
aatgattgccattctaactggt

SEQ ID NO: 765088 - DNA, 22 bp, Artificial Sequence
  chemically synthesized
ccattctaactggtgtgagatg

SEQ ID NO: 765089 - DNA, 22 bp, Artificial Sequence
  chemically synthesized
taactggtgtgagatggtatct

SEQ ID NO: 765090 - DNA, 22 bp, Artificial Sequence
  chemically synthesized
actggtgtgagatggtatctca

SEQ ID NO: 765091 - DNA, 22 bp, Artificial Sequence
  chemically synthesized
gtgtgagatggtatctcattgt

SEQ ID NO: 765092 - DNA, 22 bp, Artificial Sequence
  chemically synthesized
gccatcagagaaatgcaaatca

SEQ ID NO: 765093 - DNA, 22 bp, Artificial Sequence
  chemically synthesized
attgtggttttgatttgcattt

SEQ ID NO: 765094 - DNA, 22 bp, Artificial Sequence
  chemically synthesized
tggttttgatttgcatttctct

SEQ ID NO: 765095 - DNA, 22 bp, Artificial Sequence
  chemically synthesized
accatcactggccatcagagaa

SEQ ID NO: 765096 - DNA, 22 bp, Artificial Sequence
  chemically synthesized
tgatttgcatttctctgatggc

SEQ ID NO: 765097 - DNA, 22 bp, Artificial Sequence
  chemically synthesized
gatttgcatttctctgatggcc

SEQ ID NO: 765098 - DNA, 22 bp, Artificial Sequence
  chemically synthesized
atttgcatttctctgatggcca

SEQ ID NO: 765099 - DNA, 22 bp, Artificial Sequence
  chemically synthesized
gcatttctctgatggccagtga

SEQ ID NO: 765100 - DNA, 22 bp, Artificial Sequence
  chemically synthesized
catttctctgatggccagtgat

SEQ ID NO: 765101 - DNA, 22 bp, Artificial Sequence
  chemically synthesized
ctctgatggccagtgatggtga

SEQ ID NO: 765102 - DNA, 22 bp, Artificial Sequence
  chemically synthesized
tctgatggccagtgatggtgag

SEQ ID NO: 765103 - DNA, 22 bp, Artificial Sequence
  chemically synthesized
tgatggccagtgatggtgagca

SEQ ID NO: 765104 - DNA, 22 bp, Artificial Sequence
  chemically synthesized
atggccagtgatggtgagcatt

SEQ ID NO: 765105 - DNA, 22 bp, Artificial Sequence
  chemically synthesized
tgcagccaaaagacacatgaaa

SEQ ID NO: 765106 - DNA, 22 bp, Artificial Sequence
  chemically synthesized
atgcagccaaaagacacatgaa

SEQ ID NO: 765107 - DNA, 22 bp, Artificial Sequence
  chemically synthesized
tttcatgtgtcttttggctgca

SEQ ID NO: 765108 - DNA, 22 bp, Artificial Sequence
  chemically synthesized
ttcatgtgtcttttggctgcat

SEQ ID NO: 765109 - DNA, 22 bp, Artificial Sequence
  chemically synthesized
tcatgtgtcttttggctgcata

SEQ ID NO: 765110 - DNA, 22 bp, Artificial Sequence
  chemically synthesized
catgtgtcttttggctgcataa

SEQ ID NO: 765111 - DNA, 22 bp, Artificial Sequence
  chemically synthesized
aaaagaagacatttatgcagcc

SEQ ID NO: 765112 - DNA, 22 bp, Artificial Sequence
  chemically synthesized
atgtgtcttttggctgcataaa

SEQ ID NO: 765113 - DNA, 22 bp, Artificial Sequence
  chemically synthesized
tcaaaagaagacatttatgcag

SEQ ID NO: 765114 - DNA, 22 bp, Artificial Sequence
  chemically synthesized
ctcaaaagaagacatttatgca

SEQ ID NO: 765115 - DNA, 22 bp, Artificial Sequence
  chemically synthesized
ttggctgcataaatgtcttctt

SEQ ID NO: 765116 - DNA, 22 bp, Artificial Sequence
  chemically synthesized
tggctgcataaatgtcttcttt

SEQ ID NO: 765117 - DNA, 22 bp, Artificial Sequence
  chemically synthesized
ggctgcataaatgtcttctttt

SEQ ID NO: 765118 - DNA, 22 bp, Artificial Sequence
  chemically synthesized
gctgcataaatgtcttcttttg

SEQ ID NO: 765119 - DNA, 22 bp, Artificial Sequence
  chemically synthesized
cataaatgtcttcttttgagaa

SEQ ID NO: 765120 - DNA, 22 bp, Artificial Sequence
  chemically synthesized
cttttgagaagtgtctgttcat

SEQ ID NO: 765121 - DNA, 22 bp, Artificial Sequence
  chemically synthesized
ttttgagaagtgtctgttcatg

SEQ ID NO: 765122 - DNA, 22 bp, Artificial Sequence
  chemically synthesized
ttgagaagtgtctgttcatgtc

SEQ ID NO: 765123 - DNA, 22 bp, Artificial Sequence
  chemically synthesized
tgagaagtgtctgttcatgtcc

SEQ ID NO: 765124 - DNA, 22 bp, Artificial Sequence
  chemically synthesized
gagaagtgtctgttcatgtcct

SEQ ID NO: 765125 - DNA, 22 bp, Artificial Sequence
  chemically synthesized
agaagtgtctgttcatgtcctt

SEQ ID NO: 765126 - DNA, 22 bp, Artificial Sequence
  chemically synthesized
ttcatgtccttcacccactttt

SEQ ID NO: 765127 - DNA, 22 bp, Artificial Sequence
  chemically synthesized
atgtccttcacccactttttga

SEQ ID NO: 765128 - DNA, 22 bp, Artificial Sequence
  chemically synthesized
cacccactttttgatggggttg

SEQ ID NO: 765129 - DNA, 22 bp, Artificial Sequence
  chemically synthesized
acccactttttgatggggttgt

SEQ ID NO: 765130 - DNA, 22 bp, Artificial Sequence
  chemically synthesized
tttgatggggttgtttgttttt

SEQ ID NO: 765131 - DNA, 22 bp, Artificial Sequence
  chemically synthesized
ttgatggggttgtttgtttttt

SEQ ID NO: 765132 - DNA, 22 bp, Artificial Sequence
  chemically synthesized
tgatggggttgtttgttttttt

SEQ ID NO: 765133 - DNA, 22 bp, Artificial Sequence
  chemically synthesized
gatggggttgtttgtttttttc

SEQ ID NO: 765134 - DNA, 22 bp, Artificial Sequence
  chemically synthesized
atggggttgtttgtttttttct

SEQ ID NO: 765135 - DNA, 22 bp, Artificial Sequence
  chemically synthesized
aaacaaatgtacaagaaaaaaa

SEQ ID NO: 765136 - DNA, 22 bp, Artificial Sequence
  chemically synthesized
tttgtttttttcttgtacattt

SEQ ID NO: 765137 - DNA, 22 bp, Artificial Sequence
  chemically synthesized
caatgaactcaaacaaatgtac

SEQ ID NO: 765138 - DNA, 22 bp, Artificial Sequence
  chemically synthesized
gtttttttcttgtacatttgtt

SEQ ID NO: 765139 - DNA, 22 bp, Artificial Sequence
  chemically synthesized
tttttttcttgtacatttgttt

SEQ ID NO: 765140 - DNA, 22 bp, Artificial Sequence
  chemically synthesized
ttttcttgtacatttgtttgag

SEQ ID NO: 765141 - DNA, 22 bp, Artificial Sequence
  chemically synthesized
tttcttgtacatttgtttgagt

SEQ ID NO: 765142 - DNA, 22 bp, Artificial Sequence
  chemically synthesized
ttcttgtacatttgtttgagtt

SEQ ID NO: 765143 - DNA, 22 bp, Artificial Sequence
  chemically synthesized
tcttgtacatttgtttgagttc

SEQ ID NO: 765144 - DNA, 22 bp, Artificial Sequence
  chemically synthesized
cttgtacatttgtttgagttca

SEQ ID NO: 765145 - DNA, 22 bp, Artificial Sequence
  chemically synthesized
ttgtacatttgtttgagttcat

SEQ ID NO: 765146 - DNA, 22 bp, Artificial Sequence
  chemically synthesized
gtacatttgtttgagttcattg

SEQ ID NO: 765147 - DNA, 22 bp, Artificial Sequence
  chemically synthesized
tacatttgtttgagttcattgt

SEQ ID NO: 765148 - DNA, 22 bp, Artificial Sequence
  chemically synthesized
atatccagaatctacaatgaac

SEQ ID NO: 765149 - DNA, 22 bp, Artificial Sequence
  chemically synthesized
gtttgagttcattgtagattct

SEQ ID NO: 765150 - DNA, 22 bp, Artificial Sequence
  chemically synthesized
tttgagttcattgtagattctg

SEQ ID NO: 765151 - DNA, 22 bp, Artificial Sequence
  chemically synthesized
gagttcattgtagattctggat

SEQ ID NO: 765152 - DNA, 22 bp, Artificial Sequence
  chemically synthesized
agttcattgtagattctggata

SEQ ID NO: 765153 - DNA, 22 bp, Artificial Sequence
  chemically synthesized
acaaagggctaatatccagaat

SEQ ID NO: 765154 - DNA, 22 bp, Artificial Sequence
  chemically synthesized
attgtagattctggatattagc

SEQ ID NO: 765155 - DNA, 22 bp, Artificial Sequence
  chemically synthesized
atctgacaaagggctaatatcc

SEQ ID NO: 765156 - DNA, 22 bp, Artificial Sequence
  chemically synthesized
ctcatctgacaaagggctaata

SEQ ID NO: 765157 - DNA, 22 bp, Artificial Sequence
  chemically synthesized
tagattctggatattagccctt

SEQ ID NO: 765158 - DNA, 22 bp, Artificial Sequence
  chemically synthesized
tggatattagccctttgtcaga

SEQ ID NO: 765159 - DNA, 22 bp, Artificial Sequence
  chemically synthesized
gcaacctactcatctgacaaag

SEQ ID NO: 765160 - DNA, 22 bp, Artificial Sequence
  chemically synthesized
cgcaacctactcatctgacaaa

SEQ ID NO: 765161 - DNA, 22 bp, Artificial Sequence
  chemically synthesized
gatattagccctttgtcagatg

SEQ ID NO: 765162 - DNA, 22 bp, Artificial Sequence
  chemically synthesized
tcgcaacctactcatctgacaa

SEQ ID NO: 765163 - DNA, 22 bp, Artificial Sequence
  chemically synthesized
gccctttgtcagatgagtaggt

SEQ ID NO: 765164 - DNA, 22 bp, Artificial Sequence
  chemically synthesized
tgtcagatgagtaggttgcgaa

SEQ ID NO: 765165 - DNA, 22 bp, Artificial Sequence
  chemically synthesized
gtcagatgagtaggttgcgaaa

SEQ ID NO: 765166 - DNA, 22 bp, Artificial Sequence
  chemically synthesized
tcagatgagtaggttgcgaaaa

SEQ ID NO: 765167 - DNA, 22 bp, Artificial Sequence
  chemically synthesized
caacatgggagaaaattttcgc

SEQ ID NO: 765168 - DNA, 22 bp, Artificial Sequence
  chemically synthesized
cgaaaattttctcccatgttgt

SEQ ID NO: 765169 - DNA, 22 bp, Artificial Sequence
  chemically synthesized
tctcccatgttgtaggttgcct

SEQ ID NO: 765170 - DNA, 22 bp, Artificial Sequence
  chemically synthesized
ctcccatgttgtaggttgcctg

SEQ ID NO: 765171 - DNA, 22 bp, Artificial Sequence
  chemically synthesized
tcccatgttgtaggttgcctgt

SEQ ID NO: 765172 - DNA, 22 bp, Artificial Sequence
  chemically synthesized
ccatcagagtgaacaggcaacc

SEQ ID NO: 765173 - DNA, 22 bp, Artificial Sequence
  chemically synthesized
ccatgttgtaggttgcctgttc

SEQ ID NO: 765174 - DNA, 22 bp, Artificial Sequence
  chemically synthesized
taggttgcctgttcactctgat

SEQ ID NO: 765175 - DNA, 22 bp, Artificial Sequence
  chemically synthesized
cctgttcactctgatggtagtt

SEQ ID NO: 765176 - DNA, 22 bp, Artificial Sequence
  chemically synthesized
cacagcaaaagaaactaccatc

SEQ ID NO: 765177 - DNA, 22 bp, Artificial Sequence
  chemically synthesized
tgcacagcaaaagaaactacca

SEQ ID NO: 765178 - DNA, 22 bp, Artificial Sequence
  chemically synthesized
ctgcacagcaaaagaaactacc

SEQ ID NO: 765179 - DNA, 22 bp, Artificial Sequence
  chemically synthesized
ttcactctgatggtagtttctt

SEQ ID NO: 765180 - DNA, 22 bp, Artificial Sequence
  chemically synthesized
actctgatggtagtttcttttg

SEQ ID NO: 765181 - DNA, 22 bp, Artificial Sequence
  chemically synthesized
tgatggtagtttcttttgctgt

SEQ ID NO: 765182 - DNA, 22 bp, Artificial Sequence
  chemically synthesized
aagagcttctgcacagcaaaag

SEQ ID NO: 765183 - DNA, 22 bp, Artificial Sequence
  chemically synthesized
atggtagtttcttttgctgtgc

SEQ ID NO: 765184 - DNA, 22 bp, Artificial Sequence
  chemically synthesized
aactaaagagcttctgcacagc

SEQ ID NO: 765185 - DNA, 22 bp, Artificial Sequence
  chemically synthesized
attaaactaaagagcttctgca

SEQ ID NO: 765186 - DNA, 22 bp, Artificial Sequence
  chemically synthesized
cttttgctgtgcagaagctctt

SEQ ID NO: 765187 - DNA, 22 bp, Artificial Sequence
  chemically synthesized
ttttgctgtgcagaagctcttt

SEQ ID NO: 765188 - DNA, 22 bp, Artificial Sequence
  chemically synthesized
ttgctgtgcagaagctctttag

SEQ ID NO: 765189 - DNA, 22 bp, Artificial Sequence
  chemically synthesized
tgctgtgcagaagctctttagt

SEQ ID NO: 765190 - DNA, 22 bp, Artificial Sequence
  chemically synthesized
gctgtgcagaagctctttagtt

SEQ ID NO: 765191 - DNA, 22 bp, Artificial Sequence
  chemically synthesized
ctgtgcagaagctctttagttt

SEQ ID NO: 765192 - DNA, 22 bp, Artificial Sequence
  chemically synthesized
tgcagaagctctttagtttaat

SEQ ID NO: 765193 - DNA, 22 bp, Artificial Sequence
  chemically synthesized
acaaatgggatctaattaaact

SEQ ID NO: 765194 - DNA, 22 bp, Artificial Sequence
  chemically synthesized
tttagtttaattagatcccatt

SEQ ID NO: 765195 - DNA, 22 bp, Artificial Sequence
  chemically synthesized
tagtttaattagatcccatttg

SEQ ID NO: 765196 - DNA, 22 bp, Artificial Sequence
  chemically synthesized
agtttaattagatcccatttgt

SEQ ID NO: 765197 - DNA, 22 bp, Artificial Sequence
  chemically synthesized
gtttaattagatcccatttgtc

SEQ ID NO: 765198 - DNA, 22 bp, Artificial Sequence
  chemically synthesized
aattagatcccatttgtcaatt

SEQ ID NO: 765199 - DNA, 22 bp, Artificial Sequence
  chemically synthesized
attagatcccatttgtcaattc

SEQ ID NO: 765200 - DNA, 22 bp, Artificial Sequence
  chemically synthesized
gatcccatttgtcaattctggc

SEQ ID NO: 765201 - DNA, 22 bp, Artificial Sequence
  chemically synthesized
gtcaattctggcttttgttgcc

SEQ ID NO: 765202 - DNA, 22 bp, Artificial Sequence
  chemically synthesized
tcaattctggcttttgttgcca

SEQ ID NO: 765203 - DNA, 22 bp, Artificial Sequence
  chemically synthesized
aaacaccaaaagcaatggcaac

SEQ ID NO: 765204 - DNA, 22 bp, Artificial Sequence
  chemically synthesized
tggcttttgttgccattgcttt

SEQ ID NO: 765205 - DNA, 22 bp, Artificial Sequence
  chemically synthesized
gcttttgttgccattgcttttg

SEQ ID NO: 765206 - DNA, 22 bp, Artificial Sequence
  chemically synthesized
atgtctaaaacaccaaaagcaa

SEQ ID NO: 765207 - DNA, 22 bp, Artificial Sequence
  chemically synthesized
catgtctaaaacaccaaaagca

SEQ ID NO: 765208 - DNA, 22 bp, Artificial Sequence
  chemically synthesized
ttgttgccattgcttttggtgt

SEQ ID NO: 765209 - DNA, 22 bp, Artificial Sequence
  chemically synthesized
tgttgccattgcttttggtgtt

SEQ ID NO: 765210 - DNA, 22 bp, Artificial Sequence
  chemically synthesized
gttgccattgcttttggtgttt

SEQ ID NO: 765211 - DNA, 22 bp, Artificial Sequence
  chemically synthesized
ttgccattgcttttggtgtttt

SEQ ID NO: 765212 - DNA, 22 bp, Artificial Sequence
  chemically synthesized
ccattgcttttggtgttttaga

SEQ ID NO: 765213 - DNA, 22 bp, Artificial Sequence
  chemically synthesized
cttttggtgttttagacatgaa

SEQ ID NO: 765214 - DNA, 22 bp, Artificial Sequence
  chemically synthesized
ttggtgttttagacatgaagtc

SEQ ID NO: 765215 - DNA, 22 bp, Artificial Sequence
  chemically synthesized
tggtgttttagacatgaagtcc

SEQ ID NO: 765216 - DNA, 22 bp, Artificial Sequence
  chemically synthesized
ggtgttttagacatgaagtcct

SEQ ID NO: 765217 - DNA, 22 bp, Artificial Sequence
  chemically synthesized
gtgttttagacatgaagtcctt

SEQ ID NO: 765218 - DNA, 22 bp, Artificial Sequence
  chemically synthesized
aggacataggcatgggcaagga

SEQ ID NO: 765219 - DNA, 22 bp, Artificial Sequence
  chemically synthesized
tagacatgaagtccttgcccat

SEQ ID NO: 765220 - DNA, 22 bp, Artificial Sequence
  chemically synthesized
agacatgaagtccttgcccatg

SEQ ID NO: 765221 - DNA, 22 bp, Artificial Sequence
  chemically synthesized
gacatgaagtccttgcccatgc

SEQ ID NO: 765222 - DNA, 22 bp, Artificial Sequence
  chemically synthesized
ccattcaggacataggcatggg

SEQ ID NO: 765223 - DNA, 22 bp, Artificial Sequence
  chemically synthesized
ggcattaccattcaggacatag

SEQ ID NO: 765224 - DNA, 22 bp, Artificial Sequence
  chemically synthesized
gcccatgcctatgtcctgaatg

SEQ ID NO: 765225 - DNA, 22 bp, Artificial Sequence
  chemically synthesized
cccatgcctatgtcctgaatgg

SEQ ID NO: 765226 - DNA, 22 bp, Artificial Sequence
  chemically synthesized
gaagaaaacctaggcattacca

SEQ ID NO: 765227 - DNA, 22 bp, Artificial Sequence
  chemically synthesized
tgtcctgaatggtaatgcctag

SEQ ID NO: 765228 - DNA, 22 bp, Artificial Sequence
  chemically synthesized
aatggtaatgcctaggttttct

SEQ ID NO: 765229 - DNA, 22 bp, Artificial Sequence
  chemically synthesized
aaaccataaaaaccctagaaga

SEQ ID NO: 765230 - DNA, 22 bp, Artificial Sequence
  chemically synthesized
gacctaaaaccataaaaaccct

SEQ ID NO: 765231 - DNA, 22 bp, Artificial Sequence
  chemically synthesized
ggttttcttctagggtttttat

SEQ ID NO: 765232 - DNA, 22 bp, Artificial Sequence
  chemically synthesized
tcttctagggtttttatggttt

SEQ ID NO: 765233 - DNA, 22 bp, Artificial Sequence
  chemically synthesized
cttctagggtttttatggtttt

SEQ ID NO: 765234 - DNA, 22 bp, Artificial Sequence
  chemically synthesized
aacgttagacctaaaaccataa

SEQ ID NO: 765235 - DNA, 22 bp, Artificial Sequence
  chemically synthesized
ttctagggtttttatggtttta

SEQ ID NO: 765236 - DNA, 22 bp, Artificial Sequence
  chemically synthesized
aaacgttagacctaaaaccata

SEQ ID NO: 765237 - DNA, 22 bp, Artificial Sequence
  chemically synthesized
ctagggtttttatggttttagg

SEQ ID NO: 765238 - DNA, 22 bp, Artificial Sequence
  chemically synthesized
tagggtttttatggttttaggt

SEQ ID NO: 765239 - DNA, 22 bp, Artificial Sequence
  chemically synthesized
gggtttttatggttttaggtct

SEQ ID NO: 765240 - DNA, 22 bp, Artificial Sequence
  chemically synthesized
aagacttaaacgttagacctaa

SEQ ID NO: 765241 - DNA, 22 bp, Artificial Sequence
  chemically synthesized
ttatggttttaggtctaacgtt

SEQ ID NO: 765242 - DNA, 22 bp, Artificial Sequence
  chemically synthesized
tatggttttaggtctaacgttt

SEQ ID NO: 765243 - DNA, 22 bp, Artificial Sequence
  chemically synthesized
atggttttaggtctaacgttta

SEQ ID NO: 765244 - DNA, 22 bp, Artificial Sequence
  chemically synthesized
tggttttaggtctaacgtttaa

SEQ ID NO: 765245 - DNA, 22 bp, Artificial Sequence
  chemically synthesized
aagatggattaaagacttaaac

SEQ ID NO: 765246 - DNA, 22 bp, Artificial Sequence
  chemically synthesized
taggtctaacgtttaagtcttt

SEQ ID NO: 765247 - DNA, 22 bp, Artificial Sequence
  chemically synthesized
aggtctaacgtttaagtcttta

SEQ ID NO: 765248 - DNA, 22 bp, Artificial Sequence
  chemically synthesized
ggtctaacgtttaagtctttaa

SEQ ID NO: 765249 - DNA, 22 bp, Artificial Sequence
  chemically synthesized
acgtttaagtctttaatccatc

SEQ ID NO: 765250 - DNA, 22 bp, Artificial Sequence
  chemically synthesized
tacaaaaatcaattcaagatgg

SEQ ID NO: 765251 - DNA, 22 bp, Artificial Sequence
  chemically synthesized
aagtctttaatccatcttgaat

SEQ ID NO: 765252 - DNA, 22 bp, Artificial Sequence
  chemically synthesized
atacaaaaatcaattcaagatg

SEQ ID NO: 765253 - DNA, 22 bp, Artificial Sequence
  chemically synthesized
agtctttaatccatcttgaatt

SEQ ID NO: 765254 - DNA, 22 bp, Artificial Sequence
  chemically synthesized
caccttatacaaaaatcaattc

SEQ ID NO: 765255 - DNA, 22 bp, Artificial Sequence
  chemically synthesized
taatccatcttgaattgatttt

SEQ ID NO: 765256 - DNA, 22 bp, Artificial Sequence
  chemically synthesized
acaccttatacaaaaatcaatt

SEQ ID NO: 765257 - DNA, 22 bp, Artificial Sequence
  chemically synthesized
aatccatcttgaattgattttt

SEQ ID NO: 765258 - DNA, 22 bp, Artificial Sequence
  chemically synthesized
atccatcttgaattgatttttg

SEQ ID NO: 765259 - DNA, 22 bp, Artificial Sequence
  chemically synthesized
cttacaccttatacaaaaatca

SEQ ID NO: 765260 - DNA, 22 bp, Artificial Sequence
  chemically synthesized
ccttacaccttatacaaaaatc

SEQ ID NO: 765261 - DNA, 22 bp, Artificial Sequence
  chemically synthesized
gaattgatttttgtataaggtg

SEQ ID NO: 765262 - DNA, 22 bp, Artificial Sequence
  chemically synthesized
aattgatttttgtataaggtgt

SEQ ID NO: 765263 - DNA, 22 bp, Artificial Sequence
  chemically synthesized
gatcccttccttacaccttata

SEQ ID NO: 765264 - DNA, 22 bp, Artificial Sequence
  chemically synthesized
atttttgtataaggtgtaagga

SEQ ID NO: 765265 - DNA, 22 bp, Artificial Sequence
  chemically synthesized
aaactggatcccttccttacac

SEQ ID NO: 765266 - DNA, 22 bp, Artificial Sequence
  chemically synthesized
ttgtataaggtgtaaggaaggg

SEQ ID NO: 765267 - DNA, 22 bp, Artificial Sequence
  chemically synthesized
tgtataaggtgtaaggaaggga

SEQ ID NO: 765268 - DNA, 22 bp, Artificial Sequence
  chemically synthesized
gtataaggtgtaaggaagggat

SEQ ID NO: 765269 - DNA, 22 bp, Artificial Sequence
  chemically synthesized
tataaggtgtaaggaagggatc

SEQ ID NO: 765270 - DNA, 22 bp, Artificial Sequence
  chemically synthesized
gccatatgtagaaagctgaaac

SEQ ID NO: 765271 - DNA, 22 bp, Artificial Sequence
  chemically synthesized
gctagccatatgtagaaagctg

SEQ ID NO: 765272 - DNA, 22 bp, Artificial Sequence
  chemically synthesized
ggaaaactggctagccatatgt

SEQ ID NO: 765273 - DNA, 22 bp, Artificial Sequence
  chemically synthesized
cagctttctacatatggctagc

SEQ ID NO: 765274 - DNA, 22 bp, Artificial Sequence
  chemically synthesized
agctttctacatatggctagcc

SEQ ID NO: 765275 - DNA, 22 bp, Artificial Sequence
  chemically synthesized
tctacatatggctagccagttt

SEQ ID NO: 765276 - DNA, 22 bp, Artificial Sequence
  chemically synthesized
ctacatatggctagccagtttt

SEQ ID NO: 765277 - DNA, 22 bp, Artificial Sequence
  chemically synthesized
tacatatggctagccagttttc

SEQ ID NO: 765278 - DNA, 22 bp, Artificial Sequence
  chemically synthesized
catatggctagccagttttccc

SEQ ID NO: 765279 - DNA, 22 bp, Artificial Sequence
  chemically synthesized
ataaatggtgctgggaaaactg

SEQ ID NO: 765280 - DNA, 22 bp, Artificial Sequence
  chemically synthesized
aataaatggtgctgggaaaact

SEQ ID NO: 765281 - DNA, 22 bp, Artificial Sequence
  chemically synthesized
tttaataaatggtgctgggaaa

SEQ ID NO: 765282 - DNA, 22 bp, Artificial Sequence
  chemically synthesized
cctatttaataaatggtgctgg

SEQ ID NO: 765283 - DNA, 22 bp, Artificial Sequence
  chemically synthesized
gccagttttcccagcaccattt

SEQ ID NO: 765284 - DNA, 22 bp, Artificial Sequence
  chemically synthesized
tcccagcaccatttattaaata

SEQ ID NO: 765285 - DNA, 22 bp, Artificial Sequence
  chemically synthesized
cccagcaccatttattaaatag

SEQ ID NO: 765286 - DNA, 22 bp, Artificial Sequence
  chemically synthesized
ccagcaccatttattaaatagg

SEQ ID NO: 765287 - DNA, 22 bp, Artificial Sequence
  chemically synthesized
attaaatagggaatcctttccc

SEQ ID NO: 765288 - DNA, 22 bp, Artificial Sequence
  chemically synthesized
ttaaatagggaatcctttcccc

SEQ ID NO: 765289 - DNA, 22 bp, Artificial Sequence
  chemically synthesized
aatagggaatcctttccccatt

SEQ ID NO: 765290 - DNA, 22 bp, Artificial Sequence
  chemically synthesized
agaaaaacaagcaatggggaaa

SEQ ID NO: 765291 - DNA, 22 bp, Artificial Sequence
  chemically synthesized
acaaacctgagaaaaacaagca

SEQ ID NO: 765292 - DNA, 22 bp, Artificial Sequence
  chemically synthesized
aacaaacctgagaaaaacaagc

SEQ ID NO: 765293 - DNA, 22 bp, Artificial Sequence
  chemically synthesized
taacaaacctgagaaaaacaag

SEQ ID NO: 765294 - DNA, 22 bp, Artificial Sequence
  chemically synthesized
tccccattgcttgtttttctca

SEQ ID NO: 765295 - DNA, 22 bp, Artificial Sequence
  chemically synthesized
ccccattgcttgtttttctcag

SEQ ID NO: 765296 - DNA, 22 bp, Artificial Sequence
  chemically synthesized
cccattgcttgtttttctcagg

SEQ ID NO: 765297 - DNA, 22 bp, Artificial Sequence
  chemically synthesized
atctttaacaaacctgagaaaa

SEQ ID NO: 765298 - DNA, 22 bp, Artificial Sequence
  chemically synthesized
tctgatctttaacaaacctgag

SEQ ID NO: 765299 - DNA, 22 bp, Artificial Sequence
  chemically synthesized
cttgtttttctcaggtttgtta

SEQ ID NO: 765300 - DNA, 22 bp, Artificial Sequence
  chemically synthesized
gtttttctcaggtttgttaaag

SEQ ID NO: 765301 - DNA, 22 bp, Artificial Sequence
  chemically synthesized
caactatctgatctttaacaaa

SEQ ID NO: 765302 - DNA, 22 bp, Artificial Sequence
  chemically synthesized
tttttctcaggtttgttaaaga

SEQ ID NO: 765303 - DNA, 22 bp, Artificial Sequence
  chemically synthesized
ttctcaggtttgttaaagatca

SEQ ID NO: 765304 - DNA, 22 bp, Artificial Sequence
  chemically synthesized
tctcaggtttgttaaagatcag

SEQ ID NO: 765305 - DNA, 22 bp, Artificial Sequence
  chemically synthesized
ctcaggtttgttaaagatcaga

SEQ ID NO: 765306 - DNA, 22 bp, Artificial Sequence
  chemically synthesized
tcaggtttgttaaagatcagat

SEQ ID NO: 765307 - DNA, 22 bp, Artificial Sequence
  chemically synthesized
aggtttgttaaagatcagatag

SEQ ID NO: 765308 - DNA, 22 bp, Artificial Sequence
  chemically synthesized
gttaaagatcagatagttgtag

SEQ ID NO: 765309 - DNA, 22 bp, Artificial Sequence
  chemically synthesized
ttaaagatcagatagttgtaga

SEQ ID NO: 765310 - DNA, 22 bp, Artificial Sequence
  chemically synthesized
aagatcagatagttgtagatat

SEQ ID NO: 765311 - DNA, 22 bp, Artificial Sequence
  chemically synthesized
agaaataatgccgcatatctac

SEQ ID NO: 765312 - DNA, 22 bp, Artificial Sequence
  chemically synthesized
tagatatgcggcattatttctg

SEQ ID NO: 765313 - DNA, 22 bp, Artificial Sequence
  chemically synthesized
tttctgagggctctgttctgtt

SEQ ID NO: 765314 - DNA, 22 bp, Artificial Sequence
  chemically synthesized
ctgagggctctgttctgttcca

SEQ ID NO: 765315 - DNA, 22 bp, Artificial Sequence
  chemically synthesized
tgagggctctgttctgttccac

SEQ ID NO: 765316 - DNA, 22 bp, Artificial Sequence
  chemically synthesized
agggctctgttctgttccactg

SEQ ID NO: 765317 - DNA, 22 bp, Artificial Sequence
  chemically synthesized
tgttctgttccactgatctata

SEQ ID NO: 765318 - DNA, 22 bp, Artificial Sequence
  chemically synthesized
ttctgttccactgatctatatc

SEQ ID NO: 765319 - DNA, 22 bp, Artificial Sequence
  chemically synthesized
gtaccaaaacagagatatagat

SEQ ID NO: 765320 - DNA, 22 bp, Artificial Sequence
  chemically synthesized
tgttccactgatctatatctct

SEQ ID NO: 765321 - DNA, 22 bp, Artificial Sequence
  chemically synthesized
ttccactgatctatatctctgt

SEQ ID NO: 765322 - DNA, 22 bp, Artificial Sequence
  chemically synthesized
cactgatctatatctctgtttt

SEQ ID NO: 765323 - DNA, 22 bp, Artificial Sequence
  chemically synthesized
atctatatctctgttttggtac

SEQ ID NO: 765324 - DNA, 22 bp, Artificial Sequence
  chemically synthesized
tatctctgttttggtaccagta

SEQ ID NO: 765325 - DNA, 22 bp, Artificial Sequence
  chemically synthesized
tgttttggtaccagtaccatgt

SEQ ID NO: 765326 - DNA, 22 bp, Artificial Sequence
  chemically synthesized
ttttggtaccagtaccatgttg

SEQ ID NO: 765327 - DNA, 22 bp, Artificial Sequence
  chemically synthesized
cagtaaccaaaacaacatggta

SEQ ID NO: 765328 - DNA, 22 bp, Artificial Sequence
  chemically synthesized
tggtaccagtaccatgttgttt

SEQ ID NO: 765329 - DNA, 22 bp, Artificial Sequence
  chemically synthesized
ggtaccagtaccatgttgtttt

SEQ ID NO: 765330 - DNA, 22 bp, Artificial Sequence
  chemically synthesized
gtaccagtaccatgttgttttg

SEQ ID NO: 765331 - DNA, 22 bp, Artificial Sequence
  chemically synthesized
caaggctacagtaaccaaaaca

SEQ ID NO: 765332 - DNA, 22 bp, Artificial Sequence
  chemically synthesized
tactacaaggctacagtaacca

SEQ ID NO: 765333 - DNA, 22 bp, Artificial Sequence
  chemically synthesized
aaactatactacaaggctacag

SEQ ID NO: 765334 - DNA, 22 bp, Artificial Sequence
  chemically synthesized
caaactatactacaaggctaca

SEQ ID NO: 765335 - DNA, 22 bp, Artificial Sequence
  chemically synthesized
ttttggttactgtagccttgta

SEQ ID NO: 765336 - DNA, 22 bp, Artificial Sequence
  chemically synthesized
acttcaaactatactacaaggc

SEQ ID NO: 765337 - DNA, 22 bp, Artificial Sequence
  chemically synthesized
tggttactgtagccttgtagta

SEQ ID NO: 765338 - DNA, 22 bp, Artificial Sequence
  chemically synthesized
ggttactgtagccttgtagtat

SEQ ID NO: 765339 - DNA, 22 bp, Artificial Sequence
  chemically synthesized
gttactgtagccttgtagtata

SEQ ID NO: 765340 - DNA, 22 bp, Artificial Sequence
  chemically synthesized
gctgacttcaaactatactaca

SEQ ID NO: 765341 - DNA, 22 bp, Artificial Sequence
  chemically synthesized
ctgtagccttgtagtatagttt

SEQ ID NO: 765342 - DNA, 22 bp, Artificial Sequence
  chemically synthesized
tagccttgtagtatagtttgaa

SEQ ID NO: 765343 - DNA, 22 bp, Artificial Sequence
  chemically synthesized
gtagtatagtttgaagtcagct

SEQ ID NO: 765344 - DNA, 22 bp, Artificial Sequence
  chemically synthesized
tagtatagtttgaagtcagcta

SEQ ID NO: 765345 - DNA, 22 bp, Artificial Sequence
  chemically synthesized
gaggcatcacactagctgactt

SEQ ID NO: 765346 - DNA, 22 bp, Artificial Sequence
  chemically synthesized
gaagtcagctagtgtgatgcct

SEQ ID NO: 765347 - DNA, 22 bp, Artificial Sequence
  chemically synthesized
aagtcagctagtgtgatgcctc

SEQ ID NO: 765348 - DNA, 22 bp, Artificial Sequence
  chemically synthesized
agccaaaagaacaaagctggag

SEQ ID NO: 765349 - DNA, 22 bp, Artificial Sequence
  chemically synthesized
gtgtgatgcctccagctttgtt

SEQ ID NO: 765350 - DNA, 22 bp, Artificial Sequence
  chemically synthesized
cagctttgttcttttggctcag

SEQ ID NO: 765351 - DNA, 22 bp, Artificial Sequence
  chemically synthesized
tgttcttttggctcaggattga

SEQ ID NO: 765352 - DNA, 22 bp, Artificial Sequence
  chemically synthesized
gttcttttggctcaggattgac

SEQ ID NO: 765353 - DNA, 22 bp, Artificial Sequence
  chemically synthesized
ttcttttggctcaggattgact

SEQ ID NO: 765354 - DNA, 22 bp, Artificial Sequence
  chemically synthesized
ttttggctcaggattgacttgg

SEQ ID NO: 765355 - DNA, 22 bp, Artificial Sequence
  chemically synthesized
ttggctcaggattgacttggcg

SEQ ID NO: 765356 - DNA, 22 bp, Artificial Sequence
  chemically synthesized
tggctcaggattgacttggcga

SEQ ID NO: 765357 - DNA, 22 bp, Artificial Sequence
  chemically synthesized
ggctcaggattgacttggcgat

SEQ ID NO: 765358 - DNA, 22 bp, Artificial Sequence
  chemically synthesized
gctcaggattgacttggcgatg

SEQ ID NO: 765359 - DNA, 22 bp, Artificial Sequence
  chemically synthesized
aggattgacttggcgatgtggg

SEQ ID NO: 765360 - DNA, 22 bp, Artificial Sequence
  chemically synthesized
acttggcgatgtgggctctttt

SEQ ID NO: 765361 - DNA, 22 bp, Artificial Sequence
  chemically synthesized
atatggaaccaaaaaagagccc

SEQ ID NO: 765362 - DNA, 22 bp, Artificial Sequence
  chemically synthesized
ggcgatgtgggctcttttttgg

SEQ ID NO: 765363 - DNA, 22 bp, Artificial Sequence
  chemically synthesized
gcgatgtgggctcttttttggt

SEQ ID NO: 765364 - DNA, 22 bp, Artificial Sequence
  chemically synthesized
aagttcatatggaaccaaaaaa

SEQ ID NO: 765365 - DNA, 22 bp, Artificial Sequence
  chemically synthesized
aaagttcatatggaaccaaaaa

SEQ ID NO: 765366 - DNA, 22 bp, Artificial Sequence
  chemically synthesized
taaagttcatatggaaccaaaa

SEQ ID NO: 765367 - DNA, 22 bp, Artificial Sequence
  chemically synthesized
ctttaaagttcatatggaacca

SEQ ID NO: 765368 - DNA, 22 bp, Artificial Sequence
  chemically synthesized
ttttttggttccatatgaactt

SEQ ID NO: 765369 - DNA, 22 bp, Artificial Sequence
  chemically synthesized
ttttggttccatatgaacttta

SEQ ID NO: 765370 - DNA, 22 bp, Artificial Sequence
  chemically synthesized
tttggttccatatgaactttaa

SEQ ID NO: 765371 - DNA, 22 bp, Artificial Sequence
  chemically synthesized
gaaaaaactactttaaagttca

SEQ ID NO: 765372 - DNA, 22 bp, Artificial Sequence
  chemically synthesized
ttggttccatatgaactttaaa

SEQ ID NO: 765373 - DNA, 22 bp, Artificial Sequence
  chemically synthesized
tggttccatatgaactttaaag

SEQ ID NO: 765374 - DNA, 22 bp, Artificial Sequence
  chemically synthesized
ggttccatatgaactttaaagt

SEQ ID NO: 765375 - DNA, 22 bp, Artificial Sequence
  chemically synthesized
gttccatatgaactttaaagta

SEQ ID NO: 765376 - DNA, 22 bp, Artificial Sequence
  chemically synthesized
catatgaactttaaagtagttt

SEQ ID NO: 765377 - DNA, 22 bp, Artificial Sequence
  chemically synthesized
acagaattggaaaaaactactt

SEQ ID NO: 765378 - DNA, 22 bp, Artificial Sequence
  chemically synthesized
cacagaattggaaaaaactact

SEQ ID NO: 765379 - DNA, 22 bp, Artificial Sequence
  chemically synthesized
ttcacagaattggaaaaaacta

SEQ ID NO: 765380 - DNA, 22 bp, Artificial Sequence
  chemically synthesized
cttcacagaattggaaaaaact

SEQ ID NO: 765381 - DNA, 22 bp, Artificial Sequence
  chemically synthesized
tcttcacagaattggaaaaaac

SEQ ID NO: 765382 - DNA, 22 bp, Artificial Sequence
  chemically synthesized
taaagtagttttttccaattct

SEQ ID NO: 765383 - DNA, 22 bp, Artificial Sequence
  chemically synthesized
aaagtagttttttccaattctg

SEQ ID NO: 765384 - DNA, 22 bp, Artificial Sequence
  chemically synthesized
aagtagttttttccaattctgt

SEQ ID NO: 765385 - DNA, 22 bp, Artificial Sequence
  chemically synthesized
ccaatgcctttcttcacagaat

SEQ ID NO: 765386 - DNA, 22 bp, Artificial Sequence
  chemically synthesized
tttccaattctgtgaagaaagg

SEQ ID NO: 765387 - DNA, 22 bp, Artificial Sequence
  chemically synthesized
ttccaattctgtgaagaaaggc

SEQ ID NO: 765388 - DNA, 22 bp, Artificial Sequence
  chemically synthesized
tccaattctgtgaagaaaggca

SEQ ID NO: 765389 - DNA, 22 bp, Artificial Sequence
  chemically synthesized
ccaattctgtgaagaaaggcat

SEQ ID NO: 765390 - DNA, 22 bp, Artificial Sequence
  chemically synthesized
caattctgtgaagaaaggcatt

SEQ ID NO: 765391 - DNA, 22 bp, Artificial Sequence
  chemically synthesized
tgtgaagaaaggcattggtagc

SEQ ID NO: 765392 - DNA, 22 bp, Artificial Sequence
  chemically synthesized
tgaagaaaggcattggtagctt

SEQ ID NO: 765393 - DNA, 22 bp, Artificial Sequence
  chemically synthesized
aatgccatccccatcaagctac

SEQ ID NO: 765394 - DNA, 22 bp, Artificial Sequence
  chemically synthesized
cagattcaatgccatccccatc

SEQ ID NO: 765395 - DNA, 22 bp, Artificial Sequence
  chemically synthesized
acagattcaatgccatccccat

SEQ ID NO: 765396 - DNA, 22 bp, Artificial Sequence
  chemically synthesized
gtagcttgatggggatggcatt

SEQ ID NO: 765397 - DNA, 22 bp, Artificial Sequence
  chemically synthesized
gatggggatggcattgaatctg

SEQ ID NO: 765398 - DNA, 22 bp, Artificial Sequence
  chemically synthesized
atggggatggcattgaatctgt

SEQ ID NO: 765399 - DNA, 22 bp, Artificial Sequence
  chemically synthesized
cccaaggtgatttacagattca

SEQ ID NO: 765400 - DNA, 22 bp, Artificial Sequence
  chemically synthesized
aatctgtaaatcaccttgggca

SEQ ID NO: 765401 - DNA, 22 bp, Artificial Sequence
  chemically synthesized
tgaaaatggccatactgcccaa

SEQ ID NO: 765402 - DNA, 22 bp, Artificial Sequence
  chemically synthesized
taaatcaccttgggcagtatgg

SEQ ID NO: 765403 - DNA, 22 bp, Artificial Sequence
  chemically synthesized
gggcagtatggccattttcaca

SEQ ID NO: 765404 - DNA, 22 bp, Artificial Sequence
  chemically synthesized
ggcagtatggccattttcacaa

SEQ ID NO: 765405 - DNA, 22 bp, Artificial Sequence
  chemically synthesized
atgggtaggaagaatcaatatt

SEQ ID NO: 765406 - DNA, 22 bp, Artificial Sequence
  chemically synthesized
catgctcatgggtaggaagaat

SEQ ID NO: 765407 - DNA, 22 bp, Artificial Sequence
  chemically synthesized
tcacaatattgattcttcctac

SEQ ID NO: 765408 - DNA, 22 bp, Artificial Sequence
  chemically synthesized
cacaatattgattcttcctacc

SEQ ID NO: 765409 - DNA, 22 bp, Artificial Sequence
  chemically synthesized
acaatattgattcttcctaccc

SEQ ID NO: 765410 - DNA, 22 bp, Artificial Sequence
  chemically synthesized
attcttcctacccatgagcatg

SEQ ID NO: 765411 - DNA, 22 bp, Artificial Sequence
  chemically synthesized
ttcctacccatgagcatggaat

SEQ ID NO: 765412 - DNA, 22 bp, Artificial Sequence
  chemically synthesized
cctacccatgagcatggaatgt

SEQ ID NO: 765413 - DNA, 22 bp, Artificial Sequence
  chemically synthesized
ctacccatgagcatggaatgtt

SEQ ID NO: 765414 - DNA, 22 bp, Artificial Sequence
  chemically synthesized
cccatgagcatggaatgttctt

SEQ ID NO: 765415 - DNA, 22 bp, Artificial Sequence
  chemically synthesized
aaggaaataaaagaggacacaa

SEQ ID NO: 765416 - DNA, 22 bp, Artificial Sequence
  chemically synthesized
ttccatttgtttgtgtcctctt

SEQ ID NO: 765417 - DNA, 22 bp, Artificial Sequence
  chemically synthesized
ctcaaggaaataaaagaggaca

SEQ ID NO: 765418 - DNA, 22 bp, Artificial Sequence
  chemically synthesized
ccatttgtttgtgtcctctttt

SEQ ID NO: 765419 - DNA, 22 bp, Artificial Sequence
  chemically synthesized
catttgtttgtgtcctctttta

SEQ ID NO: 765420 - DNA, 22 bp, Artificial Sequence
  chemically synthesized
gtttgtgtcctcttttatttcc

SEQ ID NO: 765421 - DNA, 22 bp, Artificial Sequence
  chemically synthesized
tttgtgtcctcttttatttcct

SEQ ID NO: 765422 - DNA, 22 bp, Artificial Sequence
  chemically synthesized
caaaccactgctcaaggaaata

SEQ ID NO: 765423 - DNA, 22 bp, Artificial Sequence
  chemically synthesized
gtgtcctcttttatttccttga

SEQ ID NO: 765424 - DNA, 22 bp, Artificial Sequence
  chemically synthesized
tgtcctcttttatttccttgag

SEQ ID NO: 765425 - DNA, 22 bp, Artificial Sequence
  chemically synthesized
ttttatttccttgagcagtggt

SEQ ID NO: 765426 - DNA, 22 bp, Artificial Sequence
  chemically synthesized
ttatttccttgagcagtggttt

SEQ ID NO: 765427 - DNA, 22 bp, Artificial Sequence
  chemically synthesized
aaggagaactacaaaccactgc

SEQ ID NO: 765428 - DNA, 22 bp, Artificial Sequence
  chemically synthesized
tatttccttgagcagtggtttg

SEQ ID NO: 765429 - DNA, 22 bp, Artificial Sequence
  chemically synthesized
caaggagaactacaaaccactg

SEQ ID NO: 765430 - DNA, 22 bp, Artificial Sequence
  chemically synthesized
atttccttgagcagtggtttgt

SEQ ID NO: 765431 - DNA, 22 bp, Artificial Sequence
  chemically synthesized
tttccttgagcagtggtttgta

SEQ ID NO: 765432 - DNA, 22 bp, Artificial Sequence
  chemically synthesized
ttcaaggagaactacaaaccac

SEQ ID NO: 765433 - DNA, 22 bp, Artificial Sequence
  chemically synthesized
ccttgagcagtggtttgtagtt

SEQ ID NO: 765434 - DNA, 22 bp, Artificial Sequence
  chemically synthesized
cttgagcagtggtttgtagttc

SEQ ID NO: 765435 - DNA, 22 bp, Artificial Sequence
  chemically synthesized
gagcagtggtttgtagttctcc

SEQ ID NO: 765436 - DNA, 22 bp, Artificial Sequence
  chemically synthesized
agcagtggtttgtagttctcct

SEQ ID NO: 765437 - DNA, 22 bp, Artificial Sequence
  chemically synthesized
gtagttctccttgaagaggtcc

SEQ ID NO: 765438 - DNA, 22 bp, Artificial Sequence
  chemically synthesized
tagttctccttgaagaggtcct

SEQ ID NO: 765439 - DNA, 22 bp, Artificial Sequence
  chemically synthesized
caagggatgtgaaggacctctt

SEQ ID NO: 765440 - DNA, 22 bp, Artificial Sequence
  chemically synthesized
acaagggatgtgaaggacctct

SEQ ID NO: 765441 - DNA, 22 bp, Artificial Sequence
  chemically synthesized
tccttgaagaggtccttcacat

SEQ ID NO: 765442 - DNA, 22 bp, Artificial Sequence
  chemically synthesized
cttgaagaggtccttcacatcc

SEQ ID NO: 765443 - DNA, 22 bp, Artificial Sequence
  chemically synthesized
gaagaggtccttcacatccctt

SEQ ID NO: 765444 - DNA, 22 bp, Artificial Sequence
  chemically synthesized
aagaggtccttcacatcccttg

SEQ ID NO: 765445 - DNA, 22 bp, Artificial Sequence
  chemically synthesized
ggaatgcaacttacaagggatg

SEQ ID NO: 765446 - DNA, 22 bp, Artificial Sequence
  chemically synthesized
cacatcccttgtaagttgcatt

SEQ ID NO: 765447 - DNA, 22 bp, Artificial Sequence
  chemically synthesized
acatcccttgtaagttgcattc

SEQ ID NO: 765448 - DNA, 22 bp, Artificial Sequence
  chemically synthesized
aaagagaataaaatacctagga

SEQ ID NO: 765449 - DNA, 22 bp, Artificial Sequence
  chemically synthesized
gtaagttgcattcctaggtatt

SEQ ID NO: 765450 - DNA, 22 bp, Artificial Sequence
  chemically synthesized
caaagagaataaaatacctagg

SEQ ID NO: 765451 - DNA, 22 bp, Artificial Sequence
  chemically synthesized
taagttgcattcctaggtattt

SEQ ID NO: 765452 - DNA, 22 bp, Artificial Sequence
  chemically synthesized
cttcaaagagaataaaatacct

SEQ ID NO: 765453 - DNA, 22 bp, Artificial Sequence
  chemically synthesized
cattcctaggtattttattctc

SEQ ID NO: 765454 - DNA, 22 bp, Artificial Sequence
  chemically synthesized
acaattgcttcaaagagaataa

SEQ ID NO: 765455 - DNA, 22 bp, Artificial Sequence
  chemically synthesized
ctaggtattttattctctttga

SEQ ID NO: 765456 - DNA, 22 bp, Artificial Sequence
  chemically synthesized
ggtattttattctctttgaagc

SEQ ID NO: 765457 - DNA, 22 bp, Artificial Sequence
  chemically synthesized
ccattcacaattgcttcaaaga

SEQ ID NO: 765458 - DNA, 22 bp, Artificial Sequence
  chemically synthesized
tattctctttgaagcaattgtg

SEQ ID NO: 765459 - DNA, 22 bp, Artificial Sequence
  chemically synthesized
attctctttgaagcaattgtga

SEQ ID NO: 765460 - DNA, 22 bp, Artificial Sequence
  chemically synthesized
ttctctttgaagcaattgtgaa

SEQ ID NO: 765461 - DNA, 22 bp, Artificial Sequence
  chemically synthesized
tctttgaagcaattgtgaatgg

SEQ ID NO: 765462 - DNA, 22 bp, Artificial Sequence
  chemically synthesized
tttgaagcaattgtgaatggga

SEQ ID NO: 765463 - DNA, 22 bp, Artificial Sequence
  chemically synthesized
tgaagcaattgtgaatgggagt

SEQ ID NO: 765464 - DNA, 22 bp, Artificial Sequence
  chemically synthesized
gaagcaattgtgaatgggagtt

SEQ ID NO: 765465 - DNA, 22 bp, Artificial Sequence
  chemically synthesized
aagcaattgtgaatgggagttc

SEQ ID NO: 765466 - DNA, 22 bp, Artificial Sequence
  chemically synthesized
tgaatgggagttcactcatgat

SEQ ID NO: 765467 - DNA, 22 bp, Artificial Sequence
  chemically synthesized
actcatgatttggctctctgtt

SEQ ID NO: 765468 - DNA, 22 bp, Artificial Sequence
  chemically synthesized
atgatttggctctctgtttgtc

SEQ ID NO: 765469 - DNA, 22 bp, Artificial Sequence
  chemically synthesized
tacaccaacaacagacaaacag

SEQ ID NO: 765470 - DNA, 22 bp, Artificial Sequence
  chemically synthesized
atacaccaacaacagacaaaca

SEQ ID NO: 765471 - DNA, 22 bp, Artificial Sequence
  chemically synthesized
ttatacaccaacaacagacaaa

SEQ ID NO: 765472 - DNA, 22 bp, Artificial Sequence
  chemically synthesized
ggctctctgtttgtctgttgtt

SEQ ID NO: 765473 - DNA, 22 bp, Artificial Sequence
  chemically synthesized
gctctctgtttgtctgttgttg

SEQ ID NO: 765474 - DNA, 22 bp, Artificial Sequence
  chemically synthesized
tctgtttgtctgttgttggtgt

SEQ ID NO: 765475 - DNA, 22 bp, Artificial Sequence
  chemically synthesized
tgtttgtctgttgttggtgtat

SEQ ID NO: 765476 - DNA, 22 bp, Artificial Sequence
  chemically synthesized
tttgtctgttgttggtgtataa

SEQ ID NO: 765477 - DNA, 22 bp, Artificial Sequence
  chemically synthesized
gtctgttgttggtgtataagaa

SEQ ID NO: 765478 - DNA, 22 bp, Artificial Sequence
  chemically synthesized
tctgttgttggtgtataagaat

SEQ ID NO: 765479 - DNA, 22 bp, Artificial Sequence
  chemically synthesized
ttgttggtgtataagaatgctt

SEQ ID NO: 765480 - DNA, 22 bp, Artificial Sequence
  chemically synthesized
ttggtgtataagaatgcttgtg

SEQ ID NO: 765481 - DNA, 22 bp, Artificial Sequence
  chemically synthesized
gtgtataagaatgcttgtgatt

SEQ ID NO: 765482 - DNA, 22 bp, Artificial Sequence
  chemically synthesized
aggatacaaaatcaatgtacaa

SEQ ID NO: 765483 - DNA, 22 bp, Artificial Sequence
  chemically synthesized
gtgatttttgtacattgatttt

SEQ ID NO: 765484 - DNA, 22 bp, Artificial Sequence
  chemically synthesized
tgatttttgtacattgattttg

SEQ ID NO: 765485 - DNA, 22 bp, Artificial Sequence
  chemically synthesized
agcaaagtctcaggatacaaaa

SEQ ID NO: 765486 - DNA, 22 bp, Artificial Sequence
  chemically synthesized
ttgtacattgattttgtatcct

SEQ ID NO: 765487 - DNA, 22 bp, Artificial Sequence
  chemically synthesized
cagcaaagtctcaggatacaaa

SEQ ID NO: 765488 - DNA, 22 bp, Artificial Sequence
  chemically synthesized
tgtacattgattttgtatcctg

SEQ ID NO: 765489 - DNA, 22 bp, Artificial Sequence
  chemically synthesized
gtacattgattttgtatcctga

SEQ ID NO: 765490 - DNA, 22 bp, Artificial Sequence
  chemically synthesized
tacattgattttgtatcctgag

SEQ ID NO: 765491 - DNA, 22 bp, Artificial Sequence
  chemically synthesized
attttgtatcctgagactttgc

SEQ ID NO: 765492 - DNA, 22 bp, Artificial Sequence
  chemically synthesized
ataagcaacttcagcaaagtct

SEQ ID NO: 765493 - DNA, 22 bp, Artificial Sequence
  chemically synthesized
tgtatcctgagactttgctgaa

SEQ ID NO: 765494 - DNA, 22 bp, Artificial Sequence
  chemically synthesized
gtatcctgagactttgctgaag

SEQ ID NO: 765495 - DNA, 22 bp, Artificial Sequence
  chemically synthesized
tatcctgagactttgctgaagt

SEQ ID NO: 765496 - DNA, 22 bp, Artificial Sequence
  chemically synthesized
agctgataagcaacttcagcaa

SEQ ID NO: 765497 - DNA, 22 bp, Artificial Sequence
  chemically synthesized
aagctgataagcaacttcagca

SEQ ID NO: 765498 - DNA, 22 bp, Artificial Sequence
  chemically synthesized
cttaagctgataagcaacttca

SEQ ID NO: 765499 - DNA, 22 bp, Artificial Sequence
  chemically synthesized
agactttgctgaagttgcttat

SEQ ID NO: 765500 - DNA, 22 bp, Artificial Sequence
  chemically synthesized
tgctgaagttgcttatcagctt

SEQ ID NO: 765501 - DNA, 22 bp, Artificial Sequence
  chemically synthesized
gctgaagttgcttatcagctta

SEQ ID NO: 765502 - DNA, 22 bp, Artificial Sequence
  chemically synthesized
ctgaagttgcttatcagcttaa

SEQ ID NO: 765503 - DNA, 22 bp, Artificial Sequence
  chemically synthesized
agcccaaaatctccttaagctg

SEQ ID NO: 765504 - DNA, 22 bp, Artificial Sequence
  chemically synthesized
aagttgcttatcagcttaagga

SEQ ID NO: 765505 - DNA, 22 bp, Artificial Sequence
  chemically synthesized
cttatcagcttaaggagatttt

SEQ ID NO: 765506 - DNA, 22 bp, Artificial Sequence
  chemically synthesized
atcagcttaaggagattttggg

SEQ ID NO: 765507 - DNA, 22 bp, Artificial Sequence
  chemically synthesized
tcagcttaaggagattttgggc

SEQ ID NO: 765508 - DNA, 22 bp, Artificial Sequence
  chemically synthesized
gaaaaccccatcgtctcagccc

SEQ ID NO: 765509 - DNA, 22 bp, Artificial Sequence
  chemically synthesized
aaggagattttgggctgagacg

SEQ ID NO: 765510 - DNA, 22 bp, Artificial Sequence
  chemically synthesized
aggagattttgggctgagacga

SEQ ID NO: 765511 - DNA, 22 bp, Artificial Sequence
  chemically synthesized
tatatctagaaaaccccatcgt

SEQ ID NO: 765512 - DNA, 22 bp, Artificial Sequence
  chemically synthesized
tgggctgagacgatggggtttt

SEQ ID NO: 765513 - DNA, 22 bp, Artificial Sequence
  chemically synthesized
gggctgagacgatggggttttc

SEQ ID NO: 765514 - DNA, 22 bp, Artificial Sequence
  chemically synthesized
ggctgagacgatggggttttct

SEQ ID NO: 765515 - DNA, 22 bp, Artificial Sequence
  chemically synthesized
agacgatggggttttctagata

SEQ ID NO: 765516 - DNA, 22 bp, Artificial Sequence
  chemically synthesized
cagacgacatgattgtatatct

SEQ ID NO: 765517 - DNA, 22 bp, Artificial Sequence
  chemically synthesized
gcagacgacatgattgtatatc

SEQ ID NO: 765518 - DNA, 22 bp, Artificial Sequence
  chemically synthesized
tttgcagacgacatgattgtat

SEQ ID NO: 765519 - DNA, 22 bp, Artificial Sequence
  chemically synthesized
tctagatatacaatcatgtcgt

SEQ ID NO: 765520 - DNA, 22 bp, Artificial Sequence
  chemically synthesized
ctagatatacaatcatgtcgtc

SEQ ID NO: 765521 - DNA, 22 bp, Artificial Sequence
  chemically synthesized
tccctgtttgcagacgacatga

SEQ ID NO: 765522 - DNA, 22 bp, Artificial Sequence
  chemically synthesized
tagatatacaatcatgtcgtct

SEQ ID NO: 765523 - DNA, 22 bp, Artificial Sequence
  chemically synthesized
gatatacaatcatgtcgtctgc

SEQ ID NO: 765524 - DNA, 22 bp, Artificial Sequence
  chemically synthesized
ggaaaagaggaagtcaaattgt

SEQ ID NO: 765525 - DNA, 22 bp, Artificial Sequence
  chemically synthesized
caaacagggacaatttgacttc

SEQ ID NO: 765526 - DNA, 22 bp, Artificial Sequence
  chemically synthesized
aattaggaaaagaggaagtcaa

SEQ ID NO: 765527 - DNA, 22 bp, Artificial Sequence
  chemically synthesized
gacttcctcttttcctaattga

SEQ ID NO: 765528 - DNA, 22 bp, Artificial Sequence
  chemically synthesized
acttcctcttttcctaattgaa

SEQ ID NO: 765529 - DNA, 22 bp, Artificial Sequence
  chemically synthesized
cctcttttcctaattgaatacc

SEQ ID NO: 765530 - DNA, 22 bp, Artificial Sequence
  chemically synthesized
ctcttttcctaattgaataccc

SEQ ID NO: 765531 - DNA, 22 bp, Artificial Sequence
  chemically synthesized
ttttcctaattgaatacccttt

SEQ ID NO: 765532 - DNA, 22 bp, Artificial Sequence
  chemically synthesized
ttcctaattgaataccctttat

SEQ ID NO: 765533 - DNA, 22 bp, Artificial Sequence
  chemically synthesized
tcctaattgaataccctttatt

SEQ ID NO: 765534 - DNA, 22 bp, Artificial Sequence
  chemically synthesized
cctaattgaataccctttattt

SEQ ID NO: 765535 - DNA, 22 bp, Artificial Sequence
  chemically synthesized
ctaattgaataccctttatttc

SEQ ID NO: 765536 - DNA, 22 bp, Artificial Sequence
  chemically synthesized
attgaataccctttatttcctt

SEQ ID NO: 765537 - DNA, 22 bp, Artificial Sequence
  chemically synthesized
aataccctttatttccttctcc

SEQ ID NO: 765538 - DNA, 22 bp, Artificial Sequence
  chemically synthesized
gccagggcaatcaggcaggaga

SEQ ID NO: 765539 - DNA, 22 bp, Artificial Sequence
  chemically synthesized
tggccagggcaatcaggcagga

SEQ ID NO: 765540 - DNA, 22 bp, Artificial Sequence
  chemically synthesized
tatttccttctcctgcctgatt

SEQ ID NO: 765541 - DNA, 22 bp, Artificial Sequence
  chemically synthesized
atttccttctcctgcctgattg

SEQ ID NO: 765542 - DNA, 22 bp, Artificial Sequence
  chemically synthesized
tttccttctcctgcctgattgc

SEQ ID NO: 765543 - DNA, 22 bp, Artificial Sequence
  chemically synthesized
ccttctcctgcctgattgccct

SEQ ID NO: 765544 - DNA, 22 bp, Artificial Sequence
  chemically synthesized
gaagttctggccagggcaatca

SEQ ID NO: 765545 - DNA, 22 bp, Artificial Sequence
  chemically synthesized
cttctcctgcctgattgccctg

SEQ ID NO: 765546 - DNA, 22 bp, Artificial Sequence
  chemically synthesized
ctcctgcctgattgccctggcc

SEQ ID NO: 765547 - DNA, 22 bp, Artificial Sequence
  chemically synthesized
tcctgcctgattgccctggcca

SEQ ID NO: 765548 - DNA, 22 bp, Artificial Sequence
  chemically synthesized
ctgcctgattgccctggccaga

SEQ ID NO: 765549 - DNA, 22 bp, Artificial Sequence
  chemically synthesized
cctgattgccctggccagaact

SEQ ID NO: 765550 - DNA, 22 bp, Artificial Sequence
  chemically synthesized
aacatagtgttggaagttctgg

SEQ ID NO: 765551 - DNA, 22 bp, Artificial Sequence
  chemically synthesized
attgccctggccagaacttcca

SEQ ID NO: 765552 - DNA, 22 bp, Artificial Sequence
  chemically synthesized
ttcaacatagtgttggaagttc

SEQ ID NO: 765553 - DNA, 22 bp, Artificial Sequence
  chemically synthesized
ccctggccagaacttccaacac

SEQ ID NO: 765554 - DNA, 22 bp, Artificial Sequence
  chemically synthesized
ctattcaacatagtgttggaag

SEQ ID NO: 765555 - DNA, 22 bp, Artificial Sequence
  chemically synthesized
gccagaacttccaacactatgt

SEQ ID NO: 765556 - DNA, 22 bp, Artificial Sequence
  chemically synthesized
accactcctattcaacatagtg

SEQ ID NO: 765557 - DNA, 22 bp, Artificial Sequence
  chemically synthesized
tcaccactcctattcaacatag

SEQ ID NO: 765558 - DNA, 22 bp, Artificial Sequence
  chemically synthesized
tctcaccactcctattcaacat

SEQ ID NO: 765559 - DNA, 22 bp, Artificial Sequence
  chemically synthesized
ccaacactatgttgaataggag

SEQ ID NO: 765560 - DNA, 22 bp, Artificial Sequence
  chemically synthesized
caacactatgttgaataggagt

SEQ ID NO: 765561 - DNA, 22 bp, Artificial Sequence
  chemically synthesized
tgttgaataggagtggtgagag

SEQ ID NO: 765562 - DNA, 22 bp, Artificial Sequence
  chemically synthesized
aataggagtggtgagagagggc

SEQ ID NO: 765563 - DNA, 22 bp, Artificial Sequence
  chemically synthesized
gcacaagacagggatgccctct

SEQ ID NO: 765564 - DNA, 22 bp, Artificial Sequence
  chemically synthesized
ttggcacaagacagggatgccc

SEQ ID NO: 765565 - DNA, 22 bp, Artificial Sequence
  chemically synthesized
attggcacaagacagggatgcc

SEQ ID NO: 765566 - DNA, 22 bp, Artificial Sequence
  chemically synthesized
aatgatgagtttattggcacaa

SEQ ID NO: 765567 - DNA, 22 bp, Artificial Sequence
  chemically synthesized
aaatgatgagtttattggcaca

SEQ ID NO: 765568 - DNA, 22 bp, Artificial Sequence
  chemically synthesized
taaatgatgagtttattggcac

SEQ ID NO: 765569 - DNA, 22 bp, Artificial Sequence
  chemically synthesized
tcttgtgccaataaactcatca

SEQ ID NO: 765570 - DNA, 22 bp, Artificial Sequence
  chemically synthesized
gtgccaataaactcatcattta

SEQ ID NO: 765571 - DNA, 22 bp, Artificial Sequence
  chemically synthesized
aggtgtagtctttaaatgatga

SEQ ID NO: 765572 - DNA, 22 bp, Artificial Sequence
  chemically synthesized
tgccaataaactcatcatttaa

SEQ ID NO: 765573 - DNA, 22 bp, Artificial Sequence
  chemically synthesized
agtctgaggtgtagtctttaaa

SEQ ID NO: 765574 - DNA, 22 bp, Artificial Sequence
  chemically synthesized
cctgagtctgaggtgtagtctt

SEQ ID NO: 765575 - DNA, 22 bp, Artificial Sequence
  chemically synthesized
atcatttaaagactacacctca

SEQ ID NO: 765576 - DNA, 22 bp, Artificial Sequence
  chemically synthesized
tgctacctgagtctgaggtgta

SEQ ID NO: 765577 - DNA, 22 bp, Artificial Sequence
  chemically synthesized
gtgctacctgagtctgaggtgt

SEQ ID NO: 765578 - DNA, 22 bp, Artificial Sequence
  chemically synthesized
tgtgctacctgagtctgaggtg

SEQ ID NO: 765579 - DNA, 22 bp, Artificial Sequence
  chemically synthesized
ttgtgctacctgagtctgaggt

SEQ ID NO: 765580 - DNA, 22 bp, Artificial Sequence
  chemically synthesized
ttttgtgctacctgagtctgag

SEQ ID NO: 765581 - DNA, 22 bp, Artificial Sequence
  chemically synthesized
aaagactacacctcagactcag

SEQ ID NO: 765582 - DNA, 22 bp, Artificial Sequence
  chemically synthesized
aagactacacctcagactcagg

SEQ ID NO: 765583 - DNA, 22 bp, Artificial Sequence
  chemically synthesized
ctcttttgtgctacctgagtct

SEQ ID NO: 765584 - DNA, 22 bp, Artificial Sequence
  chemically synthesized
gctcttttgtgctacctgagtc

SEQ ID NO: 765585 - DNA, 22 bp, Artificial Sequence
  chemically synthesized
tgctcttttgtgctacctgagt

SEQ ID NO: 765586 - DNA, 22 bp, Artificial Sequence
  chemically synthesized
ttgctcttttgtgctacctgag

SEQ ID NO: 765587 - DNA, 22 bp, Artificial Sequence
  chemically synthesized
cacctcagactcaggtagcaca

SEQ ID NO: 765588 - DNA, 22 bp, Artificial Sequence
  chemically synthesized
agactcaggtagcacaaaagag

SEQ ID NO: 765589 - DNA, 22 bp, Artificial Sequence
  chemically synthesized
catatcaatcttttgctctttt

SEQ ID NO: 765590 - DNA, 22 bp, Artificial Sequence
  chemically synthesized
tccatatcaatcttttgctctt

SEQ ID NO: 765591 - DNA, 22 bp, Artificial Sequence
  chemically synthesized
aggtagcacaaaagagcaaaag

SEQ ID NO: 765592 - DNA, 22 bp, Artificial Sequence
  chemically synthesized
attctccatatcaatcttttgc

SEQ ID NO: 765593 - DNA, 22 bp, Artificial Sequence
  chemically synthesized
gattctccatatcaatcttttg

SEQ ID NO: 765594 - DNA, 22 bp, Artificial Sequence
  chemically synthesized
cacttgattctccatatcaatc

SEQ ID NO: 765595 - DNA, 22 bp, Artificial Sequence
  chemically synthesized
agaactccacttgattctccat

SEQ ID NO: 765596 - DNA, 22 bp, Artificial Sequence
  chemically synthesized
cccactgagaactccacttgat

SEQ ID NO: 765597 - DNA, 22 bp, Artificial Sequence
  chemically synthesized
atatggagaatcaagtggagtt

SEQ ID NO: 765598 - DNA, 22 bp, Artificial Sequence
  chemically synthesized
gctacccactgagaactccact

SEQ ID NO: 765599 - DNA, 22 bp, Artificial Sequence
  chemically synthesized
tccagattggctacccactgag

SEQ ID NO: 765600 - DNA, 22 bp, Artificial Sequence
  chemically synthesized
gtccagattggctacccactga

SEQ ID NO: 765601 - DNA, 22 bp, Artificial Sequence
  chemically synthesized
tgtccagattggctacccactg

SEQ ID NO: 765602 - DNA, 22 bp, Artificial Sequence
  chemically synthesized
tcctttgtccagattggctacc

SEQ ID NO: 765603 - DNA, 22 bp, Artificial Sequence
  chemically synthesized
tcagtgggtagccaatctggac

SEQ ID NO: 765604 - DNA, 22 bp, Artificial Sequence
  chemically synthesized
agtgggtagccaatctggacaa

SEQ ID NO: 765605 - DNA, 22 bp, Artificial Sequence
  chemically synthesized
tgaaaattatcctttgtccaga

SEQ ID NO: 765606 - DNA, 22 bp, Artificial Sequence
  chemically synthesized
tatgaaaattatcctttgtcca

SEQ ID NO: 765607 - DNA, 22 bp, Artificial Sequence
  chemically synthesized
ctatgaaaattatcctttgtcc

SEQ ID NO: 765608 - DNA, 22 bp, Artificial Sequence
  chemically synthesized
tccaaaaatttctatgaaaatt

SEQ ID NO: 765609 - DNA, 22 bp, Artificial Sequence
  chemically synthesized
gacaaaggataattttcataga

SEQ ID NO: 765610 - DNA, 22 bp, Artificial Sequence
  chemically synthesized
tcatagaaatttttggatagtt

SEQ ID NO: 765611 - DNA, 22 bp, Artificial Sequence
  chemically synthesized
catagaaatttttggatagttt

SEQ ID NO: 765612 - DNA, 22 bp, Artificial Sequence
  chemically synthesized
atagaaatttttggatagtttt

SEQ ID NO: 765613 - DNA, 22 bp, Artificial Sequence
  chemically synthesized
agtcagaagtgaaataaaacta

SEQ ID NO: 765614 - DNA, 22 bp, Artificial Sequence
  chemically synthesized
gttaagtcagaagtgaaataaa

SEQ ID NO: 765615 - DNA, 22 bp, Artificial Sequence
  chemically synthesized
tagttaagtcagaagtgaaata

SEQ ID NO: 765616 - DNA, 22 bp, Artificial Sequence
  chemically synthesized
ttggatagttttatttcacttc

SEQ ID NO: 765617 - DNA, 22 bp, Artificial Sequence
  chemically synthesized
ctagttaagtcagaagtgaaat

SEQ ID NO: 765618 - DNA, 22 bp, Artificial Sequence
  chemically synthesized
tggatagttttatttcacttct

SEQ ID NO: 765619 - DNA, 22 bp, Artificial Sequence
  chemically synthesized
tctagttaagtcagaagtgaaa

SEQ ID NO: 765620 - DNA, 22 bp, Artificial Sequence
  chemically synthesized
ggatagttttatttcacttctg

SEQ ID NO: 765621 - DNA, 22 bp, Artificial Sequence
  chemically synthesized
ttctagttaagtcagaagtgaa

SEQ ID NO: 765622 - DNA, 22 bp, Artificial Sequence
  chemically synthesized
gatagttttatttcacttctga

SEQ ID NO: 765623 - DNA, 22 bp, Artificial Sequence
  chemically synthesized
tatttcacttctgacttaacta

SEQ ID NO: 765624 - DNA, 22 bp, Artificial Sequence
  chemically synthesized
aatgatcttttctagttaagtc

SEQ ID NO: 765625 - DNA, 22 bp, Artificial Sequence
  chemically synthesized
atttcacttctgacttaactag

SEQ ID NO: 765626 - DNA, 22 bp, Artificial Sequence
  chemically synthesized
gaatgatcttttctagttaagt

SEQ ID NO: 765627 - DNA, 22 bp, Artificial Sequence
  chemically synthesized
tttcacttctgacttaactaga

SEQ ID NO: 765628 - DNA, 22 bp, Artificial Sequence
  chemically synthesized
cacttctgacttaactagaaaa

SEQ ID NO: 765629 - DNA, 22 bp, Artificial Sequence
  chemically synthesized
acttctgacttaactagaaaag

SEQ ID NO: 765630 - DNA, 22 bp, Artificial Sequence
  chemically synthesized
ctgacttaactagaaaagatca

SEQ ID NO: 765631 - DNA, 22 bp, Artificial Sequence
  chemically synthesized
tgacttaactagaaaagatcat

SEQ ID NO: 765632 - DNA, 22 bp, Artificial Sequence
  chemically synthesized
acttaactagaaaagatcattc

SEQ ID NO: 765633 - DNA, 22 bp, Artificial Sequence
  chemically synthesized
aactagaaaagatcattcaagc

SEQ ID NO: 765634 - DNA, 22 bp, Artificial Sequence
  chemically synthesized
actagaaaagatcattcaagcc

SEQ ID NO: 765635 - DNA, 22 bp, Artificial Sequence
  chemically synthesized
gaaaagatcattcaagccttca

SEQ ID NO: 765636 - DNA, 22 bp, Artificial Sequence
  chemically synthesized
gagagcatacagtgaatgcagt

SEQ ID NO: 765637 - DNA, 22 bp, Artificial Sequence
  chemically synthesized
aagccttcattactgcattcac

SEQ ID NO: 765638 - DNA, 22 bp, Artificial Sequence
  chemically synthesized
cattactgcattcactgtatgc

SEQ ID NO: 765639 - DNA, 22 bp, Artificial Sequence
  chemically synthesized
attactgcattcactgtatgct

SEQ ID NO: 765640 - DNA, 22 bp, Artificial Sequence
  chemically synthesized
ctgcattcactgtatgctctct

SEQ ID NO: 765641 - DNA, 22 bp, Artificial Sequence
  chemically synthesized
cattcactgtatgctctctaat

SEQ ID NO: 765642 - DNA, 22 bp, Artificial Sequence
  chemically synthesized
actgtatgctctctaatttttt

SEQ ID NO: 765643 - DNA, 22 bp, Artificial Sequence
  chemically synthesized
tatgctctctaatttttttctt

SEQ ID NO: 765644 - DNA, 22 bp, Artificial Sequence
  chemically synthesized
caatcacaaaaaagaagaaaaa

SEQ ID NO: 765645 - DNA, 22 bp, Artificial Sequence
  chemically synthesized
tctaatttttttcttctttttt

SEQ ID NO: 765646 - DNA, 22 bp, Artificial Sequence
  chemically synthesized
taatttttttcttcttttttgt

SEQ ID NO: 765647 - DNA, 22 bp, Artificial Sequence
  chemically synthesized
aagactacaatcacaaaaaaga

SEQ ID NO: 765648 - DNA, 22 bp, Artificial Sequence
  chemically synthesized
atttttttcttcttttttgtga

SEQ ID NO: 765649 - DNA, 22 bp, Artificial Sequence
  chemically synthesized
ctaaagactacaatcacaaaaa

SEQ ID NO: 765650 - DNA, 22 bp, Artificial Sequence
  chemically synthesized
cctaaagactacaatcacaaaa

SEQ ID NO: 765651 - DNA, 22 bp, Artificial Sequence
  chemically synthesized
tcctaaagactacaatcacaaa

SEQ ID NO: 765652 - DNA, 22 bp, Artificial Sequence
  chemically synthesized
ttttcttcttttttgtgattgt

SEQ ID NO: 765653 - DNA, 22 bp, Artificial Sequence
  chemically synthesized
ttcctaaagactacaatcacaa

SEQ ID NO: 765654 - DNA, 22 bp, Artificial Sequence
  chemically synthesized
tttcttcttttttgtgattgta

SEQ ID NO: 765655 - DNA, 22 bp, Artificial Sequence
  chemically synthesized
ttcttcttttttgtgattgtag

SEQ ID NO: 765656 - DNA, 22 bp, Artificial Sequence
  chemically synthesized
tcttcttttttgtgattgtagt

SEQ ID NO: 765657 - DNA, 22 bp, Artificial Sequence
  chemically synthesized
cttttcctaaagactacaatca

SEQ ID NO: 765658 - DNA, 22 bp, Artificial Sequence
  chemically synthesized
cttcttttttgtgattgtagtc

SEQ ID NO: 765659 - DNA, 22 bp, Artificial Sequence
  chemically synthesized
ttcttttttgtgattgtagtct

SEQ ID NO: 765660 - DNA, 22 bp, Artificial Sequence
  chemically synthesized
ttgcttttcctaaagactacaa

SEQ ID NO: 765661 - DNA, 22 bp, Artificial Sequence
  chemically synthesized
cttttttgtgattgtagtcttt

SEQ ID NO: 765662 - DNA, 22 bp, Artificial Sequence
  chemically synthesized
ttttttgtgattgtagtcttta

SEQ ID NO: 765663 - DNA, 22 bp, Artificial Sequence
  chemically synthesized
ttttgtgattgtagtctttagg

SEQ ID NO: 765664 - DNA, 22 bp, Artificial Sequence
  chemically synthesized
gttattgcttttcctaaagact

SEQ ID NO: 765665 - DNA, 22 bp, Artificial Sequence
  chemically synthesized
tttgtgattgtagtctttagga

SEQ ID NO: 765666 - DNA, 22 bp, Artificial Sequence
  chemically synthesized
ttgtgattgtagtctttaggaa

SEQ ID NO: 765667 - DNA, 22 bp, Artificial Sequence
  chemically synthesized
tgtgattgtagtctttaggaaa

SEQ ID NO: 765668 - DNA, 22 bp, Artificial Sequence
  chemically synthesized
gtgattgtagtctttaggaaaa

SEQ ID NO: 765669 - DNA, 22 bp, Artificial Sequence
  chemically synthesized
attcgttattgcttttcctaaa

SEQ ID NO: 765670 - DNA, 22 bp, Artificial Sequence
  chemically synthesized
tgattgtagtctttaggaaaag

SEQ ID NO: 765671 - DNA, 22 bp, Artificial Sequence
  chemically synthesized
ttcattcgttattgcttttcct

SEQ ID NO: 765672 - DNA, 22 bp, Artificial Sequence
  chemically synthesized
gttcattcgttattgcttttcc

SEQ ID NO: 765673 - DNA, 22 bp, Artificial Sequence
  chemically synthesized
tgttcattcgttattgcttttc

SEQ ID NO: 765674 - DNA, 22 bp, Artificial Sequence
  chemically synthesized
tagtctttaggaaaagcaataa

SEQ ID NO: 765675 - DNA, 22 bp, Artificial Sequence
  chemically synthesized
ccctttgttcattcgttattgc

SEQ ID NO: 765676 - DNA, 22 bp, Artificial Sequence
  chemically synthesized
cccctttgttcattcgttattg

SEQ ID NO: 765677 - DNA, 22 bp, Artificial Sequence
  chemically synthesized
tcccctttgttcattcgttatt

SEQ ID NO: 765678 - DNA, 22 bp, Artificial Sequence
  chemically synthesized
ttcccctttgttcattcgttat

SEQ ID NO: 765679 - DNA, 22 bp, Artificial Sequence
  chemically synthesized
taggaaaagcaataacgaatga

SEQ ID NO: 765680 - DNA, 22 bp, Artificial Sequence
  chemically synthesized
aggaaaagcaataacgaatgaa

SEQ ID NO: 765681 - DNA, 22 bp, Artificial Sequence
  chemically synthesized
ggaaaagcaataacgaatgaac

SEQ ID NO: 765682 - DNA, 22 bp, Artificial Sequence
  chemically synthesized
ccttttcccctttgttcattcg

SEQ ID NO: 765683 - DNA, 22 bp, Artificial Sequence
  chemically synthesized
tgtaacaactaccttttcccct

SEQ ID NO: 765684 - DNA, 22 bp, Artificial Sequence
  chemically synthesized
ttatgtaacaactaccttttcc

SEQ ID NO: 765685 - DNA, 22 bp, Artificial Sequence
  chemically synthesized
gttatgtaacaactaccttttc

SEQ ID NO: 765686 - DNA, 22 bp, Artificial Sequence
  chemically synthesized
tgttatgtaacaactacctttt

SEQ ID NO: 765687 - DNA, 22 bp, Artificial Sequence
  chemically synthesized
ttgttatgtaacaactaccttt

SEQ ID NO: 765688 - DNA, 22 bp, Artificial Sequence
  chemically synthesized
tggtttttgttatgtaacaact

SEQ ID NO: 765689 - DNA, 22 bp, Artificial Sequence
  chemically synthesized
ctatggtttttgttatgtaaca

SEQ ID NO: 765690 - DNA, 22 bp, Artificial Sequence
  chemically synthesized
ctgctatggtttttgttatgta

SEQ ID NO: 765691 - DNA, 22 bp, Artificial Sequence
  chemically synthesized
ctgctgctatggtttttgttat

SEQ ID NO: 765692 - DNA, 22 bp, Artificial Sequence
  chemically synthesized
ctgctgctgctatggtttttgt

SEQ ID NO: 765693 - DNA, 22 bp, Artificial Sequence
  chemically synthesized
ctgctgctgctgctatggtttt

SEQ ID NO: 765694 - DNA, 22 bp, Artificial Sequence
  chemically synthesized
ttacataacaaaaaccatagca

SEQ ID NO: 765695 - DNA, 22 bp, Artificial Sequence
  chemically synthesized
ctgctgctgctgctgctatggt

SEQ ID NO: 765696 - DNA, 22 bp, Artificial Sequence
  chemically synthesized
gctgctgctgctgctgctatgg

SEQ ID NO: 765697 - DNA, 22 bp, Artificial Sequence
  chemically synthesized
cataacaaaaaccatagcagca

SEQ ID NO: 765698 - DNA, 22 bp, Artificial Sequence
  chemically synthesized
ttgctgctgctgctgctgctat

SEQ ID NO: 765699 - DNA, 22 bp, Artificial Sequence
  chemically synthesized
ttcttgctgctgctgctgctgc

SEQ ID NO: 765700 - DNA, 22 bp, Artificial Sequence
  chemically synthesized
ttgttcttgctgctgctgctgc

SEQ ID NO: 765701 - DNA, 22 bp, Artificial Sequence
  chemically synthesized
atgtatgttgttgttcttgctg

SEQ ID NO: 765702 - DNA, 22 bp, Artificial Sequence
  chemically synthesized
atgtacagtaaggttcatgtat

SEQ ID NO: 765703 - DNA, 22 bp, Artificial Sequence
  chemically synthesized
gacagcacctgatgtacagtaa

SEQ ID NO: 765704 - DNA, 22 bp, Artificial Sequence
  chemically synthesized
ggacagcacctgatgtacagta

SEQ ID NO: 765705 - DNA, 22 bp, Artificial Sequence
  chemically synthesized
tggacagcacctgatgtacagt

SEQ ID NO: 765706 - DNA, 22 bp, Artificial Sequence
  chemically synthesized
actgtacatcaggtgctgtcca

SEQ ID NO: 765707 - DNA, 22 bp, Artificial Sequence
  chemically synthesized
ctgtacatcaggtgctgtccaa

SEQ ID NO: 765708 - DNA, 22 bp, Artificial Sequence
  chemically synthesized
tacatcaggtgctgtccaaagc

SEQ ID NO: 765709 - DNA, 22 bp, Artificial Sequence
  chemically synthesized
atgtatatacagtgctttggac

SEQ ID NO: 765710 - DNA, 22 bp, Artificial Sequence
  chemically synthesized
tccaaagcactgtatatacatg

SEQ ID NO: 765711 - DNA, 22 bp, Artificial Sequence
  chemically synthesized
agaggagaaaatgagctcatgt

SEQ ID NO: 765712 - DNA, 22 bp, Artificial Sequence
  chemically synthesized
ttgagaggagaaaatgagctca

SEQ ID NO: 765713 - DNA, 22 bp, Artificial Sequence
  chemically synthesized
tatatacatgagctcattttct

SEQ ID NO: 765714 - DNA, 22 bp, Artificial Sequence
  chemically synthesized
gagggttgttgagaggagaaaa

SEQ ID NO: 765715 - DNA, 22 bp, Artificial Sequence
  chemically synthesized
ccctagagggttgttgagagga

SEQ ID NO: 765716 - DNA, 22 bp, Artificial Sequence
  chemically synthesized
attttctcctctcaacaaccct

SEQ ID NO: 765717 - DNA, 22 bp, Artificial Sequence
  chemically synthesized
tctcctctcaacaaccctctag

SEQ ID NO: 765718 - DNA, 22 bp, Artificial Sequence
  chemically synthesized
ctcctctcaacaaccctctagg

SEQ ID NO: 765719 - DNA, 22 bp, Artificial Sequence
  chemically synthesized
tcctctcaacaaccctctaggg

SEQ ID NO: 765720 - DNA, 22 bp, Artificial Sequence
  chemically synthesized
ctctcaacaaccctctagggta

SEQ ID NO: 765721 - DNA, 22 bp, Artificial Sequence
  chemically synthesized
tcaacaaccctctagggtaggg

SEQ ID NO: 765722 - DNA, 22 bp, Artificial Sequence
  chemically synthesized
aacaaccctctagggtaggggc

SEQ ID NO: 765723 - DNA, 22 bp, Artificial Sequence
  chemically synthesized
tagggtaggggctactattatc

SEQ ID NO: 765724 - DNA, 22 bp, Artificial Sequence
  chemically synthesized
tatggaaaatgaagataatagt

SEQ ID NO: 765725 - DNA, 22 bp, Artificial Sequence
  chemically synthesized
gggtaggggctactattatctt

SEQ ID NO: 765726 - DNA, 22 bp, Artificial Sequence
  chemically synthesized
atatggaaaatgaagataatag

SEQ ID NO: 765727 - DNA, 22 bp, Artificial Sequence
  chemically synthesized
tcttatatggaaaatgaagata

SEQ ID NO: 765728 - DNA, 22 bp, Artificial Sequence
  chemically synthesized
attatcttatatggaaaatgaa

SEQ ID NO: 765729 - DNA, 22 bp, Artificial Sequence
  chemically synthesized
cattatcttatatggaaaatga

SEQ ID NO: 765730 - DNA, 22 bp, Artificial Sequence
  chemically synthesized
ctattatcttcattttccatat

SEQ ID NO: 765731 - DNA, 22 bp, Artificial Sequence
  chemically synthesized
ttatcttcattttccatataag

SEQ ID NO: 765732 - DNA, 22 bp, Artificial Sequence
  chemically synthesized
tcttcattttccatataagata

SEQ ID NO: 765733 - DNA, 22 bp, Artificial Sequence
  chemically synthesized
cagtagtttcattatcttatat

SEQ ID NO: 765734 - DNA, 22 bp, Artificial Sequence
  chemically synthesized
acagtagtttcattatcttata

SEQ ID NO: 765735 - DNA, 22 bp, Artificial Sequence
  chemically synthesized
cattttccatataagataatga

SEQ ID NO: 765736 - DNA, 22 bp, Artificial Sequence
  chemically synthesized
attttccatataagataatgaa

SEQ ID NO: 765737 - DNA, 22 bp, Artificial Sequence
  chemically synthesized
accttacagtagtttcattatc

SEQ ID NO: 765738 - DNA, 22 bp, Artificial Sequence
  chemically synthesized
tccatataagataatgaaacta

SEQ ID NO: 765739 - DNA, 22 bp, Artificial Sequence
  chemically synthesized
ccatataagataatgaaactac

SEQ ID NO: 765740 - DNA, 22 bp, Artificial Sequence
  chemically synthesized
gttaaccttacagtagtttcat

SEQ ID NO: 765741 - DNA, 22 bp, Artificial Sequence
  chemically synthesized
catataagataatgaaactact

SEQ ID NO: 765742 - DNA, 22 bp, Artificial Sequence
  chemically synthesized
agttaaccttacagtagtttca

SEQ ID NO: 765743 - DNA, 22 bp, Artificial Sequence
  chemically synthesized
tagttaaccttacagtagtttc

SEQ ID NO: 765744 - DNA, 22 bp, Artificial Sequence
  chemically synthesized
ttagttaaccttacagtagttt

SEQ ID NO: 765745 - DNA, 22 bp, Artificial Sequence
  chemically synthesized
ggcatttttagttaaccttaca

SEQ ID NO: 765746 - DNA, 22 bp, Artificial Sequence
  chemically synthesized
tgtgaacctgggcatttttagt

SEQ ID NO: 765747 - DNA, 22 bp, Artificial Sequence
  chemically synthesized
ctgtaaggttaactaaaaatgc

SEQ ID NO: 765748 - DNA, 22 bp, Artificial Sequence
  chemically synthesized
taaggttaactaaaaatgccca

SEQ ID NO: 765749 - DNA, 22 bp, Artificial Sequence
  chemically synthesized
gctgtgtgaacctgggcatttt

SEQ ID NO: 765750 - DNA, 22 bp, Artificial Sequence
  chemically synthesized
ttagctgtgtgaacctgggcat

SEQ ID NO: 765751 - DNA, 22 bp, Artificial Sequence
  chemically synthesized
attagctgtgtgaacctgggca

SEQ ID NO: 765752 - DNA, 22 bp, Artificial Sequence
  chemically synthesized
actaaaaatgcccaggttcaca

SEQ ID NO: 765753 - DNA, 22 bp, Artificial Sequence
  chemically synthesized
catttattagctgtgtgaacct

SEQ ID NO: 765754 - DNA, 22 bp, Artificial Sequence
  chemically synthesized
aaaatgcccaggttcacacagc

SEQ ID NO: 765755 - DNA, 22 bp, Artificial Sequence
  chemically synthesized
ctgcatttattagctgtgtgaa

SEQ ID NO: 765756 - DNA, 22 bp, Artificial Sequence
  chemically synthesized
gctgcatttattagctgtgtga

SEQ ID NO: 765757 - DNA, 22 bp, Artificial Sequence
  chemically synthesized
aatcttgctgcatttattagct

SEQ ID NO: 765758 - DNA, 22 bp, Artificial Sequence
  chemically synthesized
taaatcttgctgcatttattag

SEQ ID NO: 765759 - DNA, 22 bp, Artificial Sequence
  chemically synthesized
acacagctaataaatgcagcaa

SEQ ID NO: 765760 - DNA, 22 bp, Artificial Sequence
  chemically synthesized
acgaggttctaaatcttgctgc

SEQ ID NO: 765761 - DNA, 22 bp, Artificial Sequence
  chemically synthesized
actgacgaggttctaaatcttg

SEQ ID NO: 765762 - DNA, 22 bp, Artificial Sequence
  chemically synthesized
ataaatgcagcaagatttagaa

SEQ ID NO: 765763 - DNA, 22 bp, Artificial Sequence
  chemically synthesized
aagtctgactgacgaggttcta

SEQ ID NO: 765764 - DNA, 22 bp, Artificial Sequence
  chemically synthesized
agaacctcgtcagtcagacttc

SEQ ID NO: 765765 - DNA, 22 bp, Artificial Sequence
  chemically synthesized
gaacctcgtcagtcagacttca

SEQ ID NO: 765766 - DNA, 22 bp, Artificial Sequence
  chemically synthesized
agagcacaatccctgaagtctg

SEQ ID NO: 765767 - DNA, 22 bp, Artificial Sequence
  chemically synthesized
gtcagtcagacttcagggattg

SEQ ID NO: 765768 - DNA, 22 bp, Artificial Sequence
  chemically synthesized
gtggctaagagcacaatccctg

SEQ ID NO: 765769 - DNA, 22 bp, Artificial Sequence
  chemically synthesized
cagggattgtgctcttagccac

SEQ ID NO: 765770 - DNA, 22 bp, Artificial Sequence
  chemically synthesized
agggattgtgctcttagccact

SEQ ID NO: 765771 - DNA, 22 bp, Artificial Sequence
  chemically synthesized
aaaggtaatatagcctagtggc

SEQ ID NO: 765772 - DNA, 22 bp, Artificial Sequence
  chemically synthesized
gaaaggtaatatagcctagtgg

SEQ ID NO: 765773 - DNA, 22 bp, Artificial Sequence
  chemically synthesized
tgctcttagccactaggctata

SEQ ID NO: 765774 - DNA, 22 bp, Artificial Sequence
  chemically synthesized
aacttgaaaggtaatatagcct

SEQ ID NO: 765775 - DNA, 22 bp, Artificial Sequence
  chemically synthesized
ttagccactaggctatattacc

SEQ ID NO: 765776 - DNA, 22 bp, Artificial Sequence
  chemically synthesized
agccactaggctatattacctt

SEQ ID NO: 765777 - DNA, 22 bp, Artificial Sequence
  chemically synthesized
gccactaggctatattaccttt

SEQ ID NO: 765778 - DNA, 22 bp, Artificial Sequence
  chemically synthesized
ggctatattacctttcaagttt

SEQ ID NO: 765779 - DNA, 22 bp, Artificial Sequence
  chemically synthesized
ccaccaacaactaaacttgaaa

SEQ ID NO: 765780 - DNA, 22 bp, Artificial Sequence
  chemically synthesized
tattacctttcaagtttagttg

SEQ ID NO: 765781 - DNA, 22 bp, Artificial Sequence
  chemically synthesized
cctttcaagtttagttgttggt

SEQ ID NO: 765782 - DNA, 22 bp, Artificial Sequence
  chemically synthesized
ataggaaaaactaccaccaaca

SEQ ID NO: 765783 - DNA, 22 bp, Artificial Sequence
  chemically synthesized
tcaagtttagttgttggtggta

SEQ ID NO: 765784 - DNA, 22 bp, Artificial Sequence
  chemically synthesized
caagtttagttgttggtggtag

SEQ ID NO: 765785 - DNA, 22 bp, Artificial Sequence
  chemically synthesized
aagtttagttgttggtggtagt

SEQ ID NO: 765786 - DNA, 22 bp, Artificial Sequence
  chemically synthesized
ttaataggaaaaactaccacca

SEQ ID NO: 765787 - DNA, 22 bp, Artificial Sequence
  chemically synthesized
agttgttggtggtagtttttcc

SEQ ID NO: 765788 - DNA, 22 bp, Artificial Sequence
  chemically synthesized
gttgttggtggtagtttttcct

SEQ ID NO: 765789 - DNA, 22 bp, Artificial Sequence
  chemically synthesized
ttggtggtagtttttcctatta

SEQ ID NO: 765790 - DNA, 22 bp, Artificial Sequence
  chemically synthesized
ggtagtagcattattaatagga

SEQ ID NO: 765791 - DNA, 22 bp, Artificial Sequence
  chemically synthesized
gtggtagtttttcctattaata

SEQ ID NO: 765792 - DNA, 22 bp, Artificial Sequence
  chemically synthesized
aggtagtagcattattaatagg

SEQ ID NO: 765793 - DNA, 22 bp, Artificial Sequence
  chemically synthesized
aaatttaggtagtagcattatt

SEQ ID NO: 765794 - DNA, 22 bp, Artificial Sequence
  chemically synthesized
ctaaaatttaggtagtagcatt

SEQ ID NO: 765795 - DNA, 22 bp, Artificial Sequence
  chemically synthesized
ttcctattaataatgctactac

SEQ ID NO: 765796 - DNA, 22 bp, Artificial Sequence
  chemically synthesized
gctaaaatttaggtagtagcat

SEQ ID NO: 765797 - DNA, 22 bp, Artificial Sequence
  chemically synthesized
tcctattaataatgctactacc

SEQ ID NO: 765798 - DNA, 22 bp, Artificial Sequence
  chemically synthesized
cctattaataatgctactacct

SEQ ID NO: 765799 - DNA, 22 bp, Artificial Sequence
  chemically synthesized
ctattaataatgctactaccta

SEQ ID NO: 765800 - DNA, 22 bp, Artificial Sequence
  chemically synthesized
gatttgctaaaatttaggtagt

SEQ ID NO: 765801 - DNA, 22 bp, Artificial Sequence
  chemically synthesized
ttaataatgctactacctaaat

SEQ ID NO: 765802 - DNA, 22 bp, Artificial Sequence
  chemically synthesized
ataatgctactacctaaatttt

SEQ ID NO: 765803 - DNA, 22 bp, Artificial Sequence
  chemically synthesized
atggcagtgctagatttgctaa

SEQ ID NO: 765804 - DNA, 22 bp, Artificial Sequence
  chemically synthesized
ctacctaaattttagcaaatct

SEQ ID NO: 765805 - DNA, 22 bp, Artificial Sequence
  chemically synthesized
taatggcagtgctagatttgct

SEQ ID NO: 765806 - DNA, 22 bp, Artificial Sequence
  chemically synthesized
ctaatggcagtgctagatttgc

SEQ ID NO: 765807 - DNA, 22 bp, Artificial Sequence
  chemically synthesized
cctaaattttagcaaatctagc

SEQ ID NO: 765808 - DNA, 22 bp, Artificial Sequence
  chemically synthesized
tctaatggcagtgctagatttg

SEQ ID NO: 765809 - DNA, 22 bp, Artificial Sequence
  chemically synthesized
ttttctaatggcagtgctagat

SEQ ID NO: 765810 - DNA, 22 bp, Artificial Sequence
  chemically synthesized
aattttagcaaatctagcactg

SEQ ID NO: 765811 - DNA, 22 bp, Artificial Sequence
  chemically synthesized
attttctaatggcagtgctaga

SEQ ID NO: 765812 - DNA, 22 bp, Artificial Sequence
  chemically synthesized
tattttctaatggcagtgctag

SEQ ID NO: 765813 - DNA, 22 bp, Artificial Sequence
  chemically synthesized
tagcaaatctagcactgccatt

SEQ ID NO: 765814 - DNA, 22 bp, Artificial Sequence
  chemically synthesized
agcaaatctagcactgccatta

SEQ ID NO: 765815 - DNA, 22 bp, Artificial Sequence
  chemically synthesized
tcctttattttctaatggcagt

SEQ ID NO: 765816 - DNA, 22 bp, Artificial Sequence
  chemically synthesized
gcaaatctagcactgccattag

SEQ ID NO: 765817 - DNA, 22 bp, Artificial Sequence
  chemically synthesized
acatagttatcctttattttct

SEQ ID NO: 765818 - DNA, 22 bp, Artificial Sequence
  chemically synthesized
gcactgccattagaaaataaag

SEQ ID NO: 765819 - DNA, 22 bp, Artificial Sequence
  chemically synthesized
ccattagaaaataaaggataac

SEQ ID NO: 765820 - DNA, 22 bp, Artificial Sequence
  chemically synthesized
tgtgctgacatagttatccttt

SEQ ID NO: 765821 - DNA, 22 bp, Artificial Sequence
  chemically synthesized
gtgtgctgacatagttatcctt

SEQ ID NO: 765822 - DNA, 22 bp, Artificial Sequence
  chemically synthesized
tgtgtgctgacatagttatcct

SEQ ID NO: 765823 - DNA, 22 bp, Artificial Sequence
  chemically synthesized
tttgtgtgctgacatagttatc

SEQ ID NO: 765824 - DNA, 22 bp, Artificial Sequence
  chemically synthesized
gaaaataaaggataactatgtc

SEQ ID NO: 765825 - DNA, 22 bp, Artificial Sequence
  chemically synthesized
ctctttgtgtgctgacatagtt

SEQ ID NO: 765826 - DNA, 22 bp, Artificial Sequence
  chemically synthesized
tgtcagcacacaaagagcaatt

SEQ ID NO: 765827 - DNA, 22 bp, Artificial Sequence
  chemically synthesized
ataagaccatgaaattgctctt

SEQ ID NO: 765828 - DNA, 22 bp, Artificial Sequence
  chemically synthesized
tattaataagaccatgaaattg

SEQ ID NO: 765829 - DNA, 22 bp, Artificial Sequence
  chemically synthesized
atattaataagaccatgaaatt

SEQ ID NO: 765830 - DNA, 22 bp, Artificial Sequence
  chemically synthesized
tatattaataagaccatgaaat

SEQ ID NO: 765831 - DNA, 22 bp, Artificial Sequence
  chemically synthesized
atagtctttatattaataagac

SEQ ID NO: 765832 - DNA, 22 bp, Artificial Sequence
  chemically synthesized
aatagtctttatattaataaga

SEQ ID NO: 765833 - DNA, 22 bp, Artificial Sequence
  chemically synthesized
tttaatagtctttatattaata

SEQ ID NO: 765834 - DNA, 22 bp, Artificial Sequence
  chemically synthesized
catggtcttattaatataaaga

SEQ ID NO: 765835 - DNA, 22 bp, Artificial Sequence
  chemically synthesized
atggtcttattaatataaagac

SEQ ID NO: 765836 - DNA, 22 bp, Artificial Sequence
  chemically synthesized
caaatctgtttaatagtcttta

SEQ ID NO: 765837 - DNA, 22 bp, Artificial Sequence
  chemically synthesized
ctacaaatctgtttaatagtct

SEQ ID NO: 765838 - DNA, 22 bp, Artificial Sequence
  chemically synthesized
attaatataaagactattaaac

SEQ ID NO: 765839 - DNA, 22 bp, Artificial Sequence
  chemically synthesized
ttaatataaagactattaaaca

SEQ ID NO: 765840 - DNA, 22 bp, Artificial Sequence
  chemically synthesized
atataaagactattaaacagat

SEQ ID NO: 765841 - DNA, 22 bp, Artificial Sequence
  chemically synthesized
tccactgctacaaatctgttta

SEQ ID NO: 765842 - DNA, 22 bp, Artificial Sequence
  chemically synthesized
tatccactgctacaaatctgtt

SEQ ID NO: 765843 - DNA, 22 bp, Artificial Sequence
  chemically synthesized
ttaaacagatttgtagcagtgg

SEQ ID NO: 765844 - DNA, 22 bp, Artificial Sequence
  chemically synthesized
gatgcatctctatccactgcta

SEQ ID NO: 765845 - DNA, 22 bp, Artificial Sequence
  chemically synthesized
aacagatttgtagcagtggata

SEQ ID NO: 765846 - DNA, 22 bp, Artificial Sequence
  chemically synthesized
tattggatgcatctctatccac

SEQ ID NO: 765847 - DNA, 22 bp, Artificial Sequence
  chemically synthesized
ttgtattggatgcatctctatc

SEQ ID NO: 765848 - DNA, 22 bp, Artificial Sequence
  chemically synthesized
gttgtattggatgcatctctat

SEQ ID NO: 765849 - DNA, 22 bp, Artificial Sequence
  chemically synthesized
gtagcagtggatagagatgcat

SEQ ID NO: 765850 - DNA, 22 bp, Artificial Sequence
  chemically synthesized
ttgttgtattggatgcatctct

SEQ ID NO: 765851 - DNA, 22 bp, Artificial Sequence
  chemically synthesized
tagcagtggatagagatgcatc

SEQ ID NO: 765852 - DNA, 22 bp, Artificial Sequence
  chemically synthesized
tcttgttgtattggatgcatct

SEQ ID NO: 765853 - DNA, 22 bp, Artificial Sequence
  chemically synthesized
ctcttgttgtattggatgcatc

SEQ ID NO: 765854 - DNA, 22 bp, Artificial Sequence
  chemically synthesized
tctcttgttgtattggatgcat

SEQ ID NO: 765855 - DNA, 22 bp, Artificial Sequence
  chemically synthesized
tgttttctcttgttgtattgga

SEQ ID NO: 765856 - DNA, 22 bp, Artificial Sequence
  chemically synthesized
gtgttttctcttgttgtattgg

SEQ ID NO: 765857 - DNA, 22 bp, Artificial Sequence
  chemically synthesized
tgtgttttctcttgttgtattg

SEQ ID NO: 765858 - DNA, 22 bp, Artificial Sequence
  chemically synthesized
ctttgtgttttctcttgttgta

SEQ ID NO: 765859 - DNA, 22 bp, Artificial Sequence
  chemically synthesized
aattactttgtgttttctcttg

SEQ ID NO: 765860 - DNA, 22 bp, Artificial Sequence
  chemically synthesized
tcaattactttgtgttttctct

SEQ ID NO: 765861 - DNA, 22 bp, Artificial Sequence
  chemically synthesized
ctcaattactttgtgttttctc

SEQ ID NO: 765862 - DNA, 22 bp, Artificial Sequence
  chemically synthesized
tctcaattactttgtgttttct

SEQ ID NO: 765863 - DNA, 22 bp, Artificial Sequence
  chemically synthesized
cacccattttctcaattacttt

SEQ ID NO: 765864 - DNA, 22 bp, Artificial Sequence
  chemically synthesized
gcacccattttctcaattactt

SEQ ID NO: 765865 - DNA, 22 bp, Artificial Sequence
  chemically synthesized
gtttgcacccattttctcaatt

SEQ ID NO: 765866 - DNA, 22 bp, Artificial Sequence
  chemically synthesized
cgtttgcacccattttctcaat

SEQ ID NO: 765867 - DNA, 22 bp, Artificial Sequence
  chemically synthesized
tttcgtttgcacccattttctc

SEQ ID NO: 765868 - DNA, 22 bp, Artificial Sequence
  chemically synthesized
gtttcgtttgcacccattttct

SEQ ID NO: 765869 - DNA, 22 bp, Artificial Sequence
  chemically synthesized
tttgtttcgtttgcacccattt

SEQ ID NO: 765870 - DNA, 22 bp, Artificial Sequence
  chemically synthesized
agaaaatgggtgcaaacgaaac

SEQ ID NO: 765871 - DNA, 22 bp, Artificial Sequence
  chemically synthesized
tggggacacacattatttgttt

SEQ ID NO: 765872 - DNA, 22 bp, Artificial Sequence
  chemically synthesized
atggggacacacattatttgtt

SEQ ID NO: 765873 - DNA, 22 bp, Artificial Sequence
  chemically synthesized
tatggggacacacattatttgt

SEQ ID NO: 765874 - DNA, 22 bp, Artificial Sequence
  chemically synthesized
ttatggggacacacattatttg

SEQ ID NO: 765875 - DNA, 22 bp, Artificial Sequence
  chemically synthesized
ttttatggggacacacattatt

SEQ ID NO: 765876 - DNA, 22 bp, Artificial Sequence
  chemically synthesized
cttttatggggacacacattat

SEQ ID NO: 765877 - DNA, 22 bp, Artificial Sequence
  chemically synthesized
ggccaaatgtttcttttatggg

SEQ ID NO: 765878 - DNA, 22 bp, Artificial Sequence
  chemically synthesized
aggccaaatgtttcttttatgg

SEQ ID NO: 765879 - DNA, 22 bp, Artificial Sequence
  chemically synthesized
taggccaaatgtttcttttatg

SEQ ID NO: 765880 - DNA, 22 bp, Artificial Sequence
  chemically synthesized
tacagaactttaggccaaatgt

SEQ ID NO: 765881 - DNA, 22 bp, Artificial Sequence
  chemically synthesized
taattgtacagaactttaggcc

SEQ ID NO: 765882 - DNA, 22 bp, Artificial Sequence
  chemically synthesized
tataattgtacagaactttagg

SEQ ID NO: 765883 - DNA, 22 bp, Artificial Sequence
  chemically synthesized
ctctataattgtacagaacttt

SEQ ID NO: 765884 - DNA, 22 bp, Artificial Sequence
  chemically synthesized
gctctataattgtacagaactt

SEQ ID NO: 765885 - DNA, 22 bp, Artificial Sequence
  chemically synthesized
ggcctaaagttctgtacaatta

SEQ ID NO: 765886 - DNA, 22 bp, Artificial Sequence
  chemically synthesized
aaatttgctctataattgtaca

SEQ ID NO: 765887 - DNA, 22 bp, Artificial Sequence
  chemically synthesized
gcctaaagttctgtacaattat

SEQ ID NO: 765888 - DNA, 22 bp, Artificial Sequence
  chemically synthesized
agctgaaatttgctctataatt

SEQ ID NO: 765889 - DNA, 22 bp, Artificial Sequence
  chemically synthesized
aagttctgtacaattatagagc

SEQ ID NO: 765890 - DNA, 22 bp, Artificial Sequence
  chemically synthesized
tcagctgaaatttgctctataa

SEQ ID NO: 765891 - DNA, 22 bp, Artificial Sequence
  chemically synthesized
tgtacaattatagagcaaattt

SEQ ID NO: 765892 - DNA, 22 bp, Artificial Sequence
  chemically synthesized
gtactctcagctgaaatttgct

SEQ ID NO: 765893 - DNA, 22 bp, Artificial Sequence
  chemically synthesized
tacaattatagagcaaatttca

SEQ ID NO: 765894 - DNA, 22 bp, Artificial Sequence
  chemically synthesized
ggtactctcagctgaaatttgc

SEQ ID NO: 765895 - DNA, 22 bp, Artificial Sequence
  chemically synthesized
tggtactctcagctgaaatttg

SEQ ID NO: 765896 - DNA, 22 bp, Artificial Sequence
  chemically synthesized
ttggtactctcagctgaaattt

SEQ ID NO: 765897 - DNA, 22 bp, Artificial Sequence
  chemically synthesized
tttggtactctcagctgaaatt

SEQ ID NO: 765898 - DNA, 22 bp, Artificial Sequence
  chemically synthesized
ttttggtactctcagctgaaat

SEQ ID NO: 765899 - DNA, 22 bp, Artificial Sequence
  chemically synthesized
tagagcaaatttcagctgagag

SEQ ID NO: 765900 - DNA, 22 bp, Artificial Sequence
  chemically synthesized
aacttttttggtactctcagct

SEQ ID NO: 765901 - DNA, 22 bp, Artificial Sequence
  chemically synthesized
ataactgaacttttttggtact

SEQ ID NO: 765902 - DNA, 22 bp, Artificial Sequence
  chemically synthesized
cagctgagagtaccaaaaaagt

SEQ ID NO: 765903 - DNA, 22 bp, Artificial Sequence
  chemically synthesized
tctcataactgaacttttttgg

SEQ ID NO: 765904 - DNA, 22 bp, Artificial Sequence
  chemically synthesized
agctgagagtaccaaaaaagtt

SEQ ID NO: 765905 - DNA, 22 bp, Artificial Sequence
  chemically synthesized
gtctcataactgaacttttttg

SEQ ID NO: 765906 - DNA, 22 bp, Artificial Sequence
  chemically synthesized
cttgtctcataactgaactttt

SEQ ID NO: 765907 - DNA, 22 bp, Artificial Sequence
  chemically synthesized
agagtaccaaaaaagttcagtt

SEQ ID NO: 765908 - DNA, 22 bp, Artificial Sequence
  chemically synthesized
tgaacatattgcttgtctcata

SEQ ID NO: 765909 - DNA, 22 bp, Artificial Sequence
  chemically synthesized
tactgtgaacatattgcttgtc

SEQ ID NO: 765910 - DNA, 22 bp, Artificial Sequence
  chemically synthesized
ctatactgtgaacatattgctt

SEQ ID NO: 765911 - DNA, 22 bp, Artificial Sequence
  chemically synthesized
agttatgagacaagcaatatgt

SEQ ID NO: 765912 - DNA, 22 bp, Artificial Sequence
  chemically synthesized
tgagacaagcaatatgttcaca

SEQ ID NO: 765913 - DNA, 22 bp, Artificial Sequence
  chemically synthesized
aaactgctatactgtgaacata

SEQ ID NO: 765914 - DNA, 22 bp, Artificial Sequence
  chemically synthesized
ctaaaactgctatactgtgaac

SEQ ID NO: 765915 - DNA, 22 bp, Artificial Sequence
  chemically synthesized
ctcctaaaactgctatactgtg

SEQ ID NO: 765916 - DNA, 22 bp, Artificial Sequence
  chemically synthesized
ccctactcctaaaactgctata

SEQ ID NO: 765917 - DNA, 22 bp, Artificial Sequence
  chemically synthesized
acagtatagcagttttaggagt

SEQ ID NO: 765918 - DNA, 22 bp, Artificial Sequence
  chemically synthesized
agaaaacaggatctcccctact

SEQ ID NO: 765919 - DNA, 22 bp, Artificial Sequence
  chemically synthesized
cagaaaacaggatctcccctac

SEQ ID NO: 765920 - DNA, 22 bp, Artificial Sequence
  chemically synthesized
taggagtaggggagatcctgtt

SEQ ID NO: 765921 - DNA, 22 bp, Artificial Sequence
  chemically synthesized
aggagtaggggagatcctgttt

SEQ ID NO: 765922 - DNA, 22 bp, Artificial Sequence
  chemically synthesized
ggagtaggggagatcctgtttt

SEQ ID NO: 765923 - DNA, 22 bp, Artificial Sequence
  chemically synthesized
aaaaagcccttcagaaaacagg

SEQ ID NO: 765924 - DNA, 22 bp, Artificial Sequence
  chemically synthesized
gaaaaagcccttcagaaaacag

SEQ ID NO: 765925 - DNA, 22 bp, Artificial Sequence
  chemically synthesized
ttttctgaagggctttttcaaa

SEQ ID NO: 765926 - DNA, 22 bp, Artificial Sequence
  chemically synthesized
tctgaagggctttttcaaattc

SEQ ID NO: 765927 - DNA, 22 bp, Artificial Sequence
  chemically synthesized
ctgaagggctttttcaaattcc

SEQ ID NO: 765928 - DNA, 22 bp, Artificial Sequence
  chemically synthesized
tgaagggctttttcaaattcca

SEQ ID NO: 765929 - DNA, 22 bp, Artificial Sequence
  chemically synthesized
aagggctttttcaaattccaca

SEQ ID NO: 765930 - DNA, 22 bp, Artificial Sequence
  chemically synthesized
agataagaaggaagtgtggaat

SEQ ID NO: 765931 - DNA, 22 bp, Artificial Sequence
  chemically synthesized
tttcaaattccacacttccttc

SEQ ID NO: 765932 - DNA, 22 bp, Artificial Sequence
  chemically synthesized
ttcaaattccacacttccttct

SEQ ID NO: 765933 - DNA, 22 bp, Artificial Sequence
  chemically synthesized
tcaaattccacacttccttctt

SEQ ID NO: 765934 - DNA, 22 bp, Artificial Sequence
  chemically synthesized
caaattccacacttccttctta

SEQ ID NO: 765935 - DNA, 22 bp, Artificial Sequence
  chemically synthesized
aaattccacacttccttcttat

SEQ ID NO: 765936 - DNA, 22 bp, Artificial Sequence
  chemically synthesized
cacacttccttcttatctgagt

SEQ ID NO: 765937 - DNA, 22 bp, Artificial Sequence
  chemically synthesized
acaacaagagtagatgagactc

SEQ ID NO: 765938 - DNA, 22 bp, Artificial Sequence
  chemically synthesized
ccttcttatctgagtctcatct

SEQ ID NO: 765939 - DNA, 22 bp, Artificial Sequence
  chemically synthesized
cttcttatctgagtctcatcta

SEQ ID NO: 765940 - DNA, 22 bp, Artificial Sequence
  chemically synthesized
cttatctgagtctcatctactc

SEQ ID NO: 765941 - DNA, 22 bp, Artificial Sequence
  chemically synthesized
ttatctgagtctcatctactct

SEQ ID NO: 765942 - DNA, 22 bp, Artificial Sequence
  chemically synthesized
atctgagtctcatctactcttg

SEQ ID NO: 765943 - DNA, 22 bp, Artificial Sequence
  chemically synthesized
tctgagtctcatctactcttgt

SEQ ID NO: 765944 - DNA, 22 bp, Artificial Sequence
  chemically synthesized
agtctcatctactcttgttgtg

SEQ ID NO: 765945 - DNA, 22 bp, Artificial Sequence
  chemically synthesized
agaaaggagattcacaacaaga

SEQ ID NO: 765946 - DNA, 22 bp, Artificial Sequence
  chemically synthesized
atctactcttgttgtgaatctc

SEQ ID NO: 765947 - DNA, 22 bp, Artificial Sequence
  chemically synthesized
gaagctgagaaaggagattcac

SEQ ID NO: 765948 - DNA, 22 bp, Artificial Sequence
  chemically synthesized
tggaagctgagaaaggagattc

SEQ ID NO: 765949 - DNA, 22 bp, Artificial Sequence
  chemically synthesized
ctcttgttgtgaatctcctttc

SEQ ID NO: 765950 - DNA, 22 bp, Artificial Sequence
  chemically synthesized
tctggaagctgagaaaggagat

SEQ ID NO: 765951 - DNA, 22 bp, Artificial Sequence
  chemically synthesized
ctctggaagctgagaaaggaga

SEQ ID NO: 765952 - DNA, 22 bp, Artificial Sequence
  chemically synthesized
tctctggaagctgagaaaggag

SEQ ID NO: 765953 - DNA, 22 bp, Artificial Sequence
  chemically synthesized
ttgttgtgaatctcctttctca

SEQ ID NO: 765954 - DNA, 22 bp, Artificial Sequence
  chemically synthesized
gttgtgaatctcctttctcagc

SEQ ID NO: 765955 - DNA, 22 bp, Artificial Sequence
  chemically synthesized
ttgtgaatctcctttctcagct

SEQ ID NO: 765956 - DNA, 22 bp, Artificial Sequence
  chemically synthesized
tgaatctcctttctcagcttcc

SEQ ID NO: 765957 - DNA, 22 bp, Artificial Sequence
  chemically synthesized
ccatgagttttctctggaagct

SEQ ID NO: 765958 - DNA, 22 bp, Artificial Sequence
  chemically synthesized
gccatgagttttctctggaagc

SEQ ID NO: 765959 - DNA, 22 bp, Artificial Sequence
  chemically synthesized
tgccatgagttttctctggaag

SEQ ID NO: 765960 - DNA, 22 bp, Artificial Sequence
  chemically synthesized
ctttctcagcttccagagaaaa

SEQ ID NO: 765961 - DNA, 22 bp, Artificial Sequence
  chemically synthesized
cactttgccatgagttttctct

SEQ ID NO: 765962 - DNA, 22 bp, Artificial Sequence
  chemically synthesized
tctcagcttccagagaaaactc

SEQ ID NO: 765963 - DNA, 22 bp, Artificial Sequence
  chemically synthesized
ctcagcttccagagaaaactca

SEQ ID NO: 765964 - DNA, 22 bp, Artificial Sequence
  chemically synthesized
tcagcttccagagaaaactcat

SEQ ID NO: 765965 - DNA, 22 bp, Artificial Sequence
  chemically synthesized
actgcactttgccatgagtttt

SEQ ID NO: 765966 - DNA, 22 bp, Artificial Sequence
  chemically synthesized
agcttccagagaaaactcatgg

SEQ ID NO: 765967 - DNA, 22 bp, Artificial Sequence
  chemically synthesized
aactgcactttgccatgagttt

SEQ ID NO: 765968 - DNA, 22 bp, Artificial Sequence
  chemically synthesized
tttaactgcactttgccatgag

SEQ ID NO: 765969 - DNA, 22 bp, Artificial Sequence
  chemically synthesized
ccagagaaaactcatggcaaag

SEQ ID NO: 765970 - DNA, 22 bp, Artificial Sequence
  chemically synthesized
cagagaaaactcatggcaaagt

SEQ ID NO: 765971 - DNA, 22 bp, Artificial Sequence
  chemically synthesized
tgtctatttaactgcactttgc

SEQ ID NO: 765972 - DNA, 22 bp, Artificial Sequence
  chemically synthesized
atggcaaagtgcagttaaatag

SEQ ID NO: 765973 - DNA, 22 bp, Artificial Sequence
  chemically synthesized
aatagacataggtttgaccctt

SEQ ID NO: 765974 - DNA, 22 bp, Artificial Sequence
  chemically synthesized
ataagggaaagagaagagaagg

SEQ ID NO: 765975 - DNA, 22 bp, Artificial Sequence
  chemically synthesized
tgtggctaataagggaaagaga

SEQ ID NO: 765976 - DNA, 22 bp, Artificial Sequence
  chemically synthesized
gacccttctcttctctttccct

SEQ ID NO: 765977 - DNA, 22 bp, Artificial Sequence
  chemically synthesized
acccttctcttctctttccctt

SEQ ID NO: 765978 - DNA, 22 bp, Artificial Sequence
  chemically synthesized
atcattatgtggctaataaggg

SEQ ID NO: 765979 - DNA, 22 bp, Artificial Sequence
  chemically synthesized
ctcttctctttcccttattagc

SEQ ID NO: 765980 - DNA, 22 bp, Artificial Sequence
  chemically synthesized
catcattatgtggctaataagg

SEQ ID NO: 765981 - DNA, 22 bp, Artificial Sequence
  chemically synthesized
tcttctctttcccttattagcc

SEQ ID NO: 765982 - DNA, 22 bp, Artificial Sequence
  chemically synthesized
tcatcattatgtggctaataag

SEQ ID NO: 765983 - DNA, 22 bp, Artificial Sequence
  chemically synthesized
ttctctttcccttattagccac

SEQ ID NO: 765984 - DNA, 22 bp, Artificial Sequence
  chemically synthesized
ctctttcccttattagccacat

SEQ ID NO: 765985 - DNA, 22 bp, Artificial Sequence
  chemically synthesized
tctttcccttattagccacata

SEQ ID NO: 765986 - DNA, 22 bp, Artificial Sequence
  chemically synthesized
tttcccttattagccacataat

SEQ ID NO: 765987 - DNA, 22 bp, Artificial Sequence
  chemically synthesized
tcccttattagccacataatga

SEQ ID NO: 765988 - DNA, 22 bp, Artificial Sequence
  chemically synthesized
cccttattagccacataatgat

SEQ ID NO: 765989 - DNA, 22 bp, Artificial Sequence
  chemically synthesized
ccttattagccacataatgatg

SEQ ID NO: 765990 - DNA, 22 bp, Artificial Sequence
  chemically synthesized
attagccacataatgatgaaaa

SEQ ID NO: 765991 - DNA, 22 bp, Artificial Sequence
  chemically synthesized
ttagccacataatgatgaaaac

SEQ ID NO: 765992 - DNA, 22 bp, Artificial Sequence
  chemically synthesized
gccacataatgatgaaaactct

SEQ ID NO: 765993 - DNA, 22 bp, Artificial Sequence
  chemically synthesized
gtgaaaccaaagtaatgaaaga

SEQ ID NO: 765994 - DNA, 22 bp, Artificial Sequence
  chemically synthesized
agtgaaaccaaagtaatgaaag

SEQ ID NO: 765995 - DNA, 22 bp, Artificial Sequence
  chemically synthesized
atgtttagtgaaaccaaagtaa

SEQ ID NO: 765996 - DNA, 22 bp, Artificial Sequence
  chemically synthesized
catgtttagtgaaaccaaagta

SEQ ID NO: 765997 - DNA, 22 bp, Artificial Sequence
  chemically synthesized
tttcatgtttagtgaaaccaaa

SEQ ID NO: 765998 - DNA, 22 bp, Artificial Sequence
  chemically synthesized
tttcattactttggtttcacta

SEQ ID NO: 765999 - DNA, 22 bp, Artificial Sequence
  chemically synthesized
ttatttcatgtttagtgaaacc

SEQ ID NO: 766000 - DNA, 22 bp, Artificial Sequence
  chemically synthesized
tcattactttggtttcactaaa

SEQ ID NO: 766001 - DNA, 22 bp, Artificial Sequence
  chemically synthesized
cattactttggtttcactaaac

SEQ ID NO: 766002 - DNA, 22 bp, Artificial Sequence
  chemically synthesized
attactttggtttcactaaaca

SEQ ID NO: 766003 - DNA, 22 bp, Artificial Sequence
  chemically synthesized
ctttggtttcactaaacatgaa

SEQ ID NO: 766004 - DNA, 22 bp, Artificial Sequence
  chemically synthesized
tggtttcactaaacatgaaata

SEQ ID NO: 766005 - DNA, 22 bp, Artificial Sequence
  chemically synthesized
ggtttcactaaacatgaaataa

SEQ ID NO: 766006 - DNA, 22 bp, Artificial Sequence
  chemically synthesized
gtttcactaaacatgaaataat

SEQ ID NO: 766007 - DNA, 22 bp, Artificial Sequence
  chemically synthesized
agcaggtatgtattattatttc

SEQ ID NO: 766008 - DNA, 22 bp, Artificial Sequence
  chemically synthesized
cactaaacatgaaataataata

SEQ ID NO: 766009 - DNA, 22 bp, Artificial Sequence
  chemically synthesized
actaaacatgaaataataatac

SEQ ID NO: 766010 - DNA, 22 bp, Artificial Sequence
  chemically synthesized
aacatgaaataataatacatac

SEQ ID NO: 766011 - DNA, 22 bp, Artificial Sequence
  chemically synthesized
aaaaaattcagcaggtatgtat

SEQ ID NO: 766012 - DNA, 22 bp, Artificial Sequence
  chemically synthesized
catgtaatattcaaaaaattca

SEQ ID NO: 766013 - DNA, 22 bp, Artificial Sequence
  chemically synthesized
caaaaattccatgtaatattca

SEQ ID NO: 766014 - DNA, 22 bp, Artificial Sequence
  chemically synthesized
acaaaaattccatgtaatattc

SEQ ID NO: 766015 - DNA, 22 bp, Artificial Sequence
  chemically synthesized
ctgaattttttgaatattacat

SEQ ID NO: 766016 - DNA, 22 bp, Artificial Sequence
  chemically synthesized
tacaaaaattccatgtaatatt

SEQ ID NO: 766017 - DNA, 22 bp, Artificial Sequence
  chemically synthesized
aattttttgaatattacatgga

SEQ ID NO: 766018 - DNA, 22 bp, Artificial Sequence
  chemically synthesized
tttgaatattacatggaatttt

SEQ ID NO: 766019 - DNA, 22 bp, Artificial Sequence
  chemically synthesized
ttgaatattacatggaattttt

SEQ ID NO: 766020 - DNA, 22 bp, Artificial Sequence
  chemically synthesized
aaagtattttacaaaaattcca

SEQ ID NO: 766021 - DNA, 22 bp, Artificial Sequence
  chemically synthesized
tgaatattacatggaatttttg

SEQ ID NO: 766022 - DNA, 22 bp, Artificial Sequence
  chemically synthesized
gaatattacatggaatttttgt

SEQ ID NO: 766023 - DNA, 22 bp, Artificial Sequence
  chemically synthesized
aatattacatggaatttttgta

SEQ ID NO: 766024 - DNA, 22 bp, Artificial Sequence
  chemically synthesized
ttcaaagtattttacaaaaatt

SEQ ID NO: 766025 - DNA, 22 bp, Artificial Sequence
  chemically synthesized
catggaatttttgtaaaatact

SEQ ID NO: 766026 - DNA, 22 bp, Artificial Sequence
  chemically synthesized
gacgctattcaaagtattttac

SEQ ID NO: 766027 - DNA, 22 bp, Artificial Sequence
  chemically synthesized
tagacgctattcaaagtatttt

SEQ ID NO: 766028 - DNA, 22 bp, Artificial Sequence
  chemically synthesized
tgttctagacgctattcaaagt

SEQ ID NO: 766029 - DNA, 22 bp, Artificial Sequence
  chemically synthesized
gtgttctagacgctattcaaag

SEQ ID NO: 766030 - DNA, 22 bp, Artificial Sequence
  chemically synthesized
ttgtaaaatactttgaatagcg

SEQ ID NO: 766031 - DNA, 22 bp, Artificial Sequence
  chemically synthesized
ttgtgttctagacgctattcaa

SEQ ID NO: 766032 - DNA, 22 bp, Artificial Sequence
  chemically synthesized
tgtaaaatactttgaatagcgt

SEQ ID NO: 766033 - DNA, 22 bp, Artificial Sequence
  chemically synthesized
gtaaaatactttgaatagcgtc

SEQ ID NO: 766034 - DNA, 22 bp, Artificial Sequence
  chemically synthesized
taaaatactttgaatagcgtct

SEQ ID NO: 766035 - DNA, 22 bp, Artificial Sequence
  chemically synthesized
aagatctcttgtgttctagacg

SEQ ID NO: 766036 - DNA, 22 bp, Artificial Sequence
  chemically synthesized
ttaaagatctcttgtgttctag

SEQ ID NO: 766037 - DNA, 22 bp, Artificial Sequence
  chemically synthesized
attaaagatctcttgtgttcta

SEQ ID NO: 766038 - DNA, 22 bp, Artificial Sequence
  chemically synthesized
tgaatagcgtctagaacacaag

SEQ ID NO: 766039 - DNA, 22 bp, Artificial Sequence
  chemically synthesized
gaatagcgtctagaacacaaga

SEQ ID NO: 766040 - DNA, 22 bp, Artificial Sequence
  chemically synthesized
aatagcgtctagaacacaagag

SEQ ID NO: 766041 - DNA, 22 bp, Artificial Sequence
  chemically synthesized
tttattaaagatctcttgtgtt

SEQ ID NO: 766042 - DNA, 22 bp, Artificial Sequence
  chemically synthesized
ttatttattaaagatctcttgt

SEQ ID NO: 766043 - DNA, 22 bp, Artificial Sequence
  chemically synthesized
ctattatttattaaagatctct

SEQ ID NO: 766044 - DNA, 22 bp, Artificial Sequence
  chemically synthesized
gctattatttattaaagatctc

SEQ ID NO: 766045 - DNA, 22 bp, Artificial Sequence
  chemically synthesized
gaacacaagagatctttaataa

SEQ ID NO: 766046 - DNA, 22 bp, Artificial Sequence
  chemically synthesized
catttgctattatttattaaag

SEQ ID NO: 766047 - DNA, 22 bp, Artificial Sequence
  chemically synthesized
taataaataatagcaaatgcag

SEQ ID NO: 766048 - DNA, 22 bp, Artificial Sequence
  chemically synthesized
taatagtaagccctgcatttgc

SEQ ID NO: 766049 - DNA, 22 bp, Artificial Sequence
  chemically synthesized
aataaataatagcaaatgcagg

SEQ ID NO: 766050 - DNA, 22 bp, Artificial Sequence
  chemically synthesized
gtaatagtaagccctgcatttg

SEQ ID NO: 766051 - DNA, 22 bp, Artificial Sequence
  chemically synthesized
ataaataatagcaaatgcaggg

SEQ ID NO: 766052 - DNA, 22 bp, Artificial Sequence
  chemically synthesized
tcttgtaatagtaagccctgca

SEQ ID NO: 766053 - DNA, 22 bp, Artificial Sequence
  chemically synthesized
cacatggattatcttgtaatag

SEQ ID NO: 766054 - DNA, 22 bp, Artificial Sequence
  chemically synthesized
ccacatggattatcttgtaata

SEQ ID NO: 766055 - DNA, 22 bp, Artificial Sequence
  chemically synthesized
atttccacatggattatcttgt

SEQ ID NO: 766056 - DNA, 22 bp, Artificial Sequence
  chemically synthesized
actattacaagataatccatgt

SEQ ID NO: 766057 - DNA, 22 bp, Artificial Sequence
  chemically synthesized
ctattacaagataatccatgtg

SEQ ID NO: 766058 - DNA, 22 bp, Artificial Sequence
  chemically synthesized
acatctgatttccacatggatt

SEQ ID NO: 766059 - DNA, 22 bp, Artificial Sequence
  chemically synthesized
taacatctgatttccacatgga

SEQ ID NO: 766060 - DNA, 22 bp, Artificial Sequence
  chemically synthesized
ttacaagataatccatgtggaa

SEQ ID NO: 766061 - DNA, 22 bp, Artificial Sequence
  chemically synthesized
ctaacatctgatttccacatgg

SEQ ID NO: 766062 - DNA, 22 bp, Artificial Sequence
  chemically synthesized
caagataatccatgtggaaatc

SEQ ID NO: 766063 - DNA, 22 bp, Artificial Sequence
  chemically synthesized
tttctaacatctgatttccaca

SEQ ID NO: 766064 - DNA, 22 bp, Artificial Sequence
  chemically synthesized
atgaaatctatttctaacatct

SEQ ID NO: 766065 - DNA, 22 bp, Artificial Sequence
  chemically synthesized
catgaaatctatttctaacatc

SEQ ID NO: 766066 - DNA, 22 bp, Artificial Sequence
  chemically synthesized
taacttcatgaaatctatttct

SEQ ID NO: 766067 - DNA, 22 bp, Artificial Sequence
  chemically synthesized
gaaatagatttcatgaagttac

SEQ ID NO: 766068 - DNA, 22 bp, Artificial Sequence
  chemically synthesized
aagccaagtcctgtaacttcat

SEQ ID NO: 766069 - DNA, 22 bp, Artificial Sequence
  chemically synthesized
aaggctcaagccaagtcctgta

SEQ ID NO: 766070 - DNA, 22 bp, Artificial Sequence
  chemically synthesized
catgaagttacaggacttggct

SEQ ID NO: 766071 - DNA, 22 bp, Artificial Sequence
  chemically synthesized
atgaagttacaggacttggctt

SEQ ID NO: 766072 - DNA, 22 bp, Artificial Sequence
  chemically synthesized
caggacttggcttgagccttga

SEQ ID NO: 766073 - DNA, 22 bp, Artificial Sequence
  chemically synthesized
ccaatcgtatacatccctcaag

SEQ ID NO: 766074 - DNA, 22 bp, Artificial Sequence
  chemically synthesized
cccaatcgtatacatccctcaa

SEQ ID NO: 766075 - DNA, 22 bp, Artificial Sequence
  chemically synthesized
ggcttgagccttgagggatgta

SEQ ID NO: 766076 - DNA, 22 bp, Artificial Sequence
  chemically synthesized
gcttgagccttgagggatgtat

SEQ ID NO: 766077 - DNA, 22 bp, Artificial Sequence
  chemically synthesized
caatttcccaatcgtatacatc

SEQ ID NO: 766078 - DNA, 22 bp, Artificial Sequence
  chemically synthesized
gagccttgagggatgtatacga

SEQ ID NO: 766079 - DNA, 22 bp, Artificial Sequence
  chemically synthesized
agccttgagggatgtatacgat

SEQ ID NO: 766080 - DNA, 22 bp, Artificial Sequence
  chemically synthesized
ttccaatttcccaatcgtatac

SEQ ID NO: 766081 - DNA, 22 bp, Artificial Sequence
  chemically synthesized
gttccaatttcccaatcgtata

SEQ ID NO: 766082 - DNA, 22 bp, Artificial Sequence
  chemically synthesized
tgttccaatttcccaatcgtat

SEQ ID NO: 766083 - DNA, 22 bp, Artificial Sequence
  chemically synthesized
ttgttccaatttcccaatcgta

SEQ ID NO: 766084 - DNA, 22 bp, Artificial Sequence
  chemically synthesized
gagggatgtatacgattgggaa

SEQ ID NO: 766085 - DNA, 22 bp, Artificial Sequence
  chemically synthesized
ttttgttccaatttcccaatcg

SEQ ID NO: 766086 - DNA, 22 bp, Artificial Sequence
  chemically synthesized
agggatgtatacgattgggaaa

SEQ ID NO: 766087 - DNA, 22 bp, Artificial Sequence
  chemically synthesized
cttttgttccaatttcccaatc

SEQ ID NO: 766088 - DNA, 22 bp, Artificial Sequence
  chemically synthesized
tcttttgttccaatttcccaat

SEQ ID NO: 766089 - DNA, 22 bp, Artificial Sequence
  chemically synthesized
gaatattttcttttgttccaat

SEQ ID NO: 766090 - DNA, 22 bp, Artificial Sequence
  chemically synthesized
cctggaatattttcttttgttc

SEQ ID NO: 766091 - DNA, 22 bp, Artificial Sequence
  chemically synthesized
acctggaatattttcttttgtt

SEQ ID NO: 766092 - DNA, 22 bp, Artificial Sequence
  chemically synthesized
tacctggaatattttcttttgt

SEQ ID NO: 766093 - DNA, 22 bp, Artificial Sequence
  chemically synthesized
ttacctggaatattttcttttg

SEQ ID NO: 766094 - DNA, 22 bp, Artificial Sequence
  chemically synthesized
ggaaattggaacaaaagaaaat

SEQ ID NO: 766095 - DNA, 22 bp, Artificial Sequence
  chemically synthesized
tttacctggaatattttctttt

SEQ ID NO: 766096 - DNA, 22 bp, Artificial Sequence
  chemically synthesized
tttttacctggaatattttctt

SEQ ID NO: 766097 - DNA, 22 bp, Artificial Sequence
  chemically synthesized
ttctttttacctggaatatttt

SEQ ID NO: 766098 - DNA, 22 bp, Artificial Sequence
  chemically synthesized
gaacaaaagaaaatattccagg

SEQ ID NO: 766099 - DNA, 22 bp, Artificial Sequence
  chemically synthesized
ccatgctattctttttacctgg

SEQ ID NO: 766100 - DNA, 22 bp, Artificial Sequence
  chemically synthesized
cattcccatgctattcttttta

SEQ ID NO: 766101 - DNA, 22 bp, Artificial Sequence
  chemically synthesized
ctccattcccatgctattcttt

SEQ ID NO: 766102 - DNA, 22 bp, Artificial Sequence
  chemically synthesized
actccattcccatgctattctt

SEQ ID NO: 766103 - DNA, 22 bp, Artificial Sequence
  chemically synthesized
tactccattcccatgctattct

SEQ ID NO: 766104 - DNA, 22 bp, Artificial Sequence
  chemically synthesized
caggtaaaaagaatagcatggg

SEQ ID NO: 766105 - DNA, 22 bp, Artificial Sequence
  chemically synthesized
acctttactccattcccatgct

SEQ ID NO: 766106 - DNA, 22 bp, Artificial Sequence
  chemically synthesized
cacctttactccattcccatgc

SEQ ID NO: 766107 - DNA, 22 bp, Artificial Sequence
  chemically synthesized
atttcacctttactccattccc

SEQ ID NO: 766108 - DNA, 22 bp, Artificial Sequence
  chemically synthesized
ataaaccaaattcatttcacct

SEQ ID NO: 766109 - DNA, 22 bp, Artificial Sequence
  chemically synthesized
ctcataaaccaaattcatttca

SEQ ID NO: 766110 - DNA, 22 bp, Artificial Sequence
  chemically synthesized
tccctgctcataaaccaaattc

SEQ ID NO: 766111 - DNA, 22 bp, Artificial Sequence
  chemically synthesized
attgtccctgctcataaaccaa

SEQ ID NO: 766112 - DNA, 22 bp, Artificial Sequence
  chemically synthesized
tgcaattcattgtccctgctca

SEQ ID NO: 766113 - DNA, 22 bp, Artificial Sequence
  chemically synthesized
ggtttatgagcagggacaatga

SEQ ID NO: 766114 - DNA, 22 bp, Artificial Sequence
  chemically synthesized
gtttatgagcagggacaatgaa

SEQ ID NO: 766115 - DNA, 22 bp, Artificial Sequence
  chemically synthesized
atgagcagggacaatgaattgc

SEQ ID NO: 766116 - DNA, 22 bp, Artificial Sequence
  chemically synthesized
caatcaggttgtgcaattcatt

SEQ ID NO: 766117 - DNA, 22 bp, Artificial Sequence
  chemically synthesized
tgagcagggacaatgaattgca

SEQ ID NO: 766118 - DNA, 22 bp, Artificial Sequence
  chemically synthesized
tccattccaatcaggttgtgca

SEQ ID NO: 766119 - DNA, 22 bp, Artificial Sequence
  chemically synthesized
attgtccattccaatcaggttg

SEQ ID NO: 766120 - DNA, 22 bp, Artificial Sequence
  chemically synthesized
tcattgtccattccaatcaggt

SEQ ID NO: 766121 - DNA, 22 bp, Artificial Sequence
  chemically synthesized
aactctcattgtccattccaat

SEQ ID NO: 766122 - DNA, 22 bp, Artificial Sequence
  chemically synthesized
tcaactctcattgtccattcca

SEQ ID NO: 766123 - DNA, 22 bp, Artificial Sequence
  chemically synthesized
cacaacctgattggaatggaca

SEQ ID NO: 766124 - DNA, 22 bp, Artificial Sequence
  chemically synthesized
tctcaactctcattgtccattc

SEQ ID NO: 766125 - DNA, 22 bp, Artificial Sequence
  chemically synthesized
ctctcaactctcattgtccatt

SEQ ID NO: 766126 - DNA, 22 bp, Artificial Sequence
  chemically synthesized
tttctctcaactctcattgtcc

SEQ ID NO: 766127 - DNA, 22 bp, Artificial Sequence
  chemically synthesized
attggaatggacaatgagagtt

SEQ ID NO: 766128 - DNA, 22 bp, Artificial Sequence
  chemically synthesized
cctatttctctcaactctcatt

SEQ ID NO: 766129 - DNA, 22 bp, Artificial Sequence
  chemically synthesized
tacctatttctctcaactctca

SEQ ID NO: 766130 - DNA, 22 bp, Artificial Sequence
  chemically synthesized
gaatggacaatgagagttgaga

SEQ ID NO: 766131 - DNA, 22 bp, Artificial Sequence
  chemically synthesized
cattctacctatttctctcaac

SEQ ID NO: 766132 - DNA, 22 bp, Artificial Sequence
  chemically synthesized
gtctgcattctacctatttctc

SEQ ID NO: 766133 - DNA, 22 bp, Artificial Sequence
  chemically synthesized
agcagttggtctgcattctacc

SEQ ID NO: 766134 - DNA, 22 bp, Artificial Sequence
  chemically synthesized
aagcagttggtctgcattctac

SEQ ID NO: 766135 - DNA, 22 bp, Artificial Sequence
  chemically synthesized
agagaaataggtagaatgcaga

SEQ ID NO: 766136 - DNA, 22 bp, Artificial Sequence
  chemically synthesized
gtttaagcagttggtctgcatt

SEQ ID NO: 766137 - DNA, 22 bp, Artificial Sequence
  chemically synthesized
ggtttaagcagttggtctgcat

SEQ ID NO: 766138 - DNA, 22 bp, Artificial Sequence
  chemically synthesized
cttggtttaagcagttggtctg

SEQ ID NO: 766139 - DNA, 22 bp, Artificial Sequence
  chemically synthesized
tacttggtttaagcagttggtc

SEQ ID NO: 766140 - DNA, 22 bp, Artificial Sequence
  chemically synthesized
ttctacttggtttaagcagttg

SEQ ID NO: 766141 - DNA, 22 bp, Artificial Sequence
  chemically synthesized
attctacttggtttaagcagtt

SEQ ID NO: 766142 - DNA, 22 bp, Artificial Sequence
  chemically synthesized
tattctacttggtttaagcagt

SEQ ID NO: 766143 - DNA, 22 bp, Artificial Sequence
  chemically synthesized
aaggaagactttattctacttg

SEQ ID NO: 766144 - DNA, 22 bp, Artificial Sequence
  chemically synthesized
ctaaaggaagactttattctac

SEQ ID NO: 766145 - DNA, 22 bp, Artificial Sequence
  chemically synthesized
cctaaaggaagactttattcta

SEQ ID NO: 766146 - DNA, 22 bp, Artificial Sequence
  chemically synthesized
cttaaaccaagtagaataaagt

SEQ ID NO: 766147 - DNA, 22 bp, Artificial Sequence
  chemically synthesized
aaaccaagtagaataaagtctt

SEQ ID NO: 766148 - DNA, 22 bp, Artificial Sequence
  chemically synthesized
aaccaagtagaataaagtcttc

SEQ ID NO: 766149 - DNA, 22 bp, Artificial Sequence
  chemically synthesized
ggtggcttcctaaaggaagact

SEQ ID NO: 766150 - DNA, 22 bp, Artificial Sequence
  chemically synthesized
tcggtggcttcctaaaggaaga

SEQ ID NO: 766151 - DNA, 22 bp, Artificial Sequence
  chemically synthesized
ttctcggtggcttcctaaagga

SEQ ID NO: 766152 - DNA, 22 bp, Artificial Sequence
  chemically synthesized
attctcggtggcttcctaaagg

SEQ ID NO: 766153 - DNA, 22 bp, Artificial Sequence
  chemically synthesized
tattctcggtggcttcctaaag

SEQ ID NO: 766154 - DNA, 22 bp, Artificial Sequence
  chemically synthesized
ttattctcggtggcttcctaaa

SEQ ID NO: 766155 - DNA, 22 bp, Artificial Sequence
  chemically synthesized
aacttttattctcggtggcttc

SEQ ID NO: 766156 - DNA, 22 bp, Artificial Sequence
  chemically synthesized
taaacttttattctcggtggct

SEQ ID NO: 766157 - DNA, 22 bp, Artificial Sequence
  chemically synthesized
ctaaacttttattctcggtggc

SEQ ID NO: 766158 - DNA, 22 bp, Artificial Sequence
  chemically synthesized
tctaaacttttattctcggtgg

SEQ ID NO: 766159 - DNA, 22 bp, Artificial Sequence
  chemically synthesized
cctttaggaagccaccgagaat

SEQ ID NO: 766160 - DNA, 22 bp, Artificial Sequence
  chemically synthesized
ctttaggaagccaccgagaata

SEQ ID NO: 766161 - DNA, 22 bp, Artificial Sequence
  chemically synthesized
tttctaaacttttattctcggt

SEQ ID NO: 766162 - DNA, 22 bp, Artificial Sequence
  chemically synthesized
ctttctaaacttttattctcgg

SEQ ID NO: 766163 - DNA, 22 bp, Artificial Sequence
  chemically synthesized
tctttctaaacttttattctcg

SEQ ID NO: 766164 - DNA, 22 bp, Artificial Sequence
  chemically synthesized
taggaagccaccgagaataaaa

SEQ ID NO: 766165 - DNA, 22 bp, Artificial Sequence
  chemically synthesized
ttctttctaaacttttattctc

SEQ ID NO: 766166 - DNA, 22 bp, Artificial Sequence
  chemically synthesized
aggaagccaccgagaataaaag

SEQ ID NO: 766167 - DNA, 22 bp, Artificial Sequence
  chemically synthesized
ggaagccaccgagaataaaagt

SEQ ID NO: 766168 - DNA, 22 bp, Artificial Sequence
  chemically synthesized
tacttttctttctaaactttta

SEQ ID NO: 766169 - DNA, 22 bp, Artificial Sequence
  chemically synthesized
gtacttttctttctaaactttt

SEQ ID NO: 766170 - DNA, 22 bp, Artificial Sequence
  chemically synthesized
tgtacttttctttctaaacttt

SEQ ID NO: 766171 - DNA, 22 bp, Artificial Sequence
  chemically synthesized
tctttgtacttttctttctaaa

SEQ ID NO: 766172 - DNA, 22 bp, Artificial Sequence
  chemically synthesized
gtctttgtacttttctttctaa

SEQ ID NO: 766173 - DNA, 22 bp, Artificial Sequence
  chemically synthesized
gataatcttgtctttgtacttt

SEQ ID NO: 766174 - DNA, 22 bp, Artificial Sequence
  chemically synthesized
agaaagaaaagtacaaagacaa

SEQ ID NO: 766175 - DNA, 22 bp, Artificial Sequence
  chemically synthesized
gaaagaaaagtacaaagacaag

SEQ ID NO: 766176 - DNA, 22 bp, Artificial Sequence
  chemically synthesized
atattcgataatcttgtctttg

SEQ ID NO: 766177 - DNA, 22 bp, Artificial Sequence
  chemically synthesized
aatattcgataatcttgtcttt

SEQ ID NO: 766178 - DNA, 22 bp, Artificial Sequence
  chemically synthesized
aatgaaatagtacaaatttaat

SEQ ID NO: 766179 - DNA, 22 bp, Artificial Sequence
  chemically synthesized
gaatgaaatagtacaaatttaa

SEQ ID NO: 766180 - DNA, 22 bp, Artificial Sequence
  chemically synthesized
tgaatgaaatagtacaaattta

SEQ ID NO: 766181 - DNA, 22 bp, Artificial Sequence
  chemically synthesized
ttgaatgaaatagtacaaattt

SEQ ID NO: 766182 - DNA, 22 bp, Artificial Sequence
  chemically synthesized
tttgaatgaaatagtacaaatt

SEQ ID NO: 766183 - DNA, 22 bp, Artificial Sequence
  chemically synthesized
tcgaatattaaatttgtactat

SEQ ID NO: 766184 - DNA, 22 bp, Artificial Sequence
  chemically synthesized
ctttttgaatgaaatagtacaa

SEQ ID NO: 766185 - DNA, 22 bp, Artificial Sequence
  chemically synthesized
tactttttgaatgaaatagtac

SEQ ID NO: 766186 - DNA, 22 bp, Artificial Sequence
  chemically synthesized
aatttgtactatttcattcaaa

SEQ ID NO: 766187 - DNA, 22 bp, Artificial Sequence
  chemically synthesized
gtactatttcattcaaaaagta

SEQ ID NO: 766188 - DNA, 22 bp, Artificial Sequence
  chemically synthesized
tactatttcattcaaaaagtag

SEQ ID NO: 766189 - DNA, 22 bp, Artificial Sequence
  chemically synthesized
tttcattcaaaaagtagaatga

SEQ ID NO: 766190 - DNA, 22 bp, Artificial Sequence
  chemically synthesized
tgaacaccatggatcattctac

SEQ ID NO: 766191 - DNA, 22 bp, Artificial Sequence
  chemically synthesized
atgaacaccatggatcattcta

SEQ ID NO: 766192 - DNA, 22 bp, Artificial Sequence
  chemically synthesized
cattcaaaaagtagaatgatcc

SEQ ID NO: 766193 - DNA, 22 bp, Artificial Sequence
  chemically synthesized
attcaaaaagtagaatgatcca

SEQ ID NO: 766194 - DNA, 22 bp, Artificial Sequence
  chemically synthesized
cttatgaacaccatggatcatt

SEQ ID NO: 766195 - DNA, 22 bp, Artificial Sequence
  chemically synthesized
aaaaagtagaatgatccatggt

SEQ ID NO: 766196 - DNA, 22 bp, Artificial Sequence
  chemically synthesized
ttacttatgaacaccatggatc

SEQ ID NO: 766197 - DNA, 22 bp, Artificial Sequence
  chemically synthesized
tattattacttatgaacaccat

SEQ ID NO: 766198 - DNA, 22 bp, Artificial Sequence
  chemically synthesized
cccagttgtattattacttatg

SEQ ID NO: 766199 - DNA, 22 bp, Artificial Sequence
  chemically synthesized
ccccagttgtattattacttat

SEQ ID NO: 766200 - DNA, 22 bp, Artificial Sequence
  chemically synthesized
ttccccagttgtattattactt

SEQ ID NO: 766201 - DNA, 22 bp, Artificial Sequence
  chemically synthesized
ttcttccccagttgtattatta

SEQ ID NO: 766202 - DNA, 22 bp, Artificial Sequence
  chemically synthesized
ctattcttccccagttgtatta

SEQ ID NO: 766203 - DNA, 22 bp, Artificial Sequence
  chemically synthesized
cctattcttccccagttgtatt

SEQ ID NO: 766204 - DNA, 22 bp, Artificial Sequence
  chemically synthesized
tcctattcttccccagttgtat

SEQ ID NO: 766205 - DNA, 22 bp, Artificial Sequence
  chemically synthesized
ttcctattcttccccagttgta

SEQ ID NO: 766206 - DNA, 22 bp, Artificial Sequence
  chemically synthesized
ataagtaataatacaactgggg

SEQ ID NO: 766207 - DNA, 22 bp, Artificial Sequence
  chemically synthesized
gtaaaacatccataacttttcc

SEQ ID NO: 766208 - DNA, 22 bp, Artificial Sequence
  chemically synthesized
gggaagaataggaaaagttatg

SEQ ID NO: 766209 - DNA, 22 bp, Artificial Sequence
  chemically synthesized
tagtaaaacatccataactttt

SEQ ID NO: 766210 - DNA, 22 bp, Artificial Sequence
  chemically synthesized
ctagtaaaacatccataacttt

SEQ ID NO: 766211 - DNA, 22 bp, Artificial Sequence
  chemically synthesized
ttctagtaaaacatccataact

SEQ ID NO: 766212 - DNA, 22 bp, Artificial Sequence
  chemically synthesized
cttctagtaaaacatccataac

SEQ ID NO: 766213 - DNA, 22 bp, Artificial Sequence
  chemically synthesized
tcttctagtaaaacatccataa

SEQ ID NO: 766214 - DNA, 22 bp, Artificial Sequence
  chemically synthesized
ttcttctagtaaaacatccata

SEQ ID NO: 766215 - DNA, 22 bp, Artificial Sequence
  chemically synthesized
tttttcttctagtaaaacatcc

SEQ ID NO: 766216 - DNA, 22 bp, Artificial Sequence
  chemically synthesized
atttttcttctagtaaaacatc

SEQ ID NO: 766217 - DNA, 22 bp, Artificial Sequence
  chemically synthesized
tatttttcttctagtaaaacat

SEQ ID NO: 766218 - DNA, 22 bp, Artificial Sequence
  chemically synthesized
tttatttttcttctagtaaaac

SEQ ID NO: 766219 - DNA, 22 bp, Artificial Sequence
  chemically synthesized
ctttatttttcttctagtaaaa

SEQ ID NO: 766220 - DNA, 22 bp, Artificial Sequence
  chemically synthesized
ccttctttatttttcttctagt

SEQ ID NO: 766221 - DNA, 22 bp, Artificial Sequence
  chemically synthesized
tggatgttttactagaagaaaa

SEQ ID NO: 766222 - DNA, 22 bp, Artificial Sequence
  chemically synthesized
acatctcccttctttatttttc

SEQ ID NO: 766223 - DNA, 22 bp, Artificial Sequence
  chemically synthesized
gacatctcccttctttattttt

SEQ ID NO: 766224 - DNA, 22 bp, Artificial Sequence
  chemically synthesized
ttgacatctcccttctttattt

SEQ ID NO: 766225 - DNA, 22 bp, Artificial Sequence
  chemically synthesized
tactagaagaaaaataaagaag

SEQ ID NO: 766226 - DNA, 22 bp, Artificial Sequence
  chemically synthesized
actagaagaaaaataaagaagg

SEQ ID NO: 766227 - DNA, 22 bp, Artificial Sequence
  chemically synthesized
ctagaagaaaaataaagaaggg

SEQ ID NO: 766228 - DNA, 22 bp, Artificial Sequence
  chemically synthesized
attcttgacatctcccttcttt

SEQ ID NO: 766229 - DNA, 22 bp, Artificial Sequence
  chemically synthesized
gaagaaaaataaagaagggaga

SEQ ID NO: 766230 - DNA, 22 bp, Artificial Sequence
  chemically synthesized
ataataaaaagaagggtacagc

SEQ ID NO: 766231 - DNA, 22 bp, Artificial Sequence
  chemically synthesized
gtgctgtacccttctttttatt

SEQ ID NO: 766232 - DNA, 22 bp, Artificial Sequence
  chemically synthesized
ataaaatggttaataataaaaa

SEQ ID NO: 766233 - DNA, 22 bp, Artificial Sequence
  chemically synthesized
tacccttctttttattattaac

SEQ ID NO: 766234 - DNA, 22 bp, Artificial Sequence
  chemically synthesized
atggttaataaaatggttaata

SEQ ID NO: 766235 - DNA, 22 bp, Artificial Sequence
  chemically synthesized
aatggttaataaaatggttaat

SEQ ID NO: 766236 - DNA, 22 bp, Artificial Sequence
  chemically synthesized
ctttttattattaaccatttta

SEQ ID NO: 766237 - DNA, 22 bp, Artificial Sequence
  chemically synthesized
cttaatggttaataaaatggtt

SEQ ID NO: 766238 - DNA, 22 bp, Artificial Sequence
  chemically synthesized
tttttattattaaccattttat

SEQ ID NO: 766239 - DNA, 22 bp, Artificial Sequence
  chemically synthesized
tttattattaaccattttatta

SEQ ID NO: 766240 - DNA, 22 bp, Artificial Sequence
  chemically synthesized
ttattattaaccattttattaa

SEQ ID NO: 766241 - DNA, 22 bp, Artificial Sequence
  chemically synthesized
tattattaaccattttattaac

SEQ ID NO: 766242 - DNA, 22 bp, Artificial Sequence
  chemically synthesized
attattaaccattttattaacc

SEQ ID NO: 766243 - DNA, 22 bp, Artificial Sequence
  chemically synthesized
ttattaaccattttattaacca

SEQ ID NO: 766244 - DNA, 22 bp, Artificial Sequence
  chemically synthesized
ttaaccattttattaaccatta

SEQ ID NO: 766245 - DNA, 22 bp, Artificial Sequence
  chemically synthesized
accattttattaaccattaagc

SEQ ID NO: 766246 - DNA, 22 bp, Artificial Sequence
  chemically synthesized
tattaaccattaagcagatggt

SEQ ID NO: 766247 - DNA, 22 bp, Artificial Sequence
  chemically synthesized
attaaccattaagcagatggtt

SEQ ID NO: 766248 - DNA, 22 bp, Artificial Sequence
  chemically synthesized
gaatagtatcacaaccatctgc

SEQ ID NO: 766249 - DNA, 22 bp, Artificial Sequence
  chemically synthesized
ttaaccattaagcagatggttg

SEQ ID NO: 766250 - DNA, 22 bp, Artificial Sequence
  chemically synthesized
tagaatagtatcacaaccatct

SEQ ID NO: 766251 - DNA, 22 bp, Artificial Sequence
  chemically synthesized
accattaagcagatggttgtga

SEQ ID NO: 766252 - DNA, 22 bp, Artificial Sequence
  chemically synthesized
agcagatggttgtgatactatt

SEQ ID NO: 766253 - DNA, 22 bp, Artificial Sequence
  chemically synthesized
atgatgttctagaatagtatca

SEQ ID NO: 766254 - DNA, 22 bp, Artificial Sequence
  chemically synthesized
ttcatgatgttctagaatagta

SEQ ID NO: 766255 - DNA, 22 bp, Artificial Sequence
  chemically synthesized
tgatactattctagaacatcat

SEQ ID NO: 766256 - DNA, 22 bp, Artificial Sequence
  chemically synthesized
ttctagaacatcatgaataatc

SEQ ID NO: 766257 - DNA, 22 bp, Artificial Sequence
  chemically synthesized
tagaacatcatgaataatcgta

SEQ ID NO: 766258 - DNA, 22 bp, Artificial Sequence
  chemically synthesized
gaacatcatgaataatcgtatc

SEQ ID NO: 766259 - DNA, 22 bp, Artificial Sequence
  chemically synthesized
cataggaaaggaaatatgtgga

SEQ ID NO: 766260 - DNA, 22 bp, Artificial Sequence
  chemically synthesized
acataggaaaggaaatatgtgg

SEQ ID NO: 766261 - DNA, 22 bp, Artificial Sequence
  chemically synthesized
catttacataggaaaggaaata

SEQ ID NO: 766262 - DNA, 22 bp, Artificial Sequence
  chemically synthesized
gagaccaataattccatttaca

SEQ ID NO: 766263 - DNA, 22 bp, Artificial Sequence
  chemically synthesized
agagaccaataattccatttac

SEQ ID NO: 766264 - DNA, 22 bp, Artificial Sequence
  chemically synthesized
tagagaccaataattccattta

SEQ ID NO: 766265 - DNA, 22 bp, Artificial Sequence
  chemically synthesized
cctttcctatgtaaatggaatt

SEQ ID NO: 766266 - DNA, 22 bp, Artificial Sequence
  chemically synthesized
ctttcctatgtaaatggaatta

SEQ ID NO: 766267 - DNA, 22 bp, Artificial Sequence
  chemically synthesized
ttttagagaccaataattccat

SEQ ID NO: 766268 - DNA, 22 bp, Artificial Sequence
  chemically synthesized
tcctatgtaaatggaattattg

SEQ ID NO: 766269 - DNA, 22 bp, Artificial Sequence
  chemically synthesized
cctatgtaaatggaattattgg

SEQ ID NO: 766270 - DNA, 22 bp, Artificial Sequence
  chemically synthesized
ctatgtaaatggaattattggt

SEQ ID NO: 766271 - DNA, 22 bp, Artificial Sequence
  chemically synthesized
tgtaaatggaattattggtctc

SEQ ID NO: 766272 - DNA, 22 bp, Artificial Sequence
  chemically synthesized
agtcctattttagagaccaata

SEQ ID NO: 766273 - DNA, 22 bp, Artificial Sequence
  chemically synthesized
ctgagtcctattttagagacca

SEQ ID NO: 766274 - DNA, 22 bp, Artificial Sequence
  chemically synthesized
gctgagtcctattttagagacc

SEQ ID NO: 766275 - DNA, 22 bp, Artificial Sequence
  chemically synthesized
atttgctgagtcctattttaga

SEQ ID NO: 766276 - DNA, 22 bp, Artificial Sequence
  chemically synthesized
catttgctgagtcctattttag

SEQ ID NO: 766277 - DNA, 22 bp, Artificial Sequence
  chemically synthesized
tcatttgctgagtcctatttta

SEQ ID NO: 766278 - DNA, 22 bp, Artificial Sequence
  chemically synthesized
ttggtctctaaaataggactca

SEQ ID NO: 766279 - DNA, 22 bp, Artificial Sequence
  chemically synthesized
gtctctaaaataggactcagca

SEQ ID NO: 766280 - DNA, 22 bp, Artificial Sequence
  chemically synthesized
taaaataggactcagcaaatga

SEQ ID NO: 766281 - DNA, 22 bp, Artificial Sequence
  chemically synthesized
aaataggactcagcaaatgaaa

SEQ ID NO: 766282 - DNA, 22 bp, Artificial Sequence
  chemically synthesized
aaatggggaagttttcatttgc

SEQ ID NO: 766283 - DNA, 22 bp, Artificial Sequence
  chemically synthesized
tattaaaatggggaagttttca

SEQ ID NO: 766284 - DNA, 22 bp, Artificial Sequence
  chemically synthesized
agctatattaaaatggggaagt

SEQ ID NO: 766285 - DNA, 22 bp, Artificial Sequence
  chemically synthesized
agcaaatgaaaacttccccatt

SEQ ID NO: 766286 - DNA, 22 bp, Artificial Sequence
  chemically synthesized
tcagctatattaaaatggggaa

SEQ ID NO: 766287 - DNA, 22 bp, Artificial Sequence
  chemically synthesized
ctcagctatattaaaatgggga

SEQ ID NO: 766288 - DNA, 22 bp, Artificial Sequence
  chemically synthesized
cttctcagctatattaaaatgg

SEQ ID NO: 766289 - DNA, 22 bp, Artificial Sequence
  chemically synthesized
acttctcagctatattaaaatg

SEQ ID NO: 766290 - DNA, 22 bp, Artificial Sequence
  chemically synthesized
cttacttctcagctatattaaa

SEQ ID NO: 766291 - DNA, 22 bp, Artificial Sequence
  chemically synthesized
ccttacttctcagctatattaa

SEQ ID NO: 766292 - DNA, 22 bp, Artificial Sequence
  chemically synthesized
tttccttacttctcagctatat

SEQ ID NO: 766293 - DNA, 22 bp, Artificial Sequence
  chemically synthesized
gtttccttacttctcagctata

SEQ ID NO: 766294 - DNA, 22 bp, Artificial Sequence
  chemically synthesized
ccccattttaatatagctgaga

SEQ ID NO: 766295 - DNA, 22 bp, Artificial Sequence
  chemically synthesized
cccattttaatatagctgagaa

SEQ ID NO: 766296 - DNA, 22 bp, Artificial Sequence
  chemically synthesized
tgtttgtttccttacttctcag

SEQ ID NO: 766297 - DNA, 22 bp, Artificial Sequence
  chemically synthesized
taatatagctgagaagtaagga

SEQ ID NO: 766298 - DNA, 22 bp, Artificial Sequence
  chemically synthesized
aatatagctgagaagtaaggaa

SEQ ID NO: 766299 - DNA, 22 bp, Artificial Sequence
  chemically synthesized
atatagctgagaagtaaggaaa

SEQ ID NO: 766300 - DNA, 22 bp, Artificial Sequence
  chemically synthesized
caccattgtgtttgtttcctta

SEQ ID NO: 766301 - DNA, 22 bp, Artificial Sequence
  chemically synthesized
tacaccattgtgtttgtttcct

SEQ ID NO: 766302 - DNA, 22 bp, Artificial Sequence
  chemically synthesized
ctacaccattgtgtttgtttcc

SEQ ID NO: 766303 - DNA, 22 bp, Artificial Sequence
  chemically synthesized
tctacaccattgtgtttgtttc

SEQ ID NO: 766304 - DNA, 22 bp, Artificial Sequence
  chemically synthesized
tttctacaccattgtgtttgtt

SEQ ID NO: 766305 - DNA, 22 bp, Artificial Sequence
  chemically synthesized
agaagtaaggaaacaaacacaa

SEQ ID NO: 766306 - DNA, 22 bp, Artificial Sequence
  chemically synthesized
ttctttctacaccattgtgttt

SEQ ID NO: 766307 - DNA, 22 bp, Artificial Sequence
  chemically synthesized
ttattctttctacaccattgtg

SEQ ID NO: 766308 - DNA, 22 bp, Artificial Sequence
  chemically synthesized
ttgttattctttctacaccatt

SEQ ID NO: 766309 - DNA, 22 bp, Artificial Sequence
  chemically synthesized
attgttattctttctacaccat

SEQ ID NO: 766310 - DNA, 22 bp, Artificial Sequence
  chemically synthesized
gtcacttattgttattctttct

SEQ ID NO: 766311 - DNA, 22 bp, Artificial Sequence
  chemically synthesized
ggtcacttattgttattctttc

SEQ ID NO: 766312 - DNA, 22 bp, Artificial Sequence
  chemically synthesized
aggagatttggtcacttattgt

SEQ ID NO: 766313 - DNA, 22 bp, Artificial Sequence
  chemically synthesized
aaggagatttggtcacttattg

SEQ ID NO: 766314 - DNA, 22 bp, Artificial Sequence
  chemically synthesized
ttaaggagatttggtcacttat

SEQ ID NO: 766315 - DNA, 22 bp, Artificial Sequence
  chemically synthesized
taataaaattcttaaggagatt

SEQ ID NO: 766316 - DNA, 22 bp, Artificial Sequence
  chemically synthesized
tctataataaaattcttaagga

SEQ ID NO: 766317 - DNA, 22 bp, Artificial Sequence
  chemically synthesized
gagataatctgtctataataaa

SEQ ID NO: 766318 - DNA, 22 bp, Artificial Sequence
  chemically synthesized
agagataatctgtctataataa

SEQ ID NO: 766319 - DNA, 22 bp, Artificial Sequence
  chemically synthesized
cttaagaattttattatagaca

SEQ ID NO: 766320 - DNA, 22 bp, Artificial Sequence
  chemically synthesized
aagaattttattatagacagat

SEQ ID NO: 766321 - DNA, 22 bp, Artificial Sequence
  chemically synthesized
agaattttattatagacagatt

SEQ ID NO: 766322 - DNA, 22 bp, Artificial Sequence
  chemically synthesized
agaaaagcttagagataatctg

SEQ ID NO: 766323 - DNA, 22 bp, Artificial Sequence
  chemically synthesized
cagaaaagcttagagataatct

SEQ ID NO: 766324 - DNA, 22 bp, Artificial Sequence
  chemically synthesized
tcagaaaagcttagagataatc

SEQ ID NO: 766325 - DNA, 22 bp, Artificial Sequence
  chemically synthesized
tattatagacagattatctcta

SEQ ID NO: 766326 - DNA, 22 bp, Artificial Sequence
  chemically synthesized
attatagacagattatctctaa

SEQ ID NO: 766327 - DNA, 22 bp, Artificial Sequence
  chemically synthesized
ttatagacagattatctctaag

SEQ ID NO: 766328 - DNA, 22 bp, Artificial Sequence
  chemically synthesized
ctttcagaaaagcttagagata

SEQ ID NO: 766329 - DNA, 22 bp, Artificial Sequence
  chemically synthesized
tagacagattatctctaagctt

SEQ ID NO: 766330 - DNA, 22 bp, Artificial Sequence
  chemically synthesized
actgctttcagaaaagcttaga

SEQ ID NO: 766331 - DNA, 22 bp, Artificial Sequence
  chemically synthesized
atatactaactgctttcagaaa

SEQ ID NO: 766332 - DNA, 22 bp, Artificial Sequence
  chemically synthesized
tctctaagcttttctgaaagca

SEQ ID NO: 766333 - DNA, 22 bp, Artificial Sequence
  chemically synthesized
ttcatatactaactgctttcag

SEQ ID NO: 766334 - DNA, 22 bp, Artificial Sequence
  chemically synthesized
taagcttttctgaaagcagtta

SEQ ID NO: 766335 - DNA, 22 bp, Artificial Sequence
  chemically synthesized
agcttttctgaaagcagttagt

SEQ ID NO: 766336 - DNA, 22 bp, Artificial Sequence
  chemically synthesized
taattattcatatactaactgc

SEQ ID NO: 766337 - DNA, 22 bp, Artificial Sequence
  chemically synthesized
ataattattcatatactaactg

SEQ ID NO: 766338 - DNA, 22 bp, Artificial Sequence
  chemically synthesized
ttctgaaagcagttagtatatg

SEQ ID NO: 766339 - DNA, 22 bp, Artificial Sequence
  chemically synthesized
tctgaaagcagttagtatatga

SEQ ID NO: 766340 - DNA, 22 bp, Artificial Sequence
  chemically synthesized
ctgaaagcagttagtatatgaa

SEQ ID NO: 766341 - DNA, 22 bp, Artificial Sequence
  chemically synthesized
tgaaagcagttagtatatgaat

SEQ ID NO: 766342 - DNA, 22 bp, Artificial Sequence
  chemically synthesized
aaagcagttagtatatgaataa

SEQ ID NO: 766343 - DNA, 22 bp, Artificial Sequence
  chemically synthesized
atggccttataattattcatat

SEQ ID NO: 766344 - DNA, 22 bp, Artificial Sequence
  chemically synthesized
gtatatgaataattataaggcc

SEQ ID NO: 766345 - DNA, 22 bp, Artificial Sequence
  chemically synthesized
tcagtaaggaggaactaatggc

SEQ ID NO: 766346 - DNA, 22 bp, Artificial Sequence
  chemically synthesized
taaggccattagttcctcctta

SEQ ID NO: 766347 - DNA, 22 bp, Artificial Sequence
  chemically synthesized
gataaaaattatcagtaaggag

SEQ ID NO: 766348 - DNA, 22 bp, Artificial Sequence
  chemically synthesized
aattagataaaaattatcagta

SEQ ID NO: 766349 - DNA, 22 bp, Artificial Sequence
  chemically synthesized
aaattagataaaaattatcagt

SEQ ID NO: 766350 - DNA, 22 bp, Artificial Sequence
  chemically synthesized
gttcctccttactgataatttt

SEQ ID NO: 766351 - DNA, 22 bp, Artificial Sequence
  chemically synthesized
atttaaattagataaaaattat

SEQ ID NO: 766352 - DNA, 22 bp, Artificial Sequence
  chemically synthesized
ctccttactgataatttttatc

SEQ ID NO: 766353 - DNA, 22 bp, Artificial Sequence
  chemically synthesized
cttactgataatttttatctaa

SEQ ID NO: 766354 - DNA, 22 bp, Artificial Sequence
  chemically synthesized
actgataatttttatctaattt

SEQ ID NO: 766355 - DNA, 22 bp, Artificial Sequence
  chemically synthesized
ctgataatttttatctaattta

SEQ ID NO: 766356 - DNA, 22 bp, Artificial Sequence
  chemically synthesized
ccatcaagctaatttaaattag

SEQ ID NO: 766357 - DNA, 22 bp, Artificial Sequence
  chemically synthesized
ataatttttatctaatttaaat

SEQ ID NO: 766358 - DNA, 22 bp, Artificial Sequence
  chemically synthesized
cccatcaagctaatttaaatta

SEQ ID NO: 766359 - DNA, 22 bp, Artificial Sequence
  chemically synthesized
tcccatcaagctaatttaaatt

SEQ ID NO: 766360 - DNA, 22 bp, Artificial Sequence
  chemically synthesized
ttcccatcaagctaatttaaat

SEQ ID NO: 766361 - DNA, 22 bp, Artificial Sequence
  chemically synthesized
tttcccatcaagctaatttaaa

SEQ ID NO: 766362 - DNA, 22 bp, Artificial Sequence
  chemically synthesized
ttttcccatcaagctaatttaa

SEQ ID NO: 766363 - DNA, 22 bp, Artificial Sequence
  chemically synthesized
tttttcccatcaagctaattta

SEQ ID NO: 766364 - DNA, 22 bp, Artificial Sequence
  chemically synthesized
ttatctaatttaaattagcttg

SEQ ID NO: 766365 - DNA, 22 bp, Artificial Sequence
  chemically synthesized
tatctaatttaaattagcttga

SEQ ID NO: 766366 - DNA, 22 bp, Artificial Sequence
  chemically synthesized
atctaatttaaattagcttgat

SEQ ID NO: 766367 - DNA, 22 bp, Artificial Sequence
  chemically synthesized
tctaatttaaattagcttgatg

SEQ ID NO: 766368 - DNA, 22 bp, Artificial Sequence
  chemically synthesized
atttaaattagcttgatgggaa

SEQ ID NO: 766369 - DNA, 22 bp, Artificial Sequence
  chemically synthesized
aaattagcttgatgggaaaaaa

SEQ ID NO: 766370 - DNA, 22 bp, Artificial Sequence
  chemically synthesized
aattagcttgatgggaaaaaaa

SEQ ID NO: 766371 - DNA, 22 bp, Artificial Sequence
  chemically synthesized
gaaatcagaccactttttttcc

SEQ ID NO: 766372 - DNA, 22 bp, Artificial Sequence
  chemically synthesized
agaaatcagaccactttttttc

SEQ ID NO: 766373 - DNA, 22 bp, Artificial Sequence
  chemically synthesized
ttagaaatcagaccactttttt

SEQ ID NO: 766374 - DNA, 22 bp, Artificial Sequence
  chemically synthesized
gcttgatgggaaaaaaagtggt

SEQ ID NO: 766375 - DNA, 22 bp, Artificial Sequence
  chemically synthesized
gatgggaaaaaaagtggtctga

SEQ ID NO: 766376 - DNA, 22 bp, Artificial Sequence
  chemically synthesized
agttcttagaaatcagaccact

SEQ ID NO: 766377 - DNA, 22 bp, Artificial Sequence
  chemically synthesized
atgggaaaaaaagtggtctgat

SEQ ID NO: 766378 - DNA, 22 bp, Artificial Sequence
  chemically synthesized
taagttcttagaaatcagacca

SEQ ID NO: 766379 - DNA, 22 bp, Artificial Sequence
  chemically synthesized
ctaagttcttagaaatcagacc

SEQ ID NO: 766380 - DNA, 22 bp, Artificial Sequence
  chemically synthesized
accttctaagttcttagaaatc

SEQ ID NO: 766381 - DNA, 22 bp, Artificial Sequence
  chemically synthesized
ctgaccttctaagttcttagaa

SEQ ID NO: 766382 - DNA, 22 bp, Artificial Sequence
  chemically synthesized
tatgttcctgaccttctaagtt

SEQ ID NO: 766383 - DNA, 22 bp, Artificial Sequence
  chemically synthesized
atttctaagaacttagaaggtc

SEQ ID NO: 766384 - DNA, 22 bp, Artificial Sequence
  chemically synthesized
aattgtatgttcctgaccttct

SEQ ID NO: 766385 - DNA, 22 bp, Artificial Sequence
  chemically synthesized
gaattgtatgttcctgaccttc

SEQ ID NO: 766386 - DNA, 22 bp, Artificial Sequence
  chemically synthesized
ctaagaacttagaaggtcagga

SEQ ID NO: 766387 - DNA, 22 bp, Artificial Sequence
  chemically synthesized
tgaattgtatgttcctgacctt

SEQ ID NO: 766388 - DNA, 22 bp, Artificial Sequence
  chemically synthesized
taagaacttagaaggtcaggaa

SEQ ID NO: 766389 - DNA, 22 bp, Artificial Sequence
  chemically synthesized
agaacttagaaggtcaggaaca

SEQ ID NO: 766390 - DNA, 22 bp, Artificial Sequence
  chemically synthesized
ttttgaattgtatgttcctgac

SEQ ID NO: 766391 - DNA, 22 bp, Artificial Sequence
  chemically synthesized
ctattttgaattgtatgttcct

SEQ ID NO: 766392 - DNA, 22 bp, Artificial Sequence
  chemically synthesized
actattttgaattgtatgttcc

SEQ ID NO: 766393 - DNA, 22 bp, Artificial Sequence
  chemically synthesized
tactattttgaattgtatgttc

SEQ ID NO: 766394 - DNA, 22 bp, Artificial Sequence
  chemically synthesized
agaaggtcaggaacatacaatt

SEQ ID NO: 766395 - DNA, 22 bp, Artificial Sequence
  chemically synthesized
tttactattttgaattgtatgt

SEQ ID NO: 766396 - DNA, 22 bp, Artificial Sequence
  chemically synthesized
gaaggtcaggaacatacaattc

SEQ ID NO: 766397 - DNA, 22 bp, Artificial Sequence
  chemically synthesized
ctttactattttgaattgtatg

SEQ ID NO: 766398 - DNA, 22 bp, Artificial Sequence
  chemically synthesized
ggataatttctttactattttg

SEQ ID NO: 766399 - DNA, 22 bp, Artificial Sequence
  chemically synthesized
aggataatttctttactatttt

SEQ ID NO: 766400 - DNA, 22 bp, Artificial Sequence
  chemically synthesized
gccacttaggataatttcttta

SEQ ID NO: 766401 - DNA, 22 bp, Artificial Sequence
  chemically synthesized
agccacttaggataatttcttt

SEQ ID NO: 766402 - DNA, 22 bp, Artificial Sequence
  chemically synthesized
aaaatagtaaagaaattatcct

SEQ ID NO: 766403 - DNA, 22 bp, Artificial Sequence
  chemically synthesized
aatttagccacttaggataatt

SEQ ID NO: 766404 - DNA, 22 bp, Artificial Sequence
  chemically synthesized
tcaatttagccacttaggataa

SEQ ID NO: 766405 - DNA, 22 bp, Artificial Sequence
  chemically synthesized
ctctcaatttagccacttagga

SEQ ID NO: 766406 - DNA, 22 bp, Artificial Sequence
  chemically synthesized
ctactctcaatttagccactta

SEQ ID NO: 766407 - DNA, 22 bp, Artificial Sequence
  chemically synthesized
cctactctcaatttagccactt

SEQ ID NO: 766408 - DNA, 22 bp, Artificial Sequence
  chemically synthesized
ttcctactctcaatttagccac

SEQ ID NO: 766409 - DNA, 22 bp, Artificial Sequence
  chemically synthesized
cttcctactctcaatttagcca

SEQ ID NO: 766410 - DNA, 22 bp, Artificial Sequence
  chemically synthesized
tcctaagtggctaaattgagag

SEQ ID NO: 766411 - DNA, 22 bp, Artificial Sequence
  chemically synthesized
agtggctaaattgagagtagga

SEQ ID NO: 766412 - DNA, 22 bp, Artificial Sequence
  chemically synthesized
taaggtgtcacttcttcctact

SEQ ID NO: 766413 - DNA, 22 bp, Artificial Sequence
  chemically synthesized
tgtaaggtgtcacttcttccta

SEQ ID NO: 766414 - DNA, 22 bp, Artificial Sequence
  chemically synthesized
tctgtaaggtgtcacttcttcc

SEQ ID NO: 766415 - DNA, 22 bp, Artificial Sequence
  chemically synthesized
aattgagagtaggaagaagtga

SEQ ID NO: 766416 - DNA, 22 bp, Artificial Sequence
  chemically synthesized
attctctgtaaggtgtcacttc

SEQ ID NO: 766417 - DNA, 22 bp, Artificial Sequence
  chemically synthesized
agagtaggaagaagtgacacct

SEQ ID NO: 766418 - DNA, 22 bp, Artificial Sequence
  chemically synthesized
tgattctctgtaaggtgtcact

SEQ ID NO: 766419 - DNA, 22 bp, Artificial Sequence
  chemically synthesized
ctgattctctgtaaggtgtcac

SEQ ID NO: 766420 - DNA, 22 bp, Artificial Sequence
  chemically synthesized
tctgattctctgtaaggtgtca

SEQ ID NO: 766421 - DNA, 22 bp, Artificial Sequence
  chemically synthesized
cacctttctgattctctgtaag

SEQ ID NO: 766422 - DNA, 22 bp, Artificial Sequence
  chemically synthesized
acacctttctgattctctgtaa

SEQ ID NO: 766423 - DNA, 22 bp, Artificial Sequence
  chemically synthesized
tacacctttctgattctctgta

SEQ ID NO: 766424 - DNA, 22 bp, Artificial Sequence
  chemically synthesized
ttacacctttctgattctctgt

SEQ ID NO: 766425 - DNA, 22 bp, Artificial Sequence
  chemically synthesized
cttttacacctttctgattctc

SEQ ID NO: 766426 - DNA, 22 bp, Artificial Sequence
  chemically synthesized
acagagaatcagaaaggtgtaa

SEQ ID NO: 766427 - DNA, 22 bp, Artificial Sequence
  chemically synthesized
cagagaatcagaaaggtgtaaa

SEQ ID NO: 766428 - DNA, 22 bp, Artificial Sequence
  chemically synthesized
tgcatgcccatggctcctttta

SEQ ID NO: 766429 - DNA, 22 bp, Artificial Sequence
  chemically synthesized
gtcaattatgcatgcccatggc

SEQ ID NO: 766430 - DNA, 22 bp, Artificial Sequence
  chemically synthesized
tgtgaccctggtcaattatgca

SEQ ID NO: 766431 - DNA, 22 bp, Artificial Sequence
  chemically synthesized
cacactgtgtgaccctggtcaa

SEQ ID NO: 766432 - DNA, 22 bp, Artificial Sequence
  chemically synthesized
ccacactgtgtgaccctggtca

SEQ ID NO: 766433 - DNA, 22 bp, Artificial Sequence
  chemically synthesized
gtttccacactgtgtgaccctg

SEQ ID NO: 766434 - DNA, 22 bp, Artificial Sequence
  chemically synthesized
ttagtttccacactgtgtgacc

SEQ ID NO: 766435 - DNA, 22 bp, Artificial Sequence
  chemically synthesized
accagggtcacacagtgtggaa

SEQ ID NO: 766436 - DNA, 22 bp, Artificial Sequence
  chemically synthesized
atgcatggagagctgttagttt

SEQ ID NO: 766437 - DNA, 22 bp, Artificial Sequence
  chemically synthesized
ctgatgcatggagagctgttag

SEQ ID NO: 766438 - DNA, 22 bp, Artificial Sequence
  chemically synthesized
aagggctactgatgcatggaga

SEQ ID NO: 766439 - DNA, 22 bp, Artificial Sequence
  chemically synthesized
caagggctactgatgcatggag

SEQ ID NO: 766440 - DNA, 22 bp, Artificial Sequence
  chemically synthesized
acagctctccatgcatcagtag

SEQ ID NO: 766441 - DNA, 22 bp, Artificial Sequence
  chemically synthesized
tccatgcatcagtagcccttga

SEQ ID NO: 766442 - DNA, 22 bp, Artificial Sequence
  chemically synthesized
catgcatcagtagcccttgaag

SEQ ID NO: 766443 - DNA, 22 bp, Artificial Sequence
  chemically synthesized
taaaacgaggtgatgccttcaa

SEQ ID NO: 766444 - DNA, 22 bp, Artificial Sequence
  chemically synthesized
gctataaaacgaggtgatgcct

SEQ ID NO: 766445 - DNA, 22 bp, Artificial Sequence
  chemically synthesized
cgctataaaacgaggtgatgcc

SEQ ID NO: 766446 - DNA, 22 bp, Artificial Sequence
  chemically synthesized
cttcgctataaaacgaggtgat

SEQ ID NO: 766447 - DNA, 22 bp, Artificial Sequence
  chemically synthesized
gcttcgctataaaacgaggtga

SEQ ID NO: 766448 - DNA, 22 bp, Artificial Sequence
  chemically synthesized
tgcttcgctataaaacgaggtg

SEQ ID NO: 766449 - DNA, 22 bp, Artificial Sequence
  chemically synthesized
ttttgcttcgctataaaacgag

SEQ ID NO: 766450 - DNA, 22 bp, Artificial Sequence
  chemically synthesized
gaaggcatcacctcgttttata

SEQ ID NO: 766451 - DNA, 22 bp, Artificial Sequence
  chemically synthesized
aaggcatcacctcgttttatag

SEQ ID NO: 766452 - DNA, 22 bp, Artificial Sequence
  chemically synthesized
actattttgcttcgctataaaa

SEQ ID NO: 766453 - DNA, 22 bp, Artificial Sequence
  chemically synthesized
agcattaactattttgcttcgc

SEQ ID NO: 766454 - DNA, 22 bp, Artificial Sequence
  chemically synthesized
gttttatagcgaagcaaaatag

SEQ ID NO: 766455 - DNA, 22 bp, Artificial Sequence
  chemically synthesized
tatagcgaagcaaaatagttaa

SEQ ID NO: 766456 - DNA, 22 bp, Artificial Sequence
  chemically synthesized
atagcgaagcaaaatagttaat

SEQ ID NO: 766457 - DNA, 22 bp, Artificial Sequence
  chemically synthesized
tagcgaagcaaaatagttaatg

SEQ ID NO: 766458 - DNA, 22 bp, Artificial Sequence
  chemically synthesized
agcatcatcatcctgagcatta

SEQ ID NO: 766459 - DNA, 22 bp, Artificial Sequence
  chemically synthesized
attcagcatcatcatcctgagc

SEQ ID NO: 766460 - DNA, 22 bp, Artificial Sequence
  chemically synthesized
gctaattcagcatcatcatcct

SEQ ID NO: 766461 - DNA, 22 bp, Artificial Sequence
  chemically synthesized
cctggctaattcagcatcatca

SEQ ID NO: 766462 - DNA, 22 bp, Artificial Sequence
  chemically synthesized
ccctggctaattcagcatcatc

SEQ ID NO: 766463 - DNA, 22 bp, Artificial Sequence
  chemically synthesized
atgctcaggatgatgatgctga

SEQ ID NO: 766464 - DNA, 22 bp, Artificial Sequence
  chemically synthesized
tccctggctaattcagcatcat

SEQ ID NO: 766465 - DNA, 22 bp, Artificial Sequence
  chemically synthesized
ctttccctggctaattcagcat

SEQ ID NO: 766466 - DNA, 22 bp, Artificial Sequence
  chemically synthesized
aggatgatgatgctgaattagc

SEQ ID NO: 766467 - DNA, 22 bp, Artificial Sequence
  chemically synthesized
aatgtaaatctgctttccctgg

SEQ ID NO: 766468 - DNA, 22 bp, Artificial Sequence
  chemically synthesized
ctgaatgtaaatctgctttccc

SEQ ID NO: 766469 - DNA, 22 bp, Artificial Sequence
  chemically synthesized
actgaatgtaaatctgctttcc

SEQ ID NO: 766470 - DNA, 22 bp, Artificial Sequence
  chemically synthesized
tactgaatgtaaatctgctttc

SEQ ID NO: 766471 - DNA, 22 bp, Artificial Sequence
  chemically synthesized
aattagccagggaaagcagatt

SEQ ID NO: 766472 - DNA, 22 bp, Artificial Sequence
  chemically synthesized
gccagggaaagcagatttacat

SEQ ID NO: 766473 - DNA, 22 bp, Artificial Sequence
  chemically synthesized
aacagattttactgaatgtaaa

SEQ ID NO: 766474 - DNA, 22 bp, Artificial Sequence
  chemically synthesized
aaacagattttactgaatgtaa

SEQ ID NO: 766475 - DNA, 22 bp, Artificial Sequence
  chemically synthesized
ttaaacagattttactgaatgt

SEQ ID NO: 766476 - DNA, 22 bp, Artificial Sequence
  chemically synthesized
cttaaacagattttactgaatg

SEQ ID NO: 766477 - DNA, 22 bp, Artificial Sequence
  chemically synthesized
ttcttaaacagattttactgaa

SEQ ID NO: 766478 - DNA, 22 bp, Artificial Sequence
  chemically synthesized
cttcttaaacagattttactga

SEQ ID NO: 766479 - DNA, 22 bp, Artificial Sequence
  chemically synthesized
tcttcttaaacagattttactg

SEQ ID NO: 766480 - DNA, 22 bp, Artificial Sequence
  chemically synthesized
ctttcttcttaaacagatttta

SEQ ID NO: 766481 - DNA, 22 bp, Artificial Sequence
  chemically synthesized
acattcagtaaaatctgtttaa

SEQ ID NO: 766482 - DNA, 22 bp, Artificial Sequence
  chemically synthesized
cattcagtaaaatctgtttaag

SEQ ID NO: 766483 - DNA, 22 bp, Artificial Sequence
  chemically synthesized
catacactgctttcttcttaaa

SEQ ID NO: 766484 - DNA, 22 bp, Artificial Sequence
  chemically synthesized
agtaaaatctgtttaagaagaa

SEQ ID NO: 766485 - DNA, 22 bp, Artificial Sequence
  chemically synthesized
acatacactgctttcttcttaa

SEQ ID NO: 766486 - DNA, 22 bp, Artificial Sequence
  chemically synthesized
aagcatttacatacactgcttt

SEQ ID NO: 766487 - DNA, 22 bp, Artificial Sequence
  chemically synthesized
gaagcatttacatacactgctt

SEQ ID NO: 766488 - DNA, 22 bp, Artificial Sequence
  chemically synthesized
tttaagaagaaagcagtgtatg

SEQ ID NO: 766489 - DNA, 22 bp, Artificial Sequence
  chemically synthesized
aagaagaaagcagtgtatgtaa

SEQ ID NO: 766490 - DNA, 22 bp, Artificial Sequence
  chemically synthesized
agaagaaagcagtgtatgtaaa

SEQ ID NO: 766491 - DNA, 22 bp, Artificial Sequence
  chemically synthesized
gtcatttgaagcatttacatac

SEQ ID NO: 766492 - DNA, 22 bp, Artificial Sequence
  chemically synthesized
ggtcatttgaagcatttacata

SEQ ID NO: 766493 - DNA, 22 bp, Artificial Sequence
  chemically synthesized
tatcaaataacagtcatttggt

SEQ ID NO: 766494 - DNA, 22 bp, Artificial Sequence
  chemically synthesized
caaatgaccaaatgactgttat

SEQ ID NO: 766495 - DNA, 22 bp, Artificial Sequence
  chemically synthesized
aaatgaccaaatgactgttatt

SEQ ID NO: 766496 - DNA, 22 bp, Artificial Sequence
  chemically synthesized
aaaacaactgtatcaaataaca

SEQ ID NO: 766497 - DNA, 22 bp, Artificial Sequence
  chemically synthesized
caaaacaactgtatcaaataac

SEQ ID NO: 766498 - DNA, 22 bp, Artificial Sequence
  chemically synthesized
tcaaaacaactgtatcaaataa

SEQ ID NO: 766499 - DNA, 22 bp, Artificial Sequence
  chemically synthesized
ttcaaaacaactgtatcaaata

SEQ ID NO: 766500 - DNA, 22 bp, Artificial Sequence
  chemically synthesized
acaccttttcaaaacaactgta

SEQ ID NO: 766501 - DNA, 22 bp, Artificial Sequence
  chemically synthesized
ttatttgatacagttgttttga

SEQ ID NO: 766502 - DNA, 22 bp, Artificial Sequence
  chemically synthesized
tttgatacagttgttttgaaaa

SEQ ID NO: 766503 - DNA, 22 bp, Artificial Sequence
  chemically synthesized
aatcattaacaccttttcaaaa

SEQ ID NO: 766504 - DNA, 22 bp, Artificial Sequence
  chemically synthesized
aaatcattaacaccttttcaaa

SEQ ID NO: 766505 - DNA, 22 bp, Artificial Sequence
  chemically synthesized
gatacagttgttttgaaaaggt

SEQ ID NO: 766506 - DNA, 22 bp, Artificial Sequence
  chemically synthesized
atacagttgttttgaaaaggtg

SEQ ID NO: 766507 - DNA, 22 bp, Artificial Sequence
  chemically synthesized
tttaaatcattaacaccttttc

SEQ ID NO: 766508 - DNA, 22 bp, Artificial Sequence
  chemically synthesized
atttaaatcattaacacctttt

SEQ ID NO: 766509 - DNA, 22 bp, Artificial Sequence
  chemically synthesized
tatttaaatcattaacaccttt

SEQ ID NO: 766510 - DNA, 22 bp, Artificial Sequence
  chemically synthesized
ttatttaaatcattaacacctt

SEQ ID NO: 766511 - DNA, 22 bp, Artificial Sequence
  chemically synthesized
tttttatttaaatcattaacac

SEQ ID NO: 766512 - DNA, 22 bp, Artificial Sequence
  chemically synthesized
atttttatttaaatcattaaca

SEQ ID NO: 766513 - DNA, 22 bp, Artificial Sequence
  chemically synthesized
ttttgaaaaggtgttaatgatt

SEQ ID NO: 766514 - DNA, 22 bp, Artificial Sequence
  chemically synthesized
tatttttatttaaatcattaac

SEQ ID NO: 766515 - DNA, 22 bp, Artificial Sequence
  chemically synthesized
tgaaaaggtgttaatgatttaa

SEQ ID NO: 766516 - DNA, 22 bp, Artificial Sequence
  chemically synthesized
ttttatttttatttaaatcatt

SEQ ID NO: 766517 - DNA, 22 bp, Artificial Sequence
  chemically synthesized
gaaaaggtgttaatgatttaaa

SEQ ID NO: 766518 - DNA, 22 bp, Artificial Sequence
  chemically synthesized
gttttatttttatttaaatcat

SEQ ID NO: 766519 - DNA, 22 bp, Artificial Sequence
  chemically synthesized
aaaaggtgttaatgatttaaat

SEQ ID NO: 766520 - DNA, 22 bp, Artificial Sequence
  chemically synthesized
tgttttatttttatttaaatca

SEQ ID NO: 766521 - DNA, 22 bp, Artificial Sequence
  chemically synthesized
ttgttttatttttatttaaatc

SEQ ID NO: 766522 - DNA, 22 bp, Artificial Sequence
  chemically synthesized
tttttgttttatttttatttaa

SEQ ID NO: 766523 - DNA, 22 bp, Artificial Sequence
  chemically synthesized
atgatttaaataaaaataaaac

SEQ ID NO: 766524 - DNA, 22 bp, Artificial Sequence
  chemically synthesized
atataattgtttttgttttatt

SEQ ID NO: 766525 - DNA, 22 bp, Artificial Sequence
  chemically synthesized
catataattgtttttgttttat

SEQ ID NO: 766526 - DNA, 22 bp, Artificial Sequence
  chemically synthesized
tcatataattgtttttgtttta

SEQ ID NO: 766527 - DNA, 22 bp, Artificial Sequence
  chemically synthesized
aaataaaaataaaacaaaaaca

SEQ ID NO: 766528 - DNA, 22 bp, Artificial Sequence
  chemically synthesized
ctttcatataattgtttttgtt

SEQ ID NO: 766529 - DNA, 22 bp, Artificial Sequence
  chemically synthesized
aataaaaataaaacaaaaacaa

SEQ ID NO: 766530 - DNA, 22 bp, Artificial Sequence
  chemically synthesized
tactttcatataattgtttttg

SEQ ID NO: 766531 - DNA, 22 bp, Artificial Sequence
  chemically synthesized
agggagttctactttcatataa

SEQ ID NO: 766532 - DNA, 22 bp, Artificial Sequence
  chemically synthesized
gataaccagtctaagggagttc

SEQ ID NO: 766533 - DNA, 22 bp, Artificial Sequence
  chemically synthesized
tatgaaagtagaactcccttag

SEQ ID NO: 766534 - DNA, 22 bp, Artificial Sequence
  chemically synthesized
atgagtcatgttggataaccag

SEQ ID NO: 766535 - DNA, 22 bp, Artificial Sequence
  chemically synthesized
aatgagtcatgttggataacca

SEQ ID NO: 766536 - DNA, 22 bp, Artificial Sequence
  chemically synthesized
ccttagactggttatccaacat

SEQ ID NO: 766537 - DNA, 22 bp, Artificial Sequence
  chemically synthesized
atgtttaatgagtcatgttgga

SEQ ID NO: 766538 - DNA, 22 bp, Artificial Sequence
  chemically synthesized
agactggttatccaacatgact

SEQ ID NO: 766539 - DNA, 22 bp, Artificial Sequence
  chemically synthesized
gactggttatccaacatgactc

SEQ ID NO: 766540 - DNA, 22 bp, Artificial Sequence
  chemically synthesized
gagctcatgtttaatgagtcat

SEQ ID NO: 766541 - DNA, 22 bp, Artificial Sequence
  chemically synthesized
agagctcatgtttaatgagtca

SEQ ID NO: 766542 - DNA, 22 bp, Artificial Sequence
  chemically synthesized
gttatccaacatgactcattaa

SEQ ID NO: 766543 - DNA, 22 bp, Artificial Sequence
  chemically synthesized
tttagagctcatgtttaatgag

SEQ ID NO: 766544 - DNA, 22 bp, Artificial Sequence
  chemically synthesized
tccaacatgactcattaaacat

SEQ ID NO: 766545 - DNA, 22 bp, Artificial Sequence
  chemically synthesized
ctatttagagctcatgtttaat

SEQ ID NO: 766546 - DNA, 22 bp, Artificial Sequence
  chemically synthesized
tactatttagagctcatgttta

SEQ ID NO: 766547 - DNA, 22 bp, Artificial Sequence
  chemically synthesized
caaaagctctactatttagagc

SEQ ID NO: 766548 - DNA, 22 bp, Artificial Sequence
  chemically synthesized
attaaacatgagctctaaatag

SEQ ID NO: 766549 - DNA, 22 bp, Artificial Sequence
  chemically synthesized
aacatgagctctaaatagtaga

SEQ ID NO: 766550 - DNA, 22 bp, Artificial Sequence
  chemically synthesized
taaatagtagagcttttggagc

SEQ ID NO: 766551 - DNA, 22 bp, Artificial Sequence
  chemically synthesized
aatagtagagcttttggagcac

SEQ ID NO: 766552 - DNA, 22 bp, Artificial Sequence
  chemically synthesized
ttggagcacacttgcatacact

SEQ ID NO: 766553 - DNA, 22 bp, Artificial Sequence
  chemically synthesized
tggagcacacttgcatacactc

SEQ ID NO: 766554 - DNA, 22 bp, Artificial Sequence
  chemically synthesized
ggagcacacttgcatacactca

SEQ ID NO: 766555 - DNA, 22 bp, Artificial Sequence
  chemically synthesized
gagcacacttgcatacactcat

SEQ ID NO: 766556 - DNA, 22 bp, Artificial Sequence
  chemically synthesized
tgtgtgtatacgtatgagtgta

SEQ ID NO: 766557 - DNA, 22 bp, Artificial Sequence
  chemically synthesized
tgtgtgtgtatacgtatgagtg

SEQ ID NO: 766558 - DNA, 22 bp, Artificial Sequence
  chemically synthesized
ctgtgtgtgtatacgtatgagt

SEQ ID NO: 766559 - DNA, 22 bp, Artificial Sequence
  chemically synthesized
tttctgtgtgtgtatacgtatg

SEQ ID NO: 766560 - DNA, 22 bp, Artificial Sequence
  chemically synthesized
gcatacactcatacgtatacac

SEQ ID NO: 766561 - DNA, 22 bp, Artificial Sequence
  chemically synthesized
catacactcatacgtatacaca

SEQ ID NO: 766562 - DNA, 22 bp, Artificial Sequence
  chemically synthesized
atacgtatacacacacagaaac

SEQ ID NO: 766563 - DNA, 22 bp, Artificial Sequence
  chemically synthesized
ataatagaatatctgtttctgt

SEQ ID NO: 766564 - DNA, 22 bp, Artificial Sequence
  chemically synthesized
cataatagaatatctgtttctg

SEQ ID NO: 766565 - DNA, 22 bp, Artificial Sequence
  chemically synthesized
tgtcttcataatagaatatctg

SEQ ID NO: 766566 - DNA, 22 bp, Artificial Sequence
  chemically synthesized
atgtcttcataatagaatatct

SEQ ID NO: 766567 - DNA, 22 bp, Artificial Sequence
  chemically synthesized
ttatgtcttcataatagaatat

SEQ ID NO: 766568 - DNA, 22 bp, Artificial Sequence
  chemically synthesized
ttcttatgtcttcataatagaa

SEQ ID NO: 766569 - DNA, 22 bp, Artificial Sequence
  chemically synthesized
tgttcttatgtcttcataatag

SEQ ID NO: 766570 - DNA, 22 bp, Artificial Sequence
  chemically synthesized
ctgttcttatgtcttcataata

SEQ ID NO: 766571 - DNA, 22 bp, Artificial Sequence
  chemically synthesized
aatttctgttcttatgtcttca

SEQ ID NO: 766572 - DNA, 22 bp, Artificial Sequence
  chemically synthesized
caatttctgttcttatgtcttc

SEQ ID NO: 766573 - DNA, 22 bp, Artificial Sequence
  chemically synthesized
tcaatttctgttcttatgtctt

SEQ ID NO: 766574 - DNA, 22 bp, Artificial Sequence
  chemically synthesized
ctttcaatttctgttcttatgt

SEQ ID NO: 766575 - DNA, 22 bp, Artificial Sequence
  chemically synthesized
gctttcaatttctgttcttatg

SEQ ID NO: 766576 - DNA, 22 bp, Artificial Sequence
  chemically synthesized
tattatgaagacataagaacag

SEQ ID NO: 766577 - DNA, 22 bp, Artificial Sequence
  chemically synthesized
ttatgaagacataagaacagaa

SEQ ID NO: 766578 - DNA, 22 bp, Artificial Sequence
  chemically synthesized
tgaagacataagaacagaaatt

SEQ ID NO: 766579 - DNA, 22 bp, Artificial Sequence
  chemically synthesized
aagatttgctttcaatttctgt

SEQ ID NO: 766580 - DNA, 22 bp, Artificial Sequence
  chemically synthesized
taaagatttgctttcaatttct

SEQ ID NO: 766581 - DNA, 22 bp, Artificial Sequence
  chemically synthesized
ctaaagatttgctttcaatttc

SEQ ID NO: 766582 - DNA, 22 bp, Artificial Sequence
  chemically synthesized
tacacgtttctaaagatttgct

SEQ ID NO: 766583 - DNA, 22 bp, Artificial Sequence
  chemically synthesized
ctgtacacgtttctaaagattt

SEQ ID NO: 766584 - DNA, 22 bp, Artificial Sequence
  chemically synthesized
gattgctgtacacgtttctaaa

SEQ ID NO: 766585 - DNA, 22 bp, Artificial Sequence
  chemically synthesized
agattgctgtacacgtttctaa

SEQ ID NO: 766586 - DNA, 22 bp, Artificial Sequence
  chemically synthesized
aaagcaaatctttagaaacgtg

SEQ ID NO: 766587 - DNA, 22 bp, Artificial Sequence
  chemically synthesized
tagattgctgtacacgtttcta

SEQ ID NO: 766588 - DNA, 22 bp, Artificial Sequence
  chemically synthesized
ttagattgctgtacacgtttct

SEQ ID NO: 766589 - DNA, 22 bp, Artificial Sequence
  chemically synthesized
tttttagattgctgtacacgtt

SEQ ID NO: 766590 - DNA, 22 bp, Artificial Sequence
  chemically synthesized
atttttagattgctgtacacgt

SEQ ID NO: 766591 - DNA, 22 bp, Artificial Sequence
  chemically synthesized
tatttttagattgctgtacacg

SEQ ID NO: 766592 - DNA, 22 bp, Artificial Sequence
  chemically synthesized
ttatttttagattgctgtacac

SEQ ID NO: 766593 - DNA, 22 bp, Artificial Sequence
  chemically synthesized
tttatttttagattgctgtaca

SEQ ID NO: 766594 - DNA, 22 bp, Artificial Sequence
  chemically synthesized
tagaaacgtgtacagcaatcta

SEQ ID NO: 766595 - DNA, 22 bp, Artificial Sequence
  chemically synthesized
agaaacgtgtacagcaatctaa

SEQ ID NO: 766596 - DNA, 22 bp, Artificial Sequence
  chemically synthesized
gaaacgtgtacagcaatctaaa

SEQ ID NO: 766597 - DNA, 22 bp, Artificial Sequence
  chemically synthesized
agccgatgctttttatttttag

SEQ ID NO: 766598 - DNA, 22 bp, Artificial Sequence
  chemically synthesized
aagccgatgctttttattttta

SEQ ID NO: 766599 - DNA, 22 bp, Artificial Sequence
  chemically synthesized
aaaataaaaagcatcggcttaa

SEQ ID NO: 766600 - DNA, 22 bp, Artificial Sequence
  chemically synthesized
caaataccagacatacaaaatt

SEQ ID NO: 766601 - DNA, 22 bp, Artificial Sequence
  chemically synthesized
aaaattacaaataccagacata

SEQ ID NO: 766602 - DNA, 22 bp, Artificial Sequence
  chemically synthesized
aaaaattacaaataccagacat

SEQ ID NO: 766603 - DNA, 22 bp, Artificial Sequence
  chemically synthesized
taaaaattacaaataccagaca

SEQ ID NO: 766604 - DNA, 22 bp, Artificial Sequence
  chemically synthesized
aaattttgtatgtctggtattt

SEQ ID NO: 766605 - DNA, 22 bp, Artificial Sequence
  chemically synthesized
aattttgtatgtctggtatttg

SEQ ID NO: 766606 - DNA, 22 bp, Artificial Sequence
  chemically synthesized
ttttaaaaattacaaataccag

SEQ ID NO: 766607 - DNA, 22 bp, Artificial Sequence
  chemically synthesized
tgtatgtctggtatttgtaatt

SEQ ID NO: 766608 - DNA, 22 bp, Artificial Sequence
  chemically synthesized
gtatgtctggtatttgtaattt

SEQ ID NO: 766609 - DNA, 22 bp, Artificial Sequence
  chemically synthesized
tatgtctggtatttgtaatttt

SEQ ID NO: 766610 - DNA, 22 bp, Artificial Sequence
  chemically synthesized
gtatttgtaatttttaaaataa

SEQ ID NO: 766611 - DNA, 22 bp, Artificial Sequence
  chemically synthesized
gtaatttttaaaataattcatt

SEQ ID NO: 766612 - DNA, 22 bp, Artificial Sequence
  chemically synthesized
taatttttaaaataattcattt

SEQ ID NO: 766613 - DNA, 22 bp, Artificial Sequence
  chemically synthesized
taacatgcaataaaaatgaatt

SEQ ID NO: 766614 - DNA, 22 bp, Artificial Sequence
  chemically synthesized
gtaacatgcaataaaaatgaat

SEQ ID NO: 766615 - DNA, 22 bp, Artificial Sequence
  chemically synthesized
tgtaacatgcaataaaaatgaa

SEQ ID NO: 766616 - DNA, 22 bp, Artificial Sequence
  chemically synthesized
ttgtaacatgcaataaaaatga

SEQ ID NO: 766617 - DNA, 22 bp, Artificial Sequence
  chemically synthesized
ttaaaataattcatttttattg

SEQ ID NO: 766618 - DNA, 22 bp, Artificial Sequence
  chemically synthesized
taaaataattcatttttattgc

SEQ ID NO: 766619 - DNA, 22 bp, Artificial Sequence
  chemically synthesized
aaaataattcatttttattgca

SEQ ID NO: 766620 - DNA, 22 bp, Artificial Sequence
  chemically synthesized
aaataattcatttttattgcat

SEQ ID NO: 766621 - DNA, 22 bp, Artificial Sequence
  chemically synthesized
atacttttgtaacatgcaataa

SEQ ID NO: 766622 - DNA, 22 bp, Artificial Sequence
  chemically synthesized
atttttattgcatgttacaaaa

SEQ ID NO: 766623 - DNA, 22 bp, Artificial Sequence
  chemically synthesized
ttattgcatgttacaaaagtat

SEQ ID NO: 766624 - DNA, 22 bp, Artificial Sequence
  chemically synthesized
tattgcatgttacaaaagtatc

SEQ ID NO: 766625 - DNA, 22 bp, Artificial Sequence
  chemically synthesized
attgcatgttacaaaagtatca

SEQ ID NO: 766626 - DNA, 22 bp, Artificial Sequence
  chemically synthesized
ttgcatgttacaaaagtatcag

SEQ ID NO: 766627 - DNA, 22 bp, Artificial Sequence
  chemically synthesized
catgttacaaaagtatcagtct

SEQ ID NO: 766628 - DNA, 22 bp, Artificial Sequence
  chemically synthesized
ccaatccataatagactgatac

SEQ ID NO: 766629 - DNA, 22 bp, Artificial Sequence
  chemically synthesized
attcccaatccataatagactg

SEQ ID NO: 766630 - DNA, 22 bp, Artificial Sequence
  chemically synthesized
aattcccaatccataatagact

SEQ ID NO: 766631 - DNA, 22 bp, Artificial Sequence
  chemically synthesized
taattcccaatccataatagac

SEQ ID NO: 766632 - DNA, 22 bp, Artificial Sequence
  chemically synthesized
caaaagtatcagtctattatgg

SEQ ID NO: 766633 - DNA, 22 bp, Artificial Sequence
  chemically synthesized
ttttaattcccaatccataata

SEQ ID NO: 766634 - DNA, 22 bp, Artificial Sequence
  chemically synthesized
gttttaattcccaatccataat

SEQ ID NO: 766635 - DNA, 22 bp, Artificial Sequence
  chemically synthesized
cgcttgttttaattcccaatcc

SEQ ID NO: 766636 - DNA, 22 bp, Artificial Sequence
  chemically synthesized
gcgcttgttttaattcccaatc

SEQ ID NO: 766637 - DNA, 22 bp, Artificial Sequence
  chemically synthesized
tgcgcttgttttaattcccaat

SEQ ID NO: 766638 - DNA, 22 bp, Artificial Sequence
  chemically synthesized
ttgcgcttgttttaattcccaa

SEQ ID NO: 766639 - DNA, 22 bp, Artificial Sequence
  chemically synthesized
tttgcgcttgttttaattccca

SEQ ID NO: 766640 - DNA, 22 bp, Artificial Sequence
  chemically synthesized
ttttgcgcttgttttaattccc

SEQ ID NO: 766641 - DNA, 22 bp, Artificial Sequence
  chemically synthesized
tttttgcgcttgttttaattcc

SEQ ID NO: 766642 - DNA, 22 bp, Artificial Sequence
  chemically synthesized
ttttttgcgcttgttttaattc

SEQ ID NO: 766643 - DNA, 22 bp, Artificial Sequence
  chemically synthesized
ttatggattgggaattaaaaca

SEQ ID NO: 766644 - DNA, 22 bp, Artificial Sequence
  chemically synthesized
tttttttgcgcttgttttaatt

SEQ ID NO: 766645 - DNA, 22 bp, Artificial Sequence
  chemically synthesized
ttttttttgcgcttgttttaat

SEQ ID NO: 766646 - DNA, 22 bp, Artificial Sequence
  chemically synthesized
tttttttttgcgcttgttttaa

SEQ ID NO: 766647 - DNA, 22 bp, Artificial Sequence
  chemically synthesized
tggattgggaattaaaacaagc

SEQ ID NO: 766648 - DNA, 22 bp, Artificial Sequence
  chemically synthesized
ttttttttttgcgcttgtttta

SEQ ID NO: 766649 - DNA, 22 bp, Artificial Sequence
  chemically synthesized
tttttttttttgcgcttgtttt

SEQ ID NO: 766650 - DNA, 22 bp, Artificial Sequence
  chemically synthesized
ttttttttttttgcgcttgttt

SEQ ID NO: 766651 - DNA, 22 bp, Artificial Sequence
  chemically synthesized
tttttttttttttgcgcttgtt

SEQ ID NO: 766652 - DNA, 22 bp, Artificial Sequence
  chemically synthesized
ttttttttttttttgcgcttgt

SEQ ID NO: 766653 - DNA, 22 bp, Artificial Sequence
  chemically synthesized
tttttttttttttttgcgcttg

SEQ ID NO: 766654 - DNA, 22 bp, Artificial Sequence
  chemically synthesized
ttttttttttttttttgcgctt

SEQ ID NO: 766655 - DNA, 22 bp, Artificial Sequence
  chemically synthesized
ggaattaaaacaagcgcaaaaa

SEQ ID NO: 766656 - DNA, 22 bp, Artificial Sequence
  chemically synthesized
gggttttttttttttttttttt

SEQ ID NO: 766657 - DNA, 22 bp, Artificial Sequence
  chemically synthesized
cgggtttttttttttttttttt

SEQ ID NO: 766658 - DNA, 22 bp, Artificial Sequence
  chemically synthesized
aaacaagcgcaaaaaaaaaaaa

SEQ ID NO: 766659 - DNA, 22 bp, Artificial Sequence
  chemically synthesized
ggaaagatccacttcgggtttt

SEQ ID NO: 766660 - DNA, 22 bp, Artificial Sequence
  chemically synthesized
ttaggaaagatccacttcgggt

SEQ ID NO: 766661 - DNA, 22 bp, Artificial Sequence
  chemically synthesized
gttaggaaagatccacttcggg

SEQ ID NO: 766662 - DNA, 22 bp, Artificial Sequence
  chemically synthesized
gaaaaacttgttaggaaagatc

SEQ ID NO: 766663 - DNA, 22 bp, Artificial Sequence
  chemically synthesized
tcgaaaaacttgttaggaaaga

SEQ ID NO: 766664 - DNA, 22 bp, Artificial Sequence
  chemically synthesized
ctcgaaaaacttgttaggaaag

SEQ ID NO: 766665 - DNA, 22 bp, Artificial Sequence
  chemically synthesized
ttctcgaaaaacttgttaggaa

SEQ ID NO: 766666 - DNA, 22 bp, Artificial Sequence
  chemically synthesized
tggattcttctcgaaaaacttg

SEQ ID NO: 766667 - DNA, 22 bp, Artificial Sequence
  chemically synthesized
ctatggattcttctcgaaaaac

SEQ ID NO: 766668 - DNA, 22 bp, Artificial Sequence
  chemically synthesized
cctatggattcttctcgaaaaa

SEQ ID NO: 766669 - DNA, 22 bp, Artificial Sequence
  chemically synthesized
tcctaacaagtttttcgagaag

SEQ ID NO: 766670 - DNA, 22 bp, Artificial Sequence
  chemically synthesized
ttcctatggattcttctcgaaa

SEQ ID NO: 766671 - DNA, 22 bp, Artificial Sequence
  chemically synthesized
cctaacaagtttttcgagaaga

SEQ ID NO: 766672 - DNA, 22 bp, Artificial Sequence
  chemically synthesized
cttcctatggattcttctcgaa

SEQ ID NO: 766673 - DNA, 22 bp, Artificial Sequence
  chemically synthesized
ctaacaagtttttcgagaagaa

SEQ ID NO: 766674 - DNA, 22 bp, Artificial Sequence
  chemically synthesized
acaagtttttcgagaagaatcc

SEQ ID NO: 766675 - DNA, 22 bp, Artificial Sequence
  chemically synthesized
ttcgagaagaatccataggaag

SEQ ID NO: 766676 - DNA, 22 bp, Artificial Sequence
  chemically synthesized
tgggtccaatttcttcctatgg

SEQ ID NO: 766677 - DNA, 22 bp, Artificial Sequence
  chemically synthesized
tcgagaagaatccataggaaga

SEQ ID NO: 766678 - DNA, 22 bp, Artificial Sequence
  chemically synthesized
cgagaagaatccataggaagaa

SEQ ID NO: 766679 - DNA, 22 bp, Artificial Sequence
  chemically synthesized
gagaagaatccataggaagaaa

SEQ ID NO: 766680 - DNA, 22 bp, Artificial Sequence
  chemically synthesized
ataaggccaagactgtgggtcc

SEQ ID NO: 766681 - DNA, 22 bp, Artificial Sequence
  chemically synthesized
gaatcctgataaggccaagact

SEQ ID NO: 766682 - DNA, 22 bp, Artificial Sequence
  chemically synthesized
gacccacagtcttggccttatc

SEQ ID NO: 766683 - DNA, 22 bp, Artificial Sequence
  chemically synthesized
gattagaatcctgataaggcca

SEQ ID NO: 766684 - DNA, 22 bp, Artificial Sequence
  chemically synthesized
cggtggttagattagaatcctg

SEQ ID NO: 766685 - DNA, 22 bp, Artificial Sequence
  chemically synthesized
ggccttatcaggattctaatct

SEQ ID NO: 766686 - DNA, 22 bp, Artificial Sequence
  chemically synthesized
gccttatcaggattctaatcta

SEQ ID NO: 766687 - DNA, 22 bp, Artificial Sequence
  chemically synthesized
ggaacctccggtggttagatta

SEQ ID NO: 766688 - DNA, 22 bp, Artificial Sequence
  chemically synthesized
atcaggattctaatctaaccac

SEQ ID NO: 766689 - DNA, 22 bp, Artificial Sequence
  chemically synthesized
tcaggattctaatctaaccacc

SEQ ID NO: 766690 - DNA, 22 bp, Artificial Sequence
  chemically synthesized
gttaggaacctccggtggttag

SEQ ID NO: 766691 - DNA, 22 bp, Artificial Sequence
  chemically synthesized
atctggttaggaacctccggtg

SEQ ID NO: 766692 - DNA, 22 bp, Artificial Sequence
  chemically synthesized
tgatctggttaggaacctccgg

SEQ ID NO: 766693 - DNA, 22 bp, Artificial Sequence
  chemically synthesized
taatctaaccaccggaggttcc

SEQ ID NO: 766694 - DNA, 22 bp, Artificial Sequence
  chemically synthesized
ctgatctggttaggaacctccg

SEQ ID NO: 766695 - DNA, 22 bp, Artificial Sequence
  chemically synthesized
tctgatctggttaggaacctcc

SEQ ID NO: 766696 - DNA, 22 bp, Artificial Sequence
  chemically synthesized
atctaaccaccggaggttccta

SEQ ID NO: 766697 - DNA, 22 bp, Artificial Sequence
  chemically synthesized
cattttctgatctggttaggaa

SEQ ID NO: 766698 - DNA, 22 bp, Artificial Sequence
  chemically synthesized
accaccggaggttcctaaccag

SEQ ID NO: 766699 - DNA, 22 bp, Artificial Sequence
  chemically synthesized
tatccaactgcattttctgatc

SEQ ID NO: 766700 - DNA, 22 bp, Artificial Sequence
  chemically synthesized
ctaaccagatcagaaaatgcag

SEQ ID NO: 766701 - DNA, 22 bp, Artificial Sequence
  chemically synthesized
accagatcagaaaatgcagttg

SEQ ID NO: 766702 - DNA, 22 bp, Artificial Sequence
  chemically synthesized
tgagtctgtatccaactgcatt

SEQ ID NO: 766703 - DNA, 22 bp, Artificial Sequence
  chemically synthesized
gtgagtctgtatccaactgcat

SEQ ID NO: 766704 - DNA, 22 bp, Artificial Sequence
  chemically synthesized
ttgtgagtctgtatccaactgc

SEQ ID NO: 766705 - DNA, 22 bp, Artificial Sequence
  chemically synthesized
gatacagactcacaagagggtg

SEQ ID NO: 766706 - DNA, 22 bp, Artificial Sequence
  chemically synthesized
acaagagggtgtgactgttttt

SEQ ID NO: 766707 - DNA, 22 bp, Artificial Sequence
  chemically synthesized
cgtggccacatatagaataaga

SEQ ID NO: 766708 - DNA, 22 bp, Artificial Sequence
  chemically synthesized
ttttttcccttcttattctata

SEQ ID NO: 766709 - DNA, 22 bp, Artificial Sequence
  chemically synthesized
tttcccttcttattctatatgt

SEQ ID NO: 766710 - DNA, 22 bp, Artificial Sequence
  chemically synthesized
ttcccttcttattctatatgtg

SEQ ID NO: 766711 - DNA, 22 bp, Artificial Sequence
  chemically synthesized
tcccttcttattctatatgtgg

SEQ ID NO: 766712 - DNA, 22 bp, Artificial Sequence
  chemically synthesized
cccttcttattctatatgtggc

SEQ ID NO: 766713 - DNA, 22 bp, Artificial Sequence
  chemically synthesized
ccttcttattctatatgtggcc

SEQ ID NO: 766714 - DNA, 22 bp, Artificial Sequence
  chemically synthesized
aaggtgttgcgtggccacatat

SEQ ID NO: 766715 - DNA, 22 bp, Artificial Sequence
  chemically synthesized
aaaggtgttgcgtggccacata

SEQ ID NO: 766716 - DNA, 22 bp, Artificial Sequence
  chemically synthesized
taaaggtgttgcgtggccacat

SEQ ID NO: 766717 - DNA, 22 bp, Artificial Sequence
  chemically synthesized
ttaaaggtgttgcgtggccaca

SEQ ID NO: 766718 - DNA, 22 bp, Artificial Sequence
  chemically synthesized
cttattctatatgtggccacgc

SEQ ID NO: 766719 - DNA, 22 bp, Artificial Sequence
  chemically synthesized
ttattctatatgtggccacgca

SEQ ID NO: 766720 - DNA, 22 bp, Artificial Sequence
  chemically synthesized
cttttaaaggtgttgcgtggcc

SEQ ID NO: 766721 - DNA, 22 bp, Artificial Sequence
  chemically synthesized
attctatatgtggccacgcaac

SEQ ID NO: 766722 - DNA, 22 bp, Artificial Sequence
  chemically synthesized
ttctatatgtggccacgcaaca

SEQ ID NO: 766723 - DNA, 22 bp, Artificial Sequence
  chemically synthesized
ctgcttttaaaggtgttgcgtg

SEQ ID NO: 766724 - DNA, 22 bp, Artificial Sequence
  chemically synthesized
tatatgtggccacgcaacacct

SEQ ID NO: 766725 - DNA, 22 bp, Artificial Sequence
  chemically synthesized
tgctgcttttaaaggtgttgcg

SEQ ID NO: 766726 - DNA, 22 bp, Artificial Sequence
  chemically synthesized
tatgtggccacgcaacaccttt

SEQ ID NO: 766727 - DNA, 22 bp, Artificial Sequence
  chemically synthesized
ggacgacaactctgctgctttt

SEQ ID NO: 766728 - DNA, 22 bp, Artificial Sequence
  chemically synthesized
gggacgacaactctgctgcttt

SEQ ID NO: 766729 - DNA, 22 bp, Artificial Sequence
  chemically synthesized
ttgggacgacaactctgctgct

SEQ ID NO: 766730 - DNA, 22 bp, Artificial Sequence
  chemically synthesized
tcttgggacgacaactctgctg

SEQ ID NO: 766731 - DNA, 22 bp, Artificial Sequence
  chemically synthesized
ctcttgggacgacaactctgct

SEQ ID NO: 766732 - DNA, 22 bp, Artificial Sequence
  chemically synthesized
tttctcttgggacgacaactct

SEQ ID NO: 766733 - DNA, 22 bp, Artificial Sequence
  chemically synthesized
gtttctcttgggacgacaactc

SEQ ID NO: 766734 - DNA, 22 bp, Artificial Sequence
  chemically synthesized
taaaagcagcagagttgtcgtc

SEQ ID NO: 766735 - DNA, 22 bp, Artificial Sequence
  chemically synthesized
aaaagcagcagagttgtcgtcc

SEQ ID NO: 766736 - DNA, 22 bp, Artificial Sequence
  chemically synthesized
ttgtttctcttgggacgacaac

SEQ ID NO: 766737 - DNA, 22 bp, Artificial Sequence
  chemically synthesized
aaagcagcagagttgtcgtccc

SEQ ID NO: 766738 - DNA, 22 bp, Artificial Sequence
  chemically synthesized
actcttgtttctcttgggacga

SEQ ID NO: 766739 - DNA, 22 bp, Artificial Sequence
  chemically synthesized
aaattaactcttgtttctcttg

SEQ ID NO: 766740 - DNA, 22 bp, Artificial Sequence
  chemically synthesized
tcgtcccaagagaaacaagagt

SEQ ID NO: 766741 - DNA, 22 bp, Artificial Sequence
  chemically synthesized
caagccaaacagcagtcctcaa

SEQ ID NO: 766742 - DNA, 22 bp, Artificial Sequence
  chemically synthesized
atttgaggactgctgtttggct

SEQ ID NO: 766743 - DNA, 22 bp, Artificial Sequence
  chemically synthesized
gaggactgctgtttggcttgga

SEQ ID NO: 766744 - DNA, 22 bp, Artificial Sequence
  chemically synthesized
gagcaaccaggctccaagccaa

SEQ ID NO: 766745 - DNA, 22 bp, Artificial Sequence
  chemically synthesized
aggactgctgtttggcttggag

SEQ ID NO: 766746 - DNA, 22 bp, Artificial Sequence
  chemically synthesized
cctagagcaaccaggctccaag

SEQ ID NO: 766747 - DNA, 22 bp, Artificial Sequence
  chemically synthesized
ctgtttggcttggagcctggtt

SEQ ID NO: 766748 - DNA, 22 bp, Artificial Sequence
  chemically synthesized
tctacctagagcaaccaggctc

SEQ ID NO: 766749 - DNA, 22 bp, Artificial Sequence
  chemically synthesized
atctacctagagcaaccaggct

SEQ ID NO: 766750 - DNA, 22 bp, Artificial Sequence
  chemically synthesized
tttggcttggagcctggttgct

SEQ ID NO: 766751 - DNA, 22 bp, Artificial Sequence
  chemically synthesized
cttatctacctagagcaaccag

SEQ ID NO: 766752 - DNA, 22 bp, Artificial Sequence
  chemically synthesized
ggcttggagcctggttgctcta

SEQ ID NO: 766753 - DNA, 22 bp, Artificial Sequence
  chemically synthesized
gcttggagcctggttgctctag

SEQ ID NO: 766754 - DNA, 22 bp, Artificial Sequence
  chemically synthesized
ggagcctggttgctctaggtag

SEQ ID NO: 766755 - DNA, 22 bp, Artificial Sequence
  chemically synthesized
gagcctggttgctctaggtaga

SEQ ID NO: 766756 - DNA, 22 bp, Artificial Sequence
  chemically synthesized
aaaacatactccttatctacct

SEQ ID NO: 766757 - DNA, 22 bp, Artificial Sequence
  chemically synthesized
gttgctctaggtagataaggag

SEQ ID NO: 766758 - DNA, 22 bp, Artificial Sequence
  chemically synthesized
ctctaggtagataaggagtatg

SEQ ID NO: 766759 - DNA, 22 bp, Artificial Sequence
  chemically synthesized
taggtagataaggagtatgttt

SEQ ID NO: 766760 - DNA, 22 bp, Artificial Sequence
  chemically synthesized
ggtagataaggagtatgttttc

SEQ ID NO: 766761 - DNA, 22 bp, Artificial Sequence
  chemically synthesized
agatgcaacgcaatgcagtgga

SEQ ID NO: 766762 - DNA, 22 bp, Artificial Sequence
  chemically synthesized
aagatgcaacgcaatgcagtgg

SEQ ID NO: 766763 - DNA, 22 bp, Artificial Sequence
  chemically synthesized
gtttaagatgcaacgcaatgca

SEQ ID NO: 766764 - DNA, 22 bp, Artificial Sequence
  chemically synthesized
tcaggtccactgcattgcgttg

SEQ ID NO: 766765 - DNA, 22 bp, Artificial Sequence
  chemically synthesized
caggtccactgcattgcgttgc

SEQ ID NO: 766766 - DNA, 22 bp, Artificial Sequence
  chemically synthesized
ctcgtttaagatgcaacgcaat

SEQ ID NO: 766767 - DNA, 22 bp, Artificial Sequence
  chemically synthesized
aggtccactgcattgcgttgca

SEQ ID NO: 766768 - DNA, 22 bp, Artificial Sequence
  chemically synthesized
cattgcgttgcatcttaaacga

SEQ ID NO: 766769 - DNA, 22 bp, Artificial Sequence
  chemically synthesized
aatccatagctgctcgtttaag

SEQ ID NO: 766770 - DNA, 22 bp, Artificial Sequence
  chemically synthesized
ctaaatccatagctgctcgttt

SEQ ID NO: 766771 - DNA, 22 bp, Artificial Sequence
  chemically synthesized
cgttgcatcttaaacgagcagc

SEQ ID NO: 766772 - DNA, 22 bp, Artificial Sequence
  chemically synthesized
catcttaaacgagcagctatgg

SEQ ID NO: 766773 - DNA, 22 bp, Artificial Sequence
  chemically synthesized
tggactcctaaatccatagctg

SEQ ID NO: 766774 - DNA, 22 bp, Artificial Sequence
  chemically synthesized
aaacgagcagctatggatttag

SEQ ID NO: 766775 - DNA, 22 bp, Artificial Sequence
  chemically synthesized
aacgagcagctatggatttagg

SEQ ID NO: 766776 - DNA, 22 bp, Artificial Sequence
  chemically synthesized
aagcaaagcctgtggactccta

SEQ ID NO: 766777 - DNA, 22 bp, Artificial Sequence
  chemically synthesized
aaagcaaagcctgtggactcct

SEQ ID NO: 766778 - DNA, 22 bp, Artificial Sequence
  chemically synthesized
taaagcaaagcctgtggactcc

SEQ ID NO: 766779 - DNA, 22 bp, Artificial Sequence
  chemically synthesized
ttaaagcaaagcctgtggactc

SEQ ID NO: 766780 - DNA, 22 bp, Artificial Sequence
  chemically synthesized
tggatttaggagtccacaggct

SEQ ID NO: 766781 - DNA, 22 bp, Artificial Sequence
  chemically synthesized
aggagtccacaggctttgcttt

SEQ ID NO: 766782 - DNA, 22 bp, Artificial Sequence
  chemically synthesized
ggagtccacaggctttgcttta

SEQ ID NO: 766783 - DNA, 22 bp, Artificial Sequence
  chemically synthesized
ataacagccgtttttaaagcaa

SEQ ID NO: 766784 - DNA, 22 bp, Artificial Sequence
  chemically synthesized
aataacagccgtttttaaagca

SEQ ID NO: 766785 - DNA, 22 bp, Artificial Sequence
  chemically synthesized
taataacagccgtttttaaagc

SEQ ID NO: 766786 - DNA, 22 bp, Artificial Sequence
  chemically synthesized
aggactttaataacagccgttt

SEQ ID NO: 766787 - DNA, 22 bp, Artificial Sequence
  chemically synthesized
tgaggactttaataacagccgt

SEQ ID NO: 766788 - DNA, 22 bp, Artificial Sequence
  chemically synthesized
tgctttaaaaacggctgttatt

SEQ ID NO: 766789 - DNA, 22 bp, Artificial Sequence
  chemically synthesized
gctttaaaaacggctgttatta

SEQ ID NO: 766790 - DNA, 22 bp, Artificial Sequence
  chemically synthesized
ctttaaaaacggctgttattaa

SEQ ID NO: 766791 - DNA, 22 bp, Artificial Sequence
  chemically synthesized
taaaaacggctgttattaaagt

SEQ ID NO: 766792 - DNA, 22 bp, Artificial Sequence
  chemically synthesized
aaaaacggctgttattaaagtc

SEQ ID NO: 766793 - DNA, 22 bp, Artificial Sequence
  chemically synthesized
aaaacggctgttattaaagtcc

SEQ ID NO: 766794 - DNA, 22 bp, Artificial Sequence
  chemically synthesized
caggataatagtctctgaggac

SEQ ID NO: 766795 - DNA, 22 bp, Artificial Sequence
  chemically synthesized
ttattaaagtcctcagagacta

SEQ ID NO: 766796 - DNA, 22 bp, Artificial Sequence
  chemically synthesized
ttaaagtcctcagagactatta

SEQ ID NO: 766797 - DNA, 22 bp, Artificial Sequence
  chemically synthesized
aagtcctcagagactattatcc

SEQ ID NO: 766798 - DNA, 22 bp, Artificial Sequence
  chemically synthesized
agagactattatcctgcagggt

SEQ ID NO: 766799 - DNA, 22 bp, Artificial Sequence
  chemically synthesized
ttatcctgcagggtttgttgtc

SEQ ID NO: 766800 - DNA, 22 bp, Artificial Sequence
  chemically synthesized
tcctgcagggtttgttgtcttt

SEQ ID NO: 766801 - DNA, 22 bp, Artificial Sequence
  chemically synthesized
cagggtttgttgtctttgcttt

SEQ ID NO: 766802 - DNA, 22 bp, Artificial Sequence
  chemically synthesized
gaatgagatatgaaagcaaaga

SEQ ID NO: 766803 - DNA, 22 bp, Artificial Sequence
  chemically synthesized
cgaatgagatatgaaagcaaag

SEQ ID NO: 766804 - DNA, 22 bp, Artificial Sequence
  chemically synthesized
tcgaatgagatatgaaagcaaa

SEQ ID NO: 766805 - DNA, 22 bp, Artificial Sequence
  chemically synthesized
gttgtctttgctttcatatctc

SEQ ID NO: 766806 - DNA, 22 bp, Artificial Sequence
  chemically synthesized
ttgtctttgctttcatatctca

SEQ ID NO: 766807 - DNA, 22 bp, Artificial Sequence
  chemically synthesized
tctttgctttcatatctcattc

SEQ ID NO: 766808 - DNA, 22 bp, Artificial Sequence
  chemically synthesized
agtgtgagaattttcgaatgag

SEQ ID NO: 766809 - DNA, 22 bp, Artificial Sequence
  chemically synthesized
tgctttcatatctcattcgaaa

SEQ ID NO: 766810 - DNA, 22 bp, Artificial Sequence
  chemically synthesized
aagtgtgagaattttcgaatga

SEQ ID NO: 766811 - DNA, 22 bp, Artificial Sequence
  chemically synthesized
gctttcatatctcattcgaaaa

SEQ ID NO: 766812 - DNA, 22 bp, Artificial Sequence
  chemically synthesized
ctttcatatctcattcgaaaat

SEQ ID NO: 766813 - DNA, 22 bp, Artificial Sequence
  chemically synthesized
tcatatctcattcgaaaattct

SEQ ID NO: 766814 - DNA, 22 bp, Artificial Sequence
  chemically synthesized
catatctcattcgaaaattctc

SEQ ID NO: 766815 - DNA, 22 bp, Artificial Sequence
  chemically synthesized
atatctcattcgaaaattctca

SEQ ID NO: 766816 - DNA, 22 bp, Artificial Sequence
  chemically synthesized
cagtgcttaagtgtgagaattt

SEQ ID NO: 766817 - DNA, 22 bp, Artificial Sequence
  chemically synthesized
ttgcagtgcttaagtgtgagaa

SEQ ID NO: 766818 - DNA, 22 bp, Artificial Sequence
  chemically synthesized
attcgaaaattctcacacttaa

SEQ ID NO: 766819 - DNA, 22 bp, Artificial Sequence
  chemically synthesized
ctgttgcagtgcttaagtgtga

SEQ ID NO: 766820 - DNA, 22 bp, Artificial Sequence
  chemically synthesized
tgctgttgcagtgcttaagtgt

SEQ ID NO: 766821 - DNA, 22 bp, Artificial Sequence
  chemically synthesized
gaaaattctcacacttaagcac

SEQ ID NO: 766822 - DNA, 22 bp, Artificial Sequence
  chemically synthesized
tctgctgttgcagtgcttaagt

SEQ ID NO: 766823 - DNA, 22 bp, Artificial Sequence
  chemically synthesized
tctctgctgttgcagtgcttaa

SEQ ID NO: 766824 - DNA, 22 bp, Artificial Sequence
  chemically synthesized
ctctctgctgttgcagtgctta

SEQ ID NO: 766825 - DNA, 22 bp, Artificial Sequence
  chemically synthesized
tcacacttaagcactgcaacag

SEQ ID NO: 766826 - DNA, 22 bp, Artificial Sequence
  chemically synthesized
acacttaagcactgcaacagca

SEQ ID NO: 766827 - DNA, 22 bp, Artificial Sequence
  chemically synthesized
aagcactgcaacagcagagaga

SEQ ID NO: 766828 - DNA, 22 bp, Artificial Sequence
  chemically synthesized
agcactgcaacagcagagagaa

SEQ ID NO: 766829 - DNA, 22 bp, Artificial Sequence
  chemically synthesized
agagagcatatcccttctctct

SEQ ID NO: 766830 - DNA, 22 bp, Artificial Sequence
  chemically synthesized
ctgagagagcatatcccttctc

SEQ ID NO: 766831 - DNA, 22 bp, Artificial Sequence
  chemically synthesized
caacagcagagagaagggatat

SEQ ID NO: 766832 - DNA, 22 bp, Artificial Sequence
  chemically synthesized
cctgctgagagagcatatccct

SEQ ID NO: 766833 - DNA, 22 bp, Artificial Sequence
  chemically synthesized
tccctgctgagagagcatatcc

SEQ ID NO: 766834 - DNA, 22 bp, Artificial Sequence
  chemically synthesized
ctccctgctgagagagcatatc

SEQ ID NO: 766835 - DNA, 22 bp, Artificial Sequence
  chemically synthesized
tctcagcagggagaagggatat

SEQ ID NO: 766836 - DNA, 22 bp, Artificial Sequence
  chemically synthesized
aggcaagaaagcatatcccttc

SEQ ID NO: 766837 - DNA, 22 bp, Artificial Sequence
  chemically synthesized
tcagcagggagaagggatatgc

SEQ ID NO: 766838 - DNA, 22 bp, Artificial Sequence
  chemically synthesized
agcagggagaagggatatgctt

SEQ ID NO: 766839 - DNA, 22 bp, Artificial Sequence
  chemically synthesized
ggaatatactgaggcaagaaag

SEQ ID NO: 766840 - DNA, 22 bp, Artificial Sequence
  chemically synthesized
gggaatatactgaggcaagaaa

SEQ ID NO: 766841 - DNA, 22 bp, Artificial Sequence
  chemically synthesized
cacttgggaatatactgaggca

SEQ ID NO: 766842 - DNA, 22 bp, Artificial Sequence
  chemically synthesized
gcacttgggaatatactgaggc

SEQ ID NO: 766843 - DNA, 22 bp, Artificial Sequence
  chemically synthesized
tgcacttgggaatatactgagg

SEQ ID NO: 766844 - DNA, 22 bp, Artificial Sequence
  chemically synthesized
tcttgcctcagtatattcccaa

SEQ ID NO: 766845 - DNA, 22 bp, Artificial Sequence
  chemically synthesized
cttgcctcagtatattcccaag

SEQ ID NO: 766846 - DNA, 22 bp, Artificial Sequence
  chemically synthesized
ttgcctcagtatattcccaagt

SEQ ID NO: 766847 - DNA, 22 bp, Artificial Sequence
  chemically synthesized
gcctcagtatattcccaagtgc

SEQ ID NO: 766848 - DNA, 22 bp, Artificial Sequence
  chemically synthesized
aaatgaagctttgcacttggga

SEQ ID NO: 766849 - DNA, 22 bp, Artificial Sequence
  chemically synthesized
cctcagtatattcccaagtgca

SEQ ID NO: 766850 - DNA, 22 bp, Artificial Sequence
  chemically synthesized
gaaatgaagctttgcacttggg

SEQ ID NO: 766851 - DNA, 22 bp, Artificial Sequence
  chemically synthesized
tgaaatgaagctttgcacttgg

SEQ ID NO: 766852 - DNA, 22 bp, Artificial Sequence
  chemically synthesized
agtatattcccaagtgcaaagc

SEQ ID NO: 766853 - DNA, 22 bp, Artificial Sequence
  chemically synthesized
gattttgaaatgaagctttgca

SEQ ID NO: 766854 - DNA, 22 bp, Artificial Sequence
  chemically synthesized
ccaagtgcaaagcttcatttca

SEQ ID NO: 766855 - DNA, 22 bp, Artificial Sequence
  chemically synthesized
aagattagattttgaaatgaag

SEQ ID NO: 766856 - DNA, 22 bp, Artificial Sequence
  chemically synthesized
aaagattagattttgaaatgaa

SEQ ID NO: 766857 - DNA, 22 bp, Artificial Sequence
  chemically synthesized
taaagattagattttgaaatga

SEQ ID NO: 766858 - DNA, 22 bp, Artificial Sequence
  chemically synthesized
ttaaagattagattttgaaatg

SEQ ID NO: 766859 - DNA, 22 bp, Artificial Sequence
  chemically synthesized
catttcaaaatctaatctttaa

SEQ ID NO: 766860 - DNA, 22 bp, Artificial Sequence
  chemically synthesized
ggccaggcatttttaaagatta

SEQ ID NO: 766861 - DNA, 22 bp, Artificial Sequence
  chemically synthesized
atttcaaaatctaatctttaaa

SEQ ID NO: 766862 - DNA, 22 bp, Artificial Sequence
  chemically synthesized
caaaatctaatctttaaaaatg

SEQ ID NO: 766863 - DNA, 22 bp, Artificial Sequence
  chemically synthesized
aaaatctaatctttaaaaatgc

SEQ ID NO: 766864 - DNA, 22 bp, Artificial Sequence
  chemically synthesized
atctttaaaaatgcctggccta

SEQ ID NO: 766865 - DNA, 22 bp, Artificial Sequence
  chemically synthesized
cgggggtaatccaccctaggcc

SEQ ID NO: 766866 - DNA, 22 bp, Artificial Sequence
  chemically synthesized
taaaaatgcctggcctagggtg

SEQ ID NO: 766867 - DNA, 22 bp, Artificial Sequence
  chemically synthesized
aaaaatgcctggcctagggtgg

SEQ ID NO: 766868 - DNA, 22 bp, Artificial Sequence
  chemically synthesized
aaaatgcctggcctagggtgga

SEQ ID NO: 766869 - DNA, 22 bp, Artificial Sequence
  chemically synthesized
ctccgggggtaatccaccctag

SEQ ID NO: 766870 - DNA, 22 bp, Artificial Sequence
  chemically synthesized
cctccgggggtaatccacccta

SEQ ID NO: 766871 - DNA, 22 bp, Artificial Sequence
  chemically synthesized
acagtttcctccgggggtaatc

SEQ ID NO: 766872 - DNA, 22 bp, Artificial Sequence
  chemically synthesized
gacagtttcctccgggggtaat

SEQ ID NO: 766873 - DNA, 22 bp, Artificial Sequence
  chemically synthesized
gcctagggtggattacccccgg

SEQ ID NO: 766874 - DNA, 22 bp, Artificial Sequence
  chemically synthesized
gggtggattacccccggaggaa

SEQ ID NO: 766875 - DNA, 22 bp, Artificial Sequence
  chemically synthesized
aggcggtttgacagtttcctcc

SEQ ID NO: 766876 - DNA, 22 bp, Artificial Sequence
  chemically synthesized
aaggcggtttgacagtttcctc

SEQ ID NO: 766877 - DNA, 22 bp, Artificial Sequence
  chemically synthesized
cttaaggcggtttgacagtttc

SEQ ID NO: 766878 - DNA, 22 bp, Artificial Sequence
  chemically synthesized
cccccggaggaaactgtcaaac

SEQ ID NO: 766879 - DNA, 22 bp, Artificial Sequence
  chemically synthesized
gggattgcttaaggcggtttga

SEQ ID NO: 766880 - DNA, 22 bp, Artificial Sequence
  chemically synthesized
ccagagttcgggattgcttaag

SEQ ID NO: 766881 - DNA, 22 bp, Artificial Sequence
  chemically synthesized
tcaaaccgccttaagcaatccc

SEQ ID NO: 766882 - DNA, 22 bp, Artificial Sequence
  chemically synthesized
aagcaatcccgaactctggtaa

SEQ ID NO: 766883 - DNA, 22 bp, Artificial Sequence
  chemically synthesized
agcaatcccgaactctggtaat

SEQ ID NO: 766884 - DNA, 22 bp, Artificial Sequence
  chemically synthesized
tggtaatacgtgatgctttctc

SEQ ID NO: 766885 - DNA, 22 bp, Artificial Sequence
  chemically synthesized
gtaatacgtgatgctttctctc

SEQ ID NO: 766886 - DNA, 22 bp, Artificial Sequence
  chemically synthesized
agaatggagtcagagggtcaca

SEQ ID NO: 766887 - DNA, 22 bp, Artificial Sequence
  chemically synthesized
aagaatggagtcagagggtcac

SEQ ID NO: 766888 - DNA, 22 bp, Artificial Sequence
  chemically synthesized
tctctccttgtgtgaccctctg

SEQ ID NO: 766889 - DNA, 22 bp, Artificial Sequence
  chemically synthesized
ctctccttgtgtgaccctctga

SEQ ID NO: 766890 - DNA, 22 bp, Artificial Sequence
  chemically synthesized
tctccttgtgtgaccctctgac

SEQ ID NO: 766891 - DNA, 22 bp, Artificial Sequence
  chemically synthesized
tccttgtgtgaccctctgactc

SEQ ID NO: 766892 - DNA, 22 bp, Artificial Sequence
  chemically synthesized
cttgtgtgaccctctgactcca

SEQ ID NO: 766893 - DNA, 22 bp, Artificial Sequence
  chemically synthesized
gtgtgaccctctgactccattc

SEQ ID NO: 766894 - DNA, 22 bp, Artificial Sequence
  chemically synthesized
tgtgaccctctgactccattct

SEQ ID NO: 766895 - DNA, 22 bp, Artificial Sequence
  chemically synthesized
aaaggtaatcttaagaatggag

SEQ ID NO: 766896 - DNA, 22 bp, Artificial Sequence
  chemically synthesized
aaaaggtaatcttaagaatgga

SEQ ID NO: 766897 - DNA, 22 bp, Artificial Sequence
  chemically synthesized
taaaaggtaatcttaagaatgg

SEQ ID NO: 766898 - DNA, 22 bp, Artificial Sequence
  chemically synthesized
tgactccattcttaagattacc

SEQ ID NO: 766899 - DNA, 22 bp, Artificial Sequence
  chemically synthesized
atcagttttaaaaggtaatctt

SEQ ID NO: 766900 - DNA, 22 bp, Artificial Sequence
  chemically synthesized
actccattcttaagattacctt

SEQ ID NO: 766901 - DNA, 22 bp, Artificial Sequence
  chemically synthesized
cattcttaagattaccttttaa

SEQ ID NO: 766902 - DNA, 22 bp, Artificial Sequence
  chemically synthesized
aatgaactcatcagttttaaaa

SEQ ID NO: 766903 - DNA, 22 bp, Artificial Sequence
  chemically synthesized
ttaagattaccttttaaaactg

SEQ ID NO: 766904 - DNA, 22 bp, Artificial Sequence
  chemically synthesized
aaatgaactcatcagttttaaa

SEQ ID NO: 766905 - DNA, 22 bp, Artificial Sequence
  chemically synthesized
aagattaccttttaaaactgat

SEQ ID NO: 766906 - DNA, 22 bp, Artificial Sequence
  chemically synthesized
agattaccttttaaaactgatg

SEQ ID NO: 766907 - DNA, 22 bp, Artificial Sequence
  chemically synthesized
ccttttaaaactgatgagttca

SEQ ID NO: 766908 - DNA, 22 bp, Artificial Sequence
  chemically synthesized
ggagatcttaaatgaactcatc

SEQ ID NO: 766909 - DNA, 22 bp, Artificial Sequence
  chemically synthesized
ttaaaactgatgagttcattta

SEQ ID NO: 766910 - DNA, 22 bp, Artificial Sequence
  chemically synthesized
taaaactgatgagttcatttaa

SEQ ID NO: 766911 - DNA, 22 bp, Artificial Sequence
  chemically synthesized
aaaactgatgagttcatttaag

SEQ ID NO: 766912 - DNA, 22 bp, Artificial Sequence
  chemically synthesized
aaactgatgagttcatttaaga

SEQ ID NO: 766913 - DNA, 22 bp, Artificial Sequence
  chemically synthesized
caacctaggagatcttaaatga

SEQ ID NO: 766914 - DNA, 22 bp, Artificial Sequence
  chemically synthesized
ccaacctaggagatcttaaatg

SEQ ID NO: 766915 - DNA, 22 bp, Artificial Sequence
  chemically synthesized
cttccaacctaggagatcttaa

SEQ ID NO: 766916 - DNA, 22 bp, Artificial Sequence
  chemically synthesized
acttccaacctaggagatctta

SEQ ID NO: 766917 - DNA, 22 bp, Artificial Sequence
  chemically synthesized
atgagttcatttaagatctcct

SEQ ID NO: 766918 - DNA, 22 bp, Artificial Sequence
  chemically synthesized
atcttacttccaacctaggaga

SEQ ID NO: 766919 - DNA, 22 bp, Artificial Sequence
  chemically synthesized
tcatcttacttccaacctagga

SEQ ID NO: 766920 - DNA, 22 bp, Artificial Sequence
  chemically synthesized
atttaagatctcctaggttgga

SEQ ID NO: 766921 - DNA, 22 bp, Artificial Sequence
  chemically synthesized
aagatctcctaggttggaagta

SEQ ID NO: 766922 - DNA, 22 bp, Artificial Sequence
  chemically synthesized
agatctcctaggttggaagtaa

SEQ ID NO: 766923 - DNA, 22 bp, Artificial Sequence
  chemically synthesized
ctaggttggaagtaagatgaga

SEQ ID NO: 766924 - DNA, 22 bp, Artificial Sequence
  chemically synthesized
ggttggaagtaagatgagaggt

SEQ ID NO: 766925 - DNA, 22 bp, Artificial Sequence
  chemically synthesized
gaagtaagatgagaggtatctt

SEQ ID NO: 766926 - DNA, 22 bp, Artificial Sequence
  chemically synthesized
ggaaaaacaagacgtagatgag

SEQ ID NO: 766927 - DNA, 22 bp, Artificial Sequence
  chemically synthesized
tctcatctacgtcttgtttttc

SEQ ID NO: 766928 - DNA, 22 bp, Artificial Sequence
  chemically synthesized
ctcatctacgtcttgtttttcc

SEQ ID NO: 766929 - DNA, 22 bp, Artificial Sequence
  chemically synthesized
tcatctacgtcttgtttttcct

SEQ ID NO: 766930 - DNA, 22 bp, Artificial Sequence
  chemically synthesized
atctacgtcttgtttttcctag

SEQ ID NO: 766931 - DNA, 22 bp, Artificial Sequence
  chemically synthesized
gatgagaagaaactaggaaaaa

SEQ ID NO: 766932 - DNA, 22 bp, Artificial Sequence
  chemically synthesized
cgtcttgtttttcctagtttct

SEQ ID NO: 766933 - DNA, 22 bp, Artificial Sequence
  chemically synthesized
tgactggatgagaagaaactag

SEQ ID NO: 766934 - DNA, 22 bp, Artificial Sequence
  chemically synthesized
gtttttcctagtttcttctcat

SEQ ID NO: 766935 - DNA, 22 bp, Artificial Sequence
  chemically synthesized
cattgtgactggatgagaagaa

SEQ ID NO: 766936 - DNA, 22 bp, Artificial Sequence
  chemically synthesized
tttttcctagtttcttctcatc

SEQ ID NO: 766937 - DNA, 22 bp, Artificial Sequence
  chemically synthesized
gcattgtgactggatgagaaga

SEQ ID NO: 766938 - DNA, 22 bp, Artificial Sequence
  chemically synthesized
tgcattgtgactggatgagaag

SEQ ID NO: 766939 - DNA, 22 bp, Artificial Sequence
  chemically synthesized
ttgcattgtgactggatgagaa

SEQ ID NO: 766940 - DNA, 22 bp, Artificial Sequence
  chemically synthesized
ttcctagtttcttctcatccag

SEQ ID NO: 766941 - DNA, 22 bp, Artificial Sequence
  chemically synthesized
tcctagtttcttctcatccagt

SEQ ID NO: 766942 - DNA, 22 bp, Artificial Sequence
  chemically synthesized
cctagtttcttctcatccagtc

SEQ ID NO: 766943 - DNA, 22 bp, Artificial Sequence
  chemically synthesized
ctagtttcttctcatccagtca

SEQ ID NO: 766944 - DNA, 22 bp, Artificial Sequence
  chemically synthesized
gtttcttctcatccagtcacaa

SEQ ID NO: 766945 - DNA, 22 bp, Artificial Sequence
  chemically synthesized
gggaatttttgcattgtgactg

SEQ ID NO: 766946 - DNA, 22 bp, Artificial Sequence
  chemically synthesized
cttctcatccagtcacaatgca

SEQ ID NO: 766947 - DNA, 22 bp, Artificial Sequence
  chemically synthesized
ttctcatccagtcacaatgcaa

SEQ ID NO: 766948 - DNA, 22 bp, Artificial Sequence
  chemically synthesized
ctcatccagtcacaatgcaaaa

SEQ ID NO: 766949 - DNA, 22 bp, Artificial Sequence
  chemically synthesized
tcatccagtcacaatgcaaaaa

SEQ ID NO: 766950 - DNA, 22 bp, Artificial Sequence
  chemically synthesized
atccagtcacaatgcaaaaatt

SEQ ID NO: 766951 - DNA, 22 bp, Artificial Sequence
  chemically synthesized
tgatgaataaatattcgggaat

SEQ ID NO: 766952 - DNA, 22 bp, Artificial Sequence
  chemically synthesized
gtgatgaataaatattcgggaa

SEQ ID NO: 766953 - DNA, 22 bp, Artificial Sequence
  chemically synthesized
tgtgatgaataaatattcggga

SEQ ID NO: 766954 - DNA, 22 bp, Artificial Sequence
  chemically synthesized
ttgtgatgaataaatattcggg

SEQ ID NO: 766955 - DNA, 22 bp, Artificial Sequence
  chemically synthesized
atgcacatttttgtgatgaata

SEQ ID NO: 766956 - DNA, 22 bp, Artificial Sequence
  chemically synthesized
aatgcacatttttgtgatgaat

SEQ ID NO: 766957 - DNA, 22 bp, Artificial Sequence
  chemically synthesized
ccgaatatttattcatcacaaa

SEQ ID NO: 766958 - DNA, 22 bp, Artificial Sequence
  chemically synthesized
attcatcacaaaaatgtgcatt

SEQ ID NO: 766959 - DNA, 22 bp, Artificial Sequence
  chemically synthesized
ttcatcacaaaaatgtgcatta

SEQ ID NO: 766960 - DNA, 22 bp, Artificial Sequence
  chemically synthesized
atcacaaaaatgtgcattaagt

SEQ ID NO: 766961 - DNA, 22 bp, Artificial Sequence
  chemically synthesized
tagacatacaataggtacttaa

SEQ ID NO: 766962 - DNA, 22 bp, Artificial Sequence
  chemically synthesized
atagacatacaataggtactta

SEQ ID NO: 766963 - DNA, 22 bp, Artificial Sequence
  chemically synthesized
cttatagacatacaataggtac

SEQ ID NO: 766964 - DNA, 22 bp, Artificial Sequence
  chemically synthesized
tcggccctacttatagacatac

SEQ ID NO: 766965 - DNA, 22 bp, Artificial Sequence
  chemically synthesized
agtacctattgtatgtctataa

SEQ ID NO: 766966 - DNA, 22 bp, Artificial Sequence
  chemically synthesized
ttgtatgtctataagtagggcc

SEQ ID NO: 766967 - DNA, 22 bp, Artificial Sequence
  chemically synthesized
tatgtctataagtagggccgat

SEQ ID NO: 766968 - DNA, 22 bp, Artificial Sequence
  chemically synthesized
aaaggtaggtattatcggccct

SEQ ID NO: 766969 - DNA, 22 bp, Artificial Sequence
  chemically synthesized
aaaaggtaggtattatcggccc

SEQ ID NO: 766970 - DNA, 22 bp, Artificial Sequence
  chemically synthesized
taagtagggccgataataccta

SEQ ID NO: 766971 - DNA, 22 bp, Artificial Sequence
  chemically synthesized
ccaaaaccttaaaaggtaggta

SEQ ID NO: 766972 - DNA, 22 bp, Artificial Sequence
  chemically synthesized
gccaaaaccttaaaaggtaggt

SEQ ID NO: 766973 - DNA, 22 bp, Artificial Sequence
  chemically synthesized
tgccaaaaccttaaaaggtagg

SEQ ID NO: 766974 - DNA, 22 bp, Artificial Sequence
  chemically synthesized
atctttgccaaaaccttaaaag

SEQ ID NO: 766975 - DNA, 22 bp, Artificial Sequence
  chemically synthesized
atctaatctttgccaaaacctt

SEQ ID NO: 766976 - DNA, 22 bp, Artificial Sequence
  chemically synthesized
ccttttaaggttttggcaaaga

SEQ ID NO: 766977 - DNA, 22 bp, Artificial Sequence
  chemically synthesized
ttaaggttttggcaaagattag

SEQ ID NO: 766978 - DNA, 22 bp, Artificial Sequence
  chemically synthesized
acatcatctcatctaatctttg

SEQ ID NO: 766979 - DNA, 22 bp, Artificial Sequence
  chemically synthesized
taaggttttggcaaagattaga

SEQ ID NO: 766980 - DNA, 22 bp, Artificial Sequence
  chemically synthesized
aaggttttggcaaagattagat

SEQ ID NO: 766981 - DNA, 22 bp, Artificial Sequence
  chemically synthesized
aggttttggcaaagattagatg

SEQ ID NO: 766982 - DNA, 22 bp, Artificial Sequence
  chemically synthesized
ctcacatcatctcatctaatct

SEQ ID NO: 766983 - DNA, 22 bp, Artificial Sequence
  chemically synthesized
atctactcacatcatctcatct

SEQ ID NO: 766984 - DNA, 22 bp, Artificial Sequence
  chemically synthesized
tggcaaagattagatgagatga

SEQ ID NO: 766985 - DNA, 22 bp, Artificial Sequence
  chemically synthesized
ggcaaagattagatgagatgat

SEQ ID NO: 766986 - DNA, 22 bp, Artificial Sequence
  chemically synthesized
gcaaagattagatgagatgatg

SEQ ID NO: 766987 - DNA, 22 bp, Artificial Sequence
  chemically synthesized
gttgatctactcacatcatctc

SEQ ID NO: 766988 - DNA, 22 bp, Artificial Sequence
  chemically synthesized
ggttgatctactcacatcatct

SEQ ID NO: 766989 - DNA, 22 bp, Artificial Sequence
  chemically synthesized
ggtacttggttgatctactcac

SEQ ID NO: 766990 - DNA, 22 bp, Artificial Sequence
  chemically synthesized
gatgagatgatgtgagtagatc

SEQ ID NO: 766991 - DNA, 22 bp, Artificial Sequence
  chemically synthesized
ggttaggtacttggttgatcta

SEQ ID NO: 766992 - DNA, 22 bp, Artificial Sequence
  chemically synthesized
ggcattgggttaggtacttggt

SEQ ID NO: 766993 - DNA, 22 bp, Artificial Sequence
  chemically synthesized
acaataggttaggcattgggtt

SEQ ID NO: 766994 - DNA, 22 bp, Artificial Sequence
  chemically synthesized
atgaaacctcacaataggttag

SEQ ID NO: 766995 - DNA, 22 bp, Artificial Sequence
  chemically synthesized
acccaatgcctaacctattgtg

SEQ ID NO: 766996 - DNA, 22 bp, Artificial Sequence
  chemically synthesized
acctattgtgaggtttcattaa

SEQ ID NO: 766997 - DNA, 22 bp, Artificial Sequence
  chemically synthesized
gaaggatgcaacattaatgaaa

SEQ ID NO: 766998 - DNA, 22 bp, Artificial Sequence
  chemically synthesized
ttgtgaggtttcattaatgttg

SEQ ID NO: 766999 - DNA, 22 bp, Artificial Sequence
  chemically synthesized
tgaggtttcattaatgttgcat

SEQ ID NO: 767000 - DNA, 22 bp, Artificial Sequence
  chemically synthesized
cattaatgttgcatccttctag

SEQ ID NO: 767001 - DNA, 22 bp, Artificial Sequence
  chemically synthesized
attaatgttgcatccttctagt

SEQ ID NO: 767002 - DNA, 22 bp, Artificial Sequence
  chemically synthesized
atgttgcatccttctagtcccc

SEQ ID NO: 767003 - DNA, 22 bp, Artificial Sequence
  chemically synthesized
catccttctagtccccctctca

SEQ ID NO: 767004 - DNA, 22 bp, Artificial Sequence
  chemically synthesized
gagtcatggcagaaagtgagag

SEQ ID NO: 767005 - DNA, 22 bp, Artificial Sequence
  chemically synthesized
ctagtccccctctcactttctg

SEQ ID NO: 767006 - DNA, 22 bp, Artificial Sequence
  chemically synthesized
tagtccccctctcactttctgc

SEQ ID NO: 767007 - DNA, 22 bp, Artificial Sequence
  chemically synthesized
gtccccctctcactttctgcca

SEQ ID NO: 767008 - DNA, 22 bp, Artificial Sequence
  chemically synthesized
gcaggattggagtcatggcaga

SEQ ID NO: 767009 - DNA, 22 bp, Artificial Sequence
  chemically synthesized
ctagcaggattggagtcatggc

SEQ ID NO: 767010 - DNA, 22 bp, Artificial Sequence
  chemically synthesized
tgctagcaggattggagtcatg

SEQ ID NO: 767011 - DNA, 22 bp, Artificial Sequence
  chemically synthesized
tcactttctgccatgactccaa

SEQ ID NO: 767012 - DNA, 22 bp, Artificial Sequence
  chemically synthesized
tctgctagcaggattggagtca

SEQ ID NO: 767013 - DNA, 22 bp, Artificial Sequence
  chemically synthesized
actttctgccatgactccaatc

SEQ ID NO: 767014 - DNA, 22 bp, Artificial Sequence
  chemically synthesized
ctctgctagcaggattggagtc

SEQ ID NO: 767015 - DNA, 22 bp, Artificial Sequence
  chemically synthesized
tctgccatgactccaatcctgc

SEQ ID NO: 767016 - DNA, 22 bp, Artificial Sequence
  chemically synthesized
ctgccatgactccaatcctgct

SEQ ID NO: 767017 - DNA, 22 bp, Artificial Sequence
  chemically synthesized
tgccatgactccaatcctgcta

SEQ ID NO: 767018 - DNA, 22 bp, Artificial Sequence
  chemically synthesized
atatcttctctgctagcaggat

SEQ ID NO: 767019 - DNA, 22 bp, Artificial Sequence
  chemically synthesized
ccatgactccaatcctgctagc

SEQ ID NO: 767020 - DNA, 22 bp, Artificial Sequence
  chemically synthesized
aacggcctcatatcttctctgc

SEQ ID NO: 767021 - DNA, 22 bp, Artificial Sequence
  chemically synthesized
caatcctgctagcagagaagat

SEQ ID NO: 767022 - DNA, 22 bp, Artificial Sequence
  chemically synthesized
gaacggcctcatatcttctctg

SEQ ID NO: 767023 - DNA, 22 bp, Artificial Sequence
  chemically synthesized
tgaacggcctcatatcttctct

SEQ ID NO: 767024 - DNA, 22 bp, Artificial Sequence
  chemically synthesized
ttgaacggcctcatatcttctc

SEQ ID NO: 767025 - DNA, 22 bp, Artificial Sequence
  chemically synthesized
ttttgaacggcctcatatcttc

SEQ ID NO: 767026 - DNA, 22 bp, Artificial Sequence
  chemically synthesized
cttttgaacggcctcatatctt

SEQ ID NO: 767027 - DNA, 22 bp, Artificial Sequence
  chemically synthesized
tcttttgaacggcctcatatct

SEQ ID NO: 767028 - DNA, 22 bp, Artificial Sequence
  chemically synthesized
ctagcagagaagatatgaggcc

SEQ ID NO: 767029 - DNA, 22 bp, Artificial Sequence
  chemically synthesized
gttttcttttgaacggcctcat

SEQ ID NO: 767030 - DNA, 22 bp, Artificial Sequence
  chemically synthesized
gcagagaagatatgaggccgtt

SEQ ID NO: 767031 - DNA, 22 bp, Artificial Sequence
  chemically synthesized
atgcagtaggtattcgttttct

SEQ ID NO: 767032 - DNA, 22 bp, Artificial Sequence
  chemically synthesized
catgcagtaggtattcgttttc

SEQ ID NO: 767033 - DNA, 22 bp, Artificial Sequence
  chemically synthesized
ccatcttcatgcagtaggtatt

SEQ ID NO: 767034 - DNA, 22 bp, Artificial Sequence
  chemically synthesized
aaaagaaaacgaatacctactg

SEQ ID NO: 767035 - DNA, 22 bp, Artificial Sequence
  chemically synthesized
gctcccatcttcatgcagtagg

SEQ ID NO: 767036 - DNA, 22 bp, Artificial Sequence
  chemically synthesized
tggctcccatcttcatgcagta

SEQ ID NO: 767037 - DNA, 22 bp, Artificial Sequence
  chemically synthesized
tagctctggctcccatcttcat

SEQ ID NO: 767038 - DNA, 22 bp, Artificial Sequence
  chemically synthesized
cctgtagctctggctcccatct

SEQ ID NO: 767039 - DNA, 22 bp, Artificial Sequence
  chemically synthesized
ctgcctgtagctctggctccca

SEQ ID NO: 767040 - DNA, 22 bp, Artificial Sequence
  chemically synthesized
ctgcatgaagatgggagccaga

SEQ ID NO: 767041 - DNA, 22 bp, Artificial Sequence
  chemically synthesized
catgaagatgggagccagagct

SEQ ID NO: 767042 - DNA, 22 bp, Artificial Sequence
  chemically synthesized
gctcctgcctgtagctctggct

SEQ ID NO: 767043 - DNA, 22 bp, Artificial Sequence
  chemically synthesized
agctcctgcctgtagctctggc

SEQ ID NO: 767044 - DNA, 22 bp, Artificial Sequence
  chemically synthesized
ttagctcctgcctgtagctctg

SEQ ID NO: 767045 - DNA, 22 bp, Artificial Sequence
  chemically synthesized
cctcttagctcctgcctgtagc

SEQ ID NO: 767046 - DNA, 22 bp, Artificial Sequence
  chemically synthesized
agaactacctcttagctcctgc

SEQ ID NO: 767047 - DNA, 22 bp, Artificial Sequence
  chemically synthesized
ctgagaactacctcttagctcc

SEQ ID NO: 767048 - DNA, 22 bp, Artificial Sequence
  chemically synthesized
cctgagaactacctcttagctc

SEQ ID NO: 767049 - DNA, 22 bp, Artificial Sequence
  chemically synthesized
caggcaggagctaagaggtagt

SEQ ID NO: 767050 - DNA, 22 bp, Artificial Sequence
  chemically synthesized
aacttcctgagaactacctctt

SEQ ID NO: 767051 - DNA, 22 bp, Artificial Sequence
  chemically synthesized
aacctgaacttcctgagaacta

SEQ ID NO: 767052 - DNA, 22 bp, Artificial Sequence
  chemically synthesized
gaacctgaacttcctgagaact

SEQ ID NO: 767053 - DNA, 22 bp, Artificial Sequence
  chemically synthesized
tgaacctgaacttcctgagaac

SEQ ID NO: 767054 - DNA, 22 bp, Artificial Sequence
  chemically synthesized
agaggtagttctcaggaagttc

SEQ ID NO: 767055 - DNA, 22 bp, Artificial Sequence
  chemically synthesized
taccctttgaacctgaacttcc

SEQ ID NO: 767056 - DNA, 22 bp, Artificial Sequence
  chemically synthesized
cactgtaccctttgaacctgaa

SEQ ID NO: 767057 - DNA, 22 bp, Artificial Sequence
  chemically synthesized
tcaggaagttcaggttcaaagg

SEQ ID NO: 767058 - DNA, 22 bp, Artificial Sequence
  chemically synthesized
gctacactgtaccctttgaacc

SEQ ID NO: 767059 - DNA, 22 bp, Artificial Sequence
  chemically synthesized
aggaagttcaggttcaaagggt

SEQ ID NO: 767060 - DNA, 22 bp, Artificial Sequence
  chemically synthesized
attggctacactgtaccctttg

SEQ ID NO: 767061 - DNA, 22 bp, Artificial Sequence
  chemically synthesized
tcattggctacactgtaccctt

SEQ ID NO: 767062 - DNA, 22 bp, Artificial Sequence
  chemically synthesized
aggttcaaagggtacagtgtag

SEQ ID NO: 767063 - DNA, 22 bp, Artificial Sequence
  chemically synthesized
agctctcattggctacactgta

SEQ ID NO: 767064 - DNA, 22 bp, Artificial Sequence
  chemically synthesized
taagctctcattggctacactg

SEQ ID NO: 767065 - DNA, 22 bp, Artificial Sequence
  chemically synthesized
aaagggtacagtgtagccaatg

SEQ ID NO: 767066 - DNA, 22 bp, Artificial Sequence
  chemically synthesized
caggcggcattctaagctctca

SEQ ID NO: 767067 - DNA, 22 bp, Artificial Sequence
  chemically synthesized
cagaatcagataaaaatctcca

SEQ ID NO: 767068 - DNA, 22 bp, Artificial Sequence
  chemically synthesized
agaatgccgcctggagattttt

SEQ ID NO: 767069 - DNA, 22 bp, Artificial Sequence
  chemically synthesized
acagaatcagataaaaatctcc

SEQ ID NO: 767070 - DNA, 22 bp, Artificial Sequence
  chemically synthesized
gaatgccgcctggagattttta

SEQ ID NO: 767071 - DNA, 22 bp, Artificial Sequence
  chemically synthesized
tccttacagaatcagataaaaa

SEQ ID NO: 767072 - DNA, 22 bp, Artificial Sequence
  chemically synthesized
gagatttttatctgattctgta

SEQ ID NO: 767073 - DNA, 22 bp, Artificial Sequence
  chemically synthesized
cagtggaatattatccttacag

SEQ ID NO: 767074 - DNA, 22 bp, Artificial Sequence
  chemically synthesized
ttatctgattctgtaaggataa

SEQ ID NO: 767075 - DNA, 22 bp, Artificial Sequence
  chemically synthesized
tatctgattctgtaaggataat

SEQ ID NO: 767076 - DNA, 22 bp, Artificial Sequence
  chemically synthesized
atctgattctgtaaggataata

SEQ ID NO: 767077 - DNA, 22 bp, Artificial Sequence
  chemically synthesized
tctgattctgtaaggataatat

SEQ ID NO: 767078 - DNA, 22 bp, Artificial Sequence
  chemically synthesized
attctgtaaggataatattcca

SEQ ID NO: 767079 - DNA, 22 bp, Artificial Sequence
  chemically synthesized
cacaagaagctacagtggaata

SEQ ID NO: 767080 - DNA, 22 bp, Artificial Sequence
  chemically synthesized
tgtaaggataatattccactgt

SEQ ID NO: 767081 - DNA, 22 bp, Artificial Sequence
  chemically synthesized
acacaagaagctacagtggaat

SEQ ID NO: 767082 - DNA, 22 bp, Artificial Sequence
  chemically synthesized
tacacaagaagctacagtggaa

SEQ ID NO: 767083 - DNA, 22 bp, Artificial Sequence
  chemically synthesized
taaggataatattccactgtag

SEQ ID NO: 767084 - DNA, 22 bp, Artificial Sequence
  chemically synthesized
cacctttacacaagaagctaca

SEQ ID NO: 767085 - DNA, 22 bp, Artificial Sequence
  chemically synthesized
cactgtagcttcttgtgtaaag

SEQ ID NO: 767086 - DNA, 22 bp, Artificial Sequence
  chemically synthesized
acaatgttacacctttacacaa

SEQ ID NO: 767087 - DNA, 22 bp, Artificial Sequence
  chemically synthesized
cacaatgttacacctttacaca

SEQ ID NO: 767088 - DNA, 22 bp, Artificial Sequence
  chemically synthesized
tcacaatgttacacctttacac

SEQ ID NO: 767089 - DNA, 22 bp, Artificial Sequence
  chemically synthesized
tagcttcttgtgtaaaggtgta

SEQ ID NO: 767090 - DNA, 22 bp, Artificial Sequence
  chemically synthesized
ttttcacaatgttacaccttta

SEQ ID NO: 767091 - DNA, 22 bp, Artificial Sequence
  chemically synthesized
cttgtgtaaaggtgtaacattg

SEQ ID NO: 767092 - DNA, 22 bp, Artificial Sequence
  chemically synthesized
ttgtgtaaaggtgtaacattgt

SEQ ID NO: 767093 - DNA, 22 bp, Artificial Sequence
  chemically synthesized
gtgtaaaggtgtaacattgtga

SEQ ID NO: 767094 - DNA, 22 bp, Artificial Sequence
  chemically synthesized
tgtaaaggtgtaacattgtgaa

SEQ ID NO: 767095 - DNA, 22 bp, Artificial Sequence
  chemically synthesized
ccagatgctattttcacaatgt

SEQ ID NO: 767096 - DNA, 22 bp, Artificial Sequence
  chemically synthesized
ccaataatcattaccagatgct

SEQ ID NO: 767097 - DNA, 22 bp, Artificial Sequence
  chemically synthesized
tgaaaatagcatctggtaatga

SEQ ID NO: 767098 - DNA, 22 bp, Artificial Sequence
  chemically synthesized
aacaccatcctcccaataatca

SEQ ID NO: 767099 - DNA, 22 bp, Artificial Sequence
  chemically synthesized
ccctgaacaccatcctcccaat

SEQ ID NO: 767100 - DNA, 22 bp, Artificial Sequence
  chemically synthesized
accctgaacaccatcctcccaa

SEQ ID NO: 767101 - DNA, 22 bp, Artificial Sequence
  chemically synthesized
gtaatgattattgggaggatgg

SEQ ID NO: 767102 - DNA, 22 bp, Artificial Sequence
  chemically synthesized
catttaccctgaacaccatcct

SEQ ID NO: 767103 - DNA, 22 bp, Artificial Sequence
  chemically synthesized
ctacatttaccctgaacaccat

SEQ ID NO: 767104 - DNA, 22 bp, Artificial Sequence
  chemically synthesized
ttgggaggatggtgttcagggt

SEQ ID NO: 767105 - DNA, 22 bp, Artificial Sequence
  chemically synthesized
accctgctacatttaccctgaa

SEQ ID NO: 767106 - DNA, 22 bp, Artificial Sequence
  chemically synthesized
ggaggatggtgttcagggtaaa

SEQ ID NO: 767107 - DNA, 22 bp, Artificial Sequence
  chemically synthesized
tgaccctgctacatttaccctg

SEQ ID NO: 767108 - DNA, 22 bp, Artificial Sequence
  chemically synthesized
actctgaccctgctacatttac

SEQ ID NO: 767109 - DNA, 22 bp, Artificial Sequence
  chemically synthesized
cactctgaccctgctacattta

SEQ ID NO: 767110 - DNA, 22 bp, Artificial Sequence
  chemically synthesized
ccttcactctgaccctgctaca

SEQ ID NO: 767111 - DNA, 22 bp, Artificial Sequence
  chemically synthesized
ctgccttcactctgaccctgct

SEQ ID NO: 767112 - DNA, 22 bp, Artificial Sequence
  chemically synthesized
agggtaaatgtagcagggtcag

SEQ ID NO: 767113 - DNA, 22 bp, Artificial Sequence
  chemically synthesized
cctgccttcactctgaccctgc

SEQ ID NO: 767114 - DNA, 22 bp, Artificial Sequence
  chemically synthesized
gacttcctgccttcactctgac

SEQ ID NO: 767115 - DNA, 22 bp, Artificial Sequence
  chemically synthesized
tccactagacttcctgccttca

SEQ ID NO: 767116 - DNA, 22 bp, Artificial Sequence
  chemically synthesized
cctgtccactagacttcctgcc

SEQ ID NO: 767117 - DNA, 22 bp, Artificial Sequence
  chemically synthesized
ggactgcctgtccactagactt

SEQ ID NO: 767118 - DNA, 22 bp, Artificial Sequence
  chemically synthesized
tatggctgggactgcctgtcca

SEQ ID NO: 767119 - DNA, 22 bp, Artificial Sequence
  chemically synthesized
ctgtatggctgggactgcctgt

SEQ ID NO: 767120 - DNA, 22 bp, Artificial Sequence
  chemically synthesized
gttcctgtatggctgggactgc

SEQ ID NO: 767121 - DNA, 22 bp, Artificial Sequence
  chemically synthesized
ggttcctgtatggctgggactg

SEQ ID NO: 767122 - DNA, 22 bp, Artificial Sequence
  chemically synthesized
tggttcctgtatggctgggact

SEQ ID NO: 767123 - DNA, 22 bp, Artificial Sequence
  chemically synthesized
gtggacaggcagtcccagccat

SEQ ID NO: 767124 - DNA, 22 bp, Artificial Sequence
  chemically synthesized
ttttggttcctgtatggctggg

SEQ ID NO: 767125 - DNA, 22 bp, Artificial Sequence
  chemically synthesized
ctgttttggttcctgtatggct

SEQ ID NO: 767126 - DNA, 22 bp, Artificial Sequence
  chemically synthesized
aagccactgctgttttggttcc

SEQ ID NO: 767127 - DNA, 22 bp, Artificial Sequence
  chemically synthesized
tgaagccactgctgttttggtt

SEQ ID NO: 767128 - DNA, 22 bp, Artificial Sequence
  chemically synthesized
attctgaagccactgctgtttt

SEQ ID NO: 767129 - DNA, 22 bp, Artificial Sequence
  chemically synthesized
tgattctgaagccactgctgtt

SEQ ID NO: 767130 - DNA, 22 bp, Artificial Sequence
  chemically synthesized
tctgattctgaagccactgctg

SEQ ID NO: 767131 - DNA, 22 bp, Artificial Sequence
  chemically synthesized
tctctgattctgaagccactgc

SEQ ID NO: 767132 - DNA, 22 bp, Artificial Sequence
  chemically synthesized
ctctctgattctgaagccactg

SEQ ID NO: 767133 - DNA, 22 bp, Artificial Sequence
  chemically synthesized
ccttctctctgattctgaagcc

SEQ ID NO: 767134 - DNA, 22 bp, Artificial Sequence
  chemically synthesized
accttctctctgattctgaagc

SEQ ID NO: 767135 - DNA, 22 bp, Artificial Sequence
  chemically synthesized
taccttctctctgattctgaag

SEQ ID NO: 767136 - DNA, 22 bp, Artificial Sequence
  chemically synthesized
tttaccttctctctgattctga

SEQ ID NO: 767137 - DNA, 22 bp, Artificial Sequence
  chemically synthesized
ctttaccttctctctgattctg

SEQ ID NO: 767138 - DNA, 22 bp, Artificial Sequence
  chemically synthesized
ttctttaccttctctctgattc

SEQ ID NO: 767139 - DNA, 22 bp, Artificial Sequence
  chemically synthesized
cagaatcagagagaaggtaaag

SEQ ID NO: 767140 - DNA, 22 bp, Artificial Sequence
  chemically synthesized
agaatcagagagaaggtaaaga

SEQ ID NO: 767141 - DNA, 22 bp, Artificial Sequence
  chemically synthesized
aatgatggtagcatccctcttc

SEQ ID NO: 767142 - DNA, 22 bp, Artificial Sequence
  chemically synthesized
tgagcactcaatgatggtagca

SEQ ID NO: 767143 - DNA, 22 bp, Artificial Sequence
  chemically synthesized
atgagcactcaatgatggtagc

SEQ ID NO: 767144 - DNA, 22 bp, Artificial Sequence
  chemically synthesized
taacttatgagcactcaatgat

SEQ ID NO: 767145 - DNA, 22 bp, Artificial Sequence
  chemically synthesized
ataacttatgagcactcaatga

SEQ ID NO: 767146 - DNA, 22 bp, Artificial Sequence
  chemically synthesized
tataacttatgagcactcaatg

SEQ ID NO: 767147 - DNA, 22 bp, Artificial Sequence
  chemically synthesized
ttataacttatgagcactcaat

SEQ ID NO: 767148 - DNA, 22 bp, Artificial Sequence
  chemically synthesized
tttttataacttatgagcactc

SEQ ID NO: 767149 - DNA, 22 bp, Artificial Sequence
  chemically synthesized
ccatcattgagtgctcataagt

SEQ ID NO: 767150 - DNA, 22 bp, Artificial Sequence
  chemically synthesized
agtgctcataagttataaaaat

SEQ ID NO: 767151 - DNA, 22 bp, Artificial Sequence
  chemically synthesized
aatcacacatgcagctattttt

SEQ ID NO: 767152 - DNA, 22 bp, Artificial Sequence
  chemically synthesized
ataagttataaaaatagctgca

SEQ ID NO: 767153 - DNA, 22 bp, Artificial Sequence
  chemically synthesized
taaaaatagctgcatgtgtgat

SEQ ID NO: 767154 - DNA, 22 bp, Artificial Sequence
  chemically synthesized
catgtgtgatttaattccatcc

SEQ ID NO: 767155 - DNA, 22 bp, Artificial Sequence
  chemically synthesized
caaaggtaggacaagagaagga

SEQ ID NO: 767156 - DNA, 22 bp, Artificial Sequence
  chemically synthesized
ccaaaggtaggacaagagaagg

SEQ ID NO: 767157 - DNA, 22 bp, Artificial Sequence
  chemically synthesized
aattccatccttctcttgtcct

SEQ ID NO: 767158 - DNA, 22 bp, Artificial Sequence
  chemically synthesized
ccttccaaaggtaggacaagag

SEQ ID NO: 767159 - DNA, 22 bp, Artificial Sequence
  chemically synthesized
attccatccttctcttgtccta

SEQ ID NO: 767160 - DNA, 22 bp, Artificial Sequence
  chemically synthesized
taccttccaaaggtaggacaag

SEQ ID NO: 767161 - DNA, 22 bp, Artificial Sequence
  chemically synthesized
catccttctcttgtcctacctt

SEQ ID NO: 767162 - DNA, 22 bp, Artificial Sequence
  chemically synthesized
aattctaccttccaaaggtagg

SEQ ID NO: 767163 - DNA, 22 bp, Artificial Sequence
  chemically synthesized
ctgaattctaccttccaaaggt

SEQ ID NO: 767164 - DNA, 22 bp, Artificial Sequence
  chemically synthesized
cctgaattctaccttccaaagg

SEQ ID NO: 767165 - DNA, 22 bp, Artificial Sequence
  chemically synthesized
ctcttgtcctacctttggaagg

SEQ ID NO: 767166 - DNA, 22 bp, Artificial Sequence
  chemically synthesized
tcctgaattctaccttccaaag

SEQ ID NO: 767167 - DNA, 22 bp, Artificial Sequence
  chemically synthesized
tcttgtcctacctttggaaggt

SEQ ID NO: 767168 - DNA, 22 bp, Artificial Sequence
  chemically synthesized
ttgtcctacctttggaaggtag

SEQ ID NO: 767169 - DNA, 22 bp, Artificial Sequence
  chemically synthesized
gtcctacctttggaaggtagaa

SEQ ID NO: 767170 - DNA, 22 bp, Artificial Sequence
  chemically synthesized
tcctacctttggaaggtagaat

SEQ ID NO: 767171 - DNA, 22 bp, Artificial Sequence
  chemically synthesized
tcactttcctgaattctacctt

SEQ ID NO: 767172 - DNA, 22 bp, Artificial Sequence
  chemically synthesized
cctttggaaggtagaattcagg

SEQ ID NO: 767173 - DNA, 22 bp, Artificial Sequence
  chemically synthesized
tggaaggtagaattcaggaaag

SEQ ID NO: 767174 - DNA, 22 bp, Artificial Sequence
  chemically synthesized
ggaaggtagaattcaggaaagt

SEQ ID NO: 767175 - DNA, 22 bp, Artificial Sequence
  chemically synthesized
tgaatagttatcactttcctga

SEQ ID NO: 767176 - DNA, 22 bp, Artificial Sequence
  chemically synthesized
gaaggtagaattcaggaaagtg

SEQ ID NO: 767177 - DNA, 22 bp, Artificial Sequence
  chemically synthesized
gtgaatagttatcactttcctg

SEQ ID NO: 767178 - DNA, 22 bp, Artificial Sequence
  chemically synthesized
aaatgtacttgtgaatagttat

SEQ ID NO: 767179 - DNA, 22 bp, Artificial Sequence
  chemically synthesized
aaaatgtacttgtgaatagtta

SEQ ID NO: 767180 - DNA, 22 bp, Artificial Sequence
  chemically synthesized
taaaatgtacttgtgaatagtt

SEQ ID NO: 767181 - DNA, 22 bp, Artificial Sequence
  chemically synthesized
aggaaagtgataactattcaca

SEQ ID NO: 767182 - DNA, 22 bp, Artificial Sequence
  chemically synthesized
tctttaaaatgtacttgtgaat

SEQ ID NO: 767183 - DNA, 22 bp, Artificial Sequence
  chemically synthesized
tatctttaaaatgtacttgtga

SEQ ID NO: 767184 - DNA, 22 bp, Artificial Sequence
  chemically synthesized
ctatctttaaaatgtacttgtg

SEQ ID NO: 767185 - DNA, 22 bp, Artificial Sequence
  chemically synthesized
ttcacaagtacattttaaagat

SEQ ID NO: 767186 - DNA, 22 bp, Artificial Sequence
  chemically synthesized
aataacatttctatctttaaaa

SEQ ID NO: 767187 - DNA, 22 bp, Artificial Sequence
  chemically synthesized
aaataacatttctatctttaaa

SEQ ID NO: 767188 - DNA, 22 bp, Artificial Sequence
  chemically synthesized
taaataacatttctatctttaa

SEQ ID NO: 767189 - DNA, 22 bp, Artificial Sequence
  chemically synthesized
acaagtacattttaaagataga

SEQ ID NO: 767190 - DNA, 22 bp, Artificial Sequence
  chemically synthesized
taaagatagaaatgttatttaa

SEQ ID NO: 767191 - DNA, 22 bp, Artificial Sequence
  chemically synthesized
agaaatagaactttaaataaca

SEQ ID NO: 767192 - DNA, 22 bp, Artificial Sequence
  chemically synthesized
aaagatagaaatgttatttaaa

SEQ ID NO: 767193 - DNA, 22 bp, Artificial Sequence
  chemically synthesized
gagaaatagaactttaaataac

SEQ ID NO: 767194 - DNA, 22 bp, Artificial Sequence
  chemically synthesized
aagatagaaatgttatttaaag

SEQ ID NO: 767195 - DNA, 22 bp, Artificial Sequence
  chemically synthesized
cttgagaaatagaactttaaat

SEQ ID NO: 767196 - DNA, 22 bp, Artificial Sequence
  chemically synthesized
ctccttgagaaatagaacttta

SEQ ID NO: 767197 - DNA, 22 bp, Artificial Sequence
  chemically synthesized
actccttgagaaatagaacttt

SEQ ID NO: 767198 - DNA, 22 bp, Artificial Sequence
  chemically synthesized
ttactccttgagaaatagaact

SEQ ID NO: 767199 - DNA, 22 bp, Artificial Sequence
  chemically synthesized
cttactccttgagaaatagaac

SEQ ID NO: 767200 - DNA, 22 bp, Artificial Sequence
  chemically synthesized
tcttactccttgagaaatagaa

SEQ ID NO: 767201 - DNA, 22 bp, Artificial Sequence
  chemically synthesized
ttcttactccttgagaaataga

SEQ ID NO: 767202 - DNA, 22 bp, Artificial Sequence
  chemically synthesized
tttcttactccttgagaaatag

SEQ ID NO: 767203 - DNA, 22 bp, Artificial Sequence
  chemically synthesized
ttttcttactccttgagaaata

SEQ ID NO: 767204 - DNA, 22 bp, Artificial Sequence
  chemically synthesized
tttaaagttctatttctcaagg

SEQ ID NO: 767205 - DNA, 22 bp, Artificial Sequence
  chemically synthesized
aaagttctatttctcaaggagt

SEQ ID NO: 767206 - DNA, 22 bp, Artificial Sequence
  chemically synthesized
aagttctatttctcaaggagta

SEQ ID NO: 767207 - DNA, 22 bp, Artificial Sequence
  chemically synthesized
tatttctcaaggagtaagaaaa

SEQ ID NO: 767208 - DNA, 22 bp, Artificial Sequence
  chemically synthesized
tttctcaaggagtaagaaaaaa

SEQ ID NO: 767209 - DNA, 22 bp, Artificial Sequence
  chemically synthesized
ctcaaggagtaagaaaaaaata

SEQ ID NO: 767210 - DNA, 22 bp, Artificial Sequence
  chemically synthesized
tcaaggagtaagaaaaaaatac

SEQ ID NO: 767211 - DNA, 22 bp, Artificial Sequence
  chemically synthesized
aaacacagcatatgtatttttt

SEQ ID NO: 767212 - DNA, 22 bp, Artificial Sequence
  chemically synthesized
aaggagtaagaaaaaaatacat

SEQ ID NO: 767213 - DNA, 22 bp, Artificial Sequence
  chemically synthesized
gaaacacagcatatgtattttt

SEQ ID NO: 767214 - DNA, 22 bp, Artificial Sequence
  chemically synthesized
tgtttcaaacacacacacacac

SEQ ID NO: 767215 - DNA, 22 bp, Artificial Sequence
  chemically synthesized
caaacacacacacacacacaca

SEQ ID NO: 767216 - DNA, 22 bp, Artificial Sequence
  chemically synthesized
aaacacacacacacacacacac

SEQ ID NO: 767217 - DNA, 22 bp, Artificial Sequence
  chemically synthesized
gccccaaggtgtgtgtgtgtgt

SEQ ID NO: 767218 - DNA, 22 bp, Artificial Sequence
  chemically synthesized
ggccccaaggtgtgtgtgtgtg

SEQ ID NO: 767219 - DNA, 22 bp, Artificial Sequence
  chemically synthesized
tttggccccaaggtgtgtgtgt

SEQ ID NO: 767220 - DNA, 22 bp, Artificial Sequence
  chemically synthesized
atttggccccaaggtgtgtgtg

SEQ ID NO: 767221 - DNA, 22 bp, Artificial Sequence
  chemically synthesized
atttatttggccccaaggtgtg

SEQ ID NO: 767222 - DNA, 22 bp, Artificial Sequence
  chemically synthesized
taatttatttggccccaaggtg

SEQ ID NO: 767223 - DNA, 22 bp, Artificial Sequence
  chemically synthesized
tcattctaatttatttggcccc

SEQ ID NO: 767224 - DNA, 22 bp, Artificial Sequence
  chemically synthesized
gtcattctaatttatttggccc

SEQ ID NO: 767225 - DNA, 22 bp, Artificial Sequence
  chemically synthesized
tgtcattctaatttatttggcc

SEQ ID NO: 767226 - DNA, 22 bp, Artificial Sequence
  chemically synthesized
ggggccaaataaattagaatga

SEQ ID NO: 767227 - DNA, 22 bp, Artificial Sequence
  chemically synthesized
gggccaaataaattagaatgac

SEQ ID NO: 767228 - DNA, 22 bp, Artificial Sequence
  chemically synthesized
gtgtcaatggttttgtcattct

SEQ ID NO: 767229 - DNA, 22 bp, Artificial Sequence
  chemically synthesized
ggtgtcaatggttttgtcattc

SEQ ID NO: 767230 - DNA, 22 bp, Artificial Sequence
  chemically synthesized
tcatttggtgtcaatggttttg

SEQ ID NO: 767231 - DNA, 22 bp, Artificial Sequence
  chemically synthesized
gtcatttggtgtcaatggtttt

SEQ ID NO: 767232 - DNA, 22 bp, Artificial Sequence
  chemically synthesized
gaatgacaaaaccattgacacc

SEQ ID NO: 767233 - DNA, 22 bp, Artificial Sequence
  chemically synthesized
atgtcaatgcccttgtcatttg

SEQ ID NO: 767234 - DNA, 22 bp, Artificial Sequence
  chemically synthesized
gatgtcaatgcccttgtcattt

SEQ ID NO: 767235 - DNA, 22 bp, Artificial Sequence
  chemically synthesized
tgatgtcaatgcccttgtcatt

SEQ ID NO: 767236 - DNA, 22 bp, Artificial Sequence
  chemically synthesized
acaccaaatgacaagggcattg

SEQ ID NO: 767237 - DNA, 22 bp, Artificial Sequence
  chemically synthesized
tatggagctttgatgtcaatgc

SEQ ID NO: 767238 - DNA, 22 bp, Artificial Sequence
  chemically synthesized
tgcctatatggagctttgatgt

SEQ ID NO: 767239 - DNA, 22 bp, Artificial Sequence
  chemically synthesized
acatcaaagctccatataggca

SEQ ID NO: 767240 - DNA, 22 bp, Artificial Sequence
  chemically synthesized
ggtgggagtcacctgtgcctat

SEQ ID NO: 767241 - DNA, 22 bp, Artificial Sequence
  chemically synthesized
aggtgggagtcacctgtgccta

SEQ ID NO: 767242 - DNA, 22 bp, Artificial Sequence
  chemically synthesized
taggtgggagtcacctgtgcct

SEQ ID NO: 767243 - DNA, 22 bp, Artificial Sequence
  chemically synthesized
catataggcacaggtgactccc

SEQ ID NO: 767244 - DNA, 22 bp, Artificial Sequence
  chemically synthesized
atagggtatattttaggtggga

SEQ ID NO: 767245 - DNA, 22 bp, Artificial Sequence
  chemically synthesized
gatagggtatattttaggtggg

SEQ ID NO: 767246 - DNA, 22 bp, Artificial Sequence
  chemically synthesized
ggaatgcttgatagggtatatt

SEQ ID NO: 767247 - DNA, 22 bp, Artificial Sequence
  chemically synthesized
aggaatgcttgatagggtatat

SEQ ID NO: 767248 - DNA, 22 bp, Artificial Sequence
  chemically synthesized
ccacctaaaatataccctatca

SEQ ID NO: 767249 - DNA, 22 bp, Artificial Sequence
  chemically synthesized
aaatataccctatcaagcattc

SEQ ID NO: 767250 - DNA, 22 bp, Artificial Sequence
  chemically synthesized
gcacccatatagtttaggaatg

SEQ ID NO: 767251 - DNA, 22 bp, Artificial Sequence
  chemically synthesized
gaactggcacccatatagttta

SEQ ID NO: 767252 - DNA, 22 bp, Artificial Sequence
  chemically synthesized
tcaagcattcctaaactatatg

SEQ ID NO: 767253 - DNA, 22 bp, Artificial Sequence
  chemically synthesized
agaactggcacccatatagttt

SEQ ID NO: 767254 - DNA, 22 bp, Artificial Sequence
  chemically synthesized
tagaactggcacccatatagtt

SEQ ID NO: 767255 - DNA, 22 bp, Artificial Sequence
  chemically synthesized
tgtcctttagaactggcaccca

SEQ ID NO: 767256 - DNA, 22 bp, Artificial Sequence
  chemically synthesized
ctaaactatatgggtgccagtt

SEQ ID NO: 767257 - DNA, 22 bp, Artificial Sequence
  chemically synthesized
aactatatgggtgccagttcta

SEQ ID NO: 767258 - DNA, 22 bp, Artificial Sequence
  chemically synthesized
aggaaattgtgtcctttagaac

SEQ ID NO: 767259 - DNA, 22 bp, Artificial Sequence
  chemically synthesized
tatgggtgccagttctaaagga

SEQ ID NO: 767260 - DNA, 22 bp, Artificial Sequence
  chemically synthesized
tcaggaaattgtgtcctttaga

SEQ ID NO: 767261 - DNA, 22 bp, Artificial Sequence
  chemically synthesized
ctcaggaaattgtgtcctttag

SEQ ID NO: 767262 - DNA, 22 bp, Artificial Sequence
  chemically synthesized
tctcaggaaattgtgtccttta

SEQ ID NO: 767263 - DNA, 22 bp, Artificial Sequence
  chemically synthesized
ttctcaggaaattgtgtccttt

SEQ ID NO: 767264 - DNA, 22 bp, Artificial Sequence
  chemically synthesized
tttctcaggaaattgtgtcctt

SEQ ID NO: 767265 - DNA, 22 bp, Artificial Sequence
  chemically synthesized
cccactttttctcaggaaattg

SEQ ID NO: 767266 - DNA, 22 bp, Artificial Sequence
  chemically synthesized
tacccactttttctcaggaaat

SEQ ID NO: 767267 - DNA, 22 bp, Artificial Sequence
  chemically synthesized
taaaggacacaatttcctgaga

SEQ ID NO: 767268 - DNA, 22 bp, Artificial Sequence
  chemically synthesized
aaggacacaatttcctgagaaa

SEQ ID NO: 767269 - DNA, 22 bp, Artificial Sequence
  chemically synthesized
ctctacccactttttctcagga

SEQ ID NO: 767270 - DNA, 22 bp, Artificial Sequence
  chemically synthesized
aagcagtgttactctacccact

SEQ ID NO: 767271 - DNA, 22 bp, Artificial Sequence
  chemically synthesized
cctgagaaaaagtgggtagagt

SEQ ID NO: 767272 - DNA, 22 bp, Artificial Sequence
  chemically synthesized
ctgagaaaaagtgggtagagta

SEQ ID NO: 767273 - DNA, 22 bp, Artificial Sequence
  chemically synthesized
agaaaaagtgggtagagtaaca

SEQ ID NO: 767274 - DNA, 22 bp, Artificial Sequence
  chemically synthesized
aaaatatctgaagcagtgttac

SEQ ID NO: 767275 - DNA, 22 bp, Artificial Sequence
  chemically synthesized
aaaaatatctgaagcagtgtta

SEQ ID NO: 767276 - DNA, 22 bp, Artificial Sequence
  chemically synthesized
taaaaatatctgaagcagtgtt

SEQ ID NO: 767277 - DNA, 22 bp, Artificial Sequence
  chemically synthesized
ttaaaaatatctgaagcagtgt

SEQ ID NO: 767278 - DNA, 22 bp, Artificial Sequence
  chemically synthesized
tttaaaaatatctgaagcagtg

SEQ ID NO: 767279 - DNA, 22 bp, Artificial Sequence
  chemically synthesized
tttttaaaaatatctgaagcag

SEQ ID NO: 767280 - DNA, 22 bp, Artificial Sequence
  chemically synthesized
ctttttaaaaatatctgaagca

SEQ ID NO: 767281 - DNA, 22 bp, Artificial Sequence
  chemically synthesized
ggtccacggcttctttttaaaa

SEQ ID NO: 767282 - DNA, 22 bp, Artificial Sequence
  chemically synthesized
cttcagatatttttaaaaagaa

SEQ ID NO: 767283 - DNA, 22 bp, Artificial Sequence
  chemically synthesized
cagatatttttaaaaagaagcc

SEQ ID NO: 767284 - DNA, 22 bp, Artificial Sequence
  chemically synthesized
cactgggtccacggcttctttt

SEQ ID NO: 767285 - DNA, 22 bp, Artificial Sequence
  chemically synthesized
agatatttttaaaaagaagccg

SEQ ID NO: 767286 - DNA, 22 bp, Artificial Sequence
  chemically synthesized
tccactgggtccacggcttctt

SEQ ID NO: 767287 - DNA, 22 bp, Artificial Sequence
  chemically synthesized
gttctccactgggtccacggct

SEQ ID NO: 767288 - DNA, 22 bp, Artificial Sequence
  chemically synthesized
ttaaaaagaagccgtggaccca

SEQ ID NO: 767289 - DNA, 22 bp, Artificial Sequence
  chemically synthesized
taaaaagaagccgtggacccag

SEQ ID NO: 767290 - DNA, 22 bp, Artificial Sequence
  chemically synthesized
aaaaagaagccgtggacccagt

SEQ ID NO: 767291 - DNA, 22 bp, Artificial Sequence
  chemically synthesized
aaaagaagccgtggacccagtg

SEQ ID NO: 767292 - DNA, 22 bp, Artificial Sequence
  chemically synthesized
tgtgcagagccaaatgaatatc

SEQ ID NO: 767293 - DNA, 22 bp, Artificial Sequence
  chemically synthesized
atgtgcagagccaaatgaatat

SEQ ID NO: 767294 - DNA, 22 bp, Artificial Sequence
  chemically synthesized
atgttgatattcatttggctct

SEQ ID NO: 767295 - DNA, 22 bp, Artificial Sequence
  chemically synthesized
aagtttatgtgcagagccaaat

SEQ ID NO: 767296 - DNA, 22 bp, Artificial Sequence
  chemically synthesized
aaagtttatgtgcagagccaaa

SEQ ID NO: 767297 - DNA, 22 bp, Artificial Sequence
  chemically synthesized
taaagtttatgtgcagagccaa

SEQ ID NO: 767298 - DNA, 22 bp, Artificial Sequence
  chemically synthesized
ttaaagtttatgtgcagagcca

SEQ ID NO: 767299 - DNA, 22 bp, Artificial Sequence
  chemically synthesized
tttaaagtttatgtgcagagcc

SEQ ID NO: 767300 - DNA, 22 bp, Artificial Sequence
  chemically synthesized
ttttaaagtttatgtgcagagc

SEQ ID NO: 767301 - DNA, 22 bp, Artificial Sequence
  chemically synthesized
atattcatttggctctgcacat

SEQ ID NO: 767302 - DNA, 22 bp, Artificial Sequence
  chemically synthesized
ttttttaaagtttatgtgcaga

SEQ ID NO: 767303 - DNA, 22 bp, Artificial Sequence
  chemically synthesized
atttggctctgcacataaactt

SEQ ID NO: 767304 - DNA, 22 bp, Artificial Sequence
  chemically synthesized
ggctctgcacataaactttaaa

SEQ ID NO: 767305 - DNA, 22 bp, Artificial Sequence
  chemically synthesized
gctctgcacataaactttaaaa

SEQ ID NO: 767306 - DNA, 22 bp, Artificial Sequence
  chemically synthesized
tgcacataaactttaaaaaaga

SEQ ID NO: 767307 - DNA, 22 bp, Artificial Sequence
  chemically synthesized
aaaggcatgccattctttttta

SEQ ID NO: 767308 - DNA, 22 bp, Artificial Sequence
  chemically synthesized
cacataaactttaaaaaagaat

SEQ ID NO: 767309 - DNA, 22 bp, Artificial Sequence
  chemically synthesized
taaaaaagaatggcatgccttt

SEQ ID NO: 767310 - DNA, 22 bp, Artificial Sequence
  chemically synthesized
aaaaaagaatggcatgcctttt

SEQ ID NO: 767311 - DNA, 22 bp, Artificial Sequence
  chemically synthesized
aacaccagaattaaaaggcatg

SEQ ID NO: 767312 - DNA, 22 bp, Artificial Sequence
  chemically synthesized
aaaaagaatggcatgcctttta

SEQ ID NO: 767313 - DNA, 22 bp, Artificial Sequence
  chemically synthesized
caacaccagaattaaaaggcat

SEQ ID NO: 767314 - DNA, 22 bp, Artificial Sequence
  chemically synthesized
tcaacaccagaattaaaaggca

SEQ ID NO: 767315 - DNA, 22 bp, Artificial Sequence
  chemically synthesized
tttcaacaccagaattaaaagg

SEQ ID NO: 767316 - DNA, 22 bp, Artificial Sequence
  chemically synthesized
tctttcaacaccagaattaaaa

SEQ ID NO: 767317 - DNA, 22 bp, Artificial Sequence
  chemically synthesized
ctctttcaacaccagaattaaa

SEQ ID NO: 767318 - DNA, 22 bp, Artificial Sequence
  chemically synthesized
tctctttcaacaccagaattaa

SEQ ID NO: 767319 - DNA, 22 bp, Artificial Sequence
  chemically synthesized
gttttctctttcaacaccagaa

SEQ ID NO: 767320 - DNA, 22 bp, Artificial Sequence
  chemically synthesized
agactcgttttctctttcaaca

SEQ ID NO: 767321 - DNA, 22 bp, Artificial Sequence
  chemically synthesized
aagactcgttttctctttcaac

SEQ ID NO: 767322 - DNA, 22 bp, Artificial Sequence
  chemically synthesized
ttaattctggtgttgaaagaga

SEQ ID NO: 767323 - DNA, 22 bp, Artificial Sequence
  chemically synthesized
taagactcgttttctctttcaa

SEQ ID NO: 767324 - DNA, 22 bp, Artificial Sequence
  chemically synthesized
taattctggtgttgaaagagaa

SEQ ID NO: 767325 - DNA, 22 bp, Artificial Sequence
  chemically synthesized
aattctggtgttgaaagagaaa

SEQ ID NO: 767326 - DNA, 22 bp, Artificial Sequence
  chemically synthesized
attctggtgttgaaagagaaaa

SEQ ID NO: 767327 - DNA, 22 bp, Artificial Sequence
  chemically synthesized
tctttaagactcgttttctctt

SEQ ID NO: 767328 - DNA, 22 bp, Artificial Sequence
  chemically synthesized
tggtgttgaaagagaaaacgag

SEQ ID NO: 767329 - DNA, 22 bp, Artificial Sequence
  chemically synthesized
gtgttgaaagagaaaacgagtc

SEQ ID NO: 767330 - DNA, 22 bp, Artificial Sequence
  chemically synthesized
agcctgtctttaagactcgttt

SEQ ID NO: 767331 - DNA, 22 bp, Artificial Sequence
  chemically synthesized
aaagagaaaacgagtcttaaag

SEQ ID NO: 767332 - DNA, 22 bp, Artificial Sequence
  chemically synthesized
aaaaaagaaaactcagcctgtc

SEQ ID NO: 767333 - DNA, 22 bp, Artificial Sequence
  chemically synthesized
aaagacaggctgagttttcttt

SEQ ID NO: 767334 - DNA, 22 bp, Artificial Sequence
  chemically synthesized
aagacaggctgagttttctttt

SEQ ID NO: 767335 - DNA, 22 bp, Artificial Sequence
  chemically synthesized
gatgcagtattaaaaaaagaaa

SEQ ID NO: 767336 - DNA, 22 bp, Artificial Sequence
  chemically synthesized
agatgcagtattaaaaaaagaa

SEQ ID NO: 767337 - DNA, 22 bp, Artificial Sequence
  chemically synthesized
tagatgcagtattaaaaaaaga

SEQ ID NO: 767338 - DNA, 22 bp, Artificial Sequence
  chemically synthesized
agttttctttttttaatactgc

SEQ ID NO: 767339 - DNA, 22 bp, Artificial Sequence
  chemically synthesized
tggattttagatgcagtattaa

SEQ ID NO: 767340 - DNA, 22 bp, Artificial Sequence
  chemically synthesized
tatggattttagatgcagtatt

SEQ ID NO: 767341 - DNA, 22 bp, Artificial Sequence
  chemically synthesized
ctatggattttagatgcagtat

SEQ ID NO: 767342 - DNA, 22 bp, Artificial Sequence
  chemically synthesized
tctatggattttagatgcagta

SEQ ID NO: 767343 - DNA, 22 bp, Artificial Sequence
  chemically synthesized
tctttttttaatactgcatcta

SEQ ID NO: 767344 - DNA, 22 bp, Artificial Sequence
  chemically synthesized
ctttttttaatactgcatctaa

SEQ ID NO: 767345 - DNA, 22 bp, Artificial Sequence
  chemically synthesized
tttttttaatactgcatctaaa

SEQ ID NO: 767346 - DNA, 22 bp, Artificial Sequence
  chemically synthesized
tttttaatactgcatctaaaat

SEQ ID NO: 767347 - DNA, 22 bp, Artificial Sequence
  chemically synthesized
ttttaatactgcatctaaaatc

SEQ ID NO: 767348 - DNA, 22 bp, Artificial Sequence
  chemically synthesized
tttaatactgcatctaaaatcc

SEQ ID NO: 767349 - DNA, 22 bp, Artificial Sequence
  chemically synthesized
ttaatactgcatctaaaatcca

SEQ ID NO: 767350 - DNA, 22 bp, Artificial Sequence
  chemically synthesized
taatactgcatctaaaatccat

SEQ ID NO: 767351 - DNA, 22 bp, Artificial Sequence
  chemically synthesized
aatactgcatctaaaatccata

SEQ ID NO: 767352 - DNA, 22 bp, Artificial Sequence
  chemically synthesized
atactgcatctaaaatccatag

SEQ ID NO: 767353 - DNA, 22 bp, Artificial Sequence
  chemically synthesized
cagcacagtattttctatggat

SEQ ID NO: 767354 - DNA, 22 bp, Artificial Sequence
  chemically synthesized
catctaaaatccatagaaaata

SEQ ID NO: 767355 - DNA, 22 bp, Artificial Sequence
  chemically synthesized
aaatccatagaaaatactgtgc

SEQ ID NO: 767356 - DNA, 22 bp, Artificial Sequence
  chemically synthesized
tatagcaatatcagaaataata

SEQ ID NO: 767357 - DNA, 22 bp, Artificial Sequence
  chemically synthesized
tgctgcaatattatttctgata

SEQ ID NO: 767358 - DNA, 22 bp, Artificial Sequence
  chemically synthesized
aggctgtatagcaatatcagaa

SEQ ID NO: 767359 - DNA, 22 bp, Artificial Sequence
  chemically synthesized
caatattatttctgatattgct

SEQ ID NO: 767360 - DNA, 22 bp, Artificial Sequence
  chemically synthesized
tgagcactgaggctgtatagca

SEQ ID NO: 767361 - DNA, 22 bp, Artificial Sequence
  chemically synthesized
tttctgatattgctatacagcc

SEQ ID NO: 767362 - DNA, 22 bp, Artificial Sequence
  chemically synthesized
ctgatattgctatacagcctca

SEQ ID NO: 767363 - DNA, 22 bp, Artificial Sequence
  chemically synthesized
tgatattgctatacagcctcag

SEQ ID NO: 767364 - DNA, 22 bp, Artificial Sequence
  chemically synthesized
atattgctatacagcctcagtg

SEQ ID NO: 767365 - DNA, 22 bp, Artificial Sequence
  chemically synthesized
acccaattatgagcactgaggc

SEQ ID NO: 767366 - DNA, 22 bp, Artificial Sequence
  chemically synthesized
ctatacagcctcagtgctcata

SEQ ID NO: 767367 - DNA, 22 bp, Artificial Sequence
  chemically synthesized
tacagcctcagtgctcataatt

SEQ ID NO: 767368 - DNA, 22 bp, Artificial Sequence
  chemically synthesized
atgcaggaaatgctcacccaat

SEQ ID NO: 767369 - DNA, 22 bp, Artificial Sequence
  chemically synthesized
agtgctcataattgggtgagca

SEQ ID NO: 767370 - DNA, 22 bp, Artificial Sequence
  chemically synthesized
ataattgggtgagcatttcctg

SEQ ID NO: 767371 - DNA, 22 bp, Artificial Sequence
  chemically synthesized
aaagatgtctcatgcaggaaat

SEQ ID NO: 767372 - DNA, 22 bp, Artificial Sequence
  chemically synthesized
ggtgagcatttcctgcatgaga

SEQ ID NO: 767373 - DNA, 22 bp, Artificial Sequence
  chemically synthesized
atctgaaagatgtctcatgcag

SEQ ID NO: 767374 - DNA, 22 bp, Artificial Sequence
  chemically synthesized
gcactgatctgaaagatgtctc

SEQ ID NO: 767375 - DNA, 22 bp, Artificial Sequence
  chemically synthesized
ttggcactgatctgaaagatgt

SEQ ID NO: 767376 - DNA, 22 bp, Artificial Sequence
  chemically synthesized
cctgcatgagacatctttcaga

SEQ ID NO: 767377 - DNA, 22 bp, Artificial Sequence
  chemically synthesized
ctgcatgagacatctttcagat

SEQ ID NO: 767378 - DNA, 22 bp, Artificial Sequence
  chemically synthesized
ctgttggcactgatctgaaaga

SEQ ID NO: 767379 - DNA, 22 bp, Artificial Sequence
  chemically synthesized
catgagacatctttcagatcag

SEQ ID NO: 767380 - DNA, 22 bp, Artificial Sequence
  chemically synthesized
aagattactgttggcactgatc

SEQ ID NO: 767381 - DNA, 22 bp, Artificial Sequence
  chemically synthesized
caagattactgttggcactgat

SEQ ID NO: 767382 - DNA, 22 bp, Artificial Sequence
  chemically synthesized
tcaagattactgttggcactga

SEQ ID NO: 767383 - DNA, 22 bp, Artificial Sequence
  chemically synthesized
tcagatcagtgccaacagtaat

SEQ ID NO: 767384 - DNA, 22 bp, Artificial Sequence
  chemically synthesized
aggtctttcaagattactgttg

SEQ ID NO: 767385 - DNA, 22 bp, Artificial Sequence
  chemically synthesized
cagatcagtgccaacagtaatc

SEQ ID NO: 767386 - DNA, 22 bp, Artificial Sequence
  chemically synthesized
agatcagtgccaacagtaatct

SEQ ID NO: 767387 - DNA, 22 bp, Artificial Sequence
  chemically synthesized
catgttaaggtctttcaagatt

SEQ ID NO: 767388 - DNA, 22 bp, Artificial Sequence
  chemically synthesized
gcatgttaaggtctttcaagat

SEQ ID NO: 767389 - DNA, 22 bp, Artificial Sequence
  chemically synthesized
gggtttgcatgttaaggtcttt

SEQ ID NO: 767390 - DNA, 22 bp, Artificial Sequence
  chemically synthesized
gaaagaccttaacatgcaaacc

SEQ ID NO: 767391 - DNA, 22 bp, Artificial Sequence
  chemically synthesized
aaagaccttaacatgcaaaccc

SEQ ID NO: 767392 - DNA, 22 bp, Artificial Sequence
  chemically synthesized
aatgtacaatctagggtttgca

SEQ ID NO: 767393 - DNA, 22 bp, Artificial Sequence
  chemically synthesized
aaatgtacaatctagggtttgc

SEQ ID NO: 767394 - DNA, 22 bp, Artificial Sequence
  chemically synthesized
tgacttaaatgtacaatctagg

SEQ ID NO: 767395 - DNA, 22 bp, Artificial Sequence
  chemically synthesized
aacatgcaaaccctagattgta

SEQ ID NO: 767396 - DNA, 22 bp, Artificial Sequence
  chemically synthesized
acatgcaaaccctagattgtac

SEQ ID NO: 767397 - DNA, 22 bp, Artificial Sequence
  chemically synthesized
tgtgacttaaatgtacaatcta

SEQ ID NO: 767398 - DNA, 22 bp, Artificial Sequence
  chemically synthesized
tctctgtgacttaaatgtacaa

SEQ ID NO: 767399 - DNA, 22 bp, Artificial Sequence
  chemically synthesized
gattgtacatttaagtcacaga

SEQ ID NO: 767400 - DNA, 22 bp, Artificial Sequence
  chemically synthesized
atatgtggttgtctctgtgact

SEQ ID NO: 767401 - DNA, 22 bp, Artificial Sequence
  chemically synthesized
catatgtggttgtctctgtgac

SEQ ID NO: 767402 - DNA, 22 bp, Artificial Sequence
  chemically synthesized
tcatatgtggttgtctctgtga

SEQ ID NO: 767403 - DNA, 22 bp, Artificial Sequence
  chemically synthesized
ttcatatgtggttgtctctgtg

SEQ ID NO: 767404 - DNA, 22 bp, Artificial Sequence
  chemically synthesized
tacatttaagtcacagagacaa

SEQ ID NO: 767405 - DNA, 22 bp, Artificial Sequence
  chemically synthesized
tagacttttcatatgtggttgt

SEQ ID NO: 767406 - DNA, 22 bp, Artificial Sequence
  chemically synthesized
aagtcacagagacaaccacata

SEQ ID NO: 767407 - DNA, 22 bp, Artificial Sequence
  chemically synthesized
agtcacagagacaaccacatat

SEQ ID NO: 767408 - DNA, 22 bp, Artificial Sequence
  chemically synthesized
aacattgtagacttttcatatg

SEQ ID NO: 767409 - DNA, 22 bp, Artificial Sequence
  chemically synthesized
caacattgtagacttttcatat

SEQ ID NO: 767410 - DNA, 22 bp, Artificial Sequence
  chemically synthesized
caatgttgaaggtacttttggt

SEQ ID NO: 767411 - DNA, 22 bp, Artificial Sequence
  chemically synthesized
aaggtacttttggttttttata

SEQ ID NO: 767412 - DNA, 22 bp, Artificial Sequence
  chemically synthesized
cacataaaatataatataaaaa

SEQ ID NO: 767413 - DNA, 22 bp, Artificial Sequence
  chemically synthesized
ctgcacataaaatataatataa

SEQ ID NO: 767414 - DNA, 22 bp, Artificial Sequence
  chemically synthesized
ttggttttttatattatatttt

SEQ ID NO: 767415 - DNA, 22 bp, Artificial Sequence
  chemically synthesized
attcctgcacataaaatataat

SEQ ID NO: 767416 - DNA, 22 bp, Artificial Sequence
  chemically synthesized
tggttttttatattatatttta

SEQ ID NO: 767417 - DNA, 22 bp, Artificial Sequence
  chemically synthesized
ggttttttatattatattttat

SEQ ID NO: 767418 - DNA, 22 bp, Artificial Sequence
  chemically synthesized
gttttttatattatattttatg

SEQ ID NO: 767419 - DNA, 22 bp, Artificial Sequence
  chemically synthesized
tttatattatattttatgtgca

SEQ ID NO: 767420 - DNA, 22 bp, Artificial Sequence
  chemically synthesized
ttatattatattttatgtgcag

SEQ ID NO: 767421 - DNA, 22 bp, Artificial Sequence
  chemically synthesized
tatattatattttatgtgcagg

SEQ ID NO: 767422 - DNA, 22 bp, Artificial Sequence
  chemically synthesized
atattatattttatgtgcagga

SEQ ID NO: 767423 - DNA, 22 bp, Artificial Sequence
  chemically synthesized
aaacagactgattcctgcacat

SEQ ID NO: 767424 - DNA, 22 bp, Artificial Sequence
  chemically synthesized
tattatattttatgtgcaggaa

SEQ ID NO: 767425 - DNA, 22 bp, Artificial Sequence
  chemically synthesized
caaacagactgattcctgcaca

SEQ ID NO: 767426 - DNA, 22 bp, Artificial Sequence
  chemically synthesized
ttcaaacagactgattcctgca

SEQ ID NO: 767427 - DNA, 22 bp, Artificial Sequence
  chemically synthesized
cttcaaacagactgattcctgc

SEQ ID NO: 767428 - DNA, 22 bp, Artificial Sequence
  chemically synthesized
tcttcaaacagactgattcctg

SEQ ID NO: 767429 - DNA, 22 bp, Artificial Sequence
  chemically synthesized
tattttatgtgcaggaatcagt

SEQ ID NO: 767430 - DNA, 22 bp, Artificial Sequence
  chemically synthesized
tatgtgcaggaatcagtctgtt

SEQ ID NO: 767431 - DNA, 22 bp, Artificial Sequence
  chemically synthesized
atgtgcaggaatcagtctgttt

SEQ ID NO: 767432 - DNA, 22 bp, Artificial Sequence
  chemically synthesized
tgtgcaggaatcagtctgtttg

SEQ ID NO: 767433 - DNA, 22 bp, Artificial Sequence
  chemically synthesized
agataagggtagttttcttcaa

SEQ ID NO: 767434 - DNA, 22 bp, Artificial Sequence
  chemically synthesized
tcagataagggtagttttcttc

SEQ ID NO: 767435 - DNA, 22 bp, Artificial Sequence
  chemically synthesized
ctcagataagggtagttttctt

SEQ ID NO: 767436 - DNA, 22 bp, Artificial Sequence
  chemically synthesized
tctcagataagggtagttttct

SEQ ID NO: 767437 - DNA, 22 bp, Artificial Sequence
  chemically synthesized
gtctttctcagataagggtagt

SEQ ID NO: 767438 - DNA, 22 bp, Artificial Sequence
  chemically synthesized
tttgaagaaaactacccttatc

SEQ ID NO: 767439 - DNA, 22 bp, Artificial Sequence
  chemically synthesized
gaagaaaactacccttatctga

SEQ ID NO: 767440 - DNA, 22 bp, Artificial Sequence
  chemically synthesized
aagaaaactacccttatctgag

SEQ ID NO: 767441 - DNA, 22 bp, Artificial Sequence
  chemically synthesized
gaaagacccatctggtctttct

SEQ ID NO: 767442 - DNA, 22 bp, Artificial Sequence
  chemically synthesized
cccttatctgagaaagaccaga

SEQ ID NO: 767443 - DNA, 22 bp, Artificial Sequence
  chemically synthesized
atctgagaaagaccagatgggt

SEQ ID NO: 767444 - DNA, 22 bp, Artificial Sequence
  chemically synthesized
agagttggaaagacccatctgg

SEQ ID NO: 767445 - DNA, 22 bp, Artificial Sequence
  chemically synthesized
tctgagaaagaccagatgggtc

SEQ ID NO: 767446 - DNA, 22 bp, Artificial Sequence
  chemically synthesized
agaaagaccagatgggtctttc

SEQ ID NO: 767447 - DNA, 22 bp, Artificial Sequence
  chemically synthesized
caaaaacaaatatgtctcagag

SEQ ID NO: 767448 - DNA, 22 bp, Artificial Sequence
  chemically synthesized
tgcaaaaacaaatatgtctcag

SEQ ID NO: 767449 - DNA, 22 bp, Artificial Sequence
  chemically synthesized
tccaactctgagacatatttgt

SEQ ID NO: 767450 - DNA, 22 bp, Artificial Sequence
  chemically synthesized
ccaactctgagacatatttgtt

SEQ ID NO: 767451 - DNA, 22 bp, Artificial Sequence
  chemically synthesized
caactctgagacatatttgttt

SEQ ID NO: 767452 - DNA, 22 bp, Artificial Sequence
  chemically synthesized
atcatggctctgcaaaaacaaa

SEQ ID NO: 767453 - DNA, 22 bp, Artificial Sequence
  chemically synthesized
tgagacatatttgtttttgcag

SEQ ID NO: 767454 - DNA, 22 bp, Artificial Sequence
  chemically synthesized
agacatatttgtttttgcagag

SEQ ID NO: 767455 - DNA, 22 bp, Artificial Sequence
  chemically synthesized
cccccacccctcatcatggctc

SEQ ID NO: 767456 - DNA, 22 bp, Artificial Sequence
  chemically synthesized
gtttttgcagagccatgatgag

SEQ ID NO: 767457 - DNA, 22 bp, Artificial Sequence
  chemically synthesized
tttttgcagagccatgatgagg

SEQ ID NO: 767458 - DNA, 22 bp, Artificial Sequence
  chemically synthesized
ccctacccccacccctcatcat

SEQ ID NO: 767459 - DNA, 22 bp, Artificial Sequence
  chemically synthesized
ttgcagagccatgatgaggggt

SEQ ID NO: 767460 - DNA, 22 bp, Artificial Sequence
  chemically synthesized
tgcagagccatgatgaggggtg

SEQ ID NO: 767461 - DNA, 22 bp, Artificial Sequence
  chemically synthesized
gcagagccatgatgaggggtgg

SEQ ID NO: 767462 - DNA, 22 bp, Artificial Sequence
  chemically synthesized
cagagccatgatgaggggtggg

SEQ ID NO: 767463 - DNA, 22 bp, Artificial Sequence
  chemically synthesized
atccccctaccctacccccacc

SEQ ID NO: 767464 - DNA, 22 bp, Artificial Sequence
  chemically synthesized
catccccctaccctacccccac

SEQ ID NO: 767465 - DNA, 22 bp, Artificial Sequence
  chemically synthesized
tttcatccccctaccctacccc

SEQ ID NO: 767466 - DNA, 22 bp, Artificial Sequence
  chemically synthesized
ccctgtttcatccccctaccct

SEQ ID NO: 767467 - DNA, 22 bp, Artificial Sequence
  chemically synthesized
ctgccctgtttcatccccctac

SEQ ID NO: 767468 - DNA, 22 bp, Artificial Sequence
  chemically synthesized
gttcctgccctgtttcatcccc

SEQ ID NO: 767469 - DNA, 22 bp, Artificial Sequence
  chemically synthesized
taagtattagttcctgccctgt

SEQ ID NO: 767470 - DNA, 22 bp, Artificial Sequence
  chemically synthesized
taagggctgtaagtattagttc

SEQ ID NO: 767471 - DNA, 22 bp, Artificial Sequence
  chemically synthesized
ataagggctgtaagtattagtt

SEQ ID NO: 767472 - DNA, 22 bp, Artificial Sequence
  chemically synthesized
gtgtaaaggatttataagggct

SEQ ID NO: 767473 - DNA, 22 bp, Artificial Sequence
  chemically synthesized
atacttacagcccttataaatc

SEQ ID NO: 767474 - DNA, 22 bp, Artificial Sequence
  chemically synthesized
atagagttggtgtaaaggattt

SEQ ID NO: 767475 - DNA, 22 bp, Artificial Sequence
  chemically synthesized
acagcccttataaatcctttac

SEQ ID NO: 767476 - DNA, 22 bp, Artificial Sequence
  chemically synthesized
catagagttggtgtaaaggatt

SEQ ID NO: 767477 - DNA, 22 bp, Artificial Sequence
  chemically synthesized
cagcccttataaatcctttaca

SEQ ID NO: 767478 - DNA, 22 bp, Artificial Sequence
  chemically synthesized
tttcatagagttggtgtaaagg

SEQ ID NO: 767479 - DNA, 22 bp, Artificial Sequence
  chemically synthesized
ataaatcctttacaccaactct

SEQ ID NO: 767480 - DNA, 22 bp, Artificial Sequence
  chemically synthesized
taaatcctttacaccaactcta

SEQ ID NO: 767481 - DNA, 22 bp, Artificial Sequence
  chemically synthesized
tacaccaactctatgaaatagg

SEQ ID NO: 767482 - DNA, 22 bp, Artificial Sequence
  chemically synthesized
acaccaactctatgaaataggc

SEQ ID NO: 767483 - DNA, 22 bp, Artificial Sequence
  chemically synthesized
caccaactctatgaaataggcc

SEQ ID NO: 767484 - DNA, 22 bp, Artificial Sequence
  chemically synthesized
gataggggataaagaaggccta

SEQ ID NO: 767485 - DNA, 22 bp, Artificial Sequence
  chemically synthesized
ctcgataggggataaagaaggc

SEQ ID NO: 767486 - DNA, 22 bp, Artificial Sequence
  chemically synthesized
cctcgataggggataaagaagg

SEQ ID NO: 767487 - DNA, 22 bp, Artificial Sequence
  chemically synthesized
tatgaaataggccttctttatc

SEQ ID NO: 767488 - DNA, 22 bp, Artificial Sequence
  chemically synthesized
tgaaataggccttctttatccc

SEQ ID NO: 767489 - DNA, 22 bp, Artificial Sequence
  chemically synthesized
gtggtttcctcgataggggata

SEQ ID NO: 767490 - DNA, 22 bp, Artificial Sequence
  chemically synthesized
aaactcgtggtttcctcgatag

SEQ ID NO: 767491 - DNA, 22 bp, Artificial Sequence
  chemically synthesized
tcaaactcgtggtttcctcgat

SEQ ID NO: 767492 - DNA, 22 bp, Artificial Sequence
  chemically synthesized
ctttatcccctatcgaggaaac

SEQ ID NO: 767493 - DNA, 22 bp, Artificial Sequence
  chemically synthesized
tttatcccctatcgaggaaacc

SEQ ID NO: 767494 - DNA, 22 bp, Artificial Sequence
  chemically synthesized
tatcccctatcgaggaaaccac

SEQ ID NO: 767495 - DNA, 22 bp, Artificial Sequence
  chemically synthesized
cctctcaaactcgtggtttcct

SEQ ID NO: 767496 - DNA, 22 bp, Artificial Sequence
  chemically synthesized
atcccctatcgaggaaaccacg

SEQ ID NO: 767497 - DNA, 22 bp, Artificial Sequence
  chemically synthesized
acctctcaaactcgtggtttcc

SEQ ID NO: 767498 - DNA, 22 bp, Artificial Sequence
  chemically synthesized
tcccctatcgaggaaaccacga

SEQ ID NO: 767499 - DNA, 22 bp, Artificial Sequence
  chemically synthesized
tacctctcaaactcgtggtttc

SEQ ID NO: 767500 - DNA, 22 bp, Artificial Sequence
  chemically synthesized
ctttacctctcaaactcgtggt

SEQ ID NO: 767501 - DNA, 22 bp, Artificial Sequence
  chemically synthesized
tcgaggaaaccacgagtttgag

SEQ ID NO: 767502 - DNA, 22 bp, Artificial Sequence
  chemically synthesized
tataagttactttacctctcaa

SEQ ID NO: 767503 - DNA, 22 bp, Artificial Sequence
  chemically synthesized
gtataagttactttacctctca

SEQ ID NO: 767504 - DNA, 22 bp, Artificial Sequence
  chemically synthesized
tgatttgtataagttactttac

SEQ ID NO: 767505 - DNA, 22 bp, Artificial Sequence
  chemically synthesized
tatgatttgtataagttacttt

SEQ ID NO: 767506 - DNA, 22 bp, Artificial Sequence
  chemically synthesized
gagaggtaaagtaacttataca

SEQ ID NO: 767507 - DNA, 22 bp, Artificial Sequence
  chemically synthesized
agaggtaaagtaacttatacaa

SEQ ID NO: 767508 - DNA, 22 bp, Artificial Sequence
  chemically synthesized
ccacataacaacaactctatga

SEQ ID NO: 767509 - DNA, 22 bp, Artificial Sequence
  chemically synthesized
tgccacataacaacaactctat

SEQ ID NO: 767510 - DNA, 22 bp, Artificial Sequence
  chemically synthesized
ctgccacataacaacaactcta

SEQ ID NO: 767511 - DNA, 22 bp, Artificial Sequence
  chemically synthesized
atacaaatcatagagttgttgt

SEQ ID NO: 767512 - DNA, 22 bp, Artificial Sequence
  chemically synthesized
tacaaatcatagagttgttgtt

SEQ ID NO: 767513 - DNA, 22 bp, Artificial Sequence
  chemically synthesized
cttctgccacataacaacaact

SEQ ID NO: 767514 - DNA, 22 bp, Artificial Sequence
  chemically synthesized
accctgcttctgccacataaca

SEQ ID NO: 767515 - DNA, 22 bp, Artificial Sequence
  chemically synthesized
taaccctgcttctgccacataa

SEQ ID NO: 767516 - DNA, 22 bp, Artificial Sequence
  chemically synthesized
tgctctaaccctgcttctgcca

SEQ ID NO: 767517 - DNA, 22 bp, Artificial Sequence
  chemically synthesized
ttgttatgtggcagaagcaggg

SEQ ID NO: 767518 - DNA, 22 bp, Artificial Sequence
  chemically synthesized
ttatgtggcagaagcagggtta

SEQ ID NO: 767519 - DNA, 22 bp, Artificial Sequence
  chemically synthesized
tgtggcagaagcagggttagag

SEQ ID NO: 767520 - DNA, 22 bp, Artificial Sequence
  chemically synthesized
aggaagatctatgctctaaccc

SEQ ID NO: 767521 - DNA, 22 bp, Artificial Sequence
  chemically synthesized
caggaagatctatgctctaacc

SEQ ID NO: 767522 - DNA, 22 bp, Artificial Sequence
  chemically synthesized
gtttcaggaagatctatgctct

SEQ ID NO: 767523 - DNA, 22 bp, Artificial Sequence
  chemically synthesized
gagcatagatcttcctgaaact

SEQ ID NO: 767524 - DNA, 22 bp, Artificial Sequence
  chemically synthesized
gagggaagagaataaaaataac

SEQ ID NO: 767525 - DNA, 22 bp, Artificial Sequence
  chemically synthesized
cctgaaactaggttatttttat

SEQ ID NO: 767526 - DNA, 22 bp, Artificial Sequence
  chemically synthesized
ggagggaagagaataaaaataa

SEQ ID NO: 767527 - DNA, 22 bp, Artificial Sequence
  chemically synthesized
ctgaaactaggttatttttatt

SEQ ID NO: 767528 - DNA, 22 bp, Artificial Sequence
  chemically synthesized
aaactaggttatttttattctc

SEQ ID NO: 767529 - DNA, 22 bp, Artificial Sequence
  chemically synthesized
gagcttggagggaagagaataa

SEQ ID NO: 767530 - DNA, 22 bp, Artificial Sequence
  chemically synthesized
ggttatttttattctcttccct

SEQ ID NO: 767531 - DNA, 22 bp, Artificial Sequence
  chemically synthesized
tttttattctcttccctccaag

SEQ ID NO: 767532 - DNA, 22 bp, Artificial Sequence
  chemically synthesized
ttattctcttccctccaagctc

SEQ ID NO: 767533 - DNA, 22 bp, Artificial Sequence
  chemically synthesized
tattctcttccctccaagctcc

SEQ ID NO: 767534 - DNA, 22 bp, Artificial Sequence
  chemically synthesized
attctcttccctccaagctcca

SEQ ID NO: 767535 - DNA, 22 bp, Artificial Sequence
  chemically synthesized
ttctcttccctccaagctccag

SEQ ID NO: 767536 - DNA, 22 bp, Artificial Sequence
  chemically synthesized
tcttccctccaagctccagtgt

SEQ ID NO: 767537 - DNA, 22 bp, Artificial Sequence
  chemically synthesized
atggatggggaagacactggag

SEQ ID NO: 767538 - DNA, 22 bp, Artificial Sequence
  chemically synthesized
ttccctccaagctccagtgtct

SEQ ID NO: 767539 - DNA, 22 bp, Artificial Sequence
  chemically synthesized
aatggatggggaagacactgga

SEQ ID NO: 767540 - DNA, 22 bp, Artificial Sequence
  chemically synthesized
ccctccaagctccagtgtcttc

SEQ ID NO: 767541 - DNA, 22 bp, Artificial Sequence
  chemically synthesized
cctccaagctccagtgtcttcc

SEQ ID NO: 767542 - DNA, 22 bp, Artificial Sequence
  chemically synthesized
tatttaatggatggggaagaca

SEQ ID NO: 767543 - DNA, 22 bp, Artificial Sequence
  chemically synthesized
gtatttaatggatggggaagac

SEQ ID NO: 767544 - DNA, 22 bp, Artificial Sequence
  chemically synthesized
caagctccagtgtcttccccat

SEQ ID NO: 767545 - DNA, 22 bp, Artificial Sequence
  chemically synthesized
tgtatttaatggatggggaaga

SEQ ID NO: 767546 - DNA, 22 bp, Artificial Sequence
  chemically synthesized
ctttgtatttaatggatgggga

SEQ ID NO: 767547 - DNA, 22 bp, Artificial Sequence
  chemically synthesized
gctttgtatttaatggatgggg

SEQ ID NO: 767548 - DNA, 22 bp, Artificial Sequence
  chemically synthesized
cagtgtcttccccatccattaa

SEQ ID NO: 767549 - DNA, 22 bp, Artificial Sequence
  chemically synthesized
ccccatccattaaatacaaagc

SEQ ID NO: 767550 - DNA, 22 bp, Artificial Sequence
  chemically synthesized
cccatccattaaatacaaagca

SEQ ID NO: 767551 - DNA, 22 bp, Artificial Sequence
  chemically synthesized
aatacaaagcaagtgacttctg

SEQ ID NO: 767552 - DNA, 22 bp, Artificial Sequence
  chemically synthesized
tgatacatgtagcccaagtcag

SEQ ID NO: 767553 - DNA, 22 bp, Artificial Sequence
  chemically synthesized
ctgtgatacatgtagcccaagt

SEQ ID NO: 767554 - DNA, 22 bp, Artificial Sequence
  chemically synthesized
tgttgctgtgatacatgtagcc

SEQ ID NO: 767555 - DNA, 22 bp, Artificial Sequence
  chemically synthesized
ctgacttgggctacatgtatca

SEQ ID NO: 767556 - DNA, 22 bp, Artificial Sequence
  chemically synthesized
tgacttgggctacatgtatcac

SEQ ID NO: 767557 - DNA, 22 bp, Artificial Sequence
  chemically synthesized
taattatgttgctgtgatacat

SEQ ID NO: 767558 - DNA, 22 bp, Artificial Sequence
  chemically synthesized
acttgggctacatgtatcacag

SEQ ID NO: 767559 - DNA, 22 bp, Artificial Sequence
  chemically synthesized
ttataattatgttgctgtgata

SEQ ID NO: 767560 - DNA, 22 bp, Artificial Sequence
  chemically synthesized
gggctacatgtatcacagcaac

SEQ ID NO: 767561 - DNA, 22 bp, Artificial Sequence
  chemically synthesized
ggctacatgtatcacagcaaca

SEQ ID NO: 767562 - DNA, 22 bp, Artificial Sequence
  chemically synthesized
catgtatcacagcaacataatt

SEQ ID NO: 767563 - DNA, 22 bp, Artificial Sequence
  chemically synthesized
atgagttattataattatgttg

SEQ ID NO: 767564 - DNA, 22 bp, Artificial Sequence
  chemically synthesized
aatgagttattataattatgtt

SEQ ID NO: 767565 - DNA, 22 bp, Artificial Sequence
  chemically synthesized
acagatgccttaatgagttatt

SEQ ID NO: 767566 - DNA, 22 bp, Artificial Sequence
  chemically synthesized
aatatctcacagatgccttaat

SEQ ID NO: 767567 - DNA, 22 bp, Artificial Sequence
  chemically synthesized
taataactcattaaggcatctg

SEQ ID NO: 767568 - DNA, 22 bp, Artificial Sequence
  chemically synthesized
aaactaaatatctcacagatgc

SEQ ID NO: 767569 - DNA, 22 bp, Artificial Sequence
  chemically synthesized
tgaaactaaatatctcacagat

SEQ ID NO: 767570 - DNA, 22 bp, Artificial Sequence
  chemically synthesized
attaaggcatctgtgagatatt

SEQ ID NO: 767571 - DNA, 22 bp, Artificial Sequence
  chemically synthesized
aggcatctgtgagatatttagt

SEQ ID NO: 767572 - DNA, 22 bp, Artificial Sequence
  chemically synthesized
tcagtgctctgaaactaaatat

SEQ ID NO: 767573 - DNA, 22 bp, Artificial Sequence
  chemically synthesized
ctatcagtgctctgaaactaaa

SEQ ID NO: 767574 - DNA, 22 bp, Artificial Sequence
  chemically synthesized
tgagatatttagtttcagagca

SEQ ID NO: 767575 - DNA, 22 bp, Artificial Sequence
  chemically synthesized
accattcctatcagtgctctga

SEQ ID NO: 767576 - DNA, 22 bp, Artificial Sequence
  chemically synthesized
ttgaccattcctatcagtgctc

SEQ ID NO: 767577 - DNA, 22 bp, Artificial Sequence
  chemically synthesized
agtttcagagcactgataggaa

SEQ ID NO: 767578 - DNA, 22 bp, Artificial Sequence
  chemically synthesized
agttgttgaccattcctatcag

SEQ ID NO: 767579 - DNA, 22 bp, Artificial Sequence
  chemically synthesized
gtttcagagcactgataggaat

SEQ ID NO: 767580 - DNA, 22 bp, Artificial Sequence
  chemically synthesized
ttcagttgttgaccattcctat

SEQ ID NO: 767581 - DNA, 22 bp, Artificial Sequence
  chemically synthesized
cagagcactgataggaatggtc

SEQ ID NO: 767582 - DNA, 22 bp, Artificial Sequence
  chemically synthesized
agagcactgataggaatggtca

SEQ ID NO: 767583 - DNA, 22 bp, Artificial Sequence
  chemically synthesized
gaaaattattcagttgttgacc

SEQ ID NO: 767584 - DNA, 22 bp, Artificial Sequence
  chemically synthesized
ataggaatggtcaacaactgaa

SEQ ID NO: 767585 - DNA, 22 bp, Artificial Sequence
  chemically synthesized
attggaaaattattcagttgtt

SEQ ID NO: 767586 - DNA, 22 bp, Artificial Sequence
  chemically synthesized
aaagcaatacctaattggaaaa

SEQ ID NO: 767587 - DNA, 22 bp, Artificial Sequence
  chemically synthesized
aaaagcaatacctaattggaaa

SEQ ID NO: 767588 - DNA, 22 bp, Artificial Sequence
  chemically synthesized
taaaagcaatacctaattggaa

SEQ ID NO: 767589 - DNA, 22 bp, Artificial Sequence
  chemically synthesized
ttaaaagcaatacctaattgga

SEQ ID NO: 767590 - DNA, 22 bp, Artificial Sequence
  chemically synthesized
aataattttccaattaggtatt

SEQ ID NO: 767591 - DNA, 22 bp, Artificial Sequence
  chemically synthesized
aggataaatttttaaaagcaat

SEQ ID NO: 767592 - DNA, 22 bp, Artificial Sequence
  chemically synthesized
tccaattaggtattgcttttaa

SEQ ID NO: 767593 - DNA, 22 bp, Artificial Sequence
  chemically synthesized
ccaattaggtattgcttttaaa

SEQ ID NO: 767594 - DNA, 22 bp, Artificial Sequence
  chemically synthesized
caattaggtattgcttttaaaa

SEQ ID NO: 767595 - DNA, 22 bp, Artificial Sequence
  chemically synthesized
actaaggataaatttttaaaag

SEQ ID NO: 767596 - DNA, 22 bp, Artificial Sequence
  chemically synthesized
ggtattgcttttaaaaatttat

SEQ ID NO: 767597 - DNA, 22 bp, Artificial Sequence
  chemically synthesized
agttgactaaggataaattttt

SEQ ID NO: 767598 - DNA, 22 bp, Artificial Sequence
  chemically synthesized
tgagttgactaaggataaattt

SEQ ID NO: 767599 - DNA, 22 bp, Artificial Sequence
  chemically synthesized
gttctgagttgactaaggataa

SEQ ID NO: 767600 - DNA, 22 bp, Artificial Sequence
  chemically synthesized
cttttaaaaatttatccttagt

SEQ ID NO: 767601 - DNA, 22 bp, Artificial Sequence
  chemically synthesized
ttaaaaatttatccttagtcaa

SEQ ID NO: 767602 - DNA, 22 bp, Artificial Sequence
  chemically synthesized
taaaaatttatccttagtcaac

SEQ ID NO: 767603 - DNA, 22 bp, Artificial Sequence
  chemically synthesized
aaaaatttatccttagtcaact

SEQ ID NO: 767604 - DNA, 22 bp, Artificial Sequence
  chemically synthesized
aaaatttatccttagtcaactc

SEQ ID NO: 767605 - DNA, 22 bp, Artificial Sequence
  chemically synthesized
atccttagtcaactcagaacta

SEQ ID NO: 767606 - DNA, 22 bp, Artificial Sequence
  chemically synthesized
tccttagtcaactcagaactaa

SEQ ID NO: 767607 - DNA, 22 bp, Artificial Sequence
  chemically synthesized
agaaacatcaatgatattagtt

SEQ ID NO: 767608 - DNA, 22 bp, Artificial Sequence
  chemically synthesized
agtcaactcagaactaatatca

SEQ ID NO: 767609 - DNA, 22 bp, Artificial Sequence
  chemically synthesized
gtcaactcagaactaatatcat

SEQ ID NO: 767610 - DNA, 22 bp, Artificial Sequence
  chemically synthesized
gaaccattcagaaacatcaatg

SEQ ID NO: 767611 - DNA, 22 bp, Artificial Sequence
  chemically synthesized
agaactaatatcattgatgttt

SEQ ID NO: 767612 - DNA, 22 bp, Artificial Sequence
  chemically synthesized
agaaccattcagaaacatcaat

SEQ ID NO: 767613 - DNA, 22 bp, Artificial Sequence
  chemically synthesized
atttagaaccattcagaaacat

SEQ ID NO: 767614 - DNA, 22 bp, Artificial Sequence
  chemically synthesized
atatcattgatgtttctgaatg

SEQ ID NO: 767615 - DNA, 22 bp, Artificial Sequence
  chemically synthesized
tgttcatttagaaccattcaga

SEQ ID NO: 767616 - DNA, 22 bp, Artificial Sequence
  chemically synthesized
atgtttctgaatggttctaaat

SEQ ID NO: 767617 - DNA, 22 bp, Artificial Sequence
  chemically synthesized
ctgaatggttctaaatgaacac

SEQ ID NO: 767618 - DNA, 22 bp, Artificial Sequence
  chemically synthesized
tgaatggttctaaatgaacaca

SEQ ID NO: 767619 - DNA, 22 bp, Artificial Sequence
  chemically synthesized
aatggttctaaatgaacacaat

SEQ ID NO: 767620 - DNA, 22 bp, Artificial Sequence
  chemically synthesized
aagaataggagtgtattgtgtt

SEQ ID NO: 767621 - DNA, 22 bp, Artificial Sequence
  chemically synthesized
gaagaataggagtgtattgtgt

SEQ ID NO: 767622 - DNA, 22 bp, Artificial Sequence
  chemically synthesized
tttgaagaataggagtgtattg

SEQ ID NO: 767623 - DNA, 22 bp, Artificial Sequence
  chemically synthesized
taaatgaacacaatacactcct

SEQ ID NO: 767624 - DNA, 22 bp, Artificial Sequence
  chemically synthesized
aatgaacacaatacactcctat

SEQ ID NO: 767625 - DNA, 22 bp, Artificial Sequence
  chemically synthesized
cctatttgaagaataggagtgt

SEQ ID NO: 767626 - DNA, 22 bp, Artificial Sequence
  chemically synthesized
ctattcttcaaataggtaactc

SEQ ID NO: 767627 - DNA, 22 bp, Artificial Sequence
  chemically synthesized
gtccatgggaagagagttacct

SEQ ID NO: 767628 - DNA, 22 bp, Artificial Sequence
  chemically synthesized
ttcttcaaataggtaactctct

SEQ ID NO: 767629 - DNA, 22 bp, Artificial Sequence
  chemically synthesized
ttcaaataggtaactctcttcc

SEQ ID NO: 767630 - DNA, 22 bp, Artificial Sequence
  chemically synthesized
caaataggtaactctcttccca

SEQ ID NO: 767631 - DNA, 22 bp, Artificial Sequence
  chemically synthesized
aaataggtaactctcttcccat

SEQ ID NO: 767632 - DNA, 22 bp, Artificial Sequence
  chemically synthesized
atataaccaaatatgtattggt

SEQ ID NO: 767633 - DNA, 22 bp, Artificial Sequence
  chemically synthesized
tcttcccatggaccaatacata

SEQ ID NO: 767634 - DNA, 22 bp, Artificial Sequence
  chemically synthesized
ttcccatggaccaatacatatt

SEQ ID NO: 767635 - DNA, 22 bp, Artificial Sequence
  chemically synthesized
cccatggaccaatacatatttg

SEQ ID NO: 767636 - DNA, 22 bp, Artificial Sequence
  chemically synthesized
ccatggaccaatacatatttgg

SEQ ID NO: 767637 - DNA, 22 bp, Artificial Sequence
  chemically synthesized
cacagattaatataaccaaata

SEQ ID NO: 767638 - DNA, 22 bp, Artificial Sequence
  chemically synthesized
ggttatattaatctgtgcaatt

SEQ ID NO: 767639 - DNA, 22 bp, Artificial Sequence
  chemically synthesized
gttatattaatctgtgcaattt

SEQ ID NO: 767640 - DNA, 22 bp, Artificial Sequence
  chemically synthesized
tgtaatatagacaaattgcaca

SEQ ID NO: 767641 - DNA, 22 bp, Artificial Sequence
  chemically synthesized
tatgtaatatagacaaattgca

SEQ ID NO: 767642 - DNA, 22 bp, Artificial Sequence
  chemically synthesized
tattaatctgtgcaatttgtct

SEQ ID NO: 767643 - DNA, 22 bp, Artificial Sequence
  chemically synthesized
tctatgtaatatagacaaattg

SEQ ID NO: 767644 - DNA, 22 bp, Artificial Sequence
  chemically synthesized
actctctatgtaatatagacaa

SEQ ID NO: 767645 - DNA, 22 bp, Artificial Sequence
  chemically synthesized
atctgtgcaatttgtctatatt

SEQ ID NO: 767646 - DNA, 22 bp, Artificial Sequence
  chemically synthesized
aactctctatgtaatatagaca

SEQ ID NO: 767647 - DNA, 22 bp, Artificial Sequence
  chemically synthesized
taactctctatgtaatatagac

SEQ ID NO: 767648 - DNA, 22 bp, Artificial Sequence
  chemically synthesized
ttaactctctatgtaatataga

SEQ ID NO: 767649 - DNA, 22 bp, Artificial Sequence
  chemically synthesized
tgcaatttgtctatattacata

SEQ ID NO: 767650 - DNA, 22 bp, Artificial Sequence
  chemically synthesized
gagcttttaactctctatgtaa

SEQ ID NO: 767651 - DNA, 22 bp, Artificial Sequence
  chemically synthesized
cgagcttttaactctctatgta

SEQ ID NO: 767652 - DNA, 22 bp, Artificial Sequence
  chemically synthesized
tcgagcttttaactctctatgt

SEQ ID NO: 767653 - DNA, 22 bp, Artificial Sequence
  chemically synthesized
ttcgagcttttaactctctatg

SEQ ID NO: 767654 - DNA, 22 bp, Artificial Sequence
  chemically synthesized
gtctatattacatagagagtta

SEQ ID NO: 767655 - DNA, 22 bp, Artificial Sequence
  chemically synthesized
tctatattacatagagagttaa

SEQ ID NO: 767656 - DNA, 22 bp, Artificial Sequence
  chemically synthesized
tattacatagagagttaaaagc

SEQ ID NO: 767657 - DNA, 22 bp, Artificial Sequence
  chemically synthesized
catagagagttaaaagctcgaa

SEQ ID NO: 767658 - DNA, 22 bp, Artificial Sequence
  chemically synthesized
cagaaataagagcttttcgagc

SEQ ID NO: 767659 - DNA, 22 bp, Artificial Sequence
  chemically synthesized
aaagctcgaaaagctcttattt

SEQ ID NO: 767660 - DNA, 22 bp, Artificial Sequence
  chemically synthesized
gtgacaaagagattccagaaat

SEQ ID NO: 767661 - DNA, 22 bp, Artificial Sequence
  chemically synthesized
gaaaagctcttatttctggaat

SEQ ID NO: 767662 - DNA, 22 bp, Artificial Sequence
  chemically synthesized
agtgacaaagagattccagaaa

SEQ ID NO: 767663 - DNA, 22 bp, Artificial Sequence
  chemically synthesized
ttatttctggaatctctttgtc

SEQ ID NO: 767664 - DNA, 22 bp, Artificial Sequence
  chemically synthesized
atttctggaatctctttgtcac

SEQ ID NO: 767665 - DNA, 22 bp, Artificial Sequence
  chemically synthesized
tttctggaatctctttgtcact

SEQ ID NO: 767666 - DNA, 22 bp, Artificial Sequence
  chemically synthesized
ctggaatctctttgtcactaag

SEQ ID NO: 767667 - DNA, 22 bp, Artificial Sequence
  chemically synthesized
tggaatctctttgtcactaagc

SEQ ID NO: 767668 - DNA, 22 bp, Artificial Sequence
  chemically synthesized
gaatctctttgtcactaagcta

SEQ ID NO: 767669 - DNA, 22 bp, Artificial Sequence
  chemically synthesized
gaggacaaaaaatagcttagtg

SEQ ID NO: 767670 - DNA, 22 bp, Artificial Sequence
  chemically synthesized
tggaggacaaaaaatagcttag

SEQ ID NO: 767671 - DNA, 22 bp, Artificial Sequence
  chemically synthesized
tctggaggacaaaaaatagctt

SEQ ID NO: 767672 - DNA, 22 bp, Artificial Sequence
  chemically synthesized
tttgtcactaagctattttttg

SEQ ID NO: 767673 - DNA, 22 bp, Artificial Sequence
  chemically synthesized
tgtcactaagctattttttgtc

SEQ ID NO: 767674 - DNA, 22 bp, Artificial Sequence
  chemically synthesized
gtcactaagctattttttgtcc

SEQ ID NO: 767675 - DNA, 22 bp, Artificial Sequence
  chemically synthesized
tcactaagctattttttgtcct

SEQ ID NO: 767676 - DNA, 22 bp, Artificial Sequence
  chemically synthesized
agctattttttgtcctccagag

SEQ ID NO: 767677 - DNA, 22 bp, Artificial Sequence
  chemically synthesized
aaccacagtgattctctggagg

SEQ ID NO: 767678 - DNA, 22 bp, Artificial Sequence
  chemically synthesized
gaaccacagtgattctctggag

SEQ ID NO: 767679 - DNA, 22 bp, Artificial Sequence
  chemically synthesized
ttttttgtcctccagagaatca

SEQ ID NO: 767680 - DNA, 22 bp, Artificial Sequence
  chemically synthesized
tttgtcctccagagaatcactg

SEQ ID NO: 767681 - DNA, 22 bp, Artificial Sequence
  chemically synthesized
ttgtcctccagagaatcactgt

SEQ ID NO: 767682 - DNA, 22 bp, Artificial Sequence
  chemically synthesized
tgtcctccagagaatcactgtg

SEQ ID NO: 767683 - DNA, 22 bp, Artificial Sequence
  chemically synthesized
gtcctccagagaatcactgtgg

SEQ ID NO: 767684 - DNA, 22 bp, Artificial Sequence
  chemically synthesized
tcctccagagaatcactgtggt

SEQ ID NO: 767685 - DNA, 22 bp, Artificial Sequence
  chemically synthesized
atatacaaccttgaaccacagt

SEQ ID NO: 767686 - DNA, 22 bp, Artificial Sequence
  chemically synthesized
taatatacaaccttgaaccaca

SEQ ID NO: 767687 - DNA, 22 bp, Artificial Sequence
  chemically synthesized
cagagaatcactgtggttcaag

SEQ ID NO: 767688 - DNA, 22 bp, Artificial Sequence
  chemically synthesized
ctaatatacaaccttgaaccac

SEQ ID NO: 767689 - DNA, 22 bp, Artificial Sequence
  chemically synthesized
tctaatatacaaccttgaacca

SEQ ID NO: 767690 - DNA, 22 bp, Artificial Sequence
  chemically synthesized
ttctaatatacaaccttgaacc

SEQ ID NO: 767691 - DNA, 22 bp, Artificial Sequence
  chemically synthesized
tttctaatatacaaccttgaac

SEQ ID NO: 767692 - DNA, 22 bp, Artificial Sequence
  chemically synthesized
ttttctaatatacaaccttgaa

SEQ ID NO: 767693 - DNA, 22 bp, Artificial Sequence
  chemically synthesized
cttttttctaatatacaacctt

SEQ ID NO: 767694 - DNA, 22 bp, Artificial Sequence
  chemically synthesized
attgcttttttctaatatacaa

SEQ ID NO: 767695 - DNA, 22 bp, Artificial Sequence
  chemically synthesized
tggttcaaggttgtatattaga

SEQ ID NO: 767696 - DNA, 22 bp, Artificial Sequence
  chemically synthesized
aaggttgtatattagaaaaaag

SEQ ID NO: 767697 - DNA, 22 bp, Artificial Sequence
  chemically synthesized
acatcaactaattgcttttttc

SEQ ID NO: 767698 - DNA, 22 bp, Artificial Sequence
  chemically synthesized
gacatcaactaattgctttttt

SEQ ID NO: 767699 - DNA, 22 bp, Artificial Sequence
  chemically synthesized
tatattagaaaaaagcaattag

SEQ ID NO: 767700 - DNA, 22 bp, Artificial Sequence
  chemically synthesized
gaaaaaagcaattagttgatgt

SEQ ID NO: 767701 - DNA, 22 bp, Artificial Sequence
  chemically synthesized
ggaaaagatgagacttgacatc

SEQ ID NO: 767702 - DNA, 22 bp, Artificial Sequence
  chemically synthesized
ttgggaaaagatgagacttgac

SEQ ID NO: 767703 - DNA, 22 bp, Artificial Sequence
  chemically synthesized
gttgatgtcaagtctcatcttt

SEQ ID NO: 767704 - DNA, 22 bp, Artificial Sequence
  chemically synthesized
atgtcaagtctcatcttttccc

SEQ ID NO: 767705 - DNA, 22 bp, Artificial Sequence
  chemically synthesized
gatatgtgttattgggaaaaga

SEQ ID NO: 767706 - DNA, 22 bp, Artificial Sequence
  chemically synthesized
agatatgtgttattgggaaaag

SEQ ID NO: 767707 - DNA, 22 bp, Artificial Sequence
  chemically synthesized
ttagatatgtgttattgggaaa

SEQ ID NO: 767708 - DNA, 22 bp, Artificial Sequence
  chemically synthesized
cttagatatgtgttattgggaa

SEQ ID NO: 767709 - DNA, 22 bp, Artificial Sequence
  chemically synthesized
ttcttagatatgtgttattggg

SEQ ID NO: 767710 - DNA, 22 bp, Artificial Sequence
  chemically synthesized
cttcttagatatgtgttattgg

SEQ ID NO: 767711 - DNA, 22 bp, Artificial Sequence
  chemically synthesized
tcttcttagatatgtgttattg

SEQ ID NO: 767712 - DNA, 22 bp, Artificial Sequence
  chemically synthesized
atcttttcccaataacacatat

SEQ ID NO: 767713 - DNA, 22 bp, Artificial Sequence
  chemically synthesized
ctttcttcttagatatgtgtta

SEQ ID NO: 767714 - DNA, 22 bp, Artificial Sequence
  chemically synthesized
gctttcttcttagatatgtgtt

SEQ ID NO: 767715 - DNA, 22 bp, Artificial Sequence
  chemically synthesized
ttgctttcttcttagatatgtg

SEQ ID NO: 767716 - DNA, 22 bp, Artificial Sequence
  chemically synthesized
ttcccaataacacatatctaag

SEQ ID NO: 767717 - DNA, 22 bp, Artificial Sequence
  chemically synthesized
tcccaataacacatatctaaga

SEQ ID NO: 767718 - DNA, 22 bp, Artificial Sequence
  chemically synthesized
cccaataacacatatctaagaa

SEQ ID NO: 767719 - DNA, 22 bp, Artificial Sequence
  chemically synthesized
ccaataacacatatctaagaag

SEQ ID NO: 767720 - DNA, 22 bp, Artificial Sequence
  chemically synthesized
ccatatgttcttgctttcttct

SEQ ID NO: 767721 - DNA, 22 bp, Artificial Sequence
  chemically synthesized
gccatatgttcttgctttcttc

SEQ ID NO: 767722 - DNA, 22 bp, Artificial Sequence
  chemically synthesized
tgccatatgttcttgctttctt

SEQ ID NO: 767723 - DNA, 22 bp, Artificial Sequence
  chemically synthesized
tggcactttgccatatgttctt

SEQ ID NO: 767724 - DNA, 22 bp, Artificial Sequence
  chemically synthesized
agaagaaagcaagaacatatgg

SEQ ID NO: 767725 - DNA, 22 bp, Artificial Sequence
  chemically synthesized
gtgtatgatcaaaaataattat

SEQ ID NO: 767726 - DNA, 22 bp, Artificial Sequence
  chemically synthesized
tagtgtatgatcaaaaataatt

SEQ ID NO: 767727 - DNA, 22 bp, Artificial Sequence
  chemically synthesized
ctagtgtatgatcaaaaataat

SEQ ID NO: 767728 - DNA, 22 bp, Artificial Sequence
  chemically synthesized
tgatttctagtgtatgatcaaa

SEQ ID NO: 767729 - DNA, 22 bp, Artificial Sequence
  chemically synthesized
ttgtgatttctagtgtatgatc

SEQ ID NO: 767730 - DNA, 22 bp, Artificial Sequence
  chemically synthesized
tttttgatcatacactagaaat

SEQ ID NO: 767731 - DNA, 22 bp, Artificial Sequence
  chemically synthesized
catggctgttgtgatttctagt

SEQ ID NO: 767732 - DNA, 22 bp, Artificial Sequence
  chemically synthesized
ttgatcatacactagaaatcac

SEQ ID NO: 767733 - DNA, 22 bp, Artificial Sequence
  chemically synthesized
tgatcatacactagaaatcaca

SEQ ID NO: 767734 - DNA, 22 bp, Artificial Sequence
  chemically synthesized
gatcatacactagaaatcacaa

SEQ ID NO: 767735 - DNA, 22 bp, Artificial Sequence
  chemically synthesized
cctacatggctgttgtgatttc

SEQ ID NO: 767736 - DNA, 22 bp, Artificial Sequence
  chemically synthesized
atcatacactagaaatcacaac

SEQ ID NO: 767737 - DNA, 22 bp, Artificial Sequence
  chemically synthesized
gaaatcacaacagccatgtagg

SEQ ID NO: 767738 - DNA, 22 bp, Artificial Sequence
  chemically synthesized
aaacaagccagagggaattacc

SEQ ID NO: 767739 - DNA, 22 bp, Artificial Sequence
  chemically synthesized
ataattaaaacaagccagaggg

SEQ ID NO: 767740 - DNA, 22 bp, Artificial Sequence
  chemically synthesized
caaccctaataattaaaacaag

SEQ ID NO: 767741 - DNA, 22 bp, Artificial Sequence
  chemically synthesized
acaaccctaataattaaaacaa

SEQ ID NO: 767742 - DNA, 22 bp, Artificial Sequence
  chemically synthesized
cctctggcttgttttaattatt

SEQ ID NO: 767743 - DNA, 22 bp, Artificial Sequence
  chemically synthesized
catttacaaccctaataattaa

SEQ ID NO: 767744 - DNA, 22 bp, Artificial Sequence
  chemically synthesized
gcatttacaaccctaataatta

SEQ ID NO: 767745 - DNA, 22 bp, Artificial Sequence
  chemically synthesized
tggcttgttttaattattaggg

SEQ ID NO: 767746 - DNA, 22 bp, Artificial Sequence
  chemically synthesized
tttgcatttacaaccctaataa

SEQ ID NO: 767747 - DNA, 22 bp, Artificial Sequence
  chemically synthesized
gcttgttttaattattagggtt

SEQ ID NO: 767748 - DNA, 22 bp, Artificial Sequence
  chemically synthesized
ttgtttgcatttacaaccctaa

SEQ ID NO: 767749 - DNA, 22 bp, Artificial Sequence
  chemically synthesized
gttttaattattagggttgtaa

SEQ ID NO: 767750 - DNA, 22 bp, Artificial Sequence
  chemically synthesized
ttttaattattagggttgtaaa

SEQ ID NO: 767751 - DNA, 22 bp, Artificial Sequence
  chemically synthesized
taattattagggttgtaaatgc

SEQ ID NO: 767752 - DNA, 22 bp, Artificial Sequence
  chemically synthesized
aattattagggttgtaaatgca

SEQ ID NO: 767753 - DNA, 22 bp, Artificial Sequence
  chemically synthesized
attattagggttgtaaatgcaa

SEQ ID NO: 767754 - DNA, 22 bp, Artificial Sequence
  chemically synthesized
ttagggttgtaaatgcaaacaa

SEQ ID NO: 767755 - DNA, 22 bp, Artificial Sequence
  chemically synthesized
gggttgtaaatgcaaacaacaa

SEQ ID NO: 767756 - DNA, 22 bp, Artificial Sequence
  chemically synthesized
taaatgcaaacaacaacttcat

SEQ ID NO: 767757 - DNA, 22 bp, Artificial Sequence
  chemically synthesized
gggggtaaagtgggggatagaa

SEQ ID NO: 767758 - DNA, 22 bp, Artificial Sequence
  chemically synthesized
agggggtaaagtgggggataga

SEQ ID NO: 767759 - DNA, 22 bp, Artificial Sequence
  chemically synthesized
tagggggtaaagtgggggatag

SEQ ID NO: 767760 - DNA, 22 bp, Artificial Sequence
  chemically synthesized
ttagggggtaaagtgggggata

SEQ ID NO: 767761 - DNA, 22 bp, Artificial Sequence
  chemically synthesized
aggtttttagggggtaaagtgg

SEQ ID NO: 767762 - DNA, 22 bp, Artificial Sequence
  chemically synthesized
cattctatcccccactttaccc

SEQ ID NO: 767763 - DNA, 22 bp, Artificial Sequence
  chemically synthesized
gaggtttttagggggtaaagtg

SEQ ID NO: 767764 - DNA, 22 bp, Artificial Sequence
  chemically synthesized
attctatcccccactttacccc

SEQ ID NO: 767765 - DNA, 22 bp, Artificial Sequence
  chemically synthesized
tgaggtttttagggggtaaagt

SEQ ID NO: 767766 - DNA, 22 bp, Artificial Sequence
  chemically synthesized
tatcccccactttaccccctaa

SEQ ID NO: 767767 - DNA, 22 bp, Artificial Sequence
  chemically synthesized
tcccccactttaccccctaaaa

SEQ ID NO: 767768 - DNA, 22 bp, Artificial Sequence
  chemically synthesized
cgtgggagtattttgaggtttt

SEQ ID NO: 767769 - DNA, 22 bp, Artificial Sequence
  chemically synthesized
taccccctaaaaacctcaaaat

SEQ ID NO: 767770 - DNA, 22 bp, Artificial Sequence
  chemically synthesized
accccctaaaaacctcaaaata

SEQ ID NO: 767771 - DNA, 22 bp, Artificial Sequence
  chemically synthesized
ccccctaaaaacctcaaaatac

SEQ ID NO: 767772 - DNA, 22 bp, Artificial Sequence
  chemically synthesized
tggttgcgtgggagtattttga

SEQ ID NO: 767773 - DNA, 22 bp, Artificial Sequence
  chemically synthesized
gtggttgcgtgggagtattttg

SEQ ID NO: 767774 - DNA, 22 bp, Artificial Sequence
  chemically synthesized
tgtggttgcgtgggagtatttt

SEQ ID NO: 767775 - DNA, 22 bp, Artificial Sequence
  chemically synthesized
ttttgtggttgcgtgggagtat

SEQ ID NO: 767776 - DNA, 22 bp, Artificial Sequence
  chemically synthesized
aaaacctcaaaatactcccacg

SEQ ID NO: 767777 - DNA, 22 bp, Artificial Sequence
  chemically synthesized
aaaatactcccacgcaaccaca

SEQ ID NO: 767778 - DNA, 22 bp, Artificial Sequence
  chemically synthesized
catcagtgtagggttgttttgt

SEQ ID NO: 767779 - DNA, 22 bp, Artificial Sequence
  chemically synthesized
ccacgcaaccacaaaacaaccc

SEQ ID NO: 767780 - DNA, 22 bp, Artificial Sequence
  chemically synthesized
taaacaattacatcagtgtagg

SEQ ID NO: 767781 - DNA, 22 bp, Artificial Sequence
  chemically synthesized
ttgtaaacaattacatcagtgt

SEQ ID NO: 767782 - DNA, 22 bp, Artificial Sequence
  chemically synthesized
acctattgtaaacaattacatc

SEQ ID NO: 767783 - DNA, 22 bp, Artificial Sequence
  chemically synthesized
tcattaacctattgtaaacaat

SEQ ID NO: 767784 - DNA, 22 bp, Artificial Sequence
  chemically synthesized
cactgatgtaattgtttacaat

SEQ ID NO: 767785 - DNA, 22 bp, Artificial Sequence
  chemically synthesized
ctatcattaacctattgtaaac

SEQ ID NO: 767786 - DNA, 22 bp, Artificial Sequence
  chemically synthesized
cctatcattaacctattgtaaa

SEQ ID NO: 767787 - DNA, 22 bp, Artificial Sequence
  chemically synthesized
tcctatcattaacctattgtaa

SEQ ID NO: 767788 - DNA, 22 bp, Artificial Sequence
  chemically synthesized
atgtaattgtttacaataggtt

SEQ ID NO: 767789 - DNA, 22 bp, Artificial Sequence
  chemically synthesized
gattttcctatcattaacctat

SEQ ID NO: 767790 - DNA, 22 bp, Artificial Sequence
  chemically synthesized
agattttcctatcattaaccta

SEQ ID NO: 767791 - DNA, 22 bp, Artificial Sequence
  chemically synthesized
tttacaataggttaatgatagg

SEQ ID NO: 767792 - DNA, 22 bp, Artificial Sequence
  chemically synthesized
acaataggttaatgataggaaa

SEQ ID NO: 767793 - DNA, 22 bp, Artificial Sequence
  chemically synthesized
caataggttaatgataggaaaa

SEQ ID NO: 767794 - DNA, 22 bp, Artificial Sequence
  chemically synthesized
atgataggaaaatctaagacat

SEQ ID NO: 767795 - DNA, 22 bp, Artificial Sequence
  chemically synthesized
aaatgaaaaaaatagaaatgtc

SEQ ID NO: 767796 - DNA, 22 bp, Artificial Sequence
  chemically synthesized
aaaatgaaaaaaatagaaatgt

SEQ ID NO: 767797 - DNA, 22 bp, Artificial Sequence
  chemically synthesized
tttaaaatgaaaaaaatagaaa

SEQ ID NO: 767798 - DNA, 22 bp, Artificial Sequence
  chemically synthesized
ctatttaaaatgaaaaaaatag

SEQ ID NO: 767799 - DNA, 22 bp, Artificial Sequence
  chemically synthesized
agacatttctatttttttcatt

SEQ ID NO: 767800 - DNA, 22 bp, Artificial Sequence
  chemically synthesized
tcctgctatttaaaatgaaaaa

SEQ ID NO: 767801 - DNA, 22 bp, Artificial Sequence
  chemically synthesized
ctatttttttcattttaaatag

SEQ ID NO: 767802 - DNA, 22 bp, Artificial Sequence
  chemically synthesized
gaaattgtcctgctatttaaaa

SEQ ID NO: 767803 - DNA, 22 bp, Artificial Sequence
  chemically synthesized
tatttttttcattttaaatagc

SEQ ID NO: 767804 - DNA, 22 bp, Artificial Sequence
  chemically synthesized
ggaaattgtcctgctatttaaa

SEQ ID NO: 767805 - DNA, 22 bp, Artificial Sequence
  chemically synthesized
tggaaattgtcctgctatttaa

SEQ ID NO: 767806 - DNA, 22 bp, Artificial Sequence
  chemically synthesized
tttttttcattttaaatagcag

SEQ ID NO: 767807 - DNA, 22 bp, Artificial Sequence
  chemically synthesized
ttttggaaattgtcctgctatt

SEQ ID NO: 767808 - DNA, 22 bp, Artificial Sequence
  chemically synthesized
ttttcattttaaatagcaggac

SEQ ID NO: 767809 - DNA, 22 bp, Artificial Sequence
  chemically synthesized
tttcattttaaatagcaggaca

SEQ ID NO: 767810 - DNA, 22 bp, Artificial Sequence
  chemically synthesized
ttcattttaaatagcaggacaa

SEQ ID NO: 767811 - DNA, 22 bp, Artificial Sequence
  chemically synthesized
tcattttaaatagcaggacaat

SEQ ID NO: 767812 - DNA, 22 bp, Artificial Sequence
  chemically synthesized
cattttaaatagcaggacaatt

SEQ ID NO: 767813 - DNA, 22 bp, Artificial Sequence
  chemically synthesized
attttaaatagcaggacaattt

SEQ ID NO: 767814 - DNA, 22 bp, Artificial Sequence
  chemically synthesized
tgattattttggaaattgtcct

SEQ ID NO: 767815 - DNA, 22 bp, Artificial Sequence
  chemically synthesized
taaatagcaggacaatttccaa

SEQ ID NO: 767816 - DNA, 22 bp, Artificial Sequence
  chemically synthesized
aaatagcaggacaatttccaaa

SEQ ID NO: 767817 - DNA, 22 bp, Artificial Sequence
  chemically synthesized
aatagcaggacaatttccaaaa

SEQ ID NO: 767818 - DNA, 22 bp, Artificial Sequence
  chemically synthesized
atgagtgtctgtgattattttg

SEQ ID NO: 767819 - DNA, 22 bp, Artificial Sequence
  chemically synthesized
tgtctgatgagtgtctgtgatt

SEQ ID NO: 767820 - DNA, 22 bp, Artificial Sequence
  chemically synthesized
ccaaaataatcacagacactca

SEQ ID NO: 767821 - DNA, 22 bp, Artificial Sequence
  chemically synthesized
caaaataatcacagacactcat

SEQ ID NO: 767822 - DNA, 22 bp, Artificial Sequence
  chemically synthesized
atcagacacaactgtattcatt

SEQ ID NO: 767823 - DNA, 22 bp, Artificial Sequence
  chemically synthesized
aagagtacccacaaatgaatac

SEQ ID NO: 767824 - DNA, 22 bp, Artificial Sequence
  chemically synthesized
tgggctaaagagtacccacaaa

SEQ ID NO: 767825 - DNA, 22 bp, Artificial Sequence
  chemically synthesized
tgctgtgggctaaagagtaccc

SEQ ID NO: 767826 - DNA, 22 bp, Artificial Sequence
  chemically synthesized
tattcatttgtgggtactcttt

SEQ ID NO: 767827 - DNA, 22 bp, Artificial Sequence
  chemically synthesized
tatgctgtgggctaaagagtac

SEQ ID NO: 767828 - DNA, 22 bp, Artificial Sequence
  chemically synthesized
atttgtgggtactctttagccc

SEQ ID NO: 767829 - DNA, 22 bp, Artificial Sequence
  chemically synthesized
atatctctatgctgtgggctaa

SEQ ID NO: 767830 - DNA, 22 bp, Artificial Sequence
  chemically synthesized
gtgggtactctttagcccacag

SEQ ID NO: 767831 - DNA, 22 bp, Artificial Sequence
  chemically synthesized
tgggtactctttagcccacagc

SEQ ID NO: 767832 - DNA, 22 bp, Artificial Sequence
  chemically synthesized
aggttaatatctctatgctgtg

SEQ ID NO: 767833 - DNA, 22 bp, Artificial Sequence
  chemically synthesized
aaggttaatatctctatgctgt

SEQ ID NO: 767834 - DNA, 22 bp, Artificial Sequence
  chemically synthesized
taaggttaatatctctatgctg

SEQ ID NO: 767835 - DNA, 22 bp, Artificial Sequence
  chemically synthesized
tttagcccacagcatagagata

SEQ ID NO: 767836 - DNA, 22 bp, Artificial Sequence
  chemically synthesized
tagcccacagcatagagatatt

SEQ ID NO: 767837 - DNA, 22 bp, Artificial Sequence
  chemically synthesized
agcccacagcatagagatatta

SEQ ID NO: 767838 - DNA, 22 bp, Artificial Sequence
  chemically synthesized
gcccacagcatagagatattaa

SEQ ID NO: 767839 - DNA, 22 bp, Artificial Sequence
  chemically synthesized
gaaatagttttaaggttaatat

SEQ ID NO: 767840 - DNA, 22 bp, Artificial Sequence
  chemically synthesized
tgaatacctagaaatagtttta

SEQ ID NO: 767841 - DNA, 22 bp, Artificial Sequence
  chemically synthesized
atgaatacctagaaatagtttt

SEQ ID NO: 767842 - DNA, 22 bp, Artificial Sequence
  chemically synthesized
accttaaaactatttctaggta

SEQ ID NO: 767843 - DNA, 22 bp, Artificial Sequence
  chemically synthesized
aaaacttatgaatacctagaaa

SEQ ID NO: 767844 - DNA, 22 bp, Artificial Sequence
  chemically synthesized
aaaactatttctaggtattcat

SEQ ID NO: 767845 - DNA, 22 bp, Artificial Sequence
  chemically synthesized
aaactatttctaggtattcata

SEQ ID NO: 767846 - DNA, 22 bp, Artificial Sequence
  chemically synthesized
acattcaaaacttatgaatacc

SEQ ID NO: 767847 - DNA, 22 bp, Artificial Sequence
  chemically synthesized
aacattcaaaacttatgaatac

SEQ ID NO: 767848 - DNA, 22 bp, Artificial Sequence
  chemically synthesized
taacattcaaaacttatgaata

SEQ ID NO: 767849 - DNA, 22 bp, Artificial Sequence
  chemically synthesized
tttaacattcaaaacttatgaa

SEQ ID NO: 767850 - DNA, 22 bp, Artificial Sequence
  chemically synthesized
ctttaacattcaaaacttatga

SEQ ID NO: 767851 - DNA, 22 bp, Artificial Sequence
  chemically synthesized
tttctaggtattcataagtttt

SEQ ID NO: 767852 - DNA, 22 bp, Artificial Sequence
  chemically synthesized
ctaggtattcataagttttgaa

SEQ ID NO: 767853 - DNA, 22 bp, Artificial Sequence
  chemically synthesized
taggtattcataagttttgaat

SEQ ID NO: 767854 - DNA, 22 bp, Artificial Sequence
  chemically synthesized
ggtattcataagttttgaatgt

SEQ ID NO: 767855 - DNA, 22 bp, Artificial Sequence
  chemically synthesized
gaaccttctttaacattcaaaa

SEQ ID NO: 767856 - DNA, 22 bp, Artificial Sequence
  chemically synthesized
ataagttttgaatgttaaagaa

SEQ ID NO: 767857 - DNA, 22 bp, Artificial Sequence
  chemically synthesized
catcatggtactagaaccttct

SEQ ID NO: 767858 - DNA, 22 bp, Artificial Sequence
  chemically synthesized
acatcatggtactagaaccttc

SEQ ID NO: 767859 - DNA, 22 bp, Artificial Sequence
  chemically synthesized
tgaatgttaaagaaggttctag

SEQ ID NO: 767860 - DNA, 22 bp, Artificial Sequence
  chemically synthesized
gaatgttaaagaaggttctagt

SEQ ID NO: 767861 - DNA, 22 bp, Artificial Sequence
  chemically synthesized
aatgttaaagaaggttctagta

SEQ ID NO: 767862 - DNA, 22 bp, Artificial Sequence
  chemically synthesized
gtttacatcatggtactagaac

SEQ ID NO: 767863 - DNA, 22 bp, Artificial Sequence
  chemically synthesized
agtttacatcatggtactagaa

SEQ ID NO: 767864 - DNA, 22 bp, Artificial Sequence
  chemically synthesized
tagtttacatcatggtactaga

SEQ ID NO: 767865 - DNA, 22 bp, Artificial Sequence
  chemically synthesized
aagaaggttctagtaccatgat

SEQ ID NO: 767866 - DNA, 22 bp, Artificial Sequence
  chemically synthesized
tagtaccatgatgtaaactaaa

SEQ ID NO: 767867 - DNA, 22 bp, Artificial Sequence
  chemically synthesized
tatcagcaggactttagtttac

SEQ ID NO: 767868 - DNA, 22 bp, Artificial Sequence
  chemically synthesized
gtaccatgatgtaaactaaagt

SEQ ID NO: 767869 - DNA, 22 bp, Artificial Sequence
  chemically synthesized
aagtcctgctgatataattgga

SEQ ID NO: 767870 - DNA, 22 bp, Artificial Sequence
  chemically synthesized
ctgatataattggatctgattc

SEQ ID NO: 767871 - DNA, 22 bp, Artificial Sequence
  chemically synthesized
aagatcaccagagaatcagatc

SEQ ID NO: 767872 - DNA, 22 bp, Artificial Sequence
  chemically synthesized
atataattggatctgattctct

SEQ ID NO: 767873 - DNA, 22 bp, Artificial Sequence
  chemically synthesized
actgaagatcaccagagaatca

SEQ ID NO: 767874 - DNA, 22 bp, Artificial Sequence
  chemically synthesized
actcactgaagatcaccagaga

SEQ ID NO: 767875 - DNA, 22 bp, Artificial Sequence
  chemically synthesized
gatctgattctctggtgatctt

SEQ ID NO: 767876 - DNA, 22 bp, Artificial Sequence
  chemically synthesized
attctctggtgatcttcagtga

SEQ ID NO: 767877 - DNA, 22 bp, Artificial Sequence
  chemically synthesized
tctggtgatcttcagtgagtta

SEQ ID NO: 767878 - DNA, 22 bp, Artificial Sequence
  chemically synthesized
tggtgatcttcagtgagttaat

SEQ ID NO: 767879 - DNA, 22 bp, Artificial Sequence
  chemically synthesized
gtagtagacagaaattaactca

SEQ ID NO: 767880 - DNA, 22 bp, Artificial Sequence
  chemically synthesized
gtgatcttcagtgagttaattt

SEQ ID NO: 767881 - DNA, 22 bp, Artificial Sequence
  chemically synthesized
ggtagtagacagaaattaactc

SEQ ID NO: 767882 - DNA, 22 bp, Artificial Sequence
  chemically synthesized
cttggtagtagacagaaattaa

SEQ ID NO: 767883 - DNA, 22 bp, Artificial Sequence
  chemically synthesized
tacttggtagtagacagaaatt

SEQ ID NO: 767884 - DNA, 22 bp, Artificial Sequence
  chemically synthesized
cagtgagttaatttctgtctac

SEQ ID NO: 767885 - DNA, 22 bp, Artificial Sequence
  chemically synthesized
ctctacttggtagtagacagaa

SEQ ID NO: 767886 - DNA, 22 bp, Artificial Sequence
  chemically synthesized
agtgagttaatttctgtctact

SEQ ID NO: 767887 - DNA, 22 bp, Artificial Sequence
  chemically synthesized
gctctacttggtagtagacaga

SEQ ID NO: 767888 - DNA, 22 bp, Artificial Sequence
  chemically synthesized
atttctgtctactaccaagtag

SEQ ID NO: 767889 - DNA, 22 bp, Artificial Sequence
  chemically synthesized
ctgtctactaccaagtagagca

SEQ ID NO: 767890 - DNA, 22 bp, Artificial Sequence
  chemically synthesized
tgtctactaccaagtagagcaa

SEQ ID NO: 767891 - DNA, 22 bp, Artificial Sequence
  chemically synthesized
cagaagaaagaatttgctctac

SEQ ID NO: 767892 - DNA, 22 bp, Artificial Sequence
  chemically synthesized
tctactaccaagtagagcaaat

SEQ ID NO: 767893 - DNA, 22 bp, Artificial Sequence
  chemically synthesized
tccagaagaaagaatttgctct

SEQ ID NO: 767894 - DNA, 22 bp, Artificial Sequence
  chemically synthesized
ctaccaagtagagcaaattctt

SEQ ID NO: 767895 - DNA, 22 bp, Artificial Sequence
  chemically synthesized
ccaagtagagcaaattctttct

SEQ ID NO: 767896 - DNA, 22 bp, Artificial Sequence
  chemically synthesized
tttcttctggagagtgtgactt

SEQ ID NO: 767897 - DNA, 22 bp, Artificial Sequence
  chemically synthesized
ggcacacacacaaaagtcacac

SEQ ID NO: 767898 - DNA, 22 bp, Artificial Sequence
  chemically synthesized
tcttctggagagtgtgactttt

SEQ ID NO: 767899 - DNA, 22 bp, Artificial Sequence
  chemically synthesized
cttctggagagtgtgacttttg

SEQ ID NO: 767900 - DNA, 22 bp, Artificial Sequence
  chemically synthesized
ttctggagagtgtgacttttgt

SEQ ID NO: 767901 - DNA, 22 bp, Artificial Sequence
  chemically synthesized
tctaggcacacacacaaaagtc

SEQ ID NO: 767902 - DNA, 22 bp, Artificial Sequence
  chemically synthesized
ctggagagtgtgacttttgtgt

SEQ ID NO: 767903 - DNA, 22 bp, Artificial Sequence
  chemically synthesized
tggagagtgtgacttttgtgtg

SEQ ID NO: 767904 - DNA, 22 bp, Artificial Sequence
  chemically synthesized
gagagtgtgacttttgtgtgtg

SEQ ID NO: 767905 - DNA, 22 bp, Artificial Sequence
  chemically synthesized
ttgtgtgtgtgcctagatagtt

SEQ ID NO: 767906 - DNA, 22 bp, Artificial Sequence
  chemically synthesized
tgtgtgtgtgcctagatagttc

SEQ ID NO: 767907 - DNA, 22 bp, Artificial Sequence
  chemically synthesized
gtgtgtgtgcctagatagttct

SEQ ID NO: 767908 - DNA, 22 bp, Artificial Sequence
  chemically synthesized
tgtgtgtgcctagatagttctt

SEQ ID NO: 767909 - DNA, 22 bp, Artificial Sequence
  chemically synthesized
gatagttctttcatcctatttt

SEQ ID NO: 767910 - DNA, 22 bp, Artificial Sequence
  chemically synthesized
tataagagaagaaaagcaaaat

SEQ ID NO: 767911 - DNA, 22 bp, Artificial Sequence
  chemically synthesized
tttcatcctattttgcttttct

SEQ ID NO: 767912 - DNA, 22 bp, Artificial Sequence
  chemically synthesized
ttgtataagagaagaaaagcaa

SEQ ID NO: 767913 - DNA, 22 bp, Artificial Sequence
  chemically synthesized
tcatcctattttgcttttcttc

SEQ ID NO: 767914 - DNA, 22 bp, Artificial Sequence
  chemically synthesized
catcctattttgcttttcttct

SEQ ID NO: 767915 - DNA, 22 bp, Artificial Sequence
  chemically synthesized
atcctattttgcttttcttctc

SEQ ID NO: 767916 - DNA, 22 bp, Artificial Sequence
  chemically synthesized
accctattgtataagagaagaa

SEQ ID NO: 767917 - DNA, 22 bp, Artificial Sequence
  chemically synthesized
ttcaccctattgtataagagaa

SEQ ID NO: 767918 - DNA, 22 bp, Artificial Sequence
  chemically synthesized
ttttgcttttcttctcttatac

SEQ ID NO: 767919 - DNA, 22 bp, Artificial Sequence
  chemically synthesized
tgcttttcttctcttatacaat

SEQ ID NO: 767920 - DNA, 22 bp, Artificial Sequence
  chemically synthesized
gcttttcttctcttatacaata

SEQ ID NO: 767921 - DNA, 22 bp, Artificial Sequence
  chemically synthesized
cttttcttctcttatacaatag

SEQ ID NO: 767922 - DNA, 22 bp, Artificial Sequence
  chemically synthesized
ttcttctcttatacaatagggt

SEQ ID NO: 767923 - DNA, 22 bp, Artificial Sequence
  chemically synthesized
tcttctcttatacaatagggtg

SEQ ID NO: 767924 - DNA, 22 bp, Artificial Sequence
  chemically synthesized
cccatcactgttcaccctattg

SEQ ID NO: 767925 - DNA, 22 bp, Artificial Sequence
  chemically synthesized
cttctcttatacaatagggtga

SEQ ID NO: 767926 - DNA, 22 bp, Artificial Sequence
  chemically synthesized
ttctcttatacaatagggtgaa

SEQ ID NO: 767927 - DNA, 22 bp, Artificial Sequence
  chemically synthesized
tccccatcactgttcaccctat

SEQ ID NO: 767928 - DNA, 22 bp, Artificial Sequence
  chemically synthesized
ctccccatcactgttcacccta

SEQ ID NO: 767929 - DNA, 22 bp, Artificial Sequence
  chemically synthesized
ctcttatacaatagggtgaaca

SEQ ID NO: 767930 - DNA, 22 bp, Artificial Sequence
  chemically synthesized
tctccccatcactgttcaccct

SEQ ID NO: 767931 - DNA, 22 bp, Artificial Sequence
  chemically synthesized
tcttatacaatagggtgaacag

SEQ ID NO: 767932 - DNA, 22 bp, Artificial Sequence
  chemically synthesized
ttatacaatagggtgaacagtg

SEQ ID NO: 767933 - DNA, 22 bp, Artificial Sequence
  chemically synthesized
ttttctccccatcactgttcac

SEQ ID NO: 767934 - DNA, 22 bp, Artificial Sequence
  chemically synthesized
gttttctccccatcactgttca

SEQ ID NO: 767935 - DNA, 22 bp, Artificial Sequence
  chemically synthesized
atacaatagggtgaacagtgat

SEQ ID NO: 767936 - DNA, 22 bp, Artificial Sequence
  chemically synthesized
tgttttctccccatcactgttc

SEQ ID NO: 767937 - DNA, 22 bp, Artificial Sequence
  chemically synthesized
tacaatagggtgaacagtgatg

SEQ ID NO: 767938 - DNA, 22 bp, Artificial Sequence
  chemically synthesized
acaaaagagtaactttgttttc

SEQ ID NO: 767939 - DNA, 22 bp, Artificial Sequence
  chemically synthesized
atacattaacaaaagagtaact

SEQ ID NO: 767940 - DNA, 22 bp, Artificial Sequence
  chemically synthesized
ctcatacattaacaaaagagta

SEQ ID NO: 767941 - DNA, 22 bp, Artificial Sequence
  chemically synthesized
cctcatacattaacaaaagagt

SEQ ID NO: 767942 - DNA, 22 bp, Artificial Sequence
  chemically synthesized
tcctcatacattaacaaaagag

SEQ ID NO: 767943 - DNA, 22 bp, Artificial Sequence
  chemically synthesized
ttcctcatacattaacaaaaga

SEQ ID NO: 767944 - DNA, 22 bp, Artificial Sequence
  chemically synthesized
cttttcctcatacattaacaaa

SEQ ID NO: 767945 - DNA, 22 bp, Artificial Sequence
  chemically synthesized
ctccttttcctcatacattaac

SEQ ID NO: 767946 - DNA, 22 bp, Artificial Sequence
  chemically synthesized
cctccttttcctcatacattaa

SEQ ID NO: 767947 - DNA, 22 bp, Artificial Sequence
  chemically synthesized
ctcttttgttaatgtatgagga

SEQ ID NO: 767948 - DNA, 22 bp, Artificial Sequence
  chemically synthesized
tcttcctccttttcctcataca

SEQ ID NO: 767949 - DNA, 22 bp, Artificial Sequence
  chemically synthesized
ttttgttaatgtatgaggaaaa

SEQ ID NO: 767950 - DNA, 22 bp, Artificial Sequence
  chemically synthesized
ttgttaatgtatgaggaaaagg

SEQ ID NO: 767951 - DNA, 22 bp, Artificial Sequence
  chemically synthesized
tgttaatgtatgaggaaaagga

SEQ ID NO: 767952 - DNA, 22 bp, Artificial Sequence
  chemically synthesized
gttaatgtatgaggaaaaggag

SEQ ID NO: 767953 - DNA, 22 bp, Artificial Sequence
  chemically synthesized
ttaatgtatgaggaaaaggagg

SEQ ID NO: 767954 - DNA, 22 bp, Artificial Sequence
  chemically synthesized
atgtatgaggaaaaggaggaag

SEQ ID NO: 767955 - DNA, 22 bp, Artificial Sequence
  chemically synthesized
catcagtgtccacatgcatatc

SEQ ID NO: 767956 - DNA, 22 bp, Artificial Sequence
  chemically synthesized
acatcagtgtccacatgcatat

SEQ ID NO: 767957 - DNA, 22 bp, Artificial Sequence
  chemically synthesized
tacatcagtgtccacatgcata

SEQ ID NO: 767958 - DNA, 22 bp, Artificial Sequence
  chemically synthesized
cctttacatcagtgtccacatg

SEQ ID NO: 767959 - DNA, 22 bp, Artificial Sequence
  chemically synthesized
cctacctttacatcagtgtcca

SEQ ID NO: 767960 - DNA, 22 bp, Artificial Sequence
  chemically synthesized
atgtaaaggtaggtaatatttg

SEQ ID NO: 767961 - DNA, 22 bp, Artificial Sequence
  chemically synthesized
ccggcaaatatgccaaatatta

SEQ ID NO: 767962 - DNA, 22 bp, Artificial Sequence
  chemically synthesized
cccggcaaatatgccaaatatt

SEQ ID NO: 767963 - DNA, 22 bp, Artificial Sequence
  chemically synthesized
tcccggcaaatatgccaaatat

SEQ ID NO: 767964 - DNA, 22 bp, Artificial Sequence
  chemically synthesized
ttcccggcaaatatgccaaata

SEQ ID NO: 767965 - DNA, 22 bp, Artificial Sequence
  chemically synthesized
tttcccggcaaatatgccaaat

SEQ ID NO: 767966 - DNA, 22 bp, Artificial Sequence
  chemically synthesized
ttttcccggcaaatatgccaaa

SEQ ID NO: 767967 - DNA, 22 bp, Artificial Sequence
  chemically synthesized
tgacatttttttcccggcaaat

SEQ ID NO: 767968 - DNA, 22 bp, Artificial Sequence
  chemically synthesized
atgacatttttttcccggcaaa

SEQ ID NO: 767969 - DNA, 22 bp, Artificial Sequence
  chemically synthesized
tatgacatttttttcccggcaa

SEQ ID NO: 767970 - DNA, 22 bp, Artificial Sequence
  chemically synthesized
ctttatgacatttttttcccgg

SEQ ID NO: 767971 - DNA, 22 bp, Artificial Sequence
  chemically synthesized
cctttatgacatttttttcccg

SEQ ID NO: 767972 - DNA, 22 bp, Artificial Sequence
  chemically synthesized
ggcatatttgccgggaaaaaaa

SEQ ID NO: 767973 - DNA, 22 bp, Artificial Sequence
  chemically synthesized
tcctttatgacatttttttccc

SEQ ID NO: 767974 - DNA, 22 bp, Artificial Sequence
  chemically synthesized
gcatatttgccgggaaaaaaat

SEQ ID NO: 767975 - DNA, 22 bp, Artificial Sequence
  chemically synthesized
ttcctttatgacatttttttcc

SEQ ID NO: 767976 - DNA, 22 bp, Artificial Sequence
  chemically synthesized
cttttcctttatgacatttttt

SEQ ID NO: 767977 - DNA, 22 bp, Artificial Sequence
  chemically synthesized
cctacttttcctttatgacatt

SEQ ID NO: 767978 - DNA, 22 bp, Artificial Sequence
  chemically synthesized
gccgggaaaaaaatgtcataaa

SEQ ID NO: 767979 - DNA, 22 bp, Artificial Sequence
  chemically synthesized
gcctacttttcctttatgacat

SEQ ID NO: 767980 - DNA, 22 bp, Artificial Sequence
  chemically synthesized
ccgggaaaaaaatgtcataaag

SEQ ID NO: 767981 - DNA, 22 bp, Artificial Sequence
  chemically synthesized
tgcctacttttcctttatgaca

SEQ ID NO: 767982 - DNA, 22 bp, Artificial Sequence
  chemically synthesized
gcattttgcctacttttccttt

SEQ ID NO: 767983 - DNA, 22 bp, Artificial Sequence
  chemically synthesized
agcattttgcctacttttcctt

SEQ ID NO: 767984 - DNA, 22 bp, Artificial Sequence
  chemically synthesized
agaatgaggaaatgtaccttag

SEQ ID NO: 767985 - DNA, 22 bp, Artificial Sequence
  chemically synthesized
taagaatgaggaaatgtacctt

SEQ ID NO: 767986 - DNA, 22 bp, Artificial Sequence
  chemically synthesized
atgaatgggttctaagaatgag

SEQ ID NO: 767987 - DNA, 22 bp, Artificial Sequence
  chemically synthesized
aggtacatttcctcattcttag

SEQ ID NO: 767988 - DNA, 22 bp, Artificial Sequence
  chemically synthesized
cctcattcttagaacccattca

SEQ ID NO: 767989 - DNA, 22 bp, Artificial Sequence
  chemically synthesized
ctcattcttagaacccattcat

SEQ ID NO: 767990 - DNA, 22 bp, Artificial Sequence
  chemically synthesized
attcttagaacccattcatgag

SEQ ID NO: 767991 - DNA, 22 bp, Artificial Sequence
  chemically synthesized
ttagaacccattcatgagcttt

SEQ ID NO: 767992 - DNA, 22 bp, Artificial Sequence
  chemically synthesized
agaacccattcatgagctttcc

SEQ ID NO: 767993 - DNA, 22 bp, Artificial Sequence
  chemically synthesized
gaacccattcatgagctttcca

SEQ ID NO: 767994 - DNA, 22 bp, Artificial Sequence
  chemically synthesized
atgagctttccattgtgatatg

SEQ ID NO: 767995 - DNA, 22 bp, Artificial Sequence
  chemically synthesized
tccattgtgatatggtttggct

SEQ ID NO: 767996 - DNA, 22 bp, Artificial Sequence
  chemically synthesized
ccattgtgatatggtttggctt

SEQ ID NO: 767997 - DNA, 22 bp, Artificial Sequence
  chemically synthesized
ggtgaggacacaaagccaaacc

SEQ ID NO: 767998 - DNA, 22 bp, Artificial Sequence
  chemically synthesized
cattgtgatatggtttggcttt

SEQ ID NO: 767999 - DNA, 22 bp, Artificial Sequence
  chemically synthesized
gggtgaggacacaaagccaaac

SEQ ID NO: 768000 - DNA, 22 bp, Artificial Sequence
  chemically synthesized
tgatatggtttggctttgtgtc

SEQ ID NO: 768001 - DNA, 22 bp, Artificial Sequence
  chemically synthesized
gatgagatttgggtgaggacac

SEQ ID NO: 768002 - DNA, 22 bp, Artificial Sequence
  chemically synthesized
tagatgagatttgggtgaggac

SEQ ID NO: 768003 - DNA, 22 bp, Artificial Sequence
  chemically synthesized
ggctttgtgtcctcacccaaat

SEQ ID NO: 768004 - DNA, 22 bp, Artificial Sequence
  chemically synthesized
gctttgtgtcctcacccaaatc

SEQ ID NO: 768005 - DNA, 22 bp, Artificial Sequence
  chemically synthesized
cagttctagatgagatttgggt

SEQ ID NO: 768006 - DNA, 22 bp, Artificial Sequence
  chemically synthesized
tgtgtcctcacccaaatctcat

SEQ ID NO: 768007 - DNA, 22 bp, Artificial Sequence
  chemically synthesized
gtgtcctcacccaaatctcatc

SEQ ID NO: 768008 - DNA, 22 bp, Artificial Sequence
  chemically synthesized
tgtcctcacccaaatctcatct

SEQ ID NO: 768009 - DNA, 22 bp, Artificial Sequence
  chemically synthesized
ccccggattacagttctagatg

SEQ ID NO: 768010 - DNA, 22 bp, Artificial Sequence
  chemically synthesized
acccaaatctcatctagaactg

SEQ ID NO: 768011 - DNA, 22 bp, Artificial Sequence
  chemically synthesized
ccaccaggttcccccggattac

SEQ ID NO: 768012 - DNA, 22 bp, Artificial Sequence
  chemically synthesized
atctagaactgtaatccggggg

SEQ ID NO: 768013 - DNA, 22 bp, Artificial Sequence
  chemically synthesized
gaactgtaatccgggggaacct

SEQ ID NO: 768014 - DNA, 22 bp, Artificial Sequence
  chemically synthesized
taatccgggggaacctggtggg

SEQ ID NO: 768015 - DNA, 22 bp, Artificial Sequence
  chemically synthesized
gtgggaggtgattggatcatgg

SEQ ID NO: 768016 - DNA, 22 bp, Artificial Sequence
  chemically synthesized
gatcatgggggtggcttccccc

SEQ ID NO: 768017 - DNA, 22 bp, Artificial Sequence
  chemically synthesized
tcacatgggaaaacagcatggg

SEQ ID NO: 768018 - DNA, 22 bp, Artificial Sequence
  chemically synthesized
actatcacatgggaaaacagca

SEQ ID NO: 768019 - DNA, 22 bp, Artificial Sequence
  chemically synthesized
actcactatcacatgggaaaac

SEQ ID NO: 768020 - DNA, 22 bp, Artificial Sequence
  chemically synthesized
cccccatgctgttttcccatgt

SEQ ID NO: 768021 - DNA, 22 bp, Artificial Sequence
  chemically synthesized
ccccatgctgttttcccatgtg

SEQ ID NO: 768022 - DNA, 22 bp, Artificial Sequence
  chemically synthesized
atgagaactcactcactatcac

SEQ ID NO: 768023 - DNA, 22 bp, Artificial Sequence
  chemically synthesized
ttttcccatgtgatagtgagtg

SEQ ID NO: 768024 - DNA, 22 bp, Artificial Sequence
  chemically synthesized
tcccatgtgatagtgagtgagt

SEQ ID NO: 768025 - DNA, 22 bp, Artificial Sequence
  chemically synthesized
cccatgtgatagtgagtgagtt

SEQ ID NO: 768026 - DNA, 22 bp, Artificial Sequence
  chemically synthesized
ccatgtgatagtgagtgagttc

SEQ ID NO: 768027 - DNA, 22 bp, Artificial Sequence
  chemically synthesized
taaaaccatcaaatctcatgag

SEQ ID NO: 768028 - DNA, 22 bp, Artificial Sequence
  chemically synthesized
ataaaaccatcaaatctcatga

SEQ ID NO: 768029 - DNA, 22 bp, Artificial Sequence
  chemically synthesized
tcatgagatttgatggttttat

SEQ ID NO: 768030 - DNA, 22 bp, Artificial Sequence
  chemically synthesized
atgagatttgatggttttataa

SEQ ID NO: 768031 - DNA, 22 bp, Artificial Sequence
  chemically synthesized
gatggttttataaggggctctt

SEQ ID NO: 768032 - DNA, 22 bp, Artificial Sequence
  chemically synthesized
atggttttataaggggctcttc

SEQ ID NO: 768033 - DNA, 22 bp, Artificial Sequence
  chemically synthesized
tataaggggctcttcccattca

SEQ ID NO: 768034 - DNA, 22 bp, Artificial Sequence
  chemically synthesized
ataaggggctcttcccattcac

SEQ ID NO: 768035 - DNA, 22 bp, Artificial Sequence
  chemically synthesized
taaggggctcttcccattcact

SEQ ID NO: 768036 - DNA, 22 bp, Artificial Sequence
  chemically synthesized
ttcccattcactctttctctct

SEQ ID NO: 768037 - DNA, 22 bp, Artificial Sequence
  chemically synthesized
cccattcactctttctctctct

SEQ ID NO: 768038 - DNA, 22 bp, Artificial Sequence
  chemically synthesized
ccattcactctttctctctctc

SEQ ID NO: 768039 - DNA, 22 bp, Artificial Sequence
  chemically synthesized
acaaggcagcaggagagagaga

SEQ ID NO: 768040 - DNA, 22 bp, Artificial Sequence
  chemically synthesized
cacaaggcagcaggagagagag

SEQ ID NO: 768041 - DNA, 22 bp, Artificial Sequence
  chemically synthesized
actctttctctctctctcctgc

SEQ ID NO: 768042 - DNA, 22 bp, Artificial Sequence
  chemically synthesized
tttctctctctctcctgctgcc

SEQ ID NO: 768043 - DNA, 22 bp, Artificial Sequence
  chemically synthesized
tctctctctctcctgctgcctt

SEQ ID NO: 768044 - DNA, 22 bp, Artificial Sequence
  chemically synthesized
ctctctctctcctgctgccttg

SEQ ID NO: 768045 - DNA, 22 bp, Artificial Sequence
  chemically synthesized
tctctctctcctgctgccttgt

SEQ ID NO: 768046 - DNA, 22 bp, Artificial Sequence
  chemically synthesized
tctctctcctgctgccttgtga

SEQ ID NO: 768047 - DNA, 22 bp, Artificial Sequence
  chemically synthesized
tctctcctgctgccttgtgaag

SEQ ID NO: 768048 - DNA, 22 bp, Artificial Sequence
  chemically synthesized
tctcctgctgccttgtgaaggt

SEQ ID NO: 768049 - DNA, 22 bp, Artificial Sequence
  chemically synthesized
tcctgctgccttgtgaaggtgc

SEQ ID NO: 768050 - DNA, 22 bp, Artificial Sequence
  chemically synthesized
ctgctgccttgtgaaggtgctt

SEQ ID NO: 768051 - DNA, 22 bp, Artificial Sequence
  chemically synthesized
ctgccttgtgaaggtgcttcct

SEQ ID NO: 768052 - DNA, 22 bp, Artificial Sequence
  chemically synthesized
ccttgtgaaggtgcttccttcc

SEQ ID NO: 768053 - DNA, 22 bp, Artificial Sequence
  chemically synthesized
gtgaaggtgcttccttcccctt

SEQ ID NO: 768054 - DNA, 22 bp, Artificial Sequence
  chemically synthesized
tgaaggtgcttccttccccttt

SEQ ID NO: 768055 - DNA, 22 bp, Artificial Sequence
  chemically synthesized
taatcatggtggaaagcaaagg

SEQ ID NO: 768056 - DNA, 22 bp, Artificial Sequence
  chemically synthesized
ataatcatggtggaaagcaaag

SEQ ID NO: 768057 - DNA, 22 bp, Artificial Sequence
  chemically synthesized
ccttcccctttgctttccacca

SEQ ID NO: 768058 - DNA, 22 bp, Artificial Sequence
  chemically synthesized
cttcccctttgctttccaccat

SEQ ID NO: 768059 - DNA, 22 bp, Artificial Sequence
  chemically synthesized
cccctttgctttccaccatgat

SEQ ID NO: 768060 - DNA, 22 bp, Artificial Sequence
  chemically synthesized
aggaaacttataatcatggtgg

SEQ ID NO: 768061 - DNA, 22 bp, Artificial Sequence
  chemically synthesized
ccctttgctttccaccatgatt

SEQ ID NO: 768062 - DNA, 22 bp, Artificial Sequence
  chemically synthesized
tgctttccaccatgattataag

SEQ ID NO: 768063 - DNA, 22 bp, Artificial Sequence
  chemically synthesized
gctttccaccatgattataagt

SEQ ID NO: 768064 - DNA, 22 bp, Artificial Sequence
  chemically synthesized
ctttccaccatgattataagtt

SEQ ID NO: 768065 - DNA, 22 bp, Artificial Sequence
  chemically synthesized
gggaggcctcaggaaacttata

SEQ ID NO: 768066 - DNA, 22 bp, Artificial Sequence
  chemically synthesized
tccaccatgattataagtttcc

SEQ ID NO: 768067 - DNA, 22 bp, Artificial Sequence
  chemically synthesized
ccaccatgattataagtttcct

SEQ ID NO: 768068 - DNA, 22 bp, Artificial Sequence
  chemically synthesized
caccatgattataagtttcctg

SEQ ID NO: 768069 - DNA, 22 bp, Artificial Sequence
  chemically synthesized
tgtggctggggaggcctcagga

SEQ ID NO: 768070 - DNA, 22 bp, Artificial Sequence
  chemically synthesized
tgtgtggctggggaggcctcag

SEQ ID NO: 768071 - DNA, 22 bp, Artificial Sequence
  chemically synthesized
taagtttcctgaggcctcccca

SEQ ID NO: 768072 - DNA, 22 bp, Artificial Sequence
  chemically synthesized
acagttctgtgtggctggggag

SEQ ID NO: 768073 - DNA, 22 bp, Artificial Sequence
  chemically synthesized
cctgaggcctccccagccacac

SEQ ID NO: 768074 - DNA, 22 bp, Artificial Sequence
  chemically synthesized
actcacagttctgtgtggctgg

SEQ ID NO: 768075 - DNA, 22 bp, Artificial Sequence
  chemically synthesized
ctgaggcctccccagccacaca

SEQ ID NO: 768076 - DNA, 22 bp, Artificial Sequence
  chemically synthesized
aggcctccccagccacacagaa

SEQ ID NO: 768077 - DNA, 22 bp, Artificial Sequence
  chemically synthesized
gttgactcacagttctgtgtgg

SEQ ID NO: 768078 - DNA, 22 bp, Artificial Sequence
  chemically synthesized
agttgactcacagttctgtgtg

SEQ ID NO: 768079 - DNA, 22 bp, Artificial Sequence
  chemically synthesized
cccagccacacagaactgtgag

SEQ ID NO: 768080 - DNA, 22 bp, Artificial Sequence
  chemically synthesized
aagaaaaagaggtttagttgac

SEQ ID NO: 768081 - DNA, 22 bp, Artificial Sequence
  chemically synthesized
aaagaaaaagaggtttagttga

SEQ ID NO: 768082 - DNA, 22 bp, Artificial Sequence
  chemically synthesized
tttaaagaaaaagaggtttagt

SEQ ID NO: 768083 - DNA, 22 bp, Artificial Sequence
  chemically synthesized
atttaaagaaaaagaggtttag

SEQ ID NO: 768084 - DNA, 22 bp, Artificial Sequence
  chemically synthesized
tgagtcaactaaacctcttttt

SEQ ID NO: 768085 - DNA, 22 bp, Artificial Sequence
  chemically synthesized
gggtaatttatttaaagaaaaa

SEQ ID NO: 768086 - DNA, 22 bp, Artificial Sequence
  chemically synthesized
aacctctttttctttaaataaa

SEQ ID NO: 768087 - DNA, 22 bp, Artificial Sequence
  chemically synthesized
agactggggtaatttatttaaa

SEQ ID NO: 768088 - DNA, 22 bp, Artificial Sequence
  chemically synthesized
cctgagactggggtaatttatt

SEQ ID NO: 768089 - DNA, 22 bp, Artificial Sequence
  chemically synthesized
ccctgagactggggtaatttat

SEQ ID NO: 768090 - DNA, 22 bp, Artificial Sequence
  chemically synthesized
tttttctttaaataaattaccc

SEQ ID NO: 768091 - DNA, 22 bp, Artificial Sequence
  chemically synthesized
tttctttaaataaattacccca

SEQ ID NO: 768092 - DNA, 22 bp, Artificial Sequence
  chemically synthesized
ttctttaaataaattaccccag

SEQ ID NO: 768093 - DNA, 22 bp, Artificial Sequence
  chemically synthesized
tctttaaataaattaccccagt

SEQ ID NO: 768094 - DNA, 22 bp, Artificial Sequence
  chemically synthesized
ctttaaataaattaccccagtc

SEQ ID NO: 768095 - DNA, 22 bp, Artificial Sequence
  chemically synthesized
tttaaataaattaccccagtct

SEQ ID NO: 768096 - DNA, 22 bp, Artificial Sequence
  chemically synthesized
taaataaattaccccagtctca

SEQ ID NO: 768097 - DNA, 22 bp, Artificial Sequence
  chemically synthesized
aaataaattaccccagtctcag

SEQ ID NO: 768098 - DNA, 22 bp, Artificial Sequence
  chemically synthesized
taaagaacttccctgagactgg

SEQ ID NO: 768099 - DNA, 22 bp, Artificial Sequence
  chemically synthesized
aataaattaccccagtctcagg

SEQ ID NO: 768100 - DNA, 22 bp, Artificial Sequence
  chemically synthesized
ctataaagaacttccctgagac

SEQ ID NO: 768101 - DNA, 22 bp, Artificial Sequence
  chemically synthesized
acactgctataaagaacttccc

SEQ ID NO: 768102 - DNA, 22 bp, Artificial Sequence
  chemically synthesized
ccccagtctcagggaagttctt

SEQ ID NO: 768103 - DNA, 22 bp, Artificial Sequence
  chemically synthesized
cacactgctataaagaacttcc

SEQ ID NO: 768104 - DNA, 22 bp, Artificial Sequence
  chemically synthesized
gtttcacactgctataaagaac

SEQ ID NO: 768105 - DNA, 22 bp, Artificial Sequence
  chemically synthesized
gttcgtttcacactgctataaa

SEQ ID NO: 768106 - DNA, 22 bp, Artificial Sequence
  chemically synthesized
agggaagttctttatagcagtg

SEQ ID NO: 768107 - DNA, 22 bp, Artificial Sequence
  chemically synthesized
tttatagcagtgtgaaacgaac

SEQ ID NO: 768108 - DNA, 22 bp, Artificial Sequence
  chemically synthesized
tatagcagtgtgaaacgaacta

SEQ ID NO: 768109 - DNA, 22 bp, Artificial Sequence
  chemically synthesized
atagcagtgtgaaacgaactaa

SEQ ID NO: 768110 - DNA, 22 bp, Artificial Sequence
  chemically synthesized
tagcagtgtgaaacgaactaat

SEQ ID NO: 768111 - DNA, 22 bp, Artificial Sequence
  chemically synthesized
atagatacacgatgtatattag

SEQ ID NO: 768112 - DNA, 22 bp, Artificial Sequence
  chemically synthesized
ggaagaattaatagatacacga

SEQ ID NO: 768113 - DNA, 22 bp, Artificial Sequence
  chemically synthesized
gggaagaattaatagatacacg

SEQ ID NO: 768114 - DNA, 22 bp, Artificial Sequence
  chemically synthesized
tgggaagaattaatagatacac

SEQ ID NO: 768115 - DNA, 22 bp, Artificial Sequence
  chemically synthesized
atatacatcgtgtatctattaa

SEQ ID NO: 768116 - DNA, 22 bp, Artificial Sequence
  chemically synthesized
aatgctttgggaagaattaata

SEQ ID NO: 768117 - DNA, 22 bp, Artificial Sequence
  chemically synthesized
aactgaatgctttgggaagaat

SEQ ID NO: 768118 - DNA, 22 bp, Artificial Sequence
  chemically synthesized
aactgaactgaatgctttggga

SEQ ID NO: 768119 - DNA, 22 bp, Artificial Sequence
  chemically synthesized
tgaactgaactgaatgctttgg

SEQ ID NO: 768120 - DNA, 22 bp, Artificial Sequence
  chemically synthesized
ctgaactgaactgaatgctttg

SEQ ID NO: 768121 - DNA, 22 bp, Artificial Sequence
  chemically synthesized
ttaattcttcccaaagcattca

SEQ ID NO: 768122 - DNA, 22 bp, Artificial Sequence
  chemically synthesized
attcttcccaaagcattcagtt

SEQ ID NO: 768123 - DNA, 22 bp, Artificial Sequence
  chemically synthesized
gcatcttctgaactgaactgaa

SEQ ID NO: 768124 - DNA, 22 bp, Artificial Sequence
  chemically synthesized
ttcccaaagcattcagttcagt

SEQ ID NO: 768125 - DNA, 22 bp, Artificial Sequence
  chemically synthesized
tagcatcttctgaactgaactg

SEQ ID NO: 768126 - DNA, 22 bp, Artificial Sequence
  chemically synthesized
cccaaagcattcagttcagttc

SEQ ID NO: 768127 - DNA, 22 bp, Artificial Sequence
  chemically synthesized
ccaaagcattcagttcagttca

SEQ ID NO: 768128 - DNA, 22 bp, Artificial Sequence
  chemically synthesized
agggtctctagcatcttctgaa

SEQ ID NO: 768129 - DNA, 22 bp, Artificial Sequence
  chemically synthesized
agttcagttcagaagatgctag

SEQ ID NO: 768130 - DNA, 22 bp, Artificial Sequence
  chemically synthesized
agttcagaagatgctagagacc

SEQ ID NO: 768131 - DNA, 22 bp, Artificial Sequence
  chemically synthesized
agtgagatggtctaagggtctc

SEQ ID NO: 768132 - DNA, 22 bp, Artificial Sequence
  chemically synthesized
agaagatgctagagacccttag

SEQ ID NO: 768133 - DNA, 22 bp, Artificial Sequence
  chemically synthesized
cagtgagatggtctaagggtct

SEQ ID NO: 768134 - DNA, 22 bp, Artificial Sequence
  chemically synthesized
cttcagtgagatggtctaaggg

SEQ ID NO: 768135 - DNA, 22 bp, Artificial Sequence
  chemically synthesized
gacctgcttcagtgagatggtc

SEQ ID NO: 768136 - DNA, 22 bp, Artificial Sequence
  chemically synthesized
gagacccttagaccatctcact

SEQ ID NO: 768137 - DNA, 22 bp, Artificial Sequence
  chemically synthesized
agaccatctcactgaagcaggt

SEQ ID NO: 768138 - DNA, 22 bp, Artificial Sequence
  chemically synthesized
gaccatctcactgaagcaggtc

SEQ ID NO: 768139 - DNA, 22 bp, Artificial Sequence
  chemically synthesized
actgaagcaggtccagggtatt

SEQ ID NO: 768140 - DNA, 22 bp, Artificial Sequence
  chemically synthesized
aagcaggtccagggtatttttt

SEQ ID NO: 768141 - DNA, 22 bp, Artificial Sequence
  chemically synthesized
catcatggcacaaggacacaaa

SEQ ID NO: 768142 - DNA, 22 bp, Artificial Sequence
  chemically synthesized
tttgtgtccttgtgccatgatg

SEQ ID NO: 768143 - DNA, 22 bp, Artificial Sequence
  chemically synthesized
ttgtgtccttgtgccatgatgc

SEQ ID NO: 768144 - DNA, 22 bp, Artificial Sequence
  chemically synthesized
tgtgtccttgtgccatgatgca

SEQ ID NO: 768145 - DNA, 22 bp, Artificial Sequence
  chemically synthesized
gtgtccttgtgccatgatgcaa

SEQ ID NO: 768146 - DNA, 22 bp, Artificial Sequence
  chemically synthesized
tgtccttgtgccatgatgcaat

SEQ ID NO: 768147 - DNA, 22 bp, Artificial Sequence
  chemically synthesized
gtgccatgatgcaatgttcttt

SEQ ID NO: 768148 - DNA, 22 bp, Artificial Sequence
  chemically synthesized
tgccatgatgcaatgttctttt

SEQ ID NO: 768149 - DNA, 22 bp, Artificial Sequence
  chemically synthesized
aaaaaaaaagaagaagaaaaga

SEQ ID NO: 768150 - DNA, 22 bp, Artificial Sequence
  chemically synthesized
cgtctcaaaaaaaaagaagaag

SEQ ID NO: 768151 - DNA, 22 bp, Artificial Sequence
  chemically synthesized
ttttcttcttctttttttttga

SEQ ID NO: 768152 - DNA, 22 bp, Artificial Sequence
  chemically synthesized
ttcttcttctttttttttgaga

SEQ ID NO: 768153 - DNA, 22 bp, Artificial Sequence
  chemically synthesized
tcttcttctttttttttgagac

SEQ ID NO: 768154 - DNA, 22 bp, Artificial Sequence
  chemically synthesized
cttcttctttttttttgagacg

SEQ ID NO: 768155 - DNA, 22 bp, Artificial Sequence
  chemically synthesized
ttcttctttttttttgagacgg

SEQ ID NO: 768156 - DNA, 22 bp, Artificial Sequence
  chemically synthesized
cttctttttttttgagacggag

SEQ ID NO: 768157 - DNA, 22 bp, Artificial Sequence
  chemically synthesized
ttctttttttttgagacggagt

SEQ ID NO: 768158 - DNA, 22 bp, Artificial Sequence
  chemically synthesized
ctttttttttgagacggagtct

SEQ ID NO: 768159 - DNA, 22 bp, Artificial Sequence
  chemically synthesized
ggcaacagagcaagactccgtc

SEQ ID NO: 768160 - DNA, 22 bp, Artificial Sequence
  chemically synthesized
tttttttttgagacggagtctt

SEQ ID NO: 768161 - DNA, 22 bp, Artificial Sequence
  chemically synthesized
tttttttgagacggagtcttgc

SEQ ID NO: 768162 - DNA, 22 bp, Artificial Sequence
  chemically synthesized
ttttttgagacggagtcttgct

SEQ ID NO: 768163 - DNA, 22 bp, Artificial Sequence
  chemically synthesized
tttttgagacggagtcttgctc

SEQ ID NO: 768164 - DNA, 22 bp, Artificial Sequence
  chemically synthesized
ttttgagacggagtcttgctct

SEQ ID NO: 768165 - DNA, 22 bp, Artificial Sequence
  chemically synthesized
tttgagacggagtcttgctctg

SEQ ID NO: 768166 - DNA, 22 bp, Artificial Sequence
  chemically synthesized
cagcctgggcaacagagcaaga

SEQ ID NO: 768167 - DNA, 22 bp, Artificial Sequence
  chemically synthesized
ttgagacggagtcttgctctgt

SEQ ID NO: 768168 - DNA, 22 bp, Artificial Sequence
  chemically synthesized
tgagacggagtcttgctctgtt

SEQ ID NO: 768169 - DNA, 22 bp, Artificial Sequence
  chemically synthesized
gagacggagtcttgctctgttg

SEQ ID NO: 768170 - DNA, 22 bp, Artificial Sequence
  chemically synthesized
agacggagtcttgctctgttgc

SEQ ID NO: 768171 - DNA, 22 bp, Artificial Sequence
  chemically synthesized
cactccagcctgggcaacagag

SEQ ID NO: 768172 - DNA, 22 bp, Artificial Sequence
  chemically synthesized
gctctgttgcccaggctggagt

SEQ ID NO: 768173 - DNA, 22 bp, Artificial Sequence
  chemically synthesized
ctctgttgcccaggctggagtg

SEQ ID NO: 768174 - DNA, 22 bp, Artificial Sequence
  chemically synthesized
tgttgcccaggctggagtgcag

SEQ ID NO: 768175 - DNA, 22 bp, Artificial Sequence
  chemically synthesized
ttgcccaggctggagtgcagtg

SEQ ID NO: 768176 - DNA, 22 bp, Artificial Sequence
  chemically synthesized
cccaggctggagtgcagtggcg

SEQ ID NO: 768177 - DNA, 22 bp, Artificial Sequence
  chemically synthesized
cagtgagccgagatcgcgccac

SEQ ID NO: 768178 - DNA, 22 bp, Artificial Sequence
  chemically synthesized
gcagtgagccgagatcgcgcca

SEQ ID NO: 768179 - DNA, 22 bp, Artificial Sequence
  chemically synthesized
gagtgcagtggcgcgatctcgg

SEQ ID NO: 768180 - DNA, 22 bp, Artificial Sequence
  chemically synthesized
ggctcactgcaagctccacctc

SEQ ID NO: 768181 - DNA, 22 bp, Artificial Sequence
  chemically synthesized
actgcaagctccacctcccggg

SEQ ID NO: 768182 - DNA, 22 bp, Artificial Sequence
  chemically synthesized
caagctccacctcccgggttca

SEQ ID NO: 768183 - DNA, 22 bp, Artificial Sequence
  chemically synthesized
aggcaggagaatggcgtgaacc

SEQ ID NO: 768184 - DNA, 22 bp, Artificial Sequence
  chemically synthesized
cacctcccgggttcacgccatt

SEQ ID NO: 768185 - DNA, 22 bp, Artificial Sequence
  chemically synthesized
ggaggctgaggcaggagaatgg

SEQ ID NO: 768186 - DNA, 22 bp, Artificial Sequence
  chemically synthesized
ccgggttcacgccattctcctg

SEQ ID NO: 768187 - DNA, 22 bp, Artificial Sequence
  chemically synthesized
gggaggctgaggcaggagaatg

SEQ ID NO: 768188 - DNA, 22 bp, Artificial Sequence
  chemically synthesized
cttgggaggctgaggcaggaga

SEQ ID NO: 768189 - DNA, 22 bp, Artificial Sequence
  chemically synthesized
acgccattctcctgcctcagcc

SEQ ID NO: 768190 - DNA, 22 bp, Artificial Sequence
  chemically synthesized
tagtcccagctacttgggaggc

SEQ ID NO: 768191 - DNA, 22 bp, Artificial Sequence
  chemically synthesized
tcctgcctcagcctcccaagta

SEQ ID NO: 768192 - DNA, 22 bp, Artificial Sequence
  chemically synthesized
ctgcctcagcctcccaagtagc

SEQ ID NO: 768193 - DNA, 22 bp, Artificial Sequence
  chemically synthesized
cctcagcctcccaagtagctgg

SEQ ID NO: 768194 - DNA, 22 bp, Artificial Sequence
  chemically synthesized
agcctcccaagtagctgggact

SEQ ID NO: 768195 - DNA, 22 bp, Artificial Sequence
  chemically synthesized
ccaagtagctgggactacaggc

SEQ ID NO: 768196 - DNA, 22 bp, Artificial Sequence
  chemically synthesized
gccgggcgtggtggcgggcgcc

SEQ ID NO: 768197 - DNA, 22 bp, Artificial Sequence
  chemically synthesized
ggactacaggcgcccgccacca

SEQ ID NO: 768198 - DNA, 22 bp, Artificial Sequence
  chemically synthesized
caggcgcccgccaccacgcccg

SEQ ID NO: 768199 - DNA, 22 bp, Artificial Sequence
  chemically synthesized
aaatacaaaaaattagccgggc

SEQ ID NO: 768200 - DNA, 22 bp, Artificial Sequence
  chemically synthesized
aaaatacaaaaaattagccggg

SEQ ID NO: 768201 - DNA, 22 bp, Artificial Sequence
  chemically synthesized
cttaaaatacaaaaaattagcc

SEQ ID NO: 768202 - DNA, 22 bp, Artificial Sequence
  chemically synthesized
attttttgtattttaagtagat

SEQ ID NO: 768203 - DNA, 22 bp, Artificial Sequence
  chemically synthesized
tttgtattttaagtagatacgg

SEQ ID NO: 768204 - DNA, 22 bp, Artificial Sequence
  chemically synthesized
ttgtattttaagtagatacggg

SEQ ID NO: 768205 - DNA, 22 bp, Artificial Sequence
  chemically synthesized
acatggtgacaccccgtatcta

SEQ ID NO: 768206 - DNA, 22 bp, Artificial Sequence
  chemically synthesized
tgtattttaagtagatacgggg

SEQ ID NO: 768207 - DNA, 22 bp, Artificial Sequence
  chemically synthesized
gtattttaagtagatacggggt

SEQ ID NO: 768208 - DNA, 22 bp, Artificial Sequence
  chemically synthesized
tattttaagtagatacggggtg

SEQ ID NO: 768209 - DNA, 22 bp, Artificial Sequence
  chemically synthesized
gctaacatggtgacaccccgta

SEQ ID NO: 768210 - DNA, 22 bp, Artificial Sequence
  chemically synthesized
taagtagatacggggtgtcacc

SEQ ID NO: 768211 - DNA, 22 bp, Artificial Sequence
  chemically synthesized
aagtagatacggggtgtcacca

SEQ ID NO: 768212 - DNA, 22 bp, Artificial Sequence
  chemically synthesized
agtagatacggggtgtcaccat

SEQ ID NO: 768213 - DNA, 22 bp, Artificial Sequence
  chemically synthesized
gccaggatggtctcgatctcct

SEQ ID NO: 768214 - DNA, 22 bp, Artificial Sequence
  chemically synthesized
aggtgggcagatcacgaggtca

SEQ ID NO: 768215 - DNA, 22 bp, Artificial Sequence
  chemically synthesized
gatctcctgacctcgtgatctg

SEQ ID NO: 768216 - DNA, 22 bp, Artificial Sequence
  chemically synthesized
ggaggctgaggtgggcagatca

SEQ ID NO: 768217 - DNA, 22 bp, Artificial Sequence
  chemically synthesized
gggaggctgaggtgggcagatc

SEQ ID NO: 768218 - DNA, 22 bp, Artificial Sequence
  chemically synthesized
tgggaggctgaggtgggcagat

SEQ ID NO: 768219 - DNA, 22 bp, Artificial Sequence
  chemically synthesized
ctgacctcgtgatctgcccacc

SEQ ID NO: 768220 - DNA, 22 bp, Artificial Sequence
  chemically synthesized
acctcgtgatctgcccacctca

SEQ ID NO: 768221 - DNA, 22 bp, Artificial Sequence
  chemically synthesized
gtgatctgcccacctcagcctc

SEQ ID NO: 768222 - DNA, 22 bp, Artificial Sequence
  chemically synthesized
taatcccagcactttgggaggc

SEQ ID NO: 768223 - DNA, 22 bp, Artificial Sequence
  chemically synthesized
cccacctcagcctcccaaagtg

SEQ ID NO: 768224 - DNA, 22 bp, Artificial Sequence
  chemically synthesized
aacgcctgtaatcccagcactt

SEQ ID NO: 768225 - DNA, 22 bp, Artificial Sequence
  chemically synthesized
agcctcccaaagtgctgggatt

SEQ ID NO: 768226 - DNA, 22 bp, Artificial Sequence
  chemically synthesized
ccaaagtgctgggattacaggc

SEQ ID NO: 768227 - DNA, 22 bp, Artificial Sequence
  chemically synthesized
cggccgggcgcggtggctcaac

SEQ ID NO: 768228 - DNA, 22 bp, Artificial Sequence
  chemically synthesized
ggattacaggcgttgagccacc

SEQ ID NO: 768229 - DNA, 22 bp, Artificial Sequence
  chemically synthesized
caggcgttgagccaccgcgccc

SEQ ID NO: 768230 - DNA, 22 bp, Artificial Sequence
  chemically synthesized
aaaagagcattgcggccgggcg

SEQ ID NO: 768231 - DNA, 22 bp, Artificial Sequence
  chemically synthesized
agccaccgcgcccggccgcaat

SEQ ID NO: 768232 - DNA, 22 bp, Artificial Sequence
  chemically synthesized
agttgaaaagagcattgcggcc

SEQ ID NO: 768233 - DNA, 22 bp, Artificial Sequence
  chemically synthesized
tcagttgaaaagagcattgcgg

SEQ ID NO: 768234 - DNA, 22 bp, Artificial Sequence
  chemically synthesized
ttctcagttgaaaagagcattg

SEQ ID NO: 768235 - DNA, 22 bp, Artificial Sequence
  chemically synthesized
gttctcagttgaaaagagcatt

SEQ ID NO: 768236 - DNA, 22 bp, Artificial Sequence
  chemically synthesized
caaatgtacttgttctcagttg

SEQ ID NO: 768237 - DNA, 22 bp, Artificial Sequence
  chemically synthesized
ccaaatgtacttgttctcagtt

SEQ ID NO: 768238 - DNA, 22 bp, Artificial Sequence
  chemically synthesized
tccaaatgtacttgttctcagt

SEQ ID NO: 768239 - DNA, 22 bp, Artificial Sequence
  chemically synthesized
ttttcaactgagaacaagtaca

SEQ ID NO: 768240 - DNA, 22 bp, Artificial Sequence
  chemically synthesized
ttcaactgagaacaagtacatt

SEQ ID NO: 768241 - DNA, 22 bp, Artificial Sequence
  chemically synthesized
tcaactgagaacaagtacattt

SEQ ID NO: 768242 - DNA, 22 bp, Artificial Sequence
  chemically synthesized
caactgagaacaagtacatttg

SEQ ID NO: 768243 - DNA, 22 bp, Artificial Sequence
  chemically synthesized
gggatgattttccaaatgtact

SEQ ID NO: 768244 - DNA, 22 bp, Artificial Sequence
  chemically synthesized
aactgagaacaagtacatttgg

SEQ ID NO: 768245 - DNA, 22 bp, Artificial Sequence
  chemically synthesized
ggggatgattttccaaatgtac

SEQ ID NO: 768246 - DNA, 22 bp, Artificial Sequence
  chemically synthesized
tggggatgattttccaaatgta

SEQ ID NO: 768247 - DNA, 22 bp, Artificial Sequence
  chemically synthesized
ttggggatgattttccaaatgt

SEQ ID NO: 768248 - DNA, 22 bp, Artificial Sequence
  chemically synthesized
ttttggggatgattttccaaat

SEQ ID NO: 768249 - DNA, 22 bp, Artificial Sequence
  chemically synthesized
agaacaagtacatttggaaaat

SEQ ID NO: 768250 - DNA, 22 bp, Artificial Sequence
  chemically synthesized
ctcttttggggatgattttcca

SEQ ID NO: 768251 - DNA, 22 bp, Artificial Sequence
  chemically synthesized
gctcttttggggatgattttcc

SEQ ID NO: 768252 - DNA, 22 bp, Artificial Sequence
  chemically synthesized
ccaaaccttgctcttttgggga

SEQ ID NO: 768253 - DNA, 22 bp, Artificial Sequence
  chemically synthesized
cccaaaccttgctcttttgggg

SEQ ID NO: 768254 - DNA, 22 bp, Artificial Sequence
  chemically synthesized
ggaaaatcatccccaaaagagc

SEQ ID NO: 768255 - DNA, 22 bp, Artificial Sequence
  chemically synthesized
gaaaatcatccccaaaagagca

SEQ ID NO: 768256 - DNA, 22 bp, Artificial Sequence
  chemically synthesized
agccttcccaaaccttgctctt

SEQ ID NO: 768257 - DNA, 22 bp, Artificial Sequence
  chemically synthesized
gggaaggcttaggcctttccat

SEQ ID NO: 768258 - DNA, 22 bp, Artificial Sequence
  chemically synthesized
ggaaggcttaggcctttccatg

SEQ ID NO: 768259 - DNA, 22 bp, Artificial Sequence
  chemically synthesized
tataacatgtcatatgggcatg

SEQ ID NO: 768260 - DNA, 22 bp, Artificial Sequence
  chemically synthesized
atataacatgtcatatgggcat

SEQ ID NO: 768261 - DNA, 22 bp, Artificial Sequence
  chemically synthesized
aggcctttccatgcccatatga

SEQ ID NO: 768262 - DNA, 22 bp, Artificial Sequence
  chemically synthesized
ggcctttccatgcccatatgac

SEQ ID NO: 768263 - DNA, 22 bp, Artificial Sequence
  chemically synthesized
tccatgcccatatgacatgtta

SEQ ID NO: 768264 - DNA, 22 bp, Artificial Sequence
  chemically synthesized
ataagacttatataacatgtca

SEQ ID NO: 768265 - DNA, 22 bp, Artificial Sequence
  chemically synthesized
ccatgcccatatgacatgttat

SEQ ID NO: 768266 - DNA, 22 bp, Artificial Sequence
  chemically synthesized
cataagacttatataacatgtc

SEQ ID NO: 768267 - DNA, 22 bp, Artificial Sequence
  chemically synthesized
catgcccatatgacatgttata

SEQ ID NO: 768268 - DNA, 22 bp, Artificial Sequence
  chemically synthesized
ttcataagacttatataacatg

SEQ ID NO: 768269 - DNA, 22 bp, Artificial Sequence
  chemically synthesized
gttcttcataagacttatataa

SEQ ID NO: 768270 - DNA, 22 bp, Artificial Sequence
  chemically synthesized
tagttcttcataagacttatat

SEQ ID NO: 768271 - DNA, 22 bp, Artificial Sequence
  chemically synthesized
ttctagttcttcataagactta

SEQ ID NO: 768272 - DNA, 22 bp, Artificial Sequence
  chemically synthesized
tctgttctagttcttcataaga

SEQ ID NO: 768273 - DNA, 22 bp, Artificial Sequence
  chemically synthesized
atctgttctagttcttcataag

SEQ ID NO: 768274 - DNA, 22 bp, Artificial Sequence
  chemically synthesized
ttatctgttctagttcttcata

SEQ ID NO: 768275 - DNA, 22 bp, Artificial Sequence
  chemically synthesized
tataagtcttatgaagaactag

SEQ ID NO: 768276 - DNA, 22 bp, Artificial Sequence
  chemically synthesized
atgaagaactagaacagataag

SEQ ID NO: 768277 - DNA, 22 bp, Artificial Sequence
  chemically synthesized
taaagtcatcctcttatctgtt

SEQ ID NO: 768278 - DNA, 22 bp, Artificial Sequence
  chemically synthesized
tgaagaactagaacagataaga

SEQ ID NO: 768279 - DNA, 22 bp, Artificial Sequence
  chemically synthesized
gaacagataagaggatgacttt

SEQ ID NO: 768280 - DNA, 22 bp, Artificial Sequence
  chemically synthesized
taaaataatctgtaaagtcatc

SEQ ID NO: 768281 - DNA, 22 bp, Artificial Sequence
  chemically synthesized
gtaaaataatctgtaaagtcat

SEQ ID NO: 768282 - DNA, 22 bp, Artificial Sequence
  chemically synthesized
ttgtaaaataatctgtaaagtc

SEQ ID NO: 768283 - DNA, 22 bp, Artificial Sequence
  chemically synthesized
atgtaaaaattcttgtaaaata

SEQ ID NO: 768284 - DNA, 22 bp, Artificial Sequence
  chemically synthesized
tcatgtaaaaattcttgtaaaa

SEQ ID NO: 768285 - DNA, 22 bp, Artificial Sequence
  chemically synthesized
tacagattattttacaagaatt

SEQ ID NO: 768286 - DNA, 22 bp, Artificial Sequence
  chemically synthesized
acagattattttacaagaattt

SEQ ID NO: 768287 - DNA, 22 bp, Artificial Sequence
  chemically synthesized
cagattattttacaagaatttt

SEQ ID NO: 768288 - DNA, 22 bp, Artificial Sequence
  chemically synthesized
ttttacaagaatttttacatga

SEQ ID NO: 768289 - DNA, 22 bp, Artificial Sequence
  chemically synthesized
tacaagaatttttacatgagaa

SEQ ID NO: 768290 - DNA, 22 bp, Artificial Sequence
  chemically synthesized
acaagaatttttacatgagaat

SEQ ID NO: 768291 - DNA, 22 bp, Artificial Sequence
  chemically synthesized
caagaatttttacatgagaatg

SEQ ID NO: 768292 - DNA, 22 bp, Artificial Sequence
  chemically synthesized
aaaaaaaaaaaaaagtcattct

SEQ ID NO: 768293 - DNA, 22 bp, Artificial Sequence
  chemically synthesized
tctcaaaaaaaaaaaaaagtca

SEQ ID NO: 768294 - DNA, 22 bp, Artificial Sequence
  chemically synthesized
ttacatgagaatgacttttttt

SEQ ID NO: 768295 - DNA, 22 bp, Artificial Sequence
  chemically synthesized
tacatgagaatgactttttttt

SEQ ID NO: 768296 - DNA, 22 bp, Artificial Sequence
  chemically synthesized
tgtctcaaaaaaaaaaaaaagt

SEQ ID NO: 768297 - DNA, 22 bp, Artificial Sequence
  chemically synthesized
acatgagaatgacttttttttt

SEQ ID NO: 768298 - DNA, 22 bp, Artificial Sequence
  chemically synthesized
catgagaatgactttttttttt

SEQ ID NO: 768299 - DNA, 22 bp, Artificial Sequence
  chemically synthesized
ttttttttttttgagacagagt

SEQ ID NO: 768300 - DNA, 22 bp, Artificial Sequence
  chemically synthesized
tttttttttttgagacagagtt

SEQ ID NO: 768301 - DNA, 22 bp, Artificial Sequence
  chemically synthesized
ttttttttttgagacagagttt

SEQ ID NO: 768302 - DNA, 22 bp, Artificial Sequence
  chemically synthesized
tttttttttgagacagagtttt

SEQ ID NO: 768303 - DNA, 22 bp, Artificial Sequence
  chemically synthesized
ggcgacaagagcaaaactctgt

SEQ ID NO: 768304 - DNA, 22 bp, Artificial Sequence
  chemically synthesized
ttttttttgagacagagttttg

SEQ ID NO: 768305 - DNA, 22 bp, Artificial Sequence
  chemically synthesized
tttttttgagacagagttttgc

SEQ ID NO: 768306 - DNA, 22 bp, Artificial Sequence
  chemically synthesized
ttttttgagacagagttttgct

SEQ ID NO: 768307 - DNA, 22 bp, Artificial Sequence
  chemically synthesized
tttttgagacagagttttgctc

SEQ ID NO: 768308 - DNA, 22 bp, Artificial Sequence
  chemically synthesized
ttttgagacagagttttgctct

SEQ ID NO: 768309 - DNA, 22 bp, Artificial Sequence
  chemically synthesized
tttgagacagagttttgctctt

SEQ ID NO: 768310 - DNA, 22 bp, Artificial Sequence
  chemically synthesized
ttgagacagagttttgctcttg

SEQ ID NO: 768311 - DNA, 22 bp, Artificial Sequence
  chemically synthesized
cagcctgggcgacaagagcaaa

SEQ ID NO: 768312 - DNA, 22 bp, Artificial Sequence
  chemically synthesized
tgagacagagttttgctcttgt

SEQ ID NO: 768313 - DNA, 22 bp, Artificial Sequence
  chemically synthesized
gagacagagttttgctcttgtc

SEQ ID NO: 768314 - DNA, 22 bp, Artificial Sequence
  chemically synthesized
agacagagttttgctcttgtcg

SEQ ID NO: 768315 - DNA, 22 bp, Artificial Sequence
  chemically synthesized
cactccagcctgggcgacaaga

SEQ ID NO: 768316 - DNA, 22 bp, Artificial Sequence
  chemically synthesized
tgctcttgtcgcccaggctgga

SEQ ID NO: 768317 - DNA, 22 bp, Artificial Sequence
  chemically synthesized
gctcttgtcgcccaggctggag

SEQ ID NO: 768318 - DNA, 22 bp, Artificial Sequence
  chemically synthesized
ctcttgtcgcccaggctggagt

SEQ ID NO: 768319 - DNA, 22 bp, Artificial Sequence
  chemically synthesized
ttgtcgcccaggctggagtgca

SEQ ID NO: 768320 - DNA, 22 bp, Artificial Sequence
  chemically synthesized
gtcgcccaggctggagtgcaat

SEQ ID NO: 768321 - DNA, 22 bp, Artificial Sequence
  chemically synthesized
tcgcccaggctggagtgcaatg

SEQ ID NO: 768322 - DNA, 22 bp, Artificial Sequence
  chemically synthesized
cagtgagccgagatcacaccat

SEQ ID NO: 768323 - DNA, 22 bp, Artificial Sequence
  chemically synthesized
gagtgcaatggtgtgatctcgg

SEQ ID NO: 768324 - DNA, 22 bp, Artificial Sequence
  chemically synthesized
aacccaggagggggacagaggt

SEQ ID NO: 768325 - DNA, 22 bp, Artificial Sequence
  chemically synthesized
ggctcactgcaacctctgtccc

SEQ ID NO: 768326 - DNA, 22 bp, Artificial Sequence
  chemically synthesized
gaacccaggagggggacagagg

SEQ ID NO: 768327 - DNA, 22 bp, Artificial Sequence
  chemically synthesized
actgcaacctctgtccccctcc

SEQ ID NO: 768328 - DNA, 22 bp, Artificial Sequence
  chemically synthesized
caacctctgtccccctcctggg

SEQ ID NO: 768329 - DNA, 22 bp, Artificial Sequence
  chemically synthesized
tgtccccctcctgggttcaagc

SEQ ID NO: 768330 - DNA, 22 bp, Artificial Sequence
  chemically synthesized
aggcaggagaatcgcttgaacc

SEQ ID NO: 768331 - DNA, 22 bp, Artificial Sequence
  chemically synthesized
tccccctcctgggttcaagcga

SEQ ID NO: 768332 - DNA, 22 bp, Artificial Sequence
  chemically synthesized
ctgggttcaagcgattctcctg

SEQ ID NO: 768333 - DNA, 22 bp, Artificial Sequence
  chemically synthesized
aggaggctgaggcaggagaatc

SEQ ID NO: 768334 - DNA, 22 bp, Artificial Sequence
  chemically synthesized
ggttcaagcgattctcctgcct

SEQ ID NO: 768335 - DNA, 22 bp, Artificial Sequence
  chemically synthesized
ctcaggaggctgaggcaggaga

SEQ ID NO: 768336 - DNA, 22 bp, Artificial Sequence
  chemically synthesized
aagcgattctcctgcctcagcc

SEQ ID NO: 768337 - DNA, 22 bp, Artificial Sequence
  chemically synthesized
taatcccagctactcaggaggc

SEQ ID NO: 768338 - DNA, 22 bp, Artificial Sequence
  chemically synthesized
tcctgcctcagcctcctgagta

SEQ ID NO: 768339 - DNA, 22 bp, Artificial Sequence
  chemically synthesized
ctgcctcagcctcctgagtagc

SEQ ID NO: 768340 - DNA, 22 bp, Artificial Sequence
  chemically synthesized
cctcagcctcctgagtagctgg

SEQ ID NO: 768341 - DNA, 22 bp, Artificial Sequence
  chemically synthesized
agcctcctgagtagctgggatt

SEQ ID NO: 768342 - DNA, 22 bp, Artificial Sequence
  chemically synthesized
ctgagtagctgggattacaggc

SEQ ID NO: 768343 - DNA, 22 bp, Artificial Sequence
  chemically synthesized
agtagctgggattacaggcacc

SEQ ID NO: 768344 - DNA, 22 bp, Artificial Sequence
  chemically synthesized
gccgggcatggtggcaggtgcc

SEQ ID NO: 768345 - DNA, 22 bp, Artificial Sequence
  chemically synthesized
ggattacaggcacctgccacca

SEQ ID NO: 768346 - DNA, 22 bp, Artificial Sequence
  chemically synthesized
caggcacctgccaccatgcccg

SEQ ID NO: 768347 - DNA, 22 bp, Artificial Sequence
  chemically synthesized
aaaataaaaaaactggccgggc

SEQ ID NO: 768348 - DNA, 22 bp, Artificial Sequence
  chemically synthesized
ctaaaaataaaaaaactggccg

SEQ ID NO: 768349 - DNA, 22 bp, Artificial Sequence
  chemically synthesized
ccaccatgcccggccagttttt

SEQ ID NO: 768350 - DNA, 22 bp, Artificial Sequence
  chemically synthesized
tactaaaaataaaaaaactggc

SEQ ID NO: 768351 - DNA, 22 bp, Artificial Sequence
  chemically synthesized
tctctactaaaaataaaaaaac

SEQ ID NO: 768352 - DNA, 22 bp, Artificial Sequence
  chemically synthesized
ttttatttttagtagagacagg

SEQ ID NO: 768353 - DNA, 22 bp, Artificial Sequence
  chemically synthesized
tttatttttagtagagacaggg

SEQ ID NO: 768354 - DNA, 22 bp, Artificial Sequence
  chemically synthesized
ttatttttagtagagacagggt

SEQ ID NO: 768355 - DNA, 22 bp, Artificial Sequence
  chemically synthesized
tatttttagtagagacagggtt

SEQ ID NO: 768356 - DNA, 22 bp, Artificial Sequence
  chemically synthesized
atttttagtagagacagggttt

SEQ ID NO: 768357 - DNA, 22 bp, Artificial Sequence
  chemically synthesized
gccaacatggtgaaaccctgtc

SEQ ID NO: 768358 - DNA, 22 bp, Artificial Sequence
  chemically synthesized
tttttagtagagacagggtttc

SEQ ID NO: 768359 - DNA, 22 bp, Artificial Sequence
  chemically synthesized
ttagtagagacagggtttcacc

SEQ ID NO: 768360 - DNA, 22 bp, Artificial Sequence
  chemically synthesized
tagtagagacagggtttcacca

SEQ ID NO: 768361 - DNA, 22 bp, Artificial Sequence
  chemically synthesized
agtagagacagggtttcaccat

SEQ ID NO: 768362 - DNA, 22 bp, Artificial Sequence
  chemically synthesized
gtagagacagggtttcaccatg

SEQ ID NO: 768363 - DNA, 22 bp, Artificial Sequence
  chemically synthesized
gacaccagcctggccaacatgg

SEQ ID NO: 768364 - DNA, 22 bp, Artificial Sequence
  chemically synthesized
ggagttcgacaccagcctggcc

SEQ ID NO: 768365 - DNA, 22 bp, Artificial Sequence
  chemically synthesized
caccatgttggccaggctggtg

SEQ ID NO: 768366 - DNA, 22 bp, Artificial Sequence
  chemically synthesized
accatgttggccaggctggtgt

SEQ ID NO: 768367 - DNA, 22 bp, Artificial Sequence
  chemically synthesized
gccaggctggtgtcgaactcct

SEQ ID NO: 768368 - DNA, 22 bp, Artificial Sequence
  chemically synthesized
gtgtcgaactcctaaccttatg

SEQ ID NO: 768369 - DNA, 22 bp, Artificial Sequence
  chemically synthesized
aggcaggtgggtcacataaggt

SEQ ID NO: 768370 - DNA, 22 bp, Artificial Sequence
  chemically synthesized
ggaagctgaggcaggtgggtca

SEQ ID NO: 768371 - DNA, 22 bp, Artificial Sequence
  chemically synthesized
ctaaccttatgtgacccacctg

SEQ ID NO: 768372 - DNA, 22 bp, Artificial Sequence
  chemically synthesized
gggaagctgaggcaggtgggtc

SEQ ID NO: 768373 - DNA, 22 bp, Artificial Sequence
  chemically synthesized
tgggaagctgaggcaggtgggt

SEQ ID NO: 768374 - DNA, 22 bp, Artificial Sequence
  chemically synthesized
accttatgtgacccacctgcct

SEQ ID NO: 768375 - DNA, 22 bp, Artificial Sequence
  chemically synthesized
atgtgacccacctgcctcagct

SEQ ID NO: 768376 - DNA, 22 bp, Artificial Sequence
  chemically synthesized
tgtgacccacctgcctcagctt

SEQ ID NO: 768377 - DNA, 22 bp, Artificial Sequence
  chemically synthesized
taatcccagcactttgggaagc

SEQ ID NO: 768378 - DNA, 22 bp, Artificial Sequence
  chemically synthesized
cctcagcttcccaaagtgctgg

SEQ ID NO: 768379 - DNA, 22 bp, Artificial Sequence
  chemically synthesized
acgcctataatcccagcacttt

SEQ ID NO: 768380 - DNA, 22 bp, Artificial Sequence
  chemically synthesized
agcttcccaaagtgctgggatt

SEQ ID NO: 768381 - DNA, 22 bp, Artificial Sequence
  chemically synthesized
cccaaagtgctgggattatagg

SEQ ID NO: 768382 - DNA, 22 bp, Artificial Sequence
  chemically synthesized
ccaaagtgctgggattataggc

SEQ ID NO: 768383 - DNA, 22 bp, Artificial Sequence
  chemically synthesized
ggattataggcgtgagccactg

SEQ ID NO: 768384 - DNA, 22 bp, Artificial Sequence
  chemically synthesized
aaatgtagtccaggtgcagtgg

SEQ ID NO: 768385 - DNA, 22 bp, Artificial Sequence
  chemically synthesized
taggcgtgagccactgcacctg

SEQ ID NO: 768386 - DNA, 22 bp, Artificial Sequence
  chemically synthesized
ttaaaatgtagtccaggtgcag

SEQ ID NO: 768387 - DNA, 22 bp, Artificial Sequence
  chemically synthesized
atcgttattaaaatgtagtcca

SEQ ID NO: 768388 - DNA, 22 bp, Artificial Sequence
  chemically synthesized
aatcgttattaaaatgtagtcc

SEQ ID NO: 768389 - DNA, 22 bp, Artificial Sequence
  chemically synthesized
taatcgttattaaaatgtagtc

SEQ ID NO: 768390 - DNA, 22 bp, Artificial Sequence
  chemically synthesized
tttaatcgttattaaaatgtag

SEQ ID NO: 768391 - DNA, 22 bp, Artificial Sequence
  chemically synthesized
ttctttaatcgttattaaaatg

SEQ ID NO: 768392 - DNA, 22 bp, Artificial Sequence
  chemically synthesized
cacctggactacattttaataa

SEQ ID NO: 768393 - DNA, 22 bp, Artificial Sequence
  chemically synthesized
cactgttctttaatcgttatta

SEQ ID NO: 768394 - DNA, 22 bp, Artificial Sequence
  chemically synthesized
ccactgttctttaatcgttatt

SEQ ID NO: 768395 - DNA, 22 bp, Artificial Sequence
  chemically synthesized
gactacattttaataacgatta

SEQ ID NO: 768396 - DNA, 22 bp, Artificial Sequence
  chemically synthesized
cattttaataacgattaaagaa

SEQ ID NO: 768397 - DNA, 22 bp, Artificial Sequence
  chemically synthesized
taataacgattaaagaacagtg

SEQ ID NO: 768398 - DNA, 22 bp, Artificial Sequence
  chemically synthesized
aataacgattaaagaacagtgg

SEQ ID NO: 768399 - DNA, 22 bp, Artificial Sequence
  chemically synthesized
tgaagcagatttccactgttct

SEQ ID NO: 768400 - DNA, 22 bp, Artificial Sequence
  chemically synthesized
ataacgattaaagaacagtgga

SEQ ID NO: 768401 - DNA, 22 bp, Artificial Sequence
  chemically synthesized
agggtgttatgaagcagatttc

SEQ ID NO: 768402 - DNA, 22 bp, Artificial Sequence
  chemically synthesized
aagaacagtggaaatctgcttc

SEQ ID NO: 768403 - DNA, 22 bp, Artificial Sequence
  chemically synthesized
ctcagggtgttatgaagcagat

SEQ ID NO: 768404 - DNA, 22 bp, Artificial Sequence
  chemically synthesized
actcagggtgttatgaagcaga

SEQ ID NO: 768405 - DNA, 22 bp, Artificial Sequence
  chemically synthesized
ttactcagggtgttatgaagca

SEQ ID NO: 768406 - DNA, 22 bp, Artificial Sequence
  chemically synthesized
cttactcagggtgttatgaagc

SEQ ID NO: 768407 - DNA, 22 bp, Artificial Sequence
  chemically synthesized
atttcttactcagggtgttatg

SEQ ID NO: 768408 - DNA, 22 bp, Artificial Sequence
  chemically synthesized
tcatttcttactcagggtgtta

SEQ ID NO: 768409 - DNA, 22 bp, Artificial Sequence
  chemically synthesized
ctcatttcttactcagggtgtt

SEQ ID NO: 768410 - DNA, 22 bp, Artificial Sequence
  chemically synthesized
cttcataacaccctgagtaaga

SEQ ID NO: 768411 - DNA, 22 bp, Artificial Sequence
  chemically synthesized
caatttctcatttcttactcag

SEQ ID NO: 768412 - DNA, 22 bp, Artificial Sequence
  chemically synthesized
cataacaccctgagtaagaaat

SEQ ID NO: 768413 - DNA, 22 bp, Artificial Sequence
  chemically synthesized
ataacaccctgagtaagaaatg

SEQ ID NO: 768414 - DNA, 22 bp, Artificial Sequence
  chemically synthesized
atatgcagctacaatttctcat

SEQ ID NO: 768415 - DNA, 22 bp, Artificial Sequence
  chemically synthesized
agtaagaaatgagaaattgtag

SEQ ID NO: 768416 - DNA, 22 bp, Artificial Sequence
  chemically synthesized
agggtcagcgacaatgctgata

SEQ ID NO: 768417 - DNA, 22 bp, Artificial Sequence
  chemically synthesized
tagctgcatatcagcattgtcg

SEQ ID NO: 768418 - DNA, 22 bp, Artificial Sequence
  chemically synthesized
tactcagggtcagcgacaatgc

SEQ ID NO: 768419 - DNA, 22 bp, Artificial Sequence
  chemically synthesized
atactcagggtcagcgacaatg

SEQ ID NO: 768420 - DNA, 22 bp, Artificial Sequence
  chemically synthesized
catatcagcattgtcgctgacc

SEQ ID NO: 768421 - DNA, 22 bp, Artificial Sequence
  chemically synthesized
gtttatactcagggtcagcgac

SEQ ID NO: 768422 - DNA, 22 bp, Artificial Sequence
  chemically synthesized
cgtttatactcagggtcagcga

SEQ ID NO: 768423 - DNA, 22 bp, Artificial Sequence
  chemically synthesized
ttcgtttatactcagggtcagc

SEQ ID NO: 768424 - DNA, 22 bp, Artificial Sequence
  chemically synthesized
cttcgtttatactcagggtcag

SEQ ID NO: 768425 - DNA, 22 bp, Artificial Sequence
  chemically synthesized
tcgctgaccctgagtataaacg

SEQ ID NO: 768426 - DNA, 22 bp, Artificial Sequence
  chemically synthesized
accctgagtataaacgaagaag

SEQ ID NO: 768427 - DNA, 22 bp, Artificial Sequence
  chemically synthesized
ggtcaccatgaggcttcttcgt

SEQ ID NO: 768428 - DNA, 22 bp, Artificial Sequence
  chemically synthesized
gggtcaccatgaggcttcttcg

SEQ ID NO: 768429 - DNA, 22 bp, Artificial Sequence
  chemically synthesized
tttgggtcaccatgaggcttct

SEQ ID NO: 768430 - DNA, 22 bp, Artificial Sequence
  chemically synthesized
agtataaacgaagaagcctcat

SEQ ID NO: 768431 - DNA, 22 bp, Artificial Sequence
  chemically synthesized
tgtttgggtcaccatgaggctt

SEQ ID NO: 768432 - DNA, 22 bp, Artificial Sequence
  chemically synthesized
tctgtttgggtcaccatgaggc

SEQ ID NO: 768433 - DNA, 22 bp, Artificial Sequence
  chemically synthesized
acaattctctgtttgggtcacc

SEQ ID NO: 768434 - DNA, 22 bp, Artificial Sequence
  chemically synthesized
gttaacaattctctgtttgggt

SEQ ID NO: 768435 - DNA, 22 bp, Artificial Sequence
  chemically synthesized
agttaacaattctctgtttggg

SEQ ID NO: 768436 - DNA, 22 bp, Artificial Sequence
  chemically synthesized
atggtgacccaaacagagaatt

SEQ ID NO: 768437 - DNA, 22 bp, Artificial Sequence
  chemically synthesized
tggacatgacttagttaacaat

SEQ ID NO: 768438 - DNA, 22 bp, Artificial Sequence
  chemically synthesized
ttaactaagtcatgtccatagt

SEQ ID NO: 768439 - DNA, 22 bp, Artificial Sequence
  chemically synthesized
tccatggtaaagcactatggac

SEQ ID NO: 768440 - DNA, 22 bp, Artificial Sequence
  chemically synthesized
gtccatggtaaagcactatgga

SEQ ID NO: 768441 - DNA, 22 bp, Artificial Sequence
  chemically synthesized
actaagtcatgtccatagtgct

SEQ ID NO: 768442 - DNA, 22 bp, Artificial Sequence
  chemically synthesized
agtcatgtccatagtgctttac

SEQ ID NO: 768443 - DNA, 22 bp, Artificial Sequence
  chemically synthesized
gaagggtggatcaaaaacattt

SEQ ID NO: 768444 - DNA, 22 bp, Artificial Sequence
  chemically synthesized
agaagggtggatcaaaaacatt

SEQ ID NO: 768445 - DNA, 22 bp, Artificial Sequence
  chemically synthesized
taccatggacaaatgtttttga

SEQ ID NO: 768446 - DNA, 22 bp, Artificial Sequence
  chemically synthesized
accatggacaaatgtttttgat

SEQ ID NO: 768447 - DNA, 22 bp, Artificial Sequence
  chemically synthesized
ccatggacaaatgtttttgatc

SEQ ID NO: 768448 - DNA, 22 bp, Artificial Sequence
  chemically synthesized
ccttagaagggtggatcaaaaa

SEQ ID NO: 768449 - DNA, 22 bp, Artificial Sequence
  chemically synthesized
cccctgccttagaagggtggat

SEQ ID NO: 768450 - DNA, 22 bp, Artificial Sequence
  chemically synthesized
tacccctgccttagaagggtgg

SEQ ID NO: 768451 - DNA, 22 bp, Artificial Sequence
  chemically synthesized
ctacccctgccttagaagggtg

SEQ ID NO: 768452 - DNA, 22 bp, Artificial Sequence
  chemically synthesized
tctacccctgccttagaagggt

SEQ ID NO: 768453 - DNA, 22 bp, Artificial Sequence
  chemically synthesized
ttctacccctgccttagaaggg

SEQ ID NO: 768454 - DNA, 22 bp, Artificial Sequence
  chemically synthesized
ttgatccacccttctaaggcag

SEQ ID NO: 768455 - DNA, 22 bp, Artificial Sequence
  chemically synthesized
tgatccacccttctaaggcagg

SEQ ID NO: 768456 - DNA, 22 bp, Artificial Sequence
  chemically synthesized
gatccacccttctaaggcaggg

SEQ ID NO: 768457 - DNA, 22 bp, Artificial Sequence
  chemically synthesized
atccacccttctaaggcagggg

SEQ ID NO: 768458 - DNA, 22 bp, Artificial Sequence
  chemically synthesized
aacagcttttctacccctgcct

SEQ ID NO: 768459 - DNA, 22 bp, Artificial Sequence
  chemically synthesized
caacagcttttctacccctgcc

SEQ ID NO: 768460 - DNA, 22 bp, Artificial Sequence
  chemically synthesized
ctaaggcaggggtagaaaagct

SEQ ID NO: 768461 - DNA, 22 bp, Artificial Sequence
  chemically synthesized
caacatttcaacagcttttcta

SEQ ID NO: 768462 - DNA, 22 bp, Artificial Sequence
  chemically synthesized
taaggcaggggtagaaaagctg

SEQ ID NO: 768463 - DNA, 22 bp, Artificial Sequence
  chemically synthesized
acaacatttcaacagcttttct

SEQ ID NO: 768464 - DNA, 22 bp, Artificial Sequence
  chemically synthesized
aggcaggggtagaaaagctgtt

SEQ ID NO: 768465 - DNA, 22 bp, Artificial Sequence
  chemically synthesized
aagcagagatttacaacatttc

SEQ ID NO: 768466 - DNA, 22 bp, Artificial Sequence
  chemically synthesized
ttgaaatgttgtaaatctctgc

SEQ ID NO: 768467 - DNA, 22 bp, Artificial Sequence
  chemically synthesized
aaatgttgtaaatctctgcttg

SEQ ID NO: 768468 - DNA, 22 bp, Artificial Sequence
  chemically synthesized
aaaccgtatcacaaactcaagc

SEQ ID NO: 768469 - DNA, 22 bp, Artificial Sequence
  chemically synthesized
aaaaccgtatcacaaactcaag

SEQ ID NO: 768470 - DNA, 22 bp, Artificial Sequence
  chemically synthesized
taaatctctgcttgagtttgtg

SEQ ID NO: 768471 - DNA, 22 bp, Artificial Sequence
  chemically synthesized
aatttaaaaccgtatcacaaac

SEQ ID NO: 768472 - DNA, 22 bp, Artificial Sequence
  chemically synthesized
ctaaatttaaaaccgtatcaca

SEQ ID NO: 768473 - DNA, 22 bp, Artificial Sequence
  chemically synthesized
tgcttgagtttgtgatacggtt

SEQ ID NO: 768474 - DNA, 22 bp, Artificial Sequence
  chemically synthesized
tgctaaatttaaaaccgtatca

SEQ ID NO: 768475 - DNA, 22 bp, Artificial Sequence
  chemically synthesized
ctgctaaatttaaaaccgtatc

SEQ ID NO: 768476 - DNA, 22 bp, Artificial Sequence
  chemically synthesized
cttgagtttgtgatacggtttt

SEQ ID NO: 768477 - DNA, 22 bp, Artificial Sequence
  chemically synthesized
tctgctaaatttaaaaccgtat

SEQ ID NO: 768478 - DNA, 22 bp, Artificial Sequence
  chemically synthesized
ttctgctaaatttaaaaccgta

SEQ ID NO: 768479 - DNA, 22 bp, Artificial Sequence
  chemically synthesized
gagtttgtgatacggttttaaa

SEQ ID NO: 768480 - DNA, 22 bp, Artificial Sequence
  chemically synthesized
agtttgtgatacggttttaaat

SEQ ID NO: 768481 - DNA, 22 bp, Artificial Sequence
  chemically synthesized
gtgatacggttttaaatttagc

SEQ ID NO: 768482 - DNA, 22 bp, Artificial Sequence
  chemically synthesized
tgatacggttttaaatttagca

SEQ ID NO: 768483 - DNA, 22 bp, Artificial Sequence
  chemically synthesized
gtgaatatttttctgctaaatt

SEQ ID NO: 768484 - DNA, 22 bp, Artificial Sequence
  chemically synthesized
ttggtgaatatttttctgctaa

SEQ ID NO: 768485 - DNA, 22 bp, Artificial Sequence
  chemically synthesized
ctgttggtgaatatttttctgc

SEQ ID NO: 768486 - DNA, 22 bp, Artificial Sequence
  chemically synthesized
tcctgttggtgaatatttttct

SEQ ID NO: 768487 - DNA, 22 bp, Artificial Sequence
  chemically synthesized
taaatttagcagaaaaatattc

SEQ ID NO: 768488 - DNA, 22 bp, Artificial Sequence
  chemically synthesized
aaatttagcagaaaaatattca

SEQ ID NO: 768489 - DNA, 22 bp, Artificial Sequence
  chemically synthesized
aatttagcagaaaaatattcac

SEQ ID NO: 768490 - DNA, 22 bp, Artificial Sequence
  chemically synthesized
attctcctgttggtgaatattt

SEQ ID NO: 768491 - DNA, 22 bp, Artificial Sequence
  chemically synthesized
tcattctcctgttggtgaatat

SEQ ID NO: 768492 - DNA, 22 bp, Artificial Sequence
  chemically synthesized
ctcattctcctgttggtgaata

SEQ ID NO: 768493 - DNA, 22 bp, Artificial Sequence
  chemically synthesized
agcagaaaaatattcaccaaca

SEQ ID NO: 768494 - DNA, 22 bp, Artificial Sequence
  chemically synthesized
gcagaaaaatattcaccaacag

SEQ ID NO: 768495 - DNA, 22 bp, Artificial Sequence
  chemically synthesized
gtttctcattctcctgttggtg

SEQ ID NO: 768496 - DNA, 22 bp, Artificial Sequence
  chemically synthesized
tccacgttggtttctcattctc

SEQ ID NO: 768497 - DNA, 22 bp, Artificial Sequence
  chemically synthesized
accaacaggagaatgagaaacc

SEQ ID NO: 768498 - DNA, 22 bp, Artificial Sequence
  chemically synthesized
ataattatccacgttggtttct

SEQ ID NO: 768499 - DNA, 22 bp, Artificial Sequence
  chemically synthesized
aggataacattaataattatcc

SEQ ID NO: 768500 - DNA, 22 bp, Artificial Sequence
  chemically synthesized
ttcaggataacattaataatta

SEQ ID NO: 768501 - DNA, 22 bp, Artificial Sequence
  chemically synthesized
tgttcaggataacattaataat

SEQ ID NO: 768502 - DNA, 22 bp, Artificial Sequence
  chemically synthesized
ctgttcaggataacattaataa

SEQ ID NO: 768503 - DNA, 22 bp, Artificial Sequence
  chemically synthesized
tctgttcaggataacattaata

SEQ ID NO: 768504 - DNA, 22 bp, Artificial Sequence
  chemically synthesized
ttttctgttcaggataacatta

SEQ ID NO: 768505 - DNA, 22 bp, Artificial Sequence
  chemically synthesized
attttctgttcaggataacatt

SEQ ID NO: 768506 - DNA, 22 bp, Artificial Sequence
  chemically synthesized
tattttctgttcaggataacat

SEQ ID NO: 768507 - DNA, 22 bp, Artificial Sequence
  chemically synthesized
ttattttctgttcaggataaca

SEQ ID NO: 768508 - DNA, 22 bp, Artificial Sequence
  chemically synthesized
tttattttctgttcaggataac

SEQ ID NO: 768509 - DNA, 22 bp, Artificial Sequence
  chemically synthesized
ttaatgttatcctgaacagaaa

SEQ ID NO: 768510 - DNA, 22 bp, Artificial Sequence
  chemically synthesized
atgttatcctgaacagaaaata

SEQ ID NO: 768511 - DNA, 22 bp, Artificial Sequence
  chemically synthesized
agcaagtctttttattttctgt

SEQ ID NO: 768512 - DNA, 22 bp, Artificial Sequence
  chemically synthesized
cagcaagtctttttattttctg

SEQ ID NO: 768513 - DNA, 22 bp, Artificial Sequence
  chemically synthesized
tcagcaagtctttttattttct

SEQ ID NO: 768514 - DNA, 22 bp, Artificial Sequence
  chemically synthesized
ttcagcaagtctttttattttc

SEQ ID NO: 768515 - DNA, 22 bp, Artificial Sequence
  chemically synthesized
tcctgaacagaaaataaaaaga

SEQ ID NO: 768516 - DNA, 22 bp, Artificial Sequence
  chemically synthesized
aacagaaaataaaaagacttgc

SEQ ID NO: 768517 - DNA, 22 bp, Artificial Sequence
  chemically synthesized
acaaaaccaggcagaaaggttt

SEQ ID NO: 768518 - DNA, 22 bp, Artificial Sequence
  chemically synthesized
tgacaaaaccaggcagaaaggt

SEQ ID NO: 768519 - DNA, 22 bp, Artificial Sequence
  chemically synthesized
gctgaaaaacctttctgcctgg

SEQ ID NO: 768520 - DNA, 22 bp, Artificial Sequence
  chemically synthesized
ctgaaaaacctttctgcctggt

SEQ ID NO: 768521 - DNA, 22 bp, Artificial Sequence
  chemically synthesized
aaaaacctttctgcctggtttt

SEQ ID NO: 768522 - DNA, 22 bp, Artificial Sequence
  chemically synthesized
tctgcctggttttgtcagagtt

SEQ ID NO: 768523 - DNA, 22 bp, Artificial Sequence
  chemically synthesized
ctgcctggttttgtcagagttc

SEQ ID NO: 768524 - DNA, 22 bp, Artificial Sequence
  chemically synthesized
tgcctggttttgtcagagttct

SEQ ID NO: 768525 - DNA, 22 bp, Artificial Sequence
  chemically synthesized
cctggttttgtcagagttctct

SEQ ID NO: 768526 - DNA, 22 bp, Artificial Sequence
  chemically synthesized
gttttgtcagagttctcttcct

SEQ ID NO: 768527 - DNA, 22 bp, Artificial Sequence
  chemically synthesized
tgtcagagttctcttcctttta

SEQ ID NO: 768528 - DNA, 22 bp, Artificial Sequence
  chemically synthesized
gtcagagttctcttccttttac

SEQ ID NO: 768529 - DNA, 22 bp, Artificial Sequence
  chemically synthesized
tcagagttctcttccttttaca

SEQ ID NO: 768530 - DNA, 22 bp, Artificial Sequence
  chemically synthesized
tcttccttttacacattcactt

SEQ ID NO: 768531 - DNA, 22 bp, Artificial Sequence
  chemically synthesized
ttccttttacacattcactttt

SEQ ID NO: 768532 - DNA, 22 bp, Artificial Sequence
  chemically synthesized
ccttttacacattcactttttg

SEQ ID NO: 768533 - DNA, 22 bp, Artificial Sequence
  chemically synthesized
cttttacacattcactttttga

SEQ ID NO: 768534 - DNA, 22 bp, Artificial Sequence
  chemically synthesized
ttacacattcactttttgatgt

SEQ ID NO: 768535 - DNA, 22 bp, Artificial Sequence
  chemically synthesized
tacacattcactttttgatgtt

SEQ ID NO: 768536 - DNA, 22 bp, Artificial Sequence
  chemically synthesized
acacattcactttttgatgttt

SEQ ID NO: 768537 - DNA, 22 bp, Artificial Sequence
  chemically synthesized
cacattcactttttgatgtttt

SEQ ID NO: 768538 - DNA, 22 bp, Artificial Sequence
  chemically synthesized
ccagcccacaaaaggaaaacat

SEQ ID NO: 768539 - DNA, 22 bp, Artificial Sequence
  chemically synthesized
tgccagcccacaaaaggaaaac

SEQ ID NO: 768540 - DNA, 22 bp, Artificial Sequence
  chemically synthesized
ctgccagcccacaaaaggaaaa

SEQ ID NO: 768541 - DNA, 22 bp, Artificial Sequence
  chemically synthesized
actttttgatgttttccttttg

SEQ ID NO: 768542 - DNA, 22 bp, Artificial Sequence
  chemically synthesized
tctgccagcccacaaaaggaaa

SEQ ID NO: 768543 - DNA, 22 bp, Artificial Sequence
  chemically synthesized
tttgatgttttccttttgtggg

SEQ ID NO: 768544 - DNA, 22 bp, Artificial Sequence
  chemically synthesized
ttgatgttttccttttgtgggc

SEQ ID NO: 768545 - DNA, 22 bp, Artificial Sequence
  chemically synthesized
tgatgttttccttttgtgggct

SEQ ID NO: 768546 - DNA, 22 bp, Artificial Sequence
  chemically synthesized
gatgttttccttttgtgggctg

SEQ ID NO: 768547 - DNA, 22 bp, Artificial Sequence
  chemically synthesized
atgttttccttttgtgggctgg

SEQ ID NO: 768548 - DNA, 22 bp, Artificial Sequence
  chemically synthesized
tccttttgtgggctggcagaaa

SEQ ID NO: 768549 - DNA, 22 bp, Artificial Sequence
  chemically synthesized
ccttttgtgggctggcagaaag

SEQ ID NO: 768550 - DNA, 22 bp, Artificial Sequence
  chemically synthesized
cttttgtgggctggcagaaaga

SEQ ID NO: 768551 - DNA, 22 bp, Artificial Sequence
  chemically synthesized
gagtgacccccatctttctgcc

SEQ ID NO: 768552 - DNA, 22 bp, Artificial Sequence
  chemically synthesized
agagtgacccccatctttctgc

SEQ ID NO: 768553 - DNA, 22 bp, Artificial Sequence
  chemically synthesized
ttgtgggctggcagaaagatgg

SEQ ID NO: 768554 - DNA, 22 bp, Artificial Sequence
  chemically synthesized
tgtgggctggcagaaagatggg

SEQ ID NO: 768555 - DNA, 22 bp, Artificial Sequence
  chemically synthesized
gtgggctggcagaaagatgggg

SEQ ID NO: 768556 - DNA, 22 bp, Artificial Sequence
  chemically synthesized
tgggctggcagaaagatggggg

SEQ ID NO: 768557 - DNA, 22 bp, Artificial Sequence
  chemically synthesized
gtaaaagtttagagtgaccccc

SEQ ID NO: 768558 - DNA, 22 bp, Artificial Sequence
  chemically synthesized
agtaaaagtttagagtgacccc

SEQ ID NO: 768559 - DNA, 22 bp, Artificial Sequence
  chemically synthesized
gcagaaagatgggggtcactct

SEQ ID NO: 768560 - DNA, 22 bp, Artificial Sequence
  chemically synthesized
tagtaaaagtttagagtgaccc

SEQ ID NO: 768561 - DNA, 22 bp, Artificial Sequence
  chemically synthesized
ttagtaaaagtttagagtgacc

SEQ ID NO: 768562 - DNA, 22 bp, Artificial Sequence
  chemically synthesized
agagtatttttagtaaaagttt

SEQ ID NO: 768563 - DNA, 22 bp, Artificial Sequence
  chemically synthesized
aagagtatttttagtaaaagtt

SEQ ID NO: 768564 - DNA, 22 bp, Artificial Sequence
  chemically synthesized
taagagtatttttagtaaaagt

SEQ ID NO: 768565 - DNA, 22 bp, Artificial Sequence
  chemically synthesized
tagttttaagagtatttttagt

SEQ ID NO: 768566 - DNA, 22 bp, Artificial Sequence
  chemically synthesized
gtagttttaagagtatttttag

SEQ ID NO: 768567 - DNA, 22 bp, Artificial Sequence
  chemically synthesized
taaacttttactaaaaatactc

SEQ ID NO: 768568 - DNA, 22 bp, Artificial Sequence
  chemically synthesized
aacttttactaaaaatactctt

SEQ ID NO: 768569 - DNA, 22 bp, Artificial Sequence
  chemically synthesized
catcttgtagttttaagagtat

SEQ ID NO: 768570 - DNA, 22 bp, Artificial Sequence
  chemically synthesized
acatcttgtagttttaagagta

SEQ ID NO: 768571 - DNA, 22 bp, Artificial Sequence
  chemically synthesized
ttactaaaaatactcttaaaac

SEQ ID NO: 768572 - DNA, 22 bp, Artificial Sequence
  chemically synthesized
tactaaaaatactcttaaaact

SEQ ID NO: 768573 - DNA, 22 bp, Artificial Sequence
  chemically synthesized
actaaaaatactcttaaaacta

SEQ ID NO: 768574 - DNA, 22 bp, Artificial Sequence
  chemically synthesized
ctaaaaatactcttaaaactac

SEQ ID NO: 768575 - DNA, 22 bp, Artificial Sequence
  chemically synthesized
aaaatactcttaaaactacaag

SEQ ID NO: 768576 - DNA, 22 bp, Artificial Sequence
  chemically synthesized
aaatagagaacttacatcttgt

SEQ ID NO: 768577 - DNA, 22 bp, Artificial Sequence
  chemically synthesized
aaaatagagaacttacatcttg

SEQ ID NO: 768578 - DNA, 22 bp, Artificial Sequence
  chemically synthesized
taaaatagagaacttacatctt

SEQ ID NO: 768579 - DNA, 22 bp, Artificial Sequence
  chemically synthesized
ttaaaactacaagatgtaagtt

SEQ ID NO: 768580 - DNA, 22 bp, Artificial Sequence
  chemically synthesized
tttaaaatagagaacttacatc

SEQ ID NO: 768581 - DNA, 22 bp, Artificial Sequence
  chemically synthesized
aaaactacaagatgtaagttct

SEQ ID NO: 768582 - DNA, 22 bp, Artificial Sequence
  chemically synthesized
aaactacaagatgtaagttctc

SEQ ID NO: 768583 - DNA, 22 bp, Artificial Sequence
  chemically synthesized
tgggctctttaaaatagagaac

SEQ ID NO: 768584 - DNA, 22 bp, Artificial Sequence
  chemically synthesized
caagatgtaagttctctatttt

SEQ ID NO: 768585 - DNA, 22 bp, Artificial Sequence
  chemically synthesized
agaaggctatgggctctttaaa

SEQ ID NO: 768586 - DNA, 22 bp, Artificial Sequence
  chemically synthesized
cagaaggctatgggctctttaa

SEQ ID NO: 768587 - DNA, 22 bp, Artificial Sequence
  chemically synthesized
tcagaaggctatgggctcttta

SEQ ID NO: 768588 - DNA, 22 bp, Artificial Sequence
  chemically synthesized
ttcagaaggctatgggctcttt

SEQ ID NO: 768589 - DNA, 22 bp, Artificial Sequence
  chemically synthesized
tttcagaaggctatgggctctt

SEQ ID NO: 768590 - DNA, 22 bp, Artificial Sequence
  chemically synthesized
tctattttaaagagcccatagc

SEQ ID NO: 768591 - DNA, 22 bp, Artificial Sequence
  chemically synthesized
tattttaaagagcccatagcct

SEQ ID NO: 768592 - DNA, 22 bp, Artificial Sequence
  chemically synthesized
agactttttcagaaggctatgg

SEQ ID NO: 768593 - DNA, 22 bp, Artificial Sequence
  chemically synthesized
ttttaaagagcccatagccttc

SEQ ID NO: 768594 - DNA, 22 bp, Artificial Sequence
  chemically synthesized
aagactttttcagaaggctatg

SEQ ID NO: 768595 - DNA, 22 bp, Artificial Sequence
  chemically synthesized
taaagagcccatagccttctga

SEQ ID NO: 768596 - DNA, 22 bp, Artificial Sequence
  chemically synthesized
cttaagactttttcagaaggct

SEQ ID NO: 768597 - DNA, 22 bp, Artificial Sequence
  chemically synthesized
aaagagcccatagccttctgaa

SEQ ID NO: 768598 - DNA, 22 bp, Artificial Sequence
  chemically synthesized
gcttaagactttttcagaaggc

SEQ ID NO: 768599 - DNA, 22 bp, Artificial Sequence
  chemically synthesized
aagagcccatagccttctgaaa

SEQ ID NO: 768600 - DNA, 22 bp, Artificial Sequence
  chemically synthesized
tttgcttaagactttttcagaa

SEQ ID NO: 768601 - DNA, 22 bp, Artificial Sequence
  chemically synthesized
atttgcttaagactttttcaga

SEQ ID NO: 768602 - DNA, 22 bp, Artificial Sequence
  chemically synthesized
atttatttgcttaagacttttt

SEQ ID NO: 768603 - DNA, 22 bp, Artificial Sequence
  chemically synthesized
gttcatttatttgcttaagact

SEQ ID NO: 768604 - DNA, 22 bp, Artificial Sequence
  chemically synthesized
ggttcatttatttgcttaagac

SEQ ID NO: 768605 - DNA, 22 bp, Artificial Sequence
  chemically synthesized
tggttcatttatttgcttaaga

SEQ ID NO: 768606 - DNA, 22 bp, Artificial Sequence
  chemically synthesized
ctgaaaaagtcttaagcaaata

SEQ ID NO: 768607 - DNA, 22 bp, Artificial Sequence
  chemically synthesized
ttttggttcatttatttgctta

SEQ ID NO: 768608 - DNA, 22 bp, Artificial Sequence
  chemically synthesized
tgaaaaagtcttaagcaaataa

SEQ ID NO: 768609 - DNA, 22 bp, Artificial Sequence
  chemically synthesized
aaaaagtcttaagcaaataaat

SEQ ID NO: 768610 - DNA, 22 bp, Artificial Sequence
  chemically synthesized
aagcaaataaatgaaccaaaat

SEQ ID NO: 768611 - DNA, 22 bp, Artificial Sequence
  chemically synthesized
agcaaataaatgaaccaaaata

SEQ ID NO: 768612 - DNA, 22 bp, Artificial Sequence
  chemically synthesized
acatgatcacatgttattttgg

SEQ ID NO: 768613 - DNA, 22 bp, Artificial Sequence
  chemically synthesized
aacatgatcacatgttattttg

SEQ ID NO: 768614 - DNA, 22 bp, Artificial Sequence
  chemically synthesized
cagtttaacatgatcacatgtt

SEQ ID NO: 768615 - DNA, 22 bp, Artificial Sequence
  chemically synthesized
tgttccagtttaacatgatcac

SEQ ID NO: 768616 - DNA, 22 bp, Artificial Sequence
  chemically synthesized
ccacagggctgtgttccagttt

SEQ ID NO: 768617 - DNA, 22 bp, Artificial Sequence
  chemically synthesized
ttcccacagggctgtgttccag

SEQ ID NO: 768618 - DNA, 22 bp, Artificial Sequence
  chemically synthesized
gttcccacagggctgtgttcca

SEQ ID NO: 768619 - DNA, 22 bp, Artificial Sequence
  chemically synthesized
tgttcccacagggctgtgttcc

SEQ ID NO: 768620 - DNA, 22 bp, Artificial Sequence
  chemically synthesized
tttgttcccacagggctgtgtt

SEQ ID NO: 768621 - DNA, 22 bp, Artificial Sequence
  chemically synthesized
ttctttgttcccacagggctgt

SEQ ID NO: 768622 - DNA, 22 bp, Artificial Sequence
  chemically synthesized
aactggaacacagccctgtggg

SEQ ID NO: 768623 - DNA, 22 bp, Artificial Sequence
  chemically synthesized
attgttctttgttcccacaggg

SEQ ID NO: 768624 - DNA, 22 bp, Artificial Sequence
  chemically synthesized
gaacacagccctgtgggaacaa

SEQ ID NO: 768625 - DNA, 22 bp, Artificial Sequence
  chemically synthesized
gggggcaaggctaattgttctt

SEQ ID NO: 768626 - DNA, 22 bp, Artificial Sequence
  chemically synthesized
ggggggcaaggctaattgttct

SEQ ID NO: 768627 - DNA, 22 bp, Artificial Sequence
  chemically synthesized
tgggaacaaagaacaattagcc

SEQ ID NO: 768628 - DNA, 22 bp, Artificial Sequence
  chemically synthesized
caaatcttggggggcaaggcta

SEQ ID NO: 768629 - DNA, 22 bp, Artificial Sequence
  chemically synthesized
gccttgccccccaagatttgca

SEQ ID NO: 768630 - DNA, 22 bp, Artificial Sequence
  chemically synthesized
tatgatggcatctgcaaatctt

SEQ ID NO: 768631 - DNA, 22 bp, Artificial Sequence
  chemically synthesized
gtatgatggcatctgcaaatct

SEQ ID NO: 768632 - DNA, 22 bp, Artificial Sequence
  chemically synthesized
gccccccaagatttgcagatgc

SEQ ID NO: 768633 - DNA, 22 bp, Artificial Sequence
  chemically synthesized
ccccccaagatttgcagatgcc

SEQ ID NO: 768634 - DNA, 22 bp, Artificial Sequence
  chemically synthesized
atcaaatatcatcacttgtatg

SEQ ID NO: 768635 - DNA, 22 bp, Artificial Sequence
  chemically synthesized
gcagatgccatcatacaagtga

SEQ ID NO: 768636 - DNA, 22 bp, Artificial Sequence
  chemically synthesized
cagatgccatcatacaagtgat

SEQ ID NO: 768637 - DNA, 22 bp, Artificial Sequence
  chemically synthesized
aagaccctgatcaaatatcatc

SEQ ID NO: 768638 - DNA, 22 bp, Artificial Sequence
  chemically synthesized
atccctcaagaccctgatcaaa

SEQ ID NO: 768639 - DNA, 22 bp, Artificial Sequence
  chemically synthesized
ctcatccctcaagaccctgatc

SEQ ID NO: 768640 - DNA, 22 bp, Artificial Sequence
  chemically synthesized
ctactcatccctcaagaccctg

SEQ ID NO: 768641 - DNA, 22 bp, Artificial Sequence
  chemically synthesized
gccagctgctactcatccctca

SEQ ID NO: 768642 - DNA, 22 bp, Artificial Sequence
  chemically synthesized
gatcagggtcttgagggatgag

SEQ ID NO: 768643 - DNA, 22 bp, Artificial Sequence
  chemically synthesized
atcagggtcttgagggatgagt

SEQ ID NO: 768644 - DNA, 22 bp, Artificial Sequence
  chemically synthesized
ccctggccagctgctactcatc

SEQ ID NO: 768645 - DNA, 22 bp, Artificial Sequence
  chemically synthesized
tcccctggccagctgctactca

SEQ ID NO: 768646 - DNA, 22 bp, Artificial Sequence
  chemically synthesized
ctcccctggccagctgctactc

SEQ ID NO: 768647 - DNA, 22 bp, Artificial Sequence
  chemically synthesized
gagggatgagtagcagctggcc

SEQ ID NO: 768648 - DNA, 22 bp, Artificial Sequence
  chemically synthesized
agggatgagtagcagctggcca

SEQ ID NO: 768649 - DNA, 22 bp, Artificial Sequence
  chemically synthesized
ccacttctcccctggccagctg

SEQ ID NO: 768650 - DNA, 22 bp, Artificial Sequence
  chemically synthesized
tcccacttctcccctggccagc

SEQ ID NO: 768651 - DNA, 22 bp, Artificial Sequence
  chemically synthesized
actctcccacttctcccctggc

SEQ ID NO: 768652 - DNA, 22 bp, Artificial Sequence
  chemically synthesized
cactctcccacttctcccctgg

SEQ ID NO: 768653 - DNA, 22 bp, Artificial Sequence
  chemically synthesized
aaatttcactctcccacttctc

SEQ ID NO: 768654 - DNA, 22 bp, Artificial Sequence
  chemically synthesized
caaatttcactctcccacttct

SEQ ID NO: 768655 - DNA, 22 bp, Artificial Sequence
  chemically synthesized
cttcaaatttcactctcccact

SEQ ID NO: 768656 - DNA, 22 bp, Artificial Sequence
  chemically synthesized
gccaggggagaagtgggagagt

SEQ ID NO: 768657 - DNA, 22 bp, Artificial Sequence
  chemically synthesized
ccactgcttcaaatttcactct

SEQ ID NO: 768658 - DNA, 22 bp, Artificial Sequence
  chemically synthesized
cccactgcttcaaatttcactc

SEQ ID NO: 768659 - DNA, 22 bp, Artificial Sequence
  chemically synthesized
tcccactgcttcaaatttcact

SEQ ID NO: 768660 - DNA, 22 bp, Artificial Sequence
  chemically synthesized
ttcccactgcttcaaatttcac

SEQ ID NO: 768661 - DNA, 22 bp, Artificial Sequence
  chemically synthesized
atgtttttcccactgcttcaaa

SEQ ID NO: 768662 - DNA, 22 bp, Artificial Sequence
  chemically synthesized
attcatgtttttcccactgctt

SEQ ID NO: 768663 - DNA, 22 bp, Artificial Sequence
  chemically synthesized
cattcatgtttttcccactgct

SEQ ID NO: 768664 - DNA, 22 bp, Artificial Sequence
  chemically synthesized
aacttcattcatgtttttccca

SEQ ID NO: 768665 - DNA, 22 bp, Artificial Sequence
  chemically synthesized
caacttcattcatgtttttccc

SEQ ID NO: 768666 - DNA, 22 bp, Artificial Sequence
  chemically synthesized
gaagcagtgggaaaaacatgaa

SEQ ID NO: 768667 - DNA, 22 bp, Artificial Sequence
  chemically synthesized
tcttcaacttcattcatgtttt

SEQ ID NO: 768668 - DNA, 22 bp, Artificial Sequence
  chemically synthesized
aagcagtgggaaaaacatgaat

SEQ ID NO: 768669 - DNA, 22 bp, Artificial Sequence
  chemically synthesized
atcttcaacttcattcatgttt

SEQ ID NO: 768670 - DNA, 22 bp, Artificial Sequence
  chemically synthesized
gtcttatcttcaacttcattca

SEQ ID NO: 768671 - DNA, 22 bp, Artificial Sequence
  chemically synthesized
tctcgtcttatcttcaacttca

SEQ ID NO: 768672 - DNA, 22 bp, Artificial Sequence
  chemically synthesized
atctcgtcttatcttcaacttc

SEQ ID NO: 768673 - DNA, 22 bp, Artificial Sequence
  chemically synthesized
ttatctcgtcttatcttcaact

SEQ ID NO: 768674 - DNA, 22 bp, Artificial Sequence
  chemically synthesized
atgtgtattcttatctcgtctt

SEQ ID NO: 768675 - DNA, 22 bp, Artificial Sequence
  chemically synthesized
tgatgtgtattcttatctcgtc

SEQ ID NO: 768676 - DNA, 22 bp, Artificial Sequence
  chemically synthesized
gctctgatgtgtattcttatct

SEQ ID NO: 768677 - DNA, 22 bp, Artificial Sequence
  chemically synthesized
aagataagacgagataagaata

SEQ ID NO: 768678 - DNA, 22 bp, Artificial Sequence
  chemically synthesized
agctctgatgtgtattcttatc

SEQ ID NO: 768679 - DNA, 22 bp, Artificial Sequence
  chemically synthesized
cttagctctgatgtgtattctt

SEQ ID NO: 768680 - DNA, 22 bp, Artificial Sequence
  chemically synthesized
cggagttacttagctctgatgt

SEQ ID NO: 768681 - DNA, 22 bp, Artificial Sequence
  chemically synthesized
cctccggagttacttagctctg

SEQ ID NO: 768682 - DNA, 22 bp, Artificial Sequence
  chemically synthesized
ccctccggagttacttagctct

SEQ ID NO: 768683 - DNA, 22 bp, Artificial Sequence
  chemically synthesized
ttccctccggagttacttagct

SEQ ID NO: 768684 - DNA, 22 bp, Artificial Sequence
  chemically synthesized
ccctcttccctccggagttact

SEQ ID NO: 768685 - DNA, 22 bp, Artificial Sequence
  chemically synthesized
cccctcttccctccggagttac

SEQ ID NO: 768686 - DNA, 22 bp, Artificial Sequence
  chemically synthesized
agtaactccggagggaagaggg

SEQ ID NO: 768687 - DNA, 22 bp, Artificial Sequence
  chemically synthesized
ccgccatgggtcttcccctctt

SEQ ID NO: 768688 - DNA, 22 bp, Artificial Sequence
  chemically synthesized
cccgccatgggtcttcccctct

SEQ ID NO: 768689 - DNA, 22 bp, Artificial Sequence
  chemically synthesized
ttcccgccatgggtcttcccct

SEQ ID NO: 768690 - DNA, 22 bp, Artificial Sequence
  chemically synthesized
cggagggaagaggggaagaccc

SEQ ID NO: 768691 - DNA, 22 bp, Artificial Sequence
  chemically synthesized
tcttcccgccatgggtcttccc

SEQ ID NO: 768692 - DNA, 22 bp, Artificial Sequence
  chemically synthesized
tctctcttcccgccatgggtct

SEQ ID NO: 768693 - DNA, 22 bp, Artificial Sequence
  chemically synthesized
tgtctctcttcccgccatgggt

SEQ ID NO: 768694 - DNA, 22 bp, Artificial Sequence
  chemically synthesized
ccactctgtctctcttcccgcc

SEQ ID NO: 768695 - DNA, 22 bp, Artificial Sequence
  chemically synthesized
accactctgtctctcttcccgc

SEQ ID NO: 768696 - DNA, 22 bp, Artificial Sequence
  chemically synthesized
atcttaccactctgtctctctt

SEQ ID NO: 768697 - DNA, 22 bp, Artificial Sequence
  chemically synthesized
gatcttaccactctgtctctct

SEQ ID NO: 768698 - DNA, 22 bp, Artificial Sequence
  chemically synthesized
tgatcttaccactctgtctctc

SEQ ID NO: 768699 - DNA, 22 bp, Artificial Sequence
  chemically synthesized
ctctctctctctctctctctct

SEQ ID NO: 768700 - DNA, 22 bp, Artificial Sequence
  chemically synthesized
tctctctctctctctctctctc

SEQ ID NO: 768701 - DNA, 22 bp, Artificial Sequence
  chemically synthesized
tctctctctctctctctctctc

SEQ ID NO: 768702 - DNA, 22 bp, Artificial Sequence
  chemically synthesized
tctctctctctctctctctctc

SEQ ID NO: 768703 - DNA, 22 bp, Artificial Sequence
  chemically synthesized
tctctctctctctctctctctc

SEQ ID NO: 768704 - DNA, 22 bp, Artificial Sequence
  chemically synthesized
tctctctctctctctctctctc

SEQ ID NO: 768705 - DNA, 22 bp, Artificial Sequence
  chemically synthesized
tctctctctctctctctctctc

SEQ ID NO: 768706 - DNA, 22 bp, Artificial Sequence
  chemically synthesized
tctctctctctctctctctctc

SEQ ID NO: 768707 - DNA, 22 bp, Artificial Sequence
  chemically synthesized
tctctctctctctctctctctc

SEQ ID NO: 768708 - DNA, 22 bp, Artificial Sequence
  chemically synthesized
tctctctctctctctctctcta

SEQ ID NO: 768709 - DNA, 22 bp, Artificial Sequence
  chemically synthesized
tctctctctctctctctctata

SEQ ID NO: 768710 - DNA, 22 bp, Artificial Sequence
  chemically synthesized
tctctctctctctctctatata

SEQ ID NO: 768711 - DNA, 22 bp, Artificial Sequence
  chemically synthesized
tctctctctctctctatatata

SEQ ID NO: 768712 - DNA, 22 bp, Artificial Sequence
  chemically synthesized
tctctctctctctatatatata

SEQ ID NO: 768713 - DNA, 22 bp, Artificial Sequence
  chemically synthesized
tatatatatatatatatatata

SEQ ID NO: 768714 - DNA, 22 bp, Artificial Sequence
  chemically synthesized
tctctctctctatatatatata

SEQ ID NO: 768715 - DNA, 22 bp, Artificial Sequence
  chemically synthesized
tctctctctatatatatatata

SEQ ID NO: 768716 - DNA, 22 bp, Artificial Sequence
  chemically synthesized
tctctctatatatatatatata

SEQ ID NO: 768717 - DNA, 22 bp, Artificial Sequence
  chemically synthesized
tctctatatatatatatatata

SEQ ID NO: 768718 - DNA, 22 bp, Artificial Sequence
  chemically synthesized
tgcagctatatatatatatata

SEQ ID NO: 768719 - DNA, 22 bp, Artificial Sequence
  chemically synthesized
tctatatatatatatatatata

SEQ ID NO: 768720 - DNA, 22 bp, Artificial Sequence
  chemically synthesized
ctgtgcagctatatatatatat

SEQ ID NO: 768721 - DNA, 22 bp, Artificial Sequence
  chemically synthesized
tatatatatatatatatatata

SEQ ID NO: 768722 - DNA, 22 bp, Artificial Sequence
  chemically synthesized
cctgtgcagctatatatatata

SEQ ID NO: 768723 - DNA, 22 bp, Artificial Sequence
  chemically synthesized
tatatatatatatatatatata

SEQ ID NO: 768724 - DNA, 22 bp, Artificial Sequence
  chemically synthesized
cttcctgtgcagctatatatat

SEQ ID NO: 768725 - DNA, 22 bp, Artificial Sequence
  chemically synthesized
acaatccaggccctccttcctg

SEQ ID NO: 768726 - DNA, 22 bp, Artificial Sequence
  chemically synthesized
cacaatccaggccctccttcct

SEQ ID NO: 768727 - DNA, 22 bp, Artificial Sequence
  chemically synthesized
cacaggaaggagggcctggatt

SEQ ID NO: 768728 - DNA, 22 bp, Artificial Sequence
  chemically synthesized
atacacaagccccttcacaatc

SEQ ID NO: 768729 - DNA, 22 bp, Artificial Sequence
  chemically synthesized
gatacacaagccccttcacaat

SEQ ID NO: 768730 - DNA, 22 bp, Artificial Sequence
  chemically synthesized
gcttgatacacaagccccttca

SEQ ID NO: 768731 - DNA, 22 bp, Artificial Sequence
  chemically synthesized
agcttgatacacaagccccttc

SEQ ID NO: 768732 - DNA, 22 bp, Artificial Sequence
  chemically synthesized
gattgtgaaggggcttgtgtat

SEQ ID NO: 768733 - DNA, 22 bp, Artificial Sequence
  chemically synthesized
tgaaggggcttgtgtatcaagc

SEQ ID NO: 768734 - DNA, 22 bp, Artificial Sequence
  chemically synthesized
gtgtatcaagctaagggtttgg

SEQ ID NO: 768735 - DNA, 22 bp, Artificial Sequence
  chemically synthesized
acaggataaagtccaaaccctt

SEQ ID NO: 768736 - DNA, 22 bp, Artificial Sequence
  chemically synthesized
tgtatcaagctaagggtttgga

SEQ ID NO: 768737 - DNA, 22 bp, Artificial Sequence
  chemically synthesized
cacaggataaagtccaaaccct

SEQ ID NO: 768738 - DNA, 22 bp, Artificial Sequence
  chemically synthesized
gacatcttcacaggataaagtc

SEQ ID NO: 768739 - DNA, 22 bp, Artificial Sequence
  chemically synthesized
agggtttggactttatcctgtg

SEQ ID NO: 768740 - DNA, 22 bp, Artificial Sequence
  chemically synthesized
aacagattagacatcttcacag

SEQ ID NO: 768741 - DNA, 22 bp, Artificial Sequence
  chemically synthesized
aaacagattagacatcttcaca

SEQ ID NO: 768742 - DNA, 22 bp, Artificial Sequence
  chemically synthesized
ggactttatcctgtgaagatgt

SEQ ID NO: 768743 - DNA, 22 bp, Artificial Sequence
  chemically synthesized
gactttatcctgtgaagatgtc

SEQ ID NO: 768744 - DNA, 22 bp, Artificial Sequence
  chemically synthesized
tatcctgtgaagatgtctaatc

SEQ ID NO: 768745 - DNA, 22 bp, Artificial Sequence
  chemically synthesized
atcctgtgaagatgtctaatct

SEQ ID NO: 768746 - DNA, 22 bp, Artificial Sequence
  chemically synthesized
tcctgtgaagatgtctaatctg

SEQ ID NO: 768747 - DNA, 22 bp, Artificial Sequence
  chemically synthesized
ccaaaaaatcttaaacagatta

SEQ ID NO: 768748 - DNA, 22 bp, Artificial Sequence
  chemically synthesized
tgaagatgtctaatctgtttaa

SEQ ID NO: 768749 - DNA, 22 bp, Artificial Sequence
  chemically synthesized
atctgtttaagattttttggta

SEQ ID NO: 768750 - DNA, 22 bp, Artificial Sequence
  chemically synthesized
ccaccaagatgatgttaccaaa

SEQ ID NO: 768751 - DNA, 22 bp, Artificial Sequence
  chemically synthesized
tttaagattttttggtaacatc

SEQ ID NO: 768752 - DNA, 22 bp, Artificial Sequence
  chemically synthesized
actgccaccaagatgatgttac

SEQ ID NO: 768753 - DNA, 22 bp, Artificial Sequence
  chemically synthesized
aagattttttggtaacatcatc

SEQ ID NO: 768754 - DNA, 22 bp, Artificial Sequence
  chemically synthesized
cactgccaccaagatgatgtta

SEQ ID NO: 768755 - DNA, 22 bp, Artificial Sequence
  chemically synthesized
agattttttggtaacatcatct

SEQ ID NO: 768756 - DNA, 22 bp, Artificial Sequence
  chemically synthesized
tcactgccaccaagatgatgtt

SEQ ID NO: 768757 - DNA, 22 bp, Artificial Sequence
  chemically synthesized
ttcactgccaccaagatgatgt

SEQ ID NO: 768758 - DNA, 22 bp, Artificial Sequence
  chemically synthesized
tttggtaacatcatcttggtgg

SEQ ID NO: 768759 - DNA, 22 bp, Artificial Sequence
  chemically synthesized
ttggtaacatcatcttggtggc

SEQ ID NO: 768760 - DNA, 22 bp, Artificial Sequence
  chemically synthesized
tggtaacatcatcttggtggca

SEQ ID NO: 768761 - DNA, 22 bp, Artificial Sequence
  chemically synthesized
ggtaacatcatcttggtggcag

SEQ ID NO: 768762 - DNA, 22 bp, Artificial Sequence
  chemically synthesized
gtaacatcatcttggtggcagt

SEQ ID NO: 768763 - DNA, 22 bp, Artificial Sequence
  chemically synthesized
atgtaccttttcactgccacca

SEQ ID NO: 768764 - DNA, 22 bp, Artificial Sequence
  chemically synthesized
taatgtaccttttcactgccac

SEQ ID NO: 768765 - DNA, 22 bp, Artificial Sequence
  chemically synthesized
cctctaatgtaccttttcactg

SEQ ID NO: 768766 - DNA, 22 bp, Artificial Sequence
  chemically synthesized
gcctctaatgtaccttttcact

SEQ ID NO: 768767 - DNA, 22 bp, Artificial Sequence
  chemically synthesized
ttgcctctaatgtaccttttca

SEQ ID NO: 768768 - DNA, 22 bp, Artificial Sequence
  chemically synthesized
ggtggcagtgaaaaggtacatt

SEQ ID NO: 768769 - DNA, 22 bp, Artificial Sequence
  chemically synthesized
gtggcagtgaaaaggtacatta

SEQ ID NO: 768770 - DNA, 22 bp, Artificial Sequence
  chemically synthesized
atgttcttgcctctaatgtacc

SEQ ID NO: 768771 - DNA, 22 bp, Artificial Sequence
  chemically synthesized
taatgttcttgcctctaatgta

SEQ ID NO: 768772 - DNA, 22 bp, Artificial Sequence
  chemically synthesized
cctctaatgttcttgcctctaa

SEQ ID NO: 768773 - DNA, 22 bp, Artificial Sequence
  chemically synthesized
gcctctaatgttcttgcctcta

SEQ ID NO: 768774 - DNA, 22 bp, Artificial Sequence
  chemically synthesized
ttgcctctaatgttcttgcctc

SEQ ID NO: 768775 - DNA, 22 bp, Artificial Sequence
  chemically synthesized
tcttgcctctaatgttcttgcc

SEQ ID NO: 768776 - DNA, 22 bp, Artificial Sequence
  chemically synthesized
catattctcttgcctctaatgt

SEQ ID NO: 768777 - DNA, 22 bp, Artificial Sequence
  chemically synthesized
gaggcaagaacattagaggcaa

SEQ ID NO: 768778 - DNA, 22 bp, Artificial Sequence
  chemically synthesized
gatctccatattctcttgcctc

SEQ ID NO: 768779 - DNA, 22 bp, Artificial Sequence
  chemically synthesized
agatctccatattctcttgcct

SEQ ID NO: 768780 - DNA, 22 bp, Artificial Sequence
  chemically synthesized
agtttagatctccatattctct

SEQ ID NO: 768781 - DNA, 22 bp, Artificial Sequence
  chemically synthesized
cctcagtttagatctccatatt

SEQ ID NO: 768782 - DNA, 22 bp, Artificial Sequence
  chemically synthesized
gaggcaagagaatatggagatc

SEQ ID NO: 768783 - DNA, 22 bp, Artificial Sequence
  chemically synthesized
ttacctcagtttagatctccat

SEQ ID NO: 768784 - DNA, 22 bp, Artificial Sequence
  chemically synthesized
tgtctattacctcagtttagat

SEQ ID NO: 768785 - DNA, 22 bp, Artificial Sequence
  chemically synthesized
atcctgtgtctattacctcagt

SEQ ID NO: 768786 - DNA, 22 bp, Artificial Sequence
  chemically synthesized
tcatcctgtgtctattacctca

SEQ ID NO: 768787 - DNA, 22 bp, Artificial Sequence
  chemically synthesized
ctcatcctgtgtctattacctc

SEQ ID NO: 768788 - DNA, 22 bp, Artificial Sequence
  chemically synthesized
tctcatcctgtgtctattacct

SEQ ID NO: 768789 - DNA, 22 bp, Artificial Sequence
  chemically synthesized
ttctcatcctgtgtctattacc

SEQ ID NO: 768790 - DNA, 22 bp, Artificial Sequence
  chemically synthesized
tttctcatcctgtgtctattac

SEQ ID NO: 768791 - DNA, 22 bp, Artificial Sequence
  chemically synthesized
cctttttctcatcctgtgtcta

SEQ ID NO: 768792 - DNA, 22 bp, Artificial Sequence
  chemically synthesized
aactgaggtaatagacacagga

SEQ ID NO: 768793 - DNA, 22 bp, Artificial Sequence
  chemically synthesized
aggtaatagacacaggatgaga

SEQ ID NO: 768794 - DNA, 22 bp, Artificial Sequence
  chemically synthesized
aaaaatatctccctttttctca

SEQ ID NO: 768795 - DNA, 22 bp, Artificial Sequence
  chemically synthesized
tcaaaaatatctccctttttct

SEQ ID NO: 768796 - DNA, 22 bp, Artificial Sequence
  chemically synthesized
atgatctctcaaaaatatctcc

SEQ ID NO: 768797 - DNA, 22 bp, Artificial Sequence
  chemically synthesized
tattcatgatctctcaaaaata

SEQ ID NO: 768798 - DNA, 22 bp, Artificial Sequence
  chemically synthesized
agttgtattcatgatctctcaa

SEQ ID NO: 768799 - DNA, 22 bp, Artificial Sequence
  chemically synthesized
taagttgtattcatgatctctc

SEQ ID NO: 768800 - DNA, 22 bp, Artificial Sequence
  chemically synthesized
ttgagagatcatgaatacaact

SEQ ID NO: 768801 - DNA, 22 bp, Artificial Sequence
  chemically synthesized
agtcagtctctaagttgtattc

SEQ ID NO: 768802 - DNA, 22 bp, Artificial Sequence
  chemically synthesized
tgagagatcatgaatacaactt

SEQ ID NO: 768803 - DNA, 22 bp, Artificial Sequence
  chemically synthesized
gagagatcatgaatacaactta

SEQ ID NO: 768804 - DNA, 22 bp, Artificial Sequence
  chemically synthesized
agagatcatgaatacaacttag

SEQ ID NO: 768805 - DNA, 22 bp, Artificial Sequence
  chemically synthesized
cattcagtcagtctctaagttg

SEQ ID NO: 768806 - DNA, 22 bp, Artificial Sequence
  chemically synthesized
gcattcagtcagtctctaagtt

SEQ ID NO: 768807 - DNA, 22 bp, Artificial Sequence
  chemically synthesized
tccttgcattcagtcagtctct

SEQ ID NO: 768808 - DNA, 22 bp, Artificial Sequence
  chemically synthesized
tatgttatccttgcattcagtc

SEQ ID NO: 768809 - DNA, 22 bp, Artificial Sequence
  chemically synthesized
cctatatgttatccttgcattc

SEQ ID NO: 768810 - DNA, 22 bp, Artificial Sequence
  chemically synthesized
agagactgactgaatgcaagga

SEQ ID NO: 768811 - DNA, 22 bp, Artificial Sequence
  chemically synthesized
gagactgactgaatgcaaggat

SEQ ID NO: 768812 - DNA, 22 bp, Artificial Sequence
  chemically synthesized
cctccctatatgttatccttgc

SEQ ID NO: 768813 - DNA, 22 bp, Artificial Sequence
  chemically synthesized
gcctccctatatgttatccttg

SEQ ID NO: 768814 - DNA, 22 bp, Artificial Sequence
  chemically synthesized
actgaatgcaaggataacatat

SEQ ID NO: 768815 - DNA, 22 bp, Artificial Sequence
  chemically synthesized
aatgcaaggataacatataggg

SEQ ID NO: 768816 - DNA, 22 bp, Artificial Sequence
  chemically synthesized
agccagaaacccaacttgcctc

SEQ ID NO: 768817 - DNA, 22 bp, Artificial Sequence
  chemically synthesized
taagccagaaacccaacttgcc

SEQ ID NO: 768818 - DNA, 22 bp, Artificial Sequence
  chemically synthesized
tctaagccagaaacccaacttg

SEQ ID NO: 768819 - DNA, 22 bp, Artificial Sequence
  chemically synthesized
ctctaagccagaaacccaactt

SEQ ID NO: 768820 - DNA, 22 bp, Artificial Sequence
  chemically synthesized
ttctctaagccagaaacccaac

SEQ ID NO: 768821 - DNA, 22 bp, Artificial Sequence
  chemically synthesized
cttctctaagccagaaacccaa

SEQ ID NO: 768822 - DNA, 22 bp, Artificial Sequence
  chemically synthesized
tcacccccatcttcttctctaa

SEQ ID NO: 768823 - DNA, 22 bp, Artificial Sequence
  chemically synthesized
ggtttctggcttagagaagaag

SEQ ID NO: 768824 - DNA, 22 bp, Artificial Sequence
  chemically synthesized
ctggcttagagaagaagatggg

SEQ ID NO: 768825 - DNA, 22 bp, Artificial Sequence
  chemically synthesized
tggcttagagaagaagatgggg

SEQ ID NO: 768826 - DNA, 22 bp, Artificial Sequence
  chemically synthesized
gcttagagaagaagatgggggt

SEQ ID NO: 768827 - DNA, 22 bp, Artificial Sequence
  chemically synthesized
agagaagaagatgggggtgata

SEQ ID NO: 768828 - DNA, 22 bp, Artificial Sequence
  chemically synthesized
gagaagaagatgggggtgataa

SEQ ID NO: 768829 - DNA, 22 bp, Artificial Sequence
  chemically synthesized
ataataggtagcattatcaccc

SEQ ID NO: 768830 - DNA, 22 bp, Artificial Sequence
  chemically synthesized
aataataggtagcattatcacc

SEQ ID NO: 768831 - DNA, 22 bp, Artificial Sequence
  chemically synthesized
taataataggtagcattatcac

SEQ ID NO: 768832 - DNA, 22 bp, Artificial Sequence
  chemically synthesized
aacactttaataataggtagca

SEQ ID NO: 768833 - DNA, 22 bp, Artificial Sequence
  chemically synthesized
gaaattcaacactttaataata

SEQ ID NO: 768834 - DNA, 22 bp, Artificial Sequence
  chemically synthesized
ggaaattcaacactttaataat

SEQ ID NO: 768835 - DNA, 22 bp, Artificial Sequence
  chemically synthesized
cttggaaattcaacactttaat

SEQ ID NO: 768836 - DNA, 22 bp, Artificial Sequence
  chemically synthesized
cctattattaaagtgttgaatt

SEQ ID NO: 768837 - DNA, 22 bp, Artificial Sequence
  chemically synthesized
acatctccttggaaattcaaca

SEQ ID NO: 768838 - DNA, 22 bp, Artificial Sequence
  chemically synthesized
ttattaaagtgttgaatttcca

SEQ ID NO: 768839 - DNA, 22 bp, Artificial Sequence
  chemically synthesized
ctcacatctccttggaaattca

SEQ ID NO: 768840 - DNA, 22 bp, Artificial Sequence
  chemically synthesized
ttaaagtgttgaatttccaagg

SEQ ID NO: 768841 - DNA, 22 bp, Artificial Sequence
  chemically synthesized
aactgctcacatctccttggaa

SEQ ID NO: 768842 - DNA, 22 bp, Artificial Sequence
  chemically synthesized
aagtgttgaatttccaaggaga

SEQ ID NO: 768843 - DNA, 22 bp, Artificial Sequence
  chemically synthesized
tgttaaactgctcacatctcct

SEQ ID NO: 768844 - DNA, 22 bp, Artificial Sequence
  chemically synthesized
aatttccaaggagatgtgagca

SEQ ID NO: 768845 - DNA, 22 bp, Artificial Sequence
  chemically synthesized
agcctatgttaaactgctcaca

SEQ ID NO: 768846 - DNA, 22 bp, Artificial Sequence
  chemically synthesized
ccaaggagatgtgagcagttta

SEQ ID NO: 768847 - DNA, 22 bp, Artificial Sequence
  chemically synthesized
caaggagatgtgagcagtttaa

SEQ ID NO: 768848 - DNA, 22 bp, Artificial Sequence
  chemically synthesized
agtgacaggctaagcctatgtt

SEQ ID NO: 768849 - DNA, 22 bp, Artificial Sequence
  chemically synthesized
tcactaagtgacaggctaagcc

SEQ ID NO: 768850 - DNA, 22 bp, Artificial Sequence
  chemically synthesized
aacataggcttagcctgtcact

SEQ ID NO: 768851 - DNA, 22 bp, Artificial Sequence
  chemically synthesized
acataggcttagcctgtcactt

SEQ ID NO: 768852 - DNA, 22 bp, Artificial Sequence
  chemically synthesized
cacaccctatcactaagtgaca

SEQ ID NO: 768853 - DNA, 22 bp, Artificial Sequence
  chemically synthesized
ccacaccctatcactaagtgac

SEQ ID NO: 768854 - DNA, 22 bp, Artificial Sequence
  chemically synthesized
ccttccacaccctatcactaag

SEQ ID NO: 768855 - DNA, 22 bp, Artificial Sequence
  chemically synthesized
tcccttccacaccctatcacta

SEQ ID NO: 768856 - DNA, 22 bp, Artificial Sequence
  chemically synthesized
agcctgtcacttagtgataggg

SEQ ID NO: 768857 - DNA, 22 bp, Artificial Sequence
  chemically synthesized
gcctgtcacttagtgatagggt

SEQ ID NO: 768858 - DNA, 22 bp, Artificial Sequence
  chemically synthesized
tcacttagtgatagggtgtgga

SEQ ID NO: 768859 - DNA, 22 bp, Artificial Sequence
  chemically synthesized
agtgatagggtgtggaagggag

SEQ ID NO: 768860 - DNA, 22 bp, Artificial Sequence
  chemically synthesized
gtgatagggtgtggaagggaga

SEQ ID NO: 768861 - DNA, 22 bp, Artificial Sequence
  chemically synthesized
acctttgtcggggggtacgtgt

SEQ ID NO: 768862 - DNA, 22 bp, Artificial Sequence
  chemically synthesized
tgtcggggggtacgtgtcatcc

SEQ ID NO: 768863 - DNA, 22 bp, Artificial Sequence
  chemically synthesized
gtcggggggtacgtgtcatcca

SEQ ID NO: 768864 - DNA, 22 bp, Artificial Sequence
  chemically synthesized
tcggggggtacgtgtcatccac

SEQ ID NO: 768865 - DNA, 22 bp, Artificial Sequence
  chemically synthesized
ccatgcccatgagtggatgaca

SEQ ID NO: 768866 - DNA, 22 bp, Artificial Sequence
  chemically synthesized
aggctaccatgcccatgagtgg

SEQ ID NO: 768867 - DNA, 22 bp, Artificial Sequence
  chemically synthesized
caggctaccatgcccatgagtg

SEQ ID NO: 768868 - DNA, 22 bp, Artificial Sequence
  chemically synthesized
tttcaggctaccatgcccatga

SEQ ID NO: 768869 - DNA, 22 bp, Artificial Sequence
  chemically synthesized
ccgcccctatttcaggctacca

SEQ ID NO: 768870 - DNA, 22 bp, Artificial Sequence
  chemically synthesized
accgcccctatttcaggctacc

SEQ ID NO: 768871 - DNA, 22 bp, Artificial Sequence
  chemically synthesized
taccgcccctatttcaggctac

SEQ ID NO: 768872 - DNA, 22 bp, Artificial Sequence
  chemically synthesized
tttaccgcccctatttcaggct

SEQ ID NO: 768873 - DNA, 22 bp, Artificial Sequence
  chemically synthesized
atgggcatggtagcctgaaata

SEQ ID NO: 768874 - DNA, 22 bp, Artificial Sequence
  chemically synthesized
ctttaccgcccctatttcaggc

SEQ ID NO: 768875 - DNA, 22 bp, Artificial Sequence
  chemically synthesized
ggcccttctttaccgcccctat

SEQ ID NO: 768876 - DNA, 22 bp, Artificial Sequence
  chemically synthesized
ctgggcccttctttaccgcccc

SEQ ID NO: 768877 - DNA, 22 bp, Artificial Sequence
  chemically synthesized
cctgctgggcccttctttaccg

SEQ ID NO: 768878 - DNA, 22 bp, Artificial Sequence
  chemically synthesized
aaataggggcggtaaagaaggg

SEQ ID NO: 768879 - DNA, 22 bp, Artificial Sequence
  chemically synthesized
actccctgctgggcccttcttt

SEQ ID NO: 768880 - DNA, 22 bp, Artificial Sequence
  chemically synthesized
tctgactccctgctgggccctt

SEQ ID NO: 768881 - DNA, 22 bp, Artificial Sequence
  chemically synthesized
agagagcaagaaagacaacata

SEQ ID NO: 768882 - DNA, 22 bp, Artificial Sequence
  chemically synthesized
tgttgtctttcttgctctctca

SEQ ID NO: 768883 - DNA, 22 bp, Artificial Sequence
  chemically synthesized
tctttcttgctctctcaggcgt

SEQ ID NO: 768884 - DNA, 22 bp, Artificial Sequence
  chemically synthesized
tcttgctctctcaggcgtctgt

SEQ ID NO: 768885 - DNA, 22 bp, Artificial Sequence
  chemically synthesized
cttgctctctcaggcgtctgtg

SEQ ID NO: 768886 - DNA, 22 bp, Artificial Sequence
  chemically synthesized
ttgctctctcaggcgtctgtgt

SEQ ID NO: 768887 - DNA, 22 bp, Artificial Sequence
  chemically synthesized
gctctctcaggcgtctgtgttc

SEQ ID NO: 768888 - DNA, 22 bp, Artificial Sequence
  chemically synthesized
ctctctcaggcgtctgtgttct

SEQ ID NO: 768889 - DNA, 22 bp, Artificial Sequence
  chemically synthesized
tctcaggcgtctgtgttctttg

SEQ ID NO: 768890 - DNA, 22 bp, Artificial Sequence
  chemically synthesized
tcaggcgtctgtgttctttgtg

SEQ ID NO: 768891 - DNA, 22 bp, Artificial Sequence
  chemically synthesized
aggcgtctgtgttctttgtgtc

SEQ ID NO: 768892 - DNA, 22 bp, Artificial Sequence
  chemically synthesized
acaggcacgtgtgaatgacaca

SEQ ID NO: 768893 - DNA, 22 bp, Artificial Sequence
  chemically synthesized
tgttctttgtgtcattcacacg

SEQ ID NO: 768894 - DNA, 22 bp, Artificial Sequence
  chemically synthesized
acgctcacaggcacgtgtgaat

SEQ ID NO: 768895 - DNA, 22 bp, Artificial Sequence
  chemically synthesized
tttgtgtcattcacacgtgcct

SEQ ID NO: 768896 - DNA, 22 bp, Artificial Sequence
  chemically synthesized
tgtgtcattcacacgtgcctgt

SEQ ID NO: 768897 - DNA, 22 bp, Artificial Sequence
  chemically synthesized
gtgtcattcacacgtgcctgtg

SEQ ID NO: 768898 - DNA, 22 bp, Artificial Sequence
  chemically synthesized
tgtcattcacacgtgcctgtga

SEQ ID NO: 768899 - DNA, 22 bp, Artificial Sequence
  chemically synthesized
acacgtgcctgtgagcgtgaac

SEQ ID NO: 768900 - DNA, 22 bp, Artificial Sequence
  chemically synthesized
atgcatgatgcaagttcacgct

SEQ ID NO: 768901 - DNA, 22 bp, Artificial Sequence
  chemically synthesized
ctgatgcatgatgcaagttcac

SEQ ID NO: 768902 - DNA, 22 bp, Artificial Sequence
  chemically synthesized
tgagcgtgaacttgcatcatgc

SEQ ID NO: 768903 - DNA, 22 bp, Artificial Sequence
  chemically synthesized
agggaactactgatgcatgatg

SEQ ID NO: 768904 - DNA, 22 bp, Artificial Sequence
  chemically synthesized
tactaagggaactactgatgca

SEQ ID NO: 768905 - DNA, 22 bp, Artificial Sequence
  chemically synthesized
gcatcatgcatcagtagttccc

SEQ ID NO: 768906 - DNA, 22 bp, Artificial Sequence
  chemically synthesized
catcatgcatcagtagttccct

SEQ ID NO: 768907 - DNA, 22 bp, Artificial Sequence
  chemically synthesized
agaaccactgtactaagggaac

SEQ ID NO: 768908 - DNA, 22 bp, Artificial Sequence
  chemically synthesized
gagaaccactgtactaagggaa

SEQ ID NO: 768909 - DNA, 22 bp, Artificial Sequence
  chemically synthesized
aagtttgagaaccactgtacta

SEQ ID NO: 768910 - DNA, 22 bp, Artificial Sequence
  chemically synthesized
ccttagtacagtggttctcaaa

SEQ ID NO: 768911 - DNA, 22 bp, Artificial Sequence
  chemically synthesized
aagcccactcaagtttgagaac

SEQ ID NO: 768912 - DNA, 22 bp, Artificial Sequence
  chemically synthesized
tcaagcccactcaagtttgaga

SEQ ID NO: 768913 - DNA, 22 bp, Artificial Sequence
  chemically synthesized
agtacagtggttctcaaacttg

SEQ ID NO: 768914 - DNA, 22 bp, Artificial Sequence
  chemically synthesized
gtacagtggttctcaaacttga

SEQ ID NO: 768915 - DNA, 22 bp, Artificial Sequence
  chemically synthesized
ggtgattctcaagcccactcaa

SEQ ID NO: 768916 - DNA, 22 bp, Artificial Sequence
  chemically synthesized
tgggtgattctcaagcccactc

SEQ ID NO: 768917 - DNA, 22 bp, Artificial Sequence
  chemically synthesized
tcaaacttgagtgggcttgaga

SEQ ID NO: 768918 - DNA, 22 bp, Artificial Sequence
  chemically synthesized
aaacttgagtgggcttgagaat

SEQ ID NO: 768919 - DNA, 22 bp, Artificial Sequence
  chemically synthesized
atgagccctctgggtgattctc

SEQ ID NO: 768920 - DNA, 22 bp, Artificial Sequence
  chemically synthesized
aatgagccctctgggtgattct

SEQ ID NO: 768921 - DNA, 22 bp, Artificial Sequence
  chemically synthesized
gagtgggcttgagaatcaccca

SEQ ID NO: 768922 - DNA, 22 bp, Artificial Sequence
  chemically synthesized
taatgagccctctgggtgattc

SEQ ID NO: 768923 - DNA, 22 bp, Artificial Sequence
  chemically synthesized
agtgggcttgagaatcacccag

SEQ ID NO: 768924 - DNA, 22 bp, Artificial Sequence
  chemically synthesized
tgttttaatgagccctctgggt

SEQ ID NO: 768925 - DNA, 22 bp, Artificial Sequence
  chemically synthesized
gagaatcacccagagggctcat

SEQ ID NO: 768926 - DNA, 22 bp, Artificial Sequence
  chemically synthesized
agaatcacccagagggctcatt

SEQ ID NO: 768927 - DNA, 22 bp, Artificial Sequence
  chemically synthesized
agagtggagcccagcagcctgt

SEQ ID NO: 768928 - DNA, 22 bp, Artificial Sequence
  chemically synthesized
tcagagtggagcccagcagcct

SEQ ID NO: 768929 - DNA, 22 bp, Artificial Sequence
  chemically synthesized
attaaaacacaggctgctgggc

SEQ ID NO: 768930 - DNA, 22 bp, Artificial Sequence
  chemically synthesized
aaacacaggctgctgggctcca

SEQ ID NO: 768931 - DNA, 22 bp, Artificial Sequence
  chemically synthesized
ctgggctccactctgagagatc

SEQ ID NO: 768932 - DNA, 22 bp, Artificial Sequence
  chemically synthesized
ggctccactctgagagatcatg

SEQ ID NO: 768933 - DNA, 22 bp, Artificial Sequence
  chemically synthesized
cactctgagagatcatgattct

SEQ ID NO: 768934 - DNA, 22 bp, Artificial Sequence
  chemically synthesized
ccccagacatacagaatcatga

SEQ ID NO: 768935 - DNA, 22 bp, Artificial Sequence
  chemically synthesized
taccccagacatacagaatcat

SEQ ID NO: 768936 - DNA, 22 bp, Artificial Sequence
  chemically synthesized
tgagagatcatgattctgtatg

SEQ ID NO: 768937 - DNA, 22 bp, Artificial Sequence
  chemically synthesized
agagatcatgattctgtatgtc

SEQ ID NO: 768938 - DNA, 22 bp, Artificial Sequence
  chemically synthesized
agttctaccccagacatacaga

SEQ ID NO: 768939 - DNA, 22 bp, Artificial Sequence
  chemically synthesized
gagttctaccccagacatacag

SEQ ID NO: 768940 - DNA, 22 bp, Artificial Sequence
  chemically synthesized
ttgagttctaccccagacatac

SEQ ID NO: 768941 - DNA, 22 bp, Artificial Sequence
  chemically synthesized
tgtatgtctggggtagaactca

SEQ ID NO: 768942 - DNA, 22 bp, Artificial Sequence
  chemically synthesized
tatgtctggggtagaactcaag

SEQ ID NO: 768943 - DNA, 22 bp, Artificial Sequence
  chemically synthesized
agaaatgcaaattcttgagttc

SEQ ID NO: 768944 - DNA, 22 bp, Artificial Sequence
  chemically synthesized
taagaaatgcaaattcttgagt

SEQ ID NO: 768945 - DNA, 22 bp, Artificial Sequence
  chemically synthesized
ctaagaaatgcaaattcttgag

SEQ ID NO: 768946 - DNA, 22 bp, Artificial Sequence
  chemically synthesized
gggtagaactcaagaatttgca

SEQ ID NO: 768947 - DNA, 22 bp, Artificial Sequence
  chemically synthesized
ggaacttctaagaaatgcaaat

SEQ ID NO: 768948 - DNA, 22 bp, Artificial Sequence
  chemically synthesized
gggaacttctaagaaatgcaaa

SEQ ID NO: 768949 - DNA, 22 bp, Artificial Sequence
  chemically synthesized
aagaatttgcatttcttagaag

SEQ ID NO: 768950 - DNA, 22 bp, Artificial Sequence
  chemically synthesized
gcatttcttagaagttcccaag

SEQ ID NO: 768951 - DNA, 22 bp, Artificial Sequence
  chemically synthesized
catttcttagaagttcccaagt

SEQ ID NO: 768952 - DNA, 22 bp, Artificial Sequence
  chemically synthesized
gcagtatcggcatcacttggga

SEQ ID NO: 768953 - DNA, 22 bp, Artificial Sequence
  chemically synthesized
cttagaagttcccaagtgatgc

SEQ ID NO: 768954 - DNA, 22 bp, Artificial Sequence
  chemically synthesized
ttagaagttcccaagtgatgcc

SEQ ID NO: 768955 - DNA, 22 bp, Artificial Sequence
  chemically synthesized
gactagcagtatcggcatcact

SEQ ID NO: 768956 - DNA, 22 bp, Artificial Sequence
  chemically synthesized
agaagttcccaagtgatgccga

SEQ ID NO: 768957 - DNA, 22 bp, Artificial Sequence
  chemically synthesized
gaagttcccaagtgatgccgat

SEQ ID NO: 768958 - DNA, 22 bp, Artificial Sequence
  chemically synthesized
tggactagcagtatcggcatca

SEQ ID NO: 768959 - DNA, 22 bp, Artificial Sequence
  chemically synthesized
ccaagtgatgccgatactgcta

SEQ ID NO: 768960 - DNA, 22 bp, Artificial Sequence
  chemically synthesized
aaatggggtctctggactagca

SEQ ID NO: 768961 - DNA, 22 bp, Artificial Sequence
  chemically synthesized
aaaatggggtctctggactagc

SEQ ID NO: 768962 - DNA, 22 bp, Artificial Sequence
  chemically synthesized
ttaaaatggggtctctggacta

SEQ ID NO: 768963 - DNA, 22 bp, Artificial Sequence
  chemically synthesized
attcttaaaatggggtctctgg

SEQ ID NO: 768964 - DNA, 22 bp, Artificial Sequence
  chemically synthesized
cattcttaaaatggggtctctg

SEQ ID NO: 768965 - DNA, 22 bp, Artificial Sequence
  chemically synthesized
ctagtccagagaccccatttta

SEQ ID NO: 768966 - DNA, 22 bp, Artificial Sequence
  chemically synthesized
gtccagagaccccattttaaga

SEQ ID NO: 768967 - DNA, 22 bp, Artificial Sequence
  chemically synthesized
gaacagtgtttcattcttaaaa

SEQ ID NO: 768968 - DNA, 22 bp, Artificial Sequence
  chemically synthesized
tgctagaacagtgtttcattct

SEQ ID NO: 768969 - DNA, 22 bp, Artificial Sequence
  chemically synthesized
ttatgctagaacagtgtttcat

SEQ ID NO: 768970 - DNA, 22 bp, Artificial Sequence
  chemically synthesized
taagaatgaaacactgttctag

SEQ ID NO: 768971 - DNA, 22 bp, Artificial Sequence
  chemically synthesized
agggctgttatgctagaacagt

SEQ ID NO: 768972 - DNA, 22 bp, Artificial Sequence
  chemically synthesized
aagaatgaaacactgttctagc

SEQ ID NO: 768973 - DNA, 22 bp, Artificial Sequence
  chemically synthesized
agaatgaaacactgttctagca

SEQ ID NO: 768974 - DNA, 22 bp, Artificial Sequence
  chemically synthesized
cagaagattaagggctgttatg

SEQ ID NO: 768975 - DNA, 22 bp, Artificial Sequence
  chemically synthesized
ttctagcataacagcccttaat

SEQ ID NO: 768976 - DNA, 22 bp, Artificial Sequence
  chemically synthesized
atgacctccagaagattaaggg

SEQ ID NO: 768977 - DNA, 22 bp, Artificial Sequence
  chemically synthesized
tagcataacagcccttaatctt

SEQ ID NO: 768978 - DNA, 22 bp, Artificial Sequence
  chemically synthesized
gcataacagcccttaatcttct

SEQ ID NO: 768979 - DNA, 22 bp, Artificial Sequence
  chemically synthesized
taaaggcattcatgacctccag

SEQ ID NO: 768980 - DNA, 22 bp, Artificial Sequence
  chemically synthesized
ataaaggcattcatgacctcca

SEQ ID NO: 768981 - DNA, 22 bp, Artificial Sequence
  chemically synthesized
ttataaaggcattcatgacctc

SEQ ID NO: 768982 - DNA, 22 bp, Artificial Sequence
  chemically synthesized
aatcttctggaggtcatgaatg

SEQ ID NO: 768983 - DNA, 22 bp, Artificial Sequence
  chemically synthesized
atcttctggaggtcatgaatgc

SEQ ID NO: 768984 - DNA, 22 bp, Artificial Sequence
  chemically synthesized
ctggaggtcatgaatgccttta

SEQ ID NO: 768985 - DNA, 22 bp, Artificial Sequence
  chemically synthesized
tggaggtcatgaatgcctttat

SEQ ID NO: 768986 - DNA, 22 bp, Artificial Sequence
  chemically synthesized
gaggtcatgaatgcctttataa

SEQ ID NO: 768987 - DNA, 22 bp, Artificial Sequence
  chemically synthesized
aggagaagatccatcattctta

SEQ ID NO: 768988 - DNA, 22 bp, Artificial Sequence
  chemically synthesized
gaggagaagatccatcattctt

SEQ ID NO: 768989 - DNA, 22 bp, Artificial Sequence
  chemically synthesized
tgaggagaagatccatcattct

SEQ ID NO: 768990 - DNA, 22 bp, Artificial Sequence
  chemically synthesized
ttgaggagaagatccatcattc

SEQ ID NO: 768991 - DNA, 22 bp, Artificial Sequence
  chemically synthesized
tataagaatgatggatcttctc

SEQ ID NO: 768992 - DNA, 22 bp, Artificial Sequence
  chemically synthesized
caggtttttgaggagaagatcc

SEQ ID NO: 768993 - DNA, 22 bp, Artificial Sequence
  chemically synthesized
ataagaatgatggatcttctcc

SEQ ID NO: 768994 - DNA, 22 bp, Artificial Sequence
  chemically synthesized
taagaatgatggatcttctcct

SEQ ID NO: 768995 - DNA, 22 bp, Artificial Sequence
  chemically synthesized
tgcaggtttttgaggagaagat

SEQ ID NO: 768996 - DNA, 22 bp, Artificial Sequence
  chemically synthesized
ctgcaggtttttgaggagaaga

SEQ ID NO: 768997 - DNA, 22 bp, Artificial Sequence
  chemically synthesized
taaatatttctgcaggtttttg

SEQ ID NO: 768998 - DNA, 22 bp, Artificial Sequence
  chemically synthesized
ataaatatttctgcaggttttt

SEQ ID NO: 768999 - DNA, 22 bp, Artificial Sequence
  chemically synthesized
tgtttataaatatttctgcagg

SEQ ID NO: 769000 - DNA, 22 bp, Artificial Sequence
  chemically synthesized
ctcctcaaaaacctgcagaaat

SEQ ID NO: 769001 - DNA, 22 bp, Artificial Sequence
  chemically synthesized
gtgtttataaatatttctgcag

SEQ ID NO: 769002 - DNA, 22 bp, Artificial Sequence
  chemically synthesized
tcctcaaaaacctgcagaaata

SEQ ID NO: 769003 - DNA, 22 bp, Artificial Sequence
  chemically synthesized
tgtgtttataaatatttctgca

SEQ ID NO: 769004 - DNA, 22 bp, Artificial Sequence
  chemically synthesized
ctcaaaaacctgcagaaatatt

SEQ ID NO: 769005 - DNA, 22 bp, Artificial Sequence
  chemically synthesized
aaaaacctgcagaaatatttat

SEQ ID NO: 769006 - DNA, 22 bp, Artificial Sequence
  chemically synthesized
cagaaatatttataaacacaaa

SEQ ID NO: 769007 - DNA, 22 bp, Artificial Sequence
  chemically synthesized
ataaacacaaaatacgacctat

SEQ ID NO: 769008 - DNA, 22 bp, Artificial Sequence
  chemically synthesized
taaacacaaaatacgacctatt

SEQ ID NO: 769009 - DNA, 22 bp, Artificial Sequence
  chemically synthesized
ttacttcacgggcttctgctac

SEQ ID NO: 769010 - DNA, 22 bp, Artificial Sequence
  chemically synthesized
cttcacgggcttctgctactgc

SEQ ID NO: 769011 - DNA, 22 bp, Artificial Sequence
  chemically synthesized
cacgggcttctgctactgccac

SEQ ID NO: 769012 - DNA, 22 bp, Artificial Sequence
  chemically synthesized
acgggcttctgctactgccacc

SEQ ID NO: 769013 - DNA, 22 bp, Artificial Sequence
  chemically synthesized
ctgctactgccacctccacctc

SEQ ID NO: 769014 - DNA, 22 bp, Artificial Sequence
  chemically synthesized
tgctactgccacctccacctcc

SEQ ID NO: 769015 - DNA, 22 bp, Artificial Sequence
  chemically synthesized
ctactgccacctccacctccac

SEQ ID NO: 769016 - DNA, 22 bp, Artificial Sequence
  chemically synthesized
tatgtcccgggggtggaggtgg

SEQ ID NO: 769017 - DNA, 22 bp, Artificial Sequence
  chemically synthesized
ctgccacctccacctccacccc

SEQ ID NO: 769018 - DNA, 22 bp, Artificial Sequence
  chemically synthesized
ccacctccacctccacccccgg

SEQ ID NO: 769019 - DNA, 22 bp, Artificial Sequence
  chemically synthesized
atccattgtatgtcccgggggt

SEQ ID NO: 769020 - DNA, 22 bp, Artificial Sequence
  chemically synthesized
attaatccattgtatgtcccgg

SEQ ID NO: 769021 - DNA, 22 bp, Artificial Sequence
  chemically synthesized
cacctccacccccgggacatac

SEQ ID NO: 769022 - DNA, 22 bp, Artificial Sequence
  chemically synthesized
cattaatccattgtatgtcccg

SEQ ID NO: 769023 - DNA, 22 bp, Artificial Sequence
  chemically synthesized
tcttcattaatccattgtatgt

SEQ ID NO: 769024 - DNA, 22 bp, Artificial Sequence
  chemically synthesized
cacccccgggacatacaatgga

SEQ ID NO: 769025 - DNA, 22 bp, Artificial Sequence
  chemically synthesized
gaaggatacgttgtcttcatta

SEQ ID NO: 769026 - DNA, 22 bp, Artificial Sequence
  chemically synthesized
aaatggtactggaaggatacgt

SEQ ID NO: 769027 - DNA, 22 bp, Artificial Sequence
  chemically synthesized
aaaatggtactggaaggatacg

SEQ ID NO: 769028 - DNA, 22 bp, Artificial Sequence
  chemically synthesized
taaaatggtactggaaggatac

SEQ ID NO: 769029 - DNA, 22 bp, Artificial Sequence
  chemically synthesized
atgaagacaacgtatccttcca

SEQ ID NO: 769030 - DNA, 22 bp, Artificial Sequence
  chemically synthesized
ctttaaaatggtactggaagga

SEQ ID NO: 769031 - DNA, 22 bp, Artificial Sequence
  chemically synthesized
tcctttaaaatggtactggaag

SEQ ID NO: 769032 - DNA, 22 bp, Artificial Sequence
  chemically synthesized
ggggttctcctttaaaatggta

SEQ ID NO: 769033 - DNA, 22 bp, Artificial Sequence
  chemically synthesized
gggggttctcctttaaaatggt

SEQ ID NO: 769034 - DNA, 22 bp, Artificial Sequence
  chemically synthesized
ttgggggttctcctttaaaatg

SEQ ID NO: 769035 - DNA, 22 bp, Artificial Sequence
  chemically synthesized
cttgggggttctcctttaaaat

SEQ ID NO: 769036 - DNA, 22 bp, Artificial Sequence
  chemically synthesized
ttcttgggggttctcctttaaa

SEQ ID NO: 769037 - DNA, 22 bp, Artificial Sequence
  chemically synthesized
cttcttgggggttctcctttaa

SEQ ID NO: 769038 - DNA, 22 bp, Artificial Sequence
  chemically synthesized
ccagtaccattttaaaggagaa

SEQ ID NO: 769039 - DNA, 22 bp, Artificial Sequence
  chemically synthesized
cagtaccattttaaaggagaac

SEQ ID NO: 769040 - DNA, 22 bp, Artificial Sequence
  chemically synthesized
ttcttcttgggggttctccttt

SEQ ID NO: 769041 - DNA, 22 bp, Artificial Sequence
  chemically synthesized
caatgtattcttcttcttgggg

SEQ ID NO: 769042 - DNA, 22 bp, Artificial Sequence
  chemically synthesized
taaaggagaacccccaagaaga

SEQ ID NO: 769043 - DNA, 22 bp, Artificial Sequence
  chemically synthesized
ccaatgtattcttcttcttggg

SEQ ID NO: 769044 - DNA, 22 bp, Artificial Sequence
  chemically synthesized
aaaggagaacccccaagaagaa

SEQ ID NO: 769045 - DNA, 22 bp, Artificial Sequence
  chemically synthesized
tccaatgtattcttcttcttgg

SEQ ID NO: 769046 - DNA, 22 bp, Artificial Sequence
  chemically synthesized
aaggagaacccccaagaagaag

SEQ ID NO: 769047 - DNA, 22 bp, Artificial Sequence
  chemically synthesized
gtgccattttccaatgtattct

SEQ ID NO: 769048 - DNA, 22 bp, Artificial Sequence
  chemically synthesized
ggtgccattttccaatgtattc

SEQ ID NO: 769049 - DNA, 22 bp, Artificial Sequence
  chemically synthesized
tggtgccattttccaatgtatt

SEQ ID NO: 769050 - DNA, 22 bp, Artificial Sequence
  chemically synthesized
aataagtaaaatcacattttgg

SEQ ID NO: 769051 - DNA, 22 bp, Artificial Sequence
  chemically synthesized
gaaaatggcaccaaaatgtgat

SEQ ID NO: 769052 - DNA, 22 bp, Artificial Sequence
  chemically synthesized
agacaactaaataagtaaaatc

SEQ ID NO: 769053 - DNA, 22 bp, Artificial Sequence
  chemically synthesized
taagacaactaaataagtaaaa

SEQ ID NO: 769054 - DNA, 22 bp, Artificial Sequence
  chemically synthesized
ggagtaattctaagacaactaa

SEQ ID NO: 769055 - DNA, 22 bp, Artificial Sequence
  chemically synthesized
actgggagtaattctaagacaa

SEQ ID NO: 769056 - DNA, 22 bp, Artificial Sequence
  chemically synthesized
tacttatttagttgtcttagaa

SEQ ID NO: 769057 - DNA, 22 bp, Artificial Sequence
  chemically synthesized
acttatttagttgtcttagaat

SEQ ID NO: 769058 - DNA, 22 bp, Artificial Sequence
  chemically synthesized
cttatttagttgtcttagaatt

SEQ ID NO: 769059 - DNA, 22 bp, Artificial Sequence
  chemically synthesized
atttagttgtcttagaattact

SEQ ID NO: 769060 - DNA, 22 bp, Artificial Sequence
  chemically synthesized
tttagttgtcttagaattactc

SEQ ID NO: 769061 - DNA, 22 bp, Artificial Sequence
  chemically synthesized
agttgtcttagaattactccca

SEQ ID NO: 769062 - DNA, 22 bp, Artificial Sequence
  chemically synthesized
gttgtcttagaattactcccag

SEQ ID NO: 769063 - DNA, 22 bp, Artificial Sequence
  chemically synthesized
tacgtaggctcactgggagtaa

SEQ ID NO: 769064 - DNA, 22 bp, Artificial Sequence
  chemically synthesized
gtacgtaggctcactgggagta

SEQ ID NO: 769065 - DNA, 22 bp, Artificial Sequence
  chemically synthesized
tgtacgtaggctcactgggagt

SEQ ID NO: 769066 - DNA, 22 bp, Artificial Sequence
  chemically synthesized
tcttagaattactcccagtgag

SEQ ID NO: 769067 - DNA, 22 bp, Artificial Sequence
  chemically synthesized
agaattactcccagtgagccta

SEQ ID NO: 769068 - DNA, 22 bp, Artificial Sequence
  chemically synthesized
gaattactcccagtgagcctac

SEQ ID NO: 769069 - DNA, 22 bp, Artificial Sequence
  chemically synthesized
ctcccagtgagcctacgtacaa

SEQ ID NO: 769070 - DNA, 22 bp, Artificial Sequence
  chemically synthesized
ccagtgagcctacgtacaaaat

SEQ ID NO: 769071 - DNA, 22 bp, Artificial Sequence
  chemically synthesized
cccaaatcgggtcattttgtac

SEQ ID NO: 769072 - DNA, 22 bp, Artificial Sequence
  chemically synthesized
ccccaaatcgggtcattttgta

SEQ ID NO: 769073 - DNA, 22 bp, Artificial Sequence
  chemically synthesized
cttccccaaatcgggtcatttt

SEQ ID NO: 769074 - DNA, 22 bp, Artificial Sequence
  chemically synthesized
cgtacaaaatgacccgatttgg

SEQ ID NO: 769075 - DNA, 22 bp, Artificial Sequence
  chemically synthesized
acaggtctccttccccaaatcg

SEQ ID NO: 769076 - DNA, 22 bp, Artificial Sequence
  chemically synthesized
gacaggtctccttccccaaatc

SEQ ID NO: 769077 - DNA, 22 bp, Artificial Sequence
  chemically synthesized
tgacaggtctccttccccaaat

SEQ ID NO: 769078 - DNA, 22 bp, Artificial Sequence
  chemically synthesized
tcctttgacaggtctccttccc

SEQ ID NO: 769079 - DNA, 22 bp, Artificial Sequence
  chemically synthesized
ggggaaggagacctgtcaaagg

SEQ ID NO: 769080 - DNA, 22 bp, Artificial Sequence
  chemically synthesized
gggaaggagacctgtcaaagga

SEQ ID NO: 769081 - DNA, 22 bp, Artificial Sequence
  chemically synthesized
cacccaagaactgtcctttgac

SEQ ID NO: 769082 - DNA, 22 bp, Artificial Sequence
  chemically synthesized
attgcacccaagaactgtcctt

SEQ ID NO: 769083 - DNA, 22 bp, Artificial Sequence
  chemically synthesized
ctcattgcacccaagaactgtc

SEQ ID NO: 769084 - DNA, 22 bp, Artificial Sequence
  chemically synthesized
cctcattgcacccaagaactgt

SEQ ID NO: 769085 - DNA, 22 bp, Artificial Sequence
  chemically synthesized
tcaaaggacagttcttgggtgc

SEQ ID NO: 769086 - DNA, 22 bp, Artificial Sequence
  chemically synthesized
gagtgaaatgaatttcctcatt

SEQ ID NO: 769087 - DNA, 22 bp, Artificial Sequence
  chemically synthesized
ttgggtgcaatgaggaaattca

SEQ ID NO: 769088 - DNA, 22 bp, Artificial Sequence
  chemically synthesized
gggtgcaatgaggaaattcatt

SEQ ID NO: 769089 - DNA, 22 bp, Artificial Sequence
  chemically synthesized
ggtgcaatgaggaaattcattt

SEQ ID NO: 769090 - DNA, 22 bp, Artificial Sequence
  chemically synthesized
aatgtggttagagtgaaatgaa

SEQ ID NO: 769091 - DNA, 22 bp, Artificial Sequence
  chemically synthesized
tctgaatgtggttagagtgaaa

SEQ ID NO: 769092 - DNA, 22 bp, Artificial Sequence
  chemically synthesized
atttcactctaaccacattcag

SEQ ID NO: 769093 - DNA, 22 bp, Artificial Sequence
  chemically synthesized
cactctaaccacattcagataa

SEQ ID NO: 769094 - DNA, 22 bp, Artificial Sequence
  chemically synthesized
actctaaccacattcagataac

SEQ ID NO: 769095 - DNA, 22 bp, Artificial Sequence
  chemically synthesized
taaccacattcagataacctga

SEQ ID NO: 769096 - DNA, 22 bp, Artificial Sequence
  chemically synthesized
aaatgggaaaaggtcaggttat

SEQ ID NO: 769097 - DNA, 22 bp, Artificial Sequence
  chemically synthesized
accacattcagataacctgacc

SEQ ID NO: 769098 - DNA, 22 bp, Artificial Sequence
  chemically synthesized
agataacctgaccttttcccat

SEQ ID NO: 769099 - DNA, 22 bp, Artificial Sequence
  chemically synthesized
ccaagtgaatggcaggttaaaa

SEQ ID NO: 769100 - DNA, 22 bp, Artificial Sequence
  chemically synthesized
accttttcccattttaacctgc

SEQ ID NO: 769101 - DNA, 22 bp, Artificial Sequence
  chemically synthesized
cccaagtgaatggcaggttaaa

SEQ ID NO: 769102 - DNA, 22 bp, Artificial Sequence
  chemically synthesized
cttcccaagtgaatggcaggtt

SEQ ID NO: 769103 - DNA, 22 bp, Artificial Sequence
  chemically synthesized
ttcccattttaacctgccattc

SEQ ID NO: 769104 - DNA, 22 bp, Artificial Sequence
  chemically synthesized
tcccattttaacctgccattca

SEQ ID NO: 769105 - DNA, 22 bp, Artificial Sequence
  chemically synthesized
ttacttcccaagtgaatggcag

SEQ ID NO: 769106 - DNA, 22 bp, Artificial Sequence
  chemically synthesized
cccattttaacctgccattcac

SEQ ID NO: 769107 - DNA, 22 bp, Artificial Sequence
  chemically synthesized
gttacttcccaagtgaatggca

SEQ ID NO: 769108 - DNA, 22 bp, Artificial Sequence
  chemically synthesized
ccattttaacctgccattcact

SEQ ID NO: 769109 - DNA, 22 bp, Artificial Sequence
  chemically synthesized
tttgttacttcccaagtgaatg

SEQ ID NO: 769110 - DNA, 22 bp, Artificial Sequence
  chemically synthesized
ttatttgttacttcccaagtga

SEQ ID NO: 769111 - DNA, 22 bp, Artificial Sequence
  chemically synthesized
taacctgccattcacttgggaa

SEQ ID NO: 769112 - DNA, 22 bp, Artificial Sequence
  chemically synthesized
aacctgccattcacttgggaag

SEQ ID NO: 769113 - DNA, 22 bp, Artificial Sequence
  chemically synthesized
tgttatttgttacttcccaagt

SEQ ID NO: 769114 - DNA, 22 bp, Artificial Sequence
  chemically synthesized
acctgccattcacttgggaagt

SEQ ID NO: 769115 - DNA, 22 bp, Artificial Sequence
  chemically synthesized
tctgttatttgttacttcccaa

SEQ ID NO: 769116 - DNA, 22 bp, Artificial Sequence
  chemically synthesized
ccattcacttgggaagtaacaa

SEQ ID NO: 769117 - DNA, 22 bp, Artificial Sequence
  chemically synthesized
acttgggaagtaacaaataaca

SEQ ID NO: 769118 - DNA, 22 bp, Artificial Sequence
  chemically synthesized
cccacccacctctctgttattt

SEQ ID NO: 769119 - DNA, 22 bp, Artificial Sequence
  chemically synthesized
gggaagtaacaaataacagaga

SEQ ID NO: 769120 - DNA, 22 bp, Artificial Sequence
  chemically synthesized
ggaagtaacaaataacagagag

SEQ ID NO: 769121 - DNA, 22 bp, Artificial Sequence
  chemically synthesized
catggttacccacccacctctc

SEQ ID NO: 769122 - DNA, 22 bp, Artificial Sequence
  chemically synthesized
tccatggttacccacccacctc

SEQ ID NO: 769123 - DNA, 22 bp, Artificial Sequence
  chemically synthesized
ctccatggttacccacccacct

SEQ ID NO: 769124 - DNA, 22 bp, Artificial Sequence
  chemically synthesized
tctccatggttacccacccacc

SEQ ID NO: 769125 - DNA, 22 bp, Artificial Sequence
  chemically synthesized
ttctccatggttacccacccac

SEQ ID NO: 769126 - DNA, 22 bp, Artificial Sequence
  chemically synthesized
aatgcacccttttctccatggt

SEQ ID NO: 769127 - DNA, 22 bp, Artificial Sequence
  chemically synthesized
gctgaatgcacccttttctcca

SEQ ID NO: 769128 - DNA, 22 bp, Artificial Sequence
  chemically synthesized
cacaggcaggcccctggctgaa

SEQ ID NO: 769129 - DNA, 22 bp, Artificial Sequence
  chemically synthesized
ccacaggcaggcccctggctga

SEQ ID NO: 769130 - DNA, 22 bp, Artificial Sequence
  chemically synthesized
cgtccttccacaggcaggcccc

SEQ ID NO: 769131 - DNA, 22 bp, Artificial Sequence
  chemically synthesized
ctccgtccttccacaggcaggc

SEQ ID NO: 769132 - DNA, 22 bp, Artificial Sequence
  chemically synthesized
agccaggggcctgcctgtggaa

SEQ ID NO: 769133 - DNA, 22 bp, Artificial Sequence
  chemically synthesized
cccgaggtgcaaactgctccgt

SEQ ID NO: 769134 - DNA, 22 bp, Artificial Sequence
  chemically synthesized
cctgtggaaggacggagcagtt

SEQ ID NO: 769135 - DNA, 22 bp, Artificial Sequence
  chemically synthesized
ccccgaggtgcaaactgctccg

SEQ ID NO: 769136 - DNA, 22 bp, Artificial Sequence
  chemically synthesized
tccccgaggtgcaaactgctcc

SEQ ID NO: 769137 - DNA, 22 bp, Artificial Sequence
  chemically synthesized
tggaaggacggagcagtttgca

SEQ ID NO: 769138 - DNA, 22 bp, Artificial Sequence
  chemically synthesized
cgctttccccgaggtgcaaact

SEQ ID NO: 769139 - DNA, 22 bp, Artificial Sequence
  chemically synthesized
cctccgctttccccgaggtgca

SEQ ID NO: 769140 - DNA, 22 bp, Artificial Sequence
  chemically synthesized
gagccctacctccgctttcccc

SEQ ID NO: 769141 - DNA, 22 bp, Artificial Sequence
  chemically synthesized
gcacctcggggaaagcggaggt

SEQ ID NO: 769142 - DNA, 22 bp, Artificial Sequence
  chemically synthesized
cacctcggggaaagcggaggta

SEQ ID NO: 769143 - DNA, 22 bp, Artificial Sequence
  chemically synthesized
ggggaaagcggaggtagggctc

SEQ ID NO: 769144 - DNA, 22 bp, Artificial Sequence
  chemically synthesized
ccagacagagagcctagagccc

SEQ ID NO: 769145 - DNA, 22 bp, Artificial Sequence
  chemically synthesized
ggctaccagacagagagcctag

SEQ ID NO: 769146 - DNA, 22 bp, Artificial Sequence
  chemically synthesized
cctgggctaccagacagagagc

SEQ ID NO: 769147 - DNA, 22 bp, Artificial Sequence
  chemically synthesized
ccctgggctaccagacagagag

SEQ ID NO: 769148 - DNA, 22 bp, Artificial Sequence
  chemically synthesized
tttccctgggctaccagacaga

SEQ ID NO: 769149 - DNA, 22 bp, Artificial Sequence
  chemically synthesized
taggctctctgtctggtagccc

SEQ ID NO: 769150 - DNA, 22 bp, Artificial Sequence
  chemically synthesized
aactgtttccctgggctaccag

SEQ ID NO: 769151 - DNA, 22 bp, Artificial Sequence
  chemically synthesized
gaactgtttccctgggctacca

SEQ ID NO: 769152 - DNA, 22 bp, Artificial Sequence
  chemically synthesized
ggctctctgtctggtagcccag

SEQ ID NO: 769153 - DNA, 22 bp, Artificial Sequence
  chemically synthesized
atcttgaactgtttccctgggc

SEQ ID NO: 769154 - DNA, 22 bp, Artificial Sequence
  chemically synthesized
tctgtctggtagcccagggaaa

SEQ ID NO: 769155 - DNA, 22 bp, Artificial Sequence
  chemically synthesized
gatcttgaactgtttccctggg

SEQ ID NO: 769156 - DNA, 22 bp, Artificial Sequence
  chemically synthesized
tgatcttgaactgtttccctgg

SEQ ID NO: 769157 - DNA, 22 bp, Artificial Sequence
  chemically synthesized
tgtctggtagcccagggaaaca

SEQ ID NO: 769158 - DNA, 22 bp, Artificial Sequence
  chemically synthesized
tctggtagcccagggaaacagt

SEQ ID NO: 769159 - DNA, 22 bp, Artificial Sequence
  chemically synthesized
ctttgatcttgaactgtttccc

SEQ ID NO: 769160 - DNA, 22 bp, Artificial Sequence
  chemically synthesized
cctttgatcttgaactgtttcc

SEQ ID NO: 769161 - DNA, 22 bp, Artificial Sequence
  chemically synthesized
tcctttgatcttgaactgtttc

SEQ ID NO: 769162 - DNA, 22 bp, Artificial Sequence
  chemically synthesized
ttcctttgatcttgaactgttt

SEQ ID NO: 769163 - DNA, 22 bp, Artificial Sequence
  chemically synthesized
gtagcccagggaaacagttcaa

SEQ ID NO: 769164 - DNA, 22 bp, Artificial Sequence
  chemically synthesized
tcttttcctttgatcttgaact

SEQ ID NO: 769165 - DNA, 22 bp, Artificial Sequence
  chemically synthesized
attatcttttcctttgatcttg

SEQ ID NO: 769166 - DNA, 22 bp, Artificial Sequence
  chemically synthesized
aattatcttttcctttgatctt

SEQ ID NO: 769167 - DNA, 22 bp, Artificial Sequence
  chemically synthesized
ttaattatcttttcctttgatc

SEQ ID NO: 769168 - DNA, 22 bp, Artificial Sequence
  chemically synthesized
agcacattcttaattatctttt

SEQ ID NO: 769169 - DNA, 22 bp, Artificial Sequence
  chemically synthesized
aagatcaaaggaaaagataatt

SEQ ID NO: 769170 - DNA, 22 bp, Artificial Sequence
  chemically synthesized
aagcacattcttaattatcttt

SEQ ID NO: 769171 - DNA, 22 bp, Artificial Sequence
  chemically synthesized
taagcacattcttaattatctt

SEQ ID NO: 769172 - DNA, 22 bp, Artificial Sequence
  chemically synthesized
ttaagcacattcttaattatct

SEQ ID NO: 769173 - DNA, 22 bp, Artificial Sequence
  chemically synthesized
ttttaagcacattcttaattat

SEQ ID NO: 769174 - DNA, 22 bp, Artificial Sequence
  chemically synthesized
cttttaagcacattcttaatta

SEQ ID NO: 769175 - DNA, 22 bp, Artificial Sequence
  chemically synthesized
tcttttaagcacattcttaatt

SEQ ID NO: 769176 - DNA, 22 bp, Artificial Sequence
  chemically synthesized
aagttttcttttaagcacattc

SEQ ID NO: 769177 - DNA, 22 bp, Artificial Sequence
  chemically synthesized
gaagttttcttttaagcacatt

SEQ ID NO: 769178 - DNA, 22 bp, Artificial Sequence
  chemically synthesized
atttgaagttttcttttaagca

SEQ ID NO: 769179 - DNA, 22 bp, Artificial Sequence
  chemically synthesized
agaatgtgcttaaaagaaaact

SEQ ID NO: 769180 - DNA, 22 bp, Artificial Sequence
  chemically synthesized
tgtagcacagctgatttgaagt

SEQ ID NO: 769181 - DNA, 22 bp, Artificial Sequence
  chemically synthesized
gtgtagcacagctgatttgaag

SEQ ID NO: 769182 - DNA, 22 bp, Artificial Sequence
  chemically synthesized
tgtgtagcacagctgatttgaa

SEQ ID NO: 769183 - DNA, 22 bp, Artificial Sequence
  chemically synthesized
aaaagaaaacttcaaatcagct

SEQ ID NO: 769184 - DNA, 22 bp, Artificial Sequence
  chemically synthesized
aaagaaaacttcaaatcagctg

SEQ ID NO: 769185 - DNA, 22 bp, Artificial Sequence
  chemically synthesized
atatctttgtgtagcacagctg

SEQ ID NO: 769186 - DNA, 22 bp, Artificial Sequence
  chemically synthesized
tctcatatctttgtgtagcaca

SEQ ID NO: 769187 - DNA, 22 bp, Artificial Sequence
  chemically synthesized
caaatcagctgtgctacacaaa

SEQ ID NO: 769188 - DNA, 22 bp, Artificial Sequence
  chemically synthesized
aaatcagctgtgctacacaaag

SEQ ID NO: 769189 - DNA, 22 bp, Artificial Sequence
  chemically synthesized
caacaggcattgtctcatatct

SEQ ID NO: 769190 - DNA, 22 bp, Artificial Sequence
  chemically synthesized
tgctacacaaagatatgagaca

SEQ ID NO: 769191 - DNA, 22 bp, Artificial Sequence
  chemically synthesized
tacaacaggcattgtctcatat

SEQ ID NO: 769192 - DNA, 22 bp, Artificial Sequence
  chemically synthesized
tctacaacaggcattgtctcat

SEQ ID NO: 769193 - DNA, 22 bp, Artificial Sequence
  chemically synthesized
ctctacaacaggcattgtctca

SEQ ID NO: 769194 - DNA, 22 bp, Artificial Sequence
  chemically synthesized
tctctacaacaggcattgtctc

SEQ ID NO: 769195 - DNA, 22 bp, Artificial Sequence
  chemically synthesized
cacaaagatatgagacaatgcc

SEQ ID NO: 769196 - DNA, 22 bp, Artificial Sequence
  chemically synthesized
ttctctacaacaggcattgtct

SEQ ID NO: 769197 - DNA, 22 bp, Artificial Sequence
  chemically synthesized
ttttctctacaacaggcattgt

SEQ ID NO: 769198 - DNA, 22 bp, Artificial Sequence
  chemically synthesized
gggtaaagtcaaaatgctcttt

SEQ ID NO: 769199 - DNA, 22 bp, Artificial Sequence
  chemically synthesized
agggtaaagtcaaaatgctctt

SEQ ID NO: 769200 - DNA, 22 bp, Artificial Sequence
  chemically synthesized
ttgtagagaaaagagcattttg

SEQ ID NO: 769201 - DNA, 22 bp, Artificial Sequence
  chemically synthesized
ttagggtaaagtcaaaatgctc

SEQ ID NO: 769202 - DNA, 22 bp, Artificial Sequence
  chemically synthesized
tagagaaaagagcattttgact

SEQ ID NO: 769203 - DNA, 22 bp, Artificial Sequence
  chemically synthesized
tgactttaccctaagaatcttt

SEQ ID NO: 769204 - DNA, 22 bp, Artificial Sequence
  chemically synthesized
gactttaccctaagaatctttc

SEQ ID NO: 769205 - DNA, 22 bp, Artificial Sequence
  chemically synthesized
actttaccctaagaatctttct

SEQ ID NO: 769206 - DNA, 22 bp, Artificial Sequence
  chemically synthesized
tggaaagcacataagaaagatt

SEQ ID NO: 769207 - DNA, 22 bp, Artificial Sequence
  chemically synthesized
taccctaagaatctttcttatg

SEQ ID NO: 769208 - DNA, 22 bp, Artificial Sequence
  chemically synthesized
accctaagaatctttcttatgt

SEQ ID NO: 769209 - DNA, 22 bp, Artificial Sequence
  chemically synthesized
ccctaagaatctttcttatgtg

SEQ ID NO: 769210 - DNA, 22 bp, Artificial Sequence
  chemically synthesized
ggctatggaaagcacataagaa

SEQ ID NO: 769211 - DNA, 22 bp, Artificial Sequence
  chemically synthesized
agaatctttcttatgtgctttc

SEQ ID NO: 769212 - DNA, 22 bp, Artificial Sequence
  chemically synthesized
taccgctgggctatggaaagca

SEQ ID NO: 769213 - DNA, 22 bp, Artificial Sequence
  chemically synthesized
tcttatgtgctttccatagccc

SEQ ID NO: 769214 - DNA, 22 bp, Artificial Sequence
  chemically synthesized
cttatgtgctttccatagccca

SEQ ID NO: 769215 - DNA, 22 bp, Artificial Sequence
  chemically synthesized
ttatgtgctttccatagcccag

SEQ ID NO: 769216 - DNA, 22 bp, Artificial Sequence
  chemically synthesized
atgtgctttccatagcccagcg

SEQ ID NO: 769217 - DNA, 22 bp, Artificial Sequence
  chemically synthesized
tgtgctttccatagcccagcgg

SEQ ID NO: 769218 - DNA, 22 bp, Artificial Sequence
  chemically synthesized
aaaataactataccgctgggct

SEQ ID NO: 769219 - DNA, 22 bp, Artificial Sequence
  chemically synthesized
aaaaataactataccgctgggc

SEQ ID NO: 769220 - DNA, 22 bp, Artificial Sequence
  chemically synthesized
tccatagcccagcggtatagtt

SEQ ID NO: 769221 - DNA, 22 bp, Artificial Sequence
  chemically synthesized
ccatagcccagcggtatagtta

SEQ ID NO: 769222 - DNA, 22 bp, Artificial Sequence
  chemically synthesized
catagcccagcggtatagttat

SEQ ID NO: 769223 - DNA, 22 bp, Artificial Sequence
  chemically synthesized
cagggtcatttaaaaataacta

SEQ ID NO: 769224 - DNA, 22 bp, Artificial Sequence
  chemically synthesized
ccagggtcatttaaaaataact

SEQ ID NO: 769225 - DNA, 22 bp, Artificial Sequence
  chemically synthesized
tccagggtcatttaaaaataac

SEQ ID NO: 769226 - DNA, 22 bp, Artificial Sequence
  chemically synthesized
ctttccagggtcatttaaaaat

SEQ ID NO: 769227 - DNA, 22 bp, Artificial Sequence
  chemically synthesized
cctttccagggtcatttaaaaa

SEQ ID NO: 769228 - DNA, 22 bp, Artificial Sequence
  chemically synthesized
cttcctttccagggtcatttaa

SEQ ID NO: 769229 - DNA, 22 bp, Artificial Sequence
  chemically synthesized
tgcttcctttccagggtcattt

SEQ ID NO: 769230 - DNA, 22 bp, Artificial Sequence
  chemically synthesized
tttttaaatgaccctggaaagg

SEQ ID NO: 769231 - DNA, 22 bp, Artificial Sequence
  chemically synthesized
ttaaatgaccctggaaaggaag

SEQ ID NO: 769232 - DNA, 22 bp, Artificial Sequence
  chemically synthesized
taaatgaccctggaaaggaagc

SEQ ID NO: 769233 - DNA, 22 bp, Artificial Sequence
  chemically synthesized
aaatgaccctggaaaggaagca

SEQ ID NO: 769234 - DNA, 22 bp, Artificial Sequence
  chemically synthesized
aatgaccctggaaaggaagcag

SEQ ID NO: 769235 - DNA, 22 bp, Artificial Sequence
  chemically synthesized
atgcaataaagaacacctctgc

SEQ ID NO: 769236 - DNA, 22 bp, Artificial Sequence
  chemically synthesized
ttcatgcaataaagaacacctc

SEQ ID NO: 769237 - DNA, 22 bp, Artificial Sequence
  chemically synthesized
gaaaggaagcagaggtgttctt

SEQ ID NO: 769238 - DNA, 22 bp, Artificial Sequence
  chemically synthesized
tattcatgcaataaagaacacc

SEQ ID NO: 769239 - DNA, 22 bp, Artificial Sequence
  chemically synthesized
ctattcatgcaataaagaacac

SEQ ID NO: 769240 - DNA, 22 bp, Artificial Sequence
  chemically synthesized
ccttctattcatgcaataaaga

SEQ ID NO: 769241 - DNA, 22 bp, Artificial Sequence
  chemically synthesized
aatgaaagattgccttctattc

SEQ ID NO: 769242 - DNA, 22 bp, Artificial Sequence
  chemically synthesized
aaatgaaagattgccttctatt

SEQ ID NO: 769243 - DNA, 22 bp, Artificial Sequence
  chemically synthesized
tttattgcatgaatagaaggca

SEQ ID NO: 769244 - DNA, 22 bp, Artificial Sequence
  chemically synthesized
taaatgaaagattgccttctat

SEQ ID NO: 769245 - DNA, 22 bp, Artificial Sequence
  chemically synthesized
tattgcatgaatagaaggcaat

SEQ ID NO: 769246 - DNA, 22 bp, Artificial Sequence
  chemically synthesized
tttaaatgaaagattgccttct

SEQ ID NO: 769247 - DNA, 22 bp, Artificial Sequence
  chemically synthesized
attgcatgaatagaaggcaatc

SEQ ID NO: 769248 - DNA, 22 bp, Artificial Sequence
  chemically synthesized
ttgcatgaatagaaggcaatct

SEQ ID NO: 769249 - DNA, 22 bp, Artificial Sequence
  chemically synthesized
catgaatagaaggcaatctttc

SEQ ID NO: 769250 - DNA, 22 bp, Artificial Sequence
  chemically synthesized
aggttctttaaatgaaagattg

SEQ ID NO: 769251 - DNA, 22 bp, Artificial Sequence
  chemically synthesized
tcatttaaagaaccttaacccc

SEQ ID NO: 769252 - DNA, 22 bp, Artificial Sequence
  chemically synthesized
catttaaagaaccttaaccccg

SEQ ID NO: 769253 - DNA, 22 bp, Artificial Sequence
  chemically synthesized
atttaaagaaccttaaccccgc

SEQ ID NO: 769254 - DNA, 22 bp, Artificial Sequence
  chemically synthesized
atgcatgcatgcagagcggggt

SEQ ID NO: 769255 - DNA, 22 bp, Artificial Sequence
  chemically synthesized
aaagaaccttaaccccgctctg

SEQ ID NO: 769256 - DNA, 22 bp, Artificial Sequence
  chemically synthesized
catgcatgcatgcagagcgggg

SEQ ID NO: 769257 - DNA, 22 bp, Artificial Sequence
  chemically synthesized
aagaaccttaaccccgctctgc

SEQ ID NO: 769258 - DNA, 22 bp, Artificial Sequence
  chemically synthesized
acttcatgcatgcatgcagagc

SEQ ID NO: 769259 - DNA, 22 bp, Artificial Sequence
  chemically synthesized
ctgacttcatgcatgcatgcag

SEQ ID NO: 769260 - DNA, 22 bp, Artificial Sequence
  chemically synthesized
aaccccgctctgcatgcatgca

SEQ ID NO: 769261 - DNA, 22 bp, Artificial Sequence
  chemically synthesized
accccgctctgcatgcatgcat

SEQ ID NO: 769262 - DNA, 22 bp, Artificial Sequence
  chemically synthesized
tgttcctgacttcatgcatgca

SEQ ID NO: 769263 - DNA, 22 bp, Artificial Sequence
  chemically synthesized
gtgttcctgacttcatgcatgc

SEQ ID NO: 769264 - DNA, 22 bp, Artificial Sequence
  chemically synthesized
cccttgtgttcctgacttcatg

SEQ ID NO: 769265 - DNA, 22 bp, Artificial Sequence
  chemically synthesized
tgcatgcatgcatgaagtcagg

SEQ ID NO: 769266 - DNA, 22 bp, Artificial Sequence
  chemically synthesized
catgcatgcatgaagtcaggaa

SEQ ID NO: 769267 - DNA, 22 bp, Artificial Sequence
  chemically synthesized
ccaaaatgaataatacagtatt

SEQ ID NO: 769268 - DNA, 22 bp, Artificial Sequence
  chemically synthesized
tagttgccaaaatgaataatac

SEQ ID NO: 769269 - DNA, 22 bp, Artificial Sequence
  chemically synthesized
atagttgccaaaatgaataata

SEQ ID NO: 769270 - DNA, 22 bp, Artificial Sequence
  chemically synthesized
aatttatagttgccaaaatgaa

SEQ ID NO: 769271 - DNA, 22 bp, Artificial Sequence
  chemically synthesized
gaatttatagttgccaaaatga

SEQ ID NO: 769272 - DNA, 22 bp, Artificial Sequence
  chemically synthesized
tattattcattttggcaactat

SEQ ID NO: 769273 - DNA, 22 bp, Artificial Sequence
  chemically synthesized
ttcattttggcaactataaatt

SEQ ID NO: 769274 - DNA, 22 bp, Artificial Sequence
  chemically synthesized
agagccatcatttgaatttata

SEQ ID NO: 769275 - DNA, 22 bp, Artificial Sequence
  chemically synthesized
attttggcaactataaattcaa

SEQ ID NO: 769276 - DNA, 22 bp, Artificial Sequence
  chemically synthesized
tggcaactataaattcaaatga

SEQ ID NO: 769277 - DNA, 22 bp, Artificial Sequence
  chemically synthesized
ggcaactataaattcaaatgat

SEQ ID NO: 769278 - DNA, 22 bp, Artificial Sequence
  chemically synthesized
gcaactataaattcaaatgatg

SEQ ID NO: 769279 - DNA, 22 bp, Artificial Sequence
  chemically synthesized
cccaacctcagagccatcattt

SEQ ID NO: 769280 - DNA, 22 bp, Artificial Sequence
  chemically synthesized
tccccaacctcagagccatcat

SEQ ID NO: 769281 - DNA, 22 bp, Artificial Sequence
  chemically synthesized
ctccccaacctcagagccatca

SEQ ID NO: 769282 - DNA, 22 bp, Artificial Sequence
  chemically synthesized
tctccccaacctcagagccatc

SEQ ID NO: 769283 - DNA, 22 bp, Artificial Sequence
  chemically synthesized
taaattcaaatgatggctctga

SEQ ID NO: 769284 - DNA, 22 bp, Artificial Sequence
  chemically synthesized
ttctccccaacctcagagccat

SEQ ID NO: 769285 - DNA, 22 bp, Artificial Sequence
  chemically synthesized
tttctccccaacctcagagcca

SEQ ID NO: 769286 - DNA, 22 bp, Artificial Sequence
  chemically synthesized
aaatgatggctctgaggttggg

SEQ ID NO: 769287 - DNA, 22 bp, Artificial Sequence
  chemically synthesized
agcgggcctttttctccccaac

SEQ ID NO: 769288 - DNA, 22 bp, Artificial Sequence
  chemically synthesized
cagctcagcgggcctttttctc

SEQ ID NO: 769289 - DNA, 22 bp, Artificial Sequence
  chemically synthesized
tgaggttggggagaaaaaggcc

SEQ ID NO: 769290 - DNA, 22 bp, Artificial Sequence
  chemically synthesized
tccagctcagcgggcctttttc

SEQ ID NO: 769291 - DNA, 22 bp, Artificial Sequence
  chemically synthesized
aggttggggagaaaaaggcccg

SEQ ID NO: 769292 - DNA, 22 bp, Artificial Sequence
  chemically synthesized
ctctccagctcagcgggccttt

SEQ ID NO: 769293 - DNA, 22 bp, Artificial Sequence
  chemically synthesized
tgctctccagctcagcgggcct

SEQ ID NO: 769294 - DNA, 22 bp, Artificial Sequence
  chemically synthesized
gggagaaaaaggcccgctgagc

SEQ ID NO: 769295 - DNA, 22 bp, Artificial Sequence
  chemically synthesized
aaggaagcgttctgctctccag

SEQ ID NO: 769296 - DNA, 22 bp, Artificial Sequence
  chemically synthesized
ataagctgaaggaagcgttctg

SEQ ID NO: 769297 - DNA, 22 bp, Artificial Sequence
  chemically synthesized
gataagctgaaggaagcgttct

SEQ ID NO: 769298 - DNA, 22 bp, Artificial Sequence
  chemically synthesized
agctggagagcagaacgcttcc

SEQ ID NO: 769299 - DNA, 22 bp, Artificial Sequence
  chemically synthesized
tgataagctgaaggaagcgttc

SEQ ID NO: 769300 - DNA, 22 bp, Artificial Sequence
  chemically synthesized
tttgataagctgaaggaagcgt

SEQ ID NO: 769301 - DNA, 22 bp, Artificial Sequence
  chemically synthesized
ctttgataagctgaaggaagcg

SEQ ID NO: 769302 - DNA, 22 bp, Artificial Sequence
  chemically synthesized
gagagcagaacgcttccttcag

SEQ ID NO: 769303 - DNA, 22 bp, Artificial Sequence
  chemically synthesized
tcacttctttgataagctgaag

SEQ ID NO: 769304 - DNA, 22 bp, Artificial Sequence
  chemically synthesized
tagcactatcacttctttgata

SEQ ID NO: 769305 - DNA, 22 bp, Artificial Sequence
  chemically synthesized
ccttcagcttatcaaagaagtg

SEQ ID NO: 769306 - DNA, 22 bp, Artificial Sequence
  chemically synthesized
cttcagcttatcaaagaagtga

SEQ ID NO: 769307 - DNA, 22 bp, Artificial Sequence
  chemically synthesized
cctgtagcactatcacttcttt

SEQ ID NO: 769308 - DNA, 22 bp, Artificial Sequence
  chemically synthesized
cagcttatcaaagaagtgatag

SEQ ID NO: 769309 - DNA, 22 bp, Artificial Sequence
  chemically synthesized
ctgcctgtagcactatcacttc

SEQ ID NO: 769310 - DNA, 22 bp, Artificial Sequence
  chemically synthesized
agcttatcaaagaagtgatagt

SEQ ID NO: 769311 - DNA, 22 bp, Artificial Sequence
  chemically synthesized
atcaaagaagtgatagtgctac

SEQ ID NO: 769312 - DNA, 22 bp, Artificial Sequence
  chemically synthesized
tcaaagaagtgatagtgctaca

SEQ ID NO: 769313 - DNA, 22 bp, Artificial Sequence
  chemically synthesized
tggggcactcctgcctgtagca

SEQ ID NO: 769314 - DNA, 22 bp, Artificial Sequence
  chemically synthesized
ttatggggcactcctgcctgta

SEQ ID NO: 769315 - DNA, 22 bp, Artificial Sequence
  chemically synthesized
gattattatggggcactcctgc

SEQ ID NO: 769316 - DNA, 22 bp, Artificial Sequence
  chemically synthesized
cctagattattatggggcactc

SEQ ID NO: 769317 - DNA, 22 bp, Artificial Sequence
  chemically synthesized
ccctagattattatggggcact

SEQ ID NO: 769318 - DNA, 22 bp, Artificial Sequence
  chemically synthesized
tccctagattattatggggcac

SEQ ID NO: 769319 - DNA, 22 bp, Artificial Sequence
  chemically synthesized
caggcaggagtgccccataata

SEQ ID NO: 769320 - DNA, 22 bp, Artificial Sequence
  chemically synthesized
agaggcgtattttccctagatt

SEQ ID NO: 769321 - DNA, 22 bp, Artificial Sequence
  chemically synthesized
actcagaggcgtattttcccta

SEQ ID NO: 769322 - DNA, 22 bp, Artificial Sequence
  chemically synthesized
attgactcagaggcgtattttc

SEQ ID NO: 769323 - DNA, 22 bp, Artificial Sequence
  chemically synthesized
cattgactcagaggcgtatttt

SEQ ID NO: 769324 - DNA, 22 bp, Artificial Sequence
  chemically synthesized
gggaaaatacgcctctgagtca

SEQ ID NO: 769325 - DNA, 22 bp, Artificial Sequence
  chemically synthesized
tgagtcaatgaagattttctgt

SEQ ID NO: 769326 - DNA, 22 bp, Artificial Sequence
  chemically synthesized
agtcaatgaagattttctgtta

SEQ ID NO: 769327 - DNA, 22 bp, Artificial Sequence
  chemically synthesized
taggcaaaacagcccatgcaat

SEQ ID NO: 769328 - DNA, 22 bp, Artificial Sequence
  chemically synthesized
gctgtaggcaaaacagcccatg

SEQ ID NO: 769329 - DNA, 22 bp, Artificial Sequence
  chemically synthesized
ggctgtaggcaaaacagcccat

SEQ ID NO: 769330 - DNA, 22 bp, Artificial Sequence
  chemically synthesized
tctgttattgcatgggctgttt

SEQ ID NO: 769331 - DNA, 22 bp, Artificial Sequence
  chemically synthesized
ctgttattgcatgggctgtttt

SEQ ID NO: 769332 - DNA, 22 bp, Artificial Sequence
  chemically synthesized
ttggctgtaggcaaaacagccc

SEQ ID NO: 769333 - DNA, 22 bp, Artificial Sequence
  chemically synthesized
tgttattgcatgggctgttttg

SEQ ID NO: 769334 - DNA, 22 bp, Artificial Sequence
  chemically synthesized
cttggctgtaggcaaaacagcc

SEQ ID NO: 769335 - DNA, 22 bp, Artificial Sequence
  chemically synthesized
tcttggctgtaggcaaaacagc

SEQ ID NO: 769336 - DNA, 22 bp, Artificial Sequence
  chemically synthesized
ttattgcatgggctgttttgcc

SEQ ID NO: 769337 - DNA, 22 bp, Artificial Sequence
  chemically synthesized
ttgcatgggctgttttgcctac

SEQ ID NO: 769338 - DNA, 22 bp, Artificial Sequence
  chemically synthesized
catgggctgttttgcctacagc

SEQ ID NO: 769339 - DNA, 22 bp, Artificial Sequence
  chemically synthesized
ttttgcctacagccaagaaaat

SEQ ID NO: 769340 - DNA, 22 bp, Artificial Sequence
  chemically synthesized
ccatcagacagaattttcttgg

SEQ ID NO: 769341 - DNA, 22 bp, Artificial Sequence
  chemically synthesized
tgcctacagccaagaaaattct

SEQ ID NO: 769342 - DNA, 22 bp, Artificial Sequence
  chemically synthesized
gcctacagccaagaaaattctg

SEQ ID NO: 769343 - DNA, 22 bp, Artificial Sequence
  chemically synthesized
cctacagccaagaaaattctgt

SEQ ID NO: 769344 - DNA, 22 bp, Artificial Sequence
  chemically synthesized
aaacattaccatcagacagaat

SEQ ID NO: 769345 - DNA, 22 bp, Artificial Sequence
  chemically synthesized
cagccaagaaaattctgtctga

SEQ ID NO: 769346 - DNA, 22 bp, Artificial Sequence
  chemically synthesized
tgtctgatggtaatgttttagc

SEQ ID NO: 769347 - DNA, 22 bp, Artificial Sequence
  chemically synthesized
tctgatggtaatgttttagctg

SEQ ID NO: 769348 - DNA, 22 bp, Artificial Sequence
  chemically synthesized
atggtaatgttttagctgctga

SEQ ID NO: 769349 - DNA, 22 bp, Artificial Sequence
  chemically synthesized
aagacagaggagatgaatcagc

SEQ ID NO: 769350 - DNA, 22 bp, Artificial Sequence
  chemically synthesized
tagctgctgattcatctcctct

SEQ ID NO: 769351 - DNA, 22 bp, Artificial Sequence
  chemically synthesized
agctgctgattcatctcctctg

SEQ ID NO: 769352 - DNA, 22 bp, Artificial Sequence
  chemically synthesized
gctgctgattcatctcctctgt

SEQ ID NO: 769353 - DNA, 22 bp, Artificial Sequence
  chemically synthesized
agaagaattgaagacagaggag

SEQ ID NO: 769354 - DNA, 22 bp, Artificial Sequence
  chemically synthesized
ctgattcatctcctctgtcttc

SEQ ID NO: 769355 - DNA, 22 bp, Artificial Sequence
  chemically synthesized
ctgagaagaattgaagacagag

SEQ ID NO: 769356 - DNA, 22 bp, Artificial Sequence
  chemically synthesized
gctgagaagaattgaagacaga

SEQ ID NO: 769357 - DNA, 22 bp, Artificial Sequence
  chemically synthesized
attcatctcctctgtcttcaat

SEQ ID NO: 769358 - DNA, 22 bp, Artificial Sequence
  chemically synthesized
atctcctctgtcttcaattctt

SEQ ID NO: 769359 - DNA, 22 bp, Artificial Sequence
  chemically synthesized
ctctgtcttcaattcttctcag

SEQ ID NO: 769360 - DNA, 22 bp, Artificial Sequence
  chemically synthesized
tgtcttcaattcttctcagcaa

SEQ ID NO: 769361 - DNA, 22 bp, Artificial Sequence
  chemically synthesized
tcttcaattcttctcagcaaac

SEQ ID NO: 769362 - DNA, 22 bp, Artificial Sequence
  chemically synthesized
caattcttctcagcaaactttt

SEQ ID NO: 769363 - DNA, 22 bp, Artificial Sequence
  chemically synthesized
aattcttctcagcaaactttta

SEQ ID NO: 769364 - DNA, 22 bp, Artificial Sequence
  chemically synthesized
ttctcagcaaacttttattggg

SEQ ID NO: 769365 - DNA, 22 bp, Artificial Sequence
  chemically synthesized
ctcagcaaacttttattgggtc

SEQ ID NO: 769366 - DNA, 22 bp, Artificial Sequence
  chemically synthesized
tcagcaaacttttattgggtct

SEQ ID NO: 769367 - DNA, 22 bp, Artificial Sequence
  chemically synthesized
agcaaacttttattgggtctca

SEQ ID NO: 769368 - DNA, 22 bp, Artificial Sequence
  chemically synthesized
taaatgtgcccaggatgagacc

SEQ ID NO: 769369 - DNA, 22 bp, Artificial Sequence
  chemically synthesized
tgtaaatgtgcccaggatgaga

SEQ ID NO: 769370 - DNA, 22 bp, Artificial Sequence
  chemically synthesized
ctctgtaaatgtgcccaggatg

SEQ ID NO: 769371 - DNA, 22 bp, Artificial Sequence
  chemically synthesized
ttattgggtctcatcctgggca

SEQ ID NO: 769372 - DNA, 22 bp, Artificial Sequence
  chemically synthesized
tattgggtctcatcctgggcac

SEQ ID NO: 769373 - DNA, 22 bp, Artificial Sequence
  chemically synthesized
attgggtctcatcctgggcaca

SEQ ID NO: 769374 - DNA, 22 bp, Artificial Sequence
  chemically synthesized
ttgggtctcatcctgggcacat

SEQ ID NO: 769375 - DNA, 22 bp, Artificial Sequence
  chemically synthesized
ggtctcatcctgggcacattta

SEQ ID NO: 769376 - DNA, 22 bp, Artificial Sequence
  chemically synthesized
tggaaattgctctgtaaatgtg

SEQ ID NO: 769377 - DNA, 22 bp, Artificial Sequence
  chemically synthesized
atcctgggcacatttacagagc

SEQ ID NO: 769378 - DNA, 22 bp, Artificial Sequence
  chemically synthesized
tcattatggaaattgctctgta

SEQ ID NO: 769379 - DNA, 22 bp, Artificial Sequence
  chemically synthesized
ggcacatttacagagcaatttc

SEQ ID NO: 769380 - DNA, 22 bp, Artificial Sequence
  chemically synthesized
aagagatgttatcattatggaa

SEQ ID NO: 769381 - DNA, 22 bp, Artificial Sequence
  chemically synthesized
gaagagatgttatcattatgga

SEQ ID NO: 769382 - DNA, 22 bp, Artificial Sequence
  chemically synthesized
acagagcaatttccataatgat

SEQ ID NO: 769383 - DNA, 22 bp, Artificial Sequence
  chemically synthesized
cagagcaatttccataatgata

SEQ ID NO: 769384 - DNA, 22 bp, Artificial Sequence
  chemically synthesized
atttgaagagatgttatcatta

SEQ ID NO: 769385 - DNA, 22 bp, Artificial Sequence
  chemically synthesized
aatctcatttgaagagatgtta

SEQ ID NO: 769386 - DNA, 22 bp, Artificial Sequence
  chemically synthesized
aaatctcatttgaagagatgtt

SEQ ID NO: 769387 - DNA, 22 bp, Artificial Sequence
  chemically synthesized
taaatctcatttgaagagatgt

SEQ ID NO: 769388 - DNA, 22 bp, Artificial Sequence
  chemically synthesized
ccataatgataacatctcttca

SEQ ID NO: 769389 - DNA, 22 bp, Artificial Sequence
  chemically synthesized
cataatgataacatctcttcaa

SEQ ID NO: 769390 - DNA, 22 bp, Artificial Sequence
  chemically synthesized
cactttaaatctcatttgaaga

SEQ ID NO: 769391 - DNA, 22 bp, Artificial Sequence
  chemically synthesized
attacactttaaatctcatttg

SEQ ID NO: 769392 - DNA, 22 bp, Artificial Sequence
  chemically synthesized
aattacactttaaatctcattt

SEQ ID NO: 769393 - DNA, 22 bp, Artificial Sequence
  chemically synthesized
taattacactttaaatctcatt

SEQ ID NO: 769394 - DNA, 22 bp, Artificial Sequence
  chemically synthesized
ttaattacactttaaatctcat

SEQ ID NO: 769395 - DNA, 22 bp, Artificial Sequence
  chemically synthesized
ttcaaatgagatttaaagtgta

SEQ ID NO: 769396 - DNA, 22 bp, Artificial Sequence
  chemically synthesized
caaatgagatttaaagtgtaat

SEQ ID NO: 769397 - DNA, 22 bp, Artificial Sequence
  chemically synthesized
aaatgagatttaaagtgtaatt

SEQ ID NO: 769398 - DNA, 22 bp, Artificial Sequence
  chemically synthesized
ccacaacacatgtgccttttaa

SEQ ID NO: 769399 - DNA, 22 bp, Artificial Sequence
  chemically synthesized
gccacaacacatgtgcctttta

SEQ ID NO: 769400 - DNA, 22 bp, Artificial Sequence
  chemically synthesized
tgccacaacacatgtgcctttt

SEQ ID NO: 769401 - DNA, 22 bp, Artificial Sequence
  chemically synthesized
aaagtgtaattaaaaggcacat

SEQ ID NO: 769402 - DNA, 22 bp, Artificial Sequence
  chemically synthesized
aagtgtaattaaaaggcacatg

SEQ ID NO: 769403 - DNA, 22 bp, Artificial Sequence
  chemically synthesized
aaaggcacatgtgttgtggcaa

SEQ ID NO: 769404 - DNA, 22 bp, Artificial Sequence
  chemically synthesized
cacaacaacgcctttgccacaa

SEQ ID NO: 769405 - DNA, 22 bp, Artificial Sequence
  chemically synthesized
tggcaaaggcgttgttgtgcag

SEQ ID NO: 769406 - DNA, 22 bp, Artificial Sequence
  chemically synthesized
catggcacgatgatgtatggtc

SEQ ID NO: 769407 - DNA, 22 bp, Artificial Sequence
  chemically synthesized
ttgtgcagtgaccatacatcat

SEQ ID NO: 769408 - DNA, 22 bp, Artificial Sequence
  chemically synthesized
tgcagtgaccatacatcatcgt

SEQ ID NO: 769409 - DNA, 22 bp, Artificial Sequence
  chemically synthesized
agtgagagctccatggcacgat

SEQ ID NO: 769410 - DNA, 22 bp, Artificial Sequence
  chemically synthesized
gctgagtgagagctccatggca

SEQ ID NO: 769411 - DNA, 22 bp, Artificial Sequence
  chemically synthesized
cataggctggctgagtgagagc

SEQ ID NO: 769412 - DNA, 22 bp, Artificial Sequence
  chemically synthesized
tcactcagccagcctatggaat

SEQ ID NO: 769413 - DNA, 22 bp, Artificial Sequence
  chemically synthesized
actcagccagcctatggaatga

SEQ ID NO: 769414 - DNA, 22 bp, Artificial Sequence
  chemically synthesized
agccagcctatggaatgacccc

SEQ ID NO: 769415 - DNA, 22 bp, Artificial Sequence
  chemically synthesized
tcagagtgaaaccggggtcatt

SEQ ID NO: 769416 - DNA, 22 bp, Artificial Sequence
  chemically synthesized
atcagagtgaaaccggggtcat

SEQ ID NO: 769417 - DNA, 22 bp, Artificial Sequence
  chemically synthesized
tggaatgaccccggtttcactc

SEQ ID NO: 769418 - DNA, 22 bp, Artificial Sequence
  chemically synthesized
aaacaaagccatggaatcttat

SEQ ID NO: 769419 - DNA, 22 bp, Artificial Sequence
  chemically synthesized
cactctgataagattccatggc

SEQ ID NO: 769420 - DNA, 22 bp, Artificial Sequence
  chemically synthesized
gcctcaaacaaagccatggaat

SEQ ID NO: 769421 - DNA, 22 bp, Artificial Sequence
  chemically synthesized
actctgataagattccatggct

SEQ ID NO: 769422 - DNA, 22 bp, Artificial Sequence
  chemically synthesized
tgataagattccatggctttgt

SEQ ID NO: 769423 - DNA, 22 bp, Artificial Sequence
  chemically synthesized
ataagattccatggctttgttt

SEQ ID NO: 769424 - DNA, 22 bp, Artificial Sequence
  chemically synthesized
atgaagccattagcctcaaaca

SEQ ID NO: 769425 - DNA, 22 bp, Artificial Sequence
  chemically synthesized
taatgaagccattagcctcaaa

SEQ ID NO: 769426 - DNA, 22 bp, Artificial Sequence
  chemically synthesized
ctaatgaagccattagcctcaa

SEQ ID NO: 769427 - DNA, 22 bp, Artificial Sequence
  chemically synthesized
catggctttgtttgaggctaat

SEQ ID NO: 769428 - DNA, 22 bp, Artificial Sequence
  chemically synthesized
tctaatgaagccattagcctca

SEQ ID NO: 769429 - DNA, 22 bp, Artificial Sequence
  chemically synthesized
ttctaatgaagccattagcctc

SEQ ID NO: 769430 - DNA, 22 bp, Artificial Sequence
  chemically synthesized
tttctaatgaagccattagcct

SEQ ID NO: 769431 - DNA, 22 bp, Artificial Sequence
  chemically synthesized
ttttttctaatgaagccattag

SEQ ID NO: 769432 - DNA, 22 bp, Artificial Sequence
  chemically synthesized
attttttctaatgaagccatta

SEQ ID NO: 769433 - DNA, 22 bp, Artificial Sequence
  chemically synthesized
tgtttgaggctaatggcttcat

SEQ ID NO: 769434 - DNA, 22 bp, Artificial Sequence
  chemically synthesized
gtttgaggctaatggcttcatt

SEQ ID NO: 769435 - DNA, 22 bp, Artificial Sequence
  chemically synthesized
tttattttttctaatgaagcca

SEQ ID NO: 769436 - DNA, 22 bp, Artificial Sequence
  chemically synthesized
tttgaggctaatggcttcatta

SEQ ID NO: 769437 - DNA, 22 bp, Artificial Sequence
  chemically synthesized
atttattttttctaatgaagcc

SEQ ID NO: 769438 - DNA, 22 bp, Artificial Sequence
  chemically synthesized
gaggctaatggcttcattagaa

SEQ ID NO: 769439 - DNA, 22 bp, Artificial Sequence
  chemically synthesized
tttatttattttttctaatgaa

SEQ ID NO: 769440 - DNA, 22 bp, Artificial Sequence
  chemically synthesized
aggctaatggcttcattagaaa

SEQ ID NO: 769441 - DNA, 22 bp, Artificial Sequence
  chemically synthesized
atttatttattttttctaatga

SEQ ID NO: 769442 - DNA, 22 bp, Artificial Sequence
  chemically synthesized
tatttatttattttttctaatg

SEQ ID NO: 769443 - DNA, 22 bp, Artificial Sequence
  chemically synthesized
ttatttatttattttttctaat

SEQ ID NO: 769444 - DNA, 22 bp, Artificial Sequence
  chemically synthesized
ttttatttatttattttttcta

SEQ ID NO: 769445 - DNA, 22 bp, Artificial Sequence
  chemically synthesized
cttttatttatttattttttct

SEQ ID NO: 769446 - DNA, 22 bp, Artificial Sequence
  chemically synthesized
atggcttcattagaaaaaataa

SEQ ID NO: 769447 - DNA, 22 bp, Artificial Sequence
  chemically synthesized
tcttcttttatttatttatttt

SEQ ID NO: 769448 - DNA, 22 bp, Artificial Sequence
  chemically synthesized
atcttcttttatttatttattt

SEQ ID NO: 769449 - DNA, 22 bp, Artificial Sequence
  chemically synthesized
tatcttcttttatttatttatt

SEQ ID NO: 769450 - DNA, 22 bp, Artificial Sequence
  chemically synthesized
cattagaaaaaataaataaata

SEQ ID NO: 769451 - DNA, 22 bp, Artificial Sequence
  chemically synthesized
attagaaaaaataaataaataa

SEQ ID NO: 769452 - DNA, 22 bp, Artificial Sequence
  chemically synthesized
ttttatcttcttttatttattt

SEQ ID NO: 769453 - DNA, 22 bp, Artificial Sequence
  chemically synthesized
gttttatcttcttttatttatt

SEQ ID NO: 769454 - DNA, 22 bp, Artificial Sequence
  chemically synthesized
gaaaaaataaataaataaaaga

SEQ ID NO: 769455 - DNA, 22 bp, Artificial Sequence
  chemically synthesized
caataaagagcttgttttatct

SEQ ID NO: 769456 - DNA, 22 bp, Artificial Sequence
  chemically synthesized
tccaataaagagcttgttttat

SEQ ID NO: 769457 - DNA, 22 bp, Artificial Sequence
  chemically synthesized
tctctccaataaagagcttgtt

SEQ ID NO: 769458 - DNA, 22 bp, Artificial Sequence
  chemically synthesized
atctctccaataaagagcttgt

SEQ ID NO: 769459 - DNA, 22 bp, Artificial Sequence
  chemically synthesized
atggacttatctctccaataaa

SEQ ID NO: 769460 - DNA, 22 bp, Artificial Sequence
  chemically synthesized
acgcatgttcatggacttatct

SEQ ID NO: 769461 - DNA, 22 bp, Artificial Sequence
  chemically synthesized
tttattggagagataagtccat

SEQ ID NO: 769462 - DNA, 22 bp, Artificial Sequence
  chemically synthesized
tattggagagataagtccatga

SEQ ID NO: 769463 - DNA, 22 bp, Artificial Sequence
  chemically synthesized
attggagagataagtccatgaa

SEQ ID NO: 769464 - DNA, 22 bp, Artificial Sequence
  chemically synthesized
ttggagagataagtccatgaac

SEQ ID NO: 769465 - DNA, 22 bp, Artificial Sequence
  chemically synthesized
gagagataagtccatgaacatg

SEQ ID NO: 769466 - DNA, 22 bp, Artificial Sequence
  chemically synthesized
gacttctgcacccttctccctt

SEQ ID NO: 769467 - DNA, 22 bp, Artificial Sequence
  chemically synthesized
agagacagaacgaagggagaag

SEQ ID NO: 769468 - DNA, 22 bp, Artificial Sequence
  chemically synthesized
taagagacagaacgaagggaga

SEQ ID NO: 769469 - DNA, 22 bp, Artificial Sequence
  chemically synthesized
ctgcacccttctcccttcgttc

SEQ ID NO: 769470 - DNA, 22 bp, Artificial Sequence
  chemically synthesized
tgcacccttctcccttcgttct

SEQ ID NO: 769471 - DNA, 22 bp, Artificial Sequence
  chemically synthesized
agttctaagagacagaacgaag

SEQ ID NO: 769472 - DNA, 22 bp, Artificial Sequence
  chemically synthesized
cacccttctcccttcgttctgt

SEQ ID NO: 769473 - DNA, 22 bp, Artificial Sequence
  chemically synthesized
tgagttctaagagacagaacga

SEQ ID NO: 769474 - DNA, 22 bp, Artificial Sequence
  chemically synthesized
cctctgagttctaagagacaga

SEQ ID NO: 769475 - DNA, 22 bp, Artificial Sequence
  chemically synthesized
ctcccttcgttctgtctcttag

SEQ ID NO: 769476 - DNA, 22 bp, Artificial Sequence
  chemically synthesized
tcccttcgttctgtctcttaga

SEQ ID NO: 769477 - DNA, 22 bp, Artificial Sequence
  chemically synthesized
ttgcctctgagttctaagagac

SEQ ID NO: 769478 - DNA, 22 bp, Artificial Sequence
  chemically synthesized
gttgcctctgagttctaagaga

SEQ ID NO: 769479 - DNA, 22 bp, Artificial Sequence
  chemically synthesized
ccttcgttctgtctcttagaac

SEQ ID NO: 769480 - DNA, 22 bp, Artificial Sequence
  chemically synthesized
ttgttgcctctgagttctaaga

SEQ ID NO: 769481 - DNA, 22 bp, Artificial Sequence
  chemically synthesized
cttgttgcctctgagttctaag

SEQ ID NO: 769482 - DNA, 22 bp, Artificial Sequence
  chemically synthesized
cgttctgtctcttagaactcag

SEQ ID NO: 769483 - DNA, 22 bp, Artificial Sequence
  chemically synthesized
gttctgtctcttagaactcaga

SEQ ID NO: 769484 - DNA, 22 bp, Artificial Sequence
  chemically synthesized
tgtctcttagaactcagaggca

SEQ ID NO: 769485 - DNA, 22 bp, Artificial Sequence
  chemically synthesized
tctcttagaactcagaggcaac

SEQ ID NO: 769486 - DNA, 22 bp, Artificial Sequence
  chemically synthesized
aaggagtttcttgttgcctctg

SEQ ID NO: 769487 - DNA, 22 bp, Artificial Sequence
  chemically synthesized
ttagaactcagaggcaacaaga

SEQ ID NO: 769488 - DNA, 22 bp, Artificial Sequence
  chemically synthesized
agaactcagaggcaacaagaaa

SEQ ID NO: 769489 - DNA, 22 bp, Artificial Sequence
  chemically synthesized
gaactcagaggcaacaagaaac

SEQ ID NO: 769490 - DNA, 22 bp, Artificial Sequence
  chemically synthesized
cgtgctcaaggagtttcttgtt

SEQ ID NO: 769491 - DNA, 22 bp, Artificial Sequence
  chemically synthesized
ccgtgctcaaggagtttcttgt

SEQ ID NO: 769492 - DNA, 22 bp, Artificial Sequence
  chemically synthesized
acttccgtgctcaaggagtttc

SEQ ID NO: 769493 - DNA, 22 bp, Artificial Sequence
  chemically synthesized
agaggcaacaagaaactccttg

SEQ ID NO: 769494 - DNA, 22 bp, Artificial Sequence
  chemically synthesized
gtgttcacttccgtgctcaagg

SEQ ID NO: 769495 - DNA, 22 bp, Artificial Sequence
  chemically synthesized
ttagtgttcacttccgtgctca

SEQ ID NO: 769496 - DNA, 22 bp, Artificial Sequence
  chemically synthesized
gttagtgttcacttccgtgctc

SEQ ID NO: 769497 - DNA, 22 bp, Artificial Sequence
  chemically synthesized
tccgtttgttagtgttcacttc

SEQ ID NO: 769498 - DNA, 22 bp, Artificial Sequence
  chemically synthesized
cttgagcacggaagtgaacact

SEQ ID NO: 769499 - DNA, 22 bp, Artificial Sequence
  chemically synthesized
gagcacggaagtgaacactaac

SEQ ID NO: 769500 - DNA, 22 bp, Artificial Sequence
  chemically synthesized
acctgtccgtttgttagtgttc

SEQ ID NO: 769501 - DNA, 22 bp, Artificial Sequence
  chemically synthesized
agcacggaagtgaacactaaca

SEQ ID NO: 769502 - DNA, 22 bp, Artificial Sequence
  chemically synthesized
cacctgtccgtttgttagtgtt

SEQ ID NO: 769503 - DNA, 22 bp, Artificial Sequence
  chemically synthesized
tcacctgtccgtttgttagtgt

SEQ ID NO: 769504 - DNA, 22 bp, Artificial Sequence
  chemically synthesized
agctttcacctgtccgtttgtt

SEQ ID NO: 769505 - DNA, 22 bp, Artificial Sequence
  chemically synthesized
cagctttcacctgtccgtttgt

SEQ ID NO: 769506 - DNA, 22 bp, Artificial Sequence
  chemically synthesized
tcagctttcacctgtccgtttg

SEQ ID NO: 769507 - DNA, 22 bp, Artificial Sequence
  chemically synthesized
acaaacggacaggtgaaagctg

SEQ ID NO: 769508 - DNA, 22 bp, Artificial Sequence
  chemically synthesized
agggcaagcacatcctttcagc

SEQ ID NO: 769509 - DNA, 22 bp, Artificial Sequence
  chemically synthesized
tcagggcaagcacatcctttca

SEQ ID NO: 769510 - DNA, 22 bp, Artificial Sequence
  chemically synthesized
ctcagggcaagcacatcctttc

SEQ ID NO: 769511 - DNA, 22 bp, Artificial Sequence
  chemically synthesized
agcttctcagggcaagcacatc

SEQ ID NO: 769512 - DNA, 22 bp, Artificial Sequence
  chemically synthesized
aaaggatgtgcttgccctgaga

SEQ ID NO: 769513 - DNA, 22 bp, Artificial Sequence
  chemically synthesized
gccctgagaagctgagctcctt

SEQ ID NO: 769514 - DNA, 22 bp, Artificial Sequence
  chemically synthesized
ccctgagaagctgagctcctta

SEQ ID NO: 769515 - DNA, 22 bp, Artificial Sequence
  chemically synthesized
agaagctgagctccttatgtcc

SEQ ID NO: 769516 - DNA, 22 bp, Artificial Sequence
  chemically synthesized
agctccttatgtcctatggcct

SEQ ID NO: 769517 - DNA, 22 bp, Artificial Sequence
  chemically synthesized
aaaccatgagagtaggccatag

SEQ ID NO: 769518 - DNA, 22 bp, Artificial Sequence
  chemically synthesized
aaaaccatgagagtaggccata

SEQ ID NO: 769519 - DNA, 22 bp, Artificial Sequence
  chemically synthesized
cttatgtcctatggcctactct

SEQ ID NO: 769520 - DNA, 22 bp, Artificial Sequence
  chemically synthesized
atgtcctatggcctactctcat

SEQ ID NO: 769521 - DNA, 22 bp, Artificial Sequence
  chemically synthesized
tgtcctatggcctactctcatg

SEQ ID NO: 769522 - DNA, 22 bp, Artificial Sequence
  chemically synthesized
gcaatcacacttaaaaccatga

SEQ ID NO: 769523 - DNA, 22 bp, Artificial Sequence
  chemically synthesized
tggcctactctcatggttttaa

SEQ ID NO: 769524 - DNA, 22 bp, Artificial Sequence
  chemically synthesized
tagcaatcacacttaaaaccat

SEQ ID NO: 769525 - DNA, 22 bp, Artificial Sequence
  chemically synthesized
ctagcaatcacacttaaaacca

SEQ ID NO: 769526 - DNA, 22 bp, Artificial Sequence
  chemically synthesized
tctagcaatcacacttaaaacc

SEQ ID NO: 769527 - DNA, 22 bp, Artificial Sequence
  chemically synthesized
ttctagcaatcacacttaaaac

SEQ ID NO: 769528 - DNA, 22 bp, Artificial Sequence
  chemically synthesized
ctctcatggttttaagtgtgat

SEQ ID NO: 769529 - DNA, 22 bp, Artificial Sequence
  chemically synthesized
cacttttctagcaatcacactt

SEQ ID NO: 769530 - DNA, 22 bp, Artificial Sequence
  chemically synthesized
ccacttttctagcaatcacact

SEQ ID NO: 769531 - DNA, 22 bp, Artificial Sequence
  chemically synthesized
tcatggttttaagtgtgattgc

SEQ ID NO: 769532 - DNA, 22 bp, Artificial Sequence
  chemically synthesized
atggttttaagtgtgattgcta

SEQ ID NO: 769533 - DNA, 22 bp, Artificial Sequence
  chemically synthesized
tagtttccacttttctagcaat

SEQ ID NO: 769534 - DNA, 22 bp, Artificial Sequence
  chemically synthesized
taagtgtgattgctagaaaagt

SEQ ID NO: 769535 - DNA, 22 bp, Artificial Sequence
  chemically synthesized
aagtgtgattgctagaaaagtg

SEQ ID NO: 769536 - DNA, 22 bp, Artificial Sequence
  chemically synthesized
agtgtgattgctagaaaagtgg

SEQ ID NO: 769537 - DNA, 22 bp, Artificial Sequence
  chemically synthesized
taacctgtagtttccacttttc

SEQ ID NO: 769538 - DNA, 22 bp, Artificial Sequence
  chemically synthesized
ctagaaaagtggaaactacagg

SEQ ID NO: 769539 - DNA, 22 bp, Artificial Sequence
  chemically synthesized
agggaattgtaacctgtagttt

SEQ ID NO: 769540 - DNA, 22 bp, Artificial Sequence
  chemically synthesized
gaaaagtggaaactacaggtta

SEQ ID NO: 769541 - DNA, 22 bp, Artificial Sequence
  chemically synthesized
atccattcagggaattgtaacc

SEQ ID NO: 769542 - DNA, 22 bp, Artificial Sequence
  chemically synthesized
caggttacaattccctgaatgg

SEQ ID NO: 769543 - DNA, 22 bp, Artificial Sequence
  chemically synthesized
aggagcaagcattcatccattc

SEQ ID NO: 769544 - DNA, 22 bp, Artificial Sequence
  chemically synthesized
caggagcaagcattcatccatt

SEQ ID NO: 769545 - DNA, 22 bp, Artificial Sequence
  chemically synthesized
tcaggagcaagcattcatccat

SEQ ID NO: 769546 - DNA, 22 bp, Artificial Sequence
  chemically synthesized
caattccctgaatggatgaatg

SEQ ID NO: 769547 - DNA, 22 bp, Artificial Sequence
  chemically synthesized
ttcaggagcaagcattcatcca

SEQ ID NO: 769548 - DNA, 22 bp, Artificial Sequence
  chemically synthesized
cctgaatggatgaatgcttgct

SEQ ID NO: 769549 - DNA, 22 bp, Artificial Sequence
  chemically synthesized
aatggatgaatgcttgctcctg

SEQ ID NO: 769550 - DNA, 22 bp, Artificial Sequence
  chemically synthesized
aggcaccaggcagtttttcagg

SEQ ID NO: 769551 - DNA, 22 bp, Artificial Sequence
  chemically synthesized
tcaggcaccaggcagtttttca

SEQ ID NO: 769552 - DNA, 22 bp, Artificial Sequence
  chemically synthesized
ctcaggcaccaggcagtttttc

SEQ ID NO: 769553 - DNA, 22 bp, Artificial Sequence
  chemically synthesized
tctcaggcaccaggcagttttt

SEQ ID NO: 769554 - DNA, 22 bp, Artificial Sequence
  chemically synthesized
ctttctcaggcaccaggcagtt

SEQ ID NO: 769555 - DNA, 22 bp, Artificial Sequence
  chemically synthesized
gctttctcaggcaccaggcagt

SEQ ID NO: 769556 - DNA, 22 bp, Artificial Sequence
  chemically synthesized
gctcctgaaaaactgcctggtg

SEQ ID NO: 769557 - DNA, 22 bp, Artificial Sequence
  chemically synthesized
ctcctgaaaaactgcctggtgc

SEQ ID NO: 769558 - DNA, 22 bp, Artificial Sequence
  chemically synthesized
cttgctttctcaggcaccaggc

SEQ ID NO: 769559 - DNA, 22 bp, Artificial Sequence
  chemically synthesized
ccttgctttctcaggcaccagg

SEQ ID NO: 769560 - DNA, 22 bp, Artificial Sequence
  chemically synthesized
ctgaaaaactgcctggtgcctg

SEQ ID NO: 769561 - DNA, 22 bp, Artificial Sequence
  chemically synthesized
aaaaactgcctggtgcctgaga

SEQ ID NO: 769562 - DNA, 22 bp, Artificial Sequence
  chemically synthesized
aaggagtatttccttgctttct

SEQ ID NO: 769563 - DNA, 22 bp, Artificial Sequence
  chemically synthesized
cctggtgcctgagaaagcaagg

SEQ ID NO: 769564 - DNA, 22 bp, Artificial Sequence
  chemically synthesized
ctcaaggagtatttccttgctt

SEQ ID NO: 769565 - DNA, 22 bp, Artificial Sequence
  chemically synthesized
gtgcctgagaaagcaaggaaat

SEQ ID NO: 769566 - DNA, 22 bp, Artificial Sequence
  chemically synthesized
actactcaaggagtatttcctt

SEQ ID NO: 769567 - DNA, 22 bp, Artificial Sequence
  chemically synthesized
agaaagcaaggaaatactcctt

SEQ ID NO: 769568 - DNA, 22 bp, Artificial Sequence
  chemically synthesized
aaacattgactactcaaggagt

SEQ ID NO: 769569 - DNA, 22 bp, Artificial Sequence
  chemically synthesized
caaacattgactactcaaggag

SEQ ID NO: 769570 - DNA, 22 bp, Artificial Sequence
  chemically synthesized
gaggtttcaaacattgactact

SEQ ID NO: 769571 - DNA, 22 bp, Artificial Sequence
  chemically synthesized
ggaggtttcaaacattgactac

SEQ ID NO: 769572 - DNA, 22 bp, Artificial Sequence
  chemically synthesized
tggaggtttcaaacattgacta

SEQ ID NO: 769573 - DNA, 22 bp, Artificial Sequence
  chemically synthesized
ctttggaggtttcaaacattga

SEQ ID NO: 769574 - DNA, 22 bp, Artificial Sequence
  chemically synthesized
cttgagtagtcaatgtttgaaa

SEQ ID NO: 769575 - DNA, 22 bp, Artificial Sequence
  chemically synthesized
gctactttggaggtttcaaaca

SEQ ID NO: 769576 - DNA, 22 bp, Artificial Sequence
  chemically synthesized
agctactttggaggtttcaaac

SEQ ID NO: 769577 - DNA, 22 bp, Artificial Sequence
  chemically synthesized
gagtagtcaatgtttgaaacct

SEQ ID NO: 769578 - DNA, 22 bp, Artificial Sequence
  chemically synthesized
agtagtcaatgtttgaaacctc

SEQ ID NO: 769579 - DNA, 22 bp, Artificial Sequence
  chemically synthesized
gaaacctccaaagtagctaaga

SEQ ID NO: 769580 - DNA, 22 bp, Artificial Sequence
  chemically synthesized
aaacctccaaagtagctaagac

SEQ ID NO: 769581 - DNA, 22 bp, Artificial Sequence
  chemically synthesized
cagtgaagaagaaatagtctta

SEQ ID NO: 769582 - DNA, 22 bp, Artificial Sequence
  chemically synthesized
acagtgaagaagaaatagtctt

SEQ ID NO: 769583 - DNA, 22 bp, Artificial Sequence
  chemically synthesized
tacagtgaagaagaaatagtct

SEQ ID NO: 769584 - DNA, 22 bp, Artificial Sequence
  chemically synthesized
caaagtagctaagactatttct

SEQ ID NO: 769585 - DNA, 22 bp, Artificial Sequence
  chemically synthesized
attttacagtgaagaagaaata

SEQ ID NO: 769586 - DNA, 22 bp, Artificial Sequence
  chemically synthesized
tattgattttacagtgaagaag

SEQ ID NO: 769587 - DNA, 22 bp, Artificial Sequence
  chemically synthesized
atattgattttacagtgaagaa

SEQ ID NO: 769588 - DNA, 22 bp, Artificial Sequence
  chemically synthesized
agactatttcttcttcactgta

SEQ ID NO: 769589 - DNA, 22 bp, Artificial Sequence
  chemically synthesized
tttcttcttcactgtaaaatca

SEQ ID NO: 769590 - DNA, 22 bp, Artificial Sequence
  chemically synthesized
aaaatcttatattgattttaca

SEQ ID NO: 769591 - DNA, 22 bp, Artificial Sequence
  chemically synthesized
aaaaatcttatattgattttac

SEQ ID NO: 769592 - DNA, 22 bp, Artificial Sequence
  chemically synthesized
cttcttcactgtaaaatcaata

SEQ ID NO: 769593 - DNA, 22 bp, Artificial Sequence
  chemically synthesized
ttcttcactgtaaaatcaatat

SEQ ID NO: 769594 - DNA, 22 bp, Artificial Sequence
  chemically synthesized
cttcactgtaaaatcaatataa

SEQ ID NO: 769595 - DNA, 22 bp, Artificial Sequence
  chemically synthesized
ttcactgtaaaatcaatataag

SEQ ID NO: 769596 - DNA, 22 bp, Artificial Sequence
  chemically synthesized
cactgtaaaatcaatataagat

SEQ ID NO: 769597 - DNA, 22 bp, Artificial Sequence
  chemically synthesized
caaagcttaaaaatcttatatt

SEQ ID NO: 769598 - DNA, 22 bp, Artificial Sequence
  chemically synthesized
actgtaaaatcaatataagatt

SEQ ID NO: 769599 - DNA, 22 bp, Artificial Sequence
  chemically synthesized
taaaatcaatataagattttta

SEQ ID NO: 769600 - DNA, 22 bp, Artificial Sequence
  chemically synthesized
agtagttccaaagcttaaaaat

SEQ ID NO: 769601 - DNA, 22 bp, Artificial Sequence
  chemically synthesized
gagtagttccaaagcttaaaaa

SEQ ID NO: 769602 - DNA, 22 bp, Artificial Sequence
  chemically synthesized
gggtttgagtagttccaaagct

SEQ ID NO: 769603 - DNA, 22 bp, Artificial Sequence
  chemically synthesized
cgggtttgagtagttccaaagc

SEQ ID NO: 769604 - DNA, 22 bp, Artificial Sequence
  chemically synthesized
tcgggtttgagtagttccaaag

SEQ ID NO: 769605 - DNA, 22 bp, Artificial Sequence
  chemically synthesized
ttttcgggtttgagtagttcca

SEQ ID NO: 769606 - DNA, 22 bp, Artificial Sequence
  chemically synthesized
ttaagctttggaactactcaaa

SEQ ID NO: 769607 - DNA, 22 bp, Artificial Sequence
  chemically synthesized
taagctttggaactactcaaac

SEQ ID NO: 769608 - DNA, 22 bp, Artificial Sequence
  chemically synthesized
aagctttggaactactcaaacc

SEQ ID NO: 769609 - DNA, 22 bp, Artificial Sequence
  chemically synthesized
agctttggaactactcaaaccc

SEQ ID NO: 769610 - DNA, 22 bp, Artificial Sequence
  chemically synthesized
tggaactactcaaacccgaaaa

SEQ ID NO: 769611 - DNA, 22 bp, Artificial Sequence
  chemically synthesized
ggaactactcaaacccgaaaat

SEQ ID NO: 769612 - DNA, 22 bp, Artificial Sequence
  chemically synthesized
ggtaggcaagctattttcgggt

SEQ ID NO: 769613 - DNA, 22 bp, Artificial Sequence
  chemically synthesized
gaactactcaaacccgaaaata

SEQ ID NO: 769614 - DNA, 22 bp, Artificial Sequence
  chemically synthesized
ctcaaacccgaaaatagcttgc

SEQ ID NO: 769615 - DNA, 22 bp, Artificial Sequence
  chemically synthesized
aaacccgaaaatagcttgccta

SEQ ID NO: 769616 - DNA, 22 bp, Artificial Sequence
  chemically synthesized
tgagtcaggatctgggtaggca

SEQ ID NO: 769617 - DNA, 22 bp, Artificial Sequence
  chemically synthesized
atgaatactatgagtcaggatc

SEQ ID NO: 769618 - DNA, 22 bp, Artificial Sequence
  chemically synthesized
aatgaatactatgagtcaggat

SEQ ID NO: 769619 - DNA, 22 bp, Artificial Sequence
  chemically synthesized
gcctacccagatcctgactcat

SEQ ID NO: 769620 - DNA, 22 bp, Artificial Sequence
  chemically synthesized
cctacccagatcctgactcata

SEQ ID NO: 769621 - DNA, 22 bp, Artificial Sequence
  chemically synthesized
cccagatcctgactcatagtat

SEQ ID NO: 769622 - DNA, 22 bp, Artificial Sequence
  chemically synthesized
atatcatttaatgaatactatg

SEQ ID NO: 769623 - DNA, 22 bp, Artificial Sequence
  chemically synthesized
actcatagtattcattaaatga

SEQ ID NO: 769624 - DNA, 22 bp, Artificial Sequence
  chemically synthesized
atagtattcattaaatgatatg

SEQ ID NO: 769625 - DNA, 22 bp, Artificial Sequence
  chemically synthesized
attaaatgatatgaactgattt

SEQ ID NO: 769626 - DNA, 22 bp, Artificial Sequence
  chemically synthesized
aatgatatgaactgatttttta

SEQ ID NO: 769627 - DNA, 22 bp, Artificial Sequence
  chemically synthesized
aaaccagcagccaagtaaaaaa

SEQ ID NO: 769628 - DNA, 22 bp, Artificial Sequence
  chemically synthesized
aaaaccagcagccaagtaaaaa

SEQ ID NO: 769629 - DNA, 22 bp, Artificial Sequence
  chemically synthesized
tcaatacttaaaaccagcagcc

SEQ ID NO: 769630 - DNA, 22 bp, Artificial Sequence
  chemically synthesized
attttttacttggctgctggtt

SEQ ID NO: 769631 - DNA, 22 bp, Artificial Sequence
  chemically synthesized
tctatcaatacttaaaaccagc

SEQ ID NO: 769632 - DNA, 22 bp, Artificial Sequence
  chemically synthesized
tttacttggctgctggttttaa

SEQ ID NO: 769633 - DNA, 22 bp, Artificial Sequence
  chemically synthesized
ttacttggctgctggttttaag

SEQ ID NO: 769634 - DNA, 22 bp, Artificial Sequence
  chemically synthesized
tacttggctgctggttttaagt

SEQ ID NO: 769635 - DNA, 22 bp, Artificial Sequence
  chemically synthesized
acttggctgctggttttaagta

SEQ ID NO: 769636 - DNA, 22 bp, Artificial Sequence
  chemically synthesized
cttggctgctggttttaagtat

SEQ ID NO: 769637 - DNA, 22 bp, Artificial Sequence
  chemically synthesized
ggctgctggttttaagtattga

SEQ ID NO: 769638 - DNA, 22 bp, Artificial Sequence
  chemically synthesized
gctgctggttttaagtattgat

SEQ ID NO: 769639 - DNA, 22 bp, Artificial Sequence
  chemically synthesized
ctggttttaagtattgatagat

SEQ ID NO: 769640 - DNA, 22 bp, Artificial Sequence
  chemically synthesized
gttttaagtattgatagataat

SEQ ID NO: 769641 - DNA, 22 bp, Artificial Sequence
  chemically synthesized
tcatatgatatgattatctatc

SEQ ID NO: 769642 - DNA, 22 bp, Artificial Sequence
  chemically synthesized
taagtattgatagataatcata

SEQ ID NO: 769643 - DNA, 22 bp, Artificial Sequence
  chemically synthesized
cctgtcatatgatatgattatc

SEQ ID NO: 769644 - DNA, 22 bp, Artificial Sequence
  chemically synthesized
aagtattgatagataatcatat

SEQ ID NO: 769645 - DNA, 22 bp, Artificial Sequence
  chemically synthesized
ccctgtcatatgatatgattat

SEQ ID NO: 769646 - DNA, 22 bp, Artificial Sequence
  chemically synthesized
agtattgatagataatcatatc

SEQ ID NO: 769647 - DNA, 22 bp, Artificial Sequence
  chemically synthesized
atagataatcatatcatatgac

SEQ ID NO: 769648 - DNA, 22 bp, Artificial Sequence
  chemically synthesized
atatgatttccctgtcatatga

SEQ ID NO: 769649 - DNA, 22 bp, Artificial Sequence
  chemically synthesized
gccccatgtgttaatatgattt

SEQ ID NO: 769650 - DNA, 22 bp, Artificial Sequence
  chemically synthesized
ttcgccccatgtgttaatatga

SEQ ID NO: 769651 - DNA, 22 bp, Artificial Sequence
  chemically synthesized
attcgccccatgtgttaatatg

SEQ ID NO: 769652 - DNA, 22 bp, Artificial Sequence
  chemically synthesized
tattcgccccatgtgttaatat

SEQ ID NO: 769653 - DNA, 22 bp, Artificial Sequence
  chemically synthesized
aaagattttattcgccccatgt

SEQ ID NO: 769654 - DNA, 22 bp, Artificial Sequence
  chemically synthesized
gaaagattttattcgccccatg

SEQ ID NO: 769655 - DNA, 22 bp, Artificial Sequence
  chemically synthesized
tgaaagattttattcgccccat

SEQ ID NO: 769656 - DNA, 22 bp, Artificial Sequence
  chemically synthesized
ttgaaagattttattcgcccca

SEQ ID NO: 769657 - DNA, 22 bp, Artificial Sequence
  chemically synthesized
atcttttgaaagattttattcg

SEQ ID NO: 769658 - DNA, 22 bp, Artificial Sequence
  chemically synthesized
acacatggggcgaataaaatct

SEQ ID NO: 769659 - DNA, 22 bp, Artificial Sequence
  chemically synthesized
aaaactgatcttttgaaagatt

SEQ ID NO: 769660 - DNA, 22 bp, Artificial Sequence
  chemically synthesized
gatctcaaaactgatcttttga

SEQ ID NO: 769661 - DNA, 22 bp, Artificial Sequence
  chemically synthesized
ggatctcaaaactgatcttttg

SEQ ID NO: 769662 - DNA, 22 bp, Artificial Sequence
  chemically synthesized
tcaaaagatcagttttgagatc

SEQ ID NO: 769663 - DNA, 22 bp, Artificial Sequence
  chemically synthesized
atgatcatcttggatctcaaaa

SEQ ID NO: 769664 - DNA, 22 bp, Artificial Sequence
  chemically synthesized
caaaagatcagttttgagatcc

SEQ ID NO: 769665 - DNA, 22 bp, Artificial Sequence
  chemically synthesized
aatgatcatcttggatctcaaa

SEQ ID NO: 769666 - DNA, 22 bp, Artificial Sequence
  chemically synthesized
aaaagatcagttttgagatcca

SEQ ID NO: 769667 - DNA, 22 bp, Artificial Sequence
  chemically synthesized
tttaatgatcatcttggatctc

SEQ ID NO: 769668 - DNA, 22 bp, Artificial Sequence
  chemically synthesized
ttatttaatgatcatcttggat

SEQ ID NO: 769669 - DNA, 22 bp, Artificial Sequence
  chemically synthesized
tgagatccaagatgatcattaa

SEQ ID NO: 769670 - DNA, 22 bp, Artificial Sequence
  chemically synthesized
agaatctattatttaatgatca

SEQ ID NO: 769671 - DNA, 22 bp, Artificial Sequence
  chemically synthesized
gagatccaagatgatcattaaa

SEQ ID NO: 769672 - DNA, 22 bp, Artificial Sequence
  chemically synthesized
cagaatctattatttaatgatc

SEQ ID NO: 769673 - DNA, 22 bp, Artificial Sequence
  chemically synthesized
agatccaagatgatcattaaat

SEQ ID NO: 769674 - DNA, 22 bp, Artificial Sequence
  chemically synthesized
aatgcttcagaatctattattt

SEQ ID NO: 769675 - DNA, 22 bp, Artificial Sequence
  chemically synthesized
aaatgcttcagaatctattatt

SEQ ID NO: 769676 - DNA, 22 bp, Artificial Sequence
  chemically synthesized
taaatgcttcagaatctattat

SEQ ID NO: 769677 - DNA, 22 bp, Artificial Sequence
  chemically synthesized
ttaaatgcttcagaatctatta

SEQ ID NO: 769678 - DNA, 22 bp, Artificial Sequence
  chemically synthesized
ttttaaatgcttcagaatctat

SEQ ID NO: 769679 - DNA, 22 bp, Artificial Sequence
  chemically synthesized
aataatagattctgaagcattt

SEQ ID NO: 769680 - DNA, 22 bp, Artificial Sequence
  chemically synthesized
caagtcctcttttaaatgcttc

SEQ ID NO: 769681 - DNA, 22 bp, Artificial Sequence
  chemically synthesized
aaagttccaagtcctcttttaa

SEQ ID NO: 769682 - DNA, 22 bp, Artificial Sequence
  chemically synthesized
aaaagttccaagtcctctttta

SEQ ID NO: 769683 - DNA, 22 bp, Artificial Sequence
  chemically synthesized
tgaagcatttaaaagaggactt

SEQ ID NO: 769684 - DNA, 22 bp, Artificial Sequence
  chemically synthesized
aagcatttaaaagaggacttgg

SEQ ID NO: 769685 - DNA, 22 bp, Artificial Sequence
  chemically synthesized
aaaagaggacttggaactttta

SEQ ID NO: 769686 - DNA, 22 bp, Artificial Sequence
  chemically synthesized
aaagaggacttggaacttttaa

SEQ ID NO: 769687 - DNA, 22 bp, Artificial Sequence
  chemically synthesized
ggaacttttaaatgccatatgt

SEQ ID NO: 769688 - DNA, 22 bp, Artificial Sequence
  chemically synthesized
gaacttttaaatgccatatgtt

SEQ ID NO: 769689 - DNA, 22 bp, Artificial Sequence
  chemically synthesized
aaaaggtgatcgaacatatggc

SEQ ID NO: 769690 - DNA, 22 bp, Artificial Sequence
  chemically synthesized
aaaaaggtgatcgaacatatgg

SEQ ID NO: 769691 - DNA, 22 bp, Artificial Sequence
  chemically synthesized
taaaaaggtgatcgaacatatg

SEQ ID NO: 769692 - DNA, 22 bp, Artificial Sequence
  chemically synthesized
ttaaatgccatatgttcgatca

SEQ ID NO: 769693 - DNA, 22 bp, Artificial Sequence
  chemically synthesized
taaatgccatatgttcgatcac

SEQ ID NO: 769694 - DNA, 22 bp, Artificial Sequence
  chemically synthesized
tgttttaaaaaggtgatcgaac

SEQ ID NO: 769695 - DNA, 22 bp, Artificial Sequence
  chemically synthesized
aaatgccatatgttcgatcacc

SEQ ID NO: 769696 - DNA, 22 bp, Artificial Sequence
  chemically synthesized
aatgccatatgttcgatcacct

SEQ ID NO: 769697 - DNA, 22 bp, Artificial Sequence
  chemically synthesized
tcatgttatgttttaaaaaggt

SEQ ID NO: 769698 - DNA, 22 bp, Artificial Sequence
  chemically synthesized
gatcacctttttaaaacataac

SEQ ID NO: 769699 - DNA, 22 bp, Artificial Sequence
  chemically synthesized
catgaatattgtcatgttatgt

SEQ ID NO: 769700 - DNA, 22 bp, Artificial Sequence
  chemically synthesized
tttaaaacataacatgacaata

SEQ ID NO: 769701 - DNA, 22 bp, Artificial Sequence
  chemically synthesized
agtctccatgaatattgtcatg

SEQ ID NO: 769702 - DNA, 22 bp, Artificial Sequence
  chemically synthesized
ttaaaacataacatgacaatat

SEQ ID NO: 769703 - DNA, 22 bp, Artificial Sequence
  chemically synthesized
taaaacataacatgacaatatt

SEQ ID NO: 769704 - DNA, 22 bp, Artificial Sequence
  chemically synthesized
aaaacataacatgacaatattc

SEQ ID NO: 769705 - DNA, 22 bp, Artificial Sequence
  chemically synthesized
aaacataacatgacaatattca

SEQ ID NO: 769706 - DNA, 22 bp, Artificial Sequence
  chemically synthesized
catggcatattgagtctccatg

SEQ ID NO: 769707 - DNA, 22 bp, Artificial Sequence
  chemically synthesized
atggagactcaatatgccatgt

SEQ ID NO: 769708 - DNA, 22 bp, Artificial Sequence
  chemically synthesized
taagtaacgtagacattacatg

SEQ ID NO: 769709 - DNA, 22 bp, Artificial Sequence
  chemically synthesized
ctgtaagtaacgtagacattac

SEQ ID NO: 769710 - DNA, 22 bp, Artificial Sequence
  chemically synthesized
aatatgccatgtaatgtctacg

SEQ ID NO: 769711 - DNA, 22 bp, Artificial Sequence
  chemically synthesized
tgctgtaagtaacgtagacatt

SEQ ID NO: 769712 - DNA, 22 bp, Artificial Sequence
  chemically synthesized
tctgctgtaagtaacgtagaca

SEQ ID NO: 769713 - DNA, 22 bp, Artificial Sequence
  chemically synthesized
gtggaactctctgctgtaagta

SEQ ID NO: 769714 - DNA, 22 bp, Artificial Sequence
  chemically synthesized
cgttacttacagcagagagttc

SEQ ID NO: 769715 - DNA, 22 bp, Artificial Sequence
  chemically synthesized
cttacagcagagagttccacta

SEQ ID NO: 769716 - DNA, 22 bp, Artificial Sequence
  chemically synthesized
acagcagagagttccactaatt

SEQ ID NO: 769717 - DNA, 22 bp, Artificial Sequence
  chemically synthesized
cagcagagagttccactaattt

SEQ ID NO: 769718 - DNA, 22 bp, Artificial Sequence
  chemically synthesized
ggcaaagaaaggagcacagaaa

SEQ ID NO: 769719 - DNA, 22 bp, Artificial Sequence
  chemically synthesized
aggcaaagaaaggagcacagaa

SEQ ID NO: 769720 - DNA, 22 bp, Artificial Sequence
  chemically synthesized
cactaattttctgtgctccttt

SEQ ID NO: 769721 - DNA, 22 bp, Artificial Sequence
  chemically synthesized
atttaggcaaagaaaggagcac

SEQ ID NO: 769722 - DNA, 22 bp, Artificial Sequence
  chemically synthesized
attttctgtgctcctttctttg

SEQ ID NO: 769723 - DNA, 22 bp, Artificial Sequence
  chemically synthesized
tctgtgctcctttctttgccta

SEQ ID NO: 769724 - DNA, 22 bp, Artificial Sequence
  chemically synthesized
ctgtgctcctttctttgcctaa

SEQ ID NO: 769725 - DNA, 22 bp, Artificial Sequence
  chemically synthesized
tgtgctcctttctttgcctaaa

SEQ ID NO: 769726 - DNA, 22 bp, Artificial Sequence
  chemically synthesized
tgctcctttctttgcctaaatg

SEQ ID NO: 769727 - DNA, 22 bp, Artificial Sequence
  chemically synthesized
aatgaaatagttcatttaggca

SEQ ID NO: 769728 - DNA, 22 bp, Artificial Sequence
  chemically synthesized
ctttctttgcctaaatgaacta

SEQ ID NO: 769729 - DNA, 22 bp, Artificial Sequence
  chemically synthesized
tgctaaatgaaatagttcattt

SEQ ID NO: 769730 - DNA, 22 bp, Artificial Sequence
  chemically synthesized
tctttgcctaaatgaactattt

SEQ ID NO: 769731 - DNA, 22 bp, Artificial Sequence
  chemically synthesized
ctttgcctaaatgaactatttc

SEQ ID NO: 769732 - DNA, 22 bp, Artificial Sequence
  chemically synthesized
tttgcctaaatgaactatttca

SEQ ID NO: 769733 - DNA, 22 bp, Artificial Sequence
  chemically synthesized
tgcctaaatgaactatttcatt

SEQ ID NO: 769734 - DNA, 22 bp, Artificial Sequence
  chemically synthesized
gcctaaatgaactatttcattt

SEQ ID NO: 769735 - DNA, 22 bp, Artificial Sequence
  chemically synthesized
cctaaatgaactatttcattta

SEQ ID NO: 769736 - DNA, 22 bp, Artificial Sequence
  chemically synthesized
aatgaactatttcatttagcac

SEQ ID NO: 769737 - DNA, 22 bp, Artificial Sequence
  chemically synthesized
caaacaaaatattgtgctaaat

SEQ ID NO: 769738 - DNA, 22 bp, Artificial Sequence
  chemically synthesized
tacaaacaaaatattgtgctaa

SEQ ID NO: 769739 - DNA, 22 bp, Artificial Sequence
  chemically synthesized
ttctacaaacaaaatattgtgc

SEQ ID NO: 769740 - DNA, 22 bp, Artificial Sequence
  chemically synthesized
attctacaaacaaaatattgtg

SEQ ID NO: 769741 - DNA, 22 bp, Artificial Sequence
  chemically synthesized
tattctacaaacaaaatattgt

SEQ ID NO: 769742 - DNA, 22 bp, Artificial Sequence
  chemically synthesized
tttcatttagcacaatattttg

SEQ ID NO: 769743 - DNA, 22 bp, Artificial Sequence
  chemically synthesized
catttagcacaatattttgttt

SEQ ID NO: 769744 - DNA, 22 bp, Artificial Sequence
  chemically synthesized
atttagcacaatattttgtttg

SEQ ID NO: 769745 - DNA, 22 bp, Artificial Sequence
  chemically synthesized
agcacaatattttgtttgtaga

SEQ ID NO: 769746 - DNA, 22 bp, Artificial Sequence
  chemically synthesized
gcacaatattttgtttgtagaa

SEQ ID NO: 769747 - DNA, 22 bp, Artificial Sequence
  chemically synthesized
tgtttgtagaataaaatttatc

SEQ ID NO: 769748 - DNA, 22 bp, Artificial Sequence
  chemically synthesized
gtttgtagaataaaatttatcc

SEQ ID NO: 769749 - DNA, 22 bp, Artificial Sequence
  chemically synthesized
ccaacatcacaaggataaattt

SEQ ID NO: 769750 - DNA, 22 bp, Artificial Sequence
  chemically synthesized
tttgtagaataaaatttatcct

SEQ ID NO: 769751 - DNA, 22 bp, Artificial Sequence
  chemically synthesized
gtagaataaaatttatccttgt

SEQ ID NO: 769752 - DNA, 22 bp, Artificial Sequence
  chemically synthesized
tagaataaaatttatccttgtg

SEQ ID NO: 769753 - DNA, 22 bp, Artificial Sequence
  chemically synthesized
ataactcccaacatcacaagga

SEQ ID NO: 769754 - DNA, 22 bp, Artificial Sequence
  chemically synthesized
cataactcccaacatcacaagg

SEQ ID NO: 769755 - DNA, 22 bp, Artificial Sequence
  chemically synthesized
tttcataactcccaacatcaca

SEQ ID NO: 769756 - DNA, 22 bp, Artificial Sequence
  chemically synthesized
atccttgtgatgttgggagtta

SEQ ID NO: 769757 - DNA, 22 bp, Artificial Sequence
  chemically synthesized
tccttgtgatgttgggagttat

SEQ ID NO: 769758 - DNA, 22 bp, Artificial Sequence
  chemically synthesized
gtgatgttgggagttatgaaat

SEQ ID NO: 769759 - DNA, 22 bp, Artificial Sequence
  chemically synthesized
tgatgttgggagttatgaaata

SEQ ID NO: 769760 - DNA, 22 bp, Artificial Sequence
  chemically synthesized
aaacacatgagttatttcataa

SEQ ID NO: 769761 - DNA, 22 bp, Artificial Sequence
  chemically synthesized
aaaacacatgagttatttcata

SEQ ID NO: 769762 - DNA, 22 bp, Artificial Sequence
  chemically synthesized
taaaacacatgagttatttcat

SEQ ID NO: 769763 - DNA, 22 bp, Artificial Sequence
  chemically synthesized
ggagttatgaaataactcatgt

SEQ ID NO: 769764 - DNA, 22 bp, Artificial Sequence
  chemically synthesized
atgatattttaaaacacatgag

SEQ ID NO: 769765 - DNA, 22 bp, Artificial Sequence
  chemically synthesized
aatgatattttaaaacacatga

SEQ ID NO: 769766 - DNA, 22 bp, Artificial Sequence
  chemically synthesized
tgaaataactcatgtgttttaa

SEQ ID NO: 769767 - DNA, 22 bp, Artificial Sequence
  chemically synthesized
cgtacatttaatgatattttaa

SEQ ID NO: 769768 - DNA, 22 bp, Artificial Sequence
  chemically synthesized
attccgtacatttaatgatatt

SEQ ID NO: 769769 - DNA, 22 bp, Artificial Sequence
  chemically synthesized
atgtgttttaaaatatcattaa

SEQ ID NO: 769770 - DNA, 22 bp, Artificial Sequence
  chemically synthesized
aattccgtacatttaatgatat

SEQ ID NO: 769771 - DNA, 22 bp, Artificial Sequence
  chemically synthesized
tagtttaattccgtacatttaa

SEQ ID NO: 769772 - DNA, 22 bp, Artificial Sequence
  chemically synthesized
taaaatatcattaaatgtacgg

SEQ ID NO: 769773 - DNA, 22 bp, Artificial Sequence
  chemically synthesized
aaaatatcattaaatgtacgga

SEQ ID NO: 769774 - DNA, 22 bp, Artificial Sequence
  chemically synthesized
aaatatcattaaatgtacggaa

SEQ ID NO: 769775 - DNA, 22 bp, Artificial Sequence
  chemically synthesized
attatagtttaattccgtacat

SEQ ID NO: 769776 - DNA, 22 bp, Artificial Sequence
  chemically synthesized
ctaattatagtttaattccgta

SEQ ID NO: 769777 - DNA, 22 bp, Artificial Sequence
  chemically synthesized
tactaattatagtttaattccg

SEQ ID NO: 769778 - DNA, 22 bp, Artificial Sequence
  chemically synthesized
ctactaattatagtttaattcc

SEQ ID NO: 769779 - DNA, 22 bp, Artificial Sequence
  chemically synthesized
aatgtacggaattaaactataa

SEQ ID NO: 769780 - DNA, 22 bp, Artificial Sequence
  chemically synthesized
aaatgatttctactaattatag

SEQ ID NO: 769781 - DNA, 22 bp, Artificial Sequence
  chemically synthesized
aagaccctcaaatgatttctac

SEQ ID NO: 769782 - DNA, 22 bp, Artificial Sequence
  chemically synthesized
aactataattagtagaaatcat

SEQ ID NO: 769783 - DNA, 22 bp, Artificial Sequence
  chemically synthesized
taattagtagaaatcatttgag

SEQ ID NO: 769784 - DNA, 22 bp, Artificial Sequence
  chemically synthesized
gtagaaatcatttgagggtctt

SEQ ID NO: 769785 - DNA, 22 bp, Artificial Sequence
  chemically synthesized
tcagcatcagtaaattaaagac

SEQ ID NO: 769786 - DNA, 22 bp, Artificial Sequence
  chemically synthesized
gtcagcatcagtaaattaaaga

SEQ ID NO: 769787 - DNA, 22 bp, Artificial Sequence
  chemically synthesized
gagggtctttaatttactgatg

SEQ ID NO: 769788 - DNA, 22 bp, Artificial Sequence
  chemically synthesized
agggtctttaatttactgatgc

SEQ ID NO: 769789 - DNA, 22 bp, Artificial Sequence
  chemically synthesized
atgagaatttgtcagcatcagt

SEQ ID NO: 769790 - DNA, 22 bp, Artificial Sequence
  chemically synthesized
gatgagaatttgtcagcatcag

SEQ ID NO: 769791 - DNA, 22 bp, Artificial Sequence
  chemically synthesized
tttgatgagaatttgtcagcat

SEQ ID NO: 769792 - DNA, 22 bp, Artificial Sequence
  chemically synthesized
taatttactgatgctgacaaat

SEQ ID NO: 769793 - DNA, 22 bp, Artificial Sequence
  chemically synthesized
aatttactgatgctgacaaatt

SEQ ID NO: 769794 - DNA, 22 bp, Artificial Sequence
  chemically synthesized
atttactgatgctgacaaattc

SEQ ID NO: 769795 - DNA, 22 bp, Artificial Sequence
  chemically synthesized
actgatgctgacaaattctcat

SEQ ID NO: 769796 - DNA, 22 bp, Artificial Sequence
  chemically synthesized
ctgatgctgacaaattctcatc

SEQ ID NO: 769797 - DNA, 22 bp, Artificial Sequence
  chemically synthesized
atgctgacaaattctcatcaaa

SEQ ID NO: 769798 - DNA, 22 bp, Artificial Sequence
  chemically synthesized
aaagcacagtaactatttgatg

SEQ ID NO: 769799 - DNA, 22 bp, Artificial Sequence
  chemically synthesized
gaaagcacagtaactatttgat

SEQ ID NO: 769800 - DNA, 22 bp, Artificial Sequence
  chemically synthesized
acaaattctcatcaaatagtta

SEQ ID NO: 769801 - DNA, 22 bp, Artificial Sequence
  chemically synthesized
cttgaaagcacagtaactattt

SEQ ID NO: 769802 - DNA, 22 bp, Artificial Sequence
  chemically synthesized
acttgaaagcacagtaactatt

SEQ ID NO: 769803 - DNA, 22 bp, Artificial Sequence
  chemically synthesized
tacttgaaagcacagtaactat

SEQ ID NO: 769804 - DNA, 22 bp, Artificial Sequence
  chemically synthesized
ttttacttgaaagcacagtaac

SEQ ID NO: 769805 - DNA, 22 bp, Artificial Sequence
  chemically synthesized
tcatcaaatagttactgtgctt

SEQ ID NO: 769806 - DNA, 22 bp, Artificial Sequence
  chemically synthesized
atcaaatagttactgtgctttc

SEQ ID NO: 769807 - DNA, 22 bp, Artificial Sequence
  chemically synthesized
caaagatgttattttacttgaa

SEQ ID NO: 769808 - DNA, 22 bp, Artificial Sequence
  chemically synthesized
cctacaaagatgttattttact

SEQ ID NO: 769809 - DNA, 22 bp, Artificial Sequence
  chemically synthesized
ctgtgctttcaagtaaaataac

SEQ ID NO: 769810 - DNA, 22 bp, Artificial Sequence
  chemically synthesized
tgctttcaagtaaaataacatc

SEQ ID NO: 769811 - DNA, 22 bp, Artificial Sequence
  chemically synthesized
catctgcctacaaagatgttat

SEQ ID NO: 769812 - DNA, 22 bp, Artificial Sequence
  chemically synthesized
acatctgcctacaaagatgtta

SEQ ID NO: 769813 - DNA, 22 bp, Artificial Sequence
  chemically synthesized
tcaagtaaaataacatctttgt

SEQ ID NO: 769814 - DNA, 22 bp, Artificial Sequence
  chemically synthesized
caagtaaaataacatctttgta

SEQ ID NO: 769815 - DNA, 22 bp, Artificial Sequence
  chemically synthesized
aagtaaaataacatctttgtag

SEQ ID NO: 769816 - DNA, 22 bp, Artificial Sequence
  chemically synthesized
gtgtcttacatctgcctacaaa

SEQ ID NO: 769817 - DNA, 22 bp, Artificial Sequence
  chemically synthesized
tagtgtcttacatctgcctaca

SEQ ID NO: 769818 - DNA, 22 bp, Artificial Sequence
  chemically synthesized
ctagtgtcttacatctgcctac

SEQ ID NO: 769819 - DNA, 22 bp, Artificial Sequence
  chemically synthesized
tctagtgtcttacatctgccta

SEQ ID NO: 769820 - DNA, 22 bp, Artificial Sequence
  chemically synthesized
ttctagtgtcttacatctgcct

SEQ ID NO: 769821 - DNA, 22 bp, Artificial Sequence
  chemically synthesized
tttttctagtgtcttacatctg

SEQ ID NO: 769822 - DNA, 22 bp, Artificial Sequence
  chemically synthesized
tgtaggcagatgtaagacacta

SEQ ID NO: 769823 - DNA, 22 bp, Artificial Sequence
  chemically synthesized
gtaggcagatgtaagacactag

SEQ ID NO: 769824 - DNA, 22 bp, Artificial Sequence
  chemically synthesized
taggcagatgtaagacactaga

SEQ ID NO: 769825 - DNA, 22 bp, Artificial Sequence
  chemically synthesized
aaagtgtacattatttttctag

SEQ ID NO: 769826 - DNA, 22 bp, Artificial Sequence
  chemically synthesized
gaaagtgtacattatttttcta

SEQ ID NO: 769827 - DNA, 22 bp, Artificial Sequence
  chemically synthesized
tgaaagtgtacattatttttct

SEQ ID NO: 769828 - DNA, 22 bp, Artificial Sequence
  chemically synthesized
tttgaaagtgtacattattttt

SEQ ID NO: 769829 - DNA, 22 bp, Artificial Sequence
  chemically synthesized
tctttgaaagtgtacattattt

SEQ ID NO: 769830 - DNA, 22 bp, Artificial Sequence
  chemically synthesized
ctctttgaaagtgtacattatt

SEQ ID NO: 769831 - DNA, 22 bp, Artificial Sequence
  chemically synthesized
tctctttgaaagtgtacattat

SEQ ID NO: 769832 - DNA, 22 bp, Artificial Sequence
  chemically synthesized
actttctctttgaaagtgtaca

SEQ ID NO: 769833 - DNA, 22 bp, Artificial Sequence
  chemically synthesized
gaaaaataatgtacactttcaa

SEQ ID NO: 769834 - DNA, 22 bp, Artificial Sequence
  chemically synthesized
agaggtatgggaggttcacttt

SEQ ID NO: 769835 - DNA, 22 bp, Artificial Sequence
  chemically synthesized
cagaggtatgggaggttcactt

SEQ ID NO: 769836 - DNA, 22 bp, Artificial Sequence
  chemically synthesized
tcaaagagaaagtgaacctccc

SEQ ID NO: 769837 - DNA, 22 bp, Artificial Sequence
  chemically synthesized
tttcagaggtatgggaggttca

SEQ ID NO: 769838 - DNA, 22 bp, Artificial Sequence
  chemically synthesized
caaagagaaagtgaacctccca

SEQ ID NO: 769839 - DNA, 22 bp, Artificial Sequence
  chemically synthesized
atttcagaggtatgggaggttc

SEQ ID NO: 769840 - DNA, 22 bp, Artificial Sequence
  chemically synthesized
aaagagaaagtgaacctcccat

SEQ ID NO: 769841 - DNA, 22 bp, Artificial Sequence
  chemically synthesized
tatttcagaggtatgggaggtt

SEQ ID NO: 769842 - DNA, 22 bp, Artificial Sequence
  chemically synthesized
ttatttcagaggtatgggaggt

SEQ ID NO: 769843 - DNA, 22 bp, Artificial Sequence
  chemically synthesized
cttttatttcagaggtatggga

SEQ ID NO: 769844 - DNA, 22 bp, Artificial Sequence
  chemically synthesized
aattgcttttatttcagaggta

SEQ ID NO: 769845 - DNA, 22 bp, Artificial Sequence
  chemically synthesized
taaattgcttttatttcagagg

SEQ ID NO: 769846 - DNA, 22 bp, Artificial Sequence
  chemically synthesized
ctaaattgcttttatttcagag

SEQ ID NO: 769847 - DNA, 22 bp, Artificial Sequence
  chemically synthesized
ccatacctctgaaataaaagca

SEQ ID NO: 769848 - DNA, 22 bp, Artificial Sequence
  chemically synthesized
tgaaataaaagcaatttagaaa

SEQ ID NO: 769849 - DNA, 22 bp, Artificial Sequence
  chemically synthesized
aaatatatcagatttctaaatt

SEQ ID NO: 769850 - DNA, 22 bp, Artificial Sequence
  chemically synthesized
aaaatatatcagatttctaaat

SEQ ID NO: 769851 - DNA, 22 bp, Artificial Sequence
  chemically synthesized
aaataaaagcaatttagaaatc

SEQ ID NO: 769852 - DNA, 22 bp, Artificial Sequence
  chemically synthesized
taaaatatatcagatttctaaa

SEQ ID NO: 769853 - DNA, 22 bp, Artificial Sequence
  chemically synthesized
ttaaaatatatcagatttctaa

SEQ ID NO: 769854 - DNA, 22 bp, Artificial Sequence
  chemically synthesized
ttttaaaatatatcagatttct

SEQ ID NO: 769855 - DNA, 22 bp, Artificial Sequence
  chemically synthesized
tgtgcctcttttaaaatatatc

SEQ ID NO: 769856 - DNA, 22 bp, Artificial Sequence
  chemically synthesized
atgtgcctcttttaaaatatat

SEQ ID NO: 769857 - DNA, 22 bp, Artificial Sequence
  chemically synthesized
agaaatctgatatattttaaaa

SEQ ID NO: 769858 - DNA, 22 bp, Artificial Sequence
  chemically synthesized
gaaatctgatatattttaaaag

SEQ ID NO: 769859 - DNA, 22 bp, Artificial Sequence
  chemically synthesized
acttatgtgcctcttttaaaat

SEQ ID NO: 769860 - DNA, 22 bp, Artificial Sequence
  chemically synthesized
cagattaacttatgtgcctctt

SEQ ID NO: 769861 - DNA, 22 bp, Artificial Sequence
  chemically synthesized
atatattttaaaagaggcacat

SEQ ID NO: 769862 - DNA, 22 bp, Artificial Sequence
  chemically synthesized
acagattaacttatgtgcctct

SEQ ID NO: 769863 - DNA, 22 bp, Artificial Sequence
  chemically synthesized
taaaagaggcacataagttaat

SEQ ID NO: 769864 - DNA, 22 bp, Artificial Sequence
  chemically synthesized
aaaagaggcacataagttaatc

SEQ ID NO: 769865 - DNA, 22 bp, Artificial Sequence
  chemically synthesized
aaagaggcacataagttaatct

SEQ ID NO: 769866 - DNA, 22 bp, Artificial Sequence
  chemically synthesized
accgtcaacgagtaaagtgaaa

SEQ ID NO: 769867 - DNA, 22 bp, Artificial Sequence
  chemically synthesized
caccgtcaacgagtaaagtgaa

SEQ ID NO: 769868 - DNA, 22 bp, Artificial Sequence
  chemically synthesized
atctgtaaatttcactttactc

SEQ ID NO: 769869 - DNA, 22 bp, Artificial Sequence
  chemically synthesized
taaatttcactttactcgttga

SEQ ID NO: 769870 - DNA, 22 bp, Artificial Sequence
  chemically synthesized
aacgtagcatttcaccgtcaac

SEQ ID NO: 769871 - DNA, 22 bp, Artificial Sequence
  chemically synthesized
cactttactcgttgacggtgaa

SEQ ID NO: 769872 - DNA, 22 bp, Artificial Sequence
  chemically synthesized
actttactcgttgacggtgaaa

SEQ ID NO: 769873 - DNA, 22 bp, Artificial Sequence
  chemically synthesized
tactcgttgacggtgaaatgct

SEQ ID NO: 769874 - DNA, 22 bp, Artificial Sequence
  chemically synthesized
actcgttgacggtgaaatgcta

SEQ ID NO: 769875 - DNA, 22 bp, Artificial Sequence
  chemically synthesized
ctcgttgacggtgaaatgctac

SEQ ID NO: 769876 - DNA, 22 bp, Artificial Sequence
  chemically synthesized
gttgacggtgaaatgctacgtt

SEQ ID NO: 769877 - DNA, 22 bp, Artificial Sequence
  chemically synthesized
taacaacagattgaacgtagca

SEQ ID NO: 769878 - DNA, 22 bp, Artificial Sequence
  chemically synthesized
acggtgaaatgctacgttcaat

SEQ ID NO: 769879 - DNA, 22 bp, Artificial Sequence
  chemically synthesized
ctgtaacaacagattgaacgta

SEQ ID NO: 769880 - DNA, 22 bp, Artificial Sequence
  chemically synthesized
gctgtaacaacagattgaacgt

SEQ ID NO: 769881 - DNA, 22 bp, Artificial Sequence
  chemically synthesized
tgctgtaacaacagattgaacg

SEQ ID NO: 769882 - DNA, 22 bp, Artificial Sequence
  chemically synthesized
ttgctgtaacaacagattgaac

SEQ ID NO: 769883 - DNA, 22 bp, Artificial Sequence
  chemically synthesized
tttgctgtaacaacagattgaa

SEQ ID NO: 769884 - DNA, 22 bp, Artificial Sequence
  chemically synthesized
actttttgctgtaacaacagat

SEQ ID NO: 769885 - DNA, 22 bp, Artificial Sequence
  chemically synthesized
cattaactttttgctgtaacaa

SEQ ID NO: 769886 - DNA, 22 bp, Artificial Sequence
  chemically synthesized
cgttcaatctgttgttacagca

SEQ ID NO: 769887 - DNA, 22 bp, Artificial Sequence
  chemically synthesized
ccattaactttttgctgtaaca

SEQ ID NO: 769888 - DNA, 22 bp, Artificial Sequence
  chemically synthesized
tccattaactttttgctgtaac

SEQ ID NO: 769889 - DNA, 22 bp, Artificial Sequence
  chemically synthesized
aatctgttgttacagcaaaaag

SEQ ID NO: 769890 - DNA, 22 bp, Artificial Sequence
  chemically synthesized
ttgttacagcaaaaagttaatg

SEQ ID NO: 769891 - DNA, 22 bp, Artificial Sequence
  chemically synthesized
ttacagcaaaaagttaatggaa

SEQ ID NO: 769892 - DNA, 22 bp, Artificial Sequence
  chemically synthesized
cagcaaaaagttaatggaaagt

SEQ ID NO: 769893 - DNA, 22 bp, Artificial Sequence
  chemically synthesized
cagtgaagtcaaactttccatt

SEQ ID NO: 769894 - DNA, 22 bp, Artificial Sequence
  chemically synthesized
ttacagtgaagtcaaactttcc

SEQ ID NO: 769895 - DNA, 22 bp, Artificial Sequence
  chemically synthesized
atggaaagtttgacttcactgt

SEQ ID NO: 769896 - DNA, 22 bp, Artificial Sequence
  chemically synthesized
aaagaggatattgttacagtga

SEQ ID NO: 769897 - DNA, 22 bp, Artificial Sequence
  chemically synthesized
gttaaaagaggatattgttaca

SEQ ID NO: 769898 - DNA, 22 bp, Artificial Sequence
  chemically synthesized
ggttaaaagaggatattgttac

SEQ ID NO: 769899 - DNA, 22 bp, Artificial Sequence
  chemically synthesized
gacttcactgtaacaatatcct

SEQ ID NO: 769900 - DNA, 22 bp, Artificial Sequence
  chemically synthesized
tttggttaaaagaggatattgt

SEQ ID NO: 769901 - DNA, 22 bp, Artificial Sequence
  chemically synthesized
acttcactgtaacaatatcctc

SEQ ID NO: 769902 - DNA, 22 bp, Artificial Sequence
  chemically synthesized
cactgtaacaatatcctctttt

SEQ ID NO: 769903 - DNA, 22 bp, Artificial Sequence
  chemically synthesized
actgtaacaatatcctctttta

SEQ ID NO: 769904 - DNA, 22 bp, Artificial Sequence
  chemically synthesized
taacaatatcctcttttaacca

SEQ ID NO: 769905 - DNA, 22 bp, Artificial Sequence
  chemically synthesized
aggaaggttatttggttaaaag

SEQ ID NO: 769906 - DNA, 22 bp, Artificial Sequence
  chemically synthesized
aaggaaggttatttggttaaaa

SEQ ID NO: 769907 - DNA, 22 bp, Artificial Sequence
  chemically synthesized
tccaaggtttaaggaaggttat

SEQ ID NO: 769908 - DNA, 22 bp, Artificial Sequence
  chemically synthesized
atccaaggtttaaggaaggtta

SEQ ID NO: 769909 - DNA, 22 bp, Artificial Sequence
  chemically synthesized
ttttaaccaaataaccttcctt

SEQ ID NO: 769910 - DNA, 22 bp, Artificial Sequence
  chemically synthesized
tatccaaggtttaaggaaggtt

SEQ ID NO: 769911 - DNA, 22 bp, Artificial Sequence
  chemically synthesized
ttaaccaaataaccttccttaa

SEQ ID NO: 769912 - DNA, 22 bp, Artificial Sequence
  chemically synthesized
taaccaaataaccttccttaaa

SEQ ID NO: 769913 - DNA, 22 bp, Artificial Sequence
  chemically synthesized
aaccaaataaccttccttaaac

SEQ ID NO: 769914 - DNA, 22 bp, Artificial Sequence
  chemically synthesized
accaaataaccttccttaaacc

SEQ ID NO: 769915 - DNA, 22 bp, Artificial Sequence
  chemically synthesized
ccttaaaccttggataaaattc

SEQ ID NO: 769916 - DNA, 22 bp, Artificial Sequence
  chemically synthesized
cttaaaccttggataaaattcc

SEQ ID NO: 769917 - DNA, 22 bp, Artificial Sequence
  chemically synthesized
aaaccttggataaaattcccct

SEQ ID NO: 769918 - DNA, 22 bp, Artificial Sequence
  chemically synthesized
aaccttggataaaattcccctg

SEQ ID NO: 769919 - DNA, 22 bp, Artificial Sequence
  chemically synthesized
ggataaaattcccctgtttcac

SEQ ID NO: 769920 - DNA, 22 bp, Artificial Sequence
  chemically synthesized
gataaaattcccctgtttcaca

SEQ ID NO: 769921 - DNA, 22 bp, Artificial Sequence
  chemically synthesized
tgatggtgatagtgtgaaacag

SEQ ID NO: 769922 - DNA, 22 bp, Artificial Sequence
  chemically synthesized
tctgtgatggtgatagtgtgaa

SEQ ID NO: 769923 - DNA, 22 bp, Artificial Sequence
  chemically synthesized
atctgtgatggtgatagtgtga

SEQ ID NO: 769924 - DNA, 22 bp, Artificial Sequence
  chemically synthesized
ccctgtttcacactatcaccat

SEQ ID NO: 769925 - DNA, 22 bp, Artificial Sequence
  chemically synthesized
aatccgtttatctgtgatggtg

SEQ ID NO: 769926 - DNA, 22 bp, Artificial Sequence
  chemically synthesized
tttcacactatcaccatcacag

SEQ ID NO: 769927 - DNA, 22 bp, Artificial Sequence
  chemically synthesized
caatccgtttatctgtgatggt

SEQ ID NO: 769928 - DNA, 22 bp, Artificial Sequence
  chemically synthesized
tcaatccgtttatctgtgatgg

SEQ ID NO: 769929 - DNA, 22 bp, Artificial Sequence
  chemically synthesized
ttcaatccgtttatctgtgatg

SEQ ID NO: 769930 - DNA, 22 bp, Artificial Sequence
  chemically synthesized
cacactatcaccatcacagata

SEQ ID NO: 769931 - DNA, 22 bp, Artificial Sequence
  chemically synthesized
acactatcaccatcacagataa

SEQ ID NO: 769932 - DNA, 22 bp, Artificial Sequence
  chemically synthesized
tcttttcaatccgtttatctgt

SEQ ID NO: 769933 - DNA, 22 bp, Artificial Sequence
  chemically synthesized
tcaccatcacagataaacggat

SEQ ID NO: 769934 - DNA, 22 bp, Artificial Sequence
  chemically synthesized
agaatggtgttgtcttttcaat

SEQ ID NO: 769935 - DNA, 22 bp, Artificial Sequence
  chemically synthesized
ctgagaatggtgttgtcttttc

SEQ ID NO: 769936 - DNA, 22 bp, Artificial Sequence
  chemically synthesized
tactgagaatggtgttgtcttt

SEQ ID NO: 769937 - DNA, 22 bp, Artificial Sequence
  chemically synthesized
aaaagacaacaccattctcagt

SEQ ID NO: 769938 - DNA, 22 bp, Artificial Sequence
  chemically synthesized
agtgtaagcaaacagttctact

SEQ ID NO: 769939 - DNA, 22 bp, Artificial Sequence
  chemically synthesized
actgagtgtaagcaaacagttc

SEQ ID NO: 769940 - DNA, 22 bp, Artificial Sequence
  chemically synthesized
gctaactgagtgtaagcaaaca

SEQ ID NO: 769941 - DNA, 22 bp, Artificial Sequence
  chemically synthesized
ggctaactgagtgtaagcaaac

SEQ ID NO: 769942 - DNA, 22 bp, Artificial Sequence
  chemically synthesized
tcagtagaactgtttgcttaca

SEQ ID NO: 769943 - DNA, 22 bp, Artificial Sequence
  chemically synthesized
agtagaactgtttgcttacact

SEQ ID NO: 769944 - DNA, 22 bp, Artificial Sequence
  chemically synthesized
tttgcttacactcagttagcca

SEQ ID NO: 769945 - DNA, 22 bp, Artificial Sequence
  chemically synthesized
gcttacactcagttagccaagc

SEQ ID NO: 769946 - DNA, 22 bp, Artificial Sequence
  chemically synthesized
cttacactcagttagccaagct

SEQ ID NO: 769947 - DNA, 22 bp, Artificial Sequence
  chemically synthesized
acactcagttagccaagcttct

SEQ ID NO: 769948 - DNA, 22 bp, Artificial Sequence
  chemically synthesized
cactcagttagccaagcttcta

SEQ ID NO: 769949 - DNA, 22 bp, Artificial Sequence
  chemically synthesized
agttagccaagcttctactacc

SEQ ID NO: 769950 - DNA, 22 bp, Artificial Sequence
  chemically synthesized
catggcaatgaaatcaggtagt

SEQ ID NO: 769951 - DNA, 22 bp, Artificial Sequence
  chemically synthesized
gccaagcttctactacctgatt

SEQ ID NO: 769952 - DNA, 22 bp, Artificial Sequence
  chemically synthesized
ccatggcaatgaaatcaggtag

SEQ ID NO: 769953 - DNA, 22 bp, Artificial Sequence
  chemically synthesized
tccatggcaatgaaatcaggta

SEQ ID NO: 769954 - DNA, 22 bp, Artificial Sequence
  chemically synthesized
ctactacctgatttcattgcca

SEQ ID NO: 769955 - DNA, 22 bp, Artificial Sequence
  chemically synthesized
gaggattttccatggcaatgaa

SEQ ID NO: 769956 - DNA, 22 bp, Artificial Sequence
  chemically synthesized
tactacctgatttcattgccat

SEQ ID NO: 769957 - DNA, 22 bp, Artificial Sequence
  chemically synthesized
ctacctgatttcattgccatgg

SEQ ID NO: 769958 - DNA, 22 bp, Artificial Sequence
  chemically synthesized
tcctggaggattttccatggca

SEQ ID NO: 769959 - DNA, 22 bp, Artificial Sequence
  chemically synthesized
cctgatttcattgccatggaaa

SEQ ID NO: 769960 - DNA, 22 bp, Artificial Sequence
  chemically synthesized
atttcattgccatggaaaatcc

SEQ ID NO: 769961 - DNA, 22 bp, Artificial Sequence
  chemically synthesized
cattgccatggaaaatcctcca

SEQ ID NO: 769962 - DNA, 22 bp, Artificial Sequence
  chemically synthesized
cccaagttatcctggaggattt

SEQ ID NO: 769963 - DNA, 22 bp, Artificial Sequence
  chemically synthesized
attgccatggaaaatcctccag

SEQ ID NO: 769964 - DNA, 22 bp, Artificial Sequence
  chemically synthesized
ctacccaagttatcctggagga

SEQ ID NO: 769965 - DNA, 22 bp, Artificial Sequence
  chemically synthesized
ccatggaaaatcctccaggata

SEQ ID NO: 769966 - DNA, 22 bp, Artificial Sequence
  chemically synthesized
caggataacttgggtagcagct

SEQ ID NO: 769967 - DNA, 22 bp, Artificial Sequence
  chemically synthesized
ggagaagtaatagaggtagctg

SEQ ID NO: 769968 - DNA, 22 bp, Artificial Sequence
  chemically synthesized
gggtagcagctacctctattac

SEQ ID NO: 769969 - DNA, 22 bp, Artificial Sequence
  chemically synthesized
ggtagcagctacctctattact

SEQ ID NO: 769970 - DNA, 22 bp, Artificial Sequence
  chemically synthesized
gaagcagtgggatgttgggaga

SEQ ID NO: 769971 - DNA, 22 bp, Artificial Sequence
  chemically synthesized
cctctattacttctcccaacat

SEQ ID NO: 769972 - DNA, 22 bp, Artificial Sequence
  chemically synthesized
tattacttctcccaacatccca

SEQ ID NO: 769973 - DNA, 22 bp, Artificial Sequence
  chemically synthesized
ttacttctcccaacatcccact

SEQ ID NO: 769974 - DNA, 22 bp, Artificial Sequence
  chemically synthesized
cttctcccaacatcccactgct

SEQ ID NO: 769975 - DNA, 22 bp, Artificial Sequence
  chemically synthesized
ctcccaacatcccactgcttcc

SEQ ID NO: 769976 - DNA, 22 bp, Artificial Sequence
  chemically synthesized
tcccaacatcccactgcttcca

SEQ ID NO: 769977 - DNA, 22 bp, Artificial Sequence
  chemically synthesized
ccaacatcccactgcttccagt

SEQ ID NO: 769978 - DNA, 22 bp, Artificial Sequence
  chemically synthesized
taacagcaaacagtagcaactg

SEQ ID NO: 769979 - DNA, 22 bp, Artificial Sequence
  chemically synthesized
attgtaacagcaaacagtagca

SEQ ID NO: 769980 - DNA, 22 bp, Artificial Sequence
  chemically synthesized
cttccagttgctactgtttgct

SEQ ID NO: 769981 - DNA, 22 bp, Artificial Sequence
  chemically synthesized
ccactgattgtaacagcaaaca

SEQ ID NO: 769982 - DNA, 22 bp, Artificial Sequence
  chemically synthesized
ccagttgctactgtttgctgtt

SEQ ID NO: 769983 - DNA, 22 bp, Artificial Sequence
  chemically synthesized
cagttgctactgtttgctgtta

SEQ ID NO: 769984 - DNA, 22 bp, Artificial Sequence
  chemically synthesized
ggctaccactgattgtaacagc

SEQ ID NO: 769985 - DNA, 22 bp, Artificial Sequence
  chemically synthesized
taggctaccactgattgtaaca

SEQ ID NO: 769986 - DNA, 22 bp, Artificial Sequence
  chemically synthesized
ctactgtttgctgttacaatca

SEQ ID NO: 769987 - DNA, 22 bp, Artificial Sequence
  chemically synthesized
ctaggctaccactgattgtaac

SEQ ID NO: 769988 - DNA, 22 bp, Artificial Sequence
  chemically synthesized
ctgtttgctgttacaatcagtg

SEQ ID NO: 769989 - DNA, 22 bp, Artificial Sequence
  chemically synthesized
tttgctgttacaatcagtggta

SEQ ID NO: 769990 - DNA, 22 bp, Artificial Sequence
  chemically synthesized
aagtttctaggctaccactgat

SEQ ID NO: 769991 - DNA, 22 bp, Artificial Sequence
  chemically synthesized
gctgttacaatcagtggtagcc

SEQ ID NO: 769992 - DNA, 22 bp, Artificial Sequence
  chemically synthesized
ctgttacaatcagtggtagcct

SEQ ID NO: 769993 - DNA, 22 bp, Artificial Sequence
  chemically synthesized
ttacaatcagtggtagcctaga

SEQ ID NO: 769994 - DNA, 22 bp, Artificial Sequence
  chemically synthesized
ggtggttcaagtttctaggcta

SEQ ID NO: 769995 - DNA, 22 bp, Artificial Sequence
  chemically synthesized
gggtggttcaagtttctaggct

SEQ ID NO: 769996 - DNA, 22 bp, Artificial Sequence
  chemically synthesized
caatcagtggtagcctagaaac

SEQ ID NO: 769997 - DNA, 22 bp, Artificial Sequence
  chemically synthesized
aaacacttgggtggttcaagtt

SEQ ID NO: 769998 - DNA, 22 bp, Artificial Sequence
  chemically synthesized
aaaacacttgggtggttcaagt

SEQ ID NO: 769999 - DNA, 22 bp, Artificial Sequence
  chemically synthesized
cgcatttaaaacacttgggtgg

SEQ ID NO: 770000 - DNA, 22 bp, Artificial Sequence
  chemically synthesized
ccgcatttaaaacacttgggtg

SEQ ID NO: 770001 - DNA, 22 bp, Artificial Sequence
  chemically synthesized
gaaacttgaaccacccaagtgt

SEQ ID NO: 770002 - DNA, 22 bp, Artificial Sequence
  chemically synthesized
ttccgcatttaaaacacttggg

SEQ ID NO: 770003 - DNA, 22 bp, Artificial Sequence
  chemically synthesized
tcttccgcatttaaaacacttg

SEQ ID NO: 770004 - DNA, 22 bp, Artificial Sequence
  chemically synthesized
ctcttccgcatttaaaacactt

SEQ ID NO: 770005 - DNA, 22 bp, Artificial Sequence
  chemically synthesized
tctcttccgcatttaaaacact

SEQ ID NO: 770006 - DNA, 22 bp, Artificial Sequence
  chemically synthesized
gaaccacccaagtgttttaaat

SEQ ID NO: 770007 - DNA, 22 bp, Artificial Sequence
  chemically synthesized
aaccacccaagtgttttaaatg

SEQ ID NO: 770008 - DNA, 22 bp, Artificial Sequence
  chemically synthesized
agattttctcttccgcatttaa

SEQ ID NO: 770009 - DNA, 22 bp, Artificial Sequence
  chemically synthesized
cctcagattttctcttccgcat

SEQ ID NO: 770010 - DNA, 22 bp, Artificial Sequence
  chemically synthesized
ccctcagattttctcttccgca

SEQ ID NO: 770011 - DNA, 22 bp, Artificial Sequence
  chemically synthesized
tccctcagattttctcttccgc

SEQ ID NO: 770012 - DNA, 22 bp, Artificial Sequence
  chemically synthesized
taaatgcggaagagaaaatctg

SEQ ID NO: 770013 - DNA, 22 bp, Artificial Sequence
  chemically synthesized
ccaattttccctcagattttct

SEQ ID NO: 770014 - DNA, 22 bp, Artificial Sequence
  chemically synthesized
aaatgcggaagagaaaatctga

SEQ ID NO: 770015 - DNA, 22 bp, Artificial Sequence
  chemically synthesized
cccaattttccctcagattttc

SEQ ID NO: 770016 - DNA, 22 bp, Artificial Sequence
  chemically synthesized
aatgcggaagagaaaatctgag

SEQ ID NO: 770017 - DNA, 22 bp, Artificial Sequence
  chemically synthesized
cttcccaattttccctcagatt

SEQ ID NO: 770018 - DNA, 22 bp, Artificial Sequence
  chemically synthesized
ccttcccaattttccctcagat

SEQ ID NO: 770019 - DNA, 22 bp, Artificial Sequence
  chemically synthesized
tccttcccaattttccctcaga

SEQ ID NO: 770020 - DNA, 22 bp, Artificial Sequence
  chemically synthesized
ttccttcccaattttccctcag

SEQ ID NO: 770021 - DNA, 22 bp, Artificial Sequence
  chemically synthesized
tttccttcccaattttccctca

SEQ ID NO: 770022 - DNA, 22 bp, Artificial Sequence
  chemically synthesized
agggaaaattgggaaggaaaaa

SEQ ID NO: 770023 - DNA, 22 bp, Artificial Sequence
  chemically synthesized
ggaaacatggaaacactttttc

SEQ ID NO: 770024 - DNA, 22 bp, Artificial Sequence
  chemically synthesized
cggaaacatggaaacacttttt

SEQ ID NO: 770025 - DNA, 22 bp, Artificial Sequence
  chemically synthesized
ttcggaaacatggaaacacttt

SEQ ID NO: 770026 - DNA, 22 bp, Artificial Sequence
  chemically synthesized
ggaaggaaaaagtgtttccatg

SEQ ID NO: 770027 - DNA, 22 bp, Artificial Sequence
  chemically synthesized
ccatgtttccgaagagcggcat

SEQ ID NO: 770028 - DNA, 22 bp, Artificial Sequence
  chemically synthesized
catgtttccgaagagcggcatt

SEQ ID NO: 770029 - DNA, 22 bp, Artificial Sequence
  chemically synthesized
ccgaagagcggcattgtgcttg

SEQ ID NO: 770030 - DNA, 22 bp, Artificial Sequence
  chemically synthesized
cgaagagcggcattgtgcttgt

SEQ ID NO: 770031 - DNA, 22 bp, Artificial Sequence
  chemically synthesized
atgaaaaacagtcatacaagca

SEQ ID NO: 770032 - DNA, 22 bp, Artificial Sequence
  chemically synthesized
tgcttgtatgactgtttttcat

SEQ ID NO: 770033 - DNA, 22 bp, Artificial Sequence
  chemically synthesized
caaaaagtcaaagctgatgaaa

SEQ ID NO: 770034 - DNA, 22 bp, Artificial Sequence
  chemically synthesized
gtatgactgtttttcatcagct

SEQ ID NO: 770035 - DNA, 22 bp, Artificial Sequence
  chemically synthesized
tatgactgtttttcatcagctt

SEQ ID NO: 770036 - DNA, 22 bp, Artificial Sequence
  chemically synthesized
tccaaaaagtcaaagctgatga

SEQ ID NO: 770037 - DNA, 22 bp, Artificial Sequence
  chemically synthesized
cctctccaaaaagtcaaagctg

SEQ ID NO: 770038 - DNA, 22 bp, Artificial Sequence
  chemically synthesized
tttttcatcagctttgactttt

SEQ ID NO: 770039 - DNA, 22 bp, Artificial Sequence
  chemically synthesized
ttcatcagctttgactttttgg

SEQ ID NO: 770040 - DNA, 22 bp, Artificial Sequence
  chemically synthesized
tcatcagctttgactttttgga

SEQ ID NO: 770041 - DNA, 22 bp, Artificial Sequence
  chemically synthesized
catcagctttgactttttggag

SEQ ID NO: 770042 - DNA, 22 bp, Artificial Sequence
  chemically synthesized
atcagctttgactttttggaga

SEQ ID NO: 770043 - DNA, 22 bp, Artificial Sequence
  chemically synthesized
tgaaaagtaaaactgcctctcc

SEQ ID NO: 770044 - DNA, 22 bp, Artificial Sequence
  chemically synthesized
tgactttttggagaggcagttt

SEQ ID NO: 770045 - DNA, 22 bp, Artificial Sequence
  chemically synthesized
gactttttggagaggcagtttt

SEQ ID NO: 770046 - DNA, 22 bp, Artificial Sequence
  chemically synthesized
gctatgaaaagtaaaactgcct

SEQ ID NO: 770047 - DNA, 22 bp, Artificial Sequence
  chemically synthesized
actttttggagaggcagtttta

SEQ ID NO: 770048 - DNA, 22 bp, Artificial Sequence
  chemically synthesized
tttggagaggcagttttacttt

SEQ ID NO: 770049 - DNA, 22 bp, Artificial Sequence
  chemically synthesized
gactagctatgaaaagtaaaac

SEQ ID NO: 770050 - DNA, 22 bp, Artificial Sequence
  chemically synthesized
ttggagaggcagttttactttt

SEQ ID NO: 770051 - DNA, 22 bp, Artificial Sequence
  chemically synthesized
tggagaggcagttttacttttc

SEQ ID NO: 770052 - DNA, 22 bp, Artificial Sequence
  chemically synthesized
ggagaggcagttttacttttca

SEQ ID NO: 770053 - DNA, 22 bp, Artificial Sequence
  chemically synthesized
gagaggcagttttacttttcat

SEQ ID NO: 770054 - DNA, 22 bp, Artificial Sequence
  chemically synthesized
tacttttcatagctagtctaat

SEQ ID NO: 770055 - DNA, 22 bp, Artificial Sequence
  chemically synthesized
gtgagaagaaatattagactag

SEQ ID NO: 770056 - DNA, 22 bp, Artificial Sequence
  chemically synthesized
acttttcatagctagtctaata

SEQ ID NO: 770057 - DNA, 22 bp, Artificial Sequence
  chemically synthesized
agtgagaagaaatattagacta

SEQ ID NO: 770058 - DNA, 22 bp, Artificial Sequence
  chemically synthesized
cttttcatagctagtctaatat

SEQ ID NO: 770059 - DNA, 22 bp, Artificial Sequence
  chemically synthesized
tttagtgagaagaaatattaga

SEQ ID NO: 770060 - DNA, 22 bp, Artificial Sequence
  chemically synthesized
ttcatagctagtctaatatttc

SEQ ID NO: 770061 - DNA, 22 bp, Artificial Sequence
  chemically synthesized
tcatagctagtctaatatttct

SEQ ID NO: 770062 - DNA, 22 bp, Artificial Sequence
  chemically synthesized
catagctagtctaatatttctt

SEQ ID NO: 770063 - DNA, 22 bp, Artificial Sequence
  chemically synthesized
atagctagtctaatatttcttc

SEQ ID NO: 770064 - DNA, 22 bp, Artificial Sequence
  chemically synthesized
actatttagtgagaagaaatat

SEQ ID NO: 770065 - DNA, 22 bp, Artificial Sequence
  chemically synthesized
attcactatttagtgagaagaa

SEQ ID NO: 770066 - DNA, 22 bp, Artificial Sequence
  chemically synthesized
gtctaatatttcttctcactaa

SEQ ID NO: 770067 - DNA, 22 bp, Artificial Sequence
  chemically synthesized
tgttaattcactatttagtgag

SEQ ID NO: 770068 - DNA, 22 bp, Artificial Sequence
  chemically synthesized
atatttcttctcactaaatagt

SEQ ID NO: 770069 - DNA, 22 bp, Artificial Sequence
  chemically synthesized
cactgtgttaattcactattta

SEQ ID NO: 770070 - DNA, 22 bp, Artificial Sequence
  chemically synthesized
gcactgtgttaattcactattt

SEQ ID NO: 770071 - DNA, 22 bp, Artificial Sequence
  chemically synthesized
cttctcactaaatagtgaatta

SEQ ID NO: 770072 - DNA, 22 bp, Artificial Sequence
  chemically synthesized
ttctcactaaatagtgaattaa

SEQ ID NO: 770073 - DNA, 22 bp, Artificial Sequence
  chemically synthesized
aatttgcactgtgttaattcac

SEQ ID NO: 770074 - DNA, 22 bp, Artificial Sequence
  chemically synthesized
ctcactaaatagtgaattaaca

SEQ ID NO: 770075 - DNA, 22 bp, Artificial Sequence
  chemically synthesized
tcactaaatagtgaattaacac

SEQ ID NO: 770076 - DNA, 22 bp, Artificial Sequence
  chemically synthesized
ctaaatttgcactgtgttaatt

SEQ ID NO: 770077 - DNA, 22 bp, Artificial Sequence
  chemically synthesized
actaaatagtgaattaacacag

SEQ ID NO: 770078 - DNA, 22 bp, Artificial Sequence
  chemically synthesized
aatagtgaattaacacagtgca

SEQ ID NO: 770079 - DNA, 22 bp, Artificial Sequence
  chemically synthesized
acacagtgcaaatttagcagtc

SEQ ID NO: 770080 - DNA, 22 bp, Artificial Sequence
  chemically synthesized
tgagtaaagatgtcaaaaggat

SEQ ID NO: 770081 - DNA, 22 bp, Artificial Sequence
  chemically synthesized
atgagtaaagatgtcaaaagga

SEQ ID NO: 770082 - DNA, 22 bp, Artificial Sequence
  chemically synthesized
tatgagtaaagatgtcaaaagg

SEQ ID NO: 770083 - DNA, 22 bp, Artificial Sequence
  chemically synthesized
agcagtcatccttttgacatct

SEQ ID NO: 770084 - DNA, 22 bp, Artificial Sequence
  chemically synthesized
ttttatgagtaaagatgtcaaa

SEQ ID NO: 770085 - DNA, 22 bp, Artificial Sequence
  chemically synthesized
gcagtcatccttttgacatctt

SEQ ID NO: 770086 - DNA, 22 bp, Artificial Sequence
  chemically synthesized
attttatgagtaaagatgtcaa

SEQ ID NO: 770087 - DNA, 22 bp, Artificial Sequence
  chemically synthesized
cttattttatgagtaaagatgt

SEQ ID NO: 770088 - DNA, 22 bp, Artificial Sequence
  chemically synthesized
acttattttatgagtaaagatg

SEQ ID NO: 770089 - DNA, 22 bp, Artificial Sequence
  chemically synthesized
tacttattttatgagtaaagat

SEQ ID NO: 770090 - DNA, 22 bp, Artificial Sequence
  chemically synthesized
ttacttattttatgagtaaaga

SEQ ID NO: 770091 - DNA, 22 bp, Artificial Sequence
  chemically synthesized
cttttacttattttatgagtaa

SEQ ID NO: 770092 - DNA, 22 bp, Artificial Sequence
  chemically synthesized
ttgacatctttactcataaaat

SEQ ID NO: 770093 - DNA, 22 bp, Artificial Sequence
  chemically synthesized
tgacatctttactcataaaata

SEQ ID NO: 770094 - DNA, 22 bp, Artificial Sequence
  chemically synthesized
gacatctttactcataaaataa

SEQ ID NO: 770095 - DNA, 22 bp, Artificial Sequence
  chemically synthesized
acatctttactcataaaataag

SEQ ID NO: 770096 - DNA, 22 bp, Artificial Sequence
  chemically synthesized
gggattgcttttacttatttta

SEQ ID NO: 770097 - DNA, 22 bp, Artificial Sequence
  chemically synthesized
tactcataaaataagtaaaagc

SEQ ID NO: 770098 - DNA, 22 bp, Artificial Sequence
  chemically synthesized
actcataaaataagtaaaagca

SEQ ID NO: 770099 - DNA, 22 bp, Artificial Sequence
  chemically synthesized
taagttggggattgcttttact

SEQ ID NO: 770100 - DNA, 22 bp, Artificial Sequence
  chemically synthesized
ctcataaaataagtaaaagcaa

SEQ ID NO: 770101 - DNA, 22 bp, Artificial Sequence
  chemically synthesized
gtaagttggggattgcttttac

SEQ ID NO: 770102 - DNA, 22 bp, Artificial Sequence
  chemically synthesized
tgtaagttggggattgctttta

SEQ ID NO: 770103 - DNA, 22 bp, Artificial Sequence
  chemically synthesized
ataaaataagtaaaagcaatcc

SEQ ID NO: 770104 - DNA, 22 bp, Artificial Sequence
  chemically synthesized
tttgtaagttggggattgcttt

SEQ ID NO: 770105 - DNA, 22 bp, Artificial Sequence
  chemically synthesized
gagaactctttgtaagttgggg

SEQ ID NO: 770106 - DNA, 22 bp, Artificial Sequence
  chemically synthesized
gttagagaactctttgtaagtt

SEQ ID NO: 770107 - DNA, 22 bp, Artificial Sequence
  chemically synthesized
ggttagagaactctttgtaagt

SEQ ID NO: 770108 - DNA, 22 bp, Artificial Sequence
  chemically synthesized
tggttagagaactctttgtaag

SEQ ID NO: 770109 - DNA, 22 bp, Artificial Sequence
  chemically synthesized
ttggttagagaactctttgtaa

SEQ ID NO: 770110 - DNA, 22 bp, Artificial Sequence
  chemically synthesized
caagtgatttttggttagagaa

SEQ ID NO: 770111 - DNA, 22 bp, Artificial Sequence
  chemically synthesized
gcaagtgatttttggttagaga

SEQ ID NO: 770112 - DNA, 22 bp, Artificial Sequence
  chemically synthesized
acaaagagttctctaaccaaaa

SEQ ID NO: 770113 - DNA, 22 bp, Artificial Sequence
  chemically synthesized
tttgcaagtgatttttggttag

SEQ ID NO: 770114 - DNA, 22 bp, Artificial Sequence
  chemically synthesized
caaagagttctctaaccaaaaa

SEQ ID NO: 770115 - DNA, 22 bp, Artificial Sequence
  chemically synthesized
atttgcaagtgatttttggtta

SEQ ID NO: 770116 - DNA, 22 bp, Artificial Sequence
  chemically synthesized
gaccatttatttgcaagtgatt

SEQ ID NO: 770117 - DNA, 22 bp, Artificial Sequence
  chemically synthesized
tctaaccaaaaatcacttgcaa

SEQ ID NO: 770118 - DNA, 22 bp, Artificial Sequence
  chemically synthesized
tggaccatttatttgcaagtga

SEQ ID NO: 770119 - DNA, 22 bp, Artificial Sequence
  chemically synthesized
taaccaaaaatcacttgcaaat

SEQ ID NO: 770120 - DNA, 22 bp, Artificial Sequence
  chemically synthesized
accaaaaatcacttgcaaataa

SEQ ID NO: 770121 - DNA, 22 bp, Artificial Sequence
  chemically synthesized
gggttctggaccatttatttgc

SEQ ID NO: 770122 - DNA, 22 bp, Artificial Sequence
  chemically synthesized
ggggttctggaccatttatttg

SEQ ID NO: 770123 - DNA, 22 bp, Artificial Sequence
  chemically synthesized
agtttggggttctggaccattt

SEQ ID NO: 770124 - DNA, 22 bp, Artificial Sequence
  chemically synthesized
gagtttggggttctggaccatt

SEQ ID NO: 770125 - DNA, 22 bp, Artificial Sequence
  chemically synthesized
gcaaataaatggtccagaaccc

SEQ ID NO: 770126 - DNA, 22 bp, Artificial Sequence
  chemically synthesized
caaataaatggtccagaacccc

SEQ ID NO: 770127 - DNA, 22 bp, Artificial Sequence
  chemically synthesized
tgtccatggaaatttgagtttg

SEQ ID NO: 770128 - DNA, 22 bp, Artificial Sequence
  chemically synthesized
ttgtgtccatggaaatttgagt

SEQ ID NO: 770129 - DNA, 22 bp, Artificial Sequence
  chemically synthesized
aaatttccatggacacaatagt

SEQ ID NO: 770130 - DNA, 22 bp, Artificial Sequence
  chemically synthesized
agacatgtatatgactattgtg

SEQ ID NO: 770131 - DNA, 22 bp, Artificial Sequence
  chemically synthesized
ccatggacacaatagtcatata

SEQ ID NO: 770132 - DNA, 22 bp, Artificial Sequence
  chemically synthesized
gtctgagacatgtatatgacta

SEQ ID NO: 770133 - DNA, 22 bp, Artificial Sequence
  chemically synthesized
catggacacaatagtcatatac

SEQ ID NO: 770134 - DNA, 22 bp, Artificial Sequence
  chemically synthesized
tatatgtatatgctggtctgag

SEQ ID NO: 770135 - DNA, 22 bp, Artificial Sequence
  chemically synthesized
aatagctatatatgtatatgct

SEQ ID NO: 770136 - DNA, 22 bp, Artificial Sequence
  chemically synthesized
agaccagcatatacatatatag

SEQ ID NO: 770137 - DNA, 22 bp, Artificial Sequence
  chemically synthesized
tttaacctataccatggatgat

SEQ ID NO: 770138 - DNA, 22 bp, Artificial Sequence
  chemically synthesized
tcaaaatgatataaatcatcca

SEQ ID NO: 770139 - DNA, 22 bp, Artificial Sequence
  chemically synthesized
aacctataccatggatgattta

SEQ ID NO: 770140 - DNA, 22 bp, Artificial Sequence
  chemically synthesized
acctataccatggatgatttat

SEQ ID NO: 770141 - DNA, 22 bp, Artificial Sequence
  chemically synthesized
taccatggatgatttatatcat

SEQ ID NO: 770142 - DNA, 22 bp, Artificial Sequence
  chemically synthesized
atatcattttgatagcatgact

SEQ ID NO: 770143 - DNA, 22 bp, Artificial Sequence
  chemically synthesized
tatcattttgatagcatgactt

SEQ ID NO: 770144 - DNA, 22 bp, Artificial Sequence
  chemically synthesized
ccaaatcatataacccaaagtc

SEQ ID NO: 770145 - DNA, 22 bp, Artificial Sequence
  chemically synthesized
cccaaatcatataacccaaagt

SEQ ID NO: 770146 - DNA, 22 bp, Artificial Sequence
  chemically synthesized
tgatagcatgactttgggttat

SEQ ID NO: 770147 - DNA, 22 bp, Artificial Sequence
  chemically synthesized
gatagcatgactttgggttata

SEQ ID NO: 770148 - DNA, 22 bp, Artificial Sequence
  chemically synthesized
atagcatgactttgggttatat

SEQ ID NO: 770149 - DNA, 22 bp, Artificial Sequence
  chemically synthesized
tgggttatatgatttgggaaat

SEQ ID NO: 770150 - DNA, 22 bp, Artificial Sequence
  chemically synthesized
gggttatatgatttgggaaata

SEQ ID NO: 770151 - DNA, 22 bp, Artificial Sequence
  chemically synthesized
ggttatatgatttgggaaatat

SEQ ID NO: 770152 - DNA, 22 bp, Artificial Sequence
  chemically synthesized
atatcccaaaagatgcatattt

SEQ ID NO: 770153 - DNA, 22 bp, Artificial Sequence
  chemically synthesized
tatgatttgggaaatatgcatc

SEQ ID NO: 770154 - DNA, 22 bp, Artificial Sequence
  chemically synthesized
catatcccaaaagatgcatatt

SEQ ID NO: 770155 - DNA, 22 bp, Artificial Sequence
  chemically synthesized
tcatatcccaaaagatgcatat

SEQ ID NO: 770156 - DNA, 22 bp, Artificial Sequence
  chemically synthesized
aatctttcatatcccaaaagat

SEQ ID NO: 770157 - DNA, 22 bp, Artificial Sequence
  chemically synthesized
gggaaatatgcatcttttggga

SEQ ID NO: 770158 - DNA, 22 bp, Artificial Sequence
  chemically synthesized
gaatctttcatatcccaaaaga

SEQ ID NO: 770159 - DNA, 22 bp, Artificial Sequence
  chemically synthesized
ggaaatatgcatcttttgggat

SEQ ID NO: 770160 - DNA, 22 bp, Artificial Sequence
  chemically synthesized
ttgaatctttcatatcccaaaa

SEQ ID NO: 770161 - DNA, 22 bp, Artificial Sequence
  chemically synthesized
cttgaatctttcatatcccaaa

SEQ ID NO: 770162 - DNA, 22 bp, Artificial Sequence
  chemically synthesized
cgtacttcttgaatctttcata

SEQ ID NO: 770163 - DNA, 22 bp, Artificial Sequence
  chemically synthesized
ccgtacttcttgaatctttcat

SEQ ID NO: 770164 - DNA, 22 bp, Artificial Sequence
  chemically synthesized
tccgtacttcttgaatctttca

SEQ ID NO: 770165 - DNA, 22 bp, Artificial Sequence
  chemically synthesized
ttccgtacttcttgaatctttc

SEQ ID NO: 770166 - DNA, 22 bp, Artificial Sequence
  chemically synthesized
ttttccgtacttcttgaatctt

SEQ ID NO: 770167 - DNA, 22 bp, Artificial Sequence
  chemically synthesized
ttgggatatgaaagattcaaga

SEQ ID NO: 770168 - DNA, 22 bp, Artificial Sequence
  chemically synthesized
cttttccgtacttcttgaatct

SEQ ID NO: 770169 - DNA, 22 bp, Artificial Sequence
  chemically synthesized
tgggatatgaaagattcaagaa

SEQ ID NO: 770170 - DNA, 22 bp, Artificial Sequence
  chemically synthesized
gggatatgaaagattcaagaag

SEQ ID NO: 770171 - DNA, 22 bp, Artificial Sequence
  chemically synthesized
ggatatgaaagattcaagaagt

SEQ ID NO: 770172 - DNA, 22 bp, Artificial Sequence
  chemically synthesized
aaataggaagtatttcttttcc

SEQ ID NO: 770173 - DNA, 22 bp, Artificial Sequence
  chemically synthesized
aaaataggaagtatttcttttc

SEQ ID NO: 770174 - DNA, 22 bp, Artificial Sequence
  chemically synthesized
aagaagtacggaaaagaaatac

SEQ ID NO: 770175 - DNA, 22 bp, Artificial Sequence
  chemically synthesized
gacaaatccaggtcttaaaata

SEQ ID NO: 770176 - DNA, 22 bp, Artificial Sequence
  chemically synthesized
ggtgttggacaaatccaggtct

SEQ ID NO: 770177 - DNA, 22 bp, Artificial Sequence
  chemically synthesized
cctattttaagacctggatttg

SEQ ID NO: 770178 - DNA, 22 bp, Artificial Sequence
  chemically synthesized
ttgggtgttggacaaatccagg

SEQ ID NO: 770179 - DNA, 22 bp, Artificial Sequence
  chemically synthesized
ctattttaagacctggatttgt

SEQ ID NO: 770180 - DNA, 22 bp, Artificial Sequence
  chemically synthesized
gttgggtgttggacaaatccag

SEQ ID NO: 770181 - DNA, 22 bp, Artificial Sequence
  chemically synthesized
tgttgggtgttggacaaatcca

SEQ ID NO: 770182 - DNA, 22 bp, Artificial Sequence
  chemically synthesized
ttttaagacctggatttgtcca

SEQ ID NO: 770183 - DNA, 22 bp, Artificial Sequence
  chemically synthesized
ctttgttgggtgttggacaaat

SEQ ID NO: 770184 - DNA, 22 bp, Artificial Sequence
  chemically synthesized
taagacctggatttgtccaaca

SEQ ID NO: 770185 - DNA, 22 bp, Artificial Sequence
  chemically synthesized
aagacctggatttgtccaacac

SEQ ID NO: 770186 - DNA, 22 bp, Artificial Sequence
  chemically synthesized
agacctggatttgtccaacacc

SEQ ID NO: 770187 - DNA, 22 bp, Artificial Sequence
  chemically synthesized
tatatctcctttgttgggtgtt

SEQ ID NO: 770188 - DNA, 22 bp, Artificial Sequence
  chemically synthesized
atatatctcctttgttgggtgt

SEQ ID NO: 770189 - DNA, 22 bp, Artificial Sequence
  chemically synthesized
gatttgtccaacacccaacaaa

SEQ ID NO: 770190 - DNA, 22 bp, Artificial Sequence
  chemically synthesized
gtccaacacccaacaaaggaga

SEQ ID NO: 770191 - DNA, 22 bp, Artificial Sequence
  chemically synthesized
tccaacacccaacaaaggagat

SEQ ID NO: 770192 - DNA, 22 bp, Artificial Sequence
  chemically synthesized
ctctctccttccaccttctggt

SEQ ID NO: 770193 - DNA, 22 bp, Artificial Sequence
  chemically synthesized
tctccttccaccttctggtgcc

SEQ ID NO: 770194 - DNA, 22 bp, Artificial Sequence
  chemically synthesized
tccttccaccttctggtgccca

SEQ ID NO: 770195 - DNA, 22 bp, Artificial Sequence
  chemically synthesized
ggagtagaaaatatgggcacca

SEQ ID NO: 770196 - DNA, 22 bp, Artificial Sequence
  chemically synthesized
cttccaccttctggtgcccata

SEQ ID NO: 770197 - DNA, 22 bp, Artificial Sequence
  chemically synthesized
gggagtagaaaatatgggcacc

SEQ ID NO: 770198 - DNA, 22 bp, Artificial Sequence
  chemically synthesized
ccaccttctggtgcccatattt

SEQ ID NO: 770199 - DNA, 22 bp, Artificial Sequence
  chemically synthesized
caccttctggtgcccatatttt

SEQ ID NO: 770200 - DNA, 22 bp, Artificial Sequence
  chemically synthesized
ctggtgcccatattttctactc

SEQ ID NO: 770201 - DNA, 22 bp, Artificial Sequence
  chemically synthesized
tggtgcccatattttctactcc

SEQ ID NO: 770202 - DNA, 22 bp, Artificial Sequence
  chemically synthesized
gtgcccatattttctactccca

SEQ ID NO: 770203 - DNA, 22 bp, Artificial Sequence
  chemically synthesized
aaacataaggaagtttgggagt

SEQ ID NO: 770204 - DNA, 22 bp, Artificial Sequence
  chemically synthesized
tctactcccaaacttccttatg

SEQ ID NO: 770205 - DNA, 22 bp, Artificial Sequence
  chemically synthesized
ctactcccaaacttccttatgt

SEQ ID NO: 770206 - DNA, 22 bp, Artificial Sequence
  chemically synthesized
tactcccaaacttccttatgtt

SEQ ID NO: 770207 - DNA, 22 bp, Artificial Sequence
  chemically synthesized
ctcccaaacttccttatgtttt

SEQ ID NO: 770208 - DNA, 22 bp, Artificial Sequence
  chemically synthesized
ccaaacttccttatgttttaat

SEQ ID NO: 770209 - DNA, 22 bp, Artificial Sequence
  chemically synthesized
ccttatgttttaatcctcattc

SEQ ID NO: 770210 - DNA, 22 bp, Artificial Sequence
  chemically synthesized
cttatgttttaatcctcattct

SEQ ID NO: 770211 - DNA, 22 bp, Artificial Sequence
  chemically synthesized
aacagatagaagagaatgagga

SEQ ID NO: 770212 - DNA, 22 bp, Artificial Sequence
  chemically synthesized
caacagatagaagagaatgagg

SEQ ID NO: 770213 - DNA, 22 bp, Artificial Sequence
  chemically synthesized
tcaacagatagaagagaatgag

SEQ ID NO: 770214 - DNA, 22 bp, Artificial Sequence
  chemically synthesized
atgttttaatcctcattctctt

SEQ ID NO: 770215 - DNA, 22 bp, Artificial Sequence
  chemically synthesized
tgttttaatcctcattctcttc

SEQ ID NO: 770216 - DNA, 22 bp, Artificial Sequence
  chemically synthesized
taatcctcattctcttctatct

SEQ ID NO: 770217 - DNA, 22 bp, Artificial Sequence
  chemically synthesized
aatcctcattctcttctatctg

SEQ ID NO: 770218 - DNA, 22 bp, Artificial Sequence
  chemically synthesized
atcctcattctcttctatctgt

SEQ ID NO: 770219 - DNA, 22 bp, Artificial Sequence
  chemically synthesized
ggaataagattttcaacagata

SEQ ID NO: 770220 - DNA, 22 bp, Artificial Sequence
  chemically synthesized
gggaataagattttcaacagat

SEQ ID NO: 770221 - DNA, 22 bp, Artificial Sequence
  chemically synthesized
tgggaataagattttcaacaga

SEQ ID NO: 770222 - DNA, 22 bp, Artificial Sequence
  chemically synthesized
attctcttctatctgttgaaaa

SEQ ID NO: 770223 - DNA, 22 bp, Artificial Sequence
  chemically synthesized
tcttctatctgttgaaaatctt

SEQ ID NO: 770224 - DNA, 22 bp, Artificial Sequence
  chemically synthesized
tactttgggaataagattttca

SEQ ID NO: 770225 - DNA, 22 bp, Artificial Sequence
  chemically synthesized
ttctatctgttgaaaatcttat

SEQ ID NO: 770226 - DNA, 22 bp, Artificial Sequence
  chemically synthesized
ctatctgttgaaaatcttattc

SEQ ID NO: 770227 - DNA, 22 bp, Artificial Sequence
  chemically synthesized
tatctgttgaaaatcttattcc

SEQ ID NO: 770228 - DNA, 22 bp, Artificial Sequence
  chemically synthesized
tctgttgaaaatcttattccca

SEQ ID NO: 770229 - DNA, 22 bp, Artificial Sequence
  chemically synthesized
tcagtctatactttgggaataa

SEQ ID NO: 770230 - DNA, 22 bp, Artificial Sequence
  chemically synthesized
ttgaaaatcttattcccaaagt

SEQ ID NO: 770231 - DNA, 22 bp, Artificial Sequence
  chemically synthesized
aaaatcttattcccaaagtata

SEQ ID NO: 770232 - DNA, 22 bp, Artificial Sequence
  chemically synthesized
attcccaaagtatagactgaca

SEQ ID NO: 770233 - DNA, 22 bp, Artificial Sequence
  chemically synthesized
ttcccaaagtatagactgacaa

SEQ ID NO: 770234 - DNA, 22 bp, Artificial Sequence
  chemically synthesized
ccagaatgtgaaagttgtcagt

SEQ ID NO: 770235 - DNA, 22 bp, Artificial Sequence
  chemically synthesized
ccaaagtatagactgacaactt

SEQ ID NO: 770236 - DNA, 22 bp, Artificial Sequence
  chemically synthesized
aaatataaaaatctcccagaat

SEQ ID NO: 770237 - DNA, 22 bp, Artificial Sequence
  chemically synthesized
acaactttcacattctgggaga

SEQ ID NO: 770238 - DNA, 22 bp, Artificial Sequence
  chemically synthesized
aaaatataaaaatctcccagaa

SEQ ID NO: 770239 - DNA, 22 bp, Artificial Sequence
  chemically synthesized
taaaatataaaaatctcccaga

SEQ ID NO: 770240 - DNA, 22 bp, Artificial Sequence
  chemically synthesized
ttaaaatataaaaatctcccag

SEQ ID NO: 770241 - DNA, 22 bp, Artificial Sequence
  chemically synthesized
tttaaaatataaaaatctccca

SEQ ID NO: 770242 - DNA, 22 bp, Artificial Sequence
  chemically synthesized
tttttaaaatataaaaatctcc

SEQ ID NO: 770243 - DNA, 22 bp, Artificial Sequence
  chemically synthesized
tcacattctgggagatttttat

SEQ ID NO: 770244 - DNA, 22 bp, Artificial Sequence
  chemically synthesized
cacattctgggagatttttata

SEQ ID NO: 770245 - DNA, 22 bp, Artificial Sequence
  chemically synthesized
acattctgggagatttttatat

SEQ ID NO: 770246 - DNA, 22 bp, Artificial Sequence
  chemically synthesized
tgggagatttttatattttaaa

SEQ ID NO: 770247 - DNA, 22 bp, Artificial Sequence
  chemically synthesized
ggagatttttatattttaaaaa

SEQ ID NO: 770248 - DNA, 22 bp, Artificial Sequence
  chemically synthesized
ttatattttaaaaagaggggct

SEQ ID NO: 770249 - DNA, 22 bp, Artificial Sequence
  chemically synthesized
tatattttaaaaagaggggctg

SEQ ID NO: 770250 - DNA, 22 bp, Artificial Sequence
  chemically synthesized
atattttaaaaagaggggctgg

SEQ ID NO: 770251 - DNA, 22 bp, Artificial Sequence
  chemically synthesized
tattttaaaaagaggggctggg

SEQ ID NO: 770252 - DNA, 22 bp, Artificial Sequence
  chemically synthesized
taaaaagaggggctgggcatgg

SEQ ID NO: 770253 - DNA, 22 bp, Artificial Sequence
  chemically synthesized
aaaaagaggggctgggcatggt

SEQ ID NO: 770254 - DNA, 22 bp, Artificial Sequence
  chemically synthesized
cagatgtgagccaccatgccca

SEQ ID NO: 770255 - DNA, 22 bp, Artificial Sequence
  chemically synthesized
aaaagaggggctgggcatggtg

SEQ ID NO: 770256 - DNA, 22 bp, Artificial Sequence
  chemically synthesized
gaattacagatgtgagccacca

SEQ ID NO: 770257 - DNA, 22 bp, Artificial Sequence
  chemically synthesized
ggcatggtggctcacatctgta

SEQ ID NO: 770258 - DNA, 22 bp, Artificial Sequence
  chemically synthesized
acaacgtgctggaattacagat

SEQ ID NO: 770259 - DNA, 22 bp, Artificial Sequence
  chemically synthesized
gcctgacaacgtgctggaatta

SEQ ID NO: 770260 - DNA, 22 bp, Artificial Sequence
  chemically synthesized
ggcctgacaacgtgctggaatt

SEQ ID NO: 770261 - DNA, 22 bp, Artificial Sequence
  chemically synthesized
acatctgtaattccagcacgtt

SEQ ID NO: 770262 - DNA, 22 bp, Artificial Sequence
  chemically synthesized
taattccagcacgttgtcaggc

SEQ ID NO: 770263 - DNA, 22 bp, Artificial Sequence
  chemically synthesized
cagcacgttgtcaggccaaggt

SEQ ID NO: 770264 - DNA, 22 bp, Artificial Sequence
  chemically synthesized
aagtgatccacccaccttggcc

SEQ ID NO: 770265 - DNA, 22 bp, Artificial Sequence
  chemically synthesized
ggctgaagtgatccacccacct

SEQ ID NO: 770266 - DNA, 22 bp, Artificial Sequence
  chemically synthesized
ctgggctgaagtgatccaccca

SEQ ID NO: 770267 - DNA, 22 bp, Artificial Sequence
  chemically synthesized
tcaggccaaggtgggtggatca

SEQ ID NO: 770268 - DNA, 22 bp, Artificial Sequence
  chemically synthesized
agattcctgggctgaagtgatc

SEQ ID NO: 770269 - DNA, 22 bp, Artificial Sequence
  chemically synthesized
gtctcagattcctgggctgaag

SEQ ID NO: 770270 - DNA, 22 bp, Artificial Sequence
  chemically synthesized
agctggtctcagattcctgggc

SEQ ID NO: 770271 - DNA, 22 bp, Artificial Sequence
  chemically synthesized
cctaagctggtctcagattcct

SEQ ID NO: 770272 - DNA, 22 bp, Artificial Sequence
  chemically synthesized
cagcccaggaatctgagaccag

SEQ ID NO: 770273 - DNA, 22 bp, Artificial Sequence
  chemically synthesized
agcccaggaatctgagaccagc

SEQ ID NO: 770274 - DNA, 22 bp, Artificial Sequence
  chemically synthesized
gccacattgcctaagctggtct

SEQ ID NO: 770275 - DNA, 22 bp, Artificial Sequence
  chemically synthesized
cgccacattgcctaagctggtc

SEQ ID NO: 770276 - DNA, 22 bp, Artificial Sequence
  chemically synthesized
agaccagcttaggcaatgtggc

SEQ ID NO: 770277 - DNA, 22 bp, Artificial Sequence
  chemically synthesized
tagaaacagagtttcgccacat

SEQ ID NO: 770278 - DNA, 22 bp, Artificial Sequence
  chemically synthesized
tgtagaaacagagtttcgccac

SEQ ID NO: 770279 - DNA, 22 bp, Artificial Sequence
  chemically synthesized
ctgtagaaacagagtttcgcca

SEQ ID NO: 770280 - DNA, 22 bp, Artificial Sequence
  chemically synthesized
tctgtagaaacagagtttcgcc

SEQ ID NO: 770281 - DNA, 22 bp, Artificial Sequence
  chemically synthesized
aggcaatgtggcgaaactctgt

SEQ ID NO: 770282 - DNA, 22 bp, Artificial Sequence
  chemically synthesized
ggcaatgtggcgaaactctgtt

SEQ ID NO: 770283 - DNA, 22 bp, Artificial Sequence
  chemically synthesized
tattttctgtagaaacagagtt

SEQ ID NO: 770284 - DNA, 22 bp, Artificial Sequence
  chemically synthesized
gtattttctgtagaaacagagt

SEQ ID NO: 770285 - DNA, 22 bp, Artificial Sequence
  chemically synthesized
tgtattttctgtagaaacagag

SEQ ID NO: 770286 - DNA, 22 bp, Artificial Sequence
  chemically synthesized
ttgtattttctgtagaaacaga

SEQ ID NO: 770287 - DNA, 22 bp, Artificial Sequence
  chemically synthesized
tttgtattttctgtagaaacag

SEQ ID NO: 770288 - DNA, 22 bp, Artificial Sequence
  chemically synthesized
ctttttgtattttctgtagaaa

SEQ ID NO: 770289 - DNA, 22 bp, Artificial Sequence
  chemically synthesized
tgtttctacagaaaatacaaaa

SEQ ID NO: 770290 - DNA, 22 bp, Artificial Sequence
  chemically synthesized
tttctacagaaaatacaaaaag

SEQ ID NO: 770291 - DNA, 22 bp, Artificial Sequence
  chemically synthesized
ctacagaaaatacaaaaagtag

SEQ ID NO: 770292 - DNA, 22 bp, Artificial Sequence
  chemically synthesized
tacagaaaatacaaaaagtagc

SEQ ID NO: 770293 - DNA, 22 bp, Artificial Sequence
  chemically synthesized
cagaaaatacaaaaagtagcgg

SEQ ID NO: 770294 - DNA, 22 bp, Artificial Sequence
  chemically synthesized
caggcacgtgccaccacacccc

SEQ ID NO: 770295 - DNA, 22 bp, Artificial Sequence
  chemically synthesized
ggactacaggcacgtgccacca

SEQ ID NO: 770296 - DNA, 22 bp, Artificial Sequence
  chemically synthesized
ccaagtggctgggactacaggc

SEQ ID NO: 770297 - DNA, 22 bp, Artificial Sequence
  chemically synthesized
agcctcccaagtggctgggact

SEQ ID NO: 770298 - DNA, 22 bp, Artificial Sequence
  chemically synthesized
ccacctcagcctcccaagtggc

SEQ ID NO: 770299 - DNA, 22 bp, Artificial Sequence
  chemically synthesized
tagtcccagccacttgggaggc

SEQ ID NO: 770300 - DNA, 22 bp, Artificial Sequence
  chemically synthesized
cctcccacctcagcctcccaag

SEQ ID NO: 770301 - DNA, 22 bp, Artificial Sequence
  chemically synthesized
aggtgatcctccctcccacctc

SEQ ID NO: 770302 - DNA, 22 bp, Artificial Sequence
  chemically synthesized
gggaggctgaggtgggagggag

SEQ ID NO: 770303 - DNA, 22 bp, Artificial Sequence
  chemically synthesized
ggaggctgaggtgggagggagg

SEQ ID NO: 770304 - DNA, 22 bp, Artificial Sequence
  chemically synthesized
ggctcaggtgatcctccctccc

SEQ ID NO: 770305 - DNA, 22 bp, Artificial Sequence
  chemically synthesized
aggtgggagggaggatcacctg

SEQ ID NO: 770306 - DNA, 22 bp, Artificial Sequence
  chemically synthesized
gacatccctgggctcaggtgat

SEQ ID NO: 770307 - DNA, 22 bp, Artificial Sequence
  chemically synthesized
cgacatccctgggctcaggtga

SEQ ID NO: 770308 - DNA, 22 bp, Artificial Sequence
  chemically synthesized
caacttcgacatccctgggctc

SEQ ID NO: 770309 - DNA, 22 bp, Artificial Sequence
  chemically synthesized
actgcaacttcgacatccctgg

SEQ ID NO: 770310 - DNA, 22 bp, Artificial Sequence
  chemically synthesized
agcccagggatgtcgaagttgc

SEQ ID NO: 770311 - DNA, 22 bp, Artificial Sequence
  chemically synthesized
gagtgcagtggcacaatcatgg

SEQ ID NO: 770312 - DNA, 22 bp, Artificial Sequence
  chemically synthesized
cagtgagccatgattgtgccac

SEQ ID NO: 770313 - DNA, 22 bp, Artificial Sequence
  chemically synthesized
tcacccaggctggagtgcagtg

SEQ ID NO: 770314 - DNA, 22 bp, Artificial Sequence
  chemically synthesized
tgccactgcactccagcctggg

SEQ ID NO: 770315 - DNA, 22 bp, Artificial Sequence
  chemically synthesized
cactccagcctgggtgacaggg

SEQ ID NO: 770316 - DNA, 22 bp, Artificial Sequence
  chemically synthesized
gagacagggtcataccctgtca

SEQ ID NO: 770317 - DNA, 22 bp, Artificial Sequence
  chemically synthesized
ggagacagggtcataccctgtc

SEQ ID NO: 770318 - DNA, 22 bp, Artificial Sequence
  chemically synthesized
tggagacagggtcataccctgt

SEQ ID NO: 770319 - DNA, 22 bp, Artificial Sequence
  chemically synthesized
cagcctgggtgacagggtatga

SEQ ID NO: 770320 - DNA, 22 bp, Artificial Sequence
  chemically synthesized
ttggagacagggtcataccctg

SEQ ID NO: 770321 - DNA, 22 bp, Artificial Sequence
  chemically synthesized
tttggagacagggtcataccct

SEQ ID NO: 770322 - DNA, 22 bp, Artificial Sequence
  chemically synthesized
ttttggagacagggtcataccc

SEQ ID NO: 770323 - DNA, 22 bp, Artificial Sequence
  chemically synthesized
tttttggagacagggtcatacc

SEQ ID NO: 770324 - DNA, 22 bp, Artificial Sequence
  chemically synthesized
ttttttggagacagggtcatac

SEQ ID NO: 770325 - DNA, 22 bp, Artificial Sequence
  chemically synthesized
ggtgacagggtatgaccctgtc

SEQ ID NO: 770326 - DNA, 22 bp, Artificial Sequence
  chemically synthesized
cccttttttttggagacagggt

SEQ ID NO: 770327 - DNA, 22 bp, Artificial Sequence
  chemically synthesized
ccccttttttttggagacaggg

SEQ ID NO: 770328 - DNA, 22 bp, Artificial Sequence
  chemically synthesized
agcttccccttttttttggaga

SEQ ID NO: 770329 - DNA, 22 bp, Artificial Sequence
  chemically synthesized
actcagcttccccttttttttg

SEQ ID NO: 770330 - DNA, 22 bp, Artificial Sequence
  chemically synthesized
aactcagcttcccctttttttt

SEQ ID NO: 770331 - DNA, 22 bp, Artificial Sequence
  chemically synthesized
gtttaactcagcttcccctttt

SEQ ID NO: 770332 - DNA, 22 bp, Artificial Sequence
  chemically synthesized
ggtttaactcagcttccccttt

SEQ ID NO: 770333 - DNA, 22 bp, Artificial Sequence
  chemically synthesized
tctccaaaaaaaaggggaagct

SEQ ID NO: 770334 - DNA, 22 bp, Artificial Sequence
  chemically synthesized
gtttggtttaactcagcttccc

SEQ ID NO: 770335 - DNA, 22 bp, Artificial Sequence
  chemically synthesized
caaaaaaaaggggaagctgagt

SEQ ID NO: 770336 - DNA, 22 bp, Artificial Sequence
  chemically synthesized
agattggtttggtttaactcag

SEQ ID NO: 770337 - DNA, 22 bp, Artificial Sequence
  chemically synthesized
tgattcagattggtttggttta

SEQ ID NO: 770338 - DNA, 22 bp, Artificial Sequence
  chemically synthesized
tcaatctgtgattcagattggt

SEQ ID NO: 770339 - DNA, 22 bp, Artificial Sequence
  chemically synthesized
agttaaaccaaaccaatctgaa

SEQ ID NO: 770340 - DNA, 22 bp, Artificial Sequence
  chemically synthesized
aaccaaaccaatctgaatcaca

SEQ ID NO: 770341 - DNA, 22 bp, Artificial Sequence
  chemically synthesized
gaaatcctatcaatctgtgatt

SEQ ID NO: 770342 - DNA, 22 bp, Artificial Sequence
  chemically synthesized
ggaaatcctatcaatctgtgat

SEQ ID NO: 770343 - DNA, 22 bp, Artificial Sequence
  chemically synthesized
ttggaaatcctatcaatctgtg

SEQ ID NO: 770344 - DNA, 22 bp, Artificial Sequence
  chemically synthesized
tattcttggaaatcctatcaat

SEQ ID NO: 770345 - DNA, 22 bp, Artificial Sequence
  chemically synthesized
atattcttggaaatcctatcaa

SEQ ID NO: 770346 - DNA, 22 bp, Artificial Sequence
  chemically synthesized
ttatattcttggaaatcctatc

SEQ ID NO: 770347 - DNA, 22 bp, Artificial Sequence
  chemically synthesized
aatcacagattgataggatttc

SEQ ID NO: 770348 - DNA, 22 bp, Artificial Sequence
  chemically synthesized
cattcttatattcttggaaatc

SEQ ID NO: 770349 - DNA, 22 bp, Artificial Sequence
  chemically synthesized
gcattcttatattcttggaaat

SEQ ID NO: 770350 - DNA, 22 bp, Artificial Sequence
  chemically synthesized
tgcattcttatattcttggaaa

SEQ ID NO: 770351 - DNA, 22 bp, Artificial Sequence
  chemically synthesized
ctttgcattcttatattcttgg

SEQ ID NO: 770352 - DNA, 22 bp, Artificial Sequence
  chemically synthesized
actttgcattcttatattcttg

SEQ ID NO: 770353 - DNA, 22 bp, Artificial Sequence
  chemically synthesized
tactttgcattcttatattctt

SEQ ID NO: 770354 - DNA, 22 bp, Artificial Sequence
  chemically synthesized
ataggatttccaagaatataag

SEQ ID NO: 770355 - DNA, 22 bp, Artificial Sequence
  chemically synthesized
ttactttgcattcttatattct

SEQ ID NO: 770356 - DNA, 22 bp, Artificial Sequence
  chemically synthesized
aatatttttactttgcattctt

SEQ ID NO: 770357 - DNA, 22 bp, Artificial Sequence
  chemically synthesized
ccaagaatataagaatgcaaag

SEQ ID NO: 770358 - DNA, 22 bp, Artificial Sequence
  chemically synthesized
caagaatataagaatgcaaagt

SEQ ID NO: 770359 - DNA, 22 bp, Artificial Sequence
  chemically synthesized
ccatctgaatatttttactttg

SEQ ID NO: 770360 - DNA, 22 bp, Artificial Sequence
  chemically synthesized
tgctaccatctgaatattttta

SEQ ID NO: 770361 - DNA, 22 bp, Artificial Sequence
  chemically synthesized
atgctaccatctgaatattttt

SEQ ID NO: 770362 - DNA, 22 bp, Artificial Sequence
  chemically synthesized
cccccagacgcttatgctacca

SEQ ID NO: 770363 - DNA, 22 bp, Artificial Sequence
  chemically synthesized
tgcccccagacgcttatgctac

SEQ ID NO: 770364 - DNA, 22 bp, Artificial Sequence
  chemically synthesized
ctgcccccagacgcttatgcta

SEQ ID NO: 770365 - DNA, 22 bp, Artificial Sequence
  chemically synthesized
tctgcccccagacgcttatgct

SEQ ID NO: 770366 - DNA, 22 bp, Artificial Sequence
  chemically synthesized
agatggtagcataagcgtctgg

SEQ ID NO: 770367 - DNA, 22 bp, Artificial Sequence
  chemically synthesized
aagcctttctgcccccagacgc

SEQ ID NO: 770368 - DNA, 22 bp, Artificial Sequence
  chemically synthesized
ccaagaatagctaaagcctttc

SEQ ID NO: 770369 - DNA, 22 bp, Artificial Sequence
  chemically synthesized
cctaccaagaatagctaaagcc

SEQ ID NO: 770370 - DNA, 22 bp, Artificial Sequence
  chemically synthesized
ggggcagaaaggctttagctat

SEQ ID NO: 770371 - DNA, 22 bp, Artificial Sequence
  chemically synthesized
accaaagtagattgcctaccaa

SEQ ID NO: 770372 - DNA, 22 bp, Artificial Sequence
  chemically synthesized
tagctattcttggtaggcaatc

SEQ ID NO: 770373 - DNA, 22 bp, Artificial Sequence
  chemically synthesized
agctattcttggtaggcaatct

SEQ ID NO: 770374 - DNA, 22 bp, Artificial Sequence
  chemically synthesized
gctattcttggtaggcaatcta

SEQ ID NO: 770375 - DNA, 22 bp, Artificial Sequence
  chemically synthesized
ttcttggtaggcaatctacttt

SEQ ID NO: 770376 - DNA, 22 bp, Artificial Sequence
  chemically synthesized
acagtattaaccaaagtagatt

SEQ ID NO: 770377 - DNA, 22 bp, Artificial Sequence
  chemically synthesized
ttggtaggcaatctactttggt

SEQ ID NO: 770378 - DNA, 22 bp, Artificial Sequence
  chemically synthesized
ggtaggcaatctactttggtta

SEQ ID NO: 770379 - DNA, 22 bp, Artificial Sequence
  chemically synthesized
gtaggcaatctactttggttaa

SEQ ID NO: 770380 - DNA, 22 bp, Artificial Sequence
  chemically synthesized
ggtgagccagttcacagtatta

SEQ ID NO: 770381 - DNA, 22 bp, Artificial Sequence
  chemically synthesized
aggtgagccagttcacagtatt

SEQ ID NO: 770382 - DNA, 22 bp, Artificial Sequence
  chemically synthesized
ctttggttaatactgtgaactg

SEQ ID NO: 770383 - DNA, 22 bp, Artificial Sequence
  chemically synthesized
tggttaatactgtgaactggct

SEQ ID NO: 770384 - DNA, 22 bp, Artificial Sequence
  chemically synthesized
ggttaatactgtgaactggctc

SEQ ID NO: 770385 - DNA, 22 bp, Artificial Sequence
  chemically synthesized
gttaatactgtgaactggctca

SEQ ID NO: 770386 - DNA, 22 bp, Artificial Sequence
  chemically synthesized
atactgtgaactggctcaccta

SEQ ID NO: 770387 - DNA, 22 bp, Artificial Sequence
  chemically synthesized
tgaactggctcacctaaatcta

SEQ ID NO: 770388 - DNA, 22 bp, Artificial Sequence
  chemically synthesized
gaaggatggtaagtagatttag

SEQ ID NO: 770389 - DNA, 22 bp, Artificial Sequence
  chemically synthesized
gctcacctaaatctacttacca

SEQ ID NO: 770390 - DNA, 22 bp, Artificial Sequence
  chemically synthesized
tccaactggaaggatggtaagt

SEQ ID NO: 770391 - DNA, 22 bp, Artificial Sequence
  chemically synthesized
acctaaatctacttaccatcct

SEQ ID NO: 770392 - DNA, 22 bp, Artificial Sequence
  chemically synthesized
aatctacttaccatccttccag

SEQ ID NO: 770393 - DNA, 22 bp, Artificial Sequence
  chemically synthesized
caacctgtccaactggaaggat

SEQ ID NO: 770394 - DNA, 22 bp, Artificial Sequence
  chemically synthesized
ccaacctgtccaactggaagga

SEQ ID NO: 770395 - DNA, 22 bp, Artificial Sequence
  chemically synthesized
atttccaacctgtccaactgga

SEQ ID NO: 770396 - DNA, 22 bp, Artificial Sequence
  chemically synthesized
cttaccatccttccagttggac

SEQ ID NO: 770397 - DNA, 22 bp, Artificial Sequence
  chemically synthesized
aatttccaacctgtccaactgg

SEQ ID NO: 770398 - DNA, 22 bp, Artificial Sequence
  chemically synthesized
taatttccaacctgtccaactg

SEQ ID NO: 770399 - DNA, 22 bp, Artificial Sequence
  chemically synthesized
ttaatttccaacctgtccaact

SEQ ID NO: 770400 - DNA, 22 bp, Artificial Sequence
  chemically synthesized
accatccttccagttggacagg

SEQ ID NO: 770401 - DNA, 22 bp, Artificial Sequence
  chemically synthesized
ccatccttccagttggacaggt

SEQ ID NO: 770402 - DNA, 22 bp, Artificial Sequence
  chemically synthesized
ccagttggacaggttggaaatt

SEQ ID NO: 770403 - DNA, 22 bp, Artificial Sequence
  chemically synthesized
cagttggacaggttggaaatta

SEQ ID NO: 770404 - DNA, 22 bp, Artificial Sequence
  chemically synthesized
gcaaatacagtttttaatttcc

SEQ ID NO: 770405 - DNA, 22 bp, Artificial Sequence
  chemically synthesized
gacaggttggaaattaaaaact

SEQ ID NO: 770406 - DNA, 22 bp, Artificial Sequence
  chemically synthesized
catggaagtctggcaaatacag

SEQ ID NO: 770407 - DNA, 22 bp, Artificial Sequence
  chemically synthesized
gaaattaaaaactgtatttgcc

SEQ ID NO: 770408 - DNA, 22 bp, Artificial Sequence
  chemically synthesized
gctgcatggaagtctggcaaat

SEQ ID NO: 770409 - DNA, 22 bp, Artificial Sequence
  chemically synthesized
aaaactgtatttgccagacttc

SEQ ID NO: 770410 - DNA, 22 bp, Artificial Sequence
  chemically synthesized
tatttgccagacttccatgcag

SEQ ID NO: 770411 - DNA, 22 bp, Artificial Sequence
  chemically synthesized
ataatcagaacactagctgcat

SEQ ID NO: 770412 - DNA, 22 bp, Artificial Sequence
  chemically synthesized
gccagacttccatgcagctagt

SEQ ID NO: 770413 - DNA, 22 bp, Artificial Sequence
  chemically synthesized
ccagacttccatgcagctagtg

SEQ ID NO: 770414 - DNA, 22 bp, Artificial Sequence
  chemically synthesized
attcataatcagaacactagct

SEQ ID NO: 770415 - DNA, 22 bp, Artificial Sequence
  chemically synthesized
ccatgcagctagtgttctgatt

SEQ ID NO: 770416 - DNA, 22 bp, Artificial Sequence
  chemically synthesized
catgcagctagtgttctgatta

SEQ ID NO: 770417 - DNA, 22 bp, Artificial Sequence
  chemically synthesized
tatcctaattcataatcagaac

SEQ ID NO: 770418 - DNA, 22 bp, Artificial Sequence
  chemically synthesized
ttatatcctaattcataatcag

SEQ ID NO: 770419 - DNA, 22 bp, Artificial Sequence
  chemically synthesized
attatatcctaattcataatca

SEQ ID NO: 770420 - DNA, 22 bp, Artificial Sequence
  chemically synthesized
acttattatatcctaattcata

SEQ ID NO: 770421 - DNA, 22 bp, Artificial Sequence
  chemically synthesized
gtgttctgattatgaattagga

SEQ ID NO: 770422 - DNA, 22 bp, Artificial Sequence
  chemically synthesized
tgattatgaattaggatataat

SEQ ID NO: 770423 - DNA, 22 bp, Artificial Sequence
  chemically synthesized
acaaccctaacttattatatcc

SEQ ID NO: 770424 - DNA, 22 bp, Artificial Sequence
  chemically synthesized
attatgaattaggatataataa

SEQ ID NO: 770425 - DNA, 22 bp, Artificial Sequence
  chemically synthesized
tctgacaaccctaacttattat

SEQ ID NO: 770426 - DNA, 22 bp, Artificial Sequence
  chemically synthesized
tgaattaggatataataagtta

SEQ ID NO: 770427 - DNA, 22 bp, Artificial Sequence
  chemically synthesized
atctgacaaccctaacttatta

SEQ ID NO: 770428 - DNA, 22 bp, Artificial Sequence
  chemically synthesized
tatctgacaaccctaacttatt

SEQ ID NO: 770429 - DNA, 22 bp, Artificial Sequence
  chemically synthesized
tattttatctgacaaccctaac

SEQ ID NO: 770430 - DNA, 22 bp, Artificial Sequence
  chemically synthesized
ggatataataagttagggttgt

SEQ ID NO: 770431 - DNA, 22 bp, Artificial Sequence
  chemically synthesized
gtattttatctgacaaccctaa

SEQ ID NO: 770432 - DNA, 22 bp, Artificial Sequence
  chemically synthesized
ggtgccttgtattttatctgac

SEQ ID NO: 770433 - DNA, 22 bp, Artificial Sequence
  chemically synthesized
actgggtgccttgtattttatc

SEQ ID NO: 770434 - DNA, 22 bp, Artificial Sequence
  chemically synthesized
aactgggtgccttgtattttat

SEQ ID NO: 770435 - DNA, 22 bp, Artificial Sequence
  chemically synthesized
gggttgtcagataaaatacaag

SEQ ID NO: 770436 - DNA, 22 bp, Artificial Sequence
  chemically synthesized
aatttaactgggtgccttgtat

SEQ ID NO: 770437 - DNA, 22 bp, Artificial Sequence
  chemically synthesized
aaatttaactgggtgccttgta

SEQ ID NO: 770438 - DNA, 22 bp, Artificial Sequence
  chemically synthesized
tcagataaaatacaaggcaccc

SEQ ID NO: 770439 - DNA, 22 bp, Artificial Sequence
  chemically synthesized
tgtagaaaatttaaatttaact

SEQ ID NO: 770440 - DNA, 22 bp, Artificial Sequence
  chemically synthesized
aataaaaaaagattgtgtagaa

SEQ ID NO: 770441 - DNA, 22 bp, Artificial Sequence
  chemically synthesized
aatttaaattttctacacaatc

SEQ ID NO: 770442 - DNA, 22 bp, Artificial Sequence
  chemically synthesized
acactaaataaaaaaagattgt

SEQ ID NO: 770443 - DNA, 22 bp, Artificial Sequence
  chemically synthesized
aaattttctacacaatcttttt

SEQ ID NO: 770444 - DNA, 22 bp, Artificial Sequence
  chemically synthesized
aacactaaataaaaaaagattg

SEQ ID NO: 770445 - DNA, 22 bp, Artificial Sequence
  chemically synthesized
aattttctacacaatctttttt

SEQ ID NO: 770446 - DNA, 22 bp, Artificial Sequence
  chemically synthesized
tctacacaatctttttttattt

SEQ ID NO: 770447 - DNA, 22 bp, Artificial Sequence
  chemically synthesized
ctacacaatctttttttattta

SEQ ID NO: 770448 - DNA, 22 bp, Artificial Sequence
  chemically synthesized
tacacaatctttttttatttag

SEQ ID NO: 770449 - DNA, 22 bp, Artificial Sequence
  chemically synthesized
cacaatctttttttatttagtg

SEQ ID NO: 770450 - DNA, 22 bp, Artificial Sequence
  chemically synthesized
tttttatttagtgttaagtatg

SEQ ID NO: 770451 - DNA, 22 bp, Artificial Sequence
  chemically synthesized
ttttatttagtgttaagtatgt

SEQ ID NO: 770452 - DNA, 22 bp, Artificial Sequence
  chemically synthesized
tttatttagtgttaagtatgtt

SEQ ID NO: 770453 - DNA, 22 bp, Artificial Sequence
  chemically synthesized
ttatttagtgttaagtatgttg

SEQ ID NO: 770454 - DNA, 22 bp, Artificial Sequence
  chemically synthesized
tatttagtgttaagtatgttgc

SEQ ID NO: 770455 - DNA, 22 bp, Artificial Sequence
  chemically synthesized
atttagtgttaagtatgttgca

SEQ ID NO: 770456 - DNA, 22 bp, Artificial Sequence
  chemically synthesized
tttagtgttaagtatgttgcat

SEQ ID NO: 770457 - DNA, 22 bp, Artificial Sequence
  chemically synthesized
agtgttaagtatgttgcatgca

SEQ ID NO: 770458 - DNA, 22 bp, Artificial Sequence
  chemically synthesized
gtgttaagtatgttgcatgcat

SEQ ID NO: 770459 - DNA, 22 bp, Artificial Sequence
  chemically synthesized
gcaaataaaaataatgcatgca

SEQ ID NO: 770460 - DNA, 22 bp, Artificial Sequence
  chemically synthesized
agcaaataaaaataatgcatgc

SEQ ID NO: 770461 - DNA, 22 bp, Artificial Sequence
  chemically synthesized
agtatgttgcatgcattatttt

SEQ ID NO: 770462 - DNA, 22 bp, Artificial Sequence
  chemically synthesized
ccagatttagcaaataaaaata

SEQ ID NO: 770463 - DNA, 22 bp, Artificial Sequence
  chemically synthesized
catgcattatttttatttgcta

SEQ ID NO: 770464 - DNA, 22 bp, Artificial Sequence
  chemically synthesized
gcaaaacgttgccagatttagc

SEQ ID NO: 770465 - DNA, 22 bp, Artificial Sequence
  chemically synthesized
ggcaaaacgttgccagatttag

SEQ ID NO: 770466 - DNA, 22 bp, Artificial Sequence
  chemically synthesized
tttttatttgctaaatctggca

SEQ ID NO: 770467 - DNA, 22 bp, Artificial Sequence
  chemically synthesized
ttatttgctaaatctggcaacg

SEQ ID NO: 770468 - DNA, 22 bp, Artificial Sequence
  chemically synthesized
tatttgctaaatctggcaacgt

SEQ ID NO: 770469 - DNA, 22 bp, Artificial Sequence
  chemically synthesized
atttgctaaatctggcaacgtt

SEQ ID NO: 770470 - DNA, 22 bp, Artificial Sequence
  chemically synthesized
tttgctaaatctggcaacgttt

SEQ ID NO: 770471 - DNA, 22 bp, Artificial Sequence
  chemically synthesized
gctaaatctggcaacgttttgc

SEQ ID NO: 770472 - DNA, 22 bp, Artificial Sequence
  chemically synthesized
ctaaatctggcaacgttttgcc

SEQ ID NO: 770473 - DNA, 22 bp, Artificial Sequence
  chemically synthesized
aatctggcaacgttttgccaaa

SEQ ID NO: 770474 - DNA, 22 bp, Artificial Sequence
  chemically synthesized
acaagtatacacatttggcaaa

SEQ ID NO: 770475 - DNA, 22 bp, Artificial Sequence
  chemically synthesized
tcacaagtatacacatttggca

SEQ ID NO: 770476 - DNA, 22 bp, Artificial Sequence
  chemically synthesized
gcaacgttttgccaaatgtgta

SEQ ID NO: 770477 - DNA, 22 bp, Artificial Sequence
  chemically synthesized
cagatctctcacaagtatacac

SEQ ID NO: 770478 - DNA, 22 bp, Artificial Sequence
  chemically synthesized
ccagatctctcacaagtataca

SEQ ID NO: 770479 - DNA, 22 bp, Artificial Sequence
  chemically synthesized
tccagatctctcacaagtatac

SEQ ID NO: 770480 - DNA, 22 bp, Artificial Sequence
  chemically synthesized
tgccaaatgtgtatacttgtga

SEQ ID NO: 770481 - DNA, 22 bp, Artificial Sequence
  chemically synthesized
gccaaatgtgtatacttgtgag

SEQ ID NO: 770482 - DNA, 22 bp, Artificial Sequence
  chemically synthesized
ccaaatgtgtatacttgtgaga

SEQ ID NO: 770483 - DNA, 22 bp, Artificial Sequence
  chemically synthesized
cactttccagatctctcacaag

SEQ ID NO: 770484 - DNA, 22 bp, Artificial Sequence
  chemically synthesized
ccactttccagatctctcacaa

SEQ ID NO: 770485 - DNA, 22 bp, Artificial Sequence
  chemically synthesized
acttccactttccagatctctc

SEQ ID NO: 770486 - DNA, 22 bp, Artificial Sequence
  chemically synthesized
tgcctcacttccactttccaga

SEQ ID NO: 770487 - DNA, 22 bp, Artificial Sequence
  chemically synthesized
gtgagagatctggaaagtggaa

SEQ ID NO: 770488 - DNA, 22 bp, Artificial Sequence
  chemically synthesized
tgagagatctggaaagtggaag

SEQ ID NO: 770489 - DNA, 22 bp, Artificial Sequence
  chemically synthesized
gaaagtggaagtgaggcatagg

SEQ ID NO: 770490 - DNA, 22 bp, Artificial Sequence
  chemically synthesized
gccaacagaaatagccaaaagg

SEQ ID NO: 770491 - DNA, 22 bp, Artificial Sequence
  chemically synthesized
agctcgccaacagaaatagcca

SEQ ID NO: 770492 - DNA, 22 bp, Artificial Sequence
  chemically synthesized
tctgccccttttggctatttct

SEQ ID NO: 770493 - DNA, 22 bp, Artificial Sequence
  chemically synthesized
ctgccccttttggctatttctg

SEQ ID NO: 770494 - DNA, 22 bp, Artificial Sequence
  chemically synthesized
tgccccttttggctatttctgt

SEQ ID NO: 770495 - DNA, 22 bp, Artificial Sequence
  chemically synthesized
actaagctcgccaacagaaata

SEQ ID NO: 770496 - DNA, 22 bp, Artificial Sequence
  chemically synthesized
ccccttttggctatttctgttg

SEQ ID NO: 770497 - DNA, 22 bp, Artificial Sequence
  chemically synthesized
gactaagctcgccaacagaaat

SEQ ID NO: 770498 - DNA, 22 bp, Artificial Sequence
  chemically synthesized
tgactaagctcgccaacagaaa

SEQ ID NO: 770499 - DNA, 22 bp, Artificial Sequence
  chemically synthesized
tttgactaagctcgccaacaga

SEQ ID NO: 770500 - DNA, 22 bp, Artificial Sequence
  chemically synthesized
ctttgactaagctcgccaacag

SEQ ID NO: 770501 - DNA, 22 bp, Artificial Sequence
  chemically synthesized
ttggctatttctgttggcgagc

SEQ ID NO: 770502 - DNA, 22 bp, Artificial Sequence
  chemically synthesized
tggctatttctgttggcgagct

SEQ ID NO: 770503 - DNA, 22 bp, Artificial Sequence
  chemically synthesized
ggctatttctgttggcgagctt

SEQ ID NO: 770504 - DNA, 22 bp, Artificial Sequence
  chemically synthesized
gctatttctgttggcgagctta

SEQ ID NO: 770505 - DNA, 22 bp, Artificial Sequence
  chemically synthesized
atgtttctttgactaagctcgc

SEQ ID NO: 770506 - DNA, 22 bp, Artificial Sequence
  chemically synthesized
tttctgttggcgagcttagtca

SEQ ID NO: 770507 - DNA, 22 bp, Artificial Sequence
  chemically synthesized
ctgttggcgagcttagtcaaag

SEQ ID NO: 770508 - DNA, 22 bp, Artificial Sequence
  chemically synthesized
tgttggcgagcttagtcaaaga

SEQ ID NO: 770509 - DNA, 22 bp, Artificial Sequence
  chemically synthesized
ttggcgagcttagtcaaagaaa

SEQ ID NO: 770510 - DNA, 22 bp, Artificial Sequence
  chemically synthesized
gcgagcttagtcaaagaaacat

SEQ ID NO: 770511 - DNA, 22 bp, Artificial Sequence
  chemically synthesized
atgtaggaaatctcatgtttct

SEQ ID NO: 770512 - DNA, 22 bp, Artificial Sequence
  chemically synthesized
tgatgtaggaaatctcatgttt

SEQ ID NO: 770513 - DNA, 22 bp, Artificial Sequence
  chemically synthesized
agtcaaagaaacatgagatttc

SEQ ID NO: 770514 - DNA, 22 bp, Artificial Sequence
  chemically synthesized
gtcaaagaaacatgagatttcc

SEQ ID NO: 770515 - DNA, 22 bp, Artificial Sequence
  chemically synthesized
gaactctgatgtaggaaatctc

SEQ ID NO: 770516 - DNA, 22 bp, Artificial Sequence
  chemically synthesized
ggaactctgatgtaggaaatct

SEQ ID NO: 770517 - DNA, 22 bp, Artificial Sequence
  chemically synthesized
tggaactctgatgtaggaaatc

SEQ ID NO: 770518 - DNA, 22 bp, Artificial Sequence
  chemically synthesized
gagaaagaactttggaactctg

SEQ ID NO: 770519 - DNA, 22 bp, Artificial Sequence
  chemically synthesized
cctacatcagagttccaaagtt

SEQ ID NO: 770520 - DNA, 22 bp, Artificial Sequence
  chemically synthesized
ctacatcagagttccaaagttc

SEQ ID NO: 770521 - DNA, 22 bp, Artificial Sequence
  chemically synthesized
catcagagttccaaagttcttt

SEQ ID NO: 770522 - DNA, 22 bp, Artificial Sequence
  chemically synthesized
cagccaggaagctggagaaaga

SEQ ID NO: 770523 - DNA, 22 bp, Artificial Sequence
  chemically synthesized
tccagccaggaagctggagaaa

SEQ ID NO: 770524 - DNA, 22 bp, Artificial Sequence
  chemically synthesized
ctccagccaggaagctggagaa

SEQ ID NO: 770525 - DNA, 22 bp, Artificial Sequence
  chemically synthesized
caaagttctttctccagcttcc

SEQ ID NO: 770526 - DNA, 22 bp, Artificial Sequence
  chemically synthesized
cccttctccagccaggaagctg

SEQ ID NO: 770527 - DNA, 22 bp, Artificial Sequence
  chemically synthesized
tttctccagcttcctggctgga

SEQ ID NO: 770528 - DNA, 22 bp, Artificial Sequence
  chemically synthesized
gcaactgcccttctccagccag

SEQ ID NO: 770529 - DNA, 22 bp, Artificial Sequence
  chemically synthesized
tctccagcttcctggctggaga

SEQ ID NO: 770530 - DNA, 22 bp, Artificial Sequence
  chemically synthesized
ctccagcttcctggctggagaa

SEQ ID NO: 770531 - DNA, 22 bp, Artificial Sequence
  chemically synthesized
tccagcttcctggctggagaag

SEQ ID NO: 770532 - DNA, 22 bp, Artificial Sequence
  chemically synthesized
ttagcaactgcccttctccagc

SEQ ID NO: 770533 - DNA, 22 bp, Artificial Sequence
  chemically synthesized
cagcttcctggctggagaaggg

SEQ ID NO: 770534 - DNA, 22 bp, Artificial Sequence
  chemically synthesized
ctgttagcaactgcccttctcc

SEQ ID NO: 770535 - DNA, 22 bp, Artificial Sequence
  chemically synthesized
cctggctggagaagggcagttg

SEQ ID NO: 770536 - DNA, 22 bp, Artificial Sequence
  chemically synthesized
ctggctggagaagggcagttgc

SEQ ID NO: 770537 - DNA, 22 bp, Artificial Sequence
  chemically synthesized
aagctgctgttagcaactgccc

SEQ ID NO: 770538 - DNA, 22 bp, Artificial Sequence
  chemically synthesized
gaagctgctgttagcaactgcc

SEQ ID NO: 770539 - DNA, 22 bp, Artificial Sequence
  chemically synthesized
tgaagctgctgttagcaactgc

SEQ ID NO: 770540 - DNA, 22 bp, Artificial Sequence
  chemically synthesized
gctggagaagggcagttgctaa

SEQ ID NO: 770541 - DNA, 22 bp, Artificial Sequence
  chemically synthesized
ttgaagctgctgttagcaactg

SEQ ID NO: 770542 - DNA, 22 bp, Artificial Sequence
  chemically synthesized
gagaagggcagttgctaacagc

SEQ ID NO: 770543 - DNA, 22 bp, Artificial Sequence
  chemically synthesized
ccacttttgaagctgctgttag

SEQ ID NO: 770544 - DNA, 22 bp, Artificial Sequence
  chemically synthesized
gacgctaccacttttgaagctg

SEQ ID NO: 770545 - DNA, 22 bp, Artificial Sequence
  chemically synthesized
ctaacagcagcttcaaaagtgg

SEQ ID NO: 770546 - DNA, 22 bp, Artificial Sequence
  chemically synthesized
aaatctagacgctaccactttt

SEQ ID NO: 770547 - DNA, 22 bp, Artificial Sequence
  chemically synthesized
acagcagcttcaaaagtggtag

SEQ ID NO: 770548 - DNA, 22 bp, Artificial Sequence
  chemically synthesized
caaaagtggtagcgtctagatt

SEQ ID NO: 770549 - DNA, 22 bp, Artificial Sequence
  chemically synthesized
aaaagtggtagcgtctagattt

SEQ ID NO: 770550 - DNA, 22 bp, Artificial Sequence
  chemically synthesized
ggaaccaggaggttgaaatcta

SEQ ID NO: 770551 - DNA, 22 bp, Artificial Sequence
  chemically synthesized
taaataggaactaggaaccagg

SEQ ID NO: 770552 - DNA, 22 bp, Artificial Sequence
  chemically synthesized
gatttcaacctcctggttccta

SEQ ID NO: 770553 - DNA, 22 bp, Artificial Sequence
  chemically synthesized
gtaaataggaactaggaaccag

SEQ ID NO: 770554 - DNA, 22 bp, Artificial Sequence
  chemically synthesized
tgtaaataggaactaggaacca

SEQ ID NO: 770555 - DNA, 22 bp, Artificial Sequence
  chemically synthesized
caacctcctggttcctagttcc

SEQ ID NO: 770556 - DNA, 22 bp, Artificial Sequence
  chemically synthesized
aacctcctggttcctagttcct

SEQ ID NO: 770557 - DNA, 22 bp, Artificial Sequence
  chemically synthesized
ctggttcctagttcctatttac

SEQ ID NO: 770558 - DNA, 22 bp, Artificial Sequence
  chemically synthesized
aagaacatactttgtaaatagg

SEQ ID NO: 770559 - DNA, 22 bp, Artificial Sequence
  chemically synthesized
caagaacatactttgtaaatag

SEQ ID NO: 770560 - DNA, 22 bp, Artificial Sequence
  chemically synthesized
gttcctagttcctatttacaaa

SEQ ID NO: 770561 - DNA, 22 bp, Artificial Sequence
  chemically synthesized
ctagttcctatttacaaagtat

SEQ ID NO: 770562 - DNA, 22 bp, Artificial Sequence
  chemically synthesized
gttcctatttacaaagtatgtt

SEQ ID NO: 770563 - DNA, 22 bp, Artificial Sequence
  chemically synthesized
ctatttacaaagtatgttcttg

SEQ ID NO: 770564 - DNA, 22 bp, Artificial Sequence
  chemically synthesized
aagcaatgatttcaagaacata

SEQ ID NO: 770565 - DNA, 22 bp, Artificial Sequence
  chemically synthesized
tttacaaagtatgttcttgaaa

SEQ ID NO: 770566 - DNA, 22 bp, Artificial Sequence
  chemically synthesized
acaaagtatgttcttgaaatca

SEQ ID NO: 770567 - DNA, 22 bp, Artificial Sequence
  chemically synthesized
caaagtatgttcttgaaatcat

SEQ ID NO: 770568 - DNA, 22 bp, Artificial Sequence
  chemically synthesized
cggggtaccactgaagcaatga

SEQ ID NO: 770569 - DNA, 22 bp, Artificial Sequence
  chemically synthesized
ttgaaatcattgcttcagtggt

SEQ ID NO: 770570 - DNA, 22 bp, Artificial Sequence
  chemically synthesized
ccatctccggggtaccactgaa

SEQ ID NO: 770571 - DNA, 22 bp, Artificial Sequence
  chemically synthesized
gaaatcattgcttcagtggtac

SEQ ID NO: 770572 - DNA, 22 bp, Artificial Sequence
  chemically synthesized
aaatcattgcttcagtggtacc

SEQ ID NO: 770573 - DNA, 22 bp, Artificial Sequence
  chemically synthesized
cttcagtggtaccccggagatg

SEQ ID NO: 770574 - DNA, 22 bp, Artificial Sequence
  chemically synthesized
cagtggtaccccggagatggta

SEQ ID NO: 770575 - DNA, 22 bp, Artificial Sequence
  chemically synthesized
agtggtaccccggagatggtag

SEQ ID NO: 770576 - DNA, 22 bp, Artificial Sequence
  chemically synthesized
atccaataagaaactaccatct

SEQ ID NO: 770577 - DNA, 22 bp, Artificial Sequence
  chemically synthesized
tatagaactgatccaataagaa

SEQ ID NO: 770578 - DNA, 22 bp, Artificial Sequence
  chemically synthesized
aaactatatagaactgatccaa

SEQ ID NO: 770579 - DNA, 22 bp, Artificial Sequence
  chemically synthesized
taaaactatatagaactgatcc

SEQ ID NO: 770580 - DNA, 22 bp, Artificial Sequence
  chemically synthesized
ctaaaactatatagaactgatc

SEQ ID NO: 770581 - DNA, 22 bp, Artificial Sequence
  chemically synthesized
cttattggatcagttctatata

SEQ ID NO: 770582 - DNA, 22 bp, Artificial Sequence
  chemically synthesized
ttattggatcagttctatatag

SEQ ID NO: 770583 - DNA, 22 bp, Artificial Sequence
  chemically synthesized
attggatcagttctatatagtt

SEQ ID NO: 770584 - DNA, 22 bp, Artificial Sequence
  chemically synthesized
ttggatcagttctatatagttt

SEQ ID NO: 770585 - DNA, 22 bp, Artificial Sequence
  chemically synthesized
gatcagttctatatagttttag

SEQ ID NO: 770586 - DNA, 22 bp, Artificial Sequence
  chemically synthesized
gaggacagatttctaaaactat

SEQ ID NO: 770587 - DNA, 22 bp, Artificial Sequence
  chemically synthesized
cgaggacagatttctaaaacta

SEQ ID NO: 770588 - DNA, 22 bp, Artificial Sequence
  chemically synthesized
gcttcgaggacagatttctaaa

SEQ ID NO: 770589 - DNA, 22 bp, Artificial Sequence
  chemically synthesized
ggcttcgaggacagatttctaa

SEQ ID NO: 770590 - DNA, 22 bp, Artificial Sequence
  chemically synthesized
tatatagttttagaaatctgtc

SEQ ID NO: 770591 - DNA, 22 bp, Artificial Sequence
  chemically synthesized
tatagttttagaaatctgtcct

SEQ ID NO: 770592 - DNA, 22 bp, Artificial Sequence
  chemically synthesized
gacttggcttcgaggacagatt

SEQ ID NO: 770593 - DNA, 22 bp, Artificial Sequence
  chemically synthesized
agacttggcttcgaggacagat

SEQ ID NO: 770594 - DNA, 22 bp, Artificial Sequence
  chemically synthesized
tagacttggcttcgaggacaga

SEQ ID NO: 770595 - DNA, 22 bp, Artificial Sequence
  chemically synthesized
tagaaatctgtcctcgaagcca

SEQ ID NO: 770596 - DNA, 22 bp, Artificial Sequence
  chemically synthesized
agaaatctgtcctcgaagccaa

SEQ ID NO: 770597 - DNA, 22 bp, Artificial Sequence
  chemically synthesized
gaaatctgtcctcgaagccaag

SEQ ID NO: 770598 - DNA, 22 bp, Artificial Sequence
  chemically synthesized
aagtagcaggttttagacttgg

SEQ ID NO: 770599 - DNA, 22 bp, Artificial Sequence
  chemically synthesized
tcctcgaagccaagtctaaaac

SEQ ID NO: 770600 - DNA, 22 bp, Artificial Sequence
  chemically synthesized
gaagccaagtctaaaacctgct

SEQ ID NO: 770601 - DNA, 22 bp, Artificial Sequence
  chemically synthesized
gaaaggctaaagtagcaggttt

SEQ ID NO: 770602 - DNA, 22 bp, Artificial Sequence
  chemically synthesized
ggaaaggctaaagtagcaggtt

SEQ ID NO: 770603 - DNA, 22 bp, Artificial Sequence
  chemically synthesized
tggaaaggctaaagtagcaggt

SEQ ID NO: 770604 - DNA, 22 bp, Artificial Sequence
  chemically synthesized
aaacctgctactttagcctttc

SEQ ID NO: 770605 - DNA, 22 bp, Artificial Sequence
  chemically synthesized
ctactttagcctttccaaaact

SEQ ID NO: 770606 - DNA, 22 bp, Artificial Sequence
  chemically synthesized
gacacatatcaaagttttggaa

SEQ ID NO: 770607 - DNA, 22 bp, Artificial Sequence
  chemically synthesized
ctttagcctttccaaaactttg

SEQ ID NO: 770608 - DNA, 22 bp, Artificial Sequence
  chemically synthesized
tagcctttccaaaactttgata

SEQ ID NO: 770609 - DNA, 22 bp, Artificial Sequence
  chemically synthesized
agcctttccaaaactttgatat

SEQ ID NO: 770610 - DNA, 22 bp, Artificial Sequence
  chemically synthesized
gcctttccaaaactttgatatg

SEQ ID NO: 770611 - DNA, 22 bp, Artificial Sequence
  chemically synthesized
ggtacgttagacacatatcaaa

SEQ ID NO: 770612 - DNA, 22 bp, Artificial Sequence
  chemically synthesized
taggtacgttagacacatatca

SEQ ID NO: 770613 - DNA, 22 bp, Artificial Sequence
  chemically synthesized
tccaaaactttgatatgtgtct

SEQ ID NO: 770614 - DNA, 22 bp, Artificial Sequence
  chemically synthesized
ccaaaactttgatatgtgtcta

SEQ ID NO: 770615 - DNA, 22 bp, Artificial Sequence
  chemically synthesized
ctctaggtacgttagacacata

SEQ ID NO: 770616 - DNA, 22 bp, Artificial Sequence
  chemically synthesized
caaaactttgatatgtgtctaa

SEQ ID NO: 770617 - DNA, 22 bp, Artificial Sequence
  chemically synthesized
tgatatgtgtctaacgtaccta

SEQ ID NO: 770618 - DNA, 22 bp, Artificial Sequence
  chemically synthesized
gatatgtgtctaacgtacctag

SEQ ID NO: 770619 - DNA, 22 bp, Artificial Sequence
  chemically synthesized
atatgtgtctaacgtacctaga

SEQ ID NO: 770620 - DNA, 22 bp, Artificial Sequence
  chemically synthesized
cagaaaagagaaactactctag

SEQ ID NO: 770621 - DNA, 22 bp, Artificial Sequence
  chemically synthesized
actgcagaaaagagaaactact

SEQ ID NO: 770622 - DNA, 22 bp, Artificial Sequence
  chemically synthesized
acgtacctagagtagtttctct

SEQ ID NO: 770623 - DNA, 22 bp, Artificial Sequence
  chemically synthesized
gagtagtttctcttttctgcag

SEQ ID NO: 770624 - DNA, 22 bp, Artificial Sequence
  chemically synthesized
ctcttttctgcagtgaactccg

SEQ ID NO: 770625 - DNA, 22 bp, Artificial Sequence
  chemically synthesized
tcttttctgcagtgaactccgt

SEQ ID NO: 770626 - DNA, 22 bp, Artificial Sequence
  chemically synthesized
aaggtcaatataacggagttca

SEQ ID NO: 770627 - DNA, 22 bp, Artificial Sequence
  chemically synthesized
ttttctgcagtgaactccgtta

SEQ ID NO: 770628 - DNA, 22 bp, Artificial Sequence
  chemically synthesized
ttctgcagtgaactccgttata

SEQ ID NO: 770629 - DNA, 22 bp, Artificial Sequence
  chemically synthesized
tctgcagtgaactccgttatat

SEQ ID NO: 770630 - DNA, 22 bp, Artificial Sequence
  chemically synthesized
ctgcagtgaactccgttatatt

SEQ ID NO: 770631 - DNA, 22 bp, Artificial Sequence
  chemically synthesized
tgcagtgaactccgttatattg

SEQ ID NO: 770632 - DNA, 22 bp, Artificial Sequence
  chemically synthesized
cagtgaactccgttatattgac

SEQ ID NO: 770633 - DNA, 22 bp, Artificial Sequence
  chemically synthesized
cgttatattgaccttcagggcc

SEQ ID NO: 770634 - DNA, 22 bp, Artificial Sequence
  chemically synthesized
tattgaccttcagggccacctc

SEQ ID NO: 770635 - DNA, 22 bp, Artificial Sequence
  chemically synthesized
accttcagggccacctcctcta

SEQ ID NO: 770636 - DNA, 22 bp, Artificial Sequence
  chemically synthesized
cagggccacctcctctatttgt

SEQ ID NO: 770637 - DNA, 22 bp, Artificial Sequence
  chemically synthesized
caagtagtagaaacaaatagag

SEQ ID NO: 770638 - DNA, 22 bp, Artificial Sequence
  chemically synthesized
agggccacctcctctatttgtt

SEQ ID NO: 770639 - DNA, 22 bp, Artificial Sequence
  chemically synthesized
ctctatttgtttctactacttg

SEQ ID NO: 770640 - DNA, 22 bp, Artificial Sequence
  chemically synthesized
aaggaagatattgcaagtagta

SEQ ID NO: 770641 - DNA, 22 bp, Artificial Sequence
  chemically synthesized
tatttgtttctactacttgcaa

SEQ ID NO: 770642 - DNA, 22 bp, Artificial Sequence
  chemically synthesized
tttgtttctactacttgcaata

SEQ ID NO: 770643 - DNA, 22 bp, Artificial Sequence
  chemically synthesized
gtttctactacttgcaatatct

SEQ ID NO: 770644 - DNA, 22 bp, Artificial Sequence
  chemically synthesized
atgactaaaggaagatattgca

SEQ ID NO: 770645 - DNA, 22 bp, Artificial Sequence
  chemically synthesized
tttctactacttgcaatatctt

SEQ ID NO: 770646 - DNA, 22 bp, Artificial Sequence
  chemically synthesized
aatgactaaaggaagatattgc

SEQ ID NO: 770647 - DNA, 22 bp, Artificial Sequence
  chemically synthesized
taatgactaaaggaagatattg

SEQ ID NO: 770648 - DNA, 22 bp, Artificial Sequence
  chemically synthesized
ttaatgactaaaggaagatatt

SEQ ID NO: 770649 - DNA, 22 bp, Artificial Sequence
  chemically synthesized
ctactacttgcaatatcttcct

SEQ ID NO: 770650 - DNA, 22 bp, Artificial Sequence
  chemically synthesized
tttaatgactaaaggaagatat

SEQ ID NO: 770651 - DNA, 22 bp, Artificial Sequence
  chemically synthesized
tactacttgcaatatcttcctt

SEQ ID NO: 770652 - DNA, 22 bp, Artificial Sequence
  chemically synthesized
ttttaatgactaaaggaagata

SEQ ID NO: 770653 - DNA, 22 bp, Artificial Sequence
  chemically synthesized
ctacttgcaatatcttccttta

SEQ ID NO: 770654 - DNA, 22 bp, Artificial Sequence
  chemically synthesized
cttgcaatatcttcctttagtc

SEQ ID NO: 770655 - DNA, 22 bp, Artificial Sequence
  chemically synthesized
tagatttttttaatgactaaag

SEQ ID NO: 770656 - DNA, 22 bp, Artificial Sequence
  chemically synthesized
gcaatatcttcctttagtcatt

SEQ ID NO: 770657 - DNA, 22 bp, Artificial Sequence
  chemically synthesized
gtagatttttttaatgactaaa

SEQ ID NO: 770658 - DNA, 22 bp, Artificial Sequence
  chemically synthesized
caatatcttcctttagtcatta

SEQ ID NO: 770659 - DNA, 22 bp, Artificial Sequence
  chemically synthesized
tttgtagatttttttaatgact

SEQ ID NO: 770660 - DNA, 22 bp, Artificial Sequence
  chemically synthesized
tattgtttgtagatttttttaa

SEQ ID NO: 770661 - DNA, 22 bp, Artificial Sequence
  chemically synthesized
cctttagtcattaaaaaaatct

SEQ ID NO: 770662 - DNA, 22 bp, Artificial Sequence
  chemically synthesized
ctttagtcattaaaaaaatcta

SEQ ID NO: 770663 - DNA, 22 bp, Artificial Sequence
  chemically synthesized
tagtcattaaaaaaatctacaa

SEQ ID NO: 770664 - DNA, 22 bp, Artificial Sequence
  chemically synthesized
agtcattaaaaaaatctacaaa

SEQ ID NO: 770665 - DNA, 22 bp, Artificial Sequence
  chemically synthesized
gtcattaaaaaaatctacaaac

SEQ ID NO: 770666 - DNA, 22 bp, Artificial Sequence
  chemically synthesized
aaaaaatctacaaacaatacaa

SEQ ID NO: 770667 - DNA, 22 bp, Artificial Sequence
  chemically synthesized
agaaaaccataaagttgtattg

SEQ ID NO: 770668 - DNA, 22 bp, Artificial Sequence
  chemically synthesized
caaacaatacaactttatggtt

SEQ ID NO: 770669 - DNA, 22 bp, Artificial Sequence
  chemically synthesized
tgacaaagaaccatgttaagaa

SEQ ID NO: 770670 - DNA, 22 bp, Artificial Sequence
  chemically synthesized
ctgtgacaaagaaccatgttaa

SEQ ID NO: 770671 - DNA, 22 bp, Artificial Sequence
  chemically synthesized
tatggttttcttaacatggttc

SEQ ID NO: 770672 - DNA, 22 bp, Artificial Sequence
  chemically synthesized
tgctgtgacaaagaaccatgtt

SEQ ID NO: 770673 - DNA, 22 bp, Artificial Sequence
  chemically synthesized
atggttttcttaacatggttct

SEQ ID NO: 770674 - DNA, 22 bp, Artificial Sequence
  chemically synthesized
tggttttcttaacatggttctt

SEQ ID NO: 770675 - DNA, 22 bp, Artificial Sequence
  chemically synthesized
tcttaacatggttctttgtcac

SEQ ID NO: 770676 - DNA, 22 bp, Artificial Sequence
  chemically synthesized
cttaacatggttctttgtcaca

SEQ ID NO: 770677 - DNA, 22 bp, Artificial Sequence
  chemically synthesized
ttaacatggttctttgtcacag

SEQ ID NO: 770678 - DNA, 22 bp, Artificial Sequence
  chemically synthesized
aacatggttctttgtcacagca

SEQ ID NO: 770679 - DNA, 22 bp, Artificial Sequence
  chemically synthesized
acatggttctttgtcacagcag

SEQ ID NO: 770680 - DNA, 22 bp, Artificial Sequence
  chemically synthesized
tgatgggaaatctctgctgtga

SEQ ID NO: 770681 - DNA, 22 bp, Artificial Sequence
  chemically synthesized
tgtgatgggaaatctctgctgt

SEQ ID NO: 770682 - DNA, 22 bp, Artificial Sequence
  chemically synthesized
ctgtgatgggaaatctctgctg

SEQ ID NO: 770683 - DNA, 22 bp, Artificial Sequence
  chemically synthesized
tttgtcacagcagagatttccc

SEQ ID NO: 770684 - DNA, 22 bp, Artificial Sequence
  chemically synthesized
tccttctgtgatgggaaatctc

SEQ ID NO: 770685 - DNA, 22 bp, Artificial Sequence
  chemically synthesized
tgtcacagcagagatttcccat

SEQ ID NO: 770686 - DNA, 22 bp, Artificial Sequence
  chemically synthesized
gtcacagcagagatttcccatc

SEQ ID NO: 770687 - DNA, 22 bp, Artificial Sequence
  chemically synthesized
ctatccttctgtgatgggaaat

SEQ ID NO: 770688 - DNA, 22 bp, Artificial Sequence
  chemically synthesized
tcacagcagagatttcccatca

SEQ ID NO: 770689 - DNA, 22 bp, Artificial Sequence
  chemically synthesized
aattcctatccttctgtgatgg

SEQ ID NO: 770690 - DNA, 22 bp, Artificial Sequence
  chemically synthesized
ctcaattcctatccttctgtga

SEQ ID NO: 770691 - DNA, 22 bp, Artificial Sequence
  chemically synthesized
cctcaattcctatccttctgtg

SEQ ID NO: 770692 - DNA, 22 bp, Artificial Sequence
  chemically synthesized
ccttcctcaattcctatccttc

SEQ ID NO: 770693 - DNA, 22 bp, Artificial Sequence
  chemically synthesized
gccttcctcaattcctatcctt

SEQ ID NO: 770694 - DNA, 22 bp, Artificial Sequence
  chemically synthesized
cccatcacagaaggataggaat

SEQ ID NO: 770695 - DNA, 22 bp, Artificial Sequence
  chemically synthesized
ccatcacagaaggataggaatt

SEQ ID NO: 770696 - DNA, 22 bp, Artificial Sequence
  chemically synthesized
cataggtacaaatccacttgcc

SEQ ID NO: 770697 - DNA, 22 bp, Artificial Sequence
  chemically synthesized
tccataggtacaaatccacttg

SEQ ID NO: 770698 - DNA, 22 bp, Artificial Sequence
  chemically synthesized
aggaaggcaagtggatttgtac

SEQ ID NO: 770699 - DNA, 22 bp, Artificial Sequence
  chemically synthesized
gtacctatggagagatgtcttg

SEQ ID NO: 770700 - DNA, 22 bp, Artificial Sequence
  chemically synthesized
tacctatggagagatgtcttgt

SEQ ID NO: 770701 - DNA, 22 bp, Artificial Sequence
  chemically synthesized
gaaataaaataaataaaacaag

SEQ ID NO: 770702 - DNA, 22 bp, Artificial Sequence
  chemically synthesized
tggagagatgtcttgttttatt

SEQ ID NO: 770703 - DNA, 22 bp, Artificial Sequence
  chemically synthesized
agaaataaaataaataaaacaa

SEQ ID NO: 770704 - DNA, 22 bp, Artificial Sequence
  chemically synthesized
tagaaataaaataaataaaaca

SEQ ID NO: 770705 - DNA, 22 bp, Artificial Sequence
  chemically synthesized
tttagaaataaaataaataaaa

SEQ ID NO: 770706 - DNA, 22 bp, Artificial Sequence
  chemically synthesized
gttttatttattttatttctaa

SEQ ID NO: 770707 - DNA, 22 bp, Artificial Sequence
  chemically synthesized
ttttatttattttatttctaaa

SEQ ID NO: 770708 - DNA, 22 bp, Artificial Sequence
  chemically synthesized
taaagtatgttctttagaaata

SEQ ID NO: 770709 - DNA, 22 bp, Artificial Sequence
  chemically synthesized
gtaaagtatgttctttagaaat

SEQ ID NO: 770710 - DNA, 22 bp, Artificial Sequence
  chemically synthesized
tatttattttatttctaaagaa

SEQ ID NO: 770711 - DNA, 22 bp, Artificial Sequence
  chemically synthesized
atttattttatttctaaagaac

SEQ ID NO: 770712 - DNA, 22 bp, Artificial Sequence
  chemically synthesized
tttattttatttctaaagaaca

SEQ ID NO: 770713 - DNA, 22 bp, Artificial Sequence
  chemically synthesized
attttatttctaaagaacatac

SEQ ID NO: 770714 - DNA, 22 bp, Artificial Sequence
  chemically synthesized
ttttatttctaaagaacatact

SEQ ID NO: 770715 - DNA, 22 bp, Artificial Sequence
  chemically synthesized
aagtgtcttgtaaagtatgttc

SEQ ID NO: 770716 - DNA, 22 bp, Artificial Sequence
  chemically synthesized
tatttctaaagaacatacttta

SEQ ID NO: 770717 - DNA, 22 bp, Artificial Sequence
  chemically synthesized
atttctaaagaacatactttac

SEQ ID NO: 770718 - DNA, 22 bp, Artificial Sequence
  chemically synthesized
tttctaaagaacatactttaca

SEQ ID NO: 770719 - DNA, 22 bp, Artificial Sequence
  chemically synthesized
ctaaagaacatactttacaaga

SEQ ID NO: 770720 - DNA, 22 bp, Artificial Sequence
  chemically synthesized
caacctaaagtgtcttgtaaag

SEQ ID NO: 770721 - DNA, 22 bp, Artificial Sequence
  chemically synthesized
taaagaacatactttacaagac

SEQ ID NO: 770722 - DNA, 22 bp, Artificial Sequence
  chemically synthesized
aagaacatactttacaagacac

SEQ ID NO: 770723 - DNA, 22 bp, Artificial Sequence
  chemically synthesized
ttacaacctaaagtgtcttgta

SEQ ID NO: 770724 - DNA, 22 bp, Artificial Sequence
  chemically synthesized
atgcactgttacaacctaaagt

SEQ ID NO: 770725 - DNA, 22 bp, Artificial Sequence
  chemically synthesized
aatgcactgttacaacctaaag

SEQ ID NO: 770726 - DNA, 22 bp, Artificial Sequence
  chemically synthesized
taatgcactgttacaacctaaa

SEQ ID NO: 770727 - DNA, 22 bp, Artificial Sequence
  chemically synthesized
tacaagacactttaggttgtaa

SEQ ID NO: 770728 - DNA, 22 bp, Artificial Sequence
  chemically synthesized
acaagacactttaggttgtaac

SEQ ID NO: 770729 - DNA, 22 bp, Artificial Sequence
  chemically synthesized
caagacactttaggttgtaaca

SEQ ID NO: 770730 - DNA, 22 bp, Artificial Sequence
  chemically synthesized
ggtattttaatgcactgttaca

SEQ ID NO: 770731 - DNA, 22 bp, Artificial Sequence
  chemically synthesized
aggtattttaatgcactgttac

SEQ ID NO: 770732 - DNA, 22 bp, Artificial Sequence
  chemically synthesized
tttaggtattttaatgcactgt

SEQ ID NO: 770733 - DNA, 22 bp, Artificial Sequence
  chemically synthesized
taggttgtaacagtgcattaaa

SEQ ID NO: 770734 - DNA, 22 bp, Artificial Sequence
  chemically synthesized
aggttgtaacagtgcattaaaa

SEQ ID NO: 770735 - DNA, 22 bp, Artificial Sequence
  chemically synthesized
ggttgtaacagtgcattaaaat

SEQ ID NO: 770736 - DNA, 22 bp, Artificial Sequence
  chemically synthesized
gtatactgtttaggtattttaa

SEQ ID NO: 770737 - DNA, 22 bp, Artificial Sequence
  chemically synthesized
taacagtgcattaaaataccta

SEQ ID NO: 770738 - DNA, 22 bp, Artificial Sequence
  chemically synthesized
aaggatgctggtatactgttta

SEQ ID NO: 770739 - DNA, 22 bp, Artificial Sequence
  chemically synthesized
ctaaaggatgctggtatactgt

SEQ ID NO: 770740 - DNA, 22 bp, Artificial Sequence
  chemically synthesized
aaatacctaaacagtataccag

SEQ ID NO: 770741 - DNA, 22 bp, Artificial Sequence
  chemically synthesized
aacagtataccagcatccttta

SEQ ID NO: 770742 - DNA, 22 bp, Artificial Sequence
  chemically synthesized
taggaacactttactattattt

SEQ ID NO: 770743 - DNA, 22 bp, Artificial Sequence
  chemically synthesized
aggaacactttactattatttt

SEQ ID NO: 770744 - DNA, 22 bp, Artificial Sequence
  chemically synthesized
ggaacactttactattattttt

SEQ ID NO: 770745 - DNA, 22 bp, Artificial Sequence
  chemically synthesized
tactattatttttctcatctct

SEQ ID NO: 770746 - DNA, 22 bp, Artificial Sequence
  chemically synthesized
actattatttttctcatctctt

SEQ ID NO: 770747 - DNA, 22 bp, Artificial Sequence
  chemically synthesized
ctattatttttctcatctcttt

SEQ ID NO: 770748 - DNA, 22 bp, Artificial Sequence
  chemically synthesized
gatatgagggacaaaagagatg

SEQ ID NO: 770749 - DNA, 22 bp, Artificial Sequence
  chemically synthesized
ttatttttctcatctcttttgt

SEQ ID NO: 770750 - DNA, 22 bp, Artificial Sequence
  chemically synthesized
tttttctcatctcttttgtccc

SEQ ID NO: 770751 - DNA, 22 bp, Artificial Sequence
  chemically synthesized
acatctagatatgagggacaaa

SEQ ID NO: 770752 - DNA, 22 bp, Artificial Sequence
  chemically synthesized
ttctcatctcttttgtccctca

SEQ ID NO: 770753 - DNA, 22 bp, Artificial Sequence
  chemically synthesized
gacatctagatatgagggacaa

SEQ ID NO: 770754 - DNA, 22 bp, Artificial Sequence
  chemically synthesized
tctcatctcttttgtccctcat

SEQ ID NO: 770755 - DNA, 22 bp, Artificial Sequence
  chemically synthesized
ctcatctcttttgtccctcata

SEQ ID NO: 770756 - DNA, 22 bp, Artificial Sequence
  chemically synthesized
tcatctcttttgtccctcatat

SEQ ID NO: 770757 - DNA, 22 bp, Artificial Sequence
  chemically synthesized
atctcttttgtccctcatatct

SEQ ID NO: 770758 - DNA, 22 bp, Artificial Sequence
  chemically synthesized
ttttgtccctcatatctagatg

SEQ ID NO: 770759 - DNA, 22 bp, Artificial Sequence
  chemically synthesized
ttgtccctcatatctagatgtc

SEQ ID NO: 770760 - DNA, 22 bp, Artificial Sequence
  chemically synthesized
tgtccctcatatctagatgtca

SEQ ID NO: 770761 - DNA, 22 bp, Artificial Sequence
  chemically synthesized
tcagtggaaatttgacatctag

SEQ ID NO: 770762 - DNA, 22 bp, Artificial Sequence
  chemically synthesized
gtccctcatatctagatgtcaa

SEQ ID NO: 770763 - DNA, 22 bp, Artificial Sequence
  chemically synthesized
gtcagtggaaatttgacatcta

SEQ ID NO: 770764 - DNA, 22 bp, Artificial Sequence
  chemically synthesized
tccctcatatctagatgtcaaa

SEQ ID NO: 770765 - DNA, 22 bp, Artificial Sequence
  chemically synthesized
cttgtcagtggaaatttgacat

SEQ ID NO: 770766 - DNA, 22 bp, Artificial Sequence
  chemically synthesized
atatctagatgtcaaatttcca

SEQ ID NO: 770767 - DNA, 22 bp, Artificial Sequence
  chemically synthesized
gatgtcaaatttccactgacaa

SEQ ID NO: 770768 - DNA, 22 bp, Artificial Sequence
  chemically synthesized
ggcatcaaattacttgtcagtg

SEQ ID NO: 770769 - DNA, 22 bp, Artificial Sequence
  chemically synthesized
cctaggcatcaaattacttgtc

SEQ ID NO: 770770 - DNA, 22 bp, Artificial Sequence
  chemically synthesized
ccctaggcatcaaattacttgt

SEQ ID NO: 770771 - DNA, 22 bp, Artificial Sequence
  chemically synthesized
tccctaggcatcaaattacttg

SEQ ID NO: 770772 - DNA, 22 bp, Artificial Sequence
  chemically synthesized
ccactgacaagtaatttgatgc

SEQ ID NO: 770773 - DNA, 22 bp, Artificial Sequence
  chemically synthesized
cactgacaagtaatttgatgcc

SEQ ID NO: 770774 - DNA, 22 bp, Artificial Sequence
  chemically synthesized
acaagtaatttgatgcctaggg

SEQ ID NO: 770775 - DNA, 22 bp, Artificial Sequence
  chemically synthesized
aatcgaatattttccctaggca

SEQ ID NO: 770776 - DNA, 22 bp, Artificial Sequence
  chemically synthesized
ttgaatcgaatattttccctag

SEQ ID NO: 770777 - DNA, 22 bp, Artificial Sequence
  chemically synthesized
gatgcctagggaaaatattcga

SEQ ID NO: 770778 - DNA, 22 bp, Artificial Sequence
  chemically synthesized
atgcctagggaaaatattcgat

SEQ ID NO: 770779 - DNA, 22 bp, Artificial Sequence
  chemically synthesized
tgaaactgttgaatcgaatatt

SEQ ID NO: 770780 - DNA, 22 bp, Artificial Sequence
  chemically synthesized
gggaaaatattcgattcaacag

SEQ ID NO: 770781 - DNA, 22 bp, Artificial Sequence
  chemically synthesized
ataggacatcatgttatgaaac

SEQ ID NO: 770782 - DNA, 22 bp, Artificial Sequence
  chemically synthesized
gattcaacagtttcataacatg

SEQ ID NO: 770783 - DNA, 22 bp, Artificial Sequence
  chemically synthesized
attaataggacatcatgttatg

SEQ ID NO: 770784 - DNA, 22 bp, Artificial Sequence
  chemically synthesized
aattaataggacatcatgttat

SEQ ID NO: 770785 - DNA, 22 bp, Artificial Sequence
  chemically synthesized
taattaataggacatcatgtta

SEQ ID NO: 770786 - DNA, 22 bp, Artificial Sequence
  chemically synthesized
aacagtttcataacatgatgtc

SEQ ID NO: 770787 - DNA, 22 bp, Artificial Sequence
  chemically synthesized
cataacatgatgtcctattaat

SEQ ID NO: 770788 - DNA, 22 bp, Artificial Sequence
  chemically synthesized
ataacatgatgtcctattaatt

SEQ ID NO: 770789 - DNA, 22 bp, Artificial Sequence
  chemically synthesized
atgtcagtgtatcatgttttaa

SEQ ID NO: 770790 - DNA, 22 bp, Artificial Sequence
  chemically synthesized
aatgtcagtgtatcatgtttta

SEQ ID NO: 770791 - DNA, 22 bp, Artificial Sequence
  chemically synthesized
ttaattaaaacatgatacactg

SEQ ID NO: 770792 - DNA, 22 bp, Artificial Sequence
  chemically synthesized
gaaatttaatgtcagtgtatca

SEQ ID NO: 770793 - DNA, 22 bp, Artificial Sequence
  chemically synthesized
ggaaatttaatgtcagtgtatc

SEQ ID NO: 770794 - DNA, 22 bp, Artificial Sequence
  chemically synthesized
attaaaacatgatacactgaca

SEQ ID NO: 770795 - DNA, 22 bp, Artificial Sequence
  chemically synthesized
atttggaaatttaatgtcagtg

SEQ ID NO: 770796 - DNA, 22 bp, Artificial Sequence
  chemically synthesized
catttggaaatttaatgtcagt

SEQ ID NO: 770797 - DNA, 22 bp, Artificial Sequence
  chemically synthesized
aaacatgatacactgacattaa

SEQ ID NO: 770798 - DNA, 22 bp, Artificial Sequence
  chemically synthesized
tcatttggaaatttaatgtcag

SEQ ID NO: 770799 - DNA, 22 bp, Artificial Sequence
  chemically synthesized
ttcatttggaaatttaatgtca

SEQ ID NO: 770800 - DNA, 22 bp, Artificial Sequence
  chemically synthesized
ttttcatttggaaatttaatgt

SEQ ID NO: 770801 - DNA, 22 bp, Artificial Sequence
  chemically synthesized
cttttcatttggaaatttaatg

SEQ ID NO: 770802 - DNA, 22 bp, Artificial Sequence
  chemically synthesized
ggcttcttttcatttggaaatt

SEQ ID NO: 770803 - DNA, 22 bp, Artificial Sequence
  chemically synthesized
tgggcttcttttcatttggaaa

SEQ ID NO: 770804 - DNA, 22 bp, Artificial Sequence
  chemically synthesized
ctgggcttcttttcatttggaa

SEQ ID NO: 770805 - DNA, 22 bp, Artificial Sequence
  chemically synthesized
acattaaatttccaaatgaaaa

SEQ ID NO: 770806 - DNA, 22 bp, Artificial Sequence
  chemically synthesized
acttctgggcttcttttcattt

SEQ ID NO: 770807 - DNA, 22 bp, Artificial Sequence
  chemically synthesized
cacttctgggcttcttttcatt

SEQ ID NO: 770808 - DNA, 22 bp, Artificial Sequence
  chemically synthesized
aatttccaaatgaaaagaagcc

SEQ ID NO: 770809 - DNA, 22 bp, Artificial Sequence
  chemically synthesized
tgatatttcacttctgggcttc

SEQ ID NO: 770810 - DNA, 22 bp, Artificial Sequence
  chemically synthesized
ccaaatgaaaagaagcccagaa

SEQ ID NO: 770811 - DNA, 22 bp, Artificial Sequence
  chemically synthesized
gtgatatttcacttctgggctt

SEQ ID NO: 770812 - DNA, 22 bp, Artificial Sequence
  chemically synthesized
caaatgaaaagaagcccagaag

SEQ ID NO: 770813 - DNA, 22 bp, Artificial Sequence
  chemically synthesized
tacgtatgtatcaagtttgtga

SEQ ID NO: 770814 - DNA, 22 bp, Artificial Sequence
  chemically synthesized
catgtgactatacgtatgtatc

SEQ ID NO: 770815 - DNA, 22 bp, Artificial Sequence
  chemically synthesized
cacccctccatgtgactatacg

SEQ ID NO: 770816 - DNA, 22 bp, Artificial Sequence
  chemically synthesized
gatacatacgtatagtcacatg

SEQ ID NO: 770817 - DNA, 22 bp, Artificial Sequence
  chemically synthesized
atacatacgtatagtcacatgg

SEQ ID NO: 770818 - DNA, 22 bp, Artificial Sequence
  chemically synthesized
gtatccctccacccctccatgt

SEQ ID NO: 770819 - DNA, 22 bp, Artificial Sequence
  chemically synthesized
agtatccctccacccctccatg

SEQ ID NO: 770820 - DNA, 22 bp, Artificial Sequence
  chemically synthesized
cttagtatccctccacccctcc

SEQ ID NO: 770821 - DNA, 22 bp, Artificial Sequence
  chemically synthesized
ccttagtatccctccacccctc

SEQ ID NO: 770822 - DNA, 22 bp, Artificial Sequence
  chemically synthesized
tccttagtatccctccacccct

SEQ ID NO: 770823 - DNA, 22 bp, Artificial Sequence
  chemically synthesized
tctttccttagtatccctccac

SEQ ID NO: 770824 - DNA, 22 bp, Artificial Sequence
  chemically synthesized
aaaacacactgtctttccttag

SEQ ID NO: 770825 - DNA, 22 bp, Artificial Sequence
  chemically synthesized
gaaaacacactgtctttcctta

SEQ ID NO: 770826 - DNA, 22 bp, Artificial Sequence
  chemically synthesized
aggaaagacagtgtgttttcaa

SEQ ID NO: 770827 - DNA, 22 bp, Artificial Sequence
  chemically synthesized
acacgtgcaagccaggtttgaa

SEQ ID NO: 770828 - DNA, 22 bp, Artificial Sequence
  chemically synthesized
acctcacacgtgcaagccaggt

SEQ ID NO: 770829 - DNA, 22 bp, Artificial Sequence
  chemically synthesized
tcaaacctggcttgcacgtgtg

SEQ ID NO: 770830 - DNA, 22 bp, Artificial Sequence
  chemically synthesized
cagtgttcacctcacacgtgca

SEQ ID NO: 770831 - DNA, 22 bp, Artificial Sequence
  chemically synthesized
caaacctggcttgcacgtgtga

SEQ ID NO: 770832 - DNA, 22 bp, Artificial Sequence
  chemically synthesized
aaacctggcttgcacgtgtgag

SEQ ID NO: 770833 - DNA, 22 bp, Artificial Sequence
  chemically synthesized
tccagtgttcacctcacacgtg

SEQ ID NO: 770834 - DNA, 22 bp, Artificial Sequence
  chemically synthesized
ttctccagtgttcacctcacac

SEQ ID NO: 770835 - DNA, 22 bp, Artificial Sequence
  chemically synthesized
tgttctccagtgttcacctcac

SEQ ID NO: 770836 - DNA, 22 bp, Artificial Sequence
  chemically synthesized
gcttgcacgtgtgaggtgaaca

SEQ ID NO: 770837 - DNA, 22 bp, Artificial Sequence
  chemically synthesized
gcacgtgtgaggtgaacactgg

SEQ ID NO: 770838 - DNA, 22 bp, Artificial Sequence
  chemically synthesized
cacgtgtgaggtgaacactgga

SEQ ID NO: 770839 - DNA, 22 bp, Artificial Sequence
  chemically synthesized
acagcagagaggtaagttctgt

SEQ ID NO: 770840 - DNA, 22 bp, Artificial Sequence
  chemically synthesized
gagaacagaacttacctctctg

SEQ ID NO: 770841 - DNA, 22 bp, Artificial Sequence
  chemically synthesized
caagtgctgacagcagagaggt

SEQ ID NO: 770842 - DNA, 22 bp, Artificial Sequence
  chemically synthesized
ttccaagtgctgacagcagaga

SEQ ID NO: 770843 - DNA, 22 bp, Artificial Sequence
  chemically synthesized
agtgctgttccaagtgctgaca

SEQ ID NO: 770844 - DNA, 22 bp, Artificial Sequence
  chemically synthesized
acctctctgctgtcagcacttg

SEQ ID NO: 770845 - DNA, 22 bp, Artificial Sequence
  chemically synthesized
cctctctgctgtcagcacttgg

SEQ ID NO: 770846 - DNA, 22 bp, Artificial Sequence
  chemically synthesized
tctgctgtcagcacttggaaca

SEQ ID NO: 770847 - DNA, 22 bp, Artificial Sequence
  chemically synthesized
tgctgtcagcacttggaacagc

SEQ ID NO: 770848 - DNA, 22 bp, Artificial Sequence
  chemically synthesized
gagtgcgctcagtgctgttcca

SEQ ID NO: 770849 - DNA, 22 bp, Artificial Sequence
  chemically synthesized
ctgtcagcacttggaacagcac

SEQ ID NO: 770850 - DNA, 22 bp, Artificial Sequence
  chemically synthesized
tcagcacttggaacagcactga

SEQ ID NO: 770851 - DNA, 22 bp, Artificial Sequence
  chemically synthesized
agcgcctcgagtgcgctcagtg

SEQ ID NO: 770852 - DNA, 22 bp, Artificial Sequence
  chemically synthesized
ttgagcgcctcgagtgcgctca

SEQ ID NO: 770853 - DNA, 22 bp, Artificial Sequence
  chemically synthesized
attgagcgcctcgagtgcgctc

SEQ ID NO: 770854 - DNA, 22 bp, Artificial Sequence
  chemically synthesized
ggaacagcactgagcgcactcg

SEQ ID NO: 770855 - DNA, 22 bp, Artificial Sequence
  chemically synthesized
gaacagcactgagcgcactcga

SEQ ID NO: 770856 - DNA, 22 bp, Artificial Sequence
  chemically synthesized
gatttattgagcgcctcgagtg

SEQ ID NO: 770857 - DNA, 22 bp, Artificial Sequence
  chemically synthesized
agctcgatttattgagcgcctc

SEQ ID NO: 770858 - DNA, 22 bp, Artificial Sequence
  chemically synthesized
agcgcactcgaggcgctcaata

SEQ ID NO: 770859 - DNA, 22 bp, Artificial Sequence
  chemically synthesized
aaaaattaagctcgatttattg

SEQ ID NO: 770860 - DNA, 22 bp, Artificial Sequence
  chemically synthesized
aaaaaattaagctcgatttatt

SEQ ID NO: 770861 - DNA, 22 bp, Artificial Sequence
  chemically synthesized
gaggcgctcaataaatcgagct

SEQ ID NO: 770862 - DNA, 22 bp, Artificial Sequence
  chemically synthesized
aataaatcgagcttaatttttt

SEQ ID NO: 770863 - DNA, 22 bp, Artificial Sequence
  chemically synthesized
aattttttaaatcttttcgctc

SEQ ID NO: 770864 - DNA, 22 bp, Artificial Sequence
  chemically synthesized
attttttaaatcttttcgctcc

SEQ ID NO: 770865 - DNA, 22 bp, Artificial Sequence
  chemically synthesized
tttaaatcttttcgctcccttc

SEQ ID NO: 770866 - DNA, 22 bp, Artificial Sequence
  chemically synthesized
ttaaatcttttcgctcccttcg

SEQ ID NO: 770867 - DNA, 22 bp, Artificial Sequence
  chemically synthesized
taaatcttttcgctcccttcgc

SEQ ID NO: 770868 - DNA, 22 bp, Artificial Sequence
  chemically synthesized
aaatcttttcgctcccttcgcc

SEQ ID NO: 770869 - DNA, 22 bp, Artificial Sequence
  chemically synthesized
aatcttttcgctcccttcgccc

SEQ ID NO: 770870 - DNA, 22 bp, Artificial Sequence
  chemically synthesized
ttcgctcccttcgcccattctg

SEQ ID NO: 770871 - DNA, 22 bp, Artificial Sequence
  chemically synthesized
tcgctcccttcgcccattctgc

SEQ ID NO: 770872 - DNA, 22 bp, Artificial Sequence
  chemically synthesized
cgctcccttcgcccattctgca

SEQ ID NO: 770873 - DNA, 22 bp, Artificial Sequence
  chemically synthesized
gctcccttcgcccattctgcat

SEQ ID NO: 770874 - DNA, 22 bp, Artificial Sequence
  chemically synthesized
tacatgagatatatgcagaatg

SEQ ID NO: 770875 - DNA, 22 bp, Artificial Sequence
  chemically synthesized
ccttcgcccattctgcatatat

SEQ ID NO: 770876 - DNA, 22 bp, Artificial Sequence
  chemically synthesized
cgcccattctgcatatatctca

SEQ ID NO: 770877 - DNA, 22 bp, Artificial Sequence
  chemically synthesized
gcccattctgcatatatctcat

SEQ ID NO: 770878 - DNA, 22 bp, Artificial Sequence
  chemically synthesized
ggaaatgaaattgtacatgaga

SEQ ID NO: 770879 - DNA, 22 bp, Artificial Sequence
  chemically synthesized
gggaaatgaaattgtacatgag

SEQ ID NO: 770880 - DNA, 22 bp, Artificial Sequence
  chemically synthesized
tgggaaatgaaattgtacatga

SEQ ID NO: 770881 - DNA, 22 bp, Artificial Sequence
  chemically synthesized
ttgggaaatgaaattgtacatg

SEQ ID NO: 770882 - DNA, 22 bp, Artificial Sequence
  chemically synthesized
tgcatatatctcatgtacaatt

SEQ ID NO: 770883 - DNA, 22 bp, Artificial Sequence
  chemically synthesized
catatatctcatgtacaatttc

SEQ ID NO: 770884 - DNA, 22 bp, Artificial Sequence
  chemically synthesized
gtacttttgggaaatgaaattg

SEQ ID NO: 770885 - DNA, 22 bp, Artificial Sequence
  chemically synthesized
atgtacaatttcatttcccaaa

SEQ ID NO: 770886 - DNA, 22 bp, Artificial Sequence
  chemically synthesized
gaacctggtacttttgggaaat

SEQ ID NO: 770887 - DNA, 22 bp, Artificial Sequence
  chemically synthesized
atgttagaacctggtacttttg

SEQ ID NO: 770888 - DNA, 22 bp, Artificial Sequence
  chemically synthesized
ctgatgttagaacctggtactt

SEQ ID NO: 770889 - DNA, 22 bp, Artificial Sequence
  chemically synthesized
cctgatgttagaacctggtact

SEQ ID NO: 770890 - DNA, 22 bp, Artificial Sequence
  chemically synthesized
catttcccaaaagtaccaggtt

SEQ ID NO: 770891 - DNA, 22 bp, Artificial Sequence
  chemically synthesized
atttcccaaaagtaccaggttc

SEQ ID NO: 770892 - DNA, 22 bp, Artificial Sequence
  chemically synthesized
ttcctgatgttagaacctggta

SEQ ID NO: 770893 - DNA, 22 bp, Artificial Sequence
  chemically synthesized
cttcctgatgttagaacctggt

SEQ ID NO: 770894 - DNA, 22 bp, Artificial Sequence
  chemically synthesized
tcttcctgatgttagaacctgg

SEQ ID NO: 770895 - DNA, 22 bp, Artificial Sequence
  chemically synthesized
cccaaaagtaccaggttctaac

SEQ ID NO: 770896 - DNA, 22 bp, Artificial Sequence
  chemically synthesized
ccaaaagtaccaggttctaaca

SEQ ID NO: 770897 - DNA, 22 bp, Artificial Sequence
  chemically synthesized
accatatattttcttcctgatg

SEQ ID NO: 770898 - DNA, 22 bp, Artificial Sequence
  chemically synthesized
taacatcaggaagaaaatatat

SEQ ID NO: 770899 - DNA, 22 bp, Artificial Sequence
  chemically synthesized
acatcaggaagaaaatatatgg

SEQ ID NO: 770900 - DNA, 22 bp, Artificial Sequence
  chemically synthesized
accaccagaaatggtcaatact

SEQ ID NO: 770901 - DNA, 22 bp, Artificial Sequence
  chemically synthesized
gaccaccagaaatggtcaatac

SEQ ID NO: 770902 - DNA, 22 bp, Artificial Sequence
  chemically synthesized
agagtagagaccttgaccacca

SEQ ID NO: 770903 - DNA, 22 bp, Artificial Sequence
  chemically synthesized
accatttctggtggtcaaggtc

SEQ ID NO: 770904 - DNA, 22 bp, Artificial Sequence
  chemically synthesized
catgagattaagagtagagacc

SEQ ID NO: 770905 - DNA, 22 bp, Artificial Sequence
  chemically synthesized
ctggtggtcaaggtctctactc

SEQ ID NO: 770906 - DNA, 22 bp, Artificial Sequence
  chemically synthesized
tggtggtcaaggtctctactct

SEQ ID NO: 770907 - DNA, 22 bp, Artificial Sequence
  chemically synthesized
gtggtcaaggtctctactctta

SEQ ID NO: 770908 - DNA, 22 bp, Artificial Sequence
  chemically synthesized
attacatgagattaagagtaga

SEQ ID NO: 770909 - DNA, 22 bp, Artificial Sequence
  chemically synthesized
taggatcaccctaattacatga

SEQ ID NO: 770910 - DNA, 22 bp, Artificial Sequence
  chemically synthesized
tactcttaatctcatgtaatta

SEQ ID NO: 770911 - DNA, 22 bp, Artificial Sequence
  chemically synthesized
ctcttaatctcatgtaattagg

SEQ ID NO: 770912 - DNA, 22 bp, Artificial Sequence
  chemically synthesized
ttaatctcatgtaattagggtg

SEQ ID NO: 770913 - DNA, 22 bp, Artificial Sequence
  chemically synthesized
aatctcatgtaattagggtgat

SEQ ID NO: 770914 - DNA, 22 bp, Artificial Sequence
  chemically synthesized
atctcatgtaattagggtgatc

SEQ ID NO: 770915 - DNA, 22 bp, Artificial Sequence
  chemically synthesized
gacaatgaactataggatcacc

SEQ ID NO: 770916 - DNA, 22 bp, Artificial Sequence
  chemically synthesized
ggacaatgaactataggatcac

SEQ ID NO: 770917 - DNA, 22 bp, Artificial Sequence
  chemically synthesized
atgtaattagggtgatcctata

SEQ ID NO: 770918 - DNA, 22 bp, Artificial Sequence
  chemically synthesized
aggtttggacaatgaactatag

SEQ ID NO: 770919 - DNA, 22 bp, Artificial Sequence
  chemically synthesized
gggtgatcctatagttcattgt

SEQ ID NO: 770920 - DNA, 22 bp, Artificial Sequence
  chemically synthesized
aaaagtgttcaggtttggacaa

SEQ ID NO: 770921 - DNA, 22 bp, Artificial Sequence
  chemically synthesized
tcaaaagtgttcaggtttggac

SEQ ID NO: 770922 - DNA, 22 bp, Artificial Sequence
  chemically synthesized
tagttcattgtccaaacctgaa

SEQ ID NO: 770923 - DNA, 22 bp, Artificial Sequence
  chemically synthesized
gacactctcaaaagtgttcagg

SEQ ID NO: 770924 - DNA, 22 bp, Artificial Sequence
  chemically synthesized
attgtccaaacctgaacacttt

SEQ ID NO: 770925 - DNA, 22 bp, Artificial Sequence
  chemically synthesized
tccaaacctgaacacttttgag

SEQ ID NO: 770926 - DNA, 22 bp, Artificial Sequence
  chemically synthesized
gcatcctggacactctcaaaag

SEQ ID NO: 770927 - DNA, 22 bp, Artificial Sequence
  chemically synthesized
ttagcatcctggacactctcaa

SEQ ID NO: 770928 - DNA, 22 bp, Artificial Sequence
  chemically synthesized
ttattagcatcctggacactct

SEQ ID NO: 770929 - DNA, 22 bp, Artificial Sequence
  chemically synthesized
aacacttttgagagtgtccagg

SEQ ID NO: 770930 - DNA, 22 bp, Artificial Sequence
  chemically synthesized
tgtgattattattagcatcctg

SEQ ID NO: 770931 - DNA, 22 bp, Artificial Sequence
  chemically synthesized
ttgagagtgtccaggatgctaa

SEQ ID NO: 770932 - DNA, 22 bp, Artificial Sequence
  chemically synthesized
tgagagtgtccaggatgctaat

SEQ ID NO: 770933 - DNA, 22 bp, Artificial Sequence
  chemically synthesized
gagagtgtccaggatgctaata

SEQ ID NO: 770934 - DNA, 22 bp, Artificial Sequence
  chemically synthesized
agagtgtccaggatgctaataa

SEQ ID NO: 770935 - DNA, 22 bp, Artificial Sequence
  chemically synthesized
accctgtgtgattattattagc

SEQ ID NO: 770936 - DNA, 22 bp, Artificial Sequence
  chemically synthesized
ataataatcacacagggtcagg

SEQ ID NO: 770937 - DNA, 22 bp, Artificial Sequence
  chemically synthesized
caggcatgagccagtgtgcctg

SEQ ID NO: 770938 - DNA, 22 bp, Artificial Sequence
  chemically synthesized
gattacaggcatgagccagtgt

SEQ ID NO: 770939 - DNA, 22 bp, Artificial Sequence
  chemically synthesized
ccaaagcacctggattacaggc

SEQ ID NO: 770940 - DNA, 22 bp, Artificial Sequence
  chemically synthesized
gctcatgcctgtaatccaggtg

SEQ ID NO: 770941 - DNA, 22 bp, Artificial Sequence
  chemically synthesized
ggcctcccaaagcacctggatt

SEQ ID NO: 770942 - DNA, 22 bp, Artificial Sequence
  chemically synthesized
atgcctgtaatccaggtgcttt

SEQ ID NO: 770943 - DNA, 22 bp, Artificial Sequence
  chemically synthesized
cctcggcctcccaaagcacctg

SEQ ID NO: 770944 - DNA, 22 bp, Artificial Sequence
  chemically synthesized
ctacctcggcctcccaaagcac

SEQ ID NO: 770945 - DNA, 22 bp, Artificial Sequence
  chemically synthesized
taatccaggtgctttgggaggc

SEQ ID NO: 770946 - DNA, 22 bp, Artificial Sequence
  chemically synthesized
aagcaatactcctacctcggcc

SEQ ID NO: 770947 - DNA, 22 bp, Artificial Sequence
  chemically synthesized
caagcaatactcctacctcggc

SEQ ID NO: 770948 - DNA, 22 bp, Artificial Sequence
  chemically synthesized
gcttcaagcaatactcctacct

SEQ ID NO: 770949 - DNA, 22 bp, Artificial Sequence
  chemically synthesized
tgggaggccgaggtaggagtat

SEQ ID NO: 770950 - DNA, 22 bp, Artificial Sequence
  chemically synthesized
gggaggccgaggtaggagtatt

SEQ ID NO: 770951 - DNA, 22 bp, Artificial Sequence
  chemically synthesized
ctggcttcaagcaatactccta

SEQ ID NO: 770952 - DNA, 22 bp, Artificial Sequence
  chemically synthesized
ggaggccgaggtaggagtattg

SEQ ID NO: 770953 - DNA, 22 bp, Artificial Sequence
  chemically synthesized
aaactcctggcttcaagcaata

SEQ ID NO: 770954 - DNA, 22 bp, Artificial Sequence
  chemically synthesized
atctcaaactcctggcttcaag

SEQ ID NO: 770955 - DNA, 22 bp, Artificial Sequence
  chemically synthesized
cccaggctgatctcaaactcct

SEQ ID NO: 770956 - DNA, 22 bp, Artificial Sequence
  chemically synthesized
cttgaagccaggagtttgagat

SEQ ID NO: 770957 - DNA, 22 bp, Artificial Sequence
  chemically synthesized
cattgcccaggctgatctcaaa

SEQ ID NO: 770958 - DNA, 22 bp, Artificial Sequence
  chemically synthesized
gaagccaggagtttgagatcag

SEQ ID NO: 770959 - DNA, 22 bp, Artificial Sequence
  chemically synthesized
aagccaggagtttgagatcagc

SEQ ID NO: 770960 - DNA, 22 bp, Artificial Sequence
  chemically synthesized
gagatcagcctgggcaatgtag

SEQ ID NO: 770961 - DNA, 22 bp, Artificial Sequence
  chemically synthesized
agatcagcctgggcaatgtagc

SEQ ID NO: 770962 - DNA, 22 bp, Artificial Sequence
  chemically synthesized
tagagataagagtcatgctaca

SEQ ID NO: 770963 - DNA, 22 bp, Artificial Sequence
  chemically synthesized
ggcaatgtagcatgactcttat

SEQ ID NO: 770964 - DNA, 22 bp, Artificial Sequence
  chemically synthesized
aaacatattgtagagataagag

SEQ ID NO: 770965 - DNA, 22 bp, Artificial Sequence
  chemically synthesized
aaaacatattgtagagataaga

SEQ ID NO: 770966 - DNA, 22 bp, Artificial Sequence
  chemically synthesized
taaaacatattgtagagataag

SEQ ID NO: 770967 - DNA, 22 bp, Artificial Sequence
  chemically synthesized
ttaaaacatattgtagagataa

SEQ ID NO: 770968 - DNA, 22 bp, Artificial Sequence
  chemically synthesized
atttttaaaacatattgtagag

SEQ ID NO: 770969 - DNA, 22 bp, Artificial Sequence
  chemically synthesized
aatttttaaaacatattgtaga

SEQ ID NO: 770970 - DNA, 22 bp, Artificial Sequence
  chemically synthesized
taatttttaaaacatattgtag

SEQ ID NO: 770971 - DNA, 22 bp, Artificial Sequence
  chemically synthesized
ttaatttttaaaacatattgta

SEQ ID NO: 770972 - DNA, 22 bp, Artificial Sequence
  chemically synthesized
tttttaatttttaaaacatatt

SEQ ID NO: 770973 - DNA, 22 bp, Artificial Sequence
  chemically synthesized
atttttaatttttaaaacatat

SEQ ID NO: 770974 - DNA, 22 bp, Artificial Sequence
  chemically synthesized
ttatctctacaatatgttttaa

SEQ ID NO: 770975 - DNA, 22 bp, Artificial Sequence
  chemically synthesized
tatttttaatttttaaaacata

SEQ ID NO: 770976 - DNA, 22 bp, Artificial Sequence
  chemically synthesized
ttatttttaatttttaaaacat

SEQ ID NO: 770977 - DNA, 22 bp, Artificial Sequence
  chemically synthesized
atctctacaatatgttttaaaa

SEQ ID NO: 770978 - DNA, 22 bp, Artificial Sequence
  chemically synthesized
tctctacaatatgttttaaaaa

SEQ ID NO: 770979 - DNA, 22 bp, Artificial Sequence
  chemically synthesized
tttttatttttaatttttaaaa

SEQ ID NO: 770980 - DNA, 22 bp, Artificial Sequence
  chemically synthesized
atttttatttttaatttttaaa

SEQ ID NO: 770981 - DNA, 22 bp, Artificial Sequence
  chemically synthesized
tatttttatttttaatttttaa

SEQ ID NO: 770982 - DNA, 22 bp, Artificial Sequence
  chemically synthesized
tacaatatgttttaaaaattaa

SEQ ID NO: 770983 - DNA, 22 bp, Artificial Sequence
  chemically synthesized
ttatttttatttttaattttta

SEQ ID NO: 770984 - DNA, 22 bp, Artificial Sequence
  chemically synthesized
tttatttttatttttaattttt

SEQ ID NO: 770985 - DNA, 22 bp, Artificial Sequence
  chemically synthesized
caatatgttttaaaaattaaaa

SEQ ID NO: 770986 - DNA, 22 bp, Artificial Sequence
  chemically synthesized
ttttatttttatttttaatttt

SEQ ID NO: 770987 - DNA, 22 bp, Artificial Sequence
  chemically synthesized
tttttttatttttatttttaat

SEQ ID NO: 770988 - DNA, 22 bp, Artificial Sequence
  chemically synthesized
actgtttttttatttttatttt

SEQ ID NO: 770989 - DNA, 22 bp, Artificial Sequence
  chemically synthesized
aactgtttttttatttttattt

SEQ ID NO: 770990 - DNA, 22 bp, Artificial Sequence
  chemically synthesized
taactgtttttttatttttatt

SEQ ID NO: 770991 - DNA, 22 bp, Artificial Sequence
  chemically synthesized
taaaaattaaaaataaaaataa

SEQ ID NO: 770992 - DNA, 22 bp, Artificial Sequence
  chemically synthesized
aaaaattaaaaataaaaataaa

SEQ ID NO: 770993 - DNA, 22 bp, Artificial Sequence
  chemically synthesized
aaaattaaaaataaaaataaaa

SEQ ID NO: 770994 - DNA, 22 bp, Artificial Sequence
  chemically synthesized
ctttaactgtttttttattttt

SEQ ID NO: 770995 - DNA, 22 bp, Artificial Sequence
  chemically synthesized
aaactcctttaactgttttttt

SEQ ID NO: 770996 - DNA, 22 bp, Artificial Sequence
  chemically synthesized
aaaataaaaataaaaaaacagt

SEQ ID NO: 770997 - DNA, 22 bp, Artificial Sequence
  chemically synthesized
tcaaactcctttaactgttttt

SEQ ID NO: 770998 - DNA, 22 bp, Artificial Sequence
  chemically synthesized
ttctcaaactcctttaactgtt

SEQ ID NO: 770999 - DNA, 22 bp, Artificial Sequence
  chemically synthesized
gccaggctgttctcaaactcct

SEQ ID NO: 771000 - DNA, 22 bp, Artificial Sequence
  chemically synthesized
gccatgttggccaggctgttct

SEQ ID NO: 771001 - DNA, 22 bp, Artificial Sequence
  chemically synthesized
cgccatgttggccaggctgttc

SEQ ID NO: 771002 - DNA, 22 bp, Artificial Sequence
  chemically synthesized
aaggagtttgagaacagcctgg

SEQ ID NO: 771003 - DNA, 22 bp, Artificial Sequence
  chemically synthesized
gagaacagcctggccaacatgg

SEQ ID NO: 771004 - DNA, 22 bp, Artificial Sequence
  chemically synthesized
agaacagcctggccaacatggc

SEQ ID NO: 771005 - DNA, 22 bp, Artificial Sequence
  chemically synthesized
gtagagacagagtttcgccatg

SEQ ID NO: 771006 - DNA, 22 bp, Artificial Sequence
  chemically synthesized
agtagagacagagtttcgccat

SEQ ID NO: 771007 - DNA, 22 bp, Artificial Sequence
  chemically synthesized
tagtagagacagagtttcgcca

SEQ ID NO: 771008 - DNA, 22 bp, Artificial Sequence
  chemically synthesized
ttagtagagacagagtttcgcc

SEQ ID NO: 771009 - DNA, 22 bp, Artificial Sequence
  chemically synthesized
gccaacatggcgaaactctgtc

SEQ ID NO: 771010 - DNA, 22 bp, Artificial Sequence
  chemically synthesized
tatttttagtagagacagagtt

SEQ ID NO: 771011 - DNA, 22 bp, Artificial Sequence
  chemically synthesized
gtatttttagtagagacagagt

SEQ ID NO: 771012 - DNA, 22 bp, Artificial Sequence
  chemically synthesized
tgtatttttagtagagacagag

SEQ ID NO: 771013 - DNA, 22 bp, Artificial Sequence
  chemically synthesized
ttgtatttttagtagagacaga

SEQ ID NO: 771014 - DNA, 22 bp, Artificial Sequence
  chemically synthesized
atttttgtatttttagtagaga

SEQ ID NO: 771015 - DNA, 22 bp, Artificial Sequence
  chemically synthesized
ctaatttttgtatttttagtag

SEQ ID NO: 771016 - DNA, 22 bp, Artificial Sequence
  chemically synthesized
tgtctctactaaaaatacaaaa

SEQ ID NO: 771017 - DNA, 22 bp, Artificial Sequence
  chemically synthesized
tctctactaaaaatacaaaaat

SEQ ID NO: 771018 - DNA, 22 bp, Artificial Sequence
  chemically synthesized
tactaaaaatacaaaaattagc

SEQ ID NO: 771019 - DNA, 22 bp, Artificial Sequence
  chemically synthesized
ctaaaaatacaaaaattagcag

SEQ ID NO: 771020 - DNA, 22 bp, Artificial Sequence
  chemically synthesized
aaaatacaaaaattagcagggc

SEQ ID NO: 771021 - DNA, 22 bp, Artificial Sequence
  chemically synthesized
caggtgcccaccaccatgccct

SEQ ID NO: 771022 - DNA, 22 bp, Artificial Sequence
  chemically synthesized
ggattacaggtgcccaccacca

SEQ ID NO: 771023 - DNA, 22 bp, Artificial Sequence
  chemically synthesized
gcagggcatggtggtgggcacc

SEQ ID NO: 771024 - DNA, 22 bp, Artificial Sequence
  chemically synthesized
agtagctgggattacaggtgcc

SEQ ID NO: 771025 - DNA, 22 bp, Artificial Sequence
  chemically synthesized
ctgagtagctgggattacaggt

SEQ ID NO: 771026 - DNA, 22 bp, Artificial Sequence
  chemically synthesized
agcctcctgagtagctgggatt

SEQ ID NO: 771027 - DNA, 22 bp, Artificial Sequence
  chemically synthesized
cctcagcctcctgagtagctgg

SEQ ID NO: 771028 - DNA, 22 bp, Artificial Sequence
  chemically synthesized
ctgcctcagcctcctgagtagc

SEQ ID NO: 771029 - DNA, 22 bp, Artificial Sequence
  chemically synthesized
tcctgcctcagcctcctgagta

SEQ ID NO: 771030 - DNA, 22 bp, Artificial Sequence
  chemically synthesized
taatcccagctactcaggaggc

SEQ ID NO: 771031 - DNA, 22 bp, Artificial Sequence
  chemically synthesized
aagcgattctcctgcctcagcc

SEQ ID NO: 771032 - DNA, 22 bp, Artificial Sequence
  chemically synthesized
ctcaggaggctgaggcaggaga

SEQ ID NO: 771033 - DNA, 22 bp, Artificial Sequence
  chemically synthesized
aggaggctgaggcaggagaatc

SEQ ID NO: 771034 - DNA, 22 bp, Artificial Sequence
  chemically synthesized
ccgggttcaagcgattctcctg

SEQ ID NO: 771035 - DNA, 22 bp, Artificial Sequence
  chemically synthesized
cacctcccgggttcaagcgatt

SEQ ID NO: 771036 - DNA, 22 bp, Artificial Sequence
  chemically synthesized
aggcaggagaatcgcttgaacc

SEQ ID NO: 771037 - DNA, 22 bp, Artificial Sequence
  chemically synthesized
caacctccacctcccgggttca

SEQ ID NO: 771038 - DNA, 22 bp, Artificial Sequence
  chemically synthesized
actgcaacctccacctcccggg

SEQ ID NO: 771039 - DNA, 22 bp, Artificial Sequence
  chemically synthesized
ggctcactgcaacctccacctc

SEQ ID NO: 771040 - DNA, 22 bp, Artificial Sequence
  chemically synthesized
gaacccgggaggtggaggttgc

SEQ ID NO: 771041 - DNA, 22 bp, Artificial Sequence
  chemically synthesized
aacccgggaggtggaggttgca

SEQ ID NO: 771042 - DNA, 22 bp, Artificial Sequence
  chemically synthesized
cagtgcagtggtgcgatctcgg

SEQ ID NO: 771043 - DNA, 22 bp, Artificial Sequence
  chemically synthesized
cagtgagccgagatcgcaccac

SEQ ID NO: 771044 - DNA, 22 bp, Artificial Sequence
  chemically synthesized
tcacccaagctgcagtgcagtg

SEQ ID NO: 771045 - DNA, 22 bp, Artificial Sequence
  chemically synthesized
tgtcacccaagctgcagtgcag

SEQ ID NO: 771046 - DNA, 22 bp, Artificial Sequence
  chemically synthesized
gctctgtcacccaagctgcagt

SEQ ID NO: 771047 - DNA, 22 bp, Artificial Sequence
  chemically synthesized
cactgcagcttgggtgacagag

SEQ ID NO: 771048 - DNA, 22 bp, Artificial Sequence
  chemically synthesized
aaatggagtctcgctctgtcac

SEQ ID NO: 771049 - DNA, 22 bp, Artificial Sequence
  chemically synthesized
gaaatggagtctcgctctgtca

SEQ ID NO: 771050 - DNA, 22 bp, Artificial Sequence
  chemically synthesized
tgaaatggagtctcgctctgtc

SEQ ID NO: 771051 - DNA, 22 bp, Artificial Sequence
  chemically synthesized
ttgaaatggagtctcgctctgt

SEQ ID NO: 771052 - DNA, 22 bp, Artificial Sequence
  chemically synthesized
cagcttgggtgacagagcgaga

SEQ ID NO: 771053 - DNA, 22 bp, Artificial Sequence
  chemically synthesized
tttgaaatggagtctcgctctg

SEQ ID NO: 771054 - DNA, 22 bp, Artificial Sequence
  chemically synthesized
ttttgaaatggagtctcgctct

SEQ ID NO: 771055 - DNA, 22 bp, Artificial Sequence
  chemically synthesized
tttttgaaatggagtctcgctc

SEQ ID NO: 771056 - DNA, 22 bp, Artificial Sequence
  chemically synthesized
ttttttgaaatggagtctcgct

SEQ ID NO: 771057 - DNA, 22 bp, Artificial Sequence
  chemically synthesized
tttttttgaaatggagtctcgc

SEQ ID NO: 771058 - DNA, 22 bp, Artificial Sequence
  chemically synthesized
ttttttttgaaatggagtctcg

SEQ ID NO: 771059 - DNA, 22 bp, Artificial Sequence
  chemically synthesized
gggtgacagagcgagactccat

SEQ ID NO: 771060 - DNA, 22 bp, Artificial Sequence
  chemically synthesized
tttttttttgaaatggagtctc

SEQ ID NO: 771061 - DNA, 22 bp, Artificial Sequence
  chemically synthesized
ggtgacagagcgagactccatt

SEQ ID NO: 771062 - DNA, 22 bp, Artificial Sequence
  chemically synthesized
ttttttttttgaaatggagtct

SEQ ID NO: 771063 - DNA, 22 bp, Artificial Sequence
  chemically synthesized
tttttttttttgaaatggagtc

SEQ ID NO: 771064 - DNA, 22 bp, Artificial Sequence
  chemically synthesized
attttttttttttttgaaatgg

SEQ ID NO: 771065 - DNA, 22 bp, Artificial Sequence
  chemically synthesized
tgcccacctaattttttttttt

SEQ ID NO: 771066 - DNA, 22 bp, Artificial Sequence
  chemically synthesized
catttcaaaaaaaaaaaaaatt

SEQ ID NO: 771067 - DNA, 22 bp, Artificial Sequence
  chemically synthesized
caaaaaaaaaaaaaattaggtg

SEQ ID NO: 771068 - DNA, 22 bp, Artificial Sequence
  chemically synthesized
aaaaaaaaaaaaaattaggtgg

SEQ ID NO: 771069 - DNA, 22 bp, Artificial Sequence
  chemically synthesized
tgcaccactatgcccacctaat

SEQ ID NO: 771070 - DNA, 22 bp, Artificial Sequence
  chemically synthesized
tagctgtgcaccactatgccca

SEQ ID NO: 771071 - DNA, 22 bp, Artificial Sequence
  chemically synthesized
ggtgggcatagtggtgcacagc

SEQ ID NO: 771072 - DNA, 22 bp, Artificial Sequence
  chemically synthesized
agtagccaggattatagctgtg

SEQ ID NO: 771073 - DNA, 22 bp, Artificial Sequence
  chemically synthesized
ctgagtagccaggattatagct

SEQ ID NO: 771074 - DNA, 22 bp, Artificial Sequence
  chemically synthesized
agcctactgagtagccaggatt

SEQ ID NO: 771075 - DNA, 22 bp, Artificial Sequence
  chemically synthesized
cagcctactgagtagccaggat

SEQ ID NO: 771076 - DNA, 22 bp, Artificial Sequence
  chemically synthesized
cttcagcctactgagtagccag

SEQ ID NO: 771077 - DNA, 22 bp, Artificial Sequence
  chemically synthesized
ctccttcagcctactgagtagc

SEQ ID NO: 771078 - DNA, 22 bp, Artificial Sequence
  chemically synthesized
taatcctggctactcagtaggc

SEQ ID NO: 771079 - DNA, 22 bp, Artificial Sequence
  chemically synthesized
aagcaatcctcctccttcagcc

SEQ ID NO: 771080 - DNA, 22 bp, Artificial Sequence
  chemically synthesized
gctactcagtaggctgaaggag

SEQ ID NO: 771081 - DNA, 22 bp, Artificial Sequence
  chemically synthesized
ctcagtaggctgaaggaggagg

SEQ ID NO: 771082 - DNA, 22 bp, Artificial Sequence
  chemically synthesized
agctcaagcaatcctcctcctt

SEQ ID NO: 771083 - DNA, 22 bp, Artificial Sequence
  chemically synthesized
agtaggctgaaggaggaggatt

SEQ ID NO: 771084 - DNA, 22 bp, Artificial Sequence
  chemically synthesized
ctgagctcaagcaatcctcctc

SEQ ID NO: 771085 - DNA, 22 bp, Artificial Sequence
  chemically synthesized
aaactcctgagctcaagcaatc

SEQ ID NO: 771086 - DNA, 22 bp, Artificial Sequence
  chemically synthesized
aaggaggaggattgcttgagct

SEQ ID NO: 771087 - DNA, 22 bp, Artificial Sequence
  chemically synthesized
cagcctcaaactcctgagctca

SEQ ID NO: 771088 - DNA, 22 bp, Artificial Sequence
  chemically synthesized
actgcagcctcaaactcctgag

SEQ ID NO: 771089 - DNA, 22 bp, Artificial Sequence
  chemically synthesized
cttgagctcaggagtttgaggc

SEQ ID NO: 771090 - DNA, 22 bp, Artificial Sequence
  chemically synthesized
gagctcaggagtttgaggctgc

SEQ ID NO: 771091 - DNA, 22 bp, Artificial Sequence
  chemically synthesized
agctcaggagtttgaggctgca

SEQ ID NO: 771092 - DNA, 22 bp, Artificial Sequence
  chemically synthesized
aggagtttgaggctgcagtgag

SEQ ID NO: 771093 - DNA, 22 bp, Artificial Sequence
  chemically synthesized
gaggctgcagtgagctatgatc

SEQ ID NO: 771094 - DNA, 22 bp, Artificial Sequence
  chemically synthesized
aggctgcagtgagctatgatca

SEQ ID NO: 771095 - DNA, 22 bp, Artificial Sequence
  chemically synthesized
gagtggagtggcatgatcatag

SEQ ID NO: 771096 - DNA, 22 bp, Artificial Sequence
  chemically synthesized
cagtgagctatgatcatgccac

SEQ ID NO: 771097 - DNA, 22 bp, Artificial Sequence
  chemically synthesized
tcacccaggctggagtggagtg

SEQ ID NO: 771098 - DNA, 22 bp, Artificial Sequence
  chemically synthesized
tgtcacccaggctggagtggag

SEQ ID NO: 771099 - DNA, 22 bp, Artificial Sequence
  chemically synthesized
tgatcatgccactccactccag

SEQ ID NO: 771100 - DNA, 22 bp, Artificial Sequence
  chemically synthesized
ctctgtcacccaggctggagtg

SEQ ID NO: 771101 - DNA, 22 bp, Artificial Sequence
  chemically synthesized
gctctgtcacccaggctggagt

SEQ ID NO: 771102 - DNA, 22 bp, Artificial Sequence
  chemically synthesized
cactccagcctgggtgacagag

SEQ ID NO: 771103 - DNA, 22 bp, Artificial Sequence
  chemically synthesized
gagacagagtcttgctctgtca

SEQ ID NO: 771104 - DNA, 22 bp, Artificial Sequence
  chemically synthesized
agagacagagtcttgctctgtc

SEQ ID NO: 771105 - DNA, 22 bp, Artificial Sequence
  chemically synthesized
tagagacagagtcttgctctgt

SEQ ID NO: 771106 - DNA, 22 bp, Artificial Sequence
  chemically synthesized
cagcctgggtgacagagcaaga

SEQ ID NO: 771107 - DNA, 22 bp, Artificial Sequence
  chemically synthesized
ttttagagacagagtcttgctc

SEQ ID NO: 771108 - DNA, 22 bp, Artificial Sequence
  chemically synthesized
attttagagacagagtcttgct

SEQ ID NO: 771109 - DNA, 22 bp, Artificial Sequence
  chemically synthesized
tttattttagagacagagtctt

SEQ ID NO: 771110 - DNA, 22 bp, Artificial Sequence
  chemically synthesized
ggtgacagagcaagactctgtc

SEQ ID NO: 771111 - DNA, 22 bp, Artificial Sequence
  chemically synthesized
atttattttagagacagagtct

SEQ ID NO: 771112 - DNA, 22 bp, Artificial Sequence
  chemically synthesized
tatttattttagagacagagtc

SEQ ID NO: 771113 - DNA, 22 bp, Artificial Sequence
  chemically synthesized
ttttatttattttagagacaga

SEQ ID NO: 771114 - DNA, 22 bp, Artificial Sequence
  chemically synthesized
attttatttattttagagacag

SEQ ID NO: 771115 - DNA, 22 bp, Artificial Sequence
  chemically synthesized
tattttatttattttagagaca

SEQ ID NO: 771116 - DNA, 22 bp, Artificial Sequence
  chemically synthesized
ttttattttatttattttagag

SEQ ID NO: 771117 - DNA, 22 bp, Artificial Sequence
  chemically synthesized
attttattttatttattttaga

SEQ ID NO: 771118 - DNA, 22 bp, Artificial Sequence
  chemically synthesized
tattttattttatttattttag

SEQ ID NO: 771119 - DNA, 22 bp, Artificial Sequence
  chemically synthesized
ttttattttattttatttattt

SEQ ID NO: 771120 - DNA, 22 bp, Artificial Sequence
  chemically synthesized
attttattttattttatttatt

SEQ ID NO: 771121 - DNA, 22 bp, Artificial Sequence
  chemically synthesized
tattttattttattttatttat

SEQ ID NO: 771122 - DNA, 22 bp, Artificial Sequence
  chemically synthesized
tgtctctaaaataaataaaata

SEQ ID NO: 771123 - DNA, 22 bp, Artificial Sequence
  chemically synthesized
tctctaaaataaataaaataaa

SEQ ID NO: 771124 - DNA, 22 bp, Artificial Sequence
  chemically synthesized
tattttattttattttatttta

SEQ ID NO: 771125 - DNA, 22 bp, Artificial Sequence
  chemically synthesized
taaaataaataaaataaaataa

SEQ ID NO: 771126 - DNA, 22 bp, Artificial Sequence
  chemically synthesized
ctatattttattttattttatt

SEQ ID NO: 771127 - DNA, 22 bp, Artificial Sequence
  chemically synthesized
actatattttattttattttat

SEQ ID NO: 771128 - DNA, 22 bp, Artificial Sequence
  chemically synthesized
aaataaataaaataaaataaaa

SEQ ID NO: 771129 - DNA, 22 bp, Artificial Sequence
  chemically synthesized
tactatattttattttatttta

SEQ ID NO: 771130 - DNA, 22 bp, Artificial Sequence
  chemically synthesized
ctttactatattttattttatt

SEQ ID NO: 771131 - DNA, 22 bp, Artificial Sequence
  chemically synthesized
actttactatattttattttat

SEQ ID NO: 771132 - DNA, 22 bp, Artificial Sequence
  chemically synthesized
tactttactatattttatttta

SEQ ID NO: 771133 - DNA, 22 bp, Artificial Sequence
  chemically synthesized
ctttactttactatattttatt

SEQ ID NO: 771134 - DNA, 22 bp, Artificial Sequence
  chemically synthesized
tgttactttactttactatatt

SEQ ID NO: 771135 - DNA, 22 bp, Artificial Sequence
  chemically synthesized
gtgttactttactttactatat

SEQ ID NO: 771136 - DNA, 22 bp, Artificial Sequence
  chemically synthesized
ttgtgttactttactttactat

SEQ ID NO: 771137 - DNA, 22 bp, Artificial Sequence
  chemically synthesized
ttcttgtgttactttactttac

SEQ ID NO: 771138 - DNA, 22 bp, Artificial Sequence
  chemically synthesized
ttattcttgtgttactttactt

SEQ ID NO: 771139 - DNA, 22 bp, Artificial Sequence
  chemically synthesized
tccctgttattcttgtgttact

SEQ ID NO: 771140 - DNA, 22 bp, Artificial Sequence
  chemically synthesized
atccctgttattcttgtgttac

SEQ ID NO: 771141 - DNA, 22 bp, Artificial Sequence
  chemically synthesized
tcccagtttatccctgttattc

SEQ ID NO: 771142 - DNA, 22 bp, Artificial Sequence
  chemically synthesized
cggctgtcccagtttatccctg

SEQ ID NO: 771143 - DNA, 22 bp, Artificial Sequence
  chemically synthesized
tctccggctgtcccagtttatc

SEQ ID NO: 771144 - DNA, 22 bp, Artificial Sequence
  chemically synthesized
gtctccggctgtcccagtttat

SEQ ID NO: 771145 - DNA, 22 bp, Artificial Sequence
  chemically synthesized
atttgtctccggctgtcccagt

SEQ ID NO: 771146 - DNA, 22 bp, Artificial Sequence
  chemically synthesized
tcctaatttgtctccggctgtc

SEQ ID NO: 771147 - DNA, 22 bp, Artificial Sequence
  chemically synthesized
atctatcctaatttgtctccgg

SEQ ID NO: 771148 - DNA, 22 bp, Artificial Sequence
  chemically synthesized
ggacagccggagacaaattagg

SEQ ID NO: 771149 - DNA, 22 bp, Artificial Sequence
  chemically synthesized
taggttcatctatcctaatttg

SEQ ID NO: 771150 - DNA, 22 bp, Artificial Sequence
  chemically synthesized
ctataggttcatctatcctaat

SEQ ID NO: 771151 - DNA, 22 bp, Artificial Sequence
  chemically synthesized
actgctataggttcatctatcc

SEQ ID NO: 771152 - DNA, 22 bp, Artificial Sequence
  chemically synthesized
ttgactgctataggttcatcta

SEQ ID NO: 771153 - DNA, 22 bp, Artificial Sequence
  chemically synthesized
attgactgctataggttcatct

SEQ ID NO: 771154 - DNA, 22 bp, Artificial Sequence
  chemically synthesized
tattgactgctataggttcatc

SEQ ID NO: 771155 - DNA, 22 bp, Artificial Sequence
  chemically synthesized
ggatagatgaacctatagcagt

SEQ ID NO: 771156 - DNA, 22 bp, Artificial Sequence
  chemically synthesized
cccattttattgactgctatag

SEQ ID NO: 771157 - DNA, 22 bp, Artificial Sequence
  chemically synthesized
gcccattttattgactgctata

SEQ ID NO: 771158 - DNA, 22 bp, Artificial Sequence
  chemically synthesized
tgcccattttattgactgctat

SEQ ID NO: 771159 - DNA, 22 bp, Artificial Sequence
  chemically synthesized
ttgcccattttattgactgcta

SEQ ID NO: 771160 - DNA, 22 bp, Artificial Sequence
  chemically synthesized
agacccttttgcccattttatt

SEQ ID NO: 771161 - DNA, 22 bp, Artificial Sequence
  chemically synthesized
ctgagacccttttgcccatttt

SEQ ID NO: 771162 - DNA, 22 bp, Artificial Sequence
  chemically synthesized
tagcagtcaataaaatgggcaa

SEQ ID NO: 771163 - DNA, 22 bp, Artificial Sequence
  chemically synthesized
ctactgagacccttttgcccat

SEQ ID NO: 771164 - DNA, 22 bp, Artificial Sequence
  chemically synthesized
ctgctactgagacccttttgcc

SEQ ID NO: 771165 - DNA, 22 bp, Artificial Sequence
  chemically synthesized
tgctgctactgagacccttttg

SEQ ID NO: 771166 - DNA, 22 bp, Artificial Sequence
  chemically synthesized
cctctgctgctactgagaccct

SEQ ID NO: 771167 - DNA, 22 bp, Artificial Sequence
  chemically synthesized
agtagcagcagaggcagccttt

SEQ ID NO: 771168 - DNA, 22 bp, Artificial Sequence
  chemically synthesized
gagagaatgagcgggaagaaag

SEQ ID NO: 771169 - DNA, 22 bp, Artificial Sequence
  chemically synthesized
ggagagaatgagcgggaagaaa

SEQ ID NO: 771170 - DNA, 22 bp, Artificial Sequence
  chemically synthesized
cttggagagaatgagcgggaag

SEQ ID NO: 771171 - DNA, 22 bp, Artificial Sequence
  chemically synthesized
ttacttggagagaatgagcggg

SEQ ID NO: 771172 - DNA, 22 bp, Artificial Sequence
  chemically synthesized
gttacttggagagaatgagcgg

SEQ ID NO: 771173 - DNA, 22 bp, Artificial Sequence
  chemically synthesized
tgttacttggagagaatgagcg

SEQ ID NO: 771174 - DNA, 22 bp, Artificial Sequence
  chemically synthesized
ttgttacttggagagaatgagc

SEQ ID NO: 771175 - DNA, 22 bp, Artificial Sequence
  chemically synthesized
tcttcccgctcattctctccaa

SEQ ID NO: 771176 - DNA, 22 bp, Artificial Sequence
  chemically synthesized
cttcccgctcattctctccaag

SEQ ID NO: 771177 - DNA, 22 bp, Artificial Sequence
  chemically synthesized
ttcccgctcattctctccaagt

SEQ ID NO: 771178 - DNA, 22 bp, Artificial Sequence
  chemically synthesized
cccgctcattctctccaagtaa

SEQ ID NO: 771179 - DNA, 22 bp, Artificial Sequence
  chemically synthesized
ccgctcattctctccaagtaac

SEQ ID NO: 771180 - DNA, 22 bp, Artificial Sequence
  chemically synthesized
attctctccaagtaacaaaagg

SEQ ID NO: 771181 - DNA, 22 bp, Artificial Sequence
  chemically synthesized
tctccaagtaacaaaaggtctg

SEQ ID NO: 771182 - DNA, 22 bp, Artificial Sequence
  chemically synthesized
tccaagtaacaaaaggtctgtg

SEQ ID NO: 771183 - DNA, 22 bp, Artificial Sequence
  chemically synthesized
caagtaacaaaaggtctgtgac

SEQ ID NO: 771184 - DNA, 22 bp, Artificial Sequence
  chemically synthesized
tgacacgacgttctctttctgc

SEQ ID NO: 771185 - DNA, 22 bp, Artificial Sequence
  chemically synthesized
cgtgcagtgaaccccaggcaga

SEQ ID NO: 771186 - DNA, 22 bp, Artificial Sequence
  chemically synthesized
actgcgtgcagtgaaccccagg

SEQ ID NO: 771187 - DNA, 22 bp, Artificial Sequence
  chemically synthesized
tctttctgcctggggttcactg

SEQ ID NO: 771188 - DNA, 22 bp, Artificial Sequence
  chemically synthesized
tttctgcctggggttcactgca

SEQ ID NO: 771189 - DNA, 22 bp, Artificial Sequence
  chemically synthesized
tctgcctggggttcactgcacg

SEQ ID NO: 771190 - DNA, 22 bp, Artificial Sequence
  chemically synthesized
ctgcctggggttcactgcacgc

SEQ ID NO: 771191 - DNA, 22 bp, Artificial Sequence
  chemically synthesized
tgcctggggttcactgcacgca

SEQ ID NO: 771192 - DNA, 22 bp, Artificial Sequence
  chemically synthesized
cctggggttcactgcacgcagt

SEQ ID NO: 771193 - DNA, 22 bp, Artificial Sequence
  chemically synthesized
gggttcactgcacgcagtgaat

SEQ ID NO: 771194 - DNA, 22 bp, Artificial Sequence
  chemically synthesized
actgcacgcagtgaattgatca

SEQ ID NO: 771195 - DNA, 22 bp, Artificial Sequence
  chemically synthesized
cacgcagtgaattgatcactgc

SEQ ID NO: 771196 - DNA, 22 bp, Artificial Sequence
  chemically synthesized
aatgtaagaaacaggtgcagtg

SEQ ID NO: 771197 - DNA, 22 bp, Artificial Sequence
  chemically synthesized
cctgaatgtaagaaacaggtgc

SEQ ID NO: 771198 - DNA, 22 bp, Artificial Sequence
  chemically synthesized
cgttccctgaatgtaagaaaca

SEQ ID NO: 771199 - DNA, 22 bp, Artificial Sequence
  chemically synthesized
atcactgcacctgtttcttaca

SEQ ID NO: 771200 - DNA, 22 bp, Artificial Sequence
  chemically synthesized
ccgttccctgaatgtaagaaac

SEQ ID NO: 771201 - DNA, 22 bp, Artificial Sequence
  chemically synthesized
tccgttccctgaatgtaagaaa

SEQ ID NO: 771202 - DNA, 22 bp, Artificial Sequence
  chemically synthesized
ctttccgttccctgaatgtaag

SEQ ID NO: 771203 - DNA, 22 bp, Artificial Sequence
  chemically synthesized
tgctttccgttccctgaatgta

SEQ ID NO: 771204 - DNA, 22 bp, Artificial Sequence
  chemically synthesized
cacctgtttcttacattcaggg

SEQ ID NO: 771205 - DNA, 22 bp, Artificial Sequence
  chemically synthesized
tctgctttccgttccctgaatg

SEQ ID NO: 771206 - DNA, 22 bp, Artificial Sequence
  chemically synthesized
ctctgctttccgttccctgaat

SEQ ID NO: 771207 - DNA, 22 bp, Artificial Sequence
  chemically synthesized
tctctgctttccgttccctgaa

SEQ ID NO: 771208 - DNA, 22 bp, Artificial Sequence
  chemically synthesized
tttcttacattcagggaacgga

SEQ ID NO: 771209 - DNA, 22 bp, Artificial Sequence
  chemically synthesized
gcctttctctgctttccgttcc

SEQ ID NO: 771210 - DNA, 22 bp, Artificial Sequence
  chemically synthesized
cttacattcagggaacggaaag

SEQ ID NO: 771211 - DNA, 22 bp, Artificial Sequence
  chemically synthesized
ttacattcagggaacggaaagc

SEQ ID NO: 771212 - DNA, 22 bp, Artificial Sequence
  chemically synthesized
acattcagggaacggaaagcag

SEQ ID NO: 771213 - DNA, 22 bp, Artificial Sequence
  chemically synthesized
cattcagggaacggaaagcaga

SEQ ID NO: 771214 - DNA, 22 bp, Artificial Sequence
  chemically synthesized
agggaacggaaagcagagaaag

SEQ ID NO: 771215 - DNA, 22 bp, Artificial Sequence
  chemically synthesized
ggtgcacaaacagtggtgtgaa

SEQ ID NO: 771216 - DNA, 22 bp, Artificial Sequence
  chemically synthesized
acaccactgtttgtgcacccag

SEQ ID NO: 771217 - DNA, 22 bp, Artificial Sequence
  chemically synthesized
cccacggtgagagggcacctgg

SEQ ID NO: 771218 - DNA, 22 bp, Artificial Sequence
  chemically synthesized
tttgtgcacccaggtgccctct

SEQ ID NO: 771219 - DNA, 22 bp, Artificial Sequence
  chemically synthesized
ctccccacggtgagagggcacc

SEQ ID NO: 771220 - DNA, 22 bp, Artificial Sequence
  chemically synthesized
actccccacggtgagagggcac

SEQ ID NO: 771221 - DNA, 22 bp, Artificial Sequence
  chemically synthesized
gtgcacccaggtgccctctcac

SEQ ID NO: 771222 - DNA, 22 bp, Artificial Sequence
  chemically synthesized
tgcacccaggtgccctctcacc

SEQ ID NO: 771223 - DNA, 22 bp, Artificial Sequence
  chemically synthesized
tcaccgtggggagtaaacacct

SEQ ID NO: 771224 - DNA, 22 bp, Artificial Sequence
  chemically synthesized
accgtggggagtaaacaccttc

SEQ ID NO: 771225 - DNA, 22 bp, Artificial Sequence
  chemically synthesized
cgtagcaaacagaaccgaaggt

SEQ ID NO: 771226 - DNA, 22 bp, Artificial Sequence
  chemically synthesized
ccgtagcaaacagaaccgaagg

SEQ ID NO: 771227 - DNA, 22 bp, Artificial Sequence
  chemically synthesized
tccgtagcaaacagaaccgaag

SEQ ID NO: 771228 - DNA, 22 bp, Artificial Sequence
  chemically synthesized
ttccgtagcaaacagaaccgaa

SEQ ID NO: 771229 - DNA, 22 bp, Artificial Sequence
  chemically synthesized
ttttccgtagcaaacagaaccg

SEQ ID NO: 771230 - DNA, 22 bp, Artificial Sequence
  chemically synthesized
cttttccgtagcaaacagaacc

SEQ ID NO: 771231 - DNA, 22 bp, Artificial Sequence
  chemically synthesized
tcttttccgtagcaaacagaac

SEQ ID NO: 771232 - DNA, 22 bp, Artificial Sequence
  chemically synthesized
ttcttttccgtagcaaacagaa

SEQ ID NO: 771233 - DNA, 22 bp, Artificial Sequence
  chemically synthesized
atttttcttttccgtagcaaac

SEQ ID NO: 771234 - DNA, 22 bp, Artificial Sequence
  chemically synthesized
catttttcttttccgtagcaaa

SEQ ID NO: 771235 - DNA, 22 bp, Artificial Sequence
  chemically synthesized
tcatttttcttttccgtagcaa

SEQ ID NO: 771236 - DNA, 22 bp, Artificial Sequence
  chemically synthesized
ttcatttttcttttccgtagca

SEQ ID NO: 771237 - DNA, 22 bp, Artificial Sequence
  chemically synthesized
cggttctgtttgctacggaaaa

SEQ ID NO: 771238 - DNA, 22 bp, Artificial Sequence
  chemically synthesized
ttttcatttttcttttccgtag

SEQ ID NO: 771239 - DNA, 22 bp, Artificial Sequence
  chemically synthesized
ggttctgtttgctacggaaaag

SEQ ID NO: 771240 - DNA, 22 bp, Artificial Sequence
  chemically synthesized
tgtttgctacggaaaagaaaaa

SEQ ID NO: 771241 - DNA, 22 bp, Artificial Sequence
  chemically synthesized
gccctcttttcatttttctttt

SEQ ID NO: 771242 - DNA, 22 bp, Artificial Sequence
  chemically synthesized
tttgctacggaaaagaaaaatg

SEQ ID NO: 771243 - DNA, 22 bp, Artificial Sequence
  chemically synthesized
ttggccctcttttcatttttct

SEQ ID NO: 771244 - DNA, 22 bp, Artificial Sequence
  chemically synthesized
gctacggaaaagaaaaatgaaa

SEQ ID NO: 771245 - DNA, 22 bp, Artificial Sequence
  chemically synthesized
ctacggaaaagaaaaatgaaaa

SEQ ID NO: 771246 - DNA, 22 bp, Artificial Sequence
  chemically synthesized
ttattggccctcttttcatttt

SEQ ID NO: 771247 - DNA, 22 bp, Artificial Sequence
  chemically synthesized
gttattggccctcttttcattt

SEQ ID NO: 771248 - DNA, 22 bp, Artificial Sequence
  chemically synthesized
tgttattggccctcttttcatt

SEQ ID NO: 771249 - DNA, 22 bp, Artificial Sequence
  chemically synthesized
cggaaaagaaaaatgaaaagag

SEQ ID NO: 771250 - DNA, 22 bp, Artificial Sequence
  chemically synthesized
aagggcattttgttattggccc

SEQ ID NO: 771251 - DNA, 22 bp, Artificial Sequence
  chemically synthesized
gaagggcattttgttattggcc

SEQ ID NO: 771252 - DNA, 22 bp, Artificial Sequence
  chemically synthesized
tgaagggcattttgttattggc

SEQ ID NO: 771253 - DNA, 22 bp, Artificial Sequence
  chemically synthesized
tttgaagggcattttgttattg

SEQ ID NO: 771254 - DNA, 22 bp, Artificial Sequence
  chemically synthesized
ctttgaagggcattttgttatt

SEQ ID NO: 771255 - DNA, 22 bp, Artificial Sequence
  chemically synthesized
tctttgaagggcattttgttat

SEQ ID NO: 771256 - DNA, 22 bp, Artificial Sequence
  chemically synthesized
acaaagtgttttctttgaaggg

SEQ ID NO: 771257 - DNA, 22 bp, Artificial Sequence
  chemically synthesized
cacacaggctcacaaagtgttt

SEQ ID NO: 771258 - DNA, 22 bp, Artificial Sequence
  chemically synthesized
ctacacacaggctcacaaagtg

SEQ ID NO: 771259 - DNA, 22 bp, Artificial Sequence
  chemically synthesized
gctacacacaggctcacaaagt

SEQ ID NO: 771260 - DNA, 22 bp, Artificial Sequence
  chemically synthesized
tgctacacacaggctcacaaag

SEQ ID NO: 771261 - DNA, 22 bp, Artificial Sequence
  chemically synthesized
caaagaaaacactttgtgagcc

SEQ ID NO: 771262 - DNA, 22 bp, Artificial Sequence
  chemically synthesized
aaagaaaacactttgtgagcct

SEQ ID NO: 771263 - DNA, 22 bp, Artificial Sequence
  chemically synthesized
tctttgctacacacaggctcac

SEQ ID NO: 771264 - DNA, 22 bp, Artificial Sequence
  chemically synthesized
atctttgctacacacaggctca

SEQ ID NO: 771265 - DNA, 22 bp, Artificial Sequence
  chemically synthesized
ttatctttgctacacacaggct

SEQ ID NO: 771266 - DNA, 22 bp, Artificial Sequence
  chemically synthesized
gttcttatctttgctacacaca

SEQ ID NO: 771267 - DNA, 22 bp, Artificial Sequence
  chemically synthesized
tgtgagcctgtgtgtagcaaag

SEQ ID NO: 771268 - DNA, 22 bp, Artificial Sequence
  chemically synthesized
gtgagcctgtgtgtagcaaaga

SEQ ID NO: 771269 - DNA, 22 bp, Artificial Sequence
  chemically synthesized
tgagcctgtgtgtagcaaagat

SEQ ID NO: 771270 - DNA, 22 bp, Artificial Sequence
  chemically synthesized
tgtgtagcaaagataagaacta

SEQ ID NO: 771271 - DNA, 22 bp, Artificial Sequence
  chemically synthesized
atgacagtgtcctagttcttat

SEQ ID NO: 771272 - DNA, 22 bp, Artificial Sequence
  chemically synthesized
tcatgacagtgtcctagttctt

SEQ ID NO: 771273 - DNA, 22 bp, Artificial Sequence
  chemically synthesized
ctcatgacagtgtcctagttct

SEQ ID NO: 771274 - DNA, 22 bp, Artificial Sequence
  chemically synthesized
tctcatgacagtgtcctagttc

SEQ ID NO: 771275 - DNA, 22 bp, Artificial Sequence
  chemically synthesized
ggatctttctcatgacagtgtc

SEQ ID NO: 771276 - DNA, 22 bp, Artificial Sequence
  chemically synthesized
taggatctttctcatgacagtg

SEQ ID NO: 771277 - DNA, 22 bp, Artificial Sequence
  chemically synthesized
ttctaggatctttctcatgaca

SEQ ID NO: 771278 - DNA, 22 bp, Artificial Sequence
  chemically synthesized
ggacactgtcatgagaaagatc

SEQ ID NO: 771279 - DNA, 22 bp, Artificial Sequence
  chemically synthesized
aagaagctattctaggatcttt

SEQ ID NO: 771280 - DNA, 22 bp, Artificial Sequence
  chemically synthesized
caagaagctattctaggatctt

SEQ ID NO: 771281 - DNA, 22 bp, Artificial Sequence
  chemically synthesized
tcaagaagctattctaggatct

SEQ ID NO: 771282 - DNA, 22 bp, Artificial Sequence
  chemically synthesized
tttcaagaagctattctaggat

SEQ ID NO: 771283 - DNA, 22 bp, Artificial Sequence
  chemically synthesized
tcatgagaaagatcctagaata

SEQ ID NO: 771284 - DNA, 22 bp, Artificial Sequence
  chemically synthesized
ctttcaagaagctattctagga

SEQ ID NO: 771285 - DNA, 22 bp, Artificial Sequence
  chemically synthesized
tctttcaagaagctattctagg

SEQ ID NO: 771286 - DNA, 22 bp, Artificial Sequence
  chemically synthesized
aagaaatctttctttcaagaag

SEQ ID NO: 771287 - DNA, 22 bp, Artificial Sequence
  chemically synthesized
aaagaaatctttctttcaagaa

SEQ ID NO: 771288 - DNA, 22 bp, Artificial Sequence
  chemically synthesized
taaagaaatctttctttcaaga

SEQ ID NO: 771289 - DNA, 22 bp, Artificial Sequence
  chemically synthesized
ttaaagaaatctttctttcaag

SEQ ID NO: 771290 - DNA, 22 bp, Artificial Sequence
  chemically synthesized
tttaaagaaatctttctttcaa

SEQ ID NO: 771291 - DNA, 22 bp, Artificial Sequence
  chemically synthesized
ttttaaagaaatctttctttca

SEQ ID NO: 771292 - DNA, 22 bp, Artificial Sequence
  chemically synthesized
gaatagcttcttgaaagaaaga

SEQ ID NO: 771293 - DNA, 22 bp, Artificial Sequence
  chemically synthesized
tttttaaagaaatctttctttc

SEQ ID NO: 771294 - DNA, 22 bp, Artificial Sequence
  chemically synthesized
ttttttaaagaaatctttcttt

SEQ ID NO: 771295 - DNA, 22 bp, Artificial Sequence
  chemically synthesized
tttttttaaagaaatctttctt

SEQ ID NO: 771296 - DNA, 22 bp, Artificial Sequence
  chemically synthesized
ttttttttaaagaaatctttct

SEQ ID NO: 771297 - DNA, 22 bp, Artificial Sequence
  chemically synthesized
tttttttttaaagaaatctttc

SEQ ID NO: 771298 - DNA, 22 bp, Artificial Sequence
  chemically synthesized
ttttttttttaaagaaatcttt

SEQ ID NO: 771299 - DNA, 22 bp, Artificial Sequence
  chemically synthesized
tttttttttttaaagaaatctt

SEQ ID NO: 771300 - DNA, 22 bp, Artificial Sequence
  chemically synthesized
ttttttttttttaaagaaatct

SEQ ID NO: 771301 - DNA, 22 bp, Artificial Sequence
  chemically synthesized
tttttttttttttaaagaaatc

SEQ ID NO: 771302 - DNA, 22 bp, Artificial Sequence
  chemically synthesized
cttgaaagaaagatttctttaa

SEQ ID NO: 771303 - DNA, 22 bp, Artificial Sequence
  chemically synthesized
ttgaaagaaagatttctttaaa

SEQ ID NO: 771304 - DNA, 22 bp, Artificial Sequence
  chemically synthesized
tttttttttttttttaaagaaa

SEQ ID NO: 771305 - DNA, 22 bp, Artificial Sequence
  chemically synthesized
gaaagaaagatttctttaaaaa

SEQ ID NO: 771306 - DNA, 22 bp, Artificial Sequence
  chemically synthesized
aaagaaagatttctttaaaaaa

SEQ ID NO: 771307 - DNA, 22 bp, Artificial Sequence
  chemically synthesized
gcattcttttttttttttttta

SEQ ID NO: 771308 - DNA, 22 bp, Artificial Sequence
  chemically synthesized
actcgcattctttttttttttt

SEQ ID NO: 771309 - DNA, 22 bp, Artificial Sequence
  chemically synthesized
ctttaaaaaaaaaaaaaaagaa

SEQ ID NO: 771310 - DNA, 22 bp, Artificial Sequence
  chemically synthesized
tttaaaaaaaaaaaaaaagaat

SEQ ID NO: 771311 - DNA, 22 bp, Artificial Sequence
  chemically synthesized
taaaaaaaaaaaaaaagaatgc

SEQ ID NO: 771312 - DNA, 22 bp, Artificial Sequence
  chemically synthesized
aaaaaaaaaaaaaaagaatgcg

SEQ ID NO: 771313 - DNA, 22 bp, Artificial Sequence
  chemically synthesized
aaaaaaaaaaaaaagaatgcga

SEQ ID NO: 771314 - DNA, 22 bp, Artificial Sequence
  chemically synthesized
ctacgacatctattgtgtatta

SEQ ID NO: 771315 - DNA, 22 bp, Artificial Sequence
  chemically synthesized
cgacatctattgtgtattatct

SEQ ID NO: 771316 - DNA, 22 bp, Artificial Sequence
  chemically synthesized
agagggatatggcagataatac

SEQ ID NO: 771317 - DNA, 22 bp, Artificial Sequence
  chemically synthesized
ctaagagggatatggcagataa

SEQ ID NO: 771318 - DNA, 22 bp, Artificial Sequence
  chemically synthesized
gctaagagggatatggcagata

SEQ ID NO: 771319 - DNA, 22 bp, Artificial Sequence
  chemically synthesized
ttgtgtattatctgccatatcc

SEQ ID NO: 771320 - DNA, 22 bp, Artificial Sequence
  chemically synthesized
tgtattatctgccatatccctc

SEQ ID NO: 771321 - DNA, 22 bp, Artificial Sequence
  chemically synthesized
atcgtcatttgctaagagggat

SEQ ID NO: 771322 - DNA, 22 bp, Artificial Sequence
  chemically synthesized
aatcgtcatttgctaagaggga

SEQ ID NO: 771323 - DNA, 22 bp, Artificial Sequence
  chemically synthesized
taatcgtcatttgctaagaggg

SEQ ID NO: 771324 - DNA, 22 bp, Artificial Sequence
  chemically synthesized
tctgccatatccctcttagcaa

SEQ ID NO: 771325 - DNA, 22 bp, Artificial Sequence
  chemically synthesized
ccatatccctcttagcaaatga

SEQ ID NO: 771326 - DNA, 22 bp, Artificial Sequence
  chemically synthesized
ttagcaaatgacgattaaagtt

SEQ ID NO: 771327 - DNA, 22 bp, Artificial Sequence
  chemically synthesized
agcaaatgacgattaaagtttc

SEQ ID NO: 771328 - DNA, 22 bp, Artificial Sequence
  chemically synthesized
ccgacagatgcagaaactttaa

SEQ ID NO: 771329 - DNA, 22 bp, Artificial Sequence
  chemically synthesized
gcaaatgacgattaaagtttct

SEQ ID NO: 771330 - DNA, 22 bp, Artificial Sequence
  chemically synthesized
cattaccgacagatgcagaaac

SEQ ID NO: 771331 - DNA, 22 bp, Artificial Sequence
  chemically synthesized
gcattaccgacagatgcagaaa

SEQ ID NO: 771332 - DNA, 22 bp, Artificial Sequence
  chemically synthesized
ccgtttgcattaccgacagatg

SEQ ID NO: 771333 - DNA, 22 bp, Artificial Sequence
  chemically synthesized
cccgtttgcattaccgacagat

SEQ ID NO: 771334 - DNA, 22 bp, Artificial Sequence
  chemically synthesized
tcccgtttgcattaccgacaga

SEQ ID NO: 771335 - DNA, 22 bp, Artificial Sequence
  chemically synthesized
aagtttctgcatctgtcggtaa

SEQ ID NO: 771336 - DNA, 22 bp, Artificial Sequence
  chemically synthesized
tttcccgtttgcattaccgaca

SEQ ID NO: 771337 - DNA, 22 bp, Artificial Sequence
  chemically synthesized
ctgcatctgtcggtaatgcaaa

SEQ ID NO: 771338 - DNA, 22 bp, Artificial Sequence
  chemically synthesized
tgcatctgtcggtaatgcaaac

SEQ ID NO: 771339 - DNA, 22 bp, Artificial Sequence
  chemically synthesized
catctgtcggtaatgcaaacgg

SEQ ID NO: 771340 - DNA, 22 bp, Artificial Sequence
  chemically synthesized
tcggtaatgcaaacgggaaaga

SEQ ID NO: 771341 - DNA, 22 bp, Artificial Sequence
  chemically synthesized
aggaaagtgaattctttcccgt

SEQ ID NO: 771342 - DNA, 22 bp, Artificial Sequence
  chemically synthesized
caggaaagtgaattctttcccg

SEQ ID NO: 771343 - DNA, 22 bp, Artificial Sequence
  chemically synthesized
aagtaaatttcaggaaagtgaa

SEQ ID NO: 771344 - DNA, 22 bp, Artificial Sequence
  chemically synthesized
aaagtaaatttcaggaaagtga

SEQ ID NO: 771345 - DNA, 22 bp, Artificial Sequence
  chemically synthesized
actttcctgaaatttactttaa

SEQ ID NO: 771346 - DNA, 22 bp, Artificial Sequence
  chemically synthesized
cgtaaaggaaaatttaaagtaa

SEQ ID NO: 771347 - DNA, 22 bp, Artificial Sequence
  chemically synthesized
tccgtaaaggaaaatttaaagt

SEQ ID NO: 771348 - DNA, 22 bp, Artificial Sequence
  chemically synthesized
tcctgaaatttactttaaattt

SEQ ID NO: 771349 - DNA, 22 bp, Artificial Sequence
  chemically synthesized
ctccgtaaaggaaaatttaaag

SEQ ID NO: 771350 - DNA, 22 bp, Artificial Sequence
  chemically synthesized
cctgaaatttactttaaatttt

SEQ ID NO: 771351 - DNA, 22 bp, Artificial Sequence
  chemically synthesized
ctgaaatttactttaaattttc

SEQ ID NO: 771352 - DNA, 22 bp, Artificial Sequence
  chemically synthesized
aaatttactttaaattttcctt

SEQ ID NO: 771353 - DNA, 22 bp, Artificial Sequence
  chemically synthesized
actttaaattttcctttacgga

SEQ ID NO: 771354 - DNA, 22 bp, Artificial Sequence
  chemically synthesized
ctttaaattttcctttacggag

SEQ ID NO: 771355 - DNA, 22 bp, Artificial Sequence
  chemically synthesized
taaattttcctttacggagaaa

SEQ ID NO: 771356 - DNA, 22 bp, Artificial Sequence
  chemically synthesized
aaattttcctttacggagaaat

SEQ ID NO: 771357 - DNA, 22 bp, Artificial Sequence
  chemically synthesized
aattttcctttacggagaaatg

SEQ ID NO: 771358 - DNA, 22 bp, Artificial Sequence
  chemically synthesized
tcctttacggagaaatgattca

SEQ ID NO: 771359 - DNA, 22 bp, Artificial Sequence
  chemically synthesized
cctttacggagaaatgattcat

SEQ ID NO: 771360 - DNA, 22 bp, Artificial Sequence
  chemically synthesized
ctttacggagaaatgattcatt

SEQ ID NO: 771361 - DNA, 22 bp, Artificial Sequence
  chemically synthesized
tacggagaaatgattcattccc

SEQ ID NO: 771362 - DNA, 22 bp, Artificial Sequence
  chemically synthesized
acggagaaatgattcattcccc

SEQ ID NO: 771363 - DNA, 22 bp, Artificial Sequence
  chemically synthesized
cggagaaatgattcattccccc

SEQ ID NO: 771364 - DNA, 22 bp, Artificial Sequence
  chemically synthesized
catatcaggtatgaaatacagg

SEQ ID NO: 771365 - DNA, 22 bp, Artificial Sequence
  chemically synthesized
tattacatatcaggtatgaaat

SEQ ID NO: 771366 - DNA, 22 bp, Artificial Sequence
  chemically synthesized
attccccctgtatttcatacct

SEQ ID NO: 771367 - DNA, 22 bp, Artificial Sequence
  chemically synthesized
cccctgtatttcatacctgata

SEQ ID NO: 771368 - DNA, 22 bp, Artificial Sequence
  chemically synthesized
tatttcatacctgatatgtaat

SEQ ID NO: 771369 - DNA, 22 bp, Artificial Sequence
  chemically synthesized
aacataaaatctgtattacata

SEQ ID NO: 771370 - DNA, 22 bp, Artificial Sequence
  chemically synthesized
aaacataaaatctgtattacat

SEQ ID NO: 771371 - DNA, 22 bp, Artificial Sequence
  chemically synthesized
taaacataaaatctgtattaca

SEQ ID NO: 771372 - DNA, 22 bp, Artificial Sequence
  chemically synthesized
catacctgatatgtaatacaga

SEQ ID NO: 771373 - DNA, 22 bp, Artificial Sequence
  chemically synthesized
ttaaacataaaatctgtattac

SEQ ID NO: 771374 - DNA, 22 bp, Artificial Sequence
  chemically synthesized
atacctgatatgtaatacagat

SEQ ID NO: 771375 - DNA, 22 bp, Artificial Sequence
  chemically synthesized
tttaaacataaaatctgtatta

SEQ ID NO: 771376 - DNA, 22 bp, Artificial Sequence
  chemically synthesized
ttttaaacataaaatctgtatt

SEQ ID NO: 771377 - DNA, 22 bp, Artificial Sequence
  chemically synthesized
atatgtaatacagattttatgt

SEQ ID NO: 771378 - DNA, 22 bp, Artificial Sequence
  chemically synthesized
tatgtttaaaaaaatggctttg

SEQ ID NO: 771379 - DNA, 22 bp, Artificial Sequence
  chemically synthesized
atgtttaaaaaaatggctttgt

SEQ ID NO: 771380 - DNA, 22 bp, Artificial Sequence
  chemically synthesized
tgtttaaaaaaatggctttgtg

SEQ ID NO: 771381 - DNA, 22 bp, Artificial Sequence
  chemically synthesized
gtatgggagccccacaaagcca

SEQ ID NO: 771382 - DNA, 22 bp, Artificial Sequence
  chemically synthesized
gttagtatgggagccccacaaa

SEQ ID NO: 771383 - DNA, 22 bp, Artificial Sequence
  chemically synthesized
aaaaaaatggctttgtggggct

SEQ ID NO: 771384 - DNA, 22 bp, Artificial Sequence
  chemically synthesized
ggttagtatgggagccccacaa

SEQ ID NO: 771385 - DNA, 22 bp, Artificial Sequence
  chemically synthesized
aaaaaatggctttgtggggctc

SEQ ID NO: 771386 - DNA, 22 bp, Artificial Sequence
  chemically synthesized
tggttagtatgggagccccaca

SEQ ID NO: 771387 - DNA, 22 bp, Artificial Sequence
  chemically synthesized
ttggttagtatgggagccccac

SEQ ID NO: 771388 - DNA, 22 bp, Artificial Sequence
  chemically synthesized
tgtggggctcccatactaacca

SEQ ID NO: 771389 - DNA, 22 bp, Artificial Sequence
  chemically synthesized
ggaagaaatttttggttagtat

SEQ ID NO: 771390 - DNA, 22 bp, Artificial Sequence
  chemically synthesized
gtggggctcccatactaaccaa

SEQ ID NO: 771391 - DNA, 22 bp, Artificial Sequence
  chemically synthesized
tggggctcccatactaaccaaa

SEQ ID NO: 771392 - DNA, 22 bp, Artificial Sequence
  chemically synthesized
ccatactaaccaaaaatttctt

SEQ ID NO: 771393 - DNA, 22 bp, Artificial Sequence
  chemically synthesized
gaaatgtctaggaagaaatttt

SEQ ID NO: 771394 - DNA, 22 bp, Artificial Sequence
  chemically synthesized
accaaaaatttcttcctagaca

SEQ ID NO: 771395 - DNA, 22 bp, Artificial Sequence
  chemically synthesized
gatacagttagaaatgtctagg

SEQ ID NO: 771396 - DNA, 22 bp, Artificial Sequence
  chemically synthesized
tagatacagttagaaatgtcta

SEQ ID NO: 771397 - DNA, 22 bp, Artificial Sequence
  chemically synthesized
tctagatacagttagaaatgtc

SEQ ID NO: 771398 - DNA, 22 bp, Artificial Sequence
  chemically synthesized
ctctagatacagttagaaatgt

SEQ ID NO: 771399 - DNA, 22 bp, Artificial Sequence
  chemically synthesized
tctctagatacagttagaaatg

SEQ ID NO: 771400 - DNA, 22 bp, Artificial Sequence
  chemically synthesized
cttcctagacatttctaactgt

SEQ ID NO: 771401 - DNA, 22 bp, Artificial Sequence
  chemically synthesized
ttttctctagatacagttagaa

SEQ ID NO: 771402 - DNA, 22 bp, Artificial Sequence
  chemically synthesized
ttcctagacatttctaactgta

SEQ ID NO: 771403 - DNA, 22 bp, Artificial Sequence
  chemically synthesized
cctagacatttctaactgtatc

SEQ ID NO: 771404 - DNA, 22 bp, Artificial Sequence
  chemically synthesized
ctagacatttctaactgtatct

SEQ ID NO: 771405 - DNA, 22 bp, Artificial Sequence
  chemically synthesized
gacatttctaactgtatctaga

SEQ ID NO: 771406 - DNA, 22 bp, Artificial Sequence
  chemically synthesized
atgtccctgttttctctagata

SEQ ID NO: 771407 - DNA, 22 bp, Artificial Sequence
  chemically synthesized
gatgtccctgttttctctagat

SEQ ID NO: 771408 - DNA, 22 bp, Artificial Sequence
  chemically synthesized
tgatgtccctgttttctctaga

SEQ ID NO: 771409 - DNA, 22 bp, Artificial Sequence
  chemically synthesized
ctaactgtatctagagaaaaca

SEQ ID NO: 771410 - DNA, 22 bp, Artificial Sequence
  chemically synthesized
ttttgatgtccctgttttctct

SEQ ID NO: 771411 - DNA, 22 bp, Artificial Sequence
  chemically synthesized
taactgtatctagagaaaacag

SEQ ID NO: 771412 - DNA, 22 bp, Artificial Sequence
  chemically synthesized
gttttgatgtccctgttttctc

SEQ ID NO: 771413 - DNA, 22 bp, Artificial Sequence
  chemically synthesized
tgttttgatgtccctgttttct

SEQ ID NO: 771414 - DNA, 22 bp, Artificial Sequence
  chemically synthesized
actgtatctagagaaaacaggg

SEQ ID NO: 771415 - DNA, 22 bp, Artificial Sequence
  chemically synthesized
ttttgttttgatgtccctgttt

SEQ ID NO: 771416 - DNA, 22 bp, Artificial Sequence
  chemically synthesized
gttttgttttgatgtccctgtt

SEQ ID NO: 771417 - DNA, 22 bp, Artificial Sequence
  chemically synthesized
tatctagagaaaacagggacat

SEQ ID NO: 771418 - DNA, 22 bp, Artificial Sequence
  chemically synthesized
ttgttttgttttgatgtccctg

SEQ ID NO: 771419 - DNA, 22 bp, Artificial Sequence
  chemically synthesized
gagaaaacagggacatcaaaac

SEQ ID NO: 771420 - DNA, 22 bp, Artificial Sequence
  chemically synthesized
tgttcttgttttgttttgatgt

SEQ ID NO: 771421 - DNA, 22 bp, Artificial Sequence
  chemically synthesized
ttgtgttcttgttttgttttga

SEQ ID NO: 771422 - DNA, 22 bp, Artificial Sequence
  chemically synthesized
tgttgttgtgttcttgttttgt

SEQ ID NO: 771423 - DNA, 22 bp, Artificial Sequence
  chemically synthesized
ctgtgttgttgtgttcttgttt

SEQ ID NO: 771424 - DNA, 22 bp, Artificial Sequence
  chemically synthesized
gctgtgttgttgtgttcttgtt

SEQ ID NO: 771425 - DNA, 22 bp, Artificial Sequence
  chemically synthesized
tgctgtgttgttgtgttcttgt

SEQ ID NO: 771426 - DNA, 22 bp, Artificial Sequence
  chemically synthesized
aaaatccaggattttgctgtgt

SEQ ID NO: 771427 - DNA, 22 bp, Artificial Sequence
  chemically synthesized
taaattgaaaatccaggatttt

SEQ ID NO: 771428 - DNA, 22 bp, Artificial Sequence
  chemically synthesized
ataaattgaaaatccaggattt

SEQ ID NO: 771429 - DNA, 22 bp, Artificial Sequence
  chemically synthesized
tataaattgaaaatccaggatt

SEQ ID NO: 771430 - DNA, 22 bp, Artificial Sequence
  chemically synthesized
atccatgactttataaattgaa

SEQ ID NO: 771431 - DNA, 22 bp, Artificial Sequence
  chemically synthesized
catccatgactttataaattga

SEQ ID NO: 771432 - DNA, 22 bp, Artificial Sequence
  chemically synthesized
ttcatccatgactttataaatt

SEQ ID NO: 771433 - DNA, 22 bp, Artificial Sequence
  chemically synthesized
gattttcaatttataaagtcat

SEQ ID NO: 771434 - DNA, 22 bp, Artificial Sequence
  chemically synthesized
aaccagttcttcatccatgact

SEQ ID NO: 771435 - DNA, 22 bp, Artificial Sequence
  chemically synthesized
tcaatttataaagtcatggatg

SEQ ID NO: 771436 - DNA, 22 bp, Artificial Sequence
  chemically synthesized
aaaccagttcttcatccatgac

SEQ ID NO: 771437 - DNA, 22 bp, Artificial Sequence
  chemically synthesized
caatttataaagtcatggatga

SEQ ID NO: 771438 - DNA, 22 bp, Artificial Sequence
  chemically synthesized
aatttataaagtcatggatgaa

SEQ ID NO: 771439 - DNA, 22 bp, Artificial Sequence
  chemically synthesized
ggtttaaaccagttcttcatcc

SEQ ID NO: 771440 - DNA, 22 bp, Artificial Sequence
  chemically synthesized
aggtttaaaccagttcttcatc

SEQ ID NO: 771441 - DNA, 22 bp, Artificial Sequence
  chemically synthesized
ataaagtcatggatgaagaact

SEQ ID NO: 771442 - DNA, 22 bp, Artificial Sequence
  chemically synthesized
taggtttaaaccagttcttcat

SEQ ID NO: 771443 - DNA, 22 bp, Artificial Sequence
  chemically synthesized
taaagtcatggatgaagaactg

SEQ ID NO: 771444 - DNA, 22 bp, Artificial Sequence
  chemically synthesized
tggattttaggtttaaaccagt

SEQ ID NO: 771445 - DNA, 22 bp, Artificial Sequence
  chemically synthesized
attatggattttaggtttaaac

SEQ ID NO: 771446 - DNA, 22 bp, Artificial Sequence
  chemically synthesized
tgattatggattttaggtttaa

SEQ ID NO: 771447 - DNA, 22 bp, Artificial Sequence
  chemically synthesized
tctgattatggattttaggttt

SEQ ID NO: 771448 - DNA, 22 bp, Artificial Sequence
  chemically synthesized
aagttctctgattatggatttt

SEQ ID NO: 771449 - DNA, 22 bp, Artificial Sequence
  chemically synthesized
gaagttctctgattatggattt

SEQ ID NO: 771450 - DNA, 22 bp, Artificial Sequence
  chemically synthesized
gtttaaacctaaaatccataat

SEQ ID NO: 771451 - DNA, 22 bp, Artificial Sequence
  chemically synthesized
tgaagttctctgattatggatt

SEQ ID NO: 771452 - DNA, 22 bp, Artificial Sequence
  chemically synthesized
tttgaagttctctgattatgga

SEQ ID NO: 771453 - DNA, 22 bp, Artificial Sequence
  chemically synthesized
aaacctaaaatccataatcaga

SEQ ID NO: 771454 - DNA, 22 bp, Artificial Sequence
  chemically synthesized
aacctaaaatccataatcagag

SEQ ID NO: 771455 - DNA, 22 bp, Artificial Sequence
  chemically synthesized
aaatccataatcagagaacttc

SEQ ID NO: 771456 - DNA, 22 bp, Artificial Sequence
  chemically synthesized
atgtgtataatataccatatct

SEQ ID NO: 771457 - DNA, 22 bp, Artificial Sequence
  chemically synthesized
caaagagatatggtatattata

SEQ ID NO: 771458 - DNA, 22 bp, Artificial Sequence
  chemically synthesized
aaagagatatggtatattatac

SEQ ID NO: 771459 - DNA, 22 bp, Artificial Sequence
  chemically synthesized
aaaaggaaaaggctgatgtgta

SEQ ID NO: 771460 - DNA, 22 bp, Artificial Sequence
  chemically synthesized
caaaaggaaaaggctgatgtgt

SEQ ID NO: 771461 - DNA, 22 bp, Artificial Sequence
  chemically synthesized
ttcaaaaggaaaaggctgatgt

SEQ ID NO: 771462 - DNA, 22 bp, Artificial Sequence
  chemically synthesized
cttcaaaaggaaaaggctgatg

SEQ ID NO: 771463 - DNA, 22 bp, Artificial Sequence
  chemically synthesized
tcttcaaaaggaaaaggctgat

SEQ ID NO: 771464 - DNA, 22 bp, Artificial Sequence
  chemically synthesized
ttcttcaaaaggaaaaggctga

SEQ ID NO: 771465 - DNA, 22 bp, Artificial Sequence
  chemically synthesized
cttttcttcaaaaggaaaaggc

SEQ ID NO: 771466 - DNA, 22 bp, Artificial Sequence
  chemically synthesized
tgcttttcttcaaaaggaaaag

SEQ ID NO: 771467 - DNA, 22 bp, Artificial Sequence
  chemically synthesized
tacacatcagccttttcctttt

SEQ ID NO: 771468 - DNA, 22 bp, Artificial Sequence
  chemically synthesized
tctgcttttcttcaaaaggaaa

SEQ ID NO: 771469 - DNA, 22 bp, Artificial Sequence
  chemically synthesized
tctctgcttttcttcaaaagga

SEQ ID NO: 771470 - DNA, 22 bp, Artificial Sequence
  chemically synthesized
ctctctgcttttcttcaaaagg

SEQ ID NO: 771471 - DNA, 22 bp, Artificial Sequence
  chemically synthesized
cagtgtcttctctctgcttttc

SEQ ID NO: 771472 - DNA, 22 bp, Artificial Sequence
  chemically synthesized
ttccttttgaagaaaagcagag

SEQ ID NO: 771473 - DNA, 22 bp, Artificial Sequence
  chemically synthesized
ccagtgtcttctctctgctttt

SEQ ID NO: 771474 - DNA, 22 bp, Artificial Sequence
  chemically synthesized
tccttttgaagaaaagcagaga

SEQ ID NO: 771475 - DNA, 22 bp, Artificial Sequence
  chemically synthesized
ccttttgaagaaaagcagagag

SEQ ID NO: 771476 - DNA, 22 bp, Artificial Sequence
  chemically synthesized
cttttgaagaaaagcagagaga

SEQ ID NO: 771477 - DNA, 22 bp, Artificial Sequence
  chemically synthesized
cccttccagtgtcttctctctg

SEQ ID NO: 771478 - DNA, 22 bp, Artificial Sequence
  chemically synthesized
ttgaagaaaagcagagagaaga

SEQ ID NO: 771479 - DNA, 22 bp, Artificial Sequence
  chemically synthesized
ccccttccagtgtcttctctct

SEQ ID NO: 771480 - DNA, 22 bp, Artificial Sequence
  chemically synthesized
tgaagaaaagcagagagaagac

SEQ ID NO: 771481 - DNA, 22 bp, Artificial Sequence
  chemically synthesized
gaagaaaagcagagagaagaca

SEQ ID NO: 771482 - DNA, 22 bp, Artificial Sequence
  chemically synthesized
aagaaaagcagagagaagacac

SEQ ID NO: 771483 - DNA, 22 bp, Artificial Sequence
  chemically synthesized
ccagagtagcaggaggtttccc

SEQ ID NO: 771484 - DNA, 22 bp, Artificial Sequence
  chemically synthesized
ggagctcccagagtagcaggag

SEQ ID NO: 771485 - DNA, 22 bp, Artificial Sequence
  chemically synthesized
gaaggggaaacctcctgctact

SEQ ID NO: 771486 - DNA, 22 bp, Artificial Sequence
  chemically synthesized
aggagctcccagagtagcagga

SEQ ID NO: 771487 - DNA, 22 bp, Artificial Sequence
  chemically synthesized
ctgctactctgggagctcctaa

SEQ ID NO: 771488 - DNA, 22 bp, Artificial Sequence
  chemically synthesized
ctactctgggagctcctaaggg

SEQ ID NO: 771489 - DNA, 22 bp, Artificial Sequence
  chemically synthesized
ctctgggagctcctaagggctg

SEQ ID NO: 771490 - DNA, 22 bp, Artificial Sequence
  chemically synthesized
tgggagctcctaagggctggga

SEQ ID NO: 771491 - DNA, 22 bp, Artificial Sequence
  chemically synthesized
ggagctcctaagggctgggacc

SEQ ID NO: 771492 - DNA, 22 bp, Artificial Sequence
  chemically synthesized
ctaagggctgggaccatatctg

SEQ ID NO: 771493 - DNA, 22 bp, Artificial Sequence
  chemically synthesized
agggctgggaccatatctgcct

SEQ ID NO: 771494 - DNA, 22 bp, Artificial Sequence
  chemically synthesized
ggaccatatctgccttgtctgc

SEQ ID NO: 771495 - DNA, 22 bp, Artificial Sequence
  chemically synthesized
gaagtgggagatacagccgcag

SEQ ID NO: 771496 - DNA, 22 bp, Artificial Sequence
  chemically synthesized
ccttgtctgcggctgtatctcc

SEQ ID NO: 771497 - DNA, 22 bp, Artificial Sequence
  chemically synthesized
tcaagctggaagtgggagatac

SEQ ID NO: 771498 - DNA, 22 bp, Artificial Sequence
  chemically synthesized
gtctgcggctgtatctcccact

SEQ ID NO: 771499 - DNA, 22 bp, Artificial Sequence
  chemically synthesized
tctgcggctgtatctcccactt

SEQ ID NO: 771500 - DNA, 22 bp, Artificial Sequence
  chemically synthesized
cggctgtatctcccacttccag

SEQ ID NO: 771501 - DNA, 22 bp, Artificial Sequence
  chemically synthesized
cataccagctatcaagctggaa

SEQ ID NO: 771502 - DNA, 22 bp, Artificial Sequence
  chemically synthesized
tatctcccacttccagcttgat

SEQ ID NO: 771503 - DNA, 22 bp, Artificial Sequence
  chemically synthesized
ccacttccagcttgatagctgg

SEQ ID NO: 771504 - DNA, 22 bp, Artificial Sequence
  chemically synthesized
ccagcttgatagctggtatgca

SEQ ID NO: 771505 - DNA, 22 bp, Artificial Sequence
  chemically synthesized
cagcttgatagctggtatgcaa

SEQ ID NO: 771506 - DNA, 22 bp, Artificial Sequence
  chemically synthesized
aaagcaaaagcagttgcatacc

SEQ ID NO: 771507 - DNA, 22 bp, Artificial Sequence
  chemically synthesized
ttgaaagcaaaagcagttgcat

SEQ ID NO: 771508 - DNA, 22 bp, Artificial Sequence
  chemically synthesized
attgaaagcaaaagcagttgca

SEQ ID NO: 771509 - DNA, 22 bp, Artificial Sequence
  chemically synthesized
gatagctggtatgcaactgctt

SEQ ID NO: 771510 - DNA, 22 bp, Artificial Sequence
  chemically synthesized
tattgaaagcaaaagcagttgc

SEQ ID NO: 771511 - DNA, 22 bp, Artificial Sequence
  chemically synthesized
atagctggtatgcaactgcttt

SEQ ID NO: 771512 - DNA, 22 bp, Artificial Sequence
  chemically synthesized
gtatgcaactgcttttgctttc

SEQ ID NO: 771513 - DNA, 22 bp, Artificial Sequence
  chemically synthesized
gataactttattgaaagcaaaa

SEQ ID NO: 771514 - DNA, 22 bp, Artificial Sequence
  chemically synthesized
ctcgataactttattgaaagca

SEQ ID NO: 771515 - DNA, 22 bp, Artificial Sequence
  chemically synthesized
actcgataactttattgaaagc

SEQ ID NO: 771516 - DNA, 22 bp, Artificial Sequence
  chemically synthesized
cttttgctttcaataaagttat

SEQ ID NO: 771517 - DNA, 22 bp, Artificial Sequence
  chemically synthesized
ttgctttcaataaagttatcga

SEQ ID NO: 771518 - DNA, 22 bp, Artificial Sequence
  chemically synthesized
tgctttcaataaagttatcgag

SEQ ID NO: 771519 - DNA, 22 bp, Artificial Sequence
  chemically synthesized
gctttcaataaagttatcgagt

SEQ ID NO: 771520 - DNA, 22 bp, Artificial Sequence
  chemically synthesized
ctttcaataaagttatcgagta

SEQ ID NO: 771521 - DNA, 22 bp, Artificial Sequence
  chemically synthesized
tcaataaagttatcgagtaaat

SEQ ID NO: 771522 - DNA, 22 bp, Artificial Sequence
  chemically synthesized
atgtatccaatcatttactcga

SEQ ID NO: 771523 - DNA, 22 bp, Artificial Sequence
  chemically synthesized
caataaagttatcgagtaaatg

SEQ ID NO: 771524 - DNA, 22 bp, Artificial Sequence
  chemically synthesized
aataaagttatcgagtaaatga

SEQ ID NO: 771525 - DNA, 22 bp, Artificial Sequence
  chemically synthesized
tcgagtaaatgattggatacat

SEQ ID NO: 771526 - DNA, 22 bp, Artificial Sequence
  chemically synthesized
atcaatgtattaatgtatccaa

SEQ ID NO: 771527 - DNA, 22 bp, Artificial Sequence
  chemically synthesized
ataactaatcaatgtattaatg

SEQ ID NO: 771528 - DNA, 22 bp, Artificial Sequence
  chemically synthesized
cataactaatcaatgtattaat

SEQ ID NO: 771529 - DNA, 22 bp, Artificial Sequence
  chemically synthesized
tcataactaatcaatgtattaa

SEQ ID NO: 771530 - DNA, 22 bp, Artificial Sequence
  chemically synthesized
gatacattaatacattgattag

SEQ ID NO: 771531 - DNA, 22 bp, Artificial Sequence
  chemically synthesized
atgtctttcataactaatcaat

SEQ ID NO: 771532 - DNA, 22 bp, Artificial Sequence
  chemically synthesized
gatgtctttcataactaatcaa

SEQ ID NO: 771533 - DNA, 22 bp, Artificial Sequence
  chemically synthesized
gtacttgatgtctttcataact

SEQ ID NO: 771534 - DNA, 22 bp, Artificial Sequence
  chemically synthesized
atacattgattagttatgaaag

SEQ ID NO: 771535 - DNA, 22 bp, Artificial Sequence
  chemically synthesized
tggtacttgatgtctttcataa

SEQ ID NO: 771536 - DNA, 22 bp, Artificial Sequence
  chemically synthesized
tctggtacttgatgtctttcat

SEQ ID NO: 771537 - DNA, 22 bp, Artificial Sequence
  chemically synthesized
attagttatgaaagacatcaag

SEQ ID NO: 771538 - DNA, 22 bp, Artificial Sequence
  chemically synthesized
atgttctctggtacttgatgtc

SEQ ID NO: 771539 - DNA, 22 bp, Artificial Sequence
  chemically synthesized
gatgttctctggtacttgatgt

SEQ ID NO: 771540 - DNA, 22 bp, Artificial Sequence
  chemically synthesized
tgatgttctctggtacttgatg

SEQ ID NO: 771541 - DNA, 22 bp, Artificial Sequence
  chemically synthesized
gttatgaaagacatcaagtacc

SEQ ID NO: 771542 - DNA, 22 bp, Artificial Sequence
  chemically synthesized
tttgatgttctctggtacttga

SEQ ID NO: 771543 - DNA, 22 bp, Artificial Sequence
  chemically synthesized
ctttgatgttctctggtacttg

SEQ ID NO: 771544 - DNA, 22 bp, Artificial Sequence
  chemically synthesized
tgaaagacatcaagtaccagag

SEQ ID NO: 771545 - DNA, 22 bp, Artificial Sequence
  chemically synthesized
gccttctttgatgttctctggt

SEQ ID NO: 771546 - DNA, 22 bp, Artificial Sequence
  chemically synthesized
ttagccttctttgatgttctct

SEQ ID NO: 771547 - DNA, 22 bp, Artificial Sequence
  chemically synthesized
attattagccttctttgatgtt

SEQ ID NO: 771548 - DNA, 22 bp, Artificial Sequence
  chemically synthesized
tcattattagccttctttgatg

SEQ ID NO: 771549 - DNA, 22 bp, Artificial Sequence
  chemically synthesized
actctcattattagccttcttt

SEQ ID NO: 771550 - DNA, 22 bp, Artificial Sequence
  chemically synthesized
gactctcattattagccttctt

SEQ ID NO: 771551 - DNA, 22 bp, Artificial Sequence
  chemically synthesized
cttgactctcattattagcctt

SEQ ID NO: 771552 - DNA, 22 bp, Artificial Sequence
  chemically synthesized
cccactgcttgactctcattat

SEQ ID NO: 771553 - DNA, 22 bp, Artificial Sequence
  chemically synthesized
ataatgagagtcaagcagtggg

SEQ ID NO: 771554 - DNA, 22 bp, Artificial Sequence
  chemically synthesized
ggtatataccaaggttacccac

SEQ ID NO: 771555 - DNA, 22 bp, Artificial Sequence
  chemically synthesized
tctaggtatataccaaggttac

SEQ ID NO: 771556 - DNA, 22 bp, Artificial Sequence
  chemically synthesized
ttatctaggtatataccaaggt

SEQ ID NO: 771557 - DNA, 22 bp, Artificial Sequence
  chemically synthesized
tattatctaggtatataccaag

SEQ ID NO: 771558 - DNA, 22 bp, Artificial Sequence
  chemically synthesized
ggtatatacctagataatagag

SEQ ID NO: 771559 - DNA, 22 bp, Artificial Sequence
  chemically synthesized
gtatatacctagataatagagc

SEQ ID NO: 771560 - DNA, 22 bp, Artificial Sequence
  chemically synthesized
gataatagagcactggtttctc

SEQ ID NO: 771561 - DNA, 22 bp, Artificial Sequence
  chemically synthesized
aaaaaaaaaaaaaaaaaaaaag

SEQ ID NO: 771562 - DNA, 22 bp, Artificial Sequence
  chemically synthesized
gtttctcttttttttttttttt

SEQ ID NO: 771563 - DNA, 22 bp, Artificial Sequence
  chemically synthesized
ctcttttttttttttttttttt

SEQ ID NO: 771564 - DNA, 22 bp, Artificial Sequence
  chemically synthesized
tctttttttttttttttttttt

SEQ ID NO: 771565 - DNA, 22 bp, Artificial Sequence
  chemically synthesized
tttttttttttttttttttttt

SEQ ID NO: 771566 - DNA, 22 bp, Artificial Sequence
  chemically synthesized
ttttttttttttttttttttaa

SEQ ID NO: 771567 - DNA, 22 bp, Artificial Sequence
  chemically synthesized
tttttttttttttttttttaat

SEQ ID NO: 771568 - DNA, 22 bp, Artificial Sequence
  chemically synthesized
ttttttttttttttttttaatt

SEQ ID NO: 771569 - DNA, 22 bp, Artificial Sequence
  chemically synthesized
tttttttttttttttttaattt

SEQ ID NO: 771570 - DNA, 22 bp, Artificial Sequence
  chemically synthesized
ttttttttttttttttaatttt

SEQ ID NO: 771571 - DNA, 22 bp, Artificial Sequence
  chemically synthesized
tttttttttttttttaattttt

SEQ ID NO: 771572 - DNA, 22 bp, Artificial Sequence
  chemically synthesized
ttttttttttttttaatttttt

SEQ ID NO: 771573 - DNA, 22 bp, Artificial Sequence
  chemically synthesized
tttttttttttttaattttttt

SEQ ID NO: 771574 - DNA, 22 bp, Artificial Sequence
  chemically synthesized
ttttttttttttaatttttttt

SEQ ID NO: 771575 - DNA, 22 bp, Artificial Sequence
  chemically synthesized
tttttttttttaattttttttt

SEQ ID NO: 771576 - DNA, 22 bp, Artificial Sequence
  chemically synthesized
ttttttttttaatttttttttt

SEQ ID NO: 771577 - DNA, 22 bp, Artificial Sequence
  chemically synthesized
tttttttttaattttttttttt

SEQ ID NO: 771578 - DNA, 22 bp, Artificial Sequence
  chemically synthesized
ttttttttaatttttttttttt

SEQ ID NO: 771579 - DNA, 22 bp, Artificial Sequence
  chemically synthesized
tttttttaattttttttttttt

SEQ ID NO: 771580 - DNA, 22 bp, Artificial Sequence
  chemically synthesized
gagtataataaaaaaaaaaaaa

SEQ ID NO: 771581 - DNA, 22 bp, Artificial Sequence
  chemically synthesized
ttttttaatttttttttttttt

SEQ ID NO: 771582 - DNA, 22 bp, Artificial Sequence
  chemically synthesized
agagtataataaaaaaaaaaaa

SEQ ID NO: 771583 - DNA, 22 bp, Artificial Sequence
  chemically synthesized
tttttaattttttttttttttt

SEQ ID NO: 771584 - DNA, 22 bp, Artificial Sequence
  chemically synthesized
ttttaatttttttttttttttt

SEQ ID NO: 771585 - DNA, 22 bp, Artificial Sequence
  chemically synthesized
tttaatttttttttttttttta

SEQ ID NO: 771586 - DNA, 22 bp, Artificial Sequence
  chemically synthesized
ttaattttttttttttttttat

SEQ ID NO: 771587 - DNA, 22 bp, Artificial Sequence
  chemically synthesized
taattttttttttttttttatt

SEQ ID NO: 771588 - DNA, 22 bp, Artificial Sequence
  chemically synthesized
aattttttttttttttttatta

SEQ ID NO: 771589 - DNA, 22 bp, Artificial Sequence
  chemically synthesized
aaacttagagtataataaaaaa

SEQ ID NO: 771590 - DNA, 22 bp, Artificial Sequence
  chemically synthesized
attttttttttttttttattat

SEQ ID NO: 771591 - DNA, 22 bp, Artificial Sequence
  chemically synthesized
tttttttttttttattatactc

SEQ ID NO: 771592 - DNA, 22 bp, Artificial Sequence
  chemically synthesized
ttttttttttttattatactct

SEQ ID NO: 771593 - DNA, 22 bp, Artificial Sequence
  chemically synthesized
tttttttttttattatactcta

SEQ ID NO: 771594 - DNA, 22 bp, Artificial Sequence
  chemically synthesized
ttttttttttattatactctaa

SEQ ID NO: 771595 - DNA, 22 bp, Artificial Sequence
  chemically synthesized
tttttttttattatactctaag

SEQ ID NO: 771596 - DNA, 22 bp, Artificial Sequence
  chemically synthesized
ttttttttattatactctaagt

SEQ ID NO: 771597 - DNA, 22 bp, Artificial Sequence
  chemically synthesized
tttttttattatactctaagtt

SEQ ID NO: 771598 - DNA, 22 bp, Artificial Sequence
  chemically synthesized
ttttttattatactctaagttt

SEQ ID NO: 771599 - DNA, 22 bp, Artificial Sequence
  chemically synthesized
tttttattatactctaagtttt

SEQ ID NO: 771600 - DNA, 22 bp, Artificial Sequence
  chemically synthesized
ttttattatactctaagtttta

SEQ ID NO: 771601 - DNA, 22 bp, Artificial Sequence
  chemically synthesized
tttattatactctaagttttag

SEQ ID NO: 771602 - DNA, 22 bp, Artificial Sequence
  chemically synthesized
ttattatactctaagttttagg

SEQ ID NO: 771603 - DNA, 22 bp, Artificial Sequence
  chemically synthesized
tattatactctaagttttaggg

SEQ ID NO: 771604 - DNA, 22 bp, Artificial Sequence
  chemically synthesized
attatactctaagttttagggt

SEQ ID NO: 771605 - DNA, 22 bp, Artificial Sequence
  chemically synthesized
ttatactctaagttttagggta

SEQ ID NO: 771606 - DNA, 22 bp, Artificial Sequence
  chemically synthesized
tactctaagttttagggtacat

SEQ ID NO: 771607 - DNA, 22 bp, Artificial Sequence
  chemically synthesized
cacaatgtgcacatgtacccta

SEQ ID NO: 771608 - DNA, 22 bp, Artificial Sequence
  chemically synthesized
taagttttagggtacatgtgca

SEQ ID NO: 771609 - DNA, 22 bp, Artificial Sequence
  chemically synthesized
acctgcacaatgtgcacatgta

SEQ ID NO: 771610 - DNA, 22 bp, Artificial Sequence
  chemically synthesized
agttttagggtacatgtgcaca

SEQ ID NO: 771611 - DNA, 22 bp, Artificial Sequence
  chemically synthesized
tagggtacatgtgcacattgtg

SEQ ID NO: 771612 - DNA, 22 bp, Artificial Sequence
  chemically synthesized
agggtacatgtgcacattgtgc

SEQ ID NO: 771613 - DNA, 22 bp, Artificial Sequence
  chemically synthesized
gggtacatgtgcacattgtgca

SEQ ID NO: 771614 - DNA, 22 bp, Artificial Sequence
  chemically synthesized
tgcaggttagttacatatgtat

SEQ ID NO: 771615 - DNA, 22 bp, Artificial Sequence
  chemically synthesized
gttacatatgtatacatgtgcc

SEQ ID NO: 771616 - DNA, 22 bp, Artificial Sequence
  chemically synthesized
catatgtatacatgtgccatgc

SEQ ID NO: 771617 - DNA, 22 bp, Artificial Sequence
  chemically synthesized
gtgggtgcagcgcaccagcatg

SEQ ID NO: 771618 - DNA, 22 bp, Artificial Sequence
  chemically synthesized
gatgacacgttagtgggtgcag

SEQ ID NO: 771619 - DNA, 22 bp, Artificial Sequence
  chemically synthesized
atgctagatgacacgttagtgg

SEQ ID NO: 771620 - DNA, 22 bp, Artificial Sequence
  chemically synthesized
gtgcgctgcacccactaacgtg

SEQ ID NO: 771621 - DNA, 22 bp, Artificial Sequence
  chemically synthesized
cacccactaacgtgtcatctag

SEQ ID NO: 771622 - DNA, 22 bp, Artificial Sequence
  chemically synthesized
ggagatatacctaatgctagat

SEQ ID NO: 771623 - DNA, 22 bp, Artificial Sequence
  chemically synthesized
acgtgtcatctagcattaggta

SEQ ID NO: 771624 - DNA, 22 bp, Artificial Sequence
  chemically synthesized
gcattaggtatatctcccaatg

SEQ ID NO: 771625 - DNA, 22 bp, Artificial Sequence
  chemically synthesized
ggtatatctcccaatgctatcc

SEQ ID NO: 771626 - DNA, 22 bp, Artificial Sequence
  chemically synthesized
ccaatgctatccctcccccctc

SEQ ID NO: 771627 - DNA, 22 bp, Artificial Sequence
  chemically synthesized
tggtggggtcgggggagggggg

SEQ ID NO: 771628 - DNA, 22 bp, Artificial Sequence
  chemically synthesized
tccctcccccctcccccgaccc

SEQ ID NO: 771629 - DNA, 22 bp, Artificial Sequence
  chemically synthesized
gggactgtggtggggtcggggg

SEQ ID NO: 771630 - DNA, 22 bp, Artificial Sequence
  chemically synthesized
tggggactgtggtggggtcggg

SEQ ID NO: 771631 - DNA, 22 bp, Artificial Sequence
  chemically synthesized
ccccctcccccgaccccaccac

SEQ ID NO: 771632 - DNA, 22 bp, Artificial Sequence
  chemically synthesized
ccccgaccccaccacagtcccc

SEQ ID NO: 771633 - DNA, 22 bp, Artificial Sequence
  chemically synthesized
aacaatgagatcacatggacac

SEQ ID NO: 771634 - DNA, 22 bp, Artificial Sequence
  chemically synthesized
cccttcctgtgtccatgtgatc

SEQ ID NO: 771635 - DNA, 22 bp, Artificial Sequence
  chemically synthesized
cctgtgtccatgtgatctcatt

SEQ ID NO: 771636 - DNA, 22 bp, Artificial Sequence
  chemically synthesized
ctgtgtccatgtgatctcattg

SEQ ID NO: 771637 - DNA, 22 bp, Artificial Sequence
  chemically synthesized
tgtccatgtgatctcattgttc

SEQ ID NO: 771638 - DNA, 22 bp, Artificial Sequence
  chemically synthesized
ataggtgggaattgaacaatga

SEQ ID NO: 771639 - DNA, 22 bp, Artificial Sequence
  chemically synthesized
actcataggtgggaattgaaca

SEQ ID NO: 771640 - DNA, 22 bp, Artificial Sequence
  chemically synthesized
tcactcataggtgggaattgaa

SEQ ID NO: 771641 - DNA, 22 bp, Artificial Sequence
  chemically synthesized
attgttcaattcccacctatga

SEQ ID NO: 771642 - DNA, 22 bp, Artificial Sequence
  chemically synthesized
ttcaattcccacctatgagtga

SEQ ID NO: 771643 - DNA, 22 bp, Artificial Sequence
  chemically synthesized
aattcccacctatgagtgagaa

SEQ ID NO: 771644 - DNA, 22 bp, Artificial Sequence
  chemically synthesized
ccacctatgagtgagaatatgc

SEQ ID NO: 771645 - DNA, 22 bp, Artificial Sequence
  chemically synthesized
tgagtgagaatatgcggtgttt

SEQ ID NO: 771646 - DNA, 22 bp, Artificial Sequence
  chemically synthesized
tcgcaagaacaaaaaaccaaac

SEQ ID NO: 771647 - DNA, 22 bp, Artificial Sequence
  chemically synthesized
agtaaactatcgcaagaacaaa

SEQ ID NO: 771648 - DNA, 22 bp, Artificial Sequence
  chemically synthesized
tcagtaaactatcgcaagaaca

SEQ ID NO: 771649 - DNA, 22 bp, Artificial Sequence
  chemically synthesized
ggttttttgttcttgcgatagt

SEQ ID NO: 771650 - DNA, 22 bp, Artificial Sequence
  chemically synthesized
gttttttgttcttgcgatagtt

SEQ ID NO: 771651 - DNA, 22 bp, Artificial Sequence
  chemically synthesized
tttgttcttgcgatagtttact

SEQ ID NO: 771652 - DNA, 22 bp, Artificial Sequence
  chemically synthesized
ttgttcttgcgatagtttactg

SEQ ID NO: 771653 - DNA, 22 bp, Artificial Sequence
  chemically synthesized
tgttcttgcgatagtttactga

SEQ ID NO: 771654 - DNA, 22 bp, Artificial Sequence
  chemically synthesized
gttcttgcgatagtttactgag

SEQ ID NO: 771655 - DNA, 22 bp, Artificial Sequence
  chemically synthesized
gaaaccatcattctcagtaaac

SEQ ID NO: 771656 - DNA, 22 bp, Artificial Sequence
  chemically synthesized
ttcttgcgatagtttactgaga

SEQ ID NO: 771657 - DNA, 22 bp, Artificial Sequence
  chemically synthesized
ttgcgatagtttactgagaatg

SEQ ID NO: 771658 - DNA, 22 bp, Artificial Sequence
  chemically synthesized
gcgatagtttactgagaatgat

SEQ ID NO: 771659 - DNA, 22 bp, Artificial Sequence
  chemically synthesized
cgatagtttactgagaatgatg

SEQ ID NO: 771660 - DNA, 22 bp, Artificial Sequence
  chemically synthesized
actgagaatgatggtttccaat

SEQ ID NO: 771661 - DNA, 22 bp, Artificial Sequence
  chemically synthesized
ctgagaatgatggtttccaatt

SEQ ID NO: 771662 - DNA, 22 bp, Artificial Sequence
  chemically synthesized
agaatgatggtttccaatttca

SEQ ID NO: 771663 - DNA, 22 bp, Artificial Sequence
  chemically synthesized
tagggacatggatgaaattgga

SEQ ID NO: 771664 - DNA, 22 bp, Artificial Sequence
  chemically synthesized
atgtccgttgtagggacatgga

SEQ ID NO: 771665 - DNA, 22 bp, Artificial Sequence
  chemically synthesized
ccaatttcatccatgtccctac

SEQ ID NO: 771666 - DNA, 22 bp, Artificial Sequence
  chemically synthesized
caatttcatccatgtccctaca

SEQ ID NO: 771667 - DNA, 22 bp, Artificial Sequence
  chemically synthesized
catccatgtccctacaacggac

SEQ ID NO: 771668 - DNA, 22 bp, Artificial Sequence
  chemically synthesized
atccatgtccctacaacggaca

SEQ ID NO: 771669 - DNA, 22 bp, Artificial Sequence
  chemically synthesized
caacggacatgaactcatcatt

SEQ ID NO: 771670 - DNA, 22 bp, Artificial Sequence
  chemically synthesized
tgcagccataaaaaatgatgag

SEQ ID NO: 771671 - DNA, 22 bp, Artificial Sequence
  chemically synthesized
atcattttttatggctgcatag

SEQ ID NO: 771672 - DNA, 22 bp, Artificial Sequence
  chemically synthesized
tttatggctgcatagtattcca

SEQ ID NO: 771673 - DNA, 22 bp, Artificial Sequence
  chemically synthesized
ttatggctgcatagtattccat

SEQ ID NO: 771674 - DNA, 22 bp, Artificial Sequence
  chemically synthesized
tatggctgcatagtattccatg

SEQ ID NO: 771675 - DNA, 22 bp, Artificial Sequence
  chemically synthesized
atggctgcatagtattccatgg

SEQ ID NO: 771676 - DNA, 22 bp, Artificial Sequence
  chemically synthesized
tggctgcatagtattccatggt

SEQ ID NO: 771677 - DNA, 22 bp, Artificial Sequence
  chemically synthesized
catagtattccatggtggatat

SEQ ID NO: 771678 - DNA, 22 bp, Artificial Sequence
  chemically synthesized
agaaaatgtggcacatatccac

SEQ ID NO: 771679 - DNA, 22 bp, Artificial Sequence
  chemically synthesized
gattaagaaaatgtggcacata

SEQ ID NO: 771680 - DNA, 22 bp, Artificial Sequence
  chemically synthesized
catggtggatatgtgccacatt

SEQ ID NO: 771681 - DNA, 22 bp, Artificial Sequence
  chemically synthesized
tcttaatccagtctatcattgt

SEQ ID NO: 771682 - DNA, 22 bp, Artificial Sequence
  chemically synthesized
cttaatccagtctatcattgtt

SEQ ID NO: 771683 - DNA, 22 bp, Artificial Sequence
  chemically synthesized
ttaatccagtctatcattgttg

SEQ ID NO: 771684 - DNA, 22 bp, Artificial Sequence
  chemically synthesized
aatccagtctatcattgttgga

SEQ ID NO: 771685 - DNA, 22 bp, Artificial Sequence
  chemically synthesized
atccagtctatcattgttggac

SEQ ID NO: 771686 - DNA, 22 bp, Artificial Sequence
  chemically synthesized
gaaccaacccaaatgtccaaca

SEQ ID NO: 771687 - DNA, 22 bp, Artificial Sequence
  chemically synthesized
ggaaccaacccaaatgtccaac

SEQ ID NO: 771688 - DNA, 22 bp, Artificial Sequence
  chemically synthesized
tcattgttggacatttgggttg

SEQ ID NO: 771689 - DNA, 22 bp, Artificial Sequence
  chemically synthesized
ttggacatttgggttggttcca

SEQ ID NO: 771690 - DNA, 22 bp, Artificial Sequence
  chemically synthesized
gacatttgggttggttccaagt

SEQ ID NO: 771691 - DNA, 22 bp, Artificial Sequence
  chemically synthesized
acaatagcaaagacttggaacc

SEQ ID NO: 771692 - DNA, 22 bp, Artificial Sequence
  chemically synthesized
ttcacaatagcaaagacttgga

SEQ ID NO: 771693 - DNA, 22 bp, Artificial Sequence
  chemically synthesized
gggttggttccaagtctttgct

SEQ ID NO: 771694 - DNA, 22 bp, Artificial Sequence
  chemically synthesized
ggttggttccaagtctttgcta

SEQ ID NO: 771695 - DNA, 22 bp, Artificial Sequence
  chemically synthesized
cggcactattcacaatagcaaa

SEQ ID NO: 771696 - DNA, 22 bp, Artificial Sequence
  chemically synthesized
gttccaagtctttgctattgtg

SEQ ID NO: 771697 - DNA, 22 bp, Artificial Sequence
  chemically synthesized
ttgcggcactattcacaatagc

SEQ ID NO: 771698 - DNA, 22 bp, Artificial Sequence
  chemically synthesized
attgcggcactattcacaatag

SEQ ID NO: 771699 - DNA, 22 bp, Artificial Sequence
  chemically synthesized
caagtctttgctattgtgaata

SEQ ID NO: 771700 - DNA, 22 bp, Artificial Sequence
  chemically synthesized
tgctattgtgaatagtgccgca

SEQ ID NO: 771701 - DNA, 22 bp, Artificial Sequence
  chemically synthesized
gctattgtgaatagtgccgcaa

SEQ ID NO: 771702 - DNA, 22 bp, Artificial Sequence
  chemically synthesized
ctattgtgaatagtgccgcaat

SEQ ID NO: 771703 - DNA, 22 bp, Artificial Sequence
  chemically synthesized
ttgtgaatagtgccgcaataaa

SEQ ID NO: 771704 - DNA, 22 bp, Artificial Sequence
  chemically synthesized
tgaatagtgccgcaataaacat

SEQ ID NO: 771705 - DNA, 22 bp, Artificial Sequence
  chemically synthesized
taaagacacatgcacacgtatg

SEQ ID NO: 771706 - DNA, 22 bp, Artificial Sequence
  chemically synthesized
ctataaagacacatgcacacgt

SEQ ID NO: 771707 - DNA, 22 bp, Artificial Sequence
  chemically synthesized
taaatcatgctgctataaagac

SEQ ID NO: 771708 - DNA, 22 bp, Artificial Sequence
  chemically synthesized
tatagcagcatgatttatagtc

SEQ ID NO: 771709 - DNA, 22 bp, Artificial Sequence
  chemically synthesized
atagcagcatgatttatagtcc

SEQ ID NO: 771710 - DNA, 22 bp, Artificial Sequence
  chemically synthesized
tagcagcatgatttatagtcct

SEQ ID NO: 771711 - DNA, 22 bp, Artificial Sequence
  chemically synthesized
ggtatatacccaaaggactata

SEQ ID NO: 771712 - DNA, 22 bp, Artificial Sequence
  chemically synthesized
ctgggtatatacccaaaggact

SEQ ID NO: 771713 - DNA, 22 bp, Artificial Sequence
  chemically synthesized
atagtcctttgggtatataccc

SEQ ID NO: 771714 - DNA, 22 bp, Artificial Sequence
  chemically synthesized
tagtcctttgggtatataccca

SEQ ID NO: 771715 - DNA, 22 bp, Artificial Sequence
  chemically synthesized
acccagccatcccattactggg

SEQ ID NO: 771716 - DNA, 22 bp, Artificial Sequence
  chemically synthesized
gacccagccatcccattactgg

SEQ ID NO: 771717 - DNA, 22 bp, Artificial Sequence
  chemically synthesized
tgggtatatacccagtaatggg

SEQ ID NO: 771718 - DNA, 22 bp, Artificial Sequence
  chemically synthesized
gggtatatacccagtaatggga

SEQ ID NO: 771719 - DNA, 22 bp, Artificial Sequence
  chemically synthesized
ggtatatacccagtaatgggat

SEQ ID NO: 771720 - DNA, 22 bp, Artificial Sequence
  chemically synthesized
gaaataccatttgacccagcca

SEQ ID NO: 771721 - DNA, 22 bp, Artificial Sequence
  chemically synthesized
gaactagaaataccatttgacc

SEQ ID NO: 771722 - DNA, 22 bp, Artificial Sequence
  chemically synthesized
agggatctagaactagaaatac

SEQ ID NO: 771723 - DNA, 22 bp, Artificial Sequence
  chemically synthesized
ggtcaaatggtatttctagttc

SEQ ID NO: 771724 - DNA, 22 bp, Artificial Sequence
  chemically synthesized
ctcagggatctagaactagaaa

SEQ ID NO: 771725 - DNA, 22 bp, Artificial Sequence
  chemically synthesized
ctagttctagatccctgaggaa

SEQ ID NO: 771726 - DNA, 22 bp, Artificial Sequence
  chemically synthesized
tagttctagatccctgaggaat

SEQ ID NO: 771727 - DNA, 22 bp, Artificial Sequence
  chemically synthesized
gttctagatccctgaggaatcg

SEQ ID NO: 771728 - DNA, 22 bp, Artificial Sequence
  chemically synthesized
tggaagtcagtgtggcgattcc

SEQ ID NO: 771729 - DNA, 22 bp, Artificial Sequence
  chemically synthesized
tagatccctgaggaatcgccac

SEQ ID NO: 771730 - DNA, 22 bp, Artificial Sequence
  chemically synthesized
gatccctgaggaatcgccacac

SEQ ID NO: 771731 - DNA, 22 bp, Artificial Sequence
  chemically synthesized
aaccattgtggaagtcagtgtg

SEQ ID NO: 771732 - DNA, 22 bp, Artificial Sequence
  chemically synthesized
aggaatcgccacactgacttcc

SEQ ID NO: 771733 - DNA, 22 bp, Artificial Sequence
  chemically synthesized
gttcaaccattgtggaagtcag

SEQ ID NO: 771734 - DNA, 22 bp, Artificial Sequence
  chemically synthesized
taaactagttcaaccattgtgg

SEQ ID NO: 771735 - DNA, 22 bp, Artificial Sequence
  chemically synthesized
acttccacaatggttgaactag

SEQ ID NO: 771736 - DNA, 22 bp, Artificial Sequence
  chemically synthesized
gtgggactgtaaactagttcaa

SEQ ID NO: 771737 - DNA, 22 bp, Artificial Sequence
  chemically synthesized
ccacaatggttgaactagttta

SEQ ID NO: 771738 - DNA, 22 bp, Artificial Sequence
  chemically synthesized
ttggtgggactgtaaactagtt

SEQ ID NO: 771739 - DNA, 22 bp, Artificial Sequence
  chemically synthesized
cacaatggttgaactagtttac

SEQ ID NO: 771740 - DNA, 22 bp, Artificial Sequence
  chemically synthesized
cactgttggtgggactgtaaac

SEQ ID NO: 771741 - DNA, 22 bp, Artificial Sequence
  chemically synthesized
acactgttggtgggactgtaaa

SEQ ID NO: 771742 - DNA, 22 bp, Artificial Sequence
  chemically synthesized
ttacactgttggtgggactgta

SEQ ID NO: 771743 - DNA, 22 bp, Artificial Sequence
  chemically synthesized
aactagtttacagtcccaccaa

SEQ ID NO: 771744 - DNA, 22 bp, Artificial Sequence
  chemically synthesized
gtttacagtcccaccaacagtg

SEQ ID NO: 771745 - DNA, 22 bp, Artificial Sequence
  chemically synthesized
acagtcccaccaacagtgtaag

SEQ ID NO: 771746 - DNA, 22 bp, Artificial Sequence
  chemically synthesized
cagtcccaccaacagtgtaaga

SEQ ID NO: 771747 - DNA, 22 bp, Artificial Sequence
  chemically synthesized
gagaggatgtggagaaatagga

SEQ ID NO: 771748 - DNA, 22 bp, Artificial Sequence
  chemically synthesized
ctatttctccacatcctctcca

SEQ ID NO: 771749 - DNA, 22 bp, Artificial Sequence
  chemically synthesized
tttctccacatcctctccagca

SEQ ID NO: 771750 - DNA, 22 bp, Artificial Sequence
  chemically synthesized
ctccacatcctctccagcacct

SEQ ID NO: 771751 - DNA, 22 bp, Artificial Sequence
  chemically synthesized
tccacatcctctccagcacctg

SEQ ID NO: 771752 - DNA, 22 bp, Artificial Sequence
  chemically synthesized
cacatcctctccagcacctgtt

SEQ ID NO: 771753 - DNA, 22 bp, Artificial Sequence
  chemically synthesized
aaaagtcaggaaacaacaggtg

SEQ ID NO: 771754 - DNA, 22 bp, Artificial Sequence
  chemically synthesized
tccagcacctgttgtttcctga

SEQ ID NO: 771755 - DNA, 22 bp, Artificial Sequence
  chemically synthesized
cagcacctgttgtttcctgact

SEQ ID NO: 771756 - DNA, 22 bp, Artificial Sequence
  chemically synthesized
gaatggcaatcattaaaaagtc

SEQ ID NO: 771757 - DNA, 22 bp, Artificial Sequence
  chemically synthesized
ttgtttcctgactttttaatga

SEQ ID NO: 771758 - DNA, 22 bp, Artificial Sequence
  chemically synthesized
tttcctgactttttaatgattg

SEQ ID NO: 771759 - DNA, 22 bp, Artificial Sequence
  chemically synthesized
cctgactttttaatgattgcca

SEQ ID NO: 771760 - DNA, 22 bp, Artificial Sequence
  chemically synthesized
ctgactttttaatgattgccat

SEQ ID NO: 771761 - DNA, 22 bp, Artificial Sequence
  chemically synthesized
acaccagttagaatggcaatca

SEQ ID NO: 771762 - DNA, 22 bp, Artificial Sequence
  chemically synthesized
actttttaatgattgccattct

SEQ ID NO: 771763 - DNA, 22 bp, Artificial Sequence
  chemically synthesized
tttaatgattgccattctaact

SEQ ID NO: 771764 - DNA, 22 bp, Artificial Sequence
  chemically synthesized
ttaatgattgccattctaactg

SEQ ID NO: 771765 - DNA, 22 bp, Artificial Sequence
  chemically synthesized
taatgattgccattctaactgg

SEQ ID NO: 771766 - DNA, 22 bp, Artificial Sequence
  chemically synthesized
aatgattgccattctaactggt

SEQ ID NO: 771767 - DNA, 22 bp, Artificial Sequence
  chemically synthesized
atgattgccattctaactggtg

SEQ ID NO: 771768 - DNA, 22 bp, Artificial Sequence
  chemically synthesized
tgagatatcatctcacaccagt

SEQ ID NO: 771769 - DNA, 22 bp, Artificial Sequence
  chemically synthesized
ccattctaactggtgtgagatg

SEQ ID NO: 771770 - DNA, 22 bp, Artificial Sequence
  chemically synthesized
taactggtgtgagatgatatct

SEQ ID NO: 771771 - DNA, 22 bp, Artificial Sequence
  chemically synthesized
actggtgtgagatgatatctca

SEQ ID NO: 771772 - DNA, 22 bp, Artificial Sequence
  chemically synthesized
gtgtgagatgatatctcatagt

SEQ ID NO: 771773 - DNA, 22 bp, Artificial Sequence
  chemically synthesized
gccatcagagaaatgcaaatca

SEQ ID NO: 771774 - DNA, 22 bp, Artificial Sequence
  chemically synthesized
atagtggttttgatttgcattt

SEQ ID NO: 771775 - DNA, 22 bp, Artificial Sequence
  chemically synthesized
atcatcactggccatcagagaa

SEQ ID NO: 771776 - DNA, 22 bp, Artificial Sequence
  chemically synthesized
tgatttgcatttctctgatggc

SEQ ID NO: 771777 - DNA, 22 bp, Artificial Sequence
  chemically synthesized
gatttgcatttctctgatggcc

SEQ ID NO: 771778 - DNA, 22 bp, Artificial Sequence
  chemically synthesized
atttgcatttctctgatggcca

SEQ ID NO: 771779 - DNA, 22 bp, Artificial Sequence
  chemically synthesized
gcatttctctgatggccagtga

SEQ ID NO: 771780 - DNA, 22 bp, Artificial Sequence
  chemically synthesized
catttctctgatggccagtgat

SEQ ID NO: 771781 - DNA, 22 bp, Artificial Sequence
  chemically synthesized
ctctgatggccagtgatgatga

SEQ ID NO: 771782 - DNA, 22 bp, Artificial Sequence
  chemically synthesized
tctgatggccagtgatgatgag

SEQ ID NO: 771783 - DNA, 22 bp, Artificial Sequence
  chemically synthesized
tgatggccagtgatgatgagca

SEQ ID NO: 771784 - DNA, 22 bp, Artificial Sequence
  chemically synthesized
atggccagtgatgatgagcatt

SEQ ID NO: 771785 - DNA, 22 bp, Artificial Sequence
  chemically synthesized
tgcagccaaaaaacacatgaag

SEQ ID NO: 771786 - DNA, 22 bp, Artificial Sequence
  chemically synthesized
atgcagccaaaaaacacatgaa

SEQ ID NO: 771787 - DNA, 22 bp, Artificial Sequence
  chemically synthesized
cttcatgtgttttttggctgca

SEQ ID NO: 771788 - DNA, 22 bp, Artificial Sequence
  chemically synthesized
ttcatgtgttttttggctgcat

SEQ ID NO: 771789 - DNA, 22 bp, Artificial Sequence
  chemically synthesized
catgtgttttttggctgcataa

SEQ ID NO: 771790 - DNA, 22 bp, Artificial Sequence
  chemically synthesized
aaaagaagacatttatgcagcc

SEQ ID NO: 771791 - DNA, 22 bp, Artificial Sequence
  chemically synthesized
atgtgttttttggctgcataaa

SEQ ID NO: 771792 - DNA, 22 bp, Artificial Sequence
  chemically synthesized
tcaaaagaagacatttatgcag

SEQ ID NO: 771793 - DNA, 22 bp, Artificial Sequence
  chemically synthesized
ctcaaaagaagacatttatgca

SEQ ID NO: 771794 - DNA, 22 bp, Artificial Sequence
  chemically synthesized
tttggctgcataaatgtcttct

SEQ ID NO: 771795 - DNA, 22 bp, Artificial Sequence
  chemically synthesized
ttggctgcataaatgtcttctt

SEQ ID NO: 771796 - DNA, 22 bp, Artificial Sequence
  chemically synthesized
tggctgcataaatgtcttcttt

SEQ ID NO: 771797 - DNA, 22 bp, Artificial Sequence
  chemically synthesized
ggctgcataaatgtcttctttt

SEQ ID NO: 771798 - DNA, 22 bp, Artificial Sequence
  chemically synthesized
gctgcataaatgtcttcttttg

SEQ ID NO: 771799 - DNA, 22 bp, Artificial Sequence
  chemically synthesized
cataaatgtcttcttttgagaa

SEQ ID NO: 771800 - DNA, 22 bp, Artificial Sequence
  chemically synthesized
cttttgagaagtgtctgttcat

SEQ ID NO: 771801 - DNA, 22 bp, Artificial Sequence
  chemically synthesized
ttttgagaagtgtctgttcatg

SEQ ID NO: 771802 - DNA, 22 bp, Artificial Sequence
  chemically synthesized
ttgagaagtgtctgttcatgtc

SEQ ID NO: 771803 - DNA, 22 bp, Artificial Sequence
  chemically synthesized
tgagaagtgtctgttcatgtcc

SEQ ID NO: 771804 - DNA, 22 bp, Artificial Sequence
  chemically synthesized
gagaagtgtctgttcatgtcct

SEQ ID NO: 771805 - DNA, 22 bp, Artificial Sequence
  chemically synthesized
agaagtgtctgttcatgtcctt

SEQ ID NO: 771806 - DNA, 22 bp, Artificial Sequence
  chemically synthesized
ttcatgtccttcgcccactttt

SEQ ID NO: 771807 - DNA, 22 bp, Artificial Sequence
  chemically synthesized
atgtccttcgcccactttttga

SEQ ID NO: 771808 - DNA, 22 bp, Artificial Sequence
  chemically synthesized
cgcccactttttgatggggttg

SEQ ID NO: 771809 - DNA, 22 bp, Artificial Sequence
  chemically synthesized
gcccactttttgatggggttgt

SEQ ID NO: 771810 - DNA, 22 bp, Artificial Sequence
  chemically synthesized
caagaaaaaaacaaacaacccc

SEQ ID NO: 771811 - DNA, 22 bp, Artificial Sequence
  chemically synthesized
acaagaaaaaaacaaacaaccc

SEQ ID NO: 771812 - DNA, 22 bp, Artificial Sequence
  chemically synthesized
tttgatggggttgtttgttttt

SEQ ID NO: 771813 - DNA, 22 bp, Artificial Sequence
  chemically synthesized
ttgatggggttgtttgtttttt

SEQ ID NO: 771814 - DNA, 22 bp, Artificial Sequence
  chemically synthesized
tgatggggttgtttgttttttt

SEQ ID NO: 771815 - DNA, 22 bp, Artificial Sequence
  chemically synthesized
gatggggttgtttgtttttttc

SEQ ID NO: 771816 - DNA, 22 bp, Artificial Sequence
  chemically synthesized
atggggttgtttgtttttttct

SEQ ID NO: 771817 - DNA, 22 bp, Artificial Sequence
  chemically synthesized
aaacaaatttacaagaaaaaaa

SEQ ID NO: 771818 - DNA, 22 bp, Artificial Sequence
  chemically synthesized
tttgtttttttcttgtaaattt

SEQ ID NO: 771819 - DNA, 22 bp, Artificial Sequence
  chemically synthesized
caatgaactcaaacaaatttac

SEQ ID NO: 771820 - DNA, 22 bp, Artificial Sequence
  chemically synthesized
gtttttttcttgtaaatttgtt

SEQ ID NO: 771821 - DNA, 22 bp, Artificial Sequence
  chemically synthesized
tttttttcttgtaaatttgttt

SEQ ID NO: 771822 - DNA, 22 bp, Artificial Sequence
  chemically synthesized
ttttcttgtaaatttgtttgag

SEQ ID NO: 771823 - DNA, 22 bp, Artificial Sequence
  chemically synthesized
tttcttgtaaatttgtttgagt

SEQ ID NO: 771824 - DNA, 22 bp, Artificial Sequence
  chemically synthesized
ttcttgtaaatttgtttgagtt

SEQ ID NO: 771825 - DNA, 22 bp, Artificial Sequence
  chemically synthesized
tcttgtaaatttgtttgagttc

SEQ ID NO: 771826 - DNA, 22 bp, Artificial Sequence
  chemically synthesized
cttgtaaatttgtttgagttca

SEQ ID NO: 771827 - DNA, 22 bp, Artificial Sequence
  chemically synthesized
ttgtaaatttgtttgagttcat

SEQ ID NO: 771828 - DNA, 22 bp, Artificial Sequence
  chemically synthesized
gtaaatttgtttgagttcattg

SEQ ID NO: 771829 - DNA, 22 bp, Artificial Sequence
  chemically synthesized
taaatttgtttgagttcattgt

SEQ ID NO: 771830 - DNA, 22 bp, Artificial Sequence
  chemically synthesized
atatccagaatctacaatgaac

SEQ ID NO: 771831 - DNA, 22 bp, Artificial Sequence
  chemically synthesized
gtttgagttcattgtagattct

SEQ ID NO: 771832 - DNA, 22 bp, Artificial Sequence
  chemically synthesized
tttgagttcattgtagattctg

SEQ ID NO: 771833 - DNA, 22 bp, Artificial Sequence
  chemically synthesized
gagttcattgtagattctggat

SEQ ID NO: 771834 - DNA, 22 bp, Artificial Sequence
  chemically synthesized
agttcattgtagattctggata

SEQ ID NO: 771835 - DNA, 22 bp, Artificial Sequence
  chemically synthesized
acaaagggctaatatccagaat

SEQ ID NO: 771836 - DNA, 22 bp, Artificial Sequence
  chemically synthesized
attgtagattctggatattagc

SEQ ID NO: 771837 - DNA, 22 bp, Artificial Sequence
  chemically synthesized
atctgacaaagggctaatatcc

SEQ ID NO: 771838 - DNA, 22 bp, Artificial Sequence
  chemically synthesized
ctcatctgacaaagggctaata

SEQ ID NO: 771839 - DNA, 22 bp, Artificial Sequence
  chemically synthesized
tagattctggatattagccctt

SEQ ID NO: 771840 - DNA, 22 bp, Artificial Sequence
  chemically synthesized
tggatattagccctttgtcaga

SEQ ID NO: 771841 - DNA, 22 bp, Artificial Sequence
  chemically synthesized
cgcaacctactcatctgacaaa

SEQ ID NO: 771842 - DNA, 22 bp, Artificial Sequence
  chemically synthesized
gatattagccctttgtcagatg

SEQ ID NO: 771843 - DNA, 22 bp, Artificial Sequence
  chemically synthesized
ccgcaacctactcatctgacaa

SEQ ID NO: 771844 - DNA, 22 bp, Artificial Sequence
  chemically synthesized
gccctttgtcagatgagtaggt

SEQ ID NO: 771845 - DNA, 22 bp, Artificial Sequence
  chemically synthesized
tgtcagatgagtaggttgcgga

SEQ ID NO: 771846 - DNA, 22 bp, Artificial Sequence
  chemically synthesized
gtcagatgagtaggttgcggaa

SEQ ID NO: 771847 - DNA, 22 bp, Artificial Sequence
  chemically synthesized
tcagatgagtaggttgcggaaa

SEQ ID NO: 771848 - DNA, 22 bp, Artificial Sequence
  chemically synthesized
caacatgggagaaaatttccgc

SEQ ID NO: 771849 - DNA, 22 bp, Artificial Sequence
  chemically synthesized
cggaaattttctcccatgttgt

SEQ ID NO: 771850 - DNA, 22 bp, Artificial Sequence
  chemically synthesized
tctcccatgttgtaggttgcct

SEQ ID NO: 771851 - DNA, 22 bp, Artificial Sequence
  chemically synthesized
ctcccatgttgtaggttgcctg

SEQ ID NO: 771852 - DNA, 22 bp, Artificial Sequence
  chemically synthesized
tcccatgttgtaggttgcctgt

SEQ ID NO: 771853 - DNA, 22 bp, Artificial Sequence
  chemically synthesized
ccatcagagtgaacaggcaacc

SEQ ID NO: 771854 - DNA, 22 bp, Artificial Sequence
  chemically synthesized
ccatgttgtaggttgcctgttc

SEQ ID NO: 771855 - DNA, 22 bp, Artificial Sequence
  chemically synthesized
taggttgcctgttcactctgat

SEQ ID NO: 771856 - DNA, 22 bp, Artificial Sequence
  chemically synthesized
cctgttcactctgatggtagtt

SEQ ID NO: 771857 - DNA, 22 bp, Artificial Sequence
  chemically synthesized
cacagcaaaagaaactaccatc

SEQ ID NO: 771858 - DNA, 22 bp, Artificial Sequence
  chemically synthesized
tgcacagcaaaagaaactacca

SEQ ID NO: 771859 - DNA, 22 bp, Artificial Sequence
  chemically synthesized
ctgcacagcaaaagaaactacc

SEQ ID NO: 771860 - DNA, 22 bp, Artificial Sequence
  chemically synthesized
ttcactctgatggtagtttctt

SEQ ID NO: 771861 - DNA, 22 bp, Artificial Sequence
  chemically synthesized
actctgatggtagtttcttttg

SEQ ID NO: 771862 - DNA, 22 bp, Artificial Sequence
  chemically synthesized
tgatggtagtttcttttgctgt

SEQ ID NO: 771863 - DNA, 22 bp, Artificial Sequence
  chemically synthesized
aagagcttctgcacagcaaaag

SEQ ID NO: 771864 - DNA, 22 bp, Artificial Sequence
  chemically synthesized
atggtagtttcttttgctgtgc

SEQ ID NO: 771865 - DNA, 22 bp, Artificial Sequence
  chemically synthesized
aactcaagagcttctgcacagc

SEQ ID NO: 771866 - DNA, 22 bp, Artificial Sequence
  chemically synthesized
attaaactcaagagcttctgca

SEQ ID NO: 771867 - DNA, 22 bp, Artificial Sequence
  chemically synthesized
cttttgctgtgcagaagctctt

SEQ ID NO: 771868 - DNA, 22 bp, Artificial Sequence
  chemically synthesized
ttttgctgtgcagaagctcttg

SEQ ID NO: 771869 - DNA, 22 bp, Artificial Sequence
  chemically synthesized
ttgctgtgcagaagctcttgag

SEQ ID NO: 771870 - DNA, 22 bp, Artificial Sequence
  chemically synthesized
tgctgtgcagaagctcttgagt

SEQ ID NO: 771871 - DNA, 22 bp, Artificial Sequence
  chemically synthesized
gctgtgcagaagctcttgagtt

SEQ ID NO: 771872 - DNA, 22 bp, Artificial Sequence
  chemically synthesized
ctgtgcagaagctcttgagttt

SEQ ID NO: 771873 - DNA, 22 bp, Artificial Sequence
  chemically synthesized
tgcagaagctcttgagtttaat

SEQ ID NO: 771874 - DNA, 22 bp, Artificial Sequence
  chemically synthesized
acaaatgggatctaattaaact

SEQ ID NO: 771875 - DNA, 22 bp, Artificial Sequence
  chemically synthesized
ttgagtttaattagatcccatt

SEQ ID NO: 771876 - DNA, 22 bp, Artificial Sequence
  chemically synthesized
gagtttaattagatcccatttg

SEQ ID NO: 771877 - DNA, 22 bp, Artificial Sequence
  chemically synthesized
agtttaattagatcccatttgt

SEQ ID NO: 771878 - DNA, 22 bp, Artificial Sequence
  chemically synthesized
aattagatcccatttgtcaatt

SEQ ID NO: 771879 - DNA, 22 bp, Artificial Sequence
  chemically synthesized
attagatcccatttgtcaattt

SEQ ID NO: 771880 - DNA, 22 bp, Artificial Sequence
  chemically synthesized
gatcccatttgtcaattttggc

SEQ ID NO: 771881 - DNA, 22 bp, Artificial Sequence
  chemically synthesized
aaaagcaatggcaacaaaagcc

SEQ ID NO: 771882 - DNA, 22 bp, Artificial Sequence
  chemically synthesized
caaaagcaatggcaacaaaagc

SEQ ID NO: 771883 - DNA, 22 bp, Artificial Sequence
  chemically synthesized
tcaaaagcaatggcaacaaaag

SEQ ID NO: 771884 - DNA, 22 bp, Artificial Sequence
  chemically synthesized
gtcaattttggcttttgttgcc

SEQ ID NO: 771885 - DNA, 22 bp, Artificial Sequence
  chemically synthesized
ttcaaaagcaatggcaacaaaa

SEQ ID NO: 771886 - DNA, 22 bp, Artificial Sequence
  chemically synthesized
tcaattttggcttttgttgcca

SEQ ID NO: 771887 - DNA, 22 bp, Artificial Sequence
  chemically synthesized
aaagtttttcaaaagcaatggc

SEQ ID NO: 771888 - DNA, 22 bp, Artificial Sequence
  chemically synthesized
tggcttttgttgccattgcttt

SEQ ID NO: 771889 - DNA, 22 bp, Artificial Sequence
  chemically synthesized
caaagtttttcaaaagcaatgg

SEQ ID NO: 771890 - DNA, 22 bp, Artificial Sequence
  chemically synthesized
ggcttttgttgccattgctttt

SEQ ID NO: 771891 - DNA, 22 bp, Artificial Sequence
  chemically synthesized
tcaaagtttttcaaaagcaatg

SEQ ID NO: 771892 - DNA, 22 bp, Artificial Sequence
  chemically synthesized
gcttttgttgccattgcttttg

SEQ ID NO: 771893 - DNA, 22 bp, Artificial Sequence
  chemically synthesized
ttcaaagtttttcaaaagcaat

SEQ ID NO: 771894 - DNA, 22 bp, Artificial Sequence
  chemically synthesized
tttcaaagtttttcaaaagcaa

SEQ ID NO: 771895 - DNA, 22 bp, Artificial Sequence
  chemically synthesized
ttttcaaagtttttcaaaagca

SEQ ID NO: 771896 - DNA, 22 bp, Artificial Sequence
  chemically synthesized
ttgttgccattgcttttgaaaa

SEQ ID NO: 771897 - DNA, 22 bp, Artificial Sequence
  chemically synthesized
tgttgccattgcttttgaaaaa

SEQ ID NO: 771898 - DNA, 22 bp, Artificial Sequence
  chemically synthesized
gttgccattgcttttgaaaaac

SEQ ID NO: 771899 - DNA, 22 bp, Artificial Sequence
  chemically synthesized
ttgccattgcttttgaaaaact

SEQ ID NO: 771900 - DNA, 22 bp, Artificial Sequence
  chemically synthesized
aatttttttcaaagtttttcaa

SEQ ID NO: 771901 - DNA, 22 bp, Artificial Sequence
  chemically synthesized
taaatttttttcaaagtttttc

SEQ ID NO: 771902 - DNA, 22 bp, Artificial Sequence
  chemically synthesized
ccattgcttttgaaaaactttg

SEQ ID NO: 771903 - DNA, 22 bp, Artificial Sequence
  chemically synthesized
ctaaatttttttcaaagttttt

SEQ ID NO: 771904 - DNA, 22 bp, Artificial Sequence
  chemically synthesized
ttctaaatttttttcaaagttt

SEQ ID NO: 771905 - DNA, 22 bp, Artificial Sequence
  chemically synthesized
cttttgaaaaactttgaaaaaa

SEQ ID NO: 771906 - DNA, 22 bp, Artificial Sequence
  chemically synthesized
ttgaaaaactttgaaaaaaatt

SEQ ID NO: 771907 - DNA, 22 bp, Artificial Sequence
  chemically synthesized
tacattcttctaaatttttttc

SEQ ID NO: 771908 - DNA, 22 bp, Artificial Sequence
  chemically synthesized
tgaaaaactttgaaaaaaattt

SEQ ID NO: 771909 - DNA, 22 bp, Artificial Sequence
  chemically synthesized
gaaaaactttgaaaaaaattta

SEQ ID NO: 771910 - DNA, 22 bp, Artificial Sequence
  chemically synthesized
aaaaactttgaaaaaaatttag

SEQ ID NO: 771911 - DNA, 22 bp, Artificial Sequence
  chemically synthesized
gttatacattcttctaaatttt

SEQ ID NO: 771912 - DNA, 22 bp, Artificial Sequence
  chemically synthesized
tagttatacattcttctaaatt

SEQ ID NO: 771913 - DNA, 22 bp, Artificial Sequence
  chemically synthesized
ttctagttatacattcttctaa

SEQ ID NO: 771914 - DNA, 22 bp, Artificial Sequence
  chemically synthesized
tgaaaaaaatttagaagaatgt

SEQ ID NO: 771915 - DNA, 22 bp, Artificial Sequence
  chemically synthesized
gaaaaaaatttagaagaatgta

SEQ ID NO: 771916 - DNA, 22 bp, Artificial Sequence
  chemically synthesized
aaaaaaatttagaagaatgtat

SEQ ID NO: 771917 - DNA, 22 bp, Artificial Sequence
  chemically synthesized
gttattctagttatacattctt

SEQ ID NO: 771918 - DNA, 22 bp, Artificial Sequence
  chemically synthesized
tattcgttattctagttataca

SEQ ID NO: 771919 - DNA, 22 bp, Artificial Sequence
  chemically synthesized
tgtattcgttattctagttata

SEQ ID NO: 771920 - DNA, 22 bp, Artificial Sequence
  chemically synthesized
tctgtattcgttattctagtta

SEQ ID NO: 771921 - DNA, 22 bp, Artificial Sequence
  chemically synthesized
agaagaatgtataactagaata

SEQ ID NO: 771922 - DNA, 22 bp, Artificial Sequence
  chemically synthesized
ctctgtattcgttattctagtt

SEQ ID NO: 771923 - DNA, 22 bp, Artificial Sequence
  chemically synthesized
gaagaatgtataactagaataa

SEQ ID NO: 771924 - DNA, 22 bp, Artificial Sequence
  chemically synthesized
agcacttctctgtattcgttat

SEQ ID NO: 771925 - DNA, 22 bp, Artificial Sequence
  chemically synthesized
aagcacttctctgtattcgtta

SEQ ID NO: 771926 - DNA, 22 bp, Artificial Sequence
  chemically synthesized
taagcacttctctgtattcgtt

SEQ ID NO: 771927 - DNA, 22 bp, Artificial Sequence
  chemically synthesized
ctttaagcacttctctgtattc

SEQ ID NO: 771928 - DNA, 22 bp, Artificial Sequence
  chemically synthesized
gaataacgaatacagagaagtg

SEQ ID NO: 771929 - DNA, 22 bp, Artificial Sequence
  chemically synthesized
catcagctcctttaagcacttc

SEQ ID NO: 771930 - DNA, 22 bp, Artificial Sequence
  chemically synthesized
agctccatcagctcctttaagc

SEQ ID NO: 771931 - DNA, 22 bp, Artificial Sequence
  chemically synthesized
cagctccatcagctcctttaag

SEQ ID NO: 771932 - DNA, 22 bp, Artificial Sequence
  chemically synthesized
tcagctccatcagctcctttaa

SEQ ID NO: 771933 - DNA, 22 bp, Artificial Sequence
  chemically synthesized
gttttcagctccatcagctcct

SEQ ID NO: 771934 - DNA, 22 bp, Artificial Sequence
  chemically synthesized
ggttttcagctccatcagctcc

SEQ ID NO: 771935 - DNA, 22 bp, Artificial Sequence
  chemically synthesized
gagccttggttttcagctccat

SEQ ID NO: 771936 - DNA, 22 bp, Artificial Sequence
  chemically synthesized
aaaggagctgatggagctgaaa

SEQ ID NO: 771937 - DNA, 22 bp, Artificial Sequence
  chemically synthesized
tcgagccttggttttcagctcc

SEQ ID NO: 771938 - DNA, 22 bp, Artificial Sequence
  chemically synthesized
aaggagctgatggagctgaaaa

SEQ ID NO: 771939 - DNA, 22 bp, Artificial Sequence
  chemically synthesized
acgtagttctcgagccttggtt

SEQ ID NO: 771940 - DNA, 22 bp, Artificial Sequence
  chemically synthesized
atggagctgaaaaccaaggctc

SEQ ID NO: 771941 - DNA, 22 bp, Artificial Sequence
  chemically synthesized
cacgtagttctcgagccttggt

SEQ ID NO: 771942 - DNA, 22 bp, Artificial Sequence
  chemically synthesized
ttcacgtagttctcgagccttg

SEQ ID NO: 771943 - DNA, 22 bp, Artificial Sequence
  chemically synthesized
cattcttcacgtagttctcgag

SEQ ID NO: 771944 - DNA, 22 bp, Artificial Sequence
  chemically synthesized
aaaaccaaggctcgagaactac

SEQ ID NO: 771945 - DNA, 22 bp, Artificial Sequence
  chemically synthesized
tgcattcttcacgtagttctcg

SEQ ID NO: 771946 - DNA, 22 bp, Artificial Sequence
  chemically synthesized
ctgcattcttcacgtagttctc

SEQ ID NO: 771947 - DNA, 22 bp, Artificial Sequence
  chemically synthesized
aggcttctgcattcttcacgta

SEQ ID NO: 771948 - DNA, 22 bp, Artificial Sequence
  chemically synthesized
ctgaggcttctgcattcttcac

SEQ ID NO: 771949 - DNA, 22 bp, Artificial Sequence
  chemically synthesized
gagaactacgtgaagaatgcag

SEQ ID NO: 771950 - DNA, 22 bp, Artificial Sequence
  chemically synthesized
cgtgaagaatgcagaagcctca

SEQ ID NO: 771951 - DNA, 22 bp, Artificial Sequence
  chemically synthesized
atcgcatcggctcctgaggctt

SEQ ID NO: 771952 - DNA, 22 bp, Artificial Sequence
  chemically synthesized
cagttgatcgcatcggctcctg

SEQ ID NO: 771953 - DNA, 22 bp, Artificial Sequence
  chemically synthesized
ccagttgatcgcatcggctcct

SEQ ID NO: 771954 - DNA, 22 bp, Artificial Sequence
  chemically synthesized
ttccagttgatcgcatcggctc

SEQ ID NO: 771955 - DNA, 22 bp, Artificial Sequence
  chemically synthesized
cttccagttgatcgcatcggct

SEQ ID NO: 771956 - DNA, 22 bp, Artificial Sequence
  chemically synthesized
tcttccagttgatcgcatcggc

SEQ ID NO: 771957 - DNA, 22 bp, Artificial Sequence
  chemically synthesized
aggagccgatgcgatcaactgg

SEQ ID NO: 771958 - DNA, 22 bp, Artificial Sequence
  chemically synthesized
ataccctttcttccagttgatc

SEQ ID NO: 771959 - DNA, 22 bp, Artificial Sequence
  chemically synthesized
ctgataccctttcttccagttg

SEQ ID NO: 771960 - DNA, 22 bp, Artificial Sequence
  chemically synthesized
cattgctgataccctttcttcc

SEQ ID NO: 771961 - DNA, 22 bp, Artificial Sequence
  chemically synthesized
ccattgctgataccctttcttc

SEQ ID NO: 771962 - DNA, 22 bp, Artificial Sequence
  chemically synthesized
atcttccattgctgataccctt

SEQ ID NO: 771963 - DNA, 22 bp, Artificial Sequence
  chemically synthesized
catcttccattgctgataccct

SEQ ID NO: 771964 - DNA, 22 bp, Artificial Sequence
  chemically synthesized
atttcatcttccattgctgata

SEQ ID NO: 771965 - DNA, 22 bp, Artificial Sequence
  chemically synthesized
gaagaaagggtatcagcaatgg

SEQ ID NO: 771966 - DNA, 22 bp, Artificial Sequence
  chemically synthesized
attcatttcatcttccattgct

SEQ ID NO: 771967 - DNA, 22 bp, Artificial Sequence
  chemically synthesized
cattcatttcatcttccattgc

SEQ ID NO: 771968 - DNA, 22 bp, Artificial Sequence
  chemically synthesized
atttcattcatttcatcttcca

SEQ ID NO: 771969 - DNA, 22 bp, Artificial Sequence
  chemically synthesized
catttcattcatttcatcttcc

SEQ ID NO: 771970 - DNA, 22 bp, Artificial Sequence
  chemically synthesized
gcttcatttcattcatttcatc

SEQ ID NO: 771971 - DNA, 22 bp, Artificial Sequence
  chemically synthesized
tcgcttcatttcattcatttca

SEQ ID NO: 771972 - DNA, 22 bp, Artificial Sequence
  chemically synthesized
ctcgcttcatttcattcatttc

SEQ ID NO: 771973 - DNA, 22 bp, Artificial Sequence
  chemically synthesized
ccttctcgcttcatttcattca

SEQ ID NO: 771974 - DNA, 22 bp, Artificial Sequence
  chemically synthesized
cccttctcgcttcatttcattc

SEQ ID NO: 771975 - DNA, 22 bp, Artificial Sequence
  chemically synthesized
aacttcccttctcgcttcattt

SEQ ID NO: 771976 - DNA, 22 bp, Artificial Sequence
  chemically synthesized
taaacttcccttctcgcttcat

SEQ ID NO: 771977 - DNA, 22 bp, Artificial Sequence
  chemically synthesized
tctaaacttcccttctcgcttc

SEQ ID NO: 771978 - DNA, 22 bp, Artificial Sequence
  chemically synthesized
ctctaaacttcccttctcgctt

SEQ ID NO: 771979 - DNA, 22 bp, Artificial Sequence
  chemically synthesized
tctctaaacttcccttctcgct

SEQ ID NO: 771980 - DNA, 22 bp, Artificial Sequence
  chemically synthesized
ttctctaaacttcccttctcgc

SEQ ID NO: 771981 - DNA, 22 bp, Artificial Sequence
  chemically synthesized
tttctctaaacttcccttctcg

SEQ ID NO: 771982 - DNA, 22 bp, Artificial Sequence
  chemically synthesized
ttttctctaaacttcccttctc

SEQ ID NO: 771983 - DNA, 22 bp, Artificial Sequence
  chemically synthesized
ttttttctctaaacttcccttc

SEQ ID NO: 771984 - DNA, 22 bp, Artificial Sequence
  chemically synthesized
ttcttttttctctaaacttccc

SEQ ID NO: 771985 - DNA, 22 bp, Artificial Sequence
  chemically synthesized
attcttttttctctaaacttcc

SEQ ID NO: 771986 - DNA, 22 bp, Artificial Sequence
  chemically synthesized
tattcttttttctctaaacttc

SEQ ID NO: 771987 - DNA, 22 bp, Artificial Sequence
  chemically synthesized
ttattcttttttctctaaactt

SEQ ID NO: 771988 - DNA, 22 bp, Artificial Sequence
  chemically synthesized
tttattcttttttctctaaact

SEQ ID NO: 771989 - DNA, 22 bp, Artificial Sequence
  chemically synthesized
tttttattcttttttctctaaa

SEQ ID NO: 771990 - DNA, 22 bp, Artificial Sequence
  chemically synthesized
ctttttattcttttttctctaa

SEQ ID NO: 771991 - DNA, 22 bp, Artificial Sequence
  chemically synthesized
atttctttttattcttttttct

SEQ ID NO: 771992 - DNA, 22 bp, Artificial Sequence
  chemically synthesized
ctcatttctttttattcttttt

SEQ ID NO: 771993 - DNA, 22 bp, Artificial Sequence
  chemically synthesized
gctcatttctttttattctttt

SEQ ID NO: 771994 - DNA, 22 bp, Artificial Sequence
  chemically synthesized
tgctcatttctttttattcttt

SEQ ID NO: 771995 - DNA, 22 bp, Artificial Sequence
  chemically synthesized
agagaaaaaagaataaaaagaa

SEQ ID NO: 771996 - DNA, 22 bp, Artificial Sequence
  chemically synthesized
gagaaaaaagaataaaaagaaa

SEQ ID NO: 771997 - DNA, 22 bp, Artificial Sequence
  chemically synthesized
gaggctttgctcatttcttttt

SEQ ID NO: 771998 - DNA, 22 bp, Artificial Sequence
  chemically synthesized
ggaggctttgctcatttctttt

SEQ ID NO: 771999 - DNA, 22 bp, Artificial Sequence
  chemically synthesized
ttggaggctttgctcatttctt

SEQ ID NO: 772000 - DNA, 22 bp, Artificial Sequence
  chemically synthesized
cttggaggctttgctcatttct

SEQ ID NO: 772001 - DNA, 22 bp, Artificial Sequence
  chemically synthesized
acatagtcccatatttcttgga

SEQ ID NO: 772002 - DNA, 22 bp, Artificial Sequence
  chemically synthesized
cacatagtcccatatttcttgg

SEQ ID NO: 772003 - DNA, 22 bp, Artificial Sequence
  chemically synthesized
tcacatagtcccatatttcttg

SEQ ID NO: 772004 - DNA, 22 bp, Artificial Sequence
  chemically synthesized
ttcacatagtcccatatttctt

SEQ ID NO: 772005 - DNA, 22 bp, Artificial Sequence
  chemically synthesized
gtcttttcacatagtcccatat

SEQ ID NO: 772006 - DNA, 22 bp, Artificial Sequence
  chemically synthesized
ggtcttttcacatagtcccata

SEQ ID NO: 772007 - DNA, 22 bp, Artificial Sequence
  chemically synthesized
caagaaatatgggactatgtga

SEQ ID NO: 772008 - DNA, 22 bp, Artificial Sequence
  chemically synthesized
tgtgaaaagaccaaatctacgt

SEQ ID NO: 772009 - DNA, 22 bp, Artificial Sequence
  chemically synthesized
aggtacaccaatcagacgtaga

SEQ ID NO: 772010 - DNA, 22 bp, Artificial Sequence
  chemically synthesized
caggtacaccaatcagacgtag

SEQ ID NO: 772011 - DNA, 22 bp, Artificial Sequence
  chemically synthesized
tcaggtacaccaatcagacgta

SEQ ID NO: 772012 - DNA, 22 bp, Artificial Sequence
  chemically synthesized
cacatcactttcaggtacacca

SEQ ID NO: 772013 - DNA, 22 bp, Artificial Sequence
  chemically synthesized
tccacatcactttcaggtacac

SEQ ID NO: 772014 - DNA, 22 bp, Artificial Sequence
  chemically synthesized
cgtctgattggtgtacctgaaa

SEQ ID NO: 772015 - DNA, 22 bp, Artificial Sequence
  chemically synthesized
cattctccacatcactttcagg

SEQ ID NO: 772016 - DNA, 22 bp, Artificial Sequence
  chemically synthesized
attggtgtacctgaaagtgatg

SEQ ID NO: 772017 - DNA, 22 bp, Artificial Sequence
  chemically synthesized
gttccattctccacatcacttt

SEQ ID NO: 772018 - DNA, 22 bp, Artificial Sequence
  chemically synthesized
ggttccattctccacatcactt

SEQ ID NO: 772019 - DNA, 22 bp, Artificial Sequence
  chemically synthesized
gtgtacctgaaagtgatgtgga

SEQ ID NO: 772020 - DNA, 22 bp, Artificial Sequence
  chemically synthesized
caacttggttccattctccaca

SEQ ID NO: 772021 - DNA, 22 bp, Artificial Sequence
  chemically synthesized
ccaacttggttccattctccac

SEQ ID NO: 772022 - DNA, 22 bp, Artificial Sequence
  chemically synthesized
tccaacttggttccattctcca

SEQ ID NO: 772023 - DNA, 22 bp, Artificial Sequence
  chemically synthesized
aaagtgatgtggagaatggaac

SEQ ID NO: 772024 - DNA, 22 bp, Artificial Sequence
  chemically synthesized
cagagtgttttccaacttggtt

SEQ ID NO: 772025 - DNA, 22 bp, Artificial Sequence
  chemically synthesized
gataatatcctgcagagtgttt

SEQ ID NO: 772026 - DNA, 22 bp, Artificial Sequence
  chemically synthesized
ctggataatatcctgcagagtg

SEQ ID NO: 772027 - DNA, 22 bp, Artificial Sequence
  chemically synthesized
tcctggataatatcctgcagag

SEQ ID NO: 772028 - DNA, 22 bp, Artificial Sequence
  chemically synthesized
gaaaacactctgcaggatatta

SEQ ID NO: 772029 - DNA, 22 bp, Artificial Sequence
  chemically synthesized
gggaagttctcctggataatat

SEQ ID NO: 772030 - DNA, 22 bp, Artificial Sequence
  chemically synthesized
gattggggaagttctcctggat

SEQ ID NO: 772031 - DNA, 22 bp, Artificial Sequence
  chemically synthesized
tgcaggatattatccaggagaa

SEQ ID NO: 772032 - DNA, 22 bp, Artificial Sequence
  chemically synthesized
caggatattatccaggagaact

SEQ ID NO: 772033 - DNA, 22 bp, Artificial Sequence
  chemically synthesized
ctagattggggaagttctcctg

SEQ ID NO: 772034 - DNA, 22 bp, Artificial Sequence
  chemically synthesized
actagattggggaagttctcct

SEQ ID NO: 772035 - DNA, 22 bp, Artificial Sequence
  chemically synthesized
ccttactagattggggaagttc

SEQ ID NO: 772036 - DNA, 22 bp, Artificial Sequence
  chemically synthesized
tccaggagaacttccccaatct

SEQ ID NO: 772037 - DNA, 22 bp, Artificial Sequence
  chemically synthesized
gcctgccttactagattgggga

SEQ ID NO: 772038 - DNA, 22 bp, Artificial Sequence
  chemically synthesized
aacgttggcctgccttactaga

SEQ ID NO: 772039 - DNA, 22 bp, Artificial Sequence
  chemically synthesized
ccccaatctagtaaggcaggcc

SEQ ID NO: 772040 - DNA, 22 bp, Artificial Sequence
  chemically synthesized
aatctgaacgttggcctgcctt

SEQ ID NO: 772041 - DNA, 22 bp, Artificial Sequence
  chemically synthesized
cccaatctagtaaggcaggcca

SEQ ID NO: 772042 - DNA, 22 bp, Artificial Sequence
  chemically synthesized
ctgaatctgaacgttggcctgc

SEQ ID NO: 772043 - DNA, 22 bp, Artificial Sequence
  chemically synthesized
cctgaatctgaacgttggcctg

SEQ ID NO: 772044 - DNA, 22 bp, Artificial Sequence
  chemically synthesized
tatttcctgaatctgaacgttg

SEQ ID NO: 772045 - DNA, 22 bp, Artificial Sequence
  chemically synthesized
gtaaggcaggccaacgttcaga

SEQ ID NO: 772046 - DNA, 22 bp, Artificial Sequence
  chemically synthesized
tgtatttcctgaatctgaacgt

SEQ ID NO: 772047 - DNA, 22 bp, Artificial Sequence
  chemically synthesized
tctgtatttcctgaatctgaac

SEQ ID NO: 772048 - DNA, 22 bp, Artificial Sequence
  chemically synthesized
tggcgttctctgtatttcctga

SEQ ID NO: 772049 - DNA, 22 bp, Artificial Sequence
  chemically synthesized
gtggcgttctctgtatttcctg

SEQ ID NO: 772050 - DNA, 22 bp, Artificial Sequence
  chemically synthesized
tgtggcgttctctgtatttcct

SEQ ID NO: 772051 - DNA, 22 bp, Artificial Sequence
  chemically synthesized
agattcaggaaatacagagaac

SEQ ID NO: 772052 - DNA, 22 bp, Artificial Sequence
  chemically synthesized
aggaaatacagagaacgccaca

SEQ ID NO: 772053 - DNA, 22 bp, Artificial Sequence
  chemically synthesized
gaggagtatctttgtggcgttc

SEQ ID NO: 772054 - DNA, 22 bp, Artificial Sequence
  chemically synthesized
tcgaggagtatctttgtggcgt

SEQ ID NO: 772055 - DNA, 22 bp, Artificial Sequence
  chemically synthesized
ctcgaggagtatctttgtggcg

SEQ ID NO: 772056 - DNA, 22 bp, Artificial Sequence
  chemically synthesized
ttctcgaggagtatctttgtgg

SEQ ID NO: 772057 - DNA, 22 bp, Artificial Sequence
  chemically synthesized
ctcttctcgaggagtatctttg

SEQ ID NO: 772058 - DNA, 22 bp, Artificial Sequence
  chemically synthesized
gagttgctcttctcgaggagta

SEQ ID NO: 772059 - DNA, 22 bp, Artificial Sequence
  chemically synthesized
ggagttgctcttctcgaggagt

SEQ ID NO: 772060 - DNA, 22 bp, Artificial Sequence
  chemically synthesized
tgtgtcttggagttgctcttct

SEQ ID NO: 772061 - DNA, 22 bp, Artificial Sequence
  chemically synthesized
acaattatgtgtcttggagttg

SEQ ID NO: 772062 - DNA, 22 bp, Artificial Sequence
  chemically synthesized
ctcgagaagagcaactccaaga

SEQ ID NO: 772063 - DNA, 22 bp, Artificial Sequence
  chemically synthesized
gagaagagcaactccaagacac

SEQ ID NO: 772064 - DNA, 22 bp, Artificial Sequence
  chemically synthesized
gtgaatctgacaattatgtgtc

SEQ ID NO: 772065 - DNA, 22 bp, Artificial Sequence
  chemically synthesized
ggtgaatctgacaattatgtgt

SEQ ID NO: 772066 - DNA, 22 bp, Artificial Sequence
  chemically synthesized
aacttggtgaatctgacaatta

SEQ ID NO: 772067 - DNA, 22 bp, Artificial Sequence
  chemically synthesized
caacttggtgaatctgacaatt

SEQ ID NO: 772068 - DNA, 22 bp, Artificial Sequence
  chemically synthesized
caagacacataattgtcagatt

SEQ ID NO: 772069 - DNA, 22 bp, Artificial Sequence
  chemically synthesized
atttcaacttggtgaatctgac

SEQ ID NO: 772070 - DNA, 22 bp, Artificial Sequence
  chemically synthesized
catttcaacttggtgaatctga

SEQ ID NO: 772071 - DNA, 22 bp, Artificial Sequence
  chemically synthesized
cttcatttcaacttggtgaatc

SEQ ID NO: 772072 - DNA, 22 bp, Artificial Sequence
  chemically synthesized
ccttcatttcaacttggtgaat

SEQ ID NO: 772073 - DNA, 22 bp, Artificial Sequence
  chemically synthesized
tccttcatttcaacttggtgaa

SEQ ID NO: 772074 - DNA, 22 bp, Artificial Sequence
  chemically synthesized
ttccttcatttcaacttggtga

SEQ ID NO: 772075 - DNA, 22 bp, Artificial Sequence
  chemically synthesized
tttccttcatttcaacttggtg

SEQ ID NO: 772076 - DNA, 22 bp, Artificial Sequence
  chemically synthesized
tcagattcaccaagttgaaatg

SEQ ID NO: 772077 - DNA, 22 bp, Artificial Sequence
  chemically synthesized
acattttttccttcatttcaac

SEQ ID NO: 772078 - DNA, 22 bp, Artificial Sequence
  chemically synthesized
aacattttttccttcatttcaa

SEQ ID NO: 772079 - DNA, 22 bp, Artificial Sequence
  chemically synthesized
cccttaacattttttccttcat

SEQ ID NO: 772080 - DNA, 22 bp, Artificial Sequence
  chemically synthesized
accaagttgaaatgaaggaaaa

SEQ ID NO: 772081 - DNA, 22 bp, Artificial Sequence
  chemically synthesized
gctgcccttaacattttttcct

SEQ ID NO: 772082 - DNA, 22 bp, Artificial Sequence
  chemically synthesized
tggctgcccttaacattttttc

SEQ ID NO: 772083 - DNA, 22 bp, Artificial Sequence
  chemically synthesized
tctggctgcccttaacattttt

SEQ ID NO: 772084 - DNA, 22 bp, Artificial Sequence
  chemically synthesized
aaatgaaggaaaaaatgttaag

SEQ ID NO: 772085 - DNA, 22 bp, Artificial Sequence
  chemically synthesized
tctctggctgcccttaacattt

SEQ ID NO: 772086 - DNA, 22 bp, Artificial Sequence
  chemically synthesized
ctctctggctgcccttaacatt

SEQ ID NO: 772087 - DNA, 22 bp, Artificial Sequence
  chemically synthesized
tctctctggctgcccttaacat

SEQ ID NO: 772088 - DNA, 22 bp, Artificial Sequence
  chemically synthesized
gacctttctctctggctgccct

SEQ ID NO: 772089 - DNA, 22 bp, Artificial Sequence
  chemically synthesized
agggtaactcgacctttctctc

SEQ ID NO: 772090 - DNA, 22 bp, Artificial Sequence
  chemically synthesized
gagggtaactcgacctttctct

SEQ ID NO: 772091 - DNA, 22 bp, Artificial Sequence
  chemically synthesized
agggcagccagagagaaaggtc

SEQ ID NO: 772092 - DNA, 22 bp, Artificial Sequence
  chemically synthesized
tgagggtaactcgacctttctc

SEQ ID NO: 772093 - DNA, 22 bp, Artificial Sequence
  chemically synthesized
ctttgagggtaactcgaccttt

SEQ ID NO: 772094 - DNA, 22 bp, Artificial Sequence
  chemically synthesized
cctttgagggtaactcgacctt

SEQ ID NO: 772095 - DNA, 22 bp, Artificial Sequence
  chemically synthesized
tcctttgagggtaactcgacct

SEQ ID NO: 772096 - DNA, 22 bp, Artificial Sequence
  chemically synthesized
atgggctttcctttgagggtaa

SEQ ID NO: 772097 - DNA, 22 bp, Artificial Sequence
  chemically synthesized
gtctgatgggctttcctttgag

SEQ ID NO: 772098 - DNA, 22 bp, Artificial Sequence
  chemically synthesized
ttagtctgatgggctttccttt

SEQ ID NO: 772099 - DNA, 22 bp, Artificial Sequence
  chemically synthesized
ccctcaaaggaaagcccatcag

SEQ ID NO: 772100 - DNA, 22 bp, Artificial Sequence
  chemically synthesized
aaaggaaagcccatcagactaa

SEQ ID NO: 772101 - DNA, 22 bp, Artificial Sequence
  chemically synthesized
ccgagagatccgctgttagtct

SEQ ID NO: 772102 - DNA, 22 bp, Artificial Sequence
  chemically synthesized
tgccgagagatccgctgttagt

SEQ ID NO: 772103 - DNA, 22 bp, Artificial Sequence
  chemically synthesized
ctgccgagagatccgctgttag

SEQ ID NO: 772104 - DNA, 22 bp, Artificial Sequence
  chemically synthesized
tagggtttctgccgagagatcc

SEQ ID NO: 772105 - DNA, 22 bp, Artificial Sequence
  chemically synthesized
gtagggtttctgccgagagatc

SEQ ID NO: 772106 - DNA, 22 bp, Artificial Sequence
  chemically synthesized
gcttgtagggtttctgccgaga

SEQ ID NO: 772107 - DNA, 22 bp, Artificial Sequence
  chemically synthesized
acagcggatctctcggcagaaa

SEQ ID NO: 772108 - DNA, 22 bp, Artificial Sequence
  chemically synthesized
tggcttgtagggtttctgccga

SEQ ID NO: 772109 - DNA, 22 bp, Artificial Sequence
  chemically synthesized
ctggcttgtagggtttctgccg

SEQ ID NO: 772110 - DNA, 22 bp, Artificial Sequence
  chemically synthesized
ttctggcttgtagggtttctgc

SEQ ID NO: 772111 - DNA, 22 bp, Artificial Sequence
  chemically synthesized
tcttctggcttgtagggtttct

SEQ ID NO: 772112 - DNA, 22 bp, Artificial Sequence
  chemically synthesized
tcggcagaaaccctacaagcca

SEQ ID NO: 772113 - DNA, 22 bp, Artificial Sequence
  chemically synthesized
ggcagaaaccctacaagccaga

SEQ ID NO: 772114 - DNA, 22 bp, Artificial Sequence
  chemically synthesized
gcccccactctcttctggcttg

SEQ ID NO: 772115 - DNA, 22 bp, Artificial Sequence
  chemically synthesized
aatattggcccccactctcttc

SEQ ID NO: 772116 - DNA, 22 bp, Artificial Sequence
  chemically synthesized
caagccagaagagagtgggggc

SEQ ID NO: 772117 - DNA, 22 bp, Artificial Sequence
  chemically synthesized
agaatgttgaatattggccccc

SEQ ID NO: 772118 - DNA, 22 bp, Artificial Sequence
  chemically synthesized
aagaatgttgaatattggcccc

SEQ ID NO: 772119 - DNA, 22 bp, Artificial Sequence
  chemically synthesized
taagaatgttgaatattggccc

SEQ ID NO: 772120 - DNA, 22 bp, Artificial Sequence
  chemically synthesized
tttaagaatgttgaatattggc

SEQ ID NO: 772121 - DNA, 22 bp, Artificial Sequence
  chemically synthesized
ctttaagaatgttgaatattgg

SEQ ID NO: 772122 - DNA, 22 bp, Artificial Sequence
  chemically synthesized
tctttaagaatgttgaatattg

SEQ ID NO: 772123 - DNA, 22 bp, Artificial Sequence
  chemically synthesized
ttctttaagaatgttgaatatt

SEQ ID NO: 772124 - DNA, 22 bp, Artificial Sequence
  chemically synthesized
ttttctttaagaatgttgaata

SEQ ID NO: 772125 - DNA, 22 bp, Artificial Sequence
  chemically synthesized
aaaattcttttctttaagaatg

SEQ ID NO: 772126 - DNA, 22 bp, Artificial Sequence
  chemically synthesized
ggttgaaaattcttttctttaa

SEQ ID NO: 772127 - DNA, 22 bp, Artificial Sequence
  chemically synthesized
tgggttgaaaattcttttcttt

SEQ ID NO: 772128 - DNA, 22 bp, Artificial Sequence
  chemically synthesized
aacattcttaaagaaaagaatt

SEQ ID NO: 772129 - DNA, 22 bp, Artificial Sequence
  chemically synthesized
ttaaagaaaagaattttcaacc

SEQ ID NO: 772130 - DNA, 22 bp, Artificial Sequence
  chemically synthesized
aaagaaaagaattttcaaccca

SEQ ID NO: 772131 - DNA, 22 bp, Artificial Sequence
  chemically synthesized
gatatgaaattctgggttgaaa

SEQ ID NO: 772132 - DNA, 22 bp, Artificial Sequence
  chemically synthesized
aagaaaagaattttcaacccag

SEQ ID NO: 772133 - DNA, 22 bp, Artificial Sequence
  chemically synthesized
gctggatatgaaattctgggtt

SEQ ID NO: 772134 - DNA, 22 bp, Artificial Sequence
  chemically synthesized
ggctggatatgaaattctgggt

SEQ ID NO: 772135 - DNA, 22 bp, Artificial Sequence
  chemically synthesized
gtttggctggatatgaaattct

SEQ ID NO: 772136 - DNA, 22 bp, Artificial Sequence
  chemically synthesized
agtttggctggatatgaaattc

SEQ ID NO: 772137 - DNA, 22 bp, Artificial Sequence
  chemically synthesized
tcaacccagaatttcatatcca

SEQ ID NO: 772138 - DNA, 22 bp, Artificial Sequence
  chemically synthesized
caacccagaatttcatatccag

SEQ ID NO: 772139 - DNA, 22 bp, Artificial Sequence
  chemically synthesized
aacccagaatttcatatccagc

SEQ ID NO: 772140 - DNA, 22 bp, Artificial Sequence
  chemically synthesized
tgaagcttagtttggctggata

SEQ ID NO: 772141 - DNA, 22 bp, Artificial Sequence
  chemically synthesized
atgaagcttagtttggctggat

SEQ ID NO: 772142 - DNA, 22 bp, Artificial Sequence
  chemically synthesized
acttatgaagcttagtttggct

SEQ ID NO: 772143 - DNA, 22 bp, Artificial Sequence
  chemically synthesized
cacttatgaagcttagtttggc

SEQ ID NO: 772144 - DNA, 22 bp, Artificial Sequence
  chemically synthesized
cttcacttatgaagcttagttt

SEQ ID NO: 772145 - DNA, 22 bp, Artificial Sequence
  chemically synthesized
catatccagccaaactaagctt

SEQ ID NO: 772146 - DNA, 22 bp, Artificial Sequence
  chemically synthesized
atatccagccaaactaagcttc

SEQ ID NO: 772147 - DNA, 22 bp, Artificial Sequence
  chemically synthesized
tccttcacttatgaagcttagt

SEQ ID NO: 772148 - DNA, 22 bp, Artificial Sequence
  chemically synthesized
ctccttcacttatgaagcttag

SEQ ID NO: 772149 - DNA, 22 bp, Artificial Sequence
  chemically synthesized
tttctccttcacttatgaagct

SEQ ID NO: 772150 - DNA, 22 bp, Artificial Sequence
  chemically synthesized
atttctccttcacttatgaagc

SEQ ID NO: 772151 - DNA, 22 bp, Artificial Sequence
  chemically synthesized
tatttctccttcacttatgaag

SEQ ID NO: 772152 - DNA, 22 bp, Artificial Sequence
  chemically synthesized
agcttcataagtgaaggagaaa

SEQ ID NO: 772153 - DNA, 22 bp, Artificial Sequence
  chemically synthesized
taaagtattttatttctccttc

SEQ ID NO: 772154 - DNA, 22 bp, Artificial Sequence
  chemically synthesized
tctataaagtattttatttctc

SEQ ID NO: 772155 - DNA, 22 bp, Artificial Sequence
  chemically synthesized
cataagtgaaggagaaataaaa

SEQ ID NO: 772156 - DNA, 22 bp, Artificial Sequence
  chemically synthesized
gtctataaagtattttatttct

SEQ ID NO: 772157 - DNA, 22 bp, Artificial Sequence
  chemically synthesized
ataagtgaaggagaaataaaat

SEQ ID NO: 772158 - DNA, 22 bp, Artificial Sequence
  chemically synthesized
cttgtctataaagtattttatt

SEQ ID NO: 772159 - DNA, 22 bp, Artificial Sequence
  chemically synthesized
gcttgtctataaagtattttat

SEQ ID NO: 772160 - DNA, 22 bp, Artificial Sequence
  chemically synthesized
agcatttgcttgtctataaagt

SEQ ID NO: 772161 - DNA, 22 bp, Artificial Sequence
  chemically synthesized
tcagcatttgcttgtctataaa

SEQ ID NO: 772162 - DNA, 22 bp, Artificial Sequence
  chemically synthesized
tatagacaagcaaatgctgaga

SEQ ID NO: 772163 - DNA, 22 bp, Artificial Sequence
  chemically synthesized
atagacaagcaaatgctgagag

SEQ ID NO: 772164 - DNA, 22 bp, Artificial Sequence
  chemically synthesized
tagacaagcaaatgctgagaga

SEQ ID NO: 772165 - DNA, 22 bp, Artificial Sequence
  chemically synthesized
gtggtgacaaaatctctcagca

SEQ ID NO: 772166 - DNA, 22 bp, Artificial Sequence
  chemically synthesized
gggcaggcctggtggtgacaaa

SEQ ID NO: 772167 - DNA, 22 bp, Artificial Sequence
  chemically synthesized
agggcaggcctggtggtgacaa

SEQ ID NO: 772168 - DNA, 22 bp, Artificial Sequence
  chemically synthesized
tagggcaggcctggtggtgaca

SEQ ID NO: 772169 - DNA, 22 bp, Artificial Sequence
  chemically synthesized
ttagggcaggcctggtggtgac

SEQ ID NO: 772170 - DNA, 22 bp, Artificial Sequence
  chemically synthesized
ttttagggcaggcctggtggtg

SEQ ID NO: 772171 - DNA, 22 bp, Artificial Sequence
  chemically synthesized
agagattttgtcaccaccaggc

SEQ ID NO: 772172 - DNA, 22 bp, Artificial Sequence
  chemically synthesized
aggagctcttttagggcaggcc

SEQ ID NO: 772173 - DNA, 22 bp, Artificial Sequence
  chemically synthesized
tgtcaccaccaggcctgcccta

SEQ ID NO: 772174 - DNA, 22 bp, Artificial Sequence
  chemically synthesized
caggagctcttttagggcaggc

SEQ ID NO: 772175 - DNA, 22 bp, Artificial Sequence
  chemically synthesized
gtcaccaccaggcctgccctaa

SEQ ID NO: 772176 - DNA, 22 bp, Artificial Sequence
  chemically synthesized
tcaccaccaggcctgccctaaa

SEQ ID NO: 772177 - DNA, 22 bp, Artificial Sequence
  chemically synthesized
cttcaggagctcttttagggca

SEQ ID NO: 772178 - DNA, 22 bp, Artificial Sequence
  chemically synthesized
ccttcaggagctcttttagggc

SEQ ID NO: 772179 - DNA, 22 bp, Artificial Sequence
  chemically synthesized
gcgcttccttcaggagctcttt

SEQ ID NO: 772180 - DNA, 22 bp, Artificial Sequence
  chemically synthesized
agcgcttccttcaggagctctt

SEQ ID NO: 772181 - DNA, 22 bp, Artificial Sequence
  chemically synthesized
ccctaaaagagctcctgaagga

SEQ ID NO: 772182 - DNA, 22 bp, Artificial Sequence
  chemically synthesized
catgtttagcgcttccttcagg

SEQ ID NO: 772183 - DNA, 22 bp, Artificial Sequence
  chemically synthesized
ccatgtttagcgcttccttcag

SEQ ID NO: 772184 - DNA, 22 bp, Artificial Sequence
  chemically synthesized
tccatgtttagcgcttccttca

SEQ ID NO: 772185 - DNA, 22 bp, Artificial Sequence
  chemically synthesized
aaagagctcctgaaggaagcgc

SEQ ID NO: 772186 - DNA, 22 bp, Artificial Sequence
  chemically synthesized
ctttccatgtttagcgcttcct

SEQ ID NO: 772187 - DNA, 22 bp, Artificial Sequence
  chemically synthesized
ttcctttccatgtttagcgctt

SEQ ID NO: 772188 - DNA, 22 bp, Artificial Sequence
  chemically synthesized
ctgaaggaagcgctaaacatgg

SEQ ID NO: 772189 - DNA, 22 bp, Artificial Sequence
  chemically synthesized
aaggaagcgctaaacatggaaa

SEQ ID NO: 772190 - DNA, 22 bp, Artificial Sequence
  chemically synthesized
gtaccggttgttcctttccatg

SEQ ID NO: 772191 - DNA, 22 bp, Artificial Sequence
  chemically synthesized
cagcggctggtaccggttgttc

SEQ ID NO: 772192 - DNA, 22 bp, Artificial Sequence
  chemically synthesized
aacatggaaaggaacaaccggt

SEQ ID NO: 772193 - DNA, 22 bp, Artificial Sequence
  chemically synthesized
gcagcggctggtaccggttgtt

SEQ ID NO: 772194 - DNA, 22 bp, Artificial Sequence
  chemically synthesized
tgcagcggctggtaccggttgt

SEQ ID NO: 772195 - DNA, 22 bp, Artificial Sequence
  chemically synthesized
gcatgattttgcagcggctggt

SEQ ID NO: 772196 - DNA, 22 bp, Artificial Sequence
  chemically synthesized
ggcatgattttgcagcggctgg

SEQ ID NO: 772197 - DNA, 22 bp, Artificial Sequence
  chemically synthesized
tggcatgattttgcagcggctg

SEQ ID NO: 772198 - DNA, 22 bp, Artificial Sequence
  chemically synthesized
cattttggcatgattttgcagc

SEQ ID NO: 772199 - DNA, 22 bp, Artificial Sequence
  chemically synthesized
acattttggcatgattttgcag

SEQ ID NO: 772200 - DNA, 22 bp, Artificial Sequence
  chemically synthesized
tacattttggcatgattttgca

SEQ ID NO: 772201 - DNA, 22 bp, Artificial Sequence
  chemically synthesized
gatggtctttacattttggcat

SEQ ID NO: 772202 - DNA, 22 bp, Artificial Sequence
  chemically synthesized
caaaatcatgccaaaatgtaaa

SEQ ID NO: 772203 - DNA, 22 bp, Artificial Sequence
  chemically synthesized
gtctcgatggtctttacatttt

SEQ ID NO: 772204 - DNA, 22 bp, Artificial Sequence
  chemically synthesized
ctagtctcgatggtctttacat

SEQ ID NO: 772205 - DNA, 22 bp, Artificial Sequence
  chemically synthesized
cctagtctcgatggtctttaca

SEQ ID NO: 772206 - DNA, 22 bp, Artificial Sequence
  chemically synthesized
ttcctagtctcgatggtcttta

SEQ ID NO: 772207 - DNA, 22 bp, Artificial Sequence
  chemically synthesized
cttcctagtctcgatggtcttt

SEQ ID NO: 772208 - DNA, 22 bp, Artificial Sequence
  chemically synthesized
atgcagtttcttcctagtctcg

SEQ ID NO: 772209 - DNA, 22 bp, Artificial Sequence
  chemically synthesized
gttgatgcagtttcttcctagt

SEQ ID NO: 772210 - DNA, 22 bp, Artificial Sequence
  chemically synthesized
attagttgatgcagtttcttcc

SEQ ID NO: 772211 - DNA, 22 bp, Artificial Sequence
  chemically synthesized
ctcattagttgatgcagtttct

SEQ ID NO: 772212 - DNA, 22 bp, Artificial Sequence
  chemically synthesized
gctcattagttgatgcagtttc

SEQ ID NO: 772213 - DNA, 22 bp, Artificial Sequence
  chemically synthesized
tgctcattagttgatgcagttt

SEQ ID NO: 772214 - DNA, 22 bp, Artificial Sequence
  chemically synthesized
ggaagaaactgcatcaactaat

SEQ ID NO: 772215 - DNA, 22 bp, Artificial Sequence
  chemically synthesized
gtgattttgctcattagttgat

SEQ ID NO: 772216 - DNA, 22 bp, Artificial Sequence
  chemically synthesized
gctggtgattttgctcattagt

SEQ ID NO: 772217 - DNA, 22 bp, Artificial Sequence
  chemically synthesized
catcaactaatgagcaaaatca

SEQ ID NO: 772218 - DNA, 22 bp, Artificial Sequence
  chemically synthesized
tgatgttagctggtgattttgc

SEQ ID NO: 772219 - DNA, 22 bp, Artificial Sequence
  chemically synthesized
tcattatgatgttagctggtga

SEQ ID NO: 772220 - DNA, 22 bp, Artificial Sequence
  chemically synthesized
atgagcaaaatcaccagctaac

SEQ ID NO: 772221 - DNA, 22 bp, Artificial Sequence
  chemically synthesized
atcctgtcattatgatgttagc

SEQ ID NO: 772222 - DNA, 22 bp, Artificial Sequence
  chemically synthesized
gatcctgtcattatgatgttag

SEQ ID NO: 772223 - DNA, 22 bp, Artificial Sequence
  chemically synthesized
tgtgtgaatttgatcctgtcat

SEQ ID NO: 772224 - DNA, 22 bp, Artificial Sequence
  chemically synthesized
ttatgtgtgaatttgatcctgt

SEQ ID NO: 772225 - DNA, 22 bp, Artificial Sequence
  chemically synthesized
acatcataatgacaggatcaaa

SEQ ID NO: 772226 - DNA, 22 bp, Artificial Sequence
  chemically synthesized
atattgttatgtgtgaatttga

SEQ ID NO: 772227 - DNA, 22 bp, Artificial Sequence
  chemically synthesized
aagttaatattgttatgtgtga

SEQ ID NO: 772228 - DNA, 22 bp, Artificial Sequence
  chemically synthesized
aaagttaatattgttatgtgtg

SEQ ID NO: 772229 - DNA, 22 bp, Artificial Sequence
  chemically synthesized
tatttaaagttaatattgttat

SEQ ID NO: 772230 - DNA, 22 bp, Artificial Sequence
  chemically synthesized
atatttaaagttaatattgtta

SEQ ID NO: 772231 - DNA, 22 bp, Artificial Sequence
  chemically synthesized
acacataacaatattaacttta

SEQ ID NO: 772232 - DNA, 22 bp, Artificial Sequence
  chemically synthesized
gtccatttatatttaaagttaa

SEQ ID NO: 772233 - DNA, 22 bp, Artificial Sequence
  chemically synthesized
agtccatttatatttaaagtta

SEQ ID NO: 772234 - DNA, 22 bp, Artificial Sequence
  chemically synthesized
cagaatttagtccatttatatt

SEQ ID NO: 772235 - DNA, 22 bp, Artificial Sequence
  chemically synthesized
attgcagaatttagtccattta

SEQ ID NO: 772236 - DNA, 22 bp, Artificial Sequence
  chemically synthesized
aattgcagaatttagtccattt

SEQ ID NO: 772237 - DNA, 22 bp, Artificial Sequence
  chemically synthesized
actttaaatataaatggactaa

SEQ ID NO: 772238 - DNA, 22 bp, Artificial Sequence
  chemically synthesized
taattgcagaatttagtccatt

SEQ ID NO: 772239 - DNA, 22 bp, Artificial Sequence
  chemically synthesized
ttaattgcagaatttagtccat

SEQ ID NO: 772240 - DNA, 22 bp, Artificial Sequence
  chemically synthesized
taaatataaatggactaaattc

SEQ ID NO: 772241 - DNA, 22 bp, Artificial Sequence
  chemically synthesized
aaatataaatggactaaattct

SEQ ID NO: 772242 - DNA, 22 bp, Artificial Sequence
  chemically synthesized
aatataaatggactaaattctg

SEQ ID NO: 772243 - DNA, 22 bp, Artificial Sequence
  chemically synthesized
tgtcttttaattgcagaattta

SEQ ID NO: 772244 - DNA, 22 bp, Artificial Sequence
  chemically synthesized
ccagtctgtgtcttttaattgc

SEQ ID NO: 772245 - DNA, 22 bp, Artificial Sequence
  chemically synthesized
gccagtctgtgtcttttaattg

SEQ ID NO: 772246 - DNA, 22 bp, Artificial Sequence
  chemically synthesized
aattctgcaattaaaagacaca

SEQ ID NO: 772247 - DNA, 22 bp, Artificial Sequence
  chemically synthesized
tccaacttgccagtctgtgtct

SEQ ID NO: 772248 - DNA, 22 bp, Artificial Sequence
  chemically synthesized
atccaacttgccagtctgtgtc

SEQ ID NO: 772249 - DNA, 22 bp, Artificial Sequence
  chemically synthesized
tgcaattaaaagacacagactg

SEQ ID NO: 772250 - DNA, 22 bp, Artificial Sequence
  chemically synthesized
tatccaacttgccagtctgtgt

SEQ ID NO: 772251 - DNA, 22 bp, Artificial Sequence
  chemically synthesized
caattaaaagacacagactggc

SEQ ID NO: 772252 - DNA, 22 bp, Artificial Sequence
  chemically synthesized
tttatccaacttgccagtctgt

SEQ ID NO: 772253 - DNA, 22 bp, Artificial Sequence
  chemically synthesized
actctttatccaacttgccagt

SEQ ID NO: 772254 - DNA, 22 bp, Artificial Sequence
  chemically synthesized
gactctttatccaacttgccag

SEQ ID NO: 772255 - DNA, 22 bp, Artificial Sequence
  chemically synthesized
aaagacacagactggcaagttg

SEQ ID NO: 772256 - DNA, 22 bp, Artificial Sequence
  chemically synthesized
atgggtcttgactctttatcca

SEQ ID NO: 772257 - DNA, 22 bp, Artificial Sequence
  chemically synthesized
gcaagttggataaagagtcaag

SEQ ID NO: 772258 - DNA, 22 bp, Artificial Sequence
  chemically synthesized
gataaagagtcaagacccatca

SEQ ID NO: 772259 - DNA, 22 bp, Artificial Sequence
  chemically synthesized
aatacagcacactgatgggtct

SEQ ID NO: 772260 - DNA, 22 bp, Artificial Sequence
  chemically synthesized
ctgaatacagcacactgatggg

SEQ ID NO: 772261 - DNA, 22 bp, Artificial Sequence
  chemically synthesized
cctgaatacagcacactgatgg

SEQ ID NO: 772262 - DNA, 22 bp, Artificial Sequence
  chemically synthesized
cacgtgagatgggtttcctgaa

SEQ ID NO: 772263 - DNA, 22 bp, Artificial Sequence
  chemically synthesized
tgcacgtgagatgggtttcctg

SEQ ID NO: 772264 - DNA, 22 bp, Artificial Sequence
  chemically synthesized
tattcaggaaacccatctcacg

SEQ ID NO: 772265 - DNA, 22 bp, Artificial Sequence
  chemically synthesized
tgtgtgtctctgcacgtgagat

SEQ ID NO: 772266 - DNA, 22 bp, Artificial Sequence
  chemically synthesized
aggaaacccatctcacgtgcag

SEQ ID NO: 772267 - DNA, 22 bp, Artificial Sequence
  chemically synthesized
agcctatgtgtgtctctgcacg

SEQ ID NO: 772268 - DNA, 22 bp, Artificial Sequence
  chemically synthesized
gagcctatgtgtgtctctgcac

SEQ ID NO: 772269 - DNA, 22 bp, Artificial Sequence
  chemically synthesized
tgagcctatgtgtgtctctgca

SEQ ID NO: 772270 - DNA, 22 bp, Artificial Sequence
  chemically synthesized
ttttgagcctatgtgtgtctct

SEQ ID NO: 772271 - DNA, 22 bp, Artificial Sequence
  chemically synthesized
attttgagcctatgtgtgtctc

SEQ ID NO: 772272 - DNA, 22 bp, Artificial Sequence
  chemically synthesized
tattttgagcctatgtgtgtct

SEQ ID NO: 772273 - DNA, 22 bp, Artificial Sequence
  chemically synthesized
ttattttgagcctatgtgtgtc

SEQ ID NO: 772274 - DNA, 22 bp, Artificial Sequence
  chemically synthesized
acgtgcagagacacacataggc

SEQ ID NO: 772275 - DNA, 22 bp, Artificial Sequence
  chemically synthesized
catccttttattttgagcctat

SEQ ID NO: 772276 - DNA, 22 bp, Artificial Sequence
  chemically synthesized
ctccatccttttattttgagcc

SEQ ID NO: 772277 - DNA, 22 bp, Artificial Sequence
  chemically synthesized
cctccatccttttattttgagc

SEQ ID NO: 772278 - DNA, 22 bp, Artificial Sequence
  chemically synthesized
gtagatcttcctccatcctttt

SEQ ID NO: 772279 - DNA, 22 bp, Artificial Sequence
  chemically synthesized
ggtagatcttcctccatccttt

SEQ ID NO: 772280 - DNA, 22 bp, Artificial Sequence
  chemically synthesized
cttggtagatcttcctccatcc

SEQ ID NO: 772281 - DNA, 22 bp, Artificial Sequence
  chemically synthesized
gcttggtagatcttcctccatc

SEQ ID NO: 772282 - DNA, 22 bp, Artificial Sequence
  chemically synthesized
aaaataaaaggatggaggaaga

SEQ ID NO: 772283 - DNA, 22 bp, Artificial Sequence
  chemically synthesized
catttgcttggtagatcttcct

SEQ ID NO: 772284 - DNA, 22 bp, Artificial Sequence
  chemically synthesized
ccatttgcttggtagatcttcc

SEQ ID NO: 772285 - DNA, 22 bp, Artificial Sequence
  chemically synthesized
tccatttgcttggtagatcttc

SEQ ID NO: 772286 - DNA, 22 bp, Artificial Sequence
  chemically synthesized
ttttccatttgcttggtagatc

SEQ ID NO: 772287 - DNA, 22 bp, Artificial Sequence
  chemically synthesized
gttttccatttgcttggtagat

SEQ ID NO: 772288 - DNA, 22 bp, Artificial Sequence
  chemically synthesized
tgttttccatttgcttggtaga

SEQ ID NO: 772289 - DNA, 22 bp, Artificial Sequence
  chemically synthesized
ttgttttccatttgcttggtag

SEQ ID NO: 772290 - DNA, 22 bp, Artificial Sequence
  chemically synthesized
tttgttttccatttgcttggta

SEQ ID NO: 772291 - DNA, 22 bp, Artificial Sequence
  chemically synthesized
ttttgttttccatttgcttggt

SEQ ID NO: 772292 - DNA, 22 bp, Artificial Sequence
  chemically synthesized
tttttgttttccatttgcttgg

SEQ ID NO: 772293 - DNA, 22 bp, Artificial Sequence
  chemically synthesized
cctttttttgttttccatttgc

SEQ ID NO: 772294 - DNA, 22 bp, Artificial Sequence
  chemically synthesized
ccaagcaaatggaaaacaaaaa

SEQ ID NO: 772295 - DNA, 22 bp, Artificial Sequence
  chemically synthesized
caacccctgcctttttttgttt

SEQ ID NO: 772296 - DNA, 22 bp, Artificial Sequence
  chemically synthesized
ggattgcaacccctgccttttt

SEQ ID NO: 772297 - DNA, 22 bp, Artificial Sequence
  chemically synthesized
tcagagactaggattgcaaccc

SEQ ID NO: 772298 - DNA, 22 bp, Artificial Sequence
  chemically synthesized
atcagagactaggattgcaacc

SEQ ID NO: 772299 - DNA, 22 bp, Artificial Sequence
  chemically synthesized
tatcagagactaggattgcaac

SEQ ID NO: 772300 - DNA, 22 bp, Artificial Sequence
  chemically synthesized
ttttatcagagactaggattgc

SEQ ID NO: 772301 - DNA, 22 bp, Artificial Sequence
  chemically synthesized
aagtctgttttatcagagacta

SEQ ID NO: 772302 - DNA, 22 bp, Artificial Sequence
  chemically synthesized
aaagtctgttttatcagagact

SEQ ID NO: 772303 - DNA, 22 bp, Artificial Sequence
  chemically synthesized
gtttaaagtctgttttatcaga

SEQ ID NO: 772304 - DNA, 22 bp, Artificial Sequence
  chemically synthesized
caatcctagtctctgataaaac

SEQ ID NO: 772305 - DNA, 22 bp, Artificial Sequence
  chemically synthesized
ttggtttaaagtctgttttatc

SEQ ID NO: 772306 - DNA, 22 bp, Artificial Sequence
  chemically synthesized
gttggtttaaagtctgttttat

SEQ ID NO: 772307 - DNA, 22 bp, Artificial Sequence
  chemically synthesized
tgttggtttaaagtctgtttta

SEQ ID NO: 772308 - DNA, 22 bp, Artificial Sequence
  chemically synthesized
gtctctgataaaacagacttta

SEQ ID NO: 772309 - DNA, 22 bp, Artificial Sequence
  chemically synthesized
atctttgttggtttaaagtctg

SEQ ID NO: 772310 - DNA, 22 bp, Artificial Sequence
  chemically synthesized
gatctttgttggtttaaagtct

SEQ ID NO: 772311 - DNA, 22 bp, Artificial Sequence
  chemically synthesized
tgatctttgttggtttaaagtc

SEQ ID NO: 772312 - DNA, 22 bp, Artificial Sequence
  chemically synthesized
ttgatctttgttggtttaaagt

SEQ ID NO: 772313 - DNA, 22 bp, Artificial Sequence
  chemically synthesized
tgataaaacagactttaaacca

SEQ ID NO: 772314 - DNA, 22 bp, Artificial Sequence
  chemically synthesized
ttttgatctttgttggtttaaa

SEQ ID NO: 772315 - DNA, 22 bp, Artificial Sequence
  chemically synthesized
ataaaacagactttaaaccaac

SEQ ID NO: 772316 - DNA, 22 bp, Artificial Sequence
  chemically synthesized
tctcttttgatctttgttggtt

SEQ ID NO: 772317 - DNA, 22 bp, Artificial Sequence
  chemically synthesized
gtctcttttgatctttgttggt

SEQ ID NO: 772318 - DNA, 22 bp, Artificial Sequence
  chemically synthesized
tgtctcttttgatctttgttgg

SEQ ID NO: 772319 - DNA, 22 bp, Artificial Sequence
  chemically synthesized
tttgtctcttttgatctttgtt

SEQ ID NO: 772320 - DNA, 22 bp, Artificial Sequence
  chemically synthesized
ctttgtctcttttgatctttgt

SEQ ID NO: 772321 - DNA, 22 bp, Artificial Sequence
  chemically synthesized
taaaccaacaaagatcaaaaga

SEQ ID NO: 772322 - DNA, 22 bp, Artificial Sequence
  chemically synthesized
aaaccaacaaagatcaaaagag

SEQ ID NO: 772323 - DNA, 22 bp, Artificial Sequence
  chemically synthesized
aaccaacaaagatcaaaagaga

SEQ ID NO: 772324 - DNA, 22 bp, Artificial Sequence
  chemically synthesized
tgtaatggccttctttgtctct

SEQ ID NO: 772325 - DNA, 22 bp, Artificial Sequence
  chemically synthesized
ccattatgtaatggccttcttt

SEQ ID NO: 772326 - DNA, 22 bp, Artificial Sequence
  chemically synthesized
accattatgtaatggccttctt

SEQ ID NO: 772327 - DNA, 22 bp, Artificial Sequence
  chemically synthesized
taccattatgtaatggccttct

SEQ ID NO: 772328 - DNA, 22 bp, Artificial Sequence
  chemically synthesized
atccctttaccattatgtaatg

SEQ ID NO: 772329 - DNA, 22 bp, Artificial Sequence
  chemically synthesized
aattgatccctttaccattatg

SEQ ID NO: 772330 - DNA, 22 bp, Artificial Sequence
  chemically synthesized
ttgaattgatccctttaccatt

SEQ ID NO: 772331 - DNA, 22 bp, Artificial Sequence
  chemically synthesized
gttgaattgatccctttaccat

SEQ ID NO: 772332 - DNA, 22 bp, Artificial Sequence
  chemically synthesized
ttgttgaattgatccctttacc

SEQ ID NO: 772333 - DNA, 22 bp, Artificial Sequence
  chemically synthesized
ctcttgttgaattgatcccttt

SEQ ID NO: 772334 - DNA, 22 bp, Artificial Sequence
  chemically synthesized
cataatggtaaagggatcaatt

SEQ ID NO: 772335 - DNA, 22 bp, Artificial Sequence
  chemically synthesized
gctcctcttgttgaattgatcc

SEQ ID NO: 772336 - DNA, 22 bp, Artificial Sequence
  chemically synthesized
ggatagttagctcctcttgttg

SEQ ID NO: 772337 - DNA, 22 bp, Artificial Sequence
  chemically synthesized
aggatagttagctcctcttgtt

SEQ ID NO: 772338 - DNA, 22 bp, Artificial Sequence
  chemically synthesized
aacaagaggagctaactatcct

SEQ ID NO: 772339 - DNA, 22 bp, Artificial Sequence
  chemically synthesized
ggtgcataaatatttaggatag

SEQ ID NO: 772340 - DNA, 22 bp, Artificial Sequence
  chemically synthesized
tattgggtgcataaatatttag

SEQ ID NO: 772341 - DNA, 22 bp, Artificial Sequence
  chemically synthesized
ctgtattgggtgcataaatatt

SEQ ID NO: 772342 - DNA, 22 bp, Artificial Sequence
  chemically synthesized
actatcctaaatatttatgcac

SEQ ID NO: 772343 - DNA, 22 bp, Artificial Sequence
  chemically synthesized
tcctaaatatttatgcacccaa

SEQ ID NO: 772344 - DNA, 22 bp, Artificial Sequence
  chemically synthesized
ggtgctcctgtattgggtgcat

SEQ ID NO: 772345 - DNA, 22 bp, Artificial Sequence
  chemically synthesized
aatatttatgcacccaatacag

SEQ ID NO: 772346 - DNA, 22 bp, Artificial Sequence
  chemically synthesized
tgaatctgggtgctcctgtatt

SEQ ID NO: 772347 - DNA, 22 bp, Artificial Sequence
  chemically synthesized
atgaatctgggtgctcctgtat

SEQ ID NO: 772348 - DNA, 22 bp, Artificial Sequence
  chemically synthesized
tatgaatctgggtgctcctgta

SEQ ID NO: 772349 - DNA, 22 bp, Artificial Sequence
  chemically synthesized
atgcacccaatacaggagcacc

SEQ ID NO: 772350 - DNA, 22 bp, Artificial Sequence
  chemically synthesized
tgcacccaatacaggagcaccc

SEQ ID NO: 772351 - DNA, 22 bp, Artificial Sequence
  chemically synthesized
ctttatgaatctgggtgctcct

SEQ ID NO: 772352 - DNA, 22 bp, Artificial Sequence
  chemically synthesized
gctttatgaatctgggtgctcc

SEQ ID NO: 772353 - DNA, 22 bp, Artificial Sequence
  chemically synthesized
aggacttgctttatgaatctgg

SEQ ID NO: 772354 - DNA, 22 bp, Artificial Sequence
  chemically synthesized
taggtcactcaggacttgcttt

SEQ ID NO: 772355 - DNA, 22 bp, Artificial Sequence
  chemically synthesized
gtaggtcactcaggacttgctt

SEQ ID NO: 772356 - DNA, 22 bp, Artificial Sequence
  chemically synthesized
tgtaggtcactcaggacttgct

SEQ ID NO: 772357 - DNA, 22 bp, Artificial Sequence
  chemically synthesized
tttgtaggtcactcaggacttg

SEQ ID NO: 772358 - DNA, 22 bp, Artificial Sequence
  chemically synthesized
ataaagcaagtcctgagtgacc

SEQ ID NO: 772359 - DNA, 22 bp, Artificial Sequence
  chemically synthesized
agtctctttgtaggtcactcag

SEQ ID NO: 772360 - DNA, 22 bp, Artificial Sequence
  chemically synthesized
agtgacctacaaagagacttag

SEQ ID NO: 772361 - DNA, 22 bp, Artificial Sequence
  chemically synthesized
atgtgtgggagtctaagtctct

SEQ ID NO: 772362 - DNA, 22 bp, Artificial Sequence
  chemically synthesized
ttaatgtgtgggagtctaagtc

SEQ ID NO: 772363 - DNA, 22 bp, Artificial Sequence
  chemically synthesized
caaagagacttagactcccaca

SEQ ID NO: 772364 - DNA, 22 bp, Artificial Sequence
  chemically synthesized
ccattattaatgtgtgggagtc

SEQ ID NO: 772365 - DNA, 22 bp, Artificial Sequence
  chemically synthesized
aagtctcccattattaatgtgt

SEQ ID NO: 772366 - DNA, 22 bp, Artificial Sequence
  chemically synthesized
agactcccacacattaataatg

SEQ ID NO: 772367 - DNA, 22 bp, Artificial Sequence
  chemically synthesized
gactcccacacattaataatgg

SEQ ID NO: 772368 - DNA, 22 bp, Artificial Sequence
  chemically synthesized
ccacacattaataatgggagac

SEQ ID NO: 772369 - DNA, 22 bp, Artificial Sequence
  chemically synthesized
acagtggggtgttaaagtctcc

SEQ ID NO: 772370 - DNA, 22 bp, Artificial Sequence
  chemically synthesized
ataatgggagactttaacaccc

SEQ ID NO: 772371 - DNA, 22 bp, Artificial Sequence
  chemically synthesized
atgttgacagtggggtgttaaa

SEQ ID NO: 772372 - DNA, 22 bp, Artificial Sequence
  chemically synthesized
tctaatgttgacagtggggtgt

SEQ ID NO: 772373 - DNA, 22 bp, Artificial Sequence
  chemically synthesized
atctgtctaatgttgacagtgg

SEQ ID NO: 772374 - DNA, 22 bp, Artificial Sequence
  chemically synthesized
gttgatctgtctaatgttgaca

SEQ ID NO: 772375 - DNA, 22 bp, Artificial Sequence
  chemically synthesized
taacaccccactgtcaacatta

SEQ ID NO: 772376 - DNA, 22 bp, Artificial Sequence
  chemically synthesized
aacaccccactgtcaacattag

SEQ ID NO: 772377 - DNA, 22 bp, Artificial Sequence
  chemically synthesized
acaccccactgtcaacattaga

SEQ ID NO: 772378 - DNA, 22 bp, Artificial Sequence
  chemically synthesized
tctcgttgatctgtctaatgtt

SEQ ID NO: 772379 - DNA, 22 bp, Artificial Sequence
  chemically synthesized
tgtctcgttgatctgtctaatg

SEQ ID NO: 772380 - DNA, 22 bp, Artificial Sequence
  chemically synthesized
ctgtctcgttgatctgtctaat

SEQ ID NO: 772381 - DNA, 22 bp, Artificial Sequence
  chemically synthesized
tctgtctcgttgatctgtctaa

SEQ ID NO: 772382 - DNA, 22 bp, Artificial Sequence
  chemically synthesized
actttctgtctcgttgatctgt

SEQ ID NO: 772383 - DNA, 22 bp, Artificial Sequence
  chemically synthesized
tcaacattagacagatcaacga

SEQ ID NO: 772384 - DNA, 22 bp, Artificial Sequence
  chemically synthesized
ttgactttctgtctcgttgatc

SEQ ID NO: 772385 - DNA, 22 bp, Artificial Sequence
  chemically synthesized
gttgactttctgtctcgttgat

SEQ ID NO: 772386 - DNA, 22 bp, Artificial Sequence
  chemically synthesized
gacagatcaacgagacagaaag

SEQ ID NO: 772387 - DNA, 22 bp, Artificial Sequence
  chemically synthesized
ggtatccttgttgactttctgt

SEQ ID NO: 772388 - DNA, 22 bp, Artificial Sequence
  chemically synthesized
ctgggtatccttgttgactttc

SEQ ID NO: 772389 - DNA, 22 bp, Artificial Sequence
  chemically synthesized
aattcctgggtatccttgttga

SEQ ID NO: 772390 - DNA, 22 bp, Artificial Sequence
  chemically synthesized
agttcaattcctgggtatcctt

SEQ ID NO: 772391 - DNA, 22 bp, Artificial Sequence
  chemically synthesized
gtgcagagctgagttcaattcc

SEQ ID NO: 772392 - DNA, 22 bp, Artificial Sequence
  chemically synthesized
ggtgcagagctgagttcaattc

SEQ ID NO: 772393 - DNA, 22 bp, Artificial Sequence
  chemically synthesized
cttggtgcagagctgagttcaa

SEQ ID NO: 772394 - DNA, 22 bp, Artificial Sequence
  chemically synthesized
ggtctccttggtgcagagctga

SEQ ID NO: 772395 - DNA, 22 bp, Artificial Sequence
  chemically synthesized
ttaggtctccttggtgcagagc

SEQ ID NO: 772396 - DNA, 22 bp, Artificial Sequence
  chemically synthesized
aactcagctctgcaccaaggag

SEQ ID NO: 772397 - DNA, 22 bp, Artificial Sequence
  chemically synthesized
tagatgtctattaggtctcctt

SEQ ID NO: 772398 - DNA, 22 bp, Artificial Sequence
  chemically synthesized
agctctgcaccaaggagaccta

SEQ ID NO: 772399 - DNA, 22 bp, Artificial Sequence
  chemically synthesized
tgtagatgtctattaggtctcc

SEQ ID NO: 772400 - DNA, 22 bp, Artificial Sequence
  chemically synthesized
tgcaccaaggagacctaataga

SEQ ID NO: 772401 - DNA, 22 bp, Artificial Sequence
  chemically synthesized
caccaaggagacctaatagaca

SEQ ID NO: 772402 - DNA, 22 bp, Artificial Sequence
  chemically synthesized
gggtggagagttctgtagatgt

SEQ ID NO: 772403 - DNA, 22 bp, Artificial Sequence
  chemically synthesized
ggggtggagagttctgtagatg

SEQ ID NO: 772404 - DNA, 22 bp, Artificial Sequence
  chemically synthesized
atttggggtggagagttctgta

SEQ ID NO: 772405 - DNA, 22 bp, Artificial Sequence
  chemically synthesized
atagacatctacagaactctcc

SEQ ID NO: 772406 - DNA, 22 bp, Artificial Sequence
  chemically synthesized
ttgatttggggtggagagttct

SEQ ID NO: 772407 - DNA, 22 bp, Artificial Sequence
  chemically synthesized
tgttgatttggggtggagagtt

SEQ ID NO: 772408 - DNA, 22 bp, Artificial Sequence
  chemically synthesized
cagaactctccaccccaaatca

SEQ ID NO: 772409 - DNA, 22 bp, Artificial Sequence
  chemically synthesized
aaaaaaatgtatattctgttga

SEQ ID NO: 772410 - DNA, 22 bp, Artificial Sequence
  chemically synthesized
tccaccccaaatcaacagaata

SEQ ID NO: 772411 - DNA, 22 bp, Artificial Sequence
  chemically synthesized
caccccaaatcaacagaatata

SEQ ID NO: 772412 - DNA, 22 bp, Artificial Sequence
  chemically synthesized
gaataggtgtggtgtggtgctg

SEQ ID NO: 772413 - DNA, 22 bp, Artificial Sequence
  chemically synthesized
ggaataggtgtggtgtggtgct

SEQ ID NO: 772414 - DNA, 22 bp, Artificial Sequence
  chemically synthesized
tggaataggtgtggtgtggtgc

SEQ ID NO: 772415 - DNA, 22 bp, Artificial Sequence
  chemically synthesized
ttttcagcaccacaccacacct

SEQ ID NO: 772416 - DNA, 22 bp, Artificial Sequence
  chemically synthesized
tttcagcaccacaccacaccta

SEQ ID NO: 772417 - DNA, 22 bp, Artificial Sequence
  chemically synthesized
ttcagcaccacaccacacctat

SEQ ID NO: 772418 - DNA, 22 bp, Artificial Sequence
  chemically synthesized
tcagcaccacaccacacctatt

SEQ ID NO: 772419 - DNA, 22 bp, Artificial Sequence
  chemically synthesized
cagcaccacaccacacctattc

SEQ ID NO: 772420 - DNA, 22 bp, Artificial Sequence
  chemically synthesized
agcaccacaccacacctattcc

SEQ ID NO: 772421 - DNA, 22 bp, Artificial Sequence
  chemically synthesized
caagtatgtggtcaattttgga

SEQ ID NO: 772422 - DNA, 22 bp, Artificial Sequence
  chemically synthesized
ccaagtatgtggtcaattttgg

SEQ ID NO: 772423 - DNA, 22 bp, Artificial Sequence
  chemically synthesized
cttccaagtatgtggtcaattt

SEQ ID NO: 772424 - DNA, 22 bp, Artificial Sequence
  chemically synthesized
acttccaagtatgtggtcaatt

SEQ ID NO: 772425 - DNA, 22 bp, Artificial Sequence
  chemically synthesized
tacttccaagtatgtggtcaat

SEQ ID NO: 772426 - DNA, 22 bp, Artificial Sequence
  chemically synthesized
ttccaaaattgaccacatactt

SEQ ID NO: 772427 - DNA, 22 bp, Artificial Sequence
  chemically synthesized
caaaattgaccacatacttgga

SEQ ID NO: 772428 - DNA, 22 bp, Artificial Sequence
  chemically synthesized
aggagagctttacttccaagta

SEQ ID NO: 772429 - DNA, 22 bp, Artificial Sequence
  chemically synthesized
ctgaggagagctttacttccaa

SEQ ID NO: 772430 - DNA, 22 bp, Artificial Sequence
  chemically synthesized
gctgaggagagctttacttcca

SEQ ID NO: 772431 - DNA, 22 bp, Artificial Sequence
  chemically synthesized
accacatacttggaagtaaagc

SEQ ID NO: 772432 - DNA, 22 bp, Artificial Sequence
  chemically synthesized
catttgctgaggagagctttac

SEQ ID NO: 772433 - DNA, 22 bp, Artificial Sequence
  chemically synthesized
acatttgctgaggagagcttta

SEQ ID NO: 772434 - DNA, 22 bp, Artificial Sequence
  chemically synthesized
tacatttgctgaggagagcttt

SEQ ID NO: 772435 - DNA, 22 bp, Artificial Sequence
  chemically synthesized
ttacatttgctgaggagagctt

SEQ ID NO: 772436 - DNA, 22 bp, Artificial Sequence
  chemically synthesized
ttttacatttgctgaggagagc

SEQ ID NO: 772437 - DNA, 22 bp, Artificial Sequence
  chemically synthesized
ggaagtaaagctctcctcagca

SEQ ID NO: 772438 - DNA, 22 bp, Artificial Sequence
  chemically synthesized
ttcttttacatttgctgaggag

SEQ ID NO: 772439 - DNA, 22 bp, Artificial Sequence
  chemically synthesized
gaagtaaagctctcctcagcaa

SEQ ID NO: 772440 - DNA, 22 bp, Artificial Sequence
  chemically synthesized
tgttcttttacatttgctgagg

SEQ ID NO: 772441 - DNA, 22 bp, Artificial Sequence
  chemically synthesized
ctgttcttttacatttgctgag

SEQ ID NO: 772442 - DNA, 22 bp, Artificial Sequence
  chemically synthesized
taatttctgttcttttacattt

SEQ ID NO: 772443 - DNA, 22 bp, Artificial Sequence
  chemically synthesized
ttataatttctgttcttttaca

SEQ ID NO: 772444 - DNA, 22 bp, Artificial Sequence
  chemically synthesized
tcctcagcaaatgtaaaagaac

SEQ ID NO: 772445 - DNA, 22 bp, Artificial Sequence
  chemically synthesized
gttataatttctgttcttttac

SEQ ID NO: 772446 - DNA, 22 bp, Artificial Sequence
  chemically synthesized
ctcagcaaatgtaaaagaacag

SEQ ID NO: 772447 - DNA, 22 bp, Artificial Sequence
  chemically synthesized
agcaaatgtaaaagaacagaaa

SEQ ID NO: 772448 - DNA, 22 bp, Artificial Sequence
  chemically synthesized
agagatagtttgttataatttc

SEQ ID NO: 772449 - DNA, 22 bp, Artificial Sequence
  chemically synthesized
tggtctgagagatagtttgtta

SEQ ID NO: 772450 - DNA, 22 bp, Artificial Sequence
  chemically synthesized
cactgtggtctgagagatagtt

SEQ ID NO: 772451 - DNA, 22 bp, Artificial Sequence
  chemically synthesized
attgcactgtggtctgagagat

SEQ ID NO: 772452 - DNA, 22 bp, Artificial Sequence
  chemically synthesized
gattgcactgtggtctgagaga

SEQ ID NO: 772453 - DNA, 22 bp, Artificial Sequence
  chemically synthesized
taacaaactatctctcagacca

SEQ ID NO: 772454 - DNA, 22 bp, Artificial Sequence
  chemically synthesized
gtttgattgcactgtggtctga

SEQ ID NO: 772455 - DNA, 22 bp, Artificial Sequence
  chemically synthesized
tagtttgattgcactgtggtct

SEQ ID NO: 772456 - DNA, 22 bp, Artificial Sequence
  chemically synthesized
agttctagtttgattgcactgt

SEQ ID NO: 772457 - DNA, 22 bp, Artificial Sequence
  chemically synthesized
tctctcagaccacagtgcaatc

SEQ ID NO: 772458 - DNA, 22 bp, Artificial Sequence
  chemically synthesized
tcagaccacagtgcaatcaaac

SEQ ID NO: 772459 - DNA, 22 bp, Artificial Sequence
  chemically synthesized
atcctgagttctagtttgattg

SEQ ID NO: 772460 - DNA, 22 bp, Artificial Sequence
  chemically synthesized
agaccacagtgcaatcaaacta

SEQ ID NO: 772461 - DNA, 22 bp, Artificial Sequence
  chemically synthesized
aatcctgagttctagtttgatt

SEQ ID NO: 772462 - DNA, 22 bp, Artificial Sequence
  chemically synthesized
ttaatcctgagttctagtttga

SEQ ID NO: 772463 - DNA, 22 bp, Artificial Sequence
  chemically synthesized
agtgagattcttaatcctgagt

SEQ ID NO: 772464 - DNA, 22 bp, Artificial Sequence
  chemically synthesized
gagtgagattcttaatcctgag

SEQ ID NO: 772465 - DNA, 22 bp, Artificial Sequence
  chemically synthesized
tgagtgagattcttaatcctga

SEQ ID NO: 772466 - DNA, 22 bp, Artificial Sequence
  chemically synthesized
gaactcaggattaagaatctca

SEQ ID NO: 772467 - DNA, 22 bp, Artificial Sequence
  chemically synthesized
agcggctttgagtgagattctt

SEQ ID NO: 772468 - DNA, 22 bp, Artificial Sequence
  chemically synthesized
aggattaagaatctcactcaaa

SEQ ID NO: 772469 - DNA, 22 bp, Artificial Sequence
  chemically synthesized
catgtagttgagcggctttgag

SEQ ID NO: 772470 - DNA, 22 bp, Artificial Sequence
  chemically synthesized
ccatgtagttgagcggctttga

SEQ ID NO: 772471 - DNA, 22 bp, Artificial Sequence
  chemically synthesized
agaatctcactcaaagccgctc

SEQ ID NO: 772472 - DNA, 22 bp, Artificial Sequence
  chemically synthesized
agtttccatgtagttgagcggc

SEQ ID NO: 772473 - DNA, 22 bp, Artificial Sequence
  chemically synthesized
ttcagtttccatgtagttgagc

SEQ ID NO: 772474 - DNA, 22 bp, Artificial Sequence
  chemically synthesized
actcaaagccgctcaactacat

SEQ ID NO: 772475 - DNA, 22 bp, Artificial Sequence
  chemically synthesized
aaagccgctcaactacatggaa

SEQ ID NO: 772476 - DNA, 22 bp, Artificial Sequence
  chemically synthesized
aggagcaggttgttcagtttcc

SEQ ID NO: 772477 - DNA, 22 bp, Artificial Sequence
  chemically synthesized
aactacatggaaactgaacaac

SEQ ID NO: 772478 - DNA, 22 bp, Artificial Sequence
  chemically synthesized
catggaaactgaacaacctgct

SEQ ID NO: 772479 - DNA, 22 bp, Artificial Sequence
  chemically synthesized
tgtacccagtagtcattcagga

SEQ ID NO: 772480 - DNA, 22 bp, Artificial Sequence
  chemically synthesized
aacaacctgctcctgaatgact

SEQ ID NO: 772481 - DNA, 22 bp, Artificial Sequence
  chemically synthesized
gttatgtacccagtagtcattc

SEQ ID NO: 772482 - DNA, 22 bp, Artificial Sequence
  chemically synthesized
cgttatgtacccagtagtcatt

SEQ ID NO: 772483 - DNA, 22 bp, Artificial Sequence
  chemically synthesized
atttcgttatgtacccagtagt

SEQ ID NO: 772484 - DNA, 22 bp, Artificial Sequence
  chemically synthesized
catttcgttatgtacccagtag

SEQ ID NO: 772485 - DNA, 22 bp, Artificial Sequence
  chemically synthesized
ctcctgaatgactactgggtac

SEQ ID NO: 772486 - DNA, 22 bp, Artificial Sequence
  chemically synthesized
ctgaatgactactgggtacata

SEQ ID NO: 772487 - DNA, 22 bp, Artificial Sequence
  chemically synthesized
ccttcatttcgttatgtaccca

SEQ ID NO: 772488 - DNA, 22 bp, Artificial Sequence
  chemically synthesized
tgccttcatttcgttatgtacc

SEQ ID NO: 772489 - DNA, 22 bp, Artificial Sequence
  chemically synthesized
aatgactactgggtacataacg

SEQ ID NO: 772490 - DNA, 22 bp, Artificial Sequence
  chemically synthesized
ctgccttcatttcgttatgtac

SEQ ID NO: 772491 - DNA, 22 bp, Artificial Sequence
  chemically synthesized
tttctgccttcatttcgttatg

SEQ ID NO: 772492 - DNA, 22 bp, Artificial Sequence
  chemically synthesized
atttctgccttcatttcgttat

SEQ ID NO: 772493 - DNA, 22 bp, Artificial Sequence
  chemically synthesized
tatttctgccttcatttcgtta

SEQ ID NO: 772494 - DNA, 22 bp, Artificial Sequence
  chemically synthesized
ctgggtacataacgaaatgaag

SEQ ID NO: 772495 - DNA, 22 bp, Artificial Sequence
  chemically synthesized
ggtacataacgaaatgaaggca

SEQ ID NO: 772496 - DNA, 22 bp, Artificial Sequence
  chemically synthesized
aaagaacatctttatttctgcc

SEQ ID NO: 772497 - DNA, 22 bp, Artificial Sequence
  chemically synthesized
caaagaacatctttatttctgc

SEQ ID NO: 772498 - DNA, 22 bp, Artificial Sequence
  chemically synthesized
gtttcaaagaacatctttattt

SEQ ID NO: 772499 - DNA, 22 bp, Artificial Sequence
  chemically synthesized
gttggtttcaaagaacatcttt

SEQ ID NO: 772500 - DNA, 22 bp, Artificial Sequence
  chemically synthesized
tcgttggtttcaaagaacatct

SEQ ID NO: 772501 - DNA, 22 bp, Artificial Sequence
  chemically synthesized
ttctcgttggtttcaaagaaca

SEQ ID NO: 772502 - DNA, 22 bp, Artificial Sequence
  chemically synthesized
gttctcgttggtttcaaagaac

SEQ ID NO: 772503 - DNA, 22 bp, Artificial Sequence
  chemically synthesized
tgttctcgttggtttcaaagaa

SEQ ID NO: 772504 - DNA, 22 bp, Artificial Sequence
  chemically synthesized
gtatgtggtgtctttgttctcg

SEQ ID NO: 772505 - DNA, 22 bp, Artificial Sequence
  chemically synthesized
tttgaaaccaacgagaacaaag

SEQ ID NO: 772506 - DNA, 22 bp, Artificial Sequence
  chemically synthesized
tggtatgtggtgtctttgttct

SEQ ID NO: 772507 - DNA, 22 bp, Artificial Sequence
  chemically synthesized
tgaaaccaacgagaacaaagac

SEQ ID NO: 772508 - DNA, 22 bp, Artificial Sequence
  chemically synthesized
gaaaccaacgagaacaaagaca

SEQ ID NO: 772509 - DNA, 22 bp, Artificial Sequence
  chemically synthesized
aaaccaacgagaacaaagacac

SEQ ID NO: 772510 - DNA, 22 bp, Artificial Sequence
  chemically synthesized
aatgcgtcccagagattctggt

SEQ ID NO: 772511 - DNA, 22 bp, Artificial Sequence
  chemically synthesized
gaatgcgtcccagagattctgg

SEQ ID NO: 772512 - DNA, 22 bp, Artificial Sequence
  chemically synthesized
tgaatgcgtcccagagattctg

SEQ ID NO: 772513 - DNA, 22 bp, Artificial Sequence
  chemically synthesized
ctttgaatgcgtcccagagatt

SEQ ID NO: 772514 - DNA, 22 bp, Artificial Sequence
  chemically synthesized
cacactgctttgaatgcgtccc

SEQ ID NO: 772515 - DNA, 22 bp, Artificial Sequence
  chemically synthesized
tacacactgctttgaatgcgtc

SEQ ID NO: 772516 - DNA, 22 bp, Artificial Sequence
  chemically synthesized
cctctacacactgctttgaatg

SEQ ID NO: 772517 - DNA, 22 bp, Artificial Sequence
  chemically synthesized
ccctctacacactgctttgaat

SEQ ID NO: 772518 - DNA, 22 bp, Artificial Sequence
  chemically synthesized
tgggacgcattcaaagcagtgt

SEQ ID NO: 772519 - DNA, 22 bp, Artificial Sequence
  chemically synthesized
ggacgcattcaaagcagtgtgt

SEQ ID NO: 772520 - DNA, 22 bp, Artificial Sequence
  chemically synthesized
taaatttccctctacacactgc

SEQ ID NO: 772521 - DNA, 22 bp, Artificial Sequence
  chemically synthesized
gtgctataaatttccctctaca

SEQ ID NO: 772522 - DNA, 22 bp, Artificial Sequence
  chemically synthesized
agtgctataaatttccctctac

SEQ ID NO: 772523 - DNA, 22 bp, Artificial Sequence
  chemically synthesized
aaagcagtgtgtagagggaaat

SEQ ID NO: 772524 - DNA, 22 bp, Artificial Sequence
  chemically synthesized
taggcatttagtgctataaatt

SEQ ID NO: 772525 - DNA, 22 bp, Artificial Sequence
  chemically synthesized
gtaggcatttagtgctataaat

SEQ ID NO: 772526 - DNA, 22 bp, Artificial Sequence
  chemically synthesized
ttgtaggcatttagtgctataa

SEQ ID NO: 772527 - DNA, 22 bp, Artificial Sequence
  chemically synthesized
tcttgtaggcatttagtgctat

SEQ ID NO: 772528 - DNA, 22 bp, Artificial Sequence
  chemically synthesized
ctcttgtaggcatttagtgcta

SEQ ID NO: 772529 - DNA, 22 bp, Artificial Sequence
  chemically synthesized
tctcttgtaggcatttagtgct

SEQ ID NO: 772530 - DNA, 22 bp, Artificial Sequence
  chemically synthesized
ctttctcttgtaggcatttagt

SEQ ID NO: 772531 - DNA, 22 bp, Artificial Sequence
  chemically synthesized
ctgctttctcttgtaggcattt

SEQ ID NO: 772532 - DNA, 22 bp, Artificial Sequence
  chemically synthesized
cctgctttctcttgtaggcatt

SEQ ID NO: 772533 - DNA, 22 bp, Artificial Sequence
  chemically synthesized
tcctgctttctcttgtaggcat

SEQ ID NO: 772534 - DNA, 22 bp, Artificial Sequence
  chemically synthesized
atagcactaaatgcctacaaga

SEQ ID NO: 772535 - DNA, 22 bp, Artificial Sequence
  chemically synthesized
tagcactaaatgcctacaagag

SEQ ID NO: 772536 - DNA, 22 bp, Artificial Sequence
  chemically synthesized
gatctttcctgctttctcttgt

SEQ ID NO: 772537 - DNA, 22 bp, Artificial Sequence
  chemically synthesized
ggatctttcctgctttctcttg

SEQ ID NO: 772538 - DNA, 22 bp, Artificial Sequence
  chemically synthesized
tggatctttcctgctttctctt

SEQ ID NO: 772539 - DNA, 22 bp, Artificial Sequence
  chemically synthesized
aatgcctacaagagaaagcagg

SEQ ID NO: 772540 - DNA, 22 bp, Artificial Sequence
  chemically synthesized
caagagaaagcaggaaagatcc

SEQ ID NO: 772541 - DNA, 22 bp, Artificial Sequence
  chemically synthesized
gggtgtcaattttggatctttc

SEQ ID NO: 772542 - DNA, 22 bp, Artificial Sequence
  chemically synthesized
tgatgttagggtgtcaattttg

SEQ ID NO: 772543 - DNA, 22 bp, Artificial Sequence
  chemically synthesized
attgtgatgttagggtgtcaat

SEQ ID NO: 772544 - DNA, 22 bp, Artificial Sequence
  chemically synthesized
aattgtgatgttagggtgtcaa

SEQ ID NO: 772545 - DNA, 22 bp, Artificial Sequence
  chemically synthesized
taattgtgatgttagggtgtca

SEQ ID NO: 772546 - DNA, 22 bp, Artificial Sequence
  chemically synthesized
ttaattgtgatgttagggtgtc

SEQ ID NO: 772547 - DNA, 22 bp, Artificial Sequence
  chemically synthesized
ttttaattgtgatgttagggtg

SEQ ID NO: 772548 - DNA, 22 bp, Artificial Sequence
  chemically synthesized
gttcttttaattgtgatgttag

SEQ ID NO: 772549 - DNA, 22 bp, Artificial Sequence
  chemically synthesized
tagttcttttaattgtgatgtt

SEQ ID NO: 772550 - DNA, 22 bp, Artificial Sequence
  chemically synthesized
ctagttcttttaattgtgatgt

SEQ ID NO: 772551 - DNA, 22 bp, Artificial Sequence
  chemically synthesized
tctagttcttttaattgtgatg

SEQ ID NO: 772552 - DNA, 22 bp, Artificial Sequence
  chemically synthesized
ttctagttcttttaattgtgat

SEQ ID NO: 772553 - DNA, 22 bp, Artificial Sequence
  chemically synthesized
acaccctaacatcacaattaaa

SEQ ID NO: 772554 - DNA, 22 bp, Artificial Sequence
  chemically synthesized
cttttctagttcttttaattgt

SEQ ID NO: 772555 - DNA, 22 bp, Artificial Sequence
  chemically synthesized
gcttttctagttcttttaattg

SEQ ID NO: 772556 - DNA, 22 bp, Artificial Sequence
  chemically synthesized
ttgcttttctagttcttttaat

SEQ ID NO: 772557 - DNA, 22 bp, Artificial Sequence
  chemically synthesized
ctcttgcttttctagttctttt

SEQ ID NO: 772558 - DNA, 22 bp, Artificial Sequence
  chemically synthesized
acatcacaattaaaagaactag

SEQ ID NO: 772559 - DNA, 22 bp, Artificial Sequence
  chemically synthesized
gctcttgcttttctagttcttt

SEQ ID NO: 772560 - DNA, 22 bp, Artificial Sequence
  chemically synthesized
aatgtgtttgctcttgcttttc

SEQ ID NO: 772561 - DNA, 22 bp, Artificial Sequence
  chemically synthesized
gaatgtgtttgctcttgctttt

SEQ ID NO: 772562 - DNA, 22 bp, Artificial Sequence
  chemically synthesized
tgaatgtgtttgctcttgcttt

SEQ ID NO: 772563 - DNA, 22 bp, Artificial Sequence
  chemically synthesized
aaagaactagaaaagcaagagc

SEQ ID NO: 772564 - DNA, 22 bp, Artificial Sequence
  chemically synthesized
ttgaatgtgtttgctcttgctt

SEQ ID NO: 772565 - DNA, 22 bp, Artificial Sequence
  chemically synthesized
gcttttgaatgtgtttgctctt

SEQ ID NO: 772566 - DNA, 22 bp, Artificial Sequence
  chemically synthesized
ctagcttttgaatgtgtttgct

SEQ ID NO: 772567 - DNA, 22 bp, Artificial Sequence
  chemically synthesized
gaaaagcaagagcaaacacatt

SEQ ID NO: 772568 - DNA, 22 bp, Artificial Sequence
  chemically synthesized
tgctagcttttgaatgtgtttg

SEQ ID NO: 772569 - DNA, 22 bp, Artificial Sequence
  chemically synthesized
ctgctagcttttgaatgtgttt

SEQ ID NO: 772570 - DNA, 22 bp, Artificial Sequence
  chemically synthesized
ccttctgctagcttttgaatgt

SEQ ID NO: 772571 - DNA, 22 bp, Artificial Sequence
  chemically synthesized
gccttctgctagcttttgaatg

SEQ ID NO: 772572 - DNA, 22 bp, Artificial Sequence
  chemically synthesized
ttgccttctgctagcttttgaa

SEQ ID NO: 772573 - DNA, 22 bp, Artificial Sequence
  chemically synthesized
cttgccttctgctagcttttga

SEQ ID NO: 772574 - DNA, 22 bp, Artificial Sequence
  chemically synthesized
tttcttgccttctgctagcttt

SEQ ID NO: 772575 - DNA, 22 bp, Artificial Sequence
  chemically synthesized
gttatttcttgccttctgctag

SEQ ID NO: 772576 - DNA, 22 bp, Artificial Sequence
  chemically synthesized
agttatttcttgccttctgcta

SEQ ID NO: 772577 - DNA, 22 bp, Artificial Sequence
  chemically synthesized
tagttatttcttgccttctgct

SEQ ID NO: 772578 - DNA, 22 bp, Artificial Sequence
  chemically synthesized
attttagttatttcttgccttc

SEQ ID NO: 772579 - DNA, 22 bp, Artificial Sequence
  chemically synthesized
aaaagctagcagaaggcaagaa

SEQ ID NO: 772580 - DNA, 22 bp, Artificial Sequence
  chemically synthesized
tgattttagttatttcttgcct

SEQ ID NO: 772581 - DNA, 22 bp, Artificial Sequence
  chemically synthesized
ctctgattttagttatttcttg

SEQ ID NO: 772582 - DNA, 22 bp, Artificial Sequence
  chemically synthesized
tgctctgattttagttatttct

SEQ ID NO: 772583 - DNA, 22 bp, Artificial Sequence
  chemically synthesized
gcagaaggcaagaaataactaa

SEQ ID NO: 772584 - DNA, 22 bp, Artificial Sequence
  chemically synthesized
agttctgctctgattttagtta

SEQ ID NO: 772585 - DNA, 22 bp, Artificial Sequence
  chemically synthesized
cagttctgctctgattttagtt

SEQ ID NO: 772586 - DNA, 22 bp, Artificial Sequence
  chemically synthesized
cttcagttctgctctgatttta

SEQ ID NO: 772587 - DNA, 22 bp, Artificial Sequence
  chemically synthesized
ccttcagttctgctctgatttt

SEQ ID NO: 772588 - DNA, 22 bp, Artificial Sequence
  chemically synthesized
tttccttcagttctgctctgat

SEQ ID NO: 772589 - DNA, 22 bp, Artificial Sequence
  chemically synthesized
tatttccttcagttctgctctg

SEQ ID NO: 772590 - DNA, 22 bp, Artificial Sequence
  chemically synthesized
tgtctctatttccttcagttct

SEQ ID NO: 772591 - DNA, 22 bp, Artificial Sequence
  chemically synthesized
gtgtctctatttccttcagttc

SEQ ID NO: 772592 - DNA, 22 bp, Artificial Sequence
  chemically synthesized
aaatcagagcagaactgaagga

SEQ ID NO: 772593 - DNA, 22 bp, Artificial Sequence
  chemically synthesized
tgtgtctctatttccttcagtt

SEQ ID NO: 772594 - DNA, 22 bp, Artificial Sequence
  chemically synthesized
ttgtgtctctatttccttcagt

SEQ ID NO: 772595 - DNA, 22 bp, Artificial Sequence
  chemically synthesized
tttgtgtctctatttccttcag

SEQ ID NO: 772596 - DNA, 22 bp, Artificial Sequence
  chemically synthesized
aagggttttttgtgtctctatt

SEQ ID NO: 772597 - DNA, 22 bp, Artificial Sequence
  chemically synthesized
gaagggttttttgtgtctctat

SEQ ID NO: 772598 - DNA, 22 bp, Artificial Sequence
  chemically synthesized
tgaagggttttttgtgtctcta

SEQ ID NO: 772599 - DNA, 22 bp, Artificial Sequence
  chemically synthesized
ttgaagggttttttgtgtctct

SEQ ID NO: 772600 - DNA, 22 bp, Artificial Sequence
  chemically synthesized
tttgaagggttttttgtgtctc

SEQ ID NO: 772601 - DNA, 22 bp, Artificial Sequence
  chemically synthesized
aaggaaatagagacacaaaaaa

SEQ ID NO: 772602 - DNA, 22 bp, Artificial Sequence
  chemically synthesized
attttttgaagggttttttgtg

SEQ ID NO: 772603 - DNA, 22 bp, Artificial Sequence
  chemically synthesized
attgattttttgaagggttttt

SEQ ID NO: 772604 - DNA, 22 bp, Artificial Sequence
  chemically synthesized
gattcattgattttttgaaggg

SEQ ID NO: 772605 - DNA, 22 bp, Artificial Sequence
  chemically synthesized
ctggattcattgattttttgaa

SEQ ID NO: 772606 - DNA, 22 bp, Artificial Sequence
  chemically synthesized
aaaaaaccagctcctggattca

SEQ ID NO: 772607 - DNA, 22 bp, Artificial Sequence
  chemically synthesized
caaaaaatcaatgaatccagga

SEQ ID NO: 772608 - DNA, 22 bp, Artificial Sequence
  chemically synthesized
caaaaaaccagctcctggattc

SEQ ID NO: 772609 - DNA, 22 bp, Artificial Sequence
  chemically synthesized
aaaaaatcaatgaatccaggag

SEQ ID NO: 772610 - DNA, 22 bp, Artificial Sequence
  chemically synthesized
tcaaaaaaccagctcctggatt

SEQ ID NO: 772611 - DNA, 22 bp, Artificial Sequence
  chemically synthesized
atcctttcaaaaaaccagctcc

SEQ ID NO: 772612 - DNA, 22 bp, Artificial Sequence
  chemically synthesized
ttgatcctttcaaaaaaccagc

SEQ ID NO: 772613 - DNA, 22 bp, Artificial Sequence
  chemically synthesized
gttgatcctttcaaaaaaccag

SEQ ID NO: 772614 - DNA, 22 bp, Artificial Sequence
  chemically synthesized
tgttgatcctttcaaaaaacca

SEQ ID NO: 772615 - DNA, 22 bp, Artificial Sequence
  chemically synthesized
tcaattttgttgatcctttcaa

SEQ ID NO: 772616 - DNA, 22 bp, Artificial Sequence
  chemically synthesized
gttttttgaaaggatcaacaaa

SEQ ID NO: 772617 - DNA, 22 bp, Artificial Sequence
  chemically synthesized
gcggtctatcaattttgttgat

SEQ ID NO: 772618 - DNA, 22 bp, Artificial Sequence
  chemically synthesized
tttgaaaggatcaacaaaattg

SEQ ID NO: 772619 - DNA, 22 bp, Artificial Sequence
  chemically synthesized
ctagcggtctatcaattttgtt

SEQ ID NO: 772620 - DNA, 22 bp, Artificial Sequence
  chemically synthesized
ttgaaaggatcaacaaaattga

SEQ ID NO: 772621 - DNA, 22 bp, Artificial Sequence
  chemically synthesized
gctagcggtctatcaattttgt

SEQ ID NO: 772622 - DNA, 22 bp, Artificial Sequence
  chemically synthesized
tgaaaggatcaacaaaattgat

SEQ ID NO: 772623 - DNA, 22 bp, Artificial Sequence
  chemically synthesized
gaaaggatcaacaaaattgata

SEQ ID NO: 772624 - DNA, 22 bp, Artificial Sequence
  chemically synthesized
aaaggatcaacaaaattgatag

SEQ ID NO: 772625 - DNA, 22 bp, Artificial Sequence
  chemically synthesized
gtcttgctagcggtctatcaat

SEQ ID NO: 772626 - DNA, 22 bp, Artificial Sequence
  chemically synthesized
ttagtcttgctagcggtctatc

SEQ ID NO: 772627 - DNA, 22 bp, Artificial Sequence
  chemically synthesized
attagtcttgctagcggtctat

SEQ ID NO: 772628 - DNA, 22 bp, Artificial Sequence
  chemically synthesized
tattagtcttgctagcggtcta

SEQ ID NO: 772629 - DNA, 22 bp, Artificial Sequence
  chemically synthesized
tttattagtcttgctagcggtc

SEQ ID NO: 772630 - DNA, 22 bp, Artificial Sequence
  chemically synthesized
ctttattagtcttgctagcggt

SEQ ID NO: 772631 - DNA, 22 bp, Artificial Sequence
  chemically synthesized
tctttattagtcttgctagcgg

SEQ ID NO: 772632 - DNA, 22 bp, Artificial Sequence
  chemically synthesized
ttctttattagtcttgctagcg

SEQ ID NO: 772633 - DNA, 22 bp, Artificial Sequence
  chemically synthesized
tttctttattagtcttgctagc

SEQ ID NO: 772634 - DNA, 22 bp, Artificial Sequence
  chemically synthesized
ttttctttattagtcttgctag

SEQ ID NO: 772635 - DNA, 22 bp, Artificial Sequence
  chemically synthesized
tttttctttattagtcttgcta

SEQ ID NO: 772636 - DNA, 22 bp, Artificial Sequence
  chemically synthesized
tttttttctttattagtcttgc

SEQ ID NO: 772637 - DNA, 22 bp, Artificial Sequence
  chemically synthesized
atagaccgctagcaagactaat

SEQ ID NO: 772638 - DNA, 22 bp, Artificial Sequence
  chemically synthesized
tctttttttctttattagtctt

SEQ ID NO: 772639 - DNA, 22 bp, Artificial Sequence
  chemically synthesized
tctctttttttctttattagtc

SEQ ID NO: 772640 - DNA, 22 bp, Artificial Sequence
  chemically synthesized
ctctctttttttctttattagt

SEQ ID NO: 772641 - DNA, 22 bp, Artificial Sequence
  chemically synthesized
ttctctctttttttctttatta

SEQ ID NO: 772642 - DNA, 22 bp, Artificial Sequence
  chemically synthesized
attcttctctctttttttcttt

SEQ ID NO: 772643 - DNA, 22 bp, Artificial Sequence
  chemically synthesized
gcaagactaataaagaaaaaaa

SEQ ID NO: 772644 - DNA, 22 bp, Artificial Sequence
  chemically synthesized
gattcttctctctttttttctt

SEQ ID NO: 772645 - DNA, 22 bp, Artificial Sequence
  chemically synthesized
tttgattcttctctcttttttt

SEQ ID NO: 772646 - DNA, 22 bp, Artificial Sequence
  chemically synthesized
ataaagaaaaaaagagagaaga

SEQ ID NO: 772647 - DNA, 22 bp, Artificial Sequence
  chemically synthesized
tgtctatttgattcttctctct

SEQ ID NO: 772648 - DNA, 22 bp, Artificial Sequence
  chemically synthesized
ttgtgtctatttgattcttctc

SEQ ID NO: 772649 - DNA, 22 bp, Artificial Sequence
  chemically synthesized
attgtgtctatttgattcttct

SEQ ID NO: 772650 - DNA, 22 bp, Artificial Sequence
  chemically synthesized
tattgtgtctatttgattcttc

SEQ ID NO: 772651 - DNA, 22 bp, Artificial Sequence
  chemically synthesized
ttattgtgtctatttgattctt

SEQ ID NO: 772652 - DNA, 22 bp, Artificial Sequence
  chemically synthesized
tttattgtgtctatttgattct

SEQ ID NO: 772653 - DNA, 22 bp, Artificial Sequence
  chemically synthesized
tcattttttattgtgtctattt

SEQ ID NO: 772654 - DNA, 22 bp, Artificial Sequence
  chemically synthesized
atcattttttattgtgtctatt

SEQ ID NO: 772655 - DNA, 22 bp, Artificial Sequence
  chemically synthesized
tatcattttttattgtgtctat

SEQ ID NO: 772656 - DNA, 22 bp, Artificial Sequence
  chemically synthesized
tgggatcggtggtgatatcccc

SEQ ID NO: 772657 - DNA, 22 bp, Artificial Sequence
  chemically synthesized
tgtgggatcggtggtgatatcc

SEQ ID NO: 772658 - DNA, 22 bp, Artificial Sequence
  chemically synthesized
ctgtgggatcggtggtgatatc

SEQ ID NO: 772659 - DNA, 22 bp, Artificial Sequence
  chemically synthesized
tatttctgtgggatcggtggtg

SEQ ID NO: 772660 - DNA, 22 bp, Artificial Sequence
  chemically synthesized
gtatttctgtgggatcggtggt

SEQ ID NO: 772661 - DNA, 22 bp, Artificial Sequence
  chemically synthesized
atggtagtttgtatttctgtgg

SEQ ID NO: 772662 - DNA, 22 bp, Artificial Sequence
  chemically synthesized
tgatggtagtttgtatttctgt

SEQ ID NO: 772663 - DNA, 22 bp, Artificial Sequence
  chemically synthesized
tctgatggtagtttgtatttct

SEQ ID NO: 772664 - DNA, 22 bp, Artificial Sequence
  chemically synthesized
tagtattctctgatggtagttt

SEQ ID NO: 772665 - DNA, 22 bp, Artificial Sequence
  chemically synthesized
gtagtattctctgatggtagtt

SEQ ID NO: 772666 - DNA, 22 bp, Artificial Sequence
  chemically synthesized
catagaggtgtttgtagtattc

SEQ ID NO: 772667 - DNA, 22 bp, Artificial Sequence
  chemically synthesized
gcatagaggtgtttgtagtatt

SEQ ID NO: 772668 - DNA, 22 bp, Artificial Sequence
  chemically synthesized
ccatcagagaatactacaaaca

SEQ ID NO: 772669 - DNA, 22 bp, Artificial Sequence
  chemically synthesized
tttgcatagaggtgtttgtagt

SEQ ID NO: 772670 - DNA, 22 bp, Artificial Sequence
  chemically synthesized
atttgcatagaggtgtttgtag

SEQ ID NO: 772671 - DNA, 22 bp, Artificial Sequence
  chemically synthesized
gtttatttgcatagaggtgttt

SEQ ID NO: 772672 - DNA, 22 bp, Artificial Sequence
  chemically synthesized
tagtttatttgcatagaggtgt

SEQ ID NO: 772673 - DNA, 22 bp, Artificial Sequence
  chemically synthesized
ctagtttatttgcatagaggtg

SEQ ID NO: 772674 - DNA, 22 bp, Artificial Sequence
  chemically synthesized
tctagtttatttgcatagaggt

SEQ ID NO: 772675 - DNA, 22 bp, Artificial Sequence
  chemically synthesized
gattttctagtttatttgcata

SEQ ID NO: 772676 - DNA, 22 bp, Artificial Sequence
  chemically synthesized
caaacacctctatgcaaataaa

SEQ ID NO: 772677 - DNA, 22 bp, Artificial Sequence
  chemically synthesized
tagattttctagtttatttgca

SEQ ID NO: 772678 - DNA, 22 bp, Artificial Sequence
  chemically synthesized
ctagattttctagtttatttgc

SEQ ID NO: 772679 - DNA, 22 bp, Artificial Sequence
  chemically synthesized
ttctagattttctagtttattt

SEQ ID NO: 772680 - DNA, 22 bp, Artificial Sequence
  chemically synthesized
cttctagattttctagtttatt

SEQ ID NO: 772681 - DNA, 22 bp, Artificial Sequence
  chemically synthesized
tatgcaaataaactagaaaatc

SEQ ID NO: 772682 - DNA, 22 bp, Artificial Sequence
  chemically synthesized
tgcaaataaactagaaaatcta

SEQ ID NO: 772683 - DNA, 22 bp, Artificial Sequence
  chemically synthesized
gaaaatctagaagaaatggata

SEQ ID NO: 772684 - DNA, 22 bp, Artificial Sequence
  chemically synthesized
gaagaaatggatacattcctcg

SEQ ID NO: 772685 - DNA, 22 bp, Artificial Sequence
  chemically synthesized
ggagagtgtatgtgtcgaggaa

SEQ ID NO: 772686 - DNA, 22 bp, Artificial Sequence
  chemically synthesized
gggagagtgtatgtgtcgagga

SEQ ID NO: 772687 - DNA, 22 bp, Artificial Sequence
  chemically synthesized
gtcttgggagagtgtatgtgtc

SEQ ID NO: 772688 - DNA, 22 bp, Artificial Sequence
  chemically synthesized
agtcttgggagagtgtatgtgt

SEQ ID NO: 772689 - DNA, 22 bp, Artificial Sequence
  chemically synthesized
gtttagtcttgggagagtgtat

SEQ ID NO: 772690 - DNA, 22 bp, Artificial Sequence
  chemically synthesized
ctggtttagtcttgggagagtg

SEQ ID NO: 772691 - DNA, 22 bp, Artificial Sequence
  chemically synthesized
ctcgacacatacactctcccaa

SEQ ID NO: 772692 - DNA, 22 bp, Artificial Sequence
  chemically synthesized
cctggtttagtcttgggagagt

SEQ ID NO: 772693 - DNA, 22 bp, Artificial Sequence
  chemically synthesized
ttcctggtttagtcttgggaga

SEQ ID NO: 772694 - DNA, 22 bp, Artificial Sequence
  chemically synthesized
gacacatacactctcccaagac

SEQ ID NO: 772695 - DNA, 22 bp, Artificial Sequence
  chemically synthesized
cttcctggtttagtcttgggag

SEQ ID NO: 772696 - DNA, 22 bp, Artificial Sequence
  chemically synthesized
aacttcttcctggtttagtctt

SEQ ID NO: 772697 - DNA, 22 bp, Artificial Sequence
  chemically synthesized
tcccaagactaaaccaggaaga

SEQ ID NO: 772698 - DNA, 22 bp, Artificial Sequence
  chemically synthesized
agagattcaacttcttcctggt

SEQ ID NO: 772699 - DNA, 22 bp, Artificial Sequence
  chemically synthesized
ccaagactaaaccaggaagaag

SEQ ID NO: 772700 - DNA, 22 bp, Artificial Sequence
  chemically synthesized
ttcagagattcaacttcttcct

SEQ ID NO: 772701 - DNA, 22 bp, Artificial Sequence
  chemically synthesized
gtctattcagagattcaacttc

SEQ ID NO: 772702 - DNA, 22 bp, Artificial Sequence
  chemically synthesized
aaccaggaagaagttgaatctc

SEQ ID NO: 772703 - DNA, 22 bp, Artificial Sequence
  chemically synthesized
ttggtctattcagagattcaac

SEQ ID NO: 772704 - DNA, 22 bp, Artificial Sequence
  chemically synthesized
ttattggtctattcagagattc

SEQ ID NO: 772705 - DNA, 22 bp, Artificial Sequence
  chemically synthesized
agagcctgttattggtctattc

SEQ ID NO: 772706 - DNA, 22 bp, Artificial Sequence
  chemically synthesized
cagagcctgttattggtctatt

SEQ ID NO: 772707 - DNA, 22 bp, Artificial Sequence
  chemically synthesized
aatctctgaatagaccaataac

SEQ ID NO: 772708 - DNA, 22 bp, Artificial Sequence
  chemically synthesized
ccacaatttcagagcctgttat

SEQ ID NO: 772709 - DNA, 22 bp, Artificial Sequence
  chemically synthesized
tgaatagaccaataacaggctc

SEQ ID NO: 772710 - DNA, 22 bp, Artificial Sequence
  chemically synthesized
aatagaccaataacaggctctg

SEQ ID NO: 772711 - DNA, 22 bp, Artificial Sequence
  chemically synthesized
ttgccacaatttcagagcctgt

SEQ ID NO: 772712 - DNA, 22 bp, Artificial Sequence
  chemically synthesized
attattgccacaatttcagagc

SEQ ID NO: 772713 - DNA, 22 bp, Artificial Sequence
  chemically synthesized
gtaaaatattgattattgccac

SEQ ID NO: 772714 - DNA, 22 bp, Artificial Sequence
  chemically synthesized
gttggtaaaatattgattattg

SEQ ID NO: 772715 - DNA, 22 bp, Artificial Sequence
  chemically synthesized
tgaaattgtggcaataatcaat

SEQ ID NO: 772716 - DNA, 22 bp, Artificial Sequence
  chemically synthesized
ggttggtaaaatattgattatt

SEQ ID NO: 772717 - DNA, 22 bp, Artificial Sequence
  chemically synthesized
tggttggtaaaatattgattat

SEQ ID NO: 772718 - DNA, 22 bp, Artificial Sequence
  chemically synthesized
aaattgtggcaataatcaatat

SEQ ID NO: 772719 - DNA, 22 bp, Artificial Sequence
  chemically synthesized
ttggttggtaaaatattgatta

SEQ ID NO: 772720 - DNA, 22 bp, Artificial Sequence
  chemically synthesized
tttggttggtaaaatattgatt

SEQ ID NO: 772721 - DNA, 22 bp, Artificial Sequence
  chemically synthesized
tttttggttggtaaaatattga

SEQ ID NO: 772722 - DNA, 22 bp, Artificial Sequence
  chemically synthesized
tggcaataatcaatattttacc

SEQ ID NO: 772723 - DNA, 22 bp, Artificial Sequence
  chemically synthesized
gactctttttggttggtaaaat

SEQ ID NO: 772724 - DNA, 22 bp, Artificial Sequence
  chemically synthesized
gtcctggactctttttggttgg

SEQ ID NO: 772725 - DNA, 22 bp, Artificial Sequence
  chemically synthesized
taccaaccaaaaagagtccagg

SEQ ID NO: 772726 - DNA, 22 bp, Artificial Sequence
  chemically synthesized
accaaccaaaaagagtccagga

SEQ ID NO: 772727 - DNA, 22 bp, Artificial Sequence
  chemically synthesized
ccaaccaaaaagagtccaggac

SEQ ID NO: 772728 - DNA, 22 bp, Artificial Sequence
  chemically synthesized
tgaatccatctggtcctggact

SEQ ID NO: 772729 - DNA, 22 bp, Artificial Sequence
  chemically synthesized
ggctgtgaatccatctggtcct

SEQ ID NO: 772730 - DNA, 22 bp, Artificial Sequence
  chemically synthesized
gtagaattcggctgtgaatcca

SEQ ID NO: 772731 - DNA, 22 bp, Artificial Sequence
  chemically synthesized
tggtagaattcggctgtgaatc

SEQ ID NO: 772732 - DNA, 22 bp, Artificial Sequence
  chemically synthesized
tacctctggtagaattcggctg

SEQ ID NO: 772733 - DNA, 22 bp, Artificial Sequence
  chemically synthesized
gtacctctggtagaattcggct

SEQ ID NO: 772734 - DNA, 22 bp, Artificial Sequence
  chemically synthesized
cttgtacctctggtagaattcg

SEQ ID NO: 772735 - DNA, 22 bp, Artificial Sequence
  chemically synthesized
ctccttgtacctctggtagaat

SEQ ID NO: 772736 - DNA, 22 bp, Artificial Sequence
  chemically synthesized
acagccgaattctaccagaggt

SEQ ID NO: 772737 - DNA, 22 bp, Artificial Sequence
  chemically synthesized
taccagaggtacaaggaggaac

SEQ ID NO: 772738 - DNA, 22 bp, Artificial Sequence
  chemically synthesized
ccagaggtacaaggaggaactg

SEQ ID NO: 772739 - DNA, 22 bp, Artificial Sequence
  chemically synthesized
agaaggaatggtaccagttcct

SEQ ID NO: 772740 - DNA, 22 bp, Artificial Sequence
  chemically synthesized
cagaaggaatggtaccagttcc

SEQ ID NO: 772741 - DNA, 22 bp, Artificial Sequence
  chemically synthesized
gaatagtttcagaaggaatggt

SEQ ID NO: 772742 - DNA, 22 bp, Artificial Sequence
  chemically synthesized
attggaatagtttcagaaggaa

SEQ ID NO: 772743 - DNA, 22 bp, Artificial Sequence
  chemically synthesized
ttgattggaatagtttcagaag

SEQ ID NO: 772744 - DNA, 22 bp, Artificial Sequence
  chemically synthesized
tattgattggaatagtttcaga

SEQ ID NO: 772745 - DNA, 22 bp, Artificial Sequence
  chemically synthesized
gtaccattccttctgaaactat

SEQ ID NO: 772746 - DNA, 22 bp, Artificial Sequence
  chemically synthesized
ctattgattggaatagtttcag

SEQ ID NO: 772747 - DNA, 22 bp, Artificial Sequence
  chemically synthesized
tctattgattggaatagtttca

SEQ ID NO: 772748 - DNA, 22 bp, Artificial Sequence
  chemically synthesized
ttctattgattggaatagtttc

SEQ ID NO: 772749 - DNA, 22 bp, Artificial Sequence
  chemically synthesized
tttctattgattggaatagttt

SEQ ID NO: 772750 - DNA, 22 bp, Artificial Sequence
  chemically synthesized
tttttctattgattggaatagt

SEQ ID NO: 772751 - DNA, 22 bp, Artificial Sequence
  chemically synthesized
cttctgaaactattccaatcaa

SEQ ID NO: 772752 - DNA, 22 bp, Artificial Sequence
  chemically synthesized
cctctttttctattgattggaa

SEQ ID NO: 772753 - DNA, 22 bp, Artificial Sequence
  chemically synthesized
ctgaaactattccaatcaatag

SEQ ID NO: 772754 - DNA, 22 bp, Artificial Sequence
  chemically synthesized
tgaaactattccaatcaataga

SEQ ID NO: 772755 - DNA, 22 bp, Artificial Sequence
  chemically synthesized
aaactattccaatcaatagaaa

SEQ ID NO: 772756 - DNA, 22 bp, Artificial Sequence
  chemically synthesized
gggaggattccctctttttcta

SEQ ID NO: 772757 - DNA, 22 bp, Artificial Sequence
  chemically synthesized
ttccaatcaatagaaaaagagg

SEQ ID NO: 772758 - DNA, 22 bp, Artificial Sequence
  chemically synthesized
caatcaatagaaaaagagggaa

SEQ ID NO: 772759 - DNA, 22 bp, Artificial Sequence
  chemically synthesized
ataaaatgagttagggaggatt

SEQ ID NO: 772760 - DNA, 22 bp, Artificial Sequence
  chemically synthesized
gcctcataaaatgagttaggga

SEQ ID NO: 772761 - DNA, 22 bp, Artificial Sequence
  chemically synthesized
cctaactcattttatgaggcca

SEQ ID NO: 772762 - DNA, 22 bp, Artificial Sequence
  chemically synthesized
gtatcagaatgatgctggcctc

SEQ ID NO: 772763 - DNA, 22 bp, Artificial Sequence
  chemically synthesized
actcattttatgaggccagcat

SEQ ID NO: 772764 - DNA, 22 bp, Artificial Sequence
  chemically synthesized
ggtatcagaatgatgctggcct

SEQ ID NO: 772765 - DNA, 22 bp, Artificial Sequence
  chemically synthesized
tggtatcagaatgatgctggcc

SEQ ID NO: 772766 - DNA, 22 bp, Artificial Sequence
  chemically synthesized
attttatgaggccagcatcatt

SEQ ID NO: 772767 - DNA, 22 bp, Artificial Sequence
  chemically synthesized
tatgaggccagcatcattctga

SEQ ID NO: 772768 - DNA, 22 bp, Artificial Sequence
  chemically synthesized
atgaggccagcatcattctgat

SEQ ID NO: 772769 - DNA, 22 bp, Artificial Sequence
  chemically synthesized
cccggctttggtatcagaatga

SEQ ID NO: 772770 - DNA, 22 bp, Artificial Sequence
  chemically synthesized
tgaggccagcatcattctgata

SEQ ID NO: 772771 - DNA, 22 bp, Artificial Sequence
  chemically synthesized
tgcccggctttggtatcagaat

SEQ ID NO: 772772 - DNA, 22 bp, Artificial Sequence
  chemically synthesized
tgtctctgcccggctttggtat

SEQ ID NO: 772773 - DNA, 22 bp, Artificial Sequence
  chemically synthesized
gttgtgtctctgcccggctttg

SEQ ID NO: 772774 - DNA, 22 bp, Artificial Sequence
  chemically synthesized
ggttgtgtctctgcccggcttt

SEQ ID NO: 772775 - DNA, 22 bp, Artificial Sequence
  chemically synthesized
tggttgtgtctctgcccggctt

SEQ ID NO: 772776 - DNA, 22 bp, Artificial Sequence
  chemically synthesized
ttggttgtgtctctgcccggct

SEQ ID NO: 772777 - DNA, 22 bp, Artificial Sequence
  chemically synthesized
tttggttgtgtctctgcccggc

SEQ ID NO: 772778 - DNA, 22 bp, Artificial Sequence
  chemically synthesized
ttttggttgtgtctctgcccgg

SEQ ID NO: 772779 - DNA, 22 bp, Artificial Sequence
  chemically synthesized
tgataccaaagccgggcagaga

SEQ ID NO: 772780 - DNA, 22 bp, Artificial Sequence
  chemically synthesized
ttttttggttgtgtctctgccc

SEQ ID NO: 772781 - DNA, 22 bp, Artificial Sequence
  chemically synthesized
ataccaaagccgggcagagaca

SEQ ID NO: 772782 - DNA, 22 bp, Artificial Sequence
  chemically synthesized
tcttttttggttgtgtctctgc

SEQ ID NO: 772783 - DNA, 22 bp, Artificial Sequence
  chemically synthesized
aaattctcttttttggttgtgt

SEQ ID NO: 772784 - DNA, 22 bp, Artificial Sequence
  chemically synthesized
gtctaaaattctcttttttggt

SEQ ID NO: 772785 - DNA, 22 bp, Artificial Sequence
  chemically synthesized
atcaaggatattggtctaaaat

SEQ ID NO: 772786 - DNA, 22 bp, Artificial Sequence
  chemically synthesized
catcaatgttcatcaaggatat

SEQ ID NO: 772787 - DNA, 22 bp, Artificial Sequence
  chemically synthesized
gcatcaatgttcatcaaggata

SEQ ID NO: 772788 - DNA, 22 bp, Artificial Sequence
  chemically synthesized
tgcatcaatgttcatcaaggat

SEQ ID NO: 772789 - DNA, 22 bp, Artificial Sequence
  chemically synthesized
tagaccaatatccttgatgaac

SEQ ID NO: 772790 - DNA, 22 bp, Artificial Sequence
  chemically synthesized
agaccaatatccttgatgaaca

SEQ ID NO: 772791 - DNA, 22 bp, Artificial Sequence
  chemically synthesized
gaccaatatccttgatgaacat

SEQ ID NO: 772792 - DNA, 22 bp, Artificial Sequence
  chemically synthesized
aggagttttgcatcaatgttca

SEQ ID NO: 772793 - DNA, 22 bp, Artificial Sequence
  chemically synthesized
ttgaggagttttgcatcaatgt

SEQ ID NO: 772794 - DNA, 22 bp, Artificial Sequence
  chemically synthesized
attgaggagttttgcatcaatg

SEQ ID NO: 772795 - DNA, 22 bp, Artificial Sequence
  chemically synthesized
tattgaggagttttgcatcaat

SEQ ID NO: 772796 - DNA, 22 bp, Artificial Sequence
  chemically synthesized
gatgaacattgatgcaaaactc

SEQ ID NO: 772797 - DNA, 22 bp, Artificial Sequence
  chemically synthesized
atgaacattgatgcaaaactcc

SEQ ID NO: 772798 - DNA, 22 bp, Artificial Sequence
  chemically synthesized
ccagtattttattgaggagttt

SEQ ID NO: 772799 - DNA, 22 bp, Artificial Sequence
  chemically synthesized
gccagtattttattgaggagtt

SEQ ID NO: 772800 - DNA, 22 bp, Artificial Sequence
  chemically synthesized
ggtttgccagtattttattgag

SEQ ID NO: 772801 - DNA, 22 bp, Artificial Sequence
  chemically synthesized
atgcaaaactcctcaataaaat

SEQ ID NO: 772802 - DNA, 22 bp, Artificial Sequence
  chemically synthesized
gattcggtttgccagtatttta

SEQ ID NO: 772803 - DNA, 22 bp, Artificial Sequence
  chemically synthesized
ctggattcggtttgccagtatt

SEQ ID NO: 772804 - DNA, 22 bp, Artificial Sequence
  chemically synthesized
ctcaataaaatactggcaaacc

SEQ ID NO: 772805 - DNA, 22 bp, Artificial Sequence
  chemically synthesized
aataaaatactggcaaaccgaa

SEQ ID NO: 772806 - DNA, 22 bp, Artificial Sequence
  chemically synthesized
atgtgctgctggattcggtttg

SEQ ID NO: 772807 - DNA, 22 bp, Artificial Sequence
  chemically synthesized
gatgtgctgctggattcggttt

SEQ ID NO: 772808 - DNA, 22 bp, Artificial Sequence
  chemically synthesized
tgatgtgctgctggattcggtt

SEQ ID NO: 772809 - DNA, 22 bp, Artificial Sequence
  chemically synthesized
ttgatgtgctgctggattcggt

SEQ ID NO: 772810 - DNA, 22 bp, Artificial Sequence
  chemically synthesized
tttgatgtgctgctggattcgg

SEQ ID NO: 772811 - DNA, 22 bp, Artificial Sequence
  chemically synthesized
gcaaaccgaatccagcagcaca

SEQ ID NO: 772812 - DNA, 22 bp, Artificial Sequence
  chemically synthesized
atcatggtggataagctttttg

SEQ ID NO: 772813 - DNA, 22 bp, Artificial Sequence
  chemically synthesized
gatcatggtggataagcttttt

SEQ ID NO: 772814 - DNA, 22 bp, Artificial Sequence
  chemically synthesized
atccaccatgatcaagtgggct

SEQ ID NO: 772815 - DNA, 22 bp, Artificial Sequence
  chemically synthesized
tccaccatgatcaagtgggctt

SEQ ID NO: 772816 - DNA, 22 bp, Artificial Sequence
  chemically synthesized
catcccagggatgaagcccact

SEQ ID NO: 772817 - DNA, 22 bp, Artificial Sequence
  chemically synthesized
gcatcccagggatgaagcccac

SEQ ID NO: 772818 - DNA, 22 bp, Artificial Sequence
  chemically synthesized
aaccagccttgcatcccaggga

SEQ ID NO: 772819 - DNA, 22 bp, Artificial Sequence
  chemically synthesized
cgtatattgaaccagccttgca

SEQ ID NO: 772820 - DNA, 22 bp, Artificial Sequence
  chemically synthesized
catccctgggatgcaaggctgg

SEQ ID NO: 772821 - DNA, 22 bp, Artificial Sequence
  chemically synthesized
gcgtatattgaaccagccttgc

SEQ ID NO: 772822 - DNA, 22 bp, Artificial Sequence
  chemically synthesized
atccctgggatgcaaggctggt

SEQ ID NO: 772823 - DNA, 22 bp, Artificial Sequence
  chemically synthesized
atttgcgtatattgaaccagcc

SEQ ID NO: 772824 - DNA, 22 bp, Artificial Sequence
  chemically synthesized
ttgatttgcgtatattgaacca

SEQ ID NO: 772825 - DNA, 22 bp, Artificial Sequence
  chemically synthesized
ggatgcaaggctggttcaatat

SEQ ID NO: 772826 - DNA, 22 bp, Artificial Sequence
  chemically synthesized
attgatttgcgtatattgaacc

SEQ ID NO: 772827 - DNA, 22 bp, Artificial Sequence
  chemically synthesized
catttattgatttgcgtatatt

SEQ ID NO: 772828 - DNA, 22 bp, Artificial Sequence
  chemically synthesized
gattacatttattgatttgcgt

SEQ ID NO: 772829 - DNA, 22 bp, Artificial Sequence
  chemically synthesized
gttcaatatacgcaaatcaata

SEQ ID NO: 772830 - DNA, 22 bp, Artificial Sequence
  chemically synthesized
aatatacgcaaatcaataaatg

SEQ ID NO: 772831 - DNA, 22 bp, Artificial Sequence
  chemically synthesized
tatgctggattacatttattga

SEQ ID NO: 772832 - DNA, 22 bp, Artificial Sequence
  chemically synthesized
atatgctggattacatttattg

SEQ ID NO: 772833 - DNA, 22 bp, Artificial Sequence
  chemically synthesized
tttatatgctggattacattta

SEQ ID NO: 772834 - DNA, 22 bp, Artificial Sequence
  chemically synthesized
tgtttatatgctggattacatt

SEQ ID NO: 772835 - DNA, 22 bp, Artificial Sequence
  chemically synthesized
gctctgtttatatgctggatta

SEQ ID NO: 772836 - DNA, 22 bp, Artificial Sequence
  chemically synthesized
ggctctgtttatatgctggatt

SEQ ID NO: 772837 - DNA, 22 bp, Artificial Sequence
  chemically synthesized
tggctctgtttatatgctggat

SEQ ID NO: 772838 - DNA, 22 bp, Artificial Sequence
  chemically synthesized
tctttggctctgtttatatgct

SEQ ID NO: 772839 - DNA, 22 bp, Artificial Sequence
  chemically synthesized
gtctttggctctgtttatatgc

SEQ ID NO: 772840 - DNA, 22 bp, Artificial Sequence
  chemically synthesized
tgtctttggctctgtttatatg

SEQ ID NO: 772841 - DNA, 22 bp, Artificial Sequence
  chemically synthesized
ttgtctttggctctgtttatat

SEQ ID NO: 772842 - DNA, 22 bp, Artificial Sequence
  chemically synthesized
agataatcatgtggtttttgtc

SEQ ID NO: 772843 - DNA, 22 bp, Artificial Sequence
  chemically synthesized
ttgagataatcatgtggttttt

SEQ ID NO: 772844 - DNA, 22 bp, Artificial Sequence
  chemically synthesized
catctattgagataatcatgtg

SEQ ID NO: 772845 - DNA, 22 bp, Artificial Sequence
  chemically synthesized
tgcatctattgagataatcatg

SEQ ID NO: 772846 - DNA, 22 bp, Artificial Sequence
  chemically synthesized
ctgcatctattgagataatcat

SEQ ID NO: 772847 - DNA, 22 bp, Artificial Sequence
  chemically synthesized
tctgcatctattgagataatca

SEQ ID NO: 772848 - DNA, 22 bp, Artificial Sequence
  chemically synthesized
ttctgcatctattgagataatc

SEQ ID NO: 772849 - DNA, 22 bp, Artificial Sequence
  chemically synthesized
tttctgcatctattgagataat

SEQ ID NO: 772850 - DNA, 22 bp, Artificial Sequence
  chemically synthesized
tcaaaggctttttctgcatcta

SEQ ID NO: 772851 - DNA, 22 bp, Artificial Sequence
  chemically synthesized
gtcaaaggctttttctgcatct

SEQ ID NO: 772852 - DNA, 22 bp, Artificial Sequence
  chemically synthesized
tgtcaaaggctttttctgcatc

SEQ ID NO: 772853 - DNA, 22 bp, Artificial Sequence
  chemically synthesized
tctcaatagatgcagaaaaagc

SEQ ID NO: 772854 - DNA, 22 bp, Artificial Sequence
  chemically synthesized
aattttgtcaaaggctttttct

SEQ ID NO: 772855 - DNA, 22 bp, Artificial Sequence
  chemically synthesized
aatagatgcagaaaaagccttt

SEQ ID NO: 772856 - DNA, 22 bp, Artificial Sequence
  chemically synthesized
ttgaattttgtcaaaggctttt

SEQ ID NO: 772857 - DNA, 22 bp, Artificial Sequence
  chemically synthesized
gcatgaagggttgttgaatttt

SEQ ID NO: 772858 - DNA, 22 bp, Artificial Sequence
  chemically synthesized
agcatgaagggttgttgaattt

SEQ ID NO: 772859 - DNA, 22 bp, Artificial Sequence
  chemically synthesized
tagcatgaagggttgttgaatt

SEQ ID NO: 772860 - DNA, 22 bp, Artificial Sequence
  chemically synthesized
ttagcatgaagggttgttgaat

SEQ ID NO: 772861 - DNA, 22 bp, Artificial Sequence
  chemically synthesized
tgacaaaattcaacaacccttc

SEQ ID NO: 772862 - DNA, 22 bp, Artificial Sequence
  chemically synthesized
gacaaaattcaacaacccttca

SEQ ID NO: 772863 - DNA, 22 bp, Artificial Sequence
  chemically synthesized
acaaaattcaacaacccttcat

SEQ ID NO: 772864 - DNA, 22 bp, Artificial Sequence
  chemically synthesized
agagtttttagcatgaagggtt

SEQ ID NO: 772865 - DNA, 22 bp, Artificial Sequence
  chemically synthesized
ttgagagtttttagcatgaagg

SEQ ID NO: 772866 - DNA, 22 bp, Artificial Sequence
  chemically synthesized
attgagagtttttagcatgaag

SEQ ID NO: 772867 - DNA, 22 bp, Artificial Sequence
  chemically synthesized
atttattgagagtttttagcat

SEQ ID NO: 772868 - DNA, 22 bp, Artificial Sequence
  chemically synthesized
aacaacccttcatgctaaaaac

SEQ ID NO: 772869 - DNA, 22 bp, Artificial Sequence
  chemically synthesized
catgctaaaaactctcaataaa

SEQ ID NO: 772870 - DNA, 22 bp, Artificial Sequence
  chemically synthesized
atgctaaaaactctcaataaat

SEQ ID NO: 772871 - DNA, 22 bp, Artificial Sequence
  chemically synthesized
aaaactctcaataaattaggta

SEQ ID NO: 772872 - DNA, 22 bp, Artificial Sequence
  chemically synthesized
aaatacgtcccatcaataccta

SEQ ID NO: 772873 - DNA, 22 bp, Artificial Sequence
  chemically synthesized
gaaatacgtcccatcaatacct

SEQ ID NO: 772874 - DNA, 22 bp, Artificial Sequence
  chemically synthesized
tgaaatacgtcccatcaatacc

SEQ ID NO: 772875 - DNA, 22 bp, Artificial Sequence
  chemically synthesized
tcaataaattaggtattgatgg

SEQ ID NO: 772876 - DNA, 22 bp, Artificial Sequence
  chemically synthesized
aataaattaggtattgatggga

SEQ ID NO: 772877 - DNA, 22 bp, Artificial Sequence
  chemically synthesized
ttttgaaatacgtcccatcaat

SEQ ID NO: 772878 - DNA, 22 bp, Artificial Sequence
  chemically synthesized
ttattttgaaatacgtcccatc

SEQ ID NO: 772879 - DNA, 22 bp, Artificial Sequence
  chemically synthesized
attattttgaaatacgtcccat

SEQ ID NO: 772880 - DNA, 22 bp, Artificial Sequence
  chemically synthesized
ttattattttgaaatacgtccc

SEQ ID NO: 772881 - DNA, 22 bp, Artificial Sequence
  chemically synthesized
ggtattgatgggacgtatttca

SEQ ID NO: 772882 - DNA, 22 bp, Artificial Sequence
  chemically synthesized
atgggacgtatttcaaaataat

SEQ ID NO: 772883 - DNA, 22 bp, Artificial Sequence
  chemically synthesized
tcatagatagctcttattattt

SEQ ID NO: 772884 - DNA, 22 bp, Artificial Sequence
  chemically synthesized
gtcatagatagctcttattatt

SEQ ID NO: 772885 - DNA, 22 bp, Artificial Sequence
  chemically synthesized
tgggtttgtcatagatagctct

SEQ ID NO: 772886 - DNA, 22 bp, Artificial Sequence
  chemically synthesized
caaaataataagagctatctat

SEQ ID NO: 772887 - DNA, 22 bp, Artificial Sequence
  chemically synthesized
aaaataataagagctatctatg

SEQ ID NO: 772888 - DNA, 22 bp, Artificial Sequence
  chemically synthesized
gctgtgggtttgtcatagatag

SEQ ID NO: 772889 - DNA, 22 bp, Artificial Sequence
  chemically synthesized
agtatgatattggctgtgggtt

SEQ ID NO: 772890 - DNA, 22 bp, Artificial Sequence
  chemically synthesized
tctatgacaaacccacagccaa

SEQ ID NO: 772891 - DNA, 22 bp, Artificial Sequence
  chemically synthesized
tgacaaacccacagccaatatc

SEQ ID NO: 772892 - DNA, 22 bp, Artificial Sequence
  chemically synthesized
cccattcagtatgatattggct

SEQ ID NO: 772893 - DNA, 22 bp, Artificial Sequence
  chemically synthesized
gcccattcagtatgatattggc

SEQ ID NO: 772894 - DNA, 22 bp, Artificial Sequence
  chemically synthesized
tgcccattcagtatgatattgg

SEQ ID NO: 772895 - DNA, 22 bp, Artificial Sequence
  chemically synthesized
ttgcccattcagtatgatattg

SEQ ID NO: 772896 - DNA, 22 bp, Artificial Sequence
  chemically synthesized
cagtttttgcccattcagtatg

SEQ ID NO: 772897 - DNA, 22 bp, Artificial Sequence
  chemically synthesized
ccagtttttgcccattcagtat

SEQ ID NO: 772898 - DNA, 22 bp, Artificial Sequence
  chemically synthesized
aagggaatgcttccagtttttg

SEQ ID NO: 772899 - DNA, 22 bp, Artificial Sequence
  chemically synthesized
aaagggaatgcttccagttttt

SEQ ID NO: 772900 - DNA, 22 bp, Artificial Sequence
  chemically synthesized
taaagggaatgcttccagtttt

SEQ ID NO: 772901 - DNA, 22 bp, Artificial Sequence
  chemically synthesized
ttaaagggaatgcttccagttt

SEQ ID NO: 772902 - DNA, 22 bp, Artificial Sequence
  chemically synthesized
aatgggcaaaaactggaagcat

SEQ ID NO: 772903 - DNA, 22 bp, Artificial Sequence
  chemically synthesized
tgccagtttttaaagggaatgc

SEQ ID NO: 772904 - DNA, 22 bp, Artificial Sequence
  chemically synthesized
gtgccagtttttaaagggaatg

SEQ ID NO: 772905 - DNA, 22 bp, Artificial Sequence
  chemically synthesized
tcttgtgccagtttttaaaggg

SEQ ID NO: 772906 - DNA, 22 bp, Artificial Sequence
  chemically synthesized
gaagcattccctttaaaaactg

SEQ ID NO: 772907 - DNA, 22 bp, Artificial Sequence
  chemically synthesized
cctttaaaaactggcacaagac

SEQ ID NO: 772908 - DNA, 22 bp, Artificial Sequence
  chemically synthesized
taaaaactggcacaagacaggg

SEQ ID NO: 772909 - DNA, 22 bp, Artificial Sequence
  chemically synthesized
aaaaactggcacaagacaggga

SEQ ID NO: 772910 - DNA, 22 bp, Artificial Sequence
  chemically synthesized
aaaactggcacaagacagggat

SEQ ID NO: 772911 - DNA, 22 bp, Artificial Sequence
  chemically synthesized
gcacaagacagggatgccctct

SEQ ID NO: 772912 - DNA, 22 bp, Artificial Sequence
  chemically synthesized
aataggagtggtgagagagggc

SEQ ID NO: 772913 - DNA, 22 bp, Artificial Sequence
  chemically synthesized
tgttgaataggagtggtgagag

SEQ ID NO: 772914 - DNA, 22 bp, Artificial Sequence
  chemically synthesized
caacactatgttgaataggagt

SEQ ID NO: 772915 - DNA, 22 bp, Artificial Sequence
  chemically synthesized
ccaacactatgttgaataggag

SEQ ID NO: 772916 - DNA, 22 bp, Artificial Sequence
  chemically synthesized
tctcaccactcctattcaacat

SEQ ID NO: 772917 - DNA, 22 bp, Artificial Sequence
  chemically synthesized
tcaccactcctattcaacatag

SEQ ID NO: 772918 - DNA, 22 bp, Artificial Sequence
  chemically synthesized
accactcctattcaacatagtg

SEQ ID NO: 772919 - DNA, 22 bp, Artificial Sequence
  chemically synthesized
gccagaacttccaacactatgt

SEQ ID NO: 772920 - DNA, 22 bp, Artificial Sequence
  chemically synthesized
ctattcaacatagtgttggaag

SEQ ID NO: 772921 - DNA, 22 bp, Artificial Sequence
  chemically synthesized
ccctggccagaacttccaacac

SEQ ID NO: 772922 - DNA, 22 bp, Artificial Sequence
  chemically synthesized
ttcaacatagtgttggaagttc

SEQ ID NO: 772923 - DNA, 22 bp, Artificial Sequence
  chemically synthesized
attgccctggccagaacttcca

SEQ ID NO: 772924 - DNA, 22 bp, Artificial Sequence
  chemically synthesized
aacatagtgttggaagttctgg

SEQ ID NO: 772925 - DNA, 22 bp, Artificial Sequence
  chemically synthesized
cctgattgccctggccagaact

SEQ ID NO: 772926 - DNA, 22 bp, Artificial Sequence
  chemically synthesized
ctgcctgattgccctggccaga

SEQ ID NO: 772927 - DNA, 22 bp, Artificial Sequence
  chemically synthesized
tcctgcctgattgccctggcca

SEQ ID NO: 772928 - DNA, 22 bp, Artificial Sequence
  chemically synthesized
ctcctgcctgattgccctggcc

SEQ ID NO: 772929 - DNA, 22 bp, Artificial Sequence
  chemically synthesized
cttctcctgcctgattgccctg

SEQ ID NO: 772930 - DNA, 22 bp, Artificial Sequence
  chemically synthesized
gaagttctggccagggcaatca

SEQ ID NO: 772931 - DNA, 22 bp, Artificial Sequence
  chemically synthesized
ccttctcctgcctgattgccct

SEQ ID NO: 772932 - DNA, 22 bp, Artificial Sequence
  chemically synthesized
tttccttctcctgcctgattgc

SEQ ID NO: 772933 - DNA, 22 bp, Artificial Sequence
  chemically synthesized
atttccttctcctgcctgattg

SEQ ID NO: 772934 - DNA, 22 bp, Artificial Sequence
  chemically synthesized
tatttccttctcctgcctgatt

SEQ ID NO: 772935 - DNA, 22 bp, Artificial Sequence
  chemically synthesized
tggccagggcaatcaggcagga

SEQ ID NO: 772936 - DNA, 22 bp, Artificial Sequence
  chemically synthesized
gccagggcaatcaggcaggaga

SEQ ID NO: 772937 - DNA, 22 bp, Artificial Sequence
  chemically synthesized
aataccctttatttccttctcc

SEQ ID NO: 772938 - DNA, 22 bp, Artificial Sequence
  chemically synthesized
attgaataccctttatttcctt

SEQ ID NO: 772939 - DNA, 22 bp, Artificial Sequence
  chemically synthesized
ctaattgaataccctttatttc

SEQ ID NO: 772940 - DNA, 22 bp, Artificial Sequence
  chemically synthesized
cctaattgaataccctttattt

SEQ ID NO: 772941 - DNA, 22 bp, Artificial Sequence
  chemically synthesized
tcctaattgaataccctttatt

SEQ ID NO: 772942 - DNA, 22 bp, Artificial Sequence
  chemically synthesized
ttcctaattgaataccctttat

SEQ ID NO: 772943 - DNA, 22 bp, Artificial Sequence
  chemically synthesized
ttttcctaattgaatacccttt

SEQ ID NO: 772944 - DNA, 22 bp, Artificial Sequence
  chemically synthesized
ctcttttcctaattgaataccc

SEQ ID NO: 772945 - DNA, 22 bp, Artificial Sequence
  chemically synthesized
cctcttttcctaattgaatacc

SEQ ID NO: 772946 - DNA, 22 bp, Artificial Sequence
  chemically synthesized
acttcctcttttcctaattgaa

SEQ ID NO: 772947 - DNA, 22 bp, Artificial Sequence
  chemically synthesized
gacttcctcttttcctaattga

SEQ ID NO: 772948 - DNA, 22 bp, Artificial Sequence
  chemically synthesized
aattaggaaaagaggaagtcaa

SEQ ID NO: 772949 - DNA, 22 bp, Artificial Sequence
  chemically synthesized
caaacagggacaatttgacttc

SEQ ID NO: 772950 - DNA, 22 bp, Artificial Sequence
  chemically synthesized
ggaaaagaggaagtcaaattgt

SEQ ID NO: 772951 - DNA, 22 bp, Artificial Sequence
  chemically synthesized
gataaacaatcatgtcgtctgc

SEQ ID NO: 772952 - DNA, 22 bp, Artificial Sequence
  chemically synthesized
tagataaacaatcatgtcgtct

SEQ ID NO: 772953 - DNA, 22 bp, Artificial Sequence
  chemically synthesized
tccctgtttgcagacgacatga

SEQ ID NO: 772954 - DNA, 22 bp, Artificial Sequence
  chemically synthesized
ctagataaacaatcatgtcgtc

SEQ ID NO: 772955 - DNA, 22 bp, Artificial Sequence
  chemically synthesized
tctagataaacaatcatgtcgt

SEQ ID NO: 772956 - DNA, 22 bp, Artificial Sequence
  chemically synthesized
tttgcagacgacatgattgttt

SEQ ID NO: 772957 - DNA, 22 bp, Artificial Sequence
  chemically synthesized
gcagacgacatgattgtttatc

SEQ ID NO: 772958 - DNA, 22 bp, Artificial Sequence
  chemically synthesized
cagacgacatgattgtttatct

SEQ ID NO: 772959 - DNA, 22 bp, Artificial Sequence
  chemically synthesized
agacgatggggttttctagata

SEQ ID NO: 772960 - DNA, 22 bp, Artificial Sequence
  chemically synthesized
ggctgagacgatggggttttct

SEQ ID NO: 772961 - DNA, 22 bp, Artificial Sequence
  chemically synthesized
gggctgagacgatggggttttc

SEQ ID NO: 772962 - DNA, 22 bp, Artificial Sequence
  chemically synthesized
tgggctgagacgatggggtttt

SEQ ID NO: 772963 - DNA, 22 bp, Artificial Sequence
  chemically synthesized
tttatctagaaaaccccatcgt

SEQ ID NO: 772964 - DNA, 22 bp, Artificial Sequence
  chemically synthesized
atctagaaaaccccatcgtctc

SEQ ID NO: 772965 - DNA, 22 bp, Artificial Sequence
  chemically synthesized
tctagaaaaccccatcgtctca

SEQ ID NO: 772966 - DNA, 22 bp, Artificial Sequence
  chemically synthesized
aggagattttgggctgagacga

SEQ ID NO: 772967 - DNA, 22 bp, Artificial Sequence
  chemically synthesized
aaggagattttgggctgagacg

SEQ ID NO: 772968 - DNA, 22 bp, Artificial Sequence
  chemically synthesized
gaaaaccccatcgtctcagccc

SEQ ID NO: 772969 - DNA, 22 bp, Artificial Sequence
  chemically synthesized
tcagcttaaggagattttgggc

SEQ ID NO: 772970 - DNA, 22 bp, Artificial Sequence
  chemically synthesized
atcagcttaaggagattttggg

SEQ ID NO: 772971 - DNA, 22 bp, Artificial Sequence
  chemically synthesized
cttatcagcttaaggagatttt

SEQ ID NO: 772972 - DNA, 22 bp, Artificial Sequence
  chemically synthesized
aagttgcttatcagcttaagga

SEQ ID NO: 772973 - DNA, 22 bp, Artificial Sequence
  chemically synthesized
agcccaaaatctccttaagctg

SEQ ID NO: 772974 - DNA, 22 bp, Artificial Sequence
  chemically synthesized
ctgaagttgcttatcagcttaa

SEQ ID NO: 772975 - DNA, 22 bp, Artificial Sequence
  chemically synthesized
gctgaagttgcttatcagctta

SEQ ID NO: 772976 - DNA, 22 bp, Artificial Sequence
  chemically synthesized
tgctgaagttgcttatcagctt

SEQ ID NO: 772977 - DNA, 22 bp, Artificial Sequence
  chemically synthesized
agactttgctgaagttgcttat

SEQ ID NO: 772978 - DNA, 22 bp, Artificial Sequence
  chemically synthesized
cttaagctgataagcaacttca

SEQ ID NO: 772979 - DNA, 22 bp, Artificial Sequence
  chemically synthesized
aagctgataagcaacttcagca

SEQ ID NO: 772980 - DNA, 22 bp, Artificial Sequence
  chemically synthesized
agctgataagcaacttcagcaa

SEQ ID NO: 772981 - DNA, 22 bp, Artificial Sequence
  chemically synthesized
tatcctgagactttgctgaagt

SEQ ID NO: 772982 - DNA, 22 bp, Artificial Sequence
  chemically synthesized
gtatcctgagactttgctgaag

SEQ ID NO: 772983 - DNA, 22 bp, Artificial Sequence
  chemically synthesized
tgtatcctgagactttgctgaa

SEQ ID NO: 772984 - DNA, 22 bp, Artificial Sequence
  chemically synthesized
ataagcaacttcagcaaagtct

SEQ ID NO: 772985 - DNA, 22 bp, Artificial Sequence
  chemically synthesized
attttgtatcctgagactttgc

SEQ ID NO: 772986 - DNA, 22 bp, Artificial Sequence
  chemically synthesized
gtacattgattttgtatcctga

SEQ ID NO: 772987 - DNA, 22 bp, Artificial Sequence
  chemically synthesized
agtacattgattttgtatcctg

SEQ ID NO: 772988 - DNA, 22 bp, Artificial Sequence
  chemically synthesized
cagcaaagtctcaggatacaaa

SEQ ID NO: 772989 - DNA, 22 bp, Artificial Sequence
  chemically synthesized
tagtacattgattttgtatcct

SEQ ID NO: 772990 - DNA, 22 bp, Artificial Sequence
  chemically synthesized
agcaaagtctcaggatacaaaa

SEQ ID NO: 772991 - DNA, 22 bp, Artificial Sequence
  chemically synthesized
tgattttagtacattgattttg

SEQ ID NO: 772992 - DNA, 22 bp, Artificial Sequence
  chemically synthesized
gtgattttagtacattgatttt

SEQ ID NO: 772993 - DNA, 22 bp, Artificial Sequence
  chemically synthesized
aggatacaaaatcaatgtacta

SEQ ID NO: 772994 - DNA, 22 bp, Artificial Sequence
  chemically synthesized
gtgtataagaatgcttgtgatt

SEQ ID NO: 772995 - DNA, 22 bp, Artificial Sequence
  chemically synthesized
ttggtgtataagaatgcttgtg

SEQ ID NO: 772996 - DNA, 22 bp, Artificial Sequence
  chemically synthesized
ttgttggtgtataagaatgctt

SEQ ID NO: 772997 - DNA, 22 bp, Artificial Sequence
  chemically synthesized
tctgttgttggtgtataagaat

SEQ ID NO: 772998 - DNA, 22 bp, Artificial Sequence
  chemically synthesized
aaatcacaagcattcttataca

SEQ ID NO: 772999 - DNA, 22 bp, Artificial Sequence
  chemically synthesized
gtctgttgttggtgtataagaa

SEQ ID NO: 773000 - DNA, 22 bp, Artificial Sequence
  chemically synthesized
tttgtctgttgttggtgtataa

SEQ ID NO: 773001 - DNA, 22 bp, Artificial Sequence
  chemically synthesized
tgtttgtctgttgttggtgtat

SEQ ID NO: 773002 - DNA, 22 bp, Artificial Sequence
  chemically synthesized
tctgtttgtctgttgttggtgt

SEQ ID NO: 773003 - DNA, 22 bp, Artificial Sequence
  chemically synthesized
gctctctgtttgtctgttgttg

SEQ ID NO: 773004 - DNA, 22 bp, Artificial Sequence
  chemically synthesized
ggctctctgtttgtctgttgtt

SEQ ID NO: 773005 - DNA, 22 bp, Artificial Sequence
  chemically synthesized
ttatacaccaacaacagacaaa

SEQ ID NO: 773006 - DNA, 22 bp, Artificial Sequence
  chemically synthesized
atacaccaacaacagacaaaca

SEQ ID NO: 773007 - DNA, 22 bp, Artificial Sequence
  chemically synthesized
tacaccaacaacagacaaacag

SEQ ID NO: 773008 - DNA, 22 bp, Artificial Sequence
  chemically synthesized
atgatttggctctctgtttgtc

SEQ ID NO: 773009 - DNA, 22 bp, Artificial Sequence
  chemically synthesized
actcatgatttggctctctgtt

SEQ ID NO: 773010 - DNA, 22 bp, Artificial Sequence
  chemically synthesized
tgaatgggagttcactcatgat

SEQ ID NO: 773011 - DNA, 22 bp, Artificial Sequence
  chemically synthesized
aagcaattgtgaatgggagttc

SEQ ID NO: 773012 - DNA, 22 bp, Artificial Sequence
  chemically synthesized
gaagcaattgtgaatgggagtt

SEQ ID NO: 773013 - DNA, 22 bp, Artificial Sequence
  chemically synthesized
tgaagcaattgtgaatgggagt

SEQ ID NO: 773014 - DNA, 22 bp, Artificial Sequence
  chemically synthesized
tttgaagcaattgtgaatggga

SEQ ID NO: 773015 - DNA, 22 bp, Artificial Sequence
  chemically synthesized
tctttgaagcaattgtgaatgg

SEQ ID NO: 773016 - DNA, 22 bp, Artificial Sequence
  chemically synthesized
ttctctttgaagcaattgtgaa

SEQ ID NO: 773017 - DNA, 22 bp, Artificial Sequence
  chemically synthesized
attctctttgaagcaattgtga

SEQ ID NO: 773018 - DNA, 22 bp, Artificial Sequence
  chemically synthesized
tattctctttgaagcaattgtg

SEQ ID NO: 773019 - DNA, 22 bp, Artificial Sequence
  chemically synthesized
ccattcacaattgcttcaaaga

SEQ ID NO: 773020 - DNA, 22 bp, Artificial Sequence
  chemically synthesized
ggtattttattctctttgaagc

SEQ ID NO: 773021 - DNA, 22 bp, Artificial Sequence
  chemically synthesized
ctaggtattttattctctttga

SEQ ID NO: 773022 - DNA, 22 bp, Artificial Sequence
  chemically synthesized
acaattgcttcaaagagaataa

SEQ ID NO: 773023 - DNA, 22 bp, Artificial Sequence
  chemically synthesized
gattcctaggtattttattctc

SEQ ID NO: 773024 - DNA, 22 bp, Artificial Sequence
  chemically synthesized
cttcaaagagaataaaatacct

SEQ ID NO: 773025 - DNA, 22 bp, Artificial Sequence
  chemically synthesized
taagttggattcctaggtattt

SEQ ID NO: 773026 - DNA, 22 bp, Artificial Sequence
  chemically synthesized
caaagagaataaaatacctagg

SEQ ID NO: 773027 - DNA, 22 bp, Artificial Sequence
  chemically synthesized
gtaagttggattcctaggtatt

SEQ ID NO: 773028 - DNA, 22 bp, Artificial Sequence
  chemically synthesized
aaagagaataaaatacctagga

SEQ ID NO: 773029 - DNA, 22 bp, Artificial Sequence
  chemically synthesized
acatcccttgtaagttggattc

SEQ ID NO: 773030 - DNA, 22 bp, Artificial Sequence
  chemically synthesized
cacatcccttgtaagttggatt

SEQ ID NO: 773031 - DNA, 22 bp, Artificial Sequence
  chemically synthesized
ggaatccaacttacaagggatg

SEQ ID NO: 773032 - DNA, 22 bp, Artificial Sequence
  chemically synthesized
aagaggtccttcacatcccttg

SEQ ID NO: 773033 - DNA, 22 bp, Artificial Sequence
  chemically synthesized
gaagaggtccttcacatccctt

SEQ ID NO: 773034 - DNA, 22 bp, Artificial Sequence
  chemically synthesized
cttgaagaggtccttcacatcc

SEQ ID NO: 773035 - DNA, 22 bp, Artificial Sequence
  chemically synthesized
tccttgaagaggtccttcacat

SEQ ID NO: 773036 - DNA, 22 bp, Artificial Sequence
  chemically synthesized
acaagggatgtgaaggacctct

SEQ ID NO: 773037 - DNA, 22 bp, Artificial Sequence
  chemically synthesized
caagggatgtgaaggacctctt

SEQ ID NO: 773038 - DNA, 22 bp, Artificial Sequence
  chemically synthesized
tagttctccttgaagaggtcct

SEQ ID NO: 773039 - DNA, 22 bp, Artificial Sequence
  chemically synthesized
gtagttctccttgaagaggtcc

SEQ ID NO: 773040 - DNA, 22 bp, Artificial Sequence
  chemically synthesized
agcagtggtttgtagttctcct

SEQ ID NO: 773041 - DNA, 22 bp, Artificial Sequence
  chemically synthesized
gagcagtggtttgtagttctcc

SEQ ID NO: 773042 - DNA, 22 bp, Artificial Sequence
  chemically synthesized
cttgagcagtggtttgtagttc

SEQ ID NO: 773043 - DNA, 22 bp, Artificial Sequence
  chemically synthesized
ccttgagcagtggtttgtagtt

SEQ ID NO: 773044 - DNA, 22 bp, Artificial Sequence
  chemically synthesized
ttcaaggagaactacaaaccac

SEQ ID NO: 773045 - DNA, 22 bp, Artificial Sequence
  chemically synthesized
tttccttgagcagtggtttgta

SEQ ID NO: 773046 - DNA, 22 bp, Artificial Sequence
  chemically synthesized
atttccttgagcagtggtttgt

SEQ ID NO: 773047 - DNA, 22 bp, Artificial Sequence
  chemically synthesized
caaggagaactacaaaccactg

SEQ ID NO: 773048 - DNA, 22 bp, Artificial Sequence
  chemically synthesized
tatttccttgagcagtggtttg

SEQ ID NO: 773049 - DNA, 22 bp, Artificial Sequence
  chemically synthesized
aaggagaactacaaaccactgc

SEQ ID NO: 773050 - DNA, 22 bp, Artificial Sequence
  chemically synthesized
ttatttccttgagcagtggttt

SEQ ID NO: 773051 - DNA, 22 bp, Artificial Sequence
  chemically synthesized
ttttatttccttgagcagtggt

SEQ ID NO: 773052 - DNA, 22 bp, Artificial Sequence
  chemically synthesized
tgtcctcttttatttccttgag

SEQ ID NO: 773053 - DNA, 22 bp, Artificial Sequence
  chemically synthesized
gtgtcctcttttatttccttga

SEQ ID NO: 773054 - DNA, 22 bp, Artificial Sequence
  chemically synthesized
caaaccactgctcaaggaaata

SEQ ID NO: 773055 - DNA, 22 bp, Artificial Sequence
  chemically synthesized
tttgtgtcctcttttatttcct

SEQ ID NO: 773056 - DNA, 22 bp, Artificial Sequence
  chemically synthesized
gtttgtgtcctcttttatttcc

SEQ ID NO: 773057 - DNA, 22 bp, Artificial Sequence
  chemically synthesized
catttgtttgtgtcctctttta

SEQ ID NO: 773058 - DNA, 22 bp, Artificial Sequence
  chemically synthesized
ccatttgtttgtgtcctctttt

SEQ ID NO: 773059 - DNA, 22 bp, Artificial Sequence
  chemically synthesized
ctcaaggaaataaaagaggaca

SEQ ID NO: 773060 - DNA, 22 bp, Artificial Sequence
  chemically synthesized
ttccatttgtttgtgtcctctt

SEQ ID NO: 773061 - DNA, 22 bp, Artificial Sequence
  chemically synthesized
aaggaaataaaagaggacacaa

SEQ ID NO: 773062 - DNA, 22 bp, Artificial Sequence
  chemically synthesized
cccatgagcatggaatattctt

SEQ ID NO: 773063 - DNA, 22 bp, Artificial Sequence
  chemically synthesized
ctacccatgagcatggaatatt

SEQ ID NO: 773064 - DNA, 22 bp, Artificial Sequence
  chemically synthesized
cctacccatgagcatggaatat

SEQ ID NO: 773065 - DNA, 22 bp, Artificial Sequence
  chemically synthesized
ttcctacccatgagcatggaat

SEQ ID NO: 773066 - DNA, 22 bp, Artificial Sequence
  chemically synthesized
attcttcctacccatgagcatg

SEQ ID NO: 773067 - DNA, 22 bp, Artificial Sequence
  chemically synthesized
acgatattgattcttcctaccc

SEQ ID NO: 773068 - DNA, 22 bp, Artificial Sequence
  chemically synthesized
cacgatattgattcttcctacc

SEQ ID NO: 773069 - DNA, 22 bp, Artificial Sequence
  chemically synthesized
tcacgatattgattcttcctac

SEQ ID NO: 773070 - DNA, 22 bp, Artificial Sequence
  chemically synthesized
catgctcatgggtaggaagaat

SEQ ID NO: 773071 - DNA, 22 bp, Artificial Sequence
  chemically synthesized
atgggtaggaagaatcaatatc

SEQ ID NO: 773072 - DNA, 22 bp, Artificial Sequence
  chemically synthesized
ggcagtatggccattttcacga

SEQ ID NO: 773073 - DNA, 22 bp, Artificial Sequence
  chemically synthesized
gggcagtatggccattttcacg

SEQ ID NO: 773074 - DNA, 22 bp, Artificial Sequence
  chemically synthesized
ccttgggcagtatggccatttt

SEQ ID NO: 773075 - DNA, 22 bp, Artificial Sequence
  chemically synthesized
taaattaccttgggcagtatgg

SEQ ID NO: 773076 - DNA, 22 bp, Artificial Sequence
  chemically synthesized
aatctgtaaattaccttgggca

SEQ ID NO: 773077 - DNA, 22 bp, Artificial Sequence
  chemically synthesized
cccaaggtaatttacagattca

SEQ ID NO: 773078 - DNA, 22 bp, Artificial Sequence
  chemically synthesized
atggggatggcattgaatctgt

SEQ ID NO: 773079 - DNA, 22 bp, Artificial Sequence
  chemically synthesized
gatggggatggcattgaatctg

SEQ ID NO: 773080 - DNA, 22 bp, Artificial Sequence
  chemically synthesized
gtagcttgatggggatggcatt

SEQ ID NO: 773081 - DNA, 22 bp, Artificial Sequence
  chemically synthesized
acagattcaatgccatccccat

SEQ ID NO: 773082 - DNA, 22 bp, Artificial Sequence
  chemically synthesized
cagattcaatgccatccccatc

SEQ ID NO: 773083 - DNA, 22 bp, Artificial Sequence
  chemically synthesized
aatgccatccccatcaagctac

SEQ ID NO: 773084 - DNA, 22 bp, Artificial Sequence
  chemically synthesized
tgaagaaagtcattggtagctt

SEQ ID NO: 773085 - DNA, 22 bp, Artificial Sequence
  chemically synthesized
tgtgaagaaagtcattggtagc

SEQ ID NO: 773086 - DNA, 22 bp, Artificial Sequence
  chemically synthesized
caattctgtgaagaaagtcatt

SEQ ID NO: 773087 - DNA, 22 bp, Artificial Sequence
  chemically synthesized
ccaattctgtgaagaaagtcat

SEQ ID NO: 773088 - DNA, 22 bp, Artificial Sequence
  chemically synthesized
tccaattctgtgaagaaagtca

SEQ ID NO: 773089 - DNA, 22 bp, Artificial Sequence
  chemically synthesized
ttccaattctgtgaagaaagtc

SEQ ID NO: 773090 - DNA, 22 bp, Artificial Sequence
  chemically synthesized
tttccaattctgtgaagaaagt

SEQ ID NO: 773091 - DNA, 22 bp, Artificial Sequence
  chemically synthesized
ccaatgactttcttcacagaat

SEQ ID NO: 773092 - DNA, 22 bp, Artificial Sequence
  chemically synthesized
aagtagttttttccaattctgt

SEQ ID NO: 773093 - DNA, 22 bp, Artificial Sequence
  chemically synthesized
aaagtagttttttccaattctg

SEQ ID NO: 773094 - DNA, 22 bp, Artificial Sequence
  chemically synthesized
taaagtagttttttccaattct

SEQ ID NO: 773095 - DNA, 22 bp, Artificial Sequence
  chemically synthesized
tcttcacagaattggaaaaaac

SEQ ID NO: 773096 - DNA, 22 bp, Artificial Sequence
  chemically synthesized
cttcacagaattggaaaaaact

SEQ ID NO: 773097 - DNA, 22 bp, Artificial Sequence
  chemically synthesized
ttcacagaattggaaaaaacta

SEQ ID NO: 773098 - DNA, 22 bp, Artificial Sequence
  chemically synthesized
cacagaattggaaaaaactact

SEQ ID NO: 773099 - DNA, 22 bp, Artificial Sequence
  chemically synthesized
acagaattggaaaaaactactt

SEQ ID NO: 773100 - DNA, 22 bp, Artificial Sequence
  chemically synthesized
catatgaactttaaagtagttt

SEQ ID NO: 773101 - DNA, 22 bp, Artificial Sequence
  chemically synthesized
gttccatatgaactttaaagta

SEQ ID NO: 773102 - DNA, 22 bp, Artificial Sequence
  chemically synthesized
ggttccatatgaactttaaagt

SEQ ID NO: 773103 - DNA, 22 bp, Artificial Sequence
  chemically synthesized
tggttccatatgaactttaaag

SEQ ID NO: 773104 - DNA, 22 bp, Artificial Sequence
  chemically synthesized
ttggttccatatgaactttaaa

SEQ ID NO: 773105 - DNA, 22 bp, Artificial Sequence
  chemically synthesized
gaaaaaactactttaaagttca

SEQ ID NO: 773106 - DNA, 22 bp, Artificial Sequence
  chemically synthesized
tttggttccatatgaactttaa

SEQ ID NO: 773107 - DNA, 22 bp, Artificial Sequence
  chemically synthesized
ttttggttccatatgaacttta

SEQ ID NO: 773108 - DNA, 22 bp, Artificial Sequence
  chemically synthesized
ttttttggttccatatgaactt

SEQ ID NO: 773109 - DNA, 22 bp, Artificial Sequence
  chemically synthesized
ctttaaagttcatatggaacca

SEQ ID NO: 773110 - DNA, 22 bp, Artificial Sequence
  chemically synthesized
taaagttcatatggaaccaaaa

SEQ ID NO: 773111 - DNA, 22 bp, Artificial Sequence
  chemically synthesized
aaagttcatatggaaccaaaaa

SEQ ID NO: 773112 - DNA, 22 bp, Artificial Sequence
  chemically synthesized
aagttcatatggaaccaaaaaa

SEQ ID NO: 773113 - DNA, 22 bp, Artificial Sequence
  chemically synthesized
gcgatgcgggctcttttttggt

SEQ ID NO: 773114 - DNA, 22 bp, Artificial Sequence
  chemically synthesized
ggcgatgcgggctcttttttgg

SEQ ID NO: 773115 - DNA, 22 bp, Artificial Sequence
  chemically synthesized
atatggaaccaaaaaagagccc

SEQ ID NO: 773116 - DNA, 22 bp, Artificial Sequence
  chemically synthesized
acttggcgatgcgggctctttt

SEQ ID NO: 773117 - DNA, 22 bp, Artificial Sequence
  chemically synthesized
ggattgacttggcgatgcgggc

SEQ ID NO: 773118 - DNA, 22 bp, Artificial Sequence
  chemically synthesized
aggattgacttggcgatgcggg

SEQ ID NO: 773119 - DNA, 22 bp, Artificial Sequence
  chemically synthesized
gcttaggattgacttggcgatg

SEQ ID NO: 773120 - DNA, 22 bp, Artificial Sequence
  chemically synthesized
ggcttaggattgacttggcgat

SEQ ID NO: 773121 - DNA, 22 bp, Artificial Sequence
  chemically synthesized
tggcttaggattgacttggcga

SEQ ID NO: 773122 - DNA, 22 bp, Artificial Sequence
  chemically synthesized
ttggcttaggattgacttggcg

SEQ ID NO: 773123 - DNA, 22 bp, Artificial Sequence
  chemically synthesized
ttttggcttaggattgacttgg

SEQ ID NO: 773124 - DNA, 22 bp, Artificial Sequence
  chemically synthesized
ttcttttggcttaggattgact

SEQ ID NO: 773125 - DNA, 22 bp, Artificial Sequence
  chemically synthesized
gttcttttggcttaggattgac

SEQ ID NO: 773126 - DNA, 22 bp, Artificial Sequence
  chemically synthesized
tgttcttttggcttaggattga

SEQ ID NO: 773127 - DNA, 22 bp, Artificial Sequence
  chemically synthesized
cagctttgttcttttggcttag

SEQ ID NO: 773128 - DNA, 22 bp, Artificial Sequence
  chemically synthesized
agccaaaagaacaaagctggag

SEQ ID NO: 773129 - DNA, 22 bp, Artificial Sequence
  chemically synthesized
aagtcaggtagtgtgatgcctc

SEQ ID NO: 773130 - DNA, 22 bp, Artificial Sequence
  chemically synthesized
gaagtcaggtagtgtgatgcct

SEQ ID NO: 773131 - DNA, 22 bp, Artificial Sequence
  chemically synthesized
gaggcatcacactacctgactt

SEQ ID NO: 773132 - DNA, 22 bp, Artificial Sequence
  chemically synthesized
tagtatagtttgaagtcaggta

SEQ ID NO: 773133 - DNA, 22 bp, Artificial Sequence
  chemically synthesized
gtagtatagtttgaagtcaggt

SEQ ID NO: 773134 - DNA, 22 bp, Artificial Sequence
  chemically synthesized
tagccttgtagtatagtttgaa

SEQ ID NO: 773135 - DNA, 22 bp, Artificial Sequence
  chemically synthesized
ctgtagccttgtagtatagttt

SEQ ID NO: 773136 - DNA, 22 bp, Artificial Sequence
  chemically synthesized
cctgacttcaaactatactaca

SEQ ID NO: 773137 - DNA, 22 bp, Artificial Sequence
  chemically synthesized
gttactgtagccttgtagtata

SEQ ID NO: 773138 - DNA, 22 bp, Artificial Sequence
  chemically synthesized
ggttactgtagccttgtagtat

SEQ ID NO: 773139 - DNA, 22 bp, Artificial Sequence
  chemically synthesized
tggttactgtagccttgtagta

SEQ ID NO: 773140 - DNA, 22 bp, Artificial Sequence
  chemically synthesized
acttcaaactatactacaaggc

SEQ ID NO: 773141 - DNA, 22 bp, Artificial Sequence
  chemically synthesized
ttttggttactgtagccttgta

SEQ ID NO: 773142 - DNA, 22 bp, Artificial Sequence
  chemically synthesized
caaactatactacaaggctaca

SEQ ID NO: 773143 - DNA, 22 bp, Artificial Sequence
  chemically synthesized
aaactatactacaaggctacag

SEQ ID NO: 773144 - DNA, 22 bp, Artificial Sequence
  chemically synthesized
tactacaaggctacagtaacca

SEQ ID NO: 773145 - DNA, 22 bp, Artificial Sequence
  chemically synthesized
caaggctacagtaaccaaaaca

SEQ ID NO: 773146 - DNA, 22 bp, Artificial Sequence
  chemically synthesized
gtaccagtaccatgctgttttg

SEQ ID NO: 773147 - DNA, 22 bp, Artificial Sequence
  chemically synthesized
ggtaccagtaccatgctgtttt

SEQ ID NO: 773148 - DNA, 22 bp, Artificial Sequence
  chemically synthesized
tggtaccagtaccatgctgttt

SEQ ID NO: 773149 - DNA, 22 bp, Artificial Sequence
  chemically synthesized
cagtaaccaaaacagcatggta

SEQ ID NO: 773150 - DNA, 22 bp, Artificial Sequence
  chemically synthesized
ttttggtaccagtaccatgctg

SEQ ID NO: 773151 - DNA, 22 bp, Artificial Sequence
  chemically synthesized
tgttttggtaccagtaccatgc

SEQ ID NO: 773152 - DNA, 22 bp, Artificial Sequence
  chemically synthesized
tatctctgttttggtaccagta

SEQ ID NO: 773153 - DNA, 22 bp, Artificial Sequence
  chemically synthesized
atctatatctctgttttggtac

SEQ ID NO: 773154 - DNA, 22 bp, Artificial Sequence
  chemically synthesized
cattgatctatatctctgtttt

SEQ ID NO: 773155 - DNA, 22 bp, Artificial Sequence
  chemically synthesized
ttccattgatctatatctctgt

SEQ ID NO: 773156 - DNA, 22 bp, Artificial Sequence
  chemically synthesized
tgttccattgatctatatctct

SEQ ID NO: 773157 - DNA, 22 bp, Artificial Sequence
  chemically synthesized
gtaccaaaacagagatatagat

SEQ ID NO: 773158 - DNA, 22 bp, Artificial Sequence
  chemically synthesized
ttctgttccattgatctatatc

SEQ ID NO: 773159 - DNA, 22 bp, Artificial Sequence
  chemically synthesized
tgttctgttccattgatctata

SEQ ID NO: 773160 - DNA, 22 bp, Artificial Sequence
  chemically synthesized
agggctctgttctgttccattg

SEQ ID NO: 773161 - DNA, 22 bp, Artificial Sequence
  chemically synthesized
tgagggctctgttctgttccat

SEQ ID NO: 773162 - DNA, 22 bp, Artificial Sequence
  chemically synthesized
ctgagggctctgttctgttcca

SEQ ID NO: 773163 - DNA, 22 bp, Artificial Sequence
  chemically synthesized
tttctgagggctctgttctgtt

SEQ ID NO: 773164 - DNA, 22 bp, Artificial Sequence
  chemically synthesized
tagatatgcggcattatttctg

SEQ ID NO: 773165 - DNA, 22 bp, Artificial Sequence
  chemically synthesized
agaaataatgccgcatatctac

SEQ ID NO: 773166 - DNA, 22 bp, Artificial Sequence
  chemically synthesized
tcaaagatcagatagttgtaga

SEQ ID NO: 773167 - DNA, 22 bp, Artificial Sequence
  chemically synthesized
gtcaaagatcagatagttgtag

SEQ ID NO: 773168 - DNA, 22 bp, Artificial Sequence
  chemically synthesized
aggtttgtcaaagatcagatag

SEQ ID NO: 773169 - DNA, 22 bp, Artificial Sequence
  chemically synthesized
tcaggtttgtcaaagatcagat

SEQ ID NO: 773170 - DNA, 22 bp, Artificial Sequence
  chemically synthesized
ctcaggtttgtcaaagatcaga

SEQ ID NO: 773171 - DNA, 22 bp, Artificial Sequence
  chemically synthesized
tctcaggtttgtcaaagatcag

SEQ ID NO: 773172 - DNA, 22 bp, Artificial Sequence
  chemically synthesized
ttctcaggtttgtcaaagatca

SEQ ID NO: 773173 - DNA, 22 bp, Artificial Sequence
  chemically synthesized
tttttctcaggtttgtcaaaga

SEQ ID NO: 773174 - DNA, 22 bp, Artificial Sequence
  chemically synthesized
caactatctgatctttgacaaa

SEQ ID NO: 773175 - DNA, 22 bp, Artificial Sequence
  chemically synthesized
gtttttctcaggtttgtcaaag

SEQ ID NO: 773176 - DNA, 22 bp, Artificial Sequence
  chemically synthesized
cttgtttttctcaggtttgtca

SEQ ID NO: 773177 - DNA, 22 bp, Artificial Sequence
  chemically synthesized
tctgatctttgacaaacctgag

SEQ ID NO: 773178 - DNA, 22 bp, Artificial Sequence
  chemically synthesized
atctttgacaaacctgagaaaa

SEQ ID NO: 773179 - DNA, 22 bp, Artificial Sequence
  chemically synthesized
cccattgcttgtttttctcagg

SEQ ID NO: 773180 - DNA, 22 bp, Artificial Sequence
  chemically synthesized
ccccattgcttgtttttctcag

SEQ ID NO: 773181 - DNA, 22 bp, Artificial Sequence
  chemically synthesized
tccccattgcttgtttttctca

SEQ ID NO: 773182 - DNA, 22 bp, Artificial Sequence
  chemically synthesized
tgacaaacctgagaaaaacaag

SEQ ID NO: 773183 - DNA, 22 bp, Artificial Sequence
  chemically synthesized
gacaaacctgagaaaaacaagc

SEQ ID NO: 773184 - DNA, 22 bp, Artificial Sequence
  chemically synthesized
acaaacctgagaaaaacaagca

SEQ ID NO: 773185 - DNA, 22 bp, Artificial Sequence
  chemically synthesized
agaaaaacaagcaatggggaaa

SEQ ID NO: 773186 - DNA, 22 bp, Artificial Sequence
  chemically synthesized
aatagggaatcctttccccatt

SEQ ID NO: 773187 - DNA, 22 bp, Artificial Sequence
  chemically synthesized
ttaaatagggaatcctttcccc

SEQ ID NO: 773188 - DNA, 22 bp, Artificial Sequence
  chemically synthesized
attaaatagggaatcctttccc

SEQ ID NO: 773189 - DNA, 22 bp, Artificial Sequence
  chemically synthesized
ccagcaccatttattaaatagg

SEQ ID NO: 773190 - DNA, 22 bp, Artificial Sequence
  chemically synthesized
cccagcaccatttattaaatag

SEQ ID NO: 773191 - DNA, 22 bp, Artificial Sequence
  chemically synthesized
tcccagcaccatttattaaata

SEQ ID NO: 773192 - DNA, 22 bp, Artificial Sequence
  chemically synthesized
gccagttttcccagcaccattt

SEQ ID NO: 773193 - DNA, 22 bp, Artificial Sequence
  chemically synthesized
cctatttaataaatggtgctgg

SEQ ID NO: 773194 - DNA, 22 bp, Artificial Sequence
  chemically synthesized
tttaataaatggtgctgggaaa

SEQ ID NO: 773195 - DNA, 22 bp, Artificial Sequence
  chemically synthesized
aataaatggtgctgggaaaact

SEQ ID NO: 773196 - DNA, 22 bp, Artificial Sequence
  chemically synthesized
ataaatggtgctgggaaaactg

SEQ ID NO: 773197 - DNA, 22 bp, Artificial Sequence
  chemically synthesized
catatggctagccagttttccc

SEQ ID NO: 773198 - DNA, 22 bp, Artificial Sequence
  chemically synthesized
tacatatggctagccagttttc

SEQ ID NO: 773199 - DNA, 22 bp, Artificial Sequence
  chemically synthesized
ctacatatggctagccagtttt

SEQ ID NO: 773200 - DNA, 22 bp, Artificial Sequence
  chemically synthesized
tctacatatggctagccagttt

SEQ ID NO: 773201 - DNA, 22 bp, Artificial Sequence
  chemically synthesized
agctttctacatatggctagcc

SEQ ID NO: 773202 - DNA, 22 bp, Artificial Sequence
  chemically synthesized
cagctttctacatatggctagc

SEQ ID NO: 773203 - DNA, 22 bp, Artificial Sequence
  chemically synthesized
ggaaaactggctagccatatgt

SEQ ID NO: 773204 - DNA, 22 bp, Artificial Sequence
  chemically synthesized
gctagccatatgtagaaagctg

SEQ ID NO: 773205 - DNA, 22 bp, Artificial Sequence
  chemically synthesized
gccatatgtagaaagctgaaac

SEQ ID NO: 773206 - DNA, 22 bp, Artificial Sequence
  chemically synthesized
tataaggtgtaaggaagggatc

SEQ ID NO: 773207 - DNA, 22 bp, Artificial Sequence
  chemically synthesized
gtataaggtgtaaggaagggat

SEQ ID NO: 773208 - DNA, 22 bp, Artificial Sequence
  chemically synthesized
tgtataaggtgtaaggaaggga

SEQ ID NO: 773209 - DNA, 22 bp, Artificial Sequence
  chemically synthesized
ttgtataaggtgtaaggaaggg

SEQ ID NO: 773210 - DNA, 22 bp, Artificial Sequence
  chemically synthesized
aaactggatcccttccttacac

SEQ ID NO: 773211 - DNA, 22 bp, Artificial Sequence
  chemically synthesized
atttttgtataaggtgtaagga

SEQ ID NO: 773212 - DNA, 22 bp, Artificial Sequence
  chemically synthesized
gatcccttccttacaccttata

SEQ ID NO: 773213 - DNA, 22 bp, Artificial Sequence
  chemically synthesized
aattgatttttgtataaggtgt

SEQ ID NO: 773214 - DNA, 22 bp, Artificial Sequence
  chemically synthesized
gaattgatttttgtataaggtg

SEQ ID NO: 773215 - DNA, 22 bp, Artificial Sequence
  chemically synthesized
ccttacaccttatacaaaaatc

SEQ ID NO: 773216 - DNA, 22 bp, Artificial Sequence
  chemically synthesized
cttacaccttatacaaaaatca

SEQ ID NO: 773217 - DNA, 22 bp, Artificial Sequence
  chemically synthesized
atccatcttgaattgatttttg

SEQ ID NO: 773218 - DNA, 22 bp, Artificial Sequence
  chemically synthesized
aatccatcttgaattgattttt

SEQ ID NO: 773219 - DNA, 22 bp, Artificial Sequence
  chemically synthesized
acaccttatacaaaaatcaatt

SEQ ID NO: 773220 - DNA, 22 bp, Artificial Sequence
  chemically synthesized
taatccatcttgaattgatttt

SEQ ID NO: 773221 - DNA, 22 bp, Artificial Sequence
  chemically synthesized
caccttatacaaaaatcaattc

SEQ ID NO: 773222 - DNA, 22 bp, Artificial Sequence
  chemically synthesized
aatctttaatccatcttgaatt

SEQ ID NO: 773223 - DNA, 22 bp, Artificial Sequence
  chemically synthesized
atacaaaaatcaattcaagatg

SEQ ID NO: 773224 - DNA, 22 bp, Artificial Sequence
  chemically synthesized
aaatctttaatccatcttgaat

SEQ ID NO: 773225 - DNA, 22 bp, Artificial Sequence
  chemically synthesized
tacaaaaatcaattcaagatgg

SEQ ID NO: 773226 - DNA, 22 bp, Artificial Sequence
  chemically synthesized
acgtttaaatctttaatccatc

SEQ ID NO: 773227 - DNA, 22 bp, Artificial Sequence
  chemically synthesized
ggtctaacgtttaaatctttaa

SEQ ID NO: 773228 - DNA, 22 bp, Artificial Sequence
  chemically synthesized
aggtctaacgtttaaatcttta

SEQ ID NO: 773229 - DNA, 22 bp, Artificial Sequence
  chemically synthesized
taggtctaacgtttaaatcttt

SEQ ID NO: 773230 - DNA, 22 bp, Artificial Sequence
  chemically synthesized
aagatggattaaagatttaaac

SEQ ID NO: 773231 - DNA, 22 bp, Artificial Sequence
  chemically synthesized
tggttttaggtctaacgtttaa

SEQ ID NO: 773232 - DNA, 22 bp, Artificial Sequence
  chemically synthesized
atggttttaggtctaacgttta

SEQ ID NO: 773233 - DNA, 22 bp, Artificial Sequence
  chemically synthesized
tatggttttaggtctaacgttt

SEQ ID NO: 773234 - DNA, 22 bp, Artificial Sequence
  chemically synthesized
ttatggttttaggtctaacgtt

SEQ ID NO: 773235 - DNA, 22 bp, Artificial Sequence
  chemically synthesized
aagatttaaacgttagacctaa

SEQ ID NO: 773236 - DNA, 22 bp, Artificial Sequence
  chemically synthesized
gggtttttatggttttaggtct

SEQ ID NO: 773237 - DNA, 22 bp, Artificial Sequence
  chemically synthesized
tagggtttttatggttttaggt

SEQ ID NO: 773238 - DNA, 22 bp, Artificial Sequence
  chemically synthesized
ctagggtttttatggttttagg

SEQ ID NO: 773239 - DNA, 22 bp, Artificial Sequence
  chemically synthesized
aaacgttagacctaaaaccata

SEQ ID NO: 773240 - DNA, 22 bp, Artificial Sequence
  chemically synthesized
ttctagggtttttatggtttta

SEQ ID NO: 773241 - DNA, 22 bp, Artificial Sequence
  chemically synthesized
aacgttagacctaaaaccataa

SEQ ID NO: 773242 - DNA, 22 bp, Artificial Sequence
  chemically synthesized
cttctagggtttttatggtttt

SEQ ID NO: 773243 - DNA, 22 bp, Artificial Sequence
  chemically synthesized
tcttctagggtttttatggttt

SEQ ID NO: 773244 - DNA, 22 bp, Artificial Sequence
  chemically synthesized
ggttttcttctagggtttttat

SEQ ID NO: 773245 - DNA, 22 bp, Artificial Sequence
  chemically synthesized
gacctaaaaccataaaaaccct

SEQ ID NO: 773246 - DNA, 22 bp, Artificial Sequence
  chemically synthesized
aaaccataaaaaccctagaaga

SEQ ID NO: 773247 - DNA, 22 bp, Artificial Sequence
  chemically synthesized
aatggtaatgcctaggttttct

SEQ ID NO: 773248 - DNA, 22 bp, Artificial Sequence
  chemically synthesized
tgtcctgaatggtaatgcctag

SEQ ID NO: 773249 - DNA, 22 bp, Artificial Sequence
  chemically synthesized
gaagaaaacctaggcattacca

SEQ ID NO: 773250 - DNA, 22 bp, Artificial Sequence
  chemically synthesized
cccacgcctatgtcctgaatgg

SEQ ID NO: 773251 - DNA, 22 bp, Artificial Sequence
  chemically synthesized
gcccacgcctatgtcctgaatg

SEQ ID NO: 773252 - DNA, 22 bp, Artificial Sequence
  chemically synthesized
ggcattaccattcaggacatag

SEQ ID NO: 773253 - DNA, 22 bp, Artificial Sequence
  chemically synthesized
ccattcaggacataggcgtggg

SEQ ID NO: 773254 - DNA, 22 bp, Artificial Sequence
  chemically synthesized
gacatgaagtccttgcccacgc

SEQ ID NO: 773255 - DNA, 22 bp, Artificial Sequence
  chemically synthesized
ggacatgaagtccttgcccacg

SEQ ID NO: 773256 - DNA, 22 bp, Artificial Sequence
  chemically synthesized
tggacatgaagtccttgcccac

SEQ ID NO: 773257 - DNA, 22 bp, Artificial Sequence
  chemically synthesized
aggacataggcgtgggcaagga

SEQ ID NO: 773258 - DNA, 22 bp, Artificial Sequence
  chemically synthesized
gtgttttggacatgaagtcctt

SEQ ID NO: 773259 - DNA, 22 bp, Artificial Sequence
  chemically synthesized
ggtgttttggacatgaagtcct

SEQ ID NO: 773260 - DNA, 22 bp, Artificial Sequence
  chemically synthesized
tggtgttttggacatgaagtcc

SEQ ID NO: 773261 - DNA, 22 bp, Artificial Sequence
  chemically synthesized
ttggtgttttggacatgaagtc

SEQ ID NO: 773262 - DNA, 22 bp, Artificial Sequence
  chemically synthesized
cttttggtgttttggacatgaa

SEQ ID NO: 773263 - DNA, 22 bp, Artificial Sequence
  chemically synthesized
ccattgcttttggtgttttgga

SEQ ID NO: 773264 - DNA, 22 bp, Artificial Sequence
  chemically synthesized
ttgccattgcttttggtgtttt

SEQ ID NO: 773265 - DNA, 22 bp, Artificial Sequence
  chemically synthesized
gttgccattgcttttggtgttt

SEQ ID NO: 773266 - DNA, 22 bp, Artificial Sequence
  chemically synthesized
tgttgccattgcttttggtgtt

SEQ ID NO: 773267 - DNA, 22 bp, Artificial Sequence
  chemically synthesized
ttgttgccattgcttttggtgt

SEQ ID NO: 773268 - DNA, 22 bp, Artificial Sequence
  chemically synthesized
catgtccaaaacaccaaaagca

SEQ ID NO: 773269 - DNA, 22 bp, Artificial Sequence
  chemically synthesized
atgtccaaaacaccaaaagcaa

SEQ ID NO: 773270 - DNA, 22 bp, Artificial Sequence
  chemically synthesized
gcttttgttgccattgcttttg

SEQ ID NO: 773271 - DNA, 22 bp, Artificial Sequence
  chemically synthesized
ggcttttgttgccattgctttt

SEQ ID NO: 773272 - DNA, 22 bp, Artificial Sequence
  chemically synthesized
tggcttttgttgccattgcttt

SEQ ID NO: 773273 - DNA, 22 bp, Artificial Sequence
  chemically synthesized
tcaattttggcttttgttgcca

SEQ ID NO: 773274 - DNA, 22 bp, Artificial Sequence
  chemically synthesized
gtcaattttggcttttgttgcc

SEQ ID NO: 773275 - DNA, 22 bp, Artificial Sequence
  chemically synthesized
tcaagagaaaccatttgtcaat

SEQ ID NO: 773276 - DNA, 22 bp, Artificial Sequence
  chemically synthesized
ctatcaagagaaaccatttgtc

SEQ ID NO: 773277 - DNA, 22 bp, Artificial Sequence
  chemically synthesized
ggctgctatcaagagaaaccat

SEQ ID NO: 773278 - DNA, 22 bp, Artificial Sequence
  chemically synthesized
acaaatggtttctcttgatagc

SEQ ID NO: 773279 - DNA, 22 bp, Artificial Sequence
  chemically synthesized
ctcttgatagcagcccagttta

SEQ ID NO: 773280 - DNA, 22 bp, Artificial Sequence
  chemically synthesized
tcttgatagcagcccagtttac

SEQ ID NO: 773281 - DNA, 22 bp, Artificial Sequence
  chemically synthesized
aaacaatcatacagtaaactgg

SEQ ID NO: 773282 - DNA, 22 bp, Artificial Sequence
  chemically synthesized
ttgatagcagcccagtttactg

SEQ ID NO: 773283 - DNA, 22 bp, Artificial Sequence
  chemically synthesized
gatagcagcccagtttactgta

SEQ ID NO: 773284 - DNA, 22 bp, Artificial Sequence
  chemically synthesized
atagcagcccagtttactgtat

SEQ ID NO: 773285 - DNA, 22 bp, Artificial Sequence
  chemically synthesized
actgtatgattgttttagccac

SEQ ID NO: 773286 - DNA, 22 bp, Artificial Sequence
  chemically synthesized
gagggggaaaaggtggctaaaa

SEQ ID NO: 773287 - DNA, 22 bp, Artificial Sequence
  chemically synthesized
ctgtatgattgttttagccacc

SEQ ID NO: 773288 - DNA, 22 bp, Artificial Sequence
  chemically synthesized
tatgattgttttagccaccttt

SEQ ID NO: 773289 - DNA, 22 bp, Artificial Sequence
  chemically synthesized
gaagattggagggggaaaaggt

SEQ ID NO: 773290 - DNA, 22 bp, Artificial Sequence
  chemically synthesized
ggaagattggagggggaaaagg

SEQ ID NO: 773291 - DNA, 22 bp, Artificial Sequence
  chemically synthesized
ttttagccaccttttccccctc

SEQ ID NO: 773292 - DNA, 22 bp, Artificial Sequence
  chemically synthesized
tagccaccttttccccctccaa

SEQ ID NO: 773293 - DNA, 22 bp, Artificial Sequence
  chemically synthesized
taacttggaagattggaggggg

SEQ ID NO: 773294 - DNA, 22 bp, Artificial Sequence
  chemically synthesized
agccaccttttccccctccaat

SEQ ID NO: 773295 - DNA, 22 bp, Artificial Sequence
  chemically synthesized
gccaccttttccccctccaatc

SEQ ID NO: 773296 - DNA, 22 bp, Artificial Sequence
  chemically synthesized
ctgtaacttggaagattggagg

SEQ ID NO: 773297 - DNA, 22 bp, Artificial Sequence
  chemically synthesized
ttccccctccaatcttccaagt

SEQ ID NO: 773298 - DNA, 22 bp, Artificial Sequence
  chemically synthesized
tccccctccaatcttccaagtt

SEQ ID NO: 773299 - DNA, 22 bp, Artificial Sequence
  chemically synthesized
ccccctccaatcttccaagtta

SEQ ID NO: 773300 - DNA, 22 bp, Artificial Sequence
  chemically synthesized
cccctccaatcttccaagttac

SEQ ID NO: 773301 - DNA, 22 bp, Artificial Sequence
  chemically synthesized
caatcttccaagttacagcagt

SEQ ID NO: 773302 - DNA, 22 bp, Artificial Sequence
  chemically synthesized
gtagtgaggagaactgctgtaa

SEQ ID NO: 773303 - DNA, 22 bp, Artificial Sequence
  chemically synthesized
ggtagtgaggagaactgctgta

SEQ ID NO: 773304 - DNA, 22 bp, Artificial Sequence
  chemically synthesized
tggtagtgaggagaactgctgt

SEQ ID NO: 773305 - DNA, 22 bp, Artificial Sequence
  chemically synthesized
ttggtagtgaggagaactgctg

SEQ ID NO: 773306 - DNA, 22 bp, Artificial Sequence
  chemically synthesized
ccaagttacagcagttctcctc

SEQ ID NO: 773307 - DNA, 22 bp, Artificial Sequence
  chemically synthesized
caagttacagcagttctcctca

SEQ ID NO: 773308 - DNA, 22 bp, Artificial Sequence
  chemically synthesized
ccatcacacttttggtagtgag

SEQ ID NO: 773309 - DNA, 22 bp, Artificial Sequence
  chemically synthesized
cagcagttctcctcactaccaa

SEQ ID NO: 773310 - DNA, 22 bp, Artificial Sequence
  chemically synthesized
tagtcctaccatcacacttttg

SEQ ID NO: 773311 - DNA, 22 bp, Artificial Sequence
  chemically synthesized
tcctcactaccaaaagtgtgat

SEQ ID NO: 773312 - DNA, 22 bp, Artificial Sequence
  chemically synthesized
ctcactaccaaaagtgtgatgg

SEQ ID NO: 773313 - DNA, 22 bp, Artificial Sequence
  chemically synthesized
actaccaaaagtgtgatggtag

SEQ ID NO: 773314 - DNA, 22 bp, Artificial Sequence
  chemically synthesized
ccaaaagtgtgatggtaggact

SEQ ID NO: 773315 - DNA, 22 bp, Artificial Sequence
  chemically synthesized
tagaatgaatgaagggacaatg

SEQ ID NO: 773316 - DNA, 22 bp, Artificial Sequence
  chemically synthesized
gtagaatgaatgaagggacaat

SEQ ID NO: 773317 - DNA, 22 bp, Artificial Sequence
  chemically synthesized
tagtttgccattgtcccttcat

SEQ ID NO: 773318 - DNA, 22 bp, Artificial Sequence
  chemically synthesized
agtatttgtagaatgaatgaag

SEQ ID NO: 773319 - DNA, 22 bp, Artificial Sequence
  chemically synthesized
gccattgtcccttcattcattc

SEQ ID NO: 773320 - DNA, 22 bp, Artificial Sequence
  chemically synthesized
ccattgtcccttcattcattct

SEQ ID NO: 773321 - DNA, 22 bp, Artificial Sequence
  chemically synthesized
cctcagtatttgtagaatgaat

SEQ ID NO: 773322 - DNA, 22 bp, Artificial Sequence
  chemically synthesized
tcccttcattcattctacaaat

SEQ ID NO: 773323 - DNA, 22 bp, Artificial Sequence
  chemically synthesized
catctccctcagtatttgtaga

SEQ ID NO: 773324 - DNA, 22 bp, Artificial Sequence
  chemically synthesized
cattcattctacaaatactgag

SEQ ID NO: 773325 - DNA, 22 bp, Artificial Sequence
  chemically synthesized
attcattctacaaatactgagg

SEQ ID NO: 773326 - DNA, 22 bp, Artificial Sequence
  chemically synthesized
atcactgcatctccctcagtat

SEQ ID NO: 773327 - DNA, 22 bp, Artificial Sequence
  chemically synthesized
attctacaaatactgagggaga

SEQ ID NO: 773328 - DNA, 22 bp, Artificial Sequence
  chemically synthesized
tacaaatactgagggagatgca

SEQ ID NO: 773329 - DNA, 22 bp, Artificial Sequence
  chemically synthesized
tcatgttcatcactgcatctcc

SEQ ID NO: 773330 - DNA, 22 bp, Artificial Sequence
  chemically synthesized
caaatactgagggagatgcagt

SEQ ID NO: 773331 - DNA, 22 bp, Artificial Sequence
  chemically synthesized
agggagatgcagtgatgaacat

SEQ ID NO: 773332 - DNA, 22 bp, Artificial Sequence
  chemically synthesized
ggacagtgtctgtcatgttcat

SEQ ID NO: 773333 - DNA, 22 bp, Artificial Sequence
  chemically synthesized
gactgggacagtgtctgtcatg

SEQ ID NO: 773334 - DNA, 22 bp, Artificial Sequence
  chemically synthesized
taacagaaaaccccggattaga

SEQ ID NO: 773335 - DNA, 22 bp, Artificial Sequence
  chemically synthesized
ataacagaaaaccccggattag

SEQ ID NO: 773336 - DNA, 22 bp, Artificial Sequence
  chemically synthesized
tataacagaaaaccccggatta

SEQ ID NO: 773337 - DNA, 22 bp, Artificial Sequence
  chemically synthesized
ttataacagaaaaccccggatt

SEQ ID NO: 773338 - DNA, 22 bp, Artificial Sequence
  chemically synthesized
ttttataacagaaaaccccgga

SEQ ID NO: 773339 - DNA, 22 bp, Artificial Sequence
  chemically synthesized
tcccagtctaatccggggtttt

SEQ ID NO: 773340 - DNA, 22 bp, Artificial Sequence
  chemically synthesized
atatcattcttttataacagaa

SEQ ID NO: 773341 - DNA, 22 bp, Artificial Sequence
  chemically synthesized
atccggggttttctgttataaa

SEQ ID NO: 773342 - DNA, 22 bp, Artificial Sequence
  chemically synthesized
aaccctgatatcattcttttat

SEQ ID NO: 773343 - DNA, 22 bp, Artificial Sequence
  chemically synthesized
atctaaaccctgatatcattct

SEQ ID NO: 773344 - DNA, 22 bp, Artificial Sequence
  chemically synthesized
tctgttataaaagaatgatatc

SEQ ID NO: 773345 - DNA, 22 bp, Artificial Sequence
  chemically synthesized
ctgttataaaagaatgatatca

SEQ ID NO: 773346 - DNA, 22 bp, Artificial Sequence
  chemically synthesized
tgttataaaagaatgatatcag

SEQ ID NO: 773347 - DNA, 22 bp, Artificial Sequence
  chemically synthesized
ttataaaagaatgatatcaggg

SEQ ID NO: 773348 - DNA, 22 bp, Artificial Sequence
  chemically synthesized
taaaagaatgatatcagggttt

SEQ ID NO: 773349 - DNA, 22 bp, Artificial Sequence
  chemically synthesized
agagtacctaatctaaaccctg

SEQ ID NO: 773350 - DNA, 22 bp, Artificial Sequence
  chemically synthesized
cattcagagtacctaatctaaa

SEQ ID NO: 773351 - DNA, 22 bp, Artificial Sequence
  chemically synthesized
gcattcagagtacctaatctaa

SEQ ID NO: 773352 - DNA, 22 bp, Artificial Sequence
  chemically synthesized
tgcattcagagtacctaatcta

SEQ ID NO: 773353 - DNA, 22 bp, Artificial Sequence
  chemically synthesized
aaagggctttgcattcagagta

SEQ ID NO: 773354 - DNA, 22 bp, Artificial Sequence
  chemically synthesized
caaagggctttgcattcagagt

SEQ ID NO: 773355 - DNA, 22 bp, Artificial Sequence
  chemically synthesized
tcaaagggctttgcattcagag

SEQ ID NO: 773356 - DNA, 22 bp, Artificial Sequence
  chemically synthesized
agattaggtactctgaatgcaa

SEQ ID NO: 773357 - DNA, 22 bp, Artificial Sequence
  chemically synthesized
gattaggtactctgaatgcaaa

SEQ ID NO: 773358 - DNA, 22 bp, Artificial Sequence
  chemically synthesized
ggtactctgaatgcaaagccct

SEQ ID NO: 773359 - DNA, 22 bp, Artificial Sequence
  chemically synthesized
tccaactttcaaagggctttgc

SEQ ID NO: 773360 - DNA, 22 bp, Artificial Sequence
  chemically synthesized
tgaatgcaaagccctttgaaag

SEQ ID NO: 773361 - DNA, 22 bp, Artificial Sequence
  chemically synthesized
agagttgtccaactttcaaagg

SEQ ID NO: 773362 - DNA, 22 bp, Artificial Sequence
  chemically synthesized
aatgcaaagccctttgaaagtt

SEQ ID NO: 773363 - DNA, 22 bp, Artificial Sequence
  chemically synthesized
atgtgttcagagttgtccaact

SEQ ID NO: 773364 - DNA, 22 bp, Artificial Sequence
  chemically synthesized
tgaaagttggacaactctgaac

SEQ ID NO: 773365 - DNA, 22 bp, Artificial Sequence
  chemically synthesized
gaaagttggacaactctgaaca

SEQ ID NO: 773366 - DNA, 22 bp, Artificial Sequence
  chemically synthesized
ggatccctgatgtgttcagagt

SEQ ID NO: 773367 - DNA, 22 bp, Artificial Sequence
  chemically synthesized
aaagttggacaactctgaacac

SEQ ID NO: 773368 - DNA, 22 bp, Artificial Sequence
  chemically synthesized
gacaactctgaacacatcaggg

SEQ ID NO: 773369 - DNA, 22 bp, Artificial Sequence
  chemically synthesized
atcatgtactaggatccctgat

SEQ ID NO: 773370 - DNA, 22 bp, Artificial Sequence
  chemically synthesized
ttcatcatgtactaggatccct

SEQ ID NO: 773371 - DNA, 22 bp, Artificial Sequence
  chemically synthesized
gttcatcatgtactaggatccc

SEQ ID NO: 773372 - DNA, 22 bp, Artificial Sequence
  chemically synthesized
tgaacacatcagggatcctagt

SEQ ID NO: 773373 - DNA, 22 bp, Artificial Sequence
  chemically synthesized
aacacatcagggatcctagtac

SEQ ID NO: 773374 - DNA, 22 bp, Artificial Sequence
  chemically synthesized
agatacttgttcatcatgtact

SEQ ID NO: 773375 - DNA, 22 bp, Artificial Sequence
  chemically synthesized
tcagatacttgttcatcatgta

SEQ ID NO: 773376 - DNA, 22 bp, Artificial Sequence
  chemically synthesized
tctcagatacttgttcatcatg

SEQ ID NO: 773377 - DNA, 22 bp, Artificial Sequence
  chemically synthesized
gtacatgatgaacaagtatctg

SEQ ID NO: 773378 - DNA, 22 bp, Artificial Sequence
  chemically synthesized
agaaaattctctcagatacttg

SEQ ID NO: 773379 - DNA, 22 bp, Artificial Sequence
  chemically synthesized
aattaagaaaattctctcagat

SEQ ID NO: 773380 - DNA, 22 bp, Artificial Sequence
  chemically synthesized
ggtgttaaattaagaaaattct

SEQ ID NO: 773381 - DNA, 22 bp, Artificial Sequence
  chemically synthesized
taggtgttaaattaagaaaatt

SEQ ID NO: 773382 - DNA, 22 bp, Artificial Sequence
  chemically synthesized
ctaggtgttaaattaagaaaat

SEQ ID NO: 773383 - DNA, 22 bp, Artificial Sequence
  chemically synthesized
tctaggtgttaaattaagaaaa

SEQ ID NO: 773384 - DNA, 22 bp, Artificial Sequence
  chemically synthesized
attttctaggtgttaaattaag

SEQ ID NO: 773385 - DNA, 22 bp, Artificial Sequence
  chemically synthesized
agagaattttcttaatttaaca

SEQ ID NO: 773386 - DNA, 22 bp, Artificial Sequence
  chemically synthesized
gctgattttctaggtgttaaat

SEQ ID NO: 773387 - DNA, 22 bp, Artificial Sequence
  chemically synthesized
agctgattttctaggtgttaaa

SEQ ID NO: 773388 - DNA, 22 bp, Artificial Sequence
  chemically synthesized
tagctgattttctaggtgttaa

SEQ ID NO: 773389 - DNA, 22 bp, Artificial Sequence
  chemically synthesized
ttagctgattttctaggtgtta

SEQ ID NO: 773390 - DNA, 22 bp, Artificial Sequence
  chemically synthesized
tcttaatttaacacctagaaaa

SEQ ID NO: 773391 - DNA, 22 bp, Artificial Sequence
  chemically synthesized
cttaatttaacacctagaaaat

SEQ ID NO: 773392 - DNA, 22 bp, Artificial Sequence
  chemically synthesized
cccttttagctgattttctagg

SEQ ID NO: 773393 - DNA, 22 bp, Artificial Sequence
  chemically synthesized
ttaatttaacacctagaaaatc

SEQ ID NO: 773394 - DNA, 22 bp, Artificial Sequence
  chemically synthesized
acccttttagctgattttctag

SEQ ID NO: 773395 - DNA, 22 bp, Artificial Sequence
  chemically synthesized
tacccttttagctgattttcta

SEQ ID NO: 773396 - DNA, 22 bp, Artificial Sequence
  chemically synthesized
aatttaacacctagaaaatcag

SEQ ID NO: 773397 - DNA, 22 bp, Artificial Sequence
  chemically synthesized
atttaacacctagaaaatcagc

SEQ ID NO: 773398 - DNA, 22 bp, Artificial Sequence
  chemically synthesized
aacacctagaaaatcagctaaa

SEQ ID NO: 773399 - DNA, 22 bp, Artificial Sequence
  chemically synthesized
acacctagaaaatcagctaaaa

SEQ ID NO: 773400 - DNA, 22 bp, Artificial Sequence
  chemically synthesized
tgcaaacagttttaccctttta

SEQ ID NO: 773401 - DNA, 22 bp, Artificial Sequence
  chemically synthesized
gaaaatcagctaaaagggtaaa

SEQ ID NO: 773402 - DNA, 22 bp, Artificial Sequence
  chemically synthesized
tgtgcaaacagttttacccttt

SEQ ID NO: 773403 - DNA, 22 bp, Artificial Sequence
  chemically synthesized
ctgtgcaaacagttttaccctt

SEQ ID NO: 773404 - DNA, 22 bp, Artificial Sequence
  chemically synthesized
tctgtgcaaacagttttaccct

SEQ ID NO: 773405 - DNA, 22 bp, Artificial Sequence
  chemically synthesized
gttttctgtgcaaacagtttta

SEQ ID NO: 773406 - DNA, 22 bp, Artificial Sequence
  chemically synthesized
ggttttctgtgcaaacagtttt

SEQ ID NO: 773407 - DNA, 22 bp, Artificial Sequence
  chemically synthesized
aaagggtaaaactgtttgcaca

SEQ ID NO: 773408 - DNA, 22 bp, Artificial Sequence
  chemically synthesized
aatggtttggttttctgtgcaa

SEQ ID NO: 773409 - DNA, 22 bp, Artificial Sequence
  chemically synthesized
aaatggtttggttttctgtgca

SEQ ID NO: 773410 - DNA, 22 bp, Artificial Sequence
  chemically synthesized
ttaaatggtttggttttctgtg

SEQ ID NO: 773411 - DNA, 22 bp, Artificial Sequence
  chemically synthesized
cttaaatggtttggttttctgt

SEQ ID NO: 773412 - DNA, 22 bp, Artificial Sequence
  chemically synthesized
ttcttaaatggtttggttttct

SEQ ID NO: 773413 - DNA, 22 bp, Artificial Sequence
  chemically synthesized
tttgcacagaaaaccaaaccat

SEQ ID NO: 773414 - DNA, 22 bp, Artificial Sequence
  chemically synthesized
aatctcttcttaaatggtttgg

SEQ ID NO: 773415 - DNA, 22 bp, Artificial Sequence
  chemically synthesized
gcacagaaaaccaaaccattta

SEQ ID NO: 773416 - DNA, 22 bp, Artificial Sequence
  chemically synthesized
cacagaaaaccaaaccatttaa

SEQ ID NO: 773417 - DNA, 22 bp, Artificial Sequence
  chemically synthesized
ttcaatctcttcttaaatggtt

SEQ ID NO: 773418 - DNA, 22 bp, Artificial Sequence
  chemically synthesized
ataactattcaatctcttctta

SEQ ID NO: 773419 - DNA, 22 bp, Artificial Sequence
  chemically synthesized
aagaagagattgaatagttatt

SEQ ID NO: 773420 - DNA, 22 bp, Artificial Sequence
  chemically synthesized
agaagagattgaatagttatta

SEQ ID NO: 773421 - DNA, 22 bp, Artificial Sequence
  chemically synthesized
atcaaaagaatctaataactat

SEQ ID NO: 773422 - DNA, 22 bp, Artificial Sequence
  chemically synthesized
cctgatcaaaagaatctaataa

SEQ ID NO: 773423 - DNA, 22 bp, Artificial Sequence
  chemically synthesized
tacctgatcaaaagaatctaat

SEQ ID NO: 773424 - DNA, 22 bp, Artificial Sequence
  chemically synthesized
ctacctgatcaaaagaatctaa

SEQ ID NO: 773425 - DNA, 22 bp, Artificial Sequence
  chemically synthesized
tctacctgatcaaaagaatcta

SEQ ID NO: 773426 - DNA, 22 bp, Artificial Sequence
  chemically synthesized
aatagttattagattcttttga

SEQ ID NO: 773427 - DNA, 22 bp, Artificial Sequence
  chemically synthesized
ttagattcttttgatcaggtag

SEQ ID NO: 773428 - DNA, 22 bp, Artificial Sequence
  chemically synthesized
ccaggataggttttctacctga

SEQ ID NO: 773429 - DNA, 22 bp, Artificial Sequence
  chemically synthesized
gattcttttgatcaggtagaaa

SEQ ID NO: 773430 - DNA, 22 bp, Artificial Sequence
  chemically synthesized
actcccaggataggttttctac

SEQ ID NO: 773431 - DNA, 22 bp, Artificial Sequence
  chemically synthesized
aactcccaggataggttttcta

SEQ ID NO: 773432 - DNA, 22 bp, Artificial Sequence
  chemically synthesized
ttttgatcaggtagaaaaccta

SEQ ID NO: 773433 - DNA, 22 bp, Artificial Sequence
  chemically synthesized
taactcccaggataggttttct

SEQ ID NO: 773434 - DNA, 22 bp, Artificial Sequence
  chemically synthesized
ttgatcaggtagaaaacctatc

SEQ ID NO: 773435 - DNA, 22 bp, Artificial Sequence
  chemically synthesized
tgatcaggtagaaaacctatcc

SEQ ID NO: 773436 - DNA, 22 bp, Artificial Sequence
  chemically synthesized
gatcaggtagaaaacctatcct

SEQ ID NO: 773437 - DNA, 22 bp, Artificial Sequence
  chemically synthesized
atcaggtagaaaacctatcctg

SEQ ID NO: 773438 - DNA, 22 bp, Artificial Sequence
  chemically synthesized
agattttaactcccaggatagg

SEQ ID NO: 773439 - DNA, 22 bp, Artificial Sequence
  chemically synthesized
gagattttaactcccaggatag

SEQ ID NO: 773440 - DNA, 22 bp, Artificial Sequence
  chemically synthesized
tcttgagattttaactcccagg

SEQ ID NO: 773441 - DNA, 22 bp, Artificial Sequence
  chemically synthesized
tcctgggagttaaaatctcaag

SEQ ID NO: 773442 - DNA, 22 bp, Artificial Sequence
  chemically synthesized
ggagttaaaatctcaagatagg

SEQ ID NO: 773443 - DNA, 22 bp, Artificial Sequence
  chemically synthesized
taggccaagaagagcctatctt

SEQ ID NO: 773444 - DNA, 22 bp, Artificial Sequence
  chemically synthesized
aaatctcaagataggctcttct

SEQ ID NO: 773445 - DNA, 22 bp, Artificial Sequence
  chemically synthesized
aagataggctcttcttggccta

SEQ ID NO: 773446 - DNA, 22 bp, Artificial Sequence
  chemically synthesized
gtccaaatagatattataggcc

SEQ ID NO: 773447 - DNA, 22 bp, Artificial Sequence
  chemically synthesized
ttcttggcctataatatctatt

SEQ ID NO: 773448 - DNA, 22 bp, Artificial Sequence
  chemically synthesized
cttggcctataatatctatttg

SEQ ID NO: 773449 - DNA, 22 bp, Artificial Sequence
  chemically synthesized
ttggcctataatatctatttgg

SEQ ID NO: 773450 - DNA, 22 bp, Artificial Sequence
  chemically synthesized
ggcctataatatctatttggac

SEQ ID NO: 773451 - DNA, 22 bp, Artificial Sequence
  chemically synthesized
gcctataatatctatttggact

SEQ ID NO: 773452 - DNA, 22 bp, Artificial Sequence
  chemically synthesized
aggccatgtgactagtccaaat

SEQ ID NO: 773453 - DNA, 22 bp, Artificial Sequence
  chemically synthesized
caggccatgtgactagtccaaa

SEQ ID NO: 773454 - DNA, 22 bp, Artificial Sequence
  chemically synthesized
taatatctatttggactagtca

SEQ ID NO: 773455 - DNA, 22 bp, Artificial Sequence
  chemically synthesized
atttcaggccatgtgactagtc

SEQ ID NO: 773456 - DNA, 22 bp, Artificial Sequence
  chemically synthesized
attaatttcaggccatgtgact

SEQ ID NO: 773457 - DNA, 22 bp, Artificial Sequence
  chemically synthesized
tttggactagtcacatggcctg

SEQ ID NO: 773458 - DNA, 22 bp, Artificial Sequence
  chemically synthesized
tctcattaatttcaggccatgt

SEQ ID NO: 773459 - DNA, 22 bp, Artificial Sequence
  chemically synthesized
ggactagtcacatggcctgaaa

SEQ ID NO: 773460 - DNA, 22 bp, Artificial Sequence
  chemically synthesized
gactagtcacatggcctgaaat

SEQ ID NO: 773461 - DNA, 22 bp, Artificial Sequence
  chemically synthesized
aattatctcattaatttcaggc

SEQ ID NO: 773462 - DNA, 22 bp, Artificial Sequence
  chemically synthesized
caattatctcattaatttcagg

SEQ ID NO: 773463 - DNA, 22 bp, Artificial Sequence
  chemically synthesized
tcaattatctcattaatttcag

SEQ ID NO: 773464 - DNA, 22 bp, Artificial Sequence
  chemically synthesized
gtcacatggcctgaaattaatg

SEQ ID NO: 773465 - DNA, 22 bp, Artificial Sequence
  chemically synthesized
gtggaggatagttttcaattat

SEQ ID NO: 773466 - DNA, 22 bp, Artificial Sequence
  chemically synthesized
aaattaatgagataattgaaaa

SEQ ID NO: 773467 - DNA, 22 bp, Artificial Sequence
  chemically synthesized
tagtggaggatagttttcaatt

SEQ ID NO: 773468 - DNA, 22 bp, Artificial Sequence
  chemically synthesized
atgagataattgaaaactatcc

SEQ ID NO: 773469 - DNA, 22 bp, Artificial Sequence
  chemically synthesized
aaaactatcctccactagaatc

SEQ ID NO: 773470 - DNA, 22 bp, Artificial Sequence
  chemically synthesized
tcctccactagaatctcctcat

SEQ ID NO: 773471 - DNA, 22 bp, Artificial Sequence
  chemically synthesized
cataaaatgcataaaatgagga

SEQ ID NO: 773472 - DNA, 22 bp, Artificial Sequence
  chemically synthesized
gcataaaatgcataaaatgagg

SEQ ID NO: 773473 - DNA, 22 bp, Artificial Sequence
  chemically synthesized
cactagaatctcctcattttat

SEQ ID NO: 773474 - DNA, 22 bp, Artificial Sequence
  chemically synthesized
gaatctcctcattttatgcatt

SEQ ID NO: 773475 - DNA, 22 bp, Artificial Sequence
  chemically synthesized
agcaaccttgcataaaatgcat

SEQ ID NO: 773476 - DNA, 22 bp, Artificial Sequence
  chemically synthesized
ctcattttatgcattttatgca

SEQ ID NO: 773477 - DNA, 22 bp, Artificial Sequence
  chemically synthesized
attttatgcattttatgcaagg

SEQ ID NO: 773478 - DNA, 22 bp, Artificial Sequence
  chemically synthesized
ggccactaagcaaccttgcata

SEQ ID NO: 773479 - DNA, 22 bp, Artificial Sequence
  chemically synthesized
tatgcattttatgcaaggttgc

SEQ ID NO: 773480 - DNA, 22 bp, Artificial Sequence
  chemically synthesized
atgcattttatgcaaggttgct

SEQ ID NO: 773481 - DNA, 22 bp, Artificial Sequence
  chemically synthesized
tgcattttatgcaaggttgctt

SEQ ID NO: 773482 - DNA, 22 bp, Artificial Sequence
  chemically synthesized
tcaatcctaggccactaagcaa

SEQ ID NO: 773483 - DNA, 22 bp, Artificial Sequence
  chemically synthesized
tatgcaaggttgcttagtggcc

SEQ ID NO: 773484 - DNA, 22 bp, Artificial Sequence
  chemically synthesized
ttatcaatcctaggccactaag

SEQ ID NO: 773485 - DNA, 22 bp, Artificial Sequence
  chemically synthesized
atgcaaggttgcttagtggcct

SEQ ID NO: 773486 - DNA, 22 bp, Artificial Sequence
  chemically synthesized
tgcaaggttgcttagtggccta

SEQ ID NO: 773487 - DNA, 22 bp, Artificial Sequence
  chemically synthesized
ttattatcaatcctaggccact

SEQ ID NO: 773488 - DNA, 22 bp, Artificial Sequence
  chemically synthesized
attattatcaatcctaggccac

SEQ ID NO: 773489 - DNA, 22 bp, Artificial Sequence
  chemically synthesized
cttattattatcaatcctaggc

SEQ ID NO: 773490 - DNA, 22 bp, Artificial Sequence
  chemically synthesized
acttattattatcaatcctagg

SEQ ID NO: 773491 - DNA, 22 bp, Artificial Sequence
  chemically synthesized
cttagtggcctaggattgataa

SEQ ID NO: 773492 - DNA, 22 bp, Artificial Sequence
  chemically synthesized
gcttacttattattatcaatcc

SEQ ID NO: 773493 - DNA, 22 bp, Artificial Sequence
  chemically synthesized
agtggcctaggattgataataa

SEQ ID NO: 773494 - DNA, 22 bp, Artificial Sequence
  chemically synthesized
gtggcctaggattgataataat

SEQ ID NO: 773495 - DNA, 22 bp, Artificial Sequence
  chemically synthesized
attagcttacttattattatca

SEQ ID NO: 773496 - DNA, 22 bp, Artificial Sequence
  chemically synthesized
ggttcattagcttacttattat

SEQ ID NO: 773497 - DNA, 22 bp, Artificial Sequence
  chemically synthesized
ggattgataataataagtaagc

SEQ ID NO: 773498 - DNA, 22 bp, Artificial Sequence
  chemically synthesized
ggattgggttcattagcttact

SEQ ID NO: 773499 - DNA, 22 bp, Artificial Sequence
  chemically synthesized
gggattgggttcattagcttac

SEQ ID NO: 773500 - DNA, 22 bp, Artificial Sequence
  chemically synthesized
ataataataagtaagctaatga

SEQ ID NO: 773501 - DNA, 22 bp, Artificial Sequence
  chemically synthesized
caaaatcagtttgggattgggt

SEQ ID NO: 773502 - DNA, 22 bp, Artificial Sequence
  chemically synthesized
atgaacccaatcccaaactgat

SEQ ID NO: 773503 - DNA, 22 bp, Artificial Sequence
  chemically synthesized
ataaaagatactgcaaaatcag

SEQ ID NO: 773504 - DNA, 22 bp, Artificial Sequence
  chemically synthesized
ctgataaaagatactgcaaaat

SEQ ID NO: 773505 - DNA, 22 bp, Artificial Sequence
  chemically synthesized
attttgcagtatcttttatcag

SEQ ID NO: 773506 - DNA, 22 bp, Artificial Sequence
  chemically synthesized
ccatgaaatctactgataaaag

SEQ ID NO: 773507 - DNA, 22 bp, Artificial Sequence
  chemically synthesized
tgcagtatcttttatcagtaga

SEQ ID NO: 773508 - DNA, 22 bp, Artificial Sequence
  chemically synthesized
gcagtatcttttatcagtagat

SEQ ID NO: 773509 - DNA, 22 bp, Artificial Sequence
  chemically synthesized
cagtatcttttatcagtagatt

SEQ ID NO: 773510 - DNA, 22 bp, Artificial Sequence
  chemically synthesized
ttatcagtagatttcatggcag

SEQ ID NO: 773511 - DNA, 22 bp, Artificial Sequence
  chemically synthesized
aatatacagcaactgccatgaa

SEQ ID NO: 773512 - DNA, 22 bp, Artificial Sequence
  chemically synthesized
tatcagtagatttcatggcagt

SEQ ID NO: 773513 - DNA, 22 bp, Artificial Sequence
  chemically synthesized
atcagtagatttcatggcagtt

SEQ ID NO: 773514 - DNA, 22 bp, Artificial Sequence
  chemically synthesized
tcagtagatttcatggcagttg

SEQ ID NO: 773515 - DNA, 22 bp, Artificial Sequence
  chemically synthesized
caattaaatatacagcaactgc

SEQ ID NO: 773516 - DNA, 22 bp, Artificial Sequence
  chemically synthesized
acaattaaatatacagcaactg

SEQ ID NO: 773517 - DNA, 22 bp, Artificial Sequence
  chemically synthesized
tacaattaaatatacagcaact

SEQ ID NO: 773518 - DNA, 22 bp, Artificial Sequence
  chemically synthesized
ttacaattaaatatacagcaac

SEQ ID NO: 773519 - DNA, 22 bp, Artificial Sequence
  chemically synthesized
tttacaattaaatatacagcaa

SEQ ID NO: 773520 - DNA, 22 bp, Artificial Sequence
  chemically synthesized
catggcagttgctgtatattta

SEQ ID NO: 773521 - DNA, 22 bp, Artificial Sequence
  chemically synthesized
atggcagttgctgtatatttaa

SEQ ID NO: 773522 - DNA, 22 bp, Artificial Sequence
  chemically synthesized
ctgtatatttaattgtaaaaaa

SEQ ID NO: 773523 - DNA, 22 bp, Artificial Sequence
  chemically synthesized
aacagtcccgaattttttacaa

SEQ ID NO: 773524 - DNA, 22 bp, Artificial Sequence
  chemically synthesized
aaacagtcccgaattttttaca

SEQ ID NO: 773525 - DNA, 22 bp, Artificial Sequence
  chemically synthesized
tatatttaattgtaaaaaattc

SEQ ID NO: 773526 - DNA, 22 bp, Artificial Sequence
  chemically synthesized
cccagtttaaacagtcccgaat

SEQ ID NO: 773527 - DNA, 22 bp, Artificial Sequence
  chemically synthesized
aattgtaaaaaattcgggactg

SEQ ID NO: 773528 - DNA, 22 bp, Artificial Sequence
  chemically synthesized
attgtaaaaaattcgggactgt

SEQ ID NO: 773529 - DNA, 22 bp, Artificial Sequence
  chemically synthesized
acctccccagtttaaacagtcc

SEQ ID NO: 773530 - DNA, 22 bp, Artificial Sequence
  chemically synthesized
taaaaaattcgggactgtttaa

SEQ ID NO: 773531 - DNA, 22 bp, Artificial Sequence
  chemically synthesized
tcacctccccagtttaaacagt

SEQ ID NO: 773532 - DNA, 22 bp, Artificial Sequence
  chemically synthesized
ctcacctccccagtttaaacag

SEQ ID NO: 773533 - DNA, 22 bp, Artificial Sequence
  chemically synthesized
tctcacctccccagtttaaaca

SEQ ID NO: 773534 - DNA, 22 bp, Artificial Sequence
  chemically synthesized
ttttctcacctccccagtttaa

SEQ ID NO: 773535 - DNA, 22 bp, Artificial Sequence
  chemically synthesized
tgttttctcacctccccagttt

SEQ ID NO: 773536 - DNA, 22 bp, Artificial Sequence
  chemically synthesized
ctgttttctcacctccccagtt

SEQ ID NO: 773537 - DNA, 22 bp, Artificial Sequence
  chemically synthesized
gggactgtttaaactggggagg

SEQ ID NO: 773538 - DNA, 22 bp, Artificial Sequence
  chemically synthesized
cttctgttttctcacctcccca

SEQ ID NO: 773539 - DNA, 22 bp, Artificial Sequence
  chemically synthesized
ccttctgttttctcacctcccc

SEQ ID NO: 773540 - DNA, 22 bp, Artificial Sequence
  chemically synthesized
tccttctgttttctcacctccc

SEQ ID NO: 773541 - DNA, 22 bp, Artificial Sequence
  chemically synthesized
ttccttctgttttctcacctcc

SEQ ID NO: 773542 - DNA, 22 bp, Artificial Sequence
  chemically synthesized
tttaaactggggaggtgagaaa

SEQ ID NO: 773543 - DNA, 22 bp, Artificial Sequence
  chemically synthesized
ttttccttctgttttctcacct

SEQ ID NO: 773544 - DNA, 22 bp, Artificial Sequence
  chemically synthesized
aaactggggaggtgagaaaaca

SEQ ID NO: 773545 - DNA, 22 bp, Artificial Sequence
  chemically synthesized
aactggggaggtgagaaaacag

SEQ ID NO: 773546 - DNA, 22 bp, Artificial Sequence
  chemically synthesized
cctcttttccttctgttttctc

SEQ ID NO: 773547 - DNA, 22 bp, Artificial Sequence
  chemically synthesized
tacctcttttccttctgttttc

SEQ ID NO: 773548 - DNA, 22 bp, Artificial Sequence
  chemically synthesized
ctacctcttttccttctgtttt

SEQ ID NO: 773549 - DNA, 22 bp, Artificial Sequence
  chemically synthesized
gggaggtgagaaaacagaagga

SEQ ID NO: 773550 - DNA, 22 bp, Artificial Sequence
  chemically synthesized
tttctacctcttttccttctgt

SEQ ID NO: 773551 - DNA, 22 bp, Artificial Sequence
  chemically synthesized
atttctacctcttttccttctg

SEQ ID NO: 773552 - DNA, 22 bp, Artificial Sequence
  chemically synthesized
ttatttctacctcttttccttc

SEQ ID NO: 773553 - DNA, 22 bp, Artificial Sequence
  chemically synthesized
cttatttctacctcttttcctt

SEQ ID NO: 773554 - DNA, 22 bp, Artificial Sequence
  chemically synthesized
tgcttcttatttctacctcttt

SEQ ID NO: 773555 - DNA, 22 bp, Artificial Sequence
  chemically synthesized
gtgcttcttatttctacctctt

SEQ ID NO: 773556 - DNA, 22 bp, Artificial Sequence
  chemically synthesized
ttgtgcttcttatttctacctc

SEQ ID NO: 773557 - DNA, 22 bp, Artificial Sequence
  chemically synthesized
cttgtgcttcttatttctacct

SEQ ID NO: 773558 - DNA, 22 bp, Artificial Sequence
  chemically synthesized
acaatcttcttgtgcttcttat

SEQ ID NO: 773559 - DNA, 22 bp, Artificial Sequence
  chemically synthesized
gttcacaatcttcttgtgcttc

SEQ ID NO: 773560 - DNA, 22 bp, Artificial Sequence
  chemically synthesized
tgaaaactggttcacaatcttc

SEQ ID NO: 773561 - DNA, 22 bp, Artificial Sequence
  chemically synthesized
atgaaaactggttcacaatctt

SEQ ID NO: 773562 - DNA, 22 bp, Artificial Sequence
  chemically synthesized
agtttatgaaaactggttcaca

SEQ ID NO: 773563 - DNA, 22 bp, Artificial Sequence
  chemically synthesized
taagtttatgaaaactggttca

SEQ ID NO: 773564 - DNA, 22 bp, Artificial Sequence
  chemically synthesized
ctaagtttatgaaaactggttc

SEQ ID NO: 773565 - DNA, 22 bp, Artificial Sequence
  chemically synthesized
cttctaagtttatgaaaactgg

SEQ ID NO: 773566 - DNA, 22 bp, Artificial Sequence
  chemically synthesized
attgcttctaagtttatgaaaa

SEQ ID NO: 773567 - DNA, 22 bp, Artificial Sequence
  chemically synthesized
cattgcttctaagtttatgaaa

SEQ ID NO: 773568 - DNA, 22 bp, Artificial Sequence
  chemically synthesized
tcattgcttctaagtttatgaa

SEQ ID NO: 773569 - DNA, 22 bp, Artificial Sequence
  chemically synthesized
tgaaccagttttcataaactta

SEQ ID NO: 773570 - DNA, 22 bp, Artificial Sequence
  chemically synthesized
aagtacctttcattgcttctaa

SEQ ID NO: 773571 - DNA, 22 bp, Artificial Sequence
  chemically synthesized
caagtacctttcattgcttcta

SEQ ID NO: 773572 - DNA, 22 bp, Artificial Sequence
  chemically synthesized
tcataaacttagaagcaatgaa

SEQ ID NO: 773573 - DNA, 22 bp, Artificial Sequence
  chemically synthesized
cataaacttagaagcaatgaaa

SEQ ID NO: 773574 - DNA, 22 bp, Artificial Sequence
  chemically synthesized
ataaacttagaagcaatgaaag

SEQ ID NO: 773575 - DNA, 22 bp, Artificial Sequence
  chemically synthesized
cagtttcaagtacctttcattg

SEQ ID NO: 773576 - DNA, 22 bp, Artificial Sequence
  chemically synthesized
gcagtttcaagtacctttcatt

SEQ ID NO: 773577 - DNA, 22 bp, Artificial Sequence
  chemically synthesized
tttgcagtttcaagtacctttc

SEQ ID NO: 773578 - DNA, 22 bp, Artificial Sequence
  chemically synthesized
tgtttgcagtttcaagtacctt

SEQ ID NO: 773579 - DNA, 22 bp, Artificial Sequence
  chemically synthesized
agaagcaatgaaaggtacttga

SEQ ID NO: 773580 - DNA, 22 bp, Artificial Sequence
  chemically synthesized
gaagcaatgaaaggtacttgaa

SEQ ID NO: 773581 - DNA, 22 bp, Artificial Sequence
  chemically synthesized
ttctgtttgcagtttcaagtac

SEQ ID NO: 773582 - DNA, 22 bp, Artificial Sequence
  chemically synthesized
tattctgtttgcagtttcaagt

SEQ ID NO: 773583 - DNA, 22 bp, Artificial Sequence
  chemically synthesized
agtccactctattctgtttgca

SEQ ID NO: 773584 - DNA, 22 bp, Artificial Sequence
  chemically synthesized
aagtccactctattctgtttgc

SEQ ID NO: 773585 - DNA, 22 bp, Artificial Sequence
  chemically synthesized
taagtccactctattctgtttg

SEQ ID NO: 773586 - DNA, 22 bp, Artificial Sequence
  chemically synthesized
gaaactgcaaacagaatagagt

SEQ ID NO: 773587 - DNA, 22 bp, Artificial Sequence
  chemically synthesized
aaactgcaaacagaatagagtg

SEQ ID NO: 773588 - DNA, 22 bp, Artificial Sequence
  chemically synthesized
caaacagaatagagtggactta

SEQ ID NO: 773589 - DNA, 22 bp, Artificial Sequence
  chemically synthesized
agtacacaatcagtgagcagtt

SEQ ID NO: 773590 - DNA, 22 bp, Artificial Sequence
  chemically synthesized
aaaactgctcactgattgtgta

SEQ ID NO: 773591 - DNA, 22 bp, Artificial Sequence
  chemically synthesized
aaactgctcactgattgtgtac

SEQ ID NO: 773592 - DNA, 22 bp, Artificial Sequence
  chemically synthesized
acagagaaaatgttgagtacac

SEQ ID NO: 773593 - DNA, 22 bp, Artificial Sequence
  chemically synthesized
aacagagaaaatgttgagtaca

SEQ ID NO: 773594 - DNA, 22 bp, Artificial Sequence
  chemically synthesized
ctcactgattgtgtactcaaca

SEQ ID NO: 773595 - DNA, 22 bp, Artificial Sequence
  chemically synthesized
tttaacagagaaaatgttgagt

SEQ ID NO: 773596 - DNA, 22 bp, Artificial Sequence
  chemically synthesized
actgattgtgtactcaacattt

SEQ ID NO: 773597 - DNA, 22 bp, Artificial Sequence
  chemically synthesized
attgtgtactcaacattttctc

SEQ ID NO: 773598 - DNA, 22 bp, Artificial Sequence
  chemically synthesized
ggatcctatttaacagagaaaa

SEQ ID NO: 773599 - DNA, 22 bp, Artificial Sequence
  chemically synthesized
tgtactcaacattttctctgtt

SEQ ID NO: 773600 - DNA, 22 bp, Artificial Sequence
  chemically synthesized
taggatcctatttaacagagaa

SEQ ID NO: 773601 - DNA, 22 bp, Artificial Sequence
  chemically synthesized
ctctaggatcctatttaacaga

SEQ ID NO: 773602 - DNA, 22 bp, Artificial Sequence
  chemically synthesized
aacattttctctgttaaatagg

SEQ ID NO: 773603 - DNA, 22 bp, Artificial Sequence
  chemically synthesized
aaatagctgctctaggatccta

SEQ ID NO: 773604 - DNA, 22 bp, Artificial Sequence
  chemically synthesized
tctctgttaaataggatcctag

SEQ ID NO: 773605 - DNA, 22 bp, Artificial Sequence
  chemically synthesized
gaaatagctgctctaggatcct

SEQ ID NO: 773606 - DNA, 22 bp, Artificial Sequence
  chemically synthesized
ctctgttaaataggatcctaga

SEQ ID NO: 773607 - DNA, 22 bp, Artificial Sequence
  chemically synthesized
tctgttaaataggatcctagag

SEQ ID NO: 773608 - DNA, 22 bp, Artificial Sequence
  chemically synthesized
tgttaaataggatcctagagca

SEQ ID NO: 773609 - DNA, 22 bp, Artificial Sequence
  chemically synthesized
ttaaataggatcctagagcagc

SEQ ID NO: 773610 - DNA, 22 bp, Artificial Sequence
  chemically synthesized
aataggatcctagagcagctat

SEQ ID NO: 773611 - DNA, 22 bp, Artificial Sequence
  chemically synthesized
aggtgagtggcaatttgaaata

SEQ ID NO: 773612 - DNA, 22 bp, Artificial Sequence
  chemically synthesized
aaggtgagtggcaatttgaaat

SEQ ID NO: 773613 - DNA, 22 bp, Artificial Sequence
  chemically synthesized
gagcagctatttcaaattgcca

SEQ ID NO: 773614 - DNA, 22 bp, Artificial Sequence
  chemically synthesized
agatttaaggtgagtggcaatt

SEQ ID NO: 773615 - DNA, 22 bp, Artificial Sequence
  chemically synthesized
tttcaaattgccactcacctta

SEQ ID NO: 773616 - DNA, 22 bp, Artificial Sequence
  chemically synthesized
gagtctgagatttaaggtgagt

SEQ ID NO: 773617 - DNA, 22 bp, Artificial Sequence
  chemically synthesized
caaattgccactcaccttaaat

SEQ ID NO: 773618 - DNA, 22 bp, Artificial Sequence
  chemically synthesized
aaattgccactcaccttaaatc

SEQ ID NO: 773619 - DNA, 22 bp, Artificial Sequence
  chemically synthesized
ccactcaccttaaatctcagac

SEQ ID NO: 773620 - DNA, 22 bp, Artificial Sequence
  chemically synthesized
accttaaatctcagactccaac

SEQ ID NO: 773621 - DNA, 22 bp, Artificial Sequence
  chemically synthesized
aaatctcagactccaacacctt

SEQ ID NO: 773622 - DNA, 22 bp, Artificial Sequence
  chemically synthesized
aatctcagactccaacaccttc

SEQ ID NO: 773623 - DNA, 22 bp, Artificial Sequence
  chemically synthesized
aatgcccagtgatgaggaaggt

SEQ ID NO: 773624 - DNA, 22 bp, Artificial Sequence
  chemically synthesized
agactccaacaccttcctcatc

SEQ ID NO: 773625 - DNA, 22 bp, Artificial Sequence
  chemically synthesized
cagctaaatgcccagtgatgag

SEQ ID NO: 773626 - DNA, 22 bp, Artificial Sequence
  chemically synthesized
caacaccttcctcatcactggg

SEQ ID NO: 773627 - DNA, 22 bp, Artificial Sequence
  chemically synthesized
cctcatcactgggcatttagct

SEQ ID NO: 773628 - DNA, 22 bp, Artificial Sequence
  chemically synthesized
ctcatcactgggcatttagctg

SEQ ID NO: 773629 - DNA, 22 bp, Artificial Sequence
  chemically synthesized
aagtggaagctgcagctaaatg

SEQ ID NO: 773630 - DNA, 22 bp, Artificial Sequence
  chemically synthesized
atcactgggcatttagctgcag

SEQ ID NO: 773631 - DNA, 22 bp, Artificial Sequence
  chemically synthesized
ttgaagtggaagctgcagctaa

SEQ ID NO: 773632 - DNA, 22 bp, Artificial Sequence
  chemically synthesized
attgaagtggaagctgcagcta

SEQ ID NO: 773633 - DNA, 22 bp, Artificial Sequence
  chemically synthesized
tattgaagtggaagctgcagct

SEQ ID NO: 773634 - DNA, 22 bp, Artificial Sequence
  chemically synthesized
ttattgaagtggaagctgcagc

SEQ ID NO: 773635 - DNA, 22 bp, Artificial Sequence
  chemically synthesized
tttattgaagtggaagctgcag

SEQ ID NO: 773636 - DNA, 22 bp, Artificial Sequence
  chemically synthesized
ggcatttagctgcagcttccac

SEQ ID NO: 773637 - DNA, 22 bp, Artificial Sequence
  chemically synthesized
ttttttattgaagtggaagctg

SEQ ID NO: 773638 - DNA, 22 bp, Artificial Sequence
  chemically synthesized
attttttattgaagtggaagct

SEQ ID NO: 773639 - DNA, 22 bp, Artificial Sequence
  chemically synthesized
gatttattttttattgaagtgg

SEQ ID NO: 773640 - DNA, 22 bp, Artificial Sequence
  chemically synthesized
agctgcagcttccacttcaata

SEQ ID NO: 773641 - DNA, 22 bp, Artificial Sequence
  chemically synthesized
gctgcagcttccacttcaataa

SEQ ID NO: 773642 - DNA, 22 bp, Artificial Sequence
  chemically synthesized
tattggatttattttttattga

SEQ ID NO: 773643 - DNA, 22 bp, Artificial Sequence
  chemically synthesized
cagcttccacttcaataaaaaa

SEQ ID NO: 773644 - DNA, 22 bp, Artificial Sequence
  chemically synthesized
ttgtattggatttattttttat

SEQ ID NO: 773645 - DNA, 22 bp, Artificial Sequence
  chemically synthesized
ccacttcaataaaaaataaatc

SEQ ID NO: 773646 - DNA, 22 bp, Artificial Sequence
  chemically synthesized
cacttcaataaaaaataaatcc

SEQ ID NO: 773647 - DNA, 22 bp, Artificial Sequence
  chemically synthesized
caataaaaaataaatccaatac

SEQ ID NO: 773648 - DNA, 22 bp, Artificial Sequence
  chemically synthesized
agtaggattgttgtattggatt

SEQ ID NO: 773649 - DNA, 22 bp, Artificial Sequence
  chemically synthesized
aataaaaaataaatccaataca

SEQ ID NO: 773650 - DNA, 22 bp, Artificial Sequence
  chemically synthesized
gtgaaaggttaagtaggattgt

SEQ ID NO: 773651 - DNA, 22 bp, Artificial Sequence
  chemically synthesized
ggtgaaaggttaagtaggattg

SEQ ID NO: 773652 - DNA, 22 bp, Artificial Sequence
  chemically synthesized
taagtttggtgaaaggttaagt

SEQ ID NO: 773653 - DNA, 22 bp, Artificial Sequence
  chemically synthesized
gtaagtttggtgaaaggttaag

SEQ ID NO: 773654 - DNA, 22 bp, Artificial Sequence
  chemically synthesized
tgtaagtttggtgaaaggttaa

SEQ ID NO: 773655 - DNA, 22 bp, Artificial Sequence
  chemically synthesized
gtagttttgtaagtttggtgaa

SEQ ID NO: 773656 - DNA, 22 bp, Artificial Sequence
  chemically synthesized
ctggtagttttgtaagtttggt

SEQ ID NO: 773657 - DNA, 22 bp, Artificial Sequence
  chemically synthesized
cttaacctttcaccaaacttac

SEQ ID NO: 773658 - DNA, 22 bp, Artificial Sequence
  chemically synthesized
aacctttcaccaaacttacaaa

SEQ ID NO: 773659 - DNA, 22 bp, Artificial Sequence
  chemically synthesized
acctttcaccaaacttacaaaa

SEQ ID NO: 773660 - DNA, 22 bp, Artificial Sequence
  chemically synthesized
tcaccaaacttacaaaactacc

SEQ ID NO: 773661 - DNA, 22 bp, Artificial Sequence
  chemically synthesized
caccaaacttacaaaactacca

SEQ ID NO: 773662 - DNA, 22 bp, Artificial Sequence
  chemically synthesized
accaaacttacaaaactaccag

SEQ ID NO: 773663 - DNA, 22 bp, Artificial Sequence
  chemically synthesized
acaaaactaccagtagctatgc

SEQ ID NO: 773664 - DNA, 22 bp, Artificial Sequence
  chemically synthesized
caaaactaccagtagctatgcc

SEQ ID NO: 773665 - DNA, 22 bp, Artificial Sequence
  chemically synthesized
ccagtagctatgcccatcctcc

SEQ ID NO: 773666 - DNA, 22 bp, Artificial Sequence
  chemically synthesized
caacatcaggggagaagggaag

SEQ ID NO: 773667 - DNA, 22 bp, Artificial Sequence
  chemically synthesized
tgcccatcctccttcccttctc

SEQ ID NO: 773668 - DNA, 22 bp, Artificial Sequence
  chemically synthesized
ttacaacatcaggggagaaggg

SEQ ID NO: 773669 - DNA, 22 bp, Artificial Sequence
  chemically synthesized
tattacaacatcaggggagaag

SEQ ID NO: 773670 - DNA, 22 bp, Artificial Sequence
  chemically synthesized
ctattacaacatcaggggagaa

SEQ ID NO: 773671 - DNA, 22 bp, Artificial Sequence
  chemically synthesized
cttcccttctcccctgatgttg

SEQ ID NO: 773672 - DNA, 22 bp, Artificial Sequence
  chemically synthesized
cccttctcccctgatgttgtaa

SEQ ID NO: 773673 - DNA, 22 bp, Artificial Sequence
  chemically synthesized
ccttctcccctgatgttgtaat

SEQ ID NO: 773674 - DNA, 22 bp, Artificial Sequence
  chemically synthesized
ctcccctgatgttgtaatagaa

SEQ ID NO: 773675 - DNA, 22 bp, Artificial Sequence
  chemically synthesized
tcccctgatgttgtaatagaag

SEQ ID NO: 773676 - DNA, 22 bp, Artificial Sequence
  chemically synthesized
ccctgatgttgtaatagaagct

SEQ ID NO: 773677 - DNA, 22 bp, Artificial Sequence
  chemically synthesized
atgttgtaatagaagctgtact

SEQ ID NO: 773678 - DNA, 22 bp, Artificial Sequence
  chemically synthesized
agataggaaggaaagtacagct

SEQ ID NO: 773679 - DNA, 22 bp, Artificial Sequence
  chemically synthesized
cagataggaaggaaagtacagc

SEQ ID NO: 773680 - DNA, 22 bp, Artificial Sequence
  chemically synthesized
taatagaagctgtactttcctt

SEQ ID NO: 773681 - DNA, 22 bp, Artificial Sequence
  chemically synthesized
gcttcagataggaaggaaagta

SEQ ID NO: 773682 - DNA, 22 bp, Artificial Sequence
  chemically synthesized
gaaattagcttcagataggaag

SEQ ID NO: 773683 - DNA, 22 bp, Artificial Sequence
  chemically synthesized
agaaattagcttcagataggaa

SEQ ID NO: 773684 - DNA, 22 bp, Artificial Sequence
  chemically synthesized
tactttccttcctatctgaagc

SEQ ID NO: 773685 - DNA, 22 bp, Artificial Sequence
  chemically synthesized
tccttcctatctgaagctaatt

SEQ ID NO: 773686 - DNA, 22 bp, Artificial Sequence
  chemically synthesized
ccttcctatctgaagctaattt

SEQ ID NO: 773687 - DNA, 22 bp, Artificial Sequence
  chemically synthesized
cttcctatctgaagctaatttc

SEQ ID NO: 773688 - DNA, 22 bp, Artificial Sequence
  chemically synthesized
cctatctgaagctaatttctaa

SEQ ID NO: 773689 - DNA, 22 bp, Artificial Sequence
  chemically synthesized
ctatctgaagctaatttctaaa

SEQ ID NO: 773690 - DNA, 22 bp, Artificial Sequence
  chemically synthesized
tctgaagctaatttctaaattt

SEQ ID NO: 773691 - DNA, 22 bp, Artificial Sequence
  chemically synthesized
aagctaatttctaaatttcatc

SEQ ID NO: 773692 - DNA, 22 bp, Artificial Sequence
  chemically synthesized
agaaggcagaaagatgaaattt

SEQ ID NO: 773693 - DNA, 22 bp, Artificial Sequence
  chemically synthesized
gagaaggcagaaagatgaaatt

SEQ ID NO: 773694 - DNA, 22 bp, Artificial Sequence
  chemically synthesized
atttctaaatttcatctttctg

SEQ ID NO: 773695 - DNA, 22 bp, Artificial Sequence
  chemically synthesized
ctaaatttcatctttctgcctt

SEQ ID NO: 773696 - DNA, 22 bp, Artificial Sequence
  chemically synthesized
taaatttcatctttctgccttc

SEQ ID NO: 773697 - DNA, 22 bp, Artificial Sequence
  chemically synthesized
aatttcatctttctgccttctc

SEQ ID NO: 773698 - DNA, 22 bp, Artificial Sequence
  chemically synthesized
catctttctgccttctcaagta

SEQ ID NO: 773699 - DNA, 22 bp, Artificial Sequence
  chemically synthesized
atctttctgccttctcaagtac

SEQ ID NO: 773700 - DNA, 22 bp, Artificial Sequence
  chemically synthesized
tctgccttctcaagtacctgtg

SEQ ID NO: 773701 - DNA, 22 bp, Artificial Sequence
  chemically synthesized
ctgccttctcaagtacctgtgc

SEQ ID NO: 773702 - DNA, 22 bp, Artificial Sequence
  chemically synthesized
tgccttctcaagtacctgtgct

SEQ ID NO: 773703 - DNA, 22 bp, Artificial Sequence
  chemically synthesized
gagataatcaatagcacaggta

SEQ ID NO: 773704 - DNA, 22 bp, Artificial Sequence
  chemically synthesized
ccttctcaagtacctgtgctat

SEQ ID NO: 773705 - DNA, 22 bp, Artificial Sequence
  chemically synthesized
ctcaagtacctgtgctattgat

SEQ ID NO: 773706 - DNA, 22 bp, Artificial Sequence
  chemically synthesized
tcaagtacctgtgctattgatt

SEQ ID NO: 773707 - DNA, 22 bp, Artificial Sequence
  chemically synthesized
aagtacctgtgctattgattat

SEQ ID NO: 773708 - DNA, 22 bp, Artificial Sequence
  chemically synthesized
tgctattgattatctctaattt

SEQ ID NO: 773709 - DNA, 22 bp, Artificial Sequence
  chemically synthesized
aggatgcaggagaaattagaga

SEQ ID NO: 773710 - DNA, 22 bp, Artificial Sequence
  chemically synthesized
ttgattatctctaatttctcct

SEQ ID NO: 773711 - DNA, 22 bp, Artificial Sequence
  chemically synthesized
attatctctaatttctcctgca

SEQ ID NO: 773712 - DNA, 22 bp, Artificial Sequence
  chemically synthesized
tctctaatttctcctgcatcct

SEQ ID NO: 773713 - DNA, 22 bp, Artificial Sequence
  chemically synthesized
taatttctcctgcatcctcaac

SEQ ID NO: 773714 - DNA, 22 bp, Artificial Sequence
  chemically synthesized
atttctcctgcatcctcaacct

SEQ ID NO: 773715 - DNA, 22 bp, Artificial Sequence
  chemically synthesized
ctcctgcatcctcaacctctcc

SEQ ID NO: 773716 - DNA, 22 bp, Artificial Sequence
  chemically synthesized
tcctgcatcctcaacctctccc

SEQ ID NO: 773717 - DNA, 22 bp, Artificial Sequence
  chemically synthesized
ctgcatcctcaacctctccctc

SEQ ID NO: 773718 - DNA, 22 bp, Artificial Sequence
  chemically synthesized
catcctcaacctctccctctct

SEQ ID NO: 773719 - DNA, 22 bp, Artificial Sequence
  chemically synthesized
aacctctccctctctaccatct

SEQ ID NO: 773720 - DNA, 22 bp, Artificial Sequence
  chemically synthesized
aatggcaatgagaagaagatgg

SEQ ID NO: 773721 - DNA, 22 bp, Artificial Sequence
  chemically synthesized
aaatggcaatgagaagaagatg

SEQ ID NO: 773722 - DNA, 22 bp, Artificial Sequence
  chemically synthesized
tccctctctaccatcttcttct

SEQ ID NO: 773723 - DNA, 22 bp, Artificial Sequence
  chemically synthesized
cctctctaccatcttcttctca

SEQ ID NO: 773724 - DNA, 22 bp, Artificial Sequence
  chemically synthesized
tctaccatcttcttctcattgc

SEQ ID NO: 773725 - DNA, 22 bp, Artificial Sequence
  chemically synthesized
taccatcttcttctcattgcca

SEQ ID NO: 773726 - DNA, 22 bp, Artificial Sequence
  chemically synthesized
cacatgtttaaatggcaatgag

SEQ ID NO: 773727 - DNA, 22 bp, Artificial Sequence
  chemically synthesized
acacatgtttaaatggcaatga

SEQ ID NO: 773728 - DNA, 22 bp, Artificial Sequence
  chemically synthesized
ccatcttcttctcattgccatt

SEQ ID NO: 773729 - DNA, 22 bp, Artificial Sequence
  chemically synthesized
cttctcattgccatttaaacat

SEQ ID NO: 773730 - DNA, 22 bp, Artificial Sequence
  chemically synthesized
ttctcattgccatttaaacatg

SEQ ID NO: 773731 - DNA, 22 bp, Artificial Sequence
  chemically synthesized
ctcattgccatttaaacatgtg

SEQ ID NO: 773732 - DNA, 22 bp, Artificial Sequence
  chemically synthesized
tcattgccatttaaacatgtgt

SEQ ID NO: 773733 - DNA, 22 bp, Artificial Sequence
  chemically synthesized
attgccatttaaacatgtgtaa

SEQ ID NO: 773734 - DNA, 22 bp, Artificial Sequence
  chemically synthesized
aaagggtagtgacttacacatg

SEQ ID NO: 773735 - DNA, 22 bp, Artificial Sequence
  chemically synthesized
aaaagggtagtgacttacacat

SEQ ID NO: 773736 - DNA, 22 bp, Artificial Sequence
  chemically synthesized
ccatttaaacatgtgtaagtca

SEQ ID NO: 773737 - DNA, 22 bp, Artificial Sequence
  chemically synthesized
ttaaaagggtagtgacttacac

SEQ ID NO: 773738 - DNA, 22 bp, Artificial Sequence
  chemically synthesized
aaacatgtgtaagtcactaccc

SEQ ID NO: 773739 - DNA, 22 bp, Artificial Sequence
  chemically synthesized
aacatgtgtaagtcactaccct

SEQ ID NO: 773740 - DNA, 22 bp, Artificial Sequence
  chemically synthesized
cccttttaagagtgtgttcttc

SEQ ID NO: 773741 - DNA, 22 bp, Artificial Sequence
  chemically synthesized
ttaagagtgtgttcttcctgcc

SEQ ID NO: 773742 - DNA, 22 bp, Artificial Sequence
  chemically synthesized
taagagtgtgttcttcctgccc

SEQ ID NO: 773743 - DNA, 22 bp, Artificial Sequence
  chemically synthesized
aagagtgtgttcttcctgcccc

SEQ ID NO: 773744 - DNA, 22 bp, Artificial Sequence
  chemically synthesized
agagtgtgttcttcctgcccct

SEQ ID NO: 773745 - DNA, 22 bp, Artificial Sequence
  chemically synthesized
ttcctgcccctacatccatctt

SEQ ID NO: 773746 - DNA, 22 bp, Artificial Sequence
  chemically synthesized
cctgcccctacatccatcttct

SEQ ID NO: 773747 - DNA, 22 bp, Artificial Sequence
  chemically synthesized
ctgcccctacatccatcttctg

SEQ ID NO: 773748 - DNA, 22 bp, Artificial Sequence
  chemically synthesized
cccctacatccatcttctgcta

SEQ ID NO: 773749 - DNA, 22 bp, Artificial Sequence
  chemically synthesized
catccatcttctgctactatgg

SEQ ID NO: 773750 - DNA, 22 bp, Artificial Sequence
  chemically synthesized
cgatgggaagagagaaagggcc

SEQ ID NO: 773751 - DNA, 22 bp, Artificial Sequence
  chemically synthesized
ctgctactatggccctttctct

SEQ ID NO: 773752 - DNA, 22 bp, Artificial Sequence
  chemically synthesized
tgctactatggccctttctctc

SEQ ID NO: 773753 - DNA, 22 bp, Artificial Sequence
  chemically synthesized
gctgcgatgggaagagagaaag

SEQ ID NO: 773754 - DNA, 22 bp, Artificial Sequence
  chemically synthesized
ctactatggccctttctctctt

SEQ ID NO: 773755 - DNA, 22 bp, Artificial Sequence
  chemically synthesized
ggctgcgatgggaagagagaaa

SEQ ID NO: 773756 - DNA, 22 bp, Artificial Sequence
  chemically synthesized
tggctgcgatgggaagagagaa

SEQ ID NO: 773757 - DNA, 22 bp, Artificial Sequence
  chemically synthesized
ttggctgcgatgggaagagaga

SEQ ID NO: 773758 - DNA, 22 bp, Artificial Sequence
  chemically synthesized
ctatggccctttctctcttccc

SEQ ID NO: 773759 - DNA, 22 bp, Artificial Sequence
  chemically synthesized
tggccctttctctcttcccatc

SEQ ID NO: 773760 - DNA, 22 bp, Artificial Sequence
  chemically synthesized
agacttttggctgcgatgggaa

SEQ ID NO: 773761 - DNA, 22 bp, Artificial Sequence
  chemically synthesized
aagacttttggctgcgatggga

SEQ ID NO: 773762 - DNA, 22 bp, Artificial Sequence
  chemically synthesized
taagacttttggctgcgatggg

SEQ ID NO: 773763 - DNA, 22 bp, Artificial Sequence
  chemically synthesized
ttttaagacttttggctgcgat

SEQ ID NO: 773764 - DNA, 22 bp, Artificial Sequence
  chemically synthesized
tctctcttcccatcgcagccaa

SEQ ID NO: 773765 - DNA, 22 bp, Artificial Sequence
  chemically synthesized
ctctcttcccatcgcagccaaa

SEQ ID NO: 773766 - DNA, 22 bp, Artificial Sequence
  chemically synthesized
tctcttcccatcgcagccaaaa

SEQ ID NO: 773767 - DNA, 22 bp, Artificial Sequence
  chemically synthesized
tcttcccatcgcagccaaaagt

SEQ ID NO: 773768 - DNA, 22 bp, Artificial Sequence
  chemically synthesized
ttcccatcgcagccaaaagtct

SEQ ID NO: 773769 - DNA, 22 bp, Artificial Sequence
  chemically synthesized
cccatcgcagccaaaagtctta

SEQ ID NO: 773770 - DNA, 22 bp, Artificial Sequence
  chemically synthesized
ccatcgcagccaaaagtcttaa

SEQ ID NO: 773771 - DNA, 22 bp, Artificial Sequence
  chemically synthesized
aaaataattgttttacacttgc

SEQ ID NO: 773772 - DNA, 22 bp, Artificial Sequence
  chemically synthesized
aaataattgttttacacttgct

SEQ ID NO: 773773 - DNA, 22 bp, Artificial Sequence
  chemically synthesized
agaaagtgggggagcaagtgta

SEQ ID NO: 773774 - DNA, 22 bp, Artificial Sequence
  chemically synthesized
agaattgagaaagtgggggagc

SEQ ID NO: 773775 - DNA, 22 bp, Artificial Sequence
  chemically synthesized
ttttacacttgctcccccactt

SEQ ID NO: 773776 - DNA, 22 bp, Artificial Sequence
  chemically synthesized
tacacttgctcccccactttct

SEQ ID NO: 773777 - DNA, 22 bp, Artificial Sequence
  chemically synthesized
acacttgctcccccactttctc

SEQ ID NO: 773778 - DNA, 22 bp, Artificial Sequence
  chemically synthesized
cacttgctcccccactttctca

SEQ ID NO: 773779 - DNA, 22 bp, Artificial Sequence
  chemically synthesized
aggcatgattgagaattgagaa

SEQ ID NO: 773780 - DNA, 22 bp, Artificial Sequence
  chemically synthesized
gctcccccactttctcaattct

SEQ ID NO: 773781 - DNA, 22 bp, Artificial Sequence
  chemically synthesized
ctcccccactttctcaattctc

SEQ ID NO: 773782 - DNA, 22 bp, Artificial Sequence
  chemically synthesized
ccccactttctcaattctcaat

SEQ ID NO: 773783 - DNA, 22 bp, Artificial Sequence
  chemically synthesized
cagtacgttcaggcatgattga

SEQ ID NO: 773784 - DNA, 22 bp, Artificial Sequence
  chemically synthesized
tctcaattctcaatcatgcctg

SEQ ID NO: 773785 - DNA, 22 bp, Artificial Sequence
  chemically synthesized
ctcaattctcaatcatgcctga

SEQ ID NO: 773786 - DNA, 22 bp, Artificial Sequence
  chemically synthesized
tcaattctcaatcatgcctgaa

SEQ ID NO: 773787 - DNA, 22 bp, Artificial Sequence
  chemically synthesized
aattctcaatcatgcctgaacg

SEQ ID NO: 773788 - DNA, 22 bp, Artificial Sequence
  chemically synthesized
tcaatcatgcctgaacgtactg

SEQ ID NO: 773789 - DNA, 22 bp, Artificial Sequence
  chemically synthesized
aatcatgcctgaacgtactgca

SEQ ID NO: 773790 - DNA, 22 bp, Artificial Sequence
  chemically synthesized
aagaaccaagattgcagtacgt

SEQ ID NO: 773791 - DNA, 22 bp, Artificial Sequence
  chemically synthesized
gtggtaactaaagaaccaagat

SEQ ID NO: 773792 - DNA, 22 bp, Artificial Sequence
  chemically synthesized
aacgtactgcaatcttggttct

SEQ ID NO: 773793 - DNA, 22 bp, Artificial Sequence
  chemically synthesized
ggtggtaactaaagaaccaaga

SEQ ID NO: 773794 - DNA, 22 bp, Artificial Sequence
  chemically synthesized
cttggtggtaactaaagaacca

SEQ ID NO: 773795 - DNA, 22 bp, Artificial Sequence
  chemically synthesized
caatcttggttctttagttacc

SEQ ID NO: 773796 - DNA, 22 bp, Artificial Sequence
  chemically synthesized
agtaattacttggtggtaacta

SEQ ID NO: 773797 - DNA, 22 bp, Artificial Sequence
  chemically synthesized
ggttctttagttaccaccaagt

SEQ ID NO: 773798 - DNA, 22 bp, Artificial Sequence
  chemically synthesized
gttctttagttaccaccaagta

SEQ ID NO: 773799 - DNA, 22 bp, Artificial Sequence
  chemically synthesized
tttagttaccaccaagtaatta

SEQ ID NO: 773800 - DNA, 22 bp, Artificial Sequence
  chemically synthesized
tggagaactcagtaattacttg

SEQ ID NO: 773801 - DNA, 22 bp, Artificial Sequence
  chemically synthesized
tagttaccaccaagtaattact

SEQ ID NO: 773802 - DNA, 22 bp, Artificial Sequence
  chemically synthesized
agttaccaccaagtaattactg

SEQ ID NO: 773803 - DNA, 22 bp, Artificial Sequence
  chemically synthesized
gttaccaccaagtaattactga

SEQ ID NO: 773804 - DNA, 22 bp, Artificial Sequence
  chemically synthesized
attatggagaactcagtaatta

SEQ ID NO: 773805 - DNA, 22 bp, Artificial Sequence
  chemically synthesized
ccaccaagtaattactgagttc

SEQ ID NO: 773806 - DNA, 22 bp, Artificial Sequence
  chemically synthesized
agtgttgattatggagaactca

SEQ ID NO: 773807 - DNA, 22 bp, Artificial Sequence
  chemically synthesized
cagtgttgattatggagaactc

SEQ ID NO: 773808 - DNA, 22 bp, Artificial Sequence
  chemically synthesized
ctgagttctccataatcaacac

SEQ ID NO: 773809 - DNA, 22 bp, Artificial Sequence
  chemically synthesized
tgcaagtgatttcagtgttgat

SEQ ID NO: 773810 - DNA, 22 bp, Artificial Sequence
  chemically synthesized
agttctccataatcaacactga

SEQ ID NO: 773811 - DNA, 22 bp, Artificial Sequence
  chemically synthesized
atgcaagtgatttcagtgttga

SEQ ID NO: 773812 - DNA, 22 bp, Artificial Sequence
  chemically synthesized
tatgcaagtgatttcagtgttg

SEQ ID NO: 773813 - DNA, 22 bp, Artificial Sequence
  chemically synthesized
tccataatcaacactgaaatca

SEQ ID NO: 773814 - DNA, 22 bp, Artificial Sequence
  chemically synthesized
cataatcaacactgaaatcact

SEQ ID NO: 773815 - DNA, 22 bp, Artificial Sequence
  chemically synthesized
acaacctttatgcaagtgattt

SEQ ID NO: 773816 - DNA, 22 bp, Artificial Sequence
  chemically synthesized
aaatcacttgcataaaggttgt

SEQ ID NO: 773817 - DNA, 22 bp, Artificial Sequence
  chemically synthesized
gcaacaaggaaggtattgacaa

SEQ ID NO: 773818 - DNA, 22 bp, Artificial Sequence
  chemically synthesized
agcaacaaggaaggtattgaca

SEQ ID NO: 773819 - DNA, 22 bp, Artificial Sequence
  chemically synthesized
gcataaaggttgtcaatacctt

SEQ ID NO: 773820 - DNA, 22 bp, Artificial Sequence
  chemically synthesized
cataaaggttgtcaataccttc

SEQ ID NO: 773821 - DNA, 22 bp, Artificial Sequence
  chemically synthesized
atttagcaacaaggaaggtatt

SEQ ID NO: 773822 - DNA, 22 bp, Artificial Sequence
  chemically synthesized
ttaatttagcaacaaggaaggt

SEQ ID NO: 773823 - DNA, 22 bp, Artificial Sequence
  chemically synthesized
tcaataccttccttgttgctaa

SEQ ID NO: 773824 - DNA, 22 bp, Artificial Sequence
  chemically synthesized
ccttgttgctaaattaatagga

SEQ ID NO: 773825 - DNA, 22 bp, Artificial Sequence
  chemically synthesized
cttgttgctaaattaataggat

SEQ ID NO: 773826 - DNA, 22 bp, Artificial Sequence
  chemically synthesized
gttgctaaattaataggatata

SEQ ID NO: 773827 - DNA, 22 bp, Artificial Sequence
  chemically synthesized
ttgctaaattaataggatatat

SEQ ID NO: 773828 - DNA, 22 bp, Artificial Sequence
  chemically synthesized
ctaaattaataggatatatttt

SEQ ID NO: 773829 - DNA, 22 bp, Artificial Sequence
  chemically synthesized
aattaataggatatattttggt

SEQ ID NO: 773830 - DNA, 22 bp, Artificial Sequence
  chemically synthesized
ataggatatattttggtcttat

SEQ ID NO: 773831 - DNA, 22 bp, Artificial Sequence
  chemically synthesized
caaaagcatcatgaaagataag

SEQ ID NO: 773832 - DNA, 22 bp, Artificial Sequence
  chemically synthesized
tggtcttatctttcatgatgct

SEQ ID NO: 773833 - DNA, 22 bp, Artificial Sequence
  chemically synthesized
ggtcttatctttcatgatgctt

SEQ ID NO: 773834 - DNA, 22 bp, Artificial Sequence
  chemically synthesized
gtcttatctttcatgatgcttt

SEQ ID NO: 773835 - DNA, 22 bp, Artificial Sequence
  chemically synthesized
atctttcatgatgcttttgtag

SEQ ID NO: 773836 - DNA, 22 bp, Artificial Sequence
  chemically synthesized
tctttcatgatgcttttgtagt

SEQ ID NO: 773837 - DNA, 22 bp, Artificial Sequence
  chemically synthesized
gaggtgtcaaatactacaaaag

SEQ ID NO: 773838 - DNA, 22 bp, Artificial Sequence
  chemically synthesized
agaggtgtcaaatactacaaaa

SEQ ID NO: 773839 - DNA, 22 bp, Artificial Sequence
  chemically synthesized
tcatgatgcttttgtagtattt

SEQ ID NO: 773840 - DNA, 22 bp, Artificial Sequence
  chemically synthesized
catgatgcttttgtagtatttg

SEQ ID NO: 773841 - DNA, 22 bp, Artificial Sequence
  chemically synthesized
atgatgcttttgtagtatttga

SEQ ID NO: 773842 - DNA, 22 bp, Artificial Sequence
  chemically synthesized
ttgtagtatttgacacctctaa

SEQ ID NO: 773843 - DNA, 22 bp, Artificial Sequence
  chemically synthesized
tgtagtatttgacacctctaaa

SEQ ID NO: 773844 - DNA, 22 bp, Artificial Sequence
  chemically synthesized
gtagtatttgacacctctaaat

SEQ ID NO: 773845 - DNA, 22 bp, Artificial Sequence
  chemically synthesized
tagtatttgacacctctaaatg

SEQ ID NO: 773846 - DNA, 22 bp, Artificial Sequence
  chemically synthesized
aagaaaaagtaacatttagagg

SEQ ID NO: 773847 - DNA, 22 bp, Artificial Sequence
  chemically synthesized
caagaaaaagtaacatttagag

SEQ ID NO: 773848 - DNA, 22 bp, Artificial Sequence
  chemically synthesized
tcaagaaaaagtaacatttaga

SEQ ID NO: 773849 - DNA, 22 bp, Artificial Sequence
  chemically synthesized
gacacctctaaatgttactttt

SEQ ID NO: 773850 - DNA, 22 bp, Artificial Sequence
  chemically synthesized
acacctctaaatgttacttttt

SEQ ID NO: 773851 - DNA, 22 bp, Artificial Sequence
  chemically synthesized
taaatgttactttttcttgaaa

SEQ ID NO: 773852 - DNA, 22 bp, Artificial Sequence
  chemically synthesized
aatgttactttttcttgaaaac

SEQ ID NO: 773853 - DNA, 22 bp, Artificial Sequence
  chemically synthesized
ctttttcttgaaaacctctctt

SEQ ID NO: 773854 - DNA, 22 bp, Artificial Sequence
  chemically synthesized
tttcttgaaaacctctcttccc

SEQ ID NO: 773855 - DNA, 22 bp, Artificial Sequence
  chemically synthesized
ttcttgaaaacctctcttccct

SEQ ID NO: 773856 - DNA, 22 bp, Artificial Sequence
  chemically synthesized
tcttgaaaacctctcttccctt

SEQ ID NO: 773857 - DNA, 22 bp, Artificial Sequence
  chemically synthesized
cttgaaaacctctcttcccttg

SEQ ID NO: 773858 - DNA, 22 bp, Artificial Sequence
  chemically synthesized
ttgaaaacctctcttcccttgg

SEQ ID NO: 773859 - DNA, 22 bp, Artificial Sequence
  chemically synthesized
gaaaacctctcttcccttggat

SEQ ID NO: 773860 - DNA, 22 bp, Artificial Sequence
  chemically synthesized
aaaacctctcttcccttggatt

SEQ ID NO: 773861 - DNA, 22 bp, Artificial Sequence
  chemically synthesized
gtgtgatgtcacagaatccaag

SEQ ID NO: 773862 - DNA, 22 bp, Artificial Sequence
  chemically synthesized
ggttcgtgtgatgtcacagaat

SEQ ID NO: 773863 - DNA, 22 bp, Artificial Sequence
  chemically synthesized
tcttcccttggattctgtgaca

SEQ ID NO: 773864 - DNA, 22 bp, Artificial Sequence
  chemically synthesized
ttcccttggattctgtgacatc

SEQ ID NO: 773865 - DNA, 22 bp, Artificial Sequence
  chemically synthesized
cccttggattctgtgacatcac

SEQ ID NO: 773866 - DNA, 22 bp, Artificial Sequence
  chemically synthesized
ccttggattctgtgacatcaca

SEQ ID NO: 773867 - DNA, 22 bp, Artificial Sequence
  chemically synthesized
ggattctgtgacatcacacgaa

SEQ ID NO: 773868 - DNA, 22 bp, Artificial Sequence
  chemically synthesized
gattctgtgacatcacacgaac

SEQ ID NO: 773869 - DNA, 22 bp, Artificial Sequence
  chemically synthesized
tgtgacatcacacgaacctagt

SEQ ID NO: 773870 - DNA, 22 bp, Artificial Sequence
  chemically synthesized
tgacatcacacgaacctagtct

SEQ ID NO: 773871 - DNA, 22 bp, Artificial Sequence
  chemically synthesized
agtagataggagacagactagg

SEQ ID NO: 773872 - DNA, 22 bp, Artificial Sequence
  chemically synthesized
cagttcagtagataggagacag

SEQ ID NO: 773873 - DNA, 22 bp, Artificial Sequence
  chemically synthesized
gcagttcagtagataggagaca

SEQ ID NO: 773874 - DNA, 22 bp, Artificial Sequence
  chemically synthesized
gtctgtctcctatctactgaac

SEQ ID NO: 773875 - DNA, 22 bp, Artificial Sequence
  chemically synthesized
tctcctatctactgaactgcaa

SEQ ID NO: 773876 - DNA, 22 bp, Artificial Sequence
  chemically synthesized
ctatctactgaactgcaaattt

SEQ ID NO: 773877 - DNA, 22 bp, Artificial Sequence
  chemically synthesized
agtggagacagggaaatttgca

SEQ ID NO: 773878 - DNA, 22 bp, Artificial Sequence
  chemically synthesized
cagtggagacagggaaatttgc

SEQ ID NO: 773879 - DNA, 22 bp, Artificial Sequence
  chemically synthesized
tctactgaactgcaaatttccc

SEQ ID NO: 773880 - DNA, 22 bp, Artificial Sequence
  chemically synthesized
tcagtggagacagggaaatttg

SEQ ID NO: 773881 - DNA, 22 bp, Artificial Sequence
  chemically synthesized
ctgaactgcaaatttccctgtc

SEQ ID NO: 773882 - DNA, 22 bp, Artificial Sequence
  chemically synthesized
aactgcaaatttccctgtctcc

SEQ ID NO: 773883 - DNA, 22 bp, Artificial Sequence
  chemically synthesized
caaatttccctgtctccactga

SEQ ID NO: 773884 - DNA, 22 bp, Artificial Sequence
  chemically synthesized
ccctgtctccactgaaagctta

SEQ ID NO: 773885 - DNA, 22 bp, Artificial Sequence
  chemically synthesized
cctgtctccactgaaagcttat

SEQ ID NO: 773886 - DNA, 22 bp, Artificial Sequence
  chemically synthesized
tctccactgaaagcttattttt

SEQ ID NO: 773887 - DNA, 22 bp, Artificial Sequence
  chemically synthesized
aggggtaaataaagaaaaataa

SEQ ID NO: 773888 - DNA, 22 bp, Artificial Sequence
  chemically synthesized
caggggtaaataaagaaaaata

SEQ ID NO: 773889 - DNA, 22 bp, Artificial Sequence
  chemically synthesized
cactgaaagcttatttttcttt

SEQ ID NO: 773890 - DNA, 22 bp, Artificial Sequence
  chemically synthesized
aaagcttatttttctttattta

SEQ ID NO: 773891 - DNA, 22 bp, Artificial Sequence
  chemically synthesized
atttttctttatttacccctga

SEQ ID NO: 773892 - DNA, 22 bp, Artificial Sequence
  chemically synthesized
tttttctttatttacccctgaa

SEQ ID NO: 773893 - DNA, 22 bp, Artificial Sequence
  chemically synthesized
ttctttatttacccctgaaact

SEQ ID NO: 773894 - DNA, 22 bp, Artificial Sequence
  chemically synthesized
tctttatttacccctgaaactt

SEQ ID NO: 773895 - DNA, 22 bp, Artificial Sequence
  chemically synthesized
ctttatttacccctgaaacttt

SEQ ID NO: 773896 - DNA, 22 bp, Artificial Sequence
  chemically synthesized
tttatttacccctgaaactttg

SEQ ID NO: 773897 - DNA, 22 bp, Artificial Sequence
  chemically synthesized
tatttacccctgaaactttgcc

SEQ ID NO: 773898 - DNA, 22 bp, Artificial Sequence
  chemically synthesized
atttacccctgaaactttgcca

SEQ ID NO: 773899 - DNA, 22 bp, Artificial Sequence
  chemically synthesized
tttacccctgaaactttgccat

SEQ ID NO: 773900 - DNA, 22 bp, Artificial Sequence
  chemically synthesized
acccctgaaactttgccatttt

SEQ ID NO: 773901 - DNA, 22 bp, Artificial Sequence
  chemically synthesized
cccctgaaactttgccattttc

SEQ ID NO: 773902 - DNA, 22 bp, Artificial Sequence
  chemically synthesized
ggagtgaacccaggaaaatggc

SEQ ID NO: 773903 - DNA, 22 bp, Artificial Sequence
  chemically synthesized
aaactttgccattttcctgggt

SEQ ID NO: 773904 - DNA, 22 bp, Artificial Sequence
  chemically synthesized
tgccattttcctgggttcactc

SEQ ID NO: 773905 - DNA, 22 bp, Artificial Sequence
  chemically synthesized
gccattttcctgggttcactcc

SEQ ID NO: 773906 - DNA, 22 bp, Artificial Sequence
  chemically synthesized
ccattttcctgggttcactcct

SEQ ID NO: 773907 - DNA, 22 bp, Artificial Sequence
  chemically synthesized
tcctgggttcactcctaggccc

SEQ ID NO: 773908 - DNA, 22 bp, Artificial Sequence
  chemically synthesized
cctgggttcactcctaggccct

SEQ ID NO: 773909 - DNA, 22 bp, Artificial Sequence
  chemically synthesized
gtagatgagaagagggcctagg

SEQ ID NO: 773910 - DNA, 22 bp, Artificial Sequence
  chemically synthesized
ctgggttcactcctaggccctc

SEQ ID NO: 773911 - DNA, 22 bp, Artificial Sequence
  chemically synthesized
ggttcactcctaggccctcttc

SEQ ID NO: 773912 - DNA, 22 bp, Artificial Sequence
  chemically synthesized
actcctaggccctcttctcatc

SEQ ID NO: 773913 - DNA, 22 bp, Artificial Sequence
  chemically synthesized
agagtaaagttcgtagatgaga

SEQ ID NO: 773914 - DNA, 22 bp, Artificial Sequence
  chemically synthesized
ctaggccctcttctcatctacg

SEQ ID NO: 773915 - DNA, 22 bp, Artificial Sequence
  chemically synthesized
ggccctcttctcatctacgaac

SEQ ID NO: 773916 - DNA, 22 bp, Artificial Sequence
  chemically synthesized
aaatggttcagagtaaagttcg

SEQ ID NO: 773917 - DNA, 22 bp, Artificial Sequence
  chemically synthesized
gaaatggttcagagtaaagttc

SEQ ID NO: 773918 - DNA, 22 bp, Artificial Sequence
  chemically synthesized
ttctcatctacgaactttactc

SEQ ID NO: 773919 - DNA, 22 bp, Artificial Sequence
  chemically synthesized
ctcatctacgaactttactctg

SEQ ID NO: 773920 - DNA, 22 bp, Artificial Sequence
  chemically synthesized
tcatctacgaactttactctga

SEQ ID NO: 773921 - DNA, 22 bp, Artificial Sequence
  chemically synthesized
atctacgaactttactctgaac

SEQ ID NO: 773922 - DNA, 22 bp, Artificial Sequence
  chemically synthesized
caagggtttgaaatggttcaga

SEQ ID NO: 773923 - DNA, 22 bp, Artificial Sequence
  chemically synthesized
gcaagggtttgaaatggttcag

SEQ ID NO: 773924 - DNA, 22 bp, Artificial Sequence
  chemically synthesized
cgaactttactctgaaccattt

SEQ ID NO: 773925 - DNA, 22 bp, Artificial Sequence
  chemically synthesized
aaaccttgcaagggtttgaaat

SEQ ID NO: 773926 - DNA, 22 bp, Artificial Sequence
  chemically synthesized
tactctgaaccatttcaaaccc

SEQ ID NO: 773927 - DNA, 22 bp, Artificial Sequence
  chemically synthesized
actctgaaccatttcaaaccct

SEQ ID NO: 773928 - DNA, 22 bp, Artificial Sequence
  chemically synthesized
ctctgaaccatttcaaaccctt

SEQ ID NO: 773929 - DNA, 22 bp, Artificial Sequence
  chemically synthesized
tgaaccatttcaaacccttgca

SEQ ID NO: 773930 - DNA, 22 bp, Artificial Sequence
  chemically synthesized
aaccatttcaaacccttgcaag

SEQ ID NO: 773931 - DNA, 22 bp, Artificial Sequence
  chemically synthesized
caaacccttgcaaggttttaat

SEQ ID NO: 773932 - DNA, 22 bp, Artificial Sequence
  chemically synthesized
aaacccttgcaaggttttaatt

SEQ ID NO: 773933 - DNA, 22 bp, Artificial Sequence
  chemically synthesized
tcagtatatacgtaattaaaac

SEQ ID NO: 773934 - DNA, 22 bp, Artificial Sequence
  chemically synthesized
attatcagtatatacgtaatta

SEQ ID NO: 773935 - DNA, 22 bp, Artificial Sequence
  chemically synthesized
aattatcagtatatacgtaatt

SEQ ID NO: 773936 - DNA, 22 bp, Artificial Sequence
  chemically synthesized
gcaaggttttaattacgtatat

SEQ ID NO: 773937 - DNA, 22 bp, Artificial Sequence
  chemically synthesized
caaggttttaattacgtatata

SEQ ID NO: 773938 - DNA, 22 bp, Artificial Sequence
  chemically synthesized
gatatttaattatcagtatata

SEQ ID NO: 773939 - DNA, 22 bp, Artificial Sequence
  chemically synthesized
taattacgtatatactgataat

SEQ ID NO: 773940 - DNA, 22 bp, Artificial Sequence
  chemically synthesized
attggatatttaattatcagta

SEQ ID NO: 773941 - DNA, 22 bp, Artificial Sequence
  chemically synthesized
aattacgtatatactgataatt

SEQ ID NO: 773942 - DNA, 22 bp, Artificial Sequence
  chemically synthesized
aattggatatttaattatcagt

SEQ ID NO: 773943 - DNA, 22 bp, Artificial Sequence
  chemically synthesized
attacgtatatactgataatta

SEQ ID NO: 773944 - DNA, 22 bp, Artificial Sequence
  chemically synthesized
taattggatatttaattatcag

SEQ ID NO: 773945 - DNA, 22 bp, Artificial Sequence
  chemically synthesized
cgtatatactgataattaaata

SEQ ID NO: 773946 - DNA, 22 bp, Artificial Sequence
  chemically synthesized
gagaatctttaattggatattt

SEQ ID NO: 773947 - DNA, 22 bp, Artificial Sequence
  chemically synthesized
ggctagagaatctttaattgga

SEQ ID NO: 773948 - DNA, 22 bp, Artificial Sequence
  chemically synthesized
ataattaaatatccaattaaag

SEQ ID NO: 773949 - DNA, 22 bp, Artificial Sequence
  chemically synthesized
taggctagagaatctttaattg

SEQ ID NO: 773950 - DNA, 22 bp, Artificial Sequence
  chemically synthesized
aatatccaattaaagattctct

SEQ ID NO: 773951 - DNA, 22 bp, Artificial Sequence
  chemically synthesized
tggagaaatgttctaggctaga

SEQ ID NO: 773952 - DNA, 22 bp, Artificial Sequence
  chemically synthesized
aagattctctagcctagaacat

SEQ ID NO: 773953 - DNA, 22 bp, Artificial Sequence
  chemically synthesized
aacctatggagaaatgttctag

SEQ ID NO: 773954 - DNA, 22 bp, Artificial Sequence
  chemically synthesized
tctagcctagaacatttctcca

SEQ ID NO: 773955 - DNA, 22 bp, Artificial Sequence
  chemically synthesized
tagcctagaacatttctccata

SEQ ID NO: 773956 - DNA, 22 bp, Artificial Sequence
  chemically synthesized
gcctagaacatttctccatagg

SEQ ID NO: 773957 - DNA, 22 bp, Artificial Sequence
  chemically synthesized
ggtatgtgagctgaacctatgg

SEQ ID NO: 773958 - DNA, 22 bp, Artificial Sequence
  chemically synthesized
gaacatttctccataggttcag

SEQ ID NO: 773959 - DNA, 22 bp, Artificial Sequence
  chemically synthesized
tgatacctaggtatgtgagctg

SEQ ID NO: 773960 - DNA, 22 bp, Artificial Sequence
  chemically synthesized
ctccataggttcagctcacata

SEQ ID NO: 773961 - DNA, 22 bp, Artificial Sequence
  chemically synthesized
tccataggttcagctcacatac

SEQ ID NO: 773962 - DNA, 22 bp, Artificial Sequence
  chemically synthesized
cataggttcagctcacatacct

SEQ ID NO: 773963 - DNA, 22 bp, Artificial Sequence
  chemically synthesized
agttgtgatacctaggtatgtg

SEQ ID NO: 773964 - DNA, 22 bp, Artificial Sequence
  chemically synthesized
agctcacatacctaggtatcac

SEQ ID NO: 773965 - DNA, 22 bp, Artificial Sequence
  chemically synthesized
acatacctaggtatcacaactt

SEQ ID NO: 773966 - DNA, 22 bp, Artificial Sequence
  chemically synthesized
ggtatcacaacttagttacact

SEQ ID NO: 773967 - DNA, 22 bp, Artificial Sequence
  chemically synthesized
tccaggtgagtaatgatgatag

SEQ ID NO: 773968 - DNA, 22 bp, Artificial Sequence
  chemically synthesized
agttacactatcatcattactc

SEQ ID NO: 773969 - DNA, 22 bp, Artificial Sequence
  chemically synthesized
gttacactatcatcattactca

SEQ ID NO: 773970 - DNA, 22 bp, Artificial Sequence
  chemically synthesized
aaattgtccaggtgagtaatga

SEQ ID NO: 773971 - DNA, 22 bp, Artificial Sequence
  chemically synthesized
ttgaaattgtccaggtgagtaa

SEQ ID NO: 773972 - DNA, 22 bp, Artificial Sequence
  chemically synthesized
cactatcatcattactcacctg

SEQ ID NO: 773973 - DNA, 22 bp, Artificial Sequence
  chemically synthesized
tcatcattactcacctggacaa

SEQ ID NO: 773974 - DNA, 22 bp, Artificial Sequence
  chemically synthesized
agcacactattgaaattgtcca

SEQ ID NO: 773975 - DNA, 22 bp, Artificial Sequence
  chemically synthesized
cagcacactattgaaattgtcc

SEQ ID NO: 773976 - DNA, 22 bp, Artificial Sequence
  chemically synthesized
ctcacctggacaatttcaatag

SEQ ID NO: 773977 - DNA, 22 bp, Artificial Sequence
  chemically synthesized
acctggacaatttcaatagtgt

SEQ ID NO: 773978 - DNA, 22 bp, Artificial Sequence
  chemically synthesized
gacaatttcaatagtgtgctga

SEQ ID NO: 773979 - DNA, 22 bp, Artificial Sequence
  chemically synthesized
gaggcaagaagatagcttcagc

SEQ ID NO: 773980 - DNA, 22 bp, Artificial Sequence
  chemically synthesized
caatagtgtgctgaagctatct

SEQ ID NO: 773981 - DNA, 22 bp, Artificial Sequence
  chemically synthesized
aatagtgtgctgaagctatctt

SEQ ID NO: 773982 - DNA, 22 bp, Artificial Sequence
  chemically synthesized
gcaaactggaggcaagaagata

SEQ ID NO: 773983 - DNA, 22 bp, Artificial Sequence
  chemically synthesized
agcaaactggaggcaagaagat

SEQ ID NO: 773984 - DNA, 22 bp, Artificial Sequence
  chemically synthesized
aagctatcttcttgcctccagt

SEQ ID NO: 773985 - DNA, 22 bp, Artificial Sequence
  chemically synthesized
gaggaagcttagcaaactggag

SEQ ID NO: 773986 - DNA, 22 bp, Artificial Sequence
  chemically synthesized
tcttcttgcctccagtttgcta

SEQ ID NO: 773987 - DNA, 22 bp, Artificial Sequence
  chemically synthesized
cttgcctccagtttgctaagct

SEQ ID NO: 773988 - DNA, 22 bp, Artificial Sequence
  chemically synthesized
ttgcctccagtttgctaagctt

SEQ ID NO: 773989 - DNA, 22 bp, Artificial Sequence
  chemically synthesized
aagggactagaggaagcttagc

SEQ ID NO: 773990 - DNA, 22 bp, Artificial Sequence
  chemically synthesized
gcctccagtttgctaagcttcc

SEQ ID NO: 773991 - DNA, 22 bp, Artificial Sequence
  chemically synthesized
caagggactagaggaagcttag

SEQ ID NO: 773992 - DNA, 22 bp, Artificial Sequence
  chemically synthesized
cctccagtttgctaagcttcct

SEQ ID NO: 773993 - DNA, 22 bp, Artificial Sequence
  chemically synthesized
tttcaagggactagaggaagct

SEQ ID NO: 773994 - DNA, 22 bp, Artificial Sequence
  chemically synthesized
cagtttgctaagcttcctctag

SEQ ID NO: 773995 - DNA, 22 bp, Artificial Sequence
  chemically synthesized
gctaagcttcctctagtccctt

SEQ ID NO: 773996 - DNA, 22 bp, Artificial Sequence
  chemically synthesized
ctaagcttcctctagtcccttg

SEQ ID NO: 773997 - DNA, 22 bp, Artificial Sequence
  chemically synthesized
agcttcctctagtcccttgaaa

SEQ ID NO: 773998 - DNA, 22 bp, Artificial Sequence
  chemically synthesized
cctctagtcccttgaaataaca

SEQ ID NO: 773999 - DNA, 22 bp, Artificial Sequence
  chemically synthesized
ctctagtcccttgaaataacat

SEQ ID NO: 774000 - DNA, 22 bp, Artificial Sequence
  chemically synthesized
tagtcccttgaaataacatgac

SEQ ID NO: 774001 - DNA, 22 bp, Artificial Sequence
  chemically synthesized
gtcccttgaaataacatgacat

SEQ ID NO: 774002 - DNA, 22 bp, Artificial Sequence
  chemically synthesized
gaagtgagaaagtcatgtcatg

SEQ ID NO: 774003 - DNA, 22 bp, Artificial Sequence
  chemically synthesized
gaaataacatgacatgactttc

SEQ ID NO: 774004 - DNA, 22 bp, Artificial Sequence
  chemically synthesized
aaataacatgacatgactttct

SEQ ID NO: 774005 - DNA, 22 bp, Artificial Sequence
  chemically synthesized
tgcataaaggcctggaagtgag

SEQ ID NO: 774006 - DNA, 22 bp, Artificial Sequence
  chemically synthesized
tctcacttccaggcctttatgc

SEQ ID NO: 774007 - DNA, 22 bp, Artificial Sequence
  chemically synthesized
ctcacttccaggcctttatgca

SEQ ID NO: 774008 - DNA, 22 bp, Artificial Sequence
  chemically synthesized
tcacttccaggcctttatgcat

SEQ ID NO: 774009 - DNA, 22 bp, Artificial Sequence
  chemically synthesized
acttccaggcctttatgcatag

SEQ ID NO: 774010 - DNA, 22 bp, Artificial Sequence
  chemically synthesized
ccaggcctttatgcatagtatt

SEQ ID NO: 774011 - DNA, 22 bp, Artificial Sequence
  chemically synthesized
caggcctttatgcatagtattc

SEQ ID NO: 774012 - DNA, 22 bp, Artificial Sequence
  chemically synthesized
tatgcatagtattccatctgct

SEQ ID NO: 774013 - DNA, 22 bp, Artificial Sequence
  chemically synthesized
atgcatagtattccatctgctg

SEQ ID NO: 774014 - DNA, 22 bp, Artificial Sequence
  chemically synthesized
tgcatagtattccatctgctgg

SEQ ID NO: 774015 - DNA, 22 bp, Artificial Sequence
  chemically synthesized
gaggaggtggagtcccagcaga

SEQ ID NO: 774016 - DNA, 22 bp, Artificial Sequence
  chemically synthesized
ggaggaggtggagtcccagcag

SEQ ID NO: 774017 - DNA, 22 bp, Artificial Sequence
  chemically synthesized
gggatttggaggaggtggagtc

SEQ ID NO: 774018 - DNA, 22 bp, Artificial Sequence
  chemically synthesized
catctgctgggactccacctcc

SEQ ID NO: 774019 - DNA, 22 bp, Artificial Sequence
  chemically synthesized
ctgggactccacctcctccaaa

SEQ ID NO: 774020 - DNA, 22 bp, Artificial Sequence
  chemically synthesized
ggactccacctcctccaaatcc

SEQ ID NO: 774021 - DNA, 22 bp, Artificial Sequence
  chemically synthesized
gacaggtcaagttggggatttg

SEQ ID NO: 774022 - DNA, 22 bp, Artificial Sequence
  chemically synthesized
cacctcctccaaatccccaact

SEQ ID NO: 774023 - DNA, 22 bp, Artificial Sequence
  chemically synthesized
ctccaaatccccaacttgacct

SEQ ID NO: 774024 - DNA, 22 bp, Artificial Sequence
  chemically synthesized
caaatccccaacttgacctgtc

SEQ ID NO: 774025 - DNA, 22 bp, Artificial Sequence
  chemically synthesized
aagagaagcaggagttagacag

SEQ ID NO: 774026 - DNA, 22 bp, Artificial Sequence
  chemically synthesized
agacctgaagagaagcaggagt

SEQ ID NO: 774027 - DNA, 22 bp, Artificial Sequence
  chemically synthesized
gacctgtctaactcctgcttct

SEQ ID NO: 774028 - DNA, 22 bp, Artificial Sequence
  chemically synthesized
acctgtctaactcctgcttctc

SEQ ID NO: 774029 - DNA, 22 bp, Artificial Sequence
  chemically synthesized
agctgagacctgaagagaagca

SEQ ID NO: 774030 - DNA, 22 bp, Artificial Sequence
  chemically synthesized
tctaactcctgcttctcttcag

SEQ ID NO: 774031 - DNA, 22 bp, Artificial Sequence
  chemically synthesized
cctcagctgagacctgaagaga

SEQ ID NO: 774032 - DNA, 22 bp, Artificial Sequence
  chemically synthesized
acctcagctgagacctgaagag

SEQ ID NO: 774033 - DNA, 22 bp, Artificial Sequence
  chemically synthesized
actcctgcttctcttcaggtct

SEQ ID NO: 774034 - DNA, 22 bp, Artificial Sequence
  chemically synthesized
ctgcttctcttcaggtctcagc

SEQ ID NO: 774035 - DNA, 22 bp, Artificial Sequence
  chemically synthesized
cttctcttcaggtctcagctga

SEQ ID NO: 774036 - DNA, 22 bp, Artificial Sequence
  chemically synthesized
ctcttcaggtctcagctgaggt

SEQ ID NO: 774037 - DNA, 22 bp, Artificial Sequence
  chemically synthesized
tcttcaggtctcagctgaggta

SEQ ID NO: 774038 - DNA, 22 bp, Artificial Sequence
  chemically synthesized
ccaaggaagccttacctcagct

SEQ ID NO: 774039 - DNA, 22 bp, Artificial Sequence
  chemically synthesized
cccaaggaagccttacctcagc

SEQ ID NO: 774040 - DNA, 22 bp, Artificial Sequence
  chemically synthesized
ttcaggtctcagctgaggtaag

SEQ ID NO: 774041 - DNA, 22 bp, Artificial Sequence
  chemically synthesized
tcccaaggaagccttacctcag

SEQ ID NO: 774042 - DNA, 22 bp, Artificial Sequence
  chemically synthesized
caggtctcagctgaggtaaggc

SEQ ID NO: 774043 - DNA, 22 bp, Artificial Sequence
  chemically synthesized
aggtctcagctgaggtaaggct

SEQ ID NO: 774044 - DNA, 22 bp, Artificial Sequence
  chemically synthesized
agctgaggtaaggcttccttgg

SEQ ID NO: 774045 - DNA, 22 bp, Artificial Sequence
  chemically synthesized
aggtaaggcttccttgggaaag

SEQ ID NO: 774046 - DNA, 22 bp, Artificial Sequence
  chemically synthesized
gcaggatgcagaaggctttccc

SEQ ID NO: 774047 - DNA, 22 bp, Artificial Sequence
  chemically synthesized
ggcaggatgcagaaggctttcc

SEQ ID NO: 774048 - DNA, 22 bp, Artificial Sequence
  chemically synthesized
gcttggcaggatgcagaaggct

SEQ ID NO: 774049 - DNA, 22 bp, Artificial Sequence
  chemically synthesized
ccttgggaaagccttctgcatc

SEQ ID NO: 774050 - DNA, 22 bp, Artificial Sequence
  chemically synthesized
cttgggaaagccttctgcatcc

SEQ ID NO: 774051 - DNA, 22 bp, Artificial Sequence
  chemically synthesized
accctggcttggcaggatgcag

SEQ ID NO: 774052 - DNA, 22 bp, Artificial Sequence
  chemically synthesized
gggaaagccttctgcatcctgc

SEQ ID NO: 774053 - DNA, 22 bp, Artificial Sequence
  chemically synthesized
ggaaagccttctgcatcctgcc

SEQ ID NO: 774054 - DNA, 22 bp, Artificial Sequence
  chemically synthesized
ctgcatcctgccaagccagggt

SEQ ID NO: 774055 - DNA, 22 bp, Artificial Sequence
  chemically synthesized
tgcatcctgccaagccagggtc

SEQ ID NO: 774056 - DNA, 22 bp, Artificial Sequence
  chemically synthesized
catcctgccaagccagggtcaa

SEQ ID NO: 774057 - DNA, 22 bp, Artificial Sequence
  chemically synthesized
ccaagccagggtcaattacctt

SEQ ID NO: 774058 - DNA, 22 bp, Artificial Sequence
  chemically synthesized
cgggtgtacatcaaggtaattg

SEQ ID NO: 774059 - DNA, 22 bp, Artificial Sequence
  chemically synthesized
tgatagtgctacgggtgtacat

SEQ ID NO: 774060 - DNA, 22 bp, Artificial Sequence
  chemically synthesized
ctatgatagtgctacgggtgta

SEQ ID NO: 774061 - DNA, 22 bp, Artificial Sequence
  chemically synthesized
ccttgatgtacacccgtagcac

SEQ ID NO: 774062 - DNA, 22 bp, Artificial Sequence
  chemically synthesized
gatgtacacccgtagcactatc

SEQ ID NO: 774063 - DNA, 22 bp, Artificial Sequence
  chemically synthesized
atgtacacccgtagcactatca

SEQ ID NO: 774064 - DNA, 22 bp, Artificial Sequence
  chemically synthesized
tagatggtaagggtattactat

SEQ ID NO: 774065 - DNA, 22 bp, Artificial Sequence
  chemically synthesized
aacctatagatggtaagggtat

SEQ ID NO: 774066 - DNA, 22 bp, Artificial Sequence
  chemically synthesized
tcatagtaatacccttaccatc

SEQ ID NO: 774067 - DNA, 22 bp, Artificial Sequence
  chemically synthesized
gatatgagatattcaacctata

SEQ ID NO: 774068 - DNA, 22 bp, Artificial Sequence
  chemically synthesized
ggatatgagatattcaacctat

SEQ ID NO: 774069 - DNA, 22 bp, Artificial Sequence
  chemically synthesized
tggatatgagatattcaaccta

SEQ ID NO: 774070 - DNA, 22 bp, Artificial Sequence
  chemically synthesized
accatctataggttgaatatct

SEQ ID NO: 774071 - DNA, 22 bp, Artificial Sequence
  chemically synthesized
ccatctataggttgaatatctc

SEQ ID NO: 774072 - DNA, 22 bp, Artificial Sequence
  chemically synthesized
taggttgaatatctcatatcca

SEQ ID NO: 774073 - DNA, 22 bp, Artificial Sequence
  chemically synthesized
agtcgcaagtattttggatatg

SEQ ID NO: 774074 - DNA, 22 bp, Artificial Sequence
  chemically synthesized
cagtcgcaagtattttggatat

SEQ ID NO: 774075 - DNA, 22 bp, Artificial Sequence
  chemically synthesized
tcagtcgcaagtattttggata

SEQ ID NO: 774076 - DNA, 22 bp, Artificial Sequence
  chemically synthesized
aatatctcatatccaaaatact

SEQ ID NO: 774077 - DNA, 22 bp, Artificial Sequence
  chemically synthesized
aaatactttcagtcgcaagtat

SEQ ID NO: 774078 - DNA, 22 bp, Artificial Sequence
  chemically synthesized
gaaatactttcagtcgcaagta

SEQ ID NO: 774079 - DNA, 22 bp, Artificial Sequence
  chemically synthesized
atatccaaaatacttgcgactg

SEQ ID NO: 774080 - DNA, 22 bp, Artificial Sequence
  chemically synthesized
aaatttgaaatactttcagtcg

SEQ ID NO: 774081 - DNA, 22 bp, Artificial Sequence
  chemically synthesized
caaaacctgaaatttgaaatac

SEQ ID NO: 774082 - DNA, 22 bp, Artificial Sequence
  chemically synthesized
gcgactgaaagtatttcaaatt

SEQ ID NO: 774083 - DNA, 22 bp, Artificial Sequence
  chemically synthesized
cgactgaaagtatttcaaattt

SEQ ID NO: 774084 - DNA, 22 bp, Artificial Sequence
  chemically synthesized
aaagtatttcaaatttcaggtt

SEQ ID NO: 774085 - DNA, 22 bp, Artificial Sequence
  chemically synthesized
caaatttcaggttttggaatat

SEQ ID NO: 774086 - DNA, 22 bp, Artificial Sequence
  chemically synthesized
aaatttcaggttttggaatatt

SEQ ID NO: 774087 - DNA, 22 bp, Artificial Sequence
  chemically synthesized
caggttttggaatatttgcatt

SEQ ID NO: 774088 - DNA, 22 bp, Artificial Sequence
  chemically synthesized
aggttttggaatatttgcatta

SEQ ID NO: 774089 - DNA, 22 bp, Artificial Sequence
  chemically synthesized
catgatatccatagggtaatgc

SEQ ID NO: 774090 - DNA, 22 bp, Artificial Sequence
  chemically synthesized
tggaatatttgcattaccctat

SEQ ID NO: 774091 - DNA, 22 bp, Artificial Sequence
  chemically synthesized
ggaatatttgcattaccctatg

SEQ ID NO: 774092 - DNA, 22 bp, Artificial Sequence
  chemically synthesized
gaatatttgcattaccctatgg

SEQ ID NO: 774093 - DNA, 22 bp, Artificial Sequence
  chemically synthesized
aaggcctgcatgatatccatag

SEQ ID NO: 774094 - DNA, 22 bp, Artificial Sequence
  chemically synthesized
gcattaccctatggatatcatg

SEQ ID NO: 774095 - DNA, 22 bp, Artificial Sequence
  chemically synthesized
cattaccctatggatatcatgc

SEQ ID NO: 774096 - DNA, 22 bp, Artificial Sequence
  chemically synthesized
ccctatggatatcatgcaggcc

SEQ ID NO: 774097 - DNA, 22 bp, Artificial Sequence
  chemically synthesized
aaaatgccctaaaggcctgcat

SEQ ID NO: 774098 - DNA, 22 bp, Artificial Sequence
  chemically synthesized
ttgaaaatgccctaaaggcctg

SEQ ID NO: 774099 - DNA, 22 bp, Artificial Sequence
  chemically synthesized
tggatatcatgcaggcctttag

SEQ ID NO: 774100 - DNA, 22 bp, Artificial Sequence
  chemically synthesized
gtggtgtcaagatattgttgaa

SEQ ID NO: 774101 - DNA, 22 bp, Artificial Sequence
  chemically synthesized
tggtggtgtcaagatattgttg

SEQ ID NO: 774102 - DNA, 22 bp, Artificial Sequence
  chemically synthesized
tagggcattttcaacaatatct

SEQ ID NO: 774103 - DNA, 22 bp, Artificial Sequence
  chemically synthesized
agggcattttcaacaatatctt

SEQ ID NO: 774104 - DNA, 22 bp, Artificial Sequence
  chemically synthesized
tctggtggtgtcaagatattgt

SEQ ID NO: 774105 - DNA, 22 bp, Artificial Sequence
  chemically synthesized
gggcattttcaacaatatcttg

SEQ ID NO: 774106 - DNA, 22 bp, Artificial Sequence
  chemically synthesized
gtatattctctggtggtgtcaa

SEQ ID NO: 774107 - DNA, 22 bp, Artificial Sequence
  chemically synthesized
tcaacaatatcttgacaccacc

SEQ ID NO: 774108 - DNA, 22 bp, Artificial Sequence
  chemically synthesized
caacaatatcttgacaccacca

SEQ ID NO: 774109 - DNA, 22 bp, Artificial Sequence
  chemically synthesized
aacaatatcttgacaccaccag

SEQ ID NO: 774110 - DNA, 22 bp, Artificial Sequence
  chemically synthesized
ctggtatattctctggtggtgt

SEQ ID NO: 774111 - DNA, 22 bp, Artificial Sequence
  chemically synthesized
gctggtatattctctggtggtg

SEQ ID NO: 774112 - DNA, 22 bp, Artificial Sequence
  chemically synthesized
tgtttgctggtatattctctgg

SEQ ID NO: 774113 - DNA, 22 bp, Artificial Sequence
  chemically synthesized
gacaccaccagagaatatacca

SEQ ID NO: 774114 - DNA, 22 bp, Artificial Sequence
  chemically synthesized
acaccaccagagaatataccag

SEQ ID NO: 774115 - DNA, 22 bp, Artificial Sequence
  chemically synthesized
atcactgtgtttgctggtatat

SEQ ID NO: 774116 - DNA, 22 bp, Artificial Sequence
  chemically synthesized
cgtgcattaatcactgtgtttg

SEQ ID NO: 774117 - DNA, 22 bp, Artificial Sequence
  chemically synthesized
atgcacgtaggttttggcccca

SEQ ID NO: 774118 - DNA, 22 bp, Artificial Sequence
  chemically synthesized
caatgtccagcatggggccaaa

SEQ ID NO: 774119 - DNA, 22 bp, Artificial Sequence
  chemically synthesized
tggccccatgctggacattgta

SEQ ID NO: 774120 - DNA, 22 bp, Artificial Sequence
  chemically synthesized
ggccccatgctggacattgtag

SEQ ID NO: 774121 - DNA, 22 bp, Artificial Sequence
  chemically synthesized
gccccatgctggacattgtagg

SEQ ID NO: 774122 - DNA, 22 bp, Artificial Sequence
  chemically synthesized
gacgcgacaacggcaggtaccc

SEQ ID NO: 774123 - DNA, 22 bp, Artificial Sequence
  chemically synthesized
gacattgtagggtacctgccgt

SEQ ID NO: 774124 - DNA, 22 bp, Artificial Sequence
  chemically synthesized
tagggtacctgccgttgtcgcg

SEQ ID NO: 774125 - DNA, 22 bp, Artificial Sequence
  chemically synthesized
ccgttgtcgcgtctagcccgca

SEQ ID NO: 774126 - DNA, 22 bp, Artificial Sequence
  chemically synthesized
tcgcgtctagcccgcacatgtg

SEQ ID NO: 774127 - DNA, 22 bp, Artificial Sequence
  chemically synthesized
gcccgcacatgtgccatttttc

SEQ ID NO: 774128 - DNA, 22 bp, Artificial Sequence
  chemically synthesized
catcatacaagcaaacccacaa

SEQ ID NO: 774129 - DNA, 22 bp, Artificial Sequence
  chemically synthesized
ttcgtaccttttgtgggtttgc

SEQ ID NO: 774130 - DNA, 22 bp, Artificial Sequence
  chemically synthesized
tcgtaccttttgtgggtttgct

SEQ ID NO: 774131 - DNA, 22 bp, Artificial Sequence
  chemically synthesized
cgtaccttttgtgggtttgctt

SEQ ID NO: 774132 - DNA, 22 bp, Artificial Sequence
  chemically synthesized
gtaccttttgtgggtttgcttg

SEQ ID NO: 774133 - DNA, 22 bp, Artificial Sequence
  chemically synthesized
ttgtgggtttgcttgtatgatg

SEQ ID NO: 774134 - DNA, 22 bp, Artificial Sequence
  chemically synthesized
tgtgggtttgcttgtatgatgg

SEQ ID NO: 774135 - DNA, 22 bp, Artificial Sequence
  chemically synthesized
gtgggtttgcttgtatgatgga

SEQ ID NO: 774136 - DNA, 22 bp, Artificial Sequence
  chemically synthesized
tgggtttgcttgtatgatggaa

SEQ ID NO: 774137 - DNA, 22 bp, Artificial Sequence
  chemically synthesized
cacccacacccagattccatca

SEQ ID NO: 774138 - DNA, 22 bp, Artificial Sequence
  chemically synthesized
ccacccacacccagattccatc

SEQ ID NO: 774139 - DNA, 22 bp, Artificial Sequence
  chemically synthesized
tccacccacacccagattccat

SEQ ID NO: 774140 - DNA, 22 bp, Artificial Sequence
  chemically synthesized
ttccacccacacccagattcca

SEQ ID NO: 774141 - DNA, 22 bp, Artificial Sequence
  chemically synthesized
gcttgtatgatggaatctgggt

SEQ ID NO: 774142 - DNA, 22 bp, Artificial Sequence
  chemically synthesized
cttgtatgatggaatctgggtg

SEQ ID NO: 774143 - DNA, 22 bp, Artificial Sequence
  chemically synthesized
gtatgatggaatctgggtgtgg

SEQ ID NO: 774144 - DNA, 22 bp, Artificial Sequence
  chemically synthesized
tatgatggaatctgggtgtggg

SEQ ID NO: 774145 - DNA, 22 bp, Artificial Sequence
  chemically synthesized
tgatatatcttttccacccaca

SEQ ID NO: 774146 - DNA, 22 bp, Artificial Sequence
  chemically synthesized
gctgtgatatatcttttccacc

SEQ ID NO: 774147 - DNA, 22 bp, Artificial Sequence
  chemically synthesized
ggtgtgggtggaaaagatatat

SEQ ID NO: 774148 - DNA, 22 bp, Artificial Sequence
  chemically synthesized
agcccccgttagctgtgatata

SEQ ID NO: 774149 - DNA, 22 bp, Artificial Sequence
  chemically synthesized
tcagcccccgttagctgtgata

SEQ ID NO: 774150 - DNA, 22 bp, Artificial Sequence
  chemically synthesized
acgggggctgagaggatctttc

SEQ ID NO: 774151 - DNA, 22 bp, Artificial Sequence
  chemically synthesized
agcatccccaagggaagaaaga

SEQ ID NO: 774152 - DNA, 22 bp, Artificial Sequence
  chemically synthesized
ttcagcatccccaagggaagaa

SEQ ID NO: 774153 - DNA, 22 bp, Artificial Sequence
  chemically synthesized
attcagcatccccaagggaaga

SEQ ID NO: 774154 - DNA, 22 bp, Artificial Sequence
  chemically synthesized
agaggatctttcttcccttggg

SEQ ID NO: 774155 - DNA, 22 bp, Artificial Sequence
  chemically synthesized
tcttcccttggggatgctgaat

SEQ ID NO: 774156 - DNA, 22 bp, Artificial Sequence
  chemically synthesized
cttcccttggggatgctgaata

SEQ ID NO: 774157 - DNA, 22 bp, Artificial Sequence
  chemically synthesized
ttcccttggggatgctgaataa

SEQ ID NO: 774158 - DNA, 22 bp, Artificial Sequence
  chemically synthesized
cccttggggatgctgaataaac

SEQ ID NO: 774159 - DNA, 22 bp, Artificial Sequence
  chemically synthesized
ccttggggatgctgaataaact

SEQ ID NO: 774160 - DNA, 22 bp, Artificial Sequence
  chemically synthesized
ggggatgctgaataaactctat

SEQ ID NO: 774161 - DNA, 22 bp, Artificial Sequence
  chemically synthesized
gggatgctgaataaactctatg

SEQ ID NO: 774162 - DNA, 22 bp, Artificial Sequence
  chemically synthesized
aataaactctatgtggtgtgcc

SEQ ID NO: 774163 - DNA, 22 bp, Artificial Sequence
  chemically synthesized
tatgtggtgtgcctgcattttc

SEQ ID NO: 774164 - DNA, 22 bp, Artificial Sequence
  chemically synthesized
tgtggtgtgcctgcattttcac

SEQ ID NO: 774165 - DNA, 22 bp, Artificial Sequence
  chemically synthesized
atgtgacaagtcacagtgaaaa

SEQ ID NO: 774166 - DNA, 22 bp, Artificial Sequence
  chemically synthesized
acctcatgtgacaagtcacagt

SEQ ID NO: 774167 - DNA, 22 bp, Artificial Sequence
  chemically synthesized
tgacctcatgtgacaagtcaca

SEQ ID NO: 774168 - DNA, 22 bp, Artificial Sequence
  chemically synthesized
ctgacctcatgtgacaagtcac

SEQ ID NO: 774169 - DNA, 22 bp, Artificial Sequence
  chemically synthesized
cattttcactgtgacttgtcac

SEQ ID NO: 774170 - DNA, 22 bp, Artificial Sequence
  chemically synthesized
cacttctgacctcatgtgacaa

SEQ ID NO: 774171 - DNA, 22 bp, Artificial Sequence
  chemically synthesized
tcactgtgacttgtcacatgag

SEQ ID NO: 774172 - DNA, 22 bp, Artificial Sequence
  chemically synthesized
cactgtgacttgtcacatgagg

SEQ ID NO: 774173 - DNA, 22 bp, Artificial Sequence
  chemically synthesized
actgtgacttgtcacatgaggt

SEQ ID NO: 774174 - DNA, 22 bp, Artificial Sequence
  chemically synthesized
tgacttgtcacatgaggtcaga

SEQ ID NO: 774175 - DNA, 22 bp, Artificial Sequence
  chemically synthesized
gtcacatgaggtcagaagtgga

SEQ ID NO: 774176 - DNA, 22 bp, Artificial Sequence
  chemically synthesized
tcacatgaggtcagaagtggag

SEQ ID NO: 774177 - DNA, 22 bp, Artificial Sequence
  chemically synthesized
acatgacatcacaaatggaaaa

SEQ ID NO: 774178 - DNA, 22 bp, Artificial Sequence
  chemically synthesized
aatgctgacatgacatcacaaa

SEQ ID NO: 774179 - DNA, 22 bp, Artificial Sequence
  chemically synthesized
gaatgctgacatgacatcacaa

SEQ ID NO: 774180 - DNA, 22 bp, Artificial Sequence
  chemically synthesized
tttgaatgctgacatgacatca

SEQ ID NO: 774181 - DNA, 22 bp, Artificial Sequence
  chemically synthesized
tccatttgtgatgtcatgtcag

SEQ ID NO: 774182 - DNA, 22 bp, Artificial Sequence
  chemically synthesized
ccatttgtgatgtcatgtcagc

SEQ ID NO: 774183 - DNA, 22 bp, Artificial Sequence
  chemically synthesized
catttgtgatgtcatgtcagca

SEQ ID NO: 774184 - DNA, 22 bp, Artificial Sequence
  chemically synthesized
caaaactgtttgaatgctgaca

SEQ ID NO: 774185 - DNA, 22 bp, Artificial Sequence
  chemically synthesized
gtgatgtcatgtcagcattcaa

SEQ ID NO: 774186 - DNA, 22 bp, Artificial Sequence
  chemically synthesized
tgatgtcatgtcagcattcaaa

SEQ ID NO: 774187 - DNA, 22 bp, Artificial Sequence
  chemically synthesized
caaattccaaaactgtttgaat

SEQ ID NO: 774188 - DNA, 22 bp, Artificial Sequence
  chemically synthesized
aaatccaaatgttccaaattcc

SEQ ID NO: 774189 - DNA, 22 bp, Artificial Sequence
  chemically synthesized
aaacagttttggaatttggaac

SEQ ID NO: 774190 - DNA, 22 bp, Artificial Sequence
  chemically synthesized
tggaatttggaacatttggatt

SEQ ID NO: 774191 - DNA, 22 bp, Artificial Sequence
  chemically synthesized
ggaatttggaacatttggattt

SEQ ID NO: 774192 - DNA, 22 bp, Artificial Sequence
  chemically synthesized
gaatttggaacatttggatttc

SEQ ID NO: 774193 - DNA, 22 bp, Artificial Sequence
  chemically synthesized
atccaaaaacctgaaatccaaa

SEQ ID NO: 774194 - DNA, 22 bp, Artificial Sequence
  chemically synthesized
ggaacatttggatttcaggttt

SEQ ID NO: 774195 - DNA, 22 bp, Artificial Sequence
  chemically synthesized
gaacatttggatttcaggtttt

SEQ ID NO: 774196 - DNA, 22 bp, Artificial Sequence
  chemically synthesized
aacatccctgatccaaaaacct

SEQ ID NO: 774197 - DNA, 22 bp, Artificial Sequence
  chemically synthesized
ggatttcaggtttttggatcag

SEQ ID NO: 774198 - DNA, 22 bp, Artificial Sequence
  chemically synthesized
gatttcaggtttttggatcagg

SEQ ID NO: 774199 - DNA, 22 bp, Artificial Sequence
  chemically synthesized
caggttgaacatccctgatcca

SEQ ID NO: 774200 - DNA, 22 bp, Artificial Sequence
  chemically synthesized
ctacaggttgaacatccctgat

SEQ ID NO: 774201 - DNA, 22 bp, Artificial Sequence
  chemically synthesized
caggtttttggatcagggatgt

SEQ ID NO: 774202 - DNA, 22 bp, Artificial Sequence
  chemically synthesized
aggtttttggatcagggatgtt

SEQ ID NO: 774203 - DNA, 22 bp, Artificial Sequence
  chemically synthesized
ttggatcagggatgttcaacct

SEQ ID NO: 774204 - DNA, 22 bp, Artificial Sequence
  chemically synthesized
tggatcagggatgttcaacctg

SEQ ID NO: 774205 - DNA, 22 bp, Artificial Sequence
  chemically synthesized
ggatcagggatgttcaacctgt

SEQ ID NO: 774206 - DNA, 22 bp, Artificial Sequence
  chemically synthesized
gatcagggatgttcaacctgta

SEQ ID NO: 774207 - DNA, 22 bp, Artificial Sequence
  chemically synthesized
aacaagtaactactacaggttg

SEQ ID NO: 774208 - DNA, 22 bp, Artificial Sequence
  chemically synthesized
aacctgtagtagttacttgttt

SEQ ID NO: 774209 - DNA, 22 bp, Artificial Sequence
  chemically synthesized
tagtagttacttgtttaatttc

SEQ ID NO: 774210 - DNA, 22 bp, Artificial Sequence
  chemically synthesized
gtgggggaggaaggaaattaaa

SEQ ID NO: 774211 - DNA, 22 bp, Artificial Sequence
  chemically synthesized
agtgggggaggaaggaaattaa

SEQ ID NO: 774212 - DNA, 22 bp, Artificial Sequence
  chemically synthesized
tagtttagtgggggaggaagga

SEQ ID NO: 774213 - DNA, 22 bp, Artificial Sequence
  chemically synthesized
cttgtttaatttccttcctccc

SEQ ID NO: 774214 - DNA, 22 bp, Artificial Sequence
  chemically synthesized
gtttaatttccttcctccccca

SEQ ID NO: 774215 - DNA, 22 bp, Artificial Sequence
  chemically synthesized
tttaatttccttcctcccccac

SEQ ID NO: 774216 - DNA, 22 bp, Artificial Sequence
  chemically synthesized
atctgtagtttagtgggggagg

SEQ ID NO: 774217 - DNA, 22 bp, Artificial Sequence
  chemically synthesized
gatctgtagtttagtgggggag

SEQ ID NO: 774218 - DNA, 22 bp, Artificial Sequence
  chemically synthesized
tgatctgtagtttagtggggga

SEQ ID NO: 774219 - DNA, 22 bp, Artificial Sequence
  chemically synthesized
aatttccttcctcccccactaa

SEQ ID NO: 774220 - DNA, 22 bp, Artificial Sequence
  chemically synthesized
atttccttcctcccccactaaa

SEQ ID NO: 774221 - DNA, 22 bp, Artificial Sequence
  chemically synthesized
tttgatctgtagtttagtgggg

SEQ ID NO: 774222 - DNA, 22 bp, Artificial Sequence
  chemically synthesized
ctttgatctgtagtttagtggg

SEQ ID NO: 774223 - DNA, 22 bp, Artificial Sequence
  chemically synthesized
ccttcctcccccactaaactac

SEQ ID NO: 774224 - DNA, 22 bp, Artificial Sequence
  chemically synthesized
cttcctcccccactaaactaca

SEQ ID NO: 774225 - DNA, 22 bp, Artificial Sequence
  chemically synthesized
tcttctttgatctgtagtttag

SEQ ID NO: 774226 - DNA, 22 bp, Artificial Sequence
  chemically synthesized
tatcttctttgatctgtagttt

SEQ ID NO: 774227 - DNA, 22 bp, Artificial Sequence
  chemically synthesized
cctcccccactaaactacagat

SEQ ID NO: 774228 - DNA, 22 bp, Artificial Sequence
  chemically synthesized
ctcccccactaaactacagatc

SEQ ID NO: 774229 - DNA, 22 bp, Artificial Sequence
  chemically synthesized
ccccactaaactacagatcaaa

SEQ ID NO: 774230 - DNA, 22 bp, Artificial Sequence
  chemically synthesized
atctctatcttctttgatctgt

SEQ ID NO: 774231 - DNA, 22 bp, Artificial Sequence
  chemically synthesized
gatctctatcttctttgatctg

SEQ ID NO: 774232 - DNA, 22 bp, Artificial Sequence
  chemically synthesized
aactacagatcaaagaagatag

SEQ ID NO: 774233 - DNA, 22 bp, Artificial Sequence
  chemically synthesized
cagatcaaagaagatagagatc

SEQ ID NO: 774234 - DNA, 22 bp, Artificial Sequence
  chemically synthesized
gagacacatcaataaataaagg

SEQ ID NO: 774235 - DNA, 22 bp, Artificial Sequence
  chemically synthesized
gacactagagacacatcaataa

SEQ ID NO: 774236 - DNA, 22 bp, Artificial Sequence
  chemically synthesized
tttcctttatttattgatgtgt

SEQ ID NO: 774237 - DNA, 22 bp, Artificial Sequence
  chemically synthesized
cctttatttattgatgtgtctc

SEQ ID NO: 774238 - DNA, 22 bp, Artificial Sequence
  chemically synthesized
ggctagacactagagacacatc

SEQ ID NO: 774239 - DNA, 22 bp, Artificial Sequence
  chemically synthesized
ctttatttattgatgtgtctct

SEQ ID NO: 774240 - DNA, 22 bp, Artificial Sequence
  chemically synthesized
tatttattgatgtgtctctagt

SEQ ID NO: 774241 - DNA, 22 bp, Artificial Sequence
  chemically synthesized
atttattgatgtgtctctagtg

SEQ ID NO: 774242 - DNA, 22 bp, Artificial Sequence
  chemically synthesized
tttattgatgtgtctctagtgt

SEQ ID NO: 774243 - DNA, 22 bp, Artificial Sequence
  chemically synthesized
attgatgtgtctctagtgtcta

SEQ ID NO: 774244 - DNA, 22 bp, Artificial Sequence
  chemically synthesized
caaacattaggctagacactag

SEQ ID NO: 774245 - DNA, 22 bp, Artificial Sequence
  chemically synthesized
ttgatgtgtctctagtgtctag

SEQ ID NO: 774246 - DNA, 22 bp, Artificial Sequence
  chemically synthesized
atgtgtctctagtgtctagcct

SEQ ID NO: 774247 - DNA, 22 bp, Artificial Sequence
  chemically synthesized
atgttccaaacattaggctaga

SEQ ID NO: 774248 - DNA, 22 bp, Artificial Sequence
  chemically synthesized
ttgatgttccaaacattaggct

SEQ ID NO: 774249 - DNA, 22 bp, Artificial Sequence
  chemically synthesized
attgatgttccaaacattaggc

SEQ ID NO: 774250 - DNA, 22 bp, Artificial Sequence
  chemically synthesized
tagtgtctagcctaatgtttgg

SEQ ID NO: 774251 - DNA, 22 bp, Artificial Sequence
  chemically synthesized
gtgtctagcctaatgtttggaa

SEQ ID NO: 774252 - DNA, 22 bp, Artificial Sequence
  chemically synthesized
atgaatatttattgatgttcca

SEQ ID NO: 774253 - DNA, 22 bp, Artificial Sequence
  chemically synthesized
catgaatatttattgatgttcc

SEQ ID NO: 774254 - DNA, 22 bp, Artificial Sequence
  chemically synthesized
gcctaatgtttggaacatcaat

SEQ ID NO: 774255 - DNA, 22 bp, Artificial Sequence
  chemically synthesized
tcatgaatatttattgatgttc

SEQ ID NO: 774256 - DNA, 22 bp, Artificial Sequence
  chemically synthesized
tttcatgaatatttattgatgt

SEQ ID NO: 774257 - DNA, 22 bp, Artificial Sequence
  chemically synthesized
ctttcatgaatatttattgatg

SEQ ID NO: 774258 - DNA, 22 bp, Artificial Sequence
  chemically synthesized
atgtttggaacatcaataaata

SEQ ID NO: 774259 - DNA, 22 bp, Artificial Sequence
  chemically synthesized
tccatttctttcatgaatattt

SEQ ID NO: 774260 - DNA, 22 bp, Artificial Sequence
  chemically synthesized
ggaacatcaataaatattcatg

SEQ ID NO: 774261 - DNA, 22 bp, Artificial Sequence
  chemically synthesized
atccatttctttcatgaatatt

SEQ ID NO: 774262 - DNA, 22 bp, Artificial Sequence
  chemically synthesized
gaacatcaataaatattcatga

SEQ ID NO: 774263 - DNA, 22 bp, Artificial Sequence
  chemically synthesized
tttatccatttctttcatgaat

SEQ ID NO: 774264 - DNA, 22 bp, Artificial Sequence
  chemically synthesized
atgaaagaaatggataaataac

SEQ ID NO: 774265 - DNA, 22 bp, Artificial Sequence
  chemically synthesized
gtgcaagcatacagttatttat

SEQ ID NO: 774266 - DNA, 22 bp, Artificial Sequence
  chemically synthesized
tggtgcaagcatacagttattt

SEQ ID NO: 774267 - DNA, 22 bp, Artificial Sequence
  chemically synthesized
ctggtgcaagcatacagttatt

SEQ ID NO: 774268 - DNA, 22 bp, Artificial Sequence
  chemically synthesized
tgggatatcttctggtgcaagc

SEQ ID NO: 774269 - DNA, 22 bp, Artificial Sequence
  chemically synthesized
ctgtgggatatcttctggtgca

SEQ ID NO: 774270 - DNA, 22 bp, Artificial Sequence
  chemically synthesized
tatgcttgcaccagaagatatc

SEQ ID NO: 774271 - DNA, 22 bp, Artificial Sequence
  chemically synthesized
gaaaagactgctgtgggatatc

SEQ ID NO: 774272 - DNA, 22 bp, Artificial Sequence
  chemically synthesized
gcaccagaagatatcccacagc

SEQ ID NO: 774273 - DNA, 22 bp, Artificial Sequence
  chemically synthesized
caccagaagatatcccacagca

SEQ ID NO: 774274 - DNA, 22 bp, Artificial Sequence
  chemically synthesized
ccaaggattagaaaagactgct

SEQ ID NO: 774275 - DNA, 22 bp, Artificial Sequence
  chemically synthesized
aaattaccaaggattagaaaag

SEQ ID NO: 774276 - DNA, 22 bp, Artificial Sequence
  chemically synthesized
ttctaatccttggtaatttgaa

SEQ ID NO: 774277 - DNA, 22 bp, Artificial Sequence
  chemically synthesized
tctaatccttggtaatttgaat

SEQ ID NO: 774278 - DNA, 22 bp, Artificial Sequence
  chemically synthesized
ctaatccttggtaatttgaatt

SEQ ID NO: 774279 - DNA, 22 bp, Artificial Sequence
  chemically synthesized
taatccttggtaatttgaattt

SEQ ID NO: 774280 - DNA, 22 bp, Artificial Sequence
  chemically synthesized
atccttggtaatttgaattttt

SEQ ID NO: 774281 - DNA, 22 bp, Artificial Sequence
  chemically synthesized
ggtaatttgaattttttgtatt

SEQ ID NO: 774282 - DNA, 22 bp, Artificial Sequence
  chemically synthesized
gtaatttgaattttttgtatta

SEQ ID NO: 774283 - DNA, 22 bp, Artificial Sequence
  chemically synthesized
tatataaatcaataatacaaaa

SEQ ID NO: 774284 - DNA, 22 bp, Artificial Sequence
  chemically synthesized
gtatataaatcaataatacaaa

SEQ ID NO: 774285 - DNA, 22 bp, Artificial Sequence
  chemically synthesized
gaattttttgtattattgattt

SEQ ID NO: 774286 - DNA, 22 bp, Artificial Sequence
  chemically synthesized
gcccttgtatataaatcaataa

SEQ ID NO: 774287 - DNA, 22 bp, Artificial Sequence
  chemically synthesized
aattttttgtattattgattta

SEQ ID NO: 774288 - DNA, 22 bp, Artificial Sequence
  chemically synthesized
tttgtattattgatttatatac

SEQ ID NO: 774289 - DNA, 22 bp, Artificial Sequence
  chemically synthesized
ttgtattattgatttatataca

SEQ ID NO: 774290 - DNA, 22 bp, Artificial Sequence
  chemically synthesized
tgtattattgatttatatacaa

SEQ ID NO: 774291 - DNA, 22 bp, Artificial Sequence
  chemically synthesized
gtattattgatttatatacaag

SEQ ID NO: 774292 - DNA, 22 bp, Artificial Sequence
  chemically synthesized
tattattgatttatatacaagg

SEQ ID NO: 774293 - DNA, 22 bp, Artificial Sequence
  chemically synthesized
gcaggacattagcccttgtata

SEQ ID NO: 774294 - DNA, 22 bp, Artificial Sequence
  chemically synthesized
cgcaggacattagcccttgtat

SEQ ID NO: 774295 - DNA, 22 bp, Artificial Sequence
  chemically synthesized
ttgatttatatacaagggctaa

SEQ ID NO: 774296 - DNA, 22 bp, Artificial Sequence
  chemically synthesized
cttcgcaggacattagcccttg

SEQ ID NO: 774297 - DNA, 22 bp, Artificial Sequence
  chemically synthesized
atttatatacaagggctaatgt

SEQ ID NO: 774298 - DNA, 22 bp, Artificial Sequence
  chemically synthesized
ctacttcgcaggacattagccc

SEQ ID NO: 774299 - DNA, 22 bp, Artificial Sequence
  chemically synthesized
atatacaagggctaatgtcctg

SEQ ID NO: 774300 - DNA, 22 bp, Artificial Sequence
  chemically synthesized
tatacaagggctaatgtcctgc

SEQ ID NO: 774301 - DNA, 22 bp, Artificial Sequence
  chemically synthesized
atgtcctgcgaagtagtagtac

SEQ ID NO: 774302 - DNA, 22 bp, Artificial Sequence
  chemically synthesized
aaaacagaaacatatgtactac

SEQ ID NO: 774303 - DNA, 22 bp, Artificial Sequence
  chemically synthesized
aaaaacagaaacatatgtacta

SEQ ID NO: 774304 - DNA, 22 bp, Artificial Sequence
  chemically synthesized
taaaaacagaaacatatgtact

SEQ ID NO: 774305 - DNA, 22 bp, Artificial Sequence
  chemically synthesized
ttaaaaacagaaacatatgtac

SEQ ID NO: 774306 - DNA, 22 bp, Artificial Sequence
  chemically synthesized
cgaagtagtagtacatatgttt

SEQ ID NO: 774307 - DNA, 22 bp, Artificial Sequence
  chemically synthesized
tgaaacaatgtcttttaaaaac

SEQ ID NO: 774308 - DNA, 22 bp, Artificial Sequence
  chemically synthesized
atgaaacaatgtcttttaaaaa

SEQ ID NO: 774309 - DNA, 22 bp, Artificial Sequence
  chemically synthesized
tatgaaacaatgtcttttaaaa

SEQ ID NO: 774310 - DNA, 22 bp, Artificial Sequence
  chemically synthesized
ctgtttttaaaagacattgttt

SEQ ID NO: 774311 - DNA, 22 bp, Artificial Sequence
  chemically synthesized
tgtttttaaaagacattgtttc

SEQ ID NO: 774312 - DNA, 22 bp, Artificial Sequence
  chemically synthesized
tttttaaaagacattgtttcat

SEQ ID NO: 774313 - DNA, 22 bp, Artificial Sequence
  chemically synthesized
taatagaattttatgaaacaat

SEQ ID NO: 774314 - DNA, 22 bp, Artificial Sequence
  chemically synthesized
ttaaaagacattgtttcataaa

SEQ ID NO: 774315 - DNA, 22 bp, Artificial Sequence
  chemically synthesized
taaaagacattgtttcataaaa

SEQ ID NO: 774316 - DNA, 22 bp, Artificial Sequence
  chemically synthesized
attataatagaattttatgaaa

SEQ ID NO: 774317 - DNA, 22 bp, Artificial Sequence
  chemically synthesized
aaaagacattgtttcataaaat

SEQ ID NO: 774318 - DNA, 22 bp, Artificial Sequence
  chemically synthesized
cattataatagaattttatgaa

SEQ ID NO: 774319 - DNA, 22 bp, Artificial Sequence
  chemically synthesized
aaagacattgtttcataaaatt

SEQ ID NO: 774320 - DNA, 22 bp, Artificial Sequence
  chemically synthesized
tcattataatagaattttatga

SEQ ID NO: 774321 - DNA, 22 bp, Artificial Sequence
  chemically synthesized
ttcattataatagaattttatg

SEQ ID NO: 774322 - DNA, 22 bp, Artificial Sequence
  chemically synthesized
tttcataaaattctattataat

SEQ ID NO: 774323 - DNA, 22 bp, Artificial Sequence
  chemically synthesized
cataaaattctattataatgaa

SEQ ID NO: 774324 - DNA, 22 bp, Artificial Sequence
  chemically synthesized
ataaaattctattataatgaaa

SEQ ID NO: 774325 - DNA, 22 bp, Artificial Sequence
  chemically synthesized
tattataatgaaaagcatgggc

SEQ ID NO: 774326 - DNA, 22 bp, Artificial Sequence
  chemically synthesized
ttataatgaaaagcatgggcta

SEQ ID NO: 774327 - DNA, 22 bp, Artificial Sequence
  chemically synthesized
taatgaaaagcatgggctatta

SEQ ID NO: 774328 - DNA, 22 bp, Artificial Sequence
  chemically synthesized
catgaaggaaaaatgtaatagc

SEQ ID NO: 774329 - DNA, 22 bp, Artificial Sequence
  chemically synthesized
ttacatttttccttcatggaga

SEQ ID NO: 774330 - DNA, 22 bp, Artificial Sequence
  chemically synthesized
catttttccttcatggagatat

SEQ ID NO: 774331 - DNA, 22 bp, Artificial Sequence
  chemically synthesized
cgatatataagaaatatctcca

SEQ ID NO: 774332 - DNA, 22 bp, Artificial Sequence
  chemically synthesized
acgatatataagaaatatctcc

SEQ ID NO: 774333 - DNA, 22 bp, Artificial Sequence
  chemically synthesized
ttccttcatggagatatttctt

SEQ ID NO: 774334 - DNA, 22 bp, Artificial Sequence
  chemically synthesized
tccttcatggagatatttctta

SEQ ID NO: 774335 - DNA, 22 bp, Artificial Sequence
  chemically synthesized
ccttcatggagatatttcttat

SEQ ID NO: 774336 - DNA, 22 bp, Artificial Sequence
  chemically synthesized
gatttacgatatataagaaata

SEQ ID NO: 774337 - DNA, 22 bp, Artificial Sequence
  chemically synthesized
cttcatggagatatttcttata

SEQ ID NO: 774338 - DNA, 22 bp, Artificial Sequence
  chemically synthesized
tagatttacgatatataagaaa

SEQ ID NO: 774339 - DNA, 22 bp, Artificial Sequence
  chemically synthesized
ctagatttacgatatataagaa

SEQ ID NO: 774340 - DNA, 22 bp, Artificial Sequence
  chemically synthesized
catggagatatttcttatatat

SEQ ID NO: 774341 - DNA, 22 bp, Artificial Sequence
  chemically synthesized
atggagatatttcttatatatc

SEQ ID NO: 774342 - DNA, 22 bp, Artificial Sequence
  chemically synthesized
atacacatttctagatttacga

SEQ ID NO: 774343 - DNA, 22 bp, Artificial Sequence
  chemically synthesized
aatacacatttctagatttacg

SEQ ID NO: 774344 - DNA, 22 bp, Artificial Sequence
  chemically synthesized
cttatatatcgtaaatctagaa

SEQ ID NO: 774345 - DNA, 22 bp, Artificial Sequence
  chemically synthesized
ttatatatcgtaaatctagaaa

SEQ ID NO: 774346 - DNA, 22 bp, Artificial Sequence
  chemically synthesized
atttaatacacatttctagatt

SEQ ID NO: 774347 - DNA, 22 bp, Artificial Sequence
  chemically synthesized
atatatcgtaaatctagaaatg

SEQ ID NO: 774348 - DNA, 22 bp, Artificial Sequence
  chemically synthesized
tatatcgtaaatctagaaatgt

SEQ ID NO: 774349 - DNA, 22 bp, Artificial Sequence
  chemically synthesized
gtatgtctaatttaatacacat

SEQ ID NO: 774350 - DNA, 22 bp, Artificial Sequence
  chemically synthesized
tagtatgtctaatttaatacac

SEQ ID NO: 774351 - DNA, 22 bp, Artificial Sequence
  chemically synthesized
ctagtatgtctaatttaataca

SEQ ID NO: 774352 - DNA, 22 bp, Artificial Sequence
  chemically synthesized
acttctagtatgtctaatttaa

SEQ ID NO: 774353 - DNA, 22 bp, Artificial Sequence
  chemically synthesized
gacttctagtatgtctaattta

SEQ ID NO: 774354 - DNA, 22 bp, Artificial Sequence
  chemically synthesized
gaaatgtgtattaaattagaca

SEQ ID NO: 774355 - DNA, 22 bp, Artificial Sequence
  chemically synthesized
tgacttctagtatgtctaattt

SEQ ID NO: 774356 - DNA, 22 bp, Artificial Sequence
  chemically synthesized
tttgacttctagtatgtctaat

SEQ ID NO: 774357 - DNA, 22 bp, Artificial Sequence
  chemically synthesized
agttctttgacttctagtatgt

SEQ ID NO: 774358 - DNA, 22 bp, Artificial Sequence
  chemically synthesized
aattagacatactagaagtcaa

SEQ ID NO: 774359 - DNA, 22 bp, Artificial Sequence
  chemically synthesized
tacctcagttctttgacttcta

SEQ ID NO: 774360 - DNA, 22 bp, Artificial Sequence
  chemically synthesized
gacatactagaagtcaaagaac

SEQ ID NO: 774361 - DNA, 22 bp, Artificial Sequence
  chemically synthesized
aatagctgtacctcagttcttt

SEQ ID NO: 774362 - DNA, 22 bp, Artificial Sequence
  chemically synthesized
taaatagctgtacctcagttct

SEQ ID NO: 774363 - DNA, 22 bp, Artificial Sequence
  chemically synthesized
ctaaatagctgtacctcagttc

SEQ ID NO: 774364 - DNA, 22 bp, Artificial Sequence
  chemically synthesized
gaagtcaaagaactgaggtaca

SEQ ID NO: 774365 - DNA, 22 bp, Artificial Sequence
  chemically synthesized
atttctaaatagctgtacctca

SEQ ID NO: 774366 - DNA, 22 bp, Artificial Sequence
  chemically synthesized
cacaaattcatttctaaatagc

SEQ ID NO: 774367 - DNA, 22 bp, Artificial Sequence
  chemically synthesized
ccacaaattcatttctaaatag

SEQ ID NO: 774368 - DNA, 22 bp, Artificial Sequence
  chemically synthesized
cttccacaaattcatttctaaa

SEQ ID NO: 774369 - DNA, 22 bp, Artificial Sequence
  chemically synthesized
aggtacagctatttagaaatga

SEQ ID NO: 774370 - DNA, 22 bp, Artificial Sequence
  chemically synthesized
tgcttccacaaattcatttcta

SEQ ID NO: 774371 - DNA, 22 bp, Artificial Sequence
  chemically synthesized
atggccctctgcttccacaaat

SEQ ID NO: 774372 - DNA, 22 bp, Artificial Sequence
  chemically synthesized
tttagaaatgaatttgtggaag

SEQ ID NO: 774373 - DNA, 22 bp, Artificial Sequence
  chemically synthesized
ttcatggccctctgcttccaca

SEQ ID NO: 774374 - DNA, 22 bp, Artificial Sequence
  chemically synthesized
agaaatgaatttgtggaagcag

SEQ ID NO: 774375 - DNA, 22 bp, Artificial Sequence
  chemically synthesized
gaaatgaatttgtggaagcaga

SEQ ID NO: 774376 - DNA, 22 bp, Artificial Sequence
  chemically synthesized
cacagctgttcatggccctctg

SEQ ID NO: 774377 - DNA, 22 bp, Artificial Sequence
  chemically synthesized
gcacagctgttcatggccctct

SEQ ID NO: 774378 - DNA, 22 bp, Artificial Sequence
  chemically synthesized
gtggaagcagagggccatgaac

SEQ ID NO: 774379 - DNA, 22 bp, Artificial Sequence
  chemically synthesized
tggaagcagagggccatgaaca

SEQ ID NO: 774380 - DNA, 22 bp, Artificial Sequence
  chemically synthesized
ggtgtacaacttgcacagctgt

SEQ ID NO: 774381 - DNA, 22 bp, Artificial Sequence
  chemically synthesized
tcggtgtacaacttgcacagct

SEQ ID NO: 774382 - DNA, 22 bp, Artificial Sequence
  chemically synthesized
ctcggtgtacaacttgcacagc

SEQ ID NO: 774383 - DNA, 22 bp, Artificial Sequence
  chemically synthesized
tctcggtgtacaacttgcacag

SEQ ID NO: 774384 - DNA, 22 bp, Artificial Sequence
  chemically synthesized
ttctcggtgtacaacttgcaca

SEQ ID NO: 774385 - DNA, 22 bp, Artificial Sequence
  chemically synthesized
tttttctcggtgtacaacttgc

SEQ ID NO: 774386 - DNA, 22 bp, Artificial Sequence
  chemically synthesized
gtttttctcggtgtacaacttg

SEQ ID NO: 774387 - DNA, 22 bp, Artificial Sequence
  chemically synthesized
tgtttttctcggtgtacaactt

SEQ ID NO: 774388 - DNA, 22 bp, Artificial Sequence
  chemically synthesized
tttgtttttctcggtgtacaac

SEQ ID NO: 774389 - DNA, 22 bp, Artificial Sequence
  chemically synthesized
ctttgtttttctcggtgtacaa

SEQ ID NO: 774390 - DNA, 22 bp, Artificial Sequence
  chemically synthesized
tgcaagttgtacaccgagaaaa

SEQ ID NO: 774391 - DNA, 22 bp, Artificial Sequence
  chemically synthesized
tacaccgagaaaaacaaagaag

SEQ ID NO: 774392 - DNA, 22 bp, Artificial Sequence
  chemically synthesized
atgatgtgaatggtacttcttt

SEQ ID NO: 774393 - DNA, 22 bp, Artificial Sequence
  chemically synthesized
tgaaacatacaactcatgatgt

SEQ ID NO: 774394 - DNA, 22 bp, Artificial Sequence
  chemically synthesized
acatcatgagttgtatgtttca

SEQ ID NO: 774395 - DNA, 22 bp, Artificial Sequence
  chemically synthesized
ccatgaagagccgtccagattg

SEQ ID NO: 774396 - DNA, 22 bp, Artificial Sequence
  chemically synthesized
tatgtttcacaatctggacggc

SEQ ID NO: 774397 - DNA, 22 bp, Artificial Sequence
  chemically synthesized
aggactgccatgaagagccgtc

SEQ ID NO: 774398 - DNA, 22 bp, Artificial Sequence
  chemically synthesized
cacaatctggacggctcttcat

SEQ ID NO: 774399 - DNA, 22 bp, Artificial Sequence
  chemically synthesized
acaatctggacggctcttcatg

SEQ ID NO: 774400 - DNA, 22 bp, Artificial Sequence
  chemically synthesized
caattcaggactgccatgaaga

SEQ ID NO: 774401 - DNA, 22 bp, Artificial Sequence
  chemically synthesized
ctacaattcaggactgccatga

SEQ ID NO: 774402 - DNA, 22 bp, Artificial Sequence
  chemically synthesized
actacaattcaggactgccatg

SEQ ID NO: 774403 - DNA, 22 bp, Artificial Sequence
  chemically synthesized
tactacaattcaggactgccat

SEQ ID NO: 774404 - DNA, 22 bp, Artificial Sequence
  chemically synthesized
gacggctcttcatggcagtcct

SEQ ID NO: 774405 - DNA, 22 bp, Artificial Sequence
  chemically synthesized
ttactacaattcaggactgcca

SEQ ID NO: 774406 - DNA, 22 bp, Artificial Sequence
  chemically synthesized
ttttactacaattcaggactgc

SEQ ID NO: 774407 - DNA, 22 bp, Artificial Sequence
  chemically synthesized
tcttttactacaattcaggact

SEQ ID NO: 774408 - DNA, 22 bp, Artificial Sequence
  chemically synthesized
ctcttttactacaattcaggac

SEQ ID NO: 774409 - DNA, 22 bp, Artificial Sequence
  chemically synthesized
ttcatggcagtcctgaattgta

SEQ ID NO: 774410 - DNA, 22 bp, Artificial Sequence
  chemically synthesized
catggcagtcctgaattgtagt

SEQ ID NO: 774411 - DNA, 22 bp, Artificial Sequence
  chemically synthesized
atggcagtcctgaattgtagta

SEQ ID NO: 774412 - DNA, 22 bp, Artificial Sequence
  chemically synthesized
aattgtagtaaaagagaagggt

SEQ ID NO: 774413 - DNA, 22 bp, Artificial Sequence
  chemically synthesized
tagtaaaagagaagggttattc

SEQ ID NO: 774414 - DNA, 22 bp, Artificial Sequence
  chemically synthesized
aggaaaaaataatgagaacgaa

SEQ ID NO: 774415 - DNA, 22 bp, Artificial Sequence
  chemically synthesized
ttcgttctcattattttttcct

SEQ ID NO: 774416 - DNA, 22 bp, Artificial Sequence
  chemically synthesized
gttctcattattttttcctcag

SEQ ID NO: 774417 - DNA, 22 bp, Artificial Sequence
  chemically synthesized
tcattattttttcctcagactc

SEQ ID NO: 774418 - DNA, 22 bp, Artificial Sequence
  chemically synthesized
accatgaagagagagtctgagg

SEQ ID NO: 774419 - DNA, 22 bp, Artificial Sequence
  chemically synthesized
attattttttcctcagactctc

SEQ ID NO: 774420 - DNA, 22 bp, Artificial Sequence
  chemically synthesized
ttttttcctcagactctctctt

SEQ ID NO: 774421 - DNA, 22 bp, Artificial Sequence
  chemically synthesized
tttcctcagactctctcttcat

SEQ ID NO: 774422 - DNA, 22 bp, Artificial Sequence
  chemically synthesized
ttcctcagactctctcttcatg

SEQ ID NO: 774423 - DNA, 22 bp, Artificial Sequence
  chemically synthesized
tcctcagactctctcttcatgg

SEQ ID NO: 774424 - DNA, 22 bp, Artificial Sequence
  chemically synthesized
cctcagactctctcttcatggt

SEQ ID NO: 774425 - DNA, 22 bp, Artificial Sequence
  chemically synthesized
ctcagactctctcttcatggtg

SEQ ID NO: 774426 - DNA, 22 bp, Artificial Sequence
  chemically synthesized
agactctctcttcatggtgagg

SEQ ID NO: 774427 - DNA, 22 bp, Artificial Sequence
  chemically synthesized
tctcttcatggtgagggatgat

SEQ ID NO: 774428 - DNA, 22 bp, Artificial Sequence
  chemically synthesized
tcttcatggtgagggatgatta

SEQ ID NO: 774429 - DNA, 22 bp, Artificial Sequence
  chemically synthesized
agaatacgagaataatcatccc

SEQ ID NO: 774430 - DNA, 22 bp, Artificial Sequence
  chemically synthesized
aagaatacgagaataatcatcc

SEQ ID NO: 774431 - DNA, 22 bp, Artificial Sequence
  chemically synthesized
ttcatggtgagggatgattatt

SEQ ID NO: 774432 - DNA, 22 bp, Artificial Sequence
  chemically synthesized
catggtgagggatgattattct

SEQ ID NO: 774433 - DNA, 22 bp, Artificial Sequence
  chemically synthesized
atggtgagggatgattattctc

SEQ ID NO: 774434 - DNA, 22 bp, Artificial Sequence
  chemically synthesized
aaatttaagaatacgagaataa

SEQ ID NO: 774435 - DNA, 22 bp, Artificial Sequence
  chemically synthesized
gactgaaatttaagaatacgag

SEQ ID NO: 774436 - DNA, 22 bp, Artificial Sequence
  chemically synthesized
ttagactgaaatttaagaatac

SEQ ID NO: 774437 - DNA, 22 bp, Artificial Sequence
  chemically synthesized
tattagactgaaatttaagaat

SEQ ID NO: 774438 - DNA, 22 bp, Artificial Sequence
  chemically synthesized
ttctcgtattcttaaatttcag

SEQ ID NO: 774439 - DNA, 22 bp, Artificial Sequence
  chemically synthesized
ataactctattagactgaaatt

SEQ ID NO: 774440 - DNA, 22 bp, Artificial Sequence
  chemically synthesized
tcgtattcttaaatttcagtct

SEQ ID NO: 774441 - DNA, 22 bp, Artificial Sequence
  chemically synthesized
taataactctattagactgaaa

SEQ ID NO: 774442 - DNA, 22 bp, Artificial Sequence
  chemically synthesized
gtattcttaaatttcagtctaa

SEQ ID NO: 774443 - DNA, 22 bp, Artificial Sequence
  chemically synthesized
aaattctaataactctattaga

SEQ ID NO: 774444 - DNA, 22 bp, Artificial Sequence
  chemically synthesized
ttaaatttcagtctaatagagt

SEQ ID NO: 774445 - DNA, 22 bp, Artificial Sequence
  chemically synthesized
aaaattctaataactctattag

SEQ ID NO: 774446 - DNA, 22 bp, Artificial Sequence
  chemically synthesized
taaaattctaataactctatta

SEQ ID NO: 774447 - DNA, 22 bp, Artificial Sequence
  chemically synthesized
aaatttcagtctaatagagtta

SEQ ID NO: 774448 - DNA, 22 bp, Artificial Sequence
  chemically synthesized
aatttcagtctaatagagttat

SEQ ID NO: 774449 - DNA, 22 bp, Artificial Sequence
  chemically synthesized
cagctttaaaattctaataact

SEQ ID NO: 774450 - DNA, 22 bp, Artificial Sequence
  chemically synthesized
cagtctaatagagttattagaa

SEQ ID NO: 774451 - DNA, 22 bp, Artificial Sequence
  chemically synthesized
agtctaatagagttattagaat

SEQ ID NO: 774452 - DNA, 22 bp, Artificial Sequence
  chemically synthesized
tccagctttaaaattctaataa

SEQ ID NO: 774453 - DNA, 22 bp, Artificial Sequence
  chemically synthesized
atagagttattagaattttaaa

SEQ ID NO: 774454 - DNA, 22 bp, Artificial Sequence
  chemically synthesized
agatactctccagctttaaaat

SEQ ID NO: 774455 - DNA, 22 bp, Artificial Sequence
  chemically synthesized
aagatactctccagctttaaaa

SEQ ID NO: 774456 - DNA, 22 bp, Artificial Sequence
  chemically synthesized
ttagaattttaaagctggagag

SEQ ID NO: 774457 - DNA, 22 bp, Artificial Sequence
  chemically synthesized
atgtttaagatactctccagct

SEQ ID NO: 774458 - DNA, 22 bp, Artificial Sequence
  chemically synthesized
catgtttaagatactctccagc

SEQ ID NO: 774459 - DNA, 22 bp, Artificial Sequence
  chemically synthesized
gaattttaaagctggagagtat

SEQ ID NO: 774460 - DNA, 22 bp, Artificial Sequence
  chemically synthesized
cttcatgtttaagatactctcc

SEQ ID NO: 774461 - DNA, 22 bp, Artificial Sequence
  chemically synthesized
taaagctggagagtatcttaaa

SEQ ID NO: 774462 - DNA, 22 bp, Artificial Sequence
  chemically synthesized
ggctacttcatgtttaagatac

SEQ ID NO: 774463 - DNA, 22 bp, Artificial Sequence
  chemically synthesized
aaagctggagagtatcttaaac

SEQ ID NO: 774464 - DNA, 22 bp, Artificial Sequence
  chemically synthesized
aagctggagagtatcttaaaca

SEQ ID NO: 774465 - DNA, 22 bp, Artificial Sequence
  chemically synthesized
taggctacttcatgtttaagat

SEQ ID NO: 774466 - DNA, 22 bp, Artificial Sequence
  chemically synthesized
gagagtatcttaaacatgaagt

SEQ ID NO: 774467 - DNA, 22 bp, Artificial Sequence
  chemically synthesized
tcatctctaggctacttcatgt

SEQ ID NO: 774468 - DNA, 22 bp, Artificial Sequence
  chemically synthesized
gtcatctctaggctacttcatg

SEQ ID NO: 774469 - DNA, 22 bp, Artificial Sequence
  chemically synthesized
tgtcatctctaggctacttcat

SEQ ID NO: 774470 - DNA, 22 bp, Artificial Sequence
  chemically synthesized
tttgtcatctctaggctacttc

SEQ ID NO: 774471 - DNA, 22 bp, Artificial Sequence
  chemically synthesized
aaacatgaagtagcctagagat

SEQ ID NO: 774472 - DNA, 22 bp, Artificial Sequence
  chemically synthesized
aacatgaagtagcctagagatg

SEQ ID NO: 774473 - DNA, 22 bp, Artificial Sequence
  chemically synthesized
gcacataggtaaaacctctttg

SEQ ID NO: 774474 - DNA, 22 bp, Artificial Sequence
  chemically synthesized
gagatgacaaagaggttttacc

SEQ ID NO: 774475 - DNA, 22 bp, Artificial Sequence
  chemically synthesized
atgagagttagcacataggtaa

SEQ ID NO: 774476 - DNA, 22 bp, Artificial Sequence
  chemically synthesized
actaatgagagttagcacatag

SEQ ID NO: 774477 - DNA, 22 bp, Artificial Sequence
  chemically synthesized
ccactcactaatgagagttagc

SEQ ID NO: 774478 - DNA, 22 bp, Artificial Sequence
  chemically synthesized
tacctatgtgctaactctcatt

SEQ ID NO: 774479 - DNA, 22 bp, Artificial Sequence
  chemically synthesized
acctatgtgctaactctcatta

SEQ ID NO: 774480 - DNA, 22 bp, Artificial Sequence
  chemically synthesized
cctatgtgctaactctcattag

SEQ ID NO: 774481 - DNA, 22 bp, Artificial Sequence
  chemically synthesized
tgtgctaactctcattagtgag

SEQ ID NO: 774482 - DNA, 22 bp, Artificial Sequence
  chemically synthesized
caggtagctaccactcactaat

SEQ ID NO: 774483 - DNA, 22 bp, Artificial Sequence
  chemically synthesized
actctcattagtgagtggtagc

SEQ ID NO: 774484 - DNA, 22 bp, Artificial Sequence
  chemically synthesized
tcattagtgagtggtagctacc

SEQ ID NO: 774485 - DNA, 22 bp, Artificial Sequence
  chemically synthesized
attagtgagtggtagctacctg

SEQ ID NO: 774486 - DNA, 22 bp, Artificial Sequence
  chemically synthesized
aaggcaatgctccaggtagcta

SEQ ID NO: 774487 - DNA, 22 bp, Artificial Sequence
  chemically synthesized
tcaaggcaatgctccaggtagc

SEQ ID NO: 774488 - DNA, 22 bp, Artificial Sequence
  chemically synthesized
ctcaaggcaatgctccaggtag

SEQ ID NO: 774489 - DNA, 22 bp, Artificial Sequence
  chemically synthesized
gtgagtggtagctacctggagc

SEQ ID NO: 774490 - DNA, 22 bp, Artificial Sequence
  chemically synthesized
tatcagagcacttctcaaggca

SEQ ID NO: 774491 - DNA, 22 bp, Artificial Sequence
  chemically synthesized
cctggagcattgccttgagaag

SEQ ID NO: 774492 - DNA, 22 bp, Artificial Sequence
  chemically synthesized
tgtatcagagcacttctcaagg

SEQ ID NO: 774493 - DNA, 22 bp, Artificial Sequence
  chemically synthesized
gagcattgccttgagaagtgct

SEQ ID NO: 774494 - DNA, 22 bp, Artificial Sequence
  chemically synthesized
ccttgagaagtgctctgataca

SEQ ID NO: 774495 - DNA, 22 bp, Artificial Sequence
  chemically synthesized
gtcagtcagctctgtatcagag

SEQ ID NO: 774496 - DNA, 22 bp, Artificial Sequence
  chemically synthesized
gagaagtgctctgatacagagc

SEQ ID NO: 774497 - DNA, 22 bp, Artificial Sequence
  chemically synthesized
agaagtgctctgatacagagct

SEQ ID NO: 774498 - DNA, 22 bp, Artificial Sequence
  chemically synthesized
aaagacatggctagtcagtcag

SEQ ID NO: 774499 - DNA, 22 bp, Artificial Sequence
  chemically synthesized
tgatacagagctgactgactag

SEQ ID NO: 774500 - DNA, 22 bp, Artificial Sequence
  chemically synthesized
atacagagctgactgactagcc

SEQ ID NO: 774501 - DNA, 22 bp, Artificial Sequence
  chemically synthesized
cccctgaaagacatggctagtc

SEQ ID NO: 774502 - DNA, 22 bp, Artificial Sequence
  chemically synthesized
acccctgaaagacatggctagt

SEQ ID NO: 774503 - DNA, 22 bp, Artificial Sequence
  chemically synthesized
gtttacccctgaaagacatggc

SEQ ID NO: 774504 - DNA, 22 bp, Artificial Sequence
  chemically synthesized
actgactagccatgtctttcag

SEQ ID NO: 774505 - DNA, 22 bp, Artificial Sequence
  chemically synthesized
tctcgtttacccctgaaagaca

SEQ ID NO: 774506 - DNA, 22 bp, Artificial Sequence
  chemically synthesized
tgtctcgtttacccctgaaaga

SEQ ID NO: 774507 - DNA, 22 bp, Artificial Sequence
  chemically synthesized
ctgtctcgtttacccctgaaag

SEQ ID NO: 774508 - DNA, 22 bp, Artificial Sequence
  chemically synthesized
actagccatgtctttcaggggt

SEQ ID NO: 774509 - DNA, 22 bp, Artificial Sequence
  chemically synthesized
gccatgtctttcaggggtaaac

SEQ ID NO: 774510 - DNA, 22 bp, Artificial Sequence
  chemically synthesized
cgtttctgtctcgtttacccct

SEQ ID NO: 774511 - DNA, 22 bp, Artificial Sequence
  chemically synthesized
ccgtttctgtctcgtttacccc

SEQ ID NO: 774512 - DNA, 22 bp, Artificial Sequence
  chemically synthesized
tcaggggtaaacgagacagaaa

SEQ ID NO: 774513 - DNA, 22 bp, Artificial Sequence
  chemically synthesized
caggggtaaacgagacagaaac

SEQ ID NO: 774514 - DNA, 22 bp, Artificial Sequence
  chemically synthesized
aggggtaaacgagacagaaacg

SEQ ID NO: 774515 - DNA, 22 bp, Artificial Sequence
  chemically synthesized
gaacaaggaaggaaaatacgtg

SEQ ID NO: 774516 - DNA, 22 bp, Artificial Sequence
  chemically synthesized
actggaacaaggaaggaaaata

SEQ ID NO: 774517 - DNA, 22 bp, Artificial Sequence
  chemically synthesized
acgtattttccttccttgttcc

SEQ ID NO: 774518 - DNA, 22 bp, Artificial Sequence
  chemically synthesized
gaaaatgaatagattaactgga

SEQ ID NO: 774519 - DNA, 22 bp, Artificial Sequence
  chemically synthesized
tccttccttgttccagttaatc

SEQ ID NO: 774520 - DNA, 22 bp, Artificial Sequence
  chemically synthesized
ccttccttgttccagttaatct

SEQ ID NO: 774521 - DNA, 22 bp, Artificial Sequence
  chemically synthesized
tggaaaatgaatagattaactg

SEQ ID NO: 774522 - DNA, 22 bp, Artificial Sequence
  chemically synthesized
cttccttgttccagttaatcta

SEQ ID NO: 774523 - DNA, 22 bp, Artificial Sequence
  chemically synthesized
ctggaaaatgaatagattaact

SEQ ID NO: 774524 - DNA, 22 bp, Artificial Sequence
  chemically synthesized
ttctggaaaatgaatagattaa

SEQ ID NO: 774525 - DNA, 22 bp, Artificial Sequence
  chemically synthesized
ccttgttccagttaatctattc

SEQ ID NO: 774526 - DNA, 22 bp, Artificial Sequence
  chemically synthesized
cttgttccagttaatctattca

SEQ ID NO: 774527 - DNA, 22 bp, Artificial Sequence
  chemically synthesized
tcttctggaaaatgaatagatt

SEQ ID NO: 774528 - DNA, 22 bp, Artificial Sequence
  chemically synthesized
ctcttctggaaaatgaatagat

SEQ ID NO: 774529 - DNA, 22 bp, Artificial Sequence
  chemically synthesized
tctcttctggaaaatgaataga

SEQ ID NO: 774530 - DNA, 22 bp, Artificial Sequence
  chemically synthesized
gttccagttaatctattcattt

SEQ ID NO: 774531 - DNA, 22 bp, Artificial Sequence
  chemically synthesized
ttccagttaatctattcatttt

SEQ ID NO: 774532 - DNA, 22 bp, Artificial Sequence
  chemically synthesized
attttctcttctggaaaatgaa

SEQ ID NO: 774533 - DNA, 22 bp, Artificial Sequence
  chemically synthesized
cagttaatctattcattttcca

SEQ ID NO: 774534 - DNA, 22 bp, Artificial Sequence
  chemically synthesized
aattttctcttctggaaaatga

SEQ ID NO: 774535 - DNA, 22 bp, Artificial Sequence
  chemically synthesized
atctattcattttccagaagag

SEQ ID NO: 774536 - DNA, 22 bp, Artificial Sequence
  chemically synthesized
gaccttaattttctcttctgga

SEQ ID NO: 774537 - DNA, 22 bp, Artificial Sequence
  chemically synthesized
tggaccttaattttctcttctg

SEQ ID NO: 774538 - DNA, 22 bp, Artificial Sequence
  chemically synthesized
ctggaccttaattttctcttct

SEQ ID NO: 774539 - DNA, 22 bp, Artificial Sequence
  chemically synthesized
tctggaccttaattttctcttc

SEQ ID NO: 774540 - DNA, 22 bp, Artificial Sequence
  chemically synthesized
ttcattttccagaagagaaaat

SEQ ID NO: 774541 - DNA, 22 bp, Artificial Sequence
  chemically synthesized
ttctggaccttaattttctctt

SEQ ID NO: 774542 - DNA, 22 bp, Artificial Sequence
  chemically synthesized
attttccagaagagaaaattaa

SEQ ID NO: 774543 - DNA, 22 bp, Artificial Sequence
  chemically synthesized
cttttctggaccttaattttct

SEQ ID NO: 774544 - DNA, 22 bp, Artificial Sequence
  chemically synthesized
tccagaagagaaaattaaggtc

SEQ ID NO: 774545 - DNA, 22 bp, Artificial Sequence
  chemically synthesized
ccagaagagaaaattaaggtcc

SEQ ID NO: 774546 - DNA, 22 bp, Artificial Sequence
  chemically synthesized
cattgcttttctggaccttaat

SEQ ID NO: 774547 - DNA, 22 bp, Artificial Sequence
  chemically synthesized
cagaagagaaaattaaggtcca

SEQ ID NO: 774548 - DNA, 22 bp, Artificial Sequence
  chemically synthesized
agagcaagttgcattgcttttc

SEQ ID NO: 774549 - DNA, 22 bp, Artificial Sequence
  chemically synthesized
aggtccagaaaagcaatgcaac

SEQ ID NO: 774550 - DNA, 22 bp, Artificial Sequence
  chemically synthesized
atgttaagagcaagttgcattg

SEQ ID NO: 774551 - DNA, 22 bp, Artificial Sequence
  chemically synthesized
cagcactgatgttaagagcaag

SEQ ID NO: 774552 - DNA, 22 bp, Artificial Sequence
  chemically synthesized
ctccagcactgatgttaagagc

SEQ ID NO: 774553 - DNA, 22 bp, Artificial Sequence
  chemically synthesized
tgctccagcactgatgttaaga

SEQ ID NO: 774554 - DNA, 22 bp, Artificial Sequence
  chemically synthesized
ggttctgctccagcactgatgt

SEQ ID NO: 774555 - DNA, 22 bp, Artificial Sequence
  chemically synthesized
gctcttaacatcagtgctggag

SEQ ID NO: 774556 - DNA, 22 bp, Artificial Sequence
  chemically synthesized
ctcttaacatcagtgctggagc

SEQ ID NO: 774557 - DNA, 22 bp, Artificial Sequence
  chemically synthesized
ttaacatcagtgctggagcaga

SEQ ID NO: 774558 - DNA, 22 bp, Artificial Sequence
  chemically synthesized
aacatcagtgctggagcagaac

SEQ ID NO: 774559 - DNA, 22 bp, Artificial Sequence
  chemically synthesized
acatcagtgctggagcagaacc

SEQ ID NO: 774560 - DNA, 22 bp, Artificial Sequence
  chemically synthesized
gaagtacagaaacctgggttct

SEQ ID NO: 774561 - DNA, 22 bp, Artificial Sequence
  chemically synthesized
gagcagaacccaggtttctgta

SEQ ID NO: 774562 - DNA, 22 bp, Artificial Sequence
  chemically synthesized
ctgtacttctagcctacgtccc

SEQ ID NO: 774563 - DNA, 22 bp, Artificial Sequence
  chemically synthesized
tgtacttctagcctacgtccct

SEQ ID NO: 774564 - DNA, 22 bp, Artificial Sequence
  chemically synthesized
tacttctagcctacgtcccttc

SEQ ID NO: 774565 - DNA, 22 bp, Artificial Sequence
  chemically synthesized
aaaccaggtgtgaaggaaggga

SEQ ID NO: 774566 - DNA, 22 bp, Artificial Sequence
  chemically synthesized
gaaaccaggtgtgaaggaaggg

SEQ ID NO: 774567 - DNA, 22 bp, Artificial Sequence
  chemically synthesized
ctagcctacgtcccttccttca

SEQ ID NO: 774568 - DNA, 22 bp, Artificial Sequence
  chemically synthesized
tagcctacgtcccttccttcac

SEQ ID NO: 774569 - DNA, 22 bp, Artificial Sequence
  chemically synthesized
gcctacgtcccttccttcacac

SEQ ID NO: 774570 - DNA, 22 bp, Artificial Sequence
  chemically synthesized
cgtcccttccttcacacctggt

SEQ ID NO: 774571 - DNA, 22 bp, Artificial Sequence
  chemically synthesized
aggaatcttgaaaccaggtgtg

SEQ ID NO: 774572 - DNA, 22 bp, Artificial Sequence
  chemically synthesized
aaggaatcttgaaaccaggtgt

SEQ ID NO: 774573 - DNA, 22 bp, Artificial Sequence
  chemically synthesized
taaggaatcttgaaaccaggtg

SEQ ID NO: 774574 - DNA, 22 bp, Artificial Sequence
  chemically synthesized
tctttaaggaatcttgaaacca

SEQ ID NO: 774575 - DNA, 22 bp, Artificial Sequence
  chemically synthesized
atctttaaggaatcttgaaacc

SEQ ID NO: 774576 - DNA, 22 bp, Artificial Sequence
  chemically synthesized
ccttcacacctggtttcaagat

SEQ ID NO: 774577 - DNA, 22 bp, Artificial Sequence
  chemically synthesized
cttcacacctggtttcaagatt

SEQ ID NO: 774578 - DNA, 22 bp, Artificial Sequence
  chemically synthesized
cacacctggtttcaagattcct

SEQ ID NO: 774579 - DNA, 22 bp, Artificial Sequence
  chemically synthesized
acacctggtttcaagattcctt

SEQ ID NO: 774580 - DNA, 22 bp, Artificial Sequence
  chemically synthesized
taatttatctttaaggaatctt

SEQ ID NO: 774581 - DNA, 22 bp, Artificial Sequence
  chemically synthesized
ataatttatctttaaggaatct

SEQ ID NO: 774582 - DNA, 22 bp, Artificial Sequence
  chemically synthesized
gtttcaagattccttaaagata

SEQ ID NO: 774583 - DNA, 22 bp, Artificial Sequence
  chemically synthesized
gaatttataatttatctttaag

SEQ ID NO: 774584 - DNA, 22 bp, Artificial Sequence
  chemically synthesized
caagattccttaaagataaatt

SEQ ID NO: 774585 - DNA, 22 bp, Artificial Sequence
  chemically synthesized
aagattccttaaagataaatta

SEQ ID NO: 774586 - DNA, 22 bp, Artificial Sequence
  chemically synthesized
gggctagaatttataatttatc

SEQ ID NO: 774587 - DNA, 22 bp, Artificial Sequence
  chemically synthesized
agggctagaatttataatttat

SEQ ID NO: 774588 - DNA, 22 bp, Artificial Sequence
  chemically synthesized
cttaaagataaattataaattc

SEQ ID NO: 774589 - DNA, 22 bp, Artificial Sequence
  chemically synthesized
aaagataaattataaattctag

SEQ ID NO: 774590 - DNA, 22 bp, Artificial Sequence
  chemically synthesized
aagataaattataaattctagc

SEQ ID NO: 774591 - DNA, 22 bp, Artificial Sequence
  chemically synthesized
aaaggcagcaaatcttagggct

SEQ ID NO: 774592 - DNA, 22 bp, Artificial Sequence
  chemically synthesized
gaaaggcagcaaatcttagggc

SEQ ID NO: 774593 - DNA, 22 bp, Artificial Sequence
  chemically synthesized
taaattctagccctaagatttg

SEQ ID NO: 774594 - DNA, 22 bp, Artificial Sequence
  chemically synthesized
aaatttgaaaggcagcaaatct

SEQ ID NO: 774595 - DNA, 22 bp, Artificial Sequence
  chemically synthesized
tagccctaagatttgctgcctt

SEQ ID NO: 774596 - DNA, 22 bp, Artificial Sequence
  chemically synthesized
gccctaagatttgctgcctttc

SEQ ID NO: 774597 - DNA, 22 bp, Artificial Sequence
  chemically synthesized
aaaataggttaaaatttgaaag

SEQ ID NO: 774598 - DNA, 22 bp, Artificial Sequence
  chemically synthesized
agatttgctgcctttcaaattt

SEQ ID NO: 774599 - DNA, 22 bp, Artificial Sequence
  chemically synthesized
gaaaataggttaaaatttgaaa

SEQ ID NO: 774600 - DNA, 22 bp, Artificial Sequence
  chemically synthesized
accttgaaaataggttaaaatt

SEQ ID NO: 774601 - DNA, 22 bp, Artificial Sequence
  chemically synthesized
gctgcctttcaaattttaacct

SEQ ID NO: 774602 - DNA, 22 bp, Artificial Sequence
  chemically synthesized
ctgcctttcaaattttaaccta

SEQ ID NO: 774603 - DNA, 22 bp, Artificial Sequence
  chemically synthesized
cctttcaaattttaacctattt

SEQ ID NO: 774604 - DNA, 22 bp, Artificial Sequence
  chemically synthesized
tcaaattttaacctattttcaa

SEQ ID NO: 774605 - DNA, 22 bp, Artificial Sequence
  chemically synthesized
caaattttaacctattttcaag

SEQ ID NO: 774606 - DNA, 22 bp, Artificial Sequence
  chemically synthesized
aaattttaacctattttcaagg

SEQ ID NO: 774607 - DNA, 22 bp, Artificial Sequence
  chemically synthesized
taacctattttcaaggttaact

SEQ ID NO: 774608 - DNA, 22 bp, Artificial Sequence
  chemically synthesized
aacctattttcaaggttaacta

SEQ ID NO: 774609 - DNA, 22 bp, Artificial Sequence
  chemically synthesized
acctattttcaaggttaactac

SEQ ID NO: 774610 - DNA, 22 bp, Artificial Sequence
  chemically synthesized
gtgaccaaaggcaggtagttaa

SEQ ID NO: 774611 - DNA, 22 bp, Artificial Sequence
  chemically synthesized
ttttcaaggttaactacctgcc

SEQ ID NO: 774612 - DNA, 22 bp, Artificial Sequence
  chemically synthesized
tgctggtgaccaaaggcaggta

SEQ ID NO: 774613 - DNA, 22 bp, Artificial Sequence
  chemically synthesized
tcaaggttaactacctgccttt

SEQ ID NO: 774614 - DNA, 22 bp, Artificial Sequence
  chemically synthesized
atgctggtgaccaaaggcaggt

SEQ ID NO: 774615 - DNA, 22 bp, Artificial Sequence
  chemically synthesized
caaggttaactacctgcctttg

SEQ ID NO: 774616 - DNA, 22 bp, Artificial Sequence
  chemically synthesized
aaggttaactacctgcctttgg

SEQ ID NO: 774617 - DNA, 22 bp, Artificial Sequence
  chemically synthesized
tttatgctggtgaccaaaggca

SEQ ID NO: 774618 - DNA, 22 bp, Artificial Sequence
  chemically synthesized
atttatgctggtgaccaaaggc

SEQ ID NO: 774619 - DNA, 22 bp, Artificial Sequence
  chemically synthesized
actacctgcctttggtcaccag

SEQ ID NO: 774620 - DNA, 22 bp, Artificial Sequence
  chemically synthesized
cctgcctttggtcaccagcata

SEQ ID NO: 774621 - DNA, 22 bp, Artificial Sequence
  chemically synthesized
cctttggtcaccagcataaata

SEQ ID NO: 774622 - DNA, 22 bp, Artificial Sequence
  chemically synthesized
tggtcaccagcataaataaatc

SEQ ID NO: 774623 - DNA, 22 bp, Artificial Sequence
  chemically synthesized
ggtcaccagcataaataaatct

SEQ ID NO: 774624 - DNA, 22 bp, Artificial Sequence
  chemically synthesized
gtcaccagcataaataaatctg

SEQ ID NO: 774625 - DNA, 22 bp, Artificial Sequence
  chemically synthesized
acatggcatatccagatttatt

SEQ ID NO: 774626 - DNA, 22 bp, Artificial Sequence
  chemically synthesized
tcacatggcatatccagattta

SEQ ID NO: 774627 - DNA, 22 bp, Artificial Sequence
  chemically synthesized
tgttctcacatggcatatccag

SEQ ID NO: 774628 - DNA, 22 bp, Artificial Sequence
  chemically synthesized
tgatgatgctgtgttctcacat

SEQ ID NO: 774629 - DNA, 22 bp, Artificial Sequence
  chemically synthesized
ctgtgatgatgctgtgttctca

SEQ ID NO: 774630 - DNA, 22 bp, Artificial Sequence
  chemically synthesized
gatatgccatgtgagaacacag

SEQ ID NO: 774631 - DNA, 22 bp, Artificial Sequence
  chemically synthesized
gctgtgatgatgctgtgttctc

SEQ ID NO: 774632 - DNA, 22 bp, Artificial Sequence
  chemically synthesized
tttgctgtgatgatgctgtgtt

SEQ ID NO: 774633 - DNA, 22 bp, Artificial Sequence
  chemically synthesized
aagactatttgctgtgatgatg

SEQ ID NO: 774634 - DNA, 22 bp, Artificial Sequence
  chemically synthesized
tgatgctaaagactatttgctg

SEQ ID NO: 774635 - DNA, 22 bp, Artificial Sequence
  chemically synthesized
atgatgctaaagactatttgct

SEQ ID NO: 774636 - DNA, 22 bp, Artificial Sequence
  chemically synthesized
tatgatgctaaagactatttgc

SEQ ID NO: 774637 - DNA, 22 bp, Artificial Sequence
  chemically synthesized
tgtgatagttttatgatgctaa

SEQ ID NO: 774638 - DNA, 22 bp, Artificial Sequence
  chemically synthesized
atgtgatagttttatgatgcta

SEQ ID NO: 774639 - DNA, 22 bp, Artificial Sequence
  chemically synthesized
tatgtgatagttttatgatgct

SEQ ID NO: 774640 - DNA, 22 bp, Artificial Sequence
  chemically synthesized
cattttatgtgatagttttatg

SEQ ID NO: 774641 - DNA, 22 bp, Artificial Sequence
  chemically synthesized
tagcatcataaaactatcacat

SEQ ID NO: 774642 - DNA, 22 bp, Artificial Sequence
  chemically synthesized
gcactacattttatgtgatagt

SEQ ID NO: 774643 - DNA, 22 bp, Artificial Sequence
  chemically synthesized
agcatcataaaactatcacata

SEQ ID NO: 774644 - DNA, 22 bp, Artificial Sequence
  chemically synthesized
ggcactacattttatgtgatag

SEQ ID NO: 774645 - DNA, 22 bp, Artificial Sequence
  chemically synthesized
gcatcataaaactatcacataa

SEQ ID NO: 774646 - DNA, 22 bp, Artificial Sequence
  chemically synthesized
ggtagtgcacttggcactacat

SEQ ID NO: 774647 - DNA, 22 bp, Artificial Sequence
  chemically synthesized
aggtagtgcacttggcactaca

SEQ ID NO: 774648 - DNA, 22 bp, Artificial Sequence
  chemically synthesized
taggtagtgcacttggcactac

SEQ ID NO: 774649 - DNA, 22 bp, Artificial Sequence
  chemically synthesized
tcacataaaatgtagtgccaag

SEQ ID NO: 774650 - DNA, 22 bp, Artificial Sequence
  chemically synthesized
ttaggtagtgcacttggcacta

SEQ ID NO: 774651 - DNA, 22 bp, Artificial Sequence
  chemically synthesized
taacatgtgccttttaggtagt

SEQ ID NO: 774652 - DNA, 22 bp, Artificial Sequence
  chemically synthesized
ataacatgtgccttttaggtag

SEQ ID NO: 774653 - DNA, 22 bp, Artificial Sequence
  chemically synthesized
cttataacatgtgccttttagg

SEQ ID NO: 774654 - DNA, 22 bp, Artificial Sequence
  chemically synthesized
ctacttataacatgtgcctttt

SEQ ID NO: 774655 - DNA, 22 bp, Artificial Sequence
  chemically synthesized
cctaaaaggcacatgttataag

SEQ ID NO: 774656 - DNA, 22 bp, Artificial Sequence
  chemically synthesized
aaaggcacatgttataagtagt

SEQ ID NO: 774657 - DNA, 22 bp, Artificial Sequence
  chemically synthesized
acaatgacccctactacttata

SEQ ID NO: 774658 - DNA, 22 bp, Artificial Sequence
  chemically synthesized
attgacaatgacccctactact

SEQ ID NO: 774659 - DNA, 22 bp, Artificial Sequence
  chemically synthesized
gattgacaatgacccctactac

SEQ ID NO: 774660 - DNA, 22 bp, Artificial Sequence
  chemically synthesized
acttgattgacaatgaccccta

SEQ ID NO: 774661 - DNA, 22 bp, Artificial Sequence
  chemically synthesized
aacttgattgacaatgacccct

SEQ ID NO: 774662 - DNA, 22 bp, Artificial Sequence
  chemically synthesized
cttaacttgattgacaatgacc

SEQ ID NO: 774663 - DNA, 22 bp, Artificial Sequence
  chemically synthesized
taagtagtaggggtcattgtca

SEQ ID NO: 774664 - DNA, 22 bp, Artificial Sequence
  chemically synthesized
cattgcttaacttgattgacaa

SEQ ID NO: 774665 - DNA, 22 bp, Artificial Sequence
  chemically synthesized
ccccctgcattgcttaacttga

SEQ ID NO: 774666 - DNA, 22 bp, Artificial Sequence
  chemically synthesized
cccccctgcattgcttaacttg

SEQ ID NO: 774667 - DNA, 22 bp, Artificial Sequence
  chemically synthesized
tcccccctgcattgcttaactt

SEQ ID NO: 774668 - DNA, 22 bp, Artificial Sequence
  chemically synthesized
tttcccccctgcattgcttaac

SEQ ID NO: 774669 - DNA, 22 bp, Artificial Sequence
  chemically synthesized
ctttcccccctgcattgcttaa

SEQ ID NO: 774670 - DNA, 22 bp, Artificial Sequence
  chemically synthesized
tcaatcaagttaagcaatgcag

SEQ ID NO: 774671 - DNA, 22 bp, Artificial Sequence
  chemically synthesized
acaatttctttcccccctgcat

SEQ ID NO: 774672 - DNA, 22 bp, Artificial Sequence
  chemically synthesized
tgacaatttctttcccccctgc

SEQ ID NO: 774673 - DNA, 22 bp, Artificial Sequence
  chemically synthesized
ctctgacaatttctttcccccc

SEQ ID NO: 774674 - DNA, 22 bp, Artificial Sequence
  chemically synthesized
agcaatgcaggggggaaagaaa

SEQ ID NO: 774675 - DNA, 22 bp, Artificial Sequence
  chemically synthesized
ttcctctgacaatttctttccc

SEQ ID NO: 774676 - DNA, 22 bp, Artificial Sequence
  chemically synthesized
gttgttcctctgacaatttctt

SEQ ID NO: 774677 - DNA, 22 bp, Artificial Sequence
  chemically synthesized
cgttgttcctctgacaatttct

SEQ ID NO: 774678 - DNA, 22 bp, Artificial Sequence
  chemically synthesized
ttcgttgttcctctgacaattt

SEQ ID NO: 774679 - DNA, 22 bp, Artificial Sequence
  chemically synthesized
cagatgatctcttcgttgttcc

SEQ ID NO: 774680 - DNA, 22 bp, Artificial Sequence
  chemically synthesized
tcagaggaacaacgaagagatc

SEQ ID NO: 774681 - DNA, 22 bp, Artificial Sequence
  chemically synthesized
aaaacgatattacagatgatct

SEQ ID NO: 774682 - DNA, 22 bp, Artificial Sequence
  chemically synthesized
aagccaaatatgtctcaaaacg

SEQ ID NO: 774683 - DNA, 22 bp, Artificial Sequence
  chemically synthesized
taatatcgttttgagacatatt

SEQ ID NO: 774684 - DNA, 22 bp, Artificial Sequence
  chemically synthesized
tatagattcaagccaaatatgt

SEQ ID NO: 774685 - DNA, 22 bp, Artificial Sequence
  chemically synthesized
gtatagattcaagccaaatatg

SEQ ID NO: 774686 - DNA, 22 bp, Artificial Sequence
  chemically synthesized
ccatttgtatagattcaagcca

SEQ ID NO: 774687 - DNA, 22 bp, Artificial Sequence
  chemically synthesized
tgagacatatttggcttgaatc

SEQ ID NO: 774688 - DNA, 22 bp, Artificial Sequence
  chemically synthesized
gagacatatttggcttgaatct

SEQ ID NO: 774689 - DNA, 22 bp, Artificial Sequence
  chemically synthesized
agacatatttggcttgaatcta

SEQ ID NO: 774690 - DNA, 22 bp, Artificial Sequence
  chemically synthesized
ctgccatttgtatagattcaag

SEQ ID NO: 774691 - DNA, 22 bp, Artificial Sequence
  chemically synthesized
tgctgccatttgtatagattca

SEQ ID NO: 774692 - DNA, 22 bp, Artificial Sequence
  chemically synthesized
ggcttgaatctatacaaatggc

SEQ ID NO: 774693 - DNA, 22 bp, Artificial Sequence
  chemically synthesized
gcttgaatctatacaaatggca

SEQ ID NO: 774694 - DNA, 22 bp, Artificial Sequence
  chemically synthesized
caagtattctgctgccatttgt

SEQ ID NO: 774695 - DNA, 22 bp, Artificial Sequence
  chemically synthesized
gcaagtattctgctgccatttg

SEQ ID NO: 774696 - DNA, 22 bp, Artificial Sequence
  chemically synthesized
gaatctatacaaatggcagcag

SEQ ID NO: 774697 - DNA, 22 bp, Artificial Sequence
  chemically synthesized
aatctatacaaatggcagcaga

SEQ ID NO: 774698 - DNA, 22 bp, Artificial Sequence
  chemically synthesized
tacaaatggcagcagaatactt

SEQ ID NO: 774699 - DNA, 22 bp, Artificial Sequence
  chemically synthesized
ggacaaaagtccttgcaagtat

SEQ ID NO: 774700 - DNA, 22 bp, Artificial Sequence
  chemically synthesized
acactgggacaaaagtccttgc

SEQ ID NO: 774701 - DNA, 22 bp, Artificial Sequence
  chemically synthesized
cacactgggacaaaagtccttg

SEQ ID NO: 774702 - DNA, 22 bp, Artificial Sequence
  chemically synthesized
ttcacactgggacaaaagtcct

SEQ ID NO: 774703 - DNA, 22 bp, Artificial Sequence
  chemically synthesized
cctcttcacactgggacaaaag

SEQ ID NO: 774704 - DNA, 22 bp, Artificial Sequence
  chemically synthesized
ttacctcttcacactgggacaa

SEQ ID NO: 774705 - DNA, 22 bp, Artificial Sequence
  chemically synthesized
gcaaggacttttgtcccagtgt

SEQ ID NO: 774706 - DNA, 22 bp, Artificial Sequence
  chemically synthesized
caaggacttttgtcccagtgtg

SEQ ID NO: 774707 - DNA, 22 bp, Artificial Sequence
  chemically synthesized
cagttgttacctcttcacactg

SEQ ID NO: 774708 - DNA, 22 bp, Artificial Sequence
  chemically synthesized
ttgtcccagtgtgaagaggtaa

SEQ ID NO: 774709 - DNA, 22 bp, Artificial Sequence
  chemically synthesized
tgtcccagtgtgaagaggtaac

SEQ ID NO: 774710 - DNA, 22 bp, Artificial Sequence
  chemically synthesized
gtcccagtgtgaagaggtaaca

SEQ ID NO: 774711 - DNA, 22 bp, Artificial Sequence
  chemically synthesized
tcccagtgtgaagaggtaacaa

SEQ ID NO: 774712 - DNA, 22 bp, Artificial Sequence
  chemically synthesized
aatcaattccagttgttacctc

SEQ ID NO: 774713 - DNA, 22 bp, Artificial Sequence
  chemically synthesized
atagacgttgaatcaattccag

SEQ ID NO: 774714 - DNA, 22 bp, Artificial Sequence
  chemically synthesized
gaattgattcaacgtctattaa

SEQ ID NO: 774715 - DNA, 22 bp, Artificial Sequence
  chemically synthesized
gcaccatgaccaatgttaatag

SEQ ID NO: 774716 - DNA, 22 bp, Artificial Sequence
  chemically synthesized
attcaacgtctattaacattgg

SEQ ID NO: 774717 - DNA, 22 bp, Artificial Sequence
  chemically synthesized
aacgtctattaacattggtcat

SEQ ID NO: 774718 - DNA, 22 bp, Artificial Sequence
  chemically synthesized
agtatctagcaccatgaccaat

SEQ ID NO: 774719 - DNA, 22 bp, Artificial Sequence
  chemically synthesized
tcagtatctagcaccatgacca

SEQ ID NO: 774720 - DNA, 22 bp, Artificial Sequence
  chemically synthesized
ttaacattggtcatggtgctag

SEQ ID NO: 774721 - DNA, 22 bp, Artificial Sequence
  chemically synthesized
acattggtcatggtgctagata

SEQ ID NO: 774722 - DNA, 22 bp, Artificial Sequence
  chemically synthesized
gtggattctcagtatctagcac

SEQ ID NO: 774723 - DNA, 22 bp, Artificial Sequence
  chemically synthesized
ctggtggattctcagtatctag

SEQ ID NO: 774724 - DNA, 22 bp, Artificial Sequence
  chemically synthesized
actggtggattctcagtatcta

SEQ ID NO: 774725 - DNA, 22 bp, Artificial Sequence
  chemically synthesized
gtcatggtgctagatactgaga

SEQ ID NO: 774726 - DNA, 22 bp, Artificial Sequence
  chemically synthesized
tttactggtggattctcagtat

SEQ ID NO: 774727 - DNA, 22 bp, Artificial Sequence
  chemically synthesized
ctgtttactggtggattctcag

SEQ ID NO: 774728 - DNA, 22 bp, Artificial Sequence
  chemically synthesized
cctgtttactggtggattctca

SEQ ID NO: 774729 - DNA, 22 bp, Artificial Sequence
  chemically synthesized
tcctgtttactggtggattctc

SEQ ID NO: 774730 - DNA, 22 bp, Artificial Sequence
  chemically synthesized
gatactgagaatccaccagtaa

SEQ ID NO: 774731 - DNA, 22 bp, Artificial Sequence
  chemically synthesized
tgtctttcctgtttactggtgg

SEQ ID NO: 774732 - DNA, 22 bp, Artificial Sequence
  chemically synthesized
agaatccaccagtaaacaggaa

SEQ ID NO: 774733 - DNA, 22 bp, Artificial Sequence
  chemically synthesized
aaatgtaaccaaccacaaagat

SEQ ID NO: 774734 - DNA, 22 bp, Artificial Sequence
  chemically synthesized
ctaaaatgtaaccaaccacaaa

SEQ ID NO: 774735 - DNA, 22 bp, Artificial Sequence
  chemically synthesized
tactaaaatgtaaccaaccaca

SEQ ID NO: 774736 - DNA, 22 bp, Artificial Sequence
  chemically synthesized
tctactaaaatgtaaccaacca

SEQ ID NO: 774737 - DNA, 22 bp, Artificial Sequence
  chemically synthesized
ctctactaaaatgtaaccaacc

SEQ ID NO: 774738 - DNA, 22 bp, Artificial Sequence
  chemically synthesized
acttctctactaaaatgtaacc

SEQ ID NO: 774739 - DNA, 22 bp, Artificial Sequence
  chemically synthesized
tctttgtggttggttacatttt

SEQ ID NO: 774740 - DNA, 22 bp, Artificial Sequence
  chemically synthesized
tgtggttggttacattttagta

SEQ ID NO: 774741 - DNA, 22 bp, Artificial Sequence
  chemically synthesized
gtggttggttacattttagtag

SEQ ID NO: 774742 - DNA, 22 bp, Artificial Sequence
  chemically synthesized
tggttggttacattttagtaga

SEQ ID NO: 774743 - DNA, 22 bp, Artificial Sequence
  chemically synthesized
agtgcctcacttctctactaaa

SEQ ID NO: 774744 - DNA, 22 bp, Artificial Sequence
  chemically synthesized
ttcagtgcctcacttctctact

SEQ ID NO: 774745 - DNA, 22 bp, Artificial Sequence
  chemically synthesized
gttacattttagtagagaagtg

SEQ ID NO: 774746 - DNA, 22 bp, Artificial Sequence
  chemically synthesized
cattttagtagagaagtgaggc

SEQ ID NO: 774747 - DNA, 22 bp, Artificial Sequence
  chemically synthesized
acatcattgttcagtgcctcac

SEQ ID NO: 774748 - DNA, 22 bp, Artificial Sequence
  chemically synthesized
tagtagagaagtgaggcactga

SEQ ID NO: 774749 - DNA, 22 bp, Artificial Sequence
  chemically synthesized
agtagagaagtgaggcactgaa

SEQ ID NO: 774750 - DNA, 22 bp, Artificial Sequence
  chemically synthesized
gtagagaagtgaggcactgaac

SEQ ID NO: 774751 - DNA, 22 bp, Artificial Sequence
  chemically synthesized
aaaacactcacatcattgttca

SEQ ID NO: 774752 - DNA, 22 bp, Artificial Sequence
  chemically synthesized
caaaacactcacatcattgttc

SEQ ID NO: 774753 - DNA, 22 bp, Artificial Sequence
  chemically synthesized
tcaaaacactcacatcattgtt

SEQ ID NO: 774754 - DNA, 22 bp, Artificial Sequence
  chemically synthesized
tttcaaaacactcacatcattg

SEQ ID NO: 774755 - DNA, 22 bp, Artificial Sequence
  chemically synthesized
ctctttcaaaacactcacatca

SEQ ID NO: 774756 - DNA, 22 bp, Artificial Sequence
  chemically synthesized
cctctttcaaaacactcacatc

SEQ ID NO: 774757 - DNA, 22 bp, Artificial Sequence
  chemically synthesized
tacttcctctttcaaaacactc

SEQ ID NO: 774758 - DNA, 22 bp, Artificial Sequence
  chemically synthesized
aacaatgatgtgagtgttttga

SEQ ID NO: 774759 - DNA, 22 bp, Artificial Sequence
  chemically synthesized
gtacttcctctttcaaaacact

SEQ ID NO: 774760 - DNA, 22 bp, Artificial Sequence
  chemically synthesized
cttgtacttcctctttcaaaac

SEQ ID NO: 774761 - DNA, 22 bp, Artificial Sequence
  chemically synthesized
agaagttccttgtacttcctct

SEQ ID NO: 774762 - DNA, 22 bp, Artificial Sequence
  chemically synthesized
tgaaagaggaagtacaaggaac

SEQ ID NO: 774763 - DNA, 22 bp, Artificial Sequence
  chemically synthesized
gaaagaggaagtacaaggaact

SEQ ID NO: 774764 - DNA, 22 bp, Artificial Sequence
  chemically synthesized
ccacccctaagaagttccttgt

SEQ ID NO: 774765 - DNA, 22 bp, Artificial Sequence
  chemically synthesized
aaagaggaagtacaaggaactt

SEQ ID NO: 774766 - DNA, 22 bp, Artificial Sequence
  chemically synthesized
cccctcccacccctaagaagtt

SEQ ID NO: 774767 - DNA, 22 bp, Artificial Sequence
  chemically synthesized
gggtcatcggctacccctccca

SEQ ID NO: 774768 - DNA, 22 bp, Artificial Sequence
  chemically synthesized
ggggtcatcggctacccctccc

SEQ ID NO: 774769 - DNA, 22 bp, Artificial Sequence
  chemically synthesized
cttaggggtgggaggggtagcc

SEQ ID NO: 774770 - DNA, 22 bp, Artificial Sequence
  chemically synthesized
ttaggggtgggaggggtagccg

SEQ ID NO: 774771 - DNA, 22 bp, Artificial Sequence
  chemically synthesized
aggggtgggaggggtagccgat

SEQ ID NO: 774772 - DNA, 22 bp, Artificial Sequence
  chemically synthesized
ggggtgggaggggtagccgatg

SEQ ID NO: 774773 - DNA, 22 bp, Artificial Sequence
  chemically synthesized
tcaaaaatttggggtcatcggc

SEQ ID NO: 774774 - DNA, 22 bp, Artificial Sequence
  chemically synthesized
cgagtggcaattgtcaaaaatt

SEQ ID NO: 774775 - DNA, 22 bp, Artificial Sequence
  chemically synthesized
ccgagtggcaattgtcaaaaat

SEQ ID NO: 774776 - DNA, 22 bp, Artificial Sequence
  chemically synthesized
tttccgagtggcaattgtcaaa

SEQ ID NO: 774777 - DNA, 22 bp, Artificial Sequence
  chemically synthesized
tgtttccgagtggcaattgtca

SEQ ID NO: 774778 - DNA, 22 bp, Artificial Sequence
  chemically synthesized
tattctgtttccgagtggcaat

SEQ ID NO: 774779 - DNA, 22 bp, Artificial Sequence
  chemically synthesized
tatattctgtttccgagtggca

SEQ ID NO: 774780 - DNA, 22 bp, Artificial Sequence
  chemically synthesized
ttgacaattgccactcggaaac

SEQ ID NO: 774781 - DNA, 22 bp, Artificial Sequence
  chemically synthesized
tgacaattgccactcggaaaca

SEQ ID NO: 774782 - DNA, 22 bp, Artificial Sequence
  chemically synthesized
atctctatattctgtttccgag

SEQ ID NO: 774783 - DNA, 22 bp, Artificial Sequence
  chemically synthesized
gacaattgccactcggaaacag

SEQ ID NO: 774784 - DNA, 22 bp, Artificial Sequence
  chemically synthesized
acaattgccactcggaaacaga

SEQ ID NO: 774785 - DNA, 22 bp, Artificial Sequence
  chemically synthesized
ccactcggaaacagaatataga

SEQ ID NO: 774786 - DNA, 22 bp, Artificial Sequence
  chemically synthesized
tcacaaattgatctctatattc

SEQ ID NO: 774787 - DNA, 22 bp, Artificial Sequence
  chemically synthesized
ggaaacagaatatagagatcaa

SEQ ID NO: 774788 - DNA, 22 bp, Artificial Sequence
  chemically synthesized
cagaaagttatcacaaattgat

SEQ ID NO: 774789 - DNA, 22 bp, Artificial Sequence
  chemically synthesized
gatgcagaatagctgcagaaag

SEQ ID NO: 774790 - DNA, 22 bp, Artificial Sequence
  chemically synthesized
gtgataactttctgcagctatt

SEQ ID NO: 774791 - DNA, 22 bp, Artificial Sequence
  chemically synthesized
tgataactttctgcagctattc

SEQ ID NO: 774792 - DNA, 22 bp, Artificial Sequence
  chemically synthesized
gatatccagcctggatgcagaa

SEQ ID NO: 774793 - DNA, 22 bp, Artificial Sequence
  chemically synthesized
ggatatccagcctggatgcaga

SEQ ID NO: 774794 - DNA, 22 bp, Artificial Sequence
  chemically synthesized
tctgcagctattctgcatccag

SEQ ID NO: 774795 - DNA, 22 bp, Artificial Sequence
  chemically synthesized
tggatatccagcctggatgcag

SEQ ID NO: 774796 - DNA, 22 bp, Artificial Sequence
  chemically synthesized
ctgcagctattctgcatccagg

SEQ ID NO: 774797 - DNA, 22 bp, Artificial Sequence
  chemically synthesized
tgcagctattctgcatccaggc

SEQ ID NO: 774798 - DNA, 22 bp, Artificial Sequence
  chemically synthesized
ttttggatatccagcctggatg

SEQ ID NO: 774799 - DNA, 22 bp, Artificial Sequence
  chemically synthesized
cagctattctgcatccaggctg

SEQ ID NO: 774800 - DNA, 22 bp, Artificial Sequence
  chemically synthesized
gttttggatatccagcctggat

SEQ ID NO: 774801 - DNA, 22 bp, Artificial Sequence
  chemically synthesized
ttctgcatccaggctggatatc

SEQ ID NO: 774802 - DNA, 22 bp, Artificial Sequence
  chemically synthesized
tgcatccaggctggatatccaa

SEQ ID NO: 774803 - DNA, 22 bp, Artificial Sequence
  chemically synthesized
catccaggctggatatccaaaa

SEQ ID NO: 774804 - DNA, 22 bp, Artificial Sequence
  chemically synthesized
cagcaatccagtgtttgttttg

SEQ ID NO: 774805 - DNA, 22 bp, Artificial Sequence
  chemically synthesized
ccagcaatccagtgtttgtttt

SEQ ID NO: 774806 - DNA, 22 bp, Artificial Sequence
  chemically synthesized
tccagcaatccagtgtttgttt

SEQ ID NO: 774807 - DNA, 22 bp, Artificial Sequence
  chemically synthesized
gatatccaaaacaaacactgga

SEQ ID NO: 774808 - DNA, 22 bp, Artificial Sequence
  chemically synthesized
agttttccagcaatccagtgtt

SEQ ID NO: 774809 - DNA, 22 bp, Artificial Sequence
  chemically synthesized
ctaagttttccagcaatccagt

SEQ ID NO: 774810 - DNA, 22 bp, Artificial Sequence
  chemically synthesized
aattcctaagttttccagcaat

SEQ ID NO: 774811 - DNA, 22 bp, Artificial Sequence
  chemically synthesized
tgaatattaaattcctaagttt

SEQ ID NO: 774812 - DNA, 22 bp, Artificial Sequence
  chemically synthesized
gtgaatattaaattcctaagtt

SEQ ID NO: 774813 - DNA, 22 bp, Artificial Sequence
  chemically synthesized
gattgctggaaaacttaggaat

SEQ ID NO: 774814 - DNA, 22 bp, Artificial Sequence
  chemically synthesized
ctggaaaacttaggaatttaat

SEQ ID NO: 774815 - DNA, 22 bp, Artificial Sequence
  chemically synthesized
gaaaacttaggaatttaatatt

SEQ ID NO: 774816 - DNA, 22 bp, Artificial Sequence
  chemically synthesized
gaatatcgatttgtgaatatta

SEQ ID NO: 774817 - DNA, 22 bp, Artificial Sequence
  chemically synthesized
agaatatcgatttgtgaatatt

SEQ ID NO: 774818 - DNA, 22 bp, Artificial Sequence
  chemically synthesized
tagaatatcgatttgtgaatat

SEQ ID NO: 774819 - DNA, 22 bp, Artificial Sequence
  chemically synthesized
aggaatttaatattcacaaatc

SEQ ID NO: 774820 - DNA, 22 bp, Artificial Sequence
  chemically synthesized
ttttagaatatcgatttgtgaa

SEQ ID NO: 774821 - DNA, 22 bp, Artificial Sequence
  chemically synthesized
ggaatttaatattcacaaatcg

SEQ ID NO: 774822 - DNA, 22 bp, Artificial Sequence
  chemically synthesized
attttagaatatcgatttgtga

SEQ ID NO: 774823 - DNA, 22 bp, Artificial Sequence
  chemically synthesized
cttattttagaatatcgatttg

SEQ ID NO: 774824 - DNA, 22 bp, Artificial Sequence
  chemically synthesized
acttattttagaatatcgattt

SEQ ID NO: 774825 - DNA, 22 bp, Artificial Sequence
  chemically synthesized
tacttattttagaatatcgatt

SEQ ID NO: 774826 - DNA, 22 bp, Artificial Sequence
  chemically synthesized
ttacttattttagaatatcgat

SEQ ID NO: 774827 - DNA, 22 bp, Artificial Sequence
  chemically synthesized
aatattcacaaatcgatattct

SEQ ID NO: 774828 - DNA, 22 bp, Artificial Sequence
  chemically synthesized
atattcacaaatcgatattcta

SEQ ID NO: 774829 - DNA, 22 bp, Artificial Sequence
  chemically synthesized
tttttacttattttagaatatc

SEQ ID NO: 774830 - DNA, 22 bp, Artificial Sequence
  chemically synthesized
attgtttttacttattttagaa

SEQ ID NO: 774831 - DNA, 22 bp, Artificial Sequence
  chemically synthesized
acaaatcgatattctaaaataa

SEQ ID NO: 774832 - DNA, 22 bp, Artificial Sequence
  chemically synthesized
taattgtttttacttattttag

SEQ ID NO: 774833 - DNA, 22 bp, Artificial Sequence
  chemically synthesized
ctaattgtttttacttatttta

SEQ ID NO: 774834 - DNA, 22 bp, Artificial Sequence
  chemically synthesized
tctaattgtttttacttatttt

SEQ ID NO: 774835 - DNA, 22 bp, Artificial Sequence
  chemically synthesized
ttctaattgtttttacttattt

SEQ ID NO: 774836 - DNA, 22 bp, Artificial Sequence
  chemically synthesized
tcttttctaattgtttttactt

SEQ ID NO: 774837 - DNA, 22 bp, Artificial Sequence
  chemically synthesized
taaaataagtaaaaacaattag

SEQ ID NO: 774838 - DNA, 22 bp, Artificial Sequence
  chemically synthesized
aaataagtaaaaacaattagaa

SEQ ID NO: 774839 - DNA, 22 bp, Artificial Sequence
  chemically synthesized
tgtgaatctgtcttttctaatt

SEQ ID NO: 774840 - DNA, 22 bp, Artificial Sequence
  chemically synthesized
tgtgtgaatctgtcttttctaa

SEQ ID NO: 774841 - DNA, 22 bp, Artificial Sequence
  chemically synthesized
ctctgtgtgaatctgtcttttc

SEQ ID NO: 774842 - DNA, 22 bp, Artificial Sequence
  chemically synthesized
ttactctgtgtgaatctgtctt

SEQ ID NO: 774843 - DNA, 22 bp, Artificial Sequence
  chemically synthesized
gaaaagacagattcacacagag

SEQ ID NO: 774844 - DNA, 22 bp, Artificial Sequence
  chemically synthesized
aaatggttattactctgtgtga

SEQ ID NO: 774845 - DNA, 22 bp, Artificial Sequence
  chemically synthesized
agattcaaatggttattactct

SEQ ID NO: 774846 - DNA, 22 bp, Artificial Sequence
  chemically synthesized
ttgagattcaaatggttattac

SEQ ID NO: 774847 - DNA, 22 bp, Artificial Sequence
  chemically synthesized
acacagagtaataaccatttga

SEQ ID NO: 774848 - DNA, 22 bp, Artificial Sequence
  chemically synthesized
gtatctattgagattcaaatgg

SEQ ID NO: 774849 - DNA, 22 bp, Artificial Sequence
  chemically synthesized
taactagtatctattgagattc

SEQ ID NO: 774850 - DNA, 22 bp, Artificial Sequence
  chemically synthesized
ataactagtatctattgagatt

SEQ ID NO: 774851 - DNA, 22 bp, Artificial Sequence
  chemically synthesized
tataactagtatctattgagat

SEQ ID NO: 774852 - DNA, 22 bp, Artificial Sequence
  chemically synthesized
gaatctcaatagatactagtta

SEQ ID NO: 774853 - DNA, 22 bp, Artificial Sequence
  chemically synthesized
aatctcaatagatactagttat

SEQ ID NO: 774854 - DNA, 22 bp, Artificial Sequence
  chemically synthesized
aaggtccgtatcattttataac

SEQ ID NO: 774855 - DNA, 22 bp, Artificial Sequence
  chemically synthesized
aatagatactagttataaaatg

SEQ ID NO: 774856 - DNA, 22 bp, Artificial Sequence
  chemically synthesized
aaaggtccgtatcattttataa

SEQ ID NO: 774857 - DNA, 22 bp, Artificial Sequence
  chemically synthesized
atttaaaggtccgtatcatttt

SEQ ID NO: 774858 - DNA, 22 bp, Artificial Sequence
  chemically synthesized
gttataaaatgatacggacctt

SEQ ID NO: 774859 - DNA, 22 bp, Artificial Sequence
  chemically synthesized
taaaatgatacggacctttaaa

SEQ ID NO: 774860 - DNA, 22 bp, Artificial Sequence
  chemically synthesized
gacatcagaagatgtactgatt

SEQ ID NO: 774861 - DNA, 22 bp, Artificial Sequence
  chemically synthesized
agacatcagaagatgtactgat

SEQ ID NO: 774862 - DNA, 22 bp, Artificial Sequence
  chemically synthesized
tagacatcagaagatgtactga

SEQ ID NO: 774863 - DNA, 22 bp, Artificial Sequence
  chemically synthesized
ttagacatcagaagatgtactg

SEQ ID NO: 774864 - DNA, 22 bp, Artificial Sequence
  chemically synthesized
taaatcagtacatcttctgatg

SEQ ID NO: 774865 - DNA, 22 bp, Artificial Sequence
  chemically synthesized
aaatcagtacatcttctgatgt

SEQ ID NO: 774866 - DNA, 22 bp, Artificial Sequence
  chemically synthesized
aatcagtacatcttctgatgtc

SEQ ID NO: 774867 - DNA, 22 bp, Artificial Sequence
  chemically synthesized
gtgagtagtgataagcatcttt

SEQ ID NO: 774868 - DNA, 22 bp, Artificial Sequence
  chemically synthesized
ctgatgtctaaaagatgcttat

SEQ ID NO: 774869 - DNA, 22 bp, Artificial Sequence
  chemically synthesized
tgatgtctaaaagatgcttatc

SEQ ID NO: 774870 - DNA, 22 bp, Artificial Sequence
  chemically synthesized
atgtctaaaagatgcttatcac

SEQ ID NO: 774871 - DNA, 22 bp, Artificial Sequence
  chemically synthesized
aaagatgcttatcactactcac

SEQ ID NO: 774872 - DNA, 22 bp, Artificial Sequence
  chemically synthesized
atcactactcactagactcttt

SEQ ID NO: 774873 - DNA, 22 bp, Artificial Sequence
  chemically synthesized
tcactactcactagactctttt

SEQ ID NO: 774874 - DNA, 22 bp, Artificial Sequence
  chemically synthesized
caaagcaagtgaaaaagagtct

SEQ ID NO: 774875 - DNA, 22 bp, Artificial Sequence
  chemically synthesized
gcaaagcaagtgaaaaagagtc

SEQ ID NO: 774876 - DNA, 22 bp, Artificial Sequence
  chemically synthesized
atttgcaaagcaagtgaaaaag

SEQ ID NO: 774877 - DNA, 22 bp, Artificial Sequence
  chemically synthesized
ctcactagactctttttcactt

SEQ ID NO: 774878 - DNA, 22 bp, Artificial Sequence
  chemically synthesized
actagactctttttcacttgct

SEQ ID NO: 774879 - DNA, 22 bp, Artificial Sequence
  chemically synthesized
aactgatttgcaaagcaagtga

SEQ ID NO: 774880 - DNA, 22 bp, Artificial Sequence
  chemically synthesized
aaactgatttgcaaagcaagtg

SEQ ID NO: 774881 - DNA, 22 bp, Artificial Sequence
  chemically synthesized
gactctttttcacttgctttgc

SEQ ID NO: 774882 - DNA, 22 bp, Artificial Sequence
  chemically synthesized
tttttcacttgctttgcaaatc

SEQ ID NO: 774883 - DNA, 22 bp, Artificial Sequence
  chemically synthesized
tttcacttgctttgcaaatcag

SEQ ID NO: 774884 - DNA, 22 bp, Artificial Sequence
  chemically synthesized
ttcacttgctttgcaaatcagt

SEQ ID NO: 774885 - DNA, 22 bp, Artificial Sequence
  chemically synthesized
tcacttgctttgcaaatcagtt

SEQ ID NO: 774886 - DNA, 22 bp, Artificial Sequence
  chemically synthesized
cacttgctttgcaaatcagttt

SEQ ID NO: 774887 - DNA, 22 bp, Artificial Sequence
  chemically synthesized
ccatgtatgtttaaactgattt

SEQ ID NO: 774888 - DNA, 22 bp, Artificial Sequence
  chemically synthesized
acttgctttgcaaatcagttta

SEQ ID NO: 774889 - DNA, 22 bp, Artificial Sequence
  chemically synthesized
attaccatgtatgtttaaactg

SEQ ID NO: 774890 - DNA, 22 bp, Artificial Sequence
  chemically synthesized
gctttgcaaatcagtttaaaca

SEQ ID NO: 774891 - DNA, 22 bp, Artificial Sequence
  chemically synthesized
ctttgcaaatcagtttaaacat

SEQ ID NO: 774892 - DNA, 22 bp, Artificial Sequence
  chemically synthesized
ctgattaccatgtatgtttaaa

SEQ ID NO: 774893 - DNA, 22 bp, Artificial Sequence
  chemically synthesized
tgcaaatcagtttaaacataca

SEQ ID NO: 774894 - DNA, 22 bp, Artificial Sequence
  chemically synthesized
gcaaatcagtttaaacatacat

SEQ ID NO: 774895 - DNA, 22 bp, Artificial Sequence
  chemically synthesized
caaatcagtttaaacatacatg

SEQ ID NO: 774896 - DNA, 22 bp, Artificial Sequence
  chemically synthesized
aaacatacatggtaatcaggag

SEQ ID NO: 774897 - DNA, 22 bp, Artificial Sequence
  chemically synthesized
aacatacatggtaatcaggagt

SEQ ID NO: 774898 - DNA, 22 bp, Artificial Sequence
  chemically synthesized
caagtgaataaaaataatgact

SEQ ID NO: 774899 - DNA, 22 bp, Artificial Sequence
  chemically synthesized
ccaagtgaataaaaataatgac

SEQ ID NO: 774900 - DNA, 22 bp, Artificial Sequence
  chemically synthesized
tccaagtgaataaaaataatga

SEQ ID NO: 774901 - DNA, 22 bp, Artificial Sequence
  chemically synthesized
actttccaagtgaataaaaata

SEQ ID NO: 774902 - DNA, 22 bp, Artificial Sequence
  chemically synthesized
tgactttccaagtgaataaaaa

SEQ ID NO: 774903 - DNA, 22 bp, Artificial Sequence
  chemically synthesized
ctgactttccaagtgaataaaa

SEQ ID NO: 774904 - DNA, 22 bp, Artificial Sequence
  chemically synthesized
tttttattcacttggaaagtca

SEQ ID NO: 774905 - DNA, 22 bp, Artificial Sequence
  chemically synthesized
ggaaaaggtacttctgactttc

SEQ ID NO: 774906 - DNA, 22 bp, Artificial Sequence
  chemically synthesized
ttattcacttggaaagtcagaa

SEQ ID NO: 774907 - DNA, 22 bp, Artificial Sequence
  chemically synthesized
tattcacttggaaagtcagaag

SEQ ID NO: 774908 - DNA, 22 bp, Artificial Sequence
  chemically synthesized
attcacttggaaagtcagaagt

SEQ ID NO: 774909 - DNA, 22 bp, Artificial Sequence
  chemically synthesized
ttcacttggaaagtcagaagta

SEQ ID NO: 774910 - DNA, 22 bp, Artificial Sequence
  chemically synthesized
actgggaaaaggtacttctgac

SEQ ID NO: 774911 - DNA, 22 bp, Artificial Sequence
  chemically synthesized
acttggaaagtcagaagtacct

SEQ ID NO: 774912 - DNA, 22 bp, Artificial Sequence
  chemically synthesized
ggaaagtcagaagtaccttttc

SEQ ID NO: 774913 - DNA, 22 bp, Artificial Sequence
  chemically synthesized
gaaagtcagaagtaccttttcc

SEQ ID NO: 774914 - DNA, 22 bp, Artificial Sequence
  chemically synthesized
aaaatctcactgggaaaaggta

SEQ ID NO: 774915 - DNA, 22 bp, Artificial Sequence
  chemically synthesized
caaaatctcactgggaaaaggt

SEQ ID NO: 774916 - DNA, 22 bp, Artificial Sequence
  chemically synthesized
cttcaaaatctcactgggaaaa

SEQ ID NO: 774917 - DNA, 22 bp, Artificial Sequence
  chemically synthesized
ccttcaaaatctcactgggaaa

SEQ ID NO: 774918 - DNA, 22 bp, Artificial Sequence
  chemically synthesized
tccttcaaaatctcactgggaa

SEQ ID NO: 774919 - DNA, 22 bp, Artificial Sequence
  chemically synthesized
ttccttcaaaatctcactggga

SEQ ID NO: 774920 - DNA, 22 bp, Artificial Sequence
  chemically synthesized
cttttccttcaaaatctcactg

SEQ ID NO: 774921 - DNA, 22 bp, Artificial Sequence
  chemically synthesized
acttttccttcaaaatctcact

SEQ ID NO: 774922 - DNA, 22 bp, Artificial Sequence
  chemically synthesized
tacttttccttcaaaatctcac

SEQ ID NO: 774923 - DNA, 22 bp, Artificial Sequence
  chemically synthesized
ttcccagtgagattttgaagga

SEQ ID NO: 774924 - DNA, 22 bp, Artificial Sequence
  chemically synthesized
tcccagtgagattttgaaggaa

SEQ ID NO: 774925 - DNA, 22 bp, Artificial Sequence
  chemically synthesized
cccagtgagattttgaaggaaa

SEQ ID NO: 774926 - DNA, 22 bp, Artificial Sequence
  chemically synthesized
ccagtgagattttgaaggaaaa

SEQ ID NO: 774927 - DNA, 22 bp, Artificial Sequence
  chemically synthesized
caaatgaagggtgttttacttt

SEQ ID NO: 774928 - DNA, 22 bp, Artificial Sequence
  chemically synthesized
tgaaggaaaagtaaaacaccct

SEQ ID NO: 774929 - DNA, 22 bp, Artificial Sequence
  chemically synthesized
gaaggaaaagtaaaacaccctt

SEQ ID NO: 774930 - DNA, 22 bp, Artificial Sequence
  chemically synthesized
aaggaaaagtaaaacacccttc

SEQ ID NO: 774931 - DNA, 22 bp, Artificial Sequence
  chemically synthesized
gacacccataaaatctccaaat

SEQ ID NO: 774932 - DNA, 22 bp, Artificial Sequence
  chemically synthesized
agacacccataaaatctccaaa

SEQ ID NO: 774933 - DNA, 22 bp, Artificial Sequence
  chemically synthesized
catttggagattttatgggtgt

SEQ ID NO: 774934 - DNA, 22 bp, Artificial Sequence
  chemically synthesized
atttggagattttatgggtgtc

SEQ ID NO: 774935 - DNA, 22 bp, Artificial Sequence
  chemically synthesized
ggagattttatgggtgtctaaa

SEQ ID NO: 774936 - DNA, 22 bp, Artificial Sequence
  chemically synthesized
gaaaagcacatgtttagacacc

SEQ ID NO: 774937 - DNA, 22 bp, Artificial Sequence
  chemically synthesized
gagattttatgggtgtctaaac

SEQ ID NO: 774938 - DNA, 22 bp, Artificial Sequence
  chemically synthesized
agaaaagcacatgtttagacac

SEQ ID NO: 774939 - DNA, 22 bp, Artificial Sequence
  chemically synthesized
tttagaaaagcacatgtttaga

SEQ ID NO: 774940 - DNA, 22 bp, Artificial Sequence
  chemically synthesized
ctgtttagaaaagcacatgttt

SEQ ID NO: 774941 - DNA, 22 bp, Artificial Sequence
  chemically synthesized
tatgggtgtctaaacatgtgct

SEQ ID NO: 774942 - DNA, 22 bp, Artificial Sequence
  chemically synthesized
cctgtttagaaaagcacatgtt

SEQ ID NO: 774943 - DNA, 22 bp, Artificial Sequence
  chemically synthesized
atgggtgtctaaacatgtgctt

SEQ ID NO: 774944 - DNA, 22 bp, Artificial Sequence
  chemically synthesized
tgggtgtctaaacatgtgcttt

SEQ ID NO: 774945 - DNA, 22 bp, Artificial Sequence
  chemically synthesized
aacatgtgcttttctaaacagg

SEQ ID NO: 774946 - DNA, 22 bp, Artificial Sequence
  chemically synthesized
ataagtcataaatcatttcctg

SEQ ID NO: 774947 - DNA, 22 bp, Artificial Sequence
  chemically synthesized
gataagtcataaatcatttcct

SEQ ID NO: 774948 - DNA, 22 bp, Artificial Sequence
  chemically synthesized
tgataagtcataaatcatttcc

SEQ ID NO: 774949 - DNA, 22 bp, Artificial Sequence
  chemically synthesized
ttctaaacaggaaatgatttat

SEQ ID NO: 774950 - DNA, 22 bp, Artificial Sequence
  chemically synthesized
tctaaacaggaaatgatttatg

SEQ ID NO: 774951 - DNA, 22 bp, Artificial Sequence
  chemically synthesized
ctaaacaggaaatgatttatga

SEQ ID NO: 774952 - DNA, 22 bp, Artificial Sequence
  chemically synthesized
taaacaggaaatgatttatgac

SEQ ID NO: 774953 - DNA, 22 bp, Artificial Sequence
  chemically synthesized
aacaggaaatgatttatgactt

SEQ ID NO: 774954 - DNA, 22 bp, Artificial Sequence
  chemically synthesized
aggcatatcctttgataagtca

SEQ ID NO: 774955 - DNA, 22 bp, Artificial Sequence
  chemically synthesized
atgacttatcaaaggatatgcc

SEQ ID NO: 774956 - DNA, 22 bp, Artificial Sequence
  chemically synthesized
tgacttatcaaaggatatgcct

SEQ ID NO: 774957 - DNA, 22 bp, Artificial Sequence
  chemically synthesized
ggtgagagactcaggcatatcc

SEQ ID NO: 774958 - DNA, 22 bp, Artificial Sequence
  chemically synthesized
atcaaaggatatgcctgagtct

SEQ ID NO: 774959 - DNA, 22 bp, Artificial Sequence
  chemically synthesized
tcaaaggatatgcctgagtctc

SEQ ID NO: 774960 - DNA, 22 bp, Artificial Sequence
  chemically synthesized
gagattaggtgagagactcagg

SEQ ID NO: 774961 - DNA, 22 bp, Artificial Sequence
  chemically synthesized
agagattaggtgagagactcag

SEQ ID NO: 774962 - DNA, 22 bp, Artificial Sequence
  chemically synthesized
ggtttagagattaggtgagaga

SEQ ID NO: 774963 - DNA, 22 bp, Artificial Sequence
  chemically synthesized
agtctctcacctaatctctaaa

SEQ ID NO: 774964 - DNA, 22 bp, Artificial Sequence
  chemically synthesized
tcacctaatctctaaacccagc

SEQ ID NO: 774965 - DNA, 22 bp, Artificial Sequence
  chemically synthesized
acctaatctctaaacccagctg

SEQ ID NO: 774966 - DNA, 22 bp, Artificial Sequence
  chemically synthesized
gagaaatggagaaagtcagctg

SEQ ID NO: 774967 - DNA, 22 bp, Artificial Sequence
  chemically synthesized
atctctaaacccagctgacttt

SEQ ID NO: 774968 - DNA, 22 bp, Artificial Sequence
  chemically synthesized
taaacccagctgactttctcca

SEQ ID NO: 774969 - DNA, 22 bp, Artificial Sequence
  chemically synthesized
agtgttagagaaatggagaaag

SEQ ID NO: 774970 - DNA, 22 bp, Artificial Sequence
  chemically synthesized
aacccagctgactttctccatt

SEQ ID NO: 774971 - DNA, 22 bp, Artificial Sequence
  chemically synthesized
cgctcagtgttagagaaatgga

SEQ ID NO: 774972 - DNA, 22 bp, Artificial Sequence
  chemically synthesized
ctacgctcagtgttagagaaat

SEQ ID NO: 774973 - DNA, 22 bp, Artificial Sequence
  chemically synthesized
gctacgctcagtgttagagaaa

SEQ ID NO: 774974 - DNA, 22 bp, Artificial Sequence
  chemically synthesized
tgctacgctcagtgttagagaa

SEQ ID NO: 774975 - DNA, 22 bp, Artificial Sequence
  chemically synthesized
actttctccatttctctaacac

SEQ ID NO: 774976 - DNA, 22 bp, Artificial Sequence
  chemically synthesized
ttgctacgctcagtgttagaga

SEQ ID NO: 774977 - DNA, 22 bp, Artificial Sequence
  chemically synthesized
cttttgctacgctcagtgttag

SEQ ID NO: 774978 - DNA, 22 bp, Artificial Sequence
  chemically synthesized
tctccatttctctaacactgag

SEQ ID NO: 774979 - DNA, 22 bp, Artificial Sequence
  chemically synthesized
ctccatttctctaacactgagc

SEQ ID NO: 774980 - DNA, 22 bp, Artificial Sequence
  chemically synthesized
tccatttctctaacactgagcg

SEQ ID NO: 774981 - DNA, 22 bp, Artificial Sequence
  chemically synthesized
catttctctaacactgagcgta

SEQ ID NO: 774982 - DNA, 22 bp, Artificial Sequence
  chemically synthesized
ctctaacactgagcgtagcaaa

SEQ ID NO: 774983 - DNA, 22 bp, Artificial Sequence
  chemically synthesized
tctaacactgagcgtagcaaaa

SEQ ID NO: 774984 - DNA, 22 bp, Artificial Sequence
  chemically synthesized
taacactgagcgtagcaaaagg

SEQ ID NO: 774985 - DNA, 22 bp, Artificial Sequence
  chemically synthesized
atcaagagcgtctccttttgct

SEQ ID NO: 774986 - DNA, 22 bp, Artificial Sequence
  chemically synthesized
acactgagcgtagcaaaaggag

SEQ ID NO: 774987 - DNA, 22 bp, Artificial Sequence
  chemically synthesized
gctaatcaagagcgtctccttt

SEQ ID NO: 774988 - DNA, 22 bp, Artificial Sequence
  chemically synthesized
ggctaatcaagagcgtctcctt

SEQ ID NO: 774989 - DNA, 22 bp, Artificial Sequence
  chemically synthesized
agcgtagcaaaaggagacgctc

SEQ ID NO: 774990 - DNA, 22 bp, Artificial Sequence
  chemically synthesized
ttggctaatcaagagcgtctcc

SEQ ID NO: 774991 - DNA, 22 bp, Artificial Sequence
  chemically synthesized
gtgtatgagcagcagtgtctct

SEQ ID NO: 774992 - DNA, 22 bp, Artificial Sequence
  chemically synthesized
ttgattagccaagagacactgc

SEQ ID NO: 774993 - DNA, 22 bp, Artificial Sequence
  chemically synthesized
gattagccaagagacactgctg

SEQ ID NO: 774994 - DNA, 22 bp, Artificial Sequence
  chemically synthesized
attagccaagagacactgctgc

SEQ ID NO: 774995 - DNA, 22 bp, Artificial Sequence
  chemically synthesized
gccaagagacactgctgctcat

SEQ ID NO: 774996 - DNA, 22 bp, Artificial Sequence
  chemically synthesized
agtcaaatataggttggtgtat

SEQ ID NO: 774997 - DNA, 22 bp, Artificial Sequence
  chemically synthesized
ctgctcatacaccaacctatat

SEQ ID NO: 774998 - DNA, 22 bp, Artificial Sequence
  chemically synthesized
ctcatacaccaacctatatttg

SEQ ID NO: 774999 - DNA, 22 bp, Artificial Sequence
  chemically synthesized
cccaaccctgagtcaaatatag

SEQ ID NO: 775000 - DNA, 22 bp, Artificial Sequence
  chemically synthesized
atacaccaacctatatttgact

SEQ ID NO: 775001 - DNA, 22 bp, Artificial Sequence
  chemically synthesized
acaattccccaaccctgagtca

SEQ ID NO: 775002 - DNA, 22 bp, Artificial Sequence
  chemically synthesized
cacaattccccaaccctgagtc

SEQ ID NO: 775003 - DNA, 22 bp, Artificial Sequence
  chemically synthesized
tttcacaattccccaaccctga

SEQ ID NO: 775004 - DNA, 22 bp, Artificial Sequence
  chemically synthesized
tatttgactcagggttggggaa

SEQ ID NO: 775005 - DNA, 22 bp, Artificial Sequence
  chemically synthesized
ggttgtttcacaattccccaac

SEQ ID NO: 775006 - DNA, 22 bp, Artificial Sequence
  chemically synthesized
aggttgtttcacaattccccaa

SEQ ID NO: 775007 - DNA, 22 bp, Artificial Sequence
  chemically synthesized
gactcagggttggggaattgtg

SEQ ID NO: 775008 - DNA, 22 bp, Artificial Sequence
  chemically synthesized
actcagggttggggaattgtga

SEQ ID NO: 775009 - DNA, 22 bp, Artificial Sequence
  chemically synthesized
catttaggttgtttcacaattc

SEQ ID NO: 775010 - DNA, 22 bp, Artificial Sequence
  chemically synthesized
agggttggggaattgtgaaaca

SEQ ID NO: 775011 - DNA, 22 bp, Artificial Sequence
  chemically synthesized
aaagtgctgcatttaggttgtt

SEQ ID NO: 775012 - DNA, 22 bp, Artificial Sequence
  chemically synthesized
gggaattgtgaaacaacctaaa

SEQ ID NO: 775013 - DNA, 22 bp, Artificial Sequence
  chemically synthesized
atctaaaagtgctgcatttagg

SEQ ID NO: 775014 - DNA, 22 bp, Artificial Sequence
  chemically synthesized
catctaaaagtgctgcatttag

SEQ ID NO: 775015 - DNA, 22 bp, Artificial Sequence
  chemically synthesized
tcatctaaaagtgctgcattta

SEQ ID NO: 775016 - DNA, 22 bp, Artificial Sequence
  chemically synthesized
tgaaacaacctaaatgcagcac

SEQ ID NO: 775017 - DNA, 22 bp, Artificial Sequence
  chemically synthesized
agagcaattttcatctaaaagt

SEQ ID NO: 775018 - DNA, 22 bp, Artificial Sequence
  chemically synthesized
aatgcagcacttttagatgaaa

SEQ ID NO: 775019 - DNA, 22 bp, Artificial Sequence
  chemically synthesized
ttagatgaaaattgctctgagg

SEQ ID NO: 775020 - DNA, 22 bp, Artificial Sequence
  chemically synthesized
agaatggaaaatcctcagagca

SEQ ID NO: 775021 - DNA, 22 bp, Artificial Sequence
  chemically synthesized
tagatgaaaattgctctgagga

SEQ ID NO: 775022 - DNA, 22 bp, Artificial Sequence
  chemically synthesized
cagaatggaaaatcctcagagc

SEQ ID NO: 775023 - DNA, 22 bp, Artificial Sequence
  chemically synthesized
agatgaaaattgctctgaggat

SEQ ID NO: 775024 - DNA, 22 bp, Artificial Sequence
  chemically synthesized
tcagaatggaaaatcctcagag

SEQ ID NO: 775025 - DNA, 22 bp, Artificial Sequence
  chemically synthesized
gatgaaaattgctctgaggatt

SEQ ID NO: 775026 - DNA, 22 bp, Artificial Sequence
  chemically synthesized
ttcagaatggaaaatcctcaga

SEQ ID NO: 775027 - DNA, 22 bp, Artificial Sequence
  chemically synthesized
cttttcagaatggaaaatcctc

SEQ ID NO: 775028 - DNA, 22 bp, Artificial Sequence
  chemically synthesized
tacttttcagaatggaaaatcc

SEQ ID NO: 775029 - DNA, 22 bp, Artificial Sequence
  chemically synthesized
ctacttttcagaatggaaaatc

SEQ ID NO: 775030 - DNA, 22 bp, Artificial Sequence
  chemically synthesized
cttctacttttcagaatggaaa

SEQ ID NO: 775031 - DNA, 22 bp, Artificial Sequence
  chemically synthesized
ccttctacttttcagaatggaa

SEQ ID NO: 775032 - DNA, 22 bp, Artificial Sequence
  chemically synthesized
ctctgaggattttccattctga

SEQ ID NO: 775033 - DNA, 22 bp, Artificial Sequence
  chemically synthesized
tgaggattttccattctgaaaa

SEQ ID NO: 775034 - DNA, 22 bp, Artificial Sequence
  chemically synthesized
gtttccttctacttttcagaat

SEQ ID NO: 775035 - DNA, 22 bp, Artificial Sequence
  chemically synthesized
ggtttccttctacttttcagaa

SEQ ID NO: 775036 - DNA, 22 bp, Artificial Sequence
  chemically synthesized
aggattttccattctgaaaagt

SEQ ID NO: 775037 - DNA, 22 bp, Artificial Sequence
  chemically synthesized
cttggtttccttctacttttca

SEQ ID NO: 775038 - DNA, 22 bp, Artificial Sequence
  chemically synthesized
tccattctgaaaagtagaagga

SEQ ID NO: 775039 - DNA, 22 bp, Artificial Sequence
  chemically synthesized
ccattctgaaaagtagaaggaa

SEQ ID NO: 775040 - DNA, 22 bp, Artificial Sequence
  chemically synthesized
cattctgaaaagtagaaggaaa

SEQ ID NO: 775041 - DNA, 22 bp, Artificial Sequence
  chemically synthesized
taagaactccttggtttccttc

SEQ ID NO: 775042 - DNA, 22 bp, Artificial Sequence
  chemically synthesized
tgaaaagtagaaggaaaccaag

SEQ ID NO: 775043 - DNA, 22 bp, Artificial Sequence
  chemically synthesized
aaaagtagaaggaaaccaagga

SEQ ID NO: 775044 - DNA, 22 bp, Artificial Sequence
  chemically synthesized
gtattataagaactccttggtt

SEQ ID NO: 775045 - DNA, 22 bp, Artificial Sequence
  chemically synthesized
tggtattataagaactccttgg

SEQ ID NO: 775046 - DNA, 22 bp, Artificial Sequence
  chemically synthesized
ctggtattataagaactccttg

SEQ ID NO: 775047 - DNA, 22 bp, Artificial Sequence
  chemically synthesized
tctggtattataagaactcctt

SEQ ID NO: 775048 - DNA, 22 bp, Artificial Sequence
  chemically synthesized
agttttctggtattataagaac

SEQ ID NO: 775049 - DNA, 22 bp, Artificial Sequence
  chemically synthesized
taagttttctggtattataaga

SEQ ID NO: 775050 - DNA, 22 bp, Artificial Sequence
  chemically synthesized
ctaagttttctggtattataag

SEQ ID NO: 775051 - DNA, 22 bp, Artificial Sequence
  chemically synthesized
agggcttctaagttttctggta

SEQ ID NO: 775052 - DNA, 22 bp, Artificial Sequence
  chemically synthesized
ttataataccagaaaacttaga

SEQ ID NO: 775053 - DNA, 22 bp, Artificial Sequence
  chemically synthesized
tgcattaagggcttctaagttt

SEQ ID NO: 775054 - DNA, 22 bp, Artificial Sequence
  chemically synthesized
ataataccagaaaacttagaag

SEQ ID NO: 775055 - DNA, 22 bp, Artificial Sequence
  chemically synthesized
taataccagaaaacttagaagc

SEQ ID NO: 775056 - DNA, 22 bp, Artificial Sequence
  chemically synthesized
agaagcccttaatgcacaatat

SEQ ID NO: 775057 - DNA, 22 bp, Artificial Sequence
  chemically synthesized
taggtcagtgtaatattgtgca

SEQ ID NO: 775058 - DNA, 22 bp, Artificial Sequence
  chemically synthesized
gaagcccttaatgcacaatatt

SEQ ID NO: 775059 - DNA, 22 bp, Artificial Sequence
  chemically synthesized
gtaggtcagtgtaatattgtgc

SEQ ID NO: 775060 - DNA, 22 bp, Artificial Sequence
  chemically synthesized
tgtaggtcagtgtaatattgtg

SEQ ID NO: 775061 - DNA, 22 bp, Artificial Sequence
  chemically synthesized
aatgcacaatattacactgacc

SEQ ID NO: 775062 - DNA, 22 bp, Artificial Sequence
  chemically synthesized
atgcacaatattacactgacct

SEQ ID NO: 775063 - DNA, 22 bp, Artificial Sequence
  chemically synthesized
tgcgaaggtcattttgtaggtc

SEQ ID NO: 775064 - DNA, 22 bp, Artificial Sequence
  chemically synthesized
gtgcgaaggtcattttgtaggt

SEQ ID NO: 775065 - DNA, 22 bp, Artificial Sequence
  chemically synthesized
tgtgcgaaggtcattttgtagg

SEQ ID NO: 775066 - DNA, 22 bp, Artificial Sequence
  chemically synthesized
actttgtgcgaaggtcattttg

SEQ ID NO: 775067 - DNA, 22 bp, Artificial Sequence
  chemically synthesized
cactgacctacaaaatgacctt

SEQ ID NO: 775068 - DNA, 22 bp, Artificial Sequence
  chemically synthesized
acctacaaaatgaccttcgcac

SEQ ID NO: 775069 - DNA, 22 bp, Artificial Sequence
  chemically synthesized
ataagttaactttgtgcgaagg

SEQ ID NO: 775070 - DNA, 22 bp, Artificial Sequence
  chemically synthesized
aataagttaactttgtgcgaag

SEQ ID NO: 775071 - DNA, 22 bp, Artificial Sequence
  chemically synthesized
ttaataagttaactttgtgcga

SEQ ID NO: 775072 - DNA, 22 bp, Artificial Sequence
  chemically synthesized
caaaatgaccttcgcacaaagt

SEQ ID NO: 775073 - DNA, 22 bp, Artificial Sequence
  chemically synthesized
cttaataagttaactttgtgcg

SEQ ID NO: 775074 - DNA, 22 bp, Artificial Sequence
  chemically synthesized
cttcttaataagttaactttgt

SEQ ID NO: 775075 - DNA, 22 bp, Artificial Sequence
  chemically synthesized
gcttcttaataagttaactttg

SEQ ID NO: 775076 - DNA, 22 bp, Artificial Sequence
  chemically synthesized
cttgcttcttaataagttaact

SEQ ID NO: 775077 - DNA, 22 bp, Artificial Sequence
  chemically synthesized
ccttgcttcttaataagttaac

SEQ ID NO: 775078 - DNA, 22 bp, Artificial Sequence
  chemically synthesized
tccttgcttcttaataagttaa

SEQ ID NO: 775079 - DNA, 22 bp, Artificial Sequence
  chemically synthesized
cgcacaaagttaacttattaag

SEQ ID NO: 775080 - DNA, 22 bp, Artificial Sequence
  chemically synthesized
ttttccttgcttcttaataagt

SEQ ID NO: 775081 - DNA, 22 bp, Artificial Sequence
  chemically synthesized
gcacaaagttaacttattaaga

SEQ ID NO: 775082 - DNA, 22 bp, Artificial Sequence
  chemically synthesized
cctattttccttgcttcttaat

SEQ ID NO: 775083 - DNA, 22 bp, Artificial Sequence
  chemically synthesized
tacctattttccttgcttctta

SEQ ID NO: 775084 - DNA, 22 bp, Artificial Sequence
  chemically synthesized
ctacctattttccttgcttctt

SEQ ID NO: 775085 - DNA, 22 bp, Artificial Sequence
  chemically synthesized
tctacctattttccttgcttct

SEQ ID NO: 775086 - DNA, 22 bp, Artificial Sequence
  chemically synthesized
acttattaagaagcaaggaaaa

SEQ ID NO: 775087 - DNA, 22 bp, Artificial Sequence
  chemically synthesized
attaagaagcaaggaaaatagg

SEQ ID NO: 775088 - DNA, 22 bp, Artificial Sequence
  chemically synthesized
ttaagaagcaaggaaaataggt

SEQ ID NO: 775089 - DNA, 22 bp, Artificial Sequence
  chemically synthesized
agaagcaaggaaaataggtaga

SEQ ID NO: 775090 - DNA, 22 bp, Artificial Sequence
  chemically synthesized
taccaacaatgcctttctacct

SEQ ID NO: 775091 - DNA, 22 bp, Artificial Sequence
  chemically synthesized
gtaccaacaatgcctttctacc

SEQ ID NO: 775092 - DNA, 22 bp, Artificial Sequence
  chemically synthesized
tttgtaccaacaatgcctttct

SEQ ID NO: 775093 - DNA, 22 bp, Artificial Sequence
  chemically synthesized
tatttgtaccaacaatgccttt

SEQ ID NO: 775094 - DNA, 22 bp, Artificial Sequence
  chemically synthesized
ctatttgtaccaacaatgcctt

SEQ ID NO: 775095 - DNA, 22 bp, Artificial Sequence
  chemically synthesized
gcagcgtttctatttgtaccaa

SEQ ID NO: 775096 - DNA, 22 bp, Artificial Sequence
  chemically synthesized
agcagcgtttctatttgtacca

SEQ ID NO: 775097 - DNA, 22 bp, Artificial Sequence
  chemically synthesized
tagcagcgtttctatttgtacc

SEQ ID NO: 775098 - DNA, 22 bp, Artificial Sequence
  chemically synthesized
ggcattttagcagcgtttctat

SEQ ID NO: 775099 - DNA, 22 bp, Artificial Sequence
  chemically synthesized
ttggtacaaatagaaacgctgc

SEQ ID NO: 775100 - DNA, 22 bp, Artificial Sequence
  chemically synthesized
gtacaaatagaaacgctgctaa

SEQ ID NO: 775101 - DNA, 22 bp, Artificial Sequence
  chemically synthesized
cagactcggcattttagcagcg

SEQ ID NO: 775102 - DNA, 22 bp, Artificial Sequence
  chemically synthesized
ccagactcggcattttagcagc

SEQ ID NO: 775103 - DNA, 22 bp, Artificial Sequence
  chemically synthesized
tccagactcggcattttagcag

SEQ ID NO: 775104 - DNA, 22 bp, Artificial Sequence
  chemically synthesized
aaattttccagactcggcattt

SEQ ID NO: 775105 - DNA, 22 bp, Artificial Sequence
  chemically synthesized
caaattttccagactcggcatt

SEQ ID NO: 775106 - DNA, 22 bp, Artificial Sequence
  chemically synthesized
tcaaattttccagactcggcat

SEQ ID NO: 775107 - DNA, 22 bp, Artificial Sequence
  chemically synthesized
ttcaaattttccagactcggca

SEQ ID NO: 775108 - DNA, 22 bp, Artificial Sequence
  chemically synthesized
tttcaaattttccagactcggc

SEQ ID NO: 775109 - DNA, 22 bp, Artificial Sequence
  chemically synthesized
ctaaaatgccgagtctggaaaa

SEQ ID NO: 775110 - DNA, 22 bp, Artificial Sequence
  chemically synthesized
agatctttttcaaattttccag

SEQ ID NO: 775111 - DNA, 22 bp, Artificial Sequence
  chemically synthesized
aaatgccgagtctggaaaattt

SEQ ID NO: 775112 - DNA, 22 bp, Artificial Sequence
  chemically synthesized
gaaattaagatctttttcaaat

SEQ ID NO: 775113 - DNA, 22 bp, Artificial Sequence
  chemically synthesized
ggaaattaagatctttttcaaa

SEQ ID NO: 775114 - DNA, 22 bp, Artificial Sequence
  chemically synthesized
tggaaattaagatctttttcaa

SEQ ID NO: 775115 - DNA, 22 bp, Artificial Sequence
  chemically synthesized
gaaaatttgaaaaagatcttaa

SEQ ID NO: 775116 - DNA, 22 bp, Artificial Sequence
  chemically synthesized
gaaaaagatcttaatttccaaa

SEQ ID NO: 775117 - DNA, 22 bp, Artificial Sequence
  chemically synthesized
agcagaaacagttttggaaatt

SEQ ID NO: 775118 - DNA, 22 bp, Artificial Sequence
  chemically synthesized
aaaaagatcttaatttccaaaa

SEQ ID NO: 775119 - DNA, 22 bp, Artificial Sequence
  chemically synthesized
tgagcagaaacagttttggaaa

SEQ ID NO: 775120 - DNA, 22 bp, Artificial Sequence
  chemically synthesized
ctgagcagaaacagttttggaa

SEQ ID NO: 775121 - DNA, 22 bp, Artificial Sequence
  chemically synthesized
tctgagcagaaacagttttgga

SEQ ID NO: 775122 - DNA, 22 bp, Artificial Sequence
  chemically synthesized
tttctgagcagaaacagttttg

SEQ ID NO: 775123 - DNA, 22 bp, Artificial Sequence
  chemically synthesized
ctttctgagcagaaacagtttt

SEQ ID NO: 775124 - DNA, 22 bp, Artificial Sequence
  chemically synthesized
cttctttctgagcagaaacagt

SEQ ID NO: 775125 - DNA, 22 bp, Artificial Sequence
  chemically synthesized
acttctttctgagcagaaacag

SEQ ID NO: 775126 - DNA, 22 bp, Artificial Sequence
  chemically synthesized
aatttccaaaactgtttctgct

SEQ ID NO: 775127 - DNA, 22 bp, Artificial Sequence
  chemically synthesized
atttccaaaactgtttctgctc

SEQ ID NO: 775128 - DNA, 22 bp, Artificial Sequence
  chemically synthesized
ttacttctttctgagcagaaac

SEQ ID NO: 775129 - DNA, 22 bp, Artificial Sequence
  chemically synthesized
ctcttacttctttctgagcaga

SEQ ID NO: 775130 - DNA, 22 bp, Artificial Sequence
  chemically synthesized
ccaaaactgtttctgctcagaa

SEQ ID NO: 775131 - DNA, 22 bp, Artificial Sequence
  chemically synthesized
caaaactgtttctgctcagaaa

SEQ ID NO: 775132 - DNA, 22 bp, Artificial Sequence
  chemically synthesized
tttctgctcagaaagaagtaag

SEQ ID NO: 775133 - DNA, 22 bp, Artificial Sequence
  chemically synthesized
ctgctcagaaagaagtaagagg

SEQ ID NO: 775134 - DNA, 22 bp, Artificial Sequence
  chemically synthesized
tgctcagaaagaagtaagagga

SEQ ID NO: 775135 - DNA, 22 bp, Artificial Sequence
  chemically synthesized
ctcagaaagaagtaagaggaat

SEQ ID NO: 775136 - DNA, 22 bp, Artificial Sequence
  chemically synthesized
tatcaccaaatgatattcctct

SEQ ID NO: 775137 - DNA, 22 bp, Artificial Sequence
  chemically synthesized
agaaagaagtaagaggaatatc

SEQ ID NO: 775138 - DNA, 22 bp, Artificial Sequence
  chemically synthesized
atatcaccaaatgatattcctc

SEQ ID NO: 775139 - DNA, 22 bp, Artificial Sequence
  chemically synthesized
tatatcaccaaatgatattcct

SEQ ID NO: 775140 - DNA, 22 bp, Artificial Sequence
  chemically synthesized
aaaagggccaagttttatatca

SEQ ID NO: 775141 - DNA, 22 bp, Artificial Sequence
  chemically synthesized
tcaaaagggccaagttttatat

SEQ ID NO: 775142 - DNA, 22 bp, Artificial Sequence
  chemically synthesized
ggtgatataaaacttggccctt

SEQ ID NO: 775143 - DNA, 22 bp, Artificial Sequence
  chemically synthesized
ccacactctcaaaagggccaag

SEQ ID NO: 775144 - DNA, 22 bp, Artificial Sequence
  chemically synthesized
gtgatataaaacttggcccttt

SEQ ID NO: 775145 - DNA, 22 bp, Artificial Sequence
  chemically synthesized
tcccacactctcaaaagggcca

SEQ ID NO: 775146 - DNA, 22 bp, Artificial Sequence
  chemically synthesized
ctcccacactctcaaaagggcc

SEQ ID NO: 775147 - DNA, 22 bp, Artificial Sequence
  chemically synthesized
tctcccacactctcaaaagggc

SEQ ID NO: 775148 - DNA, 22 bp, Artificial Sequence
  chemically synthesized
cacccattttctcccacactct

SEQ ID NO: 775149 - DNA, 22 bp, Artificial Sequence
  chemically synthesized
ggcccttttgagagtgtgggag

SEQ ID NO: 775150 - DNA, 22 bp, Artificial Sequence
  chemically synthesized
tccacccattttctcccacact

SEQ ID NO: 775151 - DNA, 22 bp, Artificial Sequence
  chemically synthesized
gcccttttgagagtgtgggaga

SEQ ID NO: 775152 - DNA, 22 bp, Artificial Sequence
  chemically synthesized
ttgagagtgtgggagaaaatgg

SEQ ID NO: 775153 - DNA, 22 bp, Artificial Sequence
  chemically synthesized
tgagagtgtgggagaaaatggg

SEQ ID NO: 775154 - DNA, 22 bp, Artificial Sequence
  chemically synthesized
gagagtgtgggagaaaatgggt

SEQ ID NO: 775155 - DNA, 22 bp, Artificial Sequence
  chemically synthesized
agagtgtgggagaaaatgggtg

SEQ ID NO: 775156 - DNA, 22 bp, Artificial Sequence
  chemically synthesized
tgtcagaatcaatagttctcca

SEQ ID NO: 775157 - DNA, 22 bp, Artificial Sequence
  chemically synthesized
cagtgattatgtcagaatcaat

SEQ ID NO: 775158 - DNA, 22 bp, Artificial Sequence
  chemically synthesized
gcagtgattatgtcagaatcaa

SEQ ID NO: 775159 - DNA, 22 bp, Artificial Sequence
  chemically synthesized
ttgattctgacataatcactgc

SEQ ID NO: 775160 - DNA, 22 bp, Artificial Sequence
  chemically synthesized
attctgacataatcactgcaaa

SEQ ID NO: 775161 - DNA, 22 bp, Artificial Sequence
  chemically synthesized
tgacataatcactgcaaatttt

SEQ ID NO: 775162 - DNA, 22 bp, Artificial Sequence
  chemically synthesized
acataatcactgcaaattttct

SEQ ID NO: 775163 - DNA, 22 bp, Artificial Sequence
  chemically synthesized
atcaatgacagtgtagaaaatt

SEQ ID NO: 775164 - DNA, 22 bp, Artificial Sequence
  chemically synthesized
aagaaattaatcaatgacagtg

SEQ ID NO: 775165 - DNA, 22 bp, Artificial Sequence
  chemically synthesized
caaattttctacactgtcattg

SEQ ID NO: 775166 - DNA, 22 bp, Artificial Sequence
  chemically synthesized
ttgaagaaattaatcaatgaca

SEQ ID NO: 775167 - DNA, 22 bp, Artificial Sequence
  chemically synthesized
attgaagaaattaatcaatgac

SEQ ID NO: 775168 - DNA, 22 bp, Artificial Sequence
  chemically synthesized
tctacactgtcattgattaatt

SEQ ID NO: 775169 - DNA, 22 bp, Artificial Sequence
  chemically synthesized
ctacactgtcattgattaattt

SEQ ID NO: 775170 - DNA, 22 bp, Artificial Sequence
  chemically synthesized
tacactgtcattgattaatttc

SEQ ID NO: 775171 - DNA, 22 bp, Artificial Sequence
  chemically synthesized
cactgtcattgattaatttctt

SEQ ID NO: 775172 - DNA, 22 bp, Artificial Sequence
  chemically synthesized
aatcgatgtttattgaagaaat

SEQ ID NO: 775173 - DNA, 22 bp, Artificial Sequence
  chemically synthesized
tcattgattaatttcttcaata

SEQ ID NO: 775174 - DNA, 22 bp, Artificial Sequence
  chemically synthesized
attaatttcttcaataaacatc

SEQ ID NO: 775175 - DNA, 22 bp, Artificial Sequence
  chemically synthesized
atttcttcaataaacatcgatt

SEQ ID NO: 775176 - DNA, 22 bp, Artificial Sequence
  chemically synthesized
cttcaataaacatcgatttagg

SEQ ID NO: 775177 - DNA, 22 bp, Artificial Sequence
  chemically synthesized
ttcaataaacatcgatttagga

SEQ ID NO: 775178 - DNA, 22 bp, Artificial Sequence
  chemically synthesized
gaacacagtagatcctaaatcg

SEQ ID NO: 775179 - DNA, 22 bp, Artificial Sequence
  chemically synthesized
caataaacatcgatttaggatc

SEQ ID NO: 775180 - DNA, 22 bp, Artificial Sequence
  chemically synthesized
aataaacatcgatttaggatct

SEQ ID NO: 775181 - DNA, 22 bp, Artificial Sequence
  chemically synthesized
aggatctactgtgttctagggc

SEQ ID NO: 775182 - DNA, 22 bp, Artificial Sequence
  chemically synthesized
ggatctactgtgttctagggct

SEQ ID NO: 775183 - DNA, 22 bp, Artificial Sequence
  chemically synthesized
gacagagcagcacagccctaga

SEQ ID NO: 775184 - DNA, 22 bp, Artificial Sequence
  chemically synthesized
tgttagacagagcagcacagcc

SEQ ID NO: 775185 - DNA, 22 bp, Artificial Sequence
  chemically synthesized
ctgtgttctagggctgtgctgc

SEQ ID NO: 775186 - DNA, 22 bp, Artificial Sequence
  chemically synthesized
ctgtgttagacagagcagcaca

SEQ ID NO: 775187 - DNA, 22 bp, Artificial Sequence
  chemically synthesized
tgttctagggctgtgctgctct

SEQ ID NO: 775188 - DNA, 22 bp, Artificial Sequence
  chemically synthesized
tagggctgtgctgctctgtcta

SEQ ID NO: 775189 - DNA, 22 bp, Artificial Sequence
  chemically synthesized
gggctgtgctgctctgtctaac

SEQ ID NO: 775190 - DNA, 22 bp, Artificial Sequence
  chemically synthesized
cagccagtggctcctgtgttag

SEQ ID NO: 775191 - DNA, 22 bp, Artificial Sequence
  chemically synthesized
tgctgctctgtctaacacagga

SEQ ID NO: 775192 - DNA, 22 bp, Artificial Sequence
  chemically synthesized
cctacagccagtggctcctgtg

SEQ ID NO: 775193 - DNA, 22 bp, Artificial Sequence
  chemically synthesized
ctctgtctaacacaggagccac

SEQ ID NO: 775194 - DNA, 22 bp, Artificial Sequence
  chemically synthesized
tgtctaacacaggagccactgg

SEQ ID NO: 775195 - DNA, 22 bp, Artificial Sequence
  chemically synthesized
tctaacacaggagccactggct

SEQ ID NO: 775196 - DNA, 22 bp, Artificial Sequence
  chemically synthesized
ggtagctacctacagccagtgg

SEQ ID NO: 775197 - DNA, 22 bp, Artificial Sequence
  chemically synthesized
acacaggagccactggctgtag

SEQ ID NO: 775198 - DNA, 22 bp, Artificial Sequence
  chemically synthesized
ctcggtagctacctacagccag

SEQ ID NO: 775199 - DNA, 22 bp, Artificial Sequence
  chemically synthesized
aattgctcggtagctacctaca

SEQ ID NO: 775200 - DNA, 22 bp, Artificial Sequence
  chemically synthesized
caattgctcggtagctacctac

SEQ ID NO: 775201 - DNA, 22 bp, Artificial Sequence
  chemically synthesized
atttcaattgctcggtagctac

SEQ ID NO: 775202 - DNA, 22 bp, Artificial Sequence
  chemically synthesized
gctgtaggtagctaccgagcaa

SEQ ID NO: 775203 - DNA, 22 bp, Artificial Sequence
  chemically synthesized
gcctgatttcaattgctcggta

SEQ ID NO: 775204 - DNA, 22 bp, Artificial Sequence
  chemically synthesized
taggtagctaccgagcaattga

SEQ ID NO: 775205 - DNA, 22 bp, Artificial Sequence
  chemically synthesized
actagcctgatttcaattgctc

SEQ ID NO: 775206 - DNA, 22 bp, Artificial Sequence
  chemically synthesized
cgtctcactagcctgatttcaa

SEQ ID NO: 775207 - DNA, 22 bp, Artificial Sequence
  chemically synthesized
tccgtctcactagcctgatttc

SEQ ID NO: 775208 - DNA, 22 bp, Artificial Sequence
  chemically synthesized
ccgagcaattgaaatcaggcta

SEQ ID NO: 775209 - DNA, 22 bp, Artificial Sequence
  chemically synthesized
agtctctccgtctcactagcct

SEQ ID NO: 775210 - DNA, 22 bp, Artificial Sequence
  chemically synthesized
cagtctctccgtctcactagcc

SEQ ID NO: 775211 - DNA, 22 bp, Artificial Sequence
  chemically synthesized
aacttcagtctctccgtctcac

SEQ ID NO: 775212 - DNA, 22 bp, Artificial Sequence
  chemically synthesized
aaatcaggctagtgagacggag

SEQ ID NO: 775213 - DNA, 22 bp, Artificial Sequence
  chemically synthesized
ttaaacttcagtctctccgtct

SEQ ID NO: 775214 - DNA, 22 bp, Artificial Sequence
  chemically synthesized
gttaaacttcagtctctccgtc

SEQ ID NO: 775215 - DNA, 22 bp, Artificial Sequence
  chemically synthesized
gtgagacggagagactgaagtt

SEQ ID NO: 775216 - DNA, 22 bp, Artificial Sequence
  chemically synthesized
ataaaatggaataaaaatttgt

SEQ ID NO: 775217 - DNA, 22 bp, Artificial Sequence
  chemically synthesized
aataaaatggaataaaaatttg

SEQ ID NO: 775218 - DNA, 22 bp, Artificial Sequence
  chemically synthesized
aagtttaacaaatttttattcc

SEQ ID NO: 775219 - DNA, 22 bp, Artificial Sequence
  chemically synthesized
aatttaataaaatggaataaaa

SEQ ID NO: 775220 - DNA, 22 bp, Artificial Sequence
  chemically synthesized
aaatttaataaaatggaataaa

SEQ ID NO: 775221 - DNA, 22 bp, Artificial Sequence
  chemically synthesized
aacaaatttttattccatttta

SEQ ID NO: 775222 - DNA, 22 bp, Artificial Sequence
  chemically synthesized
acaaatttttattccattttat

SEQ ID NO: 775223 - DNA, 22 bp, Artificial Sequence
  chemically synthesized
tatttaaatttaataaaatgga

SEQ ID NO: 775224 - DNA, 22 bp, Artificial Sequence
  chemically synthesized
atatttaaatttaataaaatgg

SEQ ID NO: 775225 - DNA, 22 bp, Artificial Sequence
  chemically synthesized
aatttatatttaaatttaataa

SEQ ID NO: 775226 - DNA, 22 bp, Artificial Sequence
  chemically synthesized
aaatttatatttaaatttaata

SEQ ID NO: 775227 - DNA, 22 bp, Artificial Sequence
  chemically synthesized
ttattccattttattaaattta

SEQ ID NO: 775228 - DNA, 22 bp, Artificial Sequence
  chemically synthesized
taaatttatatttaaatttaat

SEQ ID NO: 775229 - DNA, 22 bp, Artificial Sequence
  chemically synthesized
tattccattttattaaatttaa

SEQ ID NO: 775230 - DNA, 22 bp, Artificial Sequence
  chemically synthesized
ttaaatttatatttaaatttaa

SEQ ID NO: 775231 - DNA, 22 bp, Artificial Sequence
  chemically synthesized
attccattttattaaatttaaa

SEQ ID NO: 775232 - DNA, 22 bp, Artificial Sequence
  chemically synthesized
ttccattttattaaatttaaat

SEQ ID NO: 775233 - DNA, 22 bp, Artificial Sequence
  chemically synthesized
cattttattaaatttaaatata

SEQ ID NO: 775234 - DNA, 22 bp, Artificial Sequence
  chemically synthesized
tattaaatttaaatataaattt

SEQ ID NO: 775235 - DNA, 22 bp, Artificial Sequence
  chemically synthesized
attaaatttaaatataaattta

SEQ ID NO: 775236 - DNA, 22 bp, Artificial Sequence
  chemically synthesized
ttaaatttaaatataaatttaa

SEQ ID NO: 775237 - DNA, 22 bp, Artificial Sequence
  chemically synthesized
aatttaaatataaatttaaaaa

SEQ ID NO: 775238 - DNA, 22 bp, Artificial Sequence
  chemically synthesized
aaccaagagtcaatttttaaat

SEQ ID NO: 775239 - DNA, 22 bp, Artificial Sequence
  chemically synthesized
aaatataaatttaaaaattgac

SEQ ID NO: 775240 - DNA, 22 bp, Artificial Sequence
  chemically synthesized
aatataaatttaaaaattgact

SEQ ID NO: 775241 - DNA, 22 bp, Artificial Sequence
  chemically synthesized
aataactgaaccaagagtcaat

SEQ ID NO: 775242 - DNA, 22 bp, Artificial Sequence
  chemically synthesized
caataactgaaccaagagtcaa

SEQ ID NO: 775243 - DNA, 22 bp, Artificial Sequence
  chemically synthesized
tcaataactgaaccaagagtca

SEQ ID NO: 775244 - DNA, 22 bp, Artificial Sequence
  chemically synthesized
ttcaataactgaaccaagagtc

SEQ ID NO: 775245 - DNA, 22 bp, Artificial Sequence
  chemically synthesized
aaaaattgactcttggttcagt

SEQ ID NO: 775246 - DNA, 22 bp, Artificial Sequence
  chemically synthesized
aaaattgactcttggttcagtt

SEQ ID NO: 775247 - DNA, 22 bp, Artificial Sequence
  chemically synthesized
actcttggttcagttattgaaa

SEQ ID NO: 775248 - DNA, 22 bp, Artificial Sequence
  chemically synthesized
ttggttcagttattgaaaaact

SEQ ID NO: 775249 - DNA, 22 bp, Artificial Sequence
  chemically synthesized
ggttcagttattgaaaaacttt

SEQ ID NO: 775250 - DNA, 22 bp, Artificial Sequence
  chemically synthesized
caaacatacacaaaagtttttc

SEQ ID NO: 775251 - DNA, 22 bp, Artificial Sequence
  chemically synthesized
gttcagttattgaaaaactttt

SEQ ID NO: 775252 - DNA, 22 bp, Artificial Sequence
  chemically synthesized
ttccaaacatacacaaaagttt

SEQ ID NO: 775253 - DNA, 22 bp, Artificial Sequence
  chemically synthesized
agttattgaaaaacttttgtgt

SEQ ID NO: 775254 - DNA, 22 bp, Artificial Sequence
  chemically synthesized
agttgttccaaacatacacaaa

SEQ ID NO: 775255 - DNA, 22 bp, Artificial Sequence
  chemically synthesized
ttgaaaaacttttgtgtatgtt

SEQ ID NO: 775256 - DNA, 22 bp, Artificial Sequence
  chemically synthesized
ctaagttgttccaaacatacac

SEQ ID NO: 775257 - DNA, 22 bp, Artificial Sequence
  chemically synthesized
aaaaacttttgtgtatgtttgg

SEQ ID NO: 775258 - DNA, 22 bp, Artificial Sequence
  chemically synthesized
acattcctaagttgttccaaac

SEQ ID NO: 775259 - DNA, 22 bp, Artificial Sequence
  chemically synthesized
ttgtgtatgtttggaacaactt

SEQ ID NO: 775260 - DNA, 22 bp, Artificial Sequence
  chemically synthesized
tgtgtatgtttggaacaactta

SEQ ID NO: 775261 - DNA, 22 bp, Artificial Sequence
  chemically synthesized
gtgtatgtttggaacaacttag

SEQ ID NO: 775262 - DNA, 22 bp, Artificial Sequence
  chemically synthesized
tgtatgtttggaacaacttagg

SEQ ID NO: 775263 - DNA, 22 bp, Artificial Sequence
  chemically synthesized
aaaaaagaagattcacattcct

SEQ ID NO: 775264 - DNA, 22 bp, Artificial Sequence
  chemically synthesized
ggaacaacttaggaatgtgaat

SEQ ID NO: 775265 - DNA, 22 bp, Artificial Sequence
  chemically synthesized
gaacaacttaggaatgtgaatc

SEQ ID NO: 775266 - DNA, 22 bp, Artificial Sequence
  chemically synthesized
tagttgaaaaaagaagattcac

SEQ ID NO: 775267 - DNA, 22 bp, Artificial Sequence
  chemically synthesized
atagttgaaaaaagaagattca

SEQ ID NO: 775268 - DNA, 22 bp, Artificial Sequence
  chemically synthesized
tatagttgaaaaaagaagattc

SEQ ID NO: 775269 - DNA, 22 bp, Artificial Sequence
  chemically synthesized
aggaatgtgaatcttctttttt

SEQ ID NO: 775270 - DNA, 22 bp, Artificial Sequence
  chemically synthesized
ggaatgtgaatcttcttttttc

SEQ ID NO: 775271 - DNA, 22 bp, Artificial Sequence
  chemically synthesized
ataaactttatagttgaaaaaa

SEQ ID NO: 775272 - DNA, 22 bp, Artificial Sequence
  chemically synthesized
cataaactttatagttgaaaaa

SEQ ID NO: 775273 - DNA, 22 bp, Artificial Sequence
  chemically synthesized
catttcataaactttatagttg

SEQ ID NO: 775274 - DNA, 22 bp, Artificial Sequence
  chemically synthesized
acatttcataaactttatagtt

SEQ ID NO: 775275 - DNA, 22 bp, Artificial Sequence
  chemically synthesized
tttacatttcataaactttata

SEQ ID NO: 775276 - DNA, 22 bp, Artificial Sequence
  chemically synthesized
cttttttcaactataaagttta

SEQ ID NO: 775277 - DNA, 22 bp, Artificial Sequence
  chemically synthesized
ttttttcaactataaagtttat

SEQ ID NO: 775278 - DNA, 22 bp, Artificial Sequence
  chemically synthesized
tatttacatttcataaacttta

SEQ ID NO: 775279 - DNA, 22 bp, Artificial Sequence
  chemically synthesized
ttttcaactataaagtttatga

SEQ ID NO: 775280 - DNA, 22 bp, Artificial Sequence
  chemically synthesized
tttcaactataaagtttatgaa

SEQ ID NO: 775281 - DNA, 22 bp, Artificial Sequence
  chemically synthesized
ttcaactataaagtttatgaaa

SEQ ID NO: 775282 - DNA, 22 bp, Artificial Sequence
  chemically synthesized
tcaactataaagtttatgaaat

SEQ ID NO: 775283 - DNA, 22 bp, Artificial Sequence
  chemically synthesized
gtctctatttacatttcataaa

SEQ ID NO: 775284 - DNA, 22 bp, Artificial Sequence
  chemically synthesized
caactataaagtttatgaaatg

SEQ ID NO: 775285 - DNA, 22 bp, Artificial Sequence
  chemically synthesized
ggtctctatttacatttcataa

SEQ ID NO: 775286 - DNA, 22 bp, Artificial Sequence
  chemically synthesized
aactataaagtttatgaaatgt

SEQ ID NO: 775287 - DNA, 22 bp, Artificial Sequence
  chemically synthesized
taaagtttatgaaatgtaaata

SEQ ID NO: 775288 - DNA, 22 bp, Artificial Sequence
  chemically synthesized
atgaaatgtaaatagagaccaa

SEQ ID NO: 775289 - DNA, 22 bp, Artificial Sequence
  chemically synthesized
tgaaatgtaaatagagaccaaa

SEQ ID NO: 775290 - DNA, 22 bp, Artificial Sequence
  chemically synthesized
aagtataataaaaaaaaaagaa

SEQ ID NO: 775291 - DNA, 22 bp, Artificial Sequence
  chemically synthesized
aaagtataataaaaaaaaaaga

SEQ ID NO: 775292 - DNA, 22 bp, Artificial Sequence
  chemically synthesized
gaacttaaagtataataaaaaa

SEQ ID NO: 775293 - DNA, 22 bp, Artificial Sequence
  chemically synthesized
tcttttttttttattatacttt

SEQ ID NO: 775294 - DNA, 22 bp, Artificial Sequence
  chemically synthesized
cttttttttttattatacttta

SEQ ID NO: 775295 - DNA, 22 bp, Artificial Sequence
  chemically synthesized
ttttttttttattatactttaa

SEQ ID NO: 775296 - DNA, 22 bp, Artificial Sequence
  chemically synthesized
ttttttttattatactttaagt

SEQ ID NO: 775297 - DNA, 22 bp, Artificial Sequence
  chemically synthesized
tttttttattatactttaagtt

SEQ ID NO: 775298 - DNA, 22 bp, Artificial Sequence
  chemically synthesized
ttttttattatactttaagttc

SEQ ID NO: 775299 - DNA, 22 bp, Artificial Sequence
  chemically synthesized
tttttattatactttaagttct

SEQ ID NO: 775300 - DNA, 22 bp, Artificial Sequence
  chemically synthesized
ttttattatactttaagttcta

SEQ ID NO: 775301 - DNA, 22 bp, Artificial Sequence
  chemically synthesized
tttattatactttaagttctag

SEQ ID NO: 775302 - DNA, 22 bp, Artificial Sequence
  chemically synthesized
tgcacatgtgccctagaactta

SEQ ID NO: 775303 - DNA, 22 bp, Artificial Sequence
  chemically synthesized
ttattatactttaagttctagg

SEQ ID NO: 775304 - DNA, 22 bp, Artificial Sequence
  chemically synthesized
tattatactttaagttctaggg

SEQ ID NO: 775305 - DNA, 22 bp, Artificial Sequence
  chemically synthesized
attatactttaagttctagggc

SEQ ID NO: 775306 - DNA, 22 bp, Artificial Sequence
  chemically synthesized
ttatactttaagttctagggca

SEQ ID NO: 775307 - DNA, 22 bp, Artificial Sequence
  chemically synthesized
tactttaagttctagggcacat

SEQ ID NO: 775308 - DNA, 22 bp, Artificial Sequence
  chemically synthesized
taagttctagggcacatgtgca

SEQ ID NO: 775309 - DNA, 22 bp, Artificial Sequence
  chemically synthesized
aagttctagggcacatgtgcac

SEQ ID NO: 775310 - DNA, 22 bp, Artificial Sequence
  chemically synthesized
agttctagggcacatgtgcaca

SEQ ID NO: 775311 - DNA, 22 bp, Artificial Sequence
  chemically synthesized
tagggcacatgtgcacaacgtg

SEQ ID NO: 775312 - DNA, 22 bp, Artificial Sequence
  chemically synthesized
gggcacatgtgcacaacgtgcg

SEQ ID NO: 775313 - DNA, 22 bp, Artificial Sequence
  chemically synthesized
gttacatatgtatacatgtgcc

SEQ ID NO: 775314 - DNA, 22 bp, Artificial Sequence
  chemically synthesized
ttacatatgtatacatgtgcca

SEQ ID NO: 775315 - DNA, 22 bp, Artificial Sequence
  chemically synthesized
catatgtatacatgtgccatgt

SEQ ID NO: 775316 - DNA, 22 bp, Artificial Sequence
  chemically synthesized
atgggtgcagcacaccaacatg

SEQ ID NO: 775317 - DNA, 22 bp, Artificial Sequence
  chemically synthesized
atgtaaatgacgagttaatggg

SEQ ID NO: 775318 - DNA, 22 bp, Artificial Sequence
  chemically synthesized
gtgtgctgcacccattaactcg

SEQ ID NO: 775319 - DNA, 22 bp, Artificial Sequence
  chemically synthesized
cacccattaactcgtcatttac

SEQ ID NO: 775320 - DNA, 22 bp, Artificial Sequence
  chemically synthesized
ggagatatacctaatgtaaatg

SEQ ID NO: 775321 - DNA, 22 bp, Artificial Sequence
  chemically synthesized
actcgtcatttacattaggtat

SEQ ID NO: 775322 - DNA, 22 bp, Artificial Sequence
  chemically synthesized
gtcatttacattaggtatatct

SEQ ID NO: 775323 - DNA, 22 bp, Artificial Sequence
  chemically synthesized
acattaggtatatctcctaacg

SEQ ID NO: 775324 - DNA, 22 bp, Artificial Sequence
  chemically synthesized
cattaggtatatctcctaacgc

SEQ ID NO: 775325 - DNA, 22 bp, Artificial Sequence
  chemically synthesized
ggtatatctcctaacgctatcc

SEQ ID NO: 775326 - DNA, 22 bp, Artificial Sequence
  chemically synthesized
ctaacgctatccctcccccctc

SEQ ID NO: 775327 - DNA, 22 bp, Artificial Sequence
  chemically synthesized
tcgtggggtggggggagggggg

SEQ ID NO: 775328 - DNA, 22 bp, Artificial Sequence
  chemically synthesized
acgctatccctcccccctcccc

SEQ ID NO: 775329 - DNA, 22 bp, Artificial Sequence
  chemically synthesized
tccctcccccctccccccaccc

SEQ ID NO: 775330 - DNA, 22 bp, Artificial Sequence
  chemically synthesized
ccccctccccccaccccacgac

SEQ ID NO: 775331 - DNA, 22 bp, Artificial Sequence
  chemically synthesized
cccccaccccacgacaggccct

SEQ ID NO: 775332 - DNA, 22 bp, Artificial Sequence
  chemically synthesized
gacacagggtggggaacatcac

SEQ ID NO: 775333 - DNA, 22 bp, Artificial Sequence
  chemically synthesized
ggacacagggtggggaacatca

SEQ ID NO: 775334 - DNA, 22 bp, Artificial Sequence
  chemically synthesized
gtgtgtgatgttccccaccctg

SEQ ID NO: 775335 - DNA, 22 bp, Artificial Sequence
  chemically synthesized
agcaatgagaacacttggacac

SEQ ID NO: 775336 - DNA, 22 bp, Artificial Sequence
  chemically synthesized
cccaccctgtgtccaagtgttc

SEQ ID NO: 775337 - DNA, 22 bp, Artificial Sequence
  chemically synthesized
tgtccaagtgttctcattgctc

SEQ ID NO: 775338 - DNA, 22 bp, Artificial Sequence
  chemically synthesized
acaggcgggaattgagcaatga

SEQ ID NO: 775339 - DNA, 22 bp, Artificial Sequence
  chemically synthesized
ctcacaggcgggaattgagcaa

SEQ ID NO: 775340 - DNA, 22 bp, Artificial Sequence
  chemically synthesized
actcacaggcgggaattgagca

SEQ ID NO: 775341 - DNA, 22 bp, Artificial Sequence
  chemically synthesized
ttactcacaggcgggaattgag

SEQ ID NO: 775342 - DNA, 22 bp, Artificial Sequence
  chemically synthesized
tcattgctcaattcccgcctgt

SEQ ID NO: 775343 - DNA, 22 bp, Artificial Sequence
  chemically synthesized
attgctcaattcccgcctgtga

SEQ ID NO: 775344 - DNA, 22 bp, Artificial Sequence
  chemically synthesized
ctcaattcccgcctgtgagtaa

SEQ ID NO: 775345 - DNA, 22 bp, Artificial Sequence
  chemically synthesized
aattcccgcctgtgagtaagaa

SEQ ID NO: 775346 - DNA, 22 bp, Artificial Sequence
  chemically synthesized
ccgcctgtgagtaagaacatgt

SEQ ID NO: 775347 - DNA, 22 bp, Artificial Sequence
  chemically synthesized
tgagtaagaacatgtggtgttt

SEQ ID NO: 775348 - DNA, 22 bp, Artificial Sequence
  chemically synthesized
tcacaaggacagaaaaccaaac

SEQ ID NO: 775349 - DNA, 22 bp, Artificial Sequence
  chemically synthesized
agcaaactatcacaaggacaga

SEQ ID NO: 775350 - DNA, 22 bp, Artificial Sequence
  chemically synthesized
tgagcaaactatcacaaggaca

SEQ ID NO: 775351 - DNA, 22 bp, Artificial Sequence
  chemically synthesized
ggttttctgtccttgtgatagt

SEQ ID NO: 775352 - DNA, 22 bp, Artificial Sequence
  chemically synthesized
gttttctgtccttgtgatagtt

SEQ ID NO: 775353 - DNA, 22 bp, Artificial Sequence
  chemically synthesized
tctgtccttgtgatagtttgct

SEQ ID NO: 775354 - DNA, 22 bp, Artificial Sequence
  chemically synthesized
ctgtccttgtgatagtttgctc

SEQ ID NO: 775355 - DNA, 22 bp, Artificial Sequence
  chemically synthesized
tgtccttgtgatagtttgctca

SEQ ID NO: 775356 - DNA, 22 bp, Artificial Sequence
  chemically synthesized
gaaaccatcattctgagcaaac

SEQ ID NO: 775357 - DNA, 22 bp, Artificial Sequence
  chemically synthesized
tccttgtgatagtttgctcaga

SEQ ID NO: 775358 - DNA, 22 bp, Artificial Sequence
  chemically synthesized
gtgatagtttgctcagaatgat

SEQ ID NO: 775359 - DNA, 22 bp, Artificial Sequence
  chemically synthesized
tgatagtttgctcagaatgatg

SEQ ID NO: 775360 - DNA, 22 bp, Artificial Sequence
  chemically synthesized
gctcagaatgatggtttccagc

SEQ ID NO: 775361 - DNA, 22 bp, Artificial Sequence
  chemically synthesized
ctcagaatgatggtttccagct

SEQ ID NO: 775362 - DNA, 22 bp, Artificial Sequence
  chemically synthesized
agaatgatggtttccagcttca

SEQ ID NO: 775363 - DNA, 22 bp, Artificial Sequence
  chemically synthesized
tagggacgtggatgaagctgga

SEQ ID NO: 775364 - DNA, 22 bp, Artificial Sequence
  chemically synthesized
gtagggacgtggatgaagctgg

SEQ ID NO: 775365 - DNA, 22 bp, Artificial Sequence
  chemically synthesized
tgtagggacgtggatgaagctg

SEQ ID NO: 775366 - DNA, 22 bp, Artificial Sequence
  chemically synthesized
aagtcctttgtagggacgtgga

SEQ ID NO: 775367 - DNA, 22 bp, Artificial Sequence
  chemically synthesized
ccagcttcatccacgtccctac

SEQ ID NO: 775368 - DNA, 22 bp, Artificial Sequence
  chemically synthesized
cagcttcatccacgtccctaca

SEQ ID NO: 775369 - DNA, 22 bp, Artificial Sequence
  chemically synthesized
catccacgtccctacaaaggac

SEQ ID NO: 775370 - DNA, 22 bp, Artificial Sequence
  chemically synthesized
atccacgtccctacaaaggact

SEQ ID NO: 775371 - DNA, 22 bp, Artificial Sequence
  chemically synthesized
caaaggacttgaactcatcctc

SEQ ID NO: 775372 - DNA, 22 bp, Artificial Sequence
  chemically synthesized
tgcagccataaagaggatgagt

SEQ ID NO: 775373 - DNA, 22 bp, Artificial Sequence
  chemically synthesized
gaactcatcctctttatggctg

SEQ ID NO: 775374 - DNA, 22 bp, Artificial Sequence
  chemically synthesized
aactcatcctctttatggctgc

SEQ ID NO: 775375 - DNA, 22 bp, Artificial Sequence
  chemically synthesized
atcctctttatggctgcatagt

SEQ ID NO: 775376 - DNA, 22 bp, Artificial Sequence
  chemically synthesized
tttatggctgcatagtattcca

SEQ ID NO: 775377 - DNA, 22 bp, Artificial Sequence
  chemically synthesized
tatggctgcatagtattccatg

SEQ ID NO: 775378 - DNA, 22 bp, Artificial Sequence
  chemically synthesized
atggctgcatagtattccatga

SEQ ID NO: 775379 - DNA, 22 bp, Artificial Sequence
  chemically synthesized
tggctgcatagtattccatgat

SEQ ID NO: 775380 - DNA, 22 bp, Artificial Sequence
  chemically synthesized
catagtattccatgatatatat

SEQ ID NO: 775381 - DNA, 22 bp, Artificial Sequence
  chemically synthesized
agaaaatgtggcacatatatat

SEQ ID NO: 775382 - DNA, 22 bp, Artificial Sequence
  chemically synthesized
catgatatatatgtgccacatt

SEQ ID NO: 775383 - DNA, 22 bp, Artificial Sequence
  chemically synthesized
tcttaatccggtctatcattga

SEQ ID NO: 775384 - DNA, 22 bp, Artificial Sequence
  chemically synthesized
cttaatccggtctatcattgat

SEQ ID NO: 775385 - DNA, 22 bp, Artificial Sequence
  chemically synthesized
ttaatccggtctatcattgatg

SEQ ID NO: 775386 - DNA, 22 bp, Artificial Sequence
  chemically synthesized
aatccggtctatcattgatgga

SEQ ID NO: 775387 - DNA, 22 bp, Artificial Sequence
  chemically synthesized
atccggtctatcattgatggac

SEQ ID NO: 775388 - DNA, 22 bp, Artificial Sequence
  chemically synthesized
gaaccaacccaaatgtccatca

SEQ ID NO: 775389 - DNA, 22 bp, Artificial Sequence
  chemically synthesized
ggaaccaacccaaatgtccatc

SEQ ID NO: 775390 - DNA, 22 bp, Artificial Sequence
  chemically synthesized
tcattgatggacatttgggttg

SEQ ID NO: 775391 - DNA, 22 bp, Artificial Sequence
  chemically synthesized
atggacatttgggttggttcca

SEQ ID NO: 775392 - DNA, 22 bp, Artificial Sequence
  chemically synthesized
cagtagcaaagacttggaacca

SEQ ID NO: 775393 - DNA, 22 bp, Artificial Sequence
  chemically synthesized
acagtagcaaagacttggaacc

SEQ ID NO: 775394 - DNA, 22 bp, Artificial Sequence
  chemically synthesized
tttacagtagcaaagacttgga

SEQ ID NO: 775395 - DNA, 22 bp, Artificial Sequence
  chemically synthesized
gggttggttccaagtctttgct

SEQ ID NO: 775396 - DNA, 22 bp, Artificial Sequence
  chemically synthesized
ggttggttccaagtctttgcta

SEQ ID NO: 775397 - DNA, 22 bp, Artificial Sequence
  chemically synthesized
cggcactatttacagtagcaaa

SEQ ID NO: 775398 - DNA, 22 bp, Artificial Sequence
  chemically synthesized
gttccaagtctttgctactgta

SEQ ID NO: 775399 - DNA, 22 bp, Artificial Sequence
  chemically synthesized
ttgcggcactatttacagtagc

SEQ ID NO: 775400 - DNA, 22 bp, Artificial Sequence
  chemically synthesized
attgcggcactatttacagtag

SEQ ID NO: 775401 - DNA, 22 bp, Artificial Sequence
  chemically synthesized
caagtctttgctactgtaaata

SEQ ID NO: 775402 - DNA, 22 bp, Artificial Sequence
  chemically synthesized
tgctactgtaaatagtgccgca

SEQ ID NO: 775403 - DNA, 22 bp, Artificial Sequence
  chemically synthesized
gctactgtaaatagtgccgcaa

SEQ ID NO: 775404 - DNA, 22 bp, Artificial Sequence
  chemically synthesized
ctactgtaaatagtgccgcaat

SEQ ID NO: 775405 - DNA, 22 bp, Artificial Sequence
  chemically synthesized
cacacgtatgtttattgcggca

SEQ ID NO: 775406 - DNA, 22 bp, Artificial Sequence
  chemically synthesized
ctgtaaatagtgccgcaataaa

SEQ ID NO: 775407 - DNA, 22 bp, Artificial Sequence
  chemically synthesized
taaatagtgccgcaataaacat

SEQ ID NO: 775408 - DNA, 22 bp, Artificial Sequence
  chemically synthesized
acctgcacacgtatgtttattg

SEQ ID NO: 775409 - DNA, 22 bp, Artificial Sequence
  chemically synthesized
gtctcacctgcacacgtatgtt

SEQ ID NO: 775410 - DNA, 22 bp, Artificial Sequence
  chemically synthesized
ggtctcacctgcacacgtatgt

SEQ ID NO: 775411 - DNA, 22 bp, Artificial Sequence
  chemically synthesized
aaaatatttggtctcacctgca

SEQ ID NO: 775412 - DNA, 22 bp, Artificial Sequence
  chemically synthesized
attgaaaatatttggtctcacc

SEQ ID NO: 775413 - DNA, 22 bp, Artificial Sequence
  chemically synthesized
cattgaaaatatttggtctcac

SEQ ID NO: 775414 - DNA, 22 bp, Artificial Sequence
  chemically synthesized
tcattgaaaatatttggtctca

SEQ ID NO: 775415 - DNA, 22 bp, Artificial Sequence
  chemically synthesized
gacaccgtattttcattgaaaa

SEQ ID NO: 775416 - DNA, 22 bp, Artificial Sequence
  chemically synthesized
ggacaccgtattttcattgaaa

SEQ ID NO: 775417 - DNA, 22 bp, Artificial Sequence
  chemically synthesized
aatttggacaccgtattttcat

SEQ ID NO: 775418 - DNA, 22 bp, Artificial Sequence
  chemically synthesized
tcaatgaaaatacggtgtccaa

SEQ ID NO: 775419 - DNA, 22 bp, Artificial Sequence
  chemically synthesized
caatgaaaatacggtgtccaaa

SEQ ID NO: 775420 - DNA, 22 bp, Artificial Sequence
  chemically synthesized
aatgaaaatacggtgtccaaat

SEQ ID NO: 775421 - DNA, 22 bp, Artificial Sequence
  chemically synthesized
catcccatctcaatttggacac

SEQ ID NO: 775422 - DNA, 22 bp, Artificial Sequence
  chemically synthesized
aattgcatcccatctcaatttg

SEQ ID NO: 775423 - DNA, 22 bp, Artificial Sequence
  chemically synthesized
caattgcatcccatctcaattt

SEQ ID NO: 775424 - DNA, 22 bp, Artificial Sequence
  chemically synthesized
tcaattgcatcccatctcaatt

SEQ ID NO: 775425 - DNA, 22 bp, Artificial Sequence
  chemically synthesized
gcatgtgtctttcaattgcatc

SEQ ID NO: 775426 - DNA, 22 bp, Artificial Sequence
  chemically synthesized
agatgggatgcaattgaaagac

SEQ ID NO: 775427 - DNA, 22 bp, Artificial Sequence
  chemically synthesized
aaatctggcatgtgtctttcaa

SEQ ID NO: 775428 - DNA, 22 bp, Artificial Sequence
  chemically synthesized
gaaatctggcatgtgtctttca

SEQ ID NO: 775429 - DNA, 22 bp, Artificial Sequence
  chemically synthesized
tgaaatctggcatgtgtctttc

SEQ ID NO: 775430 - DNA, 22 bp, Artificial Sequence
  chemically synthesized
agtctttgaaatctggcatgtg

SEQ ID NO: 775431 - DNA, 22 bp, Artificial Sequence
  chemically synthesized
taagtctttgaaatctggcatg

SEQ ID NO: 775432 - DNA, 22 bp, Artificial Sequence
  chemically synthesized
aaagacacatgccagatttcaa

SEQ ID NO: 775433 - DNA, 22 bp, Artificial Sequence
  chemically synthesized
cattctaagtctttgaaatctg

SEQ ID NO: 775434 - DNA, 22 bp, Artificial Sequence
  chemically synthesized
ccattctaagtctttgaaatct

SEQ ID NO: 775435 - DNA, 22 bp, Artificial Sequence
  chemically synthesized
tccattctaagtctttgaaatc

SEQ ID NO: 775436 - DNA, 22 bp, Artificial Sequence
  chemically synthesized
ttccattctaagtctttgaaat

SEQ ID NO: 775437 - DNA, 22 bp, Artificial Sequence
  chemically synthesized
tttccattctaagtctttgaaa

SEQ ID NO: 775438 - DNA, 22 bp, Artificial Sequence
  chemically synthesized
ctttttccattctaagtctttg

SEQ ID NO: 775439 - DNA, 22 bp, Artificial Sequence
  chemically synthesized
gctttttccattctaagtcttt

SEQ ID NO: 775440 - DNA, 22 bp, Artificial Sequence
  chemically synthesized
ataaaatttgctttttccattc

SEQ ID NO: 775441 - DNA, 22 bp, Artificial Sequence
  chemically synthesized
caaagacttagaatggaaaaag

SEQ ID NO: 775442 - DNA, 22 bp, Artificial Sequence
  chemically synthesized
aaagacttagaatggaaaaagc

SEQ ID NO: 775443 - DNA, 22 bp, Artificial Sequence
  chemically synthesized
agaatggaaaaagcaaatttta

SEQ ID NO: 775444 - DNA, 22 bp, Artificial Sequence
  chemically synthesized
gaatggaaaaagcaaattttat

SEQ ID NO: 775445 - DNA, 22 bp, Artificial Sequence
  chemically synthesized
aatatgtaatcaataaaaagta

SEQ ID NO: 775446 - DNA, 22 bp, Artificial Sequence
  chemically synthesized
caatatgtaatcaataaaaagt

SEQ ID NO: 775447 - DNA, 22 bp, Artificial Sequence
  chemically synthesized
tttcaatatgtaatcaataaaa

SEQ ID NO: 775448 - DNA, 22 bp, Artificial Sequence
  chemically synthesized
tattaatactttttattgatta

SEQ ID NO: 775449 - DNA, 22 bp, Artificial Sequence
  chemically synthesized
attaatactttttattgattac

SEQ ID NO: 775450 - DNA, 22 bp, Artificial Sequence
  chemically synthesized
ttatttcaatatgtaatcaata

SEQ ID NO: 775451 - DNA, 22 bp, Artificial Sequence
  chemically synthesized
ttaatactttttattgattaca

SEQ ID NO: 775452 - DNA, 22 bp, Artificial Sequence
  chemically synthesized
atactttttattgattacatat

SEQ ID NO: 775453 - DNA, 22 bp, Artificial Sequence
  chemically synthesized
tttattgattacatattgaaat

SEQ ID NO: 775454 - DNA, 22 bp, Artificial Sequence
  chemically synthesized
ttattgattacatattgaaata

SEQ ID NO: 775455 - DNA, 22 bp, Artificial Sequence
  chemically synthesized
tattgattacatattgaaataa

SEQ ID NO: 775456 - DNA, 22 bp, Artificial Sequence
  chemically synthesized
attgattacatattgaaataat

SEQ ID NO: 775457 - DNA, 22 bp, Artificial Sequence
  chemically synthesized
ttgattacatattgaaataata

SEQ ID NO: 775458 - DNA, 22 bp, Artificial Sequence
  chemically synthesized
attacatattgaaataataata

SEQ ID NO: 775459 - DNA, 22 bp, Artificial Sequence
  chemically synthesized
atatatccaacatattattatt

SEQ ID NO: 775460 - DNA, 22 bp, Artificial Sequence
  chemically synthesized
catattgaaataataatatgtt

SEQ ID NO: 775461 - DNA, 22 bp, Artificial Sequence
  chemically synthesized
accctgatatatccaacatatt

SEQ ID NO: 775462 - DNA, 22 bp, Artificial Sequence
  chemically synthesized
ttgaccctgatatatccaacat

SEQ ID NO: 775463 - DNA, 22 bp, Artificial Sequence
  chemically synthesized
attgaccctgatatatccaaca

SEQ ID NO: 775464 - DNA, 22 bp, Artificial Sequence
  chemically synthesized
aaataataatatgttggatata

SEQ ID NO: 775465 - DNA, 22 bp, Artificial Sequence
  chemically synthesized
tattgaccctgatatatccaac

SEQ ID NO: 775466 - DNA, 22 bp, Artificial Sequence
  chemically synthesized
atattttattgaccctgatata

SEQ ID NO: 775467 - DNA, 22 bp, Artificial Sequence
  chemically synthesized
gatatatcagggtcaataaaat

SEQ ID NO: 775468 - DNA, 22 bp, Artificial Sequence
  chemically synthesized
aaagtagaagtgaaactaatat

SEQ ID NO: 775469 - DNA, 22 bp, Artificial Sequence
  chemically synthesized
aaaagtagaagtgaaactaata

SEQ ID NO: 775470 - DNA, 22 bp, Artificial Sequence
  chemically synthesized
taaaagtagaagtgaaactaat

SEQ ID NO: 775471 - DNA, 22 bp, Artificial Sequence
  chemically synthesized
tttaaaagtagaagtgaaacta

SEQ ID NO: 775472 - DNA, 22 bp, Artificial Sequence
  chemically synthesized
gtagccacgttctttaaaagta

SEQ ID NO: 775473 - DNA, 22 bp, Artificial Sequence
  chemically synthesized
gtttcacttctacttttaaaga

SEQ ID NO: 775474 - DNA, 22 bp, Artificial Sequence
  chemically synthesized
tagtagccacgttctttaaaag

SEQ ID NO: 775475 - DNA, 22 bp, Artificial Sequence
  chemically synthesized
cacttctacttttaaagaacgt

SEQ ID NO: 775476 - DNA, 22 bp, Artificial Sequence
  chemically synthesized
acttctacttttaaagaacgtg

SEQ ID NO: 775477 - DNA, 22 bp, Artificial Sequence
  chemically synthesized
agtattctagtagccacgttct

SEQ ID NO: 775478 - DNA, 22 bp, Artificial Sequence
  chemically synthesized
aagtattctagtagccacgttc

SEQ ID NO: 775479 - DNA, 22 bp, Artificial Sequence
  chemically synthesized
ctacttttaaagaacgtggcta

SEQ ID NO: 775480 - DNA, 22 bp, Artificial Sequence
  chemically synthesized
tacttttaaagaacgtggctac

SEQ ID NO: 775481 - DNA, 22 bp, Artificial Sequence
  chemically synthesized
cttttaaagaacgtggctacta

SEQ ID NO: 775482 - DNA, 22 bp, Artificial Sequence
  chemically synthesized
ttaaagaacgtggctactagaa

SEQ ID NO: 775483 - DNA, 22 bp, Artificial Sequence
  chemically synthesized
taaagaacgtggctactagaat

SEQ ID NO: 775484 - DNA, 22 bp, Artificial Sequence
  chemically synthesized
aaagaacgtggctactagaata

SEQ ID NO: 775485 - DNA, 22 bp, Artificial Sequence
  chemically synthesized
tgtaatcttaagtattctagta

SEQ ID NO: 775486 - DNA, 22 bp, Artificial Sequence
  chemically synthesized
aagaacgtggctactagaatac

SEQ ID NO: 775487 - DNA, 22 bp, Artificial Sequence
  chemically synthesized
ctagaatacttaagattacata

SEQ ID NO: 775488 - DNA, 22 bp, Artificial Sequence
  chemically synthesized
gaatacttaagattacataggt

SEQ ID NO: 775489 - DNA, 22 bp, Artificial Sequence
  chemically synthesized
tcccatagaaatgagagccacc

SEQ ID NO: 775490 - DNA, 22 bp, Artificial Sequence
  chemically synthesized
aagattacataggtggctctca

SEQ ID NO: 775491 - DNA, 22 bp, Artificial Sequence
  chemically synthesized
agattacataggtggctctcat

SEQ ID NO: 775492 - DNA, 22 bp, Artificial Sequence
  chemically synthesized
cataggtggctctcatttctat

SEQ ID NO: 775493 - DNA, 22 bp, Artificial Sequence
  chemically synthesized
tcatttctatgggacaacactg

SEQ ID NO: 775494 - DNA, 22 bp, Artificial Sequence
  chemically synthesized
atttctatgggacaacactgtt

SEQ ID NO: 775495 - DNA, 22 bp, Artificial Sequence
  chemically synthesized
ctatgggacaacactgttctgg

SEQ ID NO: 775496 - DNA, 22 bp, Artificial Sequence
  chemically synthesized
tatgggacaacactgttctgga

SEQ ID NO: 775497 - DNA, 22 bp, Artificial Sequence
  chemically synthesized
tgggacaacactgttctggaca

SEQ ID NO: 775498 - DNA, 22 bp, Artificial Sequence
  chemically synthesized
ccaatgccagcacaatgtccag

SEQ ID NO: 775499 - DNA, 22 bp, Artificial Sequence
  chemically synthesized
tgttcccaatgccagcacaatg

SEQ ID NO: 775500 - DNA, 22 bp, Artificial Sequence
  chemically synthesized
atgttcccaatgccagcacaat

SEQ ID NO: 775501 - DNA, 22 bp, Artificial Sequence
  chemically synthesized
tatgttcccaatgccagcacaa

SEQ ID NO: 775502 - DNA, 22 bp, Artificial Sequence
  chemically synthesized
ttctggacattgtgctggcatt

SEQ ID NO: 775503 - DNA, 22 bp, Artificial Sequence
  chemically synthesized
gttttatgttcccaatgccagc

SEQ ID NO: 775504 - DNA, 22 bp, Artificial Sequence
  chemically synthesized
agttttatgttcccaatgccag

SEQ ID NO: 775505 - DNA, 22 bp, Artificial Sequence
  chemically synthesized
tggacattgtgctggcattggg

SEQ ID NO: 775506 - DNA, 22 bp, Artificial Sequence
  chemically synthesized
gacattgtgctggcattgggaa

SEQ ID NO: 775507 - DNA, 22 bp, Artificial Sequence
  chemically synthesized
tgctggcattgggaacataaaa

SEQ ID NO: 775508 - DNA, 22 bp, Artificial Sequence
  chemically synthesized
agggaatgtttagttttatgtt

SEQ ID NO: 775509 - DNA, 22 bp, Artificial Sequence
  chemically synthesized
aagggaatgtttagttttatgt

SEQ ID NO: 775510 - DNA, 22 bp, Artificial Sequence
  chemically synthesized
gcattgggaacataaaactaaa

SEQ ID NO: 775511 - DNA, 22 bp, Artificial Sequence
  chemically synthesized
ggaacataaaactaaacattcc

SEQ ID NO: 775512 - DNA, 22 bp, Artificial Sequence
  chemically synthesized
cgtaaaatccttaagggaatgt

SEQ ID NO: 775513 - DNA, 22 bp, Artificial Sequence
  chemically synthesized
aacattcccttaaggattttac

SEQ ID NO: 775514 - DNA, 22 bp, Artificial Sequence
  chemically synthesized
ccttaaggattttacggaatgg

SEQ ID NO: 775515 - DNA, 22 bp, Artificial Sequence
  chemically synthesized
aaggattttacggaatggtggt

SEQ ID NO: 775516 - DNA, 22 bp, Artificial Sequence
  chemically synthesized
aggattttacggaatggtggta

SEQ ID NO: 775517 - DNA, 22 bp, Artificial Sequence
  chemically synthesized
tagcagtaaatgtaccaccatt

SEQ ID NO: 775518 - DNA, 22 bp, Artificial Sequence
  chemically synthesized
ctatagcagtaaatgtaccacc

SEQ ID NO: 775519 - DNA, 22 bp, Artificial Sequence
  chemically synthesized
tgctatagcagtaaatgtacca

SEQ ID NO: 775520 - DNA, 22 bp, Artificial Sequence
  chemically synthesized
tacggaatggtggtacatttac

SEQ ID NO: 775521 - DNA, 22 bp, Artificial Sequence
  chemically synthesized
tctgctatagcagtaaatgtac

SEQ ID NO: 775522 - DNA, 22 bp, Artificial Sequence
  chemically synthesized
acggaatggtggtacatttact

SEQ ID NO: 775523 - DNA, 22 bp, Artificial Sequence
  chemically synthesized
cggaatggtggtacatttactg

SEQ ID NO: 775524 - DNA, 22 bp, Artificial Sequence
  chemically synthesized
tatctctctgctatagcagtaa

SEQ ID NO: 775525 - DNA, 22 bp, Artificial Sequence
  chemically synthesized
tatatctctctgctatagcagt

SEQ ID NO: 775526 - DNA, 22 bp, Artificial Sequence
  chemically synthesized
ctctatatctctctgctatagc

SEQ ID NO: 775527 - DNA, 22 bp, Artificial Sequence
  chemically synthesized
cattcctctatatctctctgct

SEQ ID NO: 775528 - DNA, 22 bp, Artificial Sequence
  chemically synthesized
gcattcctctatatctctctgc

SEQ ID NO: 775529 - DNA, 22 bp, Artificial Sequence
  chemically synthesized
tgcattcctctatatctctctg

SEQ ID NO: 775530 - DNA, 22 bp, Artificial Sequence
  chemically synthesized
actgctatagcagagagatata

SEQ ID NO: 775531 - DNA, 22 bp, Artificial Sequence
  chemically synthesized
ctgctatagcagagagatatag

SEQ ID NO: 775532 - DNA, 22 bp, Artificial Sequence
  chemically synthesized
ctatagcagagagatatagagg

SEQ ID NO: 775533 - DNA, 22 bp, Artificial Sequence
  chemically synthesized
tagcagagagatatagaggaat

SEQ ID NO: 775534 - DNA, 22 bp, Artificial Sequence
  chemically synthesized
tgtccccatagcgtcctttgca

SEQ ID NO: 775535 - DNA, 22 bp, Artificial Sequence
  chemically synthesized
atctatgtccccatagcgtcct

SEQ ID NO: 775536 - DNA, 22 bp, Artificial Sequence
  chemically synthesized
ctcatctatgtccccatagcgt

SEQ ID NO: 775537 - DNA, 22 bp, Artificial Sequence
  chemically synthesized
ctactcatctatgtccccatag

SEQ ID NO: 775538 - DNA, 22 bp, Artificial Sequence
  chemically synthesized
attgctactcatctatgtcccc

SEQ ID NO: 775539 - DNA, 22 bp, Artificial Sequence
  chemically synthesized
aattgctactcatctatgtccc

SEQ ID NO: 775540 - DNA, 22 bp, Artificial Sequence
  chemically synthesized
atttaattgctactcatctatg

SEQ ID NO: 775541 - DNA, 22 bp, Artificial Sequence
  chemically synthesized
tggggacatagatgagtagcaa

SEQ ID NO: 775542 - DNA, 22 bp, Artificial Sequence
  chemically synthesized
acatcagcctaatttaattgct

SEQ ID NO: 775543 - DNA, 22 bp, Artificial Sequence
  chemically synthesized
ggtagccatggttgacatcagc

SEQ ID NO: 775544 - DNA, 22 bp, Artificial Sequence
  chemically synthesized
aggtagccatggttgacatcag

SEQ ID NO: 775545 - DNA, 22 bp, Artificial Sequence
  chemically synthesized
taggtagccatggttgacatca

SEQ ID NO: 775546 - DNA, 22 bp, Artificial Sequence
  chemically synthesized
ttttaggtagccatggttgaca

SEQ ID NO: 775547 - DNA, 22 bp, Artificial Sequence
  chemically synthesized
aattaggctgatgtcaaccatg

SEQ ID NO: 775548 - DNA, 22 bp, Artificial Sequence
  chemically synthesized
attttaggtagccatggttgac

SEQ ID NO: 775549 - DNA, 22 bp, Artificial Sequence
  chemically synthesized
ggctgatgtcaaccatggctac

SEQ ID NO: 775550 - DNA, 22 bp, Artificial Sequence
  chemically synthesized
atgtcaaccatggctacctaaa

SEQ ID NO: 775551 - DNA, 22 bp, Artificial Sequence
  chemically synthesized
agcatgccttattttaggtagc

SEQ ID NO: 775552 - DNA, 22 bp, Artificial Sequence
  chemically synthesized
aagcatgccttattttaggtag

SEQ ID NO: 775553 - DNA, 22 bp, Artificial Sequence
  chemically synthesized
aggatcaatttaagcatgcctt

SEQ ID NO: 775554 - DNA, 22 bp, Artificial Sequence
  chemically synthesized
aaggatcaatttaagcatgcct

SEQ ID NO: 775555 - DNA, 22 bp, Artificial Sequence
  chemically synthesized
taaggatcaatttaagcatgcc

SEQ ID NO: 775556 - DNA, 22 bp, Artificial Sequence
  chemically synthesized
cctaaaataaggcatgcttaaa

SEQ ID NO: 775557 - DNA, 22 bp, Artificial Sequence
  chemically synthesized
aaataaggcatgcttaaattga

SEQ ID NO: 775558 - DNA, 22 bp, Artificial Sequence
  chemically synthesized
aaactttaaggatcaatttaag

SEQ ID NO: 775559 - DNA, 22 bp, Artificial Sequence
  chemically synthesized
cactcaaactttaaggatcaat

SEQ ID NO: 775560 - DNA, 22 bp, Artificial Sequence
  chemically synthesized
ccactcaaactttaaggatcaa

SEQ ID NO: 775561 - DNA, 22 bp, Artificial Sequence
  chemically synthesized
acttccactcaaactttaagga

SEQ ID NO: 775562 - DNA, 22 bp, Artificial Sequence
  chemically synthesized
aaattgatccttaaagtttgag

SEQ ID NO: 775563 - DNA, 22 bp, Artificial Sequence
  chemically synthesized
atctaacttccactcaaacttt

SEQ ID NO: 775564 - DNA, 22 bp, Artificial Sequence
  chemically synthesized
aattgatccttaaagtttgagt

SEQ ID NO: 775565 - DNA, 22 bp, Artificial Sequence
  chemically synthesized
catctaacttccactcaaactt

SEQ ID NO: 775566 - DNA, 22 bp, Artificial Sequence
  chemically synthesized
ttcatctaacttccactcaaac

SEQ ID NO: 775567 - DNA, 22 bp, Artificial Sequence
  chemically synthesized
cttcatctaacttccactcaaa

SEQ ID NO: 775568 - DNA, 22 bp, Artificial Sequence
  chemically synthesized
tcttcatctaacttccactcaa

SEQ ID NO: 775569 - DNA, 22 bp, Artificial Sequence
  chemically synthesized
atccttaaagtttgagtggaag

SEQ ID NO: 775570 - DNA, 22 bp, Artificial Sequence
  chemically synthesized
gtctttcttcatctaacttcca

SEQ ID NO: 775571 - DNA, 22 bp, Artificial Sequence
  chemically synthesized
cgtctttcttcatctaacttcc

SEQ ID NO: 775572 - DNA, 22 bp, Artificial Sequence
  chemically synthesized
aaagtttgagtggaagttagat

SEQ ID NO: 775573 - DNA, 22 bp, Artificial Sequence
  chemically synthesized
aagtttgagtggaagttagatg

SEQ ID NO: 775574 - DNA, 22 bp, Artificial Sequence
  chemically synthesized
gagtggaagttagatgaagaaa

SEQ ID NO: 775575 - DNA, 22 bp, Artificial Sequence
  chemically synthesized
agtggaagttagatgaagaaag

SEQ ID NO: 775576 - DNA, 22 bp, Artificial Sequence
  chemically synthesized
gaatacccttcgtctttcttca

SEQ ID NO: 775577 - DNA, 22 bp, Artificial Sequence
  chemically synthesized
ctggaatacccttcgtctttct

SEQ ID NO: 775578 - DNA, 22 bp, Artificial Sequence
  chemically synthesized
cctggaatacccttcgtctttc

SEQ ID NO: 775579 - DNA, 22 bp, Artificial Sequence
  chemically synthesized
gatgaagaaagacgaagggtat

SEQ ID NO: 775580 - DNA, 22 bp, Artificial Sequence
  chemically synthesized
cgtcttcctggaatacccttcg

SEQ ID NO: 775581 - DNA, 22 bp, Artificial Sequence
  chemically synthesized
tcgtacatgccattccgtcttc

SEQ ID NO: 775582 - DNA, 22 bp, Artificial Sequence
  chemically synthesized
caggaagacggaatggcatgta

SEQ ID NO: 775583 - DNA, 22 bp, Artificial Sequence
  chemically synthesized
ccaatgttatcgtacatgccat

SEQ ID NO: 775584 - DNA, 22 bp, Artificial Sequence
  chemically synthesized
tcccaatgttatcgtacatgcc

SEQ ID NO: 775585 - DNA, 22 bp, Artificial Sequence
  chemically synthesized
ctcccaatgttatcgtacatgc

SEQ ID NO: 775586 - DNA, 22 bp, Artificial Sequence
  chemically synthesized
cttctcccaatgttatcgtaca

SEQ ID NO: 775587 - DNA, 22 bp, Artificial Sequence
  chemically synthesized
tactacttctcccaatgttatc

SEQ ID NO: 775588 - DNA, 22 bp, Artificial Sequence
  chemically synthesized
tattgtactacttctcccaatg

SEQ ID NO: 775589 - DNA, 22 bp, Artificial Sequence
  chemically synthesized
atcactgtattgtactacttct

SEQ ID NO: 775590 - DNA, 22 bp, Artificial Sequence
  chemically synthesized
aatcactgtattgtactacttc

SEQ ID NO: 775591 - DNA, 22 bp, Artificial Sequence
  chemically synthesized
ttaatcactgtattgtactact

SEQ ID NO: 775592 - DNA, 22 bp, Artificial Sequence
  chemically synthesized
gattcttaatcactgtattgta

SEQ ID NO: 775593 - DNA, 22 bp, Artificial Sequence
  chemically synthesized
ggagaagtagtacaatacagtg

SEQ ID NO: 775594 - DNA, 22 bp, Artificial Sequence
  chemically synthesized
tagattcttaatcactgtattg

SEQ ID NO: 775595 - DNA, 22 bp, Artificial Sequence
  chemically synthesized
aaagggtagaggttctagattc

SEQ ID NO: 775596 - DNA, 22 bp, Artificial Sequence
  chemically synthesized
agaatctagaacctctaccctt

SEQ ID NO: 775597 - DNA, 22 bp, Artificial Sequence
  chemically synthesized
agtgcatatgactcaaagggta

SEQ ID NO: 775598 - DNA, 22 bp, Artificial Sequence
  chemically synthesized
gagtgcatatgactcaaagggt

SEQ ID NO: 775599 - DNA, 22 bp, Artificial Sequence
  chemically synthesized
gaacctctaccctttgagtcat

SEQ ID NO: 775600 - DNA, 22 bp, Artificial Sequence
  chemically synthesized
taccctttgagtcatatgcact

SEQ ID NO: 775601 - DNA, 22 bp, Artificial Sequence
  chemically synthesized
ccctttgagtcatatgcactca

SEQ ID NO: 775602 - DNA, 22 bp, Artificial Sequence
  chemically synthesized
tgagtcatatgcactcaagctg

SEQ ID NO: 775603 - DNA, 22 bp, Artificial Sequence
  chemically synthesized
gagtcatatgcactcaagctgt

SEQ ID NO: 775604 - DNA, 22 bp, Artificial Sequence
  chemically synthesized
agtcatatgcactcaagctgta

SEQ ID NO: 775605 - DNA, 22 bp, Artificial Sequence
  chemically synthesized
acagatagtaagtggtacagct

SEQ ID NO: 775606 - DNA, 22 bp, Artificial Sequence
  chemically synthesized
aagctgtaccacttactatctg

SEQ ID NO: 775607 - DNA, 22 bp, Artificial Sequence
  chemically synthesized
catatgatctcacagatagtaa

SEQ ID NO: 775608 - DNA, 22 bp, Artificial Sequence
  chemically synthesized
acatatgatctcacagatagta

SEQ ID NO: 775609 - DNA, 22 bp, Artificial Sequence
  chemically synthesized
taccacttactatctgtgagat

SEQ ID NO: 775610 - DNA, 22 bp, Artificial Sequence
  chemically synthesized
actatctgtgagatcatatgta

SEQ ID NO: 775611 - DNA, 22 bp, Artificial Sequence
  chemically synthesized
ctatctgtgagatcatatgtaa

SEQ ID NO: 775612 - DNA, 22 bp, Artificial Sequence
  chemically synthesized
tctgtgagatcatatgtaaatt

SEQ ID NO: 775613 - DNA, 22 bp, Artificial Sequence
  chemically synthesized
tgagatcatatgtaaattactt

SEQ ID NO: 775614 - DNA, 22 bp, Artificial Sequence
  chemically synthesized
acagagaaggaaagagatacag

SEQ ID NO: 775615 - DNA, 22 bp, Artificial Sequence
  chemically synthesized
cacagagaaggaaagagataca

SEQ ID NO: 775616 - DNA, 22 bp, Artificial Sequence
  chemically synthesized
tttcacagagaaggaaagagat

SEQ ID NO: 775617 - DNA, 22 bp, Artificial Sequence
  chemically synthesized
cttatctgtatctctttccttc

SEQ ID NO: 775618 - DNA, 22 bp, Artificial Sequence
  chemically synthesized
atctgtatctctttccttctct

SEQ ID NO: 775619 - DNA, 22 bp, Artificial Sequence
  chemically synthesized
tctgtatctctttccttctctg

SEQ ID NO: 775620 - DNA, 22 bp, Artificial Sequence
  chemically synthesized
tatctctttccttctctgtgaa

SEQ ID NO: 775621 - DNA, 22 bp, Artificial Sequence
  chemically synthesized
tttccttctctgtgaaataggg

SEQ ID NO: 775622 - DNA, 22 bp, Artificial Sequence
  chemically synthesized
acagtagtagtatccctatttc

SEQ ID NO: 775623 - DNA, 22 bp, Artificial Sequence
  chemically synthesized
tccttctctgtgaaatagggat

SEQ ID NO: 775624 - DNA, 22 bp, Artificial Sequence
  chemically synthesized
ccttctctgtgaaatagggata

SEQ ID NO: 775625 - DNA, 22 bp, Artificial Sequence
  chemically synthesized
cttctctgtgaaatagggatac

SEQ ID NO: 775626 - DNA, 22 bp, Artificial Sequence
  chemically synthesized
ctctgtgaaatagggatactac

SEQ ID NO: 775627 - DNA, 22 bp, Artificial Sequence
  chemically synthesized
tctgtgaaatagggatactact

SEQ ID NO: 775628 - DNA, 22 bp, Artificial Sequence
  chemically synthesized
taaggttgacagtagtagtatc

SEQ ID NO: 775629 - DNA, 22 bp, Artificial Sequence
  chemically synthesized
tgtgaaatagggatactactac

SEQ ID NO: 775630 - DNA, 22 bp, Artificial Sequence
  chemically synthesized
ataaggttgacagtagtagtat

SEQ ID NO: 775631 - DNA, 22 bp, Artificial Sequence
  chemically synthesized
tataaggttgacagtagtagta

SEQ ID NO: 775632 - DNA, 22 bp, Artificial Sequence
  chemically synthesized
tgaaatagggatactactactg

SEQ ID NO: 775633 - DNA, 22 bp, Artificial Sequence
  chemically synthesized
cgataactttataaggttgaca

SEQ ID NO: 775634 - DNA, 22 bp, Artificial Sequence
  chemically synthesized
acgataactttataaggttgac

SEQ ID NO: 775635 - DNA, 22 bp, Artificial Sequence
  chemically synthesized
ttacgataactttataaggttg

SEQ ID NO: 775636 - DNA, 22 bp, Artificial Sequence
  chemically synthesized
cttacgataactttataaggtt

SEQ ID NO: 775637 - DNA, 22 bp, Artificial Sequence
  chemically synthesized
ctactgtcaaccttataaagtt

SEQ ID NO: 775638 - DNA, 22 bp, Artificial Sequence
  chemically synthesized
ctgtcaaccttataaagttatc

SEQ ID NO: 775639 - DNA, 22 bp, Artificial Sequence
  chemically synthesized
atgcatttcttacgataacttt

SEQ ID NO: 775640 - DNA, 22 bp, Artificial Sequence
  chemically synthesized
tcaaccttataaagttatcgta

SEQ ID NO: 775641 - DNA, 22 bp, Artificial Sequence
  chemically synthesized
actcatgcatttcttacgataa

SEQ ID NO: 775642 - DNA, 22 bp, Artificial Sequence
  chemically synthesized
ataaagttatcgtaagaaatgc

SEQ ID NO: 775643 - DNA, 22 bp, Artificial Sequence
  chemically synthesized
taaagttatcgtaagaaatgca

SEQ ID NO: 775644 - DNA, 22 bp, Artificial Sequence
  chemically synthesized
agcagtatattaactcatgcat

SEQ ID NO: 775645 - DNA, 22 bp, Artificial Sequence
  chemically synthesized
tgagcagtatattaactcatgc

SEQ ID NO: 775646 - DNA, 22 bp, Artificial Sequence
  chemically synthesized
tcgtaagaaatgcatgagttaa

SEQ ID NO: 775647 - DNA, 22 bp, Artificial Sequence
  chemically synthesized
atatactgctcagaactgtgtc

SEQ ID NO: 775648 - DNA, 22 bp, Artificial Sequence
  chemically synthesized
ctcagaactgtgtctggtccac

SEQ ID NO: 775649 - DNA, 22 bp, Artificial Sequence
  chemically synthesized
agaactgtgtctggtccacatt

SEQ ID NO: 775650 - DNA, 22 bp, Artificial Sequence
  chemically synthesized
tgtctggtccacattgtatttc

SEQ ID NO: 775651 - DNA, 22 bp, Artificial Sequence
  chemically synthesized
acaataatagcaggaaatacaa

SEQ ID NO: 775652 - DNA, 22 bp, Artificial Sequence
  chemically synthesized
attcacaataatagcaggaaat

SEQ ID NO: 775653 - DNA, 22 bp, Artificial Sequence
  chemically synthesized
gtccacattgtatttcctgcta

SEQ ID NO: 775654 - DNA, 22 bp, Artificial Sequence
  chemically synthesized
taattcacaataatagcaggaa

SEQ ID NO: 775655 - DNA, 22 bp, Artificial Sequence
  chemically synthesized
ctaattcacaataatagcagga

SEQ ID NO: 775656 - DNA, 22 bp, Artificial Sequence
  chemically synthesized
tctaattcacaataatagcagg

SEQ ID NO: 775657 - DNA, 22 bp, Artificial Sequence
  chemically synthesized
tatttcctgctattattgtgaa

SEQ ID NO: 775658 - DNA, 22 bp, Artificial Sequence
  chemically synthesized
tgggagtattttctaattcaca

SEQ ID NO: 775659 - DNA, 22 bp, Artificial Sequence
  chemically synthesized
cctgctattattgtgaattaga

SEQ ID NO: 775660 - DNA, 22 bp, Artificial Sequence
  chemically synthesized
ctgctattattgtgaattagaa

SEQ ID NO: 775661 - DNA, 22 bp, Artificial Sequence
  chemically synthesized
ctattattgtgaattagaaaat

SEQ ID NO: 775662 - DNA, 22 bp, Artificial Sequence
  chemically synthesized
caacctgtgggagtattttcta

SEQ ID NO: 775663 - DNA, 22 bp, Artificial Sequence
  chemically synthesized
ttattgtgaattagaaaatact

SEQ ID NO: 775664 - DNA, 22 bp, Artificial Sequence
  chemically synthesized
ctccaacctgtgggagtatttt

SEQ ID NO: 775665 - DNA, 22 bp, Artificial Sequence
  chemically synthesized
ttgtgaattagaaaatactccc

SEQ ID NO: 775666 - DNA, 22 bp, Artificial Sequence
  chemically synthesized
actccaacctgtgggagtattt

SEQ ID NO: 775667 - DNA, 22 bp, Artificial Sequence
  chemically synthesized
tactccaacctgtgggagtatt

SEQ ID NO: 775668 - DNA, 22 bp, Artificial Sequence
  chemically synthesized
tgaattagaaaatactcccaca

SEQ ID NO: 775669 - DNA, 22 bp, Artificial Sequence
  chemically synthesized
cctttactccaacctgtgggag

SEQ ID NO: 775670 - DNA, 22 bp, Artificial Sequence
  chemically synthesized
gaaaatactcccacaggttgga

SEQ ID NO: 775671 - DNA, 22 bp, Artificial Sequence
  chemically synthesized
acagacagtattccctttactc

SEQ ID NO: 775672 - DNA, 22 bp, Artificial Sequence
  chemically synthesized
cacagacagtattccctttact

SEQ ID NO: 775673 - DNA, 22 bp, Artificial Sequence
  chemically synthesized
ccacaggttggagtaaagggaa

SEQ ID NO: 775674 - DNA, 22 bp, Artificial Sequence
  chemically synthesized
tcacagacagtattccctttac

SEQ ID NO: 775675 - DNA, 22 bp, Artificial Sequence
  chemically synthesized
acactttcacagacagtattcc

SEQ ID NO: 775676 - DNA, 22 bp, Artificial Sequence
  chemically synthesized
gagtaaagggaatactgtctgt

SEQ ID NO: 775677 - DNA, 22 bp, Artificial Sequence
  chemically synthesized
cctgacactttcacagacagta

SEQ ID NO: 775678 - DNA, 22 bp, Artificial Sequence
  chemically synthesized
ccctgacactttcacagacagt

SEQ ID NO: 775679 - DNA, 22 bp, Artificial Sequence
  chemically synthesized
tagccccatcttccctgacact

SEQ ID NO: 775680 - DNA, 22 bp, Artificial Sequence
  chemically synthesized
tgtagccccatcttccctgaca

SEQ ID NO: 775681 - DNA, 22 bp, Artificial Sequence
  chemically synthesized
tctgtgaaagtgtcagggaaga

SEQ ID NO: 775682 - DNA, 22 bp, Artificial Sequence
  chemically synthesized
tgaaagtgtcagggaagatggg

SEQ ID NO: 775683 - DNA, 22 bp, Artificial Sequence
  chemically synthesized
gtcacctctgtagccccatctt

SEQ ID NO: 775684 - DNA, 22 bp, Artificial Sequence
  chemically synthesized
gtgaatgcatgatgcctggtca

SEQ ID NO: 775685 - DNA, 22 bp, Artificial Sequence
  chemically synthesized
tggtgaatgcatgatgcctggt

SEQ ID NO: 775686 - DNA, 22 bp, Artificial Sequence
  chemically synthesized
ctctggtgaatgcatgatgcct

SEQ ID NO: 775687 - DNA, 22 bp, Artificial Sequence
  chemically synthesized
cagaggtgaccaggcatcatgc

SEQ ID NO: 775688 - DNA, 22 bp, Artificial Sequence
  chemically synthesized
aaggataaaaggtcaaactgct

SEQ ID NO: 775689 - DNA, 22 bp, Artificial Sequence
  chemically synthesized
gaaggataaaaggtcaaactgc

SEQ ID NO: 775690 - DNA, 22 bp, Artificial Sequence
  chemically synthesized
accagagcagtttgacctttta

SEQ ID NO: 775691 - DNA, 22 bp, Artificial Sequence
  chemically synthesized
acagcttgaaggataaaaggtc

SEQ ID NO: 775692 - DNA, 22 bp, Artificial Sequence
  chemically synthesized
tcacagcttgaaggataaaagg

SEQ ID NO: 775693 - DNA, 22 bp, Artificial Sequence
  chemically synthesized
atcctctcacagcttgaaggat

SEQ ID NO: 775694 - DNA, 22 bp, Artificial Sequence
  chemically synthesized
gaccttttatccttcaagctgt

SEQ ID NO: 775695 - DNA, 22 bp, Artificial Sequence
  chemically synthesized
accttttatccttcaagctgtg

SEQ ID NO: 775696 - DNA, 22 bp, Artificial Sequence
  chemically synthesized
ttatccttcaagctgtgagagg

SEQ ID NO: 775697 - DNA, 22 bp, Artificial Sequence
  chemically synthesized
tatccttcaagctgtgagagga

SEQ ID NO: 775698 - DNA, 22 bp, Artificial Sequence
  chemically synthesized
atccttcaagctgtgagaggat

SEQ ID NO: 775699 - DNA, 22 bp, Artificial Sequence
  chemically synthesized
aagatgtgactaatcctctcac

SEQ ID NO: 775700 - DNA, 22 bp, Artificial Sequence
  chemically synthesized
tccttcaagctgtgagaggatt

SEQ ID NO: 775701 - DNA, 22 bp, Artificial Sequence
  chemically synthesized
caagatgtgactaatcctctca

SEQ ID NO: 775702 - DNA, 22 bp, Artificial Sequence
  chemically synthesized
tcaagatgtgactaatcctctc

SEQ ID NO: 775703 - DNA, 22 bp, Artificial Sequence
  chemically synthesized
caagctgtgagaggattagtca

SEQ ID NO: 775704 - DNA, 22 bp, Artificial Sequence
  chemically synthesized
aagctgtgagaggattagtcac

SEQ ID NO: 775705 - DNA, 22 bp, Artificial Sequence
  chemically synthesized
gaatatgttttcaagatgtgac

SEQ ID NO: 775706 - DNA, 22 bp, Artificial Sequence
  chemically synthesized
tgagaggattagtcacatcttg

SEQ ID NO: 775707 - DNA, 22 bp, Artificial Sequence
  chemically synthesized
tgcctggaatatgttttcaaga

SEQ ID NO: 775708 - DNA, 22 bp, Artificial Sequence
  chemically synthesized
atgcctggaatatgttttcaag

SEQ ID NO: 775709 - DNA, 22 bp, Artificial Sequence
  chemically synthesized
ttatgcctggaatatgttttca

SEQ ID NO: 775710 - DNA, 22 bp, Artificial Sequence
  chemically synthesized
gtcacatcttgaaaacatattc

SEQ ID NO: 775711 - DNA, 22 bp, Artificial Sequence
  chemically synthesized
ctcttatgcctggaatatgttt

SEQ ID NO: 775712 - DNA, 22 bp, Artificial Sequence
  chemically synthesized
ctactcttatgcctggaatatg

SEQ ID NO: 775713 - DNA, 22 bp, Artificial Sequence
  chemically synthesized
tgctactcttatgcctggaata

SEQ ID NO: 775714 - DNA, 22 bp, Artificial Sequence
  chemically synthesized
gaaaacatattccaggcataag

SEQ ID NO: 775715 - DNA, 22 bp, Artificial Sequence
  chemically synthesized
aaaacatattccaggcataaga

SEQ ID NO: 775716 - DNA, 22 bp, Artificial Sequence
  chemically synthesized
aatgctctgctactcttatgcc

SEQ ID NO: 775717 - DNA, 22 bp, Artificial Sequence
  chemically synthesized
caggcataagagtagcagagca

SEQ ID NO: 775718 - DNA, 22 bp, Artificial Sequence
  chemically synthesized
gatccatctaaatgctctgcta

SEQ ID NO: 775719 - DNA, 22 bp, Artificial Sequence
  chemically synthesized
agatccatctaaatgctctgct

SEQ ID NO: 775720 - DNA, 22 bp, Artificial Sequence
  chemically synthesized
ccttagatccatctaaatgctc

SEQ ID NO: 775721 - DNA, 22 bp, Artificial Sequence
  chemically synthesized
ttgccttagatccatctaaatg

SEQ ID NO: 775722 - DNA, 22 bp, Artificial Sequence
  chemically synthesized
tctattgccttagatccatcta

SEQ ID NO: 775723 - DNA, 22 bp, Artificial Sequence
  chemically synthesized
atctattgccttagatccatct

SEQ ID NO: 775724 - DNA, 22 bp, Artificial Sequence
  chemically synthesized
ttatctattgccttagatccat

SEQ ID NO: 775725 - DNA, 22 bp, Artificial Sequence
  chemically synthesized
tctcttatctattgccttagat

SEQ ID NO: 775726 - DNA, 22 bp, Artificial Sequence
  chemically synthesized
atctcttatctattgccttaga

SEQ ID NO: 775727 - DNA, 22 bp, Artificial Sequence
  chemically synthesized
ttatctcttatctattgcctta

SEQ ID NO: 775728 - DNA, 22 bp, Artificial Sequence
  chemically synthesized
agatggatctaaggcaatagat

SEQ ID NO: 775729 - DNA, 22 bp, Artificial Sequence
  chemically synthesized
gatggatctaaggcaatagata

SEQ ID NO: 775730 - DNA, 22 bp, Artificial Sequence
  chemically synthesized
gcctcttatctcttatctattg

SEQ ID NO: 775731 - DNA, 22 bp, Artificial Sequence
  chemically synthesized
cattggcctcttatctcttatc

SEQ ID NO: 775732 - DNA, 22 bp, Artificial Sequence
  chemically synthesized
ctgcattggcctcttatctctt

SEQ ID NO: 775733 - DNA, 22 bp, Artificial Sequence
  chemically synthesized
aggcaatagataagagataaga

SEQ ID NO: 775734 - DNA, 22 bp, Artificial Sequence
  chemically synthesized
gctgcattggcctcttatctct

SEQ ID NO: 775735 - DNA, 22 bp, Artificial Sequence
  chemically synthesized
gcttgctgcattggcctcttat

SEQ ID NO: 775736 - DNA, 22 bp, Artificial Sequence
  chemically synthesized
aactagcttgctgcattggcct

SEQ ID NO: 775737 - DNA, 22 bp, Artificial Sequence
  chemically synthesized
ctcaactagcttgctgcattgg

SEQ ID NO: 775738 - DNA, 22 bp, Artificial Sequence
  chemically synthesized
gcagtggccccgcagcactgct

SEQ ID NO: 775739 - DNA, 22 bp, Artificial Sequence
  chemically synthesized
ttcgcagtggccccgcagcact

SEQ ID NO: 775740 - DNA, 22 bp, Artificial Sequence
  chemically synthesized
tattcgcagtggccccgcagca

SEQ ID NO: 775741 - DNA, 22 bp, Artificial Sequence
  chemically synthesized
gttgagcagtgctgcggggcca

SEQ ID NO: 775742 - DNA, 22 bp, Artificial Sequence
  chemically synthesized
ccctctattcgcagtggccccg

SEQ ID NO: 775743 - DNA, 22 bp, Artificial Sequence
  chemically synthesized
agcagtgctgcggggccactgc

SEQ ID NO: 775744 - DNA, 22 bp, Artificial Sequence
  chemically synthesized
atgccctgccctctattcgcag

SEQ ID NO: 775745 - DNA, 22 bp, Artificial Sequence
  chemically synthesized
ttcatgccctgccctctattcg

SEQ ID NO: 775746 - DNA, 22 bp, Artificial Sequence
  chemically synthesized
cggggccactgcgaatagaggg

SEQ ID NO: 775747 - DNA, 22 bp, Artificial Sequence
  chemically synthesized
attcatgccctgccctctattc

SEQ ID NO: 775748 - DNA, 22 bp, Artificial Sequence
  chemically synthesized
cgaatagagggcagggcatgaa

SEQ ID NO: 775749 - DNA, 22 bp, Artificial Sequence
  chemically synthesized
gcaaccatatccaccttattca

SEQ ID NO: 775750 - DNA, 22 bp, Artificial Sequence
  chemically synthesized
agcaaccatatccaccttattc

SEQ ID NO: 775751 - DNA, 22 bp, Artificial Sequence
  chemically synthesized
aagagcatttagcaaccatatc

SEQ ID NO: 775752 - DNA, 22 bp, Artificial Sequence
  chemically synthesized
caagagcatttagcaaccatat

SEQ ID NO: 775753 - DNA, 22 bp, Artificial Sequence
  chemically synthesized
ctaaatgctcttgaaacctttc

SEQ ID NO: 775754 - DNA, 22 bp, Artificial Sequence
  chemically synthesized
aaaagaagcagagaaaggtttc

SEQ ID NO: 775755 - DNA, 22 bp, Artificial Sequence
  chemically synthesized
aatgctcttgaaacctttctct

SEQ ID NO: 775756 - DNA, 22 bp, Artificial Sequence
  chemically synthesized
gatacctaaaaagaagcagaga

SEQ ID NO: 775757 - DNA, 22 bp, Artificial Sequence
  chemically synthesized
ttgaaacctttctctgcttctt

SEQ ID NO: 775758 - DNA, 22 bp, Artificial Sequence
  chemically synthesized
gaaacctttctctgcttctttt

SEQ ID NO: 775759 - DNA, 22 bp, Artificial Sequence
  chemically synthesized
gctagatacctaaaaagaagca

SEQ ID NO: 775760 - DNA, 22 bp, Artificial Sequence
  chemically synthesized
aaacctttctctgcttcttttt

SEQ ID NO: 775761 - DNA, 22 bp, Artificial Sequence
  chemically synthesized
tctctgcttctttttaggtatc

SEQ ID NO: 775762 - DNA, 22 bp, Artificial Sequence
  chemically synthesized
ctctgcttctttttaggtatct

SEQ ID NO: 775763 - DNA, 22 bp, Artificial Sequence
  chemically synthesized
tctgcttctttttaggtatcta

SEQ ID NO: 775764 - DNA, 22 bp, Artificial Sequence
  chemically synthesized
tgcttctttttaggtatctagc

SEQ ID NO: 775765 - DNA, 22 bp, Artificial Sequence
  chemically synthesized
cttctttttaggtatctagcta

SEQ ID NO: 775766 - DNA, 22 bp, Artificial Sequence
  chemically synthesized
gaaaatgaagtctagctagata

SEQ ID NO: 775767 - DNA, 22 bp, Artificial Sequence
  chemically synthesized
ctttttaggtatctagctagac

SEQ ID NO: 775768 - DNA, 22 bp, Artificial Sequence
  chemically synthesized
tttttaggtatctagctagact

SEQ ID NO: 775769 - DNA, 22 bp, Artificial Sequence
  chemically synthesized
tttaggtatctagctagacttc

SEQ ID NO: 775770 - DNA, 22 bp, Artificial Sequence
  chemically synthesized
ttaggtatctagctagacttca

SEQ ID NO: 775771 - DNA, 22 bp, Artificial Sequence
  chemically synthesized
taggtatctagctagacttcat

SEQ ID NO: 775772 - DNA, 22 bp, Artificial Sequence
  chemically synthesized
aggtatctagctagacttcatt

SEQ ID NO: 775773 - DNA, 22 bp, Artificial Sequence
  chemically synthesized
ggtatctagctagacttcattt

SEQ ID NO: 775774 - DNA, 22 bp, Artificial Sequence
  chemically synthesized
gctagacttcattttccagccc

SEQ ID NO: 775775 - DNA, 22 bp, Artificial Sequence
  chemically synthesized
gacttcattttccagcccctct

SEQ ID NO: 775776 - DNA, 22 bp, Artificial Sequence
  chemically synthesized
cattttccagcccctctgctgt

SEQ ID NO: 775777 - DNA, 22 bp, Artificial Sequence
  chemically synthesized
tggccacatgtaacagcagagg

SEQ ID NO: 775778 - DNA, 22 bp, Artificial Sequence
  chemically synthesized
attttccagcccctctgctgtt

SEQ ID NO: 775779 - DNA, 22 bp, Artificial Sequence
  chemically synthesized
tccagcccctctgctgttacat

SEQ ID NO: 775780 - DNA, 22 bp, Artificial Sequence
  chemically synthesized
ccctgtggccacatgtaacagc

SEQ ID NO: 775781 - DNA, 22 bp, Artificial Sequence
  chemically synthesized
ccagcccctctgctgttacatg

SEQ ID NO: 775782 - DNA, 22 bp, Artificial Sequence
  chemically synthesized
cagcccctctgctgttacatgt

SEQ ID NO: 775783 - DNA, 22 bp, Artificial Sequence
  chemically synthesized
tgccctgtggccacatgtaaca

SEQ ID NO: 775784 - DNA, 22 bp, Artificial Sequence
  chemically synthesized
gaactctgccctgtggccacat

SEQ ID NO: 775785 - DNA, 22 bp, Artificial Sequence
  chemically synthesized
tgctgttacatgtggccacagg

SEQ ID NO: 775786 - DNA, 22 bp, Artificial Sequence
  chemically synthesized
gctagaactctgccctgtggcc

SEQ ID NO: 775787 - DNA, 22 bp, Artificial Sequence
  chemically synthesized
ctgttacatgtggccacagggc

SEQ ID NO: 775788 - DNA, 22 bp, Artificial Sequence
  chemically synthesized
ctggctagaactctgccctgtg

SEQ ID NO: 775789 - DNA, 22 bp, Artificial Sequence
  chemically synthesized
ttacatgtggccacagggcaga

SEQ ID NO: 775790 - DNA, 22 bp, Artificial Sequence
  chemically synthesized
tactggctagaactctgccctg

SEQ ID NO: 775791 - DNA, 22 bp, Artificial Sequence
  chemically synthesized
ctactggctagaactctgccct

SEQ ID NO: 775792 - DNA, 22 bp, Artificial Sequence
  chemically synthesized
catgtggccacagggcagagtt

SEQ ID NO: 775793 - DNA, 22 bp, Artificial Sequence
  chemically synthesized
aaccttctactggctagaactc

SEQ ID NO: 775794 - DNA, 22 bp, Artificial Sequence
  chemically synthesized
actcaaccttctactggctaga

SEQ ID NO: 775795 - DNA, 22 bp, Artificial Sequence
  chemically synthesized
gactcaaccttctactggctag

SEQ ID NO: 775796 - DNA, 22 bp, Artificial Sequence
  chemically synthesized
tgactcaaccttctactggcta

SEQ ID NO: 775797 - DNA, 22 bp, Artificial Sequence
  chemically synthesized
tagccagtagaaggttgagtca

SEQ ID NO: 775798 - DNA, 22 bp, Artificial Sequence
  chemically synthesized
gccagtagaaggttgagtcaaa

SEQ ID NO: 775799 - DNA, 22 bp, Artificial Sequence
  chemically synthesized
cacacggaggcgtcccatgtcc

SEQ ID NO: 775800 - DNA, 22 bp, Artificial Sequence
  chemically synthesized
agtcaaaggacatgggacgcct

SEQ ID NO: 775801 - DNA, 22 bp, Artificial Sequence
  chemically synthesized
gaggactgcacacggaggcgtc

SEQ ID NO: 775802 - DNA, 22 bp, Artificial Sequence
  chemically synthesized
cgtgtgcagtcctctagctcat

SEQ ID NO: 775803 - DNA, 22 bp, Artificial Sequence
  chemically synthesized
agccagcccaaaggggaatgag

SEQ ID NO: 775804 - DNA, 22 bp, Artificial Sequence
  chemically synthesized
tagctcattcccctttgggctg

SEQ ID NO: 775805 - DNA, 22 bp, Artificial Sequence
  chemically synthesized
aagatattcagccagcccaaag

SEQ ID NO: 775806 - DNA, 22 bp, Artificial Sequence
  chemically synthesized
gctcattcccctttgggctggc

SEQ ID NO: 775807 - DNA, 22 bp, Artificial Sequence
  chemically synthesized
ctgaagatattcagccagccca

SEQ ID NO: 775808 - DNA, 22 bp, Artificial Sequence
  chemically synthesized
attcccctttgggctggctgaa

SEQ ID NO: 775809 - DNA, 22 bp, Artificial Sequence
  chemically synthesized
ccctcctgaagatattcagcca

SEQ ID NO: 775810 - DNA, 22 bp, Artificial Sequence
  chemically synthesized
ccctttgggctggctgaatatc

SEQ ID NO: 775811 - DNA, 22 bp, Artificial Sequence
  chemically synthesized
tgggctggctgaatatcttcag

SEQ ID NO: 775812 - DNA, 22 bp, Artificial Sequence
  chemically synthesized
gggctggctgaatatcttcagg

SEQ ID NO: 775813 - DNA, 22 bp, Artificial Sequence
  chemically synthesized
ggctggctgaatatcttcagga

SEQ ID NO: 775814 - DNA, 22 bp, Artificial Sequence
  chemically synthesized
ccgaggttgccctcctgaagat

SEQ ID NO: 775815 - DNA, 22 bp, Artificial Sequence
  chemically synthesized
gctgaatatcttcaggagggca

SEQ ID NO: 775816 - DNA, 22 bp, Artificial Sequence
  chemically synthesized
aatatcttcaggagggcaacct

SEQ ID NO: 775817 - DNA, 22 bp, Artificial Sequence
  chemically synthesized
caatagccaattgccgaggttg

SEQ ID NO: 775818 - DNA, 22 bp, Artificial Sequence
  chemically synthesized
caggagggcaacctcggcaatt

SEQ ID NO: 775819 - DNA, 22 bp, Artificial Sequence
  chemically synthesized
aggagggcaacctcggcaattg

SEQ ID NO: 775820 - DNA, 22 bp, Artificial Sequence
  chemically synthesized
catctgcaatagccaattgccg

SEQ ID NO: 775821 - DNA, 22 bp, Artificial Sequence
  chemically synthesized
ccatctgcaatagccaattgcc

SEQ ID NO: 775822 - DNA, 22 bp, Artificial Sequence
  chemically synthesized
ggcaattggctattgcagatgg

SEQ ID NO: 775823 - DNA, 22 bp, Artificial Sequence
  chemically synthesized
gctattgcagatggaagaccct

SEQ ID NO: 775824 - DNA, 22 bp, Artificial Sequence
  chemically synthesized
ttgcagatggaagacccttgct

SEQ ID NO: 775825 - DNA, 22 bp, Artificial Sequence
  chemically synthesized
cagatggaagacccttgctggc

SEQ ID NO: 775826 - DNA, 22 bp, Artificial Sequence
  chemically synthesized
aaaaaaaaacaggccagcaagg

SEQ ID NO: 775827 - DNA, 22 bp, Artificial Sequence
  chemically synthesized
gctggcctgttttttttttaat

SEQ ID NO: 775828 - DNA, 22 bp, Artificial Sequence
  chemically synthesized
ctggcctgttttttttttaatt

SEQ ID NO: 775829 - DNA, 22 bp, Artificial Sequence
  chemically synthesized
gcctgttttttttttaatttat

SEQ ID NO: 775830 - DNA, 22 bp, Artificial Sequence
  chemically synthesized
ttttttttttaatttatttttt

SEQ ID NO: 775831 - DNA, 22 bp, Artificial Sequence
  chemically synthesized
tttttttaatttattttttatt

SEQ ID NO: 775832 - DNA, 22 bp, Artificial Sequence
  chemically synthesized
ttttttaatttattttttattt

SEQ ID NO: 775833 - DNA, 22 bp, Artificial Sequence
  chemically synthesized
tttttaatttattttttatttt

SEQ ID NO: 775834 - DNA, 22 bp, Artificial Sequence
  chemically synthesized
ttttaatttattttttattttt

SEQ ID NO: 775835 - DNA, 22 bp, Artificial Sequence
  chemically synthesized
tttaatttattttttatttttt

SEQ ID NO: 775836 - DNA, 22 bp, Artificial Sequence
  chemically synthesized
ttaatttattttttatttttta

SEQ ID NO: 775837 - DNA, 22 bp, Artificial Sequence
  chemically synthesized
taatttattttttattttttat

SEQ ID NO: 775838 - DNA, 22 bp, Artificial Sequence
  chemically synthesized
aatttattttttattttttatt

SEQ ID NO: 775839 - DNA, 22 bp, Artificial Sequence
  chemically synthesized
atttattttttattttttattt

SEQ ID NO: 775840 - DNA, 22 bp, Artificial Sequence
  chemically synthesized
attttttattttttatttttat

SEQ ID NO: 775841 - DNA, 22 bp, Artificial Sequence
  chemically synthesized
ttttttattttttatttttatt

SEQ ID NO: 775842 - DNA, 22 bp, Artificial Sequence
  chemically synthesized
tttattttttatttttatttta

SEQ ID NO: 775843 - DNA, 22 bp, Artificial Sequence
  chemically synthesized
aaaaaaataaaataaaataaaa

SEQ ID NO: 775844 - DNA, 22 bp, Artificial Sequence
  chemically synthesized
ttattttttatttttattttat

SEQ ID NO: 775845 - DNA, 22 bp, Artificial Sequence
  chemically synthesized
tattttttatttttattttatt

SEQ ID NO: 775846 - DNA, 22 bp, Artificial Sequence
  chemically synthesized
attttttatttttattttattt

SEQ ID NO: 775847 - DNA, 22 bp, Artificial Sequence
  chemically synthesized
ttttttatttttattttatttt

SEQ ID NO: 775848 - DNA, 22 bp, Artificial Sequence
  chemically synthesized
tctaaaaaaaataaaataaaat

SEQ ID NO: 775849 - DNA, 22 bp, Artificial Sequence
  chemically synthesized
tatctaaaaaaaataaaataaa

SEQ ID NO: 775850 - DNA, 22 bp, Artificial Sequence
  chemically synthesized
tttatttttattttattttatt

SEQ ID NO: 775851 - DNA, 22 bp, Artificial Sequence
  chemically synthesized
ttatttttattttattttattt

SEQ ID NO: 775852 - DNA, 22 bp, Artificial Sequence
  chemically synthesized
tatttttattttattttatttt

SEQ ID NO: 775853 - DNA, 22 bp, Artificial Sequence
  chemically synthesized
atttttattttattttattttt

SEQ ID NO: 775854 - DNA, 22 bp, Artificial Sequence
  chemically synthesized
tttttattttattttatttttt

SEQ ID NO: 775855 - DNA, 22 bp, Artificial Sequence
  chemically synthesized
ttattttattttatttttttta

SEQ ID NO: 775856 - DNA, 22 bp, Artificial Sequence
  chemically synthesized
tattttattttattttttttag

SEQ ID NO: 775857 - DNA, 22 bp, Artificial Sequence
  chemically synthesized
attttattttattttttttaga

SEQ ID NO: 775858 - DNA, 22 bp, Artificial Sequence
  chemically synthesized
ttttattttattttttttagat

SEQ ID NO: 775859 - DNA, 22 bp, Artificial Sequence
  chemically synthesized
tattttattttttttagataga

SEQ ID NO: 775860 - DNA, 22 bp, Artificial Sequence
  chemically synthesized
attttattttttttagatagag

SEQ ID NO: 775861 - DNA, 22 bp, Artificial Sequence
  chemically synthesized
ttttattttttttagatagagt

SEQ ID NO: 775862 - DNA, 22 bp, Artificial Sequence
  chemically synthesized
gcgacagagcaagactctatct

SEQ ID NO: 775863 - DNA, 22 bp, Artificial Sequence
  chemically synthesized
tattttttttagatagagtctt

SEQ ID NO: 775864 - DNA, 22 bp, Artificial Sequence
  chemically synthesized
attttttttagatagagtcttg

SEQ ID NO: 775865 - DNA, 22 bp, Artificial Sequence
  chemically synthesized
ttttttttagatagagtcttgc

SEQ ID NO: 775866 - DNA, 22 bp, Artificial Sequence
  chemically synthesized
tttttagatagagtcttgctct

SEQ ID NO: 775867 - DNA, 22 bp, Artificial Sequence
  chemically synthesized
cagcctggcgacagagcaagac

SEQ ID NO: 775868 - DNA, 22 bp, Artificial Sequence
  chemically synthesized
ttttagatagagtcttgctctg

SEQ ID NO: 775869 - DNA, 22 bp, Artificial Sequence
  chemically synthesized
tttagatagagtcttgctctgt

SEQ ID NO: 775870 - DNA, 22 bp, Artificial Sequence
  chemically synthesized
ttagatagagtcttgctctgtc

SEQ ID NO: 775871 - DNA, 22 bp, Artificial Sequence
  chemically synthesized
tagatagagtcttgctctgtcg

SEQ ID NO: 775872 - DNA, 22 bp, Artificial Sequence
  chemically synthesized
agatagagtcttgctctgtcgc

SEQ ID NO: 775873 - DNA, 22 bp, Artificial Sequence
  chemically synthesized
cactccagcctggcgacagagc

SEQ ID NO: 775874 - DNA, 22 bp, Artificial Sequence
  chemically synthesized
gatagagtcttgctctgtcgcc

SEQ ID NO: 775875 - DNA, 22 bp, Artificial Sequence
  chemically synthesized
gctctgtcgccaggctggagtg

SEQ ID NO: 775876 - DNA, 22 bp, Artificial Sequence
  chemically synthesized
ctctgtcgccaggctggagtgc

SEQ ID NO: 775877 - DNA, 22 bp, Artificial Sequence
  chemically synthesized
tgtcgccaggctggagtgcagt

SEQ ID NO: 775878 - DNA, 22 bp, Artificial Sequence
  chemically synthesized
tcgccaggctggagtgcagtgg

SEQ ID NO: 775879 - DNA, 22 bp, Artificial Sequence
  chemically synthesized
cagtgagacaagatcatgccac

SEQ ID NO: 775880 - DNA, 22 bp, Artificial Sequence
  chemically synthesized
gagtgcagtggcatgatcttgt

SEQ ID NO: 775881 - DNA, 22 bp, Artificial Sequence
  chemically synthesized
aagccgggaggcggaggttgca

SEQ ID NO: 775882 - DNA, 22 bp, Artificial Sequence
  chemically synthesized
gaagccgggaggcggaggttgc

SEQ ID NO: 775883 - DNA, 22 bp, Artificial Sequence
  chemically synthesized
gtctcactgcaacctccgcctc

SEQ ID NO: 775884 - DNA, 22 bp, Artificial Sequence
  chemically synthesized
tctcactgcaacctccgcctcc

SEQ ID NO: 775885 - DNA, 22 bp, Artificial Sequence
  chemically synthesized
actgcaacctccgcctcccggc

SEQ ID NO: 775886 - DNA, 22 bp, Artificial Sequence
  chemically synthesized
caacctccgcctcccggcttca

SEQ ID NO: 775887 - DNA, 22 bp, Artificial Sequence
  chemically synthesized
aagcaggagaatcacttgaagc

SEQ ID NO: 775888 - DNA, 22 bp, Artificial Sequence
  chemically synthesized
cgcctcccggcttcaagtgatt

SEQ ID NO: 775889 - DNA, 22 bp, Artificial Sequence
  chemically synthesized
ggaggctgaagcaggagaatca

SEQ ID NO: 775890 - DNA, 22 bp, Artificial Sequence
  chemically synthesized
ccggcttcaagtgattctcctg

SEQ ID NO: 775891 - DNA, 22 bp, Artificial Sequence
  chemically synthesized
gggaggctgaagcaggagaatc

SEQ ID NO: 775892 - DNA, 22 bp, Artificial Sequence
  chemically synthesized
cttgggaggctgaagcaggaga

SEQ ID NO: 775893 - DNA, 22 bp, Artificial Sequence
  chemically synthesized
caagtgattctcctgcttcagc

SEQ ID NO: 775894 - DNA, 22 bp, Artificial Sequence
  chemically synthesized
aagtgattctcctgcttcagcc

SEQ ID NO: 775895 - DNA, 22 bp, Artificial Sequence
  chemically synthesized
taatcccagctacttgggaggc

SEQ ID NO: 775896 - DNA, 22 bp, Artificial Sequence
  chemically synthesized
tcctgcttcagcctcccaagta

SEQ ID NO: 775897 - DNA, 22 bp, Artificial Sequence
  chemically synthesized
ctgcttcagcctcccaagtagc

SEQ ID NO: 775898 - DNA, 22 bp, Artificial Sequence
  chemically synthesized
cttcagcctcccaagtagctgg

SEQ ID NO: 775899 - DNA, 22 bp, Artificial Sequence
  chemically synthesized
cagcctcccaagtagctgggat

SEQ ID NO: 775900 - DNA, 22 bp, Artificial Sequence
  chemically synthesized
agcctcccaagtagctgggatt

SEQ ID NO: 775901 - DNA, 22 bp, Artificial Sequence
  chemically synthesized
ccaagtagctgggattacaggt

SEQ ID NO: 775902 - DNA, 22 bp, Artificial Sequence
  chemically synthesized
ggagtggtggtgggcacctgta

SEQ ID NO: 775903 - DNA, 22 bp, Artificial Sequence
  chemically synthesized
ggattacaggtgcccaccacca

SEQ ID NO: 775904 - DNA, 22 bp, Artificial Sequence
  chemically synthesized
caggtgcccaccaccactccta

SEQ ID NO: 775905 - DNA, 22 bp, Artificial Sequence
  chemically synthesized
aaaatacaaaaaatagctagga

SEQ ID NO: 775906 - DNA, 22 bp, Artificial Sequence
  chemically synthesized
ctaaaaatacaaaaaatagcta

SEQ ID NO: 775907 - DNA, 22 bp, Artificial Sequence
  chemically synthesized
tactaaaaatacaaaaaatagc

SEQ ID NO: 775908 - DNA, 22 bp, Artificial Sequence
  chemically synthesized
ctagctattttttgtattttta

SEQ ID NO: 775909 - DNA, 22 bp, Artificial Sequence
  chemically synthesized
gctattttttgtatttttagta

SEQ ID NO: 775910 - DNA, 22 bp, Artificial Sequence
  chemically synthesized
ttttttgtatttttagtagaga

SEQ ID NO: 775911 - DNA, 22 bp, Artificial Sequence
  chemically synthesized
tttgtatttttagtagagatgg

SEQ ID NO: 775912 - DNA, 22 bp, Artificial Sequence
  chemically synthesized
ttgtatttttagtagagatggg

SEQ ID NO: 775913 - DNA, 22 bp, Artificial Sequence
  chemically synthesized
tgtatttttagtagagatgggg

SEQ ID NO: 775914 - DNA, 22 bp, Artificial Sequence
  chemically synthesized
gtatttttagtagagatggggt

SEQ ID NO: 775915 - DNA, 22 bp, Artificial Sequence
  chemically synthesized
tatttttagtagagatggggtt

SEQ ID NO: 775916 - DNA, 22 bp, Artificial Sequence
  chemically synthesized
gccaacatgatgaaaccccatc

SEQ ID NO: 775917 - DNA, 22 bp, Artificial Sequence
  chemically synthesized
ttagtagagatggggtttcatc

SEQ ID NO: 775918 - DNA, 22 bp, Artificial Sequence
  chemically synthesized
tagtagagatggggtttcatca

SEQ ID NO: 775919 - DNA, 22 bp, Artificial Sequence
  chemically synthesized
agtagagatggggtttcatcat

SEQ ID NO: 775920 - DNA, 22 bp, Artificial Sequence
  chemically synthesized
gtagagatggggtttcatcatg

SEQ ID NO: 775921 - DNA, 22 bp, Artificial Sequence
  chemically synthesized
gagaccatcctggccaacatga

SEQ ID NO: 775922 - DNA, 22 bp, Artificial Sequence
  chemically synthesized
catcatgttggccaggatggtc

SEQ ID NO: 775923 - DNA, 22 bp, Artificial Sequence
  chemically synthesized
atcatgttggccaggatggtct

SEQ ID NO: 775924 - DNA, 22 bp, Artificial Sequence
  chemically synthesized
aggtcaggagctcgagaccatc

SEQ ID NO: 775925 - DNA, 22 bp, Artificial Sequence
  chemically synthesized
gccaggatggtctcgagctcct

SEQ ID NO: 775926 - DNA, 22 bp, Artificial Sequence
  chemically synthesized
gagctcctgacctcaggtgatc

SEQ ID NO: 775927 - DNA, 22 bp, Artificial Sequence
  chemically synthesized
ggaggccaaggtgggcggatca

SEQ ID NO: 775928 - DNA, 22 bp, Artificial Sequence
  chemically synthesized
ctgacctcaggtgatccgccca

SEQ ID NO: 775929 - DNA, 22 bp, Artificial Sequence
  chemically synthesized
gggaggccaaggtgggcggatc

SEQ ID NO: 775930 - DNA, 22 bp, Artificial Sequence
  chemically synthesized
tgggaggccaaggtgggcggat

SEQ ID NO: 775931 - DNA, 22 bp, Artificial Sequence
  chemically synthesized
acctcaggtgatccgcccacct

SEQ ID NO: 775932 - DNA, 22 bp, Artificial Sequence
  chemically synthesized
aggtgatccgcccaccttggcc

SEQ ID NO: 775933 - DNA, 22 bp, Artificial Sequence
  chemically synthesized
taatcccagcactttgggaggc

SEQ ID NO: 775934 - DNA, 22 bp, Artificial Sequence
  chemically synthesized
acacctgtaatcccagcacttt

SEQ ID NO: 775935 - DNA, 22 bp, Artificial Sequence
  chemically synthesized
ggcctcccaaagtgctgggatt

SEQ ID NO: 775936 - DNA, 22 bp, Artificial Sequence
  chemically synthesized
gcctcccaaagtgctgggatta

SEQ ID NO: 775937 - DNA, 22 bp, Artificial Sequence
  chemically synthesized
ccaaagtgctgggattacaggt

SEQ ID NO: 775938 - DNA, 22 bp, Artificial Sequence
  chemically synthesized
ggattacaggtgtgagccactg

SEQ ID NO: 775939 - DNA, 22 bp, Artificial Sequence
  chemically synthesized
caggtgtgagccactgcacctg

SEQ ID NO: 775940 - DNA, 22 bp, Artificial Sequence
  chemically synthesized
aagaatacaggccaggccaggt

SEQ ID NO: 775941 - DNA, 22 bp, Artificial Sequence
  chemically synthesized
ttcaagaatacaggccaggcca

SEQ ID NO: 775942 - DNA, 22 bp, Artificial Sequence
  chemically synthesized
cacctggcctggcctgtattct

SEQ ID NO: 775943 - DNA, 22 bp, Artificial Sequence
  chemically synthesized
gcctggcctgtattcttgaata

SEQ ID NO: 775944 - DNA, 22 bp, Artificial Sequence
  chemically synthesized
gcctgtattcttgaataattat

SEQ ID NO: 775945 - DNA, 22 bp, Artificial Sequence
  chemically synthesized
tattcttgaataattatgtggg

SEQ ID NO: 775946 - DNA, 22 bp, Artificial Sequence
  chemically synthesized
ttgaataattatgtgggtgtca

SEQ ID NO: 775947 - DNA, 22 bp, Artificial Sequence
  chemically synthesized
gaataattatgtgggtgtcacc

SEQ ID NO: 775948 - DNA, 22 bp, Artificial Sequence
  chemically synthesized
aataattatgtgggtgtcaccc

SEQ ID NO: 775949 - DNA, 22 bp, Artificial Sequence
  chemically synthesized
tgtgggtgtcacccctcccttc

SEQ ID NO: 775950 - DNA, 22 bp, Artificial Sequence
  chemically synthesized
gatgtgtgtgtgggaagggagg

SEQ ID NO: 775951 - DNA, 22 bp, Artificial Sequence
  chemically synthesized
gtgttggatgtgtgtgtgggaa

SEQ ID NO: 775952 - DNA, 22 bp, Artificial Sequence
  chemically synthesized
gttggtgttggatgtgtgtgtg

SEQ ID NO: 775953 - DNA, 22 bp, Artificial Sequence
  chemically synthesized
ccttcccacacacacatccaac

SEQ ID NO: 775954 - DNA, 22 bp, Artificial Sequence
  chemically synthesized
atgttagttggtgttggatgtg

SEQ ID NO: 775955 - DNA, 22 bp, Artificial Sequence
  chemically synthesized
cccacacacacatccaacacca

SEQ ID NO: 775956 - DNA, 22 bp, Artificial Sequence
  chemically synthesized
ccacacacacatccaacaccaa

SEQ ID NO: 775957 - DNA, 22 bp, Artificial Sequence
  chemically synthesized
aggtgaattcatgttagttggt

SEQ ID NO: 775958 - DNA, 22 bp, Artificial Sequence
  chemically synthesized
atgtaaacagtctaaggtgaat

SEQ ID NO: 775959 - DNA, 22 bp, Artificial Sequence
  chemically synthesized
tcatgtaaacagtctaaggtga

SEQ ID NO: 775960 - DNA, 22 bp, Artificial Sequence
  chemically synthesized
ctcatgtaaacagtctaaggtg

SEQ ID NO: 775961 - DNA, 22 bp, Artificial Sequence
  chemically synthesized
tctcatgtaaacagtctaaggt

SEQ ID NO: 775962 - DNA, 22 bp, Artificial Sequence
  chemically synthesized
acatgaattcaccttagactgt

SEQ ID NO: 775963 - DNA, 22 bp, Artificial Sequence
  chemically synthesized
tttctcatgtaaacagtctaag

SEQ ID NO: 775964 - DNA, 22 bp, Artificial Sequence
  chemically synthesized
ctttctcatgtaaacagtctaa

SEQ ID NO: 775965 - DNA, 22 bp, Artificial Sequence
  chemically synthesized
accttagactgtttacatgaga

SEQ ID NO: 775966 - DNA, 22 bp, Artificial Sequence
  chemically synthesized
agactgtttacatgagaaagaa

SEQ ID NO: 775967 - DNA, 22 bp, Artificial Sequence
  chemically synthesized
gactgtttacatgagaaagaaa

SEQ ID NO: 775968 - DNA, 22 bp, Artificial Sequence
  chemically synthesized
tttacatgagaaagaaatacat

SEQ ID NO: 775969 - DNA, 22 bp, Artificial Sequence
  chemically synthesized
aacaaaatagaaatgtatttct

SEQ ID NO: 775970 - DNA, 22 bp, Artificial Sequence
  chemically synthesized
aaacaaaatagaaatgtatttc

SEQ ID NO: 775971 - DNA, 22 bp, Artificial Sequence
  chemically synthesized
acatgagaaagaaatacatttc

SEQ ID NO: 775972 - DNA, 22 bp, Artificial Sequence
  chemically synthesized
catgagaaagaaatacatttct

SEQ ID NO: 775973 - DNA, 22 bp, Artificial Sequence
  chemically synthesized
aaatgacttaaacaaaatagaa

SEQ ID NO: 775974 - DNA, 22 bp, Artificial Sequence
  chemically synthesized
ttaaaatgacttaaacaaaata

SEQ ID NO: 775975 - DNA, 22 bp, Artificial Sequence
  chemically synthesized
ctattttgtttaagtcatttta

SEQ ID NO: 775976 - DNA, 22 bp, Artificial Sequence
  chemically synthesized
tattttgtttaagtcattttaa

SEQ ID NO: 775977 - DNA, 22 bp, Artificial Sequence
  chemically synthesized
ttttgtttaagtcattttaata

SEQ ID NO: 775978 - DNA, 22 bp, Artificial Sequence
  chemically synthesized
tgtttaagtcattttaatagtc

SEQ ID NO: 775979 - DNA, 22 bp, Artificial Sequence
  chemically synthesized
gtttaagtcattttaatagtcc

SEQ ID NO: 775980 - DNA, 22 bp, Artificial Sequence
  chemically synthesized
tttaagtcattttaatagtcca

SEQ ID NO: 775981 - DNA, 22 bp, Artificial Sequence
  chemically synthesized
aacatccaccaaatggactatt

SEQ ID NO: 775982 - DNA, 22 bp, Artificial Sequence
  chemically synthesized
aagtcattttaatagtccattt

SEQ ID NO: 775983 - DNA, 22 bp, Artificial Sequence
  chemically synthesized
agtcattttaatagtccatttg

SEQ ID NO: 775984 - DNA, 22 bp, Artificial Sequence
  chemically synthesized
taatatattaaacatccaccaa

SEQ ID NO: 775985 - DNA, 22 bp, Artificial Sequence
  chemically synthesized
taatagtccatttggtggatgt

SEQ ID NO: 775986 - DNA, 22 bp, Artificial Sequence
  chemically synthesized
aatagtccatttggtggatgtt

SEQ ID NO: 775987 - DNA, 22 bp, Artificial Sequence
  chemically synthesized
atagtccatttggtggatgttt

SEQ ID NO: 775988 - DNA, 22 bp, Artificial Sequence
  chemically synthesized
acagctataatatattaaacat

SEQ ID NO: 775989 - DNA, 22 bp, Artificial Sequence
  chemically synthesized
ggtggatgtttaatatattata

SEQ ID NO: 775990 - DNA, 22 bp, Artificial Sequence
  chemically synthesized
gtggatgtttaatatattatag

SEQ ID NO: 775991 - DNA, 22 bp, Artificial Sequence
  chemically synthesized
agataggctaacagctataata

SEQ ID NO: 775992 - DNA, 22 bp, Artificial Sequence
  chemically synthesized
aatatattatagctgttagcct

SEQ ID NO: 775993 - DNA, 22 bp, Artificial Sequence
  chemically synthesized
atatattatagctgttagccta

SEQ ID NO: 775994 - DNA, 22 bp, Artificial Sequence
  chemically synthesized
taatagctaagataggctaaca

SEQ ID NO: 775995 - DNA, 22 bp, Artificial Sequence
  chemically synthesized
atatctataatagctaagatag

SEQ ID NO: 775996 - DNA, 22 bp, Artificial Sequence
  chemically synthesized
tagctgttagcctatcttagct

SEQ ID NO: 775997 - DNA, 22 bp, Artificial Sequence
  chemically synthesized
catatctataatagctaagata

SEQ ID NO: 775998 - DNA, 22 bp, Artificial Sequence
  chemically synthesized
ttagcctatcttagctattata

SEQ ID NO: 775999 - DNA, 22 bp, Artificial Sequence
  chemically synthesized
gcctatcttagctattatagat

SEQ ID NO: 776000 - DNA, 22 bp, Artificial Sequence
  chemically synthesized
agtatgtttcatatctataata

SEQ ID NO: 776001 - DNA, 22 bp, Artificial Sequence
  chemically synthesized
aagtatgtttcatatctataat

SEQ ID NO: 776002 - DNA, 22 bp, Artificial Sequence
  chemically synthesized
taagtatgtttcatatctataa

SEQ ID NO: 776003 - DNA, 22 bp, Artificial Sequence
  chemically synthesized
tttaagtatgtttcatatctat

SEQ ID NO: 776004 - DNA, 22 bp, Artificial Sequence
  chemically synthesized
tcttagctattatagatatgaa

SEQ ID NO: 776005 - DNA, 22 bp, Artificial Sequence
  chemically synthesized
gctctttaagtatgtttcatat

SEQ ID NO: 776006 - DNA, 22 bp, Artificial Sequence
  chemically synthesized
agctattatagatatgaaacat

SEQ ID NO: 776007 - DNA, 22 bp, Artificial Sequence
  chemically synthesized
agctctttaagtatgtttcata

SEQ ID NO: 776008 - DNA, 22 bp, Artificial Sequence
  chemically synthesized
gctattatagatatgaaacata

SEQ ID NO: 776009 - DNA, 22 bp, Artificial Sequence
  chemically synthesized
tagctctttaagtatgtttcat

SEQ ID NO: 776010 - DNA, 22 bp, Artificial Sequence
  chemically synthesized
ttagctctttaagtatgtttca

SEQ ID NO: 776011 - DNA, 22 bp, Artificial Sequence
  chemically synthesized
ttatagatatgaaacatactta

SEQ ID NO: 776012 - DNA, 22 bp, Artificial Sequence
  chemically synthesized
tagatatgaaacatacttaaag

SEQ ID NO: 776013 - DNA, 22 bp, Artificial Sequence
  chemically synthesized
gtaaaaatgcttttagctcttt

SEQ ID NO: 776014 - DNA, 22 bp, Artificial Sequence
  chemically synthesized
ctcgtaaaaatgcttttagctc

SEQ ID NO: 776015 - DNA, 22 bp, Artificial Sequence
  chemically synthesized
cctcgtaaaaatgcttttagct

SEQ ID NO: 776016 - DNA, 22 bp, Artificial Sequence
  chemically synthesized
tcctcgtaaaaatgcttttagc

SEQ ID NO: 776017 - DNA, 22 bp, Artificial Sequence
  chemically synthesized
ttcctcgtaaaaatgcttttag

SEQ ID NO: 776018 - DNA, 22 bp, Artificial Sequence
  chemically synthesized
tttcctcgtaaaaatgctttta

SEQ ID NO: 776019 - DNA, 22 bp, Artificial Sequence
  chemically synthesized
ttttcctcgtaaaaatgctttt

SEQ ID NO: 776020 - DNA, 22 bp, Artificial Sequence
  chemically synthesized
tttttcctcgtaaaaatgcttt

SEQ ID NO: 776021 - DNA, 22 bp, Artificial Sequence
  chemically synthesized
aaagagctaaaagcatttttac

SEQ ID NO: 776022 - DNA, 22 bp, Artificial Sequence
  chemically synthesized
aagagctaaaagcatttttacg

SEQ ID NO: 776023 - DNA, 22 bp, Artificial Sequence
  chemically synthesized
aaagcatttttacgaggaaaaa

SEQ ID NO: 776024 - DNA, 22 bp, Artificial Sequence
  chemically synthesized
tcatcaagtctttttttcctcg

SEQ ID NO: 776025 - DNA, 22 bp, Artificial Sequence
  chemically synthesized
tctgtcatcaagtctttttttc

SEQ ID NO: 776026 - DNA, 22 bp, Artificial Sequence
  chemically synthesized
atctgtcatcaagtcttttttt

SEQ ID NO: 776027 - DNA, 22 bp, Artificial Sequence
  chemically synthesized
ttacgaggaaaaaaagacttga

SEQ ID NO: 776028 - DNA, 22 bp, Artificial Sequence
  chemically synthesized
tacgaggaaaaaaagacttgat

SEQ ID NO: 776029 - DNA, 22 bp, Artificial Sequence
  chemically synthesized
acgaggaaaaaaagacttgatg

SEQ ID NO: 776030 - DNA, 22 bp, Artificial Sequence
  chemically synthesized
cgaggaaaaaaagacttgatga

SEQ ID NO: 776031 - DNA, 22 bp, Artificial Sequence
  chemically synthesized
atatcttatctgtcatcaagtc

SEQ ID NO: 776032 - DNA, 22 bp, Artificial Sequence
  chemically synthesized
tcatatcttatctgtcatcaag

SEQ ID NO: 776033 - DNA, 22 bp, Artificial Sequence
  chemically synthesized
atcactctcatatcttatctgt

SEQ ID NO: 776034 - DNA, 22 bp, Artificial Sequence
  chemically synthesized
catcactctcatatcttatctg

SEQ ID NO: 776035 - DNA, 22 bp, Artificial Sequence
  chemically synthesized
ttcatcactctcatatcttatc

SEQ ID NO: 776036 - DNA, 22 bp, Artificial Sequence
  chemically synthesized
cttcatcactctcatatcttat

SEQ ID NO: 776037 - DNA, 22 bp, Artificial Sequence
  chemically synthesized
tcttcatcactctcatatctta

SEQ ID NO: 776038 - DNA, 22 bp, Artificial Sequence
  chemically synthesized
gatgacagataagatatgagag

SEQ ID NO: 776039 - DNA, 22 bp, Artificial Sequence
  chemically synthesized
atgacagataagatatgagagt

SEQ ID NO: 776040 - DNA, 22 bp, Artificial Sequence
  chemically synthesized
gtgacaactttcttcatcactc

SEQ ID NO: 776041 - DNA, 22 bp, Artificial Sequence
  chemically synthesized
agtgacaactttcttcatcact

SEQ ID NO: 776042 - DNA, 22 bp, Artificial Sequence
  chemically synthesized
aaagaatttagtgacaactttc

SEQ ID NO: 776043 - DNA, 22 bp, Artificial Sequence
  chemically synthesized
ctcaaagaatttagtgacaact

SEQ ID NO: 776044 - DNA, 22 bp, Artificial Sequence
  chemically synthesized
ctactcaaagaatttagtgaca

SEQ ID NO: 776045 - DNA, 22 bp, Artificial Sequence
  chemically synthesized
aggccctgctactcaaagaatt

SEQ ID NO: 776046 - DNA, 22 bp, Artificial Sequence
  chemically synthesized
gaggccctgctactcaaagaat

SEQ ID NO: 776047 - DNA, 22 bp, Artificial Sequence
  chemically synthesized
tcactaaattctttgagtagca

SEQ ID NO: 776048 - DNA, 22 bp, Artificial Sequence
  chemically synthesized
aattctttgagtagcagggcct

SEQ ID NO: 776049 - DNA, 22 bp, Artificial Sequence
  chemically synthesized
aagataacacttgaggccctgc

SEQ ID NO: 776050 - DNA, 22 bp, Artificial Sequence
  chemically synthesized
tttgagtagcagggcctcaagt

SEQ ID NO: 776051 - DNA, 22 bp, Artificial Sequence
  chemically synthesized
cactcaagataacacttgaggc

SEQ ID NO: 776052 - DNA, 22 bp, Artificial Sequence
  chemically synthesized
tgagtagcagggcctcaagtgt

SEQ ID NO: 776053 - DNA, 22 bp, Artificial Sequence
  chemically synthesized
gcactcaagataacacttgagg

SEQ ID NO: 776054 - DNA, 22 bp, Artificial Sequence
  chemically synthesized
gagtagcagggcctcaagtgtt

SEQ ID NO: 776055 - DNA, 22 bp, Artificial Sequence
  chemically synthesized
agtagcagggcctcaagtgtta

SEQ ID NO: 776056 - DNA, 22 bp, Artificial Sequence
  chemically synthesized
tatttgcactcaagataacact

SEQ ID NO: 776057 - DNA, 22 bp, Artificial Sequence
  chemically synthesized
atatttgcactcaagataacac

SEQ ID NO: 776058 - DNA, 22 bp, Artificial Sequence
  chemically synthesized
tttatatttgcactcaagataa

SEQ ID NO: 776059 - DNA, 22 bp, Artificial Sequence
  chemically synthesized
actgtttatatttgcactcaag

SEQ ID NO: 776060 - DNA, 22 bp, Artificial Sequence
  chemically synthesized
aagtgttatcttgagtgcaaat

SEQ ID NO: 776061 - DNA, 22 bp, Artificial Sequence
  chemically synthesized
tcggttcactgtttatatttgc

SEQ ID NO: 776062 - DNA, 22 bp, Artificial Sequence
  chemically synthesized
atcggttcactgtttatatttg

SEQ ID NO: 776063 - DNA, 22 bp, Artificial Sequence
  chemically synthesized
tcttgagtgcaaatataaacag

SEQ ID NO: 776064 - DNA, 22 bp, Artificial Sequence
  chemically synthesized
gagtgcaaatataaacagtgaa

SEQ ID NO: 776065 - DNA, 22 bp, Artificial Sequence
  chemically synthesized
agtgcaaatataaacagtgaac

SEQ ID NO: 776066 - DNA, 22 bp, Artificial Sequence
  chemically synthesized
accaagaacatacttatcggtt

SEQ ID NO: 776067 - DNA, 22 bp, Artificial Sequence
  chemically synthesized
gcgagttcaccaagaacatact

SEQ ID NO: 776068 - DNA, 22 bp, Artificial Sequence
  chemically synthesized
ggcgagttcaccaagaacatac

SEQ ID NO: 776069 - DNA, 22 bp, Artificial Sequence
  chemically synthesized
tggcgagttcaccaagaacata

SEQ ID NO: 776070 - DNA, 22 bp, Artificial Sequence
  chemically synthesized
ctttggcgagttcaccaagaac

SEQ ID NO: 776071 - DNA, 22 bp, Artificial Sequence
  chemically synthesized
actttggcgagttcaccaagaa

SEQ ID NO: 776072 - DNA, 22 bp, Artificial Sequence
  chemically synthesized
aaaatttactttggcgagttca

SEQ ID NO: 776073 - DNA, 22 bp, Artificial Sequence
  chemically synthesized
gctgaaaatttactttggcgag

SEQ ID NO: 776074 - DNA, 22 bp, Artificial Sequence
  chemically synthesized
ctggctgaaaatttactttggc

SEQ ID NO: 776075 - DNA, 22 bp, Artificial Sequence
  chemically synthesized
ttggtgaactcgccaaagtaaa

SEQ ID NO: 776076 - DNA, 22 bp, Artificial Sequence
  chemically synthesized
ggtgaactcgccaaagtaaatt

SEQ ID NO: 776077 - DNA, 22 bp, Artificial Sequence
  chemically synthesized
gtgaactcgccaaagtaaattt

SEQ ID NO: 776078 - DNA, 22 bp, Artificial Sequence
  chemically synthesized
attgctggctgaaaatttactt

SEQ ID NO: 776079 - DNA, 22 bp, Artificial Sequence
  chemically synthesized
ttcattgctggctgaaaattta

SEQ ID NO: 776080 - DNA, 22 bp, Artificial Sequence
  chemically synthesized
ttgttcattgctggctgaaaat

SEQ ID NO: 776081 - DNA, 22 bp, Artificial Sequence
  chemically synthesized
gccaaagtaaattttcagccag

SEQ ID NO: 776082 - DNA, 22 bp, Artificial Sequence
  chemically synthesized
ctgttgttcattgctggctgaa

SEQ ID NO: 776083 - DNA, 22 bp, Artificial Sequence
  chemically synthesized
actgttgttcattgctggctga

SEQ ID NO: 776084 - DNA, 22 bp, Artificial Sequence
  chemically synthesized
ttactgttgttcattgctggct

SEQ ID NO: 776085 - DNA, 22 bp, Artificial Sequence
  chemically synthesized
cttactgttgttcattgctggc

SEQ ID NO: 776086 - DNA, 22 bp, Artificial Sequence
  chemically synthesized
cttcttactgttgttcattgct

SEQ ID NO: 776087 - DNA, 22 bp, Artificial Sequence
  chemically synthesized
ctacttcttactgttgttcatt

SEQ ID NO: 776088 - DNA, 22 bp, Artificial Sequence
  chemically synthesized
tcagccagcaatgaacaacagt

SEQ ID NO: 776089 - DNA, 22 bp, Artificial Sequence
  chemically synthesized
cagccagcaatgaacaacagta

SEQ ID NO: 776090 - DNA, 22 bp, Artificial Sequence
  chemically synthesized
agccagcaatgaacaacagtaa

SEQ ID NO: 776091 - DNA, 22 bp, Artificial Sequence
  chemically synthesized
accaaattcctacttcttactg

SEQ ID NO: 776092 - DNA, 22 bp, Artificial Sequence
  chemically synthesized
acctcaccaaattcctacttct

SEQ ID NO: 776093 - DNA, 22 bp, Artificial Sequence
  chemically synthesized
aacctcaccaaattcctacttc

SEQ ID NO: 776094 - DNA, 22 bp, Artificial Sequence
  chemically synthesized
taacctcaccaaattcctactt

SEQ ID NO: 776095 - DNA, 22 bp, Artificial Sequence
  chemically synthesized
tttaacctcaccaaattcctac

SEQ ID NO: 776096 - DNA, 22 bp, Artificial Sequence
  chemically synthesized
ctttaacctcaccaaattccta

SEQ ID NO: 776097 - DNA, 22 bp, Artificial Sequence
  chemically synthesized
atttctttaacctcaccaaatt

SEQ ID NO: 776098 - DNA, 22 bp, Artificial Sequence
  chemically synthesized
aggaagatacctgatttcttta

SEQ ID NO: 776099 - DNA, 22 bp, Artificial Sequence
  chemically synthesized
ggtgaggttaaagaaatcaggt

SEQ ID NO: 776100 - DNA, 22 bp, Artificial Sequence
  chemically synthesized
gtgaggttaaagaaatcaggta

SEQ ID NO: 776101 - DNA, 22 bp, Artificial Sequence
  chemically synthesized
aattgaggaagatacctgattt

SEQ ID NO: 776102 - DNA, 22 bp, Artificial Sequence
  chemically synthesized
ctgaattgaggaagatacctga

SEQ ID NO: 776103 - DNA, 22 bp, Artificial Sequence
  chemically synthesized
tgctgaattgaggaagatacct

SEQ ID NO: 776104 - DNA, 22 bp, Artificial Sequence
  chemically synthesized
ctgctgaattgaggaagatacc

SEQ ID NO: 776105 - DNA, 22 bp, Artificial Sequence
  chemically synthesized
tctgctgaattgaggaagatac

SEQ ID NO: 776106 - DNA, 22 bp, Artificial Sequence
  chemically synthesized
ttctgctgaattgaggaagata

SEQ ID NO: 776107 - DNA, 22 bp, Artificial Sequence
  chemically synthesized
aagaaatcaggtatcttcctca

SEQ ID NO: 776108 - DNA, 22 bp, Artificial Sequence
  chemically synthesized
ttttctgctgaattgaggaaga

SEQ ID NO: 776109 - DNA, 22 bp, Artificial Sequence
  chemically synthesized
acctcttttctgctgaattgag

SEQ ID NO: 776110 - DNA, 22 bp, Artificial Sequence
  chemically synthesized
gacctcttttctgctgaattga

SEQ ID NO: 776111 - DNA, 22 bp, Artificial Sequence
  chemically synthesized
aaacttgacctcttttctgctg

SEQ ID NO: 776112 - DNA, 22 bp, Artificial Sequence
  chemically synthesized
gaaacttgacctcttttctgct

SEQ ID NO: 776113 - DNA, 22 bp, Artificial Sequence
  chemically synthesized
tgaaacttgacctcttttctgc

SEQ ID NO: 776114 - DNA, 22 bp, Artificial Sequence
  chemically synthesized
ttgaaacttgacctcttttctg

SEQ ID NO: 776115 - DNA, 22 bp, Artificial Sequence
  chemically synthesized
cctcaattcagcagaaaagagg

SEQ ID NO: 776116 - DNA, 22 bp, Artificial Sequence
  chemically synthesized
ctcaattcagcagaaaagaggt

SEQ ID NO: 776117 - DNA, 22 bp, Artificial Sequence
  chemically synthesized
aattcagcagaaaagaggtcaa

SEQ ID NO: 776118 - DNA, 22 bp, Artificial Sequence
  chemically synthesized
agcagaaaagaggtcaagtttc

SEQ ID NO: 776119 - DNA, 22 bp, Artificial Sequence
  chemically synthesized
ccaatgtcttttgaaacttgac

SEQ ID NO: 776120 - DNA, 22 bp, Artificial Sequence
  chemically synthesized
cccaatgtcttttgaaacttga

SEQ ID NO: 776121 - DNA, 22 bp, Artificial Sequence
  chemically synthesized
agggtcacccacacttcccaat

SEQ ID NO: 776122 - DNA, 22 bp, Artificial Sequence
  chemically synthesized
gagggtcacccacacttcccaa

SEQ ID NO: 776123 - DNA, 22 bp, Artificial Sequence
  chemically synthesized
ttgagggtcacccacacttccc

SEQ ID NO: 776124 - DNA, 22 bp, Artificial Sequence
  chemically synthesized
caaaagacattgggaagtgtgg

SEQ ID NO: 776125 - DNA, 22 bp, Artificial Sequence
  chemically synthesized
aaaagacattgggaagtgtggg

SEQ ID NO: 776126 - DNA, 22 bp, Artificial Sequence
  chemically synthesized
aattcttgagggtcacccacac

SEQ ID NO: 776127 - DNA, 22 bp, Artificial Sequence
  chemically synthesized
tctaaattcttgagggtcaccc

SEQ ID NO: 776128 - DNA, 22 bp, Artificial Sequence
  chemically synthesized
atctaaattcttgagggtcacc

SEQ ID NO: 776129 - DNA, 22 bp, Artificial Sequence
  chemically synthesized
ttatctaaattcttgagggtca

SEQ ID NO: 776130 - DNA, 22 bp, Artificial Sequence
  chemically synthesized
ggaagtgtgggtgaccctcaag

SEQ ID NO: 776131 - DNA, 22 bp, Artificial Sequence
  chemically synthesized
cttatctaaattcttgagggtc

SEQ ID NO: 776132 - DNA, 22 bp, Artificial Sequence
  chemically synthesized
ttcttatctaaattcttgaggg

SEQ ID NO: 776133 - DNA, 22 bp, Artificial Sequence
  chemically synthesized
ctcttcttatctaaattcttga

SEQ ID NO: 776134 - DNA, 22 bp, Artificial Sequence
  chemically synthesized
cctcttcttatctaaattcttg

SEQ ID NO: 776135 - DNA, 22 bp, Artificial Sequence
  chemically synthesized
tcctcttcttatctaaattctt

SEQ ID NO: 776136 - DNA, 22 bp, Artificial Sequence
  chemically synthesized
acagttttcctcttcttatcta

SEQ ID NO: 776137 - DNA, 22 bp, Artificial Sequence
  chemically synthesized
tgacagttttcctcttcttatc

SEQ ID NO: 776138 - DNA, 22 bp, Artificial Sequence
  chemically synthesized
aagaatttagataagaagagga

SEQ ID NO: 776139 - DNA, 22 bp, Artificial Sequence
  chemically synthesized
agataagaagaggaaaactgtc

SEQ ID NO: 776140 - DNA, 22 bp, Artificial Sequence
  chemically synthesized
gataagaagaggaaaactgtca

SEQ ID NO: 776141 - DNA, 22 bp, Artificial Sequence
  chemically synthesized
accaaatgactctgacagtttt

SEQ ID NO: 776142 - DNA, 22 bp, Artificial Sequence
  chemically synthesized
aaccaaatgactctgacagttt

SEQ ID NO: 776143 - DNA, 22 bp, Artificial Sequence
  chemically synthesized
tcaataccttaaccaaatgact

SEQ ID NO: 776144 - DNA, 22 bp, Artificial Sequence
  chemically synthesized
atcaataccttaaccaaatgac

SEQ ID NO: 776145 - DNA, 22 bp, Artificial Sequence
  chemically synthesized
aatcttatcaataccttaacca

SEQ ID NO: 776146 - DNA, 22 bp, Artificial Sequence
  chemically synthesized
tcagagtcatttggttaaggta

SEQ ID NO: 776147 - DNA, 22 bp, Artificial Sequence
  chemically synthesized
gaatcttatcaataccttaacc

SEQ ID NO: 776148 - DNA, 22 bp, Artificial Sequence
  chemically synthesized
ggttaaggtattgataagattc

SEQ ID NO: 776149 - DNA, 22 bp, Artificial Sequence
  chemically synthesized
gttaaggtattgataagattca

SEQ ID NO: 776150 - DNA, 22 bp, Artificial Sequence
  chemically synthesized
aggtattgataagattcaagct

SEQ ID NO: 776151 - DNA, 22 bp, Artificial Sequence
  chemically synthesized
ataagattcaagctatgcggct

SEQ ID NO: 776152 - DNA, 22 bp, Artificial Sequence
  chemically synthesized
agccaccgcacccagccgcata

SEQ ID NO: 776153 - DNA, 22 bp, Artificial Sequence
  chemically synthesized
aagctatgcggctgggtgcggt

SEQ ID NO: 776154 - DNA, 22 bp, Artificial Sequence
  chemically synthesized
ccaaagtgctgagccaccgcac

SEQ ID NO: 776155 - DNA, 22 bp, Artificial Sequence
  chemically synthesized
tgcggctgggtgcggtggctca

SEQ ID NO: 776156 - DNA, 22 bp, Artificial Sequence
  chemically synthesized
ggcctcccaaagtgctgagcca

SEQ ID NO: 776157 - DNA, 22 bp, Artificial Sequence
  chemically synthesized
cggcctcccaaagtgctgagcc

SEQ ID NO: 776158 - DNA, 22 bp, Artificial Sequence
  chemically synthesized
ggtgcggtggctcagcactttg

SEQ ID NO: 776159 - DNA, 22 bp, Artificial Sequence
  chemically synthesized
gtggtccgcccacttcggcctc

SEQ ID NO: 776160 - DNA, 22 bp, Artificial Sequence
  chemically synthesized
agcactttgggaggccgaagtg

SEQ ID NO: 776161 - DNA, 22 bp, Artificial Sequence
  chemically synthesized
acctcgtggtccgcccacttcg

SEQ ID NO: 776162 - DNA, 22 bp, Artificial Sequence
  chemically synthesized
ctgacctcgtggtccgcccact

SEQ ID NO: 776163 - DNA, 22 bp, Artificial Sequence
  chemically synthesized
tgggaggccgaagtgggcggac

SEQ ID NO: 776164 - DNA, 22 bp, Artificial Sequence
  chemically synthesized
gggaggccgaagtgggcggacc

SEQ ID NO: 776165 - DNA, 22 bp, Artificial Sequence
  chemically synthesized
ggaggccgaagtgggcggacca

SEQ ID NO: 776166 - DNA, 22 bp, Artificial Sequence
  chemically synthesized
aactcctgacctcgtggtccgc

SEQ ID NO: 776167 - DNA, 22 bp, Artificial Sequence
  chemically synthesized
gaactcctgacctcgtggtccg

SEQ ID NO: 776168 - DNA, 22 bp, Artificial Sequence
  chemically synthesized
gtcttgaactcctgacctcgtg

SEQ ID NO: 776169 - DNA, 22 bp, Artificial Sequence
  chemically synthesized
gccggactggtcttgaactcct

SEQ ID NO: 776170 - DNA, 22 bp, Artificial Sequence
  chemically synthesized
accatgttagccggactggtct

SEQ ID NO: 776171 - DNA, 22 bp, Artificial Sequence
  chemically synthesized
caccatgttagccggactggtc

SEQ ID NO: 776172 - DNA, 22 bp, Artificial Sequence
  chemically synthesized
aagaccagtccggctaacatgg

SEQ ID NO: 776173 - DNA, 22 bp, Artificial Sequence
  chemically synthesized
gtagagatggggtttcaccatg

SEQ ID NO: 776174 - DNA, 22 bp, Artificial Sequence
  chemically synthesized
agtagagatggggtttcaccat

SEQ ID NO: 776175 - DNA, 22 bp, Artificial Sequence
  chemically synthesized
tagtagagatggggtttcacca

SEQ ID NO: 776176 - DNA, 22 bp, Artificial Sequence
  chemically synthesized
tatctttagtagagatggggtt

SEQ ID NO: 776177 - DNA, 22 bp, Artificial Sequence
  chemically synthesized
gtatctttagtagagatggggt

SEQ ID NO: 776178 - DNA, 22 bp, Artificial Sequence
  chemically synthesized
tgtatctttagtagagatgggg

SEQ ID NO: 776179 - DNA, 22 bp, Artificial Sequence
  chemically synthesized
acatggtgaaaccccatctcta

SEQ ID NO: 776180 - DNA, 22 bp, Artificial Sequence
  chemically synthesized
ttgtatctttagtagagatggg

SEQ ID NO: 776181 - DNA, 22 bp, Artificial Sequence
  chemically synthesized
tttgtatctttagtagagatgg

SEQ ID NO: 776182 - DNA, 22 bp, Artificial Sequence
  chemically synthesized
gcaaattttttgtatctttagt

SEQ ID NO: 776183 - DNA, 22 bp, Artificial Sequence
  chemically synthesized
tactaaagatacaaaaaatttg

SEQ ID NO: 776184 - DNA, 22 bp, Artificial Sequence
  chemically synthesized
ctaaagatacaaaaaatttgcc

SEQ ID NO: 776185 - DNA, 22 bp, Artificial Sequence
  chemically synthesized
aagatacaaaaaatttgccagg

SEQ ID NO: 776186 - DNA, 22 bp, Artificial Sequence
  chemically synthesized
caggcacatgccaccatgcctg

SEQ ID NO: 776187 - DNA, 22 bp, Artificial Sequence
  chemically synthesized
ggattacaggcacatgccacca

SEQ ID NO: 776188 - DNA, 22 bp, Artificial Sequence
  chemically synthesized
gccaggcatggtggcatgtgcc

SEQ ID NO: 776189 - DNA, 22 bp, Artificial Sequence
  chemically synthesized
ccaggcatggtggcatgtgcct

SEQ ID NO: 776190 - DNA, 22 bp, Artificial Sequence
  chemically synthesized
ccgagtaactgggattacaggc

SEQ ID NO: 776191 - DNA, 22 bp, Artificial Sequence
  chemically synthesized
agcctcccgagtaactgggatt

SEQ ID NO: 776192 - DNA, 22 bp, Artificial Sequence
  chemically synthesized
cctcagcctcccgagtaactgg

SEQ ID NO: 776193 - DNA, 22 bp, Artificial Sequence
  chemically synthesized
ctgcctcagcctcccgagtaac

SEQ ID NO: 776194 - DNA, 22 bp, Artificial Sequence
  chemically synthesized
tcctgcctcagcctcccgagta

SEQ ID NO: 776195 - DNA, 22 bp, Artificial Sequence
  chemically synthesized
taatcccagttactcgggaggc

SEQ ID NO: 776196 - DNA, 22 bp, Artificial Sequence
  chemically synthesized
aagtgattctcctgcctcagcc

SEQ ID NO: 776197 - DNA, 22 bp, Artificial Sequence
  chemically synthesized
ctcgggaggctgaggcaggaga

SEQ ID NO: 776198 - DNA, 22 bp, Artificial Sequence
  chemically synthesized
gggaggctgaggcaggagaatc

SEQ ID NO: 776199 - DNA, 22 bp, Artificial Sequence
  chemically synthesized
ccaagttcaagtgattctcctg

SEQ ID NO: 776200 - DNA, 22 bp, Artificial Sequence
  chemically synthesized
cacctcccaagttcaagtgatt

SEQ ID NO: 776201 - DNA, 22 bp, Artificial Sequence
  chemically synthesized
aggcaggagaatcacttgaact

SEQ ID NO: 776202 - DNA, 22 bp, Artificial Sequence
  chemically synthesized
caacctccacctcccaagttca

SEQ ID NO: 776203 - DNA, 22 bp, Artificial Sequence
  chemically synthesized
actacaacctccacctcccaag

SEQ ID NO: 776204 - DNA, 22 bp, Artificial Sequence
  chemically synthesized
ggctcactacaacctccacctc

SEQ ID NO: 776205 - DNA, 22 bp, Artificial Sequence
  chemically synthesized
gaacttgggaggtggaggttgt

SEQ ID NO: 776206 - DNA, 22 bp, Artificial Sequence
  chemically synthesized
aacttgggaggtggaggttgta

SEQ ID NO: 776207 - DNA, 22 bp, Artificial Sequence
  chemically synthesized
gggaggtggaggttgtagtgag

SEQ ID NO: 776208 - DNA, 22 bp, Artificial Sequence
  chemically synthesized
ggaggtggaggttgtagtgagc

SEQ ID NO: 776209 - DNA, 22 bp, Artificial Sequence
  chemically synthesized
gagtgcaatggcacaatctcgg

SEQ ID NO: 776210 - DNA, 22 bp, Artificial Sequence
  chemically synthesized
tagtgagccgagattgtgccat

SEQ ID NO: 776211 - DNA, 22 bp, Artificial Sequence
  chemically synthesized
taacccaggctggagtgcaatg

SEQ ID NO: 776212 - DNA, 22 bp, Artificial Sequence
  chemically synthesized
accctgtaacccaggctggagt

SEQ ID NO: 776213 - DNA, 22 bp, Artificial Sequence
  chemically synthesized
tgccattgcactccagcctggg

SEQ ID NO: 776214 - DNA, 22 bp, Artificial Sequence
  chemically synthesized
cactccagcctgggttacaggg

SEQ ID NO: 776215 - DNA, 22 bp, Artificial Sequence
  chemically synthesized
agacggagtctcaccctgtaac

SEQ ID NO: 776216 - DNA, 22 bp, Artificial Sequence
  chemically synthesized
gagacggagtctcaccctgtaa

SEQ ID NO: 776217 - DNA, 22 bp, Artificial Sequence
  chemically synthesized
tgagacggagtctcaccctgta

SEQ ID NO: 776218 - DNA, 22 bp, Artificial Sequence
  chemically synthesized
ttgagacggagtctcaccctgt

SEQ ID NO: 776219 - DNA, 22 bp, Artificial Sequence
  chemically synthesized
cagcctgggttacagggtgaga

SEQ ID NO: 776220 - DNA, 22 bp, Artificial Sequence
  chemically synthesized
tttgagacggagtctcaccctg

SEQ ID NO: 776221 - DNA, 22 bp, Artificial Sequence
  chemically synthesized
ttttgagacggagtctcaccct

SEQ ID NO: 776222 - DNA, 22 bp, Artificial Sequence
  chemically synthesized
tttttgagacggagtctcaccc

SEQ ID NO: 776223 - DNA, 22 bp, Artificial Sequence
  chemically synthesized
ttttttgagacggagtctcacc

SEQ ID NO: 776224 - DNA, 22 bp, Artificial Sequence
  chemically synthesized
tttttttgagacggagtctcac

SEQ ID NO: 776225 - DNA, 22 bp, Artificial Sequence
  chemically synthesized
ttttttttgagacggagtctca

SEQ ID NO: 776226 - DNA, 22 bp, Artificial Sequence
  chemically synthesized
tttttttttgagacggagtctc

SEQ ID NO: 776227 - DNA, 22 bp, Artificial Sequence
  chemically synthesized
ggttacagggtgagactccgtc

SEQ ID NO: 776228 - DNA, 22 bp, Artificial Sequence
  chemically synthesized
ttttttttttgagacggagtct

SEQ ID NO: 776229 - DNA, 22 bp, Artificial Sequence
  chemically synthesized
tttttttttttgagacggagtc

SEQ ID NO: 776230 - DNA, 22 bp, Artificial Sequence
  chemically synthesized
ttttttttttttgagacggagt

SEQ ID NO: 776231 - DNA, 22 bp, Artificial Sequence
  chemically synthesized
tttttttttttttgagacggag

SEQ ID NO: 776232 - DNA, 22 bp, Artificial Sequence
  chemically synthesized
ttttttttttttttgagacgga

SEQ ID NO: 776233 - DNA, 22 bp, Artificial Sequence
  chemically synthesized
cagggtgagactccgtctcaaa

SEQ ID NO: 776234 - DNA, 22 bp, Artificial Sequence
  chemically synthesized
tttttttttttttttgagacgg

SEQ ID NO: 776235 - DNA, 22 bp, Artificial Sequence
  chemically synthesized
ttttttttttttttttgagacg

SEQ ID NO: 776236 - DNA, 22 bp, Artificial Sequence
  chemically synthesized
aatccttttttttttttttttt

SEQ ID NO: 776237 - DNA, 22 bp, Artificial Sequence
  chemically synthesized
gaatcctttttttttttttttt

SEQ ID NO: 776238 - DNA, 22 bp, Artificial Sequence
  chemically synthesized
cgtctcaaaaaaaaaaaaaaaa

SEQ ID NO: 776239 - DNA, 22 bp, Artificial Sequence
  chemically synthesized
aaaaaaaaaaaaaaaaaaggat

SEQ ID NO: 776240 - DNA, 22 bp, Artificial Sequence
  chemically synthesized
gagtagcgtaacttgaatcctt

SEQ ID NO: 776241 - DNA, 22 bp, Artificial Sequence
  chemically synthesized
ggagtagcgtaacttgaatcct

SEQ ID NO: 776242 - DNA, 22 bp, Artificial Sequence
  chemically synthesized
tggagtagcgtaacttgaatcc

SEQ ID NO: 776243 - DNA, 22 bp, Artificial Sequence
  chemically synthesized
tggattttggagtagcgtaact

SEQ ID NO: 776244 - DNA, 22 bp, Artificial Sequence
  chemically synthesized
ccatattgtggattttggagta

SEQ ID NO: 776245 - DNA, 22 bp, Artificial Sequence
  chemically synthesized
aagttacgctactccaaaatcc

SEQ ID NO: 776246 - DNA, 22 bp, Artificial Sequence
  chemically synthesized
cgctactccaaaatccacaata

SEQ ID NO: 776247 - DNA, 22 bp, Artificial Sequence
  chemically synthesized
aaataccaagctgccatattgt

SEQ ID NO: 776248 - DNA, 22 bp, Artificial Sequence
  chemically synthesized
ctccaaaatccacaatatggca

SEQ ID NO: 776249 - DNA, 22 bp, Artificial Sequence
  chemically synthesized
tcaaataccaagctgccatatt

SEQ ID NO: 776250 - DNA, 22 bp, Artificial Sequence
  chemically synthesized
ctcaaataccaagctgccatat

SEQ ID NO: 776251 - DNA, 22 bp, Artificial Sequence
  chemically synthesized
caaaatccacaatatggcagct

SEQ ID NO: 776252 - DNA, 22 bp, Artificial Sequence
  chemically synthesized
tcttctcaaataccaagctgcc

SEQ ID NO: 776253 - DNA, 22 bp, Artificial Sequence
  chemically synthesized
ctgtcttctcaaataccaagct

SEQ ID NO: 776254 - DNA, 22 bp, Artificial Sequence
  chemically synthesized
tgctgtcttctcaaataccaag

SEQ ID NO: 776255 - DNA, 22 bp, Artificial Sequence
  chemically synthesized
ctgctgtcttctcaaataccaa

SEQ ID NO: 776256 - DNA, 22 bp, Artificial Sequence
  chemically synthesized
cttctgctgtcttctcaaatac

SEQ ID NO: 776257 - DNA, 22 bp, Artificial Sequence
  chemically synthesized
ggtatttgagaagacagcagaa

SEQ ID NO: 776258 - DNA, 22 bp, Artificial Sequence
  chemically synthesized
gtatttgagaagacagcagaag

SEQ ID NO: 776259 - DNA, 22 bp, Artificial Sequence
  chemically synthesized
gagaagacagcagaagcaggat

SEQ ID NO: 776260 - DNA, 22 bp, Artificial Sequence
  chemically synthesized
agaagacagcagaagcaggatg

SEQ ID NO: 776261 - DNA, 22 bp, Artificial Sequence
  chemically synthesized
aggggagaagggggaaggggaa

SEQ ID NO: 776262 - DNA, 22 bp, Artificial Sequence
  chemically synthesized
caggggagaagggggaagggga

SEQ ID NO: 776263 - DNA, 22 bp, Artificial Sequence
  chemically synthesized
cttcaggggagaagggggaagg

SEQ ID NO: 776264 - DNA, 22 bp, Artificial Sequence
  chemically synthesized
tcaccttccccttcccccttct

SEQ ID NO: 776265 - DNA, 22 bp, Artificial Sequence
  chemically synthesized
accttccccttcccccttctcc

SEQ ID NO: 776266 - DNA, 22 bp, Artificial Sequence
  chemically synthesized
atgacctgcttcaggggagaag

SEQ ID NO: 776267 - DNA, 22 bp, Artificial Sequence
  chemically synthesized
ccccttcccccttctcccctga

SEQ ID NO: 776268 - DNA, 22 bp, Artificial Sequence
  chemically synthesized
cccttcccccttctcccctgaa

SEQ ID NO: 776269 - DNA, 22 bp, Artificial Sequence
  chemically synthesized
cccccttctcccctgaagcagg

SEQ ID NO: 776270 - DNA, 22 bp, Artificial Sequence
  chemically synthesized
ccccttctcccctgaagcaggt

SEQ ID NO: 776271 - DNA, 22 bp, Artificial Sequence
  chemically synthesized
gtatgatagtctcatgacctgc

SEQ ID NO: 776272 - DNA, 22 bp, Artificial Sequence
  chemically synthesized
ctcccctgaagcaggtcatgag

SEQ ID NO: 776273 - DNA, 22 bp, Artificial Sequence
  chemically synthesized
tggtatgatagtctcatgacct

SEQ ID NO: 776274 - DNA, 22 bp, Artificial Sequence
  chemically synthesized
tcccctgaagcaggtcatgaga

SEQ ID NO: 776275 - DNA, 22 bp, Artificial Sequence
  chemically synthesized
ccctgaagcaggtcatgagact

SEQ ID NO: 776276 - DNA, 22 bp, Artificial Sequence
  chemically synthesized
aagcaggtcatgagactatcat

SEQ ID NO: 776277 - DNA, 22 bp, Artificial Sequence
  chemically synthesized
cagtatagtaagggcacctctg

SEQ ID NO: 776278 - DNA, 22 bp, Artificial Sequence
  chemically synthesized
ccagtatagtaagggcacctct

SEQ ID NO: 776279 - DNA, 22 bp, Artificial Sequence
  chemically synthesized
cttccagtatagtaagggcacc

SEQ ID NO: 776280 - DNA, 22 bp, Artificial Sequence
  chemically synthesized
ccttccagtatagtaagggcac

SEQ ID NO: 776281 - DNA, 22 bp, Artificial Sequence
  chemically synthesized
tcataccagaggtgcccttact

SEQ ID NO: 776282 - DNA, 22 bp, Artificial Sequence
  chemically synthesized
tccttccagtatagtaagggca

SEQ ID NO: 776283 - DNA, 22 bp, Artificial Sequence
  chemically synthesized
ctttccttccagtatagtaagg

SEQ ID NO: 776284 - DNA, 22 bp, Artificial Sequence
  chemically synthesized
cctttccttccagtatagtaag

SEQ ID NO: 776285 - DNA, 22 bp, Artificial Sequence
  chemically synthesized
tcctttccttccagtatagtaa

SEQ ID NO: 776286 - DNA, 22 bp, Artificial Sequence
  chemically synthesized
actatactggaaggaaaggaaa

SEQ ID NO: 776287 - DNA, 22 bp, Artificial Sequence
  chemically synthesized
agaggtaaaaattttcctttcc

SEQ ID NO: 776288 - DNA, 22 bp, Artificial Sequence
  chemically synthesized
ctatactggaaggaaaggaaaa

SEQ ID NO: 776289 - DNA, 22 bp, Artificial Sequence
  chemically synthesized
cagaggtaaaaattttcctttc

SEQ ID NO: 776290 - DNA, 22 bp, Artificial Sequence
  chemically synthesized
tcagaggtaaaaattttccttt

SEQ ID NO: 776291 - DNA, 22 bp, Artificial Sequence
  chemically synthesized
tactggaaggaaaggaaaattt

SEQ ID NO: 776292 - DNA, 22 bp, Artificial Sequence
  chemically synthesized
tgttttcagaggtaaaaatttt

SEQ ID NO: 776293 - DNA, 22 bp, Artificial Sequence
  chemically synthesized
gaaggaaaggaaaatttttacc

SEQ ID NO: 776294 - DNA, 22 bp, Artificial Sequence
  chemically synthesized
tgtccctgtgttttcagaggta

SEQ ID NO: 776295 - DNA, 22 bp, Artificial Sequence
  chemically synthesized
ctgtgtccctgtgttttcagag

SEQ ID NO: 776296 - DNA, 22 bp, Artificial Sequence
  chemically synthesized
ttacctctgaaaacacagggac

SEQ ID NO: 776297 - DNA, 22 bp, Artificial Sequence
  chemically synthesized
tacctctgaaaacacagggaca

SEQ ID NO: 776298 - DNA, 22 bp, Artificial Sequence
  chemically synthesized
cagaacctcctgtgtccctgtg

SEQ ID NO: 776299 - DNA, 22 bp, Artificial Sequence
  chemically synthesized
acctctgaaaacacagggacac

SEQ ID NO: 776300 - DNA, 22 bp, Artificial Sequence
  chemically synthesized
cctctgaaaacacagggacaca

SEQ ID NO: 776301 - DNA, 22 bp, Artificial Sequence
  chemically synthesized
tgcagaacctcctgtgtccctg

SEQ ID NO: 776302 - DNA, 22 bp, Artificial Sequence
  chemically synthesized
ctgcagaacctcctgtgtccct

SEQ ID NO: 776303 - DNA, 22 bp, Artificial Sequence
  chemically synthesized
tgaaaacacagggacacaggag

SEQ ID NO: 776304 - DNA, 22 bp, Artificial Sequence
  chemically synthesized
tttctgcagaacctcctgtgtc

SEQ ID NO: 776305 - DNA, 22 bp, Artificial Sequence
  chemically synthesized
aaaacacagggacacaggaggt

SEQ ID NO: 776306 - DNA, 22 bp, Artificial Sequence
  chemically synthesized
gggtgaccacagcaaggcctgt

SEQ ID NO: 776307 - DNA, 22 bp, Artificial Sequence
  chemically synthesized
tgcagaaacaggccttgctgtg

SEQ ID NO: 776308 - DNA, 22 bp, Artificial Sequence
  chemically synthesized
cagaaacaggccttgctgtggt

SEQ ID NO: 776309 - DNA, 22 bp, Artificial Sequence
  chemically synthesized
gctgtggtcaccccagtttatt

SEQ ID NO: 776310 - DNA, 22 bp, Artificial Sequence
  chemically synthesized
ctgtggtcaccccagtttatta

SEQ ID NO: 776311 - DNA, 22 bp, Artificial Sequence
  chemically synthesized
tggtcaccccagtttattacca

SEQ ID NO: 776312 - DNA, 22 bp, Artificial Sequence
  chemically synthesized
gacaaaggggaatggtaataaa

SEQ ID NO: 776313 - DNA, 22 bp, Artificial Sequence
  chemically synthesized
attaccattcccctttgtccag

SEQ ID NO: 776314 - DNA, 22 bp, Artificial Sequence
  chemically synthesized
ttaccattcccctttgtccagt

SEQ ID NO: 776315 - DNA, 22 bp, Artificial Sequence
  chemically synthesized
ccattcccctttgtccagtcat

SEQ ID NO: 776316 - DNA, 22 bp, Artificial Sequence
  chemically synthesized
ccctttgtccagtcatactgga

SEQ ID NO: 776317 - DNA, 22 bp, Artificial Sequence
  chemically synthesized
aggaaaagtagatgtccagtat

SEQ ID NO: 776318 - DNA, 22 bp, Artificial Sequence
  chemically synthesized
gaggaaaagtagatgtccagta

SEQ ID NO: 776319 - DNA, 22 bp, Artificial Sequence
  chemically synthesized
tgtccagtcatactggacatct

SEQ ID NO: 776320 - DNA, 22 bp, Artificial Sequence
  chemically synthesized
gtccagtcatactggacatcta

SEQ ID NO: 776321 - DNA, 22 bp, Artificial Sequence
  chemically synthesized
tccagtcatactggacatctac

SEQ ID NO: 776322 - DNA, 22 bp, Artificial Sequence
  chemically synthesized
atttgaggaaaagtagatgtcc

SEQ ID NO: 776323 - DNA, 22 bp, Artificial Sequence
  chemically synthesized
tgatttgaggaaaagtagatgt

SEQ ID NO: 776324 - DNA, 22 bp, Artificial Sequence
  chemically synthesized
tgctctgatttgaggaaaagta

SEQ ID NO: 776325 - DNA, 22 bp, Artificial Sequence
  chemically synthesized
atgctctgatttgaggaaaagt

SEQ ID NO: 776326 - DNA, 22 bp, Artificial Sequence
  chemically synthesized
tatgctctgatttgaggaaaag

SEQ ID NO: 776327 - DNA, 22 bp, Artificial Sequence
  chemically synthesized
ttatgctctgatttgaggaaaa

SEQ ID NO: 776328 - DNA, 22 bp, Artificial Sequence
  chemically synthesized
gacatctacttttcctcaaatc

SEQ ID NO: 776329 - DNA, 22 bp, Artificial Sequence
  chemically synthesized
cttttcctcaaatcagagcata

SEQ ID NO: 776330 - DNA, 22 bp, Artificial Sequence
  chemically synthesized
ttcctcaaatcagagcataaaa

SEQ ID NO: 776331 - DNA, 22 bp, Artificial Sequence
  chemically synthesized
tcctcaaatcagagcataaaaa

SEQ ID NO: 776332 - DNA, 22 bp, Artificial Sequence
  chemically synthesized
cctcaaatcagagcataaaaat

SEQ ID NO: 776333 - DNA, 22 bp, Artificial Sequence
  chemically synthesized
ctcaaatcagagcataaaaata

SEQ ID NO: 776334 - DNA, 22 bp, Artificial Sequence
  chemically synthesized
aaatcagagcataaaaatacac

SEQ ID NO: 776335 - DNA, 22 bp, Artificial Sequence
  chemically synthesized
agaaatgacccaaagaatcagg

SEQ ID NO: 776336 - DNA, 22 bp, Artificial Sequence
  chemically synthesized
cagaaatgacccaaagaatcag

SEQ ID NO: 776337 - DNA, 22 bp, Artificial Sequence
  chemically synthesized
ttccctgattctttgggtcatt

SEQ ID NO: 776338 - DNA, 22 bp, Artificial Sequence
  chemically synthesized
tccctgattctttgggtcattt

SEQ ID NO: 776339 - DNA, 22 bp, Artificial Sequence
  chemically synthesized
ccctgattctttgggtcatttc

SEQ ID NO: 776340 - DNA, 22 bp, Artificial Sequence
  chemically synthesized
cctgattctttgggtcatttct

SEQ ID NO: 776341 - DNA, 22 bp, Artificial Sequence
  chemically synthesized
attctttgggtcatttctgaag

SEQ ID NO: 776342 - DNA, 22 bp, Artificial Sequence
  chemically synthesized
acatgacacaggagccttcaga

SEQ ID NO: 776343 - DNA, 22 bp, Artificial Sequence
  chemically synthesized
tttgggtcatttctgaaggctc

SEQ ID NO: 776344 - DNA, 22 bp, Artificial Sequence
  chemically synthesized
cacatgacacaggagccttcag

SEQ ID NO: 776345 - DNA, 22 bp, Artificial Sequence
  chemically synthesized
tgggtcatttctgaaggctcct

SEQ ID NO: 776346 - DNA, 22 bp, Artificial Sequence
  chemically synthesized
gggtcatttctgaaggctcctg

SEQ ID NO: 776347 - DNA, 22 bp, Artificial Sequence
  chemically synthesized
ggtcatttctgaaggctcctgt

SEQ ID NO: 776348 - DNA, 22 bp, Artificial Sequence
  chemically synthesized
atataagtttcacatgacacag

SEQ ID NO: 776349 - DNA, 22 bp, Artificial Sequence
  chemically synthesized
aatataagtttcacatgacaca

SEQ ID NO: 776350 - DNA, 22 bp, Artificial Sequence
  chemically synthesized
ctgaaggctcctgtgtcatgtg

SEQ ID NO: 776351 - DNA, 22 bp, Artificial Sequence
  chemically synthesized
tgaaggctcctgtgtcatgtga

SEQ ID NO: 776352 - DNA, 22 bp, Artificial Sequence
  chemically synthesized
tttaatataagtttcacatgac

SEQ ID NO: 776353 - DNA, 22 bp, Artificial Sequence
  chemically synthesized
aaggctcctgtgtcatgtgaaa

SEQ ID NO: 776354 - DNA, 22 bp, Artificial Sequence
  chemically synthesized
atttaatataagtttcacatga

SEQ ID NO: 776355 - DNA, 22 bp, Artificial Sequence
  chemically synthesized
ctgtgtcatgtgaaacttatat

SEQ ID NO: 776356 - DNA, 22 bp, Artificial Sequence
  chemically synthesized
tgtcatgtgaaacttatattaa

SEQ ID NO: 776357 - DNA, 22 bp, Artificial Sequence
  chemically synthesized
atattaaataaattcgcatgct

SEQ ID NO: 776358 - DNA, 22 bp, Artificial Sequence
  chemically synthesized
tattaaataaattcgcatgctt

SEQ ID NO: 776359 - DNA, 22 bp, Artificial Sequence
  chemically synthesized
aataaattcgcatgcttttatg

SEQ ID NO: 776360 - DNA, 22 bp, Artificial Sequence
  chemically synthesized
gcatgcttttatgttgttgatt

SEQ ID NO: 776361 - DNA, 22 bp, Artificial Sequence
  chemically synthesized
taatgaaggacaaatcaacaac

SEQ ID NO: 776362 - DNA, 22 bp, Artificial Sequence
  chemically synthesized
ttatgttgttgatttgtccttc

SEQ ID NO: 776363 - DNA, 22 bp, Artificial Sequence
  chemically synthesized
tatgttgttgatttgtccttca

SEQ ID NO: 776364 - DNA, 22 bp, Artificial Sequence
  chemically synthesized
aggcacctataatgaaggacaa

SEQ ID NO: 776365 - DNA, 22 bp, Artificial Sequence
  chemically synthesized
atgttgttgatttgtccttcat

SEQ ID NO: 776366 - DNA, 22 bp, Artificial Sequence
  chemically synthesized
tgttgttgatttgtccttcatt

SEQ ID NO: 776367 - DNA, 22 bp, Artificial Sequence
  chemically synthesized
ttgatttgtccttcattatagg

SEQ ID NO: 776368 - DNA, 22 bp, Artificial Sequence
  chemically synthesized
atggctgaggcacctataatga

SEQ ID NO: 776369 - DNA, 22 bp, Artificial Sequence
  chemically synthesized
atttgtccttcattataggtgc

SEQ ID NO: 776370 - DNA, 22 bp, Artificial Sequence
  chemically synthesized
ggttcatggctgaggcacctat

SEQ ID NO: 776371 - DNA, 22 bp, Artificial Sequence
  chemically synthesized
gtccttcattataggtgcctca

SEQ ID NO: 776372 - DNA, 22 bp, Artificial Sequence
  chemically synthesized
tccttcattataggtgcctcag

SEQ ID NO: 776373 - DNA, 22 bp, Artificial Sequence
  chemically synthesized
cattataggtgcctcagccatg

SEQ ID NO: 776374 - DNA, 22 bp, Artificial Sequence
  chemically synthesized
attataggtgcctcagccatga

SEQ ID NO: 776375 - DNA, 22 bp, Artificial Sequence
  chemically synthesized
acccatcgctaggttcatggct

SEQ ID NO: 776376 - DNA, 22 bp, Artificial Sequence
  chemically synthesized
taggtgcctcagccatgaacct

SEQ ID NO: 776377 - DNA, 22 bp, Artificial Sequence
  chemically synthesized
tcacccatcgctaggttcatgg

SEQ ID NO: 776378 - DNA, 22 bp, Artificial Sequence
  chemically synthesized
ctcacccatcgctaggttcatg

SEQ ID NO: 776379 - DNA, 22 bp, Artificial Sequence
  chemically synthesized
tctcacccatcgctaggttcat

SEQ ID NO: 776380 - DNA, 22 bp, Artificial Sequence
  chemically synthesized
ttctcacccatcgctaggttca

SEQ ID NO: 776381 - DNA, 22 bp, Artificial Sequence
  chemically synthesized
ttttctcacccatcgctaggtt

SEQ ID NO: 776382 - DNA, 22 bp, Artificial Sequence
  chemically synthesized
agccatgaacctagcgatgggt

SEQ ID NO: 776383 - DNA, 22 bp, Artificial Sequence
  chemically synthesized
gcgatgggtgagaaaagagatc

SEQ ID NO: 776384 - DNA, 22 bp, Artificial Sequence
  chemically synthesized
caggggagaaaagatctctttt

SEQ ID NO: 776385 - DNA, 22 bp, Artificial Sequence
  chemically synthesized
acaggggagaaaagatctcttt

SEQ ID NO: 776386 - DNA, 22 bp, Artificial Sequence
  chemically synthesized
ttacaggggagaaaagatctct

SEQ ID NO: 776387 - DNA, 22 bp, Artificial Sequence
  chemically synthesized
actcttacaggggagaaaagat

SEQ ID NO: 776388 - DNA, 22 bp, Artificial Sequence
  chemically synthesized
gactcttacaggggagaaaaga

SEQ ID NO: 776389 - DNA, 22 bp, Artificial Sequence
  chemically synthesized
cttgactcttacaggggagaaa

SEQ ID NO: 776390 - DNA, 22 bp, Artificial Sequence
  chemically synthesized
gaatctacttgactcttacagg

SEQ ID NO: 776391 - DNA, 22 bp, Artificial Sequence
  chemically synthesized
agaatctacttgactcttacag

SEQ ID NO: 776392 - DNA, 22 bp, Artificial Sequence
  chemically synthesized
tagaatctacttgactcttaca

SEQ ID NO: 776393 - DNA, 22 bp, Artificial Sequence
  chemically synthesized
ttctcccctgtaagagtcaagt

SEQ ID NO: 776394 - DNA, 22 bp, Artificial Sequence
  chemically synthesized
tctcccctgtaagagtcaagta

SEQ ID NO: 776395 - DNA, 22 bp, Artificial Sequence
  chemically synthesized
ctcccctgtaagagtcaagtag

SEQ ID NO: 776396 - DNA, 22 bp, Artificial Sequence
  chemically synthesized
gaattttagaatctacttgact

SEQ ID NO: 776397 - DNA, 22 bp, Artificial Sequence
  chemically synthesized
tcccctgtaagagtcaagtaga

SEQ ID NO: 776398 - DNA, 22 bp, Artificial Sequence
  chemically synthesized
agaattttagaatctacttgac

SEQ ID NO: 776399 - DNA, 22 bp, Artificial Sequence
  chemically synthesized
ccctgtaagagtcaagtagatt

SEQ ID NO: 776400 - DNA, 22 bp, Artificial Sequence
  chemically synthesized
tttagaattttagaatctactt

SEQ ID NO: 776401 - DNA, 22 bp, Artificial Sequence
  chemically synthesized
gtttagaattttagaatctact

SEQ ID NO: 776402 - DNA, 22 bp, Artificial Sequence
  chemically synthesized
taagagtcaagtagattctaaa

SEQ ID NO: 776403 - DNA, 22 bp, Artificial Sequence
  chemically synthesized
cttgtttagaattttagaatct

SEQ ID NO: 776404 - DNA, 22 bp, Artificial Sequence
  chemically synthesized
agaacccgaaacctgcttgttt

SEQ ID NO: 776405 - DNA, 22 bp, Artificial Sequence
  chemically synthesized
tgagaacccgaaacctgcttgt

SEQ ID NO: 776406 - DNA, 22 bp, Artificial Sequence
  chemically synthesized
taaaattctaaacaagcaggtt

SEQ ID NO: 776407 - DNA, 22 bp, Artificial Sequence
  chemically synthesized
ctgagaacccgaaacctgcttg

SEQ ID NO: 776408 - DNA, 22 bp, Artificial Sequence
  chemically synthesized
tctgagaacccgaaacctgctt

SEQ ID NO: 776409 - DNA, 22 bp, Artificial Sequence
  chemically synthesized
aaattctaaacaagcaggtttc

SEQ ID NO: 776410 - DNA, 22 bp, Artificial Sequence
  chemically synthesized
ttttctgagaacccgaaacctg

SEQ ID NO: 776411 - DNA, 22 bp, Artificial Sequence
  chemically synthesized
taaacaagcaggtttcgggttc

SEQ ID NO: 776412 - DNA, 22 bp, Artificial Sequence
  chemically synthesized
aacaagcaggtttcgggttctc

SEQ ID NO: 776413 - DNA, 22 bp, Artificial Sequence
  chemically synthesized
tcaaccccctgttttctgagaa

SEQ ID NO: 776414 - DNA, 22 bp, Artificial Sequence
  chemically synthesized
gtcaaccccctgttttctgaga

SEQ ID NO: 776415 - DNA, 22 bp, Artificial Sequence
  chemically synthesized
ttgtcaaccccctgttttctga

SEQ ID NO: 776416 - DNA, 22 bp, Artificial Sequence
  chemically synthesized
cgggttctcagaaaacaggggg

SEQ ID NO: 776417 - DNA, 22 bp, Artificial Sequence
  chemically synthesized
gggttctcagaaaacagggggt

SEQ ID NO: 776418 - DNA, 22 bp, Artificial Sequence
  chemically synthesized
tcagaaaacagggggttgacaa

SEQ ID NO: 776419 - DNA, 22 bp, Artificial Sequence
  chemically synthesized
agaaaacagggggttgacaaga

SEQ ID NO: 776420 - DNA, 22 bp, Artificial Sequence
  chemically synthesized
tgtcagaaccattcttgtcaac

SEQ ID NO: 776421 - DNA, 22 bp, Artificial Sequence
  chemically synthesized
ggctatgtcagaaccattcttg

SEQ ID NO: 776422 - DNA, 22 bp, Artificial Sequence
  chemically synthesized
gggctatgtcagaaccattctt

SEQ ID NO: 776423 - DNA, 22 bp, Artificial Sequence
  chemically synthesized
acagtttgggctatgtcagaac

SEQ ID NO: 776424 - DNA, 22 bp, Artificial Sequence
  chemically synthesized
cacagtttgggctatgtcagaa

SEQ ID NO: 776425 - DNA, 22 bp, Artificial Sequence
  chemically synthesized
tcacagtttgggctatgtcaga

SEQ ID NO: 776426 - DNA, 22 bp, Artificial Sequence
  chemically synthesized
acaagaatggttctgacatagc

SEQ ID NO: 776427 - DNA, 22 bp, Artificial Sequence
  chemically synthesized
agttttcacagtttgggctatg

SEQ ID NO: 776428 - DNA, 22 bp, Artificial Sequence
  chemically synthesized
tgacatagcccaaactgtgaaa

SEQ ID NO: 776429 - DNA, 22 bp, Artificial Sequence
  chemically synthesized
acatagcccaaactgtgaaaac

SEQ ID NO: 776430 - DNA, 22 bp, Artificial Sequence
  chemically synthesized
gaatcataattcagttttcaca

SEQ ID NO: 776431 - DNA, 22 bp, Artificial Sequence
  chemically synthesized
ggaatcataattcagttttcac

SEQ ID NO: 776432 - DNA, 22 bp, Artificial Sequence
  chemically synthesized
ccttggaatcataattcagttt

SEQ ID NO: 776433 - DNA, 22 bp, Artificial Sequence
  chemically synthesized
ttgccttggaatcataattcag

SEQ ID NO: 776434 - DNA, 22 bp, Artificial Sequence
  chemically synthesized
tgaaaactgaattatgattcca

SEQ ID NO: 776435 - DNA, 22 bp, Artificial Sequence
  chemically synthesized
aatgctattgccttggaatcat

SEQ ID NO: 776436 - DNA, 22 bp, Artificial Sequence
  chemically synthesized
aattatgattccaaggcaatag

SEQ ID NO: 776437 - DNA, 22 bp, Artificial Sequence
  chemically synthesized
tgattccaaggcaatagcattt

SEQ ID NO: 776438 - DNA, 22 bp, Artificial Sequence
  chemically synthesized
aacaagcatgagtattaaatgc

SEQ ID NO: 776439 - DNA, 22 bp, Artificial Sequence
  chemically synthesized
caaggcaatagcatttaatact

SEQ ID NO: 776440 - DNA, 22 bp, Artificial Sequence
  chemically synthesized
ttcaacaagcatgagtattaaa

SEQ ID NO: 776441 - DNA, 22 bp, Artificial Sequence
  chemically synthesized
cctattcaacaagcatgagtat

SEQ ID NO: 776442 - DNA, 22 bp, Artificial Sequence
  chemically synthesized
gcctattcaacaagcatgagta

SEQ ID NO: 776443 - DNA, 22 bp, Artificial Sequence
  chemically synthesized
gaagcccttgcctattcaacaa

SEQ ID NO: 776444 - DNA, 22 bp, Artificial Sequence
  chemically synthesized
aatactcatgcttgttgaatag

SEQ ID NO: 776445 - DNA, 22 bp, Artificial Sequence
  chemically synthesized
atactcatgcttgttgaatagg

SEQ ID NO: 776446 - DNA, 22 bp, Artificial Sequence
  chemically synthesized
tggaagcccttgcctattcaac

SEQ ID NO: 776447 - DNA, 22 bp, Artificial Sequence
  chemically synthesized
ctggaagcccttgcctattcaa

SEQ ID NO: 776448 - DNA, 22 bp, Artificial Sequence
  chemically synthesized
cttctggaagcccttgcctatt

SEQ ID NO: 776449 - DNA, 22 bp, Artificial Sequence
  chemically synthesized
ccttctggaagcccttgcctat

SEQ ID NO: 776450 - DNA, 22 bp, Artificial Sequence
  chemically synthesized
atgcttgttgaataggcaaggg

SEQ ID NO: 776451 - DNA, 22 bp, Artificial Sequence
  chemically synthesized
atcttccttctggaagcccttg

SEQ ID NO: 776452 - DNA, 22 bp, Artificial Sequence
  chemically synthesized
gttgaataggcaagggcttcca

SEQ ID NO: 776453 - DNA, 22 bp, Artificial Sequence
  chemically synthesized
tgatcttccttctggaagccct

SEQ ID NO: 776454 - DNA, 22 bp, Artificial Sequence
  chemically synthesized
ttgaataggcaagggcttccag

SEQ ID NO: 776455 - DNA, 22 bp, Artificial Sequence
  chemically synthesized
aataggcaagggcttccagaag

SEQ ID NO: 776456 - DNA, 22 bp, Artificial Sequence
  chemically synthesized
ccagaaggaagatcagagcctg

SEQ ID NO: 776457 - DNA, 22 bp, Artificial Sequence
  chemically synthesized
cagaaggaagatcagagcctgg

SEQ ID NO: 776458 - DNA, 22 bp, Artificial Sequence
  chemically synthesized
cagagatgaaaagaccaggctc

SEQ ID NO: 776459 - DNA, 22 bp, Artificial Sequence
  chemically synthesized
ccagagatgaaaagaccaggct

SEQ ID NO: 776460 - DNA, 22 bp, Artificial Sequence
  chemically synthesized
ggtttccagagatgaaaagacc

SEQ ID NO: 776461 - DNA, 22 bp, Artificial Sequence
  chemically synthesized
gtcttttcatctctggaaacct

SEQ ID NO: 776462 - DNA, 22 bp, Artificial Sequence
  chemically synthesized
agagtaaaccacatctaggttt

SEQ ID NO: 776463 - DNA, 22 bp, Artificial Sequence
  chemically synthesized
ttcatctctggaaacctagatg

SEQ ID NO: 776464 - DNA, 22 bp, Artificial Sequence
  chemically synthesized
tcatctctggaaacctagatgt

SEQ ID NO: 776465 - DNA, 22 bp, Artificial Sequence
  chemically synthesized
taagagtaaaccacatctaggt

SEQ ID NO: 776466 - DNA, 22 bp, Artificial Sequence
  chemically synthesized
catctctggaaacctagatgtg

SEQ ID NO: 776467 - DNA, 22 bp, Artificial Sequence
  chemically synthesized
atctctggaaacctagatgtgg

SEQ ID NO: 776468 - DNA, 22 bp, Artificial Sequence
  chemically synthesized
attctaagagtaaaccacatct

SEQ ID NO: 776469 - DNA, 22 bp, Artificial Sequence
  chemically synthesized
cattctaagagtaaaccacatc

SEQ ID NO: 776470 - DNA, 22 bp, Artificial Sequence
  chemically synthesized
tcattctaagagtaaaccacat

SEQ ID NO: 776471 - DNA, 22 bp, Artificial Sequence
  chemically synthesized
tggaaacctagatgtggtttac

SEQ ID NO: 776472 - DNA, 22 bp, Artificial Sequence
  chemically synthesized
ttcattctaagagtaaaccaca

SEQ ID NO: 776473 - DNA, 22 bp, Artificial Sequence
  chemically synthesized
tttcattctaagagtaaaccac

SEQ ID NO: 776474 - DNA, 22 bp, Artificial Sequence
  chemically synthesized
gaaacctagatgtggtttactc

SEQ ID NO: 776475 - DNA, 22 bp, Artificial Sequence
  chemically synthesized
gccctttttcattctaagagta

SEQ ID NO: 776476 - DNA, 22 bp, Artificial Sequence
  chemically synthesized
agccctttttcattctaagagt

SEQ ID NO: 776477 - DNA, 22 bp, Artificial Sequence
  chemically synthesized
gatgtggtttactcttagaatg

SEQ ID NO: 776478 - DNA, 22 bp, Artificial Sequence
  chemically synthesized
actcttagaatgaaaaagggct

SEQ ID NO: 776479 - DNA, 22 bp, Artificial Sequence
  chemically synthesized
ctcttagaatgaaaaagggcta

SEQ ID NO: 776480 - DNA, 22 bp, Artificial Sequence
  chemically synthesized
ttagaatgaaaaagggctaagt

SEQ ID NO: 776481 - DNA, 22 bp, Artificial Sequence
  chemically synthesized
gagccccaggaagacttagccc

SEQ ID NO: 776482 - DNA, 22 bp, Artificial Sequence
  chemically synthesized
agaatgaaaaagggctaagtct

SEQ ID NO: 776483 - DNA, 22 bp, Artificial Sequence
  chemically synthesized
agagccccaggaagacttagcc

SEQ ID NO: 776484 - DNA, 22 bp, Artificial Sequence
  chemically synthesized
gaatgaaaaagggctaagtctt

SEQ ID NO: 776485 - DNA, 22 bp, Artificial Sequence
  chemically synthesized
agtcttcctggggctctaagga

SEQ ID NO: 776486 - DNA, 22 bp, Artificial Sequence
  chemically synthesized
aacacagggagagtccttagag

SEQ ID NO: 776487 - DNA, 22 bp, Artificial Sequence
  chemically synthesized
ttcaacacagggagagtcctta

SEQ ID NO: 776488 - DNA, 22 bp, Artificial Sequence
  chemically synthesized
cctggggctctaaggactctcc

SEQ ID NO: 776489 - DNA, 22 bp, Artificial Sequence
  chemically synthesized
tattcaacacagggagagtcct

SEQ ID NO: 776490 - DNA, 22 bp, Artificial Sequence
  chemically synthesized
ctggggctctaaggactctccc

SEQ ID NO: 776491 - DNA, 22 bp, Artificial Sequence
  chemically synthesized
ctattcaacacagggagagtcc

SEQ ID NO: 776492 - DNA, 22 bp, Artificial Sequence
  chemically synthesized
tctattcaacacagggagagtc

SEQ ID NO: 776493 - DNA, 22 bp, Artificial Sequence
  chemically synthesized
ttctattcaacacagggagagt

SEQ ID NO: 776494 - DNA, 22 bp, Artificial Sequence
  chemically synthesized
gggctctaaggactctccctgt

SEQ ID NO: 776495 - DNA, 22 bp, Artificial Sequence
  chemically synthesized
tttctattcaacacagggagag

SEQ ID NO: 776496 - DNA, 22 bp, Artificial Sequence
  chemically synthesized
taaggactctccctgtgttgaa

SEQ ID NO: 776497 - DNA, 22 bp, Artificial Sequence
  chemically synthesized
tccctttttctattcaacacag

SEQ ID NO: 776498 - DNA, 22 bp, Artificial Sequence
  chemically synthesized
atccctttttctattcaacaca

SEQ ID NO: 776499 - DNA, 22 bp, Artificial Sequence
  chemically synthesized
aggactctccctgtgttgaata

SEQ ID NO: 776500 - DNA, 22 bp, Artificial Sequence
  chemically synthesized
aaggtttatccctttttctatt

SEQ ID NO: 776501 - DNA, 22 bp, Artificial Sequence
  chemically synthesized
tccctgtgttgaatagaaaaag

SEQ ID NO: 776502 - DNA, 22 bp, Artificial Sequence
  chemically synthesized
cctgtgttgaatagaaaaaggg

SEQ ID NO: 776503 - DNA, 22 bp, Artificial Sequence
  chemically synthesized
tgttgaatagaaaaagggataa

SEQ ID NO: 776504 - DNA, 22 bp, Artificial Sequence
  chemically synthesized
aatagaaaaagggataaacctt

SEQ ID NO: 776505 - DNA, 22 bp, Artificial Sequence
  chemically synthesized
caaacccagttgaaggtttatc

SEQ ID NO: 776506 - DNA, 22 bp, Artificial Sequence
  chemically synthesized
acaaacccagttgaaggtttat

SEQ ID NO: 776507 - DNA, 22 bp, Artificial Sequence
  chemically synthesized
tacaaacccagttgaaggttta

SEQ ID NO: 776508 - DNA, 22 bp, Artificial Sequence
  chemically synthesized
catggaacaacgatattttaca

SEQ ID NO: 776509 - DNA, 22 bp, Artificial Sequence
  chemically synthesized
caactgggtttgtaaaatatcg

SEQ ID NO: 776510 - DNA, 22 bp, Artificial Sequence
  chemically synthesized
aactgggtttgtaaaatatcgt

SEQ ID NO: 776511 - DNA, 22 bp, Artificial Sequence
  chemically synthesized
attccatggaacaacgatattt

SEQ ID NO: 776512 - DNA, 22 bp, Artificial Sequence
  chemically synthesized
gattccatggaacaacgatatt

SEQ ID NO: 776513 - DNA, 22 bp, Artificial Sequence
  chemically synthesized
ggtttgtaaaatatcgttgttc

SEQ ID NO: 776514 - DNA, 22 bp, Artificial Sequence
  chemically synthesized
aatttgattccatggaacaacg

SEQ ID NO: 776515 - DNA, 22 bp, Artificial Sequence
  chemically synthesized
gaatttgattccatggaacaac

SEQ ID NO: 776516 - DNA, 22 bp, Artificial Sequence
  chemically synthesized
gtaaaatatcgttgttccatgg

SEQ ID NO: 776517 - DNA, 22 bp, Artificial Sequence
  chemically synthesized
taaaatatcgttgttccatgga

SEQ ID NO: 776518 - DNA, 22 bp, Artificial Sequence
  chemically synthesized
gtcttgaatttgattccatgga

SEQ ID NO: 776519 - DNA, 22 bp, Artificial Sequence
  chemically synthesized
ggtcttgaatttgattccatgg

SEQ ID NO: 776520 - DNA, 22 bp, Artificial Sequence
  chemically synthesized
accttggtcttgaatttgattc

SEQ ID NO: 776521 - DNA, 22 bp, Artificial Sequence
  chemically synthesized
gaccttggtcttgaatttgatt

SEQ ID NO: 776522 - DNA, 22 bp, Artificial Sequence
  chemically synthesized
tgaccttggtcttgaatttgat

SEQ ID NO: 776523 - DNA, 22 bp, Artificial Sequence
  chemically synthesized
ttgaccttggtcttgaatttga

SEQ ID NO: 776524 - DNA, 22 bp, Artificial Sequence
  chemically synthesized
ttccatggaatcaaattcaaga

SEQ ID NO: 776525 - DNA, 22 bp, Artificial Sequence
  chemically synthesized
catggaatcaaattcaagacca

SEQ ID NO: 776526 - DNA, 22 bp, Artificial Sequence
  chemically synthesized
aagaccaaggtcaaaagtgatg

SEQ ID NO: 776527 - DNA, 22 bp, Artificial Sequence
  chemically synthesized
ggtagggtcagagaaagcaaga

SEQ ID NO: 776528 - DNA, 22 bp, Artificial Sequence
  chemically synthesized
atcctgggtagggtcagagaaa

SEQ ID NO: 776529 - DNA, 22 bp, Artificial Sequence
  chemically synthesized
tgatcctgggtagggtcagaga

SEQ ID NO: 776530 - DNA, 22 bp, Artificial Sequence
  chemically synthesized
gttctgatcctgggtagggtca

SEQ ID NO: 776531 - DNA, 22 bp, Artificial Sequence
  chemically synthesized
tggttctgatcctgggtagggt

SEQ ID NO: 776532 - DNA, 22 bp, Artificial Sequence
  chemically synthesized
gctttctctgaccctacccagg

SEQ ID NO: 776533 - DNA, 22 bp, Artificial Sequence
  chemically synthesized
ctttctctgaccctacccagga

SEQ ID NO: 776534 - DNA, 22 bp, Artificial Sequence
  chemically synthesized
tctctgaccctacccaggatca

SEQ ID NO: 776535 - DNA, 22 bp, Artificial Sequence
  chemically synthesized
ctctgaccctacccaggatcag

SEQ ID NO: 776536 - DNA, 22 bp, Artificial Sequence
  chemically synthesized
aaggctctggttctgatcctgg

SEQ ID NO: 776537 - DNA, 22 bp, Artificial Sequence
  chemically synthesized
tctgaccctacccaggatcaga

SEQ ID NO: 776538 - DNA, 22 bp, Artificial Sequence
  chemically synthesized
tgaccctacccaggatcagaac

SEQ ID NO: 776539 - DNA, 22 bp, Artificial Sequence
  chemically synthesized
accctacccaggatcagaacca

SEQ ID NO: 776540 - DNA, 22 bp, Artificial Sequence
  chemically synthesized
ccagctgaaggctctggttctg

SEQ ID NO: 776541 - DNA, 22 bp, Artificial Sequence
  chemically synthesized
cccaggatcagaaccagagcct

SEQ ID NO: 776542 - DNA, 22 bp, Artificial Sequence
  chemically synthesized
agcagcagaaggaatgggctgc

SEQ ID NO: 776543 - DNA, 22 bp, Artificial Sequence
  chemically synthesized
cagcagcagaaggaatgggctg

SEQ ID NO: 776544 - DNA, 22 bp, Artificial Sequence
  chemically synthesized
gtttcagcagcagaaggaatgg

SEQ ID NO: 776545 - DNA, 22 bp, Artificial Sequence
  chemically synthesized
cagctggcagcccattccttct

SEQ ID NO: 776546 - DNA, 22 bp, Artificial Sequence
  chemically synthesized
agctggcagcccattccttctg

SEQ ID NO: 776547 - DNA, 22 bp, Artificial Sequence
  chemically synthesized
gcagcccattccttctgctgct

SEQ ID NO: 776548 - DNA, 22 bp, Artificial Sequence
  chemically synthesized
gtgaggattggtttcagcagca

SEQ ID NO: 776549 - DNA, 22 bp, Artificial Sequence
  chemically synthesized
gctggtgaggattggtttcagc

SEQ ID NO: 776550 - DNA, 22 bp, Artificial Sequence
  chemically synthesized
cttctgctgctgaaaccaatcc

SEQ ID NO: 776551 - DNA, 22 bp, Artificial Sequence
  chemically synthesized
cctggctggtgaggattggttt

SEQ ID NO: 776552 - DNA, 22 bp, Artificial Sequence
  chemically synthesized
ctgctgctgaaaccaatcctca

SEQ ID NO: 776553 - DNA, 22 bp, Artificial Sequence
  chemically synthesized
tgctgctgaaaccaatcctcac

SEQ ID NO: 776554 - DNA, 22 bp, Artificial Sequence
  chemically synthesized
aattgcctggctggtgaggatt

SEQ ID NO: 776555 - DNA, 22 bp, Artificial Sequence
  chemically synthesized
ctgctgaaaccaatcctcacca

SEQ ID NO: 776556 - DNA, 22 bp, Artificial Sequence
  chemically synthesized
ctgaattgcctggctggtgagg

SEQ ID NO: 776557 - DNA, 22 bp, Artificial Sequence
  chemically synthesized
ctgaaaccaatcctcaccagcc

SEQ ID NO: 776558 - DNA, 22 bp, Artificial Sequence
  chemically synthesized
tgctgaattgcctggctggtga

SEQ ID NO: 776559 - DNA, 22 bp, Artificial Sequence
  chemically synthesized
ctgctgaattgcctggctggtg

SEQ ID NO: 776560 - DNA, 22 bp, Artificial Sequence
  chemically synthesized
aaaccaatcctcaccagccagg

SEQ ID NO: 776561 - DNA, 22 bp, Artificial Sequence
  chemically synthesized
agtgagcttctgctgaattgcc

SEQ ID NO: 776562 - DNA, 22 bp, Artificial Sequence
  chemically synthesized
accagccaggcaattcagcaga

SEQ ID NO: 776563 - DNA, 22 bp, Artificial Sequence
  chemically synthesized
tccctgagtgagcttctgctga

SEQ ID NO: 776564 - DNA, 22 bp, Artificial Sequence
  chemically synthesized
catgctgtccctgagtgagctt

SEQ ID NO: 776565 - DNA, 22 bp, Artificial Sequence
  chemically synthesized
ccatgctgtccctgagtgagct

SEQ ID NO: 776566 - DNA, 22 bp, Artificial Sequence
  chemically synthesized
ttccatgctgtccctgagtgag

SEQ ID NO: 776567 - DNA, 22 bp, Artificial Sequence
  chemically synthesized
agcagaagctcactcagggaca

SEQ ID NO: 776568 - DNA, 22 bp, Artificial Sequence
  chemically synthesized
acgcctcttccatgctgtccct

SEQ ID NO: 776569 - DNA, 22 bp, Artificial Sequence
  chemically synthesized
atctcacgcctcttccatgctg

SEQ ID NO: 776570 - DNA, 22 bp, Artificial Sequence
  chemically synthesized
actcagggacagcatggaagag

SEQ ID NO: 776571 - DNA, 22 bp, Artificial Sequence
  chemically synthesized
agggacagcatggaagaggcgt

SEQ ID NO: 776572 - DNA, 22 bp, Artificial Sequence
  chemically synthesized
acagaatggcagcagcgatatt

SEQ ID NO: 776573 - DNA, 22 bp, Artificial Sequence
  chemically synthesized
acaccggttaacagaatggcag

SEQ ID NO: 776574 - DNA, 22 bp, Artificial Sequence
  chemically synthesized
gagctcacaccggttaacagaa

SEQ ID NO: 776575 - DNA, 22 bp, Artificial Sequence
  chemically synthesized
ctgccattctgttaaccggtgt

SEQ ID NO: 776576 - DNA, 22 bp, Artificial Sequence
  chemically synthesized
ccattctgttaaccggtgtgag

SEQ ID NO: 776577 - DNA, 22 bp, Artificial Sequence
  chemically synthesized
tgttaaccggtgtgagctctag

SEQ ID NO: 776578 - DNA, 22 bp, Artificial Sequence
  chemically synthesized
ttaaccggtgtgagctctagac

SEQ ID NO: 776579 - DNA, 22 bp, Artificial Sequence
  chemically synthesized
accggtgtgagctctagacttc

SEQ ID NO: 776580 - DNA, 22 bp, Artificial Sequence
  chemically synthesized
tagacttcatcatgattactat

SEQ ID NO: 776581 - DNA, 22 bp, Artificial Sequence
  chemically synthesized
gacttcatcatgattactatat

SEQ ID NO: 776582 - DNA, 22 bp, Artificial Sequence
  chemically synthesized
catcatgattactatatttcct

SEQ ID NO: 776583 - DNA, 22 bp, Artificial Sequence
  chemically synthesized
atcatgattactatatttcctt

SEQ ID NO: 776584 - DNA, 22 bp, Artificial Sequence
  chemically synthesized
ctatatttccttctgccttctg

SEQ ID NO: 776585 - DNA, 22 bp, Artificial Sequence
  chemically synthesized
tatttccttctgccttctggga

SEQ ID NO: 776586 - DNA, 22 bp, Artificial Sequence
  chemically synthesized
ccttctgccttctgggattcct

SEQ ID NO: 776587 - DNA, 22 bp, Artificial Sequence
  chemically synthesized
cttctgccttctgggattcctt

SEQ ID NO: 776588 - DNA, 22 bp, Artificial Sequence
  chemically synthesized
aaacaagtgtcagaaggaatcc

SEQ ID NO: 776589 - DNA, 22 bp, Artificial Sequence
  chemically synthesized
ctgccttctgggattccttctg

SEQ ID NO: 776590 - DNA, 22 bp, Artificial Sequence
  chemically synthesized
tgccttctgggattccttctga

SEQ ID NO: 776591 - DNA, 22 bp, Artificial Sequence
  chemically synthesized
ccttctgggattccttctgaca

SEQ ID NO: 776592 - DNA, 22 bp, Artificial Sequence
  chemically synthesized
aactgaaacaagtgtcagaagg

SEQ ID NO: 776593 - DNA, 22 bp, Artificial Sequence
  chemically synthesized
aaactgaaacaagtgtcagaag

SEQ ID NO: 776594 - DNA, 22 bp, Artificial Sequence
  chemically synthesized
ttaaactgaaacaagtgtcaga

SEQ ID NO: 776595 - DNA, 22 bp, Artificial Sequence
  chemically synthesized
ctgggattccttctgacacttg

SEQ ID NO: 776596 - DNA, 22 bp, Artificial Sequence
  chemically synthesized
tgggattccttctgacacttgt

SEQ ID NO: 776597 - DNA, 22 bp, Artificial Sequence
  chemically synthesized
ggattccttctgacacttgttt

SEQ ID NO: 776598 - DNA, 22 bp, Artificial Sequence
  chemically synthesized
cttctgacacttgtttcagttt

SEQ ID NO: 776599 - DNA, 22 bp, Artificial Sequence
  chemically synthesized
ctgacacttgtttcagtttaag

SEQ ID NO: 776600 - DNA, 22 bp, Artificial Sequence
  chemically synthesized
tgacacttgtttcagtttaaga

SEQ ID NO: 776601 - DNA, 22 bp, Artificial Sequence
  chemically synthesized
acacttgtttcagtttaagaac

SEQ ID NO: 776602 - DNA, 22 bp, Artificial Sequence
  chemically synthesized
agaaagaaacatggttcttaaa

SEQ ID NO: 776603 - DNA, 22 bp, Artificial Sequence
  chemically synthesized
gagaaagaaacatggttcttaa

SEQ ID NO: 776604 - DNA, 22 bp, Artificial Sequence
  chemically synthesized
gtttcagtttaagaaccatgtt

SEQ ID NO: 776605 - DNA, 22 bp, Artificial Sequence
  chemically synthesized
tttcagtttaagaaccatgttt

SEQ ID NO: 776606 - DNA, 22 bp, Artificial Sequence
  chemically synthesized
cagtttaagaaccatgtttctt

SEQ ID NO: 776607 - DNA, 22 bp, Artificial Sequence
  chemically synthesized
agtttaagaaccatgtttcttt

SEQ ID NO: 776608 - DNA, 22 bp, Artificial Sequence
  chemically synthesized
aagaaccatgtttctttctcaa

SEQ ID NO: 776609 - DNA, 22 bp, Artificial Sequence
  chemically synthesized
agaaccatgtttctttctcaaa

SEQ ID NO: 776610 - DNA, 22 bp, Artificial Sequence
  chemically synthesized
ctttctcaaatcattttcctta

SEQ ID NO: 776611 - DNA, 22 bp, Artificial Sequence
  chemically synthesized
tttctcaaatcattttccttat

SEQ ID NO: 776612 - DNA, 22 bp, Artificial Sequence
  chemically synthesized
tgaagaaacagcataaggaaaa

SEQ ID NO: 776613 - DNA, 22 bp, Artificial Sequence
  chemically synthesized
tctcaaatcattttccttatgc

SEQ ID NO: 776614 - DNA, 22 bp, Artificial Sequence
  chemically synthesized
ctcaaatcattttccttatgct

SEQ ID NO: 776615 - DNA, 22 bp, Artificial Sequence
  chemically synthesized
ctgtgaagaaacagcataagga

SEQ ID NO: 776616 - DNA, 22 bp, Artificial Sequence
  chemically synthesized
tcaaatcattttccttatgctg

SEQ ID NO: 776617 - DNA, 22 bp, Artificial Sequence
  chemically synthesized
aaatcattttccttatgctgtt

SEQ ID NO: 776618 - DNA, 22 bp, Artificial Sequence
  chemically synthesized
tccttatgctgtttcttcacag

SEQ ID NO: 776619 - DNA, 22 bp, Artificial Sequence
  chemically synthesized
ccttatgctgtttcttcacagg

SEQ ID NO: 776620 - DNA, 22 bp, Artificial Sequence
  chemically synthesized
cttatgctgtttcttcacagga

SEQ ID NO: 776621 - DNA, 22 bp, Artificial Sequence
  chemically synthesized
atgctgtttcttcacaggaatg

SEQ ID NO: 776622 - DNA, 22 bp, Artificial Sequence
  chemically synthesized
tgctgtttcttcacaggaatga

SEQ ID NO: 776623 - DNA, 22 bp, Artificial Sequence
  chemically synthesized
tgatgagaaaagtgtatcattc

SEQ ID NO: 776624 - DNA, 22 bp, Artificial Sequence
  chemically synthesized
tttcttcacaggaatgatacac

SEQ ID NO: 776625 - DNA, 22 bp, Artificial Sequence
  chemically synthesized
cttcacaggaatgatacacttt

SEQ ID NO: 776626 - DNA, 22 bp, Artificial Sequence
  chemically synthesized
ttcacaggaatgatacactttt

SEQ ID NO: 776627 - DNA, 22 bp, Artificial Sequence
  chemically synthesized
cacaggaatgatacacttttct

SEQ ID NO: 776628 - DNA, 22 bp, Artificial Sequence
  chemically synthesized
acaggaatgatacacttttctc

SEQ ID NO: 776629 - DNA, 22 bp, Artificial Sequence
  chemically synthesized
aaaaattatgatgagaaaagtg

SEQ ID NO: 776630 - DNA, 22 bp, Artificial Sequence
  chemically synthesized
caaaaattatgatgagaaaagt

SEQ ID NO: 776631 - DNA, 22 bp, Artificial Sequence
  chemically synthesized
tcaaaaattatgatgagaaaag

SEQ ID NO: 776632 - DNA, 22 bp, Artificial Sequence
  chemically synthesized
caacatattttcaaaaattatg

SEQ ID NO: 776633 - DNA, 22 bp, Artificial Sequence
  chemically synthesized
gcaacatattttcaaaaattat

SEQ ID NO: 776634 - DNA, 22 bp, Artificial Sequence
  chemically synthesized
tgcaacatattttcaaaaatta

SEQ ID NO: 776635 - DNA, 22 bp, Artificial Sequence
  chemically synthesized
ttgcaacatattttcaaaaatt

SEQ ID NO: 776636 - DNA, 22 bp, Artificial Sequence
  chemically synthesized
tttgcaacatattttcaaaaat

SEQ ID NO: 776637 - DNA, 22 bp, Artificial Sequence
  chemically synthesized
ttctcatcataatttttgaaaa

SEQ ID NO: 776638 - DNA, 22 bp, Artificial Sequence
  chemically synthesized
ttttgcaacatattttcaaaaa

SEQ ID NO: 776639 - DNA, 22 bp, Artificial Sequence
  chemically synthesized
tctcatcataatttttgaaaat

SEQ ID NO: 776640 - DNA, 22 bp, Artificial Sequence
  chemically synthesized
ctcatcataatttttgaaaata

SEQ ID NO: 776641 - DNA, 22 bp, Artificial Sequence
  chemically synthesized
tcatcataatttttgaaaatat

SEQ ID NO: 776642 - DNA, 22 bp, Artificial Sequence
  chemically synthesized
atcataatttttgaaaatatgt

SEQ ID NO: 776643 - DNA, 22 bp, Artificial Sequence
  chemically synthesized
ttgaaaatatgttgcaaaaaaa

SEQ ID NO: 776644 - DNA, 22 bp, Artificial Sequence
  chemically synthesized
tgaaaatatgttgcaaaaaaat

SEQ ID NO: 776645 - DNA, 22 bp, Artificial Sequence
  chemically synthesized
gaaaatatgttgcaaaaaaata

SEQ ID NO: 776646 - DNA, 22 bp, Artificial Sequence
  chemically synthesized
aaaatatgttgcaaaaaaatac

SEQ ID NO: 776647 - DNA, 22 bp, Artificial Sequence
  chemically synthesized
cagatagcacacagtatttttt

SEQ ID NO: 776648 - DNA, 22 bp, Artificial Sequence
  chemically synthesized
caaaaaaatactgtgtgctatc

SEQ ID NO: 776649 - DNA, 22 bp, Artificial Sequence
  chemically synthesized
tgtgctatctgcagtgattatt

SEQ ID NO: 776650 - DNA, 22 bp, Artificial Sequence
  chemically synthesized
aggcaaaggaaagaataatcac

SEQ ID NO: 776651 - DNA, 22 bp, Artificial Sequence
  chemically synthesized
aaggcaaaggaaagaataatca

SEQ ID NO: 776652 - DNA, 22 bp, Artificial Sequence
  chemically synthesized
taaggcaaaggaaagaataatc

SEQ ID NO: 776653 - DNA, 22 bp, Artificial Sequence
  chemically synthesized
ttaaggcaaaggaaagaataat

SEQ ID NO: 776654 - DNA, 22 bp, Artificial Sequence
  chemically synthesized
tttaaggcaaaggaaagaataa

SEQ ID NO: 776655 - DNA, 22 bp, Artificial Sequence
  chemically synthesized
tctgcagtgattattctttcct

SEQ ID NO: 776656 - DNA, 22 bp, Artificial Sequence
  chemically synthesized
tttttaaggcaaaggaaagaat

SEQ ID NO: 776657 - DNA, 22 bp, Artificial Sequence
  chemically synthesized
ctttttaaggcaaaggaaagaa

SEQ ID NO: 776658 - DNA, 22 bp, Artificial Sequence
  chemically synthesized
tctttttaaggcaaaggaaaga

SEQ ID NO: 776659 - DNA, 22 bp, Artificial Sequence
  chemically synthesized
cagtgattattctttcctttgc

SEQ ID NO: 776660 - DNA, 22 bp, Artificial Sequence
  chemically synthesized
gaatactttctttttaaggcaa

SEQ ID NO: 776661 - DNA, 22 bp, Artificial Sequence
  chemically synthesized
ttctttcctttgccttaaaaag

SEQ ID NO: 776662 - DNA, 22 bp, Artificial Sequence
  chemically synthesized
cctagaatactttctttttaag

SEQ ID NO: 776663 - DNA, 22 bp, Artificial Sequence
  chemically synthesized
ccctagaatactttctttttaa

SEQ ID NO: 776664 - DNA, 22 bp, Artificial Sequence
  chemically synthesized
tttcctttgccttaaaaagaaa

SEQ ID NO: 776665 - DNA, 22 bp, Artificial Sequence
  chemically synthesized
tccctagaatactttcttttta

SEQ ID NO: 776666 - DNA, 22 bp, Artificial Sequence
  chemically synthesized
tcctttgccttaaaaagaaagt

SEQ ID NO: 776667 - DNA, 22 bp, Artificial Sequence
  chemically synthesized
cctttgccttaaaaagaaagta

SEQ ID NO: 776668 - DNA, 22 bp, Artificial Sequence
  chemically synthesized
ctttgccttaaaaagaaagtat

SEQ ID NO: 776669 - DNA, 22 bp, Artificial Sequence
  chemically synthesized
tgccttaaaaagaaagtattct

SEQ ID NO: 776670 - DNA, 22 bp, Artificial Sequence
  chemically synthesized
catcctttccctagaatacttt

SEQ ID NO: 776671 - DNA, 22 bp, Artificial Sequence
  chemically synthesized
gccttaaaaagaaagtattcta

SEQ ID NO: 776672 - DNA, 22 bp, Artificial Sequence
  chemically synthesized
ccatcctttccctagaatactt

SEQ ID NO: 776673 - DNA, 22 bp, Artificial Sequence
  chemically synthesized
ccttaaaaagaaagtattctag

SEQ ID NO: 776674 - DNA, 22 bp, Artificial Sequence
  chemically synthesized
tccatcctttccctagaatact

SEQ ID NO: 776675 - DNA, 22 bp, Artificial Sequence
  chemically synthesized
aaaaagaaagtattctagggaa

SEQ ID NO: 776676 - DNA, 22 bp, Artificial Sequence
  chemically synthesized
aaaagaaagtattctagggaaa

SEQ ID NO: 776677 - DNA, 22 bp, Artificial Sequence
  chemically synthesized
tggtgttttccatcctttccct

SEQ ID NO: 776678 - DNA, 22 bp, Artificial Sequence
  chemically synthesized
tgtggtgttttccatcctttcc

SEQ ID NO: 776679 - DNA, 22 bp, Artificial Sequence
  chemically synthesized
ctgtggtgttttccatcctttc

SEQ ID NO: 776680 - DNA, 22 bp, Artificial Sequence
  chemically synthesized
acaacttctgtggtgttttcca

SEQ ID NO: 776681 - DNA, 22 bp, Artificial Sequence
  chemically synthesized
tagggaaaggatggaaaacacc

SEQ ID NO: 776682 - DNA, 22 bp, Artificial Sequence
  chemically synthesized
tcacaacttctgtggtgttttc

SEQ ID NO: 776683 - DNA, 22 bp, Artificial Sequence
  chemically synthesized
gggaaaggatggaaaacaccac

SEQ ID NO: 776684 - DNA, 22 bp, Artificial Sequence
  chemically synthesized
gaaatcacaaatgcccattctc

SEQ ID NO: 776685 - DNA, 22 bp, Artificial Sequence
  chemically synthesized
ttagaaatcacaaatgcccatt

SEQ ID NO: 776686 - DNA, 22 bp, Artificial Sequence
  chemically synthesized
gttagaaatcacaaatgcccat

SEQ ID NO: 776687 - DNA, 22 bp, Artificial Sequence
  chemically synthesized
tgagaatgggcatttgtgattt

SEQ ID NO: 776688 - DNA, 22 bp, Artificial Sequence
  chemically synthesized
acaaatccttgttagaaatcac

SEQ ID NO: 776689 - DNA, 22 bp, Artificial Sequence
  chemically synthesized
gtgatttctaacaaggatttgt

SEQ ID NO: 776690 - DNA, 22 bp, Artificial Sequence
  chemically synthesized
tgatttctaacaaggatttgtc

SEQ ID NO: 776691 - DNA, 22 bp, Artificial Sequence
  chemically synthesized
ctaacaaggatttgtcagcctt

SEQ ID NO: 776692 - DNA, 22 bp, Artificial Sequence
  chemically synthesized
taacaaggatttgtcagccttt

SEQ ID NO: 776693 - DNA, 22 bp, Artificial Sequence
  chemically synthesized
acaaggatttgtcagcctttga

SEQ ID NO: 776694 - DNA, 22 bp, Artificial Sequence
  chemically synthesized
gtaaagtccagagcagtcaaag

SEQ ID NO: 776695 - DNA, 22 bp, Artificial Sequence
  chemically synthesized
gtcagcctttgactgctctgga

SEQ ID NO: 776696 - DNA, 22 bp, Artificial Sequence
  chemically synthesized
tggctggtaaagtccagagcag

SEQ ID NO: 776697 - DNA, 22 bp, Artificial Sequence
  chemically synthesized
tcagcctttgactgctctggac

SEQ ID NO: 776698 - DNA, 22 bp, Artificial Sequence
  chemically synthesized
agcaactgtggctggtaaagtc

SEQ ID NO: 776699 - DNA, 22 bp, Artificial Sequence
  chemically synthesized
tgactgctctggactttaccag

SEQ ID NO: 776700 - DNA, 22 bp, Artificial Sequence
  chemically synthesized
cagcaactgtggctggtaaagt

SEQ ID NO: 776701 - DNA, 22 bp, Artificial Sequence
  chemically synthesized
gactgctctggactttaccagc

SEQ ID NO: 776702 - DNA, 22 bp, Artificial Sequence
  chemically synthesized
actgctctggactttaccagcc

SEQ ID NO: 776703 - DNA, 22 bp, Artificial Sequence
  chemically synthesized
ctctggactttaccagccacag

SEQ ID NO: 776704 - DNA, 22 bp, Artificial Sequence
  chemically synthesized
catgtcttcagcaactgtggct

SEQ ID NO: 776705 - DNA, 22 bp, Artificial Sequence
  chemically synthesized
tggactttaccagccacagttg

SEQ ID NO: 776706 - DNA, 22 bp, Artificial Sequence
  chemically synthesized
gactttaccagccacagttgct

SEQ ID NO: 776707 - DNA, 22 bp, Artificial Sequence
  chemically synthesized
accctgcatgtcttcagcaact

SEQ ID NO: 776708 - DNA, 22 bp, Artificial Sequence
  chemically synthesized
caccctgcatgtcttcagcaac

SEQ ID NO: 776709 - DNA, 22 bp, Artificial Sequence
  chemically synthesized
taccagccacagttgctgaaga

SEQ ID NO: 776710 - DNA, 22 bp, Artificial Sequence
  chemically synthesized
tcaccctgcatgtcttcagcaa

SEQ ID NO: 776711 - DNA, 22 bp, Artificial Sequence
  chemically synthesized
accagccacagttgctgaagac

SEQ ID NO: 776712 - DNA, 22 bp, Artificial Sequence
  chemically synthesized
ccagccacagttgctgaagaca

SEQ ID NO: 776713 - DNA, 22 bp, Artificial Sequence
  chemically synthesized
atctttcaccctgcatgtcttc

SEQ ID NO: 776714 - DNA, 22 bp, Artificial Sequence
  chemically synthesized
taagggctgatctttcaccctg

SEQ ID NO: 776715 - DNA, 22 bp, Artificial Sequence
  chemically synthesized
ctgaagacatgcagggtgaaag

SEQ ID NO: 776716 - DNA, 22 bp, Artificial Sequence
  chemically synthesized
aagacatgcagggtgaaagatc

SEQ ID NO: 776717 - DNA, 22 bp, Artificial Sequence
  chemically synthesized
gagctgtaagggctgatctttc

SEQ ID NO: 776718 - DNA, 22 bp, Artificial Sequence
  chemically synthesized
agagctgtaagggctgatcttt

SEQ ID NO: 776719 - DNA, 22 bp, Artificial Sequence
  chemically synthesized
atttagagctgtaagggctgat

SEQ ID NO: 776720 - DNA, 22 bp, Artificial Sequence
  chemically synthesized
attgatttagagctgtaagggc

SEQ ID NO: 776721 - DNA, 22 bp, Artificial Sequence
  chemically synthesized
aggagttcattgatttagagct

SEQ ID NO: 776722 - DNA, 22 bp, Artificial Sequence
  chemically synthesized
aaggagttcattgatttagagc

SEQ ID NO: 776723 - DNA, 22 bp, Artificial Sequence
  chemically synthesized
acagctctaaatcaatgaactc

SEQ ID NO: 776724 - DNA, 22 bp, Artificial Sequence
  chemically synthesized
cagctctaaatcaatgaactcc

SEQ ID NO: 776725 - DNA, 22 bp, Artificial Sequence
  chemically synthesized
ggggcaggtttaaggagttcat

SEQ ID NO: 776726 - DNA, 22 bp, Artificial Sequence
  chemically synthesized
gggggcaggtttaaggagttca

SEQ ID NO: 776727 - DNA, 22 bp, Artificial Sequence
  chemically synthesized
taaatcaatgaactccttaaac

SEQ ID NO: 776728 - DNA, 22 bp, Artificial Sequence
  chemically synthesized
aatcaatgaactccttaaacct

SEQ ID NO: 776729 - DNA, 22 bp, Artificial Sequence
  chemically synthesized
atacatttgggggcaggtttaa

SEQ ID NO: 776730 - DNA, 22 bp, Artificial Sequence
  chemically synthesized
ctgatacatttgggggcaggtt

SEQ ID NO: 776731 - DNA, 22 bp, Artificial Sequence
  chemically synthesized
cttaaacctgcccccaaatgta

SEQ ID NO: 776732 - DNA, 22 bp, Artificial Sequence
  chemically synthesized
aaacctgcccccaaatgtatca

SEQ ID NO: 776733 - DNA, 22 bp, Artificial Sequence
  chemically synthesized
aacctgcccccaaatgtatcag

SEQ ID NO: 776734 - DNA, 22 bp, Artificial Sequence
  chemically synthesized
gtggagggtccagctcctgata

SEQ ID NO: 776735 - DNA, 22 bp, Artificial Sequence
  chemically synthesized
cccccaaatgtatcaggagctg

SEQ ID NO: 776736 - DNA, 22 bp, Artificial Sequence
  chemically synthesized
ctagtggagggtccagctcctg

SEQ ID NO: 776737 - DNA, 22 bp, Artificial Sequence
  chemically synthesized
cctgctagtggagggtccagct

SEQ ID NO: 776738 - DNA, 22 bp, Artificial Sequence
  chemically synthesized
agaccctgcctgctagtggagg

SEQ ID NO: 776739 - DNA, 22 bp, Artificial Sequence
  chemically synthesized
gaccctccactagcaggcaggg

SEQ ID NO: 776740 - DNA, 22 bp, Artificial Sequence
  chemically synthesized
aaggaaatctcagaccctgcct

SEQ ID NO: 776741 - DNA, 22 bp, Artificial Sequence
  chemically synthesized
cactagcaggcagggtctgaga

SEQ ID NO: 776742 - DNA, 22 bp, Artificial Sequence
  chemically synthesized
gcaggcagggtctgagatttcc

SEQ ID NO: 776743 - DNA, 22 bp, Artificial Sequence
  chemically synthesized
gcacatagtgagtgctcaagga

SEQ ID NO: 776744 - DNA, 22 bp, Artificial Sequence
  chemically synthesized
agatttccttgagcactcacta

SEQ ID NO: 776745 - DNA, 22 bp, Artificial Sequence
  chemically synthesized
ggacagtaactcgcacatagtg

SEQ ID NO: 776746 - DNA, 22 bp, Artificial Sequence
  chemically synthesized
ccttgagcactcactatgtgcg

SEQ ID NO: 776747 - DNA, 22 bp, Artificial Sequence
  chemically synthesized
aggacagtaactcgcacatagt

SEQ ID NO: 776748 - DNA, 22 bp, Artificial Sequence
  chemically synthesized
cttgagcactcactatgtgcga

SEQ ID NO: 776749 - DNA, 22 bp, Artificial Sequence
  chemically synthesized
tttaggacagtaactcgcacat

SEQ ID NO: 776750 - DNA, 22 bp, Artificial Sequence
  chemically synthesized
gagcactcactatgtgcgagtt

SEQ ID NO: 776751 - DNA, 22 bp, Artificial Sequence
  chemically synthesized
atttaggacagtaactcgcaca

SEQ ID NO: 776752 - DNA, 22 bp, Artificial Sequence
  chemically synthesized
agcactcactatgtgcgagtta

SEQ ID NO: 776753 - DNA, 22 bp, Artificial Sequence
  chemically synthesized
gacttatttaggacagtaactc

SEQ ID NO: 776754 - DNA, 22 bp, Artificial Sequence
  chemically synthesized
actatgtgcgagttactgtcct

SEQ ID NO: 776755 - DNA, 22 bp, Artificial Sequence
  chemically synthesized
cactggacttatttaggacagt

SEQ ID NO: 776756 - DNA, 22 bp, Artificial Sequence
  chemically synthesized
tgtgcgagttactgtcctaaat

SEQ ID NO: 776757 - DNA, 22 bp, Artificial Sequence
  chemically synthesized
ctacactggacttatttaggac

SEQ ID NO: 776758 - DNA, 22 bp, Artificial Sequence
  chemically synthesized
ctgtcctaaataagtccagtgt

SEQ ID NO: 776759 - DNA, 22 bp, Artificial Sequence
  chemically synthesized
tcctaaataagtccagtgtagt

SEQ ID NO: 776760 - DNA, 22 bp, Artificial Sequence
  chemically synthesized
gaatgaagtgaattactacact

SEQ ID NO: 776761 - DNA, 22 bp, Artificial Sequence
  chemically synthesized
aataagtccagtgtagtaattc

SEQ ID NO: 776762 - DNA, 22 bp, Artificial Sequence
  chemically synthesized
ttagaatgaagtgaattactac

SEQ ID NO: 776763 - DNA, 22 bp, Artificial Sequence
  chemically synthesized
ttattagaatgaagtgaattac

SEQ ID NO: 776764 - DNA, 22 bp, Artificial Sequence
  chemically synthesized
atagggttgttattagaatgaa

SEQ ID NO: 776765 - DNA, 22 bp, Artificial Sequence
  chemically synthesized
atgacctcatagggttgttatt

SEQ ID NO: 776766 - DNA, 22 bp, Artificial Sequence
  chemically synthesized
acttcattctaataacaaccct

SEQ ID NO: 776767 - DNA, 22 bp, Artificial Sequence
  chemically synthesized
cattctaataacaaccctatga

SEQ ID NO: 776768 - DNA, 22 bp, Artificial Sequence
  chemically synthesized
attctaataacaaccctatgag

SEQ ID NO: 776769 - DNA, 22 bp, Artificial Sequence
  chemically synthesized
taataacaaccctatgaggtca

SEQ ID NO: 776770 - DNA, 22 bp, Artificial Sequence
  chemically synthesized
ataacaaccctatgaggtcatt

SEQ ID NO: 776771 - DNA, 22 bp, Artificial Sequence
  chemically synthesized
tatccgcagtgaagattaatga

SEQ ID NO: 776772 - DNA, 22 bp, Artificial Sequence
  chemically synthesized
gtatccgcagtgaagattaatg

SEQ ID NO: 776773 - DNA, 22 bp, Artificial Sequence
  chemically synthesized
tgtatccgcagtgaagattaat

SEQ ID NO: 776774 - DNA, 22 bp, Artificial Sequence
  chemically synthesized
tttgtatccgcagtgaagatta

SEQ ID NO: 776775 - DNA, 22 bp, Artificial Sequence
  chemically synthesized
ctttgtatccgcagtgaagatt

SEQ ID NO: 776776 - DNA, 22 bp, Artificial Sequence
  chemically synthesized
tgaggtcattaatcttcactgc

SEQ ID NO: 776777 - DNA, 22 bp, Artificial Sequence
  chemically synthesized
agtttctttgtatccgcagtga

SEQ ID NO: 776778 - DNA, 22 bp, Artificial Sequence
  chemically synthesized
atcttcactgcggatacaaaga

SEQ ID NO: 776779 - DNA, 22 bp, Artificial Sequence
  chemically synthesized
tatacctcagtttctttgtatc

SEQ ID NO: 776780 - DNA, 22 bp, Artificial Sequence
  chemically synthesized
tatatacctcagtttctttgta

SEQ ID NO: 776781 - DNA, 22 bp, Artificial Sequence
  chemically synthesized
cactgcggatacaaagaaactg

SEQ ID NO: 776782 - DNA, 22 bp, Artificial Sequence
  chemically synthesized
actgcggatacaaagaaactga

SEQ ID NO: 776783 - DNA, 22 bp, Artificial Sequence
  chemically synthesized
cggatacaaagaaactgaggta

SEQ ID NO: 776784 - DNA, 22 bp, Artificial Sequence
  chemically synthesized
agtcacctctatatacctcagt

SEQ ID NO: 776785 - DNA, 22 bp, Artificial Sequence
  chemically synthesized
gctgagtcacctctatatacct

SEQ ID NO: 776786 - DNA, 22 bp, Artificial Sequence
  chemically synthesized
tagctgagtcacctctatatac

SEQ ID NO: 776787 - DNA, 22 bp, Artificial Sequence
  chemically synthesized
ccacattctagctgagtcacct

SEQ ID NO: 776788 - DNA, 22 bp, Artificial Sequence
  chemically synthesized
aggtatatagaggtgactcagc

SEQ ID NO: 776789 - DNA, 22 bp, Artificial Sequence
  chemically synthesized
actgccacattctagctgagtc

SEQ ID NO: 776790 - DNA, 22 bp, Artificial Sequence
  chemically synthesized
gactgccacattctagctgagt

SEQ ID NO: 776791 - DNA, 22 bp, Artificial Sequence
  chemically synthesized
taacttgactgccacattctag

SEQ ID NO: 776792 - DNA, 22 bp, Artificial Sequence
  chemically synthesized
ctgtaacttgactgccacattc

SEQ ID NO: 776793 - DNA, 22 bp, Artificial Sequence
  chemically synthesized
cctgtaacttgactgccacatt

SEQ ID NO: 776794 - DNA, 22 bp, Artificial Sequence
  chemically synthesized
agctagaatgtggcagtcaagt

SEQ ID NO: 776795 - DNA, 22 bp, Artificial Sequence
  chemically synthesized
gaatgtggcagtcaagttacag

SEQ ID NO: 776796 - DNA, 22 bp, Artificial Sequence
  chemically synthesized
taaagaatggtataaatttcct

SEQ ID NO: 776797 - DNA, 22 bp, Artificial Sequence
  chemically synthesized
caggaaatttataccattcttt

SEQ ID NO: 776798 - DNA, 22 bp, Artificial Sequence
  chemically synthesized
aggaaaggcagttgtaaagaat

SEQ ID NO: 776799 - DNA, 22 bp, Artificial Sequence
  chemically synthesized
caggaaaggcagttgtaaagaa

SEQ ID NO: 776800 - DNA, 22 bp, Artificial Sequence
  chemically synthesized
cttcaggaaaggcagttgtaaa

SEQ ID NO: 776801 - DNA, 22 bp, Artificial Sequence
  chemically synthesized
ataccattctttacaactgcct

SEQ ID NO: 776802 - DNA, 22 bp, Artificial Sequence
  chemically synthesized
taccattctttacaactgcctt

SEQ ID NO: 776803 - DNA, 22 bp, Artificial Sequence
  chemically synthesized
tttacaactgcctttcctgaag

SEQ ID NO: 776804 - DNA, 22 bp, Artificial Sequence
  chemically synthesized
tacacagccattacttcaggaa

SEQ ID NO: 776805 - DNA, 22 bp, Artificial Sequence
  chemically synthesized
tacaactgcctttcctgaagta

SEQ ID NO: 776806 - DNA, 22 bp, Artificial Sequence
  chemically synthesized
acaactgcctttcctgaagtaa

SEQ ID NO: 776807 - DNA, 22 bp, Artificial Sequence
  chemically synthesized
caactgcctttcctgaagtaat

SEQ ID NO: 776808 - DNA, 22 bp, Artificial Sequence
  chemically synthesized
cctttcctgaagtaatggctgt

SEQ ID NO: 776809 - DNA, 22 bp, Artificial Sequence
  chemically synthesized
acaatattatacacagccatta

SEQ ID NO: 776810 - DNA, 22 bp, Artificial Sequence
  chemically synthesized
aacaatattatacacagccatt

SEQ ID NO: 776811 - DNA, 22 bp, Artificial Sequence
  chemically synthesized
tcctgaagtaatggctgtgtat

SEQ ID NO: 776812 - DNA, 22 bp, Artificial Sequence
  chemically synthesized
cctgaagtaatggctgtgtata

SEQ ID NO: 776813 - DNA, 22 bp, Artificial Sequence
  chemically synthesized
ctgaagtaatggctgtgtataa

SEQ ID NO: 776814 - DNA, 22 bp, Artificial Sequence
  chemically synthesized
aagtaatggctgtgtataatat

SEQ ID NO: 776815 - DNA, 22 bp, Artificial Sequence
  chemically synthesized
tcgacccaatcttaacaatatt

SEQ ID NO: 776816 - DNA, 22 bp, Artificial Sequence
  chemically synthesized
gtcgacccaatcttaacaatat

SEQ ID NO: 776817 - DNA, 22 bp, Artificial Sequence
  chemically synthesized
tgtcgacccaatcttaacaata

SEQ ID NO: 776818 - DNA, 22 bp, Artificial Sequence
  chemically synthesized
ttgtcgacccaatcttaacaat

SEQ ID NO: 776819 - DNA, 22 bp, Artificial Sequence
  chemically synthesized
tgtataatattgttaagattgg

SEQ ID NO: 776820 - DNA, 22 bp, Artificial Sequence
  chemically synthesized
atttttgtcgacccaatcttaa

SEQ ID NO: 776821 - DNA, 22 bp, Artificial Sequence
  chemically synthesized
gttgatttttgtcgacccaatc

SEQ ID NO: 776822 - DNA, 22 bp, Artificial Sequence
  chemically synthesized
actggttgatttttgtcgaccc

SEQ ID NO: 776823 - DNA, 22 bp, Artificial Sequence
  chemically synthesized
gactggttgatttttgtcgacc

SEQ ID NO: 776824 - DNA, 22 bp, Artificial Sequence
  chemically synthesized
ttaagattgggtcgacaaaaat

SEQ ID NO: 776825 - DNA, 22 bp, Artificial Sequence
  chemically synthesized
agattgggtcgacaaaaatcaa

SEQ ID NO: 776826 - DNA, 22 bp, Artificial Sequence
  chemically synthesized
atatttgactggttgatttttg

SEQ ID NO: 776827 - DNA, 22 bp, Artificial Sequence
  chemically synthesized
taatatttgactggttgatttt

SEQ ID NO: 776828 - DNA, 22 bp, Artificial Sequence
  chemically synthesized
ctaatatttgactggttgattt

SEQ ID NO: 776829 - DNA, 22 bp, Artificial Sequence
  chemically synthesized
ggtcgacaaaaatcaaccagtc

SEQ ID NO: 776830 - DNA, 22 bp, Artificial Sequence
  chemically synthesized
ggcttctaatatttgactggtt

SEQ ID NO: 776831 - DNA, 22 bp, Artificial Sequence
  chemically synthesized
gggcttctaatatttgactggt

SEQ ID NO: 776832 - DNA, 22 bp, Artificial Sequence
  chemically synthesized
gcggggcttgggcttctaatat

SEQ ID NO: 776833 - DNA, 22 bp, Artificial Sequence
  chemically synthesized
ttggcggggcttgggcttctaa

SEQ ID NO: 776834 - DNA, 22 bp, Artificial Sequence
  chemically synthesized
gaagcccaagccccgccaacag

SEQ ID NO: 776835 - DNA, 22 bp, Artificial Sequence
  chemically synthesized
atacaggaatccatctgttggc

SEQ ID NO: 776836 - DNA, 22 bp, Artificial Sequence
  chemically synthesized
gggaaaatcatctaatacagga

SEQ ID NO: 776837 - DNA, 22 bp, Artificial Sequence
  chemically synthesized
gaagactcgggaaaatcatcta

SEQ ID NO: 776838 - DNA, 22 bp, Artificial Sequence
  chemically synthesized
ctgtattagatgattttcccga

SEQ ID NO: 776839 - DNA, 22 bp, Artificial Sequence
  chemically synthesized
tcgttagaagactcgggaaaat

SEQ ID NO: 776840 - DNA, 22 bp, Artificial Sequence
  chemically synthesized
gtcgttagaagactcgggaaaa

SEQ ID NO: 776841 - DNA, 22 bp, Artificial Sequence
  chemically synthesized
tgtcgttagaagactcgggaaa

SEQ ID NO: 776842 - DNA, 22 bp, Artificial Sequence
  chemically synthesized
tattagatgattttcccgagtc

SEQ ID NO: 776843 - DNA, 22 bp, Artificial Sequence
  chemically synthesized
ttgtcgttagaagactcgggaa

SEQ ID NO: 776844 - DNA, 22 bp, Artificial Sequence
  chemically synthesized
tttttgtcgttagaagactcgg

SEQ ID NO: 776845 - DNA, 22 bp, Artificial Sequence
  chemically synthesized
gatgattttcccgagtcttcta

SEQ ID NO: 776846 - DNA, 22 bp, Artificial Sequence
  chemically synthesized
ctgtttttgtcgttagaagact

SEQ ID NO: 776847 - DNA, 22 bp, Artificial Sequence
  chemically synthesized
ccattgctgtttttgtcgttag

SEQ ID NO: 776848 - DNA, 22 bp, Artificial Sequence
  chemically synthesized
tcccgagtcttctaacgacaaa

SEQ ID NO: 776849 - DNA, 22 bp, Artificial Sequence
  chemically synthesized
cccgagtcttctaacgacaaaa

SEQ ID NO: 776850 - DNA, 22 bp, Artificial Sequence
  chemically synthesized
ccgagtcttctaacgacaaaaa

SEQ ID NO: 776851 - DNA, 22 bp, Artificial Sequence
  chemically synthesized
ctgccattgctgtttttgtcgt

SEQ ID NO: 776852 - DNA, 22 bp, Artificial Sequence
  chemically synthesized
ctaacgacaaaaacagcaatgg

SEQ ID NO: 776853 - DNA, 22 bp, Artificial Sequence
  chemically synthesized
taacgacaaaaacagcaatggc

SEQ ID NO: 776854 - DNA, 22 bp, Artificial Sequence
  chemically synthesized
acgacaaaaacagcaatggcag

SEQ ID NO: 776855 - DNA, 22 bp, Artificial Sequence
  chemically synthesized
cagataatgctgctgccattgc

SEQ ID NO: 776856 - DNA, 22 bp, Artificial Sequence
  chemically synthesized
gcagataatgctgctgccattg

SEQ ID NO: 776857 - DNA, 22 bp, Artificial Sequence
  chemically synthesized
ataaatatttgcagataatgct

SEQ ID NO: 776858 - DNA, 22 bp, Artificial Sequence
  chemically synthesized
agtactcataaatatttgcaga

SEQ ID NO: 776859 - DNA, 22 bp, Artificial Sequence
  chemically synthesized
tctgcaaatatttatgagtact

SEQ ID NO: 776860 - DNA, 22 bp, Artificial Sequence
  chemically synthesized
caaatatttatgagtacttaat

SEQ ID NO: 776861 - DNA, 22 bp, Artificial Sequence
  chemically synthesized
atgagtacttaattgtgttgtg

SEQ ID NO: 776862 - DNA, 22 bp, Artificial Sequence
  chemically synthesized
tgagtacttaattgtgttgtgc

SEQ ID NO: 776863 - DNA, 22 bp, Artificial Sequence
  chemically synthesized
atatggtatgtggcacaacaca

SEQ ID NO: 776864 - DNA, 22 bp, Artificial Sequence
  chemically synthesized
aatatggtatgtggcacaacac

SEQ ID NO: 776865 - DNA, 22 bp, Artificial Sequence
  chemically synthesized
aattgtgttgtgccacatacca

SEQ ID NO: 776866 - DNA, 22 bp, Artificial Sequence
  chemically synthesized
attgtgttgtgccacataccat

SEQ ID NO: 776867 - DNA, 22 bp, Artificial Sequence
  chemically synthesized
tgttgtgccacataccatatta

SEQ ID NO: 776868 - DNA, 22 bp, Artificial Sequence
  chemically synthesized
acacatggaaaccacttaatat

SEQ ID NO: 776869 - DNA, 22 bp, Artificial Sequence
  chemically synthesized
tgccacataccatattaagtgg

SEQ ID NO: 776870 - DNA, 22 bp, Artificial Sequence
  chemically synthesized
aacacatggaaaccacttaata

SEQ ID NO: 776871 - DNA, 22 bp, Artificial Sequence
  chemically synthesized
atttaacacatggaaaccactt

SEQ ID NO: 776872 - DNA, 22 bp, Artificial Sequence
  chemically synthesized
cattgatttaacacatggaaac

SEQ ID NO: 776873 - DNA, 22 bp, Artificial Sequence
  chemically synthesized
ggattacattgatttaacacat

SEQ ID NO: 776874 - DNA, 22 bp, Artificial Sequence
  chemically synthesized
agtggtttccatgtgttaaatc

SEQ ID NO: 776875 - DNA, 22 bp, Artificial Sequence
  chemically synthesized
gatactgggattacattgattt

SEQ ID NO: 776876 - DNA, 22 bp, Artificial Sequence
  chemically synthesized
ccatgtgttaaatcaatgtaat

SEQ ID NO: 776877 - DNA, 22 bp, Artificial Sequence
  chemically synthesized
catgtgttaaatcaatgtaatc

SEQ ID NO: 776878 - DNA, 22 bp, Artificial Sequence
  chemically synthesized
acgcccactggatactgggatt

SEQ ID NO: 776879 - DNA, 22 bp, Artificial Sequence
  chemically synthesized
aatcaatgtaatcccagtatcc

SEQ ID NO: 776880 - DNA, 22 bp, Artificial Sequence
  chemically synthesized
ctgacgcccactggatactggg

SEQ ID NO: 776881 - DNA, 22 bp, Artificial Sequence
  chemically synthesized
tgctgacgcccactggatactg

SEQ ID NO: 776882 - DNA, 22 bp, Artificial Sequence
  chemically synthesized
aaggcagctctgctgacgccca

SEQ ID NO: 776883 - DNA, 22 bp, Artificial Sequence
  chemically synthesized
cagctcaaggcagctctgctga

SEQ ID NO: 776884 - DNA, 22 bp, Artificial Sequence
  chemically synthesized
atgaaagaggttgcagctcaag

SEQ ID NO: 776885 - DNA, 22 bp, Artificial Sequence
  chemically synthesized
ctaatgaaagaggttgcagctc

SEQ ID NO: 776886 - DNA, 22 bp, Artificial Sequence
  chemically synthesized
gttgctaatgaaagaggttgca

SEQ ID NO: 776887 - DNA, 22 bp, Artificial Sequence
  chemically synthesized
ccttgagctgcaacctctttca

SEQ ID NO: 776888 - DNA, 22 bp, Artificial Sequence
  chemically synthesized
agctggttgctaatgaaagagg

SEQ ID NO: 776889 - DNA, 22 bp, Artificial Sequence
  chemically synthesized
gagctgcaacctctttcattag

SEQ ID NO: 776890 - DNA, 22 bp, Artificial Sequence
  chemically synthesized
agctgcaacctctttcattagc

SEQ ID NO: 776891 - DNA, 22 bp, Artificial Sequence
  chemically synthesized
caacctctttcattagcaacca

SEQ ID NO: 776892 - DNA, 22 bp, Artificial Sequence
  chemically synthesized
agggatctaagctggttgctaa

SEQ ID NO: 776893 - DNA, 22 bp, Artificial Sequence
  chemically synthesized
tttcattagcaaccagcttaga

SEQ ID NO: 776894 - DNA, 22 bp, Artificial Sequence
  chemically synthesized
tcattagcaaccagcttagatc

SEQ ID NO: 776895 - DNA, 22 bp, Artificial Sequence
  chemically synthesized
cattagcaaccagcttagatcc

SEQ ID NO: 776896 - DNA, 22 bp, Artificial Sequence
  chemically synthesized
attagcaaccagcttagatccc

SEQ ID NO: 776897 - DNA, 22 bp, Artificial Sequence
  chemically synthesized
gcaaccagcttagatcccttag

SEQ ID NO: 776898 - DNA, 22 bp, Artificial Sequence
  chemically synthesized
agatcccttagtcattttggct

SEQ ID NO: 776899 - DNA, 22 bp, Artificial Sequence
  chemically synthesized
gatcccttagtcattttggctg

SEQ ID NO: 776900 - DNA, 22 bp, Artificial Sequence
  chemically synthesized
agtcattttggctgggctactc

SEQ ID NO: 776901 - DNA, 22 bp, Artificial Sequence
  chemically synthesized
gtcattttggctgggctactct

SEQ ID NO: 776902 - DNA, 22 bp, Artificial Sequence
  chemically synthesized
gggtatgaatcaccaccagagt

SEQ ID NO: 776903 - DNA, 22 bp, Artificial Sequence
  chemically synthesized
tggctgggctactctggtggtg

SEQ ID NO: 776904 - DNA, 22 bp, Artificial Sequence
  chemically synthesized
ggctgggctactctggtggtga

SEQ ID NO: 776905 - DNA, 22 bp, Artificial Sequence
  chemically synthesized
gctgggctactctggtggtgat

SEQ ID NO: 776906 - DNA, 22 bp, Artificial Sequence
  chemically synthesized
ggctactctggtggtgattcat

SEQ ID NO: 776907 - DNA, 22 bp, Artificial Sequence
  chemically synthesized
ctctggtggtgattcatacccc

SEQ ID NO: 776908 - DNA, 22 bp, Artificial Sequence
  chemically synthesized
aggcaaggccctggggtatgaa

SEQ ID NO: 776909 - DNA, 22 bp, Artificial Sequence
  chemically synthesized
tggtggtgattcataccccagg

SEQ ID NO: 776910 - DNA, 22 bp, Artificial Sequence
  chemically synthesized
gtggtgattcataccccagggc

SEQ ID NO: 776911 - DNA, 22 bp, Artificial Sequence
  chemically synthesized
agctcaggcaaggccctggggt

SEQ ID NO: 776912 - DNA, 22 bp, Artificial Sequence
  chemically synthesized
cagctcaggcaaggccctgggg

SEQ ID NO: 776913 - DNA, 22 bp, Artificial Sequence
  chemically synthesized
gcttcagctcaggcaaggccct

SEQ ID NO: 776914 - DNA, 22 bp, Artificial Sequence
  chemically synthesized
tagcttcagctcaggcaaggcc

SEQ ID NO: 776915 - DNA, 22 bp, Artificial Sequence
  chemically synthesized
ataccccagggccttgcctgag

SEQ ID NO: 776916 - DNA, 22 bp, Artificial Sequence
  chemically synthesized
gcctgagctgaagctagaacgt

SEQ ID NO: 776917 - DNA, 22 bp, Artificial Sequence
  chemically synthesized
cctgagctgaagctagaacgtg

SEQ ID NO: 776918 - DNA, 22 bp, Artificial Sequence
  chemically synthesized
cagggtgcaaagccacgttcta

SEQ ID NO: 776919 - DNA, 22 bp, Artificial Sequence
  chemically synthesized
ccagggtgcaaagccacgttct

SEQ ID NO: 776920 - DNA, 22 bp, Artificial Sequence
  chemically synthesized
agctgaagctagaacgtggctt

SEQ ID NO: 776921 - DNA, 22 bp, Artificial Sequence
  chemically synthesized
aagctagaacgtggctttgcac

SEQ ID NO: 776922 - DNA, 22 bp, Artificial Sequence
  chemically synthesized
gaacgtggctttgcaccctgga

SEQ ID NO: 776923 - DNA, 22 bp, Artificial Sequence
  chemically synthesized
gcaaaatataggcaggtttcca

SEQ ID NO: 776924 - DNA, 22 bp, Artificial Sequence
  chemically synthesized
tgcaccctggaaacctgcctat

SEQ ID NO: 776925 - DNA, 22 bp, Artificial Sequence
  chemically synthesized
gcaccctggaaacctgcctata

SEQ ID NO: 776926 - DNA, 22 bp, Artificial Sequence
  chemically synthesized
caccctggaaacctgcctatat

SEQ ID NO: 776927 - DNA, 22 bp, Artificial Sequence
  chemically synthesized
gaaacctgcctatattttgcca

SEQ ID NO: 776928 - DNA, 22 bp, Artificial Sequence
  chemically synthesized
aggggagaaaactggcaaaata

SEQ ID NO: 776929 - DNA, 22 bp, Artificial Sequence
  chemically synthesized
aaggggagaaaactggcaaaat

SEQ ID NO: 776930 - DNA, 22 bp, Artificial Sequence
  chemically synthesized
cttaaggggagaaaactggcaa

SEQ ID NO: 776931 - DNA, 22 bp, Artificial Sequence
  chemically synthesized
cctatattttgccagttttctc

SEQ ID NO: 776932 - DNA, 22 bp, Artificial Sequence
  chemically synthesized
agttccttaaggggagaaaact

SEQ ID NO: 776933 - DNA, 22 bp, Artificial Sequence
  chemically synthesized
cagttccttaaggggagaaaac

SEQ ID NO: 776934 - DNA, 22 bp, Artificial Sequence
  chemically synthesized
tattttgccagttttctcccct

SEQ ID NO: 776935 - DNA, 22 bp, Artificial Sequence
  chemically synthesized
ggtttcagttccttaaggggag

SEQ ID NO: 776936 - DNA, 22 bp, Artificial Sequence
  chemically synthesized
tgccagttttctccccttaagg

SEQ ID NO: 776937 - DNA, 22 bp, Artificial Sequence
  chemically synthesized
gccagttttctccccttaagga

SEQ ID NO: 776938 - DNA, 22 bp, Artificial Sequence
  chemically synthesized
ccagttttctccccttaaggaa

SEQ ID NO: 776939 - DNA, 22 bp, Artificial Sequence
  chemically synthesized
tctccccttaaggaactgaaac

SEQ ID NO: 776940 - DNA, 22 bp, Artificial Sequence
  chemically synthesized
ggtaccagctaggtttcagttc

SEQ ID NO: 776941 - DNA, 22 bp, Artificial Sequence
  chemically synthesized
ctccccttaaggaactgaaacc

SEQ ID NO: 776942 - DNA, 22 bp, Artificial Sequence
  chemically synthesized
aggtaccagctaggtttcagtt

SEQ ID NO: 776943 - DNA, 22 bp, Artificial Sequence
  chemically synthesized
tccccttaaggaactgaaacct

SEQ ID NO: 776944 - DNA, 22 bp, Artificial Sequence
  chemically synthesized
ttaggtaccagctaggtttcag

SEQ ID NO: 776945 - DNA, 22 bp, Artificial Sequence
  chemically synthesized
cccttaaggaactgaaacctag

SEQ ID NO: 776946 - DNA, 22 bp, Artificial Sequence
  chemically synthesized
aaggaactgaaacctagctggt

SEQ ID NO: 776947 - DNA, 22 bp, Artificial Sequence
  chemically synthesized
aggaactgaaacctagctggta

SEQ ID NO: 776948 - DNA, 22 bp, Artificial Sequence
  chemically synthesized
gaaagaagcaattcttaggtac

SEQ ID NO: 776949 - DNA, 22 bp, Artificial Sequence
  chemically synthesized
aaacctagctggtacctaagaa

SEQ ID NO: 776950 - DNA, 22 bp, Artificial Sequence
  chemically synthesized
agaaagaagcaattcttaggta

SEQ ID NO: 776951 - DNA, 22 bp, Artificial Sequence
  chemically synthesized
tttagaaagaagcaattcttag

SEQ ID NO: 776952 - DNA, 22 bp, Artificial Sequence
  chemically synthesized
atttagaaagaagcaattctta

SEQ ID NO: 776953 - DNA, 22 bp, Artificial Sequence
  chemically synthesized
tatttagaaagaagcaattctt

SEQ ID NO: 776954 - DNA, 22 bp, Artificial Sequence
  chemically synthesized
gctggtacctaagaattgcttc

SEQ ID NO: 776955 - DNA, 22 bp, Artificial Sequence
  chemically synthesized
gtacctaagaattgcttctttc

SEQ ID NO: 776956 - DNA, 22 bp, Artificial Sequence
  chemically synthesized
agaattgcttctttctaaataa

SEQ ID NO: 776957 - DNA, 22 bp, Artificial Sequence
  chemically synthesized
cttctttctaaataaagcctac

SEQ ID NO: 776958 - DNA, 22 bp, Artificial Sequence
  chemically synthesized
ctttctaaataaagcctactat

SEQ ID NO: 776959 - DNA, 22 bp, Artificial Sequence
  chemically synthesized
tttctaaataaagcctactatg

SEQ ID NO: 776960 - DNA, 22 bp, Artificial Sequence
  chemically synthesized
tctaaataaagcctactatggc

SEQ ID NO: 776961 - DNA, 22 bp, Artificial Sequence
  chemically synthesized
ctaaataaagcctactatggcc

SEQ ID NO: 776962 - DNA, 22 bp, Artificial Sequence
  chemically synthesized
ggaaggtggtgtggccatagta

SEQ ID NO: 776963 - DNA, 22 bp, Artificial Sequence
  chemically synthesized
taaataaagcctactatggcca

SEQ ID NO: 776964 - DNA, 22 bp, Artificial Sequence
  chemically synthesized
gggaaggtggtgtggccatagt

SEQ ID NO: 776965 - DNA, 22 bp, Artificial Sequence
  chemically synthesized
aataaagcctactatggccaca

SEQ ID NO: 776966 - DNA, 22 bp, Artificial Sequence
  chemically synthesized
gtttgggaaggtggtgtggcca

SEQ ID NO: 776967 - DNA, 22 bp, Artificial Sequence
  chemically synthesized
agtttgggaaggtggtgtggcc

SEQ ID NO: 776968 - DNA, 22 bp, Artificial Sequence
  chemically synthesized
ctatggccacaccaccttccca

SEQ ID NO: 776969 - DNA, 22 bp, Artificial Sequence
  chemically synthesized
tggccacaccaccttcccaaac

SEQ ID NO: 776970 - DNA, 22 bp, Artificial Sequence
  chemically synthesized
cccaaactaaggtgctgaccga

SEQ ID NO: 776971 - DNA, 22 bp, Artificial Sequence
  chemically synthesized
ccaaactaaggtgctgaccgat

SEQ ID NO: 776972 - DNA, 22 bp, Artificial Sequence
  chemically synthesized
gtagaaggagaggagagcatcg

SEQ ID NO: 776973 - DNA, 22 bp, Artificial Sequence
  chemically synthesized
aggtgctgaccgatgctctcct

SEQ ID NO: 776974 - DNA, 22 bp, Artificial Sequence
  chemically synthesized
gaatctggtagaaggagaggag

SEQ ID NO: 776975 - DNA, 22 bp, Artificial Sequence
  chemically synthesized
accgatgctctcctctccttct

SEQ ID NO: 776976 - DNA, 22 bp, Artificial Sequence
  chemically synthesized
aaggttggaatctggtagaagg

SEQ ID NO: 776977 - DNA, 22 bp, Artificial Sequence
  chemically synthesized
tcctctccttctaccagattcc

SEQ ID NO: 776978 - DNA, 22 bp, Artificial Sequence
  chemically synthesized
ctctccttctaccagattccaa

SEQ ID NO: 776979 - DNA, 22 bp, Artificial Sequence
  chemically synthesized
tccttctaccagattccaacct

SEQ ID NO: 776980 - DNA, 22 bp, Artificial Sequence
  chemically synthesized
cttctaccagattccaaccttt

SEQ ID NO: 776981 - DNA, 22 bp, Artificial Sequence
  chemically synthesized
aaatatgaataactaaaggttg

SEQ ID NO: 776982 - DNA, 22 bp, Artificial Sequence
  chemically synthesized
ctaccagattccaacctttagt

SEQ ID NO: 776983 - DNA, 22 bp, Artificial Sequence
  chemically synthesized
taccagattccaacctttagtt

SEQ ID NO: 776984 - DNA, 22 bp, Artificial Sequence
  chemically synthesized
ccagattccaacctttagttat

SEQ ID NO: 776985 - DNA, 22 bp, Artificial Sequence
  chemically synthesized
caacctttagttattcatattt

SEQ ID NO: 776986 - DNA, 22 bp, Artificial Sequence
  chemically synthesized
agtgaaatgactaaaatatgaa

SEQ ID NO: 776987 - DNA, 22 bp, Artificial Sequence
  chemically synthesized
tagttattcatattttagtcat

SEQ ID NO: 776988 - DNA, 22 bp, Artificial Sequence
  chemically synthesized
agttattcatattttagtcatt

SEQ ID NO: 776989 - DNA, 22 bp, Artificial Sequence
  chemically synthesized
gttattcatattttagtcattt

SEQ ID NO: 776990 - DNA, 22 bp, Artificial Sequence
  chemically synthesized
taaagttaagtgaaatgactaa

SEQ ID NO: 776991 - DNA, 22 bp, Artificial Sequence
  chemically synthesized
ttcatattttagtcatttcact

SEQ ID NO: 776992 - DNA, 22 bp, Artificial Sequence
  chemically synthesized
atattttagtcatttcacttaa

SEQ ID NO: 776993 - DNA, 22 bp, Artificial Sequence
  chemically synthesized
tagtcatttcacttaactttac

SEQ ID NO: 776994 - DNA, 22 bp, Artificial Sequence
  chemically synthesized
agtcatttcacttaactttaca

SEQ ID NO: 776995 - DNA, 22 bp, Artificial Sequence
  chemically synthesized
gtcatttcacttaactttacaa

SEQ ID NO: 776996 - DNA, 22 bp, Artificial Sequence
  chemically synthesized
cacttaactttacaacttcctc

SEQ ID NO: 776997 - DNA, 22 bp, Artificial Sequence
  chemically synthesized
acttaactttacaacttcctct

SEQ ID NO: 776998 - DNA, 22 bp, Artificial Sequence
  chemically synthesized
caaaatcagtgggcaagaggaa

SEQ ID NO: 776999 - DNA, 22 bp, Artificial Sequence
  chemically synthesized
aactttacaacttcctcttgcc

SEQ ID NO: 777000 - DNA, 22 bp, Artificial Sequence
  chemically synthesized
actttacaacttcctcttgccc

SEQ ID NO: 777001 - DNA, 22 bp, Artificial Sequence
  chemically synthesized
ttccaaaatcagtgggcaagag

SEQ ID NO: 777002 - DNA, 22 bp, Artificial Sequence
  chemically synthesized
tacaacttcctcttgcccactg

SEQ ID NO: 777003 - DNA, 22 bp, Artificial Sequence
  chemically synthesized
acaacttcctcttgcccactga

SEQ ID NO: 777004 - DNA, 22 bp, Artificial Sequence
  chemically synthesized
caacttcctcttgcccactgat

SEQ ID NO: 777005 - DNA, 22 bp, Artificial Sequence
  chemically synthesized
cctcttgcccactgattttgga

SEQ ID NO: 777006 - DNA, 22 bp, Artificial Sequence
  chemically synthesized
ctcttgcccactgattttggaa

SEQ ID NO: 777007 - DNA, 22 bp, Artificial Sequence
  chemically synthesized
ttgcccactgattttggaatag

SEQ ID NO: 777008 - DNA, 22 bp, Artificial Sequence
  chemically synthesized
gcccactgattttggaatagct

SEQ ID NO: 777009 - DNA, 22 bp, Artificial Sequence
  chemically synthesized
cccactgattttggaatagctg

SEQ ID NO: 777010 - DNA, 22 bp, Artificial Sequence
  chemically synthesized
aagaaaggaaaccagctattcc

SEQ ID NO: 777011 - DNA, 22 bp, Artificial Sequence
  chemically synthesized
caagaaaggaaaccagctattc

SEQ ID NO: 777012 - DNA, 22 bp, Artificial Sequence
  chemically synthesized
attttggaatagctggtttcct

SEQ ID NO: 777013 - DNA, 22 bp, Artificial Sequence
  chemically synthesized
aagtcttcaagaaaggaaacca

SEQ ID NO: 777014 - DNA, 22 bp, Artificial Sequence
  chemically synthesized
tggaatagctggtttcctttct

SEQ ID NO: 777015 - DNA, 22 bp, Artificial Sequence
  chemically synthesized
ggaatagctggtttcctttctt

SEQ ID NO: 777016 - DNA, 22 bp, Artificial Sequence
  chemically synthesized
gaatagctggtttcctttcttg

SEQ ID NO: 777017 - DNA, 22 bp, Artificial Sequence
  chemically synthesized
gtattcaagtcttcaagaaagg

SEQ ID NO: 777018 - DNA, 22 bp, Artificial Sequence
  chemically synthesized
gtaattggtattcaagtcttca

SEQ ID NO: 777019 - DNA, 22 bp, Artificial Sequence
  chemically synthesized
gtttcctttcttgaagacttga

SEQ ID NO: 777020 - DNA, 22 bp, Artificial Sequence
  chemically synthesized
cctttcttgaagacttgaatac

SEQ ID NO: 777021 - DNA, 22 bp, Artificial Sequence
  chemically synthesized
ccctggtaattggtattcaagt

SEQ ID NO: 777022 - DNA, 22 bp, Artificial Sequence
  chemically synthesized
ctttcttgaagacttgaatacc

SEQ ID NO: 777023 - DNA, 22 bp, Artificial Sequence
  chemically synthesized
tcttgaagacttgaataccaat

SEQ ID NO: 777024 - DNA, 22 bp, Artificial Sequence
  chemically synthesized
cttgaagacttgaataccaatt

SEQ ID NO: 777025 - DNA, 22 bp, Artificial Sequence
  chemically synthesized
ttgaagacttgaataccaatta

SEQ ID NO: 777026 - DNA, 22 bp, Artificial Sequence
  chemically synthesized
gaagacttgaataccaattacc

SEQ ID NO: 777027 - DNA, 22 bp, Artificial Sequence
  chemically synthesized
gagggctgccctggtaattggt

SEQ ID NO: 777028 - DNA, 22 bp, Artificial Sequence
  chemically synthesized
aagacttgaataccaattacca

SEQ ID NO: 777029 - DNA, 22 bp, Artificial Sequence
  chemically synthesized
gaataccaattaccagggcagc

SEQ ID NO: 777030 - DNA, 22 bp, Artificial Sequence
  chemically synthesized
aataccaattaccagggcagcc

SEQ ID NO: 777031 - DNA, 22 bp, Artificial Sequence
  chemically synthesized
gagacaggaggctagagggctg

SEQ ID NO: 777032 - DNA, 22 bp, Artificial Sequence
  chemically synthesized
ctggagacaggaggctagaggg

SEQ ID NO: 777033 - DNA, 22 bp, Artificial Sequence
  chemically synthesized
ccagggcagccctctagcctcc

SEQ ID NO: 777034 - DNA, 22 bp, Artificial Sequence
  chemically synthesized
actgctggagacaggaggctag

SEQ ID NO: 777035 - DNA, 22 bp, Artificial Sequence
  chemically synthesized
tagcagctaactgctggagaca

SEQ ID NO: 777036 - DNA, 22 bp, Artificial Sequence
  chemically synthesized
tagcctcctgtctccagcagtt

SEQ ID NO: 777037 - DNA, 22 bp, Artificial Sequence
  chemically synthesized
gcctcctgtctccagcagttag

SEQ ID NO: 777038 - DNA, 22 bp, Artificial Sequence
  chemically synthesized
ctgtctccagcagttagctgct

SEQ ID NO: 777039 - DNA, 22 bp, Artificial Sequence
  chemically synthesized
tctccagcagttagctgctaca

SEQ ID NO: 777040 - DNA, 22 bp, Artificial Sequence
  chemically synthesized
cagcagttagctgctacagaca

SEQ ID NO: 777041 - DNA, 22 bp, Artificial Sequence
  chemically synthesized
acaagaagcataatgtctgtag

SEQ ID NO: 777042 - DNA, 22 bp, Artificial Sequence
  chemically synthesized
tgacaagaagcataatgtctgt

SEQ ID NO: 777043 - DNA, 22 bp, Artificial Sequence
  chemically synthesized
cctctgacaagaagcataatgt

SEQ ID NO: 777044 - DNA, 22 bp, Artificial Sequence
  chemically synthesized
gctgctacagacattatgcttc

SEQ ID NO: 777045 - DNA, 22 bp, Artificial Sequence
  chemically synthesized
ctacagacattatgcttcttgt

SEQ ID NO: 777046 - DNA, 22 bp, Artificial Sequence
  chemically synthesized
cagacattatgcttcttgtcag

SEQ ID NO: 777047 - DNA, 22 bp, Artificial Sequence
  chemically synthesized
tgcttcttgtcagaggcaatgt

SEQ ID NO: 777048 - DNA, 22 bp, Artificial Sequence
  chemically synthesized
cttgtcagaggcaatgtgggtc

SEQ ID NO: 777049 - DNA, 22 bp, Artificial Sequence
  chemically synthesized
gaggtaaagcatgacccacatt

SEQ ID NO: 777050 - DNA, 22 bp, Artificial Sequence
  chemically synthesized
ttgtcagaggcaatgtgggtca

SEQ ID NO: 777051 - DNA, 22 bp, Artificial Sequence
  chemically synthesized
agaggtaaagcatgacccacat

SEQ ID NO: 777052 - DNA, 22 bp, Artificial Sequence
  chemically synthesized
gtcagaggcaatgtgggtcatg

SEQ ID NO: 777053 - DNA, 22 bp, Artificial Sequence
  chemically synthesized
tcagaggcaatgtgggtcatgc

SEQ ID NO: 777054 - DNA, 22 bp, Artificial Sequence
  chemically synthesized
tttagaggtaaagcatgaccca

SEQ ID NO: 777055 - DNA, 22 bp, Artificial Sequence
  chemically synthesized
tgtttagaggtaaagcatgacc

SEQ ID NO: 777056 - DNA, 22 bp, Artificial Sequence
  chemically synthesized
ttctgtttagaggtaaagcatg

SEQ ID NO: 777057 - DNA, 22 bp, Artificial Sequence
  chemically synthesized
tacctctaaacagaatagcccc

SEQ ID NO: 777058 - DNA, 22 bp, Artificial Sequence
  chemically synthesized
tgtcatagatagggggctattc

SEQ ID NO: 777059 - DNA, 22 bp, Artificial Sequence
  chemically synthesized
acctctaaacagaatagccccc

SEQ ID NO: 777060 - DNA, 22 bp, Artificial Sequence
  chemically synthesized
cctctaaacagaatagccccct

SEQ ID NO: 777061 - DNA, 22 bp, Artificial Sequence
  chemically synthesized
tatgtcatagatagggggctat

SEQ ID NO: 777062 - DNA, 22 bp, Artificial Sequence
  chemically synthesized
ttctatgtcatagatagggggc

SEQ ID NO: 777063 - DNA, 22 bp, Artificial Sequence
  chemically synthesized
taaacagaatagccccctatct

SEQ ID NO: 777064 - DNA, 22 bp, Artificial Sequence
  chemically synthesized
aacagaatagccccctatctat

SEQ ID NO: 777065 - DNA, 22 bp, Artificial Sequence
  chemically synthesized
ctattctatgtcatagataggg

SEQ ID NO: 777066 - DNA, 22 bp, Artificial Sequence
  chemically synthesized
cctattctatgtcatagatagg

SEQ ID NO: 777067 - DNA, 22 bp, Artificial Sequence
  chemically synthesized
caggcatttcctattctatgtc

SEQ ID NO: 777068 - DNA, 22 bp, Artificial Sequence
  chemically synthesized
cctgcaggcatttcctattcta

SEQ ID NO: 777069 - DNA, 22 bp, Artificial Sequence
  chemically synthesized
tctatgacatagaataggaaat

SEQ ID NO: 777070 - DNA, 22 bp, Artificial Sequence
  chemically synthesized
tgacatagaataggaaatgcct

SEQ ID NO: 777071 - DNA, 22 bp, Artificial Sequence
  chemically synthesized
ataagaccagatccctgcctgc

SEQ ID NO: 777072 - DNA, 22 bp, Artificial Sequence
  chemically synthesized
caggcagggatctggtcttatt

SEQ ID NO: 777073 - DNA, 22 bp, Artificial Sequence
  chemically synthesized
gagatatgaagattaataagac

SEQ ID NO: 777074 - DNA, 22 bp, Artificial Sequence
  chemically synthesized
gtcttattaatcttcatatctc

SEQ ID NO: 777075 - DNA, 22 bp, Artificial Sequence
  chemically synthesized
attaatcttcatatctctaaca

SEQ ID NO: 777076 - DNA, 22 bp, Artificial Sequence
  chemically synthesized
ttaatcttcatatctctaacac

SEQ ID NO: 777077 - DNA, 22 bp, Artificial Sequence
  chemically synthesized
agaacagaaagagtgttagaga

SEQ ID NO: 777078 - DNA, 22 bp, Artificial Sequence
  chemically synthesized
atcttcatatctctaacactct

SEQ ID NO: 777079 - DNA, 22 bp, Artificial Sequence
  chemically synthesized
tgtgctaagaacagaaagagtg

SEQ ID NO: 777080 - DNA, 22 bp, Artificial Sequence
  chemically synthesized
catatctctaacactctttctg

SEQ ID NO: 777081 - DNA, 22 bp, Artificial Sequence
  chemically synthesized
atatctctaacactctttctgt

SEQ ID NO: 777082 - DNA, 22 bp, Artificial Sequence
  chemically synthesized
taacactctttctgttcttagc

SEQ ID NO: 777083 - DNA, 22 bp, Artificial Sequence
  chemically synthesized
acactctttctgttcttagcac

SEQ ID NO: 777084 - DNA, 22 bp, Artificial Sequence
  chemically synthesized
agaatagtctatgtgctaagaa

SEQ ID NO: 777085 - DNA, 22 bp, Artificial Sequence
  chemically synthesized
tttctgttcttagcacatagac

SEQ ID NO: 777086 - DNA, 22 bp, Artificial Sequence
  chemically synthesized
tctgttcttagcacatagacta

SEQ ID NO: 777087 - DNA, 22 bp, Artificial Sequence
  chemically synthesized
acgtattaagaatagtctatgt

SEQ ID NO: 777088 - DNA, 22 bp, Artificial Sequence
  chemically synthesized
ctgttcttagcacatagactat

SEQ ID NO: 777089 - DNA, 22 bp, Artificial Sequence
  chemically synthesized
tgttcttagcacatagactatt

SEQ ID NO: 777090 - DNA, 22 bp, Artificial Sequence
  chemically synthesized
ttcttagcacatagactattct

SEQ ID NO: 777091 - DNA, 22 bp, Artificial Sequence
  chemically synthesized
attcacgtattaagaatagtct

SEQ ID NO: 777092 - DNA, 22 bp, Artificial Sequence
  chemically synthesized
ttagcacatagactattcttaa

SEQ ID NO: 777093 - DNA, 22 bp, Artificial Sequence
  chemically synthesized
attcattcacgtattaagaata

SEQ ID NO: 777094 - DNA, 22 bp, Artificial Sequence
  chemically synthesized
agcacatagactattcttaata

SEQ ID NO: 777095 - DNA, 22 bp, Artificial Sequence
  chemically synthesized
cattcattcacgtattaagaat

SEQ ID NO: 777096 - DNA, 22 bp, Artificial Sequence
  chemically synthesized
gcacatagactattcttaatac

SEQ ID NO: 777097 - DNA, 22 bp, Artificial Sequence
  chemically synthesized
cttcattcattcacgtattaag

SEQ ID NO: 777098 - DNA, 22 bp, Artificial Sequence
  chemically synthesized
attccttcattcattcacgtat

SEQ ID NO: 777099 - DNA, 22 bp, Artificial Sequence
  chemically synthesized
cattccttcattcattcacgta

SEQ ID NO: 777100 - DNA, 22 bp, Artificial Sequence
  chemically synthesized
ttcattccttcattcattcacg

SEQ ID NO: 777101 - DNA, 22 bp, Artificial Sequence
  chemically synthesized
ttcttaatacgtgaatgaatga

SEQ ID NO: 777102 - DNA, 22 bp, Artificial Sequence
  chemically synthesized
attcttcattccttcattcatt

SEQ ID NO: 777103 - DNA, 22 bp, Artificial Sequence
  chemically synthesized
ttaatacgtgaatgaatgaagg

SEQ ID NO: 777104 - DNA, 22 bp, Artificial Sequence
  chemically synthesized
aatacgtgaatgaatgaaggaa

SEQ ID NO: 777105 - DNA, 22 bp, Artificial Sequence
  chemically synthesized
attcattcttcattccttcatt

SEQ ID NO: 777106 - DNA, 22 bp, Artificial Sequence
  chemically synthesized
atacgtgaatgaatgaaggaat

SEQ ID NO: 777107 - DNA, 22 bp, Artificial Sequence
  chemically synthesized
aatagccgttcattcattcttc

SEQ ID NO: 777108 - DNA, 22 bp, Artificial Sequence
  chemically synthesized
caatagccgttcattcattctt

SEQ ID NO: 777109 - DNA, 22 bp, Artificial Sequence
  chemically synthesized
tcaatagccgttcattcattct

SEQ ID NO: 777110 - DNA, 22 bp, Artificial Sequence
  chemically synthesized
atatctttcaatagccgttcat

SEQ ID NO: 777111 - DNA, 22 bp, Artificial Sequence
  chemically synthesized
ttgaaagatatcaatcttcatt

SEQ ID NO: 777112 - DNA, 22 bp, Artificial Sequence
  chemically synthesized
aaagatatcaatcttcattttc

SEQ ID NO: 777113 - DNA, 22 bp, Artificial Sequence
  chemically synthesized
acagtgggaaaggaaaatgaag

SEQ ID NO: 777114 - DNA, 22 bp, Artificial Sequence
  chemically synthesized
aacagtgggaaaggaaaatgaa

SEQ ID NO: 777115 - DNA, 22 bp, Artificial Sequence
  chemically synthesized
taacagtgggaaaggaaaatga

SEQ ID NO: 777116 - DNA, 22 bp, Artificial Sequence
  chemically synthesized
ttaacagtgggaaaggaaaatg

SEQ ID NO: 777117 - DNA, 22 bp, Artificial Sequence
  chemically synthesized
atttttaacagtgggaaaggaa

SEQ ID NO: 777118 - DNA, 22 bp, Artificial Sequence
  chemically synthesized
gatttttaacagtgggaaagga

SEQ ID NO: 777119 - DNA, 22 bp, Artificial Sequence
  chemically synthesized
tgatttttaacagtgggaaagg

SEQ ID NO: 777120 - DNA, 22 bp, Artificial Sequence
  chemically synthesized
cattttcctttcccactgttaa

SEQ ID NO: 777121 - DNA, 22 bp, Artificial Sequence
  chemically synthesized
tcgctttgatttttaacagtgg

SEQ ID NO: 777122 - DNA, 22 bp, Artificial Sequence
  chemically synthesized
attttcctttcccactgttaaa

SEQ ID NO: 777123 - DNA, 22 bp, Artificial Sequence
  chemically synthesized
tcctttcccactgttaaaaatc

SEQ ID NO: 777124 - DNA, 22 bp, Artificial Sequence
  chemically synthesized
agttatcgctttgatttttaac

SEQ ID NO: 777125 - DNA, 22 bp, Artificial Sequence
  chemically synthesized
cctttcccactgttaaaaatca

SEQ ID NO: 777126 - DNA, 22 bp, Artificial Sequence
  chemically synthesized
gagttatcgctttgatttttaa

SEQ ID NO: 777127 - DNA, 22 bp, Artificial Sequence
  chemically synthesized
ctttcccactgttaaaaatcaa

SEQ ID NO: 777128 - DNA, 22 bp, Artificial Sequence
  chemically synthesized
tcccactgttaaaaatcaaagc

SEQ ID NO: 777129 - DNA, 22 bp, Artificial Sequence
  chemically synthesized
cccactgttaaaaatcaaagcg

SEQ ID NO: 777130 - DNA, 22 bp, Artificial Sequence
  chemically synthesized
ccactgttaaaaatcaaagcga

SEQ ID NO: 777131 - DNA, 22 bp, Artificial Sequence
  chemically synthesized
gaaatttgagttatcgctttga

SEQ ID NO: 777132 - DNA, 22 bp, Artificial Sequence
  chemically synthesized
attggaaatttgagttatcgct

SEQ ID NO: 777133 - DNA, 22 bp, Artificial Sequence
  chemically synthesized
ttaaaaatcaaagcgataactc

SEQ ID NO: 777134 - DNA, 22 bp, Artificial Sequence
  chemically synthesized
taattggaaatttgagttatcg

SEQ ID NO: 777135 - DNA, 22 bp, Artificial Sequence
  chemically synthesized
aaaatcaaagcgataactcaaa

SEQ ID NO: 777136 - DNA, 22 bp, Artificial Sequence
  chemically synthesized
attctaattggaaatttgagtt

SEQ ID NO: 777137 - DNA, 22 bp, Artificial Sequence
  chemically synthesized
cattctaattggaaatttgagt

SEQ ID NO: 777138 - DNA, 22 bp, Artificial Sequence
  chemically synthesized
gtatgtttcattctaattggaa

SEQ ID NO: 777139 - DNA, 22 bp, Artificial Sequence
  chemically synthesized
gaactggtatgtttcattctaa

SEQ ID NO: 777140 - DNA, 22 bp, Artificial Sequence
  chemically synthesized
aaatttccaattagaatgaaac

SEQ ID NO: 777141 - DNA, 22 bp, Artificial Sequence
  chemically synthesized
ccaattagaatgaaacatacca

SEQ ID NO: 777142 - DNA, 22 bp, Artificial Sequence
  chemically synthesized
caattagaatgaaacataccag

SEQ ID NO: 777143 - DNA, 22 bp, Artificial Sequence
  chemically synthesized
gaatgaaacataccagttctag

SEQ ID NO: 777144 - DNA, 22 bp, Artificial Sequence
  chemically synthesized
tcagaataccaactagaactgg

SEQ ID NO: 777145 - DNA, 22 bp, Artificial Sequence
  chemically synthesized
tgtcagaataccaactagaact

SEQ ID NO: 777146 - DNA, 22 bp, Artificial Sequence
  chemically synthesized
ctgtcagaataccaactagaac

SEQ ID NO: 777147 - DNA, 22 bp, Artificial Sequence
  chemically synthesized
tctgtcagaataccaactagaa

SEQ ID NO: 777148 - DNA, 22 bp, Artificial Sequence
  chemically synthesized
ttctgtcagaataccaactaga

SEQ ID NO: 777149 - DNA, 22 bp, Artificial Sequence
  chemically synthesized
tttctgtcagaataccaactag

SEQ ID NO: 777150 - DNA, 22 bp, Artificial Sequence
  chemically synthesized
cagtataattttttctgtcaga

SEQ ID NO: 777151 - DNA, 22 bp, Artificial Sequence
  chemically synthesized
tagttggtattctgacagaaaa

SEQ ID NO: 777152 - DNA, 22 bp, Artificial Sequence
  chemically synthesized
gttggtattctgacagaaaaaa

SEQ ID NO: 777153 - DNA, 22 bp, Artificial Sequence
  chemically synthesized
gtattctgacagaaaaaattat

SEQ ID NO: 777154 - DNA, 22 bp, Artificial Sequence
  chemically synthesized
tgacagaaaaaattatactgca

SEQ ID NO: 777155 - DNA, 22 bp, Artificial Sequence
  chemically synthesized
acagaaaaaattatactgcagg

SEQ ID NO: 777156 - DNA, 22 bp, Artificial Sequence
  chemically synthesized
gtgtaaaaatataacctgcagt

SEQ ID NO: 777157 - DNA, 22 bp, Artificial Sequence
  chemically synthesized
agtgtaaaaatataacctgcag

SEQ ID NO: 777158 - DNA, 22 bp, Artificial Sequence
  chemically synthesized
tagtgtaaaaatataacctgca

SEQ ID NO: 777159 - DNA, 22 bp, Artificial Sequence
  chemically synthesized
tactgcaggttatatttttaca

SEQ ID NO: 777160 - DNA, 22 bp, Artificial Sequence
  chemically synthesized
caggttatatttttacactaaa

SEQ ID NO: 777161 - DNA, 22 bp, Artificial Sequence
  chemically synthesized
cgtgatggaaaattttagtgta

SEQ ID NO: 777162 - DNA, 22 bp, Artificial Sequence
  chemically synthesized
tatttttacactaaaattttcc

SEQ ID NO: 777163 - DNA, 22 bp, Artificial Sequence
  chemically synthesized
cagttacgtgatggaaaatttt

SEQ ID NO: 777164 - DNA, 22 bp, Artificial Sequence
  chemically synthesized
attccagttacgtgatggaaaa

SEQ ID NO: 777165 - DNA, 22 bp, Artificial Sequence
  chemically synthesized
ttacactaaaattttccatcac

SEQ ID NO: 777166 - DNA, 22 bp, Artificial Sequence
  chemically synthesized
tacactaaaattttccatcacg

SEQ ID NO: 777167 - DNA, 22 bp, Artificial Sequence
  chemically synthesized
acactaaaattttccatcacgt

SEQ ID NO: 777168 - DNA, 22 bp, Artificial Sequence
  chemically synthesized
cactaaaattttccatcacgta

SEQ ID NO: 777169 - DNA, 22 bp, Artificial Sequence
  chemically synthesized
aaattttccatcacgtaactgg

SEQ ID NO: 777170 - DNA, 22 bp, Artificial Sequence
  chemically synthesized
gaataaattaattccagttacg

SEQ ID NO: 777171 - DNA, 22 bp, Artificial Sequence
  chemically synthesized
ggaataaattaattccagttac

SEQ ID NO: 777172 - DNA, 22 bp, Artificial Sequence
  chemically synthesized
tccatcacgtaactggaattaa

SEQ ID NO: 777173 - DNA, 22 bp, Artificial Sequence
  chemically synthesized
tcttggaataaattaattccag

SEQ ID NO: 777174 - DNA, 22 bp, Artificial Sequence
  chemically synthesized
ccatcacgtaactggaattaat

SEQ ID NO: 777175 - DNA, 22 bp, Artificial Sequence
  chemically synthesized
catcacgtaactggaattaatt

SEQ ID NO: 777176 - DNA, 22 bp, Artificial Sequence
  chemically synthesized
ctatcttggaataaattaattc

SEQ ID NO: 777177 - DNA, 22 bp, Artificial Sequence
  chemically synthesized
tactatcttggaataaattaat

SEQ ID NO: 777178 - DNA, 22 bp, Artificial Sequence
  chemically synthesized
ctactatcttggaataaattaa

SEQ ID NO: 777179 - DNA, 22 bp, Artificial Sequence
  chemically synthesized
gaattaatttattccaagatag

SEQ ID NO: 777180 - DNA, 22 bp, Artificial Sequence
  chemically synthesized
caccaatacatttctactatct

SEQ ID NO: 777181 - DNA, 22 bp, Artificial Sequence
  chemically synthesized
atttattccaagatagtagaaa

SEQ ID NO: 777182 - DNA, 22 bp, Artificial Sequence
  chemically synthesized
attccaagatagtagaaatgta

SEQ ID NO: 777183 - DNA, 22 bp, Artificial Sequence
  chemically synthesized
atactgcaccaatacatttcta

SEQ ID NO: 777184 - DNA, 22 bp, Artificial Sequence
  chemically synthesized
ttccaagatagtagaaatgtat

SEQ ID NO: 777185 - DNA, 22 bp, Artificial Sequence
  chemically synthesized
catactgcaccaatacatttct

SEQ ID NO: 777186 - DNA, 22 bp, Artificial Sequence
  chemically synthesized
caagatagtagaaatgtattgg

SEQ ID NO: 777187 - DNA, 22 bp, Artificial Sequence
  chemically synthesized
atttcatactgcaccaatacat

SEQ ID NO: 777188 - DNA, 22 bp, Artificial Sequence
  chemically synthesized
catttcatactgcaccaataca

SEQ ID NO: 777189 - DNA, 22 bp, Artificial Sequence
  chemically synthesized
aatccccttcatttcatactgc

SEQ ID NO: 777190 - DNA, 22 bp, Artificial Sequence
  chemically synthesized
aaatccccttcatttcatactg

SEQ ID NO: 777191 - DNA, 22 bp, Artificial Sequence
  chemically synthesized
tttaaatccccttcatttcata

SEQ ID NO: 777192 - DNA, 22 bp, Artificial Sequence
  chemically synthesized
tgttatttaaatccccttcatt

SEQ ID NO: 777193 - DNA, 22 bp, Artificial Sequence
  chemically synthesized
gtgcagtatgaaatgaagggga

SEQ ID NO: 777194 - DNA, 22 bp, Artificial Sequence
  chemically synthesized
ttatgttatttaaatccccttc

SEQ ID NO: 777195 - DNA, 22 bp, Artificial Sequence
  chemically synthesized
attatgttatttaaatcccctt

SEQ ID NO: 777196 - DNA, 22 bp, Artificial Sequence
  chemically synthesized
tattatgttatttaaatcccct

SEQ ID NO: 777197 - DNA, 22 bp, Artificial Sequence
  chemically synthesized
ttattatgttatttaaatcccc

SEQ ID NO: 777198 - DNA, 22 bp, Artificial Sequence
  chemically synthesized
tttattatgttatttaaatccc

SEQ ID NO: 777199 - DNA, 22 bp, Artificial Sequence
  chemically synthesized
tttttattatgttatttaaatc

SEQ ID NO: 777200 - DNA, 22 bp, Artificial Sequence
  chemically synthesized
ctttttattatgttatttaaat

SEQ ID NO: 777201 - DNA, 22 bp, Artificial Sequence
  chemically synthesized
ttctttttattatgttatttaa

SEQ ID NO: 777202 - DNA, 22 bp, Artificial Sequence
  chemically synthesized
taatgttcttctttttattatg

SEQ ID NO: 777203 - DNA, 22 bp, Artificial Sequence
  chemically synthesized
aaataacataataaaaagaaga

SEQ ID NO: 777204 - DNA, 22 bp, Artificial Sequence
  chemically synthesized
aataacataataaaaagaagaa

SEQ ID NO: 777205 - DNA, 22 bp, Artificial Sequence
  chemically synthesized
aacagattgtaatgttcttctt

SEQ ID NO: 777206 - DNA, 22 bp, Artificial Sequence
  chemically synthesized
tgttaaacagattgtaatgttc

SEQ ID NO: 777207 - DNA, 22 bp, Artificial Sequence
  chemically synthesized
ggttatgttaaacagattgtaa

SEQ ID NO: 777208 - DNA, 22 bp, Artificial Sequence
  chemically synthesized
ccagggttaggttatgttaaac

SEQ ID NO: 777209 - DNA, 22 bp, Artificial Sequence
  chemically synthesized
cccagggttaggttatgttaaa

SEQ ID NO: 777210 - DNA, 22 bp, Artificial Sequence
  chemically synthesized
caatctgtttaacataacctaa

SEQ ID NO: 777211 - DNA, 22 bp, Artificial Sequence
  chemically synthesized
atcttcccagggttaggttatg

SEQ ID NO: 777212 - DNA, 22 bp, Artificial Sequence
  chemically synthesized
ttaatcttcccagggttaggtt

SEQ ID NO: 777213 - DNA, 22 bp, Artificial Sequence
  chemically synthesized
tttaacataacctaaccctggg

SEQ ID NO: 777214 - DNA, 22 bp, Artificial Sequence
  chemically synthesized
aacataacctaaccctgggaag

SEQ ID NO: 777215 - DNA, 22 bp, Artificial Sequence
  chemically synthesized
aaagctattaatcttcccaggg

SEQ ID NO: 777216 - DNA, 22 bp, Artificial Sequence
  chemically synthesized
acataacctaaccctgggaaga

SEQ ID NO: 777217 - DNA, 22 bp, Artificial Sequence
  chemically synthesized
tatgaattgaaagctattaatc

SEQ ID NO: 777218 - DNA, 22 bp, Artificial Sequence
  chemically synthesized
gtatgaattgaaagctattaat

SEQ ID NO: 777219 - DNA, 22 bp, Artificial Sequence
  chemically synthesized
accctgggaagattaatagctt

SEQ ID NO: 777220 - DNA, 22 bp, Artificial Sequence
  chemically synthesized
tgtatgaattgaaagctattaa

SEQ ID NO: 777221 - DNA, 22 bp, Artificial Sequence
  chemically synthesized
ggaagattaatagctttcaatt

SEQ ID NO: 777222 - DNA, 22 bp, Artificial Sequence
  chemically synthesized
agtctttgtatgaattgaaagc

SEQ ID NO: 777223 - DNA, 22 bp, Artificial Sequence
  chemically synthesized
cagtctttgtatgaattgaaag

SEQ ID NO: 777224 - DNA, 22 bp, Artificial Sequence
  chemically synthesized
tagacttcagtctttgtatgaa

SEQ ID NO: 777225 - DNA, 22 bp, Artificial Sequence
  chemically synthesized
atagctttcaattcatacaaag

SEQ ID NO: 777226 - DNA, 22 bp, Artificial Sequence
  chemically synthesized
tcaattcatacaaagactgaag

SEQ ID NO: 777227 - DNA, 22 bp, Artificial Sequence
  chemically synthesized
caattcatacaaagactgaagt

SEQ ID NO: 777228 - DNA, 22 bp, Artificial Sequence
  chemically synthesized
aattcatacaaagactgaagtc

SEQ ID NO: 777229 - DNA, 22 bp, Artificial Sequence
  chemically synthesized
atacaaagactgaagtctacaa

SEQ ID NO: 777230 - DNA, 22 bp, Artificial Sequence
  chemically synthesized
ataagaccatgtgtatatgaaa

SEQ ID NO: 777231 - DNA, 22 bp, Artificial Sequence
  chemically synthesized
aataagaccatgtgtatatgaa

SEQ ID NO: 777232 - DNA, 22 bp, Artificial Sequence
  chemically synthesized
aagtctacaatttcatatacac

SEQ ID NO: 777233 - DNA, 22 bp, Artificial Sequence
  chemically synthesized
taataagaccatgtgtatatga

SEQ ID NO: 777234 - DNA, 22 bp, Artificial Sequence
  chemically synthesized
ttaataagaccatgtgtatatg

SEQ ID NO: 777235 - DNA, 22 bp, Artificial Sequence
  chemically synthesized
atttttaataagaccatgtgta

SEQ ID NO: 777236 - DNA, 22 bp, Artificial Sequence
  chemically synthesized
catttttaataagaccatgtgt

SEQ ID NO: 777237 - DNA, 22 bp, Artificial Sequence
  chemically synthesized
caatttcatatacacatggtct

SEQ ID NO: 777238 - DNA, 22 bp, Artificial Sequence
  chemically synthesized
tcatttttaataagaccatgtg

SEQ ID NO: 777239 - DNA, 22 bp, Artificial Sequence
  chemically synthesized
catatacacatggtcttattaa

SEQ ID NO: 777240 - DNA, 22 bp, Artificial Sequence
  chemically synthesized
atatacacatggtcttattaaa

SEQ ID NO: 777241 - DNA, 22 bp, Artificial Sequence
  chemically synthesized
taaccagctttcatttttaata

SEQ ID NO: 777242 - DNA, 22 bp, Artificial Sequence
  chemically synthesized
attataaccagctttcattttt

SEQ ID NO: 777243 - DNA, 22 bp, Artificial Sequence
  chemically synthesized
cattataaccagctttcatttt

SEQ ID NO: 777244 - DNA, 22 bp, Artificial Sequence
  chemically synthesized
gcatttcattataaccagcttt

SEQ ID NO: 777245 - DNA, 22 bp, Artificial Sequence
  chemically synthesized
attaaaaatgaaagctggttat

SEQ ID NO: 777246 - DNA, 22 bp, Artificial Sequence
  chemically synthesized
ttaaaaatgaaagctggttata

SEQ ID NO: 777247 - DNA, 22 bp, Artificial Sequence
  chemically synthesized
aaaatgaaagctggttataatg

SEQ ID NO: 777248 - DNA, 22 bp, Artificial Sequence
  chemically synthesized
gcgtggtgctagcatttcatta

SEQ ID NO: 777249 - DNA, 22 bp, Artificial Sequence
  chemically synthesized
agcgtggtgctagcatttcatt

SEQ ID NO: 777250 - DNA, 22 bp, Artificial Sequence
  chemically synthesized
gttataatgaaatgctagcacc

SEQ ID NO: 777251 - DNA, 22 bp, Artificial Sequence
  chemically synthesized
taatgaaatgctagcaccacgc

SEQ ID NO: 777252 - DNA, 22 bp, Artificial Sequence
  chemically synthesized
atacaccatgccaatcttagcg

SEQ ID NO: 777253 - DNA, 22 bp, Artificial Sequence
  chemically synthesized
catacaccatgccaatcttagc

SEQ ID NO: 777254 - DNA, 22 bp, Artificial Sequence
  chemically synthesized
tttcatacaccatgccaatctt

SEQ ID NO: 777255 - DNA, 22 bp, Artificial Sequence
  chemically synthesized
gcaccacgctaagattggcatg

SEQ ID NO: 777256 - DNA, 22 bp, Artificial Sequence
  chemically synthesized
tctatttcatacaccatgccaa

SEQ ID NO: 777257 - DNA, 22 bp, Artificial Sequence
  chemically synthesized
gtctatttcatacaccatgcca

SEQ ID NO: 777258 - DNA, 22 bp, Artificial Sequence
  chemically synthesized
gtttgtctatttcatacaccat

SEQ ID NO: 777259 - DNA, 22 bp, Artificial Sequence
  chemically synthesized
ttagtttgtctatttcatacac

SEQ ID NO: 777260 - DNA, 22 bp, Artificial Sequence
  chemically synthesized
agattggcatggtgtatgaaat

SEQ ID NO: 777261 - DNA, 22 bp, Artificial Sequence
  chemically synthesized
gcatggtgtatgaaatagacaa

SEQ ID NO: 777262 - DNA, 22 bp, Artificial Sequence
  chemically synthesized
ccacactgttagtttgtctatt

SEQ ID NO: 777263 - DNA, 22 bp, Artificial Sequence
  chemically synthesized
ttgccacactgttagtttgtct

SEQ ID NO: 777264 - DNA, 22 bp, Artificial Sequence
  chemically synthesized
caactattgccacactgttagt

SEQ ID NO: 777265 - DNA, 22 bp, Artificial Sequence
  chemically synthesized
cacctccaactattgccacact

SEQ ID NO: 777266 - DNA, 22 bp, Artificial Sequence
  chemically synthesized
tgaaattccacctccaactatt

SEQ ID NO: 777267 - DNA, 22 bp, Artificial Sequence
  chemically synthesized
acagtgtggcaatagttggagg

SEQ ID NO: 777268 - DNA, 22 bp, Artificial Sequence
  chemically synthesized
tcctatgaaattccacctccaa

SEQ ID NO: 777269 - DNA, 22 bp, Artificial Sequence
  chemically synthesized
aaaagttatcctatgaaattcc

SEQ ID NO: 777270 - DNA, 22 bp, Artificial Sequence
  chemically synthesized
gaactaaaaagttatcctatga

SEQ ID NO: 777271 - DNA, 22 bp, Artificial Sequence
  chemically synthesized
gaggtggaatttcataggataa

SEQ ID NO: 777272 - DNA, 22 bp, Artificial Sequence
  chemically synthesized
ggaactaaaaagttatcctatg

SEQ ID NO: 777273 - DNA, 22 bp, Artificial Sequence
  chemically synthesized
tggaactaaaaagttatcctat

SEQ ID NO: 777274 - DNA, 22 bp, Artificial Sequence
  chemically synthesized
accattttggaactaaaaagtt

SEQ ID NO: 777275 - DNA, 22 bp, Artificial Sequence
  chemically synthesized
gaccattttggaactaaaaagt

SEQ ID NO: 777276 - DNA, 22 bp, Artificial Sequence
  chemically synthesized
cataggataactttttagttcc

SEQ ID NO: 777277 - DNA, 22 bp, Artificial Sequence
  chemically synthesized
ataggataactttttagttcca

SEQ ID NO: 777278 - DNA, 22 bp, Artificial Sequence
  chemically synthesized
tgtgatttgaccattttggaac

SEQ ID NO: 777279 - DNA, 22 bp, Artificial Sequence
  chemically synthesized
tttagttccaaaatggtcaaat

SEQ ID NO: 777280 - DNA, 22 bp, Artificial Sequence
  chemically synthesized
ttagttccaaaatggtcaaatc

SEQ ID NO: 777281 - DNA, 22 bp, Artificial Sequence
  chemically synthesized
cagccattgtgtgatttgacca

SEQ ID NO: 777282 - DNA, 22 bp, Artificial Sequence
  chemically synthesized
tagttccaaaatggtcaaatca

SEQ ID NO: 777283 - DNA, 22 bp, Artificial Sequence
  chemically synthesized
agttccaaaatggtcaaatcac

SEQ ID NO: 777284 - DNA, 22 bp, Artificial Sequence
  chemically synthesized
gttccaaaatggtcaaatcaca

SEQ ID NO: 777285 - DNA, 22 bp, Artificial Sequence
  chemically synthesized
tatctccagccattgtgtgatt

SEQ ID NO: 777286 - DNA, 22 bp, Artificial Sequence
  chemically synthesized
caaaatggtcaaatcacacaat

SEQ ID NO: 777287 - DNA, 22 bp, Artificial Sequence
  chemically synthesized
attatatctccagccattgtgt

SEQ ID NO: 777288 - DNA, 22 bp, Artificial Sequence
  chemically synthesized
aattatatctccagccattgtg

SEQ ID NO: 777289 - DNA, 22 bp, Artificial Sequence
  chemically synthesized
ttaattatatctccagccattg

SEQ ID NO: 777290 - DNA, 22 bp, Artificial Sequence
  chemically synthesized
attcttaattatatctccagcc

SEQ ID NO: 777291 - DNA, 22 bp, Artificial Sequence
  chemically synthesized
gagcctaattcttaattatatc

SEQ ID NO: 777292 - DNA, 22 bp, Artificial Sequence
  chemically synthesized
agagcctaattcttaattatat

SEQ ID NO: 777293 - DNA, 22 bp, Artificial Sequence
  chemically synthesized
tagagcctaattcttaattata

SEQ ID NO: 777294 - DNA, 22 bp, Artificial Sequence
  chemically synthesized
ttagagcctaattcttaattat

SEQ ID NO: 777295 - DNA, 22 bp, Artificial Sequence
  chemically synthesized
tttttagagcctaattcttaat

SEQ ID NO: 777296 - DNA, 22 bp, Artificial Sequence
  chemically synthesized
gtttttagagcctaattcttaa

SEQ ID NO: 777297 - DNA, 22 bp, Artificial Sequence
  chemically synthesized
gagatataattaagaattaggc

SEQ ID NO: 777298 - DNA, 22 bp, Artificial Sequence
  chemically synthesized
agaatttgtttttagagcctaa

SEQ ID NO: 777299 - DNA, 22 bp, Artificial Sequence
  chemically synthesized
cagaatttgtttttagagccta

SEQ ID NO: 777300 - DNA, 22 bp, Artificial Sequence
  chemically synthesized
tttcagaatttgtttttagagc

SEQ ID NO: 777301 - DNA, 22 bp, Artificial Sequence
  chemically synthesized
tgtttcagaatttgtttttaga

SEQ ID NO: 777302 - DNA, 22 bp, Artificial Sequence
  chemically synthesized
ctgtttcagaatttgtttttag

SEQ ID NO: 777303 - DNA, 22 bp, Artificial Sequence
  chemically synthesized
agaattaggctctaaaaacaaa

SEQ ID NO: 777304 - DNA, 22 bp, Artificial Sequence
  chemically synthesized
ccttctgtttcagaatttgttt

SEQ ID NO: 777305 - DNA, 22 bp, Artificial Sequence
  chemically synthesized
ggctctaaaaacaaattctgaa

SEQ ID NO: 777306 - DNA, 22 bp, Artificial Sequence
  chemically synthesized
attaccttctgtttcagaattt

SEQ ID NO: 777307 - DNA, 22 bp, Artificial Sequence
  chemically synthesized
taaaaacaaattctgaaacaga

SEQ ID NO: 777308 - DNA, 22 bp, Artificial Sequence
  chemically synthesized
aaaacaaattctgaaacagaag

SEQ ID NO: 777309 - DNA, 22 bp, Artificial Sequence
  chemically synthesized
cccgaagatatattaattacct

SEQ ID NO: 777310 - DNA, 22 bp, Artificial Sequence
  chemically synthesized
ccccgaagatatattaattacc

SEQ ID NO: 777311 - DNA, 22 bp, Artificial Sequence
  chemically synthesized
tccccgaagatatattaattac

SEQ ID NO: 777312 - DNA, 22 bp, Artificial Sequence
  chemically synthesized
tgaaacagaaggtaattaatat

SEQ ID NO: 777313 - DNA, 22 bp, Artificial Sequence
  chemically synthesized
aaacagaaggtaattaatatat

SEQ ID NO: 777314 - DNA, 22 bp, Artificial Sequence
  chemically synthesized
aaaatccagctttccccgaaga

SEQ ID NO: 777315 - DNA, 22 bp, Artificial Sequence
  chemically synthesized
attaaaaatccagctttccccg

SEQ ID NO: 777316 - DNA, 22 bp, Artificial Sequence
  chemically synthesized
atatatcttcggggaaagctgg

SEQ ID NO: 777317 - DNA, 22 bp, Artificial Sequence
  chemically synthesized
attcattaaaaatccagctttc

SEQ ID NO: 777318 - DNA, 22 bp, Artificial Sequence
  chemically synthesized
cggggaaagctggatttttaat

SEQ ID NO: 777319 - DNA, 22 bp, Artificial Sequence
  chemically synthesized
ggggaaagctggatttttaatg

SEQ ID NO: 777320 - DNA, 22 bp, Artificial Sequence
  chemically synthesized
cggtcatgtctgattcattaaa

SEQ ID NO: 777321 - DNA, 22 bp, Artificial Sequence
  chemically synthesized
tgcggtcatgtctgattcatta

SEQ ID NO: 777322 - DNA, 22 bp, Artificial Sequence
  chemically synthesized
tctgcggtcatgtctgattcat

SEQ ID NO: 777323 - DNA, 22 bp, Artificial Sequence
  chemically synthesized
ctctgcggtcatgtctgattca

SEQ ID NO: 777324 - DNA, 22 bp, Artificial Sequence
  chemically synthesized
tctctgcggtcatgtctgattc

SEQ ID NO: 777325 - DNA, 22 bp, Artificial Sequence
  chemically synthesized
gatttttaatgaatcagacatg

SEQ ID NO: 777326 - DNA, 22 bp, Artificial Sequence
  chemically synthesized
ttaatgaatcagacatgaccgc

SEQ ID NO: 777327 - DNA, 22 bp, Artificial Sequence
  chemically synthesized
taatgaatcagacatgaccgca

SEQ ID NO: 777328 - DNA, 22 bp, Artificial Sequence
  chemically synthesized
aatgaatcagacatgaccgcag

SEQ ID NO: 777329 - DNA, 22 bp, Artificial Sequence
  chemically synthesized
atgaatcagacatgaccgcaga

SEQ ID NO: 777330 - DNA, 22 bp, Artificial Sequence
  chemically synthesized
agagagtacagggcaacatcga

SEQ ID NO: 777331 - DNA, 22 bp, Artificial Sequence
  chemically synthesized
accagactaagagagtacaggg

SEQ ID NO: 777332 - DNA, 22 bp, Artificial Sequence
  chemically synthesized
gctaaccagactaagagagtac

SEQ ID NO: 777333 - DNA, 22 bp, Artificial Sequence
  chemically synthesized
gatgttgccctgtactctctta

SEQ ID NO: 777334 - DNA, 22 bp, Artificial Sequence
  chemically synthesized
agctaaccagactaagagagta

SEQ ID NO: 777335 - DNA, 22 bp, Artificial Sequence
  chemically synthesized
tagctaaccagactaagagagt

SEQ ID NO: 777336 - DNA, 22 bp, Artificial Sequence
  chemically synthesized
ccctgtactctcttagtctggt

SEQ ID NO: 777337 - DNA, 22 bp, Artificial Sequence
  chemically synthesized
tactctcttagtctggttagct

SEQ ID NO: 777338 - DNA, 22 bp, Artificial Sequence
  chemically synthesized
gtgtggggtggttttagctaac

SEQ ID NO: 777339 - DNA, 22 bp, Artificial Sequence
  chemically synthesized
tcttagtctggttagctaaaac

SEQ ID NO: 777340 - DNA, 22 bp, Artificial Sequence
  chemically synthesized
ttagtctggttagctaaaacca

SEQ ID NO: 777341 - DNA, 22 bp, Artificial Sequence
  chemically synthesized
agtctggttagctaaaaccacc

SEQ ID NO: 777342 - DNA, 22 bp, Artificial Sequence
  chemically synthesized
gtctggttagctaaaaccaccc

SEQ ID NO: 777343 - DNA, 22 bp, Artificial Sequence
  chemically synthesized
ggaggtccctagtgtggggtgg

SEQ ID NO: 777344 - DNA, 22 bp, Artificial Sequence
  chemically synthesized
gttagctaaaaccaccccacac

SEQ ID NO: 777345 - DNA, 22 bp, Artificial Sequence
  chemically synthesized
gctaaaaccaccccacactagg

SEQ ID NO: 777346 - DNA, 22 bp, Artificial Sequence
  chemically synthesized
aaaccaccccacactagggacc

SEQ ID NO: 777347 - DNA, 22 bp, Artificial Sequence
  chemically synthesized
accccatgcactaggaggtccc

SEQ ID NO: 777348 - DNA, 22 bp, Artificial Sequence
  chemically synthesized
aaccccatgcactaggaggtcc

SEQ ID NO: 777349 - DNA, 22 bp, Artificial Sequence
  chemically synthesized
gggacctcctagtgcatggggt

SEQ ID NO: 777350 - DNA, 22 bp, Artificial Sequence
  chemically synthesized
acaaatgtgaaatttaacccca

SEQ ID NO: 777351 - DNA, 22 bp, Artificial Sequence
  chemically synthesized
ctcacaaatgtgaaatttaacc

SEQ ID NO: 777352 - DNA, 22 bp, Artificial Sequence
  chemically synthesized
ctagtgcatggggttaaatttc

SEQ ID NO: 777353 - DNA, 22 bp, Artificial Sequence
  chemically synthesized
ctgctcacaaatgtgaaattta

SEQ ID NO: 777354 - DNA, 22 bp, Artificial Sequence
  chemically synthesized
gtgcatggggttaaatttcaca

SEQ ID NO: 777355 - DNA, 22 bp, Artificial Sequence
  chemically synthesized
actgctcacaaatgtgaaattt

SEQ ID NO: 777356 - DNA, 22 bp, Artificial Sequence
  chemically synthesized
aatttcacatttgtgagcagta

SEQ ID NO: 777357 - DNA, 22 bp, Artificial Sequence
  chemically synthesized
cacatttgtgagcagtaagcat

SEQ ID NO: 777358 - DNA, 22 bp, Artificial Sequence
  chemically synthesized
acatttgtgagcagtaagcatg

SEQ ID NO: 777359 - DNA, 22 bp, Artificial Sequence
  chemically synthesized
gtgagcagtaagcatgtgtttg

SEQ ID NO: 777360 - DNA, 22 bp, Artificial Sequence
  chemically synthesized
caagagtgccagcaaacacatg

SEQ ID NO: 777361 - DNA, 22 bp, Artificial Sequence
  chemically synthesized
tgagcagtaagcatgtgtttgc

SEQ ID NO: 777362 - DNA, 22 bp, Artificial Sequence
  chemically synthesized
gctggcactcttgcagcatact

SEQ ID NO: 777363 - DNA, 22 bp, Artificial Sequence
  chemically synthesized
cacagcatgcccagtatgctgc

SEQ ID NO: 777364 - DNA, 22 bp, Artificial Sequence
  chemically synthesized
ctggcactcttgcagcatactg

SEQ ID NO: 777365 - DNA, 22 bp, Artificial Sequence
  chemically synthesized
ccacagcatgcccagtatgctg

SEQ ID NO: 777366 - DNA, 22 bp, Artificial Sequence
  chemically synthesized
gcactcttgcagcatactgggc

SEQ ID NO: 777367 - DNA, 22 bp, Artificial Sequence
  chemically synthesized
atccttccacagcatgcccagt

SEQ ID NO: 777368 - DNA, 22 bp, Artificial Sequence
  chemically synthesized
tgatccttccacagcatgccca

SEQ ID NO: 777369 - DNA, 22 bp, Artificial Sequence
  chemically synthesized
ttgcagcatactgggcatgctg

SEQ ID NO: 777370 - DNA, 22 bp, Artificial Sequence
  chemically synthesized
tctgatccttccacagcatgcc

SEQ ID NO: 777371 - DNA, 22 bp, Artificial Sequence
  chemically synthesized
gcagcatactgggcatgctgtg

SEQ ID NO: 777372 - DNA, 22 bp, Artificial Sequence
  chemically synthesized
cagcatactgggcatgctgtgg

SEQ ID NO: 777373 - DNA, 22 bp, Artificial Sequence
  chemically synthesized
caaaaattctctgatccttcca

SEQ ID NO: 777374 - DNA, 22 bp, Artificial Sequence
  chemically synthesized
ggcatgctgtggaaggatcaga

SEQ ID NO: 777375 - DNA, 22 bp, Artificial Sequence
  chemically synthesized
gtgcacaattccaaaaattctc

SEQ ID NO: 777376 - DNA, 22 bp, Artificial Sequence
  chemically synthesized
tggaaggatcagagaatttttg

SEQ ID NO: 777377 - DNA, 22 bp, Artificial Sequence
  chemically synthesized
agtgcacaattccaaaaattct

SEQ ID NO: 777378 - DNA, 22 bp, Artificial Sequence
  chemically synthesized
tatagaacaaagacatttagtg

SEQ ID NO: 777379 - DNA, 22 bp, Artificial Sequence
  chemically synthesized
ttggaattgtgcactaaatgtc

SEQ ID NO: 777380 - DNA, 22 bp, Artificial Sequence
  chemically synthesized
tggaattgtgcactaaatgtct

SEQ ID NO: 777381 - DNA, 22 bp, Artificial Sequence
  chemically synthesized
ggaattgtgcactaaatgtctt

SEQ ID NO: 777382 - DNA, 22 bp, Artificial Sequence
  chemically synthesized
gaattgtgcactaaatgtcttt

SEQ ID NO: 777383 - DNA, 22 bp, Artificial Sequence
  chemically synthesized
aaactgtatagaacaaagacat

SEQ ID NO: 777384 - DNA, 22 bp, Artificial Sequence
  chemically synthesized
aaaactgtatagaacaaagaca

SEQ ID NO: 777385 - DNA, 22 bp, Artificial Sequence
  chemically synthesized
tgcactaaatgtctttgttcta

SEQ ID NO: 777386 - DNA, 22 bp, Artificial Sequence
  chemically synthesized
tttaaaactgtatagaacaaag

SEQ ID NO: 777387 - DNA, 22 bp, Artificial Sequence
  chemically synthesized
atttaaaactgtatagaacaaa

SEQ ID NO: 777388 - DNA, 22 bp, Artificial Sequence
  chemically synthesized
atttatttaaaactgtatagaa

SEQ ID NO: 777389 - DNA, 22 bp, Artificial Sequence
  chemically synthesized
aatgtctttgttctatacagtt

SEQ ID NO: 777390 - DNA, 22 bp, Artificial Sequence
  chemically synthesized
tgttctatacagttttaaataa

SEQ ID NO: 777391 - DNA, 22 bp, Artificial Sequence
  chemically synthesized
aaaatgactcatttatttaaaa

SEQ ID NO: 777392 - DNA, 22 bp, Artificial Sequence
  chemically synthesized
gttctatacagttttaaataaa

SEQ ID NO: 777393 - DNA, 22 bp, Artificial Sequence
  chemically synthesized
ttctatacagttttaaataaat

SEQ ID NO: 777394 - DNA, 22 bp, Artificial Sequence
  chemically synthesized
tatacagttttaaataaatgag

SEQ ID NO: 777395 - DNA, 22 bp, Artificial Sequence
  chemically synthesized
tacagttttaaataaatgagtc

SEQ ID NO: 777396 - DNA, 22 bp, Artificial Sequence
  chemically synthesized
caagtctgaaaatgactcattt

SEQ ID NO: 777397 - DNA, 22 bp, Artificial Sequence
  chemically synthesized
taaataaatgagtcattttcag

SEQ ID NO: 777398 - DNA, 22 bp, Artificial Sequence
  chemically synthesized
aaataaatgagtcattttcaga

SEQ ID NO: 777399 - DNA, 22 bp, Artificial Sequence
  chemically synthesized
aataaatgagtcattttcagac

SEQ ID NO: 777400 - DNA, 22 bp, Artificial Sequence
  chemically synthesized
aagaaaaactccaagtctgaaa

SEQ ID NO: 777401 - DNA, 22 bp, Artificial Sequence
  chemically synthesized
aaagaaaaactccaagtctgaa

SEQ ID NO: 777402 - DNA, 22 bp, Artificial Sequence
  chemically synthesized
tcagacttggagtttttcttta

SEQ ID NO: 777403 - DNA, 22 bp, Artificial Sequence
  chemically synthesized
taccaacagatttaaagaaaaa

SEQ ID NO: 777404 - DNA, 22 bp, Artificial Sequence
  chemically synthesized
cagacttggagtttttctttaa

SEQ ID NO: 777405 - DNA, 22 bp, Artificial Sequence
  chemically synthesized
ataccaacagatttaaagaaaa

SEQ ID NO: 777406 - DNA, 22 bp, Artificial Sequence
  chemically synthesized
agacttggagtttttctttaaa

SEQ ID NO: 777407 - DNA, 22 bp, Artificial Sequence
  chemically synthesized
tataccaacagatttaaagaaa

SEQ ID NO: 777408 - DNA, 22 bp, Artificial Sequence
  chemically synthesized
ggagtttttctttaaatctgtt

SEQ ID NO: 777409 - DNA, 22 bp, Artificial Sequence
  chemically synthesized
gagtttttctttaaatctgttg

SEQ ID NO: 777410 - DNA, 22 bp, Artificial Sequence
  chemically synthesized
ttctttaaatctgttggtataa

SEQ ID NO: 777411 - DNA, 22 bp, Artificial Sequence
  chemically synthesized
gaaaataggattttataccaac

SEQ ID NO: 777412 - DNA, 22 bp, Artificial Sequence
  chemically synthesized
tctttaaatctgttggtataaa

SEQ ID NO: 777413 - DNA, 22 bp, Artificial Sequence
  chemically synthesized
agaaaataggattttataccaa

SEQ ID NO: 777414 - DNA, 22 bp, Artificial Sequence
  chemically synthesized
ctttaaatctgttggtataaaa

SEQ ID NO: 777415 - DNA, 22 bp, Artificial Sequence
  chemically synthesized
tttaaatctgttggtataaaat

SEQ ID NO: 777416 - DNA, 22 bp, Artificial Sequence
  chemically synthesized
taaatctgttggtataaaatcc

SEQ ID NO: 777417 - DNA, 22 bp, Artificial Sequence
  chemically synthesized
atttagaaaataggattttata

SEQ ID NO: 777418 - DNA, 22 bp, Artificial Sequence
  chemically synthesized
aaatctgttggtataaaatcct

SEQ ID NO: 777419 - DNA, 22 bp, Artificial Sequence
  chemically synthesized
catttagaaaataggattttat

SEQ ID NO: 777420 - DNA, 22 bp, Artificial Sequence
  chemically synthesized
aatctgttggtataaaatccta

SEQ ID NO: 777421 - DNA, 22 bp, Artificial Sequence
  chemically synthesized
ttggtataaaatcctattttct

SEQ ID NO: 777422 - DNA, 22 bp, Artificial Sequence
  chemically synthesized
gtataaaatcctattttctaaa

SEQ ID NO: 777423 - DNA, 22 bp, Artificial Sequence
  chemically synthesized
agtatggtttcatttagaaaat

SEQ ID NO: 777424 - DNA, 22 bp, Artificial Sequence
  chemically synthesized
gagtatggtttcatttagaaaa

SEQ ID NO: 777425 - DNA, 22 bp, Artificial Sequence
  chemically synthesized
tgagtatggtttcatttagaaa

SEQ ID NO: 777426 - DNA, 22 bp, Artificial Sequence
  chemically synthesized
ttgagtatggtttcatttagaa

SEQ ID NO: 777427 - DNA, 22 bp, Artificial Sequence
  chemically synthesized
cacttttgagtatggtttcatt

SEQ ID NO: 777428 - DNA, 22 bp, Artificial Sequence
  chemically synthesized
ttttctaaatgaaaccatactc

SEQ ID NO: 777429 - DNA, 22 bp, Artificial Sequence
  chemically synthesized
tctaaatgaaaccatactcaaa

SEQ ID NO: 777430 - DNA, 22 bp, Artificial Sequence
  chemically synthesized
atatattccacttttgagtatg

SEQ ID NO: 777431 - DNA, 22 bp, Artificial Sequence
  chemically synthesized
ctaaatgaaaccatactcaaaa

SEQ ID NO: 777432 - DNA, 22 bp, Artificial Sequence
  chemically synthesized
catatattccacttttgagtat

SEQ ID NO: 777433 - DNA, 22 bp, Artificial Sequence
  chemically synthesized
taaatgaaaccatactcaaaag

SEQ ID NO: 777434 - DNA, 22 bp, Artificial Sequence
  chemically synthesized
tcatatattccacttttgagta

SEQ ID NO: 777435 - DNA, 22 bp, Artificial Sequence
  chemically synthesized
aatgaaaccatactcaaaagtg

SEQ ID NO: 777436 - DNA, 22 bp, Artificial Sequence
  chemically synthesized
tttcatatattccacttttgag

SEQ ID NO: 777437 - DNA, 22 bp, Artificial Sequence
  chemically synthesized
tctctttcatatattccacttt

SEQ ID NO: 777438 - DNA, 22 bp, Artificial Sequence
  chemically synthesized
atctctttcatatattccactt

SEQ ID NO: 777439 - DNA, 22 bp, Artificial Sequence
  chemically synthesized
tatctctttcatatattccact

SEQ ID NO: 777440 - DNA, 22 bp, Artificial Sequence
  chemically synthesized
ttatctctttcatatattccac

SEQ ID NO: 777441 - DNA, 22 bp, Artificial Sequence
  chemically synthesized
atcttttatctctttcatatat

SEQ ID NO: 777442 - DNA, 22 bp, Artificial Sequence
  chemically synthesized
catcttttatctctttcatata

SEQ ID NO: 777443 - DNA, 22 bp, Artificial Sequence
  chemically synthesized
tcatcttttatctctttcatat

SEQ ID NO: 777444 - DNA, 22 bp, Artificial Sequence
  chemically synthesized
aaaagtggaatatatgaaagag

SEQ ID NO: 777445 - DNA, 22 bp, Artificial Sequence
  chemically synthesized
aatactttcatcttttatctct

SEQ ID NO: 777446 - DNA, 22 bp, Artificial Sequence
  chemically synthesized
gaatactttcatcttttatctc

SEQ ID NO: 777447 - DNA, 22 bp, Artificial Sequence
  chemically synthesized
acccacttgaatactttcatct

SEQ ID NO: 777448 - DNA, 22 bp, Artificial Sequence
  chemically synthesized
cctaacccacttgaatactttc

SEQ ID NO: 777449 - DNA, 22 bp, Artificial Sequence
  chemically synthesized
caaggttccctaacccacttga

SEQ ID NO: 777450 - DNA, 22 bp, Artificial Sequence
  chemically synthesized
ccaaggttccctaacccacttg

SEQ ID NO: 777451 - DNA, 22 bp, Artificial Sequence
  chemically synthesized
tccaaggttccctaacccactt

SEQ ID NO: 777452 - DNA, 22 bp, Artificial Sequence
  chemically synthesized
tttccaaggttccctaacccac

SEQ ID NO: 777453 - DNA, 22 bp, Artificial Sequence
  chemically synthesized
aatgggctctttccaaggttcc

SEQ ID NO: 777454 - DNA, 22 bp, Artificial Sequence
  chemically synthesized
aagtgggttagggaaccttgga

SEQ ID NO: 777455 - DNA, 22 bp, Artificial Sequence
  chemically synthesized
gggaaccttggaaagagcccat

SEQ ID NO: 777456 - DNA, 22 bp, Artificial Sequence
  chemically synthesized
ggaaagagcccattcaatccct

SEQ ID NO: 777457 - DNA, 22 bp, Artificial Sequence
  chemically synthesized
gaaagagcccattcaatccctc

SEQ ID NO: 777458 - DNA, 22 bp, Artificial Sequence
  chemically synthesized
agaggccaaagggagagatggg

SEQ ID NO: 777459 - DNA, 22 bp, Artificial Sequence
  chemically synthesized
aatccctcttcccatctctccc

SEQ ID NO: 777460 - DNA, 22 bp, Artificial Sequence
  chemically synthesized
ttcccatctctccctttggcct

SEQ ID NO: 777461 - DNA, 22 bp, Artificial Sequence
  chemically synthesized
caaggtgcctcagaggccaaag

SEQ ID NO: 777462 - DNA, 22 bp, Artificial Sequence
  chemically synthesized
cccatctctccctttggcctct

SEQ ID NO: 777463 - DNA, 22 bp, Artificial Sequence
  chemically synthesized
ccatctctccctttggcctctg

SEQ ID NO: 777464 - DNA, 22 bp, Artificial Sequence
  chemically synthesized
tgcaaggtgcctcagaggccaa

SEQ ID NO: 777465 - DNA, 22 bp, Artificial Sequence
  chemically synthesized
tccctttggcctctgaggcacc

SEQ ID NO: 777466 - DNA, 22 bp, Artificial Sequence
  chemically synthesized
gaaagttctgcaaggtgcctca

SEQ ID NO: 777467 - DNA, 22 bp, Artificial Sequence
  chemically synthesized
cctttggcctctgaggcacctt

SEQ ID NO: 777468 - DNA, 22 bp, Artificial Sequence
  chemically synthesized
tagaaagttctgcaaggtgcct

SEQ ID NO: 777469 - DNA, 22 bp, Artificial Sequence
  chemically synthesized
tggcctctgaggcaccttgcag

SEQ ID NO: 777470 - DNA, 22 bp, Artificial Sequence
  chemically synthesized
ggcctctgaggcaccttgcaga

SEQ ID NO: 777471 - DNA, 22 bp, Artificial Sequence
  chemically synthesized
gcctctgaggcaccttgcagaa

SEQ ID NO: 777472 - DNA, 22 bp, Artificial Sequence
  chemically synthesized
aagtcattctagaaagttctgc

SEQ ID NO: 777473 - DNA, 22 bp, Artificial Sequence
  chemically synthesized
tgaggcaccttgcagaactttc

SEQ ID NO: 777474 - DNA, 22 bp, Artificial Sequence
  chemically synthesized
aggcaccttgcagaactttcta

SEQ ID NO: 777475 - DNA, 22 bp, Artificial Sequence
  chemically synthesized
gcagaactttctagaatgactt

SEQ ID NO: 777476 - DNA, 22 bp, Artificial Sequence
  chemically synthesized
cagaactttctagaatgacttg

SEQ ID NO: 777477 - DNA, 22 bp, Artificial Sequence
  chemically synthesized
aaaccatgcaaaccattcaagt

SEQ ID NO: 777478 - DNA, 22 bp, Artificial Sequence
  chemically synthesized
tctagaatgacttgaatggttt

SEQ ID NO: 777479 - DNA, 22 bp, Artificial Sequence
  chemically synthesized
ctagaatgacttgaatggtttg

SEQ ID NO: 777480 - DNA, 22 bp, Artificial Sequence
  chemically synthesized
tagaatgacttgaatggtttgc

SEQ ID NO: 777481 - DNA, 22 bp, Artificial Sequence
  chemically synthesized
gaatgacttgaatggtttgcat

SEQ ID NO: 777482 - DNA, 22 bp, Artificial Sequence
  chemically synthesized
gaatggtttgcatggtttgaat

SEQ ID NO: 777483 - DNA, 22 bp, Artificial Sequence
  chemically synthesized
aatggtttgcatggtttgaatt

SEQ ID NO: 777484 - DNA, 22 bp, Artificial Sequence
  chemically synthesized
agaccatgcaaatcgaattcaa

SEQ ID NO: 777485 - DNA, 22 bp, Artificial Sequence
  chemically synthesized
cagaccatgcaaatcgaattca

SEQ ID NO: 777486 - DNA, 22 bp, Artificial Sequence
  chemically synthesized
tcagaccatgcaaatcgaattc

SEQ ID NO: 777487 - DNA, 22 bp, Artificial Sequence
  chemically synthesized
gcatggtttgaattcgatttgc

SEQ ID NO: 777488 - DNA, 22 bp, Artificial Sequence
  chemically synthesized
catggtttgaattcgatttgca

SEQ ID NO: 777489 - DNA, 22 bp, Artificial Sequence
  chemically synthesized
gaggctttcagaccatgcaaat

SEQ ID NO: 777490 - DNA, 22 bp, Artificial Sequence
  chemically synthesized
gaattcgatttgcatggtctga

SEQ ID NO: 777491 - DNA, 22 bp, Artificial Sequence
  chemically synthesized
aattcgatttgcatggtctgaa

SEQ ID NO: 777492 - DNA, 22 bp, Artificial Sequence
  chemically synthesized
cagatctggaggctttcagacc

SEQ ID NO: 777493 - DNA, 22 bp, Artificial Sequence
  chemically synthesized
gatttgcatggtctgaaagcct

SEQ ID NO: 777494 - DNA, 22 bp, Artificial Sequence
  chemically synthesized
ctccagatctggaggctttcag

SEQ ID NO: 777495 - DNA, 22 bp, Artificial Sequence
  chemically synthesized
gcatggtctgaaagcctccaga

SEQ ID NO: 777496 - DNA, 22 bp, Artificial Sequence
  chemically synthesized
catggtctgaaagcctccagat

SEQ ID NO: 777497 - DNA, 22 bp, Artificial Sequence
  chemically synthesized
aaagcctccagatctggagcaa

SEQ ID NO: 777498 - DNA, 22 bp, Artificial Sequence
  chemically synthesized
aaaagtatgagtgttgctccag

SEQ ID NO: 777499 - DNA, 22 bp, Artificial Sequence
  chemically synthesized
acctgaaaagtatgagtgttgc

SEQ ID NO: 777500 - DNA, 22 bp, Artificial Sequence
  chemically synthesized
cagatctggagcaacactcata

SEQ ID NO: 777501 - DNA, 22 bp, Artificial Sequence
  chemically synthesized
cctcacctgaaaagtatgagtg

SEQ ID NO: 777502 - DNA, 22 bp, Artificial Sequence
  chemically synthesized
gagcaacactcatacttttcag

SEQ ID NO: 777503 - DNA, 22 bp, Artificial Sequence
  chemically synthesized
aatcccagttacctcacctgaa

SEQ ID NO: 777504 - DNA, 22 bp, Artificial Sequence
  chemically synthesized
aaatcccagttacctcacctga

SEQ ID NO: 777505 - DNA, 22 bp, Artificial Sequence
  chemically synthesized
ttaaatcccagttacctcacct

SEQ ID NO: 777506 - DNA, 22 bp, Artificial Sequence
  chemically synthesized
cttaaatcccagttacctcacc

SEQ ID NO: 777507 - DNA, 22 bp, Artificial Sequence
  chemically synthesized
atacttttcaggtgaggtaact

SEQ ID NO: 777508 - DNA, 22 bp, Artificial Sequence
  chemically synthesized
aacttcttaaatcccagttacc

SEQ ID NO: 777509 - DNA, 22 bp, Artificial Sequence
  chemically synthesized
ttcaggtgaggtaactgggatt

SEQ ID NO: 777510 - DNA, 22 bp, Artificial Sequence
  chemically synthesized
tcaggtgaggtaactgggattt

SEQ ID NO: 777511 - DNA, 22 bp, Artificial Sequence
  chemically synthesized
caggtgaggtaactgggattta

SEQ ID NO: 777512 - DNA, 22 bp, Artificial Sequence
  chemically synthesized
aggtgaggtaactgggatttaa

SEQ ID NO: 777513 - DNA, 22 bp, Artificial Sequence
  chemically synthesized
caaaaatccctgaacttcttaa

SEQ ID NO: 777514 - DNA, 22 bp, Artificial Sequence
  chemically synthesized
gcaaaaatccctgaacttctta

SEQ ID NO: 777515 - DNA, 22 bp, Artificial Sequence
  chemically synthesized
tgcaaaaatccctgaacttctt

SEQ ID NO: 777516 - DNA, 22 bp, Artificial Sequence
  chemically synthesized
ggatttaagaagttcagggatt

SEQ ID NO: 777517 - DNA, 22 bp, Artificial Sequence
  chemically synthesized
aagaagttcagggatttttgca

SEQ ID NO: 777518 - DNA, 22 bp, Artificial Sequence
  chemically synthesized
tcggtgtgattttgcaaaaatc

SEQ ID NO: 777519 - DNA, 22 bp, Artificial Sequence
  chemically synthesized
agaagttcagggatttttgcaa

SEQ ID NO: 777520 - DNA, 22 bp, Artificial Sequence
  chemically synthesized
gtcggtgtgattttgcaaaaat

SEQ ID NO: 777521 - DNA, 22 bp, Artificial Sequence
  chemically synthesized
cttgtcggtgtgattttgcaaa

SEQ ID NO: 777522 - DNA, 22 bp, Artificial Sequence
  chemically synthesized
acttgtcggtgtgattttgcaa

SEQ ID NO: 777523 - DNA, 22 bp, Artificial Sequence
  chemically synthesized
agggatttttgcaaaatcacac

SEQ ID NO: 777524 - DNA, 22 bp, Artificial Sequence
  chemically synthesized
atttacttgtcggtgtgatttt

SEQ ID NO: 777525 - DNA, 22 bp, Artificial Sequence
  chemically synthesized
aactgatttacttgtcggtgtg

SEQ ID NO: 777526 - DNA, 22 bp, Artificial Sequence
  chemically synthesized
tcaactgatttacttgtcggtg

SEQ ID NO: 777527 - DNA, 22 bp, Artificial Sequence
  chemically synthesized
ttgcaaaatcacaccgacaagt

SEQ ID NO: 777528 - DNA, 22 bp, Artificial Sequence
  chemically synthesized
tgcaaaatcacaccgacaagta

SEQ ID NO: 777529 - DNA, 22 bp, Artificial Sequence
  chemically synthesized
gcaaaatcacaccgacaagtaa

SEQ ID NO: 777530 - DNA, 22 bp, Artificial Sequence
  chemically synthesized
caaaatcacaccgacaagtaaa

SEQ ID NO: 777531 - DNA, 22 bp, Artificial Sequence
  chemically synthesized
cctctcaactgatttacttgtc

SEQ ID NO: 777532 - DNA, 22 bp, Artificial Sequence
  chemically synthesized
ccctctcaactgatttacttgt

SEQ ID NO: 777533 - DNA, 22 bp, Artificial Sequence
  chemically synthesized
cttccctctcaactgatttact

SEQ ID NO: 777534 - DNA, 22 bp, Artificial Sequence
  chemically synthesized
gttccttccctctcaactgatt

SEQ ID NO: 777535 - DNA, 22 bp, Artificial Sequence
  chemically synthesized
tggttccttccctctcaactga

SEQ ID NO: 777536 - DNA, 22 bp, Artificial Sequence
  chemically synthesized
cgaaaatactctggttccttcc

SEQ ID NO: 777537 - DNA, 22 bp, Artificial Sequence
  chemically synthesized
gtgctacgaaaatactctggtt

SEQ ID NO: 777538 - DNA, 22 bp, Artificial Sequence
  chemically synthesized
agagggaaggaaccagagtatt

SEQ ID NO: 777539 - DNA, 22 bp, Artificial Sequence
  chemically synthesized
aagtcaaaagccccaagacctg

SEQ ID NO: 777540 - DNA, 22 bp, Artificial Sequence
  chemically synthesized
tcgtagcaccaggtcttggggc

SEQ ID NO: 777541 - DNA, 22 bp, Artificial Sequence
  chemically synthesized
cgtagcaccaggtcttggggct

SEQ ID NO: 777542 - DNA, 22 bp, Artificial Sequence
  chemically synthesized
gtagcaccaggtcttggggctt

SEQ ID NO: 777543 - DNA, 22 bp, Artificial Sequence
  chemically synthesized
ggggcttttgacttcaatttct

SEQ ID NO: 777544 - DNA, 22 bp, Artificial Sequence
  chemically synthesized
gggcttttgacttcaatttctc

SEQ ID NO: 777545 - DNA, 22 bp, Artificial Sequence
  chemically synthesized
cagggggcagggcaatgagaaa

SEQ ID NO: 777546 - DNA, 22 bp, Artificial Sequence
  chemically synthesized
ttgacttcaatttctcattgcc

SEQ ID NO: 777547 - DNA, 22 bp, Artificial Sequence
  chemically synthesized
tgacttcaatttctcattgccc

SEQ ID NO: 777548 - DNA, 22 bp, Artificial Sequence
  chemically synthesized
ttccagggggcagggcaatgag

SEQ ID NO: 777549 - DNA, 22 bp, Artificial Sequence
  chemically synthesized
gacttcaatttctcattgccct

SEQ ID NO: 777550 - DNA, 22 bp, Artificial Sequence
  chemically synthesized
acttcaatttctcattgccctg

SEQ ID NO: 777551 - DNA, 22 bp, Artificial Sequence
  chemically synthesized
caatttctcattgccctgcccc

SEQ ID NO: 777552 - DNA, 22 bp, Artificial Sequence
  chemically synthesized
aatttctcattgccctgccccc

SEQ ID NO: 777553 - DNA, 22 bp, Artificial Sequence
  chemically synthesized
agtggcactgttccagggggca

SEQ ID NO: 777554 - DNA, 22 bp, Artificial Sequence
  chemically synthesized
ctcattgccctgccccctggaa

SEQ ID NO: 777555 - DNA, 22 bp, Artificial Sequence
  chemically synthesized
tcattgccctgccccctggaac

SEQ ID NO: 777556 - DNA, 22 bp, Artificial Sequence
  chemically synthesized
attgccctgccccctggaacag

SEQ ID NO: 777557 - DNA, 22 bp, Artificial Sequence
  chemically synthesized
ccctgccccctggaacagtgcc

SEQ ID NO: 777558 - DNA, 22 bp, Artificial Sequence
  chemically synthesized
tgaaccattgagtggcactgtt

SEQ ID NO: 777559 - DNA, 22 bp, Artificial Sequence
  chemically synthesized
ccccctggaacagtgccactca

SEQ ID NO: 777560 - DNA, 22 bp, Artificial Sequence
  chemically synthesized
gcaacctatgaaccattgagtg

SEQ ID NO: 777561 - DNA, 22 bp, Artificial Sequence
  chemically synthesized
gaacagtgccactcaatggttc

SEQ ID NO: 777562 - DNA, 22 bp, Artificial Sequence
  chemically synthesized
atgctggcaacctatgaaccat

SEQ ID NO: 777563 - DNA, 22 bp, Artificial Sequence
  chemically synthesized
aatggttcataggttgccagca

SEQ ID NO: 777564 - DNA, 22 bp, Artificial Sequence
  chemically synthesized
ccaggtgatgacactcatgctg

SEQ ID NO: 777565 - DNA, 22 bp, Artificial Sequence
  chemically synthesized
ataggttgccagcatgagtgtc

SEQ ID NO: 777566 - DNA, 22 bp, Artificial Sequence
  chemically synthesized
accagctcccaggtgatgacac

SEQ ID NO: 777567 - DNA, 22 bp, Artificial Sequence
  chemically synthesized
ccagcatgagtgtcatcacctg

SEQ ID NO: 777568 - DNA, 22 bp, Artificial Sequence
  chemically synthesized
ctaaccagctcccaggtgatga

SEQ ID NO: 777569 - DNA, 22 bp, Artificial Sequence
  chemically synthesized
cattgctaaccagctcccaggt

SEQ ID NO: 777570 - DNA, 22 bp, Artificial Sequence
  chemically synthesized
tgcattgctaaccagctcccag

SEQ ID NO: 777571 - DNA, 22 bp, Artificial Sequence
  chemically synthesized
cgattctgcattgctaaccagc

SEQ ID NO: 777572 - DNA, 22 bp, Artificial Sequence
  chemically synthesized
ggagctggttagcaatgcagaa

SEQ ID NO: 777573 - DNA, 22 bp, Artificial Sequence
  chemically synthesized
tggcaaggcctgcgattctgca

SEQ ID NO: 777574 - DNA, 22 bp, Artificial Sequence
  chemically synthesized
gttagcaatgcagaatcgcagg

SEQ ID NO: 777575 - DNA, 22 bp, Artificial Sequence
  chemically synthesized
gcaatgcagaatcgcaggcctt

SEQ ID NO: 777576 - DNA, 22 bp, Artificial Sequence
  chemically synthesized
gcaggtctgtggcaaggcctgc

SEQ ID NO: 777577 - DNA, 22 bp, Artificial Sequence
  chemically synthesized
agcaggtctgtggcaaggcctg

SEQ ID NO: 777578 - DNA, 22 bp, Artificial Sequence
  chemically synthesized
atttagcaggtctgtggcaagg

SEQ ID NO: 777579 - DNA, 22 bp, Artificial Sequence
  chemically synthesized
tgatttagcaggtctgtggcaa

SEQ ID NO: 777580 - DNA, 22 bp, Artificial Sequence
  chemically synthesized
gccacagacctgctaaatcaga

SEQ ID NO: 777581 - DNA, 22 bp, Artificial Sequence
  chemically synthesized
ccacagacctgctaaatcagaa

SEQ ID NO: 777582 - DNA, 22 bp, Artificial Sequence
  chemically synthesized
gatcccaccacagagattctga

SEQ ID NO: 777583 - DNA, 22 bp, Artificial Sequence
  chemically synthesized
tctggatcccaccacagagatt

SEQ ID NO: 777584 - DNA, 22 bp, Artificial Sequence
  chemically synthesized
ctaaatcagaatctctgtggtg

SEQ ID NO: 777585 - DNA, 22 bp, Artificial Sequence
  chemically synthesized
aatcagaatctctgtggtggga

SEQ ID NO: 777586 - DNA, 22 bp, Artificial Sequence
  chemically synthesized
tgaaaatgcagttgtctggatc

SEQ ID NO: 777587 - DNA, 22 bp, Artificial Sequence
  chemically synthesized
atgaaaatgcagttgtctggat

SEQ ID NO: 777588 - DNA, 22 bp, Artificial Sequence
  chemically synthesized
tgtggtgggatccagacaactg

SEQ ID NO: 777589 - DNA, 22 bp, Artificial Sequence
  chemically synthesized
tggtgggatccagacaactgca

SEQ ID NO: 777590 - DNA, 22 bp, Artificial Sequence
  chemically synthesized
gcaagcttatgaaaatgcagtt

SEQ ID NO: 777591 - DNA, 22 bp, Artificial Sequence
  chemically synthesized
agaatgacctggcaagcttatg

SEQ ID NO: 777592 - DNA, 22 bp, Artificial Sequence
  chemically synthesized
aagaatgacctggcaagcttat

SEQ ID NO: 777593 - DNA, 22 bp, Artificial Sequence
  chemically synthesized
cattttcataagcttgccaggt

SEQ ID NO: 777594 - DNA, 22 bp, Artificial Sequence
  chemically synthesized
tcataagcttgccaggtcattc

SEQ ID NO: 777595 - DNA, 22 bp, Artificial Sequence
  chemically synthesized
cataagcttgccaggtcattct

SEQ ID NO: 777596 - DNA, 22 bp, Artificial Sequence
  chemically synthesized
ataagcttgccaggtcattctt

SEQ ID NO: 777597 - DNA, 22 bp, Artificial Sequence
  chemically synthesized
aagggtgaggatgcttaagaat

SEQ ID NO: 777598 - DNA, 22 bp, Artificial Sequence
  chemically synthesized
gccaggtcattcttaagcatcc

SEQ ID NO: 777599 - DNA, 22 bp, Artificial Sequence
  chemically synthesized
ccaggtcattcttaagcatcct

SEQ ID NO: 777600 - DNA, 22 bp, Artificial Sequence
  chemically synthesized
ttaagcatcctcacccttgaac

SEQ ID NO: 777601 - DNA, 22 bp, Artificial Sequence
  chemically synthesized
aagcatcctcacccttgaacat

SEQ ID NO: 777602 - DNA, 22 bp, Artificial Sequence
  chemically synthesized
agcatcctcacccttgaacatc

SEQ ID NO: 777603 - DNA, 22 bp, Artificial Sequence
  chemically synthesized
acccttgaacatctttcccgtc

SEQ ID NO: 777604 - DNA, 22 bp, Artificial Sequence
  chemically synthesized
gaacatctttcccgtctttcct

SEQ ID NO: 777605 - DNA, 22 bp, Artificial Sequence
  chemically synthesized
aacatctttcccgtctttcctt

SEQ ID NO: 777606 - DNA, 22 bp, Artificial Sequence
  chemically synthesized
tcccgtctttccttttcttctg

SEQ ID NO: 777607 - DNA, 22 bp, Artificial Sequence
  chemically synthesized
aggaatcatgaccagaagaaaa

SEQ ID NO: 777608 - DNA, 22 bp, Artificial Sequence
  chemically synthesized
cccgtctttccttttcttctgg

SEQ ID NO: 777609 - DNA, 22 bp, Artificial Sequence
  chemically synthesized
ccgtctttccttttcttctggt

SEQ ID NO: 777610 - DNA, 22 bp, Artificial Sequence
  chemically synthesized
ggagttgaggaatcatgaccag

SEQ ID NO: 777611 - DNA, 22 bp, Artificial Sequence
  chemically synthesized
gggagttgaggaatcatgacca

SEQ ID NO: 777612 - DNA, 22 bp, Artificial Sequence
  chemically synthesized
tccttttcttctggtcatgatt

SEQ ID NO: 777613 - DNA, 22 bp, Artificial Sequence
  chemically synthesized
ccttttcttctggtcatgattc

SEQ ID NO: 777614 - DNA, 22 bp, Artificial Sequence
  chemically synthesized
cttttcttctggtcatgattcc

SEQ ID NO: 777615 - DNA, 22 bp, Artificial Sequence
  chemically synthesized
agcttgggagttgaggaatcat

SEQ ID NO: 777616 - DNA, 22 bp, Artificial Sequence
  chemically synthesized
ttcttctggtcatgattcctca

SEQ ID NO: 777617 - DNA, 22 bp, Artificial Sequence
  chemically synthesized
gagcttgggagttgaggaatca

SEQ ID NO: 777618 - DNA, 22 bp, Artificial Sequence
  chemically synthesized
tcttctggtcatgattcctcaa

SEQ ID NO: 777619 - DNA, 22 bp, Artificial Sequence
  chemically synthesized
tgagcttgggagttgaggaatc

SEQ ID NO: 777620 - DNA, 22 bp, Artificial Sequence
  chemically synthesized
cttctggtcatgattcctcaac

SEQ ID NO: 777621 - DNA, 22 bp, Artificial Sequence
  chemically synthesized
ttgagcttgggagttgaggaat

SEQ ID NO: 777622 - DNA, 22 bp, Artificial Sequence
  chemically synthesized
ttctggtcatgattcctcaact

SEQ ID NO: 777623 - DNA, 22 bp, Artificial Sequence
  chemically synthesized
ctggtcatgattcctcaactcc

SEQ ID NO: 777624 - DNA, 22 bp, Artificial Sequence
  chemically synthesized
cttttgagcttgggagttgagg

SEQ ID NO: 777625 - DNA, 22 bp, Artificial Sequence
  chemically synthesized
tggtcatgattcctcaactccc

SEQ ID NO: 777626 - DNA, 22 bp, Artificial Sequence
  chemically synthesized
gtcatgattcctcaactcccaa

SEQ ID NO: 777627 - DNA, 22 bp, Artificial Sequence
  chemically synthesized
actacttttgagcttgggagtt

SEQ ID NO: 777628 - DNA, 22 bp, Artificial Sequence
  chemically synthesized
cactacttttgagcttgggagt

SEQ ID NO: 777629 - DNA, 22 bp, Artificial Sequence
  chemically synthesized
tcactacttttgagcttgggag

SEQ ID NO: 777630 - DNA, 22 bp, Artificial Sequence
  chemically synthesized
ctcaactcccaagctcaaaagt

SEQ ID NO: 777631 - DNA, 22 bp, Artificial Sequence
  chemically synthesized
aactcccaagctcaaaagtagt

SEQ ID NO: 777632 - DNA, 22 bp, Artificial Sequence
  chemically synthesized
taacaacattttcactactttt

SEQ ID NO: 777633 - DNA, 22 bp, Artificial Sequence
  chemically synthesized
ataacaacattttcactacttt

SEQ ID NO: 777634 - DNA, 22 bp, Artificial Sequence
  chemically synthesized
tataacaacattttcactactt

SEQ ID NO: 777635 - DNA, 22 bp, Artificial Sequence
  chemically synthesized
ccaagctcaaaagtagtgaaaa

SEQ ID NO: 777636 - DNA, 22 bp, Artificial Sequence
  chemically synthesized
ctttataacaacattttcacta

SEQ ID NO: 777637 - DNA, 22 bp, Artificial Sequence
  chemically synthesized
ttcctttataacaacattttca

SEQ ID NO: 777638 - DNA, 22 bp, Artificial Sequence
  chemically synthesized
tgttcctttataacaacatttt

SEQ ID NO: 777639 - DNA, 22 bp, Artificial Sequence
  chemically synthesized
ctgttcctttataacaacattt

SEQ ID NO: 777640 - DNA, 22 bp, Artificial Sequence
  chemically synthesized
aaaagtagtgaaaatgttgtta

SEQ ID NO: 777641 - DNA, 22 bp, Artificial Sequence
  chemically synthesized
tctgttcctttataacaacatt

SEQ ID NO: 777642 - DNA, 22 bp, Artificial Sequence
  chemically synthesized
ttctgttcctttataacaacat

SEQ ID NO: 777643 - DNA, 22 bp, Artificial Sequence
  chemically synthesized
tttctgttcctttataacaaca

SEQ ID NO: 777644 - DNA, 22 bp, Artificial Sequence
  chemically synthesized
ttttctgttcctttataacaac

SEQ ID NO: 777645 - DNA, 22 bp, Artificial Sequence
  chemically synthesized
tttttctgttcctttataacaa

SEQ ID NO: 777646 - DNA, 22 bp, Artificial Sequence
  chemically synthesized
attttttttctgttcctttata

SEQ ID NO: 777647 - DNA, 22 bp, Artificial Sequence
  chemically synthesized
ctaattttttttctgttccttt

SEQ ID NO: 777648 - DNA, 22 bp, Artificial Sequence
  chemically synthesized
tcctaattttttttctgttcct

SEQ ID NO: 777649 - DNA, 22 bp, Artificial Sequence
  chemically synthesized
ctctcctaattttttttctgtt

SEQ ID NO: 777650 - DNA, 22 bp, Artificial Sequence
  chemically synthesized
ttataaaggaacagaaaaaaaa

SEQ ID NO: 777651 - DNA, 22 bp, Artificial Sequence
  chemically synthesized
ttcctctcctaattttttttct

SEQ ID NO: 777652 - DNA, 22 bp, Artificial Sequence
  chemically synthesized
tattcctctcctaatttttttt

SEQ ID NO: 777653 - DNA, 22 bp, Artificial Sequence
  chemically synthesized
taaaggaacagaaaaaaaatta

SEQ ID NO: 777654 - DNA, 22 bp, Artificial Sequence
  chemically synthesized
tctattcctctcctaatttttt

SEQ ID NO: 777655 - DNA, 22 bp, Artificial Sequence
  chemically synthesized
actctctattcctctcctaatt

SEQ ID NO: 777656 - DNA, 22 bp, Artificial Sequence
  chemically synthesized
cactctctattcctctcctaat

SEQ ID NO: 777657 - DNA, 22 bp, Artificial Sequence
  chemically synthesized
gagtaatttcactctctattcc

SEQ ID NO: 777658 - DNA, 22 bp, Artificial Sequence
  chemically synthesized
tggagtaatttcactctctatt

SEQ ID NO: 777659 - DNA, 22 bp, Artificial Sequence
  chemically synthesized
ggagaggaatagagagtgaaat

SEQ ID NO: 777660 - DNA, 22 bp, Artificial Sequence
  chemically synthesized
aggtgagggaataaaggctctg

SEQ ID NO: 777661 - DNA, 22 bp, Artificial Sequence
  chemically synthesized
ctccagagcctttattccctca

SEQ ID NO: 777662 - DNA, 22 bp, Artificial Sequence
  chemically synthesized
agtgggacctgaggtgagggaa

SEQ ID NO: 777663 - DNA, 22 bp, Artificial Sequence
  chemically synthesized
cagagcctttattccctcacct

SEQ ID NO: 777664 - DNA, 22 bp, Artificial Sequence
  chemically synthesized
cagtgggacctgaggtgaggga

SEQ ID NO: 777665 - DNA, 22 bp, Artificial Sequence
  chemically synthesized
tattccctcacctcaggtccca

SEQ ID NO: 777666 - DNA, 22 bp, Artificial Sequence
  chemically synthesized
attccctcacctcaggtcccac

SEQ ID NO: 777667 - DNA, 22 bp, Artificial Sequence
  chemically synthesized
ttccctcacctcaggtcccact

SEQ ID NO: 777668 - DNA, 22 bp, Artificial Sequence
  chemically synthesized
caaaatgacttcagtgggacct

SEQ ID NO: 777669 - DNA, 22 bp, Artificial Sequence
  chemically synthesized
ccaaaatgacttcagtgggacc

SEQ ID NO: 777670 - DNA, 22 bp, Artificial Sequence
  chemically synthesized
cctcacctcaggtcccactgaa

SEQ ID NO: 777671 - DNA, 22 bp, Artificial Sequence
  chemically synthesized
acctcaggtcccactgaagtca

SEQ ID NO: 777672 - DNA, 22 bp, Artificial Sequence
  chemically synthesized
cataatttccaaaatgacttca

SEQ ID NO: 777673 - DNA, 22 bp, Artificial Sequence
  chemically synthesized
aggtcccactgaagtcattttg

SEQ ID NO: 777674 - DNA, 22 bp, Artificial Sequence
  chemically synthesized
aagtcattttggaaattatgta

SEQ ID NO: 777675 - DNA, 22 bp, Artificial Sequence
  chemically synthesized
tggaaattatgtagctttttct

SEQ ID NO: 777676 - DNA, 22 bp, Artificial Sequence
  chemically synthesized
ggaaattatgtagctttttctt

SEQ ID NO: 777677 - DNA, 22 bp, Artificial Sequence
  chemically synthesized
gaaattatgtagctttttcttt

SEQ ID NO: 777678 - DNA, 22 bp, Artificial Sequence
  chemically synthesized
tgtagctttttctttttctttt

SEQ ID NO: 777679 - DNA, 22 bp, Artificial Sequence
  chemically synthesized
aaaaaaaaaaaaaaaagaaaaa

SEQ ID NO: 777680 - DNA, 22 bp, Artificial Sequence
  chemically synthesized
tctcaaaaaaaaaaaaaaaaga

SEQ ID NO: 777681 - DNA, 22 bp, Artificial Sequence
  chemically synthesized
tttctttttctttttttttttt

SEQ ID NO: 777682 - DNA, 22 bp, Artificial Sequence
  chemically synthesized
ttctttttcttttttttttttt

SEQ ID NO: 777683 - DNA, 22 bp, Artificial Sequence
  chemically synthesized
tctttttctttttttttttttt

SEQ ID NO: 777684 - DNA, 22 bp, Artificial Sequence
  chemically synthesized
ctttttcttttttttttttttt

SEQ ID NO: 777685 - DNA, 22 bp, Artificial Sequence
  chemically synthesized
tttttctttttttttttttttt

SEQ ID NO: 777686 - DNA, 22 bp, Artificial Sequence
  chemically synthesized
tttcttttttttttttttttga

SEQ ID NO: 777687 - DNA, 22 bp, Artificial Sequence
  chemically synthesized
ttcttttttttttttttttgag

SEQ ID NO: 777688 - DNA, 22 bp, Artificial Sequence
  chemically synthesized
tcttttttttttttttttgaga

SEQ ID NO: 777689 - DNA, 22 bp, Artificial Sequence
  chemically synthesized
cttttttttttttttttgagac

SEQ ID NO: 777690 - DNA, 22 bp, Artificial Sequence
  chemically synthesized
ttttttttttttttttgagaca

SEQ ID NO: 777691 - DNA, 22 bp, Artificial Sequence
  chemically synthesized
ttttttttttttttgagacagg

SEQ ID NO: 777692 - DNA, 22 bp, Artificial Sequence
  chemically synthesized
tttttttttttttgagacaggg

SEQ ID NO: 777693 - DNA, 22 bp, Artificial Sequence
  chemically synthesized
ttttttttttttgagacagggt

SEQ ID NO: 777694 - DNA, 22 bp, Artificial Sequence
  chemically synthesized
tttttttttttgagacagggtt

SEQ ID NO: 777695 - DNA, 22 bp, Artificial Sequence
  chemically synthesized
ccaatatggtgaaaccctgtct

SEQ ID NO: 777696 - DNA, 22 bp, Artificial Sequence
  chemically synthesized
ttttttttttgagacagggttt

SEQ ID NO: 777697 - DNA, 22 bp, Artificial Sequence
  chemically synthesized
gccaatatggtgaaaccctgtc

SEQ ID NO: 777698 - DNA, 22 bp, Artificial Sequence
  chemically synthesized
tttttttttgagacagggtttc

SEQ ID NO: 777699 - DNA, 22 bp, Artificial Sequence
  chemically synthesized
tgccaatatggtgaaaccctgt

SEQ ID NO: 777700 - DNA, 22 bp, Artificial Sequence
  chemically synthesized
ttttttttgagacagggtttca

SEQ ID NO: 777701 - DNA, 22 bp, Artificial Sequence
  chemically synthesized
tttttttgagacagggtttcac

SEQ ID NO: 777702 - DNA, 22 bp, Artificial Sequence
  chemically synthesized
ttttttgagacagggtttcacc

SEQ ID NO: 777703 - DNA, 22 bp, Artificial Sequence
  chemically synthesized
tttttgagacagggtttcacca

SEQ ID NO: 777704 - DNA, 22 bp, Artificial Sequence
  chemically synthesized
ttttgagacagggtttcaccat

SEQ ID NO: 777705 - DNA, 22 bp, Artificial Sequence
  chemically synthesized
tttgagacagggtttcaccata

SEQ ID NO: 777706 - DNA, 22 bp, Artificial Sequence
  chemically synthesized
ttgagacagggtttcaccatat

SEQ ID NO: 777707 - DNA, 22 bp, Artificial Sequence
  chemically synthesized
tgagacagggtttcaccatatt

SEQ ID NO: 777708 - DNA, 22 bp, Artificial Sequence
  chemically synthesized
gagacagggtttcaccatattg

SEQ ID NO: 777709 - DNA, 22 bp, Artificial Sequence
  chemically synthesized
agacagggtttcaccatattgg

SEQ ID NO: 777710 - DNA, 22 bp, Artificial Sequence
  chemically synthesized
gagaccagctttgccaatatgg

SEQ ID NO: 777711 - DNA, 22 bp, Artificial Sequence
  chemically synthesized
caccatattggcaaagctggtc

SEQ ID NO: 777712 - DNA, 22 bp, Artificial Sequence
  chemically synthesized
accatattggcaaagctggtct

SEQ ID NO: 777713 - DNA, 22 bp, Artificial Sequence
  chemically synthesized
aggtcaggagttcgagaccagc

SEQ ID NO: 777714 - DNA, 22 bp, Artificial Sequence
  chemically synthesized
gaggtcaggagttcgagaccag

SEQ ID NO: 777715 - DNA, 22 bp, Artificial Sequence
  chemically synthesized
gcaaagctggtctcgaactcct

SEQ ID NO: 777716 - DNA, 22 bp, Artificial Sequence
  chemically synthesized
gtctcgaactcctgacctcaag

SEQ ID NO: 777717 - DNA, 22 bp, Artificial Sequence
  chemically synthesized
aggagggcagatcacttgaggt

SEQ ID NO: 777718 - DNA, 22 bp, Artificial Sequence
  chemically synthesized
gaactcctgacctcaagtgatc

SEQ ID NO: 777719 - DNA, 22 bp, Artificial Sequence
  chemically synthesized
ggaggctgaggagggcagatca

SEQ ID NO: 777720 - DNA, 22 bp, Artificial Sequence
  chemically synthesized
ctgacctcaagtgatctgccct

SEQ ID NO: 777721 - DNA, 22 bp, Artificial Sequence
  chemically synthesized
gggaggctgaggagggcagatc

SEQ ID NO: 777722 - DNA, 22 bp, Artificial Sequence
  chemically synthesized
tgggaggctgaggagggcagat

SEQ ID NO: 777723 - DNA, 22 bp, Artificial Sequence
  chemically synthesized
acctcaagtgatctgccctcct

SEQ ID NO: 777724 - DNA, 22 bp, Artificial Sequence
  chemically synthesized
aagtgatctgccctcctcagcc

SEQ ID NO: 777725 - DNA, 22 bp, Artificial Sequence
  chemically synthesized
taatcccagtactttgggaggc

SEQ ID NO: 777726 - DNA, 22 bp, Artificial Sequence
  chemically synthesized
ccctcctcagcctcccaaagta

SEQ ID NO: 777727 - DNA, 22 bp, Artificial Sequence
  chemically synthesized
ctcagcctcccaaagtactggg

SEQ ID NO: 777728 - DNA, 22 bp, Artificial Sequence
  chemically synthesized
agcctcccaaagtactgggatt

SEQ ID NO: 777729 - DNA, 22 bp, Artificial Sequence
  chemically synthesized
ccaaagtactgggattacaggc

SEQ ID NO: 777730 - DNA, 22 bp, Artificial Sequence
  chemically synthesized
gtgcagtggcgcagcctgtaat

SEQ ID NO: 777731 - DNA, 22 bp, Artificial Sequence
  chemically synthesized
caggcctggtgcagtggcgcag

SEQ ID NO: 777732 - DNA, 22 bp, Artificial Sequence
  chemically synthesized
ccaggcctggtgcagtggcgca

SEQ ID NO: 777733 - DNA, 22 bp, Artificial Sequence
  chemically synthesized
ggattacaggctgcgccactgc

SEQ ID NO: 777734 - DNA, 22 bp, Artificial Sequence
  chemically synthesized
atttccaggcctggtgcagtgg

SEQ ID NO: 777735 - DNA, 22 bp, Artificial Sequence
  chemically synthesized
aatttccaggcctggtgcagtg

SEQ ID NO: 777736 - DNA, 22 bp, Artificial Sequence
  chemically synthesized
caggctgcgccactgcaccagg

SEQ ID NO: 777737 - DNA, 22 bp, Artificial Sequence
  chemically synthesized
cgccactgcaccaggcctggaa

SEQ ID NO: 777738 - DNA, 22 bp, Artificial Sequence
  chemically synthesized
aacaaagatacttaatttccag

SEQ ID NO: 777739 - DNA, 22 bp, Artificial Sequence
  chemically synthesized
caccaggcctggaaattaagta

SEQ ID NO: 777740 - DNA, 22 bp, Artificial Sequence
  chemically synthesized
gaaattaagtatctttgtttaa

SEQ ID NO: 777741 - DNA, 22 bp, Artificial Sequence
  chemically synthesized
ataatgccatcattaaacaaag

SEQ ID NO: 777742 - DNA, 22 bp, Artificial Sequence
  chemically synthesized
cataatgccatcattaaacaaa

SEQ ID NO: 777743 - DNA, 22 bp, Artificial Sequence
  chemically synthesized
tcataatgccatcattaaacaa

SEQ ID NO: 777744 - DNA, 22 bp, Artificial Sequence
  chemically synthesized
ttcataatgccatcattaaaca

SEQ ID NO: 777745 - DNA, 22 bp, Artificial Sequence
  chemically synthesized
tttcataatgccatcattaaac

SEQ ID NO: 777746 - DNA, 22 bp, Artificial Sequence
  chemically synthesized
agtatctttgtttaatgatggc

SEQ ID NO: 777747 - DNA, 22 bp, Artificial Sequence
  chemically synthesized
gtctttttcataatgccatcat

SEQ ID NO: 777748 - DNA, 22 bp, Artificial Sequence
  chemically synthesized
tgtttaatgatggcattatgaa

SEQ ID NO: 777749 - DNA, 22 bp, Artificial Sequence
  chemically synthesized
gtttaatgatggcattatgaaa

SEQ ID NO: 777750 - DNA, 22 bp, Artificial Sequence
  chemically synthesized
tttaatgatggcattatgaaaa

SEQ ID NO: 777751 - DNA, 22 bp, Artificial Sequence
  chemically synthesized
aatgatggcattatgaaaaaga

SEQ ID NO: 777752 - DNA, 22 bp, Artificial Sequence
  chemically synthesized
atgatggcattatgaaaaagac

SEQ ID NO: 777753 - DNA, 22 bp, Artificial Sequence
  chemically synthesized
tgaaaaagactaatatgttctg

SEQ ID NO: 777754 - DNA, 22 bp, Artificial Sequence
  chemically synthesized
aagtaaccgggaagaggagtgg

SEQ ID NO: 777755 - DNA, 22 bp, Artificial Sequence
  chemically synthesized
atatgttctgccactcctcttc

SEQ ID NO: 777756 - DNA, 22 bp, Artificial Sequence
  chemically synthesized
tgccactcctcttcccggttac

SEQ ID NO: 777757 - DNA, 22 bp, Artificial Sequence
  chemically synthesized
aaaaaagctgaagtaaccggga

SEQ ID NO: 777758 - DNA, 22 bp, Artificial Sequence
  chemically synthesized
aaaaaaagctgaagtaaccggg

SEQ ID NO: 777759 - DNA, 22 bp, Artificial Sequence
  chemically synthesized
ccactcctcttcccggttactt

SEQ ID NO: 777760 - DNA, 22 bp, Artificial Sequence
  chemically synthesized
atttaaaaaaagctgaagtaac

SEQ ID NO: 777761 - DNA, 22 bp, Artificial Sequence
  chemically synthesized
ctcttcccggttacttcagctt

SEQ ID NO: 777762 - DNA, 22 bp, Artificial Sequence
  chemically synthesized
ctcatttaaaaaaagctgaagt

SEQ ID NO: 777763 - DNA, 22 bp, Artificial Sequence
  chemically synthesized
actcatttaaaaaaagctgaag

SEQ ID NO: 777764 - DNA, 22 bp, Artificial Sequence
  chemically synthesized
ttcccggttacttcagcttttt

SEQ ID NO: 777765 - DNA, 22 bp, Artificial Sequence
  chemically synthesized
cccggttacttcagcttttttt

SEQ ID NO: 777766 - DNA, 22 bp, Artificial Sequence
  chemically synthesized
gtttactcatttaaaaaaagct

SEQ ID NO: 777767 - DNA, 22 bp, Artificial Sequence
  chemically synthesized
ccggttacttcagcttttttta

SEQ ID NO: 777768 - DNA, 22 bp, Artificial Sequence
  chemically synthesized
tagtttactcatttaaaaaaag

SEQ ID NO: 777769 - DNA, 22 bp, Artificial Sequence
  chemically synthesized
ctagtttactcatttaaaaaaa

SEQ ID NO: 777770 - DNA, 22 bp, Artificial Sequence
  chemically synthesized
tctagtttactcatttaaaaaa

SEQ ID NO: 777771 - DNA, 22 bp, Artificial Sequence
  chemically synthesized
cttcagctttttttaaatgagt

SEQ ID NO: 777772 - DNA, 22 bp, Artificial Sequence
  chemically synthesized
cagctttttttaaatgagtaaa

SEQ ID NO: 777773 - DNA, 22 bp, Artificial Sequence
  chemically synthesized
agctttttttaaatgagtaaac

SEQ ID NO: 777774 - DNA, 22 bp, Artificial Sequence
  chemically synthesized
tttttaaatgagtaaactagaa

SEQ ID NO: 777775 - DNA, 22 bp, Artificial Sequence
  chemically synthesized
ttttaaatgagtaaactagaaa

SEQ ID NO: 777776 - DNA, 22 bp, Artificial Sequence
  chemically synthesized
aaaaaaaatgattttctagttt

SEQ ID NO: 777777 - DNA, 22 bp, Artificial Sequence
  chemically synthesized
tttaaatgagtaaactagaaaa

SEQ ID NO: 777778 - DNA, 22 bp, Artificial Sequence
  chemically synthesized
gaaaaaaaatgattttctagtt

SEQ ID NO: 777779 - DNA, 22 bp, Artificial Sequence
  chemically synthesized
ttaaatgagtaaactagaaaat

SEQ ID NO: 777780 - DNA, 22 bp, Artificial Sequence
  chemically synthesized
taaatgagtaaactagaaaatc

SEQ ID NO: 777781 - DNA, 22 bp, Artificial Sequence
  chemically synthesized
aaatgagtaaactagaaaatca

SEQ ID NO: 777782 - DNA, 22 bp, Artificial Sequence
  chemically synthesized
aatgagtaaactagaaaatcat

SEQ ID NO: 777783 - DNA, 22 bp, Artificial Sequence
  chemically synthesized
gtttgaaaaaaaatgattttct

SEQ ID NO: 777784 - DNA, 22 bp, Artificial Sequence
  chemically synthesized
agtttgaaaaaaaatgattttc

SEQ ID NO: 777785 - DNA, 22 bp, Artificial Sequence
  chemically synthesized
gaaaatcattttttttcaaact

SEQ ID NO: 777786 - DNA, 22 bp, Artificial Sequence
  chemically synthesized
catgataaacatgaagacattt

SEQ ID NO: 777787 - DNA, 22 bp, Artificial Sequence
  chemically synthesized
tttttcaaactaaatgtcttca

SEQ ID NO: 777788 - DNA, 22 bp, Artificial Sequence
  chemically synthesized
ttttcaaactaaatgtcttcat

SEQ ID NO: 777789 - DNA, 22 bp, Artificial Sequence
  chemically synthesized
tttcaaactaaatgtcttcatg

SEQ ID NO: 777790 - DNA, 22 bp, Artificial Sequence
  chemically synthesized
ttcaaactaaatgtcttcatgt

SEQ ID NO: 777791 - DNA, 22 bp, Artificial Sequence
  chemically synthesized
tcaaactaaatgtcttcatgtt

SEQ ID NO: 777792 - DNA, 22 bp, Artificial Sequence
  chemically synthesized
caaactaaatgtcttcatgttt

SEQ ID NO: 777793 - DNA, 22 bp, Artificial Sequence
  chemically synthesized
aaactaaatgtcttcatgttta

SEQ ID NO: 777794 - DNA, 22 bp, Artificial Sequence
  chemically synthesized
aatgtcttcatgtttatcatgt

SEQ ID NO: 777795 - DNA, 22 bp, Artificial Sequence
  chemically synthesized
cataacaaatgttacatgataa

SEQ ID NO: 777796 - DNA, 22 bp, Artificial Sequence
  chemically synthesized
acataacaaatgttacatgata

SEQ ID NO: 777797 - DNA, 22 bp, Artificial Sequence
  chemically synthesized
catgtttatcatgtaacatttg

SEQ ID NO: 777798 - DNA, 22 bp, Artificial Sequence
  chemically synthesized
atgtttatcatgtaacatttgt

SEQ ID NO: 777799 - DNA, 22 bp, Artificial Sequence
  chemically synthesized
aacaatgagtttacataacaaa

SEQ ID NO: 777800 - DNA, 22 bp, Artificial Sequence
  chemically synthesized
atcatgtaacatttgttatgta

SEQ ID NO: 777801 - DNA, 22 bp, Artificial Sequence
  chemically synthesized
aaacaatgagtttacataacaa

SEQ ID NO: 777802 - DNA, 22 bp, Artificial Sequence
  chemically synthesized
tcatgtaacatttgttatgtaa

SEQ ID NO: 777803 - DNA, 22 bp, Artificial Sequence
  chemically synthesized
tttaaacaatgagtttacataa

SEQ ID NO: 777804 - DNA, 22 bp, Artificial Sequence
  chemically synthesized
tatttaaacaatgagtttacat

SEQ ID NO: 777805 - DNA, 22 bp, Artificial Sequence
  chemically synthesized
ctatttaaacaatgagtttaca

SEQ ID NO: 777806 - DNA, 22 bp, Artificial Sequence
  chemically synthesized
gtccttctatttaaacaatgag

SEQ ID NO: 777807 - DNA, 22 bp, Artificial Sequence
  chemically synthesized
gttatgtaaactcattgtttaa

SEQ ID NO: 777808 - DNA, 22 bp, Artificial Sequence
  chemically synthesized
ttatgtaaactcattgtttaaa

SEQ ID NO: 777809 - DNA, 22 bp, Artificial Sequence
  chemically synthesized
tgtaaactcattgtttaaatag

SEQ ID NO: 777810 - DNA, 22 bp, Artificial Sequence
  chemically synthesized
cacgccctagtccttctattta

SEQ ID NO: 777811 - DNA, 22 bp, Artificial Sequence
  chemically synthesized
attgtttaaatagaaggactag

SEQ ID NO: 777812 - DNA, 22 bp, Artificial Sequence
  chemically synthesized
tttaaatagaaggactagggcg

SEQ ID NO: 777813 - DNA, 22 bp, Artificial Sequence
  chemically synthesized
aaatagaaggactagggcgtgc

SEQ ID NO: 777814 - DNA, 22 bp, Artificial Sequence
  chemically synthesized
tggccaaatgttgcacgcccta

SEQ ID NO: 777815 - DNA, 22 bp, Artificial Sequence
  chemically synthesized
aatagaaggactagggcgtgca

SEQ ID NO: 777816 - DNA, 22 bp, Artificial Sequence
  chemically synthesized
gtggccaaatgttgcacgccct

SEQ ID NO: 777817 - DNA, 22 bp, Artificial Sequence
  chemically synthesized
tgtggccaaatgttgcacgccc

SEQ ID NO: 777818 - DNA, 22 bp, Artificial Sequence
  chemically synthesized
ttgtggccaaatgttgcacgcc

SEQ ID NO: 777819 - DNA, 22 bp, Artificial Sequence
  chemically synthesized
ttttgtggccaaatgttgcacg

SEQ ID NO: 777820 - DNA, 22 bp, Artificial Sequence
  chemically synthesized
cttttgtggccaaatgttgcac

SEQ ID NO: 777821 - DNA, 22 bp, Artificial Sequence
  chemically synthesized
tcttttgtggccaaatgttgca

SEQ ID NO: 777822 - DNA, 22 bp, Artificial Sequence
  chemically synthesized
gggcgtgcaacatttggccaca

SEQ ID NO: 777823 - DNA, 22 bp, Artificial Sequence
  chemically synthesized
tgtgtgtgcatattttcttttg

SEQ ID NO: 777824 - DNA, 22 bp, Artificial Sequence
  chemically synthesized
gtgtgtgtgcatattttctttt

SEQ ID NO: 777825 - DNA, 22 bp, Artificial Sequence
  chemically synthesized
tgtttgtgtgtgtgcatatttt

SEQ ID NO: 777826 - DNA, 22 bp, Artificial Sequence
  chemically synthesized
ggccacaaaagaaaatatgcac

SEQ ID NO: 777827 - DNA, 22 bp, Artificial Sequence
  chemically synthesized
gccacaaaagaaaatatgcaca

SEQ ID NO: 777828 - DNA, 22 bp, Artificial Sequence
  chemically synthesized
aaaaaaatcagttatgtttgtg

SEQ ID NO: 777829 - DNA, 22 bp, Artificial Sequence
  chemically synthesized
aaaaaaaatcagttatgtttgt

SEQ ID NO: 777830 - DNA, 22 bp, Artificial Sequence
  chemically synthesized
taaaaaaaatcagttatgtttg

SEQ ID NO: 777831 - DNA, 22 bp, Artificial Sequence
  chemically synthesized
ttaaaaaaaatcagttatgttt

SEQ ID NO: 777832 - DNA, 22 bp, Artificial Sequence
  chemically synthesized
tttaaaaaaaatcagttatgtt

SEQ ID NO: 777833 - DNA, 22 bp, Artificial Sequence
  chemically synthesized
ttttaaaaaaaatcagttatgt

SEQ ID NO: 777834 - DNA, 22 bp, Artificial Sequence
  chemically synthesized
tttttaaaaaaaatcagttatg

SEQ ID NO: 777835 - DNA, 22 bp, Artificial Sequence
  chemically synthesized
ttttttaaaaaaaatcagttat

SEQ ID NO: 777836 - DNA, 22 bp, Artificial Sequence
  chemically synthesized
tttttttaaaaaaaatcagtta

SEQ ID NO: 777837 - DNA, 22 bp, Artificial Sequence
  chemically synthesized
aagtaatacatgtttttttttt

SEQ ID NO: 777838 - DNA, 22 bp, Artificial Sequence
  chemically synthesized
aaagtaatacatgttttttttt

SEQ ID NO: 777839 - DNA, 22 bp, Artificial Sequence
  chemically synthesized
taaagtaatacatgtttttttt

SEQ ID NO: 777840 - DNA, 22 bp, Artificial Sequence
  chemically synthesized
attttttttaaaaaaaaaacat

SEQ ID NO: 777841 - DNA, 22 bp, Artificial Sequence
  chemically synthesized
ttaaagtaatacatgttttttt

SEQ ID NO: 777842 - DNA, 22 bp, Artificial Sequence
  chemically synthesized
tttttaaaaaaaaaacatgtat

SEQ ID NO: 777843 - DNA, 22 bp, Artificial Sequence
  chemically synthesized
ttttaaaaaaaaaacatgtatt

SEQ ID NO: 777844 - DNA, 22 bp, Artificial Sequence
  chemically synthesized
tttaaaaaaaaaacatgtatta

SEQ ID NO: 777845 - DNA, 22 bp, Artificial Sequence
  chemically synthesized
ttaaaaaaaaaacatgtattac

SEQ ID NO: 777846 - DNA, 22 bp, Artificial Sequence
  chemically synthesized
taaaaaaaaaacatgtattact

SEQ ID NO: 777847 - DNA, 22 bp, Artificial Sequence
  chemically synthesized
gcatatttttaaagtaatacat

SEQ ID NO: 777848 - DNA, 22 bp, Artificial Sequence
  chemically synthesized
aaaaaaaaaacatgtattactt

SEQ ID NO: 777849 - DNA, 22 bp, Artificial Sequence
  chemically synthesized
aaaaaaaaacatgtattacttt

SEQ ID NO: 777850 - DNA, 22 bp, Artificial Sequence
  chemically synthesized
actggcatatttttaaagtaat

SEQ ID NO: 777851 - DNA, 22 bp, Artificial Sequence
  chemically synthesized
aactggcatatttttaaagtaa

SEQ ID NO: 777852 - DNA, 22 bp, Artificial Sequence
  chemically synthesized
acatttaactggcatattttta

SEQ ID NO: 777853 - DNA, 22 bp, Artificial Sequence
  chemically synthesized
aacatttaactggcatattttt

SEQ ID NO: 777854 - DNA, 22 bp, Artificial Sequence
  chemically synthesized
taacatttaactggcatatttt

SEQ ID NO: 777855 - DNA, 22 bp, Artificial Sequence
  chemically synthesized
ctttaaaaatatgccagttaaa

SEQ ID NO: 777856 - DNA, 22 bp, Artificial Sequence
  chemically synthesized
taaaaatatgccagttaaatgt

SEQ ID NO: 777857 - DNA, 22 bp, Artificial Sequence
  chemically synthesized
aaaaatatgccagttaaatgtt

SEQ ID NO: 777858 - DNA, 22 bp, Artificial Sequence
  chemically synthesized
aaaatatgccagttaaatgtta

SEQ ID NO: 777859 - DNA, 22 bp, Artificial Sequence
  chemically synthesized
atacataagttttaacatttaa

SEQ ID NO: 777860 - DNA, 22 bp, Artificial Sequence
  chemically synthesized
gcacattcatacataagtttta

SEQ ID NO: 777861 - DNA, 22 bp, Artificial Sequence
  chemically synthesized
agcacattcatacataagtttt

SEQ ID NO: 777862 - DNA, 22 bp, Artificial Sequence
  chemically synthesized
tttagcacattcatacataagt

SEQ ID NO: 777863 - DNA, 22 bp, Artificial Sequence
  chemically synthesized
gtttagcacattcatacataag

SEQ ID NO: 777864 - DNA, 22 bp, Artificial Sequence
  chemically synthesized
tgtttagcacattcatacataa

SEQ ID NO: 777865 - DNA, 22 bp, Artificial Sequence
  chemically synthesized
aatgttaaaacttatgtatgaa

SEQ ID NO: 777866 - DNA, 22 bp, Artificial Sequence
  chemically synthesized
tttgtttagcacattcatacat

SEQ ID NO: 777867 - DNA, 22 bp, Artificial Sequence
  chemically synthesized
gtctctttgtttagcacattca

SEQ ID NO: 777868 - DNA, 22 bp, Artificial Sequence
  chemically synthesized
aaacttatgtatgaatgtgcta

SEQ ID NO: 777869 - DNA, 22 bp, Artificial Sequence
  chemically synthesized
tgttagtctctttgtttagcac

SEQ ID NO: 777870 - DNA, 22 bp, Artificial Sequence
  chemically synthesized
gtgttagtctctttgtttagca

SEQ ID NO: 777871 - DNA, 22 bp, Artificial Sequence
  chemically synthesized
atgtatgaatgtgctaaacaaa

SEQ ID NO: 777872 - DNA, 22 bp, Artificial Sequence
  chemically synthesized
tgtgttagtctctttgtttagc

SEQ ID NO: 777873 - DNA, 22 bp, Artificial Sequence
  chemically synthesized
tgtatgaatgtgctaaacaaag

SEQ ID NO: 777874 - DNA, 22 bp, Artificial Sequence
  chemically synthesized
ttttgtgttagtctctttgttt

SEQ ID NO: 777875 - DNA, 22 bp, Artificial Sequence
  chemically synthesized
ccagaaattattttgtgttagt

SEQ ID NO: 777876 - DNA, 22 bp, Artificial Sequence
  chemically synthesized
aacaaagagactaacacaaaat

SEQ ID NO: 777877 - DNA, 22 bp, Artificial Sequence
  chemically synthesized
aaaatgttaccagaaattattt

SEQ ID NO: 777878 - DNA, 22 bp, Artificial Sequence
  chemically synthesized
acacaaaataatttctggtaac

SEQ ID NO: 777879 - DNA, 22 bp, Artificial Sequence
  chemically synthesized
atgatactaaaaatgttaccag

SEQ ID NO: 777880 - DNA, 22 bp, Artificial Sequence
  chemically synthesized
catgatactaaaaatgttacca

SEQ ID NO: 777881 - DNA, 22 bp, Artificial Sequence
  chemically synthesized
tgggccttcatgatactaaaaa

SEQ ID NO: 777882 - DNA, 22 bp, Artificial Sequence
  chemically synthesized
atgggccttcatgatactaaaa

SEQ ID NO: 777883 - DNA, 22 bp, Artificial Sequence
  chemically synthesized
tatgggccttcatgatactaaa

SEQ ID NO: 777884 - DNA, 22 bp, Artificial Sequence
  chemically synthesized
ctggtaacatttttagtatcat

SEQ ID NO: 777885 - DNA, 22 bp, Artificial Sequence
  chemically synthesized
ttatgggccttcatgatactaa

SEQ ID NO: 777886 - DNA, 22 bp, Artificial Sequence
  chemically synthesized
tggtaacatttttagtatcatg

SEQ ID NO: 777887 - DNA, 22 bp, Artificial Sequence
  chemically synthesized
gtaacatttttagtatcatgaa

SEQ ID NO: 777888 - DNA, 22 bp, Artificial Sequence
  chemically synthesized
atttttatgggccttcatgata

SEQ ID NO: 777889 - DNA, 22 bp, Artificial Sequence
  chemically synthesized
ctcatttttatgggccttcatg

SEQ ID NO: 777890 - DNA, 22 bp, Artificial Sequence
  chemically synthesized
ttagtatcatgaaggcccataa

SEQ ID NO: 777891 - DNA, 22 bp, Artificial Sequence
  chemically synthesized
tagtatcatgaaggcccataaa

SEQ ID NO: 777892 - DNA, 22 bp, Artificial Sequence
  chemically synthesized
agtatcatgaaggcccataaaa

SEQ ID NO: 777893 - DNA, 22 bp, Artificial Sequence
  chemically synthesized
gtatcatgaaggcccataaaaa

SEQ ID NO: 777894 - DNA, 22 bp, Artificial Sequence
  chemically synthesized
aataatccataccctcctcatt

SEQ ID NO: 777895 - DNA, 22 bp, Artificial Sequence
  chemically synthesized
caataatccataccctcctcat

SEQ ID NO: 777896 - DNA, 22 bp, Artificial Sequence
  chemically synthesized
acacaatttcaataatccatac

SEQ ID NO: 777897 - DNA, 22 bp, Artificial Sequence
  chemically synthesized
cacacaatttcaataatccata

SEQ ID NO: 777898 - DNA, 22 bp, Artificial Sequence
  chemically synthesized
atttcacacaatttcaataatc

SEQ ID NO: 777899 - DNA, 22 bp, Artificial Sequence
  chemically synthesized
taatttcacacaatttcaataa

SEQ ID NO: 777900 - DNA, 22 bp, Artificial Sequence
  chemically synthesized
ctaatttcacacaatttcaata

SEQ ID NO: 777901 - DNA, 22 bp, Artificial Sequence
  chemically synthesized
tctaatttcacacaatttcaat

SEQ ID NO: 777902 - DNA, 22 bp, Artificial Sequence
  chemically synthesized
tgtagttttctaatttcacaca

SEQ ID NO: 777903 - DNA, 22 bp, Artificial Sequence
  chemically synthesized
tatgtagttttctaatttcaca

SEQ ID NO: 777904 - DNA, 22 bp, Artificial Sequence
  chemically synthesized
ctatgtagttttctaatttcac

SEQ ID NO: 777905 - DNA, 22 bp, Artificial Sequence
  chemically synthesized
ttgaaattgtgtgaaattagaa

SEQ ID NO: 777906 - DNA, 22 bp, Artificial Sequence
  chemically synthesized
aaattgtgtgaaattagaaaac

SEQ ID NO: 777907 - DNA, 22 bp, Artificial Sequence
  chemically synthesized
tgtgaaattagaaaactacata

SEQ ID NO: 777908 - DNA, 22 bp, Artificial Sequence
  chemically synthesized
acgggaatgtttctatgtagtt

SEQ ID NO: 777909 - DNA, 22 bp, Artificial Sequence
  chemically synthesized
cattcacgggaatgtttctatg

SEQ ID NO: 777910 - DNA, 22 bp, Artificial Sequence
  chemically synthesized
gcattcacgggaatgtttctat

SEQ ID NO: 777911 - DNA, 22 bp, Artificial Sequence
  chemically synthesized
gaaaactacatagaaacattcc

SEQ ID NO: 777912 - DNA, 22 bp, Artificial Sequence
  chemically synthesized
cttgcattcacgggaatgtttc

SEQ ID NO: 777913 - DNA, 22 bp, Artificial Sequence
  chemically synthesized
tctccttgcattcacgggaatg

SEQ ID NO: 777914 - DNA, 22 bp, Artificial Sequence
  chemically synthesized
gtctccttgcattcacgggaat

SEQ ID NO: 777915 - DNA, 22 bp, Artificial Sequence
  chemically synthesized
tgtctccttgcattcacgggaa

SEQ ID NO: 777916 - DNA, 22 bp, Artificial Sequence
  chemically synthesized
catagaaacattcccgtgaatg

SEQ ID NO: 777917 - DNA, 22 bp, Artificial Sequence
  chemically synthesized
tttgtctccttgcattcacggg

SEQ ID NO: 777918 - DNA, 22 bp, Artificial Sequence
  chemically synthesized
tctttgtctccttgcattcacg

SEQ ID NO: 777919 - DNA, 22 bp, Artificial Sequence
  chemically synthesized
ctctctttgtctccttgcattc

SEQ ID NO: 777920 - DNA, 22 bp, Artificial Sequence
  chemically synthesized
gctctctttgtctccttgcatt

SEQ ID NO: 777921 - DNA, 22 bp, Artificial Sequence
  chemically synthesized
tttgctctctttgtctccttgc

SEQ ID NO: 777922 - DNA, 22 bp, Artificial Sequence
  chemically synthesized
ccgtgaatgcaaggagacaaag

SEQ ID NO: 777923 - DNA, 22 bp, Artificial Sequence
  chemically synthesized
actatttgctctctttgtctcc

SEQ ID NO: 777924 - DNA, 22 bp, Artificial Sequence
  chemically synthesized
aactatttgctctctttgtctc

SEQ ID NO: 777925 - DNA, 22 bp, Artificial Sequence
  chemically synthesized
aaggagcagatatggaggggtc

SEQ ID NO: 777926 - DNA, 22 bp, Artificial Sequence
  chemically synthesized
aaaggagcagatatggaggggt

SEQ ID NO: 777927 - DNA, 22 bp, Artificial Sequence
  chemically synthesized
taaaggagcagatatggagggg

SEQ ID NO: 777928 - DNA, 22 bp, Artificial Sequence
  chemically synthesized
agtacattggacccctccatat

SEQ ID NO: 777929 - DNA, 22 bp, Artificial Sequence
  chemically synthesized
ttaaaggagcagatatggaggg

SEQ ID NO: 777930 - DNA, 22 bp, Artificial Sequence
  chemically synthesized
tttaaaggagcagatatggagg

SEQ ID NO: 777931 - DNA, 22 bp, Artificial Sequence
  chemically synthesized
gacccctccatatctgctcctt

SEQ ID NO: 777932 - DNA, 22 bp, Artificial Sequence
  chemically synthesized
aaatatacattttttaaaggag

SEQ ID NO: 777933 - DNA, 22 bp, Artificial Sequence
  chemically synthesized
catatctgctcctttaaaaaat

SEQ ID NO: 777934 - DNA, 22 bp, Artificial Sequence
  chemically synthesized
ctcctttaaaaaatgtatattt

SEQ ID NO: 777935 - DNA, 22 bp, Artificial Sequence
  chemically synthesized
ctttaaaaaatgtatatttcag

SEQ ID NO: 777936 - DNA, 22 bp, Artificial Sequence
  chemically synthesized
taaaaaatgtatatttcagtca

SEQ ID NO: 777937 - DNA, 22 bp, Artificial Sequence
  chemically synthesized
aaaaaatgtatatttcagtcat

SEQ ID NO: 777938 - DNA, 22 bp, Artificial Sequence
  chemically synthesized
aaaaatgtatatttcagtcatt

SEQ ID NO: 777939 - DNA, 22 bp, Artificial Sequence
  chemically synthesized
acataaaatgtaaatgactgaa

SEQ ID NO: 777940 - DNA, 22 bp, Artificial Sequence
  chemically synthesized
aacataaaatgtaaatgactga

SEQ ID NO: 777941 - DNA, 22 bp, Artificial Sequence
  chemically synthesized
cagtcatttacattttatgtta

SEQ ID NO: 777942 - DNA, 22 bp, Artificial Sequence
  chemically synthesized
agtcatttacattttatgttaa

SEQ ID NO: 777943 - DNA, 22 bp, Artificial Sequence
  chemically synthesized
gaagagtcagataataatttaa

SEQ ID NO: 777944 - DNA, 22 bp, Artificial Sequence
  chemically synthesized
agaagagtcagataataattta

SEQ ID NO: 777945 - DNA, 22 bp, Artificial Sequence
  chemically synthesized
acattttatgttaaattattat

SEQ ID NO: 777946 - DNA, 22 bp, Artificial Sequence
  chemically synthesized
tagaagagtcagataataattt

SEQ ID NO: 777947 - DNA, 22 bp, Artificial Sequence
  chemically synthesized
cattttatgttaaattattatc

SEQ ID NO: 777948 - DNA, 22 bp, Artificial Sequence
  chemically synthesized
ttagaagagtcagataataatt

SEQ ID NO: 777949 - DNA, 22 bp, Artificial Sequence
  chemically synthesized
tatgttaaattattatctgact

SEQ ID NO: 777950 - DNA, 22 bp, Artificial Sequence
  chemically synthesized
atgttaaattattatctgactc

SEQ ID NO: 777951 - DNA, 22 bp, Artificial Sequence
  chemically synthesized
tgttaaattattatctgactct

SEQ ID NO: 777952 - DNA, 22 bp, Artificial Sequence
  chemically synthesized
aattattatctgactcttctaa

SEQ ID NO: 777953 - DNA, 22 bp, Artificial Sequence
  chemically synthesized
caccaaaaacttttagaagagt

SEQ ID NO: 777954 - DNA, 22 bp, Artificial Sequence
  chemically synthesized
acaccaaaaacttttagaagag

SEQ ID NO: 777955 - DNA, 22 bp, Artificial Sequence
  chemically synthesized
ttatctgactcttctaaaagtt

SEQ ID NO: 777956 - DNA, 22 bp, Artificial Sequence
  chemically synthesized
atttacaccaaaaacttttaga

SEQ ID NO: 777957 - DNA, 22 bp, Artificial Sequence
  chemically synthesized
aatttacaccaaaaacttttag

SEQ ID NO: 777958 - DNA, 22 bp, Artificial Sequence
  chemically synthesized
taatttacaccaaaaactttta

SEQ ID NO: 777959 - DNA, 22 bp, Artificial Sequence
  chemically synthesized
tctgactcttctaaaagttttt

SEQ ID NO: 777960 - DNA, 22 bp, Artificial Sequence
  chemically synthesized
actcttctaaaagtttttggtg

SEQ ID NO: 777961 - DNA, 22 bp, Artificial Sequence
  chemically synthesized
ttctaaaagtttttggtgtaaa

SEQ ID NO: 777962 - DNA, 22 bp, Artificial Sequence
  chemically synthesized
agatcatctttaatttacacca

SEQ ID NO: 777963 - DNA, 22 bp, Artificial Sequence
  chemically synthesized
ctaaaagtttttggtgtaaatt

SEQ ID NO: 777964 - DNA, 22 bp, Artificial Sequence
  chemically synthesized
taaaagtttttggtgtaaatta

SEQ ID NO: 777965 - DNA, 22 bp, Artificial Sequence
  chemically synthesized
aaagtttttggtgtaaattaaa

SEQ ID NO: 777966 - DNA, 22 bp, Artificial Sequence
  chemically synthesized
ataattcagatcatctttaatt

SEQ ID NO: 777967 - DNA, 22 bp, Artificial Sequence
  chemically synthesized
tgataattcagatcatctttaa

SEQ ID NO: 777968 - DNA, 22 bp, Artificial Sequence
  chemically synthesized
ctgataattcagatcatcttta

SEQ ID NO: 777969 - DNA, 22 bp, Artificial Sequence
  chemically synthesized
ttggtgtaaattaaagatgatc

SEQ ID NO: 777970 - DNA, 22 bp, Artificial Sequence
  chemically synthesized
tctgataattcagatcatcttt

SEQ ID NO: 777971 - DNA, 22 bp, Artificial Sequence
  chemically synthesized
tggtgtaaattaaagatgatct

SEQ ID NO: 777972 - DNA, 22 bp, Artificial Sequence
  chemically synthesized
ggtgtaaattaaagatgatctg

SEQ ID NO: 777973 - DNA, 22 bp, Artificial Sequence
  chemically synthesized
gtgtaaattaaagatgatctga

SEQ ID NO: 777974 - DNA, 22 bp, Artificial Sequence
  chemically synthesized
attttctgataattcagatcat

SEQ ID NO: 777975 - DNA, 22 bp, Artificial Sequence
  chemically synthesized
agtcctgattttctgataattc

SEQ ID NO: 777976 - DNA, 22 bp, Artificial Sequence
  chemically synthesized
aagatgatctgaattatcagaa

SEQ ID NO: 777977 - DNA, 22 bp, Artificial Sequence
  chemically synthesized
tcagtcctgattttctgataat

SEQ ID NO: 777978 - DNA, 22 bp, Artificial Sequence
  chemically synthesized
ttctcagtcctgattttctgat

SEQ ID NO: 777979 - DNA, 22 bp, Artificial Sequence
  chemically synthesized
aattatcagaaaatcaggactg

SEQ ID NO: 777980 - DNA, 22 bp, Artificial Sequence
  chemically synthesized
agggtagttgttctcagtcctg

SEQ ID NO: 777981 - DNA, 22 bp, Artificial Sequence
  chemically synthesized
cagggtagttgttctcagtcct

SEQ ID NO: 777982 - DNA, 22 bp, Artificial Sequence
  chemically synthesized
tcagggtagttgttctcagtcc

SEQ ID NO: 777983 - DNA, 22 bp, Artificial Sequence
  chemically synthesized
tcagaaaatcaggactgagaac

SEQ ID NO: 777984 - DNA, 22 bp, Artificial Sequence
  chemically synthesized
ttcagggtagttgttctcagtc

SEQ ID NO: 777985 - DNA, 22 bp, Artificial Sequence
  chemically synthesized
tttcagggtagttgttctcagt

SEQ ID NO: 777986 - DNA, 22 bp, Artificial Sequence
  chemically synthesized
ttttcagggtagttgttctcag

SEQ ID NO: 777987 - DNA, 22 bp, Artificial Sequence
  chemically synthesized
tttttcagggtagttgttctca

SEQ ID NO: 777988 - DNA, 22 bp, Artificial Sequence
  chemically synthesized
ttttttcagggtagttgttctc

SEQ ID NO: 777989 - DNA, 22 bp, Artificial Sequence
  chemically synthesized
tttttttcagggtagttgttct

SEQ ID NO: 777990 - DNA, 22 bp, Artificial Sequence
  chemically synthesized
ttttttttcagggtagttgttc

SEQ ID NO: 777991 - DNA, 22 bp, Artificial Sequence
  chemically synthesized
agaacaactaccctgaaaaaaa

SEQ ID NO: 777992 - DNA, 22 bp, Artificial Sequence
  chemically synthesized
aagtaatccatttttttttttc

SEQ ID NO: 777993 - DNA, 22 bp, Artificial Sequence
  chemically synthesized
taaagtaatccatttttttttt

SEQ ID NO: 777994 - DNA, 22 bp, Artificial Sequence
  chemically synthesized
ccctgaaaaaaaaaaatggatt

SEQ ID NO: 777995 - DNA, 22 bp, Artificial Sequence
  chemically synthesized
acattctaaagtaatccatttt

SEQ ID NO: 777996 - DNA, 22 bp, Artificial Sequence
  chemically synthesized
cacattctaaagtaatccattt

SEQ ID NO: 777997 - DNA, 22 bp, Artificial Sequence
  chemically synthesized
tcacattctaaagtaatccatt

SEQ ID NO: 777998 - DNA, 22 bp, Artificial Sequence
  chemically synthesized
tttcacattctaaagtaatcca

SEQ ID NO: 777999 - DNA, 22 bp, Artificial Sequence
  chemically synthesized
aaaaaaaaaaatggattacttt

SEQ ID NO: 778000 - DNA, 22 bp, Artificial Sequence
  chemically synthesized
gccattctttcacattctaaag

SEQ ID NO: 778001 - DNA, 22 bp, Artificial Sequence
  chemically synthesized
ggccattctttcacattctaaa

SEQ ID NO: 778002 - DNA, 22 bp, Artificial Sequence
  chemically synthesized
catagaccttggccattctttc

SEQ ID NO: 778003 - DNA, 22 bp, Artificial Sequence
  chemically synthesized
ctttagaatgtgaaagaatggc

SEQ ID NO: 778004 - DNA, 22 bp, Artificial Sequence
  chemically synthesized
gcatagaccttggccattcttt

SEQ ID NO: 778005 - DNA, 22 bp, Artificial Sequence
  chemically synthesized
tgcatagaccttggccattctt

SEQ ID NO: 778006 - DNA, 22 bp, Artificial Sequence
  chemically synthesized
tagaatgtgaaagaatggccaa

SEQ ID NO: 778007 - DNA, 22 bp, Artificial Sequence
  chemically synthesized
agaatgtgaaagaatggccaag

SEQ ID NO: 778008 - DNA, 22 bp, Artificial Sequence
  chemically synthesized
gaatgtgaaagaatggccaagg

SEQ ID NO: 778009 - DNA, 22 bp, Artificial Sequence
  chemically synthesized
aaagcaaaaataactttgcata

SEQ ID NO: 778010 - DNA, 22 bp, Artificial Sequence
  chemically synthesized
ttcaaagcaaaaataactttgc

SEQ ID NO: 778011 - DNA, 22 bp, Artificial Sequence
  chemically synthesized
tattcaaagcaaaaataacttt

SEQ ID NO: 778012 - DNA, 22 bp, Artificial Sequence
  chemically synthesized
ctattcaaagcaaaaataactt

SEQ ID NO: 778013 - DNA, 22 bp, Artificial Sequence
  chemically synthesized
agggtttctattcaaagcaaaa

SEQ ID NO: 778014 - DNA, 22 bp, Artificial Sequence
  chemically synthesized
tgcaaagttatttttgctttga

SEQ ID NO: 778015 - DNA, 22 bp, Artificial Sequence
  chemically synthesized
cactcagggtttctattcaaag

SEQ ID NO: 778016 - DNA, 22 bp, Artificial Sequence
  chemically synthesized
tttttgctttgaatagaaaccc

SEQ ID NO: 778017 - DNA, 22 bp, Artificial Sequence
  chemically synthesized
aacattgcactcagggtttcta

SEQ ID NO: 778018 - DNA, 22 bp, Artificial Sequence
  chemically synthesized
aaacattgcactcagggtttct

SEQ ID NO: 778019 - DNA, 22 bp, Artificial Sequence
  chemically synthesized
ttgctttgaatagaaaccctga

SEQ ID NO: 778020 - DNA, 22 bp, Artificial Sequence
  chemically synthesized
tgctttgaatagaaaccctgag

SEQ ID NO: 778021 - DNA, 22 bp, Artificial Sequence
  chemically synthesized
ttaaacattgcactcagggttt

SEQ ID NO: 778022 - DNA, 22 bp, Artificial Sequence
  chemically synthesized
gctttgaatagaaaccctgagt

SEQ ID NO: 778023 - DNA, 22 bp, Artificial Sequence
  chemically synthesized
ctttgaatagaaaccctgagtg

SEQ ID NO: 778024 - DNA, 22 bp, Artificial Sequence
  chemically synthesized
tgaatagaaaccctgagtgcaa

SEQ ID NO: 778025 - DNA, 22 bp, Artificial Sequence
  chemically synthesized
tattcttaaacattgcactcag

SEQ ID NO: 778026 - DNA, 22 bp, Artificial Sequence
  chemically synthesized
gaatagaaaccctgagtgcaat

SEQ ID NO: 778027 - DNA, 22 bp, Artificial Sequence
  chemically synthesized
atattcttaaacattgcactca

SEQ ID NO: 778028 - DNA, 22 bp, Artificial Sequence
  chemically synthesized
aatagaaaccctgagtgcaatg

SEQ ID NO: 778029 - DNA, 22 bp, Artificial Sequence
  chemically synthesized
ggaataggtttatattcttaaa

SEQ ID NO: 778030 - DNA, 22 bp, Artificial Sequence
  chemically synthesized
agtgcaatgtttaagaatataa

SEQ ID NO: 778031 - DNA, 22 bp, Artificial Sequence
  chemically synthesized
catgttgggaataggtttatat

SEQ ID NO: 778032 - DNA, 22 bp, Artificial Sequence
  chemically synthesized
gcatgttgggaataggtttata

SEQ ID NO: 778033 - DNA, 22 bp, Artificial Sequence
  chemically synthesized
tgcatgttgggaataggtttat

SEQ ID NO: 778034 - DNA, 22 bp, Artificial Sequence
  chemically synthesized
ttgcatgttgggaataggttta

SEQ ID NO: 778035 - DNA, 22 bp, Artificial Sequence
  chemically synthesized
aagaatataaacctattcccaa

SEQ ID NO: 778036 - DNA, 22 bp, Artificial Sequence
  chemically synthesized
agaatataaacctattcccaac

SEQ ID NO: 778037 - DNA, 22 bp, Artificial Sequence
  chemically synthesized
tagaatttttgcatgttgggaa

SEQ ID NO: 778038 - DNA, 22 bp, Artificial Sequence
  chemically synthesized
tatagaatttttgcatgttggg

SEQ ID NO: 778039 - DNA, 22 bp, Artificial Sequence
  chemically synthesized
aagaattctatagaatttttgc

SEQ ID NO: 778040 - DNA, 22 bp, Artificial Sequence
  chemically synthesized
gaagaattctatagaatttttg

SEQ ID NO: 778041 - DNA, 22 bp, Artificial Sequence
  chemically synthesized
ttcccaacatgcaaaaattcta

SEQ ID NO: 778042 - DNA, 22 bp, Artificial Sequence
  chemically synthesized
ccaacatgcaaaaattctatag

SEQ ID NO: 778043 - DNA, 22 bp, Artificial Sequence
  chemically synthesized
atttgaagaattctatagaatt

SEQ ID NO: 778044 - DNA, 22 bp, Artificial Sequence
  chemically synthesized
gagggttcatttgaagaattct

SEQ ID NO: 778045 - DNA, 22 bp, Artificial Sequence
  chemically synthesized
ggagggttcatttgaagaattc

SEQ ID NO: 778046 - DNA, 22 bp, Artificial Sequence
  chemically synthesized
acttggagggttcatttgaaga

SEQ ID NO: 778047 - DNA, 22 bp, Artificial Sequence
  chemically synthesized
tatagaattcttcaaatgaacc

SEQ ID NO: 778048 - DNA, 22 bp, Artificial Sequence
  chemically synthesized
tagaattcttcaaatgaaccct

SEQ ID NO: 778049 - DNA, 22 bp, Artificial Sequence
  chemically synthesized
aaatactgacttggagggttca

SEQ ID NO: 778050 - DNA, 22 bp, Artificial Sequence
  chemically synthesized
ttcaaatgaaccctccaagtca

SEQ ID NO: 778051 - DNA, 22 bp, Artificial Sequence
  chemically synthesized
caaatgaaccctccaagtcagt

SEQ ID NO: 778052 - DNA, 22 bp, Artificial Sequence
  chemically synthesized
aaatgaaccctccaagtcagta

SEQ ID NO: 778053 - DNA, 22 bp, Artificial Sequence
  chemically synthesized
caagtcagtattttaactctgc

SEQ ID NO: 778054 - DNA, 22 bp, Artificial Sequence
  chemically synthesized
gcacatacacagtagcagagtt

SEQ ID NO: 778055 - DNA, 22 bp, Artificial Sequence
  chemically synthesized
ggaaacctagcacatacacagt

SEQ ID NO: 778056 - DNA, 22 bp, Artificial Sequence
  chemically synthesized
gggaaacctagcacatacacag

SEQ ID NO: 778057 - DNA, 22 bp, Artificial Sequence
  chemically synthesized
taactctgctactgtgtatgtg

SEQ ID NO: 778058 - DNA, 22 bp, Artificial Sequence
  chemically synthesized
aactctgctactgtgtatgtgc

SEQ ID NO: 778059 - DNA, 22 bp, Artificial Sequence
  chemically synthesized
actctgctactgtgtatgtgct

SEQ ID NO: 778060 - DNA, 22 bp, Artificial Sequence
  chemically synthesized
catttgggaaacctagcacata

SEQ ID NO: 778061 - DNA, 22 bp, Artificial Sequence
  chemically synthesized
tgctactgtgtatgtgctaggt

SEQ ID NO: 778062 - DNA, 22 bp, Artificial Sequence
  chemically synthesized
ctactgtgtatgtgctaggttt

SEQ ID NO: 778063 - DNA, 22 bp, Artificial Sequence
  chemically synthesized
ctgtgtatgtgctaggtttccc

SEQ ID NO: 778064 - DNA, 22 bp, Artificial Sequence
  chemically synthesized
tgtatgtgctaggtttcccaaa

SEQ ID NO: 778065 - DNA, 22 bp, Artificial Sequence
  chemically synthesized
ggaatagagaattccatttggg

SEQ ID NO: 778066 - DNA, 22 bp, Artificial Sequence
  chemically synthesized
tgggaatagagaattccatttg

SEQ ID NO: 778067 - DNA, 22 bp, Artificial Sequence
  chemically synthesized
ttctgggaatagagaattccat

SEQ ID NO: 778068 - DNA, 22 bp, Artificial Sequence
  chemically synthesized
ggtttcccaaatggaattctct

SEQ ID NO: 778069 - DNA, 22 bp, Artificial Sequence
  chemically synthesized
cccaaatggaattctctattcc

SEQ ID NO: 778070 - DNA, 22 bp, Artificial Sequence
  chemically synthesized
ccaaatggaattctctattccc

SEQ ID NO: 778071 - DNA, 22 bp, Artificial Sequence
  chemically synthesized
gaaaagattgttctgggaatag

SEQ ID NO: 778072 - DNA, 22 bp, Artificial Sequence
  chemically synthesized
agaaaagattgttctgggaata

SEQ ID NO: 778073 - DNA, 22 bp, Artificial Sequence
  chemically synthesized
tagaaaagattgttctgggaat

SEQ ID NO: 778074 - DNA, 22 bp, Artificial Sequence
  chemically synthesized
tggctttagaaaagattgttct

SEQ ID NO: 778075 - DNA, 22 bp, Artificial Sequence
  chemically synthesized
gtggctttagaaaagattgttc

SEQ ID NO: 778076 - DNA, 22 bp, Artificial Sequence
  chemically synthesized
tgtggctttagaaaagattgtt

SEQ ID NO: 778077 - DNA, 22 bp, Artificial Sequence
  chemically synthesized
tctattcccagaacaatctttt

SEQ ID NO: 778078 - DNA, 22 bp, Artificial Sequence
  chemically synthesized
ttgtggctttagaaaagattgt

SEQ ID NO: 778079 - DNA, 22 bp, Artificial Sequence
  chemically synthesized
tttgtggctttagaaaagattg

SEQ ID NO: 778080 - DNA, 22 bp, Artificial Sequence
  chemically synthesized
tattcccagaacaatcttttct

SEQ ID NO: 778081 - DNA, 22 bp, Artificial Sequence
  chemically synthesized
ttcccagaacaatcttttctaa

SEQ ID NO: 778082 - DNA, 22 bp, Artificial Sequence
  chemically synthesized
tgttttttgtggctttagaaaa

SEQ ID NO: 778083 - DNA, 22 bp, Artificial Sequence
  chemically synthesized
ccagaacaatcttttctaaagc

SEQ ID NO: 778084 - DNA, 22 bp, Artificial Sequence
  chemically synthesized
gtgttttttgtggctttagaaa

SEQ ID NO: 778085 - DNA, 22 bp, Artificial Sequence
  chemically synthesized
tttgtgttttttgtggctttag

SEQ ID NO: 778086 - DNA, 22 bp, Artificial Sequence
  chemically synthesized
tatttgtgttttttgtggcttt

SEQ ID NO: 778087 - DNA, 22 bp, Artificial Sequence
  chemically synthesized
aattctatttgtgttttttgtg

SEQ ID NO: 778088 - DNA, 22 bp, Artificial Sequence
  chemically synthesized
gaattctatttgtgttttttgt

SEQ ID NO: 778089 - DNA, 22 bp, Artificial Sequence
  chemically synthesized
tgaattctatttgtgttttttg

SEQ ID NO: 778090 - DNA, 22 bp, Artificial Sequence
  chemically synthesized
ttctaaagccacaaaaaacaca

SEQ ID NO: 778091 - DNA, 22 bp, Artificial Sequence
  chemically synthesized
tctaaagccacaaaaaacacaa

SEQ ID NO: 778092 - DNA, 22 bp, Artificial Sequence
  chemically synthesized
ctaaagccacaaaaaacacaaa

SEQ ID NO: 778093 - DNA, 22 bp, Artificial Sequence
  chemically synthesized
taaagccacaaaaaacacaaat

SEQ ID NO: 778094 - DNA, 22 bp, Artificial Sequence
  chemically synthesized
aagccacaaaaaacacaaatag

SEQ ID NO: 778095 - DNA, 22 bp, Artificial Sequence
  chemically synthesized
aaagttcttatgcttgatatac

SEQ ID NO: 778096 - DNA, 22 bp, Artificial Sequence
  chemically synthesized
tgaaagaaggcataaagtatat

SEQ ID NO: 778097 - DNA, 22 bp, Artificial Sequence
  chemically synthesized
atgaaagaaggcataaagtata

SEQ ID NO: 778098 - DNA, 22 bp, Artificial Sequence
  chemically synthesized
tatgaaagaaggcataaagtat

SEQ ID NO: 778099 - DNA, 22 bp, Artificial Sequence
  chemically synthesized
ttatgcttgatatactttatgc

SEQ ID NO: 778100 - DNA, 22 bp, Artificial Sequence
  chemically synthesized
atgcttgatatactttatgcct

SEQ ID NO: 778101 - DNA, 22 bp, Artificial Sequence
  chemically synthesized
tgcttgatatactttatgcctt

SEQ ID NO: 778102 - DNA, 22 bp, Artificial Sequence
  chemically synthesized
gatatactttatgccttctttc

SEQ ID NO: 778103 - DNA, 22 bp, Artificial Sequence
  chemically synthesized
atatactttatgccttctttca

SEQ ID NO: 778104 - DNA, 22 bp, Artificial Sequence
  chemically synthesized
ggtgatgtgttttatgaaagaa

SEQ ID NO: 778105 - DNA, 22 bp, Artificial Sequence
  chemically synthesized
tatgccttctttcataaaacac

SEQ ID NO: 778106 - DNA, 22 bp, Artificial Sequence
  chemically synthesized
atgccttctttcataaaacaca

SEQ ID NO: 778107 - DNA, 22 bp, Artificial Sequence
  chemically synthesized
tgccttctttcataaaacacat

SEQ ID NO: 778108 - DNA, 22 bp, Artificial Sequence
  chemically synthesized
ctttcataaaacacatcaccta

SEQ ID NO: 778109 - DNA, 22 bp, Artificial Sequence
  chemically synthesized
tttcataaaacacatcacctag

SEQ ID NO: 778110 - DNA, 22 bp, Artificial Sequence
  chemically synthesized
tcataaaacacatcacctagtt

SEQ ID NO: 778111 - DNA, 22 bp, Artificial Sequence
  chemically synthesized
cataaaacacatcacctagttt

SEQ ID NO: 778112 - DNA, 22 bp, Artificial Sequence
  chemically synthesized
agagaaacgtgaaaactaggtg

SEQ ID NO: 778113 - DNA, 22 bp, Artificial Sequence
  chemically synthesized
ataaaacacatcacctagtttt

SEQ ID NO: 778114 - DNA, 22 bp, Artificial Sequence
  chemically synthesized
gttttcacgtttctctgaatat

SEQ ID NO: 778115 - DNA, 22 bp, Artificial Sequence
  chemically synthesized
tgacaacataggatattcagag

SEQ ID NO: 778116 - DNA, 22 bp, Artificial Sequence
  chemically synthesized
gtgacaacataggatattcaga

SEQ ID NO: 778117 - DNA, 22 bp, Artificial Sequence
  chemically synthesized
tgtgacaacataggatattcag

SEQ ID NO: 778118 - DNA, 22 bp, Artificial Sequence
  chemically synthesized
ttgtgacaacataggatattca

SEQ ID NO: 778119 - DNA, 22 bp, Artificial Sequence
  chemically synthesized
tcacgtttctctgaatatccta

SEQ ID NO: 778120 - DNA, 22 bp, Artificial Sequence
  chemically synthesized
cacgtttctctgaatatcctat

SEQ ID NO: 778121 - DNA, 22 bp, Artificial Sequence
  chemically synthesized
acgtttctctgaatatcctatg

SEQ ID NO: 778122 - DNA, 22 bp, Artificial Sequence
  chemically synthesized
ctctgaatatcctatgttgtca

SEQ ID NO: 778123 - DNA, 22 bp, Artificial Sequence
  chemically synthesized
tctgaatatcctatgttgtcac

SEQ ID NO: 778124 - DNA, 22 bp, Artificial Sequence
  chemically synthesized
tgaatatcctatgttgtcacaa

SEQ ID NO: 778125 - DNA, 22 bp, Artificial Sequence
  chemically synthesized
aatatcctatgttgtcacaaaa

SEQ ID NO: 778126 - DNA, 22 bp, Artificial Sequence
  chemically synthesized
ggagaaatatatcttttgtgac

SEQ ID NO: 778127 - DNA, 22 bp, Artificial Sequence
  chemically synthesized
aggagaaatatatcttttgtga

SEQ ID NO: 778128 - DNA, 22 bp, Artificial Sequence
  chemically synthesized
acttaggagaaatatatctttt

SEQ ID NO: 778129 - DNA, 22 bp, Artificial Sequence
  chemically synthesized
aacttaggagaaatatatcttt

SEQ ID NO: 778130 - DNA, 22 bp, Artificial Sequence
  chemically synthesized
tgttgtcacaaaagatatattt

SEQ ID NO: 778131 - DNA, 22 bp, Artificial Sequence
  chemically synthesized
gcttaacttaggagaaatatat

SEQ ID NO: 778132 - DNA, 22 bp, Artificial Sequence
  chemically synthesized
agcttaacttaggagaaatata

SEQ ID NO: 778133 - DNA, 22 bp, Artificial Sequence
  chemically synthesized
tagcttaacttaggagaaatat

SEQ ID NO: 778134 - DNA, 22 bp, Artificial Sequence
  chemically synthesized
tcacaaaagatatatttctcct

SEQ ID NO: 778135 - DNA, 22 bp, Artificial Sequence
  chemically synthesized
aaatcatgcgttttagcttaac

SEQ ID NO: 778136 - DNA, 22 bp, Artificial Sequence
  chemically synthesized
aaaatcatgcgttttagcttaa

SEQ ID NO: 778137 - DNA, 22 bp, Artificial Sequence
  chemically synthesized
ctcctaagttaagctaaaacgc

SEQ ID NO: 778138 - DNA, 22 bp, Artificial Sequence
  chemically synthesized
tcttaaaatcatgcgttttagc

SEQ ID NO: 778139 - DNA, 22 bp, Artificial Sequence
  chemically synthesized
tcctaagttaagctaaaacgca

SEQ ID NO: 778140 - DNA, 22 bp, Artificial Sequence
  chemically synthesized
ctaagttaagctaaaacgcatg

SEQ ID NO: 778141 - DNA, 22 bp, Artificial Sequence
  chemically synthesized
ggttgtcttaaaatcatgcgtt

SEQ ID NO: 778142 - DNA, 22 bp, Artificial Sequence
  chemically synthesized
agttaagctaaaacgcatgatt

SEQ ID NO: 778143 - DNA, 22 bp, Artificial Sequence
  chemically synthesized
aggttgtcttaaaatcatgcgt

SEQ ID NO: 778144 - DNA, 22 bp, Artificial Sequence
  chemically synthesized
atttaggttgtcttaaaatcat

SEQ ID NO: 778145 - DNA, 22 bp, Artificial Sequence
  chemically synthesized
agctaaaacgcatgattttaag

SEQ ID NO: 778146 - DNA, 22 bp, Artificial Sequence
  chemically synthesized
catttaggttgtcttaaaatca

SEQ ID NO: 778147 - DNA, 22 bp, Artificial Sequence
  chemically synthesized
tcatttaggttgtcttaaaatc

SEQ ID NO: 778148 - DNA, 22 bp, Artificial Sequence
  chemically synthesized
aaacgcatgattttaagacaac

SEQ ID NO: 778149 - DNA, 22 bp, Artificial Sequence
  chemically synthesized
caattttcatttaggttgtctt

SEQ ID NO: 778150 - DNA, 22 bp, Artificial Sequence
  chemically synthesized
gcaattttcatttaggttgtct

SEQ ID NO: 778151 - DNA, 22 bp, Artificial Sequence
  chemically synthesized
tgtttgcaattttcatttaggt

SEQ ID NO: 778152 - DNA, 22 bp, Artificial Sequence
  chemically synthesized
gtgtttgcaattttcatttagg

SEQ ID NO: 778153 - DNA, 22 bp, Artificial Sequence
  chemically synthesized
tgtgtttgcaattttcatttag

SEQ ID NO: 778154 - DNA, 22 bp, Artificial Sequence
  chemically synthesized
taagacaacctaaatgaaaatt

SEQ ID NO: 778155 - DNA, 22 bp, Artificial Sequence
  chemically synthesized
aagacaacctaaatgaaaattg

SEQ ID NO: 778156 - DNA, 22 bp, Artificial Sequence
  chemically synthesized
agacaacctaaatgaaaattgc

SEQ ID NO: 778157 - DNA, 22 bp, Artificial Sequence
  chemically synthesized
tgaatgtgttttgtgtttgcaa

SEQ ID NO: 778158 - DNA, 22 bp, Artificial Sequence
  chemically synthesized
atgaatgtgttttgtgtttgca

SEQ ID NO: 778159 - DNA, 22 bp, Artificial Sequence
  chemically synthesized
aatgaaaattgcaaacacaaaa

SEQ ID NO: 778160 - DNA, 22 bp, Artificial Sequence
  chemically synthesized
caaacacaaaacacattcataa

SEQ ID NO: 778161 - DNA, 22 bp, Artificial Sequence
  chemically synthesized
ataagcatgaatttatgaatgt

SEQ ID NO: 778162 - DNA, 22 bp, Artificial Sequence
  chemically synthesized
cataagcatgaatttatgaatg

SEQ ID NO: 778163 - DNA, 22 bp, Artificial Sequence
  chemically synthesized
taagtcataatttcataagcat

SEQ ID NO: 778164 - DNA, 22 bp, Artificial Sequence
  chemically synthesized
ataaattcatgcttatgaaatt

SEQ ID NO: 778165 - DNA, 22 bp, Artificial Sequence
  chemically synthesized
tgctgtaagtcataatttcata

SEQ ID NO: 778166 - DNA, 22 bp, Artificial Sequence
  chemically synthesized
atgctgtaagtcataatttcat

SEQ ID NO: 778167 - DNA, 22 bp, Artificial Sequence
  chemically synthesized
atgcttatgaaattatgactta

SEQ ID NO: 778168 - DNA, 22 bp, Artificial Sequence
  chemically synthesized
atgaaattatgacttacagcat

SEQ ID NO: 778169 - DNA, 22 bp, Artificial Sequence
  chemically synthesized
tgaaattatgacttacagcata

SEQ ID NO: 778170 - DNA, 22 bp, Artificial Sequence
  chemically synthesized
aatatcaagaataacttatgct

SEQ ID NO: 778171 - DNA, 22 bp, Artificial Sequence
  chemically synthesized
aaatatcaagaataacttatgc

SEQ ID NO: 778172 - DNA, 22 bp, Artificial Sequence
  chemically synthesized
taaatatcaagaataacttatg

SEQ ID NO: 778173 - DNA, 22 bp, Artificial Sequence
  chemically synthesized
ttaaatatcaagaataacttat

SEQ ID NO: 778174 - DNA, 22 bp, Artificial Sequence
  chemically synthesized
tgacttacagcataagttattc

SEQ ID NO: 778175 - DNA, 22 bp, Artificial Sequence
  chemically synthesized
ttttaaatatcaagaataactt

SEQ ID NO: 778176 - DNA, 22 bp, Artificial Sequence
  chemically synthesized
acagcataagttattcttgata

SEQ ID NO: 778177 - DNA, 22 bp, Artificial Sequence
  chemically synthesized
cagcataagttattcttgatat

SEQ ID NO: 778178 - DNA, 22 bp, Artificial Sequence
  chemically synthesized
ataaacgattcttttaaatatc

SEQ ID NO: 778179 - DNA, 22 bp, Artificial Sequence
  chemically synthesized
ttcttgatatttaaaagaatcg

SEQ ID NO: 778180 - DNA, 22 bp, Artificial Sequence
  chemically synthesized
ttgatatttaaaagaatcgttt

SEQ ID NO: 778181 - DNA, 22 bp, Artificial Sequence
  chemically synthesized
gatatttaaaagaatcgtttat

SEQ ID NO: 778182 - DNA, 22 bp, Artificial Sequence
  chemically synthesized
atatttaaaagaatcgtttatg

SEQ ID NO: 778183 - DNA, 22 bp, Artificial Sequence
  chemically synthesized
atgatgacaaaaactcataaac

SEQ ID NO: 778184 - DNA, 22 bp, Artificial Sequence
  chemically synthesized
aaaagaatcgtttatgagtttt

SEQ ID NO: 778185 - DNA, 22 bp, Artificial Sequence
  chemically synthesized
aaagaatcgtttatgagttttt

SEQ ID NO: 778186 - DNA, 22 bp, Artificial Sequence
  chemically synthesized
tcaaacattcatgatgacaaaa

SEQ ID NO: 778187 - DNA, 22 bp, Artificial Sequence
  chemically synthesized
ttgtcaaacattcatgatgaca

SEQ ID NO: 778188 - DNA, 22 bp, Artificial Sequence
  chemically synthesized
gttgtcaaacattcatgatgac

SEQ ID NO: 778189 - DNA, 22 bp, Artificial Sequence
  chemically synthesized
atgagtttttgtcatcatgaat

SEQ ID NO: 778190 - DNA, 22 bp, Artificial Sequence
  chemically synthesized
tgagtttttgtcatcatgaatg

SEQ ID NO: 778191 - DNA, 22 bp, Artificial Sequence
  chemically synthesized
ttgtcatcatgaatgtttgaca

SEQ ID NO: 778192 - DNA, 22 bp, Artificial Sequence
  chemically synthesized
tgtcatcatgaatgtttgacaa

SEQ ID NO: 778193 - DNA, 22 bp, Artificial Sequence
  chemically synthesized
gtcatcatgaatgtttgacaac

SEQ ID NO: 778194 - DNA, 22 bp, Artificial Sequence
  chemically synthesized
acagataatcttgttgtcaaac

SEQ ID NO: 778195 - DNA, 22 bp, Artificial Sequence
  chemically synthesized
tcatcatgaatgtttgacaaca

SEQ ID NO: 778196 - DNA, 22 bp, Artificial Sequence
  chemically synthesized
ttcacagataatcttgttgtca

SEQ ID NO: 778197 - DNA, 22 bp, Artificial Sequence
  chemically synthesized
gttcacagataatcttgttgtc

SEQ ID NO: 778198 - DNA, 22 bp, Artificial Sequence
  chemically synthesized
ttgttcacagataatcttgttg

SEQ ID NO: 778199 - DNA, 22 bp, Artificial Sequence
  chemically synthesized
gacaacaagattatctgtgaac

SEQ ID NO: 778200 - DNA, 22 bp, Artificial Sequence
  chemically synthesized
acaacaagattatctgtgaaca

SEQ ID NO: 778201 - DNA, 22 bp, Artificial Sequence
  chemically synthesized
tgtaagcccacacaatctcttg

SEQ ID NO: 778202 - DNA, 22 bp, Artificial Sequence
  chemically synthesized
tctgtgaacaagagattgtgtg

SEQ ID NO: 778203 - DNA, 22 bp, Artificial Sequence
  chemically synthesized
tgaacaagagattgtgtgggct

SEQ ID NO: 778204 - DNA, 22 bp, Artificial Sequence
  chemically synthesized
aaaatactgtgtaagcccacac

SEQ ID NO: 778205 - DNA, 22 bp, Artificial Sequence
  chemically synthesized
gttgaaaatactgtgtaagccc

SEQ ID NO: 778206 - DNA, 22 bp, Artificial Sequence
  chemically synthesized
agttgaaaatactgtgtaagcc

SEQ ID NO: 778207 - DNA, 22 bp, Artificial Sequence
  chemically synthesized
tagttgaaaatactgtgtaagc

SEQ ID NO: 778208 - DNA, 22 bp, Artificial Sequence
  chemically synthesized
ttagttgaaaatactgtgtaag

SEQ ID NO: 778209 - DNA, 22 bp, Artificial Sequence
  chemically synthesized
tgtgggcttacacagtattttc

SEQ ID NO: 778210 - DNA, 22 bp, Artificial Sequence
  chemically synthesized
acacagtattttcaactaaaag

SEQ ID NO: 778211 - DNA, 22 bp, Artificial Sequence
  chemically synthesized
cacagtattttcaactaaaagt

SEQ ID NO: 778212 - DNA, 22 bp, Artificial Sequence
  chemically synthesized
aacaaaataccgtaacttttag

SEQ ID NO: 778213 - DNA, 22 bp, Artificial Sequence
  chemically synthesized
tgttaaacaaaataccgtaact

SEQ ID NO: 778214 - DNA, 22 bp, Artificial Sequence
  chemically synthesized
tgtgttaaacaaaataccgtaa

SEQ ID NO: 778215 - DNA, 22 bp, Artificial Sequence
  chemically synthesized
tcaactaaaagttacggtattt

SEQ ID NO: 778216 - DNA, 22 bp, Artificial Sequence
  chemically synthesized
ctgtgttaaacaaaataccgta

SEQ ID NO: 778217 - DNA, 22 bp, Artificial Sequence
  chemically synthesized
caactaaaagttacggtatttt

SEQ ID NO: 778218 - DNA, 22 bp, Artificial Sequence
  chemically synthesized
aactaaaagttacggtattttg

SEQ ID NO: 778219 - DNA, 22 bp, Artificial Sequence
  chemically synthesized
aaagttacggtattttgtttaa

SEQ ID NO: 778220 - DNA, 22 bp, Artificial Sequence
  chemically synthesized
tggtgtggtttctgtgttaaac

SEQ ID NO: 778221 - DNA, 22 bp, Artificial Sequence
  chemically synthesized
cggtattttgtttaacacagaa

SEQ ID NO: 778222 - DNA, 22 bp, Artificial Sequence
  chemically synthesized
acctatggtgtggtttctgtgt

SEQ ID NO: 778223 - DNA, 22 bp, Artificial Sequence
  chemically synthesized
aacctatggtgtggtttctgtg

SEQ ID NO: 778224 - DNA, 22 bp, Artificial Sequence
  chemically synthesized
tgtttaacacagaaaccacacc

SEQ ID NO: 778225 - DNA, 22 bp, Artificial Sequence
  chemically synthesized
gtttaacacagaaaccacacca

SEQ ID NO: 778226 - DNA, 22 bp, Artificial Sequence
  chemically synthesized
aaacttaacctatggtgtggtt

SEQ ID NO: 778227 - DNA, 22 bp, Artificial Sequence
  chemically synthesized
tttaacacagaaaccacaccat

SEQ ID NO: 778228 - DNA, 22 bp, Artificial Sequence
  chemically synthesized
aacacagaaaccacaccatagg

SEQ ID NO: 778229 - DNA, 22 bp, Artificial Sequence
  chemically synthesized
acacagaaaccacaccataggt

SEQ ID NO: 778230 - DNA, 22 bp, Artificial Sequence
  chemically synthesized
aaaataatctcaaacttaacct

SEQ ID NO: 778231 - DNA, 22 bp, Artificial Sequence
  chemically synthesized
caaaataatctcaaacttaacc

SEQ ID NO: 778232 - DNA, 22 bp, Artificial Sequence
  chemically synthesized
agatatttcaaaataatctcaa

SEQ ID NO: 778233 - DNA, 22 bp, Artificial Sequence
  chemically synthesized
agtagttcagatatttcaaaat

SEQ ID NO: 778234 - DNA, 22 bp, Artificial Sequence
  chemically synthesized
agtttgagattattttgaaata

SEQ ID NO: 778235 - DNA, 22 bp, Artificial Sequence
  chemically synthesized
ctgagtagttcagatatttcaa

SEQ ID NO: 778236 - DNA, 22 bp, Artificial Sequence
  chemically synthesized
gagattattttgaaatatctga

SEQ ID NO: 778237 - DNA, 22 bp, Artificial Sequence
  chemically synthesized
agattattttgaaatatctgaa

SEQ ID NO: 778238 - DNA, 22 bp, Artificial Sequence
  chemically synthesized
cctgctgagtagttcagatatt

SEQ ID NO: 778239 - DNA, 22 bp, Artificial Sequence
  chemically synthesized
acctgctgagtagttcagatat

SEQ ID NO: 778240 - DNA, 22 bp, Artificial Sequence
  chemically synthesized
tacctgctgagtagttcagata

SEQ ID NO: 778241 - DNA, 22 bp, Artificial Sequence
  chemically synthesized
ttacctgctgagtagttcagat

SEQ ID NO: 778242 - DNA, 22 bp, Artificial Sequence
  chemically synthesized
ttttgaaatatctgaactactc

SEQ ID NO: 778243 - DNA, 22 bp, Artificial Sequence
  chemically synthesized
tttttacctgctgagtagttca

SEQ ID NO: 778244 - DNA, 22 bp, Artificial Sequence
  chemically synthesized
gtttttacctgctgagtagttc

SEQ ID NO: 778245 - DNA, 22 bp, Artificial Sequence
  chemically synthesized
tgaaatatctgaactactcagc

SEQ ID NO: 778246 - DNA, 22 bp, Artificial Sequence
  chemically synthesized
gaaatatctgaactactcagca

SEQ ID NO: 778247 - DNA, 22 bp, Artificial Sequence
  chemically synthesized
tttgtttttacctgctgagtag

SEQ ID NO: 778248 - DNA, 22 bp, Artificial Sequence
  chemically synthesized
aaatatctgaactactcagcag

SEQ ID NO: 778249 - DNA, 22 bp, Artificial Sequence
  chemically synthesized
tattatttgtttttacctgctg

SEQ ID NO: 778250 - DNA, 22 bp, Artificial Sequence
  chemically synthesized
aactactcagcaggtaaaaaca

SEQ ID NO: 778251 - DNA, 22 bp, Artificial Sequence
  chemically synthesized
ctcagcaggtaaaaacaaataa

SEQ ID NO: 778252 - DNA, 22 bp, Artificial Sequence
  chemically synthesized
taaatgggctgtattatttgtt

SEQ ID NO: 778253 - DNA, 22 bp, Artificial Sequence
  chemically synthesized
agcaggtaaaaacaaataatac

SEQ ID NO: 778254 - DNA, 22 bp, Artificial Sequence
  chemically synthesized
atgagctataaatgggctgtat

SEQ ID NO: 778255 - DNA, 22 bp, Artificial Sequence
  chemically synthesized
aaaacaaaaaactgatgagcta

SEQ ID NO: 778256 - DNA, 22 bp, Artificial Sequence
  chemically synthesized
gatgactcaaaacaaaaaactg

SEQ ID NO: 778257 - DNA, 22 bp, Artificial Sequence
  chemically synthesized
agatgactcaaaacaaaaaact

SEQ ID NO: 778258 - DNA, 22 bp, Artificial Sequence
  chemically synthesized
atagctcatcagttttttgttt

SEQ ID NO: 778259 - DNA, 22 bp, Artificial Sequence
  chemically synthesized
tagctcatcagttttttgtttt

SEQ ID NO: 778260 - DNA, 22 bp, Artificial Sequence
  chemically synthesized
cttagatgactcaaaacaaaaa

SEQ ID NO: 778261 - DNA, 22 bp, Artificial Sequence
  chemically synthesized
ttgcttagatgactcaaaacaa

SEQ ID NO: 778262 - DNA, 22 bp, Artificial Sequence
  chemically synthesized
atcagttttttgttttgagtca

SEQ ID NO: 778263 - DNA, 22 bp, Artificial Sequence
  chemically synthesized
agttattgcttagatgactcaa

SEQ ID NO: 778264 - DNA, 22 bp, Artificial Sequence
  chemically synthesized
gagttattgcttagatgactca

SEQ ID NO: 778265 - DNA, 22 bp, Artificial Sequence
  chemically synthesized
cttgagttattgcttagatgac

SEQ ID NO: 778266 - DNA, 22 bp, Artificial Sequence
  chemically synthesized
ccttgagttattgcttagatga

SEQ ID NO: 778267 - DNA, 22 bp, Artificial Sequence
  chemically synthesized
tttgttttgagtcatctaagca

SEQ ID NO: 778268 - DNA, 22 bp, Artificial Sequence
  chemically synthesized
ttgttttgagtcatctaagcaa

SEQ ID NO: 778269 - DNA, 22 bp, Artificial Sequence
  chemically synthesized
tgttttgagtcatctaagcaat

SEQ ID NO: 778270 - DNA, 22 bp, Artificial Sequence
  chemically synthesized
gttttgagtcatctaagcaata

SEQ ID NO: 778271 - DNA, 22 bp, Artificial Sequence
  chemically synthesized
ttttgagtcatctaagcaataa

SEQ ID NO: 778272 - DNA, 22 bp, Artificial Sequence
  chemically synthesized
accttccttgagttattgctta

SEQ ID NO: 778273 - DNA, 22 bp, Artificial Sequence
  chemically synthesized
tcaccttccttgagttattgct

SEQ ID NO: 778274 - DNA, 22 bp, Artificial Sequence
  chemically synthesized
tgagtcatctaagcaataactc

SEQ ID NO: 778275 - DNA, 22 bp, Artificial Sequence
  chemically synthesized
gagtcatctaagcaataactca

SEQ ID NO: 778276 - DNA, 22 bp, Artificial Sequence
  chemically synthesized
tctcaccttccttgagttattg

SEQ ID NO: 778277 - DNA, 22 bp, Artificial Sequence
  chemically synthesized
agtcatctaagcaataactcaa

SEQ ID NO: 778278 - DNA, 22 bp, Artificial Sequence
  chemically synthesized
tctctcaccttccttgagttat

SEQ ID NO: 778279 - DNA, 22 bp, Artificial Sequence
  chemically synthesized
agcaataactcaaggaaggtga

SEQ ID NO: 778280 - DNA, 22 bp, Artificial Sequence
  chemically synthesized
gagggtggcaaatgctctctct

SEQ ID NO: 778281 - DNA, 22 bp, Artificial Sequence
  chemically synthesized
aaggaaggtgagagagagcatt

SEQ ID NO: 778282 - DNA, 22 bp, Artificial Sequence
  chemically synthesized
ccaccctggagggtggcaaatg

SEQ ID NO: 778283 - DNA, 22 bp, Artificial Sequence
  chemically synthesized
agttgccaccctggagggtggc

SEQ ID NO: 778284 - DNA, 22 bp, Artificial Sequence
  chemically synthesized
aagttcagttgccaccctggag

SEQ ID NO: 778285 - DNA, 22 bp, Artificial Sequence
  chemically synthesized
ctgaagttcagttgccaccctg

SEQ ID NO: 778286 - DNA, 22 bp, Artificial Sequence
  chemically synthesized
gccaccctccagggtggcaact

SEQ ID NO: 778287 - DNA, 22 bp, Artificial Sequence
  chemically synthesized
ccaccctccagggtggcaactg

SEQ ID NO: 778288 - DNA, 22 bp, Artificial Sequence
  chemically synthesized
cagggaattcctgaagttcagt

SEQ ID NO: 778289 - DNA, 22 bp, Artificial Sequence
  chemically synthesized
cagggtggcaactgaacttcag

SEQ ID NO: 778290 - DNA, 22 bp, Artificial Sequence
  chemically synthesized
tatctccagggaattcctgaag

SEQ ID NO: 778291 - DNA, 22 bp, Artificial Sequence
  chemically synthesized
gctgtatctccagggaattcct

SEQ ID NO: 778292 - DNA, 22 bp, Artificial Sequence
  chemically synthesized
aacttcaggaattccctggaga

SEQ ID NO: 778293 - DNA, 22 bp, Artificial Sequence
  chemically synthesized
caggaattccctggagatacag

SEQ ID NO: 778294 - DNA, 22 bp, Artificial Sequence
  chemically synthesized
aggaattccctggagatacagc

SEQ ID NO: 778295 - DNA, 22 bp, Artificial Sequence
  chemically synthesized
cctggagatacagccaattgat

SEQ ID NO: 778296 - DNA, 22 bp, Artificial Sequence
  chemically synthesized
gagatacagccaattgatgctt

SEQ ID NO: 778297 - DNA, 22 bp, Artificial Sequence
  chemically synthesized
atggcagagcatggtgagagat

SEQ ID NO: 778298 - DNA, 22 bp, Artificial Sequence
  chemically synthesized
atgcttcacatctctcaccatg

SEQ ID NO: 778299 - DNA, 22 bp, Artificial Sequence
  chemically synthesized
cacatctctcaccatgctctgc

SEQ ID NO: 778300 - DNA, 22 bp, Artificial Sequence
  chemically synthesized
acatctctcaccatgctctgcc

SEQ ID NO: 778301 - DNA, 22 bp, Artificial Sequence
  chemically synthesized
tcaccatgctctgccatcaatt

SEQ ID NO: 778302 - DNA, 22 bp, Artificial Sequence
  chemically synthesized
catggcaatggagaattgatgg

SEQ ID NO: 778303 - DNA, 22 bp, Artificial Sequence
  chemically synthesized
accatgctctgccatcaattct

SEQ ID NO: 778304 - DNA, 22 bp, Artificial Sequence
  chemically synthesized
tggattccatggcaatggagaa

SEQ ID NO: 778305 - DNA, 22 bp, Artificial Sequence
  chemically synthesized
tgccatcaattctccattgcca

SEQ ID NO: 778306 - DNA, 22 bp, Artificial Sequence
  chemically synthesized
ccatcaattctccattgccatg

SEQ ID NO: 778307 - DNA, 22 bp, Artificial Sequence
  chemically synthesized
cattgtggattccatggcaatg

SEQ ID NO: 778308 - DNA, 22 bp, Artificial Sequence
  chemically synthesized
ccattgtggattccatggcaat

SEQ ID NO: 778309 - DNA, 22 bp, Artificial Sequence
  chemically synthesized
tccattgccatggaatccacaa

SEQ ID NO: 778310 - DNA, 22 bp, Artificial Sequence
  chemically synthesized
cattgccatggaatccacaatg

SEQ ID NO: 778311 - DNA, 22 bp, Artificial Sequence
  chemically synthesized
agtgtggcacatttccattgtg

SEQ ID NO: 778312 - DNA, 22 bp, Artificial Sequence
  chemically synthesized
ccatggaatccacaatggaaat

SEQ ID NO: 778313 - DNA, 22 bp, Artificial Sequence
  chemically synthesized
aaatgaaaagtggcctaagtgt

SEQ ID NO: 778314 - DNA, 22 bp, Artificial Sequence
  chemically synthesized
aggccacttttcatttcagttc

SEQ ID NO: 778315 - DNA, 22 bp, Artificial Sequence
  chemically synthesized
ggccacttttcatttcagttct

SEQ ID NO: 778316 - DNA, 22 bp, Artificial Sequence
  chemically synthesized
ttcatttcagttcttttatata

SEQ ID NO: 778317 - DNA, 22 bp, Artificial Sequence
  chemically synthesized
tcatttcagttcttttatatat

SEQ ID NO: 778318 - DNA, 22 bp, Artificial Sequence
  chemically synthesized
catttcagttcttttatatatt

SEQ ID NO: 778319 - DNA, 22 bp, Artificial Sequence
  chemically synthesized
atttcagttcttttatatatta

SEQ ID NO: 778320 - DNA, 22 bp, Artificial Sequence
  chemically synthesized
cagttcttttatatattaccct

SEQ ID NO: 778321 - DNA, 22 bp, Artificial Sequence
  chemically synthesized
agttcttttatatattaccctc

SEQ ID NO: 778322 - DNA, 22 bp, Artificial Sequence
  chemically synthesized
ttttatatattaccctcccttt

SEQ ID NO: 778323 - DNA, 22 bp, Artificial Sequence
  chemically synthesized
ttatatattaccctcccttttc

SEQ ID NO: 778324 - DNA, 22 bp, Artificial Sequence
  chemically synthesized
caaggagaatatgaaaagggag

SEQ ID NO: 778325 - DNA, 22 bp, Artificial Sequence
  chemically synthesized
tatatattaccctcccttttca

SEQ ID NO: 778326 - DNA, 22 bp, Artificial Sequence
  chemically synthesized
atatattaccctcccttttcat

SEQ ID NO: 778327 - DNA, 22 bp, Artificial Sequence
  chemically synthesized
tatattaccctcccttttcata

SEQ ID NO: 778328 - DNA, 22 bp, Artificial Sequence
  chemically synthesized
agttccaaggagaatatgaaaa

SEQ ID NO: 778329 - DNA, 22 bp, Artificial Sequence
  chemically synthesized
attcagttccaaggagaatatg

SEQ ID NO: 778330 - DNA, 22 bp, Artificial Sequence
  chemically synthesized
ccctcccttttcatattctcct

SEQ ID NO: 778331 - DNA, 22 bp, Artificial Sequence
  chemically synthesized
ccttttcatattctccttggaa

SEQ ID NO: 778332 - DNA, 22 bp, Artificial Sequence
  chemically synthesized
ttcatattctccttggaactga

SEQ ID NO: 778333 - DNA, 22 bp, Artificial Sequence
  chemically synthesized
tcatattctccttggaactgaa

SEQ ID NO: 778334 - DNA, 22 bp, Artificial Sequence
  chemically synthesized
catattctccttggaactgaat

SEQ ID NO: 778335 - DNA, 22 bp, Artificial Sequence
  chemically synthesized
aaacagtaactcattcagttcc

SEQ ID NO: 778336 - DNA, 22 bp, Artificial Sequence
  chemically synthesized
atattctccttggaactgaatg

SEQ ID NO: 778337 - DNA, 22 bp, Artificial Sequence
  chemically synthesized
gaaacagtaactcattcagttc

SEQ ID NO: 778338 - DNA, 22 bp, Artificial Sequence
  chemically synthesized
tgaaacagtaactcattcagtt

SEQ ID NO: 778339 - DNA, 22 bp, Artificial Sequence
  chemically synthesized
tttgaaacagtaactcattcag

SEQ ID NO: 778340 - DNA, 22 bp, Artificial Sequence
  chemically synthesized
tccttggaactgaatgagttac

SEQ ID NO: 778341 - DNA, 22 bp, Artificial Sequence
  chemically synthesized
cttggaactgaatgagttactg

SEQ ID NO: 778342 - DNA, 22 bp, Artificial Sequence
  chemically synthesized
ggaactgaatgagttactgttt

SEQ ID NO: 778343 - DNA, 22 bp, Artificial Sequence
  chemically synthesized
gaactgaatgagttactgtttc

SEQ ID NO: 778344 - DNA, 22 bp, Artificial Sequence
  chemically synthesized
aatgagttactgtttcaaagaa

SEQ ID NO: 778345 - DNA, 22 bp, Artificial Sequence
  chemically synthesized
gtacagggcccccattctttga

SEQ ID NO: 778346 - DNA, 22 bp, Artificial Sequence
  chemically synthesized
cctagtacagggcccccattct

SEQ ID NO: 778347 - DNA, 22 bp, Artificial Sequence
  chemically synthesized
ccctagtacagggcccccattc

SEQ ID NO: 778348 - DNA, 22 bp, Artificial Sequence
  chemically synthesized
ctgtttcaaagaatgggggccc

SEQ ID NO: 778349 - DNA, 22 bp, Artificial Sequence
  chemically synthesized
tttcaaagaatgggggccctgt

SEQ ID NO: 778350 - DNA, 22 bp, Artificial Sequence
  chemically synthesized
caaagaatgggggccctgtact

SEQ ID NO: 778351 - DNA, 22 bp, Artificial Sequence
  chemically synthesized
aaagaatgggggccctgtacta

SEQ ID NO: 778352 - DNA, 22 bp, Artificial Sequence
  chemically synthesized
taccccacccttccctagtaca

SEQ ID NO: 778353 - DNA, 22 bp, Artificial Sequence
  chemically synthesized
tcattataccccacccttccct

SEQ ID NO: 778354 - DNA, 22 bp, Artificial Sequence
  chemically synthesized
gtcattataccccacccttccc

SEQ ID NO: 778355 - DNA, 22 bp, Artificial Sequence
  chemically synthesized
cttgtcattataccccaccctt

SEQ ID NO: 778356 - DNA, 22 bp, Artificial Sequence
  chemically synthesized
gcttgtcattataccccaccct

SEQ ID NO: 778357 - DNA, 22 bp, Artificial Sequence
  chemically synthesized
tactagggaagggtggggtata

SEQ ID NO: 778358 - DNA, 22 bp, Artificial Sequence
  chemically synthesized
gggaagggtggggtataatgac

SEQ ID NO: 778359 - DNA, 22 bp, Artificial Sequence
  chemically synthesized
caaacaaatgaacttgcttgtc

SEQ ID NO: 778360 - DNA, 22 bp, Artificial Sequence
  chemically synthesized
ttccaaacaaatgaacttgctt

SEQ ID NO: 778361 - DNA, 22 bp, Artificial Sequence
  chemically synthesized
attccaaacaaatgaacttgct

SEQ ID NO: 778362 - DNA, 22 bp, Artificial Sequence
  chemically synthesized
tattccaaacaaatgaacttgc

SEQ ID NO: 778363 - DNA, 22 bp, Artificial Sequence
  chemically synthesized
ttttattccaaacaaatgaact

SEQ ID NO: 778364 - DNA, 22 bp, Artificial Sequence
  chemically synthesized
actattttattccaaacaaatg

SEQ ID NO: 778365 - DNA, 22 bp, Artificial Sequence
  chemically synthesized
ctgactattttattccaaacaa

SEQ ID NO: 778366 - DNA, 22 bp, Artificial Sequence
  chemically synthesized
ttgctgactattttattccaaa

SEQ ID NO: 778367 - DNA, 22 bp, Artificial Sequence
  chemically synthesized
tgttgctgactattttattcca

SEQ ID NO: 778368 - DNA, 22 bp, Artificial Sequence
  chemically synthesized
ttctgttgctgactattttatt

SEQ ID NO: 778369 - DNA, 22 bp, Artificial Sequence
  chemically synthesized
atttgtttggaataaaatagtc

SEQ ID NO: 778370 - DNA, 22 bp, Artificial Sequence
  chemically synthesized
ttgttctgttgctgactatttt

SEQ ID NO: 778371 - DNA, 22 bp, Artificial Sequence
  chemically synthesized
attgttctgttgctgactattt

SEQ ID NO: 778372 - DNA, 22 bp, Artificial Sequence
  chemically synthesized
gtttggaataaaatagtcagca

SEQ ID NO: 778373 - DNA, 22 bp, Artificial Sequence
  chemically synthesized
tttggaataaaatagtcagcaa

SEQ ID NO: 778374 - DNA, 22 bp, Artificial Sequence
  chemically synthesized
tgtttattgttctgttgctgac

SEQ ID NO: 778375 - DNA, 22 bp, Artificial Sequence
  chemically synthesized
ggaataaaatagtcagcaacag

SEQ ID NO: 778376 - DNA, 22 bp, Artificial Sequence
  chemically synthesized
gaataaaatagtcagcaacaga

SEQ ID NO: 778377 - DNA, 22 bp, Artificial Sequence
  chemically synthesized
tgtgtttattgttctgttgctg

SEQ ID NO: 778378 - DNA, 22 bp, Artificial Sequence
  chemically synthesized
ctgtgtttattgttctgttgct

SEQ ID NO: 778379 - DNA, 22 bp, Artificial Sequence
  chemically synthesized
gcagacttctgtgtttattgtt

SEQ ID NO: 778380 - DNA, 22 bp, Artificial Sequence
  chemically synthesized
tagcagacttctgtgtttattg

SEQ ID NO: 778381 - DNA, 22 bp, Artificial Sequence
  chemically synthesized
ctagcagacttctgtgtttatt

SEQ ID NO: 778382 - DNA, 22 bp, Artificial Sequence
  chemically synthesized
ttctagcagacttctgtgttta

SEQ ID NO: 778383 - DNA, 22 bp, Artificial Sequence
  chemically synthesized
aaggcctcttctagcagacttc

SEQ ID NO: 778384 - DNA, 22 bp, Artificial Sequence
  chemically synthesized
ataaactgaaggcctcttctag

SEQ ID NO: 778385 - DNA, 22 bp, Artificial Sequence
  chemically synthesized
tgttgataaactgaaggcctct

SEQ ID NO: 778386 - DNA, 22 bp, Artificial Sequence
  chemically synthesized
gtgttgataaactgaaggcctc

SEQ ID NO: 778387 - DNA, 22 bp, Artificial Sequence
  chemically synthesized
tgtgttgataaactgaaggcct

SEQ ID NO: 778388 - DNA, 22 bp, Artificial Sequence
  chemically synthesized
tttgtgttgataaactgaaggc

SEQ ID NO: 778389 - DNA, 22 bp, Artificial Sequence
  chemically synthesized
ctagaagaggccttcagtttat

SEQ ID NO: 778390 - DNA, 22 bp, Artificial Sequence
  chemically synthesized
gaagaggccttcagtttatcaa

SEQ ID NO: 778391 - DNA, 22 bp, Artificial Sequence
  chemically synthesized
cagtttatcaacacaaagagtt

SEQ ID NO: 778392 - DNA, 22 bp, Artificial Sequence
  chemically synthesized
agtttatcaacacaaagagttt

SEQ ID NO: 778393 - DNA, 22 bp, Artificial Sequence
  chemically synthesized
atcaacacaaagagttttcttc

SEQ ID NO: 778394 - DNA, 22 bp, Artificial Sequence
  chemically synthesized
tcaacacaaagagttttcttca

SEQ ID NO: 778395 - DNA, 22 bp, Artificial Sequence
  chemically synthesized
acatccaaggaagtcatgaaga

SEQ ID NO: 778396 - DNA, 22 bp, Artificial Sequence
  chemically synthesized
aatgcaactgacatccaaggaa

SEQ ID NO: 778397 - DNA, 22 bp, Artificial Sequence
  chemically synthesized
aaatgcaactgacatccaagga

SEQ ID NO: 778398 - DNA, 22 bp, Artificial Sequence
  chemically synthesized
tcttcatgacttccttggatgt

SEQ ID NO: 778399 - DNA, 22 bp, Artificial Sequence
  chemically synthesized
cttcatgacttccttggatgtc

SEQ ID NO: 778400 - DNA, 22 bp, Artificial Sequence
  chemically synthesized
ttcatgacttccttggatgtca

SEQ ID NO: 778401 - DNA, 22 bp, Artificial Sequence
  chemically synthesized
catgacttccttggatgtcagt

SEQ ID NO: 778402 - DNA, 22 bp, Artificial Sequence
  chemically synthesized
tatttaaatgcaactgacatcc

SEQ ID NO: 778403 - DNA, 22 bp, Artificial Sequence
  chemically synthesized
atgacttccttggatgtcagtt

SEQ ID NO: 778404 - DNA, 22 bp, Artificial Sequence
  chemically synthesized
tatatttaaatgcaactgacat

SEQ ID NO: 778405 - DNA, 22 bp, Artificial Sequence
  chemically synthesized
ccttggatgtcagttgcattta

SEQ ID NO: 778406 - DNA, 22 bp, Artificial Sequence
  chemically synthesized
cttggatgtcagttgcatttaa

SEQ ID NO: 778407 - DNA, 22 bp, Artificial Sequence
  chemically synthesized
gcaactctatatttaaatgcaa

SEQ ID NO: 778408 - DNA, 22 bp, Artificial Sequence
  chemically synthesized
ggatgtcagttgcatttaaata

SEQ ID NO: 778409 - DNA, 22 bp, Artificial Sequence
  chemically synthesized
ttagcaactctatatttaaatg

SEQ ID NO: 778410 - DNA, 22 bp, Artificial Sequence
  chemically synthesized
gatgtcagttgcatttaaatat

SEQ ID NO: 778411 - DNA, 22 bp, Artificial Sequence
  chemically synthesized
catttaaatatagagttgctaa

SEQ ID NO: 778412 - DNA, 22 bp, Artificial Sequence
  chemically synthesized
aaatatagagttgctaataatt

SEQ ID NO: 778413 - DNA, 22 bp, Artificial Sequence
  chemically synthesized
aatatagagttgctaataattt

SEQ ID NO: 778414 - DNA, 22 bp, Artificial Sequence
  chemically synthesized
aacgagtaaagaggaaaggaaa

SEQ ID NO: 778415 - DNA, 22 bp, Artificial Sequence
  chemically synthesized
ctaataatttcctttcctcttt

SEQ ID NO: 778416 - DNA, 22 bp, Artificial Sequence
  chemically synthesized
ataatttcctttcctctttact

SEQ ID NO: 778417 - DNA, 22 bp, Artificial Sequence
  chemically synthesized
cataattaaacgagtaaagagg

SEQ ID NO: 778418 - DNA, 22 bp, Artificial Sequence
  chemically synthesized
cctttcctctttactcgtttaa

SEQ ID NO: 778419 - DNA, 22 bp, Artificial Sequence
  chemically synthesized
ctttcctctttactcgtttaat

SEQ ID NO: 778420 - DNA, 22 bp, Artificial Sequence
  chemically synthesized
tcctctttactcgtttaattat

SEQ ID NO: 778421 - DNA, 22 bp, Artificial Sequence
  chemically synthesized
atatccgattgcataattaaac

SEQ ID NO: 778422 - DNA, 22 bp, Artificial Sequence
  chemically synthesized
cctctttactcgtttaattatg

SEQ ID NO: 778423 - DNA, 22 bp, Artificial Sequence
  chemically synthesized
aatatccgattgcataattaaa

SEQ ID NO: 778424 - DNA, 22 bp, Artificial Sequence
  chemically synthesized
ctctttactcgtttaattatgc

SEQ ID NO: 778425 - DNA, 22 bp, Artificial Sequence
  chemically synthesized
taatatccgattgcataattaa

SEQ ID NO: 778426 - DNA, 22 bp, Artificial Sequence
  chemically synthesized
tttactcgtttaattatgcaat

SEQ ID NO: 778427 - DNA, 22 bp, Artificial Sequence
  chemically synthesized
tactcgtttaattatgcaatcg

SEQ ID NO: 778428 - DNA, 22 bp, Artificial Sequence
  chemically synthesized
actcgtttaattatgcaatcgg

SEQ ID NO: 778429 - DNA, 22 bp, Artificial Sequence
  chemically synthesized
ctcgtttaattatgcaatcgga

SEQ ID NO: 778430 - DNA, 22 bp, Artificial Sequence
  chemically synthesized
gtttaattatgcaatcggatat

SEQ ID NO: 778431 - DNA, 22 bp, Artificial Sequence
  chemically synthesized
acccaatgctttaatatccgat

SEQ ID NO: 778432 - DNA, 22 bp, Artificial Sequence
  chemically synthesized
aattatgcaatcggatattaaa

SEQ ID NO: 778433 - DNA, 22 bp, Artificial Sequence
  chemically synthesized
attatgcaatcggatattaaag

SEQ ID NO: 778434 - DNA, 22 bp, Artificial Sequence
  chemically synthesized
tgcaatcggatattaaagcatt

SEQ ID NO: 778435 - DNA, 22 bp, Artificial Sequence
  chemically synthesized
ggcaaaatacctgacccaatgc

SEQ ID NO: 778436 - DNA, 22 bp, Artificial Sequence
  chemically synthesized
aaattgggcaaaatacctgacc

SEQ ID NO: 778437 - DNA, 22 bp, Artificial Sequence
  chemically synthesized
aagcattgggtcaggtattttg

SEQ ID NO: 778438 - DNA, 22 bp, Artificial Sequence
  chemically synthesized
ggtcaggtattttgcccaattt

SEQ ID NO: 778439 - DNA, 22 bp, Artificial Sequence
  chemically synthesized
aaatacaaataaaatagctaaa

SEQ ID NO: 778440 - DNA, 22 bp, Artificial Sequence
  chemically synthesized
tgcccaattttagctattttat

SEQ ID NO: 778441 - DNA, 22 bp, Artificial Sequence
  chemically synthesized
gcccaattttagctattttatt

SEQ ID NO: 778442 - DNA, 22 bp, Artificial Sequence
  chemically synthesized
cccaattttagctattttattt

SEQ ID NO: 778443 - DNA, 22 bp, Artificial Sequence
  chemically synthesized
gaaatagttaaaatacaaataa

SEQ ID NO: 778444 - DNA, 22 bp, Artificial Sequence
  chemically synthesized
tagctattttatttgtatttta

SEQ ID NO: 778445 - DNA, 22 bp, Artificial Sequence
  chemically synthesized
agctattttatttgtattttaa

SEQ ID NO: 778446 - DNA, 22 bp, Artificial Sequence
  chemically synthesized
gctattttatttgtattttaac

SEQ ID NO: 778447 - DNA, 22 bp, Artificial Sequence
  chemically synthesized
aaattggaaatagttaaaatac

SEQ ID NO: 778448 - DNA, 22 bp, Artificial Sequence
  chemically synthesized
ttttatttgtattttaactatt

SEQ ID NO: 778449 - DNA, 22 bp, Artificial Sequence
  chemically synthesized
tatttgtattttaactatttcc

SEQ ID NO: 778450 - DNA, 22 bp, Artificial Sequence
  chemically synthesized
atttgtattttaactatttcca

SEQ ID NO: 778451 - DNA, 22 bp, Artificial Sequence
  chemically synthesized
tttgtattttaactatttccaa

SEQ ID NO: 778452 - DNA, 22 bp, Artificial Sequence
  chemically synthesized
gtattttaactatttccaattt

SEQ ID NO: 778453 - DNA, 22 bp, Artificial Sequence
  chemically synthesized
tattttaactatttccaatttt

SEQ ID NO: 778454 - DNA, 22 bp, Artificial Sequence
  chemically synthesized
taactatttccaattttaactg

SEQ ID NO: 778455 - DNA, 22 bp, Artificial Sequence
  chemically synthesized
aactatttccaattttaactgt

SEQ ID NO: 778456 - DNA, 22 bp, Artificial Sequence
  chemically synthesized
actatttccaattttaactgtt

SEQ ID NO: 778457 - DNA, 22 bp, Artificial Sequence
  chemically synthesized
gatataaatcaagaacagttaa

SEQ ID NO: 778458 - DNA, 22 bp, Artificial Sequence
  chemically synthesized
tttccaattttaactgttcttg

SEQ ID NO: 778459 - DNA, 22 bp, Artificial Sequence
  chemically synthesized
ccaattttaactgttcttgatt

SEQ ID NO: 778460 - DNA, 22 bp, Artificial Sequence
  chemically synthesized
caattttaactgttcttgattt

SEQ ID NO: 778461 - DNA, 22 bp, Artificial Sequence
  chemically synthesized
gaaataaattggatataaatca

SEQ ID NO: 778462 - DNA, 22 bp, Artificial Sequence
  chemically synthesized
taactgttcttgatttatatcc

SEQ ID NO: 778463 - DNA, 22 bp, Artificial Sequence
  chemically synthesized
aactgttcttgatttatatcca

SEQ ID NO: 778464 - DNA, 22 bp, Artificial Sequence
  chemically synthesized
actgttcttgatttatatccaa

SEQ ID NO: 778465 - DNA, 22 bp, Artificial Sequence
  chemically synthesized
ttcttgatttatatccaattta

SEQ ID NO: 778466 - DNA, 22 bp, Artificial Sequence
  chemically synthesized
ttgatttatatccaatttattt

SEQ ID NO: 778467 - DNA, 22 bp, Artificial Sequence
  chemically synthesized
caatataaattggaaataaatt

SEQ ID NO: 778468 - DNA, 22 bp, Artificial Sequence
  chemically synthesized
gatttatatccaatttatttcc

SEQ ID NO: 778469 - DNA, 22 bp, Artificial Sequence
  chemically synthesized
ccaatataaattggaaataaat

SEQ ID NO: 778470 - DNA, 22 bp, Artificial Sequence
  chemically synthesized
atttatatccaatttatttcca

SEQ ID NO: 778471 - DNA, 22 bp, Artificial Sequence
  chemically synthesized
atatccaatttatttccaattt

SEQ ID NO: 778472 - DNA, 22 bp, Artificial Sequence
  chemically synthesized
tatccaatttatttccaattta

SEQ ID NO: 778473 - DNA, 22 bp, Artificial Sequence
  chemically synthesized
gccaagatttccaatataaatt

SEQ ID NO: 778474 - DNA, 22 bp, Artificial Sequence
  chemically synthesized
ctggccaagatttccaatataa

SEQ ID NO: 778475 - DNA, 22 bp, Artificial Sequence
  chemically synthesized
actggccaagatttccaatata

SEQ ID NO: 778476 - DNA, 22 bp, Artificial Sequence
  chemically synthesized
atttccaatttatattggaaat

SEQ ID NO: 778477 - DNA, 22 bp, Artificial Sequence
  chemically synthesized
tttccaatttatattggaaatc

SEQ ID NO: 778478 - DNA, 22 bp, Artificial Sequence
  chemically synthesized
tttactggccaagatttccaat

SEQ ID NO: 778479 - DNA, 22 bp, Artificial Sequence
  chemically synthesized
ccaatttatattggaaatcttg

SEQ ID NO: 778480 - DNA, 22 bp, Artificial Sequence
  chemically synthesized
caatttatattggaaatcttgg

SEQ ID NO: 778481 - DNA, 22 bp, Artificial Sequence
  chemically synthesized
aaattatttactggccaagatt

SEQ ID NO: 778482 - DNA, 22 bp, Artificial Sequence
  chemically synthesized
atattggaaatcttggccagta

SEQ ID NO: 778483 - DNA, 22 bp, Artificial Sequence
  chemically synthesized
tattggaaatcttggccagtaa

SEQ ID NO: 778484 - DNA, 22 bp, Artificial Sequence
  chemically synthesized
tactcaaattatttactggcca

SEQ ID NO: 778485 - DNA, 22 bp, Artificial Sequence
  chemically synthesized
gaaatcttggccagtaaataat

SEQ ID NO: 778486 - DNA, 22 bp, Artificial Sequence
  chemically synthesized
aaccatgctatactcaaattat

SEQ ID NO: 778487 - DNA, 22 bp, Artificial Sequence
  chemically synthesized
ggccagtaaataatttgagtat

SEQ ID NO: 778488 - DNA, 22 bp, Artificial Sequence
  chemically synthesized
gccagtaaataatttgagtata

SEQ ID NO: 778489 - DNA, 22 bp, Artificial Sequence
  chemically synthesized
taatattaaaccatgctatact

SEQ ID NO: 778490 - DNA, 22 bp, Artificial Sequence
  chemically synthesized
ataatattaaaccatgctatac

SEQ ID NO: 778491 - DNA, 22 bp, Artificial Sequence
  chemically synthesized
tataatattaaaccatgctata

SEQ ID NO: 778492 - DNA, 22 bp, Artificial Sequence
  chemically synthesized
gagtatagcatggtttaatatt

SEQ ID NO: 778493 - DNA, 22 bp, Artificial Sequence
  chemically synthesized
agtatagcatggtttaatatta

SEQ ID NO: 778494 - DNA, 22 bp, Artificial Sequence
  chemically synthesized
tgtatgtatatataacctttat

SEQ ID NO: 778495 - DNA, 22 bp, Artificial Sequence
  chemically synthesized
aatattataaaggttatatata

SEQ ID NO: 778496 - DNA, 22 bp, Artificial Sequence
  chemically synthesized
atattataaaggttatatatac

SEQ ID NO: 778497 - DNA, 22 bp, Artificial Sequence
  chemically synthesized
taaaggttatatatacatacac

SEQ ID NO: 778498 - DNA, 22 bp, Artificial Sequence
  chemically synthesized
catgggagagagagactgtgta

SEQ ID NO: 778499 - DNA, 22 bp, Artificial Sequence
  chemically synthesized
tatatacatacacagtctctct

SEQ ID NO: 778500 - DNA, 22 bp, Artificial Sequence
  chemically synthesized
gtggatatagttacatgggaga

SEQ ID NO: 778501 - DNA, 22 bp, Artificial Sequence
  chemically synthesized
agtggatatagttacatgggag

SEQ ID NO: 778502 - DNA, 22 bp, Artificial Sequence
  chemically synthesized
tagtggatatagttacatggga

SEQ ID NO: 778503 - DNA, 22 bp, Artificial Sequence
  chemically synthesized
ggactttagtggatatagttac

SEQ ID NO: 778504 - DNA, 22 bp, Artificial Sequence
  chemically synthesized
aggactttagtggatatagtta

SEQ ID NO: 778505 - DNA, 22 bp, Artificial Sequence
  chemically synthesized
tctctcccatgtaactatatcc

SEQ ID NO: 778506 - DNA, 22 bp, Artificial Sequence
  chemically synthesized
taggactttagtggatatagtt

SEQ ID NO: 778507 - DNA, 22 bp, Artificial Sequence
  chemically synthesized
tctcccatgtaactatatccac

SEQ ID NO: 778508 - DNA, 22 bp, Artificial Sequence
  chemically synthesized
ctttaggactttagtggatata

SEQ ID NO: 778509 - DNA, 22 bp, Artificial Sequence
  chemically synthesized
tcccatgtaactatatccacta

SEQ ID NO: 778510 - DNA, 22 bp, Artificial Sequence
  chemically synthesized
ccatgtaactatatccactaaa

SEQ ID NO: 778511 - DNA, 22 bp, Artificial Sequence
  chemically synthesized
ttactttaggactttagtggat

SEQ ID NO: 778512 - DNA, 22 bp, Artificial Sequence
  chemically synthesized
tatccactaaagtcctaaagta

SEQ ID NO: 778513 - DNA, 22 bp, Artificial Sequence
  chemically synthesized
aagtcctaaagtaacaatgcct

SEQ ID NO: 778514 - DNA, 22 bp, Artificial Sequence
  chemically synthesized
agtcaccataacagacagaggc

SEQ ID NO: 778515 - DNA, 22 bp, Artificial Sequence
  chemically synthesized
aagtaacaatgcctctgtctgt

SEQ ID NO: 778516 - DNA, 22 bp, Artificial Sequence
  chemically synthesized
tgtctgttatggtgactcagtc

SEQ ID NO: 778517 - DNA, 22 bp, Artificial Sequence
  chemically synthesized
tatgggaaacccagactgagtc

SEQ ID NO: 778518 - DNA, 22 bp, Artificial Sequence
  chemically synthesized
tctgttatggtgactcagtctg

SEQ ID NO: 778519 - DNA, 22 bp, Artificial Sequence
  chemically synthesized
ctgtatgggaaacccagactga

SEQ ID NO: 778520 - DNA, 22 bp, Artificial Sequence
  chemically synthesized
ttatggtgactcagtctgggtt

SEQ ID NO: 778521 - DNA, 22 bp, Artificial Sequence
  chemically synthesized
tggtgactcagtctgggtttcc

SEQ ID NO: 778522 - DNA, 22 bp, Artificial Sequence
  chemically synthesized
agtctgctgtatgggaaaccca

SEQ ID NO: 778523 - DNA, 22 bp, Artificial Sequence
  chemically synthesized
agtctgggtttcccatacagca

SEQ ID NO: 778524 - DNA, 22 bp, Artificial Sequence
  chemically synthesized
ggatcacctcagtctgctgtat

SEQ ID NO: 778525 - DNA, 22 bp, Artificial Sequence
  chemically synthesized
ctaggatcacctcagtctgctg

SEQ ID NO: 778526 - DNA, 22 bp, Artificial Sequence
  chemically synthesized
ggtttcccatacagcagactga

SEQ ID NO: 778527 - DNA, 22 bp, Artificial Sequence
  chemically synthesized
cctaggatcacctcagtctgct

SEQ ID NO: 778528 - DNA, 22 bp, Artificial Sequence
  chemically synthesized
cccatacagcagactgaggtga

SEQ ID NO: 778529 - DNA, 22 bp, Artificial Sequence
  chemically synthesized
ccatacagcagactgaggtgat

SEQ ID NO: 778530 - DNA, 22 bp, Artificial Sequence
  chemically synthesized
cagtgtttcctaggatcacctc

SEQ ID NO: 778531 - DNA, 22 bp, Artificial Sequence
  chemically synthesized
cctacagtgtttcctaggatca

SEQ ID NO: 778532 - DNA, 22 bp, Artificial Sequence
  chemically synthesized
ttccctacagtgtttcctagga

SEQ ID NO: 778533 - DNA, 22 bp, Artificial Sequence
  chemically synthesized
ctgttccctacagtgtttccta

SEQ ID NO: 778534 - DNA, 22 bp, Artificial Sequence
  chemically synthesized
cctgttccctacagtgtttcct

SEQ ID NO: 778535 - DNA, 22 bp, Artificial Sequence
  chemically synthesized
tcctgttccctacagtgtttcc

SEQ ID NO: 778536 - DNA, 22 bp, Artificial Sequence
  chemically synthesized
aggtgatcctaggaaacactgt

SEQ ID NO: 778537 - DNA, 22 bp, Artificial Sequence
  chemically synthesized
ctttcctgttccctacagtgtt

SEQ ID NO: 778538 - DNA, 22 bp, Artificial Sequence
  chemically synthesized
ctcctttcctgttccctacagt

SEQ ID NO: 778539 - DNA, 22 bp, Artificial Sequence
  chemically synthesized
tcctcctttcctgttccctaca

SEQ ID NO: 778540 - DNA, 22 bp, Artificial Sequence
  chemically synthesized
ctctcctcctttcctgttccct

SEQ ID NO: 778541 - DNA, 22 bp, Artificial Sequence
  chemically synthesized
ggaaacactgtagggaacagga

SEQ ID NO: 778542 - DNA, 22 bp, Artificial Sequence
  chemically synthesized
cctctcctcctttcctgttccc

SEQ ID NO: 778543 - DNA, 22 bp, Artificial Sequence
  chemically synthesized
tcctctcctcctttcctgttcc

SEQ ID NO: 778544 - DNA, 22 bp, Artificial Sequence
  chemically synthesized
ttcctctcctcctttcctgttc

SEQ ID NO: 778545 - DNA, 22 bp, Artificial Sequence
  chemically synthesized
cttttcctctcctcctttcctg

SEQ ID NO: 778546 - DNA, 22 bp, Artificial Sequence
  chemically synthesized
ccttttcctctcctcctttcct

SEQ ID NO: 778547 - DNA, 22 bp, Artificial Sequence
  chemically synthesized
ttccttttcctctcctcctttc

SEQ ID NO: 778548 - DNA, 22 bp, Artificial Sequence
  chemically synthesized
cttccttttcctctcctccttt

SEQ ID NO: 778549 - DNA, 22 bp, Artificial Sequence
  chemically synthesized
tagggaacaggaaaggaggaga

SEQ ID NO: 778550 - DNA, 22 bp, Artificial Sequence
  chemically synthesized
tttcttccttttcctctcctcc

SEQ ID NO: 778551 - DNA, 22 bp, Artificial Sequence
  chemically synthesized
gattgtttcttccttttcctct

SEQ ID NO: 778552 - DNA, 22 bp, Artificial Sequence
  chemically synthesized
tggattgtttcttccttttcct

SEQ ID NO: 778553 - DNA, 22 bp, Artificial Sequence
  chemically synthesized
caggcatgagccaccacgccca

SEQ ID NO: 778554 - DNA, 22 bp, Artificial Sequence
  chemically synthesized
tttattgggctgggcgtggtgg

SEQ ID NO: 778555 - DNA, 22 bp, Artificial Sequence
  chemically synthesized
tattgggctgggcgtggtggct

SEQ ID NO: 778556 - DNA, 22 bp, Artificial Sequence
  chemically synthesized
attgggctgggcgtggtggctc

SEQ ID NO: 778557 - DNA, 22 bp, Artificial Sequence
  chemically synthesized
ttgggctgggcgtggtggctca

SEQ ID NO: 778558 - DNA, 22 bp, Artificial Sequence
  chemically synthesized
ggattacaggcatgagccacca

SEQ ID NO: 778559 - DNA, 22 bp, Artificial Sequence
  chemically synthesized
ggctgggcgtggtggctcatgc

SEQ ID NO: 778560 - DNA, 22 bp, Artificial Sequence
  chemically synthesized
ggcgtggtggctcatgcctgta

SEQ ID NO: 778561 - DNA, 22 bp, Artificial Sequence
  chemically synthesized
ccaaagtcctgggattacaggc

SEQ ID NO: 778562 - DNA, 22 bp, Artificial Sequence
  chemically synthesized
gcctcccaaagtcctgggatta

SEQ ID NO: 778563 - DNA, 22 bp, Artificial Sequence
  chemically synthesized
ggcctcccaaagtcctgggatt

SEQ ID NO: 778564 - DNA, 22 bp, Artificial Sequence
  chemically synthesized
atgcctgtaatcccaggacttt

SEQ ID NO: 778565 - DNA, 22 bp, Artificial Sequence
  chemically synthesized
taatcccaggactttgggaggc

SEQ ID NO: 778566 - DNA, 22 bp, Artificial Sequence
  chemically synthesized
aagtgatccgcccgccttggcc

SEQ ID NO: 778567 - DNA, 22 bp, Artificial Sequence
  chemically synthesized
atctcaagtgatccgcccgcct

SEQ ID NO: 778568 - DNA, 22 bp, Artificial Sequence
  chemically synthesized
tgggaggccaaggcgggcggat

SEQ ID NO: 778569 - DNA, 22 bp, Artificial Sequence
  chemically synthesized
gggaggccaaggcgggcggatc

SEQ ID NO: 778570 - DNA, 22 bp, Artificial Sequence
  chemically synthesized
ctgatctcaagtgatccgcccg

SEQ ID NO: 778571 - DNA, 22 bp, Artificial Sequence
  chemically synthesized
ggaggccaaggcgggcggatca

SEQ ID NO: 778572 - DNA, 22 bp, Artificial Sequence
  chemically synthesized
gaactcctgatctcaagtgatc

SEQ ID NO: 778573 - DNA, 22 bp, Artificial Sequence
  chemically synthesized
gtctagaactcctgatctcaag

SEQ ID NO: 778574 - DNA, 22 bp, Artificial Sequence
  chemically synthesized
gccaggctggtctagaactcct

SEQ ID NO: 778575 - DNA, 22 bp, Artificial Sequence
  chemically synthesized
ggccaggctggtctagaactcc

SEQ ID NO: 778576 - DNA, 22 bp, Artificial Sequence
  chemically synthesized
gagatcaggagttctagaccag

SEQ ID NO: 778577 - DNA, 22 bp, Artificial Sequence
  chemically synthesized
agatcaggagttctagaccagc

SEQ ID NO: 778578 - DNA, 22 bp, Artificial Sequence
  chemically synthesized
accatttggccaggctggtcta

SEQ ID NO: 778579 - DNA, 22 bp, Artificial Sequence
  chemically synthesized
caccatttggccaggctggtct

SEQ ID NO: 778580 - DNA, 22 bp, Artificial Sequence
  chemically synthesized
tagaccagcctggccaaatggt

SEQ ID NO: 778581 - DNA, 22 bp, Artificial Sequence
  chemically synthesized
gaccagcctggccaaatggtga

SEQ ID NO: 778582 - DNA, 22 bp, Artificial Sequence
  chemically synthesized
gtagagatggggtttcaccatt

SEQ ID NO: 778583 - DNA, 22 bp, Artificial Sequence
  chemically synthesized
agtagagatggggtttcaccat

SEQ ID NO: 778584 - DNA, 22 bp, Artificial Sequence
  chemically synthesized
tagtagagatggggtttcacca

SEQ ID NO: 778585 - DNA, 22 bp, Artificial Sequence
  chemically synthesized
ttagtagagatggggtttcacc

SEQ ID NO: 778586 - DNA, 22 bp, Artificial Sequence
  chemically synthesized
gccaaatggtgaaaccccatct

SEQ ID NO: 778587 - DNA, 22 bp, Artificial Sequence
  chemically synthesized
tatttttagtagagatggggtt

SEQ ID NO: 778588 - DNA, 22 bp, Artificial Sequence
  chemically synthesized
gtatttttagtagagatggggt

SEQ ID NO: 778589 - DNA, 22 bp, Artificial Sequence
  chemically synthesized
tgtatttttagtagagatgggg

SEQ ID NO: 778590 - DNA, 22 bp, Artificial Sequence
  chemically synthesized
ttgtatttttagtagagatggg

SEQ ID NO: 778591 - DNA, 22 bp, Artificial Sequence
  chemically synthesized
atttttgtatttttagtagaga

SEQ ID NO: 778592 - DNA, 22 bp, Artificial Sequence
  chemically synthesized
tactaaaaatacaaaaattagt

SEQ ID NO: 778593 - DNA, 22 bp, Artificial Sequence
  chemically synthesized
ctaaaaatacaaaaattagttg

SEQ ID NO: 778594 - DNA, 22 bp, Artificial Sequence
  chemically synthesized
aaaatacaaaaattagttgggt

SEQ ID NO: 778595 - DNA, 22 bp, Artificial Sequence
  chemically synthesized
caggcatgcgccaccacaccca

SEQ ID NO: 778596 - DNA, 22 bp, Artificial Sequence
  chemically synthesized
ggactacaggcatgcgccacca

SEQ ID NO: 778597 - DNA, 22 bp, Artificial Sequence
  chemically synthesized
gttgggtgtggtggcgcatgcc

SEQ ID NO: 778598 - DNA, 22 bp, Artificial Sequence
  chemically synthesized
ggtgtggtggcgcatgcctgta

SEQ ID NO: 778599 - DNA, 22 bp, Artificial Sequence
  chemically synthesized
agtagctgggactacaggcatg

SEQ ID NO: 778600 - DNA, 22 bp, Artificial Sequence
  chemically synthesized
gagtagctgggactacaggcat

SEQ ID NO: 778601 - DNA, 22 bp, Artificial Sequence
  chemically synthesized
ttgagtagctgggactacaggc

SEQ ID NO: 778602 - DNA, 22 bp, Artificial Sequence
  chemically synthesized
agcctcttgagtagctgggact

SEQ ID NO: 778603 - DNA, 22 bp, Artificial Sequence
  chemically synthesized
cctcagcctcttgagtagctgg

SEQ ID NO: 778604 - DNA, 22 bp, Artificial Sequence
  chemically synthesized
ctgcctcagcctcttgagtagc

SEQ ID NO: 778605 - DNA, 22 bp, Artificial Sequence
  chemically synthesized
tcctgcctcagcctcttgagta

SEQ ID NO: 778606 - DNA, 22 bp, Artificial Sequence
  chemically synthesized
tagtcccagctactcaagaggc

SEQ ID NO: 778607 - DNA, 22 bp, Artificial Sequence
  chemically synthesized
aagtgattctcctgcctcagcc

SEQ ID NO: 778608 - DNA, 22 bp, Artificial Sequence
  chemically synthesized
ctcaagaggctgaggcaggaga

SEQ ID NO: 778609 - DNA, 22 bp, Artificial Sequence
  chemically synthesized
aagaggctgaggcaggagaatc

SEQ ID NO: 778610 - DNA, 22 bp, Artificial Sequence
  chemically synthesized
ccgagttcaagtgattctcctg

SEQ ID NO: 778611 - DNA, 22 bp, Artificial Sequence
  chemically synthesized
cacctcccgagttcaagtgatt

SEQ ID NO: 778612 - DNA, 22 bp, Artificial Sequence
  chemically synthesized
aggcaggagaatcacttgaact

SEQ ID NO: 778613 - DNA, 22 bp, Artificial Sequence
  chemically synthesized
caacctccacctcccgagttca

SEQ ID NO: 778614 - DNA, 22 bp, Artificial Sequence
  chemically synthesized
actgcaacctccacctcccgag

SEQ ID NO: 778615 - DNA, 22 bp, Artificial Sequence
  chemically synthesized
agctcactgcaacctccacctc

SEQ ID NO: 778616 - DNA, 22 bp, Artificial Sequence
  chemically synthesized
gaactcgggaggtggaggttgc

SEQ ID NO: 778617 - DNA, 22 bp, Artificial Sequence
  chemically synthesized
aactcgggaggtggaggttgca

SEQ ID NO: 778618 - DNA, 22 bp, Artificial Sequence
  chemically synthesized
gggaggtggaggttgcagtgag

SEQ ID NO: 778619 - DNA, 22 bp, Artificial Sequence
  chemically synthesized
gagtgcagtggcacaatctcag

SEQ ID NO: 778620 - DNA, 22 bp, Artificial Sequence
  chemically synthesized
gctggagtgcagtggcacaatc

SEQ ID NO: 778621 - DNA, 22 bp, Artificial Sequence
  chemically synthesized
cagtgagctgagattgtgccac

SEQ ID NO: 778622 - DNA, 22 bp, Artificial Sequence
  chemically synthesized
caccctggctggagtgcagtgg

SEQ ID NO: 778623 - DNA, 22 bp, Artificial Sequence
  chemically synthesized
tgcaccctggctggagtgcagt

SEQ ID NO: 778624 - DNA, 22 bp, Artificial Sequence
  chemically synthesized
agattgtgccactgcactccag

SEQ ID NO: 778625 - DNA, 22 bp, Artificial Sequence
  chemically synthesized
actctgcaccctggctggagtg

SEQ ID NO: 778626 - DNA, 22 bp, Artificial Sequence
  chemically synthesized
tgccactgcactccagccaggg

SEQ ID NO: 778627 - DNA, 22 bp, Artificial Sequence
  chemically synthesized
cactccagccagggtgcagagt

SEQ ID NO: 778628 - DNA, 22 bp, Artificial Sequence
  chemically synthesized
ccgagatggagtctcactctgc

SEQ ID NO: 778629 - DNA, 22 bp, Artificial Sequence
  chemically synthesized
cccgagatggagtctcactctg

SEQ ID NO: 778630 - DNA, 22 bp, Artificial Sequence
  chemically synthesized
cagccagggtgcagagtgagac

SEQ ID NO: 778631 - DNA, 22 bp, Artificial Sequence
  chemically synthesized
tcccgagatggagtctcactct

SEQ ID NO: 778632 - DNA, 22 bp, Artificial Sequence
  chemically synthesized
ttcccgagatggagtctcactc

SEQ ID NO: 778633 - DNA, 22 bp, Artificial Sequence
  chemically synthesized
tttcccgagatggagtctcact

SEQ ID NO: 778634 - DNA, 22 bp, Artificial Sequence
  chemically synthesized
ttttcccgagatggagtctcac

SEQ ID NO: 778635 - DNA, 22 bp, Artificial Sequence
  chemically synthesized
tttttcccgagatggagtctca

SEQ ID NO: 778636 - DNA, 22 bp, Artificial Sequence
  chemically synthesized
ttttttcccgagatggagtctc

SEQ ID NO: 778637 - DNA, 22 bp, Artificial Sequence
  chemically synthesized
tttttttcccgagatggagtct

SEQ ID NO: 778638 - DNA, 22 bp, Artificial Sequence
  chemically synthesized
ttttttttcccgagatggagtc

SEQ ID NO: 778639 - DNA, 22 bp, Artificial Sequence
  chemically synthesized
tttttttttcccgagatggagt

SEQ ID NO: 778640 - DNA, 22 bp, Artificial Sequence
  chemically synthesized
ttttttttttcccgagatggag

SEQ ID NO: 778641 - DNA, 22 bp, Artificial Sequence
  chemically synthesized
tttttttttttcccgagatgga

SEQ ID NO: 778642 - DNA, 22 bp, Artificial Sequence
  chemically synthesized
ttttttttttttcccgagatgg

SEQ ID NO: 778643 - DNA, 22 bp, Artificial Sequence
  chemically synthesized
tttttttttttttcccgagatg

SEQ ID NO: 778644 - DNA, 22 bp, Artificial Sequence
  chemically synthesized
ttttttttttttttcccgagat

SEQ ID NO: 778645 - DNA, 22 bp, Artificial Sequence
  chemically synthesized
ttttttttttttttttcccgag

SEQ ID NO: 778646 - DNA, 22 bp, Artificial Sequence
  chemically synthesized
catctcgggaaaaaaaaaaaaa

SEQ ID NO: 778647 - DNA, 22 bp, Artificial Sequence
  chemically synthesized
aataaatacctctttttttttt

SEQ ID NO: 778648 - DNA, 22 bp, Artificial Sequence
  chemically synthesized
gggaaaaaaaaaaaaaaaagag

SEQ ID NO: 778649 - DNA, 22 bp, Artificial Sequence
  chemically synthesized
ctcaataaatacctcttttttt

SEQ ID NO: 778650 - DNA, 22 bp, Artificial Sequence
  chemically synthesized
gtaatctactcaataaatacct

SEQ ID NO: 778651 - DNA, 22 bp, Artificial Sequence
  chemically synthesized
cccagattagtaatctactcaa

SEQ ID NO: 778652 - DNA, 22 bp, Artificial Sequence
  chemically synthesized
attgagtagattactaatctgg

SEQ ID NO: 778653 - DNA, 22 bp, Artificial Sequence
  chemically synthesized
agccccagttccccagattagt

SEQ ID NO: 778654 - DNA, 22 bp, Artificial Sequence
  chemically synthesized
ttgagtagattactaatctggg

SEQ ID NO: 778655 - DNA, 22 bp, Artificial Sequence
  chemically synthesized
agtagattactaatctggggaa

SEQ ID NO: 778656 - DNA, 22 bp, Artificial Sequence
  chemically synthesized
ctaatctggggaactggggctc

SEQ ID NO: 778657 - DNA, 22 bp, Artificial Sequence
  chemically synthesized
atctggggaactggggctcaat

SEQ ID NO: 778658 - DNA, 22 bp, Artificial Sequence
  chemically synthesized
gggaactggggctcaatgctgt

SEQ ID NO: 778659 - DNA, 22 bp, Artificial Sequence
  chemically synthesized
agagcatccccaacagcattga

SEQ ID NO: 778660 - DNA, 22 bp, Artificial Sequence
  chemically synthesized
gggctcaatgctgttggggatg

SEQ ID NO: 778661 - DNA, 22 bp, Artificial Sequence
  chemically synthesized
caaagatcctcagagcatcccc

SEQ ID NO: 778662 - DNA, 22 bp, Artificial Sequence
  chemically synthesized
aatgctgttggggatgctctga

SEQ ID NO: 778663 - DNA, 22 bp, Artificial Sequence
  chemically synthesized
ttggggatgctctgaggatctt

SEQ ID NO: 778664 - DNA, 22 bp, Artificial Sequence
  chemically synthesized
agatatattccaaagatcctca

SEQ ID NO: 778665 - DNA, 22 bp, Artificial Sequence
  chemically synthesized
gagatatattccaaagatcctc

SEQ ID NO: 778666 - DNA, 22 bp, Artificial Sequence
  chemically synthesized
tgagatatattccaaagatcct

SEQ ID NO: 778667 - DNA, 22 bp, Artificial Sequence
  chemically synthesized
gggatgctctgaggatctttgg

SEQ ID NO: 778668 - DNA, 22 bp, Artificial Sequence
  chemically synthesized
ggataattttgagatatattcc

SEQ ID NO: 778669 - DNA, 22 bp, Artificial Sequence
  chemically synthesized
tgaggatctttggaatatatct

SEQ ID NO: 778670 - DNA, 22 bp, Artificial Sequence
  chemically synthesized
aggatctttggaatatatctca

SEQ ID NO: 778671 - DNA, 22 bp, Artificial Sequence
  chemically synthesized
actgggataattttgagatata

SEQ ID NO: 778672 - DNA, 22 bp, Artificial Sequence
  chemically synthesized
ccctcactgggataattttgag

SEQ ID NO: 778673 - DNA, 22 bp, Artificial Sequence
  chemically synthesized
tggaatatatctcaaaattatc

SEQ ID NO: 778674 - DNA, 22 bp, Artificial Sequence
  chemically synthesized
tcccctcactgggataattttg

SEQ ID NO: 778675 - DNA, 22 bp, Artificial Sequence
  chemically synthesized
ggaatatatctcaaaattatcc

SEQ ID NO: 778676 - DNA, 22 bp, Artificial Sequence
  chemically synthesized
gaatatatctcaaaattatccc

SEQ ID NO: 778677 - DNA, 22 bp, Artificial Sequence
  chemically synthesized
tctcccctcactgggataattt

SEQ ID NO: 778678 - DNA, 22 bp, Artificial Sequence
  chemically synthesized
ctctcccctcactgggataatt

SEQ ID NO: 778679 - DNA, 22 bp, Artificial Sequence
  chemically synthesized
tctctcccctcactgggataat

SEQ ID NO: 778680 - DNA, 22 bp, Artificial Sequence
  chemically synthesized
agctttctctcccctcactggg

SEQ ID NO: 778681 - DNA, 22 bp, Artificial Sequence
  chemically synthesized
aaaattatcccagtgaggggag

SEQ ID NO: 778682 - DNA, 22 bp, Artificial Sequence
  chemically synthesized
tcccagtgaggggagagaaagc

SEQ ID NO: 778683 - DNA, 22 bp, Artificial Sequence
  chemically synthesized
aaccaataagggagagtagatg

SEQ ID NO: 778684 - DNA, 22 bp, Artificial Sequence
  chemically synthesized
agatttgtacccatctactctc

SEQ ID NO: 778685 - DNA, 22 bp, Artificial Sequence
  chemically synthesized
gtacccatctactctcccttat

SEQ ID NO: 778686 - DNA, 22 bp, Artificial Sequence
  chemically synthesized
tacccatctactctcccttatt

SEQ ID NO: 778687 - DNA, 22 bp, Artificial Sequence
  chemically synthesized
acaggagcaagactcaaccaat

SEQ ID NO: 778688 - DNA, 22 bp, Artificial Sequence
  chemically synthesized
ctctcccttattggttgagtct

SEQ ID NO: 778689 - DNA, 22 bp, Artificial Sequence
  chemically synthesized
tcccttattggttgagtcttgc

SEQ ID NO: 778690 - DNA, 22 bp, Artificial Sequence
  chemically synthesized
ccttattggttgagtcttgctc

SEQ ID NO: 778691 - DNA, 22 bp, Artificial Sequence
  chemically synthesized
attggttgagtcttgctcctgt

SEQ ID NO: 778692 - DNA, 22 bp, Artificial Sequence
  chemically synthesized
ttggttgagtcttgctcctgtt

SEQ ID NO: 778693 - DNA, 22 bp, Artificial Sequence
  chemically synthesized
gttgagtcttgctcctgttaat

SEQ ID NO: 778694 - DNA, 22 bp, Artificial Sequence
  chemically synthesized
agtcttgctcctgttaataccc

SEQ ID NO: 778695 - DNA, 22 bp, Artificial Sequence
  chemically synthesized
gctcctgttaataccctgtcac

SEQ ID NO: 778696 - DNA, 22 bp, Artificial Sequence
  chemically synthesized
ctcctgttaataccctgtcact

SEQ ID NO: 778697 - DNA, 22 bp, Artificial Sequence
  chemically synthesized
ctgttaataccctgtcactttg

SEQ ID NO: 778698 - DNA, 22 bp, Artificial Sequence
  chemically synthesized
ttaataccctgtcactttgggc

SEQ ID NO: 778699 - DNA, 22 bp, Artificial Sequence
  chemically synthesized
ataccctgtcactttgggcttg

SEQ ID NO: 778700 - DNA, 22 bp, Artificial Sequence
  chemically synthesized
tcactttgggcttggtccatgt

SEQ ID NO: 778701 - DNA, 22 bp, Artificial Sequence
  chemically synthesized
gggtggtagatgggcacatgga

SEQ ID NO: 778702 - DNA, 22 bp, Artificial Sequence
  chemically synthesized
ggggtggtagatgggcacatgg

SEQ ID NO: 778703 - DNA, 22 bp, Artificial Sequence
  chemically synthesized
tggggtggtagatgggcacatg

SEQ ID NO: 778704 - DNA, 22 bp, Artificial Sequence
  chemically synthesized
tgggcttggtccatgtgcccat

SEQ ID NO: 778705 - DNA, 22 bp, Artificial Sequence
  chemically synthesized
gggcttggtccatgtgcccatc

SEQ ID NO: 778706 - DNA, 22 bp, Artificial Sequence
  chemically synthesized
ggcttggtccatgtgcccatct

SEQ ID NO: 778707 - DNA, 22 bp, Artificial Sequence
  chemically synthesized
gctttggggtggtagatgggca

SEQ ID NO: 778708 - DNA, 22 bp, Artificial Sequence
  chemically synthesized
agctttggggtggtagatgggc

SEQ ID NO: 778709 - DNA, 22 bp, Artificial Sequence
  chemically synthesized
ttagctttggggtggtagatgg

SEQ ID NO: 778710 - DNA, 22 bp, Artificial Sequence
  chemically synthesized
ggtccatgtgcccatctaccac

SEQ ID NO: 778711 - DNA, 22 bp, Artificial Sequence
  chemically synthesized
gtccatgtgcccatctaccacc

SEQ ID NO: 778712 - DNA, 22 bp, Artificial Sequence
  chemically synthesized
catgtcctcttagctttggggt

SEQ ID NO: 778713 - DNA, 22 bp, Artificial Sequence
  chemically synthesized
ccatgtcctcttagctttgggg

SEQ ID NO: 778714 - DNA, 22 bp, Artificial Sequence
  chemically synthesized
tccatgtcctcttagctttggg

SEQ ID NO: 778715 - DNA, 22 bp, Artificial Sequence
  chemically synthesized
ccaccccaaagctaagaggaca

SEQ ID NO: 778716 - DNA, 22 bp, Artificial Sequence
  chemically synthesized
caggtatcctttccatgtcctc

SEQ ID NO: 778717 - DNA, 22 bp, Artificial Sequence
  chemically synthesized
agaggacatggaaaggatacct

SEQ ID NO: 778718 - DNA, 22 bp, Artificial Sequence
  chemically synthesized
cagcatctgttctacatggtat

SEQ ID NO: 778719 - DNA, 22 bp, Artificial Sequence
  chemically synthesized
agggtaatatcaaataccatgt

SEQ ID NO: 778720 - DNA, 22 bp, Artificial Sequence
  chemically synthesized
ttctacatggtatttgatatta

SEQ ID NO: 778721 - DNA, 22 bp, Artificial Sequence
  chemically synthesized
tacatggtatttgatattaccc

SEQ ID NO: 778722 - DNA, 22 bp, Artificial Sequence
  chemically synthesized
catggtatttgatattaccctc

SEQ ID NO: 778723 - DNA, 22 bp, Artificial Sequence
  chemically synthesized
tgggcacatattgagggtaata

SEQ ID NO: 778724 - DNA, 22 bp, Artificial Sequence
  chemically synthesized
gtgggcacatattgagggtaat

SEQ ID NO: 778725 - DNA, 22 bp, Artificial Sequence
  chemically synthesized
tgtgggcacatattgagggtaa

SEQ ID NO: 778726 - DNA, 22 bp, Artificial Sequence
  chemically synthesized
ttttgtgggcacatattgaggg

SEQ ID NO: 778727 - DNA, 22 bp, Artificial Sequence
  chemically synthesized
gatattaccctcaatatgtgcc

SEQ ID NO: 778728 - DNA, 22 bp, Artificial Sequence
  chemically synthesized
atattaccctcaatatgtgccc

SEQ ID NO: 778729 - DNA, 22 bp, Artificial Sequence
  chemically synthesized
tatactgttttgtgggcacata

SEQ ID NO: 778730 - DNA, 22 bp, Artificial Sequence
  chemically synthesized
ccctcaatatgtgcccacaaaa

SEQ ID NO: 778731 - DNA, 22 bp, Artificial Sequence
  chemically synthesized
aatatgtgcccacaaaacagta

SEQ ID NO: 778732 - DNA, 22 bp, Artificial Sequence
  chemically synthesized
agtccatgatcctgtatactgt

SEQ ID NO: 778733 - DNA, 22 bp, Artificial Sequence
  chemically synthesized
gagtccatgatcctgtatactg

SEQ ID NO: 778734 - DNA, 22 bp, Artificial Sequence
  chemically synthesized
tgagtccatgatcctgtatact

SEQ ID NO: 778735 - DNA, 22 bp, Artificial Sequence
  chemically synthesized
tcattttgagtccatgatcctg

SEQ ID NO: 778736 - DNA, 22 bp, Artificial Sequence
  chemically synthesized
ctgtcattttgagtccatgatc

SEQ ID NO: 778737 - DNA, 22 bp, Artificial Sequence
  chemically synthesized
gctgtcattttgagtccatgat

SEQ ID NO: 778738 - DNA, 22 bp, Artificial Sequence
  chemically synthesized
tgctgtcattttgagtccatga

SEQ ID NO: 778739 - DNA, 22 bp, Artificial Sequence
  chemically synthesized
ttttgctgtcattttgagtcca

SEQ ID NO: 778740 - DNA, 22 bp, Artificial Sequence
  chemically synthesized
attttgctgtcattttgagtcc

SEQ ID NO: 778741 - DNA, 22 bp, Artificial Sequence
  chemically synthesized
tttattttgctgtcattttgag

SEQ ID NO: 778742 - DNA, 22 bp, Artificial Sequence
  chemically synthesized
aaaatgacagcaaaataaacag

SEQ ID NO: 778743 - DNA, 22 bp, Artificial Sequence
  chemically synthesized
tgaacagtgtgtgcatctgttt

SEQ ID NO: 778744 - DNA, 22 bp, Artificial Sequence
  chemically synthesized
gtgaacagtgtgtgcatctgtt

SEQ ID NO: 778745 - DNA, 22 bp, Artificial Sequence
  chemically synthesized
tgtgaacagtgtgtgcatctgt

SEQ ID NO: 778746 - DNA, 22 bp, Artificial Sequence
  chemically synthesized
caaacccaatcaaatcctttgt

SEQ ID NO: 778747 - DNA, 22 bp, Artificial Sequence
  chemically synthesized
gcaaacccaatcaaatcctttg

SEQ ID NO: 778748 - DNA, 22 bp, Artificial Sequence
  chemically synthesized
tgcaaacccaatcaaatccttt

SEQ ID NO: 778749 - DNA, 22 bp, Artificial Sequence
  chemically synthesized
ttcacaaaggatttgattgggt

SEQ ID NO: 778750 - DNA, 22 bp, Artificial Sequence
  chemically synthesized
acaaaggatttgattgggtttg

SEQ ID NO: 778751 - DNA, 22 bp, Artificial Sequence
  chemically synthesized
gattgggtttgcaaagctccct

SEQ ID NO: 778752 - DNA, 22 bp, Artificial Sequence
  chemically synthesized
attgggtttgcaaagctcccta

SEQ ID NO: 778753 - DNA, 22 bp, Artificial Sequence
  chemically synthesized
tatgcaaagaaatgtagggagc

SEQ ID NO: 778754 - DNA, 22 bp, Artificial Sequence
  chemically synthesized
atatgcaaagaaatgtagggag

SEQ ID NO: 778755 - DNA, 22 bp, Artificial Sequence
  chemically synthesized
ggtttgcaaagctccctacatt

SEQ ID NO: 778756 - DNA, 22 bp, Artificial Sequence
  chemically synthesized
gtttatatgcaaagaaatgtag

SEQ ID NO: 778757 - DNA, 22 bp, Artificial Sequence
  chemically synthesized
gcaaagctccctacatttcttt

SEQ ID NO: 778758 - DNA, 22 bp, Artificial Sequence
  chemically synthesized
caaagctccctacatttctttg

SEQ ID NO: 778759 - DNA, 22 bp, Artificial Sequence
  chemically synthesized
cctacatttctttgcatataaa

SEQ ID NO: 778760 - DNA, 22 bp, Artificial Sequence
  chemically synthesized
agggatgagtctagtttatatg

SEQ ID NO: 778761 - DNA, 22 bp, Artificial Sequence
  chemically synthesized
aagggatgagtctagtttatat

SEQ ID NO: 778762 - DNA, 22 bp, Artificial Sequence
  chemically synthesized
catttctttgcatataaactag

SEQ ID NO: 778763 - DNA, 22 bp, Artificial Sequence
  chemically synthesized
ctttgcatataaactagactca

SEQ ID NO: 778764 - DNA, 22 bp, Artificial Sequence
  chemically synthesized
aaatttaagggatgagtctagt

SEQ ID NO: 778765 - DNA, 22 bp, Artificial Sequence
  chemically synthesized
tttgcatataaactagactcat

SEQ ID NO: 778766 - DNA, 22 bp, Artificial Sequence
  chemically synthesized
gaaatttaagggatgagtctag

SEQ ID NO: 778767 - DNA, 22 bp, Artificial Sequence
  chemically synthesized
tgaaatttaagggatgagtcta

SEQ ID NO: 778768 - DNA, 22 bp, Artificial Sequence
  chemically synthesized
tgcatataaactagactcatcc

SEQ ID NO: 778769 - DNA, 22 bp, Artificial Sequence
  chemically synthesized
gcatataaactagactcatccc

SEQ ID NO: 778770 - DNA, 22 bp, Artificial Sequence
  chemically synthesized
catataaactagactcatccct

SEQ ID NO: 778771 - DNA, 22 bp, Artificial Sequence
  chemically synthesized
ctttgaaatttaagggatgagt

SEQ ID NO: 778772 - DNA, 22 bp, Artificial Sequence
  chemically synthesized
actttgaaatttaagggatgag

SEQ ID NO: 778773 - DNA, 22 bp, Artificial Sequence
  chemically synthesized
tactttgaaatttaagggatga

SEQ ID NO: 778774 - DNA, 22 bp, Artificial Sequence
  chemically synthesized
gactcatcccttaaatttcaaa

SEQ ID NO: 778775 - DNA, 22 bp, Artificial Sequence
  chemically synthesized
gtgagattttactttgaaattt

SEQ ID NO: 778776 - DNA, 22 bp, Artificial Sequence
  chemically synthesized
atcccttaaatttcaaagtaaa

SEQ ID NO: 778777 - DNA, 22 bp, Artificial Sequence
  chemically synthesized
agttggtgagattttactttga

SEQ ID NO: 778778 - DNA, 22 bp, Artificial Sequence
  chemically synthesized
gctcagttggtgagattttact

SEQ ID NO: 778779 - DNA, 22 bp, Artificial Sequence
  chemically synthesized
cgctcagttggtgagattttac

SEQ ID NO: 778780 - DNA, 22 bp, Artificial Sequence
  chemically synthesized
tcgctcagttggtgagatttta

SEQ ID NO: 778781 - DNA, 22 bp, Artificial Sequence
  chemically synthesized
aaatttcaaagtaaaatctcac

SEQ ID NO: 778782 - DNA, 22 bp, Artificial Sequence
  chemically synthesized
aatttcaaagtaaaatctcacc

SEQ ID NO: 778783 - DNA, 22 bp, Artificial Sequence
  chemically synthesized
caaagtaaaatctcaccaactg

SEQ ID NO: 778784 - DNA, 22 bp, Artificial Sequence
  chemically synthesized
aaagtaaaatctcaccaactga

SEQ ID NO: 778785 - DNA, 22 bp, Artificial Sequence
  chemically synthesized
tgccacagctttcgctcagttg

SEQ ID NO: 778786 - DNA, 22 bp, Artificial Sequence
  chemically synthesized
tgtgccacagctttcgctcagt

SEQ ID NO: 778787 - DNA, 22 bp, Artificial Sequence
  chemically synthesized
ctgtgccacagctttcgctcag

SEQ ID NO: 778788 - DNA, 22 bp, Artificial Sequence
  chemically synthesized
accaactgagcgaaagctgtgg

SEQ ID NO: 778789 - DNA, 22 bp, Artificial Sequence
  chemically synthesized
aggaacttctgtgccacagctt

SEQ ID NO: 778790 - DNA, 22 bp, Artificial Sequence
  chemically synthesized
tgaggaacttctgtgccacagc

SEQ ID NO: 778791 - DNA, 22 bp, Artificial Sequence
  chemically synthesized
agcgaaagctgtggcacagaag

SEQ ID NO: 778792 - DNA, 22 bp, Artificial Sequence
  chemically synthesized
aaactctgaggaacttctgtgc

SEQ ID NO: 778793 - DNA, 22 bp, Artificial Sequence
  chemically synthesized
aaaactctgaggaacttctgtg

SEQ ID NO: 778794 - DNA, 22 bp, Artificial Sequence
  chemically synthesized
taaaactctgaggaacttctgt

SEQ ID NO: 778795 - DNA, 22 bp, Artificial Sequence
  chemically synthesized
ttaaaactctgaggaacttctg

SEQ ID NO: 778796 - DNA, 22 bp, Artificial Sequence
  chemically synthesized
tggcacagaagttcctcagagt

SEQ ID NO: 778797 - DNA, 22 bp, Artificial Sequence
  chemically synthesized
aacccaaagcacatcttttaaa

SEQ ID NO: 778798 - DNA, 22 bp, Artificial Sequence
  chemically synthesized
ctcagagttttaaaagatgtgc

SEQ ID NO: 778799 - DNA, 22 bp, Artificial Sequence
  chemically synthesized
gaattaaacccaaagcacatct

SEQ ID NO: 778800 - DNA, 22 bp, Artificial Sequence
  chemically synthesized
agagttttaaaagatgtgcttt

SEQ ID NO: 778801 - DNA, 22 bp, Artificial Sequence
  chemically synthesized
taaaagatgtgctttgggttta

SEQ ID NO: 778802 - DNA, 22 bp, Artificial Sequence
  chemically synthesized
aaaagatgtgctttgggtttaa

SEQ ID NO: 778803 - DNA, 22 bp, Artificial Sequence
  chemically synthesized
aaagatgtgctttgggtttaat

SEQ ID NO: 778804 - DNA, 22 bp, Artificial Sequence
  chemically synthesized
tatgtatgtggttggaattaaa

SEQ ID NO: 778805 - DNA, 22 bp, Artificial Sequence
  chemically synthesized
atatgtatgtggttggaattaa

SEQ ID NO: 778806 - DNA, 22 bp, Artificial Sequence
  chemically synthesized
tatatgtatgtggttggaatta

SEQ ID NO: 778807 - DNA, 22 bp, Artificial Sequence
  chemically synthesized
tgggtttaattccaaccacata

SEQ ID NO: 778808 - DNA, 22 bp, Artificial Sequence
  chemically synthesized
gggtttaattccaaccacatac

SEQ ID NO: 778809 - DNA, 22 bp, Artificial Sequence
  chemically synthesized
ggtttaattccaaccacataca

SEQ ID NO: 778810 - DNA, 22 bp, Artificial Sequence
  chemically synthesized
acatggttttatatgtatgtgg

SEQ ID NO: 778811 - DNA, 22 bp, Artificial Sequence
  chemically synthesized
aattccaaccacatacatataa

SEQ ID NO: 778812 - DNA, 22 bp, Artificial Sequence
  chemically synthesized
attccaaccacatacatataaa

SEQ ID NO: 778813 - DNA, 22 bp, Artificial Sequence
  chemically synthesized
aaactgacatggttttatatgt

SEQ ID NO: 778814 - DNA, 22 bp, Artificial Sequence
  chemically synthesized
gaaactgacatggttttatatg

SEQ ID NO: 778815 - DNA, 22 bp, Artificial Sequence
  chemically synthesized
tgaaactgacatggttttatat

SEQ ID NO: 778816 - DNA, 22 bp, Artificial Sequence
  chemically synthesized
caaccacatacatataaaacca

SEQ ID NO: 778817 - DNA, 22 bp, Artificial Sequence
  chemically synthesized
gactttgaaactgacatggttt

SEQ ID NO: 778818 - DNA, 22 bp, Artificial Sequence
  chemically synthesized
acctagactttgaaactgacat

SEQ ID NO: 778819 - DNA, 22 bp, Artificial Sequence
  chemically synthesized
agagccctgacctagactttga

SEQ ID NO: 778820 - DNA, 22 bp, Artificial Sequence
  chemically synthesized
aagagccctgacctagactttg

SEQ ID NO: 778821 - DNA, 22 bp, Artificial Sequence
  chemically synthesized
taagagccctgacctagacttt

SEQ ID NO: 778822 - DNA, 22 bp, Artificial Sequence
  chemically synthesized
agctttaagagccctgacctag

SEQ ID NO: 778823 - DNA, 22 bp, Artificial Sequence
  chemically synthesized
cagctttaagagccctgaccta

SEQ ID NO: 778824 - DNA, 22 bp, Artificial Sequence
  chemically synthesized
tttcagctttaagagccctgac

SEQ ID NO: 778825 - DNA, 22 bp, Artificial Sequence
  chemically synthesized
caaagtctaggtcagggctctt

SEQ ID NO: 778826 - DNA, 22 bp, Artificial Sequence
  chemically synthesized
aaagtctaggtcagggctctta

SEQ ID NO: 778827 - DNA, 22 bp, Artificial Sequence
  chemically synthesized
gctgtttcagctttaagagccc

SEQ ID NO: 778828 - DNA, 22 bp, Artificial Sequence
  chemically synthesized
agtctagctgtttcagctttaa

SEQ ID NO: 778829 - DNA, 22 bp, Artificial Sequence
  chemically synthesized
ggtcagggctcttaaagctgaa

SEQ ID NO: 778830 - DNA, 22 bp, Artificial Sequence
  chemically synthesized
gagtctagctgtttcagcttta

SEQ ID NO: 778831 - DNA, 22 bp, Artificial Sequence
  chemically synthesized
agatttgagtctagctgtttca

SEQ ID NO: 778832 - DNA, 22 bp, Artificial Sequence
  chemically synthesized
tgagatttgagtctagctgttt

SEQ ID NO: 778833 - DNA, 22 bp, Artificial Sequence
  chemically synthesized
ttaaagctgaaacagctagact

SEQ ID NO: 778834 - DNA, 22 bp, Artificial Sequence
  chemically synthesized
aaagctgaaacagctagactca

SEQ ID NO: 778835 - DNA, 22 bp, Artificial Sequence
  chemically synthesized
aagctgaaacagctagactcaa

SEQ ID NO: 778836 - DNA, 22 bp, Artificial Sequence
  chemically synthesized
tgaaaatgctctgagatttgag

SEQ ID NO: 778837 - DNA, 22 bp, Artificial Sequence
  chemically synthesized
aaacagctagactcaaatctca

SEQ ID NO: 778838 - DNA, 22 bp, Artificial Sequence
  chemically synthesized
gactcaaatctcagagcatttt

SEQ ID NO: 778839 - DNA, 22 bp, Artificial Sequence
  chemically synthesized
aaatctcagagcattttcataa

SEQ ID NO: 778840 - DNA, 22 bp, Artificial Sequence
  chemically synthesized
agagcattttcataactggatg

SEQ ID NO: 778841 - DNA, 22 bp, Artificial Sequence
  chemically synthesized
tcataactggatgatctgtact

SEQ ID NO: 778842 - DNA, 22 bp, Artificial Sequence
  chemically synthesized
caaatgcaagtgagtacagatc

SEQ ID NO: 778843 - DNA, 22 bp, Artificial Sequence
  chemically synthesized
cataactggatgatctgtactc

SEQ ID NO: 778844 - DNA, 22 bp, Artificial Sequence
  chemically synthesized
ataactggatgatctgtactca

SEQ ID NO: 778845 - DNA, 22 bp, Artificial Sequence
  chemically synthesized
cctgcaaatgcaagtgagtaca

SEQ ID NO: 778846 - DNA, 22 bp, Artificial Sequence
  chemically synthesized
gcctgcaaatgcaagtgagtac

SEQ ID NO: 778847 - DNA, 22 bp, Artificial Sequence
  chemically synthesized
tgcctgcaaatgcaagtgagta

SEQ ID NO: 778848 - DNA, 22 bp, Artificial Sequence
  chemically synthesized
gatgatctgtactcacttgcat

SEQ ID NO: 778849 - DNA, 22 bp, Artificial Sequence
  chemically synthesized
caattttgcctgcaaatgcaag

SEQ ID NO: 778850 - DNA, 22 bp, Artificial Sequence
  chemically synthesized
acaattttgcctgcaaatgcaa

SEQ ID NO: 778851 - DNA, 22 bp, Artificial Sequence
  chemically synthesized
atttacaattttgcctgcaaat

SEQ ID NO: 778852 - DNA, 22 bp, Artificial Sequence
  chemically synthesized
tactcacttgcatttgcaggca

SEQ ID NO: 778853 - DNA, 22 bp, Artificial Sequence
  chemically synthesized
ctcatttacaattttgcctgca

SEQ ID NO: 778854 - DNA, 22 bp, Artificial Sequence
  chemically synthesized
acttgcatttgcaggcaaaatt

SEQ ID NO: 778855 - DNA, 22 bp, Artificial Sequence
  chemically synthesized
taattcctcatttacaattttg

SEQ ID NO: 778856 - DNA, 22 bp, Artificial Sequence
  chemically synthesized
gcatttgcaggcaaaattgtaa

SEQ ID NO: 778857 - DNA, 22 bp, Artificial Sequence
  chemically synthesized
catttgcaggcaaaattgtaaa

SEQ ID NO: 778858 - DNA, 22 bp, Artificial Sequence
  chemically synthesized
gcaggcaaaattgtaaatgagg

SEQ ID NO: 778859 - DNA, 22 bp, Artificial Sequence
  chemically synthesized
caggcaaaattgtaaatgagga

SEQ ID NO: 778860 - DNA, 22 bp, Artificial Sequence
  chemically synthesized
aatgtatatattgtaattcctc

SEQ ID NO: 778861 - DNA, 22 bp, Artificial Sequence
  chemically synthesized
tgaatgtatatattgtaattcc

SEQ ID NO: 778862 - DNA, 22 bp, Artificial Sequence
  chemically synthesized
ttctgaatgtatatattgtaat

SEQ ID NO: 778863 - DNA, 22 bp, Artificial Sequence
  chemically synthesized
taaatgaggaattacaatatat

SEQ ID NO: 778864 - DNA, 22 bp, Artificial Sequence
  chemically synthesized
tgttctgaatgtatatattgta

SEQ ID NO: 778865 - DNA, 22 bp, Artificial Sequence
  chemically synthesized
tctgttctgaatgtatatattg

SEQ ID NO: 778866 - DNA, 22 bp, Artificial Sequence
  chemically synthesized
ctctgttctgaatgtatatatt

SEQ ID NO: 778867 - DNA, 22 bp, Artificial Sequence
  chemically synthesized
ttctctgttctgaatgtatata

SEQ ID NO: 778868 - DNA, 22 bp, Artificial Sequence
  chemically synthesized
cttctctgttctgaatgtatat

SEQ ID NO: 778869 - DNA, 22 bp, Artificial Sequence
  chemically synthesized
caatatatacattcagaacaga

SEQ ID NO: 778870 - DNA, 22 bp, Artificial Sequence
  chemically synthesized
gggaaatttcttctctgttctg

SEQ ID NO: 778871 - DNA, 22 bp, Artificial Sequence
  chemically synthesized
agggaaatttcttctctgttct

SEQ ID NO: 778872 - DNA, 22 bp, Artificial Sequence
  chemically synthesized
tagggaaatttcttctctgttc

SEQ ID NO: 778873 - DNA, 22 bp, Artificial Sequence
  chemically synthesized
tctttagggaaatttcttctct

SEQ ID NO: 778874 - DNA, 22 bp, Artificial Sequence
  chemically synthesized
gtctttagggaaatttcttctc

SEQ ID NO: 778875 - DNA, 22 bp, Artificial Sequence
  chemically synthesized
agaacagagaagaaatttccct

SEQ ID NO: 778876 - DNA, 22 bp, Artificial Sequence
  chemically synthesized
gtacttgtctttagggaaattt

SEQ ID NO: 778877 - DNA, 22 bp, Artificial Sequence
  chemically synthesized
ggtacttgtctttagggaaatt

SEQ ID NO: 778878 - DNA, 22 bp, Artificial Sequence
  chemically synthesized
tggtacttgtctttagggaaat

SEQ ID NO: 778879 - DNA, 22 bp, Artificial Sequence
  chemically synthesized
ttggtacttgtctttagggaaa

SEQ ID NO: 778880 - DNA, 22 bp, Artificial Sequence
  chemically synthesized
acatttttggtacttgtcttta

SEQ ID NO: 778881 - DNA, 22 bp, Artificial Sequence
  chemically synthesized
cattaacatttttggtacttgt

SEQ ID NO: 778882 - DNA, 22 bp, Artificial Sequence
  chemically synthesized
acattaacatttttggtacttg

SEQ ID NO: 778883 - DNA, 22 bp, Artificial Sequence
  chemically synthesized
tacattaacatttttggtactt

SEQ ID NO: 778884 - DNA, 22 bp, Artificial Sequence
  chemically synthesized
ccctaaagacaagtaccaaaaa

SEQ ID NO: 778885 - DNA, 22 bp, Artificial Sequence
  chemically synthesized
cctaaagacaagtaccaaaaat

SEQ ID NO: 778886 - DNA, 22 bp, Artificial Sequence
  chemically synthesized
aagacaagtaccaaaaatgtta

SEQ ID NO: 778887 - DNA, 22 bp, Artificial Sequence
  chemically synthesized
agtggcaaatctttacattaac

SEQ ID NO: 778888 - DNA, 22 bp, Artificial Sequence
  chemically synthesized
aagtggcaaatctttacattaa

SEQ ID NO: 778889 - DNA, 22 bp, Artificial Sequence
  chemically synthesized
ttaagtggcaaatctttacatt

SEQ ID NO: 778890 - DNA, 22 bp, Artificial Sequence
  chemically synthesized
ttcttaagtggcaaatctttac

SEQ ID NO: 778891 - DNA, 22 bp, Artificial Sequence
  chemically synthesized
gttcttaagtggcaaatcttta

SEQ ID NO: 778892 - DNA, 22 bp, Artificial Sequence
  chemically synthesized
catttgttcttaagtggcaaat

SEQ ID NO: 778893 - DNA, 22 bp, Artificial Sequence
  chemically synthesized
ccatttgttcttaagtggcaaa

SEQ ID NO: 778894 - DNA, 22 bp, Artificial Sequence
  chemically synthesized
tccatttgttcttaagtggcaa

SEQ ID NO: 778895 - DNA, 22 bp, Artificial Sequence
  chemically synthesized
ttccatttgttcttaagtggca

SEQ ID NO: 778896 - DNA, 22 bp, Artificial Sequence
  chemically synthesized
atgtaaagatttgccacttaag

SEQ ID NO: 778897 - DNA, 22 bp, Artificial Sequence
  chemically synthesized
tttccatttgttcttaagtggc

SEQ ID NO: 778898 - DNA, 22 bp, Artificial Sequence
  chemically synthesized
ttttccatttgttcttaagtgg

SEQ ID NO: 778899 - DNA, 22 bp, Artificial Sequence
  chemically synthesized
tttttccatttgttcttaagtg

SEQ ID NO: 778900 - DNA, 22 bp, Artificial Sequence
  chemically synthesized
ttttttccatttgttcttaagt

SEQ ID NO: 778901 - DNA, 22 bp, Artificial Sequence
  chemically synthesized
gccacttaagaacaaatggaaa

SEQ ID NO: 778902 - DNA, 22 bp, Artificial Sequence
  chemically synthesized
ccacttaagaacaaatggaaaa

SEQ ID NO: 778903 - DNA, 22 bp, Artificial Sequence
  chemically synthesized
ggcaccaatgatttttttttcc

SEQ ID NO: 778904 - DNA, 22 bp, Artificial Sequence
  chemically synthesized
aagaacaaatggaaaaaaaaat

SEQ ID NO: 778905 - DNA, 22 bp, Artificial Sequence
  chemically synthesized
agaacaaatggaaaaaaaaatc

SEQ ID NO: 778906 - DNA, 22 bp, Artificial Sequence
  chemically synthesized
tgtgtcgaaagttaggcaccaa

SEQ ID NO: 778907 - DNA, 22 bp, Artificial Sequence
  chemically synthesized
gattatgtgtcgaaagttaggc

SEQ ID NO: 778908 - DNA, 22 bp, Artificial Sequence
  chemically synthesized
agattatgtgtcgaaagttagg

SEQ ID NO: 778909 - DNA, 22 bp, Artificial Sequence
  chemically synthesized
agaccttagattatgtgtcgaa

SEQ ID NO: 778910 - DNA, 22 bp, Artificial Sequence
  chemically synthesized
cagaccttagattatgtgtcga

SEQ ID NO: 778911 - DNA, 22 bp, Artificial Sequence
  chemically synthesized
gtgcctaactttcgacacataa

SEQ ID NO: 778912 - DNA, 22 bp, Artificial Sequence
  chemically synthesized
actttcgacacataatctaagg

SEQ ID NO: 778913 - DNA, 22 bp, Artificial Sequence
  chemically synthesized
tcgacacataatctaaggtctg

SEQ ID NO: 778914 - DNA, 22 bp, Artificial Sequence
  chemically synthesized
cgacacataatctaaggtctga

SEQ ID NO: 778915 - DNA, 22 bp, Artificial Sequence
  chemically synthesized
gacacataatctaaggtctgaa

SEQ ID NO: 778916 - DNA, 22 bp, Artificial Sequence
  chemically synthesized
tgaaacacaaaaagacttcaga

SEQ ID NO: 778917 - DNA, 22 bp, Artificial Sequence
  chemically synthesized
atattgtgaaacacaaaaagac

SEQ ID NO: 778918 - DNA, 22 bp, Artificial Sequence
  chemically synthesized
catattgtgaaacacaaaaaga

SEQ ID NO: 778919 - DNA, 22 bp, Artificial Sequence
  chemically synthesized
aggtctgaagtctttttgtgtt

SEQ ID NO: 778920 - DNA, 22 bp, Artificial Sequence
  chemically synthesized
aagtctttttgtgtttcacaat

SEQ ID NO: 778921 - DNA, 22 bp, Artificial Sequence
  chemically synthesized
tggccagggcaccttcatattg

SEQ ID NO: 778922 - DNA, 22 bp, Artificial Sequence
  chemically synthesized
tttgtgtttcacaatatgaagg

SEQ ID NO: 778923 - DNA, 22 bp, Artificial Sequence
  chemically synthesized
ttgtgtttcacaatatgaaggt

SEQ ID NO: 778924 - DNA, 22 bp, Artificial Sequence
  chemically synthesized
tgtgtttcacaatatgaaggtg

SEQ ID NO: 778925 - DNA, 22 bp, Artificial Sequence
  chemically synthesized
gtgtttcacaatatgaaggtgc

SEQ ID NO: 778926 - DNA, 22 bp, Artificial Sequence
  chemically synthesized
tgtttcacaatatgaaggtgcc

SEQ ID NO: 778927 - DNA, 22 bp, Artificial Sequence
  chemically synthesized
cacaatatgaaggtgccctggc

SEQ ID NO: 778928 - DNA, 22 bp, Artificial Sequence
  chemically synthesized
acaatatgaaggtgccctggcc

SEQ ID NO: 778929 - DNA, 22 bp, Artificial Sequence
  chemically synthesized
ggaatagtataaatattgtggc

SEQ ID NO: 778930 - DNA, 22 bp, Artificial Sequence
  chemically synthesized
taggaatagtataaatattgtg

SEQ ID NO: 778931 - DNA, 22 bp, Artificial Sequence
  chemically synthesized
ctaggaatagtataaatattgt

SEQ ID NO: 778932 - DNA, 22 bp, Artificial Sequence
  chemically synthesized
caatcttctaggaatagtataa

SEQ ID NO: 778933 - DNA, 22 bp, Artificial Sequence
  chemically synthesized
acaatcttctaggaatagtata

SEQ ID NO: 778934 - DNA, 22 bp, Artificial Sequence
  chemically synthesized
gccacaatatttatactattcc

SEQ ID NO: 778935 - DNA, 22 bp, Artificial Sequence
  chemically synthesized
tttacaatcttctaggaatagt

SEQ ID NO: 778936 - DNA, 22 bp, Artificial Sequence
  chemically synthesized
agatactatttacaatcttcta

SEQ ID NO: 778937 - DNA, 22 bp, Artificial Sequence
  chemically synthesized
atactattcctagaagattgta

SEQ ID NO: 778938 - DNA, 22 bp, Artificial Sequence
  chemically synthesized
tactattcctagaagattgtaa

SEQ ID NO: 778939 - DNA, 22 bp, Artificial Sequence
  chemically synthesized
ttcctagaagattgtaaatagt

SEQ ID NO: 778940 - DNA, 22 bp, Artificial Sequence
  chemically synthesized
ctagaagattgtaaatagtatc

SEQ ID NO: 778941 - DNA, 22 bp, Artificial Sequence
  chemically synthesized
acagtgcacattcagatactat

SEQ ID NO: 778942 - DNA, 22 bp, Artificial Sequence
  chemically synthesized
gaagattgtaaatagtatctga

SEQ ID NO: 778943 - DNA, 22 bp, Artificial Sequence
  chemically synthesized
agaaactcacagtgcacattca

SEQ ID NO: 778944 - DNA, 22 bp, Artificial Sequence
  chemically synthesized
taaatagtatctgaatgtgcac

SEQ ID NO: 778945 - DNA, 22 bp, Artificial Sequence
  chemically synthesized
aatctgagaaactcacagtgca

SEQ ID NO: 778946 - DNA, 22 bp, Artificial Sequence
  chemically synthesized
gggttgaatctgagaaactcac

SEQ ID NO: 778947 - DNA, 22 bp, Artificial Sequence
  chemically synthesized
aatgtgcactgtgagtttctca

SEQ ID NO: 778948 - DNA, 22 bp, Artificial Sequence
  chemically synthesized
ctggggttgaatctgagaaact

SEQ ID NO: 778949 - DNA, 22 bp, Artificial Sequence
  chemically synthesized
ttcctggggttgaatctgagaa

SEQ ID NO: 778950 - DNA, 22 bp, Artificial Sequence
  chemically synthesized
tgagtttctcagattcaacccc

SEQ ID NO: 778951 - DNA, 22 bp, Artificial Sequence
  chemically synthesized
cgcaattgttcctggggttgaa

SEQ ID NO: 778952 - DNA, 22 bp, Artificial Sequence
  chemically synthesized
gcgcaattgttcctggggttga

SEQ ID NO: 778953 - DNA, 22 bp, Artificial Sequence
  chemically synthesized
ctcagattcaaccccaggaaca

SEQ ID NO: 778954 - DNA, 22 bp, Artificial Sequence
  chemically synthesized
tcagattcaaccccaggaacaa

SEQ ID NO: 778955 - DNA, 22 bp, Artificial Sequence
  chemically synthesized
agattcaaccccaggaacaatt

SEQ ID NO: 778956 - DNA, 22 bp, Artificial Sequence
  chemically synthesized
aaccccaggaacaattgcgcaa

SEQ ID NO: 778957 - DNA, 22 bp, Artificial Sequence
  chemically synthesized
tatgcaggagagcatttgcgca

SEQ ID NO: 778958 - DNA, 22 bp, Artificial Sequence
  chemically synthesized
tatatgcaggagagcatttgcg

SEQ ID NO: 778959 - DNA, 22 bp, Artificial Sequence
  chemically synthesized
ctatatgcaggagagcatttgc

SEQ ID NO: 778960 - DNA, 22 bp, Artificial Sequence
  chemically synthesized
gcagtttctatatgcaggagag

SEQ ID NO: 778961 - DNA, 22 bp, Artificial Sequence
  chemically synthesized
cgcaaatgctctcctgcatata

SEQ ID NO: 778962 - DNA, 22 bp, Artificial Sequence
  chemically synthesized
aaaagaggatctagcagtttct

SEQ ID NO: 778963 - DNA, 22 bp, Artificial Sequence
  chemically synthesized
tcctgcatatagaaactgctag

SEQ ID NO: 778964 - DNA, 22 bp, Artificial Sequence
  chemically synthesized
tgaaaagaggatctagcagttt

SEQ ID NO: 778965 - DNA, 22 bp, Artificial Sequence
  chemically synthesized
ctgcatatagaaactgctagat

SEQ ID NO: 778966 - DNA, 22 bp, Artificial Sequence
  chemically synthesized
catatagaaactgctagatcct

SEQ ID NO: 778967 - DNA, 22 bp, Artificial Sequence
  chemically synthesized
ctagatcctcttttcagagctg

SEQ ID NO: 778968 - DNA, 22 bp, Artificial Sequence
  chemically synthesized
gatcctcttttcagagctgctg

SEQ ID NO: 778969 - DNA, 22 bp, Artificial Sequence
  chemically synthesized
cagaaaaacaaaaagcagcagc

SEQ ID NO: 778970 - DNA, 22 bp, Artificial Sequence
  chemically synthesized
ttttcagagctgctgctttttg

SEQ ID NO: 778971 - DNA, 22 bp, Artificial Sequence
  chemically synthesized
tctccagaaaaacaaaaagcag

SEQ ID NO: 778972 - DNA, 22 bp, Artificial Sequence
  chemically synthesized
ttcagagctgctgctttttgtt

SEQ ID NO: 778973 - DNA, 22 bp, Artificial Sequence
  chemically synthesized
tcagagctgctgctttttgttt

SEQ ID NO: 778974 - DNA, 22 bp, Artificial Sequence
  chemically synthesized
cagagctgctgctttttgtttt

SEQ ID NO: 778975 - DNA, 22 bp, Artificial Sequence
  chemically synthesized
agagctgctgctttttgttttt

SEQ ID NO: 778976 - DNA, 22 bp, Artificial Sequence
  chemically synthesized
ctgctttttgtttttctggaga

SEQ ID NO: 778977 - DNA, 22 bp, Artificial Sequence
  chemically synthesized
ctttttgtttttctggagacag

SEQ ID NO: 778978 - DNA, 22 bp, Artificial Sequence
  chemically synthesized
tttgtttttctggagacagggt

SEQ ID NO: 778979 - DNA, 22 bp, Artificial Sequence
  chemically synthesized
ttgtttttctggagacagggtc

SEQ ID NO: 778980 - DNA, 22 bp, Artificial Sequence
  chemically synthesized
tgtttttctggagacagggtct

SEQ ID NO: 778981 - DNA, 22 bp, Artificial Sequence
  chemically synthesized
ggcagcagggtgagaccctgtc

SEQ ID NO: 778982 - DNA, 22 bp, Artificial Sequence
  chemically synthesized
gtttttctggagacagggtctc

SEQ ID NO: 778983 - DNA, 22 bp, Artificial Sequence
  chemically synthesized
gggcagcagggtgagaccctgt

SEQ ID NO: 778984 - DNA, 22 bp, Artificial Sequence
  chemically synthesized
tttttctggagacagggtctca

SEQ ID NO: 778985 - DNA, 22 bp, Artificial Sequence
  chemically synthesized
ttctggagacagggtctcaccc

SEQ ID NO: 778986 - DNA, 22 bp, Artificial Sequence
  chemically synthesized
tctggagacagggtctcaccct

SEQ ID NO: 778987 - DNA, 22 bp, Artificial Sequence
  chemically synthesized
ctggagacagggtctcaccctg

SEQ ID NO: 778988 - DNA, 22 bp, Artificial Sequence
  chemically synthesized
cagcttgggcagcagggtgaga

SEQ ID NO: 778989 - DNA, 22 bp, Artificial Sequence
  chemically synthesized
tggagacagggtctcaccctgc

SEQ ID NO: 778990 - DNA, 22 bp, Artificial Sequence
  chemically synthesized
gagacagggtctcaccctgctg

SEQ ID NO: 778991 - DNA, 22 bp, Artificial Sequence
  chemically synthesized
cactccagcttgggcagcaggg

SEQ ID NO: 778992 - DNA, 22 bp, Artificial Sequence
  chemically synthesized
accactgcactccagcttgggc

SEQ ID NO: 778993 - DNA, 22 bp, Artificial Sequence
  chemically synthesized
accctgctgcccaagctggagt

SEQ ID NO: 778994 - DNA, 22 bp, Artificial Sequence
  chemically synthesized
ctgcccaagctggagtgcagtg

SEQ ID NO: 778995 - DNA, 22 bp, Artificial Sequence
  chemically synthesized
cccaagctggagtgcagtggtg

SEQ ID NO: 778996 - DNA, 22 bp, Artificial Sequence
  chemically synthesized
cagtgagccgtggtctcaccac

SEQ ID NO: 778997 - DNA, 22 bp, Artificial Sequence
  chemically synthesized
gagtgcagtggtgagaccacgg

SEQ ID NO: 778998 - DNA, 22 bp, Artificial Sequence
  chemically synthesized
ggaagtcgaagctgcagtgagc

SEQ ID NO: 778999 - DNA, 22 bp, Artificial Sequence
  chemically synthesized
gggaagtcgaagctgcagtgag

SEQ ID NO: 779000 - DNA, 22 bp, Artificial Sequence
  chemically synthesized
agcttgggaagtcgaagctgca

SEQ ID NO: 779001 - DNA, 22 bp, Artificial Sequence
  chemically synthesized
gagcttgggaagtcgaagctgc

SEQ ID NO: 779002 - DNA, 22 bp, Artificial Sequence
  chemically synthesized
cttgagcttgggaagtcgaagc

SEQ ID NO: 779003 - DNA, 22 bp, Artificial Sequence
  chemically synthesized
actgcagcttcgacttcccaag

SEQ ID NO: 779004 - DNA, 22 bp, Artificial Sequence
  chemically synthesized
cagcttcgacttcccaagctca

SEQ ID NO: 779005 - DNA, 22 bp, Artificial Sequence
  chemically synthesized
aggtgggaggattgcttgagct

SEQ ID NO: 779006 - DNA, 22 bp, Artificial Sequence
  chemically synthesized
cgacttcccaagctcaagcaat

SEQ ID NO: 779007 - DNA, 22 bp, Artificial Sequence
  chemically synthesized
gacttcccaagctcaagcaatc

SEQ ID NO: 779008 - DNA, 22 bp, Artificial Sequence
  chemically synthesized
cccaagctcaagcaatcctccc

SEQ ID NO: 779009 - DNA, 22 bp, Artificial Sequence
  chemically synthesized
ccaagctcaagcaatcctccca

SEQ ID NO: 779010 - DNA, 22 bp, Artificial Sequence
  chemically synthesized
aggaggctgaggtgggaggatt

SEQ ID NO: 779011 - DNA, 22 bp, Artificial Sequence
  chemically synthesized
ctcaggaggctgaggtgggagg

SEQ ID NO: 779012 - DNA, 22 bp, Artificial Sequence
  chemically synthesized
aagcaatcctcccacctcagcc

SEQ ID NO: 779013 - DNA, 22 bp, Artificial Sequence
  chemically synthesized
taatcccaactactcaggaggc

SEQ ID NO: 779014 - DNA, 22 bp, Artificial Sequence
  chemically synthesized
ccacctcagcctcctgagtagt

SEQ ID NO: 779015 - DNA, 22 bp, Artificial Sequence
  chemically synthesized
agcctcctgagtagttgggatt

SEQ ID NO: 779016 - DNA, 22 bp, Artificial Sequence
  chemically synthesized
ctgagtagttgggattataggt

SEQ ID NO: 779017 - DNA, 22 bp, Artificial Sequence
  chemically synthesized
agtagttgggattataggtgtg

SEQ ID NO: 779018 - DNA, 22 bp, Artificial Sequence
  chemically synthesized
ggtgtggtggcacacacctata

SEQ ID NO: 779019 - DNA, 22 bp, Artificial Sequence
  chemically synthesized
gctgggtgtggtggcacacacc

SEQ ID NO: 779020 - DNA, 22 bp, Artificial Sequence
  chemically synthesized
agctgggtgtggtggcacacac

SEQ ID NO: 779021 - DNA, 22 bp, Artificial Sequence
  chemically synthesized
ggattataggtgtgtgccacca

SEQ ID NO: 779022 - DNA, 22 bp, Artificial Sequence
  chemically synthesized
taggtgtgtgccaccacaccca

SEQ ID NO: 779023 - DNA, 22 bp, Artificial Sequence
  chemically synthesized
ataaaaataaaaaacttagctg

SEQ ID NO: 779024 - DNA, 22 bp, Artificial Sequence
  chemically synthesized
taataaaaataaaaaacttagc

SEQ ID NO: 779025 - DNA, 22 bp, Artificial Sequence
  chemically synthesized
atctctaataaaaataaaaaac

SEQ ID NO: 779026 - DNA, 22 bp, Artificial Sequence
  chemically synthesized
catctctaataaaaataaaaaa

SEQ ID NO: 779027 - DNA, 22 bp, Artificial Sequence
  chemically synthesized
gtgggacttcatctctaataaa

SEQ ID NO: 779028 - DNA, 22 bp, Artificial Sequence
  chemically synthesized
agttttttatttttattagaga

SEQ ID NO: 779029 - DNA, 22 bp, Artificial Sequence
  chemically synthesized
tttatttttattagagatgaag

SEQ ID NO: 779030 - DNA, 22 bp, Artificial Sequence
  chemically synthesized
ttatttttattagagatgaagt

SEQ ID NO: 779031 - DNA, 22 bp, Artificial Sequence
  chemically synthesized
tatttttattagagatgaagtc

SEQ ID NO: 779032 - DNA, 22 bp, Artificial Sequence
  chemically synthesized
gcaatctagtgggacttcatct

SEQ ID NO: 779033 - DNA, 22 bp, Artificial Sequence
  chemically synthesized
atttttattagagatgaagtcc

SEQ ID NO: 779034 - DNA, 22 bp, Artificial Sequence
  chemically synthesized
tttttattagagatgaagtccc

SEQ ID NO: 779035 - DNA, 22 bp, Artificial Sequence
  chemically synthesized
ttattagagatgaagtcccact

SEQ ID NO: 779036 - DNA, 22 bp, Artificial Sequence
  chemically synthesized
tattagagatgaagtcccacta

SEQ ID NO: 779037 - DNA, 22 bp, Artificial Sequence
  chemically synthesized
attagagatgaagtcccactag

SEQ ID NO: 779038 - DNA, 22 bp, Artificial Sequence
  chemically synthesized
ttagagatgaagtcccactaga

SEQ ID NO: 779039 - DNA, 22 bp, Artificial Sequence
  chemically synthesized
gagatgaagtcccactagattg

SEQ ID NO: 779040 - DNA, 22 bp, Artificial Sequence
  chemically synthesized
agaccaaccctagcaatctagt

SEQ ID NO: 779041 - DNA, 22 bp, Artificial Sequence
  chemically synthesized
agcccaggaaattaagaccaac

SEQ ID NO: 779042 - DNA, 22 bp, Artificial Sequence
  chemically synthesized
gagcccaggaaattaagaccaa

SEQ ID NO: 779043 - DNA, 22 bp, Artificial Sequence
  chemically synthesized
gattgctagggttggtcttaat

SEQ ID NO: 779044 - DNA, 22 bp, Artificial Sequence
  chemically synthesized
ttgagcccaggaaattaagacc

SEQ ID NO: 779045 - DNA, 22 bp, Artificial Sequence
  chemically synthesized
ctagggttggtcttaatttcct

SEQ ID NO: 779046 - DNA, 22 bp, Artificial Sequence
  chemically synthesized
gggttggtcttaatttcctggg

SEQ ID NO: 779047 - DNA, 22 bp, Artificial Sequence
  chemically synthesized
gtcttaatttcctgggctcaag

SEQ ID NO: 779048 - DNA, 22 bp, Artificial Sequence
  chemically synthesized
aggcgggaggatctcttgagcc

SEQ ID NO: 779049 - DNA, 22 bp, Artificial Sequence
  chemically synthesized
aatttcctgggctcaagagatc

SEQ ID NO: 779050 - DNA, 22 bp, Artificial Sequence
  chemically synthesized
atttcctgggctcaagagatcc

SEQ ID NO: 779051 - DNA, 22 bp, Artificial Sequence
  chemically synthesized
cctgggctcaagagatcctccc

SEQ ID NO: 779052 - DNA, 22 bp, Artificial Sequence
  chemically synthesized
ggaggctgaggcgggaggatct

SEQ ID NO: 779053 - DNA, 22 bp, Artificial Sequence
  chemically synthesized
ctgggctcaagagatcctcccg

SEQ ID NO: 779054 - DNA, 22 bp, Artificial Sequence
  chemically synthesized
gggaggctgaggcgggaggatc

SEQ ID NO: 779055 - DNA, 22 bp, Artificial Sequence
  chemically synthesized
tgggaggctgaggcgggaggat

SEQ ID NO: 779056 - DNA, 22 bp, Artificial Sequence
  chemically synthesized
ggctcaagagatcctcccgcct

SEQ ID NO: 779057 - DNA, 22 bp, Artificial Sequence
  chemically synthesized
aagagatcctcccgcctcagcc

SEQ ID NO: 779058 - DNA, 22 bp, Artificial Sequence
  chemically synthesized
taatcccagtgctttgggaggc

SEQ ID NO: 779059 - DNA, 22 bp, Artificial Sequence
  chemically synthesized
gtaatcccagtgctttgggagg

SEQ ID NO: 779060 - DNA, 22 bp, Artificial Sequence
  chemically synthesized
ccgcctcagcctcccaaagcac

SEQ ID NO: 779061 - DNA, 22 bp, Artificial Sequence
  chemically synthesized
acacttgtaatcccagtgcttt

SEQ ID NO: 779062 - DNA, 22 bp, Artificial Sequence
  chemically synthesized
agcctcccaaagcactgggatt

SEQ ID NO: 779063 - DNA, 22 bp, Artificial Sequence
  chemically synthesized
ccaaagcactgggattacaagt

SEQ ID NO: 779064 - DNA, 22 bp, Artificial Sequence
  chemically synthesized
ggccatgtgtggtggctcacac

SEQ ID NO: 779065 - DNA, 22 bp, Artificial Sequence
  chemically synthesized
tgggccatgtgtggtggctcac

SEQ ID NO: 779066 - DNA, 22 bp, Artificial Sequence
  chemically synthesized
ggattacaagtgtgagccacca

SEQ ID NO: 779067 - DNA, 22 bp, Artificial Sequence
  chemically synthesized
caagtgtgagccaccacacatg

SEQ ID NO: 779068 - DNA, 22 bp, Artificial Sequence
  chemically synthesized
gtaagaagcagctctgggccat

SEQ ID NO: 779069 - DNA, 22 bp, Artificial Sequence
  chemically synthesized
cctggtaagaagcagctctggg

SEQ ID NO: 779070 - DNA, 22 bp, Artificial Sequence
  chemically synthesized
tctgcctggtaagaagcagctc

SEQ ID NO: 779071 - DNA, 22 bp, Artificial Sequence
  chemically synthesized
tgtctgcctggtaagaagcagc

SEQ ID NO: 779072 - DNA, 22 bp, Artificial Sequence
  chemically synthesized
tctgtctgcctggtaagaagca

SEQ ID NO: 779073 - DNA, 22 bp, Artificial Sequence
  chemically synthesized
ctctgtctgcctggtaagaagc

SEQ ID NO: 779074 - DNA, 22 bp, Artificial Sequence
  chemically synthesized
ccatttctctgtctgcctggta

SEQ ID NO: 779075 - DNA, 22 bp, Artificial Sequence
  chemically synthesized
cctcccatttctctgtctgcct

SEQ ID NO: 779076 - DNA, 22 bp, Artificial Sequence
  chemically synthesized
cttcttaccaggcagacagaga

SEQ ID NO: 779077 - DNA, 22 bp, Artificial Sequence
  chemically synthesized
cttaccaggcagacagagaaat

SEQ ID NO: 779078 - DNA, 22 bp, Artificial Sequence
  chemically synthesized
ttaccaggcagacagagaaatg

SEQ ID NO: 779079 - DNA, 22 bp, Artificial Sequence
  chemically synthesized
accaggcagacagagaaatggg

SEQ ID NO: 779080 - DNA, 22 bp, Artificial Sequence
  chemically synthesized
ccaggcagacagagaaatggga

SEQ ID NO: 779081 - DNA, 22 bp, Artificial Sequence
  chemically synthesized
caaggtcgtgctgcctcccatt

SEQ ID NO: 779082 - DNA, 22 bp, Artificial Sequence
  chemically synthesized
tccaaggtcgtgctgcctccca

SEQ ID NO: 779083 - DNA, 22 bp, Artificial Sequence
  chemically synthesized
ctccaaggtcgtgctgcctccc

SEQ ID NO: 779084 - DNA, 22 bp, Artificial Sequence
  chemically synthesized
cttctccaaggtcgtgctgcct

SEQ ID NO: 779085 - DNA, 22 bp, Artificial Sequence
  chemically synthesized
ctccttctccaaggtcgtgctg

SEQ ID NO: 779086 - DNA, 22 bp, Artificial Sequence
  chemically synthesized
cctccttctccaaggtcgtgct

SEQ ID NO: 779087 - DNA, 22 bp, Artificial Sequence
  chemically synthesized
tttcctccttctccaaggtcgt

SEQ ID NO: 779088 - DNA, 22 bp, Artificial Sequence
  chemically synthesized
ggagaaggaggaaatagtcatt

SEQ ID NO: 779089 - DNA, 22 bp, Artificial Sequence
  chemically synthesized
gagaaggaggaaatagtcattg

SEQ ID NO: 779090 - DNA, 22 bp, Artificial Sequence
  chemically synthesized
ataaaagaaggggacaatgact

SEQ ID NO: 779091 - DNA, 22 bp, Artificial Sequence
  chemically synthesized
cctaataaaagaaggggacaat

SEQ ID NO: 779092 - DNA, 22 bp, Artificial Sequence
  chemically synthesized
cactccctaataaaagaagggg

SEQ ID NO: 779093 - DNA, 22 bp, Artificial Sequence
  chemically synthesized
tccccttcttttattagggagt

SEQ ID NO: 779094 - DNA, 22 bp, Artificial Sequence
  chemically synthesized
cttttattagggagtgcaggcc

SEQ ID NO: 779095 - DNA, 22 bp, Artificial Sequence
  chemically synthesized
ttttattagggagtgcaggccc

SEQ ID NO: 779096 - DNA, 22 bp, Artificial Sequence
  chemically synthesized
ttattagggagtgcaggcccca

SEQ ID NO: 779097 - DNA, 22 bp, Artificial Sequence
  chemically synthesized
tattagggagtgcaggccccac

SEQ ID NO: 779098 - DNA, 22 bp, Artificial Sequence
  chemically synthesized
attagggagtgcaggccccacc

SEQ ID NO: 779099 - DNA, 22 bp, Artificial Sequence
  chemically synthesized
ttagggagtgcaggccccacca

SEQ ID NO: 779100 - DNA, 22 bp, Artificial Sequence
  chemically synthesized
gtagaatagtagtatggtgggg

SEQ ID NO: 779101 - DNA, 22 bp, Artificial Sequence
  chemically synthesized
gggagtgcaggccccaccatac

SEQ ID NO: 779102 - DNA, 22 bp, Artificial Sequence
  chemically synthesized
tgctggtagaatagtagtatgg

SEQ ID NO: 779103 - DNA, 22 bp, Artificial Sequence
  chemically synthesized
ctattctaccagcacagtgcct

SEQ ID NO: 779104 - DNA, 22 bp, Artificial Sequence
  chemically synthesized
ttctaccagcacagtgcctgct

SEQ ID NO: 779105 - DNA, 22 bp, Artificial Sequence
  chemically synthesized
taccagcacagtgcctgctcct

SEQ ID NO: 779106 - DNA, 22 bp, Artificial Sequence
  chemically synthesized
ccagcacagtgcctgctcctct

SEQ ID NO: 779107 - DNA, 22 bp, Artificial Sequence
  chemically synthesized
gaaggagcagcccagaggagca

SEQ ID NO: 779108 - DNA, 22 bp, Artificial Sequence
  chemically synthesized
ctcctctgggctgctccttcca

SEQ ID NO: 779109 - DNA, 22 bp, Artificial Sequence
  chemically synthesized
ctctgggctgctccttccaacc

SEQ ID NO: 779110 - DNA, 22 bp, Artificial Sequence
  chemically synthesized
agggcagcagtgaggttggaag

SEQ ID NO: 779111 - DNA, 22 bp, Artificial Sequence
  chemically synthesized
tgggctgctccttccaacctca

SEQ ID NO: 779112 - DNA, 22 bp, Artificial Sequence
  chemically synthesized
ggctgctccttccaacctcact

SEQ ID NO: 779113 - DNA, 22 bp, Artificial Sequence
  chemically synthesized
ctccttccaacctcactgctgc

SEQ ID NO: 779114 - DNA, 22 bp, Artificial Sequence
  chemically synthesized
cttccaacctcactgctgccct

SEQ ID NO: 779115 - DNA, 22 bp, Artificial Sequence
  chemically synthesized
aatatgaggctgagggcagcag

SEQ ID NO: 779116 - DNA, 22 bp, Artificial Sequence
  chemically synthesized
tgaatatgaggctgagggcagc

SEQ ID NO: 779117 - DNA, 22 bp, Artificial Sequence
  chemically synthesized
ccaacctcactgctgccctcag

SEQ ID NO: 779118 - DNA, 22 bp, Artificial Sequence
  chemically synthesized
caacctcactgctgccctcagc

SEQ ID NO: 779119 - DNA, 22 bp, Artificial Sequence
  chemically synthesized
aaatgttctgaatatgaggctg

SEQ ID NO: 779120 - DNA, 22 bp, Artificial Sequence
  chemically synthesized
actgctgccctcagcctcatat

SEQ ID NO: 779121 - DNA, 22 bp, Artificial Sequence
  chemically synthesized
ctgccctcagcctcatattcag

SEQ ID NO: 779122 - DNA, 22 bp, Artificial Sequence
  chemically synthesized
accactgaaatgttctgaatat

SEQ ID NO: 779123 - DNA, 22 bp, Artificial Sequence
  chemically synthesized
ccctcagcctcatattcagaac

SEQ ID NO: 779124 - DNA, 22 bp, Artificial Sequence
  chemically synthesized
caccactgaaatgttctgaata

SEQ ID NO: 779125 - DNA, 22 bp, Artificial Sequence
  chemically synthesized
agcctcatattcagaacatttc

SEQ ID NO: 779126 - DNA, 22 bp, Artificial Sequence
  chemically synthesized
atcttcaccactgaaatgttct

SEQ ID NO: 779127 - DNA, 22 bp, Artificial Sequence
  chemically synthesized
tgatcttcaccactgaaatgtt

SEQ ID NO: 779128 - DNA, 22 bp, Artificial Sequence
  chemically synthesized
atattcagaacatttcagtggt

SEQ ID NO: 779129 - DNA, 22 bp, Artificial Sequence
  chemically synthesized
tgtgctctgatcttcaccactg

SEQ ID NO: 779130 - DNA, 22 bp, Artificial Sequence
  chemically synthesized
agaacatttcagtggtgaagat

SEQ ID NO: 779131 - DNA, 22 bp, Artificial Sequence
  chemically synthesized
attatgtgctctgatcttcacc

SEQ ID NO: 779132 - DNA, 22 bp, Artificial Sequence
  chemically synthesized
cagtggtgaagatcagagcaca

SEQ ID NO: 779133 - DNA, 22 bp, Artificial Sequence
  chemically synthesized
agtggtgaagatcagagcacat

SEQ ID NO: 779134 - DNA, 22 bp, Artificial Sequence
  chemically synthesized
cagacaagctcattatgtgctc

SEQ ID NO: 779135 - DNA, 22 bp, Artificial Sequence
  chemically synthesized
ttccagacaagctcattatgtg

SEQ ID NO: 779136 - DNA, 22 bp, Artificial Sequence
  chemically synthesized
gttccagacaagctcattatgt

SEQ ID NO: 779137 - DNA, 22 bp, Artificial Sequence
  chemically synthesized
atttgttccagacaagctcatt

SEQ ID NO: 779138 - DNA, 22 bp, Artificial Sequence
  chemically synthesized
aatttgttccagacaagctcat

SEQ ID NO: 779139 - DNA, 22 bp, Artificial Sequence
  chemically synthesized
aagcccggaatcttaatttgtt

SEQ ID NO: 779140 - DNA, 22 bp, Artificial Sequence
  chemically synthesized
aaagcccggaatcttaatttgt

SEQ ID NO: 779141 - DNA, 22 bp, Artificial Sequence
  chemically synthesized
taaagcccggaatcttaatttg

SEQ ID NO: 779142 - DNA, 22 bp, Artificial Sequence
  chemically synthesized
gtctggaacaaattaagattcc

SEQ ID NO: 779143 - DNA, 22 bp, Artificial Sequence
  chemically synthesized
actttaaagcccggaatcttaa

SEQ ID NO: 779144 - DNA, 22 bp, Artificial Sequence
  chemically synthesized
tctggaacaaattaagattccg

SEQ ID NO: 779145 - DNA, 22 bp, Artificial Sequence
  chemically synthesized
gactttaaagcccggaatctta

SEQ ID NO: 779146 - DNA, 22 bp, Artificial Sequence
  chemically synthesized
tttgactttaaagcccggaatc

SEQ ID NO: 779147 - DNA, 22 bp, Artificial Sequence
  chemically synthesized
gaacaaattaagattccgggct

SEQ ID NO: 779148 - DNA, 22 bp, Artificial Sequence
  chemically synthesized
agattccgggctttaaagtcaa

SEQ ID NO: 779149 - DNA, 22 bp, Artificial Sequence
  chemically synthesized
cgggctttaaagtcaaacagac

SEQ ID NO: 779150 - DNA, 22 bp, Artificial Sequence
  chemically synthesized
aaacccatgtaacccatgtctg

SEQ ID NO: 779151 - DNA, 22 bp, Artificial Sequence
  chemically synthesized
taaagtcaaacagacatgggtt

SEQ ID NO: 779152 - DNA, 22 bp, Artificial Sequence
  chemically synthesized
aaagtcaaacagacatgggtta

SEQ ID NO: 779153 - DNA, 22 bp, Artificial Sequence
  chemically synthesized
aagtcaaacagacatgggttac

SEQ ID NO: 779154 - DNA, 22 bp, Artificial Sequence
  chemically synthesized
catgggtttgagtctcatttgg

SEQ ID NO: 779155 - DNA, 22 bp, Artificial Sequence
  chemically synthesized
aagatcgcagagccaaatgaga

SEQ ID NO: 779156 - DNA, 22 bp, Artificial Sequence
  chemically synthesized
ctgaagatcgcagagccaaatg

SEQ ID NO: 779157 - DNA, 22 bp, Artificial Sequence
  chemically synthesized
gctgaagatcgcagagccaaat

SEQ ID NO: 779158 - DNA, 22 bp, Artificial Sequence
  chemically synthesized
gagtctcatttggctctgcgat

SEQ ID NO: 779159 - DNA, 22 bp, Artificial Sequence
  chemically synthesized
agtctcatttggctctgcgatc

SEQ ID NO: 779160 - DNA, 22 bp, Artificial Sequence
  chemically synthesized
atttggctctgcgatcttcagc

SEQ ID NO: 779161 - DNA, 22 bp, Artificial Sequence
  chemically synthesized
ggctctgcgatcttcagcaaat

SEQ ID NO: 779162 - DNA, 22 bp, Artificial Sequence
  chemically synthesized
gctctgcgatcttcagcaaatt

SEQ ID NO: 779163 - DNA, 22 bp, Artificial Sequence
  chemically synthesized
tgcgatcttcagcaaatttctt

SEQ ID NO: 779164 - DNA, 22 bp, Artificial Sequence
  chemically synthesized
cgatcttcagcaaatttcttat

SEQ ID NO: 779165 - DNA, 22 bp, Artificial Sequence
  chemically synthesized
cggataaggaaatagataagaa

SEQ ID NO: 779166 - DNA, 22 bp, Artificial Sequence
  chemically synthesized
tgcggataaggaaatagataag

SEQ ID NO: 779167 - DNA, 22 bp, Artificial Sequence
  chemically synthesized
cagcaaatttcttatctatttc

SEQ ID NO: 779168 - DNA, 22 bp, Artificial Sequence
  chemically synthesized
agcaaatttcttatctatttcc

SEQ ID NO: 779169 - DNA, 22 bp, Artificial Sequence
  chemically synthesized
cattctgcggataaggaaatag

SEQ ID NO: 779170 - DNA, 22 bp, Artificial Sequence
  chemically synthesized
cttatctatttccttatccgca

SEQ ID NO: 779171 - DNA, 22 bp, Artificial Sequence
  chemically synthesized
tcatctccattctgcggataag

SEQ ID NO: 779172 - DNA, 22 bp, Artificial Sequence
  chemically synthesized
ttatctatttccttatccgcag

SEQ ID NO: 779173 - DNA, 22 bp, Artificial Sequence
  chemically synthesized
atctatttccttatccgcagaa

SEQ ID NO: 779174 - DNA, 22 bp, Artificial Sequence
  chemically synthesized
tctatttccttatccgcagaat

SEQ ID NO: 779175 - DNA, 22 bp, Artificial Sequence
  chemically synthesized
tttccttatccgcagaatggag

SEQ ID NO: 779176 - DNA, 22 bp, Artificial Sequence
  chemically synthesized
ccttatccgcagaatggagatg

SEQ ID NO: 779177 - DNA, 22 bp, Artificial Sequence
  chemically synthesized
cttatccgcagaatggagatga

SEQ ID NO: 779178 - DNA, 22 bp, Artificial Sequence
  chemically synthesized
atccgcagaatggagatgataa

SEQ ID NO: 779179 - DNA, 22 bp, Artificial Sequence
  chemically synthesized
aggaaggtggtattatcatctc

SEQ ID NO: 779180 - DNA, 22 bp, Artificial Sequence
  chemically synthesized
tccgcagaatggagatgataat

SEQ ID NO: 779181 - DNA, 22 bp, Artificial Sequence
  chemically synthesized
gaggaaggtggtattatcatct

SEQ ID NO: 779182 - DNA, 22 bp, Artificial Sequence
  chemically synthesized
tatatacatcacaaaagtccct

SEQ ID NO: 779183 - DNA, 22 bp, Artificial Sequence
  chemically synthesized
cctcaagggacttttgtgatgt

SEQ ID NO: 779184 - DNA, 22 bp, Artificial Sequence
  chemically synthesized
ctcaagggacttttgtgatgta

SEQ ID NO: 779185 - DNA, 22 bp, Artificial Sequence
  chemically synthesized
aagggacttttgtgatgtatat

SEQ ID NO: 779186 - DNA, 22 bp, Artificial Sequence
  chemically synthesized
aatacccagcactatatataca

SEQ ID NO: 779187 - DNA, 22 bp, Artificial Sequence
  chemically synthesized
ttgtgatgtatatatagtgctg

SEQ ID NO: 779188 - DNA, 22 bp, Artificial Sequence
  chemically synthesized
tgtgatgtatatatagtgctgg

SEQ ID NO: 779189 - DNA, 22 bp, Artificial Sequence
  chemically synthesized
agtactaaatacccagcactat

SEQ ID NO: 779190 - DNA, 22 bp, Artificial Sequence
  chemically synthesized
gtgatgtatatatagtgctggg

SEQ ID NO: 779191 - DNA, 22 bp, Artificial Sequence
  chemically synthesized
cagtactaaatacccagcacta

SEQ ID NO: 779192 - DNA, 22 bp, Artificial Sequence
  chemically synthesized
tgatgtatatatagtgctgggt

SEQ ID NO: 779193 - DNA, 22 bp, Artificial Sequence
  chemically synthesized
tcagtactaaatacccagcact

SEQ ID NO: 779194 - DNA, 22 bp, Artificial Sequence
  chemically synthesized
gcatattttcagtactaaatac

SEQ ID NO: 779195 - DNA, 22 bp, Artificial Sequence
  chemically synthesized
tagcatattttcagtactaaat

SEQ ID NO: 779196 - DNA, 22 bp, Artificial Sequence
  chemically synthesized
ggtatttagtactgaaaatatg

SEQ ID NO: 779197 - DNA, 22 bp, Artificial Sequence
  chemically synthesized
caaatagcaacctctagcatat

SEQ ID NO: 779198 - DNA, 22 bp, Artificial Sequence
  chemically synthesized
agtactgaaaatatgctagagg

SEQ ID NO: 779199 - DNA, 22 bp, Artificial Sequence
  chemically synthesized
gtactgaaaatatgctagaggt

SEQ ID NO: 779200 - DNA, 22 bp, Artificial Sequence
  chemically synthesized
ctacaaatagcaacctctagca

SEQ ID NO: 779201 - DNA, 22 bp, Artificial Sequence
  chemically synthesized
ctactacaaatagcaacctcta

SEQ ID NO: 779202 - DNA, 22 bp, Artificial Sequence
  chemically synthesized
aaaatatgctagaggttgctat

SEQ ID NO: 779203 - DNA, 22 bp, Artificial Sequence
  chemically synthesized
ctactactacaaatagcaacct

SEQ ID NO: 779204 - DNA, 22 bp, Artificial Sequence
  chemically synthesized
ccactactactactacaaatag

SEQ ID NO: 779205 - DNA, 22 bp, Artificial Sequence
  chemically synthesized
ctaccactactactactacaaa

SEQ ID NO: 779206 - DNA, 22 bp, Artificial Sequence
  chemically synthesized
gaggttgctatttgtagtagta

SEQ ID NO: 779207 - DNA, 22 bp, Artificial Sequence
  chemically synthesized
ctactaccactactactactac

SEQ ID NO: 779208 - DNA, 22 bp, Artificial Sequence
  chemically synthesized
ctactactaccactactactac

SEQ ID NO: 779209 - DNA, 22 bp, Artificial Sequence
  chemically synthesized
ctatttgtagtagtagtagtgg

SEQ ID NO: 779210 - DNA, 22 bp, Artificial Sequence
  chemically synthesized
tttgtagtagtagtagtggtag

SEQ ID NO: 779211 - DNA, 22 bp, Artificial Sequence
  chemically synthesized
catactactactactaccacta

SEQ ID NO: 779212 - DNA, 22 bp, Artificial Sequence
  chemically synthesized
ccatactactactactaccact

SEQ ID NO: 779213 - DNA, 22 bp, Artificial Sequence
  chemically synthesized
gtagtagtagtagtggtagtag

SEQ ID NO: 779214 - DNA, 22 bp, Artificial Sequence
  chemically synthesized
tccatactactactactaccac

SEQ ID NO: 779215 - DNA, 22 bp, Artificial Sequence
  chemically synthesized
tagtagtagtagtggtagtagt

SEQ ID NO: 779216 - DNA, 22 bp, Artificial Sequence
  chemically synthesized
tttccatactactactactacc

SEQ ID NO: 779217 - DNA, 22 bp, Artificial Sequence
  chemically synthesized
ctttccatactactactactac

SEQ ID NO: 779218 - DNA, 22 bp, Artificial Sequence
  chemically synthesized
cttctttccatactactactac

SEQ ID NO: 779219 - DNA, 22 bp, Artificial Sequence
  chemically synthesized
ccttctttccatactactacta

SEQ ID NO: 779220 - DNA, 22 bp, Artificial Sequence
  chemically synthesized
cttccttctttccatactacta

SEQ ID NO: 779221 - DNA, 22 bp, Artificial Sequence
  chemically synthesized
gcttccttctttccatactact

SEQ ID NO: 779222 - DNA, 22 bp, Artificial Sequence
  chemically synthesized
tgcggtagcttgcttccttctt

SEQ ID NO: 779223 - DNA, 22 bp, Artificial Sequence
  chemically synthesized
tgtgcggtagcttgcttccttc

SEQ ID NO: 779224 - DNA, 22 bp, Artificial Sequence
  chemically synthesized
ctgtgcggtagcttgcttcctt

SEQ ID NO: 779225 - DNA, 22 bp, Artificial Sequence
  chemically synthesized
aggagacttctgtgcggtagct

SEQ ID NO: 779226 - DNA, 22 bp, Artificial Sequence
  chemically synthesized
caggagacttctgtgcggtagc

SEQ ID NO: 779227 - DNA, 22 bp, Artificial Sequence
  chemically synthesized
tcaggagacttctgtgcggtag

SEQ ID NO: 779228 - DNA, 22 bp, Artificial Sequence
  chemically synthesized
agattttcaggagacttctgtg

SEQ ID NO: 779229 - DNA, 22 bp, Artificial Sequence
  chemically synthesized
cagattttcaggagacttctgt

SEQ ID NO: 779230 - DNA, 22 bp, Artificial Sequence
  chemically synthesized
tcagattttcaggagacttctg

SEQ ID NO: 779231 - DNA, 22 bp, Artificial Sequence
  chemically synthesized
ttcagattttcaggagacttct

SEQ ID NO: 779232 - DNA, 22 bp, Artificial Sequence
  chemically synthesized
tttcagattttcaggagacttc

SEQ ID NO: 779233 - DNA, 22 bp, Artificial Sequence
  chemically synthesized
ccgcacagaagtctcctgaaaa

SEQ ID NO: 779234 - DNA, 22 bp, Artificial Sequence
  chemically synthesized
cccaagcctttttcagattttc

SEQ ID NO: 779235 - DNA, 22 bp, Artificial Sequence
  chemically synthesized
ccccaagcctttttcagatttt

SEQ ID NO: 779236 - DNA, 22 bp, Artificial Sequence
  chemically synthesized
gatttccccaagcctttttcag

SEQ ID NO: 779237 - DNA, 22 bp, Artificial Sequence
  chemically synthesized
ctggatttccccaagccttttt

SEQ ID NO: 779238 - DNA, 22 bp, Artificial Sequence
  chemically synthesized
ctgaaaatctgaaaaaggcttg

SEQ ID NO: 779239 - DNA, 22 bp, Artificial Sequence
  chemically synthesized
tgctggatttccccaagccttt

SEQ ID NO: 779240 - DNA, 22 bp, Artificial Sequence
  chemically synthesized
aaaatctgaaaaaggcttgggg

SEQ ID NO: 779241 - DNA, 22 bp, Artificial Sequence
  chemically synthesized
tctgctggatttccccaagcct

SEQ ID NO: 779242 - DNA, 22 bp, Artificial Sequence
  chemically synthesized
tctctgctggatttccccaagc

SEQ ID NO: 779243 - DNA, 22 bp, Artificial Sequence
  chemically synthesized
aaaaaggcttggggaaatccag

SEQ ID NO: 779244 - DNA, 22 bp, Artificial Sequence
  chemically synthesized
ggggaaatccagcagagagagc

SEQ ID NO: 779245 - DNA, 22 bp, Artificial Sequence
  chemically synthesized
aagaaagggaaagctctctctg

SEQ ID NO: 779246 - DNA, 22 bp, Artificial Sequence
  chemically synthesized
gggaaatccagcagagagagct

SEQ ID NO: 779247 - DNA, 22 bp, Artificial Sequence
  chemically synthesized
tgaagaaagggaaagctctctc

SEQ ID NO: 779248 - DNA, 22 bp, Artificial Sequence
  chemically synthesized
ctctgaagaaagggaaagctct

SEQ ID NO: 779249 - DNA, 22 bp, Artificial Sequence
  chemically synthesized
tgctctgaagaaagggaaagct

SEQ ID NO: 779250 - DNA, 22 bp, Artificial Sequence
  chemically synthesized
aaaacctctgctctgaagaaag

SEQ ID NO: 779251 - DNA, 22 bp, Artificial Sequence
  chemically synthesized
aaaaacctctgctctgaagaaa

SEQ ID NO: 779252 - DNA, 22 bp, Artificial Sequence
  chemically synthesized
tccctttcttcagagcagaggt

SEQ ID NO: 779253 - DNA, 22 bp, Artificial Sequence
  chemically synthesized
ccctttcttcagagcagaggtt

SEQ ID NO: 779254 - DNA, 22 bp, Artificial Sequence
  chemically synthesized
cctttcttcagagcagaggttt

SEQ ID NO: 779255 - DNA, 22 bp, Artificial Sequence
  chemically synthesized
aatcacaacttaaaaacctctg

SEQ ID NO: 779256 - DNA, 22 bp, Artificial Sequence
  chemically synthesized
gaatcacaacttaaaaacctct

SEQ ID NO: 779257 - DNA, 22 bp, Artificial Sequence
  chemically synthesized
tcttcagagcagaggtttttaa

SEQ ID NO: 779258 - DNA, 22 bp, Artificial Sequence
  chemically synthesized
cttcagagcagaggtttttaag

SEQ ID NO: 779259 - DNA, 22 bp, Artificial Sequence
  chemically synthesized
ttcagagcagaggtttttaagt

SEQ ID NO: 779260 - DNA, 22 bp, Artificial Sequence
  chemically synthesized
cagagcagaggtttttaagttg

SEQ ID NO: 779261 - DNA, 22 bp, Artificial Sequence
  chemically synthesized
agagcagaggtttttaagttgt

SEQ ID NO: 779262 - DNA, 22 bp, Artificial Sequence
  chemically synthesized
ccggcccttgaatcacaactta

SEQ ID NO: 779263 - DNA, 22 bp, Artificial Sequence
  chemically synthesized
ttaagttgtgattcaagggccg

SEQ ID NO: 779264 - DNA, 22 bp, Artificial Sequence
  chemically synthesized
aggggatgttgccggcccttga

SEQ ID NO: 779265 - DNA, 22 bp, Artificial Sequence
  chemically synthesized
taagttgtgattcaagggccgg

SEQ ID NO: 779266 - DNA, 22 bp, Artificial Sequence
  chemically synthesized
aagttgtgattcaagggccggc

SEQ ID NO: 779267 - DNA, 22 bp, Artificial Sequence
  chemically synthesized
tcaggggatgttgccggccctt

SEQ ID NO: 779268 - DNA, 22 bp, Artificial Sequence
  chemically synthesized
agttgtgattcaagggccggca

SEQ ID NO: 779269 - DNA, 22 bp, Artificial Sequence
  chemically synthesized
tgattcaagggccggcaacatc

SEQ ID NO: 779270 - DNA, 22 bp, Artificial Sequence
  chemically synthesized
acaagttctcaggggatgttgc

SEQ ID NO: 779271 - DNA, 22 bp, Artificial Sequence
  chemically synthesized
taacaagttctcaggggatgtt

SEQ ID NO: 779272 - DNA, 22 bp, Artificial Sequence
  chemically synthesized
aagggccggcaacatcccctga

SEQ ID NO: 779273 - DNA, 22 bp, Artificial Sequence
  chemically synthesized
catctctaacaagttctcaggg

SEQ ID NO: 779274 - DNA, 22 bp, Artificial Sequence
  chemically synthesized
gcatctctaacaagttctcagg

SEQ ID NO: 779275 - DNA, 22 bp, Artificial Sequence
  chemically synthesized
agaatttgcatctctaacaagt

SEQ ID NO: 779276 - DNA, 22 bp, Artificial Sequence
  chemically synthesized
agaacttgttagagatgcaaat

SEQ ID NO: 779277 - DNA, 22 bp, Artificial Sequence
  chemically synthesized
ggatggggcctgagaatttgca

SEQ ID NO: 779278 - DNA, 22 bp, Artificial Sequence
  chemically synthesized
gttagagatgcaaattctcagg

SEQ ID NO: 779279 - DNA, 22 bp, Artificial Sequence
  chemically synthesized
ttagagatgcaaattctcaggc

SEQ ID NO: 779280 - DNA, 22 bp, Artificial Sequence
  chemically synthesized
gtctgggatggggcctgagaat

SEQ ID NO: 779281 - DNA, 22 bp, Artificial Sequence
  chemically synthesized
gagatgcaaattctcaggcccc

SEQ ID NO: 779282 - DNA, 22 bp, Artificial Sequence
  chemically synthesized
tgtcagttggtctgggatgggg

SEQ ID NO: 779283 - DNA, 22 bp, Artificial Sequence
  chemically synthesized
tgtgtcagttggtctgggatgg

SEQ ID NO: 779284 - DNA, 22 bp, Artificial Sequence
  chemically synthesized
ctgtgtcagttggtctgggatg

SEQ ID NO: 779285 - DNA, 22 bp, Artificial Sequence
  chemically synthesized
tcaggccccatcccagaccaac

SEQ ID NO: 779286 - DNA, 22 bp, Artificial Sequence
  chemically synthesized
aggccccatcccagaccaactg

SEQ ID NO: 779287 - DNA, 22 bp, Artificial Sequence
  chemically synthesized
ggccccatccccagagtttctg

SEQ ID NO: 779288 - DNA, 22 bp, Artificial Sequence
  chemically synthesized
gctgggccccatccccagagtt

SEQ ID NO: 779289 - DNA, 22 bp, Artificial Sequence
  chemically synthesized
acacagaaactctggggatggg

SEQ ID NO: 779290 - DNA, 22 bp, Artificial Sequence
  chemically synthesized
aaacgtagctggctgggcccca

SEQ ID NO: 779291 - DNA, 22 bp, Artificial Sequence
  chemically synthesized
aaaacgtagctggctgggcccc

SEQ ID NO: 779292 - DNA, 22 bp, Artificial Sequence
  chemically synthesized
taaaacgtagctggctgggccc

SEQ ID NO: 779293 - DNA, 22 bp, Artificial Sequence
  chemically synthesized
ttaaaacgtagctggctgggcc

SEQ ID NO: 779294 - DNA, 22 bp, Artificial Sequence
  chemically synthesized
tttaaaacgtagctggctgggc

SEQ ID NO: 779295 - DNA, 22 bp, Artificial Sequence
  chemically synthesized
tggggatggggcccagccagct

SEQ ID NO: 779296 - DNA, 22 bp, Artificial Sequence
  chemically synthesized
gggatggggcccagccagctac

SEQ ID NO: 779297 - DNA, 22 bp, Artificial Sequence
  chemically synthesized
aatgcctttttaaaacgtagct

SEQ ID NO: 779298 - DNA, 22 bp, Artificial Sequence
  chemically synthesized
tgaatgcctttttaaaacgtag

SEQ ID NO: 779299 - DNA, 22 bp, Artificial Sequence
  chemically synthesized
ctgaatgcctttttaaaacgta

SEQ ID NO: 779300 - DNA, 22 bp, Artificial Sequence
  chemically synthesized
taatggaatcttctgaatgcct

SEQ ID NO: 779301 - DNA, 22 bp, Artificial Sequence
  chemically synthesized
cgttttaaaaaggcattcagaa

SEQ ID NO: 779302 - DNA, 22 bp, Artificial Sequence
  chemically synthesized
acctgtaatggaatcttctgaa

SEQ ID NO: 779303 - DNA, 22 bp, Artificial Sequence
  chemically synthesized
taaaaaggcattcagaagattc

SEQ ID NO: 779304 - DNA, 22 bp, Artificial Sequence
  chemically synthesized
aaaaaggcattcagaagattcc

SEQ ID NO: 779305 - DNA, 22 bp, Artificial Sequence
  chemically synthesized
aaaaggcattcagaagattcca

SEQ ID NO: 779306 - DNA, 22 bp, Artificial Sequence
  chemically synthesized
aaaagttgacctgtaatggaat

SEQ ID NO: 779307 - DNA, 22 bp, Artificial Sequence
  chemically synthesized
tcaaaagttgacctgtaatgga

SEQ ID NO: 779308 - DNA, 22 bp, Artificial Sequence
  chemically synthesized
ctcaaaagttgacctgtaatgg

SEQ ID NO: 779309 - DNA, 22 bp, Artificial Sequence
  chemically synthesized
agaagattccattacaggtcaa

SEQ ID NO: 779310 - DNA, 22 bp, Artificial Sequence
  chemically synthesized
gagcagtgcttctcaaaagttg

SEQ ID NO: 779311 - DNA, 22 bp, Artificial Sequence
  chemically synthesized
cattacaggtcaacttttgaga

SEQ ID NO: 779312 - DNA, 22 bp, Artificial Sequence
  chemically synthesized
cgctagagcagtgcttctcaaa

SEQ ID NO: 779313 - DNA, 22 bp, Artificial Sequence
  chemically synthesized
caggtcaacttttgagaagcac

SEQ ID NO: 779314 - DNA, 22 bp, Artificial Sequence
  chemically synthesized
ttccgctagagcagtgcttctc

SEQ ID NO: 779315 - DNA, 22 bp, Artificial Sequence
  chemically synthesized
ctattccgctagagcagtgctt

SEQ ID NO: 779316 - DNA, 22 bp, Artificial Sequence
  chemically synthesized
ctgctattccgctagagcagtg

SEQ ID NO: 779317 - DNA, 22 bp, Artificial Sequence
  chemically synthesized
cctgctattccgctagagcagt

SEQ ID NO: 779318 - DNA, 22 bp, Artificial Sequence
  chemically synthesized
ttgagaagcactgctctagcgg

SEQ ID NO: 779319 - DNA, 22 bp, Artificial Sequence
  chemically synthesized
tgagaagcactgctctagcgga

SEQ ID NO: 779320 - DNA, 22 bp, Artificial Sequence
  chemically synthesized
gagaagcactgctctagcggaa

SEQ ID NO: 779321 - DNA, 22 bp, Artificial Sequence
  chemically synthesized
cccttcctgctattccgctaga

SEQ ID NO: 779322 - DNA, 22 bp, Artificial Sequence
  chemically synthesized
agaagcactgctctagcggaat

SEQ ID NO: 779323 - DNA, 22 bp, Artificial Sequence
  chemically synthesized
acccttcctgctattccgctag

SEQ ID NO: 779324 - DNA, 22 bp, Artificial Sequence
  chemically synthesized
gcatttacccttcctgctattc

SEQ ID NO: 779325 - DNA, 22 bp, Artificial Sequence
  chemically synthesized
agcatttacccttcctgctatt

SEQ ID NO: 779326 - DNA, 22 bp, Artificial Sequence
  chemically synthesized
ctctagcggaatagcaggaagg

SEQ ID NO: 779327 - DNA, 22 bp, Artificial Sequence
  chemically synthesized
agcttagcatttacccttcctg

SEQ ID NO: 779328 - DNA, 22 bp, Artificial Sequence
  chemically synthesized
tagcggaatagcaggaagggta

SEQ ID NO: 779329 - DNA, 22 bp, Artificial Sequence
  chemically synthesized
gcggaatagcaggaagggtaaa

SEQ ID NO: 779330 - DNA, 22 bp, Artificial Sequence
  chemically synthesized
agctcagcttagcatttaccct

SEQ ID NO: 779331 - DNA, 22 bp, Artificial Sequence
  chemically synthesized
acgtcccatatgaactaagctc

SEQ ID NO: 779332 - DNA, 22 bp, Artificial Sequence
  chemically synthesized
agctgagcttagttcatatggg

SEQ ID NO: 779333 - DNA, 22 bp, Artificial Sequence
  chemically synthesized
agcttagttcatatgggacgtt

SEQ ID NO: 779334 - DNA, 22 bp, Artificial Sequence
  chemically synthesized
agttcatatgggacgttaacat

SEQ ID NO: 779335 - DNA, 22 bp, Artificial Sequence
  chemically synthesized
atgagagaggaaatgttaacgt

SEQ ID NO: 779336 - DNA, 22 bp, Artificial Sequence
  chemically synthesized
gttcatatgggacgttaacatt

SEQ ID NO: 779337 - DNA, 22 bp, Artificial Sequence
  chemically synthesized
atatgggacgttaacatttcct

SEQ ID NO: 779338 - DNA, 22 bp, Artificial Sequence
  chemically synthesized
acatttcctctctcattagtgg

SEQ ID NO: 779339 - DNA, 22 bp, Artificial Sequence
  chemically synthesized
cccaggaggggaccactaatga

SEQ ID NO: 779340 - DNA, 22 bp, Artificial Sequence
  chemically synthesized
cctctctcattagtggtcccct

SEQ ID NO: 779341 - DNA, 22 bp, Artificial Sequence
  chemically synthesized
gatctgcccaggaggggaccac

SEQ ID NO: 779342 - DNA, 22 bp, Artificial Sequence
  chemically synthesized
ctctctcattagtggtcccctc

SEQ ID NO: 779343 - DNA, 22 bp, Artificial Sequence
  chemically synthesized
tctcattagtggtcccctcctg

SEQ ID NO: 779344 - DNA, 22 bp, Artificial Sequence
  chemically synthesized
tcattagtggtcccctcctggg

SEQ ID NO: 779345 - DNA, 22 bp, Artificial Sequence
  chemically synthesized
attagtggtcccctcctgggca

SEQ ID NO: 779346 - DNA, 22 bp, Artificial Sequence
  chemically synthesized
aaatgctagatctgcccaggag

SEQ ID NO: 779347 - DNA, 22 bp, Artificial Sequence
  chemically synthesized
gtggtcccctcctgggcagatc

SEQ ID NO: 779348 - DNA, 22 bp, Artificial Sequence
  chemically synthesized
ctgggcagatctagcatttgag

SEQ ID NO: 779349 - DNA, 22 bp, Artificial Sequence
  chemically synthesized
ggcagatctagcatttgagatt

SEQ ID NO: 779350 - DNA, 22 bp, Artificial Sequence
  chemically synthesized
gcatttgagattttcatttaca

SEQ ID NO: 779351 - DNA, 22 bp, Artificial Sequence
  chemically synthesized
gagattttcatttacatttctt

SEQ ID NO: 779352 - DNA, 22 bp, Artificial Sequence
  chemically synthesized
agattttcatttacatttctta

SEQ ID NO: 779353 - DNA, 22 bp, Artificial Sequence
  chemically synthesized
catggtatataagtaagaaatg

SEQ ID NO: 779354 - DNA, 22 bp, Artificial Sequence
  chemically synthesized
tcatttacatttcttacttata

SEQ ID NO: 779355 - DNA, 22 bp, Artificial Sequence
  chemically synthesized
catttacatttcttacttatat

SEQ ID NO: 779356 - DNA, 22 bp, Artificial Sequence
  chemically synthesized
atttacatttcttacttatata

SEQ ID NO: 779357 - DNA, 22 bp, Artificial Sequence
  chemically synthesized
cccaagactgcatggtatataa

SEQ ID NO: 779358 - DNA, 22 bp, Artificial Sequence
  chemically synthesized
acatttcttacttatataccat

SEQ ID NO: 779359 - DNA, 22 bp, Artificial Sequence
  chemically synthesized
catttcttacttatataccatg

SEQ ID NO: 779360 - DNA, 22 bp, Artificial Sequence
  chemically synthesized
cttacttatataccatgcagtc

SEQ ID NO: 779361 - DNA, 22 bp, Artificial Sequence
  chemically synthesized
ttacttatataccatgcagtct

SEQ ID NO: 779362 - DNA, 22 bp, Artificial Sequence
  chemically synthesized
acttatataccatgcagtcttg

SEQ ID NO: 779363 - DNA, 22 bp, Artificial Sequence
  chemically synthesized
acgggccctacccaagactgca

SEQ ID NO: 779364 - DNA, 22 bp, Artificial Sequence
  chemically synthesized
cttatataccatgcagtcttgg

SEQ ID NO: 779365 - DNA, 22 bp, Artificial Sequence
  chemically synthesized
aacgggccctacccaagactgc

SEQ ID NO: 779366 - DNA, 22 bp, Artificial Sequence
  chemically synthesized
taacgggccctacccaagactg

SEQ ID NO: 779367 - DNA, 22 bp, Artificial Sequence
  chemically synthesized
atataccatgcagtcttgggta

SEQ ID NO: 779368 - DNA, 22 bp, Artificial Sequence
  chemically synthesized
tataccatgcagtcttgggtag

SEQ ID NO: 779369 - DNA, 22 bp, Artificial Sequence
  chemically synthesized
catctttaacgggccctaccca

SEQ ID NO: 779370 - DNA, 22 bp, Artificial Sequence
  chemically synthesized
ccatctttaacgggccctaccc

SEQ ID NO: 779371 - DNA, 22 bp, Artificial Sequence
  chemically synthesized
cttccatctttaacgggcccta

SEQ ID NO: 779372 - DNA, 22 bp, Artificial Sequence
  chemically synthesized
tctacttccatctttaacgggc

SEQ ID NO: 779373 - DNA, 22 bp, Artificial Sequence
  chemically synthesized
gggtagggcccgttaaagatgg

SEQ ID NO: 779374 - DNA, 22 bp, Artificial Sequence
  chemically synthesized
ggtagggcccgttaaagatgga

SEQ ID NO: 779375 - DNA, 22 bp, Artificial Sequence
  chemically synthesized
atagttatctacttccatcttt

SEQ ID NO: 779376 - DNA, 22 bp, Artificial Sequence
  chemically synthesized
caccaacctaatagttatctac

SEQ ID NO: 779377 - DNA, 22 bp, Artificial Sequence
  chemically synthesized
gcaccaacctaatagttatcta

SEQ ID NO: 779378 - DNA, 22 bp, Artificial Sequence
  chemically synthesized
tgcaccaacctaatagttatct

SEQ ID NO: 779379 - DNA, 22 bp, Artificial Sequence
  chemically synthesized
aagatggaagtagataactatt

SEQ ID NO: 779380 - DNA, 22 bp, Artificial Sequence
  chemically synthesized
ttgcaccaacctaatagttatc

SEQ ID NO: 779381 - DNA, 22 bp, Artificial Sequence
  chemically synthesized
cttttgcaccaacctaatagtt

SEQ ID NO: 779382 - DNA, 22 bp, Artificial Sequence
  chemically synthesized
ttaggttggtgcaaaagtaatt

SEQ ID NO: 779383 - DNA, 22 bp, Artificial Sequence
  chemically synthesized
ggttggtgcaaaagtaattgcg

SEQ ID NO: 779384 - DNA, 22 bp, Artificial Sequence
  chemically synthesized
atggtaaaaaaaacgcaattac

SEQ ID NO: 779385 - DNA, 22 bp, Artificial Sequence
  chemically synthesized
aatggtaaaaaaaacgcaatta

SEQ ID NO: 779386 - DNA, 22 bp, Artificial Sequence
  chemically synthesized
taatggtaaaaaaaacgcaatt

SEQ ID NO: 779387 - DNA, 22 bp, Artificial Sequence
  chemically synthesized
ttaatggtaaaaaaaacgcaat

SEQ ID NO: 779388 - DNA, 22 bp, Artificial Sequence
  chemically synthesized
gtgcaaaagtaattgcgttttt

SEQ ID NO: 779389 - DNA, 22 bp, Artificial Sequence
  chemically synthesized
cttttaatggtaaaaaaaacgc

SEQ ID NO: 779390 - DNA, 22 bp, Artificial Sequence
  chemically synthesized
ccattgcttttaatggtaaaaa

SEQ ID NO: 779391 - DNA, 22 bp, Artificial Sequence
  chemically synthesized
gccattgcttttaatggtaaaa

SEQ ID NO: 779392 - DNA, 22 bp, Artificial Sequence
  chemically synthesized
tgccattgcttttaatggtaaa

SEQ ID NO: 779393 - DNA, 22 bp, Artificial Sequence
  chemically synthesized
cgttttttttaccattaaaagc

SEQ ID NO: 779394 - DNA, 22 bp, Artificial Sequence
  chemically synthesized
tggtctttgccattgcttttaa

SEQ ID NO: 779395 - DNA, 22 bp, Artificial Sequence
  chemically synthesized
tttttaccattaaaagcaatgg

SEQ ID NO: 779396 - DNA, 22 bp, Artificial Sequence
  chemically synthesized
ttttaccattaaaagcaatggc

SEQ ID NO: 779397 - DNA, 22 bp, Artificial Sequence
  chemically synthesized
tttaccattaaaagcaatggca

SEQ ID NO: 779398 - DNA, 22 bp, Artificial Sequence
  chemically synthesized
ttaccattaaaagcaatggcaa

SEQ ID NO: 779399 - DNA, 22 bp, Artificial Sequence
  chemically synthesized
taccattaaaagcaatggcaaa

SEQ ID NO: 779400 - DNA, 22 bp, Artificial Sequence
  chemically synthesized
accattaaaagcaatggcaaag

SEQ ID NO: 779401 - DNA, 22 bp, Artificial Sequence
  chemically synthesized
ccattaaaagcaatggcaaaga

SEQ ID NO: 779402 - DNA, 22 bp, Artificial Sequence
  chemically synthesized
aaagcaatggcaaagaccacaa

SEQ ID NO: 779403 - DNA, 22 bp, Artificial Sequence
  chemically synthesized
gtgcaaaagtaattgtggtctt

SEQ ID NO: 779404 - DNA, 22 bp, Artificial Sequence
  chemically synthesized
ggttggtgcaaaagtaattgtg

SEQ ID NO: 779405 - DNA, 22 bp, Artificial Sequence
  chemically synthesized
ttaggttggtgcaaaagtaatt

SEQ ID NO: 779406 - DNA, 22 bp, Artificial Sequence
  chemically synthesized
cagctgttaggttggtgcaaaa

SEQ ID NO: 779407 - DNA, 22 bp, Artificial Sequence
  chemically synthesized
acagctgttaggttggtgcaaa

SEQ ID NO: 779408 - DNA, 22 bp, Artificial Sequence
  chemically synthesized
cttttgcaccaacctaacagct

SEQ ID NO: 779409 - DNA, 22 bp, Artificial Sequence
  chemically synthesized
ttgcaccaacctaacagctgta

SEQ ID NO: 779410 - DNA, 22 bp, Artificial Sequence
  chemically synthesized
tgcaccaacctaacagctgtaa

SEQ ID NO: 779411 - DNA, 22 bp, Artificial Sequence
  chemically synthesized
gcaccaacctaacagctgtaag

SEQ ID NO: 779412 - DNA, 22 bp, Artificial Sequence
  chemically synthesized
caccaacctaacagctgtaagg

SEQ ID NO: 779413 - DNA, 22 bp, Artificial Sequence
  chemically synthesized
gacagagaacaaataatccctt

SEQ ID NO: 779414 - DNA, 22 bp, Artificial Sequence
  chemically synthesized
ggacagagaacaaataatccct

SEQ ID NO: 779415 - DNA, 22 bp, Artificial Sequence
  chemically synthesized
tggacagagaacaaataatccc

SEQ ID NO: 779416 - DNA, 22 bp, Artificial Sequence
  chemically synthesized
acagctgtaagggattatttgt

SEQ ID NO: 779417 - DNA, 22 bp, Artificial Sequence
  chemically synthesized
gttttggacagagaacaaataa

SEQ ID NO: 779418 - DNA, 22 bp, Artificial Sequence
  chemically synthesized
tggttttggacagagaacaaat

SEQ ID NO: 779419 - DNA, 22 bp, Artificial Sequence
  chemically synthesized
ctggttttggacagagaacaaa

SEQ ID NO: 779420 - DNA, 22 bp, Artificial Sequence
  chemically synthesized
tctggttttggacagagaacaa

SEQ ID NO: 779421 - DNA, 22 bp, Artificial Sequence
  chemically synthesized
taagggattatttgttctctgt

SEQ ID NO: 779422 - DNA, 22 bp, Artificial Sequence
  chemically synthesized
gtcagtctttctggttttggac

SEQ ID NO: 779423 - DNA, 22 bp, Artificial Sequence
  chemically synthesized
tttgttctctgtccaaaaccag

SEQ ID NO: 779424 - DNA, 22 bp, Artificial Sequence
  chemically synthesized
tagtcagtctttctggttttgg

SEQ ID NO: 779425 - DNA, 22 bp, Artificial Sequence
  chemically synthesized
ctagtcagtctttctggttttg

SEQ ID NO: 779426 - DNA, 22 bp, Artificial Sequence
  chemically synthesized
tctagtcagtctttctggtttt

SEQ ID NO: 779427 - DNA, 22 bp, Artificial Sequence
  chemically synthesized
gttctctgtccaaaaccagaaa

SEQ ID NO: 779428 - DNA, 22 bp, Artificial Sequence
  chemically synthesized
ttctctgtccaaaaccagaaag

SEQ ID NO: 779429 - DNA, 22 bp, Artificial Sequence
  chemically synthesized
tctgtccaaaaccagaaagact

SEQ ID NO: 779430 - DNA, 22 bp, Artificial Sequence
  chemically synthesized
tgtccaaaaccagaaagactga

SEQ ID NO: 779431 - DNA, 22 bp, Artificial Sequence
  chemically synthesized
tccaaaaccagaaagactgact

SEQ ID NO: 779432 - DNA, 22 bp, Artificial Sequence
  chemically synthesized
taaaagtctttctagtcagtct

SEQ ID NO: 779433 - DNA, 22 bp, Artificial Sequence
  chemically synthesized
aaatggcctgtaaaagtctttc

SEQ ID NO: 779434 - DNA, 22 bp, Artificial Sequence
  chemically synthesized
aaaatggcctgtaaaagtcttt

SEQ ID NO: 779435 - DNA, 22 bp, Artificial Sequence
  chemically synthesized
actagaaagacttttacaggcc

SEQ ID NO: 779436 - DNA, 22 bp, Artificial Sequence
  chemically synthesized
gaaagacttttacaggccattt

SEQ ID NO: 779437 - DNA, 22 bp, Artificial Sequence
  chemically synthesized
aaacaaacaaggacttaaaatg

SEQ ID NO: 779438 - DNA, 22 bp, Artificial Sequence
  chemically synthesized
aaaacaaacaaggacttaaaat

SEQ ID NO: 779439 - DNA, 22 bp, Artificial Sequence
  chemically synthesized
ttacaggccattttaagtcctt

SEQ ID NO: 779440 - DNA, 22 bp, Artificial Sequence
  chemically synthesized
tacaggccattttaagtccttg

SEQ ID NO: 779441 - DNA, 22 bp, Artificial Sequence
  chemically synthesized
acaggccattttaagtccttgt

SEQ ID NO: 779442 - DNA, 22 bp, Artificial Sequence
  chemically synthesized
caggccattttaagtccttgtt

SEQ ID NO: 779443 - DNA, 22 bp, Artificial Sequence
  chemically synthesized
tatgtacatatttaaaacaaac

SEQ ID NO: 779444 - DNA, 22 bp, Artificial Sequence
  chemically synthesized
atatgtacatatttaaaacaaa

SEQ ID NO: 779445 - DNA, 22 bp, Artificial Sequence
  chemically synthesized
tatatgtacatatttaaaacaa

SEQ ID NO: 779446 - DNA, 22 bp, Artificial Sequence
  chemically synthesized
taagtccttgtttgttttaaat

SEQ ID NO: 779447 - DNA, 22 bp, Artificial Sequence
  chemically synthesized
ttatatgtacatatttaaaaca

SEQ ID NO: 779448 - DNA, 22 bp, Artificial Sequence
  chemically synthesized
aagtccttgtttgttttaaata

SEQ ID NO: 779449 - DNA, 22 bp, Artificial Sequence
  chemically synthesized
agtccttgtttgttttaaatat

SEQ ID NO: 779450 - DNA, 22 bp, Artificial Sequence
  chemically synthesized
atttttatatgtacatatttaa

SEQ ID NO: 779451 - DNA, 22 bp, Artificial Sequence
  chemically synthesized
gtttgttttaaatatgtacata

SEQ ID NO: 779452 - DNA, 22 bp, Artificial Sequence
  chemically synthesized
tttgttttaaatatgtacatat

SEQ ID NO: 779453 - DNA, 22 bp, Artificial Sequence
  chemically synthesized
gttttaaatatgtacatataaa

SEQ ID NO: 779454 - DNA, 22 bp, Artificial Sequence
  chemically synthesized
ttttaaatatgtacatataaaa

SEQ ID NO: 779455 - DNA, 22 bp, Artificial Sequence
  chemically synthesized
taaatatgtacatataaaaatc

SEQ ID NO: 779456 - DNA, 22 bp, Artificial Sequence
  chemically synthesized
aaatatgtacatataaaaatca

SEQ ID NO: 779457 - DNA, 22 bp, Artificial Sequence
  chemically synthesized
aatatgtacatataaaaatcag

SEQ ID NO: 779458 - DNA, 22 bp, Artificial Sequence
  chemically synthesized
tatagacatagatactgatttt

SEQ ID NO: 779459 - DNA, 22 bp, Artificial Sequence
  chemically synthesized
atatagacatagatactgattt

SEQ ID NO: 779460 - DNA, 22 bp, Artificial Sequence
  chemically synthesized
aagtgcttatatagacatagat

SEQ ID NO: 779461 - DNA, 22 bp, Artificial Sequence
  chemically synthesized
acacactgaagtgcttatatag

SEQ ID NO: 779462 - DNA, 22 bp, Artificial Sequence
  chemically synthesized
ttaacacactgaagtgcttata

SEQ ID NO: 779463 - DNA, 22 bp, Artificial Sequence
  chemically synthesized
tgtctatataagcacttcagtg

SEQ ID NO: 779464 - DNA, 22 bp, Artificial Sequence
  chemically synthesized
tatgattgttaacacactgaag

SEQ ID NO: 779465 - DNA, 22 bp, Artificial Sequence
  chemically synthesized
tataagcacttcagtgtgttaa

SEQ ID NO: 779466 - DNA, 22 bp, Artificial Sequence
  chemically synthesized
atgggcgtgattatatgattgt

SEQ ID NO: 779467 - DNA, 22 bp, Artificial Sequence
  chemically synthesized
cagtgtgttaacaatcatataa

SEQ ID NO: 779468 - DNA, 22 bp, Artificial Sequence
  chemically synthesized
tcatgggcgtgattatatgatt

SEQ ID NO: 779469 - DNA, 22 bp, Artificial Sequence
  chemically synthesized
agtgtgttaacaatcatataat

SEQ ID NO: 779470 - DNA, 22 bp, Artificial Sequence
  chemically synthesized
acaatcatataatcacgcccat

SEQ ID NO: 779471 - DNA, 22 bp, Artificial Sequence
  chemically synthesized
catgatactctcatgggcgtga

SEQ ID NO: 779472 - DNA, 22 bp, Artificial Sequence
  chemically synthesized
aacataatggtaatgatggtgc

SEQ ID NO: 779473 - DNA, 22 bp, Artificial Sequence
  chemically synthesized
caacataatggtaatgatggtg

SEQ ID NO: 779474 - DNA, 22 bp, Artificial Sequence
  chemically synthesized
tcaacataatggtaatgatggt

SEQ ID NO: 779475 - DNA, 22 bp, Artificial Sequence
  chemically synthesized
ttcaacataatggtaatgatgg

SEQ ID NO: 779476 - DNA, 22 bp, Artificial Sequence
  chemically synthesized
acattgcaccatcattaccatt

SEQ ID NO: 779477 - DNA, 22 bp, Artificial Sequence
  chemically synthesized
accttttcaacataatggtaat

SEQ ID NO: 779478 - DNA, 22 bp, Artificial Sequence
  chemically synthesized
ctcaccttttcaacataatggt

SEQ ID NO: 779479 - DNA, 22 bp, Artificial Sequence
  chemically synthesized
caccatcattaccattatgttg

SEQ ID NO: 779480 - DNA, 22 bp, Artificial Sequence
  chemically synthesized
ttgctcaccttttcaacataat

SEQ ID NO: 779481 - DNA, 22 bp, Artificial Sequence
  chemically synthesized
ccattatgttgaaaaggtgagc

SEQ ID NO: 779482 - DNA, 22 bp, Artificial Sequence
  chemically synthesized
aagagtagctattgctcacctt

SEQ ID NO: 779483 - DNA, 22 bp, Artificial Sequence
  chemically synthesized
aaagagtagctattgctcacct

SEQ ID NO: 779484 - DNA, 22 bp, Artificial Sequence
  chemically synthesized
tgttgaaaaggtgagcaatagc

SEQ ID NO: 779485 - DNA, 22 bp, Artificial Sequence
  chemically synthesized
aaaaggtgagcaatagctactc

SEQ ID NO: 779486 - DNA, 22 bp, Artificial Sequence
  chemically synthesized
agtagatttaaagagtagctat

SEQ ID NO: 779487 - DNA, 22 bp, Artificial Sequence
  chemically synthesized
taagtagatttaaagagtagct

SEQ ID NO: 779488 - DNA, 22 bp, Artificial Sequence
  chemically synthesized
ctaagtagatttaaagagtagc

SEQ ID NO: 779489 - DNA, 22 bp, Artificial Sequence
  chemically synthesized
tatgatttctaagtagatttaa

SEQ ID NO: 779490 - DNA, 22 bp, Artificial Sequence
  chemically synthesized
ctctttaaatctacttagaaat

SEQ ID NO: 779491 - DNA, 22 bp, Artificial Sequence
  chemically synthesized
tttaaatctacttagaaatcat

SEQ ID NO: 779492 - DNA, 22 bp, Artificial Sequence
  chemically synthesized
taaatctacttagaaatcatac

SEQ ID NO: 779493 - DNA, 22 bp, Artificial Sequence
  chemically synthesized
ccacacaatcctgtatgatttc

SEQ ID NO: 779494 - DNA, 22 bp, Artificial Sequence
  chemically synthesized
aaatctacttagaaatcataca

SEQ ID NO: 779495 - DNA, 22 bp, Artificial Sequence
  chemically synthesized
accacacaatcctgtatgattt

SEQ ID NO: 779496 - DNA, 22 bp, Artificial Sequence
  chemically synthesized
aatctacttagaaatcatacag

SEQ ID NO: 779497 - DNA, 22 bp, Artificial Sequence
  chemically synthesized
cttagaaatcatacaggattgt

SEQ ID NO: 779498 - DNA, 22 bp, Artificial Sequence
  chemically synthesized
agaaatcatacaggattgtgtg

SEQ ID NO: 779499 - DNA, 22 bp, Artificial Sequence
  chemically synthesized
gaaatcatacaggattgtgtgg

SEQ ID NO: 779500 - DNA, 22 bp, Artificial Sequence
  chemically synthesized
atacacagaatttaccacacaa

SEQ ID NO: 779501 - DNA, 22 bp, Artificial Sequence
  chemically synthesized
tgttaatacacagaatttacca

SEQ ID NO: 779502 - DNA, 22 bp, Artificial Sequence
  chemically synthesized
atgttaatacacagaatttacc

SEQ ID NO: 779503 - DNA, 22 bp, Artificial Sequence
  chemically synthesized
tatgttaatacacagaatttac

SEQ ID NO: 779504 - DNA, 22 bp, Artificial Sequence
  chemically synthesized
actttatgttaatacacagaat

SEQ ID NO: 779505 - DNA, 22 bp, Artificial Sequence
  chemically synthesized
tgtggtaaattctgtgtattaa

SEQ ID NO: 779506 - DNA, 22 bp, Artificial Sequence
  chemically synthesized
aaatctgactttatgttaatac

SEQ ID NO: 779507 - DNA, 22 bp, Artificial Sequence
  chemically synthesized
gaaatctgactttatgttaata

SEQ ID NO: 779508 - DNA, 22 bp, Artificial Sequence
  chemically synthesized
agatttgaaatctgactttatg

SEQ ID NO: 779509 - DNA, 22 bp, Artificial Sequence
  chemically synthesized
aagatttgaaatctgactttat

SEQ ID NO: 779510 - DNA, 22 bp, Artificial Sequence
  chemically synthesized
tgtgtattaacataaagtcaga

SEQ ID NO: 779511 - DNA, 22 bp, Artificial Sequence
  chemically synthesized
taagatttgaaatctgacttta

SEQ ID NO: 779512 - DNA, 22 bp, Artificial Sequence
  chemically synthesized
tgtattaacataaagtcagatt

SEQ ID NO: 779513 - DNA, 22 bp, Artificial Sequence
  chemically synthesized
caagcctttaagatttgaaatc

SEQ ID NO: 779514 - DNA, 22 bp, Artificial Sequence
  chemically synthesized
acataaagtcagatttcaaatc

SEQ ID NO: 779515 - DNA, 22 bp, Artificial Sequence
  chemically synthesized
tacaagcctttaagatttgaaa

SEQ ID NO: 779516 - DNA, 22 bp, Artificial Sequence
  chemically synthesized
ttctacaagcctttaagatttg

SEQ ID NO: 779517 - DNA, 22 bp, Artificial Sequence
  chemically synthesized
tgaaaatgttattctacaagcc

SEQ ID NO: 779518 - DNA, 22 bp, Artificial Sequence
  chemically synthesized
caaatcttaaaggcttgtagaa

SEQ ID NO: 779519 - DNA, 22 bp, Artificial Sequence
  chemically synthesized
aaatcttaaaggcttgtagaat

SEQ ID NO: 779520 - DNA, 22 bp, Artificial Sequence
  chemically synthesized
aaaggcttgtagaataacattt

SEQ ID NO: 779521 - DNA, 22 bp, Artificial Sequence
  chemically synthesized
aaggcttgtagaataacatttt

SEQ ID NO: 779522 - DNA, 22 bp, Artificial Sequence
  chemically synthesized
accatatggctgtgaaaatgtt

SEQ ID NO: 779523 - DNA, 22 bp, Artificial Sequence
  chemically synthesized
ttaaccatatggctgtgaaaat

SEQ ID NO: 779524 - DNA, 22 bp, Artificial Sequence
  chemically synthesized
gtagaataacattttcacagcc

SEQ ID NO: 779525 - DNA, 22 bp, Artificial Sequence
  chemically synthesized
tagaataacattttcacagcca

SEQ ID NO: 779526 - DNA, 22 bp, Artificial Sequence
  chemically synthesized
caactattaaccatatggctgt

SEQ ID NO: 779527 - DNA, 22 bp, Artificial Sequence
  chemically synthesized
acaactattaaccatatggctg

SEQ ID NO: 779528 - DNA, 22 bp, Artificial Sequence
  chemically synthesized
tacaactattaaccatatggct

SEQ ID NO: 779529 - DNA, 22 bp, Artificial Sequence
  chemically synthesized
tttacaactattaaccatatgg

SEQ ID NO: 779530 - DNA, 22 bp, Artificial Sequence
  chemically synthesized
ctttacaactattaaccatatg

SEQ ID NO: 779531 - DNA, 22 bp, Artificial Sequence
  chemically synthesized
tctttacaactattaaccatat

SEQ ID NO: 779532 - DNA, 22 bp, Artificial Sequence
  chemically synthesized
ttctttacaactattaaccata

SEQ ID NO: 779533 - DNA, 22 bp, Artificial Sequence
  chemically synthesized
tcacagccatatggttaatagt

SEQ ID NO: 779534 - DNA, 22 bp, Artificial Sequence
  chemically synthesized
cacagccatatggttaatagtt

SEQ ID NO: 779535 - DNA, 22 bp, Artificial Sequence
  chemically synthesized
tcttttctttacaactattaac

SEQ ID NO: 779536 - DNA, 22 bp, Artificial Sequence
  chemically synthesized
acagccatatggttaatagttg

SEQ ID NO: 779537 - DNA, 22 bp, Artificial Sequence
  chemically synthesized
atagttgtaaagaaaagacaat

SEQ ID NO: 779538 - DNA, 22 bp, Artificial Sequence
  chemically synthesized
agcagtaaaaaaacattgtctt

SEQ ID NO: 779539 - DNA, 22 bp, Artificial Sequence
  chemically synthesized
tcagcagtaaaaaaacattgtc

SEQ ID NO: 779540 - DNA, 22 bp, Artificial Sequence
  chemically synthesized
ctcagcagtaaaaaaacattgt

SEQ ID NO: 779541 - DNA, 22 bp, Artificial Sequence
  chemically synthesized
taaagaaaagacaatgtttttt

SEQ ID NO: 779542 - DNA, 22 bp, Artificial Sequence
  chemically synthesized
tagtcaaatttctcagcagtaa

SEQ ID NO: 779543 - DNA, 22 bp, Artificial Sequence
  chemically synthesized
tgtagtcaaatttctcagcagt

SEQ ID NO: 779544 - DNA, 22 bp, Artificial Sequence
  chemically synthesized
ttttactgctgagaaatttgac

SEQ ID NO: 779545 - DNA, 22 bp, Artificial Sequence
  chemically synthesized
tttactgctgagaaatttgact

SEQ ID NO: 779546 - DNA, 22 bp, Artificial Sequence
  chemically synthesized
agagtcctctgtagtcaaattt

SEQ ID NO: 779547 - DNA, 22 bp, Artificial Sequence
  chemically synthesized
ttactgctgagaaatttgacta

SEQ ID NO: 779548 - DNA, 22 bp, Artificial Sequence
  chemically synthesized
aagagtcctctgtagtcaaatt

SEQ ID NO: 779549 - DNA, 22 bp, Artificial Sequence
  chemically synthesized
tactgctgagaaatttgactac

SEQ ID NO: 779550 - DNA, 22 bp, Artificial Sequence
  chemically synthesized
actgctgagaaatttgactaca

SEQ ID NO: 779551 - DNA, 22 bp, Artificial Sequence
  chemically synthesized
ctgctgagaaatttgactacag

SEQ ID NO: 779552 - DNA, 22 bp, Artificial Sequence
  chemically synthesized
ctgagaaatttgactacagagg

SEQ ID NO: 779553 - DNA, 22 bp, Artificial Sequence
  chemically synthesized
agaaatttgactacagaggact

SEQ ID NO: 779554 - DNA, 22 bp, Artificial Sequence
  chemically synthesized
gactacagaggactcttaagta

SEQ ID NO: 779555 - DNA, 22 bp, Artificial Sequence
  chemically synthesized
aatgaaggacaatacttaagag

SEQ ID NO: 779556 - DNA, 22 bp, Artificial Sequence
  chemically synthesized
actacagaggactcttaagtat

SEQ ID NO: 779557 - DNA, 22 bp, Artificial Sequence
  chemically synthesized
taaatgaaggacaatacttaag

SEQ ID NO: 779558 - DNA, 22 bp, Artificial Sequence
  chemically synthesized
cagaggactcttaagtattgtc

SEQ ID NO: 779559 - DNA, 22 bp, Artificial Sequence
  chemically synthesized
agattctaaatgaaggacaata

SEQ ID NO: 779560 - DNA, 22 bp, Artificial Sequence
  chemically synthesized
aagattctaaatgaaggacaat

SEQ ID NO: 779561 - DNA, 22 bp, Artificial Sequence
  chemically synthesized
tttaagattctaaatgaaggac

SEQ ID NO: 779562 - DNA, 22 bp, Artificial Sequence
  chemically synthesized
ttaagtattgtccttcatttag

SEQ ID NO: 779563 - DNA, 22 bp, Artificial Sequence
  chemically synthesized
aagtattgtccttcatttagaa

SEQ ID NO: 779564 - DNA, 22 bp, Artificial Sequence
  chemically synthesized
agtattgtccttcatttagaat

SEQ ID NO: 779565 - DNA, 22 bp, Artificial Sequence
  chemically synthesized
tccttcatttagaatcttaaac

SEQ ID NO: 779566 - DNA, 22 bp, Artificial Sequence
  chemically synthesized
catttagaatcttaaacaatat

SEQ ID NO: 779567 - DNA, 22 bp, Artificial Sequence
  chemically synthesized
atttagaatcttaaacaatatc

SEQ ID NO: 779568 - DNA, 22 bp, Artificial Sequence
  chemically synthesized
agaatcttaaacaatatcatta

SEQ ID NO: 779569 - DNA, 22 bp, Artificial Sequence
  chemically synthesized
gaatcttaaacaatatcattac

SEQ ID NO: 779570 - DNA, 22 bp, Artificial Sequence
  chemically synthesized
aaaatcaaaaggacatatgtaa

SEQ ID NO: 779571 - DNA, 22 bp, Artificial Sequence
  chemically synthesized
aaacaatatcattacatatgtc

SEQ ID NO: 779572 - DNA, 22 bp, Artificial Sequence
  chemically synthesized
aacaatatcattacatatgtcc

SEQ ID NO: 779573 - DNA, 22 bp, Artificial Sequence
  chemically synthesized
attgaaaatcaaaaggacatat

SEQ ID NO: 779574 - DNA, 22 bp, Artificial Sequence
  chemically synthesized
catatgtccttttgattttcaa

SEQ ID NO: 779575 - DNA, 22 bp, Artificial Sequence
  chemically synthesized
tgtaaatatgtattcattgaaa

SEQ ID NO: 779576 - DNA, 22 bp, Artificial Sequence
  chemically synthesized
atgtaaatatgtattcattgaa

SEQ ID NO: 779577 - DNA, 22 bp, Artificial Sequence
  chemically synthesized
tatgtaaatatgtattcattga

SEQ ID NO: 779578 - DNA, 22 bp, Artificial Sequence
  chemically synthesized
ttgattttcaatgaatacatat

SEQ ID NO: 779579 - DNA, 22 bp, Artificial Sequence
  chemically synthesized
cattttatgtaaatatgtattc

SEQ ID NO: 779580 - DNA, 22 bp, Artificial Sequence
  chemically synthesized
tgattttcaatgaatacatatt

SEQ ID NO: 779581 - DNA, 22 bp, Artificial Sequence
  chemically synthesized
gattttcaatgaatacatattt

SEQ ID NO: 779582 - DNA, 22 bp, Artificial Sequence
  chemically synthesized
attttcaatgaatacatattta

SEQ ID NO: 779583 - DNA, 22 bp, Artificial Sequence
  chemically synthesized
tcaatgaatacatatttacata

SEQ ID NO: 779584 - DNA, 22 bp, Artificial Sequence
  chemically synthesized
caatgaatacatatttacataa

SEQ ID NO: 779585 - DNA, 22 bp, Artificial Sequence
  chemically synthesized
aatgaatacatatttacataaa

SEQ ID NO: 779586 - DNA, 22 bp, Artificial Sequence
  chemically synthesized
acataaaatgtagtcatttctc

SEQ ID NO: 779587 - DNA, 22 bp, Artificial Sequence
  chemically synthesized
cataaaatgtagtcatttctcc

SEQ ID NO: 779588 - DNA, 22 bp, Artificial Sequence
  chemically synthesized
aacaatgaagaagtgggagaaa

SEQ ID NO: 779589 - DNA, 22 bp, Artificial Sequence
  chemically synthesized
caacaatgaagaagtgggagaa

SEQ ID NO: 779590 - DNA, 22 bp, Artificial Sequence
  chemically synthesized
gcgaaggcaatttcaacaatga

SEQ ID NO: 779591 - DNA, 22 bp, Artificial Sequence
  chemically synthesized
ctcccacttcttcattgttgaa

SEQ ID NO: 779592 - DNA, 22 bp, Artificial Sequence
  chemically synthesized
tcccacttcttcattgttgaaa

SEQ ID NO: 779593 - DNA, 22 bp, Artificial Sequence
  chemically synthesized
ttggcgaaggcaatttcaacaa

SEQ ID NO: 779594 - DNA, 22 bp, Artificial Sequence
  chemically synthesized
ccacttcttcattgttgaaatt

SEQ ID NO: 779595 - DNA, 22 bp, Artificial Sequence
  chemically synthesized
cttcattgttgaaattgccttc

SEQ ID NO: 779596 - DNA, 22 bp, Artificial Sequence
  chemically synthesized
ttcattgttgaaattgccttcg

SEQ ID NO: 779597 - DNA, 22 bp, Artificial Sequence
  chemically synthesized
catagctgttggcgaaggcaat

SEQ ID NO: 779598 - DNA, 22 bp, Artificial Sequence
  chemically synthesized
cattgttgaaattgccttcgcc

SEQ ID NO: 779599 - DNA, 22 bp, Artificial Sequence
  chemically synthesized
attgttgaaattgccttcgcca

SEQ ID NO: 779600 - DNA, 22 bp, Artificial Sequence
  chemically synthesized
acactgcatagctgttggcgaa

SEQ ID NO: 779601 - DNA, 22 bp, Artificial Sequence
  chemically synthesized
ttgaaattgccttcgccaacag

SEQ ID NO: 779602 - DNA, 22 bp, Artificial Sequence
  chemically synthesized
gacactgcatagctgttggcga

SEQ ID NO: 779603 - DNA, 22 bp, Artificial Sequence
  chemically synthesized
aaattgccttcgccaacagcta

SEQ ID NO: 779604 - DNA, 22 bp, Artificial Sequence
  chemically synthesized
ccttcgccaacagctatgcagt

SEQ ID NO: 779605 - DNA, 22 bp, Artificial Sequence
  chemically synthesized
atcccatcttgacactgcatag

SEQ ID NO: 779606 - DNA, 22 bp, Artificial Sequence
  chemically synthesized
tgatcccatcttgacactgcat

SEQ ID NO: 779607 - DNA, 22 bp, Artificial Sequence
  chemically synthesized
cgccaacagctatgcagtgtca

SEQ ID NO: 779608 - DNA, 22 bp, Artificial Sequence
  chemically synthesized
gccaacagctatgcagtgtcaa

SEQ ID NO: 779609 - DNA, 22 bp, Artificial Sequence
  chemically synthesized
ccacacattctgatcccatctt

SEQ ID NO: 779610 - DNA, 22 bp, Artificial Sequence
  chemically synthesized
tgcagtgtcaagatgggatcag

SEQ ID NO: 779611 - DNA, 22 bp, Artificial Sequence
  chemically synthesized
ctcccacacattctgatcccat

SEQ ID NO: 779612 - DNA, 22 bp, Artificial Sequence
  chemically synthesized
aaaaaaatatctgctcccacac

SEQ ID NO: 779613 - DNA, 22 bp, Artificial Sequence
  chemically synthesized
acagtgcatatgtcagcaaagc

SEQ ID NO: 779614 - DNA, 22 bp, Artificial Sequence
  chemically synthesized
ttttcagtcatgctttgctgac

SEQ ID NO: 779615 - DNA, 22 bp, Artificial Sequence
  chemically synthesized
tttcagtcatgctttgctgaca

SEQ ID NO: 779616 - DNA, 22 bp, Artificial Sequence
  chemically synthesized
ttcagtcatgctttgctgacat

SEQ ID NO: 779617 - DNA, 22 bp, Artificial Sequence
  chemically synthesized
tcagtcatgctttgctgacata

SEQ ID NO: 779618 - DNA, 22 bp, Artificial Sequence
  chemically synthesized
gttaacagtgcatatgtcagca

SEQ ID NO: 779619 - DNA, 22 bp, Artificial Sequence
  chemically synthesized
cagtcatgctttgctgacatat

SEQ ID NO: 779620 - DNA, 22 bp, Artificial Sequence
  chemically synthesized
agtcatgctttgctgacatatg

SEQ ID NO: 779621 - DNA, 22 bp, Artificial Sequence
  chemically synthesized
agtggtaattcgttaacagtgc

SEQ ID NO: 779622 - DNA, 22 bp, Artificial Sequence
  chemically synthesized
tgctgacatatgcactgttaac

SEQ ID NO: 779623 - DNA, 22 bp, Artificial Sequence
  chemically synthesized
cagtggtaattcgttaacagtg

SEQ ID NO: 779624 - DNA, 22 bp, Artificial Sequence
  chemically synthesized
gctgacatatgcactgttaacg

SEQ ID NO: 779625 - DNA, 22 bp, Artificial Sequence
  chemically synthesized
ctgacatatgcactgttaacga

SEQ ID NO: 779626 - DNA, 22 bp, Artificial Sequence
  chemically synthesized
tttcagtggtaattcgttaaca

SEQ ID NO: 779627 - DNA, 22 bp, Artificial Sequence
  chemically synthesized
acatatgcactgttaacgaatt

SEQ ID NO: 779628 - DNA, 22 bp, Artificial Sequence
  chemically synthesized
gacacatatattgtttcagtgg

SEQ ID NO: 779629 - DNA, 22 bp, Artificial Sequence
  chemically synthesized
ttaacgaattaccactgaaaca

SEQ ID NO: 779630 - DNA, 22 bp, Artificial Sequence
  chemically synthesized
agacacatatattgtttcagtg

SEQ ID NO: 779631 - DNA, 22 bp, Artificial Sequence
  chemically synthesized
ttagacacatatattgtttcag

SEQ ID NO: 779632 - DNA, 22 bp, Artificial Sequence
  chemically synthesized
acgaattaccactgaaacaata

SEQ ID NO: 779633 - DNA, 22 bp, Artificial Sequence
  chemically synthesized
cttagacacatatattgtttca

SEQ ID NO: 779634 - DNA, 22 bp, Artificial Sequence
  chemically synthesized
catgtttcttagacacatatat

SEQ ID NO: 779635 - DNA, 22 bp, Artificial Sequence
  chemically synthesized
ccactgaaacaatatatgtgtc

SEQ ID NO: 779636 - DNA, 22 bp, Artificial Sequence
  chemically synthesized
tacatgtttcttagacacatat

SEQ ID NO: 779637 - DNA, 22 bp, Artificial Sequence
  chemically synthesized
ctacatgtttcttagacacata

SEQ ID NO: 779638 - DNA, 22 bp, Artificial Sequence
  chemically synthesized
ttctacatgtttcttagacaca

SEQ ID NO: 779639 - DNA, 22 bp, Artificial Sequence
  chemically synthesized
aaacaatatatgtgtctaagaa

SEQ ID NO: 779640 - DNA, 22 bp, Artificial Sequence
  chemically synthesized
acagccagctcttctacatgtt

SEQ ID NO: 779641 - DNA, 22 bp, Artificial Sequence
  chemically synthesized
agaaacatgtagaagagctggc

SEQ ID NO: 779642 - DNA, 22 bp, Artificial Sequence
  chemically synthesized
gcatagataagaattaacagcc

SEQ ID NO: 779643 - DNA, 22 bp, Artificial Sequence
  chemically synthesized
tcgcatagataagaattaacag

SEQ ID NO: 779644 - DNA, 22 bp, Artificial Sequence
  chemically synthesized
ctcgcatagataagaattaaca

SEQ ID NO: 779645 - DNA, 22 bp, Artificial Sequence
  chemically synthesized
ttctcgcatagataagaattaa

SEQ ID NO: 779646 - DNA, 22 bp, Artificial Sequence
  chemically synthesized
cttctcgcatagataagaatta

SEQ ID NO: 779647 - DNA, 22 bp, Artificial Sequence
  chemically synthesized
ttcttctcgcatagataagaat

SEQ ID NO: 779648 - DNA, 22 bp, Artificial Sequence
  chemically synthesized
tcttcttctcgcatagataaga

SEQ ID NO: 779649 - DNA, 22 bp, Artificial Sequence
  chemically synthesized
gctgttaattcttatctatgcg

SEQ ID NO: 779650 - DNA, 22 bp, Artificial Sequence
  chemically synthesized
atattctcttcttctcgcatag

SEQ ID NO: 779651 - DNA, 22 bp, Artificial Sequence
  chemically synthesized
ttaattcttatctatgcgagaa

SEQ ID NO: 779652 - DNA, 22 bp, Artificial Sequence
  chemically synthesized
tcatattctcttcttctcgcat

SEQ ID NO: 779653 - DNA, 22 bp, Artificial Sequence
  chemically synthesized
attcttatctatgcgagaagaa

SEQ ID NO: 779654 - DNA, 22 bp, Artificial Sequence
  chemically synthesized
ctctcatattctcttcttctcg

SEQ ID NO: 779655 - DNA, 22 bp, Artificial Sequence
  chemically synthesized
actctcatattctcttcttctc

SEQ ID NO: 779656 - DNA, 22 bp, Artificial Sequence
  chemically synthesized
ttatctatgcgagaagaagaga

SEQ ID NO: 779657 - DNA, 22 bp, Artificial Sequence
  chemically synthesized
ttactctcatattctcttcttc

SEQ ID NO: 779658 - DNA, 22 bp, Artificial Sequence
  chemically synthesized
cttactctcatattctcttctt

SEQ ID NO: 779659 - DNA, 22 bp, Artificial Sequence
  chemically synthesized
atctatgcgagaagaagagaat

SEQ ID NO: 779660 - DNA, 22 bp, Artificial Sequence
  chemically synthesized
tctatgcgagaagaagagaata

SEQ ID NO: 779661 - DNA, 22 bp, Artificial Sequence
  chemically synthesized
ttcttactctcatattctcttc

SEQ ID NO: 779662 - DNA, 22 bp, Artificial Sequence
  chemically synthesized
tgcgagaagaagagaatatgag

SEQ ID NO: 779663 - DNA, 22 bp, Artificial Sequence
  chemically synthesized
aacaaaccaagttcttcttact

SEQ ID NO: 779664 - DNA, 22 bp, Artificial Sequence
  chemically synthesized
agtctcaacaaaccaagttctt

SEQ ID NO: 779665 - DNA, 22 bp, Artificial Sequence
  chemically synthesized
gccaaagttgagtctcaacaaa

SEQ ID NO: 779666 - DNA, 22 bp, Artificial Sequence
  chemically synthesized
agccaaagttgagtctcaacaa

SEQ ID NO: 779667 - DNA, 22 bp, Artificial Sequence
  chemically synthesized
caatttagccaaagttgagtct

SEQ ID NO: 779668 - DNA, 22 bp, Artificial Sequence
  chemically synthesized
ggtttgttgagactcaactttg

SEQ ID NO: 779669 - DNA, 22 bp, Artificial Sequence
  chemically synthesized
gtttgttgagactcaactttgg

SEQ ID NO: 779670 - DNA, 22 bp, Artificial Sequence
  chemically synthesized
atgattccaatttagccaaagt

SEQ ID NO: 779671 - DNA, 22 bp, Artificial Sequence
  chemically synthesized
gttgagactcaactttggctaa

SEQ ID NO: 779672 - DNA, 22 bp, Artificial Sequence
  chemically synthesized
aatgattccaatttagccaaag

SEQ ID NO: 779673 - DNA, 22 bp, Artificial Sequence
  chemically synthesized
ttgagactcaactttggctaaa

SEQ ID NO: 779674 - DNA, 22 bp, Artificial Sequence
  chemically synthesized
taatgattccaatttagccaaa

SEQ ID NO: 779675 - DNA, 22 bp, Artificial Sequence
  chemically synthesized
agactcaactttggctaaattg

SEQ ID NO: 779676 - DNA, 22 bp, Artificial Sequence
  chemically synthesized
atctttaatgattccaatttag

SEQ ID NO: 779677 - DNA, 22 bp, Artificial Sequence
  chemically synthesized
aatctttaatgattccaattta

SEQ ID NO: 779678 - DNA, 22 bp, Artificial Sequence
  chemically synthesized
taatctttaatgattccaattt

SEQ ID NO: 779679 - DNA, 22 bp, Artificial Sequence
  chemically synthesized
ttaatctttaatgattccaatt

SEQ ID NO: 779680 - DNA, 22 bp, Artificial Sequence
  chemically synthesized
aactttggctaaattggaatca

SEQ ID NO: 779681 - DNA, 22 bp, Artificial Sequence
  chemically synthesized
tttttaatctttaatgattcca

SEQ ID NO: 779682 - DNA, 22 bp, Artificial Sequence
  chemically synthesized
tggctaaattggaatcattaaa

SEQ ID NO: 779683 - DNA, 22 bp, Artificial Sequence
  chemically synthesized
ggctaaattggaatcattaaag

SEQ ID NO: 779684 - DNA, 22 bp, Artificial Sequence
  chemically synthesized
gctaaattggaatcattaaaga

SEQ ID NO: 779685 - DNA, 22 bp, Artificial Sequence
  chemically synthesized
aattggaatcattaaagattaa

SEQ ID NO: 779686 - DNA, 22 bp, Artificial Sequence
  chemically synthesized
gaatcattaaagattaaaaaca

SEQ ID NO: 779687 - DNA, 22 bp, Artificial Sequence
  chemically synthesized
tggggaacccagatatcattgt

SEQ ID NO: 779688 - DNA, 22 bp, Artificial Sequence
  chemically synthesized
gtggggaacccagatatcattg

SEQ ID NO: 779689 - DNA, 22 bp, Artificial Sequence
  chemically synthesized
aagattaaaaacaatgatatct

SEQ ID NO: 779690 - DNA, 22 bp, Artificial Sequence
  chemically synthesized
tgtggggaacccagatatcatt

SEQ ID NO: 779691 - DNA, 22 bp, Artificial Sequence
  chemically synthesized
ttgtggggaacccagatatcat

SEQ ID NO: 779692 - DNA, 22 bp, Artificial Sequence
  chemically synthesized
aaaacaatgatatctgggttcc

SEQ ID NO: 779693 - DNA, 22 bp, Artificial Sequence
  chemically synthesized
ggttccccacaaaagtctgata

SEQ ID NO: 779694 - DNA, 22 bp, Artificial Sequence
  chemically synthesized
taccccaagccaatgatatcag

SEQ ID NO: 779695 - DNA, 22 bp, Artificial Sequence
  chemically synthesized
cccacaaaagtctgatatcatt

SEQ ID NO: 779696 - DNA, 22 bp, Artificial Sequence
  chemically synthesized
atatcattggcttggggtacag

SEQ ID NO: 779697 - DNA, 22 bp, Artificial Sequence
  chemically synthesized
aaaaaatgccccagctgtaccc

SEQ ID NO: 779698 - DNA, 22 bp, Artificial Sequence
  chemically synthesized
aaaaaaatgccccagctgtacc

SEQ ID NO: 779699 - DNA, 22 bp, Artificial Sequence
  chemically synthesized
gcttggggtacagctggggcat

SEQ ID NO: 779700 - DNA, 22 bp, Artificial Sequence
  chemically synthesized
gaagcttaaaaaaatgccccag

SEQ ID NO: 779701 - DNA, 22 bp, Artificial Sequence
  chemically synthesized
ggaagcttaaaaaaatgcccca

SEQ ID NO: 779702 - DNA, 22 bp, Artificial Sequence
  chemically synthesized
ggggtacagctggggcattttt

SEQ ID NO: 779703 - DNA, 22 bp, Artificial Sequence
  chemically synthesized
gggtacagctggggcatttttt

SEQ ID NO: 779704 - DNA, 22 bp, Artificial Sequence
  chemically synthesized
gcatcatcttggaagcttaaaa

SEQ ID NO: 779705 - DNA, 22 bp, Artificial Sequence
  chemically synthesized
gggcatttttttaagcttccaa

SEQ ID NO: 779706 - DNA, 22 bp, Artificial Sequence
  chemically synthesized
atgatcattagcatcatcttgg

SEQ ID NO: 779707 - DNA, 22 bp, Artificial Sequence
  chemically synthesized
ttttaagcttccaagatgatgc

SEQ ID NO: 779708 - DNA, 22 bp, Artificial Sequence
  chemically synthesized
tttaagcttccaagatgatgct

SEQ ID NO: 779709 - DNA, 22 bp, Artificial Sequence
  chemically synthesized
ttaagcttccaagatgatgcta

SEQ ID NO: 779710 - DNA, 22 bp, Artificial Sequence
  chemically synthesized
taagcttccaagatgatgctaa

SEQ ID NO: 779711 - DNA, 22 bp, Artificial Sequence
  chemically synthesized
aagcttccaagatgatgctaat

SEQ ID NO: 779712 - DNA, 22 bp, Artificial Sequence
  chemically synthesized
agcttccaagatgatgctaatg

SEQ ID NO: 779713 - DNA, 22 bp, Artificial Sequence
  chemically synthesized
ccaagatgatgctaatgatcat

SEQ ID NO: 779714 - DNA, 22 bp, Artificial Sequence
  chemically synthesized
caagatgatgctaatgatcatt

SEQ ID NO: 779715 - DNA, 22 bp, Artificial Sequence
  chemically synthesized
taaggaaatgacgctaatgatc

SEQ ID NO: 779716 - DNA, 22 bp, Artificial Sequence
  chemically synthesized
atgatcattagcgtcatttcct

SEQ ID NO: 779717 - DNA, 22 bp, Artificial Sequence
  chemically synthesized
gaggtgacctataaggaaatga

SEQ ID NO: 779718 - DNA, 22 bp, Artificial Sequence
  chemically synthesized
ggttagaggtgacctataagga

SEQ ID NO: 779719 - DNA, 22 bp, Artificial Sequence
  chemically synthesized
gcgtcatttccttataggtcac

SEQ ID NO: 779720 - DNA, 22 bp, Artificial Sequence
  chemically synthesized
tgaagtggttaggttagaggtg

SEQ ID NO: 779721 - DNA, 22 bp, Artificial Sequence
  chemically synthesized
ccttataggtcacctctaacct

SEQ ID NO: 779722 - DNA, 22 bp, Artificial Sequence
  chemically synthesized
cttataggtcacctctaaccta

SEQ ID NO: 779723 - DNA, 22 bp, Artificial Sequence
  chemically synthesized
ctgtgaagtggttaggttagag

SEQ ID NO: 779724 - DNA, 22 bp, Artificial Sequence
  chemically synthesized
ataggtcacctctaacctaacc

SEQ ID NO: 779725 - DNA, 22 bp, Artificial Sequence
  chemically synthesized
taggtcacctctaacctaacca

SEQ ID NO: 779726 - DNA, 22 bp, Artificial Sequence
  chemically synthesized
actactgtgaagtggttaggtt

SEQ ID NO: 779727 - DNA, 22 bp, Artificial Sequence
  chemically synthesized
aactactgtgaagtggttaggt

SEQ ID NO: 779728 - DNA, 22 bp, Artificial Sequence
  chemically synthesized
taacctaaccacttcacagtag

SEQ ID NO: 779729 - DNA, 22 bp, Artificial Sequence
  chemically synthesized
acctaaccacttcacagtagtt

SEQ ID NO: 779730 - DNA, 22 bp, Artificial Sequence
  chemically synthesized
accacttcacagtagttaaatc

SEQ ID NO: 779731 - DNA, 22 bp, Artificial Sequence
  chemically synthesized
gtacagatcatagccagattta

SEQ ID NO: 779732 - DNA, 22 bp, Artificial Sequence
  chemically synthesized
cacagtagttaaatctggctat

SEQ ID NO: 779733 - DNA, 22 bp, Artificial Sequence
  chemically synthesized
acagtagttaaatctggctatg

SEQ ID NO: 779734 - DNA, 22 bp, Artificial Sequence
  chemically synthesized
aatctggctatgatctgtacta

SEQ ID NO: 779735 - DNA, 22 bp, Artificial Sequence
  chemically synthesized
ccaaccagataccagctagtac

SEQ ID NO: 779736 - DNA, 22 bp, Artificial Sequence
  chemically synthesized
gctatgatctgtactagctggt

SEQ ID NO: 779737 - DNA, 22 bp, Artificial Sequence
  chemically synthesized
tcccaaccagataccagctagt

SEQ ID NO: 779738 - DNA, 22 bp, Artificial Sequence
  chemically synthesized
tgatctgtactagctggtatct

SEQ ID NO: 779739 - DNA, 22 bp, Artificial Sequence
  chemically synthesized
gtgattctcccaaccagatacc

SEQ ID NO: 779740 - DNA, 22 bp, Artificial Sequence
  chemically synthesized
tactagctggtatctggttggg

SEQ ID NO: 779741 - DNA, 22 bp, Artificial Sequence
  chemically synthesized
gctggtatctggttgggagaat

SEQ ID NO: 779742 - DNA, 22 bp, Artificial Sequence
  chemically synthesized
gtatctggttgggagaatcact

SEQ ID NO: 779743 - DNA, 22 bp, Artificial Sequence
  chemically synthesized
gttgggagaatcactagtactg

SEQ ID NO: 779744 - DNA, 22 bp, Artificial Sequence
  chemically synthesized
ggagaatcactagtactgggtt

SEQ ID NO: 779745 - DNA, 22 bp, Artificial Sequence
  chemically synthesized
ggcagaaatacaaaaacccagt

SEQ ID NO: 779746 - DNA, 22 bp, Artificial Sequence
  chemically synthesized
gctgggcagaaatacaaaaacc

SEQ ID NO: 779747 - DNA, 22 bp, Artificial Sequence
  chemically synthesized
gtactgggtttttgtatttctg

SEQ ID NO: 779748 - DNA, 22 bp, Artificial Sequence
  chemically synthesized
ggtttttgtatttctgcccagc

SEQ ID NO: 779749 - DNA, 22 bp, Artificial Sequence
  chemically synthesized
ttgtatttctgcccagccaggc

SEQ ID NO: 779750 - DNA, 22 bp, Artificial Sequence
  chemically synthesized
tgtatttctgcccagccaggcg

SEQ ID NO: 779751 - DNA, 22 bp, Artificial Sequence
  chemically synthesized
gtatttctgcccagccaggcgt

SEQ ID NO: 779752 - DNA, 22 bp, Artificial Sequence
  chemically synthesized
tatttctgcccagccaggcgtt

SEQ ID NO: 779753 - DNA, 22 bp, Artificial Sequence
  chemically synthesized
atgtaaaatatgatcaacgcct

SEQ ID NO: 779754 - DNA, 22 bp, Artificial Sequence
  chemically synthesized
ctgcccagccaggcgttgatca

SEQ ID NO: 779755 - DNA, 22 bp, Artificial Sequence
  chemically synthesized
tgcccagccaggcgttgatcat

SEQ ID NO: 779756 - DNA, 22 bp, Artificial Sequence
  chemically synthesized
cccagccaggcgttgatcatat

SEQ ID NO: 779757 - DNA, 22 bp, Artificial Sequence
  chemically synthesized
tgcaaatcctaatgtaaaatat

SEQ ID NO: 779758 - DNA, 22 bp, Artificial Sequence
  chemically synthesized
atgcaaatcctaatgtaaaata

SEQ ID NO: 779759 - DNA, 22 bp, Artificial Sequence
  chemically synthesized
tatgcaaatcctaatgtaaaat

SEQ ID NO: 779760 - DNA, 22 bp, Artificial Sequence
  chemically synthesized
ttatgcaaatcctaatgtaaaa

SEQ ID NO: 779761 - DNA, 22 bp, Artificial Sequence
  chemically synthesized
ttttatgcaaatcctaatgtaa

SEQ ID NO: 779762 - DNA, 22 bp, Artificial Sequence
  chemically synthesized
cttttatgcaaatcctaatgta

SEQ ID NO: 779763 - DNA, 22 bp, Artificial Sequence
  chemically synthesized
atcatattttacattaggattt

SEQ ID NO: 779764 - DNA, 22 bp, Artificial Sequence
  chemically synthesized
cttcttttatgcaaatcctaat

SEQ ID NO: 779765 - DNA, 22 bp, Artificial Sequence
  chemically synthesized
gcctgcttcttttatgcaaatc

SEQ ID NO: 779766 - DNA, 22 bp, Artificial Sequence
  chemically synthesized
tacattaggatttgcataaaag

SEQ ID NO: 779767 - DNA, 22 bp, Artificial Sequence
  chemically synthesized
cctggcctgcttcttttatgca

SEQ ID NO: 779768 - DNA, 22 bp, Artificial Sequence
  chemically synthesized
acattaggatttgcataaaaga

SEQ ID NO: 779769 - DNA, 22 bp, Artificial Sequence
  chemically synthesized
cattaggatttgcataaaagaa

SEQ ID NO: 779770 - DNA, 22 bp, Artificial Sequence
  chemically synthesized
ggatttgcataaaagaagcagg

SEQ ID NO: 779771 - DNA, 22 bp, Artificial Sequence
  chemically synthesized
gcataaaagaagcaggccaggc

SEQ ID NO: 779772 - DNA, 22 bp, Artificial Sequence
  chemically synthesized
cataaaagaagcaggccaggca

SEQ ID NO: 779773 - DNA, 22 bp, Artificial Sequence
  chemically synthesized
tgtggggaaaggaacatagggc

SEQ ID NO: 779774 - DNA, 22 bp, Artificial Sequence
  chemically synthesized
gtgtggggaaaggaacataggg

SEQ ID NO: 779775 - DNA, 22 bp, Artificial Sequence
  chemically synthesized
tgtatgaccttgtgtggggaaa

SEQ ID NO: 779776 - DNA, 22 bp, Artificial Sequence
  chemically synthesized
atgtatgaccttgtgtggggaa

SEQ ID NO: 779777 - DNA, 22 bp, Artificial Sequence
  chemically synthesized
tatgtatgaccttgtgtgggga

SEQ ID NO: 779778 - DNA, 22 bp, Artificial Sequence
  chemically synthesized
tgttcctttccccacacaaggt

SEQ ID NO: 779779 - DNA, 22 bp, Artificial Sequence
  chemically synthesized
ctttccccacacaaggtcatac

SEQ ID NO: 779780 - DNA, 22 bp, Artificial Sequence
  chemically synthesized
tccccacacaaggtcatacata

SEQ ID NO: 779781 - DNA, 22 bp, Artificial Sequence
  chemically synthesized
ccccacacaaggtcatacataa

SEQ ID NO: 779782 - DNA, 22 bp, Artificial Sequence
  chemically synthesized
cccacacaaggtcatacataaa

SEQ ID NO: 779783 - DNA, 22 bp, Artificial Sequence
  chemically synthesized
ttattttttattttttccccct

SEQ ID NO: 779784 - DNA, 22 bp, Artificial Sequence
  chemically synthesized
ttttttattttttccccctctg

SEQ ID NO: 779785 - DNA, 22 bp, Artificial Sequence
  chemically synthesized
cagggaaaaggccagaggggga

SEQ ID NO: 779786 - DNA, 22 bp, Artificial Sequence
  chemically synthesized
acagggaaaaggccagaggggg

SEQ ID NO: 779787 - DNA, 22 bp, Artificial Sequence
  chemically synthesized
tttattttttccccctctggcc

SEQ ID NO: 779788 - DNA, 22 bp, Artificial Sequence
  chemically synthesized
ttattttttccccctctggcct

SEQ ID NO: 779789 - DNA, 22 bp, Artificial Sequence
  chemically synthesized
tattttttccccctctggcctt

SEQ ID NO: 779790 - DNA, 22 bp, Artificial Sequence
  chemically synthesized
attttttccccctctggccttt

SEQ ID NO: 779791 - DNA, 22 bp, Artificial Sequence
  chemically synthesized
ttttttccccctctggcctttt

SEQ ID NO: 779792 - DNA, 22 bp, Artificial Sequence
  chemically synthesized
tttccccctctggccttttccc

SEQ ID NO: 779793 - DNA, 22 bp, Artificial Sequence
  chemically synthesized
ttccccctctggccttttccct

SEQ ID NO: 779794 - DNA, 22 bp, Artificial Sequence
  chemically synthesized
tccccctctggccttttccctg

SEQ ID NO: 779795 - DNA, 22 bp, Artificial Sequence
  chemically synthesized
ccccctctggccttttccctgt

SEQ ID NO: 779796 - DNA, 22 bp, Artificial Sequence
  chemically synthesized
cccctctggccttttccctgta

SEQ ID NO: 779797 - DNA, 22 bp, Artificial Sequence
  chemically synthesized
tggccttttccctgtaagtata

SEQ ID NO: 779798 - DNA, 22 bp, Artificial Sequence
  chemically synthesized
gccttttccctgtaagtatatg

SEQ ID NO: 779799 - DNA, 22 bp, Artificial Sequence
  chemically synthesized
tatcaaagtgataacatatact

SEQ ID NO: 779800 - DNA, 22 bp, Artificial Sequence
  chemically synthesized
gtatcaaagtgataacatatac

SEQ ID NO: 779801 - DNA, 22 bp, Artificial Sequence
  chemically synthesized
ttccctgtaagtatatgttatc

SEQ ID NO: 779802 - DNA, 22 bp, Artificial Sequence
  chemically synthesized
tccctgtaagtatatgttatca

SEQ ID NO: 779803 - DNA, 22 bp, Artificial Sequence
  chemically synthesized
ccctgtaagtatatgttatcac

SEQ ID NO: 779804 - DNA, 22 bp, Artificial Sequence
  chemically synthesized
atttgtatcaaagtgataacat

SEQ ID NO: 779805 - DNA, 22 bp, Artificial Sequence
  chemically synthesized
cctgtaagtatatgttatcact

SEQ ID NO: 779806 - DNA, 22 bp, Artificial Sequence
  chemically synthesized
taagtatatgttatcactttga

SEQ ID NO: 779807 - DNA, 22 bp, Artificial Sequence
  chemically synthesized
tgattcatttgtatcaaagtga

SEQ ID NO: 779808 - DNA, 22 bp, Artificial Sequence
  chemically synthesized
aattatgattcatttgtatcaa

SEQ ID NO: 779809 - DNA, 22 bp, Artificial Sequence
  chemically synthesized
tcactttgatacaaatgaatca

SEQ ID NO: 779810 - DNA, 22 bp, Artificial Sequence
  chemically synthesized
tgatacaaatgaatcataattg

SEQ ID NO: 779811 - DNA, 22 bp, Artificial Sequence
  chemically synthesized
gatacaaatgaatcataattga

SEQ ID NO: 779812 - DNA, 22 bp, Artificial Sequence
  chemically synthesized
atacaaatgaatcataattgaa

SEQ ID NO: 779813 - DNA, 22 bp, Artificial Sequence
  chemically synthesized
aatactcattcactcactccat

SEQ ID NO: 779814 - DNA, 22 bp, Artificial Sequence
  chemically synthesized
atgaataagtaagtgaatggag

SEQ ID NO: 779815 - DNA, 22 bp, Artificial Sequence
  chemically synthesized
attcactcactccattcactta

SEQ ID NO: 779816 - DNA, 22 bp, Artificial Sequence
  chemically synthesized
actcactccattcacttactta

SEQ ID NO: 779817 - DNA, 22 bp, Artificial Sequence
  chemically synthesized
actccattcacttacttattca

SEQ ID NO: 779818 - DNA, 22 bp, Artificial Sequence
  chemically synthesized
atgaaagcattaatgaataagt

SEQ ID NO: 779819 - DNA, 22 bp, Artificial Sequence
  chemically synthesized
aatgaaagcattaatgaataag

SEQ ID NO: 779820 - DNA, 22 bp, Artificial Sequence
  chemically synthesized
cattcacttacttattcattaa

SEQ ID NO: 779821 - DNA, 22 bp, Artificial Sequence
  chemically synthesized
acttacttattcattaatgctt

SEQ ID NO: 779822 - DNA, 22 bp, Artificial Sequence
  chemically synthesized
acttattcattaatgctttcat

SEQ ID NO: 779823 - DNA, 22 bp, Artificial Sequence
  chemically synthesized
cttattcattaatgctttcatt

SEQ ID NO: 779824 - DNA, 22 bp, Artificial Sequence
  chemically synthesized
attcattaatgctttcattaaa

SEQ ID NO: 779825 - DNA, 22 bp, Artificial Sequence
  chemically synthesized
ttcattaatgctttcattaaat

SEQ ID NO: 779826 - DNA, 22 bp, Artificial Sequence
  chemically synthesized
ccacataataaatatttaatga

SEQ ID NO: 779827 - DNA, 22 bp, Artificial Sequence
  chemically synthesized
attaatgctttcattaaatatt

SEQ ID NO: 779828 - DNA, 22 bp, Artificial Sequence
  chemically synthesized
atgctttcattaaatatttatt

SEQ ID NO: 779829 - DNA, 22 bp, Artificial Sequence
  chemically synthesized
cgtatacctaccacataataaa

SEQ ID NO: 779830 - DNA, 22 bp, Artificial Sequence
  chemically synthesized
ccgtatacctaccacataataa

SEQ ID NO: 779831 - DNA, 22 bp, Artificial Sequence
  chemically synthesized
tcattaaatatttattatgtgg

SEQ ID NO: 779832 - DNA, 22 bp, Artificial Sequence
  chemically synthesized
cattaaatatttattatgtggt

SEQ ID NO: 779833 - DNA, 22 bp, Artificial Sequence
  chemically synthesized
attaaatatttattatgtggta

SEQ ID NO: 779834 - DNA, 22 bp, Artificial Sequence
  chemically synthesized
tacttccgtatacctaccacat

SEQ ID NO: 779835 - DNA, 22 bp, Artificial Sequence
  chemically synthesized
gtacttccgtatacctaccaca

SEQ ID NO: 779836 - DNA, 22 bp, Artificial Sequence
  chemically synthesized
aatatttattatgtggtaggta

SEQ ID NO: 779837 - DNA, 22 bp, Artificial Sequence
  chemically synthesized
tgtacttccgtatacctaccac

SEQ ID NO: 779838 - DNA, 22 bp, Artificial Sequence
  chemically synthesized
ttgtacttccgtatacctacca

SEQ ID NO: 779839 - DNA, 22 bp, Artificial Sequence
  chemically synthesized
tttgtacttccgtatacctacc

SEQ ID NO: 779840 - DNA, 22 bp, Artificial Sequence
  chemically synthesized
ttttgtacttccgtatacctac

SEQ ID NO: 779841 - DNA, 22 bp, Artificial Sequence
  chemically synthesized
attatgtggtaggtatacggaa

SEQ ID NO: 779842 - DNA, 22 bp, Artificial Sequence
  chemically synthesized
ttatgtggtaggtatacggaag

SEQ ID NO: 779843 - DNA, 22 bp, Artificial Sequence
  chemically synthesized
tacttttttgtacttccgtata

SEQ ID NO: 779844 - DNA, 22 bp, Artificial Sequence
  chemically synthesized
gtacttttttgtacttccgtat

SEQ ID NO: 779845 - DNA, 22 bp, Artificial Sequence
  chemically synthesized
tgtacttttttgtacttccgta

SEQ ID NO: 779846 - DNA, 22 bp, Artificial Sequence
  chemically synthesized
tgtggtaggtatacggaagtac

SEQ ID NO: 779847 - DNA, 22 bp, Artificial Sequence
  chemically synthesized
ttgtacttttttgtacttccgt

SEQ ID NO: 779848 - DNA, 22 bp, Artificial Sequence
  chemically synthesized
tttgtacttttttgtacttccg

SEQ ID NO: 779849 - DNA, 22 bp, Artificial Sequence
  chemically synthesized
tgaggtctttttgtactttttt

SEQ ID NO: 779850 - DNA, 22 bp, Artificial Sequence
  chemically synthesized
gtgaggtctttttgtacttttt

SEQ ID NO: 779851 - DNA, 22 bp, Artificial Sequence
  chemically synthesized
tgtgaggtctttttgtactttt

SEQ ID NO: 779852 - DNA, 22 bp, Artificial Sequence
  chemically synthesized
agctttgtgaggtctttttgta

SEQ ID NO: 779853 - DNA, 22 bp, Artificial Sequence
  chemically synthesized
aagctttgtgaggtctttttgt

SEQ ID NO: 779854 - DNA, 22 bp, Artificial Sequence
  chemically synthesized
gatcttaagctttgtgaggtct

SEQ ID NO: 779855 - DNA, 22 bp, Artificial Sequence
  chemically synthesized
agatcttaagctttgtgaggtc

SEQ ID NO: 779856 - DNA, 22 bp, Artificial Sequence
  chemically synthesized
tttagatcttaagctttgtgag

SEQ ID NO: 779857 - DNA, 22 bp, Artificial Sequence
  chemically synthesized
ctgtttagatcttaagctttgt

SEQ ID NO: 779858 - DNA, 22 bp, Artificial Sequence
  chemically synthesized
tattcctgtttagatcttaagc

SEQ ID NO: 779859 - DNA, 22 bp, Artificial Sequence
  chemically synthesized
gtattcctgtttagatcttaag

SEQ ID NO: 779860 - DNA, 22 bp, Artificial Sequence
  chemically synthesized
acaaagcttaagatctaaacag

SEQ ID NO: 779861 - DNA, 22 bp, Artificial Sequence
  chemically synthesized
cccatgaatttgtattcctgtt

SEQ ID NO: 779862 - DNA, 22 bp, Artificial Sequence
  chemically synthesized
aagatctaaacaggaatacaaa

SEQ ID NO: 779863 - DNA, 22 bp, Artificial Sequence
  chemically synthesized
agatctaaacaggaatacaaat

SEQ ID NO: 779864 - DNA, 22 bp, Artificial Sequence
  chemically synthesized
aattgcccatgaatttgtattc

SEQ ID NO: 779865 - DNA, 22 bp, Artificial Sequence
  chemically synthesized
caattgcccatgaatttgtatt

SEQ ID NO: 779866 - DNA, 22 bp, Artificial Sequence
  chemically synthesized
aacaggaatacaaattcatggg

SEQ ID NO: 779867 - DNA, 22 bp, Artificial Sequence
  chemically synthesized
ccatatggtatttcaattgccc

SEQ ID NO: 779868 - DNA, 22 bp, Artificial Sequence
  chemically synthesized
gccatatggtatttcaattgcc

SEQ ID NO: 779869 - DNA, 22 bp, Artificial Sequence
  chemically synthesized
tgccatatggtatttcaattgc

SEQ ID NO: 779870 - DNA, 22 bp, Artificial Sequence
  chemically synthesized
ccctttgccatatggtatttca

SEQ ID NO: 779871 - DNA, 22 bp, Artificial Sequence
  chemically synthesized
accctttgccatatggtatttc

SEQ ID NO: 779872 - DNA, 22 bp, Artificial Sequence
  chemically synthesized
atgggcaattgaaataccatat

SEQ ID NO: 779873 - DNA, 22 bp, Artificial Sequence
  chemically synthesized
tcttaccctttgccatatggta

SEQ ID NO: 779874 - DNA, 22 bp, Artificial Sequence
  chemically synthesized
gtcttaccctttgccatatggt

SEQ ID NO: 779875 - DNA, 22 bp, Artificial Sequence
  chemically synthesized
aaataccatatggcaaagggta

SEQ ID NO: 779876 - DNA, 22 bp, Artificial Sequence
  chemically synthesized
agtacatttgtcttaccctttg

SEQ ID NO: 779877 - DNA, 22 bp, Artificial Sequence
  chemically synthesized
cagtacatttgtcttacccttt

SEQ ID NO: 779878 - DNA, 22 bp, Artificial Sequence
  chemically synthesized
cttcagtacatttgtcttaccc

SEQ ID NO: 779879 - DNA, 22 bp, Artificial Sequence
  chemically synthesized
aatgtgctacttcagtacattt

SEQ ID NO: 779880 - DNA, 22 bp, Artificial Sequence
  chemically synthesized
caatgtgctacttcagtacatt

SEQ ID NO: 779881 - DNA, 22 bp, Artificial Sequence
  chemically synthesized
caccttcaatgtgctacttcag

SEQ ID NO: 779882 - DNA, 22 bp, Artificial Sequence
  chemically synthesized
ctgcaccttcaatgtgctactt

SEQ ID NO: 779883 - DNA, 22 bp, Artificial Sequence
  chemically synthesized
aagtagcacattgaaggtgcag

SEQ ID NO: 779884 - DNA, 22 bp, Artificial Sequence
  chemically synthesized
aacatcccaaaccggatctcct

SEQ ID NO: 779885 - DNA, 22 bp, Artificial Sequence
  chemically synthesized
ctgaacatcccaaaccggatct

SEQ ID NO: 779886 - DNA, 22 bp, Artificial Sequence
  chemically synthesized
aaggtgcaggagatccggtttg

SEQ ID NO: 779887 - DNA, 22 bp, Artificial Sequence
  chemically synthesized
ataaatagattcctgaacatcc

SEQ ID NO: 779888 - DNA, 22 bp, Artificial Sequence
  chemically synthesized
gggatgttcaggaatctattta

SEQ ID NO: 779889 - DNA, 22 bp, Artificial Sequence
  chemically synthesized
ggatgttcaggaatctatttat

SEQ ID NO: 779890 - DNA, 22 bp, Artificial Sequence
  chemically synthesized
agacagcacctcataaatagat

SEQ ID NO: 779891 - DNA, 22 bp, Artificial Sequence
  chemically synthesized
cagacagcacctcataaataga

SEQ ID NO: 779892 - DNA, 22 bp, Artificial Sequence
  chemically synthesized
tcagacagcacctcataaatag

SEQ ID NO: 779893 - DNA, 22 bp, Artificial Sequence
  chemically synthesized
ttcagacagcacctcataaata

SEQ ID NO: 779894 - DNA, 22 bp, Artificial Sequence
  chemically synthesized
aggaatctatttatgaggtgct

SEQ ID NO: 779895 - DNA, 22 bp, Artificial Sequence
  chemically synthesized
ataatcccttttcagacagcac

SEQ ID NO: 779896 - DNA, 22 bp, Artificial Sequence
  chemically synthesized
tttatgaggtgctgtctgaaaa

SEQ ID NO: 779897 - DNA, 22 bp, Artificial Sequence
  chemically synthesized
gttaataatcccttttcagaca

SEQ ID NO: 779898 - DNA, 22 bp, Artificial Sequence
  chemically synthesized
atgaggtgctgtctgaaaaggg

SEQ ID NO: 779899 - DNA, 22 bp, Artificial Sequence
  chemically synthesized
tgaggtgctgtctgaaaaggga

SEQ ID NO: 779900 - DNA, 22 bp, Artificial Sequence
  chemically synthesized
gctagttaataatcccttttca

SEQ ID NO: 779901 - DNA, 22 bp, Artificial Sequence
  chemically synthesized
agctagttaataatcccttttc

SEQ ID NO: 779902 - DNA, 22 bp, Artificial Sequence
  chemically synthesized
tttagctagttaataatccctt

SEQ ID NO: 779903 - DNA, 22 bp, Artificial Sequence
  chemically synthesized
gtttagctagttaataatccct

SEQ ID NO: 779904 - DNA, 22 bp, Artificial Sequence
  chemically synthesized
tgtttagctagttaataatccc

SEQ ID NO: 779905 - DNA, 22 bp, Artificial Sequence
  chemically synthesized
tctgaaaagggattattaacta

SEQ ID NO: 779906 - DNA, 22 bp, Artificial Sequence
  chemically synthesized
tcacctttgtttagctagttaa

SEQ ID NO: 779907 - DNA, 22 bp, Artificial Sequence
  chemically synthesized
aaaagggattattaactagcta

SEQ ID NO: 779908 - DNA, 22 bp, Artificial Sequence
  chemically synthesized
tatcacctttgtttagctagtt

SEQ ID NO: 779909 - DNA, 22 bp, Artificial Sequence
  chemically synthesized
ctctatcacctttgtttagcta

SEQ ID NO: 779910 - DNA, 22 bp, Artificial Sequence
  chemically synthesized
tcctctatcacctttgtttagc

SEQ ID NO: 779911 - DNA, 22 bp, Artificial Sequence
  chemically synthesized
tctctcctctatcacctttgtt

SEQ ID NO: 779912 - DNA, 22 bp, Artificial Sequence
  chemically synthesized
ttaactagctaaacaaaggtga

SEQ ID NO: 779913 - DNA, 22 bp, Artificial Sequence
  chemically synthesized
actagctaaacaaaggtgatag

SEQ ID NO: 779914 - DNA, 22 bp, Artificial Sequence
  chemically synthesized
gctaaacaaaggtgatagagga

SEQ ID NO: 779915 - DNA, 22 bp, Artificial Sequence
  chemically synthesized
ggaacaatctgtctctcctcta

SEQ ID NO: 779916 - DNA, 22 bp, Artificial Sequence
  chemically synthesized
aacaaaggtgatagaggagaga

SEQ ID NO: 779917 - DNA, 22 bp, Artificial Sequence
  chemically synthesized
ctaggaacaatctgtctctcct

SEQ ID NO: 779918 - DNA, 22 bp, Artificial Sequence
  chemically synthesized
tcctaggaacaatctgtctctc

SEQ ID NO: 779919 - DNA, 22 bp, Artificial Sequence
  chemically synthesized
cctctcctaggaacaatctgtc

SEQ ID NO: 779920 - DNA, 22 bp, Artificial Sequence
  chemically synthesized
catcaaatggctccctctccta

SEQ ID NO: 779921 - DNA, 22 bp, Artificial Sequence
  chemically synthesized
gccctccatcaaatggctccct

SEQ ID NO: 779922 - DNA, 22 bp, Artificial Sequence
  chemically synthesized
ttcctaggagagggagccattt

SEQ ID NO: 779923 - DNA, 22 bp, Artificial Sequence
  chemically synthesized
tggccctccatcaaatggctcc

SEQ ID NO: 779924 - DNA, 22 bp, Artificial Sequence
  chemically synthesized
ctggccctccatcaaatggctc

SEQ ID NO: 779925 - DNA, 22 bp, Artificial Sequence
  chemically synthesized
ctaggagagggagccatttgat

SEQ ID NO: 779926 - DNA, 22 bp, Artificial Sequence
  chemically synthesized
cttctggccctccatcaaatgg

SEQ ID NO: 779927 - DNA, 22 bp, Artificial Sequence
  chemically synthesized
gcttctggccctccatcaaatg

SEQ ID NO: 779928 - DNA, 22 bp, Artificial Sequence
  chemically synthesized
ggagagggagccatttgatgga

SEQ ID NO: 779929 - DNA, 22 bp, Artificial Sequence
  chemically synthesized
ttgcttctggccctccatcaaa

SEQ ID NO: 779930 - DNA, 22 bp, Artificial Sequence
  chemically synthesized
cttgcttctggccctccatcaa

SEQ ID NO: 779931 - DNA, 22 bp, Artificial Sequence
  chemically synthesized
tttcttgcttctggccctccat

SEQ ID NO: 779932 - DNA, 22 bp, Artificial Sequence
  chemically synthesized
gtttcttgcttctggccctcca

SEQ ID NO: 779933 - DNA, 22 bp, Artificial Sequence
  chemically synthesized
tgtttcttgcttctggccctcc

SEQ ID NO: 779934 - DNA, 22 bp, Artificial Sequence
  chemically synthesized
gatggagggccagaagcaagaa

SEQ ID NO: 779935 - DNA, 22 bp, Artificial Sequence
  chemically synthesized
atggagggccagaagcaagaaa

SEQ ID NO: 779936 - DNA, 22 bp, Artificial Sequence
  chemically synthesized
caatcaaataaaatatctttgt

SEQ ID NO: 779937 - DNA, 22 bp, Artificial Sequence
  chemically synthesized
tacaatcaaataaaatatcttt

SEQ ID NO: 779938 - DNA, 22 bp, Artificial Sequence
  chemically synthesized
aactctacaatcaaataaaata

SEQ ID NO: 779939 - DNA, 22 bp, Artificial Sequence
  chemically synthesized
ctgaactctacaatcaaataaa

SEQ ID NO: 779940 - DNA, 22 bp, Artificial Sequence
  chemically synthesized
actgaactctacaatcaaataa

SEQ ID NO: 779941 - DNA, 22 bp, Artificial Sequence
  chemically synthesized
tactgaactctacaatcaaata

SEQ ID NO: 779942 - DNA, 22 bp, Artificial Sequence
  chemically synthesized
tttactgaactctacaatcaaa

SEQ ID NO: 779943 - DNA, 22 bp, Artificial Sequence
  chemically synthesized
tccctctttactgaactctaca

SEQ ID NO: 779944 - DNA, 22 bp, Artificial Sequence
  chemically synthesized
atccctctttactgaactctac

SEQ ID NO: 779945 - DNA, 22 bp, Artificial Sequence
  chemically synthesized
tatttgattgtagagttcagta

SEQ ID NO: 779946 - DNA, 22 bp, Artificial Sequence
  chemically synthesized
atttgattgtagagttcagtaa

SEQ ID NO: 779947 - DNA, 22 bp, Artificial Sequence
  chemically synthesized
tttgattgtagagttcagtaaa

SEQ ID NO: 779948 - DNA, 22 bp, Artificial Sequence
  chemically synthesized
aagccttatccctctttactga

SEQ ID NO: 779949 - DNA, 22 bp, Artificial Sequence
  chemically synthesized
gattgtagagttcagtaaagag

SEQ ID NO: 779950 - DNA, 22 bp, Artificial Sequence
  chemically synthesized
attgtagagttcagtaaagagg

SEQ ID NO: 779951 - DNA, 22 bp, Artificial Sequence
  chemically synthesized
tagagttcagtaaagagggata

SEQ ID NO: 779952 - DNA, 22 bp, Artificial Sequence
  chemically synthesized
cgtgtgaccactcaagccttat

SEQ ID NO: 779953 - DNA, 22 bp, Artificial Sequence
  chemically synthesized
agtaaagagggataaggcttga

SEQ ID NO: 779954 - DNA, 22 bp, Artificial Sequence
  chemically synthesized
actccgtgtgaccactcaagcc

SEQ ID NO: 779955 - DNA, 22 bp, Artificial Sequence
  chemically synthesized
tcactccgtgtgaccactcaag

SEQ ID NO: 779956 - DNA, 22 bp, Artificial Sequence
  chemically synthesized
atgctctcactccgtgtgacca

SEQ ID NO: 779957 - DNA, 22 bp, Artificial Sequence
  chemically synthesized
catgctctcactccgtgtgacc

SEQ ID NO: 779958 - DNA, 22 bp, Artificial Sequence
  chemically synthesized
gagtggtcacacggagtgagag

SEQ ID NO: 779959 - DNA, 22 bp, Artificial Sequence
  chemically synthesized
agtggtcacacggagtgagagc

SEQ ID NO: 779960 - DNA, 22 bp, Artificial Sequence
  chemically synthesized
catggcccttcatgctctcact

SEQ ID NO: 779961 - DNA, 22 bp, Artificial Sequence
  chemically synthesized
acatggcccttcatgctctcac

SEQ ID NO: 779962 - DNA, 22 bp, Artificial Sequence
  chemically synthesized
cttacatggcccttcatgctct

SEQ ID NO: 779963 - DNA, 22 bp, Artificial Sequence
  chemically synthesized
cactacttacatggcccttcat

SEQ ID NO: 779964 - DNA, 22 bp, Artificial Sequence
  chemically synthesized
gcattccactacttacatggcc

SEQ ID NO: 779965 - DNA, 22 bp, Artificial Sequence
  chemically synthesized
ctagcattccactacttacatg

SEQ ID NO: 779966 - DNA, 22 bp, Artificial Sequence
  chemically synthesized
actagcattccactacttacat

SEQ ID NO: 779967 - DNA, 22 bp, Artificial Sequence
  chemically synthesized
acatttactagcattccactac

SEQ ID NO: 779968 - DNA, 22 bp, Artificial Sequence
  chemically synthesized
gacatttactagcattccacta

SEQ ID NO: 779969 - DNA, 22 bp, Artificial Sequence
  chemically synthesized
tttgacatttactagcattcca

SEQ ID NO: 779970 - DNA, 22 bp, Artificial Sequence
  chemically synthesized
gagccagttatttgacatttac

SEQ ID NO: 779971 - DNA, 22 bp, Artificial Sequence
  chemically synthesized
ccctagagccagttatttgaca

SEQ ID NO: 779972 - DNA, 22 bp, Artificial Sequence
  chemically synthesized
ccctcccctagagccagttatt

SEQ ID NO: 779973 - DNA, 22 bp, Artificial Sequence
  chemically synthesized
gtaaatgtcaaataactggctc

SEQ ID NO: 779974 - DNA, 22 bp, Artificial Sequence
  chemically synthesized
gcgccactgccctcccctagag

SEQ ID NO: 779975 - DNA, 22 bp, Artificial Sequence
  chemically synthesized
caattagcgccactgccctccc

SEQ ID NO: 779976 - DNA, 22 bp, Artificial Sequence
  chemically synthesized
gctctaggggagggcagtggcg

SEQ ID NO: 779977 - DNA, 22 bp, Artificial Sequence
  chemically synthesized
taggggagggcagtggcgctaa

SEQ ID NO: 779978 - DNA, 22 bp, Artificial Sequence
  chemically synthesized
gcaaatgctacaattagcgcca

SEQ ID NO: 779979 - DNA, 22 bp, Artificial Sequence
  chemically synthesized
ggggagggcagtggcgctaatt

SEQ ID NO: 779980 - DNA, 22 bp, Artificial Sequence
  chemically synthesized
caccacagaaattggcaaatgc

SEQ ID NO: 779981 - DNA, 22 bp, Artificial Sequence
  chemically synthesized
acaccacagaaattggcaaatg

SEQ ID NO: 779982 - DNA, 22 bp, Artificial Sequence
  chemically synthesized
attgtagcatttgccaatttct

SEQ ID NO: 779983 - DNA, 22 bp, Artificial Sequence
  chemically synthesized
tagcatttgccaatttctgtgg

SEQ ID NO: 779984 - DNA, 22 bp, Artificial Sequence
  chemically synthesized
tgagagcacttacaccacagaa

SEQ ID NO: 779985 - DNA, 22 bp, Artificial Sequence
  chemically synthesized
ttgtgagagcacttacaccaca

SEQ ID NO: 779986 - DNA, 22 bp, Artificial Sequence
  chemically synthesized
gccaatttctgtggtgtaagtg

SEQ ID NO: 779987 - DNA, 22 bp, Artificial Sequence
  chemically synthesized
ccaatttctgtggtgtaagtgc

SEQ ID NO: 779988 - DNA, 22 bp, Artificial Sequence
  chemically synthesized
aaatcagctattgtgagagcac

SEQ ID NO: 779989 - DNA, 22 bp, Artificial Sequence
  chemically synthesized
ctgtggtgtaagtgctctcaca

SEQ ID NO: 779990 - DNA, 22 bp, Artificial Sequence
  chemically synthesized
gaaatcagctattgtgagagca

SEQ ID NO: 779991 - DNA, 22 bp, Artificial Sequence
  chemically synthesized
tgtggtgtaagtgctctcacaa

SEQ ID NO: 779992 - DNA, 22 bp, Artificial Sequence
  chemically synthesized
tggtgtaagtgctctcacaata

SEQ ID NO: 779993 - DNA, 22 bp, Artificial Sequence
  chemically synthesized
cttgaaatcagctattgtgaga

SEQ ID NO: 779994 - DNA, 22 bp, Artificial Sequence
  chemically synthesized
gttgcttgaaatcagctattgt

SEQ ID NO: 779995 - DNA, 22 bp, Artificial Sequence
  chemically synthesized
tcacaatagctgatttcaagca

SEQ ID NO: 779996 - DNA, 22 bp, Artificial Sequence
  chemically synthesized
acaatagctgatttcaagcaac

SEQ ID NO: 779997 - DNA, 22 bp, Artificial Sequence
  chemically synthesized
aatgacatcaagttagttgctt

SEQ ID NO: 779998 - DNA, 22 bp, Artificial Sequence
  chemically synthesized
attcaatgacatcaagttagtt

SEQ ID NO: 779999 - DNA, 22 bp, Artificial Sequence
  chemically synthesized
cattcaatgacatcaagttagt

SEQ ID NO: 780000 - DNA, 22 bp, Artificial Sequence
  chemically synthesized
atttcaagcaactaacttgatg

SEQ ID NO: 780001 - DNA, 22 bp, Artificial Sequence
  chemically synthesized
ttcattcaatgacatcaagtta

SEQ ID NO: 780002 - DNA, 22 bp, Artificial Sequence
  chemically synthesized
caagcaactaacttgatgtcat

SEQ ID NO: 780003 - DNA, 22 bp, Artificial Sequence
  chemically synthesized
aagcaactaacttgatgtcatt

SEQ ID NO: 780004 - DNA, 22 bp, Artificial Sequence
  chemically synthesized
agttcttcattcaatgacatca

SEQ ID NO: 780005 - DNA, 22 bp, Artificial Sequence
  chemically synthesized
cactgagttcttcattcaatga

SEQ ID NO: 780006 - DNA, 22 bp, Artificial Sequence
  chemically synthesized
ccactgagttcttcattcaatg

SEQ ID NO: 780007 - DNA, 22 bp, Artificial Sequence
  chemically synthesized
tccactgagttcttcattcaat

SEQ ID NO: 780008 - DNA, 22 bp, Artificial Sequence
  chemically synthesized
acttgatgtcattgaatgaaga

SEQ ID NO: 780009 - DNA, 22 bp, Artificial Sequence
  chemically synthesized
tttccactgagttcttcattca

SEQ ID NO: 780010 - DNA, 22 bp, Artificial Sequence
  chemically synthesized
gatgtcattgaatgaagaactc

SEQ ID NO: 780011 - DNA, 22 bp, Artificial Sequence
  chemically synthesized
atgtcattgaatgaagaactca

SEQ ID NO: 780012 - DNA, 22 bp, Artificial Sequence
  chemically synthesized
tgtgtatctctttccactgagt

SEQ ID NO: 780013 - DNA, 22 bp, Artificial Sequence
  chemically synthesized
aatgaagaactcagtggaaaga

SEQ ID NO: 780014 - DNA, 22 bp, Artificial Sequence
  chemically synthesized
caagagccaattatgtgtatct

SEQ ID NO: 780015 - DNA, 22 bp, Artificial Sequence
  chemically synthesized
agtggaaagagatacacataat

SEQ ID NO: 780016 - DNA, 22 bp, Artificial Sequence
  chemically synthesized
acacattccaagagccaattat

SEQ ID NO: 780017 - DNA, 22 bp, Artificial Sequence
  chemically synthesized
attaacacattccaagagccaa

SEQ ID NO: 780018 - DNA, 22 bp, Artificial Sequence
  chemically synthesized
taattaacacattccaagagcc

SEQ ID NO: 780019 - DNA, 22 bp, Artificial Sequence
  chemically synthesized
ctaattaacacattccaagagc

SEQ ID NO: 780020 - DNA, 22 bp, Artificial Sequence
  chemically synthesized
tcttctaattaacacattccaa

SEQ ID NO: 780021 - DNA, 22 bp, Artificial Sequence
  chemically synthesized
atcttctaattaacacattcca

SEQ ID NO: 780022 - DNA, 22 bp, Artificial Sequence
  chemically synthesized
cttatcttctaattaacacatt

SEQ ID NO: 780023 - DNA, 22 bp, Artificial Sequence
  chemically synthesized
gctcttggaatgtgttaattag

SEQ ID NO: 780024 - DNA, 22 bp, Artificial Sequence
  chemically synthesized
actacttatcttctaattaaca

SEQ ID NO: 780025 - DNA, 22 bp, Artificial Sequence
  chemically synthesized
ctaactacttatcttctaatta

SEQ ID NO: 780026 - DNA, 22 bp, Artificial Sequence
  chemically synthesized
ttggaatgtgttaattagaaga

SEQ ID NO: 780027 - DNA, 22 bp, Artificial Sequence
  chemically synthesized
gctaactacttatcttctaatt

SEQ ID NO: 780028 - DNA, 22 bp, Artificial Sequence
  chemically synthesized
ggaatgtgttaattagaagata

SEQ ID NO: 780029 - DNA, 22 bp, Artificial Sequence
  chemically synthesized
gaatgtgttaattagaagataa

SEQ ID NO: 780030 - DNA, 22 bp, Artificial Sequence
  chemically synthesized
cttgctaactacttatcttcta

SEQ ID NO: 780031 - DNA, 22 bp, Artificial Sequence
  chemically synthesized
tgcttgctaactacttatcttc

SEQ ID NO: 780032 - DNA, 22 bp, Artificial Sequence
  chemically synthesized
attagaagataagtagttagca

SEQ ID NO: 780033 - DNA, 22 bp, Artificial Sequence
  chemically synthesized
gaagataagtagttagcaagca

SEQ ID NO: 780034 - DNA, 22 bp, Artificial Sequence
  chemically synthesized
gtacacacatgctctgcttgct

SEQ ID NO: 780035 - DNA, 22 bp, Artificial Sequence
  chemically synthesized
agtacacacatgctctgcttgc

SEQ ID NO: 780036 - DNA, 22 bp, Artificial Sequence
  chemically synthesized
tgtttagtacacacatgctctg

SEQ ID NO: 780037 - DNA, 22 bp, Artificial Sequence
  chemically synthesized
tctatgtttagtacacacatgc

SEQ ID NO: 780038 - DNA, 22 bp, Artificial Sequence
  chemically synthesized
gcaagcagagcatgtgtgtact

SEQ ID NO: 780039 - DNA, 22 bp, Artificial Sequence
  chemically synthesized
actatctatgtttagtacacac

SEQ ID NO: 780040 - DNA, 22 bp, Artificial Sequence
  chemically synthesized
tccctcactatctatgtttagt

SEQ ID NO: 780041 - DNA, 22 bp, Artificial Sequence
  chemically synthesized
tatccctcactatctatgttta

SEQ ID NO: 780042 - DNA, 22 bp, Artificial Sequence
  chemically synthesized
ctatccctcactatctatgttt

SEQ ID NO: 780043 - DNA, 22 bp, Artificial Sequence
  chemically synthesized
gtccttctatccctcactatct

SEQ ID NO: 780044 - DNA, 22 bp, Artificial Sequence
  chemically synthesized
ggtccttctatccctcactatc

SEQ ID NO: 780045 - DNA, 22 bp, Artificial Sequence
  chemically synthesized
tggtccttctatccctcactat

SEQ ID NO: 780046 - DNA, 22 bp, Artificial Sequence
  chemically synthesized
ttggtccttctatccctcacta

SEQ ID NO: 780047 - DNA, 22 bp, Artificial Sequence
  chemically synthesized
aacatagatagtgagggataga

SEQ ID NO: 780048 - DNA, 22 bp, Artificial Sequence
  chemically synthesized
ggtatcttttggtccttctatc

SEQ ID NO: 780049 - DNA, 22 bp, Artificial Sequence
  chemically synthesized
atgaatattgggtatcttttgg

SEQ ID NO: 780050 - DNA, 22 bp, Artificial Sequence
  chemically synthesized
gtacccaggtgcctcatgaata

SEQ ID NO: 780051 - DNA, 22 bp, Artificial Sequence
  chemically synthesized
agtacccaggtgcctcatgaat

SEQ ID NO: 780052 - DNA, 22 bp, Artificial Sequence
  chemically synthesized
tgaatatttagtacccaggtgc

SEQ ID NO: 780053 - DNA, 22 bp, Artificial Sequence
  chemically synthesized
atgaggcacctgggtactaaat

SEQ ID NO: 780054 - DNA, 22 bp, Artificial Sequence
  chemically synthesized
gcatattatgaatatttagtac

SEQ ID NO: 780055 - DNA, 22 bp, Artificial Sequence
  chemically synthesized
agcatattatgaatatttagta

SEQ ID NO: 780056 - DNA, 22 bp, Artificial Sequence
  chemically synthesized
ggtactaaatattcataatatg

SEQ ID NO: 780057 - DNA, 22 bp, Artificial Sequence
  chemically synthesized
atgtgtatttagcatattatga

SEQ ID NO: 780058 - DNA, 22 bp, Artificial Sequence
  chemically synthesized
gtctcatgtgtatttagcatat

SEQ ID NO: 780059 - DNA, 22 bp, Artificial Sequence
  chemically synthesized
ggtctcatgtgtatttagcata

SEQ ID NO: 780060 - DNA, 22 bp, Artificial Sequence
  chemically synthesized
aatattcataatatgctaaata

SEQ ID NO: 780061 - DNA, 22 bp, Artificial Sequence
  chemically synthesized
tatatttggtctcatgtgtatt

SEQ ID NO: 780062 - DNA, 22 bp, Artificial Sequence
  chemically synthesized
ataatatgctaaatacacatga

SEQ ID NO: 780063 - DNA, 22 bp, Artificial Sequence
  chemically synthesized
gtatatttggtctcatgtgtat

SEQ ID NO: 780064 - DNA, 22 bp, Artificial Sequence
  chemically synthesized
ttgtatatttggtctcatgtgt

SEQ ID NO: 780065 - DNA, 22 bp, Artificial Sequence
  chemically synthesized
gtgcctcttgtatatttggtct

SEQ ID NO: 780066 - DNA, 22 bp, Artificial Sequence
  chemically synthesized
agtgcctcttgtatatttggtc

SEQ ID NO: 780067 - DNA, 22 bp, Artificial Sequence
  chemically synthesized
aatacacatgagaccaaatata

SEQ ID NO: 780068 - DNA, 22 bp, Artificial Sequence
  chemically synthesized
aatatttagtgcctcttgtata

SEQ ID NO: 780069 - DNA, 22 bp, Artificial Sequence
  chemically synthesized
gaatatttagtgcctcttgtat

SEQ ID NO: 780070 - DNA, 22 bp, Artificial Sequence
  chemically synthesized
atcttgaatatttagtgcctct

SEQ ID NO: 780071 - DNA, 22 bp, Artificial Sequence
  chemically synthesized
gatcttgaatatttagtgcctc

SEQ ID NO: 780072 - DNA, 22 bp, Artificial Sequence
  chemically synthesized
tttgatcttgaatatttagtgc

SEQ ID NO: 780073 - DNA, 22 bp, Artificial Sequence
  chemically synthesized
atttgatcttgaatatttagtg

SEQ ID NO: 780074 - DNA, 22 bp, Artificial Sequence
  chemically synthesized
atgtgtatttatttgatcttga

SEQ ID NO: 780075 - DNA, 22 bp, Artificial Sequence
  chemically synthesized
aatattcaagatcaaataaata

SEQ ID NO: 780076 - DNA, 22 bp, Artificial Sequence
  chemically synthesized
agtgctcatgtgtatttatttg

SEQ ID NO: 780077 - DNA, 22 bp, Artificial Sequence
  chemically synthesized
aagatcaaataaatacacatga

SEQ ID NO: 780078 - DNA, 22 bp, Artificial Sequence
  chemically synthesized
tgaacattaagtgctcatgtgt

SEQ ID NO: 780079 - DNA, 22 bp, Artificial Sequence
  chemically synthesized
gtgaacattaagtgctcatgtg

SEQ ID NO: 780080 - DNA, 22 bp, Artificial Sequence
  chemically synthesized
agaccttgtgaacattaagtgc

SEQ ID NO: 780081 - DNA, 22 bp, Artificial Sequence
  chemically synthesized
aattaagaccttgtgaacatta

SEQ ID NO: 780082 - DNA, 22 bp, Artificial Sequence
  chemically synthesized
tggatgcctgaattaagacctt

SEQ ID NO: 780083 - DNA, 22 bp, Artificial Sequence
  chemically synthesized
aatgttcacaaggtcttaattc

SEQ ID NO: 780084 - DNA, 22 bp, Artificial Sequence
  chemically synthesized
atgttcacaaggtcttaattca

SEQ ID NO: 780085 - DNA, 22 bp, Artificial Sequence
  chemically synthesized
acaaggtcttaattcaggcatc

SEQ ID NO: 780086 - DNA, 22 bp, Artificial Sequence
  chemically synthesized
gaataggtatcacctatggatg

SEQ ID NO: 780087 - DNA, 22 bp, Artificial Sequence
  chemically synthesized
aattcaggcatccataggtgat

SEQ ID NO: 780088 - DNA, 22 bp, Artificial Sequence
  chemically synthesized
attcaggcatccataggtgata

SEQ ID NO: 780089 - DNA, 22 bp, Artificial Sequence
  chemically synthesized
cggtgctggaataggtatcacc

SEQ ID NO: 780090 - DNA, 22 bp, Artificial Sequence
  chemically synthesized
aggcatccataggtgataccta

SEQ ID NO: 780091 - DNA, 22 bp, Artificial Sequence
  chemically synthesized
acggtgctggaataggtatcac

SEQ ID NO: 780092 - DNA, 22 bp, Artificial Sequence
  chemically synthesized
aggcagaagacttacggtgctg

SEQ ID NO: 780093 - DNA, 22 bp, Artificial Sequence
  chemically synthesized
tcaggcagaagacttacggtgc

SEQ ID NO: 780094 - DNA, 22 bp, Artificial Sequence
  chemically synthesized
ttccagcaccgtaagtcttctg

SEQ ID NO: 780095 - DNA, 22 bp, Artificial Sequence
  chemically synthesized
cagcaccgtaagtcttctgcct

SEQ ID NO: 780096 - DNA, 22 bp, Artificial Sequence
  chemically synthesized
gccatgtaattctcaggcagaa

SEQ ID NO: 780097 - DNA, 22 bp, Artificial Sequence
  chemically synthesized
atgactagccatgtaattctca

SEQ ID NO: 780098 - DNA, 22 bp, Artificial Sequence
  chemically synthesized
ctgcctgagaattacatggcta

SEQ ID NO: 780099 - DNA, 22 bp, Artificial Sequence
  chemically synthesized
tgcctgagaattacatggctag

SEQ ID NO: 780100 - DNA, 22 bp, Artificial Sequence
  chemically synthesized
cctgagaattacatggctagtc

SEQ ID NO: 780101 - DNA, 22 bp, Artificial Sequence
  chemically synthesized
ccaaaatagcctgatgactagc

SEQ ID NO: 780102 - DNA, 22 bp, Artificial Sequence
  chemically synthesized
agaattacatggctagtcatca

SEQ ID NO: 780103 - DNA, 22 bp, Artificial Sequence
  chemically synthesized
gccaaaatagcctgatgactag

SEQ ID NO: 780104 - DNA, 22 bp, Artificial Sequence
  chemically synthesized
taacttgccaaaatagcctgat

SEQ ID NO: 780105 - DNA, 22 bp, Artificial Sequence
  chemically synthesized
catggctagtcatcaggctatt

SEQ ID NO: 780106 - DNA, 22 bp, Artificial Sequence
  chemically synthesized
gtcatcaggctattttggcaag

SEQ ID NO: 780107 - DNA, 22 bp, Artificial Sequence
  chemically synthesized
ttttggcaagttacagctgtgg

SEQ ID NO: 780108 - DNA, 22 bp, Artificial Sequence
  chemically synthesized
tggcaagttacagctgtggcca

SEQ ID NO: 780109 - DNA, 22 bp, Artificial Sequence
  chemically synthesized
ggcaagttacagctgtggccat

SEQ ID NO: 780110 - DNA, 22 bp, Artificial Sequence
  chemically synthesized
gcaagttacagctgtggccatg

SEQ ID NO: 780111 - DNA, 22 bp, Artificial Sequence
  chemically synthesized
cagctgtggccatgcattcttg

SEQ ID NO: 780112 - DNA, 22 bp, Artificial Sequence
  chemically synthesized
tcagagacacagagacaagaat

SEQ ID NO: 780113 - DNA, 22 bp, Artificial Sequence
  chemically synthesized
atcagagacacagagacaagaa

SEQ ID NO: 780114 - DNA, 22 bp, Artificial Sequence
  chemically synthesized
tggccatgcattcttgtctctg

SEQ ID NO: 780115 - DNA, 22 bp, Artificial Sequence
  chemically synthesized
ttgtctctgtgtctctgataaa

SEQ ID NO: 780116 - DNA, 22 bp, Artificial Sequence
  chemically synthesized
agtggcatgtggtttatcagag

SEQ ID NO: 780117 - DNA, 22 bp, Artificial Sequence
  chemically synthesized
gtctctgtgtctctgataaacc

SEQ ID NO: 780118 - DNA, 22 bp, Artificial Sequence
  chemically synthesized
tctctgtgtctctgataaacca

SEQ ID NO: 780119 - DNA, 22 bp, Artificial Sequence
  chemically synthesized
attcagtggcatgtggtttatc

SEQ ID NO: 780120 - DNA, 22 bp, Artificial Sequence
  chemically synthesized
tgtgtctctgataaaccacatg

SEQ ID NO: 780121 - DNA, 22 bp, Artificial Sequence
  chemically synthesized
tgtctctgataaaccacatgcc

SEQ ID NO: 780122 - DNA, 22 bp, Artificial Sequence
  chemically synthesized
tgataaaccacatgccactgaa

SEQ ID NO: 780123 - DNA, 22 bp, Artificial Sequence
  chemically synthesized
ataaaccacatgccactgaatc

SEQ ID NO: 780124 - DNA, 22 bp, Artificial Sequence
  chemically synthesized
aatcaggcaccacccattttgg

SEQ ID NO: 780125 - DNA, 22 bp, Artificial Sequence
  chemically synthesized
ccaacaagggagtccaaaatgg

SEQ ID NO: 780126 - DNA, 22 bp, Artificial Sequence
  chemically synthesized
cccaacaagggagtccaaaatg

SEQ ID NO: 780127 - DNA, 22 bp, Artificial Sequence
  chemically synthesized
acttcccaacaagggagtccaa

SEQ ID NO: 780128 - DNA, 22 bp, Artificial Sequence
  chemically synthesized
tggactcccttgttgggaagtc

SEQ ID NO: 780129 - DNA, 22 bp, Artificial Sequence
  chemically synthesized
ggactcccttgttgggaagtca

SEQ ID NO: 780130 - DNA, 22 bp, Artificial Sequence
  chemically synthesized
gactcccttgttgggaagtcaa

SEQ ID NO: 780131 - DNA, 22 bp, Artificial Sequence
  chemically synthesized
caaggaccaaagttgacttccc

SEQ ID NO: 780132 - DNA, 22 bp, Artificial Sequence
  chemically synthesized
acaaggaccaaagttgacttcc

SEQ ID NO: 780133 - DNA, 22 bp, Artificial Sequence
  chemically synthesized
ccttgttgggaagtcaactttg

SEQ ID NO: 780134 - DNA, 22 bp, Artificial Sequence
  chemically synthesized
gttgggaagtcaactttggtcc

SEQ ID NO: 780135 - DNA, 22 bp, Artificial Sequence
  chemically synthesized
ttgggaagtcaactttggtcct

SEQ ID NO: 780136 - DNA, 22 bp, Artificial Sequence
  chemically synthesized
tggtgtgcttacaaggaccaaa

SEQ ID NO: 780137 - DNA, 22 bp, Artificial Sequence
  chemically synthesized
ggaagtcaactttggtccttgt

SEQ ID NO: 780138 - DNA, 22 bp, Artificial Sequence
  chemically synthesized
ccaattatggtgtgcttacaag

SEQ ID NO: 780139 - DNA, 22 bp, Artificial Sequence
  chemically synthesized
cccaattatggtgtgcttacaa

SEQ ID NO: 780140 - DNA, 22 bp, Artificial Sequence
  chemically synthesized
tggtccttgtaagcacaccata

SEQ ID NO: 780141 - DNA, 22 bp, Artificial Sequence
  chemically synthesized
ggtccttgtaagcacaccataa

SEQ ID NO: 780142 - DNA, 22 bp, Artificial Sequence
  chemically synthesized
gtccttgtaagcacaccataat

SEQ ID NO: 780143 - DNA, 22 bp, Artificial Sequence
  chemically synthesized
catcagccttcccaattatggt

SEQ ID NO: 780144 - DNA, 22 bp, Artificial Sequence
  chemically synthesized
gtaagcacaccataattgggaa

SEQ ID NO: 780145 - DNA, 22 bp, Artificial Sequence
  chemically synthesized
taagcacaccataattgggaag

SEQ ID NO: 780146 - DNA, 22 bp, Artificial Sequence
  chemically synthesized
tattgcatcagccttcccaatt

SEQ ID NO: 780147 - DNA, 22 bp, Artificial Sequence
  chemically synthesized
tgtattgcatcagccttcccaa

SEQ ID NO: 780148 - DNA, 22 bp, Artificial Sequence
  chemically synthesized
tctctgtattgcatcagccttc

SEQ ID NO: 780149 - DNA, 22 bp, Artificial Sequence
  chemically synthesized
tctgtctctgtattgcatcagc

SEQ ID NO: 780150 - DNA, 22 bp, Artificial Sequence
  chemically synthesized
gtctgtctctgtattgcatcag

SEQ ID NO: 780151 - DNA, 22 bp, Artificial Sequence
  chemically synthesized
ggaaggctgatgcaatacagag

SEQ ID NO: 780152 - DNA, 22 bp, Artificial Sequence
  chemically synthesized
tatgtcttgtctgtctctgtat

SEQ ID NO: 780153 - DNA, 22 bp, Artificial Sequence
  chemically synthesized
atgcaatacagagacagacaag

SEQ ID NO: 780154 - DNA, 22 bp, Artificial Sequence
  chemically synthesized
cagtacacaacattatatgtct

SEQ ID NO: 780155 - DNA, 22 bp, Artificial Sequence
  chemically synthesized
tgcagtacacaacattatatgt

SEQ ID NO: 780156 - DNA, 22 bp, Artificial Sequence
  chemically synthesized
aattctgcagtacacaacatta

SEQ ID NO: 780157 - DNA, 22 bp, Artificial Sequence
  chemically synthesized
gaattctgcagtacacaacatt

SEQ ID NO: 780158 - DNA, 22 bp, Artificial Sequence
  chemically synthesized
gagtacttgaattctgcagtac

SEQ ID NO: 780159 - DNA, 22 bp, Artificial Sequence
  chemically synthesized
tgaagattagagtacttgaatt

SEQ ID NO: 780160 - DNA, 22 bp, Artificial Sequence
  chemically synthesized
tgtactgcagaattcaagtact

SEQ ID NO: 780161 - DNA, 22 bp, Artificial Sequence
  chemically synthesized
cagaattcaagtactctaatct

SEQ ID NO: 780162 - DNA, 22 bp, Artificial Sequence
  chemically synthesized
aagtactctaatcttcacagtc

SEQ ID NO: 780163 - DNA, 22 bp, Artificial Sequence
  chemically synthesized
gaatagagtgtaagcagactgt

SEQ ID NO: 780164 - DNA, 22 bp, Artificial Sequence
  chemically synthesized
agaatagagtgtaagcagactg

SEQ ID NO: 780165 - DNA, 22 bp, Artificial Sequence
  chemically synthesized
taatcttcacagtctgcttaca

SEQ ID NO: 780166 - DNA, 22 bp, Artificial Sequence
  chemically synthesized
atcttcacagtctgcttacact

SEQ ID NO: 780167 - DNA, 22 bp, Artificial Sequence
  chemically synthesized
acacgcttagaatagagtgtaa

SEQ ID NO: 780168 - DNA, 22 bp, Artificial Sequence
  chemically synthesized
cacagtctgcttacactctatt

SEQ ID NO: 780169 - DNA, 22 bp, Artificial Sequence
  chemically synthesized
acagtctgcttacactctattc

SEQ ID NO: 780170 - DNA, 22 bp, Artificial Sequence
  chemically synthesized
agttaacacgcttagaatagag

SEQ ID NO: 780171 - DNA, 22 bp, Artificial Sequence
  chemically synthesized
cttacactctattctaagcgtg

SEQ ID NO: 780172 - DNA, 22 bp, Artificial Sequence
  chemically synthesized
acactctattctaagcgtgtta

SEQ ID NO: 780173 - DNA, 22 bp, Artificial Sequence
  chemically synthesized
cactctattctaagcgtgttaa

SEQ ID NO: 780174 - DNA, 22 bp, Artificial Sequence
  chemically synthesized
tattctaagcgtgttaacttag

SEQ ID NO: 780175 - DNA, 22 bp, Artificial Sequence
  chemically synthesized
ttctaagcgtgttaacttagca

SEQ ID NO: 780176 - DNA, 22 bp, Artificial Sequence
  chemically synthesized
taagcgtgttaacttagcacat

SEQ ID NO: 780177 - DNA, 22 bp, Artificial Sequence
  chemically synthesized
agcgtgttaacttagcacatat

SEQ ID NO: 780178 - DNA, 22 bp, Artificial Sequence
  chemically synthesized
acttagcacatatctttcccgt

SEQ ID NO: 780179 - DNA, 22 bp, Artificial Sequence
  chemically synthesized
agcacatatctttcccgtttgc

SEQ ID NO: 780180 - DNA, 22 bp, Artificial Sequence
  chemically synthesized
gcacatatctttcccgtttgct

SEQ ID NO: 780181 - DNA, 22 bp, Artificial Sequence
  chemically synthesized
aaatcacagtgagaagcaaacg

SEQ ID NO: 780182 - DNA, 22 bp, Artificial Sequence
  chemically synthesized
ttaaaatcacagtgagaagcaa

SEQ ID NO: 780183 - DNA, 22 bp, Artificial Sequence
  chemically synthesized
attaaaatcacagtgagaagca

SEQ ID NO: 780184 - DNA, 22 bp, Artificial Sequence
  chemically synthesized
tcccgtttgcttctcactgtga

SEQ ID NO: 780185 - DNA, 22 bp, Artificial Sequence
  chemically synthesized
cccgtttgcttctcactgtgat

SEQ ID NO: 780186 - DNA, 22 bp, Artificial Sequence
  chemically synthesized
ccgtttgcttctcactgtgatt

SEQ ID NO: 780187 - DNA, 22 bp, Artificial Sequence
  chemically synthesized
gcttctcactgtgattttaata

SEQ ID NO: 780188 - DNA, 22 bp, Artificial Sequence
  chemically synthesized
aatcacagagtttattaaaatc

SEQ ID NO: 780189 - DNA, 22 bp, Artificial Sequence
  chemically synthesized
cttctcactgtgattttaataa

SEQ ID NO: 780190 - DNA, 22 bp, Artificial Sequence
  chemically synthesized
gaatcacagagtttattaaaat

SEQ ID NO: 780191 - DNA, 22 bp, Artificial Sequence
  chemically synthesized
ctcactgtgattttaataaact

SEQ ID NO: 780192 - DNA, 22 bp, Artificial Sequence
  chemically synthesized
tcactgtgattttaataaactc

SEQ ID NO: 780193 - DNA, 22 bp, Artificial Sequence
  chemically synthesized
actgtgattttaataaactctg

SEQ ID NO: 780194 - DNA, 22 bp, Artificial Sequence
  chemically synthesized
aaatacttgaatcacagagttt

SEQ ID NO: 780195 - DNA, 22 bp, Artificial Sequence
  chemically synthesized
tgattttaataaactctgtgat

SEQ ID NO: 780196 - DNA, 22 bp, Artificial Sequence
  chemically synthesized
taataaactctgtgattcaagt

SEQ ID NO: 780197 - DNA, 22 bp, Artificial Sequence
  chemically synthesized
aataaactctgtgattcaagta

SEQ ID NO: 780198 - DNA, 22 bp, Artificial Sequence
  chemically synthesized
ataaactctgtgattcaagtat

SEQ ID NO: 780199 - DNA, 22 bp, Artificial Sequence
  chemically synthesized
atagaccaaattaaaatacttg

SEQ ID NO: 780200 - DNA, 22 bp, Artificial Sequence
  chemically synthesized
tgtgattcaagtattttaattt

SEQ ID NO: 780201 - DNA, 22 bp, Artificial Sequence
  chemically synthesized
tgattcaagtattttaatttgg

SEQ ID NO: 780202 - DNA, 22 bp, Artificial Sequence
  chemically synthesized
aagtattttaatttggtctatg

SEQ ID NO: 780203 - DNA, 22 bp, Artificial Sequence
  chemically synthesized
taatttggtctatgagcctttc

SEQ ID NO: 780204 - DNA, 22 bp, Artificial Sequence
  chemically synthesized
aatttggtctatgagcctttct

SEQ ID NO: 780205 - DNA, 22 bp, Artificial Sequence
  chemically synthesized
atttggtctatgagcctttctg

SEQ ID NO: 780206 - DNA, 22 bp, Artificial Sequence
  chemically synthesized
tccaaatcatgaaacagaaagg

SEQ ID NO: 780207 - DNA, 22 bp, Artificial Sequence
  chemically synthesized
ggtctatgagcctttctgtttc

SEQ ID NO: 780208 - DNA, 22 bp, Artificial Sequence
  chemically synthesized
gtctatgagcctttctgtttca

SEQ ID NO: 780209 - DNA, 22 bp, Artificial Sequence
  chemically synthesized
tgagcctttctgtttcatgatt

SEQ ID NO: 780210 - DNA, 22 bp, Artificial Sequence
  chemically synthesized
ccaggcagcctatccaaatcat

SEQ ID NO: 780211 - DNA, 22 bp, Artificial Sequence
  chemically synthesized
tctgtttcatgatttggatagg

SEQ ID NO: 780212 - DNA, 22 bp, Artificial Sequence
  chemically synthesized
ctgtttcatgatttggataggc

SEQ ID NO: 780213 - DNA, 22 bp, Artificial Sequence
  chemically synthesized
tgtttcatgatttggataggct

SEQ ID NO: 780214 - DNA, 22 bp, Artificial Sequence
  chemically synthesized
tttcatgatttggataggctgc

SEQ ID NO: 780215 - DNA, 22 bp, Artificial Sequence
  chemically synthesized
aagtatactaccaggcagccta

SEQ ID NO: 780216 - DNA, 22 bp, Artificial Sequence
  chemically synthesized
catgatttggataggctgcctg

SEQ ID NO: 780217 - DNA, 22 bp, Artificial Sequence
  chemically synthesized
caagtatactaccaggcagcct

SEQ ID NO: 780218 - DNA, 22 bp, Artificial Sequence
  chemically synthesized
atgatttggataggctgcctgg

SEQ ID NO: 780219 - DNA, 22 bp, Artificial Sequence
  chemically synthesized
ggataggctgcctggtagtata

SEQ ID NO: 780220 - DNA, 22 bp, Artificial Sequence
  chemically synthesized
gataggctgcctggtagtatac

SEQ ID NO: 780221 - DNA, 22 bp, Artificial Sequence
  chemically synthesized
aatgcaatgatggccttcaagt

SEQ ID NO: 780222 - DNA, 22 bp, Artificial Sequence
  chemically synthesized
cctggtagtatacttgaaggcc

SEQ ID NO: 780223 - DNA, 22 bp, Artificial Sequence
  chemically synthesized
aaatgcaatgatggccttcaag

SEQ ID NO: 780224 - DNA, 22 bp, Artificial Sequence
  chemically synthesized
cttaaatgcaatgatggccttc

SEQ ID NO: 780225 - DNA, 22 bp, Artificial Sequence
  chemically synthesized
gtagtatacttgaaggccatca

SEQ ID NO: 780226 - DNA, 22 bp, Artificial Sequence
  chemically synthesized
gggaattacttaaatgcaatga

SEQ ID NO: 780227 - DNA, 22 bp, Artificial Sequence
  chemically synthesized
gaaggccatcattgcatttaag

SEQ ID NO: 780228 - DNA, 22 bp, Artificial Sequence
  chemically synthesized
aaggccatcattgcatttaagt

SEQ ID NO: 780229 - DNA, 22 bp, Artificial Sequence
  chemically synthesized
tcatctggggaattacttaaat

SEQ ID NO: 780230 - DNA, 22 bp, Artificial Sequence
  chemically synthesized
tgtcatctggggaattacttaa

SEQ ID NO: 780231 - DNA, 22 bp, Artificial Sequence
  chemically synthesized
ctctgtcatctggggaattact

SEQ ID NO: 780232 - DNA, 22 bp, Artificial Sequence
  chemically synthesized
cctctgtcatctggggaattac

SEQ ID NO: 780233 - DNA, 22 bp, Artificial Sequence
  chemically synthesized
catttaagtaattccccagatg

SEQ ID NO: 780234 - DNA, 22 bp, Artificial Sequence
  chemically synthesized
aagtaattccccagatgacaga

SEQ ID NO: 780235 - DNA, 22 bp, Artificial Sequence
  chemically synthesized
tgataaacttcctctgtcatct

SEQ ID NO: 780236 - DNA, 22 bp, Artificial Sequence
  chemically synthesized
agtaattccccagatgacagag

SEQ ID NO: 780237 - DNA, 22 bp, Artificial Sequence
  chemically synthesized
acctatgataaacttcctctgt

SEQ ID NO: 780238 - DNA, 22 bp, Artificial Sequence
  chemically synthesized
cacctatgataaacttcctctg

SEQ ID NO: 780239 - DNA, 22 bp, Artificial Sequence
  chemically synthesized
cccagatgacagaggaagttta

SEQ ID NO: 780240 - DNA, 22 bp, Artificial Sequence
  chemically synthesized
aaatttcacctatgataaactt

SEQ ID NO: 780241 - DNA, 22 bp, Artificial Sequence
  chemically synthesized
aaaatttcacctatgataaact

SEQ ID NO: 780242 - DNA, 22 bp, Artificial Sequence
  chemically synthesized
taaaatttcacctatgataaac

SEQ ID NO: 780243 - DNA, 22 bp, Artificial Sequence
  chemically synthesized
ttaaaatttcacctatgataaa

SEQ ID NO: 780244 - DNA, 22 bp, Artificial Sequence
  chemically synthesized
tcataaatcttttaaaatttca

SEQ ID NO: 780245 - DNA, 22 bp, Artificial Sequence
  chemically synthesized
atcataggtgaaattttaaaag

SEQ ID NO: 780246 - DNA, 22 bp, Artificial Sequence
  chemically synthesized
tcataggtgaaattttaaaaga

SEQ ID NO: 780247 - DNA, 22 bp, Artificial Sequence
  chemically synthesized
acctatcataaatcttttaaaa

SEQ ID NO: 780248 - DNA, 22 bp, Artificial Sequence
  chemically synthesized
cacctatcataaatcttttaaa

SEQ ID NO: 780249 - DNA, 22 bp, Artificial Sequence
  chemically synthesized
aacttcacctatcataaatctt

SEQ ID NO: 780250 - DNA, 22 bp, Artificial Sequence
  chemically synthesized
aaacttcacctatcataaatct

SEQ ID NO: 780251 - DNA, 22 bp, Artificial Sequence
  chemically synthesized
taaacttcacctatcataaatc

SEQ ID NO: 780252 - DNA, 22 bp, Artificial Sequence
  chemically synthesized
ttaaacttcacctatcataaat

SEQ ID NO: 780253 - DNA, 22 bp, Artificial Sequence
  chemically synthesized
tttaaacttcacctatcataaa

SEQ ID NO: 780254 - DNA, 22 bp, Artificial Sequence
  chemically synthesized
ttttaaacttcacctatcataa

SEQ ID NO: 780255 - DNA, 22 bp, Artificial Sequence
  chemically synthesized
tttttaaacttcacctatcata

SEQ ID NO: 780256 - DNA, 22 bp, Artificial Sequence
  chemically synthesized
taaaagatttatgataggtgaa

SEQ ID NO: 780257 - DNA, 22 bp, Artificial Sequence
  chemically synthesized
ttttttttaaacttcacctatc

SEQ ID NO: 780258 - DNA, 22 bp, Artificial Sequence
  chemically synthesized
aaaagatttatgataggtgaag

SEQ ID NO: 780259 - DNA, 22 bp, Artificial Sequence
  chemically synthesized
aaagatttatgataggtgaagt

SEQ ID NO: 780260 - DNA, 22 bp, Artificial Sequence
  chemically synthesized
ttattttttttaaacttcacct

SEQ ID NO: 780261 - DNA, 22 bp, Artificial Sequence
  chemically synthesized
ttattattttttttaaacttca

SEQ ID NO: 780262 - DNA, 22 bp, Artificial Sequence
  chemically synthesized
atgataggtgaagtttaaaaaa

SEQ ID NO: 780263 - DNA, 22 bp, Artificial Sequence
  chemically synthesized
tgataggtgaagtttaaaaaaa

SEQ ID NO: 780264 - DNA, 22 bp, Artificial Sequence
  chemically synthesized
cgcccggccaattattattatt

SEQ ID NO: 780265 - DNA, 22 bp, Artificial Sequence
  chemically synthesized
aaaaaaaataataataattggc

SEQ ID NO: 780266 - DNA, 22 bp, Artificial Sequence
  chemically synthesized
aaaaaaataataataattggcc

SEQ ID NO: 780267 - DNA, 22 bp, Artificial Sequence
  chemically synthesized
caggcgtgagccactgcgcccg

SEQ ID NO: 780268 - DNA, 22 bp, Artificial Sequence
  chemically synthesized
ggattacaggcgtgagccactg

SEQ ID NO: 780269 - DNA, 22 bp, Artificial Sequence
  chemically synthesized
gccgggcgcagtggctcacgcc

SEQ ID NO: 780270 - DNA, 22 bp, Artificial Sequence
  chemically synthesized
ccaaagtgctgggattacaggc

SEQ ID NO: 780271 - DNA, 22 bp, Artificial Sequence
  chemically synthesized
ggcctcccaaagtgctgggatt

SEQ ID NO: 780272 - DNA, 22 bp, Artificial Sequence
  chemically synthesized
acgcctgtaatcccagcacttt

SEQ ID NO: 780273 - DNA, 22 bp, Artificial Sequence
  chemically synthesized
taatcccagcactttgggaggc

SEQ ID NO: 780274 - DNA, 22 bp, Artificial Sequence
  chemically synthesized
gtgatccacccacctcggcctc

SEQ ID NO: 780275 - DNA, 22 bp, Artificial Sequence
  chemically synthesized
acctcgtgatccacccacctcg

SEQ ID NO: 780276 - DNA, 22 bp, Artificial Sequence
  chemically synthesized
ctgacctcgtgatccacccacc

SEQ ID NO: 780277 - DNA, 22 bp, Artificial Sequence
  chemically synthesized
tgggaggccgaggtgggtggat

SEQ ID NO: 780278 - DNA, 22 bp, Artificial Sequence
  chemically synthesized
gggaggccgaggtgggtggatc

SEQ ID NO: 780279 - DNA, 22 bp, Artificial Sequence
  chemically synthesized
ggaggccgaggtgggtggatca

SEQ ID NO: 780280 - DNA, 22 bp, Artificial Sequence
  chemically synthesized
gatctcctgacctcgtgatcca

SEQ ID NO: 780281 - DNA, 22 bp, Artificial Sequence
  chemically synthesized
gccaggatggtctcgatctcct

SEQ ID NO: 780282 - DNA, 22 bp, Artificial Sequence
  chemically synthesized
ttagccaggatggtctcgatct

SEQ ID NO: 780283 - DNA, 22 bp, Artificial Sequence
  chemically synthesized
gttagccaggatggtctcgatc

SEQ ID NO: 780284 - DNA, 22 bp, Artificial Sequence
  chemically synthesized
cttgttagccaggatggtctcg

SEQ ID NO: 780285 - DNA, 22 bp, Artificial Sequence
  chemically synthesized
tccttgttagccaggatggtct

SEQ ID NO: 780286 - DNA, 22 bp, Artificial Sequence
  chemically synthesized
ctccttgttagccaggatggtc

SEQ ID NO: 780287 - DNA, 22 bp, Artificial Sequence
  chemically synthesized
gtagagatggggtttctccttg

SEQ ID NO: 780288 - DNA, 22 bp, Artificial Sequence
  chemically synthesized
agtagagatggggtttctcctt

SEQ ID NO: 780289 - DNA, 22 bp, Artificial Sequence
  chemically synthesized
tagtagagatggggtttctcct

SEQ ID NO: 780290 - DNA, 22 bp, Artificial Sequence
  chemically synthesized
ttagtagagatggggtttctcc

SEQ ID NO: 780291 - DNA, 22 bp, Artificial Sequence
  chemically synthesized
gctaacaaggagaaaccccatc

SEQ ID NO: 780292 - DNA, 22 bp, Artificial Sequence
  chemically synthesized
tgcatttttagtagagatgggg

SEQ ID NO: 780293 - DNA, 22 bp, Artificial Sequence
  chemically synthesized
acaaggagaaaccccatctcta

SEQ ID NO: 780294 - DNA, 22 bp, Artificial Sequence
  chemically synthesized
gtgcatttttagtagagatggg

SEQ ID NO: 780295 - DNA, 22 bp, Artificial Sequence
  chemically synthesized
tgtgcatttttagtagagatgg

SEQ ID NO: 780296 - DNA, 22 bp, Artificial Sequence
  chemically synthesized
attttgtgcatttttagtagag

SEQ ID NO: 780297 - DNA, 22 bp, Artificial Sequence
  chemically synthesized
gctaattttgtgcatttttagt

SEQ ID NO: 780298 - DNA, 22 bp, Artificial Sequence
  chemically synthesized
tactaaaaatgcacaaaattag

SEQ ID NO: 780299 - DNA, 22 bp, Artificial Sequence
  chemically synthesized
ccaccatgtctggctaattttg

SEQ ID NO: 780300 - DNA, 22 bp, Artificial Sequence
  chemically synthesized
ctaaaaatgcacaaaattagcc

SEQ ID NO: 780301 - DNA, 22 bp, Artificial Sequence
  chemically synthesized
aaaatgcacaaaattagccaga

SEQ ID NO: 780302 - DNA, 22 bp, Artificial Sequence
  chemically synthesized
gtaccacaggcgcctgccacca

SEQ ID NO: 780303 - DNA, 22 bp, Artificial Sequence
  chemically synthesized
gccagacatggtggcaggcgcc

SEQ ID NO: 780304 - DNA, 22 bp, Artificial Sequence
  chemically synthesized
ccgagcagctggtaccacaggc

SEQ ID NO: 780305 - DNA, 22 bp, Artificial Sequence
  chemically synthesized
agcctcccgagcagctggtacc

SEQ ID NO: 780306 - DNA, 22 bp, Artificial Sequence
  chemically synthesized
cctcagcctcccgagcagctgg

SEQ ID NO: 780307 - DNA, 22 bp, Artificial Sequence
  chemically synthesized
ctgcctcagcctcccgagcagc

SEQ ID NO: 780308 - DNA, 22 bp, Artificial Sequence
  chemically synthesized
tcctgcctcagcctcccgagca

SEQ ID NO: 780309 - DNA, 22 bp, Artificial Sequence
  chemically synthesized
tggtaccagctgctcgggaggc

SEQ ID NO: 780310 - DNA, 22 bp, Artificial Sequence
  chemically synthesized
acgccattctcctgcctcagcc

SEQ ID NO: 780311 - DNA, 22 bp, Artificial Sequence
  chemically synthesized
ctcgggaggctgaggcaggaga

SEQ ID NO: 780312 - DNA, 22 bp, Artificial Sequence
  chemically synthesized
ggttcacgccattctcctgcct

SEQ ID NO: 780313 - DNA, 22 bp, Artificial Sequence
  chemically synthesized
gggaggctgaggcaggagaatg

SEQ ID NO: 780314 - DNA, 22 bp, Artificial Sequence
  chemically synthesized
ctgggttcacgccattctcctg

SEQ ID NO: 780315 - DNA, 22 bp, Artificial Sequence
  chemically synthesized
cacctcctgggttcacgccatt

SEQ ID NO: 780316 - DNA, 22 bp, Artificial Sequence
  chemically synthesized
aggcaggagaatggcgtgaacc

SEQ ID NO: 780317 - DNA, 22 bp, Artificial Sequence
  chemically synthesized
caagctccacctcctgggttca

SEQ ID NO: 780318 - DNA, 22 bp, Artificial Sequence
  chemically synthesized
actgcaagctccacctcctggg

SEQ ID NO: 780319 - DNA, 22 bp, Artificial Sequence
  chemically synthesized
ggctcactgcaagctccacctc

SEQ ID NO: 780320 - DNA, 22 bp, Artificial Sequence
  chemically synthesized
gagtgcagtggtgtgatctcgg

SEQ ID NO: 780321 - DNA, 22 bp, Artificial Sequence
  chemically synthesized
gcagtgagccgagatcacacca

SEQ ID NO: 780322 - DNA, 22 bp, Artificial Sequence
  chemically synthesized
cagtgagccgagatcacaccac

SEQ ID NO: 780323 - DNA, 22 bp, Artificial Sequence
  chemically synthesized
cccaggctagagtgcagtggtg

SEQ ID NO: 780324 - DNA, 22 bp, Artificial Sequence
  chemically synthesized
ttacccaggctagagtgcagtg

SEQ ID NO: 780325 - DNA, 22 bp, Artificial Sequence
  chemically synthesized
tgttacccaggctagagtgcag

SEQ ID NO: 780326 - DNA, 22 bp, Artificial Sequence
  chemically synthesized
actctgttacccaggctagagt

SEQ ID NO: 780327 - DNA, 22 bp, Artificial Sequence
  chemically synthesized
cactctagcctgggtaacagag

SEQ ID NO: 780328 - DNA, 22 bp, Artificial Sequence
  chemically synthesized
atacagagtctcactctgttac

SEQ ID NO: 780329 - DNA, 22 bp, Artificial Sequence
  chemically synthesized
gatacagagtctcactctgtta

SEQ ID NO: 780330 - DNA, 22 bp, Artificial Sequence
  chemically synthesized
tgatacagagtctcactctgtt

SEQ ID NO: 780331 - DNA, 22 bp, Artificial Sequence
  chemically synthesized
ttgatacagagtctcactctgt

SEQ ID NO: 780332 - DNA, 22 bp, Artificial Sequence
  chemically synthesized
tagcctgggtaacagagtgaga

SEQ ID NO: 780333 - DNA, 22 bp, Artificial Sequence
  chemically synthesized
tttgatacagagtctcactctg

SEQ ID NO: 780334 - DNA, 22 bp, Artificial Sequence
  chemically synthesized
ttttgatacagagtctcactct

SEQ ID NO: 780335 - DNA, 22 bp, Artificial Sequence
  chemically synthesized
gcctgggtaacagagtgagact

SEQ ID NO: 780336 - DNA, 22 bp, Artificial Sequence
  chemically synthesized
tttttgatacagagtctcactc

SEQ ID NO: 780337 - DNA, 22 bp, Artificial Sequence
  chemically synthesized
ttttttgatacagagtctcact

SEQ ID NO: 780338 - DNA, 22 bp, Artificial Sequence
  chemically synthesized
tttttttgatacagagtctcac

SEQ ID NO: 780339 - DNA, 22 bp, Artificial Sequence
  chemically synthesized
ttttttttgatacagagtctca

SEQ ID NO: 780340 - DNA, 22 bp, Artificial Sequence
  chemically synthesized
tttttttttgatacagagtctc

SEQ ID NO: 780341 - DNA, 22 bp, Artificial Sequence
  chemically synthesized
ggtaacagagtgagactctgta

SEQ ID NO: 780342 - DNA, 22 bp, Artificial Sequence
  chemically synthesized
ttttttttttgatacagagtct

SEQ ID NO: 780343 - DNA, 22 bp, Artificial Sequence
  chemically synthesized
tttttttttttgatacagagtc

SEQ ID NO: 780344 - DNA, 22 bp, Artificial Sequence
  chemically synthesized
ttttttttttttgatacagagt

SEQ ID NO: 780345 - DNA, 22 bp, Artificial Sequence
  chemically synthesized
tttttttttttttgatacagag

SEQ ID NO: 780346 - DNA, 22 bp, Artificial Sequence
  chemically synthesized
tttttttttttttttgatacag

SEQ ID NO: 780347 - DNA, 22 bp, Artificial Sequence
  chemically synthesized
ctttttttttttttttgataca

SEQ ID NO: 780348 - DNA, 22 bp, Artificial Sequence
  chemically synthesized
tctttttttttttttttgatac

SEQ ID NO: 780349 - DNA, 22 bp, Artificial Sequence
  chemically synthesized
ttctttttttttttttttgata

SEQ ID NO: 780350 - DNA, 22 bp, Artificial Sequence
  chemically synthesized
tttctttttttttttttttgat

SEQ ID NO: 780351 - DNA, 22 bp, Artificial Sequence
  chemically synthesized
ttttctttttttttttttttga

SEQ ID NO: 780352 - DNA, 22 bp, Artificial Sequence
  chemically synthesized
tttttctttttttttttttttg

SEQ ID NO: 780353 - DNA, 22 bp, Artificial Sequence
  chemically synthesized
ttttttcttttttttttttttt

SEQ ID NO: 780354 - DNA, 22 bp, Artificial Sequence
  chemically synthesized
tttttttttctttttttttttt

SEQ ID NO: 780355 - DNA, 22 bp, Artificial Sequence
  chemically synthesized
tgtatcaaaaaaaaaaaaaaag

SEQ ID NO: 780356 - DNA, 22 bp, Artificial Sequence
  chemically synthesized
ttatttttttttcttttttttt

SEQ ID NO: 780357 - DNA, 22 bp, Artificial Sequence
  chemically synthesized
tatcaaaaaaaaaaaaaaagaa

SEQ ID NO: 780358 - DNA, 22 bp, Artificial Sequence
  chemically synthesized
ctattatttttttttctttttt

SEQ ID NO: 780359 - DNA, 22 bp, Artificial Sequence
  chemically synthesized
agttactattatttttttttct

SEQ ID NO: 780360 - DNA, 22 bp, Artificial Sequence
  chemically synthesized
aagttactattatttttttttc

SEQ ID NO: 780361 - DNA, 22 bp, Artificial Sequence
  chemically synthesized
aaaaatttaagttactattatt

SEQ ID NO: 780362 - DNA, 22 bp, Artificial Sequence
  chemically synthesized
gaaaaatttaagttactattat

SEQ ID NO: 780363 - DNA, 22 bp, Artificial Sequence
  chemically synthesized
ccccttgaaaaatttaagttac

SEQ ID NO: 780364 - DNA, 22 bp, Artificial Sequence
  chemically synthesized
cccccttgaaaaatttaagtta

SEQ ID NO: 780365 - DNA, 22 bp, Artificial Sequence
  chemically synthesized
tcccccttgaaaaatttaagtt

SEQ ID NO: 780366 - DNA, 22 bp, Artificial Sequence
  chemically synthesized
ttcccccttgaaaaatttaagt

SEQ ID NO: 780367 - DNA, 22 bp, Artificial Sequence
  chemically synthesized
cgaggtgtttttcccccttgaa

SEQ ID NO: 780368 - DNA, 22 bp, Artificial Sequence
  chemically synthesized
aaatttttcaagggggaaaaac

SEQ ID NO: 780369 - DNA, 22 bp, Artificial Sequence
  chemically synthesized
aatttttcaagggggaaaaaca

SEQ ID NO: 780370 - DNA, 22 bp, Artificial Sequence
  chemically synthesized
atcaactccgaggtgtttttcc

SEQ ID NO: 780371 - DNA, 22 bp, Artificial Sequence
  chemically synthesized
catcaactccgaggtgtttttc

SEQ ID NO: 780372 - DNA, 22 bp, Artificial Sequence
  chemically synthesized
ttcaagggggaaaaacacctcg

SEQ ID NO: 780373 - DNA, 22 bp, Artificial Sequence
  chemically synthesized
tcaagggggaaaaacacctcgg

SEQ ID NO: 780374 - DNA, 22 bp, Artificial Sequence
  chemically synthesized
caagggggaaaaacacctcgga

SEQ ID NO: 780375 - DNA, 22 bp, Artificial Sequence
  chemically synthesized
aagggggaaaaacacctcggag

SEQ ID NO: 780376 - DNA, 22 bp, Artificial Sequence
  chemically synthesized
aacgaatgatcttcatcaactc

SEQ ID NO: 780377 - DNA, 22 bp, Artificial Sequence
  chemically synthesized
agcaaattcaacgaatgatctt

SEQ ID NO: 780378 - DNA, 22 bp, Artificial Sequence
  chemically synthesized
ggagttgatgaagatcattcgt

SEQ ID NO: 780379 - DNA, 22 bp, Artificial Sequence
  chemically synthesized
atgaagatcattcgttgaattt

SEQ ID NO: 780380 - DNA, 22 bp, Artificial Sequence
  chemically synthesized
aaatgtagcaaatgattaagca

SEQ ID NO: 780381 - DNA, 22 bp, Artificial Sequence
  chemically synthesized
aaaatgtagcaaatgattaagc

SEQ ID NO: 780382 - DNA, 22 bp, Artificial Sequence
  chemically synthesized
taaaatgtagcaaatgattaag

SEQ ID NO: 780383 - DNA, 22 bp, Artificial Sequence
  chemically synthesized
gttgaatttgcttaatcatttg

SEQ ID NO: 780384 - DNA, 22 bp, Artificial Sequence
  chemically synthesized
tttaaaatgtagcaaatgatta

SEQ ID NO: 780385 - DNA, 22 bp, Artificial Sequence
  chemically synthesized
aatttgcttaatcatttgctac

SEQ ID NO: 780386 - DNA, 22 bp, Artificial Sequence
  chemically synthesized
attctttaaaatgtagcaaatg

SEQ ID NO: 780387 - DNA, 22 bp, Artificial Sequence
  chemically synthesized
gcttaatcatttgctacatttt

SEQ ID NO: 780388 - DNA, 22 bp, Artificial Sequence
  chemically synthesized
cttaatcatttgctacatttta

SEQ ID NO: 780389 - DNA, 22 bp, Artificial Sequence
  chemically synthesized
aatcatttgctacattttaaag

SEQ ID NO: 780390 - DNA, 22 bp, Artificial Sequence
  chemically synthesized
atcatttgctacattttaaaga

SEQ ID NO: 780391 - DNA, 22 bp, Artificial Sequence
  chemically synthesized
acaggaagtcaagttcattctt

SEQ ID NO: 780392 - DNA, 22 bp, Artificial Sequence
  chemically synthesized
gctacattttaaagaatgaact

SEQ ID NO: 780393 - DNA, 22 bp, Artificial Sequence
  chemically synthesized
cacaggaagtcaagttcattct

SEQ ID NO: 780394 - DNA, 22 bp, Artificial Sequence
  chemically synthesized
ctacattttaaagaatgaactt

SEQ ID NO: 780395 - DNA, 22 bp, Artificial Sequence
  chemically synthesized
cattttaaagaatgaacttgac

SEQ ID NO: 780396 - DNA, 22 bp, Artificial Sequence
  chemically synthesized
acttcacaggaagtcaagttca

SEQ ID NO: 780397 - DNA, 22 bp, Artificial Sequence
  chemically synthesized
cacttcacaggaagtcaagttc

SEQ ID NO: 780398 - DNA, 22 bp, Artificial Sequence
  chemically synthesized
tcacttcacaggaagtcaagtt

SEQ ID NO: 780399 - DNA, 22 bp, Artificial Sequence
  chemically synthesized
ttcacttcacaggaagtcaagt

SEQ ID NO: 780400 - DNA, 22 bp, Artificial Sequence
  chemically synthesized
tttcacttcacaggaagtcaag

SEQ ID NO: 780401 - DNA, 22 bp, Artificial Sequence
  chemically synthesized
taaagaatgaacttgacttcct

SEQ ID NO: 780402 - DNA, 22 bp, Artificial Sequence
  chemically synthesized
ttttcacttcacaggaagtcaa

SEQ ID NO: 780403 - DNA, 22 bp, Artificial Sequence
  chemically synthesized
aaagaatgaacttgacttcctg

SEQ ID NO: 780404 - DNA, 22 bp, Artificial Sequence
  chemically synthesized
aagaatgaacttgacttcctgt

SEQ ID NO: 780405 - DNA, 22 bp, Artificial Sequence
  chemically synthesized
cttttttcacttcacaggaagt

SEQ ID NO: 780406 - DNA, 22 bp, Artificial Sequence
  chemically synthesized
gcttttttcacttcacaggaag

SEQ ID NO: 780407 - DNA, 22 bp, Artificial Sequence
  chemically synthesized
tgcttttttcacttcacaggaa

SEQ ID NO: 780408 - DNA, 22 bp, Artificial Sequence
  chemically synthesized
ttgcttttttcacttcacagga

SEQ ID NO: 780409 - DNA, 22 bp, Artificial Sequence
  chemically synthesized
tttgcttttttcacttcacagg

SEQ ID NO: 780410 - DNA, 22 bp, Artificial Sequence
  chemically synthesized
ttttgcttttttcacttcacag

SEQ ID NO: 780411 - DNA, 22 bp, Artificial Sequence
  chemically synthesized
tttttgcttttttcacttcaca

SEQ ID NO: 780412 - DNA, 22 bp, Artificial Sequence
  chemically synthesized
ttttttgcttttttcacttcac

SEQ ID NO: 780413 - DNA, 22 bp, Artificial Sequence
  chemically synthesized
tttttttgcttttttcacttca

SEQ ID NO: 780414 - DNA, 22 bp, Artificial Sequence
  chemically synthesized
ttttttttgcttttttcacttc

SEQ ID NO: 780415 - DNA, 22 bp, Artificial Sequence
  chemically synthesized
tttttttttgcttttttcactt

SEQ ID NO: 780416 - DNA, 22 bp, Artificial Sequence
  chemically synthesized
gacttcctgtgaagtgaaaaaa

SEQ ID NO: 780417 - DNA, 22 bp, Artificial Sequence
  chemically synthesized
ttttttttttgcttttttcact

SEQ ID NO: 780418 - DNA, 22 bp, Artificial Sequence
  chemically synthesized
acttcctgtgaagtgaaaaaag

SEQ ID NO: 780419 - DNA, 22 bp, Artificial Sequence
  chemically synthesized
tttttttttttgcttttttcac

SEQ ID NO: 780420 - DNA, 22 bp, Artificial Sequence
  chemically synthesized
ttttttttttttgcttttttca

SEQ ID NO: 780421 - DNA, 22 bp, Artificial Sequence
  chemically synthesized
tttttttttttttgcttttttc

SEQ ID NO: 780422 - DNA, 22 bp, Artificial Sequence
  chemically synthesized
ttttttttttttttgctttttt

SEQ ID NO: 780423 - DNA, 22 bp, Artificial Sequence
  chemically synthesized
cctgtgaagtgaaaaaagcaaa

SEQ ID NO: 780424 - DNA, 22 bp, Artificial Sequence
  chemically synthesized
ctgtgaagtgaaaaaagcaaaa

SEQ ID NO: 780425 - DNA, 22 bp, Artificial Sequence
  chemically synthesized
tgaagtgaaaaaagcaaaaaaa

SEQ ID NO: 780426 - DNA, 22 bp, Artificial Sequence
  chemically synthesized
aagatttttttttttttttttg

SEQ ID NO: 780427 - DNA, 22 bp, Artificial Sequence
  chemically synthesized
caagattttttttttttttttt

SEQ ID NO: 780428 - DNA, 22 bp, Artificial Sequence
  chemically synthesized
agaagtcaatccatttcaagat

SEQ ID NO: 780429 - DNA, 22 bp, Artificial Sequence
  chemically synthesized
cagaagtcaatccatttcaaga

SEQ ID NO: 780430 - DNA, 22 bp, Artificial Sequence
  chemically synthesized
acaaatcatttcagaagtcaat

SEQ ID NO: 780431 - DNA, 22 bp, Artificial Sequence
  chemically synthesized
gaaatggattgacttctgaaat

SEQ ID NO: 780432 - DNA, 22 bp, Artificial Sequence
  chemically synthesized
aaatggattgacttctgaaatg

SEQ ID NO: 780433 - DNA, 22 bp, Artificial Sequence
  chemically synthesized
gatgtggcctcacaaatcattt

SEQ ID NO: 780434 - DNA, 22 bp, Artificial Sequence
  chemically synthesized
tggatgtggcctcacaaatcat

SEQ ID NO: 780435 - DNA, 22 bp, Artificial Sequence
  chemically synthesized
ctggatgtggcctcacaaatca

SEQ ID NO: 780436 - DNA, 22 bp, Artificial Sequence
  chemically synthesized
tctggatgtggcctcacaaatc

SEQ ID NO: 780437 - DNA, 22 bp, Artificial Sequence
  chemically synthesized
acttctgaaatgatttgtgagg

SEQ ID NO: 780438 - DNA, 22 bp, Artificial Sequence
  chemically synthesized
ctttctggatgtggcctcacaa

SEQ ID NO: 780439 - DNA, 22 bp, Artificial Sequence
  chemically synthesized
ctgaaatgatttgtgaggccac

SEQ ID NO: 780440 - DNA, 22 bp, Artificial Sequence
  chemically synthesized
tgaaatgatttgtgaggccaca

SEQ ID NO: 780441 - DNA, 22 bp, Artificial Sequence
  chemically synthesized
aaatgatttgtgaggccacatc

SEQ ID NO: 780442 - DNA, 22 bp, Artificial Sequence
  chemically synthesized
aattcctttctggatgtggcct

SEQ ID NO: 780443 - DNA, 22 bp, Artificial Sequence
  chemically synthesized
tcaattcctttctggatgtggc

SEQ ID NO: 780444 - DNA, 22 bp, Artificial Sequence
  chemically synthesized
ctcaattcctttctggatgtgg

SEQ ID NO: 780445 - DNA, 22 bp, Artificial Sequence
  chemically synthesized
tctcaattcctttctggatgtg

SEQ ID NO: 780446 - DNA, 22 bp, Artificial Sequence
  chemically synthesized
ttctcaattcctttctggatgt

SEQ ID NO: 780447 - DNA, 22 bp, Artificial Sequence
  chemically synthesized
tttctcaattcctttctggatg

SEQ ID NO: 780448 - DNA, 22 bp, Artificial Sequence
  chemically synthesized
gtgaggccacatccagaaagga

SEQ ID NO: 780449 - DNA, 22 bp, Artificial Sequence
  chemically synthesized
tgaggccacatccagaaaggaa

SEQ ID NO: 780450 - DNA, 22 bp, Artificial Sequence
  chemically synthesized
aagactttttctcaattccttt

SEQ ID NO: 780451 - DNA, 22 bp, Artificial Sequence
  chemically synthesized
aaagactttttctcaattcctt

SEQ ID NO: 780452 - DNA, 22 bp, Artificial Sequence
  chemically synthesized
atcatatatttaaagacttttt

SEQ ID NO: 780453 - DNA, 22 bp, Artificial Sequence
  chemically synthesized
gatcatatatttaaagactttt

SEQ ID NO: 780454 - DNA, 22 bp, Artificial Sequence
  chemically synthesized
tgatcatatatttaaagacttt

SEQ ID NO: 780455 - DNA, 22 bp, Artificial Sequence
  chemically synthesized
tttgatcatatatttaaagact

SEQ ID NO: 780456 - DNA, 22 bp, Artificial Sequence
  chemically synthesized
ctttgatcatatatttaaagac

SEQ ID NO: 780457 - DNA, 22 bp, Artificial Sequence
  chemically synthesized
agaaaaagtctttaaatatatg

SEQ ID NO: 780458 - DNA, 22 bp, Artificial Sequence
  chemically synthesized
aacatttctttgatcatatatt

SEQ ID NO: 780459 - DNA, 22 bp, Artificial Sequence
  chemically synthesized
attcaacatttctttgatcata

SEQ ID NO: 780460 - DNA, 22 bp, Artificial Sequence
  chemically synthesized
aattcaacatttctttgatcat

SEQ ID NO: 780461 - DNA, 22 bp, Artificial Sequence
  chemically synthesized
taattcaacatttctttgatca

SEQ ID NO: 780462 - DNA, 22 bp, Artificial Sequence
  chemically synthesized
ttaattcaacatttctttgatc

SEQ ID NO: 780463 - DNA, 22 bp, Artificial Sequence
  chemically synthesized
tttaattcaacatttctttgat

SEQ ID NO: 780464 - DNA, 22 bp, Artificial Sequence
  chemically synthesized
ttttaattcaacatttctttga

SEQ ID NO: 780465 - DNA, 22 bp, Artificial Sequence
  chemically synthesized
taaatatatgatcaaagaaatg

SEQ ID NO: 780466 - DNA, 22 bp, Artificial Sequence
  chemically synthesized
aaatatatgatcaaagaaatgt

SEQ ID NO: 780467 - DNA, 22 bp, Artificial Sequence
  chemically synthesized
aatatatgatcaaagaaatgtt

SEQ ID NO: 780468 - DNA, 22 bp, Artificial Sequence
  chemically synthesized
ggtttttttaattcaacatttc

SEQ ID NO: 780469 - DNA, 22 bp, Artificial Sequence
  chemically synthesized
gggtttttttaattcaacattt

SEQ ID NO: 780470 - DNA, 22 bp, Artificial Sequence
  chemically synthesized
aattaaaaaaacccaagcatca

SEQ ID NO: 780471 - DNA, 22 bp, Artificial Sequence
  chemically synthesized
aaaaaacccaagcatcatattc

SEQ ID NO: 780472 - DNA, 22 bp, Artificial Sequence
  chemically synthesized
gaacgaacgtgtgaaaatgagc

SEQ ID NO: 780473 - DNA, 22 bp, Artificial Sequence
  chemically synthesized
tgatgacacttgctcattttca

SEQ ID NO: 780474 - DNA, 22 bp, Artificial Sequence
  chemically synthesized
ggaacgaacgtgtgaaaatgag

SEQ ID NO: 780475 - DNA, 22 bp, Artificial Sequence
  chemically synthesized
tggaacgaacgtgtgaaaatga

SEQ ID NO: 780476 - DNA, 22 bp, Artificial Sequence
  chemically synthesized
atgacacttgctcattttcaca

SEQ ID NO: 780477 - DNA, 22 bp, Artificial Sequence
  chemically synthesized
ttggaacgaacgtgtgaaaatg

SEQ ID NO: 780478 - DNA, 22 bp, Artificial Sequence
  chemically synthesized
atatttttggaacgaacgtgtg

SEQ ID NO: 780479 - DNA, 22 bp, Artificial Sequence
  chemically synthesized
aatatttttggaacgaacgtgt

SEQ ID NO: 780480 - DNA, 22 bp, Artificial Sequence
  chemically synthesized
taatatttttggaacgaacgtg

SEQ ID NO: 780481 - DNA, 22 bp, Artificial Sequence
  chemically synthesized
gctcattttcacacgttcgttc

SEQ ID NO: 780482 - DNA, 22 bp, Artificial Sequence
  chemically synthesized
ttaatatttttggaacgaacgt

SEQ ID NO: 780483 - DNA, 22 bp, Artificial Sequence
  chemically synthesized
ctcattttcacacgttcgttcc

SEQ ID NO: 780484 - DNA, 22 bp, Artificial Sequence
  chemically synthesized
tttaatatttttggaacgaacg

SEQ ID NO: 780485 - DNA, 22 bp, Artificial Sequence
  chemically synthesized
attttcacacgttcgttccaaa

SEQ ID NO: 780486 - DNA, 22 bp, Artificial Sequence
  chemically synthesized
tgttttttaatatttttggaac

SEQ ID NO: 780487 - DNA, 22 bp, Artificial Sequence
  chemically synthesized
gtgttttttaatatttttggaa

SEQ ID NO: 780488 - DNA, 22 bp, Artificial Sequence
  chemically synthesized
tcacacgttcgttccaaaaata

SEQ ID NO: 780489 - DNA, 22 bp, Artificial Sequence
  chemically synthesized
cacacgttcgttccaaaaatat

SEQ ID NO: 780490 - DNA, 22 bp, Artificial Sequence
  chemically synthesized
ttgtgttttttaatatttttgg

SEQ ID NO: 780491 - DNA, 22 bp, Artificial Sequence
  chemically synthesized
acacgttcgttccaaaaatatt

SEQ ID NO: 780492 - DNA, 22 bp, Artificial Sequence
  chemically synthesized
atctcttgtgttttttaatatt

SEQ ID NO: 780493 - DNA, 22 bp, Artificial Sequence
  chemically synthesized
gttccaaaaatattaaaaaaca

SEQ ID NO: 780494 - DNA, 22 bp, Artificial Sequence
  chemically synthesized
caaaaatattaaaaaacacaag

SEQ ID NO: 780495 - DNA, 22 bp, Artificial Sequence
  chemically synthesized
aatgtcatcaaatgattcatct

SEQ ID NO: 780496 - DNA, 22 bp, Artificial Sequence
  chemically synthesized
aaaaacacaagagatgaatcat

SEQ ID NO: 780497 - DNA, 22 bp, Artificial Sequence
  chemically synthesized
aaatgtcatcaaatgattcatc

SEQ ID NO: 780498 - DNA, 22 bp, Artificial Sequence
  chemically synthesized
taaatgtcatcaaatgattcat

SEQ ID NO: 780499 - DNA, 22 bp, Artificial Sequence
  chemically synthesized
ttttaaatgtcatcaaatgatt

SEQ ID NO: 780500 - DNA, 22 bp, Artificial Sequence
  chemically synthesized
cattgttttaaatgtcatcaaa

SEQ ID NO: 780501 - DNA, 22 bp, Artificial Sequence
  chemically synthesized
gcattgttttaaatgtcatcaa

SEQ ID NO: 780502 - DNA, 22 bp, Artificial Sequence
  chemically synthesized
tgcattgttttaaatgtcatca

SEQ ID NO: 780503 - DNA, 22 bp, Artificial Sequence
  chemically synthesized
ttgcattgttttaaatgtcatc

SEQ ID NO: 780504 - DNA, 22 bp, Artificial Sequence
  chemically synthesized
tttttgcattgttttaaatgtc

SEQ ID NO: 780505 - DNA, 22 bp, Artificial Sequence
  chemically synthesized
atttttgcattgttttaaatgt

SEQ ID NO: 780506 - DNA, 22 bp, Artificial Sequence
  chemically synthesized
aatttatttttgcattgtttta

SEQ ID NO: 780507 - DNA, 22 bp, Artificial Sequence
  chemically synthesized
gatgacatttaaaacaatgcaa

SEQ ID NO: 780508 - DNA, 22 bp, Artificial Sequence
  chemically synthesized
atgacatttaaaacaatgcaaa

SEQ ID NO: 780509 - DNA, 22 bp, Artificial Sequence
  chemically synthesized
gatctaaatttatttttgcatt

SEQ ID NO: 780510 - DNA, 22 bp, Artificial Sequence
  chemically synthesized
agatctaaatttatttttgcat

SEQ ID NO: 780511 - DNA, 22 bp, Artificial Sequence
  chemically synthesized
tagatctaaatttatttttgca

SEQ ID NO: 780512 - DNA, 22 bp, Artificial Sequence
  chemically synthesized
aaaacaatgcaaaaataaattt

SEQ ID NO: 780513 - DNA, 22 bp, Artificial Sequence
  chemically synthesized
aaacaatgcaaaaataaattta

SEQ ID NO: 780514 - DNA, 22 bp, Artificial Sequence
  chemically synthesized
aatgacactttagatctaaatt

SEQ ID NO: 780515 - DNA, 22 bp, Artificial Sequence
  chemically synthesized
caatgacactttagatctaaat

SEQ ID NO: 780516 - DNA, 22 bp, Artificial Sequence
  chemically synthesized
tcaatgacactttagatctaaa

SEQ ID NO: 780517 - DNA, 22 bp, Artificial Sequence
  chemically synthesized
ggtctttcaatgacactttaga

SEQ ID NO: 780518 - DNA, 22 bp, Artificial Sequence
  chemically synthesized
agatctaaagtgtcattgaaag

SEQ ID NO: 780519 - DNA, 22 bp, Artificial Sequence
  chemically synthesized
atccaattaggtctttcaatga

SEQ ID NO: 780520 - DNA, 22 bp, Artificial Sequence
  chemically synthesized
gatctaaagtgtcattgaaaga

SEQ ID NO: 780521 - DNA, 22 bp, Artificial Sequence
  chemically synthesized
taatccaattaggtctttcaat

SEQ ID NO: 780522 - DNA, 22 bp, Artificial Sequence
  chemically synthesized
ctaatccaattaggtctttcaa

SEQ ID NO: 780523 - DNA, 22 bp, Artificial Sequence
  chemically synthesized
tctaatccaattaggtctttca

SEQ ID NO: 780524 - DNA, 22 bp, Artificial Sequence
  chemically synthesized
aagtgtcattgaaagacctaat

SEQ ID NO: 780525 - DNA, 22 bp, Artificial Sequence
  chemically synthesized
actttctaatccaattaggtct

SEQ ID NO: 780526 - DNA, 22 bp, Artificial Sequence
  chemically synthesized
aatattaactttctaatccaat

SEQ ID NO: 780527 - DNA, 22 bp, Artificial Sequence
  chemically synthesized
aaatattaactttctaatccaa

SEQ ID NO: 780528 - DNA, 22 bp, Artificial Sequence
  chemically synthesized
aaagacctaattggattagaaa

SEQ ID NO: 780529 - DNA, 22 bp, Artificial Sequence
  chemically synthesized
tttaaatattaactttctaatc

SEQ ID NO: 780530 - DNA, 22 bp, Artificial Sequence
  chemically synthesized
atttaaatattaactttctaat

SEQ ID NO: 780531 - DNA, 22 bp, Artificial Sequence
  chemically synthesized
tttatttaaatattaactttct

SEQ ID NO: 780532 - DNA, 22 bp, Artificial Sequence
  chemically synthesized
attggattagaaagttaatatt

SEQ ID NO: 780533 - DNA, 22 bp, Artificial Sequence
  chemically synthesized
aatattatttatttaaatatta

SEQ ID NO: 780534 - DNA, 22 bp, Artificial Sequence
  chemically synthesized
gattagaaagttaatatttaaa

SEQ ID NO: 780535 - DNA, 22 bp, Artificial Sequence
  chemically synthesized
tgaatattatttatttaaatat

SEQ ID NO: 780536 - DNA, 22 bp, Artificial Sequence
  chemically synthesized
ctgaatattatttatttaaata

SEQ ID NO: 780537 - DNA, 22 bp, Artificial Sequence
  chemically synthesized
gaaagttaatatttaaataaat

SEQ ID NO: 780538 - DNA, 22 bp, Artificial Sequence
  chemically synthesized
tttctgaatattatttatttaa

SEQ ID NO: 780539 - DNA, 22 bp, Artificial Sequence
  chemically synthesized
tgtttctgaatattatttattt

SEQ ID NO: 780540 - DNA, 22 bp, Artificial Sequence
  chemically synthesized
tctgtttctgaatattatttat

SEQ ID NO: 780541 - DNA, 22 bp, Artificial Sequence
  chemically synthesized
atatttaaataaataatattca

SEQ ID NO: 780542 - DNA, 22 bp, Artificial Sequence
  chemically synthesized
aaataaataatattcagaaaca

SEQ ID NO: 780543 - DNA, 22 bp, Artificial Sequence
  chemically synthesized
aataaataatattcagaaacag

SEQ ID NO: 780544 - DNA, 22 bp, Artificial Sequence
  chemically synthesized
agaaacagagaggattatgctc

SEQ ID NO: 780545 - DNA, 22 bp, Artificial Sequence
  chemically synthesized
aaataaaggccagagcataatc

SEQ ID NO: 780546 - DNA, 22 bp, Artificial Sequence
  chemically synthesized
ataacatacattgaaataaagg

SEQ ID NO: 780547 - DNA, 22 bp, Artificial Sequence
  chemically synthesized
ctgataacatacattgaaataa

SEQ ID NO: 780548 - DNA, 22 bp, Artificial Sequence
  chemically synthesized
tgctctggcctttatttcaatg

SEQ ID NO: 780549 - DNA, 22 bp, Artificial Sequence
  chemically synthesized
actgataacatacattgaaata

SEQ ID NO: 780550 - DNA, 22 bp, Artificial Sequence
  chemically synthesized
tggcctttatttcaatgtatgt

SEQ ID NO: 780551 - DNA, 22 bp, Artificial Sequence
  chemically synthesized
gcctttatttcaatgtatgtta

SEQ ID NO: 780552 - DNA, 22 bp, Artificial Sequence
  chemically synthesized
tagtggcatttactgataacat

SEQ ID NO: 780553 - DNA, 22 bp, Artificial Sequence
  chemically synthesized
tatttcaatgtatgttatcagt

SEQ ID NO: 780554 - DNA, 22 bp, Artificial Sequence
  chemically synthesized
atagtggcatttactgataaca

SEQ ID NO: 780555 - DNA, 22 bp, Artificial Sequence
  chemically synthesized
atttcaatgtatgttatcagta

SEQ ID NO: 780556 - DNA, 22 bp, Artificial Sequence
  chemically synthesized
tatagtggcatttactgataac

SEQ ID NO: 780557 - DNA, 22 bp, Artificial Sequence
  chemically synthesized
tttcaatgtatgttatcagtaa

SEQ ID NO: 780558 - DNA, 22 bp, Artificial Sequence
  chemically synthesized
caatgtatgttatcagtaaatg

SEQ ID NO: 780559 - DNA, 22 bp, Artificial Sequence
  chemically synthesized
attttatagtggcatttactga

SEQ ID NO: 780560 - DNA, 22 bp, Artificial Sequence
  chemically synthesized
aatgtatgttatcagtaaatgc

SEQ ID NO: 780561 - DNA, 22 bp, Artificial Sequence
  chemically synthesized
aattttatagtggcatttactg

SEQ ID NO: 780562 - DNA, 22 bp, Artificial Sequence
  chemically synthesized
catatttaattttatagtggca

SEQ ID NO: 780563 - DNA, 22 bp, Artificial Sequence
  chemically synthesized
tcagtaaatgccactataaaat

SEQ ID NO: 780564 - DNA, 22 bp, Artificial Sequence
  chemically synthesized
caaattgcatatttaattttat

SEQ ID NO: 780565 - DNA, 22 bp, Artificial Sequence
  chemically synthesized
tccaaattgcatatttaatttt

SEQ ID NO: 780566 - DNA, 22 bp, Artificial Sequence
  chemically synthesized
ctccaaattgcatatttaattt

SEQ ID NO: 780567 - DNA, 22 bp, Artificial Sequence
  chemically synthesized
aatttctccaaattgcatattt

SEQ ID NO: 780568 - DNA, 22 bp, Artificial Sequence
  chemically synthesized
taaaattaaatatgcaatttgg

SEQ ID NO: 780569 - DNA, 22 bp, Artificial Sequence
  chemically synthesized
aattaaatttctccaaattgca

SEQ ID NO: 780570 - DNA, 22 bp, Artificial Sequence
  chemically synthesized
aaattaaatttctccaaattgc

SEQ ID NO: 780571 - DNA, 22 bp, Artificial Sequence
  chemically synthesized
aatatgcaatttggagaaattt

SEQ ID NO: 780572 - DNA, 22 bp, Artificial Sequence
  chemically synthesized
ggagaaatttaatttaagtttg

SEQ ID NO: 780573 - DNA, 22 bp, Artificial Sequence
  chemically synthesized
gagaaatttaatttaagtttgt

SEQ ID NO: 780574 - DNA, 22 bp, Artificial Sequence
  chemically synthesized
aatttaagtttgttgggattta

SEQ ID NO: 780575 - DNA, 22 bp, Artificial Sequence
  chemically synthesized
atttaagtttgttgggatttat

SEQ ID NO: 780576 - DNA, 22 bp, Artificial Sequence
  chemically synthesized
aagtttgttgggatttatttac

SEQ ID NO: 780577 - DNA, 22 bp, Artificial Sequence
  chemically synthesized
aacaaatgggcagtaaataaat

SEQ ID NO: 780578 - DNA, 22 bp, Artificial Sequence
  chemically synthesized
agtttgttgggatttatttact

SEQ ID NO: 780579 - DNA, 22 bp, Artificial Sequence
  chemically synthesized
aaacaaatgggcagtaaataaa

SEQ ID NO: 780580 - DNA, 22 bp, Artificial Sequence
  chemically synthesized
taaacaaatgggcagtaaataa

SEQ ID NO: 780581 - DNA, 22 bp, Artificial Sequence
  chemically synthesized
gttgggatttatttactgccca

SEQ ID NO: 780582 - DNA, 22 bp, Artificial Sequence
  chemically synthesized
ttgggatttatttactgcccat

SEQ ID NO: 780583 - DNA, 22 bp, Artificial Sequence
  chemically synthesized
ggatttatttactgcccatttg

SEQ ID NO: 780584 - DNA, 22 bp, Artificial Sequence
  chemically synthesized
gcagaatgcctttaaacaaatg

SEQ ID NO: 780585 - DNA, 22 bp, Artificial Sequence
  chemically synthesized
atttactgcccatttgtttaaa

SEQ ID NO: 780586 - DNA, 22 bp, Artificial Sequence
  chemically synthesized
tttactgcccatttgtttaaag

SEQ ID NO: 780587 - DNA, 22 bp, Artificial Sequence
  chemically synthesized
actgcccatttgtttaaaggca

SEQ ID NO: 780588 - DNA, 22 bp, Artificial Sequence
  chemically synthesized
ctgcccatttgtttaaaggcat

SEQ ID NO: 780589 - DNA, 22 bp, Artificial Sequence
  chemically synthesized
cagtatctagcagaatgccttt

SEQ ID NO: 780590 - DNA, 22 bp, Artificial Sequence
  chemically synthesized
cccatttgtttaaaggcattct

SEQ ID NO: 780591 - DNA, 22 bp, Artificial Sequence
  chemically synthesized
gtttaaaggcattctgctagat

SEQ ID NO: 780592 - DNA, 22 bp, Artificial Sequence
  chemically synthesized
tttaaaggcattctgctagata

SEQ ID NO: 780593 - DNA, 22 bp, Artificial Sequence
  chemically synthesized
gtagccccctgcagtatctagc

SEQ ID NO: 780594 - DNA, 22 bp, Artificial Sequence
  chemically synthesized
aaaggcattctgctagatactg

SEQ ID NO: 780595 - DNA, 22 bp, Artificial Sequence
  chemically synthesized
cgtagccccctgcagtatctag

SEQ ID NO: 780596 - DNA, 22 bp, Artificial Sequence
  chemically synthesized
aaggcattctgctagatactgc

SEQ ID NO: 780597 - DNA, 22 bp, Artificial Sequence
  chemically synthesized
atcttcgtagccccctgcagta

SEQ ID NO: 780598 - DNA, 22 bp, Artificial Sequence
  chemically synthesized
catcttcgtagccccctgcagt

SEQ ID NO: 780599 - DNA, 22 bp, Artificial Sequence
  chemically synthesized
tcatcttcgtagccccctgcag

SEQ ID NO: 780600 - DNA, 22 bp, Artificial Sequence
  chemically synthesized
ttcatcttcgtagccccctgca

SEQ ID NO: 780601 - DNA, 22 bp, Artificial Sequence
  chemically synthesized
tgctagatactgcagggggcta

SEQ ID NO: 780602 - DNA, 22 bp, Artificial Sequence
  chemically synthesized
ctagatactgcagggggctacg

SEQ ID NO: 780603 - DNA, 22 bp, Artificial Sequence
  chemically synthesized
gatactgcagggggctacgaag

SEQ ID NO: 780604 - DNA, 22 bp, Artificial Sequence
  chemically synthesized
agaatgtatttttcatcttcgt

SEQ ID NO: 780605 - DNA, 22 bp, Artificial Sequence
  chemically synthesized
cagggggctacgaagatgaaaa

SEQ ID NO: 780606 - DNA, 22 bp, Artificial Sequence
  chemically synthesized
taaagtcctgagaatgtatttt

SEQ ID NO: 780607 - DNA, 22 bp, Artificial Sequence
  chemically synthesized
cgaagatgaaaaatacattctc

SEQ ID NO: 780608 - DNA, 22 bp, Artificial Sequence
  chemically synthesized
gactgtaaagtcctgagaatgt

SEQ ID NO: 780609 - DNA, 22 bp, Artificial Sequence
  chemically synthesized
taattagactgtaaagtcctga

SEQ ID NO: 780610 - DNA, 22 bp, Artificial Sequence
  chemically synthesized
atagttgtaattagactgtaaa

SEQ ID NO: 780611 - DNA, 22 bp, Artificial Sequence
  chemically synthesized
catagttgtaattagactgtaa

SEQ ID NO: 780612 - DNA, 22 bp, Artificial Sequence
  chemically synthesized
ttcatagttgtaattagactgt

SEQ ID NO: 780613 - DNA, 22 bp, Artificial Sequence
  chemically synthesized
tcaggactttacagtctaatta

SEQ ID NO: 780614 - DNA, 22 bp, Artificial Sequence
  chemically synthesized
aggactttacagtctaattaca

SEQ ID NO: 780615 - DNA, 22 bp, Artificial Sequence
  chemically synthesized
gagaacattcttcatagttgta

SEQ ID NO: 780616 - DNA, 22 bp, Artificial Sequence
  chemically synthesized
tacagtctaattacaactatga

SEQ ID NO: 780617 - DNA, 22 bp, Artificial Sequence
  chemically synthesized
ggagaacattcttcatagttgt

SEQ ID NO: 780618 - DNA, 22 bp, Artificial Sequence
  chemically synthesized
acagtctaattacaactatgaa

SEQ ID NO: 780619 - DNA, 22 bp, Artificial Sequence
  chemically synthesized
tggagaacattcttcatagttg

SEQ ID NO: 780620 - DNA, 22 bp, Artificial Sequence
  chemically synthesized
cagtctaattacaactatgaag

SEQ ID NO: 780621 - DNA, 22 bp, Artificial Sequence
  chemically synthesized
gagctttggagaacattcttca

SEQ ID NO: 780622 - DNA, 22 bp, Artificial Sequence
  chemically synthesized
agagctttggagaacattcttc

SEQ ID NO: 780623 - DNA, 22 bp, Artificial Sequence
  chemically synthesized
attacaactatgaagaatgttc

SEQ ID NO: 780624 - DNA, 22 bp, Artificial Sequence
  chemically synthesized
caactatgaagaatgttctcca

SEQ ID NO: 780625 - DNA, 22 bp, Artificial Sequence
  chemically synthesized
tatttagagctttggagaacat

SEQ ID NO: 780626 - DNA, 22 bp, Artificial Sequence
  chemically synthesized
aattgtatttagagctttggag

SEQ ID NO: 780627 - DNA, 22 bp, Artificial Sequence
  chemically synthesized
tgaagaatgttctccaaagctc

SEQ ID NO: 780628 - DNA, 22 bp, Artificial Sequence
  chemically synthesized
tactaaattgtatttagagctt

SEQ ID NO: 780629 - DNA, 22 bp, Artificial Sequence
  chemically synthesized
gtactaaattgtatttagagct

SEQ ID NO: 780630 - DNA, 22 bp, Artificial Sequence
  chemically synthesized
tttgtactaaattgtatttaga

SEQ ID NO: 780631 - DNA, 22 bp, Artificial Sequence
  chemically synthesized
atttgtactaaattgtatttag

SEQ ID NO: 780632 - DNA, 22 bp, Artificial Sequence
  chemically synthesized
tatttgtactaaattgtattta

SEQ ID NO: 780633 - DNA, 22 bp, Artificial Sequence
  chemically synthesized
tccaaagctctaaatacaattt

SEQ ID NO: 780634 - DNA, 22 bp, Artificial Sequence
  chemically synthesized
caaagctctaaatacaatttag

SEQ ID NO: 780635 - DNA, 22 bp, Artificial Sequence
  chemically synthesized
tactttatttgtactaaattgt

SEQ ID NO: 780636 - DNA, 22 bp, Artificial Sequence
  chemically synthesized
gtactttatttgtactaaattg

SEQ ID NO: 780637 - DNA, 22 bp, Artificial Sequence
  chemically synthesized
tttgtactttatttgtactaaa

SEQ ID NO: 780638 - DNA, 22 bp, Artificial Sequence
  chemically synthesized
atttgtactttatttgtactaa

SEQ ID NO: 780639 - DNA, 22 bp, Artificial Sequence
  chemically synthesized
tatttgtactttatttgtacta

SEQ ID NO: 780640 - DNA, 22 bp, Artificial Sequence
  chemically synthesized
taaatacaatttagtacaaata

SEQ ID NO: 780641 - DNA, 22 bp, Artificial Sequence
  chemically synthesized
ttatttgtactttatttgtact

SEQ ID NO: 780642 - DNA, 22 bp, Artificial Sequence
  chemically synthesized
tttatttgtactttatttgtac

SEQ ID NO: 780643 - DNA, 22 bp, Artificial Sequence
  chemically synthesized
aatacaatttagtacaaataaa

SEQ ID NO: 780644 - DNA, 22 bp, Artificial Sequence
  chemically synthesized
gctttttatttgtactttattt

SEQ ID NO: 780645 - DNA, 22 bp, Artificial Sequence
  chemically synthesized
agctttttatttgtactttatt

SEQ ID NO: 780646 - DNA, 22 bp, Artificial Sequence
  chemically synthesized
tagctttttatttgtactttat

SEQ ID NO: 780647 - DNA, 22 bp, Artificial Sequence
  chemically synthesized
tttagctttttatttgtacttt

SEQ ID NO: 780648 - DNA, 22 bp, Artificial Sequence
  chemically synthesized
agtacaaataaagtacaaataa

SEQ ID NO: 780649 - DNA, 22 bp, Artificial Sequence
  chemically synthesized
gtacaaataaagtacaaataaa

SEQ ID NO: 780650 - DNA, 22 bp, Artificial Sequence
  chemically synthesized
aaacctctttagctttttattt

SEQ ID NO: 780651 - DNA, 22 bp, Artificial Sequence
  chemically synthesized
caaacctctttagctttttatt

SEQ ID NO: 780652 - DNA, 22 bp, Artificial Sequence
  chemically synthesized
ttcaaacctctttagcttttta

SEQ ID NO: 780653 - DNA, 22 bp, Artificial Sequence
  chemically synthesized
cttcaaacctctttagcttttt

SEQ ID NO: 780654 - DNA, 22 bp, Artificial Sequence
  chemically synthesized
tcttcaaacctctttagctttt

SEQ ID NO: 780655 - DNA, 22 bp, Artificial Sequence
  chemically synthesized
ctttcttcaaacctctttagct

SEQ ID NO: 780656 - DNA, 22 bp, Artificial Sequence
  chemically synthesized
tcctttcttcaaacctctttag

SEQ ID NO: 780657 - DNA, 22 bp, Artificial Sequence
  chemically synthesized
ctcctttcttcaaacctcttta

SEQ ID NO: 780658 - DNA, 22 bp, Artificial Sequence
  chemically synthesized
tgtttctcctttcttcaaacct

SEQ ID NO: 780659 - DNA, 22 bp, Artificial Sequence
  chemically synthesized
aagaggtttgaagaaaggagaa

SEQ ID NO: 780660 - DNA, 22 bp, Artificial Sequence
  chemically synthesized
ccagcagctatgtttctccttt

SEQ ID NO: 780661 - DNA, 22 bp, Artificial Sequence
  chemically synthesized
gaagaaaggagaaacatagctg

SEQ ID NO: 780662 - DNA, 22 bp, Artificial Sequence
  chemically synthesized
aagaaaggagaaacatagctgc

SEQ ID NO: 780663 - DNA, 22 bp, Artificial Sequence
  chemically synthesized
ccgatcctcccagcagctatgt

SEQ ID NO: 780664 - DNA, 22 bp, Artificial Sequence
  chemically synthesized
ttcccgatcctcccagcagcta

SEQ ID NO: 780665 - DNA, 22 bp, Artificial Sequence
  chemically synthesized
aaccatgagctgttcccgatcc

SEQ ID NO: 780666 - DNA, 22 bp, Artificial Sequence
  chemically synthesized
ctcaaccatgagctgttcccga

SEQ ID NO: 780667 - DNA, 22 bp, Artificial Sequence
  chemically synthesized
ctgggaggatcgggaacagctc

SEQ ID NO: 780668 - DNA, 22 bp, Artificial Sequence
  chemically synthesized
ggaggatcgggaacagctcatg

SEQ ID NO: 780669 - DNA, 22 bp, Artificial Sequence
  chemically synthesized
ccgcagctcctcaaccatgagc

SEQ ID NO: 780670 - DNA, 22 bp, Artificial Sequence
  chemically synthesized
tctcccgcagctcctcaaccat

SEQ ID NO: 780671 - DNA, 22 bp, Artificial Sequence
  chemically synthesized
aagtactgtctcccgcagctcc

SEQ ID NO: 780672 - DNA, 22 bp, Artificial Sequence
  chemically synthesized
ttgaagtactgtctcccgcagc

SEQ ID NO: 780673 - DNA, 22 bp, Artificial Sequence
  chemically synthesized
atggttgaggagctgcgggaga

SEQ ID NO: 780674 - DNA, 22 bp, Artificial Sequence
  chemically synthesized
attattgaagtactgtctcccg

SEQ ID NO: 780675 - DNA, 22 bp, Artificial Sequence
  chemically synthesized
aggagctgcgggagacagtact

SEQ ID NO: 780676 - DNA, 22 bp, Artificial Sequence
  chemically synthesized
ccaataccctaattattgaagt

SEQ ID NO: 780677 - DNA, 22 bp, Artificial Sequence
  chemically synthesized
cgggagacagtacttcaataat

SEQ ID NO: 780678 - DNA, 22 bp, Artificial Sequence
  chemically synthesized
cctgccaataccctaattattg

SEQ ID NO: 780679 - DNA, 22 bp, Artificial Sequence
  chemically synthesized
gcctgccaataccctaattatt

SEQ ID NO: 780680 - DNA, 22 bp, Artificial Sequence
  chemically synthesized
tgcctgccaataccctaattat

SEQ ID NO: 780681 - DNA, 22 bp, Artificial Sequence
  chemically synthesized
tttgcctgccaataccctaatt

SEQ ID NO: 780682 - DNA, 22 bp, Artificial Sequence
  chemically synthesized
tgctctttgcctgccaataccc

SEQ ID NO: 780683 - DNA, 22 bp, Artificial Sequence
  chemically synthesized
tgtgctctttgcctgccaatac

SEQ ID NO: 780684 - DNA, 22 bp, Artificial Sequence
  chemically synthesized
caataattagggtattggcagg

SEQ ID NO: 780685 - DNA, 22 bp, Artificial Sequence
  chemically synthesized
aataattagggtattggcaggc

SEQ ID NO: 780686 - DNA, 22 bp, Artificial Sequence
  chemically synthesized
tctgtgctctttgcctgccaat

SEQ ID NO: 780687 - DNA, 22 bp, Artificial Sequence
  chemically synthesized
ctctgtgctctttgcctgccaa

SEQ ID NO: 780688 - DNA, 22 bp, Artificial Sequence
  chemically synthesized
tctctgtgctctttgcctgcca

SEQ ID NO: 780689 - DNA, 22 bp, Artificial Sequence
  chemically synthesized
gctttctctgtgctctttgcct

SEQ ID NO: 780690 - DNA, 22 bp, Artificial Sequence
  chemically synthesized
ggctttctctgtgctctttgcc

SEQ ID NO: 780691 - DNA, 22 bp, Artificial Sequence
  chemically synthesized
gggtattggcaggcaaagagca

SEQ ID NO: 780692 - DNA, 22 bp, Artificial Sequence
  chemically synthesized
ttggctttctctgtgctctttg

SEQ ID NO: 780693 - DNA, 22 bp, Artificial Sequence
  chemically synthesized
cttggctttctctgtgctcttt

SEQ ID NO: 780694 - DNA, 22 bp, Artificial Sequence
  chemically synthesized
gccttcttggctttctctgtgc

SEQ ID NO: 780695 - DNA, 22 bp, Artificial Sequence
  chemically synthesized
gcaggcaaagagcacagagaaa

SEQ ID NO: 780696 - DNA, 22 bp, Artificial Sequence
  chemically synthesized
ggccttcttggctttctctgtg

SEQ ID NO: 780697 - DNA, 22 bp, Artificial Sequence
  chemically synthesized
cgtgtcatataatggccttggc

SEQ ID NO: 780698 - DNA, 22 bp, Artificial Sequence
  chemically synthesized
agttccgtgtcatataatggcc

SEQ ID NO: 780699 - DNA, 22 bp, Artificial Sequence
  chemically synthesized
taggatcacatctaagttccgt

SEQ ID NO: 780700 - DNA, 22 bp, Artificial Sequence
  chemically synthesized
ataggatcacatctaagttccg

SEQ ID NO: 780701 - DNA, 22 bp, Artificial Sequence
  chemically synthesized
tataggatcacatctaagttcc

SEQ ID NO: 780702 - DNA, 22 bp, Artificial Sequence
  chemically synthesized
ttataggatcacatctaagttc

SEQ ID NO: 780703 - DNA, 22 bp, Artificial Sequence
  chemically synthesized
tatgacacggaacttagatgtg

SEQ ID NO: 780704 - DNA, 22 bp, Artificial Sequence
  chemically synthesized
ccttttataggatcacatctaa

SEQ ID NO: 780705 - DNA, 22 bp, Artificial Sequence
  chemically synthesized
gccttttataggatcacatcta

SEQ ID NO: 780706 - DNA, 22 bp, Artificial Sequence
  chemically synthesized
tcttgccttttataggatcaca

SEQ ID NO: 780707 - DNA, 22 bp, Artificial Sequence
  chemically synthesized
agatgtgatcctataaaaggca

SEQ ID NO: 780708 - DNA, 22 bp, Artificial Sequence
  chemically synthesized
gatgtgatcctataaaaggcaa

SEQ ID NO: 780709 - DNA, 22 bp, Artificial Sequence
  chemically synthesized
caggccacatgagccactgtct

SEQ ID NO: 780710 - DNA, 22 bp, Artificial Sequence
  chemically synthesized
acaggccacatgagccactgtc

SEQ ID NO: 780711 - DNA, 22 bp, Artificial Sequence
  chemically synthesized
taaaaggcaagacagtggctca

SEQ ID NO: 780712 - DNA, 22 bp, Artificial Sequence
  chemically synthesized
aaaagagtttacaggccacatg

SEQ ID NO: 780713 - DNA, 22 bp, Artificial Sequence
  chemically synthesized
ttcaaaagagtttacaggccac

SEQ ID NO: 780714 - DNA, 22 bp, Artificial Sequence
  chemically synthesized
attcaaaagagtttacaggcca

SEQ ID NO: 780715 - DNA, 22 bp, Artificial Sequence
  chemically synthesized
tattcaaaagagtttacaggcc

SEQ ID NO: 780716 - DNA, 22 bp, Artificial Sequence
  chemically synthesized
gggtctttattcaaaagagttt

SEQ ID NO: 780717 - DNA, 22 bp, Artificial Sequence
  chemically synthesized
atgtggcctgtaaactcttttg

SEQ ID NO: 780718 - DNA, 22 bp, Artificial Sequence
  chemically synthesized
ggggtctttattcaaaagagtt

SEQ ID NO: 780719 - DNA, 22 bp, Artificial Sequence
  chemically synthesized
taaactcttttgaataaagacc

SEQ ID NO: 780720 - DNA, 22 bp, Artificial Sequence
  chemically synthesized
cccatagaagtttggggtcttt

SEQ ID NO: 780721 - DNA, 22 bp, Artificial Sequence
  chemically synthesized
ttttgaataaagaccccaaact

SEQ ID NO: 780722 - DNA, 22 bp, Artificial Sequence
  chemically synthesized
ttgaataaagaccccaaacttc

SEQ ID NO: 780723 - DNA, 22 bp, Artificial Sequence
  chemically synthesized
tgaataaagaccccaaacttct

SEQ ID NO: 780724 - DNA, 22 bp, Artificial Sequence
  chemically synthesized
gaataaagaccccaaacttcta

SEQ ID NO: 780725 - DNA, 22 bp, Artificial Sequence
  chemically synthesized
aataaagaccccaaacttctat

SEQ ID NO: 780726 - DNA, 22 bp, Artificial Sequence
  chemically synthesized
gcatagtaattacccatagaag

SEQ ID NO: 780727 - DNA, 22 bp, Artificial Sequence
  chemically synthesized
tagcatagtaattacccataga

SEQ ID NO: 780728 - DNA, 22 bp, Artificial Sequence
  chemically synthesized
ctagcatagtaattacccatag

SEQ ID NO: 780729 - DNA, 22 bp, Artificial Sequence
  chemically synthesized
cttctagcatagtaattaccca

SEQ ID NO: 780730 - DNA, 22 bp, Artificial Sequence
  chemically synthesized
gcttctagcatagtaattaccc

SEQ ID NO: 780731 - DNA, 22 bp, Artificial Sequence
  chemically synthesized
ctatgggtaattactatgctag

SEQ ID NO: 780732 - DNA, 22 bp, Artificial Sequence
  chemically synthesized
tatgggtaattactatgctaga

SEQ ID NO: 780733 - DNA, 22 bp, Artificial Sequence
  chemically synthesized
agacagtttgcttctagcatag

SEQ ID NO: 780734 - DNA, 22 bp, Artificial Sequence
  chemically synthesized
tgggtaattactatgctagaag

SEQ ID NO: 780735 - DNA, 22 bp, Artificial Sequence
  chemically synthesized
ctatgctagaagcaaactgtct

SEQ ID NO: 780736 - DNA, 22 bp, Artificial Sequence
  chemically synthesized
tgctagaagcaaactgtctcag

SEQ ID NO: 780737 - DNA, 22 bp, Artificial Sequence
  chemically synthesized
gggtgagaggatactgagacag

SEQ ID NO: 780738 - DNA, 22 bp, Artificial Sequence
  chemically synthesized
ggggtgagaggatactgagaca

SEQ ID NO: 780739 - DNA, 22 bp, Artificial Sequence
  chemically synthesized
gaagcaaactgtctcagtatcc

SEQ ID NO: 780740 - DNA, 22 bp, Artificial Sequence
  chemically synthesized
ataatgatgtttggggtgagag

SEQ ID NO: 780741 - DNA, 22 bp, Artificial Sequence
  chemically synthesized
aataatgatgtttggggtgaga

SEQ ID NO: 780742 - DNA, 22 bp, Artificial Sequence
  chemically synthesized
tctcagtatcctctcaccccaa

SEQ ID NO: 780743 - DNA, 22 bp, Artificial Sequence
  chemically synthesized
agtatcctctcaccccaaacat

SEQ ID NO: 780744 - DNA, 22 bp, Artificial Sequence
  chemically synthesized
atgatcagtttaataatgatgt

SEQ ID NO: 780745 - DNA, 22 bp, Artificial Sequence
  chemically synthesized
tcaccccaaacatcattattaa

SEQ ID NO: 780746 - DNA, 22 bp, Artificial Sequence
  chemically synthesized
accccaaacatcattattaaac

SEQ ID NO: 780747 - DNA, 22 bp, Artificial Sequence
  chemically synthesized
ggaaacctcatgatcagtttaa

SEQ ID NO: 780748 - DNA, 22 bp, Artificial Sequence
  chemically synthesized
ccctgggaaacctcatgatcag

SEQ ID NO: 780749 - DNA, 22 bp, Artificial Sequence
  chemically synthesized
ttaaactgatcatgaggtttcc

SEQ ID NO: 780750 - DNA, 22 bp, Artificial Sequence
  chemically synthesized
caatgttgccctgggaaacctc

SEQ ID NO: 780751 - DNA, 22 bp, Artificial Sequence
  chemically synthesized
ccaatgttgccctgggaaacct

SEQ ID NO: 780752 - DNA, 22 bp, Artificial Sequence
  chemically synthesized
aactgatcatgaggtttcccag

SEQ ID NO: 780753 - DNA, 22 bp, Artificial Sequence
  chemically synthesized
tttccaatgttgccctgggaaa

SEQ ID NO: 780754 - DNA, 22 bp, Artificial Sequence
  chemically synthesized
tgtttccaatgttgccctggga

SEQ ID NO: 780755 - DNA, 22 bp, Artificial Sequence
  chemically synthesized
atcatgaggtttcccagggcaa

SEQ ID NO: 780756 - DNA, 22 bp, Artificial Sequence
  chemically synthesized
gagatgactctgtttccaatgt

SEQ ID NO: 780757 - DNA, 22 bp, Artificial Sequence
  chemically synthesized
cccagggcaacattggaaacag

SEQ ID NO: 780758 - DNA, 22 bp, Artificial Sequence
  chemically synthesized
ccagggcaacattggaaacaga

SEQ ID NO: 780759 - DNA, 22 bp, Artificial Sequence
  chemically synthesized
tatacccagactggagatgact

SEQ ID NO: 780760 - DNA, 22 bp, Artificial Sequence
  chemically synthesized
gaaacagagtcatctccagtct

SEQ ID NO: 780761 - DNA, 22 bp, Artificial Sequence
  chemically synthesized
tgcataagtctgtatacccaga

SEQ ID NO: 780762 - DNA, 22 bp, Artificial Sequence
  chemically synthesized
cagtctgggtatacagacttat

SEQ ID NO: 780763 - DNA, 22 bp, Artificial Sequence
  chemically synthesized
aaacagacagttgtgcataagt

SEQ ID NO: 780764 - DNA, 22 bp, Artificial Sequence
  chemically synthesized
ggtatacagacttatgcacaac

SEQ ID NO: 780765 - DNA, 22 bp, Artificial Sequence
  chemically synthesized
ttaaaacagacagttgtgcata

SEQ ID NO: 780766 - DNA, 22 bp, Artificial Sequence
  chemically synthesized
gttaaaacagacagttgtgcat

SEQ ID NO: 780767 - DNA, 22 bp, Artificial Sequence
  chemically synthesized
cttgttaaaacagacagttgtg

SEQ ID NO: 780768 - DNA, 22 bp, Artificial Sequence
  chemically synthesized
atgcacaactgtctgttttaac

SEQ ID NO: 780769 - DNA, 22 bp, Artificial Sequence
  chemically synthesized
tgcacaactgtctgttttaaca

SEQ ID NO: 780770 - DNA, 22 bp, Artificial Sequence
  chemically synthesized
gtcacacgacaacatattcctt

SEQ ID NO: 780771 - DNA, 22 bp, Artificial Sequence
  chemically synthesized
tctgttttaacaaggaatatgt

SEQ ID NO: 780772 - DNA, 22 bp, Artificial Sequence
  chemically synthesized
ttttaacaaggaatatgttgtc

SEQ ID NO: 780773 - DNA, 22 bp, Artificial Sequence
  chemically synthesized
taacaaggaatatgttgtcgtg

SEQ ID NO: 780774 - DNA, 22 bp, Artificial Sequence
  chemically synthesized
aacaaggaatatgttgtcgtgt

SEQ ID NO: 780775 - DNA, 22 bp, Artificial Sequence
  chemically synthesized
acaaggaatatgttgtcgtgtg

SEQ ID NO: 780776 - DNA, 22 bp, Artificial Sequence
  chemically synthesized
gggagacaaatgggcaaattag

SEQ ID NO: 780777 - DNA, 22 bp, Artificial Sequence
  chemically synthesized
tcgtgtgactaatttgcccatt

SEQ ID NO: 780778 - DNA, 22 bp, Artificial Sequence
  chemically synthesized
gagtgtagttggggagacaaat

SEQ ID NO: 780779 - DNA, 22 bp, Artificial Sequence
  chemically synthesized
atttgcccatttgtctccccaa

SEQ ID NO: 780780 - DNA, 22 bp, Artificial Sequence
  chemically synthesized
gagcctagagtgtagttgggga

SEQ ID NO: 780781 - DNA, 22 bp, Artificial Sequence
  chemically synthesized
gcccatttgtctccccaactac

SEQ ID NO: 780782 - DNA, 22 bp, Artificial Sequence
  chemically synthesized
cccatttgtctccccaactaca

SEQ ID NO: 780783 - DNA, 22 bp, Artificial Sequence
  chemically synthesized
tagagcctagagtgtagttggg

SEQ ID NO: 780784 - DNA, 22 bp, Artificial Sequence
  chemically synthesized
gcctctagagcctagagtgtag

SEQ ID NO: 780785 - DNA, 22 bp, Artificial Sequence
  chemically synthesized
ggcctctagagcctagagtgta

SEQ ID NO: 780786 - DNA, 22 bp, Artificial Sequence
  chemically synthesized
gtctccccaactacactctagg

SEQ ID NO: 780787 - DNA, 22 bp, Artificial Sequence
  chemically synthesized
tctccccaactacactctaggc

SEQ ID NO: 780788 - DNA, 22 bp, Artificial Sequence
  chemically synthesized
cccaactacactctaggctcta

SEQ ID NO: 780789 - DNA, 22 bp, Artificial Sequence
  chemically synthesized
cactctaggctctagaggccaa

SEQ ID NO: 780790 - DNA, 22 bp, Artificial Sequence
  chemically synthesized
taggctctagaggccaagggtt

SEQ ID NO: 780791 - DNA, 22 bp, Artificial Sequence
  chemically synthesized
ggctctagaggccaagggtttt

SEQ ID NO: 780792 - DNA, 22 bp, Artificial Sequence
  chemically synthesized
aggatgaaaatgataaaaccct

SEQ ID NO: 780793 - DNA, 22 bp, Artificial Sequence
  chemically synthesized
aaggatgaaaatgataaaaccc

SEQ ID NO: 780794 - DNA, 22 bp, Artificial Sequence
  chemically synthesized
tagaggccaagggttttatcat

SEQ ID NO: 780795 - DNA, 22 bp, Artificial Sequence
  chemically synthesized
gaggccaagggttttatcattt

SEQ ID NO: 780796 - DNA, 22 bp, Artificial Sequence
  chemically synthesized
gatttaaggatgaaaatgataa

SEQ ID NO: 780797 - DNA, 22 bp, Artificial Sequence
  chemically synthesized
ctagatttaaggatgaaaatga

SEQ ID NO: 780798 - DNA, 22 bp, Artificial Sequence
  chemically synthesized
attgctagatttaaggatgaaa

SEQ ID NO: 780799 - DNA, 22 bp, Artificial Sequence
  chemically synthesized
tatcattttcatccttaaatct

SEQ ID NO: 780800 - DNA, 22 bp, Artificial Sequence
  chemically synthesized
atcattttcatccttaaatcta

SEQ ID NO: 780801 - DNA, 22 bp, Artificial Sequence
  chemically synthesized
tcattttcatccttaaatctag

SEQ ID NO: 780802 - DNA, 22 bp, Artificial Sequence
  chemically synthesized
aacaatgtactaattgctagat

SEQ ID NO: 780803 - DNA, 22 bp, Artificial Sequence
  chemically synthesized
tcatccttaaatctagcaatta

SEQ ID NO: 780804 - DNA, 22 bp, Artificial Sequence
  chemically synthesized
catccttaaatctagcaattag

SEQ ID NO: 780805 - DNA, 22 bp, Artificial Sequence
  chemically synthesized
atccttaaatctagcaattagt

SEQ ID NO: 780806 - DNA, 22 bp, Artificial Sequence
  chemically synthesized
agtgttaaacaatgtactaatt

SEQ ID NO: 780807 - DNA, 22 bp, Artificial Sequence
  chemically synthesized
aaatctagcaattagtacattg

SEQ ID NO: 780808 - DNA, 22 bp, Artificial Sequence
  chemically synthesized
ctaagtgttaaacaatgtacta

SEQ ID NO: 780809 - DNA, 22 bp, Artificial Sequence
  chemically synthesized
aatctagcaattagtacattgt

SEQ ID NO: 780810 - DNA, 22 bp, Artificial Sequence
  chemically synthesized
gctaagtgttaaacaatgtact

SEQ ID NO: 780811 - DNA, 22 bp, Artificial Sequence
  chemically synthesized
gcaattagtacattgtttaaca

SEQ ID NO: 780812 - DNA, 22 bp, Artificial Sequence
  chemically synthesized
agcacttgctaagtgttaaaca

SEQ ID NO: 780813 - DNA, 22 bp, Artificial Sequence
  chemically synthesized
attgagcacttgctaagtgtta

SEQ ID NO: 780814 - DNA, 22 bp, Artificial Sequence
  chemically synthesized
gtacattgtttaacacttagca

SEQ ID NO: 780815 - DNA, 22 bp, Artificial Sequence
  chemically synthesized
tttaacacttagcaagtgctca

SEQ ID NO: 780816 - DNA, 22 bp, Artificial Sequence
  chemically synthesized
aataagcattaattgagcactt

SEQ ID NO: 780817 - DNA, 22 bp, Artificial Sequence
  chemically synthesized
aacacttagcaagtgctcaatt

SEQ ID NO: 780818 - DNA, 22 bp, Artificial Sequence
  chemically synthesized
acacttagcaagtgctcaatta

SEQ ID NO: 780819 - DNA, 22 bp, Artificial Sequence
  chemically synthesized
attcaataagcattaattgagc

SEQ ID NO: 780820 - DNA, 22 bp, Artificial Sequence
  chemically synthesized
gttcattcaataagcattaatt

SEQ ID NO: 780821 - DNA, 22 bp, Artificial Sequence
  chemically synthesized
agcaagtgctcaattaatgctt

SEQ ID NO: 780822 - DNA, 22 bp, Artificial Sequence
  chemically synthesized
gcaagtgctcaattaatgctta

SEQ ID NO: 780823 - DNA, 22 bp, Artificial Sequence
  chemically synthesized
ttggttcattcaataagcatta

SEQ ID NO: 780824 - DNA, 22 bp, Artificial Sequence
  chemically synthesized
gttggttcattcaataagcatt

SEQ ID NO: 780825 - DNA, 22 bp, Artificial Sequence
  chemically synthesized
aattaatgcttattgaatgaac

SEQ ID NO: 780826 - DNA, 22 bp, Artificial Sequence
  chemically synthesized
atagatttgttggttcattcaa

SEQ ID NO: 780827 - DNA, 22 bp, Artificial Sequence
  chemically synthesized
gatagatttgttggttcattca

SEQ ID NO: 780828 - DNA, 22 bp, Artificial Sequence
  chemically synthesized
tttgatagatttgttggttcat

SEQ ID NO: 780829 - DNA, 22 bp, Artificial Sequence
  chemically synthesized
atgcttattgaatgaaccaaca

SEQ ID NO: 780830 - DNA, 22 bp, Artificial Sequence
  chemically synthesized
ttgtttgatagatttgttggtt

SEQ ID NO: 780831 - DNA, 22 bp, Artificial Sequence
  chemically synthesized
attgaatgaaccaacaaatcta

SEQ ID NO: 780832 - DNA, 22 bp, Artificial Sequence
  chemically synthesized
ttgaatgaaccaacaaatctat

SEQ ID NO: 780833 - DNA, 22 bp, Artificial Sequence
  chemically synthesized
aatgaaccaacaaatctatcaa

SEQ ID NO: 780834 - DNA, 22 bp, Artificial Sequence
  chemically synthesized
atgcactattgtttgatagatt

SEQ ID NO: 780835 - DNA, 22 bp, Artificial Sequence
  chemically synthesized
gatgcactattgtttgatagat

SEQ ID NO: 780836 - DNA, 22 bp, Artificial Sequence
  chemically synthesized
tgatgcactattgtttgataga

SEQ ID NO: 780837 - DNA, 22 bp, Artificial Sequence
  chemically synthesized
gagcaaacattttgatgcacta

SEQ ID NO: 780838 - DNA, 22 bp, Artificial Sequence
  chemically synthesized
tcaaacaatagtgcatcaaaat

SEQ ID NO: 780839 - DNA, 22 bp, Artificial Sequence
  chemically synthesized
ataagcagattggagcaaacat

SEQ ID NO: 780840 - DNA, 22 bp, Artificial Sequence
  chemically synthesized
ttaataagcagattggagcaaa

SEQ ID NO: 780841 - DNA, 22 bp, Artificial Sequence
  chemically synthesized
agttattaataagcagattgga

SEQ ID NO: 780842 - DNA, 22 bp, Artificial Sequence
  chemically synthesized
gctccaatctgcttattaataa

SEQ ID NO: 780843 - DNA, 22 bp, Artificial Sequence
  chemically synthesized
ctccaatctgcttattaataac

SEQ ID NO: 780844 - DNA, 22 bp, Artificial Sequence
  chemically synthesized
caatctgcttattaataactca

SEQ ID NO: 780845 - DNA, 22 bp, Artificial Sequence
  chemically synthesized
gcaaccaagacactgagttatt

SEQ ID NO: 780846 - DNA, 22 bp, Artificial Sequence
  chemically synthesized
ggcaaccaagacactgagttat

SEQ ID NO: 780847 - DNA, 22 bp, Artificial Sequence
  chemically synthesized
tggcaaccaagacactgagtta

SEQ ID NO: 780848 - DNA, 22 bp, Artificial Sequence
  chemically synthesized
ctttggcaaccaagacactgag

SEQ ID NO: 780849 - DNA, 22 bp, Artificial Sequence
  chemically synthesized
cttattaataactcagtgtctt

SEQ ID NO: 780850 - DNA, 22 bp, Artificial Sequence
  chemically synthesized
attaataactcagtgtcttggt

SEQ ID NO: 780851 - DNA, 22 bp, Artificial Sequence
  chemically synthesized
ttaataactcagtgtcttggtt

SEQ ID NO: 780852 - DNA, 22 bp, Artificial Sequence
  chemically synthesized
ccctcctttggcaaccaagaca

SEQ ID NO: 780853 - DNA, 22 bp, Artificial Sequence
  chemically synthesized
cccctcctttggcaaccaagac

SEQ ID NO: 780854 - DNA, 22 bp, Artificial Sequence
  chemically synthesized
tcccctcctttggcaaccaaga

SEQ ID NO: 780855 - DNA, 22 bp, Artificial Sequence
  chemically synthesized
ataactcagtgtcttggttgcc

SEQ ID NO: 780856 - DNA, 22 bp, Artificial Sequence
  chemically synthesized
tttcccctcctttggcaaccaa

SEQ ID NO: 780857 - DNA, 22 bp, Artificial Sequence
  chemically synthesized
tctttcccctcctttggcaacc

SEQ ID NO: 780858 - DNA, 22 bp, Artificial Sequence
  chemically synthesized
ctctttcccctcctttggcaac

SEQ ID NO: 780859 - DNA, 22 bp, Artificial Sequence
  chemically synthesized
tctctttcccctcctttggcaa

SEQ ID NO: 780860 - DNA, 22 bp, Artificial Sequence
  chemically synthesized
agtgtcttggttgccaaaggag

SEQ ID NO: 780861 - DNA, 22 bp, Artificial Sequence
  chemically synthesized
ccctttctctttcccctccttt

SEQ ID NO: 780862 - DNA, 22 bp, Artificial Sequence
  chemically synthesized
taccctttctctttcccctcct

SEQ ID NO: 780863 - DNA, 22 bp, Artificial Sequence
  chemically synthesized
ggttgccaaaggaggggaaaga

SEQ ID NO: 780864 - DNA, 22 bp, Artificial Sequence
  chemically synthesized
gttgccaaaggaggggaaagag

SEQ ID NO: 780865 - DNA, 22 bp, Artificial Sequence
  chemically synthesized
cactctaccctttctctttccc

SEQ ID NO: 780866 - DNA, 22 bp, Artificial Sequence
  chemically synthesized
ccaaaggaggggaaagagaaag

SEQ ID NO: 780867 - DNA, 22 bp, Artificial Sequence
  chemically synthesized
ctacactctaccctttctcttt

SEQ ID NO: 780868 - DNA, 22 bp, Artificial Sequence
  chemically synthesized
tactacactctaccctttctct

SEQ ID NO: 780869 - DNA, 22 bp, Artificial Sequence
  chemically synthesized
ctactacactctaccctttctc

SEQ ID NO: 780870 - DNA, 22 bp, Artificial Sequence
  chemically synthesized
ttctactacactctaccctttc

SEQ ID NO: 780871 - DNA, 22 bp, Artificial Sequence
  chemically synthesized
cccctcttctactacactctac

SEQ ID NO: 780872 - DNA, 22 bp, Artificial Sequence
  chemically synthesized
ccccctcttctactacactcta

SEQ ID NO: 780873 - DNA, 22 bp, Artificial Sequence
  chemically synthesized
tttccccctcttctactacact

SEQ ID NO: 780874 - DNA, 22 bp, Artificial Sequence
  chemically synthesized
atttccccctcttctactacac

SEQ ID NO: 780875 - DNA, 22 bp, Artificial Sequence
  chemically synthesized
gaatcttatttccccctcttct

SEQ ID NO: 780876 - DNA, 22 bp, Artificial Sequence
  chemically synthesized
gttagaatcttatttccccctc

SEQ ID NO: 780877 - DNA, 22 bp, Artificial Sequence
  chemically synthesized
tgctagttagaatcttatttcc

SEQ ID NO: 780878 - DNA, 22 bp, Artificial Sequence
  chemically synthesized
attgtgctagttagaatcttat

SEQ ID NO: 780879 - DNA, 22 bp, Artificial Sequence
  chemically synthesized
ttcattgtgctagttagaatct

SEQ ID NO: 780880 - DNA, 22 bp, Artificial Sequence
  chemically synthesized
aaatctgttcattgtgctagtt

SEQ ID NO: 780881 - DNA, 22 bp, Artificial Sequence
  chemically synthesized
taactagcacaatgaacagatt

SEQ ID NO: 780882 - DNA, 22 bp, Artificial Sequence
  chemically synthesized
actagcacaatgaacagatttg

SEQ ID NO: 780883 - DNA, 22 bp, Artificial Sequence
  chemically synthesized
gcacaatgaacagatttgagtt

SEQ ID NO: 780884 - DNA, 22 bp, Artificial Sequence
  chemically synthesized
tgtgtacatatgtaactcaaat

SEQ ID NO: 780885 - DNA, 22 bp, Artificial Sequence
  chemically synthesized
atgtgtacatatgtaactcaaa

SEQ ID NO: 780886 - DNA, 22 bp, Artificial Sequence
  chemically synthesized
tatgtgtacatatgtaactcaa

SEQ ID NO: 780887 - DNA, 22 bp, Artificial Sequence
  chemically synthesized
tgccgattttatgtgtacatat

SEQ ID NO: 780888 - DNA, 22 bp, Artificial Sequence
  chemically synthesized
gagttacatatgtacacataaa

SEQ ID NO: 780889 - DNA, 22 bp, Artificial Sequence
  chemically synthesized
agttacatatgtacacataaaa

SEQ ID NO: 780890 - DNA, 22 bp, Artificial Sequence
  chemically synthesized
catatgtacacataaaatcggc

SEQ ID NO: 780891 - DNA, 22 bp, Artificial Sequence
  chemically synthesized
tatgtgagtatcacgtctatgc

SEQ ID NO: 780892 - DNA, 22 bp, Artificial Sequence
  chemically synthesized
gtatgtgagtatcacgtctatg

SEQ ID NO: 780893 - DNA, 22 bp, Artificial Sequence
  chemically synthesized
tatttgtatgtgagtatcacgt

SEQ ID NO: 780894 - DNA, 22 bp, Artificial Sequence
  chemically synthesized
caatctgtatttgtatgtgagt

SEQ ID NO: 780895 - DNA, 22 bp, Artificial Sequence
  chemically synthesized
ccaatctgtatttgtatgtgag

SEQ ID NO: 780896 - DNA, 22 bp, Artificial Sequence
  chemically synthesized
tccaatctgtatttgtatgtga

SEQ ID NO: 780897 - DNA, 22 bp, Artificial Sequence
  chemically synthesized
ttccaatctgtatttgtatgtg

SEQ ID NO: 780898 - DNA, 22 bp, Artificial Sequence
  chemically synthesized
tttccaatctgtatttgtatgt

SEQ ID NO: 780899 - DNA, 22 bp, Artificial Sequence
  chemically synthesized
ttttccaatctgtatttgtatg

SEQ ID NO: 780900 - DNA, 22 bp, Artificial Sequence
  chemically synthesized
tttttccaatctgtatttgtat

SEQ ID NO: 780901 - DNA, 22 bp, Artificial Sequence
  chemically synthesized
ttttttccaatctgtatttgta

SEQ ID NO: 780902 - DNA, 22 bp, Artificial Sequence
  chemically synthesized
tttttttccaatctgtatttgt

SEQ ID NO: 780903 - DNA, 22 bp, Artificial Sequence
  chemically synthesized
ttttttttccaatctgtatttg

SEQ ID NO: 780904 - DNA, 22 bp, Artificial Sequence
  chemically synthesized
tttttttttccaatctgtattt

SEQ ID NO: 780905 - DNA, 22 bp, Artificial Sequence
  chemically synthesized
acatacaaatacagattggaaa

SEQ ID NO: 780906 - DNA, 22 bp, Artificial Sequence
  chemically synthesized
gtagcccagtggggtttttttt

SEQ ID NO: 780907 - DNA, 22 bp, Artificial Sequence
  chemically synthesized
ctcgtagcccagtggggttttt

SEQ ID NO: 780908 - DNA, 22 bp, Artificial Sequence
  chemically synthesized
gaaaaaaaaaaaaccccactgg

SEQ ID NO: 780909 - DNA, 22 bp, Artificial Sequence
  chemically synthesized
cactcctcgtagcccagtgggg

SEQ ID NO: 780910 - DNA, 22 bp, Artificial Sequence
  chemically synthesized
ggctacgaggagtggagttgcc

SEQ ID NO: 780911 - DNA, 22 bp, Artificial Sequence
  chemically synthesized
cgaggagtggagttgccaccat

SEQ ID NO: 780912 - DNA, 22 bp, Artificial Sequence
  chemically synthesized
gaggggatatatagcagggaat

SEQ ID NO: 780913 - DNA, 22 bp, Artificial Sequence
  chemically synthesized
ccaccattccctgctatatatc

SEQ ID NO: 780914 - DNA, 22 bp, Artificial Sequence
  chemically synthesized
aggccagctagaggggatatat

SEQ ID NO: 780915 - DNA, 22 bp, Artificial Sequence
  chemically synthesized
cctgctatatatcccctctagc

SEQ ID NO: 780916 - DNA, 22 bp, Artificial Sequence
  chemically synthesized
ctatatatcccctctagctggc

SEQ ID NO: 780917 - DNA, 22 bp, Artificial Sequence
  chemically synthesized
tatatcccctctagctggcctt

SEQ ID NO: 780918 - DNA, 22 bp, Artificial Sequence
  chemically synthesized
aaagagaggagaagtcacctaa

SEQ ID NO: 780919 - DNA, 22 bp, Artificial Sequence
  chemically synthesized
gaaagagaggagaagtcaccta

SEQ ID NO: 780920 - DNA, 22 bp, Artificial Sequence
  chemically synthesized
tagctggccttaggtgacttct

SEQ ID NO: 780921 - DNA, 22 bp, Artificial Sequence
  chemically synthesized
gctggccttaggtgacttctcc

SEQ ID NO: 780922 - DNA, 22 bp, Artificial Sequence
  chemically synthesized
gccttaggtgacttctcctctc

SEQ ID NO: 780923 - DNA, 22 bp, Artificial Sequence
  chemically synthesized
aaggagccttgaaagagaggag

SEQ ID NO: 780924 - DNA, 22 bp, Artificial Sequence
  chemically synthesized
aggtgacttctcctctctttca

SEQ ID NO: 780925 - DNA, 22 bp, Artificial Sequence
  chemically synthesized
ggtgacttctcctctctttcaa

SEQ ID NO: 780926 - DNA, 22 bp, Artificial Sequence
  chemically synthesized
gaatgtctaaaggagccttgaa

SEQ ID NO: 780927 - DNA, 22 bp, Artificial Sequence
  chemically synthesized
tagaatgtctaaaggagccttg

SEQ ID NO: 780928 - DNA, 22 bp, Artificial Sequence
  chemically synthesized
ctcctctctttcaaggctcctt

SEQ ID NO: 780929 - DNA, 22 bp, Artificial Sequence
  chemically synthesized
tcctctctttcaaggctccttt

SEQ ID NO: 780930 - DNA, 22 bp, Artificial Sequence
  chemically synthesized
ctctctttcaaggctcctttag

SEQ ID NO: 780931 - DNA, 22 bp, Artificial Sequence
  chemically synthesized
attctagaatgtctaaaggagc

SEQ ID NO: 780932 - DNA, 22 bp, Artificial Sequence
  chemically synthesized
cattctagaatgtctaaaggag

SEQ ID NO: 780933 - DNA, 22 bp, Artificial Sequence
  chemically synthesized
tcattctagaatgtctaaagga

SEQ ID NO: 780934 - DNA, 22 bp, Artificial Sequence
  chemically synthesized
tctttcaaggctcctttagaca

SEQ ID NO: 780935 - DNA, 22 bp, Artificial Sequence
  chemically synthesized
tttcaaggctcctttagacatt

SEQ ID NO: 780936 - DNA, 22 bp, Artificial Sequence
  chemically synthesized
tcaaggctcctttagacattct

SEQ ID NO: 780937 - DNA, 22 bp, Artificial Sequence
  chemically synthesized
caaggctcctttagacattcta

SEQ ID NO: 780938 - DNA, 22 bp, Artificial Sequence
  chemically synthesized
aaggctcctttagacattctag

SEQ ID NO: 780939 - DNA, 22 bp, Artificial Sequence
  chemically synthesized
caatattttcattctagaatgt

SEQ ID NO: 780940 - DNA, 22 bp, Artificial Sequence
  chemically synthesized
tgcaatattttcattctagaat

SEQ ID NO: 780941 - DNA, 22 bp, Artificial Sequence
  chemically synthesized
ctttagacattctagaatgaaa

SEQ ID NO: 780942 - DNA, 22 bp, Artificial Sequence
  chemically synthesized
caattctgcaatattttcattc

SEQ ID NO: 780943 - DNA, 22 bp, Artificial Sequence
  chemically synthesized
tagacattctagaatgaaaata

SEQ ID NO: 780944 - DNA, 22 bp, Artificial Sequence
  chemically synthesized
agacattctagaatgaaaatat

SEQ ID NO: 780945 - DNA, 22 bp, Artificial Sequence
  chemically synthesized
gacattctagaatgaaaatatt

SEQ ID NO: 780946 - DNA, 22 bp, Artificial Sequence
  chemically synthesized
attccaattctgcaatattttc

SEQ ID NO: 780947 - DNA, 22 bp, Artificial Sequence
  chemically synthesized
tcattccaattctgcaatattt

SEQ ID NO: 780948 - DNA, 22 bp, Artificial Sequence
  chemically synthesized
tctcattccaattctgcaatat

SEQ ID NO: 780949 - DNA, 22 bp, Artificial Sequence
  chemically synthesized
tagaatgaaaatattgcagaat

SEQ ID NO: 780950 - DNA, 22 bp, Artificial Sequence
  chemically synthesized
gaatgaaaatattgcagaattg

SEQ ID NO: 780951 - DNA, 22 bp, Artificial Sequence
  chemically synthesized
cagaattggaatgagagaggca

SEQ ID NO: 780952 - DNA, 22 bp, Artificial Sequence
  chemically synthesized
gaatgagagaggcatactgttt

SEQ ID NO: 780953 - DNA, 22 bp, Artificial Sequence
  chemically synthesized
agagagtaaatcaaacagtatg

SEQ ID NO: 780954 - DNA, 22 bp, Artificial Sequence
  chemically synthesized
tctaagagagtaaatcaaacag

SEQ ID NO: 780955 - DNA, 22 bp, Artificial Sequence
  chemically synthesized
atctaagagagtaaatcaaaca

SEQ ID NO: 780956 - DNA, 22 bp, Artificial Sequence
  chemically synthesized
tatctaagagagtaaatcaaac

SEQ ID NO: 780957 - DNA, 22 bp, Artificial Sequence
  chemically synthesized
aggctttatctaagagagtaaa

SEQ ID NO: 780958 - DNA, 22 bp, Artificial Sequence
  chemically synthesized
ttcaggctttatctaagagagt

SEQ ID NO: 780959 - DNA, 22 bp, Artificial Sequence
  chemically synthesized
tttgatttactctcttagataa

SEQ ID NO: 780960 - DNA, 22 bp, Artificial Sequence
  chemically synthesized
gatttactctcttagataaagc

SEQ ID NO: 780961 - DNA, 22 bp, Artificial Sequence
  chemically synthesized
atttactctcttagataaagcc

SEQ ID NO: 780962 - DNA, 22 bp, Artificial Sequence
  chemically synthesized
actctcttagataaagcctgaa

SEQ ID NO: 780963 - DNA, 22 bp, Artificial Sequence
  chemically synthesized
taagcgaaattattcaggcttt

SEQ ID NO: 780964 - DNA, 22 bp, Artificial Sequence
  chemically synthesized
ctctcttagataaagcctgaat

SEQ ID NO: 780965 - DNA, 22 bp, Artificial Sequence
  chemically synthesized
ttataagcgaaattattcaggc

SEQ ID NO: 780966 - DNA, 22 bp, Artificial Sequence
  chemically synthesized
tcttagataaagcctgaataat

SEQ ID NO: 780967 - DNA, 22 bp, Artificial Sequence
  chemically synthesized
ttagataaagcctgaataattt

SEQ ID NO: 780968 - DNA, 22 bp, Artificial Sequence
  chemically synthesized
agataaagcctgaataatttcg

SEQ ID NO: 780969 - DNA, 22 bp, Artificial Sequence
  chemically synthesized
gataaagcctgaataatttcgc

SEQ ID NO: 780970 - DNA, 22 bp, Artificial Sequence
  chemically synthesized
tcattgttataagcgaaattat

SEQ ID NO: 780971 - DNA, 22 bp, Artificial Sequence
  chemically synthesized
tgtcattgttataagcgaaatt

SEQ ID NO: 780972 - DNA, 22 bp, Artificial Sequence
  chemically synthesized
ctgtcattgttataagcgaaat

SEQ ID NO: 780973 - DNA, 22 bp, Artificial Sequence
  chemically synthesized
aataatttcgcttataacaatg

SEQ ID NO: 780974 - DNA, 22 bp, Artificial Sequence
  chemically synthesized
caataatttctgtcattgttat

SEQ ID NO: 780975 - DNA, 22 bp, Artificial Sequence
  chemically synthesized
ccaataatttctgtcattgtta

SEQ ID NO: 780976 - DNA, 22 bp, Artificial Sequence
  chemically synthesized
tcttccaataatttctgtcatt

SEQ ID NO: 780977 - DNA, 22 bp, Artificial Sequence
  chemically synthesized
cgcttataacaatgacagaaat

SEQ ID NO: 780978 - DNA, 22 bp, Artificial Sequence
  chemically synthesized
gcttataacaatgacagaaatt

SEQ ID NO: 780979 - DNA, 22 bp, Artificial Sequence
  chemically synthesized
ttatcttccaataatttctgtc

SEQ ID NO: 780980 - DNA, 22 bp, Artificial Sequence
  chemically synthesized
gttatcttccaataatttctgt

SEQ ID NO: 780981 - DNA, 22 bp, Artificial Sequence
  chemically synthesized
tgttatcttccaataatttctg

SEQ ID NO: 780982 - DNA, 22 bp, Artificial Sequence
  chemically synthesized
ataacaatgacagaaattattg

SEQ ID NO: 780983 - DNA, 22 bp, Artificial Sequence
  chemically synthesized
taacaatgacagaaattattgg

SEQ ID NO: 780984 - DNA, 22 bp, Artificial Sequence
  chemically synthesized
acatgacactttgttatcttcc

SEQ ID NO: 780985 - DNA, 22 bp, Artificial Sequence
  chemically synthesized
gataattcacatgacactttgt

SEQ ID NO: 780986 - DNA, 22 bp, Artificial Sequence
  chemically synthesized
agataattcacatgacactttg

SEQ ID NO: 780987 - DNA, 22 bp, Artificial Sequence
  chemically synthesized
ttggaagataacaaagtgtcat

SEQ ID NO: 780988 - DNA, 22 bp, Artificial Sequence
  chemically synthesized
ttagataattcacatgacactt

SEQ ID NO: 780989 - DNA, 22 bp, Artificial Sequence
  chemically synthesized
cttagataattcacatgacact

SEQ ID NO: 780990 - DNA, 22 bp, Artificial Sequence
  chemically synthesized
gaagataacaaagtgtcatgtg

SEQ ID NO: 780991 - DNA, 22 bp, Artificial Sequence
  chemically synthesized
tcttagataattcacatgacac

SEQ ID NO: 780992 - DNA, 22 bp, Artificial Sequence
  chemically synthesized
tctttcttagataattcacatg

SEQ ID NO: 780993 - DNA, 22 bp, Artificial Sequence
  chemically synthesized
atgttatctttcttagataatt

SEQ ID NO: 780994 - DNA, 22 bp, Artificial Sequence
  chemically synthesized
caccctaatgttatctttctta

SEQ ID NO: 780995 - DNA, 22 bp, Artificial Sequence
  chemically synthesized
attccaccctaatgttatcttt

SEQ ID NO: 780996 - DNA, 22 bp, Artificial Sequence
  chemically synthesized
cattccaccctaatgttatctt

SEQ ID NO: 780997 - DNA, 22 bp, Artificial Sequence
  chemically synthesized
ttcattccaccctaatgttatc

SEQ ID NO: 780998 - DNA, 22 bp, Artificial Sequence
  chemically synthesized
tctaagaaagataacattaggg

SEQ ID NO: 780999 - DNA, 22 bp, Artificial Sequence
  chemically synthesized
agaaagataacattagggtgga

SEQ ID NO: 781000 - DNA, 22 bp, Artificial Sequence
  chemically synthesized
agagctcttcattccaccctaa

SEQ ID NO: 781001 - DNA, 22 bp, Artificial Sequence
  chemically synthesized
cagagctcttcattccacccta

SEQ ID NO: 781002 - DNA, 22 bp, Artificial Sequence
  chemically synthesized
ttcagagctcttcattccaccc

SEQ ID NO: 781003 - DNA, 22 bp, Artificial Sequence
  chemically synthesized
gcactcttcagagctcttcatt

SEQ ID NO: 781004 - DNA, 22 bp, Artificial Sequence
  chemically synthesized
gggtggaatgaagagctctgaa

SEQ ID NO: 781005 - DNA, 22 bp, Artificial Sequence
  chemically synthesized
atatattggcactcttcagagc

SEQ ID NO: 781006 - DNA, 22 bp, Artificial Sequence
  chemically synthesized
ttcatatattggcactcttcag

SEQ ID NO: 781007 - DNA, 22 bp, Artificial Sequence
  chemically synthesized
tgaagagtgccaatatatgaat

SEQ ID NO: 781008 - DNA, 22 bp, Artificial Sequence
  chemically synthesized
aagagtgccaatatatgaataa

SEQ ID NO: 781009 - DNA, 22 bp, Artificial Sequence
  chemically synthesized
catataatgtgtattattcata

SEQ ID NO: 781010 - DNA, 22 bp, Artificial Sequence
  chemically synthesized
tccatataatgtgtattattca

SEQ ID NO: 781011 - DNA, 22 bp, Artificial Sequence
  chemically synthesized
ctccatataatgtgtattattc

SEQ ID NO: 781012 - DNA, 22 bp, Artificial Sequence
  chemically synthesized
tctccatataatgtgtattatt

SEQ ID NO: 781013 - DNA, 22 bp, Artificial Sequence
  chemically synthesized
accaaaaaagaaaaggctttct

SEQ ID NO: 781014 - DNA, 22 bp, Artificial Sequence
  chemically synthesized
tatggagaaagccttttctttt

SEQ ID NO: 781015 - DNA, 22 bp, Artificial Sequence
  chemically synthesized
aatcatgtattcaccaaaaaag

SEQ ID NO: 781016 - DNA, 22 bp, Artificial Sequence
  chemically synthesized
ctcaatcatgtattcaccaaaa

SEQ ID NO: 781017 - DNA, 22 bp, Artificial Sequence
  chemically synthesized
tactcaatcatgtattcaccaa

SEQ ID NO: 781018 - DNA, 22 bp, Artificial Sequence
  chemically synthesized
ttcttttttggtgaatacatga

SEQ ID NO: 781019 - DNA, 22 bp, Artificial Sequence
  chemically synthesized
tcttttttggtgaatacatgat

SEQ ID NO: 781020 - DNA, 22 bp, Artificial Sequence
  chemically synthesized
cttttttggtgaatacatgatt

SEQ ID NO: 781021 - DNA, 22 bp, Artificial Sequence
  chemically synthesized
ttttttggtgaatacatgattg

SEQ ID NO: 781022 - DNA, 22 bp, Artificial Sequence
  chemically synthesized
ttttggtgaatacatgattgag

SEQ ID NO: 781023 - DNA, 22 bp, Artificial Sequence
  chemically synthesized
tttggtgaatacatgattgagt

SEQ ID NO: 781024 - DNA, 22 bp, Artificial Sequence
  chemically synthesized
ttggtgaatacatgattgagta

SEQ ID NO: 781025 - DNA, 22 bp, Artificial Sequence
  chemically synthesized
tggtgaatacatgattgagtag

SEQ ID NO: 781026 - DNA, 22 bp, Artificial Sequence
  chemically synthesized
ggtgaatacatgattgagtaga

SEQ ID NO: 781027 - DNA, 22 bp, Artificial Sequence
  chemically synthesized
gtgaatacatgattgagtagaa

SEQ ID NO: 781028 - DNA, 22 bp, Artificial Sequence
  chemically synthesized
cagcaacgtaaaattctactca

SEQ ID NO: 781029 - DNA, 22 bp, Artificial Sequence
  chemically synthesized
ccagcaacgtaaaattctactc

SEQ ID NO: 781030 - DNA, 22 bp, Artificial Sequence
  chemically synthesized
ccttccagcaacgtaaaattct

SEQ ID NO: 781031 - DNA, 22 bp, Artificial Sequence
  chemically synthesized
taccttccagcaacgtaaaatt

SEQ ID NO: 781032 - DNA, 22 bp, Artificial Sequence
  chemically synthesized
agtagaattttacgttgctgga

SEQ ID NO: 781033 - DNA, 22 bp, Artificial Sequence
  chemically synthesized
tacgttgctggaaggtagagtt

SEQ ID NO: 781034 - DNA, 22 bp, Artificial Sequence
  chemically synthesized
acgttgctggaaggtagagttt

SEQ ID NO: 781035 - DNA, 22 bp, Artificial Sequence
  chemically synthesized
cgttgctggaaggtagagtttg

SEQ ID NO: 781036 - DNA, 22 bp, Artificial Sequence
  chemically synthesized
ctggaaggtagagtttgttctt

SEQ ID NO: 781037 - DNA, 22 bp, Artificial Sequence
  chemically synthesized
gaaggtagagtttgttcttctc

SEQ ID NO: 781038 - DNA, 22 bp, Artificial Sequence
  chemically synthesized
catgtatatatgcatagagaga

SEQ ID NO: 781039 - DNA, 22 bp, Artificial Sequence
  chemically synthesized
gttccatgtatatatgcataga

SEQ ID NO: 781040 - DNA, 22 bp, Artificial Sequence
  chemically synthesized
gttcttctctctatgcatatat

SEQ ID NO: 781041 - DNA, 22 bp, Artificial Sequence
  chemically synthesized
ttcttctctctatgcatatata

SEQ ID NO: 781042 - DNA, 22 bp, Artificial Sequence
  chemically synthesized
ttctctctatgcatatatacat

SEQ ID NO: 781043 - DNA, 22 bp, Artificial Sequence
  chemically synthesized
ctctctatgcatatatacatgg

SEQ ID NO: 781044 - DNA, 22 bp, Artificial Sequence
  chemically synthesized
tctctatgcatatatacatgga

SEQ ID NO: 781045 - DNA, 22 bp, Artificial Sequence
  chemically synthesized
tctatgcatatatacatggaac

SEQ ID NO: 781046 - DNA, 22 bp, Artificial Sequence
  chemically synthesized
aggtggagactagttccatgta

SEQ ID NO: 781047 - DNA, 22 bp, Artificial Sequence
  chemically synthesized
tatgcatatatacatggaacta

SEQ ID NO: 781048 - DNA, 22 bp, Artificial Sequence
  chemically synthesized
tcaggtggagactagttccatg

SEQ ID NO: 781049 - DNA, 22 bp, Artificial Sequence
  chemically synthesized
tgcatatatacatggaactagt

SEQ ID NO: 781050 - DNA, 22 bp, Artificial Sequence
  chemically synthesized
gtctccacctgagagcttatga

SEQ ID NO: 781051 - DNA, 22 bp, Artificial Sequence
  chemically synthesized
cacctgagagcttatgacctct

SEQ ID NO: 781052 - DNA, 22 bp, Artificial Sequence
  chemically synthesized
agagcttatgacctctttctct

SEQ ID NO: 781053 - DNA, 22 bp, Artificial Sequence
  chemically synthesized
aacaccaaagagagagaaagag

SEQ ID NO: 781054 - DNA, 22 bp, Artificial Sequence
  chemically synthesized
atgacctctttctctctctttg

SEQ ID NO: 781055 - DNA, 22 bp, Artificial Sequence
  chemically synthesized
tgacctctttctctctctttgg

SEQ ID NO: 781056 - DNA, 22 bp, Artificial Sequence
  chemically synthesized
tttctctctctttggtgttgaa

SEQ ID NO: 781057 - DNA, 22 bp, Artificial Sequence
  chemically synthesized
tctctctctttggtgttgaata

SEQ ID NO: 781058 - DNA, 22 bp, Artificial Sequence
  chemically synthesized
ctctctctttggtgttgaatat

SEQ ID NO: 781059 - DNA, 22 bp, Artificial Sequence
  chemically synthesized
tctctctttggtgttgaatatg

SEQ ID NO: 781060 - DNA, 22 bp, Artificial Sequence
  chemically synthesized
tctctttggtgttgaatatgtg

SEQ ID NO: 781061 - DNA, 22 bp, Artificial Sequence
  chemically synthesized
tctttggtgttgaatatgtgtg

SEQ ID NO: 781062 - DNA, 22 bp, Artificial Sequence
  chemically synthesized
tttggtgttgaatatgtgtgta

SEQ ID NO: 781063 - DNA, 22 bp, Artificial Sequence
  chemically synthesized
tggtgttgaatatgtgtgtata

SEQ ID NO: 781064 - DNA, 22 bp, Artificial Sequence
  chemically synthesized
cagtatcacacatatacacaca

SEQ ID NO: 781065 - DNA, 22 bp, Artificial Sequence
  chemically synthesized
ggtgttgaatatgtgtgtatat

SEQ ID NO: 781066 - DNA, 22 bp, Artificial Sequence
  chemically synthesized
gtgttgaatatgtgtgtatatg

SEQ ID NO: 781067 - DNA, 22 bp, Artificial Sequence
  chemically synthesized
aatatgtgtgtatatgtgtgat

SEQ ID NO: 781068 - DNA, 22 bp, Artificial Sequence
  chemically synthesized
agaagcactgcagtatcacaca

SEQ ID NO: 781069 - DNA, 22 bp, Artificial Sequence
  chemically synthesized
gagaagcactgcagtatcacac

SEQ ID NO: 781070 - DNA, 22 bp, Artificial Sequence
  chemically synthesized
cagcttgagaagcactgcagta

SEQ ID NO: 781071 - DNA, 22 bp, Artificial Sequence
  chemically synthesized
cacgcacgttgcagcttgagaa

SEQ ID NO: 781072 - DNA, 22 bp, Artificial Sequence
  chemically synthesized
cagtgcttctcaagctgcaacg

SEQ ID NO: 781073 - DNA, 22 bp, Artificial Sequence
  chemically synthesized
ctcaagctgcaacgtgcgtgca

SEQ ID NO: 781074 - DNA, 22 bp, Artificial Sequence
  chemically synthesized
tcaagctgcaacgtgcgtgcag

SEQ ID NO: 781075 - DNA, 22 bp, Artificial Sequence
  chemically synthesized
aagctgcaacgtgcgtgcagat

SEQ ID NO: 781076 - DNA, 22 bp, Artificial Sequence
  chemically synthesized
caacgtgcgtgcagatcccttg

SEQ ID NO: 781077 - DNA, 22 bp, Artificial Sequence
  chemically synthesized
taagacaatccccaagggatct

SEQ ID NO: 781078 - DNA, 22 bp, Artificial Sequence
  chemically synthesized
aatcagaatccgccattgtaag

SEQ ID NO: 781079 - DNA, 22 bp, Artificial Sequence
  chemically synthesized
ggggattgtcttacaatggcgg

SEQ ID NO: 781080 - DNA, 22 bp, Artificial Sequence
  chemically synthesized
ttgaatcagaatccgccattgt

SEQ ID NO: 781081 - DNA, 22 bp, Artificial Sequence
  chemically synthesized
gggattgtcttacaatggcgga

SEQ ID NO: 781082 - DNA, 22 bp, Artificial Sequence
  chemically synthesized
agaactgttgaatcagaatccg

SEQ ID NO: 781083 - DNA, 22 bp, Artificial Sequence
  chemically synthesized
tcttacaatggcggattctgat

SEQ ID NO: 781084 - DNA, 22 bp, Artificial Sequence
  chemically synthesized
cagaactgttgaatcagaatcc

SEQ ID NO: 781085 - DNA, 22 bp, Artificial Sequence
  chemically synthesized
acaatggcggattctgattcaa

SEQ ID NO: 781086 - DNA, 22 bp, Artificial Sequence
  chemically synthesized
caatggcggattctgattcaac

SEQ ID NO: 781087 - DNA, 22 bp, Artificial Sequence
  chemically synthesized
tgattcaacagttctgaagtgg

SEQ ID NO: 781088 - DNA, 22 bp, Artificial Sequence
  chemically synthesized
aaatcccaggccccacttcaga

SEQ ID NO: 781089 - DNA, 22 bp, Artificial Sequence
  chemically synthesized
gaaatcccaggccccacttcag

SEQ ID NO: 781090 - DNA, 22 bp, Artificial Sequence
  chemically synthesized
attcaacagttctgaagtgggg

SEQ ID NO: 781091 - DNA, 22 bp, Artificial Sequence
  chemically synthesized
tgaaatcccaggccccacttca

SEQ ID NO: 781092 - DNA, 22 bp, Artificial Sequence
  chemically synthesized
aacagttctgaagtggggcctg

SEQ ID NO: 781093 - DNA, 22 bp, Artificial Sequence
  chemically synthesized
gaattttgaaatcccaggcccc

SEQ ID NO: 781094 - DNA, 22 bp, Artificial Sequence
  chemically synthesized
agaattttgaaatcccaggccc

SEQ ID NO: 781095 - DNA, 22 bp, Artificial Sequence
  chemically synthesized
tagaattttgaaatcccaggcc

SEQ ID NO: 781096 - DNA, 22 bp, Artificial Sequence
  chemically synthesized
ttagaattttgaaatcccaggc

SEQ ID NO: 781097 - DNA, 22 bp, Artificial Sequence
  chemically synthesized
tttagaattttgaaatcccagg

SEQ ID NO: 781098 - DNA, 22 bp, Artificial Sequence
  chemically synthesized
ttttagaattttgaaatcccag

SEQ ID NO: 781099 - DNA, 22 bp, Artificial Sequence
  chemically synthesized
tgaagtggggcctgggatttca

SEQ ID NO: 781100 - DNA, 22 bp, Artificial Sequence
  chemically synthesized
aagtggggcctgggatttcaaa

SEQ ID NO: 781101 - DNA, 22 bp, Artificial Sequence
  chemically synthesized
ggagtttttttagaattttgaa

SEQ ID NO: 781102 - DNA, 22 bp, Artificial Sequence
  chemically synthesized
gggagtttttttagaattttga

SEQ ID NO: 781103 - DNA, 22 bp, Artificial Sequence
  chemically synthesized
ttgggagtttttttagaatttt

SEQ ID NO: 781104 - DNA, 22 bp, Artificial Sequence
  chemically synthesized
ggatttcaaaattctaaaaaaa

SEQ ID NO: 781105 - DNA, 22 bp, Artificial Sequence
  chemically synthesized
aacatctcttgggagttttttt

SEQ ID NO: 781106 - DNA, 22 bp, Artificial Sequence
  chemically synthesized
caaaattctaaaaaaactccca

SEQ ID NO: 781107 - DNA, 22 bp, Artificial Sequence
  chemically synthesized
aaaattctaaaaaaactcccaa

SEQ ID NO: 781108 - DNA, 22 bp, Artificial Sequence
  chemically synthesized
aagcctcaacatctcttgggag

SEQ ID NO: 781109 - DNA, 22 bp, Artificial Sequence
  chemically synthesized
taaaaaaactcccaagagatgt

SEQ ID NO: 781110 - DNA, 22 bp, Artificial Sequence
  chemically synthesized
aaaaaactcccaagagatgttg

SEQ ID NO: 781111 - DNA, 22 bp, Artificial Sequence
  chemically synthesized
ccaagagatgttgaggcttcaa

SEQ ID NO: 781112 - DNA, 22 bp, Artificial Sequence
  chemically synthesized
tgcaaagtgtgattgaagcctc

SEQ ID NO: 781113 - DNA, 22 bp, Artificial Sequence
  chemically synthesized
ctgtgcaaagtgtgattgaagc

SEQ ID NO: 781114 - DNA, 22 bp, Artificial Sequence
  chemically synthesized
gctgtgcaaagtgtgattgaag

SEQ ID NO: 781115 - DNA, 22 bp, Artificial Sequence
  chemically synthesized
aggcttcaatcacactttgcac

SEQ ID NO: 781116 - DNA, 22 bp, Artificial Sequence
  chemically synthesized
caatcacactttgcacagcaag

SEQ ID NO: 781117 - DNA, 22 bp, Artificial Sequence
  chemically synthesized
aaagagcatcaccttgctgtgc

SEQ ID NO: 781118 - DNA, 22 bp, Artificial Sequence
  chemically synthesized
aatcacactttgcacagcaagg

SEQ ID NO: 781119 - DNA, 22 bp, Artificial Sequence
  chemically synthesized
aaaagagcatcaccttgctgtg

SEQ ID NO: 781120 - DNA, 22 bp, Artificial Sequence
  chemically synthesized
ttaaaagagcatcaccttgctg

SEQ ID NO: 781121 - DNA, 22 bp, Artificial Sequence
  chemically synthesized
cttaaaagagcatcaccttgct

SEQ ID NO: 781122 - DNA, 22 bp, Artificial Sequence
  chemically synthesized
agtttcttaaaagagcatcacc

SEQ ID NO: 781123 - DNA, 22 bp, Artificial Sequence
  chemically synthesized
cagtttcttaaaagagcatcac

SEQ ID NO: 781124 - DNA, 22 bp, Artificial Sequence
  chemically synthesized
tgcacagcaaggtgatgctctt

SEQ ID NO: 781125 - DNA, 22 bp, Artificial Sequence
  chemically synthesized
gcacagcaaggtgatgctcttt

SEQ ID NO: 781126 - DNA, 22 bp, Artificial Sequence
  chemically synthesized
cacagcaaggtgatgctctttt

SEQ ID NO: 781127 - DNA, 22 bp, Artificial Sequence
  chemically synthesized
cttcagtttcttaaaagagcat

SEQ ID NO: 781128 - DNA, 22 bp, Artificial Sequence
  chemically synthesized
gtaattgcttcagtttcttaaa

SEQ ID NO: 781129 - DNA, 22 bp, Artificial Sequence
  chemically synthesized
ttagtaattgcttcagtttctt

SEQ ID NO: 781130 - DNA, 22 bp, Artificial Sequence
  chemically synthesized
gttagtaattgcttcagtttct

SEQ ID NO: 781131 - DNA, 22 bp, Artificial Sequence
  chemically synthesized
tttgttagtaattgcttcagtt

SEQ ID NO: 781132 - DNA, 22 bp, Artificial Sequence
  chemically synthesized
ttttaagaaactgaagcaatta

SEQ ID NO: 781133 - DNA, 22 bp, Artificial Sequence
  chemically synthesized
ttaagaaactgaagcaattact

SEQ ID NO: 781134 - DNA, 22 bp, Artificial Sequence
  chemically synthesized
taagaaactgaagcaattacta

SEQ ID NO: 781135 - DNA, 22 bp, Artificial Sequence
  chemically synthesized
aagaaactgaagcaattactaa

SEQ ID NO: 781136 - DNA, 22 bp, Artificial Sequence
  chemically synthesized
agaaactgaagcaattactaac

SEQ ID NO: 781137 - DNA, 22 bp, Artificial Sequence
  chemically synthesized
tgtgacctatttgttagtaatt

SEQ ID NO: 781138 - DNA, 22 bp, Artificial Sequence
  chemically synthesized
atgtgacctatttgttagtaat

SEQ ID NO: 781139 - DNA, 22 bp, Artificial Sequence
  chemically synthesized
aagcaattactaacaaataggt

SEQ ID NO: 781140 - DNA, 22 bp, Artificial Sequence
  chemically synthesized
catacttatgtgacctatttgt

SEQ ID NO: 781141 - DNA, 22 bp, Artificial Sequence
  chemically synthesized
taattacatacttatgtgacct

SEQ ID NO: 781142 - DNA, 22 bp, Artificial Sequence
  chemically synthesized
ctaacaaataggtcacataagt

SEQ ID NO: 781143 - DNA, 22 bp, Artificial Sequence
  chemically synthesized
ttataattacatacttatgtga

SEQ ID NO: 781144 - DNA, 22 bp, Artificial Sequence
  chemically synthesized
tgttataattacatacttatgt

SEQ ID NO: 781145 - DNA, 22 bp, Artificial Sequence
  chemically synthesized
acaaataggtcacataagtatg

SEQ ID NO: 781146 - DNA, 22 bp, Artificial Sequence
  chemically synthesized
ctgttataattacatacttatg

SEQ ID NO: 781147 - DNA, 22 bp, Artificial Sequence
  chemically synthesized
acttctgttataattacatact

SEQ ID NO: 781148 - DNA, 22 bp, Artificial Sequence
  chemically synthesized
tgcacagattcacttctgttat

SEQ ID NO: 781149 - DNA, 22 bp, Artificial Sequence
  chemically synthesized
gtgcacagattcacttctgtta

SEQ ID NO: 781150 - DNA, 22 bp, Artificial Sequence
  chemically synthesized
tgtgcacagattcacttctgtt

SEQ ID NO: 781151 - DNA, 22 bp, Artificial Sequence
  chemically synthesized
ttgtgcacagattcacttctgt

SEQ ID NO: 781152 - DNA, 22 bp, Artificial Sequence
  chemically synthesized
ttttgtgcacagattcacttct

SEQ ID NO: 781153 - DNA, 22 bp, Artificial Sequence
  chemically synthesized
cttttgtgcacagattcacttc

SEQ ID NO: 781154 - DNA, 22 bp, Artificial Sequence
  chemically synthesized
tcttttgtgcacagattcactt

SEQ ID NO: 781155 - DNA, 22 bp, Artificial Sequence
  chemically synthesized
tttcttttgtgcacagattcac

SEQ ID NO: 781156 - DNA, 22 bp, Artificial Sequence
  chemically synthesized
taacagaagtgaatctgtgcac

SEQ ID NO: 781157 - DNA, 22 bp, Artificial Sequence
  chemically synthesized
atagttctttcttttgtgcaca

SEQ ID NO: 781158 - DNA, 22 bp, Artificial Sequence
  chemically synthesized
catagttctttcttttgtgcac

SEQ ID NO: 781159 - DNA, 22 bp, Artificial Sequence
  chemically synthesized
tcatagttctttcttttgtgca

SEQ ID NO: 781160 - DNA, 22 bp, Artificial Sequence
  chemically synthesized
tttcatagttctttcttttgtg

SEQ ID NO: 781161 - DNA, 22 bp, Artificial Sequence
  chemically synthesized
tgcacaaaagaaagaactatga

SEQ ID NO: 781162 - DNA, 22 bp, Artificial Sequence
  chemically synthesized
agacataattctttcatagttc

SEQ ID NO: 781163 - DNA, 22 bp, Artificial Sequence
  chemically synthesized
tgaaagaattatgtctgagtta

SEQ ID NO: 781164 - DNA, 22 bp, Artificial Sequence
  chemically synthesized
tgtctgagttatatgtgtatat

SEQ ID NO: 781165 - DNA, 22 bp, Artificial Sequence
  chemically synthesized
agttatatgtgtatatatatat

SEQ ID NO: 781166 - DNA, 22 bp, Artificial Sequence
  chemically synthesized
tatgtgtatatatatatactat

SEQ ID NO: 781167 - DNA, 22 bp, Artificial Sequence
  chemically synthesized
tatatatgtgtgcgtatatata

SEQ ID NO: 781168 - DNA, 22 bp, Artificial Sequence
  chemically synthesized
tatgtccatatatatatatacg

SEQ ID NO: 781169 - DNA, 22 bp, Artificial Sequence
  chemically synthesized
tcacagtaataataatgccaat

SEQ ID NO: 781170 - DNA, 22 bp, Artificial Sequence
  chemically synthesized
tatcacagtaataataatgcca

SEQ ID NO: 781171 - DNA, 22 bp, Artificial Sequence
  chemically synthesized
ctatcacagtaataataatgcc

SEQ ID NO: 781172 - DNA, 22 bp, Artificial Sequence
  chemically synthesized
tctatcacagtaataataatgc

SEQ ID NO: 781173 - DNA, 22 bp, Artificial Sequence
  chemically synthesized
gcattattattactgtgataga

SEQ ID NO: 781174 - DNA, 22 bp, Artificial Sequence
  chemically synthesized
cagaagagaggtctttctatca

SEQ ID NO: 781175 - DNA, 22 bp, Artificial Sequence
  chemically synthesized
gcagaagagaggtctttctatc

SEQ ID NO: 781176 - DNA, 22 bp, Artificial Sequence
  chemically synthesized
ttattactgtgatagaaagacc

SEQ ID NO: 781177 - DNA, 22 bp, Artificial Sequence
  chemically synthesized
gcttgcagaagagaggtctttc

SEQ ID NO: 781178 - DNA, 22 bp, Artificial Sequence
  chemically synthesized
ttactgtgatagaaagacctct

SEQ ID NO: 781179 - DNA, 22 bp, Artificial Sequence
  chemically synthesized
ggcttgcagaagagaggtcttt

SEQ ID NO: 781180 - DNA, 22 bp, Artificial Sequence
  chemically synthesized
ctgtgatagaaagacctctctt

SEQ ID NO: 781181 - DNA, 22 bp, Artificial Sequence
  chemically synthesized
tgatagaaagacctctcttctg

SEQ ID NO: 781182 - DNA, 22 bp, Artificial Sequence
  chemically synthesized
tcttctgcaagccaaattatct

SEQ ID NO: 781183 - DNA, 22 bp, Artificial Sequence
  chemically synthesized
ttctgcaagccaaattatcttt

SEQ ID NO: 781184 - DNA, 22 bp, Artificial Sequence
  chemically synthesized
ctgcaagccaaattatctttca

SEQ ID NO: 781185 - DNA, 22 bp, Artificial Sequence
  chemically synthesized
tgcaagccaaattatctttcac

SEQ ID NO: 781186 - DNA, 22 bp, Artificial Sequence
  chemically synthesized
aagaagcaacaaagtgaaagat

SEQ ID NO: 781187 - DNA, 22 bp, Artificial Sequence
  chemically synthesized
caagccaaattatctttcactt

SEQ ID NO: 781188 - DNA, 22 bp, Artificial Sequence
  chemically synthesized
tctttcactttgttgcttcttg

SEQ ID NO: 781189 - DNA, 22 bp, Artificial Sequence
  chemically synthesized
tcactttgttgcttcttgaatt

SEQ ID NO: 781190 - DNA, 22 bp, Artificial Sequence
  chemically synthesized
cactttgttgcttcttgaattc

SEQ ID NO: 781191 - DNA, 22 bp, Artificial Sequence
  chemically synthesized
actttgttgcttcttgaattct

SEQ ID NO: 781192 - DNA, 22 bp, Artificial Sequence
  chemically synthesized
tgttgcttcttgaattcttttc

SEQ ID NO: 781193 - DNA, 22 bp, Artificial Sequence
  chemically synthesized
gttgcttcttgaattcttttct

SEQ ID NO: 781194 - DNA, 22 bp, Artificial Sequence
  chemically synthesized
ttgcttcttgaattcttttctt

SEQ ID NO: 781195 - DNA, 22 bp, Artificial Sequence
  chemically synthesized
taggggaaaaaagaagaaaaga

SEQ ID NO: 781196 - DNA, 22 bp, Artificial Sequence
  chemically synthesized
cttcttgaattcttttcttctt

SEQ ID NO: 781197 - DNA, 22 bp, Artificial Sequence
  chemically synthesized
cttgaattcttttcttcttttt

SEQ ID NO: 781198 - DNA, 22 bp, Artificial Sequence
  chemically synthesized
ttgaattcttttcttctttttt

SEQ ID NO: 781199 - DNA, 22 bp, Artificial Sequence
  chemically synthesized
gaattcttttcttcttttttcc

SEQ ID NO: 781200 - DNA, 22 bp, Artificial Sequence
  chemically synthesized
aattcttttcttcttttttccc

SEQ ID NO: 781201 - DNA, 22 bp, Artificial Sequence
  chemically synthesized
gagatgcaattgtaggggaaaa

SEQ ID NO: 781202 - DNA, 22 bp, Artificial Sequence
  chemically synthesized
ttttcttcttttttcccctaca

SEQ ID NO: 781203 - DNA, 22 bp, Artificial Sequence
  chemically synthesized
ttcttcttttttcccctacaat

SEQ ID NO: 781204 - DNA, 22 bp, Artificial Sequence
  chemically synthesized
tcttcttttttcccctacaatt

SEQ ID NO: 781205 - DNA, 22 bp, Artificial Sequence
  chemically synthesized
cttcttttttcccctacaattg

SEQ ID NO: 781206 - DNA, 22 bp, Artificial Sequence
  chemically synthesized
ttcttttttcccctacaattgc

SEQ ID NO: 781207 - DNA, 22 bp, Artificial Sequence
  chemically synthesized
cttttttcccctacaattgcat

SEQ ID NO: 781208 - DNA, 22 bp, Artificial Sequence
  chemically synthesized
ttttttcccctacaattgcatc

SEQ ID NO: 781209 - DNA, 22 bp, Artificial Sequence
  chemically synthesized
aaggagatctggagatgcaatt

SEQ ID NO: 781210 - DNA, 22 bp, Artificial Sequence
  chemically synthesized
ttttcccctacaattgcatctc

SEQ ID NO: 781211 - DNA, 22 bp, Artificial Sequence
  chemically synthesized
caaggagatctggagatgcaat

SEQ ID NO: 781212 - DNA, 22 bp, Artificial Sequence
  chemically synthesized
tttcccctacaattgcatctcc

SEQ ID NO: 781213 - DNA, 22 bp, Artificial Sequence
  chemically synthesized
tcaaggagatctggagatgcaa

SEQ ID NO: 781214 - DNA, 22 bp, Artificial Sequence
  chemically synthesized
ttcccctacaattgcatctcca

SEQ ID NO: 781215 - DNA, 22 bp, Artificial Sequence
  chemically synthesized
tcccctacaattgcatctccag

SEQ ID NO: 781216 - DNA, 22 bp, Artificial Sequence
  chemically synthesized
cccctacaattgcatctccaga

SEQ ID NO: 781217 - DNA, 22 bp, Artificial Sequence
  chemically synthesized
ccctacaattgcatctccagat

SEQ ID NO: 781218 - DNA, 22 bp, Artificial Sequence
  chemically synthesized
accctttcaaggagatctggag

SEQ ID NO: 781219 - DNA, 22 bp, Artificial Sequence
  chemically synthesized
gaccctttcaaggagatctgga

SEQ ID NO: 781220 - DNA, 22 bp, Artificial Sequence
  chemically synthesized
caattgcatctccagatctcct

SEQ ID NO: 781221 - DNA, 22 bp, Artificial Sequence
  chemically synthesized
cttgaccctttcaaggagatct

SEQ ID NO: 781222 - DNA, 22 bp, Artificial Sequence
  chemically synthesized
tacttgaccctttcaaggagat

SEQ ID NO: 781223 - DNA, 22 bp, Artificial Sequence
  chemically synthesized
catctccagatctccttgaaag

SEQ ID NO: 781224 - DNA, 22 bp, Artificial Sequence
  chemically synthesized
cagatctccttgaaagggtcaa

SEQ ID NO: 781225 - DNA, 22 bp, Artificial Sequence
  chemically synthesized
cttgaaagggtcaagtagaatg

SEQ ID NO: 781226 - DNA, 22 bp, Artificial Sequence
  chemically synthesized
gatagcccataggcattctact

SEQ ID NO: 781227 - DNA, 22 bp, Artificial Sequence
  chemically synthesized
gaaagggtcaagtagaatgcct

SEQ ID NO: 781228 - DNA, 22 bp, Artificial Sequence
  chemically synthesized
aaagggtcaagtagaatgccta

SEQ ID NO: 781229 - DNA, 22 bp, Artificial Sequence
  chemically synthesized
ccaacatagttagatagcccat

SEQ ID NO: 781230 - DNA, 22 bp, Artificial Sequence
  chemically synthesized
accaacatagttagatagccca

SEQ ID NO: 781231 - DNA, 22 bp, Artificial Sequence
  chemically synthesized
cttaccaacatagttagatagc

SEQ ID NO: 781232 - DNA, 22 bp, Artificial Sequence
  chemically synthesized
aaactccttaccaacatagtta

SEQ ID NO: 781233 - DNA, 22 bp, Artificial Sequence
  chemically synthesized
tgggctatctaactatgttggt

SEQ ID NO: 781234 - DNA, 22 bp, Artificial Sequence
  chemically synthesized
aattcaaactccttaccaacat

SEQ ID NO: 781235 - DNA, 22 bp, Artificial Sequence
  chemically synthesized
tctaactatgttggtaaggagt

SEQ ID NO: 781236 - DNA, 22 bp, Artificial Sequence
  chemically synthesized
actatgttggtaaggagtttga

SEQ ID NO: 781237 - DNA, 22 bp, Artificial Sequence
  chemically synthesized
aatgtcattgaattcaaactcc

SEQ ID NO: 781238 - DNA, 22 bp, Artificial Sequence
  chemically synthesized
tgttggtaaggagtttgaattc

SEQ ID NO: 781239 - DNA, 22 bp, Artificial Sequence
  chemically synthesized
gtaaggagtttgaattcaatga

SEQ ID NO: 781240 - DNA, 22 bp, Artificial Sequence
  chemically synthesized
gatatgcattgaatgtcattga

SEQ ID NO: 781241 - DNA, 22 bp, Artificial Sequence
  chemically synthesized
agatatgcattgaatgtcattg

SEQ ID NO: 781242 - DNA, 22 bp, Artificial Sequence
  chemically synthesized
gcttagatatgcattgaatgtc

SEQ ID NO: 781243 - DNA, 22 bp, Artificial Sequence
  chemically synthesized
ggcttagatatgcattgaatgt

SEQ ID NO: 781244 - DNA, 22 bp, Artificial Sequence
  chemically synthesized
gaattcaatgacattcaatgca

SEQ ID NO: 781245 - DNA, 22 bp, Artificial Sequence
  chemically synthesized
aattcaatgacattcaatgcat

SEQ ID NO: 781246 - DNA, 22 bp, Artificial Sequence
  chemically synthesized
aatgacattcaatgcatatcta

SEQ ID NO: 781247 - DNA, 22 bp, Artificial Sequence
  chemically synthesized
tgacagcttggcttagatatgc

SEQ ID NO: 781248 - DNA, 22 bp, Artificial Sequence
  chemically synthesized
aatgcatatctaagccaagctg

SEQ ID NO: 781249 - DNA, 22 bp, Artificial Sequence
  chemically synthesized
agtgtgttgtgacagcttggct

SEQ ID NO: 781250 - DNA, 22 bp, Artificial Sequence
  chemically synthesized
gagtgtgttgtgacagcttggc

SEQ ID NO: 781251 - DNA, 22 bp, Artificial Sequence
  chemically synthesized
gcaggcttgagtgtgttgtgac

SEQ ID NO: 781252 - DNA, 22 bp, Artificial Sequence
  chemically synthesized
ggcaggcttgagtgtgttgtga

SEQ ID NO: 781253 - DNA, 22 bp, Artificial Sequence
  chemically synthesized
tggcaggcttgagtgtgttgtg

SEQ ID NO: 781254 - DNA, 22 bp, Artificial Sequence
  chemically synthesized
agccaagctgtcacaacacact

SEQ ID NO: 781255 - DNA, 22 bp, Artificial Sequence
  chemically synthesized
ctttggcaggcttgagtgtgtt

SEQ ID NO: 781256 - DNA, 22 bp, Artificial Sequence
  chemically synthesized
tcacaacacactcaagcctgcc

SEQ ID NO: 781257 - DNA, 22 bp, Artificial Sequence
  chemically synthesized
tacgaactcctttggcaggctt

SEQ ID NO: 781258 - DNA, 22 bp, Artificial Sequence
  chemically synthesized
gtacgaactcctttggcaggct

SEQ ID NO: 781259 - DNA, 22 bp, Artificial Sequence
  chemically synthesized
aagatttgtacgaactcctttg

SEQ ID NO: 781260 - DNA, 22 bp, Artificial Sequence
  chemically synthesized
aaagatttgtacgaactccttt

SEQ ID NO: 781261 - DNA, 22 bp, Artificial Sequence
  chemically synthesized
taaagatttgtacgaactcctt

SEQ ID NO: 781262 - DNA, 22 bp, Artificial Sequence
  chemically synthesized
aagcctgccaaaggagttcgta

SEQ ID NO: 781263 - DNA, 22 bp, Artificial Sequence
  chemically synthesized
ttttaaagatttgtacgaactc

SEQ ID NO: 781264 - DNA, 22 bp, Artificial Sequence
  chemically synthesized
ccaaaggagttcgtacaaatct

SEQ ID NO: 781265 - DNA, 22 bp, Artificial Sequence
  chemically synthesized
taaattattttaaagatttgta

SEQ ID NO: 781266 - DNA, 22 bp, Artificial Sequence
  chemically synthesized
ctgtaaattattttaaagattt

SEQ ID NO: 781267 - DNA, 22 bp, Artificial Sequence
  chemically synthesized
tcctgtaaattattttaaagat

SEQ ID NO: 781268 - DNA, 22 bp, Artificial Sequence
  chemically synthesized
tctctcctgtaaattattttaa

SEQ ID NO: 781269 - DNA, 22 bp, Artificial Sequence
  chemically synthesized
gtctctcctgtaaattatttta

SEQ ID NO: 781270 - DNA, 22 bp, Artificial Sequence
  chemically synthesized
gtacaaatctttaaaataattt

SEQ ID NO: 781271 - DNA, 22 bp, Artificial Sequence
  chemically synthesized
tgtctctcctgtaaattatttt

SEQ ID NO: 781272 - DNA, 22 bp, Artificial Sequence
  chemically synthesized
taaaataatttacaggagagac

SEQ ID NO: 781273 - DNA, 22 bp, Artificial Sequence
  chemically synthesized
aaaataatttacaggagagaca

SEQ ID NO: 781274 - DNA, 22 bp, Artificial Sequence
  chemically synthesized
aaataatttacaggagagacaa

SEQ ID NO: 781275 - DNA, 22 bp, Artificial Sequence
  chemically synthesized
acaggagagacaaaattaccac

SEQ ID NO: 781276 - DNA, 22 bp, Artificial Sequence
  chemically synthesized
caggagagacaaaattaccaca

SEQ ID NO: 781277 - DNA, 22 bp, Artificial Sequence
  chemically synthesized
ataatgggaatgatgtggtaat

SEQ ID NO: 781278 - DNA, 22 bp, Artificial Sequence
  chemically synthesized
tgataatgggaatgatgtggta

SEQ ID NO: 781279 - DNA, 22 bp, Artificial Sequence
  chemically synthesized
ctgataatgggaatgatgtggt

SEQ ID NO: 781280 - DNA, 22 bp, Artificial Sequence
  chemically synthesized
ttctgataatgggaatgatgtg

SEQ ID NO: 781281 - DNA, 22 bp, Artificial Sequence
  chemically synthesized
cttctgataatgggaatgatgt

SEQ ID NO: 781282 - DNA, 22 bp, Artificial Sequence
  chemically synthesized
tttcttctgataatgggaatga

SEQ ID NO: 781283 - DNA, 22 bp, Artificial Sequence
  chemically synthesized
aattatttcttctgataatggg

SEQ ID NO: 781284 - DNA, 22 bp, Artificial Sequence
  chemically synthesized
gaattatttcttctgataatgg

SEQ ID NO: 781285 - DNA, 22 bp, Artificial Sequence
  chemically synthesized
ccacatcattcccattatcaga

SEQ ID NO: 781286 - DNA, 22 bp, Artificial Sequence
  chemically synthesized
atttgaattatttcttctgata

SEQ ID NO: 781287 - DNA, 22 bp, Artificial Sequence
  chemically synthesized
aatttgaattatttcttctgat

SEQ ID NO: 781288 - DNA, 22 bp, Artificial Sequence
  chemically synthesized
ttaatttgaattatttcttctg

SEQ ID NO: 781289 - DNA, 22 bp, Artificial Sequence
  chemically synthesized
cttaatttgaattatttcttct

SEQ ID NO: 781290 - DNA, 22 bp, Artificial Sequence
  chemically synthesized
tcttaatttgaattatttcttc

SEQ ID NO: 781291 - DNA, 22 bp, Artificial Sequence
  chemically synthesized
ttcttaatttgaattatttctt

SEQ ID NO: 781292 - DNA, 22 bp, Artificial Sequence
  chemically synthesized
ccattatcagaagaaataattc

SEQ ID NO: 781293 - DNA, 22 bp, Artificial Sequence
  chemically synthesized
atttttcttaatttgaattatt

SEQ ID NO: 781294 - DNA, 22 bp, Artificial Sequence
  chemically synthesized
taatttttcttaatttgaatta

SEQ ID NO: 781295 - DNA, 22 bp, Artificial Sequence
  chemically synthesized
ctaatttttcttaatttgaatt

SEQ ID NO: 781296 - DNA, 22 bp, Artificial Sequence
  chemically synthesized
tcagaagaaataattcaaatta

SEQ ID NO: 781297 - DNA, 22 bp, Artificial Sequence
  chemically synthesized
tttctaatttttcttaatttga

SEQ ID NO: 781298 - DNA, 22 bp, Artificial Sequence
  chemically synthesized
atttctaatttttcttaatttg

SEQ ID NO: 781299 - DNA, 22 bp, Artificial Sequence
  chemically synthesized
tatttctaatttttcttaattt

SEQ ID NO: 781300 - DNA, 22 bp, Artificial Sequence
  chemically synthesized
ttatttctaatttttcttaatt

SEQ ID NO: 781301 - DNA, 22 bp, Artificial Sequence
  chemically synthesized
atttttatttctaatttttctt

SEQ ID NO: 781302 - DNA, 22 bp, Artificial Sequence
  chemically synthesized
catttttatttctaatttttct

SEQ ID NO: 781303 - DNA, 22 bp, Artificial Sequence
  chemically synthesized
ttcatttttatttctaattttt

SEQ ID NO: 781304 - DNA, 22 bp, Artificial Sequence
  chemically synthesized
aaattaagaaaaattagaaata

SEQ ID NO: 781305 - DNA, 22 bp, Artificial Sequence
  chemically synthesized
agaaaaattagaaataaaaatg

SEQ ID NO: 781306 - DNA, 22 bp, Artificial Sequence
  chemically synthesized
agtgtcatctcttcatttttat

SEQ ID NO: 781307 - DNA, 22 bp, Artificial Sequence
  chemically synthesized
cagtgtcatctcttcattttta

SEQ ID NO: 781308 - DNA, 22 bp, Artificial Sequence
  chemically synthesized
ttcagtgtcatctcttcatttt

SEQ ID NO: 781309 - DNA, 22 bp, Artificial Sequence
  chemically synthesized
gaaataaaaatgaagagatgac

SEQ ID NO: 781310 - DNA, 22 bp, Artificial Sequence
  chemically synthesized
cagtggtgagatattcttcagt

SEQ ID NO: 781311 - DNA, 22 bp, Artificial Sequence
  chemically synthesized
ccagtggtgagatattcttcag

SEQ ID NO: 781312 - DNA, 22 bp, Artificial Sequence
  chemically synthesized
aagaatatctcaccactggaag

SEQ ID NO: 781313 - DNA, 22 bp, Artificial Sequence
  chemically synthesized
tagatgaaagtcatcttccagt

SEQ ID NO: 781314 - DNA, 22 bp, Artificial Sequence
  chemically synthesized
accactggaagatgactttcat

SEQ ID NO: 781315 - DNA, 22 bp, Artificial Sequence
  chemically synthesized
tagagagatcactgtagatgaa

SEQ ID NO: 781316 - DNA, 22 bp, Artificial Sequence
  chemically synthesized
atagagagatcactgtagatga

SEQ ID NO: 781317 - DNA, 22 bp, Artificial Sequence
  chemically synthesized
gaagatgactttcatctacagt

SEQ ID NO: 781318 - DNA, 22 bp, Artificial Sequence
  chemically synthesized
tatagagagatcactgtagatg

SEQ ID NO: 781319 - DNA, 22 bp, Artificial Sequence
  chemically synthesized
ctttatagagagatcactgtag

SEQ ID NO: 781320 - DNA, 22 bp, Artificial Sequence
  chemically synthesized
gctttatagagagatcactgta

SEQ ID NO: 781321 - DNA, 22 bp, Artificial Sequence
  chemically synthesized
tgctttatagagagatcactgt

SEQ ID NO: 781322 - DNA, 22 bp, Artificial Sequence
  chemically synthesized
tcatctacagtgatctctctat

SEQ ID NO: 781323 - DNA, 22 bp, Artificial Sequence
  chemically synthesized
catctacagtgatctctctata

SEQ ID NO: 781324 - DNA, 22 bp, Artificial Sequence
  chemically synthesized
atctacagtgatctctctataa

SEQ ID NO: 781325 - DNA, 22 bp, Artificial Sequence
  chemically synthesized
aaaagtatctttgctttataga

SEQ ID NO: 781326 - DNA, 22 bp, Artificial Sequence
  chemically synthesized
cagtgatctctctataaagcaa

SEQ ID NO: 781327 - DNA, 22 bp, Artificial Sequence
  chemically synthesized
aataatagctgaaaagtatctt

SEQ ID NO: 781328 - DNA, 22 bp, Artificial Sequence
  chemically synthesized
tctataaagcaaagatactttt

SEQ ID NO: 781329 - DNA, 22 bp, Artificial Sequence
  chemically synthesized
tataaagcaaagatacttttca

SEQ ID NO: 781330 - DNA, 22 bp, Artificial Sequence
  chemically synthesized
ctgaataatagctgaaaagtat

SEQ ID NO: 781331 - DNA, 22 bp, Artificial Sequence
  chemically synthesized
actgaataatagctgaaaagta

SEQ ID NO: 781332 - DNA, 22 bp, Artificial Sequence
  chemically synthesized
taaagcaaagatacttttcagc

SEQ ID NO: 781333 - DNA, 22 bp, Artificial Sequence
  chemically synthesized
acttactgaataatagctgaaa

SEQ ID NO: 781334 - DNA, 22 bp, Artificial Sequence
  chemically synthesized
gactcacttactgaataatagc

SEQ ID NO: 781335 - DNA, 22 bp, Artificial Sequence
  chemically synthesized
ttggactcacttactgaataat

SEQ ID NO: 781336 - DNA, 22 bp, Artificial Sequence
  chemically synthesized
ttcagctattattcagtaagtg

SEQ ID NO: 781337 - DNA, 22 bp, Artificial Sequence
  chemically synthesized
tcagctattattcagtaagtga

SEQ ID NO: 781338 - DNA, 22 bp, Artificial Sequence
  chemically synthesized
cagctattattcagtaagtgag

SEQ ID NO: 781339 - DNA, 22 bp, Artificial Sequence
  chemically synthesized
agctattattcagtaagtgagt

SEQ ID NO: 781340 - DNA, 22 bp, Artificial Sequence
  chemically synthesized
ttattcagtaagtgagtccaac

SEQ ID NO: 781341 - DNA, 22 bp, Artificial Sequence
  chemically synthesized
ttcagtaagtgagtccaacagt

SEQ ID NO: 781342 - DNA, 22 bp, Artificial Sequence
  chemically synthesized
agtaagtgagtccaacagtttc

SEQ ID NO: 781343 - DNA, 22 bp, Artificial Sequence
  chemically synthesized
acaatatcagaggaaactgttg

SEQ ID NO: 781344 - DNA, 22 bp, Artificial Sequence
  chemically synthesized
aattcacaatatcagaggaaac

SEQ ID NO: 781345 - DNA, 22 bp, Artificial Sequence
  chemically synthesized
attaaattcacaatatcagagg

SEQ ID NO: 781346 - DNA, 22 bp, Artificial Sequence
  chemically synthesized
ctaattaaattcacaatatcag

SEQ ID NO: 781347 - DNA, 22 bp, Artificial Sequence
  chemically synthesized
cctactaattaaattcacaata

SEQ ID NO: 781348 - DNA, 22 bp, Artificial Sequence
  chemically synthesized
cctctgatattgtgaatttaat

SEQ ID NO: 781349 - DNA, 22 bp, Artificial Sequence
  chemically synthesized
ctctgatattgtgaatttaatt

SEQ ID NO: 781350 - DNA, 22 bp, Artificial Sequence
  chemically synthesized
tgatattgtgaatttaattagt

SEQ ID NO: 781351 - DNA, 22 bp, Artificial Sequence
  chemically synthesized
atattgtgaatttaattagtag

SEQ ID NO: 781352 - DNA, 22 bp, Artificial Sequence
  chemically synthesized
atgagcaaattgcctactaatt

SEQ ID NO: 781353 - DNA, 22 bp, Artificial Sequence
  chemically synthesized
catgagcaaattgcctactaat

SEQ ID NO: 781354 - DNA, 22 bp, Artificial Sequence
  chemically synthesized
tgaatttaattagtaggcaatt

SEQ ID NO: 781355 - DNA, 22 bp, Artificial Sequence
  chemically synthesized
atttcatgagcaaattgcctac

SEQ ID NO: 781356 - DNA, 22 bp, Artificial Sequence
  chemically synthesized
tgatttcatgagcaaattgcct

SEQ ID NO: 781357 - DNA, 22 bp, Artificial Sequence
  chemically synthesized
aattagtaggcaatttgctcat

SEQ ID NO: 781358 - DNA, 22 bp, Artificial Sequence
  chemically synthesized
gattctgatttcatgagcaaat

SEQ ID NO: 781359 - DNA, 22 bp, Artificial Sequence
  chemically synthesized
attagtaggcaatttgctcatg

SEQ ID NO: 781360 - DNA, 22 bp, Artificial Sequence
  chemically synthesized
gtaggcaatttgctcatgaaat

SEQ ID NO: 781361 - DNA, 22 bp, Artificial Sequence
  chemically synthesized
gctcatgaaatcagaatctagc

SEQ ID NO: 781362 - DNA, 22 bp, Artificial Sequence
  chemically synthesized
ctcatgaaatcagaatctagcc

SEQ ID NO: 781363 - DNA, 22 bp, Artificial Sequence
  chemically synthesized
atgaaatcagaatctagccctt

SEQ ID NO: 781364 - DNA, 22 bp, Artificial Sequence
  chemically synthesized
gcccttcccttgctgggttgct

SEQ ID NO: 781365 - DNA, 22 bp, Artificial Sequence
  chemically synthesized
cccttgctgggttgctggatct

SEQ ID NO: 781366 - DNA, 22 bp, Artificial Sequence
  chemically synthesized
ccttgctgggttgctggatctg

SEQ ID NO: 781367 - DNA, 22 bp, Artificial Sequence
  chemically synthesized
gctgggttgctggatctgtgta

SEQ ID NO: 781368 - DNA, 22 bp, Artificial Sequence
  chemically synthesized
ctgggttgctggatctgtgtat

SEQ ID NO: 781369 - DNA, 22 bp, Artificial Sequence
  chemically synthesized
ggttgctggatctgtgtattcc

SEQ ID NO: 781370 - DNA, 22 bp, Artificial Sequence
  chemically synthesized
gagaagaatataggaatacaca

SEQ ID NO: 781371 - DNA, 22 bp, Artificial Sequence
  chemically synthesized
ctggatctgtgtattcctatat

SEQ ID NO: 781372 - DNA, 22 bp, Artificial Sequence
  chemically synthesized
gatctgtgtattcctatattct

SEQ ID NO: 781373 - DNA, 22 bp, Artificial Sequence
  chemically synthesized
tgtattcctatattcttctcta

SEQ ID NO: 781374 - DNA, 22 bp, Artificial Sequence
  chemically synthesized
agaaatgaggcaatagctagag

SEQ ID NO: 781375 - DNA, 22 bp, Artificial Sequence
  chemically synthesized
gagaaatgaggcaatagctaga

SEQ ID NO: 781376 - DNA, 22 bp, Artificial Sequence
  chemically synthesized
ctatattcttctctagctattg

SEQ ID NO: 781377 - DNA, 22 bp, Artificial Sequence
  chemically synthesized
tattcttctctagctattgcct

SEQ ID NO: 781378 - DNA, 22 bp, Artificial Sequence
  chemically synthesized
ttctctagctattgcctcattt

SEQ ID NO: 781379 - DNA, 22 bp, Artificial Sequence
  chemically synthesized
ctctagctattgcctcatttct

SEQ ID NO: 781380 - DNA, 22 bp, Artificial Sequence
  chemically synthesized
tctagctattgcctcatttctc

SEQ ID NO: 781381 - DNA, 22 bp, Artificial Sequence
  chemically synthesized
tagctattgcctcatttctcaa

SEQ ID NO: 781382 - DNA, 22 bp, Artificial Sequence
  chemically synthesized
gctattgcctcatttctcaaat

SEQ ID NO: 781383 - DNA, 22 bp, Artificial Sequence
  chemically synthesized
ttgcctcatttctcaaattcct

SEQ ID NO: 781384 - DNA, 22 bp, Artificial Sequence
  chemically synthesized
cctcatttctcaaattcctttc

SEQ ID NO: 781385 - DNA, 22 bp, Artificial Sequence
  chemically synthesized
atttctcaaattcctttcatgt

SEQ ID NO: 781386 - DNA, 22 bp, Artificial Sequence
  chemically synthesized
ctcaaattcctttcatgtcttc

SEQ ID NO: 781387 - DNA, 22 bp, Artificial Sequence
  chemically synthesized
tcaaattcctttcatgtcttca

SEQ ID NO: 781388 - DNA, 22 bp, Artificial Sequence
  chemically synthesized
aaattcctttcatgtcttcatc

SEQ ID NO: 781389 - DNA, 22 bp, Artificial Sequence
  chemically synthesized
ctttcatgtcttcatctccatt

SEQ ID NO: 781390 - DNA, 22 bp, Artificial Sequence
  chemically synthesized
tcatgtcttcatctccattcct

SEQ ID NO: 781391 - DNA, 22 bp, Artificial Sequence
  chemically synthesized
catgtcttcatctccattcctt

SEQ ID NO: 781392 - DNA, 22 bp, Artificial Sequence
  chemically synthesized
atgtcttcatctccattcctta

SEQ ID NO: 781393 - DNA, 22 bp, Artificial Sequence
  chemically synthesized
catctccattccttatttccac

SEQ ID NO: 781394 - DNA, 22 bp, Artificial Sequence
  chemically synthesized
agaagtagggaggtggaaataa

SEQ ID NO: 781395 - DNA, 22 bp, Artificial Sequence
  chemically synthesized
atctccattccttatttccacc

SEQ ID NO: 781396 - DNA, 22 bp, Artificial Sequence
  chemically synthesized
cattccttatttccacctccct

SEQ ID NO: 781397 - DNA, 22 bp, Artificial Sequence
  chemically synthesized
cttatttccacctccctacttc

SEQ ID NO: 781398 - DNA, 22 bp, Artificial Sequence
  chemically synthesized
tggtggtgagttgagaagtagg

SEQ ID NO: 781399 - DNA, 22 bp, Artificial Sequence
  chemically synthesized
atttccacctccctacttctca

SEQ ID NO: 781400 - DNA, 22 bp, Artificial Sequence
  chemically synthesized
atggtggtgagttgagaagtag

SEQ ID NO: 781401 - DNA, 22 bp, Artificial Sequence
  chemically synthesized
tttccacctccctacttctcaa

SEQ ID NO: 781402 - DNA, 22 bp, Artificial Sequence
  chemically synthesized
ccacctccctacttctcaactc

SEQ ID NO: 781403 - DNA, 22 bp, Artificial Sequence
  chemically synthesized
cacctccctacttctcaactca

SEQ ID NO: 781404 - DNA, 22 bp, Artificial Sequence
  chemically synthesized
cctacttctcaactcaccacca

SEQ ID NO: 781405 - DNA, 22 bp, Artificial Sequence
  chemically synthesized
cttctcaactcaccaccataag

SEQ ID NO: 781406 - DNA, 22 bp, Artificial Sequence
  chemically synthesized
ctcaactcaccaccataagact

SEQ ID NO: 781407 - DNA, 22 bp, Artificial Sequence
  chemically synthesized
tcaactcaccaccataagactt

SEQ ID NO: 781408 - DNA, 22 bp, Artificial Sequence
  chemically synthesized
aactcaccaccataagacttct

SEQ ID NO: 781409 - DNA, 22 bp, Artificial Sequence
  chemically synthesized
accaccataagacttcttggct

SEQ ID NO: 781410 - DNA, 22 bp, Artificial Sequence
  chemically synthesized
caggcgtgagccaccgcgcccg

SEQ ID NO: 781411 - DNA, 22 bp, Artificial Sequence
  chemically synthesized
cttggctgccgggcgcggtggc

SEQ ID NO: 781412 - DNA, 22 bp, Artificial Sequence
  chemically synthesized
ttggctgccgggcgcggtggct

SEQ ID NO: 781413 - DNA, 22 bp, Artificial Sequence
  chemically synthesized
ggctgccgggcgcggtggctca

SEQ ID NO: 781414 - DNA, 22 bp, Artificial Sequence
  chemically synthesized
ggattacaggcgtgagccaccg

SEQ ID NO: 781415 - DNA, 22 bp, Artificial Sequence
  chemically synthesized
gctgccgggcgcggtggctcac

SEQ ID NO: 781416 - DNA, 22 bp, Artificial Sequence
  chemically synthesized
ccgggcgcggtggctcacgcct

SEQ ID NO: 781417 - DNA, 22 bp, Artificial Sequence
  chemically synthesized
ccaaagtgctgggattacaggc

SEQ ID NO: 781418 - DNA, 22 bp, Artificial Sequence
  chemically synthesized
ggcctcccaaagtgctgggatt

SEQ ID NO: 781419 - DNA, 22 bp, Artificial Sequence
  chemically synthesized
acgcctgtaatcccagcacttt

SEQ ID NO: 781420 - DNA, 22 bp, Artificial Sequence
  chemically synthesized
taatcccagcactttgggaggc

SEQ ID NO: 781421 - DNA, 22 bp, Artificial Sequence
  chemically synthesized
gtgatccgcccgtctcggcctc

SEQ ID NO: 781422 - DNA, 22 bp, Artificial Sequence
  chemically synthesized
acctcgtgatccgcccgtctcg

SEQ ID NO: 781423 - DNA, 22 bp, Artificial Sequence
  chemically synthesized
ctgacctcgtgatccgcccgtc

SEQ ID NO: 781424 - DNA, 22 bp, Artificial Sequence
  chemically synthesized
tgggaggccgagacgggcggat

SEQ ID NO: 781425 - DNA, 22 bp, Artificial Sequence
  chemically synthesized
gggaggccgagacgggcggatc

SEQ ID NO: 781426 - DNA, 22 bp, Artificial Sequence
  chemically synthesized
ggaggccgagacgggcggatca

SEQ ID NO: 781427 - DNA, 22 bp, Artificial Sequence
  chemically synthesized
gatctcctgacctcgtgatccg

SEQ ID NO: 781428 - DNA, 22 bp, Artificial Sequence
  chemically synthesized
gccaggatggtctcgatctcct

SEQ ID NO: 781429 - DNA, 22 bp, Artificial Sequence
  chemically synthesized
accgtgttagccaggatggtct

SEQ ID NO: 781430 - DNA, 22 bp, Artificial Sequence
  chemically synthesized
caccgtgttagccaggatggtc

SEQ ID NO: 781431 - DNA, 22 bp, Artificial Sequence
  chemically synthesized
gtagagacggggtttcaccgtg

SEQ ID NO: 781432 - DNA, 22 bp, Artificial Sequence
  chemically synthesized
agtagagacggggtttcaccgt

SEQ ID NO: 781433 - DNA, 22 bp, Artificial Sequence
  chemically synthesized
tagtagagacggggtttcaccg

SEQ ID NO: 781434 - DNA, 22 bp, Artificial Sequence
  chemically synthesized
ttagtagagacggggtttcacc

SEQ ID NO: 781435 - DNA, 22 bp, Artificial Sequence
  chemically synthesized
gctaacacggtgaaaccccgtc

SEQ ID NO: 781436 - DNA, 22 bp, Artificial Sequence
  chemically synthesized
tatttttagtagagacggggtt

SEQ ID NO: 781437 - DNA, 22 bp, Artificial Sequence
  chemically synthesized
gtatttttagtagagacggggt

SEQ ID NO: 781438 - DNA, 22 bp, Artificial Sequence
  chemically synthesized
tgtatttttagtagagacgggg

SEQ ID NO: 781439 - DNA, 22 bp, Artificial Sequence
  chemically synthesized
acacggtgaaaccccgtctcta

SEQ ID NO: 781440 - DNA, 22 bp, Artificial Sequence
  chemically synthesized
ttgtatttttagtagagacggg

SEQ ID NO: 781441 - DNA, 22 bp, Artificial Sequence
  chemically synthesized
atttttgtatttttagtagaga

SEQ ID NO: 781442 - DNA, 22 bp, Artificial Sequence
  chemically synthesized
tactaaaaatacaaaaattagc

SEQ ID NO: 781443 - DNA, 22 bp, Artificial Sequence
  chemically synthesized
ctaaaaatacaaaaattagctg

SEQ ID NO: 781444 - DNA, 22 bp, Artificial Sequence
  chemically synthesized
aaaatacaaaaattagctgggc

SEQ ID NO: 781445 - DNA, 22 bp, Artificial Sequence
  chemically synthesized
caggcgcgcgccaccatgccca

SEQ ID NO: 781446 - DNA, 22 bp, Artificial Sequence
  chemically synthesized
ggactacaggcgcgcgccacca

SEQ ID NO: 781447 - DNA, 22 bp, Artificial Sequence
  chemically synthesized
gctgggcatggtggcgcgcgcc

SEQ ID NO: 781448 - DNA, 22 bp, Artificial Sequence
  chemically synthesized
ggcatggtggcgcgcgcctgta

SEQ ID NO: 781449 - DNA, 22 bp, Artificial Sequence
  chemically synthesized
ccgtgtagctgggactacaggc

SEQ ID NO: 781450 - DNA, 22 bp, Artificial Sequence
  chemically synthesized
agcctcccgtgtagctgggact

SEQ ID NO: 781451 - DNA, 22 bp, Artificial Sequence
  chemically synthesized
cctcagcctcccgtgtagctgg

SEQ ID NO: 781452 - DNA, 22 bp, Artificial Sequence
  chemically synthesized
ctgcctcagcctcccgtgtagc

SEQ ID NO: 781453 - DNA, 22 bp, Artificial Sequence
  chemically synthesized
tcctgcctcagcctcccgtgta

SEQ ID NO: 781454 - DNA, 22 bp, Artificial Sequence
  chemically synthesized
tagtcccagctacacgggaggc

SEQ ID NO: 781455 - DNA, 22 bp, Artificial Sequence
  chemically synthesized
acgccattctcctgcctcagcc

SEQ ID NO: 781456 - DNA, 22 bp, Artificial Sequence
  chemically synthesized
cacgggaggctgaggcaggaga

SEQ ID NO: 781457 - DNA, 22 bp, Artificial Sequence
  chemically synthesized
ccgggttcacgccattctcctg

SEQ ID NO: 781458 - DNA, 22 bp, Artificial Sequence
  chemically synthesized
cgcctcccgggttcacgccatt

SEQ ID NO: 781459 - DNA, 22 bp, Artificial Sequence
  chemically synthesized
aggcaggagaatggcgtgaacc

SEQ ID NO: 781460 - DNA, 22 bp, Artificial Sequence
  chemically synthesized
caagctccgcctcccgggttca

SEQ ID NO: 781461 - DNA, 22 bp, Artificial Sequence
  chemically synthesized
actgcaagctccgcctcccggg

SEQ ID NO: 781462 - DNA, 22 bp, Artificial Sequence
  chemically synthesized
gactcactgcaagctccgcctc

SEQ ID NO: 781463 - DNA, 22 bp, Artificial Sequence
  chemically synthesized
gagtgcagtggcgcgatctcga

SEQ ID NO: 781464 - DNA, 22 bp, Artificial Sequence
  chemically synthesized
gcagtgagtcgagatcgcgcca

SEQ ID NO: 781465 - DNA, 22 bp, Artificial Sequence
  chemically synthesized
cagtgagtcgagatcgcgccac

SEQ ID NO: 781466 - DNA, 22 bp, Artificial Sequence
  chemically synthesized
tcgcccaggctggagtgcagtg

SEQ ID NO: 781467 - DNA, 22 bp, Artificial Sequence
  chemically synthesized
tgtcgcccaggctggagtgcag

SEQ ID NO: 781468 - DNA, 22 bp, Artificial Sequence
  chemically synthesized
gctctgtcgcccaggctggagt

SEQ ID NO: 781469 - DNA, 22 bp, Artificial Sequence
  chemically synthesized
cgctctgtcgcccaggctggag

SEQ ID NO: 781470 - DNA, 22 bp, Artificial Sequence
  chemically synthesized
cactccagcctgggcgacagag

SEQ ID NO: 781471 - DNA, 22 bp, Artificial Sequence
  chemically synthesized
agacggagtttcgctctgtcgc

SEQ ID NO: 781472 - DNA, 22 bp, Artificial Sequence
  chemically synthesized
gagacggagtttcgctctgtcg

SEQ ID NO: 781473 - DNA, 22 bp, Artificial Sequence
  chemically synthesized
tgagacggagtttcgctctgtc

SEQ ID NO: 781474 - DNA, 22 bp, Artificial Sequence
  chemically synthesized
ttgagacggagtttcgctctgt

SEQ ID NO: 781475 - DNA, 22 bp, Artificial Sequence
  chemically synthesized
cagcctgggcgacagagcgaaa

SEQ ID NO: 781476 - DNA, 22 bp, Artificial Sequence
  chemically synthesized
tttgagacggagtttcgctctg

SEQ ID NO: 781477 - DNA, 22 bp, Artificial Sequence
  chemically synthesized
ttttgagacggagtttcgctct

SEQ ID NO: 781478 - DNA, 22 bp, Artificial Sequence
  chemically synthesized
tttttgagacggagtttcgctc

SEQ ID NO: 781479 - DNA, 22 bp, Artificial Sequence
  chemically synthesized
ttttttgagacggagtttcgct

SEQ ID NO: 781480 - DNA, 22 bp, Artificial Sequence
  chemically synthesized
tttttttgagacggagtttcgc

SEQ ID NO: 781481 - DNA, 22 bp, Artificial Sequence
  chemically synthesized
ttttttttgagacggagtttcg

SEQ ID NO: 781482 - DNA, 22 bp, Artificial Sequence
  chemically synthesized
tttttttttgagacggagtttc

SEQ ID NO: 781483 - DNA, 22 bp, Artificial Sequence
  chemically synthesized
ggcgacagagcgaaactccgtc

SEQ ID NO: 781484 - DNA, 22 bp, Artificial Sequence
  chemically synthesized
ttttttttttgagacggagttt

SEQ ID NO: 781485 - DNA, 22 bp, Artificial Sequence
  chemically synthesized
tttttttttttgagacggagtt

SEQ ID NO: 781486 - DNA, 22 bp, Artificial Sequence
  chemically synthesized
ttttttttttttgagacggagt

SEQ ID NO: 781487 - DNA, 22 bp, Artificial Sequence
  chemically synthesized
tttttttttttttgagacggag

SEQ ID NO: 781488 - DNA, 22 bp, Artificial Sequence
  chemically synthesized
ttttttttttttttgagacgga

SEQ ID NO: 781489 - DNA, 22 bp, Artificial Sequence
  chemically synthesized
tttttttttttttttgagacgg

SEQ ID NO: 781490 - DNA, 22 bp, Artificial Sequence
  chemically synthesized
ttttttttttttttttgagacg

SEQ ID NO: 781491 - DNA, 22 bp, Artificial Sequence
  chemically synthesized
tttttttttttttttttgagac

SEQ ID NO: 781492 - DNA, 22 bp, Artificial Sequence
  chemically synthesized
ttttttttttttttttttgaga

SEQ ID NO: 781493 - DNA, 22 bp, Artificial Sequence
  chemically synthesized
tttttttttttttttttttgag

SEQ ID NO: 781494 - DNA, 22 bp, Artificial Sequence
  chemically synthesized
ttttttttttttttttttttga

SEQ ID NO: 781495 - DNA, 22 bp, Artificial Sequence
  chemically synthesized
tttttttttttttttttttttg

SEQ ID NO: 781496 - DNA, 22 bp, Artificial Sequence
  chemically synthesized
tttttttttttttttttttttt

SEQ ID NO: 781497 - DNA, 22 bp, Artificial Sequence
  chemically synthesized
tttttttttttttttttttttt

SEQ ID NO: 781498 - DNA, 22 bp, Artificial Sequence
  chemically synthesized
cgtctcaaaaaaaaaaaaaaaa

SEQ ID NO: 781499 - DNA, 22 bp, Artificial Sequence
  chemically synthesized
aaaaaaaaaaaaaaaaaaaaaa

SEQ ID NO: 781500 - DNA, 22 bp, Artificial Sequence
  chemically synthesized
gaaccagagccaagaagtcttt

SEQ ID NO: 781501 - DNA, 22 bp, Artificial Sequence
  chemically synthesized
cactggaaccagagccaagaag

SEQ ID NO: 781502 - DNA, 22 bp, Artificial Sequence
  chemically synthesized
acactggaaccagagccaagaa

SEQ ID NO: 781503 - DNA, 22 bp, Artificial Sequence
  chemically synthesized
cttggctctggttccagtgtaa

SEQ ID NO: 781504 - DNA, 22 bp, Artificial Sequence
  chemically synthesized
ttggctctggttccagtgtaaa

SEQ ID NO: 781505 - DNA, 22 bp, Artificial Sequence
  chemically synthesized
ggctctggttccagtgtaaatt

SEQ ID NO: 781506 - DNA, 22 bp, Artificial Sequence
  chemically synthesized
gctctggttccagtgtaaattc

SEQ ID NO: 781507 - DNA, 22 bp, Artificial Sequence
  chemically synthesized
tggttccagtgtaaattctttg

SEQ ID NO: 781508 - DNA, 22 bp, Artificial Sequence
  chemically synthesized
atgatgatgcaatcaaagaatt

SEQ ID NO: 781509 - DNA, 22 bp, Artificial Sequence
  chemically synthesized
gttccagtgtaaattctttgat

SEQ ID NO: 781510 - DNA, 22 bp, Artificial Sequence
  chemically synthesized
cagtgtaaattctttgattgca

SEQ ID NO: 781511 - DNA, 22 bp, Artificial Sequence
  chemically synthesized
aagtaagaggttcatgatgatg

SEQ ID NO: 781512 - DNA, 22 bp, Artificial Sequence
  chemically synthesized
tttgattgcatcatcatgaacc

SEQ ID NO: 781513 - DNA, 22 bp, Artificial Sequence
  chemically synthesized
acctcaagtaagaggttcatga

SEQ ID NO: 781514 - DNA, 22 bp, Artificial Sequence
  chemically synthesized
tgattgcatcatcatgaacctc

SEQ ID NO: 781515 - DNA, 22 bp, Artificial Sequence
  chemically synthesized
gattgcatcatcatgaacctct

SEQ ID NO: 781516 - DNA, 22 bp, Artificial Sequence
  chemically synthesized
attgcatcatcatgaacctctt

SEQ ID NO: 781517 - DNA, 22 bp, Artificial Sequence
  chemically synthesized
catcatcatgaacctcttactt

SEQ ID NO: 781518 - DNA, 22 bp, Artificial Sequence
  chemically synthesized
agccctaacctcaagtaagagg

SEQ ID NO: 781519 - DNA, 22 bp, Artificial Sequence
  chemically synthesized
ggggcgctgagccctaacctca

SEQ ID NO: 781520 - DNA, 22 bp, Artificial Sequence
  chemically synthesized
ttacttgaggttagggctcagc

SEQ ID NO: 781521 - DNA, 22 bp, Artificial Sequence
  chemically synthesized
acttgaggttagggctcagcgc

SEQ ID NO: 781522 - DNA, 22 bp, Artificial Sequence
  chemically synthesized
cttgaggttagggctcagcgcc

SEQ ID NO: 781523 - DNA, 22 bp, Artificial Sequence
  chemically synthesized
gaggttagggctcagcgccccg

SEQ ID NO: 781524 - DNA, 22 bp, Artificial Sequence
  chemically synthesized
aggttagggctcagcgccccga

SEQ ID NO: 781525 - DNA, 22 bp, Artificial Sequence
  chemically synthesized
aaacagtgtgagggttcggggc

SEQ ID NO: 781526 - DNA, 22 bp, Artificial Sequence
  chemically synthesized
gggctcagcgccccgaaccctc

SEQ ID NO: 781527 - DNA, 22 bp, Artificial Sequence
  chemically synthesized
accctcaaacagtgtgagggtt

SEQ ID NO: 781528 - DNA, 22 bp, Artificial Sequence
  chemically synthesized
agcgccccgaaccctcacactg

SEQ ID NO: 781529 - DNA, 22 bp, Artificial Sequence
  chemically synthesized
tacagttgaccctcaaacagtg

SEQ ID NO: 781530 - DNA, 22 bp, Artificial Sequence
  chemically synthesized
acactgtttgagggtcaactgt

SEQ ID NO: 781531 - DNA, 22 bp, Artificial Sequence
  chemically synthesized
gggaaagtgttatacagttgac

SEQ ID NO: 781532 - DNA, 22 bp, Artificial Sequence
  chemically synthesized
tttgagggtcaactgtataaca

SEQ ID NO: 781533 - DNA, 22 bp, Artificial Sequence
  chemically synthesized
ggaattagggaaagtgttatac

SEQ ID NO: 781534 - DNA, 22 bp, Artificial Sequence
  chemically synthesized
gagggtcaactgtataacactt

SEQ ID NO: 781535 - DNA, 22 bp, Artificial Sequence
  chemically synthesized
agggtcaactgtataacacttt

SEQ ID NO: 781536 - DNA, 22 bp, Artificial Sequence
  chemically synthesized
tggtgagttgggaattagggaa

SEQ ID NO: 781537 - DNA, 22 bp, Artificial Sequence
  chemically synthesized
tataacactttccctaattccc

SEQ ID NO: 781538 - DNA, 22 bp, Artificial Sequence
  chemically synthesized
ttgtggtgagttgggaattagg

SEQ ID NO: 781539 - DNA, 22 bp, Artificial Sequence
  chemically synthesized
attgtggtgagttgggaattag

SEQ ID NO: 781540 - DNA, 22 bp, Artificial Sequence
  chemically synthesized
tccctaattcccaactcaccac

SEQ ID NO: 781541 - DNA, 22 bp, Artificial Sequence
  chemically synthesized
ccctaattcccaactcaccaca

SEQ ID NO: 781542 - DNA, 22 bp, Artificial Sequence
  chemically synthesized
cctaattcccaactcaccacaa

SEQ ID NO: 781543 - DNA, 22 bp, Artificial Sequence
  chemically synthesized
attcccaactcaccacaataag

SEQ ID NO: 781544 - DNA, 22 bp, Artificial Sequence
  chemically synthesized
ccaactcaccacaataagactt

SEQ ID NO: 781545 - DNA, 22 bp, Artificial Sequence
  chemically synthesized
accacaataagacttcttggct

SEQ ID NO: 781546 - DNA, 22 bp, Artificial Sequence
  chemically synthesized
cagtggaaccagagccaagaag

SEQ ID NO: 781547 - DNA, 22 bp, Artificial Sequence
  chemically synthesized
acagtggaaccagagccaagaa

SEQ ID NO: 781548 - DNA, 22 bp, Artificial Sequence
  chemically synthesized
aaagaatttacagtggaaccag

SEQ ID NO: 781549 - DNA, 22 bp, Artificial Sequence
  chemically synthesized
cttggctctggttccactgtaa

SEQ ID NO: 781550 - DNA, 22 bp, Artificial Sequence
  chemically synthesized
ttggctctggttccactgtaaa

SEQ ID NO: 781551 - DNA, 22 bp, Artificial Sequence
  chemically synthesized
ggctctggttccactgtaaatt

SEQ ID NO: 781552 - DNA, 22 bp, Artificial Sequence
  chemically synthesized
gctctggttccactgtaaattc

SEQ ID NO: 781553 - DNA, 22 bp, Artificial Sequence
  chemically synthesized
tggttccactgtaaattctttg

SEQ ID NO: 781554 - DNA, 22 bp, Artificial Sequence
  chemically synthesized
atgatgatgcctcaaagaattt

SEQ ID NO: 781555 - DNA, 22 bp, Artificial Sequence
  chemically synthesized
gttccactgtaaattctttgag

SEQ ID NO: 781556 - DNA, 22 bp, Artificial Sequence
  chemically synthesized
cactgtaaattctttgaggcat

SEQ ID NO: 781557 - DNA, 22 bp, Artificial Sequence
  chemically synthesized
taaattctttgaggcatcatca

SEQ ID NO: 781558 - DNA, 22 bp, Artificial Sequence
  chemically synthesized
agcaagtaagaggttcatgatg

SEQ ID NO: 781559 - DNA, 22 bp, Artificial Sequence
  chemically synthesized
cagcaagtaagaggttcatgat

SEQ ID NO: 781560 - DNA, 22 bp, Artificial Sequence
  chemically synthesized
tttgaggcatcatcatgaacct

SEQ ID NO: 781561 - DNA, 22 bp, Artificial Sequence
  chemically synthesized
tcagcaagtaagaggttcatga

SEQ ID NO: 781562 - DNA, 22 bp, Artificial Sequence
  chemically synthesized
tgaggcatcatcatgaacctct

SEQ ID NO: 781563 - DNA, 22 bp, Artificial Sequence
  chemically synthesized
gaggcatcatcatgaacctctt

SEQ ID NO: 781564 - DNA, 22 bp, Artificial Sequence
  chemically synthesized
aggcatcatcatgaacctctta

SEQ ID NO: 781565 - DNA, 22 bp, Artificial Sequence
  chemically synthesized
gagttttcagcaagtaagaggt

SEQ ID NO: 781566 - DNA, 22 bp, Artificial Sequence
  chemically synthesized
ggagttttcagcaagtaagagg

SEQ ID NO: 781567 - DNA, 22 bp, Artificial Sequence
  chemically synthesized
ttggagttttcagcaagtaaga

SEQ ID NO: 781568 - DNA, 22 bp, Artificial Sequence
  chemically synthesized
cttggagttttcagcaagtaag

SEQ ID NO: 781569 - DNA, 22 bp, Artificial Sequence
  chemically synthesized
tttcttggagttttcagcaagt

SEQ ID NO: 781570 - DNA, 22 bp, Artificial Sequence
  chemically synthesized
ttacttgctgaaaactccaaga

SEQ ID NO: 781571 - DNA, 22 bp, Artificial Sequence
  chemically synthesized
acttgctgaaaactccaagaaa

SEQ ID NO: 781572 - DNA, 22 bp, Artificial Sequence
  chemically synthesized
cttgctgaaaactccaagaaat

SEQ ID NO: 781573 - DNA, 22 bp, Artificial Sequence
  chemically synthesized
ggtgtgaacactatttcttgga

SEQ ID NO: 781574 - DNA, 22 bp, Artificial Sequence
  chemically synthesized
gctgaaaactccaagaaatagt

SEQ ID NO: 781575 - DNA, 22 bp, Artificial Sequence
  chemically synthesized
ctgaaaactccaagaaatagtg

SEQ ID NO: 781576 - DNA, 22 bp, Artificial Sequence
  chemically synthesized
aaaactccaagaaatagtgttc

SEQ ID NO: 781577 - DNA, 22 bp, Artificial Sequence
  chemically synthesized
aaaaagctaggtgtgaacacta

SEQ ID NO: 781578 - DNA, 22 bp, Artificial Sequence
  chemically synthesized
caagaaatagtgttcacaccta

SEQ ID NO: 781579 - DNA, 22 bp, Artificial Sequence
  chemically synthesized
ccaggcagctgaaaaagctagg

SEQ ID NO: 781580 - DNA, 22 bp, Artificial Sequence
  chemically synthesized
acacctagctttttcagctgcc

SEQ ID NO: 781581 - DNA, 22 bp, Artificial Sequence
  chemically synthesized
gctttttcagctgcctggtagt

SEQ ID NO: 781582 - DNA, 22 bp, Artificial Sequence
  chemically synthesized
gcagtgtcagggactaccaggc

SEQ ID NO: 781583 - DNA, 22 bp, Artificial Sequence
  chemically synthesized
tttcagctgcctggtagtccct

SEQ ID NO: 781584 - DNA, 22 bp, Artificial Sequence
  chemically synthesized
ttcagctgcctggtagtccctg

SEQ ID NO: 781585 - DNA, 22 bp, Artificial Sequence
  chemically synthesized
tcagctgcctggtagtccctga

SEQ ID NO: 781586 - DNA, 22 bp, Artificial Sequence
  chemically synthesized
cagctgcctggtagtccctgac

SEQ ID NO: 781587 - DNA, 22 bp, Artificial Sequence
  chemically synthesized
agctgcctggtagtccctgaca

SEQ ID NO: 781588 - DNA, 22 bp, Artificial Sequence
  chemically synthesized
cctggtagtccctgacactgcc

SEQ ID NO: 781589 - DNA, 22 bp, Artificial Sequence
  chemically synthesized
gtagtccctgacactgccagcc

SEQ ID NO: 781590 - DNA, 22 bp, Artificial Sequence
  chemically synthesized
aaagacaaggaagtggctggca

SEQ ID NO: 781591 - DNA, 22 bp, Artificial Sequence
  chemically synthesized
acactgccagccacttccttgt

SEQ ID NO: 781592 - DNA, 22 bp, Artificial Sequence
  chemically synthesized
ccagccacttccttgtctttga

SEQ ID NO: 781593 - DNA, 22 bp, Artificial Sequence
  chemically synthesized
agcaaggagaaagtctcaaaga

SEQ ID NO: 781594 - DNA, 22 bp, Artificial Sequence
  chemically synthesized
ccttgtctttgagactttctcc

SEQ ID NO: 781595 - DNA, 22 bp, Artificial Sequence
  chemically synthesized
cttgtctttgagactttctcct

SEQ ID NO: 781596 - DNA, 22 bp, Artificial Sequence
  chemically synthesized
ggaacctgagcaaggagaaagt

SEQ ID NO: 781597 - DNA, 22 bp, Artificial Sequence
  chemically synthesized
gtctttgagactttctccttgc

SEQ ID NO: 781598 - DNA, 22 bp, Artificial Sequence
  chemically synthesized
tctttgagactttctccttgct

SEQ ID NO: 781599 - DNA, 22 bp, Artificial Sequence
  chemically synthesized
tgagactttctccttgctcagg

SEQ ID NO: 781600 - DNA, 22 bp, Artificial Sequence
  chemically synthesized
gagactttctccttgctcaggt

SEQ ID NO: 781601 - DNA, 22 bp, Artificial Sequence
  chemically synthesized
agactttctccttgctcaggtt

SEQ ID NO: 781602 - DNA, 22 bp, Artificial Sequence
  chemically synthesized
tctccttgctcaggttcctagt

SEQ ID NO: 781603 - DNA, 22 bp, Artificial Sequence
  chemically synthesized
ctccttgctcaggttcctagtc

SEQ ID NO: 781604 - DNA, 22 bp, Artificial Sequence
  chemically synthesized
tccttgctcaggttcctagtca

SEQ ID NO: 781605 - DNA, 22 bp, Artificial Sequence
  chemically synthesized
caaaggagaagaatgactagga

SEQ ID NO: 781606 - DNA, 22 bp, Artificial Sequence
  chemically synthesized
cttgctcaggttcctagtcatt

SEQ ID NO: 781607 - DNA, 22 bp, Artificial Sequence
  chemically synthesized
gctcaggttcctagtcattctt

SEQ ID NO: 781608 - DNA, 22 bp, Artificial Sequence
  chemically synthesized
ctcaggttcctagtcattcttc

SEQ ID NO: 781609 - DNA, 22 bp, Artificial Sequence
  chemically synthesized
aggttcctagtcattcttctcc

SEQ ID NO: 781610 - DNA, 22 bp, Artificial Sequence
  chemically synthesized
ctagtcattcttctcctttgta

SEQ ID NO: 781611 - DNA, 22 bp, Artificial Sequence
  chemically synthesized
gtcattcttctcctttgtagcc

SEQ ID NO: 781612 - DNA, 22 bp, Artificial Sequence
  chemically synthesized
ttctcctttgtagcctgccatt

SEQ ID NO: 781613 - DNA, 22 bp, Artificial Sequence
  chemically synthesized
ctcctttgtagcctgccatttt

SEQ ID NO: 781614 - DNA, 22 bp, Artificial Sequence
  chemically synthesized
tcctttgtagcctgccattttc

SEQ ID NO: 781615 - DNA, 22 bp, Artificial Sequence
  chemically synthesized
agcaggtggccagaaaatggca

SEQ ID NO: 781616 - DNA, 22 bp, Artificial Sequence
  chemically synthesized
ctttgtagcctgccattttctg

SEQ ID NO: 781617 - DNA, 22 bp, Artificial Sequence
  chemically synthesized
tgtagcctgccattttctggcc

SEQ ID NO: 781618 - DNA, 22 bp, Artificial Sequence
  chemically synthesized
gtagcctgccattttctggcca

SEQ ID NO: 781619 - DNA, 22 bp, Artificial Sequence
  chemically synthesized
tagcctgccattttctggccac

SEQ ID NO: 781620 - DNA, 22 bp, Artificial Sequence
  chemically synthesized
taggagctaagcaggtggccag

SEQ ID NO: 781621 - DNA, 22 bp, Artificial Sequence
  chemically synthesized
ctgtaggagctaagcaggtggc

SEQ ID NO: 781622 - DNA, 22 bp, Artificial Sequence
  chemically synthesized
cctgtaggagctaagcaggtgg

SEQ ID NO: 781623 - DNA, 22 bp, Artificial Sequence
  chemically synthesized
ccattttctggccacctgctta

SEQ ID NO: 781624 - DNA, 22 bp, Artificial Sequence
  chemically synthesized
tctggccacctgcttagctcct

SEQ ID NO: 781625 - DNA, 22 bp, Artificial Sequence
  chemically synthesized
ctggccacctgcttagctccta

SEQ ID NO: 781626 - DNA, 22 bp, Artificial Sequence
  chemically synthesized
tggccacctgcttagctcctac

SEQ ID NO: 781627 - DNA, 22 bp, Artificial Sequence
  chemically synthesized
tgaagtgtttcctgtaggagct

SEQ ID NO: 781628 - DNA, 22 bp, Artificial Sequence
  chemically synthesized
gccacctgcttagctcctacag

SEQ ID NO: 781629 - DNA, 22 bp, Artificial Sequence
  chemically synthesized
atgaagtgtttcctgtaggagc

SEQ ID NO: 781630 - DNA, 22 bp, Artificial Sequence
  chemically synthesized
cttagctcctacaggaaacact

SEQ ID NO: 781631 - DNA, 22 bp, Artificial Sequence
  chemically synthesized
agctcctacaggaaacacttca

SEQ ID NO: 781632 - DNA, 22 bp, Artificial Sequence
  chemically synthesized
gctcctacaggaaacacttcat

SEQ ID NO: 781633 - DNA, 22 bp, Artificial Sequence
  chemically synthesized
ctacaggaaacacttcataagt

SEQ ID NO: 781634 - DNA, 22 bp, Artificial Sequence
  chemically synthesized
acagaaaacaacacttatgaag

SEQ ID NO: 781635 - DNA, 22 bp, Artificial Sequence
  chemically synthesized
caggaaacacttcataagtgtt

SEQ ID NO: 781636 - DNA, 22 bp, Artificial Sequence
  chemically synthesized
aggcaggatatctaacagaaaa

SEQ ID NO: 781637 - DNA, 22 bp, Artificial Sequence
  chemically synthesized
cataagtgttgttttctgttag

SEQ ID NO: 781638 - DNA, 22 bp, Artificial Sequence
  chemically synthesized
ataagtgttgttttctgttaga

SEQ ID NO: 781639 - DNA, 22 bp, Artificial Sequence
  chemically synthesized
tcaggcaggatatctaacagaa

SEQ ID NO: 781640 - DNA, 22 bp, Artificial Sequence
  chemically synthesized
ctcaggcaggatatctaacaga

SEQ ID NO: 781641 - DNA, 22 bp, Artificial Sequence
  chemically synthesized
ttttctgttagatatcctgcct

SEQ ID NO: 781642 - DNA, 22 bp, Artificial Sequence
  chemically synthesized
tctgttagatatcctgcctgag

SEQ ID NO: 781643 - DNA, 22 bp, Artificial Sequence
  chemically synthesized
ctgttagatatcctgcctgaga

SEQ ID NO: 781644 - DNA, 22 bp, Artificial Sequence
  chemically synthesized
tgttagatatcctgcctgagaa

SEQ ID NO: 781645 - DNA, 22 bp, Artificial Sequence
  chemically synthesized
ttagatatcctgcctgagaaat

SEQ ID NO: 781646 - DNA, 22 bp, Artificial Sequence
  chemically synthesized
gatatcctgcctgagaaatcac

SEQ ID NO: 781647 - DNA, 22 bp, Artificial Sequence
  chemically synthesized
tgcaagagtaggggtgtgattt

SEQ ID NO: 781648 - DNA, 22 bp, Artificial Sequence
  chemically synthesized
atgcaagagtaggggtgtgatt

SEQ ID NO: 781649 - DNA, 22 bp, Artificial Sequence
  chemically synthesized
cctgagaaatcacacccctact

SEQ ID NO: 781650 - DNA, 22 bp, Artificial Sequence
  chemically synthesized
ccacttatgcaagagtaggggt

SEQ ID NO: 781651 - DNA, 22 bp, Artificial Sequence
  chemically synthesized
cccacttatgcaagagtagggg

SEQ ID NO: 781652 - DNA, 22 bp, Artificial Sequence
  chemically synthesized
agaaatcacacccctactcttg

SEQ ID NO: 781653 - DNA, 22 bp, Artificial Sequence
  chemically synthesized
aagaatttcccacttatgcaag

SEQ ID NO: 781654 - DNA, 22 bp, Artificial Sequence
  chemically synthesized
gaagaatttcccacttatgcaa

SEQ ID NO: 781655 - DNA, 22 bp, Artificial Sequence
  chemically synthesized
agatttgaagaatttcccactt

SEQ ID NO: 781656 - DNA, 22 bp, Artificial Sequence
  chemically synthesized
ctcttgcataagtgggaaattc

SEQ ID NO: 781657 - DNA, 22 bp, Artificial Sequence
  chemically synthesized
acctaagatttgaagaatttcc

SEQ ID NO: 781658 - DNA, 22 bp, Artificial Sequence
  chemically synthesized
ttgcataagtgggaaattcttc

SEQ ID NO: 781659 - DNA, 22 bp, Artificial Sequence
  chemically synthesized
gcataagtgggaaattcttcaa

SEQ ID NO: 781660 - DNA, 22 bp, Artificial Sequence
  chemically synthesized
ctcacctaagatttgaagaatt

SEQ ID NO: 781661 - DNA, 22 bp, Artificial Sequence
  chemically synthesized
cataagtgggaaattcttcaaa

SEQ ID NO: 781662 - DNA, 22 bp, Artificial Sequence
  chemically synthesized
acattcctcacctaagatttga

SEQ ID NO: 781663 - DNA, 22 bp, Artificial Sequence
  chemically synthesized
ttcaaatcttaggtgaggaatg

SEQ ID NO: 781664 - DNA, 22 bp, Artificial Sequence
  chemically synthesized
caaatcttaggtgaggaatgtt

SEQ ID NO: 781665 - DNA, 22 bp, Artificial Sequence
  chemically synthesized
aaatcttaggtgaggaatgtta

SEQ ID NO: 781666 - DNA, 22 bp, Artificial Sequence
  chemically synthesized
aggtgaggaatgttagatggct

SEQ ID NO: 781667 - DNA, 22 bp, Artificial Sequence
  chemically synthesized
aaagagaagagaagccatctaa

SEQ ID NO: 781668 - DNA, 22 bp, Artificial Sequence
  chemically synthesized
ggtgaggaatgttagatggctt

SEQ ID NO: 781669 - DNA, 22 bp, Artificial Sequence
  chemically synthesized
gaaagagaagagaagccatcta

SEQ ID NO: 781670 - DNA, 22 bp, Artificial Sequence
  chemically synthesized
gatggcttctcttctctttcaa

SEQ ID NO: 781671 - DNA, 22 bp, Artificial Sequence
  chemically synthesized
catgcacaagccttgaaagaga

SEQ ID NO: 781672 - DNA, 22 bp, Artificial Sequence
  chemically synthesized
ctcttctctttcaaggcttgtg

SEQ ID NO: 781673 - DNA, 22 bp, Artificial Sequence
  chemically synthesized
tcttctctttcaaggcttgtgc

SEQ ID NO: 781674 - DNA, 22 bp, Artificial Sequence
  chemically synthesized
ttctctttcaaggcttgtgcat

SEQ ID NO: 781675 - DNA, 22 bp, Artificial Sequence
  chemically synthesized
ctctttcaaggcttgtgcatgc

SEQ ID NO: 781676 - DNA, 22 bp, Artificial Sequence
  chemically synthesized
tctttcaaggcttgtgcatgca

SEQ ID NO: 781677 - DNA, 22 bp, Artificial Sequence
  chemically synthesized
tttcaaggcttgtgcatgcaga

SEQ ID NO: 781678 - DNA, 22 bp, Artificial Sequence
  chemically synthesized
tcaaggcttgtgcatgcagatc

SEQ ID NO: 781679 - DNA, 22 bp, Artificial Sequence
  chemically synthesized
caaggcttgtgcatgcagatct

SEQ ID NO: 781680 - DNA, 22 bp, Artificial Sequence
  chemically synthesized
aaggcttgtgcatgcagatctt

SEQ ID NO: 781681 - DNA, 22 bp, Artificial Sequence
  chemically synthesized
taagaagatccccaaaagatct

SEQ ID NO: 781682 - DNA, 22 bp, Artificial Sequence
  chemically synthesized
gtgcatgcagatcttttgggga

SEQ ID NO: 781683 - DNA, 22 bp, Artificial Sequence
  chemically synthesized
tgcatgcagatcttttggggat

SEQ ID NO: 781684 - DNA, 22 bp, Artificial Sequence
  chemically synthesized
cattgtaagaagatccccaaaa

SEQ ID NO: 781685 - DNA, 22 bp, Artificial Sequence
  chemically synthesized
aatcagaatctgcattgtaaga

SEQ ID NO: 781686 - DNA, 22 bp, Artificial Sequence
  chemically synthesized
ttggggatcttcttacaatgca

SEQ ID NO: 781687 - DNA, 22 bp, Artificial Sequence
  chemically synthesized
tggggatcttcttacaatgcag

SEQ ID NO: 781688 - DNA, 22 bp, Artificial Sequence
  chemically synthesized
ttgaatcagaatctgcattgta

SEQ ID NO: 781689 - DNA, 22 bp, Artificial Sequence
  chemically synthesized
ggggatcttcttacaatgcaga

SEQ ID NO: 781690 - DNA, 22 bp, Artificial Sequence
  chemically synthesized
gggatcttcttacaatgcagat

SEQ ID NO: 781691 - DNA, 22 bp, Artificial Sequence
  chemically synthesized
aaaactgttgaatcagaatctg

SEQ ID NO: 781692 - DNA, 22 bp, Artificial Sequence
  chemically synthesized
caaaactgttgaatcagaatct

SEQ ID NO: 781693 - DNA, 22 bp, Artificial Sequence
  chemically synthesized
cttacaatgcagattctgattc

SEQ ID NO: 781694 - DNA, 22 bp, Artificial Sequence
  chemically synthesized
ttacaatgcagattctgattca

SEQ ID NO: 781695 - DNA, 22 bp, Artificial Sequence
  chemically synthesized
acaatgcagattctgattcaac

SEQ ID NO: 781696 - DNA, 22 bp, Artificial Sequence
  chemically synthesized
caatgcagattctgattcaaca

SEQ ID NO: 781697 - DNA, 22 bp, Artificial Sequence
  chemically synthesized
tgattcaacagttttgaagtgg

SEQ ID NO: 781698 - DNA, 22 bp, Artificial Sequence
  chemically synthesized
aaatcccaggccccacttcaaa

SEQ ID NO: 781699 - DNA, 22 bp, Artificial Sequence
  chemically synthesized
gaaatcccaggccccacttcaa

SEQ ID NO: 781700 - DNA, 22 bp, Artificial Sequence
  chemically synthesized
attcaacagttttgaagtgggg

SEQ ID NO: 781701 - DNA, 22 bp, Artificial Sequence
  chemically synthesized
tgaaatcccaggccccacttca

SEQ ID NO: 781702 - DNA, 22 bp, Artificial Sequence
  chemically synthesized
aacagttttgaagtggggcctg

SEQ ID NO: 781703 - DNA, 22 bp, Artificial Sequence
  chemically synthesized
gcattttgaaatcccaggcccc

SEQ ID NO: 781704 - DNA, 22 bp, Artificial Sequence
  chemically synthesized
ttggcattttgaaatcccaggc

SEQ ID NO: 781705 - DNA, 22 bp, Artificial Sequence
  chemically synthesized
gttggcattttgaaatcccagg

SEQ ID NO: 781706 - DNA, 22 bp, Artificial Sequence
  chemically synthesized
tgaagtggggcctgggatttca

SEQ ID NO: 781707 - DNA, 22 bp, Artificial Sequence
  chemically synthesized
gaagtggggcctgggatttcaa

SEQ ID NO: 781708 - DNA, 22 bp, Artificial Sequence
  chemically synthesized
aagtggggcctgggatttcaaa

SEQ ID NO: 781709 - DNA, 22 bp, Artificial Sequence
  chemically synthesized
ggggtttgttggcattttgaaa

SEQ ID NO: 781710 - DNA, 22 bp, Artificial Sequence
  chemically synthesized
gggggtttgttggcattttgaa

SEQ ID NO: 781711 - DNA, 22 bp, Artificial Sequence
  chemically synthesized
ggatttcaaaatgccaacaaac

SEQ ID NO: 781712 - DNA, 22 bp, Artificial Sequence
  chemically synthesized
acataacttgggggtttgttgg

SEQ ID NO: 781713 - DNA, 22 bp, Artificial Sequence
  chemically synthesized
gacataacttgggggtttgttg

SEQ ID NO: 781714 - DNA, 22 bp, Artificial Sequence
  chemically synthesized
caaaatgccaacaaacccccaa

SEQ ID NO: 781715 - DNA, 22 bp, Artificial Sequence
  chemically synthesized
aaaatgccaacaaacccccaag

SEQ ID NO: 781716 - DNA, 22 bp, Artificial Sequence
  chemically synthesized
aagccttgacataacttggggg

SEQ ID NO: 781717 - DNA, 22 bp, Artificial Sequence
  chemically synthesized
tacagtgtgattgaagccttga

SEQ ID NO: 781718 - DNA, 22 bp, Artificial Sequence
  chemically synthesized
ctatacagtgtgattgaagcct

SEQ ID NO: 781719 - DNA, 22 bp, Artificial Sequence
  chemically synthesized
gctatacagtgtgattgaagcc

SEQ ID NO: 781720 - DNA, 22 bp, Artificial Sequence
  chemically synthesized
tgtcaaggcttcaatcacactg

SEQ ID NO: 781721 - DNA, 22 bp, Artificial Sequence
  chemically synthesized
caatcacactgtatagcaaggt

SEQ ID NO: 781722 - DNA, 22 bp, Artificial Sequence
  chemically synthesized
aagacagtgtcaaccttgctat

SEQ ID NO: 781723 - DNA, 22 bp, Artificial Sequence
  chemically synthesized
aatcacactgtatagcaaggtt

SEQ ID NO: 781724 - DNA, 22 bp, Artificial Sequence
  chemically synthesized
aaagacagtgtcaaccttgcta

SEQ ID NO: 781725 - DNA, 22 bp, Artificial Sequence
  chemically synthesized
taaagacagtgtcaaccttgct

SEQ ID NO: 781726 - DNA, 22 bp, Artificial Sequence
  chemically synthesized
tttaaagacagtgtcaaccttg

SEQ ID NO: 781727 - DNA, 22 bp, Artificial Sequence
  chemically synthesized
tatagcaaggttgacactgtct

SEQ ID NO: 781728 - DNA, 22 bp, Artificial Sequence
  chemically synthesized
catcattctttaaagacagtgt

SEQ ID NO: 781729 - DNA, 22 bp, Artificial Sequence
  chemically synthesized
gtaattgcatcattctttaaag

SEQ ID NO: 781730 - DNA, 22 bp, Artificial Sequence
  chemically synthesized
ttagtaattgcatcattcttta

SEQ ID NO: 781731 - DNA, 22 bp, Artificial Sequence
  chemically synthesized
acactgtctttaaagaatgatg

SEQ ID NO: 781732 - DNA, 22 bp, Artificial Sequence
  chemically synthesized
tctttaaagaatgatgcaatta

SEQ ID NO: 781733 - DNA, 22 bp, Artificial Sequence
  chemically synthesized
tgtgtcctattagtaattgcat

SEQ ID NO: 781734 - DNA, 22 bp, Artificial Sequence
  chemically synthesized
atgtgtcctattagtaattgca

SEQ ID NO: 781735 - DNA, 22 bp, Artificial Sequence
  chemically synthesized
taaagaatgatgcaattactaa

SEQ ID NO: 781736 - DNA, 22 bp, Artificial Sequence
  chemically synthesized
aaagaatgatgcaattactaat

SEQ ID NO: 781737 - DNA, 22 bp, Artificial Sequence
  chemically synthesized
aagaatgatgcaattactaata

SEQ ID NO: 781738 - DNA, 22 bp, Artificial Sequence
  chemically synthesized
gagatttatgtgtcctattagt

SEQ ID NO: 781739 - DNA, 22 bp, Artificial Sequence
  chemically synthesized
taataattagagatttatgtgt

SEQ ID NO: 781740 - DNA, 22 bp, Artificial Sequence
  chemically synthesized
tgtaataattagagatttatgt

SEQ ID NO: 781741 - DNA, 22 bp, Artificial Sequence
  chemically synthesized
ctaataggacacataaatctct

SEQ ID NO: 781742 - DNA, 22 bp, Artificial Sequence
  chemically synthesized
ataggacacataaatctctaat

SEQ ID NO: 781743 - DNA, 22 bp, Artificial Sequence
  chemically synthesized
agttctgtaataattagagatt

SEQ ID NO: 781744 - DNA, 22 bp, Artificial Sequence
  chemically synthesized
gtgatcatagattcagttctgt

SEQ ID NO: 781745 - DNA, 22 bp, Artificial Sequence
  chemically synthesized
agtgatcatagattcagttctg

SEQ ID NO: 781746 - DNA, 22 bp, Artificial Sequence
  chemically synthesized
tagtgatcatagattcagttct

SEQ ID NO: 781747 - DNA, 22 bp, Artificial Sequence
  chemically synthesized
ttagtgatcatagattcagttc

SEQ ID NO: 781748 - DNA, 22 bp, Artificial Sequence
  chemically synthesized
taattattacagaactgaatct

SEQ ID NO: 781749 - DNA, 22 bp, Artificial Sequence
  chemically synthesized
tttagtgatcatagattcagtt

SEQ ID NO: 781750 - DNA, 22 bp, Artificial Sequence
  chemically synthesized
ttttagtgatcatagattcagt

SEQ ID NO: 781751 - DNA, 22 bp, Artificial Sequence
  chemically synthesized
attattacagaactgaatctat

SEQ ID NO: 781752 - DNA, 22 bp, Artificial Sequence
  chemically synthesized
cttttttagtgatcatagattc

SEQ ID NO: 781753 - DNA, 22 bp, Artificial Sequence
  chemically synthesized
ttacagaactgaatctatgatc

SEQ ID NO: 781754 - DNA, 22 bp, Artificial Sequence
  chemically synthesized
cagaactgaatctatgatcact

SEQ ID NO: 781755 - DNA, 22 bp, Artificial Sequence
  chemically synthesized
atggttccttttttagtgatca

SEQ ID NO: 781756 - DNA, 22 bp, Artificial Sequence
  chemically synthesized
catggttccttttttagtgatc

SEQ ID NO: 781757 - DNA, 22 bp, Artificial Sequence
  chemically synthesized
tcatggttccttttttagtgat

SEQ ID NO: 781758 - DNA, 22 bp, Artificial Sequence
  chemically synthesized
tttcatggttccttttttagtg

SEQ ID NO: 781759 - DNA, 22 bp, Artificial Sequence
  chemically synthesized
ctttcatggttccttttttagt

SEQ ID NO: 781760 - DNA, 22 bp, Artificial Sequence
  chemically synthesized
aatctatgatcactaaaaaagg

SEQ ID NO: 781761 - DNA, 22 bp, Artificial Sequence
  chemically synthesized
tctttcatggttccttttttag

SEQ ID NO: 781762 - DNA, 22 bp, Artificial Sequence
  chemically synthesized
ttctttcatggttcctttttta

SEQ ID NO: 781763 - DNA, 22 bp, Artificial Sequence
  chemically synthesized
tgatcactaaaaaaggaaccat

SEQ ID NO: 781764 - DNA, 22 bp, Artificial Sequence
  chemically synthesized
aaaaaggaaccatgaaagaaaa

SEQ ID NO: 781765 - DNA, 22 bp, Artificial Sequence
  chemically synthesized
agacataatgtcttttctttca

SEQ ID NO: 781766 - DNA, 22 bp, Artificial Sequence
  chemically synthesized
gccaaggtatgataactcagac

SEQ ID NO: 781767 - DNA, 22 bp, Artificial Sequence
  chemically synthesized
agccaaggtatgataactcaga

SEQ ID NO: 781768 - DNA, 22 bp, Artificial Sequence
  chemically synthesized
ccttagccaaggtatgataact

SEQ ID NO: 781769 - DNA, 22 bp, Artificial Sequence
  chemically synthesized
tgtctgagttatcataccttgg

SEQ ID NO: 781770 - DNA, 22 bp, Artificial Sequence
  chemically synthesized
gtactaccttagccaaggtatg

SEQ ID NO: 781771 - DNA, 22 bp, Artificial Sequence
  chemically synthesized
ggtactaccttagccaaggtat

SEQ ID NO: 781772 - DNA, 22 bp, Artificial Sequence
  chemically synthesized
tcttggtactaccttagccaag

SEQ ID NO: 781773 - DNA, 22 bp, Artificial Sequence
  chemically synthesized
agttatcataccttggctaagg

SEQ ID NO: 781774 - DNA, 22 bp, Artificial Sequence
  chemically synthesized
atcttggtactaccttagccaa

SEQ ID NO: 781775 - DNA, 22 bp, Artificial Sequence
  chemically synthesized
tcataccttggctaaggtagta

SEQ ID NO: 781776 - DNA, 22 bp, Artificial Sequence
  chemically synthesized
tgaagagcttatcttggtacta

SEQ ID NO: 781777 - DNA, 22 bp, Artificial Sequence
  chemically synthesized
gtgaagagcttatcttggtact

SEQ ID NO: 781778 - DNA, 22 bp, Artificial Sequence
  chemically synthesized
tgtgaagagcttatcttggtac

SEQ ID NO: 781779 - DNA, 22 bp, Artificial Sequence
  chemically synthesized
ggctaaggtagtaccaagataa

SEQ ID NO: 781780 - DNA, 22 bp, Artificial Sequence
  chemically synthesized
gctaaggtagtaccaagataag

SEQ ID NO: 781781 - DNA, 22 bp, Artificial Sequence
  chemically synthesized
agctttgtgaagagcttatctt

SEQ ID NO: 781782 - DNA, 22 bp, Artificial Sequence
  chemically synthesized
aggtagtaccaagataagctct

SEQ ID NO: 781783 - DNA, 22 bp, Artificial Sequence
  chemically synthesized
tgaagcccattcagctttgtga

SEQ ID NO: 781784 - DNA, 22 bp, Artificial Sequence
  chemically synthesized
atcattgtgaagcccattcagc

SEQ ID NO: 781785 - DNA, 22 bp, Artificial Sequence
  chemically synthesized
ttcacaaagctgaatgggcttc

SEQ ID NO: 781786 - DNA, 22 bp, Artificial Sequence
  chemically synthesized
cacaaagctgaatgggcttcac

SEQ ID NO: 781787 - DNA, 22 bp, Artificial Sequence
  chemically synthesized
acaaagctgaatgggcttcaca

SEQ ID NO: 781788 - DNA, 22 bp, Artificial Sequence
  chemically synthesized
ccaccctgatcattgtgaagcc

SEQ ID NO: 781789 - DNA, 22 bp, Artificial Sequence
  chemically synthesized
taccaccctgatcattgtgaag

SEQ ID NO: 781790 - DNA, 22 bp, Artificial Sequence
  chemically synthesized
aattctaccaccctgatcattg

SEQ ID NO: 781791 - DNA, 22 bp, Artificial Sequence
  chemically synthesized
aatgggcttcacaatgatcagg

SEQ ID NO: 781792 - DNA, 22 bp, Artificial Sequence
  chemically synthesized
cacaatgatcagggtggtagaa

SEQ ID NO: 781793 - DNA, 22 bp, Artificial Sequence
  chemically synthesized
acaatgatcagggtggtagaat

SEQ ID NO: 781794 - DNA, 22 bp, Artificial Sequence
  chemically synthesized
tgggcccactgaattctaccac

SEQ ID NO: 781795 - DNA, 22 bp, Artificial Sequence
  chemically synthesized
gtgggcccactgaattctacca

SEQ ID NO: 781796 - DNA, 22 bp, Artificial Sequence
  chemically synthesized
caaaggagtttgtgggcccact

SEQ ID NO: 781797 - DNA, 22 bp, Artificial Sequence
  chemically synthesized
agtgggcccacaaactcctttg

SEQ ID NO: 781798 - DNA, 22 bp, Artificial Sequence
  chemically synthesized
tccgtaatataagttgcaaagg

SEQ ID NO: 781799 - DNA, 22 bp, Artificial Sequence
  chemically synthesized
aaatgtccctatccgtaatata

SEQ ID NO: 781800 - DNA, 22 bp, Artificial Sequence
  chemically synthesized
gaaatgtccctatccgtaatat

SEQ ID NO: 781801 - DNA, 22 bp, Artificial Sequence
  chemically synthesized
ctttgcaacttatattacggat

SEQ ID NO: 781802 - DNA, 22 bp, Artificial Sequence
  chemically synthesized
tgaaatgtccctatccgtaata

SEQ ID NO: 781803 - DNA, 22 bp, Artificial Sequence
  chemically synthesized
tgcaacttatattacggatagg

SEQ ID NO: 781804 - DNA, 22 bp, Artificial Sequence
  chemically synthesized
ttttgaaatgtccctatccgta

SEQ ID NO: 781805 - DNA, 22 bp, Artificial Sequence
  chemically synthesized
gcaacttatattacggataggg

SEQ ID NO: 781806 - DNA, 22 bp, Artificial Sequence
  chemically synthesized
caacttatattacggataggga

SEQ ID NO: 781807 - DNA, 22 bp, Artificial Sequence
  chemically synthesized
atattacggatagggacatttc

SEQ ID NO: 781808 - DNA, 22 bp, Artificial Sequence
  chemically synthesized
tattacggatagggacatttca

SEQ ID NO: 781809 - DNA, 22 bp, Artificial Sequence
  chemically synthesized
gagtgtctattttgaaatgtcc

SEQ ID NO: 781810 - DNA, 22 bp, Artificial Sequence
  chemically synthesized
ttcgagtgtctattttgaaatg

SEQ ID NO: 781811 - DNA, 22 bp, Artificial Sequence
  chemically synthesized
cggatagggacatttcaaaata

SEQ ID NO: 781812 - DNA, 22 bp, Artificial Sequence
  chemically synthesized
tctgttcgagtgtctattttga

SEQ ID NO: 781813 - DNA, 22 bp, Artificial Sequence
  chemically synthesized
caaaatagacactcgaacagac

SEQ ID NO: 781814 - DNA, 22 bp, Artificial Sequence
  chemically synthesized
aaaatagacactcgaacagaca

SEQ ID NO: 781815 - DNA, 22 bp, Artificial Sequence
  chemically synthesized
cagatcacggcactgtctgttc

SEQ ID NO: 781816 - DNA, 22 bp, Artificial Sequence
  chemically synthesized
acagatcacggcactgtctgtt

SEQ ID NO: 781817 - DNA, 22 bp, Artificial Sequence
  chemically synthesized
gtgaacccttacagatcacggc

SEQ ID NO: 781818 - DNA, 22 bp, Artificial Sequence
  chemically synthesized
gaacagacagtgccgtgatctg

SEQ ID NO: 781819 - DNA, 22 bp, Artificial Sequence
  chemically synthesized
agtgtgcacatattggtgaacc

SEQ ID NO: 781820 - DNA, 22 bp, Artificial Sequence
  chemically synthesized
aagtgtgcacatattggtgaac

SEQ ID NO: 781821 - DNA, 22 bp, Artificial Sequence
  chemically synthesized
taagtgtgcacatattggtgaa

SEQ ID NO: 781822 - DNA, 22 bp, Artificial Sequence
  chemically synthesized
taagggttcaccaatatgtgca

SEQ ID NO: 781823 - DNA, 22 bp, Artificial Sequence
  chemically synthesized
accaatatgtgcacacttaaaa

SEQ ID NO: 781824 - DNA, 22 bp, Artificial Sequence
  chemically synthesized
ggcccagccaatgggtataagt

SEQ ID NO: 781825 - DNA, 22 bp, Artificial Sequence
  chemically synthesized
aatgctgggcccagccaatggg

SEQ ID NO: 781826 - DNA, 22 bp, Artificial Sequence
  chemically synthesized
aaaacttatacccattggctgg

SEQ ID NO: 781827 - DNA, 22 bp, Artificial Sequence
  chemically synthesized
aaacttatacccattggctggg

SEQ ID NO: 781828 - DNA, 22 bp, Artificial Sequence
  chemically synthesized
ccaatctaaatgctgggcccag

SEQ ID NO: 781829 - DNA, 22 bp, Artificial Sequence
  chemically synthesized
atacccattggctgggcccagc

SEQ ID NO: 781830 - DNA, 22 bp, Artificial Sequence
  chemically synthesized
tacccattggctgggcccagca

SEQ ID NO: 781831 - DNA, 22 bp, Artificial Sequence
  chemically synthesized
ctgccaatctaaatgctgggcc

SEQ ID NO: 781832 - DNA, 22 bp, Artificial Sequence
  chemically synthesized
gctgccaatctaaatgctgggc

SEQ ID NO: 781833 - DNA, 22 bp, Artificial Sequence
  chemically synthesized
gtcttgctgccaatctaaatgc

SEQ ID NO: 781834 - DNA, 22 bp, Artificial Sequence
  chemically synthesized
gctgggcccagcatttagattg

SEQ ID NO: 781835 - DNA, 22 bp, Artificial Sequence
  chemically synthesized
ggcccagcatttagattggcag

SEQ ID NO: 781836 - DNA, 22 bp, Artificial Sequence
  chemically synthesized
agattggcagcaagaccaaccc

SEQ ID NO: 781837 - DNA, 22 bp, Artificial Sequence
  chemically synthesized
gattggcagcaagaccaacccc

SEQ ID NO: 781838 - DNA, 22 bp, Artificial Sequence
  chemically synthesized
gcagcaagaccaacccctcctc

SEQ ID NO: 781839 - DNA, 22 bp, Artificial Sequence
  chemically synthesized
aggaggtggagggagaggaggg

SEQ ID NO: 781840 - DNA, 22 bp, Artificial Sequence
  chemically synthesized
agtaggctgaggaggtggaggg

SEQ ID NO: 781841 - DNA, 22 bp, Artificial Sequence
  chemically synthesized
acgttaagtaggctgaggaggt

SEQ ID NO: 781842 - DNA, 22 bp, Artificial Sequence
  chemically synthesized
cacgttaagtaggctgaggagg

SEQ ID NO: 781843 - DNA, 22 bp, Artificial Sequence
  chemically synthesized
ctctccctccacctcctcagcc

SEQ ID NO: 781844 - DNA, 22 bp, Artificial Sequence
  chemically synthesized
tccctccacctcctcagcctac

SEQ ID NO: 781845 - DNA, 22 bp, Artificial Sequence
  chemically synthesized
tcttcacgttaagtaggctgag

SEQ ID NO: 781846 - DNA, 22 bp, Artificial Sequence
  chemically synthesized
cctccacctcctcagcctactt

SEQ ID NO: 781847 - DNA, 22 bp, Artificial Sequence
  chemically synthesized
attatcttcacgttaagtaggc

SEQ ID NO: 781848 - DNA, 22 bp, Artificial Sequence
  chemically synthesized
cacctcctcagcctacttaacg

SEQ ID NO: 781849 - DNA, 22 bp, Artificial Sequence
  chemically synthesized
tcattatcttcacgttaagtag

SEQ ID NO: 781850 - DNA, 22 bp, Artificial Sequence
  chemically synthesized
attctcattatcttcacgttaa

SEQ ID NO: 781851 - DNA, 22 bp, Artificial Sequence
  chemically synthesized
cattctcattatcttcacgtta

SEQ ID NO: 781852 - DNA, 22 bp, Artificial Sequence
  chemically synthesized
ctcagcctacttaacgtgaaga

SEQ ID NO: 781853 - DNA, 22 bp, Artificial Sequence
  chemically synthesized
agcctacttaacgtgaagataa

SEQ ID NO: 781854 - DNA, 22 bp, Artificial Sequence
  chemically synthesized
cttaacgtgaagataatgagaa

SEQ ID NO: 781855 - DNA, 22 bp, Artificial Sequence
  chemically synthesized
aacgtgaagataatgagaatga

SEQ ID NO: 781856 - DNA, 22 bp, Artificial Sequence
  chemically synthesized
acgtgaagataatgagaatgaa

SEQ ID NO: 781857 - DNA, 22 bp, Artificial Sequence
  chemically synthesized
agtggaagtggatcatcatata

SEQ ID NO: 781858 - DNA, 22 bp, Artificial Sequence
  chemically synthesized
attaagtggaagtggatcatca

SEQ ID NO: 781859 - DNA, 22 bp, Artificial Sequence
  chemically synthesized
ttaattaagtggaagtggatca

SEQ ID NO: 781860 - DNA, 22 bp, Artificial Sequence
  chemically synthesized
ctattaattaagtggaagtgga

SEQ ID NO: 781861 - DNA, 22 bp, Artificial Sequence
  chemically synthesized
actattaattaagtggaagtgg

SEQ ID NO: 781862 - DNA, 22 bp, Artificial Sequence
  chemically synthesized
tatgatgatccacttccactta

SEQ ID NO: 781863 - DNA, 22 bp, Artificial Sequence
  chemically synthesized
ccacttaattaatagtaaatat

SEQ ID NO: 781864 - DNA, 22 bp, Artificial Sequence
  chemically synthesized
cacttaattaatagtaaatata

SEQ ID NO: 781865 - DNA, 22 bp, Artificial Sequence
  chemically synthesized
aattaatagtaaatatattttt

SEQ ID NO: 781866 - DNA, 22 bp, Artificial Sequence
  chemically synthesized
attaatagtaaatatatttttc

SEQ ID NO: 781867 - DNA, 22 bp, Artificial Sequence
  chemically synthesized
atagtaaatatatttttctctt

SEQ ID NO: 781868 - DNA, 22 bp, Artificial Sequence
  chemically synthesized
agaaaatcataaggaagagaaa

SEQ ID NO: 781869 - DNA, 22 bp, Artificial Sequence
  chemically synthesized
ctaagaaaatcataaggaagag

SEQ ID NO: 781870 - DNA, 22 bp, Artificial Sequence
  chemically synthesized
ttctcttccttatgattttctt

SEQ ID NO: 781871 - DNA, 22 bp, Artificial Sequence
  chemically synthesized
tctcttccttatgattttctta

SEQ ID NO: 781872 - DNA, 22 bp, Artificial Sequence
  chemically synthesized
ctcttccttatgattttcttag

SEQ ID NO: 781873 - DNA, 22 bp, Artificial Sequence
  chemically synthesized
tcttccttatgattttcttagt

SEQ ID NO: 781874 - DNA, 22 bp, Artificial Sequence
  chemically synthesized
ttccttatgattttcttagtaa

SEQ ID NO: 781875 - DNA, 22 bp, Artificial Sequence
  chemically synthesized
ccttatgattttcttagtaaca

SEQ ID NO: 781876 - DNA, 22 bp, Artificial Sequence
  chemically synthesized
gagaaaatacgatgttactaag

SEQ ID NO: 781877 - DNA, 22 bp, Artificial Sequence
  chemically synthesized
cttatgattttcttagtaacat

SEQ ID NO: 781878 - DNA, 22 bp, Artificial Sequence
  chemically synthesized
atgattttcttagtaacatcgt

SEQ ID NO: 781879 - DNA, 22 bp, Artificial Sequence
  chemically synthesized
tgattttcttagtaacatcgta

SEQ ID NO: 781880 - DNA, 22 bp, Artificial Sequence
  chemically synthesized
tcttagtaacatcgtattttct

SEQ ID NO: 781881 - DNA, 22 bp, Artificial Sequence
  chemically synthesized
cttagtaacatcgtattttctc

SEQ ID NO: 781882 - DNA, 22 bp, Artificial Sequence
  chemically synthesized
ttagtaacatcgtattttctct

SEQ ID NO: 781883 - DNA, 22 bp, Artificial Sequence
  chemically synthesized
agtaacatcgtattttctctaa

SEQ ID NO: 781884 - DNA, 22 bp, Artificial Sequence
  chemically synthesized
caataaagtaagttagagaaaa

SEQ ID NO: 781885 - DNA, 22 bp, Artificial Sequence
  chemically synthesized
gtaacatcgtattttctctaac

SEQ ID NO: 781886 - DNA, 22 bp, Artificial Sequence
  chemically synthesized
gcaataaagtaagttagagaaa

SEQ ID NO: 781887 - DNA, 22 bp, Artificial Sequence
  chemically synthesized
ttgcaataaagtaagttagaga

SEQ ID NO: 781888 - DNA, 22 bp, Artificial Sequence
  chemically synthesized
tattcttgcaataaagtaagtt

SEQ ID NO: 781889 - DNA, 22 bp, Artificial Sequence
  chemically synthesized
tctctaacttactttattgcaa

SEQ ID NO: 781890 - DNA, 22 bp, Artificial Sequence
  chemically synthesized
ctctaacttactttattgcaag

SEQ ID NO: 781891 - DNA, 22 bp, Artificial Sequence
  chemically synthesized
tctaacttactttattgcaaga

SEQ ID NO: 781892 - DNA, 22 bp, Artificial Sequence
  chemically synthesized
taacttactttattgcaagaat

SEQ ID NO: 781893 - DNA, 22 bp, Artificial Sequence
  chemically synthesized
acttactttattgcaagaatac

SEQ ID NO: 781894 - DNA, 22 bp, Artificial Sequence
  chemically synthesized
tatgtaatatatactgtattct

SEQ ID NO: 781895 - DNA, 22 bp, Artificial Sequence
  chemically synthesized
actttattgcaagaatacagta

SEQ ID NO: 781896 - DNA, 22 bp, Artificial Sequence
  chemically synthesized
ctttattgcaagaatacagtat

SEQ ID NO: 781897 - DNA, 22 bp, Artificial Sequence
  chemically synthesized
ttatatgtaatatatactgtat

SEQ ID NO: 781898 - DNA, 22 bp, Artificial Sequence
  chemically synthesized
tattgcaagaatacagtatata

SEQ ID NO: 781899 - DNA, 22 bp, Artificial Sequence
  chemically synthesized
attgcaagaatacagtatatat

SEQ ID NO: 781900 - DNA, 22 bp, Artificial Sequence
  chemically synthesized
ttgcaagaatacagtatatatt

SEQ ID NO: 781901 - DNA, 22 bp, Artificial Sequence
  chemically synthesized
cattgttatatgtaatatatac

SEQ ID NO: 781902 - DNA, 22 bp, Artificial Sequence
  chemically synthesized
gcattgttatatgtaatatata

SEQ ID NO: 781903 - DNA, 22 bp, Artificial Sequence
  chemically synthesized
caagaatacagtatatattaca

SEQ ID NO: 781904 - DNA, 22 bp, Artificial Sequence
  chemically synthesized
tgcattgttatatgtaatatat

SEQ ID NO: 781905 - DNA, 22 bp, Artificial Sequence
  chemically synthesized
gcgtatactttgcattgttata

SEQ ID NO: 781906 - DNA, 22 bp, Artificial Sequence
  chemically synthesized
catataacaatgcaaagtatac

SEQ ID NO: 781907 - DNA, 22 bp, Artificial Sequence
  chemically synthesized
ataacataaagagtgattagcg

SEQ ID NO: 781908 - DNA, 22 bp, Artificial Sequence
  chemically synthesized
acagaagccatactgataacat

SEQ ID NO: 781909 - DNA, 22 bp, Artificial Sequence
  chemically synthesized
atcactctttatgttatcagta

SEQ ID NO: 781910 - DNA, 22 bp, Artificial Sequence
  chemically synthesized
ttgacagaagccatactgataa

SEQ ID NO: 781911 - DNA, 22 bp, Artificial Sequence
  chemically synthesized
ctgttgacagaagccatactga

SEQ ID NO: 781912 - DNA, 22 bp, Artificial Sequence
  chemically synthesized
tttatgttatcagtatggcttc

SEQ ID NO: 781913 - DNA, 22 bp, Artificial Sequence
  chemically synthesized
tatgttatcagtatggcttctg

SEQ ID NO: 781914 - DNA, 22 bp, Artificial Sequence
  chemically synthesized
atgttatcagtatggcttctgt

SEQ ID NO: 781915 - DNA, 22 bp, Artificial Sequence
  chemically synthesized
tgttatcagtatggcttctgtc

SEQ ID NO: 781916 - DNA, 22 bp, Artificial Sequence
  chemically synthesized
ataggctactgttgacagaagc

SEQ ID NO: 781917 - DNA, 22 bp, Artificial Sequence
  chemically synthesized
ctaataggctactgttgacaga

SEQ ID NO: 781918 - DNA, 22 bp, Artificial Sequence
  chemically synthesized
tcagtatggcttctgtcaacag

SEQ ID NO: 781919 - DNA, 22 bp, Artificial Sequence
  chemically synthesized
ctgtcaacagtagcctattagt

SEQ ID NO: 781920 - DNA, 22 bp, Artificial Sequence
  chemically synthesized
tgtcaacagtagcctattagta

SEQ ID NO: 781921 - DNA, 22 bp, Artificial Sequence
  chemically synthesized
tcaacagtagcctattagtagt

SEQ ID NO: 781922 - DNA, 22 bp, Artificial Sequence
  chemically synthesized
ccccaaaacgtaactactaata

SEQ ID NO: 781923 - DNA, 22 bp, Artificial Sequence
  chemically synthesized
actcccccaaaacgtaactact

SEQ ID NO: 781924 - DNA, 22 bp, Artificial Sequence
  chemically synthesized
cactcccccaaaacgtaactac

SEQ ID NO: 781925 - DNA, 22 bp, Artificial Sequence
  chemically synthesized
tcactcccccaaaacgtaacta

SEQ ID NO: 781926 - DNA, 22 bp, Artificial Sequence
  chemically synthesized
ttcactcccccaaaacgtaact

SEQ ID NO: 781927 - DNA, 22 bp, Artificial Sequence
  chemically synthesized
ttagtagttacgttttggggga

SEQ ID NO: 781928 - DNA, 22 bp, Artificial Sequence
  chemically synthesized
gtagttacgttttgggggagtg

SEQ ID NO: 781929 - DNA, 22 bp, Artificial Sequence
  chemically synthesized
agtagaacttttcactccccca

SEQ ID NO: 781930 - DNA, 22 bp, Artificial Sequence
  chemically synthesized
cgttttgggggagtgaaaagtt

SEQ ID NO: 781931 - DNA, 22 bp, Artificial Sequence
  chemically synthesized
aaaaatctaagtagaacttttc

SEQ ID NO: 781932 - DNA, 22 bp, Artificial Sequence
  chemically synthesized
tgggggagtgaaaagttctact

SEQ ID NO: 781933 - DNA, 22 bp, Artificial Sequence
  chemically synthesized
gggggagtgaaaagttctactt

SEQ ID NO: 781934 - DNA, 22 bp, Artificial Sequence
  chemically synthesized
ggggagtgaaaagttctactta

SEQ ID NO: 781935 - DNA, 22 bp, Artificial Sequence
  chemically synthesized
agcccaacacattgaaaaatct

SEQ ID NO: 781936 - DNA, 22 bp, Artificial Sequence
  chemically synthesized
tacttagatttttcaatgtgtt

SEQ ID NO: 781937 - DNA, 22 bp, Artificial Sequence
  chemically synthesized
cttagatttttcaatgtgttgg

SEQ ID NO: 781938 - DNA, 22 bp, Artificial Sequence
  chemically synthesized
ggggcgctgagcccaacacatt

SEQ ID NO: 781939 - DNA, 22 bp, Artificial Sequence
  chemically synthesized
agatttttcaatgtgttgggct

SEQ ID NO: 781940 - DNA, 22 bp, Artificial Sequence
  chemically synthesized
gatttttcaatgtgttgggctc

SEQ ID NO: 781941 - DNA, 22 bp, Artificial Sequence
  chemically synthesized
ttcaatgtgttgggctcagcgc

SEQ ID NO: 781942 - DNA, 22 bp, Artificial Sequence
  chemically synthesized
tcaatgtgttgggctcagcgcc

SEQ ID NO: 781943 - DNA, 22 bp, Artificial Sequence
  chemically synthesized
caatgtgttgggctcagcgccc

SEQ ID NO: 781944 - DNA, 22 bp, Artificial Sequence
  chemically synthesized
aatgtgttgggctcagcgcccc

SEQ ID NO: 781945 - DNA, 22 bp, Artificial Sequence
  chemically synthesized
aaacaatgtgagggttaggggc

SEQ ID NO: 781946 - DNA, 22 bp, Artificial Sequence
  chemically synthesized
ggctcagcgcccctaaccctca

SEQ ID NO: 781947 - DNA, 22 bp, Artificial Sequence
  chemically synthesized
accctcaaacaatgtgagggtt

SEQ ID NO: 781948 - DNA, 22 bp, Artificial Sequence
  chemically synthesized
agcgcccctaaccctcacattg

SEQ ID NO: 781949 - DNA, 22 bp, Artificial Sequence
  chemically synthesized
tacagttgaccctcaaacaatg

SEQ ID NO: 781950 - DNA, 22 bp, Artificial Sequence
  chemically synthesized
accctcacattgtttgagggtc

SEQ ID NO: 781951 - DNA, 22 bp, Artificial Sequence
  chemically synthesized
gaaagtgttatacagttgaccc

SEQ ID NO: 781952 - DNA, 22 bp, Artificial Sequence
  chemically synthesized
acattgtttgagggtcaactgt

SEQ ID NO: 781953 - DNA, 22 bp, Artificial Sequence
  chemically synthesized
ggaaagtgttatacagttgacc

SEQ ID NO: 781954 - DNA, 22 bp, Artificial Sequence
  chemically synthesized
tggaaagtgttatacagttgac

SEQ ID NO: 781955 - DNA, 22 bp, Artificial Sequence
  chemically synthesized
tttgagggtcaactgtataaca

SEQ ID NO: 781956 - DNA, 22 bp, Artificial Sequence
  chemically synthesized
gagggtcaactgtataacactt

SEQ ID NO: 781957 - DNA, 22 bp, Artificial Sequence
  chemically synthesized
agggtcaactgtataacacttt

SEQ ID NO: 781958 - DNA, 22 bp, Artificial Sequence
  chemically synthesized
tataacactttccaaaggctcc

SEQ ID NO: 781959 - DNA, 22 bp, Artificial Sequence
  chemically synthesized
agaacagggcaaagggagcctt

SEQ ID NO: 781960 - DNA, 22 bp, Artificial Sequence
  chemically synthesized
tccaaaggctccctttgccctg

SEQ ID NO: 781961 - DNA, 22 bp, Artificial Sequence
  chemically synthesized
ccaaaggctccctttgccctgt

SEQ ID NO: 781962 - DNA, 22 bp, Artificial Sequence
  chemically synthesized
caaaggctccctttgccctgtt

SEQ ID NO: 781963 - DNA, 22 bp, Artificial Sequence
  chemically synthesized
ggccgtgtctaagaacagggca

SEQ ID NO: 781964 - DNA, 22 bp, Artificial Sequence
  chemically synthesized
atgctgggccgtgtctaagaac

SEQ ID NO: 781965 - DNA, 22 bp, Artificial Sequence
  chemically synthesized
cctttgccctgttcttagacac

SEQ ID NO: 781966 - DNA, 22 bp, Artificial Sequence
  chemically synthesized
tgccctgttcttagacacggcc

SEQ ID NO: 781967 - DNA, 22 bp, Artificial Sequence
  chemically synthesized
gccctgttcttagacacggccc

SEQ ID NO: 781968 - DNA, 22 bp, Artificial Sequence
  chemically synthesized
ccctgttcttagacacggccca

SEQ ID NO: 781969 - DNA, 22 bp, Artificial Sequence
  chemically synthesized
ccacaaattcatgctgggccgt

SEQ ID NO: 781970 - DNA, 22 bp, Artificial Sequence
  chemically synthesized
ttcttagacacggcccagcatg

SEQ ID NO: 781971 - DNA, 22 bp, Artificial Sequence
  chemically synthesized
ttagacacggcccagcatgaat

SEQ ID NO: 781972 - DNA, 22 bp, Artificial Sequence
  chemically synthesized
agacacggcccagcatgaattt

SEQ ID NO: 781973 - DNA, 22 bp, Artificial Sequence
  chemically synthesized
caagattgccacaaattcatgc

SEQ ID NO: 781974 - DNA, 22 bp, Artificial Sequence
  chemically synthesized
gacacggcccagcatgaatttg

SEQ ID NO: 781975 - DNA, 22 bp, Artificial Sequence
  chemically synthesized
attacaagattgccacaaattc

SEQ ID NO: 781976 - DNA, 22 bp, Artificial Sequence
  chemically synthesized
gacagtatgtggctcattacaa

SEQ ID NO: 781977 - DNA, 22 bp, Artificial Sequence
  chemically synthesized
gtggcaatcttgtaatgagcca

SEQ ID NO: 781978 - DNA, 22 bp, Artificial Sequence
  chemically synthesized
ttagacagtatgtggctcatta

SEQ ID NO: 781979 - DNA, 22 bp, Artificial Sequence
  chemically synthesized
tggcaatcttgtaatgagccac

SEQ ID NO: 781980 - DNA, 22 bp, Artificial Sequence
  chemically synthesized
gttagacagtatgtggctcatt

SEQ ID NO: 781981 - DNA, 22 bp, Artificial Sequence
  chemically synthesized
gtaatgagccacatactgtcta

SEQ ID NO: 781982 - DNA, 22 bp, Artificial Sequence
  chemically synthesized
taatgagccacatactgtctaa

SEQ ID NO: 781983 - DNA, 22 bp, Artificial Sequence
  chemically synthesized
gcatccaacttgttagacagta

SEQ ID NO: 781984 - DNA, 22 bp, Artificial Sequence
  chemically synthesized
tataattagcatccaacttgtt

SEQ ID NO: 781985 - DNA, 22 bp, Artificial Sequence
  chemically synthesized
gtataattagcatccaacttgt

SEQ ID NO: 781986 - DNA, 22 bp, Artificial Sequence
  chemically synthesized
tgtataattagcatccaacttg

SEQ ID NO: 781987 - DNA, 22 bp, Artificial Sequence
  chemically synthesized
tctaacaagttggatgctaatt

SEQ ID NO: 781988 - DNA, 22 bp, Artificial Sequence
  chemically synthesized
aaaagttttgtataattagcat

SEQ ID NO: 781989 - DNA, 22 bp, Artificial Sequence
  chemically synthesized
caaaagttttgtataattagca

SEQ ID NO: 781990 - DNA, 22 bp, Artificial Sequence
  chemically synthesized
tcaaaagttttgtataattagc

SEQ ID NO: 781991 - DNA, 22 bp, Artificial Sequence
  chemically synthesized
acaagttggatgctaattatac

SEQ ID NO: 781992 - DNA, 22 bp, Artificial Sequence
  chemically synthesized
ttcaaaagttttgtataattag

SEQ ID NO: 781993 - DNA, 22 bp, Artificial Sequence
  chemically synthesized
tttcaaaagttttgtataatta

SEQ ID NO: 781994 - DNA, 22 bp, Artificial Sequence
  chemically synthesized
ttttcaaaagttttgtataatt

SEQ ID NO: 781995 - DNA, 22 bp, Artificial Sequence
  chemically synthesized
gatgctaattatacaaaacttt

SEQ ID NO: 781996 - DNA, 22 bp, Artificial Sequence
  chemically synthesized
atcccttttttcaaaagttttg

SEQ ID NO: 781997 - DNA, 22 bp, Artificial Sequence
  chemically synthesized
gatcccttttttcaaaagtttt

SEQ ID NO: 781998 - DNA, 22 bp, Artificial Sequence
  chemically synthesized
tgatcccttttttcaaaagttt

SEQ ID NO: 781999 - DNA, 22 bp, Artificial Sequence
  chemically synthesized
attatacaaaacttttgaaaaa

SEQ ID NO: 782000 - DNA, 22 bp, Artificial Sequence
  chemically synthesized
tacaaaacttttgaaaaaaggg

SEQ ID NO: 782001 - DNA, 22 bp, Artificial Sequence
  chemically synthesized
tgaagtaggaactttgatccct

SEQ ID NO: 782002 - DNA, 22 bp, Artificial Sequence
  chemically synthesized
gtgaagtaggaactttgatccc

SEQ ID NO: 782003 - DNA, 22 bp, Artificial Sequence
  chemically synthesized
ttgaaaaaagggatcaaagttc

SEQ ID NO: 782004 - DNA, 22 bp, Artificial Sequence
  chemically synthesized
tgaaaaaagggatcaaagttcc

SEQ ID NO: 782005 - DNA, 22 bp, Artificial Sequence
  chemically synthesized
gaaaaaagggatcaaagttcct

SEQ ID NO: 782006 - DNA, 22 bp, Artificial Sequence
  chemically synthesized
aaaaaagggatcaaagttccta

SEQ ID NO: 782007 - DNA, 22 bp, Artificial Sequence
  chemically synthesized
aagcttgtgaagtaggaacttt

SEQ ID NO: 782008 - DNA, 22 bp, Artificial Sequence
  chemically synthesized
ttcaagcttgtgaagtaggaac

SEQ ID NO: 782009 - DNA, 22 bp, Artificial Sequence
  chemically synthesized
cagctgttcaagcttgtgaagt

SEQ ID NO: 782010 - DNA, 22 bp, Artificial Sequence
  chemically synthesized
aggctacagctgttcaagcttg

SEQ ID NO: 782011 - DNA, 22 bp, Artificial Sequence
  chemically synthesized
ctgaggctacagctgttcaagc

SEQ ID NO: 782012 - DNA, 22 bp, Artificial Sequence
  chemically synthesized
ctacttcacaagcttgaacagc

SEQ ID NO: 782013 - DNA, 22 bp, Artificial Sequence
  chemically synthesized
cttcacaagcttgaacagctgt

SEQ ID NO: 782014 - DNA, 22 bp, Artificial Sequence
  chemically synthesized
cacaagcttgaacagctgtagc

SEQ ID NO: 782015 - DNA, 22 bp, Artificial Sequence
  chemically synthesized
acaagcttgaacagctgtagcc

SEQ ID NO: 782016 - DNA, 22 bp, Artificial Sequence
  chemically synthesized
gagaaagttcctgaggctacag

SEQ ID NO: 782017 - DNA, 22 bp, Artificial Sequence
  chemically synthesized
gaacagctgtagcctcaggaac

SEQ ID NO: 782018 - DNA, 22 bp, Artificial Sequence
  chemically synthesized
aatctggagaaagttcctgagg

SEQ ID NO: 782019 - DNA, 22 bp, Artificial Sequence
  chemically synthesized
aacagctgtagcctcaggaact

SEQ ID NO: 782020 - DNA, 22 bp, Artificial Sequence
  chemically synthesized
ccctcaatctggagaaagttcc

SEQ ID NO: 782021 - DNA, 22 bp, Artificial Sequence
  chemically synthesized
gccctcaatctggagaaagttc

SEQ ID NO: 782022 - DNA, 22 bp, Artificial Sequence
  chemically synthesized
tgccctcaatctggagaaagtt

SEQ ID NO: 782023 - DNA, 22 bp, Artificial Sequence
  chemically synthesized
ttgccctcaatctggagaaagt

SEQ ID NO: 782024 - DNA, 22 bp, Artificial Sequence
  chemically synthesized
tagcctcaggaactttctccag

SEQ ID NO: 782025 - DNA, 22 bp, Artificial Sequence
  chemically synthesized
aggaactttctccagattgagg

SEQ ID NO: 782026 - DNA, 22 bp, Artificial Sequence
  chemically synthesized
gagataggatttttgccctcaa

SEQ ID NO: 782027 - DNA, 22 bp, Artificial Sequence
  chemically synthesized
ctggagataggatttttgccct

SEQ ID NO: 782028 - DNA, 22 bp, Artificial Sequence
  chemically synthesized
tctccagattgagggcaaaaat

SEQ ID NO: 782029 - DNA, 22 bp, Artificial Sequence
  chemically synthesized
cctggagataggatttttgccc

SEQ ID NO: 782030 - DNA, 22 bp, Artificial Sequence
  chemically synthesized
ctccagattgagggcaaaaatc

SEQ ID NO: 782031 - DNA, 22 bp, Artificial Sequence
  chemically synthesized
tccagattgagggcaaaaatcc

SEQ ID NO: 782032 - DNA, 22 bp, Artificial Sequence
  chemically synthesized
cagattgagggcaaaaatccta

SEQ ID NO: 782033 - DNA, 22 bp, Artificial Sequence
  chemically synthesized
gcttcctggagataggattttt

SEQ ID NO: 782034 - DNA, 22 bp, Artificial Sequence
  chemically synthesized
ggcttcctggagataggatttt

SEQ ID NO: 782035 - DNA, 22 bp, Artificial Sequence
  chemically synthesized
agggcaaaaatcctatctccag

SEQ ID NO: 782036 - DNA, 22 bp, Artificial Sequence
  chemically synthesized
caaatttggcttcctggagata

SEQ ID NO: 782037 - DNA, 22 bp, Artificial Sequence
  chemically synthesized
tctccaggaagccaaatttgca

SEQ ID NO: 782038 - DNA, 22 bp, Artificial Sequence
  chemically synthesized
ggagagtgtggcagctgcaaat

SEQ ID NO: 782039 - DNA, 22 bp, Artificial Sequence
  chemically synthesized
caggaagccaaatttgcagctg

SEQ ID NO: 782040 - DNA, 22 bp, Artificial Sequence
  chemically synthesized
gggagagtgtggcagctgcaaa

SEQ ID NO: 782041 - DNA, 22 bp, Artificial Sequence
  chemically synthesized
tgggagagtgtggcagctgcaa

SEQ ID NO: 782042 - DNA, 22 bp, Artificial Sequence
  chemically synthesized
ggattttgggagagtgtggcag

SEQ ID NO: 782043 - DNA, 22 bp, Artificial Sequence
  chemically synthesized
gcagctgccacactctcccaaa

SEQ ID NO: 782044 - DNA, 22 bp, Artificial Sequence
  chemically synthesized
cagctgccacactctcccaaaa

SEQ ID NO: 782045 - DNA, 22 bp, Artificial Sequence
  chemically synthesized
aggtgaactgggattttgggag

SEQ ID NO: 782046 - DNA, 22 bp, Artificial Sequence
  chemically synthesized
ccacactctcccaaaatcccag

SEQ ID NO: 782047 - DNA, 22 bp, Artificial Sequence
  chemically synthesized
tcccaaaatcccagttcacctc

SEQ ID NO: 782048 - DNA, 22 bp, Artificial Sequence
  chemically synthesized
cccatcagtccctgaggtgaac

SEQ ID NO: 782049 - DNA, 22 bp, Artificial Sequence
  chemically synthesized
ccaaaatcccagttcacctcag

SEQ ID NO: 782050 - DNA, 22 bp, Artificial Sequence
  chemically synthesized
actccccatcagtccctgaggt

SEQ ID NO: 782051 - DNA, 22 bp, Artificial Sequence
  chemically synthesized
acctcagggactgatggggagt

SEQ ID NO: 782052 - DNA, 22 bp, Artificial Sequence
  chemically synthesized
agggactgatggggagtcagtc

SEQ ID NO: 782053 - DNA, 22 bp, Artificial Sequence
  chemically synthesized
atggggagtcagtcatcatact

SEQ ID NO: 782054 - DNA, 22 bp, Artificial Sequence
  chemically synthesized
agcccaaaggggaaggaagtat

SEQ ID NO: 782055 - DNA, 22 bp, Artificial Sequence
  chemically synthesized
cagcccaaaggggaaggaagta

SEQ ID NO: 782056 - DNA, 22 bp, Artificial Sequence
  chemically synthesized
agtttcagcccaaaggggaagg

SEQ ID NO: 782057 - DNA, 22 bp, Artificial Sequence
  chemically synthesized
cagtttcagcccaaaggggaag

SEQ ID NO: 782058 - DNA, 22 bp, Artificial Sequence
  chemically synthesized
tcagtttcagcccaaaggggaa

SEQ ID NO: 782059 - DNA, 22 bp, Artificial Sequence
  chemically synthesized
ttcagtttcagcccaaagggga

SEQ ID NO: 782060 - DNA, 22 bp, Artificial Sequence
  chemically synthesized
tttcagtttcagcccaaagggg

SEQ ID NO: 782061 - DNA, 22 bp, Artificial Sequence
  chemically synthesized
ctttttcagtttcagcccaaag

SEQ ID NO: 782062 - DNA, 22 bp, Artificial Sequence
  chemically synthesized
gctttttcagtttcagcccaaa

SEQ ID NO: 782063 - DNA, 22 bp, Artificial Sequence
  chemically synthesized
tgctttttcagtttcagcccaa

SEQ ID NO: 782064 - DNA, 22 bp, Artificial Sequence
  chemically synthesized
ttgctttttcagtttcagccca

SEQ ID NO: 782065 - DNA, 22 bp, Artificial Sequence
  chemically synthesized
tttgctttttcagtttcagccc

SEQ ID NO: 782066 - DNA, 22 bp, Artificial Sequence
  chemically synthesized
ccttcccctttgggctgaaact

SEQ ID NO: 782067 - DNA, 22 bp, Artificial Sequence
  chemically synthesized
cttcccctttgggctgaaactg

SEQ ID NO: 782068 - DNA, 22 bp, Artificial Sequence
  chemically synthesized
cccctttgggctgaaactgaaa

SEQ ID NO: 782069 - DNA, 22 bp, Artificial Sequence
  chemically synthesized
ccctttgggctgaaactgaaaa

SEQ ID NO: 782070 - DNA, 22 bp, Artificial Sequence
  chemically synthesized
tgggctgaaactgaaaaagcaa

SEQ ID NO: 782071 - DNA, 22 bp, Artificial Sequence
  chemically synthesized
ccaccccgttttttgctttttc

SEQ ID NO: 782072 - DNA, 22 bp, Artificial Sequence
  chemically synthesized
gggctgaaactgaaaaagcaaa

SEQ ID NO: 782073 - DNA, 22 bp, Artificial Sequence
  chemically synthesized
ggctgaaactgaaaaagcaaaa

SEQ ID NO: 782074 - DNA, 22 bp, Artificial Sequence
  chemically synthesized
ccctcccaccccgttttttgct

SEQ ID NO: 782075 - DNA, 22 bp, Artificial Sequence
  chemically synthesized
aaactgaaaaagcaaaaaacgg

SEQ ID NO: 782076 - DNA, 22 bp, Artificial Sequence
  chemically synthesized
taccctcccaccccgttttttg

SEQ ID NO: 782077 - DNA, 22 bp, Artificial Sequence
  chemically synthesized
ctaccctcccaccccgtttttt

SEQ ID NO: 782078 - DNA, 22 bp, Artificial Sequence
  chemically synthesized
tctaccctcccaccccgttttt

SEQ ID NO: 782079 - DNA, 22 bp, Artificial Sequence
  chemically synthesized
tttctaccctcccaccccgttt

SEQ ID NO: 782080 - DNA, 22 bp, Artificial Sequence
  chemically synthesized
aaaaagcaaaaaacggggtggg

SEQ ID NO: 782081 - DNA, 22 bp, Artificial Sequence
  chemically synthesized
ttctttctaccctcccaccccg

SEQ ID NO: 782082 - DNA, 22 bp, Artificial Sequence
  chemically synthesized
ctgttctttctaccctcccacc

SEQ ID NO: 782083 - DNA, 22 bp, Artificial Sequence
  chemically synthesized
cctgttctttctaccctcccac

SEQ ID NO: 782084 - DNA, 22 bp, Artificial Sequence
  chemically synthesized
ccttcctgttctttctaccctc

SEQ ID NO: 782085 - DNA, 22 bp, Artificial Sequence
  chemically synthesized
caatgaacaggatacctccctt

SEQ ID NO: 782086 - DNA, 22 bp, Artificial Sequence
  chemically synthesized
tccaatgaacaggatacctccc

SEQ ID NO: 782087 - DNA, 22 bp, Artificial Sequence
  chemically synthesized
ggacctctccaatgaacaggat

SEQ ID NO: 782088 - DNA, 22 bp, Artificial Sequence
  chemically synthesized
aggacctctccaatgaacagga

SEQ ID NO: 782089 - DNA, 22 bp, Artificial Sequence
  chemically synthesized
cttaggacctctccaatgaaca

SEQ ID NO: 782090 - DNA, 22 bp, Artificial Sequence
  chemically synthesized
ccttaggacctctccaatgaac

SEQ ID NO: 782091 - DNA, 22 bp, Artificial Sequence
  chemically synthesized
cagccaggtttccttaggacct

SEQ ID NO: 782092 - DNA, 22 bp, Artificial Sequence
  chemically synthesized
ttcattggagaggtcctaagga

SEQ ID NO: 782093 - DNA, 22 bp, Artificial Sequence
  chemically synthesized
actccagccaggtttccttagg

SEQ ID NO: 782094 - DNA, 22 bp, Artificial Sequence
  chemically synthesized
attggagaggtcctaaggaaac

SEQ ID NO: 782095 - DNA, 22 bp, Artificial Sequence
  chemically synthesized
cactccagccaggtttccttag

SEQ ID NO: 782096 - DNA, 22 bp, Artificial Sequence
  chemically synthesized
tcactccagccaggtttcctta

SEQ ID NO: 782097 - DNA, 22 bp, Artificial Sequence
  chemically synthesized
gagaggtcctaaggaaacctgg

SEQ ID NO: 782098 - DNA, 22 bp, Artificial Sequence
  chemically synthesized
aggaaacctggctggagtgaaa

SEQ ID NO: 782099 - DNA, 22 bp, Artificial Sequence
  chemically synthesized
aggcacagcagattttcactcc

SEQ ID NO: 782100 - DNA, 22 bp, Artificial Sequence
  chemically synthesized
aaggcacagcagattttcactc

SEQ ID NO: 782101 - DNA, 22 bp, Artificial Sequence
  chemically synthesized
gctggagtgaaaatctgctgtg

SEQ ID NO: 782102 - DNA, 22 bp, Artificial Sequence
  chemically synthesized
gagtgaaaatctgctgtgcctt

SEQ ID NO: 782103 - DNA, 22 bp, Artificial Sequence
  chemically synthesized
gggatggaagggtggtgcttaa

SEQ ID NO: 782104 - DNA, 22 bp, Artificial Sequence
  chemically synthesized
ctgtgccttaagcaccaccctt

SEQ ID NO: 782105 - DNA, 22 bp, Artificial Sequence
  chemically synthesized
gcctggggatggaagggtggtg

SEQ ID NO: 782106 - DNA, 22 bp, Artificial Sequence
  chemically synthesized
tgccttaagcaccacccttcca

SEQ ID NO: 782107 - DNA, 22 bp, Artificial Sequence
  chemically synthesized
aagcaccacccttccatcccca

SEQ ID NO: 782108 - DNA, 22 bp, Artificial Sequence
  chemically synthesized
agcaccacccttccatccccag

SEQ ID NO: 782109 - DNA, 22 bp, Artificial Sequence
  chemically synthesized
ccatccccaggccaatacacat

SEQ ID NO: 782110 - DNA, 22 bp, Artificial Sequence
  chemically synthesized
catccccaggccaatacacatc

SEQ ID NO: 782111 - DNA, 22 bp, Artificial Sequence
  chemically synthesized
aaggaggacaacagagtaatat

SEQ ID NO: 782112 - DNA, 22 bp, Artificial Sequence
  chemically synthesized
ttgaaggaggacaacagagtaa

SEQ ID NO: 782113 - DNA, 22 bp, Artificial Sequence
  chemically synthesized
gcactgttgaaggaggacaaca

SEQ ID NO: 782114 - DNA, 22 bp, Artificial Sequence
  chemically synthesized
taactagcactgttgaaggagg

SEQ ID NO: 782115 - DNA, 22 bp, Artificial Sequence
  chemically synthesized
ctctgttgtcctccttcaacag

SEQ ID NO: 782116 - DNA, 22 bp, Artificial Sequence
  chemically synthesized
tgttgtcctccttcaacagtgc

SEQ ID NO: 782117 - DNA, 22 bp, Artificial Sequence
  chemically synthesized
agtctgtaactagcactgttga

SEQ ID NO: 782118 - DNA, 22 bp, Artificial Sequence
  chemically synthesized
gagtctgtaactagcactgttg

SEQ ID NO: 782119 - DNA, 22 bp, Artificial Sequence
  chemically synthesized
ttgtcctccttcaacagtgcta

SEQ ID NO: 782120 - DNA, 22 bp, Artificial Sequence
  chemically synthesized
tcctccttcaacagtgctagtt

SEQ ID NO: 782121 - DNA, 22 bp, Artificial Sequence
  chemically synthesized
cttcaacagtgctagttacaga

SEQ ID NO: 782122 - DNA, 22 bp, Artificial Sequence
  chemically synthesized
atggtaaacttgagtctgtaac

SEQ ID NO: 782123 - DNA, 22 bp, Artificial Sequence
  chemically synthesized
caacagtgctagttacagactc

SEQ ID NO: 782124 - DNA, 22 bp, Artificial Sequence
  chemically synthesized
aacagtgctagttacagactca

SEQ ID NO: 782125 - DNA, 22 bp, Artificial Sequence
  chemically synthesized
tatactaatggtaaacttgagt

SEQ ID NO: 782126 - DNA, 22 bp, Artificial Sequence
  chemically synthesized
ttatatactaatggtaaacttg

SEQ ID NO: 782127 - DNA, 22 bp, Artificial Sequence
  chemically synthesized
gttacagactcaagtttaccat

SEQ ID NO: 782128 - DNA, 22 bp, Artificial Sequence
  chemically synthesized
cagactcaagtttaccattagt

SEQ ID NO: 782129 - DNA, 22 bp, Artificial Sequence
  chemically synthesized
tagctattatatactaatggta

SEQ ID NO: 782130 - DNA, 22 bp, Artificial Sequence
  chemically synthesized
aagtttaccattagtatataat

SEQ ID NO: 782131 - DNA, 22 bp, Artificial Sequence
  chemically synthesized
accattagtatataatagctat

SEQ ID NO: 782132 - DNA, 22 bp, Artificial Sequence
  chemically synthesized
aggacaagtgttatagctatta

SEQ ID NO: 782133 - DNA, 22 bp, Artificial Sequence
  chemically synthesized
ccattagtatataatagctata

SEQ ID NO: 782134 - DNA, 22 bp, Artificial Sequence
  chemically synthesized
aaggacaagtgttatagctatt

SEQ ID NO: 782135 - DNA, 22 bp, Artificial Sequence
  chemically synthesized
taaggacaagtgttatagctat

SEQ ID NO: 782136 - DNA, 22 bp, Artificial Sequence
  chemically synthesized
gtatataatagctataacactt

SEQ ID NO: 782137 - DNA, 22 bp, Artificial Sequence
  chemically synthesized
acccgcattttaaggacaagtg

SEQ ID NO: 782138 - DNA, 22 bp, Artificial Sequence
  chemically synthesized
agttaacccgcattttaaggac

SEQ ID NO: 782139 - DNA, 22 bp, Artificial Sequence
  chemically synthesized
taacacttgtccttaaaatgcg

SEQ ID NO: 782140 - DNA, 22 bp, Artificial Sequence
  chemically synthesized
gtccttaaaatgcgggttaact

SEQ ID NO: 782141 - DNA, 22 bp, Artificial Sequence
  chemically synthesized
tccttaaaatgcgggttaactc

SEQ ID NO: 782142 - DNA, 22 bp, Artificial Sequence
  chemically synthesized
atgcccagcagcattgagttaa

SEQ ID NO: 782143 - DNA, 22 bp, Artificial Sequence
  chemically synthesized
aaaatgcgggttaactcaatgc

SEQ ID NO: 782144 - DNA, 22 bp, Artificial Sequence
  chemically synthesized
aaatgcgggttaactcaatgct

SEQ ID NO: 782145 - DNA, 22 bp, Artificial Sequence
  chemically synthesized
gattgatgcccagcagcattga

SEQ ID NO: 782146 - DNA, 22 bp, Artificial Sequence
  chemically synthesized
agattgatgcccagcagcattg

SEQ ID NO: 782147 - DNA, 22 bp, Artificial Sequence
  chemically synthesized
atatatttagattgatgcccag

SEQ ID NO: 782148 - DNA, 22 bp, Artificial Sequence
  chemically synthesized
actcaatgctgctgggcatcaa

SEQ ID NO: 782149 - DNA, 22 bp, Artificial Sequence
  chemically synthesized
aatatatttagattgatgccca

SEQ ID NO: 782150 - DNA, 22 bp, Artificial Sequence
  chemically synthesized
aatgctgctgggcatcaatcta

SEQ ID NO: 782151 - DNA, 22 bp, Artificial Sequence
  chemically synthesized
ccttaatatatttagattgatg

SEQ ID NO: 782152 - DNA, 22 bp, Artificial Sequence
  chemically synthesized
ctgggcatcaatctaaatatat

SEQ ID NO: 782153 - DNA, 22 bp, Artificial Sequence
  chemically synthesized
ggcatcaatctaaatatattaa

SEQ ID NO: 782154 - DNA, 22 bp, Artificial Sequence
  chemically synthesized
tagtacagtagtgcctacctta

SEQ ID NO: 782155 - DNA, 22 bp, Artificial Sequence
  chemically synthesized
aatatattaaggtaggcactac

SEQ ID NO: 782156 - DNA, 22 bp, Artificial Sequence
  chemically synthesized
gagttgtagtacagtagtgcct

SEQ ID NO: 782157 - DNA, 22 bp, Artificial Sequence
  chemically synthesized
ttagagttgtagtacagtagtg

SEQ ID NO: 782158 - DNA, 22 bp, Artificial Sequence
  chemically synthesized
ttattagagttgtagtacagta

SEQ ID NO: 782159 - DNA, 22 bp, Artificial Sequence
  chemically synthesized
aggtaggcactactgtactaca

SEQ ID NO: 782160 - DNA, 22 bp, Artificial Sequence
  chemically synthesized
ttattattagagttgtagtaca

SEQ ID NO: 782161 - DNA, 22 bp, Artificial Sequence
  chemically synthesized
attattattattagagttgtag

SEQ ID NO: 782162 - DNA, 22 bp, Artificial Sequence
  chemically synthesized
ttgattattattattagagttg

SEQ ID NO: 782163 - DNA, 22 bp, Artificial Sequence
  chemically synthesized
ctgtactacaactctaataata

SEQ ID NO: 782164 - DNA, 22 bp, Artificial Sequence
  chemically synthesized
tactacaactctaataataata

SEQ ID NO: 782165 - DNA, 22 bp, Artificial Sequence
  chemically synthesized
caactctaataataataatcaa

SEQ ID NO: 782166 - DNA, 22 bp, Artificial Sequence
  chemically synthesized
aataaatgatagttattgatta

SEQ ID NO: 782167 - DNA, 22 bp, Artificial Sequence
  chemically synthesized
taataataataatcaataacta

SEQ ID NO: 782168 - DNA, 22 bp, Artificial Sequence
  chemically synthesized
ataataataatcaataactatc

SEQ ID NO: 782169 - DNA, 22 bp, Artificial Sequence
  chemically synthesized
ccatgtggccattcaataaatg

SEQ ID NO: 782170 - DNA, 22 bp, Artificial Sequence
  chemically synthesized
tcatttattgaatggccacatg

SEQ ID NO: 782171 - DNA, 22 bp, Artificial Sequence
  chemically synthesized
ataagcatagtacctgccatgt

SEQ ID NO: 782172 - DNA, 22 bp, Artificial Sequence
  chemically synthesized
attgaatggccacatggcaggt

SEQ ID NO: 782173 - DNA, 22 bp, Artificial Sequence
  chemically synthesized
ttgaatggccacatggcaggta

SEQ ID NO: 782174 - DNA, 22 bp, Artificial Sequence
  chemically synthesized
aatggccacatggcaggtacta

SEQ ID NO: 782175 - DNA, 22 bp, Artificial Sequence
  chemically synthesized
agcagacagggaagccctgata

SEQ ID NO: 782176 - DNA, 22 bp, Artificial Sequence
  chemically synthesized
tgcttatcagggcttccctgtc

SEQ ID NO: 782177 - DNA, 22 bp, Artificial Sequence
  chemically synthesized
atcagggcttccctgtctgctc

SEQ ID NO: 782178 - DNA, 22 bp, Artificial Sequence
  chemically synthesized
tcagggcttccctgtctgctca

SEQ ID NO: 782179 - DNA, 22 bp, Artificial Sequence
  chemically synthesized
caaagaaacatgggctgagcag

SEQ ID NO: 782180 - DNA, 22 bp, Artificial Sequence
  chemically synthesized
acaaagaaacatgggctgagca

SEQ ID NO: 782181 - DNA, 22 bp, Artificial Sequence
  chemically synthesized
tacaaagaaacatgggctgagc

SEQ ID NO: 782182 - DNA, 22 bp, Artificial Sequence
  chemically synthesized
ccctgtctgctcagcccatgtt

SEQ ID NO: 782183 - DNA, 22 bp, Artificial Sequence
  chemically synthesized
cctgtctgctcagcccatgttt

SEQ ID NO: 782184 - DNA, 22 bp, Artificial Sequence
  chemically synthesized
tgttttacaaagaaacatgggc

SEQ ID NO: 782185 - DNA, 22 bp, Artificial Sequence
  chemically synthesized
tctgctcagcccatgtttcttt

SEQ ID NO: 782186 - DNA, 22 bp, Artificial Sequence
  chemically synthesized
ctcagcccatgtttctttgtaa

SEQ ID NO: 782187 - DNA, 22 bp, Artificial Sequence
  chemically synthesized
atatgttgtgttttacaaagaa

SEQ ID NO: 782188 - DNA, 22 bp, Artificial Sequence
  chemically synthesized
aatatgttgtgttttacaaaga

SEQ ID NO: 782189 - DNA, 22 bp, Artificial Sequence
  chemically synthesized
taatatgttgtgttttacaaag

SEQ ID NO: 782190 - DNA, 22 bp, Artificial Sequence
  chemically synthesized
agcccatgtttctttgtaaaac

SEQ ID NO: 782191 - DNA, 22 bp, Artificial Sequence
  chemically synthesized
ttttaatatgttgtgttttaca

SEQ ID NO: 782192 - DNA, 22 bp, Artificial Sequence
  chemically synthesized
ttgttttaatatgttgtgtttt

SEQ ID NO: 782193 - DNA, 22 bp, Artificial Sequence
  chemically synthesized
ctttgtaaaacacaacatatta

SEQ ID NO: 782194 - DNA, 22 bp, Artificial Sequence
  chemically synthesized
tttgtaaaacacaacatattaa

SEQ ID NO: 782195 - DNA, 22 bp, Artificial Sequence
  chemically synthesized
tgtaaaacacaacatattaaaa

SEQ ID NO: 782196 - DNA, 22 bp, Artificial Sequence
  chemically synthesized
caaatactgttgttttaatatg

SEQ ID NO: 782197 - DNA, 22 bp, Artificial Sequence
  chemically synthesized
gtaaaacacaacatattaaaac

SEQ ID NO: 782198 - DNA, 22 bp, Artificial Sequence
  chemically synthesized
taaaacacaacatattaaaaca

SEQ ID NO: 782199 - DNA, 22 bp, Artificial Sequence
  chemically synthesized
tctccaaatactgttgttttaa

SEQ ID NO: 782200 - DNA, 22 bp, Artificial Sequence
  chemically synthesized
gtctccaaatactgttgtttta

SEQ ID NO: 782201 - DNA, 22 bp, Artificial Sequence
  chemically synthesized
tgtctccaaatactgttgtttt

SEQ ID NO: 782202 - DNA, 22 bp, Artificial Sequence
  chemically synthesized
ttgtctccaaatactgttgttt

SEQ ID NO: 782203 - DNA, 22 bp, Artificial Sequence
  chemically synthesized
aagatatttttgtctccaaata

SEQ ID NO: 782204 - DNA, 22 bp, Artificial Sequence
  chemically synthesized
aaacaacagtatttggagacaa

SEQ ID NO: 782205 - DNA, 22 bp, Artificial Sequence
  chemically synthesized
gattgaagatatttttgtctcc

SEQ ID NO: 782206 - DNA, 22 bp, Artificial Sequence
  chemically synthesized
tgaggtggttggattgaagata

SEQ ID NO: 782207 - DNA, 22 bp, Artificial Sequence
  chemically synthesized
ggagacaaaaatatcttcaatc

SEQ ID NO: 782208 - DNA, 22 bp, Artificial Sequence
  chemically synthesized
gagacaaaaatatcttcaatcc

SEQ ID NO: 782209 - DNA, 22 bp, Artificial Sequence
  chemically synthesized
ttatgaggtggttggattgaag

SEQ ID NO: 782210 - DNA, 22 bp, Artificial Sequence
  chemically synthesized
attatgaggtggttggattgaa

SEQ ID NO: 782211 - DNA, 22 bp, Artificial Sequence
  chemically synthesized
tattatgaggtggttggattga

SEQ ID NO: 782212 - DNA, 22 bp, Artificial Sequence
  chemically synthesized
gttttattatgaggtggttgga

SEQ ID NO: 782213 - DNA, 22 bp, Artificial Sequence
  chemically synthesized
caatccaaccacctcataataa

SEQ ID NO: 782214 - DNA, 22 bp, Artificial Sequence
  chemically synthesized
aatatgttggttttattatgag

SEQ ID NO: 782215 - DNA, 22 bp, Artificial Sequence
  chemically synthesized
aatccaaccacctcataataaa

SEQ ID NO: 782216 - DNA, 22 bp, Artificial Sequence
  chemically synthesized
ataataaaaccaacatattcag

SEQ ID NO: 782217 - DNA, 22 bp, Artificial Sequence
  chemically synthesized
agttttctatattatcttatcg

SEQ ID NO: 782218 - DNA, 22 bp, Artificial Sequence
  chemically synthesized
tctatattatcttatcgtcctt

SEQ ID NO: 782219 - DNA, 22 bp, Artificial Sequence
  chemically synthesized
ctatattatcttatcgtccttg

SEQ ID NO: 782220 - DNA, 22 bp, Artificial Sequence
  chemically synthesized
tatattatcttatcgtccttgt

SEQ ID NO: 782221 - DNA, 22 bp, Artificial Sequence
  chemically synthesized
aatatgtatatggacaaggacg

SEQ ID NO: 782222 - DNA, 22 bp, Artificial Sequence
  chemically synthesized
tattatcttatcgtccttgtcc

SEQ ID NO: 782223 - DNA, 22 bp, Artificial Sequence
  chemically synthesized
tcttatcgtccttgtccatata

SEQ ID NO: 782224 - DNA, 22 bp, Artificial Sequence
  chemically synthesized
atcgtccttgtccatatacata

SEQ ID NO: 782225 - DNA, 22 bp, Artificial Sequence
  chemically synthesized
tcgtccttgtccatatacatat

SEQ ID NO: 782226 - DNA, 22 bp, Artificial Sequence
  chemically synthesized
caaatatataaccattgaatat

SEQ ID NO: 782227 - DNA, 22 bp, Artificial Sequence
  chemically synthesized
gtccatatacatattcaatggt

SEQ ID NO: 782228 - DNA, 22 bp, Artificial Sequence
  chemically synthesized
tccatatacatattcaatggtt

SEQ ID NO: 782229 - DNA, 22 bp, Artificial Sequence
  chemically synthesized
ctgcaaatatataaccattgaa

SEQ ID NO: 782230 - DNA, 22 bp, Artificial Sequence
  chemically synthesized
aatggttatatatttgcagtaa

SEQ ID NO: 782231 - DNA, 22 bp, Artificial Sequence
  chemically synthesized
tatatttgcagtaatatttata

SEQ ID NO: 782232 - DNA, 22 bp, Artificial Sequence
  chemically synthesized
gcagtaatatttatattccacc

SEQ ID NO: 782233 - DNA, 22 bp, Artificial Sequence
  chemically synthesized
cagtaatatttatattccacct

SEQ ID NO: 782234 - DNA, 22 bp, Artificial Sequence
  chemically synthesized
acaaaaagtgaaaaggtggaat

SEQ ID NO: 782235 - DNA, 22 bp, Artificial Sequence
  chemically synthesized
cacaaaaagtgaaaaggtggaa

SEQ ID NO: 782236 - DNA, 22 bp, Artificial Sequence
  chemically synthesized
atattccaccttttcacttttt

SEQ ID NO: 782237 - DNA, 22 bp, Artificial Sequence
  chemically synthesized
tattccaccttttcactttttg

SEQ ID NO: 782238 - DNA, 22 bp, Artificial Sequence
  chemically synthesized
caccttttcactttttgtgaaa

SEQ ID NO: 782239 - DNA, 22 bp, Artificial Sequence
  chemically synthesized
ttcactttttgtgaaacttgat

SEQ ID NO: 782240 - DNA, 22 bp, Artificial Sequence
  chemically synthesized
tcactttttgtgaaacttgata

SEQ ID NO: 782241 - DNA, 22 bp, Artificial Sequence
  chemically synthesized
cactttttgtgaaacttgatac

SEQ ID NO: 782242 - DNA, 22 bp, Artificial Sequence
  chemically synthesized
actttttgtgaaacttgataca

SEQ ID NO: 782243 - DNA, 22 bp, Artificial Sequence
  chemically synthesized
tttgtgaaacttgatacattat

SEQ ID NO: 782244 - DNA, 22 bp, Artificial Sequence
  chemically synthesized
ttgtgaaacttgatacattatt

SEQ ID NO: 782245 - DNA, 22 bp, Artificial Sequence
  chemically synthesized
tgtgaaacttgatacattattt

SEQ ID NO: 782246 - DNA, 22 bp, Artificial Sequence
  chemically synthesized
gtgaaacttgatacattatttg

SEQ ID NO: 782247 - DNA, 22 bp, Artificial Sequence
  chemically synthesized
tgaaacttgatacattatttgt

SEQ ID NO: 782248 - DNA, 22 bp, Artificial Sequence
  chemically synthesized
aaaggagaatgaaagaggaaca

SEQ ID NO: 782249 - DNA, 22 bp, Artificial Sequence
  chemically synthesized
gatacattatttgttcctcttt

SEQ ID NO: 782250 - DNA, 22 bp, Artificial Sequence
  chemically synthesized
caaaggagaatgaaagaggaac

SEQ ID NO: 782251 - DNA, 22 bp, Artificial Sequence
  chemically synthesized
atacattatttgttcctctttc

SEQ ID NO: 782252 - DNA, 22 bp, Artificial Sequence
  chemically synthesized
tcaaaggagaatgaaagaggaa

SEQ ID NO: 782253 - DNA, 22 bp, Artificial Sequence
  chemically synthesized
gattttcaaaggagaatgaaag

SEQ ID NO: 782254 - DNA, 22 bp, Artificial Sequence
  chemically synthesized
ggattttcaaaggagaatgaaa

SEQ ID NO: 782255 - DNA, 22 bp, Artificial Sequence
  chemically synthesized
tttgttcctctttcattctcct

SEQ ID NO: 782256 - DNA, 22 bp, Artificial Sequence
  chemically synthesized
ccttggattttcaaaggagaat

SEQ ID NO: 782257 - DNA, 22 bp, Artificial Sequence
  chemically synthesized
gttcctctttcattctcctttg

SEQ ID NO: 782258 - DNA, 22 bp, Artificial Sequence
  chemically synthesized
ttcctctttcattctcctttga

SEQ ID NO: 782259 - DNA, 22 bp, Artificial Sequence
  chemically synthesized
ttaccttggattttcaaaggag

SEQ ID NO: 782260 - DNA, 22 bp, Artificial Sequence
  chemically synthesized
gttaccttggattttcaaagga

SEQ ID NO: 782261 - DNA, 22 bp, Artificial Sequence
  chemically synthesized
ctctttcattctcctttgaaaa

SEQ ID NO: 782262 - DNA, 22 bp, Artificial Sequence
  chemically synthesized
tttcattctcctttgaaaatcc

SEQ ID NO: 782263 - DNA, 22 bp, Artificial Sequence
  chemically synthesized
tcattctcctttgaaaatccaa

SEQ ID NO: 782264 - DNA, 22 bp, Artificial Sequence
  chemically synthesized
cattctcctttgaaaatccaag

SEQ ID NO: 782265 - DNA, 22 bp, Artificial Sequence
  chemically synthesized
attctcctttgaaaatccaagg

SEQ ID NO: 782266 - DNA, 22 bp, Artificial Sequence
  chemically synthesized
tcagtatttgttaccttggatt

SEQ ID NO: 782267 - DNA, 22 bp, Artificial Sequence
  chemically synthesized
tcctttgaaaatccaaggtaac

SEQ ID NO: 782268 - DNA, 22 bp, Artificial Sequence
  chemically synthesized
ctttgaaaatccaaggtaacaa

SEQ ID NO: 782269 - DNA, 22 bp, Artificial Sequence
  chemically synthesized
ggttatcagtatttgttacctt

SEQ ID NO: 782270 - DNA, 22 bp, Artificial Sequence
  chemically synthesized
tgaaaatccaaggtaacaaata

SEQ ID NO: 782271 - DNA, 22 bp, Artificial Sequence
  chemically synthesized
gaaaatccaaggtaacaaatac

SEQ ID NO: 782272 - DNA, 22 bp, Artificial Sequence
  chemically synthesized
aaaatccaaggtaacaaatact

SEQ ID NO: 782273 - DNA, 22 bp, Artificial Sequence
  chemically synthesized
ataacctagtatatatctctcc

SEQ ID NO: 782274 - DNA, 22 bp, Artificial Sequence
  chemically synthesized
gtatatatctctccattcctcc

SEQ ID NO: 782275 - DNA, 22 bp, Artificial Sequence
  chemically synthesized
cataaccatgaaggaggaatgg

SEQ ID NO: 782276 - DNA, 22 bp, Artificial Sequence
  chemically synthesized
tgggattacataaccatgaagg

SEQ ID NO: 782277 - DNA, 22 bp, Artificial Sequence
  chemically synthesized
atgggattacataaccatgaag

SEQ ID NO: 782278 - DNA, 22 bp, Artificial Sequence
  chemically synthesized
tccattcctccttcatggttat

SEQ ID NO: 782279 - DNA, 22 bp, Artificial Sequence
  chemically synthesized
cattcctccttcatggttatgt

SEQ ID NO: 782280 - DNA, 22 bp, Artificial Sequence
  chemically synthesized
atcttatgggattacataacca

SEQ ID NO: 782281 - DNA, 22 bp, Artificial Sequence
  chemically synthesized
ctccttcatggttatgtaatcc

SEQ ID NO: 782282 - DNA, 22 bp, Artificial Sequence
  chemically synthesized
cttcatggttatgtaatcccat

SEQ ID NO: 782283 - DNA, 22 bp, Artificial Sequence
  chemically synthesized
catggttatgtaatcccataag

SEQ ID NO: 782284 - DNA, 22 bp, Artificial Sequence
  chemically synthesized
atggttatgtaatcccataaga

SEQ ID NO: 782285 - DNA, 22 bp, Artificial Sequence
  chemically synthesized
tgtaatcccataagattaattt

SEQ ID NO: 782286 - DNA, 22 bp, Artificial Sequence
  chemically synthesized
aaataaaaaagataaaattaat

SEQ ID NO: 782287 - DNA, 22 bp, Artificial Sequence
  chemically synthesized
aaaataaaaaagataaaattaa

SEQ ID NO: 782288 - DNA, 22 bp, Artificial Sequence
  chemically synthesized
taaaataaaaaagataaaatta

SEQ ID NO: 782289 - DNA, 22 bp, Artificial Sequence
  chemically synthesized
ttaaaataaaaaagataaaatt

SEQ ID NO: 782290 - DNA, 22 bp, Artificial Sequence
  chemically synthesized
catttttaaaataaaaaagata

SEQ ID NO: 782291 - DNA, 22 bp, Artificial Sequence
  chemically synthesized
attttatcttttttattttaaa

SEQ ID NO: 782292 - DNA, 22 bp, Artificial Sequence
  chemically synthesized
acatattccatttttaaaataa

SEQ ID NO: 782293 - DNA, 22 bp, Artificial Sequence
  chemically synthesized
tatcttttttattttaaaaatg

SEQ ID NO: 782294 - DNA, 22 bp, Artificial Sequence
  chemically synthesized
atcttttttattttaaaaatgg

SEQ ID NO: 782295 - DNA, 22 bp, Artificial Sequence
  chemically synthesized
aattaacatattccatttttaa

SEQ ID NO: 782296 - DNA, 22 bp, Artificial Sequence
  chemically synthesized
tcttttttattttaaaaatgga

SEQ ID NO: 782297 - DNA, 22 bp, Artificial Sequence
  chemically synthesized
caattaacatattccattttta

SEQ ID NO: 782298 - DNA, 22 bp, Artificial Sequence
  chemically synthesized
ttttattttaaaaatggaatat

SEQ ID NO: 782299 - DNA, 22 bp, Artificial Sequence
  chemically synthesized
tttattttaaaaatggaatatg

SEQ ID NO: 782300 - DNA, 22 bp, Artificial Sequence
  chemically synthesized
ttattttaaaaatggaatatgt

SEQ ID NO: 782301 - DNA, 22 bp, Artificial Sequence
  chemically synthesized
tattttaaaaatggaatatgtt

SEQ ID NO: 782302 - DNA, 22 bp, Artificial Sequence
  chemically synthesized
attttaaaaatggaatatgtta

SEQ ID NO: 782303 - DNA, 22 bp, Artificial Sequence
  chemically synthesized
ttttaaaaatggaatatgttaa

SEQ ID NO: 782304 - DNA, 22 bp, Artificial Sequence
  chemically synthesized
taaaaatggaatatgttaattg

SEQ ID NO: 782305 - DNA, 22 bp, Artificial Sequence
  chemically synthesized
aaaaatggaatatgttaattga

SEQ ID NO: 782306 - DNA, 22 bp, Artificial Sequence
  chemically synthesized
aaaatggaatatgttaattgaa

SEQ ID NO: 782307 - DNA, 22 bp, Artificial Sequence
  chemically synthesized
aaaaatcaaaacaagtttcaat

SEQ ID NO: 782308 - DNA, 22 bp, Artificial Sequence
  chemically synthesized
caaaaatcaaaacaagtttcaa

SEQ ID NO: 782309 - DNA, 22 bp, Artificial Sequence
  chemically synthesized
tcaaaaatcaaaacaagtttca

SEQ ID NO: 782310 - DNA, 22 bp, Artificial Sequence
  chemically synthesized
attgaaacttgttttgattttt

SEQ ID NO: 782311 - DNA, 22 bp, Artificial Sequence
  chemically synthesized
aaacttgttttgatttttgaaa

SEQ ID NO: 782312 - DNA, 22 bp, Artificial Sequence
  chemically synthesized
gttttgatttttgaaagatatc

SEQ ID NO: 782313 - DNA, 22 bp, Artificial Sequence
  chemically synthesized
ttttgatttttgaaagatatca

SEQ ID NO: 782314 - DNA, 22 bp, Artificial Sequence
  chemically synthesized
aaagaatggtgatgatatcttt

SEQ ID NO: 782315 - DNA, 22 bp, Artificial Sequence
  chemically synthesized
tgatttttgaaagatatcatca

SEQ ID NO: 782316 - DNA, 22 bp, Artificial Sequence
  chemically synthesized
gatttttgaaagatatcatcac

SEQ ID NO: 782317 - DNA, 22 bp, Artificial Sequence
  chemically synthesized
atttttgaaagatatcatcacc

SEQ ID NO: 782318 - DNA, 22 bp, Artificial Sequence
  chemically synthesized
tcctgaaagaatggtgatgata

SEQ ID NO: 782319 - DNA, 22 bp, Artificial Sequence
  chemically synthesized
ctgtcctgaaagaatggtgatg

SEQ ID NO: 782320 - DNA, 22 bp, Artificial Sequence
  chemically synthesized
ttgaaagatatcatcaccattc

SEQ ID NO: 782321 - DNA, 22 bp, Artificial Sequence
  chemically synthesized
tgaaagatatcatcaccattct

SEQ ID NO: 782322 - DNA, 22 bp, Artificial Sequence
  chemically synthesized
gaaagatatcatcaccattctt

SEQ ID NO: 782323 - DNA, 22 bp, Artificial Sequence
  chemically synthesized
aaagatatcatcaccattcttt

SEQ ID NO: 782324 - DNA, 22 bp, Artificial Sequence
  chemically synthesized
tgtctactgtcctgaaagaatg

SEQ ID NO: 782325 - DNA, 22 bp, Artificial Sequence
  chemically synthesized
gagctgtgtctactgtcctgaa

SEQ ID NO: 782326 - DNA, 22 bp, Artificial Sequence
  chemically synthesized
gttagagctgtgtctactgtcc

SEQ ID NO: 782327 - DNA, 22 bp, Artificial Sequence
  chemically synthesized
gtctagttagagctgtgtctac

SEQ ID NO: 782328 - DNA, 22 bp, Artificial Sequence
  chemically synthesized
agtctagttagagctgtgtcta

SEQ ID NO: 782329 - DNA, 22 bp, Artificial Sequence
  chemically synthesized
tttcaggacagtagacacagct

SEQ ID NO: 782330 - DNA, 22 bp, Artificial Sequence
  chemically synthesized
tcaggacagtagacacagctct

SEQ ID NO: 782331 - DNA, 22 bp, Artificial Sequence
  chemically synthesized
tttagtctagttagagctgtgt

SEQ ID NO: 782332 - DNA, 22 bp, Artificial Sequence
  chemically synthesized
caggacagtagacacagctcta

SEQ ID NO: 782333 - DNA, 22 bp, Artificial Sequence
  chemically synthesized
aggacagtagacacagctctaa

SEQ ID NO: 782334 - DNA, 22 bp, Artificial Sequence
  chemically synthesized
ttatttagtctagttagagctg

SEQ ID NO: 782335 - DNA, 22 bp, Artificial Sequence
  chemically synthesized
taactagactaaataataattc

SEQ ID NO: 782336 - DNA, 22 bp, Artificial Sequence
  chemically synthesized
ggcatcccagaatgaattatta

SEQ ID NO: 782337 - DNA, 22 bp, Artificial Sequence
  chemically synthesized
actagactaaataataattcat

SEQ ID NO: 782338 - DNA, 22 bp, Artificial Sequence
  chemically synthesized
gggcatcccagaatgaattatt

SEQ ID NO: 782339 - DNA, 22 bp, Artificial Sequence
  chemically synthesized
tttgggcatcccagaatgaatt

SEQ ID NO: 782340 - DNA, 22 bp, Artificial Sequence
  chemically synthesized
gactaaataataattcattctg

SEQ ID NO: 782341 - DNA, 22 bp, Artificial Sequence
  chemically synthesized
aataataattcattctgggatg

SEQ ID NO: 782342 - DNA, 22 bp, Artificial Sequence
  chemically synthesized
tggaattatttgggcatcccag

SEQ ID NO: 782343 - DNA, 22 bp, Artificial Sequence
  chemically synthesized
attctgggatgcccaaataatt

SEQ ID NO: 782344 - DNA, 22 bp, Artificial Sequence
  chemically synthesized
aatatgttatggaattatttgg

SEQ ID NO: 782345 - DNA, 22 bp, Artificial Sequence
  chemically synthesized
ttgaatatgttatggaattatt

SEQ ID NO: 782346 - DNA, 22 bp, Artificial Sequence
  chemically synthesized
tgggatgcccaaataattccat

SEQ ID NO: 782347 - DNA, 22 bp, Artificial Sequence
  chemically synthesized
ggatgcccaaataattccataa

SEQ ID NO: 782348 - DNA, 22 bp, Artificial Sequence
  chemically synthesized
agtgtggaaattattgaatatg

SEQ ID NO: 782349 - DNA, 22 bp, Artificial Sequence
  chemically synthesized
cagtgtggaaattattgaatat

SEQ ID NO: 782350 - DNA, 22 bp, Artificial Sequence
  chemically synthesized
cataacatattcaataatttcc

SEQ ID NO: 782351 - DNA, 22 bp, Artificial Sequence
  chemically synthesized
aataatttccacactgaagggt

SEQ ID NO: 782352 - DNA, 22 bp, Artificial Sequence
  chemically synthesized
ccacactgaagggtatttgctt

SEQ ID NO: 782353 - DNA, 22 bp, Artificial Sequence
  chemically synthesized
cacactgaagggtatttgcttg

SEQ ID NO: 782354 - DNA, 22 bp, Artificial Sequence
  chemically synthesized
aagggtatttgcttgatttcta

SEQ ID NO: 782355 - DNA, 22 bp, Artificial Sequence
  chemically synthesized
tgatggtcaaaaagtagaaatc

SEQ ID NO: 782356 - DNA, 22 bp, Artificial Sequence
  chemically synthesized
tctatgatggtcaaaaagtaga

SEQ ID NO: 782357 - DNA, 22 bp, Artificial Sequence
  chemically synthesized
gcttgatttctactttttgacc

SEQ ID NO: 782358 - DNA, 22 bp, Artificial Sequence
  chemically synthesized
cttgatttctactttttgacca

SEQ ID NO: 782359 - DNA, 22 bp, Artificial Sequence
  chemically synthesized
gcattgtctatgatggtcaaaa

SEQ ID NO: 782360 - DNA, 22 bp, Artificial Sequence
  chemically synthesized
ggcattgtctatgatggtcaaa

SEQ ID NO: 782361 - DNA, 22 bp, Artificial Sequence
  chemically synthesized
gatttctactttttgaccatca

SEQ ID NO: 782362 - DNA, 22 bp, Artificial Sequence
  chemically synthesized
tggcattgtctatgatggtcaa

SEQ ID NO: 782363 - DNA, 22 bp, Artificial Sequence
  chemically synthesized
atttctactttttgaccatcat

SEQ ID NO: 782364 - DNA, 22 bp, Artificial Sequence
  chemically synthesized
ctactttttgaccatcatagac

SEQ ID NO: 782365 - DNA, 22 bp, Artificial Sequence
  chemically synthesized
tactttttgaccatcatagaca

SEQ ID NO: 782366 - DNA, 22 bp, Artificial Sequence
  chemically synthesized
ctttttgaccatcatagacaat

SEQ ID NO: 782367 - DNA, 22 bp, Artificial Sequence
  chemically synthesized
tttgaccatcatagacaatgcc

SEQ ID NO: 782368 - DNA, 22 bp, Artificial Sequence
  chemically synthesized
ttgaccatcatagacaatgcca

SEQ ID NO: 782369 - DNA, 22 bp, Artificial Sequence
  chemically synthesized
tgaccatcatagacaatgccaa

SEQ ID NO: 782370 - DNA, 22 bp, Artificial Sequence
  chemically synthesized
gaccatcatagacaatgccaaa

SEQ ID NO: 782371 - DNA, 22 bp, Artificial Sequence
  chemically synthesized
accatcatagacaatgccaaaa

SEQ ID NO: 782372 - DNA, 22 bp, Artificial Sequence
  chemically synthesized
tatgtagaggatgtgtattttg

SEQ ID NO: 782373 - DNA, 22 bp, Artificial Sequence
  chemically synthesized
tacatacagcctttcatactgg

SEQ ID NO: 782374 - DNA, 22 bp, Artificial Sequence
  chemically synthesized
catacagcctttcatactggta

SEQ ID NO: 782375 - DNA, 22 bp, Artificial Sequence
  chemically synthesized
cagaaataaaagtaccagtatg

SEQ ID NO: 782376 - DNA, 22 bp, Artificial Sequence
  chemically synthesized
tcatactggtacttttatttct

SEQ ID NO: 782377 - DNA, 22 bp, Artificial Sequence
  chemically synthesized
catactggtacttttatttctg

SEQ ID NO: 782378 - DNA, 22 bp, Artificial Sequence
  chemically synthesized
atactggtacttttatttctgt

SEQ ID NO: 782379 - DNA, 22 bp, Artificial Sequence
  chemically synthesized
agaatcaatactacagaaataa

SEQ ID NO: 782380 - DNA, 22 bp, Artificial Sequence
  chemically synthesized
tgagaatcaatactacagaaat

SEQ ID NO: 782381 - DNA, 22 bp, Artificial Sequence
  chemically synthesized
ctgagaatcaatactacagaaa

SEQ ID NO: 782382 - DNA, 22 bp, Artificial Sequence
  chemically synthesized
gtacttttatttctgtagtatt

SEQ ID NO: 782383 - DNA, 22 bp, Artificial Sequence
  chemically synthesized
catttctgagaatcaatactac

SEQ ID NO: 782384 - DNA, 22 bp, Artificial Sequence
  chemically synthesized
ttatttctgtagtattgattct

SEQ ID NO: 782385 - DNA, 22 bp, Artificial Sequence
  chemically synthesized
tatttctgtagtattgattctc

SEQ ID NO: 782386 - DNA, 22 bp, Artificial Sequence
  chemically synthesized
atttctgtagtattgattctca

SEQ ID NO: 782387 - DNA, 22 bp, Artificial Sequence
  chemically synthesized
tttctgtagtattgattctcag

SEQ ID NO: 782388 - DNA, 22 bp, Artificial Sequence
  chemically synthesized
ctgtagtattgattctcagaaa

SEQ ID NO: 782389 - DNA, 22 bp, Artificial Sequence
  chemically synthesized
tgtagtattgattctcagaaat

SEQ ID NO: 782390 - DNA, 22 bp, Artificial Sequence
  chemically synthesized
atcagtcactccatttctgaga

SEQ ID NO: 782391 - DNA, 22 bp, Artificial Sequence
  chemically synthesized
gatcagtcactccatttctgag

SEQ ID NO: 782392 - DNA, 22 bp, Artificial Sequence
  chemically synthesized
tagtattgattctcagaaatgg

SEQ ID NO: 782393 - DNA, 22 bp, Artificial Sequence
  chemically synthesized
tgatcagtcactccatttctga

SEQ ID NO: 782394 - DNA, 22 bp, Artificial Sequence
  chemically synthesized
ttgatcagtcactccatttctg

SEQ ID NO: 782395 - DNA, 22 bp, Artificial Sequence
  chemically synthesized
ccttttgatcagtcactccatt

SEQ ID NO: 782396 - DNA, 22 bp, Artificial Sequence
  chemically synthesized
accttttgatcagtcactccat

SEQ ID NO: 782397 - DNA, 22 bp, Artificial Sequence
  chemically synthesized
attctcagaaatggagtgactg

SEQ ID NO: 782398 - DNA, 22 bp, Artificial Sequence
  chemically synthesized
tcagaaatggagtgactgatca

SEQ ID NO: 782399 - DNA, 22 bp, Artificial Sequence
  chemically synthesized
agaaatggagtgactgatcaaa

SEQ ID NO: 782400 - DNA, 22 bp, Artificial Sequence
  chemically synthesized
aatgcacttaccttttgatcag

SEQ ID NO: 782401 - DNA, 22 bp, Artificial Sequence
  chemically synthesized
aaatgcacttaccttttgatca

SEQ ID NO: 782402 - DNA, 22 bp, Artificial Sequence
  chemically synthesized
taaatgcacttaccttttgatc

SEQ ID NO: 782403 - DNA, 22 bp, Artificial Sequence
  chemically synthesized
caaaaattttaaatgcacttac

SEQ ID NO: 782404 - DNA, 22 bp, Artificial Sequence
  chemically synthesized
atcaaaaggtaagtgcatttaa

SEQ ID NO: 782405 - DNA, 22 bp, Artificial Sequence
  chemically synthesized
aaaatttttgtagatcatacca

SEQ ID NO: 782406 - DNA, 22 bp, Artificial Sequence
  chemically synthesized
aggaaagaaatgtggtatgatc

SEQ ID NO: 782407 - DNA, 22 bp, Artificial Sequence
  chemically synthesized
aaatttttgtagatcataccac

SEQ ID NO: 782408 - DNA, 22 bp, Artificial Sequence
  chemically synthesized
gaggaaagaaatgtggtatgat

SEQ ID NO: 782409 - DNA, 22 bp, Artificial Sequence
  chemically synthesized
tgaggaaagaaatgtggtatga

SEQ ID NO: 782410 - DNA, 22 bp, Artificial Sequence
  chemically synthesized
ttgtagatcataccacatttct

SEQ ID NO: 782411 - DNA, 22 bp, Artificial Sequence
  chemically synthesized
tgtagatcataccacatttctt

SEQ ID NO: 782412 - DNA, 22 bp, Artificial Sequence
  chemically synthesized
gtagatcataccacatttcttt

SEQ ID NO: 782413 - DNA, 22 bp, Artificial Sequence
  chemically synthesized
tggtctttgaggaaagaaatgt

SEQ ID NO: 782414 - DNA, 22 bp, Artificial Sequence
  chemically synthesized
tagatcataccacatttctttc

SEQ ID NO: 782415 - DNA, 22 bp, Artificial Sequence
  chemically synthesized
ctgtggtctttgaggaaagaaa

SEQ ID NO: 782416 - DNA, 22 bp, Artificial Sequence
  chemically synthesized
ctttcctcaaagaccacagcaa

SEQ ID NO: 782417 - DNA, 22 bp, Artificial Sequence
  chemically synthesized
tttcctcaaagaccacagcaat

SEQ ID NO: 782418 - DNA, 22 bp, Artificial Sequence
  chemically synthesized
tcctcaaagaccacagcaattt

SEQ ID NO: 782419 - DNA, 22 bp, Artificial Sequence
  chemically synthesized
cagatgaaacgcaaattgctgt

SEQ ID NO: 782420 - DNA, 22 bp, Artificial Sequence
  chemically synthesized
cctcaaagaccacagcaatttg

SEQ ID NO: 782421 - DNA, 22 bp, Artificial Sequence
  chemically synthesized
ctcaaagaccacagcaatttgc

SEQ ID NO: 782422 - DNA, 22 bp, Artificial Sequence
  chemically synthesized
aaagaccacagcaatttgcgtt

SEQ ID NO: 782423 - DNA, 22 bp, Artificial Sequence
  chemically synthesized
agatattgcagatgaaacgcaa

SEQ ID NO: 782424 - DNA, 22 bp, Artificial Sequence
  chemically synthesized
tcagatattgcagatgaaacgc

SEQ ID NO: 782425 - DNA, 22 bp, Artificial Sequence
  chemically synthesized
gcgtttcatctgcaatatctga

SEQ ID NO: 782426 - DNA, 22 bp, Artificial Sequence
  chemically synthesized
cgtttcatctgcaatatctgag

SEQ ID NO: 782427 - DNA, 22 bp, Artificial Sequence
  chemically synthesized
atggaagagagcactctcagat

SEQ ID NO: 782428 - DNA, 22 bp, Artificial Sequence
  chemically synthesized
aatggaagagagcactctcaga

SEQ ID NO: 782429 - DNA, 22 bp, Artificial Sequence
  chemically synthesized
catctgcaatatctgagagtgc

SEQ ID NO: 782430 - DNA, 22 bp, Artificial Sequence
  chemically synthesized
taatggaagagagcactctcag

SEQ ID NO: 782431 - DNA, 22 bp, Artificial Sequence
  chemically synthesized
atctgcaatatctgagagtgct

SEQ ID NO: 782432 - DNA, 22 bp, Artificial Sequence
  chemically synthesized
ttaatggaagagagcactctca

SEQ ID NO: 782433 - DNA, 22 bp, Artificial Sequence
  chemically synthesized
caatatctgagagtgctctctt

SEQ ID NO: 782434 - DNA, 22 bp, Artificial Sequence
  chemically synthesized
agaatgataatttttaatggaa

SEQ ID NO: 782435 - DNA, 22 bp, Artificial Sequence
  chemically synthesized
agagtgctctcttccattaaaa

SEQ ID NO: 782436 - DNA, 22 bp, Artificial Sequence
  chemically synthesized
tcttccattaaaaattatcatt

SEQ ID NO: 782437 - DNA, 22 bp, Artificial Sequence
  chemically synthesized
ttccattaaaaattatcattct

SEQ ID NO: 782438 - DNA, 22 bp, Artificial Sequence
  chemically synthesized
ccattaaaaattatcattctta

SEQ ID NO: 782439 - DNA, 22 bp, Artificial Sequence
  chemically synthesized
cattaaaaattatcattcttaa

SEQ ID NO: 782440 - DNA, 22 bp, Artificial Sequence
  chemically synthesized
acaaatagacagaaattaagaa

SEQ ID NO: 782441 - DNA, 22 bp, Artificial Sequence
  chemically synthesized
aaaattatcattcttaatttct

SEQ ID NO: 782442 - DNA, 22 bp, Artificial Sequence
  chemically synthesized
tctaacaaatagacagaaatta

SEQ ID NO: 782443 - DNA, 22 bp, Artificial Sequence
  chemically synthesized
tcattcttaatttctgtctatt

SEQ ID NO: 782444 - DNA, 22 bp, Artificial Sequence
  chemically synthesized
ttaatttctgtctatttgttag

SEQ ID NO: 782445 - DNA, 22 bp, Artificial Sequence
  chemically synthesized
aatttctgtctatttgttagat

SEQ ID NO: 782446 - DNA, 22 bp, Artificial Sequence
  chemically synthesized
atttctgtctatttgttagata

SEQ ID NO: 782447 - DNA, 22 bp, Artificial Sequence
  chemically synthesized
ctgtctatttgttagatagaca

SEQ ID NO: 782448 - DNA, 22 bp, Artificial Sequence
  chemically synthesized
tgtctatttgttagatagacat

SEQ ID NO: 782449 - DNA, 22 bp, Artificial Sequence
  chemically synthesized
tctatttgttagatagacatgg

SEQ ID NO: 782450 - DNA, 22 bp, Artificial Sequence
  chemically synthesized
tttgttagatagacatggtgtc

SEQ ID NO: 782451 - DNA, 22 bp, Artificial Sequence
  chemically synthesized
gttagatagacatggtgtctta

SEQ ID NO: 782452 - DNA, 22 bp, Artificial Sequence
  chemically synthesized
ttagatagacatggtgtcttat

SEQ ID NO: 782453 - DNA, 22 bp, Artificial Sequence
  chemically synthesized
gatagacatggtgtcttatttc

SEQ ID NO: 782454 - DNA, 22 bp, Artificial Sequence
  chemically synthesized
atagtagtaagggataggaaaa

SEQ ID NO: 782455 - DNA, 22 bp, Artificial Sequence
  chemically synthesized
atttctttattttcctatccct

SEQ ID NO: 782456 - DNA, 22 bp, Artificial Sequence
  chemically synthesized
ctcatagtagtaagggatagga

SEQ ID NO: 782457 - DNA, 22 bp, Artificial Sequence
  chemically synthesized
tttctttattttcctatccctt

SEQ ID NO: 782458 - DNA, 22 bp, Artificial Sequence
  chemically synthesized
cctcatagtagtaagggatagg

SEQ ID NO: 782459 - DNA, 22 bp, Artificial Sequence
  chemically synthesized
ctttattttcctatcccttact

SEQ ID NO: 782460 - DNA, 22 bp, Artificial Sequence
  chemically synthesized
tttattttcctatcccttacta

SEQ ID NO: 782461 - DNA, 22 bp, Artificial Sequence
  chemically synthesized
tattttcctatcccttactact

SEQ ID NO: 782462 - DNA, 22 bp, Artificial Sequence
  chemically synthesized
attttcctatcccttactacta

SEQ ID NO: 782463 - DNA, 22 bp, Artificial Sequence
  chemically synthesized
ttttcctatcccttactactat

SEQ ID NO: 782464 - DNA, 22 bp, Artificial Sequence
  chemically synthesized
tcctatcccttactactatgag

SEQ ID NO: 782465 - DNA, 22 bp, Artificial Sequence
  chemically synthesized
cctatcccttactactatgagg

SEQ ID NO: 782466 - DNA, 22 bp, Artificial Sequence
  chemically synthesized
ctatcccttactactatgagga

SEQ ID NO: 782467 - DNA, 22 bp, Artificial Sequence
  chemically synthesized
tgataatatgcttcctcatagt

SEQ ID NO: 782468 - DNA, 22 bp, Artificial Sequence
  chemically synthesized
tcccttactactatgaggaagc

SEQ ID NO: 782469 - DNA, 22 bp, Artificial Sequence
  chemically synthesized
actactatgaggaagcatatta

SEQ ID NO: 782470 - DNA, 22 bp, Artificial Sequence
  chemically synthesized
ctactatgaggaagcatattat

SEQ ID NO: 782471 - DNA, 22 bp, Artificial Sequence
  chemically synthesized
ctatgaggaagcatattatcat

SEQ ID NO: 782472 - DNA, 22 bp, Artificial Sequence
  chemically synthesized
gaaaaataaaactatgataata

SEQ ID NO: 782473 - DNA, 22 bp, Artificial Sequence
  chemically synthesized
tgaggaagcatattatcatagt

SEQ ID NO: 782474 - DNA, 22 bp, Artificial Sequence
  chemically synthesized
tcatagttttatttttccagct

SEQ ID NO: 782475 - DNA, 22 bp, Artificial Sequence
  chemically synthesized
ccagaagaggatatccagatag

SEQ ID NO: 782476 - DNA, 22 bp, Artificial Sequence
  chemically synthesized
tatttttccagctatctggata

SEQ ID NO: 782477 - DNA, 22 bp, Artificial Sequence
  chemically synthesized
atttttccagctatctggatat

SEQ ID NO: 782478 - DNA, 22 bp, Artificial Sequence
  chemically synthesized
tttttccagctatctggatatc

SEQ ID NO: 782479 - DNA, 22 bp, Artificial Sequence
  chemically synthesized
ttccagctatctggatatcctc

SEQ ID NO: 782480 - DNA, 22 bp, Artificial Sequence
  chemically synthesized
tccagctatctggatatcctct

SEQ ID NO: 782481 - DNA, 22 bp, Artificial Sequence
  chemically synthesized
ccagctatctggatatcctctt

SEQ ID NO: 782482 - DNA, 22 bp, Artificial Sequence
  chemically synthesized
cagctatctggatatcctcttc

SEQ ID NO: 782483 - DNA, 22 bp, Artificial Sequence
  chemically synthesized
tctggatatcctcttctgggaa

SEQ ID NO: 782484 - DNA, 22 bp, Artificial Sequence
  chemically synthesized
gatatcctcttctgggaattgc

SEQ ID NO: 782485 - DNA, 22 bp, Artificial Sequence
  chemically synthesized
gccgaagtataggaatatgcaa

SEQ ID NO: 782486 - DNA, 22 bp, Artificial Sequence
  chemically synthesized
ttctgggaattgcatattccta

SEQ ID NO: 782487 - DNA, 22 bp, Artificial Sequence
  chemically synthesized
ctgggaattgcatattcctata

SEQ ID NO: 782488 - DNA, 22 bp, Artificial Sequence
  chemically synthesized
tgggaattgcatattcctatac

SEQ ID NO: 782489 - DNA, 22 bp, Artificial Sequence
  chemically synthesized
ggaattgcatattcctatactt

SEQ ID NO: 782490 - DNA, 22 bp, Artificial Sequence
  chemically synthesized
catattcctatacttcggccag

SEQ ID NO: 782491 - DNA, 22 bp, Artificial Sequence
  chemically synthesized
aaacaacccagtacaaaactgg

SEQ ID NO: 782492 - DNA, 22 bp, Artificial Sequence
  chemically synthesized
ctatacttcggccagttttgta

SEQ ID NO: 782493 - DNA, 22 bp, Artificial Sequence
  chemically synthesized
tacttcggccagttttgtactg

SEQ ID NO: 782494 - DNA, 22 bp, Artificial Sequence
  chemically synthesized
aaattcaaacaacccagtacaa

SEQ ID NO: 782495 - DNA, 22 bp, Artificial Sequence
  chemically synthesized
aaaattcaaacaacccagtaca

SEQ ID NO: 782496 - DNA, 22 bp, Artificial Sequence
  chemically synthesized
taaaattcaaacaacccagtac

SEQ ID NO: 782497 - DNA, 22 bp, Artificial Sequence
  chemically synthesized
cggccagttttgtactgggttg

SEQ ID NO: 782498 - DNA, 22 bp, Artificial Sequence
  chemically synthesized
ttaaaattcaaacaacccagta

SEQ ID NO: 782499 - DNA, 22 bp, Artificial Sequence
  chemically synthesized
ggccagttttgtactgggttgt

SEQ ID NO: 782500 - DNA, 22 bp, Artificial Sequence
  chemically synthesized
tttaaaattcaaacaacccagt

SEQ ID NO: 782501 - DNA, 22 bp, Artificial Sequence
  chemically synthesized
atattttttaaaattcaaacaa

SEQ ID NO: 782502 - DNA, 22 bp, Artificial Sequence
  chemically synthesized
tgtactgggttgtttgaatttt

SEQ ID NO: 782503 - DNA, 22 bp, Artificial Sequence
  chemically synthesized
gtactgggttgtttgaatttta

SEQ ID NO: 782504 - DNA, 22 bp, Artificial Sequence
  chemically synthesized
tactgggttgtttgaattttaa

SEQ ID NO: 782505 - DNA, 22 bp, Artificial Sequence
  chemically synthesized
aattaatattttttaaaattca

SEQ ID NO: 782506 - DNA, 22 bp, Artificial Sequence
  chemically synthesized
attaaattaatattttttaaaa

SEQ ID NO: 782507 - DNA, 22 bp, Artificial Sequence
  chemically synthesized
ggttgtttgaattttaaaaaat

SEQ ID NO: 782508 - DNA, 22 bp, Artificial Sequence
  chemically synthesized
ttaattaaattaatatttttta

SEQ ID NO: 782509 - DNA, 22 bp, Artificial Sequence
  chemically synthesized
gttaattaaattaatatttttt

SEQ ID NO: 782510 - DNA, 22 bp, Artificial Sequence
  chemically synthesized
tttgaattttaaaaaatattaa

SEQ ID NO: 782511 - DNA, 22 bp, Artificial Sequence
  chemically synthesized
gaattttaaaaaatattaattt

SEQ ID NO: 782512 - DNA, 22 bp, Artificial Sequence
  chemically synthesized
aattttaaaaaatattaattta

SEQ ID NO: 782513 - DNA, 22 bp, Artificial Sequence
  chemically synthesized
caaatttgttaattaaattaat

SEQ ID NO: 782514 - DNA, 22 bp, Artificial Sequence
  chemically synthesized
ctacaaatttgttaattaaatt

SEQ ID NO: 782515 - DNA, 22 bp, Artificial Sequence
  chemically synthesized
taaaaaatattaatttaattaa

SEQ ID NO: 782516 - DNA, 22 bp, Artificial Sequence
  chemically synthesized
aaaaaatattaatttaattaac

SEQ ID NO: 782517 - DNA, 22 bp, Artificial Sequence
  chemically synthesized
tcctacaaatttgttaattaaa

SEQ ID NO: 782518 - DNA, 22 bp, Artificial Sequence
  chemically synthesized
aaaaatattaatttaattaaca

SEQ ID NO: 782519 - DNA, 22 bp, Artificial Sequence
  chemically synthesized
ctcctacaaatttgttaattaa

SEQ ID NO: 782520 - DNA, 22 bp, Artificial Sequence
  chemically synthesized
atttaattaacaaatttgtagg

SEQ ID NO: 782521 - DNA, 22 bp, Artificial Sequence
  chemically synthesized
atatacaaatttctcctacaaa

SEQ ID NO: 782522 - DNA, 22 bp, Artificial Sequence
  chemically synthesized
aattaacaaatttgtaggagaa

SEQ ID NO: 782523 - DNA, 22 bp, Artificial Sequence
  chemically synthesized
attaacaaatttgtaggagaaa

SEQ ID NO: 782524 - DNA, 22 bp, Artificial Sequence
  chemically synthesized
acaaatttgtaggagaaatttg

SEQ ID NO: 782525 - DNA, 22 bp, Artificial Sequence
  chemically synthesized
gtaggagaaatttgtatattag

SEQ ID NO: 782526 - DNA, 22 bp, Artificial Sequence
  chemically synthesized
taggagaaatttgtatattagg

SEQ ID NO: 782527 - DNA, 22 bp, Artificial Sequence
  chemically synthesized
gtatattaggtatatgcatctc

SEQ ID NO: 782528 - DNA, 22 bp, Artificial Sequence
  chemically synthesized
tatattaggtatatgcatctct

SEQ ID NO: 782529 - DNA, 22 bp, Artificial Sequence
  chemically synthesized
gcaacatgtgacataaagagat

SEQ ID NO: 782530 - DNA, 22 bp, Artificial Sequence
  chemically synthesized
ggtatatgcatctctttatgtc

SEQ ID NO: 782531 - DNA, 22 bp, Artificial Sequence
  chemically synthesized
tttatgtcacatgttgcgaata

SEQ ID NO: 782532 - DNA, 22 bp, Artificial Sequence
  chemically synthesized
tatgtcacatgttgcgaataca

SEQ ID NO: 782533 - DNA, 22 bp, Artificial Sequence
  chemically synthesized
atgtcacatgttgcgaatacat

SEQ ID NO: 782534 - DNA, 22 bp, Artificial Sequence
  chemically synthesized
tgtcacatgttgcgaatacatc

SEQ ID NO: 782535 - DNA, 22 bp, Artificial Sequence
  chemically synthesized
cgaatacatctactctatttgc

SEQ ID NO: 782536 - DNA, 22 bp, Artificial Sequence
  chemically synthesized
ctctatttgctgtttttctttt

SEQ ID NO: 782537 - DNA, 22 bp, Artificial Sequence
  chemically synthesized
tatttgctgtttttcttttgac

SEQ ID NO: 782538 - DNA, 22 bp, Artificial Sequence
  chemically synthesized
tttgctgtttttcttttgactt

SEQ ID NO: 782539 - DNA, 22 bp, Artificial Sequence
  chemically synthesized
gctgtttttcttttgactttgt

SEQ ID NO: 782540 - DNA, 22 bp, Artificial Sequence
  chemically synthesized
aaataacagaagacaaagtcaa

SEQ ID NO: 782541 - DNA, 22 bp, Artificial Sequence
  chemically synthesized
ctgtttttcttttgactttgtc

SEQ ID NO: 782542 - DNA, 22 bp, Artificial Sequence
  chemically synthesized
aaaataacagaagacaaagtca

SEQ ID NO: 782543 - DNA, 22 bp, Artificial Sequence
  chemically synthesized
tttttcttttgactttgtcttc

SEQ ID NO: 782544 - DNA, 22 bp, Artificial Sequence
  chemically synthesized
cttaaaataacagaagacaaag

SEQ ID NO: 782545 - DNA, 22 bp, Artificial Sequence
  chemically synthesized
ttcttttgactttgtcttctgt

SEQ ID NO: 782546 - DNA, 22 bp, Artificial Sequence
  chemically synthesized
ctgcttaaaataacagaagaca

SEQ ID NO: 782547 - DNA, 22 bp, Artificial Sequence
  chemically synthesized
tcttttgactttgtcttctgtt

SEQ ID NO: 782548 - DNA, 22 bp, Artificial Sequence
  chemically synthesized
cttttgactttgtcttctgtta

SEQ ID NO: 782549 - DNA, 22 bp, Artificial Sequence
  chemically synthesized
ttttgactttgtcttctgttat

SEQ ID NO: 782550 - DNA, 22 bp, Artificial Sequence
  chemically synthesized
ttactgcttaaaataacagaag

SEQ ID NO: 782551 - DNA, 22 bp, Artificial Sequence
  chemically synthesized
gttactgcttaaaataacagaa

SEQ ID NO: 782552 - DNA, 22 bp, Artificial Sequence
  chemically synthesized
ttgactttgtcttctgttattt

SEQ ID NO: 782553 - DNA, 22 bp, Artificial Sequence
  chemically synthesized
tgactttgtcttctgttatttt

SEQ ID NO: 782554 - DNA, 22 bp, Artificial Sequence
  chemically synthesized
gactttgtcttctgttatttta

SEQ ID NO: 782555 - DNA, 22 bp, Artificial Sequence
  chemically synthesized
actttgtcttctgttattttaa

SEQ ID NO: 782556 - DNA, 22 bp, Artificial Sequence
  chemically synthesized
tgtcttctgttattttaagcag

SEQ ID NO: 782557 - DNA, 22 bp, Artificial Sequence
  chemically synthesized
gtcttctgttattttaagcagt

SEQ ID NO: 782558 - DNA, 22 bp, Artificial Sequence
  chemically synthesized
tcttctgttattttaagcagta

SEQ ID NO: 782559 - DNA, 22 bp, Artificial Sequence
  chemically synthesized
ctgttattttaagcagtaacaa

SEQ ID NO: 782560 - DNA, 22 bp, Artificial Sequence
  chemically synthesized
tgttattttaagcagtaacaag

SEQ ID NO: 782561 - DNA, 22 bp, Artificial Sequence
  chemically synthesized
ttattttaagcagtaacaaggt

SEQ ID NO: 782562 - DNA, 22 bp, Artificial Sequence
  chemically synthesized
taaggaaaaaatataccttgtt

SEQ ID NO: 782563 - DNA, 22 bp, Artificial Sequence
  chemically synthesized
ttttaagcagtaacaaggtata

SEQ ID NO: 782564 - DNA, 22 bp, Artificial Sequence
  chemically synthesized
taagcagtaacaaggtatattt

SEQ ID NO: 782565 - DNA, 22 bp, Artificial Sequence
  chemically synthesized
aagcagtaacaaggtatatttt

SEQ ID NO: 782566 - DNA, 22 bp, Artificial Sequence
  chemically synthesized
agcagtaacaaggtatattttt

SEQ ID NO: 782567 - DNA, 22 bp, Artificial Sequence
  chemically synthesized
aaaagctataaggaaaaaatat

SEQ ID NO: 782568 - DNA, 22 bp, Artificial Sequence
  chemically synthesized
aacaagacacaaaactcaaaag

SEQ ID NO: 782569 - DNA, 22 bp, Artificial Sequence
  chemically synthesized
tttccttatagcttttgagttt

SEQ ID NO: 782570 - DNA, 22 bp, Artificial Sequence
  chemically synthesized
ttccttatagcttttgagtttt

SEQ ID NO: 782571 - DNA, 22 bp, Artificial Sequence
  chemically synthesized
taaacaagacacaaaactcaaa

SEQ ID NO: 782572 - DNA, 22 bp, Artificial Sequence
  chemically synthesized
tccttatagcttttgagttttg

SEQ ID NO: 782573 - DNA, 22 bp, Artificial Sequence
  chemically synthesized
ctaaacaagacacaaaactcaa

SEQ ID NO: 782574 - DNA, 22 bp, Artificial Sequence
  chemically synthesized
ccttatagcttttgagttttgt

SEQ ID NO: 782575 - DNA, 22 bp, Artificial Sequence
  chemically synthesized
tctaaacaagacacaaaactca

SEQ ID NO: 782576 - DNA, 22 bp, Artificial Sequence
  chemically synthesized
cttatagcttttgagttttgtg

SEQ ID NO: 782577 - DNA, 22 bp, Artificial Sequence
  chemically synthesized
atagcttttgagttttgtgtct

SEQ ID NO: 782578 - DNA, 22 bp, Artificial Sequence
  chemically synthesized
tagcttttgagttttgtgtctt

SEQ ID NO: 782579 - DNA, 22 bp, Artificial Sequence
  chemically synthesized
ttgagttttgtgtcttgtttag

SEQ ID NO: 782580 - DNA, 22 bp, Artificial Sequence
  chemically synthesized
tgagttttgtgtcttgtttaga

SEQ ID NO: 782581 - DNA, 22 bp, Artificial Sequence
  chemically synthesized
gagttttgtgtcttgtttagaa

SEQ ID NO: 782582 - DNA, 22 bp, Artificial Sequence
  chemically synthesized
agttttgtgtcttgtttagaaa

SEQ ID NO: 782583 - DNA, 22 bp, Artificial Sequence
  chemically synthesized
gaatgaggaagacgttttctaa

SEQ ID NO: 782584 - DNA, 22 bp, Artificial Sequence
  chemically synthesized
ggaatgaggaagacgttttcta

SEQ ID NO: 782585 - DNA, 22 bp, Artificial Sequence
  chemically synthesized
tgtgtcttgtttagaaaacgtc

SEQ ID NO: 782586 - DNA, 22 bp, Artificial Sequence
  chemically synthesized
gtgtcttgtttagaaaacgtct

SEQ ID NO: 782587 - DNA, 22 bp, Artificial Sequence
  chemically synthesized
ttggaatgaggaagacgttttc

SEQ ID NO: 782588 - DNA, 22 bp, Artificial Sequence
  chemically synthesized
tgtcttgtttagaaaacgtctt

SEQ ID NO: 782589 - DNA, 22 bp, Artificial Sequence
  chemically synthesized
gtttagaaaacgtcttcctcat

SEQ ID NO: 782590 - DNA, 22 bp, Artificial Sequence
  chemically synthesized
tttagaaaacgtcttcctcatt

SEQ ID NO: 782591 - DNA, 22 bp, Artificial Sequence
  chemically synthesized
agaaaacgtcttcctcattcca

SEQ ID NO: 782592 - DNA, 22 bp, Artificial Sequence
  chemically synthesized
gaaaacgtcttcctcattccaa

SEQ ID NO: 782593 - DNA, 22 bp, Artificial Sequence
  chemically synthesized
aatgtaaaaacaaaaattcttg

SEQ ID NO: 782594 - DNA, 22 bp, Artificial Sequence
  chemically synthesized
aaatgtaaaaacaaaaattctt

SEQ ID NO: 782595 - DNA, 22 bp, Artificial Sequence
  chemically synthesized
taaatgtaaaaacaaaaattct

SEQ ID NO: 782596 - DNA, 22 bp, Artificial Sequence
  chemically synthesized
cctcattccaagaatttttgtt

SEQ ID NO: 782597 - DNA, 22 bp, Artificial Sequence
  chemically synthesized
ctcattccaagaatttttgttt

SEQ ID NO: 782598 - DNA, 22 bp, Artificial Sequence
  chemically synthesized
attccaagaatttttgttttta

SEQ ID NO: 782599 - DNA, 22 bp, Artificial Sequence
  chemically synthesized
aagttttaaatgtaaaaacaaa

SEQ ID NO: 782600 - DNA, 22 bp, Artificial Sequence
  chemically synthesized
caagaatttttgtttttacatt

SEQ ID NO: 782601 - DNA, 22 bp, Artificial Sequence
  chemically synthesized
aaatgcattaaagttttaaatg

SEQ ID NO: 782602 - DNA, 22 bp, Artificial Sequence
  chemically synthesized
caaatgcattaaagttttaaat

SEQ ID NO: 782603 - DNA, 22 bp, Artificial Sequence
  chemically synthesized
ttgtttttacatttaaaacttt

SEQ ID NO: 782604 - DNA, 22 bp, Artificial Sequence
  chemically synthesized
tgtttttacatttaaaacttta

SEQ ID NO: 782605 - DNA, 22 bp, Artificial Sequence
  chemically synthesized
gtttttacatttaaaactttaa

SEQ ID NO: 782606 - DNA, 22 bp, Artificial Sequence
  chemically synthesized
tttttacatttaaaactttaat

SEQ ID NO: 782607 - DNA, 22 bp, Artificial Sequence
  chemically synthesized
ttacatttaaaactttaatgca

SEQ ID NO: 782608 - DNA, 22 bp, Artificial Sequence
  chemically synthesized
tacatttaaaactttaatgcat

SEQ ID NO: 782609 - DNA, 22 bp, Artificial Sequence
  chemically synthesized
acatttaaaactttaatgcatt

SEQ ID NO: 782610 - DNA, 22 bp, Artificial Sequence
  chemically synthesized
catttaaaactttaatgcattt

SEQ ID NO: 782611 - DNA, 22 bp, Artificial Sequence
  chemically synthesized
aaaactttaatgcatttgaaat

SEQ ID NO: 782612 - DNA, 22 bp, Artificial Sequence
  chemically synthesized
aaactttaatgcatttgaaatg

SEQ ID NO: 782613 - DNA, 22 bp, Artificial Sequence
  chemically synthesized
tgcaatgtaagaatacatttca

SEQ ID NO: 782614 - DNA, 22 bp, Artificial Sequence
  chemically synthesized
atgcaatgtaagaatacatttc

SEQ ID NO: 782615 - DNA, 22 bp, Artificial Sequence
  chemically synthesized
taatgcatttgaaatgtattct

SEQ ID NO: 782616 - DNA, 22 bp, Artificial Sequence
  chemically synthesized
aatgcatttgaaatgtattctt

SEQ ID NO: 782617 - DNA, 22 bp, Artificial Sequence
  chemically synthesized
atgcatttgaaatgtattctta

SEQ ID NO: 782618 - DNA, 22 bp, Artificial Sequence
  chemically synthesized
gcttatgcaatgtaagaataca

SEQ ID NO: 782619 - DNA, 22 bp, Artificial Sequence
  chemically synthesized
ctagcttatgcaatgtaagaat

SEQ ID NO: 782620 - DNA, 22 bp, Artificial Sequence
  chemically synthesized
cctcctagcttatgcaatgtaa

SEQ ID NO: 782621 - DNA, 22 bp, Artificial Sequence
  chemically synthesized
gaaatgtattcttacattgcat

SEQ ID NO: 782622 - DNA, 22 bp, Artificial Sequence
  chemically synthesized
aaatgtattcttacattgcata

SEQ ID NO: 782623 - DNA, 22 bp, Artificial Sequence
  chemically synthesized
ttacattgcataagctaggagg

SEQ ID NO: 782624 - DNA, 22 bp, Artificial Sequence
  chemically synthesized
acattgcataagctaggaggca

SEQ ID NO: 782625 - DNA, 22 bp, Artificial Sequence
  chemically synthesized
gaaaacacagattgcctcctag

SEQ ID NO: 782626 - DNA, 22 bp, Artificial Sequence
  chemically synthesized
cattgcataagctaggaggcaa

SEQ ID NO: 782627 - DNA, 22 bp, Artificial Sequence
  chemically synthesized
agaaaacacagattgcctccta

SEQ ID NO: 782628 - DNA, 22 bp, Artificial Sequence
  chemically synthesized
ttagaaaacacagattgcctcc

SEQ ID NO: 782629 - DNA, 22 bp, Artificial Sequence
  chemically synthesized
cataagctaggaggcaatctgt

SEQ ID NO: 782630 - DNA, 22 bp, Artificial Sequence
  chemically synthesized
ctcttagaaaacacagattgcc

SEQ ID NO: 782631 - DNA, 22 bp, Artificial Sequence
  chemically synthesized
caattcctcttagaaaacacag

SEQ ID NO: 782632 - DNA, 22 bp, Artificial Sequence
  chemically synthesized
gcaattcctcttagaaaacaca

SEQ ID NO: 782633 - DNA, 22 bp, Artificial Sequence
  chemically synthesized
tgcaattcctcttagaaaacac

SEQ ID NO: 782634 - DNA, 22 bp, Artificial Sequence
  chemically synthesized
ggaggcaatctgtgttttctaa

SEQ ID NO: 782635 - DNA, 22 bp, Artificial Sequence
  chemically synthesized
tttgcaattcctcttagaaaac

SEQ ID NO: 782636 - DNA, 22 bp, Artificial Sequence
  chemically synthesized
tgttttctaagaggaattgcaa

SEQ ID NO: 782637 - DNA, 22 bp, Artificial Sequence
  chemically synthesized
tctaagaggaattgcaaagagt

SEQ ID NO: 782638 - DNA, 22 bp, Artificial Sequence
  chemically synthesized
ctaagaggaattgcaaagagtg

SEQ ID NO: 782639 - DNA, 22 bp, Artificial Sequence
  chemically synthesized
taagaggaattgcaaagagtgc

SEQ ID NO: 782640 - DNA, 22 bp, Artificial Sequence
  chemically synthesized
agaggaattgcaaagagtgctg

SEQ ID NO: 782641 - DNA, 22 bp, Artificial Sequence
  chemically synthesized
aataaatggtgccagcactctt

SEQ ID NO: 782642 - DNA, 22 bp, Artificial Sequence
  chemically synthesized
ttcaataaatggtgccagcact

SEQ ID NO: 782643 - DNA, 22 bp, Artificial Sequence
  chemically synthesized
attcaataaatggtgccagcac

SEQ ID NO: 782644 - DNA, 22 bp, Artificial Sequence
  chemically synthesized
tattcaataaatggtgccagca

SEQ ID NO: 782645 - DNA, 22 bp, Artificial Sequence
  chemically synthesized
caaagagtgctggcaccattta

SEQ ID NO: 782646 - DNA, 22 bp, Artificial Sequence
  chemically synthesized
gcaccatttattgaataaaaca

SEQ ID NO: 782647 - DNA, 22 bp, Artificial Sequence
  chemically synthesized
aaggaataaaggtgttttattc

SEQ ID NO: 782648 - DNA, 22 bp, Artificial Sequence
  chemically synthesized
attcaaggaataaaggtgtttt

SEQ ID NO: 782649 - DNA, 22 bp, Artificial Sequence
  chemically synthesized
aattcaaggaataaaggtgttt

SEQ ID NO: 782650 - DNA, 22 bp, Artificial Sequence
  chemically synthesized
taattcaaggaataaaggtgtt

SEQ ID NO: 782651 - DNA, 22 bp, Artificial Sequence
  chemically synthesized
attgaataaaacacctttattc

SEQ ID NO: 782652 - DNA, 22 bp, Artificial Sequence
  chemically synthesized
ttttaattcaaggaataaaggt

SEQ ID NO: 782653 - DNA, 22 bp, Artificial Sequence
  chemically synthesized
ttgaataaaacacctttattcc

SEQ ID NO: 782654 - DNA, 22 bp, Artificial Sequence
  chemically synthesized
aataaaacacctttattccttg

SEQ ID NO: 782655 - DNA, 22 bp, Artificial Sequence
  chemically synthesized
tatggcaaatgtgttattttaa

SEQ ID NO: 782656 - DNA, 22 bp, Artificial Sequence
  chemically synthesized
tattccttgaattaaaataaca

SEQ ID NO: 782657 - DNA, 22 bp, Artificial Sequence
  chemically synthesized
attccttgaattaaaataacac

SEQ ID NO: 782658 - DNA, 22 bp, Artificial Sequence
  chemically synthesized
ttccttgaattaaaataacaca

SEQ ID NO: 782659 - DNA, 22 bp, Artificial Sequence
  chemically synthesized
cttgaattaaaataacacattt

SEQ ID NO: 782660 - DNA, 22 bp, Artificial Sequence
  chemically synthesized
gaattaaaataacacatttgcc

SEQ ID NO: 782661 - DNA, 22 bp, Artificial Sequence
  chemically synthesized
gaaacattatatggcaaatgtg

SEQ ID NO: 782662 - DNA, 22 bp, Artificial Sequence
  chemically synthesized
aattaaaataacacatttgcca

SEQ ID NO: 782663 - DNA, 22 bp, Artificial Sequence
  chemically synthesized
ggaaacattatatggcaaatgt

SEQ ID NO: 782664 - DNA, 22 bp, Artificial Sequence
  chemically synthesized
tggaaacattatatggcaaatg

SEQ ID NO: 782665 - DNA, 22 bp, Artificial Sequence
  chemically synthesized
ttggaaacattatatggcaaat

SEQ ID NO: 782666 - DNA, 22 bp, Artificial Sequence
  chemically synthesized
aaataacacatttgccatataa

SEQ ID NO: 782667 - DNA, 22 bp, Artificial Sequence
  chemically synthesized
tttttggaaacattatatggca

SEQ ID NO: 782668 - DNA, 22 bp, Artificial Sequence
  chemically synthesized
gccatataatgtttccaaaaac

SEQ ID NO: 782669 - DNA, 22 bp, Artificial Sequence
  chemically synthesized
ccatataatgtttccaaaaaca

SEQ ID NO: 782670 - DNA, 22 bp, Artificial Sequence
  chemically synthesized
ccaaaaacaatttgtatctatt

SEQ ID NO: 782671 - DNA, 22 bp, Artificial Sequence
  chemically synthesized
caaaaacaatttgtatctattt

SEQ ID NO: 782672 - DNA, 22 bp, Artificial Sequence
  chemically synthesized
aaaaaataaataaataaataaa

SEQ ID NO: 782673 - DNA, 22 bp, Artificial Sequence
  chemically synthesized
gtatctatttatttatttattt

SEQ ID NO: 782674 - DNA, 22 bp, Artificial Sequence
  chemically synthesized
tatctatttatttatttattta

SEQ ID NO: 782675 - DNA, 22 bp, Artificial Sequence
  chemically synthesized
catctcaaaaaataaataaata

SEQ ID NO: 782676 - DNA, 22 bp, Artificial Sequence
  chemically synthesized
tttatttatttatttatttatt

SEQ ID NO: 782677 - DNA, 22 bp, Artificial Sequence
  chemically synthesized
atttatttatttatttattttt

SEQ ID NO: 782678 - DNA, 22 bp, Artificial Sequence
  chemically synthesized
tttatttatttatttatttttt

SEQ ID NO: 782679 - DNA, 22 bp, Artificial Sequence
  chemically synthesized
atttatttatttattttttgag

SEQ ID NO: 782680 - DNA, 22 bp, Artificial Sequence
  chemically synthesized
tttatttatttattttttgaga

SEQ ID NO: 782681 - DNA, 22 bp, Artificial Sequence
  chemically synthesized
atttatttattttttgagatgg

SEQ ID NO: 782682 - DNA, 22 bp, Artificial Sequence
  chemically synthesized
tttatttattttttgagatgga

SEQ ID NO: 782683 - DNA, 22 bp, Artificial Sequence
  chemically synthesized
atttattttttgagatggagtt

SEQ ID NO: 782684 - DNA, 22 bp, Artificial Sequence
  chemically synthesized
tttattttttgagatggagttt

SEQ ID NO: 782685 - DNA, 22 bp, Artificial Sequence
  chemically synthesized
ggcaacaagagcgaaactccat

SEQ ID NO: 782686 - DNA, 22 bp, Artificial Sequence
  chemically synthesized
attttttgagatggagtttcgc

SEQ ID NO: 782687 - DNA, 22 bp, Artificial Sequence
  chemically synthesized
ttttttgagatggagtttcgct

SEQ ID NO: 782688 - DNA, 22 bp, Artificial Sequence
  chemically synthesized
tttgagatggagtttcgctctt

SEQ ID NO: 782689 - DNA, 22 bp, Artificial Sequence
  chemically synthesized
ttgagatggagtttcgctcttg

SEQ ID NO: 782690 - DNA, 22 bp, Artificial Sequence
  chemically synthesized
cagcctgggcaacaagagcgaa

SEQ ID NO: 782691 - DNA, 22 bp, Artificial Sequence
  chemically synthesized
tgagatggagtttcgctcttgt

SEQ ID NO: 782692 - DNA, 22 bp, Artificial Sequence
  chemically synthesized
gagatggagtttcgctcttgtt

SEQ ID NO: 782693 - DNA, 22 bp, Artificial Sequence
  chemically synthesized
agatggagtttcgctcttgttg

SEQ ID NO: 782694 - DNA, 22 bp, Artificial Sequence
  chemically synthesized
tactccagcctgggcaacaaga

SEQ ID NO: 782695 - DNA, 22 bp, Artificial Sequence
  chemically synthesized
cgctcttgttgcccaggctgga

SEQ ID NO: 782696 - DNA, 22 bp, Artificial Sequence
  chemically synthesized
gctcttgttgcccaggctggag

SEQ ID NO: 782697 - DNA, 22 bp, Artificial Sequence
  chemically synthesized
ttgttgcccaggctggagtaca

SEQ ID NO: 782698 - DNA, 22 bp, Artificial Sequence
  chemically synthesized
gttgcccaggctggagtacaat

SEQ ID NO: 782699 - DNA, 22 bp, Artificial Sequence
  chemically synthesized
ttgcccaggctggagtacaatg

SEQ ID NO: 782700 - DNA, 22 bp, Artificial Sequence
  chemically synthesized
cccaggctggagtacaatggtg

SEQ ID NO: 782701 - DNA, 22 bp, Artificial Sequence
  chemically synthesized
cagtgagccaagatcgcaccat

SEQ ID NO: 782702 - DNA, 22 bp, Artificial Sequence
  chemically synthesized
gagtacaatggtgcgatcttgg

SEQ ID NO: 782703 - DNA, 22 bp, Artificial Sequence
  chemically synthesized
aacccaggaggcggaggttgca

SEQ ID NO: 782704 - DNA, 22 bp, Artificial Sequence
  chemically synthesized
gaacccaggaggcggaggttgc

SEQ ID NO: 782705 - DNA, 22 bp, Artificial Sequence
  chemically synthesized
ggctcactgcaacctccgcctc

SEQ ID NO: 782706 - DNA, 22 bp, Artificial Sequence
  chemically synthesized
gctcactgcaacctccgcctcc

SEQ ID NO: 782707 - DNA, 22 bp, Artificial Sequence
  chemically synthesized
actgcaacctccgcctcctggg

SEQ ID NO: 782708 - DNA, 22 bp, Artificial Sequence
  chemically synthesized
caacctccgcctcctgggttca

SEQ ID NO: 782709 - DNA, 22 bp, Artificial Sequence
  chemically synthesized
aggcaggagaatcgcttgaacc

SEQ ID NO: 782710 - DNA, 22 bp, Artificial Sequence
  chemically synthesized
cgcctcctgggttcaagcgatt

SEQ ID NO: 782711 - DNA, 22 bp, Artificial Sequence
  chemically synthesized
ggaggctgaggcaggagaatcg

SEQ ID NO: 782712 - DNA, 22 bp, Artificial Sequence
  chemically synthesized
ctgggttcaagcgattctcctg

SEQ ID NO: 782713 - DNA, 22 bp, Artificial Sequence
  chemically synthesized
gggaggctgaggcaggagaatc

SEQ ID NO: 782714 - DNA, 22 bp, Artificial Sequence
  chemically synthesized
ggttcaagcgattctcctgcct

SEQ ID NO: 782715 - DNA, 22 bp, Artificial Sequence
  chemically synthesized
cttgggaggctgaggcaggaga

SEQ ID NO: 782716 - DNA, 22 bp, Artificial Sequence
  chemically synthesized
aagcgattctcctgcctcagcc

SEQ ID NO: 782717 - DNA, 22 bp, Artificial Sequence
  chemically synthesized
tagtcccagctacttgggaggc

SEQ ID NO: 782718 - DNA, 22 bp, Artificial Sequence
  chemically synthesized
tcctgcctcagcctcccaagta

SEQ ID NO: 782719 - DNA, 22 bp, Artificial Sequence
  chemically synthesized
ctgcctcagcctcccaagtagc

SEQ ID NO: 782720 - DNA, 22 bp, Artificial Sequence
  chemically synthesized
cctcagcctcccaagtagctgg

SEQ ID NO: 782721 - DNA, 22 bp, Artificial Sequence
  chemically synthesized
agcctcccaagtagctgggact

SEQ ID NO: 782722 - DNA, 22 bp, Artificial Sequence
  chemically synthesized
ccaagtagctgggactacaggc

SEQ ID NO: 782723 - DNA, 22 bp, Artificial Sequence
  chemically synthesized
ggcgtggtggtgggcgcctgta

SEQ ID NO: 782724 - DNA, 22 bp, Artificial Sequence
  chemically synthesized
gctgggcgtggtggtgggcgcc

SEQ ID NO: 782725 - DNA, 22 bp, Artificial Sequence
  chemically synthesized
ggactacaggcgcccaccacca

SEQ ID NO: 782726 - DNA, 22 bp, Artificial Sequence
  chemically synthesized
caggcgcccaccaccacgccca

SEQ ID NO: 782727 - DNA, 22 bp, Artificial Sequence
  chemically synthesized
aaaatacaaaaattagctgggc

SEQ ID NO: 782728 - DNA, 22 bp, Artificial Sequence
  chemically synthesized
ctaaaaatacaaaaattagctg

SEQ ID NO: 782729 - DNA, 22 bp, Artificial Sequence
  chemically synthesized
tactaaaaatacaaaaattagc

SEQ ID NO: 782730 - DNA, 22 bp, Artificial Sequence
  chemically synthesized
gtgaaaccccgtctctactaaa

SEQ ID NO: 782731 - DNA, 22 bp, Artificial Sequence
  chemically synthesized
atttttgtatttttagtagaga

SEQ ID NO: 782732 - DNA, 22 bp, Artificial Sequence
  chemically synthesized
ggtgaaaccccgtctctactaa

SEQ ID NO: 782733 - DNA, 22 bp, Artificial Sequence
  chemically synthesized
ttgtatttttagtagagacggg

SEQ ID NO: 782734 - DNA, 22 bp, Artificial Sequence
  chemically synthesized
tgtatttttagtagagacgggg

SEQ ID NO: 782735 - DNA, 22 bp, Artificial Sequence
  chemically synthesized
gtatttttagtagagacggggt

SEQ ID NO: 782736 - DNA, 22 bp, Artificial Sequence
  chemically synthesized
tatttttagtagagacggggtt

SEQ ID NO: 782737 - DNA, 22 bp, Artificial Sequence
  chemically synthesized
gccaacttggtgaaaccccgtc

SEQ ID NO: 782738 - DNA, 22 bp, Artificial Sequence
  chemically synthesized
ttagtagagacggggtttcacc

SEQ ID NO: 782739 - DNA, 22 bp, Artificial Sequence
  chemically synthesized
tagtagagacggggtttcacca

SEQ ID NO: 782740 - DNA, 22 bp, Artificial Sequence
  chemically synthesized
agtagagacggggtttcaccaa

SEQ ID NO: 782741 - DNA, 22 bp, Artificial Sequence
  chemically synthesized
gtagagacggggtttcaccaag

SEQ ID NO: 782742 - DNA, 22 bp, Artificial Sequence
  chemically synthesized
aagaccagcctagccaacttgg

SEQ ID NO: 782743 - DNA, 22 bp, Artificial Sequence
  chemically synthesized
aggagttcaagaccagcctagc

SEQ ID NO: 782744 - DNA, 22 bp, Artificial Sequence
  chemically synthesized
caccaagttggctaggctggtc

SEQ ID NO: 782745 - DNA, 22 bp, Artificial Sequence
  chemically synthesized
accaagttggctaggctggtct

SEQ ID NO: 782746 - DNA, 22 bp, Artificial Sequence
  chemically synthesized
cctgaggagttcaagaccagcc

SEQ ID NO: 782747 - DNA, 22 bp, Artificial Sequence
  chemically synthesized
gctaggctggtcttgaactcct

SEQ ID NO: 782748 - DNA, 22 bp, Artificial Sequence
  chemically synthesized
ggctggtcttgaactcctcagg

SEQ ID NO: 782749 - DNA, 22 bp, Artificial Sequence
  chemically synthesized
aggtgggtggattacctgagga

SEQ ID NO: 782750 - DNA, 22 bp, Artificial Sequence
  chemically synthesized
gtcttgaactcctcaggtaatc

SEQ ID NO: 782751 - DNA, 22 bp, Artificial Sequence
  chemically synthesized
gaactcctcaggtaatccaccc

SEQ ID NO: 782752 - DNA, 22 bp, Artificial Sequence
  chemically synthesized
ggagtctgaggtgggtggatta

SEQ ID NO: 782753 - DNA, 22 bp, Artificial Sequence
  chemically synthesized
aactcctcaggtaatccaccca

SEQ ID NO: 782754 - DNA, 22 bp, Artificial Sequence
  chemically synthesized
gggagtctgaggtgggtggatt

SEQ ID NO: 782755 - DNA, 22 bp, Artificial Sequence
  chemically synthesized
tgggagtctgaggtgggtggat

SEQ ID NO: 782756 - DNA, 22 bp, Artificial Sequence
  chemically synthesized
ctcaggtaatccacccacctca

SEQ ID NO: 782757 - DNA, 22 bp, Artificial Sequence
  chemically synthesized
aggtaatccacccacctcagac

SEQ ID NO: 782758 - DNA, 22 bp, Artificial Sequence
  chemically synthesized
taatcccagcactttgggagtc

SEQ ID NO: 782759 - DNA, 22 bp, Artificial Sequence
  chemically synthesized
cgcctgtaatcccagcactttg

SEQ ID NO: 782760 - DNA, 22 bp, Artificial Sequence
  chemically synthesized
acgcctgtaatcccagcacttt

SEQ ID NO: 782761 - DNA, 22 bp, Artificial Sequence
  chemically synthesized
agactcccaaagtgctgggatt

SEQ ID NO: 782762 - DNA, 22 bp, Artificial Sequence
  chemically synthesized
ccaaagtgctgggattacaggc

SEQ ID NO: 782763 - DNA, 22 bp, Artificial Sequence
  chemically synthesized
gaggccgggcatggtggcttac

SEQ ID NO: 782764 - DNA, 22 bp, Artificial Sequence
  chemically synthesized
ggattacaggcgtaagccacca

SEQ ID NO: 782765 - DNA, 22 bp, Artificial Sequence
  chemically synthesized
ggaggccgggcatggtggctta

SEQ ID NO: 782766 - DNA, 22 bp, Artificial Sequence
  chemically synthesized
tggaggccgggcatggtggctt

SEQ ID NO: 782767 - DNA, 22 bp, Artificial Sequence
  chemically synthesized
ttggaggccgggcatggtggct

SEQ ID NO: 782768 - DNA, 22 bp, Artificial Sequence
  chemically synthesized
tttttggaggccgggcatggtg

SEQ ID NO: 782769 - DNA, 22 bp, Artificial Sequence
  chemically synthesized
caggcgtaagccaccatgcccg

SEQ ID NO: 782770 - DNA, 22 bp, Artificial Sequence
  chemically synthesized
agagtccagaagcagatcagat

SEQ ID NO: 782771 - DNA, 22 bp, Artificial Sequence
  chemically synthesized
caaaaacaatctgatctgcttc

SEQ ID NO: 782772 - DNA, 22 bp, Artificial Sequence
  chemically synthesized
aagcaaaattgagagtccagaa

SEQ ID NO: 782773 - DNA, 22 bp, Artificial Sequence
  chemically synthesized
atctgcttctggactctcaatt

SEQ ID NO: 782774 - DNA, 22 bp, Artificial Sequence
  chemically synthesized
cttctggactctcaattttgct

SEQ ID NO: 782775 - DNA, 22 bp, Artificial Sequence
  chemically synthesized
ctggactctcaattttgcttca

SEQ ID NO: 782776 - DNA, 22 bp, Artificial Sequence
  chemically synthesized
tggactctcaattttgcttcag

SEQ ID NO: 782777 - DNA, 22 bp, Artificial Sequence
  chemically synthesized
gactctcaattttgcttcagtg

SEQ ID NO: 782778 - DNA, 22 bp, Artificial Sequence
  chemically synthesized
tcaattttgcttcagtgatcta

SEQ ID NO: 782779 - DNA, 22 bp, Artificial Sequence
  chemically synthesized
aattttgcttcagtgatctact

SEQ ID NO: 782780 - DNA, 22 bp, Artificial Sequence
  chemically synthesized
gcacaaaacaagacaagtagat

SEQ ID NO: 782781 - DNA, 22 bp, Artificial Sequence
  chemically synthesized
tgcttcagtgatctacttgtct

SEQ ID NO: 782782 - DNA, 22 bp, Artificial Sequence
  chemically synthesized
gcttcagtgatctacttgtctt

SEQ ID NO: 782783 - DNA, 22 bp, Artificial Sequence
  chemically synthesized
cttcagtgatctacttgtcttg

SEQ ID NO: 782784 - DNA, 22 bp, Artificial Sequence
  chemically synthesized
cagtgatctacttgtcttgttt

SEQ ID NO: 782785 - DNA, 22 bp, Artificial Sequence
  chemically synthesized
agtgatctacttgtcttgtttt

SEQ ID NO: 782786 - DNA, 22 bp, Artificial Sequence
  chemically synthesized
cttgtcttgttttgtgctaata

SEQ ID NO: 782787 - DNA, 22 bp, Artificial Sequence
  chemically synthesized
gtcttgttttgtgctaatacta

SEQ ID NO: 782788 - DNA, 22 bp, Artificial Sequence
  chemically synthesized
tcttgttttgtgctaatactat

SEQ ID NO: 782789 - DNA, 22 bp, Artificial Sequence
  chemically synthesized
taatccaaatagtatagtatta

SEQ ID NO: 782790 - DNA, 22 bp, Artificial Sequence
  chemically synthesized
gttttgtgctaatactatacta

SEQ ID NO: 782791 - DNA, 22 bp, Artificial Sequence
  chemically synthesized
ctgtaatccaaatagtatagta

SEQ ID NO: 782792 - DNA, 22 bp, Artificial Sequence
  chemically synthesized
ttttgtgctaatactatactat

SEQ ID NO: 782793 - DNA, 22 bp, Artificial Sequence
  chemically synthesized
tgtgctaatactatactatttg

SEQ ID NO: 782794 - DNA, 22 bp, Artificial Sequence
  chemically synthesized
gtgctaatactatactatttgg

SEQ ID NO: 782795 - DNA, 22 bp, Artificial Sequence
  chemically synthesized
tgctaatactatactatttgga

SEQ ID NO: 782796 - DNA, 22 bp, Artificial Sequence
  chemically synthesized
taaagctactgtaatccaaata

SEQ ID NO: 782797 - DNA, 22 bp, Artificial Sequence
  chemically synthesized
atactatactatttggattaca

SEQ ID NO: 782798 - DNA, 22 bp, Artificial Sequence
  chemically synthesized
ctgtaaagctactgtaatccaa

SEQ ID NO: 782799 - DNA, 22 bp, Artificial Sequence
  chemically synthesized
gctgtaaagctactgtaatcca

SEQ ID NO: 782800 - DNA, 22 bp, Artificial Sequence
  chemically synthesized
tactatttggattacagtagct

SEQ ID NO: 782801 - DNA, 22 bp, Artificial Sequence
  chemically synthesized
aacttgctgtaaagctactgta

SEQ ID NO: 782802 - DNA, 22 bp, Artificial Sequence
  chemically synthesized
tttggattacagtagctttaca

SEQ ID NO: 782803 - DNA, 22 bp, Artificial Sequence
  chemically synthesized
ggattacagtagctttacagca

SEQ ID NO: 782804 - DNA, 22 bp, Artificial Sequence
  chemically synthesized
gattacagtagctttacagcaa

SEQ ID NO: 782805 - DNA, 22 bp, Artificial Sequence
  chemically synthesized
tccaatattaaacttgctgtaa

SEQ ID NO: 782806 - DNA, 22 bp, Artificial Sequence
  chemically synthesized
atccaatattaaacttgctgta

SEQ ID NO: 782807 - DNA, 22 bp, Artificial Sequence
  chemically synthesized
cagtagctttacagcaagttta

SEQ ID NO: 782808 - DNA, 22 bp, Artificial Sequence
  chemically synthesized
ccttatccaatattaaacttgc

SEQ ID NO: 782809 - DNA, 22 bp, Artificial Sequence
  chemically synthesized
gccttatccaatattaaacttg

SEQ ID NO: 782810 - DNA, 22 bp, Artificial Sequence
  chemically synthesized
tacagcaagtttaatattggat

SEQ ID NO: 782811 - DNA, 22 bp, Artificial Sequence
  chemically synthesized
acagcaagtttaatattggata

SEQ ID NO: 782812 - DNA, 22 bp, Artificial Sequence
  chemically synthesized
cagcaagtttaatattggataa

SEQ ID NO: 782813 - DNA, 22 bp, Artificial Sequence
  chemically synthesized
aatattggataaggcaagcccc

SEQ ID NO: 782814 - DNA, 22 bp, Artificial Sequence
  chemically synthesized
atattggataaggcaagccccc

SEQ ID NO: 782815 - DNA, 22 bp, Artificial Sequence
  chemically synthesized
catcaataataagggagggggc

SEQ ID NO: 782816 - DNA, 22 bp, Artificial Sequence
  chemically synthesized
gataaggcaagccccctccctt

SEQ ID NO: 782817 - DNA, 22 bp, Artificial Sequence
  chemically synthesized
tgcatcaataataagggagggg

SEQ ID NO: 782818 - DNA, 22 bp, Artificial Sequence
  chemically synthesized
ccttattattgatgcagagaca

SEQ ID NO: 782819 - DNA, 22 bp, Artificial Sequence
  chemically synthesized
attattgatgcagagacattta

SEQ ID NO: 782820 - DNA, 22 bp, Artificial Sequence
  chemically synthesized
ttattgatgcagagacatttat

SEQ ID NO: 782821 - DNA, 22 bp, Artificial Sequence
  chemically synthesized
ttgatgcagagacatttattat

SEQ ID NO: 782822 - DNA, 22 bp, Artificial Sequence
  chemically synthesized
atgcagagacatttattatttt

SEQ ID NO: 782823 - DNA, 22 bp, Artificial Sequence
  chemically synthesized
aggaatgcatgaaaaataataa

SEQ ID NO: 782824 - DNA, 22 bp, Artificial Sequence
  chemically synthesized
attatttttcatgcattcctga

SEQ ID NO: 782825 - DNA, 22 bp, Artificial Sequence
  chemically synthesized
ttatttttcatgcattcctgag

SEQ ID NO: 782826 - DNA, 22 bp, Artificial Sequence
  chemically synthesized
tttttcatgcattcctgagata

SEQ ID NO: 782827 - DNA, 22 bp, Artificial Sequence
  chemically synthesized
ttcatgcattcctgagatactt

SEQ ID NO: 782828 - DNA, 22 bp, Artificial Sequence
  chemically synthesized
tcatgcattcctgagatacttg

SEQ ID NO: 782829 - DNA, 22 bp, Artificial Sequence
  chemically synthesized
catgcattcctgagatacttgc

SEQ ID NO: 782830 - DNA, 22 bp, Artificial Sequence
  chemically synthesized
atgcattcctgagatacttgcg

SEQ ID NO: 782831 - DNA, 22 bp, Artificial Sequence
  chemically synthesized
atatgaaataataaataatcgc

SEQ ID NO: 782832 - DNA, 22 bp, Artificial Sequence
  chemically synthesized
ctgagatacttgcgattattta

SEQ ID NO: 782833 - DNA, 22 bp, Artificial Sequence
  chemically synthesized
agatacttgcgattatttatta

SEQ ID NO: 782834 - DNA, 22 bp, Artificial Sequence
  chemically synthesized
aagttcatatgaaataataaat

SEQ ID NO: 782835 - DNA, 22 bp, Artificial Sequence
  chemically synthesized
aaagttcatatgaaataataaa

SEQ ID NO: 782836 - DNA, 22 bp, Artificial Sequence
  chemically synthesized
taaagttcatatgaaataataa

SEQ ID NO: 782837 - DNA, 22 bp, Artificial Sequence
  chemically synthesized
ttaaagttcatatgaaataata

SEQ ID NO: 782838 - DNA, 22 bp, Artificial Sequence
  chemically synthesized
gcgattatttattatttcatat

SEQ ID NO: 782839 - DNA, 22 bp, Artificial Sequence
  chemically synthesized
cgattatttattatttcatatg

SEQ ID NO: 782840 - DNA, 22 bp, Artificial Sequence
  chemically synthesized
tttattatttcatatgaacttt

SEQ ID NO: 782841 - DNA, 22 bp, Artificial Sequence
  chemically synthesized
attatttcatatgaactttaaa

SEQ ID NO: 782842 - DNA, 22 bp, Artificial Sequence
  chemically synthesized
ttatttcatatgaactttaaaa

SEQ ID NO: 782843 - DNA, 22 bp, Artificial Sequence
  chemically synthesized
aggaggggagacttttaaagtt

SEQ ID NO: 782844 - DNA, 22 bp, Artificial Sequence
  chemically synthesized
tttcatatgaactttaaaagtc

SEQ ID NO: 782845 - DNA, 22 bp, Artificial Sequence
  chemically synthesized
catatgaactttaaaagtctcc

SEQ ID NO: 782846 - DNA, 22 bp, Artificial Sequence
  chemically synthesized
atatgaactttaaaagtctccc

SEQ ID NO: 782847 - DNA, 22 bp, Artificial Sequence
  chemically synthesized
aaggcaagatatattgaggagg

SEQ ID NO: 782848 - DNA, 22 bp, Artificial Sequence
  chemically synthesized
taaaagtctcccctcctcaata

SEQ ID NO: 782849 - DNA, 22 bp, Artificial Sequence
  chemically synthesized
gaaggcaagatatattgaggag

SEQ ID NO: 782850 - DNA, 22 bp, Artificial Sequence
  chemically synthesized
aaaagtctcccctcctcaatat

SEQ ID NO: 782851 - DNA, 22 bp, Artificial Sequence
  chemically synthesized
aaagtctcccctcctcaatata

SEQ ID NO: 782852 - DNA, 22 bp, Artificial Sequence
  chemically synthesized
aagtgccttgaaggcaagatat

SEQ ID NO: 782853 - DNA, 22 bp, Artificial Sequence
  chemically synthesized
ccctcctcaatatatcttgcct

SEQ ID NO: 782854 - DNA, 22 bp, Artificial Sequence
  chemically synthesized
caagtgccttgaaggcaagata

SEQ ID NO: 782855 - DNA, 22 bp, Artificial Sequence
  chemically synthesized
ctcaatatatcttgccttcaag

SEQ ID NO: 782856 - DNA, 22 bp, Artificial Sequence
  chemically synthesized
taaatttcaagtgccttgaagg

SEQ ID NO: 782857 - DNA, 22 bp, Artificial Sequence
  chemically synthesized
aatatatcttgccttcaaggca

SEQ ID NO: 782858 - DNA, 22 bp, Artificial Sequence
  chemically synthesized
cctgtaaatttcaagtgccttg

SEQ ID NO: 782859 - DNA, 22 bp, Artificial Sequence
  chemically synthesized
aattccctgtaaatttcaagtg

SEQ ID NO: 782860 - DNA, 22 bp, Artificial Sequence
  chemically synthesized
aaattccctgtaaatttcaagt

SEQ ID NO: 782861 - DNA, 22 bp, Artificial Sequence
  chemically synthesized
gccttcaaggcacttgaaattt

SEQ ID NO: 782862 - DNA, 22 bp, Artificial Sequence
  chemically synthesized
ccttcaaggcacttgaaattta

SEQ ID NO: 782863 - DNA, 22 bp, Artificial Sequence
  chemically synthesized
caaggcacttgaaatttacagg

SEQ ID NO: 782864 - DNA, 22 bp, Artificial Sequence
  chemically synthesized
gaatttaaattccctgtaaatt

SEQ ID NO: 782865 - DNA, 22 bp, Artificial Sequence
  chemically synthesized
aaggcacttgaaatttacaggg

SEQ ID NO: 782866 - DNA, 22 bp, Artificial Sequence
  chemically synthesized
ggaatttaaattccctgtaaat

SEQ ID NO: 782867 - DNA, 22 bp, Artificial Sequence
  chemically synthesized
aatcttggaatttaaattccct

SEQ ID NO: 782868 - DNA, 22 bp, Artificial Sequence
  chemically synthesized
aaatcttggaatttaaattccc

SEQ ID NO: 782869 - DNA, 22 bp, Artificial Sequence
  chemically synthesized
gaaatttacagggaatttaaat

SEQ ID NO: 782870 - DNA, 22 bp, Artificial Sequence
  chemically synthesized
aaatttacagggaatttaaatt

SEQ ID NO: 782871 - DNA, 22 bp, Artificial Sequence
  chemically synthesized
tttaaatcttggaatttaaatt

SEQ ID NO: 782872 - DNA, 22 bp, Artificial Sequence
  chemically synthesized
atttaaatcttggaatttaaat

SEQ ID NO: 782873 - DNA, 22 bp, Artificial Sequence
  chemically synthesized
tatttaaatcttggaatttaaa

SEQ ID NO: 782874 - DNA, 22 bp, Artificial Sequence
  chemically synthesized
acagggaatttaaattccaaga

SEQ ID NO: 782875 - DNA, 22 bp, Artificial Sequence
  chemically synthesized
cagggaatttaaattccaagat

SEQ ID NO: 782876 - DNA, 22 bp, Artificial Sequence
  chemically synthesized
tcaagattttatttaaatcttg

SEQ ID NO: 782877 - DNA, 22 bp, Artificial Sequence
  chemically synthesized
atcaagattttatttaaatctt

SEQ ID NO: 782878 - DNA, 22 bp, Artificial Sequence
  chemically synthesized
aaattccaagatttaaataaaa

SEQ ID NO: 782879 - DNA, 22 bp, Artificial Sequence
  chemically synthesized
ggcttatcaagattttatttaa

SEQ ID NO: 782880 - DNA, 22 bp, Artificial Sequence
  chemically synthesized
aattccaagatttaaataaaat

SEQ ID NO: 782881 - DNA, 22 bp, Artificial Sequence
  chemically synthesized
aggcttatcaagattttattta

SEQ ID NO: 782882 - DNA, 22 bp, Artificial Sequence
  chemically synthesized
taggcttatcaagattttattt

SEQ ID NO: 782883 - DNA, 22 bp, Artificial Sequence
  chemically synthesized
caagatttaaataaaatcttga

SEQ ID NO: 782884 - DNA, 22 bp, Artificial Sequence
  chemically synthesized
tagtattttaggcttatcaaga

SEQ ID NO: 782885 - DNA, 22 bp, Artificial Sequence
  chemically synthesized
atagtattttaggcttatcaag

SEQ ID NO: 782886 - DNA, 22 bp, Artificial Sequence
  chemically synthesized
aaataaaatcttgataagccta

SEQ ID NO: 782887 - DNA, 22 bp, Artificial Sequence
  chemically synthesized
aataaaatcttgataagcctaa

SEQ ID NO: 782888 - DNA, 22 bp, Artificial Sequence
  chemically synthesized
atagaatagatttatagtattt

SEQ ID NO: 782889 - DNA, 22 bp, Artificial Sequence
  chemically synthesized
catagaatagatttatagtatt

SEQ ID NO: 782890 - DNA, 22 bp, Artificial Sequence
  chemically synthesized
gataagcctaaaatactataaa

SEQ ID NO: 782891 - DNA, 22 bp, Artificial Sequence
  chemically synthesized
ataagcctaaaatactataaat

SEQ ID NO: 782892 - DNA, 22 bp, Artificial Sequence
  chemically synthesized
tttcatagaatagatttatagt

SEQ ID NO: 782893 - DNA, 22 bp, Artificial Sequence
  chemically synthesized
gtgtctgtttcatagaatagat

SEQ ID NO: 782894 - DNA, 22 bp, Artificial Sequence
  chemically synthesized
aaatactataaatctattctat

SEQ ID NO: 782895 - DNA, 22 bp, Artificial Sequence
  chemically synthesized
atattggtgtctgtttcataga

SEQ ID NO: 782896 - DNA, 22 bp, Artificial Sequence
  chemically synthesized
aatattggtgtctgtttcatag

SEQ ID NO: 782897 - DNA, 22 bp, Artificial Sequence
  chemically synthesized
taaatctattctatgaaacaga

SEQ ID NO: 782898 - DNA, 22 bp, Artificial Sequence
  chemically synthesized
ccttaatattggtgtctgtttc

SEQ ID NO: 782899 - DNA, 22 bp, Artificial Sequence
  chemically synthesized
gccttaatattggtgtctgttt

SEQ ID NO: 782900 - DNA, 22 bp, Artificial Sequence
  chemically synthesized
tgccttaatattggtgtctgtt

SEQ ID NO: 782901 - DNA, 22 bp, Artificial Sequence
  chemically synthesized
ttttgccttaatattggtgtct

SEQ ID NO: 782902 - DNA, 22 bp, Artificial Sequence
  chemically synthesized
ttctatgaaacagacaccaata

SEQ ID NO: 782903 - DNA, 22 bp, Artificial Sequence
  chemically synthesized
tatgaaacagacaccaatatta

SEQ ID NO: 782904 - DNA, 22 bp, Artificial Sequence
  chemically synthesized
attgttttgccttaatattggt

SEQ ID NO: 782905 - DNA, 22 bp, Artificial Sequence
  chemically synthesized
cattgttttgccttaatattgg

SEQ ID NO: 782906 - DNA, 22 bp, Artificial Sequence
  chemically synthesized
tgaaacagacaccaatattaag

SEQ ID NO: 782907 - DNA, 22 bp, Artificial Sequence
  chemically synthesized
tcattgttttgccttaatattg

SEQ ID NO: 782908 - DNA, 22 bp, Artificial Sequence
  chemically synthesized
actttcattgttttgccttaat

SEQ ID NO: 782909 - DNA, 22 bp, Artificial Sequence
  chemically synthesized
cactttcattgttttgccttaa

SEQ ID NO: 782910 - DNA, 22 bp, Artificial Sequence
  chemically synthesized
tcactttcattgttttgcctta

SEQ ID NO: 782911 - DNA, 22 bp, Artificial Sequence
  chemically synthesized
gttttcactttcattgttttgc

SEQ ID NO: 782912 - DNA, 22 bp, Artificial Sequence
  chemically synthesized
ttggttttcactttcattgttt

SEQ ID NO: 782913 - DNA, 22 bp, Artificial Sequence
  chemically synthesized
attggttttcactttcattgtt

SEQ ID NO: 782914 - DNA, 22 bp, Artificial Sequence
  chemically synthesized
tattggttttcactttcattgt

SEQ ID NO: 782915 - DNA, 22 bp, Artificial Sequence
  chemically synthesized
aggcaaaacaatgaaagtgaaa

SEQ ID NO: 782916 - DNA, 22 bp, Artificial Sequence
  chemically synthesized
aacattttattggttttcactt

SEQ ID NO: 782917 - DNA, 22 bp, Artificial Sequence
  chemically synthesized
tgaacattttattggttttcac

SEQ ID NO: 782918 - DNA, 22 bp, Artificial Sequence
  chemically synthesized
agcagtgctctgaacattttat

SEQ ID NO: 782919 - DNA, 22 bp, Artificial Sequence
  chemically synthesized
aagcagtgctctgaacatttta

SEQ ID NO: 782920 - DNA, 22 bp, Artificial Sequence
  chemically synthesized
tttaagcagtgctctgaacatt

SEQ ID NO: 782921 - DNA, 22 bp, Artificial Sequence
  chemically synthesized
tggatgtatcataatctattta

SEQ ID NO: 782922 - DNA, 22 bp, Artificial Sequence
  chemically synthesized
agagcactgcttaaatagatta

SEQ ID NO: 782923 - DNA, 22 bp, Artificial Sequence
  chemically synthesized
gtggatgtatcataatctattt

SEQ ID NO: 782924 - DNA, 22 bp, Artificial Sequence
  chemically synthesized
tgtggatgtatcataatctatt

SEQ ID NO: 782925 - DNA, 22 bp, Artificial Sequence
  chemically synthesized
cattttgtggatgtatcataat

SEQ ID NO: 782926 - DNA, 22 bp, Artificial Sequence
  chemically synthesized
cttaaatagattatgatacatc

SEQ ID NO: 782927 - DNA, 22 bp, Artificial Sequence
  chemically synthesized
ttccattttgtggatgtatcat

SEQ ID NO: 782928 - DNA, 22 bp, Artificial Sequence
  chemically synthesized
aaatagattatgatacatccac

SEQ ID NO: 782929 - DNA, 22 bp, Artificial Sequence
  chemically synthesized
aatagattatgatacatccaca

SEQ ID NO: 782930 - DNA, 22 bp, Artificial Sequence
  chemically synthesized
catattgttccattttgtggat

SEQ ID NO: 782931 - DNA, 22 bp, Artificial Sequence
  chemically synthesized
tgatacatccacaaaatggaac

SEQ ID NO: 782932 - DNA, 22 bp, Artificial Sequence
  chemically synthesized
atgactacatattgttccattt

SEQ ID NO: 782933 - DNA, 22 bp, Artificial Sequence
  chemically synthesized
aatgactacatattgttccatt

SEQ ID NO: 782934 - DNA, 22 bp, Artificial Sequence
  chemically synthesized
gtttaatgactacatattgttc

SEQ ID NO: 782935 - DNA, 22 bp, Artificial Sequence
  chemically synthesized
accgttagtttaatgactacat

SEQ ID NO: 782936 - DNA, 22 bp, Artificial Sequence
  chemically synthesized
aaccgttagtttaatgactaca

SEQ ID NO: 782937 - DNA, 22 bp, Artificial Sequence
  chemically synthesized
aacccatagcaaagaacttaac

SEQ ID NO: 782938 - DNA, 22 bp, Artificial Sequence
  chemically synthesized
aactaacggttaagttctttgc

SEQ ID NO: 782939 - DNA, 22 bp, Artificial Sequence
  chemically synthesized
acggttaagttctttgctatgg

SEQ ID NO: 782940 - DNA, 22 bp, Artificial Sequence
  chemically synthesized
gacagaattcaacccatagcaa

SEQ ID NO: 782941 - DNA, 22 bp, Artificial Sequence
  chemically synthesized
ggacagaattcaacccatagca

SEQ ID NO: 782942 - DNA, 22 bp, Artificial Sequence
  chemically synthesized
agttctttgctatgggttgaat

SEQ ID NO: 782943 - DNA, 22 bp, Artificial Sequence
  chemically synthesized
tttgctatgggttgaattctgt

SEQ ID NO: 782944 - DNA, 22 bp, Artificial Sequence
  chemically synthesized
gagaaaatttggacagaattca

SEQ ID NO: 782945 - DNA, 22 bp, Artificial Sequence
  chemically synthesized
ggagaaaatttggacagaattc

SEQ ID NO: 782946 - DNA, 22 bp, Artificial Sequence
  chemically synthesized
tgctatgggttgaattctgtcc

SEQ ID NO: 782947 - DNA, 22 bp, Artificial Sequence
  chemically synthesized
gctatgggttgaattctgtcca

SEQ ID NO: 782948 - DNA, 22 bp, Artificial Sequence
  chemically synthesized
ctatgggttgaattctgtccaa

SEQ ID NO: 782949 - DNA, 22 bp, Artificial Sequence
  chemically synthesized
aatttggagaaaatttggacag

SEQ ID NO: 782950 - DNA, 22 bp, Artificial Sequence
  chemically synthesized
tgggttgaattctgtccaaatt

SEQ ID NO: 782951 - DNA, 22 bp, Artificial Sequence
  chemically synthesized
aaatttggagaaaatttggaca

SEQ ID NO: 782952 - DNA, 22 bp, Artificial Sequence
  chemically synthesized
aattctgtccaaattttctcca

SEQ ID NO: 782953 - DNA, 22 bp, Artificial Sequence
  chemically synthesized
aacatttaaatttggagaaaat

SEQ ID NO: 782954 - DNA, 22 bp, Artificial Sequence
  chemically synthesized
caacatttaaatttggagaaaa

SEQ ID NO: 782955 - DNA, 22 bp, Artificial Sequence
  chemically synthesized
tgtccaaattttctccaaattt

SEQ ID NO: 782956 - DNA, 22 bp, Artificial Sequence
  chemically synthesized
tccaaattttctccaaatttaa

SEQ ID NO: 782957 - DNA, 22 bp, Artificial Sequence
  chemically synthesized
ggacttcaacatttaaatttgg

SEQ ID NO: 782958 - DNA, 22 bp, Artificial Sequence
  chemically synthesized
tctccaaatttaaatgttgaag

SEQ ID NO: 782959 - DNA, 22 bp, Artificial Sequence
  chemically synthesized
ctccaaatttaaatgttgaagt

SEQ ID NO: 782960 - DNA, 22 bp, Artificial Sequence
  chemically synthesized
tccaaatttaaatgttgaagtc

SEQ ID NO: 782961 - DNA, 22 bp, Artificial Sequence
  chemically synthesized
caaatttaaatgttgaagtcct

SEQ ID NO: 782962 - DNA, 22 bp, Artificial Sequence
  chemically synthesized
aggtaccaggggttaggacttc

SEQ ID NO: 782963 - DNA, 22 bp, Artificial Sequence
  chemically synthesized
tgaggtaccaggggttaggact

SEQ ID NO: 782964 - DNA, 22 bp, Artificial Sequence
  chemically synthesized
aaatgttgaagtcctaacccct

SEQ ID NO: 782965 - DNA, 22 bp, Artificial Sequence
  chemically synthesized
aatgttgaagtcctaacccctg

SEQ ID NO: 782966 - DNA, 22 bp, Artificial Sequence
  chemically synthesized
aagtcctaacccctggtacctc

SEQ ID NO: 782967 - DNA, 22 bp, Artificial Sequence
  chemically synthesized
caaatagggtcacattctgagg

SEQ ID NO: 782968 - DNA, 22 bp, Artificial Sequence
  chemically synthesized
acccctggtacctcagaatgtg

SEQ ID NO: 782969 - DNA, 22 bp, Artificial Sequence
  chemically synthesized
tctccaaatagggtcacattct

SEQ ID NO: 782970 - DNA, 22 bp, Artificial Sequence
  chemically synthesized
gtacctcagaatgtgaccctat

SEQ ID NO: 782971 - DNA, 22 bp, Artificial Sequence
  chemically synthesized
taatgaccctatctccaaatag

SEQ ID NO: 782972 - DNA, 22 bp, Artificial Sequence
  chemically synthesized
agaatgtgaccctatttggaga

SEQ ID NO: 782973 - DNA, 22 bp, Artificial Sequence
  chemically synthesized
tgtaatgaccctatctccaaat

SEQ ID NO: 782974 - DNA, 22 bp, Artificial Sequence
  chemically synthesized
tctctgtaatgaccctatctcc

SEQ ID NO: 782975 - DNA, 22 bp, Artificial Sequence
  chemically synthesized
attatctctgtaatgaccctat

SEQ ID NO: 782976 - DNA, 22 bp, Artificial Sequence
  chemically synthesized
tttggagatagggtcattacag

SEQ ID NO: 782977 - DNA, 22 bp, Artificial Sequence
  chemically synthesized
agttgattatctctgtaatgac

SEQ ID NO: 782978 - DNA, 22 bp, Artificial Sequence
  chemically synthesized
aagttgattatctctgtaatga

SEQ ID NO: 782979 - DNA, 22 bp, Artificial Sequence
  chemically synthesized
taagttgattatctctgtaatg

SEQ ID NO: 782980 - DNA, 22 bp, Artificial Sequence
  chemically synthesized
ggagatagggtcattacagaga

SEQ ID NO: 782981 - DNA, 22 bp, Artificial Sequence
  chemically synthesized
gagatagggtcattacagagat

SEQ ID NO: 782982 - DNA, 22 bp, Artificial Sequence
  chemically synthesized
attttaagttgattatctctgt

SEQ ID NO: 782983 - DNA, 22 bp, Artificial Sequence
  chemically synthesized
cagagataatcaacttaaaatg

SEQ ID NO: 782984 - DNA, 22 bp, Artificial Sequence
  chemically synthesized
aggcccaaccaaatgacctcat

SEQ ID NO: 782985 - DNA, 22 bp, Artificial Sequence
  chemically synthesized
gactcaggcccaaccaaatgac

SEQ ID NO: 782986 - DNA, 22 bp, Artificial Sequence
  chemically synthesized
aaaatgaggtcatttggttggg

SEQ ID NO: 782987 - DNA, 22 bp, Artificial Sequence
  chemically synthesized
aaatgaggtcatttggttgggc

SEQ ID NO: 782988 - DNA, 22 bp, Artificial Sequence
  chemically synthesized
aggacagagtcatattggactc

SEQ ID NO: 782989 - DNA, 22 bp, Artificial Sequence
  chemically synthesized
aaggacagagtcatattggact

SEQ ID NO: 782990 - DNA, 22 bp, Artificial Sequence
  chemically synthesized
ggttgggcctgagtccaatatg

SEQ ID NO: 782991 - DNA, 22 bp, Artificial Sequence
  chemically synthesized
taaggacagagtcatattggac

SEQ ID NO: 782992 - DNA, 22 bp, Artificial Sequence
  chemically synthesized
gttgggcctgagtccaatatga

SEQ ID NO: 782993 - DNA, 22 bp, Artificial Sequence
  chemically synthesized
ttaaggacagagtcatattgga

SEQ ID NO: 782994 - DNA, 22 bp, Artificial Sequence
  chemically synthesized
ggcctgagtccaatatgactct

SEQ ID NO: 782995 - DNA, 22 bp, Artificial Sequence
  chemically synthesized
cccttttaaggacagagtcata

SEQ ID NO: 782996 - DNA, 22 bp, Artificial Sequence
  chemically synthesized
ccccttttaaggacagagtcat

SEQ ID NO: 782997 - DNA, 22 bp, Artificial Sequence
  chemically synthesized
agtccaatatgactctgtcctt

SEQ ID NO: 782998 - DNA, 22 bp, Artificial Sequence
  chemically synthesized
caacttccccttttaaggacag

SEQ ID NO: 782999 - DNA, 22 bp, Artificial Sequence
  chemically synthesized
tctccaacttccccttttaagg

SEQ ID NO: 783000 - DNA, 22 bp, Artificial Sequence
  chemically synthesized
tgtccttaaaaggggaagttgg

SEQ ID NO: 783001 - DNA, 22 bp, Artificial Sequence
  chemically synthesized
tccttaaaaggggaagttggag

SEQ ID NO: 783002 - DNA, 22 bp, Artificial Sequence
  chemically synthesized
tgtacgtgtctgtctccaactt

SEQ ID NO: 783003 - DNA, 22 bp, Artificial Sequence
  chemically synthesized
aaaaggggaagttggagacaga

SEQ ID NO: 783004 - DNA, 22 bp, Artificial Sequence
  chemically synthesized
aaaggggaagttggagacagac

SEQ ID NO: 783005 - DNA, 22 bp, Artificial Sequence
  chemically synthesized
acatggcatgccccctgtgtac

SEQ ID NO: 783006 - DNA, 22 bp, Artificial Sequence
  chemically synthesized
gagacagacacgtacacagggg

SEQ ID NO: 783007 - DNA, 22 bp, Artificial Sequence
  chemically synthesized
cacatggcatgccccctgtgta

SEQ ID NO: 783008 - DNA, 22 bp, Artificial Sequence
  chemically synthesized
tcacatggcatgccccctgtgt

SEQ ID NO: 783009 - DNA, 22 bp, Artificial Sequence
  chemically synthesized
attttcacatggcatgccccct

SEQ ID NO: 783010 - DNA, 22 bp, Artificial Sequence
  chemically synthesized
cattttcacatggcatgccccc

SEQ ID NO: 783011 - DNA, 22 bp, Artificial Sequence
  chemically synthesized
ccttcattttcacatggcatgc

SEQ ID NO: 783012 - DNA, 22 bp, Artificial Sequence
  chemically synthesized
tagatgtctgccttcattttca

SEQ ID NO: 783013 - DNA, 22 bp, Artificial Sequence
  chemically synthesized
tcctgtagatgtctgccttcat

SEQ ID NO: 783014 - DNA, 22 bp, Artificial Sequence
  chemically synthesized
gtcctgtagatgtctgccttca

SEQ ID NO: 783015 - DNA, 22 bp, Artificial Sequence
  chemically synthesized
cttgtcctgtagatgtctgcct

SEQ ID NO: 783016 - DNA, 22 bp, Artificial Sequence
  chemically synthesized
gtgctccttgtcctgtagatgt

SEQ ID NO: 783017 - DNA, 22 bp, Artificial Sequence
  chemically synthesized
ggtgctccttgtcctgtagatg

SEQ ID NO: 783018 - DNA, 22 bp, Artificial Sequence
  chemically synthesized
tggtgctccttgtcctgtagat

SEQ ID NO: 783019 - DNA, 22 bp, Artificial Sequence
  chemically synthesized
gcaatctttggtgctccttgtc

SEQ ID NO: 783020 - DNA, 22 bp, Artificial Sequence
  chemically synthesized
ttggcaatctttggtgctcctt

SEQ ID NO: 783021 - DNA, 22 bp, Artificial Sequence
  chemically synthesized
gttggcaatctttggtgctcct

SEQ ID NO: 783022 - DNA, 22 bp, Artificial Sequence
  chemically synthesized
caggacaaggagcaccaaagat

SEQ ID NO: 783023 - DNA, 22 bp, Artificial Sequence
  chemically synthesized
atggtttgttggcaatctttgg

SEQ ID NO: 783024 - DNA, 22 bp, Artificial Sequence
  chemically synthesized
tgatggtttgttggcaatcttt

SEQ ID NO: 783025 - DNA, 22 bp, Artificial Sequence
  chemically synthesized
ctgatggtttgttggcaatctt

SEQ ID NO: 783026 - DNA, 22 bp, Artificial Sequence
  chemically synthesized
gtttctgatggtttgttggcaa

SEQ ID NO: 783027 - DNA, 22 bp, Artificial Sequence
  chemically synthesized
ccctagtttctgatggtttgtt

SEQ ID NO: 783028 - DNA, 22 bp, Artificial Sequence
  chemically synthesized
cattcccctagtttctgatggt

SEQ ID NO: 783029 - DNA, 22 bp, Artificial Sequence
  chemically synthesized
ccaacaaaccatcagaaactag

SEQ ID NO: 783030 - DNA, 22 bp, Artificial Sequence
  chemically synthesized
cattccattcccctagtttctg

SEQ ID NO: 783031 - DNA, 22 bp, Artificial Sequence
  chemically synthesized
ttccattccattcccctagttt

SEQ ID NO: 783032 - DNA, 22 bp, Artificial Sequence
  chemically synthesized
ggaaggagaatctgttccattc

SEQ ID NO: 783033 - DNA, 22 bp, Artificial Sequence
  chemically synthesized
ggggaatggaatggaacagatt

SEQ ID NO: 783034 - DNA, 22 bp, Artificial Sequence
  chemically synthesized
agggctcggaaggagaatctgt

SEQ ID NO: 783035 - DNA, 22 bp, Artificial Sequence
  chemically synthesized
tgagggctcggaaggagaatct

SEQ ID NO: 783036 - DNA, 22 bp, Artificial Sequence
  chemically synthesized
ctgagggctcggaaggagaatc

SEQ ID NO: 783037 - DNA, 22 bp, Artificial Sequence
  chemically synthesized
cttctgagggctcggaaggaga

SEQ ID NO: 783038 - DNA, 22 bp, Artificial Sequence
  chemically synthesized
gttccttctgagggctcggaag

SEQ ID NO: 783039 - DNA, 22 bp, Artificial Sequence
  chemically synthesized
tccttccgagccctcagaagga

SEQ ID NO: 783040 - DNA, 22 bp, Artificial Sequence
  chemically synthesized
cttccgagccctcagaaggaac

SEQ ID NO: 783041 - DNA, 22 bp, Artificial Sequence
  chemically synthesized
ccgagccctcagaaggaaccaa

SEQ ID NO: 783042 - DNA, 22 bp, Artificial Sequence
  chemically synthesized
cgagccctcagaaggaaccaac

SEQ ID NO: 783043 - DNA, 22 bp, Artificial Sequence
  chemically synthesized
agatcaaggtgtcaggagggtt

SEQ ID NO: 783044 - DNA, 22 bp, Artificial Sequence
  chemically synthesized
agaaggaaccaaccctcctgac

SEQ ID NO: 783045 - DNA, 22 bp, Artificial Sequence
  chemically synthesized
gaggatagaagtctgagatcaa

SEQ ID NO: 783046 - DNA, 22 bp, Artificial Sequence
  chemically synthesized
tggaggatagaagtctgagatc

SEQ ID NO: 783047 - DNA, 22 bp, Artificial Sequence
  chemically synthesized
ctgacaccttgatctcagactt

SEQ ID NO: 783048 - DNA, 22 bp, Artificial Sequence
  chemically synthesized
acaccttgatctcagacttcta

SEQ ID NO: 783049 - DNA, 22 bp, Artificial Sequence
  chemically synthesized
cagttctggaggatagaagtct

SEQ ID NO: 783050 - DNA, 22 bp, Artificial Sequence
  chemically synthesized
acagttctggaggatagaagtc

SEQ ID NO: 783051 - DNA, 22 bp, Artificial Sequence
  chemically synthesized
tcttacagttctggaggataga

SEQ ID NO: 783052 - DNA, 22 bp, Artificial Sequence
  chemically synthesized
gatctcagacttctatcctcca

SEQ ID NO: 783053 - DNA, 22 bp, Artificial Sequence
  chemically synthesized
atctcagacttctatcctccag

SEQ ID NO: 783054 - DNA, 22 bp, Artificial Sequence
  chemically synthesized
ttgtcttacagttctggaggat

SEQ ID NO: 783055 - DNA, 22 bp, Artificial Sequence
  chemically synthesized
agacttctatcctccagaactg

SEQ ID NO: 783056 - DNA, 22 bp, Artificial Sequence
  chemically synthesized
ctatcctccagaactgtaagac

SEQ ID NO: 783057 - DNA, 22 bp, Artificial Sequence
  chemically synthesized
tatcctccagaactgtaagaca

SEQ ID NO: 783058 - DNA, 22 bp, Artificial Sequence
  chemically synthesized
tcctccagaactgtaagacaac

SEQ ID NO: 783059 - DNA, 22 bp, Artificial Sequence
  chemically synthesized
accaaaagaagtctgttgtctt

SEQ ID NO: 783060 - DNA, 22 bp, Artificial Sequence
  chemically synthesized
aaccaaaagaagtctgttgtct

SEQ ID NO: 783061 - DNA, 22 bp, Artificial Sequence
  chemically synthesized
cagaactgtaagacaacagact

SEQ ID NO: 783062 - DNA, 22 bp, Artificial Sequence
  chemically synthesized
gatgacttaaccaaaagaagtc

SEQ ID NO: 783063 - DNA, 22 bp, Artificial Sequence
  chemically synthesized
taagacaacagacttcttttgg

SEQ ID NO: 783064 - DNA, 22 bp, Artificial Sequence
  chemically synthesized
cttttggttaagtcatccagtt

SEQ ID NO: 783065 - DNA, 22 bp, Artificial Sequence
  chemically synthesized
ttttggttaagtcatccagttt

SEQ ID NO: 783066 - DNA, 22 bp, Artificial Sequence
  chemically synthesized
ttggttaagtcatccagtttgt

SEQ ID NO: 783067 - DNA, 22 bp, Artificial Sequence
  chemically synthesized
tggttaagtcatccagtttgtg

SEQ ID NO: 783068 - DNA, 22 bp, Artificial Sequence
  chemically synthesized
ggttaagtcatccagtttgtgg

SEQ ID NO: 783069 - DNA, 22 bp, Artificial Sequence
  chemically synthesized
gttaagtcatccagtttgtggt

SEQ ID NO: 783070 - DNA, 22 bp, Artificial Sequence
  chemically synthesized
caatagtgaaataccacaaact

SEQ ID NO: 783071 - DNA, 22 bp, Artificial Sequence
  chemically synthesized
agtcatccagtttgtggtattt

SEQ ID NO: 783072 - DNA, 22 bp, Artificial Sequence
  chemically synthesized
tgactgcaatagtgaaatacca

SEQ ID NO: 783073 - DNA, 22 bp, Artificial Sequence
  chemically synthesized
ctatgactgcaatagtgaaata

SEQ ID NO: 783074 - DNA, 22 bp, Artificial Sequence
  chemically synthesized
cctatgactgcaatagtgaaat

SEQ ID NO: 783075 - DNA, 22 bp, Artificial Sequence
  chemically synthesized
tttcctatgactgcaatagtga

SEQ ID NO: 783076 - DNA, 22 bp, Artificial Sequence
  chemically synthesized
gtttcctatgactgcaatagtg

SEQ ID NO: 783077 - DNA, 22 bp, Artificial Sequence
  chemically synthesized
gtggtatttcactattgcagtc

SEQ ID NO: 783078 - DNA, 22 bp, Artificial Sequence
  chemically synthesized
tggtatttcactattgcagtca

SEQ ID NO: 783079 - DNA, 22 bp, Artificial Sequence
  chemically synthesized
cactattgcagtcataggaaac

SEQ ID NO: 783080 - DNA, 22 bp, Artificial Sequence
  chemically synthesized
actattgcagtcataggaaaca

SEQ ID NO: 783081 - DNA, 22 bp, Artificial Sequence
  chemically synthesized
ttgcagtcataggaaacaaata

SEQ ID NO: 783082 - DNA, 22 bp, Artificial Sequence
  chemically synthesized
cagtcataggaaacaaatacat

SEQ ID NO: 783083 - DNA, 22 bp, Artificial Sequence
  chemically synthesized
tatcagtacataaagaatgtat

SEQ ID NO: 783084 - DNA, 22 bp, Artificial Sequence
  chemically synthesized
ctgtatcagtacataaagaatg

SEQ ID NO: 783085 - DNA, 22 bp, Artificial Sequence
  chemically synthesized
cctgtatcagtacataaagaat

SEQ ID NO: 783086 - DNA, 22 bp, Artificial Sequence
  chemically synthesized
tcctgtatcagtacataaagaa

SEQ ID NO: 783087 - DNA, 22 bp, Artificial Sequence
  chemically synthesized
gacattttcctgtatcagtaca

SEQ ID NO: 783088 - DNA, 22 bp, Artificial Sequence
  chemically synthesized
ggacattttcctgtatcagtac

SEQ ID NO: 783089 - DNA, 22 bp, Artificial Sequence
  chemically synthesized
ttggacattttcctgtatcagt

SEQ ID NO: 783090 - DNA, 22 bp, Artificial Sequence
  chemically synthesized
cttggacattttcctgtatcag

SEQ ID NO: 783091 - DNA, 22 bp, Artificial Sequence
  chemically synthesized
tttatgtactgatacaggaaaa

SEQ ID NO: 783092 - DNA, 22 bp, Artificial Sequence
  chemically synthesized
tatgtactgatacaggaaaatg

SEQ ID NO: 783093 - DNA, 22 bp, Artificial Sequence
  chemically synthesized
atgtactgatacaggaaaatgt

SEQ ID NO: 783094 - DNA, 22 bp, Artificial Sequence
  chemically synthesized
tgtactgatacaggaaaatgtc

SEQ ID NO: 783095 - DNA, 22 bp, Artificial Sequence
  chemically synthesized
aacaatgtttcttggacatttt

SEQ ID NO: 783096 - DNA, 22 bp, Artificial Sequence
  chemically synthesized
tcaacaatgtttcttggacatt

SEQ ID NO: 783097 - DNA, 22 bp, Artificial Sequence
  chemically synthesized
tctcaacaatgtttcttggaca

SEQ ID NO: 783098 - DNA, 22 bp, Artificial Sequence
  chemically synthesized
atacaggaaaatgtccaagaaa

SEQ ID NO: 783099 - DNA, 22 bp, Artificial Sequence
  chemically synthesized
tctctcaacaatgtttcttgga

SEQ ID NO: 783100 - DNA, 22 bp, Artificial Sequence
  chemically synthesized
ctctctcaacaatgtttcttgg

SEQ ID NO: 783101 - DNA, 22 bp, Artificial Sequence
  chemically synthesized
tgcttctctctcaacaatgttt

SEQ ID NO: 783102 - DNA, 22 bp, Artificial Sequence
  chemically synthesized
aattatgcttctctctcaacaa

SEQ ID NO: 783103 - DNA, 22 bp, Artificial Sequence
  chemically synthesized
tgaattatgcttctctctcaac

SEQ ID NO: 783104 - DNA, 22 bp, Artificial Sequence
  chemically synthesized
ctgaattatgcttctctctcaa

SEQ ID NO: 783105 - DNA, 22 bp, Artificial Sequence
  chemically synthesized
ttctgaattatgcttctctctc

SEQ ID NO: 783106 - DNA, 22 bp, Artificial Sequence
  chemically synthesized
cttctgaattatgcttctctct

SEQ ID NO: 783107 - DNA, 22 bp, Artificial Sequence
  chemically synthesized
tcttctgaattatgcttctctc

SEQ ID NO: 783108 - DNA, 22 bp, Artificial Sequence
  chemically synthesized
ttgagagagaagcataattcag

SEQ ID NO: 783109 - DNA, 22 bp, Artificial Sequence
  chemically synthesized
agagagaagcataattcagaag

SEQ ID NO: 783110 - DNA, 22 bp, Artificial Sequence
  chemically synthesized
atggtagcatacgatacacatt

SEQ ID NO: 783111 - DNA, 22 bp, Artificial Sequence
  chemically synthesized
agaagaaaatgtgtatcgtatg

SEQ ID NO: 783112 - DNA, 22 bp, Artificial Sequence
  chemically synthesized
cattaatggtagcatacgatac

SEQ ID NO: 783113 - DNA, 22 bp, Artificial Sequence
  chemically synthesized
acattaatggtagcatacgata

SEQ ID NO: 783114 - DNA, 22 bp, Artificial Sequence
  chemically synthesized
tacattaatggtagcatacgat

SEQ ID NO: 783115 - DNA, 22 bp, Artificial Sequence
  chemically synthesized
tatatatgcatctttacattaa

SEQ ID NO: 783116 - DNA, 22 bp, Artificial Sequence
  chemically synthesized
tatatatatgcatctttacatt

SEQ ID NO: 783117 - DNA, 22 bp, Artificial Sequence
  chemically synthesized
ctatatatatgcatctttacat

SEQ ID NO: 783118 - DNA, 22 bp, Artificial Sequence
  chemically synthesized
tctatatatatgcatctttaca

SEQ ID NO: 783119 - DNA, 22 bp, Artificial Sequence
  chemically synthesized
ttttctatatatatgcatcttt

SEQ ID NO: 783120 - DNA, 22 bp, Artificial Sequence
  chemically synthesized
ccattaatgtaaagatgcatat

SEQ ID NO: 783121 - DNA, 22 bp, Artificial Sequence
  chemically synthesized
atgtaaagatgcatatatatag

SEQ ID NO: 783122 - DNA, 22 bp, Artificial Sequence
  chemically synthesized
tgtatatgtgtgtgtctgtttt

SEQ ID NO: 783123 - DNA, 22 bp, Artificial Sequence
  chemically synthesized
tgttatgtatatgtgtgtgtct

SEQ ID NO: 783124 - DNA, 22 bp, Artificial Sequence
  chemically synthesized
atgttatgtatatgtgtgtgtc

SEQ ID NO: 783125 - DNA, 22 bp, Artificial Sequence
  chemically synthesized
aagcgaatatgcataagtttat

SEQ ID NO: 783126 - DNA, 22 bp, Artificial Sequence
  chemically synthesized
caagcgaatatgcataagttta

SEQ ID NO: 783127 - DNA, 22 bp, Artificial Sequence
  chemically synthesized
atgcatattcgcttgaaattcg

SEQ ID NO: 783128 - DNA, 22 bp, Artificial Sequence
  chemically synthesized
aggagatatgtacgaatttcaa

SEQ ID NO: 783129 - DNA, 22 bp, Artificial Sequence
  chemically synthesized
tgcatattcgcttgaaattcgt

SEQ ID NO: 783130 - DNA, 22 bp, Artificial Sequence
  chemically synthesized
caggagatatgtacgaatttca

SEQ ID NO: 783131 - DNA, 22 bp, Artificial Sequence
  chemically synthesized
gcttgaaattcgtacatatctc

SEQ ID NO: 783132 - DNA, 22 bp, Artificial Sequence
  chemically synthesized
tatatccttcaggagatatgta

SEQ ID NO: 783133 - DNA, 22 bp, Artificial Sequence
  chemically synthesized
gtatatccttcaggagatatgt

SEQ ID NO: 783134 - DNA, 22 bp, Artificial Sequence
  chemically synthesized
gaaattcgtacatatctcctga

SEQ ID NO: 783135 - DNA, 22 bp, Artificial Sequence
  chemically synthesized
tttgtatatccttcaggagata

SEQ ID NO: 783136 - DNA, 22 bp, Artificial Sequence
  chemically synthesized
aaattcgtacatatctcctgaa

SEQ ID NO: 783137 - DNA, 22 bp, Artificial Sequence
  chemically synthesized
gtacatatctcctgaaggatat

SEQ ID NO: 783138 - DNA, 22 bp, Artificial Sequence
  chemically synthesized
tcagctgtttgtatatccttca

SEQ ID NO: 783139 - DNA, 22 bp, Artificial Sequence
  chemically synthesized
ctgaaggatatacaaacagctg

SEQ ID NO: 783140 - DNA, 22 bp, Artificial Sequence
  chemically synthesized
aaggatatacaaacagctgaca

SEQ ID NO: 783141 - DNA, 22 bp, Artificial Sequence
  chemically synthesized
cccaccaccaatcagtattgtc

SEQ ID NO: 783142 - DNA, 22 bp, Artificial Sequence
  chemically synthesized
ccctacccaccaccaatcagta

SEQ ID NO: 783143 - DNA, 22 bp, Artificial Sequence
  chemically synthesized
acaatactgattggtggtgggt

SEQ ID NO: 783144 - DNA, 22 bp, Artificial Sequence
  chemically synthesized
tcgaatcaattcccctacccac

SEQ ID NO: 783145 - DNA, 22 bp, Artificial Sequence
  chemically synthesized
attggtggtgggtaggggaatt

SEQ ID NO: 783146 - DNA, 22 bp, Artificial Sequence
  chemically synthesized
tgcactgtcgaatcaattcccc

SEQ ID NO: 783147 - DNA, 22 bp, Artificial Sequence
  chemically synthesized
gtggtgggtaggggaattgatt

SEQ ID NO: 783148 - DNA, 22 bp, Artificial Sequence
  chemically synthesized
tatgcactgtcgaatcaattcc

SEQ ID NO: 783149 - DNA, 22 bp, Artificial Sequence
  chemically synthesized
cctctatgcactgtcgaatcaa

SEQ ID NO: 783150 - DNA, 22 bp, Artificial Sequence
  chemically synthesized
ctacctctatgcactgtcgaat

SEQ ID NO: 783151 - DNA, 22 bp, Artificial Sequence
  chemically synthesized
tcctacctctatgcactgtcga

SEQ ID NO: 783152 - DNA, 22 bp, Artificial Sequence
  chemically synthesized
ctcctacctctatgcactgtcg

SEQ ID NO: 783153 - DNA, 22 bp, Artificial Sequence
  chemically synthesized
tttctcctacctctatgcactg

SEQ ID NO: 783154 - DNA, 22 bp, Artificial Sequence
  chemically synthesized
attcgacagtgcatagaggtag

SEQ ID NO: 783155 - DNA, 22 bp, Artificial Sequence
  chemically synthesized
gacagtgcatagaggtaggaga

SEQ ID NO: 783156 - DNA, 22 bp, Artificial Sequence
  chemically synthesized
caaaaaggtataaaataaaaat

SEQ ID NO: 783157 - DNA, 22 bp, Artificial Sequence
  chemically synthesized
acaaaaaggtataaaataaaaa

SEQ ID NO: 783158 - DNA, 22 bp, Artificial Sequence
  chemically synthesized
aaaaatgaaaatttacaaaaag

SEQ ID NO: 783159 - DNA, 22 bp, Artificial Sequence
  chemically synthesized
ttattttatacctttttgtaaa

SEQ ID NO: 783160 - DNA, 22 bp, Artificial Sequence
  chemically synthesized
tattttatacctttttgtaaat

SEQ ID NO: 783161 - DNA, 22 bp, Artificial Sequence
  chemically synthesized
attttatacctttttgtaaatt

SEQ ID NO: 783162 - DNA, 22 bp, Artificial Sequence
  chemically synthesized
ttttatacctttttgtaaattt

SEQ ID NO: 783163 - DNA, 22 bp, Artificial Sequence
  chemically synthesized
tatacctttttgtaaattttca

SEQ ID NO: 783164 - DNA, 22 bp, Artificial Sequence
  chemically synthesized
atgattcaaaaatgaaaattta

SEQ ID NO: 783165 - DNA, 22 bp, Artificial Sequence
  chemically synthesized
atacctttttgtaaattttcat

SEQ ID NO: 783166 - DNA, 22 bp, Artificial Sequence
  chemically synthesized
gatgattcaaaaatgaaaattt

SEQ ID NO: 783167 - DNA, 22 bp, Artificial Sequence
  chemically synthesized
tacctttttgtaaattttcatt

SEQ ID NO: 783168 - DNA, 22 bp, Artificial Sequence
  chemically synthesized
tgatgattcaaaaatgaaaatt

SEQ ID NO: 783169 - DNA, 22 bp, Artificial Sequence
  chemically synthesized
tttgtaaattttcatttttgaa

SEQ ID NO: 783170 - DNA, 22 bp, Artificial Sequence
  chemically synthesized
ttgtaaattttcatttttgaat

SEQ ID NO: 783171 - DNA, 22 bp, Artificial Sequence
  chemically synthesized
tgtaaattttcatttttgaatc

SEQ ID NO: 783172 - DNA, 22 bp, Artificial Sequence
  chemically synthesized
gtaaattttcatttttgaatca

SEQ ID NO: 783173 - DNA, 22 bp, Artificial Sequence
  chemically synthesized
taaattttcatttttgaatcat

SEQ ID NO: 783174 - DNA, 22 bp, Artificial Sequence
  chemically synthesized
ggtgatcattttgatgattcaa

SEQ ID NO: 783175 - DNA, 22 bp, Artificial Sequence
  chemically synthesized
cactaggtgatcattttgatga

SEQ ID NO: 783176 - DNA, 22 bp, Artificial Sequence
  chemically synthesized
tcatttttgaatcatcaaaatg

SEQ ID NO: 783177 - DNA, 22 bp, Artificial Sequence
  chemically synthesized
ccactaggtgatcattttgatg

SEQ ID NO: 783178 - DNA, 22 bp, Artificial Sequence
  chemically synthesized
catttttgaatcatcaaaatga

SEQ ID NO: 783179 - DNA, 22 bp, Artificial Sequence
  chemically synthesized
tccactaggtgatcattttgat

SEQ ID NO: 783180 - DNA, 22 bp, Artificial Sequence
  chemically synthesized
atttttgaatcatcaaaatgat

SEQ ID NO: 783181 - DNA, 22 bp, Artificial Sequence
  chemically synthesized
ttttccactaggtgatcatttt

SEQ ID NO: 783182 - DNA, 22 bp, Artificial Sequence
  chemically synthesized
attttccactaggtgatcattt

SEQ ID NO: 783183 - DNA, 22 bp, Artificial Sequence
  chemically synthesized
ttgaatcatcaaaatgatcacc

SEQ ID NO: 783184 - DNA, 22 bp, Artificial Sequence
  chemically synthesized
tgaatcatcaaaatgatcacct

SEQ ID NO: 783185 - DNA, 22 bp, Artificial Sequence
  chemically synthesized
gaatcatcaaaatgatcaccta

SEQ ID NO: 783186 - DNA, 22 bp, Artificial Sequence
  chemically synthesized
cttattttccactaggtgatca

SEQ ID NO: 783187 - DNA, 22 bp, Artificial Sequence
  chemically synthesized
aatcatcaaaatgatcacctag

SEQ ID NO: 783188 - DNA, 22 bp, Artificial Sequence
  chemically synthesized
acttattttccactaggtgatc

SEQ ID NO: 783189 - DNA, 22 bp, Artificial Sequence
  chemically synthesized
tacttattttccactaggtgat

SEQ ID NO: 783190 - DNA, 22 bp, Artificial Sequence
  chemically synthesized
attttacttattttccactagg

SEQ ID NO: 783191 - DNA, 22 bp, Artificial Sequence
  chemically synthesized
aattttacttattttccactag

SEQ ID NO: 783192 - DNA, 22 bp, Artificial Sequence
  chemically synthesized
taattttacttattttccacta

SEQ ID NO: 783193 - DNA, 22 bp, Artificial Sequence
  chemically synthesized
ttaattttacttattttccact

SEQ ID NO: 783194 - DNA, 22 bp, Artificial Sequence
  chemically synthesized
tttttaattttacttattttcc

SEQ ID NO: 783195 - DNA, 22 bp, Artificial Sequence
  chemically synthesized
attgtttttaattttacttatt

SEQ ID NO: 783196 - DNA, 22 bp, Artificial Sequence
  chemically synthesized
gattgtttttaattttacttat

SEQ ID NO: 783197 - DNA, 22 bp, Artificial Sequence
  chemically synthesized
tttgattgtttttaattttact

SEQ ID NO: 783198 - DNA, 22 bp, Artificial Sequence
  chemically synthesized
atttgattgtttttaattttac

SEQ ID NO: 783199 - DNA, 22 bp, Artificial Sequence
  chemically synthesized
gtggaaaataagtaaaattaaa

SEQ ID NO: 783200 - DNA, 22 bp, Artificial Sequence
  chemically synthesized
gggggtcttatttgattgtttt

SEQ ID NO: 783201 - DNA, 22 bp, Artificial Sequence
  chemically synthesized
agggggtcttatttgattgttt

SEQ ID NO: 783202 - DNA, 22 bp, Artificial Sequence
  chemically synthesized
ataatttagggggtcttatttg

SEQ ID NO: 783203 - DNA, 22 bp, Artificial Sequence
  chemically synthesized
aaaacaatcaaataagaccccc

SEQ ID NO: 783204 - DNA, 22 bp, Artificial Sequence
  chemically synthesized
agatagtaaaaagaaagctgat

SEQ ID NO: 783205 - DNA, 22 bp, Artificial Sequence
  chemically synthesized
attaagatagtaaaaagaaagc

SEQ ID NO: 783206 - DNA, 22 bp, Artificial Sequence
  chemically synthesized
aattaagatagtaaaaagaaag

SEQ ID NO: 783207 - DNA, 22 bp, Artificial Sequence
  chemically synthesized
aattatcagctttctttttact

SEQ ID NO: 783208 - DNA, 22 bp, Artificial Sequence
  chemically synthesized
atttaattaagatagtaaaaag

SEQ ID NO: 783209 - DNA, 22 bp, Artificial Sequence
  chemically synthesized
tcagctttctttttactatctt

SEQ ID NO: 783210 - DNA, 22 bp, Artificial Sequence
  chemically synthesized
tctgatttaattaagatagtaa

SEQ ID NO: 783211 - DNA, 22 bp, Artificial Sequence
  chemically synthesized
aagttatctgatttaattaaga

SEQ ID NO: 783212 - DNA, 22 bp, Artificial Sequence
  chemically synthesized
tctttttactatcttaattaaa

SEQ ID NO: 783213 - DNA, 22 bp, Artificial Sequence
  chemically synthesized
ctttttactatcttaattaaat

SEQ ID NO: 783214 - DNA, 22 bp, Artificial Sequence
  chemically synthesized
tttttactatcttaattaaatc

SEQ ID NO: 783215 - DNA, 22 bp, Artificial Sequence
  chemically synthesized
ttcaagttatctgatttaatta

SEQ ID NO: 783216 - DNA, 22 bp, Artificial Sequence
  chemically synthesized
tttactatcttaattaaatcag

SEQ ID NO: 783217 - DNA, 22 bp, Artificial Sequence
  chemically synthesized
ttactatcttaattaaatcaga

SEQ ID NO: 783218 - DNA, 22 bp, Artificial Sequence
  chemically synthesized
tactatcttaattaaatcagat

SEQ ID NO: 783219 - DNA, 22 bp, Artificial Sequence
  chemically synthesized
actatcttaattaaatcagata

SEQ ID NO: 783220 - DNA, 22 bp, Artificial Sequence
  chemically synthesized
ctatcttaattaaatcagataa

SEQ ID NO: 783221 - DNA, 22 bp, Artificial Sequence
  chemically synthesized
tcttaattaaatcagataactt

SEQ ID NO: 783222 - DNA, 22 bp, Artificial Sequence
  chemically synthesized
aattaaatcagataacttgaac

SEQ ID NO: 783223 - DNA, 22 bp, Artificial Sequence
  chemically synthesized
attaaatcagataacttgaaca

SEQ ID NO: 783224 - DNA, 22 bp, Artificial Sequence
  chemically synthesized
aatcagataacttgaacagatc

SEQ ID NO: 783225 - DNA, 22 bp, Artificial Sequence
  chemically synthesized
cacacagaaagtacaaaagaag

SEQ ID NO: 783226 - DNA, 22 bp, Artificial Sequence
  chemically synthesized
ccacacagaaagtacaaaagaa

SEQ ID NO: 783227 - DNA, 22 bp, Artificial Sequence
  chemically synthesized
tccacacagaaagtacaaaaga

SEQ ID NO: 783228 - DNA, 22 bp, Artificial Sequence
  chemically synthesized
gaacagatcttcttttgtactt

SEQ ID NO: 783229 - DNA, 22 bp, Artificial Sequence
  chemically synthesized
aacagatcttcttttgtacttt

SEQ ID NO: 783230 - DNA, 22 bp, Artificial Sequence
  chemically synthesized
atataactttccacacagaaag

SEQ ID NO: 783231 - DNA, 22 bp, Artificial Sequence
  chemically synthesized
cttttgtactttctgtgtggaa

SEQ ID NO: 783232 - DNA, 22 bp, Artificial Sequence
  chemically synthesized
ttttgtactttctgtgtggaaa

SEQ ID NO: 783233 - DNA, 22 bp, Artificial Sequence
  chemically synthesized
agtctgatataactttccacac

SEQ ID NO: 783234 - DNA, 22 bp, Artificial Sequence
  chemically synthesized
ttgtactttctgtgtggaaagt

SEQ ID NO: 783235 - DNA, 22 bp, Artificial Sequence
  chemically synthesized
cagtctgatataactttccaca

SEQ ID NO: 783236 - DNA, 22 bp, Artificial Sequence
  chemically synthesized
tgtactttctgtgtggaaagtt

SEQ ID NO: 783237 - DNA, 22 bp, Artificial Sequence
  chemically synthesized
gtactttctgtgtggaaagtta

SEQ ID NO: 783238 - DNA, 22 bp, Artificial Sequence
  chemically synthesized
tactttctgtgtggaaagttat

SEQ ID NO: 783239 - DNA, 22 bp, Artificial Sequence
  chemically synthesized
tctgtgtggaaagttatatcag

SEQ ID NO: 783240 - DNA, 22 bp, Artificial Sequence
  chemically synthesized
acatgtttcagtctgatataac

SEQ ID NO: 783241 - DNA, 22 bp, Artificial Sequence
  chemically synthesized
ctgtgtggaaagttatatcaga

SEQ ID NO: 783242 - DNA, 22 bp, Artificial Sequence
  chemically synthesized
tgtgtggaaagttatatcagac

SEQ ID NO: 783243 - DNA, 22 bp, Artificial Sequence
  chemically synthesized
tgtggaaagttatatcagactg

SEQ ID NO: 783244 - DNA, 22 bp, Artificial Sequence
  chemically synthesized
tattaacatgtttcagtctgat

SEQ ID NO: 783245 - DNA, 22 bp, Artificial Sequence
  chemically synthesized
gtattaacatgtttcagtctga

SEQ ID NO: 783246 - DNA, 22 bp, Artificial Sequence
  chemically synthesized
tgtattaacatgtttcagtctg

SEQ ID NO: 783247 - DNA, 22 bp, Artificial Sequence
  chemically synthesized
tatcagactgaaacatgttaat

SEQ ID NO: 783248 - DNA, 22 bp, Artificial Sequence
  chemically synthesized
tatgcaaatactttgtattaac

SEQ ID NO: 783249 - DNA, 22 bp, Artificial Sequence
  chemically synthesized
aaacatgttaatacaaagtatt

SEQ ID NO: 783250 - DNA, 22 bp, Artificial Sequence
  chemically synthesized
tgtctatatgcaaatactttgt

SEQ ID NO: 783251 - DNA, 22 bp, Artificial Sequence
  chemically synthesized
atacaaagtatttgcatataga

SEQ ID NO: 783252 - DNA, 22 bp, Artificial Sequence
  chemically synthesized
gcatatagacatagacctctat

SEQ ID NO: 783253 - DNA, 22 bp, Artificial Sequence
  chemically synthesized
catatagacatagacctctatc

SEQ ID NO: 783254 - DNA, 22 bp, Artificial Sequence
  chemically synthesized
agtaaatgggaaagatagaggt

SEQ ID NO: 783255 - DNA, 22 bp, Artificial Sequence
  chemically synthesized
tctgagtaaatgggaaagatag

SEQ ID NO: 783256 - DNA, 22 bp, Artificial Sequence
  chemically synthesized
ttgtctgagtaaatgggaaaga

SEQ ID NO: 783257 - DNA, 22 bp, Artificial Sequence
  chemically synthesized
taaaagttgttgtctgagtaaa

SEQ ID NO: 783258 - DNA, 22 bp, Artificial Sequence
  chemically synthesized
tatctttcccatttactcagac

SEQ ID NO: 783259 - DNA, 22 bp, Artificial Sequence
  chemically synthesized
tctttcccatttactcagacaa

SEQ ID NO: 783260 - DNA, 22 bp, Artificial Sequence
  chemically synthesized
acattgtaaaagttgttgtctg

SEQ ID NO: 783261 - DNA, 22 bp, Artificial Sequence
  chemically synthesized
tcccatttactcagacaacaac

SEQ ID NO: 783262 - DNA, 22 bp, Artificial Sequence
  chemically synthesized
cccatttactcagacaacaact

SEQ ID NO: 783263 - DNA, 22 bp, Artificial Sequence
  chemically synthesized
ccatttactcagacaacaactt

SEQ ID NO: 783264 - DNA, 22 bp, Artificial Sequence
  chemically synthesized
actcagacaacaacttttacaa

SEQ ID NO: 783265 - DNA, 22 bp, Artificial Sequence
  chemically synthesized
ctcagacaacaacttttacaat

SEQ ID NO: 783266 - DNA, 22 bp, Artificial Sequence
  chemically synthesized
aacacatgttaacattgtaaaa

SEQ ID NO: 783267 - DNA, 22 bp, Artificial Sequence
  chemically synthesized
agacaacaacttttacaatgtt

SEQ ID NO: 783268 - DNA, 22 bp, Artificial Sequence
  chemically synthesized
aagcaatgttgaacacatgtta

SEQ ID NO: 783269 - DNA, 22 bp, Artificial Sequence
  chemically synthesized
caagcaatgttgaacacatgtt

SEQ ID NO: 783270 - DNA, 22 bp, Artificial Sequence
  chemically synthesized
ttacaatgttaacatgtgttca

SEQ ID NO: 783271 - DNA, 22 bp, Artificial Sequence
  chemically synthesized
tacaatgttaacatgtgttcaa

SEQ ID NO: 783272 - DNA, 22 bp, Artificial Sequence
  chemically synthesized
cttcaagcaatgttgaacacat

SEQ ID NO: 783273 - DNA, 22 bp, Artificial Sequence
  chemically synthesized
acaatgttaacatgtgttcaac

SEQ ID NO: 783274 - DNA, 22 bp, Artificial Sequence
  chemically synthesized
caatgttaacatgtgttcaaca

SEQ ID NO: 783275 - DNA, 22 bp, Artificial Sequence
  chemically synthesized
ccatattacttcaagcaatgtt

SEQ ID NO: 783276 - DNA, 22 bp, Artificial Sequence
  chemically synthesized
acatgtgttcaacattgcttga

SEQ ID NO: 783277 - DNA, 22 bp, Artificial Sequence
  chemically synthesized
actcccatattacttcaagcaa

SEQ ID NO: 783278 - DNA, 22 bp, Artificial Sequence
  chemically synthesized
aactcccatattacttcaagca

SEQ ID NO: 783279 - DNA, 22 bp, Artificial Sequence
  chemically synthesized
taactcccatattacttcaagc

SEQ ID NO: 783280 - DNA, 22 bp, Artificial Sequence
  chemically synthesized
ttaactcccatattacttcaag

SEQ ID NO: 783281 - DNA, 22 bp, Artificial Sequence
  chemically synthesized
ttttaactcccatattacttca

SEQ ID NO: 783282 - DNA, 22 bp, Artificial Sequence
  chemically synthesized
aacattgcttgaagtaatatgg

SEQ ID NO: 783283 - DNA, 22 bp, Artificial Sequence
  chemically synthesized
tattcttttaactcccatatta

SEQ ID NO: 783284 - DNA, 22 bp, Artificial Sequence
  chemically synthesized
gtattcttttaactcccatatt

SEQ ID NO: 783285 - DNA, 22 bp, Artificial Sequence
  chemically synthesized
cttgaagtaatatgggagttaa

SEQ ID NO: 783286 - DNA, 22 bp, Artificial Sequence
  chemically synthesized
gaagtaatatgggagttaaaag

SEQ ID NO: 783287 - DNA, 22 bp, Artificial Sequence
  chemically synthesized
aagtaatatgggagttaaaaga

SEQ ID NO: 783288 - DNA, 22 bp, Artificial Sequence
  chemically synthesized
taatacagaaagtatgtcttgt

SEQ ID NO: 783289 - DNA, 22 bp, Artificial Sequence
  chemically synthesized
tgtaatacagaaagtatgtctt

SEQ ID NO: 783290 - DNA, 22 bp, Artificial Sequence
  chemically synthesized
ctgtaatacagaaagtatgtct

SEQ ID NO: 783291 - DNA, 22 bp, Artificial Sequence
  chemically synthesized
aaagaatacaagacatactttc

SEQ ID NO: 783292 - DNA, 22 bp, Artificial Sequence
  chemically synthesized
agagcttctgtaatacagaaag

SEQ ID NO: 783293 - DNA, 22 bp, Artificial Sequence
  chemically synthesized
agttaagagcttctgtaataca

SEQ ID NO: 783294 - DNA, 22 bp, Artificial Sequence
  chemically synthesized
catcactcagttaagagcttct

SEQ ID NO: 783295 - DNA, 22 bp, Artificial Sequence
  chemically synthesized
tctgtattacagaagctcttaa

SEQ ID NO: 783296 - DNA, 22 bp, Artificial Sequence
  chemically synthesized
tccatcactcagttaagagctt

SEQ ID NO: 783297 - DNA, 22 bp, Artificial Sequence
  chemically synthesized
ctgtattacagaagctcttaac

SEQ ID NO: 783298 - DNA, 22 bp, Artificial Sequence
  chemically synthesized
ctccatcactcagttaagagct

SEQ ID NO: 783299 - DNA, 22 bp, Artificial Sequence
  chemically synthesized
tgtattacagaagctcttaact

SEQ ID NO: 783300 - DNA, 22 bp, Artificial Sequence
  chemically synthesized
tctccatcactcagttaagagc

SEQ ID NO: 783301 - DNA, 22 bp, Artificial Sequence
  chemically synthesized
ttctccatcactcagttaagag

SEQ ID NO: 783302 - DNA, 22 bp, Artificial Sequence
  chemically synthesized
tattacagaagctcttaactga

SEQ ID NO: 783303 - DNA, 22 bp, Artificial Sequence
  chemically synthesized
ttttctccatcactcagttaag

SEQ ID NO: 783304 - DNA, 22 bp, Artificial Sequence
  chemically synthesized
cttttctccatcactcagttaa

SEQ ID NO: 783305 - DNA, 22 bp, Artificial Sequence
  chemically synthesized
tcttttctccatcactcagtta

SEQ ID NO: 783306 - DNA, 22 bp, Artificial Sequence
  chemically synthesized
ttcttttctccatcactcagtt

SEQ ID NO: 783307 - DNA, 22 bp, Artificial Sequence
  chemically synthesized
cagaagctcttaactgagtgat

SEQ ID NO: 783308 - DNA, 22 bp, Artificial Sequence
  chemically synthesized
tttcttttctccatcactcagt

SEQ ID NO: 783309 - DNA, 22 bp, Artificial Sequence
  chemically synthesized
ttttcttttctccatcactcag

SEQ ID NO: 783310 - DNA, 22 bp, Artificial Sequence
  chemically synthesized
tttttcttttctccatcactca

SEQ ID NO: 783311 - DNA, 22 bp, Artificial Sequence
  chemically synthesized
agtctttttttcttttctccat

SEQ ID NO: 783312 - DNA, 22 bp, Artificial Sequence
  chemically synthesized
ttaactgagtgatggagaaaag

SEQ ID NO: 783313 - DNA, 22 bp, Artificial Sequence
  chemically synthesized
aactgagtgatggagaaaagaa

SEQ ID NO: 783314 - DNA, 22 bp, Artificial Sequence
  chemically synthesized
actgagtgatggagaaaagaaa

SEQ ID NO: 783315 - DNA, 22 bp, Artificial Sequence
  chemically synthesized
acctaagtctttttttcttttc

SEQ ID NO: 783316 - DNA, 22 bp, Artificial Sequence
  chemically synthesized
cacctaagtctttttttctttt

SEQ ID NO: 783317 - DNA, 22 bp, Artificial Sequence
  chemically synthesized
agtgatggagaaaagaaaaaaa

SEQ ID NO: 783318 - DNA, 22 bp, Artificial Sequence
  chemically synthesized
atgcttcacctaagtctttttt

SEQ ID NO: 783319 - DNA, 22 bp, Artificial Sequence
  chemically synthesized
catgcttcacctaagtcttttt

SEQ ID NO: 783320 - DNA, 22 bp, Artificial Sequence
  chemically synthesized
tcatgcttcacctaagtctttt

SEQ ID NO: 783321 - DNA, 22 bp, Artificial Sequence
  chemically synthesized
ctttcatgcttcacctaagtct

SEQ ID NO: 783322 - DNA, 22 bp, Artificial Sequence
  chemically synthesized
actttcatgcttcacctaagtc

SEQ ID NO: 783323 - DNA, 22 bp, Artificial Sequence
  chemically synthesized
aagtgacttactttcatgcttc

SEQ ID NO: 783324 - DNA, 22 bp, Artificial Sequence
  chemically synthesized
aggtgaagcatgaaagtaagtc

SEQ ID NO: 783325 - DNA, 22 bp, Artificial Sequence
  chemically synthesized
ggtgaagcatgaaagtaagtca

SEQ ID NO: 783326 - DNA, 22 bp, Artificial Sequence
  chemically synthesized
agaaaacaggcacaaagaaact

SEQ ID NO: 783327 - DNA, 22 bp, Artificial Sequence
  chemically synthesized
ttgagaaaacaggcacaaagaa

SEQ ID NO: 783328 - DNA, 22 bp, Artificial Sequence
  chemically synthesized
ctgttgagaaaacaggcacaaa

SEQ ID NO: 783329 - DNA, 22 bp, Artificial Sequence
  chemically synthesized
actgttgagaaaacaggcacaa

SEQ ID NO: 783330 - DNA, 22 bp, Artificial Sequence
  chemically synthesized
tactgttgagaaaacaggcaca

SEQ ID NO: 783331 - DNA, 22 bp, Artificial Sequence
  chemically synthesized
cagtttctttgtgcctgttttc

SEQ ID NO: 783332 - DNA, 22 bp, Artificial Sequence
  chemically synthesized
ttttactgttgagaaaacaggc

SEQ ID NO: 783333 - DNA, 22 bp, Artificial Sequence
  chemically synthesized
agtttctttgtgcctgttttct

SEQ ID NO: 783334 - DNA, 22 bp, Artificial Sequence
  chemically synthesized
ttattttactgttgagaaaaca

SEQ ID NO: 783335 - DNA, 22 bp, Artificial Sequence
  chemically synthesized
gttattttactgttgagaaaac

SEQ ID NO: 783336 - DNA, 22 bp, Artificial Sequence
  chemically synthesized
ctttgtgcctgttttctcaaca

SEQ ID NO: 783337 - DNA, 22 bp, Artificial Sequence
  chemically synthesized
tttgtgcctgttttctcaacag

SEQ ID NO: 783338 - DNA, 22 bp, Artificial Sequence
  chemically synthesized
atttgttattttactgttgaga

SEQ ID NO: 783339 - DNA, 22 bp, Artificial Sequence
  chemically synthesized
tgtgcctgttttctcaacagta

SEQ ID NO: 783340 - DNA, 22 bp, Artificial Sequence
  chemically synthesized
gtgcctgttttctcaacagtaa

SEQ ID NO: 783341 - DNA, 22 bp, Artificial Sequence
  chemically synthesized
tgcctgttttctcaacagtaaa

SEQ ID NO: 783342 - DNA, 22 bp, Artificial Sequence
  chemically synthesized
tctcatttgttattttactgtt

SEQ ID NO: 783343 - DNA, 22 bp, Artificial Sequence
  chemically synthesized
atctcatttgttattttactgt

SEQ ID NO: 783344 - DNA, 22 bp, Artificial Sequence
  chemically synthesized
ttttctcaacagtaaaataaca

SEQ ID NO: 783345 - DNA, 22 bp, Artificial Sequence
  chemically synthesized
tctcaacagtaaaataacaaat

SEQ ID NO: 783346 - DNA, 22 bp, Artificial Sequence
  chemically synthesized
ctcaacagtaaaataacaaatg

SEQ ID NO: 783347 - DNA, 22 bp, Artificial Sequence
  chemically synthesized
tcaacagtaaaataacaaatga

SEQ ID NO: 783348 - DNA, 22 bp, Artificial Sequence
  chemically synthesized
aacagtaaaataacaaatgaga

SEQ ID NO: 783349 - DNA, 22 bp, Artificial Sequence
  chemically synthesized
aacagtcatttatctcatttgt

SEQ ID NO: 783350 - DNA, 22 bp, Artificial Sequence
  chemically synthesized
caacagtcatttatctcatttg

SEQ ID NO: 783351 - DNA, 22 bp, Artificial Sequence
  chemically synthesized
agacttcaacagtcatttatct

SEQ ID NO: 783352 - DNA, 22 bp, Artificial Sequence
  chemically synthesized
aagacttcaacagtcatttatc

SEQ ID NO: 783353 - DNA, 22 bp, Artificial Sequence
  chemically synthesized
taagacttcaacagtcatttat

SEQ ID NO: 783354 - DNA, 22 bp, Artificial Sequence
  chemically synthesized
agaaattttaagacttcaacag

SEQ ID NO: 783355 - DNA, 22 bp, Artificial Sequence
  chemically synthesized
ttgaagtcttaaaatttctgaa

SEQ ID NO: 783356 - DNA, 22 bp, Artificial Sequence
  chemically synthesized
aagtcttaaaatttctgaattg

SEQ ID NO: 783357 - DNA, 22 bp, Artificial Sequence
  chemically synthesized
aaaaaacaaataaaacaattca

SEQ ID NO: 783358 - DNA, 22 bp, Artificial Sequence
  chemically synthesized
caaaaaacaaataaaacaattc

SEQ ID NO: 783359 - DNA, 22 bp, Artificial Sequence
  chemically synthesized
aaaatttctgaattgttttatt

SEQ ID NO: 783360 - DNA, 22 bp, Artificial Sequence
  chemically synthesized
aaatttctgaattgttttattt

SEQ ID NO: 783361 - DNA, 22 bp, Artificial Sequence
  chemically synthesized
ctgaattgttttatttgttttt

SEQ ID NO: 783362 - DNA, 22 bp, Artificial Sequence
  chemically synthesized
tgaattgttttatttgtttttt

SEQ ID NO: 783363 - DNA, 22 bp, Artificial Sequence
  chemically synthesized
aaagtgtaatttcaaaaaacaa

SEQ ID NO: 783364 - DNA, 22 bp, Artificial Sequence
  chemically synthesized
aattgttttatttgttttttga

SEQ ID NO: 783365 - DNA, 22 bp, Artificial Sequence
  chemically synthesized
ttttatttgttttttgaaatta

SEQ ID NO: 783366 - DNA, 22 bp, Artificial Sequence
  chemically synthesized
aaaactaaaagtgtaatttcaa

SEQ ID NO: 783367 - DNA, 22 bp, Artificial Sequence
  chemically synthesized
tatttgttttttgaaattacac

SEQ ID NO: 783368 - DNA, 22 bp, Artificial Sequence
  chemically synthesized
atttgttttttgaaattacact

SEQ ID NO: 783369 - DNA, 22 bp, Artificial Sequence
  chemically synthesized
tttgttttttgaaattacactt

SEQ ID NO: 783370 - DNA, 22 bp, Artificial Sequence
  chemically synthesized
tctcaaaactaaaagtgtaatt

SEQ ID NO: 783371 - DNA, 22 bp, Artificial Sequence
  chemically synthesized
gttttttgaaattacactttta

SEQ ID NO: 783372 - DNA, 22 bp, Artificial Sequence
  chemically synthesized
ttttttgaaattacacttttag

SEQ ID NO: 783373 - DNA, 22 bp, Artificial Sequence
  chemically synthesized
tttgaaattacacttttagttt

SEQ ID NO: 783374 - DNA, 22 bp, Artificial Sequence
  chemically synthesized
ttgaaattacacttttagtttt

SEQ ID NO: 783375 - DNA, 22 bp, Artificial Sequence
  chemically synthesized
tgaaattacacttttagttttg

SEQ ID NO: 783376 - DNA, 22 bp, Artificial Sequence
  chemically synthesized
gaaattacacttttagttttga

SEQ ID NO: 783377 - DNA, 22 bp, Artificial Sequence
  chemically synthesized
aaattacacttttagttttgag

SEQ ID NO: 783378 - DNA, 22 bp, Artificial Sequence
  chemically synthesized
cacttttagttttgagataatt

SEQ ID NO: 783379 - DNA, 22 bp, Artificial Sequence
  chemically synthesized
catgtgaacatacaattatctc

SEQ ID NO: 783380 - DNA, 22 bp, Artificial Sequence
  chemically synthesized
ttagttttgagataattgtatg

SEQ ID NO: 783381 - DNA, 22 bp, Artificial Sequence
  chemically synthesized
tagttttgagataattgtatgt

SEQ ID NO: 783382 - DNA, 22 bp, Artificial Sequence
  chemically synthesized
agttttgagataattgtatgtt

SEQ ID NO: 783383 - DNA, 22 bp, Artificial Sequence
  chemically synthesized
gttttgagataattgtatgttc

SEQ ID NO: 783384 - DNA, 22 bp, Artificial Sequence
  chemically synthesized
acaactacatgtgaacatacaa

SEQ ID NO: 783385 - DNA, 22 bp, Artificial Sequence
  chemically synthesized
tcacaactacatgtgaacatac

SEQ ID NO: 783386 - DNA, 22 bp, Artificial Sequence
  chemically synthesized
ctcacaactacatgtgaacata

SEQ ID NO: 783387 - DNA, 22 bp, Artificial Sequence
  chemically synthesized
tgagataattgtatgttcacat

SEQ ID NO: 783388 - DNA, 22 bp, Artificial Sequence
  chemically synthesized
gagataattgtatgttcacatg

SEQ ID NO: 783389 - DNA, 22 bp, Artificial Sequence
  chemically synthesized
agataattgtatgttcacatgt

SEQ ID NO: 783390 - DNA, 22 bp, Artificial Sequence
  chemically synthesized
tttctcacaactacatgtgaac

SEQ ID NO: 783391 - DNA, 22 bp, Artificial Sequence
  chemically synthesized
tattatttctcacaactacatg

SEQ ID NO: 783392 - DNA, 22 bp, Artificial Sequence
  chemically synthesized
tgtattatttctcacaactaca

SEQ ID NO: 783393 - DNA, 22 bp, Artificial Sequence
  chemically synthesized
tatgttcacatgtagttgtgag

SEQ ID NO: 783394 - DNA, 22 bp, Artificial Sequence
  chemically synthesized
tctgtattatttctcacaacta

SEQ ID NO: 783395 - DNA, 22 bp, Artificial Sequence
  chemically synthesized
ctctgtattatttctcacaact

SEQ ID NO: 783396 - DNA, 22 bp, Artificial Sequence
  chemically synthesized
tctctgtattatttctcacaac

SEQ ID NO: 783397 - DNA, 22 bp, Artificial Sequence
  chemically synthesized
gttttctctgtattatttctca

SEQ ID NO: 783398 - DNA, 22 bp, Artificial Sequence
  chemically synthesized
acatgtagttgtgagaaataat

SEQ ID NO: 783399 - DNA, 22 bp, Artificial Sequence
  chemically synthesized
tgagaaataatacagagaaaac

SEQ ID NO: 783400 - DNA, 22 bp, Artificial Sequence
  chemically synthesized
agggagacggggtcaggggtat

SEQ ID NO: 783401 - DNA, 22 bp, Artificial Sequence
  chemically synthesized
cagggagacggggtcaggggta

SEQ ID NO: 783402 - DNA, 22 bp, Artificial Sequence
  chemically synthesized
ccttcagggagacggggtcagg

SEQ ID NO: 783403 - DNA, 22 bp, Artificial Sequence
  chemically synthesized
accttcagggagacggggtcag

SEQ ID NO: 783404 - DNA, 22 bp, Artificial Sequence
  chemically synthesized
taccttcagggagacggggtca

SEQ ID NO: 783405 - DNA, 22 bp, Artificial Sequence
  chemically synthesized
caaggttttaccttcagggaga

SEQ ID NO: 783406 - DNA, 22 bp, Artificial Sequence
  chemically synthesized
gcaaggttttaccttcagggag

SEQ ID NO: 783407 - DNA, 22 bp, Artificial Sequence
  chemically synthesized
tgcaaggttttaccttcaggga

SEQ ID NO: 783408 - DNA, 22 bp, Artificial Sequence
  chemically synthesized
ttgcaaggttttaccttcaggg

SEQ ID NO: 783409 - DNA, 22 bp, Artificial Sequence
  chemically synthesized
accccgtctccctgaaggtaaa

SEQ ID NO: 783410 - DNA, 22 bp, Artificial Sequence
  chemically synthesized
tatttttgcaaggttttacctt

SEQ ID NO: 783411 - DNA, 22 bp, Artificial Sequence
  chemically synthesized
tactatatttttgcaaggtttt

SEQ ID NO: 783412 - DNA, 22 bp, Artificial Sequence
  chemically synthesized
cctgaaggtaaaaccttgcaaa

SEQ ID NO: 783413 - DNA, 22 bp, Artificial Sequence
  chemically synthesized
aaggtaaaaccttgcaaaaata

SEQ ID NO: 783414 - DNA, 22 bp, Artificial Sequence
  chemically synthesized
tgatattgtactatatttttgc

SEQ ID NO: 783415 - DNA, 22 bp, Artificial Sequence
  chemically synthesized
gttatgatattgtactatattt

SEQ ID NO: 783416 - DNA, 22 bp, Artificial Sequence
  chemically synthesized
gcaaaaatatagtacaatatca

SEQ ID NO: 783417 - DNA, 22 bp, Artificial Sequence
  chemically synthesized
caaaaatatagtacaatatcat

SEQ ID NO: 783418 - DNA, 22 bp, Artificial Sequence
  chemically synthesized
tgtcaatgtcaatatcctggtt

SEQ ID NO: 783419 - DNA, 22 bp, Artificial Sequence
  chemically synthesized
attgtgtcaatgtcaatatcct

SEQ ID NO: 783420 - DNA, 22 bp, Artificial Sequence
  chemically synthesized
gattgtgtcaatgtcaatatcc

SEQ ID NO: 783421 - DNA, 22 bp, Artificial Sequence
  chemically synthesized
ccttgattgtgtcaatgtcaat

SEQ ID NO: 783422 - DNA, 22 bp, Artificial Sequence
  chemically synthesized
accttgattgtgtcaatgtcaa

SEQ ID NO: 783423 - DNA, 22 bp, Artificial Sequence
  chemically synthesized
taccttgattgtgtcaatgtca

SEQ ID NO: 783424 - DNA, 22 bp, Artificial Sequence
  chemically synthesized
tttaccttgattgtgtcaatgt

SEQ ID NO: 783425 - DNA, 22 bp, Artificial Sequence
  chemically synthesized
ttctttaccttgattgtgtcaa

SEQ ID NO: 783426 - DNA, 22 bp, Artificial Sequence
  chemically synthesized
gaactgttctttaccttgattg

SEQ ID NO: 783427 - DNA, 22 bp, Artificial Sequence
  chemically synthesized
acattgacacaatcaaggtaaa

SEQ ID NO: 783428 - DNA, 22 bp, Artificial Sequence
  chemically synthesized
tagtgttggaactgttctttac

SEQ ID NO: 783429 - DNA, 22 bp, Artificial Sequence
  chemically synthesized
acacaatcaaggtaaagaacag

SEQ ID NO: 783430 - DNA, 22 bp, Artificial Sequence
  chemically synthesized
gtagtgttggaactgttcttta

SEQ ID NO: 783431 - DNA, 22 bp, Artificial Sequence
  chemically synthesized
caacactacaaggatgcctcct

SEQ ID NO: 783432 - DNA, 22 bp, Artificial Sequence
  chemically synthesized
caaaagggcaacacaggaggca

SEQ ID NO: 783433 - DNA, 22 bp, Artificial Sequence
  chemically synthesized
caaggatgcctcctgtgttgcc

SEQ ID NO: 783434 - DNA, 22 bp, Artificial Sequence
  chemically synthesized
ctgtgttgcccttttggagtca

SEQ ID NO: 783435 - DNA, 22 bp, Artificial Sequence
  chemically synthesized
tgttgcccttttggagtcacat

SEQ ID NO: 783436 - DNA, 22 bp, Artificial Sequence
  chemically synthesized
cccttttggagtcacatccatc

SEQ ID NO: 783437 - DNA, 22 bp, Artificial Sequence
  chemically synthesized
ttggagtcacatccatctctct

SEQ ID NO: 783438 - DNA, 22 bp, Artificial Sequence
  chemically synthesized
tggagtcacatccatctctctc

SEQ ID NO: 783439 - DNA, 22 bp, Artificial Sequence
  chemically synthesized
ggagtcacatccatctctctct

SEQ ID NO: 783440 - DNA, 22 bp, Artificial Sequence
  chemically synthesized
gagtcacatccatctctctctc

SEQ ID NO: 783441 - DNA, 22 bp, Artificial Sequence
  chemically synthesized
tctctctctctttcccctgttg

SEQ ID NO: 783442 - DNA, 22 bp, Artificial Sequence
  chemically synthesized
tctctctctttcccctgttgtc

SEQ ID NO: 783443 - DNA, 22 bp, Artificial Sequence
  chemically synthesized
caaggagtccgggacaacaggg

SEQ ID NO: 783444 - DNA, 22 bp, Artificial Sequence
  chemically synthesized
tctctctttcccctgttgtccc

SEQ ID NO: 783445 - DNA, 22 bp, Artificial Sequence
  chemically synthesized
tctctttcccctgttgtcccgg

SEQ ID NO: 783446 - DNA, 22 bp, Artificial Sequence
  chemically synthesized
tctttcccctgttgtcccggac

SEQ ID NO: 783447 - DNA, 22 bp, Artificial Sequence
  chemically synthesized
gtgattgcaaggagtccgggac

SEQ ID NO: 783448 - DNA, 22 bp, Artificial Sequence
  chemically synthesized
tttcccctgttgtcccggactc

SEQ ID NO: 783449 - DNA, 22 bp, Artificial Sequence
  chemically synthesized
tcccctgttgtcccggactcct

SEQ ID NO: 783450 - DNA, 22 bp, Artificial Sequence
  chemically synthesized
cccctgttgtcccggactcctt

SEQ ID NO: 783451 - DNA, 22 bp, Artificial Sequence
  chemically synthesized
ccctgttgtcccggactccttg

SEQ ID NO: 783452 - DNA, 22 bp, Artificial Sequence
  chemically synthesized
ttgtcccggactccttgcaatc

SEQ ID NO: 783453 - DNA, 22 bp, Artificial Sequence
  chemically synthesized
tcccggactccttgcaatcacc

SEQ ID NO: 783454 - DNA, 22 bp, Artificial Sequence
  chemically synthesized
aagaatgaagaacagattggtg

SEQ ID NO: 783455 - DNA, 22 bp, Artificial Sequence
  chemically synthesized
cttgcaatcaccaatctgttct

SEQ ID NO: 783456 - DNA, 22 bp, Artificial Sequence
  chemically synthesized
gcaatcaccaatctgttcttca

SEQ ID NO: 783457 - DNA, 22 bp, Artificial Sequence
  chemically synthesized
caatcaccaatctgttcttcat

SEQ ID NO: 783458 - DNA, 22 bp, Artificial Sequence
  chemically synthesized
aagtgacagaattaaagaatga

SEQ ID NO: 783459 - DNA, 22 bp, Artificial Sequence
  chemically synthesized
gaagtgacagaattaaagaatg

SEQ ID NO: 783460 - DNA, 22 bp, Artificial Sequence
  chemically synthesized
ttcttcattctttaattctgtc

SEQ ID NO: 783461 - DNA, 22 bp, Artificial Sequence
  chemically synthesized
ttcattctttaattctgtcact

SEQ ID NO: 783462 - DNA, 22 bp, Artificial Sequence
  chemically synthesized
cattctttaattctgtcacttc

SEQ ID NO: 783463 - DNA, 22 bp, Artificial Sequence
  chemically synthesized
tatagccgtcttgaagtgacag

SEQ ID NO: 783464 - DNA, 22 bp, Artificial Sequence
  chemically synthesized
attctttaattctgtcacttca

SEQ ID NO: 783465 - DNA, 22 bp, Artificial Sequence
  chemically synthesized
atatagccgtcttgaagtgaca

SEQ ID NO: 783466 - DNA, 22 bp, Artificial Sequence
  chemically synthesized
tttatatagccgtcttgaagtg

SEQ ID NO: 783467 - DNA, 22 bp, Artificial Sequence
  chemically synthesized
tttaattctgtcacttcaagac

SEQ ID NO: 783468 - DNA, 22 bp, Artificial Sequence
  chemically synthesized
tgtttatatagccgtcttgaag

SEQ ID NO: 783469 - DNA, 22 bp, Artificial Sequence
  chemically synthesized
taattctgtcacttcaagacgg

SEQ ID NO: 783470 - DNA, 22 bp, Artificial Sequence
  chemically synthesized
aattctgtcacttcaagacggc

SEQ ID NO: 783471 - DNA, 22 bp, Artificial Sequence
  chemically synthesized
attctgtcacttcaagacggct

SEQ ID NO: 783472 - DNA, 22 bp, Artificial Sequence
  chemically synthesized
tgtcacttcaagacggctatat

SEQ ID NO: 783473 - DNA, 22 bp, Artificial Sequence
  chemically synthesized
tcacttcaagacggctatataa

SEQ ID NO: 783474 - DNA, 22 bp, Artificial Sequence
  chemically synthesized
caagacggctatataaacagaa

SEQ ID NO: 783475 - DNA, 22 bp, Artificial Sequence
  chemically synthesized
cataatgaatgattctgtttat

SEQ ID NO: 783476 - DNA, 22 bp, Artificial Sequence
  chemically synthesized
aagacggctatataaacagaat

SEQ ID NO: 783477 - DNA, 22 bp, Artificial Sequence
  chemically synthesized
aaaaggttacataatgaatgat

SEQ ID NO: 783478 - DNA, 22 bp, Artificial Sequence
  chemically synthesized
tataaacagaatcattcattat

SEQ ID NO: 783479 - DNA, 22 bp, Artificial Sequence
  chemically synthesized
atctgaaaaggttacataatga

SEQ ID NO: 783480 - DNA, 22 bp, Artificial Sequence
  chemically synthesized
attatgtaaccttttcagatga

SEQ ID NO: 783481 - DNA, 22 bp, Artificial Sequence
  chemically synthesized
agtaaaaacagctcatctgaaa

SEQ ID NO: 783482 - DNA, 22 bp, Artificial Sequence
  chemically synthesized
tgtaaccttttcagatgagctg

SEQ ID NO: 783483 - DNA, 22 bp, Artificial Sequence
  chemically synthesized
tgctgagtaaaaacagctcatc

SEQ ID NO: 783484 - DNA, 22 bp, Artificial Sequence
  chemically synthesized
ttcagatgagctgtttttactc

SEQ ID NO: 783485 - DNA, 22 bp, Artificial Sequence
  chemically synthesized
tcagatgagctgtttttactca

SEQ ID NO: 783486 - DNA, 22 bp, Artificial Sequence
  chemically synthesized
cagatgagctgtttttactcag

SEQ ID NO: 783487 - DNA, 22 bp, Artificial Sequence
  chemically synthesized
cacagaattatgctgagtaaaa

SEQ ID NO: 783488 - DNA, 22 bp, Artificial Sequence
  chemically synthesized
agatgagctgtttttactcagc

SEQ ID NO: 783489 - DNA, 22 bp, Artificial Sequence
  chemically synthesized
gatcaatctccacagaattatg

SEQ ID NO: 783490 - DNA, 22 bp, Artificial Sequence
  chemically synthesized
tttttactcagcataattctgt

SEQ ID NO: 783491 - DNA, 22 bp, Artificial Sequence
  chemically synthesized
agatcaatctccacagaattat

SEQ ID NO: 783492 - DNA, 22 bp, Artificial Sequence
  chemically synthesized
tagatcaatctccacagaatta

SEQ ID NO: 783493 - DNA, 22 bp, Artificial Sequence
  chemically synthesized
ttagatcaatctccacagaatt

SEQ ID NO: 783494 - DNA, 22 bp, Artificial Sequence
  chemically synthesized
ttactcagcataattctgtgga

SEQ ID NO: 783495 - DNA, 22 bp, Artificial Sequence
  chemically synthesized
tactcagcataattctgtggag

SEQ ID NO: 783496 - DNA, 22 bp, Artificial Sequence
  chemically synthesized
actcagcataattctgtggaga

SEQ ID NO: 783497 - DNA, 22 bp, Artificial Sequence
  chemically synthesized
ctcagcataattctgtggagat

SEQ ID NO: 783498 - DNA, 22 bp, Artificial Sequence
  chemically synthesized
agcataattctgtggagattga

SEQ ID NO: 783499 - DNA, 22 bp, Artificial Sequence
  chemically synthesized
tacatgcaacaacttttagatc

SEQ ID NO: 783500 - DNA, 22 bp, Artificial Sequence
  chemically synthesized
atacatgcaacaacttttagat

SEQ ID NO: 783501 - DNA, 22 bp, Artificial Sequence
  chemically synthesized
tgtggagattgatctaaaagtt

SEQ ID NO: 783502 - DNA, 22 bp, Artificial Sequence
  chemically synthesized
tggagattgatctaaaagttgt

SEQ ID NO: 783503 - DNA, 22 bp, Artificial Sequence
  chemically synthesized
atctaaaagttgttgcatgtat

SEQ ID NO: 783504 - DNA, 22 bp, Artificial Sequence
  chemically synthesized
aaagttgttgcatgtataaata

SEQ ID NO: 783505 - DNA, 22 bp, Artificial Sequence
  chemically synthesized
ttgcatgtataaatatttcatt

SEQ ID NO: 783506 - DNA, 22 bp, Artificial Sequence
  chemically synthesized
agcaataaaatggaatgaaata

SEQ ID NO: 783507 - DNA, 22 bp, Artificial Sequence
  chemically synthesized
catgtataaatatttcattcca

SEQ ID NO: 783508 - DNA, 22 bp, Artificial Sequence
  chemically synthesized
ttcagcaataaaatggaatgaa

SEQ ID NO: 783509 - DNA, 22 bp, Artificial Sequence
  chemically synthesized
cattccattttattgctgaata

SEQ ID NO: 783510 - DNA, 22 bp, Artificial Sequence
  chemically synthesized
attccattttattgctgaatag

SEQ ID NO: 783511 - DNA, 22 bp, Artificial Sequence
  chemically synthesized
cattttattgctgaatagtatt

SEQ ID NO: 783512 - DNA, 22 bp, Artificial Sequence
  chemically synthesized
tattgctgaatagtattgcctg

SEQ ID NO: 783513 - DNA, 22 bp, Artificial Sequence
  chemically synthesized
attgctgaatagtattgcctgg

SEQ ID NO: 783514 - DNA, 22 bp, Artificial Sequence
  chemically synthesized
ttgctgaatagtattgcctggt

SEQ ID NO: 783515 - DNA, 22 bp, Artificial Sequence
  chemically synthesized
ctgaatagtattgcctggtatg

SEQ ID NO: 783516 - DNA, 22 bp, Artificial Sequence
  chemically synthesized
cggtacatccatacataccagg

SEQ ID NO: 783517 - DNA, 22 bp, Artificial Sequence
  chemically synthesized
aatagtattgcctggtatgtat

SEQ ID NO: 783518 - DNA, 22 bp, Artificial Sequence
  chemically synthesized
tacaaactacggtacatccata

SEQ ID NO: 783519 - DNA, 22 bp, Artificial Sequence
  chemically synthesized
cctggtatgtatggatgtaccg

SEQ ID NO: 783520 - DNA, 22 bp, Artificial Sequence
  chemically synthesized
gtatgtatggatgtaccgtagt

SEQ ID NO: 783521 - DNA, 22 bp, Artificial Sequence
  chemically synthesized
gtacaaccattcattgttgacc

SEQ ID NO: 783522 - DNA, 22 bp, Artificial Sequence
  chemically synthesized
tacaaccattcattgttgaccg

SEQ ID NO: 783523 - DNA, 22 bp, Artificial Sequence
  chemically synthesized
gaaagaacccagacggtcaaca

SEQ ID NO: 783524 - DNA, 22 bp, Artificial Sequence
  chemically synthesized
attgttgaccgtctgggttctt

SEQ ID NO: 783525 - DNA, 22 bp, Artificial Sequence
  chemically synthesized
tagccaaaaactggaaagaacc

SEQ ID NO: 783526 - DNA, 22 bp, Artificial Sequence
  chemically synthesized
ttgaccgtctgggttctttcca

SEQ ID NO: 783527 - DNA, 22 bp, Artificial Sequence
  chemically synthesized
accgtctgggttctttccagtt

SEQ ID NO: 783528 - DNA, 22 bp, Artificial Sequence
  chemically synthesized
attatagccaaaaactggaaag

SEQ ID NO: 783529 - DNA, 22 bp, Artificial Sequence
  chemically synthesized
ttcattatagccaaaaactgga

SEQ ID NO: 783530 - DNA, 22 bp, Artificial Sequence
  chemically synthesized
ggttctttccagtttttggcta

SEQ ID NO: 783531 - DNA, 22 bp, Artificial Sequence
  chemically synthesized
tttccagtttttggctataatg

SEQ ID NO: 783532 - DNA, 22 bp, Artificial Sequence
  chemically synthesized
tccagtttttggctataatgaa

SEQ ID NO: 783533 - DNA, 22 bp, Artificial Sequence
  chemically synthesized
ataccaccattattcattatag

SEQ ID NO: 783534 - DNA, 22 bp, Artificial Sequence
  chemically synthesized
ccagtttttggctataatgaat

SEQ ID NO: 783535 - DNA, 22 bp, Artificial Sequence
  chemically synthesized
cagtttttggctataatgaata

SEQ ID NO: 783536 - DNA, 22 bp, Artificial Sequence
  chemically synthesized
ttggctataatgaataatggtg

SEQ ID NO: 783537 - DNA, 22 bp, Artificial Sequence
  chemically synthesized
tggctataatgaataatggtgg

SEQ ID NO: 783538 - DNA, 22 bp, Artificial Sequence
  chemically synthesized
ggctataatgaataatggtggt

SEQ ID NO: 783539 - DNA, 22 bp, Artificial Sequence
  chemically synthesized
gctataatgaataatggtggta

SEQ ID NO: 783540 - DNA, 22 bp, Artificial Sequence
  chemically synthesized
tacaaaaatattcataccacca

SEQ ID NO: 783541 - DNA, 22 bp, Artificial Sequence
  chemically synthesized
taatgaataatggtggtatgaa

SEQ ID NO: 783542 - DNA, 22 bp, Artificial Sequence
  chemically synthesized
caacctgtacaaaaatattcat

SEQ ID NO: 783543 - DNA, 22 bp, Artificial Sequence
  chemically synthesized
acaacctgtacaaaaatattca

SEQ ID NO: 783544 - DNA, 22 bp, Artificial Sequence
  chemically synthesized
tcttacaacctgtacaaaaata

SEQ ID NO: 783545 - DNA, 22 bp, Artificial Sequence
  chemically synthesized
atcttacaacctgtacaaaaat

SEQ ID NO: 783546 - DNA, 22 bp, Artificial Sequence
  chemically synthesized
gacatttatcttacaacctgta

SEQ ID NO: 783547 - DNA, 22 bp, Artificial Sequence
  chemically synthesized
ggacatttatcttacaacctgt

SEQ ID NO: 783548 - DNA, 22 bp, Artificial Sequence
  chemically synthesized
ttggacatttatcttacaacct

SEQ ID NO: 783549 - DNA, 22 bp, Artificial Sequence
  chemically synthesized
cactcttggacatttatcttac

SEQ ID NO: 783550 - DNA, 22 bp, Artificial Sequence
  chemically synthesized
ttgtacaggttgtaagataaat

SEQ ID NO: 783551 - DNA, 22 bp, Artificial Sequence
  chemically synthesized
tgtacaggttgtaagataaatg

SEQ ID NO: 783552 - DNA, 22 bp, Artificial Sequence
  chemically synthesized
gtacaggttgtaagataaatgt

SEQ ID NO: 783553 - DNA, 22 bp, Artificial Sequence
  chemically synthesized
tacaggttgtaagataaatgtc

SEQ ID NO: 783554 - DNA, 22 bp, Artificial Sequence
  chemically synthesized
taagataaatgtccaagagtgc

SEQ ID NO: 783555 - DNA, 22 bp, Artificial Sequence
  chemically synthesized
ccatacaacccagcaattgcac

SEQ ID NO: 783556 - DNA, 22 bp, Artificial Sequence
  chemically synthesized
aacatgcagctaccatacaacc

SEQ ID NO: 783557 - DNA, 22 bp, Artificial Sequence
  chemically synthesized
taaaactaaacatgcagctacc

SEQ ID NO: 783558 - DNA, 22 bp, Artificial Sequence
  chemically synthesized
ctgggttgtatggtagctgcat

SEQ ID NO: 783559 - DNA, 22 bp, Artificial Sequence
  chemically synthesized
tgtaaaactaaacatgcagcta

SEQ ID NO: 783560 - DNA, 22 bp, Artificial Sequence
  chemically synthesized
ctgtaaaactaaacatgcagct

SEQ ID NO: 783561 - DNA, 22 bp, Artificial Sequence
  chemically synthesized
ggttgtatggtagctgcatgtt

SEQ ID NO: 783562 - DNA, 22 bp, Artificial Sequence
  chemically synthesized
tctgtaaaactaaacatgcagc

SEQ ID NO: 783563 - DNA, 22 bp, Artificial Sequence
  chemically synthesized
tatggtagctgcatgtttagtt

SEQ ID NO: 783564 - DNA, 22 bp, Artificial Sequence
  chemically synthesized
tcaattttctgtaaaactaaac

SEQ ID NO: 783565 - DNA, 22 bp, Artificial Sequence
  chemically synthesized
atcaattttctgtaaaactaaa

SEQ ID NO: 783566 - DNA, 22 bp, Artificial Sequence
  chemically synthesized
tttatcaattttctgtaaaact

SEQ ID NO: 783567 - DNA, 22 bp, Artificial Sequence
  chemically synthesized
catgtttagttttacagaaaat

SEQ ID NO: 783568 - DNA, 22 bp, Artificial Sequence
  chemically synthesized
tagcaaactgtttatcaatttt

SEQ ID NO: 783569 - DNA, 22 bp, Artificial Sequence
  chemically synthesized
agttttacagaaaattgataaa

SEQ ID NO: 783570 - DNA, 22 bp, Artificial Sequence
  chemically synthesized
gttttacagaaaattgataaac

SEQ ID NO: 783571 - DNA, 22 bp, Artificial Sequence
  chemically synthesized
tacagaaaattgataaacagtt

SEQ ID NO: 783572 - DNA, 22 bp, Artificial Sequence
  chemically synthesized
acagaaaattgataaacagttt

SEQ ID NO: 783573 - DNA, 22 bp, Artificial Sequence
  chemically synthesized
cagaaaattgataaacagtttg

SEQ ID NO: 783574 - DNA, 22 bp, Artificial Sequence
  chemically synthesized
ataaacagtttgctacagtggc

SEQ ID NO: 783575 - DNA, 22 bp, Artificial Sequence
  chemically synthesized
gtggaaatgtaaaatggtacag

SEQ ID NO: 783576 - DNA, 22 bp, Artificial Sequence
  chemically synthesized
gctacagtggctgtaccatttt

SEQ ID NO: 783577 - DNA, 22 bp, Artificial Sequence
  chemically synthesized
ctacagtggctgtaccatttta

SEQ ID NO: 783578 - DNA, 22 bp, Artificial Sequence
  chemically synthesized
ctggtggaaatgtaaaatggta

SEQ ID NO: 783579 - DNA, 22 bp, Artificial Sequence
  chemically synthesized
cagtggctgtaccattttacat

SEQ ID NO: 783580 - DNA, 22 bp, Artificial Sequence
  chemically synthesized
acatattgctggtggaaatgta

SEQ ID NO: 783581 - DNA, 22 bp, Artificial Sequence
  chemically synthesized
taccattttacatttccaccag

SEQ ID NO: 783582 - DNA, 22 bp, Artificial Sequence
  chemically synthesized
tacatttccaccagcaatatgt

SEQ ID NO: 783583 - DNA, 22 bp, Artificial Sequence
  chemically synthesized
acatttccaccagcaatatgtg

SEQ ID NO: 783584 - DNA, 22 bp, Artificial Sequence
  chemically synthesized
catttccaccagcaatatgtga

SEQ ID NO: 783585 - DNA, 22 bp, Artificial Sequence
  chemically synthesized
ccaccagcaatatgtgaatgat

SEQ ID NO: 783586 - DNA, 22 bp, Artificial Sequence
  chemically synthesized
caccagcaatatgtgaatgatc

SEQ ID NO: 783587 - DNA, 22 bp, Artificial Sequence
  chemically synthesized
gcaaggatgtggagaaaatgga

SEQ ID NO: 783588 - DNA, 22 bp, Artificial Sequence
  chemically synthesized
caacaccagatgctagcaagga

SEQ ID NO: 783589 - DNA, 22 bp, Artificial Sequence
  chemically synthesized
tctccacatccttgctagcatc

SEQ ID NO: 783590 - DNA, 22 bp, Artificial Sequence
  chemically synthesized
ctccacatccttgctagcatct

SEQ ID NO: 783591 - DNA, 22 bp, Artificial Sequence
  chemically synthesized
tccacatccttgctagcatctg

SEQ ID NO: 783592 - DNA, 22 bp, Artificial Sequence
  chemically synthesized
cacatccttgctagcatctggt

SEQ ID NO: 783593 - DNA, 22 bp, Artificial Sequence
  chemically synthesized
aaacaaagtagttacaacacca

SEQ ID NO: 783594 - DNA, 22 bp, Artificial Sequence
  chemically synthesized
gctagcatctggtgttgtaact

SEQ ID NO: 783595 - DNA, 22 bp, Artificial Sequence
  chemically synthesized
ctagcatctggtgttgtaacta

SEQ ID NO: 783596 - DNA, 22 bp, Artificial Sequence
  chemically synthesized
gcatctggtgttgtaactactt

SEQ ID NO: 783597 - DNA, 22 bp, Artificial Sequence
  chemically synthesized
tcagaatggctaaaacaaagta

SEQ ID NO: 783598 - DNA, 22 bp, Artificial Sequence
  chemically synthesized
gtgttgtaactactttgtttta

SEQ ID NO: 783599 - DNA, 22 bp, Artificial Sequence
  chemically synthesized
taactactttgttttagccatt

SEQ ID NO: 783600 - DNA, 22 bp, Artificial Sequence
  chemically synthesized
cacatctatcagaatggctaaa

SEQ ID NO: 783601 - DNA, 22 bp, Artificial Sequence
  chemically synthesized
ctacacatctatcagaatggct

SEQ ID NO: 783602 - DNA, 22 bp, Artificial Sequence
  chemically synthesized
ctttgttttagccattctgata

SEQ ID NO: 783603 - DNA, 22 bp, Artificial Sequence
  chemically synthesized
tgttttagccattctgatagat

SEQ ID NO: 783604 - DNA, 22 bp, Artificial Sequence
  chemically synthesized
gttttagccattctgatagatg

SEQ ID NO: 783605 - DNA, 22 bp, Artificial Sequence
  chemically synthesized
tatattcctacacatctatcag

SEQ ID NO: 783606 - DNA, 22 bp, Artificial Sequence
  chemically synthesized
ttttagccattctgatagatgt

SEQ ID NO: 783607 - DNA, 22 bp, Artificial Sequence
  chemically synthesized
ttatatattcctacacatctat

SEQ ID NO: 783608 - DNA, 22 bp, Artificial Sequence
  chemically synthesized
tagccattctgatagatgtgta

SEQ ID NO: 783609 - DNA, 22 bp, Artificial Sequence
  chemically synthesized
agccattctgatagatgtgtag

SEQ ID NO: 783610 - DNA, 22 bp, Artificial Sequence
  chemically synthesized
gccattctgatagatgtgtagg

SEQ ID NO: 783611 - DNA, 22 bp, Artificial Sequence
  chemically synthesized
aaattattatatattcctacac

SEQ ID NO: 783612 - DNA, 22 bp, Artificial Sequence
  chemically synthesized
tgatagatgtgtaggaatatat

SEQ ID NO: 783613 - DNA, 22 bp, Artificial Sequence
  chemically synthesized
atagatgtgtaggaatatataa

SEQ ID NO: 783614 - DNA, 22 bp, Artificial Sequence
  chemically synthesized
gagaaatgcaaattaaaattat

SEQ ID NO: 783615 - DNA, 22 bp, Artificial Sequence
  chemically synthesized
gccattagagaaatgcaaatta

SEQ ID NO: 783616 - DNA, 22 bp, Artificial Sequence
  chemically synthesized
taatttgcatttctctaatggc

SEQ ID NO: 783617 - DNA, 22 bp, Artificial Sequence
  chemically synthesized
tcaaaaacattagccattagag

SEQ ID NO: 783618 - DNA, 22 bp, Artificial Sequence
  chemically synthesized
aatttgcatttctctaatggct

SEQ ID NO: 783619 - DNA, 22 bp, Artificial Sequence
  chemically synthesized
atttgcatttctctaatggcta

SEQ ID NO: 783620 - DNA, 22 bp, Artificial Sequence
  chemically synthesized
gcatttctctaatggctaatgt

SEQ ID NO: 783621 - DNA, 22 bp, Artificial Sequence
  chemically synthesized
catttctctaatggctaatgtt

SEQ ID NO: 783622 - DNA, 22 bp, Artificial Sequence
  chemically synthesized
ctctaatggctaatgtttttga

SEQ ID NO: 783623 - DNA, 22 bp, Artificial Sequence
  chemically synthesized
tctaatggctaatgtttttgat

SEQ ID NO: 783624 - DNA, 22 bp, Artificial Sequence
  chemically synthesized
taatggctaatgtttttgataa

SEQ ID NO: 783625 - DNA, 22 bp, Artificial Sequence
  chemically synthesized
atggctaatgtttttgataatc

SEQ ID NO: 783626 - DNA, 22 bp, Artificial Sequence
  chemically synthesized
atgtttttgataatcttttcat

SEQ ID NO: 783627 - DNA, 22 bp, Artificial Sequence
  chemically synthesized
ttgataatcttttcatgcacct

SEQ ID NO: 783628 - DNA, 22 bp, Artificial Sequence
  chemically synthesized
tgataatcttttcatgcaccta

SEQ ID NO: 783629 - DNA, 22 bp, Artificial Sequence
  chemically synthesized
gataatcttttcatgcacctat

SEQ ID NO: 783630 - DNA, 22 bp, Artificial Sequence
  chemically synthesized
ataatcttttcatgcacctatt

SEQ ID NO: 783631 - DNA, 22 bp, Artificial Sequence
  chemically synthesized
ttcatgcacctatttgctatct

SEQ ID NO: 783632 - DNA, 22 bp, Artificial Sequence
  chemically synthesized
tcatgcacctatttgctatctg

SEQ ID NO: 783633 - DNA, 22 bp, Artificial Sequence
  chemically synthesized
catgcacctatttgctatctgt

SEQ ID NO: 783634 - DNA, 22 bp, Artificial Sequence
  chemically synthesized
atgcacctatttgctatctgta

SEQ ID NO: 783635 - DNA, 22 bp, Artificial Sequence
  chemically synthesized
accaaaaaggatatacagatag

SEQ ID NO: 783636 - DNA, 22 bp, Artificial Sequence
  chemically synthesized
caccaaaaaggatatacagata

SEQ ID NO: 783637 - DNA, 22 bp, Artificial Sequence
  chemically synthesized
tttgctatctgtatatcctttt

SEQ ID NO: 783638 - DNA, 22 bp, Artificial Sequence
  chemically synthesized
gctatctgtatatcctttttgg

SEQ ID NO: 783639 - DNA, 22 bp, Artificial Sequence
  chemically synthesized
ctatctgtatatcctttttggt

SEQ ID NO: 783640 - DNA, 22 bp, Artificial Sequence
  chemically synthesized
tctgtatatcctttttggtgaa

SEQ ID NO: 783641 - DNA, 22 bp, Artificial Sequence
  chemically synthesized
tatatcctttttggtgaaacgt

SEQ ID NO: 783642 - DNA, 22 bp, Artificial Sequence
  chemically synthesized
tttggtgaaacgtttcttgatg

SEQ ID NO: 783643 - DNA, 22 bp, Artificial Sequence
  chemically synthesized
ttggtgaaacgtttcttgatgt

SEQ ID NO: 783644 - DNA, 22 bp, Artificial Sequence
  chemically synthesized
tggtgaaacgtttcttgatgtg

SEQ ID NO: 783645 - DNA, 22 bp, Artificial Sequence
  chemically synthesized
ggtgaaacgtttcttgatgtgt

SEQ ID NO: 783646 - DNA, 22 bp, Artificial Sequence
  chemically synthesized
gtgaaacgtttcttgatgtgtc

SEQ ID NO: 783647 - DNA, 22 bp, Artificial Sequence
  chemically synthesized
ggaaatgggcaagacacatcaa

SEQ ID NO: 783648 - DNA, 22 bp, Artificial Sequence
  chemically synthesized
cttgatgtgtcttgcccatttc

SEQ ID NO: 783649 - DNA, 22 bp, Artificial Sequence
  chemically synthesized
ttgatgtgtcttgcccatttcc

SEQ ID NO: 783650 - DNA, 22 bp, Artificial Sequence
  chemically synthesized
gatgtgtcttgcccatttccta

SEQ ID NO: 783651 - DNA, 22 bp, Artificial Sequence
  chemically synthesized
atgtgtcttgcccatttcctaa

SEQ ID NO: 783652 - DNA, 22 bp, Artificial Sequence
  chemically synthesized
gcccatttcctaattgcattgt

SEQ ID NO: 783653 - DNA, 22 bp, Artificial Sequence
  chemically synthesized
cccatttcctaattgcattgtt

SEQ ID NO: 783654 - DNA, 22 bp, Artificial Sequence
  chemically synthesized
cctaattgcattgtttgtttct

SEQ ID NO: 783655 - DNA, 22 bp, Artificial Sequence
  chemically synthesized
caaggtaaaacaagaaacaaac

SEQ ID NO: 783656 - DNA, 22 bp, Artificial Sequence
  chemically synthesized
ctaattgcattgtttgtttctt

SEQ ID NO: 783657 - DNA, 22 bp, Artificial Sequence
  chemically synthesized
attgcattgtttgtttcttgtt

SEQ ID NO: 783658 - DNA, 22 bp, Artificial Sequence
  chemically synthesized
aaaactgcaaggtaaaacaaga

SEQ ID NO: 783659 - DNA, 22 bp, Artificial Sequence
  chemically synthesized
cattgtttgtttcttgttttac

SEQ ID NO: 783660 - DNA, 22 bp, Artificial Sequence
  chemically synthesized
tcaaaactgcaaggtaaaacaa

SEQ ID NO: 783661 - DNA, 22 bp, Artificial Sequence
  chemically synthesized
tttgtttcttgttttaccttgc

SEQ ID NO: 783662 - DNA, 22 bp, Artificial Sequence
  chemically synthesized
gtttcttgttttaccttgcagt

SEQ ID NO: 783663 - DNA, 22 bp, Artificial Sequence
  chemically synthesized
tttcttgttttaccttgcagtt

SEQ ID NO: 783664 - DNA, 22 bp, Artificial Sequence
  chemically synthesized
cttgttttaccttgcagttttg

SEQ ID NO: 783665 - DNA, 22 bp, Artificial Sequence
  chemically synthesized
ttgttttaccttgcagttttga

SEQ ID NO: 783666 - DNA, 22 bp, Artificial Sequence
  chemically synthesized
gttttaccttgcagttttgaga

SEQ ID NO: 783667 - DNA, 22 bp, Artificial Sequence
  chemically synthesized
ttttaccttgcagttttgagag

SEQ ID NO: 783668 - DNA, 22 bp, Artificial Sequence
  chemically synthesized
gaatatataaagaactctcaaa

SEQ ID NO: 783669 - DNA, 22 bp, Artificial Sequence
  chemically synthesized
taccttgcagttttgagagttc

SEQ ID NO: 783670 - DNA, 22 bp, Artificial Sequence
  chemically synthesized
accttgcagttttgagagttct

SEQ ID NO: 783671 - DNA, 22 bp, Artificial Sequence
  chemically synthesized
ccttgcagttttgagagttctt

SEQ ID NO: 783672 - DNA, 22 bp, Artificial Sequence
  chemically synthesized
gcagttttgagagttctttata

SEQ ID NO: 783673 - DNA, 22 bp, Artificial Sequence
  chemically synthesized
cagttttgagagttctttatat

SEQ ID NO: 783674 - DNA, 22 bp, Artificial Sequence
  chemically synthesized
tgagagttctttatatattcta

SEQ ID NO: 783675 - DNA, 22 bp, Artificial Sequence
  chemically synthesized
gagagttctttatatattctag

SEQ ID NO: 783676 - DNA, 22 bp, Artificial Sequence
  chemically synthesized
agagttctttatatattctaga

SEQ ID NO: 783677 - DNA, 22 bp, Artificial Sequence
  chemically synthesized
tttatatattctagacatccat

SEQ ID NO: 783678 - DNA, 22 bp, Artificial Sequence
  chemically synthesized
tatatattctagacatccatct

SEQ ID NO: 783679 - DNA, 22 bp, Artificial Sequence
  chemically synthesized
atatattctagacatccatctt

SEQ ID NO: 783680 - DNA, 22 bp, Artificial Sequence
  chemically synthesized
tatattctagacatccatcttt

SEQ ID NO: 783681 - DNA, 22 bp, Artificial Sequence
  chemically synthesized
aagccatatagccaaaagatgg

SEQ ID NO: 783682 - DNA, 22 bp, Artificial Sequence
  chemically synthesized
caagccatatagccaaaagatg

SEQ ID NO: 783683 - DNA, 22 bp, Artificial Sequence
  chemically synthesized
tcaagccatatagccaaaagat

SEQ ID NO: 783684 - DNA, 22 bp, Artificial Sequence
  chemically synthesized
tagacatccatcttttggctat

SEQ ID NO: 783685 - DNA, 22 bp, Artificial Sequence
  chemically synthesized
gacatccatcttttggctatat

SEQ ID NO: 783686 - DNA, 22 bp, Artificial Sequence
  chemically synthesized
atagaaaatattttcaagccat

SEQ ID NO: 783687 - DNA, 22 bp, Artificial Sequence
  chemically synthesized
ttggctatatggcttgaaaata

SEQ ID NO: 783688 - DNA, 22 bp, Artificial Sequence
  chemically synthesized
tggctatatggcttgaaaatat

SEQ ID NO: 783689 - DNA, 22 bp, Artificial Sequence
  chemically synthesized
ggctatatggcttgaaaatatt

SEQ ID NO: 783690 - DNA, 22 bp, Artificial Sequence
  chemically synthesized
gctatatggcttgaaaatattt

SEQ ID NO: 783691 - DNA, 22 bp, Artificial Sequence
  chemically synthesized
cagactgatagaaaatattttc

SEQ ID NO: 783692 - DNA, 22 bp, Artificial Sequence
  chemically synthesized
tatggcttgaaaatattttcta

SEQ ID NO: 783693 - DNA, 22 bp, Artificial Sequence
  chemically synthesized
gaaaatattttctatcagtctg

SEQ ID NO: 783694 - DNA, 22 bp, Artificial Sequence
  chemically synthesized
aaaatattttctatcagtctgt

SEQ ID NO: 783695 - DNA, 22 bp, Artificial Sequence
  chemically synthesized
tctatcagtctgtagcttgtct

SEQ ID NO: 783696 - DNA, 22 bp, Artificial Sequence
  chemically synthesized
ctatcagtctgtagcttgtctt

SEQ ID NO: 783697 - DNA, 22 bp, Artificial Sequence
  chemically synthesized
tatcagtctgtagcttgtcttt

SEQ ID NO: 783698 - DNA, 22 bp, Artificial Sequence
  chemically synthesized
tgagggaggatgaaaagacaag

SEQ ID NO: 783699 - DNA, 22 bp, Artificial Sequence
  chemically synthesized
tcagtctgtagcttgtcttttc

SEQ ID NO: 783700 - DNA, 22 bp, Artificial Sequence
  chemically synthesized
tagcttgtcttttcatcctccc

SEQ ID NO: 783701 - DNA, 22 bp, Artificial Sequence
  chemically synthesized
caaaagacctgtgagggaggat

SEQ ID NO: 783702 - DNA, 22 bp, Artificial Sequence
  chemically synthesized
gtcttttcatcctccctcacag

SEQ ID NO: 783703 - DNA, 22 bp, Artificial Sequence
  chemically synthesized
tcttttcatcctccctcacagg

SEQ ID NO: 783704 - DNA, 22 bp, Artificial Sequence
  chemically synthesized
cactgcaaaagacctgtgaggg

SEQ ID NO: 783705 - DNA, 22 bp, Artificial Sequence
  chemically synthesized
gcactgcaaaagacctgtgagg

SEQ ID NO: 783706 - DNA, 22 bp, Artificial Sequence
  chemically synthesized
tgcactgcaaaagacctgtgag

SEQ ID NO: 783707 - DNA, 22 bp, Artificial Sequence
  chemically synthesized
ttcatcctccctcacaggtctt

SEQ ID NO: 783708 - DNA, 22 bp, Artificial Sequence
  chemically synthesized
tcatcctccctcacaggtcttt

SEQ ID NO: 783709 - DNA, 22 bp, Artificial Sequence
  chemically synthesized
catcctccctcacaggtctttt

SEQ ID NO: 783710 - DNA, 22 bp, Artificial Sequence
  chemically synthesized
atcctccctcacaggtcttttg

SEQ ID NO: 783711 - DNA, 22 bp, Artificial Sequence
  chemically synthesized
aaacctttgcactgcaaaagac

SEQ ID NO: 783712 - DNA, 22 bp, Artificial Sequence
  chemically synthesized
aaaacctttgcactgcaaaaga

SEQ ID NO: 783713 - DNA, 22 bp, Artificial Sequence
  chemically synthesized
cctcacaggtcttttgcagtgc

SEQ ID NO: 783714 - DNA, 22 bp, Artificial Sequence
  chemically synthesized
acaggtcttttgcagtgcaaag

SEQ ID NO: 783715 - DNA, 22 bp, Artificial Sequence
  chemically synthesized
catcaagatttaaaacctttgc

SEQ ID NO: 783716 - DNA, 22 bp, Artificial Sequence
  chemically synthesized
ttgcagtgcaaaggttttaaat

SEQ ID NO: 783717 - DNA, 22 bp, Artificial Sequence
  chemically synthesized
gactgcatcaagatttaaaacc

SEQ ID NO: 783718 - DNA, 22 bp, Artificial Sequence
  chemically synthesized
tgcagtgcaaaggttttaaatc

SEQ ID NO: 783719 - DNA, 22 bp, Artificial Sequence
  chemically synthesized
gcagtgcaaaggttttaaatct

SEQ ID NO: 783720 - DNA, 22 bp, Artificial Sequence
  chemically synthesized
cagtgcaaaggttttaaatctt

SEQ ID NO: 783721 - DNA, 22 bp, Artificial Sequence
  chemically synthesized
taaatcttgatgcagtccaact

SEQ ID NO: 783722 - DNA, 22 bp, Artificial Sequence
  chemically synthesized
aaatcttgatgcagtccaactg

SEQ ID NO: 783723 - DNA, 22 bp, Artificial Sequence
  chemically synthesized
aatcttgatgcagtccaactga

SEQ ID NO: 783724 - DNA, 22 bp, Artificial Sequence
  chemically synthesized
gatgcagtccaactgatttttt

SEQ ID NO: 783725 - DNA, 22 bp, Artificial Sequence
  chemically synthesized
atgcagtccaactgattttttt

SEQ ID NO: 783726 - DNA, 22 bp, Artificial Sequence
  chemically synthesized
aaagcatgatccacacacagaa

SEQ ID NO: 783727 - DNA, 22 bp, Artificial Sequence
  chemically synthesized
atttttttctgtgtgtggatca

SEQ ID NO: 783728 - DNA, 22 bp, Artificial Sequence
  chemically synthesized
gcattgaaagcatgatccacac

SEQ ID NO: 783729 - DNA, 22 bp, Artificial Sequence
  chemically synthesized
ttttctgtgtgtggatcatgct

SEQ ID NO: 783730 - DNA, 22 bp, Artificial Sequence
  chemically synthesized
tttctgtgtgtggatcatgctt

SEQ ID NO: 783731 - DNA, 22 bp, Artificial Sequence
  chemically synthesized
ttctgtgtgtggatcatgcttt

SEQ ID NO: 783732 - DNA, 22 bp, Artificial Sequence
  chemically synthesized
gaattggcattgaaagcatgat

SEQ ID NO: 783733 - DNA, 22 bp, Artificial Sequence
  chemically synthesized
tctgtgtgtggatcatgctttc

SEQ ID NO: 783734 - DNA, 22 bp, Artificial Sequence
  chemically synthesized
ctgtgtgtggatcatgctttca

SEQ ID NO: 783735 - DNA, 22 bp, Artificial Sequence
  chemically synthesized
tgtgtgtggatcatgctttcaa

SEQ ID NO: 783736 - DNA, 22 bp, Artificial Sequence
  chemically synthesized
tgtgtggatcatgctttcaatg

SEQ ID NO: 783737 - DNA, 22 bp, Artificial Sequence
  chemically synthesized
gggctagaattggcattgaaag

SEQ ID NO: 783738 - DNA, 22 bp, Artificial Sequence
  chemically synthesized
tagggctagaattggcattgaa

SEQ ID NO: 783739 - DNA, 22 bp, Artificial Sequence
  chemically synthesized
aggctctagggctagaattggc

SEQ ID NO: 783740 - DNA, 22 bp, Artificial Sequence
  chemically synthesized
caggctctagggctagaattgg

SEQ ID NO: 783741 - DNA, 22 bp, Artificial Sequence
  chemically synthesized
tcaatgccaattctagccctag

SEQ ID NO: 783742 - DNA, 22 bp, Artificial Sequence
  chemically synthesized
caatgccaattctagccctaga

SEQ ID NO: 783743 - DNA, 22 bp, Artificial Sequence
  chemically synthesized
aatgccaattctagccctagag

SEQ ID NO: 783744 - DNA, 22 bp, Artificial Sequence
  chemically synthesized
tagccctagagcctgaagattt

SEQ ID NO: 783745 - DNA, 22 bp, Artificial Sequence
  chemically synthesized
gggaaaaatgagaaaatcttca

SEQ ID NO: 783746 - DNA, 22 bp, Artificial Sequence
  chemically synthesized
gccctagagcctgaagattttc

SEQ ID NO: 783747 - DNA, 22 bp, Artificial Sequence
  chemically synthesized
agggaaaaatgagaaaatcttc

SEQ ID NO: 783748 - DNA, 22 bp, Artificial Sequence
  chemically synthesized
gagcctgaagattttctcattt

SEQ ID NO: 783749 - DNA, 22 bp, Artificial Sequence
  chemically synthesized
tcaaaatttagggaaaaatgag

SEQ ID NO: 783750 - DNA, 22 bp, Artificial Sequence
  chemically synthesized
aagattttctcatttttcccta

SEQ ID NO: 783751 - DNA, 22 bp, Artificial Sequence
  chemically synthesized
tctcatttttccctaaattttg

SEQ ID NO: 783752 - DNA, 22 bp, Artificial Sequence
  chemically synthesized
ctcatttttccctaaattttga

SEQ ID NO: 783753 - DNA, 22 bp, Artificial Sequence
  chemically synthesized
tcatttttccctaaattttgat

SEQ ID NO: 783754 - DNA, 22 bp, Artificial Sequence
  chemically synthesized
atttttccctaaattttgatag

SEQ ID NO: 783755 - DNA, 22 bp, Artificial Sequence
  chemically synthesized
ttccctaaattttgatagtttt

SEQ ID NO: 783756 - DNA, 22 bp, Artificial Sequence
  chemically synthesized
aatgtaaaacataaaactatca

SEQ ID NO: 783757 - DNA, 22 bp, Artificial Sequence
  chemically synthesized
tccctaaattttgatagtttta

SEQ ID NO: 783758 - DNA, 22 bp, Artificial Sequence
  chemically synthesized
aaatgtaaaacataaaactatc

SEQ ID NO: 783759 - DNA, 22 bp, Artificial Sequence
  chemically synthesized
ccctaaattttgatagttttat

SEQ ID NO: 783760 - DNA, 22 bp, Artificial Sequence
  chemically synthesized
cctaaattttgatagttttatg

SEQ ID NO: 783761 - DNA, 22 bp, Artificial Sequence
  chemically synthesized
aattttgatagttttatgtttt

SEQ ID NO: 783762 - DNA, 22 bp, Artificial Sequence
  chemically synthesized
tgatagttttatgttttacatt

SEQ ID NO: 783763 - DNA, 22 bp, Artificial Sequence
  chemically synthesized
gatagttttatgttttacattt

SEQ ID NO: 783764 - DNA, 22 bp, Artificial Sequence
  chemically synthesized
atagttttatgttttacattta

SEQ ID NO: 783765 - DNA, 22 bp, Artificial Sequence
  chemically synthesized
aaaatagatcatggacttaaat

SEQ ID NO: 783766 - DNA, 22 bp, Artificial Sequence
  chemically synthesized
tatgttttacatttaagtccat

SEQ ID NO: 783767 - DNA, 22 bp, Artificial Sequence
  chemically synthesized
atgttttacatttaagtccatg

SEQ ID NO: 783768 - DNA, 22 bp, Artificial Sequence
  chemically synthesized
tgttttacatttaagtccatga

SEQ ID NO: 783769 - DNA, 22 bp, Artificial Sequence
  chemically synthesized
attcaaaatagatcatggactt

SEQ ID NO: 783770 - DNA, 22 bp, Artificial Sequence
  chemically synthesized
aattcaaaatagatcatggact

SEQ ID NO: 783771 - DNA, 22 bp, Artificial Sequence
  chemically synthesized
tacatttaagtccatgatctat

SEQ ID NO: 783772 - DNA, 22 bp, Artificial Sequence
  chemically synthesized
acatttaagtccatgatctatt

SEQ ID NO: 783773 - DNA, 22 bp, Artificial Sequence
  chemically synthesized
catttaagtccatgatctattt

SEQ ID NO: 783774 - DNA, 22 bp, Artificial Sequence
  chemically synthesized
taaaaacttaattcaaaataga

SEQ ID NO: 783775 - DNA, 22 bp, Artificial Sequence
  chemically synthesized
gtaaaaacttaattcaaaatag

SEQ ID NO: 783776 - DNA, 22 bp, Artificial Sequence
  chemically synthesized
aagtccatgatctattttgaat

SEQ ID NO: 783777 - DNA, 22 bp, Artificial Sequence
  chemically synthesized
agtccatgatctattttgaatt

SEQ ID NO: 783778 - DNA, 22 bp, Artificial Sequence
  chemically synthesized
acaccttgtaaaaacttaattc

SEQ ID NO: 783779 - DNA, 22 bp, Artificial Sequence
  chemically synthesized
aatctcacaccttgtaaaaact

SEQ ID NO: 783780 - DNA, 22 bp, Artificial Sequence
  chemically synthesized
ttttgaattaagtttttacaag

SEQ ID NO: 783781 - DNA, 22 bp, Artificial Sequence
  chemically synthesized
tgaattaagtttttacaaggtg

SEQ ID NO: 783782 - DNA, 22 bp, Artificial Sequence
  chemically synthesized
gaattaagtttttacaaggtgt

SEQ ID NO: 783783 - DNA, 22 bp, Artificial Sequence
  chemically synthesized
aacctaaatctcacaccttgta

SEQ ID NO: 783784 - DNA, 22 bp, Artificial Sequence
  chemically synthesized
aattaagtttttacaaggtgtg

SEQ ID NO: 783785 - DNA, 22 bp, Artificial Sequence
  chemically synthesized
caacctaaatctcacaccttgt

SEQ ID NO: 783786 - DNA, 22 bp, Artificial Sequence
  chemically synthesized
agtttttacaaggtgtgagatt

SEQ ID NO: 783787 - DNA, 22 bp, Artificial Sequence
  chemically synthesized
ttacaaggtgtgagatttaggt

SEQ ID NO: 783788 - DNA, 22 bp, Artificial Sequence
  chemically synthesized
tacaaggtgtgagatttaggtt

SEQ ID NO: 783789 - DNA, 22 bp, Artificial Sequence
  chemically synthesized
acaaggtgtgagatttaggttg

SEQ ID NO: 783790 - DNA, 22 bp, Artificial Sequence
  chemically synthesized
caaggtgtgagatttaggttga

SEQ ID NO: 783791 - DNA, 22 bp, Artificial Sequence
  chemically synthesized
gagtgggaaaaaaaaagaactt

SEQ ID NO: 783792 - DNA, 22 bp, Artificial Sequence
  chemically synthesized
aggttgaagttctttttttttc

SEQ ID NO: 783793 - DNA, 22 bp, Artificial Sequence
  chemically synthesized
ggttgaagttctttttttttcc

SEQ ID NO: 783794 - DNA, 22 bp, Artificial Sequence
  chemically synthesized
gacatccctagagtgggaaaaa

SEQ ID NO: 783795 - DNA, 22 bp, Artificial Sequence
  chemically synthesized
aagttctttttttttcccactc

SEQ ID NO: 783796 - DNA, 22 bp, Artificial Sequence
  chemically synthesized
tttttttttcccactctaggga

SEQ ID NO: 783797 - DNA, 22 bp, Artificial Sequence
  chemically synthesized
cagaaattggacatccctagag

SEQ ID NO: 783798 - DNA, 22 bp, Artificial Sequence
  chemically synthesized
tttttttcccactctagggatg

SEQ ID NO: 783799 - DNA, 22 bp, Artificial Sequence
  chemically synthesized
ttttttcccactctagggatgt

SEQ ID NO: 783800 - DNA, 22 bp, Artificial Sequence
  chemically synthesized
tttttcccactctagggatgtc

SEQ ID NO: 783801 - DNA, 22 bp, Artificial Sequence
  chemically synthesized
ttttcccactctagggatgtcc

SEQ ID NO: 783802 - DNA, 22 bp, Artificial Sequence
  chemically synthesized
tttcccactctagggatgtcca

SEQ ID NO: 783803 - DNA, 22 bp, Artificial Sequence
  chemically synthesized
ttcccactctagggatgtccaa

SEQ ID NO: 783804 - DNA, 22 bp, Artificial Sequence
  chemically synthesized
tcccactctagggatgtccaat

SEQ ID NO: 783805 - DNA, 22 bp, Artificial Sequence
  chemically synthesized
cccactctagggatgtccaatt

SEQ ID NO: 783806 - DNA, 22 bp, Artificial Sequence
  chemically synthesized
ccactctagggatgtccaattt

SEQ ID NO: 783807 - DNA, 22 bp, Artificial Sequence
  chemically synthesized
aacaaatggtcctgcagaaatt

SEQ ID NO: 783808 - DNA, 22 bp, Artificial Sequence
  chemically synthesized
tagggatgtccaatttctgcag

SEQ ID NO: 783809 - DNA, 22 bp, Artificial Sequence
  chemically synthesized
caacaaatggtcctgcagaaat

SEQ ID NO: 783810 - DNA, 22 bp, Artificial Sequence
  chemically synthesized
tcaacaaatggtcctgcagaaa

SEQ ID NO: 783811 - DNA, 22 bp, Artificial Sequence
  chemically synthesized
gggatgtccaatttctgcagga

SEQ ID NO: 783812 - DNA, 22 bp, Artificial Sequence
  chemically synthesized
ttcaacaaatggtcctgcagaa

SEQ ID NO: 783813 - DNA, 22 bp, Artificial Sequence
  chemically synthesized
accttttcaacaaatggtcctg

SEQ ID NO: 783814 - DNA, 22 bp, Artificial Sequence
  chemically synthesized
ctgcaggaccatttgttgaaaa

SEQ ID NO: 783815 - DNA, 22 bp, Artificial Sequence
  chemically synthesized
tgcaggaccatttgttgaaaag

SEQ ID NO: 783816 - DNA, 22 bp, Artificial Sequence
  chemically synthesized
caggaccatttgttgaaaaggt

SEQ ID NO: 783817 - DNA, 22 bp, Artificial Sequence
  chemically synthesized
aatagagaaagctcaccttttc

SEQ ID NO: 783818 - DNA, 22 bp, Artificial Sequence
  chemically synthesized
gttgaaaaggtgagctttctct

SEQ ID NO: 783819 - DNA, 22 bp, Artificial Sequence
  chemically synthesized
ttgaaaaggtgagctttctcta

SEQ ID NO: 783820 - DNA, 22 bp, Artificial Sequence
  chemically synthesized
caaaagcaattcaatagagaaa

SEQ ID NO: 783821 - DNA, 22 bp, Artificial Sequence
  chemically synthesized
aaaaggtgagctttctctattg

SEQ ID NO: 783822 - DNA, 22 bp, Artificial Sequence
  chemically synthesized
ataaagttgcaaaagcaattca

SEQ ID NO: 783823 - DNA, 22 bp, Artificial Sequence
  chemically synthesized
gataaagttgcaaaagcaattc

SEQ ID NO: 783824 - DNA, 22 bp, Artificial Sequence
  chemically synthesized
tgataaagttgcaaaagcaatt

SEQ ID NO: 783825 - DNA, 22 bp, Artificial Sequence
  chemically synthesized
ttgataaagttgcaaaagcaat

SEQ ID NO: 783826 - DNA, 22 bp, Artificial Sequence
  chemically synthesized
tctctattgaattgcttttgca

SEQ ID NO: 783827 - DNA, 22 bp, Artificial Sequence
  chemically synthesized
ctctattgaattgcttttgcaa

SEQ ID NO: 783828 - DNA, 22 bp, Artificial Sequence
  chemically synthesized
tctattgaattgcttttgcaac

SEQ ID NO: 783829 - DNA, 22 bp, Artificial Sequence
  chemically synthesized
tattgaattgcttttgcaactt

SEQ ID NO: 783830 - DNA, 22 bp, Artificial Sequence
  chemically synthesized
ttgaattgcttttgcaacttta

SEQ ID NO: 783831 - DNA, 22 bp, Artificial Sequence
  chemically synthesized
aattgcttttgcaactttatca

SEQ ID NO: 783832 - DNA, 22 bp, Artificial Sequence
  chemically synthesized
cttttgcaactttatcaaaaat

SEQ ID NO: 783833 - DNA, 22 bp, Artificial Sequence
  chemically synthesized
ttgcaactttatcaaaaatctg

SEQ ID NO: 783834 - DNA, 22 bp, Artificial Sequence
  chemically synthesized
tgcaactttatcaaaaatctgt

SEQ ID NO: 783835 - DNA, 22 bp, Artificial Sequence
  chemically synthesized
gcaactttatcaaaaatctgtt

SEQ ID NO: 783836 - DNA, 22 bp, Artificial Sequence
  chemically synthesized
caactttatcaaaaatctgttg

SEQ ID NO: 783837 - DNA, 22 bp, Artificial Sequence
  chemically synthesized
tatcaaaaatctgttgggcaca

SEQ ID NO: 783838 - DNA, 22 bp, Artificial Sequence
  chemically synthesized
atcaaaaatctgttgggcacat

SEQ ID NO: 783839 - DNA, 22 bp, Artificial Sequence
  chemically synthesized
tcaaaaatctgttgggcacatt

SEQ ID NO: 783840 - DNA, 22 bp, Artificial Sequence
  chemically synthesized
ttgggcacatttgcatgggtct

SEQ ID NO: 783841 - DNA, 22 bp, Artificial Sequence
  chemically synthesized
ggcacatttgcatgggtctgtt

SEQ ID NO: 783842 - DNA, 22 bp, Artificial Sequence
  chemically synthesized
gcatgggtctgtttttgggttc

SEQ ID NO: 783843 - DNA, 22 bp, Artificial Sequence
  chemically synthesized
catgggtctgtttttgggttct

SEQ ID NO: 783844 - DNA, 22 bp, Artificial Sequence
  chemically synthesized
tttttgggttctctattctgtt

SEQ ID NO: 783845 - DNA, 22 bp, Artificial Sequence
  chemically synthesized
atagaccaaatgaaacagaata

SEQ ID NO: 783846 - DNA, 22 bp, Artificial Sequence
  chemically synthesized
ttgggttctctattctgtttca

SEQ ID NO: 783847 - DNA, 22 bp, Artificial Sequence
  chemically synthesized
tgggttctctattctgtttcat

SEQ ID NO: 783848 - DNA, 22 bp, Artificial Sequence
  chemically synthesized
gggttctctattctgtttcatt

SEQ ID NO: 783849 - DNA, 22 bp, Artificial Sequence
  chemically synthesized
ggttctctattctgtttcattt

SEQ ID NO: 783850 - DNA, 22 bp, Artificial Sequence
  chemically synthesized
tctattctgtttcatttggtct

SEQ ID NO: 783851 - DNA, 22 bp, Artificial Sequence
  chemically synthesized
tattctgtttcatttggtctat

SEQ ID NO: 783852 - DNA, 22 bp, Artificial Sequence
  chemically synthesized
gagggatagactcatagaccaa

SEQ ID NO: 783853 - DNA, 22 bp, Artificial Sequence
  chemically synthesized
ttctgtttcatttggtctatga

SEQ ID NO: 783854 - DNA, 22 bp, Artificial Sequence
  chemically synthesized
ctggagggatagactcatagac

SEQ ID NO: 783855 - DNA, 22 bp, Artificial Sequence
  chemically synthesized
tgtttcatttggtctatgagtc

SEQ ID NO: 783856 - DNA, 22 bp, Artificial Sequence
  chemically synthesized
tttcatttggtctatgagtcta

SEQ ID NO: 783857 - DNA, 22 bp, Artificial Sequence
  chemically synthesized
catttggtctatgagtctatcc

SEQ ID NO: 783858 - DNA, 22 bp, Artificial Sequence
  chemically synthesized
atttggtctatgagtctatccc

SEQ ID NO: 783859 - DNA, 22 bp, Artificial Sequence
  chemically synthesized
ggtctatgagtctatccctcca

SEQ ID NO: 783860 - DNA, 22 bp, Artificial Sequence
  chemically synthesized
gtctatgagtctatccctccag

SEQ ID NO: 783861 - DNA, 22 bp, Artificial Sequence
  chemically synthesized
tgagtctatccctccagcaaca

SEQ ID NO: 783862 - DNA, 22 bp, Artificial Sequence
  chemically synthesized
tcaatacagtatgatgttgctg

SEQ ID NO: 783863 - DNA, 22 bp, Artificial Sequence
  chemically synthesized
tccctccagcaacatcatactg

SEQ ID NO: 783864 - DNA, 22 bp, Artificial Sequence
  chemically synthesized
cagcaacatcatactgtattga

SEQ ID NO: 783865 - DNA, 22 bp, Artificial Sequence
  chemically synthesized
acaatatagtaaggctatcaat

SEQ ID NO: 783866 - DNA, 22 bp, Artificial Sequence
  chemically synthesized
tggctaacaatatagtaaggct

SEQ ID NO: 783867 - DNA, 22 bp, Artificial Sequence
  chemically synthesized
tattgatagccttactatattg

SEQ ID NO: 783868 - DNA, 22 bp, Artificial Sequence
  chemically synthesized
atagccttactatattgttagc

SEQ ID NO: 783869 - DNA, 22 bp, Artificial Sequence
  chemically synthesized
cccaatattatggctaacaata

SEQ ID NO: 783870 - DNA, 22 bp, Artificial Sequence
  chemically synthesized
tacccaatattatggctaacaa

SEQ ID NO: 783871 - DNA, 22 bp, Artificial Sequence
  chemically synthesized
tctacccaatattatggctaac

SEQ ID NO: 783872 - DNA, 22 bp, Artificial Sequence
  chemically synthesized
actatattgttagccataatat

SEQ ID NO: 783873 - DNA, 22 bp, Artificial Sequence
  chemically synthesized
ctatattgttagccataatatt

SEQ ID NO: 783874 - DNA, 22 bp, Artificial Sequence
  chemically synthesized
tattgttagccataatattggg

SEQ ID NO: 783875 - DNA, 22 bp, Artificial Sequence
  chemically synthesized
ttagccataatattgggtagag

SEQ ID NO: 783876 - DNA, 22 bp, Artificial Sequence
  chemically synthesized
gccataatattgggtagagagg

SEQ ID NO: 783877 - DNA, 22 bp, Artificial Sequence
  chemically synthesized
ggtagagaggttactcccactt

SEQ ID NO: 783878 - DNA, 22 bp, Artificial Sequence
  chemically synthesized
aaaaggtaaataaagtgggagt

SEQ ID NO: 783879 - DNA, 22 bp, Artificial Sequence
  chemically synthesized
aaaaaggtaaataaagtgggag

SEQ ID NO: 783880 - DNA, 22 bp, Artificial Sequence
  chemically synthesized
taaaaaggtaaataaagtggga

SEQ ID NO: 783881 - DNA, 22 bp, Artificial Sequence
  chemically synthesized
ttaaaaaggtaaataaagtggg

SEQ ID NO: 783882 - DNA, 22 bp, Artificial Sequence
  chemically synthesized
ctcccactttatttaccttttt

SEQ ID NO: 783883 - DNA, 22 bp, Artificial Sequence
  chemically synthesized
aaacagtcttttaaaaaggtaa

SEQ ID NO: 783884 - DNA, 22 bp, Artificial Sequence
  chemically synthesized
ccactttatttacctttttaaa

SEQ ID NO: 783885 - DNA, 22 bp, Artificial Sequence
  chemically synthesized
tatttacctttttaaaagactg

SEQ ID NO: 783886 - DNA, 22 bp, Artificial Sequence
  chemically synthesized
atttacctttttaaaagactgt

SEQ ID NO: 783887 - DNA, 22 bp, Artificial Sequence
  chemically synthesized
tttacctttttaaaagactgtt

SEQ ID NO: 783888 - DNA, 22 bp, Artificial Sequence
  chemically synthesized
acctttttaaaagactgtttta

SEQ ID NO: 783889 - DNA, 22 bp, Artificial Sequence
  chemically synthesized
cctttttaaaagactgttttag

SEQ ID NO: 783890 - DNA, 22 bp, Artificial Sequence
  chemically synthesized
tttaaaagactgttttagttat

SEQ ID NO: 783891 - DNA, 22 bp, Artificial Sequence
  chemically synthesized
ttaaaagactgttttagttatt

SEQ ID NO: 783892 - DNA, 22 bp, Artificial Sequence
  chemically synthesized
taaaagactgttttagttattc

SEQ ID NO: 783893 - DNA, 22 bp, Artificial Sequence
  chemically synthesized
aaaagactgttttagttattct

SEQ ID NO: 783894 - DNA, 22 bp, Artificial Sequence
  chemically synthesized
aaagactgttttagttattctg

SEQ ID NO: 783895 - DNA, 22 bp, Artificial Sequence
  chemically synthesized
taagaaaagtcacaggccacag

SEQ ID NO: 783896 - DNA, 22 bp, Artificial Sequence
  chemically synthesized
ttttagttattctgtggcctgt

SEQ ID NO: 783897 - DNA, 22 bp, Artificial Sequence
  chemically synthesized
tagttattctgtggcctgtgac

SEQ ID NO: 783898 - DNA, 22 bp, Artificial Sequence
  chemically synthesized
agttattctgtggcctgtgact

SEQ ID NO: 783899 - DNA, 22 bp, Artificial Sequence
  chemically synthesized
gttattctgtggcctgtgactt

SEQ ID NO: 783900 - DNA, 22 bp, Artificial Sequence
  chemically synthesized
aaatctataagaaaagtcacag

SEQ ID NO: 783901 - DNA, 22 bp, Artificial Sequence
  chemically synthesized
taaaatctataagaaaagtcac

SEQ ID NO: 783902 - DNA, 22 bp, Artificial Sequence
  chemically synthesized
ttctgtggcctgtgacttttct

SEQ ID NO: 783903 - DNA, 22 bp, Artificial Sequence
  chemically synthesized
tgtggcctgtgacttttcttat

SEQ ID NO: 783904 - DNA, 22 bp, Artificial Sequence
  chemically synthesized
tggcctgtgacttttcttatag

SEQ ID NO: 783905 - DNA, 22 bp, Artificial Sequence
  chemically synthesized
tgacttttcttatagattttag

SEQ ID NO: 783906 - DNA, 22 bp, Artificial Sequence
  chemically synthesized
ttcttatagattttagagtatg

SEQ ID NO: 783907 - DNA, 22 bp, Artificial Sequence
  chemically synthesized
tcttatagattttagagtatgc

SEQ ID NO: 783908 - DNA, 22 bp, Artificial Sequence
  chemically synthesized
cttatagattttagagtatgct

SEQ ID NO: 783909 - DNA, 22 bp, Artificial Sequence
  chemically synthesized
tacacatagacaagcatactct

SEQ ID NO: 783910 - DNA, 22 bp, Artificial Sequence
  chemically synthesized
ttatagattttagagtatgctt

SEQ ID NO: 783911 - DNA, 22 bp, Artificial Sequence
  chemically synthesized
tgtacacatagacaagcatact

SEQ ID NO: 783912 - DNA, 22 bp, Artificial Sequence
  chemically synthesized
atagattttagagtatgcttgt

SEQ ID NO: 783913 - DNA, 22 bp, Artificial Sequence
  chemically synthesized
ctgtacacatagacaagcatac

SEQ ID NO: 783914 - DNA, 22 bp, Artificial Sequence
  chemically synthesized
tagattttagagtatgcttgtc

SEQ ID NO: 783915 - DNA, 22 bp, Artificial Sequence
  chemically synthesized
tagagtatgcttgtctatgtgt

SEQ ID NO: 783916 - DNA, 22 bp, Artificial Sequence
  chemically synthesized
agagtatgcttgtctatgtgta

SEQ ID NO: 783917 - DNA, 22 bp, Artificial Sequence
  chemically synthesized
gagtatgcttgtctatgtgtac

SEQ ID NO: 783918 - DNA, 22 bp, Artificial Sequence
  chemically synthesized
tcaaggatttctgtacacatag

SEQ ID NO: 783919 - DNA, 22 bp, Artificial Sequence
  chemically synthesized
atcaaggatttctgtacacata

SEQ ID NO: 783920 - DNA, 22 bp, Artificial Sequence
  chemically synthesized
gtctatgtgtacagaaatcctt

SEQ ID NO: 783921 - DNA, 22 bp, Artificial Sequence
  chemically synthesized
tctatgtgtacagaaatccttg

SEQ ID NO: 783922 - DNA, 22 bp, Artificial Sequence
  chemically synthesized
tcaaaatcttatcaaggatttc

SEQ ID NO: 783923 - DNA, 22 bp, Artificial Sequence
  chemically synthesized
tatcaaaatcttatcaaggatt

SEQ ID NO: 783924 - DNA, 22 bp, Artificial Sequence
  chemically synthesized
ctatcaaaatcttatcaaggat

SEQ ID NO: 783925 - DNA, 22 bp, Artificial Sequence
  chemically synthesized
tgtgtacagaaatccttgataa

SEQ ID NO: 783926 - DNA, 22 bp, Artificial Sequence
  chemically synthesized
gtttctatcaaaatcttatcaa

SEQ ID NO: 783927 - DNA, 22 bp, Artificial Sequence
  chemically synthesized
agtttctatcaaaatcttatca

SEQ ID NO: 783928 - DNA, 22 bp, Artificial Sequence
  chemically synthesized
atttagtttctatcaaaatctt

SEQ ID NO: 783929 - DNA, 22 bp, Artificial Sequence
  chemically synthesized
aatttagtttctatcaaaatct

SEQ ID NO: 783930 - DNA, 22 bp, Artificial Sequence
  chemically synthesized
aaggtttaatttagtttctatc

SEQ ID NO: 783931 - DNA, 22 bp, Artificial Sequence
  chemically synthesized
gataagattttgatagaaacta

SEQ ID NO: 783932 - DNA, 22 bp, Artificial Sequence
  chemically synthesized
ataagattttgatagaaactaa

SEQ ID NO: 783933 - DNA, 22 bp, Artificial Sequence
  chemically synthesized
tgatagaaactaaattaaacct

SEQ ID NO: 783934 - DNA, 22 bp, Artificial Sequence
  chemically synthesized
aaatcaatctaaaggtttaatt

SEQ ID NO: 783935 - DNA, 22 bp, Artificial Sequence
  chemically synthesized
gatagaaactaaattaaacctt

SEQ ID NO: 783936 - DNA, 22 bp, Artificial Sequence
  chemically synthesized
atagaaactaaattaaaccttt

SEQ ID NO: 783937 - DNA, 22 bp, Artificial Sequence
  chemically synthesized
tcaaatcaatctaaaggtttaa

SEQ ID NO: 783938 - DNA, 22 bp, Artificial Sequence
  chemically synthesized
ctcaaatcaatctaaaggttta

SEQ ID NO: 783939 - DNA, 22 bp, Artificial Sequence
  chemically synthesized
ttctcaaatcaatctaaaggtt

SEQ ID NO: 783940 - DNA, 22 bp, Artificial Sequence
  chemically synthesized
aattaaacctttagattgattt

SEQ ID NO: 783941 - DNA, 22 bp, Artificial Sequence
  chemically synthesized
aacctttagattgatttgagaa

SEQ ID NO: 783942 - DNA, 22 bp, Artificial Sequence
  chemically synthesized
tagattgatttgagaagaactg

SEQ ID NO: 783943 - DNA, 22 bp, Artificial Sequence
  chemically synthesized
agattgatttgagaagaactga

SEQ ID NO: 783944 - DNA, 22 bp, Artificial Sequence
  chemically synthesized
gattgatttgagaagaactgac

SEQ ID NO: 783945 - DNA, 22 bp, Artificial Sequence
  chemically synthesized
atttgagaagaactgacatatt

SEQ ID NO: 783946 - DNA, 22 bp, Artificial Sequence
  chemically synthesized
gagaagaactgacatatttgct

SEQ ID NO: 783947 - DNA, 22 bp, Artificial Sequence
  chemically synthesized
agaagaactgacatatttgcta

SEQ ID NO: 783948 - DNA, 22 bp, Artificial Sequence
  chemically synthesized
gaagagtcagcatagcaaatat

SEQ ID NO: 783949 - DNA, 22 bp, Artificial Sequence
  chemically synthesized
tagactggaagagtcagcatag

SEQ ID NO: 783950 - DNA, 22 bp, Artificial Sequence
  chemically synthesized
atagactggaagagtcagcata

SEQ ID NO: 783951 - DNA, 22 bp, Artificial Sequence
  chemically synthesized
acatatttgctatgctgactct

SEQ ID NO: 783952 - DNA, 22 bp, Artificial Sequence
  chemically synthesized
gctatgctgactcttccagtct

SEQ ID NO: 783953 - DNA, 22 bp, Artificial Sequence
  chemically synthesized
ctatgctgactcttccagtcta

SEQ ID NO: 783954 - DNA, 22 bp, Artificial Sequence
  chemically synthesized
tatggcatgtttatagactgga

SEQ ID NO: 783955 - DNA, 22 bp, Artificial Sequence
  chemically synthesized
tgctgactcttccagtctataa

SEQ ID NO: 783956 - DNA, 22 bp, Artificial Sequence
  chemically synthesized
actcttccagtctataaacatg

SEQ ID NO: 783957 - DNA, 22 bp, Artificial Sequence
  chemically synthesized
ttccagtctataaacatgccat

SEQ ID NO: 783958 - DNA, 22 bp, Artificial Sequence
  chemically synthesized
ccagtctataaacatgccatat

SEQ ID NO: 783959 - DNA, 22 bp, Artificial Sequence
  chemically synthesized
aataagtggattatatggcatg

SEQ ID NO: 783960 - DNA, 22 bp, Artificial Sequence
  chemically synthesized
cagtctataaacatgccatata

SEQ ID NO: 783961 - DNA, 22 bp, Artificial Sequence
  chemically synthesized
taaacatgccatataatccact

SEQ ID NO: 783962 - DNA, 22 bp, Artificial Sequence
  chemically synthesized
aaaacaacctaaataagtggat

SEQ ID NO: 783963 - DNA, 22 bp, Artificial Sequence
  chemically synthesized
atgaaaggcattaaaaacaacc

SEQ ID NO: 783964 - DNA, 22 bp, Artificial Sequence
  chemically synthesized
atttaggttgtttttaatgcct

SEQ ID NO: 783965 - DNA, 22 bp, Artificial Sequence
  chemically synthesized
tttaggttgtttttaatgcctt

SEQ ID NO: 783966 - DNA, 22 bp, Artificial Sequence
  chemically synthesized
taaaatgctgatgaaaggcatt

SEQ ID NO: 783967 - DNA, 22 bp, Artificial Sequence
  chemically synthesized
aggttgtttttaatgcctttca

SEQ ID NO: 783968 - DNA, 22 bp, Artificial Sequence
  chemically synthesized
ggttgtttttaatgcctttcat

SEQ ID NO: 783969 - DNA, 22 bp, Artificial Sequence
  chemically synthesized
tttttaatgcctttcatcagca

SEQ ID NO: 783970 - DNA, 22 bp, Artificial Sequence
  chemically synthesized
ttaatgcctttcatcagcattt

SEQ ID NO: 783971 - DNA, 22 bp, Artificial Sequence
  chemically synthesized
taatgcctttcatcagcatttt

SEQ ID NO: 783972 - DNA, 22 bp, Artificial Sequence
  chemically synthesized
aatgcctttcatcagcatttta

SEQ ID NO: 783973 - DNA, 22 bp, Artificial Sequence
  chemically synthesized
atgcctttcatcagcattttat

SEQ ID NO: 783974 - DNA, 22 bp, Artificial Sequence
  chemically synthesized
tcatcagcattttataattttc

SEQ ID NO: 783975 - DNA, 22 bp, Artificial Sequence
  chemically synthesized
catcagcattttataattttct

SEQ ID NO: 783976 - DNA, 22 bp, Artificial Sequence
  chemically synthesized
atcagcattttataattttcta

SEQ ID NO: 783977 - DNA, 22 bp, Artificial Sequence
  chemically synthesized
tataattttctacataccgatc

SEQ ID NO: 783978 - DNA, 22 bp, Artificial Sequence
  chemically synthesized
ataattttctacataccgatcc

SEQ ID NO: 783979 - DNA, 22 bp, Artificial Sequence
  chemically synthesized
taattttctacataccgatcct

SEQ ID NO: 783980 - DNA, 22 bp, Artificial Sequence
  chemically synthesized
tcatacatgtacaggatcggta

SEQ ID NO: 783981 - DNA, 22 bp, Artificial Sequence
  chemically synthesized
tctacataccgatcctgtacat

SEQ ID NO: 783982 - DNA, 22 bp, Artificial Sequence
  chemically synthesized
ctacataccgatcctgtacatg

SEQ ID NO: 783983 - DNA, 22 bp, Artificial Sequence
  chemically synthesized
tacataccgatcctgtacatgt

SEQ ID NO: 783984 - DNA, 22 bp, Artificial Sequence
  chemically synthesized
cataccgatcctgtacatgtat

SEQ ID NO: 783985 - DNA, 22 bp, Artificial Sequence
  chemically synthesized
tacatgtatgatagatttatac

SEQ ID NO: 783986 - DNA, 22 bp, Artificial Sequence
  chemically synthesized
tccaaaaatgaaatacgtaggt

SEQ ID NO: 783987 - DNA, 22 bp, Artificial Sequence
  chemically synthesized
atccaaaaatgaaatacgtagg

SEQ ID NO: 783988 - DNA, 22 bp, Artificial Sequence
  chemically synthesized
cttatccaaaaatgaaatacgt

SEQ ID NO: 783989 - DNA, 22 bp, Artificial Sequence
  chemically synthesized
atacctacgtatttcatttttg

SEQ ID NO: 783990 - DNA, 22 bp, Artificial Sequence
  chemically synthesized
taattgcttatccaaaaatgaa

SEQ ID NO: 783991 - DNA, 22 bp, Artificial Sequence
  chemically synthesized
tacctacgtatttcatttttgg

SEQ ID NO: 783992 - DNA, 22 bp, Artificial Sequence
  chemically synthesized
ataattgcttatccaaaaatga

SEQ ID NO: 783993 - DNA, 22 bp, Artificial Sequence
  chemically synthesized
cgtatttcatttttggataagc

SEQ ID NO: 783994 - DNA, 22 bp, Artificial Sequence
  chemically synthesized
catttttggataagcaattata

SEQ ID NO: 783995 - DNA, 22 bp, Artificial Sequence
  chemically synthesized
atttttggataagcaattataa

SEQ ID NO: 783996 - DNA, 22 bp, Artificial Sequence
  chemically synthesized
aaaacacaacaccatttataat

SEQ ID NO: 783997 - DNA, 22 bp, Artificial Sequence
  chemically synthesized
ttggataagcaattataaatgg

SEQ ID NO: 783998 - DNA, 22 bp, Artificial Sequence
  chemically synthesized
tggataagcaattataaatggt

SEQ ID NO: 783999 - DNA, 22 bp, Artificial Sequence
  chemically synthesized
ggataagcaattataaatggtg

SEQ ID NO: 784000 - DNA, 22 bp, Artificial Sequence
  chemically synthesized
gataagcaattataaatggtgt

SEQ ID NO: 784001 - DNA, 22 bp, Artificial Sequence
  chemically synthesized
taaatggtgttgtgtttttaat

SEQ ID NO: 784002 - DNA, 22 bp, Artificial Sequence
  chemically synthesized
gaaatgaagatgtgaaaagtga

SEQ ID NO: 784003 - DNA, 22 bp, Artificial Sequence
  chemically synthesized
tgtttttaatttcacttttcac

SEQ ID NO: 784004 - DNA, 22 bp, Artificial Sequence
  chemically synthesized
tgttggaaatgaagatgtgaaa

SEQ ID NO: 784005 - DNA, 22 bp, Artificial Sequence
  chemically synthesized
ttaatttcacttttcacatctt

SEQ ID NO: 784006 - DNA, 22 bp, Artificial Sequence
  chemically synthesized
taatttcacttttcacatcttc

SEQ ID NO: 784007 - DNA, 22 bp, Artificial Sequence
  chemically synthesized
aatttcacttttcacatcttca

SEQ ID NO: 784008 - DNA, 22 bp, Artificial Sequence
  chemically synthesized
atttcacttttcacatcttcat

SEQ ID NO: 784009 - DNA, 22 bp, Artificial Sequence
  chemically synthesized
tctatgttggaaatgaagatgt

SEQ ID NO: 784010 - DNA, 22 bp, Artificial Sequence
  chemically synthesized
cacttttcacatcttcatttcc

SEQ ID NO: 784011 - DNA, 22 bp, Artificial Sequence
  chemically synthesized
acttttcacatcttcatttcca

SEQ ID NO: 784012 - DNA, 22 bp, Artificial Sequence
  chemically synthesized
cggattatctatgttggaaatg

SEQ ID NO: 784013 - DNA, 22 bp, Artificial Sequence
  chemically synthesized
acggattatctatgttggaaat

SEQ ID NO: 784014 - DNA, 22 bp, Artificial Sequence
  chemically synthesized
ttcacatcttcatttccaacat

SEQ ID NO: 784015 - DNA, 22 bp, Artificial Sequence
  chemically synthesized
tcacatcttcatttccaacata

SEQ ID NO: 784016 - DNA, 22 bp, Artificial Sequence
  chemically synthesized
cacatcttcatttccaacatag

SEQ ID NO: 784017 - DNA, 22 bp, Artificial Sequence
  chemically synthesized
acatcttcatttccaacataga

SEQ ID NO: 784018 - DNA, 22 bp, Artificial Sequence
  chemically synthesized
catttccaacatagataatccg

SEQ ID NO: 784019 - DNA, 22 bp, Artificial Sequence
  chemically synthesized
atttccaacatagataatccgt

SEQ ID NO: 784020 - DNA, 22 bp, Artificial Sequence
  chemically synthesized
ccaacatagataatccgtaagt

SEQ ID NO: 784021 - DNA, 22 bp, Artificial Sequence
  chemically synthesized
caacatagataatccgtaagtt

SEQ ID NO: 784022 - DNA, 22 bp, Artificial Sequence
  chemically synthesized
tgatggcttgccttatgatttt

SEQ ID NO: 784023 - DNA, 22 bp, Artificial Sequence
  chemically synthesized
gccttatgattttttgacttta

SEQ ID NO: 784024 - DNA, 22 bp, Artificial Sequence
  chemically synthesized
ccttatgattttttgactttat

SEQ ID NO: 784025 - DNA, 22 bp, Artificial Sequence
  chemically synthesized
gataaacccatcataaagtcaa

SEQ ID NO: 784026 - DNA, 22 bp, Artificial Sequence
  chemically synthesized
agataaacccatcataaagtca

SEQ ID NO: 784027 - DNA, 22 bp, Artificial Sequence
  chemically synthesized
atgattttttgactttatgatg

SEQ ID NO: 784028 - DNA, 22 bp, Artificial Sequence
  chemically synthesized
tgattttttgactttatgatgg

SEQ ID NO: 784029 - DNA, 22 bp, Artificial Sequence
  chemically synthesized
catttagataaacccatcataa

SEQ ID NO: 784030 - DNA, 22 bp, Artificial Sequence
  chemically synthesized
acatttagataaacccatcata

SEQ ID NO: 784031 - DNA, 22 bp, Artificial Sequence
  chemically synthesized
tttgactttatgatgggtttat

SEQ ID NO: 784032 - DNA, 22 bp, Artificial Sequence
  chemically synthesized
ttgactttatgatgggtttatc

SEQ ID NO: 784033 - DNA, 22 bp, Artificial Sequence
  chemically synthesized
tgactttatgatgggtttatct

SEQ ID NO: 784034 - DNA, 22 bp, Artificial Sequence
  chemically synthesized
gactttatgatgggtttatcta

SEQ ID NO: 784035 - DNA, 22 bp, Artificial Sequence
  chemically synthesized
actttatgatgggtttatctaa

SEQ ID NO: 784036 - DNA, 22 bp, Artificial Sequence
  chemically synthesized
tgatgggcttacatttagataa

SEQ ID NO: 784037 - DNA, 22 bp, Artificial Sequence
  chemically synthesized
atgatgggcttacatttagata

SEQ ID NO: 784038 - DNA, 22 bp, Artificial Sequence
  chemically synthesized
tatgatgggtttatctaaatgt

SEQ ID NO: 784039 - DNA, 22 bp, Artificial Sequence
  chemically synthesized
atgatgggtttatctaaatgta

SEQ ID NO: 784040 - DNA, 22 bp, Artificial Sequence
  chemically synthesized
tgatgggtttatctaaatgtaa

SEQ ID NO: 784041 - DNA, 22 bp, Artificial Sequence
  chemically synthesized
atcttatgatgggcttacattt

SEQ ID NO: 784042 - DNA, 22 bp, Artificial Sequence
  chemically synthesized
ctcatcttatgatgggcttaca

SEQ ID NO: 784043 - DNA, 22 bp, Artificial Sequence
  chemically synthesized
atctaaatgtaagcccatcata

SEQ ID NO: 784044 - DNA, 22 bp, Artificial Sequence
  chemically synthesized
tctaaatgtaagcccatcataa

SEQ ID NO: 784045 - DNA, 22 bp, Artificial Sequence
  chemically synthesized
aatgtaagcccatcataagatg

SEQ ID NO: 784046 - DNA, 22 bp, Artificial Sequence
  chemically synthesized
tatacagatgctcctcatctta

SEQ ID NO: 784047 - DNA, 22 bp, Artificial Sequence
  chemically synthesized
atatacagatgctcctcatctt

SEQ ID NO: 784048 - DNA, 22 bp, Artificial Sequence
  chemically synthesized
tatatacagatgctcctcatct

SEQ ID NO: 784049 - DNA, 22 bp, Artificial Sequence
  chemically synthesized
ttatatacagatgctcctcatc

SEQ ID NO: 784050 - DNA, 22 bp, Artificial Sequence
  chemically synthesized
gtcacatttttatatacagatg

SEQ ID NO: 784051 - DNA, 22 bp, Artificial Sequence
  chemically synthesized
tatataaaaatgtgactagctt

SEQ ID NO: 784052 - DNA, 22 bp, Artificial Sequence
  chemically synthesized
gctttggtgtgttgatcttgta

SEQ ID NO: 784053 - DNA, 22 bp, Artificial Sequence
  chemically synthesized
acaagatccaaaaatacaagat

SEQ ID NO: 784054 - DNA, 22 bp, Artificial Sequence
  chemically synthesized
tggtgtgttgatcttgtatttt

SEQ ID NO: 784055 - DNA, 22 bp, Artificial Sequence
  chemically synthesized
ggtgtgttgatcttgtattttt

SEQ ID NO: 784056 - DNA, 22 bp, Artificial Sequence
  chemically synthesized
gtgtgttgatcttgtatttttg

SEQ ID NO: 784057 - DNA, 22 bp, Artificial Sequence
  chemically synthesized
atcttgtatttttggatcttgt

SEQ ID NO: 784058 - DNA, 22 bp, Artificial Sequence
  chemically synthesized
agaagagaggttaacaagatcc

SEQ ID NO: 784059 - DNA, 22 bp, Artificial Sequence
  chemically synthesized
gtatttttggatcttgttaacc

SEQ ID NO: 784060 - DNA, 22 bp, Artificial Sequence
  chemically synthesized
tatttttggatcttgttaacct

SEQ ID NO: 784061 - DNA, 22 bp, Artificial Sequence
  chemically synthesized
atggagctgagaagagaggtta

SEQ ID NO: 784062 - DNA, 22 bp, Artificial Sequence
  chemically synthesized
ttggatcttgttaacctctctt

SEQ ID NO: 784063 - DNA, 22 bp, Artificial Sequence
  chemically synthesized
tggatcttgttaacctctcttc

SEQ ID NO: 784064 - DNA, 22 bp, Artificial Sequence
  chemically synthesized
ggatcttgttaacctctcttct

SEQ ID NO: 784065 - DNA, 22 bp, Artificial Sequence
  chemically synthesized
gatcttgttaacctctcttctc

SEQ ID NO: 784066 - DNA, 22 bp, Artificial Sequence
  chemically synthesized
gttaacctctcttctcagctcc

SEQ ID NO: 784067 - DNA, 22 bp, Artificial Sequence
  chemically synthesized
ttaacctctcttctcagctcca

SEQ ID NO: 784068 - DNA, 22 bp, Artificial Sequence
  chemically synthesized
acctctcttctcagctccatga

SEQ ID NO: 784069 - DNA, 22 bp, Artificial Sequence
  chemically synthesized
tcttctcagctccatgagcatt

SEQ ID NO: 784070 - DNA, 22 bp, Artificial Sequence
  chemically synthesized
ttctcagctccatgagcatttt

SEQ ID NO: 784071 - DNA, 22 bp, Artificial Sequence
  chemically synthesized
ctcagctccatgagcatttttg

SEQ ID NO: 784072 - DNA, 22 bp, Artificial Sequence
  chemically synthesized
tcagctccatgagcatttttgg

SEQ ID NO: 784073 - DNA, 22 bp, Artificial Sequence
  chemically synthesized
agctccatgagcatttttggtt

SEQ ID NO: 784074 - DNA, 22 bp, Artificial Sequence
  chemically synthesized
catgagcatttttggttatttt

SEQ ID NO: 784075 - DNA, 22 bp, Artificial Sequence
  chemically synthesized
caaaaacaaaagcaaaaataac

SEQ ID NO: 784076 - DNA, 22 bp, Artificial Sequence
  chemically synthesized
tacaaaaacaaaagcaaaaata

SEQ ID NO: 784077 - DNA, 22 bp, Artificial Sequence
  chemically synthesized
ttggttatttttgcttttgttt

SEQ ID NO: 784078 - DNA, 22 bp, Artificial Sequence
  chemically synthesized
tggttatttttgcttttgtttt

SEQ ID NO: 784079 - DNA, 22 bp, Artificial Sequence
  chemically synthesized
ggttatttttgcttttgttttt

SEQ ID NO: 784080 - DNA, 22 bp, Artificial Sequence
  chemically synthesized
gttatttttgcttttgtttttg

SEQ ID NO: 784081 - DNA, 22 bp, Artificial Sequence
  chemically synthesized
tttttgcttttgtttttgtaga

SEQ ID NO: 784082 - DNA, 22 bp, Artificial Sequence
  chemically synthesized
ttgcttttgtttttgtagaata

SEQ ID NO: 784083 - DNA, 22 bp, Artificial Sequence
  chemically synthesized
tgcttttgtttttgtagaatat

SEQ ID NO: 784084 - DNA, 22 bp, Artificial Sequence
  chemically synthesized
gcttttgtttttgtagaatatt

SEQ ID NO: 784085 - DNA, 22 bp, Artificial Sequence
  chemically synthesized
cttttgtttttgtagaatattt

SEQ ID NO: 784086 - DNA, 22 bp, Artificial Sequence
  chemically synthesized
ttgtttttgtagaatatttgat

SEQ ID NO: 784087 - DNA, 22 bp, Artificial Sequence
  chemically synthesized
tgtttttgtagaatatttgata

SEQ ID NO: 784088 - DNA, 22 bp, Artificial Sequence
  chemically synthesized
gtttttgtagaatatttgatat

SEQ ID NO: 784089 - DNA, 22 bp, Artificial Sequence
  chemically synthesized
tgtacgtagaaaatatcaaata

SEQ ID NO: 784090 - DNA, 22 bp, Artificial Sequence
  chemically synthesized
tttttgtagaatatttgatatt

SEQ ID NO: 784091 - DNA, 22 bp, Artificial Sequence
  chemically synthesized
ttgtagaatatttgatattttc

SEQ ID NO: 784092 - DNA, 22 bp, Artificial Sequence
  chemically synthesized
tgtagaatatttgatattttct

SEQ ID NO: 784093 - DNA, 22 bp, Artificial Sequence
  chemically synthesized
gtagaatatttgatattttcta

SEQ ID NO: 784094 - DNA, 22 bp, Artificial Sequence
  chemically synthesized
tagaatatttgatattttctac

SEQ ID NO: 784095 - DNA, 22 bp, Artificial Sequence
  chemically synthesized
tggatggcatgactgtgtacgt

SEQ ID NO: 784096 - DNA, 22 bp, Artificial Sequence
  chemically synthesized
gtggatggcatgactgtgtacg

SEQ ID NO: 784097 - DNA, 22 bp, Artificial Sequence
  chemically synthesized
gatattttctacgtacacagtc

SEQ ID NO: 784098 - DNA, 22 bp, Artificial Sequence
  chemically synthesized
atattttctacgtacacagtca

SEQ ID NO: 784099 - DNA, 22 bp, Artificial Sequence
  chemically synthesized
tttgtggatggcatgactgtgt

SEQ ID NO: 784100 - DNA, 22 bp, Artificial Sequence
  chemically synthesized
tatttgtggatggcatgactgt

SEQ ID NO: 784101 - DNA, 22 bp, Artificial Sequence
  chemically synthesized
ctatttgtggatggcatgactg

SEQ ID NO: 784102 - DNA, 22 bp, Artificial Sequence
  chemically synthesized
tctacgtacacagtcatgccat

SEQ ID NO: 784103 - DNA, 22 bp, Artificial Sequence
  chemically synthesized
ctacgtacacagtcatgccatc

SEQ ID NO: 784104 - DNA, 22 bp, Artificial Sequence
  chemically synthesized
tttctatttgtggatggcatga

SEQ ID NO: 784105 - DNA, 22 bp, Artificial Sequence
  chemically synthesized
tacgtacacagtcatgccatcc

SEQ ID NO: 784106 - DNA, 22 bp, Artificial Sequence
  chemically synthesized
cgtacacagtcatgccatccac

SEQ ID NO: 784107 - DNA, 22 bp, Artificial Sequence
  chemically synthesized
aaaagtataaaataaaattatt

SEQ ID NO: 784108 - DNA, 22 bp, Artificial Sequence
  chemically synthesized
tattttatacttttcaatatgc

SEQ ID NO: 784109 - DNA, 22 bp, Artificial Sequence
  chemically synthesized
attttatacttttcaatatgca

SEQ ID NO: 784110 - DNA, 22 bp, Artificial Sequence
  chemically synthesized
ttttatacttttcaatatgcat

SEQ ID NO: 784111 - DNA, 22 bp, Artificial Sequence
  chemically synthesized
tatacttttcaatatgcatgct

SEQ ID NO: 784112 - DNA, 22 bp, Artificial Sequence
  chemically synthesized
atacttttcaatatgcatgctt

SEQ ID NO: 784113 - DNA, 22 bp, Artificial Sequence
  chemically synthesized
tacttttcaatatgcatgcttt

SEQ ID NO: 784114 - DNA, 22 bp, Artificial Sequence
  chemically synthesized
ttcaatatgcatgctttattgt

SEQ ID NO: 784115 - DNA, 22 bp, Artificial Sequence
  chemically synthesized
tcaatatgcatgctttattgtt

SEQ ID NO: 784116 - DNA, 22 bp, Artificial Sequence
  chemically synthesized
caatatgcatgctttattgttt

SEQ ID NO: 784117 - DNA, 22 bp, Artificial Sequence
  chemically synthesized
aatatgcatgctttattgtttt

SEQ ID NO: 784118 - DNA, 22 bp, Artificial Sequence
  chemically synthesized
caataaagcaaggaaaaacaat

SEQ ID NO: 784119 - DNA, 22 bp, Artificial Sequence
  chemically synthesized
cagacactacaataaagcaagg

SEQ ID NO: 784120 - DNA, 22 bp, Artificial Sequence
  chemically synthesized
tattgtttttccttgctttatt

SEQ ID NO: 784121 - DNA, 22 bp, Artificial Sequence
  chemically synthesized
attgtttttccttgctttattg

SEQ ID NO: 784122 - DNA, 22 bp, Artificial Sequence
  chemically synthesized
ttgtttttccttgctttattgt

SEQ ID NO: 784123 - DNA, 22 bp, Artificial Sequence
  chemically synthesized
tttttccttgctttattgtagt

SEQ ID NO: 784124 - DNA, 22 bp, Artificial Sequence
  chemically synthesized
gaagttccagacactacaataa

SEQ ID NO: 784125 - DNA, 22 bp, Artificial Sequence
  chemically synthesized
tggaagttccagacactacaat

SEQ ID NO: 784126 - DNA, 22 bp, Artificial Sequence
  chemically synthesized
ttccttgctttattgtagtgtc

SEQ ID NO: 784127 - DNA, 22 bp, Artificial Sequence
  chemically synthesized
tccttgctttattgtagtgtct

SEQ ID NO: 784128 - DNA, 22 bp, Artificial Sequence
  chemically synthesized
ccttgctttattgtagtgtctg

SEQ ID NO: 784129 - DNA, 22 bp, Artificial Sequence
  chemically synthesized
cttgctttattgtagtgtctgg

SEQ ID NO: 784130 - DNA, 22 bp, Artificial Sequence
  chemically synthesized
gctttattgtagtgtctggaac

SEQ ID NO: 784131 - DNA, 22 bp, Artificial Sequence
  chemically synthesized
ctttattgtagtgtctggaact

SEQ ID NO: 784132 - DNA, 22 bp, Artificial Sequence
  chemically synthesized
acatagttctggaagttccaga

SEQ ID NO: 784133 - DNA, 22 bp, Artificial Sequence
  chemically synthesized
aacatagttctggaagttccag

SEQ ID NO: 784134 - DNA, 22 bp, Artificial Sequence
  chemically synthesized
tattgtagtgtctggaacttcc

SEQ ID NO: 784135 - DNA, 22 bp, Artificial Sequence
  chemically synthesized
taacatagttctggaagttcca

SEQ ID NO: 784136 - DNA, 22 bp, Artificial Sequence
  chemically synthesized
attgtagtgtctggaacttcca

SEQ ID NO: 784137 - DNA, 22 bp, Artificial Sequence
  chemically synthesized
ttaacatagttctggaagttcc

SEQ ID NO: 784138 - DNA, 22 bp, Artificial Sequence
  chemically synthesized
ttgtagtgtctggaacttccag

SEQ ID NO: 784139 - DNA, 22 bp, Artificial Sequence
  chemically synthesized
tttaacatagttctggaagttc

SEQ ID NO: 784140 - DNA, 22 bp, Artificial Sequence
  chemically synthesized
ttttaacatagttctggaagtt

SEQ ID NO: 784141 - DNA, 22 bp, Artificial Sequence
  chemically synthesized
tagtgtctggaacttccagaac

SEQ ID NO: 784142 - DNA, 22 bp, Artificial Sequence
  chemically synthesized
ttttttaacatagttctggaag

SEQ ID NO: 784143 - DNA, 22 bp, Artificial Sequence
  chemically synthesized
ctcttttttaacatagttctgg

SEQ ID NO: 784144 - DNA, 22 bp, Artificial Sequence
  chemically synthesized
actactcttttttaacatagtt

SEQ ID NO: 784145 - DNA, 22 bp, Artificial Sequence
  chemically synthesized
cactactcttttttaacatagt

SEQ ID NO: 784146 - DNA, 22 bp, Artificial Sequence
  chemically synthesized
gaacttccagaactatgttaaa

SEQ ID NO: 784147 - DNA, 22 bp, Artificial Sequence
  chemically synthesized
ccagaactatgttaaaaaagag

SEQ ID NO: 784148 - DNA, 22 bp, Artificial Sequence
  chemically synthesized
cagaactatgttaaaaaagagt

SEQ ID NO: 784149 - DNA, 22 bp, Artificial Sequence
  chemically synthesized
tgttaaaaaagagtagtgaaat

SEQ ID NO: 784150 - DNA, 22 bp, Artificial Sequence
  chemically synthesized
gggaaggatgcccaatttcact

SEQ ID NO: 784151 - DNA, 22 bp, Artificial Sequence
  chemically synthesized
aaaaagagtagtgaaattgggc

SEQ ID NO: 784152 - DNA, 22 bp, Artificial Sequence
  chemically synthesized
attagggaaggatgcccaattt

SEQ ID NO: 784153 - DNA, 22 bp, Artificial Sequence
  chemically synthesized
ctaattagggaaggatgcccaa

SEQ ID NO: 784154 - DNA, 22 bp, Artificial Sequence
  chemically synthesized
cacccatgattgctaattaggg

SEQ ID NO: 784155 - DNA, 22 bp, Artificial Sequence
  chemically synthesized
ccacccatgattgctaattagg

SEQ ID NO: 784156 - DNA, 22 bp, Artificial Sequence
  chemically synthesized
ggcatccttccctaattagcaa

SEQ ID NO: 784157 - DNA, 22 bp, Artificial Sequence
  chemically synthesized
atgtttccacccatgattgcta

SEQ ID NO: 784158 - DNA, 22 bp, Artificial Sequence
  chemically synthesized
aatgtttccacccatgattgct

SEQ ID NO: 784159 - DNA, 22 bp, Artificial Sequence
  chemically synthesized
ccctaattagcaatcatgggtg

SEQ ID NO: 784160 - DNA, 22 bp, Artificial Sequence
  chemically synthesized
cctaattagcaatcatgggtgg

SEQ ID NO: 784161 - DNA, 22 bp, Artificial Sequence
  chemically synthesized
attagcaatcatgggtggaaac

SEQ ID NO: 784162 - DNA, 22 bp, Artificial Sequence
  chemically synthesized
gcaatcatgggtggaaacatta

SEQ ID NO: 784163 - DNA, 22 bp, Artificial Sequence
  chemically synthesized
ataatggaaggcttaatgtttc

SEQ ID NO: 784164 - DNA, 22 bp, Artificial Sequence
  chemically synthesized
aataatggaaggcttaatgttt

SEQ ID NO: 784165 - DNA, 22 bp, Artificial Sequence
  chemically synthesized
taataatggaaggcttaatgtt

SEQ ID NO: 784166 - DNA, 22 bp, Artificial Sequence
  chemically synthesized
atagcataattttaataatgga

SEQ ID NO: 784167 - DNA, 22 bp, Artificial Sequence
  chemically synthesized
cagttaatagcataattttaat

SEQ ID NO: 784168 - DNA, 22 bp, Artificial Sequence
  chemically synthesized
agccttccattattaaaattat

SEQ ID NO: 784169 - DNA, 22 bp, Artificial Sequence
  chemically synthesized
ccattattaaaattatgctatt

SEQ ID NO: 784170 - DNA, 22 bp, Artificial Sequence
  chemically synthesized
cattattaaaattatgctatta

SEQ ID NO: 784171 - DNA, 22 bp, Artificial Sequence
  chemically synthesized
cagaaaactacagttaatagca

SEQ ID NO: 784172 - DNA, 22 bp, Artificial Sequence
  chemically synthesized
ttaaaattatgctattaactgt

SEQ ID NO: 784173 - DNA, 22 bp, Artificial Sequence
  chemically synthesized
aaattatgctattaactgtagt

SEQ ID NO: 784174 - DNA, 22 bp, Artificial Sequence
  chemically synthesized
tgctattaactgtagttttctg

SEQ ID NO: 784175 - DNA, 22 bp, Artificial Sequence
  chemically synthesized
ataaagggtatctacagaaaac

SEQ ID NO: 784176 - DNA, 22 bp, Artificial Sequence
  chemically synthesized
aataaagggtatctacagaaaa

SEQ ID NO: 784177 - DNA, 22 bp, Artificial Sequence
  chemically synthesized
ttaactgtagttttctgtagat

SEQ ID NO: 784178 - DNA, 22 bp, Artificial Sequence
  chemically synthesized
actgtagttttctgtagatacc

SEQ ID NO: 784179 - DNA, 22 bp, Artificial Sequence
  chemically synthesized
cacatcttaataaagggtatct

SEQ ID NO: 784180 - DNA, 22 bp, Artificial Sequence
  chemically synthesized
tagttttctgtagatacccttt

SEQ ID NO: 784181 - DNA, 22 bp, Artificial Sequence
  chemically synthesized
ccacatcttaataaagggtatc

SEQ ID NO: 784182 - DNA, 22 bp, Artificial Sequence
  chemically synthesized
tctgtagataccctttattaag

SEQ ID NO: 784183 - DNA, 22 bp, Artificial Sequence
  chemically synthesized
ctgtagataccctttattaaga

SEQ ID NO: 784184 - DNA, 22 bp, Artificial Sequence
  chemically synthesized
tgtagataccctttattaagat

SEQ ID NO: 784185 - DNA, 22 bp, Artificial Sequence
  chemically synthesized
tagataccctttattaagatgt

SEQ ID NO: 784186 - DNA, 22 bp, Artificial Sequence
  chemically synthesized
ggaatagaggataacttccaca

SEQ ID NO: 784187 - DNA, 22 bp, Artificial Sequence
  chemically synthesized
tattaagatgtggaagttatcc

SEQ ID NO: 784188 - DNA, 22 bp, Artificial Sequence
  chemically synthesized
attaagatgtggaagttatcct

SEQ ID NO: 784189 - DNA, 22 bp, Artificial Sequence
  chemically synthesized
ttaagatgtggaagttatcctc

SEQ ID NO: 784190 - DNA, 22 bp, Artificial Sequence
  chemically synthesized
agatgtggaagttatcctctat

SEQ ID NO: 784191 - DNA, 22 bp, Artificial Sequence
  chemically synthesized
tgagaaaactgggaatagagga

SEQ ID NO: 784192 - DNA, 22 bp, Artificial Sequence
  chemically synthesized
tcctctattcccagttttctca

SEQ ID NO: 784193 - DNA, 22 bp, Artificial Sequence
  chemically synthesized
atgataaaaactatgagaaaac

SEQ ID NO: 784194 - DNA, 22 bp, Artificial Sequence
  chemically synthesized
tattcccagttttctcatagtt

SEQ ID NO: 784195 - DNA, 22 bp, Artificial Sequence
  chemically synthesized
ttcccagttttctcatagtttt

SEQ ID NO: 784196 - DNA, 22 bp, Artificial Sequence
  chemically synthesized
ccagttttctcatagtttttat

SEQ ID NO: 784197 - DNA, 22 bp, Artificial Sequence
  chemically synthesized
tctcatagtttttatcatgaat

SEQ ID NO: 784198 - DNA, 22 bp, Artificial Sequence
  chemically synthesized
ctcatagtttttatcatgaatg

SEQ ID NO: 784199 - DNA, 22 bp, Artificial Sequence
  chemically synthesized
tcatagtttttatcatgaatgg

SEQ ID NO: 784200 - DNA, 22 bp, Artificial Sequence
  chemically synthesized
atagtttttatcatgaatggat

SEQ ID NO: 784201 - DNA, 22 bp, Artificial Sequence
  chemically synthesized
acaacacccagcatccattcat

SEQ ID NO: 784202 - DNA, 22 bp, Artificial Sequence
  chemically synthesized
ttatcatgaatggatgctgggt

SEQ ID NO: 784203 - DNA, 22 bp, Artificial Sequence
  chemically synthesized
tatcatgaatggatgctgggtg

SEQ ID NO: 784204 - DNA, 22 bp, Artificial Sequence
  chemically synthesized
atcatgaatggatgctgggtgt

SEQ ID NO: 784205 - DNA, 22 bp, Artificial Sequence
  chemically synthesized
tcatgaatggatgctgggtgtt

SEQ ID NO: 784206 - DNA, 22 bp, Artificial Sequence
  chemically synthesized
atgcagaagcatctgacaacac

SEQ ID NO: 784207 - DNA, 22 bp, Artificial Sequence
  chemically synthesized
attgatgcagaagcatctgaca

SEQ ID NO: 784208 - DNA, 22 bp, Artificial Sequence
  chemically synthesized
tattgattgatgcagaagcatc

SEQ ID NO: 784209 - DNA, 22 bp, Artificial Sequence
  chemically synthesized
ggtgttgtcagatgcttctgca

SEQ ID NO: 784210 - DNA, 22 bp, Artificial Sequence
  chemically synthesized
tcagatgcttctgcatcaatca

SEQ ID NO: 784211 - DNA, 22 bp, Artificial Sequence
  chemically synthesized
ctgcatcaatcaatataatcat

SEQ ID NO: 784212 - DNA, 22 bp, Artificial Sequence
  chemically synthesized
tgcatcaatcaatataatcata

SEQ ID NO: 784213 - DNA, 22 bp, Artificial Sequence
  chemically synthesized
catcaatcaatataatcatatg

SEQ ID NO: 784214 - DNA, 22 bp, Artificial Sequence
  chemically synthesized
aagaagaaaaaatcatatgatt

SEQ ID NO: 784215 - DNA, 22 bp, Artificial Sequence
  chemically synthesized
ccatatcaacaaactaaagaag

SEQ ID NO: 784216 - DNA, 22 bp, Artificial Sequence
  chemically synthesized
tttcttctttagtttgttgata

SEQ ID NO: 784217 - DNA, 22 bp, Artificial Sequence
  chemically synthesized
ttcttctttagtttgttgatat

SEQ ID NO: 784218 - DNA, 22 bp, Artificial Sequence
  chemically synthesized
gtgtaatctaccatatcaacaa

SEQ ID NO: 784219 - DNA, 22 bp, Artificial Sequence
  chemically synthesized
tcttctttagtttgttgatatg

SEQ ID NO: 784220 - DNA, 22 bp, Artificial Sequence
  chemically synthesized
cttctttagtttgttgatatgg

SEQ ID NO: 784221 - DNA, 22 bp, Artificial Sequence
  chemically synthesized
ttctttagtttgttgatatggt

SEQ ID NO: 784222 - DNA, 22 bp, Artificial Sequence
  chemically synthesized
attagtgtaatctaccatatca

SEQ ID NO: 784223 - DNA, 22 bp, Artificial Sequence
  chemically synthesized
ctttagtttgttgatatggtag

SEQ ID NO: 784224 - DNA, 22 bp, Artificial Sequence
  chemically synthesized
tttagtttgttgatatggtaga

SEQ ID NO: 784225 - DNA, 22 bp, Artificial Sequence
  chemically synthesized
tagtttgttgatatggtagatt

SEQ ID NO: 784226 - DNA, 22 bp, Artificial Sequence
  chemically synthesized
agtttgttgatatggtagatta

SEQ ID NO: 784227 - DNA, 22 bp, Artificial Sequence
  chemically synthesized
gtttgttgatatggtagattac

SEQ ID NO: 784228 - DNA, 22 bp, Artificial Sequence
  chemically synthesized
aaagttaattagtgtaatctac

SEQ ID NO: 784229 - DNA, 22 bp, Artificial Sequence
  chemically synthesized
gaaagttaattagtgtaatcta

SEQ ID NO: 784230 - DNA, 22 bp, Artificial Sequence
  chemically synthesized
gttgatatggtagattacacta

SEQ ID NO: 784231 - DNA, 22 bp, Artificial Sequence
  chemically synthesized
ttgatatggtagattacactaa

SEQ ID NO: 784232 - DNA, 22 bp, Artificial Sequence
  chemically synthesized
atatggtagattacactaatta

SEQ ID NO: 784233 - DNA, 22 bp, Artificial Sequence
  chemically synthesized
aacatttgaaagttaattagtg

SEQ ID NO: 784234 - DNA, 22 bp, Artificial Sequence
  chemically synthesized
gctcaacatttgaaagttaatt

SEQ ID NO: 784235 - DNA, 22 bp, Artificial Sequence
  chemically synthesized
aaggctggctcaacatttgaaa

SEQ ID NO: 784236 - DNA, 22 bp, Artificial Sequence
  chemically synthesized
cactaattaactttcaaatgtt

SEQ ID NO: 784237 - DNA, 22 bp, Artificial Sequence
  chemically synthesized
attaactttcaaatgttgagcc

SEQ ID NO: 784238 - DNA, 22 bp, Artificial Sequence
  chemically synthesized
gtattgaaggctggctcaacat

SEQ ID NO: 784239 - DNA, 22 bp, Artificial Sequence
  chemically synthesized
agtattgaaggctggctcaaca

SEQ ID NO: 784240 - DNA, 22 bp, Artificial Sequence
  chemically synthesized
actttcaaatgttgagccagcc

SEQ ID NO: 784241 - DNA, 22 bp, Artificial Sequence
  chemically synthesized
ggatttagtattgaaggctggc

SEQ ID NO: 784242 - DNA, 22 bp, Artificial Sequence
  chemically synthesized
tcaaatgttgagccagccttca

SEQ ID NO: 784243 - DNA, 22 bp, Artificial Sequence
  chemically synthesized
caaatgttgagccagccttcaa

SEQ ID NO: 784244 - DNA, 22 bp, Artificial Sequence
  chemically synthesized
aaatgttgagccagccttcaat

SEQ ID NO: 784245 - DNA, 22 bp, Artificial Sequence
  chemically synthesized
actgggatttagtattgaaggc

SEQ ID NO: 784246 - DNA, 22 bp, Artificial Sequence
  chemically synthesized
agccagccttcaatactaaatc

SEQ ID NO: 784247 - DNA, 22 bp, Artificial Sequence
  chemically synthesized
caatactaaatcccagttagtt

SEQ ID NO: 784248 - DNA, 22 bp, Artificial Sequence
  chemically synthesized
aatactaaatcccagttagtta

SEQ ID NO: 784249 - DNA, 22 bp, Artificial Sequence
  chemically synthesized
aatcccagttagttatggtatg

SEQ ID NO: 784250 - DNA, 22 bp, Artificial Sequence
  chemically synthesized
aaaaaagagtgtcataccataa

SEQ ID NO: 784251 - DNA, 22 bp, Artificial Sequence
  chemically synthesized
aaaaaaagagtgtcataccata

SEQ ID NO: 784252 - DNA, 22 bp, Artificial Sequence
  chemically synthesized
gttatggtatgacactcttttt

SEQ ID NO: 784253 - DNA, 22 bp, Artificial Sequence
  chemically synthesized
tggtatgacactctttttttaa

SEQ ID NO: 784254 - DNA, 22 bp, Artificial Sequence
  chemically synthesized
aataacatgcgtcaaagtttaa

SEQ ID NO: 784255 - DNA, 22 bp, Artificial Sequence
  chemically synthesized
tttttttaaactttgacgcatg

SEQ ID NO: 784256 - DNA, 22 bp, Artificial Sequence
  chemically synthesized
tttttaaactttgacgcatgtt

SEQ ID NO: 784257 - DNA, 22 bp, Artificial Sequence
  chemically synthesized
ttttaaactttgacgcatgtta

SEQ ID NO: 784258 - DNA, 22 bp, Artificial Sequence
  chemically synthesized
tttaaactttgacgcatgttat

SEQ ID NO: 784259 - DNA, 22 bp, Artificial Sequence
  chemically synthesized
ttaaactttgacgcatgttatt

SEQ ID NO: 784260 - DNA, 22 bp, Artificial Sequence
  chemically synthesized
taaactttgacgcatgttattt

SEQ ID NO: 784261 - DNA, 22 bp, Artificial Sequence
  chemically synthesized
aaactttgacgcatgttattta

SEQ ID NO: 784262 - DNA, 22 bp, Artificial Sequence
  chemically synthesized
aactttgacgcatgttatttaa

SEQ ID NO: 784263 - DNA, 22 bp, Artificial Sequence
  chemically synthesized
tgacgcatgttatttaatattt

SEQ ID NO: 784264 - DNA, 22 bp, Artificial Sequence
  chemically synthesized
gacgcatgttatttaatatttt

SEQ ID NO: 784265 - DNA, 22 bp, Artificial Sequence
  chemically synthesized
acgcatgttatttaatattttg

SEQ ID NO: 784266 - DNA, 22 bp, Artificial Sequence
  chemically synthesized
gagacaaaaaccatcaacaaaa

SEQ ID NO: 784267 - DNA, 22 bp, Artificial Sequence
  chemically synthesized
tttaatattttgttgatggttt

SEQ ID NO: 784268 - DNA, 22 bp, Artificial Sequence
  chemically synthesized
aatattttgttgatggtttttg

SEQ ID NO: 784269 - DNA, 22 bp, Artificial Sequence
  chemically synthesized
atattttgttgatggtttttgt

SEQ ID NO: 784270 - DNA, 22 bp, Artificial Sequence
  chemically synthesized
tgttgatggtttttgtctctag

SEQ ID NO: 784271 - DNA, 22 bp, Artificial Sequence
  chemically synthesized
gttgatggtttttgtctctagg

SEQ ID NO: 784272 - DNA, 22 bp, Artificial Sequence
  chemically synthesized
ttgatggtttttgtctctaggc

SEQ ID NO: 784273 - DNA, 22 bp, Artificial Sequence
  chemically synthesized
aaataaataaatgagcctagag

SEQ ID NO: 784274 - DNA, 22 bp, Artificial Sequence
  chemically synthesized
atggtttttgtctctaggctca

SEQ ID NO: 784275 - DNA, 22 bp, Artificial Sequence
  chemically synthesized
ttgtctctaggctcatttattt

SEQ ID NO: 784276 - DNA, 22 bp, Artificial Sequence
  chemically synthesized
tgtctctaggctcatttattta

SEQ ID NO: 784277 - DNA, 22 bp, Artificial Sequence
  chemically synthesized
gtctctaggctcatttatttat

SEQ ID NO: 784278 - DNA, 22 bp, Artificial Sequence
  chemically synthesized
tctctaggctcatttatttatt

SEQ ID NO: 784279 - DNA, 22 bp, Artificial Sequence
  chemically synthesized
taggctcatttatttattttag

SEQ ID NO: 784280 - DNA, 22 bp, Artificial Sequence
  chemically synthesized
ggctcatttatttattttagac

SEQ ID NO: 784281 - DNA, 22 bp, Artificial Sequence
  chemically synthesized
gaagacaggaaaggtctaaaat

SEQ ID NO: 784282 - DNA, 22 bp, Artificial Sequence
  chemically synthesized
atttatttattttagacctttc

SEQ ID NO: 784283 - DNA, 22 bp, Artificial Sequence
  chemically synthesized
gttagaagacaggaaaggtcta

SEQ ID NO: 784284 - DNA, 22 bp, Artificial Sequence
  chemically synthesized
agttagaagacaggaaaggtct

SEQ ID NO: 784285 - DNA, 22 bp, Artificial Sequence
  chemically synthesized
atttattttagacctttcctgt

SEQ ID NO: 784286 - DNA, 22 bp, Artificial Sequence
  chemically synthesized
tttagttagaagacaggaaagg

SEQ ID NO: 784287 - DNA, 22 bp, Artificial Sequence
  chemically synthesized
tttattttagacctttcctgtc

SEQ ID NO: 784288 - DNA, 22 bp, Artificial Sequence
  chemically synthesized
attttagacctttcctgtcttc

SEQ ID NO: 784289 - DNA, 22 bp, Artificial Sequence
  chemically synthesized
ttttagacctttcctgtcttct

SEQ ID NO: 784290 - DNA, 22 bp, Artificial Sequence
  chemically synthesized
gattatttagttagaagacagg

SEQ ID NO: 784291 - DNA, 22 bp, Artificial Sequence
  chemically synthesized
tagacctttcctgtcttctaac

SEQ ID NO: 784292 - DNA, 22 bp, Artificial Sequence
  chemically synthesized
agacctttcctgtcttctaact

SEQ ID NO: 784293 - DNA, 22 bp, Artificial Sequence
  chemically synthesized
gacctttcctgtcttctaacta

SEQ ID NO: 784294 - DNA, 22 bp, Artificial Sequence
  chemically synthesized
tcctgtcttctaactaaataat

SEQ ID NO: 784295 - DNA, 22 bp, Artificial Sequence
  chemically synthesized
cctgtcttctaactaaataatc

SEQ ID NO: 784296 - DNA, 22 bp, Artificial Sequence
  chemically synthesized
ctgtcttctaactaaataatct

SEQ ID NO: 784297 - DNA, 22 bp, Artificial Sequence
  chemically synthesized
tcttctaactaaataatctaat

SEQ ID NO: 784298 - DNA, 22 bp, Artificial Sequence
  chemically synthesized
ctaactaaataatctaatgcta

SEQ ID NO: 784299 - DNA, 22 bp, Artificial Sequence
  chemically synthesized
taactaaataatctaatgctat

SEQ ID NO: 784300 - DNA, 22 bp, Artificial Sequence
  chemically synthesized
agaataaaatgtatagcattag

SEQ ID NO: 784301 - DNA, 22 bp, Artificial Sequence
  chemically synthesized
actaaataatctaatgctatac

SEQ ID NO: 784302 - DNA, 22 bp, Artificial Sequence
  chemically synthesized
aataatctaatgctatacattt

SEQ ID NO: 784303 - DNA, 22 bp, Artificial Sequence
  chemically synthesized
atgctatacattttattctcaa

SEQ ID NO: 784304 - DNA, 22 bp, Artificial Sequence
  chemically synthesized
tacattttattctcaatactgc

SEQ ID NO: 784305 - DNA, 22 bp, Artificial Sequence
  chemically synthesized
tattctcaatactgcttttatg

SEQ ID NO: 784306 - DNA, 22 bp, Artificial Sequence
  chemically synthesized
attctcaatactgcttttatga

SEQ ID NO: 784307 - DNA, 22 bp, Artificial Sequence
  chemically synthesized
ttctcaatactgcttttatgac

SEQ ID NO: 784308 - DNA, 22 bp, Artificial Sequence
  chemically synthesized
tcaatactgcttttatgacatc

SEQ ID NO: 784309 - DNA, 22 bp, Artificial Sequence
  chemically synthesized
aatactgcttttatgacatctc

SEQ ID NO: 784310 - DNA, 22 bp, Artificial Sequence
  chemically synthesized
gcaaaaaaaaataaagtgagat

SEQ ID NO: 784311 - DNA, 22 bp, Artificial Sequence
  chemically synthesized
cttttatgacatctcactttat

SEQ ID NO: 784312 - DNA, 22 bp, Artificial Sequence
  chemically synthesized
tggcaaaaaaaaataaagtgag

SEQ ID NO: 784313 - DNA, 22 bp, Artificial Sequence
  chemically synthesized
tctggcaaaaaaaaataaagtg

SEQ ID NO: 784314 - DNA, 22 bp, Artificial Sequence
  chemically synthesized
ttatgacatctcactttatttt

SEQ ID NO: 784315 - DNA, 22 bp, Artificial Sequence
  chemically synthesized
ctctggcaaaaaaaaataaagt

SEQ ID NO: 784316 - DNA, 22 bp, Artificial Sequence
  chemically synthesized
tatgacatctcactttattttt

SEQ ID NO: 784317 - DNA, 22 bp, Artificial Sequence
  chemically synthesized
tctctggcaaaaaaaaataaag

SEQ ID NO: 784318 - DNA, 22 bp, Artificial Sequence
  chemically synthesized
atgacatctcactttatttttt

SEQ ID NO: 784319 - DNA, 22 bp, Artificial Sequence
  chemically synthesized
ttctctggcaaaaaaaaataaa

SEQ ID NO: 784320 - DNA, 22 bp, Artificial Sequence
  chemically synthesized
tgacatctcactttattttttt

SEQ ID NO: 784321 - DNA, 22 bp, Artificial Sequence
  chemically synthesized
tttctctggcaaaaaaaaataa

SEQ ID NO: 784322 - DNA, 22 bp, Artificial Sequence
  chemically synthesized
gtctttttctctggcaaaaaaa

SEQ ID NO: 784323 - DNA, 22 bp, Artificial Sequence
  chemically synthesized
actttatttttttttgccagag

SEQ ID NO: 784324 - DNA, 22 bp, Artificial Sequence
  chemically synthesized
tatttttttttgccagagaaaa

SEQ ID NO: 784325 - DNA, 22 bp, Artificial Sequence
  chemically synthesized
atttttttttgccagagaaaaa

SEQ ID NO: 784326 - DNA, 22 bp, Artificial Sequence
  chemically synthesized
tttttttttgccagagaaaaag

SEQ ID NO: 784327 - DNA, 22 bp, Artificial Sequence
  chemically synthesized
tgagtaatctagtctttttctc

SEQ ID NO: 784328 - DNA, 22 bp, Artificial Sequence
  chemically synthesized
ttttttgccagagaaaaagact

SEQ ID NO: 784329 - DNA, 22 bp, Artificial Sequence
  chemically synthesized
tttttgccagagaaaaagacta

SEQ ID NO: 784330 - DNA, 22 bp, Artificial Sequence
  chemically synthesized
ctgtgagtaatctagtcttttt

SEQ ID NO: 784331 - DNA, 22 bp, Artificial Sequence
  chemically synthesized
ttttgccagagaaaaagactag

SEQ ID NO: 784332 - DNA, 22 bp, Artificial Sequence
  chemically synthesized
gctgtgagtaatctagtctttt

SEQ ID NO: 784333 - DNA, 22 bp, Artificial Sequence
  chemically synthesized
tttgccagagaaaaagactaga

SEQ ID NO: 784334 - DNA, 22 bp, Artificial Sequence
  chemically synthesized
tgctgtgagtaatctagtcttt

SEQ ID NO: 784335 - DNA, 22 bp, Artificial Sequence
  chemically synthesized
ttgccagagaaaaagactagat

SEQ ID NO: 784336 - DNA, 22 bp, Artificial Sequence
  chemically synthesized
tgccagagaaaaagactagatt

SEQ ID NO: 784337 - DNA, 22 bp, Artificial Sequence
  chemically synthesized
gccagagaaaaagactagatta

SEQ ID NO: 784338 - DNA, 22 bp, Artificial Sequence
  chemically synthesized
ctttgctgtgagtaatctagtc

SEQ ID NO: 784339 - DNA, 22 bp, Artificial Sequence
  chemically synthesized
ccagagaaaaagactagattac

SEQ ID NO: 784340 - DNA, 22 bp, Artificial Sequence
  chemically synthesized
ctgctttgctgtgagtaatcta

SEQ ID NO: 784341 - DNA, 22 bp, Artificial Sequence
  chemically synthesized
actactgctttgctgtgagtaa

SEQ ID NO: 784342 - DNA, 22 bp, Artificial Sequence
  chemically synthesized
gactactgctttgctgtgagta

SEQ ID NO: 784343 - DNA, 22 bp, Artificial Sequence
  chemically synthesized
tgactactgctttgctgtgagt

SEQ ID NO: 784344 - DNA, 22 bp, Artificial Sequence
  chemically synthesized
tttgactactgctttgctgtga

SEQ ID NO: 784345 - DNA, 22 bp, Artificial Sequence
  chemically synthesized
gttctttgactactgctttgct

SEQ ID NO: 784346 - DNA, 22 bp, Artificial Sequence
  chemically synthesized
gattactcacagcaaagcagta

SEQ ID NO: 784347 - DNA, 22 bp, Artificial Sequence
  chemically synthesized
ctcacagcaaagcagtagtcaa

SEQ ID NO: 784348 - DNA, 22 bp, Artificial Sequence
  chemically synthesized
acagcaaagcagtagtcaaaga

SEQ ID NO: 784349 - DNA, 22 bp, Artificial Sequence
  chemically synthesized
aataaaatgttggttctttgac

SEQ ID NO: 784350 - DNA, 22 bp, Artificial Sequence
  chemically synthesized
gctcaataaaatgttggttctt

SEQ ID NO: 784351 - DNA, 22 bp, Artificial Sequence
  chemically synthesized
tgggaactggctcaataaaatg

SEQ ID NO: 784352 - DNA, 22 bp, Artificial Sequence
  chemically synthesized
tgtgggaactggctcaataaaa

SEQ ID NO: 784353 - DNA, 22 bp, Artificial Sequence
  chemically synthesized
ctctgtgggaactggctcaata

SEQ ID NO: 784354 - DNA, 22 bp, Artificial Sequence
  chemically synthesized
ggattactctgtgggaactggc

SEQ ID NO: 784355 - DNA, 22 bp, Artificial Sequence
  chemically synthesized
gggattactctgtgggaactgg

SEQ ID NO: 784356 - DNA, 22 bp, Artificial Sequence
  chemically synthesized
tgggattactctgtgggaactg

SEQ ID NO: 784357 - DNA, 22 bp, Artificial Sequence
  chemically synthesized
tttgggattactctgtgggaac

SEQ ID NO: 784358 - DNA, 22 bp, Artificial Sequence
  chemically synthesized
ctttgggattactctgtgggaa

SEQ ID NO: 784359 - DNA, 22 bp, Artificial Sequence
  chemically synthesized
tattgagccagttcccacagag

SEQ ID NO: 784360 - DNA, 22 bp, Artificial Sequence
  chemically synthesized
attgagccagttcccacagagt

SEQ ID NO: 784361 - DNA, 22 bp, Artificial Sequence
  chemically synthesized
ttgagccagttcccacagagta

SEQ ID NO: 784362 - DNA, 22 bp, Artificial Sequence
  chemically synthesized
aacttctttgggattactctgt

SEQ ID NO: 784363 - DNA, 22 bp, Artificial Sequence
  chemically synthesized
agccagttcccacagagtaatc

SEQ ID NO: 784364 - DNA, 22 bp, Artificial Sequence
  chemically synthesized
ctgaacttctttgggattactc

SEQ ID NO: 784365 - DNA, 22 bp, Artificial Sequence
  chemically synthesized
ccacagagtaatcccaaagaag

SEQ ID NO: 784366 - DNA, 22 bp, Artificial Sequence
  chemically synthesized
tgtgtacaggtgtctcctgaac

SEQ ID NO: 784367 - DNA, 22 bp, Artificial Sequence
  chemically synthesized
tgatgcaatccactgtgtgtac

SEQ ID NO: 784368 - DNA, 22 bp, Artificial Sequence
  chemically synthesized
aggagacacctgtacacacagt

SEQ ID NO: 784369 - DNA, 22 bp, Artificial Sequence
  chemically synthesized
ctgtgatgcaatccactgtgtg

SEQ ID NO: 784370 - DNA, 22 bp, Artificial Sequence
  chemically synthesized
tcctgtgatgcaatccactgtg

SEQ ID NO: 784371 - DNA, 22 bp, Artificial Sequence
  chemically synthesized
tctcctgtgatgcaatccactg

SEQ ID NO: 784372 - DNA, 22 bp, Artificial Sequence
  chemically synthesized
ctctcctgtgatgcaatccact

SEQ ID NO: 784373 - DNA, 22 bp, Artificial Sequence
  chemically synthesized
tacacacagtggattgcatcac

SEQ ID NO: 784374 - DNA, 22 bp, Artificial Sequence
  chemically synthesized
agggtttctctcctgtgatgca

SEQ ID NO: 784375 - DNA, 22 bp, Artificial Sequence
  chemically synthesized
agctcagggtttctctcctgtg

SEQ ID NO: 784376 - DNA, 22 bp, Artificial Sequence
  chemically synthesized
aagctcagggtttctctcctgt

SEQ ID NO: 784377 - DNA, 22 bp, Artificial Sequence
  chemically synthesized
cttaagctcagggtttctctcc

SEQ ID NO: 784378 - DNA, 22 bp, Artificial Sequence
  chemically synthesized
ccttaagctcagggtttctctc

SEQ ID NO: 784379 - DNA, 22 bp, Artificial Sequence
  chemically synthesized
catcacaggagagaaaccctga

SEQ ID NO: 784380 - DNA, 22 bp, Artificial Sequence
  chemically synthesized
agcttccttaagctcagggttt

SEQ ID NO: 784381 - DNA, 22 bp, Artificial Sequence
  chemically synthesized
aagattaagcttccttaagctc

SEQ ID NO: 784382 - DNA, 22 bp, Artificial Sequence
  chemically synthesized
aaagattaagcttccttaagct

SEQ ID NO: 784383 - DNA, 22 bp, Artificial Sequence
  chemically synthesized
taaagattaagcttccttaagc

SEQ ID NO: 784384 - DNA, 22 bp, Artificial Sequence
  chemically synthesized
ttaaagattaagcttccttaag

SEQ ID NO: 784385 - DNA, 22 bp, Artificial Sequence
  chemically synthesized
tttttaaagattaagcttcctt

SEQ ID NO: 784386 - DNA, 22 bp, Artificial Sequence
  chemically synthesized
tctatttttaaagattaagctt

SEQ ID NO: 784387 - DNA, 22 bp, Artificial Sequence
  chemically synthesized
agcttaaggaagcttaatcttt

SEQ ID NO: 784388 - DNA, 22 bp, Artificial Sequence
  chemically synthesized
ctgtctatttttaaagattaag

SEQ ID NO: 784389 - DNA, 22 bp, Artificial Sequence
  chemically synthesized
aaggaagcttaatctttaaaaa

SEQ ID NO: 784390 - DNA, 22 bp, Artificial Sequence
  chemically synthesized
aggaagcttaatctttaaaaat

SEQ ID NO: 784391 - DNA, 22 bp, Artificial Sequence
  chemically synthesized
aatctttaaaaatagacagtag

SEQ ID NO: 784392 - DNA, 22 bp, Artificial Sequence
  chemically synthesized
atctttaaaaatagacagtaga

SEQ ID NO: 784393 - DNA, 22 bp, Artificial Sequence
  chemically synthesized
taaaaatagacagtagatatgc

SEQ ID NO: 784394 - DNA, 22 bp, Artificial Sequence
  chemically synthesized
aaaaatagacagtagatatgct

SEQ ID NO: 784395 - DNA, 22 bp, Artificial Sequence
  chemically synthesized
aagcaaagggcaagcatatcta

SEQ ID NO: 784396 - DNA, 22 bp, Artificial Sequence
  chemically synthesized
aaaatagacagtagatatgctt

SEQ ID NO: 784397 - DNA, 22 bp, Artificial Sequence
  chemically synthesized
tgaagcaaagggcaagcatatc

SEQ ID NO: 784398 - DNA, 22 bp, Artificial Sequence
  chemically synthesized
gccctttgcttcagaatctcac

SEQ ID NO: 784399 - DNA, 22 bp, Artificial Sequence
  chemically synthesized
ccctttgcttcagaatctcact

SEQ ID NO: 784400 - DNA, 22 bp, Artificial Sequence
  chemically synthesized
tgcttcagaatctcactcatgt

SEQ ID NO: 784401 - DNA, 22 bp, Artificial Sequence
  chemically synthesized
gcttcagaatctcactcatgtt

SEQ ID NO: 784402 - DNA, 22 bp, Artificial Sequence
  chemically synthesized
cttcagaatctcactcatgttg

SEQ ID NO: 784403 - DNA, 22 bp, Artificial Sequence
  chemically synthesized
cagaatctcactcatgttgatg

SEQ ID NO: 784404 - DNA, 22 bp, Artificial Sequence
  chemically synthesized
agaatctcactcatgttgatgt

SEQ ID NO: 784405 - DNA, 22 bp, Artificial Sequence
  chemically synthesized
aataaaatgaaaataaaacatc

SEQ ID NO: 784406 - DNA, 22 bp, Artificial Sequence
  chemically synthesized
actcatgttgatgttttatttt

SEQ ID NO: 784407 - DNA, 22 bp, Artificial Sequence
  chemically synthesized
atgttgatgttttattttcatt

SEQ ID NO: 784408 - DNA, 22 bp, Artificial Sequence
  chemically synthesized
atgttttattttcattttattt

SEQ ID NO: 784409 - DNA, 22 bp, Artificial Sequence
  chemically synthesized
aacacaaagaactaaataaaat

SEQ ID NO: 784410 - DNA, 22 bp, Artificial Sequence
  chemically synthesized
aaacacaaagaactaaataaaa

SEQ ID NO: 784411 - DNA, 22 bp, Artificial Sequence
  chemically synthesized
taaacacaaagaactaaataaa

SEQ ID NO: 784412 - DNA, 22 bp, Artificial Sequence
  chemically synthesized
ttaaacacaaagaactaaataa

SEQ ID NO: 784413 - DNA, 22 bp, Artificial Sequence
  chemically synthesized
tttaaacacaaagaactaaata

SEQ ID NO: 784414 - DNA, 22 bp, Artificial Sequence
  chemically synthesized
tattttcattttatttagttct

SEQ ID NO: 784415 - DNA, 22 bp, Artificial Sequence
  chemically synthesized
attttcattttatttagttctt

SEQ ID NO: 784416 - DNA, 22 bp, Artificial Sequence
  chemically synthesized
ttttcattttatttagttcttt

SEQ ID NO: 784417 - DNA, 22 bp, Artificial Sequence
  chemically synthesized
tcattttatttagttctttgtg

SEQ ID NO: 784418 - DNA, 22 bp, Artificial Sequence
  chemically synthesized
cattttatttagttctttgtgt

SEQ ID NO: 784419 - DNA, 22 bp, Artificial Sequence
  chemically synthesized
attttatttagttctttgtgtt

SEQ ID NO: 784420 - DNA, 22 bp, Artificial Sequence
  chemically synthesized
tatttagttctttgtgtttaaa

SEQ ID NO: 784421 - DNA, 22 bp, Artificial Sequence
  chemically synthesized
atttagttctttgtgtttaaaa

SEQ ID NO: 784422 - DNA, 22 bp, Artificial Sequence
  chemically synthesized
caaagaaaaattttttaaacac

SEQ ID NO: 784423 - DNA, 22 bp, Artificial Sequence
  chemically synthesized
tttagttctttgtgtttaaaaa

SEQ ID NO: 784424 - DNA, 22 bp, Artificial Sequence
  chemically synthesized
agttctttgtgtttaaaaaatt

SEQ ID NO: 784425 - DNA, 22 bp, Artificial Sequence
  chemically synthesized
gttctttgtgtttaaaaaattt

SEQ ID NO: 784426 - DNA, 22 bp, Artificial Sequence
  chemically synthesized
tttgtgtttaaaaaatttttct

SEQ ID NO: 784427 - DNA, 22 bp, Artificial Sequence
  chemically synthesized
tgtgtttaaaaaatttttcttt

SEQ ID NO: 784428 - DNA, 22 bp, Artificial Sequence
  chemically synthesized
gtgtttaaaaaatttttctttg

SEQ ID NO: 784429 - DNA, 22 bp, Artificial Sequence
  chemically synthesized
tgtttaaaaaatttttctttgc

SEQ ID NO: 784430 - DNA, 22 bp, Artificial Sequence
  chemically synthesized
aaaaaatttttctttgcaacct

SEQ ID NO: 784431 - DNA, 22 bp, Artificial Sequence
  chemically synthesized
aaaaatttttctttgcaacctc

SEQ ID NO: 784432 - DNA, 22 bp, Artificial Sequence
  chemically synthesized
cccaggtcaaggaggaggttgc

SEQ ID NO: 784433 - DNA, 22 bp, Artificial Sequence
  chemically synthesized
ccccaggtcaaggaggaggttg

SEQ ID NO: 784434 - DNA, 22 bp, Artificial Sequence
  chemically synthesized
tccccaggtcaaggaggaggtt

SEQ ID NO: 784435 - DNA, 22 bp, Artificial Sequence
  chemically synthesized
ttctttgcaacctcctccttga

SEQ ID NO: 784436 - DNA, 22 bp, Artificial Sequence
  chemically synthesized
tctttgcaacctcctccttgac

SEQ ID NO: 784437 - DNA, 22 bp, Artificial Sequence
  chemically synthesized
ctttgcaacctcctccttgacc

SEQ ID NO: 784438 - DNA, 22 bp, Artificial Sequence
  chemically synthesized
tttgcaacctcctccttgacct

SEQ ID NO: 784439 - DNA, 22 bp, Artificial Sequence
  chemically synthesized
aatcattttccccaggtcaagg

SEQ ID NO: 784440 - DNA, 22 bp, Artificial Sequence
  chemically synthesized
tgcaacctcctccttgacctgg

SEQ ID NO: 784441 - DNA, 22 bp, Artificial Sequence
  chemically synthesized
aaatcattttccccaggtcaag

SEQ ID NO: 784442 - DNA, 22 bp, Artificial Sequence
  chemically synthesized
gcaacctcctccttgacctggg

SEQ ID NO: 784443 - DNA, 22 bp, Artificial Sequence
  chemically synthesized
taaatcattttccccaggtcaa

SEQ ID NO: 784444 - DNA, 22 bp, Artificial Sequence
  chemically synthesized
caacctcctccttgacctgggg

SEQ ID NO: 784445 - DNA, 22 bp, Artificial Sequence
  chemically synthesized
ctccttgacctggggaaaatga

SEQ ID NO: 784446 - DNA, 22 bp, Artificial Sequence
  chemically synthesized
cttgacctggggaaaatgattt

SEQ ID NO: 784447 - DNA, 22 bp, Artificial Sequence
  chemically synthesized
gacctggggaaaatgatttaaa

SEQ ID NO: 784448 - DNA, 22 bp, Artificial Sequence
  chemically synthesized
acctggggaaaatgatttaaag

SEQ ID NO: 784449 - DNA, 22 bp, Artificial Sequence
  chemically synthesized
gggaaaatgatttaaaggtgtg

SEQ ID NO: 784450 - DNA, 22 bp, Artificial Sequence
  chemically synthesized
gaaatgaagcagcacaccttta

SEQ ID NO: 784451 - DNA, 22 bp, Artificial Sequence
  chemically synthesized
ggaaatgaagcagcacaccttt

SEQ ID NO: 784452 - DNA, 22 bp, Artificial Sequence
  chemically synthesized
aaaacacttggaaatgaagcag

SEQ ID NO: 784453 - DNA, 22 bp, Artificial Sequence
  chemically synthesized
aaaggtgtgctgcttcatttcc

SEQ ID NO: 784454 - DNA, 22 bp, Artificial Sequence
  chemically synthesized
aaggtgtgctgcttcatttcca

SEQ ID NO: 784455 - DNA, 22 bp, Artificial Sequence
  chemically synthesized
cttcatttccaagtgttttgag

SEQ ID NO: 784456 - DNA, 22 bp, Artificial Sequence
  chemically synthesized
catttccaagtgttttgaggtt

SEQ ID NO: 784457 - DNA, 22 bp, Artificial Sequence
  chemically synthesized
atttccaagtgttttgaggttt

SEQ ID NO: 784458 - DNA, 22 bp, Artificial Sequence
  chemically synthesized
ccaagtgttttgaggtttttct

SEQ ID NO: 784459 - DNA, 22 bp, Artificial Sequence
  chemically synthesized
caagtgttttgaggtttttctt

SEQ ID NO: 784460 - DNA, 22 bp, Artificial Sequence
  chemically synthesized
tgaggtttttcttttgtctttc

SEQ ID NO: 784461 - DNA, 22 bp, Artificial Sequence
  chemically synthesized
gaggtttttcttttgtctttct

SEQ ID NO: 784462 - DNA, 22 bp, Artificial Sequence
  chemically synthesized
gaaatcaataagagaaagacaa

SEQ ID NO: 784463 - DNA, 22 bp, Artificial Sequence
  chemically synthesized
aggtttttcttttgtctttctc

SEQ ID NO: 784464 - DNA, 22 bp, Artificial Sequence
  chemically synthesized
ttcttttgtctttctcttattg

SEQ ID NO: 784465 - DNA, 22 bp, Artificial Sequence
  chemically synthesized
tcttttgtctttctcttattga

SEQ ID NO: 784466 - DNA, 22 bp, Artificial Sequence
  chemically synthesized
cttttgtctttctcttattgat

SEQ ID NO: 784467 - DNA, 22 bp, Artificial Sequence
  chemically synthesized
ttttgtctttctcttattgatt

SEQ ID NO: 784468 - DNA, 22 bp, Artificial Sequence
  chemically synthesized
ttgtctttctcttattgatttc

SEQ ID NO: 784469 - DNA, 22 bp, Artificial Sequence
  chemically synthesized
tgtctttctcttattgatttct

SEQ ID NO: 784470 - DNA, 22 bp, Artificial Sequence
  chemically synthesized
gtctttctcttattgatttcta

SEQ ID NO: 784471 - DNA, 22 bp, Artificial Sequence
  chemically synthesized
tctttctcttattgatttctag

SEQ ID NO: 784472 - DNA, 22 bp, Artificial Sequence
  chemically synthesized
tctcttattgatttctagcttg

SEQ ID NO: 784473 - DNA, 22 bp, Artificial Sequence
  chemically synthesized
ctcttattgatttctagcttgg

SEQ ID NO: 784474 - DNA, 22 bp, Artificial Sequence
  chemically synthesized
tcttattgatttctagcttggt

SEQ ID NO: 784475 - DNA, 22 bp, Artificial Sequence
  chemically synthesized
ttattgatttctagcttggttt

SEQ ID NO: 784476 - DNA, 22 bp, Artificial Sequence
  chemically synthesized
ccagaacataatgaaaccaagc

SEQ ID NO: 784477 - DNA, 22 bp, Artificial Sequence
  chemically synthesized
attgatttctagcttggtttca

SEQ ID NO: 784478 - DNA, 22 bp, Artificial Sequence
  chemically synthesized
ttgatttctagcttggtttcat

SEQ ID NO: 784479 - DNA, 22 bp, Artificial Sequence
  chemically synthesized
atttctagcttggtttcattat

SEQ ID NO: 784480 - DNA, 22 bp, Artificial Sequence
  chemically synthesized
tatgttcccagaacataatgaa

SEQ ID NO: 784481 - DNA, 22 bp, Artificial Sequence
  chemically synthesized
atatgttcccagaacataatga

SEQ ID NO: 784482 - DNA, 22 bp, Artificial Sequence
  chemically synthesized
ctagcttggtttcattatgttc

SEQ ID NO: 784483 - DNA, 22 bp, Artificial Sequence
  chemically synthesized
tagcttggtttcattatgttct

SEQ ID NO: 784484 - DNA, 22 bp, Artificial Sequence
  chemically synthesized
gcttggtttcattatgttctgg

SEQ ID NO: 784485 - DNA, 22 bp, Artificial Sequence
  chemically synthesized
aacttatatgttcccagaacat

SEQ ID NO: 784486 - DNA, 22 bp, Artificial Sequence
  chemically synthesized
ggtttcattatgttctgggaac

SEQ ID NO: 784487 - DNA, 22 bp, Artificial Sequence
  chemically synthesized
gtttcattatgttctgggaaca

SEQ ID NO: 784488 - DNA, 22 bp, Artificial Sequence
  chemically synthesized
cattatgttctgggaacatata

SEQ ID NO: 784489 - DNA, 22 bp, Artificial Sequence
  chemically synthesized
gagaattcaacttatatgttcc

SEQ ID NO: 784490 - DNA, 22 bp, Artificial Sequence
  chemically synthesized
attatgttctgggaacatataa

SEQ ID NO: 784491 - DNA, 22 bp, Artificial Sequence
  chemically synthesized
agagaattcaacttatatgttc

SEQ ID NO: 784492 - DNA, 22 bp, Artificial Sequence
  chemically synthesized
tgttctgggaacatataagttg

SEQ ID NO: 784493 - DNA, 22 bp, Artificial Sequence
  chemically synthesized
tgggaacatataagttgaattc

SEQ ID NO: 784494 - DNA, 22 bp, Artificial Sequence
  chemically synthesized
agcaaatttagagaattcaact

SEQ ID NO: 784495 - DNA, 22 bp, Artificial Sequence
  chemically synthesized
cagcaaatttagagaattcaac

SEQ ID NO: 784496 - DNA, 22 bp, Artificial Sequence
  chemically synthesized
ggaacatataagttgaattctc

SEQ ID NO: 784497 - DNA, 22 bp, Artificial Sequence
  chemically synthesized
caagcaacttcagcaaatttag

SEQ ID NO: 784498 - DNA, 22 bp, Artificial Sequence
  chemically synthesized
gactccaagcaacttcagcaaa

SEQ ID NO: 784499 - DNA, 22 bp, Artificial Sequence
  chemically synthesized
aattctctaaatttgctgaagt

SEQ ID NO: 784500 - DNA, 22 bp, Artificial Sequence
  chemically synthesized
tggactccaagcaacttcagca

SEQ ID NO: 784501 - DNA, 22 bp, Artificial Sequence
  chemically synthesized
tctaaatttgctgaagttgctt

SEQ ID NO: 784502 - DNA, 22 bp, Artificial Sequence
  chemically synthesized
taaatttgctgaagttgcttgg

SEQ ID NO: 784503 - DNA, 22 bp, Artificial Sequence
  chemically synthesized
aatttgctgaagttgcttggag

SEQ ID NO: 784504 - DNA, 22 bp, Artificial Sequence
  chemically synthesized
gctgaagttgcttggagtccag

SEQ ID NO: 784505 - DNA, 22 bp, Artificial Sequence
  chemically synthesized
ctgaagttgcttggagtccaga

SEQ ID NO: 784506 - DNA, 22 bp, Artificial Sequence
  chemically synthesized
atataagccatattctggactc

SEQ ID NO: 784507 - DNA, 22 bp, Artificial Sequence
  chemically synthesized
aagttgcttggagtccagaata

SEQ ID NO: 784508 - DNA, 22 bp, Artificial Sequence
  chemically synthesized
actgatataagccatattctgg

SEQ ID NO: 784509 - DNA, 22 bp, Artificial Sequence
  chemically synthesized
cttggagtccagaatatggctt

SEQ ID NO: 784510 - DNA, 22 bp, Artificial Sequence
  chemically synthesized
ggagtccagaatatggcttata

SEQ ID NO: 784511 - DNA, 22 bp, Artificial Sequence
  chemically synthesized
gagtccagaatatggcttatat

SEQ ID NO: 784512 - DNA, 22 bp, Artificial Sequence
  chemically synthesized
atgaaacattcactgatataag

SEQ ID NO: 784513 - DNA, 22 bp, Artificial Sequence
  chemically synthesized
tcatgaaacattcactgatata

SEQ ID NO: 784514 - DNA, 22 bp, Artificial Sequence
  chemically synthesized
aagctctcatgaaacattcact

SEQ ID NO: 784515 - DNA, 22 bp, Artificial Sequence
  chemically synthesized
aaagctctcatgaaacattcac

SEQ ID NO: 784516 - DNA, 22 bp, Artificial Sequence
  chemically synthesized
taaagctctcatgaaacattca

SEQ ID NO: 784517 - DNA, 22 bp, Artificial Sequence
  chemically synthesized
ctttaaagctctcatgaaacat

SEQ ID NO: 784518 - DNA, 22 bp, Artificial Sequence
  chemically synthesized
atatcagtgaatgtttcatgag

SEQ ID NO: 784519 - DNA, 22 bp, Artificial Sequence
  chemically synthesized
tatcagtgaatgtttcatgaga

SEQ ID NO: 784520 - DNA, 22 bp, Artificial Sequence
  chemically synthesized
catgagagctttaaagtaatgt

SEQ ID NO: 784521 - DNA, 22 bp, Artificial Sequence
  chemically synthesized
atgagagctttaaagtaatgtg

SEQ ID NO: 784522 - DNA, 22 bp, Artificial Sequence
  chemically synthesized
ccaacagtagcagaatacacat

SEQ ID NO: 784523 - DNA, 22 bp, Artificial Sequence
  chemically synthesized
ctcccaacagtagcagaataca

SEQ ID NO: 784524 - DNA, 22 bp, Artificial Sequence
  chemically synthesized
taaagtaatgtgtattctgcta

SEQ ID NO: 784525 - DNA, 22 bp, Artificial Sequence
  chemically synthesized
aaagtaatgtgtattctgctac

SEQ ID NO: 784526 - DNA, 22 bp, Artificial Sequence
  chemically synthesized
aagtaatgtgtattctgctact

SEQ ID NO: 784527 - DNA, 22 bp, Artificial Sequence
  chemically synthesized
aagcactcctcccaacagtagc

SEQ ID NO: 784528 - DNA, 22 bp, Artificial Sequence
  chemically synthesized
attgaagcactcctcccaacag

SEQ ID NO: 784529 - DNA, 22 bp, Artificial Sequence
  chemically synthesized
tgctactgttgggaggagtgct

SEQ ID NO: 784530 - DNA, 22 bp, Artificial Sequence
  chemically synthesized
ctactgttgggaggagtgcttc

SEQ ID NO: 784531 - DNA, 22 bp, Artificial Sequence
  chemically synthesized
ctgttgggaggagtgcttcaat

SEQ ID NO: 784532 - DNA, 22 bp, Artificial Sequence
  chemically synthesized
ttgggaggagtgcttcaattag

SEQ ID NO: 784533 - DNA, 22 bp, Artificial Sequence
  chemically synthesized
ggaggagtgcttcaattagatc

SEQ ID NO: 784534 - DNA, 22 bp, Artificial Sequence
  chemically synthesized
aacaacaccatcaaccaatagg

SEQ ID NO: 784535 - DNA, 22 bp, Artificial Sequence
  chemically synthesized
caattagatcctattggttgat

SEQ ID NO: 784536 - DNA, 22 bp, Artificial Sequence
  chemically synthesized
aattagatcctattggttgatg

SEQ ID NO: 784537 - DNA, 22 bp, Artificial Sequence
  chemically synthesized
gatcctattggttgatggtgtt

SEQ ID NO: 784538 - DNA, 22 bp, Artificial Sequence
  chemically synthesized
ttggttgatggtgttgttcagt

SEQ ID NO: 784539 - DNA, 22 bp, Artificial Sequence
  chemically synthesized
gttgatggtgttgttcagttct

SEQ ID NO: 784540 - DNA, 22 bp, Artificial Sequence
  chemically synthesized
atggtgttgttcagttctcttt

SEQ ID NO: 784541 - DNA, 22 bp, Artificial Sequence
  chemically synthesized
aatggaaaataagcaagggtaa

SEQ ID NO: 784542 - DNA, 22 bp, Artificial Sequence
  chemically synthesized
ttcagttctctttacccttgct

SEQ ID NO: 784543 - DNA, 22 bp, Artificial Sequence
  chemically synthesized
ctaaatggaaaataagcaaggg

SEQ ID NO: 784544 - DNA, 22 bp, Artificial Sequence
  chemically synthesized
agttctctttacccttgcttat

SEQ ID NO: 784545 - DNA, 22 bp, Artificial Sequence
  chemically synthesized
tctttacccttgcttattttcc

SEQ ID NO: 784546 - DNA, 22 bp, Artificial Sequence
  chemically synthesized
tttacccttgcttattttccat

SEQ ID NO: 784547 - DNA, 22 bp, Artificial Sequence
  chemically synthesized
atagaactactaaatggaaaat

SEQ ID NO: 784548 - DNA, 22 bp, Artificial Sequence
  chemically synthesized
tacccttgcttattttccattt

SEQ ID NO: 784549 - DNA, 22 bp, Artificial Sequence
  chemically synthesized
acccttgcttattttccattta

SEQ ID NO: 784550 - DNA, 22 bp, Artificial Sequence
  chemically synthesized
cccttgcttattttccatttag

SEQ ID NO: 784551 - DNA, 22 bp, Artificial Sequence
  chemically synthesized
agttgatagaactactaaatgg

SEQ ID NO: 784552 - DNA, 22 bp, Artificial Sequence
  chemically synthesized
cagttgatagaactactaaatg

SEQ ID NO: 784553 - DNA, 22 bp, Artificial Sequence
  chemically synthesized
gcttattttccatttagtagtt

SEQ ID NO: 784554 - DNA, 22 bp, Artificial Sequence
  chemically synthesized
ttcagttgatagaactactaaa

SEQ ID NO: 784555 - DNA, 22 bp, Artificial Sequence
  chemically synthesized
cttattttccatttagtagttc

SEQ ID NO: 784556 - DNA, 22 bp, Artificial Sequence
  chemically synthesized
tcttcagttgatagaactacta

SEQ ID NO: 784557 - DNA, 22 bp, Artificial Sequence
  chemically synthesized
attttccatttagtagttctat

SEQ ID NO: 784558 - DNA, 22 bp, Artificial Sequence
  chemically synthesized
tctcttcagttgatagaactac

SEQ ID NO: 784559 - DNA, 22 bp, Artificial Sequence
  chemically synthesized
ttttccatttagtagttctatc

SEQ ID NO: 784560 - DNA, 22 bp, Artificial Sequence
  chemically synthesized
ctctctcttcagttgatagaac

SEQ ID NO: 784561 - DNA, 22 bp, Artificial Sequence
  chemically synthesized
tccatttagtagttctatcaac

SEQ ID NO: 784562 - DNA, 22 bp, Artificial Sequence
  chemically synthesized
ccatttagtagttctatcaact

SEQ ID NO: 784563 - DNA, 22 bp, Artificial Sequence
  chemically synthesized
catttagtagttctatcaactg

SEQ ID NO: 784564 - DNA, 22 bp, Artificial Sequence
  chemically synthesized
aacactcctctctcttcagttg

SEQ ID NO: 784565 - DNA, 22 bp, Artificial Sequence
  chemically synthesized
agtagttctatcaactgaagag

SEQ ID NO: 784566 - DNA, 22 bp, Artificial Sequence
  chemically synthesized
caacactcctctctcttcagtt

SEQ ID NO: 784567 - DNA, 22 bp, Artificial Sequence
  chemically synthesized
gtagttctatcaactgaagaga

SEQ ID NO: 784568 - DNA, 22 bp, Artificial Sequence
  chemically synthesized
gggacttcaacactcctctctc

SEQ ID NO: 784569 - DNA, 22 bp, Artificial Sequence
  chemically synthesized
tatcaactgaagagagaggagt

SEQ ID NO: 784570 - DNA, 22 bp, Artificial Sequence
  chemically synthesized
tcaactgaagagagaggagtgt

SEQ ID NO: 784571 - DNA, 22 bp, Artificial Sequence
  chemically synthesized
gttagggacttcaacactcctc

SEQ ID NO: 784572 - DNA, 22 bp, Artificial Sequence
  chemically synthesized
tagttagggacttcaacactcc

SEQ ID NO: 784573 - DNA, 22 bp, Artificial Sequence
  chemically synthesized
ctagttagggacttcaacactc

SEQ ID NO: 784574 - DNA, 22 bp, Artificial Sequence
  chemically synthesized
aagagagaggagtgttgaagtc

SEQ ID NO: 784575 - DNA, 22 bp, Artificial Sequence
  chemically synthesized
aagtccctaactagaaatatgg

SEQ ID NO: 784576 - DNA, 22 bp, Artificial Sequence
  chemically synthesized
aaaaaagaaacagacaaatcca

SEQ ID NO: 784577 - DNA, 22 bp, Artificial Sequence
  chemically synthesized
actagaaatatggatttgtctg

SEQ ID NO: 784578 - DNA, 22 bp, Artificial Sequence
  chemically synthesized
gaaatatggatttgtctgtttc

SEQ ID NO: 784579 - DNA, 22 bp, Artificial Sequence
  chemically synthesized
gtctgtttcttttttcagctct

SEQ ID NO: 784580 - DNA, 22 bp, Artificial Sequence
  chemically synthesized
tctgtttcttttttcagctcta

SEQ ID NO: 784581 - DNA, 22 bp, Artificial Sequence
  chemically synthesized
tttcttttttcagctctattca

SEQ ID NO: 784582 - DNA, 22 bp, Artificial Sequence
  chemically synthesized
cttttttcagctctattcattt

SEQ ID NO: 784583 - DNA, 22 bp, Artificial Sequence
  chemically synthesized
ttttttcagctctattcatttt

SEQ ID NO: 784584 - DNA, 22 bp, Artificial Sequence
  chemically synthesized
ttttcagctctattcatttttg

SEQ ID NO: 784585 - DNA, 22 bp, Artificial Sequence
  chemically synthesized
tttcagctctattcatttttgc

SEQ ID NO: 784586 - DNA, 22 bp, Artificial Sequence
  chemically synthesized
caaatacatgaagcaaaaatga

SEQ ID NO: 784587 - DNA, 22 bp, Artificial Sequence
  chemically synthesized
ttcagctctattcatttttgct

SEQ ID NO: 784588 - DNA, 22 bp, Artificial Sequence
  chemically synthesized
ccaaatacatgaagcaaaaatg

SEQ ID NO: 784589 - DNA, 22 bp, Artificial Sequence
  chemically synthesized
tcagctctattcatttttgctt

SEQ ID NO: 784590 - DNA, 22 bp, Artificial Sequence
  chemically synthesized
cagctctattcatttttgcttc

SEQ ID NO: 784591 - DNA, 22 bp, Artificial Sequence
  chemically synthesized
agctctattcatttttgcttca

SEQ ID NO: 784592 - DNA, 22 bp, Artificial Sequence
  chemically synthesized
tattcatttttgcttcatgtat

SEQ ID NO: 784593 - DNA, 22 bp, Artificial Sequence
  chemically synthesized
ttcatttttgcttcatgtattt

SEQ ID NO: 784594 - DNA, 22 bp, Artificial Sequence
  chemically synthesized
acaacagagcttccaaatacat

SEQ ID NO: 784595 - DNA, 22 bp, Artificial Sequence
  chemically synthesized
atttttgcttcatgtatttgga

SEQ ID NO: 784596 - DNA, 22 bp, Artificial Sequence
  chemically synthesized
ttgcttcatgtatttggaagct

SEQ ID NO: 784597 - DNA, 22 bp, Artificial Sequence
  chemically synthesized
tgcttcatgtatttggaagctc

SEQ ID NO: 784598 - DNA, 22 bp, Artificial Sequence
  chemically synthesized
cacctaacaacagagcttccaa

SEQ ID NO: 784599 - DNA, 22 bp, Artificial Sequence
  chemically synthesized
gcttcatgtatttggaagctct

SEQ ID NO: 784600 - DNA, 22 bp, Artificial Sequence
  chemically synthesized
gcacctaacaacagagcttcca

SEQ ID NO: 784601 - DNA, 22 bp, Artificial Sequence
  chemically synthesized
cttcatgtatttggaagctctg

SEQ ID NO: 784602 - DNA, 22 bp, Artificial Sequence
  chemically synthesized
catgtatttggaagctctgttg

SEQ ID NO: 784603 - DNA, 22 bp, Artificial Sequence
  chemically synthesized
atgtatttggaagctctgttgt

SEQ ID NO: 784604 - DNA, 22 bp, Artificial Sequence
  chemically synthesized
aatgtgtttgcacctaacaaca

SEQ ID NO: 784605 - DNA, 22 bp, Artificial Sequence
  chemically synthesized
ggaagctctgttgttaggtgca

SEQ ID NO: 784606 - DNA, 22 bp, Artificial Sequence
  chemically synthesized
gaagctctgttgttaggtgcaa

SEQ ID NO: 784607 - DNA, 22 bp, Artificial Sequence
  chemically synthesized
tgttgttaggtgcaaacacatt

SEQ ID NO: 784608 - DNA, 22 bp, Artificial Sequence
  chemically synthesized
ttgttaggtgcaaacacattta

SEQ ID NO: 784609 - DNA, 22 bp, Artificial Sequence
  chemically synthesized
ttaggtgcaaacacatttagga

SEQ ID NO: 784610 - DNA, 22 bp, Artificial Sequence
  chemically synthesized
ggaagacataataatcctaaat

SEQ ID NO: 784611 - DNA, 22 bp, Artificial Sequence
  chemically synthesized
ggtgcaaacacatttaggatta

SEQ ID NO: 784612 - DNA, 22 bp, Artificial Sequence
  chemically synthesized
actgggaagacataataatcct

SEQ ID NO: 784613 - DNA, 22 bp, Artificial Sequence
  chemically synthesized
attcactgggaagacataataa

SEQ ID NO: 784614 - DNA, 22 bp, Artificial Sequence
  chemically synthesized
agtgttaattcactgggaagac

SEQ ID NO: 784615 - DNA, 22 bp, Artificial Sequence
  chemically synthesized
aggattattatgtcttcccagt

SEQ ID NO: 784616 - DNA, 22 bp, Artificial Sequence
  chemically synthesized
ggattattatgtcttcccagtg

SEQ ID NO: 784617 - DNA, 22 bp, Artificial Sequence
  chemically synthesized
ttatgtcttcccagtgaattaa

SEQ ID NO: 784618 - DNA, 22 bp, Artificial Sequence
  chemically synthesized
tgtcttcccagtgaattaacac

SEQ ID NO: 784619 - DNA, 22 bp, Artificial Sequence
  chemically synthesized
cataaagattaagtgttaattc

SEQ ID NO: 784620 - DNA, 22 bp, Artificial Sequence
  chemically synthesized
cccagtgaattaacacttaatc

SEQ ID NO: 784621 - DNA, 22 bp, Artificial Sequence
  chemically synthesized
ccagtgaattaacacttaatct

SEQ ID NO: 784622 - DNA, 22 bp, Artificial Sequence
  chemically synthesized
acacttaatctttatgtaatgt

SEQ ID NO: 784623 - DNA, 22 bp, Artificial Sequence
  chemically synthesized
gtgacaaacagggacattacat

SEQ ID NO: 784624 - DNA, 22 bp, Artificial Sequence
  chemically synthesized
ctagtgacaaacagggacatta

SEQ ID NO: 784625 - DNA, 22 bp, Artificial Sequence
  chemically synthesized
aatctttatgtaatgtccctgt

SEQ ID NO: 784626 - DNA, 22 bp, Artificial Sequence
  chemically synthesized
atctttatgtaatgtccctgtt

SEQ ID NO: 784627 - DNA, 22 bp, Artificial Sequence
  chemically synthesized
tatgtaatgtccctgtttgtca

SEQ ID NO: 784628 - DNA, 22 bp, Artificial Sequence
  chemically synthesized
atgtaatgtccctgtttgtcac

SEQ ID NO: 784629 - DNA, 22 bp, Artificial Sequence
  chemically synthesized
tgtaatgtccctgtttgtcact

SEQ ID NO: 784630 - DNA, 22 bp, Artificial Sequence
  chemically synthesized
caaagaaaattactagtgacaa

SEQ ID NO: 784631 - DNA, 22 bp, Artificial Sequence
  chemically synthesized
attgcaaagaaaattactagtg

SEQ ID NO: 784632 - DNA, 22 bp, Artificial Sequence
  chemically synthesized
cattgcaaagaaaattactagt

SEQ ID NO: 784633 - DNA, 22 bp, Artificial Sequence
  chemically synthesized
tttgtcactagtaattttcttt

SEQ ID NO: 784634 - DNA, 22 bp, Artificial Sequence
  chemically synthesized
gtcactagtaattttctttgca

SEQ ID NO: 784635 - DNA, 22 bp, Artificial Sequence
  chemically synthesized
tcactagtaattttctttgcaa

SEQ ID NO: 784636 - DNA, 22 bp, Artificial Sequence
  chemically synthesized
gtaattttctttgcaatgaagc

SEQ ID NO: 784637 - DNA, 22 bp, Artificial Sequence
  chemically synthesized
atatcagataaagtaggcttca

SEQ ID NO: 784638 - DNA, 22 bp, Artificial Sequence
  chemically synthesized
tctttgcaatgaagcctacttt

SEQ ID NO: 784639 - DNA, 22 bp, Artificial Sequence
  chemically synthesized
ctttgcaatgaagcctacttta

SEQ ID NO: 784640 - DNA, 22 bp, Artificial Sequence
  chemically synthesized
tttgcaatgaagcctactttat

SEQ ID NO: 784641 - DNA, 22 bp, Artificial Sequence
  chemically synthesized
tgcaatgaagcctactttatct

SEQ ID NO: 784642 - DNA, 22 bp, Artificial Sequence
  chemically synthesized
gcaatgaagcctactttatctg

SEQ ID NO: 784643 - DNA, 22 bp, Artificial Sequence
  chemically synthesized
caatgaagcctactttatctga

SEQ ID NO: 784644 - DNA, 22 bp, Artificial Sequence
  chemically synthesized
ctttatctgatattaacattac

SEQ ID NO: 784645 - DNA, 22 bp, Artificial Sequence
  chemically synthesized
tatctgatattaacattactgc

SEQ ID NO: 784646 - DNA, 22 bp, Artificial Sequence
  chemically synthesized
atctgatattaacattactgct

SEQ ID NO: 784647 - DNA, 22 bp, Artificial Sequence
  chemically synthesized
tctgatattaacattactgctg

SEQ ID NO: 784648 - DNA, 22 bp, Artificial Sequence
  chemically synthesized
atcaaaagaaagcagcagcagt

SEQ ID NO: 784649 - DNA, 22 bp, Artificial Sequence
  chemically synthesized
atattaacattactgctgctgc

SEQ ID NO: 784650 - DNA, 22 bp, Artificial Sequence
  chemically synthesized
acattactgctgctgctttctt

SEQ ID NO: 784651 - DNA, 22 bp, Artificial Sequence
  chemically synthesized
tgcaacaattaatcaaaagaaa

SEQ ID NO: 784652 - DNA, 22 bp, Artificial Sequence
  chemically synthesized
ctgctgctgctttcttttgatt

SEQ ID NO: 784653 - DNA, 22 bp, Artificial Sequence
  chemically synthesized
ctgctgctttcttttgattaat

SEQ ID NO: 784654 - DNA, 22 bp, Artificial Sequence
  chemically synthesized
cattatgcaacaattaatcaaa

SEQ ID NO: 784655 - DNA, 22 bp, Artificial Sequence
  chemically synthesized
ctgctttcttttgattaattgt

SEQ ID NO: 784656 - DNA, 22 bp, Artificial Sequence
  chemically synthesized
ctttcttttgattaattgttgc

SEQ ID NO: 784657 - DNA, 22 bp, Artificial Sequence
  chemically synthesized
tcttttgattaattgttgcata

SEQ ID NO: 784658 - DNA, 22 bp, Artificial Sequence
  chemically synthesized
cttttgattaattgttgcataa

SEQ ID NO: 784659 - DNA, 22 bp, Artificial Sequence
  chemically synthesized
ttttgattaattgttgcataat

SEQ ID NO: 784660 - DNA, 22 bp, Artificial Sequence
  chemically synthesized
ttgattaattgttgcataatgt

SEQ ID NO: 784661 - DNA, 22 bp, Artificial Sequence
  chemically synthesized
tgattaattgttgcataatgta

SEQ ID NO: 784662 - DNA, 22 bp, Artificial Sequence
  chemically synthesized
gattaattgttgcataatgtaa

SEQ ID NO: 784663 - DNA, 22 bp, Artificial Sequence
  chemically synthesized
attaattgttgcataatgtaac

SEQ ID NO: 784664 - DNA, 22 bp, Artificial Sequence
  chemically synthesized
aaagaatcgaaaaagttacatt

SEQ ID NO: 784665 - DNA, 22 bp, Artificial Sequence
  chemically synthesized
attgttgcataatgtaactttt

SEQ ID NO: 784666 - DNA, 22 bp, Artificial Sequence
  chemically synthesized
ttgcataatgtaactttttcga

SEQ ID NO: 784667 - DNA, 22 bp, Artificial Sequence
  chemically synthesized
aaattaaaagaatcgaaaaagt

SEQ ID NO: 784668 - DNA, 22 bp, Artificial Sequence
  chemically synthesized
cataatgtaactttttcgattc

SEQ ID NO: 784669 - DNA, 22 bp, Artificial Sequence
  chemically synthesized
ggtaggttaaaattaaaagaat

SEQ ID NO: 784670 - DNA, 22 bp, Artificial Sequence
  chemically synthesized
tttcgattcttttaattttaac

SEQ ID NO: 784671 - DNA, 22 bp, Artificial Sequence
  chemically synthesized
ttcgattcttttaattttaacc

SEQ ID NO: 784672 - DNA, 22 bp, Artificial Sequence
  chemically synthesized
tcgattcttttaattttaacct

SEQ ID NO: 784673 - DNA, 22 bp, Artificial Sequence
  chemically synthesized
cgattcttttaattttaaccta

SEQ ID NO: 784674 - DNA, 22 bp, Artificial Sequence
  chemically synthesized
gattcttttaattttaacctac

SEQ ID NO: 784675 - DNA, 22 bp, Artificial Sequence
  chemically synthesized
aaatacaacctaggtaggttaa

SEQ ID NO: 784676 - DNA, 22 bp, Artificial Sequence
  chemically synthesized
caaatacaacctaggtaggtta

SEQ ID NO: 784677 - DNA, 22 bp, Artificial Sequence
  chemically synthesized
ttttaattttaacctacctagg

SEQ ID NO: 784678 - DNA, 22 bp, Artificial Sequence
  chemically synthesized
tttcaaatacaacctaggtagg

SEQ ID NO: 784679 - DNA, 22 bp, Artificial Sequence
  chemically synthesized
atttcaaatacaacctaggtag

SEQ ID NO: 784680 - DNA, 22 bp, Artificial Sequence
  chemically synthesized
ttaattttaacctacctaggtt

SEQ ID NO: 784681 - DNA, 22 bp, Artificial Sequence
  chemically synthesized
taattttaacctacctaggttg

SEQ ID NO: 784682 - DNA, 22 bp, Artificial Sequence
  chemically synthesized
aattttaacctacctaggttgt

SEQ ID NO: 784683 - DNA, 22 bp, Artificial Sequence
  chemically synthesized
attttaacctacctaggttgta

SEQ ID NO: 784684 - DNA, 22 bp, Artificial Sequence
  chemically synthesized
taacctacctaggttgtatttg

SEQ ID NO: 784685 - DNA, 22 bp, Artificial Sequence
  chemically synthesized
aacctacctaggttgtatttga

SEQ ID NO: 784686 - DNA, 22 bp, Artificial Sequence
  chemically synthesized
acctacctaggttgtatttgaa

SEQ ID NO: 784687 - DNA, 22 bp, Artificial Sequence
  chemically synthesized
aaagaagtttatttcaaataca

SEQ ID NO: 784688 - DNA, 22 bp, Artificial Sequence
  chemically synthesized
cctaggttgtatttgaaataaa

SEQ ID NO: 784689 - DNA, 22 bp, Artificial Sequence
  chemically synthesized
ggttgtatttgaaataaacttc

SEQ ID NO: 784690 - DNA, 22 bp, Artificial Sequence
  chemically synthesized
tatttgaaataaacttctttta

SEQ ID NO: 784691 - DNA, 22 bp, Artificial Sequence
  chemically synthesized
gaaataaacttcttttagacgg

SEQ ID NO: 784692 - DNA, 22 bp, Artificial Sequence
  chemically synthesized
aaataaacttcttttagacggc

SEQ ID NO: 784693 - DNA, 22 bp, Artificial Sequence
  chemically synthesized
agcacacaatatgccgtctaaa

SEQ ID NO: 784694 - DNA, 22 bp, Artificial Sequence
  chemically synthesized
cttttagacggcatattgtgtg

SEQ ID NO: 784695 - DNA, 22 bp, Artificial Sequence
  chemically synthesized
ataaaagctgagcacacaatat

SEQ ID NO: 784696 - DNA, 22 bp, Artificial Sequence
  chemically synthesized
ttttagacggcatattgtgtgc

SEQ ID NO: 784697 - DNA, 22 bp, Artificial Sequence
  chemically synthesized
ttagacggcatattgtgtgctc

SEQ ID NO: 784698 - DNA, 22 bp, Artificial Sequence
  chemically synthesized
tagacggcatattgtgtgctca

SEQ ID NO: 784699 - DNA, 22 bp, Artificial Sequence
  chemically synthesized
agacggcatattgtgtgctcag

SEQ ID NO: 784700 - DNA, 22 bp, Artificial Sequence
  chemically synthesized
gacggcatattgtgtgctcagc

SEQ ID NO: 784701 - DNA, 22 bp, Artificial Sequence
  chemically synthesized
agtggattgataaaagctgagc

SEQ ID NO: 784702 - DNA, 22 bp, Artificial Sequence
  chemically synthesized
gctgagtggattgataaaagct

SEQ ID NO: 784703 - DNA, 22 bp, Artificial Sequence
  chemically synthesized
agctgagtggattgataaaagc

SEQ ID NO: 784704 - DNA, 22 bp, Artificial Sequence
  chemically synthesized
tgtgctcagcttttatcaatcc

SEQ ID NO: 784705 - DNA, 22 bp, Artificial Sequence
  chemically synthesized
aaagagatttagctgagtggat

SEQ ID NO: 784706 - DNA, 22 bp, Artificial Sequence
  chemically synthesized
agcttttatcaatccactcagc

SEQ ID NO: 784707 - DNA, 22 bp, Artificial Sequence
  chemically synthesized
ttatcaatccactcagctaaat

SEQ ID NO: 784708 - DNA, 22 bp, Artificial Sequence
  chemically synthesized
tatcaatccactcagctaaatc

SEQ ID NO: 784709 - DNA, 22 bp, Artificial Sequence
  chemically synthesized
atcaatccactcagctaaatct

SEQ ID NO: 784710 - DNA, 22 bp, Artificial Sequence
  chemically synthesized
tcaatccactcagctaaatctc

SEQ ID NO: 784711 - DNA, 22 bp, Artificial Sequence
  chemically synthesized
aatataccaattaaaagagatt

SEQ ID NO: 784712 - DNA, 22 bp, Artificial Sequence
  chemically synthesized
agctaaatctcttttaattggt

SEQ ID NO: 784713 - DNA, 22 bp, Artificial Sequence
  chemically synthesized
aatctcttttaattggtatatt

SEQ ID NO: 784714 - DNA, 22 bp, Artificial Sequence
  chemically synthesized
aatgcaaatggtctaaatatac

SEQ ID NO: 784715 - DNA, 22 bp, Artificial Sequence
  chemically synthesized
aaatgcaaatggtctaaatata

SEQ ID NO: 784716 - DNA, 22 bp, Artificial Sequence
  chemically synthesized
ttttaattggtatatttagacc

SEQ ID NO: 784717 - DNA, 22 bp, Artificial Sequence
  chemically synthesized
ttaattggtatatttagaccat

SEQ ID NO: 784718 - DNA, 22 bp, Artificial Sequence
  chemically synthesized
ccttaaatgcaaatggtctaaa

SEQ ID NO: 784719 - DNA, 22 bp, Artificial Sequence
  chemically synthesized
taattggtatatttagaccatt

SEQ ID NO: 784720 - DNA, 22 bp, Artificial Sequence
  chemically synthesized
aattggtatatttagaccattt

SEQ ID NO: 784721 - DNA, 22 bp, Artificial Sequence
  chemically synthesized
attggtatatttagaccatttg

SEQ ID NO: 784722 - DNA, 22 bp, Artificial Sequence
  chemically synthesized
gtatatttagaccatttgcatt

SEQ ID NO: 784723 - DNA, 22 bp, Artificial Sequence
  chemically synthesized
agaccatttgcatttaaggtaa

SEQ ID NO: 784724 - DNA, 22 bp, Artificial Sequence
  chemically synthesized
atatatccataattaccttaaa

SEQ ID NO: 784725 - DNA, 22 bp, Artificial Sequence
  chemically synthesized
gaccatttgcatttaaggtaat

SEQ ID NO: 784726 - DNA, 22 bp, Artificial Sequence
  chemically synthesized
aagccctaatatatccataatt

SEQ ID NO: 784727 - DNA, 22 bp, Artificial Sequence
  chemically synthesized
gcatttaaggtaattatggata

SEQ ID NO: 784728 - DNA, 22 bp, Artificial Sequence
  chemically synthesized
catttaaggtaattatggatat

SEQ ID NO: 784729 - DNA, 22 bp, Artificial Sequence
  chemically synthesized
aaggtaattatggatatattag

SEQ ID NO: 784730 - DNA, 22 bp, Artificial Sequence
  chemically synthesized
aggtaattatggatatattagg

SEQ ID NO: 784731 - DNA, 22 bp, Artificial Sequence
  chemically synthesized
tggatatattagggcttcaatc

SEQ ID NO: 784732 - DNA, 22 bp, Artificial Sequence
  chemically synthesized
gggcttcaatctgccaccttat

SEQ ID NO: 784733 - DNA, 22 bp, Artificial Sequence
  chemically synthesized
caatctgccaccttatttggtt

SEQ ID NO: 784734 - DNA, 22 bp, Artificial Sequence
  chemically synthesized
aatctgccaccttatttggttt

SEQ ID NO: 784735 - DNA, 22 bp, Artificial Sequence
  chemically synthesized
ccaccttatttggtttctgttt

SEQ ID NO: 784736 - DNA, 22 bp, Artificial Sequence
  chemically synthesized
atttggtttctgtttgttttct

SEQ ID NO: 784737 - DNA, 22 bp, Artificial Sequence
  chemically synthesized
tttggtttctgtttgttttctt

SEQ ID NO: 784738 - DNA, 22 bp, Artificial Sequence
  chemically synthesized
ggtttctgtttgttttctttat

SEQ ID NO: 784739 - DNA, 22 bp, Artificial Sequence
  chemically synthesized
gtttctgtttgttttctttatt

SEQ ID NO: 784740 - DNA, 22 bp, Artificial Sequence
  chemically synthesized
ctgtttgttttctttatttctc

SEQ ID NO: 784741 - DNA, 22 bp, Artificial Sequence
  chemically synthesized
tgtttgttttctttatttctca

SEQ ID NO: 784742 - DNA, 22 bp, Artificial Sequence
  chemically synthesized
tttgttttctttatttctcatt

SEQ ID NO: 784743 - DNA, 22 bp, Artificial Sequence
  chemically synthesized
gttttctttatttctcattctt

SEQ ID NO: 784744 - DNA, 22 bp, Artificial Sequence
  chemically synthesized
ttttctttatttctcattcttc

SEQ ID NO: 784745 - DNA, 22 bp, Artificial Sequence
  chemically synthesized
tctttatttctcattcttctct

SEQ ID NO: 784746 - DNA, 22 bp, Artificial Sequence
  chemically synthesized
ctttatttctcattcttctctt

SEQ ID NO: 784747 - DNA, 22 bp, Artificial Sequence
  chemically synthesized
tttatttctcattcttctcttt

SEQ ID NO: 784748 - DNA, 22 bp, Artificial Sequence
  chemically synthesized
tatttctcattcttctctttct

SEQ ID NO: 784749 - DNA, 22 bp, Artificial Sequence
  chemically synthesized
atttctcattcttctctttctt

SEQ ID NO: 784750 - DNA, 22 bp, Artificial Sequence
  chemically synthesized
tttctcattcttctctttcttt

SEQ ID NO: 784751 - DNA, 22 bp, Artificial Sequence
  chemically synthesized
ctcattcttctctttctttttt

SEQ ID NO: 784752 - DNA, 22 bp, Artificial Sequence
  chemically synthesized
tcattcttctctttcttttttc

SEQ ID NO: 784753 - DNA, 22 bp, Artificial Sequence
  chemically synthesized
attcttctctttcttttttctt

SEQ ID NO: 784754 - DNA, 22 bp, Artificial Sequence
  chemically synthesized
ttctctttcttttttcttacct

SEQ ID NO: 784755 - DNA, 22 bp, Artificial Sequence
  chemically synthesized
ctctttcttttttcttaccttc

SEQ ID NO: 784756 - DNA, 22 bp, Artificial Sequence
  chemically synthesized
tctttcttttttcttaccttct

SEQ ID NO: 784757 - DNA, 22 bp, Artificial Sequence
  chemically synthesized
aaataacccacaagaaggtaag

SEQ ID NO: 784758 - DNA, 22 bp, Artificial Sequence
  chemically synthesized
tttcttttttcttaccttcttg

SEQ ID NO: 784759 - DNA, 22 bp, Artificial Sequence
  chemically synthesized
tcttttttcttaccttcttgtg

SEQ ID NO: 784760 - DNA, 22 bp, Artificial Sequence
  chemically synthesized
cttttttcttaccttcttgtgg

SEQ ID NO: 784761 - DNA, 22 bp, Artificial Sequence
  chemically synthesized
ttttttcttaccttcttgtggg

SEQ ID NO: 784762 - DNA, 22 bp, Artificial Sequence
  chemically synthesized
ttttcttaccttcttgtgggtt

SEQ ID NO: 784763 - DNA, 22 bp, Artificial Sequence
  chemically synthesized
tttcttaccttcttgtgggtta

SEQ ID NO: 784764 - DNA, 22 bp, Artificial Sequence
  chemically synthesized
ttcttaccttcttgtgggttat

SEQ ID NO: 784765 - DNA, 22 bp, Artificial Sequence
  chemically synthesized
agaaatgttcaaataacccaca

SEQ ID NO: 784766 - DNA, 22 bp, Artificial Sequence
  chemically synthesized
tcttaccttcttgtgggttatt

SEQ ID NO: 784767 - DNA, 22 bp, Artificial Sequence
  chemically synthesized
aagaaatgttcaaataacccac

SEQ ID NO: 784768 - DNA, 22 bp, Artificial Sequence
  chemically synthesized
cttaccttcttgtgggttattt

SEQ ID NO: 784769 - DNA, 22 bp, Artificial Sequence
  chemically synthesized
ttaccttcttgtgggttatttg

SEQ ID NO: 784770 - DNA, 22 bp, Artificial Sequence
  chemically synthesized
accttcttgtgggttatttgaa

SEQ ID NO: 784771 - DNA, 22 bp, Artificial Sequence
  chemically synthesized
ccttcttgtgggttatttgaac

SEQ ID NO: 784772 - DNA, 22 bp, Artificial Sequence
  chemically synthesized
cttgtgggttatttgaacattt

SEQ ID NO: 784773 - DNA, 22 bp, Artificial Sequence
  chemically synthesized
ttgtgggttatttgaacatttc

SEQ ID NO: 784774 - DNA, 22 bp, Artificial Sequence
  chemically synthesized
atggaatcttaagaaatgttca

SEQ ID NO: 784775 - DNA, 22 bp, Artificial Sequence
  chemically synthesized
gatggaatcttaagaaatgttc

SEQ ID NO: 784776 - DNA, 22 bp, Artificial Sequence
  chemically synthesized
gtgggttatttgaacatttctt

SEQ ID NO: 784777 - DNA, 22 bp, Artificial Sequence
  chemically synthesized
tgatggaatcttaagaaatgtt

SEQ ID NO: 784778 - DNA, 22 bp, Artificial Sequence
  chemically synthesized
tgggttatttgaacatttctta

SEQ ID NO: 784779 - DNA, 22 bp, Artificial Sequence
  chemically synthesized
tttgaacatttcttaagattcc

SEQ ID NO: 784780 - DNA, 22 bp, Artificial Sequence
  chemically synthesized
gaacatttcttaagattccatc

SEQ ID NO: 784781 - DNA, 22 bp, Artificial Sequence
  chemically synthesized
aacatttcttaagattccatca

SEQ ID NO: 784782 - DNA, 22 bp, Artificial Sequence
  chemically synthesized
cttaagattccatcaaaattta

SEQ ID NO: 784783 - DNA, 22 bp, Artificial Sequence
  chemically synthesized
ttaagattccatcaaaatttat

SEQ ID NO: 784784 - DNA, 22 bp, Artificial Sequence
  chemically synthesized
aagattccatcaaaatttattt

SEQ ID NO: 784785 - DNA, 22 bp, Artificial Sequence
  chemically synthesized
agaaaatacaacaaataaattt

SEQ ID NO: 784786 - DNA, 22 bp, Artificial Sequence
  chemically synthesized
agattccatcaaaatttatttg

SEQ ID NO: 784787 - DNA, 22 bp, Artificial Sequence
  chemically synthesized
catcaaaatttatttgttgtat

SEQ ID NO: 784788 - DNA, 22 bp, Artificial Sequence
  chemically synthesized
tacaaagtgatacgttaagaaa

SEQ ID NO: 784789 - DNA, 22 bp, Artificial Sequence
  chemically synthesized
atttgttgtattttcttaacgt

SEQ ID NO: 784790 - DNA, 22 bp, Artificial Sequence
  chemically synthesized
tttgttgtattttcttaacgta

SEQ ID NO: 784791 - DNA, 22 bp, Artificial Sequence
  chemically synthesized
gttgtattttcttaacgtatca

SEQ ID NO: 784792 - DNA, 22 bp, Artificial Sequence
  chemically synthesized
ttgtattttcttaacgtatcac

SEQ ID NO: 784793 - DNA, 22 bp, Artificial Sequence
  chemically synthesized
aaaaactatacaaagtgatacg

SEQ ID NO: 784794 - DNA, 22 bp, Artificial Sequence
  chemically synthesized
tattttcttaacgtatcacttt

SEQ ID NO: 784795 - DNA, 22 bp, Artificial Sequence
  chemically synthesized
tcttaacgtatcactttgtata

SEQ ID NO: 784796 - DNA, 22 bp, Artificial Sequence
  chemically synthesized
cttaacgtatcactttgtatag

SEQ ID NO: 784797 - DNA, 22 bp, Artificial Sequence
  chemically synthesized
ttaacgtatcactttgtatagt

SEQ ID NO: 784798 - DNA, 22 bp, Artificial Sequence
  chemically synthesized
aacgtatcactttgtatagttt

SEQ ID NO: 784799 - DNA, 22 bp, Artificial Sequence
  chemically synthesized
acgtatcactttgtatagtttt

SEQ ID NO: 784800 - DNA, 22 bp, Artificial Sequence
  chemically synthesized
gaaagaccactaaaaaactata

SEQ ID NO: 784801 - DNA, 22 bp, Artificial Sequence
  chemically synthesized
tgtatagttttttagtggtctt

SEQ ID NO: 784802 - DNA, 22 bp, Artificial Sequence
  chemically synthesized
gtatagttttttagtggtcttt

SEQ ID NO: 784803 - DNA, 22 bp, Artificial Sequence
  chemically synthesized
tatagttttttagtggtctttc

SEQ ID NO: 784804 - DNA, 22 bp, Artificial Sequence
  chemically synthesized
atgcgtatcgtaatgcctggaa

SEQ ID NO: 784805 - DNA, 22 bp, Artificial Sequence
  chemically synthesized
tttagtggtctttccaggcatt

SEQ ID NO: 784806 - DNA, 22 bp, Artificial Sequence
  chemically synthesized
ttagtggtctttccaggcatta

SEQ ID NO: 784807 - DNA, 22 bp, Artificial Sequence
  chemically synthesized
tagtggtctttccaggcattac

SEQ ID NO: 784808 - DNA, 22 bp, Artificial Sequence
  chemically synthesized
agtggtctttccaggcattacg

SEQ ID NO: 784809 - DNA, 22 bp, Artificial Sequence
  chemically synthesized
gtggtctttccaggcattacga

SEQ ID NO: 784810 - DNA, 22 bp, Artificial Sequence
  chemically synthesized
caatgttaatgcgtatcgtaat

SEQ ID NO: 784811 - DNA, 22 bp, Artificial Sequence
  chemically synthesized
tccaggcattacgatacgcatt

SEQ ID NO: 784812 - DNA, 22 bp, Artificial Sequence
  chemically synthesized
ccaggcattacgatacgcatta

SEQ ID NO: 784813 - DNA, 22 bp, Artificial Sequence
  chemically synthesized
caggcattacgatacgcattaa

SEQ ID NO: 784814 - DNA, 22 bp, Artificial Sequence
  chemically synthesized
cagtagattgcaatgttaatgc

SEQ ID NO: 784815 - DNA, 22 bp, Artificial Sequence
  chemically synthesized
cgatacgcattaacattgcaat

SEQ ID NO: 784816 - DNA, 22 bp, Artificial Sequence
  chemically synthesized
aagtcaattccagtagattgca

SEQ ID NO: 784817 - DNA, 22 bp, Artificial Sequence
  chemically synthesized
acattgcaatctactggaattg

SEQ ID NO: 784818 - DNA, 22 bp, Artificial Sequence
  chemically synthesized
cacgtcacctgaagtcaattcc

SEQ ID NO: 784819 - DNA, 22 bp, Artificial Sequence
  chemically synthesized
tacacgtcacctgaagtcaatt

SEQ ID NO: 784820 - DNA, 22 bp, Artificial Sequence
  chemically synthesized
caatctactggaattgacttca

SEQ ID NO: 784821 - DNA, 22 bp, Artificial Sequence
  chemically synthesized
ctacacgtcacctgaagtcaat

SEQ ID NO: 784822 - DNA, 22 bp, Artificial Sequence
  chemically synthesized
ctggaattgacttcaggtgacg

SEQ ID NO: 784823 - DNA, 22 bp, Artificial Sequence
  chemically synthesized
gaattgacttcaggtgacgtgt

SEQ ID NO: 784824 - DNA, 22 bp, Artificial Sequence
  chemically synthesized
acttcaggtgacgtgtagaagg

SEQ ID NO: 784825 - DNA, 22 bp, Artificial Sequence
  chemically synthesized
agtggaagtaagagtccttcta

SEQ ID NO: 784826 - DNA, 22 bp, Artificial Sequence
  chemically synthesized
caggtgacgtgtagaaggactc

SEQ ID NO: 784827 - DNA, 22 bp, Artificial Sequence
  chemically synthesized
aggtgacgtgtagaaggactct

SEQ ID NO: 784828 - DNA, 22 bp, Artificial Sequence
  chemically synthesized
aaagaagacatacctaagtgga

SEQ ID NO: 784829 - DNA, 22 bp, Artificial Sequence
  chemically synthesized
aaaagaagacatacctaagtgg

SEQ ID NO: 784830 - DNA, 22 bp, Artificial Sequence
  chemically synthesized
taaaagaagacatacctaagtg

SEQ ID NO: 784831 - DNA, 22 bp, Artificial Sequence
  chemically synthesized
ttacttccacttaggtatgtct

SEQ ID NO: 784832 - DNA, 22 bp, Artificial Sequence
  chemically synthesized
tattttaaaagaagacatacct

SEQ ID NO: 784833 - DNA, 22 bp, Artificial Sequence
  chemically synthesized
acttccacttaggtatgtcttc

SEQ ID NO: 784834 - DNA, 22 bp, Artificial Sequence
  chemically synthesized
cttccacttaggtatgtcttct

SEQ ID NO: 784835 - DNA, 22 bp, Artificial Sequence
  chemically synthesized
ccacttaggtatgtcttctttt

SEQ ID NO: 784836 - DNA, 22 bp, Artificial Sequence
  chemically synthesized
cacttaggtatgtcttctttta

SEQ ID NO: 784837 - DNA, 22 bp, Artificial Sequence
  chemically synthesized
agagttatattttaaaagaaga

SEQ ID NO: 784838 - DNA, 22 bp, Artificial Sequence
  chemically synthesized
aagagttatattttaaaagaag

SEQ ID NO: 784839 - DNA, 22 bp, Artificial Sequence
  chemically synthesized
aggtatgtcttcttttaaaata

SEQ ID NO: 784840 - DNA, 22 bp, Artificial Sequence
  chemically synthesized
ggtatgtcttcttttaaaatat

SEQ ID NO: 784841 - DNA, 22 bp, Artificial Sequence
  chemically synthesized
cttttaaaatataactcttaag

SEQ ID NO: 784842 - DNA, 22 bp, Artificial Sequence
  chemically synthesized
ttttaaaatataactcttaagt

SEQ ID NO: 784843 - DNA, 22 bp, Artificial Sequence
  chemically synthesized
ttaaaatataactcttaagtat

SEQ ID NO: 784844 - DNA, 22 bp, Artificial Sequence
  chemically synthesized
taaaatataactcttaagtatt

SEQ ID NO: 784845 - DNA, 22 bp, Artificial Sequence
  chemically synthesized
aaaatataactcttaagtattt

SEQ ID NO: 784846 - DNA, 22 bp, Artificial Sequence
  chemically synthesized
aaatataactcttaagtatttt

SEQ ID NO: 784847 - DNA, 22 bp, Artificial Sequence
  chemically synthesized
aatgtatgtagagaaaatactt

SEQ ID NO: 784848 - DNA, 22 bp, Artificial Sequence
  chemically synthesized
tcaatgtatgtagagaaaatac

SEQ ID NO: 784849 - DNA, 22 bp, Artificial Sequence
  chemically synthesized
ttaagtattttctctacataca

SEQ ID NO: 784850 - DNA, 22 bp, Artificial Sequence
  chemically synthesized
atgtggttctcaatgtatgtag

SEQ ID NO: 784851 - DNA, 22 bp, Artificial Sequence
  chemically synthesized
aagtattttctctacatacatt

SEQ ID NO: 784852 - DNA, 22 bp, Artificial Sequence
  chemically synthesized
agtattttctctacatacattg

SEQ ID NO: 784853 - DNA, 22 bp, Artificial Sequence
  chemically synthesized
tctctacatacattgagaacca

SEQ ID NO: 784854 - DNA, 22 bp, Artificial Sequence
  chemically synthesized
ctctacatacattgagaaccac

SEQ ID NO: 784855 - DNA, 22 bp, Artificial Sequence
  chemically synthesized
acaccacctgatgtggttctca

SEQ ID NO: 784856 - DNA, 22 bp, Artificial Sequence
  chemically synthesized
tctacatacattgagaaccaca

SEQ ID NO: 784857 - DNA, 22 bp, Artificial Sequence
  chemically synthesized
aacaccacctgatgtggttctc

SEQ ID NO: 784858 - DNA, 22 bp, Artificial Sequence
  chemically synthesized
taacaccacctgatgtggttct

SEQ ID NO: 784859 - DNA, 22 bp, Artificial Sequence
  chemically synthesized
tacatacattgagaaccacatc

SEQ ID NO: 784860 - DNA, 22 bp, Artificial Sequence
  chemically synthesized
catacattgagaaccacatcag

SEQ ID NO: 784861 - DNA, 22 bp, Artificial Sequence
  chemically synthesized
agaaccacatcaggtggtgtta

SEQ ID NO: 784862 - DNA, 22 bp, Artificial Sequence
  chemically synthesized
aagtgaaaactttaacaccacc

SEQ ID NO: 784863 - DNA, 22 bp, Artificial Sequence
  chemically synthesized
gaagtgaaaactttaacaccac

SEQ ID NO: 784864 - DNA, 22 bp, Artificial Sequence
  chemically synthesized
ccataagtttgaagtgaaaact

SEQ ID NO: 784865 - DNA, 22 bp, Artificial Sequence
  chemically synthesized
accataagtttgaagtgaaaac

SEQ ID NO: 784866 - DNA, 22 bp, Artificial Sequence
  chemically synthesized
tttaccataagtttgaagtgaa

SEQ ID NO: 784867 - DNA, 22 bp, Artificial Sequence
  chemically synthesized
tcctatttaccataagtttgaa

SEQ ID NO: 784868 - DNA, 22 bp, Artificial Sequence
  chemically synthesized
aagttttcacttcaaacttatg

SEQ ID NO: 784869 - DNA, 22 bp, Artificial Sequence
  chemically synthesized
tcacttcaaacttatggtaaat

SEQ ID NO: 784870 - DNA, 22 bp, Artificial Sequence
  chemically synthesized
cacttcaaacttatggtaaata

SEQ ID NO: 784871 - DNA, 22 bp, Artificial Sequence
  chemically synthesized
acttcaaacttatggtaaatag

SEQ ID NO: 784872 - DNA, 22 bp, Artificial Sequence
  chemically synthesized
caaacttatggtaaataggata

SEQ ID NO: 784873 - DNA, 22 bp, Artificial Sequence
  chemically synthesized
aaacttatggtaaataggatag

SEQ ID NO: 784874 - DNA, 22 bp, Artificial Sequence
  chemically synthesized
atggtaaataggatagtctatt

SEQ ID NO: 784875 - DNA, 22 bp, Artificial Sequence
  chemically synthesized
tggtaaataggatagtctatta

SEQ ID NO: 784876 - DNA, 22 bp, Artificial Sequence
  chemically synthesized
ttattttactctcatttttacc

SEQ ID NO: 784877 - DNA, 22 bp, Artificial Sequence
  chemically synthesized
ttttactctcatttttacccat

SEQ ID NO: 784878 - DNA, 22 bp, Artificial Sequence
  chemically synthesized
tactctcatttttacccattct

SEQ ID NO: 784879 - DNA, 22 bp, Artificial Sequence
  chemically synthesized
actctcatttttacccattcta

SEQ ID NO: 784880 - DNA, 22 bp, Artificial Sequence
  chemically synthesized
ctctcatttttacccattctac

SEQ ID NO: 784881 - DNA, 22 bp, Artificial Sequence
  chemically synthesized
agaaagaaaatagtagaatggg

SEQ ID NO: 784882 - DNA, 22 bp, Artificial Sequence
  chemically synthesized
cagaaagaaaatagtagaatgg

SEQ ID NO: 784883 - DNA, 22 bp, Artificial Sequence
  chemically synthesized
tcatttttacccattctactat

SEQ ID NO: 784884 - DNA, 22 bp, Artificial Sequence
  chemically synthesized
atttttacccattctactattt

SEQ ID NO: 784885 - DNA, 22 bp, Artificial Sequence
  chemically synthesized
acatttcagaaagaaaatagta

SEQ ID NO: 784886 - DNA, 22 bp, Artificial Sequence
  chemically synthesized
gacatttcagaaagaaaatagt

SEQ ID NO: 784887 - DNA, 22 bp, Artificial Sequence
  chemically synthesized
ttacccattctactattttctt

SEQ ID NO: 784888 - DNA, 22 bp, Artificial Sequence
  chemically synthesized
tacccattctactattttcttt

SEQ ID NO: 784889 - DNA, 22 bp, Artificial Sequence
  chemically synthesized
acccattctactattttctttc

SEQ ID NO: 784890 - DNA, 22 bp, Artificial Sequence
  chemically synthesized
cccattctactattttctttct

SEQ ID NO: 784891 - DNA, 22 bp, Artificial Sequence
  chemically synthesized
tactattttctttctgaaatgt

SEQ ID NO: 784892 - DNA, 22 bp, Artificial Sequence
  chemically synthesized
taacgaagtcttgacatttcag

SEQ ID NO: 784893 - DNA, 22 bp, Artificial Sequence
  chemically synthesized
ctattttctttctgaaatgtca

SEQ ID NO: 784894 - DNA, 22 bp, Artificial Sequence
  chemically synthesized
ttttctttctgaaatgtcaaga

SEQ ID NO: 784895 - DNA, 22 bp, Artificial Sequence
  chemically synthesized
tctttctgaaatgtcaagactt

SEQ ID NO: 784896 - DNA, 22 bp, Artificial Sequence
  chemically synthesized
ctttctgaaatgtcaagacttc

SEQ ID NO: 784897 - DNA, 22 bp, Artificial Sequence
  chemically synthesized
tttctgaaatgtcaagacttcg

SEQ ID NO: 784898 - DNA, 22 bp, Artificial Sequence
  chemically synthesized
tctgaaatgtcaagacttcgtt

SEQ ID NO: 784899 - DNA, 22 bp, Artificial Sequence
  chemically synthesized
ctgaaatgtcaagacttcgtta

SEQ ID NO: 784900 - DNA, 22 bp, Artificial Sequence
  chemically synthesized
tgaaatgtcaagacttcgttat

SEQ ID NO: 784901 - DNA, 22 bp, Artificial Sequence
  chemically synthesized
aaatgtcaagacttcgttataa

SEQ ID NO: 784902 - DNA, 22 bp, Artificial Sequence
  chemically synthesized
aacagaaaggaaattataacga

SEQ ID NO: 784903 - DNA, 22 bp, Artificial Sequence
  chemically synthesized
taaacagaaaggaaattataac

SEQ ID NO: 784904 - DNA, 22 bp, Artificial Sequence
  chemically synthesized
tctaaacagaaaggaaattata

SEQ ID NO: 784905 - DNA, 22 bp, Artificial Sequence
  chemically synthesized
cgttataatttcctttctgttt

SEQ ID NO: 784906 - DNA, 22 bp, Artificial Sequence
  chemically synthesized
gttataatttcctttctgttta

SEQ ID NO: 784907 - DNA, 22 bp, Artificial Sequence
  chemically synthesized
taatttcctttctgtttagaga

SEQ ID NO: 784908 - DNA, 22 bp, Artificial Sequence
  chemically synthesized
cctttctgtttagagaatgtct

SEQ ID NO: 784909 - DNA, 22 bp, Artificial Sequence
  chemically synthesized
ctttctgtttagagaatgtctt

SEQ ID NO: 784910 - DNA, 22 bp, Artificial Sequence
  chemically synthesized
aagaatgacaaaaagacattct

SEQ ID NO: 784911 - DNA, 22 bp, Artificial Sequence
  chemically synthesized
aaagaatgacaaaaagacattc

SEQ ID NO: 784912 - DNA, 22 bp, Artificial Sequence
  chemically synthesized
tctgtttagagaatgtcttttt

SEQ ID NO: 784913 - DNA, 22 bp, Artificial Sequence
  chemically synthesized
ttaaagaatgacaaaaagacat

SEQ ID NO: 784914 - DNA, 22 bp, Artificial Sequence
  chemically synthesized
ctgtttagagaatgtctttttg

SEQ ID NO: 784915 - DNA, 22 bp, Artificial Sequence
  chemically synthesized
tgtttagagaatgtctttttgt

SEQ ID NO: 784916 - DNA, 22 bp, Artificial Sequence
  chemically synthesized
ctcttaaagaatgacaaaaaga

SEQ ID NO: 784917 - DNA, 22 bp, Artificial Sequence
  chemically synthesized
tttagagaatgtctttttgtca

SEQ ID NO: 784918 - DNA, 22 bp, Artificial Sequence
  chemically synthesized
agagaatgtctttttgtcattc

SEQ ID NO: 784919 - DNA, 22 bp, Artificial Sequence
  chemically synthesized
gagaatgtctttttgtcattct

SEQ ID NO: 784920 - DNA, 22 bp, Artificial Sequence
  chemically synthesized
gcaaatctgctcttaaagaatg

SEQ ID NO: 784921 - DNA, 22 bp, Artificial Sequence
  chemically synthesized
ctagcaaatctgctcttaaaga

SEQ ID NO: 784922 - DNA, 22 bp, Artificial Sequence
  chemically synthesized
gctagcaaatctgctcttaaag

SEQ ID NO: 784923 - DNA, 22 bp, Artificial Sequence
  chemically synthesized
ttgctagcaaatctgctcttaa

SEQ ID NO: 784924 - DNA, 22 bp, Artificial Sequence
  chemically synthesized
tttgtcattctttaagagcaga

SEQ ID NO: 784925 - DNA, 22 bp, Artificial Sequence
  chemically synthesized
cttgctagcaaatctgctctta

SEQ ID NO: 784926 - DNA, 22 bp, Artificial Sequence
  chemically synthesized
ttgtcattctttaagagcagat

SEQ ID NO: 784927 - DNA, 22 bp, Artificial Sequence
  chemically synthesized
tgtcattctttaagagcagatt

SEQ ID NO: 784928 - DNA, 22 bp, Artificial Sequence
  chemically synthesized
gtcattctttaagagcagattt

SEQ ID NO: 784929 - DNA, 22 bp, Artificial Sequence
  chemically synthesized
tcattctttaagagcagatttg

SEQ ID NO: 784930 - DNA, 22 bp, Artificial Sequence
  chemically synthesized
tttaagagcagatttgctagca

SEQ ID NO: 784931 - DNA, 22 bp, Artificial Sequence
  chemically synthesized
taagagcagatttgctagcaag

SEQ ID NO: 784932 - DNA, 22 bp, Artificial Sequence
  chemically synthesized
aagagcagatttgctagcaaga

SEQ ID NO: 784933 - DNA, 22 bp, Artificial Sequence
  chemically synthesized
agagcagatttgctagcaagaa

SEQ ID NO: 784934 - DNA, 22 bp, Artificial Sequence
  chemically synthesized
aggaaaacaaagaatttcttgc

SEQ ID NO: 784935 - DNA, 22 bp, Artificial Sequence
  chemically synthesized
agattaaggaaaacaaagaatt

SEQ ID NO: 784936 - DNA, 22 bp, Artificial Sequence
  chemically synthesized
gctagcaagaaattctttgttt

SEQ ID NO: 784937 - DNA, 22 bp, Artificial Sequence
  chemically synthesized
tcagattaaggaaaacaaagaa

SEQ ID NO: 784938 - DNA, 22 bp, Artificial Sequence
  chemically synthesized
ctagcaagaaattctttgtttt

SEQ ID NO: 784939 - DNA, 22 bp, Artificial Sequence
  chemically synthesized
gcaagaaattctttgttttcct

SEQ ID NO: 784940 - DNA, 22 bp, Artificial Sequence
  chemically synthesized
tttgttttccttaatctgagaa

SEQ ID NO: 784941 - DNA, 22 bp, Artificial Sequence
  chemically synthesized
tgttttccttaatctgagaatg

SEQ ID NO: 784942 - DNA, 22 bp, Artificial Sequence
  chemically synthesized
aagggaaagagacattctcaga

SEQ ID NO: 784943 - DNA, 22 bp, Artificial Sequence
  chemically synthesized
gttttccttaatctgagaatgt

SEQ ID NO: 784944 - DNA, 22 bp, Artificial Sequence
  chemically synthesized
ttttccttaatctgagaatgtc

SEQ ID NO: 784945 - DNA, 22 bp, Artificial Sequence
  chemically synthesized
tccttaatctgagaatgtctct

SEQ ID NO: 784946 - DNA, 22 bp, Artificial Sequence
  chemically synthesized
ccttaatctgagaatgtctctt

SEQ ID NO: 784947 - DNA, 22 bp, Artificial Sequence
  chemically synthesized
cttaatctgagaatgtctcttt

SEQ ID NO: 784948 - DNA, 22 bp, Artificial Sequence
  chemically synthesized
aggaattaaagggaaagagaca

SEQ ID NO: 784949 - DNA, 22 bp, Artificial Sequence
  chemically synthesized
aatctgagaatgtctctttccc

SEQ ID NO: 784950 - DNA, 22 bp, Artificial Sequence
  chemically synthesized
atctgagaatgtctctttccct

SEQ ID NO: 784951 - DNA, 22 bp, Artificial Sequence
  chemically synthesized
ctaaggaattaaagggaaagag

SEQ ID NO: 784952 - DNA, 22 bp, Artificial Sequence
  chemically synthesized
cctaaggaattaaagggaaaga

SEQ ID NO: 784953 - DNA, 22 bp, Artificial Sequence
  chemically synthesized
tcctaaggaattaaagggaaag

SEQ ID NO: 784954 - DNA, 22 bp, Artificial Sequence
  chemically synthesized
agaatgtctctttccctttaat

SEQ ID NO: 784955 - DNA, 22 bp, Artificial Sequence
  chemically synthesized
aggttttcctaaggaattaaag

SEQ ID NO: 784956 - DNA, 22 bp, Artificial Sequence
  chemically synthesized
ctaaggttttcctaaggaatta

SEQ ID NO: 784957 - DNA, 22 bp, Artificial Sequence
  chemically synthesized
tttccctttaattccttaggaa

SEQ ID NO: 784958 - DNA, 22 bp, Artificial Sequence
  chemically synthesized
tccctttaattccttaggaaaa

SEQ ID NO: 784959 - DNA, 22 bp, Artificial Sequence
  chemically synthesized
ccctttaattccttaggaaaac

SEQ ID NO: 784960 - DNA, 22 bp, Artificial Sequence
  chemically synthesized
cctttaattccttaggaaaacc

SEQ ID NO: 784961 - DNA, 22 bp, Artificial Sequence
  chemically synthesized
taattccttaggaaaaccttag

SEQ ID NO: 784962 - DNA, 22 bp, Artificial Sequence
  chemically synthesized
aattccttaggaaaaccttagg

SEQ ID NO: 784963 - DNA, 22 bp, Artificial Sequence
  chemically synthesized
attccttaggaaaaccttagga

SEQ ID NO: 784964 - DNA, 22 bp, Artificial Sequence
  chemically synthesized
gataatcagataactcctaagg

SEQ ID NO: 784965 - DNA, 22 bp, Artificial Sequence
  chemically synthesized
agataatcagataactcctaag

SEQ ID NO: 784966 - DNA, 22 bp, Artificial Sequence
  chemically synthesized
cttaggaaaaccttaggagtta

SEQ ID NO: 784967 - DNA, 22 bp, Artificial Sequence
  chemically synthesized
ttagataatcagataactccta

SEQ ID NO: 784968 - DNA, 22 bp, Artificial Sequence
  chemically synthesized
aggaaaaccttaggagttatct

SEQ ID NO: 784969 - DNA, 22 bp, Artificial Sequence
  chemically synthesized
ggaaaaccttaggagttatctg

SEQ ID NO: 784970 - DNA, 22 bp, Artificial Sequence
  chemically synthesized
aggtacagactcttagataatc

SEQ ID NO: 784971 - DNA, 22 bp, Artificial Sequence
  chemically synthesized
aggagttatctgattatctaag

SEQ ID NO: 784972 - DNA, 22 bp, Artificial Sequence
  chemically synthesized
ggagttatctgattatctaaga

SEQ ID NO: 784973 - DNA, 22 bp, Artificial Sequence
  chemically synthesized
tctgattatctaagagtctgta

SEQ ID NO: 784974 - DNA, 22 bp, Artificial Sequence
  chemically synthesized
attatctaagagtctgtacctt

SEQ ID NO: 784975 - DNA, 22 bp, Artificial Sequence
  chemically synthesized
tctaagagtctgtaccttagac

SEQ ID NO: 784976 - DNA, 22 bp, Artificial Sequence
  chemically synthesized
agagtctgtaccttagactttg

SEQ ID NO: 784977 - DNA, 22 bp, Artificial Sequence
  chemically synthesized
caaaatagcataaccaaagtct

SEQ ID NO: 784978 - DNA, 22 bp, Artificial Sequence
  chemically synthesized
taccttagactttggttatgct

SEQ ID NO: 784979 - DNA, 22 bp, Artificial Sequence
  chemically synthesized
agactttggttatgctattttg

SEQ ID NO: 784980 - DNA, 22 bp, Artificial Sequence
  chemically synthesized
gactttggttatgctattttgc

SEQ ID NO: 784981 - DNA, 22 bp, Artificial Sequence
  chemically synthesized
aacgtacagaattgcaaaatag

SEQ ID NO: 784982 - DNA, 22 bp, Artificial Sequence
  chemically synthesized
aaacgtacagaattgcaaaata

SEQ ID NO: 784983 - DNA, 22 bp, Artificial Sequence
  chemically synthesized
taaacgtacagaattgcaaaat

SEQ ID NO: 784984 - DNA, 22 bp, Artificial Sequence
  chemically synthesized
ttaaacgtacagaattgcaaaa

SEQ ID NO: 784985 - DNA, 22 bp, Artificial Sequence
  chemically synthesized
tggttatgctattttgcaattc

SEQ ID NO: 784986 - DNA, 22 bp, Artificial Sequence
  chemically synthesized
ggttatgctattttgcaattct

SEQ ID NO: 784987 - DNA, 22 bp, Artificial Sequence
  chemically synthesized
gttatgctattttgcaattctg

SEQ ID NO: 784988 - DNA, 22 bp, Artificial Sequence
  chemically synthesized
acttttaaacgtacagaattgc

SEQ ID NO: 784989 - DNA, 22 bp, Artificial Sequence
  chemically synthesized
tgctattttgcaattctgtacg

SEQ ID NO: 784990 - DNA, 22 bp, Artificial Sequence
  chemically synthesized
ttttgcaattctgtacgtttaa

SEQ ID NO: 784991 - DNA, 22 bp, Artificial Sequence
  chemically synthesized
cacaaattgacttttaaacgta

SEQ ID NO: 784992 - DNA, 22 bp, Artificial Sequence
  chemically synthesized
tgcaattctgtacgtttaaaag

SEQ ID NO: 784993 - DNA, 22 bp, Artificial Sequence
  chemically synthesized
gcaattctgtacgtttaaaagt

SEQ ID NO: 784994 - DNA, 22 bp, Artificial Sequence
  chemically synthesized
caattctgtacgtttaaaagtc

SEQ ID NO: 784995 - DNA, 22 bp, Artificial Sequence
  chemically synthesized
tgtacgtttaaaagtcaatttg

SEQ ID NO: 784996 - DNA, 22 bp, Artificial Sequence
  chemically synthesized
tacgtttaaaagtcaatttgtg

SEQ ID NO: 784997 - DNA, 22 bp, Artificial Sequence
  chemically synthesized
tgtcaccatcagccctccacaa

SEQ ID NO: 784998 - DNA, 22 bp, Artificial Sequence
  chemically synthesized
gtgtcaccatcagccctccaca

SEQ ID NO: 784999 - DNA, 22 bp, Artificial Sequence
  chemically synthesized
aaaagtcaatttgtggagggct

SEQ ID NO: 785000 - DNA, 22 bp, Artificial Sequence
  chemically synthesized
aaagtcaatttgtggagggctg

SEQ ID NO: 785001 - DNA, 22 bp, Artificial Sequence
  chemically synthesized
gtggagggctgatggtgacaca

SEQ ID NO: 785002 - DNA, 22 bp, Artificial Sequence
  chemically synthesized
tggagggctgatggtgacacaa

SEQ ID NO: 785003 - DNA, 22 bp, Artificial Sequence
  chemically synthesized
gtgaacaagaatcatttgtgtc

SEQ ID NO: 785004 - DNA, 22 bp, Artificial Sequence
  chemically synthesized
atggtgacacaaatgattcttg

SEQ ID NO: 785005 - DNA, 22 bp, Artificial Sequence
  chemically synthesized
gcatctagtgaacaagaatcat

SEQ ID NO: 785006 - DNA, 22 bp, Artificial Sequence
  chemically synthesized
ctggcatctagtgaacaagaat

SEQ ID NO: 785007 - DNA, 22 bp, Artificial Sequence
  chemically synthesized
actggcatctagtgaacaagaa

SEQ ID NO: 785008 - DNA, 22 bp, Artificial Sequence
  chemically synthesized
tactggcatctagtgaacaaga

SEQ ID NO: 785009 - DNA, 22 bp, Artificial Sequence
  chemically synthesized
catgagaaaattttactggcat

SEQ ID NO: 785010 - DNA, 22 bp, Artificial Sequence
  chemically synthesized
ttgttcactagatgccagtaaa

SEQ ID NO: 785011 - DNA, 22 bp, Artificial Sequence
  chemically synthesized
gttcactagatgccagtaaaat

SEQ ID NO: 785012 - DNA, 22 bp, Artificial Sequence
  chemically synthesized
ttcactagatgccagtaaaatt

SEQ ID NO: 785013 - DNA, 22 bp, Artificial Sequence
  chemically synthesized
cgttccatgagaaaattttact

SEQ ID NO: 785014 - DNA, 22 bp, Artificial Sequence
  chemically synthesized
actagatgccagtaaaattttc

SEQ ID NO: 785015 - DNA, 22 bp, Artificial Sequence
  chemically synthesized
ttgcgttccatgagaaaatttt

SEQ ID NO: 785016 - DNA, 22 bp, Artificial Sequence
  chemically synthesized
gatgccagtaaaattttctcat

SEQ ID NO: 785017 - DNA, 22 bp, Artificial Sequence
  chemically synthesized
tagggcaggaatctattgcgtt

SEQ ID NO: 785018 - DNA, 22 bp, Artificial Sequence
  chemically synthesized
tctcatggaacgcaatagattc

SEQ ID NO: 785019 - DNA, 22 bp, Artificial Sequence
  chemically synthesized
actgtagggcaggaatctattg

SEQ ID NO: 785020 - DNA, 22 bp, Artificial Sequence
  chemically synthesized
ctcatggaacgcaatagattcc

SEQ ID NO: 785021 - DNA, 22 bp, Artificial Sequence
  chemically synthesized
tcatggaacgcaatagattcct

SEQ ID NO: 785022 - DNA, 22 bp, Artificial Sequence
  chemically synthesized
atggaacgcaatagattcctgc

SEQ ID NO: 785023 - DNA, 22 bp, Artificial Sequence
  chemically synthesized
atcactaactgtagggcaggaa

SEQ ID NO: 785024 - DNA, 22 bp, Artificial Sequence
  chemically synthesized
ctgccctacagttagtgatcag

SEQ ID NO: 785025 - DNA, 22 bp, Artificial Sequence
  chemically synthesized
taacagatacaatactgatcac

SEQ ID NO: 785026 - DNA, 22 bp, Artificial Sequence
  chemically synthesized
ccctacagttagtgatcagtat

SEQ ID NO: 785027 - DNA, 22 bp, Artificial Sequence
  chemically synthesized
ataacagatacaatactgatca

SEQ ID NO: 785028 - DNA, 22 bp, Artificial Sequence
  chemically synthesized
tataacagatacaatactgatc

SEQ ID NO: 785029 - DNA, 22 bp, Artificial Sequence
  chemically synthesized
cagttagtgatcagtattgtat

SEQ ID NO: 785030 - DNA, 22 bp, Artificial Sequence
  chemically synthesized
gtgatcagtattgtatctgtta

SEQ ID NO: 785031 - DNA, 22 bp, Artificial Sequence
  chemically synthesized
ataggaattttataacagatac

SEQ ID NO: 785032 - DNA, 22 bp, Artificial Sequence
  chemically synthesized
gaatgctgataggaattttata

SEQ ID NO: 785033 - DNA, 22 bp, Artificial Sequence
  chemically synthesized
tagaatgctgataggaatttta

SEQ ID NO: 785034 - DNA, 22 bp, Artificial Sequence
  chemically synthesized
tatctgttataaaattcctatc

SEQ ID NO: 785035 - DNA, 22 bp, Artificial Sequence
  chemically synthesized
ttataaaattcctatcagcatt

SEQ ID NO: 785036 - DNA, 22 bp, Artificial Sequence
  chemically synthesized
taaaattcctatcagcattcta

SEQ ID NO: 785037 - DNA, 22 bp, Artificial Sequence
  chemically synthesized
ctatcagcattctagagtgttt

SEQ ID NO: 785038 - DNA, 22 bp, Artificial Sequence
  chemically synthesized
tcagcattctagagtgtttttt

SEQ ID NO: 785039 - DNA, 22 bp, Artificial Sequence
  chemically synthesized
tagagtgttttttatatatata

SEQ ID NO: 785040 - DNA, 22 bp, Artificial Sequence
  chemically synthesized
tatatatacacatatatatata

SEQ ID NO: 785041 - DNA, 22 bp, Artificial Sequence
  chemically synthesized
atatatatacacatatatatat

SEQ ID NO: 785042 - DNA, 22 bp, Artificial Sequence
  chemically synthesized
gagtgttttttatatatatatg

SEQ ID NO: 785043 - DNA, 22 bp, Artificial Sequence
  chemically synthesized
tatatatatacacatatatata

SEQ ID NO: 785044 - DNA, 22 bp, Artificial Sequence
  chemically synthesized
tttatatatatatgtgtatata

SEQ ID NO: 785045 - DNA, 22 bp, Artificial Sequence
  chemically synthesized
ttatatatatatgtgtatatat

SEQ ID NO: 785046 - DNA, 22 bp, Artificial Sequence
  chemically synthesized
tatatatatatgtgtatatata

SEQ ID NO: 785047 - DNA, 22 bp, Artificial Sequence
  chemically synthesized
atatatatatgtgtatatatat

SEQ ID NO: 785048 - DNA, 22 bp, Artificial Sequence
  chemically synthesized
tatatatatgtgtatatatata

SEQ ID NO: 785049 - DNA, 22 bp, Artificial Sequence
  chemically synthesized
gcatatatatatacgtatatat

SEQ ID NO: 785050 - DNA, 22 bp, Artificial Sequence
  chemically synthesized
aagaattggcatatatatatac

SEQ ID NO: 785051 - DNA, 22 bp, Artificial Sequence
  chemically synthesized
aaaggagagtctgaagaattgg

SEQ ID NO: 785052 - DNA, 22 bp, Artificial Sequence
  chemically synthesized
gttcaaaggagagtctgaagaa

SEQ ID NO: 785053 - DNA, 22 bp, Artificial Sequence
  chemically synthesized
cagttggttcaaaggagagtct

SEQ ID NO: 785054 - DNA, 22 bp, Artificial Sequence
  chemically synthesized
gttacagttggttcaaaggaga

SEQ ID NO: 785055 - DNA, 22 bp, Artificial Sequence
  chemically synthesized
ttcagactctcctttgaaccaa

SEQ ID NO: 785056 - DNA, 22 bp, Artificial Sequence
  chemically synthesized
cagactctcctttgaaccaact

SEQ ID NO: 785057 - DNA, 22 bp, Artificial Sequence
  chemically synthesized
agactctcctttgaaccaactg

SEQ ID NO: 785058 - DNA, 22 bp, Artificial Sequence
  chemically synthesized
gtaagatgttagttacagttgg

SEQ ID NO: 785059 - DNA, 22 bp, Artificial Sequence
  chemically synthesized
tcctttgaaccaactgtaacta

SEQ ID NO: 785060 - DNA, 22 bp, Artificial Sequence
  chemically synthesized
ctttgaaccaactgtaactaac

SEQ ID NO: 785061 - DNA, 22 bp, Artificial Sequence
  chemically synthesized
tgaaccaactgtaactaacatc

SEQ ID NO: 785062 - DNA, 22 bp, Artificial Sequence
  chemically synthesized
gaaccaactgtaactaacatct

SEQ ID NO: 785063 - DNA, 22 bp, Artificial Sequence
  chemically synthesized
aaccaactgtaactaacatctt

SEQ ID NO: 785064 - DNA, 22 bp, Artificial Sequence
  chemically synthesized
atgaaggaattagtaagatgtt

SEQ ID NO: 785065 - DNA, 22 bp, Artificial Sequence
  chemically synthesized
actgatgaaggaattagtaaga

SEQ ID NO: 785066 - DNA, 22 bp, Artificial Sequence
  chemically synthesized
taactaacatcttactaattcc

SEQ ID NO: 785067 - DNA, 22 bp, Artificial Sequence
  chemically synthesized
gatcattaactgatgaaggaat

SEQ ID NO: 785068 - DNA, 22 bp, Artificial Sequence
  chemically synthesized
acatcttactaattccttcatc

SEQ ID NO: 785069 - DNA, 22 bp, Artificial Sequence
  chemically synthesized
ttagatcattaactgatgaagg

SEQ ID NO: 785070 - DNA, 22 bp, Artificial Sequence
  chemically synthesized
attagatcattaactgatgaag

SEQ ID NO: 785071 - DNA, 22 bp, Artificial Sequence
  chemically synthesized
tattagatcattaactgatgaa

SEQ ID NO: 785072 - DNA, 22 bp, Artificial Sequence
  chemically synthesized
actaattccttcatcagttaat

SEQ ID NO: 785073 - DNA, 22 bp, Artificial Sequence
  chemically synthesized
ctaattccttcatcagttaatg

SEQ ID NO: 785074 - DNA, 22 bp, Artificial Sequence
  chemically synthesized
attccttcatcagttaatgatc

SEQ ID NO: 785075 - DNA, 22 bp, Artificial Sequence
  chemically synthesized
cttcatcagttaatgatctaat

SEQ ID NO: 785076 - DNA, 22 bp, Artificial Sequence
  chemically synthesized
catcagttaatgatctaataaa

SEQ ID NO: 785077 - DNA, 22 bp, Artificial Sequence
  chemically synthesized
atcagttaatgatctaataaaa

SEQ ID NO: 785078 - DNA, 22 bp, Artificial Sequence
  chemically synthesized
atgatctaataaaatgttttac

SEQ ID NO: 785079 - DNA, 22 bp, Artificial Sequence
  chemically synthesized
ataaaatgttttacacatattc

SEQ ID NO: 785080 - DNA, 22 bp, Artificial Sequence
  chemically synthesized
tacacatattcattttatattt

SEQ ID NO: 785081 - DNA, 22 bp, Artificial Sequence
  chemically synthesized
tgagtcccataaaaatataaaa

SEQ ID NO: 785082 - DNA, 22 bp, Artificial Sequence
  chemically synthesized
acacatattcattttatatttt

SEQ ID NO: 785083 - DNA, 22 bp, Artificial Sequence
  chemically synthesized
cacatattcattttatattttt

SEQ ID NO: 785084 - DNA, 22 bp, Artificial Sequence
  chemically synthesized
attttatatttttatgggactc

SEQ ID NO: 785085 - DNA, 22 bp, Artificial Sequence
  chemically synthesized
aagagacaaaattgtgagtccc

SEQ ID NO: 785086 - DNA, 22 bp, Artificial Sequence
  chemically synthesized
tatatttttatgggactcacaa

SEQ ID NO: 785087 - DNA, 22 bp, Artificial Sequence
  chemically synthesized
atatttttatgggactcacaat

SEQ ID NO: 785088 - DNA, 22 bp, Artificial Sequence
  chemically synthesized
taaagagacaaaattgtgagtc

SEQ ID NO: 785089 - DNA, 22 bp, Artificial Sequence
  chemically synthesized
tatttttatgggactcacaatt

SEQ ID NO: 785090 - DNA, 22 bp, Artificial Sequence
  chemically synthesized
ctaaagagacaaaattgtgagt

SEQ ID NO: 785091 - DNA, 22 bp, Artificial Sequence
  chemically synthesized
ttatgggactcacaattttgtc

SEQ ID NO: 785092 - DNA, 22 bp, Artificial Sequence
  chemically synthesized
catttctaaagagacaaaattg

SEQ ID NO: 785093 - DNA, 22 bp, Artificial Sequence
  chemically synthesized
tatgggactcacaattttgtct

SEQ ID NO: 785094 - DNA, 22 bp, Artificial Sequence
  chemically synthesized
atgggactcacaattttgtctc

SEQ ID NO: 785095 - DNA, 22 bp, Artificial Sequence
  chemically synthesized
tgggactcacaattttgtctct

SEQ ID NO: 785096 - DNA, 22 bp, Artificial Sequence
  chemically synthesized
tataaggctacatttctaaaga

SEQ ID NO: 785097 - DNA, 22 bp, Artificial Sequence
  chemically synthesized
acaattttgtctctttagaaat

SEQ ID NO: 785098 - DNA, 22 bp, Artificial Sequence
  chemically synthesized
atataaggctacatttctaaag

SEQ ID NO: 785099 - DNA, 22 bp, Artificial Sequence
  chemically synthesized
tatataaggctacatttctaaa

SEQ ID NO: 785100 - DNA, 22 bp, Artificial Sequence
  chemically synthesized
tattttatataaggctacattt

SEQ ID NO: 785101 - DNA, 22 bp, Artificial Sequence
  chemically synthesized
tgtctctttagaaatgtagcct

SEQ ID NO: 785102 - DNA, 22 bp, Artificial Sequence
  chemically synthesized
gtctctttagaaatgtagcctt

SEQ ID NO: 785103 - DNA, 22 bp, Artificial Sequence
  chemically synthesized
tctctttagaaatgtagcctta

SEQ ID NO: 785104 - DNA, 22 bp, Artificial Sequence
  chemically synthesized
tgtctgtattttatataaggct

SEQ ID NO: 785105 - DNA, 22 bp, Artificial Sequence
  chemically synthesized
tttagaaatgtagccttatata

SEQ ID NO: 785106 - DNA, 22 bp, Artificial Sequence
  chemically synthesized
atgtctgtattttatataaggc

SEQ ID NO: 785107 - DNA, 22 bp, Artificial Sequence
  chemically synthesized
tatgtctgtattttatataagg

SEQ ID NO: 785108 - DNA, 22 bp, Artificial Sequence
  chemically synthesized
tagaaatgtagccttatataaa

SEQ ID NO: 785109 - DNA, 22 bp, Artificial Sequence
  chemically synthesized
agaaatgtagccttatataaaa

SEQ ID NO: 785110 - DNA, 22 bp, Artificial Sequence
  chemically synthesized
gaaatgtagccttatataaaat

SEQ ID NO: 785111 - DNA, 22 bp, Artificial Sequence
  chemically synthesized
atgggtcattttatgtctgtat

SEQ ID NO: 785112 - DNA, 22 bp, Artificial Sequence
  chemically synthesized
atataaaatacagacataaaat

SEQ ID NO: 785113 - DNA, 22 bp, Artificial Sequence
  chemically synthesized
tataaaatacagacataaaatg

SEQ ID NO: 785114 - DNA, 22 bp, Artificial Sequence
  chemically synthesized
taagtaaaataatgaattaatg

SEQ ID NO: 785115 - DNA, 22 bp, Artificial Sequence
  chemically synthesized
gtaagtaaaataatgaattaat

SEQ ID NO: 785116 - DNA, 22 bp, Artificial Sequence
  chemically synthesized
tgtaagtaaaataatgaattaa

SEQ ID NO: 785117 - DNA, 22 bp, Artificial Sequence
  chemically synthesized
ttgtaagtaaaataatgaatta

SEQ ID NO: 785118 - DNA, 22 bp, Artificial Sequence
  chemically synthesized
attcattattttacttacaaaa

SEQ ID NO: 785119 - DNA, 22 bp, Artificial Sequence
  chemically synthesized
agatacataggtaccttttgta

SEQ ID NO: 785120 - DNA, 22 bp, Artificial Sequence
  chemically synthesized
attattttacttacaaaaggta

SEQ ID NO: 785121 - DNA, 22 bp, Artificial Sequence
  chemically synthesized
cagatacataggtaccttttgt

SEQ ID NO: 785122 - DNA, 22 bp, Artificial Sequence
  chemically synthesized
tcagatacataggtaccttttg

SEQ ID NO: 785123 - DNA, 22 bp, Artificial Sequence
  chemically synthesized
ttttacttacaaaaggtaccta

SEQ ID NO: 785124 - DNA, 22 bp, Artificial Sequence
  chemically synthesized
tacttacaaaaggtacctatgt

SEQ ID NO: 785125 - DNA, 22 bp, Artificial Sequence
  chemically synthesized
acttacaaaaggtacctatgta

SEQ ID NO: 785126 - DNA, 22 bp, Artificial Sequence
  chemically synthesized
cttacaaaaggtacctatgtat

SEQ ID NO: 785127 - DNA, 22 bp, Artificial Sequence
  chemically synthesized
gaaaactttcagatacataggt

SEQ ID NO: 785128 - DNA, 22 bp, Artificial Sequence
  chemically synthesized
agaaaactttcagatacatagg

SEQ ID NO: 785129 - DNA, 22 bp, Artificial Sequence
  chemically synthesized
acaaaaggtacctatgtatctg

SEQ ID NO: 785130 - DNA, 22 bp, Artificial Sequence
  chemically synthesized
caaaaggtacctatgtatctga

SEQ ID NO: 785131 - DNA, 22 bp, Artificial Sequence
  chemically synthesized
tgtgtcaggcacttagaaaact

SEQ ID NO: 785132 - DNA, 22 bp, Artificial Sequence
  chemically synthesized
tgtatctgaaagttttctaagt

SEQ ID NO: 785133 - DNA, 22 bp, Artificial Sequence
  chemically synthesized
aaagttttctaagtgcctgaca

SEQ ID NO: 785134 - DNA, 22 bp, Artificial Sequence
  chemically synthesized
ggggaagctgtgtgtcaggcac

SEQ ID NO: 785135 - DNA, 22 bp, Artificial Sequence
  chemically synthesized
tcattaggggaagctgtgtgtc

SEQ ID NO: 785136 - DNA, 22 bp, Artificial Sequence
  chemically synthesized
tctaagtgcctgacacacagct

SEQ ID NO: 785137 - DNA, 22 bp, Artificial Sequence
  chemically synthesized
ctaagtgcctgacacacagctt

SEQ ID NO: 785138 - DNA, 22 bp, Artificial Sequence
  chemically synthesized
taagtgcctgacacacagcttc

SEQ ID NO: 785139 - DNA, 22 bp, Artificial Sequence
  chemically synthesized
agtgcctgacacacagcttccc

SEQ ID NO: 785140 - DNA, 22 bp, Artificial Sequence
  chemically synthesized
acacacagcttcccctaatgat

SEQ ID NO: 785141 - DNA, 22 bp, Artificial Sequence
  chemically synthesized
atgcgtacagaagagttatcat

SEQ ID NO: 785142 - DNA, 22 bp, Artificial Sequence
  chemically synthesized
tcatgcgtacagaagagttatc

SEQ ID NO: 785143 - DNA, 22 bp, Artificial Sequence
  chemically synthesized
cccctaatgataactcttctgt

SEQ ID NO: 785144 - DNA, 22 bp, Artificial Sequence
  chemically synthesized
ccctaatgataactcttctgta

SEQ ID NO: 785145 - DNA, 22 bp, Artificial Sequence
  chemically synthesized
atgataactcttctgtacgcat

SEQ ID NO: 785146 - DNA, 22 bp, Artificial Sequence
  chemically synthesized
gataaatctctcatgcgtacag

SEQ ID NO: 785147 - DNA, 22 bp, Artificial Sequence
  chemically synthesized
agataaatctctcatgcgtaca

SEQ ID NO: 785148 - DNA, 22 bp, Artificial Sequence
  chemically synthesized
aatgtttagataaatctctcat

SEQ ID NO: 785149 - DNA, 22 bp, Artificial Sequence
  chemically synthesized
aaatgtttagataaatctctca

SEQ ID NO: 785150 - DNA, 22 bp, Artificial Sequence
  chemically synthesized
ttctgtacgcatgagagattta

SEQ ID NO: 785151 - DNA, 22 bp, Artificial Sequence
  chemically synthesized
ctgtacgcatgagagatttatc

SEQ ID NO: 785152 - DNA, 22 bp, Artificial Sequence
  chemically synthesized
tttaaatgtttagataaatctc

SEQ ID NO: 785153 - DNA, 22 bp, Artificial Sequence
  chemically synthesized
tgtacgcatgagagatttatct

SEQ ID NO: 785154 - DNA, 22 bp, Artificial Sequence
  chemically synthesized
gtttaaatgtttagataaatct

SEQ ID NO: 785155 - DNA, 22 bp, Artificial Sequence
  chemically synthesized
tacgcatgagagatttatctaa

SEQ ID NO: 785156 - DNA, 22 bp, Artificial Sequence
  chemically synthesized
tatcagtgtttgtttaaatgtt

SEQ ID NO: 785157 - DNA, 22 bp, Artificial Sequence
  chemically synthesized
atctaaacatttaaacaaacac

SEQ ID NO: 785158 - DNA, 22 bp, Artificial Sequence
  chemically synthesized
tctaaacatttaaacaaacact

SEQ ID NO: 785159 - DNA, 22 bp, Artificial Sequence
  chemically synthesized
atagtgttgtatcagtgtttgt

SEQ ID NO: 785160 - DNA, 22 bp, Artificial Sequence
  chemically synthesized
aacatttaaacaaacactgata

SEQ ID NO: 785161 - DNA, 22 bp, Artificial Sequence
  chemically synthesized
ttaatagtgttgtatcagtgtt

SEQ ID NO: 785162 - DNA, 22 bp, Artificial Sequence
  chemically synthesized
gttaatagtgttgtatcagtgt

SEQ ID NO: 785163 - DNA, 22 bp, Artificial Sequence
  chemically synthesized
tgttaatagtgttgtatcagtg

SEQ ID NO: 785164 - DNA, 22 bp, Artificial Sequence
  chemically synthesized
aaacaaacactgatacaacact

SEQ ID NO: 785165 - DNA, 22 bp, Artificial Sequence
  chemically synthesized
aacaaacactgatacaacacta

SEQ ID NO: 785166 - DNA, 22 bp, Artificial Sequence
  chemically synthesized
tagttttgttaatagtgttgta

SEQ ID NO: 785167 - DNA, 22 bp, Artificial Sequence
  chemically synthesized
atacaacactattaacaaaact

SEQ ID NO: 785168 - DNA, 22 bp, Artificial Sequence
  chemically synthesized
aataaagtctgtagttttgtta

SEQ ID NO: 785169 - DNA, 22 bp, Artificial Sequence
  chemically synthesized
gtgaaatctgaataaagtctgt

SEQ ID NO: 785170 - DNA, 22 bp, Artificial Sequence
  chemically synthesized
ttaacaaaactacagactttat

SEQ ID NO: 785171 - DNA, 22 bp, Artificial Sequence
  chemically synthesized
acaaaactacagactttattca

SEQ ID NO: 785172 - DNA, 22 bp, Artificial Sequence
  chemically synthesized
cagactttattcagatttcacc

SEQ ID NO: 785173 - DNA, 22 bp, Artificial Sequence
  chemically synthesized
tattcagatttcaccagttttt

SEQ ID NO: 785174 - DNA, 22 bp, Artificial Sequence
  chemically synthesized
attcagatttcaccagtttttc

SEQ ID NO: 785175 - DNA, 22 bp, Artificial Sequence
  chemically synthesized
ttcagatttcaccagtttttcc

SEQ ID NO: 785176 - DNA, 22 bp, Artificial Sequence
  chemically synthesized
agatttcaccagtttttccact

SEQ ID NO: 785177 - DNA, 22 bp, Artificial Sequence
  chemically synthesized
caccagtttttccactcatgtc

SEQ ID NO: 785178 - DNA, 22 bp, Artificial Sequence
  chemically synthesized
aaacagaaaaatgacatgagtg

SEQ ID NO: 785179 - DNA, 22 bp, Artificial Sequence
  chemically synthesized
accagtttttccactcatgtca

SEQ ID NO: 785180 - DNA, 22 bp, Artificial Sequence
  chemically synthesized
gatcctgaaacagaaaaatgac

SEQ ID NO: 785181 - DNA, 22 bp, Artificial Sequence
  chemically synthesized
ttccactcatgtcatttttctg

SEQ ID NO: 785182 - DNA, 22 bp, Artificial Sequence
  chemically synthesized
tccactcatgtcatttttctgt

SEQ ID NO: 785183 - DNA, 22 bp, Artificial Sequence
  chemically synthesized
ccactcatgtcatttttctgtt

SEQ ID NO: 785184 - DNA, 22 bp, Artificial Sequence
  chemically synthesized
cactcatgtcatttttctgttt

SEQ ID NO: 785185 - DNA, 22 bp, Artificial Sequence
  chemically synthesized
gattggatcctgaaacagaaaa

SEQ ID NO: 785186 - DNA, 22 bp, Artificial Sequence
  chemically synthesized
tggattggatcctgaaacagaa

SEQ ID NO: 785187 - DNA, 22 bp, Artificial Sequence
  chemically synthesized
atgtcatttttctgtttcagga

SEQ ID NO: 785188 - DNA, 22 bp, Artificial Sequence
  chemically synthesized
ttctgtttcaggatccaatcca

SEQ ID NO: 785189 - DNA, 22 bp, Artificial Sequence
  chemically synthesized
tctgtttcaggatccaatccag

SEQ ID NO: 785190 - DNA, 22 bp, Artificial Sequence
  chemically synthesized
ctgtttcaggatccaatccaga

SEQ ID NO: 785191 - DNA, 22 bp, Artificial Sequence
  chemically synthesized
tgtttcaggatccaatccagaa

SEQ ID NO: 785192 - DNA, 22 bp, Artificial Sequence
  chemically synthesized
tttcaggatccaatccagaatc

SEQ ID NO: 785193 - DNA, 22 bp, Artificial Sequence
  chemically synthesized
caggatccaatccagaatctcc

SEQ ID NO: 785194 - DNA, 22 bp, Artificial Sequence
  chemically synthesized
aggatccaatccagaatctcct

SEQ ID NO: 785195 - DNA, 22 bp, Artificial Sequence
  chemically synthesized
ctactgcatttggtccttgggt

SEQ ID NO: 785196 - DNA, 22 bp, Artificial Sequence
  chemically synthesized
ctgcatttggtccttgggtctt

SEQ ID NO: 785197 - DNA, 22 bp, Artificial Sequence
  chemically synthesized
gaggagaccaaaaagacccaag

SEQ ID NO: 785198 - DNA, 22 bp, Artificial Sequence
  chemically synthesized
catttggtccttgggtcttttt

SEQ ID NO: 785199 - DNA, 22 bp, Artificial Sequence
  chemically synthesized
ggtccttgggtctttttggtct

SEQ ID NO: 785200 - DNA, 22 bp, Artificial Sequence
  chemically synthesized
gtccttgggtctttttggtctc

SEQ ID NO: 785201 - DNA, 22 bp, Artificial Sequence
  chemically synthesized
tcacagactagaggagaccaaa

SEQ ID NO: 785202 - DNA, 22 bp, Artificial Sequence
  chemically synthesized
gggtctttttggtctcctctag

SEQ ID NO: 785203 - DNA, 22 bp, Artificial Sequence
  chemically synthesized
ggtctttttggtctcctctagt

SEQ ID NO: 785204 - DNA, 22 bp, Artificial Sequence
  chemically synthesized
agagactgtcacagactagagg

SEQ ID NO: 785205 - DNA, 22 bp, Artificial Sequence
  chemically synthesized
tttggtctcctctagtctgtga

SEQ ID NO: 785206 - DNA, 22 bp, Artificial Sequence
  chemically synthesized
ttggtctcctctagtctgtgac

SEQ ID NO: 785207 - DNA, 22 bp, Artificial Sequence
  chemically synthesized
tggtctcctctagtctgtgaca

SEQ ID NO: 785208 - DNA, 22 bp, Artificial Sequence
  chemically synthesized
ggtctcctctagtctgtgacag

SEQ ID NO: 785209 - DNA, 22 bp, Artificial Sequence
  chemically synthesized
gtctcctctagtctgtgacagt

SEQ ID NO: 785210 - DNA, 22 bp, Artificial Sequence
  chemically synthesized
ctctagtctgtgacagtctctc

SEQ ID NO: 785211 - DNA, 22 bp, Artificial Sequence
  chemically synthesized
tagtctgtgacagtctctcagt

SEQ ID NO: 785212 - DNA, 22 bp, Artificial Sequence
  chemically synthesized
gtctgtgacagtctctcagttt

SEQ ID NO: 785213 - DNA, 22 bp, Artificial Sequence
  chemically synthesized
tgacagtctctcagtttcttct

SEQ ID NO: 785214 - DNA, 22 bp, Artificial Sequence
  chemically synthesized
aaggtcatgaagaacaagaaga

SEQ ID NO: 785215 - DNA, 22 bp, Artificial Sequence
  chemically synthesized
caaggtcatgaagaacaagaag

SEQ ID NO: 785216 - DNA, 22 bp, Artificial Sequence
  chemically synthesized
tcagtttcttcttgttcttcat

SEQ ID NO: 785217 - DNA, 22 bp, Artificial Sequence
  chemically synthesized
agtttcttcttgttcttcatga

SEQ ID NO: 785218 - DNA, 22 bp, Artificial Sequence
  chemically synthesized
aaaagtttcaaggtcatgaaga

SEQ ID NO: 785219 - DNA, 22 bp, Artificial Sequence
  chemically synthesized
ttcaaaagtttcaaggtcatga

SEQ ID NO: 785220 - DNA, 22 bp, Artificial Sequence
  chemically synthesized
cttcttgttcttcatgaccttg

SEQ ID NO: 785221 - DNA, 22 bp, Artificial Sequence
  chemically synthesized
ttcttgttcttcatgaccttga

SEQ ID NO: 785222 - DNA, 22 bp, Artificial Sequence
  chemically synthesized
cttgttcttcatgaccttgaaa

SEQ ID NO: 785223 - DNA, 22 bp, Artificial Sequence
  chemically synthesized
ttgttcttcatgaccttgaaac

SEQ ID NO: 785224 - DNA, 22 bp, Artificial Sequence
  chemically synthesized
gtcctattcaaaagtttcaagg

SEQ ID NO: 785225 - DNA, 22 bp, Artificial Sequence
  chemically synthesized
gttcttcatgaccttgaaactt

SEQ ID NO: 785226 - DNA, 22 bp, Artificial Sequence
  chemically synthesized
ttcttcatgaccttgaaacttt

SEQ ID NO: 785227 - DNA, 22 bp, Artificial Sequence
  chemically synthesized
actagtcctattcaaaagtttc

SEQ ID NO: 785228 - DNA, 22 bp, Artificial Sequence
  chemically synthesized
ttcatgaccttgaaacttttga

SEQ ID NO: 785229 - DNA, 22 bp, Artificial Sequence
  chemically synthesized
catgaccttgaaacttttgaat

SEQ ID NO: 785230 - DNA, 22 bp, Artificial Sequence
  chemically synthesized
atgaccttgaaacttttgaata

SEQ ID NO: 785231 - DNA, 22 bp, Artificial Sequence
  chemically synthesized
gaatatacctgactagtcctat

SEQ ID NO: 785232 - DNA, 22 bp, Artificial Sequence
  chemically synthesized
gaaacttttgaataggactagt

SEQ ID NO: 785233 - DNA, 22 bp, Artificial Sequence
  chemically synthesized
aaacttttgaataggactagtc

SEQ ID NO: 785234 - DNA, 22 bp, Artificial Sequence
  chemically synthesized
tagaatatacctgactagtcct

SEQ ID NO: 785235 - DNA, 22 bp, Artificial Sequence
  chemically synthesized
ctagaatatacctgactagtcc

SEQ ID NO: 785236 - DNA, 22 bp, Artificial Sequence
  chemically synthesized
ttgaataggactagtcaggtat

SEQ ID NO: 785237 - DNA, 22 bp, Artificial Sequence
  chemically synthesized
tgaataggactagtcaggtata

SEQ ID NO: 785238 - DNA, 22 bp, Artificial Sequence
  chemically synthesized
gaataggactagtcaggtatat

SEQ ID NO: 785239 - DNA, 22 bp, Artificial Sequence
  chemically synthesized
aataggactagtcaggtatatt

SEQ ID NO: 785240 - DNA, 22 bp, Artificial Sequence
  chemically synthesized
agagacttctagaatatacctg

SEQ ID NO: 785241 - DNA, 22 bp, Artificial Sequence
  chemically synthesized
aagagacttctagaatatacct

SEQ ID NO: 785242 - DNA, 22 bp, Artificial Sequence
  chemically synthesized
gtcaggtatattctagaagtct

SEQ ID NO: 785243 - DNA, 22 bp, Artificial Sequence
  chemically synthesized
agtcaaatcttaagagacttct

SEQ ID NO: 785244 - DNA, 22 bp, Artificial Sequence
  chemically synthesized
cagtcaaatcttaagagacttc

SEQ ID NO: 785245 - DNA, 22 bp, Artificial Sequence
  chemically synthesized
tagaagtctcttaagatttgac

SEQ ID NO: 785246 - DNA, 22 bp, Artificial Sequence
  chemically synthesized
gaagtctcttaagatttgactg

SEQ ID NO: 785247 - DNA, 22 bp, Artificial Sequence
  chemically synthesized
atagggaaaatacttcagtcaa

SEQ ID NO: 785248 - DNA, 22 bp, Artificial Sequence
  chemically synthesized
taatagggaaaatacttcagtc

SEQ ID NO: 785249 - DNA, 22 bp, Artificial Sequence
  chemically synthesized
ctaatagggaaaatacttcagt

SEQ ID NO: 785250 - DNA, 22 bp, Artificial Sequence
  chemically synthesized
ttaagatttgactgaagtattt

SEQ ID NO: 785251 - DNA, 22 bp, Artificial Sequence
  chemically synthesized
ttctaatagggaaaatacttca

SEQ ID NO: 785252 - DNA, 22 bp, Artificial Sequence
  chemically synthesized
cttctaatagggaaaatacttc

SEQ ID NO: 785253 - DNA, 22 bp, Artificial Sequence
  chemically synthesized
aagatttgactgaagtattttc

SEQ ID NO: 785254 - DNA, 22 bp, Artificial Sequence
  chemically synthesized
agatttgactgaagtattttcc

SEQ ID NO: 785255 - DNA, 22 bp, Artificial Sequence
  chemically synthesized
taacttcttctaatagggaaaa

SEQ ID NO: 785256 - DNA, 22 bp, Artificial Sequence
  chemically synthesized
gactgaagtattttccctatta

SEQ ID NO: 785257 - DNA, 22 bp, Artificial Sequence
  chemically synthesized
actgaagtattttccctattag

SEQ ID NO: 785258 - DNA, 22 bp, Artificial Sequence
  chemically synthesized
aagtattttccctattagaaga

SEQ ID NO: 785259 - DNA, 22 bp, Artificial Sequence
  chemically synthesized
cccaaaacctgtaacttcttct

SEQ ID NO: 785260 - DNA, 22 bp, Artificial Sequence
  chemically synthesized
ccccaaaacctgtaacttcttc

SEQ ID NO: 785261 - DNA, 22 bp, Artificial Sequence
  chemically synthesized
ttccccaaaacctgtaacttct

SEQ ID NO: 785262 - DNA, 22 bp, Artificial Sequence
  chemically synthesized
tccctattagaagaagttacag

SEQ ID NO: 785263 - DNA, 22 bp, Artificial Sequence
  chemically synthesized
ccctattagaagaagttacagg

SEQ ID NO: 785264 - DNA, 22 bp, Artificial Sequence
  chemically synthesized
cctattagaagaagttacaggt

SEQ ID NO: 785265 - DNA, 22 bp, Artificial Sequence
  chemically synthesized
gtattcttccccaaaacctgta

SEQ ID NO: 785266 - DNA, 22 bp, Artificial Sequence
  chemically synthesized
ttagaagaagttacaggttttg

SEQ ID NO: 785267 - DNA, 22 bp, Artificial Sequence
  chemically synthesized
tggtattcttccccaaaacctg

SEQ ID NO: 785268 - DNA, 22 bp, Artificial Sequence
  chemically synthesized
gaagaagttacaggttttgggg

SEQ ID NO: 785269 - DNA, 22 bp, Artificial Sequence
  chemically synthesized
tctggtattcttccccaaaacc

SEQ ID NO: 785270 - DNA, 22 bp, Artificial Sequence
  chemically synthesized
tctctctggtattcttccccaa

SEQ ID NO: 785271 - DNA, 22 bp, Artificial Sequence
  chemically synthesized
caggttttggggaagaatacca

SEQ ID NO: 785272 - DNA, 22 bp, Artificial Sequence
  chemically synthesized
tggggaagaataccagagagat

SEQ ID NO: 785273 - DNA, 22 bp, Artificial Sequence
  chemically synthesized
ggggaagaataccagagagata

SEQ ID NO: 785274 - DNA, 22 bp, Artificial Sequence
  chemically synthesized
gggaagaataccagagagataa

SEQ ID NO: 785275 - DNA, 22 bp, Artificial Sequence
  chemically synthesized
tgatatgatgtcatgaaaagga

SEQ ID NO: 785276 - DNA, 22 bp, Artificial Sequence
  chemically synthesized
ctgtgatatgatgtcatgaaaa

SEQ ID NO: 785277 - DNA, 22 bp, Artificial Sequence
  chemically synthesized
atatcatgtctcctgtgatatg

SEQ ID NO: 785278 - DNA, 22 bp, Artificial Sequence
  chemically synthesized
ttcatgacatcatatcacagga

SEQ ID NO: 785279 - DNA, 22 bp, Artificial Sequence
  chemically synthesized
tcatgacatcatatcacaggag

SEQ ID NO: 785280 - DNA, 22 bp, Artificial Sequence
  chemically synthesized
catgacatcatatcacaggaga

SEQ ID NO: 785281 - DNA, 22 bp, Artificial Sequence
  chemically synthesized
atgacatcatatcacaggagac

SEQ ID NO: 785282 - DNA, 22 bp, Artificial Sequence
  chemically synthesized
agtagtcaagtataacatcgcc

SEQ ID NO: 785283 - DNA, 22 bp, Artificial Sequence
  chemically synthesized
ttatcactggcgatgttatact

SEQ ID NO: 785284 - DNA, 22 bp, Artificial Sequence
  chemically synthesized
actaagtagtcaagtataacat

SEQ ID NO: 785285 - DNA, 22 bp, Artificial Sequence
  chemically synthesized
tcactggcgatgttatacttga

SEQ ID NO: 785286 - DNA, 22 bp, Artificial Sequence
  chemically synthesized
gcgatgttatacttgactactt

SEQ ID NO: 785287 - DNA, 22 bp, Artificial Sequence
  chemically synthesized
tacttgactacttagttaactt

SEQ ID NO: 785288 - DNA, 22 bp, Artificial Sequence
  chemically synthesized
gactacttagttaacttggtgc

SEQ ID NO: 785289 - DNA, 22 bp, Artificial Sequence
  chemically synthesized
actacttagttaacttggtgcc

SEQ ID NO: 785290 - DNA, 22 bp, Artificial Sequence
  chemically synthesized
cttagttaacttggtgcctgcc

SEQ ID NO: 785291 - DNA, 22 bp, Artificial Sequence
  chemically synthesized
agttaacttggtgcctgcctgg

SEQ ID NO: 785292 - DNA, 22 bp, Artificial Sequence
  chemically synthesized
gttaacttggtgcctgcctggt

SEQ ID NO: 785293 - DNA, 22 bp, Artificial Sequence
  chemically synthesized
acttggtgcctgcctggtttct

SEQ ID NO: 785294 - DNA, 22 bp, Artificial Sequence
  chemically synthesized
ggtgcctgcctggtttcttctc

SEQ ID NO: 785295 - DNA, 22 bp, Artificial Sequence
  chemically synthesized
gtgcctgcctggtttcttctcc

SEQ ID NO: 785296 - DNA, 22 bp, Artificial Sequence
  chemically synthesized
cctggtttcttctccattgtta

SEQ ID NO: 785297 - DNA, 22 bp, Artificial Sequence
  chemically synthesized
gtttcttctccattgttattcc

SEQ ID NO: 785298 - DNA, 22 bp, Artificial Sequence
  chemically synthesized
cttctccattgttattcctact

SEQ ID NO: 785299 - DNA, 22 bp, Artificial Sequence
  chemically synthesized
ttctccattgttattcctactt

SEQ ID NO: 785300 - DNA, 22 bp, Artificial Sequence
  chemically synthesized
ctccattgttattcctactttt

SEQ ID NO: 785301 - DNA, 22 bp, Artificial Sequence
  chemically synthesized
tccattgttattcctacttttc

SEQ ID NO: 785302 - DNA, 22 bp, Artificial Sequence
  chemically synthesized
cattgttattcctacttttcca

SEQ ID NO: 785303 - DNA, 22 bp, Artificial Sequence
  chemically synthesized
cagataatagaatatggaaaag

SEQ ID NO: 785304 - DNA, 22 bp, Artificial Sequence
  chemically synthesized
ccagataatagaatatggaaaa

SEQ ID NO: 785305 - DNA, 22 bp, Artificial Sequence
  chemically synthesized
ttattcctacttttccatattc

SEQ ID NO: 785306 - DNA, 22 bp, Artificial Sequence
  chemically synthesized
cttccagataatagaatatgga

SEQ ID NO: 785307 - DNA, 22 bp, Artificial Sequence
  chemically synthesized
acttccagataatagaatatgg

SEQ ID NO: 785308 - DNA, 22 bp, Artificial Sequence
  chemically synthesized
ttcctacttttccatattctat

SEQ ID NO: 785309 - DNA, 22 bp, Artificial Sequence
  chemically synthesized
ctacttttccatattctattat

SEQ ID NO: 785310 - DNA, 22 bp, Artificial Sequence
  chemically synthesized
cttttccatattctattatctg

SEQ ID NO: 785311 - DNA, 22 bp, Artificial Sequence
  chemically synthesized
gtaacttacttccagataatag

SEQ ID NO: 785312 - DNA, 22 bp, Artificial Sequence
  chemically synthesized
ggtaacttacttccagataata

SEQ ID NO: 785313 - DNA, 22 bp, Artificial Sequence
  chemically synthesized
ttccatattctattatctggaa

SEQ ID NO: 785314 - DNA, 22 bp, Artificial Sequence
  chemically synthesized
tccatattctattatctggaag

SEQ ID NO: 785315 - DNA, 22 bp, Artificial Sequence
  chemically synthesized
ccatattctattatctggaagt

SEQ ID NO: 785316 - DNA, 22 bp, Artificial Sequence
  chemically synthesized
catattctattatctggaagta

SEQ ID NO: 785317 - DNA, 22 bp, Artificial Sequence
  chemically synthesized
catgaacttggtaacttacttc

SEQ ID NO: 785318 - DNA, 22 bp, Artificial Sequence
  chemically synthesized
tattatctggaagtaagttacc

SEQ ID NO: 785319 - DNA, 22 bp, Artificial Sequence
  chemically synthesized
ttatctggaagtaagttaccaa

SEQ ID NO: 785320 - DNA, 22 bp, Artificial Sequence
  chemically synthesized
tctggaagtaagttaccaagtt

SEQ ID NO: 785321 - DNA, 22 bp, Artificial Sequence
  chemically synthesized
agcccctccatgaacttggtaa

SEQ ID NO: 785322 - DNA, 22 bp, Artificial Sequence
  chemically synthesized
gaagtaagttaccaagttcatg

SEQ ID NO: 785323 - DNA, 22 bp, Artificial Sequence
  chemically synthesized
ccctaagcccctccatgaactt

SEQ ID NO: 785324 - DNA, 22 bp, Artificial Sequence
  chemically synthesized
atcctcccctaagcccctccat

SEQ ID NO: 785325 - DNA, 22 bp, Artificial Sequence
  chemically synthesized
aatcctcccctaagcccctcca

SEQ ID NO: 785326 - DNA, 22 bp, Artificial Sequence
  chemically synthesized
ccaagttcatggaggggcttag

SEQ ID NO: 785327 - DNA, 22 bp, Artificial Sequence
  chemically synthesized
atggaggggcttaggggaggat

SEQ ID NO: 785328 - DNA, 22 bp, Artificial Sequence
  chemically synthesized
ggatgtagagtttaatcctccc

SEQ ID NO: 785329 - DNA, 22 bp, Artificial Sequence
  chemically synthesized
ctgggatgtagagtttaatcct

SEQ ID NO: 785330 - DNA, 22 bp, Artificial Sequence
  chemically synthesized
cctgggatgtagagtttaatcc

SEQ ID NO: 785331 - DNA, 22 bp, Artificial Sequence
  chemically synthesized
tcctgggatgtagagtttaatc

SEQ ID NO: 785332 - DNA, 22 bp, Artificial Sequence
  chemically synthesized
ctttcctgggatgtagagttta

SEQ ID NO: 785333 - DNA, 22 bp, Artificial Sequence
  chemically synthesized
aggggaggattaaactctacat

SEQ ID NO: 785334 - DNA, 22 bp, Artificial Sequence
  chemically synthesized
ggggaggattaaactctacatc

SEQ ID NO: 785335 - DNA, 22 bp, Artificial Sequence
  chemically synthesized
aactctacatcccaggaaagga

SEQ ID NO: 785336 - DNA, 22 bp, Artificial Sequence
  chemically synthesized
tacatcccaggaaaggagtatc

SEQ ID NO: 785337 - DNA, 22 bp, Artificial Sequence
  chemically synthesized
ataatatacatagatactcctt

SEQ ID NO: 785338 - DNA, 22 bp, Artificial Sequence
  chemically synthesized
aataatatacatagatactcct

SEQ ID NO: 785339 - DNA, 22 bp, Artificial Sequence
  chemically synthesized
catcccaggaaaggagtatcta

SEQ ID NO: 785340 - DNA, 22 bp, Artificial Sequence
  chemically synthesized
ttaataatatacatagatactc

SEQ ID NO: 785341 - DNA, 22 bp, Artificial Sequence
  chemically synthesized
tagaacaattcttaataatata

SEQ ID NO: 785342 - DNA, 22 bp, Artificial Sequence
  chemically synthesized
atagaacaattcttaataatat

SEQ ID NO: 785343 - DNA, 22 bp, Artificial Sequence
  chemically synthesized
ccttatagaacaattcttaata

SEQ ID NO: 785344 - DNA, 22 bp, Artificial Sequence
  chemically synthesized
cccttatagaacaattcttaat

SEQ ID NO: 785345 - DNA, 22 bp, Artificial Sequence
  chemically synthesized
tcccttatagaacaattcttaa

SEQ ID NO: 785346 - DNA, 22 bp, Artificial Sequence
  chemically synthesized
tgtatattattaagaattgttc

SEQ ID NO: 785347 - DNA, 22 bp, Artificial Sequence
  chemically synthesized
agagaaaattttcccttataga

SEQ ID NO: 785348 - DNA, 22 bp, Artificial Sequence
  chemically synthesized
ttaagaattgttctataaggga

SEQ ID NO: 785349 - DNA, 22 bp, Artificial Sequence
  chemically synthesized
gagagaaaattttcccttatag

SEQ ID NO: 785350 - DNA, 22 bp, Artificial Sequence
  chemically synthesized
agaattgttctataagggaaaa

SEQ ID NO: 785351 - DNA, 22 bp, Artificial Sequence
  chemically synthesized
ttctataagggaaaattttctc

SEQ ID NO: 785352 - DNA, 22 bp, Artificial Sequence
  chemically synthesized
tataagggaaaattttctctca

SEQ ID NO: 785353 - DNA, 22 bp, Artificial Sequence
  chemically synthesized
taagggaaaattttctctcaaa

SEQ ID NO: 785354 - DNA, 22 bp, Artificial Sequence
  chemically synthesized
gtaaaaaagcatatttgagaga

SEQ ID NO: 785355 - DNA, 22 bp, Artificial Sequence
  chemically synthesized
agtaaaaaagcatatttgagag

SEQ ID NO: 785356 - DNA, 22 bp, Artificial Sequence
  chemically synthesized
tttagtaaaaaagcatatttga

SEQ ID NO: 785357 - DNA, 22 bp, Artificial Sequence
  chemically synthesized
tgtttagtaaaaaagcatattt

SEQ ID NO: 785358 - DNA, 22 bp, Artificial Sequence
  chemically synthesized
tctgtttagtaaaaaagcatat

SEQ ID NO: 785359 - DNA, 22 bp, Artificial Sequence
  chemically synthesized
ctctgtttagtaaaaaagcata

SEQ ID NO: 785360 - DNA, 22 bp, Artificial Sequence
  chemically synthesized
tctctgtttagtaaaaaagcat

SEQ ID NO: 785361 - DNA, 22 bp, Artificial Sequence
  chemically synthesized
tctctcaaatatgcttttttac

SEQ ID NO: 785362 - DNA, 22 bp, Artificial Sequence
  chemically synthesized
ctctcaaatatgcttttttact

SEQ ID NO: 785363 - DNA, 22 bp, Artificial Sequence
  chemically synthesized
tctcaaatatgcttttttacta

SEQ ID NO: 785364 - DNA, 22 bp, Artificial Sequence
  chemically synthesized
tcaaatatgcttttttactaaa

SEQ ID NO: 785365 - DNA, 22 bp, Artificial Sequence
  chemically synthesized
aaatatgcttttttactaaaca

SEQ ID NO: 785366 - DNA, 22 bp, Artificial Sequence
  chemically synthesized
agataataatgtgttttctctg

SEQ ID NO: 785367 - DNA, 22 bp, Artificial Sequence
  chemically synthesized
ttttactaaacagagaaaacac

SEQ ID NO: 785368 - DNA, 22 bp, Artificial Sequence
  chemically synthesized
tttactaaacagagaaaacaca

SEQ ID NO: 785369 - DNA, 22 bp, Artificial Sequence
  chemically synthesized
ttactaaacagagaaaacacat

SEQ ID NO: 785370 - DNA, 22 bp, Artificial Sequence
  chemically synthesized
tactaaacagagaaaacacatt

SEQ ID NO: 785371 - DNA, 22 bp, Artificial Sequence
  chemically synthesized
actaaacagagaaaacacatta

SEQ ID NO: 785372 - DNA, 22 bp, Artificial Sequence
  chemically synthesized
ctaaacagagaaaacacattat

SEQ ID NO: 785373 - DNA, 22 bp, Artificial Sequence
  chemically synthesized
aacagagaaaacacattattat

SEQ ID NO: 785374 - DNA, 22 bp, Artificial Sequence
  chemically synthesized
gccatatagcaaccactcagat

SEQ ID NO: 785375 - DNA, 22 bp, Artificial Sequence
  chemically synthesized
ttatctgagtggttgctatatg

SEQ ID NO: 785376 - DNA, 22 bp, Artificial Sequence
  chemically synthesized
tctgagtggttgctatatggct

SEQ ID NO: 785377 - DNA, 22 bp, Artificial Sequence
  chemically synthesized
agtggttgctatatggctaatc

SEQ ID NO: 785378 - DNA, 22 bp, Artificial Sequence
  chemically synthesized
acaaaagaaggtaaatgagatt

SEQ ID NO: 785379 - DNA, 22 bp, Artificial Sequence
  chemically synthesized
ctatatggctaatctcatttac

SEQ ID NO: 785380 - DNA, 22 bp, Artificial Sequence
  chemically synthesized
tatggctaatctcatttacctt

SEQ ID NO: 785381 - DNA, 22 bp, Artificial Sequence
  chemically synthesized
tgaattgacaaaagaaggtaaa

SEQ ID NO: 785382 - DNA, 22 bp, Artificial Sequence
  chemically synthesized
atgaattgacaaaagaaggtaa

SEQ ID NO: 785383 - DNA, 22 bp, Artificial Sequence
  chemically synthesized
atctcatttaccttcttttgtc

SEQ ID NO: 785384 - DNA, 22 bp, Artificial Sequence
  chemically synthesized
atttaccttcttttgtcaattc

SEQ ID NO: 785385 - DNA, 22 bp, Artificial Sequence
  chemically synthesized
accttcttttgtcaattcataa

SEQ ID NO: 785386 - DNA, 22 bp, Artificial Sequence
  chemically synthesized
ccttcttttgtcaattcataaa

SEQ ID NO: 785387 - DNA, 22 bp, Artificial Sequence
  chemically synthesized
cttttgtcaattcataaactgg

SEQ ID NO: 785388 - DNA, 22 bp, Artificial Sequence
  chemically synthesized
ttttgtcaattcataaactggt

SEQ ID NO: 785389 - DNA, 22 bp, Artificial Sequence
  chemically synthesized
ttgtcaattcataaactggtct

SEQ ID NO: 785390 - DNA, 22 bp, Artificial Sequence
  chemically synthesized
tgtcaattcataaactggtctt

SEQ ID NO: 785391 - DNA, 22 bp, Artificial Sequence
  chemically synthesized
gtcaattcataaactggtcttt

SEQ ID NO: 785392 - DNA, 22 bp, Artificial Sequence
  chemically synthesized
tcaattcataaactggtctttt

SEQ ID NO: 785393 - DNA, 22 bp, Artificial Sequence
  chemically synthesized
gcccgaaaagggaaaaaagacc

SEQ ID NO: 785394 - DNA, 22 bp, Artificial Sequence
  chemically synthesized
ataaactggtcttttttccctt

SEQ ID NO: 785395 - DNA, 22 bp, Artificial Sequence
  chemically synthesized
tactggcccgaaaagggaaaaa

SEQ ID NO: 785396 - DNA, 22 bp, Artificial Sequence
  chemically synthesized
agttatactggcccgaaaaggg

SEQ ID NO: 785397 - DNA, 22 bp, Artificial Sequence
  chemically synthesized
gtcttttttcccttttcgggcc

SEQ ID NO: 785398 - DNA, 22 bp, Artificial Sequence
  chemically synthesized
ttaagttatactggcccgaaaa

SEQ ID NO: 785399 - DNA, 22 bp, Artificial Sequence
  chemically synthesized
ttttcccttttcgggccagtat

SEQ ID NO: 785400 - DNA, 22 bp, Artificial Sequence
  chemically synthesized
tttcccttttcgggccagtata

SEQ ID NO: 785401 - DNA, 22 bp, Artificial Sequence
  chemically synthesized
ttcccttttcgggccagtataa

SEQ ID NO: 785402 - DNA, 22 bp, Artificial Sequence
  chemically synthesized
tcccttttcgggccagtataac

SEQ ID NO: 785403 - DNA, 22 bp, Artificial Sequence
  chemically synthesized
cccttttcgggccagtataact

SEQ ID NO: 785404 - DNA, 22 bp, Artificial Sequence
  chemically synthesized
ccttttcgggccagtataactt

SEQ ID NO: 785405 - DNA, 22 bp, Artificial Sequence
  chemically synthesized
ttcgggccagtataacttaata

SEQ ID NO: 785406 - DNA, 22 bp, Artificial Sequence
  chemically synthesized
tcgggccagtataacttaatag

SEQ ID NO: 785407 - DNA, 22 bp, Artificial Sequence
  chemically synthesized
cgggccagtataacttaatagg

SEQ ID NO: 785408 - DNA, 22 bp, Artificial Sequence
  chemically synthesized
gggccagtataacttaatagga

SEQ ID NO: 785409 - DNA, 22 bp, Artificial Sequence
  chemically synthesized
ataacataagataaacaatcct

SEQ ID NO: 785410 - DNA, 22 bp, Artificial Sequence
  chemically synthesized
aataggattgtttatcttatgt

SEQ ID NO: 785411 - DNA, 22 bp, Artificial Sequence
  chemically synthesized
ataggattgtttatcttatgtt

SEQ ID NO: 785412 - DNA, 22 bp, Artificial Sequence
  chemically synthesized
caaataaattaataacataaga

SEQ ID NO: 785413 - DNA, 22 bp, Artificial Sequence
  chemically synthesized
tcatctacaaataaattaataa

SEQ ID NO: 785414 - DNA, 22 bp, Artificial Sequence
  chemically synthesized
tttatcttatgttattaattta

SEQ ID NO: 785415 - DNA, 22 bp, Artificial Sequence
  chemically synthesized
gtcatctacaaataaattaata

SEQ ID NO: 785416 - DNA, 22 bp, Artificial Sequence
  chemically synthesized
tgtcatctacaaataaattaat

SEQ ID NO: 785417 - DNA, 22 bp, Artificial Sequence
  chemically synthesized
atcttatgttattaatttattt

SEQ ID NO: 785418 - DNA, 22 bp, Artificial Sequence
  chemically synthesized
tcttatgttattaatttatttg

SEQ ID NO: 785419 - DNA, 22 bp, Artificial Sequence
  chemically synthesized
atgttattaatttatttgtaga

SEQ ID NO: 785420 - DNA, 22 bp, Artificial Sequence
  chemically synthesized
tgttattaatttatttgtagat

SEQ ID NO: 785421 - DNA, 22 bp, Artificial Sequence
  chemically synthesized
ttaatttatttgtagatgacaa

SEQ ID NO: 785422 - DNA, 22 bp, Artificial Sequence
  chemically synthesized
ccaaaaggaatctttgtcatct

SEQ ID NO: 785423 - DNA, 22 bp, Artificial Sequence
  chemically synthesized
atttatttgtagatgacaaaga

SEQ ID NO: 785424 - DNA, 22 bp, Artificial Sequence
  chemically synthesized
atttgtagatgacaaagattcc

SEQ ID NO: 785425 - DNA, 22 bp, Artificial Sequence
  chemically synthesized
tttgtagatgacaaagattcct

SEQ ID NO: 785426 - DNA, 22 bp, Artificial Sequence
  chemically synthesized
gtagatgacaaagattcctttt

SEQ ID NO: 785427 - DNA, 22 bp, Artificial Sequence
  chemically synthesized
tagatgacaaagattccttttg

SEQ ID NO: 785428 - DNA, 22 bp, Artificial Sequence
  chemically synthesized
agtgccagaacctaccaaaagg

SEQ ID NO: 785429 - DNA, 22 bp, Artificial Sequence
  chemically synthesized
gagtgccagaacctaccaaaag

SEQ ID NO: 785430 - DNA, 22 bp, Artificial Sequence
  chemically synthesized
gtcttgagtgccagaacctacc

SEQ ID NO: 785431 - DNA, 22 bp, Artificial Sequence
  chemically synthesized
ttagtcttgagtgccagaacct

SEQ ID NO: 785432 - DNA, 22 bp, Artificial Sequence
  chemically synthesized
cttttggtaggttctggcactc

SEQ ID NO: 785433 - DNA, 22 bp, Artificial Sequence
  chemically synthesized
ttggtaggttctggcactcaag

SEQ ID NO: 785434 - DNA, 22 bp, Artificial Sequence
  chemically synthesized
tggtaggttctggcactcaaga

SEQ ID NO: 785435 - DNA, 22 bp, Artificial Sequence
  chemically synthesized
ggtaggttctggcactcaagac

SEQ ID NO: 785436 - DNA, 22 bp, Artificial Sequence
  chemically synthesized
gtaggttctggcactcaagact

SEQ ID NO: 785437 - DNA, 22 bp, Artificial Sequence
  chemically synthesized
tggcactcaagactaataggtt

SEQ ID NO: 785438 - DNA, 22 bp, Artificial Sequence
  chemically synthesized
gcactcaagactaataggtttt

SEQ ID NO: 785439 - DNA, 22 bp, Artificial Sequence
  chemically synthesized
aagactaataggtttttccata

SEQ ID NO: 785440 - DNA, 22 bp, Artificial Sequence
  chemically synthesized
tatccatagaaatatatggaaa

SEQ ID NO: 785441 - DNA, 22 bp, Artificial Sequence
  chemically synthesized
gtatccatagaaatatatggaa

SEQ ID NO: 785442 - DNA, 22 bp, Artificial Sequence
  chemically synthesized
ataggtttttccatatatttct

SEQ ID NO: 785443 - DNA, 22 bp, Artificial Sequence
  chemically synthesized
gtacaatttgtatccatagaaa

SEQ ID NO: 785444 - DNA, 22 bp, Artificial Sequence
  chemically synthesized
ttccatatatttctatggatac

SEQ ID NO: 785445 - DNA, 22 bp, Artificial Sequence
  chemically synthesized
tccatatatttctatggataca

SEQ ID NO: 785446 - DNA, 22 bp, Artificial Sequence
  chemically synthesized
ccatatatttctatggatacaa

SEQ ID NO: 785447 - DNA, 22 bp, Artificial Sequence
  chemically synthesized
catatatttctatggatacaaa

SEQ ID NO: 785448 - DNA, 22 bp, Artificial Sequence
  chemically synthesized
ccagcatgctggtacaatttgt

SEQ ID NO: 785449 - DNA, 22 bp, Artificial Sequence
  chemically synthesized
cccagcatgctggtacaatttg

SEQ ID NO: 785450 - DNA, 22 bp, Artificial Sequence
  chemically synthesized
ctatggatacaaattgtaccag

SEQ ID NO: 785451 - DNA, 22 bp, Artificial Sequence
  chemically synthesized
cttcccagcatgctggtacaat

SEQ ID NO: 785452 - DNA, 22 bp, Artificial Sequence
  chemically synthesized
tatggatacaaattgtaccagc

SEQ ID NO: 785453 - DNA, 22 bp, Artificial Sequence
  chemically synthesized
ccttcccagcatgctggtacaa

SEQ ID NO: 785454 - DNA, 22 bp, Artificial Sequence
  chemically synthesized
tccttcccagcatgctggtaca

SEQ ID NO: 785455 - DNA, 22 bp, Artificial Sequence
  chemically synthesized
tggatacaaattgtaccagcat

SEQ ID NO: 785456 - DNA, 22 bp, Artificial Sequence
  chemically synthesized
attttccttcccagcatgctgg

SEQ ID NO: 785457 - DNA, 22 bp, Artificial Sequence
  chemically synthesized
tcagctcattttccttcccagc

SEQ ID NO: 785458 - DNA, 22 bp, Artificial Sequence
  chemically synthesized
taccagcatgctgggaaggaaa

SEQ ID NO: 785459 - DNA, 22 bp, Artificial Sequence
  chemically synthesized
ggaaggaaaatgagctgacagt

SEQ ID NO: 785460 - DNA, 22 bp, Artificial Sequence
  chemically synthesized
aaagtgacacatatactgtcag

SEQ ID NO: 785461 - DNA, 22 bp, Artificial Sequence
  chemically synthesized
acagtatatgtgtcactttgaa

SEQ ID NO: 785462 - DNA, 22 bp, Artificial Sequence
  chemically synthesized
taggatacccagtgattcaaag

SEQ ID NO: 785463 - DNA, 22 bp, Artificial Sequence
  chemically synthesized
cctgtaggatacccagtgattc

SEQ ID NO: 785464 - DNA, 22 bp, Artificial Sequence
  chemically synthesized
gatattccctgtaggataccca

SEQ ID NO: 785465 - DNA, 22 bp, Artificial Sequence
  chemically synthesized
tgaatcactgggtatcctacag

SEQ ID NO: 785466 - DNA, 22 bp, Artificial Sequence
  chemically synthesized
gaatcactgggtatcctacagg

SEQ ID NO: 785467 - DNA, 22 bp, Artificial Sequence
  chemically synthesized
aatcactgggtatcctacaggg

SEQ ID NO: 785468 - DNA, 22 bp, Artificial Sequence
  chemically synthesized
agtaactcgatattccctgtag

SEQ ID NO: 785469 - DNA, 22 bp, Artificial Sequence
  chemically synthesized
aagtaactcgatattccctgta

SEQ ID NO: 785470 - DNA, 22 bp, Artificial Sequence
  chemically synthesized
ggtatcctacagggaatatcga

SEQ ID NO: 785471 - DNA, 22 bp, Artificial Sequence
  chemically synthesized
aagcttaagtaactcgatattc

SEQ ID NO: 785472 - DNA, 22 bp, Artificial Sequence
  chemically synthesized
gaagcttaagtaactcgatatt

SEQ ID NO: 785473 - DNA, 22 bp, Artificial Sequence
  chemically synthesized
tgaagcttaagtaactcgatat

SEQ ID NO: 785474 - DNA, 22 bp, Artificial Sequence
  chemically synthesized
tttgaagcttaagtaactcgat

SEQ ID NO: 785475 - DNA, 22 bp, Artificial Sequence
  chemically synthesized
ctttgaagcttaagtaactcga

SEQ ID NO: 785476 - DNA, 22 bp, Artificial Sequence
  chemically synthesized
tctttgaagcttaagtaactcg

SEQ ID NO: 785477 - DNA, 22 bp, Artificial Sequence
  chemically synthesized
cagggaatatcgagttacttaa

SEQ ID NO: 785478 - DNA, 22 bp, Artificial Sequence
  chemically synthesized
tcacatctttctttgaagctta

SEQ ID NO: 785479 - DNA, 22 bp, Artificial Sequence
  chemically synthesized
accattgtcacatctttctttg

SEQ ID NO: 785480 - DNA, 22 bp, Artificial Sequence
  chemically synthesized
cttaagcttcaaagaaagatgt

SEQ ID NO: 785481 - DNA, 22 bp, Artificial Sequence
  chemically synthesized
aagcttcaaagaaagatgtgac

SEQ ID NO: 785482 - DNA, 22 bp, Artificial Sequence
  chemically synthesized
tggttaaccattgtcacatctt

SEQ ID NO: 785483 - DNA, 22 bp, Artificial Sequence
  chemically synthesized
agcttcaaagaaagatgtgaca

SEQ ID NO: 785484 - DNA, 22 bp, Artificial Sequence
  chemically synthesized
aattatggttaaccattgtcac

SEQ ID NO: 785485 - DNA, 22 bp, Artificial Sequence
  chemically synthesized
caaagaaagatgtgacaatggt

SEQ ID NO: 785486 - DNA, 22 bp, Artificial Sequence
  chemically synthesized
aaagaaagatgtgacaatggtt

SEQ ID NO: 785487 - DNA, 22 bp, Artificial Sequence
  chemically synthesized
aaatccaaatctaaattatggt

SEQ ID NO: 785488 - DNA, 22 bp, Artificial Sequence
  chemically synthesized
tgagaatattaaaatccaaatc

SEQ ID NO: 785489 - DNA, 22 bp, Artificial Sequence
  chemically synthesized
accataatttagatttggattt

SEQ ID NO: 785490 - DNA, 22 bp, Artificial Sequence
  chemically synthesized
agatttggattttaatattctc

SEQ ID NO: 785491 - DNA, 22 bp, Artificial Sequence
  chemically synthesized
gatttggattttaatattctca

SEQ ID NO: 785492 - DNA, 22 bp, Artificial Sequence
  chemically synthesized
ggattttaatattctcacagcc

SEQ ID NO: 785493 - DNA, 22 bp, Artificial Sequence
  chemically synthesized
atgggccagccaggctgtgaga

SEQ ID NO: 785494 - DNA, 22 bp, Artificial Sequence
  chemically synthesized
gattttaatattctcacagcct

SEQ ID NO: 785495 - DNA, 22 bp, Artificial Sequence
  chemically synthesized
taatattctcacagcctggctg

SEQ ID NO: 785496 - DNA, 22 bp, Artificial Sequence
  chemically synthesized
aatattctcacagcctggctgg

SEQ ID NO: 785497 - DNA, 22 bp, Artificial Sequence
  chemically synthesized
atattctcacagcctggctggc

SEQ ID NO: 785498 - DNA, 22 bp, Artificial Sequence
  chemically synthesized
tcacagcctggctggcccatca

SEQ ID NO: 785499 - DNA, 22 bp, Artificial Sequence
  chemically synthesized
acagcctggctggcccatcaat

SEQ ID NO: 785500 - DNA, 22 bp, Artificial Sequence
  chemically synthesized
gctggcccatcaattttttatg

SEQ ID NO: 785501 - DNA, 22 bp, Artificial Sequence
  chemically synthesized
agagaaaaacatcataaaaaat

SEQ ID NO: 785502 - DNA, 22 bp, Artificial Sequence
  chemically synthesized
aagagaaaaacatcataaaaaa

SEQ ID NO: 785503 - DNA, 22 bp, Artificial Sequence
  chemically synthesized
gcccatcaattttttatgatgt

SEQ ID NO: 785504 - DNA, 22 bp, Artificial Sequence
  chemically synthesized
agaaacttaagagaaaaacatc

SEQ ID NO: 785505 - DNA, 22 bp, Artificial Sequence
  chemically synthesized
ttgagaaacttaagagaaaaac

SEQ ID NO: 785506 - DNA, 22 bp, Artificial Sequence
  chemically synthesized
tttatgatgtttttctcttaag

SEQ ID NO: 785507 - DNA, 22 bp, Artificial Sequence
  chemically synthesized
ttatgatgtttttctcttaagt

SEQ ID NO: 785508 - DNA, 22 bp, Artificial Sequence
  chemically synthesized
tatgatgtttttctcttaagtt

SEQ ID NO: 785509 - DNA, 22 bp, Artificial Sequence
  chemically synthesized
atgatgtttttctcttaagttt

SEQ ID NO: 785510 - DNA, 22 bp, Artificial Sequence
  chemically synthesized
tgatgtttttctcttaagtttc

SEQ ID NO: 785511 - DNA, 22 bp, Artificial Sequence
  chemically synthesized
cccagagaaattgttgagaaac

SEQ ID NO: 785512 - DNA, 22 bp, Artificial Sequence
  chemically synthesized
gcccagagaaattgttgagaaa

SEQ ID NO: 785513 - DNA, 22 bp, Artificial Sequence
  chemically synthesized
ttctcttaagtttctcaacaat

SEQ ID NO: 785514 - DNA, 22 bp, Artificial Sequence
  chemically synthesized
tctcttaagtttctcaacaatt

SEQ ID NO: 785515 - DNA, 22 bp, Artificial Sequence
  chemically synthesized
ctcttaagtttctcaacaattt

SEQ ID NO: 785516 - DNA, 22 bp, Artificial Sequence
  chemically synthesized
tcttaagtttctcaacaatttc

SEQ ID NO: 785517 - DNA, 22 bp, Artificial Sequence
  chemically synthesized
ttaagtttctcaacaatttctc

SEQ ID NO: 785518 - DNA, 22 bp, Artificial Sequence
  chemically synthesized
aagtttctcaacaatttctctg

SEQ ID NO: 785519 - DNA, 22 bp, Artificial Sequence
  chemically synthesized
agtttctcaacaatttctctgg

SEQ ID NO: 785520 - DNA, 22 bp, Artificial Sequence
  chemically synthesized
aaacaaacttgcccagagaaat

SEQ ID NO: 785521 - DNA, 22 bp, Artificial Sequence
  chemically synthesized
gaaacaaacttgcccagagaaa

SEQ ID NO: 785522 - DNA, 22 bp, Artificial Sequence
  chemically synthesized
ctcaacaatttctctgggcaag

SEQ ID NO: 785523 - DNA, 22 bp, Artificial Sequence
  chemically synthesized
tcaacaatttctctgggcaagt

SEQ ID NO: 785524 - DNA, 22 bp, Artificial Sequence
  chemically synthesized
catttgaaacaaacttgcccag

SEQ ID NO: 785525 - DNA, 22 bp, Artificial Sequence
  chemically synthesized
gcatttgaaacaaacttgccca

SEQ ID NO: 785526 - DNA, 22 bp, Artificial Sequence
  chemically synthesized
aacaatttctctgggcaagttt

SEQ ID NO: 785527 - DNA, 22 bp, Artificial Sequence
  chemically synthesized
gtcttgcatttgaaacaaactt

SEQ ID NO: 785528 - DNA, 22 bp, Artificial Sequence
  chemically synthesized
ctctgggcaagtttgtttcaaa

SEQ ID NO: 785529 - DNA, 22 bp, Artificial Sequence
  chemically synthesized
tctgggcaagtttgtttcaaat

SEQ ID NO: 785530 - DNA, 22 bp, Artificial Sequence
  chemically synthesized
aaattagtcttgcatttgaaac

SEQ ID NO: 785531 - DNA, 22 bp, Artificial Sequence
  chemically synthesized
tgggcaagtttgtttcaaatgc

SEQ ID NO: 785532 - DNA, 22 bp, Artificial Sequence
  chemically synthesized
aaaattagtcttgcatttgaaa

SEQ ID NO: 785533 - DNA, 22 bp, Artificial Sequence
  chemically synthesized
ggcaagtttgtttcaaatgcaa

SEQ ID NO: 785534 - DNA, 22 bp, Artificial Sequence
  chemically synthesized
atcaagcttaaaattagtcttg

SEQ ID NO: 785535 - DNA, 22 bp, Artificial Sequence
  chemically synthesized
aatcaagcttaaaattagtctt

SEQ ID NO: 785536 - DNA, 22 bp, Artificial Sequence
  chemically synthesized
gtttcaaatgcaagactaattt

SEQ ID NO: 785537 - DNA, 22 bp, Artificial Sequence
  chemically synthesized
taatcaagcttaaaattagtct

SEQ ID NO: 785538 - DNA, 22 bp, Artificial Sequence
  chemically synthesized
tttcaaatgcaagactaatttt

SEQ ID NO: 785539 - DNA, 22 bp, Artificial Sequence
  chemically synthesized
caaatgcaagactaattttaag

SEQ ID NO: 785540 - DNA, 22 bp, Artificial Sequence
  chemically synthesized
aaatgcaagactaattttaagc

SEQ ID NO: 785541 - DNA, 22 bp, Artificial Sequence
  chemically synthesized
acattttaatcaagcttaaaat

SEQ ID NO: 785542 - DNA, 22 bp, Artificial Sequence
  chemically synthesized
aacattttaatcaagcttaaaa

SEQ ID NO: 785543 - DNA, 22 bp, Artificial Sequence
  chemically synthesized
tttaacattttaatcaagctta

SEQ ID NO: 785544 - DNA, 22 bp, Artificial Sequence
  chemically synthesized
attttaagcttgattaaaatgt

SEQ ID NO: 785545 - DNA, 22 bp, Artificial Sequence
  chemically synthesized
taagcttgattaaaatgttaaa

SEQ ID NO: 785546 - DNA, 22 bp, Artificial Sequence
  chemically synthesized
aagcttgattaaaatgttaaac

SEQ ID NO: 785547 - DNA, 22 bp, Artificial Sequence
  chemically synthesized
agcttgattaaaatgttaaaca

SEQ ID NO: 785548 - DNA, 22 bp, Artificial Sequence
  chemically synthesized
gattaaaatgttaaacagactc

SEQ ID NO: 785549 - DNA, 22 bp, Artificial Sequence
  chemically synthesized
attaaaatgttaaacagactca

SEQ ID NO: 785550 - DNA, 22 bp, Artificial Sequence
  chemically synthesized
aaatgttaaacagactcatgcc

SEQ ID NO: 785551 - DNA, 22 bp, Artificial Sequence
  chemically synthesized
ataaaggataatacaaatggca

SEQ ID NO: 785552 - DNA, 22 bp, Artificial Sequence
  chemically synthesized
cataaaggataatacaaatggc

SEQ ID NO: 785553 - DNA, 22 bp, Artificial Sequence
  chemically synthesized
aacagactcatgccatttgtat

SEQ ID NO: 785554 - DNA, 22 bp, Artificial Sequence
  chemically synthesized
tcataaaggataatacaaatgg

SEQ ID NO: 785555 - DNA, 22 bp, Artificial Sequence
  chemically synthesized
ttcataaaggataatacaaatg

SEQ ID NO: 785556 - DNA, 22 bp, Artificial Sequence
  chemically synthesized
tttcataaaggataatacaaat

SEQ ID NO: 785557 - DNA, 22 bp, Artificial Sequence
  chemically synthesized
attttttcataaaggataatac

SEQ ID NO: 785558 - DNA, 22 bp, Artificial Sequence
  chemically synthesized
atgccatttgtattatccttta

SEQ ID NO: 785559 - DNA, 22 bp, Artificial Sequence
  chemically synthesized
aagtattgattttttcataaag

SEQ ID NO: 785560 - DNA, 22 bp, Artificial Sequence
  chemically synthesized
ttaaagtattgattttttcata

SEQ ID NO: 785561 - DNA, 22 bp, Artificial Sequence
  chemically synthesized
gtattatcctttatgaaaaaat

SEQ ID NO: 785562 - DNA, 22 bp, Artificial Sequence
  chemically synthesized
tattatcctttatgaaaaaatc

SEQ ID NO: 785563 - DNA, 22 bp, Artificial Sequence
  chemically synthesized
tcctttatgaaaaaatcaatac

SEQ ID NO: 785564 - DNA, 22 bp, Artificial Sequence
  chemically synthesized
agaaagtctattaaagtattga

SEQ ID NO: 785565 - DNA, 22 bp, Artificial Sequence
  chemically synthesized
tatgaaaaaatcaatactttaa

SEQ ID NO: 785566 - DNA, 22 bp, Artificial Sequence
  chemically synthesized
atgaaaaaatcaatactttaat

SEQ ID NO: 785567 - DNA, 22 bp, Artificial Sequence
  chemically synthesized
ctaagaaagtctattaaagtat

SEQ ID NO: 785568 - DNA, 22 bp, Artificial Sequence
  chemically synthesized
tgaaaaaatcaatactttaata

SEQ ID NO: 785569 - DNA, 22 bp, Artificial Sequence
  chemically synthesized
cctaagaaagtctattaaagta

SEQ ID NO: 785570 - DNA, 22 bp, Artificial Sequence
  chemically synthesized
aaaatagtttcctaagaaagtc

SEQ ID NO: 785571 - DNA, 22 bp, Artificial Sequence
  chemically synthesized
tcaaaatagtttcctaagaaag

SEQ ID NO: 785572 - DNA, 22 bp, Artificial Sequence
  chemically synthesized
ctcaaaatagtttcctaagaaa

SEQ ID NO: 785573 - DNA, 22 bp, Artificial Sequence
  chemically synthesized
taatagactttcttaggaaact

SEQ ID NO: 785574 - DNA, 22 bp, Artificial Sequence
  chemically synthesized
aatagactttcttaggaaacta

SEQ ID NO: 785575 - DNA, 22 bp, Artificial Sequence
  chemically synthesized
agtttctcaaaatagtttccta

SEQ ID NO: 785576 - DNA, 22 bp, Artificial Sequence
  chemically synthesized
atagactttcttaggaaactat

SEQ ID NO: 785577 - DNA, 22 bp, Artificial Sequence
  chemically synthesized
ttgagtttctcaaaatagtttc

SEQ ID NO: 785578 - DNA, 22 bp, Artificial Sequence
  chemically synthesized
tcttaggaaactattttgagaa

SEQ ID NO: 785579 - DNA, 22 bp, Artificial Sequence
  chemically synthesized
cttaggaaactattttgagaaa

SEQ ID NO: 785580 - DNA, 22 bp, Artificial Sequence
  chemically synthesized
ttaggaaactattttgagaaac

SEQ ID NO: 785581 - DNA, 22 bp, Artificial Sequence
  chemically synthesized
acaatgctattgagtttctcaa

SEQ ID NO: 785582 - DNA, 22 bp, Artificial Sequence
  chemically synthesized
aggaaactattttgagaaactc

SEQ ID NO: 785583 - DNA, 22 bp, Artificial Sequence
  chemically synthesized
aacaatgctattgagtttctca

SEQ ID NO: 785584 - DNA, 22 bp, Artificial Sequence
  chemically synthesized
ggaaactattttgagaaactca

SEQ ID NO: 785585 - DNA, 22 bp, Artificial Sequence
  chemically synthesized
tttaacaatgctattgagtttc

SEQ ID NO: 785586 - DNA, 22 bp, Artificial Sequence
  chemically synthesized
atttaacaatgctattgagttt

SEQ ID NO: 785587 - DNA, 22 bp, Artificial Sequence
  chemically synthesized
tatttaacaatgctattgagtt

SEQ ID NO: 785588 - DNA, 22 bp, Artificial Sequence
  chemically synthesized
ctttatttaacaatgctattga

SEQ ID NO: 785589 - DNA, 22 bp, Artificial Sequence
  chemically synthesized
ttttgagaaactcaatagcatt

SEQ ID NO: 785590 - DNA, 22 bp, Artificial Sequence
  chemically synthesized
tactttatttaacaatgctatt

SEQ ID NO: 785591 - DNA, 22 bp, Artificial Sequence
  chemically synthesized
tgagaaactcaatagcattgtt

SEQ ID NO: 785592 - DNA, 22 bp, Artificial Sequence
  chemically synthesized
gagaaactcaatagcattgtta

SEQ ID NO: 785593 - DNA, 22 bp, Artificial Sequence
  chemically synthesized
agaaactcaatagcattgttaa

SEQ ID NO: 785594 - DNA, 22 bp, Artificial Sequence
  chemically synthesized
atgggacattctactttattta

SEQ ID NO: 785595 - DNA, 22 bp, Artificial Sequence
  chemically synthesized
aatagcattgttaaataaagta

SEQ ID NO: 785596 - DNA, 22 bp, Artificial Sequence
  chemically synthesized
gaatctgatgggacattctact

SEQ ID NO: 785597 - DNA, 22 bp, Artificial Sequence
  chemically synthesized
ttaaataaagtagaatgtccca

SEQ ID NO: 785598 - DNA, 22 bp, Artificial Sequence
  chemically synthesized
aataaagtagaatgtcccatca

SEQ ID NO: 785599 - DNA, 22 bp, Artificial Sequence
  chemically synthesized
tcagagaatacatataaaatac

SEQ ID NO: 785600 - DNA, 22 bp, Artificial Sequence
  chemically synthesized
gtcagagaatacatataaaata

SEQ ID NO: 785601 - DNA, 22 bp, Artificial Sequence
  chemically synthesized
tgtcagagaatacatataaaat

SEQ ID NO: 785602 - DNA, 22 bp, Artificial Sequence
  chemically synthesized
ttgtcagagaatacatataaaa

SEQ ID NO: 785603 - DNA, 22 bp, Artificial Sequence
  chemically synthesized
cccttttgtcagagaatacata

SEQ ID NO: 785604 - DNA, 22 bp, Artificial Sequence
  chemically synthesized
acccttttgtcagagaatacat

SEQ ID NO: 785605 - DNA, 22 bp, Artificial Sequence
  chemically synthesized
cagtattttatatgtattctct

SEQ ID NO: 785606 - DNA, 22 bp, Artificial Sequence
  chemically synthesized
tacccttttgtcagagaataca

SEQ ID NO: 785607 - DNA, 22 bp, Artificial Sequence
  chemically synthesized
ttttacccttttgtcagagaat

SEQ ID NO: 785608 - DNA, 22 bp, Artificial Sequence
  chemically synthesized
attttacccttttgtcagagaa

SEQ ID NO: 785609 - DNA, 22 bp, Artificial Sequence
  chemically synthesized
ttattttacccttttgtcagag

SEQ ID NO: 785610 - DNA, 22 bp, Artificial Sequence
  chemically synthesized
cttattttacccttttgtcaga

SEQ ID NO: 785611 - DNA, 22 bp, Artificial Sequence
  chemically synthesized
tatatgtattctctgacaaaag

SEQ ID NO: 785612 - DNA, 22 bp, Artificial Sequence
  chemically synthesized
atatgtattctctgacaaaagg

SEQ ID NO: 785613 - DNA, 22 bp, Artificial Sequence
  chemically synthesized
tatgtattctctgacaaaaggg

SEQ ID NO: 785614 - DNA, 22 bp, Artificial Sequence
  chemically synthesized
cttcttattttacccttttgtc

SEQ ID NO: 785615 - DNA, 22 bp, Artificial Sequence
  chemically synthesized
attgcttcttattttacccttt

SEQ ID NO: 785616 - DNA, 22 bp, Artificial Sequence
  chemically synthesized
tctgacaaaagggtaaaataag

SEQ ID NO: 785617 - DNA, 22 bp, Artificial Sequence
  chemically synthesized
tgacaaaagggtaaaataagaa

SEQ ID NO: 785618 - DNA, 22 bp, Artificial Sequence
  chemically synthesized
acaaaagggtaaaataagaagc

SEQ ID NO: 785619 - DNA, 22 bp, Artificial Sequence
  chemically synthesized
tcatgtaactcattgcttctta

SEQ ID NO: 785620 - DNA, 22 bp, Artificial Sequence
  chemically synthesized
atcatgtaactcattgcttctt

SEQ ID NO: 785621 - DNA, 22 bp, Artificial Sequence
  chemically synthesized
tatcatgtaactcattgcttct

SEQ ID NO: 785622 - DNA, 22 bp, Artificial Sequence
  chemically synthesized
ttatcatgtaactcattgcttc

SEQ ID NO: 785623 - DNA, 22 bp, Artificial Sequence
  chemically synthesized
aatcttttatcatgtaactcat

SEQ ID NO: 785624 - DNA, 22 bp, Artificial Sequence
  chemically synthesized
aaatcttttatcatgtaactca

SEQ ID NO: 785625 - DNA, 22 bp, Artificial Sequence
  chemically synthesized
taaatcttttatcatgtaactc

SEQ ID NO: 785626 - DNA, 22 bp, Artificial Sequence
  chemically synthesized
catgataaaagatttaaagggg

SEQ ID NO: 785627 - DNA, 22 bp, Artificial Sequence
  chemically synthesized
aaaggggtgtgtgtgtgtgtgt

SEQ ID NO: 785628 - DNA, 22 bp, Artificial Sequence
  chemically synthesized
aaggggtgtgtgtgtgtgtgtg

SEQ ID NO: 785629 - DNA, 22 bp, Artificial Sequence
  chemically synthesized
tacacacacacacacacacaca

SEQ ID NO: 785630 - DNA, 22 bp, Artificial Sequence
  chemically synthesized
tatacacacacacacacacaca

SEQ ID NO: 785631 - DNA, 22 bp, Artificial Sequence
  chemically synthesized
ctatacacacacacacacacac

SEQ ID NO: 785632 - DNA, 22 bp, Artificial Sequence
  chemically synthesized
tctatacacacacacacacaca

SEQ ID NO: 785633 - DNA, 22 bp, Artificial Sequence
  chemically synthesized
ttttctatacacacacacacac

SEQ ID NO: 785634 - DNA, 22 bp, Artificial Sequence
  chemically synthesized
aaagctgttttctatacacaca

SEQ ID NO: 785635 - DNA, 22 bp, Artificial Sequence
  chemically synthesized
aaaagctgttttctatacacac

SEQ ID NO: 785636 - DNA, 22 bp, Artificial Sequence
  chemically synthesized
taatgtttaaaagctgttttct

SEQ ID NO: 785637 - DNA, 22 bp, Artificial Sequence
  chemically synthesized
agaatactgtaatgtttaaaag

SEQ ID NO: 785638 - DNA, 22 bp, Artificial Sequence
  chemically synthesized
gctcagaatactgtaatgttta

SEQ ID NO: 785639 - DNA, 22 bp, Artificial Sequence
  chemically synthesized
agctcagaatactgtaatgttt

SEQ ID NO: 785640 - DNA, 22 bp, Artificial Sequence
  chemically synthesized
cacccttagctcagaatactgt

SEQ ID NO: 785641 - DNA, 22 bp, Artificial Sequence
  chemically synthesized
ccacccttagctcagaatactg

SEQ ID NO: 785642 - DNA, 22 bp, Artificial Sequence
  chemically synthesized
ttaaacattacagtattctgag

SEQ ID NO: 785643 - DNA, 22 bp, Artificial Sequence
  chemically synthesized
taaacattacagtattctgagc

SEQ ID NO: 785644 - DNA, 22 bp, Artificial Sequence
  chemically synthesized
aaacattacagtattctgagct

SEQ ID NO: 785645 - DNA, 22 bp, Artificial Sequence
  chemically synthesized
aacattacagtattctgagcta

SEQ ID NO: 785646 - DNA, 22 bp, Artificial Sequence
  chemically synthesized
aggtgaatttccacccttagct

SEQ ID NO: 785647 - DNA, 22 bp, Artificial Sequence
  chemically synthesized
cagtattctgagctaagggtgg

SEQ ID NO: 785648 - DNA, 22 bp, Artificial Sequence
  chemically synthesized
tgaggtgaatttccacccttag

SEQ ID NO: 785649 - DNA, 22 bp, Artificial Sequence
  chemically synthesized
tctgaggtgaatttccaccctt

SEQ ID NO: 785650 - DNA, 22 bp, Artificial Sequence
  chemically synthesized
tgagctaagggtggaaattcac

SEQ ID NO: 785651 - DNA, 22 bp, Artificial Sequence
  chemically synthesized
aaaattctctgaggtgaatttc

SEQ ID NO: 785652 - DNA, 22 bp, Artificial Sequence
  chemically synthesized
agctaagggtggaaattcacct

SEQ ID NO: 785653 - DNA, 22 bp, Artificial Sequence
  chemically synthesized
agggtggaaattcacctcagag

SEQ ID NO: 785654 - DNA, 22 bp, Artificial Sequence
  chemically synthesized
agacagacaattaaaaattctc

SEQ ID NO: 785655 - DNA, 22 bp, Artificial Sequence
  chemically synthesized
acctcagagaatttttaattgt

SEQ ID NO: 785656 - DNA, 22 bp, Artificial Sequence
  chemically synthesized
agagaatttttaattgtctgtc

SEQ ID NO: 785657 - DNA, 22 bp, Artificial Sequence
  chemically synthesized
aggcatcaggactcagacagac

SEQ ID NO: 785658 - DNA, 22 bp, Artificial Sequence
  chemically synthesized
gaggcatcaggactcagacaga

SEQ ID NO: 785659 - DNA, 22 bp, Artificial Sequence
  chemically synthesized
ttaattgtctgtctgagtcctg

SEQ ID NO: 785660 - DNA, 22 bp, Artificial Sequence
  chemically synthesized
aatttgaggcatcaggactcag

SEQ ID NO: 785661 - DNA, 22 bp, Artificial Sequence
  chemically synthesized
taattgtctgtctgagtcctga

SEQ ID NO: 785662 - DNA, 22 bp, Artificial Sequence
  chemically synthesized
aattgtctgtctgagtcctgat

SEQ ID NO: 785663 - DNA, 22 bp, Artificial Sequence
  chemically synthesized
attgtctgtctgagtcctgatg

SEQ ID NO: 785664 - DNA, 22 bp, Artificial Sequence
  chemically synthesized
tctgtctgagtcctgatgcctc

SEQ ID NO: 785665 - DNA, 22 bp, Artificial Sequence
  chemically synthesized
tctgagtcctgatgcctcaaat

SEQ ID NO: 785666 - DNA, 22 bp, Artificial Sequence
  chemically synthesized
ataacatgctaaatttgaggca

SEQ ID NO: 785667 - DNA, 22 bp, Artificial Sequence
  chemically synthesized
agtcctgatgcctcaaatttag

SEQ ID NO: 785668 - DNA, 22 bp, Artificial Sequence
  chemically synthesized
gaagattaataacatgctaaat

SEQ ID NO: 785669 - DNA, 22 bp, Artificial Sequence
  chemically synthesized
atgcctcaaatttagcatgtta

SEQ ID NO: 785670 - DNA, 22 bp, Artificial Sequence
  chemically synthesized
aaatttagcatgttattaatct

SEQ ID NO: 785671 - DNA, 22 bp, Artificial Sequence
  chemically synthesized
agcatgttattaatcttctaac

SEQ ID NO: 785672 - DNA, 22 bp, Artificial Sequence
  chemically synthesized
gcatgttattaatcttctaaca

SEQ ID NO: 785673 - DNA, 22 bp, Artificial Sequence
  chemically synthesized
caatagaacatggtaatgttag

SEQ ID NO: 785674 - DNA, 22 bp, Artificial Sequence
  chemically synthesized
ttaatcttctaacattaccatg

SEQ ID NO: 785675 - DNA, 22 bp, Artificial Sequence
  chemically synthesized
atcttctaacattaccatgttc

SEQ ID NO: 785676 - DNA, 22 bp, Artificial Sequence
  chemically synthesized
aaaatattgcaatagaacatgg

SEQ ID NO: 785677 - DNA, 22 bp, Artificial Sequence
  chemically synthesized
aaaaatattgcaatagaacatg

SEQ ID NO: 785678 - DNA, 22 bp, Artificial Sequence
  chemically synthesized
taaaaatattgcaatagaacat

SEQ ID NO: 785679 - DNA, 22 bp, Artificial Sequence
  chemically synthesized
ctaacattaccatgttctattg

SEQ ID NO: 785680 - DNA, 22 bp, Artificial Sequence
  chemically synthesized
taacattaccatgttctattgc

SEQ ID NO: 785681 - DNA, 22 bp, Artificial Sequence
  chemically synthesized
acattaccatgttctattgcaa

SEQ ID NO: 785682 - DNA, 22 bp, Artificial Sequence
  chemically synthesized
caatattttaaaaatattgcaa

SEQ ID NO: 785683 - DNA, 22 bp, Artificial Sequence
  chemically synthesized
ccatgttctattgcaatatttt

SEQ ID NO: 785684 - DNA, 22 bp, Artificial Sequence
  chemically synthesized
aaaattacaatattttaaaaat

SEQ ID NO: 785685 - DNA, 22 bp, Artificial Sequence
  chemically synthesized
aaaaattacaatattttaaaaa

SEQ ID NO: 785686 - DNA, 22 bp, Artificial Sequence
  chemically synthesized
taaaaattacaatattttaaaa

SEQ ID NO: 785687 - DNA, 22 bp, Artificial Sequence
  chemically synthesized
tattgcaatatttttaaaatat

SEQ ID NO: 785688 - DNA, 22 bp, Artificial Sequence
  chemically synthesized
ttaaaaattacaatattttaaa

SEQ ID NO: 785689 - DNA, 22 bp, Artificial Sequence
  chemically synthesized
ttgcaatatttttaaaatattg

SEQ ID NO: 785690 - DNA, 22 bp, Artificial Sequence
  chemically synthesized
caatatttttaaaatattgtaa

SEQ ID NO: 785691 - DNA, 22 bp, Artificial Sequence
  chemically synthesized
ttaaaatattgtaatttttaaa

SEQ ID NO: 785692 - DNA, 22 bp, Artificial Sequence
  chemically synthesized
taaaatattgtaatttttaaaa

SEQ ID NO: 785693 - DNA, 22 bp, Artificial Sequence
  chemically synthesized
aaaatattgtaatttttaaaaa

SEQ ID NO: 785694 - DNA, 22 bp, Artificial Sequence
  chemically synthesized
aaatattgtaatttttaaaaat

SEQ ID NO: 785695 - DNA, 22 bp, Artificial Sequence
  chemically synthesized
gtagcggagacagatttttaaa

SEQ ID NO: 785696 - DNA, 22 bp, Artificial Sequence
  chemically synthesized
taatttttaaaaatctgtctcc

SEQ ID NO: 785697 - DNA, 22 bp, Artificial Sequence
  chemically synthesized
acaatctagtagcggagacaga

SEQ ID NO: 785698 - DNA, 22 bp, Artificial Sequence
  chemically synthesized
ttaaaaatctgtctccgctact

SEQ ID NO: 785699 - DNA, 22 bp, Artificial Sequence
  chemically synthesized
taaaaatctgtctccgctacta

SEQ ID NO: 785700 - DNA, 22 bp, Artificial Sequence
  chemically synthesized
aaaaatctgtctccgctactag

SEQ ID NO: 785701 - DNA, 22 bp, Artificial Sequence
  chemically synthesized
aaaatctgtctccgctactaga

SEQ ID NO: 785702 - DNA, 22 bp, Artificial Sequence
  chemically synthesized
aagtcagagctcacaatctagt

SEQ ID NO: 785703 - DNA, 22 bp, Artificial Sequence
  chemically synthesized
gaagtcagagctcacaatctag

SEQ ID NO: 785704 - DNA, 22 bp, Artificial Sequence
  chemically synthesized
tgaagtcagagctcacaatcta

SEQ ID NO: 785705 - DNA, 22 bp, Artificial Sequence
  chemically synthesized
tctccgctactagattgtgagc

SEQ ID NO: 785706 - DNA, 22 bp, Artificial Sequence
  chemically synthesized
cgctactagattgtgagctctg

SEQ ID NO: 785707 - DNA, 22 bp, Artificial Sequence
  chemically synthesized
ctagattgtgagctctgacttc

SEQ ID NO: 785708 - DNA, 22 bp, Artificial Sequence
  chemically synthesized
gattgtgagctctgacttcaaa

SEQ ID NO: 785709 - DNA, 22 bp, Artificial Sequence
  chemically synthesized
tgagctctgacttcaaagacta

SEQ ID NO: 785710 - DNA, 22 bp, Artificial Sequence
  chemically synthesized
tgacttcaaagactatatctta

SEQ ID NO: 785711 - DNA, 22 bp, Artificial Sequence
  chemically synthesized
acttcaaagactatatcttatt

SEQ ID NO: 785712 - DNA, 22 bp, Artificial Sequence
  chemically synthesized
caaagactatatcttatttcta

SEQ ID NO: 785713 - DNA, 22 bp, Artificial Sequence
  chemically synthesized
aaagactatatcttatttctac

SEQ ID NO: 785714 - DNA, 22 bp, Artificial Sequence
  chemically synthesized
cataccgaggaaagaagtagaa

SEQ ID NO: 785715 - DNA, 22 bp, Artificial Sequence
  chemically synthesized
tatcttatttctacttctttcc

SEQ ID NO: 785716 - DNA, 22 bp, Artificial Sequence
  chemically synthesized
atttctacttctttcctcggta

SEQ ID NO: 785717 - DNA, 22 bp, Artificial Sequence
  chemically synthesized
tttctacttctttcctcggtat

SEQ ID NO: 785718 - DNA, 22 bp, Artificial Sequence
  chemically synthesized
ctacttctttcctcggtatgga

SEQ ID NO: 785719 - DNA, 22 bp, Artificial Sequence
  chemically synthesized
tacttctttcctcggtatggaa

SEQ ID NO: 785720 - DNA, 22 bp, Artificial Sequence
  chemically synthesized
cttctttcctcggtatggaaca

SEQ ID NO: 785721 - DNA, 22 bp, Artificial Sequence
  chemically synthesized
tacaccaggtgtgatgttccat

SEQ ID NO: 785722 - DNA, 22 bp, Artificial Sequence
  chemically synthesized
ctttcctcggtatggaacatca

SEQ ID NO: 785723 - DNA, 22 bp, Artificial Sequence
  chemically synthesized
tttcctcggtatggaacatcac

SEQ ID NO: 785724 - DNA, 22 bp, Artificial Sequence
  chemically synthesized
tcctcggtatggaacatcacac

SEQ ID NO: 785725 - DNA, 22 bp, Artificial Sequence
  chemically synthesized
cctcggtatggaacatcacacc

SEQ ID NO: 785726 - DNA, 22 bp, Artificial Sequence
  chemically synthesized
ctcggtatggaacatcacacct

SEQ ID NO: 785727 - DNA, 22 bp, Artificial Sequence
  chemically synthesized
ggtatggaacatcacacctggt

SEQ ID NO: 785728 - DNA, 22 bp, Artificial Sequence
  chemically synthesized
gtgtgactgtacaccaggtgtg

SEQ ID NO: 785729 - DNA, 22 bp, Artificial Sequence
  chemically synthesized
aaatatagctagtgtgactgta

SEQ ID NO: 785730 - DNA, 22 bp, Artificial Sequence
  chemically synthesized
agcaattgaaatatagctagtg

SEQ ID NO: 785731 - DNA, 22 bp, Artificial Sequence
  chemically synthesized
gtgtacagtcacactagctata

SEQ ID NO: 785732 - DNA, 22 bp, Artificial Sequence
  chemically synthesized
ctgagcaattgaaatatagcta

SEQ ID NO: 785733 - DNA, 22 bp, Artificial Sequence
  chemically synthesized
tagcatatggctactgagcaat

SEQ ID NO: 785734 - DNA, 22 bp, Artificial Sequence
  chemically synthesized
gctatatttcaattgctcagta

SEQ ID NO: 785735 - DNA, 22 bp, Artificial Sequence
  chemically synthesized
tatttcaattgctcagtagcca

SEQ ID NO: 785736 - DNA, 22 bp, Artificial Sequence
  chemically synthesized
caattgctcagtagccatatgc

SEQ ID NO: 785737 - DNA, 22 bp, Artificial Sequence
  chemically synthesized
aattgctcagtagccatatgct

SEQ ID NO: 785738 - DNA, 22 bp, Artificial Sequence
  chemically synthesized
ctcagtagccatatgctacagt

SEQ ID NO: 785739 - DNA, 22 bp, Artificial Sequence
  chemically synthesized
agtagccatatgctacagtact

SEQ ID NO: 785740 - DNA, 22 bp, Artificial Sequence
  chemically synthesized
tatccgtgatgtgcagtactgt

SEQ ID NO: 785741 - DNA, 22 bp, Artificial Sequence
  chemically synthesized
atatccgtgatgtgcagtactg

SEQ ID NO: 785742 - DNA, 22 bp, Artificial Sequence
  chemically synthesized
tatatccgtgatgtgcagtact

SEQ ID NO: 785743 - DNA, 22 bp, Artificial Sequence
  chemically synthesized
cagtactgcacatcacggatat

SEQ ID NO: 785744 - DNA, 22 bp, Artificial Sequence
  chemically synthesized
cgatgatgaagatattttatat

SEQ ID NO: 785745 - DNA, 22 bp, Artificial Sequence
  chemically synthesized
cacatcacggatataaaatatc

SEQ ID NO: 785746 - DNA, 22 bp, Artificial Sequence
  chemically synthesized
tgcgatgatgaagatattttat

SEQ ID NO: 785747 - DNA, 22 bp, Artificial Sequence
  chemically synthesized
tctgcgatgatgaagatatttt

SEQ ID NO: 785748 - DNA, 22 bp, Artificial Sequence
  chemically synthesized
tgatgtgaattctctgcgatga

SEQ ID NO: 785749 - DNA, 22 bp, Artificial Sequence
  chemically synthesized
catcatcgcagagaattcacat

SEQ ID NO: 785750 - DNA, 22 bp, Artificial Sequence
  chemically synthesized
atcatcgcagagaattcacatc

SEQ ID NO: 785751 - DNA, 22 bp, Artificial Sequence
  chemically synthesized
aatcaggactgtgatgtgaatt

SEQ ID NO: 785752 - DNA, 22 bp, Artificial Sequence
  chemically synthesized
taaatcaggactgtgatgtgaa

SEQ ID NO: 785753 - DNA, 22 bp, Artificial Sequence
  chemically synthesized
ctctaaatcaggactgtgatgt

SEQ ID NO: 785754 - DNA, 22 bp, Artificial Sequence
  chemically synthesized
agacatcctgctctaaatcagg

SEQ ID NO: 785755 - DNA, 22 bp, Artificial Sequence
  chemically synthesized
cagacatcctgctctaaatcag

SEQ ID NO: 785756 - DNA, 22 bp, Artificial Sequence
  chemically synthesized
acatcacagtcctgatttagag

SEQ ID NO: 785757 - DNA, 22 bp, Artificial Sequence
  chemically synthesized
atttagagcaggatgtctgaaa

SEQ ID NO: 785758 - DNA, 22 bp, Artificial Sequence
  chemically synthesized
agagcaggatgtctgaaacttg

SEQ ID NO: 785759 - DNA, 22 bp, Artificial Sequence
  chemically synthesized
gagcaggatgtctgaaacttgg

SEQ ID NO: 785760 - DNA, 22 bp, Artificial Sequence
  chemically synthesized
gtccaatatgtcagtagtgcca

SEQ ID NO: 785761 - DNA, 22 bp, Artificial Sequence
  chemically synthesized
ggtccaatatgtcagtagtgcc

SEQ ID NO: 785762 - DNA, 22 bp, Artificial Sequence
  chemically synthesized
tttggtccaatatgtcagtagt

SEQ ID NO: 785763 - DNA, 22 bp, Artificial Sequence
  chemically synthesized
aaacttggcactactgacatat

SEQ ID NO: 785764 - DNA, 22 bp, Artificial Sequence
  chemically synthesized
ggcactactgacatattggacc

SEQ ID NO: 785765 - DNA, 22 bp, Artificial Sequence
  chemically synthesized
gcactactgacatattggacca

SEQ ID NO: 785766 - DNA, 22 bp, Artificial Sequence
  chemically synthesized
ctgacatattggaccaaataat

SEQ ID NO: 785767 - DNA, 22 bp, Artificial Sequence
  chemically synthesized
acatattggaccaaataattct

SEQ ID NO: 785768 - DNA, 22 bp, Artificial Sequence
  chemically synthesized
gaccaaataattctttgttgtg

SEQ ID NO: 785769 - DNA, 22 bp, Artificial Sequence
  chemically synthesized
taatgcacaagacagcccccca

SEQ ID NO: 785770 - DNA, 22 bp, Artificial Sequence
  chemically synthesized
tttgttgtggggggctgtcttg

SEQ ID NO: 785771 - DNA, 22 bp, Artificial Sequence
  chemically synthesized
tgttgtggggggctgtcttgtg

SEQ ID NO: 785772 - DNA, 22 bp, Artificial Sequence
  chemically synthesized
gttgtggggggctgtcttgtgc

SEQ ID NO: 785773 - DNA, 22 bp, Artificial Sequence
  chemically synthesized
ttgtggggggctgtcttgtgca

SEQ ID NO: 785774 - DNA, 22 bp, Artificial Sequence
  chemically synthesized
aacatgttgtaatgcacaagac

SEQ ID NO: 785775 - DNA, 22 bp, Artificial Sequence
  chemically synthesized
tggggggctgtcttgtgcatta

SEQ ID NO: 785776 - DNA, 22 bp, Artificial Sequence
  chemically synthesized
ctcaacatgttgtaatgcacaa

SEQ ID NO: 785777 - DNA, 22 bp, Artificial Sequence
  chemically synthesized
tcttgtgcattacaacatgttg

SEQ ID NO: 785778 - DNA, 22 bp, Artificial Sequence
  chemically synthesized
gtgcattacaacatgttgagca

SEQ ID NO: 785779 - DNA, 22 bp, Artificial Sequence
  chemically synthesized
tgcattacaacatgttgagcag

SEQ ID NO: 785780 - DNA, 22 bp, Artificial Sequence
  chemically synthesized
caacatgttgagcagcatccct

SEQ ID NO: 785781 - DNA, 22 bp, Artificial Sequence
  chemically synthesized
tcatcaagtgggcagaggccag

SEQ ID NO: 785782 - DNA, 22 bp, Artificial Sequence
  chemically synthesized
agcagcatccctggcctctgcc

SEQ ID NO: 785783 - DNA, 22 bp, Artificial Sequence
  chemically synthesized
ctgtcatcaagtgggcagaggc

SEQ ID NO: 785784 - DNA, 22 bp, Artificial Sequence
  chemically synthesized
gcctctgcccacttgatgacag

SEQ ID NO: 785785 - DNA, 22 bp, Artificial Sequence
  chemically synthesized
ggggcggggatactgctgtcat

SEQ ID NO: 785786 - DNA, 22 bp, Artificial Sequence
  chemically synthesized
tgcccacttgatgacagcagta

SEQ ID NO: 785787 - DNA, 22 bp, Artificial Sequence
  chemically synthesized
cccacttgatgacagcagtatc

SEQ ID NO: 785788 - DNA, 22 bp, Artificial Sequence
  chemically synthesized
tcacattgggggcggggatact

SEQ ID NO: 785789 - DNA, 22 bp, Artificial Sequence
  chemically synthesized
gatgacagcagtatccccgccc

SEQ ID NO: 785790 - DNA, 22 bp, Artificial Sequence
  chemically synthesized
atgacagcagtatccccgcccc

SEQ ID NO: 785791 - DNA, 22 bp, Artificial Sequence
  chemically synthesized
gttgtcacattgggggcgggga

SEQ ID NO: 785792 - DNA, 22 bp, Artificial Sequence
  chemically synthesized
ggttgtcacattgggggcgggg

SEQ ID NO: 785793 - DNA, 22 bp, Artificial Sequence
  chemically synthesized
ttggttgtcacattgggggcgg

SEQ ID NO: 785794 - DNA, 22 bp, Artificial Sequence
  chemically synthesized
aagaaattcttggttgtcacat

SEQ ID NO: 785795 - DNA, 22 bp, Artificial Sequence
  chemically synthesized
acagtatctcaagaaattcttg

SEQ ID NO: 785796 - DNA, 22 bp, Artificial Sequence
  chemically synthesized
gacagtatctcaagaaattctt

SEQ ID NO: 785797 - DNA, 22 bp, Artificial Sequence
  chemically synthesized
atccccagagaacatttgacag

SEQ ID NO: 785798 - DNA, 22 bp, Artificial Sequence
  chemically synthesized
catccccagagaacatttgaca

SEQ ID NO: 785799 - DNA, 22 bp, Artificial Sequence
  chemically synthesized
cttgagatactgtcaaatgttc

SEQ ID NO: 785800 - DNA, 22 bp, Artificial Sequence
  chemically synthesized
ttgagatactgtcaaatgttct

SEQ ID NO: 785801 - DNA, 22 bp, Artificial Sequence
  chemically synthesized
gagatactgtcaaatgttctct

SEQ ID NO: 785802 - DNA, 22 bp, Artificial Sequence
  chemically synthesized
agatactgtcaaatgttctctg

SEQ ID NO: 785803 - DNA, 22 bp, Artificial Sequence
  chemically synthesized
atataatttcatccccagagaa

SEQ ID NO: 785804 - DNA, 22 bp, Artificial Sequence
  chemically synthesized
tcaaatgttctctggggatgaa

SEQ ID NO: 785805 - DNA, 22 bp, Artificial Sequence
  chemically synthesized
acctgatataatttcatcccca

SEQ ID NO: 785806 - DNA, 22 bp, Artificial Sequence
  chemically synthesized
aacctgatataatttcatcccc

SEQ ID NO: 785807 - DNA, 22 bp, Artificial Sequence
  chemically synthesized
ttaacctgatataatttcatcc

SEQ ID NO: 785808 - DNA, 22 bp, Artificial Sequence
  chemically synthesized
tctggggatgaaattatatcag

SEQ ID NO: 785809 - DNA, 22 bp, Artificial Sequence
  chemically synthesized
tggggatgaaattatatcaggt

SEQ ID NO: 785810 - DNA, 22 bp, Artificial Sequence
  chemically synthesized
gggatgaaattatatcaggtta

SEQ ID NO: 785811 - DNA, 22 bp, Artificial Sequence
  chemically synthesized
agtcagtagttcttaacctgat

SEQ ID NO: 785812 - DNA, 22 bp, Artificial Sequence
  chemically synthesized
tctaagtcagtagttcttaacc

SEQ ID NO: 785813 - DNA, 22 bp, Artificial Sequence
  chemically synthesized
atctaagtcagtagttcttaac

SEQ ID NO: 785814 - DNA, 22 bp, Artificial Sequence
  chemically synthesized
tatcaggttaagaactactgac

SEQ ID NO: 785815 - DNA, 22 bp, Artificial Sequence
  chemically synthesized
agggagtatttatctaagtcag

SEQ ID NO: 785816 - DNA, 22 bp, Artificial Sequence
  chemically synthesized
gttcagggagtatttatctaag

SEQ ID NO: 785817 - DNA, 22 bp, Artificial Sequence
  chemically synthesized
agaactactgacttagataaat

SEQ ID NO: 785818 - DNA, 22 bp, Artificial Sequence
  chemically synthesized
tagttcagggagtatttatcta

SEQ ID NO: 785819 - DNA, 22 bp, Artificial Sequence
  chemically synthesized
ctgacttagataaatactccct

SEQ ID NO: 785820 - DNA, 22 bp, Artificial Sequence
  chemically synthesized
caggactctagttcagggagta

SEQ ID NO: 785821 - DNA, 22 bp, Artificial Sequence
  chemically synthesized
acttagataaatactccctgaa

SEQ ID NO: 785822 - DNA, 22 bp, Artificial Sequence
  chemically synthesized
ccaggactctagttcagggagt

SEQ ID NO: 785823 - DNA, 22 bp, Artificial Sequence
  chemically synthesized
agataaatactccctgaactag

SEQ ID NO: 785824 - DNA, 22 bp, Artificial Sequence
  chemically synthesized
gataaatactccctgaactaga

SEQ ID NO: 785825 - DNA, 22 bp, Artificial Sequence
  chemically synthesized
aaggtttccaggactctagttc

SEQ ID NO: 785826 - DNA, 22 bp, Artificial Sequence
  chemically synthesized
gccacctaaaggtttccaggac

SEQ ID NO: 785827 - DNA, 22 bp, Artificial Sequence
  chemically synthesized
cctgaactagagtcctggaaac

SEQ ID NO: 785828 - DNA, 22 bp, Artificial Sequence
  chemically synthesized
ggccacctaaaggtttccagga

SEQ ID NO: 785829 - DNA, 22 bp, Artificial Sequence
  chemically synthesized
aactagagtcctggaaaccttt

SEQ ID NO: 785830 - DNA, 22 bp, Artificial Sequence
  chemically synthesized
gagtcctggaaacctttaggtg

SEQ ID NO: 785831 - DNA, 22 bp, Artificial Sequence
  chemically synthesized
gaataagtcttggccacctaaa

SEQ ID NO: 785832 - DNA, 22 bp, Artificial Sequence
  chemically synthesized
agaataagtcttggccacctaa

SEQ ID NO: 785833 - DNA, 22 bp, Artificial Sequence
  chemically synthesized
tagaataagtcttggccaccta

SEQ ID NO: 785834 - DNA, 22 bp, Artificial Sequence
  chemically synthesized
tttagaataagtcttggccacc

SEQ ID NO: 785835 - DNA, 22 bp, Artificial Sequence
  chemically synthesized
gaaacctttaggtggccaagac

SEQ ID NO: 785836 - DNA, 22 bp, Artificial Sequence
  chemically synthesized
gcaattctttagaataagtctt

SEQ ID NO: 785837 - DNA, 22 bp, Artificial Sequence
  chemically synthesized
agcaattctttagaataagtct

SEQ ID NO: 785838 - DNA, 22 bp, Artificial Sequence
  chemically synthesized
tagcaattctttagaataagtc

SEQ ID NO: 785839 - DNA, 22 bp, Artificial Sequence
  chemically synthesized
taggtggccaagacttattcta

SEQ ID NO: 785840 - DNA, 22 bp, Artificial Sequence
  chemically synthesized
ttagcaattctttagaataagt

SEQ ID NO: 785841 - DNA, 22 bp, Artificial Sequence
  chemically synthesized
aggtggccaagacttattctaa

SEQ ID NO: 785842 - DNA, 22 bp, Artificial Sequence
  chemically synthesized
ggtggccaagacttattctaaa

SEQ ID NO: 785843 - DNA, 22 bp, Artificial Sequence
  chemically synthesized
aaagaaaataatttttagcaat

SEQ ID NO: 785844 - DNA, 22 bp, Artificial Sequence
  chemically synthesized
aaaagaaaataatttttagcaa

SEQ ID NO: 785845 - DNA, 22 bp, Artificial Sequence
  chemically synthesized
attctaaagaattgctaaaaat

SEQ ID NO: 785846 - DNA, 22 bp, Artificial Sequence
  chemically synthesized
taaaagaaaataatttttagca

SEQ ID NO: 785847 - DNA, 22 bp, Artificial Sequence
  chemically synthesized
ttctaaagaattgctaaaaatt

SEQ ID NO: 785848 - DNA, 22 bp, Artificial Sequence
  chemically synthesized
ttaaaagaaaataatttttagc

SEQ ID NO: 785849 - DNA, 22 bp, Artificial Sequence
  chemically synthesized
ttttaaaagaaaataattttta

SEQ ID NO: 785850 - DNA, 22 bp, Artificial Sequence
  chemically synthesized
taaagaattgctaaaaattatt

SEQ ID NO: 785851 - DNA, 22 bp, Artificial Sequence
  chemically synthesized
aagaattgctaaaaattatttt

SEQ ID NO: 785852 - DNA, 22 bp, Artificial Sequence
  chemically synthesized
ccggcatctcttttaaaagaaa

SEQ ID NO: 785853 - DNA, 22 bp, Artificial Sequence
  chemically synthesized
ctaaaaattattttcttttaaa

SEQ ID NO: 785854 - DNA, 22 bp, Artificial Sequence
  chemically synthesized
ctcccggcatctcttttaaaag

SEQ ID NO: 785855 - DNA, 22 bp, Artificial Sequence
  chemically synthesized
aaaattattttcttttaaaaga

SEQ ID NO: 785856 - DNA, 22 bp, Artificial Sequence
  chemically synthesized
tcctcccggcatctcttttaaa

SEQ ID NO: 785857 - DNA, 22 bp, Artificial Sequence
  chemically synthesized
tctcctcccggcatctctttta

SEQ ID NO: 785858 - DNA, 22 bp, Artificial Sequence
  chemically synthesized
tctctcctcccggcatctcttt

SEQ ID NO: 785859 - DNA, 22 bp, Artificial Sequence
  chemically synthesized
ttttcttttaaaagagatgccg

SEQ ID NO: 785860 - DNA, 22 bp, Artificial Sequence
  chemically synthesized
ctctctctcctcccggcatctc

SEQ ID NO: 785861 - DNA, 22 bp, Artificial Sequence
  chemically synthesized
tcttttaaaagagatgccggga

SEQ ID NO: 785862 - DNA, 22 bp, Artificial Sequence
  chemically synthesized
cttttaaaagagatgccgggag

SEQ ID NO: 785863 - DNA, 22 bp, Artificial Sequence
  chemically synthesized
ctcctctctctcctcccggcat

SEQ ID NO: 785864 - DNA, 22 bp, Artificial Sequence
  chemically synthesized
ttttaaaagagatgccgggagg

SEQ ID NO: 785865 - DNA, 22 bp, Artificial Sequence
  chemically synthesized
tgctcctctctctcctcccggc

SEQ ID NO: 785866 - DNA, 22 bp, Artificial Sequence
  chemically synthesized
ttaaaagagatgccgggaggag

SEQ ID NO: 785867 - DNA, 22 bp, Artificial Sequence
  chemically synthesized
ctgctcctctctctcctcccgg

SEQ ID NO: 785868 - DNA, 22 bp, Artificial Sequence
  chemically synthesized
taaaagagatgccgggaggaga

SEQ ID NO: 785869 - DNA, 22 bp, Artificial Sequence
  chemically synthesized
tctgctcctctctctcctcccg

SEQ ID NO: 785870 - DNA, 22 bp, Artificial Sequence
  chemically synthesized
aaaagagatgccgggaggagag

SEQ ID NO: 785871 - DNA, 22 bp, Artificial Sequence
  chemically synthesized
ttctgctcctctctctcctccc

SEQ ID NO: 785872 - DNA, 22 bp, Artificial Sequence
  chemically synthesized
aaagagatgccgggaggagaga

SEQ ID NO: 785873 - DNA, 22 bp, Artificial Sequence
  chemically synthesized
tcttttctgctcctctctctcc

SEQ ID NO: 785874 - DNA, 22 bp, Artificial Sequence
  chemically synthesized
agtagttatcttttctgctcct

SEQ ID NO: 785875 - DNA, 22 bp, Artificial Sequence
  chemically synthesized
ctcagtagttatcttttctgct

SEQ ID NO: 785876 - DNA, 22 bp, Artificial Sequence
  chemically synthesized
agccaactactcagtagttatc

SEQ ID NO: 785877 - DNA, 22 bp, Artificial Sequence
  chemically synthesized
accaccgaggtattaagccaac

SEQ ID NO: 785878 - DNA, 22 bp, Artificial Sequence
  chemically synthesized
caccaccgaggtattaagccaa

SEQ ID NO: 785879 - DNA, 22 bp, Artificial Sequence
  chemically synthesized
tttcaccaccgaggtattaagc

SEQ ID NO: 785880 - DNA, 22 bp, Artificial Sequence
  chemically synthesized
ctgagtagttggcttaatacct

SEQ ID NO: 785881 - DNA, 22 bp, Artificial Sequence
  chemically synthesized
atttcaccaccgaggtattaag

SEQ ID NO: 785882 - DNA, 22 bp, Artificial Sequence
  chemically synthesized
tatttcaccaccgaggtattaa

SEQ ID NO: 785883 - DNA, 22 bp, Artificial Sequence
  chemically synthesized
agtagttggcttaatacctcgg

SEQ ID NO: 785884 - DNA, 22 bp, Artificial Sequence
  chemically synthesized
cattttatttcaccaccgaggt

SEQ ID NO: 785885 - DNA, 22 bp, Artificial Sequence
  chemically synthesized
acattttatttcaccaccgagg

SEQ ID NO: 785886 - DNA, 22 bp, Artificial Sequence
  chemically synthesized
tacattttatttcaccaccgag

SEQ ID NO: 785887 - DNA, 22 bp, Artificial Sequence
  chemically synthesized
gcttaatacctcggtggtgaaa

SEQ ID NO: 785888 - DNA, 22 bp, Artificial Sequence
  chemically synthesized
aatacctcggtggtgaaataaa

SEQ ID NO: 785889 - DNA, 22 bp, Artificial Sequence
  chemically synthesized
atacctcggtggtgaaataaaa

SEQ ID NO: 785890 - DNA, 22 bp, Artificial Sequence
  chemically synthesized
ggtggtgaaataaaatgtaaaa

SEQ ID NO: 785891 - DNA, 22 bp, Artificial Sequence
  chemically synthesized
cataggcaaaccggtgtcacag

SEQ ID NO: 785892 - DNA, 22 bp, Artificial Sequence
  chemically synthesized
ttacataggcaaaccggtgtca

SEQ ID NO: 785893 - DNA, 22 bp, Artificial Sequence
  chemically synthesized
attacataggcaaaccggtgtc

SEQ ID NO: 785894 - DNA, 22 bp, Artificial Sequence
  chemically synthesized
tgacaccggtttgcctatgtaa

SEQ ID NO: 785895 - DNA, 22 bp, Artificial Sequence
  chemically synthesized
tggggtacatgtgaaggtttat

SEQ ID NO: 785896 - DNA, 22 bp, Artificial Sequence
  chemically synthesized
gtggggtacatgtgaaggttta

SEQ ID NO: 785897 - DNA, 22 bp, Artificial Sequence
  chemically synthesized
gcctatgtaataaaccttcaca

SEQ ID NO: 785898 - DNA, 22 bp, Artificial Sequence
  chemically synthesized
cctatgtaataaaccttcacat

SEQ ID NO: 785899 - DNA, 22 bp, Artificial Sequence
  chemically synthesized
ggtttgtggggtacatgtgaag

SEQ ID NO: 785900 - DNA, 22 bp, Artificial Sequence
  chemically synthesized
aggtttgtggggtacatgtgaa

SEQ ID NO: 785901 - DNA, 22 bp, Artificial Sequence
  chemically synthesized
tgtaataaaccttcacatgtac

SEQ ID NO: 785902 - DNA, 22 bp, Artificial Sequence
  chemically synthesized
taggtttgtggggtacatgtga

SEQ ID NO: 785903 - DNA, 22 bp, Artificial Sequence
  chemically synthesized
ttttaggtttgtggggtacatg

SEQ ID NO: 785904 - DNA, 22 bp, Artificial Sequence
  chemically synthesized
attttaggtttgtggggtacat

SEQ ID NO: 785905 - DNA, 22 bp, Artificial Sequence
  chemically synthesized
tattttaggtttgtggggtaca

SEQ ID NO: 785906 - DNA, 22 bp, Artificial Sequence
  chemically synthesized
ttattttaggtttgtggggtac

SEQ ID NO: 785907 - DNA, 22 bp, Artificial Sequence
  chemically synthesized
acttttattttaggtttgtggg

SEQ ID NO: 785908 - DNA, 22 bp, Artificial Sequence
  chemically synthesized
aacttttattttaggtttgtgg

SEQ ID NO: 785909 - DNA, 22 bp, Artificial Sequence
  chemically synthesized
taacttttattttaggtttgtg

SEQ ID NO: 785910 - DNA, 22 bp, Artificial Sequence
  chemically synthesized
cacatgtaccccacaaacctaa

SEQ ID NO: 785911 - DNA, 22 bp, Artificial Sequence
  chemically synthesized
ttaacttttattttaggtttgt

SEQ ID NO: 785912 - DNA, 22 bp, Artificial Sequence
  chemically synthesized
acatgtaccccacaaacctaaa

SEQ ID NO: 785913 - DNA, 22 bp, Artificial Sequence
  chemically synthesized
tttaacttttattttaggtttg

SEQ ID NO: 785914 - DNA, 22 bp, Artificial Sequence
  chemically synthesized
ttttaacttttattttaggttt

SEQ ID NO: 785915 - DNA, 22 bp, Artificial Sequence
  chemically synthesized
atttttttaacttttattttag

SEQ ID NO: 785916 - DNA, 22 bp, Artificial Sequence
  chemically synthesized
catttttttaacttttatttta

SEQ ID NO: 785917 - DNA, 22 bp, Artificial Sequence
  chemically synthesized
tcatttttttaacttttatttt

SEQ ID NO: 785918 - DNA, 22 bp, Artificial Sequence
  chemically synthesized
ttcatttttttaacttttattt

SEQ ID NO: 785919 - DNA, 22 bp, Artificial Sequence
  chemically synthesized
ttttcatttttttaacttttat

SEQ ID NO: 785920 - DNA, 22 bp, Artificial Sequence
  chemically synthesized
ttcttttcatttttttaacttt

SEQ ID NO: 785921 - DNA, 22 bp, Artificial Sequence
  chemically synthesized
ctattcttttcatttttttaac

SEQ ID NO: 785922 - DNA, 22 bp, Artificial Sequence
  chemically synthesized
ttcctattcttttcattttttt

SEQ ID NO: 785923 - DNA, 22 bp, Artificial Sequence
  chemically synthesized
aaataaaagttaaaaaaatgaa

SEQ ID NO: 785924 - DNA, 22 bp, Artificial Sequence
  chemically synthesized
atctattcctattcttttcatt

SEQ ID NO: 785925 - DNA, 22 bp, Artificial Sequence
  chemically synthesized
aatctattcctattcttttcat

SEQ ID NO: 785926 - DNA, 22 bp, Artificial Sequence
  chemically synthesized
taatctattcctattcttttca

SEQ ID NO: 785927 - DNA, 22 bp, Artificial Sequence
  chemically synthesized
ttaatctattcctattcttttc

SEQ ID NO: 785928 - DNA, 22 bp, Artificial Sequence
  chemically synthesized
tttaatctattcctattctttt

SEQ ID NO: 785929 - DNA, 22 bp, Artificial Sequence
  chemically synthesized
ttttttaatctattcctattct

SEQ ID NO: 785930 - DNA, 22 bp, Artificial Sequence
  chemically synthesized
aaaaaatgaaaagaataggaat

SEQ ID NO: 785931 - DNA, 22 bp, Artificial Sequence
  chemically synthesized
attttttaatctattcctattc

SEQ ID NO: 785932 - DNA, 22 bp, Artificial Sequence
  chemically synthesized
tattttttaatctattcctatt

SEQ ID NO: 785933 - DNA, 22 bp, Artificial Sequence
  chemically synthesized
ttattttttaatctattcctat

SEQ ID NO: 785934 - DNA, 22 bp, Artificial Sequence
  chemically synthesized
tttttattttttaatctattcc

SEQ ID NO: 785935 - DNA, 22 bp, Artificial Sequence
  chemically synthesized
atttttattttttaatctattc

SEQ ID NO: 785936 - DNA, 22 bp, Artificial Sequence
  chemically synthesized
tatttttattttttaatctatt

SEQ ID NO: 785937 - DNA, 22 bp, Artificial Sequence
  chemically synthesized
ttatttttattttttaatctat

SEQ ID NO: 785938 - DNA, 22 bp, Artificial Sequence
  chemically synthesized
tatgtgaaatcacttttatttt

SEQ ID NO: 785939 - DNA, 22 bp, Artificial Sequence
  chemically synthesized
ttatatgtgaaatcacttttat

SEQ ID NO: 785940 - DNA, 22 bp, Artificial Sequence
  chemically synthesized
gttatatgtgaaatcactttta

SEQ ID NO: 785941 - DNA, 22 bp, Artificial Sequence
  chemically synthesized
aaaaataaaaataaaagtgatt

SEQ ID NO: 785942 - DNA, 22 bp, Artificial Sequence
  chemically synthesized
tgcaatgataggaaacatttgt

SEQ ID NO: 785943 - DNA, 22 bp, Artificial Sequence
  chemically synthesized
atgcaatgataggaaacatttg

SEQ ID NO: 785944 - DNA, 22 bp, Artificial Sequence
  chemically synthesized
cacatataacaaatgtttccta

SEQ ID NO: 785945 - DNA, 22 bp, Artificial Sequence
  chemically synthesized
acatataacaaatgtttcctat

SEQ ID NO: 785946 - DNA, 22 bp, Artificial Sequence
  chemically synthesized
ccttatgcaatgataggaaaca

SEQ ID NO: 785947 - DNA, 22 bp, Artificial Sequence
  chemically synthesized
agcagcattgccttatgcaatg

SEQ ID NO: 785948 - DNA, 22 bp, Artificial Sequence
  chemically synthesized
ttaagcagcattgccttatgca

SEQ ID NO: 785949 - DNA, 22 bp, Artificial Sequence
  chemically synthesized
attaagcagcattgccttatgc

SEQ ID NO: 785950 - DNA, 22 bp, Artificial Sequence
  chemically synthesized
tattaagcagcattgccttatg

SEQ ID NO: 785951 - DNA, 22 bp, Artificial Sequence
  chemically synthesized
ttattaagcagcattgccttat

SEQ ID NO: 785952 - DNA, 22 bp, Artificial Sequence
  chemically synthesized
cctatcattgcataaggcaatg

SEQ ID NO: 785953 - DNA, 22 bp, Artificial Sequence
  chemically synthesized
ctatcattgcataaggcaatgc

SEQ ID NO: 785954 - DNA, 22 bp, Artificial Sequence
  chemically synthesized
ttttattaagcagcattgcctt

SEQ ID NO: 785955 - DNA, 22 bp, Artificial Sequence
  chemically synthesized
cttttattaagcagcattgcct

SEQ ID NO: 785956 - DNA, 22 bp, Artificial Sequence
  chemically synthesized
tcttttattaagcagcattgcc

SEQ ID NO: 785957 - DNA, 22 bp, Artificial Sequence
  chemically synthesized
tcattgcataaggcaatgctgc

SEQ ID NO: 785958 - DNA, 22 bp, Artificial Sequence
  chemically synthesized
ttcttttattaagcagcattgc

SEQ ID NO: 785959 - DNA, 22 bp, Artificial Sequence
  chemically synthesized
aatttttcttttattaagcagc

SEQ ID NO: 785960 - DNA, 22 bp, Artificial Sequence
  chemically synthesized
cataaggcaatgctgcttaata

SEQ ID NO: 785961 - DNA, 22 bp, Artificial Sequence
  chemically synthesized
tactaaatttttcttttattaa

SEQ ID NO: 785962 - DNA, 22 bp, Artificial Sequence
  chemically synthesized
ctatactaaatttttcttttat

SEQ ID NO: 785963 - DNA, 22 bp, Artificial Sequence
  chemically synthesized
tactatactaaatttttctttt

SEQ ID NO: 785964 - DNA, 22 bp, Artificial Sequence
  chemically synthesized
cttaataaaagaaaaatttagt

SEQ ID NO: 785965 - DNA, 22 bp, Artificial Sequence
  chemically synthesized
aataaaagaaaaatttagtata

SEQ ID NO: 785966 - DNA, 22 bp, Artificial Sequence
  chemically synthesized
ataaaagaaaaatttagtatag

SEQ ID NO: 785967 - DNA, 22 bp, Artificial Sequence
  chemically synthesized
cggcacgattctactatactaa

SEQ ID NO: 785968 - DNA, 22 bp, Artificial Sequence
  chemically synthesized
atgactgcggcacgattctact

SEQ ID NO: 785969 - DNA, 22 bp, Artificial Sequence
  chemically synthesized
tcatgactgcggcacgattcta

SEQ ID NO: 785970 - DNA, 22 bp, Artificial Sequence
  chemically synthesized
ctcatgactgcggcacgattct

SEQ ID NO: 785971 - DNA, 22 bp, Artificial Sequence
  chemically synthesized
cttctcatgactgcggcacgat

SEQ ID NO: 785972 - DNA, 22 bp, Artificial Sequence
  chemically synthesized
agtatagtagaatcgtgccgca

SEQ ID NO: 785973 - DNA, 22 bp, Artificial Sequence
  chemically synthesized
gtatagtagaatcgtgccgcag

SEQ ID NO: 785974 - DNA, 22 bp, Artificial Sequence
  chemically synthesized
agagaaatggggaagggttgct

SEQ ID NO: 785975 - DNA, 22 bp, Artificial Sequence
  chemically synthesized
gttaagagaaatggggaagggt

SEQ ID NO: 785976 - DNA, 22 bp, Artificial Sequence
  chemically synthesized
aaggtgtgttggttaagagaaa

SEQ ID NO: 785977 - DNA, 22 bp, Artificial Sequence
  chemically synthesized
ccccatttctcttaaccaacac

SEQ ID NO: 785978 - DNA, 22 bp, Artificial Sequence
  chemically synthesized
cccatttctcttaaccaacaca

SEQ ID NO: 785979 - DNA, 22 bp, Artificial Sequence
  chemically synthesized
atggattcaaggtgtgttggtt

SEQ ID NO: 785980 - DNA, 22 bp, Artificial Sequence
  chemically synthesized
gatggattcaaggtgtgttggt

SEQ ID NO: 785981 - DNA, 22 bp, Artificial Sequence
  chemically synthesized
atttgatggattcaaggtgtgt

SEQ ID NO: 785982 - DNA, 22 bp, Artificial Sequence
  chemically synthesized
aatttgatggattcaaggtgtg

SEQ ID NO: 785983 - DNA, 22 bp, Artificial Sequence
  chemically synthesized
ctcttaaccaacacaccttgaa

SEQ ID NO: 785984 - DNA, 22 bp, Artificial Sequence
  chemically synthesized
tcttaaccaacacaccttgaat

SEQ ID NO: 785985 - DNA, 22 bp, Artificial Sequence
  chemically synthesized
ttaaccaacacaccttgaatcc

SEQ ID NO: 785986 - DNA, 22 bp, Artificial Sequence
  chemically synthesized
aaccaacacaccttgaatccat

SEQ ID NO: 785987 - DNA, 22 bp, Artificial Sequence
  chemically synthesized
accaacacaccttgaatccatc

SEQ ID NO: 785988 - DNA, 22 bp, Artificial Sequence
  chemically synthesized
tgcaagaatttaatttgatgga

SEQ ID NO: 785989 - DNA, 22 bp, Artificial Sequence
  chemically synthesized
atgcaagaatttaatttgatgg

SEQ ID NO: 785990 - DNA, 22 bp, Artificial Sequence
  chemically synthesized
ttatgcaagaatttaatttgat

SEQ ID NO: 785991 - DNA, 22 bp, Artificial Sequence
  chemically synthesized
cctcttatgcaagaatttaatt

SEQ ID NO: 785992 - DNA, 22 bp, Artificial Sequence
  chemically synthesized
gaatccatcaaattaaattctt

SEQ ID NO: 785993 - DNA, 22 bp, Artificial Sequence
  chemically synthesized
aatccatcaaattaaattcttg

SEQ ID NO: 785994 - DNA, 22 bp, Artificial Sequence
  chemically synthesized
aaggtggttacctcttatgcaa

SEQ ID NO: 785995 - DNA, 22 bp, Artificial Sequence
  chemically synthesized
aattcttgcataagaggtaacc

SEQ ID NO: 785996 - DNA, 22 bp, Artificial Sequence
  chemically synthesized
ttgcataagaggtaaccacctt

SEQ ID NO: 785997 - DNA, 22 bp, Artificial Sequence
  chemically synthesized
agaaagaaatctgaaggtggtt

SEQ ID NO: 785998 - DNA, 22 bp, Artificial Sequence
  chemically synthesized
gcataagaggtaaccaccttca

SEQ ID NO: 785999 - DNA, 22 bp, Artificial Sequence
  chemically synthesized
cataagaggtaaccaccttcag

SEQ ID NO: 786000 - DNA, 22 bp, Artificial Sequence
  chemically synthesized
gagatacaggtctaagaaagaa

SEQ ID NO: 786001 - DNA, 22 bp, Artificial Sequence
  chemically synthesized
agagatacaggtctaagaaaga

SEQ ID NO: 786002 - DNA, 22 bp, Artificial Sequence
  chemically synthesized
tagagatacaggtctaagaaag

SEQ ID NO: 786003 - DNA, 22 bp, Artificial Sequence
  chemically synthesized
ttagagatacaggtctaagaaa

SEQ ID NO: 786004 - DNA, 22 bp, Artificial Sequence
  chemically synthesized
ttttagagatacaggtctaaga

SEQ ID NO: 786005 - DNA, 22 bp, Artificial Sequence
  chemically synthesized
cttttagagatacaggtctaag

SEQ ID NO: 786006 - DNA, 22 bp, Artificial Sequence
  chemically synthesized
cagatttctttcttagacctgt

SEQ ID NO: 786007 - DNA, 22 bp, Artificial Sequence
  chemically synthesized
tcttttagagatacaggtctaa

SEQ ID NO: 786008 - DNA, 22 bp, Artificial Sequence
  chemically synthesized
agatttctttcttagacctgta

SEQ ID NO: 786009 - DNA, 22 bp, Artificial Sequence
  chemically synthesized
ctttcttagacctgtatctcta

SEQ ID NO: 786010 - DNA, 22 bp, Artificial Sequence
  chemically synthesized
tttcttagacctgtatctctaa

SEQ ID NO: 786011 - DNA, 22 bp, Artificial Sequence
  chemically synthesized
tcttagacctgtatctctaaaa

SEQ ID NO: 786012 - DNA, 22 bp, Artificial Sequence
  chemically synthesized
cttagacctgtatctctaaaag

SEQ ID NO: 786013 - DNA, 22 bp, Artificial Sequence
  chemically synthesized
ttagacctgtatctctaaaaga

SEQ ID NO: 786014 - DNA, 22 bp, Artificial Sequence
  chemically synthesized
agacctgtatctctaaaagaaa

SEQ ID NO: 786015 - DNA, 22 bp, Artificial Sequence
  chemically synthesized
gacctgtatctctaaaagaaaa

SEQ ID NO: 786016 - DNA, 22 bp, Artificial Sequence
  chemically synthesized
aagtggtaaggatgttttcttt

SEQ ID NO: 786017 - DNA, 22 bp, Artificial Sequence
  chemically synthesized
tatctctaaaagaaaacatcct

SEQ ID NO: 786018 - DNA, 22 bp, Artificial Sequence
  chemically synthesized
cactaaagtggtaaggatgttt

SEQ ID NO: 786019 - DNA, 22 bp, Artificial Sequence
  chemically synthesized
taaaagaaaacatccttaccac

SEQ ID NO: 786020 - DNA, 22 bp, Artificial Sequence
  chemically synthesized
aaagaaaacatccttaccactt

SEQ ID NO: 786021 - DNA, 22 bp, Artificial Sequence
  chemically synthesized
aaagccaggccagtctgcacta

SEQ ID NO: 786022 - DNA, 22 bp, Artificial Sequence
  chemically synthesized
accactttagtgcagactggcc

SEQ ID NO: 786023 - DNA, 22 bp, Artificial Sequence
  chemically synthesized
ccactttagtgcagactggcct

SEQ ID NO: 786024 - DNA, 22 bp, Artificial Sequence
  chemically synthesized
atagttgaaagccaggccagtc

SEQ ID NO: 786025 - DNA, 22 bp, Artificial Sequence
  chemically synthesized
tagtgcagactggcctggcttt

SEQ ID NO: 786026 - DNA, 22 bp, Artificial Sequence
  chemically synthesized
agtgcagactggcctggctttc

SEQ ID NO: 786027 - DNA, 22 bp, Artificial Sequence
  chemically synthesized
gtgcagactggcctggctttca

SEQ ID NO: 786028 - DNA, 22 bp, Artificial Sequence
  chemically synthesized
gcctggctttcaactatgagga

SEQ ID NO: 786029 - DNA, 22 bp, Artificial Sequence
  chemically synthesized
gctttcaactatgaggatccac

SEQ ID NO: 786030 - DNA, 22 bp, Artificial Sequence
  chemically synthesized
gggaaaaaaaatgtggatcctc

SEQ ID NO: 786031 - DNA, 22 bp, Artificial Sequence
  chemically synthesized
tcaactatgaggatccacattt

SEQ ID NO: 786032 - DNA, 22 bp, Artificial Sequence
  chemically synthesized
caactatgaggatccacatttt

SEQ ID NO: 786033 - DNA, 22 bp, Artificial Sequence
  chemically synthesized
aactatgaggatccacattttt

SEQ ID NO: 786034 - DNA, 22 bp, Artificial Sequence
  chemically synthesized
aagccattagggaaaaaaaatg

SEQ ID NO: 786035 - DNA, 22 bp, Artificial Sequence
  chemically synthesized
tgaggatccacattttttttcc

SEQ ID NO: 786036 - DNA, 22 bp, Artificial Sequence
  chemically synthesized
tttttccctaatggctttagac

SEQ ID NO: 786037 - DNA, 22 bp, Artificial Sequence
  chemically synthesized
tgtccagagtatgtctaaagcc

SEQ ID NO: 786038 - DNA, 22 bp, Artificial Sequence
  chemically synthesized
ttttccctaatggctttagaca

SEQ ID NO: 786039 - DNA, 22 bp, Artificial Sequence
  chemically synthesized
gtgtccagagtatgtctaaagc

SEQ ID NO: 786040 - DNA, 22 bp, Artificial Sequence
  chemically synthesized
tttccctaatggctttagacat

SEQ ID NO: 786041 - DNA, 22 bp, Artificial Sequence
  chemically synthesized
tgtgtccagagtatgtctaaag

SEQ ID NO: 786042 - DNA, 22 bp, Artificial Sequence
  chemically synthesized
ttccctaatggctttagacata

SEQ ID NO: 786043 - DNA, 22 bp, Artificial Sequence
  chemically synthesized
tccctaatggctttagacatac

SEQ ID NO: 786044 - DNA, 22 bp, Artificial Sequence
  chemically synthesized
ccctaatggctttagacatact

SEQ ID NO: 786045 - DNA, 22 bp, Artificial Sequence
  chemically synthesized
ttttgtgtccagagtatgtcta

SEQ ID NO: 786046 - DNA, 22 bp, Artificial Sequence
  chemically synthesized
cctaatggctttagacatactc

SEQ ID NO: 786047 - DNA, 22 bp, Artificial Sequence
  chemically synthesized
atggctttagacatactctgga

SEQ ID NO: 786048 - DNA, 22 bp, Artificial Sequence
  chemically synthesized
tagacatactctggacacaaaa

SEQ ID NO: 786049 - DNA, 22 bp, Artificial Sequence
  chemically synthesized
agacatactctggacacaaaat

SEQ ID NO: 786050 - DNA, 22 bp, Artificial Sequence
  chemically synthesized
gcaagaaaaattattttgtgtc

SEQ ID NO: 786051 - DNA, 22 bp, Artificial Sequence
  chemically synthesized
gacatactctggacacaaaata

SEQ ID NO: 786052 - DNA, 22 bp, Artificial Sequence
  chemically synthesized
ggcaagaaaaattattttgtgt

SEQ ID NO: 786053 - DNA, 22 bp, Artificial Sequence
  chemically synthesized
tggacacaaaataatttttctt

SEQ ID NO: 786054 - DNA, 22 bp, Artificial Sequence
  chemically synthesized
gacacaaaataatttttcttgc

SEQ ID NO: 786055 - DNA, 22 bp, Artificial Sequence
  chemically synthesized
gcataccaccttggcaagaaaa

SEQ ID NO: 786056 - DNA, 22 bp, Artificial Sequence
  chemically synthesized
tggcataccaccttggcaagaa

SEQ ID NO: 786057 - DNA, 22 bp, Artificial Sequence
  chemically synthesized
ctggcataccaccttggcaaga

SEQ ID NO: 786058 - DNA, 22 bp, Artificial Sequence
  chemically synthesized
gcatttctggcataccaccttg

SEQ ID NO: 786059 - DNA, 22 bp, Artificial Sequence
  chemically synthesized
ctagcatttctggcataccacc

SEQ ID NO: 786060 - DNA, 22 bp, Artificial Sequence
  chemically synthesized
cctagcatttctggcataccac

SEQ ID NO: 786061 - DNA, 22 bp, Artificial Sequence
  chemically synthesized
ttcttgccaaggtggtatgcca

SEQ ID NO: 786062 - DNA, 22 bp, Artificial Sequence
  chemically synthesized
tcctagcatttctggcatacca

SEQ ID NO: 786063 - DNA, 22 bp, Artificial Sequence
  chemically synthesized
tcttgccaaggtggtatgccag

SEQ ID NO: 786064 - DNA, 22 bp, Artificial Sequence
  chemically synthesized
cttgccaaggtggtatgccaga

SEQ ID NO: 786065 - DNA, 22 bp, Artificial Sequence
  chemically synthesized
ttgccaaggtggtatgccagaa

SEQ ID NO: 786066 - DNA, 22 bp, Artificial Sequence
  chemically synthesized
ttttcctagcatttctggcata

SEQ ID NO: 786067 - DNA, 22 bp, Artificial Sequence
  chemically synthesized
gccaaggtggtatgccagaaat

SEQ ID NO: 786068 - DNA, 22 bp, Artificial Sequence
  chemically synthesized
ccaaggtggtatgccagaaatg

SEQ ID NO: 786069 - DNA, 22 bp, Artificial Sequence
  chemically synthesized
caacgggggaattattttccta

SEQ ID NO: 786070 - DNA, 22 bp, Artificial Sequence
  chemically synthesized
ccaacgggggaattattttcct

SEQ ID NO: 786071 - DNA, 22 bp, Artificial Sequence
  chemically synthesized
cttccaacgggggaattatttt

SEQ ID NO: 786072 - DNA, 22 bp, Artificial Sequence
  chemically synthesized
ggactgcttccaacgggggaat

SEQ ID NO: 786073 - DNA, 22 bp, Artificial Sequence
  chemically synthesized
aggactgcttccaacgggggaa

SEQ ID NO: 786074 - DNA, 22 bp, Artificial Sequence
  chemically synthesized
ggaaaataattcccccgttgga

SEQ ID NO: 786075 - DNA, 22 bp, Artificial Sequence
  chemically synthesized
gtttaggactgcttccaacggg

SEQ ID NO: 786076 - DNA, 22 bp, Artificial Sequence
  chemically synthesized
gtcattggtttaggactgcttc

SEQ ID NO: 786077 - DNA, 22 bp, Artificial Sequence
  chemically synthesized
ctagtcattggtttaggactgc

SEQ ID NO: 786078 - DNA, 22 bp, Artificial Sequence
  chemically synthesized
ccccgttggaagcagtcctaaa

SEQ ID NO: 786079 - DNA, 22 bp, Artificial Sequence
  chemically synthesized
gaagcagtcctaaaccaatgac

SEQ ID NO: 786080 - DNA, 22 bp, Artificial Sequence
  chemically synthesized
tacacaaaatcctgctagtcat

SEQ ID NO: 786081 - DNA, 22 bp, Artificial Sequence
  chemically synthesized
atacacaaaatcctgctagtca

SEQ ID NO: 786082 - DNA, 22 bp, Artificial Sequence
  chemically synthesized
aaccaatgactagcaggatttt

SEQ ID NO: 786083 - DNA, 22 bp, Artificial Sequence
  chemically synthesized
gggtatttatacacaaaatcct

SEQ ID NO: 786084 - DNA, 22 bp, Artificial Sequence
  chemically synthesized
gcaggattttgtgtataaatac

SEQ ID NO: 786085 - DNA, 22 bp, Artificial Sequence
  chemically synthesized
aaaggggcaagggagctggggt

SEQ ID NO: 786086 - DNA, 22 bp, Artificial Sequence
  chemically synthesized
tgtgtataaataccccagctcc

SEQ ID NO: 786087 - DNA, 22 bp, Artificial Sequence
  chemically synthesized
caaaggggcaagggagctgggg

SEQ ID NO: 786088 - DNA, 22 bp, Artificial Sequence
  chemically synthesized
gtgtataaataccccagctccc

SEQ ID NO: 786089 - DNA, 22 bp, Artificial Sequence
  chemically synthesized
tcaaaggggcaagggagctggg

SEQ ID NO: 786090 - DNA, 22 bp, Artificial Sequence
  chemically synthesized
tgtataaataccccagctccct

SEQ ID NO: 786091 - DNA, 22 bp, Artificial Sequence
  chemically synthesized
tttcaaaggggcaagggagctg

SEQ ID NO: 786092 - DNA, 22 bp, Artificial Sequence
  chemically synthesized
ttctttcaaaggggcaagggag

SEQ ID NO: 786093 - DNA, 22 bp, Artificial Sequence
  chemically synthesized
gttattctttcaaaggggcaag

SEQ ID NO: 786094 - DNA, 22 bp, Artificial Sequence
  chemically synthesized
agagttagttattctttcaaag

SEQ ID NO: 786095 - DNA, 22 bp, Artificial Sequence
  chemically synthesized
aagagttagttattctttcaaa

SEQ ID NO: 786096 - DNA, 22 bp, Artificial Sequence
  chemically synthesized
ccttgcccctttgaaagaataa

SEQ ID NO: 786097 - DNA, 22 bp, Artificial Sequence
  chemically synthesized
gcccctttgaaagaataactaa

SEQ ID NO: 786098 - DNA, 22 bp, Artificial Sequence
  chemically synthesized
cccctttgaaagaataactaac

SEQ ID NO: 786099 - DNA, 22 bp, Artificial Sequence
  chemically synthesized
aagacatgtgtttaagagttag

SEQ ID NO: 786100 - DNA, 22 bp, Artificial Sequence
  chemically synthesized
tgaaagaataactaactcttaa

SEQ ID NO: 786101 - DNA, 22 bp, Artificial Sequence
  chemically synthesized
gaaagaataactaactcttaaa

SEQ ID NO: 786102 - DNA, 22 bp, Artificial Sequence
  chemically synthesized
aaagaataactaactcttaaac

SEQ ID NO: 786103 - DNA, 22 bp, Artificial Sequence
  chemically synthesized
aatggattgaagacatgtgttt

SEQ ID NO: 786104 - DNA, 22 bp, Artificial Sequence
  chemically synthesized
taaatggattgaagacatgtgt

SEQ ID NO: 786105 - DNA, 22 bp, Artificial Sequence
  chemically synthesized
actcttaaacacatgtcttcaa

SEQ ID NO: 786106 - DNA, 22 bp, Artificial Sequence
  chemically synthesized
ttaaacacatgtcttcaatcca

SEQ ID NO: 786107 - DNA, 22 bp, Artificial Sequence
  chemically synthesized
gggaaattctaaatggattgaa

SEQ ID NO: 786108 - DNA, 22 bp, Artificial Sequence
  chemically synthesized
aaacacatgtcttcaatccatt

SEQ ID NO: 786109 - DNA, 22 bp, Artificial Sequence
  chemically synthesized
aacacatgtcttcaatccattt

SEQ ID NO: 786110 - DNA, 22 bp, Artificial Sequence
  chemically synthesized
atcccactggggaaattctaaa

SEQ ID NO: 786111 - DNA, 22 bp, Artificial Sequence
  chemically synthesized
aatcccactggggaaattctaa

SEQ ID NO: 786112 - DNA, 22 bp, Artificial Sequence
  chemically synthesized
caatccatttagaatttcccca

SEQ ID NO: 786113 - DNA, 22 bp, Artificial Sequence
  chemically synthesized
aatccatttagaatttccccag

SEQ ID NO: 786114 - DNA, 22 bp, Artificial Sequence
  chemically synthesized
gtggagtttaatcccactgggg

SEQ ID NO: 786115 - DNA, 22 bp, Artificial Sequence
  chemically synthesized
agaatttccccagtgggattaa

SEQ ID NO: 786116 - DNA, 22 bp, Artificial Sequence
  chemically synthesized
gtctagtggagtttaatcccac

SEQ ID NO: 786117 - DNA, 22 bp, Artificial Sequence
  chemically synthesized
gaatttccccagtgggattaaa

SEQ ID NO: 786118 - DNA, 22 bp, Artificial Sequence
  chemically synthesized
ccactggtctagtggagtttaa

SEQ ID NO: 786119 - DNA, 22 bp, Artificial Sequence
  chemically synthesized
ccccagtgggattaaactccac

SEQ ID NO: 786120 - DNA, 22 bp, Artificial Sequence
  chemically synthesized
cccagtgggattaaactccact

SEQ ID NO: 786121 - DNA, 22 bp, Artificial Sequence
  chemically synthesized
tcaagccaactgccactggtct

SEQ ID NO: 786122 - DNA, 22 bp, Artificial Sequence
  chemically synthesized
aactccactagaccagtggcag

SEQ ID NO: 786123 - DNA, 22 bp, Artificial Sequence
  chemically synthesized
cactagaccagtggcagttggc

SEQ ID NO: 786124 - DNA, 22 bp, Artificial Sequence
  chemically synthesized
gaccagtggcagttggcttgat

SEQ ID NO: 786125 - DNA, 22 bp, Artificial Sequence
  chemically synthesized
agtaaaaaatgcattatcaagc

SEQ ID NO: 786126 - DNA, 22 bp, Artificial Sequence
  chemically synthesized
gcttgataatgcattttttact

SEQ ID NO: 786127 - DNA, 22 bp, Artificial Sequence
  chemically synthesized
gataatgcattttttactgaat

SEQ ID NO: 786128 - DNA, 22 bp, Artificial Sequence
  chemically synthesized
tgaagagaaatcattcagtaaa

SEQ ID NO: 786129 - DNA, 22 bp, Artificial Sequence
  chemically synthesized
ataatgcattttttactgaatg

SEQ ID NO: 786130 - DNA, 22 bp, Artificial Sequence
  chemically synthesized
tttactgaatgatttctcttca

SEQ ID NO: 786131 - DNA, 22 bp, Artificial Sequence
  chemically synthesized
ttactgaatgatttctcttcac

SEQ ID NO: 786132 - DNA, 22 bp, Artificial Sequence
  chemically synthesized
tactgaatgatttctcttcaca

SEQ ID NO: 786133 - DNA, 22 bp, Artificial Sequence
  chemically synthesized
actgaatgatttctcttcacag

SEQ ID NO: 786134 - DNA, 22 bp, Artificial Sequence
  chemically synthesized
ctgaatgatttctcttcacagt

SEQ ID NO: 786135 - DNA, 22 bp, Artificial Sequence
  chemically synthesized
aatgatttctcttcacagtctc

SEQ ID NO: 786136 - DNA, 22 bp, Artificial Sequence
  chemically synthesized
ctcttcacagtctcactatctt

SEQ ID NO: 786137 - DNA, 22 bp, Artificial Sequence
  chemically synthesized
tcttcacagtctcactatctta

SEQ ID NO: 786138 - DNA, 22 bp, Artificial Sequence
  chemically synthesized
ttcacagtctcactatcttacc

SEQ ID NO: 786139 - DNA, 22 bp, Artificial Sequence
  chemically synthesized
cacagtctcactatcttacctc

SEQ ID NO: 786140 - DNA, 22 bp, Artificial Sequence
  chemically synthesized
acagtctcactatcttacctca

SEQ ID NO: 786141 - DNA, 22 bp, Artificial Sequence
  chemically synthesized
cagaaggcagagatgaatgtga

SEQ ID NO: 786142 - DNA, 22 bp, Artificial Sequence
  chemically synthesized
actatcttacctcacattcatc

SEQ ID NO: 786143 - DNA, 22 bp, Artificial Sequence
  chemically synthesized
ctgcagaaggcagagatgaatg

SEQ ID NO: 786144 - DNA, 22 bp, Artificial Sequence
  chemically synthesized
tcttacctcacattcatctctg

SEQ ID NO: 786145 - DNA, 22 bp, Artificial Sequence
  chemically synthesized
acctcacattcatctctgcctt

SEQ ID NO: 786146 - DNA, 22 bp, Artificial Sequence
  chemically synthesized
cctcacattcatctctgccttc

SEQ ID NO: 786147 - DNA, 22 bp, Artificial Sequence
  chemically synthesized
acattcatctctgccttctgca

SEQ ID NO: 786148 - DNA, 22 bp, Artificial Sequence
  chemically synthesized
atctctgccttctgcagtagct

SEQ ID NO: 786149 - DNA, 22 bp, Artificial Sequence
  chemically synthesized
gaaatgtgaagcaccagctact

SEQ ID NO: 786150 - DNA, 22 bp, Artificial Sequence
  chemically synthesized
tgccttctgcagtagctggtgc

SEQ ID NO: 786151 - DNA, 22 bp, Artificial Sequence
  chemically synthesized
ccttctgcagtagctggtgctt

SEQ ID NO: 786152 - DNA, 22 bp, Artificial Sequence
  chemically synthesized
ctgcagtagctggtgcttcaca

SEQ ID NO: 786153 - DNA, 22 bp, Artificial Sequence
  chemically synthesized
tgcagtagctggtgcttcacat

SEQ ID NO: 786154 - DNA, 22 bp, Artificial Sequence
  chemically synthesized
ggaagtcctagaaatgtgaagc

SEQ ID NO: 786155 - DNA, 22 bp, Artificial Sequence
  chemically synthesized
cagtagctggtgcttcacattt

SEQ ID NO: 786156 - DNA, 22 bp, Artificial Sequence
  chemically synthesized
gggaagtcctagaaatgtgaag

SEQ ID NO: 786157 - DNA, 22 bp, Artificial Sequence
  chemically synthesized
gaacttgggaagtcctagaaat

SEQ ID NO: 786158 - DNA, 22 bp, Artificial Sequence
  chemically synthesized
agaacttgggaagtcctagaaa

SEQ ID NO: 786159 - DNA, 22 bp, Artificial Sequence
  chemically synthesized
gtgcttcacatttctaggactt

SEQ ID NO: 786160 - DNA, 22 bp, Artificial Sequence
  chemically synthesized
cacatttctaggacttcccaag

SEQ ID NO: 786161 - DNA, 22 bp, Artificial Sequence
  chemically synthesized
acatttctaggacttcccaagt

SEQ ID NO: 786162 - DNA, 22 bp, Artificial Sequence
  chemically synthesized
caagtacttagaacttgggaag

SEQ ID NO: 786163 - DNA, 22 bp, Artificial Sequence
  chemically synthesized
aattccaagtacttagaacttg

SEQ ID NO: 786164 - DNA, 22 bp, Artificial Sequence
  chemically synthesized
ctaggacttcccaagttctaag

SEQ ID NO: 786165 - DNA, 22 bp, Artificial Sequence
  chemically synthesized
taggacttcccaagttctaagt

SEQ ID NO: 786166 - DNA, 22 bp, Artificial Sequence
  chemically synthesized
ggacttcccaagttctaagtac

SEQ ID NO: 786167 - DNA, 22 bp, Artificial Sequence
  chemically synthesized
gaaacctgaattccaagtactt

SEQ ID NO: 786168 - DNA, 22 bp, Artificial Sequence
  chemically synthesized
ggaaacctgaattccaagtact

SEQ ID NO: 786169 - DNA, 22 bp, Artificial Sequence
  chemically synthesized
cccaagttctaagtacttggaa

SEQ ID NO: 786170 - DNA, 22 bp, Artificial Sequence
  chemically synthesized
ccaagttctaagtacttggaat

SEQ ID NO: 786171 - DNA, 22 bp, Artificial Sequence
  chemically synthesized
gcatatcttggaaacctgaatt

SEQ ID NO: 786172 - DNA, 22 bp, Artificial Sequence
  chemically synthesized
taagtacttggaattcaggttt

SEQ ID NO: 786173 - DNA, 22 bp, Artificial Sequence
  chemically synthesized
agtacttggaattcaggtttcc

SEQ ID NO: 786174 - DNA, 22 bp, Artificial Sequence
  chemically synthesized
ggaattcaggtttccaagatat

SEQ ID NO: 786175 - DNA, 22 bp, Artificial Sequence
  chemically synthesized
gaattcaggtttccaagatatg

SEQ ID NO: 786176 - DNA, 22 bp, Artificial Sequence
  chemically synthesized
aggtttccaagatatgctaact

SEQ ID NO: 786177 - DNA, 22 bp, Artificial Sequence
  chemically synthesized
ccaagatatgctaactcctcca

SEQ ID NO: 786178 - DNA, 22 bp, Artificial Sequence
  chemically synthesized
caagatatgctaactcctccat

SEQ ID NO: 786179 - DNA, 22 bp, Artificial Sequence
  chemically synthesized
ggaatatgcagagaatggagga

SEQ ID NO: 786180 - DNA, 22 bp, Artificial Sequence
  chemically synthesized
aggaatatgcagagaatggagg

SEQ ID NO: 786181 - DNA, 22 bp, Artificial Sequence
  chemically synthesized
actcctccattctctgcatatt

SEQ ID NO: 786182 - DNA, 22 bp, Artificial Sequence
  chemically synthesized
ctccattctctgcatattccta

SEQ ID NO: 786183 - DNA, 22 bp, Artificial Sequence
  chemically synthesized
cattctctgcatattcctaaat

SEQ ID NO: 786184 - DNA, 22 bp, Artificial Sequence
  chemically synthesized
tctgcatattcctaaatttttt

SEQ ID NO: 786185 - DNA, 22 bp, Artificial Sequence
  chemically synthesized
tgcatattcctaaattttttat

SEQ ID NO: 786186 - DNA, 22 bp, Artificial Sequence
  chemically synthesized
catattcctaaattttttatct

SEQ ID NO: 786187 - DNA, 22 bp, Artificial Sequence
  chemically synthesized
ctaaattttttatcttttttat

SEQ ID NO: 786188 - DNA, 22 bp, Artificial Sequence
  chemically synthesized
aattttttatcttttttatttt

SEQ ID NO: 786189 - DNA, 22 bp, Artificial Sequence
  chemically synthesized
ggaggaaaaacaataaaataaa

SEQ ID NO: 786190 - DNA, 22 bp, Artificial Sequence
  chemically synthesized
tttatcttttttattttattgt

SEQ ID NO: 786191 - DNA, 22 bp, Artificial Sequence
  chemically synthesized
ttatcttttttattttattgtt

SEQ ID NO: 786192 - DNA, 22 bp, Artificial Sequence
  chemically synthesized
tatcttttttattttattgttt

SEQ ID NO: 786193 - DNA, 22 bp, Artificial Sequence
  chemically synthesized
atcttttttattttattgtttt

SEQ ID NO: 786194 - DNA, 22 bp, Artificial Sequence
  chemically synthesized
tcttttttattttattgttttt

SEQ ID NO: 786195 - DNA, 22 bp, Artificial Sequence
  chemically synthesized
ttttattttattgtttttcctc

SEQ ID NO: 786196 - DNA, 22 bp, Artificial Sequence
  chemically synthesized
tttattttattgtttttcctcc

SEQ ID NO: 786197 - DNA, 22 bp, Artificial Sequence
  chemically synthesized
ttattttattgtttttcctccc

SEQ ID NO: 786198 - DNA, 22 bp, Artificial Sequence
  chemically synthesized
tattttattgtttttcctccca

SEQ ID NO: 786199 - DNA, 22 bp, Artificial Sequence
  chemically synthesized
attttattgtttttcctcccag

SEQ ID NO: 786200 - DNA, 22 bp, Artificial Sequence
  chemically synthesized
ttttattgtttttcctcccaga

SEQ ID NO: 786201 - DNA, 22 bp, Artificial Sequence
  chemically synthesized
tattgtttttcctcccagattt

SEQ ID NO: 786202 - DNA, 22 bp, Artificial Sequence
  chemically synthesized
attgtttttcctcccagatttt

SEQ ID NO: 786203 - DNA, 22 bp, Artificial Sequence
  chemically synthesized
ttgtttttcctcccagattttt

SEQ ID NO: 786204 - DNA, 22 bp, Artificial Sequence
  chemically synthesized
ccacaaagagaaaaaaatctgg

SEQ ID NO: 786205 - DNA, 22 bp, Artificial Sequence
  chemically synthesized
accacaaagagaaaaaaatctg

SEQ ID NO: 786206 - DNA, 22 bp, Artificial Sequence
  chemically synthesized
tttttcctcccagatttttttc

SEQ ID NO: 786207 - DNA, 22 bp, Artificial Sequence
  chemically synthesized
ttcctcccagatttttttctct

SEQ ID NO: 786208 - DNA, 22 bp, Artificial Sequence
  chemically synthesized
tcctcccagatttttttctctt

SEQ ID NO: 786209 - DNA, 22 bp, Artificial Sequence
  chemically synthesized
cctcccagatttttttctcttt

SEQ ID NO: 786210 - DNA, 22 bp, Artificial Sequence
  chemically synthesized
ctcccagatttttttctctttg

SEQ ID NO: 786211 - DNA, 22 bp, Artificial Sequence
  chemically synthesized
ccagatttttttctctttgtgg

SEQ ID NO: 786212 - DNA, 22 bp, Artificial Sequence
  chemically synthesized
aaatgatatttaccacaaagag

SEQ ID NO: 786213 - DNA, 22 bp, Artificial Sequence
  chemically synthesized
ttttctctttgtggtaaatatc

SEQ ID NO: 786214 - DNA, 22 bp, Artificial Sequence
  chemically synthesized
tttctctttgtggtaaatatca

SEQ ID NO: 786215 - DNA, 22 bp, Artificial Sequence
  chemically synthesized
ttctctttgtggtaaatatcat

SEQ ID NO: 786216 - DNA, 22 bp, Artificial Sequence
  chemically synthesized
tctctttgtggtaaatatcatt

SEQ ID NO: 786217 - DNA, 22 bp, Artificial Sequence
  chemically synthesized
ctctttgtggtaaatatcattt

SEQ ID NO: 786218 - DNA, 22 bp, Artificial Sequence
  chemically synthesized
tctttgtggtaaatatcatttt

SEQ ID NO: 786219 - DNA, 22 bp, Artificial Sequence
  chemically synthesized
tttgtggtaaatatcattttaa

SEQ ID NO: 786220 - DNA, 22 bp, Artificial Sequence
  chemically synthesized
tgtggtaaatatcattttaatt

SEQ ID NO: 786221 - DNA, 22 bp, Artificial Sequence
  chemically synthesized
gtggtaaatatcattttaattc

SEQ ID NO: 786222 - DNA, 22 bp, Artificial Sequence
  chemically synthesized
tggtaaatatcattttaattcc

SEQ ID NO: 786223 - DNA, 22 bp, Artificial Sequence
  chemically synthesized
aaatgagaataggggaattaaa

SEQ ID NO: 786224 - DNA, 22 bp, Artificial Sequence
  chemically synthesized
actaaaatgagaataggggaat

SEQ ID NO: 786225 - DNA, 22 bp, Artificial Sequence
  chemically synthesized
cactaaaatgagaataggggaa

SEQ ID NO: 786226 - DNA, 22 bp, Artificial Sequence
  chemically synthesized
accttcactaaaatgagaatag

SEQ ID NO: 786227 - DNA, 22 bp, Artificial Sequence
  chemically synthesized
aaccttcactaaaatgagaata

SEQ ID NO: 786228 - DNA, 22 bp, Artificial Sequence
  chemically synthesized
taaccttcactaaaatgagaat

SEQ ID NO: 786229 - DNA, 22 bp, Artificial Sequence
  chemically synthesized
taattcccctattctcatttta

SEQ ID NO: 786230 - DNA, 22 bp, Artificial Sequence
  chemically synthesized
tttaaccttcactaaaatgaga

SEQ ID NO: 786231 - DNA, 22 bp, Artificial Sequence
  chemically synthesized
aattcccctattctcattttag

SEQ ID NO: 786232 - DNA, 22 bp, Artificial Sequence
  chemically synthesized
attcccctattctcattttagt

SEQ ID NO: 786233 - DNA, 22 bp, Artificial Sequence
  chemically synthesized
ccctattctcattttagtgaag

SEQ ID NO: 786234 - DNA, 22 bp, Artificial Sequence
  chemically synthesized
ttctcattttagtgaaggttaa

SEQ ID NO: 786235 - DNA, 22 bp, Artificial Sequence
  chemically synthesized
aaaatgatgtctctttaacctt

SEQ ID NO: 786236 - DNA, 22 bp, Artificial Sequence
  chemically synthesized
tcattttagtgaaggttaaaga

SEQ ID NO: 786237 - DNA, 22 bp, Artificial Sequence
  chemically synthesized
attttagtgaaggttaaagaga

SEQ ID NO: 786238 - DNA, 22 bp, Artificial Sequence
  chemically synthesized
gttaaaaatgatgtctctttaa

SEQ ID NO: 786239 - DNA, 22 bp, Artificial Sequence
  chemically synthesized
tggttaaaaatgatgtctcttt

SEQ ID NO: 786240 - DNA, 22 bp, Artificial Sequence
  chemically synthesized
tagtgaaggttaaagagacatc

SEQ ID NO: 786241 - DNA, 22 bp, Artificial Sequence
  chemically synthesized
agtgaaggttaaagagacatca

SEQ ID NO: 786242 - DNA, 22 bp, Artificial Sequence
  chemically synthesized
gtgaaggttaaagagacatcat

SEQ ID NO: 786243 - DNA, 22 bp, Artificial Sequence
  chemically synthesized
tagggagttctggttaaaaatg

SEQ ID NO: 786244 - DNA, 22 bp, Artificial Sequence
  chemically synthesized
atagggagttctggttaaaaat

SEQ ID NO: 786245 - DNA, 22 bp, Artificial Sequence
  chemically synthesized
aagagacatcatttttaaccag

SEQ ID NO: 786246 - DNA, 22 bp, Artificial Sequence
  chemically synthesized
catagatcacttatagggagtt

SEQ ID NO: 786247 - DNA, 22 bp, Artificial Sequence
  chemically synthesized
ccatagatcacttatagggagt

SEQ ID NO: 786248 - DNA, 22 bp, Artificial Sequence
  chemically synthesized
tccatagatcacttatagggag

SEQ ID NO: 786249 - DNA, 22 bp, Artificial Sequence
  chemically synthesized
ttaaccagaactccctataagt

SEQ ID NO: 786250 - DNA, 22 bp, Artificial Sequence
  chemically synthesized
tttccatagatcacttataggg

SEQ ID NO: 786251 - DNA, 22 bp, Artificial Sequence
  chemically synthesized
taaccagaactccctataagtg

SEQ ID NO: 786252 - DNA, 22 bp, Artificial Sequence
  chemically synthesized
ctttccatagatcacttatagg

SEQ ID NO: 786253 - DNA, 22 bp, Artificial Sequence
  chemically synthesized
aaccagaactccctataagtga

SEQ ID NO: 786254 - DNA, 22 bp, Artificial Sequence
  chemically synthesized
tctttccatagatcacttatag

SEQ ID NO: 786255 - DNA, 22 bp, Artificial Sequence
  chemically synthesized
accagaactccctataagtgat

SEQ ID NO: 786256 - DNA, 22 bp, Artificial Sequence
  chemically synthesized
ttctttccatagatcacttata

SEQ ID NO: 786257 - DNA, 22 bp, Artificial Sequence
  chemically synthesized
tttctttccatagatcacttat

SEQ ID NO: 786258 - DNA, 22 bp, Artificial Sequence
  chemically synthesized
attttttctttccatagatcac

SEQ ID NO: 786259 - DNA, 22 bp, Artificial Sequence
  chemically synthesized
ctaattttttctttccatagat

SEQ ID NO: 786260 - DNA, 22 bp, Artificial Sequence
  chemically synthesized
gctaattttttctttccataga

SEQ ID NO: 786261 - DNA, 22 bp, Artificial Sequence
  chemically synthesized
cctataagtgatctatggaaag

SEQ ID NO: 786262 - DNA, 22 bp, Artificial Sequence
  chemically synthesized
ttgctaattttttctttccata

SEQ ID NO: 786263 - DNA, 22 bp, Artificial Sequence
  chemically synthesized
cttgctaattttttctttccat

SEQ ID NO: 786264 - DNA, 22 bp, Artificial Sequence
  chemically synthesized
tcttgctaattttttctttcca

SEQ ID NO: 786265 - DNA, 22 bp, Artificial Sequence
  chemically synthesized
taagtgatctatggaaagaaaa

SEQ ID NO: 786266 - DNA, 22 bp, Artificial Sequence
  chemically synthesized
ttcttgctaattttttctttcc

SEQ ID NO: 786267 - DNA, 22 bp, Artificial Sequence
  chemically synthesized
tttcttgctaattttttctttc

SEQ ID NO: 786268 - DNA, 22 bp, Artificial Sequence
  chemically synthesized
tggaaagaaaaaattagcaaga

SEQ ID NO: 786269 - DNA, 22 bp, Artificial Sequence
  chemically synthesized
gtcaaatgtctttttcttgcta

SEQ ID NO: 786270 - DNA, 22 bp, Artificial Sequence
  chemically synthesized
atgcaactagtcaaatgtcttt

SEQ ID NO: 786271 - DNA, 22 bp, Artificial Sequence
  chemically synthesized
actcatgcaactagtcaaatgt

SEQ ID NO: 786272 - DNA, 22 bp, Artificial Sequence
  chemically synthesized
gcaagaaaaagacatttgacta

SEQ ID NO: 786273 - DNA, 22 bp, Artificial Sequence
  chemically synthesized
gactcatgcaactagtcaaatg

SEQ ID NO: 786274 - DNA, 22 bp, Artificial Sequence
  chemically synthesized
acccttgactcatgcaactagt

SEQ ID NO: 786275 - DNA, 22 bp, Artificial Sequence
  chemically synthesized
aacccttgactcatgcaactag

SEQ ID NO: 786276 - DNA, 22 bp, Artificial Sequence
  chemically synthesized
cttaacccttgactcatgcaac

SEQ ID NO: 786277 - DNA, 22 bp, Artificial Sequence
  chemically synthesized
acttaacccttgactcatgcaa

SEQ ID NO: 786278 - DNA, 22 bp, Artificial Sequence
  chemically synthesized
tacttaacccttgactcatgca

SEQ ID NO: 786279 - DNA, 22 bp, Artificial Sequence
  chemically synthesized
ctttacttaacccttgactcat

SEQ ID NO: 786280 - DNA, 22 bp, Artificial Sequence
  chemically synthesized
gactagttgcatgagtcaaggg

SEQ ID NO: 786281 - DNA, 22 bp, Artificial Sequence
  chemically synthesized
tcctttacttaacccttgactc

SEQ ID NO: 786282 - DNA, 22 bp, Artificial Sequence
  chemically synthesized
actagttgcatgagtcaagggt

SEQ ID NO: 786283 - DNA, 22 bp, Artificial Sequence
  chemically synthesized
gttgcatgagtcaagggttaag

SEQ ID NO: 786284 - DNA, 22 bp, Artificial Sequence
  chemically synthesized
atcctctcctttacttaaccct

SEQ ID NO: 786285 - DNA, 22 bp, Artificial Sequence
  chemically synthesized
catcctctcctttacttaaccc

SEQ ID NO: 786286 - DNA, 22 bp, Artificial Sequence
  chemically synthesized
catgagtcaagggttaagtaaa

SEQ ID NO: 786287 - DNA, 22 bp, Artificial Sequence
  chemically synthesized
tcacaaatttcatcctctcctt

SEQ ID NO: 786288 - DNA, 22 bp, Artificial Sequence
  chemically synthesized
aattatcacaaatttcatcctc

SEQ ID NO: 786289 - DNA, 22 bp, Artificial Sequence
  chemically synthesized
aaattatcacaaatttcatcct

SEQ ID NO: 786290 - DNA, 22 bp, Artificial Sequence
  chemically synthesized
agtaaaggagaggatgaaattt

SEQ ID NO: 786291 - DNA, 22 bp, Artificial Sequence
  chemically synthesized
aatttaaattatcacaaatttc

SEQ ID NO: 786292 - DNA, 22 bp, Artificial Sequence
  chemically synthesized
gctaaatttaaattatcacaaa

SEQ ID NO: 786293 - DNA, 22 bp, Artificial Sequence
  chemically synthesized
ccactagctaaatttaaattat

SEQ ID NO: 786294 - DNA, 22 bp, Artificial Sequence
  chemically synthesized
caacctcccactagctaaattt

SEQ ID NO: 786295 - DNA, 22 bp, Artificial Sequence
  chemically synthesized
gcaacctcccactagctaaatt

SEQ ID NO: 786296 - DNA, 22 bp, Artificial Sequence
  chemically synthesized
gtgataatttaaatttagctag

SEQ ID NO: 786297 - DNA, 22 bp, Artificial Sequence
  chemically synthesized
tgataatttaaatttagctagt

SEQ ID NO: 786298 - DNA, 22 bp, Artificial Sequence
  chemically synthesized
tttgcaacctcccactagctaa

SEQ ID NO: 786299 - DNA, 22 bp, Artificial Sequence
  chemically synthesized
gtttgcaacctcccactagcta

SEQ ID NO: 786300 - DNA, 22 bp, Artificial Sequence
  chemically synthesized
tgtttgcaacctcccactagct

SEQ ID NO: 786301 - DNA, 22 bp, Artificial Sequence
  chemically synthesized
aaatttagctagtgggaggttg

SEQ ID NO: 786302 - DNA, 22 bp, Artificial Sequence
  chemically synthesized
aatttagctagtgggaggttgc

SEQ ID NO: 786303 - DNA, 22 bp, Artificial Sequence
  chemically synthesized
agctagtgggaggttgcaaaca

SEQ ID NO: 786304 - DNA, 22 bp, Artificial Sequence
  chemically synthesized
gctagtgggaggttgcaaacaa

SEQ ID NO: 786305 - DNA, 22 bp, Artificial Sequence
  chemically synthesized
cagagagaggagtctttgtttg

SEQ ID NO: 786306 - DNA, 22 bp, Artificial Sequence
  chemically synthesized
gtgggaggttgcaaacaaagac

SEQ ID NO: 786307 - DNA, 22 bp, Artificial Sequence
  chemically synthesized
acagagagaggagtctttgttt

SEQ ID NO: 786308 - DNA, 22 bp, Artificial Sequence
  chemically synthesized
gcttacagagagaggagtcttt

SEQ ID NO: 786309 - DNA, 22 bp, Artificial Sequence
  chemically synthesized
tagcttacagagagaggagtct

SEQ ID NO: 786310 - DNA, 22 bp, Artificial Sequence
  chemically synthesized
caaacaaagactcctctctctg

SEQ ID NO: 786311 - DNA, 22 bp, Artificial Sequence
  chemically synthesized
taaagaattctagcttacagag

SEQ ID NO: 786312 - DNA, 22 bp, Artificial Sequence
  chemically synthesized
aggctataaagaattctagctt

SEQ ID NO: 786313 - DNA, 22 bp, Artificial Sequence
  chemically synthesized
aaggctataaagaattctagct

SEQ ID NO: 786314 - DNA, 22 bp, Artificial Sequence
  chemically synthesized
ctctctctgtaagctagaattc

SEQ ID NO: 786315 - DNA, 22 bp, Artificial Sequence
  chemically synthesized
tctctgtaagctagaattcttt

SEQ ID NO: 786316 - DNA, 22 bp, Artificial Sequence
  chemically synthesized
tctgtaagctagaattctttat

SEQ ID NO: 786317 - DNA, 22 bp, Artificial Sequence
  chemically synthesized
tgtaagctagaattctttatag

SEQ ID NO: 786318 - DNA, 22 bp, Artificial Sequence
  chemically synthesized
ggaaatttaaggctataaagaa

SEQ ID NO: 786319 - DNA, 22 bp, Artificial Sequence
  chemically synthesized
taagctagaattctttatagcc

SEQ ID NO: 786320 - DNA, 22 bp, Artificial Sequence
  chemically synthesized
gacctgggaaatttaaggctat

SEQ ID NO: 786321 - DNA, 22 bp, Artificial Sequence
  chemically synthesized
gaattctttatagccttaaatt

SEQ ID NO: 786322 - DNA, 22 bp, Artificial Sequence
  chemically synthesized
aactagacctgggaaatttaag

SEQ ID NO: 786323 - DNA, 22 bp, Artificial Sequence
  chemically synthesized
tttatagccttaaatttcccag

SEQ ID NO: 786324 - DNA, 22 bp, Artificial Sequence
  chemically synthesized
tatagccttaaatttcccaggt

SEQ ID NO: 786325 - DNA, 22 bp, Artificial Sequence
  chemically synthesized
atagccttaaatttcccaggtc

SEQ ID NO: 786326 - DNA, 22 bp, Artificial Sequence
  chemically synthesized
tagccttaaatttcccaggtct

SEQ ID NO: 786327 - DNA, 22 bp, Artificial Sequence
  chemically synthesized
aaatttcccaggtctagtttag

SEQ ID NO: 786328 - DNA, 22 bp, Artificial Sequence
  chemically synthesized
aatttcccaggtctagtttagt

SEQ ID NO: 786329 - DNA, 22 bp, Artificial Sequence
  chemically synthesized
cccaggtctagtttagtattta

SEQ ID NO: 786330 - DNA, 22 bp, Artificial Sequence
  chemically synthesized
ccaggtctagtttagtatttat

SEQ ID NO: 786331 - DNA, 22 bp, Artificial Sequence
  chemically synthesized
gtttagtatttatatttatttt

SEQ ID NO: 786332 - DNA, 22 bp, Artificial Sequence
  chemically synthesized
agtatttatatttattttcctc

SEQ ID NO: 786333 - DNA, 22 bp, Artificial Sequence
  chemically synthesized
gtatttatatttattttcctca

SEQ ID NO: 786334 - DNA, 22 bp, Artificial Sequence
  chemically synthesized
cagtaaaaaagtagtgaggaaa

SEQ ID NO: 786335 - DNA, 22 bp, Artificial Sequence
  chemically synthesized
gcagtaaaaaagtagtgaggaa

SEQ ID NO: 786336 - DNA, 22 bp, Artificial Sequence
  chemically synthesized
tgcagtaaaaaagtagtgagga

SEQ ID NO: 786337 - DNA, 22 bp, Artificial Sequence
  chemically synthesized
atatttattttcctcactactt

SEQ ID NO: 786338 - DNA, 22 bp, Artificial Sequence
  chemically synthesized
tatttattttcctcactacttt

SEQ ID NO: 786339 - DNA, 22 bp, Artificial Sequence
  chemically synthesized
attttcctcactacttttttac

SEQ ID NO: 786340 - DNA, 22 bp, Artificial Sequence
  chemically synthesized
ttttcctcactacttttttact

SEQ ID NO: 786341 - DNA, 22 bp, Artificial Sequence
  chemically synthesized
cgaatattttgcagtaaaaaag

SEQ ID NO: 786342 - DNA, 22 bp, Artificial Sequence
  chemically synthesized
ccgaatattttgcagtaaaaaa

SEQ ID NO: 786343 - DNA, 22 bp, Artificial Sequence
  chemically synthesized
tcctcactacttttttactgca

SEQ ID NO: 786344 - DNA, 22 bp, Artificial Sequence
  chemically synthesized
cctcactacttttttactgcaa

SEQ ID NO: 786345 - DNA, 22 bp, Artificial Sequence
  chemically synthesized
ctcactacttttttactgcaaa

SEQ ID NO: 786346 - DNA, 22 bp, Artificial Sequence
  chemically synthesized
actacttttttactgcaaaata

SEQ ID NO: 786347 - DNA, 22 bp, Artificial Sequence
  chemically synthesized
caaatggtttccgaatattttg

SEQ ID NO: 786348 - DNA, 22 bp, Artificial Sequence
  chemically synthesized
cttttttactgcaaaatattcg

SEQ ID NO: 786349 - DNA, 22 bp, Artificial Sequence
  chemically synthesized
ttttactgcaaaatattcggaa

SEQ ID NO: 786350 - DNA, 22 bp, Artificial Sequence
  chemically synthesized
tttactgcaaaatattcggaaa

SEQ ID NO: 786351 - DNA, 22 bp, Artificial Sequence
  chemically synthesized
ttactgcaaaatattcggaaac

SEQ ID NO: 786352 - DNA, 22 bp, Artificial Sequence
  chemically synthesized
aagttacaaatggtttccgaat

SEQ ID NO: 786353 - DNA, 22 bp, Artificial Sequence
  chemically synthesized
tactgcaaaatattcggaaacc

SEQ ID NO: 786354 - DNA, 22 bp, Artificial Sequence
  chemically synthesized
aaagttacaaatggtttccgaa

SEQ ID NO: 786355 - DNA, 22 bp, Artificial Sequence
  chemically synthesized
actgcaaaatattcggaaacca

SEQ ID NO: 786356 - DNA, 22 bp, Artificial Sequence
  chemically synthesized
ctgcaaaatattcggaaaccat

SEQ ID NO: 786357 - DNA, 22 bp, Artificial Sequence
  chemically synthesized
caaaatattcggaaaccatttg

SEQ ID NO: 786358 - DNA, 22 bp, Artificial Sequence
  chemically synthesized
tgtgacttaaagttacaaatgg

SEQ ID NO: 786359 - DNA, 22 bp, Artificial Sequence
  chemically synthesized
gaattgtgtgacttaaagttac

SEQ ID NO: 786360 - DNA, 22 bp, Artificial Sequence
  chemically synthesized
ggaaaccatttgtaactttaag

SEQ ID NO: 786361 - DNA, 22 bp, Artificial Sequence
  chemically synthesized
aattagaattgtgtgacttaaa

SEQ ID NO: 786362 - DNA, 22 bp, Artificial Sequence
  chemically synthesized
gtaactttaagtcacacaattc

SEQ ID NO: 786363 - DNA, 22 bp, Artificial Sequence
  chemically synthesized
atcattaaattagaattgtgtg

SEQ ID NO: 786364 - DNA, 22 bp, Artificial Sequence
  chemically synthesized
taactttaagtcacacaattct

SEQ ID NO: 786365 - DNA, 22 bp, Artificial Sequence
  chemically synthesized
acctaatcattaaattagaatt

SEQ ID NO: 786366 - DNA, 22 bp, Artificial Sequence
  chemically synthesized
aacctaatcattaaattagaat

SEQ ID NO: 786367 - DNA, 22 bp, Artificial Sequence
  chemically synthesized
taagtcacacaattctaattta

SEQ ID NO: 786368 - DNA, 22 bp, Artificial Sequence
  chemically synthesized
taacctaatcattaaattagaa

SEQ ID NO: 786369 - DNA, 22 bp, Artificial Sequence
  chemically synthesized
aagtcacacaattctaatttaa

SEQ ID NO: 786370 - DNA, 22 bp, Artificial Sequence
  chemically synthesized
agtcacacaattctaatttaat

SEQ ID NO: 786371 - DNA, 22 bp, Artificial Sequence
  chemically synthesized
ctttaacctaatcattaaatta

SEQ ID NO: 786372 - DNA, 22 bp, Artificial Sequence
  chemically synthesized
ttgctttaacctaatcattaaa

SEQ ID NO: 786373 - DNA, 22 bp, Artificial Sequence
  chemically synthesized
gttgctttaacctaatcattaa

SEQ ID NO: 786374 - DNA, 22 bp, Artificial Sequence
  chemically synthesized
tgttgctttaacctaatcatta

SEQ ID NO: 786375 - DNA, 22 bp, Artificial Sequence
  chemically synthesized
taatttaatgattaggttaaag

SEQ ID NO: 786376 - DNA, 22 bp, Artificial Sequence
  chemically synthesized
atttaatgattaggttaaagca

SEQ ID NO: 786377 - DNA, 22 bp, Artificial Sequence
  chemically synthesized
gtaggaaattttgttgctttaa

SEQ ID NO: 786378 - DNA, 22 bp, Artificial Sequence
  chemically synthesized
aatgattaggttaaagcaacaa

SEQ ID NO: 786379 - DNA, 22 bp, Artificial Sequence
  chemically synthesized
atgattaggttaaagcaacaaa

SEQ ID NO: 786380 - DNA, 22 bp, Artificial Sequence
  chemically synthesized
caaaattagtaggaaattttgt

SEQ ID NO: 786381 - DNA, 22 bp, Artificial Sequence
  chemically synthesized
ggttaaagcaacaaaatttcct

SEQ ID NO: 786382 - DNA, 22 bp, Artificial Sequence
  chemically synthesized
aagcaacaaaatttcctactaa

SEQ ID NO: 786383 - DNA, 22 bp, Artificial Sequence
  chemically synthesized
tagagctacaaaattagtagga

SEQ ID NO: 786384 - DNA, 22 bp, Artificial Sequence
  chemically synthesized
agtgttatagagctacaaaatt

SEQ ID NO: 786385 - DNA, 22 bp, Artificial Sequence
  chemically synthesized
cctactaattttgtagctctat

SEQ ID NO: 786386 - DNA, 22 bp, Artificial Sequence
  chemically synthesized
ctactaattttgtagctctata

SEQ ID NO: 786387 - DNA, 22 bp, Artificial Sequence
  chemically synthesized
ctaattttgtagctctataaca

SEQ ID NO: 786388 - DNA, 22 bp, Artificial Sequence
  chemically synthesized
ccaatatctgagtgttatagag

SEQ ID NO: 786389 - DNA, 22 bp, Artificial Sequence
  chemically synthesized
attttgtagctctataacactc

SEQ ID NO: 786390 - DNA, 22 bp, Artificial Sequence
  chemically synthesized
tgtagctctataacactcagat

SEQ ID NO: 786391 - DNA, 22 bp, Artificial Sequence
  chemically synthesized
gtagctctataacactcagata

SEQ ID NO: 786392 - DNA, 22 bp, Artificial Sequence
  chemically synthesized
tagctctataacactcagatat

SEQ ID NO: 786393 - DNA, 22 bp, Artificial Sequence
  chemically synthesized
tataacactcagatattggcaa

SEQ ID NO: 786394 - DNA, 22 bp, Artificial Sequence
  chemically synthesized
agccatataggattgccaatat

SEQ ID NO: 786395 - DNA, 22 bp, Artificial Sequence
  chemically synthesized
gagccatataggattgccaata

SEQ ID NO: 786396 - DNA, 22 bp, Artificial Sequence
  chemically synthesized
taacactcagatattggcaatc

SEQ ID NO: 786397 - DNA, 22 bp, Artificial Sequence
  chemically synthesized
gtttgagccatataggattgcc

SEQ ID NO: 786398 - DNA, 22 bp, Artificial Sequence
  chemically synthesized
agatattggcaatcctatatgg

SEQ ID NO: 786399 - DNA, 22 bp, Artificial Sequence
  chemically synthesized
aagtattagtttgagccatata

SEQ ID NO: 786400 - DNA, 22 bp, Artificial Sequence
  chemically synthesized
gcaatcctatatggctcaaact

SEQ ID NO: 786401 - DNA, 22 bp, Artificial Sequence
  chemically synthesized
tatggctcaaactaatacttta

SEQ ID NO: 786402 - DNA, 22 bp, Artificial Sequence
  chemically synthesized
aaactaatactttaacatattg

SEQ ID NO: 786403 - DNA, 22 bp, Artificial Sequence
  chemically synthesized
gtatgtccataaacaatatgtt

SEQ ID NO: 786404 - DNA, 22 bp, Artificial Sequence
  chemically synthesized
tagtatgtccataaacaatatg

SEQ ID NO: 786405 - DNA, 22 bp, Artificial Sequence
  chemically synthesized
ctagtatgtccataaacaatat

SEQ ID NO: 786406 - DNA, 22 bp, Artificial Sequence
  chemically synthesized
atactttaacatattgtttatg

SEQ ID NO: 786407 - DNA, 22 bp, Artificial Sequence
  chemically synthesized
taacatattgtttatggacata

SEQ ID NO: 786408 - DNA, 22 bp, Artificial Sequence
  chemically synthesized
aacatattgtttatggacatac

SEQ ID NO: 786409 - DNA, 22 bp, Artificial Sequence
  chemically synthesized
acatattgtttatggacatact

SEQ ID NO: 786410 - DNA, 22 bp, Artificial Sequence
  chemically synthesized
tttatggacatactagaaattg

SEQ ID NO: 786411 - DNA, 22 bp, Artificial Sequence
  chemically synthesized
gcatacacagtacaatttctag

SEQ ID NO: 786412 - DNA, 22 bp, Artificial Sequence
  chemically synthesized
atggacatactagaaattgtac

SEQ ID NO: 786413 - DNA, 22 bp, Artificial Sequence
  chemically synthesized
tggacatactagaaattgtact

SEQ ID NO: 786414 - DNA, 22 bp, Artificial Sequence
  chemically synthesized
gaaattgtactgtgtatgctaa

SEQ ID NO: 786415 - DNA, 22 bp, Artificial Sequence
  chemically synthesized
gatcccagtgtagaagttagca

SEQ ID NO: 786416 - DNA, 22 bp, Artificial Sequence
  chemically synthesized
tactgtgtatgctaacttctac

SEQ ID NO: 786417 - DNA, 22 bp, Artificial Sequence
  chemically synthesized
tgtatgctaacttctacactgg

SEQ ID NO: 786418 - DNA, 22 bp, Artificial Sequence
  chemically synthesized
acttctacactgggatctagat

SEQ ID NO: 786419 - DNA, 22 bp, Artificial Sequence
  chemically synthesized
ctacactgggatctagattttg

SEQ ID NO: 786420 - DNA, 22 bp, Artificial Sequence
  chemically synthesized
tacactgggatctagattttgt

SEQ ID NO: 786421 - DNA, 22 bp, Artificial Sequence
  chemically synthesized
cactgggatctagattttgtac

SEQ ID NO: 786422 - DNA, 22 bp, Artificial Sequence
  chemically synthesized
gaaaagatccagaggtacaaaa

SEQ ID NO: 786423 - DNA, 22 bp, Artificial Sequence
  chemically synthesized
agaaaagatccagaggtacaaa

SEQ ID NO: 786424 - DNA, 22 bp, Artificial Sequence
  chemically synthesized
ggatctagattttgtacctctg

SEQ ID NO: 786425 - DNA, 22 bp, Artificial Sequence
  chemically synthesized
agcttagaaaagatccagaggt

SEQ ID NO: 786426 - DNA, 22 bp, Artificial Sequence
  chemically synthesized
ttcagcttagaaaagatccaga

SEQ ID NO: 786427 - DNA, 22 bp, Artificial Sequence
  chemically synthesized
gattttgtacctctggatcttt

SEQ ID NO: 786428 - DNA, 22 bp, Artificial Sequence
  chemically synthesized
attcagcttagaaaagatccag

SEQ ID NO: 786429 - DNA, 22 bp, Artificial Sequence
  chemically synthesized
tgtacctctggatcttttctaa

SEQ ID NO: 786430 - DNA, 22 bp, Artificial Sequence
  chemically synthesized
gtacctctggatcttttctaag

SEQ ID NO: 786431 - DNA, 22 bp, Artificial Sequence
  chemically synthesized
tacctctggatcttttctaagc

SEQ ID NO: 786432 - DNA, 22 bp, Artificial Sequence
  chemically synthesized
tggatcttttctaagctgaata

SEQ ID NO: 786433 - DNA, 22 bp, Artificial Sequence
  chemically synthesized
tatgaacatatttattcagctt

SEQ ID NO: 786434 - DNA, 22 bp, Artificial Sequence
  chemically synthesized
gtatgaacatatttattcagct

SEQ ID NO: 786435 - DNA, 22 bp, Artificial Sequence
  chemically synthesized
gatcttttctaagctgaataaa

SEQ ID NO: 786436 - DNA, 22 bp, Artificial Sequence
  chemically synthesized
ttctaagctgaataaatatgtt

SEQ ID NO: 786437 - DNA, 22 bp, Artificial Sequence
  chemically synthesized
tctaagctgaataaatatgttc

SEQ ID NO: 786438 - DNA, 22 bp, Artificial Sequence
  chemically synthesized
ctaagctgaataaatatgttca

SEQ ID NO: 786439 - DNA, 22 bp, Artificial Sequence
  chemically synthesized
taagctgaataaatatgttcat

SEQ ID NO: 786440 - DNA, 22 bp, Artificial Sequence
  chemically synthesized
agctgaataaatatgttcatac

SEQ ID NO: 786441 - DNA, 22 bp, Artificial Sequence
  chemically synthesized
accagagtacaaccttgtatga

SEQ ID NO: 786442 - DNA, 22 bp, Artificial Sequence
  chemically synthesized
aataaatatgttcatacaaggt

SEQ ID NO: 786443 - DNA, 22 bp, Artificial Sequence
  chemically synthesized
atacaaggttgtactctggtta

SEQ ID NO: 786444 - DNA, 22 bp, Artificial Sequence
  chemically synthesized
ataaacagaatgttaaccagag

SEQ ID NO: 786445 - DNA, 22 bp, Artificial Sequence
  chemically synthesized
gataaacagaatgttaaccaga

SEQ ID NO: 786446 - DNA, 22 bp, Artificial Sequence
  chemically synthesized
tgataaacagaatgttaaccag

SEQ ID NO: 786447 - DNA, 22 bp, Artificial Sequence
  chemically synthesized
ttgataaacagaatgttaacca

SEQ ID NO: 786448 - DNA, 22 bp, Artificial Sequence
  chemically synthesized
tactctggttaacattctgttt

SEQ ID NO: 786449 - DNA, 22 bp, Artificial Sequence
  chemically synthesized
tcatgtcttttgataaacagaa

SEQ ID NO: 786450 - DNA, 22 bp, Artificial Sequence
  chemically synthesized
tggttaacattctgtttatcaa

SEQ ID NO: 786451 - DNA, 22 bp, Artificial Sequence
  chemically synthesized
gttaacattctgtttatcaaaa

SEQ ID NO: 786452 - DNA, 22 bp, Artificial Sequence
  chemically synthesized
acattctgtttatcaaaagaca

SEQ ID NO: 786453 - DNA, 22 bp, Artificial Sequence
  chemically synthesized
atatacatgattatcatgtctt

SEQ ID NO: 786454 - DNA, 22 bp, Artificial Sequence
  chemically synthesized
catatacatgattatcatgtct

SEQ ID NO: 786455 - DNA, 22 bp, Artificial Sequence
  chemically synthesized
tgtttatcaaaagacatgataa

SEQ ID NO: 786456 - DNA, 22 bp, Artificial Sequence
  chemically synthesized
tttatcaaaagacatgataatc

SEQ ID NO: 786457 - DNA, 22 bp, Artificial Sequence
  chemically synthesized
atcaaaagacatgataatcatg

SEQ ID NO: 786458 - DNA, 22 bp, Artificial Sequence
  chemically synthesized
atgtttcatatacatgattatc

SEQ ID NO: 786459 - DNA, 22 bp, Artificial Sequence
  chemically synthesized
tcaaaagacatgataatcatgt

SEQ ID NO: 786460 - DNA, 22 bp, Artificial Sequence
  chemically synthesized
tcatgtttcatatacatgatta

SEQ ID NO: 786461 - DNA, 22 bp, Artificial Sequence
  chemically synthesized
ctcatgtttcatatacatgatt

SEQ ID NO: 786462 - DNA, 22 bp, Artificial Sequence
  chemically synthesized
tctcatgtttcatatacatgat

SEQ ID NO: 786463 - DNA, 22 bp, Artificial Sequence
  chemically synthesized
aaattttctcatgtttcatata

SEQ ID NO: 786464 - DNA, 22 bp, Artificial Sequence
  chemically synthesized
attcaaattttctcatgtttca

SEQ ID NO: 786465 - DNA, 22 bp, Artificial Sequence
  chemically synthesized
actgattcaaattttctcatgt

SEQ ID NO: 786466 - DNA, 22 bp, Artificial Sequence
  chemically synthesized
aactgattcaaattttctcatg

SEQ ID NO: 786467 - DNA, 22 bp, Artificial Sequence
  chemically synthesized
agtttaactgattcaaattttc

SEQ ID NO: 786468 - DNA, 22 bp, Artificial Sequence
  chemically synthesized
cagtttaactgattcaaatttt

SEQ ID NO: 786469 - DNA, 22 bp, Artificial Sequence
  chemically synthesized
tcagtttaactgattcaaattt

SEQ ID NO: 786470 - DNA, 22 bp, Artificial Sequence
  chemically synthesized
agtagatctttcagtttaactg

SEQ ID NO: 786471 - DNA, 22 bp, Artificial Sequence
  chemically synthesized
taagtagatctttcagtttaac

SEQ ID NO: 786472 - DNA, 22 bp, Artificial Sequence
  chemically synthesized
ctaagtagatctttcagtttaa

SEQ ID NO: 786473 - DNA, 22 bp, Artificial Sequence
  chemically synthesized
tctaagtagatctttcagttta

SEQ ID NO: 786474 - DNA, 22 bp, Artificial Sequence
  chemically synthesized
ttctaagtagatctttcagttt

SEQ ID NO: 786475 - DNA, 22 bp, Artificial Sequence
  chemically synthesized
gaatcagttaaactgaaagatc

SEQ ID NO: 786476 - DNA, 22 bp, Artificial Sequence
  chemically synthesized
aatcagttaaactgaaagatct

SEQ ID NO: 786477 - DNA, 22 bp, Artificial Sequence
  chemically synthesized
aactgaaagatctacttagaaa

SEQ ID NO: 786478 - DNA, 22 bp, Artificial Sequence
  chemically synthesized
aaagatctacttagaaaaacat

SEQ ID NO: 786479 - DNA, 22 bp, Artificial Sequence
  chemically synthesized
ggagaagaagtagatgtttttc

SEQ ID NO: 786480 - DNA, 22 bp, Artificial Sequence
  chemically synthesized
cttagaaaaacatctacttctt

SEQ ID NO: 786481 - DNA, 22 bp, Artificial Sequence
  chemically synthesized
agaaaaacatctacttcttctc

SEQ ID NO: 786482 - DNA, 22 bp, Artificial Sequence
  chemically synthesized
gaaaaacatctacttcttctcc

SEQ ID NO: 786483 - DNA, 22 bp, Artificial Sequence
  chemically synthesized
acaagaatgtgactcggagaag

SEQ ID NO: 786484 - DNA, 22 bp, Artificial Sequence
  chemically synthesized
cttcttctccgagtcacattct

SEQ ID NO: 786485 - DNA, 22 bp, Artificial Sequence
  chemically synthesized
cttctccgagtcacattcttgt

SEQ ID NO: 786486 - DNA, 22 bp, Artificial Sequence
  chemically synthesized
ttctccgagtcacattcttgtg

SEQ ID NO: 786487 - DNA, 22 bp, Artificial Sequence
  chemically synthesized
aaaagccagaattcacaagaat

SEQ ID NO: 786488 - DNA, 22 bp, Artificial Sequence
  chemically synthesized
ctccgagtcacattcttgtgaa

SEQ ID NO: 786489 - DNA, 22 bp, Artificial Sequence
  chemically synthesized
aaaaagccagaattcacaagaa

SEQ ID NO: 786490 - DNA, 22 bp, Artificial Sequence
  chemically synthesized
tccgagtcacattcttgtgaat

SEQ ID NO: 786491 - DNA, 22 bp, Artificial Sequence
  chemically synthesized
taaaaagccagaattcacaaga

SEQ ID NO: 786492 - DNA, 22 bp, Artificial Sequence
  chemically synthesized
cgagtcacattcttgtgaattc

SEQ ID NO: 786493 - DNA, 22 bp, Artificial Sequence
  chemically synthesized
aaaaataattttaaaaagccag

SEQ ID NO: 786494 - DNA, 22 bp, Artificial Sequence
  chemically synthesized
caaaaataattttaaaaagcca

SEQ ID NO: 786495 - DNA, 22 bp, Artificial Sequence
  chemically synthesized
ttgtgaattctggctttttaaa

SEQ ID NO: 786496 - DNA, 22 bp, Artificial Sequence
  chemically synthesized
gtgaattctggctttttaaaat

SEQ ID NO: 786497 - DNA, 22 bp, Artificial Sequence
  chemically synthesized
tgaattctggctttttaaaatt

SEQ ID NO: 786498 - DNA, 22 bp, Artificial Sequence
  chemically synthesized
aaatttcaaaaataattttaaa

SEQ ID NO: 786499 - DNA, 22 bp, Artificial Sequence
  chemically synthesized
ctaaaatttcaaaaataatttt

SEQ ID NO: 786500 - DNA, 22 bp, Artificial Sequence
  chemically synthesized
actaaaatttcaaaaataattt

SEQ ID NO: 786501 - DNA, 22 bp, Artificial Sequence
  chemically synthesized
tggctttttaaaattatttttg

SEQ ID NO: 786502 - DNA, 22 bp, Artificial Sequence
  chemically synthesized
gctttttaaaattatttttgaa

SEQ ID NO: 786503 - DNA, 22 bp, Artificial Sequence
  chemically synthesized
tttaaaattatttttgaaattt

SEQ ID NO: 786504 - DNA, 22 bp, Artificial Sequence
  chemically synthesized
ttaaaattatttttgaaatttt

SEQ ID NO: 786505 - DNA, 22 bp, Artificial Sequence
  chemically synthesized
tgtaatcttactaaaatttcaa

SEQ ID NO: 786506 - DNA, 22 bp, Artificial Sequence
  chemically synthesized
taaaattatttttgaaatttta

SEQ ID NO: 786507 - DNA, 22 bp, Artificial Sequence
  chemically synthesized
atgtaatcttactaaaatttca

SEQ ID NO: 786508 - DNA, 22 bp, Artificial Sequence
  chemically synthesized
aaaattatttttgaaattttag

SEQ ID NO: 786509 - DNA, 22 bp, Artificial Sequence
  chemically synthesized
tatgtaatcttactaaaatttc

SEQ ID NO: 786510 - DNA, 22 bp, Artificial Sequence
  chemically synthesized
aaattatttttgaaattttagt

SEQ ID NO: 786511 - DNA, 22 bp, Artificial Sequence
  chemically synthesized
ttttatgtaatcttactaaaat

SEQ ID NO: 786512 - DNA, 22 bp, Artificial Sequence
  chemically synthesized
tttttgaaattttagtaagatt

SEQ ID NO: 786513 - DNA, 22 bp, Artificial Sequence
  chemically synthesized
ttgaaattttagtaagattaca

SEQ ID NO: 786514 - DNA, 22 bp, Artificial Sequence
  chemically synthesized
tgaaattttagtaagattacat

SEQ ID NO: 786515 - DNA, 22 bp, Artificial Sequence
  chemically synthesized
gaaattttagtaagattacata

SEQ ID NO: 786516 - DNA, 22 bp, Artificial Sequence
  chemically synthesized
aaattttagtaagattacataa

SEQ ID NO: 786517 - DNA, 22 bp, Artificial Sequence
  chemically synthesized
catggcgctgttttatgtaatc

SEQ ID NO: 786518 - DNA, 22 bp, Artificial Sequence
  chemically synthesized
acatggcgctgttttatgtaat

SEQ ID NO: 786519 - DNA, 22 bp, Artificial Sequence
  chemically synthesized
tagtaagattacataaaacagc

SEQ ID NO: 786520 - DNA, 22 bp, Artificial Sequence
  chemically synthesized
agtaagattacataaaacagcg

SEQ ID NO: 786521 - DNA, 22 bp, Artificial Sequence
  chemically synthesized
tagtttacatggcgctgtttta

SEQ ID NO: 786522 - DNA, 22 bp, Artificial Sequence
  chemically synthesized
gtaagattacataaaacagcgc

SEQ ID NO: 786523 - DNA, 22 bp, Artificial Sequence
  chemically synthesized
atagtttacatggcgctgtttt

SEQ ID NO: 786524 - DNA, 22 bp, Artificial Sequence
  chemically synthesized
tatagtttacatggcgctgttt

SEQ ID NO: 786525 - DNA, 22 bp, Artificial Sequence
  chemically synthesized
cataaaacagcgccatgtaaac

SEQ ID NO: 786526 - DNA, 22 bp, Artificial Sequence
  chemically synthesized
tatatgatcctttatagtttac

SEQ ID NO: 786527 - DNA, 22 bp, Artificial Sequence
  chemically synthesized
gtatatgatcctttatagttta

SEQ ID NO: 786528 - DNA, 22 bp, Artificial Sequence
  chemically synthesized
atttgtatatgatcctttatag

SEQ ID NO: 786529 - DNA, 22 bp, Artificial Sequence
  chemically synthesized
catttgtatatgatcctttata

SEQ ID NO: 786530 - DNA, 22 bp, Artificial Sequence
  chemically synthesized
taaaggatcatatacaaatgaa

SEQ ID NO: 786531 - DNA, 22 bp, Artificial Sequence
  chemically synthesized
atagtaatgtgcttcatttgta

SEQ ID NO: 786532 - DNA, 22 bp, Artificial Sequence
  chemically synthesized
ctaatagtaatgtgcttcattt

SEQ ID NO: 786533 - DNA, 22 bp, Artificial Sequence
  chemically synthesized
taattactaatagtaatgtgct

SEQ ID NO: 786534 - DNA, 22 bp, Artificial Sequence
  chemically synthesized
gtggtgcattataattactaat

SEQ ID NO: 786535 - DNA, 22 bp, Artificial Sequence
  chemically synthesized
tggtggtgcattataattacta

SEQ ID NO: 786536 - DNA, 22 bp, Artificial Sequence
  chemically synthesized
ctggtggtgcattataattact

SEQ ID NO: 786537 - DNA, 22 bp, Artificial Sequence
  chemically synthesized
tttctggtggtgcattataatt

SEQ ID NO: 786538 - DNA, 22 bp, Artificial Sequence
  chemically synthesized
atttctggtggtgcattataat

SEQ ID NO: 786539 - DNA, 22 bp, Artificial Sequence
  chemically synthesized
ttatttctggtggtgcattata

SEQ ID NO: 786540 - DNA, 22 bp, Artificial Sequence
  chemically synthesized
ctattagtaattataatgcacc

SEQ ID NO: 786541 - DNA, 22 bp, Artificial Sequence
  chemically synthesized
ttagtaattataatgcaccacc

SEQ ID NO: 786542 - DNA, 22 bp, Artificial Sequence
  chemically synthesized
tctcttatttctggtggtgcat

SEQ ID NO: 786543 - DNA, 22 bp, Artificial Sequence
  chemically synthesized
tatctcttatttctggtggtgc

SEQ ID NO: 786544 - DNA, 22 bp, Artificial Sequence
  chemically synthesized
gtaattataatgcaccaccaga

SEQ ID NO: 786545 - DNA, 22 bp, Artificial Sequence
  chemically synthesized
ctatctcttatttctggtggtg

SEQ ID NO: 786546 - DNA, 22 bp, Artificial Sequence
  chemically synthesized
taatgcaccaccagaaataaga

SEQ ID NO: 786547 - DNA, 22 bp, Artificial Sequence
  chemically synthesized
aagggccttctatctcttattt

SEQ ID NO: 786548 - DNA, 22 bp, Artificial Sequence
  chemically synthesized
atagtcaaaataggttaaaggg

SEQ ID NO: 786549 - DNA, 22 bp, Artificial Sequence
  chemically synthesized
tctcatagtcaaaataggttaa

SEQ ID NO: 786550 - DNA, 22 bp, Artificial Sequence
  chemically synthesized
ctgtctcatagtcaaaataggt

SEQ ID NO: 786551 - DNA, 22 bp, Artificial Sequence
  chemically synthesized
tcctcctgtctcatagtcaaaa

SEQ ID NO: 786552 - DNA, 22 bp, Artificial Sequence
  chemically synthesized
tatcctcctgtctcatagtcaa

SEQ ID NO: 786553 - DNA, 22 bp, Artificial Sequence
  chemically synthesized
taacctattttgactatgagac

SEQ ID NO: 786554 - DNA, 22 bp, Artificial Sequence
  chemically synthesized
aacctattttgactatgagaca

SEQ ID NO: 786555 - DNA, 22 bp, Artificial Sequence
  chemically synthesized
gttctatcctcctgtctcatag

SEQ ID NO: 786556 - DNA, 22 bp, Artificial Sequence
  chemically synthesized
acctattttgactatgagacag

SEQ ID NO: 786557 - DNA, 22 bp, Artificial Sequence
  chemically synthesized
ttttgactatgagacaggagga

SEQ ID NO: 786558 - DNA, 22 bp, Artificial Sequence
  chemically synthesized
tgactatgagacaggaggatag

SEQ ID NO: 786559 - DNA, 22 bp, Artificial Sequence
  chemically synthesized
ggggaattggttctatcctcct

SEQ ID NO: 786560 - DNA, 22 bp, Artificial Sequence
  chemically synthesized
gactatgagacaggaggataga

SEQ ID NO: 786561 - DNA, 22 bp, Artificial Sequence
  chemically synthesized
actatgagacaggaggatagaa

SEQ ID NO: 786562 - DNA, 22 bp, Artificial Sequence
  chemically synthesized
ttgggggaattggttctatcct

SEQ ID NO: 786563 - DNA, 22 bp, Artificial Sequence
  chemically synthesized
tgagacaggaggatagaaccaa

SEQ ID NO: 786564 - DNA, 22 bp, Artificial Sequence
  chemically synthesized
gctgttgggggaattggttcta

SEQ ID NO: 786565 - DNA, 22 bp, Artificial Sequence
  chemically synthesized
aaccctggctgttgggggaatt

SEQ ID NO: 786566 - DNA, 22 bp, Artificial Sequence
  chemically synthesized
ataatactgaaccctggctgtt

SEQ ID NO: 786567 - DNA, 22 bp, Artificial Sequence
  chemically synthesized
ttaataatactgaaccctggct

SEQ ID NO: 786568 - DNA, 22 bp, Artificial Sequence
  chemically synthesized
ccccaacagccagggttcagta

SEQ ID NO: 786569 - DNA, 22 bp, Artificial Sequence
  chemically synthesized
tcattattaataatactgaacc

SEQ ID NO: 786570 - DNA, 22 bp, Artificial Sequence
  chemically synthesized
ttatcattattaataatactga

SEQ ID NO: 786571 - DNA, 22 bp, Artificial Sequence
  chemically synthesized
attatcattattaataatactg

SEQ ID NO: 786572 - DNA, 22 bp, Artificial Sequence
  chemically synthesized
tattatcattattaataatact

SEQ ID NO: 786573 - DNA, 22 bp, Artificial Sequence
  chemically synthesized
attttattatcattattaataa

SEQ ID NO: 786574 - DNA, 22 bp, Artificial Sequence
  chemically synthesized
agtattattaataatgataata

SEQ ID NO: 786575 - DNA, 22 bp, Artificial Sequence
  chemically synthesized
gtagattcattttattatcatt

SEQ ID NO: 786576 - DNA, 22 bp, Artificial Sequence
  chemically synthesized
ttagtagattcattttattatc

SEQ ID NO: 786577 - DNA, 22 bp, Artificial Sequence
  chemically synthesized
ttaataatgataataaaatgaa

SEQ ID NO: 786578 - DNA, 22 bp, Artificial Sequence
  chemically synthesized
ataatgataataaaatgaatct

SEQ ID NO: 786579 - DNA, 22 bp, Artificial Sequence
  chemically synthesized
gtatgttgttagtagattcatt

SEQ ID NO: 786580 - DNA, 22 bp, Artificial Sequence
  chemically synthesized
ggtatgttgttagtagattcat

SEQ ID NO: 786581 - DNA, 22 bp, Artificial Sequence
  chemically synthesized
tgaaggcttggtatgttgttag

SEQ ID NO: 786582 - DNA, 22 bp, Artificial Sequence
  chemically synthesized
catattgtgaaggcttggtatg

SEQ ID NO: 786583 - DNA, 22 bp, Artificial Sequence
  chemically synthesized
ctaacaacataccaagccttca

SEQ ID NO: 786584 - DNA, 22 bp, Artificial Sequence
  chemically synthesized
acaacataccaagccttcacaa

SEQ ID NO: 786585 - DNA, 22 bp, Artificial Sequence
  chemically synthesized
gtacggtgccctgcatattgtg

SEQ ID NO: 786586 - DNA, 22 bp, Artificial Sequence
  chemically synthesized
agtacggtgccctgcatattgt

SEQ ID NO: 786587 - DNA, 22 bp, Artificial Sequence
  chemically synthesized
cacaatatgcagggcaccgtac

SEQ ID NO: 786588 - DNA, 22 bp, Artificial Sequence
  chemically synthesized
acaatatgcagggcaccgtact

SEQ ID NO: 786589 - DNA, 22 bp, Artificial Sequence
  chemically synthesized
tataaagcacttagtacggtgc

SEQ ID NO: 786590 - DNA, 22 bp, Artificial Sequence
  chemically synthesized
atataaagcacttagtacggtg

SEQ ID NO: 786591 - DNA, 22 bp, Artificial Sequence
  chemically synthesized
aatgagaaaacttatataaagc

SEQ ID NO: 786592 - DNA, 22 bp, Artificial Sequence
  chemically synthesized
agtgctttatataagttttctc

SEQ ID NO: 786593 - DNA, 22 bp, Artificial Sequence
  chemically synthesized
tgaagattaaatgagaaaactt

SEQ ID NO: 786594 - DNA, 22 bp, Artificial Sequence
  chemically synthesized
atattgtgaagattaaatgaga

SEQ ID NO: 786595 - DNA, 22 bp, Artificial Sequence
  chemically synthesized
tatataagttttctcatttaat

SEQ ID NO: 786596 - DNA, 22 bp, Artificial Sequence
  chemically synthesized
atataagttttctcatttaatc

SEQ ID NO: 786597 - DNA, 22 bp, Artificial Sequence
  chemically synthesized
tataagttttctcatttaatct

SEQ ID NO: 786598 - DNA, 22 bp, Artificial Sequence
  chemically synthesized
tctcatttaatcttcacaatat

SEQ ID NO: 786599 - DNA, 22 bp, Artificial Sequence
  chemically synthesized
ctcatttaatcttcacaatatt

SEQ ID NO: 786600 - DNA, 22 bp, Artificial Sequence
  chemically synthesized
tcatttaatcttcacaatatta

SEQ ID NO: 786601 - DNA, 22 bp, Artificial Sequence
  chemically synthesized
atttaatcttcacaatattaat

SEQ ID NO: 786602 - DNA, 22 bp, Artificial Sequence
  chemically synthesized
aatcttcacaatattaatctct

SEQ ID NO: 786603 - DNA, 22 bp, Artificial Sequence
  chemically synthesized
atcttcacaatattaatctcta

SEQ ID NO: 786604 - DNA, 22 bp, Artificial Sequence
  chemically synthesized
aatagaggaataggagtagaga

SEQ ID NO: 786605 - DNA, 22 bp, Artificial Sequence
  chemically synthesized
cacaatattaatctctactcct

SEQ ID NO: 786606 - DNA, 22 bp, Artificial Sequence
  chemically synthesized
acaatattaatctctactccta

SEQ ID NO: 786607 - DNA, 22 bp, Artificial Sequence
  chemically synthesized
taaatagaggaataggagtaga

SEQ ID NO: 786608 - DNA, 22 bp, Artificial Sequence
  chemically synthesized
ctaaatagaggaataggagtag

SEQ ID NO: 786609 - DNA, 22 bp, Artificial Sequence
  chemically synthesized
gtttctaaatagaggaatagga

SEQ ID NO: 786610 - DNA, 22 bp, Artificial Sequence
  chemically synthesized
atctctactcctattcctctat

SEQ ID NO: 786611 - DNA, 22 bp, Artificial Sequence
  chemically synthesized
caggtctggtttctaaatagag

SEQ ID NO: 786612 - DNA, 22 bp, Artificial Sequence
  chemically synthesized
tactcctattcctctatttaga

SEQ ID NO: 786613 - DNA, 22 bp, Artificial Sequence
  chemically synthesized
ctcctattcctctatttagaaa

SEQ ID NO: 786614 - DNA, 22 bp, Artificial Sequence
  chemically synthesized
ctattcctctatttagaaacca

SEQ ID NO: 786615 - DNA, 22 bp, Artificial Sequence
  chemically synthesized
aatcactccaggtctggtttct

SEQ ID NO: 786616 - DNA, 22 bp, Artificial Sequence
  chemically synthesized
ttcctctatttagaaaccagac

SEQ ID NO: 786617 - DNA, 22 bp, Artificial Sequence
  chemically synthesized
tcaatcactccaggtctggttt

SEQ ID NO: 786618 - DNA, 22 bp, Artificial Sequence
  chemically synthesized
ctcaatcactccaggtctggtt

SEQ ID NO: 786619 - DNA, 22 bp, Artificial Sequence
  chemically synthesized
ctctatttagaaaccagacctg

SEQ ID NO: 786620 - DNA, 22 bp, Artificial Sequence
  chemically synthesized
tatttagaaaccagacctggag

SEQ ID NO: 786621 - DNA, 22 bp, Artificial Sequence
  chemically synthesized
tttagaaaccagacctggagtg

SEQ ID NO: 786622 - DNA, 22 bp, Artificial Sequence
  chemically synthesized
aagtttctcaatcactccaggt

SEQ ID NO: 786623 - DNA, 22 bp, Artificial Sequence
  chemically synthesized
caagtttctcaatcactccagg

SEQ ID NO: 786624 - DNA, 22 bp, Artificial Sequence
  chemically synthesized
agaaaccagacctggagtgatt

SEQ ID NO: 786625 - DNA, 22 bp, Artificial Sequence
  chemically synthesized
gaaaccagacctggagtgattg

SEQ ID NO: 786626 - DNA, 22 bp, Artificial Sequence
  chemically synthesized
cttcaagtttctcaatcactcc

SEQ ID NO: 786627 - DNA, 22 bp, Artificial Sequence
  chemically synthesized
ccttcaagtttctcaatcactc

SEQ ID NO: 786628 - DNA, 22 bp, Artificial Sequence
  chemically synthesized
tccttcaagtttctcaatcact

SEQ ID NO: 786629 - DNA, 22 bp, Artificial Sequence
  chemically synthesized
tgtgattttccttcaagtttct

SEQ ID NO: 786630 - DNA, 22 bp, Artificial Sequence
  chemically synthesized
gagtgattgagaaacttgaagg

SEQ ID NO: 786631 - DNA, 22 bp, Artificial Sequence
  chemically synthesized
aaactgtgtgattttccttcaa

SEQ ID NO: 786632 - DNA, 22 bp, Artificial Sequence
  chemically synthesized
caaactgtgtgattttccttca

SEQ ID NO: 786633 - DNA, 22 bp, Artificial Sequence
  chemically synthesized
tcaaactgtgtgattttccttc

SEQ ID NO: 786634 - DNA, 22 bp, Artificial Sequence
  chemically synthesized
agaaacttgaaggaaaatcaca

SEQ ID NO: 786635 - DNA, 22 bp, Artificial Sequence
  chemically synthesized
tgtcactttcaaactgtgtgat

SEQ ID NO: 786636 - DNA, 22 bp, Artificial Sequence
  chemically synthesized
gaaggaaaatcacacagtttga

SEQ ID NO: 786637 - DNA, 22 bp, Artificial Sequence
  chemically synthesized
gctatgtcactttcaaactgtg

SEQ ID NO: 786638 - DNA, 22 bp, Artificial Sequence
  chemically synthesized
aaggaaaatcacacagtttgaa

SEQ ID NO: 786639 - DNA, 22 bp, Artificial Sequence
  chemically synthesized
aacactagctatgtcactttca

SEQ ID NO: 786640 - DNA, 22 bp, Artificial Sequence
  chemically synthesized
tgaacactagctatgtcacttt

SEQ ID NO: 786641 - DNA, 22 bp, Artificial Sequence
  chemically synthesized
ctgaacactagctatgtcactt

SEQ ID NO: 786642 - DNA, 22 bp, Artificial Sequence
  chemically synthesized
tttctgaacactagctatgtca

SEQ ID NO: 786643 - DNA, 22 bp, Artificial Sequence
  chemically synthesized
tgtttctgaacactagctatgt

SEQ ID NO: 786644 - DNA, 22 bp, Artificial Sequence
  chemically synthesized
gaaagtgacatagctagtgttc

SEQ ID NO: 786645 - DNA, 22 bp, Artificial Sequence
  chemically synthesized
aaagtgacatagctagtgttca

SEQ ID NO: 786646 - DNA, 22 bp, Artificial Sequence
  chemically synthesized
gtgttcagaaacagagtctaca

SEQ ID NO: 786647 - DNA, 22 bp, Artificial Sequence
  chemically synthesized
agaaacagagtctacactttca

SEQ ID NO: 786648 - DNA, 22 bp, Artificial Sequence
  chemically synthesized
cagtggaggatagtaatgaaag

SEQ ID NO: 786649 - DNA, 22 bp, Artificial Sequence
  chemically synthesized
tcctgcagtggaggatagtaat

SEQ ID NO: 786650 - DNA, 22 bp, Artificial Sequence
  chemically synthesized
cactttcattactatcctccac

SEQ ID NO: 786651 - DNA, 22 bp, Artificial Sequence
  chemically synthesized
gaattatcctgcagtggaggat

SEQ ID NO: 786652 - DNA, 22 bp, Artificial Sequence
  chemically synthesized
tcattactatcctccactgcag

SEQ ID NO: 786653 - DNA, 22 bp, Artificial Sequence
  chemically synthesized
cattactatcctccactgcagg

SEQ ID NO: 786654 - DNA, 22 bp, Artificial Sequence
  chemically synthesized
cactggaattatcctgcagtgg

SEQ ID NO: 786655 - DNA, 22 bp, Artificial Sequence
  chemically synthesized
attactatcctccactgcagga

SEQ ID NO: 786656 - DNA, 22 bp, Artificial Sequence
  chemically synthesized
gcactggaattatcctgcagtg

SEQ ID NO: 786657 - DNA, 22 bp, Artificial Sequence
  chemically synthesized
tgcactggaattatcctgcagt

SEQ ID NO: 786658 - DNA, 22 bp, Artificial Sequence
  chemically synthesized
ctatcctccactgcaggataat

SEQ ID NO: 786659 - DNA, 22 bp, Artificial Sequence
  chemically synthesized
tcctccactgcaggataattcc

SEQ ID NO: 786660 - DNA, 22 bp, Artificial Sequence
  chemically synthesized
cactgcaggataattccagtgc

SEQ ID NO: 786661 - DNA, 22 bp, Artificial Sequence
  chemically synthesized
caggataattccagtgcaaagg

SEQ ID NO: 786662 - DNA, 22 bp, Artificial Sequence
  chemically synthesized
cagtgcaaaggatgatctgttt

SEQ ID NO: 786663 - DNA, 22 bp, Artificial Sequence
  chemically synthesized
aaaaaaaaaaaaaaacaaaaaa

SEQ ID NO: 786664 - DNA, 22 bp, Artificial Sequence
  chemically synthesized
tttgtttttttttttgtttttt

SEQ ID NO: 786665 - DNA, 22 bp, Artificial Sequence
  chemically synthesized
cctcaaaaaaaaaaaaaaacaa

SEQ ID NO: 786666 - DNA, 22 bp, Artificial Sequence
  chemically synthesized
gtttttttttttgttttttttt

SEQ ID NO: 786667 - DNA, 22 bp, Artificial Sequence
  chemically synthesized
tgcctcaaaaaaaaaaaaaaac

SEQ ID NO: 786668 - DNA, 22 bp, Artificial Sequence
  chemically synthesized
tttttttttttgtttttttttt

SEQ ID NO: 786669 - DNA, 22 bp, Artificial Sequence
  chemically synthesized
ttttttttgttttttttttttt

SEQ ID NO: 786670 - DNA, 22 bp, Artificial Sequence
  chemically synthesized
tttttttgtttttttttttttt

SEQ ID NO: 786671 - DNA, 22 bp, Artificial Sequence
  chemically synthesized
ttttttgttttttttttttttt

SEQ ID NO: 786672 - DNA, 22 bp, Artificial Sequence
  chemically synthesized
tttttgtttttttttttttttg

SEQ ID NO: 786673 - DNA, 22 bp, Artificial Sequence
  chemically synthesized
ttttgtttttttttttttttga

SEQ ID NO: 786674 - DNA, 22 bp, Artificial Sequence
  chemically synthesized
tttgtttttttttttttttgag

SEQ ID NO: 786675 - DNA, 22 bp, Artificial Sequence
  chemically synthesized
ttgtttttttttttttttgagg

SEQ ID NO: 786676 - DNA, 22 bp, Artificial Sequence
  chemically synthesized
tgtttttttttttttttgaggc

SEQ ID NO: 786677 - DNA, 22 bp, Artificial Sequence
  chemically synthesized
gtttttttttttttttgaggca

SEQ ID NO: 786678 - DNA, 22 bp, Artificial Sequence
  chemically synthesized
tttttttttttttttgaggcag

SEQ ID NO: 786679 - DNA, 22 bp, Artificial Sequence
  chemically synthesized
ttttttttttttgaggcagagt

SEQ ID NO: 786680 - DNA, 22 bp, Artificial Sequence
  chemically synthesized
tttttttttttgaggcagagtc

SEQ ID NO: 786681 - DNA, 22 bp, Artificial Sequence
  chemically synthesized
ttttttttttgaggcagagtct

SEQ ID NO: 786682 - DNA, 22 bp, Artificial Sequence
  chemically synthesized
tttttttttgaggcagagtctg

SEQ ID NO: 786683 - DNA, 22 bp, Artificial Sequence
  chemically synthesized
ttttttttgaggcagagtctgg

SEQ ID NO: 786684 - DNA, 22 bp, Artificial Sequence
  chemically synthesized
tttttttgaggcagagtctggc

SEQ ID NO: 786685 - DNA, 22 bp, Artificial Sequence
  chemically synthesized
ttttttgaggcagagtctggct

SEQ ID NO: 786686 - DNA, 22 bp, Artificial Sequence
  chemically synthesized
tttttgaggcagagtctggctc

SEQ ID NO: 786687 - DNA, 22 bp, Artificial Sequence
  chemically synthesized
ttttgaggcagagtctggctct

SEQ ID NO: 786688 - DNA, 22 bp, Artificial Sequence
  chemically synthesized
tttgaggcagagtctggctctg

SEQ ID NO: 786689 - DNA, 22 bp, Artificial Sequence
  chemically synthesized
cagcccgggcaacagagccaga

SEQ ID NO: 786690 - DNA, 22 bp, Artificial Sequence
  chemically synthesized
ttgaggcagagtctggctctgt

SEQ ID NO: 786691 - DNA, 22 bp, Artificial Sequence
  chemically synthesized
tgaggcagagtctggctctgtt

SEQ ID NO: 786692 - DNA, 22 bp, Artificial Sequence
  chemically synthesized
gaggcagagtctggctctgttg

SEQ ID NO: 786693 - DNA, 22 bp, Artificial Sequence
  chemically synthesized
aggcagagtctggctctgttgc

SEQ ID NO: 786694 - DNA, 22 bp, Artificial Sequence
  chemically synthesized
cactccagcccgggcaacagag

SEQ ID NO: 786695 - DNA, 22 bp, Artificial Sequence
  chemically synthesized
gctctgttgcccgggctggagt

SEQ ID NO: 786696 - DNA, 22 bp, Artificial Sequence
  chemically synthesized
tgttgcccgggctggagtgcag

SEQ ID NO: 786697 - DNA, 22 bp, Artificial Sequence
  chemically synthesized
ttgcccgggctggagtgcagtg

SEQ ID NO: 786698 - DNA, 22 bp, Artificial Sequence
  chemically synthesized
cccgggctggagtgcagtgact

SEQ ID NO: 786699 - DNA, 22 bp, Artificial Sequence
  chemically synthesized
cggtgagccgagatcgagtcac

SEQ ID NO: 786700 - DNA, 22 bp, Artificial Sequence
  chemically synthesized
gcggtgagccgagatcgagtca

SEQ ID NO: 786701 - DNA, 22 bp, Artificial Sequence
  chemically synthesized
gagtgcagtgactcgatctcgg

SEQ ID NO: 786702 - DNA, 22 bp, Artificial Sequence
  chemically synthesized
gatctcggctcaccgcaagctc

SEQ ID NO: 786703 - DNA, 22 bp, Artificial Sequence
  chemically synthesized
ggctcaccgcaagctccacctc

SEQ ID NO: 786704 - DNA, 22 bp, Artificial Sequence
  chemically synthesized
accgcaagctccacctcccgga

SEQ ID NO: 786705 - DNA, 22 bp, Artificial Sequence
  chemically synthesized
aggcaggaggatggcatgaatc

SEQ ID NO: 786706 - DNA, 22 bp, Artificial Sequence
  chemically synthesized
cacctcccggattcatgccatc

SEQ ID NO: 786707 - DNA, 22 bp, Artificial Sequence
  chemically synthesized
ccggattcatgccatcctcctg

SEQ ID NO: 786708 - DNA, 22 bp, Artificial Sequence
  chemically synthesized
aggaggctgaggcaggaggatg

SEQ ID NO: 786709 - DNA, 22 bp, Artificial Sequence
  chemically synthesized
ctcaggaggctgaggcaggagg

SEQ ID NO: 786710 - DNA, 22 bp, Artificial Sequence
  chemically synthesized
atgccatcctcctgcctcagcc

SEQ ID NO: 786711 - DNA, 22 bp, Artificial Sequence
  chemically synthesized
tggtcccagctactcaggaggc

SEQ ID NO: 786712 - DNA, 22 bp, Artificial Sequence
  chemically synthesized
ctgcctcagcctcctgagtagc

SEQ ID NO: 786713 - DNA, 22 bp, Artificial Sequence
  chemically synthesized
cctcagcctcctgagtagctgg

SEQ ID NO: 786714 - DNA, 22 bp, Artificial Sequence
  chemically synthesized
agcctcctgagtagctgggacc

SEQ ID NO: 786715 - DNA, 22 bp, Artificial Sequence
  chemically synthesized
tggtgggcgcctgtggtcccag

SEQ ID NO: 786716 - DNA, 22 bp, Artificial Sequence
  chemically synthesized
ctgagtagctgggaccacaggc

SEQ ID NO: 786717 - DNA, 22 bp, Artificial Sequence
  chemically synthesized
agtagctgggaccacaggcgcc

SEQ ID NO: 786718 - DNA, 22 bp, Artificial Sequence
  chemically synthesized
ggaccacaggcgcccaccacaa

SEQ ID NO: 786719 - DNA, 22 bp, Artificial Sequence
  chemically synthesized
aaaatacaaaaaatcagccggg

SEQ ID NO: 786720 - DNA, 22 bp, Artificial Sequence
  chemically synthesized
ctgaaaatacaaaaaatcagcc

SEQ ID NO: 786721 - DNA, 22 bp, Artificial Sequence
  chemically synthesized
tactgaaaatacaaaaaatcag

SEQ ID NO: 786722 - DNA, 22 bp, Artificial Sequence
  chemically synthesized
attttttgtattttcagtagag

SEQ ID NO: 786723 - DNA, 22 bp, Artificial Sequence
  chemically synthesized
tttgtattttcagtagagatgg

SEQ ID NO: 786724 - DNA, 22 bp, Artificial Sequence
  chemically synthesized
ttgtattttcagtagagatggg

SEQ ID NO: 786725 - DNA, 22 bp, Artificial Sequence
  chemically synthesized
acatggtgaaaccccatctcta

SEQ ID NO: 786726 - DNA, 22 bp, Artificial Sequence
  chemically synthesized
tgtattttcagtagagatgggg

SEQ ID NO: 786727 - DNA, 22 bp, Artificial Sequence
  chemically synthesized
gtattttcagtagagatggggt

SEQ ID NO: 786728 - DNA, 22 bp, Artificial Sequence
  chemically synthesized
tattttcagtagagatggggtt

SEQ ID NO: 786729 - DNA, 22 bp, Artificial Sequence
  chemically synthesized
gctaacatggtgaaaccccatc

SEQ ID NO: 786730 - DNA, 22 bp, Artificial Sequence
  chemically synthesized
tcagtagagatggggtttcacc

SEQ ID NO: 786731 - DNA, 22 bp, Artificial Sequence
  chemically synthesized
cagtagagatggggtttcacca

SEQ ID NO: 786732 - DNA, 22 bp, Artificial Sequence
  chemically synthesized
agtagagatggggtttcaccat

SEQ ID NO: 786733 - DNA, 22 bp, Artificial Sequence
  chemically synthesized
caccatgttagccaggatggtc

SEQ ID NO: 786734 - DNA, 22 bp, Artificial Sequence
  chemically synthesized
accatgttagccaggatggtct

SEQ ID NO: 786735 - DNA, 22 bp, Artificial Sequence
  chemically synthesized
gccaggatggtctcgatctcct

SEQ ID NO: 786736 - DNA, 22 bp, Artificial Sequence
  chemically synthesized
gatctcctgacctcgtgatccg

SEQ ID NO: 786737 - DNA, 22 bp, Artificial Sequence
  chemically synthesized
ggaggccgaggcaggcggatca

SEQ ID NO: 786738 - DNA, 22 bp, Artificial Sequence
  chemically synthesized
gggaggccgaggcaggcggatc

SEQ ID NO: 786739 - DNA, 22 bp, Artificial Sequence
  chemically synthesized
tgggaggccgaggcaggcggat

SEQ ID NO: 786740 - DNA, 22 bp, Artificial Sequence
  chemically synthesized
ctgacctcgtgatccgcctgcc

SEQ ID NO: 786741 - DNA, 22 bp, Artificial Sequence
  chemically synthesized
acctcgtgatccgcctgcctcg

SEQ ID NO: 786742 - DNA, 22 bp, Artificial Sequence
  chemically synthesized
gtgatccgcctgcctcggcctc

SEQ ID NO: 786743 - DNA, 22 bp, Artificial Sequence
  chemically synthesized
taatcccagcactttgggaggc

SEQ ID NO: 786744 - DNA, 22 bp, Artificial Sequence
  chemically synthesized
cctcggcctcccaaagtgctgg

SEQ ID NO: 786745 - DNA, 22 bp, Artificial Sequence
  chemically synthesized
acacctgtaatcccagcacttt

SEQ ID NO: 786746 - DNA, 22 bp, Artificial Sequence
  chemically synthesized
ggcctcccaaagtgctgggatt

SEQ ID NO: 786747 - DNA, 22 bp, Artificial Sequence
  chemically synthesized
ccaaagtgctgggattacaggt

SEQ ID NO: 786748 - DNA, 22 bp, Artificial Sequence
  chemically synthesized
cagccgggcacagtggctcaca

SEQ ID NO: 786749 - DNA, 22 bp, Artificial Sequence
  chemically synthesized
gcagccgggcacagtggctcac

SEQ ID NO: 786750 - DNA, 22 bp, Artificial Sequence
  chemically synthesized
ggattacaggtgtgagccactg

SEQ ID NO: 786751 - DNA, 22 bp, Artificial Sequence
  chemically synthesized
tgcagccgggcacagtggctca

SEQ ID NO: 786752 - DNA, 22 bp, Artificial Sequence
  chemically synthesized
caggtgtgagccactgtgcccg

SEQ ID NO: 786753 - DNA, 22 bp, Artificial Sequence
  chemically synthesized
aagataatcctttgcagccggg

SEQ ID NO: 786754 - DNA, 22 bp, Artificial Sequence
  chemically synthesized
aaagataatcctttgcagccgg

SEQ ID NO: 786755 - DNA, 22 bp, Artificial Sequence
  chemically synthesized
acttaaagataatcctttgcag

SEQ ID NO: 786756 - DNA, 22 bp, Artificial Sequence
  chemically synthesized
aacttaaagataatcctttgca

SEQ ID NO: 786757 - DNA, 22 bp, Artificial Sequence
  chemically synthesized
tgcccggctgcaaaggattatc

SEQ ID NO: 786758 - DNA, 22 bp, Artificial Sequence
  chemically synthesized
tgtttaacttaaagataatcct

SEQ ID NO: 786759 - DNA, 22 bp, Artificial Sequence
  chemically synthesized
tatgtttaacttaaagataatc

SEQ ID NO: 786760 - DNA, 22 bp, Artificial Sequence
  chemically synthesized
ctatgtttaacttaaagataat

SEQ ID NO: 786761 - DNA, 22 bp, Artificial Sequence
  chemically synthesized
tttctatgtttaacttaaagat

SEQ ID NO: 786762 - DNA, 22 bp, Artificial Sequence
  chemically synthesized
atttctatgtttaacttaaaga

SEQ ID NO: 786763 - DNA, 22 bp, Artificial Sequence
  chemically synthesized
caaaggattatctttaagttaa

SEQ ID NO: 786764 - DNA, 22 bp, Artificial Sequence
  chemically synthesized
catccttatttctatgtttaac

SEQ ID NO: 786765 - DNA, 22 bp, Artificial Sequence
  chemically synthesized
acatccttatttctatgtttaa

SEQ ID NO: 786766 - DNA, 22 bp, Artificial Sequence
  chemically synthesized
tacatccttatttctatgttta

SEQ ID NO: 786767 - DNA, 22 bp, Artificial Sequence
  chemically synthesized
tctttaagttaaacatagaaat

SEQ ID NO: 786768 - DNA, 22 bp, Artificial Sequence
  chemically synthesized
cattttacatccttatttctat

SEQ ID NO: 786769 - DNA, 22 bp, Artificial Sequence
  chemically synthesized
taagttaaacatagaaataagg

SEQ ID NO: 786770 - DNA, 22 bp, Artificial Sequence
  chemically synthesized
aagttaaacatagaaataagga

SEQ ID NO: 786771 - DNA, 22 bp, Artificial Sequence
  chemically synthesized
agttaaacatagaaataaggat

SEQ ID NO: 786772 - DNA, 22 bp, Artificial Sequence
  chemically synthesized
aattccattttacatccttatt

SEQ ID NO: 786773 - DNA, 22 bp, Artificial Sequence
  chemically synthesized
taaattccattttacatcctta

SEQ ID NO: 786774 - DNA, 22 bp, Artificial Sequence
  chemically synthesized
aacatagaaataaggatgtaaa

SEQ ID NO: 786775 - DNA, 22 bp, Artificial Sequence
  chemically synthesized
agaattctaaattccattttac

SEQ ID NO: 786776 - DNA, 22 bp, Artificial Sequence
  chemically synthesized
cagaattctaaattccatttta

SEQ ID NO: 786777 - DNA, 22 bp, Artificial Sequence
  chemically synthesized
atagacttcagaattctaaatt

SEQ ID NO: 786778 - DNA, 22 bp, Artificial Sequence
  chemically synthesized
ttgatagacttcagaattctaa

SEQ ID NO: 786779 - DNA, 22 bp, Artificial Sequence
  chemically synthesized
gttgatagacttcagaattcta

SEQ ID NO: 786780 - DNA, 22 bp, Artificial Sequence
  chemically synthesized
cttgttgatagacttcagaatt

SEQ ID NO: 786781 - DNA, 22 bp, Artificial Sequence
  chemically synthesized
ccttgttgatagacttcagaat

SEQ ID NO: 786782 - DNA, 22 bp, Artificial Sequence
  chemically synthesized
gtttccttgttgatagacttca

SEQ ID NO: 786783 - DNA, 22 bp, Artificial Sequence
  chemically synthesized
agaattctgaagtctatcaaca

SEQ ID NO: 786784 - DNA, 22 bp, Artificial Sequence
  chemically synthesized
gaattctgaagtctatcaacaa

SEQ ID NO: 786785 - DNA, 22 bp, Artificial Sequence
  chemically synthesized
atagcactagtttccttgttga

SEQ ID NO: 786786 - DNA, 22 bp, Artificial Sequence
  chemically synthesized
catagcactagtttccttgttg

SEQ ID NO: 786787 - DNA, 22 bp, Artificial Sequence
  chemically synthesized
tcatagcactagtttccttgtt

SEQ ID NO: 786788 - DNA, 22 bp, Artificial Sequence
  chemically synthesized
tgaagtctatcaacaaggaaac

SEQ ID NO: 786789 - DNA, 22 bp, Artificial Sequence
  chemically synthesized
ttcatagcactagtttccttgt

SEQ ID NO: 786790 - DNA, 22 bp, Artificial Sequence
  chemically synthesized
aagtctatcaacaaggaaacta

SEQ ID NO: 786791 - DNA, 22 bp, Artificial Sequence
  chemically synthesized
gcttttcatagcactagtttcc

SEQ ID NO: 786792 - DNA, 22 bp, Artificial Sequence
  chemically synthesized
cctagcttttcatagcactagt

SEQ ID NO: 786793 - DNA, 22 bp, Artificial Sequence
  chemically synthesized
tcaacaaggaaactagtgctat

SEQ ID NO: 786794 - DNA, 22 bp, Artificial Sequence
  chemically synthesized
tggacaaattacctagcttttc

SEQ ID NO: 786795 - DNA, 22 bp, Artificial Sequence
  chemically synthesized
gtggacaaattacctagctttt

SEQ ID NO: 786796 - DNA, 22 bp, Artificial Sequence
  chemically synthesized
gtgctatgaaaagctaggtaat

SEQ ID NO: 786797 - DNA, 22 bp, Artificial Sequence
  chemically synthesized
ggtatttgtggacaaattacct

SEQ ID NO: 786798 - DNA, 22 bp, Artificial Sequence
  chemically synthesized
tgaaaagctaggtaatttgtcc

SEQ ID NO: 786799 - DNA, 22 bp, Artificial Sequence
  chemically synthesized
ggtaatttgtccacaaataccc

SEQ ID NO: 786800 - DNA, 22 bp, Artificial Sequence
  chemically synthesized
tccgcaggtagcactgggtatt

SEQ ID NO: 786801 - DNA, 22 bp, Artificial Sequence
  chemically synthesized
tgtccgcaggtagcactgggta

SEQ ID NO: 786802 - DNA, 22 bp, Artificial Sequence
  chemically synthesized
gtccacaaatacccagtgctac

SEQ ID NO: 786803 - DNA, 22 bp, Artificial Sequence
  chemically synthesized
tccacaaatacccagtgctacc

SEQ ID NO: 786804 - DNA, 22 bp, Artificial Sequence
  chemically synthesized
gctctgtccgcaggtagcactg

SEQ ID NO: 786805 - DNA, 22 bp, Artificial Sequence
  chemically synthesized
tagctctgtccgcaggtagcac

SEQ ID NO: 786806 - DNA, 22 bp, Artificial Sequence
  chemically synthesized
ctagctctgtccgcaggtagca

SEQ ID NO: 786807 - DNA, 22 bp, Artificial Sequence
  chemically synthesized
tctagctctgtccgcaggtagc

SEQ ID NO: 786808 - DNA, 22 bp, Artificial Sequence
  chemically synthesized
ttctagctctgtccgcaggtag

SEQ ID NO: 786809 - DNA, 22 bp, Artificial Sequence
  chemically synthesized
cctgcggacagagctagaaaag

SEQ ID NO: 786810 - DNA, 22 bp, Artificial Sequence
  chemically synthesized
cggacagagctagaaaagtgcc

SEQ ID NO: 786811 - DNA, 22 bp, Artificial Sequence
  chemically synthesized
gtggtgaagtaaatgaccatat

SEQ ID NO: 786812 - DNA, 22 bp, Artificial Sequence
  chemically synthesized
gaaaagtgcccatatggtcatt

SEQ ID NO: 786813 - DNA, 22 bp, Artificial Sequence
  chemically synthesized
ggtggtgaagtaaatgaccata

SEQ ID NO: 786814 - DNA, 22 bp, Artificial Sequence
  chemically synthesized
tggtggtgaagtaaatgaccat

SEQ ID NO: 786815 - DNA, 22 bp, Artificial Sequence
  chemically synthesized
actttggtggtgaagtaaatga

SEQ ID NO: 786816 - DNA, 22 bp, Artificial Sequence
  chemically synthesized
cactttggtggtgaagtaaatg

SEQ ID NO: 786817 - DNA, 22 bp, Artificial Sequence
  chemically synthesized
gtgcatttcactttggtggtga

SEQ ID NO: 786818 - DNA, 22 bp, Artificial Sequence
  chemically synthesized
ggtgcatttcactttggtggtg

SEQ ID NO: 786819 - DNA, 22 bp, Artificial Sequence
  chemically synthesized
gtttggtgcatttcactttggt

SEQ ID NO: 786820 - DNA, 22 bp, Artificial Sequence
  chemically synthesized
ggtttggtgcatttcactttgg

SEQ ID NO: 786821 - DNA, 22 bp, Artificial Sequence
  chemically synthesized
acttcaccaccaaagtgaaatg

SEQ ID NO: 786822 - DNA, 22 bp, Artificial Sequence
  chemically synthesized
cttcaccaccaaagtgaaatgc

SEQ ID NO: 786823 - DNA, 22 bp, Artificial Sequence
  chemically synthesized
cccttggtttggtgcatttcac

SEQ ID NO: 786824 - DNA, 22 bp, Artificial Sequence
  chemically synthesized
ccccttggtttggtgcatttca

SEQ ID NO: 786825 - DNA, 22 bp, Artificial Sequence
  chemically synthesized
caccaccaaagtgaaatgcacc

SEQ ID NO: 786826 - DNA, 22 bp, Artificial Sequence
  chemically synthesized
accaccaaagtgaaatgcacca

SEQ ID NO: 786827 - DNA, 22 bp, Artificial Sequence
  chemically synthesized
ccagagaagtcatttccccttg

SEQ ID NO: 786828 - DNA, 22 bp, Artificial Sequence
  chemically synthesized
aactcccagagaagtcatttcc

SEQ ID NO: 786829 - DNA, 22 bp, Artificial Sequence
  chemically synthesized
ttaaactcccagagaagtcatt

SEQ ID NO: 786830 - DNA, 22 bp, Artificial Sequence
  chemically synthesized
ctctgggagtttaacaactcta

SEQ ID NO: 786831 - DNA, 22 bp, Artificial Sequence
  chemically synthesized
tctgggagtttaacaactctac

SEQ ID NO: 786832 - DNA, 22 bp, Artificial Sequence
  chemically synthesized
tgggagtttaacaactctactt

SEQ ID NO: 786833 - DNA, 22 bp, Artificial Sequence
  chemically synthesized
ggagtttaacaactctactttt

SEQ ID NO: 786834 - DNA, 22 bp, Artificial Sequence
  chemically synthesized
aatgagggaaaaaaaagtagag

SEQ ID NO: 786835 - DNA, 22 bp, Artificial Sequence
  chemically synthesized
taattaaatgagggaaaaaaaa

SEQ ID NO: 786836 - DNA, 22 bp, Artificial Sequence
  chemically synthesized
aacaactctacttttttttccc

SEQ ID NO: 786837 - DNA, 22 bp, Artificial Sequence
  chemically synthesized
acaactctacttttttttccct

SEQ ID NO: 786838 - DNA, 22 bp, Artificial Sequence
  chemically synthesized
tacttttttttccctcatttaa

SEQ ID NO: 786839 - DNA, 22 bp, Artificial Sequence
  chemically synthesized
cttttttttccctcatttaatt

SEQ ID NO: 786840 - DNA, 22 bp, Artificial Sequence
  chemically synthesized
acagaccatgttataattaaat

SEQ ID NO: 786841 - DNA, 22 bp, Artificial Sequence
  chemically synthesized
ttttttccctcatttaattata

SEQ ID NO: 786842 - DNA, 22 bp, Artificial Sequence
  chemically synthesized
tttttccctcatttaattataa

SEQ ID NO: 786843 - DNA, 22 bp, Artificial Sequence
  chemically synthesized
ttttccctcatttaattataac

SEQ ID NO: 786844 - DNA, 22 bp, Artificial Sequence
  chemically synthesized
tttccctcatttaattataaca

SEQ ID NO: 786845 - DNA, 22 bp, Artificial Sequence
  chemically synthesized
ttccctcatttaattataacat

SEQ ID NO: 786846 - DNA, 22 bp, Artificial Sequence
  chemically synthesized
tccctcatttaattataacatg

SEQ ID NO: 786847 - DNA, 22 bp, Artificial Sequence
  chemically synthesized
ccctcatttaattataacatgg

SEQ ID NO: 786848 - DNA, 22 bp, Artificial Sequence
  chemically synthesized
caagttaacagaccatgttata

SEQ ID NO: 786849 - DNA, 22 bp, Artificial Sequence
  chemically synthesized
cctcatttaattataacatggt

SEQ ID NO: 786850 - DNA, 22 bp, Artificial Sequence
  chemically synthesized
atttaattataacatggtctgt

SEQ ID NO: 786851 - DNA, 22 bp, Artificial Sequence
  chemically synthesized
aattataacatggtctgttaac

SEQ ID NO: 786852 - DNA, 22 bp, Artificial Sequence
  chemically synthesized
attataacatggtctgttaact

SEQ ID NO: 786853 - DNA, 22 bp, Artificial Sequence
  chemically synthesized
taacatggtctgttaacttgca

SEQ ID NO: 786854 - DNA, 22 bp, Artificial Sequence
  chemically synthesized
ttaacttgcaaccctctatttg

SEQ ID NO: 786855 - DNA, 22 bp, Artificial Sequence
  chemically synthesized
acttgcaaccctctatttgatg

SEQ ID NO: 786856 - DNA, 22 bp, Artificial Sequence
  chemically synthesized
aaaaaagaagagacatcaaata

SEQ ID NO: 786857 - DNA, 22 bp, Artificial Sequence
  chemically synthesized
gcaaccctctatttgatgtctc

SEQ ID NO: 786858 - DNA, 22 bp, Artificial Sequence
  chemically synthesized
caaccctctatttgatgtctct

SEQ ID NO: 786859 - DNA, 22 bp, Artificial Sequence
  chemically synthesized
aagactgaaaaaagaagagaca

SEQ ID NO: 786860 - DNA, 22 bp, Artificial Sequence
  chemically synthesized
ctaaagactgaaaaaagaagag

SEQ ID NO: 786861 - DNA, 22 bp, Artificial Sequence
  chemically synthesized
gctaaagactgaaaaaagaaga

SEQ ID NO: 786862 - DNA, 22 bp, Artificial Sequence
  chemically synthesized
tatttgatgtctcttctttttt

SEQ ID NO: 786863 - DNA, 22 bp, Artificial Sequence
  chemically synthesized
tttgatgtctcttcttttttca

SEQ ID NO: 786864 - DNA, 22 bp, Artificial Sequence
  chemically synthesized
gatgtctcttcttttttcagtc

SEQ ID NO: 786865 - DNA, 22 bp, Artificial Sequence
  chemically synthesized
atgtctcttcttttttcagtct

SEQ ID NO: 786866 - DNA, 22 bp, Artificial Sequence
  chemically synthesized
ttcttttttcagtctttagcaa

SEQ ID NO: 786867 - DNA, 22 bp, Artificial Sequence
  chemically synthesized
cttttttcagtctttagcaaat

SEQ ID NO: 786868 - DNA, 22 bp, Artificial Sequence
  chemically synthesized
ttttttcagtctttagcaaatt

SEQ ID NO: 786869 - DNA, 22 bp, Artificial Sequence
  chemically synthesized
ttttcagtctttagcaaattcc

SEQ ID NO: 786870 - DNA, 22 bp, Artificial Sequence
  chemically synthesized
tttcagtctttagcaaattcca

SEQ ID NO: 786871 - DNA, 22 bp, Artificial Sequence
  chemically synthesized
ttcagtctttagcaaattccac

SEQ ID NO: 786872 - DNA, 22 bp, Artificial Sequence
  chemically synthesized
gccaaatacgatgtggaatttg

SEQ ID NO: 786873 - DNA, 22 bp, Artificial Sequence
  chemically synthesized
tcagtctttagcaaattccaca

SEQ ID NO: 786874 - DNA, 22 bp, Artificial Sequence
  chemically synthesized
ggccaaatacgatgtggaattt

SEQ ID NO: 786875 - DNA, 22 bp, Artificial Sequence
  chemically synthesized
cagtctttagcaaattccacat

SEQ ID NO: 786876 - DNA, 22 bp, Artificial Sequence
  chemically synthesized
agtctttagcaaattccacatc

SEQ ID NO: 786877 - DNA, 22 bp, Artificial Sequence
  chemically synthesized
atttggccaaatacgatgtgga

SEQ ID NO: 786878 - DNA, 22 bp, Artificial Sequence
  chemically synthesized
tagcaaattccacatcgtattt

SEQ ID NO: 786879 - DNA, 22 bp, Artificial Sequence
  chemically synthesized
agcaaattccacatcgtatttg

SEQ ID NO: 786880 - DNA, 22 bp, Artificial Sequence
  chemically synthesized
gcaaattccacatcgtatttgg

SEQ ID NO: 786881 - DNA, 22 bp, Artificial Sequence
  chemically synthesized
tgtctgatttggccaaatacga

SEQ ID NO: 786882 - DNA, 22 bp, Artificial Sequence
  chemically synthesized
atgtctgatttggccaaatacg

SEQ ID NO: 786883 - DNA, 22 bp, Artificial Sequence
  chemically synthesized
tatgtctgatttggccaaatac

SEQ ID NO: 786884 - DNA, 22 bp, Artificial Sequence
  chemically synthesized
attttatgtctgatttggccaa

SEQ ID NO: 786885 - DNA, 22 bp, Artificial Sequence
  chemically synthesized
cacatcgtatttggccaaatca

SEQ ID NO: 786886 - DNA, 22 bp, Artificial Sequence
  chemically synthesized
atgttaattttatgtctgattt

SEQ ID NO: 786887 - DNA, 22 bp, Artificial Sequence
  chemically synthesized
ggccaaatcagacataaaatta

SEQ ID NO: 786888 - DNA, 22 bp, Artificial Sequence
  chemically synthesized
gccaaatcagacataaaattaa

SEQ ID NO: 786889 - DNA, 22 bp, Artificial Sequence
  chemically synthesized
agaatgaattgatgttaatttt

SEQ ID NO: 786890 - DNA, 22 bp, Artificial Sequence
  chemically synthesized
gagaatgaattgatgttaattt

SEQ ID NO: 786891 - DNA, 22 bp, Artificial Sequence
  chemically synthesized
ttgagaatgaattgatgttaat

SEQ ID NO: 786892 - DNA, 22 bp, Artificial Sequence
  chemically synthesized
tctcttgagaatgaattgatgt

SEQ ID NO: 786893 - DNA, 22 bp, Artificial Sequence
  chemically synthesized
gtctcttgagaatgaattgatg

SEQ ID NO: 786894 - DNA, 22 bp, Artificial Sequence
  chemically synthesized
tgtctcttgagaatgaattgat

SEQ ID NO: 786895 - DNA, 22 bp, Artificial Sequence
  chemically synthesized
ttttgtctcttgagaatgaatt

SEQ ID NO: 786896 - DNA, 22 bp, Artificial Sequence
  chemically synthesized
attttgtctcttgagaatgaat

SEQ ID NO: 786897 - DNA, 22 bp, Artificial Sequence
  chemically synthesized
tattttgtctcttgagaatgaa

SEQ ID NO: 786898 - DNA, 22 bp, Artificial Sequence
  chemically synthesized
acatcaattcattctcaagaga

SEQ ID NO: 786899 - DNA, 22 bp, Artificial Sequence
  chemically synthesized
gaaaatcgtagttttattttgt

SEQ ID NO: 786900 - DNA, 22 bp, Artificial Sequence
  chemically synthesized
attctcaagagacaaaataaaa

SEQ ID NO: 786901 - DNA, 22 bp, Artificial Sequence
  chemically synthesized
tcaagagacaaaataaaactac

SEQ ID NO: 786902 - DNA, 22 bp, Artificial Sequence
  chemically synthesized
cgattagaaaatcgtagtttta

SEQ ID NO: 786903 - DNA, 22 bp, Artificial Sequence
  chemically synthesized
aagagacaaaataaaactacga

SEQ ID NO: 786904 - DNA, 22 bp, Artificial Sequence
  chemically synthesized
ggagaaaagtaactacgattag

SEQ ID NO: 786905 - DNA, 22 bp, Artificial Sequence
  chemically synthesized
cgattttctaatcgtagttact

SEQ ID NO: 786906 - DNA, 22 bp, Artificial Sequence
  chemically synthesized
caaaagattaggagaaaagtaa

SEQ ID NO: 786907 - DNA, 22 bp, Artificial Sequence
  chemically synthesized
tctaatcgtagttacttttctc

SEQ ID NO: 786908 - DNA, 22 bp, Artificial Sequence
  chemically synthesized
gcaaaagattaggagaaaagta

SEQ ID NO: 786909 - DNA, 22 bp, Artificial Sequence
  chemically synthesized
ctaatcgtagttacttttctcc

SEQ ID NO: 786910 - DNA, 22 bp, Artificial Sequence
  chemically synthesized
taatcgtagttacttttctcct

SEQ ID NO: 786911 - DNA, 22 bp, Artificial Sequence
  chemically synthesized
atcgtagttacttttctcctaa

SEQ ID NO: 786912 - DNA, 22 bp, Artificial Sequence
  chemically synthesized
cttttctcctaatcttttgcaa

SEQ ID NO: 786913 - DNA, 22 bp, Artificial Sequence
  chemically synthesized
ttctcctaatcttttgcaaatg

SEQ ID NO: 786914 - DNA, 22 bp, Artificial Sequence
  chemically synthesized
tctcctaatcttttgcaaatgt

SEQ ID NO: 786915 - DNA, 22 bp, Artificial Sequence
  chemically synthesized
atagagaaggtgacatttgcaa

SEQ ID NO: 786916 - DNA, 22 bp, Artificial Sequence
  chemically synthesized
ctcctaatcttttgcaaatgtc

SEQ ID NO: 786917 - DNA, 22 bp, Artificial Sequence
  chemically synthesized
catagagaaggtgacatttgca

SEQ ID NO: 786918 - DNA, 22 bp, Artificial Sequence
  chemically synthesized
tcctaatcttttgcaaatgtca

SEQ ID NO: 786919 - DNA, 22 bp, Artificial Sequence
  chemically synthesized
tcatagagaaggtgacatttgc

SEQ ID NO: 786920 - DNA, 22 bp, Artificial Sequence
  chemically synthesized
ctaatcttttgcaaatgtcacc

SEQ ID NO: 786921 - DNA, 22 bp, Artificial Sequence
  chemically synthesized
atcttttgcaaatgtcaccttc

SEQ ID NO: 786922 - DNA, 22 bp, Artificial Sequence
  chemically synthesized
ttgcaaatgtcaccttctctat

SEQ ID NO: 786923 - DNA, 22 bp, Artificial Sequence
  chemically synthesized
tgcaaatgtcaccttctctatg

SEQ ID NO: 786924 - DNA, 22 bp, Artificial Sequence
  chemically synthesized
gcaaatgtcaccttctctatga

SEQ ID NO: 786925 - DNA, 22 bp, Artificial Sequence
  chemically synthesized
aacatagcattttcatagagaa

SEQ ID NO: 786926 - DNA, 22 bp, Artificial Sequence
  chemically synthesized
caaatgtcaccttctctatgaa

SEQ ID NO: 786927 - DNA, 22 bp, Artificial Sequence
  chemically synthesized
gaacatagcattttcatagaga

SEQ ID NO: 786928 - DNA, 22 bp, Artificial Sequence
  chemically synthesized
cacaggtcatttgaacatagca

SEQ ID NO: 786929 - DNA, 22 bp, Artificial Sequence
  chemically synthesized
ctctatgaaaatgctatgttca

SEQ ID NO: 786930 - DNA, 22 bp, Artificial Sequence
  chemically synthesized
tctatgaaaatgctatgttcaa

SEQ ID NO: 786931 - DNA, 22 bp, Artificial Sequence
  chemically synthesized
tatgaaaatgctatgttcaaat

SEQ ID NO: 786932 - DNA, 22 bp, Artificial Sequence
  chemically synthesized
tgaaaatgctatgttcaaatga

SEQ ID NO: 786933 - DNA, 22 bp, Artificial Sequence
  chemically synthesized
gagccatgaaatattacacagg

SEQ ID NO: 786934 - DNA, 22 bp, Artificial Sequence
  chemically synthesized
tgttcaaatgacctgtgtaata

SEQ ID NO: 786935 - DNA, 22 bp, Artificial Sequence
  chemically synthesized
cattagagccatgaaatattac

SEQ ID NO: 786936 - DNA, 22 bp, Artificial Sequence
  chemically synthesized
aaatgacctgtgtaatatttca

SEQ ID NO: 786937 - DNA, 22 bp, Artificial Sequence
  chemically synthesized
tgattgcattagagccatgaaa

SEQ ID NO: 786938 - DNA, 22 bp, Artificial Sequence
  chemically synthesized
gtgattgcattagagccatgaa

SEQ ID NO: 786939 - DNA, 22 bp, Artificial Sequence
  chemically synthesized
tgtgattgcattagagccatga

SEQ ID NO: 786940 - DNA, 22 bp, Artificial Sequence
  chemically synthesized
tgtaatatttcatggctctaat

SEQ ID NO: 786941 - DNA, 22 bp, Artificial Sequence
  chemically synthesized
catggctctaatgcaatcacaa

SEQ ID NO: 786942 - DNA, 22 bp, Artificial Sequence
  chemically synthesized
atggctctaatgcaatcacaaa

SEQ ID NO: 786943 - DNA, 22 bp, Artificial Sequence
  chemically synthesized
ataccgaatatatattttgtga

SEQ ID NO: 786944 - DNA, 22 bp, Artificial Sequence
  chemically synthesized
gataccgaatatatattttgtg

SEQ ID NO: 786945 - DNA, 22 bp, Artificial Sequence
  chemically synthesized
taatgcaatcacaaaatatata

SEQ ID NO: 786946 - DNA, 22 bp, Artificial Sequence
  chemically synthesized
atgcaatcacaaaatatatatt

SEQ ID NO: 786947 - DNA, 22 bp, Artificial Sequence
  chemically synthesized
tatatcttgataccgaatatat

SEQ ID NO: 786948 - DNA, 22 bp, Artificial Sequence
  chemically synthesized
atatatcttgataccgaatata

SEQ ID NO: 786949 - DNA, 22 bp, Artificial Sequence
  chemically synthesized
acatgtatcttatatatcttga

SEQ ID NO: 786950 - DNA, 22 bp, Artificial Sequence
  chemically synthesized
ttaacatgtatcttatatatct

SEQ ID NO: 786951 - DNA, 22 bp, Artificial Sequence
  chemically synthesized
attaacatgtatcttatatatc

SEQ ID NO: 786952 - DNA, 22 bp, Artificial Sequence
  chemically synthesized
ggtatcaagatatataagatac

SEQ ID NO: 786953 - DNA, 22 bp, Artificial Sequence
  chemically synthesized
gagggacttattaacatgtatc

SEQ ID NO: 786954 - DNA, 22 bp, Artificial Sequence
  chemically synthesized
agagggacttattaacatgtat

SEQ ID NO: 786955 - DNA, 22 bp, Artificial Sequence
  chemically synthesized
tagagggacttattaacatgta

SEQ ID NO: 786956 - DNA, 22 bp, Artificial Sequence
  chemically synthesized
acaactttagagggacttatta

SEQ ID NO: 786957 - DNA, 22 bp, Artificial Sequence
  chemically synthesized
gacaactttagagggacttatt

SEQ ID NO: 786958 - DNA, 22 bp, Artificial Sequence
  chemically synthesized
ataagtccctctaaagttgtca

SEQ ID NO: 786959 - DNA, 22 bp, Artificial Sequence
  chemically synthesized
atagtgtaaatttgacaacttt

SEQ ID NO: 786960 - DNA, 22 bp, Artificial Sequence
  chemically synthesized
tgatagtgtaaatttgacaact

SEQ ID NO: 786961 - DNA, 22 bp, Artificial Sequence
  chemically synthesized
attctgatagtgtaaatttgac

SEQ ID NO: 786962 - DNA, 22 bp, Artificial Sequence
  chemically synthesized
cattctgatagtgtaaatttga

SEQ ID NO: 786963 - DNA, 22 bp, Artificial Sequence
  chemically synthesized
tcattctgatagtgtaaatttg

SEQ ID NO: 786964 - DNA, 22 bp, Artificial Sequence
  chemically synthesized
taaagttgtcaaatttacacta

SEQ ID NO: 786965 - DNA, 22 bp, Artificial Sequence
  chemically synthesized
aagttgtcaaatttacactatc

SEQ ID NO: 786966 - DNA, 22 bp, Artificial Sequence
  chemically synthesized
aggaatctttcattctgatagt

SEQ ID NO: 786967 - DNA, 22 bp, Artificial Sequence
  chemically synthesized
tcaaatttacactatcagaatg

SEQ ID NO: 786968 - DNA, 22 bp, Artificial Sequence
  chemically synthesized
gccctcaggaatctttcattct

SEQ ID NO: 786969 - DNA, 22 bp, Artificial Sequence
  chemically synthesized
agccctcaggaatctttcattc

SEQ ID NO: 786970 - DNA, 22 bp, Artificial Sequence
  chemically synthesized
acactatcagaatgaaagattc

SEQ ID NO: 786971 - DNA, 22 bp, Artificial Sequence
  chemically synthesized
tttagccctcaggaatctttca

SEQ ID NO: 786972 - DNA, 22 bp, Artificial Sequence
  chemically synthesized
cactatcagaatgaaagattcc

SEQ ID NO: 786973 - DNA, 22 bp, Artificial Sequence
  chemically synthesized
atttagccctcaggaatctttc

SEQ ID NO: 786974 - DNA, 22 bp, Artificial Sequence
  chemically synthesized
tcagaatgaaagattcctgagg

SEQ ID NO: 786975 - DNA, 22 bp, Artificial Sequence
  chemically synthesized
ctgagggctaaataaattttgt

SEQ ID NO: 786976 - DNA, 22 bp, Artificial Sequence
  chemically synthesized
agggctaaataaattttgtctc

SEQ ID NO: 786977 - DNA, 22 bp, Artificial Sequence
  chemically synthesized
aataaattttgtctctaccttt

SEQ ID NO: 786978 - DNA, 22 bp, Artificial Sequence
  chemically synthesized
taaaagaggaggaaaggtagag

SEQ ID NO: 786979 - DNA, 22 bp, Artificial Sequence
  chemically synthesized
tgtctctacctttcctcctctt

SEQ ID NO: 786980 - DNA, 22 bp, Artificial Sequence
  chemically synthesized
gtctctacctttcctcctcttt

SEQ ID NO: 786981 - DNA, 22 bp, Artificial Sequence
  chemically synthesized
tctctacctttcctcctctttt

SEQ ID NO: 786982 - DNA, 22 bp, Artificial Sequence
  chemically synthesized
tacctttcctcctcttttacaa

SEQ ID NO: 786983 - DNA, 22 bp, Artificial Sequence
  chemically synthesized
cctttcctcctcttttacaatg

SEQ ID NO: 786984 - DNA, 22 bp, Artificial Sequence
  chemically synthesized
tacaacaagaccaggcattgta

SEQ ID NO: 786985 - DNA, 22 bp, Artificial Sequence
  chemically synthesized
tcctcctcttttacaatgcctg

SEQ ID NO: 786986 - DNA, 22 bp, Artificial Sequence
  chemically synthesized
atacaacaagaccaggcattgt

SEQ ID NO: 786987 - DNA, 22 bp, Artificial Sequence
  chemically synthesized
cctcctcttttacaatgcctgg

SEQ ID NO: 786988 - DNA, 22 bp, Artificial Sequence
  chemically synthesized
ctcctcttttacaatgcctggt

SEQ ID NO: 786989 - DNA, 22 bp, Artificial Sequence
  chemically synthesized
ctcttttacaatgcctggtctt

SEQ ID NO: 786990 - DNA, 22 bp, Artificial Sequence
  chemically synthesized
ttttacaatgcctggtcttgtt

SEQ ID NO: 786991 - DNA, 22 bp, Artificial Sequence
  chemically synthesized
ttacaatgcctggtcttgttgt

SEQ ID NO: 786992 - DNA, 22 bp, Artificial Sequence
  chemically synthesized
tacaatgcctggtcttgttgta

SEQ ID NO: 786993 - DNA, 22 bp, Artificial Sequence
  chemically synthesized
acaatgcctggtcttgttgtat

SEQ ID NO: 786994 - DNA, 22 bp, Artificial Sequence
  chemically synthesized
caatgcctggtcttgttgtata

SEQ ID NO: 786995 - DNA, 22 bp, Artificial Sequence
  chemically synthesized
aaacaccgtgtttatacaacaa

SEQ ID NO: 786996 - DNA, 22 bp, Artificial Sequence
  chemically synthesized
gtcttgttgtataaacacggtg

SEQ ID NO: 786997 - DNA, 22 bp, Artificial Sequence
  chemically synthesized
gttgtataaacacggtgtttca

SEQ ID NO: 786998 - DNA, 22 bp, Artificial Sequence
  chemically synthesized
ttgtataaacacggtgtttcag

SEQ ID NO: 786999 - DNA, 22 bp, Artificial Sequence
  chemically synthesized
tcatcaagaagatactgaaaca

SEQ ID NO: 787000 - DNA, 22 bp, Artificial Sequence
  chemically synthesized
tataaacacggtgtttcagtat

SEQ ID NO: 787001 - DNA, 22 bp, Artificial Sequence
  chemically synthesized
attatcatcaagaagatactga

SEQ ID NO: 787002 - DNA, 22 bp, Artificial Sequence
  chemically synthesized
cagtatcttcttgatgataatg

SEQ ID NO: 787003 - DNA, 22 bp, Artificial Sequence
  chemically synthesized
agtatcttcttgatgataatga

SEQ ID NO: 787004 - DNA, 22 bp, Artificial Sequence
  chemically synthesized
gccaaatccacctcattatcat

SEQ ID NO: 787005 - DNA, 22 bp, Artificial Sequence
  chemically synthesized
gattggccaaatccacctcatt

SEQ ID NO: 787006 - DNA, 22 bp, Artificial Sequence
  chemically synthesized
cttgatgataatgaggtggatt

SEQ ID NO: 787007 - DNA, 22 bp, Artificial Sequence
  chemically synthesized
ttgatgataatgaggtggattt

SEQ ID NO: 787008 - DNA, 22 bp, Artificial Sequence
  chemically synthesized
gatgataatgaggtggatttgg

SEQ ID NO: 787009 - DNA, 22 bp, Artificial Sequence
  chemically synthesized
atgataatgaggtggatttggc

SEQ ID NO: 787010 - DNA, 22 bp, Artificial Sequence
  chemically synthesized
aatagctagattggccaaatcc

SEQ ID NO: 787011 - DNA, 22 bp, Artificial Sequence
  chemically synthesized
aaatagctagattggccaaatc

SEQ ID NO: 787012 - DNA, 22 bp, Artificial Sequence
  chemically synthesized
taaatagctagattggccaaat

SEQ ID NO: 787013 - DNA, 22 bp, Artificial Sequence
  chemically synthesized
ttaaatagctagattggccaaa

SEQ ID NO: 787014 - DNA, 22 bp, Artificial Sequence
  chemically synthesized
tttaaatagctagattggccaa

SEQ ID NO: 787015 - DNA, 22 bp, Artificial Sequence
  chemically synthesized
ggccaatctagctatttaaaaa

SEQ ID NO: 787016 - DNA, 22 bp, Artificial Sequence
  chemically synthesized
gccaatctagctatttaaaaag

SEQ ID NO: 787017 - DNA, 22 bp, Artificial Sequence
  chemically synthesized
aaagaacagagcagacttttta

SEQ ID NO: 787018 - DNA, 22 bp, Artificial Sequence
  chemically synthesized
agttaaaagaacagagcagact

SEQ ID NO: 787019 - DNA, 22 bp, Artificial Sequence
  chemically synthesized
gctatttaaaaagtctgctctg

SEQ ID NO: 787020 - DNA, 22 bp, Artificial Sequence
  chemically synthesized
tttaaaaagtctgctctgttct

SEQ ID NO: 787021 - DNA, 22 bp, Artificial Sequence
  chemically synthesized
aaaaagtctgctctgttctttt

SEQ ID NO: 787022 - DNA, 22 bp, Artificial Sequence
  chemically synthesized
caaaactaagttaaaagaacag

SEQ ID NO: 787023 - DNA, 22 bp, Artificial Sequence
  chemically synthesized
aaaagtctgctctgttctttta

SEQ ID NO: 787024 - DNA, 22 bp, Artificial Sequence
  chemically synthesized
tacatctacaaaactaagttaa

SEQ ID NO: 787025 - DNA, 22 bp, Artificial Sequence
  chemically synthesized
ctctgttcttttaacttagttt

SEQ ID NO: 787026 - DNA, 22 bp, Artificial Sequence
  chemically synthesized
ttatacatctacaaaactaagt

SEQ ID NO: 787027 - DNA, 22 bp, Artificial Sequence
  chemically synthesized
gttatacatctacaaaactaag

SEQ ID NO: 787028 - DNA, 22 bp, Artificial Sequence
  chemically synthesized
tgttcttttaacttagttttgt

SEQ ID NO: 787029 - DNA, 22 bp, Artificial Sequence
  chemically synthesized
tgttatacatctacaaaactaa

SEQ ID NO: 787030 - DNA, 22 bp, Artificial Sequence
  chemically synthesized
ttcttttaacttagttttgtag

SEQ ID NO: 787031 - DNA, 22 bp, Artificial Sequence
  chemically synthesized
gttttgttatacatctacaaaa

SEQ ID NO: 787032 - DNA, 22 bp, Artificial Sequence
  chemically synthesized
ttttaacttagttttgtagatg

SEQ ID NO: 787033 - DNA, 22 bp, Artificial Sequence
  chemically synthesized
ttaacttagttttgtagatgta

SEQ ID NO: 787034 - DNA, 22 bp, Artificial Sequence
  chemically synthesized
taacttagttttgtagatgtat

SEQ ID NO: 787035 - DNA, 22 bp, Artificial Sequence
  chemically synthesized
aacttagttttgtagatgtata

SEQ ID NO: 787036 - DNA, 22 bp, Artificial Sequence
  chemically synthesized
acttagttttgtagatgtataa

SEQ ID NO: 787037 - DNA, 22 bp, Artificial Sequence
  chemically synthesized
cataactagttttgttatacat

SEQ ID NO: 787038 - DNA, 22 bp, Artificial Sequence
  chemically synthesized
ccataactagttttgttataca

SEQ ID NO: 787039 - DNA, 22 bp, Artificial Sequence
  chemically synthesized
agttttgtagatgtataacaaa

SEQ ID NO: 787040 - DNA, 22 bp, Artificial Sequence
  chemically synthesized
gttttgtagatgtataacaaaa

SEQ ID NO: 787041 - DNA, 22 bp, Artificial Sequence
  chemically synthesized
tgtagatgtataacaaaactag

SEQ ID NO: 787042 - DNA, 22 bp, Artificial Sequence
  chemically synthesized
gtagatgtataacaaaactagt

SEQ ID NO: 787043 - DNA, 22 bp, Artificial Sequence
  chemically synthesized
tagatgtataacaaaactagtt

SEQ ID NO: 787044 - DNA, 22 bp, Artificial Sequence
  chemically synthesized
agagaatttccataactagttt

SEQ ID NO: 787045 - DNA, 22 bp, Artificial Sequence
  chemically synthesized
aatctcagagaatttccataac

SEQ ID NO: 787046 - DNA, 22 bp, Artificial Sequence
  chemically synthesized
tctaaatctcagagaatttcca

SEQ ID NO: 787047 - DNA, 22 bp, Artificial Sequence
  chemically synthesized
atctaaatctcagagaatttcc

SEQ ID NO: 787048 - DNA, 22 bp, Artificial Sequence
  chemically synthesized
gttatggaaattctctgagatt

SEQ ID NO: 787049 - DNA, 22 bp, Artificial Sequence
  chemically synthesized
tggaaattctctgagatttaga

SEQ ID NO: 787050 - DNA, 22 bp, Artificial Sequence
  chemically synthesized
tgtgaaaaaatgatttatctaa

SEQ ID NO: 787051 - DNA, 22 bp, Artificial Sequence
  chemically synthesized
atgtgaaaaaatgatttatcta

SEQ ID NO: 787052 - DNA, 22 bp, Artificial Sequence
  chemically synthesized
tatgtgaaaaaatgatttatct

SEQ ID NO: 787053 - DNA, 22 bp, Artificial Sequence
  chemically synthesized
tctgagatttagataaatcatt

SEQ ID NO: 787054 - DNA, 22 bp, Artificial Sequence
  chemically synthesized
tgagatttagataaatcatttt

SEQ ID NO: 787055 - DNA, 22 bp, Artificial Sequence
  chemically synthesized
agatttagataaatcatttttt

SEQ ID NO: 787056 - DNA, 22 bp, Artificial Sequence
  chemically synthesized
agataaatcattttttcacata

SEQ ID NO: 787057 - DNA, 22 bp, Artificial Sequence
  chemically synthesized
tagcaccaattttatgtgaaaa

SEQ ID NO: 787058 - DNA, 22 bp, Artificial Sequence
  chemically synthesized
gataaatcattttttcacataa

SEQ ID NO: 787059 - DNA, 22 bp, Artificial Sequence
  chemically synthesized
tgtagcaccaattttatgtgaa

SEQ ID NO: 787060 - DNA, 22 bp, Artificial Sequence
  chemically synthesized
ctgtagcaccaattttatgtga

SEQ ID NO: 787061 - DNA, 22 bp, Artificial Sequence
  chemically synthesized
tttctgtagcaccaattttatg

SEQ ID NO: 787062 - DNA, 22 bp, Artificial Sequence
  chemically synthesized
tttcacataaaattggtgctac

SEQ ID NO: 787063 - DNA, 22 bp, Artificial Sequence
  chemically synthesized
ttcacataaaattggtgctaca

SEQ ID NO: 787064 - DNA, 22 bp, Artificial Sequence
  chemically synthesized
tcacataaaattggtgctacag

SEQ ID NO: 787065 - DNA, 22 bp, Artificial Sequence
  chemically synthesized
cacataaaattggtgctacaga

SEQ ID NO: 787066 - DNA, 22 bp, Artificial Sequence
  chemically synthesized
acataaaattggtgctacagaa

SEQ ID NO: 787067 - DNA, 22 bp, Artificial Sequence
  chemically synthesized
tagtccacatattatttctgta

SEQ ID NO: 787068 - DNA, 22 bp, Artificial Sequence
  chemically synthesized
atagtccacatattatttctgt

SEQ ID NO: 787069 - DNA, 22 bp, Artificial Sequence
  chemically synthesized
gtgctacagaaataatatgtgg

SEQ ID NO: 787070 - DNA, 22 bp, Artificial Sequence
  chemically synthesized
cagaaataatatgtggactata

SEQ ID NO: 787071 - DNA, 22 bp, Artificial Sequence
  chemically synthesized
aataatagtgaaagcttatagt

SEQ ID NO: 787072 - DNA, 22 bp, Artificial Sequence
  chemically synthesized
taagctttcactattattgaac

SEQ ID NO: 787073 - DNA, 22 bp, Artificial Sequence
  chemically synthesized
atagatatggccaaatgttcaa

SEQ ID NO: 787074 - DNA, 22 bp, Artificial Sequence
  chemically synthesized
tcactattattgaacatttggc

SEQ ID NO: 787075 - DNA, 22 bp, Artificial Sequence
  chemically synthesized
cactattattgaacatttggcc

SEQ ID NO: 787076 - DNA, 22 bp, Artificial Sequence
  chemically synthesized
actattattgaacatttggcca

SEQ ID NO: 787077 - DNA, 22 bp, Artificial Sequence
  chemically synthesized
aatagttcatagatatggccaa

SEQ ID NO: 787078 - DNA, 22 bp, Artificial Sequence
  chemically synthesized
ttattgaacatttggccatatc

SEQ ID NO: 787079 - DNA, 22 bp, Artificial Sequence
  chemically synthesized
ttgaacatttggccatatctat

SEQ ID NO: 787080 - DNA, 22 bp, Artificial Sequence
  chemically synthesized
tctcaatagttcatagatatgg

SEQ ID NO: 787081 - DNA, 22 bp, Artificial Sequence
  chemically synthesized
aacatttggccatatctatgaa

SEQ ID NO: 787082 - DNA, 22 bp, Artificial Sequence
  chemically synthesized
aactgtctcaatagttcataga

SEQ ID NO: 787083 - DNA, 22 bp, Artificial Sequence
  chemically synthesized
caactgtctcaatagttcatag

SEQ ID NO: 787084 - DNA, 22 bp, Artificial Sequence
  chemically synthesized
tcaactgtctcaatagttcata

SEQ ID NO: 787085 - DNA, 22 bp, Artificial Sequence
  chemically synthesized
ttcaactgtctcaatagttcat

SEQ ID NO: 787086 - DNA, 22 bp, Artificial Sequence
  chemically synthesized
tttcaactgtctcaatagttca

SEQ ID NO: 787087 - DNA, 22 bp, Artificial Sequence
  chemically synthesized
ggccatatctatgaactattga

SEQ ID NO: 787088 - DNA, 22 bp, Artificial Sequence
  chemically synthesized
ttttcaactgtctcaatagttc

SEQ ID NO: 787089 - DNA, 22 bp, Artificial Sequence
  chemically synthesized
gccatatctatgaactattgag

SEQ ID NO: 787090 - DNA, 22 bp, Artificial Sequence
  chemically synthesized
tttttcaactgtctcaatagtt

SEQ ID NO: 787091 - DNA, 22 bp, Artificial Sequence
  chemically synthesized
ttttttcaactgtctcaatagt

SEQ ID NO: 787092 - DNA, 22 bp, Artificial Sequence
  chemically synthesized
tggcttttttttcaactgtctc

SEQ ID NO: 787093 - DNA, 22 bp, Artificial Sequence
  chemically synthesized
tgaactattgagacagttgaaa

SEQ ID NO: 787094 - DNA, 22 bp, Artificial Sequence
  chemically synthesized
cagctgtggcttttttttcaac

SEQ ID NO: 787095 - DNA, 22 bp, Artificial Sequence
  chemically synthesized
ttgagacagttgaaaaaaaagc

SEQ ID NO: 787096 - DNA, 22 bp, Artificial Sequence
  chemically synthesized
agacagttgaaaaaaaagccac

SEQ ID NO: 787097 - DNA, 22 bp, Artificial Sequence
  chemically synthesized
gatatagttccagctgtggctt

SEQ ID NO: 787098 - DNA, 22 bp, Artificial Sequence
  chemically synthesized
agctcgatatagttccagctgt

SEQ ID NO: 787099 - DNA, 22 bp, Artificial Sequence
  chemically synthesized
aaaaaaaagccacagctggaac

SEQ ID NO: 787100 - DNA, 22 bp, Artificial Sequence
  chemically synthesized
cagagttgagctcgatatagtt

SEQ ID NO: 787101 - DNA, 22 bp, Artificial Sequence
  chemically synthesized
agttgcagagttgagctcgata

SEQ ID NO: 787102 - DNA, 22 bp, Artificial Sequence
  chemically synthesized
gaactatatcgagctcaactct

SEQ ID NO: 787103 - DNA, 22 bp, Artificial Sequence
  chemically synthesized
acaattaagttgcagagttgag

SEQ ID NO: 787104 - DNA, 22 bp, Artificial Sequence
  chemically synthesized
cacaattaagttgcagagttga

SEQ ID NO: 787105 - DNA, 22 bp, Artificial Sequence
  chemically synthesized
tttcacaattaagttgcagagt

SEQ ID NO: 787106 - DNA, 22 bp, Artificial Sequence
  chemically synthesized
tatcgagctcaactctgcaact

SEQ ID NO: 787107 - DNA, 22 bp, Artificial Sequence
  chemically synthesized
atttcacaattaagttgcagag

SEQ ID NO: 787108 - DNA, 22 bp, Artificial Sequence
  chemically synthesized
tatttatttcacaattaagttg

SEQ ID NO: 787109 - DNA, 22 bp, Artificial Sequence
  chemically synthesized
ttgtatttatttcacaattaag

SEQ ID NO: 787110 - DNA, 22 bp, Artificial Sequence
  chemically synthesized
aactctgcaacttaattgtgaa

SEQ ID NO: 787111 - DNA, 22 bp, Artificial Sequence
  chemically synthesized
ttattgtatttatttcacaatt

SEQ ID NO: 787112 - DNA, 22 bp, Artificial Sequence
  chemically synthesized
ttattattgtatttatttcaca

SEQ ID NO: 787113 - DNA, 22 bp, Artificial Sequence
  chemically synthesized
tgcaacttaattgtgaaataaa

SEQ ID NO: 787114 - DNA, 22 bp, Artificial Sequence
  chemically synthesized
caacttaattgtgaaataaata

SEQ ID NO: 787115 - DNA, 22 bp, Artificial Sequence
  chemically synthesized
caattattattattgtatttat

SEQ ID NO: 787116 - DNA, 22 bp, Artificial Sequence
  chemically synthesized
aattgtgaaataaatacaataa

SEQ ID NO: 787117 - DNA, 22 bp, Artificial Sequence
  chemically synthesized
ttacaattattattattgtatt

SEQ ID NO: 787118 - DNA, 22 bp, Artificial Sequence
  chemically synthesized
attgtgaaataaatacaataat

SEQ ID NO: 787119 - DNA, 22 bp, Artificial Sequence
  chemically synthesized
ctgttacaattattattattgt

SEQ ID NO: 787120 - DNA, 22 bp, Artificial Sequence
  chemically synthesized
tgaaataaatacaataataata

SEQ ID NO: 787121 - DNA, 22 bp, Artificial Sequence
  chemically synthesized
ggtcctgctgttacaattatta

SEQ ID NO: 787122 - DNA, 22 bp, Artificial Sequence
  chemically synthesized
aggtcctgctgttacaattatt

SEQ ID NO: 787123 - DNA, 22 bp, Artificial Sequence
  chemically synthesized
caccagcatgatttaggtcctg

SEQ ID NO: 787124 - DNA, 22 bp, Artificial Sequence
  chemically synthesized
taacagcaggacctaaatcatg

SEQ ID NO: 787125 - DNA, 22 bp, Artificial Sequence
  chemically synthesized
aggacaaacccagcagttacac

SEQ ID NO: 787126 - DNA, 22 bp, Artificial Sequence
  chemically synthesized
aatcatgctggtgtaactgctg

SEQ ID NO: 787127 - DNA, 22 bp, Artificial Sequence
  chemically synthesized
atatctgaggacaaacccagca

SEQ ID NO: 787128 - DNA, 22 bp, Artificial Sequence
  chemically synthesized
gtgtaactgctgggtttgtcct

SEQ ID NO: 787129 - DNA, 22 bp, Artificial Sequence
  chemically synthesized
gagttaatatctgaggacaaac

SEQ ID NO: 787130 - DNA, 22 bp, Artificial Sequence
  chemically synthesized
agagttaatatctgaggacaaa

SEQ ID NO: 787131 - DNA, 22 bp, Artificial Sequence
  chemically synthesized
tagagttaatatctgaggacaa

SEQ ID NO: 787132 - DNA, 22 bp, Artificial Sequence
  chemically synthesized
ctgggtttgtcctcagatatta

SEQ ID NO: 787133 - DNA, 22 bp, Artificial Sequence
  chemically synthesized
ggtttgtcctcagatattaact

SEQ ID NO: 787134 - DNA, 22 bp, Artificial Sequence
  chemically synthesized
gtcctcagatattaactctaaa

SEQ ID NO: 787135 - DNA, 22 bp, Artificial Sequence
  chemically synthesized
tcctcagatattaactctaaag

SEQ ID NO: 787136 - DNA, 22 bp, Artificial Sequence
  chemically synthesized
agatattaactctaaaggttat

SEQ ID NO: 787137 - DNA, 22 bp, Artificial Sequence
  chemically synthesized
actctaaaggttatattcattg

SEQ ID NO: 787138 - DNA, 22 bp, Artificial Sequence
  chemically synthesized
taaaggttatattcattgtggt

SEQ ID NO: 787139 - DNA, 22 bp, Artificial Sequence
  chemically synthesized
caaacaggtggcaccacaatga

SEQ ID NO: 787140 - DNA, 22 bp, Artificial Sequence
  chemically synthesized
ccaaacaggtggcaccacaatg

SEQ ID NO: 787141 - DNA, 22 bp, Artificial Sequence
  chemically synthesized
aaggttatattcattgtggtgc

SEQ ID NO: 787142 - DNA, 22 bp, Artificial Sequence
  chemically synthesized
tccaaacaggtggcaccacaat

SEQ ID NO: 787143 - DNA, 22 bp, Artificial Sequence
  chemically synthesized
tttccaaacaggtggcaccaca

SEQ ID NO: 787144 - DNA, 22 bp, Artificial Sequence
  chemically synthesized
ctttccaaacaggtggcaccac

SEQ ID NO: 787145 - DNA, 22 bp, Artificial Sequence
  chemically synthesized
tattcattgtggtgccacctgt

SEQ ID NO: 787146 - DNA, 22 bp, Artificial Sequence
  chemically synthesized
attgtggtgccacctgtttgga

SEQ ID NO: 787147 - DNA, 22 bp, Artificial Sequence
  chemically synthesized
atgtgcccttctttccaaacag

SEQ ID NO: 787148 - DNA, 22 bp, Artificial Sequence
  chemically synthesized
tggtgccacctgtttggaaaga

SEQ ID NO: 787149 - DNA, 22 bp, Artificial Sequence
  chemically synthesized
aaaatcctgatgtgcccttctt

SEQ ID NO: 787150 - DNA, 22 bp, Artificial Sequence
  chemically synthesized
tttggaaagaagggcacatcag

SEQ ID NO: 787151 - DNA, 22 bp, Artificial Sequence
  chemically synthesized
ggaaagaagggcacatcaggat

SEQ ID NO: 787152 - DNA, 22 bp, Artificial Sequence
  chemically synthesized
gaaagaagggcacatcaggatt

SEQ ID NO: 787153 - DNA, 22 bp, Artificial Sequence
  chemically synthesized
aaatatgtactcaaaatcctga

SEQ ID NO: 787154 - DNA, 22 bp, Artificial Sequence
  chemically synthesized
taaaatatgtactcaaaatcct

SEQ ID NO: 787155 - DNA, 22 bp, Artificial Sequence
  chemically synthesized
tgagtacatattttagagtttt

SEQ ID NO: 787156 - DNA, 22 bp, Artificial Sequence
  chemically synthesized
gagtacatattttagagttttc

SEQ ID NO: 787157 - DNA, 22 bp, Artificial Sequence
  chemically synthesized
agtacatattttagagttttcc

SEQ ID NO: 787158 - DNA, 22 bp, Artificial Sequence
  chemically synthesized
tatggtacagtaccaaaggaaa

SEQ ID NO: 787159 - DNA, 22 bp, Artificial Sequence
  chemically synthesized
tagagttttcctttggtactgt

SEQ ID NO: 787160 - DNA, 22 bp, Artificial Sequence
  chemically synthesized
agagttttcctttggtactgta

SEQ ID NO: 787161 - DNA, 22 bp, Artificial Sequence
  chemically synthesized
catattatatggtacagtacca

SEQ ID NO: 787162 - DNA, 22 bp, Artificial Sequence
  chemically synthesized
gagttttcctttggtactgtac

SEQ ID NO: 787163 - DNA, 22 bp, Artificial Sequence
  chemically synthesized
gtgttccatattatatggtaca

SEQ ID NO: 787164 - DNA, 22 bp, Artificial Sequence
  chemically synthesized
tcctttggtactgtaccatata

SEQ ID NO: 787165 - DNA, 22 bp, Artificial Sequence
  chemically synthesized
agtgttccatattatatggtac

SEQ ID NO: 787166 - DNA, 22 bp, Artificial Sequence
  chemically synthesized
cctttggtactgtaccatataa

SEQ ID NO: 787167 - DNA, 22 bp, Artificial Sequence
  chemically synthesized
tagtgttccatattatatggta

SEQ ID NO: 787168 - DNA, 22 bp, Artificial Sequence
  chemically synthesized
ctttggtactgtaccatataat

SEQ ID NO: 787169 - DNA, 22 bp, Artificial Sequence
  chemically synthesized
tggtactgtaccatataatatg

SEQ ID NO: 787170 - DNA, 22 bp, Artificial Sequence
  chemically synthesized
ggtactgtaccatataatatgg

SEQ ID NO: 787171 - DNA, 22 bp, Artificial Sequence
  chemically synthesized
gtactgtaccatataatatgga

SEQ ID NO: 787172 - DNA, 22 bp, Artificial Sequence
  chemically synthesized
tgattttagtgttccatattat

SEQ ID NO: 787173 - DNA, 22 bp, Artificial Sequence
  chemically synthesized
ttgtgattttagtgttccatat

SEQ ID NO: 787174 - DNA, 22 bp, Artificial Sequence
  chemically synthesized
attgtgattttagtgttccata

SEQ ID NO: 787175 - DNA, 22 bp, Artificial Sequence
  chemically synthesized
tattgtgattttagtgttccat

SEQ ID NO: 787176 - DNA, 22 bp, Artificial Sequence
  chemically synthesized
taccatataatatggaacacta

SEQ ID NO: 787177 - DNA, 22 bp, Artificial Sequence
  chemically synthesized
acacaaagcagacacattttat

SEQ ID NO: 787178 - DNA, 22 bp, Artificial Sequence
  chemically synthesized
cacacaaagcagacacatttta

SEQ ID NO: 787179 - DNA, 22 bp, Artificial Sequence
  chemically synthesized
aaatcacaataaaatgtgtctg

SEQ ID NO: 787180 - DNA, 22 bp, Artificial Sequence
  chemically synthesized
ccttcacacaaagcagacacat

SEQ ID NO: 787181 - DNA, 22 bp, Artificial Sequence
  chemically synthesized
accttcacacaaagcagacaca

SEQ ID NO: 787182 - DNA, 22 bp, Artificial Sequence
  chemically synthesized
cttaccttcacacaaagcagac

SEQ ID NO: 787183 - DNA, 22 bp, Artificial Sequence
  chemically synthesized
acttaccttcacacaaagcaga

SEQ ID NO: 787184 - DNA, 22 bp, Artificial Sequence
  chemically synthesized
gcacttacttaccttcacacaa

SEQ ID NO: 787185 - DNA, 22 bp, Artificial Sequence
  chemically synthesized
ggcacttacttaccttcacaca

SEQ ID NO: 787186 - DNA, 22 bp, Artificial Sequence
  chemically synthesized
ctttgtgtgaaggtaagtaagt

SEQ ID NO: 787187 - DNA, 22 bp, Artificial Sequence
  chemically synthesized
caataagcttggcacttactta

SEQ ID NO: 787188 - DNA, 22 bp, Artificial Sequence
  chemically synthesized
acaataagcttggcacttactt

SEQ ID NO: 787189 - DNA, 22 bp, Artificial Sequence
  chemically synthesized
tgtgtgaaggtaagtaagtgcc

SEQ ID NO: 787190 - DNA, 22 bp, Artificial Sequence
  chemically synthesized
gtgtgaaggtaagtaagtgcca

SEQ ID NO: 787191 - DNA, 22 bp, Artificial Sequence
  chemically synthesized
tgtgaaggtaagtaagtgccaa

SEQ ID NO: 787192 - DNA, 22 bp, Artificial Sequence
  chemically synthesized
aaatgccttacaataagcttgg

SEQ ID NO: 787193 - DNA, 22 bp, Artificial Sequence
  chemically synthesized
gaaatgccttacaataagcttg

SEQ ID NO: 787194 - DNA, 22 bp, Artificial Sequence
  chemically synthesized
tgtccaagatttgaaatgcctt

SEQ ID NO: 787195 - DNA, 22 bp, Artificial Sequence
  chemically synthesized
attgtaaggcatttcaaatctt

SEQ ID NO: 787196 - DNA, 22 bp, Artificial Sequence
  chemically synthesized
ttgtaaggcatttcaaatcttg

SEQ ID NO: 787197 - DNA, 22 bp, Artificial Sequence
  chemically synthesized
taaggcatttcaaatcttggac

SEQ ID NO: 787198 - DNA, 22 bp, Artificial Sequence
  chemically synthesized
aaatataaaaggcgttgtgtcc

SEQ ID NO: 787199 - DNA, 22 bp, Artificial Sequence
  chemically synthesized
caaatcttggacacaacgcctt

SEQ ID NO: 787200 - DNA, 22 bp, Artificial Sequence
  chemically synthesized
gttgaaatataaaaggcgttgt

SEQ ID NO: 787201 - DNA, 22 bp, Artificial Sequence
  chemically synthesized
aaatcttggacacaacgccttt

SEQ ID NO: 787202 - DNA, 22 bp, Artificial Sequence
  chemically synthesized
ggacacaacgccttttatattt

SEQ ID NO: 787203 - DNA, 22 bp, Artificial Sequence
  chemically synthesized
gacacaacgccttttatatttc

SEQ ID NO: 787204 - DNA, 22 bp, Artificial Sequence
  chemically synthesized
ttatatttcaactaatatactg

SEQ ID NO: 787205 - DNA, 22 bp, Artificial Sequence
  chemically synthesized
tatatttcaactaatatactgg

SEQ ID NO: 787206 - DNA, 22 bp, Artificial Sequence
  chemically synthesized
atatttcaactaatatactggg

SEQ ID NO: 787207 - DNA, 22 bp, Artificial Sequence
  chemically synthesized
tatttcaactaatatactgggc

SEQ ID NO: 787208 - DNA, 22 bp, Artificial Sequence
  chemically synthesized
caactaatatactgggctgttg

SEQ ID NO: 787209 - DNA, 22 bp, Artificial Sequence
  chemically synthesized
aactaatatactgggctgttgg

SEQ ID NO: 787210 - DNA, 22 bp, Artificial Sequence
  chemically synthesized
taaaaatgagcacagcccaaca

SEQ ID NO: 787211 - DNA, 22 bp, Artificial Sequence
  chemically synthesized
atatactgggctgttgggctgt

SEQ ID NO: 787212 - DNA, 22 bp, Artificial Sequence
  chemically synthesized
taattataaaaatgagcacagc

SEQ ID NO: 787213 - DNA, 22 bp, Artificial Sequence
  chemically synthesized
ggctgttgggctgtgctcattt

SEQ ID NO: 787214 - DNA, 22 bp, Artificial Sequence
  chemically synthesized
ctgtaattataaaaatgagcac

SEQ ID NO: 787215 - DNA, 22 bp, Artificial Sequence
  chemically synthesized
ttgggctgtgctcatttttata

SEQ ID NO: 787216 - DNA, 22 bp, Artificial Sequence
  chemically synthesized
ggctgtgctcatttttataatt

SEQ ID NO: 787217 - DNA, 22 bp, Artificial Sequence
  chemically synthesized
tgtaggaaactactgtaattat

SEQ ID NO: 787218 - DNA, 22 bp, Artificial Sequence
  chemically synthesized
tgctcatttttataattacagt

SEQ ID NO: 787219 - DNA, 22 bp, Artificial Sequence
  chemically synthesized
atgtaggaaactactgtaatta

SEQ ID NO: 787220 - DNA, 22 bp, Artificial Sequence
  chemically synthesized
tttatgtaggaaactactgtaa

SEQ ID NO: 787221 - DNA, 22 bp, Artificial Sequence
  chemically synthesized
atttttataattacagtagttt

SEQ ID NO: 787222 - DNA, 22 bp, Artificial Sequence
  chemically synthesized
ttataattacagtagtttccta

SEQ ID NO: 787223 - DNA, 22 bp, Artificial Sequence
  chemically synthesized
aaactgtttatgtaggaaacta

SEQ ID NO: 787224 - DNA, 22 bp, Artificial Sequence
  chemically synthesized
tataattacagtagtttcctac

SEQ ID NO: 787225 - DNA, 22 bp, Artificial Sequence
  chemically synthesized
aaaactgtttatgtaggaaact

SEQ ID NO: 787226 - DNA, 22 bp, Artificial Sequence
  chemically synthesized
ataattacagtagtttcctaca

SEQ ID NO: 787227 - DNA, 22 bp, Artificial Sequence
  chemically synthesized
taattacagtagtttcctacat

SEQ ID NO: 787228 - DNA, 22 bp, Artificial Sequence
  chemically synthesized
cagtagtttcctacataaacag

SEQ ID NO: 787229 - DNA, 22 bp, Artificial Sequence
  chemically synthesized
cagtgggtccatttaaaactgt

SEQ ID NO: 787230 - DNA, 22 bp, Artificial Sequence
  chemically synthesized
cctacataaacagttttaaatg

SEQ ID NO: 787231 - DNA, 22 bp, Artificial Sequence
  chemically synthesized
ctacataaacagttttaaatgg

SEQ ID NO: 787232 - DNA, 22 bp, Artificial Sequence
  chemically synthesized
cataaacagttttaaatggacc

SEQ ID NO: 787233 - DNA, 22 bp, Artificial Sequence
  chemically synthesized
gcatgttgcagtgggtccattt

SEQ ID NO: 787234 - DNA, 22 bp, Artificial Sequence
  chemically synthesized
ggcatgttgcagtgggtccatt

SEQ ID NO: 787235 - DNA, 22 bp, Artificial Sequence
  chemically synthesized
ttggcatgttgcagtgggtcca

SEQ ID NO: 787236 - DNA, 22 bp, Artificial Sequence
  chemically synthesized
cttggcatgttgcagtgggtcc

SEQ ID NO: 787237 - DNA, 22 bp, Artificial Sequence
  chemically synthesized
tttcttggcatgttgcagtggg

SEQ ID NO: 787238 - DNA, 22 bp, Artificial Sequence
  chemically synthesized
taaatggacccactgcaacatg

SEQ ID NO: 787239 - DNA, 22 bp, Artificial Sequence
  chemically synthesized
attatttcttggcatgttgcag

SEQ ID NO: 787240 - DNA, 22 bp, Artificial Sequence
  chemically synthesized
aaatggacccactgcaacatgc

SEQ ID NO: 787241 - DNA, 22 bp, Artificial Sequence
  chemically synthesized
aatggacccactgcaacatgcc

SEQ ID NO: 787242 - DNA, 22 bp, Artificial Sequence
  chemically synthesized
aatgataggagctaattatttc

SEQ ID NO: 787243 - DNA, 22 bp, Artificial Sequence
  chemically synthesized
caacatgccaagaaataattag

SEQ ID NO: 787244 - DNA, 22 bp, Artificial Sequence
  chemically synthesized
gctcctatcatttaatcttata

SEQ ID NO: 787245 - DNA, 22 bp, Artificial Sequence
  chemically synthesized
tgatacatataaatatataaga

SEQ ID NO: 787246 - DNA, 22 bp, Artificial Sequence
  chemically synthesized
ctatcatttaatcttatatatt

SEQ ID NO: 787247 - DNA, 22 bp, Artificial Sequence
  chemically synthesized
tcatttaatcttatatatttat

SEQ ID NO: 787248 - DNA, 22 bp, Artificial Sequence
  chemically synthesized
aatcttatatatttatatgtat

SEQ ID NO: 787249 - DNA, 22 bp, Artificial Sequence
  chemically synthesized
atcttatatatttatatgtatc

SEQ ID NO: 787250 - DNA, 22 bp, Artificial Sequence
  chemically synthesized
atatatttatatgtatcatagc

SEQ ID NO: 787251 - DNA, 22 bp, Artificial Sequence
  chemically synthesized
tatatttatatgtatcatagca

SEQ ID NO: 787252 - DNA, 22 bp, Artificial Sequence
  chemically synthesized
tgtgccaacatatgctatgata

SEQ ID NO: 787253 - DNA, 22 bp, Artificial Sequence
  chemically synthesized
atatgtatcatagcatatgttg

SEQ ID NO: 787254 - DNA, 22 bp, Artificial Sequence
  chemically synthesized
tatgtatcatagcatatgttgg

SEQ ID NO: 787255 - DNA, 22 bp, Artificial Sequence
  chemically synthesized
gtaagtgaatgttatgtgccaa

SEQ ID NO: 787256 - DNA, 22 bp, Artificial Sequence
  chemically synthesized
aattagtaagtgaatgttatgt

SEQ ID NO: 787257 - DNA, 22 bp, Artificial Sequence
  chemically synthesized
gaattagtaagtgaatgttatg

SEQ ID NO: 787258 - DNA, 22 bp, Artificial Sequence
  chemically synthesized
gcacataacattcacttactaa

SEQ ID NO: 787259 - DNA, 22 bp, Artificial Sequence
  chemically synthesized
atgatgcttgaattagtaagtg

SEQ ID NO: 787260 - DNA, 22 bp, Artificial Sequence
  chemically synthesized
gatgatgcttgaattagtaagt

SEQ ID NO: 787261 - DNA, 22 bp, Artificial Sequence
  chemically synthesized
cttgatgatgcttgaattagta

SEQ ID NO: 787262 - DNA, 22 bp, Artificial Sequence
  chemically synthesized
acttgatgatgcttgaattagt

SEQ ID NO: 787263 - DNA, 22 bp, Artificial Sequence
  chemically synthesized
gacttacttgatgatgcttgaa

SEQ ID NO: 787264 - DNA, 22 bp, Artificial Sequence
  chemically synthesized
acttactaattcaagcatcatc

SEQ ID NO: 787265 - DNA, 22 bp, Artificial Sequence
  chemically synthesized
atctagacttacttgatgatgc

SEQ ID NO: 787266 - DNA, 22 bp, Artificial Sequence
  chemically synthesized
actaattcaagcatcatcaagt

SEQ ID NO: 787267 - DNA, 22 bp, Artificial Sequence
  chemically synthesized
tgatctagacttacttgatgat

SEQ ID NO: 787268 - DNA, 22 bp, Artificial Sequence
  chemically synthesized
ctaattcaagcatcatcaagta

SEQ ID NO: 787269 - DNA, 22 bp, Artificial Sequence
  chemically synthesized
ctgatctagacttacttgatga

SEQ ID NO: 787270 - DNA, 22 bp, Artificial Sequence
  chemically synthesized
attcaagcatcatcaagtaagt

SEQ ID NO: 787271 - DNA, 22 bp, Artificial Sequence
  chemically synthesized
aagcatcatcaagtaagtctag

SEQ ID NO: 787272 - DNA, 22 bp, Artificial Sequence
  chemically synthesized
aatatatttctgatctagactt

SEQ ID NO: 787273 - DNA, 22 bp, Artificial Sequence
  chemically synthesized
ctaaatatatttctgatctaga

SEQ ID NO: 787274 - DNA, 22 bp, Artificial Sequence
  chemically synthesized
gatcagaaatatatttagcagt

SEQ ID NO: 787275 - DNA, 22 bp, Artificial Sequence
  chemically synthesized
aaagagtatgtagaggtggaac

SEQ ID NO: 787276 - DNA, 22 bp, Artificial Sequence
  chemically synthesized
agtctgaaagagtatgtagagg

SEQ ID NO: 787277 - DNA, 22 bp, Artificial Sequence
  chemically synthesized
agcagttccacctctacatact

SEQ ID NO: 787278 - DNA, 22 bp, Artificial Sequence
  chemically synthesized
gcagttccacctctacatactc

SEQ ID NO: 787279 - DNA, 22 bp, Artificial Sequence
  chemically synthesized
gctcagtctgaaagagtatgta

SEQ ID NO: 787280 - DNA, 22 bp, Artificial Sequence
  chemically synthesized
attagctcagtctgaaagagta

SEQ ID NO: 787281 - DNA, 22 bp, Artificial Sequence
  chemically synthesized
cacctctacatactctttcaga

SEQ ID NO: 787282 - DNA, 22 bp, Artificial Sequence
  chemically synthesized
gtggctaattagctcagtctga

SEQ ID NO: 787283 - DNA, 22 bp, Artificial Sequence
  chemically synthesized
tacatactctttcagactgagc

SEQ ID NO: 787284 - DNA, 22 bp, Artificial Sequence
  chemically synthesized
catactctttcagactgagcta

SEQ ID NO: 787285 - DNA, 22 bp, Artificial Sequence
  chemically synthesized
taactagtggctaattagctca

SEQ ID NO: 787286 - DNA, 22 bp, Artificial Sequence
  chemically synthesized
tgtaactagtggctaattagct

SEQ ID NO: 787287 - DNA, 22 bp, Artificial Sequence
  chemically synthesized
tttcagactgagctaattagcc

SEQ ID NO: 787288 - DNA, 22 bp, Artificial Sequence
  chemically synthesized
tctgtaactagtggctaattag

SEQ ID NO: 787289 - DNA, 22 bp, Artificial Sequence
  chemically synthesized
ctctgtaactagtggctaatta

SEQ ID NO: 787290 - DNA, 22 bp, Artificial Sequence
  chemically synthesized
tcagactgagctaattagccac

SEQ ID NO: 787291 - DNA, 22 bp, Artificial Sequence
  chemically synthesized
tctctgtaactagtggctaatt

SEQ ID NO: 787292 - DNA, 22 bp, Artificial Sequence
  chemically synthesized
cagactgagctaattagccact

SEQ ID NO: 787293 - DNA, 22 bp, Artificial Sequence
  chemically synthesized
ttctctgtaactagtggctaat

SEQ ID NO: 787294 - DNA, 22 bp, Artificial Sequence
  chemically synthesized
agactgagctaattagccacta

SEQ ID NO: 787295 - DNA, 22 bp, Artificial Sequence
  chemically synthesized
tttctctgtaactagtggctaa

SEQ ID NO: 787296 - DNA, 22 bp, Artificial Sequence
  chemically synthesized
tctttttctctgtaactagtgg

SEQ ID NO: 787297 - DNA, 22 bp, Artificial Sequence
  chemically synthesized
agctaattagccactagttaca

SEQ ID NO: 787298 - DNA, 22 bp, Artificial Sequence
  chemically synthesized
attagccactagttacagagaa

SEQ ID NO: 787299 - DNA, 22 bp, Artificial Sequence
  chemically synthesized
gaaagtattatctttttctctg

SEQ ID NO: 787300 - DNA, 22 bp, Artificial Sequence
  chemically synthesized
gccactagttacagagaaaaag

SEQ ID NO: 787301 - DNA, 22 bp, Artificial Sequence
  chemically synthesized
agaaagtattatctttttctct

SEQ ID NO: 787302 - DNA, 22 bp, Artificial Sequence
  chemically synthesized
tagaaagtattatctttttctc

SEQ ID NO: 787303 - DNA, 22 bp, Artificial Sequence
  chemically synthesized
gttacagagaaaaagataatac

SEQ ID NO: 787304 - DNA, 22 bp, Artificial Sequence
  chemically synthesized
cagagaaaaagataatactttc

SEQ ID NO: 787305 - DNA, 22 bp, Artificial Sequence
  chemically synthesized
aatatatattttagaaagtatt

SEQ ID NO: 787306 - DNA, 22 bp, Artificial Sequence
  chemically synthesized
gaaaatatctaaatatatattt

SEQ ID NO: 787307 - DNA, 22 bp, Artificial Sequence
  chemically synthesized
agaaaatatctaaatatatatt

SEQ ID NO: 787308 - DNA, 22 bp, Artificial Sequence
  chemically synthesized
tagaaaatatctaaatatatat

SEQ ID NO: 787309 - DNA, 22 bp, Artificial Sequence
  chemically synthesized
ttttagaaaatatctaaatata

SEQ ID NO: 787310 - DNA, 22 bp, Artificial Sequence
  chemically synthesized
tctaaaatatatatttagatat

SEQ ID NO: 787311 - DNA, 22 bp, Artificial Sequence
  chemically synthesized
ctaaaatatatatttagatatt

SEQ ID NO: 787312 - DNA, 22 bp, Artificial Sequence
  chemically synthesized
taaaatatatatttagatattt

SEQ ID NO: 787313 - DNA, 22 bp, Artificial Sequence
  chemically synthesized
aaatatatatttagatattttc

SEQ ID NO: 787314 - DNA, 22 bp, Artificial Sequence
  chemically synthesized
aaagtaaagttattttagaaaa

SEQ ID NO: 787315 - DNA, 22 bp, Artificial Sequence
  chemically synthesized
caaagtaaagttattttagaaa

SEQ ID NO: 787316 - DNA, 22 bp, Artificial Sequence
  chemically synthesized
agatattttctaaaataacttt

SEQ ID NO: 787317 - DNA, 22 bp, Artificial Sequence
  chemically synthesized
gatattttctaaaataacttta

SEQ ID NO: 787318 - DNA, 22 bp, Artificial Sequence
  chemically synthesized
aaccatttcaaagtaaagttat

SEQ ID NO: 787319 - DNA, 22 bp, Artificial Sequence
  chemically synthesized
aaaccatttcaaagtaaagtta

SEQ ID NO: 787320 - DNA, 22 bp, Artificial Sequence
  chemically synthesized
tctaaaataactttactttgaa

SEQ ID NO: 787321 - DNA, 22 bp, Artificial Sequence
  chemically synthesized
ctaaaataactttactttgaaa

SEQ ID NO: 787322 - DNA, 22 bp, Artificial Sequence
  chemically synthesized
taaaataactttactttgaaat

SEQ ID NO: 787323 - DNA, 22 bp, Artificial Sequence
  chemically synthesized
tggtcttaaaccatttcaaagt

SEQ ID NO: 787324 - DNA, 22 bp, Artificial Sequence
  chemically synthesized
gtggtcttaaaccatttcaaag

SEQ ID NO: 787325 - DNA, 22 bp, Artificial Sequence
  chemically synthesized
aaataactttactttgaaatgg

SEQ ID NO: 787326 - DNA, 22 bp, Artificial Sequence
  chemically synthesized
tgtggtcttaaaccatttcaaa

SEQ ID NO: 787327 - DNA, 22 bp, Artificial Sequence
  chemically synthesized
caagttttgtggtcttaaacca

SEQ ID NO: 787328 - DNA, 22 bp, Artificial Sequence
  chemically synthesized
gcaagttttgtggtcttaaacc

SEQ ID NO: 787329 - DNA, 22 bp, Artificial Sequence
  chemically synthesized
tactttgaaatggtttaagacc

SEQ ID NO: 787330 - DNA, 22 bp, Artificial Sequence
  chemically synthesized
actttgaaatggtttaagacca

SEQ ID NO: 787331 - DNA, 22 bp, Artificial Sequence
  chemically synthesized
ctttgaaatggtttaagaccac

SEQ ID NO: 787332 - DNA, 22 bp, Artificial Sequence
  chemically synthesized
tatttgcaagttttgtggtctt

SEQ ID NO: 787333 - DNA, 22 bp, Artificial Sequence
  chemically synthesized
tgaaatggtttaagaccacaaa

SEQ ID NO: 787334 - DNA, 22 bp, Artificial Sequence
  chemically synthesized
gaaatggtttaagaccacaaaa

SEQ ID NO: 787335 - DNA, 22 bp, Artificial Sequence
  chemically synthesized
aaatggtttaagaccacaaaac

SEQ ID NO: 787336 - DNA, 22 bp, Artificial Sequence
  chemically synthesized
tactatatttgcaagttttgtg

SEQ ID NO: 787337 - DNA, 22 bp, Artificial Sequence
  chemically synthesized
tgtactatatttgcaagttttg

SEQ ID NO: 787338 - DNA, 22 bp, Artificial Sequence
  chemically synthesized
aagaccacaaaacttgcaaata

SEQ ID NO: 787339 - DNA, 22 bp, Artificial Sequence
  chemically synthesized
agaccacaaaacttgcaaatat

SEQ ID NO: 787340 - DNA, 22 bp, Artificial Sequence
  chemically synthesized
gcaaatatagtacagagacttc

SEQ ID NO: 787341 - DNA, 22 bp, Artificial Sequence
  chemically synthesized
caaatatagtacagagacttct

SEQ ID NO: 787342 - DNA, 22 bp, Artificial Sequence
  chemically synthesized
ggtaaaaggtgcgtgagaagtc

SEQ ID NO: 787343 - DNA, 22 bp, Artificial Sequence
  chemically synthesized
ggagaagctgggtaaaaggtgc

SEQ ID NO: 787344 - DNA, 22 bp, Artificial Sequence
  chemically synthesized
tcattgggagaagctgggtaaa

SEQ ID NO: 787345 - DNA, 22 bp, Artificial Sequence
  chemically synthesized
ctcacgcaccttttacccagct

SEQ ID NO: 787346 - DNA, 22 bp, Artificial Sequence
  chemically synthesized
tcacgcaccttttacccagctt

SEQ ID NO: 787347 - DNA, 22 bp, Artificial Sequence
  chemically synthesized
acgcaccttttacccagcttct

SEQ ID NO: 787348 - DNA, 22 bp, Artificial Sequence
  chemically synthesized
aaatgctatcattgggagaagc

SEQ ID NO: 787349 - DNA, 22 bp, Artificial Sequence
  chemically synthesized
aaaatgctatcattgggagaag

SEQ ID NO: 787350 - DNA, 22 bp, Artificial Sequence
  chemically synthesized
ttacccagcttctcccaatgat

SEQ ID NO: 787351 - DNA, 22 bp, Artificial Sequence
  chemically synthesized
tacccagcttctcccaatgata

SEQ ID NO: 787352 - DNA, 22 bp, Artificial Sequence
  chemically synthesized
acccagcttctcccaatgatag

SEQ ID NO: 787353 - DNA, 22 bp, Artificial Sequence
  chemically synthesized
cccagcttctcccaatgatagc

SEQ ID NO: 787354 - DNA, 22 bp, Artificial Sequence
  chemically synthesized
tgggtatttaaaatgctatcat

SEQ ID NO: 787355 - DNA, 22 bp, Artificial Sequence
  chemically synthesized
ctcccaatgatagcattttaaa

SEQ ID NO: 787356 - DNA, 22 bp, Artificial Sequence
  chemically synthesized
tcccaatgatagcattttaaat

SEQ ID NO: 787357 - DNA, 22 bp, Artificial Sequence
  chemically synthesized
ccaatgatagcattttaaatac

SEQ ID NO: 787358 - DNA, 22 bp, Artificial Sequence
  chemically synthesized
atgataatgtactatgggtatt

SEQ ID NO: 787359 - DNA, 22 bp, Artificial Sequence
  chemically synthesized
gatgataatgtactatgggtat

SEQ ID NO: 787360 - DNA, 22 bp, Artificial Sequence
  chemically synthesized
tgatgataatgtactatgggta

SEQ ID NO: 787361 - DNA, 22 bp, Artificial Sequence
  chemically synthesized
gctttgatgataatgtactatg

SEQ ID NO: 787362 - DNA, 22 bp, Artificial Sequence
  chemically synthesized
ctagctttgatgataatgtact

SEQ ID NO: 787363 - DNA, 22 bp, Artificial Sequence
  chemically synthesized
taaatacccatagtacattatc

SEQ ID NO: 787364 - DNA, 22 bp, Artificial Sequence
  chemically synthesized
cctagctttgatgataatgtac

SEQ ID NO: 787365 - DNA, 22 bp, Artificial Sequence
  chemically synthesized
aaatacccatagtacattatca

SEQ ID NO: 787366 - DNA, 22 bp, Artificial Sequence
  chemically synthesized
aatacccatagtacattatcat

SEQ ID NO: 787367 - DNA, 22 bp, Artificial Sequence
  chemically synthesized
tgccaatgtcagtttcctagct

SEQ ID NO: 787368 - DNA, 22 bp, Artificial Sequence
  chemically synthesized
tcatcaaagctaggaaactgac

SEQ ID NO: 787369 - DNA, 22 bp, Artificial Sequence
  chemically synthesized
atagtattgtgccaatgtcagt

SEQ ID NO: 787370 - DNA, 22 bp, Artificial Sequence
  chemically synthesized
agttaatagtattgtgccaatg

SEQ ID NO: 787371 - DNA, 22 bp, Artificial Sequence
  chemically synthesized
gagttaatagtattgtgccaat

SEQ ID NO: 787372 - DNA, 22 bp, Artificial Sequence
  chemically synthesized
ggaaactgacattggcacaata

SEQ ID NO: 787373 - DNA, 22 bp, Artificial Sequence
  chemically synthesized
tatttgagttaatagtattgtg

SEQ ID NO: 787374 - DNA, 22 bp, Artificial Sequence
  chemically synthesized
acattggcacaatactattaac

SEQ ID NO: 787375 - DNA, 22 bp, Artificial Sequence
  chemically synthesized
gcacaatactattaactcaaat

SEQ ID NO: 787376 - DNA, 22 bp, Artificial Sequence
  chemically synthesized
gtgaaatataaatgaggtctgt

SEQ ID NO: 787377 - DNA, 22 bp, Artificial Sequence
  chemically synthesized
ttaactcaaatacagacctcat

SEQ ID NO: 787378 - DNA, 22 bp, Artificial Sequence
  chemically synthesized
actcaaatacagacctcattta

SEQ ID NO: 787379 - DNA, 22 bp, Artificial Sequence
  chemically synthesized
aaatacagacctcatttatatt

SEQ ID NO: 787380 - DNA, 22 bp, Artificial Sequence
  chemically synthesized
atttatatttcaccagttctta

SEQ ID NO: 787381 - DNA, 22 bp, Artificial Sequence
  chemically synthesized
gaaggatgtatgtaagaactgg

SEQ ID NO: 787382 - DNA, 22 bp, Artificial Sequence
  chemically synthesized
agaaggatgtatgtaagaactg

SEQ ID NO: 787383 - DNA, 22 bp, Artificial Sequence
  chemically synthesized
atatttcaccagttcttacata

SEQ ID NO: 787384 - DNA, 22 bp, Artificial Sequence
  chemically synthesized
tttagaaggatgtatgtaagaa

SEQ ID NO: 787385 - DNA, 22 bp, Artificial Sequence
  chemically synthesized
tatttcaccagttcttacatac

SEQ ID NO: 787386 - DNA, 22 bp, Artificial Sequence
  chemically synthesized
atttagaaggatgtatgtaaga

SEQ ID NO: 787387 - DNA, 22 bp, Artificial Sequence
  chemically synthesized
caccagttcttacatacatcct

SEQ ID NO: 787388 - DNA, 22 bp, Artificial Sequence
  chemically synthesized
accagttcttacatacatcctt

SEQ ID NO: 787389 - DNA, 22 bp, Artificial Sequence
  chemically synthesized
aaataaatatttatttagaagg

SEQ ID NO: 787390 - DNA, 22 bp, Artificial Sequence
  chemically synthesized
ttacatacatccttctaaataa

SEQ ID NO: 787391 - DNA, 22 bp, Artificial Sequence
  chemically synthesized
acatacatccttctaaataaat

SEQ ID NO: 787392 - DNA, 22 bp, Artificial Sequence
  chemically synthesized
catacatccttctaaataaata

SEQ ID NO: 787393 - DNA, 22 bp, Artificial Sequence
  chemically synthesized
agccagattaaaataaatattt

SEQ ID NO: 787394 - DNA, 22 bp, Artificial Sequence
  chemically synthesized
aagccagattaaaataaatatt

SEQ ID NO: 787395 - DNA, 22 bp, Artificial Sequence
  chemically synthesized
ctaaataaatatttattttaat

SEQ ID NO: 787396 - DNA, 22 bp, Artificial Sequence
  chemically synthesized
taaataaatatttattttaatc

SEQ ID NO: 787397 - DNA, 22 bp, Artificial Sequence
  chemically synthesized
ggatttaagccagattaaaata

SEQ ID NO: 787398 - DNA, 22 bp, Artificial Sequence
  chemically synthesized
aggatttaagccagattaaaat

SEQ ID NO: 787399 - DNA, 22 bp, Artificial Sequence
  chemically synthesized
aataaatatttattttaatctg

SEQ ID NO: 787400 - DNA, 22 bp, Artificial Sequence
  chemically synthesized
ccataagacttaggatttaagc

SEQ ID NO: 787401 - DNA, 22 bp, Artificial Sequence
  chemically synthesized
attttaatctggcttaaatcct

SEQ ID NO: 787402 - DNA, 22 bp, Artificial Sequence
  chemically synthesized
ttttaatctggcttaaatccta

SEQ ID NO: 787403 - DNA, 22 bp, Artificial Sequence
  chemically synthesized
cctaccataagacttaggattt

SEQ ID NO: 787404 - DNA, 22 bp, Artificial Sequence
  chemically synthesized
taatctggcttaaatcctaagt

SEQ ID NO: 787405 - DNA, 22 bp, Artificial Sequence
  chemically synthesized
gcctaccataagacttaggatt

SEQ ID NO: 787406 - DNA, 22 bp, Artificial Sequence
  chemically synthesized
aatctggcttaaatcctaagtc

SEQ ID NO: 787407 - DNA, 22 bp, Artificial Sequence
  chemically synthesized
atctggcttaaatcctaagtct

SEQ ID NO: 787408 - DNA, 22 bp, Artificial Sequence
  chemically synthesized
gcttaaatcctaagtcttatgg

SEQ ID NO: 787409 - DNA, 22 bp, Artificial Sequence
  chemically synthesized
aaatcctaagtcttatggtagg

SEQ ID NO: 787410 - DNA, 22 bp, Artificial Sequence
  chemically synthesized
aatcctaagtcttatggtaggc

SEQ ID NO: 787411 - DNA, 22 bp, Artificial Sequence
  chemically synthesized
taaaacatacttgcctaccata

SEQ ID NO: 787412 - DNA, 22 bp, Artificial Sequence
  chemically synthesized
agtcttatggtaggcaagtatg

SEQ ID NO: 787413 - DNA, 22 bp, Artificial Sequence
  chemically synthesized
aaaccgctataaaacatacttg

SEQ ID NO: 787414 - DNA, 22 bp, Artificial Sequence
  chemically synthesized
atggtaggcaagtatgttttat

SEQ ID NO: 787415 - DNA, 22 bp, Artificial Sequence
  chemically synthesized
tggtaggcaagtatgttttata

SEQ ID NO: 787416 - DNA, 22 bp, Artificial Sequence
  chemically synthesized
aatgatattaaaaccgctataa

SEQ ID NO: 787417 - DNA, 22 bp, Artificial Sequence
  chemically synthesized
gaatgatattaaaaccgctata

SEQ ID NO: 787418 - DNA, 22 bp, Artificial Sequence
  chemically synthesized
tgaatgatattaaaaccgctat

SEQ ID NO: 787419 - DNA, 22 bp, Artificial Sequence
  chemically synthesized
gaaaattttgaatgatattaaa

SEQ ID NO: 787420 - DNA, 22 bp, Artificial Sequence
  chemically synthesized
agaaaattttgaatgatattaa

SEQ ID NO: 787421 - DNA, 22 bp, Artificial Sequence
  chemically synthesized
tatagcggttttaatatcattc

SEQ ID NO: 787422 - DNA, 22 bp, Artificial Sequence
  chemically synthesized
atagcggttttaatatcattca

SEQ ID NO: 787423 - DNA, 22 bp, Artificial Sequence
  chemically synthesized
tttagaaaattttgaatgatat

SEQ ID NO: 787424 - DNA, 22 bp, Artificial Sequence
  chemically synthesized
tagcggttttaatatcattcaa

SEQ ID NO: 787425 - DNA, 22 bp, Artificial Sequence
  chemically synthesized
aacattatttagaaaattttga

SEQ ID NO: 787426 - DNA, 22 bp, Artificial Sequence
  chemically synthesized
taatatcattcaaaattttcta

SEQ ID NO: 787427 - DNA, 22 bp, Artificial Sequence
  chemically synthesized
aatatcattcaaaattttctaa

SEQ ID NO: 787428 - DNA, 22 bp, Artificial Sequence
  chemically synthesized
atatcattcaaaattttctaaa

SEQ ID NO: 787429 - DNA, 22 bp, Artificial Sequence
  chemically synthesized
cactgaacattatttagaaaat

SEQ ID NO: 787430 - DNA, 22 bp, Artificial Sequence
  chemically synthesized
ctacactgaacattatttagaa

SEQ ID NO: 787431 - DNA, 22 bp, Artificial Sequence
  chemically synthesized
actacactgaacattatttaga

SEQ ID NO: 787432 - DNA, 22 bp, Artificial Sequence
  chemically synthesized
tactacactgaacattatttag

SEQ ID NO: 787433 - DNA, 22 bp, Artificial Sequence
  chemically synthesized
aaaattttctaaataatgttca

SEQ ID NO: 787434 - DNA, 22 bp, Artificial Sequence
  chemically synthesized
taattttactacactgaacatt

SEQ ID NO: 787435 - DNA, 22 bp, Artificial Sequence
  chemically synthesized
ataattttactacactgaacat

SEQ ID NO: 787436 - DNA, 22 bp, Artificial Sequence
  chemically synthesized
ttataattttactacactgaac

SEQ ID NO: 787437 - DNA, 22 bp, Artificial Sequence
  chemically synthesized
tctaaataatgttcagtgtagt

SEQ ID NO: 787438 - DNA, 22 bp, Artificial Sequence
  chemically synthesized
ctaaataatgttcagtgtagta

SEQ ID NO: 787439 - DNA, 22 bp, Artificial Sequence
  chemically synthesized
taaataatgttcagtgtagtaa

SEQ ID NO: 787440 - DNA, 22 bp, Artificial Sequence
  chemically synthesized
aataatgttcagtgtagtaaaa

SEQ ID NO: 787441 - DNA, 22 bp, Artificial Sequence
  chemically synthesized
agtgtagtaaaattataagaat

SEQ ID NO: 787442 - DNA, 22 bp, Artificial Sequence
  chemically synthesized
agtgatcagaatatcattctta

SEQ ID NO: 787443 - DNA, 22 bp, Artificial Sequence
  chemically synthesized
aattaagtgatcagaatatcat

SEQ ID NO: 787444 - DNA, 22 bp, Artificial Sequence
  chemically synthesized
gaattaagtgatcagaatatca

SEQ ID NO: 787445 - DNA, 22 bp, Artificial Sequence
  chemically synthesized
tgaattaagtgatcagaatatc

SEQ ID NO: 787446 - DNA, 22 bp, Artificial Sequence
  chemically synthesized
taagaatgatattctgatcact

SEQ ID NO: 787447 - DNA, 22 bp, Artificial Sequence
  chemically synthesized
tgatcacttaattcaaaactct

SEQ ID NO: 787448 - DNA, 22 bp, Artificial Sequence
  chemically synthesized
atcacttaattcaaaactcttt

SEQ ID NO: 787449 - DNA, 22 bp, Artificial Sequence
  chemically synthesized
aattcaaaactctttgctttct

SEQ ID NO: 787450 - DNA, 22 bp, Artificial Sequence
  chemically synthesized
attcaaaactctttgctttctg

SEQ ID NO: 787451 - DNA, 22 bp, Artificial Sequence
  chemically synthesized
aaaactctttgctttctgctat

SEQ ID NO: 787452 - DNA, 22 bp, Artificial Sequence
  chemically synthesized
tggcaacagtcccatagcagaa

SEQ ID NO: 787453 - DNA, 22 bp, Artificial Sequence
  chemically synthesized
tgtggcaacagtcccatagcag

SEQ ID NO: 787454 - DNA, 22 bp, Artificial Sequence
  chemically synthesized
ctgtggcaacagtcccatagca

SEQ ID NO: 787455 - DNA, 22 bp, Artificial Sequence
  chemically synthesized
tctgtggcaacagtcccatagc

SEQ ID NO: 787456 - DNA, 22 bp, Artificial Sequence
  chemically synthesized
tttgctttctgctatgggactg

SEQ ID NO: 787457 - DNA, 22 bp, Artificial Sequence
  chemically synthesized
tgctttctgctatgggactgtt

SEQ ID NO: 787458 - DNA, 22 bp, Artificial Sequence
  chemically synthesized
gctttctgctatgggactgttg

SEQ ID NO: 787459 - DNA, 22 bp, Artificial Sequence
  chemically synthesized
ctttctgctatgggactgttgc

SEQ ID NO: 787460 - DNA, 22 bp, Artificial Sequence
  chemically synthesized
aaattttctgtggcaacagtcc

SEQ ID NO: 787461 - DNA, 22 bp, Artificial Sequence
  chemically synthesized
gaaattttctgtggcaacagtc

SEQ ID NO: 787462 - DNA, 22 bp, Artificial Sequence
  chemically synthesized
tgaaattttctgtggcaacagt

SEQ ID NO: 787463 - DNA, 22 bp, Artificial Sequence
  chemically synthesized
tctgctatgggactgttgccac

SEQ ID NO: 787464 - DNA, 22 bp, Artificial Sequence
  chemically synthesized
ttgaaattttctgtggcaacag

SEQ ID NO: 787465 - DNA, 22 bp, Artificial Sequence
  chemically synthesized
ctgctatgggactgttgccaca

SEQ ID NO: 787466 - DNA, 22 bp, Artificial Sequence
  chemically synthesized
tgctatgggactgttgccacag

SEQ ID NO: 787467 - DNA, 22 bp, Artificial Sequence
  chemically synthesized
ctatgggactgttgccacagaa

SEQ ID NO: 787468 - DNA, 22 bp, Artificial Sequence
  chemically synthesized
tgggactgttgccacagaaaat

SEQ ID NO: 787469 - DNA, 22 bp, Artificial Sequence
  chemically synthesized
ttgccacagaaaatttcaaaaa

SEQ ID NO: 787470 - DNA, 22 bp, Artificial Sequence
  chemically synthesized
ccacagaaaatttcaaaaatta

SEQ ID NO: 787471 - DNA, 22 bp, Artificial Sequence
  chemically synthesized
aaaaaaaaaaaaagtaattttt

SEQ ID NO: 787472 - DNA, 22 bp, Artificial Sequence
  chemically synthesized
aaaaaaaaaaaaaagtaatttt

SEQ ID NO: 787473 - DNA, 22 bp, Artificial Sequence
  chemically synthesized
taaaaaaaaaaaaaagtaattt

SEQ ID NO: 787474 - DNA, 22 bp, Artificial Sequence
  chemically synthesized
tctttaaaaaaaaaaaaaagta

SEQ ID NO: 787475 - DNA, 22 bp, Artificial Sequence
  chemically synthesized
tgtctttaaaaaaaaaaaaaag

SEQ ID NO: 787476 - DNA, 22 bp, Artificial Sequence
  chemically synthesized
ctgtctttaaaaaaaaaaaaaa

SEQ ID NO: 787477 - DNA, 22 bp, Artificial Sequence
  chemically synthesized
tctgtctttaaaaaaaaaaaaa

SEQ ID NO: 787478 - DNA, 22 bp, Artificial Sequence
  chemically synthesized
caaaaattactttttttttttt

SEQ ID NO: 787479 - DNA, 22 bp, Artificial Sequence
  chemically synthesized
aaaaattacttttttttttttt

SEQ ID NO: 787480 - DNA, 22 bp, Artificial Sequence
  chemically synthesized
aagatgctttctgtctttaaaa

SEQ ID NO: 787481 - DNA, 22 bp, Artificial Sequence
  chemically synthesized
cttttttttttttttaaagaca

SEQ ID NO: 787482 - DNA, 22 bp, Artificial Sequence
  chemically synthesized
ttttttttttttaaagacagaa

SEQ ID NO: 787483 - DNA, 22 bp, Artificial Sequence
  chemically synthesized
attcaagatgctttctgtcttt

SEQ ID NO: 787484 - DNA, 22 bp, Artificial Sequence
  chemically synthesized
tttttttttttaaagacagaaa

SEQ ID NO: 787485 - DNA, 22 bp, Artificial Sequence
  chemically synthesized
ttttttttttaaagacagaaag

SEQ ID NO: 787486 - DNA, 22 bp, Artificial Sequence
  chemically synthesized
tcattcaagatgctttctgtct

SEQ ID NO: 787487 - DNA, 22 bp, Artificial Sequence
  chemically synthesized
tttttttttaaagacagaaagc

SEQ ID NO: 787488 - DNA, 22 bp, Artificial Sequence
  chemically synthesized
ttttttttaaagacagaaagca

SEQ ID NO: 787489 - DNA, 22 bp, Artificial Sequence
  chemically synthesized
tttttttaaagacagaaagcat

SEQ ID NO: 787490 - DNA, 22 bp, Artificial Sequence
  chemically synthesized
ttttttaaagacagaaagcatc

SEQ ID NO: 787491 - DNA, 22 bp, Artificial Sequence
  chemically synthesized
tttttaaagacagaaagcatct

SEQ ID NO: 787492 - DNA, 22 bp, Artificial Sequence
  chemically synthesized
ttttaaagacagaaagcatctt

SEQ ID NO: 787493 - DNA, 22 bp, Artificial Sequence
  chemically synthesized
tttaaagacagaaagcatcttg

SEQ ID NO: 787494 - DNA, 22 bp, Artificial Sequence
  chemically synthesized
ttaaagacagaaagcatcttga

SEQ ID NO: 787495 - DNA, 22 bp, Artificial Sequence
  chemically synthesized
taaagacagaaagcatcttgaa

SEQ ID NO: 787496 - DNA, 22 bp, Artificial Sequence
  chemically synthesized
aaagacagaaagcatcttgaat

SEQ ID NO: 787497 - DNA, 22 bp, Artificial Sequence
  chemically synthesized
aagacagaaagcatcttgaatg

SEQ ID NO: 787498 - DNA, 22 bp, Artificial Sequence
  chemically synthesized
acagggatacaaagtcaggccc

SEQ ID NO: 787499 - DNA, 22 bp, Artificial Sequence
  chemically synthesized
gaatgagagggcctgactttgt

SEQ ID NO: 787500 - DNA, 22 bp, Artificial Sequence
  chemically synthesized
aatgagagggcctgactttgta

SEQ ID NO: 787501 - DNA, 22 bp, Artificial Sequence
  chemically synthesized
agaacgtacatattaacaggga

SEQ ID NO: 787502 - DNA, 22 bp, Artificial Sequence
  chemically synthesized
actttgtatccctgttaatatg

SEQ ID NO: 787503 - DNA, 22 bp, Artificial Sequence
  chemically synthesized
tgtatccctgttaatatgtacg

SEQ ID NO: 787504 - DNA, 22 bp, Artificial Sequence
  chemically synthesized
gtatccctgttaatatgtacgt

SEQ ID NO: 787505 - DNA, 22 bp, Artificial Sequence
  chemically synthesized
tatccctgttaatatgtacgtt

SEQ ID NO: 787506 - DNA, 22 bp, Artificial Sequence
  chemically synthesized
tggagtaattgagaacgtacat

SEQ ID NO: 787507 - DNA, 22 bp, Artificial Sequence
  chemically synthesized
tatggagtaattgagaacgtac

SEQ ID NO: 787508 - DNA, 22 bp, Artificial Sequence
  chemically synthesized
ctatggagtaattgagaacgta

SEQ ID NO: 787509 - DNA, 22 bp, Artificial Sequence
  chemically synthesized
ttaatatgtacgttctcaatta

SEQ ID NO: 787510 - DNA, 22 bp, Artificial Sequence
  chemically synthesized
atatgtacgttctcaattactc

SEQ ID NO: 787511 - DNA, 22 bp, Artificial Sequence
  chemically synthesized
atatatggtttctatggagtaa

SEQ ID NO: 787512 - DNA, 22 bp, Artificial Sequence
  chemically synthesized
catatatggtttctatggagta

SEQ ID NO: 787513 - DNA, 22 bp, Artificial Sequence
  chemically synthesized
tcatatatggtttctatggagt

SEQ ID NO: 787514 - DNA, 22 bp, Artificial Sequence
  chemically synthesized
ttcatatatggtttctatggag

SEQ ID NO: 787515 - DNA, 22 bp, Artificial Sequence
  chemically synthesized
tcaattactccatagaaaccat

SEQ ID NO: 787516 - DNA, 22 bp, Artificial Sequence
  chemically synthesized
aacttttcatatatggtttcta

SEQ ID NO: 787517 - DNA, 22 bp, Artificial Sequence
  chemically synthesized
aattactccatagaaaccatat

SEQ ID NO: 787518 - DNA, 22 bp, Artificial Sequence
  chemically synthesized
ctccatagaaaccatatatgaa

SEQ ID NO: 787519 - DNA, 22 bp, Artificial Sequence
  chemically synthesized
catagaaaccatatatgaaaag

SEQ ID NO: 787520 - DNA, 22 bp, Artificial Sequence
  chemically synthesized
ggagcaaagaagcagaactaaa

SEQ ID NO: 787521 - DNA, 22 bp, Artificial Sequence
  chemically synthesized
gggagcaaagaagcagaactaa

SEQ ID NO: 787522 - DNA, 22 bp, Artificial Sequence
  chemically synthesized
agttctgcttctttgctcccaa

SEQ ID NO: 787523 - DNA, 22 bp, Artificial Sequence
  chemically synthesized
gttctgcttctttgctcccaag

SEQ ID NO: 787524 - DNA, 22 bp, Artificial Sequence
  chemically synthesized
gtaagaaatgagacttgggagc

SEQ ID NO: 787525 - DNA, 22 bp, Artificial Sequence
  chemically synthesized
tgcttctttgctcccaagtctc

SEQ ID NO: 787526 - DNA, 22 bp, Artificial Sequence
  chemically synthesized
cttctttgctcccaagtctcat

SEQ ID NO: 787527 - DNA, 22 bp, Artificial Sequence
  chemically synthesized
ctttgctcccaagtctcatttc

SEQ ID NO: 787528 - DNA, 22 bp, Artificial Sequence
  chemically synthesized
tttgctcccaagtctcatttct

SEQ ID NO: 787529 - DNA, 22 bp, Artificial Sequence
  chemically synthesized
tgctcccaagtctcatttctta

SEQ ID NO: 787530 - DNA, 22 bp, Artificial Sequence
  chemically synthesized
gctcccaagtctcatttcttac

SEQ ID NO: 787531 - DNA, 22 bp, Artificial Sequence
  chemically synthesized
agaaaaatgctagtaagaaatg

SEQ ID NO: 787532 - DNA, 22 bp, Artificial Sequence
  chemically synthesized
ctcccaagtctcatttcttact

SEQ ID NO: 787533 - DNA, 22 bp, Artificial Sequence
  chemically synthesized
ccaagtctcatttcttactagc

SEQ ID NO: 787534 - DNA, 22 bp, Artificial Sequence
  chemically synthesized
aaccagatgttaagaaaaatgc

SEQ ID NO: 787535 - DNA, 22 bp, Artificial Sequence
  chemically synthesized
atttcttactagcatttttctt

SEQ ID NO: 787536 - DNA, 22 bp, Artificial Sequence
  chemically synthesized
cttactagcatttttcttaaca

SEQ ID NO: 787537 - DNA, 22 bp, Artificial Sequence
  chemically synthesized
ttactagcatttttcttaacat

SEQ ID NO: 787538 - DNA, 22 bp, Artificial Sequence
  chemically synthesized
actagcatttttcttaacatct

SEQ ID NO: 787539 - DNA, 22 bp, Artificial Sequence
  chemically synthesized
ctagcatttttcttaacatctg

SEQ ID NO: 787540 - DNA, 22 bp, Artificial Sequence
  chemically synthesized
tgaacattgaaccagatgttaa

SEQ ID NO: 787541 - DNA, 22 bp, Artificial Sequence
  chemically synthesized
gcatttttcttaacatctggtt

SEQ ID NO: 787542 - DNA, 22 bp, Artificial Sequence
  chemically synthesized
ctgtgaacattgaaccagatgt

SEQ ID NO: 787543 - DNA, 22 bp, Artificial Sequence
  chemically synthesized
atctgctgtgaacattgaacca

SEQ ID NO: 787544 - DNA, 22 bp, Artificial Sequence
  chemically synthesized
ttcttaacatctggttcaatgt

SEQ ID NO: 787545 - DNA, 22 bp, Artificial Sequence
  chemically synthesized
tcttaacatctggttcaatgtt

SEQ ID NO: 787546 - DNA, 22 bp, Artificial Sequence
  chemically synthesized
cttaacatctggttcaatgttc

SEQ ID NO: 787547 - DNA, 22 bp, Artificial Sequence
  chemically synthesized
ttaacatctggttcaatgttca

SEQ ID NO: 787548 - DNA, 22 bp, Artificial Sequence
  chemically synthesized
aacatctggttcaatgttcaca

SEQ ID NO: 787549 - DNA, 22 bp, Artificial Sequence
  chemically synthesized
acatctggttcaatgttcacag

SEQ ID NO: 787550 - DNA, 22 bp, Artificial Sequence
  chemically synthesized
aaagctgatctgctgtgaacat

SEQ ID NO: 787551 - DNA, 22 bp, Artificial Sequence
  chemically synthesized
gaaagctgatctgctgtgaaca

SEQ ID NO: 787552 - DNA, 22 bp, Artificial Sequence
  chemically synthesized
gttcaatgttcacagcagatca

SEQ ID NO: 787553 - DNA, 22 bp, Artificial Sequence
  chemically synthesized
aatgttcacagcagatcagctt

SEQ ID NO: 787554 - DNA, 22 bp, Artificial Sequence
  chemically synthesized
aaaaaaagtatttgaaagctga

SEQ ID NO: 787555 - DNA, 22 bp, Artificial Sequence
  chemically synthesized
aaaaaaaagtatttgaaagctg

SEQ ID NO: 787556 - DNA, 22 bp, Artificial Sequence
  chemically synthesized
taaaaaaaagtatttgaaagct

SEQ ID NO: 787557 - DNA, 22 bp, Artificial Sequence
  chemically synthesized
acagcagatcagctttcaaata

SEQ ID NO: 787558 - DNA, 22 bp, Artificial Sequence
  chemically synthesized
ggttttaaaaaaaagtatttga

SEQ ID NO: 787559 - DNA, 22 bp, Artificial Sequence
  chemically synthesized
tgggttttaaaaaaaagtattt

SEQ ID NO: 787560 - DNA, 22 bp, Artificial Sequence
  chemically synthesized
ctgggttttaaaaaaaagtatt

SEQ ID NO: 787561 - DNA, 22 bp, Artificial Sequence
  chemically synthesized
atttctgggttttaaaaaaaag

SEQ ID NO: 787562 - DNA, 22 bp, Artificial Sequence
  chemically synthesized
actaatttctgggttttaaaaa

SEQ ID NO: 787563 - DNA, 22 bp, Artificial Sequence
  chemically synthesized
tcaaatacttttttttaaaacc

SEQ ID NO: 787564 - DNA, 22 bp, Artificial Sequence
  chemically synthesized
caaatacttttttttaaaaccc

SEQ ID NO: 787565 - DNA, 22 bp, Artificial Sequence
  chemically synthesized
aaatacttttttttaaaaccca

SEQ ID NO: 787566 - DNA, 22 bp, Artificial Sequence
  chemically synthesized
ttttttaaaacccagaaattag

SEQ ID NO: 787567 - DNA, 22 bp, Artificial Sequence
  chemically synthesized
tttttaaaacccagaaattagt

SEQ ID NO: 787568 - DNA, 22 bp, Artificial Sequence
  chemically synthesized
ttttaaaacccagaaattagtc

SEQ ID NO: 787569 - DNA, 22 bp, Artificial Sequence
  chemically synthesized
tttaaaacccagaaattagtca

SEQ ID NO: 787570 - DNA, 22 bp, Artificial Sequence
  chemically synthesized
taaatgtaaaattgactaattt

SEQ ID NO: 787571 - DNA, 22 bp, Artificial Sequence
  chemically synthesized
ttaaaacccagaaattagtcaa

SEQ ID NO: 787572 - DNA, 22 bp, Artificial Sequence
  chemically synthesized
taaaacccagaaattagtcaat

SEQ ID NO: 787573 - DNA, 22 bp, Artificial Sequence
  chemically synthesized
aaaacccagaaattagtcaatt

SEQ ID NO: 787574 - DNA, 22 bp, Artificial Sequence
  chemically synthesized
aaacccagaaattagtcaattt

SEQ ID NO: 787575 - DNA, 22 bp, Artificial Sequence
  chemically synthesized
taattgtaaatgtaaaattgac

SEQ ID NO: 787576 - DNA, 22 bp, Artificial Sequence
  chemically synthesized
aaggacctataattgtaaatgt

SEQ ID NO: 787577 - DNA, 22 bp, Artificial Sequence
  chemically synthesized
gtcaattttacatttacaatta

SEQ ID NO: 787578 - DNA, 22 bp, Artificial Sequence
  chemically synthesized
gaatatcctaaaggacctataa

SEQ ID NO: 787579 - DNA, 22 bp, Artificial Sequence
  chemically synthesized
tacatttacaattataggtcct

SEQ ID NO: 787580 - DNA, 22 bp, Artificial Sequence
  chemically synthesized
acatttacaattataggtcctt

SEQ ID NO: 787581 - DNA, 22 bp, Artificial Sequence
  chemically synthesized
catttacaattataggtccttt

SEQ ID NO: 787582 - DNA, 22 bp, Artificial Sequence
  chemically synthesized
ttagaatatcctaaaggaccta

SEQ ID NO: 787583 - DNA, 22 bp, Artificial Sequence
  chemically synthesized
gttagaatatcctaaaggacct

SEQ ID NO: 787584 - DNA, 22 bp, Artificial Sequence
  chemically synthesized
cttgttagaatatcctaaagga

SEQ ID NO: 787585 - DNA, 22 bp, Artificial Sequence
  chemically synthesized
acaattataggtcctttaggat

SEQ ID NO: 787586 - DNA, 22 bp, Artificial Sequence
  chemically synthesized
acttgttagaatatcctaaagg

SEQ ID NO: 787587 - DNA, 22 bp, Artificial Sequence
  chemically synthesized
caattataggtcctttaggata

SEQ ID NO: 787588 - DNA, 22 bp, Artificial Sequence
  chemically synthesized
tacttgttagaatatcctaaag

SEQ ID NO: 787589 - DNA, 22 bp, Artificial Sequence
  chemically synthesized
ttacttgttagaatatcctaaa

SEQ ID NO: 787590 - DNA, 22 bp, Artificial Sequence
  chemically synthesized
taggtcctttaggatattctaa

SEQ ID NO: 787591 - DNA, 22 bp, Artificial Sequence
  chemically synthesized
ggatttttacttgttagaatat

SEQ ID NO: 787592 - DNA, 22 bp, Artificial Sequence
  chemically synthesized
aggatttttacttgttagaata

SEQ ID NO: 787593 - DNA, 22 bp, Artificial Sequence
  chemically synthesized
taggatttttacttgttagaat

SEQ ID NO: 787594 - DNA, 22 bp, Artificial Sequence
  chemically synthesized
cctttaggatttttacttgtta

SEQ ID NO: 787595 - DNA, 22 bp, Artificial Sequence
  chemically synthesized
gcctttaggatttttacttgtt

SEQ ID NO: 787596 - DNA, 22 bp, Artificial Sequence
  chemically synthesized
taggatattctaacaagtaaaa

SEQ ID NO: 787597 - DNA, 22 bp, Artificial Sequence
  chemically synthesized
tgcctttaggatttttacttgt

SEQ ID NO: 787598 - DNA, 22 bp, Artificial Sequence
  chemically synthesized
aggatattctaacaagtaaaaa

SEQ ID NO: 787599 - DNA, 22 bp, Artificial Sequence
  chemically synthesized
ggatattctaacaagtaaaaat

SEQ ID NO: 787600 - DNA, 22 bp, Artificial Sequence
  chemically synthesized
taacaagtaaaaatcctaaagg

SEQ ID NO: 787601 - DNA, 22 bp, Artificial Sequence
  chemically synthesized
acaagtaaaaatcctaaaggca

SEQ ID NO: 787602 - DNA, 22 bp, Artificial Sequence
  chemically synthesized
aaaacatacattttgcctttag

SEQ ID NO: 787603 - DNA, 22 bp, Artificial Sequence
  chemically synthesized
gaaaacatacattttgccttta

SEQ ID NO: 787604 - DNA, 22 bp, Artificial Sequence
  chemically synthesized
cttgaaaacatacattttgcct

SEQ ID NO: 787605 - DNA, 22 bp, Artificial Sequence
  chemically synthesized
acttgaaaacatacattttgcc

SEQ ID NO: 787606 - DNA, 22 bp, Artificial Sequence
  chemically synthesized
tacttgaaaacatacattttgc

SEQ ID NO: 787607 - DNA, 22 bp, Artificial Sequence
  chemically synthesized
ttacttgaaaacatacattttg

SEQ ID NO: 787608 - DNA, 22 bp, Artificial Sequence
  chemically synthesized
aaggcaaaatgtatgttttcaa

SEQ ID NO: 787609 - DNA, 22 bp, Artificial Sequence
  chemically synthesized
atatatttttacttgaaaacat

SEQ ID NO: 787610 - DNA, 22 bp, Artificial Sequence
  chemically synthesized
tcaagtaaaaatatatgaggtt

SEQ ID NO: 787611 - DNA, 22 bp, Artificial Sequence
  chemically synthesized
tcaaaaaaaaacaacctcatat

SEQ ID NO: 787612 - DNA, 22 bp, Artificial Sequence
  chemically synthesized
caagtaaaaatatatgaggttg

SEQ ID NO: 787613 - DNA, 22 bp, Artificial Sequence
  chemically synthesized
aagtaaaaatatatgaggttgt

SEQ ID NO: 787614 - DNA, 22 bp, Artificial Sequence
  chemically synthesized
tgtcaaaaaaaaacaacctcat

SEQ ID NO: 787615 - DNA, 22 bp, Artificial Sequence
  chemically synthesized
ggtgacagagtgagactctgtc

SEQ ID NO: 787616 - DNA, 22 bp, Artificial Sequence
  chemically synthesized
tttttttttgacagagtctcac

SEQ ID NO: 787617 - DNA, 22 bp, Artificial Sequence
  chemically synthesized
ttttttgacagagtctcactct

SEQ ID NO: 787618 - DNA, 22 bp, Artificial Sequence
  chemically synthesized
tttttgacagagtctcactctg

SEQ ID NO: 787619 - DNA, 22 bp, Artificial Sequence
  chemically synthesized
cagcctgggtgacagagtgaga

SEQ ID NO: 787620 - DNA, 22 bp, Artificial Sequence
  chemically synthesized
ttttgacagagtctcactctgt

SEQ ID NO: 787621 - DNA, 22 bp, Artificial Sequence
  chemically synthesized
tttgacagagtctcactctgtc

SEQ ID NO: 787622 - DNA, 22 bp, Artificial Sequence
  chemically synthesized
ttgacagagtctcactctgtca

SEQ ID NO: 787623 - DNA, 22 bp, Artificial Sequence
  chemically synthesized
tgacagagtctcactctgtcac

SEQ ID NO: 787624 - DNA, 22 bp, Artificial Sequence
  chemically synthesized
gacagagtctcactctgtcacc

SEQ ID NO: 787625 - DNA, 22 bp, Artificial Sequence
  chemically synthesized
cactccagcctgggtgacagag

SEQ ID NO: 787626 - DNA, 22 bp, Artificial Sequence
  chemically synthesized
acagagtctcactctgtcaccc

SEQ ID NO: 787627 - DNA, 22 bp, Artificial Sequence
  chemically synthesized
caccactgcactccagcctggg

SEQ ID NO: 787628 - DNA, 22 bp, Artificial Sequence
  chemically synthesized
actctgtcacccaggctggagt

SEQ ID NO: 787629 - DNA, 22 bp, Artificial Sequence
  chemically synthesized
tgtcacccaggctggagtgcag

SEQ ID NO: 787630 - DNA, 22 bp, Artificial Sequence
  chemically synthesized
tcacccaggctggagtgcagtg

SEQ ID NO: 787631 - DNA, 22 bp, Artificial Sequence
  chemically synthesized
cagtgagccaagattgcaccac

SEQ ID NO: 787632 - DNA, 22 bp, Artificial Sequence
  chemically synthesized
gcagtgagccaagattgcacca

SEQ ID NO: 787633 - DNA, 22 bp, Artificial Sequence
  chemically synthesized
gagtgcagtggtgcaatcttgg

SEQ ID NO: 787634 - DNA, 22 bp, Artificial Sequence
  chemically synthesized
aggaggcagagcttgcagtgag

SEQ ID NO: 787635 - DNA, 22 bp, Artificial Sequence
  chemically synthesized
ctcaggaggcagagcttgcagt

SEQ ID NO: 787636 - DNA, 22 bp, Artificial Sequence
  chemically synthesized
ggctcactgcaagctctgcctc

SEQ ID NO: 787637 - DNA, 22 bp, Artificial Sequence
  chemically synthesized
gctcactgcaagctctgcctcc

SEQ ID NO: 787638 - DNA, 22 bp, Artificial Sequence
  chemically synthesized
tagtcccactactcaggaggca

SEQ ID NO: 787639 - DNA, 22 bp, Artificial Sequence
  chemically synthesized
actgcaagctctgcctcctgag

SEQ ID NO: 787640 - DNA, 22 bp, Artificial Sequence
  chemically synthesized
caagctctgcctcctgagtagt

SEQ ID NO: 787641 - DNA, 22 bp, Artificial Sequence
  chemically synthesized
tgcctcctgagtagtgggacta

SEQ ID NO: 787642 - DNA, 22 bp, Artificial Sequence
  chemically synthesized
cctcctgagtagtgggactaca

SEQ ID NO: 787643 - DNA, 22 bp, Artificial Sequence
  chemically synthesized
ctgagtagtgggactacaggcg

SEQ ID NO: 787644 - DNA, 22 bp, Artificial Sequence
  chemically synthesized
agtagtgggactacaggcgccc

SEQ ID NO: 787645 - DNA, 22 bp, Artificial Sequence
  chemically synthesized
gccgggcgtggtggtgggcgcc

SEQ ID NO: 787646 - DNA, 22 bp, Artificial Sequence
  chemically synthesized
caggcgcccaccaccacgcccg

SEQ ID NO: 787647 - DNA, 22 bp, Artificial Sequence
  chemically synthesized
aaaacacaaaaaattagccggg

SEQ ID NO: 787648 - DNA, 22 bp, Artificial Sequence
  chemically synthesized
ctaaaaacacaaaaaattagcc

SEQ ID NO: 787649 - DNA, 22 bp, Artificial Sequence
  chemically synthesized
tactaaaaacacaaaaaattag

SEQ ID NO: 787650 - DNA, 22 bp, Artificial Sequence
  chemically synthesized
tctctactaaaaacacaaaaaa

SEQ ID NO: 787651 - DNA, 22 bp, Artificial Sequence
  chemically synthesized
attttttgtgtttttagtagag

SEQ ID NO: 787652 - DNA, 22 bp, Artificial Sequence
  chemically synthesized
tttgtgtttttagtagagacag

SEQ ID NO: 787653 - DNA, 22 bp, Artificial Sequence
  chemically synthesized
ttgtgtttttagtagagacagg

SEQ ID NO: 787654 - DNA, 22 bp, Artificial Sequence
  chemically synthesized
acacggtgaaaccctgtctcta

SEQ ID NO: 787655 - DNA, 22 bp, Artificial Sequence
  chemically synthesized
tgtgtttttagtagagacaggg

SEQ ID NO: 787656 - DNA, 22 bp, Artificial Sequence
  chemically synthesized
gtgtttttagtagagacagggt

SEQ ID NO: 787657 - DNA, 22 bp, Artificial Sequence
  chemically synthesized
tgtttttagtagagacagggtt

SEQ ID NO: 787658 - DNA, 22 bp, Artificial Sequence
  chemically synthesized
gctaacacggtgaaaccctgtc

SEQ ID NO: 787659 - DNA, 22 bp, Artificial Sequence
  chemically synthesized
ttagtagagacagggtttcacc

SEQ ID NO: 787660 - DNA, 22 bp, Artificial Sequence
  chemically synthesized
tagtagagacagggtttcaccg

SEQ ID NO: 787661 - DNA, 22 bp, Artificial Sequence
  chemically synthesized
agtagagacagggtttcaccgt

SEQ ID NO: 787662 - DNA, 22 bp, Artificial Sequence
  chemically synthesized
gtagagacagggtttcaccgtg

SEQ ID NO: 787663 - DNA, 22 bp, Artificial Sequence
  chemically synthesized
caccgtgttagccaggatggtg

SEQ ID NO: 787664 - DNA, 22 bp, Artificial Sequence
  chemically synthesized
accgtgttagccaggatggtgt

SEQ ID NO: 787665 - DNA, 22 bp, Artificial Sequence
  chemically synthesized
gccaggatggtgtcgatctcct

SEQ ID NO: 787666 - DNA, 22 bp, Artificial Sequence
  chemically synthesized
ggaggccgaggcgggcggatca

SEQ ID NO: 787667 - DNA, 22 bp, Artificial Sequence
  chemically synthesized
gggaggccgaggcgggcggatc

SEQ ID NO: 787668 - DNA, 22 bp, Artificial Sequence
  chemically synthesized
tgggaggccgaggcgggcggat

SEQ ID NO: 787669 - DNA, 22 bp, Artificial Sequence
  chemically synthesized
ctgacctcgtgatccgcccgcc

SEQ ID NO: 787670 - DNA, 22 bp, Artificial Sequence
  chemically synthesized
acctcgtgatccgcccgcctcg

SEQ ID NO: 787671 - DNA, 22 bp, Artificial Sequence
  chemically synthesized
gtgatccgcccgcctcggcctc

SEQ ID NO: 787672 - DNA, 22 bp, Artificial Sequence
  chemically synthesized
taatcccagcactttgggaggc

SEQ ID NO: 787673 - DNA, 22 bp, Artificial Sequence
  chemically synthesized
acgcctgtaatcccagcacttt

SEQ ID NO: 787674 - DNA, 22 bp, Artificial Sequence
  chemically synthesized
ggcctcccaaagtgctgggatt

SEQ ID NO: 787675 - DNA, 22 bp, Artificial Sequence
  chemically synthesized
ccaaagtgctgggattacaggc

SEQ ID NO: 787676 - DNA, 22 bp, Artificial Sequence
  chemically synthesized
ggattacaggcgtgagccaccg

SEQ ID NO: 787677 - DNA, 22 bp, Artificial Sequence
  chemically synthesized
atcggccgggcgcggtggctca

SEQ ID NO: 787678 - DNA, 22 bp, Artificial Sequence
  chemically synthesized
caggcgtgagccaccgcgcccg

SEQ ID NO: 787679 - DNA, 22 bp, Artificial Sequence
  chemically synthesized
tatataataactcatcggccgg

SEQ ID NO: 787680 - DNA, 22 bp, Artificial Sequence
  chemically synthesized
ttatatatagtgcttcatatta

SEQ ID NO: 787681 - DNA, 22 bp, Artificial Sequence
  chemically synthesized
tatatagtgcttcatattatcc

SEQ ID NO: 787682 - DNA, 22 bp, Artificial Sequence
  chemically synthesized
gcataggaacagtgatggataa

SEQ ID NO: 787683 - DNA, 22 bp, Artificial Sequence
  chemically synthesized
tagcataggaacagtgatggat

SEQ ID NO: 787684 - DNA, 22 bp, Artificial Sequence
  chemically synthesized
ctagcataggaacagtgatgga

SEQ ID NO: 787685 - DNA, 22 bp, Artificial Sequence
  chemically synthesized
catattatccatcactgttcct

SEQ ID NO: 787686 - DNA, 22 bp, Artificial Sequence
  chemically synthesized
atattatccatcactgttccta

SEQ ID NO: 787687 - DNA, 22 bp, Artificial Sequence
  chemically synthesized
tgagtgacttctagcataggaa

SEQ ID NO: 787688 - DNA, 22 bp, Artificial Sequence
  chemically synthesized
gtgagtgacttctagcatagga

SEQ ID NO: 787689 - DNA, 22 bp, Artificial Sequence
  chemically synthesized
tccatcactgttcctatgctag

SEQ ID NO: 787690 - DNA, 22 bp, Artificial Sequence
  chemically synthesized
tgtgagtgacttctagcatagg

SEQ ID NO: 787691 - DNA, 22 bp, Artificial Sequence
  chemically synthesized
ttgtgagtgacttctagcatag

SEQ ID NO: 787692 - DNA, 22 bp, Artificial Sequence
  chemically synthesized
gcttttgtgagtgacttctagc

SEQ ID NO: 787693 - DNA, 22 bp, Artificial Sequence
  chemically synthesized
agcttttgtgagtgacttctag

SEQ ID NO: 787694 - DNA, 22 bp, Artificial Sequence
  chemically synthesized
tagcttttgtgagtgacttcta

SEQ ID NO: 787695 - DNA, 22 bp, Artificial Sequence
  chemically synthesized
tttagcttttgtgagtgacttc

SEQ ID NO: 787696 - DNA, 22 bp, Artificial Sequence
  chemically synthesized
ttcctatgctagaagtcactca

SEQ ID NO: 787697 - DNA, 22 bp, Artificial Sequence
  chemically synthesized
ctatgctagaagtcactcacaa

SEQ ID NO: 787698 - DNA, 22 bp, Artificial Sequence
  chemically synthesized
tgctagaagtcactcacaaaag

SEQ ID NO: 787699 - DNA, 22 bp, Artificial Sequence
  chemically synthesized
tgccaactctttagcttttgtg

SEQ ID NO: 787700 - DNA, 22 bp, Artificial Sequence
  chemically synthesized
gaagtcactcacaaaagctaaa

SEQ ID NO: 787701 - DNA, 22 bp, Artificial Sequence
  chemically synthesized
aatagctatgccaactctttag

SEQ ID NO: 787702 - DNA, 22 bp, Artificial Sequence
  chemically synthesized
ctaaatagctatgccaactctt

SEQ ID NO: 787703 - DNA, 22 bp, Artificial Sequence
  chemically synthesized
gctaaatagctatgccaactct

SEQ ID NO: 787704 - DNA, 22 bp, Artificial Sequence
  chemically synthesized
acaaaagctaaagagttggcat

SEQ ID NO: 787705 - DNA, 22 bp, Artificial Sequence
  chemically synthesized
tatttgctaaatagctatgcca

SEQ ID NO: 787706 - DNA, 22 bp, Artificial Sequence
  chemically synthesized
atatttgctaaatagctatgcc

SEQ ID NO: 787707 - DNA, 22 bp, Artificial Sequence
  chemically synthesized
tttatatttgctaaatagctat

SEQ ID NO: 787708 - DNA, 22 bp, Artificial Sequence
  chemically synthesized
gtttatatttgctaaatagcta

SEQ ID NO: 787709 - DNA, 22 bp, Artificial Sequence
  chemically synthesized
aagagttggcatagctatttag

SEQ ID NO: 787710 - DNA, 22 bp, Artificial Sequence
  chemically synthesized
gcatagctatttagcaaatata

SEQ ID NO: 787711 - DNA, 22 bp, Artificial Sequence
  chemically synthesized
ggaagcagatatttgtttatat

SEQ ID NO: 787712 - DNA, 22 bp, Artificial Sequence
  chemically synthesized
aggaagcagatatttgtttata

SEQ ID NO: 787713 - DNA, 22 bp, Artificial Sequence
  chemically synthesized
tttagcaaatataaacaaatat

SEQ ID NO: 787714 - DNA, 22 bp, Artificial Sequence
  chemically synthesized
agcaaatataaacaaatatctg

SEQ ID NO: 787715 - DNA, 22 bp, Artificial Sequence
  chemically synthesized
gcaaatataaacaaatatctgc

SEQ ID NO: 787716 - DNA, 22 bp, Artificial Sequence
  chemically synthesized
aaatatttaggaagcagatatt

SEQ ID NO: 787717 - DNA, 22 bp, Artificial Sequence
  chemically synthesized
aaaatatttaggaagcagatat

SEQ ID NO: 787718 - DNA, 22 bp, Artificial Sequence
  chemically synthesized
taaaatatttaggaagcagata

SEQ ID NO: 787719 - DNA, 22 bp, Artificial Sequence
  chemically synthesized
accctttaaaatatttaggaag

SEQ ID NO: 787720 - DNA, 22 bp, Artificial Sequence
  chemically synthesized
ataatgactaaccctttaaaat

SEQ ID NO: 787721 - DNA, 22 bp, Artificial Sequence
  chemically synthesized
cttcctaaatattttaaagggt

SEQ ID NO: 787722 - DNA, 22 bp, Artificial Sequence
  chemically synthesized
cctaaatattttaaagggttag

SEQ ID NO: 787723 - DNA, 22 bp, Artificial Sequence
  chemically synthesized
ctaaatattttaaagggttagt

SEQ ID NO: 787724 - DNA, 22 bp, Artificial Sequence
  chemically synthesized
aatattttaaagggttagtcat

SEQ ID NO: 787725 - DNA, 22 bp, Artificial Sequence
  chemically synthesized
taaaaattaataatgactaacc

SEQ ID NO: 787726 - DNA, 22 bp, Artificial Sequence
  chemically synthesized
gtaaaaattaataatgactaac

SEQ ID NO: 787727 - DNA, 22 bp, Artificial Sequence
  chemically synthesized
tgtaaaaattaataatgactaa
